United States Patent 7,901,882 (ANALYSIS OF METHYLATION USING NUCLEIC ACID ARRAYS) - sequence listing, part 4

SEQ ID NO: 117784 - DNA, 25 bp, Homo sapien
tccagggccttgtcgcgctctcagt

SEQ ID NO: 117785 - DNA, 25 bp, Homo sapien
caccttccagcacaaggagctgatg

SEQ ID NO: 117786 - DNA, 25 bp, Homo sapien
caatcggattcccaggccgaacgga

SEQ ID NO: 117787 - DNA, 25 bp, Homo sapien
tttccgcgggaatcgataaccaatc

SEQ ID NO: 117788 - DNA, 25 bp, Homo sapien
aagttatcgccataggccggccagg

SEQ ID NO: 117789 - DNA, 25 bp, Homo sapien
acgcccgtctccgtgaagttatcgc

SEQ ID NO: 117790 - DNA, 25 bp, Homo sapien
aaagcagccgtgtccgcgcttcctg

SEQ ID NO: 117791 - DNA, 25 bp, Homo sapien
gcacctctctcagccgggcgttgat

SEQ ID NO: 117792 - DNA, 25 bp, Homo sapien
ccgggcgttgatggccactgcctga

SEQ ID NO: 117793 - DNA, 25 bp, Homo sapien
tctcgacgccgcatggtggccctga

SEQ ID NO: 117794 - DNA, 25 bp, Homo sapien
agcgactcttctcgacgccgcatgg

SEQ ID NO: 117795 - DNA, 25 bp, Homo sapien
tttgcctctcgagtcagttcgccca

SEQ ID NO: 117796 - DNA, 25 bp, Homo sapien
gggcatttgcctctcgagtcagttc

SEQ ID NO: 117797 - DNA, 25 bp, Homo sapien
agccagggcatttgcctctcgagtc

SEQ ID NO: 117798 - DNA, 25 bp, Homo sapien
cctcccagccggtctgcacctctct

SEQ ID NO: 117799 - DNA, 25 bp, Homo sapien
cgagtccttcgcctttgtggatgag

SEQ ID NO: 117800 - DNA, 25 bp, Homo sapien
tgtcggagctgccttacgacgggaa

SEQ ID NO: 117801 - DNA, 25 bp, Homo sapien
agggcgtgggtttccctcagattca

SEQ ID NO: 117802 - DNA, 25 bp, Homo sapien
ttcaatgatcctgctgggctcggtg

SEQ ID NO: 117803 - DNA, 25 bp, Homo sapien
gcgccacctgtgtcctgagcgcagg

SEQ ID NO: 117804 - DNA, 25 bp, Homo sapien
cagcccaagagatggcgcggaagtt

SEQ ID NO: 117805 - DNA, 25 bp, Homo sapien
ctctctggcaagagcgaggtgaccg

SEQ ID NO: 117806 - DNA, 25 bp, Homo sapien
ctgttccttctcaggagtgcggagc

SEQ ID NO: 117807 - DNA, 25 bp, Homo sapien
atgtaacgttgctcctgtggcacgg

SEQ ID NO: 117808 - DNA, 25 bp, Homo sapien
accttcgtagcagtcccgcacagag

SEQ ID NO: 117809 - DNA, 25 bp, Homo sapien
agcagtcccgcacagagtcgaagta

SEQ ID NO: 117810 - DNA, 25 bp, Homo sapien
cccgcacagagtcgaagtagacgta

SEQ ID NO: 117811 - DNA, 25 bp, Homo sapien
cgaagtagacgtagtactggtggtc

SEQ ID NO: 117812 - DNA, 25 bp, Homo sapien
acgtagtactggtggtctccgagga

SEQ ID NO: 117813 - DNA, 25 bp, Homo sapien
taggagcgcaggtgcagatagatct

SEQ ID NO: 117814 - DNA, 25 bp, Homo sapien
caggcggatgatgtaacgttgctcc

SEQ ID NO: 117815 - DNA, 25 bp, Homo sapien
agagatggggcaaagcacccgagcc

SEQ ID NO: 117816 - DNA, 25 bp, Homo sapien
gcaaagcacccgagccagatggagg

SEQ ID NO: 117817 - DNA, 25 bp, Homo sapien
acgacagtaaaaggcaacggagagg

SEQ ID NO: 117818 - DNA, 25 bp, Homo sapien
gaggcaggaacgacagtaaaaggca

SEQ ID NO: 117819 - DNA, 25 bp, Homo sapien
cacgtgaacaaagcgaatcggagga

SEQ ID NO: 117820 - DNA, 25 bp, Homo sapien
cccagagggaaaacgcacgtgaaca

SEQ ID NO: 117821 - DNA, 25 bp, Homo sapien
ctccgggcgtggaacccgggctcat

SEQ ID NO: 117822 - DNA, 25 bp, Homo sapien
cgggagccgatgcagcccatggctc

SEQ ID NO: 117823 - DNA, 25 bp, Homo sapien
cccgcagaagaagttcggccctgtg

SEQ ID NO: 117824 - DNA, 25 bp, Homo sapien
caggtcaggaaatgacatcagaggc

SEQ ID NO: 117825 - DNA, 25 bp, Homo sapien
catcagaggcctgtgctcagggagt

SEQ ID NO: 117826 - DNA, 25 bp, Homo sapien
ctccggaccgggacgcagagtctgc

SEQ ID NO: 117827 - DNA, 25 bp, Homo sapien
accgggacgcagagtctgcggaccc

SEQ ID NO: 117828 - DNA, 25 bp, Homo sapien
cgcgctgcgtaacccggcgacccac

SEQ ID NO: 117829 - DNA, 25 bp, Homo sapien
tggagcccagctccatacgttcggc

SEQ ID NO: 117830 - DNA, 25 bp, Homo sapien
gtctcccgcgatctccgtttcggtc

SEQ ID NO: 117831 - DNA, 25 bp, Homo sapien
gcagcgccgtgatgtcgcagaagaa

SEQ ID NO: 117832 - DNA, 25 bp, Homo sapien
ccctgggccgcacgtacatgaaggt

SEQ ID NO: 117833 - DNA, 25 bp, Homo sapien
cacgtacatgaaggtggcgcagccg

SEQ ID NO: 117834 - DNA, 25 bp, Homo sapien
cagaggcagctcgtcggcgtagctc

SEQ ID NO: 117835 - DNA, 25 bp, Homo sapien
tcgcagaagaagtgcagcagcaggc

SEQ ID NO: 117836 - DNA, 25 bp, Homo sapien
atctgcatctgaaaggcgcagctca

SEQ ID NO: 117837 - DNA, 25 bp, Homo sapien
ggcctgccatcagagctcgcgcaga

SEQ ID NO: 117838 - DNA, 25 bp, Homo sapien
cctgaggcagcaggccagagccagt

SEQ ID NO: 117839 - DNA, 25 bp, Homo sapien
ccgtggcatacgttgttgttaggga

SEQ ID NO: 117840 - DNA, 25 bp, Homo sapien
ccaggaccggccagcctacgagaga

SEQ ID NO: 117841 - DNA, 25 bp, Homo sapien
tccaccgatggaacgggagaccacg

SEQ ID NO: 117842 - DNA, 25 bp, Homo sapien
tgcaggccaaagcatccctccggga

SEQ ID NO: 117843 - DNA, 25 bp, Homo sapien
tccaagaacccgcagagaccctgag

SEQ ID NO: 117844 - DNA, 25 bp, Homo sapien
tgcgacagcaaactggctgggtccc

SEQ ID NO: 117845 - DNA, 25 bp, Homo sapien
gcttttcttatcaagtgcgacagca

SEQ ID NO: 117846 - DNA, 25 bp, Homo sapien
tccacgcagaggctcgagcgacgga

SEQ ID NO: 117847 - DNA, 25 bp, Homo sapien
ccttcccggagggatgctttggcct

SEQ ID NO: 117848 - DNA, 25 bp, Homo sapien
tctctgcgggttcttggatgcgaga

SEQ ID NO: 117849 - DNA, 25 bp, Homo sapien
gggacccagccagtttgctgtcgca

SEQ ID NO: 117850 - DNA, 25 bp, Homo sapien
tggggcgaatagttccctaacaaca

SEQ ID NO: 117851 - DNA, 25 bp, Homo sapien
gtggtctcccgttccatcggtggac

SEQ ID NO: 117852 - DNA, 25 bp, Homo sapien
cctaacaacaacgtatgccacgggg

SEQ ID NO: 117853 - DNA, 25 bp, Homo sapien
cttccctccgatcttggggtgggct

SEQ ID NO: 117854 - DNA, 25 bp, Homo sapien
tgctgtcgcacttgataagaaaagc

SEQ ID NO: 117855 - DNA, 25 bp, Homo sapien
cacctcagcggactgcatcgggagc

SEQ ID NO: 117856 - DNA, 25 bp, Homo sapien
ccgaaaccagctttggacgagactc

SEQ ID NO: 117857 - DNA, 25 bp, Homo sapien
gagactcaccctttcgtccagcaat

SEQ ID NO: 117858 - DNA, 25 bp, Homo sapien
gtccagcaatttccacaccaggcta

SEQ ID NO: 117859 - DNA, 25 bp, Homo sapien
acaccaggctactttggagtgggga

SEQ ID NO: 117860 - DNA, 25 bp, Homo sapien
agtggggagtcttccacagagatgt

SEQ ID NO: 117861 - DNA, 25 bp, Homo sapien
cagacgccttgggaatttgcaaatt

SEQ ID NO: 117862 - DNA, 25 bp, Homo sapien
ggcccggctttgtgtcagtttctac

SEQ ID NO: 117863 - DNA, 25 bp, Homo sapien
ccaaatcccggatgcaggcctaggc

SEQ ID NO: 117864 - DNA, 25 bp, Homo sapien
tcatcaacggggtagagacgaagga

SEQ ID NO: 117865 - DNA, 25 bp, Homo sapien
caccgagctgcagagaaaaatcatc

SEQ ID NO: 117866 - DNA, 25 bp, Homo sapien
ccttccagggagctgattggtcgac

SEQ ID NO: 117867 - DNA, 25 bp, Homo sapien
cgggctcgaaactacaggacttgga

SEQ ID NO: 117868 - DNA, 25 bp, Homo sapien
ttcggggcagtagcaacctgctagg

SEQ ID NO: 117869 - DNA, 25 bp, Homo sapien
tctcctggtccagagtctacgctga

SEQ ID NO: 117870 - DNA, 25 bp, Homo sapien
gatcctcggtggaacggctctatca

SEQ ID NO: 117871 - DNA, 25 bp, Homo sapien
aagctcccgcgtcagagctgggaag

SEQ ID NO: 117872 - DNA, 25 bp, Homo sapien
tcggtgtcacatgctgcttcggccc

SEQ ID NO: 117873 - DNA, 25 bp, Homo sapien
cccattggtgtgaaagaagctcccg

SEQ ID NO: 117874 - DNA, 25 bp, Homo sapien
tctcctaggaagtttcaggtgagga

SEQ ID NO: 117875 - DNA, 25 bp, Homo sapien
cggtgtcctcggacgcctccgaaat

SEQ ID NO: 117876 - DNA, 25 bp, Homo sapien
cctccgaaatctccctgcgtgtttg

SEQ ID NO: 117877 - DNA, 25 bp, Homo sapien
gcgtgtttgtttcttcggagcttca

SEQ ID NO: 117878 - DNA, 25 bp, Homo sapien
ccacctggtcggtgtcacatgctgc

SEQ ID NO: 117879 - DNA, 25 bp, Homo sapien
cgcccggggtagttgacctgcctcg

SEQ ID NO: 117880 - DNA, 25 bp, Homo sapien
cgaacgtgtccgtcagccctaactg

SEQ ID NO: 117881 - DNA, 25 bp, Homo sapien
agttgacctgcctcggggcgaacgc

SEQ ID NO: 117882 - DNA, 25 bp, Homo sapien
ccgcggaaggaggacaatagcctcc

SEQ ID NO: 117883 - DNA, 25 bp, Homo sapien
gcaccggtagttgccgcgcctgcag

SEQ ID NO: 117884 - DNA, 25 bp, Homo sapien
tacctgtgtggctggcacgggaccc

SEQ ID NO: 117885 - DNA, 25 bp, Homo sapien
taactgttccagactcttctcccgg

SEQ ID NO: 117886 - DNA, 25 bp, Homo sapien
gtccgtcagccctaactgttccaga

SEQ ID NO: 117887 - DNA, 25 bp, Homo sapien
atttcggaggcgtccgaggacaccg

SEQ ID NO: 117888 - DNA, 25 bp, Homo sapien
cttcccagctctgacgcgggagctt

SEQ ID NO: 117889 - DNA, 25 bp, Homo sapien
cgcgggagcttctttcacaccaatg

SEQ ID NO: 117890 - DNA, 25 bp, Homo sapien
agcagcatgtgacaccgaccaggtg

SEQ ID NO: 117891 - DNA, 25 bp, Homo sapien
tttcacaccaatggggctcgcgcgc

SEQ ID NO: 117892 - DNA, 25 bp, Homo sapien
aaacacgcagggagatttcggaggc

SEQ ID NO: 117893 - DNA, 25 bp, Homo sapien
tgaagctccgaagaaacaaacacgc

SEQ ID NO: 117894 - DNA, 25 bp, Homo sapien
tcctcacctgaaacttcctaggaga

SEQ ID NO: 117895 - DNA, 25 bp, Homo sapien
ggtacccgcgctcaccaagccggcg

SEQ ID NO: 117896 - DNA, 25 bp, Homo sapien
ggcgcttctggtcccggagacttgg

SEQ ID NO: 117897 - DNA, 25 bp, Homo sapien
tcccgggcttctgagcggctcgggt

SEQ ID NO: 117898 - DNA, 25 bp, Homo sapien
tgtcccccgtgtctgtgtccaggac

SEQ ID NO: 117899 - DNA, 25 bp, Homo sapien
cctaggaaccccctagcgctgggag

SEQ ID NO: 117900 - DNA, 25 bp, Homo sapien
ggccctgctcgaccacgggctttgg

SEQ ID NO: 117901 - DNA, 25 bp, Homo sapien
cctgctcgaccacgggctttgggct

SEQ ID NO: 117902 - DNA, 25 bp, Homo sapien
atcgtcgctggtaggagctctgtcc

SEQ ID NO: 117903 - DNA, 25 bp, Homo sapien
cggcagcagtcgcacttacacaatg

SEQ ID NO: 117904 - DNA, 25 bp, Homo sapien
cgcgcagaaccaacagcacgggagc

SEQ ID NO: 117905 - DNA, 25 bp, Homo sapien
ggtcctcgctcgcaggttttagccc

SEQ ID NO: 117906 - DNA, 25 bp, Homo sapien
atcaccatccgggaacctggggagc

SEQ ID NO: 117907 - DNA, 25 bp, Homo sapien
cacttacacaatggctggtaggagc

SEQ ID NO: 117908 - DNA, 25 bp, Homo sapien
ccacagactggagatcgcaggctgc

SEQ ID NO: 117909 - DNA, 25 bp, Homo sapien
gagctacggcgatcgaccgctcggc

SEQ ID NO: 117910 - DNA, 25 bp, Homo sapien
acgggagccgcctgaacctggcact

SEQ ID NO: 117911 - DNA, 25 bp, Homo sapien
gcagcgctcctgctgtggattgtca

SEQ ID NO: 117912 - DNA, 25 bp, Homo sapien
ggtcggctcagtctcccttttgctt

SEQ ID NO: 117913 - DNA, 25 bp, Homo sapien
accctacggagagtcggactgcatc

SEQ ID NO: 117914 - DNA, 25 bp, Homo sapien
ctcgcgtatttgaggacagcccatc

SEQ ID NO: 117915 - DNA, 25 bp, Homo sapien
ctggcacacagtgcaagaggcaata

SEQ ID NO: 117916 - DNA, 25 bp, Homo sapien
tgccttcttggtttgaatttcctcc

SEQ ID NO: 117917 - DNA, 25 bp, Homo sapien
ttttgctttcaaacgaggccagggc

SEQ ID NO: 117918 - DNA, 25 bp, Homo sapien
tgcatctccgcagcgagctcttgga

SEQ ID NO: 117919 - DNA, 25 bp, Homo sapien
ctcacctgcctttcagtggtgcggg

SEQ ID NO: 117920 - DNA, 25 bp, Homo sapien
tgccggccgacaaaggacggtcctc

SEQ ID NO: 117921 - DNA, 25 bp, Homo sapien
ggttctgaagtctgacccggccagt

SEQ ID NO: 117922 - DNA, 25 bp, Homo sapien
tgacccggccagtgggaaagccacc

SEQ ID NO: 117923 - DNA, 25 bp, Homo sapien
gaaagccacctgcatcacaaagcga

SEQ ID NO: 117924 - DNA, 25 bp, Homo sapien
caaagcgaggggcacacctgaaccg

SEQ ID NO: 117925 - DNA, 25 bp, Homo sapien
ctgcctcccggtgcaagtgttgcaa

SEQ ID NO: 117926 - DNA, 25 bp, Homo sapien
atcccgagagcggtggactcaaagc

SEQ ID NO: 117927 - DNA, 25 bp, Homo sapien
tacgcactgggaaaaagcacgattc

SEQ ID NO: 117928 - DNA, 25 bp, Homo sapien
agcacgattcatcgcgcctggaggc

SEQ ID NO: 117929 - DNA, 25 bp, Homo sapien
aggcctggactacgcactgggaaaa

SEQ ID NO: 117930 - DNA, 25 bp, Homo sapien
aaaccaggcgcctggcgaggcctga

SEQ ID NO: 117931 - DNA, 25 bp, Homo sapien
agcctttggggcaccacagagatgc

SEQ ID NO: 117932 - DNA, 25 bp, Homo sapien
agctgagggacgcagctagaccttg

SEQ ID NO: 117933 - DNA, 25 bp, Homo sapien
agccgggctctctcgctttccggtt

SEQ ID NO: 117934 - DNA, 25 bp, Homo sapien
agctctgggctcaagcgcaggagca

SEQ ID NO: 117935 - DNA, 25 bp, Homo sapien
tgcatgcctagcagcagcgctgttt

SEQ ID NO: 117936 - DNA, 25 bp, Homo sapien
cggatccgcgcctctggtttgcagt

SEQ ID NO: 117937 - DNA, 25 bp, Homo sapien
ttcccgtcctgcgatgaggccctgg

SEQ ID NO: 117938 - DNA, 25 bp, Homo sapien
gccttcccgttgcatttccatgttg

SEQ ID NO: 117939 - DNA, 25 bp, Homo sapien
ttcctttggccacaggagcctctgc

SEQ ID NO: 117940 - DNA, 25 bp, Homo sapien
ttagcacttagctccgtctcctttg

SEQ ID NO: 117941 - DNA, 25 bp, Homo sapien
tccatgttgttccttgttccgggga

SEQ ID NO: 117942 - DNA, 25 bp, Homo sapien
cgctgtttttctcattagcacttag

SEQ ID NO: 117943 - DNA, 25 bp, Homo sapien
gcccaatcgccatcgcttttatttg

SEQ ID NO: 117944 - DNA, 25 bp, Homo sapien
gttctttcgctgaacacacggcgcc

SEQ ID NO: 117945 - DNA, 25 bp, Homo sapien
acagtccgtcctttgtctgagtgcg

SEQ ID NO: 117946 - DNA, 25 bp, Homo sapien
gctgggtcccaccaacttgtgtctg

SEQ ID NO: 117947 - DNA, 25 bp, Homo sapien
gccgcgccacacaaaggagacttga

SEQ ID NO: 117948 - DNA, 25 bp, Homo sapien
agacttgaggctcgagctgccaccc

SEQ ID NO: 117949 - DNA, 25 bp, Homo sapien
cgaagctcacagctccttccgggga

SEQ ID NO: 117950 - DNA, 25 bp, Homo sapien
actgccttctgagtcccaccgggtg

SEQ ID NO: 117951 - DNA, 25 bp, Homo sapien
cggacaagacaagctgccgcgcttc

SEQ ID NO: 117952 - DNA, 25 bp, Homo sapien
ggcgaagctgtccacccagactaaa

SEQ ID NO: 117953 - DNA, 25 bp, Homo sapien
gggctctcagctccggcgaagctgt

SEQ ID NO: 117954 - DNA, 25 bp, Homo sapien
ttcagccacaggcacgcgagtgacg

SEQ ID NO: 117955 - DNA, 25 bp, Homo sapien
agccctgaaactgacacgaaacgga

SEQ ID NO: 117956 - DNA, 25 bp, Homo sapien
tcggcgtccgcaaagtccagacgct

SEQ ID NO: 117957 - DNA, 25 bp, Homo sapien
ctaaagcgcaattgcccggagcccg

SEQ ID NO: 117958 - DNA, 25 bp, Homo sapien
atttcctggatcattgacccgcggc

SEQ ID NO: 117959 - DNA, 25 bp, Homo sapien
cgccgccaccgtgggaaactatctt

SEQ ID NO: 117960 - DNA, 25 bp, Homo sapien
tacccttcgactgggcgttgccgct

SEQ ID NO: 117961 - DNA, 25 bp, Homo sapien
agcggaggacactttctgaggagac

SEQ ID NO: 117962 - DNA, 25 bp, Homo sapien
gctttgtgaggagaccgcgaagttt

SEQ ID NO: 117963 - DNA, 25 bp, Homo sapien
tctcccacggggaagcgaggaagta

SEQ ID NO: 117964 - DNA, 25 bp, Homo sapien
aaagctgcggcgtttgccgagcacc

SEQ ID NO: 117965 - DNA, 25 bp, Homo sapien
ttcgggaatcgaggcccgtctccca

SEQ ID NO: 117966 - DNA, 25 bp, Homo sapien
tccagcctacggctcagaaagctgc

SEQ ID NO: 117967 - DNA, 25 bp, Homo sapien
cctcggctgcgcgtttaaaactccg

SEQ ID NO: 117968 - DNA, 25 bp, Homo sapien
gctcagcatcctgcggccgaacttg

SEQ ID NO: 117969 - DNA, 25 bp, Homo sapien
atcagcggctgccactcggtttgcc

SEQ ID NO: 117970 - DNA, 25 bp, Homo sapien
gccgaacttggcagtaagaacacgt

SEQ ID NO: 117971 - DNA, 25 bp, Homo sapien
tcactagttctggagctgaccgcgc

SEQ ID NO: 117972 - DNA, 25 bp, Homo sapien
ctcggcgcccatcactagttctgga

SEQ ID NO: 117973 - DNA, 25 bp, Homo sapien
cccagctgcaaaaaaggcgctctgc

SEQ ID NO: 117974 - DNA, 25 bp, Homo sapien
taagaacacgtgtcggtaccggagc

SEQ ID NO: 117975 - DNA, 25 bp, Homo sapien
cccagggactagtcctgccgtagtc

SEQ ID NO: 117976 - DNA, 25 bp, Homo sapien
ctgcctttcctgtgcctggacacgg

SEQ ID NO: 117977 - DNA, 25 bp, Homo sapien
cccagagagggtctgacacccgaag

SEQ ID NO: 117978 - DNA, 25 bp, Homo sapien
tgctgagaacgctctgcctttcctg

SEQ ID NO: 117979 - DNA, 25 bp, Homo sapien
cagggcatgctgagaacgctctgcc

SEQ ID NO: 117980 - DNA, 25 bp, Homo sapien
ctaagctctggtctcgcggaggaaa

SEQ ID NO: 117981 - DNA, 25 bp, Homo sapien
agtcctgccgtagtctaagctctgg

SEQ ID NO: 117982 - DNA, 25 bp, Homo sapien
cctgtgcctggacacggctcgggct

SEQ ID NO: 117983 - DNA, 25 bp, Homo sapien
gtgctccgtgagtttacactgcttg

SEQ ID NO: 117984 - DNA, 25 bp, Homo sapien
ttttctccagtatgcgccctgcagg

SEQ ID NO: 117985 - DNA, 25 bp, Homo sapien
cacactctgggcactgaaagggctt

SEQ ID NO: 117986 - DNA, 25 bp, Homo sapien
ttggcacaccggaaaggcttctctc

SEQ ID NO: 117987 - DNA, 25 bp, Homo sapien
cgcttgtcgcacttcaggcactgga

SEQ ID NO: 117988 - DNA, 25 bp, Homo sapien
ttggattgtctggtgaagcccttgc

SEQ ID NO: 117989 - DNA, 25 bp, Homo sapien
gctctcagcatgctctccaggcgga

SEQ ID NO: 117990 - DNA, 25 bp, Homo sapien
cagctcgtgtcggaagcacatttca

SEQ ID NO: 117991 - DNA, 25 bp, Homo sapien
ttcggtgccttttgtccttgcttcc

SEQ ID NO: 117992 - DNA, 25 bp, Homo sapien
ttctcaccgccaggcgggcaggtca

SEQ ID NO: 117993 - DNA, 25 bp, Homo sapien
agaccaggcaggaccgagcccgtcg

SEQ ID NO: 117994 - DNA, 25 bp, Homo sapien
gtctgtgccatttcggtgccttttg

SEQ ID NO: 117995 - DNA, 25 bp, Homo sapien
ctccttgaggatgtttaccggctgc

SEQ ID NO: 117996 - DNA, 25 bp, Homo sapien
atgcacctccgcactgtggggccat

SEQ ID NO: 117997 - DNA, 25 bp, Homo sapien
tgtctgggtcccagtcttctcaccg

SEQ ID NO: 117998 - DNA, 25 bp, Homo sapien
ccggggctcttgttgtctgtgccat

SEQ ID NO: 117999 - DNA, 25 bp, Homo sapien
cttccttagcagagaacggccttgg

SEQ ID NO: 118000 - DNA, 25 bp, Homo sapien
caccaggtccggtcgccgtgggtct

SEQ ID NO: 118001 - DNA, 25 bp, Homo sapien
cccgagacaggcttcgtctgtgagg

SEQ ID NO: 118002 - DNA, 25 bp, Homo sapien
cgctgcctgagcgtcggtcctcaga

SEQ ID NO: 118003 - DNA, 25 bp, Homo sapien
aggaacctgccctgctgcgcactga

SEQ ID NO: 118004 - DNA, 25 bp, Homo sapien
ggcgtccaaacaggctagcccgctt

SEQ ID NO: 118005 - DNA, 25 bp, Homo sapien
cgtgggtctagagccctccgggctc

SEQ ID NO: 118006 - DNA, 25 bp, Homo sapien
aggctagcccgcttacccgaggcgg

SEQ ID NO: 118007 - DNA, 25 bp, Homo sapien
cgcgcatggcgttcctccagaagaa

SEQ ID NO: 118008 - DNA, 25 bp, Homo sapien
aaacggcttttcctcgctgtgcgtc

SEQ ID NO: 118009 - DNA, 25 bp, Homo sapien
tgctcgtccagcttaatcttgtaga

SEQ ID NO: 118010 - DNA, 25 bp, Homo sapien
ctcgggacacgaaaagggcttctct

SEQ ID NO: 118011 - DNA, 25 bp, Homo sapien
ctggtggaacttcatggaggccttc

SEQ ID NO: 118012 - DNA, 25 bp, Homo sapien
ccgcgactgctgagaaaaggtcttt

SEQ ID NO: 118013 - DNA, 25 bp, Homo sapien
aggtctttttgcactcgccgcaggg

SEQ ID NO: 118014 - DNA, 25 bp, Homo sapien
ccgtgtgaactctgatgtgctcgtc

SEQ ID NO: 118015 - DNA, 25 bp, Homo sapien
agtttcgacagagcctgcatcctcc

SEQ ID NO: 118016 - DNA, 25 bp, Homo sapien
tccctccttggcagagaaaggcctc

SEQ ID NO: 118017 - DNA, 25 bp, Homo sapien
tgagaaacacgaagacgcaaaaacg

SEQ ID NO: 118018 - DNA, 25 bp, Homo sapien
tcggccatggcggttccgcacgaac

SEQ ID NO: 118019 - DNA, 25 bp, Homo sapien
cttggactcccggatctgcatgcga

SEQ ID NO: 118020 - DNA, 25 bp, Homo sapien
acagggacccgagtttcgacagagc

SEQ ID NO: 118021 - DNA, 25 bp, Homo sapien
agagtccggtgctgttccttccaaa

SEQ ID NO: 118022 - DNA, 25 bp, Homo sapien
caatccagctgcgacagggacccga

SEQ ID NO: 118023 - DNA, 25 bp, Homo sapien
ggagcgttcgtcaccagcaatctga

SEQ ID NO: 118024 - DNA, 25 bp, Homo sapien
ccacaaagcgccagctgaggggccg

SEQ ID NO: 118025 - DNA, 25 bp, Homo sapien
agctgccaggcataggcgccgttct

SEQ ID NO: 118026 - DNA, 25 bp, Homo sapien
gcactcgcaggcagctatgagaccc

SEQ ID NO: 118027 - DNA, 25 bp, Homo sapien
tttaagtgtgcggaggcgcattccc

SEQ ID NO: 118028 - DNA, 25 bp, Homo sapien
gccctcccgaaatagctgccgaatg

SEQ ID NO: 118029 - DNA, 25 bp, Homo sapien
ctgccgaatgaatggtgcggacccg

SEQ ID NO: 118030 - DNA, 25 bp, Homo sapien
ctgcagcctcgcgtgaggggactta

SEQ ID NO: 118031 - DNA, 25 bp, Homo sapien
tttgtgtcaacacggccgcagcctc

SEQ ID NO: 118032 - DNA, 25 bp, Homo sapien
aggatgcagtttgtgtcaacacggc

SEQ ID NO: 118033 - DNA, 25 bp, Homo sapien
cgagcggggaacagcactcccagga

SEQ ID NO: 118034 - DNA, 25 bp, Homo sapien
aggtctgccaccaggagccggcgct

SEQ ID NO: 118035 - DNA, 25 bp, Homo sapien
gcgcctggaaaacgttcttcttctc

SEQ ID NO: 118036 - DNA, 25 bp, Homo sapien
ggactgtttgctcctacgggctgta

SEQ ID NO: 118037 - DNA, 25 bp, Homo sapien
gccgaaggggactgtttgctcctac

SEQ ID NO: 118038 - DNA, 25 bp, Homo sapien
gccgccgcctctcagttttggggcg

SEQ ID NO: 118039 - DNA, 25 bp, Homo sapien
gccgtaaggagcacctgcagaacca

SEQ ID NO: 118040 - DNA, 25 bp, Homo sapien
ctggacgacggtttccaggtgctgc

SEQ ID NO: 118041 - DNA, 25 bp, Homo sapien
gcgagaagacctacagccgtaagga

SEQ ID NO: 118042 - DNA, 25 bp, Homo sapien
gagtcgctcaaggaccacctgcgcg

SEQ ID NO: 118043 - DNA, 25 bp, Homo sapien
gaagagcttcaactgccactcgggc

SEQ ID NO: 118044 - DNA, 25 bp, Homo sapien
cctttccaatgtgcactgtgcggca

SEQ ID NO: 118045 - DNA, 25 bp, Homo sapien
cctacgagtgcgctgagtgcgagaa

SEQ ID NO: 118046 - DNA, 25 bp, Homo sapien
tcggcgtgcgcaagagcctcatcat

SEQ ID NO: 118047 - DNA, 25 bp, Homo sapien
cggcgacgcagaagcccagcatatg

SEQ ID NO: 118048 - DNA, 25 bp, Homo sapien
cactcagcgcagcagtggcagcatg

SEQ ID NO: 118049 - DNA, 25 bp, Homo sapien
gcacgccacacccacagccggaggt

SEQ ID NO: 118050 - DNA, 25 bp, Homo sapien
ggccgcagaacacgcgcgcaaactg

SEQ ID NO: 118051 - DNA, 25 bp, Homo sapien
acgcgcgcaaactgagcagcctgaa

SEQ ID NO: 118052 - DNA, 25 bp, Homo sapien
cgcaaactgagcagcctgaagggcg

SEQ ID NO: 118053 - DNA, 25 bp, Homo sapien
catatggggcactcagcgcagcagt

SEQ ID NO: 118054 - DNA, 25 bp, Homo sapien
aagcccagcatatggggcactcagc

SEQ ID NO: 118055 - DNA, 25 bp, Homo sapien
caccactttggcgagcgtcctgctt

SEQ ID NO: 118056 - DNA, 25 bp, Homo sapien
tgctccatagctccgggcgctgcgt

SEQ ID NO: 118057 - DNA, 25 bp, Homo sapien
aggggccacagtctccatttcagcg

SEQ ID NO: 118058 - DNA, 25 bp, Homo sapien
tttcagcgtcttgcatggcctggca

SEQ ID NO: 118059 - DNA, 25 bp, Homo sapien
gacccttgtttgtgtcaaaaatgac

SEQ ID NO: 118060 - DNA, 25 bp, Homo sapien
tgcccttgccgtgggtccggcgttc

SEQ ID NO: 118061 - DNA, 25 bp, Homo sapien
cccagccgggatcacagtgggcagc

SEQ ID NO: 118062 - DNA, 25 bp, Homo sapien
ttcacgttggtgcacctgctccata

SEQ ID NO: 118063 - DNA, 25 bp, Homo sapien
tctccgtcgctacgagtgagctctc

SEQ ID NO: 118064 - DNA, 25 bp, Homo sapien
agaaacttctctgacgcttgcttta

SEQ ID NO: 118065 - DNA, 25 bp, Homo sapien
gtggatttgtgaccctgcccacaca

SEQ ID NO: 118066 - DNA, 25 bp, Homo sapien
ttcgtgccaaaagagcccgttccca

SEQ ID NO: 118067 - DNA, 25 bp, Homo sapien
cccaggttggagtgtttccagattg

SEQ ID NO: 118068 - DNA, 25 bp, Homo sapien
ttccagattggaaacggtctccgtc

SEQ ID NO: 118069 - DNA, 25 bp, Homo sapien
gggaggtcgctgctcccagaatgca

SEQ ID NO: 118070 - DNA, 25 bp, Homo sapien
atgcacctggcatcaacacggcggc

SEQ ID NO: 118071 - DNA, 25 bp, Homo sapien
cccggcagtagctctcaggttaggc

SEQ ID NO: 118072 - DNA, 25 bp, Homo sapien
tattgtcccatttgaggcctcgcgg

SEQ ID NO: 118073 - DNA, 25 bp, Homo sapien
cccagggtcacgcatctattagagg

SEQ ID NO: 118074 - DNA, 25 bp, Homo sapien
gccgcgccttaggagtattgtccca

SEQ ID NO: 118075 - DNA, 25 bp, Homo sapien
acgcagctttccctcgcgaggtttc

SEQ ID NO: 118076 - DNA, 25 bp, Homo sapien
ggtttcgcactttccagcgcggttc

SEQ ID NO: 118077 - DNA, 25 bp, Homo sapien
cgccgagcgcagctcttttttaaag

SEQ ID NO: 118078 - DNA, 25 bp, Homo sapien
cagcccgcgtcgaaggcattgaccg

SEQ ID NO: 118079 - DNA, 25 bp, Homo sapien
agtgtggccggaccttcaaccgcaa

SEQ ID NO: 118080 - DNA, 25 bp, Homo sapien
tgtaccactgcagcgagtgcctgcg

SEQ ID NO: 118081 - DNA, 25 bp, Homo sapien
ctgcagccagcaagatgtaccactg

SEQ ID NO: 118082 - DNA, 25 bp, Homo sapien
caccacctggccgtgcacatgcaga

SEQ ID NO: 118083 - DNA, 25 bp, Homo sapien
gacgattcatcagcggacccatgtg

SEQ ID NO: 118084 - DNA, 25 bp, Homo sapien
cgactgcgggcagagcttccgcctg

SEQ ID NO: 118085 - DNA, 25 bp, Homo sapien
cgcctgaagatcaatctgacgattc

SEQ ID NO: 118086 - DNA, 25 bp, Homo sapien
ttccagcagcgcaagagcctgctgc

SEQ ID NO: 118087 - DNA, 25 bp, Homo sapien
aacctcaagatttgtgtgccgggtg

SEQ ID NO: 118088 - DNA, 25 bp, Homo sapien
gcgggctctataacctcaagatttg

SEQ ID NO: 118089 - DNA, 25 bp, Homo sapien
gaccgcgggctctataacctcaaga

SEQ ID NO: 118090 - DNA, 25 bp, Homo sapien
gaaagcctgtagaccgcgggctcta

SEQ ID NO: 118091 - DNA, 25 bp, Homo sapien
ggcactttgatcctctgaaagcctg

SEQ ID NO: 118092 - DNA, 25 bp, Homo sapien
cacccggcactttgatcctctgaaa

SEQ ID NO: 118093 - DNA, 25 bp, Homo sapien
tgatgtctcccacccggcactttga

SEQ ID NO: 118094 - DNA, 25 bp, Homo sapien
tgatcctctgaaagcctgtagaccg

SEQ ID NO: 118095 - DNA, 25 bp, Homo sapien
acagctgccgcgctgacgcgttttc

SEQ ID NO: 118096 - DNA, 25 bp, Homo sapien
cgtgcgcttgatctggtttctgctc

SEQ ID NO: 118097 - DNA, 25 bp, Homo sapien
gtggagccgagtcctgaattcgcca

SEQ ID NO: 118098 - DNA, 25 bp, Homo sapien
taagggcgaccctcatggaggcttg

SEQ ID NO: 118099 - DNA, 25 bp, Homo sapien
aacccgttgagtctctgcacagctg

SEQ ID NO: 118100 - DNA, 25 bp, Homo sapien
ggtcgcaacccgttgagtctctgca

SEQ ID NO: 118101 - DNA, 25 bp, Homo sapien
acacctgcgggctgttgggcaccag

SEQ ID NO: 118102 - DNA, 25 bp, Homo sapien
tcccgggttggccaatgaaaagctg

SEQ ID NO: 118103 - DNA, 25 bp, Homo sapien
agcgtttcacgcgtctggccaacct

SEQ ID NO: 118104 - DNA, 25 bp, Homo sapien
caacctgaccgtgcaccagagagtg

SEQ ID NO: 118105 - DNA, 25 bp, Homo sapien
tgcggcaagaccttcctccagcagt

SEQ ID NO: 118106 - DNA, 25 bp, Homo sapien
tgcgcgcacatcagggagaagccct

SEQ ID NO: 118107 - DNA, 25 bp, Homo sapien
cggcccttccagtgcacgcaatgtg

SEQ ID NO: 118108 - DNA, 25 bp, Homo sapien
cacgcaatgtggctgctgcttcagc

SEQ ID NO: 118109 - DNA, 25 bp, Homo sapien
tgtgcgcagtgcgacaagcgtttca

SEQ ID NO: 118110 - DNA, 25 bp, Homo sapien
tggtgctcagtgtcccaagagcttc

SEQ ID NO: 118111 - DNA, 25 bp, Homo sapien
tttgcgcttttaccgtcacactcca

SEQ ID NO: 118112 - DNA, 25 bp, Homo sapien
cgggaggaaagcgtcactcacgtct

SEQ ID NO: 118113 - DNA, 25 bp, Homo sapien
actcacgtcttcgtagtcagccgca

SEQ ID NO: 118114 - DNA, 25 bp, Homo sapien
tagtcagccgcacgcaagccgcgta

SEQ ID NO: 118115 - DNA, 25 bp, Homo sapien
aagccgcgtacagcactgcagggtc

SEQ ID NO: 118116 - DNA, 25 bp, Homo sapien
gccagttcggacctttgcgctttta

SEQ ID NO: 118117 - DNA, 25 bp, Homo sapien
cggctcacggcgtttactccttcgg

SEQ ID NO: 118118 - DNA, 25 bp, Homo sapien
cggcgcttttctccggcggccagtt

SEQ ID NO: 118119 - DNA, 25 bp, Homo sapien
cactgcgactaagggccagccggct

SEQ ID NO: 118120 - DNA, 25 bp, Homo sapien
cgcccaggcagaggaacgtctaaaa

SEQ ID NO: 118121 - DNA, 25 bp, Homo sapien
tgtgttaagtccttgctccattggc

SEQ ID NO: 118122 - DNA, 25 bp, Homo sapien
tcagctgcactcacagcaccagtga

SEQ ID NO: 118123 - DNA, 25 bp, Homo sapien
ccagtgagaccgacacggttgtgcc

SEQ ID NO: 118124 - DNA, 25 bp, Homo sapien
ccaggcgacctgaacgagaggaagc

SEQ ID NO: 118125 - DNA, 25 bp, Homo sapien
ctggtgttcatacccagccaggaag

SEQ ID NO: 118126 - DNA, 25 bp, Homo sapien
cccgttctcatcagacgggagaaaa

SEQ ID NO: 118127 - DNA, 25 bp, Homo sapien
cagccttttcactgcggggtttcct

SEQ ID NO: 118128 - DNA, 25 bp, Homo sapien
cgtgcacgcgctgatggatcaccaa

SEQ ID NO: 118129 - DNA, 25 bp, Homo sapien
cgccgctaccagagctgggtgactt

SEQ ID NO: 118130 - DNA, 25 bp, Homo sapien
gcttgtgccggaagctgatctcgca

SEQ ID NO: 118131 - DNA, 25 bp, Homo sapien
tgatctcgcattcggcgcactcgta

SEQ ID NO: 118132 - DNA, 25 bp, Homo sapien
ccctccttgatgtggttgcgctggt

SEQ ID NO: 118133 - DNA, 25 bp, Homo sapien
tgaaggagacctcatgcttgcccgc

SEQ ID NO: 118134 - DNA, 25 bp, Homo sapien
actccatgcatgtgaagggccgctc

SEQ ID NO: 118135 - DNA, 25 bp, Homo sapien
ggctgcaggaggtctccaacctgtc

SEQ ID NO: 118136 - DNA, 25 bp, Homo sapien
tacgtctggaagagcgaactgccca

SEQ ID NO: 118137 - DNA, 25 bp, Homo sapien
tgggtgtcagtgttctcctgcctca

SEQ ID NO: 118138 - DNA, 25 bp, Homo sapien
tggtttaataaagctgccgcgcgct

SEQ ID NO: 118139 - DNA, 25 bp, Homo sapien
atcccgcggtcatcaagcgacgctt

SEQ ID NO: 118140 - DNA, 25 bp, Homo sapien
ccaacctgtcagagtggctgagtcc

SEQ ID NO: 118141 - DNA, 25 bp, Homo sapien
cccttgttcccgcaggacgtgctgt

SEQ ID NO: 118142 - DNA, 25 bp, Homo sapien
acgtgggcagcctctacgtctggaa

SEQ ID NO: 118143 - DNA, 25 bp, Homo sapien
agctgcacagcagctgccatgttgc

SEQ ID NO: 118144 - DNA, 25 bp, Homo sapien
ccatgttgctacaaactgcatcctg

SEQ ID NO: 118145 - DNA, 25 bp, Homo sapien
ctctcaggccgtttaaagagaaaca

SEQ ID NO: 118146 - DNA, 25 bp, Homo sapien
aagagaaacactccgaggctcgtcg

SEQ ID NO: 118147 - DNA, 25 bp, Homo sapien
tacagccggtaggagcgaacagtgt

SEQ ID NO: 118148 - DNA, 25 bp, Homo sapien
ccgcgccaacgtcgtagcgtttctg

SEQ ID NO: 118149 - DNA, 25 bp, Homo sapien
ccgagctctgcggaaaacgtgccgg

SEQ ID NO: 118150 - DNA, 25 bp, Homo sapien
tcccggcgcctctttagcaggggag

SEQ ID NO: 118151 - DNA, 25 bp, Homo sapien
ggcgcgtgaagcaacggccgcactc

SEQ ID NO: 118152 - DNA, 25 bp, Homo sapien
gacgctgaggccacaagtccagtcg

SEQ ID NO: 118153 - DNA, 25 bp, Homo sapien
agtccagtcggtcacaaggtctgtg

SEQ ID NO: 118154 - DNA, 25 bp, Homo sapien
tctgtggaggccaaaggtcctttgg

SEQ ID NO: 118155 - DNA, 25 bp, Homo sapien
cgcacgcccgtgtgcgttcggtagt

SEQ ID NO: 118156 - DNA, 25 bp, Homo sapien
ttctcacactcggtgcaggggaagg

SEQ ID NO: 118157 - DNA, 25 bp, Homo sapien
gggctttttacacgtgcggccggca

SEQ ID NO: 118158 - DNA, 25 bp, Homo sapien
agcgttcggtgaagcgcttctcaca

SEQ ID NO: 118159 - DNA, 25 bp, Homo sapien
cacctgcagcctgagaggcgaacgg

SEQ ID NO: 118160 - DNA, 25 bp, Homo sapien
cggagggcccaaagaacttggcgtg

SEQ ID NO: 118161 - DNA, 25 bp, Homo sapien
gcccggaggaagtcgtcgtcgccgc

SEQ ID NO: 118162 - DNA, 25 bp, Homo sapien
cgcaggcggcgcctgcctggccttt

SEQ ID NO: 118163 - DNA, 25 bp, Homo sapien
cagacgaaggcccgtgaggcttcct

SEQ ID NO: 118164 - DNA, 25 bp, Homo sapien
cctgcagcctgagaggcgaacggca

SEQ ID NO: 118165 - DNA, 25 bp, Homo sapien
tattgaaagggtccccctcatggga

SEQ ID NO: 118166 - DNA, 25 bp, Homo sapien
agcccgaggactcggttattgaaag

SEQ ID NO: 118167 - DNA, 25 bp, Homo sapien
tcccaggtaccactaagccgctggg

SEQ ID NO: 118168 - DNA, 25 bp, Homo sapien
cggtatacgcggattcgaagcctca

SEQ ID NO: 118169 - DNA, 25 bp, Homo sapien
gcgccaagcagagaaaagagcctcg

SEQ ID NO: 118170 - DNA, 25 bp, Homo sapien
aatccaggccgcgagttcgtgcgcg

SEQ ID NO: 118171 - DNA, 25 bp, Homo sapien
ggcccagataaagtcgtcgccgctg

SEQ ID NO: 118172 - DNA, 25 bp, Homo sapien
gcccgcagttgcgtcaacgccttta

SEQ ID NO: 118173 - DNA, 25 bp, Homo sapien
ggccgacgaaggcacatgaggcttc

SEQ ID NO: 118174 - DNA, 25 bp, Homo sapien
cctgcagctccggaggcgaactgca

SEQ ID NO: 118175 - DNA, 25 bp, Homo sapien
ggtcactaagtccttcctcgcgaag

SEQ ID NO: 118176 - DNA, 25 bp, Homo sapien
tcgcgaagcccgcaggcatctccag

SEQ ID NO: 118177 - DNA, 25 bp, Homo sapien
cgaggcacaggcaccttctccgtga

SEQ ID NO: 118178 - DNA, 25 bp, Homo sapien
caggcaccgccactcagctctgcga

SEQ ID NO: 118179 - DNA, 25 bp, Homo sapien
acaggcaccttctccgtgagccggg

SEQ ID NO: 118180 - DNA, 25 bp, Homo sapien
ccactcagctctgcgacggccggcc

SEQ ID NO: 118181 - DNA, 25 bp, Homo sapien
gggagccacctgtccacttcggagc

SEQ ID NO: 118182 - DNA, 25 bp, Homo sapien
agccgcgcgcagtcctgggcgctcc

SEQ ID NO: 118183 - DNA, 25 bp, Homo sapien
caggtgaactgcaccctggagcctc

SEQ ID NO: 118184 - DNA, 25 bp, Homo sapien
acgcctgtgaccctggacttgctct

SEQ ID NO: 118185 - DNA, 25 bp, Homo sapien
gagggccgcatctcacgcggagcac

SEQ ID NO: 118186 - DNA, 25 bp, Homo sapien
tggcggctgctttactgctaactcc

SEQ ID NO: 118187 - DNA, 25 bp, Homo sapien
gagaaggacagctggaaccgtctga

SEQ ID NO: 118188 - DNA, 25 bp, Homo sapien
agccggtgtgtgaagccggcaccac

SEQ ID NO: 118189 - DNA, 25 bp, Homo sapien
ccgtgatgaagccagcaggtgaact

SEQ ID NO: 118190 - DNA, 25 bp, Homo sapien
ccacgttagcggaaccgagttattg

SEQ ID NO: 118191 - DNA, 25 bp, Homo sapien
ccagaccaggccttcgaactcgtga

SEQ ID NO: 118192 - DNA, 25 bp, Homo sapien
ctccaagcttctgtctggcacagca

SEQ ID NO: 118193 - DNA, 25 bp, Homo sapien
gaatgagtgataagcggcgcgtacc

SEQ ID NO: 118194 - DNA, 25 bp, Homo sapien
ttctccagacaggaaaaccaggctc

SEQ ID NO: 118195 - DNA, 25 bp, Homo sapien
tcacacgtttatttgaggcctacta

SEQ ID NO: 118196 - DNA, 25 bp, Homo sapien
tgtgccaggaacaactggggttacc

SEQ ID NO: 118197 - DNA, 25 bp, Homo sapien
cctctgggaaagatgggtccctctt

SEQ ID NO: 118198 - DNA, 25 bp, Homo sapien
gcagccttctataaaaatgacgggg

SEQ ID NO: 118199 - DNA, 25 bp, Homo sapien
cagagggagttctaccgagacgtga

SEQ ID NO: 118200 - DNA, 25 bp, Homo sapien
ggggatcgttcacgctgctgctatt

SEQ ID NO: 118201 - DNA, 25 bp, Homo sapien
tgctgctattctatgtcccgggacc

SEQ ID NO: 118202 - DNA, 25 bp, Homo sapien
ggcctctgaggttccgaccactctg

SEQ ID NO: 118203 - DNA, 25 bp, Homo sapien
gcagccttagtctttccacctgaga

SEQ ID NO: 118204 - DNA, 25 bp, Homo sapien
ctggacccggcagccttagtctttc

SEQ ID NO: 118205 - DNA, 25 bp, Homo sapien
acgtgatgcgggagaactacgagac

SEQ ID NO: 118206 - DNA, 25 bp, Homo sapien
cacctgagaaatgaacacggggatc

SEQ ID NO: 118207 - DNA, 25 bp, Homo sapien
agcgcttctcgcattccgtgcaggg

SEQ ID NO: 118208 - DNA, 25 bp, Homo sapien
gcgtcttcttgcgaaagcgcttctc

SEQ ID NO: 118209 - DNA, 25 bp, Homo sapien
ctggtgccgaatcaagtgcgtcttc

SEQ ID NO: 118210 - DNA, 25 bp, Homo sapien
tggtgccgcaccaagtgctgcttgt

SEQ ID NO: 118211 - DNA, 25 bp, Homo sapien
gcgaggttctttttccagccgaagc

SEQ ID NO: 118212 - DNA, 25 bp, Homo sapien
gcgaccagattaggccgcgagccga

SEQ ID NO: 118213 - DNA, 25 bp, Homo sapien
actaggttggttttggagctgaagc

SEQ ID NO: 118214 - DNA, 25 bp, Homo sapien
gggccttcttgctgaagcgcttgtc

SEQ ID NO: 118215 - DNA, 25 bp, Homo sapien
cagcaggctccagcttcgcttccct

SEQ ID NO: 118216 - DNA, 25 bp, Homo sapien
tagggctgacccgctctctcgggac

SEQ ID NO: 118217 - DNA, 25 bp, Homo sapien
ctagggctgacccgctctctcggga

SEQ ID NO: 118218 - DNA, 25 bp, Homo sapien
ggggtctagggctgacccgctctct

SEQ ID NO: 118219 - DNA, 25 bp, Homo sapien
gggggtctagggctgacccgctctc

SEQ ID NO: 118220 - DNA, 25 bp, Homo sapien
tgggggtctagggctgacccgctct

SEQ ID NO: 118221 - DNA, 25 bp, Homo sapien
ctgggggtctagggctgacccgctc

SEQ ID NO: 118222 - DNA, 25 bp, Homo sapien
ccagcaggctccagcttcgcttccc

SEQ ID NO: 118223 - DNA, 25 bp, Homo sapien
ccgacgggaccctcagctccacctc

SEQ ID NO: 118224 - DNA, 25 bp, Homo sapien
cgccgacttcattccaggtcccggc

SEQ ID NO: 118225 - DNA, 25 bp, Homo sapien
tcgccgacttcattccaggtcccgg

SEQ ID NO: 118226 - DNA, 25 bp, Homo sapien
cgatcgccgacttcattccaggtcc

SEQ ID NO: 118227 - DNA, 25 bp, Homo sapien
tccgatcgccgacttcattccaggt

SEQ ID NO: 118228 - DNA, 25 bp, Homo sapien
aagcagctccgatcgccgacttcat

SEQ ID NO: 118229 - DNA, 25 bp, Homo sapien
tcctcccgacgggaccctcagctcc

SEQ ID NO: 118230 - DNA, 25 bp, Homo sapien
agcagctccgatcgccgacttcatt

SEQ ID NO: 118231 - DNA, 25 bp, Homo sapien
ctgacactgtctcgcaatgccatca

SEQ ID NO: 118232 - DNA, 25 bp, Homo sapien
actggtggacctgacactgtctcgc

SEQ ID NO: 118233 - DNA, 25 bp, Homo sapien
tgacttccgcaacatgacgggactg

SEQ ID NO: 118234 - DNA, 25 bp, Homo sapien
gctgacaacttcatccaggccctgg

SEQ ID NO: 118235 - DNA, 25 bp, Homo sapien
aggcctgctgtttgtgccgcccaac

SEQ ID NO: 118236 - DNA, 25 bp, Homo sapien
tgcgtctgccagaacctgtccgagt

SEQ ID NO: 118237 - DNA, 25 bp, Homo sapien
actgcttgggaaatgtgacctttgc

SEQ ID NO: 118238 - DNA, 25 bp, Homo sapien
ccctgagcgacggacaccaggtgag

SEQ ID NO: 118239 - DNA, 25 bp, Homo sapien
gccggctctgctcacaatggcgctc

SEQ ID NO: 118240 - DNA, 25 bp, Homo sapien
ccgattcgaaaccagccgcgggagc

SEQ ID NO: 118241 - DNA, 25 bp, Homo sapien
tggagtcccgaggacccgattcgaa

SEQ ID NO: 118242 - DNA, 25 bp, Homo sapien
gccgtctctaagtcgccggtgccag

SEQ ID NO: 118243 - DNA, 25 bp, Homo sapien
tcgtgcgctgccgtctctaagtcgc

SEQ ID NO: 118244 - DNA, 25 bp, Homo sapien
tgatggtcctaaggctccgagcctg

SEQ ID NO: 118245 - DNA, 25 bp, Homo sapien
cggcctgaaagactgacagactgac

SEQ ID NO: 118246 - DNA, 25 bp, Homo sapien
gtgctgacggcctgaaagactgaca

SEQ ID NO: 118247 - DNA, 25 bp, Homo sapien
ggcagctagagtgatttaggtttgg

SEQ ID NO: 118248 - DNA, 25 bp, Homo sapien
tggcgctgcgaccaggaggaagact

SEQ ID NO: 118249 - DNA, 25 bp, Homo sapien
cccgacgcctgcgttgaggctcccg

SEQ ID NO: 118250 - DNA, 25 bp, Homo sapien
ctgcggccccttcgagtttcggtgc

SEQ ID NO: 118251 - DNA, 25 bp, Homo sapien
cgacggcagcgacgagcgcggctgc

SEQ ID NO: 118252 - DNA, 25 bp, Homo sapien
gcagtgtcccgacggctcggacgag

SEQ ID NO: 118253 - DNA, 25 bp, Homo sapien
aagactgcgccgacggcagcgacga

SEQ ID NO: 118254 - DNA, 25 bp, Homo sapien
tgcgtgtcccccgagcagctgtgcg

SEQ ID NO: 118255 - DNA, 25 bp, Homo sapien
gctgggcagtgaccgtaaagctgtt

SEQ ID NO: 118256 - DNA, 25 bp, Homo sapien
cgcgtagcccaatcagagcgctttg

SEQ ID NO: 118257 - DNA, 25 bp, Homo sapien
ccaatagcagcttcgagagccgctc

SEQ ID NO: 118258 - DNA, 25 bp, Homo sapien
ggtgcgacgcaagtctcagctcagc

SEQ ID NO: 118259 - DNA, 25 bp, Homo sapien
cccgacgtgagagagcgaagttctt

SEQ ID NO: 118260 - DNA, 25 bp, Homo sapien
cgatgcgaaggtgcttcctgttttc

SEQ ID NO: 118261 - DNA, 25 bp, Homo sapien
agcgctttgcccttgctgcagagga

SEQ ID NO: 118262 - DNA, 25 bp, Homo sapien
cacgccgccgttgcctagtaactgt

SEQ ID NO: 118263 - DNA, 25 bp, Homo sapien
cctgaaggatctgaatgcggtccgc

SEQ ID NO: 118264 - DNA, 25 bp, Homo sapien
cctgcgggagcatcgatctggtgaa

SEQ ID NO: 118265 - DNA, 25 bp, Homo sapien
agcaggagatcatccgcctgaagga

SEQ ID NO: 118266 - DNA, 25 bp, Homo sapien
ttatcagtcctcaaacaagaggctg

SEQ ID NO: 118267 - DNA, 25 bp, Homo sapien
caagaggctgaacgagctgcaggaa

SEQ ID NO: 118268 - DNA, 25 bp, Homo sapien
ctggtgaagaagtgtgaccggcaca

SEQ ID NO: 118269 - DNA, 25 bp, Homo sapien
ggcacatccgcaccgtcttcaagtt

SEQ ID NO: 118270 - DNA, 25 bp, Homo sapien
cgtcttcaagttttatcagtcctca

SEQ ID NO: 118271 - DNA, 25 bp, Homo sapien
tttggaaataagaatgcggcgtgac

SEQ ID NO: 118272 - DNA, 25 bp, Homo sapien
gtgctcgactcctgttgcgcatgct

SEQ ID NO: 118273 - DNA, 25 bp, Homo sapien
cgccgctcgctagtcctgggagtga

SEQ ID NO: 118274 - DNA, 25 bp, Homo sapien
gtcatcatcttcaccacgttctggg

SEQ ID NO: 118275 - DNA, 25 bp, Homo sapien
tgcgtctctgaaagcgaggccgttc

SEQ ID NO: 118276 - DNA, 25 bp, Homo sapien
ggctgatcgcttcgggtgctcgact

SEQ ID NO: 118277 - DNA, 25 bp, Homo sapien
cagccaatcagcgagtgggctccta

SEQ ID NO: 118278 - DNA, 25 bp, Homo sapien
ggctgacgcggaccctataacccat

SEQ ID NO: 118279 - DNA, 25 bp, Homo sapien
tgcctaacttgaagcaacaccagag

SEQ ID NO: 118280 - DNA, 25 bp, Homo sapien
tattttgctttctctccggttccca

SEQ ID NO: 118281 - DNA, 25 bp, Homo sapien
agcagcaaggcaagcccagcgccgg

SEQ ID NO: 118282 - DNA, 25 bp, Homo sapien
gccacgtacggcctaatcaaagaga

SEQ ID NO: 118283 - DNA, 25 bp, Homo sapien
cggcctaatcaaagagattgaagga

SEQ ID NO: 118284 - DNA, 25 bp, Homo sapien
taaagcgagggaaatgcctaggccc

SEQ ID NO: 118285 - DNA, 25 bp, Homo sapien
acttgaagcaacaccagagacaccc

SEQ ID NO: 118286 - DNA, 25 bp, Homo sapien
ccaaaaacataaagcgagggaaatg

SEQ ID NO: 118287 - DNA, 25 bp, Homo sapien
tttccctgaaaaggcgcctggatgc

SEQ ID NO: 118288 - DNA, 25 bp, Homo sapien
tggtctcaaccgcaggagaaacagc

SEQ ID NO: 118289 - DNA, 25 bp, Homo sapien
cgcatctcatggaggtctccgtcca

SEQ ID NO: 118290 - DNA, 25 bp, Homo sapien
agcctccaaagggacgtgccacttg

SEQ ID NO: 118291 - DNA, 25 bp, Homo sapien
ccaggacacacgctagggtggaacc

SEQ ID NO: 118292 - DNA, 25 bp, Homo sapien
tggatgctgtttctagctcccgtta

SEQ ID NO: 118293 - DNA, 25 bp, Homo sapien
gcaccacaggtgattcattcgtttc

SEQ ID NO: 118294 - DNA, 25 bp, Homo sapien
agcacgtccttgtgccacactcagg

SEQ ID NO: 118295 - DNA, 25 bp, Homo sapien
gtcctccttctgcagccgagtctgg

SEQ ID NO: 118296 - DNA, 25 bp, Homo sapien
ctggccgcgggtctacaaaacagca

SEQ ID NO: 118297 - DNA, 25 bp, Homo sapien
acctgacgctattggagactcctgc

SEQ ID NO: 118298 - DNA, 25 bp, Homo sapien
actcctgcggtttgattcatgtcca

SEQ ID NO: 118299 - DNA, 25 bp, Homo sapien
cttcaaaacttcctaggcgcgtgga

SEQ ID NO: 118300 - DNA, 25 bp, Homo sapien
gttcaggacgctcaagaccagaagc

SEQ ID NO: 118301 - DNA, 25 bp, Homo sapien
gcctcgcaatcatgggaaacagctg

SEQ ID NO: 118302 - DNA, 25 bp, Homo sapien
cagccgcaaagcagggtaggatctc

SEQ ID NO: 118303 - DNA, 25 bp, Homo sapien
tagatgagccttccacgcgggagac

SEQ ID NO: 118304 - DNA, 25 bp, Homo sapien
caggctgcgcttccggaagtaaccc

SEQ ID NO: 118305 - DNA, 25 bp, Homo sapien
caccgcaggtaggaggaacgtacca

SEQ ID NO: 118306 - DNA, 25 bp, Homo sapien
ggccgcaccgataaacgattaccga

SEQ ID NO: 118307 - DNA, 25 bp, Homo sapien
caagggcttggaggtcctttctcta

SEQ ID NO: 118308 - DNA, 25 bp, Homo sapien
gtgaccaccacccaacatgtattga

SEQ ID NO: 118309 - DNA, 25 bp, Homo sapien
gagaagcacgctggccaacaagttg

SEQ ID NO: 118310 - DNA, 25 bp, Homo sapien
cctggatccttatcgtctttgtggc

SEQ ID NO: 118311 - DNA, 25 bp, Homo sapien
aggagcctggaaatggccctttctc

SEQ ID NO: 118312 - DNA, 25 bp, Homo sapien
tgaccgtcccgcagctgaaatcttg

SEQ ID NO: 118313 - DNA, 25 bp, Homo sapien
tagagcaaaggcgttcctcattccg

SEQ ID NO: 118314 - DNA, 25 bp, Homo sapien
ccctgatgcatgactggggccaccg

SEQ ID NO: 118315 - DNA, 25 bp, Homo sapien
tggctttcccgcttcaggcaaaatc

SEQ ID NO: 118316 - DNA, 25 bp, Homo sapien
tgcccacgctaggaatcagtcagtt

SEQ ID NO: 118317 - DNA, 25 bp, Homo sapien
ccaggcctgtagaacgctgggcaca

SEQ ID NO: 118318 - DNA, 25 bp, Homo sapien
atcttgcccattgtgtctctccctg

SEQ ID NO: 118319 - DNA, 25 bp, Homo sapien
tcctgtgtgctccaagggatgagcc

SEQ ID NO: 118320 - DNA, 25 bp, Homo sapien
ctacggttatgccaggcgcctggga

SEQ ID NO: 118321 - DNA, 25 bp, Homo sapien
ctgtgtgctccaagggatgagcctc

SEQ ID NO: 118322 - DNA, 25 bp, Homo sapien
cggctggaagagagtgtggtgtgat

SEQ ID NO: 118323 - DNA, 25 bp, Homo sapien
ggtgctacggttatgccaggcgcct

SEQ ID NO: 118324 - DNA, 25 bp, Homo sapien
acgggcagcttcctgtgtgctccaa

SEQ ID NO: 118325 - DNA, 25 bp, Homo sapien
agcttcctgtgtgctccaagggatg

SEQ ID NO: 118326 - DNA, 25 bp, Homo sapien
tgtgctccaagggatgagcctcgtg

SEQ ID NO: 118327 - DNA, 25 bp, Homo sapien
tcgggaaacttgagctccggccagt

SEQ ID NO: 118328 - DNA, 25 bp, Homo sapien
tttcaaagttcgcaggatcgggcct

SEQ ID NO: 118329 - DNA, 25 bp, Homo sapien
gcagccagaggaagcccagcaactt

SEQ ID NO: 118330 - DNA, 25 bp, Homo sapien
ttgccggagccctctttgaagtctc

SEQ ID NO: 118331 - DNA, 25 bp, Homo sapien
ctcactcgcaagaacgggacccgtg

SEQ ID NO: 118332 - DNA, 25 bp, Homo sapien
ttgtgaactcgaacctgccgctgtc

SEQ ID NO: 118333 - DNA, 25 bp, Homo sapien
tgggacccgaaatggctcactcgca

SEQ ID NO: 118334 - DNA, 25 bp, Homo sapien
gggcctttttgtgctccactttgga

SEQ ID NO: 118335 - DNA, 25 bp, Homo sapien
tgtgcctgttgtggcaagcgcttcc

SEQ ID NO: 118336 - DNA, 25 bp, Homo sapien
agttgcccacaagcgggtgcacgta

SEQ ID NO: 118337 - DNA, 25 bp, Homo sapien
agattcacaagcgatccgaggggtc

SEQ ID NO: 118338 - DNA, 25 bp, Homo sapien
tgcgggaagcgctttaccaataagc

SEQ ID NO: 118339 - DNA, 25 bp, Homo sapien
taagccctatctgacttcgcaccgg

SEQ ID NO: 118340 - DNA, 25 bp, Homo sapien
aagccctacccgtgcaaagagtgcg

SEQ ID NO: 118341 - DNA, 25 bp, Homo sapien
cttcggcaagaagacgcacctggtg

SEQ ID NO: 118342 - DNA, 25 bp, Homo sapien
gtacctctgaaaccggcccaggagc

SEQ ID NO: 118343 - DNA, 25 bp, Homo sapien
ctatcgcggcttgagggcagccaca

SEQ ID NO: 118344 - DNA, 25 bp, Homo sapien
acgtgcgctgagttcaggcgttaca

SEQ ID NO: 118345 - DNA, 25 bp, Homo sapien
ttcaggcgttacaacggggtcgcac

SEQ ID NO: 118346 - DNA, 25 bp, Homo sapien
ctcggctattggctccagagaacaa

SEQ ID NO: 118347 - DNA, 25 bp, Homo sapien
gcagttcccgttaaccttagccaca

SEQ ID NO: 118348 - DNA, 25 bp, Homo sapien
cccagcagggagaaacagcgtccgg

SEQ ID NO: 118349 - DNA, 25 bp, Homo sapien
agtccctctgcattttgggcgggga

SEQ ID NO: 118350 - DNA, 25 bp, Homo sapien
ctcctgggctgtcccgttgttccga

SEQ ID NO: 118351 - DNA, 25 bp, Homo sapien
tgcacgagctgattcaggacgcggc

SEQ ID NO: 118352 - DNA, 25 bp, Homo sapien
tacctctgcggcaagtgcggcaaga

SEQ ID NO: 118353 - DNA, 25 bp, Homo sapien
agagcttcagccagaagccgaacct

SEQ ID NO: 118354 - DNA, 25 bp, Homo sapien
ccggcctgcacgagctgattcagga

SEQ ID NO: 118355 - DNA, 25 bp, Homo sapien
aagagcttcacctggtggtcgtcgc

SEQ ID NO: 118356 - DNA, 25 bp, Homo sapien
ggcacctgcgcaaccacacaggcga

SEQ ID NO: 118357 - DNA, 25 bp, Homo sapien
cccagctgcggtaagagctgccgca

SEQ ID NO: 118358 - DNA, 25 bp, Homo sapien
cctggtggtcgtcgctgaacatcca

SEQ ID NO: 118359 - DNA, 25 bp, Homo sapien
tcgctgcgggagagttaccgtattt

SEQ ID NO: 118360 - DNA, 25 bp, Homo sapien
tcagcccatgtcacccggggaaagg

SEQ ID NO: 118361 - DNA, 25 bp, Homo sapien
ttaccgtatttaccgaggccagagc

SEQ ID NO: 118362 - DNA, 25 bp, Homo sapien
tatttatccagggttgcgtggctcc

SEQ ID NO: 118363 - DNA, 25 bp, Homo sapien
ggctgcattcattccctctgggagc

SEQ ID NO: 118364 - DNA, 25 bp, Homo sapien
tgcgacgcagagtttaccatatttc

SEQ ID NO: 118365 - DNA, 25 bp, Homo sapien
ctctcccgattaatgcagctatttg

SEQ ID NO: 118366 - DNA, 25 bp, Homo sapien
catatttctccagggttgctccggc

SEQ ID NO: 118367 - DNA, 25 bp, Homo sapien
ggcccacttaggacgcgtgctatga

SEQ ID NO: 118368 - DNA, 25 bp, Homo sapien
ttcagcgtcaagcacaacctcgagg

SEQ ID NO: 118369 - DNA, 25 bp, Homo sapien
ctgcagaggagcagccctaccgctg

SEQ ID NO: 118370 - DNA, 25 bp, Homo sapien
tggtcatccaccaccctgcagagga

SEQ ID NO: 118371 - DNA, 25 bp, Homo sapien
acgagcgaggcctggtcatccacca

SEQ ID NO: 118372 - DNA, 25 bp, Homo sapien
ggccgctgcttcagcctcaagcaga

SEQ ID NO: 118373 - DNA, 25 bp, Homo sapien
tccctctctagatgggatcccggga

SEQ ID NO: 118374 - DNA, 25 bp, Homo sapien
gagggctcgctcaagacccatcagc

SEQ ID NO: 118375 - DNA, 25 bp, Homo sapien
tgcctttgataaccgggccaccggc

SEQ ID NO: 118376 - DNA, 25 bp, Homo sapien
aagggcgcccattactccaacgagg

SEQ ID NO: 118377 - DNA, 25 bp, Homo sapien
ggggctccctgcacgattacgtgag

SEQ ID NO: 118378 - DNA, 25 bp, Homo sapien
cgtcctaaaatggatggtcatcgtc

SEQ ID NO: 118379 - DNA, 25 bp, Homo sapien
ccaacgaggtgtatgagctggcgca

SEQ ID NO: 118380 - DNA, 25 bp, Homo sapien
tgacccagttgggtcggttcaccgc

SEQ ID NO: 118381 - DNA, 25 bp, Homo sapien
acgcgctgctcctggtgacccagtt

SEQ ID NO: 118382 - DNA, 25 bp, Homo sapien
tgagcaacacagagaaccgggcctt

SEQ ID NO: 118383 - DNA, 25 bp, Homo sapien
ggacgccaagctccaagcctggtca

SEQ ID NO: 118384 - DNA, 25 bp, Homo sapien
caatgtcctggtaagctcgtggccc

SEQ ID NO: 118385 - DNA, 25 bp, Homo sapien
gcacgacctgctcaatgtcctggta

SEQ ID NO: 118386 - DNA, 25 bp, Homo sapien
gggcatcgttgtgcggcctcaccac

SEQ ID NO: 118387 - DNA, 25 bp, Homo sapien
ctggctctctggacatgacccgtgt

SEQ ID NO: 118388 - DNA, 25 bp, Homo sapien
ccagggctcactcagccaatgctta

SEQ ID NO: 118389 - DNA, 25 bp, Homo sapien
aggtgacaggagctgacacaggccc

SEQ ID NO: 118390 - DNA, 25 bp, Homo sapien
tctgagtgacaagtgtgtgggcatc

SEQ ID NO: 118391 - DNA, 25 bp, Homo sapien
acagaggaatgcctaatgagggccc

SEQ ID NO: 118392 - DNA, 25 bp, Homo sapien
ccgccaacatctgcggggacaatga

SEQ ID NO: 118393 - DNA, 25 bp, Homo sapien
tcgtcttcccatgagaccgacacgg

SEQ ID NO: 118394 - DNA, 25 bp, Homo sapien
gcctaaatgtgttcaacctcgtctt

SEQ ID NO: 118395 - DNA, 25 bp, Homo sapien
agcctgctggtgtcgtttgcctaaa

SEQ ID NO: 118396 - DNA, 25 bp, Homo sapien
cagcgagcttcgtagctcgggccca

SEQ ID NO: 118397 - DNA, 25 bp, Homo sapien
ggctgggacagatggtctatcatta

SEQ ID NO: 118398 - DNA, 25 bp, Homo sapien
tgctgcgattggctccaacggctca

SEQ ID NO: 118399 - DNA, 25 bp, Homo sapien
caggctgcgcggtttcccgaaacca

SEQ ID NO: 118400 - DNA, 25 bp, Homo sapien
ctgcagcctgtcatgaacccgaggg

SEQ ID NO: 118401 - DNA, 25 bp, Homo sapien
gtgaccctcgcgcagcaggagaacc

SEQ ID NO: 118402 - DNA, 25 bp, Homo sapien
actcctcgtgacagagggtcctgcg

SEQ ID NO: 118403 - DNA, 25 bp, Homo sapien
caggttggaggaagaaagacgtcct

SEQ ID NO: 118404 - DNA, 25 bp, Homo sapien
tttctggggagaaacacctgcaccc

SEQ ID NO: 118405 - DNA, 25 bp, Homo sapien
cctacgtgagtcctcctggaaacca

SEQ ID NO: 118406 - DNA, 25 bp, Homo sapien
cgagcagagcggacactagctgacc

SEQ ID NO: 118407 - DNA, 25 bp, Homo sapien
tccgctccggaacacctgtgggaag

SEQ ID NO: 118408 - DNA, 25 bp, Homo sapien
ttgccgtgggcaatgactttgacca

SEQ ID NO: 118409 - DNA, 25 bp, Homo sapien
ctttgaccagcagggagtcgtagtg

SEQ ID NO: 118410 - DNA, 25 bp, Homo sapien
cggctccttggaaggcggaagcatt

SEQ ID NO: 118411 - DNA, 25 bp, Homo sapien
cggaagcattatccaggcggatgcc

SEQ ID NO: 118412 - DNA, 25 bp, Homo sapien
attatccaggcggatgcccatgccc

SEQ ID NO: 118413 - DNA, 25 bp, Homo sapien
ccctgctcatcttggtggcggccgt

SEQ ID NO: 118414 - DNA, 25 bp, Homo sapien
gcaatgactttgaccagcagggagt

SEQ ID NO: 118415 - DNA, 25 bp, Homo sapien
tcctgaacgtgcacttcggcggaga

SEQ ID NO: 118416 - DNA, 25 bp, Homo sapien
cggagagcgcattgcctatgaggtc

SEQ ID NO: 118417 - DNA, 25 bp, Homo sapien
cctatgaggtcagcgtgcaagaggc

SEQ ID NO: 118418 - DNA, 25 bp, Homo sapien
ggcgctgtatggaggacacacacct

SEQ ID NO: 118419 - DNA, 25 bp, Homo sapien
tgcaggcatgcagaccaagtacctc

SEQ ID NO: 118420 - DNA, 25 bp, Homo sapien
caagtacctcgatgtcggctggggc

SEQ ID NO: 118421 - DNA, 25 bp, Homo sapien
ctgggcagcgtcactcatgagttag

SEQ ID NO: 118422 - DNA, 25 bp, Homo sapien
tggagctttgccttccggctgcgct

SEQ ID NO: 118423 - DNA, 25 bp, Homo sapien
tgagcggggtagacgcaccaccgct

SEQ ID NO: 118424 - DNA, 25 bp, Homo sapien
cccagaagctgaaaatgttggacac

SEQ ID NO: 118425 - DNA, 25 bp, Homo sapien
tgttggacactcctgagaaggcgcc

SEQ ID NO: 118426 - DNA, 25 bp, Homo sapien
catcgagggagctcctggtactggc

SEQ ID NO: 118427 - DNA, 25 bp, Homo sapien
cgcctgcagccagagagcagagctg

SEQ ID NO: 118428 - DNA, 25 bp, Homo sapien
ccgtcgcccgggatacctgacaggg

SEQ ID NO: 118429 - DNA, 25 bp, Homo sapien
gggttgcaagtgtcgctgctcttct

SEQ ID NO: 118430 - DNA, 25 bp, Homo sapien
tcttctcgcagtcctccatcagggg

SEQ ID NO: 118431 - DNA, 25 bp, Homo sapien
gagcgccgtcacatacttgtccttg

SEQ ID NO: 118432 - DNA, 25 bp, Homo sapien
tttgcctatctggtcgcccaggttg

SEQ ID NO: 118433 - DNA, 25 bp, Homo sapien
ggccgacacgttgccgaagatgcta

SEQ ID NO: 118434 - DNA, 25 bp, Homo sapien
gctgctgttgtagggtttgcctatc

SEQ ID NO: 118435 - DNA, 25 bp, Homo sapien
gctgctccatgttgccgatggcgta

SEQ ID NO: 118436 - DNA, 25 bp, Homo sapien
tctgagtagcgatccagcttccgcg

SEQ ID NO: 118437 - DNA, 25 bp, Homo sapien
gacatgcccacgagacgcccttgta

SEQ ID NO: 118438 - DNA, 25 bp, Homo sapien
ctgggcacactcacagccaatgagc

SEQ ID NO: 118439 - DNA, 25 bp, Homo sapien
cttgtactcaggcagcacgtcggcg

SEQ ID NO: 118440 - DNA, 25 bp, Homo sapien
ttccgtctccttcagcaggaaggca

SEQ ID NO: 118441 - DNA, 25 bp, Homo sapien
tagcaggcgggccttcttccgtctc

SEQ ID NO: 118442 - DNA, 25 bp, Homo sapien
caggcgtagccacactcggtagcag

SEQ ID NO: 118443 - DNA, 25 bp, Homo sapien
acgatgaggtccaccacagccagcg

SEQ ID NO: 118444 - DNA, 25 bp, Homo sapien
gatgaggatgtccacaatgaacatg

SEQ ID NO: 118445 - DNA, 25 bp, Homo sapien
ctcctcgttggcattgacgtaggtg

SEQ ID NO: 118446 - DNA, 25 bp, Homo sapien
gctgaccacctcctcgttggcattg

SEQ ID NO: 118447 - DNA, 25 bp, Homo sapien
gtcaccctggcagtaagcgtgggca

SEQ ID NO: 118448 - DNA, 25 bp, Homo sapien
ccgggcctgtcaccgcagattaatg

SEQ ID NO: 118449 - DNA, 25 bp, Homo sapien
ccgcagattaatggtctccctgaca

SEQ ID NO: 118450 - DNA, 25 bp, Homo sapien
tgactggcaggaacacacacgcctg

SEQ ID NO: 118451 - DNA, 25 bp, Homo sapien
cagtgctgagccagccagagtcaga

SEQ ID NO: 118452 - DNA, 25 bp, Homo sapien
agccagagtcagacagagacaccca

SEQ ID NO: 118453 - DNA, 25 bp, Homo sapien
acatacaggcgcacatgcacagacc

SEQ ID NO: 118454 - DNA, 25 bp, Homo sapien
ctggccgactggcaaccagagcagc

SEQ ID NO: 118455 - DNA, 25 bp, Homo sapien
ttcgtccagggccagcgactcgctg

SEQ ID NO: 118456 - DNA, 25 bp, Homo sapien
gtccatggctgtcacttcgtccagg

SEQ ID NO: 118457 - DNA, 25 bp, Homo sapien
gccctgccacgtggttgtccatggc

SEQ ID NO: 118458 - DNA, 25 bp, Homo sapien
cgagccctgccacgtggttgtccat

SEQ ID NO: 118459 - DNA, 25 bp, Homo sapien
gcgcagctttctcgggagcgcgtcc

SEQ ID NO: 118460 - DNA, 25 bp, Homo sapien
ggcgtcaggtccacgtccaccacca

SEQ ID NO: 118461 - DNA, 25 bp, Homo sapien
cgcaccgacgactcccgggccgtca

SEQ ID NO: 118462 - DNA, 25 bp, Homo sapien
cctcgatgtcgtcggccgacgaggc

SEQ ID NO: 118463 - DNA, 25 bp, Homo sapien
cggtagaaggcgatttccactttgc

SEQ ID NO: 118464 - DNA, 25 bp, Homo sapien
cgccacaggaagcatggctgggact

SEQ ID NO: 118465 - DNA, 25 bp, Homo sapien
gcgatgatgaacttacggcctaggg

SEQ ID NO: 118466 - DNA, 25 bp, Homo sapien
ttctccacccgagcgttggcgatga

SEQ ID NO: 118467 - DNA, 25 bp, Homo sapien
tgcagtagatgacggcgcagttctc

SEQ ID NO: 118468 - DNA, 25 bp, Homo sapien
cgcagaagccgtcgttgcagtagat

SEQ ID NO: 118469 - DNA, 25 bp, Homo sapien
gatttccactttgcgctcctcggcg

SEQ ID NO: 118470 - DNA, 25 bp, Homo sapien
tgcagggtcgctgcatcacctcggc

SEQ ID NO: 118471 - DNA, 25 bp, Homo sapien
aacttgcggatgatggtgtccagga

SEQ ID NO: 118472 - DNA, 25 bp, Homo sapien
ctcaaacttgcggatgatggtgtcc

SEQ ID NO: 118473 - DNA, 25 bp, Homo sapien
tggccctcaaacttgcggatgatgg

SEQ ID NO: 118474 - DNA, 25 bp, Homo sapien
ctctggccctcaaacttgcggatga

SEQ ID NO: 118475 - DNA, 25 bp, Homo sapien
tcactctggccctcaaacttgcgga

SEQ ID NO: 118476 - DNA, 25 bp, Homo sapien
cccatccacactcggaagagctcgg

SEQ ID NO: 118477 - DNA, 25 bp, Homo sapien
tcgcacttgccgacgcacacggccc

SEQ ID NO: 118478 - DNA, 25 bp, Homo sapien
attgactcgcacttgccgacgcaca

SEQ ID NO: 118479 - DNA, 25 bp, Homo sapien
tgccatggccggcttgtaggcggcc

SEQ ID NO: 118480 - DNA, 25 bp, Homo sapien
aaccgtgaggacaggtgccatggcc

SEQ ID NO: 118481 - DNA, 25 bp, Homo sapien
aaaccgtgaggacaggtgccatggc

SEQ ID NO: 118482 - DNA, 25 bp, Homo sapien
ttaggcaggggaaaccgtgaggaca

SEQ ID NO: 118483 - DNA, 25 bp, Homo sapien
gactcgcgcgcccagaagaggggga

SEQ ID NO: 118484 - DNA, 25 bp, Homo sapien
gcgccgagtgctcccccaacgccag

SEQ ID NO: 118485 - DNA, 25 bp, Homo sapien
ttcccattggctgagccgcgccgag

SEQ ID NO: 118486 - DNA, 25 bp, Homo sapien
tcccattggctgagccgcgccgagt

SEQ ID NO: 118487 - DNA, 25 bp, Homo sapien
cccagattagcgactaagaaacctg

SEQ ID NO: 118488 - DNA, 25 bp, Homo sapien
cgactaagaaacctgatttgaaggg

SEQ ID NO: 118489 - DNA, 25 bp, Homo sapien
cgagcactggcttggtatacacagc

SEQ ID NO: 118490 - DNA, 25 bp, Homo sapien
ggcttggtatacacagcacgcgctc

SEQ ID NO: 118491 - DNA, 25 bp, Homo sapien
ctcagtgcctactgtgggtgaccgg

SEQ ID NO: 118492 - DNA, 25 bp, Homo sapien
gggcaacgcctggaccctcgaagac

SEQ ID NO: 118493 - DNA, 25 bp, Homo sapien
aacgcctggaccctcgaagacgagc

SEQ ID NO: 118494 - DNA, 25 bp, Homo sapien
ccacgccgagcactggcttggtata

SEQ ID NO: 118495 - DNA, 25 bp, Homo sapien
tccaccttttagatgtgggcgggga

SEQ ID NO: 118496 - DNA, 25 bp, Homo sapien
gaaattagggggctgtcctcacctc

SEQ ID NO: 118497 - DNA, 25 bp, Homo sapien
aggctcagcccgacaaagcccgggg

SEQ ID NO: 118498 - DNA, 25 bp, Homo sapien
cgatccgagcgcagcgggcaaagtt

SEQ ID NO: 118499 - DNA, 25 bp, Homo sapien
cccgggagcgaagttagagcttgaa

SEQ ID NO: 118500 - DNA, 25 bp, Homo sapien
gaggaatttcaatcccgggagcgaa

SEQ ID NO: 118501 - DNA, 25 bp, Homo sapien
gcgaagctggggaggaatttcaatc

SEQ ID NO: 118502 - DNA, 25 bp, Homo sapien
cgcgcgcagatcgatgggcgaagct

SEQ ID NO: 118503 - DNA, 25 bp, Homo sapien
cgcgatttcggatccgctgggattc

SEQ ID NO: 118504 - DNA, 25 bp, Homo sapien
atccgctgggattccggaggcacat

SEQ ID NO: 118505 - DNA, 25 bp, Homo sapien
ttttagcccacacgaaagccgcagg

SEQ ID NO: 118506 - DNA, 25 bp, Homo sapien
gcgctcttgagcctggtttggaatt

SEQ ID NO: 118507 - DNA, 25 bp, Homo sapien
ttggacccacgtccggacaggagcc

SEQ ID NO: 118508 - DNA, 25 bp, Homo sapien
ttcgtgtccagcaatcccgggagca

SEQ ID NO: 118509 - DNA, 25 bp, Homo sapien
cgtcctgcaggaacaagtgtggtag

SEQ ID NO: 118510 - DNA, 25 bp, Homo sapien
tctccctgccctcttgacggtgtgg

SEQ ID NO: 118511 - DNA, 25 bp, Homo sapien
agccctcaggcagcgtggggatctt

SEQ ID NO: 118512 - DNA, 25 bp, Homo sapien
ggaatacggagtccttcttcctgcc

SEQ ID NO: 118513 - DNA, 25 bp, Homo sapien
ctgagcctgagtggatttgaggatc

SEQ ID NO: 118514 - DNA, 25 bp, Homo sapien
cctggacactcaggtctgagcctga

SEQ ID NO: 118515 - DNA, 25 bp, Homo sapien
acccgcgaagctcctggagcgttta

SEQ ID NO: 118516 - DNA, 25 bp, Homo sapien
ttctcttcccaaactgcacggtggc

SEQ ID NO: 118517 - DNA, 25 bp, Homo sapien
gtccgggtaacagcaggccgccaat

SEQ ID NO: 118518 - DNA, 25 bp, Homo sapien
tccctcttcgatctcggggtgtcgg

SEQ ID NO: 118519 - DNA, 25 bp, Homo sapien
ttttgatggtcagactcagccagcg

SEQ ID NO: 118520 - DNA, 25 bp, Homo sapien
gcgtgctgcgaaattgaaggaagcc

SEQ ID NO: 118521 - DNA, 25 bp, Homo sapien
aaggagcctttacagcgtgctgcga

SEQ ID NO: 118522 - DNA, 25 bp, Homo sapien
ctcagccagcgaggggttcccagct

SEQ ID NO: 118523 - DNA, 25 bp, Homo sapien
gaagccgggcgagcctgcaacgcac

SEQ ID NO: 118524 - DNA, 25 bp, Homo sapien
cgcggcaagttttgatggtcagact

SEQ ID NO: 118525 - DNA, 25 bp, Homo sapien
gctgttagccgagcacgtcctgacc

SEQ ID NO: 118526 - DNA, 25 bp, Homo sapien
gttcccagctgaagacctcggagga

SEQ ID NO: 118527 - DNA, 25 bp, Homo sapien
gagatggcaagagtaagagagtccc

SEQ ID NO: 118528 - DNA, 25 bp, Homo sapien
aagagagtcccgaccggagacgcag

SEQ ID NO: 118529 - DNA, 25 bp, Homo sapien
atggcgagaataggagagtccgacc

SEQ ID NO: 118530 - DNA, 25 bp, Homo sapien
tggcgagagtaagagagtcccgacc

SEQ ID NO: 118531 - DNA, 25 bp, Homo sapien
taagagagtcccgaccggagacgca

SEQ ID NO: 118532 - DNA, 25 bp, Homo sapien
ataggagagtccgaccggagatgca

SEQ ID NO: 118533 - DNA, 25 bp, Homo sapien
cgagagtaagagagtcccgaccgga

SEQ ID NO: 118534 - DNA, 25 bp, Homo sapien
atggcgagagtaagagagtcccgac

SEQ ID NO: 118535 - DNA, 25 bp, Homo sapien
tgctcatcgcctgcttgcgtctgag

SEQ ID NO: 118536 - DNA, 25 bp, Homo sapien
agggaggagtcgcagctgaacagcc

SEQ ID NO: 118537 - DNA, 25 bp, Homo sapien
tccagctgcggctcccttatttagg

SEQ ID NO: 118538 - DNA, 25 bp, Homo sapien
tgcggctcccttatttaggcaagga

SEQ ID NO: 118539 - DNA, 25 bp, Homo sapien
cccttatttaggcaaggaggcctag

SEQ ID NO: 118540 - DNA, 25 bp, Homo sapien
catcgcctgcttgcgtctgagtgag

SEQ ID NO: 118541 - DNA, 25 bp, Homo sapien
ctcggacttagcagtcaggcagggc

SEQ ID NO: 118542 - DNA, 25 bp, Homo sapien
gcggtgtcctcggacttagcagtca

SEQ ID NO: 118543 - DNA, 25 bp, Homo sapien
cctgtgagaccttctgtgtgggaga

SEQ ID NO: 118544 - DNA, 25 bp, Homo sapien
agcaagacgcagtgaagccgcccag

SEQ ID NO: 118545 - DNA, 25 bp, Homo sapien
cggaaaaggtgctgtccttggcgcc

SEQ ID NO: 118546 - DNA, 25 bp, Homo sapien
ggcccagcggccaatccatgaaatg

SEQ ID NO: 118547 - DNA, 25 bp, Homo sapien
cagagaaagagccagccgggtccct

SEQ ID NO: 118548 - DNA, 25 bp, Homo sapien
accaatcaggacgtgcagagaaaga

SEQ ID NO: 118549 - DNA, 25 bp, Homo sapien
tcacgggattaacacgcaccagata

SEQ ID NO: 118550 - DNA, 25 bp, Homo sapien
ccagataaggaacgatgcaccaatc

SEQ ID NO: 118551 - DNA, 25 bp, Homo sapien
cggcgatgttaccatggcaaccaac

SEQ ID NO: 118552 - DNA, 25 bp, Homo sapien
ggccacatgtttgtctgcggcgatg

SEQ ID NO: 118553 - DNA, 25 bp, Homo sapien
gggttcctgctaaggtctccgagtc

SEQ ID NO: 118554 - DNA, 25 bp, Homo sapien
tcgggttctgatccactgtgctctt

SEQ ID NO: 118555 - DNA, 25 bp, Homo sapien
ttccgacaggatcagcaacgctacc

SEQ ID NO: 118556 - DNA, 25 bp, Homo sapien
acccaggaggtgacaagccgcatac

SEQ ID NO: 118557 - DNA, 25 bp, Homo sapien
gcacccagagcttttccttgcagga

SEQ ID NO: 118558 - DNA, 25 bp, Homo sapien
aacttgaccatctctaccgcgacga

SEQ ID NO: 118559 - DNA, 25 bp, Homo sapien
agctcgttgaagtggcgcagctgca

SEQ ID NO: 118560 - DNA, 25 bp, Homo sapien
gcagctccacgtggctatagaagac

SEQ ID NO: 118561 - DNA, 25 bp, Homo sapien
tgcacccgcgaagaaaacgagctgg

SEQ ID NO: 118562 - DNA, 25 bp, Homo sapien
tcgtcgtagacggtgagcacaagca

SEQ ID NO: 118563 - DNA, 25 bp, Homo sapien
acggctagcacgtcctcgtcgtaga

SEQ ID NO: 118564 - DNA, 25 bp, Homo sapien
tcatggcggtgagcacgtgctccac

SEQ ID NO: 118565 - DNA, 25 bp, Homo sapien
tggcactgctcttccggaatgaaag

SEQ ID NO: 118566 - DNA, 25 bp, Homo sapien
agcagcaggtcgacattgagcgcca

SEQ ID NO: 118567 - DNA, 25 bp, Homo sapien
tgagacgacgggacatctagagatc

SEQ ID NO: 118568 - DNA, 25 bp, Homo sapien
ggggctgacaacatatcctccaatc

SEQ ID NO: 118569 - DNA, 25 bp, Homo sapien
ggcggataggcgattccctccaatc

SEQ ID NO: 118570 - DNA, 25 bp, Homo sapien
ggcgggagccaacatagagccctca

SEQ ID NO: 118571 - DNA, 25 bp, Homo sapien
tgaaactgctattgccggcggctcc

SEQ ID NO: 118572 - DNA, 25 bp, Homo sapien
gctgacgcgttactatggatactcc

SEQ ID NO: 118573 - DNA, 25 bp, Homo sapien
ccgcgtcagcatgctggtgcattta

SEQ ID NO: 118574 - DNA, 25 bp, Homo sapien
cggctcctgttttaccgcgtcagca

SEQ ID NO: 118575 - DNA, 25 bp, Homo sapien
ggtaattgcccaccggctcagcact

SEQ ID NO: 118576 - DNA, 25 bp, Homo sapien
agcccttatcaagcagcccacggtg

SEQ ID NO: 118577 - DNA, 25 bp, Homo sapien
agcccacggtgctgatactggatga

SEQ ID NO: 118578 - DNA, 25 bp, Homo sapien
ggggcccactgcattgtcgtcatgg

SEQ ID NO: 118579 - DNA, 25 bp, Homo sapien
aggccgcacggtgctggtaattgcc

SEQ ID NO: 118580 - DNA, 25 bp, Homo sapien
atgcagagtccgagcgggttgtaca

SEQ ID NO: 118581 - DNA, 25 bp, Homo sapien
taccagcgcgctggatgcagagtcc

SEQ ID NO: 118582 - DNA, 25 bp, Homo sapien
atactggatgaagctaccagcgcgc

SEQ ID NO: 118583 - DNA, 25 bp, Homo sapien
acatccgcgtgttcgccagcaactg

SEQ ID NO: 118584 - DNA, 25 bp, Homo sapien
ggctgtcaccctgtgcaacatcaac

SEQ ID NO: 118585 - DNA, 25 bp, Homo sapien
actgccctggatgagcgagaaagcc

SEQ ID NO: 118586 - DNA, 25 bp, Homo sapien
tgcgctactacagggagttccacca

SEQ ID NO: 118587 - DNA, 25 bp, Homo sapien
accttcctctaccaggtggctgaga

SEQ ID NO: 118588 - DNA, 25 bp, Homo sapien
agcaactgctcgatgcacgggctgg

SEQ ID NO: 118589 - DNA, 25 bp, Homo sapien
ccaacgacctgcactgggctgggtc

SEQ ID NO: 118590 - DNA, 25 bp, Homo sapien
ccgtggtcctgtcagtggccacctt

SEQ ID NO: 118591 - DNA, 25 bp, Homo sapien
aacccgctacgtggctcggaagtgc

SEQ ID NO: 118592 - DNA, 25 bp, Homo sapien
tggcccggaagctcaaccgcagcga

SEQ ID NO: 118593 - DNA, 25 bp, Homo sapien
gcgctacgccaaggagctctccatg

SEQ ID NO: 118594 - DNA, 25 bp, Homo sapien
tgccatgcttcgcaaggactcgtgc

SEQ ID NO: 118595 - DNA, 25 bp, Homo sapien
agaactgtgcccacccggccatagg

SEQ ID NO: 118596 - DNA, 25 bp, Homo sapien
cggctgccgaatggtgtacatgcca

SEQ ID NO: 118597 - DNA, 25 bp, Homo sapien
cagcgaggcctacatcgcgtgagct

SEQ ID NO: 118598 - DNA, 25 bp, Homo sapien
agctgaggctgcttctaaagccatc

SEQ ID NO: 118599 - DNA, 25 bp, Homo sapien
cgcgttccagaatgcagcggaaatg

SEQ ID NO: 118600 - DNA, 25 bp, Homo sapien
tgtagtcctaaaacgactaggtctc

SEQ ID NO: 118601 - DNA, 25 bp, Homo sapien
ggctccgtttctaccgcggaggcaa

SEQ ID NO: 118602 - DNA, 25 bp, Homo sapien
ccgcggaggcaaaccttggacttca

SEQ ID NO: 118603 - DNA, 25 bp, Homo sapien
caagtcccaggaagcaacgcgtgtc

SEQ ID NO: 118604 - DNA, 25 bp, Homo sapien
gttattccttttatgtgctcccagc

SEQ ID NO: 118605 - DNA, 25 bp, Homo sapien
agcactcgactccagggctccgttt

SEQ ID NO: 118606 - DNA, 25 bp, Homo sapien
cccgagaccgaggacaagaagacta

SEQ ID NO: 118607 - DNA, 25 bp, Homo sapien
tttccttgtgcctgcgttttgctgc

SEQ ID NO: 118608 - DNA, 25 bp, Homo sapien
gttttgctgcctgggatccctagcg

SEQ ID NO: 118609 - DNA, 25 bp, Homo sapien
cgtaatggagccaagggacggcatc

SEQ ID NO: 118610 - DNA, 25 bp, Homo sapien
ctcagaggtgccgtaatggagccaa

SEQ ID NO: 118611 - DNA, 25 bp, Homo sapien
caagggacggcatcctcggggctcc

SEQ ID NO: 118612 - DNA, 25 bp, Homo sapien
aagggctcctttacactcagaggtg

SEQ ID NO: 118613 - DNA, 25 bp, Homo sapien
ccctagcgtgagaagggctccttta

SEQ ID NO: 118614 - DNA, 25 bp, Homo sapien
cccgaatttccttgtgcctgcgttt

SEQ ID NO: 118615 - DNA, 25 bp, Homo sapien
tgcggtctccgtgcaaccgaacttg

SEQ ID NO: 118616 - DNA, 25 bp, Homo sapien
tacggacttcctattggcccagaca

SEQ ID NO: 118617 - DNA, 25 bp, Homo sapien
gcctgtccgtcacgtttaagccttg

SEQ ID NO: 118618 - DNA, 25 bp, Homo sapien
ctgtggctcgcagttattggctgtc

SEQ ID NO: 118619 - DNA, 25 bp, Homo sapien
cattcacccgagtagcacgtgtctc

SEQ ID NO: 118620 - DNA, 25 bp, Homo sapien
cgtgtctcccgaagctgcaagcaca

SEQ ID NO: 118621 - DNA, 25 bp, Homo sapien
gcgcgcgcgacccttacataagcgt

SEQ ID NO: 118622 - DNA, 25 bp, Homo sapien
aggcatcccggctagacgcagatac

SEQ ID NO: 118623 - DNA, 25 bp, Homo sapien
ctggcggctgctgagcaaacagcac

SEQ ID NO: 118624 - DNA, 25 bp, Homo sapien
cctctccaggagcaattgtttatct

SEQ ID NO: 118625 - DNA, 25 bp, Homo sapien
catttgaagtcatgcctcacacggg

SEQ ID NO: 118626 - DNA, 25 bp, Homo sapien
gagcaaacagcacgagctaatcagc

SEQ ID NO: 118627 - DNA, 25 bp, Homo sapien
ccgtccagagatcagctggcggctg

SEQ ID NO: 118628 - DNA, 25 bp, Homo sapien
ctggcatgttgagccgccgtccaga

SEQ ID NO: 118629 - DNA, 25 bp, Homo sapien
tttatctgccagagggtgacaggcg

SEQ ID NO: 118630 - DNA, 25 bp, Homo sapien
atcagcaaaaggtcacgccggctcc

SEQ ID NO: 118631 - DNA, 25 bp, Homo sapien
agcccggagagttggacctgactcc

SEQ ID NO: 118632 - DNA, 25 bp, Homo sapien
agaggcggcactgcctgaaacccag

SEQ ID NO: 118633 - DNA, 25 bp, Homo sapien
ccggagagttggacctgactcccgg

SEQ ID NO: 118634 - DNA, 25 bp, Homo sapien
aagatgagcccggagagttggacct

SEQ ID NO: 118635 - DNA, 25 bp, Homo sapien
gtaaggtcggacaaggggtcagaca

SEQ ID NO: 118636 - DNA, 25 bp, Homo sapien
atctccgggttgagaggcgaagcca

SEQ ID NO: 118637 - DNA, 25 bp, Homo sapien
gcatagtccttcagtcccgtccggg

SEQ ID NO: 118638 - DNA, 25 bp, Homo sapien
ttgtccaggcgggaagttctgtgct

SEQ ID NO: 118639 - DNA, 25 bp, Homo sapien
ttgaggaatttcagccgtagcacga

SEQ ID NO: 118640 - DNA, 25 bp, Homo sapien
tctgccaggggaacaagtacagttg

SEQ ID NO: 118641 - DNA, 25 bp, Homo sapien
gtacagttgtgatctggggcgctca

SEQ ID NO: 118642 - DNA, 25 bp, Homo sapien
ctggccacctgctctgaatcattga

SEQ ID NO: 118643 - DNA, 25 bp, Homo sapien
tgcagcttgacctctgtgtctcagg

SEQ ID NO: 118644 - DNA, 25 bp, Homo sapien
ttcaatcagggtcatggcgcctgcc

SEQ ID NO: 118645 - DNA, 25 bp, Homo sapien
ccttttcaaggagccaatggtgtcg

SEQ ID NO: 118646 - DNA, 25 bp, Homo sapien
agcagctgcccttggtagatgagtc

SEQ ID NO: 118647 - DNA, 25 bp, Homo sapien
cgggacgctgtaagcgaggagcagc

SEQ ID NO: 118648 - DNA, 25 bp, Homo sapien
cccagatcagcgcagggaggcgaaa

SEQ ID NO: 118649 - DNA, 25 bp, Homo sapien
tgggcggactcctcggccaatcagc

SEQ ID NO: 118650 - DNA, 25 bp, Homo sapien
actcctcggccaatcagcctcggtc

SEQ ID NO: 118651 - DNA, 25 bp, Homo sapien
cgcagggcactgtttgggcattgcc

SEQ ID NO: 118652 - DNA, 25 bp, Homo sapien
agggcactgtttgggcattgcctag

SEQ ID NO: 118653 - DNA, 25 bp, Homo sapien
ggaggcgaaagcgacagccgggcgc

SEQ ID NO: 118654 - DNA, 25 bp, Homo sapien
cactgaaggcgggacgctgtaagcg

SEQ ID NO: 118655 - DNA, 25 bp, Homo sapien
tctacgacctgatcgagcgcatcga

SEQ ID NO: 118656 - DNA, 25 bp, Homo sapien
catcgaggatttggcgctgcagaac

SEQ ID NO: 118657 - DNA, 25 bp, Homo sapien
ggctccgaagccatgaacttccagg

SEQ ID NO: 118658 - DNA, 25 bp, Homo sapien
ggggttttctgctgactgtgttcca

SEQ ID NO: 118659 - DNA, 25 bp, Homo sapien
cacgtcatctccatcgagggtgagc

SEQ ID NO: 118660 - DNA, 25 bp, Homo sapien
acgaggtttgccgatctgtgttgca

SEQ ID NO: 118661 - DNA, 25 bp, Homo sapien
cgccatatctcgttcggggacactt

SEQ ID NO: 118662 - DNA, 25 bp, Homo sapien
tcgagtccgtgcatcccaatatcta

SEQ ID NO: 118663 - DNA, 25 bp, Homo sapien
ggcagcgccttcagcgactactcgt

SEQ ID NO: 118664 - DNA, 25 bp, Homo sapien
gcggcgctccaacatcttcacggta

SEQ ID NO: 118665 - DNA, 25 bp, Homo sapien
tccttaggccacgaatggcggcggc

SEQ ID NO: 118666 - DNA, 25 bp, Homo sapien
tccgaaagcagtccaagcggcgctc

SEQ ID NO: 118667 - DNA, 25 bp, Homo sapien
cgagaccatcgctgcctcctccacc

SEQ ID NO: 118668 - DNA, 25 bp, Homo sapien
ccagcgggagctgcgcatcgagacc

SEQ ID NO: 118669 - DNA, 25 bp, Homo sapien
atcagccagcgggagctgcgcatcg

SEQ ID NO: 118670 - DNA, 25 bp, Homo sapien
gccctctttgtccttaggccacgaa

SEQ ID NO: 118671 - DNA, 25 bp, Homo sapien
ctgcaggctcgctgcatggagaaga

SEQ ID NO: 118672 - DNA, 25 bp, Homo sapien
tctgcccgctcacttgtggactttg

SEQ ID NO: 118673 - DNA, 25 bp, Homo sapien
gctcagtgacctgtgctgctctgta

SEQ ID NO: 118674 - DNA, 25 bp, Homo sapien
gccctgggactgctctcagatgaga

SEQ ID NO: 118675 - DNA, 25 bp, Homo sapien
cggcctctctgtccttgctcttttg

SEQ ID NO: 118676 - DNA, 25 bp, Homo sapien
ctaggatccgcattcgggtggactc

SEQ ID NO: 118677 - DNA, 25 bp, Homo sapien
ctgctctgtatggtgccgtgtgtaa

SEQ ID NO: 118678 - DNA, 25 bp, Homo sapien
cccgttggaatactcgtggtctcag

SEQ ID NO: 118679 - DNA, 25 bp, Homo sapien
cccggctaacgagcgtcattacagc

SEQ ID NO: 118680 - DNA, 25 bp, Homo sapien
cgttctgtaacgatcgctcgctagg

SEQ ID NO: 118681 - DNA, 25 bp, Homo sapien
gggcgcgtccgttctcttcttccag

SEQ ID NO: 118682 - DNA, 25 bp, Homo sapien
tcagttgccatttgcattcccaatc

SEQ ID NO: 118683 - DNA, 25 bp, Homo sapien
cctgtagcttctttggagagggagt

SEQ ID NO: 118684 - DNA, 25 bp, Homo sapien
cgatcacattctctgcgaggaggga

SEQ ID NO: 118685 - DNA, 25 bp, Homo sapien
ttcccgccctgactgtcggagaaac

SEQ ID NO: 118686 - DNA, 25 bp, Homo sapien
ccggactccgcaattaagtcggctg

SEQ ID NO: 118687 - DNA, 25 bp, Homo sapien
cccgctgcatcttgttcggagctgc

SEQ ID NO: 118688 - DNA, 25 bp, Homo sapien
ggactcatccatcttcctcaaatta

SEQ ID NO: 118689 - DNA, 25 bp, Homo sapien
gtcagcgccaccatcgagggcacag

SEQ ID NO: 118690 - DNA, 25 bp, Homo sapien
cctctctctcataaggagggagggg

SEQ ID NO: 118691 - DNA, 25 bp, Homo sapien
ttgtgaaagtttgcggccgacgaga

SEQ ID NO: 118692 - DNA, 25 bp, Homo sapien
gcggcccaaccaactattattaatg

SEQ ID NO: 118693 - DNA, 25 bp, Homo sapien
ccggacacgccgctttgtgaaagtt

SEQ ID NO: 118694 - DNA, 25 bp, Homo sapien
ctcctggggcccgtagaaagcgtcg

SEQ ID NO: 118695 - DNA, 25 bp, Homo sapien
tggcagcagcgcacaactgcgggca

SEQ ID NO: 118696 - DNA, 25 bp, Homo sapien
gggcaaagaaaccactaacggagca

SEQ ID NO: 118697 - DNA, 25 bp, Homo sapien
taacggagcatccaagggcgagcgc

SEQ ID NO: 118698 - DNA, 25 bp, Homo sapien
gcgggacgcctctagatgcttaact

SEQ ID NO: 118699 - DNA, 25 bp, Homo sapien
tgcttaactgtgaatgcactgtttg

SEQ ID NO: 118700 - DNA, 25 bp, Homo sapien
tgagtgtcttaacgtctagtgtgcg

SEQ ID NO: 118701 - DNA, 25 bp, Homo sapien
tgtacagtatgtatgagcccgcgcg

SEQ ID NO: 118702 - DNA, 25 bp, Homo sapien
ccgcgcgttcacacgcgggtaggtt

SEQ ID NO: 118703 - DNA, 25 bp, Homo sapien
gccgcgcttgcacacgaacgaatgc

SEQ ID NO: 118704 - DNA, 25 bp, Homo sapien
gccgtgtgaagagccagatatgacc

SEQ ID NO: 118705 - DNA, 25 bp, Homo sapien
caatctggaggggaacgttgcaccc

SEQ ID NO: 118706 - DNA, 25 bp, Homo sapien
actttcgcattcagcgccctgactg

SEQ ID NO: 118707 - DNA, 25 bp, Homo sapien
ggatcgcaccctgatcgcggacgca

SEQ ID NO: 118708 - DNA, 25 bp, Homo sapien
gcgctcgagcttgtcactttaaatt

SEQ ID NO: 118709 - DNA, 25 bp, Homo sapien
atcccggacgcgcttggggatctcc

SEQ ID NO: 118710 - DNA, 25 bp, Homo sapien
tgcaggaaccgtcccaatctggagg

SEQ ID NO: 118711 - DNA, 25 bp, Homo sapien
aaaccatcgagcactagggcgtccc

SEQ ID NO: 118712 - DNA, 25 bp, Homo sapien
cctggaacggctgcggaacaaacca

SEQ ID NO: 118713 - DNA, 25 bp, Homo sapien
ctactcaggtctcaggctaaatgtc

SEQ ID NO: 118714 - DNA, 25 bp, Homo sapien
aggtttccctgtcaccgactgccaa

SEQ ID NO: 118715 - DNA, 25 bp, Homo sapien
gcgagtcgccctagacagcgctatt

SEQ ID NO: 118716 - DNA, 25 bp, Homo sapien
tccaagccaaaaacctgcgagtcgc

SEQ ID NO: 118717 - DNA, 25 bp, Homo sapien
agcaacggccttctgcttcccgtta

SEQ ID NO: 118718 - DNA, 25 bp, Homo sapien
gcgccctagtacctgaagccagaca

SEQ ID NO: 118719 - DNA, 25 bp, Homo sapien
gtcaagcagctcactcagaactcgg

SEQ ID NO: 118720 - DNA, 25 bp, Homo sapien
tcatcgagctcaagtacgggccaga

SEQ ID NO: 118721 - DNA, 25 bp, Homo sapien
ggcagcctcaagaagaccatcatcg

SEQ ID NO: 118722 - DNA, 25 bp, Homo sapien
tccaccgtgtccaggctgaccaagg

SEQ ID NO: 118723 - DNA, 25 bp, Homo sapien
gggcagctacatggaggttcgaacc

SEQ ID NO: 118724 - DNA, 25 bp, Homo sapien
cctgtgccgatgatgagtgcttctc

SEQ ID NO: 118725 - DNA, 25 bp, Homo sapien
tgcatcgacgcgctcaagtccgagt

SEQ ID NO: 118726 - DNA, 25 bp, Homo sapien
aggagatccgtctgaccaacctgtt

SEQ ID NO: 118727 - DNA, 25 bp, Homo sapien
ctgcgcacacgtactggggtgagct

SEQ ID NO: 118728 - DNA, 25 bp, Homo sapien
gcgcaggttcgagcagaagctgctc

SEQ ID NO: 118729 - DNA, 25 bp, Homo sapien
ctcccagaggcgctggtaagctctg

SEQ ID NO: 118730 - DNA, 25 bp, Homo sapien
cctgtactggaaggactgccgctcc

SEQ ID NO: 118731 - DNA, 25 bp, Homo sapien
caggtagagcgatgcgagcctgtac

SEQ ID NO: 118732 - DNA, 25 bp, Homo sapien
accatctggtcatagacggtgtcga

SEQ ID NO: 118733 - DNA, 25 bp, Homo sapien
cggtccaggcagtggttctcacaca

SEQ ID NO: 118734 - DNA, 25 bp, Homo sapien
ggggtgagcttgaaatcctgcagca

SEQ ID NO: 118735 - DNA, 25 bp, Homo sapien
gcgggattagagtccaagagctctc

SEQ ID NO: 118736 - DNA, 25 bp, Homo sapien
acagagctgctccttaggatcctcc

SEQ ID NO: 118737 - DNA, 25 bp, Homo sapien
agtcctcaagttgcagcggccaaga

SEQ ID NO: 118738 - DNA, 25 bp, Homo sapien
cggccaagagtgagacccgccttga

SEQ ID NO: 118739 - DNA, 25 bp, Homo sapien
gctgctcggcctatgtcgcaacaga

SEQ ID NO: 118740 - DNA, 25 bp, Homo sapien
actatgtatcccacagacctcgcgg

SEQ ID NO: 118741 - DNA, 25 bp, Homo sapien
aagagctctctgctagcgggcgcac

SEQ ID NO: 118742 - DNA, 25 bp, Homo sapien
cccgccttgaggactactatgtatc

SEQ ID NO: 118743 - DNA, 25 bp, Homo sapien
tcgggtcttcgttctagggctagac

SEQ ID NO: 118744 - DNA, 25 bp, Homo sapien
ctagggctagacttggtctctgatc

SEQ ID NO: 118745 - DNA, 25 bp, Homo sapien
tctgttttgagacgaacggcgaaga

SEQ ID NO: 118746 - DNA, 25 bp, Homo sapien
cggtgacgtggccagtttatttctg

SEQ ID NO: 118747 - DNA, 25 bp, Homo sapien
agaacgacccgagctggtctcccga

SEQ ID NO: 118748 - DNA, 25 bp, Homo sapien
ccatagagacgggtgactgacaggc

SEQ ID NO: 118749 - DNA, 25 bp, Homo sapien
ccgtgggagcgaccatagagaacgc

SEQ ID NO: 118750 - DNA, 25 bp, Homo sapien
tctctgatcgccgagaggtagcgca

SEQ ID NO: 118751 - DNA, 25 bp, Homo sapien
ctggagcagctcaatcggcgctatc

SEQ ID NO: 118752 - DNA, 25 bp, Homo sapien
cctgctgttggaatgtgtgacacag

SEQ ID NO: 118753 - DNA, 25 bp, Homo sapien
ggcatggagtacaccctggacctgc

SEQ ID NO: 118754 - DNA, 25 bp, Homo sapien
ttcgacccagcacggggcatggagt

SEQ ID NO: 118755 - DNA, 25 bp, Homo sapien
gctcaacggctatcggcgcttcgac

SEQ ID NO: 118756 - DNA, 25 bp, Homo sapien
cctgcgcttccagaagcagcgactg

SEQ ID NO: 118757 - DNA, 25 bp, Homo sapien
atgcgttggagactgccctggagca

SEQ ID NO: 118758 - DNA, 25 bp, Homo sapien
agcagcgactgctcaacggctatcg

SEQ ID NO: 118759 - DNA, 25 bp, Homo sapien
accgcacagggcattgcgagcctcg

SEQ ID NO: 118760 - DNA, 25 bp, Homo sapien
gaagctaactgaagccaggcaccgc

SEQ ID NO: 118761 - DNA, 25 bp, Homo sapien
cagaccctcggctggtgaccctgag

SEQ ID NO: 118762 - DNA, 25 bp, Homo sapien
gggaagcctcgctccctgctaatca

SEQ ID NO: 118763 - DNA, 25 bp, Homo sapien
cccagagggcattcgacccgggaag

SEQ ID NO: 118764 - DNA, 25 bp, Homo sapien
ccgtgggcacacaaaagaatcaggc

SEQ ID NO: 118765 - DNA, 25 bp, Homo sapien
agcctgtctctaccgtgggcacaca

SEQ ID NO: 118766 - DNA, 25 bp, Homo sapien
tactcgcttacctggtccctgcggg

SEQ ID NO: 118767 - DNA, 25 bp, Homo sapien
taagacagaaatagtccggcggccc

SEQ ID NO: 118768 - DNA, 25 bp, Homo sapien
cccatggaccagaaactcaaaaagt

SEQ ID NO: 118769 - DNA, 25 bp, Homo sapien
agtttgcttttcgtggctttgcgcg

SEQ ID NO: 118770 - DNA, 25 bp, Homo sapien
ctctgagtcctgctgggctctctca

SEQ ID NO: 118771 - DNA, 25 bp, Homo sapien
ctcacacttctactcgagcggagtg

SEQ ID NO: 118772 - DNA, 25 bp, Homo sapien
cgcattcctgcactgataagacaga

SEQ ID NO: 118773 - DNA, 25 bp, Homo sapien
ccggctctcgccacaaatagtttct

SEQ ID NO: 118774 - DNA, 25 bp, Homo sapien
ttctccgtcagggaattcgccggcc

SEQ ID NO: 118775 - DNA, 25 bp, Homo sapien
tgccacgccgccgatggctcctgcg

SEQ ID NO: 118776 - DNA, 25 bp, Homo sapien
ccgggaagagcgtggattcctccca

SEQ ID NO: 118777 - DNA, 25 bp, Homo sapien
agcgtggattcctcccagcgcaata

SEQ ID NO: 118778 - DNA, 25 bp, Homo sapien
ggattcctcccagcgcaatagggcg

SEQ ID NO: 118779 - DNA, 25 bp, Homo sapien
cgcacttggggcaggccgtgcgcct

SEQ ID NO: 118780 - DNA, 25 bp, Homo sapien
atcgctccttccctcgctgaagcac

SEQ ID NO: 118781 - DNA, 25 bp, Homo sapien
agcaccaaatggcaaagcgccgctc

SEQ ID NO: 118782 - DNA, 25 bp, Homo sapien
accaccagcaccaaatggcaaagcg

SEQ ID NO: 118783 - DNA, 25 bp, Homo sapien
ttcagggacctagacggcctggaga

SEQ ID NO: 118784 - DNA, 25 bp, Homo sapien
atggtcttcgccgatggggccttcc

SEQ ID NO: 118785 - DNA, 25 bp, Homo sapien
agacgtcgctgctgatggtcttcgc

SEQ ID NO: 118786 - DNA, 25 bp, Homo sapien
cgcagtctgggtctctgcgccgcag

SEQ ID NO: 118787 - DNA, 25 bp, Homo sapien
tttcttcagggacctagacggcctg

SEQ ID NO: 118788 - DNA, 25 bp, Homo sapien
ggcagcgtttcttcagggacctaga

SEQ ID NO: 118789 - DNA, 25 bp, Homo sapien
acagtaggtgctcgggcagcgtttc

SEQ ID NO: 118790 - DNA, 25 bp, Homo sapien
gccaccaggcgtgcggtccgtcaag

SEQ ID NO: 118791 - DNA, 25 bp, Homo sapien
tgcttgcatctgcacgcccacgagt

SEQ ID NO: 118792 - DNA, 25 bp, Homo sapien
tgtgtggccgcagacatcacctaca

SEQ ID NO: 118793 - DNA, 25 bp, Homo sapien
acgagtcacacacgcagtcagcatc

SEQ ID NO: 118794 - DNA, 25 bp, Homo sapien
ggccagacccgttgtgatcttcagc

SEQ ID NO: 118795 - DNA, 25 bp, Homo sapien
acagatgtgtcgtaggcctgtgctt

SEQ ID NO: 118796 - DNA, 25 bp, Homo sapien
tcttcagcctgtacacagatgtgtc

SEQ ID NO: 118797 - DNA, 25 bp, Homo sapien
cgtctgcaaagagcgaggagcttaa

SEQ ID NO: 118798 - DNA, 25 bp, Homo sapien
agtcagcatcctgtgtggccgcaga

SEQ ID NO: 118799 - DNA, 25 bp, Homo sapien
tcctctgtgtggatgacaggtcacg

SEQ ID NO: 118800 - DNA, 25 bp, Homo sapien
ggcccgcggaatcagccgctgagca

SEQ ID NO: 118801 - DNA, 25 bp, Homo sapien
tctcccagggtccacctcggattct

SEQ ID NO: 118802 - DNA, 25 bp, Homo sapien
ccgacagtcctctgtgtggatgaca

SEQ ID NO: 118803 - DNA, 25 bp, Homo sapien
gcgcgtacggcacggccaagcaact

SEQ ID NO: 118804 - DNA, 25 bp, Homo sapien
acgacttgacgatggcggggtcctc

SEQ ID NO: 118805 - DNA, 25 bp, Homo sapien
tgacaggtcacgacttgacgatggc

SEQ ID NO: 118806 - DNA, 25 bp, Homo sapien
ctactcccgtcagaggccacttggc

SEQ ID NO: 118807 - DNA, 25 bp, Homo sapien
tctttgtcgaagctgtcatctgtgg

SEQ ID NO: 118808 - DNA, 25 bp, Homo sapien
cccgttttatgtgtgagtctttctg

SEQ ID NO: 118809 - DNA, 25 bp, Homo sapien
tctgcgtgagaacccggaattcttc

SEQ ID NO: 118810 - DNA, 25 bp, Homo sapien
gcagaatgtctttgcggagccgaga

SEQ ID NO: 118811 - DNA, 25 bp, Homo sapien
ggtcctgccgagcacaagacacgtc

SEQ ID NO: 118812 - DNA, 25 bp, Homo sapien
tctccggtgacacgataactcggtc

SEQ ID NO: 118813 - DNA, 25 bp, Homo sapien
acccgccgcttgaagtctccggtga

SEQ ID NO: 118814 - DNA, 25 bp, Homo sapien
cgcgggttgagcagtgaaaagccac

SEQ ID NO: 118815 - DNA, 25 bp, Homo sapien
agcagccatgcgtggagctgggccg

SEQ ID NO: 118816 - DNA, 25 bp, Homo sapien
cccggtccgactgggcacctctcct

SEQ ID NO: 118817 - DNA, 25 bp, Homo sapien
gacacggcggccgagtgtcctcgac

SEQ ID NO: 118818 - DNA, 25 bp, Homo sapien
cactctgctggtcgcggcgggagtg

SEQ ID NO: 118819 - DNA, 25 bp, Homo sapien
atccgggcactctgctggtcgcggc

SEQ ID NO: 118820 - DNA, 25 bp, Homo sapien
gcatccgggcactctgctggtcgcg

SEQ ID NO: 118821 - DNA, 25 bp, Homo sapien
ccgctgccgcatccgggcactctgc

SEQ ID NO: 118822 - DNA, 25 bp, Homo sapien
cgggcttcgggacgcgctggccgtt

SEQ ID NO: 118823 - DNA, 25 bp, Homo sapien
cgtcctcattaacggatcggcactc

SEQ ID NO: 118824 - DNA, 25 bp, Homo sapien
accttgttgctgaagagccgcgaga

SEQ ID NO: 118825 - DNA, 25 bp, Homo sapien
cctacctggatgcagttgatgatga

SEQ ID NO: 118826 - DNA, 25 bp, Homo sapien
gcccgtgaacactgcggacacacag

SEQ ID NO: 118827 - DNA, 25 bp, Homo sapien
ctgaggctcatatgggaagtggaca

SEQ ID NO: 118828 - DNA, 25 bp, Homo sapien
cggttattctgctccaccctgcaga

SEQ ID NO: 118829 - DNA, 25 bp, Homo sapien
gtgaagttggtttccgtgcctgctt

SEQ ID NO: 118830 - DNA, 25 bp, Homo sapien
ctggggataatcgtcaggtcctcga

SEQ ID NO: 118831 - DNA, 25 bp, Homo sapien
taggctagggtcagcacgcagttgc

SEQ ID NO: 118832 - DNA, 25 bp, Homo sapien
taggcacagcactgcacccgtgtgg

SEQ ID NO: 118833 - DNA, 25 bp, Homo sapien
ccggtgctcccggaacacccgcagc

SEQ ID NO: 118834 - DNA, 25 bp, Homo sapien
tgtctagcactaggcacagcactgc

SEQ ID NO: 118835 - DNA, 25 bp, Homo sapien
ccacaccttggctgtgccatctgtg

SEQ ID NO: 118836 - DNA, 25 bp, Homo sapien
gccatctgtgctgccggtcaccaga

SEQ ID NO: 118837 - DNA, 25 bp, Homo sapien
tctgtgctgccggtcaccagaagcc

SEQ ID NO: 118838 - DNA, 25 bp, Homo sapien
ccgggcgtgtctagcactaggcaca

SEQ ID NO: 118839 - DNA, 25 bp, Homo sapien
ggaacaatacggtccagcctggctc

SEQ ID NO: 118840 - DNA, 25 bp, Homo sapien
ccgggaactcatttggggcgcagct

SEQ ID NO: 118841 - DNA, 25 bp, Homo sapien
gccgagcgcggaacaatacggtcca

SEQ ID NO: 118842 - DNA, 25 bp, Homo sapien
cagctgcgtctctggtgcacaagga

SEQ ID NO: 118843 - DNA, 25 bp, Homo sapien
caccgggcgaacaaggcagctgcgt

SEQ ID NO: 118844 - DNA, 25 bp, Homo sapien
gggctcaggctcagccagttgatgc

SEQ ID NO: 118845 - DNA, 25 bp, Homo sapien
gacctccgccctgggtagagtcctg

SEQ ID NO: 118846 - DNA, 25 bp, Homo sapien
tgagccctaaggactctgcccgagg

SEQ ID NO: 118847 - DNA, 25 bp, Homo sapien
gctggaagaagttgaccaccttgtg

SEQ ID NO: 118848 - DNA, 25 bp, Homo sapien
accaccttgtggagcgactgcactc

SEQ ID NO: 118849 - DNA, 25 bp, Homo sapien
gctcggctggaagaagttgaccacc

SEQ ID NO: 118850 - DNA, 25 bp, Homo sapien
ttatcgcccaaggtcccgaggtctg

SEQ ID NO: 118851 - DNA, 25 bp, Homo sapien
ttgaggacttttatcgcccaaggtc

SEQ ID NO: 118852 - DNA, 25 bp, Homo sapien
ccgttggctttgaggacttttatcg

SEQ ID NO: 118853 - DNA, 25 bp, Homo sapien
aagctgcggaagtcgccactctcca

SEQ ID NO: 118854 - DNA, 25 bp, Homo sapien
gactgcactcgtgcgctgtgggcct

SEQ ID NO: 118855 - DNA, 25 bp, Homo sapien
ccgcgtttagctcccgagcctcctt

SEQ ID NO: 118856 - DNA, 25 bp, Homo sapien
ttccttggggttgagggacgcactc

SEQ ID NO: 118857 - DNA, 25 bp, Homo sapien
ggttgagggacgcactcaccttccc

SEQ ID NO: 118858 - DNA, 25 bp, Homo sapien
cccggacaaaagatttgctgggccg

SEQ ID NO: 118859 - DNA, 25 bp, Homo sapien
gacaaaagatttgctgggccggccc

SEQ ID NO: 118860 - DNA, 25 bp, Homo sapien
tgctgtcgggcgtgctaagcccgag

SEQ ID NO: 118861 - DNA, 25 bp, Homo sapien
gtgctctccgcgtttagctcccgag

SEQ ID NO: 118862 - DNA, 25 bp, Homo sapien
ccaccctgtgccaccgcgagtgcag

SEQ ID NO: 118863 - DNA, 25 bp, Homo sapien
agactagactccgtccgcggtccag

SEQ ID NO: 118864 - DNA, 25 bp, Homo sapien
caccctgaaagccagcgaggttcgg

SEQ ID NO: 118865 - DNA, 25 bp, Homo sapien
ctccgctagcgaagcgcagttcgtg

SEQ ID NO: 118866 - DNA, 25 bp, Homo sapien
aataaatgcgcgaaggccagcaccg

SEQ ID NO: 118867 - DNA, 25 bp, Homo sapien
gacccagcttgtgccctggcgtcgt

SEQ ID NO: 118868 - DNA, 25 bp, Homo sapien
cgtctgcaagtgagcccgtctgcaa

SEQ ID NO: 118869 - DNA, 25 bp, Homo sapien
aatgaaagttgctgaagcctgaccc

SEQ ID NO: 118870 - DNA, 25 bp, Homo sapien
taaagagcccggttaggctgagtcc

SEQ ID NO: 118871 - DNA, 25 bp, Homo sapien
tgctcggctcggctccatgacaacg

SEQ ID NO: 118872 - DNA, 25 bp, Homo sapien
tcagcagccgcggtcgcaacttctg

SEQ ID NO: 118873 - DNA, 25 bp, Homo sapien
gtcgcaacttctggcggcggattac

SEQ ID NO: 118874 - DNA, 25 bp, Homo sapien
gtccctaggctgtgaccgccgaact

SEQ ID NO: 118875 - DNA, 25 bp, Homo sapien
cggcggattacccagggcttttgcg

SEQ ID NO: 118876 - DNA, 25 bp, Homo sapien
acccagggcttttgcgtggtgacct

SEQ ID NO: 118877 - DNA, 25 bp, Homo sapien
gctggacccggtccctaggctgtga

SEQ ID NO: 118878 - DNA, 25 bp, Homo sapien
gtggcctacctcgagtgctcggctc

SEQ ID NO: 118879 - DNA, 25 bp, Homo sapien
tcggaaactccatctcccattgggg

SEQ ID NO: 118880 - DNA, 25 bp, Homo sapien
tgcccgcccgggagctaaaaataca

SEQ ID NO: 118881 - DNA, 25 bp, Homo sapien
cgccggctaggtttgaaggcttcaa

SEQ ID NO: 118882 - DNA, 25 bp, Homo sapien
gagacaaacggtggctccctggtga

SEQ ID NO: 118883 - DNA, 25 bp, Homo sapien
ctccctggtgattggccagaacgga

SEQ ID NO: 118884 - DNA, 25 bp, Homo sapien
ttctccttgagctgcgttagcgttc

SEQ ID NO: 118885 - DNA, 25 bp, Homo sapien
ccgcgcgatgacgtgtcggaaactc

SEQ ID NO: 118886 - DNA, 25 bp, Homo sapien
gcgccgattggacagctcctgcaca

SEQ ID NO: 118887 - DNA, 25 bp, Homo sapien
gctccgtcctcaccgcacacggagg

SEQ ID NO: 118888 - DNA, 25 bp, Homo sapien
cggagggacacgctccgtcctcacc

SEQ ID NO: 118889 - DNA, 25 bp, Homo sapien
ccgtcctcaccgcacacggagggac

SEQ ID NO: 118890 - DNA, 25 bp, Homo sapien
tcaccgcacacggaggcacccgctc

SEQ ID NO: 118891 - DNA, 25 bp, Homo sapien
cacggagggacacgctccgtcctca

SEQ ID NO: 118892 - DNA, 25 bp, Homo sapien
caccgcacacggaggcacccgctcc

SEQ ID NO: 118893 - DNA, 25 bp, Homo sapien
tcctcaccgcacacggaggcacccg

SEQ ID NO: 118894 - DNA, 25 bp, Homo sapien
cgtcctcaccgcacacggagggaca

SEQ ID NO: 118895 - DNA, 25 bp, Homo sapien
ctgctagggctccaagtgccgactt

SEQ ID NO: 118896 - DNA, 25 bp, Homo sapien
cccttcacgggccaacaggagcgag

SEQ ID NO: 118897 - DNA, 25 bp, Homo sapien
agagcttgcacactccctagccgga

SEQ ID NO: 118898 - DNA, 25 bp, Homo sapien
caagtgccgacttgcagaggcctcg

SEQ ID NO: 118899 - DNA, 25 bp, Homo sapien
ccgagcctagatttctaccttcaga

SEQ ID NO: 118900 - DNA, 25 bp, Homo sapien
taccttcagaaactccgacagtggg

SEQ ID NO: 118901 - DNA, 25 bp, Homo sapien
ccaaccctggcctgtggatgcatcg

SEQ ID NO: 118902 - DNA, 25 bp, Homo sapien
ttcaccgcgcctgacgtgagtactc

SEQ ID NO: 118903 - DNA, 25 bp, Homo sapien
gttggaggccagcacggtcccagcc

SEQ ID NO: 118904 - DNA, 25 bp, Homo sapien
gacctcggcagcagtgatctgtatc

SEQ ID NO: 118905 - DNA, 25 bp, Homo sapien
atctgtatcccaaagttcaggcgtg

SEQ ID NO: 118906 - DNA, 25 bp, Homo sapien
gttcaggcgtgataacgtcaagacc

SEQ ID NO: 118907 - DNA, 25 bp, Homo sapien
acgtcaagaccgtgctgagcctgcc

SEQ ID NO: 118908 - DNA, 25 bp, Homo sapien
agcctgccgggtacagcgtgaaaat

SEQ ID NO: 118909 - DNA, 25 bp, Homo sapien
cgtgaaaatggctggtgctaccgtg

SEQ ID NO: 118910 - DNA, 25 bp, Homo sapien
ccagcttggcttcatgacctcggca

SEQ ID NO: 118911 - DNA, 25 bp, Homo sapien
cgcggacaccttcgtgagtgggccc

SEQ ID NO: 118912 - DNA, 25 bp, Homo sapien
gcctggcgcggacaccttcgtgagt

SEQ ID NO: 118913 - DNA, 25 bp, Homo sapien
acgttcttccgccactagagggcgg

SEQ ID NO: 118914 - DNA, 25 bp, Homo sapien
ctggggacgttcttccgccactaga

SEQ ID NO: 118915 - DNA, 25 bp, Homo sapien
tctgtcccaccacggggtgcgctgt

SEQ ID NO: 118916 - DNA, 25 bp, Homo sapien
ctcggtgccacttcggggtctctct

SEQ ID NO: 118917 - DNA, 25 bp, Homo sapien
gagtaactcgtccgcagcgctcgcg

SEQ ID NO: 118918 - DNA, 25 bp, Homo sapien
tgctgaaaagggaacacaggacacc

SEQ ID NO: 118919 - DNA, 25 bp, Homo sapien
tgttacaccctgaagccacctcgtg

SEQ ID NO: 118920 - DNA, 25 bp, Homo sapien
cggaaccctcgtaggcaaatcagtc

SEQ ID NO: 118921 - DNA, 25 bp, Homo sapien
ctcccgctgggtgacaaagttttct

SEQ ID NO: 118922 - DNA, 25 bp, Homo sapien
agcccgttcgtgcataaatgtaatc

SEQ ID NO: 118923 - DNA, 25 bp, Homo sapien
tcctcggccgcagaataaaccagct

SEQ ID NO: 118924 - DNA, 25 bp, Homo sapien
aggcgagccctctgcgcaattaggc

SEQ ID NO: 118925 - DNA, 25 bp, Homo sapien
agcctcctatgcctgtgcccaagtg

SEQ ID NO: 118926 - DNA, 25 bp, Homo sapien
ttcttggtgtccataaccgcgcttc

SEQ ID NO: 118927 - DNA, 25 bp, Homo sapien
caaggcggtgagtaccctctaggcg

SEQ ID NO: 118928 - DNA, 25 bp, Homo sapien
tggcctcgttttcgcgtatttagga

SEQ ID NO: 118929 - DNA, 25 bp, Homo sapien
cgctggcctcgttttcgcgtattta

SEQ ID NO: 118930 - DNA, 25 bp, Homo sapien
tctcctgaggcttgttcgcgggcgt

SEQ ID NO: 118931 - DNA, 25 bp, Homo sapien
tcgtgtctccgggagacgccgctgc

SEQ ID NO: 118932 - DNA, 25 bp, Homo sapien
cagcgagaggtttcgtcaccgcggc

SEQ ID NO: 118933 - DNA, 25 bp, Homo sapien
cgcgggtgacagacaacaggagcca

SEQ ID NO: 118934 - DNA, 25 bp, Homo sapien
ccagcgtctcctgaggcttgttcgc

SEQ ID NO: 118935 - DNA, 25 bp, Homo sapien
aggcagtaaacctgcggccaccgta

SEQ ID NO: 118936 - DNA, 25 bp, Homo sapien
cagggtaagcaacagatacggtttc

SEQ ID NO: 118937 - DNA, 25 bp, Homo sapien
atgtgtgttcatcagactgccgtga

SEQ ID NO: 118938 - DNA, 25 bp, Homo sapien
gggccgccgcaacttcgattaccga

SEQ ID NO: 118939 - DNA, 25 bp, Homo sapien
gtaaccactgcagacgcgggacctc

SEQ ID NO: 118940 - DNA, 25 bp, Homo sapien
gccgtcaccggcagaatcaccagaa

SEQ ID NO: 118941 - DNA, 25 bp, Homo sapien
ggacgcagaccacgattccgcagga

SEQ ID NO: 118942 - DNA, 25 bp, Homo sapien
atccgggagatgagacccaaggtca

SEQ ID NO: 118943 - DNA, 25 bp, Homo sapien
caggcgcatgcatttcaaggtcagg

SEQ ID NO: 118944 - DNA, 25 bp, Homo sapien
tagcaggtcgttctgttctgaaagc

SEQ ID NO: 118945 - DNA, 25 bp, Homo sapien
tctgttctgaaagcgaagcgtcttc

SEQ ID NO: 118946 - DNA, 25 bp, Homo sapien
aaagcgaagcgtcttcctggctggg

SEQ ID NO: 118947 - DNA, 25 bp, Homo sapien
tcaaggtcagggaatagcaggtcgt

SEQ ID NO: 118948 - DNA, 25 bp, Homo sapien
ttaggaagcatcgaggcaggcgcat

SEQ ID NO: 118949 - DNA, 25 bp, Homo sapien
cggaacgcacagcagttaggaagca

SEQ ID NO: 118950 - DNA, 25 bp, Homo sapien
gctgctggattgaagccctgagccg

SEQ ID NO: 118951 - DNA, 25 bp, Homo sapien
agctggcgctgcgagccaacgggcc

SEQ ID NO: 118952 - DNA, 25 bp, Homo sapien
aggagctttacaacttcccggcctg

SEQ ID NO: 118953 - DNA, 25 bp, Homo sapien
ctatggaggagctttacaacttccc

SEQ ID NO: 118954 - DNA, 25 bp, Homo sapien
gctatggaggagctttacaacttcc

SEQ ID NO: 118955 - DNA, 25 bp, Homo sapien
tcagctatggaggagctttacaact

SEQ ID NO: 118956 - DNA, 25 bp, Homo sapien
catcagctatggaggagctttacaa

SEQ ID NO: 118957 - DNA, 25 bp, Homo sapien
agcccttccgtgtccgcaggcttcg

SEQ ID NO: 118958 - DNA, 25 bp, Homo sapien
agctgcagcccttccgtgtccgcag

SEQ ID NO: 118959 - DNA, 25 bp, Homo sapien
agtctgacgggttcaaaatggcggc

SEQ ID NO: 118960 - DNA, 25 bp, Homo sapien
ggggacgcagatctcccactgcttg

SEQ ID NO: 118961 - DNA, 25 bp, Homo sapien
gagaccctgctttgaggcgggtatc

SEQ ID NO: 118962 - DNA, 25 bp, Homo sapien
ggccctcaggttgtgtgactgtgac

SEQ ID NO: 118963 - DNA, 25 bp, Homo sapien
attcgaggccgacgcatccgcgcgt

SEQ ID NO: 118964 - DNA, 25 bp, Homo sapien
tgtatgtgagagtctgacgggttca

SEQ ID NO: 118965 - DNA, 25 bp, Homo sapien
aggacagacatgctactcctgtttc

SEQ ID NO: 118966 - DNA, 25 bp, Homo sapien
ctttgaggcgggtatcggttgccct

SEQ ID NO: 118967 - DNA, 25 bp, Homo sapien
acctgtcaaatccactttgggacga

SEQ ID NO: 118968 - DNA, 25 bp, Homo sapien
ttgggacgaactaggtcacgcgctc

SEQ ID NO: 118969 - DNA, 25 bp, Homo sapien
ggagccaccgttttgtgcccgtgga

SEQ ID NO: 118970 - DNA, 25 bp, Homo sapien
accgcggcgttctgtttccaggcaa

SEQ ID NO: 118971 - DNA, 25 bp, Homo sapien
cgcgcgtccatttccctgcatggtg

SEQ ID NO: 118972 - DNA, 25 bp, Homo sapien
gggagtggagctgacaacctgtcaa

SEQ ID NO: 118973 - DNA, 25 bp, Homo sapien
tccctgcatggtggactcagtaaag

SEQ ID NO: 118974 - DNA, 25 bp, Homo sapien
agtcaaagactcagaaggcagcctg

SEQ ID NO: 118975 - DNA, 25 bp, Homo sapien
cgtctaggccgagaggccggtccca

SEQ ID NO: 118976 - DNA, 25 bp, Homo sapien
ctcggcgcaggagagactcaacttt

SEQ ID NO: 118977 - DNA, 25 bp, Homo sapien
aggagagactcaactttcccgccac

SEQ ID NO: 118978 - DNA, 25 bp, Homo sapien
tgcgcagactctacggccagtcaaa

SEQ ID NO: 118979 - DNA, 25 bp, Homo sapien
cccagttcctgtgacgtcagacttc

SEQ ID NO: 118980 - DNA, 25 bp, Homo sapien
tcctgtgacgtcagacttccgcgtc

SEQ ID NO: 118981 - DNA, 25 bp, Homo sapien
agccctatggaaggcactacacatc

SEQ ID NO: 118982 - DNA, 25 bp, Homo sapien
tcggtcccagactcagccctatgga

SEQ ID NO: 118983 - DNA, 25 bp, Homo sapien
agtgacgtcacgtgtcggccgccga

SEQ ID NO: 118984 - DNA, 25 bp, Homo sapien
ccaagccttgccttgacgtcgtaaa

SEQ ID NO: 118985 - DNA, 25 bp, Homo sapien
agggccacaagaggaaaagcacgga

SEQ ID NO: 118986 - DNA, 25 bp, Homo sapien
cctcctaggaatattcgccagcgtg

SEQ ID NO: 118987 - DNA, 25 bp, Homo sapien
tcgccagcgtgaggcacagatcatc

SEQ ID NO: 118988 - DNA, 25 bp, Homo sapien
atctcctagtgaacggtgtccctgc

SEQ ID NO: 118989 - DNA, 25 bp, Homo sapien
tcatcactgcagatcctttaacgtc

SEQ ID NO: 118990 - DNA, 25 bp, Homo sapien
agcgttctcagcactggccctcgtt

SEQ ID NO: 118991 - DNA, 25 bp, Homo sapien
ttactcgttcacagctgtgcttgtg

SEQ ID NO: 118992 - DNA, 25 bp, Homo sapien
atcctgcatctcacctagcgccctg

SEQ ID NO: 118993 - DNA, 25 bp, Homo sapien
agcgccctggatctcaccgagagct

SEQ ID NO: 118994 - DNA, 25 bp, Homo sapien
tcagggttcctctcccttgtcagtg

SEQ ID NO: 118995 - DNA, 25 bp, Homo sapien
atgcgctctcctcattactcgttca

SEQ ID NO: 118996 - DNA, 25 bp, Homo sapien
gctgtgcttgtgaaacctgccggaa

SEQ ID NO: 118997 - DNA, 25 bp, Homo sapien
aaacctgccggaagagtcggagagc

SEQ ID NO: 118998 - DNA, 25 bp, Homo sapien
ggttcctctcccttgtcagtgtgcc

SEQ ID NO: 118999 - DNA, 25 bp, Homo sapien
cagcttggacagaacgccgagaaca

SEQ ID NO: 119000 - DNA, 25 bp, Homo sapien
cccagcagtcgcagaaaaatcccaa

SEQ ID NO: 119001 - DNA, 25 bp, Homo sapien
tgacctttccttcaagagtgactgg

SEQ ID NO: 119002 - DNA, 25 bp, Homo sapien
gcctgtgctaattataccagcgtta

SEQ ID NO: 119003 - DNA, 25 bp, Homo sapien
cctgcctaattgtaccgaggaaagc

SEQ ID NO: 119004 - DNA, 25 bp, Homo sapien
tccggcacggggaaaatagctcagc

SEQ ID NO: 119005 - DNA, 25 bp, Homo sapien
atgtcccggcatgaagttccaaaga

SEQ ID NO: 119006 - DNA, 25 bp, Homo sapien
tcgcacacgggcgttctgctttaca

SEQ ID NO: 119007 - DNA, 25 bp, Homo sapien
ctcagaggtcccttgggttgaaatc

SEQ ID NO: 119008 - DNA, 25 bp, Homo sapien
gctgtgcttgtgaaacctgccggaa

SEQ ID NO: 119009 - DNA, 25 bp, Homo sapien
agtcctgaacccatgcacggctgtt

SEQ ID NO: 119010 - DNA, 25 bp, Homo sapien
tcagcagctttcttaacccggtttc

SEQ ID NO: 119011 - DNA, 25 bp, Homo sapien
cggtttccaggcctccaaatggagg

SEQ ID NO: 119012 - DNA, 25 bp, Homo sapien
cacggctgttcattctcagaggtcc

SEQ ID NO: 119013 - DNA, 25 bp, Homo sapien
tctgaaggaatggagcaaaagcggc

SEQ ID NO: 119014 - DNA, 25 bp, Homo sapien
cctgcagcagcccttttaagtgatg

SEQ ID NO: 119015 - DNA, 25 bp, Homo sapien
cctgcggtggcaacaagaaatccga

SEQ ID NO: 119016 - DNA, 25 bp, Homo sapien
acgatggcggcgctgaccttatgaa

SEQ ID NO: 119017 - DNA, 25 bp, Homo sapien
tctgaccgtgccatgaccaaaacca

SEQ ID NO: 119018 - DNA, 25 bp, Homo sapien
acctcgttaggtgagtagcaggcca

SEQ ID NO: 119019 - DNA, 25 bp, Homo sapien
accttatgaagttggcgttacgaca

SEQ ID NO: 119020 - DNA, 25 bp, Homo sapien
caggacgggcgacctttgtaaagca

SEQ ID NO: 119021 - DNA, 25 bp, Homo sapien
tggctttggcttgtcaattcccgtg

SEQ ID NO: 119022 - DNA, 25 bp, Homo sapien
cgaagaacgtgtgggcattctgacc

SEQ ID NO: 119023 - DNA, 25 bp, Homo sapien
catgcgtggatatcctgaggactca

SEQ ID NO: 119024 - DNA, 25 bp, Homo sapien
attcacctgacttggctgccagcgc

SEQ ID NO: 119025 - DNA, 25 bp, Homo sapien
tccggagccgcattcacctgacttg

SEQ ID NO: 119026 - DNA, 25 bp, Homo sapien
tggaagcgttcctccagcatgcgtg

SEQ ID NO: 119027 - DNA, 25 bp, Homo sapien
gaggactcacggacaccgattccct

SEQ ID NO: 119028 - DNA, 25 bp, Homo sapien
tcctgaggactcacggacaccgatt

SEQ ID NO: 119029 - DNA, 25 bp, Homo sapien
gcgtccaaatgtggaagcgttcctc

SEQ ID NO: 119030 - DNA, 25 bp, Homo sapien
ccagcatgcgtggatatcctgagga

SEQ ID NO: 119031 - DNA, 25 bp, Homo sapien
cttcgtgaatgcctgccggcctgaa

SEQ ID NO: 119032 - DNA, 25 bp, Homo sapien
cccaggtgtggaatcaaaacagatc

SEQ ID NO: 119033 - DNA, 25 bp, Homo sapien
aacagatcccagagcgcgatccgcg

SEQ ID NO: 119034 - DNA, 25 bp, Homo sapien
gctggagattccgacgcaaagaccc

SEQ ID NO: 119035 - DNA, 25 bp, Homo sapien
ctgtggccaatcgaggaccgggctc

SEQ ID NO: 119036 - DNA, 25 bp, Homo sapien
cgggctccgcattcttcagacgttc

SEQ ID NO: 119037 - DNA, 25 bp, Homo sapien
cacagtgggcgattttcccgcactc

SEQ ID NO: 119038 - DNA, 25 bp, Homo sapien
cctgaaggatgtcgctgatctctgc

SEQ ID NO: 119039 - DNA, 25 bp, Homo sapien
actcggctgcagaaggaggacccac

SEQ ID NO: 119040 - DNA, 25 bp, Homo sapien
tcctgaactgtttcccggggaggca

SEQ ID NO: 119041 - DNA, 25 bp, Homo sapien
cttctggtcttgagcgtcctgaact

SEQ ID NO: 119042 - DNA, 25 bp, Homo sapien
tgctgttttgtagacccgcggccag

SEQ ID NO: 119043 - DNA, 25 bp, Homo sapien
gcaggagtctccaatagcgtcaggt

SEQ ID NO: 119044 - DNA, 25 bp, Homo sapien
cctccacgcgcctaggaagttttga

SEQ ID NO: 119045 - DNA, 25 bp, Homo sapien
caggtgcagctgtttcccatgattg

SEQ ID NO: 119046 - DNA, 25 bp, Homo sapien
ctggagatcctaccctgctttgcgg

SEQ ID NO: 119047 - DNA, 25 bp, Homo sapien
tcaaacggcggcagttgctgcggct

SEQ ID NO: 119048 - DNA, 25 bp, Homo sapien
ctgcggagctgcgatgagcctctca

SEQ ID NO: 119049 - DNA, 25 bp, Homo sapien
atgctgcagctcatccatgacccgg

SEQ ID NO: 119050 - DNA, 25 bp, Homo sapien
tgcagctcatccatgacccggtttc

SEQ ID NO: 119051 - DNA, 25 bp, Homo sapien
cggggtatggtgactcggtcatccc

SEQ ID NO: 119052 - DNA, 25 bp, Homo sapien
ccagcgaccaccacagtgccagccg

SEQ ID NO: 119053 - DNA, 25 bp, Homo sapien
cgcgatgagcgcttcaaacggcggc

SEQ ID NO: 119054 - DNA, 25 bp, Homo sapien
tgagcgcttcaaacggcggcagttg

SEQ ID NO: 119055 - DNA, 25 bp, Homo sapien
tccatccgcggcaatcaccgtagtg

SEQ ID NO: 119056 - DNA, 25 bp, Homo sapien
tcagtcccgaacctccctggaagga

SEQ ID NO: 119057 - DNA, 25 bp, Homo sapien
ggccatgatcaagaccgctaagatg

SEQ ID NO: 119058 - DNA, 25 bp, Homo sapien
gtttccatccagtcttcagccagtc

SEQ ID NO: 119059 - DNA, 25 bp, Homo sapien
ttgggatccgctgagtaaagacacg

SEQ ID NO: 119060 - DNA, 25 bp, Homo sapien
cccagtccagctcagttcagacaga

SEQ ID NO: 119061 - DNA, 25 bp, Homo sapien
ctgccctcgttacccaaacagtttg

SEQ ID NO: 119062 - DNA, 25 bp, Homo sapien
gtttgcgctcgcttaaccttgatgc

SEQ ID NO: 119063 - DNA, 25 bp, Homo sapien
ctctggtgttgcttcaagttaggca

SEQ ID NO: 119064 - DNA, 25 bp, Homo sapien
tctaggtggtgccaaattctggggc

SEQ ID NO: 119065 - DNA, 25 bp, Homo sapien
attctggggcctaggcatttccctc

SEQ ID NO: 119066 - DNA, 25 bp, Homo sapien
gcatttccctcgctttatgtttttg

SEQ ID NO: 119067 - DNA, 25 bp, Homo sapien
cttcaatctctttgattaggccgta

SEQ ID NO: 119068 - DNA, 25 bp, Homo sapien
attaggccgtacgtggctgtggcaa

SEQ ID NO: 119069 - DNA, 25 bp, Homo sapien
tgggaaccggagagaaagcaaaata

SEQ ID NO: 119070 - DNA, 25 bp, Homo sapien
ggtgcccgatggcttcgctgtacca

SEQ ID NO: 119071 - DNA, 25 bp, Homo sapien
ccctgtccaggtacgcgctgtctgg

SEQ ID NO: 119072 - DNA, 25 bp, Homo sapien
agagcaaactcgtcttgtctaccca

SEQ ID NO: 119073 - DNA, 25 bp, Homo sapien
ctctgctgcttgcatttaaagagca

SEQ ID NO: 119074 - DNA, 25 bp, Homo sapien
tgcttcggatcctctctctgctgct

SEQ ID NO: 119075 - DNA, 25 bp, Homo sapien
tatcattgtttctgtggcgattgca

SEQ ID NO: 119076 - DNA, 25 bp, Homo sapien
atccactgggcaaacagaaaagctg

SEQ ID NO: 119077 - DNA, 25 bp, Homo sapien
gccacttgccggttgctaagcagtt

SEQ ID NO: 119078 - DNA, 25 bp, Homo sapien
acgcatcagacactttgcaccaaga

SEQ ID NO: 119079 - DNA, 25 bp, Homo sapien
tgggaaggcaaaacactcttttctc

SEQ ID NO: 119080 - DNA, 25 bp, Homo sapien
cgtcccgcaccgggcagagctgaag

SEQ ID NO: 119081 - DNA, 25 bp, Homo sapien
tcccagcggcgggtagtgcggaaaa

SEQ ID NO: 119082 - DNA, 25 bp, Homo sapien
agtgcgtgggaaggcaaaacactct

SEQ ID NO: 119083 - DNA, 25 bp, Homo sapien
tgcgtgggaaggcaaaacactcttt

SEQ ID NO: 119084 - DNA, 25 bp, Homo sapien
gcctgtgccggagcaggccgcttct

SEQ ID NO: 119085 - DNA, 25 bp, Homo sapien
gccgcttctccgtagcaaccacatc

SEQ ID NO: 119086 - DNA, 25 bp, Homo sapien
ttctccgtagcaaccacatcccaca

SEQ ID NO: 119087 - DNA, 25 bp, Homo sapien
tgagtgttgcttccctttatccgcg

SEQ ID NO: 119088 - DNA, 25 bp, Homo sapien
gctcatgctgtgtttggcgtttcca

SEQ ID NO: 119089 - DNA, 25 bp, Homo sapien
ctcctcgttgcagctgatgctcaga

SEQ ID NO: 119090 - DNA, 25 bp, Homo sapien
acctaagtgagcgtcctcctcgttg

SEQ ID NO: 119091 - DNA, 25 bp, Homo sapien
gcgctcaccgctgtgacctaagtga

SEQ ID NO: 119092 - DNA, 25 bp, Homo sapien
cgccgtccgcagttcactgagtgtt

SEQ ID NO: 119093 - DNA, 25 bp, Homo sapien
ccgaacccatccgtgaattgccaga

SEQ ID NO: 119094 - DNA, 25 bp, Homo sapien
ggcgtttccagggagtactacatca

SEQ ID NO: 119095 - DNA, 25 bp, Homo sapien
ggcagatggtctcggccgtcactct

SEQ ID NO: 119096 - DNA, 25 bp, Homo sapien
gcgctgcttccctcgcggggcagat

SEQ ID NO: 119097 - DNA, 25 bp, Homo sapien
aagctggacgagcccacagtggctg

SEQ ID NO: 119098 - DNA, 25 bp, Homo sapien
gcgcctgcctgaagctggacgagcc

SEQ ID NO: 119099 - DNA, 25 bp, Homo sapien
gtcgttctcagagcctcccaggtga

SEQ ID NO: 119100 - DNA, 25 bp, Homo sapien
cagaagctgtcgttctcagagcctc

SEQ ID NO: 119101 - DNA, 25 bp, Homo sapien
cgtcactcacgagacagaagctgtc

SEQ ID NO: 119102 - DNA, 25 bp, Homo sapien
gggcaccacgtcactcacgagacag

SEQ ID NO: 119103 - DNA, 25 bp, Homo sapien
cactagcctctgtgttcccgttagg

SEQ ID NO: 119104 - DNA, 25 bp, Homo sapien
tagggacatcacaccctgtctcacg

SEQ ID NO: 119105 - DNA, 25 bp, Homo sapien
cctgtctcacgtcgcagtgccatgg

SEQ ID NO: 119106 - DNA, 25 bp, Homo sapien
aacagagcaaaggatggtggccgca

SEQ ID NO: 119107 - DNA, 25 bp, Homo sapien
ctagattccagccaccaagcggaag

SEQ ID NO: 119108 - DNA, 25 bp, Homo sapien
ggaagcatgagacccgcccacacta

SEQ ID NO: 119109 - DNA, 25 bp, Homo sapien
ttcccgttagggacatcacaccctg

SEQ ID NO: 119110 - DNA, 25 bp, Homo sapien
agccaccaagcggaagcatgagacc

SEQ ID NO: 119111 - DNA, 25 bp, Homo sapien
agctcgctcaggtgacacgaagtca

SEQ ID NO: 119112 - DNA, 25 bp, Homo sapien
ggacccactcttggcttcctcttta

SEQ ID NO: 119113 - DNA, 25 bp, Homo sapien
cttcgaaggaactagtgagccagcc

SEQ ID NO: 119114 - DNA, 25 bp, Homo sapien
agagcagcagcttttgtccgtgtgg

SEQ ID NO: 119115 - DNA, 25 bp, Homo sapien
cggtgaccttcccagacacaaaatc

SEQ ID NO: 119116 - DNA, 25 bp, Homo sapien
atgcctaggaattgcggagtgaccc

SEQ ID NO: 119117 - DNA, 25 bp, Homo sapien
ttgtgacttttgtgcagctcgctca

SEQ ID NO: 119118 - DNA, 25 bp, Homo sapien
ggagtgacccatcagcacacgtaga

SEQ ID NO: 119119 - DNA, 25 bp, Homo sapien
tacctgagccgctctggccgagcaa

SEQ ID NO: 119120 - DNA, 25 bp, Homo sapien
ccggacctggagtagtacctgagcc

SEQ ID NO: 119121 - DNA, 25 bp, Homo sapien
gcgcctggtccgacatgatcgcggc

SEQ ID NO: 119122 - DNA, 25 bp, Homo sapien
cctcaggaactttgggcgcctggtc

SEQ ID NO: 119123 - DNA, 25 bp, Homo sapien
tcgatgtcgcccaccgcgtaatact

SEQ ID NO: 119124 - DNA, 25 bp, Homo sapien
atgccgtgacggaattcccgaggcc

SEQ ID NO: 119125 - DNA, 25 bp, Homo sapien
tggacccggctatgccgtgacggaa

SEQ ID NO: 119126 - DNA, 25 bp, Homo sapien
gcgtaatacttgacctccctgaaca

SEQ ID NO: 119127 - DNA, 25 bp, Homo sapien
gcttacgtagggctagatctccact

SEQ ID NO: 119128 - DNA, 25 bp, Homo sapien
ctgatggcttacgtagggctagatc

SEQ ID NO: 119129 - DNA, 25 bp, Homo sapien
gccttatcagctgatggcttacgta

SEQ ID NO: 119130 - DNA, 25 bp, Homo sapien
ggagagatggccttatcagctgatg

SEQ ID NO: 119131 - DNA, 25 bp, Homo sapien
acagcaccacatgtggtggcgcaca

SEQ ID NO: 119132 - DNA, 25 bp, Homo sapien
tctccacttggataaggcaggtctc

SEQ ID NO: 119133 - DNA, 25 bp, Homo sapien
ggtgggcgcgccagcattcgctctc

SEQ ID NO: 119134 - DNA, 25 bp, Homo sapien
ccacttggataaggcaggtctcggt

SEQ ID NO: 119135 - DNA, 25 bp, Homo sapien
gggtctccgtccagcatcgagggcc

SEQ ID NO: 119136 - DNA, 25 bp, Homo sapien
tctggttcggggtcagattccgcgc

SEQ ID NO: 119137 - DNA, 25 bp, Homo sapien
atcctgctgcccgagcccaggtgag

SEQ ID NO: 119138 - DNA, 25 bp, Homo sapien
tgctggccgacgtgagctacctgat

SEQ ID NO: 119139 - DNA, 25 bp, Homo sapien
cgacgtgagctacctgatggccatg

SEQ ID NO: 119140 - DNA, 25 bp, Homo sapien
gctgcttccttatcgtgctccaccg

SEQ ID NO: 119141 - DNA, 25 bp, Homo sapien
cgcgccagcaagaagatcctgctgc

SEQ ID NO: 119142 - DNA, 25 bp, Homo sapien
tgccgggtccctgtcgtgttccagg

SEQ ID NO: 119143 - DNA, 25 bp, Homo sapien
tactggtccatcacgcgccacatgg

SEQ ID NO: 119144 - DNA, 25 bp, Homo sapien
gctctcggtcttcggagtgcttatt

SEQ ID NO: 119145 - DNA, 25 bp, Homo sapien
cgcaagtgcgtctccaacgtcatga

SEQ ID NO: 119146 - DNA, 25 bp, Homo sapien
aacgtgacggccatagccctggacc

SEQ ID NO: 119147 - DNA, 25 bp, Homo sapien
tgctttgctgcacggccagcatctg

SEQ ID NO: 119148 - DNA, 25 bp, Homo sapien
atccatggccgtctcggatgtcctg

SEQ ID NO: 119149 - DNA, 25 bp, Homo sapien
ggagtgcttattctcaccttgctgg

SEQ ID NO: 119150 - DNA, 25 bp, Homo sapien
tgttctccaccgtaggcgccttcta

SEQ ID NO: 119151 - DNA, 25 bp, Homo sapien
tcaccagaccgcgtgcggacgggct

SEQ ID NO: 119152 - DNA, 25 bp, Homo sapien
ctcgattttatctgctcctgggtgg

SEQ ID NO: 119153 - DNA, 25 bp, Homo sapien
tctctaggcgtgagcaaaggccaca

SEQ ID NO: 119154 - DNA, 25 bp, Homo sapien
gcccgaaaaaatcacccaaggatgc

SEQ ID NO: 119155 - DNA, 25 bp, Homo sapien
gtgtgcgcacgtcatatgggccgcc

SEQ ID NO: 119156 - DNA, 25 bp, Homo sapien
ctcgctctttgtctcttctgagtga

SEQ ID NO: 119157 - DNA, 25 bp, Homo sapien
ctcttctgagtgaacttgatgaccc

SEQ ID NO: 119158 - DNA, 25 bp, Homo sapien
acccaaggatgcaagcccgccattg

SEQ ID NO: 119159 - DNA, 25 bp, Homo sapien
cagaggcacatttacggaggccaga

SEQ ID NO: 119160 - DNA, 25 bp, Homo sapien
gcagggaggccagcggccaagacag

SEQ ID NO: 119161 - DNA, 25 bp, Homo sapien
ggccaggacagagactcatttacgg

SEQ ID NO: 119162 - DNA, 25 bp, Homo sapien
gacagagactcatttacggaggcca

SEQ ID NO: 119163 - DNA, 25 bp, Homo sapien
gagactcatttacggaggccagagg

SEQ ID NO: 119164 - DNA, 25 bp, Homo sapien
ctgggacagaggcacatttacggag

SEQ ID NO: 119165 - DNA, 25 bp, Homo sapien
ggcacatttacggaggccagaggca

SEQ ID NO: 119166 - DNA, 25 bp, Homo sapien
cacatttacggaggccagaggcagg

SEQ ID NO: 119167 - DNA, 25 bp, Homo sapien
aacagccaccacagaggcgcgtgca

SEQ ID NO: 119168 - DNA, 25 bp, Homo sapien
gggaggccaacagccaccacagagg

SEQ ID NO: 119169 - DNA, 25 bp, Homo sapien
agaggcacgtataccgcggtcagtg

SEQ ID NO: 119170 - DNA, 25 bp, Homo sapien
gacagaggcacgtataccgcggtca

SEQ ID NO: 119171 - DNA, 25 bp, Homo sapien
agccaccacagaggcgcgtgcagga

SEQ ID NO: 119172 - DNA, 25 bp, Homo sapien
ccgggacagaggcacgtataccgcg

SEQ ID NO: 119173 - DNA, 25 bp, Homo sapien
acagaggtgcatttacggaggcctg

SEQ ID NO: 119174 - DNA, 25 bp, Homo sapien
gacagaggcgcgtgtacggaggcct

SEQ ID NO: 119175 - DNA, 25 bp, Homo sapien
tgtccttagtgggagggcgctttca

SEQ ID NO: 119176 - DNA, 25 bp, Homo sapien
cgctgagaaatgcagcgtgtacgtc

SEQ ID NO: 119177 - DNA, 25 bp, Homo sapien
cagtgggaatttcgtcgctgagaaa

SEQ ID NO: 119178 - DNA, 25 bp, Homo sapien
caaggcacaaggcagtgggaatttc

SEQ ID NO: 119179 - DNA, 25 bp, Homo sapien
cggcgactgacttcaaggcacaagg

SEQ ID NO: 119180 - DNA, 25 bp, Homo sapien
agccctgccggcgactgacttcaag

SEQ ID NO: 119181 - DNA, 25 bp, Homo sapien
ctgcgcccgtgtgtccttagtggga

SEQ ID NO: 119182 - DNA, 25 bp, Homo sapien
gggagggcgctttcagcctcctcct

SEQ ID NO: 119183 - DNA, 25 bp, Homo sapien
tcggcttcctagagacccggcttcc

SEQ ID NO: 119184 - DNA, 25 bp, Homo sapien
aatgccctcgtcgtcggccggagca

SEQ ID NO: 119185 - DNA, 25 bp, Homo sapien
tctggttcaatttctcccgaaacca

SEQ ID NO: 119186 - DNA, 25 bp, Homo sapien
gacagagcgtttctggttcaatttc

SEQ ID NO: 119187 - DNA, 25 bp, Homo sapien
ctgctcccaggacagagcgtttctg

SEQ ID NO: 119188 - DNA, 25 bp, Homo sapien
tgggctcacacactccctcggcttc

SEQ ID NO: 119189 - DNA, 25 bp, Homo sapien
agcagggttggaagaccatgccagc

SEQ ID NO: 119190 - DNA, 25 bp, Homo sapien
ggaagaccatgccagcgcctaactg

SEQ ID NO: 119191 - DNA, 25 bp, Homo sapien
gcgtgtttcggcagcagtgattcta

SEQ ID NO: 119192 - DNA, 25 bp, Homo sapien
tgcgggccgttcaaccctctgaata

SEQ ID NO: 119193 - DNA, 25 bp, Homo sapien
tcggttcctcgaatgacccaagctg

SEQ ID NO: 119194 - DNA, 25 bp, Homo sapien
gcttcaatgcacaaacgaggtttta

SEQ ID NO: 119195 - DNA, 25 bp, Homo sapien
gcccatcctggcttcgagattaaga

SEQ ID NO: 119196 - DNA, 25 bp, Homo sapien
agcgtctcattcttcacacacgggg

SEQ ID NO: 119197 - DNA, 25 bp, Homo sapien
ttagccagggtctcttccaaactca

SEQ ID NO: 119198 - DNA, 25 bp, Homo sapien
ggtgctaaaaatgctcgggcctcgc

SEQ ID NO: 119199 - DNA, 25 bp, Homo sapien
gagacggacgtgctccacgcagaca

SEQ ID NO: 119200 - DNA, 25 bp, Homo sapien
ggacgtgctccacgcagacacgcgt

SEQ ID NO: 119201 - DNA, 25 bp, Homo sapien
ctgtttaggagacggacgtgctcca

SEQ ID NO: 119202 - DNA, 25 bp, Homo sapien
ggagacggacgtgctccacgcagac

SEQ ID NO: 119203 - DNA, 25 bp, Homo sapien
cgctgtttaggagacggacgtgctc

SEQ ID NO: 119204 - DNA, 25 bp, Homo sapien
cgctgtttaggagatggacacgctc

SEQ ID NO: 119205 - DNA, 25 bp, Homo sapien
gtttaggagatggacgtgctccacg

SEQ ID NO: 119206 - DNA, 25 bp, Homo sapien
ctgtttaggagatggacgtgctcca

SEQ ID NO: 119207 - DNA, 25 bp, Homo sapien
ttgggctacggctgtgatggtatct

SEQ ID NO: 119208 - DNA, 25 bp, Homo sapien
ccaacgtccggggaaggcacacagt

SEQ ID NO: 119209 - DNA, 25 bp, Homo sapien
tccgcatagaccaacgtccggggaa

SEQ ID NO: 119210 - DNA, 25 bp, Homo sapien
gggctgctccgcatagaccaacgtc

SEQ ID NO: 119211 - DNA, 25 bp, Homo sapien
gcgggatgcagacccggatcagtca

SEQ ID NO: 119212 - DNA, 25 bp, Homo sapien
acccggatcagtcaggcttgagggc

SEQ ID NO: 119213 - DNA, 25 bp, Homo sapien
ctgtgatggtatctgcgctgcttgc

SEQ ID NO: 119214 - DNA, 25 bp, Homo sapien
atcagtcaggcttgagggctgctcc

SEQ ID NO: 119215 - DNA, 25 bp, Homo sapien
ccgggtcagacaaaagccaacttgc

SEQ ID NO: 119216 - DNA, 25 bp, Homo sapien
gcctttatcccacagaacggctctg

SEQ ID NO: 119217 - DNA, 25 bp, Homo sapien
aacttgcatcttccgctccgagggg

SEQ ID NO: 119218 - DNA, 25 bp, Homo sapien
accaactctggtctccgtggacatc

SEQ ID NO: 119219 - DNA, 25 bp, Homo sapien
cctgcatggctgtcagagaaaaaca

SEQ ID NO: 119220 - DNA, 25 bp, Homo sapien
tccgagaggacttgatgggagccct

SEQ ID NO: 119221 - DNA, 25 bp, Homo sapien
tccaccggcaggattcaagggacga

SEQ ID NO: 119222 - DNA, 25 bp, Homo sapien
ttcacggagcgttaagcctttatcc

SEQ ID NO: 119223 - DNA, 25 bp, Homo sapien
gcctctgatctgtgagctgcaaaga

SEQ ID NO: 119224 - DNA, 25 bp, Homo sapien
gagctccgaggttcattcacaaatc

SEQ ID NO: 119225 - DNA, 25 bp, Homo sapien
cccgacacaggctttgaagttgctg

SEQ ID NO: 119226 - DNA, 25 bp, Homo sapien
ccgaggcacccgcattcctaggaga

SEQ ID NO: 119227 - DNA, 25 bp, Homo sapien
ccggattaggtctcagaatgtgatc

SEQ ID NO: 119228 - DNA, 25 bp, Homo sapien
cggcgaatggtgaatgagacagcta

SEQ ID NO: 119229 - DNA, 25 bp, Homo sapien
cctgctccgagccagaggatgtagt

SEQ ID NO: 119230 - DNA, 25 bp, Homo sapien
cctccgtttcgtcgctcagagctta

SEQ ID NO: 119231 - DNA, 25 bp, Homo sapien
cagcgggtgcccaagatgaagaaca

SEQ ID NO: 119232 - DNA, 25 bp, Homo sapien
cttggcatgtgcagagcgaccctga

SEQ ID NO: 119233 - DNA, 25 bp, Homo sapien
agctgagcaaggtgccgctggtcca

SEQ ID NO: 119234 - DNA, 25 bp, Homo sapien
agtgcctgctcctcaagatccgcgg

SEQ ID NO: 119235 - DNA, 25 bp, Homo sapien
cgcagatcaaggagcgcaagtgcct

SEQ ID NO: 119236 - DNA, 25 bp, Homo sapien
gcctgctgaccatggaggagatcca

SEQ ID NO: 119237 - DNA, 25 bp, Homo sapien
gatgaagaacaagccgcgctcgccc

SEQ ID NO: 119238 - DNA, 25 bp, Homo sapien
cgcggtgggaaacagttcattttgc

SEQ ID NO: 119239 - DNA, 25 bp, Homo sapien
ctccttcctggtagacggggaggtg

SEQ ID NO: 119240 - DNA, 25 bp, Homo sapien
tcccgaggaattctagggcattcgc

SEQ ID NO: 119241 - DNA, 25 bp, Homo sapien
ttctagggcattcgctccaaacgtg

SEQ ID NO: 119242 - DNA, 25 bp, Homo sapien
ttcgctccaaacgtgggaaatcttc

SEQ ID NO: 119243 - DNA, 25 bp, Homo sapien
acgtgggaaatcttcgcgcgtatcc

SEQ ID NO: 119244 - DNA, 25 bp, Homo sapien
caggcagtgaatgagaacagctcgc

SEQ ID NO: 119245 - DNA, 25 bp, Homo sapien
agaacagctcgcatttctccttcct

SEQ ID NO: 119246 - DNA, 25 bp, Homo sapien
tgtaaatcccgaggaattctagggc

SEQ ID NO: 119247 - DNA, 25 bp, Homo sapien
tccaagacgctctcgctgcacggtg

SEQ ID NO: 119248 - DNA, 25 bp, Homo sapien
tcgacaacatcctgcggcccgagtt

SEQ ID NO: 119249 - DNA, 25 bp, Homo sapien
tgaacagcatggaggagaatgaccc

SEQ ID NO: 119250 - DNA, 25 bp, Homo sapien
gaccggccttcttcaggtgagcccg

SEQ ID NO: 119251 - DNA, 25 bp, Homo sapien
acgcacaaagactcacgcgacattg

SEQ ID NO: 119252 - DNA, 25 bp, Homo sapien
accagtgtgggatttactgtgaaca

SEQ ID NO: 119253 - DNA, 25 bp, Homo sapien
acattgtgtgaagctgacgccggcc

SEQ ID NO: 119254 - DNA, 25 bp, Homo sapien
gggtctactgtacgcgctactcgga

SEQ ID NO: 119255 - DNA, 25 bp, Homo sapien
gcgcttcactgaggttttgtttgca

SEQ ID NO: 119256 - DNA, 25 bp, Homo sapien
cgccgcgagcgaacggctttcattg

SEQ ID NO: 119257 - DNA, 25 bp, Homo sapien
tgtcaccacgtcaagctagagaagc

SEQ ID NO: 119258 - DNA, 25 bp, Homo sapien
tgtttgcaaaactagcgtccgtgtc

SEQ ID NO: 119259 - DNA, 25 bp, Homo sapien
acggcgtctggaagctgctttcctg

SEQ ID NO: 119260 - DNA, 25 bp, Homo sapien
gaaggtgttgctctcctatcggccc

SEQ ID NO: 119261 - DNA, 25 bp, Homo sapien
gtccatttttccaagtgtcaccacg

SEQ ID NO: 119262 - DNA, 25 bp, Homo sapien
ctgagaaatatggaggaccgtcctc

SEQ ID NO: 119263 - DNA, 25 bp, Homo sapien
taattctcgtttcaaatgggccctg

SEQ ID NO: 119264 - DNA, 25 bp, Homo sapien
tgagggtactcatggcgtgcaaatg

SEQ ID NO: 119265 - DNA, 25 bp, Homo sapien
tgcctcggagatgcttgccagactc

SEQ ID NO: 119266 - DNA, 25 bp, Homo sapien
cagctgtgggaactgtcgtttctca

SEQ ID NO: 119267 - DNA, 25 bp, Homo sapien
cctgctctccggcaaaattagttta

SEQ ID NO: 119268 - DNA, 25 bp, Homo sapien
cacccttgccgttggattcctaatt

SEQ ID NO: 119269 - DNA, 25 bp, Homo sapien
ccttcgcaaatggagccgcatactg

SEQ ID NO: 119270 - DNA, 25 bp, Homo sapien
ccagagctgccctatcggatgtttc

SEQ ID NO: 119271 - DNA, 25 bp, Homo sapien
aagcggccgcgcacggcctttaccg

SEQ ID NO: 119272 - DNA, 25 bp, Homo sapien
ggcctttaccgccgagcagctgcag

SEQ ID NO: 119273 - DNA, 25 bp, Homo sapien
ccagaccaacaggtacctgacggag

SEQ ID NO: 119274 - DNA, 25 bp, Homo sapien
aacaggtacctgacggagcagcggc

SEQ ID NO: 119275 - DNA, 25 bp, Homo sapien
gagctgagcctcaacgagtcacaga

SEQ ID NO: 119276 - DNA, 25 bp, Homo sapien
gctgagcctcaacgagtcacagatc

SEQ ID NO: 119277 - DNA, 25 bp, Homo sapien
cacgggcaacaagaacacgctggcc

SEQ ID NO: 119278 - DNA, 25 bp, Homo sapien
caagatcaagaaggccacgggcaac

SEQ ID NO: 119279 - DNA, 25 bp, Homo sapien
cgctggggttctgctagaagtcatt

SEQ ID NO: 119280 - DNA, 25 bp, Homo sapien
ccgagggcaggactttctccagacc

SEQ ID NO: 119281 - DNA, 25 bp, Homo sapien
actgctgttgttagtggcctcgtga

SEQ ID NO: 119282 - DNA, 25 bp, Homo sapien
tgatttaatcaagcgtggtgcgccc

SEQ ID NO: 119283 - DNA, 25 bp, Homo sapien
tatatttatgctgcctgcccagaga

SEQ ID NO: 119284 - DNA, 25 bp, Homo sapien
cgacaaagggccaaggtgcaattcc

SEQ ID NO: 119285 - DNA, 25 bp, Homo sapien
gctggtttaatatccgccctctgcg

SEQ ID NO: 119286 - DNA, 25 bp, Homo sapien
agtcattctgtctcccgctggttta

SEQ ID NO: 119287 - DNA, 25 bp, Homo sapien
taatcaaaggaactcagaaaccgcc

SEQ ID NO: 119288 - DNA, 25 bp, Homo sapien
agttcatggaatcgtggagtaatca

SEQ ID NO: 119289 - DNA, 25 bp, Homo sapien
cggagaaacaagacccaggctggag

SEQ ID NO: 119290 - DNA, 25 bp, Homo sapien
tgaggcggagaaacaagacccaggc

SEQ ID NO: 119291 - DNA, 25 bp, Homo sapien
acaggtggacagacagacctccggg

SEQ ID NO: 119292 - DNA, 25 bp, Homo sapien
tgggaaacaggtggacagacagacc

SEQ ID NO: 119293 - DNA, 25 bp, Homo sapien
tagacgcagctaccaggcgaccagg

SEQ ID NO: 119294 - DNA, 25 bp, Homo sapien
cgaagagcatcagcgacatagacgc

SEQ ID NO: 119295 - DNA, 25 bp, Homo sapien
cgtcagagaaataccgccgccgatt

SEQ ID NO: 119296 - DNA, 25 bp, Homo sapien
cttgtgttcttgagacccaggttcc

SEQ ID NO: 119297 - DNA, 25 bp, Homo sapien
cacaaatctcatcagcggcgcggcg

SEQ ID NO: 119298 - DNA, 25 bp, Homo sapien
ctttcaggcgcagtatgaacccttc

SEQ ID NO: 119299 - DNA, 25 bp, Homo sapien
gtgttgatctatccagcctccattg

SEQ ID NO: 119300 - DNA, 25 bp, Homo sapien
tcctcggctgctttctttgggaaca

SEQ ID NO: 119301 - DNA, 25 bp, Homo sapien
tccctccggaattcggcgaggattc

SEQ ID NO: 119302 - DNA, 25 bp, Homo sapien
tctccaccctctgctgatcaaagta

SEQ ID NO: 119303 - DNA, 25 bp, Homo sapien
acagtgacaacatctgcgtggctca

SEQ ID NO: 119304 - DNA, 25 bp, Homo sapien
tcgttcggggtctgacattgtcacc

SEQ ID NO: 119305 - DNA, 25 bp, Homo sapien
gtcacctggcagataagtgagtctg

SEQ ID NO: 119306 - DNA, 25 bp, Homo sapien
cggctcggaacatgcccgttcgtca

SEQ ID NO: 119307 - DNA, 25 bp, Homo sapien
acgagcttgtgcctcattcccggtg

SEQ ID NO: 119308 - DNA, 25 bp, Homo sapien
cccggtggctctccacgcaaagtta

SEQ ID NO: 119309 - DNA, 25 bp, Homo sapien
ctctaagcatatgcccaggtgaggc

SEQ ID NO: 119310 - DNA, 25 bp, Homo sapien
agggcgcgcctcagaatgacagcga

SEQ ID NO: 119311 - DNA, 25 bp, Homo sapien
cacgttcgtcctggagatgggactc

SEQ ID NO: 119312 - DNA, 25 bp, Homo sapien
cgtgccatcctcgtggatgagaggc

SEQ ID NO: 119313 - DNA, 25 bp, Homo sapien
agacctcgaacgtgccatcctcgtg

SEQ ID NO: 119314 - DNA, 25 bp, Homo sapien
gggacagctcagacctcgaacgtgc

SEQ ID NO: 119315 - DNA, 25 bp, Homo sapien
tcctggagatgggactcgaggtcac

SEQ ID NO: 119316 - DNA, 25 bp, Homo sapien
ggctgatggctgagcccatggagaa

SEQ ID NO: 119317 - DNA, 25 bp, Homo sapien
caagagcttggcctcggccggcaca

SEQ ID NO: 119318 - DNA, 25 bp, Homo sapien
gtgctgggacagctcagacctcgaa

SEQ ID NO: 119319 - DNA, 25 bp, Homo sapien
tgtaattgggtaccgcctccagcga

SEQ ID NO: 119320 - DNA, 25 bp, Homo sapien
aacgtgttaaagtgtggggcaatga

SEQ ID NO: 119321 - DNA, 25 bp, Homo sapien
tctgccttcaggaggaaacgtgtta

SEQ ID NO: 119322 - DNA, 25 bp, Homo sapien
tcattgcagcattgtttgaaacagc

SEQ ID NO: 119323 - DNA, 25 bp, Homo sapien
cagtggttcatgtctgaagttattc

SEQ ID NO: 119324 - DNA, 25 bp, Homo sapien
actcgcacaggtatacagtggttca

SEQ ID NO: 119325 - DNA, 25 bp, Homo sapien
ttaagttctaagcacacatcctggg

SEQ ID NO: 119326 - DNA, 25 bp, Homo sapien
cccggtaatagtcaaataatcattt

SEQ ID NO: 119327 - DNA, 25 bp, Homo sapien
cgcggccatgttgcggtagtttgtt

SEQ ID NO: 119328 - DNA, 25 bp, Homo sapien
cgtcggcgttcactactgtagctca

SEQ ID NO: 119329 - DNA, 25 bp, Homo sapien
ccgccctgcttcaaacatttgggtt

SEQ ID NO: 119330 - DNA, 25 bp, Homo sapien
gccgactgctgcaaagcgccttacg

SEQ ID NO: 119331 - DNA, 25 bp, Homo sapien
gcgccttacgactgaacccggaatc

SEQ ID NO: 119332 - DNA, 25 bp, Homo sapien
tgtccaggcacagaaacgacagtta

SEQ ID NO: 119333 - DNA, 25 bp, Homo sapien
gactctctttgtgttcggcctattc

SEQ ID NO: 119334 - DNA, 25 bp, Homo sapien
acccggaatcgacctatggccagca

SEQ ID NO: 119335 - DNA, 25 bp, Homo sapien
gcatcgcgaactggaggccgcactg

SEQ ID NO: 119336 - DNA, 25 bp, Homo sapien
cgtctgggcgaaccggcatcgcgaa

SEQ ID NO: 119337 - DNA, 25 bp, Homo sapien
cgtgcactaccgaggggcccagtgc

SEQ ID NO: 119338 - DNA, 25 bp, Homo sapien
gggaaacgcaggcatcacggctgca

SEQ ID NO: 119339 - DNA, 25 bp, Homo sapien
cacttagtggcgtctgctcgttgct

SEQ ID NO: 119340 - DNA, 25 bp, Homo sapien
cgctcagccggcaagcacttagtgg

SEQ ID NO: 119341 - DNA, 25 bp, Homo sapien
gaactcctatccctgacttcagggc

SEQ ID NO: 119342 - DNA, 25 bp, Homo sapien
tgggcctgcagacaccggccaggtc

SEQ ID NO: 119343 - DNA, 25 bp, Homo sapien
tgttactgctttgccgacggggcct

SEQ ID NO: 119344 - DNA, 25 bp, Homo sapien
gccgtctgaccgtgtgttactgctt

SEQ ID NO: 119345 - DNA, 25 bp, Homo sapien
ggtagcgtggctcactccacttgga

SEQ ID NO: 119346 - DNA, 25 bp, Homo sapien
gctcttgtgcttgagttcagtgtta

SEQ ID NO: 119347 - DNA, 25 bp, Homo sapien
tctgctttcgcaggagctcttgtgc

SEQ ID NO: 119348 - DNA, 25 bp, Homo sapien
agtgtgcggttcgtgcccttaacca

SEQ ID NO: 119349 - DNA, 25 bp, Homo sapien
cgattcaaagatgccggcgtcccgc

SEQ ID NO: 119350 - DNA, 25 bp, Homo sapien
cggccctgatgcgtgtacactctgc

SEQ ID NO: 119351 - DNA, 25 bp, Homo sapien
tcagtgctgcctcgacatccgaagg

SEQ ID NO: 119352 - DNA, 25 bp, Homo sapien
tcgtcaggcggtccttctgtccctg

SEQ ID NO: 119353 - DNA, 25 bp, Homo sapien
ggacctttcctcagtgctgcctcga

SEQ ID NO: 119354 - DNA, 25 bp, Homo sapien
acacacgctggggacctttcctcag

SEQ ID NO: 119355 - DNA, 25 bp, Homo sapien
cggaacgtatgtcgtcaggcggtcc

SEQ ID NO: 119356 - DNA, 25 bp, Homo sapien
gaccacggcccagcgcaagggacct

SEQ ID NO: 119357 - DNA, 25 bp, Homo sapien
cctcgacatccgaaggggctgggac

SEQ ID NO: 119358 - DNA, 25 bp, Homo sapien
aggactgcgctctgtctgcccacgg

SEQ ID NO: 119359 - DNA, 25 bp, Homo sapien
ttccatctgcacagagggagtcgtg

SEQ ID NO: 119360 - DNA, 25 bp, Homo sapien
tggaaccctcgggacagctctggac

SEQ ID NO: 119361 - DNA, 25 bp, Homo sapien
gactcggtcgctttcagggtcagat

SEQ ID NO: 119362 - DNA, 25 bp, Homo sapien
tcagatgtcagaggtggcctttgcc

SEQ ID NO: 119363 - DNA, 25 bp, Homo sapien
tctttcctctcttgtgctgacggcc

SEQ ID NO: 119364 - DNA, 25 bp, Homo sapien
gggactctgacgcttgaatccttaa

SEQ ID NO: 119365 - DNA, 25 bp, Homo sapien
aatccttaagggctcacctgggctg

SEQ ID NO: 119366 - DNA, 25 bp, Homo sapien
tgacaggacgaggtttcccgtggaa

SEQ ID NO: 119367 - DNA, 25 bp, Homo sapien
agacactcttggaaggggacacttc

SEQ ID NO: 119368 - DNA, 25 bp, Homo sapien
atggattagcgctgctcacttggga

SEQ ID NO: 119369 - DNA, 25 bp, Homo sapien
gcccgtgtgctcagaatgccaatga

SEQ ID NO: 119370 - DNA, 25 bp, Homo sapien
gagggccgtcttctttgcattccaa

SEQ ID NO: 119371 - DNA, 25 bp, Homo sapien
tctgggataaacaggagacactctt

SEQ ID NO: 119372 - DNA, 25 bp, Homo sapien
ggcccagcattgtcattgtgatttc

SEQ ID NO: 119373 - DNA, 25 bp, Homo sapien
ccgaggtgtgaaaatccgaggcttg

SEQ ID NO: 119374 - DNA, 25 bp, Homo sapien
aatctccgggatcatgctttttgca

SEQ ID NO: 119375 - DNA, 25 bp, Homo sapien
tttgtggggtctgcctgataatccc

SEQ ID NO: 119376 - DNA, 25 bp, Homo sapien
ctatttagtgtagcggctcgggacc

SEQ ID NO: 119377 - DNA, 25 bp, Homo sapien
ggttaatattaaccggcagctcctg

SEQ ID NO: 119378 - DNA, 25 bp, Homo sapien
tccgaaagttccactggggacgatc

SEQ ID NO: 119379 - DNA, 25 bp, Homo sapien
cgatctcgccatggttgagggactt

SEQ ID NO: 119380 - DNA, 25 bp, Homo sapien
accggggatacctcacagactgcca

SEQ ID NO: 119381 - DNA, 25 bp, Homo sapien
aagttcaaatgctgcctgtgcgcgc

SEQ ID NO: 119382 - DNA, 25 bp, Homo sapien
cttgggcggcagtcacattagagac

SEQ ID NO: 119383 - DNA, 25 bp, Homo sapien
taacggaacacatcggagttgggtc

SEQ ID NO: 119384 - DNA, 25 bp, Homo sapien
agcagacatctcgccagcagcagca

SEQ ID NO: 119385 - DNA, 25 bp, Homo sapien
agcagcagcatctcgcccatggaac

SEQ ID NO: 119386 - DNA, 25 bp, Homo sapien
tctcgcccatggaactgatgacttc

SEQ ID NO: 119387 - DNA, 25 bp, Homo sapien
gaactgatgacttccgagctgtccc

SEQ ID NO: 119388 - DNA, 25 bp, Homo sapien
ttctcttcctatataaccttgcccg

SEQ ID NO: 119389 - DNA, 25 bp, Homo sapien
tgccggccgctgataacggaacaca

SEQ ID NO: 119390 - DNA, 25 bp, Homo sapien
cccgagcataccagcagcgaggaga

SEQ ID NO: 119391 - DNA, 25 bp, Homo sapien
tggttctgccgagccactgcccgaa

SEQ ID NO: 119392 - DNA, 25 bp, Homo sapien
ccgaggcgaaggagccatcccgaaa

SEQ ID NO: 119393 - DNA, 25 bp, Homo sapien
cagtgaagtcaggttccgaggcgaa

SEQ ID NO: 119394 - DNA, 25 bp, Homo sapien
aggagccatcccgaaattacccaga

SEQ ID NO: 119395 - DNA, 25 bp, Homo sapien
ttacccagatgagaaatcttgtttc

SEQ ID NO: 119396 - DNA, 25 bp, Homo sapien
atcttgtttccgaagcgcctctgcg

SEQ ID NO: 119397 - DNA, 25 bp, Homo sapien
caccaagggagagtgagttctgacc

SEQ ID NO: 119398 - DNA, 25 bp, Homo sapien
agccactttggctgctggttctgcc

SEQ ID NO: 119399 - DNA, 25 bp, Homo sapien
aacagaaagctctcccacgacagcg

SEQ ID NO: 119400 - DNA, 25 bp, Homo sapien
cttcccaatcggtgattccggggca

SEQ ID NO: 119401 - DNA, 25 bp, Homo sapien
agtcagctgacctgaaacagaaagc

SEQ ID NO: 119402 - DNA, 25 bp, Homo sapien
cagtctcctggacgcagtcagctga

SEQ ID NO: 119403 - DNA, 25 bp, Homo sapien
aggctgcctccaaggattcttccca

SEQ ID NO: 119404 - DNA, 25 bp, Homo sapien
ctactgtcagtcagaaatggaggcg

SEQ ID NO: 119405 - DNA, 25 bp, Homo sapien
cgccaaacgtgaccgcgatggtcgc

SEQ ID NO: 119406 - DNA, 25 bp, Homo sapien
cgcgatggtcgctacactactgtca

SEQ ID NO: 119407 - DNA, 25 bp, Homo sapien
tctgcagccggctcgtctgtgtgtg

SEQ ID NO: 119408 - DNA, 25 bp, Homo sapien
gcggacatgtccctgcaagtgacgt

SEQ ID NO: 119409 - DNA, 25 bp, Homo sapien
catgtccctgcaagtgacgtctgca

SEQ ID NO: 119410 - DNA, 25 bp, Homo sapien
agtgacgtctgcagccggctcgtct

SEQ ID NO: 119411 - DNA, 25 bp, Homo sapien
cacctggtgcctgcagaggggtcag

SEQ ID NO: 119412 - DNA, 25 bp, Homo sapien
cccttacgcggatgccgcaggtggt

SEQ ID NO: 119413 - DNA, 25 bp, Homo sapien
gccggccccaggtagaggacgttca

SEQ ID NO: 119414 - DNA, 25 bp, Homo sapien
tgcaagtgacgtctgcagccggctc

SEQ ID NO: 119415 - DNA, 25 bp, Homo sapien
gggcctgctcgctctctgcttatca

SEQ ID NO: 119416 - DNA, 25 bp, Homo sapien
acccagaagggaagatggcacagcc

SEQ ID NO: 119417 - DNA, 25 bp, Homo sapien
aaaagttcaggaggagctgctcgcg

SEQ ID NO: 119418 - DNA, 25 bp, Homo sapien
ctggccagctgtcggctaatctgct

SEQ ID NO: 119419 - DNA, 25 bp, Homo sapien
ggcctgtatccgctgcgtgctgtgt

SEQ ID NO: 119420 - DNA, 25 bp, Homo sapien
ggtaatttctcattggggcctgctc

SEQ ID NO: 119421 - DNA, 25 bp, Homo sapien
ctgctggctacgagcaggtaatttc

SEQ ID NO: 119422 - DNA, 25 bp, Homo sapien
tgctgtgtgagcagagataagattc

SEQ ID NO: 119423 - DNA, 25 bp, Homo sapien
gtggcccggactgtcatgtgattcc

SEQ ID NO: 119424 - DNA, 25 bp, Homo sapien
tctctcaagtgtcattcggccgccg

SEQ ID NO: 119425 - DNA, 25 bp, Homo sapien
gcgtcgcggtgcatcaaggtaaaca

SEQ ID NO: 119426 - DNA, 25 bp, Homo sapien
gaggctgttgcgtttgctcagacga

SEQ ID NO: 119427 - DNA, 25 bp, Homo sapien
ttagatggtctctagcgaccggccc

SEQ ID NO: 119428 - DNA, 25 bp, Homo sapien
acatggctcctgactcctgtgcgga

SEQ ID NO: 119429 - DNA, 25 bp, Homo sapien
cttgattatgtgtgccctctccggg

SEQ ID NO: 119430 - DNA, 25 bp, Homo sapien
gaggacgaggtctcccatagtatga

SEQ ID NO: 119431 - DNA, 25 bp, Homo sapien
tgccaaatttgtggggcagcgttcc

SEQ ID NO: 119432 - DNA, 25 bp, Homo sapien
ccttcctggtcctgcgggtccagga

SEQ ID NO: 119433 - DNA, 25 bp, Homo sapien
ccatggccctggtcacagtgagccg

SEQ ID NO: 119434 - DNA, 25 bp, Homo sapien
ggctcctctcgaacggggacatgag

SEQ ID NO: 119435 - DNA, 25 bp, Homo sapien
gacgattggcatctggcgccttttc

SEQ ID NO: 119436 - DNA, 25 bp, Homo sapien
cccaactctagaattcctgagagag

SEQ ID NO: 119437 - DNA, 25 bp, Homo sapien
cggtccagcgaaggagtcgactcca

SEQ ID NO: 119438 - DNA, 25 bp, Homo sapien
ctgggcgagtgtctggccctttaag

SEQ ID NO: 119439 - DNA, 25 bp, Homo sapien
tgagcaataaccgttgctcccggtt

SEQ ID NO: 119440 - DNA, 25 bp, Homo sapien
ggtgcccggtatgcctgagcaataa

SEQ ID NO: 119441 - DNA, 25 bp, Homo sapien
aagcttctgctcagaccgtgacctc

SEQ ID NO: 119442 - DNA, 25 bp, Homo sapien
attgcggacagggaagcttctgctc

SEQ ID NO: 119443 - DNA, 25 bp, Homo sapien
ggccctaccagatgatgagaacttg

SEQ ID NO: 119444 - DNA, 25 bp, Homo sapien
ggaaatgactccaagcaccgcctct

SEQ ID NO: 119445 - DNA, 25 bp, Homo sapien
agagcgcctctcaccgagtcaagca

SEQ ID NO: 119446 - DNA, 25 bp, Homo sapien
cggtccgaaccgagagtggtctcaa

SEQ ID NO: 119447 - DNA, 25 bp, Homo sapien
ctgtaagtccctgtgagggctccgg

SEQ ID NO: 119448 - DNA, 25 bp, Homo sapien
ccgcggagcctgtaagtccctgtga

SEQ ID NO: 119449 - DNA, 25 bp, Homo sapien
gaaacctgaataagacctgcggggc

SEQ ID NO: 119450 - DNA, 25 bp, Homo sapien
cctggggagctggaaacctgaataa

SEQ ID NO: 119451 - DNA, 25 bp, Homo sapien
cacgaatgcgaaggccgaaagggaa

SEQ ID NO: 119452 - DNA, 25 bp, Homo sapien
tcagagaagcacgaatgcgaaggcc

SEQ ID NO: 119453 - DNA, 25 bp, Homo sapien
ggcagggacattcgtcagagaagca

SEQ ID NO: 119454 - DNA, 25 bp, Homo sapien
tccggactttgtgccgttctccgca

SEQ ID NO: 119455 - DNA, 25 bp, Homo sapien
tcattagtgaaacaggcgtgcactc

SEQ ID NO: 119456 - DNA, 25 bp, Homo sapien
gtgtgacttccgatccgccttctcg

SEQ ID NO: 119457 - DNA, 25 bp, Homo sapien
atgctacccacaacgtcagcatgtc

SEQ ID NO: 119458 - DNA, 25 bp, Homo sapien
ctggagtccacgttcacgacctctg

SEQ ID NO: 119459 - DNA, 25 bp, Homo sapien
gggaagtctgcgttcattagtgaaa

SEQ ID NO: 119460 - DNA, 25 bp, Homo sapien
cacggtgagctgaagaaaggccgtc

SEQ ID NO: 119461 - DNA, 25 bp, Homo sapien
gagctgaagaaaggccgtcgccagc

SEQ ID NO: 119462 - DNA, 25 bp, Homo sapien
acgtcagcatgtccgtggctttgga

SEQ ID NO: 119463 - DNA, 25 bp, Homo sapien
caggtgtggacacaatgcgggtgta

SEQ ID NO: 119464 - DNA, 25 bp, Homo sapien
atgcgggtgtagacgtagaacaagt

SEQ ID NO: 119465 - DNA, 25 bp, Homo sapien
acgtagaacaagtggggacgtcaca

SEQ ID NO: 119466 - DNA, 25 bp, Homo sapien
gacgtagaacaagtggggacgtcac

SEQ ID NO: 119467 - DNA, 25 bp, Homo sapien
tgcgggtgtagacgtagaacaagtg

SEQ ID NO: 119468 - DNA, 25 bp, Homo sapien
cacaatgcgggtgtagacgtagaac

SEQ ID NO: 119469 - DNA, 25 bp, Homo sapien
tagacgtagaacaagtggggacgtc

SEQ ID NO: 119470 - DNA, 25 bp, Homo sapien
tagaacaagtggggacgtcacaggt

SEQ ID NO: 119471 - DNA, 25 bp, Homo sapien
cctagtgcacacgatcacggggatc

SEQ ID NO: 119472 - DNA, 25 bp, Homo sapien
gctcggtacctgacccggagatgag

SEQ ID NO: 119473 - DNA, 25 bp, Homo sapien
ctccctcactgagtgcctgggaaca

SEQ ID NO: 119474 - DNA, 25 bp, Homo sapien
gatcacggggatctataggcacacg

SEQ ID NO: 119475 - DNA, 25 bp, Homo sapien
cctgggaacagcttccggatggctc

SEQ ID NO: 119476 - DNA, 25 bp, Homo sapien
cttccggatggctcggtacctgacc

SEQ ID NO: 119477 - DNA, 25 bp, Homo sapien
cggggatctataggcacacgatcac

SEQ ID NO: 119478 - DNA, 25 bp, Homo sapien
ttcctgcctagtgcacacgatcacg

SEQ ID NO: 119479 - DNA, 25 bp, Homo sapien
cgaagtcccgcagcgaaatctccgg

SEQ ID NO: 119480 - DNA, 25 bp, Homo sapien
ccgcagcgaaatctccgggaggccg

SEQ ID NO: 119481 - DNA, 25 bp, Homo sapien
ggcaatctgggccgtgacctccgag

SEQ ID NO: 119482 - DNA, 25 bp, Homo sapien
gagtcccgggaccaccttgcggaga

SEQ ID NO: 119483 - DNA, 25 bp, Homo sapien
gaccaccttgcggagaaaagtccgc

SEQ ID NO: 119484 - DNA, 25 bp, Homo sapien
ggggcatccgagctcaagcgccgct

SEQ ID NO: 119485 - DNA, 25 bp, Homo sapien
gtgggttccaccttcccagcgcctc

SEQ ID NO: 119486 - DNA, 25 bp, Homo sapien
ccgcacctgccacggaggagaagct

SEQ ID NO: 119487 - DNA, 25 bp, Homo sapien
tccagaaccacaatttgggagtggg

SEQ ID NO: 119488 - DNA, 25 bp, Homo sapien
ccgcacgtgtcagcgcccgcgaccc

SEQ ID NO: 119489 - DNA, 25 bp, Homo sapien
cgcgacccgggatcctccagaacca

SEQ ID NO: 119490 - DNA, 25 bp, Homo sapien
cgacccgggatcctccagaaccaca

SEQ ID NO: 119491 - DNA, 25 bp, Homo sapien
ctccagaaccacaatttgggagtgg

SEQ ID NO: 119492 - DNA, 25 bp, Homo sapien
cagaaccacaatttgggagtgggcc

SEQ ID NO: 119493 - DNA, 25 bp, Homo sapien
gggctccacccgcacgtgtcagcgc

SEQ ID NO: 119494 - DNA, 25 bp, Homo sapien
tccacccgcacgtgtcagcgcccgc

SEQ ID NO: 119495 - DNA, 25 bp, Homo sapien
aaaacgctgggctgaatgtatcatc

SEQ ID NO: 119496 - DNA, 25 bp, Homo sapien
cccggtctttcctgcgttggcgctg

SEQ ID NO: 119497 - DNA, 25 bp, Homo sapien
gggctgaatgtatcatcacagaacc

SEQ ID NO: 119498 - DNA, 25 bp, Homo sapien
atgtatcatcacagaacccaggagg

SEQ ID NO: 119499 - DNA, 25 bp, Homo sapien
aacccaggagggaaccagcaaagcg

SEQ ID NO: 119500 - DNA, 25 bp, Homo sapien
acagctgcaggcctctgcggtgacg

SEQ ID NO: 119501 - DNA, 25 bp, Homo sapien
cggtttagggtcagcaaaaacgctg

SEQ ID NO: 119502 - DNA, 25 bp, Homo sapien
acgctgggctgaatgtatcatcaca

SEQ ID NO: 119503 - DNA, 25 bp, Homo sapien
agtcctagttcaaggaataaacacg

SEQ ID NO: 119504 - DNA, 25 bp, Homo sapien
ggcgcggaatagtaagtcctagttc

SEQ ID NO: 119505 - DNA, 25 bp, Homo sapien
cgcggaatagtaagtcctagttcaa

SEQ ID NO: 119506 - DNA, 25 bp, Homo sapien
cggaatagtaagtcctagttcaagg

SEQ ID NO: 119507 - DNA, 25 bp, Homo sapien
aagggcgcggaatagtaagtcctag

SEQ ID NO: 119508 - DNA, 25 bp, Homo sapien
ggaataaacacggatccccactggc

SEQ ID NO: 119509 - DNA, 25 bp, Homo sapien
ccatgccgggactgacgcaggaaaa

SEQ ID NO: 119510 - DNA, 25 bp, Homo sapien
ctagttcaaggaataaacacggatc

SEQ ID NO: 119511 - DNA, 25 bp, Homo sapien
ctggcccagcgctttcataaaaggg

SEQ ID NO: 119512 - DNA, 25 bp, Homo sapien
cgctttcataaaagggcgcggaata

SEQ ID NO: 119513 - DNA, 25 bp, Homo sapien
gttcctggcccagcgctttcataaa

SEQ ID NO: 119514 - DNA, 25 bp, Homo sapien
cgggtgaacctggaactgtgttcct

SEQ ID NO: 119515 - DNA, 25 bp, Homo sapien
ctcagccgggtgaacctggaactgt

SEQ ID NO: 119516 - DNA, 25 bp, Homo sapien
gcgagtcttcttggcttccgtgtcc

SEQ ID NO: 119517 - DNA, 25 bp, Homo sapien
cagcgctctgggttcgggtctctgc

SEQ ID NO: 119518 - DNA, 25 bp, Homo sapien
cctttcccgcgagtcttcttggctt

SEQ ID NO: 119519 - DNA, 25 bp, Homo sapien
cgggcctgcatccaaacgcaaacgg

SEQ ID NO: 119520 - DNA, 25 bp, Homo sapien
cgtcgagtaaagcaccggaaggctc

SEQ ID NO: 119521 - DNA, 25 bp, Homo sapien
tgccctcgactaacagcgcagcgaa

SEQ ID NO: 119522 - DNA, 25 bp, Homo sapien
ccaggcccacgaagcaggaaacaca

SEQ ID NO: 119523 - DNA, 25 bp, Homo sapien
cctgcactatttgtggcgtcgagta

SEQ ID NO: 119524 - DNA, 25 bp, Homo sapien
cgttgcctcaattcactccgatgtg

SEQ ID NO: 119525 - DNA, 25 bp, Homo sapien
agcctggaaaggaacgcgttgcctc

SEQ ID NO: 119526 - DNA, 25 bp, Homo sapien
acacacgcggctcagtcacctaggg

SEQ ID NO: 119527 - DNA, 25 bp, Homo sapien
cacttggctgtggaagtgctgctcc

SEQ ID NO: 119528 - DNA, 25 bp, Homo sapien
cccgcgagccgtgttggaacaggta

SEQ ID NO: 119529 - DNA, 25 bp, Homo sapien
ttggaacaggtaccgcgaccacgac

SEQ ID NO: 119530 - DNA, 25 bp, Homo sapien
tcagcagcctcagacgagcagctct

SEQ ID NO: 119531 - DNA, 25 bp, Homo sapien
agacgagcagctctgactaagggag

SEQ ID NO: 119532 - DNA, 25 bp, Homo sapien
cggtgcaggcatacgtcagacgaaa

SEQ ID NO: 119533 - DNA, 25 bp, Homo sapien
tacgtcagacgaaaggcgccgatgc

SEQ ID NO: 119534 - DNA, 25 bp, Homo sapien
ccgatgcgtcagaaaagcgcgcctc

SEQ ID NO: 119535 - DNA, 25 bp, Homo sapien
acattagtgagtagcagtggggtcc

SEQ ID NO: 119536 - DNA, 25 bp, Homo sapien
ggtctccctcttacgagccgacatt

SEQ ID NO: 119537 - DNA, 25 bp, Homo sapien
ttacgagccgacattagtgagtagc

SEQ ID NO: 119538 - DNA, 25 bp, Homo sapien
attagtgagtagcagtggggtcctc

SEQ ID NO: 119539 - DNA, 25 bp, Homo sapien
gggtcctcggtctccctcgtgtgag

SEQ ID NO: 119540 - DNA, 25 bp, Homo sapien
ggtcctcggtctccctcgtgtgagc

SEQ ID NO: 119541 - DNA, 25 bp, Homo sapien
tcgtgtgagccgacatcggagagta

SEQ ID NO: 119542 - DNA, 25 bp, Homo sapien
tccctcttacgagccgacattagtg

SEQ ID NO: 119543 - DNA, 25 bp, Homo sapien
tgcagaaaggcagctaccggcaggc

SEQ ID NO: 119544 - DNA, 25 bp, Homo sapien
gcgtccagatctgagcgcacgagga

SEQ ID NO: 119545 - DNA, 25 bp, Homo sapien
gggctgaagacctcactccttcggc

SEQ ID NO: 119546 - DNA, 25 bp, Homo sapien
cctggggccaggatctagttaggca

SEQ ID NO: 119547 - DNA, 25 bp, Homo sapien
caggatctagttaggcactggtgag

SEQ ID NO: 119548 - DNA, 25 bp, Homo sapien
agggtccgcagagagcctgttaaca

SEQ ID NO: 119549 - DNA, 25 bp, Homo sapien
agagcctgttaacagtctggctgca

SEQ ID NO: 119550 - DNA, 25 bp, Homo sapien
cgcaagccaggtggcgtccagatct

SEQ ID NO: 119551 - DNA, 25 bp, Homo sapien
cacgactgggtgacgaggtgtcgtt

SEQ ID NO: 119552 - DNA, 25 bp, Homo sapien
cctttacccaggactgtggaaatag

SEQ ID NO: 119553 - DNA, 25 bp, Homo sapien
acccaggactgtggaaataggactc

SEQ ID NO: 119554 - DNA, 25 bp, Homo sapien
aggactgtggaaataggactctttc

SEQ ID NO: 119555 - DNA, 25 bp, Homo sapien
ataggactctttcccatgcgactgg

SEQ ID NO: 119556 - DNA, 25 bp, Homo sapien
aggactctttcccatgcgactgggt

SEQ ID NO: 119557 - DNA, 25 bp, Homo sapien
acacgctgggtgaagaggtgtgcgc

SEQ ID NO: 119558 - DNA, 25 bp, Homo sapien
cgcacgctgggtgaagaggtgtgcg

SEQ ID NO: 119559 - DNA, 25 bp, Homo sapien
tggcggccttgacacacagaaacag

SEQ ID NO: 119560 - DNA, 25 bp, Homo sapien
cactgagccgttctgtgcgccagac

SEQ ID NO: 119561 - DNA, 25 bp, Homo sapien
acgatcacagacagaaaactcacgc

SEQ ID NO: 119562 - DNA, 25 bp, Homo sapien
gggagttcaccaccaaccactgagc

SEQ ID NO: 119563 - DNA, 25 bp, Homo sapien
tcgattttcactcatggggttcctg

SEQ ID NO: 119564 - DNA, 25 bp, Homo sapien
actcggcgcaagtaatcgattttca

SEQ ID NO: 119565 - DNA, 25 bp, Homo sapien
cggctgagcactcggcgcaagtaat

SEQ ID NO: 119566 - DNA, 25 bp, Homo sapien
gctgactcacctggcggccttgaca

SEQ ID NO: 119567 - DNA, 25 bp, Homo sapien
gggccacaggcgtctccctggtccg

SEQ ID NO: 119568 - DNA, 25 bp, Homo sapien
aatccagacgcaaactgcgcggcct

SEQ ID NO: 119569 - DNA, 25 bp, Homo sapien
gaacctcaaacgctctgccctcggg

SEQ ID NO: 119570 - DNA, 25 bp, Homo sapien
gcttcccaaaaatccagacgcaaac

SEQ ID NO: 119571 - DNA, 25 bp, Homo sapien
agaggaacctcaaacgctctgccct

SEQ ID NO: 119572 - DNA, 25 bp, Homo sapien
caaaaatccagacgcaaactgcgcg

SEQ ID NO: 119573 - DNA, 25 bp, Homo sapien
gtaaagaggaacctcaaacgctctg

SEQ ID NO: 119574 - DNA, 25 bp, Homo sapien
cctctgcgttcgcttcccggttcaa

SEQ ID NO: 119575 - DNA, 25 bp, Homo sapien
cgttgcctcggtttgaacaagcgca

SEQ ID NO: 119576 - DNA, 25 bp, Homo sapien
cgcaaaaagaaggacggcagcagct

SEQ ID NO: 119577 - DNA, 25 bp, Homo sapien
gatccgaaagctggagcgttgcctc

SEQ ID NO: 119578 - DNA, 25 bp, Homo sapien
ccgaagaagccagcggtcaccggca

SEQ ID NO: 119579 - DNA, 25 bp, Homo sapien
acctgcggaaagcacgccggctgca

SEQ ID NO: 119580 - DNA, 25 bp, Homo sapien
gtgcgtccacgcgtttcgaaagatg

SEQ ID NO: 119581 - DNA, 25 bp, Homo sapien
ggagttcgtgcacgcgacttcggaa

SEQ ID NO: 119582 - DNA, 25 bp, Homo sapien
ccctgaagaggctgaagctagcggt

SEQ ID NO: 119583 - DNA, 25 bp, Homo sapien
ctccctgtgggtagcattcccgtca

SEQ ID NO: 119584 - DNA, 25 bp, Homo sapien
accatgcttttgtggtctcgccgcg

SEQ ID NO: 119585 - DNA, 25 bp, Homo sapien
gagtttctctgtgtttcgaccatgc

SEQ ID NO: 119586 - DNA, 25 bp, Homo sapien
acaccctcaggcgtagagctttaga

SEQ ID NO: 119587 - DNA, 25 bp, Homo sapien
gcacagatgctaccaccgatgagcg

SEQ ID NO: 119588 - DNA, 25 bp, Homo sapien
ggcattgcgctcatcctggaacagc

SEQ ID NO: 119589 - DNA, 25 bp, Homo sapien
ttcagctaagattgcagtgggtcca

SEQ ID NO: 119590 - DNA, 25 bp, Homo sapien
ttgcctttcgctcgcccaggcattg

SEQ ID NO: 119591 - DNA, 25 bp, Homo sapien
gacagcgctccgcaagactttgata

SEQ ID NO: 119592 - DNA, 25 bp, Homo sapien
ggaggtcacacctccgacgggatta

SEQ ID NO: 119593 - DNA, 25 bp, Homo sapien
cgcattgtccgcacggtgtgtactc

SEQ ID NO: 119594 - DNA, 25 bp, Homo sapien
aacatacttgcccttgtggtcggga

SEQ ID NO: 119595 - DNA, 25 bp, Homo sapien
gtgaaagtgtgaaaccagggccacc

SEQ ID NO: 119596 - DNA, 25 bp, Homo sapien
cctggcgcgtcgtaaagtgatttac

SEQ ID NO: 119597 - DNA, 25 bp, Homo sapien
cttgagacacacctggcgcgtcgta

SEQ ID NO: 119598 - DNA, 25 bp, Homo sapien
cgttcctgtcgtgtccagcttgaga

SEQ ID NO: 119599 - DNA, 25 bp, Homo sapien
cctcagggtgagacgacttagaagc

SEQ ID NO: 119600 - DNA, 25 bp, Homo sapien
ggaaccaaatcttcacctgcgggca

SEQ ID NO: 119601 - DNA, 25 bp, Homo sapien
agctggctacgtcgcggtaaatctc

SEQ ID NO: 119602 - DNA, 25 bp, Homo sapien
caaaatttctcgaatgcggcctggg

SEQ ID NO: 119603 - DNA, 25 bp, Homo sapien
tctgggcaccttagatgaacccgtg

SEQ ID NO: 119604 - DNA, 25 bp, Homo sapien
accgcccgtgggtcacaagtgcaaa

SEQ ID NO: 119605 - DNA, 25 bp, Homo sapien
ccgcgacaggtacttgttgagcttg

SEQ ID NO: 119606 - DNA, 25 bp, Homo sapien
ctggggatcaccttcttcagaatga

SEQ ID NO: 119607 - DNA, 25 bp, Homo sapien
cctccgggacagctagaggacagca

SEQ ID NO: 119608 - DNA, 25 bp, Homo sapien
cccgcgtaccttcgcttctgttgaa

SEQ ID NO: 119609 - DNA, 25 bp, Homo sapien
gcaggctgaacctcaccaatgtgtt

SEQ ID NO: 119610 - DNA, 25 bp, Homo sapien
gaatgaattgttcaccgtgcccgga

SEQ ID NO: 119611 - DNA, 25 bp, Homo sapien
cctcgagaccgttcattaggcagaa

SEQ ID NO: 119612 - DNA, 25 bp, Homo sapien
cttgagggctgcaaagactttctcc

SEQ ID NO: 119613 - DNA, 25 bp, Homo sapien
gggcggccctattaacagcgtcttc

SEQ ID NO: 119614 - DNA, 25 bp, Homo sapien
aagcctgggcctgtctgaaaacacc

SEQ ID NO: 119615 - DNA, 25 bp, Homo sapien
cagcagtttgaacgctcgtgacata

SEQ ID NO: 119616 - DNA, 25 bp, Homo sapien
gctccagaggcggtttcaagtttca

SEQ ID NO: 119617 - DNA, 25 bp, Homo sapien
ctcgtgcacgctgatccagtacaaa

SEQ ID NO: 119618 - DNA, 25 bp, Homo sapien
ctgacacccacttgagactccgatt

SEQ ID NO: 119619 - DNA, 25 bp, Homo sapien
gccacaggtatttttgccaacactt

SEQ ID NO: 119620 - DNA, 25 bp, Homo sapien
gcgttccgggaaatgtgcctcagta

SEQ ID NO: 119621 - DNA, 25 bp, Homo sapien
gtcctcgcggacttgtttgcacaga

SEQ ID NO: 119622 - DNA, 25 bp, Homo sapien
aacactgtgggtttccgccttctcg

SEQ ID NO: 119623 - DNA, 25 bp, Homo sapien
ggcccgactcataagtagctgaccc

SEQ ID NO: 119624 - DNA, 25 bp, Homo sapien
tgtcccgcccggatggagaggaagc

SEQ ID NO: 119625 - DNA, 25 bp, Homo sapien
cagcccggagagtccgcgtgtgcca

SEQ ID NO: 119626 - DNA, 25 bp, Homo sapien
ctgaaagcgttgagccatatacatc

SEQ ID NO: 119627 - DNA, 25 bp, Homo sapien
aaagcgttgagccatatacatctgc

SEQ ID NO: 119628 - DNA, 25 bp, Homo sapien
agccatatacatctgctcggcccga

SEQ ID NO: 119629 - DNA, 25 bp, Homo sapien
gctcggcccgactcataagtagctg

SEQ ID NO: 119630 - DNA, 25 bp, Homo sapien
cggcggctgaaagcgttgagccata

SEQ ID NO: 119631 - DNA, 25 bp, Homo sapien
tgccaataatcaaagtcgccgccgg

SEQ ID NO: 119632 - DNA, 25 bp, Homo sapien
ggcgtcgatgcggaaatttttggat

SEQ ID NO: 119633 - DNA, 25 bp, Homo sapien
ttggatttttccatcggctcgtttg

SEQ ID NO: 119634 - DNA, 25 bp, Homo sapien
ggaaactcagccgagggtgaccatg

SEQ ID NO: 119635 - DNA, 25 bp, Homo sapien
cgcacttgaagctcagcgcggcttc

SEQ ID NO: 119636 - DNA, 25 bp, Homo sapien
gacaccaacggggagtggatactcc

SEQ ID NO: 119637 - DNA, 25 bp, Homo sapien
tggatactccgaggctcaacctggg

SEQ ID NO: 119638 - DNA, 25 bp, Homo sapien
cggttctttgcgctgcagccctcag

SEQ ID NO: 119639 - DNA, 25 bp, Homo sapien
caggcgcaaagagtttccctcgttg

SEQ ID NO: 119640 - DNA, 25 bp, Homo sapien
cagctaagcgcgaaggtgttgtttc

SEQ ID NO: 119641 - DNA, 25 bp, Homo sapien
gggaccagcgcttccaaattctctg

SEQ ID NO: 119642 - DNA, 25 bp, Homo sapien
ttagccacatcgaccgcaacgttcg

SEQ ID NO: 119643 - DNA, 25 bp, Homo sapien
ctgccgcttgttaggccaagttttc

SEQ ID NO: 119644 - DNA, 25 bp, Homo sapien
ctggacctggaacgcttgcagcacg

SEQ ID NO: 119645 - DNA, 25 bp, Homo sapien
caccgggcataggagcctctcagca

SEQ ID NO: 119646 - DNA, 25 bp, Homo sapien
tgtgtccattcccttagcctccagg

SEQ ID NO: 119647 - DNA, 25 bp, Homo sapien
gacctcttcgcaggcgcctgagcag

SEQ ID NO: 119648 - DNA, 25 bp, Homo sapien
ggctccacttttccttaattgacga

SEQ ID NO: 119649 - DNA, 25 bp, Homo sapien
cttcttgctgccctacaaaacttta

SEQ ID NO: 119650 - DNA, 25 bp, Homo sapien
cacctttgcttttgcgagctgcgcg

SEQ ID NO: 119651 - DNA, 25 bp, Homo sapien
attgacgaagtcacggattcctccc

SEQ ID NO: 119652 - DNA, 25 bp, Homo sapien
gccgtctgcccgagttcggcttcaa

SEQ ID NO: 119653 - DNA, 25 bp, Homo sapien
gcgttcctacgagacacctgagctg

SEQ ID NO: 119654 - DNA, 25 bp, Homo sapien
cactgtgtttccacgggctaggaga

SEQ ID NO: 119655 - DNA, 25 bp, Homo sapien
tgagagttattgacacgcccgtgcc

SEQ ID NO: 119656 - DNA, 25 bp, Homo sapien
tcgccttcaggcacaggtaagcgca

SEQ ID NO: 119657 - DNA, 25 bp, Homo sapien
agcaactcctaacactgggctcgga

SEQ ID NO: 119658 - DNA, 25 bp, Homo sapien
gagctgctcgcatcgactgctaata

SEQ ID NO: 119659 - DNA, 25 bp, Homo sapien
gcgtgcctgcgatgtcttctctaaa

SEQ ID NO: 119660 - DNA, 25 bp, Homo sapien
cgcaaactgcgagagggtcttctta

SEQ ID NO: 119661 - DNA, 25 bp, Homo sapien
tggaagcgatttcagcgcaaactgc

SEQ ID NO: 119662 - DNA, 25 bp, Homo sapien
acccggatgatagatgtggcgtgcc

SEQ ID NO: 119663 - DNA, 25 bp, Homo sapien
atatatctgcgaaccggggactccc

SEQ ID NO: 119664 - DNA, 25 bp, Homo sapien
gcctcgggctgagaagagtaaattc

SEQ ID NO: 119665 - DNA, 25 bp, Homo sapien
tccgatcggcgcaaacgttcggttc

SEQ ID NO: 119666 - DNA, 25 bp, Homo sapien
taaattctgcagaaagggccgcgtc

SEQ ID NO: 119667 - DNA, 25 bp, Homo sapien
gacctgcggtgtctgttttattgca

SEQ ID NO: 119668 - DNA, 25 bp, Homo sapien
gcgcagactcctacttgctcagtga

SEQ ID NO: 119669 - DNA, 25 bp, Homo sapien
tgctcagtgacttcgcaagctcgtg

SEQ ID NO: 119670 - DNA, 25 bp, Homo sapien
ttcggttcgtagcaggagcttctcc

SEQ ID NO: 119671 - DNA, 25 bp, Homo sapien
ctctgtgaaaggcaggctctggctc

SEQ ID NO: 119672 - DNA, 25 bp, Homo sapien
agctgagcacggaagcgccgcctca

SEQ ID NO: 119673 - DNA, 25 bp, Homo sapien
caaaccctcgcgtgtgtaggactcc

SEQ ID NO: 119674 - DNA, 25 bp, Homo sapien
gggcccgaatggcaccgacgcaact

SEQ ID NO: 119675 - DNA, 25 bp, Homo sapien
tggcaccgacgcaactggtccaggc

SEQ ID NO: 119676 - DNA, 25 bp, Homo sapien
gcccgggacgggaacatccgagcaa

SEQ ID NO: 119677 - DNA, 25 bp, Homo sapien
atccgagcaacgatccatgcccagg

SEQ ID NO: 119678 - DNA, 25 bp, Homo sapien
aggcagaaagctagcccggcacagc

SEQ ID NO: 119679 - DNA, 25 bp, Homo sapien
gaagacgcaaacctaacacgcagga

SEQ ID NO: 119680 - DNA, 25 bp, Homo sapien
acacgcaggaggcaggaaccgtctg

SEQ ID NO: 119681 - DNA, 25 bp, Homo sapien
acagcctccgcgatgggagctccgg

SEQ ID NO: 119682 - DNA, 25 bp, Homo sapien
gtgtggctcagacccggcacagcct

SEQ ID NO: 119683 - DNA, 25 bp, Homo sapien
gtgtgctgaagacgcaaacctaaca

SEQ ID NO: 119684 - DNA, 25 bp, Homo sapien
aggcaggaaccgtctgaggcagccc

SEQ ID NO: 119685 - DNA, 25 bp, Homo sapien
cgcaagtgtgctgaagacgcaaacc

SEQ ID NO: 119686 - DNA, 25 bp, Homo sapien
cggcaaacgtcaggctgtgtggctc

SEQ ID NO: 119687 - DNA, 25 bp, Homo sapien
ttggccctgactcccgtgcacagcg

SEQ ID NO: 119688 - DNA, 25 bp, Homo sapien
ttaggacgcggttgtgctgacctga

SEQ ID NO: 119689 - DNA, 25 bp, Homo sapien
agttaggacgcggttgtgctgacct

SEQ ID NO: 119690 - DNA, 25 bp, Homo sapien
gtgttttcagctcccggctcttgcc

SEQ ID NO: 119691 - DNA, 25 bp, Homo sapien
tccttgtgttttcagctcccggctc

SEQ ID NO: 119692 - DNA, 25 bp, Homo sapien
gcgtccttgtgttttcagctcccgg

SEQ ID NO: 119693 - DNA, 25 bp, Homo sapien
ctccaggcgtccttgtgttttcagc

SEQ ID NO: 119694 - DNA, 25 bp, Homo sapien
ggactccaggcgtccttgtgttttc

SEQ ID NO: 119695 - DNA, 25 bp, Homo sapien
cgcacatgggctaggctgccaggat

SEQ ID NO: 119696 - DNA, 25 bp, Homo sapien
cccgaggcggcagttccaggtgcaa

SEQ ID NO: 119697 - DNA, 25 bp, Homo sapien
gcaagcgccgggtttgctgcccgct

SEQ ID NO: 119698 - DNA, 25 bp, Homo sapien
ttcagcttcgaaggcgacttcaaga

SEQ ID NO: 119699 - DNA, 25 bp, Homo sapien
ctgccaggatgttcagcttcgaagg

SEQ ID NO: 119700 - DNA, 25 bp, Homo sapien
gcgacttcaagacgcggcccaaggt

SEQ ID NO: 119701 - DNA, 25 bp, Homo sapien
agttccaggtgcaagcgccgggttt

SEQ ID NO: 119702 - DNA, 25 bp, Homo sapien
cccaaggtgtcccttggcggcgcga

SEQ ID NO: 119703 - DNA, 25 bp, Homo sapien
ccctgcatgcttccagcttggctga

SEQ ID NO: 119704 - DNA, 25 bp, Homo sapien
gtaccagaaggttccgccctgcatg

SEQ ID NO: 119705 - DNA, 25 bp, Homo sapien
cccgacaaggacttcagagcgctga

SEQ ID NO: 119706 - DNA, 25 bp, Homo sapien
cttggaaccgcgcaaaggacgcttc

SEQ ID NO: 119707 - DNA, 25 bp, Homo sapien
cgtattcgtccgctcgcccagtaaa

SEQ ID NO: 119708 - DNA, 25 bp, Homo sapien
tggctgtatacctgggtcacccgtg

SEQ ID NO: 119709 - DNA, 25 bp, Homo sapien
gaggcccacttcatttccgtattcg

SEQ ID NO: 119710 - DNA, 25 bp, Homo sapien
cgccctgacgatgagagatgcacga

SEQ ID NO: 119711 - DNA, 25 bp, Homo sapien
tacgagtctctgctgccattttagg

SEQ ID NO: 119712 - DNA, 25 bp, Homo sapien
agctgcaccagagcctgtgtggaaa

SEQ ID NO: 119713 - DNA, 25 bp, Homo sapien
tcagcacagcgatgcgaacctctca

SEQ ID NO: 119714 - DNA, 25 bp, Homo sapien
tggcatcgttccatgggcaagcacc

SEQ ID NO: 119715 - DNA, 25 bp, Homo sapien
tgcacggctctggaacctgccagga

SEQ ID NO: 119716 - DNA, 25 bp, Homo sapien
tgagattctgtcatttccgctgtgc

SEQ ID NO: 119717 - DNA, 25 bp, Homo sapien
atgcagaattctcccacgtgtgtca

SEQ ID NO: 119718 - DNA, 25 bp, Homo sapien
cagatgatcggcttctacgagtctc

SEQ ID NO: 119719 - DNA, 25 bp, Homo sapien
gccatttggaatcttctcggccttc

SEQ ID NO: 119720 - DNA, 25 bp, Homo sapien
gaagagccgagaaccttcgcgaagg

SEQ ID NO: 119721 - DNA, 25 bp, Homo sapien
catttcctgtttgttgttggagaaa

SEQ ID NO: 119722 - DNA, 25 bp, Homo sapien
gcggtttccagaatgggctccttct

SEQ ID NO: 119723 - DNA, 25 bp, Homo sapien
cgctgtgcggagatgccacccagct

SEQ ID NO: 119724 - DNA, 25 bp, Homo sapien
gcgcgacgacttcgcggtttccaga

SEQ ID NO: 119725 - DNA, 25 bp, Homo sapien
ttctgtcctcggtgagggtctgttc

SEQ ID NO: 119726 - DNA, 25 bp, Homo sapien
tggcccaacaataagtgccatttgg

SEQ ID NO: 119727 - DNA, 25 bp, Homo sapien
ccgcgccttcgtgtacgcacttgta

SEQ ID NO: 119728 - DNA, 25 bp, Homo sapien
gcaccgagctcttctccttggtgtg

SEQ ID NO: 119729 - DNA, 25 bp, Homo sapien
agctttcgctggcaccgagctcttc

SEQ ID NO: 119730 - DNA, 25 bp, Homo sapien
ctggtggagagctttcgctggcacc

SEQ ID NO: 119731 - DNA, 25 bp, Homo sapien
gcgccttcatggacacgctcgtgtg

SEQ ID NO: 119732 - DNA, 25 bp, Homo sapien
tcgcgtctagggagttctgaacatg

SEQ ID NO: 119733 - DNA, 25 bp, Homo sapien
gcctttgtgtatgtgctcgcgtcta

SEQ ID NO: 119734 - DNA, 25 bp, Homo sapien
acgcacttgtacgtagggaggtctg

SEQ ID NO: 119735 - DNA, 25 bp, Homo sapien
cgaggtgctgcttttaccgtagacg

SEQ ID NO: 119736 - DNA, 25 bp, Homo sapien
acgcgcctcactgtctctctgagga

SEQ ID NO: 119737 - DNA, 25 bp, Homo sapien
agcaggcgcagagtgagacttctct

SEQ ID NO: 119738 - DNA, 25 bp, Homo sapien
cgaggacacaaaccgcgcctgggct

SEQ ID NO: 119739 - DNA, 25 bp, Homo sapien
ctccgcaaaggatgacagagctgcc

SEQ ID NO: 119740 - DNA, 25 bp, Homo sapien
gacgtgccttttcgtagctttcagc

SEQ ID NO: 119741 - DNA, 25 bp, Homo sapien
ctttcagcgtagagcttgaggcctg

SEQ ID NO: 119742 - DNA, 25 bp, Homo sapien
tgtacgcagcgtgttgctccgcaaa

SEQ ID NO: 119743 - DNA, 25 bp, Homo sapien
gccctggcgctagccaatggtaggc

SEQ ID NO: 119744 - DNA, 25 bp, Homo sapien
gcgctagccaatggtaggcagtgta

SEQ ID NO: 119745 - DNA, 25 bp, Homo sapien
ttcagccaatggcaggccgcctatg

SEQ ID NO: 119746 - DNA, 25 bp, Homo sapien
aggaaagacttcagccaatggcagg

SEQ ID NO: 119747 - DNA, 25 bp, Homo sapien
acaaaccgagagaggaagtcgccgg

SEQ ID NO: 119748 - DNA, 25 bp, Homo sapien
gatgacccagacaaaccgagagagg

SEQ ID NO: 119749 - DNA, 25 bp, Homo sapien
cggcgggcagacaagatgacccaga

SEQ ID NO: 119750 - DNA, 25 bp, Homo sapien
agcacgcaaacaggaaagacttcag

SEQ ID NO: 119751 - DNA, 25 bp, Homo sapien
ccatgtttaaagtgcggtgaggctc

SEQ ID NO: 119752 - DNA, 25 bp, Homo sapien
gtgaggctcctggaacggcacccac

SEQ ID NO: 119753 - DNA, 25 bp, Homo sapien
caggcccgaggccacacctgtatgt

SEQ ID NO: 119754 - DNA, 25 bp, Homo sapien
ggccacacctgtatgtcagaactgg

SEQ ID NO: 119755 - DNA, 25 bp, Homo sapien
tatgtcagaactgggcgggtcttct

SEQ ID NO: 119756 - DNA, 25 bp, Homo sapien
cttcagcgcctgtggctatggctgt

SEQ ID NO: 119757 - DNA, 25 bp, Homo sapien
gcaggcgctgttctccccacgtatt

SEQ ID NO: 119758 - DNA, 25 bp, Homo sapien
ttaaagtgcggtgaggctcctggaa

SEQ ID NO: 119759 - DNA, 25 bp, Homo sapien
tggcggttctgaacgcgcatctcgt

SEQ ID NO: 119760 - DNA, 25 bp, Homo sapien
gcatctcgtgctgctcctgtagggc

SEQ ID NO: 119761 - DNA, 25 bp, Homo sapien
tgcagcatggaacgcttggcggttc

SEQ ID NO: 119762 - DNA, 25 bp, Homo sapien
ccgtaaccgtagcttgaggcacatt

SEQ ID NO: 119763 - DNA, 25 bp, Homo sapien
caggcctctctctgttcgttctttc

SEQ ID NO: 119764 - DNA, 25 bp, Homo sapien
cgcctccctgctttggaagcaggta

SEQ ID NO: 119765 - DNA, 25 bp, Homo sapien
ctcctcgggacggagatctcctggc

SEQ ID NO: 119766 - DNA, 25 bp, Homo sapien
aagcaggtactcagcggcctctgca

SEQ ID NO: 119767 - DNA, 25 bp, Homo sapien
acatatgcctgccacgctgaaccga

SEQ ID NO: 119768 - DNA, 25 bp, Homo sapien
tgaacctaccgtaacacctgccatg

SEQ ID NO: 119769 - DNA, 25 bp, Homo sapien
gtaacacctgccatgctgaacccaa

SEQ ID NO: 119770 - DNA, 25 bp, Homo sapien
gcctgccacgctgaaccgaccataa

SEQ ID NO: 119771 - DNA, 25 bp, Homo sapien
ctgccatgctgaacccaccgtaaca

SEQ ID NO: 119772 - DNA, 25 bp, Homo sapien
gcctgccacgctgaacccaacataa

SEQ ID NO: 119773 - DNA, 25 bp, Homo sapien
gcctgccatgctgaacccaccgtaa

SEQ ID NO: 119774 - DNA, 25 bp, Homo sapien
cctgccacgctgaacccaacatatg

SEQ ID NO: 119775 - DNA, 25 bp, Homo sapien
cggcaggattatgcgatcacggatc

SEQ ID NO: 119776 - DNA, 25 bp, Homo sapien
acactcgctcggcaggattatgcga

SEQ ID NO: 119777 - DNA, 25 bp, Homo sapien
gtcaggactgtctcgaggccacact

SEQ ID NO: 119778 - DNA, 25 bp, Homo sapien
ctaggtagcagcgtcggtcaggact

SEQ ID NO: 119779 - DNA, 25 bp, Homo sapien
cggtcgtgcacacgcgctaggtagc

SEQ ID NO: 119780 - DNA, 25 bp, Homo sapien
cggacttgaggcacgcggtgcaccc

SEQ ID NO: 119781 - DNA, 25 bp, Homo sapien
tcacggatcagtcagagcagggtca

SEQ ID NO: 119782 - DNA, 25 bp, Homo sapien
accgtgctcggcatgcggtcgtgca

SEQ ID NO: 119783 - DNA, 25 bp, Homo sapien
gctgcttatgccagcgtctgctgag

SEQ ID NO: 119784 - DNA, 25 bp, Homo sapien
cgcggctgcttatgccagcgtctgc

SEQ ID NO: 119785 - DNA, 25 bp, Homo sapien
agcccgcggctgcttatgccagcgt

SEQ ID NO: 119786 - DNA, 25 bp, Homo sapien
gcttatgccagcgtctgctgagggg

SEQ ID NO: 119787 - DNA, 25 bp, Homo sapien
ggctgcttatgccagcgtctgctga

SEQ ID NO: 119788 - DNA, 25 bp, Homo sapien
ccgcggctgcttatgccagcgtctg

SEQ ID NO: 119789 - DNA, 25 bp, Homo sapien
gagcccgcggctgcttatgccagcg

SEQ ID NO: 119790 - DNA, 25 bp, Homo sapien
ctgcttatgccagcgtctgctgagg

SEQ ID NO: 119791 - DNA, 25 bp, Homo sapien
gcagacctgccgcattccggacctg

SEQ ID NO: 119792 - DNA, 25 bp, Homo sapien
cgcacctggcggtcctgctggagac

SEQ ID NO: 119793 - DNA, 25 bp, Homo sapien
ctgctggagacgctgagtgcagtca

SEQ ID NO: 119794 - DNA, 25 bp, Homo sapien
tgggcccagcacaacccgtgcgtgg

SEQ ID NO: 119795 - DNA, 25 bp, Homo sapien
tgcagtcacacatctgggcccagca

SEQ ID NO: 119796 - DNA, 25 bp, Homo sapien
taggacctgcagtcacacatctggg

SEQ ID NO: 119797 - DNA, 25 bp, Homo sapien
ggccgtaggacctgcagtcacacat

SEQ ID NO: 119798 - DNA, 25 bp, Homo sapien
ggcacctcctcctgtgtggcggagc

SEQ ID NO: 119799 - DNA, 25 bp, Homo sapien
tgaggaagggccacaatcgtggttc

SEQ ID NO: 119800 - DNA, 25 bp, Homo sapien
ctcgtcgctggggtttgagtgttcc

SEQ ID NO: 119801 - DNA, 25 bp, Homo sapien
tgtgtgtcctgacgaggccacccac

SEQ ID NO: 119802 - DNA, 25 bp, Homo sapien
ctgcagggctgttgggcatctcaga

SEQ ID NO: 119803 - DNA, 25 bp, Homo sapien
ttcttggcaagcgaggcgtggacat

SEQ ID NO: 119804 - DNA, 25 bp, Homo sapien
cacaatcgtggttcttggcaagcga

SEQ ID NO: 119805 - DNA, 25 bp, Homo sapien
cgagcccttcggttgcactgaggaa

SEQ ID NO: 119806 - DNA, 25 bp, Homo sapien
ctgggctctagacgctgtcctggca

SEQ ID NO: 119807 - DNA, 25 bp, Homo sapien
acgtagcgtctgtggtgggctcttc

SEQ ID NO: 119808 - DNA, 25 bp, Homo sapien
ccggtcggcgcctgacgtagcgtct

SEQ ID NO: 119809 - DNA, 25 bp, Homo sapien
ctgttccacgcgggcgcctgacgta

SEQ ID NO: 119810 - DNA, 25 bp, Homo sapien
cacgcgggcgcctgacgtagcgtct

SEQ ID NO: 119811 - DNA, 25 bp, Homo sapien
cgtagcgtctgtggtgggctcttcc

SEQ ID NO: 119812 - DNA, 25 bp, Homo sapien
cctgacgtagcgtctgtggtgggct

SEQ ID NO: 119813 - DNA, 25 bp, Homo sapien
cggcgcctgacgtagcgtctgtggt

SEQ ID NO: 119814 - DNA, 25 bp, Homo sapien
cgtagcgtctgtggtgggctcttct

SEQ ID NO: 119815 - DNA, 25 bp, Homo sapien
cggggtccctgtggagaacgtctct

SEQ ID NO: 119816 - DNA, 25 bp, Homo sapien
caacaggcagcgtgtggatgccacc

SEQ ID NO: 119817 - DNA, 25 bp, Homo sapien
cgtgtggatgccaccgtcaccttca

SEQ ID NO: 119818 - DNA, 25 bp, Homo sapien
caccgtcaccttcacgggagaggca

SEQ ID NO: 119819 - DNA, 25 bp, Homo sapien
gcttctcctggaacgttgtctccga

SEQ ID NO: 119820 - DNA, 25 bp, Homo sapien
gcgggctcgtgcctcaacaggcagc

SEQ ID NO: 119821 - DNA, 25 bp, Homo sapien
aacgttgtctccgaggctcagcagc

SEQ ID NO: 119822 - DNA, 25 bp, Homo sapien
tgggtccacacctcagacccatctg

SEQ ID NO: 119823 - DNA, 25 bp, Homo sapien
acctggctgagtgccgtctgtgccc

SEQ ID NO: 119824 - DNA, 25 bp, Homo sapien
cgccctcagcaagacctggctgagt

SEQ ID NO: 119825 - DNA, 25 bp, Homo sapien
caacatcccatttccatttaacaga

SEQ ID NO: 119826 - DNA, 25 bp, Homo sapien
tggctccactccctggacagatctg

SEQ ID NO: 119827 - DNA, 25 bp, Homo sapien
gttttattgaatctcccaacatcca

SEQ ID NO: 119828 - DNA, 25 bp, Homo sapien
tgcacagacccacacctggtgctgg

SEQ ID NO: 119829 - DNA, 25 bp, Homo sapien
gcctgacacttctgtgttttattga

SEQ ID NO: 119830 - DNA, 25 bp, Homo sapien
gtctgtgcccgtggatgcacgcgca

SEQ ID NO: 119831 - DNA, 25 bp, Homo sapien
tcgctggggctccaggttgccgcct

SEQ ID NO: 119832 - DNA, 25 bp, Homo sapien
cctggccagtgacagactttttcct

SEQ ID NO: 119833 - DNA, 25 bp, Homo sapien
ataatcactcccaggccacggtggc

SEQ ID NO: 119834 - DNA, 25 bp, Homo sapien
cgcgtagctaggaagccgcgagtcc

SEQ ID NO: 119835 - DNA, 25 bp, Homo sapien
ctcctacctgctcggaggtccatgg

SEQ ID NO: 119836 - DNA, 25 bp, Homo sapien
gcgctgccctttcccgcgcgtcaac

SEQ ID NO: 119837 - DNA, 25 bp, Homo sapien
aaccggatctcgtggctgcttggcg

SEQ ID NO: 119838 - DNA, 25 bp, Homo sapien
tgcggactccaggaatgccgcgtcc

SEQ ID NO: 119839 - DNA, 25 bp, Homo sapien
gtgctgcttggcgtctgcacgcaat

SEQ ID NO: 119840 - DNA, 25 bp, Homo sapien
cagcgtccttgcaggggcctgcgat

SEQ ID NO: 119841 - DNA, 25 bp, Homo sapien
tctgcacgcaatggcgagggctccc

SEQ ID NO: 119842 - DNA, 25 bp, Homo sapien
gagtccagcgtccttgcaggggcct

SEQ ID NO: 119843 - DNA, 25 bp, Homo sapien
cttgcaggggcctgcgatgccttgt

SEQ ID NO: 119844 - DNA, 25 bp, Homo sapien
ctgcgatgccttgtgcggcctgggc

SEQ ID NO: 119845 - DNA, 25 bp, Homo sapien
gcttggcgtctgcacgcaatggcga

SEQ ID NO: 119846 - DNA, 25 bp, Homo sapien
gtgcggaaccctgtgcagccaaggg

SEQ ID NO: 119847 - DNA, 25 bp, Homo sapien
ggccctctgccagtgcgggctcaaa

SEQ ID NO: 119848 - DNA, 25 bp, Homo sapien
gcagccaatcctcacatgacggtga

SEQ ID NO: 119849 - DNA, 25 bp, Homo sapien
ccctctgccagtgcgggctcaaagg

SEQ ID NO: 119850 - DNA, 25 bp, Homo sapien
cctcacatgacggtgaccagaggcc

SEQ ID NO: 119851 - DNA, 25 bp, Homo sapien
accagaggccacttgagctcaggca

SEQ ID NO: 119852 - DNA, 25 bp, Homo sapien
ggccacttgagctcaggcacctcgg

SEQ ID NO: 119853 - DNA, 25 bp, Homo sapien
cttgagctcaggcacctcggctggc

SEQ ID NO: 119854 - DNA, 25 bp, Homo sapien
caatcctcacatgacggtgaccaga

SEQ ID NO: 119855 - DNA, 25 bp, Homo sapien
ccagcgtttccagtttccagcgttg

SEQ ID NO: 119856 - DNA, 25 bp, Homo sapien
tgtttctctgatcactaacagcctg

SEQ ID NO: 119857 - DNA, 25 bp, Homo sapien
tgcactgccgttcgctcagagccat

SEQ ID NO: 119858 - DNA, 25 bp, Homo sapien
cagagccattgtgcacgtttgtttc

SEQ ID NO: 119859 - DNA, 25 bp, Homo sapien
tccagcgttgtatggggatttccac

SEQ ID NO: 119860 - DNA, 25 bp, Homo sapien
acagcctgcacgtttccagcgtttc

SEQ ID NO: 119861 - DNA, 25 bp, Homo sapien
tttggagaattactgcgtgcactgc

SEQ ID NO: 119862 - DNA, 25 bp, Homo sapien
ccacgtgtttcagtcgcttattagc

SEQ ID NO: 119863 - DNA, 25 bp, Homo sapien
accgtgtcatcgcacggccaggctg

SEQ ID NO: 119864 - DNA, 25 bp, Homo sapien
cgtctcggtgcacggctggtaagac

SEQ ID NO: 119865 - DNA, 25 bp, Homo sapien
cacactggcagacaaccgtgtcatc

SEQ ID NO: 119866 - DNA, 25 bp, Homo sapien
tttggggaggtgacacacactggca

SEQ ID NO: 119867 - DNA, 25 bp, Homo sapien
tctcaggaggagacgttgcagcagc

SEQ ID NO: 119868 - DNA, 25 bp, Homo sapien
taagacggtggccaggccgtgacat

SEQ ID NO: 119869 - DNA, 25 bp, Homo sapien
ccgtgacatcgagggtagcacccgc

SEQ ID NO: 119870 - DNA, 25 bp, Homo sapien
caccagcgcatcagctttggggagg

SEQ ID NO: 119871 - DNA, 25 bp, Homo sapien
aaagagggccgtgtgcagtgtcgca

SEQ ID NO: 119872 - DNA, 25 bp, Homo sapien
cgtgtgcactgtcgcagggaaaaga

SEQ ID NO: 119873 - DNA, 25 bp, Homo sapien
gccgtgtgcactctcggagggaaaa

SEQ ID NO: 119874 - DNA, 25 bp, Homo sapien
cgtgtgcactctcggagggaaaaga

SEQ ID NO: 119875 - DNA, 25 bp, Homo sapien
aaaagagggccgtgtgcagtgtcgc

SEQ ID NO: 119876 - DNA, 25 bp, Homo sapien
tgtgcactgtcgcagggaaaagagg

SEQ ID NO: 119877 - DNA, 25 bp, Homo sapien
aaaagagggccgtgtgcactgtcgc

SEQ ID NO: 119878 - DNA, 25 bp, Homo sapien
cgtgtgcagtgtcgcagggaaaaga

SEQ ID NO: 119879 - DNA, 25 bp, Homo sapien
gacagcccactcacccaccggcagg

SEQ ID NO: 119880 - DNA, 25 bp, Homo sapien
gcaccgattccacccgagagcaggt

SEQ ID NO: 119881 - DNA, 25 bp, Homo sapien
gaaaattccgtactcgcaccgattc

SEQ ID NO: 119882 - DNA, 25 bp, Homo sapien
atggaaaattccgtactcgcaccga

SEQ ID NO: 119883 - DNA, 25 bp, Homo sapien
tcgggagtgtgaccgtgggctttca

SEQ ID NO: 119884 - DNA, 25 bp, Homo sapien
agacaggcttcggacagcccactca

SEQ ID NO: 119885 - DNA, 25 bp, Homo sapien
ccgaagcaatgtgtgcaggaccccg

SEQ ID NO: 119886 - DNA, 25 bp, Homo sapien
ttcagaggaggatggaaaattccgt

SEQ ID NO: 119887 - DNA, 25 bp, Homo sapien
gacagaagctttcatagagcccatg

SEQ ID NO: 119888 - DNA, 25 bp, Homo sapien
tggcattgataaagcacctgctggg

SEQ ID NO: 119889 - DNA, 25 bp, Homo sapien
caggggcacaacgttggcattgata

SEQ ID NO: 119890 - DNA, 25 bp, Homo sapien
tgcatgccaggattaagactaactc

SEQ ID NO: 119891 - DNA, 25 bp, Homo sapien
gagcccatgcatgagatctttcata

SEQ ID NO: 119892 - DNA, 25 bp, Homo sapien
ccttacttcaagtgtggtggagaca

SEQ ID NO: 119893 - DNA, 25 bp, Homo sapien
gacggctcctgcttcttgcatgcca

SEQ ID NO: 119894 - DNA, 25 bp, Homo sapien
ctggtgccctcctgagcatgggtac

SEQ ID NO: 119895 - DNA, 25 bp, Homo sapien
agtgctgcccacacggatgcccaga

SEQ ID NO: 119896 - DNA, 25 bp, Homo sapien
cgatcgacaccagggtccgcctgtg

SEQ ID NO: 119897 - DNA, 25 bp, Homo sapien
gcgggtctcatgctgtccacacgct

SEQ ID NO: 119898 - DNA, 25 bp, Homo sapien
caagaccagcgggtctcatgctgtc

SEQ ID NO: 119899 - DNA, 25 bp, Homo sapien
cccgaggagaccatcgaaggatggt

SEQ ID NO: 119900 - DNA, 25 bp, Homo sapien
cccttacacgggacagggcactgca

SEQ ID NO: 119901 - DNA, 25 bp, Homo sapien
acacggatgcccagagcgtgttccc

SEQ ID NO: 119902 - DNA, 25 bp, Homo sapien
ggaccactgctccaaccagcgttcg

SEQ ID NO: 119903 - DNA, 25 bp, Homo sapien
tggccatcttgttgagaaccatgtc

SEQ ID NO: 119904 - DNA, 25 bp, Homo sapien
agtgtctgtgtctcacctttggcca

SEQ ID NO: 119905 - DNA, 25 bp, Homo sapien
ccatgtcgatcaggacgtaggtgcc

SEQ ID NO: 119906 - DNA, 25 bp, Homo sapien
ctgcaccgtcactgccaacagaagg

SEQ ID NO: 119907 - DNA, 25 bp, Homo sapien
aatgaaagtgctgccgtccacacgg

SEQ ID NO: 119908 - DNA, 25 bp, Homo sapien
gcccgacccacaacaaagctagtga

SEQ ID NO: 119909 - DNA, 25 bp, Homo sapien
agttcatttccttcctgcttacggg

SEQ ID NO: 119910 - DNA, 25 bp, Homo sapien
acggcaccctacgttgccatagcga

SEQ ID NO: 119911 - DNA, 25 bp, Homo sapien
cgcgcgtcatacctgcggaagtcca

SEQ ID NO: 119912 - DNA, 25 bp, Homo sapien
ccaggggcgtctcaggagcaccgaa

SEQ ID NO: 119913 - DNA, 25 bp, Homo sapien
gtctcaggagcaccgaagcctcgct

SEQ ID NO: 119914 - DNA, 25 bp, Homo sapien
gggactcctcggtcataccaactca

SEQ ID NO: 119915 - DNA, 25 bp, Homo sapien
ctcggtcataccaactcaggaagtg

SEQ ID NO: 119916 - DNA, 25 bp, Homo sapien
ataccaactcaggaagtggaactgc

SEQ ID NO: 119917 - DNA, 25 bp, Homo sapien
cgattaacacgtgccgttaacggag

SEQ ID NO: 119918 - DNA, 25 bp, Homo sapien
cgctcacgattaacacgtgccgtta

SEQ ID NO: 119919 - DNA, 25 bp, Homo sapien
cagcactcggtccactgcacaggga

SEQ ID NO: 119920 - DNA, 25 bp, Homo sapien
ggcagagcctgtgagcgtttttctc

SEQ ID NO: 119921 - DNA, 25 bp, Homo sapien
ggacgagctctacctggaacccttg

SEQ ID NO: 119922 - DNA, 25 bp, Homo sapien
ccgctggcagatttgtcggcaaagt

SEQ ID NO: 119923 - DNA, 25 bp, Homo sapien
tcagtttcttagtctggcggctgtc

SEQ ID NO: 119924 - DNA, 25 bp, Homo sapien
agacgcccgggaactctactaagtg

SEQ ID NO: 119925 - DNA, 25 bp, Homo sapien
ggtgacgtgcacttagagaaactcg

SEQ ID NO: 119926 - DNA, 25 bp, Homo sapien
ggctgtcatcttcccaggccggtgt

SEQ ID NO: 119927 - DNA, 25 bp, Homo sapien
gactctccttaggagctcctctctg

SEQ ID NO: 119928 - DNA, 25 bp, Homo sapien
gattctgccgcatgggtgacgcgtc

SEQ ID NO: 119929 - DNA, 25 bp, Homo sapien
agcgtcactgctgcgacaggcacct

SEQ ID NO: 119930 - DNA, 25 bp, Homo sapien
agctcgactctccttaggagctcct

SEQ ID NO: 119931 - DNA, 25 bp, Homo sapien
gtgctcctgcggtaactcacggcca

SEQ ID NO: 119932 - DNA, 25 bp, Homo sapien
tgcctgtgctcctgcggtaactcac

SEQ ID NO: 119933 - DNA, 25 bp, Homo sapien
tgggtgacgcgtcgcttcccacctt

SEQ ID NO: 119934 - DNA, 25 bp, Homo sapien
tccctgcctggattctgccgcatgg

SEQ ID NO: 119935 - DNA, 25 bp, Homo sapien
ctccggagggttgatctcactgaca

SEQ ID NO: 119936 - DNA, 25 bp, Homo sapien
acgaggccgttttctgggctaagca

SEQ ID NO: 119937 - DNA, 25 bp, Homo sapien
cgcttgtccttcgtttccgctgtca

SEQ ID NO: 119938 - DNA, 25 bp, Homo sapien
aggtgacttattcccagtgctgctc

SEQ ID NO: 119939 - DNA, 25 bp, Homo sapien
tcggggcctcaatcgacagaacgtg

SEQ ID NO: 119940 - DNA, 25 bp, Homo sapien
agaacgtgtcacctcaggcccagga

SEQ ID NO: 119941 - DNA, 25 bp, Homo sapien
ccaagcaggcgcgtctggaaaagta

SEQ ID NO: 119942 - DNA, 25 bp, Homo sapien
tcggcgggaacctacacattagctc

SEQ ID NO: 119943 - DNA, 25 bp, Homo sapien
cacgggcgacgctggctcacgatgc

SEQ ID NO: 119944 - DNA, 25 bp, Homo sapien
ccgttcacgcagctgcagcgcagag

SEQ ID NO: 119945 - DNA, 25 bp, Homo sapien
ccagtgatgccgtggttaggacgcc

SEQ ID NO: 119946 - DNA, 25 bp, Homo sapien
ccgtggttaggacgccgttcacgca

SEQ ID NO: 119947 - DNA, 25 bp, Homo sapien
atgccgtggttaggacgccgttcac

SEQ ID NO: 119948 - DNA, 25 bp, Homo sapien
gccgtggttaggacgccgttcacgc

SEQ ID NO: 119949 - DNA, 25 bp, Homo sapien
acgggcgacgctggctcacgatgcc

SEQ ID NO: 119950 - DNA, 25 bp, Homo sapien
cgttcacgcagctgcagcgcagagc

SEQ ID NO: 119951 - DNA, 25 bp, Homo sapien
ttgggcacgttctcctccctctggg

SEQ ID NO: 119952 - DNA, 25 bp, Homo sapien
ctctgggccacgaacgagctgttgg

SEQ ID NO: 119953 - DNA, 25 bp, Homo sapien
cacgaacgagctgttgggctccgcc

SEQ ID NO: 119954 - DNA, 25 bp, Homo sapien
tccctctgggccacgaacgagctgt

SEQ ID NO: 119955 - DNA, 25 bp, Homo sapien
ggagcggttcttgggcacgttctcc

SEQ ID NO: 119956 - DNA, 25 bp, Homo sapien
tcagcacggccagggagcggttctt

SEQ ID NO: 119957 - DNA, 25 bp, Homo sapien
caccgcccgtaacccaggcttcctg

SEQ ID NO: 119958 - DNA, 25 bp, Homo sapien
cgtccccggggctggtacacacagg

SEQ ID NO: 119959 - DNA, 25 bp, Homo sapien
tgctgagggctacggtcggatctcc

SEQ ID NO: 119960 - DNA, 25 bp, Homo sapien
tgctcctttgctgagggctacggtc

SEQ ID NO: 119961 - DNA, 25 bp, Homo sapien
cacgcaggacccaccttgaagatga

SEQ ID NO: 119962 - DNA, 25 bp, Homo sapien
accttgaagatgaggcagtcgcctg

SEQ ID NO: 119963 - DNA, 25 bp, Homo sapien
tgctcggcgtacagcgaggtcagcc

SEQ ID NO: 119964 - DNA, 25 bp, Homo sapien
tcagccggtactggttctccgtggt

SEQ ID NO: 119965 - DNA, 25 bp, Homo sapien
ttctccgtggtgatgtcgatctggt

SEQ ID NO: 119966 - DNA, 25 bp, Homo sapien
agccggagagccgtcacacgcagga

SEQ ID NO: 119967 - DNA, 25 bp, Homo sapien
gtcggacccatccagtgtgcactga

SEQ ID NO: 119968 - DNA, 25 bp, Homo sapien
gtgggtcagaccctttcactgtgca

SEQ ID NO: 119969 - DNA, 25 bp, Homo sapien
ggtcagaccctttcactgtgcactg

SEQ ID NO: 119970 - DNA, 25 bp, Homo sapien
ggtcggacccattcactgtgcactg

SEQ ID NO: 119971 - DNA, 25 bp, Homo sapien
cactgaactcggtgggttggaccca

SEQ ID NO: 119972 - DNA, 25 bp, Homo sapien
ggtcggacccatccagcatgcactg

SEQ ID NO: 119973 - DNA, 25 bp, Homo sapien
ggttggacccattcactgtgcactg

SEQ ID NO: 119974 - DNA, 25 bp, Homo sapien
gggtcagacccatccagtgtgcact

SEQ ID NO: 119975 - DNA, 25 bp, Homo sapien
tgacccgtaagtgcagccgctgctt

SEQ ID NO: 119976 - DNA, 25 bp, Homo sapien
gctgcgctattgacagctgtcctaa

SEQ ID NO: 119977 - DNA, 25 bp, Homo sapien
gcgaagaatgtttccctgacccgta

SEQ ID NO: 119978 - DNA, 25 bp, Homo sapien
cacccggacattcattatgtatgga

SEQ ID NO: 119979 - DNA, 25 bp, Homo sapien
gcaatgcacggccacacacgcgtga

SEQ ID NO: 119980 - DNA, 25 bp, Homo sapien
acacgcgtgatcactccagcgagga

SEQ ID NO: 119981 - DNA, 25 bp, Homo sapien
ttcggccaagcagcgtaacaggctc

SEQ ID NO: 119982 - DNA, 25 bp, Homo sapien
aggctccgtctccagtgcgggaaac

SEQ ID NO: 119983 - DNA, 25 bp, Homo sapien
cccagtggctcagtgctggtgcacg

SEQ ID NO: 119984 - DNA, 25 bp, Homo sapien
gcagctcttcgcctgtgcagaggga

SEQ ID NO: 119985 - DNA, 25 bp, Homo sapien
agcttggcgcagaatgctggagacc

SEQ ID NO: 119986 - DNA, 25 bp, Homo sapien
taaagatccaagaaaaatgtccctg

SEQ ID NO: 119987 - DNA, 25 bp, Homo sapien
gcgcagggtcttcttgaaggtctta

SEQ ID NO: 119988 - DNA, 25 bp, Homo sapien
ggctctcaccagtggtctcgcgtca

SEQ ID NO: 119989 - DNA, 25 bp, Homo sapien
agacccagggttcggtgcctctcag

SEQ ID NO: 119990 - DNA, 25 bp, Homo sapien
tgtgcccacagcaaggcaacgcgcg

SEQ ID NO: 119991 - DNA, 25 bp, Homo sapien
tgacaagttaaaccctggagtccca

SEQ ID NO: 119992 - DNA, 25 bp, Homo sapien
agtcccagcggcactggctgtcggc

SEQ ID NO: 119993 - DNA, 25 bp, Homo sapien
tggctgtcggccgtcctgcacgtgc

SEQ ID NO: 119994 - DNA, 25 bp, Homo sapien
gcgaagccactttctgcagcccgag

SEQ ID NO: 119995 - DNA, 25 bp, Homo sapien
ccggccataacccaggctgggaaga

SEQ ID NO: 119996 - DNA, 25 bp, Homo sapien
gtgatgacatcacactgacaagtta

SEQ ID NO: 119997 - DNA, 25 bp, Homo sapien
gtgcgcgtggaaaccgtgatgacat

SEQ ID NO: 119998 - DNA, 25 bp, Homo sapien
caaggggcgaacagcgcaccaggcc

SEQ ID NO: 119999 - DNA, 25 bp, Homo sapien
tcagcctggctggtaaccggcctct

SEQ ID NO: 120000 - DNA, 25 bp, Homo sapien
ggtaaccggcctctccatagcaacg

SEQ ID NO: 120001 - DNA, 25 bp, Homo sapien
tctccatagcaacggccagcgcgcg

SEQ ID NO: 120002 - DNA, 25 bp, Homo sapien
gcattggggcatcctgccctcgctg

SEQ ID NO: 120003 - DNA, 25 bp, Homo sapien
tcttcccagcgacccggagcacagg

SEQ ID NO: 120004 - DNA, 25 bp, Homo sapien
atcgccggagcctcatccaggctgg

SEQ ID NO: 120005 - DNA, 25 bp, Homo sapien
aggagtggccggtagccgtctccct

SEQ ID NO: 120006 - DNA, 25 bp, Homo sapien
atcgcagaaccctagggtggcgaca

SEQ ID NO: 120007 - DNA, 25 bp, Homo sapien
agaagtcactctagagccgcgcgac

SEQ ID NO: 120008 - DNA, 25 bp, Homo sapien
gggcacagcccgttcacgaaaccta

SEQ ID NO: 120009 - DNA, 25 bp, Homo sapien
ttcacgaaacctaaggcgccggcca

SEQ ID NO: 120010 - DNA, 25 bp, Homo sapien
ctggccttggccgacggaacaagaa

SEQ ID NO: 120011 - DNA, 25 bp, Homo sapien
gaacaacaaaggaagcggcgcgacc

SEQ ID NO: 120012 - DNA, 25 bp, Homo sapien
tgccgggactgagttaatggaaacg

SEQ ID NO: 120013 - DNA, 25 bp, Homo sapien
gtcgcccttcgcgtggagatccggt

SEQ ID NO: 120014 - DNA, 25 bp, Homo sapien
cccagggtccatgttcgcctgcggg

SEQ ID NO: 120015 - DNA, 25 bp, Homo sapien
agggcactttcctctgtgtcggtga

SEQ ID NO: 120016 - DNA, 25 bp, Homo sapien
tcagcgcactgaggaccaaaaaggg

SEQ ID NO: 120017 - DNA, 25 bp, Homo sapien
cctaaaatctgggatcggcgacgca

SEQ ID NO: 120018 - DNA, 25 bp, Homo sapien
cctctgtggcacgactttgagcaga

SEQ ID NO: 120019 - DNA, 25 bp, Homo sapien
tctccggccctaaaaggcaattgtg

SEQ ID NO: 120020 - DNA, 25 bp, Homo sapien
cctctcttgttcgatcgcgtcctaa

SEQ ID NO: 120021 - DNA, 25 bp, Homo sapien
gattccctggagcaacgcttctcta

SEQ ID NO: 120022 - DNA, 25 bp, Homo sapien
gacccgcctagcgtcgcttgtcaga

SEQ ID NO: 120023 - DNA, 25 bp, Homo sapien
tggcaaagaactcgtagccgtcttc

SEQ ID NO: 120024 - DNA, 25 bp, Homo sapien
aaagagacgccacggtcgttctcgc

SEQ ID NO: 120025 - DNA, 25 bp, Homo sapien
tcggctccaaaggtaaaagagacgc

SEQ ID NO: 120026 - DNA, 25 bp, Homo sapien
tgtggaggaacttggccaccacctc

SEQ ID NO: 120027 - DNA, 25 bp, Homo sapien
ccaagtcgtgcttgtggaggaactt

SEQ ID NO: 120028 - DNA, 25 bp, Homo sapien
tgctcggcagatgaggtccaagtcg

SEQ ID NO: 120029 - DNA, 25 bp, Homo sapien
cagcccacctggtgtgctcggcaga

SEQ ID NO: 120030 - DNA, 25 bp, Homo sapien
cagtcagtcccgagcgcaggcacgg

SEQ ID NO: 120031 - DNA, 25 bp, Homo sapien
gcgggctgtgcatttataagaaagc

SEQ ID NO: 120032 - DNA, 25 bp, Homo sapien
catttataagaaagcccggtcggtg

SEQ ID NO: 120033 - DNA, 25 bp, Homo sapien
ctgacgcgggctgtgcatttataag

SEQ ID NO: 120034 - DNA, 25 bp, Homo sapien
cgcgggctgtgcatttataagaaag

SEQ ID NO: 120035 - DNA, 25 bp, Homo sapien
gtgcatttataagaaagcccggtcg

SEQ ID NO: 120036 - DNA, 25 bp, Homo sapien
cccggtcggtgctggtgtaactgac

SEQ ID NO: 120037 - DNA, 25 bp, Homo sapien
gacgcgggctgtgcatttataagaa

SEQ ID NO: 120038 - DNA, 25 bp, Homo sapien
ggctgtgcatttataagaaagcccg

SEQ ID NO: 120039 - DNA, 25 bp, Homo sapien
cgggttacacgcgagagccccacgc

SEQ ID NO: 120040 - DNA, 25 bp, Homo sapien
ggcagccgggttacacgcgagagcc

SEQ ID NO: 120041 - DNA, 25 bp, Homo sapien
cagccgggttacacgcgagagcccc

SEQ ID NO: 120042 - DNA, 25 bp, Homo sapien
gcagccgggttacacgcgagagccc

SEQ ID NO: 120043 - DNA, 25 bp, Homo sapien
ggggcagccgggttacacgcgagag

SEQ ID NO: 120044 - DNA, 25 bp, Homo sapien
gggcagccgggttacacgcgagagc

SEQ ID NO: 120045 - DNA, 25 bp, Homo sapien
agccgggttacacgcgagagcccca

SEQ ID NO: 120046 - DNA, 25 bp, Homo sapien
gccgggttacacgcgagagccccac

SEQ ID NO: 120047 - DNA, 25 bp, Homo sapien
cacagttactctttcccgtcccagg

SEQ ID NO: 120048 - DNA, 25 bp, Homo sapien
atgcgcccagcacagttactctttc

SEQ ID NO: 120049 - DNA, 25 bp, Homo sapien
agcacagttactcttccgtcccatg

SEQ ID NO: 120050 - DNA, 25 bp, Homo sapien
cagttactctttcccgtcccatgcg

SEQ ID NO: 120051 - DNA, 25 bp, Homo sapien
cgcgcccagcacagttactcttttc

SEQ ID NO: 120052 - DNA, 25 bp, Homo sapien
acgcgcccagcacagttactctttt

SEQ ID NO: 120053 - DNA, 25 bp, Homo sapien
cagttacccttttccgtcccatgcg

SEQ ID NO: 120054 - DNA, 25 bp, Homo sapien
gcccagcacagttactcttttccgt

SEQ ID NO: 120055 - DNA, 25 bp, Homo sapien
ctctctggtgcactgaaaaggcagc

SEQ ID NO: 120056 - DNA, 25 bp, Homo sapien
agacaccgcgcacaagaaggcagtg

SEQ ID NO: 120057 - DNA, 25 bp, Homo sapien
aggcagcaccacgtggtggatcatc

SEQ ID NO: 120058 - DNA, 25 bp, Homo sapien
cccagggcaaacgtggtgaagccag

SEQ ID NO: 120059 - DNA, 25 bp, Homo sapien
aaagggccggtgtcgtaattgactg

SEQ ID NO: 120060 - DNA, 25 bp, Homo sapien
tggacaggtactaatgccgaccaca

SEQ ID NO: 120061 - DNA, 25 bp, Homo sapien
ccaaatatggatgatgacgagcgtg

SEQ ID NO: 120062 - DNA, 25 bp, Homo sapien
agtccaggcctgtccaggcgccatt

SEQ ID NO: 120063 - DNA, 25 bp, Homo sapien
tcaggctttgctttggggccaagaa

SEQ ID NO: 120064 - DNA, 25 bp, Homo sapien
agcagctcatctgcgttcggctgtg

SEQ ID NO: 120065 - DNA, 25 bp, Homo sapien
tgttcactgaagcacagcacacggg

SEQ ID NO: 120066 - DNA, 25 bp, Homo sapien
cgatctgagtgtgttcactgaagca

SEQ ID NO: 120067 - DNA, 25 bp, Homo sapien
gcacgctacatcctcaggctttgct

SEQ ID NO: 120068 - DNA, 25 bp, Homo sapien
ttcggctgtgcgatctgagtgtgtt

SEQ ID NO: 120069 - DNA, 25 bp, Homo sapien
catatcccggccatgagagcacgcg

SEQ ID NO: 120070 - DNA, 25 bp, Homo sapien
tgaagcacagcacacgggcagaacc

SEQ ID NO: 120071 - DNA, 25 bp, Homo sapien
tcttccacctggaacacgttcgtca

SEQ ID NO: 120072 - DNA, 25 bp, Homo sapien
agatcgcgtgtttgcccgtgtcctg

SEQ ID NO: 120073 - DNA, 25 bp, Homo sapien
gaacacgttcgtcaggtgagagcct

SEQ ID NO: 120074 - DNA, 25 bp, Homo sapien
tgagagcctgctcgggctttgagta

SEQ ID NO: 120075 - DNA, 25 bp, Homo sapien
tcgggctttgagtaggtgcctgtcc

SEQ ID NO: 120076 - DNA, 25 bp, Homo sapien
agcatctgagatcgcgtgtttgccc

SEQ ID NO: 120077 - DNA, 25 bp, Homo sapien
tgtccggggcaggaacacgcagcct

SEQ ID NO: 120078 - DNA, 25 bp, Homo sapien
tggggagcatggctacgtttgtccc

SEQ ID NO: 120079 - DNA, 25 bp, Homo sapien
cgctcacatgcagggagtcgcccag

SEQ ID NO: 120080 - DNA, 25 bp, Homo sapien
acggagcctggacggaagctccacg

SEQ ID NO: 120081 - DNA, 25 bp, Homo sapien
ggagtcgcccaggacagcaagcctg

SEQ ID NO: 120082 - DNA, 25 bp, Homo sapien
cagcgctgggaaggcttcgtcctcg

SEQ ID NO: 120083 - DNA, 25 bp, Homo sapien
tacaggactcgatgcctcgaggaga

SEQ ID NO: 120084 - DNA, 25 bp, Homo sapien
tcctgaatacaggactcgatgcctc

SEQ ID NO: 120085 - DNA, 25 bp, Homo sapien
agccggcgctcacatgcagggagtc

SEQ ID NO: 120086 - DNA, 25 bp, Homo sapien
ggcagcgtgagaagcttcctgaata

SEQ ID NO: 120087 - DNA, 25 bp, Homo sapien
taacggctgttacagccgctgtttc

SEQ ID NO: 120088 - DNA, 25 bp, Homo sapien
ctctggcatggagcaggataacccg

SEQ ID NO: 120089 - DNA, 25 bp, Homo sapien
gccgctgtttcatcgcgtcgtcata

SEQ ID NO: 120090 - DNA, 25 bp, Homo sapien
cagaatgttggcacagcggcgagaa

SEQ ID NO: 120091 - DNA, 25 bp, Homo sapien
ggtcacgcggtctcttcagtttcca

SEQ ID NO: 120092 - DNA, 25 bp, Homo sapien
cgagaaggctgaccgaacaccgaga

SEQ ID NO: 120093 - DNA, 25 bp, Homo sapien
tccatttttccacttgtaacggctg

SEQ ID NO: 120094 - DNA, 25 bp, Homo sapien
cgcgtcgtcataggagttgaacaaa

SEQ ID NO: 120095 - DNA, 25 bp, Homo sapien
gcactcgggcagtgcggtgaccaat

SEQ ID NO: 120096 - DNA, 25 bp, Homo sapien
gcggtgaccaattatagcgtcgacg

SEQ ID NO: 120097 - DNA, 25 bp, Homo sapien
cagtgcggtgaccaattatagcgtc

SEQ ID NO: 120098 - DNA, 25 bp, Homo sapien
tccggttctgcgtctggccggccta

SEQ ID NO: 120099 - DNA, 25 bp, Homo sapien
cccaggacaagctcggggcccaggt

SEQ ID NO: 120100 - DNA, 25 bp, Homo sapien
tcggcagcacacctcgaggggccca

SEQ ID NO: 120101 - DNA, 25 bp, Homo sapien
aggctgcctgcacttccggttctgc

SEQ ID NO: 120102 - DNA, 25 bp, Homo sapien
tgacccgggatcacacctccgaccc

SEQ ID NO: 120103 - DNA, 25 bp, Homo sapien
gctacacggtgcaagttacgccaga

SEQ ID NO: 120104 - DNA, 25 bp, Homo sapien
cactgctttgccgtctccagaaaga

SEQ ID NO: 120105 - DNA, 25 bp, Homo sapien
ttacgccagaccagaaactgaaccg

SEQ ID NO: 120106 - DNA, 25 bp, Homo sapien
tttatttattcacggagaggctctg

SEQ ID NO: 120107 - DNA, 25 bp, Homo sapien
tctgcatcacgagagtgctgcgtta

SEQ ID NO: 120108 - DNA, 25 bp, Homo sapien
cttagcgctgccttcgagatcagtc

SEQ ID NO: 120109 - DNA, 25 bp, Homo sapien
ctgaaagtatcaggccttccgctta

SEQ ID NO: 120110 - DNA, 25 bp, Homo sapien
ctccagaaagagctgtcgaggttta

SEQ ID NO: 120111 - DNA, 25 bp, Homo sapien
ggggctgccaccaaaaacctcacag

SEQ ID NO: 120112 - DNA, 25 bp, Homo sapien
gcggcctcaagcctcccaggggaag

SEQ ID NO: 120113 - DNA, 25 bp, Homo sapien
cgcgagccctgcactggggcgcaat

SEQ ID NO: 120114 - DNA, 25 bp, Homo sapien
ggcagctgttgctgctgagcctccc

SEQ ID NO: 120115 - DNA, 25 bp, Homo sapien
gtcagctgtacattcttgccaggcc

SEQ ID NO: 120116 - DNA, 25 bp, Homo sapien
tgcccacaggcagctgttgctgctg

SEQ ID NO: 120117 - DNA, 25 bp, Homo sapien
caatggggtgtcaggaccctggacc

SEQ ID NO: 120118 - DNA, 25 bp, Homo sapien
gatctcgttctctgtcagctgtaca

SEQ ID NO: 120119 - DNA, 25 bp, Homo sapien
cgagtctgagcccatccgtcagcgt

SEQ ID NO: 120120 - DNA, 25 bp, Homo sapien
ctcagctcagaacgcaacaccaggg

SEQ ID NO: 120121 - DNA, 25 bp, Homo sapien
agcgtcaattaggaagcctcagctc

SEQ ID NO: 120122 - DNA, 25 bp, Homo sapien
tgagcccatccgtcagcgtcaatta

SEQ ID NO: 120123 - DNA, 25 bp, Homo sapien
aacgcaacaccaggggctgcgcaga

SEQ ID NO: 120124 - DNA, 25 bp, Homo sapien
tggctctgtcggctcgagtctgagc

SEQ ID NO: 120125 - DNA, 25 bp, Homo sapien
cgctcagctggctctgtcggctcga

SEQ ID NO: 120126 - DNA, 25 bp, Homo sapien
ccgtcagcgtcaattaggaagcctc

SEQ ID NO: 120127 - DNA, 25 bp, Homo sapien
catttccacgcgtgctgtgcaaaga

SEQ ID NO: 120128 - DNA, 25 bp, Homo sapien
cggcagcacgaacacgatcgtcaca

SEQ ID NO: 120129 - DNA, 25 bp, Homo sapien
ttccacgcgtgctgtgcaaagacgg

SEQ ID NO: 120130 - DNA, 25 bp, Homo sapien
gatcgtcacaatcgcgagcgccatt

SEQ ID NO: 120131 - DNA, 25 bp, Homo sapien
atttccacgcgtgctgtgcaaagac

SEQ ID NO: 120132 - DNA, 25 bp, Homo sapien
gtcacaatcgcgagcgccatttcca

SEQ ID NO: 120133 - DNA, 25 bp, Homo sapien
gcgccatttccacgcgtgctgtgca

SEQ ID NO: 120134 - DNA, 25 bp, Homo sapien
ccacgcgtgctgtgcaaagacggca

SEQ ID NO: 120135 - DNA, 25 bp, Homo sapien
tactccagttcctctcgtagtggat

SEQ ID NO: 120136 - DNA, 25 bp, Homo sapien
tggctactccagttcctctcgtagt

SEQ ID NO: 120137 - DNA, 25 bp, Homo sapien
gttcctctcgtagtggatggcacgg

SEQ ID NO: 120138 - DNA, 25 bp, Homo sapien
cgtggctactccagttcctctcgta

SEQ ID NO: 120139 - DNA, 25 bp, Homo sapien
tcctctcgtagtggatggcacggga

SEQ ID NO: 120140 - DNA, 25 bp, Homo sapien
gctactccagttcctctcgtagtgg

SEQ ID NO: 120141 - DNA, 25 bp, Homo sapien
ttcctctcgtagtggatggcacggg

SEQ ID NO: 120142 - DNA, 25 bp, Homo sapien
ggctactccagttcctctcgtagtg

SEQ ID NO: 120143 - DNA, 25 bp, Homo sapien
ctggggtcacctaataacgattatt

SEQ ID NO: 120144 - DNA, 25 bp, Homo sapien
gctgactctcgtgctctgcggacgc

SEQ ID NO: 120145 - DNA, 25 bp, Homo sapien
ctcgagctcggcctcttaagtgaca

SEQ ID NO: 120146 - DNA, 25 bp, Homo sapien
gcaacaagtttcctggggtcaccta

SEQ ID NO: 120147 - DNA, 25 bp, Homo sapien
gggaccttttgaagctaaacgctga

SEQ ID NO: 120148 - DNA, 25 bp, Homo sapien
acaacaaacaaacccatggagcacg

SEQ ID NO: 120149 - DNA, 25 bp, Homo sapien
tggagcacgaaacctctggggacct

SEQ ID NO: 120150 - DNA, 25 bp, Homo sapien
aagtgacagactcaaacacctgagc

SEQ ID NO: 120151 - DNA, 25 bp, Homo sapien
tccctgacgccctggatacacggcc

SEQ ID NO: 120152 - DNA, 25 bp, Homo sapien
gatacacggccacctggatacacgg

SEQ ID NO: 120153 - DNA, 25 bp, Homo sapien
atacacggccacctggatacacggc

SEQ ID NO: 120154 - DNA, 25 bp, Homo sapien
ccgtccctgacgccctggatacacg

SEQ ID NO: 120155 - DNA, 25 bp, Homo sapien
gtccctgacgccctggatacacggc

SEQ ID NO: 120156 - DNA, 25 bp, Homo sapien
tggatacacggccacctggatacac

SEQ ID NO: 120157 - DNA, 25 bp, Homo sapien
tgtccctgacgccctggatacacgg

SEQ ID NO: 120158 - DNA, 25 bp, Homo sapien
ggatacacggccacctggatacacg

SEQ ID NO: 120159 - DNA, 25 bp, Homo sapien
aggagaacgtactgtcctcaaggtc

SEQ ID NO: 120160 - DNA, 25 bp, Homo sapien
ccgggaggagaacgtactgtcctca

SEQ ID NO: 120161 - DNA, 25 bp, Homo sapien
gccgggaggagaacgtactgtcctc

SEQ ID NO: 120162 - DNA, 25 bp, Homo sapien
cctcaaggtctgtctcgtcgtgggg

SEQ ID NO: 120163 - DNA, 25 bp, Homo sapien
ggaggagaacgtactgtcctcaagg

SEQ ID NO: 120164 - DNA, 25 bp, Homo sapien
gtcctcaaggtctgtctcgtcgtgg

SEQ ID NO: 120165 - DNA, 25 bp, Homo sapien
gaggagaacgtactgtcctcaaggt

SEQ ID NO: 120166 - DNA, 25 bp, Homo sapien
tcctcaaggtctgtctcgtcgtggg

SEQ ID NO: 120167 - DNA, 25 bp, Homo sapien
aggccttggctgacgtcacatcact

SEQ ID NO: 120168 - DNA, 25 bp, Homo sapien
atcacttctgtctccagcactacag

SEQ ID NO: 120169 - DNA, 25 bp, Homo sapien
aaggagcccacgacggaactcctgc

SEQ ID NO: 120170 - DNA, 25 bp, Homo sapien
gtcggagcccacgacggaacacctg

SEQ ID NO: 120171 - DNA, 25 bp, Homo sapien
cactacagtcggagcccacgacgga

SEQ ID NO: 120172 - DNA, 25 bp, Homo sapien
ttctgtctccagcactacagtcgga

SEQ ID NO: 120173 - DNA, 25 bp, Homo sapien
tggctgacgtcacatcacttctgtc

SEQ ID NO: 120174 - DNA, 25 bp, Homo sapien
acctgacactgctcccgacgacccg

SEQ ID NO: 120175 - DNA, 25 bp, Homo sapien
cccgggtccgagtgccacactagag

SEQ ID NO: 120176 - DNA, 25 bp, Homo sapien
gggtccgagtgccacactagagttt

SEQ ID NO: 120177 - DNA, 25 bp, Homo sapien
cccagatctgagtgcagcaccaggg

SEQ ID NO: 120178 - DNA, 25 bp, Homo sapien
gatctgagtgcagcaccagggtttc

SEQ ID NO: 120179 - DNA, 25 bp, Homo sapien
tctgagtgcagcaccagggtttcct

SEQ ID NO: 120180 - DNA, 25 bp, Homo sapien
gagtgcagcaccagggttttctcgg

SEQ ID NO: 120181 - DNA, 25 bp, Homo sapien
ccgggtccgagtgccacactagagt

SEQ ID NO: 120182 - DNA, 25 bp, Homo sapien
agtgcagcaccagggttttctcggg

SEQ ID NO: 120183 - DNA, 25 bp, Homo sapien
tctgtgtgcagttcattaagttgtc

SEQ ID NO: 120184 - DNA, 25 bp, Homo sapien
agcgcagattggcttcggtccacac

SEQ ID NO: 120185 - DNA, 25 bp, Homo sapien
tgtgaaacccgaaatctcgaacgcg

SEQ ID NO: 120186 - DNA, 25 bp, Homo sapien
cgagcgctgtgaaacccgaaatctc

SEQ ID NO: 120187 - DNA, 25 bp, Homo sapien
gccacacgccattcctcagaggagg

SEQ ID NO: 120188 - DNA, 25 bp, Homo sapien
ttaagttgtcatgtcaggggacagc

SEQ ID NO: 120189 - DNA, 25 bp, Homo sapien
actgactgacgagtggccacacgcc

SEQ ID NO: 120190 - DNA, 25 bp, Homo sapien
tccgcgctctgtgtgcagttcatta

SEQ ID NO: 120191 - DNA, 25 bp, Homo sapien
tcaatgtttcacaatggctgtactg

SEQ ID NO: 120192 - DNA, 25 bp, Homo sapien
ggctgtactgaataatgggctcaca

SEQ ID NO: 120193 - DNA, 25 bp, Homo sapien
tgggctcacaaaattcctgagaaag

SEQ ID NO: 120194 - DNA, 25 bp, Homo sapien
aaaattagttctactgagtggatgc

SEQ ID NO: 120195 - DNA, 25 bp, Homo sapien
ctactgagtggatgcaaactgtccc

SEQ ID NO: 120196 - DNA, 25 bp, Homo sapien
gctggcacagtgctttgtttacacc

SEQ ID NO: 120197 - DNA, 25 bp, Homo sapien
agtgctttgtttacacccgaagtgg

SEQ ID NO: 120198 - DNA, 25 bp, Homo sapien
aagtgcatgtttttatcattcaatg

SEQ ID NO: 120199 - DNA, 25 bp, Homo sapien
aagactttccatgggctcctgactc

SEQ ID NO: 120200 - DNA, 25 bp, Homo sapien
cgccggggcccaagccatctttgag

SEQ ID NO: 120201 - DNA, 25 bp, Homo sapien
caagcctgaggtgcctcggattgtg

SEQ ID NO: 120202 - DNA, 25 bp, Homo sapien
tgcctcggattgtggtgcagccccc

SEQ ID NO: 120203 - DNA, 25 bp, Homo sapien
cggggcccaagccatctttgaggcc

SEQ ID NO: 120204 - DNA, 25 bp, Homo sapien
cggcaagactttccatgggctcctg

SEQ ID NO: 120205 - DNA, 25 bp, Homo sapien
actttccatgggctcctgactcggg

SEQ ID NO: 120206 - DNA, 25 bp, Homo sapien
ggagcccagaccaccgcggcggaaa

SEQ ID NO: 120207 - DNA, 25 bp, Homo sapien
aggcactcagtggaggggttccgag

SEQ ID NO: 120208 - DNA, 25 bp, Homo sapien
cacgtggggaccagcattgtgctgt

SEQ ID NO: 120209 - DNA, 25 bp, Homo sapien
tcagtggaggggttccgagtgtgac

SEQ ID NO: 120210 - DNA, 25 bp, Homo sapien
cattgtgctgtggaggcactcagtg

SEQ ID NO: 120211 - DNA, 25 bp, Homo sapien
gcattgtgctgtggaggcactcagt

SEQ ID NO: 120212 - DNA, 25 bp, Homo sapien
cagcattgtgctgtggaggcactca

SEQ ID NO: 120213 - DNA, 25 bp, Homo sapien
ccagcattgtgctgtggaggcactc

SEQ ID NO: 120214 - DNA, 25 bp, Homo sapien
gaccagcattgtgctgtggaggcac

SEQ ID NO: 120215 - DNA, 25 bp, Homo sapien
ctggagagtacgtggaaatcaacct

SEQ ID NO: 120216 - DNA, 25 bp, Homo sapien
gaaatcaacctcaccgtggcctcaa

SEQ ID NO: 120217 - DNA, 25 bp, Homo sapien
cctcaagagcacgtggggaccagcc

SEQ ID NO: 120218 - DNA, 25 bp, Homo sapien
gagtacgtggaaatcaacctcaccg

SEQ ID NO: 120219 - DNA, 25 bp, Homo sapien
tggaaatcaacctcaccgtggcctc

SEQ ID NO: 120220 - DNA, 25 bp, Homo sapien
ctcaagagcacgtggggaccagccc

SEQ ID NO: 120221 - DNA, 25 bp, Homo sapien
tggagagtacgtggaaatcaacctc

SEQ ID NO: 120222 - DNA, 25 bp, Homo sapien
atcaacctcaccgtggcctcaagag

SEQ ID NO: 120223 - DNA, 25 bp, Homo sapien
atcacgcacgtacgccgtgggaacg

SEQ ID NO: 120224 - DNA, 25 bp, Homo sapien
ggtccaggatcacgcacgtacgccg

SEQ ID NO: 120225 - DNA, 25 bp, Homo sapien
acgggtccaggatcacgcacgtacg

SEQ ID NO: 120226 - DNA, 25 bp, Homo sapien
gaacgggtccaggatcaggcacgta

SEQ ID NO: 120227 - DNA, 25 bp, Homo sapien
gacgggtccaggatcacgcacgtac

SEQ ID NO: 120228 - DNA, 25 bp, Homo sapien
tccaggatcaggcacgtacgccgga

SEQ ID NO: 120229 - DNA, 25 bp, Homo sapien
ggatcacgcatgtacgccgtgggaa

SEQ ID NO: 120230 - DNA, 25 bp, Homo sapien
gcacgtacgccggatcacgcacgta

SEQ ID NO: 120231 - DNA, 25 bp, Homo sapien
ctggacgcagcaagaatcaggcttc

SEQ ID NO: 120232 - DNA, 25 bp, Homo sapien
tttatctcgtgaacgcgggacgctc

SEQ ID NO: 120233 - DNA, 25 bp, Homo sapien
ggcatctgccagtcccaccattttg

SEQ ID NO: 120234 - DNA, 25 bp, Homo sapien
gccgtccgtgctcagaatccgtctt

SEQ ID NO: 120235 - DNA, 25 bp, Homo sapien
gtgacgcttacccaggactgagcct

SEQ ID NO: 120236 - DNA, 25 bp, Homo sapien
atcaggcttcagctccgcaatgtgg

SEQ ID NO: 120237 - DNA, 25 bp, Homo sapien
cgcacgcaggcaccagaactcaaga

SEQ ID NO: 120238 - DNA, 25 bp, Homo sapien
agaggtccagattcccgaaggctcc

SEQ ID NO: 120239 - DNA, 25 bp, Homo sapien
gcaccctgctggttctcgtgatgcg

SEQ ID NO: 120240 - DNA, 25 bp, Homo sapien
catctcacagtgagccgaggaaggg

SEQ ID NO: 120241 - DNA, 25 bp, Homo sapien
gtgatgcgctcttctcgctgaaccc

SEQ ID NO: 120242 - DNA, 25 bp, Homo sapien
gggtttcacatttcacatctcacag

SEQ ID NO: 120243 - DNA, 25 bp, Homo sapien
cctgggcagccactaggattggaac

SEQ ID NO: 120244 - DNA, 25 bp, Homo sapien
taggattggaacttcctctccacca

SEQ ID NO: 120245 - DNA, 25 bp, Homo sapien
ctgagcactcggtgggtttcacatt

SEQ ID NO: 120246 - DNA, 25 bp, Homo sapien
agcgggcagtggttcctgagcactc

SEQ ID NO: 120247 - DNA, 25 bp, Homo sapien
ggctcggcaaggtttccctcacatc

SEQ ID NO: 120248 - DNA, 25 bp, Homo sapien
gctcggcaaggtttccctcacatca

SEQ ID NO: 120249 - DNA, 25 bp, Homo sapien
ccctcacatcatcgcgagaaggttc

SEQ ID NO: 120250 - DNA, 25 bp, Homo sapien
cacatcatcgcgagaaggttccaga

SEQ ID NO: 120251 - DNA, 25 bp, Homo sapien
tccagaataccacggctcggcaaga

SEQ ID NO: 120252 - DNA, 25 bp, Homo sapien
tccagaataccacggctcggcaagg

SEQ ID NO: 120253 - DNA, 25 bp, Homo sapien
ggttccagaataccacggctcggca

SEQ ID NO: 120254 - DNA, 25 bp, Homo sapien
tcacatcatcgcgagaaggttccag

SEQ ID NO: 120255 - DNA, 25 bp, Homo sapien
aactcgggagaatcaggagcccgtg

SEQ ID NO: 120256 - DNA, 25 bp, Homo sapien
atgaatgagtgaacgcgggagaatc

SEQ ID NO: 120257 - DNA, 25 bp, Homo sapien
caagggcttcctgaatgaatgagtg

SEQ ID NO: 120258 - DNA, 25 bp, Homo sapien
gtgaactcgggagaatcaggagccc

SEQ ID NO: 120259 - DNA, 25 bp, Homo sapien
cgggacttcgcaagggctttctgaa

SEQ ID NO: 120260 - DNA, 25 bp, Homo sapien
ccgggacttcgcaagtgctttctga

SEQ ID NO: 120261 - DNA, 25 bp, Homo sapien
gccgggacttcgcaagtgctttctg

SEQ ID NO: 120262 - DNA, 25 bp, Homo sapien
ccgggacttcgcaagggctttctga

SEQ ID NO: 120263 - DNA, 25 bp, Homo sapien
agcgcacgcgtaggaagagcacgca

SEQ ID NO: 120264 - DNA, 25 bp, Homo sapien
cgcacgcgtaggaagagcacgcaga

SEQ ID NO: 120265 - DNA, 25 bp, Homo sapien
gtggcgcgtaagaagggcacgcaga

SEQ ID NO: 120266 - DNA, 25 bp, Homo sapien
gcacgtagggaaggcgcgcacgtag

SEQ ID NO: 120267 - DNA, 25 bp, Homo sapien
gaaggcgcgcacgtagggaaggcac

SEQ ID NO: 120268 - DNA, 25 bp, Homo sapien
gcacgtagggaaggcacgcagagca

SEQ ID NO: 120269 - DNA, 25 bp, Homo sapien
cagagcaggagtggcgcgtaagaag

SEQ ID NO: 120270 - DNA, 25 bp, Homo sapien
gggagcgcgcacgtagggaaggcgc

SEQ ID NO: 120271 - DNA, 25 bp, Homo sapien
tcaagggtctgctgacaccacggga

SEQ ID NO: 120272 - DNA, 25 bp, Homo sapien
ccacgtcaagggtctgctgacacca

SEQ ID NO: 120273 - DNA, 25 bp, Homo sapien
gggtccacgtcaagggtctgctgac

SEQ ID NO: 120274 - DNA, 25 bp, Homo sapien
acccacggtcacaggagcgagggcg

SEQ ID NO: 120275 - DNA, 25 bp, Homo sapien
ggtccacgtcaagggtctgctgaca

SEQ ID NO: 120276 - DNA, 25 bp, Homo sapien
caagggtctgctgacaccacgggaa

SEQ ID NO: 120277 - DNA, 25 bp, Homo sapien
gggtctgctgacaccacgggaacac

SEQ ID NO: 120278 - DNA, 25 bp, Homo sapien
ggtctgctgacaccacgggaacacc

SEQ ID NO: 120279 - DNA, 25 bp, Homo sapien
ccacccacggtcacaggagcgaggg

SEQ ID NO: 120280 - DNA, 25 bp, Homo sapien
agggcgcatcatggggtccatgtca

SEQ ID NO: 120281 - DNA, 25 bp, Homo sapien
catcatggggtccatgtcaagggtc

SEQ ID NO: 120282 - DNA, 25 bp, Homo sapien
ggtccatgtcaagggtctgctgatg

SEQ ID NO: 120283 - DNA, 25 bp, Homo sapien
ccatgtcaagggtctgctgatgctg

SEQ ID NO: 120284 - DNA, 25 bp, Homo sapien
atgtcaagggtctgctgatgctgtg

SEQ ID NO: 120285 - DNA, 25 bp, Homo sapien
ggtctgctgatgctgtgggaacacc

SEQ ID NO: 120286 - DNA, 25 bp, Homo sapien
gtctgctgatgctgtgggaacaccc

SEQ ID NO: 120287 - DNA, 25 bp, Homo sapien
ggatgtcctagtgcagaggcagcca

SEQ ID NO: 120288 - DNA, 25 bp, Homo sapien
tcacgagctcccaacggaagggatg

SEQ ID NO: 120289 - DNA, 25 bp, Homo sapien
ccacgctcgccgccttgtatgggga

SEQ ID NO: 120290 - DNA, 25 bp, Homo sapien
gccgccttgtatggggaaggccgcc

SEQ ID NO: 120291 - DNA, 25 bp, Homo sapien
aacggaagggatgtcctagtgcaga

SEQ ID NO: 120292 - DNA, 25 bp, Homo sapien
cccaacggaagggatgtcctagtgc

SEQ ID NO: 120293 - DNA, 25 bp, Homo sapien
acgagctcccaacggaagggatgtc

SEQ ID NO: 120294 - DNA, 25 bp, Homo sapien
agctcccaacggaagggatgtccta

SEQ ID NO: 120295 - DNA, 25 bp, Homo sapien
gtgcggcgttctggggaaagaagca

SEQ ID NO: 120296 - DNA, 25 bp, Homo sapien
ccctaacctcagtgtgcgccatgtt

SEQ ID NO: 120297 - DNA, 25 bp, Homo sapien
taacctcagtgtgcgccatgttctg

SEQ ID NO: 120298 - DNA, 25 bp, Homo sapien
ccatgttctggggaaagacgcagcc

SEQ ID NO: 120299 - DNA, 25 bp, Homo sapien
agcgccgtgtggtgaagacgaagcc

SEQ ID NO: 120300 - DNA, 25 bp, Homo sapien
tgcgccgtgtggtgaagacgaagcc

SEQ ID NO: 120301 - DNA, 25 bp, Homo sapien
aggaaagaggcaacccgcgccctca

SEQ ID NO: 120302 - DNA, 25 bp, Homo sapien
tgagccgcgttctggggaaagacac

SEQ ID NO: 120303 - DNA, 25 bp, Homo sapien
cgtttctatataaagcggcgccgct

SEQ ID NO: 120304 - DNA, 25 bp, Homo sapien
ccaggtctgggacgttttcgtggct

SEQ ID NO: 120305 - DNA, 25 bp, Homo sapien
ctatcggtccctgtcggtccgtccg

SEQ ID NO: 120306 - DNA, 25 bp, Homo sapien
cccaggcgtttctatataaagcggc

SEQ ID NO: 120307 - DNA, 25 bp, Homo sapien
gcggcgggaccctcgacgctacgcc

SEQ ID NO: 120308 - DNA, 25 bp, Homo sapien
gcatcccgcccggtccgagtccgcc

SEQ ID NO: 120309 - DNA, 25 bp, Homo sapien
gccgggcgctgtgccactgccaccg

SEQ ID NO: 120310 - DNA, 25 bp, Homo sapien
tttctatataaagcggcgccgcttg

SEQ ID NO: 120311 - DNA, 25 bp, Homo sapien
tggccatgccggaatccgtggtcat

SEQ ID NO: 120312 - DNA, 25 bp, Homo sapien
gaatccgtggtcatgctggaatcca

SEQ ID NO: 120313 - DNA, 25 bp, Homo sapien
tccgtggtcatgccagaatccgtgg

SEQ ID NO: 120314 - DNA, 25 bp, Homo sapien
atgctggaatccacggtcatgccgg

SEQ ID NO: 120315 - DNA, 25 bp, Homo sapien
atggccatgccggaatccgtggtca

SEQ ID NO: 120316 - DNA, 25 bp, Homo sapien
ctggaatccacggtcatgccggaac

SEQ ID NO: 120317 - DNA, 25 bp, Homo sapien
cggaatccgtggtcatgctggaatc

SEQ ID NO: 120318 - DNA, 25 bp, Homo sapien
ggtcatgccggaacccatggccatg

SEQ ID NO: 120319 - DNA, 25 bp, Homo sapien
ccactgatggtgcacgtgacccacg

SEQ ID NO: 120320 - DNA, 25 bp, Homo sapien
gtggtcatgccggaatccactgatg

SEQ ID NO: 120321 - DNA, 25 bp, Homo sapien
gtggccatgccggaatccatggcca

SEQ ID NO: 120322 - DNA, 25 bp, Homo sapien
tgacatccatggtcatgccggaatc

SEQ ID NO: 120323 - DNA, 25 bp, Homo sapien
tcagcacagaggctgacatccatgg

SEQ ID NO: 120324 - DNA, 25 bp, Homo sapien
tgaaatgagatgaggcgtccagccc

SEQ ID NO: 120325 - DNA, 25 bp, Homo sapien
cgtcgtcttgaggatggcctcgtga

SEQ ID NO: 120326 - DNA, 25 bp, Homo sapien
tgccggaatccactgatggtgcacg

SEQ ID NO: 120327 - DNA, 25 bp, Homo sapien
acggcgtctgctgcggggtattgtc

SEQ ID NO: 120328 - DNA, 25 bp, Homo sapien
cggggtattgtctggcagtgaggct

SEQ ID NO: 120329 - DNA, 25 bp, Homo sapien
ctgctgcggggtattgtctggcagt

SEQ ID NO: 120330 - DNA, 25 bp, Homo sapien
tctgctgcggggtattgtctggcag

SEQ ID NO: 120331 - DNA, 25 bp, Homo sapien
ggggtattgtctggcagtgaggctg

SEQ ID NO: 120332 - DNA, 25 bp, Homo sapien
gtctgctgcggggtattgtctggca

SEQ ID NO: 120333 - DNA, 25 bp, Homo sapien
tctgctgcggtgtgatgtctggcag

SEQ ID NO: 120334 - DNA, 25 bp, Homo sapien
ctgcggggtattgtctggcagtgag

SEQ ID NO: 120335 - DNA, 25 bp, Homo sapien
tggtctggaggaccagtggggacag

SEQ ID NO: 120336 - DNA, 25 bp, Homo sapien
gctgcagtgtgatgtctggcagtga

SEQ ID NO: 120337 - DNA, 25 bp, Homo sapien
cagtgtgatgtctggcagtgaggct

SEQ ID NO: 120338 - DNA, 25 bp, Homo sapien
aagctggggacggtgtccgctgcag

SEQ ID NO: 120339 - DNA, 25 bp, Homo sapien
cagaccccacagaggcgcagggctc

SEQ ID NO: 120340 - DNA, 25 bp, Homo sapien
acagtgtctgctgcggtgtgatgtc

SEQ ID NO: 120341 - DNA, 25 bp, Homo sapien
ccctggtctggaggaccagtgggga

SEQ ID NO: 120342 - DNA, 25 bp, Homo sapien
ttctctctctagcatgctcagaccc

SEQ ID NO: 120343 - DNA, 25 bp, Homo sapien
ggcgggtgtgaaatatcccagccgc

SEQ ID NO: 120344 - DNA, 25 bp, Homo sapien
ggtgtgaaatatcccagccgcacgc

SEQ ID NO: 120345 - DNA, 25 bp, Homo sapien
gtgaaatatcccagccgcacgcaca

SEQ ID NO: 120346 - DNA, 25 bp, Homo sapien
cccagccgcacgcacacagggcggg

SEQ ID NO: 120347 - DNA, 25 bp, Homo sapien
cacagggcgggtgtgaaatatccca

SEQ ID NO: 120348 - DNA, 25 bp, Homo sapien
atcccagccgcacgcacacagggcg

SEQ ID NO: 120349 - DNA, 25 bp, Homo sapien
gggtgtgaaatatcccagccgcacg

SEQ ID NO: 120350 - DNA, 25 bp, Homo sapien
cagggcgggtgtgaaatatcccagc

SEQ ID NO: 120351 - DNA, 25 bp, Homo sapien
tcgcagccacattgttgttgaaagc

SEQ ID NO: 120352 - DNA, 25 bp, Homo sapien
ccacattgttgttgaaagccgttgc

SEQ ID NO: 120353 - DNA, 25 bp, Homo sapien
cattgttgttgaaagccgttgccgg

SEQ ID NO: 120354 - DNA, 25 bp, Homo sapien
ttgaaagccgttgccgggcctgaaa

SEQ ID NO: 120355 - DNA, 25 bp, Homo sapien
cgggcctgaaaatcgcagctttttg

SEQ ID NO: 120356 - DNA, 25 bp, Homo sapien
ttttgaacgcacacactgaacctcc

SEQ ID NO: 120357 - DNA, 25 bp, Homo sapien
gtgaaatatcgcagccacattgttg

SEQ ID NO: 120358 - DNA, 25 bp, Homo sapien
tcgcagctttttgaacgcacacact

SEQ ID NO: 120359 - DNA, 25 bp, Homo sapien
agccctgagccggacagagcgcaag

SEQ ID NO: 120360 - DNA, 25 bp, Homo sapien
gacagagcgcaaatcccacggaggg

SEQ ID NO: 120361 - DNA, 25 bp, Homo sapien
acagagcgcaagtcccacggagggc

SEQ ID NO: 120362 - DNA, 25 bp, Homo sapien
ctgagccggacagagcgcaagtccc

SEQ ID NO: 120363 - DNA, 25 bp, Homo sapien
cctgagccggacagagcgcaagtcc

SEQ ID NO: 120364 - DNA, 25 bp, Homo sapien
ccggacagagcgcaagtcccacgga

SEQ ID NO: 120365 - DNA, 25 bp, Homo sapien
cggacagagcgcaagtcccacggag

SEQ ID NO: 120366 - DNA, 25 bp, Homo sapien
ccctgagccggacagagcgcaagtc

SEQ ID NO: 120367 - DNA, 25 bp, Homo sapien
ctcgtagcggtaaaagtccattgcc

SEQ ID NO: 120368 - DNA, 25 bp, Homo sapien
taggaagcacccatgagcccagcgc

SEQ ID NO: 120369 - DNA, 25 bp, Homo sapien
cggacgatcccagtaggaagcaccc

SEQ ID NO: 120370 - DNA, 25 bp, Homo sapien
accacactcgtggattcagtccgtc

SEQ ID NO: 120371 - DNA, 25 bp, Homo sapien
tcgtggattcagtccgtcccagctc

SEQ ID NO: 120372 - DNA, 25 bp, Homo sapien
ctacctgtgccggaaagcttctgca

SEQ ID NO: 120373 - DNA, 25 bp, Homo sapien
gaaagcttctgcaacgccacgcgca

SEQ ID NO: 120374 - DNA, 25 bp, Homo sapien
ccacgggcgacacctcgtagcggta

SEQ ID NO: 120375 - DNA, 25 bp, Homo sapien
gcgggtttctatgggactttgcaaa

SEQ ID NO: 120376 - DNA, 25 bp, Homo sapien
ccgtgatggacaggccgcaccacag

SEQ ID NO: 120377 - DNA, 25 bp, Homo sapien
gggccgggtgattagcagaaaataa

SEQ ID NO: 120378 - DNA, 25 bp, Homo sapien
ataacctcgagtattgcaagcgtcc

SEQ ID NO: 120379 - DNA, 25 bp, Homo sapien
attgcaagcgtcctgcgggtttcta

SEQ ID NO: 120380 - DNA, 25 bp, Homo sapien
cgagatgcctgcgaggccacacaaa

SEQ ID NO: 120381 - DNA, 25 bp, Homo sapien
caccgtccgtgatggacaggccgca

SEQ ID NO: 120382 - DNA, 25 bp, Homo sapien
tttgcaaagcccagggaatccggga

SEQ ID NO: 120383 - DNA, 25 bp, Homo sapien
ctcatccgtgagacacgtggccgca

SEQ ID NO: 120384 - DNA, 25 bp, Homo sapien
atcccgcagtggctcatccgtgaga

SEQ ID NO: 120385 - DNA, 25 bp, Homo sapien
ctgcacactgagatcccggtggctc

SEQ ID NO: 120386 - DNA, 25 bp, Homo sapien
ctcatccatgagacacgtggccgca

SEQ ID NO: 120387 - DNA, 25 bp, Homo sapien
tcccggtggctcatccgtgagacac

SEQ ID NO: 120388 - DNA, 25 bp, Homo sapien
catccatgagacacgtggccgcaca

SEQ ID NO: 120389 - DNA, 25 bp, Homo sapien
cgcacactgagatcccggtggctca

SEQ ID NO: 120390 - DNA, 25 bp, Homo sapien
tgagatcccgcagtggctcatccgt

SEQ ID NO: 120391 - DNA, 25 bp, Homo sapien
gcctcctctctccatggcgcgcagg

SEQ ID NO: 120392 - DNA, 25 bp, Homo sapien
acctacccacggaaggtcgaggatg

SEQ ID NO: 120393 - DNA, 25 bp, Homo sapien
cacctccttggacgatggcagactc

SEQ ID NO: 120394 - DNA, 25 bp, Homo sapien
cgcacggatggacctacccacggaa

SEQ ID NO: 120395 - DNA, 25 bp, Homo sapien
tcggctgggacggtgcctcctctct

SEQ ID NO: 120396 - DNA, 25 bp, Homo sapien
cgcagtcgctcgcactccgcctgca

SEQ ID NO: 120397 - DNA, 25 bp, Homo sapien
tgcagctggctgtggtcctcgcgca

SEQ ID NO: 120398 - DNA, 25 bp, Homo sapien
tccttggacgatggcagactcgcgg

SEQ ID NO: 120399 - DNA, 25 bp, Homo sapien
caccgccgggaaagacgcagagtcc

SEQ ID NO: 120400 - DNA, 25 bp, Homo sapien
cgagtccagcctagctgaggcctgc

SEQ ID NO: 120401 - DNA, 25 bp, Homo sapien
gtccagcctagctgaggcctgcgca

SEQ ID NO: 120402 - DNA, 25 bp, Homo sapien
tccgagaccagcctagctgaggcct

SEQ ID NO: 120403 - DNA, 25 bp, Homo sapien
accgccgggaaagacgcagagtccg

SEQ ID NO: 120404 - DNA, 25 bp, Homo sapien
ccgagtccagcctagctgaggcctg

SEQ ID NO: 120405 - DNA, 25 bp, Homo sapien
cagagtccgagtccagcctagctga

SEQ ID NO: 120406 - DNA, 25 bp, Homo sapien
ccgagaccagcctagctgaggcctg

SEQ ID NO: 120407 - DNA, 25 bp, Homo sapien
ggggaacagcgcctgtcagtgaaaa

SEQ ID NO: 120408 - DNA, 25 bp, Homo sapien
agccatctcgcgtccatctggaacg

SEQ ID NO: 120409 - DNA, 25 bp, Homo sapien
cccaggcctacacacagctgtagag

SEQ ID NO: 120410 - DNA, 25 bp, Homo sapien
gcctcgcttccggtgacatcatgtc

SEQ ID NO: 120411 - DNA, 25 bp, Homo sapien
gcctgggtgaaatgcctctcaatca

SEQ ID NO: 120412 - DNA, 25 bp, Homo sapien
ctctcaatcactggcgcgcacggag

SEQ ID NO: 120413 - DNA, 25 bp, Homo sapien
ctgcgcccacatgggctgagagaca

SEQ ID NO: 120414 - DNA, 25 bp, Homo sapien
acagggacggttatagccatctcgc

SEQ ID NO: 120415 - DNA, 25 bp, Homo sapien
ccaggtacaagtaagcccaggagta

SEQ ID NO: 120416 - DNA, 25 bp, Homo sapien
actccctgccgaggacgctggaggt

SEQ ID NO: 120417 - DNA, 25 bp, Homo sapien
gcacacggacttcctgggtgagtga

SEQ ID NO: 120418 - DNA, 25 bp, Homo sapien
caggcgtggatttcgcgctgacagc

SEQ ID NO: 120419 - DNA, 25 bp, Homo sapien
cctcatggagggaaaacagctgctg

SEQ ID NO: 120420 - DNA, 25 bp, Homo sapien
ctggcggcgtcagcaagaagttcgt

SEQ ID NO: 120421 - DNA, 25 bp, Homo sapien
ggaccgccctctacggcaccacaac

SEQ ID NO: 120422 - DNA, 25 bp, Homo sapien
ggcatcctggccaggtacaagtaag

SEQ ID NO: 120423 - DNA, 25 bp, Homo sapien
cacccattgctctgcagagaacata

SEQ ID NO: 120424 - DNA, 25 bp, Homo sapien
ggccacccatcgctctgcagagaag

SEQ ID NO: 120425 - DNA, 25 bp, Homo sapien
gctctgcagagaagacaacggcatg

SEQ ID NO: 120426 - DNA, 25 bp, Homo sapien
agaagacaacggcatggacgccatc

SEQ ID NO: 120427 - DNA, 25 bp, Homo sapien
gccacccatcgctctgcagagaaga

SEQ ID NO: 120428 - DNA, 25 bp, Homo sapien
ggccacccattgctctgcagagaac

SEQ ID NO: 120429 - DNA, 25 bp, Homo sapien
gccacccattgctctgcagagaaca

SEQ ID NO: 120430 - DNA, 25 bp, Homo sapien
acggccacccattgctctgcagaga

SEQ ID NO: 120431 - DNA, 25 bp, Homo sapien
caagttcattagcaaaggtgctacc

SEQ ID NO: 120432 - DNA, 25 bp, Homo sapien
ttccaagttcattagcaaaggtgct

SEQ ID NO: 120433 - DNA, 25 bp, Homo sapien
aaaggtgctacctcggcctgcggga

SEQ ID NO: 120434 - DNA, 25 bp, Homo sapien
gggagtcacagtaaagccaccgtca

SEQ ID NO: 120435 - DNA, 25 bp, Homo sapien
ccgtcaaaactccttccaagttcat

SEQ ID NO: 120436 - DNA, 25 bp, Homo sapien
agcaaaggtgctacctcggcctgcg

SEQ ID NO: 120437 - DNA, 25 bp, Homo sapien
ggggagtcacagtaaagccaccgtc

SEQ ID NO: 120438 - DNA, 25 bp, Homo sapien
cgtcaaaactccttccaagttcatt

SEQ ID NO: 120439 - DNA, 25 bp, Homo sapien
ggaaggcagacaccctgcaacggcc

SEQ ID NO: 120440 - DNA, 25 bp, Homo sapien
tccagcgctatggtgtggtcgtcct

SEQ ID NO: 120441 - DNA, 25 bp, Homo sapien
cctccaaacggagagcgcgacttgc

SEQ ID NO: 120442 - DNA, 25 bp, Homo sapien
cgacaggtgtgtagctgagccatcc

SEQ ID NO: 120443 - DNA, 25 bp, Homo sapien
ccacgagacacggagccgacaggtg

SEQ ID NO: 120444 - DNA, 25 bp, Homo sapien
attcagccttgagccacgagacacg

SEQ ID NO: 120445 - DNA, 25 bp, Homo sapien
gtcgtcctgacgcactcttagaagc

SEQ ID NO: 120446 - DNA, 25 bp, Homo sapien
gtgggtcgtcacagcataattcagc

SEQ ID NO: 120447 - DNA, 25 bp, Homo sapien
ttcaccagcatgacaggcccgggtg

SEQ ID NO: 120448 - DNA, 25 bp, Homo sapien
gcgcccagttcaccagcatgacagg

SEQ ID NO: 120449 - DNA, 25 bp, Homo sapien
gcttttctgaggatactggagttta

SEQ ID NO: 120450 - DNA, 25 bp, Homo sapien
aaagagaaggcctcgctcagtgcgc

SEQ ID NO: 120451 - DNA, 25 bp, Homo sapien
gccctgggagatgccctctgcctga

SEQ ID NO: 120452 - DNA, 25 bp, Homo sapien
ctgcccacagtctgaggacagatgc

SEQ ID NO: 120453 - DNA, 25 bp, Homo sapien
ccgccatcctcgctaggattaaatc

SEQ ID NO: 120454 - DNA, 25 bp, Homo sapien
ggcacccacgtctgtgcagagatta

SEQ ID NO: 120455 - DNA, 25 bp, Homo sapien
cagagagatgggtccagaaagcacc

SEQ ID NO: 120456 - DNA, 25 bp, Homo sapien
agaaaccgccggtcaagcaggctcc

SEQ ID NO: 120457 - DNA, 25 bp, Homo sapien
ctccgacccggcttttccgagatgg

SEQ ID NO: 120458 - DNA, 25 bp, Homo sapien
tggggccgattattctgaagccaga

SEQ ID NO: 120459 - DNA, 25 bp, Homo sapien
gccggcgtcatcacaggagactctc

SEQ ID NO: 120460 - DNA, 25 bp, Homo sapien
cttccagggaggtaacgagctccgc

SEQ ID NO: 120461 - DNA, 25 bp, Homo sapien
cgcctgtcttaaacacagagagatg

SEQ ID NO: 120462 - DNA, 25 bp, Homo sapien
tccgtggccacagacaagagacgca

SEQ ID NO: 120463 - DNA, 25 bp, Homo sapien
ctgagctcacaaggggtcggattgc

SEQ ID NO: 120464 - DNA, 25 bp, Homo sapien
acaaggggtcggattgcaagatctc

SEQ ID NO: 120465 - DNA, 25 bp, Homo sapien
aagctgagctcacaaggggtcggat

SEQ ID NO: 120466 - DNA, 25 bp, Homo sapien
actcagcaactgaaagaacacagga

SEQ ID NO: 120467 - DNA, 25 bp, Homo sapien
ggccgtgactcagcaactgaaagaa

SEQ ID NO: 120468 - DNA, 25 bp, Homo sapien
gtgtggccgtgactcagcaactgaa

SEQ ID NO: 120469 - DNA, 25 bp, Homo sapien
tgcaagatctcttcagaggtggaag

SEQ ID NO: 120470 - DNA, 25 bp, Homo sapien
ggggtcggattgcaagatctcttca

SEQ ID NO: 120471 - DNA, 25 bp, Homo sapien
acgttcccacaaacacagggtctgg

SEQ ID NO: 120472 - DNA, 25 bp, Homo sapien
ccgtgggacgctgcagagataacca

SEQ ID NO: 120473 - DNA, 25 bp, Homo sapien
agataaccaggtagagccacgctca

SEQ ID NO: 120474 - DNA, 25 bp, Homo sapien
ggtagagccacgctcacgagaacca

SEQ ID NO: 120475 - DNA, 25 bp, Homo sapien
cactctgagctaggacggggcacag

SEQ ID NO: 120476 - DNA, 25 bp, Homo sapien
ggacggggcacaggcaaccacgttc

SEQ ID NO: 120477 - DNA, 25 bp, Homo sapien
gtctggaggtctctccgctggtcac

SEQ ID NO: 120478 - DNA, 25 bp, Homo sapien
cagggctgcatctctcccgtgggac

SEQ ID NO: 120479 - DNA, 25 bp, Homo sapien
tggagattgactcctcgagctcctc

SEQ ID NO: 120480 - DNA, 25 bp, Homo sapien
tcaggaaggacctcatggggctttc

SEQ ID NO: 120481 - DNA, 25 bp, Homo sapien
catggggctttcacacgagagcaca

SEQ ID NO: 120482 - DNA, 25 bp, Homo sapien
acacgagagcacacatcctcagagc

SEQ ID NO: 120483 - DNA, 25 bp, Homo sapien
cccagcctcgttctgaaaatgaaag

SEQ ID NO: 120484 - DNA, 25 bp, Homo sapien
ctgagcccacgtcccgataggaagc

SEQ ID NO: 120485 - DNA, 25 bp, Homo sapien
cctgtgctctgagggctgcgcacca

SEQ ID NO: 120486 - DNA, 25 bp, Homo sapien
tgaaagacggagatagcctgtgctc

SEQ ID NO: 120487 - DNA, 25 bp, Homo sapien
caggtcactcccaggcaggtggctc

SEQ ID NO: 120488 - DNA, 25 bp, Homo sapien
cacgcaggtcgctcccacgcaggtc

SEQ ID NO: 120489 - DNA, 25 bp, Homo sapien
tcccacgcaggtcgctcccacgcag

SEQ ID NO: 120490 - DNA, 25 bp, Homo sapien
acgcaggtcgctcccacgcaggtca

SEQ ID NO: 120491 - DNA, 25 bp, Homo sapien
aggcggctcctgtgcaggtcgctcc

SEQ ID NO: 120492 - DNA, 25 bp, Homo sapien
ctcccacgcaggtcgctcccacgca

SEQ ID NO: 120493 - DNA, 25 bp, Homo sapien
cggctcctgtgcaggtcgctcctgg

SEQ ID NO: 120494 - DNA, 25 bp, Homo sapien
caggtcgctcctgggcaggtcgctc

SEQ ID NO: 120495 - DNA, 25 bp, Homo sapien
cctgagccttctctcattgcgcaga

SEQ ID NO: 120496 - DNA, 25 bp, Homo sapien
agcagaacggcaccgtcacggggtc

SEQ ID NO: 120497 - DNA, 25 bp, Homo sapien
tctctcattgcgcagaatggcaccg

SEQ ID NO: 120498 - DNA, 25 bp, Homo sapien
tcattgcgcagaatggcaccgtcac

SEQ ID NO: 120499 - DNA, 25 bp, Homo sapien
ctcattgcgcagaatggcaccgtca

SEQ ID NO: 120500 - DNA, 25 bp, Homo sapien
ctgagccttctctcattgcgcagaa

SEQ ID NO: 120501 - DNA, 25 bp, Homo sapien
tctcattgcgcagaatggcaccgtc

SEQ ID NO: 120502 - DNA, 25 bp, Homo sapien
ccttctctcattgcgcagaatggca

SEQ ID NO: 120503 - DNA, 25 bp, Homo sapien
gtcttcaacgtggagctcaagctga

SEQ ID NO: 120504 - DNA, 25 bp, Homo sapien
gctgggcctcggcttatcgagatca

SEQ ID NO: 120505 - DNA, 25 bp, Homo sapien
cgggttgctcgatggagtcttcaac

SEQ ID NO: 120506 - DNA, 25 bp, Homo sapien
gcacagatggttcaggcagccttcc

SEQ ID NO: 120507 - DNA, 25 bp, Homo sapien
cctggcttcactgagacggcggcct

SEQ ID NO: 120508 - DNA, 25 bp, Homo sapien
tgtctccgacaatggccctacgagg

SEQ ID NO: 120509 - DNA, 25 bp, Homo sapien
tgctggctgcctttgtctccgacaa

SEQ ID NO: 120510 - DNA, 25 bp, Homo sapien
gcacgacgtggacctggtgttgttt

SEQ ID NO: 120511 - DNA, 25 bp, Homo sapien
catcagccgcccacagcagggaggt

SEQ ID NO: 120512 - DNA, 25 bp, Homo sapien
aaacatcagccgcccacagcaggga

SEQ ID NO: 120513 - DNA, 25 bp, Homo sapien
acatcagccgcccacagcagggagg

SEQ ID NO: 120514 - DNA, 25 bp, Homo sapien
gtgcagggtcactgcgcacccgaga

SEQ ID NO: 120515 - DNA, 25 bp, Homo sapien
atcagccgcccacagcagggaggtg

SEQ ID NO: 120516 - DNA, 25 bp, Homo sapien
tgcagggtcactgcgcacccgagac

SEQ ID NO: 120517 - DNA, 25 bp, Homo sapien
acacacaaacatcagccgcccacgg

SEQ ID NO: 120518 - DNA, 25 bp, Homo sapien
catcagccgcccacggcagggaggt

SEQ ID NO: 120519 - DNA, 25 bp, Homo sapien
gtttggacttaattcccagaactca

SEQ ID NO: 120520 - DNA, 25 bp, Homo sapien
tcaccactgagcgacctcgaaaaag

SEQ ID NO: 120521 - DNA, 25 bp, Homo sapien
gtccctgagcgaacgcaccggcttt

SEQ ID NO: 120522 - DNA, 25 bp, Homo sapien
cgaaaaagatcacgtgggcctcaca

SEQ ID NO: 120523 - DNA, 25 bp, Homo sapien
ttgggcggacgagactccctgacac

SEQ ID NO: 120524 - DNA, 25 bp, Homo sapien
tcagggtcctgctctcagggtcctg

SEQ ID NO: 120525 - DNA, 25 bp, Homo sapien
acaaggctgcccaacaagaacgcgg

SEQ ID NO: 120526 - DNA, 25 bp, Homo sapien
cctaactgacaggaacgcggggcgc

SEQ ID NO: 120527 - DNA, 25 bp, Homo sapien
ctcatttattgaggcgccttccctg

SEQ ID NO: 120528 - DNA, 25 bp, Homo sapien
taaaccccccactcattcattgagg

SEQ ID NO: 120529 - DNA, 25 bp, Homo sapien
tctcattcattgaggcgtccctccc

SEQ ID NO: 120530 - DNA, 25 bp, Homo sapien
cgggccgagcttcagcaccggacag

SEQ ID NO: 120531 - DNA, 25 bp, Homo sapien
cccactcatttattgaggcgccttc

SEQ ID NO: 120532 - DNA, 25 bp, Homo sapien
gcgctcagtccatggccgcgcggga

SEQ ID NO: 120533 - DNA, 25 bp, Homo sapien
gcgcctctcgcgctcttgcggcgac

SEQ ID NO: 120534 - DNA, 25 bp, Homo sapien
aactaattcattgaggcgcccctcc

SEQ ID NO: 120535 - DNA, 25 bp, Homo sapien
tccgacacggacaagaaggacgggc

SEQ ID NO: 120536 - DNA, 25 bp, Homo sapien
taccgggcactacggaacgcgcacg

SEQ ID NO: 120537 - DNA, 25 bp, Homo sapien
cggcctcgagcagctaagcccagtg

SEQ ID NO: 120538 - DNA, 25 bp, Homo sapien
ggctgggattttcctccgacacgga

SEQ ID NO: 120539 - DNA, 25 bp, Homo sapien
cagttccgtccagttccgtcagagg

SEQ ID NO: 120540 - DNA, 25 bp, Homo sapien
ttcccgcgctcggaccagattcaaa

SEQ ID NO: 120541 - DNA, 25 bp, Homo sapien
atcaggcgccgctctcgcgagagct

SEQ ID NO: 120542 - DNA, 25 bp, Homo sapien
cacagctggggaacccatgcccggt

SEQ ID NO: 120543 - DNA, 25 bp, Homo sapien
gtgaggcgcgcgacaaacccaaact

SEQ ID NO: 120544 - DNA, 25 bp, Homo sapien
gcgcgtgacaaacccaaaccgttga

SEQ ID NO: 120545 - DNA, 25 bp, Homo sapien
tgaggcgcgcgacaaacccaaaccg

SEQ ID NO: 120546 - DNA, 25 bp, Homo sapien
tgaggcgcgcgacaaacccaaactg

SEQ ID NO: 120547 - DNA, 25 bp, Homo sapien
gtgaggcgcgcgacaaacccaaacc

SEQ ID NO: 120548 - DNA, 25 bp, Homo sapien
gtgaggcgcgtgacaaacccaaacc

SEQ ID NO: 120549 - DNA, 25 bp, Homo sapien
gtgaggcacgtgacaaacccaaact

SEQ ID NO: 120550 - DNA, 25 bp, Homo sapien
ggtgaggcgcgtgacaaacccaaac

SEQ ID NO: 120551 - DNA, 25 bp, Homo sapien
tctgcactcgccctagcgggcaggt

SEQ ID NO: 120552 - DNA, 25 bp, Homo sapien
gggtctgcactcacctaggttggca

SEQ ID NO: 120553 - DNA, 25 bp, Homo sapien
gggtggatactgacgtcatcgcgcg

SEQ ID NO: 120554 - DNA, 25 bp, Homo sapien
cactcacctaggttggcaggtcgca

SEQ ID NO: 120555 - DNA, 25 bp, Homo sapien
acctaggttggcaggtcgcaggaac

SEQ ID NO: 120556 - DNA, 25 bp, Homo sapien
gcgaggagaacccagctgaagctga

SEQ ID NO: 120557 - DNA, 25 bp, Homo sapien
ccagcgcgtacacgggcagcagcag

SEQ ID NO: 120558 - DNA, 25 bp, Homo sapien
ccaggtagcccagcgcgtacacggg

SEQ ID NO: 120559 - DNA, 25 bp, Homo sapien
ccttggggagaccaacgaccgctcg

SEQ ID NO: 120560 - DNA, 25 bp, Homo sapien
gtgctaaaaatgccggggatgcgca

SEQ ID NO: 120561 - DNA, 25 bp, Homo sapien
tccctttgcgcagcggttctctcgg

SEQ ID NO: 120562 - DNA, 25 bp, Homo sapien
tcgagcttcgcggactccttcgggc

SEQ ID NO: 120563 - DNA, 25 bp, Homo sapien
ggcagtgcttctgggccctctgctg

SEQ ID NO: 120564 - DNA, 25 bp, Homo sapien
cctgcttgtcggttgctaggcgctg

SEQ ID NO: 120565 - DNA, 25 bp, Homo sapien
cccaagtcagggtactgcacctacc

SEQ ID NO: 120566 - DNA, 25 bp, Homo sapien
cacgctgggcagtgcttctgggccc

SEQ ID NO: 120567 - DNA, 25 bp, Homo sapien
agcgggacgtccttagctctgggtg

SEQ ID NO: 120568 - DNA, 25 bp, Homo sapien
cgggacgtccttagctccgtgtgtg

SEQ ID NO: 120569 - DNA, 25 bp, Homo sapien
ggcggtgagcgggacgtccttagct

SEQ ID NO: 120570 - DNA, 25 bp, Homo sapien
gcgggacgtccttagctcctggtgt

SEQ ID NO: 120571 - DNA, 25 bp, Homo sapien
gcgggacgtccttagctccgtgtgt

SEQ ID NO: 120572 - DNA, 25 bp, Homo sapien
gagcgggacgtccttagctccgtgt

SEQ ID NO: 120573 - DNA, 25 bp, Homo sapien
gagcgggacgtccttagctctgggt

SEQ ID NO: 120574 - DNA, 25 bp, Homo sapien
gagcgggacgtccttagctcctggt

SEQ ID NO: 120575 - DNA, 25 bp, Homo sapien
tctccaggcacctgcggttccggat

SEQ ID NO: 120576 - DNA, 25 bp, Homo sapien
ctccaggcacctgcggttccggatt

SEQ ID NO: 120577 - DNA, 25 bp, Homo sapien
tggtgctctccaggcacctgcggtt

SEQ ID NO: 120578 - DNA, 25 bp, Homo sapien
ggtgtgttggtgctctccaggcacc

SEQ ID NO: 120579 - DNA, 25 bp, Homo sapien
gcacctgcggttccggattggtgtt

SEQ ID NO: 120580 - DNA, 25 bp, Homo sapien
caggcacctgcggttccggattggt

SEQ ID NO: 120581 - DNA, 25 bp, Homo sapien
gtgttggtgctctccaggcacctgc

SEQ ID NO: 120582 - DNA, 25 bp, Homo sapien
ctgcggttccggattggtgttccgc

SEQ ID NO: 120583 - DNA, 25 bp, Homo sapien
tgtgtgtgtaccacagcgtgtggcc

SEQ ID NO: 120584 - DNA, 25 bp, Homo sapien
cctccgtcggggaacacgtgaagtg

SEQ ID NO: 120585 - DNA, 25 bp, Homo sapien
agcgccgggcctccatcagggaaca

SEQ ID NO: 120586 - DNA, 25 bp, Homo sapien
tgtaccacagcgtgtggcctccgtc

SEQ ID NO: 120587 - DNA, 25 bp, Homo sapien
tgtgtgtaccacagcgtgtggcctc

SEQ ID NO: 120588 - DNA, 25 bp, Homo sapien
ggcctccgtcggagaacacgtgaag

SEQ ID NO: 120589 - DNA, 25 bp, Homo sapien
gcctccgtcggagaacacgtgaagt

SEQ ID NO: 120590 - DNA, 25 bp, Homo sapien
ctccgtcggggaacacgtgaagtgt

SEQ ID NO: 120591 - DNA, 25 bp, Homo sapien
tgcttgctgcgcctgtacaggacgt

SEQ ID NO: 120592 - DNA, 25 bp, Homo sapien
ttgcgagtgactcttgacgtctgtc

SEQ ID NO: 120593 - DNA, 25 bp, Homo sapien
cttcagcctgttgcgagtgactctt

SEQ ID NO: 120594 - DNA, 25 bp, Homo sapien
ctctgcgctgtcttcagcctgttgc

SEQ ID NO: 120595 - DNA, 25 bp, Homo sapien
cagagacactatggacagcgtgaag

SEQ ID NO: 120596 - DNA, 25 bp, Homo sapien
tctttcagagacactatggacagcg

SEQ ID NO: 120597 - DNA, 25 bp, Homo sapien
ttgctgcgcctgtacaggacgtccc

SEQ ID NO: 120598 - DNA, 25 bp, Homo sapien
tgactcttgacgtctgtctttcaga

SEQ ID NO: 120599 - DNA, 25 bp, Homo sapien
tgcacgcacacaggtctgagcggtg

SEQ ID NO: 120600 - DNA, 25 bp, Homo sapien
gggtcaggcgttggttgccatatca

SEQ ID NO: 120601 - DNA, 25 bp, Homo sapien
tcttgggtagaagcgaggagaccac

SEQ ID NO: 120602 - DNA, 25 bp, Homo sapien
tgccatatcatagttccgctgtaac

SEQ ID NO: 120603 - DNA, 25 bp, Homo sapien
tgggcacacctgtgtcttgggtaga

SEQ ID NO: 120604 - DNA, 25 bp, Homo sapien
acacaggtctgagcggtgggcacac

SEQ ID NO: 120605 - DNA, 25 bp, Homo sapien
ccgctgtaacaggaggtacacgttc

SEQ ID NO: 120606 - DNA, 25 bp, Homo sapien
cacgttcctaaaaatcgctacaccg

SEQ ID NO: 120607 - DNA, 25 bp, Homo sapien
tcccgccaagtgctgagattctgca

SEQ ID NO: 120608 - DNA, 25 bp, Homo sapien
cacatacaggccaggaccgggacca

SEQ ID NO: 120609 - DNA, 25 bp, Homo sapien
acatacaggccaggaccgggaccag

SEQ ID NO: 120610 - DNA, 25 bp, Homo sapien
catacaggccaggaccgggaccaga

SEQ ID NO: 120611 - DNA, 25 bp, Homo sapien
atacaggccaggaccgggaccagag

SEQ ID NO: 120612 - DNA, 25 bp, Homo sapien
gggccagcggtgcacgcacacacat

SEQ ID NO: 120613 - DNA, 25 bp, Homo sapien
ctcccgccaagtgctgagattctgc

SEQ ID NO: 120614 - DNA, 25 bp, Homo sapien
acacatacaggccaggaccgggacc

SEQ ID NO: 120615 - DNA, 25 bp, Homo sapien
ttcccacgtgccacgggctatgagg

SEQ ID NO: 120616 - DNA, 25 bp, Homo sapien
ccataacagcgctcctagggaaaga

SEQ ID NO: 120617 - DNA, 25 bp, Homo sapien
aatgcactcggcactcgtgaggtcc

SEQ ID NO: 120618 - DNA, 25 bp, Homo sapien
tggagtccctgagcatcgagcctcc

SEQ ID NO: 120619 - DNA, 25 bp, Homo sapien
ttatctgctgcagacgccgaggcct

SEQ ID NO: 120620 - DNA, 25 bp, Homo sapien
gccacctggcaagcctctgtgatta

SEQ ID NO: 120621 - DNA, 25 bp, Homo sapien
tgcagccacacggagctcaccggag

SEQ ID NO: 120622 - DNA, 25 bp, Homo sapien
tctcagcgattccagctgggctgca

SEQ ID NO: 120623 - DNA, 25 bp, Homo sapien
ccacacctggcgttccagccaccta

SEQ ID NO: 120624 - DNA, 25 bp, Homo sapien
agccacctaccgaccagagatctga

SEQ ID NO: 120625 - DNA, 25 bp, Homo sapien
ccgtttttgtctcttgccgacttgt

SEQ ID NO: 120626 - DNA, 25 bp, Homo sapien
aacggatgctcgtcctggcatctcc

SEQ ID NO: 120627 - DNA, 25 bp, Homo sapien
agcagaacggatgctcgtcctggca

SEQ ID NO: 120628 - DNA, 25 bp, Homo sapien
aagcgtgcgcgttctctcttcctca

SEQ ID NO: 120629 - DNA, 25 bp, Homo sapien
accagagatctgaagcgtgcgcgtt

SEQ ID NO: 120630 - DNA, 25 bp, Homo sapien
ttctgtgcgcggatcagctgctggt

SEQ ID NO: 120631 - DNA, 25 bp, Homo sapien
ccgttcgagcgctgtgtttgcagaa

SEQ ID NO: 120632 - DNA, 25 bp, Homo sapien
ttgcagaagggttccgttcgagccc

SEQ ID NO: 120633 - DNA, 25 bp, Homo sapien
ccgttcgagccctgtgtttgcagaa

SEQ ID NO: 120634 - DNA, 25 bp, Homo sapien
ctgtgtttgcagaagggttccgttg

SEQ ID NO: 120635 - DNA, 25 bp, Homo sapien
ctgtgtttgcagaagggttccgttc

SEQ ID NO: 120636 - DNA, 25 bp, Homo sapien
gccctgtgtttgcagaagggttccg

SEQ ID NO: 120637 - DNA, 25 bp, Homo sapien
cctgtgtttgcagaagggttccgtt

SEQ ID NO: 120638 - DNA, 25 bp, Homo sapien
tccgttcgagccctgtgtttgcaga

SEQ ID NO: 120639 - DNA, 25 bp, Homo sapien
ctccgaaggtgcctagaagcctgtg

SEQ ID NO: 120640 - DNA, 25 bp, Homo sapien
tccataaacggaggctgaaacggcc

SEQ ID NO: 120641 - DNA, 25 bp, Homo sapien
ctctgctgactcttccggaggattc

SEQ ID NO: 120642 - DNA, 25 bp, Homo sapien
ttcttagatagagagcggccgcctc

SEQ ID NO: 120643 - DNA, 25 bp, Homo sapien
tccagacccgccacttcttagatag

SEQ ID NO: 120644 - DNA, 25 bp, Homo sapien
cgcgttcccggcattgacagaatgt

SEQ ID NO: 120645 - DNA, 25 bp, Homo sapien
agggacccggttagcgtttctgcat

SEQ ID NO: 120646 - DNA, 25 bp, Homo sapien
ggctgttcctttccggcctgaggag

SEQ ID NO: 120647 - DNA, 25 bp, Homo sapien
ctcctccgttgtcggggacagcgct

SEQ ID NO: 120648 - DNA, 25 bp, Homo sapien
gctcctccgttgtcggggacagcgc

SEQ ID NO: 120649 - DNA, 25 bp, Homo sapien
cctccgtcgtcggggacagcgctga

SEQ ID NO: 120650 - DNA, 25 bp, Homo sapien
acagcgctgagagtgagactggggc

SEQ ID NO: 120651 - DNA, 25 bp, Homo sapien
agagctgagactgggacggctcctc

SEQ ID NO: 120652 - DNA, 25 bp, Homo sapien
ctcctccgtcgtgggggacagcgct

SEQ ID NO: 120653 - DNA, 25 bp, Homo sapien
ctcctccgtcgtcggggacagcgct

SEQ ID NO: 120654 - DNA, 25 bp, Homo sapien
tgagagctgagactgggacggctcc

SEQ ID NO: 120655 - DNA, 25 bp, Homo sapien
accaccgtccgaatccaagcgaagg

SEQ ID NO: 120656 - DNA, 25 bp, Homo sapien
gattctgtgactctcctcgcctcga

SEQ ID NO: 120657 - DNA, 25 bp, Homo sapien
ccacggttctcagcataaagcccag

SEQ ID NO: 120658 - DNA, 25 bp, Homo sapien
ctggatcggtcctgggcatatttac

SEQ ID NO: 120659 - DNA, 25 bp, Homo sapien
gcttcgctttttaccctgggatcca

SEQ ID NO: 120660 - DNA, 25 bp, Homo sapien
gggtctttcacagtcgcttccgtcc

SEQ ID NO: 120661 - DNA, 25 bp, Homo sapien
ctgggatccactgttcgactcgcaa

SEQ ID NO: 120662 - DNA, 25 bp, Homo sapien
cgcggcagccttcgattctgtgact

SEQ ID NO: 120663 - DNA, 25 bp, Homo sapien
ttcctcaggaagaggacggcctccc

SEQ ID NO: 120664 - DNA, 25 bp, Homo sapien
gcgcgctgcctgctttctcaggaag

SEQ ID NO: 120665 - DNA, 25 bp, Homo sapien
gcgctgccggtttcctcaggaagag

SEQ ID NO: 120666 - DNA, 25 bp, Homo sapien
cgcgcgctgcctgctttctcaggaa

SEQ ID NO: 120667 - DNA, 25 bp, Homo sapien
cgcgctgcctgcttcctcaggaaga

SEQ ID NO: 120668 - DNA, 25 bp, Homo sapien
ctttctcaggaagaggacggcctcc

SEQ ID NO: 120669 - DNA, 25 bp, Homo sapien
gcgcgctgcctgcttcctcaggaag

SEQ ID NO: 120670 - DNA, 25 bp, Homo sapien
tttcctcaggaagaggacggcctcc

SEQ ID NO: 120671 - DNA, 25 bp, Homo sapien
cgatgcagacactgctcccggccca

SEQ ID NO: 120672 - DNA, 25 bp, Homo sapien
ctggctgcgcccacagtcccacccg

SEQ ID NO: 120673 - DNA, 25 bp, Homo sapien
ggctgcgcccacagtcccacccgat

SEQ ID NO: 120674 - DNA, 25 bp, Homo sapien
gtcccacccgatgcagacactgctc

SEQ ID NO: 120675 - DNA, 25 bp, Homo sapien
cacccgatgcagacactgctgctga

SEQ ID NO: 120676 - DNA, 25 bp, Homo sapien
acagtcccacccgatgcagacactg

SEQ ID NO: 120677 - DNA, 25 bp, Homo sapien
cgcccacagtcccacccgatgcaga

SEQ ID NO: 120678 - DNA, 25 bp, Homo sapien
cgatgcagacactgctgctgaccca

SEQ ID NO: 120679 - DNA, 25 bp, Homo sapien
ccaccaggctaagcgattttccgga

SEQ ID NO: 120680 - DNA, 25 bp, Homo sapien
agtaagatcccttgcgtcaccggcg

SEQ ID NO: 120681 - DNA, 25 bp, Homo sapien
gcctcgccactctaggactacaatt

SEQ ID NO: 120682 - DNA, 25 bp, Homo sapien
acaattcccgagaggccttgcgacg

SEQ ID NO: 120683 - DNA, 25 bp, Homo sapien
gatgatgtttaggtccgggactgtc

SEQ ID NO: 120684 - DNA, 25 bp, Homo sapien
ccttgcgacggaagccatctttgtt

SEQ ID NO: 120685 - DNA, 25 bp, Homo sapien
cggccgtgtttgatttggatttgga

SEQ ID NO: 120686 - DNA, 25 bp, Homo sapien
ctggatcctggagccgatcctgtca

SEQ ID NO: 120687 - DNA, 25 bp, Homo sapien
catcagggcacaccgcgatcaggtg

SEQ ID NO: 120688 - DNA, 25 bp, Homo sapien
cagttgcaggcacgcagcggtctcc

SEQ ID NO: 120689 - DNA, 25 bp, Homo sapien
accgcgatcaggtgtgtggacagtt

SEQ ID NO: 120690 - DNA, 25 bp, Homo sapien
accgcgatcaggtgtgtggacagtc

SEQ ID NO: 120691 - DNA, 25 bp, Homo sapien
ttgcaggcacgcagcggtctcccag

SEQ ID NO: 120692 - DNA, 25 bp, Homo sapien
acaccgcgatcaggtgtgtggacag

SEQ ID NO: 120693 - DNA, 25 bp, Homo sapien
cgcaccgcgatcaggtgtgtggaca

SEQ ID NO: 120694 - DNA, 25 bp, Homo sapien
gacagttgcaggcacgcagcggtct

SEQ ID NO: 120695 - DNA, 25 bp, Homo sapien
atcgatcaggcgtgtggacagtcgc

SEQ ID NO: 120696 - DNA, 25 bp, Homo sapien
gtcctccgacgcgagatggctgtgt

SEQ ID NO: 120697 - DNA, 25 bp, Homo sapien
gtgtgccaccgactgtccaaatgcc

SEQ ID NO: 120698 - DNA, 25 bp, Homo sapien
cgactgtccaaatgccctgccaatg

SEQ ID NO: 120699 - DNA, 25 bp, Homo sapien
aatgccatcgtgaagcatccgtgtg

SEQ ID NO: 120700 - DNA, 25 bp, Homo sapien
ccttaccgtgcgctgtggcatcgat

SEQ ID NO: 120701 - DNA, 25 bp, Homo sapien
aacatcagggcacaccgcgatcagg

SEQ ID NO: 120702 - DNA, 25 bp, Homo sapien
catccgtgtgaaggaaaaagtccac

SEQ ID NO: 120703 - DNA, 25 bp, Homo sapien
gccgaccatggggaaaaacagattc

SEQ ID NO: 120704 - DNA, 25 bp, Homo sapien
gggacgctgccagactctaagactg

SEQ ID NO: 120705 - DNA, 25 bp, Homo sapien
ccgtgctggtgaaagctgcatgtca

SEQ ID NO: 120706 - DNA, 25 bp, Homo sapien
tactcgggctcagctttgcagaagc

SEQ ID NO: 120707 - DNA, 25 bp, Homo sapien
ggtaagcgcagtcccacagtctcag

SEQ ID NO: 120708 - DNA, 25 bp, Homo sapien
gcctgctcccgtatctgtgttgcca

SEQ ID NO: 120709 - DNA, 25 bp, Homo sapien
agaccctgtaatcccggctcgcgga

SEQ ID NO: 120710 - DNA, 25 bp, Homo sapien
attttccttagcagccggggttgtg

SEQ ID NO: 120711 - DNA, 25 bp, Homo sapien
gggaagcacctcatccgtctgaacc

SEQ ID NO: 120712 - DNA, 25 bp, Homo sapien
tcctttcacggacgggaagcacctc

SEQ ID NO: 120713 - DNA, 25 bp, Homo sapien
gacctgcttcctttcacggacggga

SEQ ID NO: 120714 - DNA, 25 bp, Homo sapien
cgtgccaatgacctgcttcctttca

SEQ ID NO: 120715 - DNA, 25 bp, Homo sapien
cgccaggacctaacgtgggtccctg

SEQ ID NO: 120716 - DNA, 25 bp, Homo sapien
aaccaggagcccttggtcccgccag

SEQ ID NO: 120717 - DNA, 25 bp, Homo sapien
tccacgagccacgggaggaaaccag

SEQ ID NO: 120718 - DNA, 25 bp, Homo sapien
tgctccgaggactgcggccgactca

SEQ ID NO: 120719 - DNA, 25 bp, Homo sapien
gacggctttctggatctcacgctca

SEQ ID NO: 120720 - DNA, 25 bp, Homo sapien
agcagacgagaactggccggatccc

SEQ ID NO: 120721 - DNA, 25 bp, Homo sapien
agtaccgggatcaagctcggtgcgc

SEQ ID NO: 120722 - DNA, 25 bp, Homo sapien
gacgcactgctagcgggagaagcct

SEQ ID NO: 120723 - DNA, 25 bp, Homo sapien
gccgacagacaggaaagacggcttt

SEQ ID NO: 120724 - DNA, 25 bp, Homo sapien
cggaaagcctgaagcctctagagga

SEQ ID NO: 120725 - DNA, 25 bp, Homo sapien
cccgtcctgagaagcctggtcttgc

SEQ ID NO: 120726 - DNA, 25 bp, Homo sapien
gccggatcccaacagggacttgatg

SEQ ID NO: 120727 - DNA, 25 bp, Homo sapien
acggagtggaattggcggctcctga

SEQ ID NO: 120728 - DNA, 25 bp, Homo sapien
tgaaaatggacgagaccagaactgt

SEQ ID NO: 120729 - DNA, 25 bp, Homo sapien
tgtgcagaaccctccgggacgggac

SEQ ID NO: 120730 - DNA, 25 bp, Homo sapien
ctctgtgcagaaccctccgggacgg

SEQ ID NO: 120731 - DNA, 25 bp, Homo sapien
gctcgagcgggtccacagaggaccc

SEQ ID NO: 120732 - DNA, 25 bp, Homo sapien
tccttcttcccgcatttcacgggag

SEQ ID NO: 120733 - DNA, 25 bp, Homo sapien
cagaactgtggtctcaagtcggggc

SEQ ID NO: 120734 - DNA, 25 bp, Homo sapien
aggagggctccttcttcccgcattt

SEQ ID NO: 120735 - DNA, 25 bp, Homo sapien
gcaggtgcccacagcgtccctgggt

SEQ ID NO: 120736 - DNA, 25 bp, Homo sapien
ctgttccacccacaacaagcaggtg

SEQ ID NO: 120737 - DNA, 25 bp, Homo sapien
cttgacctctcaaggaaaggctcaa

SEQ ID NO: 120738 - DNA, 25 bp, Homo sapien
gggaaagtctgccttgacctctcaa

SEQ ID NO: 120739 - DNA, 25 bp, Homo sapien
atctgtgatgggaaagtctgccttg

SEQ ID NO: 120740 - DNA, 25 bp, Homo sapien
atggggaacaggctcacatctgtga

SEQ ID NO: 120741 - DNA, 25 bp, Homo sapien
tgtccctgagtctcctggacagcgg

SEQ ID NO: 120742 - DNA, 25 bp, Homo sapien
aggctcaatttttaggggaatgatt

SEQ ID NO: 120743 - DNA, 25 bp, Homo sapien
ctcacggcgcctacctgggaccgac

SEQ ID NO: 120744 - DNA, 25 bp, Homo sapien
tacctgggaccgaccctgactgtga

SEQ ID NO: 120745 - DNA, 25 bp, Homo sapien
cctgactgtgaggaggagactcacg

SEQ ID NO: 120746 - DNA, 25 bp, Homo sapien
accctgactgtgaggaggagactca

SEQ ID NO: 120747 - DNA, 25 bp, Homo sapien
ctacctgggaccgaccctgactgtg

SEQ ID NO: 120748 - DNA, 25 bp, Homo sapien
gctcacggcgcctacctgggaccga

SEQ ID NO: 120749 - DNA, 25 bp, Homo sapien
ggctcacggcgcctacctgggaccg

SEQ ID NO: 120750 - DNA, 25 bp, Homo sapien
accgaccctgactgtgaggaggaga

SEQ ID NO: 120751 - DNA, 25 bp, Homo sapien
tcactgaattaggaggcacacgatg

SEQ ID NO: 120752 - DNA, 25 bp, Homo sapien
tagctggcgtgtgctcactgaatta

SEQ ID NO: 120753 - DNA, 25 bp, Homo sapien
gaggcacacgatgtcgtcgttctta

SEQ ID NO: 120754 - DNA, 25 bp, Homo sapien
ctggcgtgtgctcactgaattagga

SEQ ID NO: 120755 - DNA, 25 bp, Homo sapien
acacgatgtcgtcgttcttagctgg

SEQ ID NO: 120756 - DNA, 25 bp, Homo sapien
cttagctggcgtgtgctcactgaat

SEQ ID NO: 120757 - DNA, 25 bp, Homo sapien
actgaattaggaggcacacgatgtc

SEQ ID NO: 120758 - DNA, 25 bp, Homo sapien
gtcgttcttagctggcgtgtgctca

SEQ ID NO: 120759 - DNA, 25 bp, Homo sapien
cacgatgccatttgagacggaaagg

SEQ ID NO: 120760 - DNA, 25 bp, Homo sapien
tgcctcaggtcatctgtcacgatgc

SEQ ID NO: 120761 - DNA, 25 bp, Homo sapien
ctgtcacgatgccatttgagacgga

SEQ ID NO: 120762 - DNA, 25 bp, Homo sapien
tcacgatgccatttgagacggaaag

SEQ ID NO: 120763 - DNA, 25 bp, Homo sapien
ccatttgagacggaaagggcactgg

SEQ ID NO: 120764 - DNA, 25 bp, Homo sapien
atctgtcacgatgccatttgagacg

SEQ ID NO: 120765 - DNA, 25 bp, Homo sapien
tcatctgtcacgatgccgtttgaga

SEQ ID NO: 120766 - DNA, 25 bp, Homo sapien
gcacgcctcaggtcatctgtcacga

SEQ ID NO: 120767 - DNA, 25 bp, Homo sapien
tgctcatcctcctgtcgctcaaggt

SEQ ID NO: 120768 - DNA, 25 bp, Homo sapien
ggctggacgcctctccacattgctg

SEQ ID NO: 120769 - DNA, 25 bp, Homo sapien
gccaccatccgcgacgtggtcatag

SEQ ID NO: 120770 - DNA, 25 bp, Homo sapien
ccgcgacgtggtcatagtctgtgtc

SEQ ID NO: 120771 - DNA, 25 bp, Homo sapien
cgtggtcatagtctgtgtcctgctc

SEQ ID NO: 120772 - DNA, 25 bp, Homo sapien
gctcaaggtcattgtctgtggaccc

SEQ ID NO: 120773 - DNA, 25 bp, Homo sapien
tcctgtcgctcaaggtcattgtctg

SEQ ID NO: 120774 - DNA, 25 bp, Homo sapien
ccctccgtgtcactgtctctggctt

SEQ ID NO: 120775 - DNA, 25 bp, Homo sapien
tcagtccggcggtcaggtccaccgt

SEQ ID NO: 120776 - DNA, 25 bp, Homo sapien
aacgcctcagtccagcggtcaggtc

SEQ ID NO: 120777 - DNA, 25 bp, Homo sapien
cagcggtcaggtccactgtccatgc

SEQ ID NO: 120778 - DNA, 25 bp, Homo sapien
aatgcctcagtccagcggtcaggtc

SEQ ID NO: 120779 - DNA, 25 bp, Homo sapien
ggtcaggtccactgtccatgcctca

SEQ ID NO: 120780 - DNA, 25 bp, Homo sapien
gtccggcggtcaggtccaccgtcaa

SEQ ID NO: 120781 - DNA, 25 bp, Homo sapien
tcaacgcctcagtccagcggtcagg

SEQ ID NO: 120782 - DNA, 25 bp, Homo sapien
tcaatgcctcagtccagcggtcagg

SEQ ID NO: 120783 - DNA, 25 bp, Homo sapien
cggtggacgtgtctcccgcactccc

SEQ ID NO: 120784 - DNA, 25 bp, Homo sapien
cacacctgagcacgtccgcctcttc

SEQ ID NO: 120785 - DNA, 25 bp, Homo sapien
cacttccttcctgggggacacgcat

SEQ ID NO: 120786 - DNA, 25 bp, Homo sapien
ggacacgcctgagcatgtccacttc

SEQ ID NO: 120787 - DNA, 25 bp, Homo sapien
ctccgtgggacacacctgggcgtat

SEQ ID NO: 120788 - DNA, 25 bp, Homo sapien
aagggcacacctgagcgtgcgcacc

SEQ ID NO: 120789 - DNA, 25 bp, Homo sapien
ctcctctggaaagggcacacctgag

SEQ ID NO: 120790 - DNA, 25 bp, Homo sapien
tcctctctgggggacgtacctgagc

SEQ ID NO: 120791 - DNA, 25 bp, Homo sapien
ggagtctgctctgctgtccgccaat

SEQ ID NO: 120792 - DNA, 25 bp, Homo sapien
ggtgctctcggcaccaactgcagtg

SEQ ID NO: 120793 - DNA, 25 bp, Homo sapien
gcacagacgcggcaatggccacttc

SEQ ID NO: 120794 - DNA, 25 bp, Homo sapien
tatcccggatgaagcgaagagagcc

SEQ ID NO: 120795 - DNA, 25 bp, Homo sapien
ggctccacgtcttttctcctgcggg

SEQ ID NO: 120796 - DNA, 25 bp, Homo sapien
agccgtgtagacatatcagtattta

SEQ ID NO: 120797 - DNA, 25 bp, Homo sapien
ccgccaatttgagaagccgtgtaga

SEQ ID NO: 120798 - DNA, 25 bp, Homo sapien
aagagcaaatgcgaggatggtcccg

SEQ ID NO: 120799 - DNA, 25 bp, Homo sapien
agcgcgagcacagacgtcccggcag

SEQ ID NO: 120800 - DNA, 25 bp, Homo sapien
agagcagcctgagcgcgagcacaga

SEQ ID NO: 120801 - DNA, 25 bp, Homo sapien
cacagcagcatgtgcgctgcccaga

SEQ ID NO: 120802 - DNA, 25 bp, Homo sapien
ctcaccctggaagacggagctcgca

SEQ ID NO: 120803 - DNA, 25 bp, Homo sapien
caccctggaagacggagctcgcaca

SEQ ID NO: 120804 - DNA, 25 bp, Homo sapien
agcctgagcgcgagcacagacgtcc

SEQ ID NO: 120805 - DNA, 25 bp, Homo sapien
cctggaagacggagctcgcacagca

SEQ ID NO: 120806 - DNA, 25 bp, Homo sapien
gaagacggagctcgcacagcagcat

SEQ ID NO: 120807 - DNA, 25 bp, Homo sapien
agggcctgcttggagcagctcccgt

SEQ ID NO: 120808 - DNA, 25 bp, Homo sapien
ggccctgggttcaagaaggcagaca

SEQ ID NO: 120809 - DNA, 25 bp, Homo sapien
tatggctcggctcacacgcagggcc

SEQ ID NO: 120810 - DNA, 25 bp, Homo sapien
ccaggaggacgaccgcacgtcagca

SEQ ID NO: 120811 - DNA, 25 bp, Homo sapien
tcagactcgcgcactggtctcgggt

SEQ ID NO: 120812 - DNA, 25 bp, Homo sapien
tcggagccaaggagccctgaactca

SEQ ID NO: 120813 - DNA, 25 bp, Homo sapien
ctggcgaaaggtgactcggagccaa

SEQ ID NO: 120814 - DNA, 25 bp, Homo sapien
gcaggagcagctatggctcggctca

SEQ ID NO: 120815 - DNA, 25 bp, Homo sapien
acagagggcagctgatcaggacccg

SEQ ID NO: 120816 - DNA, 25 bp, Homo sapien
ccatctcggcgctgtggctgtgcac

SEQ ID NO: 120817 - DNA, 25 bp, Homo sapien
atgaggtaatgatggagacggctca

SEQ ID NO: 120818 - DNA, 25 bp, Homo sapien
aggatggcccgcataccgtcccgct

SEQ ID NO: 120819 - DNA, 25 bp, Homo sapien
gggtcagctcgctgtcgtaggaccc

SEQ ID NO: 120820 - DNA, 25 bp, Homo sapien
tactcggccggggtcagctcgctgt

SEQ ID NO: 120821 - DNA, 25 bp, Homo sapien
accgtcccgctcctgtggacacaga

SEQ ID NO: 120822 - DNA, 25 bp, Homo sapien
tgcaccttctgcaccatatcctcag

SEQ ID NO: 120823 - DNA, 25 bp, Homo sapien
tcacgaggcccgagattgctatcca

SEQ ID NO: 120824 - DNA, 25 bp, Homo sapien
aggcccgagattgctatccacagcc

SEQ ID NO: 120825 - DNA, 25 bp, Homo sapien
cattcccatcaaggcgtgcacccgg

SEQ ID NO: 120826 - DNA, 25 bp, Homo sapien
acggcagctgtgagaccgagccgca

SEQ ID NO: 120827 - DNA, 25 bp, Homo sapien
tcccagcagccttcagaggacggaa

SEQ ID NO: 120828 - DNA, 25 bp, Homo sapien
agccttcagaggacggaacgccatg

SEQ ID NO: 120829 - DNA, 25 bp, Homo sapien
acggaacgccatgggcacacggcag

SEQ ID NO: 120830 - DNA, 25 bp, Homo sapien
aaggaggaactcacgaggcccgaga

SEQ ID NO: 120831 - DNA, 25 bp, Homo sapien
gacacgcatcagtggggccccatgg

SEQ ID NO: 120832 - DNA, 25 bp, Homo sapien
ggcgggagacgtcgactgacacttt

SEQ ID NO: 120833 - DNA, 25 bp, Homo sapien
cgggagacgtcgactgacactttgg

SEQ ID NO: 120834 - DNA, 25 bp, Homo sapien
ggagacgtcgactgacactttggtg

SEQ ID NO: 120835 - DNA, 25 bp, Homo sapien
gacgtcgactgacactttggtggtg

SEQ ID NO: 120836 - DNA, 25 bp, Homo sapien
cgtcgactgacactttggtggtggt

SEQ ID NO: 120837 - DNA, 25 bp, Homo sapien
tgaatgacacgcatcagtggggccc

SEQ ID NO: 120838 - DNA, 25 bp, Homo sapien
gtggtggtgaatgacacgcatcagt

SEQ ID NO: 120839 - DNA, 25 bp, Homo sapien
gggcaccagaccacacgttcacggg

SEQ ID NO: 120840 - DNA, 25 bp, Homo sapien
gttcacggggcacctcacccagcgt

SEQ ID NO: 120841 - DNA, 25 bp, Homo sapien
ggcaccagaccacacgttcacgggg

SEQ ID NO: 120842 - DNA, 25 bp, Homo sapien
gggcaccagaccacacgttcacagg

SEQ ID NO: 120843 - DNA, 25 bp, Homo sapien
cgggcaccagaccacacgttcacgg

SEQ ID NO: 120844 - DNA, 25 bp, Homo sapien
tcacccagcgtctgcgggcaccaga

SEQ ID NO: 120845 - DNA, 25 bp, Homo sapien
gtctgcgggcaccagaccacacgtt

SEQ ID NO: 120846 - DNA, 25 bp, Homo sapien
tgcggacaccagaccacacgttcac

SEQ ID NO: 120847 - DNA, 25 bp, Homo sapien
agagggggtcgcctccagtcccacg

SEQ ID NO: 120848 - DNA, 25 bp, Homo sapien
cccgtggacacaagacaggggtgtc

SEQ ID NO: 120849 - DNA, 25 bp, Homo sapien
ccgtggacccgtggacacaagacag

SEQ ID NO: 120850 - DNA, 25 bp, Homo sapien
gcttgccgtggacccgtggacacaa

SEQ ID NO: 120851 - DNA, 25 bp, Homo sapien
agctgaaaaggagccgtgtactgcc

SEQ ID NO: 120852 - DNA, 25 bp, Homo sapien
cccagctgaaaaggagccgtgtact

SEQ ID NO: 120853 - DNA, 25 bp, Homo sapien
cacgaagaagatggcgctggagaca

SEQ ID NO: 120854 - DNA, 25 bp, Homo sapien
aagaagatggcgctggagacacctg

SEQ ID NO: 120855 - DNA, 25 bp, Homo sapien
cgagatacgccgatcccgagatacg

SEQ ID NO: 120856 - DNA, 25 bp, Homo sapien
agatacgccgatgccgagatacgcc

SEQ ID NO: 120857 - DNA, 25 bp, Homo sapien
gagatacgccgatgccgagatacgc

SEQ ID NO: 120858 - DNA, 25 bp, Homo sapien
acgccgatgccgagatacaccgatg

SEQ ID NO: 120859 - DNA, 25 bp, Homo sapien
gagatacgccgatcccgagatacgc

SEQ ID NO: 120860 - DNA, 25 bp, Homo sapien
tacgccgatgccgagatacgccgat

SEQ ID NO: 120861 - DNA, 25 bp, Homo sapien
ccgagatacgccgatgccgagatac

SEQ ID NO: 120862 - DNA, 25 bp, Homo sapien
cgccgatgccgagatacaccgatgc

SEQ ID NO: 120863 - DNA, 25 bp, Homo sapien
gctaatgctgtgcttcacctggaca

SEQ ID NO: 120864 - DNA, 25 bp, Homo sapien
tgccgagaccgagataacgctaatg

SEQ ID NO: 120865 - DNA, 25 bp, Homo sapien
ccgatgccgagataacgctgatgtc

SEQ ID NO: 120866 - DNA, 25 bp, Homo sapien
ccgatgctgagataacgccgatgcc

SEQ ID NO: 120867 - DNA, 25 bp, Homo sapien
tgctgatgccaagatacaccgatgc

SEQ ID NO: 120868 - DNA, 25 bp, Homo sapien
ccgatgctgagatacgccaatgcca

SEQ ID NO: 120869 - DNA, 25 bp, Homo sapien
ctgatgccgagatacgccgaagcca

SEQ ID NO: 120870 - DNA, 25 bp, Homo sapien
cgctgatgccaagatacgctgatgc

SEQ ID NO: 120871 - DNA, 25 bp, Homo sapien
actctgaaagaacacagtgtcgccc

SEQ ID NO: 120872 - DNA, 25 bp, Homo sapien
gctttgtgatgacctgccttctctc

SEQ ID NO: 120873 - DNA, 25 bp, Homo sapien
cagggtcgggctgcacttgcctgaa

SEQ ID NO: 120874 - DNA, 25 bp, Homo sapien
ggtgtcccgccactctgaaagaaca

SEQ ID NO: 120875 - DNA, 25 bp, Homo sapien
atcaccgagctaaggtgtcccgcca

SEQ ID NO: 120876 - DNA, 25 bp, Homo sapien
gcacccaaagatcaccgagctaagg

SEQ ID NO: 120877 - DNA, 25 bp, Homo sapien
cgggaccacagcacgtcatcacgca

SEQ ID NO: 120878 - DNA, 25 bp, Homo sapien
tgcagcagcgctttgtgatgacctg

SEQ ID NO: 120879 - DNA, 25 bp, Homo sapien
acggttacgacatggtgagctcacg

SEQ ID NO: 120880 - DNA, 25 bp, Homo sapien
tgagcccgagacagagttacgactt

SEQ ID NO: 120881 - DNA, 25 bp, Homo sapien
cgagacggttatgacacagtgagct

SEQ ID NO: 120882 - DNA, 25 bp, Homo sapien
catggtcagcccgagacagttatgg

SEQ ID NO: 120883 - DNA, 25 bp, Homo sapien
ggttacgacatagtgagcccacagc

SEQ ID NO: 120884 - DNA, 25 bp, Homo sapien
cggtcagcctgagacggttacaaca

SEQ ID NO: 120885 - DNA, 25 bp, Homo sapien
gttacgacacgatgagcccgcagca

SEQ ID NO: 120886 - DNA, 25 bp, Homo sapien
cagtgagcctgagatggttacgaca

SEQ ID NO: 120887 - DNA, 25 bp, Homo sapien
gacatgaggccacgttcacaccacg

SEQ ID NO: 120888 - DNA, 25 bp, Homo sapien
aagccggggcccaccactggcacac

SEQ ID NO: 120889 - DNA, 25 bp, Homo sapien
accactggcacactgcggaagcact

SEQ ID NO: 120890 - DNA, 25 bp, Homo sapien
caggaggacatgaggccacgttcac

SEQ ID NO: 120891 - DNA, 25 bp, Homo sapien
aattcccgcatgttccggggtcaga

SEQ ID NO: 120892 - DNA, 25 bp, Homo sapien
ggcgctggctcaggacccttcccag

SEQ ID NO: 120893 - DNA, 25 bp, Homo sapien
agcaattcccgcatgttccggggtc

SEQ ID NO: 120894 - DNA, 25 bp, Homo sapien
tgcggaagcactcccgcaggaggac

SEQ ID NO: 120895 - DNA, 25 bp, Homo sapien
cagcgttcactaccagggaaagatg

SEQ ID NO: 120896 - DNA, 25 bp, Homo sapien
ctgcagaggagaacatacgtggtca

SEQ ID NO: 120897 - DNA, 25 bp, Homo sapien
atgacccagccgtcacttcagaagc

SEQ ID NO: 120898 - DNA, 25 bp, Homo sapien
cctgaggcacaagcattccgagatg

SEQ ID NO: 120899 - DNA, 25 bp, Homo sapien
atggacacggccaacatacttggta

SEQ ID NO: 120900 - DNA, 25 bp, Homo sapien
aacagggtaccacctcgatgaggga

SEQ ID NO: 120901 - DNA, 25 bp, Homo sapien
agtggagccgcaccctgagaagctc

SEQ ID NO: 120902 - DNA, 25 bp, Homo sapien
tcctcagatggcgagaacagcgttc

SEQ ID NO: 120903 - DNA, 25 bp, Homo sapien
catggtttcacggtgcgtggcgtca

SEQ ID NO: 120904 - DNA, 25 bp, Homo sapien
gtgctcggctctaaccaggacagtg

SEQ ID NO: 120905 - DNA, 25 bp, Homo sapien
ttcacggtgcgtggcgtcatgacgt

SEQ ID NO: 120906 - DNA, 25 bp, Homo sapien
ctctaaccaggacagtgggcgcatg

SEQ ID NO: 120907 - DNA, 25 bp, Homo sapien
aaccaggacagtgggcgcatggttt

SEQ ID NO: 120908 - DNA, 25 bp, Homo sapien
gagggcagtggatgcatggtttcac

SEQ ID NO: 120909 - DNA, 25 bp, Homo sapien
caggacacgaggatgtgctcggctc

SEQ ID NO: 120910 - DNA, 25 bp, Homo sapien
acgaggatgtgctcggctctaacca

SEQ ID NO: 120911 - DNA, 25 bp, Homo sapien
tctaggagccgtattcgggaccgcc

SEQ ID NO: 120912 - DNA, 25 bp, Homo sapien
cgtggactctctaggagccgtattc

SEQ ID NO: 120913 - DNA, 25 bp, Homo sapien
gcattcccgtggactctctaggagc

SEQ ID NO: 120914 - DNA, 25 bp, Homo sapien
ctaggagccgtattcgggaccgcca

SEQ ID NO: 120915 - DNA, 25 bp, Homo sapien
gtggactctctaggagccgtattcg

SEQ ID NO: 120916 - DNA, 25 bp, Homo sapien
ccgcattcccgtggactctctagga

SEQ ID NO: 120917 - DNA, 25 bp, Homo sapien
attcccgtggactctctaggagccg

SEQ ID NO: 120918 - DNA, 25 bp, Homo sapien
tggactctctaggagccgtattcgg

SEQ ID NO: 120919 - DNA, 25 bp, Homo sapien
gctctcgcgagacctgcgtggcaat

SEQ ID NO: 120920 - DNA, 25 bp, Homo sapien
cgcgagccaccaggatgccaagagc

SEQ ID NO: 120921 - DNA, 25 bp, Homo sapien
ggcgcccatttatcgcgacacttgc

SEQ ID NO: 120922 - DNA, 25 bp, Homo sapien
gcctcgcgccgtaatgtgtggaata

SEQ ID NO: 120923 - DNA, 25 bp, Homo sapien
aggacgcgcttccactaaggctttc

SEQ ID NO: 120924 - DNA, 25 bp, Homo sapien
tcgggccgtaaagaaccgagtctgc

SEQ ID NO: 120925 - DNA, 25 bp, Homo sapien
gactcggaaccgaaggctgagccaa

SEQ ID NO: 120926 - DNA, 25 bp, Homo sapien
gactccgcacggaaaggactcggaa

SEQ ID NO: 120927 - DNA, 25 bp, Homo sapien
agtcgctgtcttcccctcgcttaag

SEQ ID NO: 120928 - DNA, 25 bp, Homo sapien
cgggagctcgaaggagaccagaaga

SEQ ID NO: 120929 - DNA, 25 bp, Homo sapien
actaggggagctgagccatgggctt

SEQ ID NO: 120930 - DNA, 25 bp, Homo sapien
cggtgcaggtacgaaaagcgcgcgc

SEQ ID NO: 120931 - DNA, 25 bp, Homo sapien
cggggaactgcgacccggaatcctg

SEQ ID NO: 120932 - DNA, 25 bp, Homo sapien
agctacccggcccagaagcgaaatc

SEQ ID NO: 120933 - DNA, 25 bp, Homo sapien
gggcaatggagctacccggcccaga

SEQ ID NO: 120934 - DNA, 25 bp, Homo sapien
ggcccactcgacagcccaggaagcg

SEQ ID NO: 120935 - DNA, 25 bp, Homo sapien
agccagagctttcccgacctcggcg

SEQ ID NO: 120936 - DNA, 25 bp, Homo sapien
agataccggagatgatcgtggctgc

SEQ ID NO: 120937 - DNA, 25 bp, Homo sapien
agcccatcttcagccagagctttcc

SEQ ID NO: 120938 - DNA, 25 bp, Homo sapien
cccagataccggagatgatcgtggc

SEQ ID NO: 120939 - DNA, 25 bp, Homo sapien
tcaggaccgaggacacggcatcagc

SEQ ID NO: 120940 - DNA, 25 bp, Homo sapien
ctcccacgccgtggcatccggcagc

SEQ ID NO: 120941 - DNA, 25 bp, Homo sapien
tccgagctctcccacgccgtggcat

SEQ ID NO: 120942 - DNA, 25 bp, Homo sapien
cacgccacggcatccggcagagggg

SEQ ID NO: 120943 - DNA, 25 bp, Homo sapien
tctggatcaagagtcacgtccgcgg

SEQ ID NO: 120944 - DNA, 25 bp, Homo sapien
cgggactgcttgtcctcgtcagcca

SEQ ID NO: 120945 - DNA, 25 bp, Homo sapien
aaccgggcccgacgctcgaagtgca

SEQ ID NO: 120946 - DNA, 25 bp, Homo sapien
cagggacagctcgaaggcatcatca

SEQ ID NO: 120947 - DNA, 25 bp, Homo sapien
gcatcatcaatgctgaactggggcc

SEQ ID NO: 120948 - DNA, 25 bp, Homo sapien
gtccgccctaagcaggccagagttg

SEQ ID NO: 120949 - DNA, 25 bp, Homo sapien
tcagtggccgccatggcaagcgaca

SEQ ID NO: 120950 - DNA, 25 bp, Homo sapien
ctggggcctctaggcagatgcttcc

SEQ ID NO: 120951 - DNA, 25 bp, Homo sapien
agtggacgatggatcacctgcctgc

SEQ ID NO: 120952 - DNA, 25 bp, Homo sapien
acggccgtgagctgcccgtaggtac

SEQ ID NO: 120953 - DNA, 25 bp, Homo sapien
aagggaagcaccctccgtgagagga

SEQ ID NO: 120954 - DNA, 25 bp, Homo sapien
accctccgtgagaggagtgaacgcc

SEQ ID NO: 120955 - DNA, 25 bp, Homo sapien
ctcgcagtggacgatggatcacctg

SEQ ID NO: 120956 - DNA, 25 bp, Homo sapien
agcccggcgggcctcttccagcacc

SEQ ID NO: 120957 - DNA, 25 bp, Homo sapien
agccaccgagtcagcacagcccacg

SEQ ID NO: 120958 - DNA, 25 bp, Homo sapien
agaggccagtgagcatctgcggagc

SEQ ID NO: 120959 - DNA, 25 bp, Homo sapien
gctgcggagcaaacagccgcctttc

SEQ ID NO: 120960 - DNA, 25 bp, Homo sapien
ggactcacctccttgtgcccttgga

SEQ ID NO: 120961 - DNA, 25 bp, Homo sapien
gtagttccgcagctccatcgtctga

SEQ ID NO: 120962 - DNA, 25 bp, Homo sapien
ctgaatcgcgttctcctgctgcgga

SEQ ID NO: 120963 - DNA, 25 bp, Homo sapien
gtggcgctcatcatctgcctcttca

SEQ ID NO: 120964 - DNA, 25 bp, Homo sapien
gtgcttgtgcaacacgcccttctca

SEQ ID NO: 120965 - DNA, 25 bp, Homo sapien
gagcaccgtgttccaaggcccatgc

SEQ ID NO: 120966 - DNA, 25 bp, Homo sapien
ctaaagaacctctctagggcggccg

SEQ ID NO: 120967 - DNA, 25 bp, Homo sapien
gtcgacgctggactcactcacacta

SEQ ID NO: 120968 - DNA, 25 bp, Homo sapien
cgacgccggactcacactacggagt

SEQ ID NO: 120969 - DNA, 25 bp, Homo sapien
ctcacactacggagtcgacgccgga

SEQ ID NO: 120970 - DNA, 25 bp, Homo sapien
gtcgacgccggactcacactacgga

SEQ ID NO: 120971 - DNA, 25 bp, Homo sapien
cactacggagtcgacgccggactca

SEQ ID NO: 120972 - DNA, 25 bp, Homo sapien
tacggagtcgaagccggactcactc

SEQ ID NO: 120973 - DNA, 25 bp, Homo sapien
ctcacactacggagtcgacgctgga

SEQ ID NO: 120974 - DNA, 25 bp, Homo sapien
ctcacactacggagtcgaagccgga

SEQ ID NO: 120975 - DNA, 25 bp, Homo sapien
actgtccccgaggacgcctctgaga

SEQ ID NO: 120976 - DNA, 25 bp, Homo sapien
gcggccagtcatgtgagcccgcgct

SEQ ID NO: 120977 - DNA, 25 bp, Homo sapien
catcgcgcggccagtcatgtgagcc

SEQ ID NO: 120978 - DNA, 25 bp, Homo sapien
aaagcgcctcggaacgcggccagct

SEQ ID NO: 120979 - DNA, 25 bp, Homo sapien
gcaggaaacgagtcggggaccaagc

SEQ ID NO: 120980 - DNA, 25 bp, Homo sapien
aacgcggccagctgtaacctggaca

SEQ ID NO: 120981 - DNA, 25 bp, Homo sapien
cgcgagagagcacggggacccccaa

SEQ ID NO: 120982 - DNA, 25 bp, Homo sapien
tgtaacctggacagggctctcccgg

SEQ ID NO: 120983 - DNA, 25 bp, Homo sapien
ggacgccatgttggacggaaccatc

SEQ ID NO: 120984 - DNA, 25 bp, Homo sapien
ggacattttcctagcattccgggta

SEQ ID NO: 120985 - DNA, 25 bp, Homo sapien
gagtctccactcttccagggtatta

SEQ ID NO: 120986 - DNA, 25 bp, Homo sapien
ggtggtcaatgctcccatgagttta

SEQ ID NO: 120987 - DNA, 25 bp, Homo sapien
gacgccctgagcaatcgcctgttga

SEQ ID NO: 120988 - DNA, 25 bp, Homo sapien
tttccctagcgaaaggctcagacgc

SEQ ID NO: 120989 - DNA, 25 bp, Homo sapien
cttttgctcagtcagtaggcgagtc

SEQ ID NO: 120990 - DNA, 25 bp, Homo sapien
tctgctgccacacatggggtggtca

SEQ ID NO: 120991 - DNA, 25 bp, Homo sapien
gggccgccatgcctgtctatccagg

SEQ ID NO: 120992 - DNA, 25 bp, Homo sapien
ctgagctacaggactcccgagtgtg

SEQ ID NO: 120993 - DNA, 25 bp, Homo sapien
tgactgcgcctggattctgccattg

SEQ ID NO: 120994 - DNA, 25 bp, Homo sapien
tctgccattgcgacacatttttgtg

SEQ ID NO: 120995 - DNA, 25 bp, Homo sapien
ctccgaagacttagcgacgccactg

SEQ ID NO: 120996 - DNA, 25 bp, Homo sapien
tgcgcccagtgatgtttccacggtg

SEQ ID NO: 120997 - DNA, 25 bp, Homo sapien
cacggtgcctgtacacagccgagca

SEQ ID NO: 120998 - DNA, 25 bp, Homo sapien
agccgagcagcatttccgttgaagg

SEQ ID NO: 120999 - DNA, 25 bp, Homo sapien
ggtcgctcagggtatcccttaaatg

SEQ ID NO: 121000 - DNA, 25 bp, Homo sapien
atacggcgccacatggcactggctc

SEQ ID NO: 121001 - DNA, 25 bp, Homo sapien
tctcgcgagaagacgaccggtagga

SEQ ID NO: 121002 - DNA, 25 bp, Homo sapien
ctcctcggggtctggacgagaaatc

SEQ ID NO: 121003 - DNA, 25 bp, Homo sapien
tctgattcagcgacagcagaggctg

SEQ ID NO: 121004 - DNA, 25 bp, Homo sapien
caattcccgggcttggagttccagg

SEQ ID NO: 121005 - DNA, 25 bp, Homo sapien
gcctgctgtcacctgaacggggctc

SEQ ID NO: 121006 - DNA, 25 bp, Homo sapien
cggagtcgatctctggccgtaaata

SEQ ID NO: 121007 - DNA, 25 bp, Homo sapien
ctgctgcagctactccaggtggacc

SEQ ID NO: 121008 - DNA, 25 bp, Homo sapien
cgaggagttctaccgcaagttcgcc

SEQ ID NO: 121009 - DNA, 25 bp, Homo sapien
acaccaagttcctcttcgtgcgcga

SEQ ID NO: 121010 - DNA, 25 bp, Homo sapien
ttcaacaagttctggcgccgctacg

SEQ ID NO: 121011 - DNA, 25 bp, Homo sapien
agcagagcgaccttcccagaaagga

SEQ ID NO: 121012 - DNA, 25 bp, Homo sapien
tggacaagtttctcagtgctggcgt

SEQ ID NO: 121013 - DNA, 25 bp, Homo sapien
gccgactccgatgtcgacgagtttc

SEQ ID NO: 121014 - DNA, 25 bp, Homo sapien
gtgccagatcgactacgacttcgtg

SEQ ID NO: 121015 - DNA, 25 bp, Homo sapien
gctctgctgtgtgtccggggccaaa

SEQ ID NO: 121016 - DNA, 25 bp, Homo sapien
ccacctctgagtagagctgtgggtg

SEQ ID NO: 121017 - DNA, 25 bp, Homo sapien
aacaatgcccacctctgagtagagc

SEQ ID NO: 121018 - DNA, 25 bp, Homo sapien
gccacactctggcggccaaacaatg

SEQ ID NO: 121019 - DNA, 25 bp, Homo sapien
ttgggcgctcgccacactctggcgg

SEQ ID NO: 121020 - DNA, 25 bp, Homo sapien
tgccagccaggctctcgggctcttg

SEQ ID NO: 121021 - DNA, 25 bp, Homo sapien
tccacgccaactgcccatccggggt

SEQ ID NO: 121022 - DNA, 25 bp, Homo sapien
gccaaagacacgcaggggcggtcgt

SEQ ID NO: 121023 - DNA, 25 bp, Homo sapien
acctgcggcacaggtggccaagctc

SEQ ID NO: 121024 - DNA, 25 bp, Homo sapien
gccaggatcgaggaaatcagccagg

SEQ ID NO: 121025 - DNA, 25 bp, Homo sapien
tgctttctcgttagaacctcgtgtc

SEQ ID NO: 121026 - DNA, 25 bp, Homo sapien
gccaagctcttgctctgtacaaata

SEQ ID NO: 121027 - DNA, 25 bp, Homo sapien
cgcacagcgaggaagtaggatgtcc

SEQ ID NO: 121028 - DNA, 25 bp, Homo sapien
aggctgggtttcctcttcagggaca

SEQ ID NO: 121029 - DNA, 25 bp, Homo sapien
tttctcctcgccatggggcgcctga

SEQ ID NO: 121030 - DNA, 25 bp, Homo sapien
gtttgcaaggcctgccgcgtcccaa

SEQ ID NO: 121031 - DNA, 25 bp, Homo sapien
ttggcttctgccctcaaccaaaatg

SEQ ID NO: 121032 - DNA, 25 bp, Homo sapien
cgtttccacgctcagtcccttttgg

SEQ ID NO: 121033 - DNA, 25 bp, Homo sapien
accaaaatggcgctagctcggaagc

SEQ ID NO: 121034 - DNA, 25 bp, Homo sapien
tgccgaagcaagtccggaagctacc

SEQ ID NO: 121035 - DNA, 25 bp, Homo sapien
ctaccgagcgagtccggaagttgcc

SEQ ID NO: 121036 - DNA, 25 bp, Homo sapien
atggcggatatcatcgcaagactcc

SEQ ID NO: 121037 - DNA, 25 bp, Homo sapien
ggacgggatccaaaaacgtgtgata

SEQ ID NO: 121038 - DNA, 25 bp, Homo sapien
cccggactttcaagatgggaccaag

SEQ ID NO: 121039 - DNA, 25 bp, Homo sapien
tgcagaggtggacgatacagtcttt

SEQ ID NO: 121040 - DNA, 25 bp, Homo sapien
tctcgaagtgctcccggaggaactt

SEQ ID NO: 121041 - DNA, 25 bp, Homo sapien
cgcgcttctggaaggacctgcagga

SEQ ID NO: 121042 - DNA, 25 bp, Homo sapien
aggacctgcaggacggcagacagtc

SEQ ID NO: 121043 - DNA, 25 bp, Homo sapien
gtctttgaggacctgctggatcccg

SEQ ID NO: 121044 - DNA, 25 bp, Homo sapien
tccagcttctcgaagtgctcccgga

SEQ ID NO: 121045 - DNA, 25 bp, Homo sapien
gacgatacagtctttgaggacctgc

SEQ ID NO: 121046 - DNA, 25 bp, Homo sapien
ctgcaggacggcagacagtctctgg

SEQ ID NO: 121047 - DNA, 25 bp, Homo sapien
tgctgtgtcaataagggtgtgtgcc

SEQ ID NO: 121048 - DNA, 25 bp, Homo sapien
cccaggacaaagctggcggacaatg

SEQ ID NO: 121049 - DNA, 25 bp, Homo sapien
ggccactctgcttaactcggccgag

SEQ ID NO: 121050 - DNA, 25 bp, Homo sapien
gcggacaatgcctggtgattcatcc

SEQ ID NO: 121051 - DNA, 25 bp, Homo sapien
cccggttaaccaggccagctgtatg

SEQ ID NO: 121052 - DNA, 25 bp, Homo sapien
caggccctttgtccgccagggcttg

SEQ ID NO: 121053 - DNA, 25 bp, Homo sapien
ccagcagcctccaagtggcaggctg

SEQ ID NO: 121054 - DNA, 25 bp, Homo sapien
cccgagtgattgagacttggcttcc

SEQ ID NO: 121055 - DNA, 25 bp, Homo sapien
gagcggatccggctgcctgatgact

SEQ ID NO: 121056 - DNA, 25 bp, Homo sapien
ggggtcacttcatgaatacggctga

SEQ ID NO: 121057 - DNA, 25 bp, Homo sapien
tgaatacggctgagcggatccggct

SEQ ID NO: 121058 - DNA, 25 bp, Homo sapien
ggctgcctgatgactgcaccatcgg

SEQ ID NO: 121059 - DNA, 25 bp, Homo sapien
tgactgcaccatcggctacatcgtg

SEQ ID NO: 121060 - DNA, 25 bp, Homo sapien
tgggtgtgcccctcatccgcagcgg

SEQ ID NO: 121061 - DNA, 25 bp, Homo sapien
agctccacgagcaggtgcaccatcc

SEQ ID NO: 121062 - DNA, 25 bp, Homo sapien
cacttcatgaatacggctgagcgga

SEQ ID NO: 121063 - DNA, 25 bp, Homo sapien
agagctgctgttggccgcctctgcc

SEQ ID NO: 121064 - DNA, 25 bp, Homo sapien
acgcggccatcacactcggagcaca

SEQ ID NO: 121065 - DNA, 25 bp, Homo sapien
tctgcctgccagcgtttgccaagcg

SEQ ID NO: 121066 - DNA, 25 bp, Homo sapien
ctcgctcacgccgtcccgcgacgtt

SEQ ID NO: 121067 - DNA, 25 bp, Homo sapien
tgttggcacacgcacaggcgcgcac

SEQ ID NO: 121068 - DNA, 25 bp, Homo sapien
tggctgcactgttggcacacgcaca

SEQ ID NO: 121069 - DNA, 25 bp, Homo sapien
ccgatgtggctgcactgttggcaca

SEQ ID NO: 121070 - DNA, 25 bp, Homo sapien
agcacacgcgctccgatgtggctgc

SEQ ID NO: 121071 - DNA, 25 bp, Homo sapien
cagtggccacgaactgctccgtgtc

SEQ ID NO: 121072 - DNA, 25 bp, Homo sapien
ccacagggcggtcgcagtcaaacaa

SEQ ID NO: 121073 - DNA, 25 bp, Homo sapien
ggcacaaaaggcgaagtcaaagagc

SEQ ID NO: 121074 - DNA, 25 bp, Homo sapien
ccacctcgggtagggccacggcata

SEQ ID NO: 121075 - DNA, 25 bp, Homo sapien
cagccactcagtgaagacttgcatg

SEQ ID NO: 121076 - DNA, 25 bp, Homo sapien
gaagacttgcatgaccgcccgccgt

SEQ ID NO: 121077 - DNA, 25 bp, Homo sapien
ccgtgggaagccctccgagtctacg

SEQ ID NO: 121078 - DNA, 25 bp, Homo sapien
ggcagagagccctcagtgcctcggt

SEQ ID NO: 121079 - DNA, 25 bp, Homo sapien
cagagaagcaggtccacgaacgagt

SEQ ID NO: 121080 - DNA, 25 bp, Homo sapien
caggacgtgcaccaggagctgactg

SEQ ID NO: 121081 - DNA, 25 bp, Homo sapien
tcggctccacctcgcatggacaaag

SEQ ID NO: 121082 - DNA, 25 bp, Homo sapien
tccatgatcttctgggcacacgcgg

SEQ ID NO: 121083 - DNA, 25 bp, Homo sapien
cggagcacaaggactcttcaacgtg

SEQ ID NO: 121084 - DNA, 25 bp, Homo sapien
ccgaaggtcgtggtcaggacgttca

SEQ ID NO: 121085 - DNA, 25 bp, Homo sapien
ggccctgaccgagccacacagagaa

SEQ ID NO: 121086 - DNA, 25 bp, Homo sapien
gacgttcagggcctgagtgaccttg

SEQ ID NO: 121087 - DNA, 25 bp, Homo sapien
gcctagtggttcatgccgagcatcc

SEQ ID NO: 121088 - DNA, 25 bp, Homo sapien
accaggtgtgcatccgtgcgtccag

SEQ ID NO: 121089 - DNA, 25 bp, Homo sapien
cggctctgtctaaccggggcaccgt

SEQ ID NO: 121090 - DNA, 25 bp, Homo sapien
caccgtctgccaatgcccgggaagg

SEQ ID NO: 121091 - DNA, 25 bp, Homo sapien
ggcccagacttgaaggaaggagttc

SEQ ID NO: 121092 - DNA, 25 bp, Homo sapien
cgagaaaactatgtgccggagagaa

SEQ ID NO: 121093 - DNA, 25 bp, Homo sapien
tgccggagagaagcgtcctgatccg

SEQ ID NO: 121094 - DNA, 25 bp, Homo sapien
tttgaagtcagttttggccgcgagc

SEQ ID NO: 121095 - DNA, 25 bp, Homo sapien
cgggtgacagctgccattattgtta

SEQ ID NO: 121096 - DNA, 25 bp, Homo sapien
gatctaaggcgggatccacggatcc

SEQ ID NO: 121097 - DNA, 25 bp, Homo sapien
cacggtgtaagtgcctccgggcacc

SEQ ID NO: 121098 - DNA, 25 bp, Homo sapien
tgacggagctcacggtgtaagtgcc

SEQ ID NO: 121099 - DNA, 25 bp, Homo sapien
cgcaggtcgcttacccggctgggta

SEQ ID NO: 121100 - DNA, 25 bp, Homo sapien
gctgccattattgttaccgcacaag

SEQ ID NO: 121101 - DNA, 25 bp, Homo sapien
ggacgcccgagccagcaaccctgag

SEQ ID NO: 121102 - DNA, 25 bp, Homo sapien
ttaccgcacaagagcgcgctgcagg

SEQ ID NO: 121103 - DNA, 25 bp, Homo sapien
acacgggtgcgaggtccgtgccaat

SEQ ID NO: 121104 - DNA, 25 bp, Homo sapien
ggacagaagtctccgtcgaaggcca

SEQ ID NO: 121105 - DNA, 25 bp, Homo sapien
tgtggccatcacaccgcatgggacg

SEQ ID NO: 121106 - DNA, 25 bp, Homo sapien
ccgcatgggacgcaagaaacgcatc

SEQ ID NO: 121107 - DNA, 25 bp, Homo sapien
caagaaacgcatctgggagcagttc

SEQ ID NO: 121108 - DNA, 25 bp, Homo sapien
catctgggagcagttcagctggagc

SEQ ID NO: 121109 - DNA, 25 bp, Homo sapien
cacaggcagtgccacggtctaggcg

SEQ ID NO: 121110 - DNA, 25 bp, Homo sapien
aagtctccgtcgaaggccagtgtgt

SEQ ID NO: 121111 - DNA, 25 bp, Homo sapien
acacagacatggcacgagaggctgc

SEQ ID NO: 121112 - DNA, 25 bp, Homo sapien
acatggcacgagaggctgcccaccg

SEQ ID NO: 121113 - DNA, 25 bp, Homo sapien
ccacgggcagccctgtgcaggagga

SEQ ID NO: 121114 - DNA, 25 bp, Homo sapien
gacgtgggacacagacatggcacga

SEQ ID NO: 121115 - DNA, 25 bp, Homo sapien
caggcacaggtgagtcagggtcacg

SEQ ID NO: 121116 - DNA, 25 bp, Homo sapien
ccgctctgcgggcacacctggcccg

SEQ ID NO: 121117 - DNA, 25 bp, Homo sapien
gtcatcatccagtccgctctgcggg

SEQ ID NO: 121118 - DNA, 25 bp, Homo sapien
aggaggccatcgtcatcatccagtc

SEQ ID NO: 121119 - DNA, 25 bp, Homo sapien
ggtagacaccaatgcccagcgcgcg

SEQ ID NO: 121120 - DNA, 25 bp, Homo sapien
ggagccgtcgatgctgaagaccaca

SEQ ID NO: 121121 - DNA, 25 bp, Homo sapien
tgggtcctgaccttctctccagtga

SEQ ID NO: 121122 - DNA, 25 bp, Homo sapien
cttcggtgccaaagtggatccactt

SEQ ID NO: 121123 - DNA, 25 bp, Homo sapien
acctgaccaccatgcgcacggggta

SEQ ID NO: 121124 - DNA, 25 bp, Homo sapien
cagcattcggcataggtgtggtcgc

SEQ ID NO: 121125 - DNA, 25 bp, Homo sapien
ggcccgtacatgaagcgcccgctta

SEQ ID NO: 121126 - DNA, 25 bp, Homo sapien
cagcggctgcgtcatgatgtagaca

SEQ ID NO: 121127 - DNA, 25 bp, Homo sapien
gaggccactagcagccagttccggc

SEQ ID NO: 121128 - DNA, 25 bp, Homo sapien
accgactaccagcaggtgacatggg

SEQ ID NO: 121129 - DNA, 25 bp, Homo sapien
accaatagaggttcaggagcgagtg

SEQ ID NO: 121130 - DNA, 25 bp, Homo sapien
ccaggcgtccctccaagaaggcgag

SEQ ID NO: 121131 - DNA, 25 bp, Homo sapien
ttctgccggcggactaatgacggta

SEQ ID NO: 121132 - DNA, 25 bp, Homo sapien
tcttccagcgccttaggggccaggc

SEQ ID NO: 121133 - DNA, 25 bp, Homo sapien
tggaggggcaaaaccatcaggtaaa

SEQ ID NO: 121134 - DNA, 25 bp, Homo sapien
tcttacagcgctgagggtcggtctt

SEQ ID NO: 121135 - DNA, 25 bp, Homo sapien
gccgcccccggagtgcccagaccgc

SEQ ID NO: 121136 - DNA, 25 bp, Homo sapien
ggccgaacccttccaaatgtccgca

SEQ ID NO: 121137 - DNA, 25 bp, Homo sapien
gaacccttccaaatgtccgcatccc

SEQ ID NO: 121138 - DNA, 25 bp, Homo sapien
caggttcaggccatcgctgccagga

SEQ ID NO: 121139 - DNA, 25 bp, Homo sapien
tcagactctgagtcgcccactccag

SEQ ID NO: 121140 - DNA, 25 bp, Homo sapien
gccgcctctgatggcctgggcaccc

SEQ ID NO: 121141 - DNA, 25 bp, Homo sapien
gcaggttcaggccatcgctgccagg

SEQ ID NO: 121142 - DNA, 25 bp, Homo sapien
cccgcgtacctggatgcgcggcgcc

SEQ ID NO: 121143 - DNA, 25 bp, Homo sapien
gcggagcaggtggatctctacgact

SEQ ID NO: 121144 - DNA, 25 bp, Homo sapien
gcatcgcagtgggattctacggcaa

SEQ ID NO: 121145 - DNA, 25 bp, Homo sapien
attctacggcaacggggagaccagt

SEQ ID NO: 121146 - DNA, 25 bp, Homo sapien
gaccagtgatggcatccatagggcc

SEQ ID NO: 121147 - DNA, 25 bp, Homo sapien
atggcatccatagggccacctactc

SEQ ID NO: 121148 - DNA, 25 bp, Homo sapien
ggggccaggagcactcttgctgctc

SEQ ID NO: 121149 - DNA, 25 bp, Homo sapien
ccctgcgagccgtacagaggctgca

SEQ ID NO: 121150 - DNA, 25 bp, Homo sapien
tctacgactggtacaggtgcggcca

SEQ ID NO: 121151 - DNA, 25 bp, Homo sapien
agctacggcagtgagaccagcatcc

SEQ ID NO: 121152 - DNA, 25 bp, Homo sapien
cggcaggcgcacgacagcctctacc

SEQ ID NO: 121153 - DNA, 25 bp, Homo sapien
cagcggacacgtcagctgcggctga

SEQ ID NO: 121154 - DNA, 25 bp, Homo sapien
cccagcctgtacagctgtggcagca

SEQ ID NO: 121155 - DNA, 25 bp, Homo sapien
gtacatgtgagttgacgtgggccta

SEQ ID NO: 121156 - DNA, 25 bp, Homo sapien
cccggtcactgagtacatgtgagtt

SEQ ID NO: 121157 - DNA, 25 bp, Homo sapien
ggcagtgagaccagcatcccggccg

SEQ ID NO: 121158 - DNA, 25 bp, Homo sapien
acatgcccagcctgtacagctgtgg

SEQ ID NO: 121159 - DNA, 25 bp, Homo sapien
ccctgcacgccacccactatcccgg

SEQ ID NO: 121160 - DNA, 25 bp, Homo sapien
ctggccgcacccaacctgtgttgtt

SEQ ID NO: 121161 - DNA, 25 bp, Homo sapien
tctgcagatggtcgccgcacctaca

SEQ ID NO: 121162 - DNA, 25 bp, Homo sapien
acccaccggaccctcgcacgccgtg

SEQ ID NO: 121163 - DNA, 25 bp, Homo sapien
cgtgccagcactgccgcttccacct

SEQ ID NO: 121164 - DNA, 25 bp, Homo sapien
gactccagcggcagccactagaccg

SEQ ID NO: 121165 - DNA, 25 bp, Homo sapien
gccgcacctacaagccctggccgca

SEQ ID NO: 121166 - DNA, 25 bp, Homo sapien
gtaccgccaactcgggtcacacctg

SEQ ID NO: 121167 - DNA, 25 bp, Homo sapien
gcagaggcggccaacagcagctctc

SEQ ID NO: 121168 - DNA, 25 bp, Homo sapien
aacagtgcagccacatcggagcgcg

SEQ ID NO: 121169 - DNA, 25 bp, Homo sapien
gtgccaacagtgcagccacatcgga

SEQ ID NO: 121170 - DNA, 25 bp, Homo sapien
tgcgtgtgccaacagtgcagccaca

SEQ ID NO: 121171 - DNA, 25 bp, Homo sapien
gtgcgcgcctgtgcgtgtgccaaca

SEQ ID NO: 121172 - DNA, 25 bp, Homo sapien
agcagctctcccgatcgagctccgg

SEQ ID NO: 121173 - DNA, 25 bp, Homo sapien
cgcttggcaaacgctggcaggcaga

SEQ ID NO: 121174 - DNA, 25 bp, Homo sapien
cagccacatcggagcgcgtgtgctc

SEQ ID NO: 121175 - DNA, 25 bp, Homo sapien
tgcgcgcttcccgatgggagcaaac

SEQ ID NO: 121176 - DNA, 25 bp, Homo sapien
ccgcggagacgcgaagggcgcactt

SEQ ID NO: 121177 - DNA, 25 bp, Homo sapien
gcgacctgcgcgcttcccgatggga

SEQ ID NO: 121178 - DNA, 25 bp, Homo sapien
gcgcttcccgatgggagcaaactgg

SEQ ID NO: 121179 - DNA, 25 bp, Homo sapien
ctccagggcgccgagaatctcgtcg

SEQ ID NO: 121180 - DNA, 25 bp, Homo sapien
cgagaatctcgtcgtgcccagggct

SEQ ID NO: 121181 - DNA, 25 bp, Homo sapien
gcgcgccgacgtcaccgggacctcc

SEQ ID NO: 121182 - DNA, 25 bp, Homo sapien
ccggcccgcgcaccaagtcccgagg

SEQ ID NO: 121183 - DNA, 25 bp, Homo sapien
tggctcggaagcacatctacctaca

SEQ ID NO: 121184 - DNA, 25 bp, Homo sapien
tgctcatccgcacgggcttcgactg

SEQ ID NO: 121185 - DNA, 25 bp, Homo sapien
gccgaggcctacaacccgcagagga

SEQ ID NO: 121186 - DNA, 25 bp, Homo sapien
agcagctgtatgtgtccgccttctc

SEQ ID NO: 121187 - DNA, 25 bp, Homo sapien
ttgaaggacgctctggtctccactg

SEQ ID NO: 121188 - DNA, 25 bp, Homo sapien
ccgagggaagattctggacgagacc

SEQ ID NO: 121189 - DNA, 25 bp, Homo sapien
caccatgctgcagtgtagacccgca

SEQ ID NO: 121190 - DNA, 25 bp, Homo sapien
tagacccgcacaggagttcagcttc

SEQ ID NO: 121191 - DNA, 25 bp, Homo sapien
tgtctgcgagtgattcccggggaga

SEQ ID NO: 121192 - DNA, 25 bp, Homo sapien
tgacggtgctgctctcccaccagac

SEQ ID NO: 121193 - DNA, 25 bp, Homo sapien
aggagccggtgggaagctccctgct

SEQ ID NO: 121194 - DNA, 25 bp, Homo sapien
tgggcctgcgcgtcaagtgcctgcc

SEQ ID NO: 121195 - DNA, 25 bp, Homo sapien
cgtcaagtgcctgccgtcggtggca

SEQ ID NO: 121196 - DNA, 25 bp, Homo sapien
caagtgcctgccgtcggtggcagcc

SEQ ID NO: 121197 - DNA, 25 bp, Homo sapien
tggcagccgcgtccatccgctgctc

SEQ ID NO: 121198 - DNA, 25 bp, Homo sapien
acaggtgagtgaggacggcagccgc

SEQ ID NO: 121199 - DNA, 25 bp, Homo sapien
aatgaatggggacgtgttttgttca

SEQ ID NO: 121200 - DNA, 25 bp, Homo sapien
tctttctcgagtccaagaccatctc

SEQ ID NO: 121201 - DNA, 25 bp, Homo sapien
tcaccgcgctttgtgagtctgtctc

SEQ ID NO: 121202 - DNA, 25 bp, Homo sapien
cctccttcagtggtctgtgaccagc

SEQ ID NO: 121203 - DNA, 25 bp, Homo sapien
tggtctgtgaccagcgggaatgaat

SEQ ID NO: 121204 - DNA, 25 bp, Homo sapien
tgttcagccctgactcttggacgct

SEQ ID NO: 121205 - DNA, 25 bp, Homo sapien
ggggtccagtctgaagccgacgccc

SEQ ID NO: 121206 - DNA, 25 bp, Homo sapien
cactcacctggcacgtggacgaagg

SEQ ID NO: 121207 - DNA, 25 bp, Homo sapien
gcctaggcagccactccgtcctctt

SEQ ID NO: 121208 - DNA, 25 bp, Homo sapien
tcacctctagcttgaggcgggcgcc

SEQ ID NO: 121209 - DNA, 25 bp, Homo sapien
agagtggctccacttggtatcccac

SEQ ID NO: 121210 - DNA, 25 bp, Homo sapien
gacgtccacctagagctttgttccc

SEQ ID NO: 121211 - DNA, 25 bp, Homo sapien
tctcggacgtccacctagagctttg

SEQ ID NO: 121212 - DNA, 25 bp, Homo sapien
cgggaaacggcatccctctgggcgc

SEQ ID NO: 121213 - DNA, 25 bp, Homo sapien
tgagcgctgacctcttttccgcgca

SEQ ID NO: 121214 - DNA, 25 bp, Homo sapien
acttggtatcccacgggccatggcc

SEQ ID NO: 121215 - DNA, 25 bp, Homo sapien
gcccagctctgcagtagggaaggca

SEQ ID NO: 121216 - DNA, 25 bp, Homo sapien
caagcccccgtgatgtgggaagcca

SEQ ID NO: 121217 - DNA, 25 bp, Homo sapien
gactgacctctcgtgcctgctctct

SEQ ID NO: 121218 - DNA, 25 bp, Homo sapien
ccaagggcccggcacgactgacctc

SEQ ID NO: 121219 - DNA, 25 bp, Homo sapien
agtgccagggtgaacgtaccccaag

SEQ ID NO: 121220 - DNA, 25 bp, Homo sapien
cagctctgcagtagggaaggcatcg

SEQ ID NO: 121221 - DNA, 25 bp, Homo sapien
gagcacgtgcacctcgtgaccaccg

SEQ ID NO: 121222 - DNA, 25 bp, Homo sapien
aaggcatcgggagtgccagggtgaa

SEQ ID NO: 121223 - DNA, 25 bp, Homo sapien
gtgctactgtggtcgccaacagccc

SEQ ID NO: 121224 - DNA, 25 bp, Homo sapien
cacacccagtcagcgcggctccgaa

SEQ ID NO: 121225 - DNA, 25 bp, Homo sapien
ctgctcgtggagccattggtgctgc

SEQ ID NO: 121226 - DNA, 25 bp, Homo sapien
ccagacactcccgtggggcccgtgc

SEQ ID NO: 121227 - DNA, 25 bp, Homo sapien
tcctgctcctcagaaagagcccttg

SEQ ID NO: 121228 - DNA, 25 bp, Homo sapien
agagcccttgtgtgctactgtggtc

SEQ ID NO: 121229 - DNA, 25 bp, Homo sapien
ttgtgtgctactgtggtcgccaaca

SEQ ID NO: 121230 - DNA, 25 bp, Homo sapien
actggcccaggactcagcgtgccgt

SEQ ID NO: 121231 - DNA, 25 bp, Homo sapien
ggctatcgggaagctccgcccagac

SEQ ID NO: 121232 - DNA, 25 bp, Homo sapien
cggcttgtccgccaggtggcaccga

SEQ ID NO: 121233 - DNA, 25 bp, Homo sapien
aatgtgccatgtggagaggccaagc

SEQ ID NO: 121234 - DNA, 25 bp, Homo sapien
cactgccaggggcaaatgtgccatg

SEQ ID NO: 121235 - DNA, 25 bp, Homo sapien
cttgtttttccatcggtattctttg

SEQ ID NO: 121236 - DNA, 25 bp, Homo sapien
agctcgttagcttgtttttccatcg

SEQ ID NO: 121237 - DNA, 25 bp, Homo sapien
tcttccctaggaggagctcgttagc

SEQ ID NO: 121238 - DNA, 25 bp, Homo sapien
cgggcctcttccctaggaggagctc

SEQ ID NO: 121239 - DNA, 25 bp, Homo sapien
ttgcctacacgaatccttatccctt

SEQ ID NO: 121240 - DNA, 25 bp, Homo sapien
ctcaacgacgaggtgcctgaggtca

SEQ ID NO: 121241 - DNA, 25 bp, Homo sapien
gtgtctgcgtgaccgttactccttc

SEQ ID NO: 121242 - DNA, 25 bp, Homo sapien
actcagagccgcaccgtggcgtcag

SEQ ID NO: 121243 - DNA, 25 bp, Homo sapien
cgtccgtatggcagcactcagagcc

SEQ ID NO: 121244 - DNA, 25 bp, Homo sapien
tctgcctcaggcagcgtccgtatgg

SEQ ID NO: 121245 - DNA, 25 bp, Homo sapien
ggccacgcgcctctgtcttggggat

SEQ ID NO: 121246 - DNA, 25 bp, Homo sapien
ctctgctgctcagtagcctcaacga

SEQ ID NO: 121247 - DNA, 25 bp, Homo sapien
cgatcgtccgccatggccaattata

SEQ ID NO: 121248 - DNA, 25 bp, Homo sapien
cgcgcgtcaccttgaggatgttgtc

SEQ ID NO: 121249 - DNA, 25 bp, Homo sapien
tggacatcagacgtgcccaacgggc

SEQ ID NO: 121250 - DNA, 25 bp, Homo sapien
tcgaagatggtgtcgcggaactcca

SEQ ID NO: 121251 - DNA, 25 bp, Homo sapien
gcgcatctgcttgaggaacgtggac

SEQ ID NO: 121252 - DNA, 25 bp, Homo sapien
ccgtgagagcccttcgattggctca

SEQ ID NO: 121253 - DNA, 25 bp, Homo sapien
attggctcatctcgccaagggaggc

SEQ ID NO: 121254 - DNA, 25 bp, Homo sapien
gcttctcattggacgcccaggctga

SEQ ID NO: 121255 - DNA, 25 bp, Homo sapien
tccaccgtggcgtacaggcacggca

SEQ ID NO: 121256 - DNA, 25 bp, Homo sapien
cgcgccacagagtctctctgcccag

SEQ ID NO: 121257 - DNA, 25 bp, Homo sapien
tggtcctcgtccacccagatggtct

SEQ ID NO: 121258 - DNA, 25 bp, Homo sapien
tccacccagatggtcttgcgctgct

SEQ ID NO: 121259 - DNA, 25 bp, Homo sapien
tcctcgccgatcttgtccttgacaa

SEQ ID NO: 121260 - DNA, 25 bp, Homo sapien
tgtccttgacaacgcggagcagctc

SEQ ID NO: 121261 - DNA, 25 bp, Homo sapien
tcaggttccaccgtggcgtacaggc

SEQ ID NO: 121262 - DNA, 25 bp, Homo sapien
acatgtcaggttccaccgtggcgta

SEQ ID NO: 121263 - DNA, 25 bp, Homo sapien
gtcctccttgtagcgtctgacgatg

SEQ ID NO: 121264 - DNA, 25 bp, Homo sapien
ctcgcacatctgctcacagggagga

SEQ ID NO: 121265 - DNA, 25 bp, Homo sapien
agccgccgagcttgaagcacatctg

SEQ ID NO: 121266 - DNA, 25 bp, Homo sapien
cgagccggctatcagcggcgacctt

SEQ ID NO: 121267 - DNA, 25 bp, Homo sapien
ttcaatgcaaaatcgtgcccgcctc

SEQ ID NO: 121268 - DNA, 25 bp, Homo sapien
acacacgcagggactcaattcaatg

SEQ ID NO: 121269 - DNA, 25 bp, Homo sapien
attgacatgatgctgctgcggctcc

SEQ ID NO: 121270 - DNA, 25 bp, Homo sapien
cacgttacgggtgcataaatattac

SEQ ID NO: 121271 - DNA, 25 bp, Homo sapien
ctttgaaaacaagcgagggcctggg

SEQ ID NO: 121272 - DNA, 25 bp, Homo sapien
tgcgcgtgtttgcaattacggtaac

SEQ ID NO: 121273 - DNA, 25 bp, Homo sapien
tgtttgcaattacggtaacttggcg

SEQ ID NO: 121274 - DNA, 25 bp, Homo sapien
agcactgagctagctggtggtagcc

SEQ ID NO: 121275 - DNA, 25 bp, Homo sapien
ccacgggagcgcgtgccgaatcgac

SEQ ID NO: 121276 - DNA, 25 bp, Homo sapien
ccgcggccggcacaaaattgcaggc

SEQ ID NO: 121277 - DNA, 25 bp, Homo sapien
cgggcgccgcgactttgaaaacaag

SEQ ID NO: 121278 - DNA, 25 bp, Homo sapien
ggcgggcgcactttcttctcagcgc

SEQ ID NO: 121279 - DNA, 25 bp, Homo sapien
cccttcccattgcatggatgaaaaa

SEQ ID NO: 121280 - DNA, 25 bp, Homo sapien
cccgtctgctactttgcgttttatt

SEQ ID NO: 121281 - DNA, 25 bp, Homo sapien
ccgcagtagcacaaacaaaaatttt

SEQ ID NO: 121282 - DNA, 25 bp, Homo sapien
tctgtacctgagtcttcgcaccgca

SEQ ID NO: 121283 - DNA, 25 bp, Homo sapien
ttaagttgaggacccatttctcagc

SEQ ID NO: 121284 - DNA, 25 bp, Homo sapien
ccattgcatggatgaaaaaggggct

SEQ ID NO: 121285 - DNA, 25 bp, Homo sapien
gctccttaaaaggatgcccgagtcc

SEQ ID NO: 121286 - DNA, 25 bp, Homo sapien
tttttataccgcagtagcacaaaca

SEQ ID NO: 121287 - DNA, 25 bp, Homo sapien
tcagacctccagtcctcagcagtgg

SEQ ID NO: 121288 - DNA, 25 bp, Homo sapien
tggatggaatacgagctgcagatgc

SEQ ID NO: 121289 - DNA, 25 bp, Homo sapien
gcagtggcccaagtcgtcagtgacc

SEQ ID NO: 121290 - DNA, 25 bp, Homo sapien
tcagtgaccggctggagagagaatt

SEQ ID NO: 121291 - DNA, 25 bp, Homo sapien
tccgtgggctacaggattaagtact

SEQ ID NO: 121292 - DNA, 25 bp, Homo sapien
gagagaattcaccatcgaggagctg

SEQ ID NO: 121293 - DNA, 25 bp, Homo sapien
gcagatgcaggccttcaacgccgtc

SEQ ID NO: 121294 - DNA, 25 bp, Homo sapien
gccggattctcagtacaacgggaac

SEQ ID NO: 121295 - DNA, 25 bp, Homo sapien
cccgttacatttcacgcgtcacgaa

SEQ ID NO: 121296 - DNA, 25 bp, Homo sapien
gcgaggcctagaccgccgtgaagac

SEQ ID NO: 121297 - DNA, 25 bp, Homo sapien
ctggcgaggcctagaccgccgtgaa

SEQ ID NO: 121298 - DNA, 25 bp, Homo sapien
cgaagccgagcaagaccagcccggg

SEQ ID NO: 121299 - DNA, 25 bp, Homo sapien
cgtcacgaagccgagcaagaccagc

SEQ ID NO: 121300 - DNA, 25 bp, Homo sapien
tcacgcgtcacgaagccgagcaaga

SEQ ID NO: 121301 - DNA, 25 bp, Homo sapien
ggaggccgctctgcaccggccgaaa

SEQ ID NO: 121302 - DNA, 25 bp, Homo sapien
ctcgccggctggccgcgtagtgtaa

SEQ ID NO: 121303 - DNA, 25 bp, Homo sapien
aggatgcttcattccatgctgatca

SEQ ID NO: 121304 - DNA, 25 bp, Homo sapien
ggcaggcccagtattgcagaactca

SEQ ID NO: 121305 - DNA, 25 bp, Homo sapien
ggagctggatcctcacctgtaggga

SEQ ID NO: 121306 - DNA, 25 bp, Homo sapien
ctcactcccgattggtgcgcgaaga

SEQ ID NO: 121307 - DNA, 25 bp, Homo sapien
tgcgcgaagatgtcactcgagcctc

SEQ ID NO: 121308 - DNA, 25 bp, Homo sapien
gagcctccttattggccgagacctg

SEQ ID NO: 121309 - DNA, 25 bp, Homo sapien
cggcgcgctctcaatccgattagtc

SEQ ID NO: 121310 - DNA, 25 bp, Homo sapien
ccgtgcgcttttacgtcacctttca

SEQ ID NO: 121311 - DNA, 25 bp, Homo sapien
tgcgagggaaccacacgcagtcggc

SEQ ID NO: 121312 - DNA, 25 bp, Homo sapien
tgtgtcgataccacagatcctgttc

SEQ ID NO: 121313 - DNA, 25 bp, Homo sapien
ccaggagccacatcgtgcgagggaa

SEQ ID NO: 121314 - DNA, 25 bp, Homo sapien
gcctgcgcaagttcgtgctctacga

SEQ ID NO: 121315 - DNA, 25 bp, Homo sapien
cgtgctctacgagctccaggtgctg

SEQ ID NO: 121316 - DNA, 25 bp, Homo sapien
tcctggagcgcaccaaagacgatgg

SEQ ID NO: 121317 - DNA, 25 bp, Homo sapien
gcctcctgataaccctcgtgctgtg

SEQ ID NO: 121318 - DNA, 25 bp, Homo sapien
ctgttccgggccaaagacctggatc

SEQ ID NO: 121319 - DNA, 25 bp, Homo sapien
gaggccgcgtagacctctcctgagt

SEQ ID NO: 121320 - DNA, 25 bp, Homo sapien
gccgcgtagacctctcctgagtgag

SEQ ID NO: 121321 - DNA, 25 bp, Homo sapien
gccgtgtagacctctcctgagtgag

SEQ ID NO: 121322 - DNA, 25 bp, Homo sapien
ccgcgtagacctctcctgagtgagg

SEQ ID NO: 121323 - DNA, 25 bp, Homo sapien
aggccgcgtagacctctcctgagtg

SEQ ID NO: 121324 - DNA, 25 bp, Homo sapien
ggccgtgtagacctctcctgagtga

SEQ ID NO: 121325 - DNA, 25 bp, Homo sapien
aaggaaggccgcgtggacctctcct

SEQ ID NO: 121326 - DNA, 25 bp, Homo sapien
taaggaaggccgtgtagacctctcc

SEQ ID NO: 121327 - DNA, 25 bp, Homo sapien
atgcacgcttgctgacgtgcccggc

SEQ ID NO: 121328 - DNA, 25 bp, Homo sapien
cggctcttgcatgcacgcttgctga

SEQ ID NO: 121329 - DNA, 25 bp, Homo sapien
ctggacgacgttttgttattattat

SEQ ID NO: 121330 - DNA, 25 bp, Homo sapien
tgcggaaacgcctccatcctggagg

SEQ ID NO: 121331 - DNA, 25 bp, Homo sapien
gggcacagcctgttcccgtcggaac

SEQ ID NO: 121332 - DNA, 25 bp, Homo sapien
aaccgcccgcagttggatacgtggc

SEQ ID NO: 121333 - DNA, 25 bp, Homo sapien
aagttgaccaactccatctaggttc

SEQ ID NO: 121334 - DNA, 25 bp, Homo sapien
tgcggcctggacgacgttttgttat

SEQ ID NO: 121335 - DNA, 25 bp, Homo sapien
cgcagggtccgttttctaaacattg

SEQ ID NO: 121336 - DNA, 25 bp, Homo sapien
tgcgcgttcttcaatgctccaaagg

SEQ ID NO: 121337 - DNA, 25 bp, Homo sapien
gcgttgcacattgcgcgtgcgcaca

SEQ ID NO: 121338 - DNA, 25 bp, Homo sapien
cgtgaatccgccgatccgggctttg

SEQ ID NO: 121339 - DNA, 25 bp, Homo sapien
agcagcgtggcgcaaccttaaggcg

SEQ ID NO: 121340 - DNA, 25 bp, Homo sapien
cgcagacttgcggaaggctccgttc

SEQ ID NO: 121341 - DNA, 25 bp, Homo sapien
aaacattgggtgtcctcgaacctgg

SEQ ID NO: 121342 - DNA, 25 bp, Homo sapien
gccgggagctctgtttataaacaca

SEQ ID NO: 121343 - DNA, 25 bp, Homo sapien
tgcccaggctctgtgtcgtcccttt

SEQ ID NO: 121344 - DNA, 25 bp, Homo sapien
gtccagcgtctgtgtcatccctttc

SEQ ID NO: 121345 - DNA, 25 bp, Homo sapien
tccttaccgtcctgccctgtccagc

SEQ ID NO: 121346 - DNA, 25 bp, Homo sapien
ctgccctgtccagcgtctgtgtcat

SEQ ID NO: 121347 - DNA, 25 bp, Homo sapien
tgtccagcgtctgtgtcatcccttt

SEQ ID NO: 121348 - DNA, 25 bp, Homo sapien
ccagcgtctgtgtcatccctttccc

SEQ ID NO: 121349 - DNA, 25 bp, Homo sapien
caggctctgtgtcgtcccttttccc

SEQ ID NO: 121350 - DNA, 25 bp, Homo sapien
ctgtccagcgtctgtgtcatccctt

SEQ ID NO: 121351 - DNA, 25 bp, Homo sapien
gcgtcttcgtggacggggccttcca

SEQ ID NO: 121352 - DNA, 25 bp, Homo sapien
gtggacttgagcatgggcctgtcca

SEQ ID NO: 121353 - DNA, 25 bp, Homo sapien
ttgagcatgggcctgtccagcttca

SEQ ID NO: 121354 - DNA, 25 bp, Homo sapien
cagcttccaggagccgcacttctac

SEQ ID NO: 121355 - DNA, 25 bp, Homo sapien
ctgcctcggcaagaacggcgtcttc

SEQ ID NO: 121356 - DNA, 25 bp, Homo sapien
acgacctcgatctctgaggcccggg

SEQ ID NO: 121357 - DNA, 25 bp, Homo sapien
ccgcgcgaacatggccgaagtcggc

SEQ ID NO: 121358 - DNA, 25 bp, Homo sapien
ttcctcatgcgccagcccagcgtca

SEQ ID NO: 121359 - DNA, 25 bp, Homo sapien
gcgtccatcagcatcacagccggga

SEQ ID NO: 121360 - DNA, 25 bp, Homo sapien
cctgtcgttatgagaaggtttcaga

SEQ ID NO: 121361 - DNA, 25 bp, Homo sapien
tccatggctgcaggcctgtcgttat

SEQ ID NO: 121362 - DNA, 25 bp, Homo sapien
ccctggaaaccagtaaatgcgtctc

SEQ ID NO: 121363 - DNA, 25 bp, Homo sapien
gccacgcagccattgtaaccctgga

SEQ ID NO: 121364 - DNA, 25 bp, Homo sapien
tggttccgtcatctcatcccgtgtg

SEQ ID NO: 121365 - DNA, 25 bp, Homo sapien
tcacagccgggaagttggcatcggt

SEQ ID NO: 121366 - DNA, 25 bp, Homo sapien
aaggtttcagaagcgggctcgtccg

SEQ ID NO: 121367 - DNA, 25 bp, Homo sapien
ggggccagatgtccgctttctcttt

SEQ ID NO: 121368 - DNA, 25 bp, Homo sapien
ctgctgttgcccaaagtgaaaccgg

SEQ ID NO: 121369 - DNA, 25 bp, Homo sapien
atcggagctgcctcttgagaatagc

SEQ ID NO: 121370 - DNA, 25 bp, Homo sapien
accgggcttagttgttgtctcagga

SEQ ID NO: 121371 - DNA, 25 bp, Homo sapien
gacgccatcggctccgggaaatgca

SEQ ID NO: 121372 - DNA, 25 bp, Homo sapien
aggcgcgcgttctctctctgaattt

SEQ ID NO: 121373 - DNA, 25 bp, Homo sapien
gctgtgctctctcgcagttcctgca

SEQ ID NO: 121374 - DNA, 25 bp, Homo sapien
tttcatttcactgcgagttggggtc

SEQ ID NO: 121375 - DNA, 25 bp, Homo sapien
gcggtgcctgccttcctaatttggt

SEQ ID NO: 121376 - DNA, 25 bp, Homo sapien
tgcctgccttcctaatttggtgtgc

SEQ ID NO: 121377 - DNA, 25 bp, Homo sapien
tcctaatttggtgtgcattcgcctc

SEQ ID NO: 121378 - DNA, 25 bp, Homo sapien
atttggtgtgcattcgcctcgccag

SEQ ID NO: 121379 - DNA, 25 bp, Homo sapien
cattcgcctcgccagtcctcattgg

SEQ ID NO: 121380 - DNA, 25 bp, Homo sapien
tcctcattggccgtggagtggctgg

SEQ ID NO: 121381 - DNA, 25 bp, Homo sapien
cattcccaggagtcgggagtggctt

SEQ ID NO: 121382 - DNA, 25 bp, Homo sapien
ccctcattcccaggagtcgggagtg

SEQ ID NO: 121383 - DNA, 25 bp, Homo sapien
tgttacgcacgaggacagccctttc

SEQ ID NO: 121384 - DNA, 25 bp, Homo sapien
tggagtaggcctgttgcatggcttc

SEQ ID NO: 121385 - DNA, 25 bp, Homo sapien
ctcaggtcagcctcgggtgacaagc

SEQ ID NO: 121386 - DNA, 25 bp, Homo sapien
catggcttctgtgcgggcatgttac

SEQ ID NO: 121387 - DNA, 25 bp, Homo sapien
ggacagccctttccgggttccatga

SEQ ID NO: 121388 - DNA, 25 bp, Homo sapien
ccgggttccatgagcctcaggggaa

SEQ ID NO: 121389 - DNA, 25 bp, Homo sapien
aggcgcctgcagacacggagctgac

SEQ ID NO: 121390 - DNA, 25 bp, Homo sapien
tttcctgtaatctcggagggtccta

SEQ ID NO: 121391 - DNA, 25 bp, Homo sapien
actgacagtcattcacacgcgcagc

SEQ ID NO: 121392 - DNA, 25 bp, Homo sapien
taccttcgaagtcgaccagaccgtc

SEQ ID NO: 121393 - DNA, 25 bp, Homo sapien
cccattggtgtcgaactgtggcggc

SEQ ID NO: 121394 - DNA, 25 bp, Homo sapien
tgtggcgtctggtcactgacagtca

SEQ ID NO: 121395 - DNA, 25 bp, Homo sapien
gaaggcgtcccgtagctcccggaca

SEQ ID NO: 121396 - DNA, 25 bp, Homo sapien
ccattgaggtccacgtcctggagga

SEQ ID NO: 121397 - DNA, 25 bp, Homo sapien
acgtcctggaggatctcgtccacct

SEQ ID NO: 121398 - DNA, 25 bp, Homo sapien
agctcccggacaccgatcatgtctg

SEQ ID NO: 121399 - DNA, 25 bp, Homo sapien
cagacacgtctggaggagacagccc

SEQ ID NO: 121400 - DNA, 25 bp, Homo sapien
ccagttaccgctttgtgcagaacgt

SEQ ID NO: 121401 - DNA, 25 bp, Homo sapien
tgcagctggcagcagagtttgcagc

SEQ ID NO: 121402 - DNA, 25 bp, Homo sapien
cggacctgcagctggcagcagagtt

SEQ ID NO: 121403 - DNA, 25 bp, Homo sapien
agtttgcagcaaaggccgcgtcgga

SEQ ID NO: 121404 - DNA, 25 bp, Homo sapien
tttgtgcagaacgtgacctcggacc

SEQ ID NO: 121405 - DNA, 25 bp, Homo sapien
ccgctttgtgcagaacgtgacctcg

SEQ ID NO: 121406 - DNA, 25 bp, Homo sapien
agaacgtgacctcggacctgcagct

SEQ ID NO: 121407 - DNA, 25 bp, Homo sapien
accggacggccgacaaaggctggca

SEQ ID NO: 121408 - DNA, 25 bp, Homo sapien
ctgagcgggatctacgcccacatca

SEQ ID NO: 121409 - DNA, 25 bp, Homo sapien
ttctcctacgcgcagctgatcgtgc

SEQ ID NO: 121410 - DNA, 25 bp, Homo sapien
ttctccgcaggatgagtcaaagccg

SEQ ID NO: 121411 - DNA, 25 bp, Homo sapien
atcccgtgagccgtgtttctccgca

SEQ ID NO: 121412 - DNA, 25 bp, Homo sapien
gaccttgctggagctcatcccgtga

SEQ ID NO: 121413 - DNA, 25 bp, Homo sapien
gcacattctcgtgggaaggttcctc

SEQ ID NO: 121414 - DNA, 25 bp, Homo sapien
gtgccggcaagacgcgcacattctc

SEQ ID NO: 121415 - DNA, 25 bp, Homo sapien
tcagcgcccagccagtgatcatggc

SEQ ID NO: 121416 - DNA, 25 bp, Homo sapien
gggcgtttctcaccgtctgaatgcg

SEQ ID NO: 121417 - DNA, 25 bp, Homo sapien
gtgatgtctcggaaacgtcctcgca

SEQ ID NO: 121418 - DNA, 25 bp, Homo sapien
ggtccaagttagcttctgtcccaga

SEQ ID NO: 121419 - DNA, 25 bp, Homo sapien
tcccaaagcgcacccggtaaggagc

SEQ ID NO: 121420 - DNA, 25 bp, Homo sapien
gggtggtcaccacatctgccaactc

SEQ ID NO: 121421 - DNA, 25 bp, Homo sapien
agccttcgcaggaccctttgtggtg

SEQ ID NO: 121422 - DNA, 25 bp, Homo sapien
tgtcccagagtaccggtattcccaa

SEQ ID NO: 121423 - DNA, 25 bp, Homo sapien
gcatgcggttcccacgaacagttta

SEQ ID NO: 121424 - DNA, 25 bp, Homo sapien
acgaacagtttagccggcaacgctt

SEQ ID NO: 121425 - DNA, 25 bp, Homo sapien
ggcctggaggagaaacccaccattg

SEQ ID NO: 121426 - DNA, 25 bp, Homo sapien
gccgtgacccagaacggaaagcatg

SEQ ID NO: 121427 - DNA, 25 bp, Homo sapien
tcatccagacggtggccagccagat

SEQ ID NO: 121428 - DNA, 25 bp, Homo sapien
tgcccaggcgtcgaggaaatcgatt

SEQ ID NO: 121429 - DNA, 25 bp, Homo sapien
aatcgattgtctcgttggccgagtg

SEQ ID NO: 121430 - DNA, 25 bp, Homo sapien
gtgctgacttggttcctgtcccgca

SEQ ID NO: 121431 - DNA, 25 bp, Homo sapien
gcctcttccactggagagcccgagg

SEQ ID NO: 121432 - DNA, 25 bp, Homo sapien
ccaagcgagttcatccgcgccggtg

SEQ ID NO: 121433 - DNA, 25 bp, Homo sapien
ggccgcacccacagacggaggagaa

SEQ ID NO: 121434 - DNA, 25 bp, Homo sapien
accggctggagtgatcgcagctgcc

SEQ ID NO: 121435 - DNA, 25 bp, Homo sapien
aaccacaccggctggagtgatcgca

SEQ ID NO: 121436 - DNA, 25 bp, Homo sapien
tgctgtaaccacaccggctggagtg

SEQ ID NO: 121437 - DNA, 25 bp, Homo sapien
tggagagcccgaggtcaaaaggtcc

SEQ ID NO: 121438 - DNA, 25 bp, Homo sapien
gagtgggactcacccagcggcgacc

SEQ ID NO: 121439 - DNA, 25 bp, Homo sapien
tccctgggtgcatcctcaaaagact

SEQ ID NO: 121440 - DNA, 25 bp, Homo sapien
ttccctgggtgcatcctcaaaagac

SEQ ID NO: 121441 - DNA, 25 bp, Homo sapien
cttcgcgggatacgtcctcaaaaga

SEQ ID NO: 121442 - DNA, 25 bp, Homo sapien
actgcagagtgacgacgaagccttc

SEQ ID NO: 121443 - DNA, 25 bp, Homo sapien
tcgcgggatacgtcctcaaaagacc

SEQ ID NO: 121444 - DNA, 25 bp, Homo sapien
tcgtgggatacgtcctcaaaagacc

SEQ ID NO: 121445 - DNA, 25 bp, Homo sapien
gcttccctgggtgcatcctcaaaag

SEQ ID NO: 121446 - DNA, 25 bp, Homo sapien
ccctgggtgcatcctcaaaagactg

SEQ ID NO: 121447 - DNA, 25 bp, Homo sapien
tgccgctctgtctgataacttcaag

SEQ ID NO: 121448 - DNA, 25 bp, Homo sapien
ctcgaagagtaaacctgccgctctg

SEQ ID NO: 121449 - DNA, 25 bp, Homo sapien
tggctccgatgtcccggtgctgacg

SEQ ID NO: 121450 - DNA, 25 bp, Homo sapien
ctgataacttcaagtaagagcagcg

SEQ ID NO: 121451 - DNA, 25 bp, Homo sapien
ggggccgctgctctgcagaccagac

SEQ ID NO: 121452 - DNA, 25 bp, Homo sapien
cgtctgatgaccggccgtaggtcca

SEQ ID NO: 121453 - DNA, 25 bp, Homo sapien
tgcagaccagaccttcccgaattat

SEQ ID NO: 121454 - DNA, 25 bp, Homo sapien
cccgaattatccgtggctccgatgt

SEQ ID NO: 121455 - DNA, 25 bp, Homo sapien
gcgctcctcacgctggagtaagtta

SEQ ID NO: 121456 - DNA, 25 bp, Homo sapien
cgcctcacgttgcaggacggaatcg

SEQ ID NO: 121457 - DNA, 25 bp, Homo sapien
acatgatcgtcaggctctttgcaaa

SEQ ID NO: 121458 - DNA, 25 bp, Homo sapien
agaacgctggatggaggcctcctcg

SEQ ID NO: 121459 - DNA, 25 bp, Homo sapien
ggtaggtctgctgcaaggagccacc

SEQ ID NO: 121460 - DNA, 25 bp, Homo sapien
gactgcgccacactcctgatgaaaa

SEQ ID NO: 121461 - DNA, 25 bp, Homo sapien
tgaaaacgtgtttacccacagcctc

SEQ ID NO: 121462 - DNA, 25 bp, Homo sapien
ctggagtaagttacgaaacatgatc

SEQ ID NO: 121463 - DNA, 25 bp, Homo sapien
cctgctcatgtgatgcggcacgtga

SEQ ID NO: 121464 - DNA, 25 bp, Homo sapien
tgcatctctccctaggggcacacgg

SEQ ID NO: 121465 - DNA, 25 bp, Homo sapien
gcggagagtttgctccaccaggcca

SEQ ID NO: 121466 - DNA, 25 bp, Homo sapien
gtgacgcagccacgtaaggccgctg

SEQ ID NO: 121467 - DNA, 25 bp, Homo sapien
aaagcccattggtcggcaacctgtc

SEQ ID NO: 121468 - DNA, 25 bp, Homo sapien
caatttccgccgaaatgctttccgg

SEQ ID NO: 121469 - DNA, 25 bp, Homo sapien
gcagctcctggagtttccgaggttc

SEQ ID NO: 121470 - DNA, 25 bp, Homo sapien
gccttgcaggaacccgactggactc

SEQ ID NO: 121471 - DNA, 25 bp, Homo sapien
cgctgcccgggctcatgttcaggca

SEQ ID NO: 121472 - DNA, 25 bp, Homo sapien
gacggggcggtagccacagacttct

SEQ ID NO: 121473 - DNA, 25 bp, Homo sapien
tgtgctaaaggctggcgtttttccc

SEQ ID NO: 121474 - DNA, 25 bp, Homo sapien
ggctcatgttcaggcagcttctcct

SEQ ID NO: 121475 - DNA, 25 bp, Homo sapien
gtgtttttgcatcacacagggcggg

SEQ ID NO: 121476 - DNA, 25 bp, Homo sapien
ggggatggtgtttttgcatcacaca

SEQ ID NO: 121477 - DNA, 25 bp, Homo sapien
cctgctgtcgttccgcggggtccag

SEQ ID NO: 121478 - DNA, 25 bp, Homo sapien
acctcctgaggagcttgtgctaaag

SEQ ID NO: 121479 - DNA, 25 bp, Homo sapien
cccagtgttgtgtgaaatcttcgga

SEQ ID NO: 121480 - DNA, 25 bp, Homo sapien
ttatccctccgtcgtgtggctttta

SEQ ID NO: 121481 - DNA, 25 bp, Homo sapien
tttcccagttcgaggtaggagcatg

SEQ ID NO: 121482 - DNA, 25 bp, Homo sapien
gtgccgccctacaccgtggtctatt

SEQ ID NO: 121483 - DNA, 25 bp, Homo sapien
cgcagtcttcgccaccagtgagtac

SEQ ID NO: 121484 - DNA, 25 bp, Homo sapien
cccttataaggctcggaggccgcga

SEQ ID NO: 121485 - DNA, 25 bp, Homo sapien
cggtcctcttcctgctgtctgttta

SEQ ID NO: 121486 - DNA, 25 bp, Homo sapien
atcgcagcggtcttagggaatttcc

SEQ ID NO: 121487 - DNA, 25 bp, Homo sapien
tgcccttccaagcagggcagcaggc

SEQ ID NO: 121488 - DNA, 25 bp, Homo sapien
cacgtcagcctgctgagagttccca

SEQ ID NO: 121489 - DNA, 25 bp, Homo sapien
gtcctgagacggtgacgcctcacgc

SEQ ID NO: 121490 - DNA, 25 bp, Homo sapien
tggacgtcctgagacggtgacgcct

SEQ ID NO: 121491 - DNA, 25 bp, Homo sapien
cacctcccgcagatgacaggtcaga

SEQ ID NO: 121492 - DNA, 25 bp, Homo sapien
ccgcagatgacaggtcagagcagga

SEQ ID NO: 121493 - DNA, 25 bp, Homo sapien
agggctccactctgtcggtgatctc

SEQ ID NO: 121494 - DNA, 25 bp, Homo sapien
caagcagggcagcaggcatgtccca

SEQ ID NO: 121495 - DNA, 25 bp, Homo sapien
tcctgagccacggtgagcccagggt

SEQ ID NO: 121496 - DNA, 25 bp, Homo sapien
ctggacgtgctgtgccggcaggacc

SEQ ID NO: 121497 - DNA, 25 bp, Homo sapien
ccgtccttcctgtaccgaagtctct

SEQ ID NO: 121498 - DNA, 25 bp, Homo sapien
gtccttcctgtaccgaagtctctcc

SEQ ID NO: 121499 - DNA, 25 bp, Homo sapien
ccttcctgtaccgaagtctctcctg

SEQ ID NO: 121500 - DNA, 25 bp, Homo sapien
cttcctgtaccgaagtctctcctgc

SEQ ID NO: 121501 - DNA, 25 bp, Homo sapien
acccggcctctgtgcgggtgctgct

SEQ ID NO: 121502 - DNA, 25 bp, Homo sapien
cttcctgagccacggtgagcccagg

SEQ ID NO: 121503 - DNA, 25 bp, Homo sapien
gtggcccagtgtgcccaggccgtgc

SEQ ID NO: 121504 - DNA, 25 bp, Homo sapien
gctgctgcagcccatggccggctgt

SEQ ID NO: 121505 - DNA, 25 bp, Homo sapien
gtgtcctcaggttggcgccactcca

SEQ ID NO: 121506 - DNA, 25 bp, Homo sapien
cactgtgtcctcaggttggcgccac

SEQ ID NO: 121507 - DNA, 25 bp, Homo sapien
ccacactgtgtcctcaggttggcgc

SEQ ID NO: 121508 - DNA, 25 bp, Homo sapien
ggcagcactcacggccacactgtgt

SEQ ID NO: 121509 - DNA, 25 bp, Homo sapien
cctgcagtcaccaggtcggggagcg

SEQ ID NO: 121510 - DNA, 25 bp, Homo sapien
gctcagctgtgcgagagggagcagt

SEQ ID NO: 121511 - DNA, 25 bp, Homo sapien
gatcacttcccagtgcggtgcacga

SEQ ID NO: 121512 - DNA, 25 bp, Homo sapien
tcgcgttccgagctccaggacggct

SEQ ID NO: 121513 - DNA, 25 bp, Homo sapien
cttccgtcggcagcactgtgtttgt

SEQ ID NO: 121514 - DNA, 25 bp, Homo sapien
actgtgtttgtgtttccacgtggaa

SEQ ID NO: 121515 - DNA, 25 bp, Homo sapien
gaaacagcagcgcacgtgtacaact

SEQ ID NO: 121516 - DNA, 25 bp, Homo sapien
gtacaactgtgcataccaaggcgtg

SEQ ID NO: 121517 - DNA, 25 bp, Homo sapien
cataccaaggcgtgcgtgccagtgc

SEQ ID NO: 121518 - DNA, 25 bp, Homo sapien
ccagtgcgcgggtctcgggatcact

SEQ ID NO: 121519 - DNA, 25 bp, Homo sapien
gaagtcctgttttcaacgttctaga

SEQ ID NO: 121520 - DNA, 25 bp, Homo sapien
aggaacacgcttgtgtgtccagccc

SEQ ID NO: 121521 - DNA, 25 bp, Homo sapien
ctgacacgcacaagccaacgaattt

SEQ ID NO: 121522 - DNA, 25 bp, Homo sapien
ctgtagacgctctgctcaggatgcg

SEQ ID NO: 121523 - DNA, 25 bp, Homo sapien
agatcctgagtgtcgctgctgcctc

SEQ ID NO: 121524 - DNA, 25 bp, Homo sapien
ctcggcctagtttccctagccagga

SEQ ID NO: 121525 - DNA, 25 bp, Homo sapien
gcaggacaggcgcttcctggcctca

SEQ ID NO: 121526 - DNA, 25 bp, Homo sapien
tgcctcctttccgtgcacacaggaa

SEQ ID NO: 121527 - DNA, 25 bp, Homo sapien
gcaagaggagaacagcaaccagcat

SEQ ID NO: 121528 - DNA, 25 bp, Homo sapien
gaggaccagctctcacggcgctccg

SEQ ID NO: 121529 - DNA, 25 bp, Homo sapien
tcacggcgctccgtctggaatggcg

SEQ ID NO: 121530 - DNA, 25 bp, Homo sapien
tgccgggaggcagatgtacagggac

SEQ ID NO: 121531 - DNA, 25 bp, Homo sapien
agaggagaacagcaaccagcatttc

SEQ ID NO: 121532 - DNA, 25 bp, Homo sapien
aggagaacagcaaccagcatttcca

SEQ ID NO: 121533 - DNA, 25 bp, Homo sapien
acccacgcactgcttgcagggaccc

SEQ ID NO: 121534 - DNA, 25 bp, Homo sapien
gaatggcgggcactccaggagtgcc

SEQ ID NO: 121535 - DNA, 25 bp, Homo sapien
atcatatggcgatggcttcgcaggc

SEQ ID NO: 121536 - DNA, 25 bp, Homo sapien
tctctgatcatatggcgacggcttc

SEQ ID NO: 121537 - DNA, 25 bp, Homo sapien
aggcgtgtctctctcatcatatggc

SEQ ID NO: 121538 - DNA, 25 bp, Homo sapien
tctctctgatcatatggcgacggct

SEQ ID NO: 121539 - DNA, 25 bp, Homo sapien
ctctcatcatatggcgatggcttcg

SEQ ID NO: 121540 - DNA, 25 bp, Homo sapien
ctctgatcatatggggacggcttcg

SEQ ID NO: 121541 - DNA, 25 bp, Homo sapien
caggcgtgtctctctcatcatatgg

SEQ ID NO: 121542 - DNA, 25 bp, Homo sapien
tctctgatcatatggggacggcttc

SEQ ID NO: 121543 - DNA, 25 bp, Homo sapien
attccttcgagcctgccgggagaca

SEQ ID NO: 121544 - DNA, 25 bp, Homo sapien
atgcgataaactggccgagggactc

SEQ ID NO: 121545 - DNA, 25 bp, Homo sapien
cgtgcaggagaacagcgattccttc

SEQ ID NO: 121546 - DNA, 25 bp, Homo sapien
gacagccacgccaatggtcacaacg

SEQ ID NO: 121547 - DNA, 25 bp, Homo sapien
tcacaacgggcacagcgctcaggaa

SEQ ID NO: 121548 - DNA, 25 bp, Homo sapien
caccttggagacatagtagacgcac

SEQ ID NO: 121549 - DNA, 25 bp, Homo sapien
tctggggtccagatgcgataaactg

SEQ ID NO: 121550 - DNA, 25 bp, Homo sapien
tcaggaacgcagcaactcagccagc

SEQ ID NO: 121551 - DNA, 25 bp, Homo sapien
ggttgagcacatacaccaggctgtc

SEQ ID NO: 121552 - DNA, 25 bp, Homo sapien
cagtctcgcggatcagcctggctat

SEQ ID NO: 121553 - DNA, 25 bp, Homo sapien
cggggtccttgaatagcagcaggta

SEQ ID NO: 121554 - DNA, 25 bp, Homo sapien
cccacctcggagaagttgacggaga

SEQ ID NO: 121555 - DNA, 25 bp, Homo sapien
caacgtcatgatcctctgcagcagc

SEQ ID NO: 121556 - DNA, 25 bp, Homo sapien
ccaggctgtcctgaaacagagactc

SEQ ID NO: 121557 - DNA, 25 bp, Homo sapien
cccgtgtctagtcactggttgctga

SEQ ID NO: 121558 - DNA, 25 bp, Homo sapien
gcccatcccagaggaggtcggtttc

SEQ ID NO: 121559 - DNA, 25 bp, Homo sapien
ctggaacagaagcaacacaaggtga

SEQ ID NO: 121560 - DNA, 25 bp, Homo sapien
ctgctgtccctgcagtggcaccggg

SEQ ID NO: 121561 - DNA, 25 bp, Homo sapien
cttgacttctgagtcccgcctgctg

SEQ ID NO: 121562 - DNA, 25 bp, Homo sapien
gcggaggccttgacttctgagtccc

SEQ ID NO: 121563 - DNA, 25 bp, Homo sapien
cacaaggtgaacagttagaagtctc

SEQ ID NO: 121564 - DNA, 25 bp, Homo sapien
tagaagtctcatagcaccaggactg

SEQ ID NO: 121565 - DNA, 25 bp, Homo sapien
cctgggcgtttatccctggaacaga

SEQ ID NO: 121566 - DNA, 25 bp, Homo sapien
ctcactgactgtgcggcgcaaccgg

SEQ ID NO: 121567 - DNA, 25 bp, Homo sapien
tcaagaggtctgagtgactgattcc

SEQ ID NO: 121568 - DNA, 25 bp, Homo sapien
gactgccagggccactttccaaaaa

SEQ ID NO: 121569 - DNA, 25 bp, Homo sapien
gcctatggtggttgagtgactgcca

SEQ ID NO: 121570 - DNA, 25 bp, Homo sapien
tagtggcctcatccagcctatggtg

SEQ ID NO: 121571 - DNA, 25 bp, Homo sapien
tctgaatctgttctcactgagggcc

SEQ ID NO: 121572 - DNA, 25 bp, Homo sapien
gactgattccctagtggctgtcctg

SEQ ID NO: 121573 - DNA, 25 bp, Homo sapien
gctcactgtttacatcttcagagtg

SEQ ID NO: 121574 - DNA, 25 bp, Homo sapien
gaggactgcttgtgccctgggatct

SEQ ID NO: 121575 - DNA, 25 bp, Homo sapien
agaacctaccgtacacgcgcgggcg

SEQ ID NO: 121576 - DNA, 25 bp, Homo sapien
gggctcacgggagccacagcgttct

SEQ ID NO: 121577 - DNA, 25 bp, Homo sapien
tcagcggctgcgttccagaacctac

SEQ ID NO: 121578 - DNA, 25 bp, Homo sapien
aaacggcatcatctttcagcgcccg

SEQ ID NO: 121579 - DNA, 25 bp, Homo sapien
tctccttggggaccgctagactgat

SEQ ID NO: 121580 - DNA, 25 bp, Homo sapien
ccgctagactgataggcgaggagac

SEQ ID NO: 121581 - DNA, 25 bp, Homo sapien
ggttgtcaccggaaacggcatcatc

SEQ ID NO: 121582 - DNA, 25 bp, Homo sapien
cgcccgggtcatgatccgctgaggc

SEQ ID NO: 121583 - DNA, 25 bp, Homo sapien
gcggggccaacctgctagaaaaggc

SEQ ID NO: 121584 - DNA, 25 bp, Homo sapien
cctgctagaaaaggcgggctgtgct

SEQ ID NO: 121585 - DNA, 25 bp, Homo sapien
cccaataggcagaaagaaagcctcg

SEQ ID NO: 121586 - DNA, 25 bp, Homo sapien
ggcctcggcgcccaataggcagaaa

SEQ ID NO: 121587 - DNA, 25 bp, Homo sapien
atggcaactgggcaaacctgccctc

SEQ ID NO: 121588 - DNA, 25 bp, Homo sapien
gacagccagtcggttcccatggcaa

SEQ ID NO: 121589 - DNA, 25 bp, Homo sapien
cctccagggcacagccgggaaaact

SEQ ID NO: 121590 - DNA, 25 bp, Homo sapien
cggacagccaggctcaggagctctc

SEQ ID NO: 121591 - DNA, 25 bp, Homo sapien
tcccagcgagaagacgaggctgcct

SEQ ID NO: 121592 - DNA, 25 bp, Homo sapien
catcgcggcgcttccatgggaatct

SEQ ID NO: 121593 - DNA, 25 bp, Homo sapien
gtatttcgtcttctggaaatccagc

SEQ ID NO: 121594 - DNA, 25 bp, Homo sapien
cggttactccatcccagcgagaaga

SEQ ID NO: 121595 - DNA, 25 bp, Homo sapien
cacctcgcgtatttcgtcttctgga

SEQ ID NO: 121596 - DNA, 25 bp, Homo sapien
ccaaatcccgagcagatggtggcgg

SEQ ID NO: 121597 - DNA, 25 bp, Homo sapien
cggcgcttccatgggaatctggccc

SEQ ID NO: 121598 - DNA, 25 bp, Homo sapien
gccgacgccaaatcccgagcagatg

SEQ ID NO: 121599 - DNA, 25 bp, Homo sapien
cacttgcagccaacgtggagcgtgc

SEQ ID NO: 121600 - DNA, 25 bp, Homo sapien
tggtagcgaaggtcgccgaacccgc

SEQ ID NO: 121601 - DNA, 25 bp, Homo sapien
ccacggagctcgtagctgcagcttt

SEQ ID NO: 121602 - DNA, 25 bp, Homo sapien
agcgcgtgttgttccgtgaaacttg

SEQ ID NO: 121603 - DNA, 25 bp, Homo sapien
tggaacgggaccagggctctaagac

SEQ ID NO: 121604 - DNA, 25 bp, Homo sapien
ctgtacgcgcgctgtacgcttgcgc

SEQ ID NO: 121605 - DNA, 25 bp, Homo sapien
cgggccgtgagcaccacagagctga

SEQ ID NO: 121606 - DNA, 25 bp, Homo sapien
ggctctaagacttgggccacttgca

SEQ ID NO: 121607 - DNA, 25 bp, Homo sapien
tgcgaagttcaatcaggggttcaga

SEQ ID NO: 121608 - DNA, 25 bp, Homo sapien
caaatgcgaagttcaatcaggggtt

SEQ ID NO: 121609 - DNA, 25 bp, Homo sapien
aaatgcgaagttcaatcaggggttc

SEQ ID NO: 121610 - DNA, 25 bp, Homo sapien
aatgcgaagttcaatcaggggttca

SEQ ID NO: 121611 - DNA, 25 bp, Homo sapien
cgaagttcaatcaggggttcagagc

SEQ ID NO: 121612 - DNA, 25 bp, Homo sapien
tgggaaatagagtagggtgcttgtc

SEQ ID NO: 121613 - DNA, 25 bp, Homo sapien
tagggtgcttgtcctgggaccagct

SEQ ID NO: 121614 - DNA, 25 bp, Homo sapien
gaagttcaatcaggggttcagagct

SEQ ID NO: 121615 - DNA, 25 bp, Homo sapien
ggggcagaactgtccggatctaaca

SEQ ID NO: 121616 - DNA, 25 bp, Homo sapien
tccgtgggctaactcagggctgctc

SEQ ID NO: 121617 - DNA, 25 bp, Homo sapien
cgagaatgggtgtagctctgtacta

SEQ ID NO: 121618 - DNA, 25 bp, Homo sapien
gtagctctgtactagggcgtggtca

SEQ ID NO: 121619 - DNA, 25 bp, Homo sapien
ctgtactagggcgtggtcatgcgta

SEQ ID NO: 121620 - DNA, 25 bp, Homo sapien
tgtccggatctaacaatccctgggg

SEQ ID NO: 121621 - DNA, 25 bp, Homo sapien
cggatctaacaatccctggggagcc

SEQ ID NO: 121622 - DNA, 25 bp, Homo sapien
ccggtgactggtccgtgggctaact

SEQ ID NO: 121623 - DNA, 25 bp, Homo sapien
tctgcgcttgcaatgtgtccggcac

SEQ ID NO: 121624 - DNA, 25 bp, Homo sapien
catccggcatggttatctgcgcttg

SEQ ID NO: 121625 - DNA, 25 bp, Homo sapien
gcgtccgttatgtgcgcttgccttc

SEQ ID NO: 121626 - DNA, 25 bp, Homo sapien
cgcttgccttcgtccagcgtggtta

SEQ ID NO: 121627 - DNA, 25 bp, Homo sapien
agcgtggttatctgcactcgcaatg

SEQ ID NO: 121628 - DNA, 25 bp, Homo sapien
cgcttgcaatggctccgcacgatta

SEQ ID NO: 121629 - DNA, 25 bp, Homo sapien
cgcacgattatctgtgctcgcaatg

SEQ ID NO: 121630 - DNA, 25 bp, Homo sapien
gctcgcaatgaatacggcaaggtta

SEQ ID NO: 121631 - DNA, 25 bp, Homo sapien
ctgctgctgcatgccgaggaccacg

SEQ ID NO: 121632 - DNA, 25 bp, Homo sapien
tgtgccacgacatcaccgactgggt

SEQ ID NO: 121633 - DNA, 25 bp, Homo sapien
acccgagtgaagtcggcacagctgc

SEQ ID NO: 121634 - DNA, 25 bp, Homo sapien
gtcgcggagctgtaactcgagctta

SEQ ID NO: 121635 - DNA, 25 bp, Homo sapien
tgtaactcgagcttaagatcccgcc

SEQ ID NO: 121636 - DNA, 25 bp, Homo sapien
taagatcccgcctctgtggtgtgcg

SEQ ID NO: 121637 - DNA, 25 bp, Homo sapien
gcagccgtggtccaaagtgtaagtg

SEQ ID NO: 121638 - DNA, 25 bp, Homo sapien
cagcacctggaggtcgtcctccgga

SEQ ID NO: 121639 - DNA, 25 bp, Homo sapien
gactttgtgacgatcccacggtctc

SEQ ID NO: 121640 - DNA, 25 bp, Homo sapien
cgtgtgagtcctctgacgcaggatg

SEQ ID NO: 121641 - DNA, 25 bp, Homo sapien
acacttgtaaggcttcgctccggcg

SEQ ID NO: 121642 - DNA, 25 bp, Homo sapien
tgaggtgtgacttctggaaaaaggc

SEQ ID NO: 121643 - DNA, 25 bp, Homo sapien
ctggcgatgtccctcctagaggttc

SEQ ID NO: 121644 - DNA, 25 bp, Homo sapien
cgcgacttgtgggaggttttctcac

SEQ ID NO: 121645 - DNA, 25 bp, Homo sapien
acacaggcgtgtcttccggaagatc

SEQ ID NO: 121646 - DNA, 25 bp, Homo sapien
gcgacctcgtgatgtgactttgtga

SEQ ID NO: 121647 - DNA, 25 bp, Homo sapien
cgttcctcccacacgtgtctgaggt

SEQ ID NO: 121648 - DNA, 25 bp, Homo sapien
gttcctcccacacgtgtctgaggtg

SEQ ID NO: 121649 - DNA, 25 bp, Homo sapien
agtcgccatgggaacagcctggggt

SEQ ID NO: 121650 - DNA, 25 bp, Homo sapien
gccaagacgccgttcctcccacacg

SEQ ID NO: 121651 - DNA, 25 bp, Homo sapien
gggacccaccactacctgtggcgtc

SEQ ID NO: 121652 - DNA, 25 bp, Homo sapien
cgctgctcgggacccaccactacct

SEQ ID NO: 121653 - DNA, 25 bp, Homo sapien
tgccctgcgcgagcttccaggggac

SEQ ID NO: 121654 - DNA, 25 bp, Homo sapien
tcctcccacacgtgtctgaggtgtc

SEQ ID NO: 121655 - DNA, 25 bp, Homo sapien
ccgctaaatgccagcccggtggagg

SEQ ID NO: 121656 - DNA, 25 bp, Homo sapien
gtctgtagtggcctctggagagccc

SEQ ID NO: 121657 - DNA, 25 bp, Homo sapien
gtatctgtgcgtttcagcggcgaca

SEQ ID NO: 121658 - DNA, 25 bp, Homo sapien
cgatgctggcaacacggcggctgct

SEQ ID NO: 121659 - DNA, 25 bp, Homo sapien
acagcgtgaggtgacccatctggcc

SEQ ID NO: 121660 - DNA, 25 bp, Homo sapien
tagcgtctctatcgcgccagttcct

SEQ ID NO: 121661 - DNA, 25 bp, Homo sapien
tggggacagccaccgctaaatgcca

SEQ ID NO: 121662 - DNA, 25 bp, Homo sapien
cagcctcagtgctatgaaggtgaca

SEQ ID NO: 121663 - DNA, 25 bp, Homo sapien
ctggagcataaacaagagcggggac

SEQ ID NO: 121664 - DNA, 25 bp, Homo sapien
ccggctctggagcataaacaagagc

SEQ ID NO: 121665 - DNA, 25 bp, Homo sapien
agaaaacagactcccgccagctctg

SEQ ID NO: 121666 - DNA, 25 bp, Homo sapien
tgctcttcgccaacttcaaccagga

SEQ ID NO: 121667 - DNA, 25 bp, Homo sapien
ccagccatgaacctggcgagccaga

SEQ ID NO: 121668 - DNA, 25 bp, Homo sapien
tcaaccaggacaacacgtaaggccg

SEQ ID NO: 121669 - DNA, 25 bp, Homo sapien
ccggcgccgaccctgagtgcagcct

SEQ ID NO: 121670 - DNA, 25 bp, Homo sapien
gcctgcgtgatccaccggaacccaa

SEQ ID NO: 121671 - DNA, 25 bp, Homo sapien
cgttaagtcaaacctcgtgagtgtg

SEQ ID NO: 121672 - DNA, 25 bp, Homo sapien
tctgcggccacaaaaacatctgctc

SEQ ID NO: 121673 - DNA, 25 bp, Homo sapien
catctgctcgctagccacgtgagta

SEQ ID NO: 121674 - DNA, 25 bp, Homo sapien
gcttctgaacaggagcagcttctta

SEQ ID NO: 121675 - DNA, 25 bp, Homo sapien
agagccgacactccatcgagagttg

SEQ ID NO: 121676 - DNA, 25 bp, Homo sapien
ggctcccgttctgtttttgtggata

SEQ ID NO: 121677 - DNA, 25 bp, Homo sapien
cgtgagtgtgccgtagttaaccctt

SEQ ID NO: 121678 - DNA, 25 bp, Homo sapien
caggcactaggcttgccgctctgtg

SEQ ID NO: 121679 - DNA, 25 bp, Homo sapien
ttcccaggtgaaatcaatgccgccg

SEQ ID NO: 121680 - DNA, 25 bp, Homo sapien
gggagcttcgctttcccaggtgaaa

SEQ ID NO: 121681 - DNA, 25 bp, Homo sapien
atagaggggcagattccagcacagc

SEQ ID NO: 121682 - DNA, 25 bp, Homo sapien
tttccttgcaaaccagtgacataga

SEQ ID NO: 121683 - DNA, 25 bp, Homo sapien
gcgaacgtttgtttatttccttgca

SEQ ID NO: 121684 - DNA, 25 bp, Homo sapien
cctgatgaagcagcaccggtgagtc

SEQ ID NO: 121685 - DNA, 25 bp, Homo sapien
gcgagtgtgccctgatgaagcagca

SEQ ID NO: 121686 - DNA, 25 bp, Homo sapien
tcaatgccgccgcaagacagggagc

SEQ ID NO: 121687 - DNA, 25 bp, Homo sapien
ctttgcggctgatgaggccggacag

SEQ ID NO: 121688 - DNA, 25 bp, Homo sapien
tttgcggctgatgaggccggacagg

SEQ ID NO: 121689 - DNA, 25 bp, Homo sapien
ttgcggctgatgaggccggacaggc

SEQ ID NO: 121690 - DNA, 25 bp, Homo sapien
actttgcggctgatgaggccggaca

SEQ ID NO: 121691 - DNA, 25 bp, Homo sapien
tgcggctgatgaggccggacaggcg

SEQ ID NO: 121692 - DNA, 25 bp, Homo sapien
gcggctgatgaggccggacaggcgg

SEQ ID NO: 121693 - DNA, 25 bp, Homo sapien
cggctgatgaggccggacaggcggc

SEQ ID NO: 121694 - DNA, 25 bp, Homo sapien
gtgtaccaggcatcaactaaccagg

SEQ ID NO: 121695 - DNA, 25 bp, Homo sapien
agcttagaccgctgggctgcggaaa

SEQ ID NO: 121696 - DNA, 25 bp, Homo sapien
ttggagcagcttagaccgctgggct

SEQ ID NO: 121697 - DNA, 25 bp, Homo sapien
ccacaggagttggagcagcttagac

SEQ ID NO: 121698 - DNA, 25 bp, Homo sapien
acctgtcggagcctttgtctgcggc

SEQ ID NO: 121699 - DNA, 25 bp, Homo sapien
gggacctgtcggagcctttgtctgc

SEQ ID NO: 121700 - DNA, 25 bp, Homo sapien
ggcatcaactaaccagggctggtga

SEQ ID NO: 121701 - DNA, 25 bp, Homo sapien
aactaaccagggctggtgactgagc

SEQ ID NO: 121702 - DNA, 25 bp, Homo sapien
gcgggcgtgatgatctctctgagcc

SEQ ID NO: 121703 - DNA, 25 bp, Homo sapien
cggggacgtccacttcgtaagtgcg

SEQ ID NO: 121704 - DNA, 25 bp, Homo sapien
atgatctctctgagccgcatcctca

SEQ ID NO: 121705 - DNA, 25 bp, Homo sapien
ctgctgcccgacgagcgcgccagca

SEQ ID NO: 121706 - DNA, 25 bp, Homo sapien
tgctcttctataccacacggccgcg

SEQ ID NO: 121707 - DNA, 25 bp, Homo sapien
acgtccacttcgtaagtgcgcaccg

SEQ ID NO: 121708 - DNA, 25 bp, Homo sapien
cgtgatgatctctctgagccgcatc

SEQ ID NO: 121709 - DNA, 25 bp, Homo sapien
ttcgtgctcttctataccacacggc

SEQ ID NO: 121710 - DNA, 25 bp, Homo sapien
tgatctgggccgacatgctctccat

SEQ ID NO: 121711 - DNA, 25 bp, Homo sapien
cggggcctacatgcgctttgatgtg

SEQ ID NO: 121712 - DNA, 25 bp, Homo sapien
gctggcccaccttcagaggtgagtg

SEQ ID NO: 121713 - DNA, 25 bp, Homo sapien
acatgctctccatcgccgtgaccta

SEQ ID NO: 121714 - DNA, 25 bp, Homo sapien
ccgtgacctacttcatcacgctgtg

SEQ ID NO: 121715 - DNA, 25 bp, Homo sapien
tacttcatcacgctgtgcctgttcc

SEQ ID NO: 121716 - DNA, 25 bp, Homo sapien
ggcctcgagtctgagatccgccact

SEQ ID NO: 121717 - DNA, 25 bp, Homo sapien
tacatgcgctttgatgtgccgcggc

SEQ ID NO: 121718 - DNA, 25 bp, Homo sapien
ctagaccgcaggaaggtgcatttgg

SEQ ID NO: 121719 - DNA, 25 bp, Homo sapien
ggaaacccaggctagaccgcaggaa

SEQ ID NO: 121720 - DNA, 25 bp, Homo sapien
aaacccaggctagaccgcaggaagg

SEQ ID NO: 121721 - DNA, 25 bp, Homo sapien
acccaggctagaccgcaggaaggtg

SEQ ID NO: 121722 - DNA, 25 bp, Homo sapien
caggctagaccgcaggaaggtgcat

SEQ ID NO: 121723 - DNA, 25 bp, Homo sapien
ggctagaccgcaggaaggtgcattt

SEQ ID NO: 121724 - DNA, 25 bp, Homo sapien
aggaaacccaggctagaccgcagga

SEQ ID NO: 121725 - DNA, 25 bp, Homo sapien
cgaggaaacccaggctagaccgcag

SEQ ID NO: 121726 - DNA, 25 bp, Homo sapien
tcatcccacaactacttggtgagcc

SEQ ID NO: 121727 - DNA, 25 bp, Homo sapien
tttattcgttcgttcatcccacaac

SEQ ID NO: 121728 - DNA, 25 bp, Homo sapien
ggtgtggggacattctcagccactt

SEQ ID NO: 121729 - DNA, 25 bp, Homo sapien
taggtgtggggacattctcagccac

SEQ ID NO: 121730 - DNA, 25 bp, Homo sapien
ctgctcatgggcatcagcaacggct

SEQ ID NO: 121731 - DNA, 25 bp, Homo sapien
tgcgtgtggtcttcatccccctctt

SEQ ID NO: 121732 - DNA, 25 bp, Homo sapien
gttcgttcatcccacaactacttgg

SEQ ID NO: 121733 - DNA, 25 bp, Homo sapien
ctcactgctcatgggcatcagcaac

SEQ ID NO: 121734 - DNA, 25 bp, Homo sapien
ttcaggcgggtgtcaccgcacctca

SEQ ID NO: 121735 - DNA, 25 bp, Homo sapien
cctcacacccgagcagccgtggcca

SEQ ID NO: 121736 - DNA, 25 bp, Homo sapien
ccctcaggctggtgttgtccacagg

SEQ ID NO: 121737 - DNA, 25 bp, Homo sapien
ttgtccacagggaacaccatgaccg

SEQ ID NO: 121738 - DNA, 25 bp, Homo sapien
atggttccatcctcgcaggcctctg

SEQ ID NO: 121739 - DNA, 25 bp, Homo sapien
accatgaccgtgtcctacatgtcag

SEQ ID NO: 121740 - DNA, 25 bp, Homo sapien
tggggtccgccgtggcctactgcac

SEQ ID NO: 121741 - DNA, 25 bp, Homo sapien
tgcacgcctccaccgccaatggttc

SEQ ID NO: 121742 - DNA, 25 bp, Homo sapien
ccctgaggtgtttctgaagctgatc

SEQ ID NO: 121743 - DNA, 25 bp, Homo sapien
aggcccacatctgccaggcatctga

SEQ ID NO: 121744 - DNA, 25 bp, Homo sapien
agtgccctcgctgatagcccttgtt

SEQ ID NO: 121745 - DNA, 25 bp, Homo sapien
cgggccatcggaaacacctgcagta

SEQ ID NO: 121746 - DNA, 25 bp, Homo sapien
aatgacatgtctgtgggttgccctg

SEQ ID NO: 121747 - DNA, 25 bp, Homo sapien
cagtgtaccagatccgcagagctcg

SEQ ID NO: 121748 - DNA, 25 bp, Homo sapien
tatcgacgctgaagaagacgccctc

SEQ ID NO: 121749 - DNA, 25 bp, Homo sapien
catgtttctttctcgcagtgtacca

SEQ ID NO: 121750 - DNA, 25 bp, Homo sapien
tacctgcgtctaccttccatctgtg

SEQ ID NO: 121751 - DNA, 25 bp, Homo sapien
gcgtttggtctcatacctgcgtcta

SEQ ID NO: 121752 - DNA, 25 bp, Homo sapien
ctgtgttctgcgtttggtctcatac

SEQ ID NO: 121753 - DNA, 25 bp, Homo sapien
tctgcagggtcacacgcaccgtgtc

SEQ ID NO: 121754 - DNA, 25 bp, Homo sapien
aggacagcagacacccgccagagtg

SEQ ID NO: 121755 - DNA, 25 bp, Homo sapien
agtgtgcgcgcccagtgactgcacc

SEQ ID NO: 121756 - DNA, 25 bp, Homo sapien
cgaggaccggaacacgtttctgcga

SEQ ID NO: 121757 - DNA, 25 bp, Homo sapien
gtctaccttccatctgtgtccagcg

SEQ ID NO: 121758 - DNA, 25 bp, Homo sapien
gtgctcctgcatgctaacccgggga

SEQ ID NO: 121759 - DNA, 25 bp, Homo sapien
tcctgcatgctaacccggggaggct

SEQ ID NO: 121760 - DNA, 25 bp, Homo sapien
gcccgggctcacatcgatggccatg

SEQ ID NO: 121761 - DNA, 25 bp, Homo sapien
atgtgctcctgcatgctaacccggg

SEQ ID NO: 121762 - DNA, 25 bp, Homo sapien
atggccatgtgctcctgcatgctaa

SEQ ID NO: 121763 - DNA, 25 bp, Homo sapien
acatcgatggccatgtgctcctgca

SEQ ID NO: 121764 - DNA, 25 bp, Homo sapien
gggtgcagggcaggctccgcaaaag

SEQ ID NO: 121765 - DNA, 25 bp, Homo sapien
actcagagaaatgcctgaggactgg

SEQ ID NO: 121766 - DNA, 25 bp, Homo sapien
ccatctcgggataccggtggaactc

SEQ ID NO: 121767 - DNA, 25 bp, Homo sapien
ctaactgtaccgcaccggccattaa

SEQ ID NO: 121768 - DNA, 25 bp, Homo sapien
taccgcaccggccattaaaagatga

SEQ ID NO: 121769 - DNA, 25 bp, Homo sapien
ttaaaagatgaaggcagaccgctgc

SEQ ID NO: 121770 - DNA, 25 bp, Homo sapien
gatgaaggcagaccgctgcaccgcc

SEQ ID NO: 121771 - DNA, 25 bp, Homo sapien
cgccgcctgcaagcagagtttgtgc

SEQ ID NO: 121772 - DNA, 25 bp, Homo sapien
ctgcaagcagagtttgtgcgtggac

SEQ ID NO: 121773 - DNA, 25 bp, Homo sapien
gctgggactgccatctcgggatacc

SEQ ID NO: 121774 - DNA, 25 bp, Homo sapien
tcgctgtcctggtacttcttggtct

SEQ ID NO: 121775 - DNA, 25 bp, Homo sapien
ctgtcctggtacttcttggtcttca

SEQ ID NO: 121776 - DNA, 25 bp, Homo sapien
gtacttcttggtcttcagcatctgc

SEQ ID NO: 121777 - DNA, 25 bp, Homo sapien
acaccgtctgcacgtcattttcgtc

SEQ ID NO: 121778 - DNA, 25 bp, Homo sapien
gcacgtcattttcgtccacatgcga

SEQ ID NO: 121779 - DNA, 25 bp, Homo sapien
tttcgtccacatgcgaggactggta

SEQ ID NO: 121780 - DNA, 25 bp, Homo sapien
gtccacatgcgaggactggtatagc

SEQ ID NO: 121781 - DNA, 25 bp, Homo sapien
cgaggtagtacaggccctcgctgtc

SEQ ID NO: 121782 - DNA, 25 bp, Homo sapien
ctcctcggggtggtagaaccacttg

SEQ ID NO: 121783 - DNA, 25 bp, Homo sapien
atgccacgccgctgcaaggacacgt

SEQ ID NO: 121784 - DNA, 25 bp, Homo sapien
ccttgtagaagagcttgcgggcctt

SEQ ID NO: 121785 - DNA, 25 bp, Homo sapien
tgccgcgcacgatggccttgtagaa

SEQ ID NO: 121786 - DNA, 25 bp, Homo sapien
atacggatcatctccttgccgcgca

SEQ ID NO: 121787 - DNA, 25 bp, Homo sapien
gcagagaggaacacggcacagtccc

SEQ ID NO: 121788 - DNA, 25 bp, Homo sapien
tcccacatgctctggatgcggccga

SEQ ID NO: 121789 - DNA, 25 bp, Homo sapien
ttgacgcggaccaccatgttgttgc

SEQ ID NO: 121790 - DNA, 25 bp, Homo sapien
ctcttcttgggtcggctcttggccc

SEQ ID NO: 121791 - DNA, 25 bp, Homo sapien
ctgcttggtggccttggtggggagc

SEQ ID NO: 121792 - DNA, 25 bp, Homo sapien
ctctcttcttgggtcggctcttggc

SEQ ID NO: 121793 - DNA, 25 bp, Homo sapien
ctctctcttcttgggtcggctcttg

SEQ ID NO: 121794 - DNA, 25 bp, Homo sapien
cctctctcttcttgggtcggctctt

SEQ ID NO: 121795 - DNA, 25 bp, Homo sapien
ccgcttggccagctccttggtggtg

SEQ ID NO: 121796 - DNA, 25 bp, Homo sapien
ctgccgcttggccagctccttggtg

SEQ ID NO: 121797 - DNA, 25 bp, Homo sapien
cgtcttcttgcctggggagtgggcc

SEQ ID NO: 121798 - DNA, 25 bp, Homo sapien
ctggcagcgctgcagttacggcccc

SEQ ID NO: 121799 - DNA, 25 bp, Homo sapien
gcagcgctgcagttacggcccccgg

SEQ ID NO: 121800 - DNA, 25 bp, Homo sapien
gctcttggggttcccagagtcctcg

SEQ ID NO: 121801 - DNA, 25 bp, Homo sapien
tcttggggttcccagagtcctcgaa

SEQ ID NO: 121802 - DNA, 25 bp, Homo sapien
ggttcccagagtcctcgaacgtgag

SEQ ID NO: 121803 - DNA, 25 bp, Homo sapien
gttcccagagtcctcgaacgtgagc

SEQ ID NO: 121804 - DNA, 25 bp, Homo sapien
ttcccagagtcctcgaacgtgagcc

SEQ ID NO: 121805 - DNA, 25 bp, Homo sapien
tggcagcgctgcagttacggccccc

SEQ ID NO: 121806 - DNA, 25 bp, Homo sapien
gcccggcgtacagcagcttgtcatc

SEQ ID NO: 121807 - DNA, 25 bp, Homo sapien
cgtacagcagcttgtcatccatggg

SEQ ID NO: 121808 - DNA, 25 bp, Homo sapien
gcgtacagcagcttgtcatccatgg

SEQ ID NO: 121809 - DNA, 25 bp, Homo sapien
ggcgtacagcagcttgtcatccatg

SEQ ID NO: 121810 - DNA, 25 bp, Homo sapien
cggcgtacagcagcttgtcatccat

SEQ ID NO: 121811 - DNA, 25 bp, Homo sapien
ccggcgtacagcagcttgtcatcca

SEQ ID NO: 121812 - DNA, 25 bp, Homo sapien
gtacagcagcttgtcatccatgggg

SEQ ID NO: 121813 - DNA, 25 bp, Homo sapien
cccggcgtacagcagcttgtcatcc

SEQ ID NO: 121814 - DNA, 25 bp, Homo sapien
cttgacctcgctctctgagtcggtg

SEQ ID NO: 121815 - DNA, 25 bp, Homo sapien
gcaggcgaccgcttgcgcaccttga

SEQ ID NO: 121816 - DNA, 25 bp, Homo sapien
tgagtcggtgtactcgaactctgtg

SEQ ID NO: 121817 - DNA, 25 bp, Homo sapien
ccagcttggccttgtctgggctgct

SEQ ID NO: 121818 - DNA, 25 bp, Homo sapien
gtccacaggtcgtcgtcgctggcct

SEQ ID NO: 121819 - DNA, 25 bp, Homo sapien
cgcccttggcgcagcggctggtctt

SEQ ID NO: 121820 - DNA, 25 bp, Homo sapien
cgaactctgtgcctgaacgcgggag

SEQ ID NO: 121821 - DNA, 25 bp, Homo sapien
gcctcgaagccaggctccttggggc

SEQ ID NO: 121822 - DNA, 25 bp, Homo sapien
ggtcaaacgattcctccgaagagtc

SEQ ID NO: 121823 - DNA, 25 bp, Homo sapien
agacaaaacggctgcttcctgctgg

SEQ ID NO: 121824 - DNA, 25 bp, Homo sapien
acgattcctccgaagagtcgctgaa

SEQ ID NO: 121825 - DNA, 25 bp, Homo sapien
agtcgctgaaggaggaacgcgcctc

SEQ ID NO: 121826 - DNA, 25 bp, Homo sapien
ctcgctaggaaacacggaaggtatt

SEQ ID NO: 121827 - DNA, 25 bp, Homo sapien
tcgcacgcactctctcgctaggaaa

SEQ ID NO: 121828 - DNA, 25 bp, Homo sapien
tcggcctctcgaagcagcagacaaa

SEQ ID NO: 121829 - DNA, 25 bp, Homo sapien
tggagctagtaaccttggtcaaacg

SEQ ID NO: 121830 - DNA, 25 bp, Homo sapien
cgacaaagccgtggtccgcaacaga

SEQ ID NO: 121831 - DNA, 25 bp, Homo sapien
cctgcatccatagccgagcacggtg

SEQ ID NO: 121832 - DNA, 25 bp, Homo sapien
gccgcaaactctatgacgcacaagg

SEQ ID NO: 121833 - DNA, 25 bp, Homo sapien
gcttcctcgcctatgacatccggta

SEQ ID NO: 121834 - DNA, 25 bp, Homo sapien
gggtaccactgtcagagctgccaca

SEQ ID NO: 121835 - DNA, 25 bp, Homo sapien
acagacggcatgcttcctgtgggta

SEQ ID NO: 121836 - DNA, 25 bp, Homo sapien
acagacacagtaacgccaatgaacc

SEQ ID NO: 121837 - DNA, 25 bp, Homo sapien
tctaggaccctcaagagcagtcgcg

SEQ ID NO: 121838 - DNA, 25 bp, Homo sapien
cggagacaggtgatctgggcggaag

SEQ ID NO: 121839 - DNA, 25 bp, Homo sapien
tccgccagcaggagcgctcgtgctt

SEQ ID NO: 121840 - DNA, 25 bp, Homo sapien
ccagcaggagcgctcgtgcttggaa

SEQ ID NO: 121841 - DNA, 25 bp, Homo sapien
cacactgggagggaagacacgtggt

SEQ ID NO: 121842 - DNA, 25 bp, Homo sapien
gcgctcgtgcttggaaggtagacac

SEQ ID NO: 121843 - DNA, 25 bp, Homo sapien
ctcgtgcttggaaggtagacacgtg

SEQ ID NO: 121844 - DNA, 25 bp, Homo sapien
ccgggtggaagtgtccctgctgcga

SEQ ID NO: 121845 - DNA, 25 bp, Homo sapien
cttggaaggtagacacgtggcccgg

SEQ ID NO: 121846 - DNA, 25 bp, Homo sapien
tgtacctgacgtcgcccttgtgcct

SEQ ID NO: 121847 - DNA, 25 bp, Homo sapien
gcccgggtccctccgaaagctgaga

SEQ ID NO: 121848 - DNA, 25 bp, Homo sapien
cctggaccggagcttttgctacgaa

SEQ ID NO: 121849 - DNA, 25 bp, Homo sapien
ctcctgtagcctccggcaaagggcg

SEQ ID NO: 121850 - DNA, 25 bp, Homo sapien
tctccgagatcctgaaaccacgcga

SEQ ID NO: 121851 - DNA, 25 bp, Homo sapien
cagtcgggcagcatgtcaagtcctg

SEQ ID NO: 121852 - DNA, 25 bp, Homo sapien
gacctgccggttgtgttctccgaga

SEQ ID NO: 121853 - DNA, 25 bp, Homo sapien
gccggactcggacgttactgccaaa

SEQ ID NO: 121854 - DNA, 25 bp, Homo sapien
tcctcgcgcctgtcccttaaaaaga

SEQ ID NO: 121855 - DNA, 25 bp, Homo sapien
gcctctgcgtgccaagcttctatgg

SEQ ID NO: 121856 - DNA, 25 bp, Homo sapien
gggccagccttactttccgctactg

SEQ ID NO: 121857 - DNA, 25 bp, Homo sapien
gggtcatagcccgtcccaacaagca

SEQ ID NO: 121858 - DNA, 25 bp, Homo sapien
ggcgttcagaaagacccacacaggt

SEQ ID NO: 121859 - DNA, 25 bp, Homo sapien
gctctcattccagctggcgttcaga

SEQ ID NO: 121860 - DNA, 25 bp, Homo sapien
aagcatcttttctgtgcacgcctcg

SEQ ID NO: 121861 - DNA, 25 bp, Homo sapien
ttctccttgtactggcgctgcacct

SEQ ID NO: 121862 - DNA, 25 bp, Homo sapien
tctgtggggccctcgtccatgtcct

SEQ ID NO: 121863 - DNA, 25 bp, Homo sapien
acatcaggggccaagccgtccgcgt

SEQ ID NO: 121864 - DNA, 25 bp, Homo sapien
agcggcacatcaggggccaagccgt

SEQ ID NO: 121865 - DNA, 25 bp, Homo sapien
ccatcagccgggagcggcacatcag

SEQ ID NO: 121866 - DNA, 25 bp, Homo sapien
cccgcagcggctctgtgatcttgga

SEQ ID NO: 121867 - DNA, 25 bp, Homo sapien
gctcagccagcggttcttcctccgg

SEQ ID NO: 121868 - DNA, 25 bp, Homo sapien
tcgtccatgtcctccacctctgcct

SEQ ID NO: 121869 - DNA, 25 bp, Homo sapien
cagcaggaaagggtagggcctcccg

SEQ ID NO: 121870 - DNA, 25 bp, Homo sapien
gcagggtcagcacggcacgagtttc

SEQ ID NO: 121871 - DNA, 25 bp, Homo sapien
gccttcaaccgctcctgctgggaag

SEQ ID NO: 121872 - DNA, 25 bp, Homo sapien
ggtggcttggacacgtcctccagct

SEQ ID NO: 121873 - DNA, 25 bp, Homo sapien
ggatgaccttggccttcagggcagc

SEQ ID NO: 121874 - DNA, 25 bp, Homo sapien
cttggacacgtcctccagcttctgg

SEQ ID NO: 121875 - DNA, 25 bp, Homo sapien
ggctcacggccttgccgtaggtgcc

SEQ ID NO: 121876 - DNA, 25 bp, Homo sapien
tctcgggagcctcctccttgcgggt

SEQ ID NO: 121877 - DNA, 25 bp, Homo sapien
cccggtgctcctgcgccttcaaccg

SEQ ID NO: 121878 - DNA, 25 bp, Homo sapien
cagggtccaggtaggccttcttgga

SEQ ID NO: 121879 - DNA, 25 bp, Homo sapien
tttccatttatgctcagggccggtg

SEQ ID NO: 121880 - DNA, 25 bp, Homo sapien
gcccagctcgaagggtttccattta

SEQ ID NO: 121881 - DNA, 25 bp, Homo sapien
cgccgcattcttggtcttggactca

SEQ ID NO: 121882 - DNA, 25 bp, Homo sapien
cgccgttgcacatggtcagtaccga

SEQ ID NO: 121883 - DNA, 25 bp, Homo sapien
cctgctcgcggaagacggtgtagac

SEQ ID NO: 121884 - DNA, 25 bp, Homo sapien
gcgagcggatgaccgagttcttctc

SEQ ID NO: 121885 - DNA, 25 bp, Homo sapien
ggcttgagcagctccttggcaggca

SEQ ID NO: 121886 - DNA, 25 bp, Homo sapien
cccagaggaatttgagcgcttgccc

SEQ ID NO: 121887 - DNA, 25 bp, Homo sapien
tcagagcggcttctcagaattcagc

SEQ ID NO: 121888 - DNA, 25 bp, Homo sapien
aagcggcggttttgacacacgaata

SEQ ID NO: 121889 - DNA, 25 bp, Homo sapien
cagatccagagagggcgcatttgca

SEQ ID NO: 121890 - DNA, 25 bp, Homo sapien
aggccttcgcgctggtgtcttacat

SEQ ID NO: 121891 - DNA, 25 bp, Homo sapien
cagcggggttttgctccagacttaa

SEQ ID NO: 121892 - DNA, 25 bp, Homo sapien
accggagcattcagcccttcatgga

SEQ ID NO: 121893 - DNA, 25 bp, Homo sapien
aaggttaaagtccaccgcgagcgtg

SEQ ID NO: 121894 - DNA, 25 bp, Homo sapien
ggccctggcactgtgcatgcatgca

SEQ ID NO: 121895 - DNA, 25 bp, Homo sapien
caccactccgggctggaccaaatga

SEQ ID NO: 121896 - DNA, 25 bp, Homo sapien
ttcccagcctcgaaaaagccaagcg

SEQ ID NO: 121897 - DNA, 25 bp, Homo sapien
caccgcttcgcattagggcactttg

SEQ ID NO: 121898 - DNA, 25 bp, Homo sapien
cacgccactagagaacaaacccttg

SEQ ID NO: 121899 - DNA, 25 bp, Homo sapien
attaggccgtctgactgctgcgtca

SEQ ID NO: 121900 - DNA, 25 bp, Homo sapien
gtctccttgcggctactcgaagtgg

SEQ ID NO: 121901 - DNA, 25 bp, Homo sapien
actttgccttgccaggccggagcca

SEQ ID NO: 121902 - DNA, 25 bp, Homo sapien
caggcagcgggtgagtctctaatct

SEQ ID NO: 121903 - DNA, 25 bp, Homo sapien
gagaaggccgttttcctagcactga

SEQ ID NO: 121904 - DNA, 25 bp, Homo sapien
cgccgaaacagacaagggctgcttt

SEQ ID NO: 121905 - DNA, 25 bp, Homo sapien
aggaagatggttgtcgccgcaatcc

SEQ ID NO: 121906 - DNA, 25 bp, Homo sapien
gcgtctgggctgagtgatcaaaata

SEQ ID NO: 121907 - DNA, 25 bp, Homo sapien
tcggcggggctgaatgatcaaaact

SEQ ID NO: 121908 - DNA, 25 bp, Homo sapien
ctctccggcaaagaaacacgcattg

SEQ ID NO: 121909 - DNA, 25 bp, Homo sapien
tccctccctgaaacgcggtgtcaga

SEQ ID NO: 121910 - DNA, 25 bp, Homo sapien
tcggcctggaagctgaaccagagac

SEQ ID NO: 121911 - DNA, 25 bp, Homo sapien
tgacgacgtttaacgcgggccgctc

SEQ ID NO: 121912 - DNA, 25 bp, Homo sapien
acgtcccggatgacgtcggtcaggc

SEQ ID NO: 121913 - DNA, 25 bp, Homo sapien
tgatctcatccaggtgcaccagggg

SEQ ID NO: 121914 - DNA, 25 bp, Homo sapien
gctcttaaataaggtgatctcatcc

SEQ ID NO: 121915 - DNA, 25 bp, Homo sapien
ggttcctcggccactctgctcttaa

SEQ ID NO: 121916 - DNA, 25 bp, Homo sapien
tctcaccaccacaggttcggcggtt

SEQ ID NO: 121917 - DNA, 25 bp, Homo sapien
gtcagcggattacatgggtggccac

SEQ ID NO: 121918 - DNA, 25 bp, Homo sapien
aagcgagagcaaaccgctgctcctc

SEQ ID NO: 121919 - DNA, 25 bp, Homo sapien
ggtcaccagcaacaggtcaccggcg

SEQ ID NO: 121920 - DNA, 25 bp, Homo sapien
aggtcagcagccacgacaccggccg

SEQ ID NO: 121921 - DNA, 25 bp, Homo sapien
gctccataaatcctccaggcaggaa

SEQ ID NO: 121922 - DNA, 25 bp, Homo sapien
gcaggaaaaaagacgagaaagagaa

SEQ ID NO: 121923 - DNA, 25 bp, Homo sapien
cgagaaagagaaaagcgtcaggaaa

SEQ ID NO: 121924 - DNA, 25 bp, Homo sapien
gcgtcaggaaaagcgagagcaaacc

SEQ ID NO: 121925 - DNA, 25 bp, Homo sapien
agcaacaggtcaccggcgacaggtc

SEQ ID NO: 121926 - DNA, 25 bp, Homo sapien
acagccgtcctgaactgcttgggga

SEQ ID NO: 121927 - DNA, 25 bp, Homo sapien
gacccgcctgtagcgccatgcagag

SEQ ID NO: 121928 - DNA, 25 bp, Homo sapien
ttctgaggaccagaaggaaaagcag

SEQ ID NO: 121929 - DNA, 25 bp, Homo sapien
ccgtcatgagcacagccgtcctgaa

SEQ ID NO: 121930 - DNA, 25 bp, Homo sapien
atcgtggacgttctccgctgcagca

SEQ ID NO: 121931 - DNA, 25 bp, Homo sapien
ctccgctgcagcaaggaaacagaca

SEQ ID NO: 121932 - DNA, 25 bp, Homo sapien
caggctcatcggagcaggaggcctt

SEQ ID NO: 121933 - DNA, 25 bp, Homo sapien
ggaaacagacaactcccagagccgg

SEQ ID NO: 121934 - DNA, 25 bp, Homo sapien
ccaagtctgcagagcgtggaaaaaa

SEQ ID NO: 121935 - DNA, 25 bp, Homo sapien
tctggggttaaaaaccaagtctgca

SEQ ID NO: 121936 - DNA, 25 bp, Homo sapien
acgaggaaaaggctcccactgcgcc

SEQ ID NO: 121937 - DNA, 25 bp, Homo sapien
ggcagagctgacctgactcgagtga

SEQ ID NO: 121938 - DNA, 25 bp, Homo sapien
ggcctggcacgtctaaagcttccta

SEQ ID NO: 121939 - DNA, 25 bp, Homo sapien
cccggaggaagtcacctgtcacagg

SEQ ID NO: 121940 - DNA, 25 bp, Homo sapien
cttttttccacgagataaccacatc

SEQ ID NO: 121941 - DNA, 25 bp, Homo sapien
ctgactcgagtgaccggcagcgtct

SEQ ID NO: 121942 - DNA, 25 bp, Homo sapien
tctccaggatgctgctgtcgatgtc

SEQ ID NO: 121943 - DNA, 25 bp, Homo sapien
ggcacgttgctctggcccaccataa

SEQ ID NO: 121944 - DNA, 25 bp, Homo sapien
ccacctcctggttgatgtagccggg

SEQ ID NO: 121945 - DNA, 25 bp, Homo sapien
cggtcgctaagcacagccaggtaga

SEQ ID NO: 121946 - DNA, 25 bp, Homo sapien
ccgccgttgatgacctgctggatca

SEQ ID NO: 121947 - DNA, 25 bp, Homo sapien
cgcgcatagaagacccgcaggttct

SEQ ID NO: 121948 - DNA, 25 bp, Homo sapien
cctgacagggtacagcggctgaaac

SEQ ID NO: 121949 - DNA, 25 bp, Homo sapien
cccaatcagctcgaggtgttccagg

SEQ ID NO: 121950 - DNA, 25 bp, Homo sapien
cccgcagccgctggaactgtttctg

SEQ ID NO: 121951 - DNA, 25 bp, Homo sapien
gtcgtcgccatagaaacgggtgatg

SEQ ID NO: 121952 - DNA, 25 bp, Homo sapien
tcgccatagaaacgggtgatggtgc

SEQ ID NO: 121953 - DNA, 25 bp, Homo sapien
tagaaacgggtgatggtgctctgca

SEQ ID NO: 121954 - DNA, 25 bp, Homo sapien
caggccacgcggttggccacggtct

SEQ ID NO: 121955 - DNA, 25 bp, Homo sapien
tctgggggtcgcagttgtcgtccac

SEQ ID NO: 121956 - DNA, 25 bp, Homo sapien
cgctggaactgtttctggttgatga

SEQ ID NO: 121957 - DNA, 25 bp, Homo sapien
agccgctggaactgtttctggttga

SEQ ID NO: 121958 - DNA, 25 bp, Homo sapien
ttcgagccagagcagcgagtacatt

SEQ ID NO: 121959 - DNA, 25 bp, Homo sapien
attgcgtctccgtgtggcaagggca

SEQ ID NO: 121960 - DNA, 25 bp, Homo sapien
gtctcaccgcgaggcctgacttcga

SEQ ID NO: 121961 - DNA, 25 bp, Homo sapien
ctcaagtcaggcgtcccagcagctt

SEQ ID NO: 121962 - DNA, 25 bp, Homo sapien
cggcacttggcccaagactcgtgct

SEQ ID NO: 121963 - DNA, 25 bp, Homo sapien
aggcctgacttcgagccagagcagc

SEQ ID NO: 121964 - DNA, 25 bp, Homo sapien
cgagtacattgcgtctccgtgtggc

SEQ ID NO: 121965 - DNA, 25 bp, Homo sapien
aagacaccagctggtctcaccgcga

SEQ ID NO: 121966 - DNA, 25 bp, Homo sapien
gcacttccgttcgtccgcaggcggg

SEQ ID NO: 121967 - DNA, 25 bp, Homo sapien
atagaaaggatgcaagggaacccgg

SEQ ID NO: 121968 - DNA, 25 bp, Homo sapien
agacagtcgcggacagtacctctcc

SEQ ID NO: 121969 - DNA, 25 bp, Homo sapien
agtacctctccggagctggccatgt

SEQ ID NO: 121970 - DNA, 25 bp, Homo sapien
acctgcccggctagggatgctcgaa

SEQ ID NO: 121971 - DNA, 25 bp, Homo sapien
gcgcgtccaccgctcaaccgagacc

SEQ ID NO: 121972 - DNA, 25 bp, Homo sapien
gcaaggagcgggctctcgtcacttc

SEQ ID NO: 121973 - DNA, 25 bp, Homo sapien
ccgccatgttgaatgtggctccgcc

SEQ ID NO: 121974 - DNA, 25 bp, Homo sapien
gcagttagcgccttgagtcccagcg

SEQ ID NO: 121975 - DNA, 25 bp, Homo sapien
ggccgcgttattaccataaaaggca

SEQ ID NO: 121976 - DNA, 25 bp, Homo sapien
cgcgcacgcgcaattagcgccaatt

SEQ ID NO: 121977 - DNA, 25 bp, Homo sapien
gcgcacgcagttagcgcccaaagga

SEQ ID NO: 121978 - DNA, 25 bp, Homo sapien
cccattggcaagagcccggctcaga

SEQ ID NO: 121979 - DNA, 25 bp, Homo sapien
cccagattggggacaaaggaagccg

SEQ ID NO: 121980 - DNA, 25 bp, Homo sapien
gcggccgctcgagccataaaaggca

SEQ ID NO: 121981 - DNA, 25 bp, Homo sapien
ggcaactttcggaacggcgcacgct

SEQ ID NO: 121982 - DNA, 25 bp, Homo sapien
tccataaaaggcgaggtttgggagc

SEQ ID NO: 121983 - DNA, 25 bp, Homo sapien
tcctctccataaaaggcgaggtttg

SEQ ID NO: 121984 - DNA, 25 bp, Homo sapien
tggatagttgttatcgggagctccc

SEQ ID NO: 121985 - DNA, 25 bp, Homo sapien
cgagttcctctccataaaaggcgag

SEQ ID NO: 121986 - DNA, 25 bp, Homo sapien
cccgagttcctctccataaaaggcg

SEQ ID NO: 121987 - DNA, 25 bp, Homo sapien
gcgctccgggagataagccaggccc

SEQ ID NO: 121988 - DNA, 25 bp, Homo sapien
gatagttgttatcgggagctcccag

SEQ ID NO: 121989 - DNA, 25 bp, Homo sapien
ccctcactgcgagccctcgccggcc

SEQ ID NO: 121990 - DNA, 25 bp, Homo sapien
cataaaaggcaaacggcgcgggtcg

SEQ ID NO: 121991 - DNA, 25 bp, Homo sapien
ggtcgctctgccaaacttagtcatc

SEQ ID NO: 121992 - DNA, 25 bp, Homo sapien
gtgtggccgcgactttcgaaatgcc

SEQ ID NO: 121993 - DNA, 25 bp, Homo sapien
cgactttcgaaatgcccggctgctt

SEQ ID NO: 121994 - DNA, 25 bp, Homo sapien
tccgagaaatctcagcgaggcctcc

SEQ ID NO: 121995 - DNA, 25 bp, Homo sapien
cgaggcctccttgggagaaaagtgc

SEQ ID NO: 121996 - DNA, 25 bp, Homo sapien
agaaaagtgcaaggcggtgacgtcc

SEQ ID NO: 121997 - DNA, 25 bp, Homo sapien
cggcccacgagtccgccataaaagg

SEQ ID NO: 121998 - DNA, 25 bp, Homo sapien
cacgttgtccatgaagaggcttcta

SEQ ID NO: 121999 - DNA, 25 bp, Homo sapien
agttactgcaaagaccctgacgtgg

SEQ ID NO: 122000 - DNA, 25 bp, Homo sapien
gcgctccaggtctgcagtttgtacc

SEQ ID NO: 122001 - DNA, 25 bp, Homo sapien
agttctgtggccgacatccagctca

SEQ ID NO: 122002 - DNA, 25 bp, Homo sapien
ctcggagctggcacacaatagttct

SEQ ID NO: 122003 - DNA, 25 bp, Homo sapien
gtggcctccgaagtgactcagcaga

SEQ ID NO: 122004 - DNA, 25 bp, Homo sapien
cgctgcctagtgaattgaatgactc

SEQ ID NO: 122005 - DNA, 25 bp, Homo sapien
gactcgtattgttcccaaggttgca

SEQ ID NO: 122006 - DNA, 25 bp, Homo sapien
tggcttagggcctgtcgcgctgcca

SEQ ID NO: 122007 - DNA, 25 bp, Homo sapien
actcgagcacttgaggaaggcgctg

SEQ ID NO: 122008 - DNA, 25 bp, Homo sapien
agcaccgaactcgagcacttgagga

SEQ ID NO: 122009 - DNA, 25 bp, Homo sapien
cgtagtagtgactgcgaccatggtg

SEQ ID NO: 122010 - DNA, 25 bp, Homo sapien
cacgcctcctggtcggcacaaagag

SEQ ID NO: 122011 - DNA, 25 bp, Homo sapien
atgattggtccatttccgcgaggcc

SEQ ID NO: 122012 - DNA, 25 bp, Homo sapien
ccagagcaaagacctcctatgattg

SEQ ID NO: 122013 - DNA, 25 bp, Homo sapien
caccattggcttcccagagcaaaga

SEQ ID NO: 122014 - DNA, 25 bp, Homo sapien
accggcagcctttcgcgggcgagat

SEQ ID NO: 122015 - DNA, 25 bp, Homo sapien
tctcctggtccgtgcacaaagcgca

SEQ ID NO: 122016 - DNA, 25 bp, Homo sapien
tgcggtccggagcactgcccattgc

SEQ ID NO: 122017 - DNA, 25 bp, Homo sapien
tggggctttgcccatcctcgggtgc

SEQ ID NO: 122018 - DNA, 25 bp, Homo sapien
cgcggagtcgcaaccgtacgtgcac

SEQ ID NO: 122019 - DNA, 25 bp, Homo sapien
tgatccctcggatcagctgtcccag

SEQ ID NO: 122020 - DNA, 25 bp, Homo sapien
ctgtcccagctcttgcggagtggga

SEQ ID NO: 122021 - DNA, 25 bp, Homo sapien
ggttagccaggcctttgatcccggc

SEQ ID NO: 122022 - DNA, 25 bp, Homo sapien
tttgacatcgagtggcgtgaccggc

SEQ ID NO: 122023 - DNA, 25 bp, Homo sapien
cgcgacaccaaaaagtgtgccttcc

SEQ ID NO: 122024 - DNA, 25 bp, Homo sapien
gacaccaaaaagtgtgccttccgta

SEQ ID NO: 122025 - DNA, 25 bp, Homo sapien
ccaccgcctccagcaagtgagtgcc

SEQ ID NO: 122026 - DNA, 25 bp, Homo sapien
gcaagtgagtgcctcgctcccacct

SEQ ID NO: 122027 - DNA, 25 bp, Homo sapien
cagctgctactttgacatcgagtgg

SEQ ID NO: 122028 - DNA, 25 bp, Homo sapien
tactttgacatcgagtggcgtgacc

SEQ ID NO: 122029 - DNA, 25 bp, Homo sapien
tgctactttgacatcgagtggcgtg

SEQ ID NO: 122030 - DNA, 25 bp, Homo sapien
gactataacaaggtggccatcaagg

SEQ ID NO: 122031 - DNA, 25 bp, Homo sapien
acgcaggcgtcctgaaggcctcggc

SEQ ID NO: 122032 - DNA, 25 bp, Homo sapien
gcgtcctgaaggcctcggcggaaac

SEQ ID NO: 122033 - DNA, 25 bp, Homo sapien
cacgcaggcgtcctgaaggcctcgg

SEQ ID NO: 122034 - DNA, 25 bp, Homo sapien
gaccacgcaggcgtcctgaaggcct

SEQ ID NO: 122035 - DNA, 25 bp, Homo sapien
tggccatcaaggtgggcgggcgcta

SEQ ID NO: 122036 - DNA, 25 bp, Homo sapien
ctataacaaggtggccatcaaggtg

SEQ ID NO: 122037 - DNA, 25 bp, Homo sapien
actataacaaggtggccatcaaggt

SEQ ID NO: 122038 - DNA, 25 bp, Homo sapien
gcgctacctgaagggcgaccacgca

SEQ ID NO: 122039 - DNA, 25 bp, Homo sapien
cgcggtcaccagcagcggcgacact

SEQ ID NO: 122040 - DNA, 25 bp, Homo sapien
acttcttcttcgagttctgcgacta

SEQ ID NO: 122041 - DNA, 25 bp, Homo sapien
tgtggacttcttcttcgagttctgc

SEQ ID NO: 122042 - DNA, 25 bp, Homo sapien
gacactcctgtggacttcttcttcg

SEQ ID NO: 122043 - DNA, 25 bp, Homo sapien
gcggcgacactcctgtggacttctt

SEQ ID NO: 122044 - DNA, 25 bp, Homo sapien
tgggcagtgactccgcggtcaccag

SEQ ID NO: 122045 - DNA, 25 bp, Homo sapien
cccgcctcgctctgggagtactagg

SEQ ID NO: 122046 - DNA, 25 bp, Homo sapien
ggcacagggtgaccccaccgtggct

SEQ ID NO: 122047 - DNA, 25 bp, Homo sapien
tgtagggggtctgcccctccaccag

SEQ ID NO: 122048 - DNA, 25 bp, Homo sapien
ccctcgctgagataggcccttccct

SEQ ID NO: 122049 - DNA, 25 bp, Homo sapien
aatcgtggctctcggcggaccctgg

SEQ ID NO: 122050 - DNA, 25 bp, Homo sapien
aaaatcgtggctctcggcggaccct

SEQ ID NO: 122051 - DNA, 25 bp, Homo sapien
ctgggcacagggtgaccccaccgtg

SEQ ID NO: 122052 - DNA, 25 bp, Homo sapien
aaggcccctactgggcacagggtga

SEQ ID NO: 122053 - DNA, 25 bp, Homo sapien
aaatcgtggctctcggcggaccctg

SEQ ID NO: 122054 - DNA, 25 bp, Homo sapien
gacctggcgtccagtcattgtgcgc

SEQ ID NO: 122055 - DNA, 25 bp, Homo sapien
gggacctggcgtccagtcattgtgc

SEQ ID NO: 122056 - DNA, 25 bp, Homo sapien
cctggcgtccagtcattgtgcgctg

SEQ ID NO: 122057 - DNA, 25 bp, Homo sapien
gcgtccagtcattgtgcgctgggaa

SEQ ID NO: 122058 - DNA, 25 bp, Homo sapien
tccagtcattgtgcgctgggaaggc

SEQ ID NO: 122059 - DNA, 25 bp, Homo sapien
tcattgtgcgctgggaaggcggtga

SEQ ID NO: 122060 - DNA, 25 bp, Homo sapien
gagggacctggcgtccagtcattgt

SEQ ID NO: 122061 - DNA, 25 bp, Homo sapien
ctggcgtccagtcattgtgcgctgg

SEQ ID NO: 122062 - DNA, 25 bp, Homo sapien
ccagcagcgaggtcctgtcggcaga

SEQ ID NO: 122063 - DNA, 25 bp, Homo sapien
gcggtcggtgctccagccgaaagcc

SEQ ID NO: 122064 - DNA, 25 bp, Homo sapien
tggtaccaggtgtcagaaaacagac

SEQ ID NO: 122065 - DNA, 25 bp, Homo sapien
tttctatgaacacctccggctggta

SEQ ID NO: 122066 - DNA, 25 bp, Homo sapien
cggcccaatgctggctgcaagacca

SEQ ID NO: 122067 - DNA, 25 bp, Homo sapien
cagccgctcatgagcgtgcggtttc

SEQ ID NO: 122068 - DNA, 25 bp, Homo sapien
accaggagtcgaatcccaggatcca

SEQ ID NO: 122069 - DNA, 25 bp, Homo sapien
tggctgcaagaccaggagtcgaatc

SEQ ID NO: 122070 - DNA, 25 bp, Homo sapien
ggtcccaggtgagatgcgggtcgag

SEQ ID NO: 122071 - DNA, 25 bp, Homo sapien
ggcactgcgcggaccggcagactct

SEQ ID NO: 122072 - DNA, 25 bp, Homo sapien
cacgagcgtcttctggaggagcggg

SEQ ID NO: 122073 - DNA, 25 bp, Homo sapien
cgcgtggaggccacgagcgtcttct

SEQ ID NO: 122074 - DNA, 25 bp, Homo sapien
ctccagactcgcgtggaggccacga

SEQ ID NO: 122075 - DNA, 25 bp, Homo sapien
acggttctccagactcgcgtggagg

SEQ ID NO: 122076 - DNA, 25 bp, Homo sapien
ggccacggttctccagactcgcgtg

SEQ ID NO: 122077 - DNA, 25 bp, Homo sapien
tcgagggagccaggccacggttctc

SEQ ID NO: 122078 - DNA, 25 bp, Homo sapien
taccacgtggccgagattcccgagg

SEQ ID NO: 122079 - DNA, 25 bp, Homo sapien
taggagctgcccaactgaaagggac

SEQ ID NO: 122080 - DNA, 25 bp, Homo sapien
aggaatcggtaggagctgcccaact

SEQ ID NO: 122081 - DNA, 25 bp, Homo sapien
ttcacgagatctctcgggaggaatc

SEQ ID NO: 122082 - DNA, 25 bp, Homo sapien
tggaagggccgttcacgagatctct

SEQ ID NO: 122083 - DNA, 25 bp, Homo sapien
caatgagcagcatagtccgatgggg

SEQ ID NO: 122084 - DNA, 25 bp, Homo sapien
cgtggccgagattcccgaggctgca

SEQ ID NO: 122085 - DNA, 25 bp, Homo sapien
agccaatgagcagcatagtccgatg

SEQ ID NO: 122086 - DNA, 25 bp, Homo sapien
ctcgccaccgcaccgggctcgagac

SEQ ID NO: 122087 - DNA, 25 bp, Homo sapien
tcagcgcctttgtcgctccagcctc

SEQ ID NO: 122088 - DNA, 25 bp, Homo sapien
gggctgttgccctcgcgcagcagac

SEQ ID NO: 122089 - DNA, 25 bp, Homo sapien
actttcgcggaacacgcgctccaga

SEQ ID NO: 122090 - DNA, 25 bp, Homo sapien
agtcgccaactttcgcggaacacgc

SEQ ID NO: 122091 - DNA, 25 bp, Homo sapien
ccagagtcttggatccctggtcctg

SEQ ID NO: 122092 - DNA, 25 bp, Homo sapien
ttggttgcaagtggcccagagtctt

SEQ ID NO: 122093 - DNA, 25 bp, Homo sapien
gcacgctccagggttggttgcaagt

SEQ ID NO: 122094 - DNA, 25 bp, Homo sapien
cgctacaggtagtgggtccggagca

SEQ ID NO: 122095 - DNA, 25 bp, Homo sapien
tacaggtagtgggtccggagcagcg

SEQ ID NO: 122096 - DNA, 25 bp, Homo sapien
acgctacaggtagtgggtccggagc

SEQ ID NO: 122097 - DNA, 25 bp, Homo sapien
ggacgctacaggtagtgggtccgga

SEQ ID NO: 122098 - DNA, 25 bp, Homo sapien
acacctcagacacgcgttgtggggg

SEQ ID NO: 122099 - DNA, 25 bp, Homo sapien
ctcttcctacggcgactgacacctc

SEQ ID NO: 122100 - DNA, 25 bp, Homo sapien
agactcttcctacggcgactgacac

SEQ ID NO: 122101 - DNA, 25 bp, Homo sapien
cagactcttcctacggcgactgaca

SEQ ID NO: 122102 - DNA, 25 bp, Homo sapien
atcttccggaagacacgcctgtgtg

SEQ ID NO: 122103 - DNA, 25 bp, Homo sapien
cacgccggagcgaagccttacaagt

SEQ ID NO: 122104 - DNA, 25 bp, Homo sapien
gtgagaaaacctcccacaagtcgcg

SEQ ID NO: 122105 - DNA, 25 bp, Homo sapien
gaaaggcctttttccagaagtcaca

SEQ ID NO: 122106 - DNA, 25 bp, Homo sapien
caccacgggatccacacgagggaga

SEQ ID NO: 122107 - DNA, 25 bp, Homo sapien
cgtgggatcgtcacaaagtcacatc

SEQ ID NO: 122108 - DNA, 25 bp, Homo sapien
tcgccgaacctctaggagggacatc

SEQ ID NO: 122109 - DNA, 25 bp, Homo sapien
agtcacatcacgaggtcgccgaacc

SEQ ID NO: 122110 - DNA, 25 bp, Homo sapien
cgctgcgaggcggattctttttccg

SEQ ID NO: 122111 - DNA, 25 bp, Homo sapien
gctgcgaggcggattctttttccgg

SEQ ID NO: 122112 - DNA, 25 bp, Homo sapien
ctgcgaggcggattctttttccggg

SEQ ID NO: 122113 - DNA, 25 bp, Homo sapien
tgcgaggcggattctttttccgggc

SEQ ID NO: 122114 - DNA, 25 bp, Homo sapien
gattctttttccgggcctgcggcga

SEQ ID NO: 122115 - DNA, 25 bp, Homo sapien
attctttttccgggcctgcggcgag

SEQ ID NO: 122116 - DNA, 25 bp, Homo sapien
ttcgggccgcgcgaaggacaggtat

SEQ ID NO: 122117 - DNA, 25 bp, Homo sapien
gggccgcgcgaaggacaggtatgcg

SEQ ID NO: 122118 - DNA, 25 bp, Homo sapien
gacattcttcacaaagtcgccctga

SEQ ID NO: 122119 - DNA, 25 bp, Homo sapien
gccgtggttcatcgggacattcttc

SEQ ID NO: 122120 - DNA, 25 bp, Homo sapien
cggccacgtgtacacgccgtggttc

SEQ ID NO: 122121 - DNA, 25 bp, Homo sapien
tgccgttgaccacttcgccttcata

SEQ ID NO: 122122 - DNA, 25 bp, Homo sapien
ccgaatccgttcctcatgccgttga

SEQ ID NO: 122123 - DNA, 25 bp, Homo sapien
gtgctgcacttgaacatcccgaatc

SEQ ID NO: 122124 - DNA, 25 bp, Homo sapien
gcaccagtggccgatgtaggacaca

SEQ ID NO: 122125 - DNA, 25 bp, Homo sapien
cgtgccgcttgccattgcaccagtg

SEQ ID NO: 122126 - DNA, 25 bp, Homo sapien
gaagaatcggctccctgcactggtc

SEQ ID NO: 122127 - DNA, 25 bp, Homo sapien
ctgcactggtctgcccggcctaggc

SEQ ID NO: 122128 - DNA, 25 bp, Homo sapien
ggcctaggccctcctcgcccatcac

SEQ ID NO: 122129 - DNA, 25 bp, Homo sapien
tcgcccatcacgcacgtgctcgggt

SEQ ID NO: 122130 - DNA, 25 bp, Homo sapien
agcaggacccagtcgccatggctgt

SEQ ID NO: 122131 - DNA, 25 bp, Homo sapien
gttgccgggctctcggcgtcccaga

SEQ ID NO: 122132 - DNA, 25 bp, Homo sapien
gcccaccctgtgctcttaaaggggc

SEQ ID NO: 122133 - DNA, 25 bp, Homo sapien
cgcgccagcgccaagcaggtgtccc

SEQ ID NO: 122134 - DNA, 25 bp, Homo sapien
ccaaggggcacgagatcgctgcaac

SEQ ID NO: 122135 - DNA, 25 bp, Homo sapien
ggcctcaaggcgcacccaaggggca

SEQ ID NO: 122136 - DNA, 25 bp, Homo sapien
caacgtgcacggcaggagctacggc

SEQ ID NO: 122137 - DNA, 25 bp, Homo sapien
cccttttgctttggttctgccatgc

SEQ ID NO: 122138 - DNA, 25 bp, Homo sapien
gcgttggcctttggcacgcgctacc

SEQ ID NO: 122139 - DNA, 25 bp, Homo sapien
tcgtgacctctgacggtttctgagc

SEQ ID NO: 122140 - DNA, 25 bp, Homo sapien
gttggaatgccgtgggtctcaaaga

SEQ ID NO: 122141 - DNA, 25 bp, Homo sapien
tcgctgcaacactgaggtcgccact

SEQ ID NO: 122142 - DNA, 25 bp, Homo sapien
gccacacatctggagcccgatagga

SEQ ID NO: 122143 - DNA, 25 bp, Homo sapien
gcgccacacatctggagcccgatag

SEQ ID NO: 122144 - DNA, 25 bp, Homo sapien
cgccacacatctggagcccgatagg

SEQ ID NO: 122145 - DNA, 25 bp, Homo sapien
ccacacatctggagcccgataggaa

SEQ ID NO: 122146 - DNA, 25 bp, Homo sapien
acacatctggagcccgataggaagg

SEQ ID NO: 122147 - DNA, 25 bp, Homo sapien
cacatctggagcccgataggaagga

SEQ ID NO: 122148 - DNA, 25 bp, Homo sapien
agcgccacacatctggagcccgata

SEQ ID NO: 122149 - DNA, 25 bp, Homo sapien
cacacatctggagcccgataggaag

SEQ ID NO: 122150 - DNA, 25 bp, Homo sapien
gccggttcaaccctggaggcagcca

SEQ ID NO: 122151 - DNA, 25 bp, Homo sapien
cctttgccgcccagaaacgcaggtg

SEQ ID NO: 122152 - DNA, 25 bp, Homo sapien
tcaccgtcatattcggggtccgggc

SEQ ID NO: 122153 - DNA, 25 bp, Homo sapien
tgccacactccgatgctgcagctag

SEQ ID NO: 122154 - DNA, 25 bp, Homo sapien
agctagcgccgtccgacccggaagt

SEQ ID NO: 122155 - DNA, 25 bp, Homo sapien
tggaggcagccaaagtcgcccaggt

SEQ ID NO: 122156 - DNA, 25 bp, Homo sapien
cgccctttatcagacaagaagagtt

SEQ ID NO: 122157 - DNA, 25 bp, Homo sapien
gctgtagcagactccgccctttatc

SEQ ID NO: 122158 - DNA, 25 bp, Homo sapien
acccatggcgcatgctctctggtgg

SEQ ID NO: 122159 - DNA, 25 bp, Homo sapien
cttctcctttccgactgggcaggcg

SEQ ID NO: 122160 - DNA, 25 bp, Homo sapien
gaagtagcccttctccagacgtaag

SEQ ID NO: 122161 - DNA, 25 bp, Homo sapien
gctaacggaggtgagctggacacac

SEQ ID NO: 122162 - DNA, 25 bp, Homo sapien
tcggtgctagcgttcagcggctaac

SEQ ID NO: 122163 - DNA, 25 bp, Homo sapien
cgtatacctccgctttaagatgaga

SEQ ID NO: 122164 - DNA, 25 bp, Homo sapien
gagagaatcttctgtcggtgctagc

SEQ ID NO: 122165 - DNA, 25 bp, Homo sapien
tgctgaaagccgactgcgcctacgt

SEQ ID NO: 122166 - DNA, 25 bp, Homo sapien
gcggcgtcagaaactcggatcttcc

SEQ ID NO: 122167 - DNA, 25 bp, Homo sapien
acacgcggcgtcagaaactcggatc

SEQ ID NO: 122168 - DNA, 25 bp, Homo sapien
cgcagcgtcagaaactcggatcttc

SEQ ID NO: 122169 - DNA, 25 bp, Homo sapien
acgcggcgtcagaaactcggatctt

SEQ ID NO: 122170 - DNA, 25 bp, Homo sapien
gcgcagcgtcagaaactcggatctt

SEQ ID NO: 122171 - DNA, 25 bp, Homo sapien
aaactcgatcttcctggcgtggccg

SEQ ID NO: 122172 - DNA, 25 bp, Homo sapien
gtcacgcagcgtcagaaactcgatc

SEQ ID NO: 122173 - DNA, 25 bp, Homo sapien
cacgcggcgtcagaaactcggatct

SEQ ID NO: 122174 - DNA, 25 bp, Homo sapien
tggaaacgcatctggggtcaagcgc

SEQ ID NO: 122175 - DNA, 25 bp, Homo sapien
gacggggatcccagactcctgcgtc

SEQ ID NO: 122176 - DNA, 25 bp, Homo sapien
cggaggatttctcggagccaagtcc

SEQ ID NO: 122177 - DNA, 25 bp, Homo sapien
cacactcgccgtgcttgttagctgc

SEQ ID NO: 122178 - DNA, 25 bp, Homo sapien
ttcgcccacggctcttgggcgacga

SEQ ID NO: 122179 - DNA, 25 bp, Homo sapien
gaggcgaaagcccaaagtcctacgc

SEQ ID NO: 122180 - DNA, 25 bp, Homo sapien
cgaagcccacgaagcggaggatttc

SEQ ID NO: 122181 - DNA, 25 bp, Homo sapien
tcaagcgcaggacgaggcgaaagcc

SEQ ID NO: 122182 - DNA, 25 bp, Homo sapien
gcctagccacctggctgctccgtgg

SEQ ID NO: 122183 - DNA, 25 bp, Homo sapien
cagaggcaaagttttcccaccttgg

SEQ ID NO: 122184 - DNA, 25 bp, Homo sapien
catccctaacagaggcaaagttttc

SEQ ID NO: 122185 - DNA, 25 bp, Homo sapien
tgcatccctaacagaggcaaagttt

SEQ ID NO: 122186 - DNA, 25 bp, Homo sapien
ccactgcatccctaacagaggcaaa

SEQ ID NO: 122187 - DNA, 25 bp, Homo sapien
tgtgctggccgctgaccgcggagtc

SEQ ID NO: 122188 - DNA, 25 bp, Homo sapien
cgctgaccgcggagtccggcgtccc

SEQ ID NO: 122189 - DNA, 25 bp, Homo sapien
tccgtggagagtccgaggtgcccac

SEQ ID NO: 122190 - DNA, 25 bp, Homo sapien
gcttaacaggcgatgcgagcccgtt

SEQ ID NO: 122191 - DNA, 25 bp, Homo sapien
gacctgtgtgatcccgggagcttaa

SEQ ID NO: 122192 - DNA, 25 bp, Homo sapien
cccaggacgcaaaggggatgatcgc

SEQ ID NO: 122193 - DNA, 25 bp, Homo sapien
atcggcagcctcagaaaggtggacc

SEQ ID NO: 122194 - DNA, 25 bp, Homo sapien
tgggcaggtgcagtcaccaccactc

SEQ ID NO: 122195 - DNA, 25 bp, Homo sapien
agctggactgggtcagacaccacta

SEQ ID NO: 122196 - DNA, 25 bp, Homo sapien
caccactacaccgagggcgagcgtg

SEQ ID NO: 122197 - DNA, 25 bp, Homo sapien
ggtgccggtactaccatgacaggta

SEQ ID NO: 122198 - DNA, 25 bp, Homo sapien
agggaggttgaacgtgatcttgttt

SEQ ID NO: 122199 - DNA, 25 bp, Homo sapien
gtccttctgagaaggccgctgcccg

SEQ ID NO: 122200 - DNA, 25 bp, Homo sapien
gactgaggagcctttcttgtccttc

SEQ ID NO: 122201 - DNA, 25 bp, Homo sapien
ggcgcttctgctgcgagcagactga

SEQ ID NO: 122202 - DNA, 25 bp, Homo sapien
gacagggtttgcagctggcgcttct

SEQ ID NO: 122203 - DNA, 25 bp, Homo sapien
tcccactgcaccgatgacagggttt

SEQ ID NO: 122204 - DNA, 25 bp, Homo sapien
tgtggtggccctgtgtttccgtccc

SEQ ID NO: 122205 - DNA, 25 bp, Homo sapien
gatcttgtttgcctcgtgtctcggg

SEQ ID NO: 122206 - DNA, 25 bp, Homo sapien
gcacgaggccttggggataccacct

SEQ ID NO: 122207 - DNA, 25 bp, Homo sapien
gcctcgaggatcagtctgggccacg

SEQ ID NO: 122208 - DNA, 25 bp, Homo sapien
gatggtcgcaggaaggaaatgcttc

SEQ ID NO: 122209 - DNA, 25 bp, Homo sapien
ccgtcccgtgtctgctgtggagaca

SEQ ID NO: 122210 - DNA, 25 bp, Homo sapien
aatgaggctcccgtctgtggaatcc

SEQ ID NO: 122211 - DNA, 25 bp, Homo sapien
ttggcatggtacgaatgaggctccc

SEQ ID NO: 122212 - DNA, 25 bp, Homo sapien
ccgagtgaatgcgtttggcatggta

SEQ ID NO: 122213 - DNA, 25 bp, Homo sapien
cacggtatgctctggagcagcagct

SEQ ID NO: 122214 - DNA, 25 bp, Homo sapien
acagaccactgcgttttcagaaagg

SEQ ID NO: 122215 - DNA, 25 bp, Homo sapien
agtctgcgctccgtgcacagggagc

SEQ ID NO: 122216 - DNA, 25 bp, Homo sapien
ttcacacgccctcctagaagcagaa

SEQ ID NO: 122217 - DNA, 25 bp, Homo sapien
gtcaggatgaaccaccggcgcttcc

SEQ ID NO: 122218 - DNA, 25 bp, Homo sapien
cgttttcagaaaggccaccaggcgc

SEQ ID NO: 122219 - DNA, 25 bp, Homo sapien
cgccaggcttgggttcaggtgtcct

SEQ ID NO: 122220 - DNA, 25 bp, Homo sapien
gttcaggtgtccttcagcgttccca

SEQ ID NO: 122221 - DNA, 25 bp, Homo sapien
ttgatgacacaaccgcgctacaatt

SEQ ID NO: 122222 - DNA, 25 bp, Homo sapien
ttttaacgtctctgcctgcggtggg

SEQ ID NO: 122223 - DNA, 25 bp, Homo sapien
cgccctcgttgatgccgcggttcat

SEQ ID NO: 122224 - DNA, 25 bp, Homo sapien
tgcggccgctcacagcgaagagatc

SEQ ID NO: 122225 - DNA, 25 bp, Homo sapien
ggctcgttcttaatgctctcataca

SEQ ID NO: 122226 - DNA, 25 bp, Homo sapien
ctccgggatcttaaatggctcgttc

SEQ ID NO: 122227 - DNA, 25 bp, Homo sapien
acgtagcacgtgtctgcaacgagtc

SEQ ID NO: 122228 - DNA, 25 bp, Homo sapien
gggctcagccagaacctccagtgga

SEQ ID NO: 122229 - DNA, 25 bp, Homo sapien
gggcattcctacgatgagcctggga

SEQ ID NO: 122230 - DNA, 25 bp, Homo sapien
tggacaggcgccagcacatttctgc

SEQ ID NO: 122231 - DNA, 25 bp, Homo sapien
ccgcgctcctctaggctgcaaaggg

SEQ ID NO: 122232 - DNA, 25 bp, Homo sapien
ccggttttcgcggttctcagcgata

SEQ ID NO: 122233 - DNA, 25 bp, Homo sapien
tctgaaagctcctcggggttacgtc

SEQ ID NO: 122234 - DNA, 25 bp, Homo sapien
tcgcttttcctctcgccgcttttgg

SEQ ID NO: 122235 - DNA, 25 bp, Homo sapien
agtctccattttcagcagcgccata

SEQ ID NO: 122236 - DNA, 25 bp, Homo sapien
tcgttcttcactcaaggttaggtcc

SEQ ID NO: 122237 - DNA, 25 bp, Homo sapien
gttaggtcctcgctagtgccagaga

SEQ ID NO: 122238 - DNA, 25 bp, Homo sapien
tctgtcgcgtctgccgtttcctaaa

SEQ ID NO: 122239 - DNA, 25 bp, Homo sapien
ggcatgaacgcccttggcgacaaga

SEQ ID NO: 122240 - DNA, 25 bp, Homo sapien
cgaggagcctccagtgcaaaacttt

SEQ ID NO: 122241 - DNA, 25 bp, Homo sapien
agcagactgtcacgctttccaaccg

SEQ ID NO: 122242 - DNA, 25 bp, Homo sapien
agcgaccgtttctgacccaaagcca

SEQ ID NO: 122243 - DNA, 25 bp, Homo sapien
aacgtctaccctgaactgaactcca

SEQ ID NO: 122244 - DNA, 25 bp, Homo sapien
gccgccgtcttcatccatcttgagg

SEQ ID NO: 122245 - DNA, 25 bp, Homo sapien
gttcgagcaaatccagcgaccgttt

SEQ ID NO: 122246 - DNA, 25 bp, Homo sapien
tggacacgcccttgccacctttctt

SEQ ID NO: 122247 - DNA, 25 bp, Homo sapien
aagatgagcagcgtgcgagtcagcc

SEQ ID NO: 122248 - DNA, 25 bp, Homo sapien
cagtggagcggagtccgcacgtcac

SEQ ID NO: 122249 - DNA, 25 bp, Homo sapien
tcggagaagtgcctccgcgagcagc

SEQ ID NO: 122250 - DNA, 25 bp, Homo sapien
tggccgcgcagcctgacgtcacaaa

SEQ ID NO: 122251 - DNA, 25 bp, Homo sapien
ctttctttttggcaggtaagacgcg

SEQ ID NO: 122252 - DNA, 25 bp, Homo sapien
gtcgaggctgatgcgctgtctccgt

SEQ ID NO: 122253 - DNA, 25 bp, Homo sapien
ttttggcaggtaagacgcgcatgcg

SEQ ID NO: 122254 - DNA, 25 bp, Homo sapien
ctgcagttttcctcagctttgggtg

SEQ ID NO: 122255 - DNA, 25 bp, Homo sapien
agcgcttccgagcattcccgaagtc

SEQ ID NO: 122256 - DNA, 25 bp, Homo sapien
agtggagcggccatttcctgtttct

SEQ ID NO: 122257 - DNA, 25 bp, Homo sapien
catcggcttccagtccgcggagggc

SEQ ID NO: 122258 - DNA, 25 bp, Homo sapien
cctggttccggctctcgatggagga

SEQ ID NO: 122259 - DNA, 25 bp, Homo sapien
gccggctagagggaaaagtgaactc

SEQ ID NO: 122260 - DNA, 25 bp, Homo sapien
tcctcgggagcgctcgtagagcaag

SEQ ID NO: 122261 - DNA, 25 bp, Homo sapien
agcggccctgatgcaggccatcaag

SEQ ID NO: 122262 - DNA, 25 bp, Homo sapien
ggcctcacctgggatccagattcga

SEQ ID NO: 122263 - DNA, 25 bp, Homo sapien
attaccataagcgatcatgcaaagg

SEQ ID NO: 122264 - DNA, 25 bp, Homo sapien
atccagattcgaggccggaagagca

SEQ ID NO: 122265 - DNA, 25 bp, Homo sapien
caagactggataagaaccgggtttg

SEQ ID NO: 122266 - DNA, 25 bp, Homo sapien
gtggacgtgcaaagccctcccgtgc

SEQ ID NO: 122267 - DNA, 25 bp, Homo sapien
gggcaccgcagtcctattaccataa

SEQ ID NO: 122268 - DNA, 25 bp, Homo sapien
gcagtgtccagacagctgcatggag

SEQ ID NO: 122269 - DNA, 25 bp, Homo sapien
gcagggagatcagaggaagaaataa

SEQ ID NO: 122270 - DNA, 25 bp, Homo sapien
gccttgaagacagcgagcctgccta

SEQ ID NO: 122271 - DNA, 25 bp, Homo sapien
attgcgtagccacctcatccagatg

SEQ ID NO: 122272 - DNA, 25 bp, Homo sapien
gctcgggtttctgactcgtctccca

SEQ ID NO: 122273 - DNA, 25 bp, Homo sapien
tgtttaccgctgaaaggcacgcctg

SEQ ID NO: 122274 - DNA, 25 bp, Homo sapien
cacgcctgctgccaaatttgaggtg

SEQ ID NO: 122275 - DNA, 25 bp, Homo sapien
agctcaccgagaaaaaagcactgtg

SEQ ID NO: 122276 - DNA, 25 bp, Homo sapien
tgccctccgttctgcagcagagatg

SEQ ID NO: 122277 - DNA, 25 bp, Homo sapien
agctttgcaaaacgggccgctgctg

SEQ ID NO: 122278 - DNA, 25 bp, Homo sapien
ctgtaaaatacctggagtgctcggc

SEQ ID NO: 122279 - DNA, 25 bp, Homo sapien
tacattgccgtgtggtcgtgtttcc

SEQ ID NO: 122280 - DNA, 25 bp, Homo sapien
cctcccgctggtggtgtgatcagaa

SEQ ID NO: 122281 - DNA, 25 bp, Homo sapien
gaagcgatccgagcagtcctctgcc

SEQ ID NO: 122282 - DNA, 25 bp, Homo sapien
gacagtgtttgacgaagcgatccga

SEQ ID NO: 122283 - DNA, 25 bp, Homo sapien
cagcgaggcctcaagacagtgtttg

SEQ ID NO: 122284 - DNA, 25 bp, Homo sapien
tcgtgtttcctgtaggtgctgtaaa

SEQ ID NO: 122285 - DNA, 25 bp, Homo sapien
agtgctcggcgctcacacagcgagg

SEQ ID NO: 122286 - DNA, 25 bp, Homo sapien
cagctcgaagaaccctgggaagacc

SEQ ID NO: 122287 - DNA, 25 bp, Homo sapien
gaagaccaagtcgtcgctggcgatg

SEQ ID NO: 122288 - DNA, 25 bp, Homo sapien
aaggtcccgtagctcgcactcagga

SEQ ID NO: 122289 - DNA, 25 bp, Homo sapien
ccaccaaattatcggcgctcaagcg

SEQ ID NO: 122290 - DNA, 25 bp, Homo sapien
cgcatgctcacgctgaggccgagat

SEQ ID NO: 122291 - DNA, 25 bp, Homo sapien
cgctggctgagtcgattgcaggtct

SEQ ID NO: 122292 - DNA, 25 bp, Homo sapien
cctgcgcagaaacgctgatccggaa

SEQ ID NO: 122293 - DNA, 25 bp, Homo sapien
agcactcgcacgaccagctcgaaga

SEQ ID NO: 122294 - DNA, 25 bp, Homo sapien
gtcccattgattcgcgggtttcctg

SEQ ID NO: 122295 - DNA, 25 bp, Homo sapien
cttcagcagcaggatgacgatggcc

SEQ ID NO: 122296 - DNA, 25 bp, Homo sapien
aagatggcgagatcgcccgcgacgt

SEQ ID NO: 122297 - DNA, 25 bp, Homo sapien
cccagtcagccggaaaatgttcatg

SEQ ID NO: 122298 - DNA, 25 bp, Homo sapien
cgcaggagcgcgtcttccagatctt

SEQ ID NO: 122299 - DNA, 25 bp, Homo sapien
agctcaagttcacgcggggaccgac

SEQ ID NO: 122300 - DNA, 25 bp, Homo sapien
ggtgcgctccgacagctcaagttca

SEQ ID NO: 122301 - DNA, 25 bp, Homo sapien
cgccaacttttcagacacagcaggg

SEQ ID NO: 122302 - DNA, 25 bp, Homo sapien
ggggctccatgctcatcagcacctg

SEQ ID NO: 122303 - DNA, 25 bp, Homo sapien
tggtcgcggcacctgcaggacgaac

SEQ ID NO: 122304 - DNA, 25 bp, Homo sapien
gggctccatgctcatcagcacctgg

SEQ ID NO: 122305 - DNA, 25 bp, Homo sapien
aggacgaactggtccggctcgctga

SEQ ID NO: 122306 - DNA, 25 bp, Homo sapien
gcaggacgaactggtccggctcgct

SEQ ID NO: 122307 - DNA, 25 bp, Homo sapien
cctgcaggacgaactggtccggctc

SEQ ID NO: 122308 - DNA, 25 bp, Homo sapien
cacctgcaggacgaactggtccggc

SEQ ID NO: 122309 - DNA, 25 bp, Homo sapien
cggcacctgcaggacgaactggtcc

SEQ ID NO: 122310 - DNA, 25 bp, Homo sapien
ttgaggctggaaggacaagaaacgc

SEQ ID NO: 122311 - DNA, 25 bp, Homo sapien
caatattggcctgggctaaggggaa

SEQ ID NO: 122312 - DNA, 25 bp, Homo sapien
cgcttcaatattggcctgggctaag

SEQ ID NO: 122313 - DNA, 25 bp, Homo sapien
caagaaacgcggacggggacaagag

SEQ ID NO: 122314 - DNA, 25 bp, Homo sapien
ccttgaggctggaaggacaagaaac

SEQ ID NO: 122315 - DNA, 25 bp, Homo sapien
ccggatgggacccaagacggagagg

SEQ ID NO: 122316 - DNA, 25 bp, Homo sapien
cttcaggtgtgccaagaggatggct

SEQ ID NO: 122317 - DNA, 25 bp, Homo sapien
gagaggacggcgcttcaatattggc

SEQ ID NO: 122318 - DNA, 25 bp, Homo sapien
ggccctgaaatagagacggtctttc

SEQ ID NO: 122319 - DNA, 25 bp, Homo sapien
cctggcgggtaggagcaaggaaact

SEQ ID NO: 122320 - DNA, 25 bp, Homo sapien
ctttcagcgaccgatttaagggtga

SEQ ID NO: 122321 - DNA, 25 bp, Homo sapien
cagcgaccgatttaagggtgaggac

SEQ ID NO: 122322 - DNA, 25 bp, Homo sapien
agacggtctttcagcgaccgattta

SEQ ID NO: 122323 - DNA, 25 bp, Homo sapien
cgggccctgaaatagagacggtctt

SEQ ID NO: 122324 - DNA, 25 bp, Homo sapien
ttcggctacagggaggagaccgaat

SEQ ID NO: 122325 - DNA, 25 bp, Homo sapien
aagcttccaggtgggcttcggctac

SEQ ID NO: 122326 - DNA, 25 bp, Homo sapien
gtgcatcccagggcatccgtgcatc

SEQ ID NO: 122327 - DNA, 25 bp, Homo sapien
tgcatcccagggcatccgtgcatcc

SEQ ID NO: 122328 - DNA, 25 bp, Homo sapien
gcgtgcatcccagggcatccgtgca

SEQ ID NO: 122329 - DNA, 25 bp, Homo sapien
tgcgtgcatcccagggcatccgtgc

SEQ ID NO: 122330 - DNA, 25 bp, Homo sapien
gtgcgtgcatcccagggcatccgtg

SEQ ID NO: 122331 - DNA, 25 bp, Homo sapien
agccgtgcgtgcatcccagggcatc

SEQ ID NO: 122332 - DNA, 25 bp, Homo sapien
cagccgtgcgtgcatcccagggcat

SEQ ID NO: 122333 - DNA, 25 bp, Homo sapien
catcccagggcatccgtgcatccgt

SEQ ID NO: 122334 - DNA, 25 bp, Homo sapien
aagcggtcagtatcgcggcttcgca

SEQ ID NO: 122335 - DNA, 25 bp, Homo sapien
tcagtatcgcggcttcgcacagggt

SEQ ID NO: 122336 - DNA, 25 bp, Homo sapien
tcctcgtagtcgttctccggggtca

SEQ ID NO: 122337 - DNA, 25 bp, Homo sapien
ttctccggggtcaggaaatcatcca

SEQ ID NO: 122338 - DNA, 25 bp, Homo sapien
gctcagcacgtccaggaagcggtca

SEQ ID NO: 122339 - DNA, 25 bp, Homo sapien
aggaaatcatccacgatggtgaccc

SEQ ID NO: 122340 - DNA, 25 bp, Homo sapien
cggggtcaggaaatcatccacgatg

SEQ ID NO: 122341 - DNA, 25 bp, Homo sapien
cacgtccaggaagcggtcagtatcg

SEQ ID NO: 122342 - DNA, 25 bp, Homo sapien
cccacctcttcctaggagtggcgga

SEQ ID NO: 122343 - DNA, 25 bp, Homo sapien
taggacttggcgtcctgctcgcttc

SEQ ID NO: 122344 - DNA, 25 bp, Homo sapien
tcttggggatgaagatcctgccggc

SEQ ID NO: 122345 - DNA, 25 bp, Homo sapien
cccggtgcttcttggggatgaagat

SEQ ID NO: 122346 - DNA, 25 bp, Homo sapien
tgagacaccacctcgtcgaagcgcg

SEQ ID NO: 122347 - DNA, 25 bp, Homo sapien
cgtgcgcggcacagcttgcccagga

SEQ ID NO: 122348 - DNA, 25 bp, Homo sapien
tcacctcgggaatggcccgttcgga

SEQ ID NO: 122349 - DNA, 25 bp, Homo sapien
tcctgctcgcttcacctcgggaatg

SEQ ID NO: 122350 - DNA, 25 bp, Homo sapien
gtgccgagagaagccctggtccttc

SEQ ID NO: 122351 - DNA, 25 bp, Homo sapien
gacccttttggtcgctctggggtgc

SEQ ID NO: 122352 - DNA, 25 bp, Homo sapien
gttctgagcgcccaacgcttagacc

SEQ ID NO: 122353 - DNA, 25 bp, Homo sapien
cgctttcagaccagcccgaggcgga

SEQ ID NO: 122354 - DNA, 25 bp, Homo sapien
ctctttagggccacgcacgggttct

SEQ ID NO: 122355 - DNA, 25 bp, Homo sapien
accgaaagtgccgagagaagccctg

SEQ ID NO: 122356 - DNA, 25 bp, Homo sapien
cctgctgggacccttttggtcgctc

SEQ ID NO: 122357 - DNA, 25 bp, Homo sapien
acgcgatggggaagctaccgaaagt

SEQ ID NO: 122358 - DNA, 25 bp, Homo sapien
cgctgcccaggctctaaatcgagcg

SEQ ID NO: 122359 - DNA, 25 bp, Homo sapien
acttgacacgcgcttacagcagagg

SEQ ID NO: 122360 - DNA, 25 bp, Homo sapien
gctgccgtttcaagctgcggggact

SEQ ID NO: 122361 - DNA, 25 bp, Homo sapien
gctctaaatcgagcgcgcccaaggg

SEQ ID NO: 122362 - DNA, 25 bp, Homo sapien
ggcaggaacagacaccggcagcgct

SEQ ID NO: 122363 - DNA, 25 bp, Homo sapien
cagccgggagacgagcgagccaact

SEQ ID NO: 122364 - DNA, 25 bp, Homo sapien
agacgagcgagccaacttcctgggg

SEQ ID NO: 122365 - DNA, 25 bp, Homo sapien
cgcttacagcagaggctgccgtttc

SEQ ID NO: 122366 - DNA, 25 bp, Homo sapien
gctcgcggctcagaccgcccaccgc

SEQ ID NO: 122367 - DNA, 25 bp, Homo sapien
cgcacgaggcgctcgcggctcagac

SEQ ID NO: 122368 - DNA, 25 bp, Homo sapien
gagcacgcccagactgggcggcaca

SEQ ID NO: 122369 - DNA, 25 bp, Homo sapien
cccgcaagactgtggtcggggccgc

SEQ ID NO: 122370 - DNA, 25 bp, Homo sapien
ggctgaactcttgggccttgcgcct

SEQ ID NO: 122371 - DNA, 25 bp, Homo sapien
gcgccttaccttgcggctgaactct

SEQ ID NO: 122372 - DNA, 25 bp, Homo sapien
cctccaggatctggtctcctggccg

SEQ ID NO: 122373 - DNA, 25 bp, Homo sapien
ctggccgcagtcctccggcatgcgc

SEQ ID NO: 122374 - DNA, 25 bp, Homo sapien
cgtagccgcctcgtcattggccaga

SEQ ID NO: 122375 - DNA, 25 bp, Homo sapien
gggcagagccctccgcgatgcagac

SEQ ID NO: 122376 - DNA, 25 bp, Homo sapien
agatgcacacacctttccgaagatg

SEQ ID NO: 122377 - DNA, 25 bp, Homo sapien
acctttccgaagatgcagacccttc

SEQ ID NO: 122378 - DNA, 25 bp, Homo sapien
tcagaccctctcatggagatgcaga

SEQ ID NO: 122379 - DNA, 25 bp, Homo sapien
cgtcattggccagaacgcttcgggt

SEQ ID NO: 122380 - DNA, 25 bp, Homo sapien
actggtgaaggcctgcgttgctccc

SEQ ID NO: 122381 - DNA, 25 bp, Homo sapien
aacgtagaccgcgtatctgaggggc

SEQ ID NO: 122382 - DNA, 25 bp, Homo sapien
aggaagtctcgtatcgcgcccggga

SEQ ID NO: 122383 - DNA, 25 bp, Homo sapien
ggccctcgcacacttccgccggaag

SEQ ID NO: 122384 - DNA, 25 bp, Homo sapien
cgcaggaagtctcgtatcgcgcccg

SEQ ID NO: 122385 - DNA, 25 bp, Homo sapien
ctgatgtcacgagcccgcaggaagt

SEQ ID NO: 122386 - DNA, 25 bp, Homo sapien
gccgtgctgatgtcacgagcccgca

SEQ ID NO: 122387 - DNA, 25 bp, Homo sapien
ccagcggttacacccggccacggag

SEQ ID NO: 122388 - DNA, 25 bp, Homo sapien
gggaggtcactgttactccagcccc

SEQ ID NO: 122389 - DNA, 25 bp, Homo sapien
tccccttgtgtgtagggccgccgtc

SEQ ID NO: 122390 - DNA, 25 bp, Homo sapien
tcgcgcctctttgtttccacgggta

SEQ ID NO: 122391 - DNA, 25 bp, Homo sapien
tggacatctacttcagcagccagct

SEQ ID NO: 122392 - DNA, 25 bp, Homo sapien
cgccgccaaggaggtgttgtaccac

SEQ ID NO: 122393 - DNA, 25 bp, Homo sapien
cagggaacccaagtccgctggccga

SEQ ID NO: 122394 - DNA, 25 bp, Homo sapien
agcggcagctctgaacgcgacgcac

SEQ ID NO: 122395 - DNA, 25 bp, Homo sapien
cgtgaaatcaaccagcggcagctct

SEQ ID NO: 122396 - DNA, 25 bp, Homo sapien
tgctggtggaaagcaccgtgaaatc

SEQ ID NO: 122397 - DNA, 25 bp, Homo sapien
cccagcgatgcagggctgtgtcaag

SEQ ID NO: 122398 - DNA, 25 bp, Homo sapien
gactctgaatttcggggtcgtttgc

SEQ ID NO: 122399 - DNA, 25 bp, Homo sapien
tggccggactcccagaagagaacct

SEQ ID NO: 122400 - DNA, 25 bp, Homo sapien
gctctcgctggacgaagcctttcga

SEQ ID NO: 122401 - DNA, 25 bp, Homo sapien
ccgcgctgacgcttatgcttgtgtt

SEQ ID NO: 122402 - DNA, 25 bp, Homo sapien
gaccgtgcttgcagctgttctcgga

SEQ ID NO: 122403 - DNA, 25 bp, Homo sapien
ggtcgtttgcaaggccagcttcctg

SEQ ID NO: 122404 - DNA, 25 bp, Homo sapien
ggccgcaccggactcattctgaatt

SEQ ID NO: 122405 - DNA, 25 bp, Homo sapien
ctgttctgtgtgtcccagcgcagca

SEQ ID NO: 122406 - DNA, 25 bp, Homo sapien
agccacaatttgcaccgcggcaggg

SEQ ID NO: 122407 - DNA, 25 bp, Homo sapien
tgtgtgctaattagccacaatttgc

SEQ ID NO: 122408 - DNA, 25 bp, Homo sapien
cgggaatggttaagcccaccgagct

SEQ ID NO: 122409 - DNA, 25 bp, Homo sapien
gccggagagtctccaccaacttctg

SEQ ID NO: 122410 - DNA, 25 bp, Homo sapien
tggaccctccggagtgcccagaaag

SEQ ID NO: 122411 - DNA, 25 bp, Homo sapien
cgagtgccatcgaattgtgtgctaa

SEQ ID NO: 122412 - DNA, 25 bp, Homo sapien
tggctctttctggatggaggcgcct

SEQ ID NO: 122413 - DNA, 25 bp, Homo sapien
tccctctccgagtgccatcgaattg

SEQ ID NO: 122414 - DNA, 25 bp, Homo sapien
atgagcacgctctccaccacaatga

SEQ ID NO: 122415 - DNA, 25 bp, Homo sapien
cacgctctccaccacaatgaggttt

SEQ ID NO: 122416 - DNA, 25 bp, Homo sapien
agcgtccgcagaaccgtcttgttga

SEQ ID NO: 122417 - DNA, 25 bp, Homo sapien
agaaccgtcttgttgaagccgctga

SEQ ID NO: 122418 - DNA, 25 bp, Homo sapien
cccaggccatgccatccgatccaga

SEQ ID NO: 122419 - DNA, 25 bp, Homo sapien
cgtcttgttgaagccgctgaggatc

SEQ ID NO: 122420 - DNA, 25 bp, Homo sapien
actcagatcgcgctcccaggcctac

SEQ ID NO: 122421 - DNA, 25 bp, Homo sapien
atccagaccctttctcgcagactcg

SEQ ID NO: 122422 - DNA, 25 bp, Homo sapien
gtggcaagcgcttcagcgtctcctc

SEQ ID NO: 122423 - DNA, 25 bp, Homo sapien
aaaagctccttgacccgggttcatg

SEQ ID NO: 122424 - DNA, 25 bp, Homo sapien
tgcgcccgcagacaaggcgctgtga

SEQ ID NO: 122425 - DNA, 25 bp, Homo sapien
gcgcttccgacacaaggtgcagatc

SEQ ID NO: 122426 - DNA, 25 bp, Homo sapien
gcgccaagcgcttcagcgagagctc

SEQ ID NO: 122427 - DNA, 25 bp, Homo sapien
agcactcgaatctggtgacgcacca

SEQ ID NO: 122428 - DNA, 25 bp, Homo sapien
gcaagggcttctcgcagcactcgaa

SEQ ID NO: 122429 - DNA, 25 bp, Homo sapien
gcttcagccgcagcacggacctggt

SEQ ID NO: 122430 - DNA, 25 bp, Homo sapien
cctctgcctggacatcgcttccctg

SEQ ID NO: 122431 - DNA, 25 bp, Homo sapien
gcctggacatcgcttccctgcccgt

SEQ ID NO: 122432 - DNA, 25 bp, Homo sapien
gggtcacctccgagacctggccagg

SEQ ID NO: 122433 - DNA, 25 bp, Homo sapien
ggatctggtggaggcgtggacacct

SEQ ID NO: 122434 - DNA, 25 bp, Homo sapien
cgccacagtccacccataagacgtt

SEQ ID NO: 122435 - DNA, 25 bp, Homo sapien
tcctggggtcgcctgtcacttctgc

SEQ ID NO: 122436 - DNA, 25 bp, Homo sapien
tcctcctgcactcaaccgccacagt

SEQ ID NO: 122437 - DNA, 25 bp, Homo sapien
tgtccctccaagtgcgggctccaca

SEQ ID NO: 122438 - DNA, 25 bp, Homo sapien
ggctgtcatcgtctaggtctctgca

SEQ ID NO: 122439 - DNA, 25 bp, Homo sapien
cacacccatccaggaggggctgtca

SEQ ID NO: 122440 - DNA, 25 bp, Homo sapien
gggtgcccgcccacgccttctcggc

SEQ ID NO: 122441 - DNA, 25 bp, Homo sapien
acccatccaggaggggctgtcatcg

SEQ ID NO: 122442 - DNA, 25 bp, Homo sapien
atccaggaggggctgtcatcgtcta

SEQ ID NO: 122443 - DNA, 25 bp, Homo sapien
catcgtctaggtctctgcaggagga

SEQ ID NO: 122444 - DNA, 25 bp, Homo sapien
tgtcatcgtctaggtctctgcagga

SEQ ID NO: 122445 - DNA, 25 bp, Homo sapien
ccacgcgtgacacctcggggtgccc

SEQ ID NO: 122446 - DNA, 25 bp, Homo sapien
aagagcttcgtgtacggctcgcacc

SEQ ID NO: 122447 - DNA, 25 bp, Homo sapien
cacatgaagacgcaccgcggagcca

SEQ ID NO: 122448 - DNA, 25 bp, Homo sapien
tcgcacttgctcacccacatgaaga

SEQ ID NO: 122449 - DNA, 25 bp, Homo sapien
agcgctcggtgctggtcacgcacca

SEQ ID NO: 122450 - DNA, 25 bp, Homo sapien
gcggcaagcgcttttcgcagcgctc

SEQ ID NO: 122451 - DNA, 25 bp, Homo sapien
ttcggccacagctcggacttcaagc

SEQ ID NO: 122452 - DNA, 25 bp, Homo sapien
gagagcccgtggatctgctcggact

SEQ ID NO: 122453 - DNA, 25 bp, Homo sapien
acttcaagcggcatcggcgcacgca

SEQ ID NO: 122454 - DNA, 25 bp, Homo sapien
cgctcacaggcggacttgggcctcg

SEQ ID NO: 122455 - DNA, 25 bp, Homo sapien
cctccggccgctgcgtcccgcggct

SEQ ID NO: 122456 - DNA, 25 bp, Homo sapien
cggggcgcgtccgaacagtcgcagc

SEQ ID NO: 122457 - DNA, 25 bp, Homo sapien
tgcgcttcgcctgcggggtcgtgct

SEQ ID NO: 122458 - DNA, 25 bp, Homo sapien
cgcttgcggcttcgcggggctgacc

SEQ ID NO: 122459 - DNA, 25 bp, Homo sapien
ctttgtgcgcaggcgcttgcggctt

SEQ ID NO: 122460 - DNA, 25 bp, Homo sapien
ccgggcctgtgtcgcggcagagcct

SEQ ID NO: 122461 - DNA, 25 bp, Homo sapien
cttctgggaaccgtgcgcgctcaca

SEQ ID NO: 122462 - DNA, 25 bp, Homo sapien
ctctaaggtgccctacacgcggtga

SEQ ID NO: 122463 - DNA, 25 bp, Homo sapien
tcactctaaggtgccctacacgcgg

SEQ ID NO: 122464 - DNA, 25 bp, Homo sapien
aggtgccctacacgcggtgacttca

SEQ ID NO: 122465 - DNA, 25 bp, Homo sapien
cgccggtcccaggacaaataccgtg

SEQ ID NO: 122466 - DNA, 25 bp, Homo sapien
tcccaggacaaataccgtgactcta

SEQ ID NO: 122467 - DNA, 25 bp, Homo sapien
ggacaaataccgtgactctatttcc

SEQ ID NO: 122468 - DNA, 25 bp, Homo sapien
caagcgatcgagaccttccactgtc

SEQ ID NO: 122469 - DNA, 25 bp, Homo sapien
gaccttccactgtccctcactctaa

SEQ ID NO: 122470 - DNA, 25 bp, Homo sapien
ctggaggattgtcagcttagtggca

SEQ ID NO: 122471 - DNA, 25 bp, Homo sapien
tggccctgtggccacgcatgaattc

SEQ ID NO: 122472 - DNA, 25 bp, Homo sapien
ctgtggccacgcatgaattcctgta

SEQ ID NO: 122473 - DNA, 25 bp, Homo sapien
gccacgcatgaattcctgtacagga

SEQ ID NO: 122474 - DNA, 25 bp, Homo sapien
ctgtacaggatttttccggagcgta

SEQ ID NO: 122475 - DNA, 25 bp, Homo sapien
tggagactggaggattgtcagctta

SEQ ID NO: 122476 - DNA, 25 bp, Homo sapien
tcagcttagtggcaaagcgagcagg

SEQ ID NO: 122477 - DNA, 25 bp, Homo sapien
tttccggagcgtagtcaggtaagga

SEQ ID NO: 122478 - DNA, 25 bp, Homo sapien
tgttcgggaccttagagtatgaggc

SEQ ID NO: 122479 - DNA, 25 bp, Homo sapien
ccgtatgttcgggaccttagagtat

SEQ ID NO: 122480 - DNA, 25 bp, Homo sapien
ggctggacgctgagcgcctaggcca

SEQ ID NO: 122481 - DNA, 25 bp, Homo sapien
acgctgagcgcctaggccagcacct

SEQ ID NO: 122482 - DNA, 25 bp, Homo sapien
agctatgtgggccagggttcgcacg

SEQ ID NO: 122483 - DNA, 25 bp, Homo sapien
aggcgtgtgtttggccttgaggcgc

SEQ ID NO: 122484 - DNA, 25 bp, Homo sapien
tgcaggagaggcgtgtgtttggcct

SEQ ID NO: 122485 - DNA, 25 bp, Homo sapien
gtatgttcgggaccttagagtatga

SEQ ID NO: 122486 - DNA, 25 bp, Homo sapien
acccgagcacgtgcgtgatgggcga

SEQ ID NO: 122487 - DNA, 25 bp, Homo sapien
gcccctttaagagcacagggtgggc

SEQ ID NO: 122488 - DNA, 25 bp, Homo sapien
gaccagtgcagggagccgattcttc

SEQ ID NO: 122489 - DNA, 25 bp, Homo sapien
cagaccagtgcagggagccgattct

SEQ ID NO: 122490 - DNA, 25 bp, Homo sapien
ggacacctgcttggcgctggcgcgc

SEQ ID NO: 122491 - DNA, 25 bp, Homo sapien
tgggacgccgagagcccggcaacac

SEQ ID NO: 122492 - DNA, 25 bp, Homo sapien
agagcccggcaacacctcagcccga

SEQ ID NO: 122493 - DNA, 25 bp, Homo sapien
acagccatggcgactgggtcctgct

SEQ ID NO: 122494 - DNA, 25 bp, Homo sapien
atcggccactggtgcaatggcaagc

SEQ ID NO: 122495 - DNA, 25 bp, Homo sapien
atgtcccgatgaaccacggcgtgta

SEQ ID NO: 122496 - DNA, 25 bp, Homo sapien
agcctgtgtcctacatcggccactg

SEQ ID NO: 122497 - DNA, 25 bp, Homo sapien
attcgggatgttcaagtgcagcacc

SEQ ID NO: 122498 - DNA, 25 bp, Homo sapien
ggtcaacggcatgaggaacggattc

SEQ ID NO: 122499 - DNA, 25 bp, Homo sapien
cagcatgtatgaaggcgaagtggtc

SEQ ID NO: 122500 - DNA, 25 bp, Homo sapien
catggccgttctgcttcagggcgac

SEQ ID NO: 122501 - DNA, 25 bp, Homo sapien
tcagggcgactttgtgaagaatgtc

SEQ ID NO: 122502 - DNA, 25 bp, Homo sapien
cctccaattctgacggtggcaggtc

SEQ ID NO: 122503 - DNA, 25 bp, Homo sapien
accgaaggcattcccgctgacagcg

SEQ ID NO: 122504 - DNA, 25 bp, Homo sapien
tggcagccagcacgttcttgagcac

SEQ ID NO: 122505 - DNA, 25 bp, Homo sapien
ggagtcacgttgatgcccatcagca

SEQ ID NO: 122506 - DNA, 25 bp, Homo sapien
tgttgccatacttcacctcgcggta

SEQ ID NO: 122507 - DNA, 25 bp, Homo sapien
tctcgtcgtagtgcaggatcagctg

SEQ ID NO: 122508 - DNA, 25 bp, Homo sapien
aggcctcgcagggagctccaatcac

SEQ ID NO: 122509 - DNA, 25 bp, Homo sapien
ggccacttggccagctaagcccaga

SEQ ID NO: 122510 - DNA, 25 bp, Homo sapien
cgcatacctgtccttcgcgcggccc

SEQ ID NO: 122511 - DNA, 25 bp, Homo sapien
ccggaaaaagaatccgcctcgcagc

SEQ ID NO: 122512 - DNA, 25 bp, Homo sapien
gcccggaaaaagaatccgcctcgca

SEQ ID NO: 122513 - DNA, 25 bp, Homo sapien
atacctgtccttcgcgcggcccgaa

SEQ ID NO: 122514 - DNA, 25 bp, Homo sapien
tcgccgcaggcccggaaaaagaatc

SEQ ID NO: 122515 - DNA, 25 bp, Homo sapien
tcccacggcccgcccagagacagca

SEQ ID NO: 122516 - DNA, 25 bp, Homo sapien
cggaaaaagaatccgcctcgcagcg

SEQ ID NO: 122517 - DNA, 25 bp, Homo sapien
acagcagccaccggctaaaacaccg

SEQ ID NO: 122518 - DNA, 25 bp, Homo sapien
aatggcttctgggcaatacggcacg

SEQ ID NO: 122519 - DNA, 25 bp, Homo sapien
ggcgtgggggctcagctagctcggt

SEQ ID NO: 122520 - DNA, 25 bp, Homo sapien
acaatggcttctgggcaatacggca

SEQ ID NO: 122521 - DNA, 25 bp, Homo sapien
gcgtgggggctcagctagctcggtg

SEQ ID NO: 122522 - DNA, 25 bp, Homo sapien
ggggctcagctagctcggtggtgaa

SEQ ID NO: 122523 - DNA, 25 bp, Homo sapien
gacacaatggcttctgggcaatacg

SEQ ID NO: 122524 - DNA, 25 bp, Homo sapien
acacaatggcttctgggcaatacgg

SEQ ID NO: 122525 - DNA, 25 bp, Homo sapien
cacaatggcttctgggcaatacggc

SEQ ID NO: 122526 - DNA, 25 bp, Homo sapien
cggagccttagcgatctgccacagc

SEQ ID NO: 122527 - DNA, 25 bp, Homo sapien
cccttcgcattagggcggagcgtgc

SEQ ID NO: 122528 - DNA, 25 bp, Homo sapien
caaaggtcaccagtcccaagtcgtc

SEQ ID NO: 122529 - DNA, 25 bp, Homo sapien
aggctacgggtccaaggtctcgtct

SEQ ID NO: 122530 - DNA, 25 bp, Homo sapien
acatgtaccctcctcttcgtcgtgg

SEQ ID NO: 122531 - DNA, 25 bp, Homo sapien
gttcggctgcgtacccggcctcaat

SEQ ID NO: 122532 - DNA, 25 bp, Homo sapien
cggcctcaattttgtggacatgtac

SEQ ID NO: 122533 - DNA, 25 bp, Homo sapien
gccgcagctgatgtcaggtatggcc

SEQ ID NO: 122534 - DNA, 25 bp, Homo sapien
atccggcctgtggacccacgggcag

SEQ ID NO: 122535 - DNA, 25 bp, Homo sapien
ttccgcgctgtagggtaatcgcgcc

SEQ ID NO: 122536 - DNA, 25 bp, Homo sapien
atagcctagttgaaaggcccgggcg

SEQ ID NO: 122537 - DNA, 25 bp, Homo sapien
ttcgcgtctcgactctcgggagcgc

SEQ ID NO: 122538 - DNA, 25 bp, Homo sapien
gagcgcgacccggttcgcgtctcga

SEQ ID NO: 122539 - DNA, 25 bp, Homo sapien
tgccacctcaggtcagtgagcgcga

SEQ ID NO: 122540 - DNA, 25 bp, Homo sapien
cagtggtccaggtcacgggccgcac

SEQ ID NO: 122541 - DNA, 25 bp, Homo sapien
gcgcagggaacacgctacagccttc

SEQ ID NO: 122542 - DNA, 25 bp, Homo sapien
gaggcgccgcaaccttactgtttcc

SEQ ID NO: 122543 - DNA, 25 bp, Homo sapien
cgcgacctgggcaagtccatcatgt

SEQ ID NO: 122544 - DNA, 25 bp, Homo sapien
cggcgtcccggaagttgacagatac

SEQ ID NO: 122545 - DNA, 25 bp, Homo sapien
tggggcagatttctcggcaccaatc

SEQ ID NO: 122546 - DNA, 25 bp, Homo sapien
tcgcaatcgcgctgtctctgaaagg

SEQ ID NO: 122547 - DNA, 25 bp, Homo sapien
aattgagctagcatgccggcgttga

SEQ ID NO: 122548 - DNA, 25 bp, Homo sapien
acttgggagcccatgattgcgaacc

SEQ ID NO: 122549 - DNA, 25 bp, Homo sapien
ttcccgcgaacagagtcaaaagagc

SEQ ID NO: 122550 - DNA, 25 bp, Homo sapien
acggtgccctaccagctcttgcggg

SEQ ID NO: 122551 - DNA, 25 bp, Homo sapien
ttggacgtttgttttcgcagccttc

SEQ ID NO: 122552 - DNA, 25 bp, Homo sapien
ttgccctgtcagcacgatgcctgga

SEQ ID NO: 122553 - DNA, 25 bp, Homo sapien
ggctggggcgaattagttgccattc

SEQ ID NO: 122554 - DNA, 25 bp, Homo sapien
gggagcgcctaagccaatggaaatg

SEQ ID NO: 122555 - DNA, 25 bp, Homo sapien
cactcgagttctagtggggagcgcc

SEQ ID NO: 122556 - DNA, 25 bp, Homo sapien
ctattccagaaccaatcactcgagt

SEQ ID NO: 122557 - DNA, 25 bp, Homo sapien
caatggaaatgctcgctgcggcagc

SEQ ID NO: 122558 - DNA, 25 bp, Homo sapien
atgattgctagtgcgccagcggagt

SEQ ID NO: 122559 - DNA, 25 bp, Homo sapien
agatgattgctagtgcgccagcgga

SEQ ID NO: 122560 - DNA, 25 bp, Homo sapien
tgtagatgattgctagtgcgccagc

SEQ ID NO: 122561 - DNA, 25 bp, Homo sapien
ctctgtagatgattgctagtgcgcc

SEQ ID NO: 122562 - DNA, 25 bp, Homo sapien
ggtactctgtagatgattgctagtg

SEQ ID NO: 122563 - DNA, 25 bp, Homo sapien
cacagcgccgtgcgccagcggagtt

SEQ ID NO: 122564 - DNA, 25 bp, Homo sapien
cggctcgggtactctgtagatgatt

SEQ ID NO: 122565 - DNA, 25 bp, Homo sapien
tcgggtactctgtagatgattgcta

SEQ ID NO: 122566 - DNA, 25 bp, Homo sapien
gcctcctggcactagtggttataaa

SEQ ID NO: 122567 - DNA, 25 bp, Homo sapien
gaggtacccatatgctctctgccgc

SEQ ID NO: 122568 - DNA, 25 bp, Homo sapien
aaaaagcacacaccaggcgccgcgg

SEQ ID NO: 122569 - DNA, 25 bp, Homo sapien
agtcaaccctggacgcaagtccctg

SEQ ID NO: 122570 - DNA, 25 bp, Homo sapien
gatcactcatccgacgtcagcgtca

SEQ ID NO: 122571 - DNA, 25 bp, Homo sapien
gcgttgacctcaccttgcttgggga

SEQ ID NO: 122572 - DNA, 25 bp, Homo sapien
ctcggggagtgagtttctctctctc

SEQ ID NO: 122573 - DNA, 25 bp, Homo sapien
ccgcggcaggtgaacttgtcaacaa

SEQ ID NO: 122574 - DNA, 25 bp, Homo sapien
ttggctcccgcgaaccaatcctgag

SEQ ID NO: 122575 - DNA, 25 bp, Homo sapien
tttcttccgaaaggccagtgtctta

SEQ ID NO: 122576 - DNA, 25 bp, Homo sapien
gggtaaactgatccctgctttcctg

SEQ ID NO: 122577 - DNA, 25 bp, Homo sapien
cgtgaatccaactgtgccaagcctt

SEQ ID NO: 122578 - DNA, 25 bp, Homo sapien
ctctagaagttagcgaccggctgta

SEQ ID NO: 122579 - DNA, 25 bp, Homo sapien
tcacagctcggaggaggcttcttct

SEQ ID NO: 122580 - DNA, 25 bp, Homo sapien
agtcctgtgcggtacgtaccctttg

SEQ ID NO: 122581 - DNA, 25 bp, Homo sapien
caggcccgagtagcttctccatgga

SEQ ID NO: 122582 - DNA, 25 bp, Homo sapien
ggtgaagcccaccatccaggacgtg

SEQ ID NO: 122583 - DNA, 25 bp, Homo sapien
tgctcctgtccacctacatcaagtt

SEQ ID NO: 122584 - DNA, 25 bp, Homo sapien
tgctgcactccaagttccacctgtg

SEQ ID NO: 122585 - DNA, 25 bp, Homo sapien
ttggaaacttgatagctggagaccc

SEQ ID NO: 122586 - DNA, 25 bp, Homo sapien
acctggtcaaagtgggcggctacat

SEQ ID NO: 122587 - DNA, 25 bp, Homo sapien
ccgcgtgccacgagaacctggtcaa

SEQ ID NO: 122588 - DNA, 25 bp, Homo sapien
cccggctcattgtttgtgcttcgca

SEQ ID NO: 122589 - DNA, 25 bp, Homo sapien
cagcaccgacattctggtaggaggc

SEQ ID NO: 122590 - DNA, 25 bp, Homo sapien
tgctttcagtcgcaggtgacctcga

SEQ ID NO: 122591 - DNA, 25 bp, Homo sapien
aggccgcgggctataagatttgatc

SEQ ID NO: 122592 - DNA, 25 bp, Homo sapien
cgagcgatctcgacaggtttatgga

SEQ ID NO: 122593 - DNA, 25 bp, Homo sapien
gtaggcttcataccctcccttcgga

SEQ ID NO: 122594 - DNA, 25 bp, Homo sapien
gctgcgcgctttattgtctgctttc

SEQ ID NO: 122595 - DNA, 25 bp, Homo sapien
tccgctgaccaaagccgcagtgttc

SEQ ID NO: 122596 - DNA, 25 bp, Homo sapien
cccgccgccctaatggattctgaag

SEQ ID NO: 122597 - DNA, 25 bp, Homo sapien
tgggtaattttcgtcgacgccacca

SEQ ID NO: 122598 - DNA, 25 bp, Homo sapien
tattcacggggagcaggacaaacca

SEQ ID NO: 122599 - DNA, 25 bp, Homo sapien
atcgaaagttcctggctcgccttta

SEQ ID NO: 122600 - DNA, 25 bp, Homo sapien
ctcgcctttaatgcagacgaatggg

SEQ ID NO: 122601 - DNA, 25 bp, Homo sapien
ccgcagcggtcacaccgttgatttg

SEQ ID NO: 122602 - DNA, 25 bp, Homo sapien
attttccgtggttaggctcgccagc

SEQ ID NO: 122603 - DNA, 25 bp, Homo sapien
ggggcctgatgcagcgtgaaatcta

SEQ ID NO: 122604 - DNA, 25 bp, Homo sapien
tgcacgccctagagcagacactgcg

SEQ ID NO: 122605 - DNA, 25 bp, Homo sapien
caaaccatggctaggcagggaaatc

SEQ ID NO: 122606 - DNA, 25 bp, Homo sapien
tctccaagggaagtcacggtccagg

SEQ ID NO: 122607 - DNA, 25 bp, Homo sapien
gaggggctcctctttcacaaccaga

SEQ ID NO: 122608 - DNA, 25 bp, Homo sapien
ggtggcccaggataaagggacaatc

SEQ ID NO: 122609 - DNA, 25 bp, Homo sapien
gtgaccatctttaactctccaaggg

SEQ ID NO: 122610 - DNA, 25 bp, Homo sapien
ggaggaagtcatcagcgtgaccatc

SEQ ID NO: 122611 - DNA, 25 bp, Homo sapien
tgcagctccctctgtttttcgcgcg

SEQ ID NO: 122612 - DNA, 25 bp, Homo sapien
cccgggttacttgattgcagctccc

SEQ ID NO: 122613 - DNA, 25 bp, Homo sapien
gacaatcaaactcaaggtgcccacg

SEQ ID NO: 122614 - DNA, 25 bp, Homo sapien
ccgacgggaagacgcccagggcaca

SEQ ID NO: 122615 - DNA, 25 bp, Homo sapien
gccgcgttcaccacgtgggcaaagg

SEQ ID NO: 122616 - DNA, 25 bp, Homo sapien
ccactacaacaaggcccatggcggt

SEQ ID NO: 122617 - DNA, 25 bp, Homo sapien
ccatggcggtgccacctcacgagga

SEQ ID NO: 122618 - DNA, 25 bp, Homo sapien
cctcacgaggagaaggacgatcacc

SEQ ID NO: 122619 - DNA, 25 bp, Homo sapien
accttgagacccatcggcctctgag

SEQ ID NO: 122620 - DNA, 25 bp, Homo sapien
ctaccggccgtgtctcagtaggaca

SEQ ID NO: 122621 - DNA, 25 bp, Homo sapien
gtccagacagcaggagcgcgaccct

SEQ ID NO: 122622 - DNA, 25 bp, Homo sapien
ctttccaagggtgccacgtactgag

SEQ ID NO: 122623 - DNA, 25 bp, Homo sapien
ctggccagctgtgactgccgctgag

SEQ ID NO: 122624 - DNA, 25 bp, Homo sapien
gctccgtgagtagggggcctctccc

SEQ ID NO: 122625 - DNA, 25 bp, Homo sapien
tcttgccgctaaggtcagcggctgc

SEQ ID NO: 122626 - DNA, 25 bp, Homo sapien
aagggtgccacgtactgaggaatgc

SEQ ID NO: 122627 - DNA, 25 bp, Homo sapien
cgaggactcttcgattgaccagaca

SEQ ID NO: 122628 - DNA, 25 bp, Homo sapien
cgaaacgaggactcttcgattgacc

SEQ ID NO: 122629 - DNA, 25 bp, Homo sapien
ggcaggtcgggcctcttgccgctaa

SEQ ID NO: 122630 - DNA, 25 bp, Homo sapien
ctgcgcgccggttttaaatagcatc

SEQ ID NO: 122631 - DNA, 25 bp, Homo sapien
ctttcgttgcttctggtccaggcta

SEQ ID NO: 122632 - DNA, 25 bp, Homo sapien
cgcgctgtgcaatttctggtctttc

SEQ ID NO: 122633 - DNA, 25 bp, Homo sapien
ttccctattgtctgaggcagccgcc

SEQ ID NO: 122634 - DNA, 25 bp, Homo sapien
atccgggtcgctgctttccctattg

SEQ ID NO: 122635 - DNA, 25 bp, Homo sapien
tccttttcagagctgtatccgggtc

SEQ ID NO: 122636 - DNA, 25 bp, Homo sapien
tgcgctcagcctcgtgttttcactt

SEQ ID NO: 122637 - DNA, 25 bp, Homo sapien
agcatctttcggacttgtcttcgcg

SEQ ID NO: 122638 - DNA, 25 bp, Homo sapien
gtcgccggtcctgtgcgcctctggt

SEQ ID NO: 122639 - DNA, 25 bp, Homo sapien
tgacaatgccctgccgccagttcca

SEQ ID NO: 122640 - DNA, 25 bp, Homo sapien
ccgggtcccgccctgacaatgccct

SEQ ID NO: 122641 - DNA, 25 bp, Homo sapien
atccggggcgggcactatgtgattc

SEQ ID NO: 122642 - DNA, 25 bp, Homo sapien
actatgtgattcgagcccgctgcgc

SEQ ID NO: 122643 - DNA, 25 bp, Homo sapien
taaagagcggcctgatgcccagagc

SEQ ID NO: 122644 - DNA, 25 bp, Homo sapien
ggattcaggataaagagcggcctga

SEQ ID NO: 122645 - DNA, 25 bp, Homo sapien
ccacttcgcggcctgagatggagtg

SEQ ID NO: 122646 - DNA, 25 bp, Homo sapien
aagaaggacgcatgcgtcacgcgca

SEQ ID NO: 122647 - DNA, 25 bp, Homo sapien
ggactgtggactccacgaccctgtc

SEQ ID NO: 122648 - DNA, 25 bp, Homo sapien
gacgcaggttacagcagcgcttggc

SEQ ID NO: 122649 - DNA, 25 bp, Homo sapien
cgcctctgggctcaaacaggaggaa

SEQ ID NO: 122650 - DNA, 25 bp, Homo sapien
atctcacacgatcgacgcctctggg

SEQ ID NO: 122651 - DNA, 25 bp, Homo sapien
agagcgcacaatctcacacgatcga

SEQ ID NO: 122652 - DNA, 25 bp, Homo sapien
ggtaatgaaacctgaagagcgcaca

SEQ ID NO: 122653 - DNA, 25 bp, Homo sapien
ggcctctgctgatgccgtcgttatc

SEQ ID NO: 122654 - DNA, 25 bp, Homo sapien
tgaacacgtctgtggaactggtacc

SEQ ID NO: 122655 - DNA, 25 bp, Homo sapien
ttacgaaaccaaaacggcgctgatg

SEQ ID NO: 122656 - DNA, 25 bp, Homo sapien
cgctgatgagtctgtttgggatccc

SEQ ID NO: 122657 - DNA, 25 bp, Homo sapien
tcagcatggactcggttagtgttca

SEQ ID NO: 122658 - DNA, 25 bp, Homo sapien
tagtgttcacgggtcgtaggtccac

SEQ ID NO: 122659 - DNA, 25 bp, Homo sapien
taggtccacagctccatggaacttc

SEQ ID NO: 122660 - DNA, 25 bp, Homo sapien
tggaacttcgtaagatgaacacgtc

SEQ ID NO: 122661 - DNA, 25 bp, Homo sapien
taccacaagaagtggcagcgttccc

SEQ ID NO: 122662 - DNA, 25 bp, Homo sapien
catagcccagcgtgtaccggcagtg

SEQ ID NO: 122663 - DNA, 25 bp, Homo sapien
ccaggccaggaacatcagcgcgatc

SEQ ID NO: 122664 - DNA, 25 bp, Homo sapien
tctcagtctgttgctgcttggaaca

SEQ ID NO: 122665 - DNA, 25 bp, Homo sapien
gcttggaacagggaagctccgcgtc

SEQ ID NO: 122666 - DNA, 25 bp, Homo sapien
gtgcacccagtcctttcgtgggata

SEQ ID NO: 122667 - DNA, 25 bp, Homo sapien
tagagccttcgcgtaatccgtctgc

SEQ ID NO: 122668 - DNA, 25 bp, Homo sapien
ccttcccattttggctgctggctga

SEQ ID NO: 122669 - DNA, 25 bp, Homo sapien
ccttggatgtcaccgtgcagtcgca

SEQ ID NO: 122670 - DNA, 25 bp, Homo sapien
gctgcggcgtgtggccattgggggc

SEQ ID NO: 122671 - DNA, 25 bp, Homo sapien
ggctgcggcgtgtggccattggggg

SEQ ID NO: 122672 - DNA, 25 bp, Homo sapien
gggctgcggcgtgtggccattgggg

SEQ ID NO: 122673 - DNA, 25 bp, Homo sapien
ctgggctgcggcgtgtggccattgg

SEQ ID NO: 122674 - DNA, 25 bp, Homo sapien
cgactacgtcctatgcagccctgag

SEQ ID NO: 122675 - DNA, 25 bp, Homo sapien
ccgactacgtcctatgcagccctga

SEQ ID NO: 122676 - DNA, 25 bp, Homo sapien
ccccgactacgtcctatgcagccct

SEQ ID NO: 122677 - DNA, 25 bp, Homo sapien
cccgactacgtcctatgcagccctg

SEQ ID NO: 122678 - DNA, 25 bp, Homo sapien
tgcagagcaccatcacccgtttcta

SEQ ID NO: 122679 - DNA, 25 bp, Homo sapien
agaccgtggccaaccgcgtggcctg

SEQ ID NO: 122680 - DNA, 25 bp, Homo sapien
gtggacgacaactgcgacccccaga

SEQ ID NO: 122681 - DNA, 25 bp, Homo sapien
atcacccgtttctatggcgacgacc

SEQ ID NO: 122682 - DNA, 25 bp, Homo sapien
tttctatggcgacgacccccagagc

SEQ ID NO: 122683 - DNA, 25 bp, Homo sapien
tcatcaaccagaaacagttccagcg

SEQ ID NO: 122684 - DNA, 25 bp, Homo sapien
cagaaacagttccagcggctgcggg

SEQ ID NO: 122685 - DNA, 25 bp, Homo sapien
gcaccatcacccgtttctatggcga

SEQ ID NO: 122686 - DNA, 25 bp, Homo sapien
aggggaccgcaaactgagctagcca

SEQ ID NO: 122687 - DNA, 25 bp, Homo sapien
ctgcacttctggctcggtaagggac

SEQ ID NO: 122688 - DNA, 25 bp, Homo sapien
gcgacttctacgtcggggatgccta

SEQ ID NO: 122689 - DNA, 25 bp, Homo sapien
gcgggagctataccacgaagagttc

SEQ ID NO: 122690 - DNA, 25 bp, Homo sapien
ctgctgctctcggtttagtccaaga

SEQ ID NO: 122691 - DNA, 25 bp, Homo sapien
cggcgaataaggttcctcctgctgc

SEQ ID NO: 122692 - DNA, 25 bp, Homo sapien
cccggatggcaaacactataaagtg

SEQ ID NO: 122693 - DNA, 25 bp, Homo sapien
aagcgatcgtctcctctgtcaactc

SEQ ID NO: 122694 - DNA, 25 bp, Homo sapien
taaccgcgaatcacgtggctgctgc

SEQ ID NO: 122695 - DNA, 25 bp, Homo sapien
gagctacccggagcaaccgttcagg

SEQ ID NO: 122696 - DNA, 25 bp, Homo sapien
atggcttccctgatgcgggtgacca

SEQ ID NO: 122697 - DNA, 25 bp, Homo sapien
gcggcagttaccctcaccaattagg

SEQ ID NO: 122698 - DNA, 25 bp, Homo sapien
ggacagggtgaagggatcccacttc

SEQ ID NO: 122699 - DNA, 25 bp, Homo sapien
cagcgctaggccgattcgaactcga

SEQ ID NO: 122700 - DNA, 25 bp, Homo sapien
actcgaccttgttttggcgttgcta

SEQ ID NO: 122701 - DNA, 25 bp, Homo sapien
cagggaacaggtatcagcgcgcctc

SEQ ID NO: 122702 - DNA, 25 bp, Homo sapien
tttcacaagatcagatttcgggctg

SEQ ID NO: 122703 - DNA, 25 bp, Homo sapien
cgcgtctctttcacaagatcagatt

SEQ ID NO: 122704 - DNA, 25 bp, Homo sapien
gtcctcagcctggaagcgccacgga

SEQ ID NO: 122705 - DNA, 25 bp, Homo sapien
cctggggatactgaaaccgtgtgtt

SEQ ID NO: 122706 - DNA, 25 bp, Homo sapien
ccgctgcttattgttaaggcgcctg

SEQ ID NO: 122707 - DNA, 25 bp, Homo sapien
gatttcctctgtaacccgctgctta

SEQ ID NO: 122708 - DNA, 25 bp, Homo sapien
agcgccacggagagactcgatttcc

SEQ ID NO: 122709 - DNA, 25 bp, Homo sapien
atttcgggctgtcaatcaggcggct

SEQ ID NO: 122710 - DNA, 25 bp, Homo sapien
tccgctaggagattggccgctttag

SEQ ID NO: 122711 - DNA, 25 bp, Homo sapien
tgacgggtatccagggtaaccgcga

SEQ ID NO: 122712 - DNA, 25 bp, Homo sapien
cgagcctgacgggtatccagggtaa

SEQ ID NO: 122713 - DNA, 25 bp, Homo sapien
ttcccgcagccaataacgagccgta

SEQ ID NO: 122714 - DNA, 25 bp, Homo sapien
ctcagcgctccgctaggagattggc

SEQ ID NO: 122715 - DNA, 25 bp, Homo sapien
attcacaaaattccggcccttcttg

SEQ ID NO: 122716 - DNA, 25 bp, Homo sapien
cctttcgtctccattcacaaaattc

SEQ ID NO: 122717 - DNA, 25 bp, Homo sapien
gcccattgttgtttattgctgaccc

SEQ ID NO: 122718 - DNA, 25 bp, Homo sapien
cagctgccacggcttgcgggtggcg

SEQ ID NO: 122719 - DNA, 25 bp, Homo sapien
gggcagaccacggagagggacgcag

SEQ ID NO: 122720 - DNA, 25 bp, Homo sapien
cagagcgcgcaagcagaaggcgccc

SEQ ID NO: 122721 - DNA, 25 bp, Homo sapien
ccgcaggggacgatcccgacagcta

SEQ ID NO: 122722 - DNA, 25 bp, Homo sapien
gggacgatcccgacagctacggcag

SEQ ID NO: 122723 - DNA, 25 bp, Homo sapien
tgaggctgccgatctgccctcgcgg

SEQ ID NO: 122724 - DNA, 25 bp, Homo sapien
ccactcaggcaaggacccggctccg

SEQ ID NO: 122725 - DNA, 25 bp, Homo sapien
gaagccgtgtggtccgcgccgcgct

SEQ ID NO: 122726 - DNA, 25 bp, Homo sapien
ttgcagggccacacgctcaaacgtc

SEQ ID NO: 122727 - DNA, 25 bp, Homo sapien
actggcttttagtcaacgggaatgc

SEQ ID NO: 122728 - DNA, 25 bp, Homo sapien
tgtgcaccaagccaagtctctcttc

SEQ ID NO: 122729 - DNA, 25 bp, Homo sapien
aggccggattaatcaccgctgcttc

SEQ ID NO: 122730 - DNA, 25 bp, Homo sapien
cgtaccttgcgatgctggcgcctac

SEQ ID NO: 122731 - DNA, 25 bp, Homo sapien
gccctacagagcagtcgccgggtaa

SEQ ID NO: 122732 - DNA, 25 bp, Homo sapien
cgcatcaccatgagcaggggtaaca

SEQ ID NO: 122733 - DNA, 25 bp, Homo sapien
taacacgcgtgtgtccgaggcacaa

SEQ ID NO: 122734 - DNA, 25 bp, Homo sapien
gcggctgcgtggtcaagatgctttc

SEQ ID NO: 122735 - DNA, 25 bp, Homo sapien
cccggcctctcgtggtgctgctgct

SEQ ID NO: 122736 - DNA, 25 bp, Homo sapien
cggctactggggcttggacagctgt

SEQ ID NO: 122737 - DNA, 25 bp, Homo sapien
agctgcgtaggaggcatggcctgtt

SEQ ID NO: 122738 - DNA, 25 bp, Homo sapien
cgtggtcaagatgctttcggctccc

SEQ ID NO: 122739 - DNA, 25 bp, Homo sapien
tagcagcgtccggaagaggaattaa

SEQ ID NO: 122740 - DNA, 25 bp, Homo sapien
cagcgtccggaagaggaattaaaag

SEQ ID NO: 122741 - DNA, 25 bp, Homo sapien
tgcgtggtcaagatgctttcggctc

SEQ ID NO: 122742 - DNA, 25 bp, Homo sapien
cctctgggacgtccactcggggact

SEQ ID NO: 122743 - DNA, 25 bp, Homo sapien
aggtctcatctgtgcaacgtgggcc

SEQ ID NO: 122744 - DNA, 25 bp, Homo sapien
aggagcgcgattagaaggtctcatc

SEQ ID NO: 122745 - DNA, 25 bp, Homo sapien
tccggggaaatatggcttctggctc

SEQ ID NO: 122746 - DNA, 25 bp, Homo sapien
tcacctgccaggtaacgggactcgg

SEQ ID NO: 122747 - DNA, 25 bp, Homo sapien
agcatgcagtcacgctgatgtcacc

SEQ ID NO: 122748 - DNA, 25 bp, Homo sapien
tcaccatccctgcaccgtgagggtg

SEQ ID NO: 122749 - DNA, 25 bp, Homo sapien
cgctgggactcagcactgcggaagt

SEQ ID NO: 122750 - DNA, 25 bp, Homo sapien
gcctctgggtcacgtgttgcctgcg

SEQ ID NO: 122751 - DNA, 25 bp, Homo sapien
ctgggtcacgtgttgcctgcggacc

SEQ ID NO: 122752 - DNA, 25 bp, Homo sapien
tgggtcacgtgttgcctgcggaccc

SEQ ID NO: 122753 - DNA, 25 bp, Homo sapien
tgggccacgtgttgcctgcggaccc

SEQ ID NO: 122754 - DNA, 25 bp, Homo sapien
tgttgcctgcggacccgcctctggg

SEQ ID NO: 122755 - DNA, 25 bp, Homo sapien
gttgcctgcggacccgcctctgggt

SEQ ID NO: 122756 - DNA, 25 bp, Homo sapien
ggacccgcctctgggtcacgtgttg

SEQ ID NO: 122757 - DNA, 25 bp, Homo sapien
gtgttgcctgcggacccgcctctgg

SEQ ID NO: 122758 - DNA, 25 bp, Homo sapien
ggcgcaccagatgtaccggaccctg

SEQ ID NO: 122759 - DNA, 25 bp, Homo sapien
ccagcgtcgagaagggcgactacta

SEQ ID NO: 122760 - DNA, 25 bp, Homo sapien
tgcgacagcgtcagccctgcgcgga

SEQ ID NO: 122761 - DNA, 25 bp, Homo sapien
ccaggtcacgtgcagctagccggcg

SEQ ID NO: 122762 - DNA, 25 bp, Homo sapien
acccgccattgtggcgcgagccagt

SEQ ID NO: 122763 - DNA, 25 bp, Homo sapien
gcagtttcgtgccacccgccattgt

SEQ ID NO: 122764 - DNA, 25 bp, Homo sapien
tgtaccggaccctgttcttcaggta

SEQ ID NO: 122765 - DNA, 25 bp, Homo sapien
ggcgactactacgaggcgcaccaga

SEQ ID NO: 122766 - DNA, 25 bp, Homo sapien
tgagcatctcgtcgccattaccgtc

SEQ ID NO: 122767 - DNA, 25 bp, Homo sapien
tgcacccacggcgaaagcactcttt

SEQ ID NO: 122768 - DNA, 25 bp, Homo sapien
tacaaacttcaagcgccggtctctc

SEQ ID NO: 122769 - DNA, 25 bp, Homo sapien
gaaagatatttctgaatcccgcctc

SEQ ID NO: 122770 - DNA, 25 bp, Homo sapien
tggccaatcagaccacaccatgaag

SEQ ID NO: 122771 - DNA, 25 bp, Homo sapien
cccaatggcagcgtcctacagtgta

SEQ ID NO: 122772 - DNA, 25 bp, Homo sapien
actggcctgcttggcaaggcaagta

SEQ ID NO: 122773 - DNA, 25 bp, Homo sapien
cttcaaggtgggtgttcacgttttg

SEQ ID NO: 122774 - DNA, 25 bp, Homo sapien
ccgtgtgtctatgtcaatgtgtctg

SEQ ID NO: 122775 - DNA, 25 bp, Homo sapien
tcagtgccctgggatgaagacctcc

SEQ ID NO: 122776 - DNA, 25 bp, Homo sapien
gtgtctgtccttcactcctccattg

SEQ ID NO: 122777 - DNA, 25 bp, Homo sapien
gaagacctccgactcgcaacgtttg

SEQ ID NO: 122778 - DNA, 25 bp, Homo sapien
agttatgtgctcagcgacggctttc

SEQ ID NO: 122779 - DNA, 25 bp, Homo sapien
tcctgtccggttcaaatatttcgcc

SEQ ID NO: 122780 - DNA, 25 bp, Homo sapien
gcgagagatcgccattggagcaacc

SEQ ID NO: 122781 - DNA, 25 bp, Homo sapien
tcgtcgctacctcctcggacaggtg

SEQ ID NO: 122782 - DNA, 25 bp, Homo sapien
cttgcggacagttttgcggaatggc

SEQ ID NO: 122783 - DNA, 25 bp, Homo sapien
tcgttcattgtgaagccgcggtctc

SEQ ID NO: 122784 - DNA, 25 bp, Homo sapien
cgcagtctcttcctttcgttcattg

SEQ ID NO: 122785 - DNA, 25 bp, Homo sapien
tggtcagcgactcactcgttgcatc

SEQ ID NO: 122786 - DNA, 25 bp, Homo sapien
gggcttcgcgtgttccaagaactgc

SEQ ID NO: 122787 - DNA, 25 bp, Homo sapien
ctccgccggagtcgaatttacgtgc

SEQ ID NO: 122788 - DNA, 25 bp, Homo sapien
tttctacctttgttccctgccagcg

SEQ ID NO: 122789 - DNA, 25 bp, Homo sapien
tcggcggagcgcatttatttgcata

SEQ ID NO: 122790 - DNA, 25 bp, Homo sapien
ctcctgctggggcacatcttaaagc

SEQ ID NO: 122791 - DNA, 25 bp, Homo sapien
tccaacgtcaaatcccagtggcttc

SEQ ID NO: 122792 - DNA, 25 bp, Homo sapien
ctggggcacatcttaaagcaaatcc

SEQ ID NO: 122793 - DNA, 25 bp, Homo sapien
tgtgtgtcgccgtgccctgcatggc

SEQ ID NO: 122794 - DNA, 25 bp, Homo sapien
gtagaagcggttacagcggcgaccg

SEQ ID NO: 122795 - DNA, 25 bp, Homo sapien
agggcacgggctccactcaagcgtc

SEQ ID NO: 122796 - DNA, 25 bp, Homo sapien
agagcctcctgctggggcacatctt

SEQ ID NO: 122797 - DNA, 25 bp, Homo sapien
cgtcctcaccggcttccgcggctct

SEQ ID NO: 122798 - DNA, 25 bp, Homo sapien
ggattaggtccattcccggcactgc

SEQ ID NO: 122799 - DNA, 25 bp, Homo sapien
ggcactgcccgtggaatcgaggttt

SEQ ID NO: 122800 - DNA, 25 bp, Homo sapien
tcccgtcgacgctctgttccgagag

SEQ ID NO: 122801 - DNA, 25 bp, Homo sapien
tacgccagtcgcaagcggcggaagc

SEQ ID NO: 122802 - DNA, 25 bp, Homo sapien
cagaaaacgtgagtgtcccgagcgc

SEQ ID NO: 122803 - DNA, 25 bp, Homo sapien
agcaccctggatttaggaagtcccg

SEQ ID NO: 122804 - DNA, 25 bp, Homo sapien
gccagctcagaacaggggcagccgt

SEQ ID NO: 122805 - DNA, 25 bp, Homo sapien
gattctaaatagacggcccaggctc

SEQ ID NO: 122806 - DNA, 25 bp, Homo sapien
gagtttcgcacttctctgtgtgaca

SEQ ID NO: 122807 - DNA, 25 bp, Homo sapien
ttcgcacttctctgtgtgacacgcc

SEQ ID NO: 122808 - DNA, 25 bp, Homo sapien
cgctgtgccaaaggggcagcacgct

SEQ ID NO: 122809 - DNA, 25 bp, Homo sapien
gttgagtttcgcacttctctgtgtg

SEQ ID NO: 122810 - DNA, 25 bp, Homo sapien
tcggttgagtttcgcacttctctgt

SEQ ID NO: 122811 - DNA, 25 bp, Homo sapien
caaaggggcagcacgcttttatgga

SEQ ID NO: 122812 - DNA, 25 bp, Homo sapien
gcacttctctgtgtgacacgcccta

SEQ ID NO: 122813 - DNA, 25 bp, Homo sapien
gtgccaaaggggcagcacgctttta

SEQ ID NO: 122814 - DNA, 25 bp, Homo sapien
ggcccaccttccgtacagatgatgt

SEQ ID NO: 122815 - DNA, 25 bp, Homo sapien
agatgatgttctctgacgggctggc

SEQ ID NO: 122816 - DNA, 25 bp, Homo sapien
gtcgccgcttacctcagttaacatt

SEQ ID NO: 122817 - DNA, 25 bp, Homo sapien
tcgcctcatggcaacagccgtagca

SEQ ID NO: 122818 - DNA, 25 bp, Homo sapien
ccgccatcttggaagagcgacgtcc

SEQ ID NO: 122819 - DNA, 25 bp, Homo sapien
ctcgctgcaacgtgcgttcccattg

SEQ ID NO: 122820 - DNA, 25 bp, Homo sapien
gggacaaggcggcagatttccttta

SEQ ID NO: 122821 - DNA, 25 bp, Homo sapien
ccgacacttgactgatggcgctgcg

SEQ ID NO: 122822 - DNA, 25 bp, Homo sapien
ccgcggccggtaaatctcggctgga

SEQ ID NO: 122823 - DNA, 25 bp, Homo sapien
ttttagcaaattctccgcgcgccgc

SEQ ID NO: 122824 - DNA, 25 bp, Homo sapien
ccggctggtgcttgaggaaagccct

SEQ ID NO: 122825 - DNA, 25 bp, Homo sapien
tcgggttccgcaggttaacagcatc

SEQ ID NO: 122826 - DNA, 25 bp, Homo sapien
ctcctcctcgaaagatggctgtttg

SEQ ID NO: 122827 - DNA, 25 bp, Homo sapien
ttcagaaatcccaagtcgtcttagg

SEQ ID NO: 122828 - DNA, 25 bp, Homo sapien
gtgggcatgtctcgcttcagaaatc

SEQ ID NO: 122829 - DNA, 25 bp, Homo sapien
atgcgccgcggtattcccttctcgg

SEQ ID NO: 122830 - DNA, 25 bp, Homo sapien
tcaggttgacaactgccttcagcgc

SEQ ID NO: 122831 - DNA, 25 bp, Homo sapien
gttatttttcctggcctcacctcgc

SEQ ID NO: 122832 - DNA, 25 bp, Homo sapien
ttcagcgcgttctcagctcagctgg

SEQ ID NO: 122833 - DNA, 25 bp, Homo sapien
ccgcggcgcacatttcagcttttca

SEQ ID NO: 122834 - DNA, 25 bp, Homo sapien
cttcacggtggagctcgcagtaatt

SEQ ID NO: 122835 - DNA, 25 bp, Homo sapien
cgcagtaattgagtcgcgagggtta

SEQ ID NO: 122836 - DNA, 25 bp, Homo sapien
cgggaaccaggattgcgatccgttc

SEQ ID NO: 122837 - DNA, 25 bp, Homo sapien
ttcctttgagaaacgcgtccgcggc

SEQ ID NO: 122838 - DNA, 25 bp, Homo sapien
gcctgcgttacgtttgcacagcaac

SEQ ID NO: 122839 - DNA, 25 bp, Homo sapien
tctttgtaaatgtccgagtcctctc

SEQ ID NO: 122840 - DNA, 25 bp, Homo sapien
tcctctcggaggaaagatcgttagg

SEQ ID NO: 122841 - DNA, 25 bp, Homo sapien
ggaaacctgattgcaaaccgctgtt

SEQ ID NO: 122842 - DNA, 25 bp, Homo sapien
gtcgctccttagatattactccagg

SEQ ID NO: 122843 - DNA, 25 bp, Homo sapien
ccactaggtcctcgtgtagagaaca

SEQ ID NO: 122844 - DNA, 25 bp, Homo sapien
ttttctggagtcctcggaacagctg

SEQ ID NO: 122845 - DNA, 25 bp, Homo sapien
ccgctgttccttcgaaacttgcaaa

SEQ ID NO: 122846 - DNA, 25 bp, Homo sapien
tccacgcaaaccgaaggagatacgg

SEQ ID NO: 122847 - DNA, 25 bp, Homo sapien
cggcgcactctttacgacatataag

SEQ ID NO: 122848 - DNA, 25 bp, Homo sapien
gcggaaaattctgcaaaagtggccc

SEQ ID NO: 122849 - DNA, 25 bp, Homo sapien
gcctgtctccggaaattcgaggttg

SEQ ID NO: 122850 - DNA, 25 bp, Homo sapien
ggcctttgcctgaatctgttgctat

SEQ ID NO: 122851 - DNA, 25 bp, Homo sapien
aggagatacggacatcgtcattctc

SEQ ID NO: 122852 - DNA, 25 bp, Homo sapien
ttgctaccgctgacacttggcaccg

SEQ ID NO: 122853 - DNA, 25 bp, Homo sapien
gtctgtcgctaatgtgggcctgtct

SEQ ID NO: 122854 - DNA, 25 bp, Homo sapien
cttcctggactccagtggagccttg

SEQ ID NO: 122855 - DNA, 25 bp, Homo sapien
cccgcctgcccggaaaggagtgagc

SEQ ID NO: 122856 - DNA, 25 bp, Homo sapien
gttggcagtggtctgttatccgctc

SEQ ID NO: 122857 - DNA, 25 bp, Homo sapien
gattaagcgcctcaggacccgtccg

SEQ ID NO: 122858 - DNA, 25 bp, Homo sapien
ctccgggattaagcgcctcaggacc

SEQ ID NO: 122859 - DNA, 25 bp, Homo sapien
tctgttatccgctcctttctccagg

SEQ ID NO: 122860 - DNA, 25 bp, Homo sapien
tgcatcggggccagcatagacgcgc

SEQ ID NO: 122861 - DNA, 25 bp, Homo sapien
gggagtgcagttctgagtcccgccc

SEQ ID NO: 122862 - DNA, 25 bp, Homo sapien
gctatgctgggttaactgcacgccc

SEQ ID NO: 122863 - DNA, 25 bp, Homo sapien
gctccgtaggaagtcgctggcgttc

SEQ ID NO: 122864 - DNA, 25 bp, Homo sapien
gctggcgttcctctcaccgagggtc

SEQ ID NO: 122865 - DNA, 25 bp, Homo sapien
aggctgagggtgaaaccgcttctct

SEQ ID NO: 122866 - DNA, 25 bp, Homo sapien
tgaaaccgcttctctgttgacgccg

SEQ ID NO: 122867 - DNA, 25 bp, Homo sapien
tctggacctaggctcggtgacacct

SEQ ID NO: 122868 - DNA, 25 bp, Homo sapien
cagagctggctatgctgggttaact

SEQ ID NO: 122869 - DNA, 25 bp, Homo sapien
gtgacacctgcacggccggtgtagc

SEQ ID NO: 122870 - DNA, 25 bp, Homo sapien
cagcagtgtcattggcctgacgtga

SEQ ID NO: 122871 - DNA, 25 bp, Homo sapien
tacctccgtgcaggcggaaagtttg

SEQ ID NO: 122872 - DNA, 25 bp, Homo sapien
agctgcagacttggaggctcttata

SEQ ID NO: 122873 - DNA, 25 bp, Homo sapien
catcatctctcgagcggcgacgcgt

SEQ ID NO: 122874 - DNA, 25 bp, Homo sapien
aacgcctcgttcagcgactgggtgc

SEQ ID NO: 122875 - DNA, 25 bp, Homo sapien
acgttggccatgacccgctgcgtct

SEQ ID NO: 122876 - DNA, 25 bp, Homo sapien
tgcgtctgcagctcctcgtaagact

SEQ ID NO: 122877 - DNA, 25 bp, Homo sapien
ggacacgtcctgcatcatctctcga

SEQ ID NO: 122878 - DNA, 25 bp, Homo sapien
cgacttcacttagggcggtcgcgta

SEQ ID NO: 122879 - DNA, 25 bp, Homo sapien
gatatgaactctacagcagccactc

SEQ ID NO: 122880 - DNA, 25 bp, Homo sapien
gtcgcgtagatatgaactctacagc

SEQ ID NO: 122881 - DNA, 25 bp, Homo sapien
cggtcgcgtagatatgaactctaca

SEQ ID NO: 122882 - DNA, 25 bp, Homo sapien
ggcggtcgcgtagatatgaactcta

SEQ ID NO: 122883 - DNA, 25 bp, Homo sapien
acttagggcggtcgcgtagatatga

SEQ ID NO: 122884 - DNA, 25 bp, Homo sapien
tcacttagggcggtcgcgtagatat

SEQ ID NO: 122885 - DNA, 25 bp, Homo sapien
cccgacttcacttagggcggtcgcg

SEQ ID NO: 122886 - DNA, 25 bp, Homo sapien
ctcgtaagcaaacgtgggcaccttc

SEQ ID NO: 122887 - DNA, 25 bp, Homo sapien
cgggacagccttttctcgtaagcaa

SEQ ID NO: 122888 - DNA, 25 bp, Homo sapien
cgcagctggtcaaaggcctcgttga

SEQ ID NO: 122889 - DNA, 25 bp, Homo sapien
ctcgttgaggttgaacatccgcttc

SEQ ID NO: 122890 - DNA, 25 bp, Homo sapien
ccagacgttctgtcttggggcctcc

SEQ ID NO: 122891 - DNA, 25 bp, Homo sapien
gaagggcagactctccacaccaggc

SEQ ID NO: 122892 - DNA, 25 bp, Homo sapien
ctcagcgcatgtggggatcttacaa

SEQ ID NO: 122893 - DNA, 25 bp, Homo sapien
ctctccaagagctcggtcatgaagg

SEQ ID NO: 122894 - DNA, 25 bp, Homo sapien
atcaagctgttctcgaatgccggtg

SEQ ID NO: 122895 - DNA, 25 bp, Homo sapien
gcagcggcataagtcggcaactcta

SEQ ID NO: 122896 - DNA, 25 bp, Homo sapien
tgccctaccagagacccatcagaag

SEQ ID NO: 122897 - DNA, 25 bp, Homo sapien
gcagccatgctgcttgtcaaggttc

SEQ ID NO: 122898 - DNA, 25 bp, Homo sapien
gttgacgcaagcacaatcccatgtc

SEQ ID NO: 122899 - DNA, 25 bp, Homo sapien
ttcgagaacgggagcttagagcctc

SEQ ID NO: 122900 - DNA, 25 bp, Homo sapien
aatgccggtgcgtttcctgttaagg

SEQ ID NO: 122901 - DNA, 25 bp, Homo sapien
agcgactgttcaccagcgcacaagc

SEQ ID NO: 122902 - DNA, 25 bp, Homo sapien
gtccagagttctgccgcgtcccaaa

SEQ ID NO: 122903 - DNA, 25 bp, Homo sapien
gcgaccttgtctgatggcctctttc

SEQ ID NO: 122904 - DNA, 25 bp, Homo sapien
tcgtggcaatgcgaagtgcttctgc

SEQ ID NO: 122905 - DNA, 25 bp, Homo sapien
ctgggtttcttctccctcgtcgtcg

SEQ ID NO: 122906 - DNA, 25 bp, Homo sapien
caccacgctccttgcagttgctttg

SEQ ID NO: 122907 - DNA, 25 bp, Homo sapien
agcgggcggatgatattcagcacca

SEQ ID NO: 122908 - DNA, 25 bp, Homo sapien
cccttctgttttattgccgaggaga

SEQ ID NO: 122909 - DNA, 25 bp, Homo sapien
tgcgaagattgcacaccggtaccgg

SEQ ID NO: 122910 - DNA, 25 bp, Homo sapien
cctgtggaagcaactgcgctgattg

SEQ ID NO: 122911 - DNA, 25 bp, Homo sapien
gattgatgcgccacagacttttttc

SEQ ID NO: 122912 - DNA, 25 bp, Homo sapien
ctcttttctttgtcccggagcaggc

SEQ ID NO: 122913 - DNA, 25 bp, Homo sapien
aactaatggtgttggcctccctgcc

SEQ ID NO: 122914 - DNA, 25 bp, Homo sapien
caggacgctgccgacttgtctttgc

SEQ ID NO: 122915 - DNA, 25 bp, Homo sapien
gtggggaggtttcctagcaactctc

SEQ ID NO: 122916 - DNA, 25 bp, Homo sapien
tgtgtttggctcttcgctaagctga

SEQ ID NO: 122917 - DNA, 25 bp, Homo sapien
ccaccggctggagagaaacaaaagc

SEQ ID NO: 122918 - DNA, 25 bp, Homo sapien
gctccgggaagccagattgcttcta

SEQ ID NO: 122919 - DNA, 25 bp, Homo sapien
gtcaattatatcctggagctccggg

SEQ ID NO: 122920 - DNA, 25 bp, Homo sapien
tccggaggtggacgtgtcaattata

SEQ ID NO: 122921 - DNA, 25 bp, Homo sapien
ctgcaggggcttgcaagcgaagata

SEQ ID NO: 122922 - DNA, 25 bp, Homo sapien
gcaagcgaagataggcggccctcct

SEQ ID NO: 122923 - DNA, 25 bp, Homo sapien
cagattgcttctaccggcggctgca

SEQ ID NO: 122924 - DNA, 25 bp, Homo sapien
atttagccacgaggggacatgactg

SEQ ID NO: 122925 - DNA, 25 bp, Homo sapien
atgactggagccctgtcacgcgcag

SEQ ID NO: 122926 - DNA, 25 bp, Homo sapien
tgcggatcgccagttcggaaccctc

SEQ ID NO: 122927 - DNA, 25 bp, Homo sapien
ggcagaaagatcaagcgcggcaccc

SEQ ID NO: 122928 - DNA, 25 bp, Homo sapien
cccgtgacaggatgggacagattcc

SEQ ID NO: 122929 - DNA, 25 bp, Homo sapien
ctggtgcgggaaaactacagagcaa

SEQ ID NO: 122930 - DNA, 25 bp, Homo sapien
cccgagtgtcttttgagagcccaca

SEQ ID NO: 122931 - DNA, 25 bp, Homo sapien
ctcactcttcgctgctacgtgcaag

SEQ ID NO: 122932 - DNA, 25 bp, Homo sapien
ggctcaaaacctctcgcagaattca

SEQ ID NO: 122933 - DNA, 25 bp, Homo sapien
ccaccgtgggtttgcccaaggtcag

SEQ ID NO: 122934 - DNA, 25 bp, Homo sapien
cttgaagccgtccatgaggtgctgc

SEQ ID NO: 122935 - DNA, 25 bp, Homo sapien
tgcagcccgtccacagaggtgtgca

SEQ ID NO: 122936 - DNA, 25 bp, Homo sapien
ggtgcgagggcttaaaccacgactc

SEQ ID NO: 122937 - DNA, 25 bp, Homo sapien
agccgggtagcactggcttgaagcc

SEQ ID NO: 122938 - DNA, 25 bp, Homo sapien
ttgaggtgcgaagtcttgccgtaca

SEQ ID NO: 122939 - DNA, 25 bp, Homo sapien
gccactgtgcgtcttcacgtgcttg

SEQ ID NO: 122940 - DNA, 25 bp, Homo sapien
atccgagttgtagcctccgagcggc

SEQ ID NO: 122941 - DNA, 25 bp, Homo sapien
tcaggcccgagtaatccgagttgta

SEQ ID NO: 122942 - DNA, 25 bp, Homo sapien
gaaacgtgtctggaggctactgccc

SEQ ID NO: 122943 - DNA, 25 bp, Homo sapien
gattttgtaacatttcccagcgctg

SEQ ID NO: 122944 - DNA, 25 bp, Homo sapien
gctcagtgggtgtgattttgtaaca

SEQ ID NO: 122945 - DNA, 25 bp, Homo sapien
cgcgagaggactaggctcagagtcc

SEQ ID NO: 122946 - DNA, 25 bp, Homo sapien
atttggttttcatgcccgacaggcg

SEQ ID NO: 122947 - DNA, 25 bp, Homo sapien
cccggtgcagaatttggttttcatg

SEQ ID NO: 122948 - DNA, 25 bp, Homo sapien
gctttgggagctgaaagtttccttg

SEQ ID NO: 122949 - DNA, 25 bp, Homo sapien
ccgcccagctgcttggactcgaggt

SEQ ID NO: 122950 - DNA, 25 bp, Homo sapien
acgcggacgtgttggctactaaata

SEQ ID NO: 122951 - DNA, 25 bp, Homo sapien
acagagcgaacgcagtgctggcact

SEQ ID NO: 122952 - DNA, 25 bp, Homo sapien
catgcagctctggaagctgaccggc

SEQ ID NO: 122953 - DNA, 25 bp, Homo sapien
cgcctctcccagaatgggaagacga

SEQ ID NO: 122954 - DNA, 25 bp, Homo sapien
catctcggtttctagagcgttggca

SEQ ID NO: 122955 - DNA, 25 bp, Homo sapien
cgcgtacctctgcagggtacgttta

SEQ ID NO: 122956 - DNA, 25 bp, Homo sapien
tttaaacccggctcttagcatctcg

SEQ ID NO: 122957 - DNA, 25 bp, Homo sapien
cccttgactagtgtgcggggtcctc

SEQ ID NO: 122958 - DNA, 25 bp, Homo sapien
ttggttatcacaacgaacattagtg

SEQ ID NO: 122959 - DNA, 25 bp, Homo sapien
ctgagatctgcaccacgagaagggc

SEQ ID NO: 122960 - DNA, 25 bp, Homo sapien
gtggtgagaacatcaggctggtttc

SEQ ID NO: 122961 - DNA, 25 bp, Homo sapien
ggctggtttctgctgttgatctaca

SEQ ID NO: 122962 - DNA, 25 bp, Homo sapien
tgcgccctgtaagttgcttctggta

SEQ ID NO: 122963 - DNA, 25 bp, Homo sapien
tctacatccgaggtgcactggcctg

SEQ ID NO: 122964 - DNA, 25 bp, Homo sapien
gccctgattatattgcgccctgtaa

SEQ ID NO: 122965 - DNA, 25 bp, Homo sapien
tgagaagggtcacatggtaacacta

SEQ ID NO: 122966 - DNA, 25 bp, Homo sapien
gagagacagcctgccgtcccaggtc

SEQ ID NO: 122967 - DNA, 25 bp, Homo sapien
aggtcgccggccagggcacacacgc

SEQ ID NO: 122968 - DNA, 25 bp, Homo sapien
cttagccgtgctctcccgccgagct

SEQ ID NO: 122969 - DNA, 25 bp, Homo sapien
tcctgggccggtcacaaagcccctc

SEQ ID NO: 122970 - DNA, 25 bp, Homo sapien
ccgggccgccgacctgacacctgct

SEQ ID NO: 122971 - DNA, 25 bp, Homo sapien
ccgacctgacacctgctgggcagcc

SEQ ID NO: 122972 - DNA, 25 bp, Homo sapien
cctgccgtcccaggtccagcccgcg

SEQ ID NO: 122973 - DNA, 25 bp, Homo sapien
ccacccgggcaatagtgacctactg

SEQ ID NO: 122974 - DNA, 25 bp, Homo sapien
agagaggagctgctacgccacagcc

SEQ ID NO: 122975 - DNA, 25 bp, Homo sapien
gcgctcctgagctagaacgccgaga

SEQ ID NO: 122976 - DNA, 25 bp, Homo sapien
gcgggatatcctgagacaacaagtt

SEQ ID NO: 122977 - DNA, 25 bp, Homo sapien
tgcctggatcaagggccctactttt

SEQ ID NO: 122978 - DNA, 25 bp, Homo sapien
gccgctctcgcttgcctggatcaag

SEQ ID NO: 122979 - DNA, 25 bp, Homo sapien
tccggatgcgcctcaggaaagccat

SEQ ID NO: 122980 - DNA, 25 bp, Homo sapien
actacgagtaccgacagccttcgcg

SEQ ID NO: 122981 - DNA, 25 bp, Homo sapien
ccgctgtcaatcaagggcgagtcag

SEQ ID NO: 122982 - DNA, 25 bp, Homo sapien
gccgtgttcgggacctagagcccga

SEQ ID NO: 122983 - DNA, 25 bp, Homo sapien
cgttccctcggacggttgcccaatg

SEQ ID NO: 122984 - DNA, 25 bp, Homo sapien
tatttggaaagcgaggacaaccggc

SEQ ID NO: 122985 - DNA, 25 bp, Homo sapien
accagcccggcttgccttgtgttta

SEQ ID NO: 122986 - DNA, 25 bp, Homo sapien
ctaagtagcagcaggtgggagacta

SEQ ID NO: 122987 - DNA, 25 bp, Homo sapien
gcaaggggacctgcccatccaacaa

SEQ ID NO: 122988 - DNA, 25 bp, Homo sapien
cttgcggcttcccaggaggtaagag

SEQ ID NO: 122989 - DNA, 25 bp, Homo sapien
tgccttgtgtttagcttcgccgcct

SEQ ID NO: 122990 - DNA, 25 bp, Homo sapien
tggctccgatcacgttccaacttcg

SEQ ID NO: 122991 - DNA, 25 bp, Homo sapien
tcacctggtagcgagtcgccaactc

SEQ ID NO: 122992 - DNA, 25 bp, Homo sapien
aagtcaaactgtgggtgcgtccgga

SEQ ID NO: 122993 - DNA, 25 bp, Homo sapien
caagggccacgtttccagcccaagg

SEQ ID NO: 122994 - DNA, 25 bp, Homo sapien
tgtggtccgcgtagcacaaacgtga

SEQ ID NO: 122995 - DNA, 25 bp, Homo sapien
tctcacgagggctgcaaacgcaggc

SEQ ID NO: 122996 - DNA, 25 bp, Homo sapien
actgaccttgtcttcgcaggcggcg

SEQ ID NO: 122997 - DNA, 25 bp, Homo sapien
gcggcaagagcaattaccagtgtta

SEQ ID NO: 122998 - DNA, 25 bp, Homo sapien
gccttcagagttcgaagagaaaaga

SEQ ID NO: 122999 - DNA, 25 bp, Homo sapien
attctccgtcagacaggccctgcgg

SEQ ID NO: 123000 - DNA, 25 bp, Homo sapien
ttcgaagagaaaagatgcgaccttc

SEQ ID NO: 123001 - DNA, 25 bp, Homo sapien
tttaggaaatcaaggggccagcgcc

SEQ ID NO: 123002 - DNA, 25 bp, Homo sapien
ggactggttgtcttttaggaaatca

SEQ ID NO: 123003 - DNA, 25 bp, Homo sapien
ggtttgctcttcagcactccggtcc

SEQ ID NO: 123004 - DNA, 25 bp, Homo sapien
gttgcctaaggctcggtttgctctt

SEQ ID NO: 123005 - DNA, 25 bp, Homo sapien
gatgcgaccttcaatccgctccatt

SEQ ID NO: 123006 - DNA, 25 bp, Homo sapien
cctgcaaacagggatgccgctcgtg

SEQ ID NO: 123007 - DNA, 25 bp, Homo sapien
tccgagaagaggcaaacagctcgtc

SEQ ID NO: 123008 - DNA, 25 bp, Homo sapien
agctcgtcttcagccgatgcccggt

SEQ ID NO: 123009 - DNA, 25 bp, Homo sapien
ccctggggttaagtcaggtgcagcc

SEQ ID NO: 123010 - DNA, 25 bp, Homo sapien
gcatcttgacggagcccacggccat

SEQ ID NO: 123011 - DNA, 25 bp, Homo sapien
ccgcgccttcgccaggaagcgagag

SEQ ID NO: 123012 - DNA, 25 bp, Homo sapien
gagtccggcagaagggcgtcccttc

SEQ ID NO: 123013 - DNA, 25 bp, Homo sapien
cgtcgcatgcgtcctgcaaacaggg

SEQ ID NO: 123014 - DNA, 25 bp, Homo sapien
agtttcctctcaaatgccgtctgcc

SEQ ID NO: 123015 - DNA, 25 bp, Homo sapien
ggaacgtccttggaggctaagactc

SEQ ID NO: 123016 - DNA, 25 bp, Homo sapien
gtccaggtcacgagaaggcttgcga

SEQ ID NO: 123017 - DNA, 25 bp, Homo sapien
aacgattcaagggactcacccactc

SEQ ID NO: 123018 - DNA, 25 bp, Homo sapien
ccagtgagaacgattcaagggactc

SEQ ID NO: 123019 - DNA, 25 bp, Homo sapien
agcaaacggccagtgagaacgattc

SEQ ID NO: 123020 - DNA, 25 bp, Homo sapien
gagaaggcttgcgacccgctacacc

SEQ ID NO: 123021 - DNA, 25 bp, Homo sapien
cggactcgaggagcaaacggccagt

SEQ ID NO: 123022 - DNA, 25 bp, Homo sapien
ggctgtagcccgtccatttctcatc

SEQ ID NO: 123023 - DNA, 25 bp, Homo sapien
agcccgtccatttctcatcctggga

SEQ ID NO: 123024 - DNA, 25 bp, Homo sapien
cgtccatttctcatcctgggatagc

SEQ ID NO: 123025 - DNA, 25 bp, Homo sapien
ctcatcctgggatagcgaggggttt

SEQ ID NO: 123026 - DNA, 25 bp, Homo sapien
cctttcccaggtggtgccgtggtgg

SEQ ID NO: 123027 - DNA, 25 bp, Homo sapien
tgaggaaaatatgtacggctgtagc

SEQ ID NO: 123028 - DNA, 25 bp, Homo sapien
tgtacggctgtagcccgtccatttc

SEQ ID NO: 123029 - DNA, 25 bp, Homo sapien
catcctgggatagcgaggggtttcc

SEQ ID NO: 123030 - DNA, 25 bp, Homo sapien
ggcgcagcttgactgccaccgactg

SEQ ID NO: 123031 - DNA, 25 bp, Homo sapien
agcggcgcagcttgactgccaccga

SEQ ID NO: 123032 - DNA, 25 bp, Homo sapien
agcggctgcccgctgagaaggaatc

SEQ ID NO: 123033 - DNA, 25 bp, Homo sapien
gaattccaaggccagcggctgcccg

SEQ ID NO: 123034 - DNA, 25 bp, Homo sapien
tgcccgggccgaattccaaggccag

SEQ ID NO: 123035 - DNA, 25 bp, Homo sapien
aatccggaccaacgggattctggct

SEQ ID NO: 123036 - DNA, 25 bp, Homo sapien
gtaggcggagctcccaggaaaacag

SEQ ID NO: 123037 - DNA, 25 bp, Homo sapien
cggagctcccaggaaaacagcgggc

SEQ ID NO: 123038 - DNA, 25 bp, Homo sapien
agtcagagaaacagtcctggcttgc

SEQ ID NO: 123039 - DNA, 25 bp, Homo sapien
tccaaaccagaggacgcagaaatgc

SEQ ID NO: 123040 - DNA, 25 bp, Homo sapien
cgggaaacctggaagtggccaccag

SEQ ID NO: 123041 - DNA, 25 bp, Homo sapien
gcctgggtagtctcgaaagtcgcca

SEQ ID NO: 123042 - DNA, 25 bp, Homo sapien
tcgaaagtcgccaaggctacctcag

SEQ ID NO: 123043 - DNA, 25 bp, Homo sapien
tgtggccgcccagatacgcctggat

SEQ ID NO: 123044 - DNA, 25 bp, Homo sapien
cgcctgaggaaactccgaggacacc

SEQ ID NO: 123045 - DNA, 25 bp, Homo sapien
agcgggtcgtcttccagaagagtca

SEQ ID NO: 123046 - DNA, 25 bp, Homo sapien
tacagcaaccacagcgtcgggaatc

SEQ ID NO: 123047 - DNA, 25 bp, Homo sapien
gccacacacggcctttacggcagga

SEQ ID NO: 123048 - DNA, 25 bp, Homo sapien
cctttacggcaggagtcgtgagcgt

SEQ ID NO: 123049 - DNA, 25 bp, Homo sapien
tcgccagcagaggtcgtaattcatc

SEQ ID NO: 123050 - DNA, 25 bp, Homo sapien
gaggtcgtaattcatcgcctttaac

SEQ ID NO: 123051 - DNA, 25 bp, Homo sapien
ctcgccggcagtagtaggcgcatgc

SEQ ID NO: 123052 - DNA, 25 bp, Homo sapien
cgcatgcgtggttgcgatcatggct

SEQ ID NO: 123053 - DNA, 25 bp, Homo sapien
gcgatcatggctggcggtaacttcg

SEQ ID NO: 123054 - DNA, 25 bp, Homo sapien
gggcactggagtgccctacacacgc

SEQ ID NO: 123055 - DNA, 25 bp, Homo sapien
ctgtggtctctgctgtactcaggcc

SEQ ID NO: 123056 - DNA, 25 bp, Homo sapien
tggtctctgctgtactcaggcctgc

SEQ ID NO: 123057 - DNA, 25 bp, Homo sapien
tctgctgtactcaggcctgcctcgg

SEQ ID NO: 123058 - DNA, 25 bp, Homo sapien
ggccagttctttcccgcactatctg

SEQ ID NO: 123059 - DNA, 25 bp, Homo sapien
ttcccgcactatctggaaatgcgtg

SEQ ID NO: 123060 - DNA, 25 bp, Homo sapien
gcactatctggaaatgcgtggaatt

SEQ ID NO: 123061 - DNA, 25 bp, Homo sapien
tgcgtggaattgtgagcatctaccc

SEQ ID NO: 123062 - DNA, 25 bp, Homo sapien
ggttagcaaacacacggaggtcatt

SEQ ID NO: 123063 - DNA, 25 bp, Homo sapien
tttaaacttgatctccgcagtgccc

SEQ ID NO: 123064 - DNA, 25 bp, Homo sapien
gcattcggcctacaggcagctttta

SEQ ID NO: 123065 - DNA, 25 bp, Homo sapien
gatctgatgtctgaagcgctttaag

SEQ ID NO: 123066 - DNA, 25 bp, Homo sapien
aggtcatttcactcgcgcagccatc

SEQ ID NO: 123067 - DNA, 25 bp, Homo sapien
ggcccgcagtcagataatttaaagg

SEQ ID NO: 123068 - DNA, 25 bp, Homo sapien
cgttcatttgctactggcccgcagt

SEQ ID NO: 123069 - DNA, 25 bp, Homo sapien
cctatttgggaagcgagtgagatct

SEQ ID NO: 123070 - DNA, 25 bp, Homo sapien
gacagtgaccattgtggccaccaga

SEQ ID NO: 123071 - DNA, 25 bp, Homo sapien
agaatcttcttctgctgggcctggg

SEQ ID NO: 123072 - DNA, 25 bp, Homo sapien
cacctgcaggacctcgactcgtgag

SEQ ID NO: 123073 - DNA, 25 bp, Homo sapien
aagttatccgttgccggacgccctg

SEQ ID NO: 123074 - DNA, 25 bp, Homo sapien
ttcctagcagaacgggtcccggtga

SEQ ID NO: 123075 - DNA, 25 bp, Homo sapien
tcactgactgacaacccagccggga

SEQ ID NO: 123076 - DNA, 25 bp, Homo sapien
tctctgacaggcacgaccagggacc

SEQ ID NO: 123077 - DNA, 25 bp, Homo sapien
tcgtgaggctctcagcgacagcgac

SEQ ID NO: 123078 - DNA, 25 bp, Homo sapien
ctgccgaggatgtagctcccaagtc

SEQ ID NO: 123079 - DNA, 25 bp, Homo sapien
ctgcagtctcattgctcggaacggc

SEQ ID NO: 123080 - DNA, 25 bp, Homo sapien
cgccgtgtttggtcgatagaatccc

SEQ ID NO: 123081 - DNA, 25 bp, Homo sapien
tgctgctcgggaagaagctaaattg

SEQ ID NO: 123082 - DNA, 25 bp, Homo sapien
ttccgttttcgcaggcgagcgattc

SEQ ID NO: 123083 - DNA, 25 bp, Homo sapien
tagaggggcgcgtaaaacaattctc

SEQ ID NO: 123084 - DNA, 25 bp, Homo sapien
caaaagtgcttctcgtctgccgagg

SEQ ID NO: 123085 - DNA, 25 bp, Homo sapien
ggcaaaattcactcagcgcgggaca

SEQ ID NO: 123086 - DNA, 25 bp, Homo sapien
ggtccgctcttctcaagtcctattg

SEQ ID NO: 123087 - DNA, 25 bp, Homo sapien
gtgcagactgaagacgccctccgtc

SEQ ID NO: 123088 - DNA, 25 bp, Homo sapien
acgccgtcgcaatggccatttgtca

SEQ ID NO: 123089 - DNA, 25 bp, Homo sapien
tgctggaacgaacatcccggtgcta

SEQ ID NO: 123090 - DNA, 25 bp, Homo sapien
cgcagcagcagccttcaggtgactc

SEQ ID NO: 123091 - DNA, 25 bp, Homo sapien
tactgggccctgcacaacgttttta

SEQ ID NO: 123092 - DNA, 25 bp, Homo sapien
ggcgcgagaagatgacgtcacagta

SEQ ID NO: 123093 - DNA, 25 bp, Homo sapien
ttggctcaagtccatgcgtctcatg

SEQ ID NO: 123094 - DNA, 25 bp, Homo sapien
tgaccgctctgttcccactggacga

SEQ ID NO: 123095 - DNA, 25 bp, Homo sapien
tgttcccactggacgagacctgccg

SEQ ID NO: 123096 - DNA, 25 bp, Homo sapien
gtctcgcgacgcaggcaagctcggc

SEQ ID NO: 123097 - DNA, 25 bp, Homo sapien
caacaccgcgcggcggagaccgtta

SEQ ID NO: 123098 - DNA, 25 bp, Homo sapien
gccgagccgccgagacgcagtgtct

SEQ ID NO: 123099 - DNA, 25 bp, Homo sapien
cagaaagagctcgaagagacgcaga

SEQ ID NO: 123100 - DNA, 25 bp, Homo sapien
gagtcctcaggacaacggacaaagg

SEQ ID NO: 123101 - DNA, 25 bp, Homo sapien
cgagacctgccgagtcctcaggaca

SEQ ID NO: 123102 - DNA, 25 bp, Homo sapien
gaagagagctgagccgctgtaaccc

SEQ ID NO: 123103 - DNA, 25 bp, Homo sapien
tcccatcacagggagctgacccggt

SEQ ID NO: 123104 - DNA, 25 bp, Homo sapien
tttttggaaaggaagtcccatcaca

SEQ ID NO: 123105 - DNA, 25 bp, Homo sapien
gactgcgactgcgacccgggaaaac

SEQ ID NO: 123106 - DNA, 25 bp, Homo sapien
cgcgccctaaccctcagtctcccga

SEQ ID NO: 123107 - DNA, 25 bp, Homo sapien
agcggcttctggtcagagccgcaga

SEQ ID NO: 123108 - DNA, 25 bp, Homo sapien
gctgacccggtgtcagcgcgcagca

SEQ ID NO: 123109 - DNA, 25 bp, Homo sapien
ccgctgtaaccctgggcctgggatt

SEQ ID NO: 123110 - DNA, 25 bp, Homo sapien
ccgcccacgcatcgacgtagaattt

SEQ ID NO: 123111 - DNA, 25 bp, Homo sapien
actgcagtcttcacgggctccagac

SEQ ID NO: 123112 - DNA, 25 bp, Homo sapien
tggtccgtccttcaggccttgactc

SEQ ID NO: 123113 - DNA, 25 bp, Homo sapien
ttcccggccgggctccatgaagtac

SEQ ID NO: 123114 - DNA, 25 bp, Homo sapien
cggtcaacgagggacgcccagaatc

SEQ ID NO: 123115 - DNA, 25 bp, Homo sapien
gcccagaatcggacgcggcaggtac

SEQ ID NO: 123116 - DNA, 25 bp, Homo sapien
tcttccgggtcactgcagtcttcac

SEQ ID NO: 123117 - DNA, 25 bp, Homo sapien
ttcccgtaggagcagcgttctgccg

SEQ ID NO: 123118 - DNA, 25 bp, Homo sapien
cattccagagtctgctggacgccca

SEQ ID NO: 123119 - DNA, 25 bp, Homo sapien
cgtccgaggtaagcgccgaaccaag

SEQ ID NO: 123120 - DNA, 25 bp, Homo sapien
gagcgcgtccacaaaacgcccgagg

SEQ ID NO: 123121 - DNA, 25 bp, Homo sapien
tcacggcgcgctcacaatggagctc

SEQ ID NO: 123122 - DNA, 25 bp, Homo sapien
ctcggagtctgtgcagaaaggcttc

SEQ ID NO: 123123 - DNA, 25 bp, Homo sapien
acgaggccgtgttaggtaagccgct

SEQ ID NO: 123124 - DNA, 25 bp, Homo sapien
aaaggcttccagatgctggcggatc

SEQ ID NO: 123125 - DNA, 25 bp, Homo sapien
gagcttcccgcaggattcgcgcaga

SEQ ID NO: 123126 - DNA, 25 bp, Homo sapien
taattccagagaaaaatggagagta

SEQ ID NO: 123127 - DNA, 25 bp, Homo sapien
ctcgctgccctttaaatcgcggctg

SEQ ID NO: 123128 - DNA, 25 bp, Homo sapien
gcgattcagagcgagccgtcgcctc

SEQ ID NO: 123129 - DNA, 25 bp, Homo sapien
gacaaagggcgattcagagcgagcc

SEQ ID NO: 123130 - DNA, 25 bp, Homo sapien
tggaaggatacgaaaagaaggccgc

SEQ ID NO: 123131 - DNA, 25 bp, Homo sapien
ctccgctgacgggaaaaatgagtcc

SEQ ID NO: 123132 - DNA, 25 bp, Homo sapien
atggagagtaaaatccaagatggcg

SEQ ID NO: 123133 - DNA, 25 bp, Homo sapien
tgccctttaaatcgcggctgaggcg

SEQ ID NO: 123134 - DNA, 25 bp, Homo sapien
gcatcaccaagtccctgtacgtcag

SEQ ID NO: 123135 - DNA, 25 bp, Homo sapien
gcatccgcaggtccctgtctgtcag

SEQ ID NO: 123136 - DNA, 25 bp, Homo sapien
tgcaacaccaggtcccgtccgtcag

SEQ ID NO: 123137 - DNA, 25 bp, Homo sapien
ccctacccatcagtcggcatcaccg

SEQ ID NO: 123138 - DNA, 25 bp, Homo sapien
ccaagtccctgtacgtcagtcagca

SEQ ID NO: 123139 - DNA, 25 bp, Homo sapien
gtacgtcagtcagcatcaccacatc

SEQ ID NO: 123140 - DNA, 25 bp, Homo sapien
tcatcggcttcaccgcatccgcagg

SEQ ID NO: 123141 - DNA, 25 bp, Homo sapien
gcatcaccaggtccctacccatcag

SEQ ID NO: 123142 - DNA, 25 bp, Homo sapien
acaggctgaaccaggcgcgaaggac

SEQ ID NO: 123143 - DNA, 25 bp, Homo sapien
gggctttcttgacagcgcgttcgcc

SEQ ID NO: 123144 - DNA, 25 bp, Homo sapien
acaggcgggcattctagctcggccc

SEQ ID NO: 123145 - DNA, 25 bp, Homo sapien
cgcagcacagacagcgccgtaaata

SEQ ID NO: 123146 - DNA, 25 bp, Homo sapien
ggtcgaggccactttccgttctcca

SEQ ID NO: 123147 - DNA, 25 bp, Homo sapien
ggggaaaccgggcacacactctctc

SEQ ID NO: 123148 - DNA, 25 bp, Homo sapien
ccctatcgctcgtcggaccagggga

SEQ ID NO: 123149 - DNA, 25 bp, Homo sapien
gcccgcaccacgtctgaattgatta

SEQ ID NO: 123150 - DNA, 25 bp, Homo sapien
ccctggatttccatcttttgtggcg

SEQ ID NO: 123151 - DNA, 25 bp, Homo sapien
ttgtggcgcgaaaataaccctttgc

SEQ ID NO: 123152 - DNA, 25 bp, Homo sapien
cagagcggtttgctggttttcattc

SEQ ID NO: 123153 - DNA, 25 bp, Homo sapien
agcaaccggcgtcgagagagacacc

SEQ ID NO: 123154 - DNA, 25 bp, Homo sapien
cggcttgccgagtccaagttgagca

SEQ ID NO: 123155 - DNA, 25 bp, Homo sapien
gactggcgcgcaaaagcggctccaa

SEQ ID NO: 123156 - DNA, 25 bp, Homo sapien
gcacctctggtctcagttgcgtgtg

SEQ ID NO: 123157 - DNA, 25 bp, Homo sapien
ggatcctcacggctcacagtgggga

SEQ ID NO: 123158 - DNA, 25 bp, Homo sapien
gcatgttctcatttccaggtttctc

SEQ ID NO: 123159 - DNA, 25 bp, Homo sapien
actgggtccctccatggccttgggc

SEQ ID NO: 123160 - DNA, 25 bp, Homo sapien
cgcacgagcttgggaaggacatgtc

SEQ ID NO: 123161 - DNA, 25 bp, Homo sapien
cctgtgcgggcagaagctgtgtcct

SEQ ID NO: 123162 - DNA, 25 bp, Homo sapien
gcatcggtggtcttcacgacgtaca

SEQ ID NO: 123163 - DNA, 25 bp, Homo sapien
caaaagtagcgcatcggtggtcttc

SEQ ID NO: 123164 - DNA, 25 bp, Homo sapien
ggtcttcacgacgtacacccagaag

SEQ ID NO: 123165 - DNA, 25 bp, Homo sapien
ccaccagcatgttctcatttccagg

SEQ ID NO: 123166 - DNA, 25 bp, Homo sapien
tcagggactacaatggctacgctgg

SEQ ID NO: 123167 - DNA, 25 bp, Homo sapien
catcagggactacaatggctacgct

SEQ ID NO: 123168 - DNA, 25 bp, Homo sapien
agggactacaatggctacgctggtc

SEQ ID NO: 123169 - DNA, 25 bp, Homo sapien
ggactacaatggctacgctggtcgg

SEQ ID NO: 123170 - DNA, 25 bp, Homo sapien
ctacaatggctacgctggtcgggtt

SEQ ID NO: 123171 - DNA, 25 bp, Homo sapien
caatggctacgctggtcgggttgaa

SEQ ID NO: 123172 - DNA, 25 bp, Homo sapien
cgctggtcgggttgaagtgctccaa

SEQ ID NO: 123173 - DNA, 25 bp, Homo sapien
gttgccatcagggactacaatggct

SEQ ID NO: 123174 - DNA, 25 bp, Homo sapien
gatggcctaattaacccgctgactg

SEQ ID NO: 123175 - DNA, 25 bp, Homo sapien
catcactcatgtcgacgaggcgctc

SEQ ID NO: 123176 - DNA, 25 bp, Homo sapien
ctctgccctcgaagttgttttcctc

SEQ ID NO: 123177 - DNA, 25 bp, Homo sapien
gtccaggtatcagtcagcctccaaa

SEQ ID NO: 123178 - DNA, 25 bp, Homo sapien
ggacccacacctcggagcagacata

SEQ ID NO: 123179 - DNA, 25 bp, Homo sapien
acgcggccgctcactgaaatagaga

SEQ ID NO: 123180 - DNA, 25 bp, Homo sapien
ggcctcctcagagcacgacgtaaag

SEQ ID NO: 123181 - DNA, 25 bp, Homo sapien
ttcgcctttttagacgcaacgccgc

SEQ ID NO: 123182 - DNA, 25 bp, Homo sapien
cgcctgcgatggtcaacacattgta

SEQ ID NO: 123183 - DNA, 25 bp, Homo sapien
taccttcgaggatgaggcatctttc

SEQ ID NO: 123184 - DNA, 25 bp, Homo sapien
ttcggctccgatagtgttcacagta

SEQ ID NO: 123185 - DNA, 25 bp, Homo sapien
ctacttgaccaggaacggcttcttc

SEQ ID NO: 123186 - DNA, 25 bp, Homo sapien
gtcgtgtccggtcactactacttga

SEQ ID NO: 123187 - DNA, 25 bp, Homo sapien
tgctgcgaagacgagcggctaaatg

SEQ ID NO: 123188 - DNA, 25 bp, Homo sapien
tacactcttggctttccggctgctg

SEQ ID NO: 123189 - DNA, 25 bp, Homo sapien
cccgacatggtagatgaggtggccc

SEQ ID NO: 123190 - DNA, 25 bp, Homo sapien
gacgcccgcttattagctctcgctg

SEQ ID NO: 123191 - DNA, 25 bp, Homo sapien
tccagctcgatctggaggctgcttc

SEQ ID NO: 123192 - DNA, 25 bp, Homo sapien
ccacaagctgggaacaaacctcgtc

SEQ ID NO: 123193 - DNA, 25 bp, Homo sapien
gccgcttcctcattctgggactaca

SEQ ID NO: 123194 - DNA, 25 bp, Homo sapien
ggcgggctcatcttccaacacagaa

SEQ ID NO: 123195 - DNA, 25 bp, Homo sapien
ttaaggccgagggtatgcctctggc

SEQ ID NO: 123196 - DNA, 25 bp, Homo sapien
tcgggaacaagacgccagagccctt

SEQ ID NO: 123197 - DNA, 25 bp, Homo sapien
ctgctgcggaaacccggcttaggaa

SEQ ID NO: 123198 - DNA, 25 bp, Homo sapien
tattgacggcggctatgcaggacac

SEQ ID NO: 123199 - DNA, 25 bp, Homo sapien
cgagcagactacattacggaacatc

SEQ ID NO: 123200 - DNA, 25 bp, Homo sapien
tacggaacatctaccttacttttgc

SEQ ID NO: 123201 - DNA, 25 bp, Homo sapien
ggccaagtaatacggggcctcagcc

SEQ ID NO: 123202 - DNA, 25 bp, Homo sapien
cgcggcaggcaaagctcatgttcct

SEQ ID NO: 123203 - DNA, 25 bp, Homo sapien
ccagggtctcggcatcatattgacg

SEQ ID NO: 123204 - DNA, 25 bp, Homo sapien
gtgtcgtccagcctataatgcgccc

SEQ ID NO: 123205 - DNA, 25 bp, Homo sapien
cgcaacatgttgtcggtgtcgtcca

SEQ ID NO: 123206 - DNA, 25 bp, Homo sapien
ggcttcgaggtcagctggtccgcag

SEQ ID NO: 123207 - DNA, 25 bp, Homo sapien
ctttggcttccccaccggcaatgga

SEQ ID NO: 123208 - DNA, 25 bp, Homo sapien
caccggcaatggagcggttgacgtt

SEQ ID NO: 123209 - DNA, 25 bp, Homo sapien
caatggagcggttgacgttgcctct

SEQ ID NO: 123210 - DNA, 25 bp, Homo sapien
atggagcggttgacgttgcctctcg

SEQ ID NO: 123211 - DNA, 25 bp, Homo sapien
ggtccgcagggaagcctttggcttc

SEQ ID NO: 123212 - DNA, 25 bp, Homo sapien
cgcgtcctgcgcagttgccgcgcgc

SEQ ID NO: 123213 - DNA, 25 bp, Homo sapien
ctgcgcttgcggagatccgggttct

SEQ ID NO: 123214 - DNA, 25 bp, Homo sapien
ggcgacctcgaaacgcctcgtgaga

SEQ ID NO: 123215 - DNA, 25 bp, Homo sapien
ctcgtgagacctttcgcgggcacac

SEQ ID NO: 123216 - DNA, 25 bp, Homo sapien
cagccgagcctgaagaggcgacctc

SEQ ID NO: 123217 - DNA, 25 bp, Homo sapien
tgagctcagaggcaccttgtcggca

SEQ ID NO: 123218 - DNA, 25 bp, Homo sapien
cgcgctgccagaaggagctattttg

SEQ ID NO: 123219 - DNA, 25 bp, Homo sapien
gggccacttcttgcgcgctgccaga

SEQ ID NO: 123220 - DNA, 25 bp, Homo sapien
cctcggacagtaggaaggagcctga

SEQ ID NO: 123221 - DNA, 25 bp, Homo sapien
gcccaaacgccggaaatgacgtcac

SEQ ID NO: 123222 - DNA, 25 bp, Homo sapien
ggaatctgggcggatgggaagtcct

SEQ ID NO: 123223 - DNA, 25 bp, Homo sapien
gtcctggagaggaccgcctgaggac

SEQ ID NO: 123224 - DNA, 25 bp, Homo sapien
ggaggatgtgtgtgtacaagcggag

SEQ ID NO: 123225 - DNA, 25 bp, Homo sapien
tgtacaagcggaggggagacgctcc

SEQ ID NO: 123226 - DNA, 25 bp, Homo sapien
cctctgcggcatcgtgggtggccca

SEQ ID NO: 123227 - DNA, 25 bp, Homo sapien
gcccagatgacccagaggtgtgcgc

SEQ ID NO: 123228 - DNA, 25 bp, Homo sapien
cagatgacccagaggtgtgcgcgca

SEQ ID NO: 123229 - DNA, 25 bp, Homo sapien
atgacccagaggtgtgcgcgcagac

SEQ ID NO: 123230 - DNA, 25 bp, Homo sapien
agtcgctcctttggcctgaggacgc

SEQ ID NO: 123231 - DNA, 25 bp, Homo sapien
gcagcgacgcgctctttttccgctt

SEQ ID NO: 123232 - DNA, 25 bp, Homo sapien
gcacctgcagcgacgcgctcttttt

SEQ ID NO: 123233 - DNA, 25 bp, Homo sapien
cctgaggacgcggttcattgtcctg

SEQ ID NO: 123234 - DNA, 25 bp, Homo sapien
cgaaactggaaacggagtcgctcct

SEQ ID NO: 123235 - DNA, 25 bp, Homo sapien
gacgcggttcattgtcctggatcct

SEQ ID NO: 123236 - DNA, 25 bp, Homo sapien
gtttttgatcgtccggaatctgggc

SEQ ID NO: 123237 - DNA, 25 bp, Homo sapien
cctggatcctgaccgaggctggtgc

SEQ ID NO: 123238 - DNA, 25 bp, Homo sapien
gtgagtgctacgacccgtctgtcta

SEQ ID NO: 123239 - DNA, 25 bp, Homo sapien
ggcggctaaattccacttgttcctc

SEQ ID NO: 123240 - DNA, 25 bp, Homo sapien
cggaccagccctcttggcggctaaa

SEQ ID NO: 123241 - DNA, 25 bp, Homo sapien
cagcgccatcgagtgaggaatccct

SEQ ID NO: 123242 - DNA, 25 bp, Homo sapien
cgctcgcccgacagcatagtacttg

SEQ ID NO: 123243 - DNA, 25 bp, Homo sapien
tttgaatgctaaactggcggggccc

SEQ ID NO: 123244 - DNA, 25 bp, Homo sapien
ctggcccagggagcaattctctttc

SEQ ID NO: 123245 - DNA, 25 bp, Homo sapien
cctccctggattcttgggctccaaa

SEQ ID NO: 123246 - DNA, 25 bp, Homo sapien
ccctccttcgtgtgactctctggga

SEQ ID NO: 123247 - DNA, 25 bp, Homo sapien
cttttcgggactcacccgggagatg

SEQ ID NO: 123248 - DNA, 25 bp, Homo sapien
cacccagagaagagaccggaacaca

SEQ ID NO: 123249 - DNA, 25 bp, Homo sapien
gaagagtgggctgcgcctgccttcc

SEQ ID NO: 123250 - DNA, 25 bp, Homo sapien
cagctgcgcttccaacatccaagga

SEQ ID NO: 123251 - DNA, 25 bp, Homo sapien
gagaacgaaaataccagctgcgctt

SEQ ID NO: 123252 - DNA, 25 bp, Homo sapien
cggaacacaaaggatgaacgaatgg

SEQ ID NO: 123253 - DNA, 25 bp, Homo sapien
cccaaacagaccaaagaggatccgg

SEQ ID NO: 123254 - DNA, 25 bp, Homo sapien
tcctcctggcggtcaatcctctgag

SEQ ID NO: 123255 - DNA, 25 bp, Homo sapien
accaatcagaagtcgcctttcggga

SEQ ID NO: 123256 - DNA, 25 bp, Homo sapien
tgtcctcggaagaagccagcggatt

SEQ ID NO: 123257 - DNA, 25 bp, Homo sapien
ggatggccacttgcagacagactgc

SEQ ID NO: 123258 - DNA, 25 bp, Homo sapien
tgcagccggagacgctccctagttc

SEQ ID NO: 123259 - DNA, 25 bp, Homo sapien
gcacgcggccagttctgagtacttt

SEQ ID NO: 123260 - DNA, 25 bp, Homo sapien
tcctctgagccgtccctcgagggaa

SEQ ID NO: 123261 - DNA, 25 bp, Homo sapien
tttgcccagaacttctcggcgcgcg

SEQ ID NO: 123262 - DNA, 25 bp, Homo sapien
aacgtccgcagctacattctgctgc

SEQ ID NO: 123263 - DNA, 25 bp, Homo sapien
cattctgctgcaagttcaggagctt

SEQ ID NO: 123264 - DNA, 25 bp, Homo sapien
tcaggagcttgttcctaggtgactc

SEQ ID NO: 123265 - DNA, 25 bp, Homo sapien
tgttcctaggtgactccggcacata

SEQ ID NO: 123266 - DNA, 25 bp, Homo sapien
ctccggcacataggctggaaacact

SEQ ID NO: 123267 - DNA, 25 bp, Homo sapien
gctggaaacactacactcaccgggg

SEQ ID NO: 123268 - DNA, 25 bp, Homo sapien
cgtccgcagcgacattccgctgtga

SEQ ID NO: 123269 - DNA, 25 bp, Homo sapien
cattccgctgtgaatccatgagctt

SEQ ID NO: 123270 - DNA, 25 bp, Homo sapien
gtgtgagcagtaccagccatccctc

SEQ ID NO: 123271 - DNA, 25 bp, Homo sapien
caggtgagtgtggtcctgttctgct

SEQ ID NO: 123272 - DNA, 25 bp, Homo sapien
agtgtggtcctgttctgctcaccca

SEQ ID NO: 123273 - DNA, 25 bp, Homo sapien
tgctcacccagcacatccctgtgtg

SEQ ID NO: 123274 - DNA, 25 bp, Homo sapien
ctctgtcccagtgggaagctgacgg

SEQ ID NO: 123275 - DNA, 25 bp, Homo sapien
tcactgtgctgtgtgagcagtacca

SEQ ID NO: 123276 - DNA, 25 bp, Homo sapien
cgggaccccatgtacaacgaggtga

SEQ ID NO: 123277 - DNA, 25 bp, Homo sapien
gaagctgacggtgttcactgtgctg

SEQ ID NO: 123278 - DNA, 25 bp, Homo sapien
tccggagctattctgttcacatttc

SEQ ID NO: 123279 - DNA, 25 bp, Homo sapien
gtttctgagactctttccggagcta

SEQ ID NO: 123280 - DNA, 25 bp, Homo sapien
cacgctcagatcttcgctttctgga

SEQ ID NO: 123281 - DNA, 25 bp, Homo sapien
tgtctgggactgtctgtttcggatc

SEQ ID NO: 123282 - DNA, 25 bp, Homo sapien
gctgccgagcaaatccactgtcatg

SEQ ID NO: 123283 - DNA, 25 bp, Homo sapien
tcggcacacggagaagcttattgga

SEQ ID NO: 123284 - DNA, 25 bp, Homo sapien
ttcaaatcgaatgactccgcggttc

SEQ ID NO: 123285 - DNA, 25 bp, Homo sapien
tgcagcgctcgacgcattttcagtc

SEQ ID NO: 123286 - DNA, 25 bp, Homo sapien
ccgagaccatacctgtccctagtta

SEQ ID NO: 123287 - DNA, 25 bp, Homo sapien
ggatctgtatccaagccgcctccag

SEQ ID NO: 123288 - DNA, 25 bp, Homo sapien
gacaggcctttggtcgtacgacaac

SEQ ID NO: 123289 - DNA, 25 bp, Homo sapien
attggctccagtcccaatgcctgcg

SEQ ID NO: 123290 - DNA, 25 bp, Homo sapien
ggtgtaagtgcaaccaaactcgctc

SEQ ID NO: 123291 - DNA, 25 bp, Homo sapien
ccgcgcttaagtaccggtgtaagtg

SEQ ID NO: 123292 - DNA, 25 bp, Homo sapien
cacctctttttagtcgctggcacaa

SEQ ID NO: 123293 - DNA, 25 bp, Homo sapien
gctcggtctgaccacagtccagggt

SEQ ID NO: 123294 - DNA, 25 bp, Homo sapien
ccagcgctacgggactggcaagaat

SEQ ID NO: 123295 - DNA, 25 bp, Homo sapien
ttccaactgcgtcggggagaatccc

SEQ ID NO: 123296 - DNA, 25 bp, Homo sapien
aggccgagcctcacgggctgtcact

SEQ ID NO: 123297 - DNA, 25 bp, Homo sapien
tgtcactgccctgcaagcggtgcct

SEQ ID NO: 123298 - DNA, 25 bp, Homo sapien
tctggacatacctgggacatgagcc

SEQ ID NO: 123299 - DNA, 25 bp, Homo sapien
ccgaggaattttgaggtcgtccgca

SEQ ID NO: 123300 - DNA, 25 bp, Homo sapien
ccgcggcattaggtgatgcgtcctt

SEQ ID NO: 123301 - DNA, 25 bp, Homo sapien
aggctcttagagacctcggaggaaa

SEQ ID NO: 123302 - DNA, 25 bp, Homo sapien
ctgcccacgttttcgcccgggagtg

SEQ ID NO: 123303 - DNA, 25 bp, Homo sapien
ttcccgcgtctgctggaagcttgct

SEQ ID NO: 123304 - DNA, 25 bp, Homo sapien
gcggtgcgcttgattgatggattca

SEQ ID NO: 123305 - DNA, 25 bp, Homo sapien
actcagcccggaagaggccctgaag

SEQ ID NO: 123306 - DNA, 25 bp, Homo sapien
tcttgcaaaatcactgcggccgggg

SEQ ID NO: 123307 - DNA, 25 bp, Homo sapien
ggccggccgcactcttgcaaaatca

SEQ ID NO: 123308 - DNA, 25 bp, Homo sapien
aaggctgatttacagccggccggcc

SEQ ID NO: 123309 - DNA, 25 bp, Homo sapien
ttgatggattcacggcgtttaaccc

SEQ ID NO: 123310 - DNA, 25 bp, Homo sapien
ctacgcggaggtgacgtggtcccag

SEQ ID NO: 123311 - DNA, 25 bp, Homo sapien
ggagccggttcgcaagcctgtttcc

SEQ ID NO: 123312 - DNA, 25 bp, Homo sapien
agccggttcgcaagcctgtttccag

SEQ ID NO: 123313 - DNA, 25 bp, Homo sapien
gccggttcgcaagcctgtttccagc

SEQ ID NO: 123314 - DNA, 25 bp, Homo sapien
cggaagcgacttggcgagttgggag

SEQ ID NO: 123315 - DNA, 25 bp, Homo sapien
gccgggtccccagatagtgtccatc

SEQ ID NO: 123316 - DNA, 25 bp, Homo sapien
tccatccccgggtcggctacgcgga

SEQ ID NO: 123317 - DNA, 25 bp, Homo sapien
cgacttggcgagttgggagcgagtt

SEQ ID NO: 123318 - DNA, 25 bp, Homo sapien
cctgtctctgcgtctgggaccagac

SEQ ID NO: 123319 - DNA, 25 bp, Homo sapien
gaggagtaaatccttctgtcgtccc

SEQ ID NO: 123320 - DNA, 25 bp, Homo sapien
ccagggctagagaggagtaaatcct

SEQ ID NO: 123321 - DNA, 25 bp, Homo sapien
gcgggccacaaggaagtagccaatg

SEQ ID NO: 123322 - DNA, 25 bp, Homo sapien
gcatgcgcactggtggactccagcc

SEQ ID NO: 123323 - DNA, 25 bp, Homo sapien
tgggaccagacgcaccaataagaga

SEQ ID NO: 123324 - DNA, 25 bp, Homo sapien
ctacgccctgtctctgcgtctggga

SEQ ID NO: 123325 - DNA, 25 bp, Homo sapien
cgcaccaataagagagcggattcgg

SEQ ID NO: 123326 - DNA, 25 bp, Homo sapien
ctggcgtgctgtttgaagaaggtta

SEQ ID NO: 123327 - DNA, 25 bp, Homo sapien
gatgcagtttccattccgtccggcc

SEQ ID NO: 123328 - DNA, 25 bp, Homo sapien
ccagactgtggagagatcccgtgca

SEQ ID NO: 123329 - DNA, 25 bp, Homo sapien
aggatccgcctccagtcccgaggag

SEQ ID NO: 123330 - DNA, 25 bp, Homo sapien
aaaccttcaagtgtgtctggcgtgc

SEQ ID NO: 123331 - DNA, 25 bp, Homo sapien
ttgtcaaatgacttccggtagcaga

SEQ ID NO: 123332 - DNA, 25 bp, Homo sapien
gctctgccgagcagtaaagattaga

SEQ ID NO: 123333 - DNA, 25 bp, Homo sapien
ggtgagtctccagcccaagaccgtc

SEQ ID NO: 123334 - DNA, 25 bp, Homo sapien
cggagcgcacagacgccagctgagt

SEQ ID NO: 123335 - DNA, 25 bp, Homo sapien
ggtttgctgagtgcttccttcctcg

SEQ ID NO: 123336 - DNA, 25 bp, Homo sapien
caggatgccgtttgatcattggctg

SEQ ID NO: 123337 - DNA, 25 bp, Homo sapien
cattggctggtttaataaagagggc

SEQ ID NO: 123338 - DNA, 25 bp, Homo sapien
aaagagggcgtgtttattttgcata

SEQ ID NO: 123339 - DNA, 25 bp, Homo sapien
ttgcataaatagtgggcgggcaccc

SEQ ID NO: 123340 - DNA, 25 bp, Homo sapien
cccagggctgctttgtaactcgaga

SEQ ID NO: 123341 - DNA, 25 bp, Homo sapien
tgctttgtaactcgagaacccggtg

SEQ ID NO: 123342 - DNA, 25 bp, Homo sapien
tgcaacaggtctggaaagtgctttc

SEQ ID NO: 123343 - DNA, 25 bp, Homo sapien
ggagacgcctccttatgcaaataga

SEQ ID NO: 123344 - DNA, 25 bp, Homo sapien
cccattaggcagtgcttcccgcgga

SEQ ID NO: 123345 - DNA, 25 bp, Homo sapien
ctgaacagctgttgcgcgcgtgcaa

SEQ ID NO: 123346 - DNA, 25 bp, Homo sapien
catcttgacttttgccgacgtggaa

SEQ ID NO: 123347 - DNA, 25 bp, Homo sapien
tgctctcgctattccgcgccaaggg

SEQ ID NO: 123348 - DNA, 25 bp, Homo sapien
agacgacctgcgctcttattggctg

SEQ ID NO: 123349 - DNA, 25 bp, Homo sapien
tcgtgtcaagtcagcaggttccctc

SEQ ID NO: 123350 - DNA, 25 bp, Homo sapien
gcagagcgggaagcgagcgaagtgc

SEQ ID NO: 123351 - DNA, 25 bp, Homo sapien
cgtagacctagatctttacctgctg

SEQ ID NO: 123352 - DNA, 25 bp, Homo sapien
cttggcggggctccgcgtagaccta

SEQ ID NO: 123353 - DNA, 25 bp, Homo sapien
cgcggcggcgatgaagcacctgaag

SEQ ID NO: 123354 - DNA, 25 bp, Homo sapien
agtgcggcgtctacgccgccgggag

SEQ ID NO: 123355 - DNA, 25 bp, Homo sapien
gaagcgagcgaagtgcggcgtctac

SEQ ID NO: 123356 - DNA, 25 bp, Homo sapien
agcgagcgaagtgcggcgtctacgc

SEQ ID NO: 123357 - DNA, 25 bp, Homo sapien
agcgaagtgcggcgtctacgccgcc

SEQ ID NO: 123358 - DNA, 25 bp, Homo sapien
gctgccgccgcttttctagaacctt

SEQ ID NO: 123359 - DNA, 25 bp, Homo sapien
ctgctagttactacctcttggaata

SEQ ID NO: 123360 - DNA, 25 bp, Homo sapien
ggtccctgcagttacgccaatgata

SEQ ID NO: 123361 - DNA, 25 bp, Homo sapien
ttcgctgctgaaagtggtcccaaag

SEQ ID NO: 123362 - DNA, 25 bp, Homo sapien
tgccgctgctcgagaaacaactctg

SEQ ID NO: 123363 - DNA, 25 bp, Homo sapien
cggccagagacagtacccgacgtta

SEQ ID NO: 123364 - DNA, 25 bp, Homo sapien
tcctggcgctgtagtgagaactgcc

SEQ ID NO: 123365 - DNA, 25 bp, Homo sapien
gttacttccgtaaatgcgctcaatg

SEQ ID NO: 123366 - DNA, 25 bp, Homo sapien
cactcctttgttctgggtcctttcg

SEQ ID NO: 123367 - DNA, 25 bp, Homo sapien
ggagacaccacggtcgacgacggct

SEQ ID NO: 123368 - DNA, 25 bp, Homo sapien
tctgcaaatgggagcggctgttttt

SEQ ID NO: 123369 - DNA, 25 bp, Homo sapien
ccatcgagctggactgaactggcca

SEQ ID NO: 123370 - DNA, 25 bp, Homo sapien
aagcacaggccttaccgcggcgtca

SEQ ID NO: 123371 - DNA, 25 bp, Homo sapien
gctgcggtcaccaaagcaggtgctg

SEQ ID NO: 123372 - DNA, 25 bp, Homo sapien
gctgtttttgaacacggggtcattc

SEQ ID NO: 123373 - DNA, 25 bp, Homo sapien
attctgcagtcaggacgaaccggtc

SEQ ID NO: 123374 - DNA, 25 bp, Homo sapien
ttgagtcagcaaactccgcggcccg

SEQ ID NO: 123375 - DNA, 25 bp, Homo sapien
ccgtaagtgacaagagacccgctga

SEQ ID NO: 123376 - DNA, 25 bp, Homo sapien
gccgcgcgcctttgagtcagcaaac

SEQ ID NO: 123377 - DNA, 25 bp, Homo sapien
gacggcggcccttctttccagaggc

SEQ ID NO: 123378 - DNA, 25 bp, Homo sapien
cacccttgcgggctggaaagaggtt

SEQ ID NO: 123379 - DNA, 25 bp, Homo sapien
cgcctccttttcagccgaggtgtgc

SEQ ID NO: 123380 - DNA, 25 bp, Homo sapien
ggagaaatgatcagcgcggtagagc

SEQ ID NO: 123381 - DNA, 25 bp, Homo sapien
cctgctctgttctgcccggaggagc

SEQ ID NO: 123382 - DNA, 25 bp, Homo sapien
gcctcggtccggtaacccatggcaa

SEQ ID NO: 123383 - DNA, 25 bp, Homo sapien
tggcaaccgccctggtaacccatgg

SEQ ID NO: 123384 - DNA, 25 bp, Homo sapien
cttcccgcgctacggtgacgattct

SEQ ID NO: 123385 - DNA, 25 bp, Homo sapien
gggaggctgccttaaacgccgatga

SEQ ID NO: 123386 - DNA, 25 bp, Homo sapien
tccaggctttgttctgcagacgctc

SEQ ID NO: 123387 - DNA, 25 bp, Homo sapien
gcacacgcatcgcacacattagtta

SEQ ID NO: 123388 - DNA, 25 bp, Homo sapien
acccgctttaggctgaggccctgta

SEQ ID NO: 123389 - DNA, 25 bp, Homo sapien
tgtgacacatcaggtgccaggccgc

SEQ ID NO: 123390 - DNA, 25 bp, Homo sapien
tttccgtcagagttcgcggtcacga

SEQ ID NO: 123391 - DNA, 25 bp, Homo sapien
ccctcctcttttgtgtcgggccaga

SEQ ID NO: 123392 - DNA, 25 bp, Homo sapien
cactgagcactctagtttcctggta

SEQ ID NO: 123393 - DNA, 25 bp, Homo sapien
ggcctgcgccgacactgactagcaa

SEQ ID NO: 123394 - DNA, 25 bp, Homo sapien
ttcattatgttggacagggcgcgtc

SEQ ID NO: 123395 - DNA, 25 bp, Homo sapien
tgagacaggcgagctatttgcattc

SEQ ID NO: 123396 - DNA, 25 bp, Homo sapien
cccgagtgtggcagagcctgatatt

SEQ ID NO: 123397 - DNA, 25 bp, Homo sapien
cgggatgctggcgtccaatttaacc

SEQ ID NO: 123398 - DNA, 25 bp, Homo sapien
tgctatttgccaaccgccgggacgt

SEQ ID NO: 123399 - DNA, 25 bp, Homo sapien
cggccgcagtggacttccagttttc

SEQ ID NO: 123400 - DNA, 25 bp, Homo sapien
cgccgtgcagaacgtggtcatctcc

SEQ ID NO: 123401 - DNA, 25 bp, Homo sapien
gcgaggaggccatcaagcagaccta

SEQ ID NO: 123402 - DNA, 25 bp, Homo sapien
cctcaatggcacatcccggaaggtg

SEQ ID NO: 123403 - DNA, 25 bp, Homo sapien
tgctcttctggcaggaccttgacca

SEQ ID NO: 123404 - DNA, 25 bp, Homo sapien
tccagttttccaagggagccgtgta

SEQ ID NO: 123405 - DNA, 25 bp, Homo sapien
caagaagctgtactggacggactca

SEQ ID NO: 123406 - DNA, 25 bp, Homo sapien
ttcggtactggtgccatcacaactg

SEQ ID NO: 123407 - DNA, 25 bp, Homo sapien
aggggtccaactgcgcatgtgtatt

SEQ ID NO: 123408 - DNA, 25 bp, Homo sapien
gagcgccttacagccattttcggta

SEQ ID NO: 123409 - DNA, 25 bp, Homo sapien
ctagcggcccggattaagaacagcg

SEQ ID NO: 123410 - DNA, 25 bp, Homo sapien
tgctgatcgtttctgcaggattcca

SEQ ID NO: 123411 - DNA, 25 bp, Homo sapien
gccggggctcacaacaaggaagtca

SEQ ID NO: 123412 - DNA, 25 bp, Homo sapien
cgtcacctgatgctgcgtcacctga

SEQ ID NO: 123413 - DNA, 25 bp, Homo sapien
atggccttctttgtccgattgaacg

SEQ ID NO: 123414 - DNA, 25 bp, Homo sapien
tcccgtgcatactttgccagaaccg

SEQ ID NO: 123415 - DNA, 25 bp, Homo sapien
atcgtaaaattgtccaacgcggcta

SEQ ID NO: 123416 - DNA, 25 bp, Homo sapien
cttgttacggttctgtggcgactta

SEQ ID NO: 123417 - DNA, 25 bp, Homo sapien
gccagaaccgtgttgctgatatttc

SEQ ID NO: 123418 - DNA, 25 bp, Homo sapien
ggcgacgttgggtcaagaactcaga

SEQ ID NO: 123419 - DNA, 25 bp, Homo sapien
ccaagatgggctctgagcgcgaacc

SEQ ID NO: 123420 - DNA, 25 bp, Homo sapien
ctggcagaaagaaacgcgaggcctc

SEQ ID NO: 123421 - DNA, 25 bp, Homo sapien
atcgtggctttctgcattcttgtta

SEQ ID NO: 123422 - DNA, 25 bp, Homo sapien
ctgcagggatgcagcgatctccacc

SEQ ID NO: 123423 - DNA, 25 bp, Homo sapien
gatgcagcgatctccaccctgcggg

SEQ ID NO: 123424 - DNA, 25 bp, Homo sapien
cagatcttcacttgggtctcgttga

SEQ ID NO: 123425 - DNA, 25 bp, Homo sapien
ctgaggattcctcggccttctcgtc

SEQ ID NO: 123426 - DNA, 25 bp, Homo sapien
tcggccttctcgtcgtttcctggcg

SEQ ID NO: 123427 - DNA, 25 bp, Homo sapien
gatgggcaagagaccctccttctca

SEQ ID NO: 123428 - DNA, 25 bp, Homo sapien
cttttgcttcattcggcggttctgg

SEQ ID NO: 123429 - DNA, 25 bp, Homo sapien
agctggacttctctgaggattcctc

SEQ ID NO: 123430 - DNA, 25 bp, Homo sapien
ccctctcgtcattagcatggcaatg

SEQ ID NO: 123431 - DNA, 25 bp, Homo sapien
tttctgtaattcgacttggaggggc

SEQ ID NO: 123432 - DNA, 25 bp, Homo sapien
ccggcttccgcagtgatggatcacc

SEQ ID NO: 123433 - DNA, 25 bp, Homo sapien
tggctgagcctcctgcaaaagtttg

SEQ ID NO: 123434 - DNA, 25 bp, Homo sapien
cacgtgacggtgtcagccaatggct

SEQ ID NO: 123435 - DNA, 25 bp, Homo sapien
ttctcacttcctccatggggccgga

SEQ ID NO: 123436 - DNA, 25 bp, Homo sapien
cggcgtgactgtgccaactttctca

SEQ ID NO: 123437 - DNA, 25 bp, Homo sapien
ctggaaactcagagctcgccggaaa

SEQ ID NO: 123438 - DNA, 25 bp, Homo sapien
acggcagctttgcatctggctccgg

SEQ ID NO: 123439 - DNA, 25 bp, Homo sapien
ccgggcccattgttagcaggctatt

SEQ ID NO: 123440 - DNA, 25 bp, Homo sapien
tgcatgtgccaagcgagacaacaac

SEQ ID NO: 123441 - DNA, 25 bp, Homo sapien
ctgggtttcatacccgtagggctcg

SEQ ID NO: 123442 - DNA, 25 bp, Homo sapien
ctgcgccatcaacttctcaggagtg

SEQ ID NO: 123443 - DNA, 25 bp, Homo sapien
gaggcggctctcgaagcttcccgac

SEQ ID NO: 123444 - DNA, 25 bp, Homo sapien
agcaggctattccacggcagctttg

SEQ ID NO: 123445 - DNA, 25 bp, Homo sapien
ggctcctggcattctgggtttcata

SEQ ID NO: 123446 - DNA, 25 bp, Homo sapien
gcaattctttcctcctgacgcgata

SEQ ID NO: 123447 - DNA, 25 bp, Homo sapien
atcctgagaattcgccgagcttcca

SEQ ID NO: 123448 - DNA, 25 bp, Homo sapien
tggagcagaagaccgccctgcgtta

SEQ ID NO: 123449 - DNA, 25 bp, Homo sapien
ccgctttgacccgaggaagagcatg

SEQ ID NO: 123450 - DNA, 25 bp, Homo sapien
tccgcgtgcagatttttggagcaat

SEQ ID NO: 123451 - DNA, 25 bp, Homo sapien
gatgtctttgtttcttccgtgcaca

SEQ ID NO: 123452 - DNA, 25 bp, Homo sapien
cgcggctggctaataccgaggttta

SEQ ID NO: 123453 - DNA, 25 bp, Homo sapien
ttgctcccggaaagtgctcggcatc

SEQ ID NO: 123454 - DNA, 25 bp, Homo sapien
ggcgctcagtgaggttcagcagatt

SEQ ID NO: 123455 - DNA, 25 bp, Homo sapien
gttgaccagcgaatgcatagagttc

SEQ ID NO: 123456 - DNA, 25 bp, Homo sapien
ggctcatacgggacgctgttgacca

SEQ ID NO: 123457 - DNA, 25 bp, Homo sapien
cggagttgctcatgggctccacata

SEQ ID NO: 123458 - DNA, 25 bp, Homo sapien
tagagttcagatagccaccggctcc

SEQ ID NO: 123459 - DNA, 25 bp, Homo sapien
cccgatgacgttagcatgcccttgc

SEQ ID NO: 123460 - DNA, 25 bp, Homo sapien
gcccttgcccttctgatcctttttg

SEQ ID NO: 123461 - DNA, 25 bp, Homo sapien
tttgtacttcatgcggcgattctgg

SEQ ID NO: 123462 - DNA, 25 bp, Homo sapien
gtccctcccgtgtggcacttgcttt

SEQ ID NO: 123463 - DNA, 25 bp, Homo sapien
gcgtcactcgggcttaccgtgagac

SEQ ID NO: 123464 - DNA, 25 bp, Homo sapien
ccaaggattttgtgtgcggcgtcac

SEQ ID NO: 123465 - DNA, 25 bp, Homo sapien
tcgatccggagtgaccaaggatttt

SEQ ID NO: 123466 - DNA, 25 bp, Homo sapien
agcgagttcgatccggagtgaccaa

SEQ ID NO: 123467 - DNA, 25 bp, Homo sapien
cttgctttgagcagcgagttcgatc

SEQ ID NO: 123468 - DNA, 25 bp, Homo sapien
cttaccgtgagacggcaggaacagc

SEQ ID NO: 123469 - DNA, 25 bp, Homo sapien
tcccgtgtggcacttgctttgagca

SEQ ID NO: 123470 - DNA, 25 bp, Homo sapien
gcctcactcagttcgtgtgccttgg

SEQ ID NO: 123471 - DNA, 25 bp, Homo sapien
tcttgatcgcacactctgacagggg

SEQ ID NO: 123472 - DNA, 25 bp, Homo sapien
tcgcgttgtttcacgatcttgatcg

SEQ ID NO: 123473 - DNA, 25 bp, Homo sapien
aggtcgctttttgcatcgcgttgtt

SEQ ID NO: 123474 - DNA, 25 bp, Homo sapien
ccgagctgtcgtagtaggtcgcttt

SEQ ID NO: 123475 - DNA, 25 bp, Homo sapien
tagccaccgtagatcgccgagctgt

SEQ ID NO: 123476 - DNA, 25 bp, Homo sapien
tttgacacccgtgagggcgcacatt

SEQ ID NO: 123477 - DNA, 25 bp, Homo sapien
ttggcattataagcgaacccgttgg

SEQ ID NO: 123478 - DNA, 25 bp, Homo sapien
ttgcggccctgcttaccttaacttc

SEQ ID NO: 123479 - DNA, 25 bp, Homo sapien
cgagacgtaaactccgccattcagc

SEQ ID NO: 123480 - DNA, 25 bp, Homo sapien
cggaccctcagcatcagccgagatg

SEQ ID NO: 123481 - DNA, 25 bp, Homo sapien
ccgcggcccggagataagcgctagt

SEQ ID NO: 123482 - DNA, 25 bp, Homo sapien
ttatgaatattacacgcggagcagc

SEQ ID NO: 123483 - DNA, 25 bp, Homo sapien
accgacttgggtatgtttcttatga

SEQ ID NO: 123484 - DNA, 25 bp, Homo sapien
ctgcctgggctagtggcaccgactt

SEQ ID NO: 123485 - DNA, 25 bp, Homo sapien
cttaacttctgacgagcgcaggctc

SEQ ID NO: 123486 - DNA, 25 bp, Homo sapien
accgcatcgaggtgacgcgcctcaa

SEQ ID NO: 123487 - DNA, 25 bp, Homo sapien
acacgggcacggaccgcatcgaggt

SEQ ID NO: 123488 - DNA, 25 bp, Homo sapien
ctctactggaccgacacgggcacgg

SEQ ID NO: 123489 - DNA, 25 bp, Homo sapien
gctatgtctactggacagatgacga

SEQ ID NO: 123490 - DNA, 25 bp, Homo sapien
cccgctagagggctatgtctactgg

SEQ ID NO: 123491 - DNA, 25 bp, Homo sapien
tgccatcgactacgacccgctagag

SEQ ID NO: 123492 - DNA, 25 bp, Homo sapien
acctacggaggatctcgctggacac

SEQ ID NO: 123493 - DNA, 25 bp, Homo sapien
ggtggacgacatccggcacgccatt

SEQ ID NO: 123494 - DNA, 25 bp, Homo sapien
ccggtcggatgtggcatttgaagaa

SEQ ID NO: 123495 - DNA, 25 bp, Homo sapien
gagagccagccgcaaaaatccgttc

SEQ ID NO: 123496 - DNA, 25 bp, Homo sapien
gcatacctttccactggcgccaaga

SEQ ID NO: 123497 - DNA, 25 bp, Homo sapien
ggggcgccctgaaagcatacctttc

SEQ ID NO: 123498 - DNA, 25 bp, Homo sapien
agctctccgtaagaacctgccaggg

SEQ ID NO: 123499 - DNA, 25 bp, Homo sapien
tttctcctccaaactgctgacgcga

SEQ ID NO: 123500 - DNA, 25 bp, Homo sapien
cgttcggcggcattttctcttcaaa

SEQ ID NO: 123501 - DNA, 25 bp, Homo sapien
ggcgccaagaccctgccgggcaaaa

SEQ ID NO: 123502 - DNA, 25 bp, Homo sapien
cagcgcttacctagaaagatgttta

SEQ ID NO: 123503 - DNA, 25 bp, Homo sapien
cgaacatcagggagtcaccagggca

SEQ ID NO: 123504 - DNA, 25 bp, Homo sapien
gtccaggcgctctgcagacaaataa

SEQ ID NO: 123505 - DNA, 25 bp, Homo sapien
tcagggaatcgccttttccggtgtc

SEQ ID NO: 123506 - DNA, 25 bp, Homo sapien
gcgaagagttttggagcagcgctta

SEQ ID NO: 123507 - DNA, 25 bp, Homo sapien
tgcaaagtcccacgcggcgaagagt

SEQ ID NO: 123508 - DNA, 25 bp, Homo sapien
ctgaaccaggaattgtctccaactc

SEQ ID NO: 123509 - DNA, 25 bp, Homo sapien
tctccaactccaggcgctcagggaa

SEQ ID NO: 123510 - DNA, 25 bp, Homo sapien
gtcctgtggtatctctgcagccttc

SEQ ID NO: 123511 - DNA, 25 bp, Homo sapien
ggatgtgaccgcagaaaacccaagc

SEQ ID NO: 123512 - DNA, 25 bp, Homo sapien
ccacttcatcaccaaagccaggatg

SEQ ID NO: 123513 - DNA, 25 bp, Homo sapien
ccagcgtgaatcagaacattaccaa

SEQ ID NO: 123514 - DNA, 25 bp, Homo sapien
ggaaaattgaacaaagccgcgcgcc

SEQ ID NO: 123515 - DNA, 25 bp, Homo sapien
cgtttttggcgctcgcttgctccct

SEQ ID NO: 123516 - DNA, 25 bp, Homo sapien
tatgaacgccgggaaaattgaacaa

SEQ ID NO: 123517 - DNA, 25 bp, Homo sapien
attaccaactgtctgcgcatccgtc

SEQ ID NO: 123518 - DNA, 25 bp, Homo sapien
caggggtacaccacgggctccttgc

SEQ ID NO: 123519 - DNA, 25 bp, Homo sapien
cccagcgggctcttgtcggccaaga

SEQ ID NO: 123520 - DNA, 25 bp, Homo sapien
cgagctcatggtcattaatttgtga

SEQ ID NO: 123521 - DNA, 25 bp, Homo sapien
ccggcgctgacatggatcttcttca

SEQ ID NO: 123522 - DNA, 25 bp, Homo sapien
tgctgcgcgtactcctcgaagggag

SEQ ID NO: 123523 - DNA, 25 bp, Homo sapien
ggctcgatgtagttggagtttatca

SEQ ID NO: 123524 - DNA, 25 bp, Homo sapien
gtttatcaaaaacgagctcatggtc

SEQ ID NO: 123525 - DNA, 25 bp, Homo sapien
tctcgcgttgtcgttttttctgggc

SEQ ID NO: 123526 - DNA, 25 bp, Homo sapien
aagtcattaacatccgcggttgtgc

SEQ ID NO: 123527 - DNA, 25 bp, Homo sapien
gcccgcgaagacatattgccacagc

SEQ ID NO: 123528 - DNA, 25 bp, Homo sapien
caggcccattcgcacacaaaaatca

SEQ ID NO: 123529 - DNA, 25 bp, Homo sapien
cgggagcagcggaagtcattaacat

SEQ ID NO: 123530 - DNA, 25 bp, Homo sapien
cgcggttgtgctgcaattaaagtta

SEQ ID NO: 123531 - DNA, 25 bp, Homo sapien
caattaaagttaggcctggggatgc

SEQ ID NO: 123532 - DNA, 25 bp, Homo sapien
aatcatctttttgcacgccggcggg

SEQ ID NO: 123533 - DNA, 25 bp, Homo sapien
cgctctcgcgagctagcctgaaacc

SEQ ID NO: 123534 - DNA, 25 bp, Homo sapien
tggaagcattccttggcagtgccta

SEQ ID NO: 123535 - DNA, 25 bp, Homo sapien
tccctcgcagttccattaggatgta

SEQ ID NO: 123536 - DNA, 25 bp, Homo sapien
taccaattgttaggccgtcagctgc

SEQ ID NO: 123537 - DNA, 25 bp, Homo sapien
ctccaaggcgaggtcaaattccata

SEQ ID NO: 123538 - DNA, 25 bp, Homo sapien
ttcatcacagggtccggttcctcga

SEQ ID NO: 123539 - DNA, 25 bp, Homo sapien
gcagtgcctagtatctctgtagtta

SEQ ID NO: 123540 - DNA, 25 bp, Homo sapien
tccacggctccgaaagactcaagta

SEQ ID NO: 123541 - DNA, 25 bp, Homo sapien
gatttgcttacgtatccagcctgga

SEQ ID NO: 123542 - DNA, 25 bp, Homo sapien
tttgtttctggatggccgaacgcca

SEQ ID NO: 123543 - DNA, 25 bp, Homo sapien
cgcgcaggagttcatccgctgcatc

SEQ ID NO: 123544 - DNA, 25 bp, Homo sapien
cccggcagattaatgggcgcgcaca

SEQ ID NO: 123545 - DNA, 25 bp, Homo sapien
cgctgcatccaagggtaaaccgggc

SEQ ID NO: 123546 - DNA, 25 bp, Homo sapien
gccttcgtcatggagtgctttgccc

SEQ ID NO: 123547 - DNA, 25 bp, Homo sapien
ccgagttggactgttggtagaaaca

SEQ ID NO: 123548 - DNA, 25 bp, Homo sapien
ggcgaccgaggcagcaaagttacaa

SEQ ID NO: 123549 - DNA, 25 bp, Homo sapien
aggcgccactgaggtccttatcaga

SEQ ID NO: 123550 - DNA, 25 bp, Homo sapien
tctgatgtgcacttaggccgagcta

SEQ ID NO: 123551 - DNA, 25 bp, Homo sapien
ttctcggggcaaatctggtctgatg

SEQ ID NO: 123552 - DNA, 25 bp, Homo sapien
gcagagcacgggctaacgtcctaaa

SEQ ID NO: 123553 - DNA, 25 bp, Homo sapien
cctaggatgcaaatgcgccgcttta

SEQ ID NO: 123554 - DNA, 25 bp, Homo sapien
ccagcacggtcgcaataaataatcg

SEQ ID NO: 123555 - DNA, 25 bp, Homo sapien
tcccggccatataggctctgggtga

SEQ ID NO: 123556 - DNA, 25 bp, Homo sapien
tttcttgtcgctgtccgaggagttc

SEQ ID NO: 123557 - DNA, 25 bp, Homo sapien
tgcgtccttccttcaaccttagctg

SEQ ID NO: 123558 - DNA, 25 bp, Homo sapien
ccagggtcagatgccagcggagcac

SEQ ID NO: 123559 - DNA, 25 bp, Homo sapien
ctgcggagagtctgcggcaacacat

SEQ ID NO: 123560 - DNA, 25 bp, Homo sapien
tggtgcccgactgcctccagagaca

SEQ ID NO: 123561 - DNA, 25 bp, Homo sapien
caacacatggtcaactgcggcaagg

SEQ ID NO: 123562 - DNA, 25 bp, Homo sapien
cggcaaggaacacagccgcttactg

SEQ ID NO: 123563 - DNA, 25 bp, Homo sapien
gcttactgtgggaagagcgatcaca

SEQ ID NO: 123564 - DNA, 25 bp, Homo sapien
gcgatcacagcgtgctctgaggcca

SEQ ID NO: 123565 - DNA, 25 bp, Homo sapien
tgcctccagagacaacagtctgcgg

SEQ ID NO: 123566 - DNA, 25 bp, Homo sapien
cggcagtcggaccttcgtccttatg

SEQ ID NO: 123567 - DNA, 25 bp, Homo sapien
cgatttcaatgcggcggcgccgcgt

SEQ ID NO: 123568 - DNA, 25 bp, Homo sapien
agcgcgtgggcgatttcaatgcggc

SEQ ID NO: 123569 - DNA, 25 bp, Homo sapien
gtccttatgctctttcttccacttc

SEQ ID NO: 123570 - DNA, 25 bp, Homo sapien
accttcgtccttatgctctttcttc

SEQ ID NO: 123571 - DNA, 25 bp, Homo sapien
cggaccttcgtccttatgctctttc

SEQ ID NO: 123572 - DNA, 25 bp, Homo sapien
cagtcggaccttcgtccttatgctc

SEQ ID NO: 123573 - DNA, 25 bp, Homo sapien
ctgcggcggcagtcggaccttcgtc

SEQ ID NO: 123574 - DNA, 25 bp, Homo sapien
gatgcggcctgagctattgctgccc

SEQ ID NO: 123575 - DNA, 25 bp, Homo sapien
cactgggacttgctcagctggattc

SEQ ID NO: 123576 - DNA, 25 bp, Homo sapien
agctggattccttaacgcacgcaca

SEQ ID NO: 123577 - DNA, 25 bp, Homo sapien
tgcagcaggtggtcaacatagagtg

SEQ ID NO: 123578 - DNA, 25 bp, Homo sapien
cgtgtccgacttcacggaggcgcca

SEQ ID NO: 123579 - DNA, 25 bp, Homo sapien
ggcgccagtcctcaacattcagttc

SEQ ID NO: 123580 - DNA, 25 bp, Homo sapien
acattcagttcaggtaagagccgcc

SEQ ID NO: 123581 - DNA, 25 bp, Homo sapien
ggctccatgactgtgcctccgtgtc

SEQ ID NO: 123582 - DNA, 25 bp, Homo sapien
tagcgactgcgcctacctgaagacc

SEQ ID NO: 123583 - DNA, 25 bp, Homo sapien
gccggacgcaaaggggctctgataa

SEQ ID NO: 123584 - DNA, 25 bp, Homo sapien
cgcttctctgtgagttgggagcaaa

SEQ ID NO: 123585 - DNA, 25 bp, Homo sapien
aagtcggctcggcattttggaacag

SEQ ID NO: 123586 - DNA, 25 bp, Homo sapien
ggcagctttcagtgtcggttttacg

SEQ ID NO: 123587 - DNA, 25 bp, Homo sapien
cattttcttttggacggagctcgcc

SEQ ID NO: 123588 - DNA, 25 bp, Homo sapien
atctcagcagtcctcacaggtggtc

SEQ ID NO: 123589 - DNA, 25 bp, Homo sapien
ttgacattgtataagcccggaacgg

SEQ ID NO: 123590 - DNA, 25 bp, Homo sapien
ggggccaacagagctggtgtttaaa

SEQ ID NO: 123591 - DNA, 25 bp, Homo sapien
ccaagtcagccaactgggccgagtc

SEQ ID NO: 123592 - DNA, 25 bp, Homo sapien
tcggcctttatggacccaagtcagc

SEQ ID NO: 123593 - DNA, 25 bp, Homo sapien
cccggccaaggaggatgcggatact

SEQ ID NO: 123594 - DNA, 25 bp, Homo sapien
cggctcattcctgctccggttttgc

SEQ ID NO: 123595 - DNA, 25 bp, Homo sapien
tgtttaaagtagaacctgcccagtc

SEQ ID NO: 123596 - DNA, 25 bp, Homo sapien
actcaagcgactgaaggggccaaca

SEQ ID NO: 123597 - DNA, 25 bp, Homo sapien
cgcgggaaggaacgcacttcgccaa

SEQ ID NO: 123598 - DNA, 25 bp, Homo sapien
ccttctggcctcctgatgggtgaac

SEQ ID NO: 123599 - DNA, 25 bp, Homo sapien
gccgattccttgtttcccagcgagg

SEQ ID NO: 123600 - DNA, 25 bp, Homo sapien
cccagaaaatatagggcggctgttc

SEQ ID NO: 123601 - DNA, 25 bp, Homo sapien
gctgttcactaaaatctggggctcc

SEQ ID NO: 123602 - DNA, 25 bp, Homo sapien
cggaagcctcttgcatggagccaca

SEQ ID NO: 123603 - DNA, 25 bp, Homo sapien
ccgtttggtactgcagcctcagcta

SEQ ID NO: 123604 - DNA, 25 bp, Homo sapien
tggtcagacaccgagattgccttta

SEQ ID NO: 123605 - DNA, 25 bp, Homo sapien
accctctgggcggtcatcaagttct

SEQ ID NO: 123606 - DNA, 25 bp, Homo sapien
cgcccagcaggaacgagtccacgta

SEQ ID NO: 123607 - DNA, 25 bp, Homo sapien
tttatgtaaagggatcgtgccgctc

SEQ ID NO: 123608 - DNA, 25 bp, Homo sapien
ccgacccacggaaattatgaaactg

SEQ ID NO: 123609 - DNA, 25 bp, Homo sapien
cgcacgctattaatggtccgatgtt

SEQ ID NO: 123610 - DNA, 25 bp, Homo sapien
cacgtgcccgtccagcagaacaata

SEQ ID NO: 123611 - DNA, 25 bp, Homo sapien
tcacctaataagttgccggcgcccg

SEQ ID NO: 123612 - DNA, 25 bp, Homo sapien
tgtggccaacgacgattaaaagatc

SEQ ID NO: 123613 - DNA, 25 bp, Homo sapien
tcgcattgtcgctctactgtattta

SEQ ID NO: 123614 - DNA, 25 bp, Homo sapien
cgcagaggtacctggagacgatttc

SEQ ID NO: 123615 - DNA, 25 bp, Homo sapien
gtccgcgaaggagcagccaacctaa

SEQ ID NO: 123616 - DNA, 25 bp, Homo sapien
aaagcgccagggacggtacagatcc

SEQ ID NO: 123617 - DNA, 25 bp, Homo sapien
ttcccaaatcttgcagcccagcgag

SEQ ID NO: 123618 - DNA, 25 bp, Homo sapien
cgccaaggagagaaccctgccatcg

SEQ ID NO: 123619 - DNA, 25 bp, Homo sapien
tgctgtcgagagaaaggtggatccc

SEQ ID NO: 123620 - DNA, 25 bp, Homo sapien
cgctgcggagaaagacacgaggctc

SEQ ID NO: 123621 - DNA, 25 bp, Homo sapien
ctacctaaatcaccgaccagttctg

SEQ ID NO: 123622 - DNA, 25 bp, Homo sapien
gtcaggcggctccatccggcaagac

SEQ ID NO: 123623 - DNA, 25 bp, Homo sapien
catttgtccgccgagtcgtagaggc

SEQ ID NO: 123624 - DNA, 25 bp, Homo sapien
agggaatccttctccggcgaggctt

SEQ ID NO: 123625 - DNA, 25 bp, Homo sapien
ctttgatgttctgcgcgaaagagca

SEQ ID NO: 123626 - DNA, 25 bp, Homo sapien
ggggcgcgtctagccacaggtctat

SEQ ID NO: 123627 - DNA, 25 bp, Homo sapien
tgagcgagtcgaccaaaaaagagtt

SEQ ID NO: 123628 - DNA, 25 bp, Homo sapien
gggctctccgagcatgacattgttg

SEQ ID NO: 123629 - DNA, 25 bp, Homo sapien
aggcagtaggagctctcttctttga

SEQ ID NO: 123630 - DNA, 25 bp, Homo sapien
ccaatcacttcttgagggtgagtcc

SEQ ID NO: 123631 - DNA, 25 bp, Homo sapien
agcgaatgcgcgttgctttaaatta

SEQ ID NO: 123632 - DNA, 25 bp, Homo sapien
gtaccgtgctgctcttagtatcaga

SEQ ID NO: 123633 - DNA, 25 bp, Homo sapien
cccggcggctttgacattgatcgga

SEQ ID NO: 123634 - DNA, 25 bp, Homo sapien
cagccgggtttatagcggcgcattc

SEQ ID NO: 123635 - DNA, 25 bp, Homo sapien
attgatcggaagtgcgccatctcgt

SEQ ID NO: 123636 - DNA, 25 bp, Homo sapien
cccgagccgagagacggaaaccagc

SEQ ID NO: 123637 - DNA, 25 bp, Homo sapien
ccagcccgctgctattgagatctca

SEQ ID NO: 123638 - DNA, 25 bp, Homo sapien
tgccgtaggctgtctcgaaaaactg

SEQ ID NO: 123639 - DNA, 25 bp, Homo sapien
tgcaggcagtctctgtgcacgagct

SEQ ID NO: 123640 - DNA, 25 bp, Homo sapien
gcacgagctcctccgcggagtagca

SEQ ID NO: 123641 - DNA, 25 bp, Homo sapien
ggtgccatttagtggcgggctcaat

SEQ ID NO: 123642 - DNA, 25 bp, Homo sapien
tgctatagaaattggacgagactgc

SEQ ID NO: 123643 - DNA, 25 bp, Homo sapien
cgttcctgcccacggtgctatagaa

SEQ ID NO: 123644 - DNA, 25 bp, Homo sapien
aaaaactggtcgaaagcctgtggca

SEQ ID NO: 123645 - DNA, 25 bp, Homo sapien
tagacgttggccgagctcttggcca

SEQ ID NO: 123646 - DNA, 25 bp, Homo sapien
gcgctttagtgccttccgtccctaa

SEQ ID NO: 123647 - DNA, 25 bp, Homo sapien
gtttgtcactgatccgcagggcccg

SEQ ID NO: 123648 - DNA, 25 bp, Homo sapien
gggtcctcgttctcgagtgtgcaga

SEQ ID NO: 123649 - DNA, 25 bp, Homo sapien
gcttgtccgatttgcacggtgactt

SEQ ID NO: 123650 - DNA, 25 bp, Homo sapien
tgcagcatgcttgtgctcaattgca

SEQ ID NO: 123651 - DNA, 25 bp, Homo sapien
tcgccggtgtaactcatgttggctg

SEQ ID NO: 123652 - DNA, 25 bp, Homo sapien
acggtgacttgattacactctctca

SEQ ID NO: 123653 - DNA, 25 bp, Homo sapien
tctcctggagtctcgcatttgcacc

SEQ ID NO: 123654 - DNA, 25 bp, Homo sapien
atgttacgggtgctgttgtccttca

SEQ ID NO: 123655 - DNA, 25 bp, Homo sapien
cctcatggtagatgaagatgttacg

SEQ ID NO: 123656 - DNA, 25 bp, Homo sapien
cccgtcctcatggtagatgaagatg

SEQ ID NO: 123657 - DNA, 25 bp, Homo sapien
accttcccgtcctcatggtagatga

SEQ ID NO: 123658 - DNA, 25 bp, Homo sapien
tagctcaagtgcctaccctcccgta

SEQ ID NO: 123659 - DNA, 25 bp, Homo sapien
ttctcatgccgcctagctcaagtgc

SEQ ID NO: 123660 - DNA, 25 bp, Homo sapien
tggcgttcaggtgctcgatcttcat

SEQ ID NO: 123661 - DNA, 25 bp, Homo sapien
tcatgccgcctagctcaagtgccta

SEQ ID NO: 123662 - DNA, 25 bp, Homo sapien
gtttcagtggcctcgtcctgtggac

SEQ ID NO: 123663 - DNA, 25 bp, Homo sapien
ctcgtcccgtggacgcagcctcgcc

SEQ ID NO: 123664 - DNA, 25 bp, Homo sapien
tcgggtttcagtggcctcgtcctgt

SEQ ID NO: 123665 - DNA, 25 bp, Homo sapien
cctgccgctgtggtcgggtttcagt

SEQ ID NO: 123666 - DNA, 25 bp, Homo sapien
agtggcctcgtcccgtggacgcagc

SEQ ID NO: 123667 - DNA, 25 bp, Homo sapien
tggcctcgtcccgtggacgcagcct

SEQ ID NO: 123668 - DNA, 25 bp, Homo sapien
gtcgggtttcagtggcctcgtcctg

SEQ ID NO: 123669 - DNA, 25 bp, Homo sapien
ctcgtcctgtggacgcagcctcgcc

SEQ ID NO: 123670 - DNA, 25 bp, Homo sapien
tgattgactcttccgctttgcagga

SEQ ID NO: 123671 - DNA, 25 bp, Homo sapien
tcctgccctcgtgttcggaatatgc

SEQ ID NO: 123672 - DNA, 25 bp, Homo sapien
aggaggtccaacagccgagcttagc

SEQ ID NO: 123673 - DNA, 25 bp, Homo sapien
ggagccggctcagtctcttcttgtt

SEQ ID NO: 123674 - DNA, 25 bp, Homo sapien
ccttggttttgactttgctctgagc

SEQ ID NO: 123675 - DNA, 25 bp, Homo sapien
aacgcctggagtggccgaacacttt

SEQ ID NO: 123676 - DNA, 25 bp, Homo sapien
cgcgggccatctccagaaaactgtc

SEQ ID NO: 123677 - DNA, 25 bp, Homo sapien
tctttctcaggagctccacagcgcg

SEQ ID NO: 123678 - DNA, 25 bp, Homo sapien
cggtttcttttcagctcgtctcaaa

SEQ ID NO: 123679 - DNA, 25 bp, Homo sapien
ccttgaagtaggcttgtcctgatcc

SEQ ID NO: 123680 - DNA, 25 bp, Homo sapien
tccacgctgccaagaattaagaccg

SEQ ID NO: 123681 - DNA, 25 bp, Homo sapien
tgctcctgtcaagttttatttcccg

SEQ ID NO: 123682 - DNA, 25 bp, Homo sapien
ccggcctgagcctccattttgagta

SEQ ID NO: 123683 - DNA, 25 bp, Homo sapien
cccttttagagaaaatgctcctgtc

SEQ ID NO: 123684 - DNA, 25 bp, Homo sapien
gccagctcctgggtaccactctggg

SEQ ID NO: 123685 - DNA, 25 bp, Homo sapien
ctccattttgtgcagtgtccgcaga

SEQ ID NO: 123686 - DNA, 25 bp, Homo sapien
cgccgccgttgtcgtagagaaacat

SEQ ID NO: 123687 - DNA, 25 bp, Homo sapien
gtcatagcccgagccgcatggagaa

SEQ ID NO: 123688 - DNA, 25 bp, Homo sapien
gcgaactccttagcgcgggagctga

SEQ ID NO: 123689 - DNA, 25 bp, Homo sapien
gccggcggtatccatgtacttgtcc

SEQ ID NO: 123690 - DNA, 25 bp, Homo sapien
agaaacatgacggtgggctcgatcc

SEQ ID NO: 123691 - DNA, 25 bp, Homo sapien
tccgcccacggcgtatgcaaagcgg

SEQ ID NO: 123692 - DNA, 25 bp, Homo sapien
gccgaagtagccatagggcagcgcc

SEQ ID NO: 123693 - DNA, 25 bp, Homo sapien
catgttcttgttgagctcgtcggcc

SEQ ID NO: 123694 - DNA, 25 bp, Homo sapien
ccaaaactcggctctgggaggccta

SEQ ID NO: 123695 - DNA, 25 bp, Homo sapien
ttcttaatgcacaacgcgacggagg

SEQ ID NO: 123696 - DNA, 25 bp, Homo sapien
ggccctgttcccagctgcgaattct

SEQ ID NO: 123697 - DNA, 25 bp, Homo sapien
ccaggactgggcagtgcattcttta

SEQ ID NO: 123698 - DNA, 25 bp, Homo sapien
agcttgatgcttacgcccgcaacaa

SEQ ID NO: 123699 - DNA, 25 bp, Homo sapien
ctgccactggcccaaaggaatttta

SEQ ID NO: 123700 - DNA, 25 bp, Homo sapien
ttcactggagctggaaacagccttc

SEQ ID NO: 123701 - DNA, 25 bp, Homo sapien
ctaagtgactccgaagccggcggca

SEQ ID NO: 123702 - DNA, 25 bp, Homo sapien
tcgctcaggcttttaggacaaaatc

SEQ ID NO: 123703 - DNA, 25 bp, Homo sapien
gcgaccctgggcatgaaactcctca

SEQ ID NO: 123704 - DNA, 25 bp, Homo sapien
tccgaagctgctccaggttgaaatg

SEQ ID NO: 123705 - DNA, 25 bp, Homo sapien
gtgacccagggtgaacttgctattt

SEQ ID NO: 123706 - DNA, 25 bp, Homo sapien
ttgtaaggcctcgtgctggcaccta

SEQ ID NO: 123707 - DNA, 25 bp, Homo sapien
cctgagggacaaaggcgagcattca

SEQ ID NO: 123708 - DNA, 25 bp, Homo sapien
tctctcccggattgttcgaagtatc

SEQ ID NO: 123709 - DNA, 25 bp, Homo sapien
cgcggcacacttcctctatgtagtc

SEQ ID NO: 123710 - DNA, 25 bp, Homo sapien
atgcacgaaccgagggacacaccgc

SEQ ID NO: 123711 - DNA, 25 bp, Homo sapien
gcaggatgcacgaaccgagggacac

SEQ ID NO: 123712 - DNA, 25 bp, Homo sapien
gcttcgtgtttgcagagcagcctcc

SEQ ID NO: 123713 - DNA, 25 bp, Homo sapien
cgccgccagactgacctggtgtggc

SEQ ID NO: 123714 - DNA, 25 bp, Homo sapien
tggccgcgtcctcagagttcgctcg

SEQ ID NO: 123715 - DNA, 25 bp, Homo sapien
cctcagagttcgctcggggcttcgt

SEQ ID NO: 123716 - DNA, 25 bp, Homo sapien
caccctcttccgctcggtgggagga

SEQ ID NO: 123717 - DNA, 25 bp, Homo sapien
agtgcaaaccgtgatccaccctctt

SEQ ID NO: 123718 - DNA, 25 bp, Homo sapien
tgcagcagaacctgtcgccagcttg

SEQ ID NO: 123719 - DNA, 25 bp, Homo sapien
agcgccgctaatccgcaggctgcag

SEQ ID NO: 123720 - DNA, 25 bp, Homo sapien
tcggatctgagccagcgccgctaat

SEQ ID NO: 123721 - DNA, 25 bp, Homo sapien
gccaaagtcgcgtcatcccgcattt

SEQ ID NO: 123722 - DNA, 25 bp, Homo sapien
tcggcctctacttcctcggatctga

SEQ ID NO: 123723 - DNA, 25 bp, Homo sapien
cgcatttgcctgcacccaggagttt

SEQ ID NO: 123724 - DNA, 25 bp, Homo sapien
ccaggagtttgcaacccgcagagcc

SEQ ID NO: 123725 - DNA, 25 bp, Homo sapien
tgcgcgcagcctgaaccgccaaagt

SEQ ID NO: 123726 - DNA, 25 bp, Homo sapien
agcccaacctgtggcgcgtgcttca

SEQ ID NO: 123727 - DNA, 25 bp, Homo sapien
ccgcgggatccgagccagcaaggat

SEQ ID NO: 123728 - DNA, 25 bp, Homo sapien
agactcaccgccaggcttctgggct

SEQ ID NO: 123729 - DNA, 25 bp, Homo sapien
agggactgatactcccggccggagc

SEQ ID NO: 123730 - DNA, 25 bp, Homo sapien
ctcccaggatggaaagggaccctca

SEQ ID NO: 123731 - DNA, 25 bp, Homo sapien
agctgcgctttgtcaccgaggcggc

SEQ ID NO: 123732 - DNA, 25 bp, Homo sapien
cgcaccaagacagcagttcgggagc

SEQ ID NO: 123733 - DNA, 25 bp, Homo sapien
cagcaaggatgctgggactcgccgc

SEQ ID NO: 123734 - DNA, 25 bp, Homo sapien
cccgccgcgagaaatgagaagccgc

SEQ ID NO: 123735 - DNA, 25 bp, Homo sapien
aatttcaatccgagaggagccggct

SEQ ID NO: 123736 - DNA, 25 bp, Homo sapien
gagcttttgaagtccggagaatttc

SEQ ID NO: 123737 - DNA, 25 bp, Homo sapien
agccaagctgggagcttttgaagtc

SEQ ID NO: 123738 - DNA, 25 bp, Homo sapien
ttccatttaaaacgacccgcgcatc

SEQ ID NO: 123739 - DNA, 25 bp, Homo sapien
tgcccggcttccgattccatttaaa

SEQ ID NO: 123740 - DNA, 25 bp, Homo sapien
tgtcgccgttgaaaggcccgctgca

SEQ ID NO: 123741 - DNA, 25 bp, Homo sapien
tgaagtccggagaatttcaatccga

SEQ ID NO: 123742 - DNA, 25 bp, Homo sapien
gcgctcgcttcacaaggtgacccta

SEQ ID NO: 123743 - DNA, 25 bp, Homo sapien
tcaaatttgtccgaagccgtgggca

SEQ ID NO: 123744 - DNA, 25 bp, Homo sapien
ccagcggtactgtaatgacgattgc

SEQ ID NO: 123745 - DNA, 25 bp, Homo sapien
gcgcgcgttaagctctcttttcttt

SEQ ID NO: 123746 - DNA, 25 bp, Homo sapien
ctggcgcatcactgccgagccatta

SEQ ID NO: 123747 - DNA, 25 bp, Homo sapien
cgagccattagctgcgggtttcctt

SEQ ID NO: 123748 - DNA, 25 bp, Homo sapien
tcatcttcgctgtggcagacgtttc

SEQ ID NO: 123749 - DNA, 25 bp, Homo sapien
ctatttatccacttgcgctcgccga

SEQ ID NO: 123750 - DNA, 25 bp, Homo sapien
gggccaacgacctcaccattgacta

SEQ ID NO: 123751 - DNA, 25 bp, Homo sapien
tcaccattgactacgctgaccagcg

SEQ ID NO: 123752 - DNA, 25 bp, Homo sapien
gaccgacctggacaccaacatgatc

SEQ ID NO: 123753 - DNA, 25 bp, Homo sapien
tggacaccaacatgatcgagtcgtc

SEQ ID NO: 123754 - DNA, 25 bp, Homo sapien
agccgaggatcgtgcgggccttcat

SEQ ID NO: 123755 - DNA, 25 bp, Homo sapien
atcgagtcgtccaacatgctgggtg

SEQ ID NO: 123756 - DNA, 25 bp, Homo sapien
ccaactgcatgacgctggtggacaa

SEQ ID NO: 123757 - DNA, 25 bp, Homo sapien
ggccttcatggacgggaccaactgc

SEQ ID NO: 123758 - DNA, 25 bp, Homo sapien
tgccgaggagccgtctgccgagcat

SEQ ID NO: 123759 - DNA, 25 bp, Homo sapien
gtctgcccagtgtccgtgggccctt

SEQ ID NO: 123760 - DNA, 25 bp, Homo sapien
atcacggggccgtctgccaagcatc

SEQ ID NO: 123761 - DNA, 25 bp, Homo sapien
agactctcctgggatcacggggccg

SEQ ID NO: 123762 - DNA, 25 bp, Homo sapien
gtcctcagtgggtgcagactctcct

SEQ ID NO: 123763 - DNA, 25 bp, Homo sapien
agcaggtcctcagtgggtgcagact

SEQ ID NO: 123764 - DNA, 25 bp, Homo sapien
gctccgtctgccaggccttgggtcg

SEQ ID NO: 123765 - DNA, 25 bp, Homo sapien
tcgtggggccgtctgctgagcatcc

SEQ ID NO: 123766 - DNA, 25 bp, Homo sapien
gcacgtcggtcagaggtccaaatta

SEQ ID NO: 123767 - DNA, 25 bp, Homo sapien
ccgaccagtttgcacgtcggtcaga

SEQ ID NO: 123768 - DNA, 25 bp, Homo sapien
cgagggcaagatcaaacgccgatcc

SEQ ID NO: 123769 - DNA, 25 bp, Homo sapien
gatcaaacgccgatccgggcagttt

SEQ ID NO: 123770 - DNA, 25 bp, Homo sapien
ggcgcggaagccaggagtccataaa

SEQ ID NO: 123771 - DNA, 25 bp, Homo sapien
gccaggagtccataaaggaccgtaa

SEQ ID NO: 123772 - DNA, 25 bp, Homo sapien
aaaattgcggcccacttgggcagcc

SEQ ID NO: 123773 - DNA, 25 bp, Homo sapien
ggtgctgcagccctccgaccagttt

SEQ ID NO: 123774 - DNA, 25 bp, Homo sapien
gccatgtggctgactctgtcccttt

SEQ ID NO: 123775 - DNA, 25 bp, Homo sapien
tttggctgttcctgccctgcgaaca

SEQ ID NO: 123776 - DNA, 25 bp, Homo sapien
tctgcggccgcagaccaattgagtc

SEQ ID NO: 123777 - DNA, 25 bp, Homo sapien
gcatcgggccaagtccagctactga

SEQ ID NO: 123778 - DNA, 25 bp, Homo sapien
tcgtgacagctcctaggcaggcatt

SEQ ID NO: 123779 - DNA, 25 bp, Homo sapien
cgtgcagattgaccctcgtgacagc

SEQ ID NO: 123780 - DNA, 25 bp, Homo sapien
gtgtgcacctatttagcgggaagta

SEQ ID NO: 123781 - DNA, 25 bp, Homo sapien
caaggaagtttctggggacacgctc

SEQ ID NO: 123782 - DNA, 25 bp, Homo sapien
ctaggcggcactctttggagaagta

SEQ ID NO: 123783 - DNA, 25 bp, Homo sapien
atcgtttgatgtgccgagccggaaa

SEQ ID NO: 123784 - DNA, 25 bp, Homo sapien
gtttctcccgaaactggcgctcttg

SEQ ID NO: 123785 - DNA, 25 bp, Homo sapien
caggttgctggtagcttctggactc

SEQ ID NO: 123786 - DNA, 25 bp, Homo sapien
agcagcgtctacttccctcagagaa

SEQ ID NO: 123787 - DNA, 25 bp, Homo sapien
cgctgactgcaggacgtcccagttt

SEQ ID NO: 123788 - DNA, 25 bp, Homo sapien
cgctgaggcctttgtagctgaagtc

SEQ ID NO: 123789 - DNA, 25 bp, Homo sapien
ctcttgggtaaaaccgcgtgccgcg

SEQ ID NO: 123790 - DNA, 25 bp, Homo sapien
aagaggcctttttgaacagtgacgc

SEQ ID NO: 123791 - DNA, 25 bp, Homo sapien
gggcctgtcaatccctttacggaca

SEQ ID NO: 123792 - DNA, 25 bp, Homo sapien
gggagtctccttgtttaccaaagca

SEQ ID NO: 123793 - DNA, 25 bp, Homo sapien
ttacggacagggaagcagaccaatc

SEQ ID NO: 123794 - DNA, 25 bp, Homo sapien
ccgcagctgtgcgaaggaccaataa

SEQ ID NO: 123795 - DNA, 25 bp, Homo sapien
ttacccgctgcaaagctgccggctg

SEQ ID NO: 123796 - DNA, 25 bp, Homo sapien
cttcggccgtctggacagaagaagc

SEQ ID NO: 123797 - DNA, 25 bp, Homo sapien
tcgtgcctcatttacagcctgcggg

SEQ ID NO: 123798 - DNA, 25 bp, Homo sapien
tctcttttagggctcgtgctacacc

SEQ ID NO: 123799 - DNA, 25 bp, Homo sapien
gaccgacttgcactcctggcttagg

SEQ ID NO: 123800 - DNA, 25 bp, Homo sapien
ccgttcgcaaggtgtggactagtcc

SEQ ID NO: 123801 - DNA, 25 bp, Homo sapien
tgatggcctgcttcacctggaatcc

SEQ ID NO: 123802 - DNA, 25 bp, Homo sapien
cccagctgttttggtttgagtcgcc

SEQ ID NO: 123803 - DNA, 25 bp, Homo sapien
aggatcggaagcctgcgtaactttc

SEQ ID NO: 123804 - DNA, 25 bp, Homo sapien
gacgaggctttccttcccgaagaca

SEQ ID NO: 123805 - DNA, 25 bp, Homo sapien
ttctggtgtccaaggctaaactctg

SEQ ID NO: 123806 - DNA, 25 bp, Homo sapien
tttaaatgcccggccatgggccctg

SEQ ID NO: 123807 - DNA, 25 bp, Homo sapien
gaggaggaagcggaatggctgccgc

SEQ ID NO: 123808 - DNA, 25 bp, Homo sapien
cagagccggggtgcatttaaatgcc

SEQ ID NO: 123809 - DNA, 25 bp, Homo sapien
gtgcatttaaatgcccggccatggg

SEQ ID NO: 123810 - DNA, 25 bp, Homo sapien
gcccgcgggcgcacccaagacctca

SEQ ID NO: 123811 - DNA, 25 bp, Homo sapien
cgcacccaagacctcagcccgcagc

SEQ ID NO: 123812 - DNA, 25 bp, Homo sapien
ccctcccgacgcaccacacctagca

SEQ ID NO: 123813 - DNA, 25 bp, Homo sapien
acctagcaaccggcgctgacaggac

SEQ ID NO: 123814 - DNA, 25 bp, Homo sapien
cagggcgcgcggctacagctgtgcg

SEQ ID NO: 123815 - DNA, 25 bp, Homo sapien
agcccccctggtgtcggctctgcga

SEQ ID NO: 123816 - DNA, 25 bp, Homo sapien
tggtgctacatcgagagcccccctg

SEQ ID NO: 123817 - DNA, 25 bp, Homo sapien
tgtcatggtgctacatcgagagccc

SEQ ID NO: 123818 - DNA, 25 bp, Homo sapien
ctgtcatggtgctacatcgagagcc

SEQ ID NO: 123819 - DNA, 25 bp, Homo sapien
gcctgtcatggtgctacatcgagag

SEQ ID NO: 123820 - DNA, 25 bp, Homo sapien
ggctacagctgtgcggccccaacct

SEQ ID NO: 123821 - DNA, 25 bp, Homo sapien
cctgtcatggtgctacatcgagagc

SEQ ID NO: 123822 - DNA, 25 bp, Homo sapien
cctcgatgtgctcgatgaggtcggc

SEQ ID NO: 123823 - DNA, 25 bp, Homo sapien
ccgaatcggcaggtattggagaaga

SEQ ID NO: 123824 - DNA, 25 bp, Homo sapien
tggttgtcctcgatgtgctcgatga

SEQ ID NO: 123825 - DNA, 25 bp, Homo sapien
atgtggttgtcctcgatgtgctcga

SEQ ID NO: 123826 - DNA, 25 bp, Homo sapien
accgatgtggttgtcctcgatgtgc

SEQ ID NO: 123827 - DNA, 25 bp, Homo sapien
catttaccgatgtggttgtcctcga

SEQ ID NO: 123828 - DNA, 25 bp, Homo sapien
cccgggccatttaccgatgtggttg

SEQ ID NO: 123829 - DNA, 25 bp, Homo sapien
ccgggcaggagtttccgcgcgcctg

SEQ ID NO: 123830 - DNA, 25 bp, Homo sapien
cctgacgcggggaccagttatgaat

SEQ ID NO: 123831 - DNA, 25 bp, Homo sapien
ttcaggaatcccacgtgacgtcacc

SEQ ID NO: 123832 - DNA, 25 bp, Homo sapien
agccctccagaagtgcggtcaagcg

SEQ ID NO: 123833 - DNA, 25 bp, Homo sapien
gcggaccgcaatgatttagaagttc

SEQ ID NO: 123834 - DNA, 25 bp, Homo sapien
agtttgcaaacttccagcgggcgcg

SEQ ID NO: 123835 - DNA, 25 bp, Homo sapien
ccatctcgggagtgtacttgtttgc

SEQ ID NO: 123836 - DNA, 25 bp, Homo sapien
ttgctcagtccaacgtggtcccttc

SEQ ID NO: 123837 - DNA, 25 bp, Homo sapien
ttagccacttttgttgcacttgccg

SEQ ID NO: 123838 - DNA, 25 bp, Homo sapien
gaatcctcagttcgggcgccctctg

SEQ ID NO: 123839 - DNA, 25 bp, Homo sapien
gctgcgcacccacgggaggatttca

SEQ ID NO: 123840 - DNA, 25 bp, Homo sapien
ggcgccatgccgcacaacactgtgg

SEQ ID NO: 123841 - DNA, 25 bp, Homo sapien
gccgtggggaaatcatccggcgcca

SEQ ID NO: 123842 - DNA, 25 bp, Homo sapien
ccgagagcatggactagagaggcac

SEQ ID NO: 123843 - DNA, 25 bp, Homo sapien
gccctttacaaagacaagctccttg

SEQ ID NO: 123844 - DNA, 25 bp, Homo sapien
tccctgaaatgtgcacgtgaaggag

SEQ ID NO: 123845 - DNA, 25 bp, Homo sapien
ctgggacagcgagccttccgaaagt

SEQ ID NO: 123846 - DNA, 25 bp, Homo sapien
tgcacagcattgagcgggccgacaa

SEQ ID NO: 123847 - DNA, 25 bp, Homo sapien
gcctggctgtgcctttgctgacacc

SEQ ID NO: 123848 - DNA, 25 bp, Homo sapien
tgctgacaccgtgcccgtgtgtgtt

SEQ ID NO: 123849 - DNA, 25 bp, Homo sapien
tcgtgattgccgacgatctcccgca

SEQ ID NO: 123850 - DNA, 25 bp, Homo sapien
cacccgttcggtctgacgcagtaca

SEQ ID NO: 123851 - DNA, 25 bp, Homo sapien
atctactggacagactggaatctgc

SEQ ID NO: 123852 - DNA, 25 bp, Homo sapien
ccgacaagactagcggccggaaccg

SEQ ID NO: 123853 - DNA, 25 bp, Homo sapien
tgacgcagtacagcgattatatcta

SEQ ID NO: 123854 - DNA, 25 bp, Homo sapien
cggacagctcattgccgctcaggtc

SEQ ID NO: 123855 - DNA, 25 bp, Homo sapien
tcttgcccagaaagcggatccggtt

SEQ ID NO: 123856 - DNA, 25 bp, Homo sapien
cgttgccgtctagatccagccgata

SEQ ID NO: 123857 - DNA, 25 bp, Homo sapien
agctgctggtcatccaggtaatcca

SEQ ID NO: 123858 - DNA, 25 bp, Homo sapien
aggtacagctcttccagccgcgaga

SEQ ID NO: 123859 - DNA, 25 bp, Homo sapien
atctcgttcccgttggcgtagagga

SEQ ID NO: 123860 - DNA, 25 bp, Homo sapien
agccgcagcttgactagactctcca

SEQ ID NO: 123861 - DNA, 25 bp, Homo sapien
aatccaggtatttgcctcgcagggc

SEQ ID NO: 123862 - DNA, 25 bp, Homo sapien
gcagacgacaagtttgggccacctc

SEQ ID NO: 123863 - DNA, 25 bp, Homo sapien
tgcgtgtccgtgtcaccaatgcaga

SEQ ID NO: 123864 - DNA, 25 bp, Homo sapien
tccagtgtgtcggttccacagaccc

SEQ ID NO: 123865 - DNA, 25 bp, Homo sapien
cattccaggggcaatgacgacgcag

SEQ ID NO: 123866 - DNA, 25 bp, Homo sapien
gacgacgcaggagtgtatttcagga

SEQ ID NO: 123867 - DNA, 25 bp, Homo sapien
tgtatttcaggacggcgctggccac

SEQ ID NO: 123868 - DNA, 25 bp, Homo sapien
acatcaggacctctttggacgcggc

SEQ ID NO: 123869 - DNA, 25 bp, Homo sapien
caggtgacagcagtgctccggaagc

SEQ ID NO: 123870 - DNA, 25 bp, Homo sapien
cttcttcctttgtgtgtgcgcgagc

SEQ ID NO: 123871 - DNA, 25 bp, Homo sapien
cctgacatctgacagcgcagaggtg

SEQ ID NO: 123872 - DNA, 25 bp, Homo sapien
tacttgtttggttcgccagcacctc

SEQ ID NO: 123873 - DNA, 25 bp, Homo sapien
tctgcccggtctactcgaagtgcgg

SEQ ID NO: 123874 - DNA, 25 bp, Homo sapien
gggagctgtcaagcccgcagcagcc

SEQ ID NO: 123875 - DNA, 25 bp, Homo sapien
ccctgacacccatagaaaagcgtgc

SEQ ID NO: 123876 - DNA, 25 bp, Homo sapien
ccacaaataaatagcggcggcggca

SEQ ID NO: 123877 - DNA, 25 bp, Homo sapien
agcctgggatggacagagcctacct

SEQ ID NO: 123878 - DNA, 25 bp, Homo sapien
gcctgaaactcgcaaacattttgct

SEQ ID NO: 123879 - DNA, 25 bp, Homo sapien
aggtctccgccgtttcttctcaagg

SEQ ID NO: 123880 - DNA, 25 bp, Homo sapien
tgcggcaacttttacccagcggagc

SEQ ID NO: 123881 - DNA, 25 bp, Homo sapien
aaataaatcgcgatggggccaaggg

SEQ ID NO: 123882 - DNA, 25 bp, Homo sapien
tgtggattcgctcccgttagttaca

SEQ ID NO: 123883 - DNA, 25 bp, Homo sapien
cattttgctcgggtgtggattcgct

SEQ ID NO: 123884 - DNA, 25 bp, Homo sapien
ctcgcaaacattttgctcgggtgtg

SEQ ID NO: 123885 - DNA, 25 bp, Homo sapien
cgtttcttctcaaggagtcggtcgg

SEQ ID NO: 123886 - DNA, 25 bp, Homo sapien
tattgttttcaagtcgctgcccgag

SEQ ID NO: 123887 - DNA, 25 bp, Homo sapien
tgcagacgcagttgctaattgtgcc

SEQ ID NO: 123888 - DNA, 25 bp, Homo sapien
ggctgcgggaattccgacctgtaca

SEQ ID NO: 123889 - DNA, 25 bp, Homo sapien
acgctccaggactccgttttctgta

SEQ ID NO: 123890 - DNA, 25 bp, Homo sapien
ttgcgcaattcgtacaaagcccttc

SEQ ID NO: 123891 - DNA, 25 bp, Homo sapien
agcccttccgtgctcacaaagttga

SEQ ID NO: 123892 - DNA, 25 bp, Homo sapien
ggacaccttaccaccactgttagta

SEQ ID NO: 123893 - DNA, 25 bp, Homo sapien
acgggttgcttttccgatctgcaaa

SEQ ID NO: 123894 - DNA, 25 bp, Homo sapien
cagcagccgccgcaatttgaagatc

SEQ ID NO: 123895 - DNA, 25 bp, Homo sapien
aatttgaagatctcgcgctccggcc

SEQ ID NO: 123896 - DNA, 25 bp, Homo sapien
aggggccgctttggcccttccatct

SEQ ID NO: 123897 - DNA, 25 bp, Homo sapien
ttatacggggacaaatccggcagca

SEQ ID NO: 123898 - DNA, 25 bp, Homo sapien
cagacaagttatacggggacaaatc

SEQ ID NO: 123899 - DNA, 25 bp, Homo sapien
ccctggtggaaatcgctcaccaaca

SEQ ID NO: 123900 - DNA, 25 bp, Homo sapien
agaagaggaaagtgcgcgccacgct

SEQ ID NO: 123901 - DNA, 25 bp, Homo sapien
tcgctcaccaacagcagaaagaaaa

SEQ ID NO: 123902 - DNA, 25 bp, Homo sapien
ggactgcccgtgtgaacggcttcaa

SEQ ID NO: 123903 - DNA, 25 bp, Homo sapien
gttctgcgccactggggctgtgaac

SEQ ID NO: 123904 - DNA, 25 bp, Homo sapien
ctcaccaaaggctgcacgctcaggg

SEQ ID NO: 123905 - DNA, 25 bp, Homo sapien
tgtgaacggcttcaaccgcatgccc

SEQ ID NO: 123906 - DNA, 25 bp, Homo sapien
cccacagtcgccaagaagactggga

SEQ ID NO: 123907 - DNA, 25 bp, Homo sapien
atcggcggtgggtacaagtcattca

SEQ ID NO: 123908 - DNA, 25 bp, Homo sapien
acaagtcattcaggctgcgaggcga

SEQ ID NO: 123909 - DNA, 25 bp, Homo sapien
ctgtgaacgtatgaggggctgtaca

SEQ ID NO: 123910 - DNA, 25 bp, Homo sapien
cctgcgagattaatttcacagggga

SEQ ID NO: 123911 - DNA, 25 bp, Homo sapien
gcgagattaatttcacaggggatta

SEQ ID NO: 123912 - DNA, 25 bp, Homo sapien
tgtctacgcggcagcgacaccgcag

SEQ ID NO: 123913 - DNA, 25 bp, Homo sapien
gcggcagcgacaccgcaggtgttac

SEQ ID NO: 123914 - DNA, 25 bp, Homo sapien
acaccgcaggtgttacgtgccgggt

SEQ ID NO: 123915 - DNA, 25 bp, Homo sapien
cgcaggtgttacgtgccgggtttct

SEQ ID NO: 123916 - DNA, 25 bp, Homo sapien
tggtcccggtcccattggccactcc

SEQ ID NO: 123917 - DNA, 25 bp, Homo sapien
caaaaccacgtgtctacgcggcagc

SEQ ID NO: 123918 - DNA, 25 bp, Homo sapien
gcccgcgcaacagctcctatttggg

SEQ ID NO: 123919 - DNA, 25 bp, Homo sapien
accacggggttgcttggtgacttct

SEQ ID NO: 123920 - DNA, 25 bp, Homo sapien
tcggccggagctcgagtccagtcca

SEQ ID NO: 123921 - DNA, 25 bp, Homo sapien
gagacttgggactctgtacccggga

SEQ ID NO: 123922 - DNA, 25 bp, Homo sapien
tctctccgcagctgagacttgggac

SEQ ID NO: 123923 - DNA, 25 bp, Homo sapien
ttggggaattccagccttaggcctc

SEQ ID NO: 123924 - DNA, 25 bp, Homo sapien
cagctcctatttggggaattccagc

SEQ ID NO: 123925 - DNA, 25 bp, Homo sapien
ttggtgacttctccggactggactc

SEQ ID NO: 123926 - DNA, 25 bp, Homo sapien
ccctggtggagtgcgataaaatctc

SEQ ID NO: 123927 - DNA, 25 bp, Homo sapien
ccgaccaggtaaggagcgctgcctg

SEQ ID NO: 123928 - DNA, 25 bp, Homo sapien
gctcccagccgttcctgcagaagaa

SEQ ID NO: 123929 - DNA, 25 bp, Homo sapien
ccaggagttaatagcagcagtgaaa

SEQ ID NO: 123930 - DNA, 25 bp, Homo sapien
ccctttgccaggagttaatagcagc

SEQ ID NO: 123931 - DNA, 25 bp, Homo sapien
tgctcccaccttgtgggtatccggg

SEQ ID NO: 123932 - DNA, 25 bp, Homo sapien
tatccggggctcaaagcggagcccg

SEQ ID NO: 123933 - DNA, 25 bp, Homo sapien
cctgcgcaagatgcgcaggagcctc

SEQ ID NO: 123934 - DNA, 25 bp, Homo sapien
aagcccagggccatcgtcgtcaacg

SEQ ID NO: 123935 - DNA, 25 bp, Homo sapien
catctacagccggacactgttctgg

SEQ ID NO: 123936 - DNA, 25 bp, Homo sapien
gccatcgtcgtcaacgcggagcgag

SEQ ID NO: 123937 - DNA, 25 bp, Homo sapien
ctcagcatcgacatctacagccgga

SEQ ID NO: 123938 - DNA, 25 bp, Homo sapien
tcaacgtccacaggctgagcgggga

SEQ ID NO: 123939 - DNA, 25 bp, Homo sapien
taccatcaacgtccacaggctgagc

SEQ ID NO: 123940 - DNA, 25 bp, Homo sapien
actgttctggacgtgcgaggccacc

SEQ ID NO: 123941 - DNA, 25 bp, Homo sapien
tgcgaggccaccaataccatcaacg

SEQ ID NO: 123942 - DNA, 25 bp, Homo sapien
ggcacatcccagtgggcagcaggtt

SEQ ID NO: 123943 - DNA, 25 bp, Homo sapien
aaccgccgggaaagcagcgctgcaa

SEQ ID NO: 123944 - DNA, 25 bp, Homo sapien
aaagcagcgctgcaaacgccctgcg

SEQ ID NO: 123945 - DNA, 25 bp, Homo sapien
gctctccgctctgcggtgctgaggc

SEQ ID NO: 123946 - DNA, 25 bp, Homo sapien
ggtccggattactgcggcgacctcg

SEQ ID NO: 123947 - DNA, 25 bp, Homo sapien
gagagggcgtatctcgccgcagaaa

SEQ ID NO: 123948 - DNA, 25 bp, Homo sapien
ccctctttgctagatttttatttct

SEQ ID NO: 123949 - DNA, 25 bp, Homo sapien
ttttatttcttggttgtggctctca

SEQ ID NO: 123950 - DNA, 25 bp, Homo sapien
gccctatgaaatcttcggggttcca

SEQ ID NO: 123951 - DNA, 25 bp, Homo sapien
ggcgcagagccaaccggaaactcct

SEQ ID NO: 123952 - DNA, 25 bp, Homo sapien
agcccggtggatttcagcattcaac

SEQ ID NO: 123953 - DNA, 25 bp, Homo sapien
tcatcccttgtggtcctagagcccg

SEQ ID NO: 123954 - DNA, 25 bp, Homo sapien
caacgatggaatttacagcccggta

SEQ ID NO: 123955 - DNA, 25 bp, Homo sapien
cagcattcaaccagcgtggattttg

SEQ ID NO: 123956 - DNA, 25 bp, Homo sapien
agactcgtttactctcgccgttgga

SEQ ID NO: 123957 - DNA, 25 bp, Homo sapien
tccggctgatttatctctgtgaaga

SEQ ID NO: 123958 - DNA, 25 bp, Homo sapien
tctcactctgatattagtttattgg

SEQ ID NO: 123959 - DNA, 25 bp, Homo sapien
tattggtttcttgtgcgttcggccc

SEQ ID NO: 123960 - DNA, 25 bp, Homo sapien
ggagcatcaggcctcacgttctgca

SEQ ID NO: 123961 - DNA, 25 bp, Homo sapien
gcccggaccctggacatctcaagag

SEQ ID NO: 123962 - DNA, 25 bp, Homo sapien
acgttctgcacaagcgttcccggtg

SEQ ID NO: 123963 - DNA, 25 bp, Homo sapien
catctcaagaggctcatagggaccc

SEQ ID NO: 123964 - DNA, 25 bp, Homo sapien
ctctgggcacaagatcccggaagaa

SEQ ID NO: 123965 - DNA, 25 bp, Homo sapien
ccggaagaaatgcagggtcagcctc

SEQ ID NO: 123966 - DNA, 25 bp, Homo sapien
ctgcgctccacacttgtctcagggg

SEQ ID NO: 123967 - DNA, 25 bp, Homo sapien
gcgcggagcgggagtatttcccaaa

SEQ ID NO: 123968 - DNA, 25 bp, Homo sapien
ctccttgtgaacagcgtgccggctt

SEQ ID NO: 123969 - DNA, 25 bp, Homo sapien
gactcaatttccctgcgggccgttc

SEQ ID NO: 123970 - DNA, 25 bp, Homo sapien
cggcgggcaccatttacagtcagaa

SEQ ID NO: 123971 - DNA, 25 bp, Homo sapien
tcacgtagaccctcaaacggcgggc

SEQ ID NO: 123972 - DNA, 25 bp, Homo sapien
aaagcagttctctcacgggaccgtg

SEQ ID NO: 123973 - DNA, 25 bp, Homo sapien
ctgccgcgaaatcccggagtggatt

SEQ ID NO: 123974 - DNA, 25 bp, Homo sapien
ctgtccatactagcgatgcccgatc

SEQ ID NO: 123975 - DNA, 25 bp, Homo sapien
tgcactgcctgtttggacacaaagc

SEQ ID NO: 123976 - DNA, 25 bp, Homo sapien
aacggctgcggcgacaattttgtga

SEQ ID NO: 123977 - DNA, 25 bp, Homo sapien
ccttctatgtgctgtgtccggacaa

SEQ ID NO: 123978 - DNA, 25 bp, Homo sapien
cgcaggatggatttctacgccgacc

SEQ ID NO: 123979 - DNA, 25 bp, Homo sapien
atggtgctccaacacgcccttcgag

SEQ ID NO: 123980 - DNA, 25 bp, Homo sapien
ccgacgttgcggagaaatggtgctc

SEQ ID NO: 123981 - DNA, 25 bp, Homo sapien
cctggaccttctttgcggaattaca

SEQ ID NO: 123982 - DNA, 25 bp, Homo sapien
acatgggcgccaaacagagcggccc

SEQ ID NO: 123983 - DNA, 25 bp, Homo sapien
gcggcagccgcacggccacttgagc

SEQ ID NO: 123984 - DNA, 25 bp, Homo sapien
cagcagagagcggtagcggcccgtc

SEQ ID NO: 123985 - DNA, 25 bp, Homo sapien
ccgagcgcggcagcagagagcggta

SEQ ID NO: 123986 - DNA, 25 bp, Homo sapien
cgcgcgcgacccaaacacacgggcc

SEQ ID NO: 123987 - DNA, 25 bp, Homo sapien
gcggggtcaacgcgcgcgacccaaa

SEQ ID NO: 123988 - DNA, 25 bp, Homo sapien
gagccaatcggcctggcggcacgag

SEQ ID NO: 123989 - DNA, 25 bp, Homo sapien
agccgcacggccacttgagccgccc

SEQ ID NO: 123990 - DNA, 25 bp, Homo sapien
gctgactgtgaagttcatccctctc

SEQ ID NO: 123991 - DNA, 25 bp, Homo sapien
ggccaccaggtttacagacttcgca

SEQ ID NO: 123992 - DNA, 25 bp, Homo sapien
gtcgctgggacttacttggccacca

SEQ ID NO: 123993 - DNA, 25 bp, Homo sapien
gtttctccgcttggttccacccaga

SEQ ID NO: 123994 - DNA, 25 bp, Homo sapien
gctacatgcttcaaactcgcgggtt

SEQ ID NO: 123995 - DNA, 25 bp, Homo sapien
gggataaacgattccgctgactgtg

SEQ ID NO: 123996 - DNA, 25 bp, Homo sapien
aacgggaactggctgcgactacagc

SEQ ID NO: 123997 - DNA, 25 bp, Homo sapien
cgcagccgctgagagctagagaaga

SEQ ID NO: 123998 - DNA, 25 bp, Homo sapien
gctcctcattggacacgacctactg

SEQ ID NO: 123999 - DNA, 25 bp, Homo sapien
ctgtcctgaagcaatccggcgctgg

SEQ ID NO: 124000 - DNA, 25 bp, Homo sapien
cgccttccgccgagactcagaaata

SEQ ID NO: 124001 - DNA, 25 bp, Homo sapien
ccttgcagcccgagttggccatatc

SEQ ID NO: 124002 - DNA, 25 bp, Homo sapien
gtggatcctctctgtcagcaggttg

SEQ ID NO: 124003 - DNA, 25 bp, Homo sapien
tcccatggacactggctgaaggtcg

SEQ ID NO: 124004 - DNA, 25 bp, Homo sapien
gaagaactgcattcctggcccgatc

SEQ ID NO: 124005 - DNA, 25 bp, Homo sapien
cgcgtcctagtaccctcatcaagaa

SEQ ID NO: 124006 - DNA, 25 bp, Homo sapien
ggtgtcactcgtataaaaacctatg

SEQ ID NO: 124007 - DNA, 25 bp, Homo sapien
cagaagtgtccgttcaagtaggtcg

SEQ ID NO: 124008 - DNA, 25 bp, Homo sapien
cggtgttttgcgctctccgctaagc

SEQ ID NO: 124009 - DNA, 25 bp, Homo sapien
tctttttggatgactccctggaacc

SEQ ID NO: 124010 - DNA, 25 bp, Homo sapien
tttacgcggcgatttcatcatgctc

SEQ ID NO: 124011 - DNA, 25 bp, Homo sapien
tgtgcaaatctgttcgctcgcaacc

SEQ ID NO: 124012 - DNA, 25 bp, Homo sapien
ttccgggttttgtgtcgaatctgcg

SEQ ID NO: 124013 - DNA, 25 bp, Homo sapien
ggcttgacgcacttctgtgcaaatc

SEQ ID NO: 124014 - DNA, 25 bp, Homo sapien
ccagagctgtcaagtggggaccttc

SEQ ID NO: 124015 - DNA, 25 bp, Homo sapien
agtacggcttctcagttcgcagctc

SEQ ID NO: 124016 - DNA, 25 bp, Homo sapien
ccaaggtcgtgttgcagtaggagta

SEQ ID NO: 124017 - DNA, 25 bp, Homo sapien
gcacgttccgatctggtccaaggtc

SEQ ID NO: 124018 - DNA, 25 bp, Homo sapien
acgccgttgaagtactcggggcacg

SEQ ID NO: 124019 - DNA, 25 bp, Homo sapien
tcacgggtcgtgttgtacttgacgc

SEQ ID NO: 124020 - DNA, 25 bp, Homo sapien
gctgggtccggaatcctctttactc

SEQ ID NO: 124021 - DNA, 25 bp, Homo sapien
ccgaggagaacaccgcagctctgct

SEQ ID NO: 124022 - DNA, 25 bp, Homo sapien
cggctccggaaatgccagggatgca

SEQ ID NO: 124023 - DNA, 25 bp, Homo sapien
ctgcttgctggaaccgtctaaaaca

SEQ ID NO: 124024 - DNA, 25 bp, Homo sapien
atgcagggagggcagaattgttttc

SEQ ID NO: 124025 - DNA, 25 bp, Homo sapien
ggccggatgccaagtgtaagtgtaa

SEQ ID NO: 124026 - DNA, 25 bp, Homo sapien
ttgcattttcctttcgcgggcgctg

SEQ ID NO: 124027 - DNA, 25 bp, Homo sapien
agctctgcgcaccaagtcgacgtga

SEQ ID NO: 124028 - DNA, 25 bp, Homo sapien
agtcgagatctgaaaccagctctgc

SEQ ID NO: 124029 - DNA, 25 bp, Homo sapien
cctgcgcgtcgcgtaaaaacgtgcc

SEQ ID NO: 124030 - DNA, 25 bp, Homo sapien
gcgcattgagagctgtgacctgtca

SEQ ID NO: 124031 - DNA, 25 bp, Homo sapien
gacgcggacctgaagcgcattgaga

SEQ ID NO: 124032 - DNA, 25 bp, Homo sapien
gtgctgtccgaggagacgccatccc

SEQ ID NO: 124033 - DNA, 25 bp, Homo sapien
caggtacctgtacttcaccaacatg

SEQ ID NO: 124034 - DNA, 25 bp, Homo sapien
tcaccaacatgcaggaccgggcagc

SEQ ID NO: 124035 - DNA, 25 bp, Homo sapien
gccaagatcgaacgcgcagccctgg

SEQ ID NO: 124036 - DNA, 25 bp, Homo sapien
tggccctggtggtggacaacacact

SEQ ID NO: 124037 - DNA, 25 bp, Homo sapien
acacactgggcaagctgttctgggt

SEQ ID NO: 124038 - DNA, 25 bp, Homo sapien
ttcctcagcagaaaggtaacggctc

SEQ ID NO: 124039 - DNA, 25 bp, Homo sapien
cctgaaggctttgcagcttctggga

SEQ ID NO: 124040 - DNA, 25 bp, Homo sapien
tcccactccgagacgcgagtttgcg

SEQ ID NO: 124041 - DNA, 25 bp, Homo sapien
atactgcgccggacagacccagttg

SEQ ID NO: 124042 - DNA, 25 bp, Homo sapien
tacctactgcctgctccagagatgc

SEQ ID NO: 124043 - DNA, 25 bp, Homo sapien
gcttccgcaaggcacggtttggacc

SEQ ID NO: 124044 - DNA, 25 bp, Homo sapien
caagcaatcctagcgcgggcgcaca

SEQ ID NO: 124045 - DNA, 25 bp, Homo sapien
gagccatggacagcctcttcgtgga

SEQ ID NO: 124046 - DNA, 25 bp, Homo sapien
ggggtcgacctagctatctcacgcc

SEQ ID NO: 124047 - DNA, 25 bp, Homo sapien
caggacggagccaagctggactgcc

SEQ ID NO: 124048 - DNA, 25 bp, Homo sapien
agagtgtcgtcttcgtttcccgtgg

SEQ ID NO: 124049 - DNA, 25 bp, Homo sapien
atccgggattgttcaaaagagtgtc

SEQ ID NO: 124050 - DNA, 25 bp, Homo sapien
taccgcaatccgcacggggtttgag

SEQ ID NO: 124051 - DNA, 25 bp, Homo sapien
cgcacctacgcggatcgggaaggca

SEQ ID NO: 124052 - DNA, 25 bp, Homo sapien
cctcctgatgcggagaagggagacc

SEQ ID NO: 124053 - DNA, 25 bp, Homo sapien
gccaggcaagcctcccagatctgaa

SEQ ID NO: 124054 - DNA, 25 bp, Homo sapien
cctagaggtcagtctgatccaggga

SEQ ID NO: 124055 - DNA, 25 bp, Homo sapien
atccagggattgtctcgaatccgcg

SEQ ID NO: 124056 - DNA, 25 bp, Homo sapien
agggattgtctcgaatccgcgcagc

SEQ ID NO: 124057 - DNA, 25 bp, Homo sapien
gataatgcggttgccaagtgccagg

SEQ ID NO: 124058 - DNA, 25 bp, Homo sapien
attgtctcgaatccgcgcagctctg

SEQ ID NO: 124059 - DNA, 25 bp, Homo sapien
ctctggacccgaaaggagaggctca

SEQ ID NO: 124060 - DNA, 25 bp, Homo sapien
gagaggctcagggagaggataatgc

SEQ ID NO: 124061 - DNA, 25 bp, Homo sapien
gaggataatgcggttgccaagtgcc

SEQ ID NO: 124062 - DNA, 25 bp, Homo sapien
gggagacgctgtcctttgcagaatg

SEQ ID NO: 124063 - DNA, 25 bp, Homo sapien
gcctcgcagcctcggctcaggaagt

SEQ ID NO: 124064 - DNA, 25 bp, Homo sapien
tcagctctcggctgcacttgggcaa

SEQ ID NO: 124065 - DNA, 25 bp, Homo sapien
cttgggcaagagatagctggagcta

SEQ ID NO: 124066 - DNA, 25 bp, Homo sapien
gccgcgtccctgcttgtggcacaag

SEQ ID NO: 124067 - DNA, 25 bp, Homo sapien
cctttcttgggcaggccaggtcagt

SEQ ID NO: 124068 - DNA, 25 bp, Homo sapien
ggcagcgttggccaggcctacccaa

SEQ ID NO: 124069 - DNA, 25 bp, Homo sapien
tttctgctgccctcatcggtctgcg

SEQ ID NO: 124070 - DNA, 25 bp, Homo sapien
tgagaaaagtcgtctgtcagcgccc

SEQ ID NO: 124071 - DNA, 25 bp, Homo sapien
ctccgacttagagcggactccgatc

SEQ ID NO: 124072 - DNA, 25 bp, Homo sapien
ctctgctgacaagcgagaaaactga

SEQ ID NO: 124073 - DNA, 25 bp, Homo sapien
cgatcagcgcgcagctaaagggttt

SEQ ID NO: 124074 - DNA, 25 bp, Homo sapien
tccagctccaagagaaagcacctcg

SEQ ID NO: 124075 - DNA, 25 bp, Homo sapien
agggattgggattggactccagctc

SEQ ID NO: 124076 - DNA, 25 bp, Homo sapien
aaccagccatggtcccgggctaatg

SEQ ID NO: 124077 - DNA, 25 bp, Homo sapien
gcacctcgggtctattcgtattctc

SEQ ID NO: 124078 - DNA, 25 bp, Homo sapien
atctccaagccgagttccagaggcg

SEQ ID NO: 124079 - DNA, 25 bp, Homo sapien
cctgcccgcttagaaaggaactctg

SEQ ID NO: 124080 - DNA, 25 bp, Homo sapien
aaggaactctgaccgccaccggaga

SEQ ID NO: 124081 - DNA, 25 bp, Homo sapien
tccgagaggggtggaaagttctcac

SEQ ID NO: 124082 - DNA, 25 bp, Homo sapien
ccatcgatgctgaaagtggcgctcc

SEQ ID NO: 124083 - DNA, 25 bp, Homo sapien
cgctccggcattttttgaagccctc

SEQ ID NO: 124084 - DNA, 25 bp, Homo sapien
cggggacccaatgtcaacagctaaa

SEQ ID NO: 124085 - DNA, 25 bp, Homo sapien
acgctactctctgtcagccgcggat

SEQ ID NO: 124086 - DNA, 25 bp, Homo sapien
gccgaaggcttactccctcctggtg

SEQ ID NO: 124087 - DNA, 25 bp, Homo sapien
actgcactacggctttgcgggaccg

SEQ ID NO: 124088 - DNA, 25 bp, Homo sapien
ggcaacgagcccgactgcactacgg

SEQ ID NO: 124089 - DNA, 25 bp, Homo sapien
tctccgacagcaacgggagcagccg

SEQ ID NO: 124090 - DNA, 25 bp, Homo sapien
agcgcgaatgggtctccgacagcaa

SEQ ID NO: 124091 - DNA, 25 bp, Homo sapien
tcttctcgatgtctcgccgcgggct

SEQ ID NO: 124092 - DNA, 25 bp, Homo sapien
gctgggacatactcgcctcacgctt

SEQ ID NO: 124093 - DNA, 25 bp, Homo sapien
tcggcagctcttctcgatgtctcgc

SEQ ID NO: 124094 - DNA, 25 bp, Homo sapien
ctgctgtcgcgaagacttggagctc

SEQ ID NO: 124095 - DNA, 25 bp, Homo sapien
ccacgttaaagagcaggtgcggcct

SEQ ID NO: 124096 - DNA, 25 bp, Homo sapien
ggccgagcgcacgatctagtcagct

SEQ ID NO: 124097 - DNA, 25 bp, Homo sapien
gcccaaacaggctcgaccaatctga

SEQ ID NO: 124098 - DNA, 25 bp, Homo sapien
cctgccttcattgatggtgggacga

SEQ ID NO: 124099 - DNA, 25 bp, Homo sapien
acggcgattacctaagggcagcagc

SEQ ID NO: 124100 - DNA, 25 bp, Homo sapien
cctgaatgtcagctccctgttcctg

SEQ ID NO: 124101 - DNA, 25 bp, Homo sapien
ggagctcagagtcgaaccgcatttg

SEQ ID NO: 124102 - DNA, 25 bp, Homo sapien
tgcacatcgtggtggtcggatttca

SEQ ID NO: 124103 - DNA, 25 bp, Homo sapien
ccctcatgtgctgtgctcgctgaca

SEQ ID NO: 124104 - DNA, 25 bp, Homo sapien
gggagctgctttgcctccaccgatc

SEQ ID NO: 124105 - DNA, 25 bp, Homo sapien
acccgctgcccttggcggtcgaagt

SEQ ID NO: 124106 - DNA, 25 bp, Homo sapien
tcggatttcaccacaagaagggctg

SEQ ID NO: 124107 - DNA, 25 bp, Homo sapien
cctgcttctgtgtgctcagctcgcg

SEQ ID NO: 124108 - DNA, 25 bp, Homo sapien
aagtccgcggctttccgcacacggt

SEQ ID NO: 124109 - DNA, 25 bp, Homo sapien
tgtcaggtgacagcccggaagctgc

SEQ ID NO: 124110 - DNA, 25 bp, Homo sapien
gctttcccgagtgcgatgaccagag

SEQ ID NO: 124111 - DNA, 25 bp, Homo sapien
ccgctcagacgaggcggactgtgac

SEQ ID NO: 124112 - DNA, 25 bp, Homo sapien
gacggctttcccgagtgcgatgacc

SEQ ID NO: 124113 - DNA, 25 bp, Homo sapien
cagactgtcaggaccgctcagacga

SEQ ID NO: 124114 - DNA, 25 bp, Homo sapien
aggcagactgtcaggaccgctcaga

SEQ ID NO: 124115 - DNA, 25 bp, Homo sapien
ggtcagtgtgtggacctgcgcctgc

SEQ ID NO: 124116 - DNA, 25 bp, Homo sapien
ctgtgacggctttcccgagtgcgat

SEQ ID NO: 124117 - DNA, 25 bp, Homo sapien
tcccgagtgcgatgaccagagcgac

SEQ ID NO: 124118 - DNA, 25 bp, Homo sapien
aacccggcacgtaacacctgcggtg

SEQ ID NO: 124119 - DNA, 25 bp, Homo sapien
acacctgcggtgtcgctgccgcgta

SEQ ID NO: 124120 - DNA, 25 bp, Homo sapien
gtaacacctgcggtgtcgctgccgc

SEQ ID NO: 124121 - DNA, 25 bp, Homo sapien
cacgtaacacctgcggtgtcgctgc

SEQ ID NO: 124122 - DNA, 25 bp, Homo sapien
acccggcacgtaacacctgcggtgt

SEQ ID NO: 124123 - DNA, 25 bp, Homo sapien
agaaacccggcacgtaacacctgcg

SEQ ID NO: 124124 - DNA, 25 bp, Homo sapien
ggagtggccaatgggaccgggacca

SEQ ID NO: 124125 - DNA, 25 bp, Homo sapien
cggcacgtaacacctgcggtgtcgc

SEQ ID NO: 124126 - DNA, 25 bp, Homo sapien
ccaccttgcggcagctgcacgtaca

SEQ ID NO: 124127 - DNA, 25 bp, Homo sapien
acacgtgcactctccaccttgcggc

SEQ ID NO: 124128 - DNA, 25 bp, Homo sapien
cttataatccctggcggagctgggt

SEQ ID NO: 124129 - DNA, 25 bp, Homo sapien
gttttcttataatccctggcggagc

SEQ ID NO: 124130 - DNA, 25 bp, Homo sapien
acttgttttcttataatccctggcg

SEQ ID NO: 124131 - DNA, 25 bp, Homo sapien
tagcggctttgagcttactacttgt

SEQ ID NO: 124132 - DNA, 25 bp, Homo sapien
gattgtagcggctttgagcttacta

SEQ ID NO: 124133 - DNA, 25 bp, Homo sapien
acacgttaatttatggtatgaggtc

SEQ ID NO: 124134 - DNA, 25 bp, Homo sapien
gcaccagcggcagttttgcagtttc

SEQ ID NO: 124135 - DNA, 25 bp, Homo sapien
tgccaccggaaagccaaaacaattg

SEQ ID NO: 124136 - DNA, 25 bp, Homo sapien
ccggaaacgcccagctagcggcgta

SEQ ID NO: 124137 - DNA, 25 bp, Homo sapien
aagcgtctcgggtttgaaagatgcc

SEQ ID NO: 124138 - DNA, 25 bp, Homo sapien
tcgcttggtccgtccagcgcggaaa

SEQ ID NO: 124139 - DNA, 25 bp, Homo sapien
gccaaaacaattggggccgcgcagg

SEQ ID NO: 124140 - DNA, 25 bp, Homo sapien
aacgcgcgcgcaatggaccgctggc

SEQ ID NO: 124141 - DNA, 25 bp, Homo sapien
cgcgaaagaggaaacggaaagagca

SEQ ID NO: 124142 - DNA, 25 bp, Homo sapien
actagaagtcccgtcgcaggcacta

SEQ ID NO: 124143 - DNA, 25 bp, Homo sapien
cgtgctcggttgaacttgcctgttc

SEQ ID NO: 124144 - DNA, 25 bp, Homo sapien
ggtttctccatgtcgcagtggccca

SEQ ID NO: 124145 - DNA, 25 bp, Homo sapien
ttcggtccacaaatgccgagcaagc

SEQ ID NO: 124146 - DNA, 25 bp, Homo sapien
cccttctccgtagcagaggatgaaa

SEQ ID NO: 124147 - DNA, 25 bp, Homo sapien
ccgagcaagcgccaataactcttgg

SEQ ID NO: 124148 - DNA, 25 bp, Homo sapien
ccagacggctgctcgagactcacaa

SEQ ID NO: 124149 - DNA, 25 bp, Homo sapien
gcaggcactaggttcctcacaggcc

SEQ ID NO: 124150 - DNA, 25 bp, Homo sapien
gtagaaggagggtactttggactca

SEQ ID NO: 124151 - DNA, 25 bp, Homo sapien
agacacaggcggcacctcggggtct

SEQ ID NO: 124152 - DNA, 25 bp, Homo sapien
cagcacttgaccatggccctgacaa

SEQ ID NO: 124153 - DNA, 25 bp, Homo sapien
gcacttgaccatggccctgacaagg

SEQ ID NO: 124154 - DNA, 25 bp, Homo sapien
tttgtactcactggcagtcggaggg

SEQ ID NO: 124155 - DNA, 25 bp, Homo sapien
tcaaacctggctctcgcggcgtcgt

SEQ ID NO: 124156 - DNA, 25 bp, Homo sapien
aaacctggctctcgcggcgtcgttc

SEQ ID NO: 124157 - DNA, 25 bp, Homo sapien
ccctttgtactcactggcagtcgga

SEQ ID NO: 124158 - DNA, 25 bp, Homo sapien
gacccggtccacgtttgcaaacgca

SEQ ID NO: 124159 - DNA, 25 bp, Homo sapien
acttcgtgcgctaccactacgtggg

SEQ ID NO: 124160 - DNA, 25 bp, Homo sapien
cggccagaagttcgactccaggtac

SEQ ID NO: 124161 - DNA, 25 bp, Homo sapien
gatcacagtgtctcgctcggggaca

SEQ ID NO: 124162 - DNA, 25 bp, Homo sapien
gccaaagccttgtccggagatcaca

SEQ ID NO: 124163 - DNA, 25 bp, Homo sapien
ttctcttccgactttgggccaaagc

SEQ ID NO: 124164 - DNA, 25 bp, Homo sapien
ggcagtacgcgcttttctcttccga

SEQ ID NO: 124165 - DNA, 25 bp, Homo sapien
acgcacattcccaatgccgggcggg

SEQ ID NO: 124166 - DNA, 25 bp, Homo sapien
tcagggtctcacgagctgctgtcag

SEQ ID NO: 124167 - DNA, 25 bp, Homo sapien
ccgagctagcgagatcccagcctga

SEQ ID NO: 124168 - DNA, 25 bp, Homo sapien
cccgtcttcctcttcaaggtgaata

SEQ ID NO: 124169 - DNA, 25 bp, Homo sapien
cgggatcccagagcatcacggacga

SEQ ID NO: 124170 - DNA, 25 bp, Homo sapien
gcagggcagagtattgcggtaatta

SEQ ID NO: 124171 - DNA, 25 bp, Homo sapien
gaaatctaattccaactgcggcccg

SEQ ID NO: 124172 - DNA, 25 bp, Homo sapien
ctgcggcccgctaagaagtcggtct

SEQ ID NO: 124173 - DNA, 25 bp, Homo sapien
gccctcatgcgcgtccaagcaggaa

SEQ ID NO: 124174 - DNA, 25 bp, Homo sapien
gcggcagccaagagagcacttcctc

SEQ ID NO: 124175 - DNA, 25 bp, Homo sapien
cgccaggaggatggacttcaagtcc

SEQ ID NO: 124176 - DNA, 25 bp, Homo sapien
gacttcaagtccttgaccgcggcgc

SEQ ID NO: 124177 - DNA, 25 bp, Homo sapien
gcccgacatcggtcgcccgcaccag

SEQ ID NO: 124178 - DNA, 25 bp, Homo sapien
ctggcttcagaagactggccgcgcg

SEQ ID NO: 124179 - DNA, 25 bp, Homo sapien
ttctgctcccgacgtcgctgcagct

SEQ ID NO: 124180 - DNA, 25 bp, Homo sapien
cgcccaggccgggacgacatgtcag

SEQ ID NO: 124181 - DNA, 25 bp, Homo sapien
agcggcagttggctccctgaacgcc

SEQ ID NO: 124182 - DNA, 25 bp, Homo sapien
aaacaccgcgattgggactctcaga

SEQ ID NO: 124183 - DNA, 25 bp, Homo sapien
ggactctcagaagcgcaggatccca

SEQ ID NO: 124184 - DNA, 25 bp, Homo sapien
cttaaggaactgctgccaggacagg

SEQ ID NO: 124185 - DNA, 25 bp, Homo sapien
acagggcagaggattgcagtaatta

SEQ ID NO: 124186 - DNA, 25 bp, Homo sapien
ggattgcagtaattatcactctctg

SEQ ID NO: 124187 - DNA, 25 bp, Homo sapien
aggaccaggccgtggttcactcgag

SEQ ID NO: 124188 - DNA, 25 bp, Homo sapien
acggggccctcatgagtgtcccggc

SEQ ID NO: 124189 - DNA, 25 bp, Homo sapien
agcaccatggacaagccagtgacgc

SEQ ID NO: 124190 - DNA, 25 bp, Homo sapien
agagagttcccgctgcagctatcgc

SEQ ID NO: 124191 - DNA, 25 bp, Homo sapien
ggtgtgtcgctccttcccaaaggtg

SEQ ID NO: 124192 - DNA, 25 bp, Homo sapien
ggacgcgcagacagctaagcacaga

SEQ ID NO: 124193 - DNA, 25 bp, Homo sapien
gtcatccctagtgtcaggacgcgca

SEQ ID NO: 124194 - DNA, 25 bp, Homo sapien
tgtgtttcaacttcggtcatcccta

SEQ ID NO: 124195 - DNA, 25 bp, Homo sapien
cgtttttaaatcgaccttgtgtgtg

SEQ ID NO: 124196 - DNA, 25 bp, Homo sapien
aggggctgactgctaagccactgca

SEQ ID NO: 124197 - DNA, 25 bp, Homo sapien
cggagcgactgttcattttttaagg

SEQ ID NO: 124198 - DNA, 25 bp, Homo sapien
cttcgtcatgggtggtgtctatttt

SEQ ID NO: 124199 - DNA, 25 bp, Homo sapien
ccgcacgagtatgtcagcgggaccc

SEQ ID NO: 124200 - DNA, 25 bp, Homo sapien
ggcccttcccgcacgagtatgtcag

SEQ ID NO: 124201 - DNA, 25 bp, Homo sapien
tgtctattttgtgtgccagcgcgtg

SEQ ID NO: 124202 - DNA, 25 bp, Homo sapien
acagcagtgccatcgggcccgtcat

SEQ ID NO: 124203 - DNA, 25 bp, Homo sapien
atcctctctctcttcgtcatgggtg

SEQ ID NO: 124204 - DNA, 25 bp, Homo sapien
gggcccgtcattggcatcatcctct

SEQ ID NO: 124205 - DNA, 25 bp, Homo sapien
ccagcgcgtggtgtgccagcgctat

SEQ ID NO: 124206 - DNA, 25 bp, Homo sapien
ccttctcgtggaccaagtcggtgga

SEQ ID NO: 124207 - DNA, 25 bp, Homo sapien
cctcgcccttccaggtgctggtgaa

SEQ ID NO: 124208 - DNA, 25 bp, Homo sapien
agcacctcaccgtgcgctggaacgg

SEQ ID NO: 124209 - DNA, 25 bp, Homo sapien
cgttttgacaaaagactgctcctcc

SEQ ID NO: 124210 - DNA, 25 bp, Homo sapien
ggggacgtgtcagtacgttttgaca

SEQ ID NO: 124211 - DNA, 25 bp, Homo sapien
catttaactttcaggggacgtgtca

SEQ ID NO: 124212 - DNA, 25 bp, Homo sapien
ctacaacacttttgacggtcggaca

SEQ ID NO: 124213 - DNA, 25 bp, Homo sapien
cgtttgcacggtgtttggagatccc

SEQ ID NO: 124214 - DNA, 25 bp, Homo sapien
gagaaggtaagaatgtcccagagaa

SEQ ID NO: 124215 - DNA, 25 bp, Homo sapien
gggccagcgcctcaaagttccgcgt

SEQ ID NO: 124216 - DNA, 25 bp, Homo sapien
cggcgctagggctgctcacctaaca

SEQ ID NO: 124217 - DNA, 25 bp, Homo sapien
tcacctaacaggagcgtggtccagg

SEQ ID NO: 124218 - DNA, 25 bp, Homo sapien
gcgcctgcaggaccatcttggcata

SEQ ID NO: 124219 - DNA, 25 bp, Homo sapien
atcttggcatagtcgcgcccgctcg

SEQ ID NO: 124220 - DNA, 25 bp, Homo sapien
ttgtcacggcgaccgcggaacgccg

SEQ ID NO: 124221 - DNA, 25 bp, Homo sapien
ctgcaaactggctggtccggctggc

SEQ ID NO: 124222 - DNA, 25 bp, Homo sapien
ttaggaaagtctctacgatcgctga

SEQ ID NO: 124223 - DNA, 25 bp, Homo sapien
ggcattaggaaagtctctacgatcg

SEQ ID NO: 124224 - DNA, 25 bp, Homo sapien
gcattaggaaagtctctacgatcgc

SEQ ID NO: 124225 - DNA, 25 bp, Homo sapien
attaggaaagtctctacgatcgctg

SEQ ID NO: 124226 - DNA, 25 bp, Homo sapien
taggaaagtctctacgatcgctgag

SEQ ID NO: 124227 - DNA, 25 bp, Homo sapien
aggaaagtctctacgatcgctgagg

SEQ ID NO: 124228 - DNA, 25 bp, Homo sapien
tagccgttgacgagcggacctcccg

SEQ ID NO: 124229 - DNA, 25 bp, Homo sapien
cattaggaaagtctctacgatcgct

SEQ ID NO: 124230 - DNA, 25 bp, Homo sapien
ggtctgatcccagagcctcaggttg

SEQ ID NO: 124231 - DNA, 25 bp, Homo sapien
agatctcagctgaaagaaatgactg

SEQ ID NO: 124232 - DNA, 25 bp, Homo sapien
ctcagctgaaagaaatgactgtagg

SEQ ID NO: 124233 - DNA, 25 bp, Homo sapien
gctgaaagaaatgactgtaggaagt

SEQ ID NO: 124234 - DNA, 25 bp, Homo sapien
tgggtctgatcccagagcctcaggt

SEQ ID NO: 124235 - DNA, 25 bp, Homo sapien
tcccggagctgcgccagggaattac

SEQ ID NO: 124236 - DNA, 25 bp, Homo sapien
tctgatcccagagcctcaggttgac

SEQ ID NO: 124237 - DNA, 25 bp, Homo sapien
ggtgggtctgatcccagagcctcag

SEQ ID NO: 124238 - DNA, 25 bp, Homo sapien
ccagggactccagaagtgtcagctc

SEQ ID NO: 124239 - DNA, 25 bp, Homo sapien
actgcacaaagtcctggggtcctgg

SEQ ID NO: 124240 - DNA, 25 bp, Homo sapien
gctgccctgcgccttaatttgctgg

SEQ ID NO: 124241 - DNA, 25 bp, Homo sapien
cgctcagtagaatccggcgcctctg

SEQ ID NO: 124242 - DNA, 25 bp, Homo sapien
cccagttggggaagctatgaccaga

SEQ ID NO: 124243 - DNA, 25 bp, Homo sapien
gcctcgggagttctcgctttttcca

SEQ ID NO: 124244 - DNA, 25 bp, Homo sapien
gccaggtccatactcggggcagatc

SEQ ID NO: 124245 - DNA, 25 bp, Homo sapien
gcccgaaggcggaaacgagcatcaa

SEQ ID NO: 124246 - DNA, 25 bp, Homo sapien
cgcttctcagcacaagggcatctgt

SEQ ID NO: 124247 - DNA, 25 bp, Homo sapien
acatggccggagattcctgtccaca

SEQ ID NO: 124248 - DNA, 25 bp, Homo sapien
gcttcggtgcctttggattcctaaa

SEQ ID NO: 124249 - DNA, 25 bp, Homo sapien
gggcatctgtctactcccgaacatg

SEQ ID NO: 124250 - DNA, 25 bp, Homo sapien
ttagtttatcgagccaaagtggtcc

SEQ ID NO: 124251 - DNA, 25 bp, Homo sapien
tcgaggagcccttacccaagtcttg

SEQ ID NO: 124252 - DNA, 25 bp, Homo sapien
gtctcgcccagctatagagccgata

SEQ ID NO: 124253 - DNA, 25 bp, Homo sapien
gcccagggcacatgtagtttcagca

SEQ ID NO: 124254 - DNA, 25 bp, Homo sapien
cctttaggttttctcctggcgcatg

SEQ ID NO: 124255 - DNA, 25 bp, Homo sapien
gttgtgcaataaatattaatcgtcc

SEQ ID NO: 124256 - DNA, 25 bp, Homo sapien
atatgtactcgggaacgttcgtcct

SEQ ID NO: 124257 - DNA, 25 bp, Homo sapien
ccgccaatcatttcggggcttattt

SEQ ID NO: 124258 - DNA, 25 bp, Homo sapien
cccactgatggtggcggtcggtcct

SEQ ID NO: 124259 - DNA, 25 bp, Homo sapien
cggtcctgatcgtcctgatggcagc

SEQ ID NO: 124260 - DNA, 25 bp, Homo sapien
tgatggcagcgaccaggctggactc

SEQ ID NO: 124261 - DNA, 25 bp, Homo sapien
ttaatcgtccttatatgtactcggg

SEQ ID NO: 124262 - DNA, 25 bp, Homo sapien
gtgccagagtcagtggtgttggaga

SEQ ID NO: 124263 - DNA, 25 bp, Homo sapien
acccatgcaccaaggctgcctgtta

SEQ ID NO: 124264 - DNA, 25 bp, Homo sapien
accaaggctgcctgttagaagcaaa

SEQ ID NO: 124265 - DNA, 25 bp, Homo sapien
ggctgcctgttagaagcaaatgagc

SEQ ID NO: 124266 - DNA, 25 bp, Homo sapien
cctgttagaagcaaatgagctactc

SEQ ID NO: 124267 - DNA, 25 bp, Homo sapien
gcaaatgagctactcccaaccaggg

SEQ ID NO: 124268 - DNA, 25 bp, Homo sapien
tgagctactcccaaccaggggcagg

SEQ ID NO: 124269 - DNA, 25 bp, Homo sapien
gtgtgacccatgcaccaaggctgcc

SEQ ID NO: 124270 - DNA, 25 bp, Homo sapien
caagccaacgctatcagggtccctg

SEQ ID NO: 124271 - DNA, 25 bp, Homo sapien
caggagactactgcgcggtacgcca

SEQ ID NO: 124272 - DNA, 25 bp, Homo sapien
agcgcgtcttctatgatgccaggtg

SEQ ID NO: 124273 - DNA, 25 bp, Homo sapien
tctgcaatggagagacgccgacacc

SEQ ID NO: 124274 - DNA, 25 bp, Homo sapien
cggaggcagaaccaaaacctttgct

SEQ ID NO: 124275 - DNA, 25 bp, Homo sapien
cggtacgccaggatccagaagtgga

SEQ ID NO: 124276 - DNA, 25 bp, Homo sapien
atccgtgggttctctatcccgctta

SEQ ID NO: 124277 - DNA, 25 bp, Homo sapien
cggtcccagacctctaccttggaga

SEQ ID NO: 124278 - DNA, 25 bp, Homo sapien
tgtgaagcttgttcgcgcactctcg

SEQ ID NO: 124279 - DNA, 25 bp, Homo sapien
aggccatttgtgtgaagcttgttcg

SEQ ID NO: 124280 - DNA, 25 bp, Homo sapien
cccaactctgagcaggcaaggttaa

SEQ ID NO: 124281 - DNA, 25 bp, Homo sapien
ctgctcctgctctcggggtagccag

SEQ ID NO: 124282 - DNA, 25 bp, Homo sapien
ccaatcagcgtatggctcagtcccg

SEQ ID NO: 124283 - DNA, 25 bp, Homo sapien
gctggcaactgacgcgcgcgatgtt

SEQ ID NO: 124284 - DNA, 25 bp, Homo sapien
cggctaatcacatcacgggcggagg

SEQ ID NO: 124285 - DNA, 25 bp, Homo sapien
gcactctcgcttttcctggccgaat

SEQ ID NO: 124286 - DNA, 25 bp, Homo sapien
tcgaacttcacgctaaggactgctc

SEQ ID NO: 124287 - DNA, 25 bp, Homo sapien
gatcatctgggcactggcgccacct

SEQ ID NO: 124288 - DNA, 25 bp, Homo sapien
acgcgccgccagtgcggatcatctg

SEQ ID NO: 124289 - DNA, 25 bp, Homo sapien
tgatccggactcagcccttagcgct

SEQ ID NO: 124290 - DNA, 25 bp, Homo sapien
ctgctcgttttactgatccggactc

SEQ ID NO: 124291 - DNA, 25 bp, Homo sapien
cgcgacagacacctatcgaacttca

SEQ ID NO: 124292 - DNA, 25 bp, Homo sapien
ggacagaccgaaggcagagaccacc

SEQ ID NO: 124293 - DNA, 25 bp, Homo sapien
aatggcccttttaccgactcgcgcg

SEQ ID NO: 124294 - DNA, 25 bp, Homo sapien
tgtgacagcgactacagcgccagcc

SEQ ID NO: 124295 - DNA, 25 bp, Homo sapien
accgacgtgtgtgacagcgactaca

SEQ ID NO: 124296 - DNA, 25 bp, Homo sapien
acagccagtacctgtcggcggagga

SEQ ID NO: 124297 - DNA, 25 bp, Homo sapien
cgactacagcgccagccgctggaag

SEQ ID NO: 124298 - DNA, 25 bp, Homo sapien
gcaagtactacctggatttgaactc

SEQ ID NO: 124299 - DNA, 25 bp, Homo sapien
ctggaaggccagcaagtactacctg

SEQ ID NO: 124300 - DNA, 25 bp, Homo sapien
gccaccgagaggagctacttccatc

SEQ ID NO: 124301 - DNA, 25 bp, Homo sapien
ccctgcagcaccgacgtgtgtgaca

SEQ ID NO: 124302 - DNA, 25 bp, Homo sapien
cgcgccggttttgttgttattgcga

SEQ ID NO: 124303 - DNA, 25 bp, Homo sapien
ccctcagtctggacagcgcagggtg

SEQ ID NO: 124304 - DNA, 25 bp, Homo sapien
cctttaagccggaacaggcagggcg

SEQ ID NO: 124305 - DNA, 25 bp, Homo sapien
gcccaggcgactacaggtagcagga

SEQ ID NO: 124306 - DNA, 25 bp, Homo sapien
tgcactggaggatacgaagcccatt

SEQ ID NO: 124307 - DNA, 25 bp, Homo sapien
cgtgtccaagtcagttacaagtgca

SEQ ID NO: 124308 - DNA, 25 bp, Homo sapien
gtgagttcttagtattccgtgtcca

SEQ ID NO: 124309 - DNA, 25 bp, Homo sapien
attgccggtaccaaggatggactga

SEQ ID NO: 124310 - DNA, 25 bp, Homo sapien
atctcgcgagatggaagccagcctc

SEQ ID NO: 124311 - DNA, 25 bp, Homo sapien
ctagtccttttcagcgttcccagga

SEQ ID NO: 124312 - DNA, 25 bp, Homo sapien
gcggcggtgacagtttgaattgaac

SEQ ID NO: 124313 - DNA, 25 bp, Homo sapien
ggagcgtcaacagcagcaccatggg

SEQ ID NO: 124314 - DNA, 25 bp, Homo sapien
tccatgacctcagtggtgcgaaacc

SEQ ID NO: 124315 - DNA, 25 bp, Homo sapien
cgttgctgacgccaatgaagtcatg

SEQ ID NO: 124316 - DNA, 25 bp, Homo sapien
cgcggttaaccttagaagcagtgtt

SEQ ID NO: 124317 - DNA, 25 bp, Homo sapien
cgcaaagaggcctgagtatccatga

SEQ ID NO: 124318 - DNA, 25 bp, Homo sapien
tcaaggaagggctctacggctccca

SEQ ID NO: 124319 - DNA, 25 bp, Homo sapien
tacgctgaccgtagcttggacgccg

SEQ ID NO: 124320 - DNA, 25 bp, Homo sapien
ggttgtgctccttccatggtccaca

SEQ ID NO: 124321 - DNA, 25 bp, Homo sapien
gtacaacagcttcgaggtgtgcatc

SEQ ID NO: 124322 - DNA, 25 bp, Homo sapien
gctgtagggcttcatccacttcctg

SEQ ID NO: 124323 - DNA, 25 bp, Homo sapien
agtacttgggcgttagcgtcctcct

SEQ ID NO: 124324 - DNA, 25 bp, Homo sapien
ctaagacttccgtgatggtgcgaac

SEQ ID NO: 124325 - DNA, 25 bp, Homo sapien
gtaggcacccatggcccttacgctg

SEQ ID NO: 124326 - DNA, 25 bp, Homo sapien
tgaggtccaggattctatatgttta

SEQ ID NO: 124327 - DNA, 25 bp, Homo sapien
atcggagtacttcactggcatcttt

SEQ ID NO: 124328 - DNA, 25 bp, Homo sapien
ccactgcttacaggaatcggagtac

SEQ ID NO: 124329 - DNA, 25 bp, Homo sapien
gaagaccagtgtctgagaaccactg

SEQ ID NO: 124330 - DNA, 25 bp, Homo sapien
tgtttaacaaacatcccaggtgatt

SEQ ID NO: 124331 - DNA, 25 bp, Homo sapien
tctaattcagtacatctgagtgagg

SEQ ID NO: 124332 - DNA, 25 bp, Homo sapien
ccttaacacccagatattctaattc

SEQ ID NO: 124333 - DNA, 25 bp, Homo sapien
tcccaggtgatttgaatgaagacca

SEQ ID NO: 124334 - DNA, 25 bp, Homo sapien
acctccttgcgggtcgcgaggagtg

SEQ ID NO: 124335 - DNA, 25 bp, Homo sapien
gcgcctgtgggtcccttctccgtgg

SEQ ID NO: 124336 - DNA, 25 bp, Homo sapien
cgctggccacctccgggtggaccct

SEQ ID NO: 124337 - DNA, 25 bp, Homo sapien
ggcctctggtctcttagggtcgccg

SEQ ID NO: 124338 - DNA, 25 bp, Homo sapien
caccctccgagggtcagcagcggcc

SEQ ID NO: 124339 - DNA, 25 bp, Homo sapien
aaggtggcagcacctccttgcgggt

SEQ ID NO: 124340 - DNA, 25 bp, Homo sapien
ttttggagcgcgaccctgcgaccca

SEQ ID NO: 124341 - DNA, 25 bp, Homo sapien
gccgttgccacagaaggtggcagca

SEQ ID NO: 124342 - DNA, 25 bp, Homo sapien
ctctgggagagcgatgctaagtttc

SEQ ID NO: 124343 - DNA, 25 bp, Homo sapien
actttggctttgacaccgactgcga

SEQ ID NO: 124344 - DNA, 25 bp, Homo sapien
agccctgcggcttctattcactctg

SEQ ID NO: 124345 - DNA, 25 bp, Homo sapien
gtttctcccatagaaagagccggga

SEQ ID NO: 124346 - DNA, 25 bp, Homo sapien
ggcttccagggcctgaccagtgacc

SEQ ID NO: 124347 - DNA, 25 bp, Homo sapien
gcacggacttcccaggttgcaggta

SEQ ID NO: 124348 - DNA, 25 bp, Homo sapien
tctggttcgttctccaccctcttga

SEQ ID NO: 124349 - DNA, 25 bp, Homo sapien
accgaagcggcgtagtcggcttcca

SEQ ID NO: 124350 - DNA, 25 bp, Homo sapien
cggtgcccagcagcgcttagaacct

SEQ ID NO: 124351 - DNA, 25 bp, Homo sapien
actgactgtgagcagcgcttccacc

SEQ ID NO: 124352 - DNA, 25 bp, Homo sapien
cgaagacgtaccgacactgactgtg

SEQ ID NO: 124353 - DNA, 25 bp, Homo sapien
ctctccgctacctggagcaggataa

SEQ ID NO: 124354 - DNA, 25 bp, Homo sapien
ggcactcacccgtcacgcgaatgga

SEQ ID NO: 124355 - DNA, 25 bp, Homo sapien
ccagccggtggctaccattacctga

SEQ ID NO: 124356 - DNA, 25 bp, Homo sapien
tagctactggaaggtacacacggcg

SEQ ID NO: 124357 - DNA, 25 bp, Homo sapien
ttagaacctgccaccgtgacgtagc

SEQ ID NO: 124358 - DNA, 25 bp, Homo sapien
gaacctcggatttgggggtcatgcc

SEQ ID NO: 124359 - DNA, 25 bp, Homo sapien
cgtgagaaccagcaggctgaacctc

SEQ ID NO: 124360 - DNA, 25 bp, Homo sapien
tgcgtgagaaccagcaggctgaacc

SEQ ID NO: 124361 - DNA, 25 bp, Homo sapien
gtgcgtgagaaccagcaggctgaac

SEQ ID NO: 124362 - DNA, 25 bp, Homo sapien
cggccggggatggtgcgtgagaacc

SEQ ID NO: 124363 - DNA, 25 bp, Homo sapien
agaaccagcaggctgaacctcggat

SEQ ID NO: 124364 - DNA, 25 bp, Homo sapien
tgagaaccagcaggctgaacctcgg

SEQ ID NO: 124365 - DNA, 25 bp, Homo sapien
gtgagaaccagcaggctgaacctcg

SEQ ID NO: 124366 - DNA, 25 bp, Homo sapien
cgcctcagactcctggttttttcca

SEQ ID NO: 124367 - DNA, 25 bp, Homo sapien
cttcctctgtcaacctctgggcgaa

SEQ ID NO: 124368 - DNA, 25 bp, Homo sapien
gcggctcggcgctgaaattcaaatt

SEQ ID NO: 124369 - DNA, 25 bp, Homo sapien
ttcaaatttgaacggctgcagaggc

SEQ ID NO: 124370 - DNA, 25 bp, Homo sapien
ccgagtccgtcactggaagccgaga

SEQ ID NO: 124371 - DNA, 25 bp, Homo sapien
gaaccaccgtttccatcgtctcgta

SEQ ID NO: 124372 - DNA, 25 bp, Homo sapien
cacactgagctgagactcacttttc

SEQ ID NO: 124373 - DNA, 25 bp, Homo sapien
atcgtctcgtagtccgacgcctggg

SEQ ID NO: 124374 - DNA, 25 bp, Homo sapien
acacgcacttacactctgggtcggc

SEQ ID NO: 124375 - DNA, 25 bp, Homo sapien
ggcgacccgccaccattgaagggga

SEQ ID NO: 124376 - DNA, 25 bp, Homo sapien
ttcccggcgatcagagctccggcga

SEQ ID NO: 124377 - DNA, 25 bp, Homo sapien
ctttacgaacctgcttggggtcgca

SEQ ID NO: 124378 - DNA, 25 bp, Homo sapien
ccgcagaccctggtcgaaatgtctc

SEQ ID NO: 124379 - DNA, 25 bp, Homo sapien
gcagccgcttctctagctctatagg

SEQ ID NO: 124380 - DNA, 25 bp, Homo sapien
gagaagacgccgagtctgagccgca

SEQ ID NO: 124381 - DNA, 25 bp, Homo sapien
ctccgaagccgagatttccacgaag

SEQ ID NO: 124382 - DNA, 25 bp, Homo sapien
actttgtgcctcgttgacgttcgcg

SEQ ID NO: 124383 - DNA, 25 bp, Homo sapien
gcctgcttgatacgtccgccatttt

SEQ ID NO: 124384 - DNA, 25 bp, Homo sapien
gtttcccgcctgagcgcaactagcg

SEQ ID NO: 124385 - DNA, 25 bp, Homo sapien
ccgctaggcgatccaataggtagta

SEQ ID NO: 124386 - DNA, 25 bp, Homo sapien
ttgcgggccaatcggaatgtagtca

SEQ ID NO: 124387 - DNA, 25 bp, Homo sapien
ctcgcgcttgactgacgaggcttgc

SEQ ID NO: 124388 - DNA, 25 bp, Homo sapien
cggatccgtcaagtccatgggaaaa

SEQ ID NO: 124389 - DNA, 25 bp, Homo sapien
ggtcctagaggttccggatccgtca

SEQ ID NO: 124390 - DNA, 25 bp, Homo sapien
gcacaccgacttgcacggcttgata

SEQ ID NO: 124391 - DNA, 25 bp, Homo sapien
gcccagttctcgattggcagccaca

SEQ ID NO: 124392 - DNA, 25 bp, Homo sapien
ggccagctgtggttgtacatcttca

SEQ ID NO: 124393 - DNA, 25 bp, Homo sapien
acgatggcttcaggcgagatgcaca

SEQ ID NO: 124394 - DNA, 25 bp, Homo sapien
acatcttcatgaggggctcgcagtc

SEQ ID NO: 124395 - DNA, 25 bp, Homo sapien
ttcgctgtcccttcgccgaggaaga

SEQ ID NO: 124396 - DNA, 25 bp, Homo sapien
agctcctcgtactgctcgatggcca

SEQ ID NO: 124397 - DNA, 25 bp, Homo sapien
cggccattgcgggaccctatttatc

SEQ ID NO: 124398 - DNA, 25 bp, Homo sapien
ccaccgaagggacaggaagcacttt

SEQ ID NO: 124399 - DNA, 25 bp, Homo sapien
ctcgcgcgtccggatctcaaaagcg

SEQ ID NO: 124400 - DNA, 25 bp, Homo sapien
gggcgccaggttatgtaccagcaaa

SEQ ID NO: 124401 - DNA, 25 bp, Homo sapien
taccagcaaagtagcgggcgcaaca

SEQ ID NO: 124402 - DNA, 25 bp, Homo sapien
tgcaagaggtacaggtcatcggccc

SEQ ID NO: 124403 - DNA, 25 bp, Homo sapien
gaggcctgcgccctgtaactctttc

SEQ ID NO: 124404 - DNA, 25 bp, Homo sapien
ctcccagagagatctttcgcgagga

SEQ ID NO: 124405 - DNA, 25 bp, Homo sapien
gggactcagtaacacccagcgaggc

SEQ ID NO: 124406 - DNA, 25 bp, Homo sapien
tccgtgtttcaaagctggatgccca

SEQ ID NO: 124407 - DNA, 25 bp, Homo sapien
tggatgcccagatttcccacccatt

SEQ ID NO: 124408 - DNA, 25 bp, Homo sapien
tgcgggaaagtccaaccagctccgt

SEQ ID NO: 124409 - DNA, 25 bp, Homo sapien
cgggcgcttgttaaaccgtgcgatg

SEQ ID NO: 124410 - DNA, 25 bp, Homo sapien
ttcccgcgtcgtttactggtcagta

SEQ ID NO: 124411 - DNA, 25 bp, Homo sapien
ctttggtccctcgagcgagatgcga

SEQ ID NO: 124412 - DNA, 25 bp, Homo sapien
cctctatggaggcactcaggaacca

SEQ ID NO: 124413 - DNA, 25 bp, Homo sapien
gacatgtcatctggccaataggttg

SEQ ID NO: 124414 - DNA, 25 bp, Homo sapien
agcctcatggcttagatggcgtcca

SEQ ID NO: 124415 - DNA, 25 bp, Homo sapien
cggcagttcctggactgttcgacca

SEQ ID NO: 124416 - DNA, 25 bp, Homo sapien
tgcgcctacgagatccggcagttcc

SEQ ID NO: 124417 - DNA, 25 bp, Homo sapien
gcttagatggcgtccatggccgcag

SEQ ID NO: 124418 - DNA, 25 bp, Homo sapien
ggccagccgagcctcatggcttaga

SEQ ID NO: 124419 - DNA, 25 bp, Homo sapien
tgtcatttaagatcgcccgggtccc

SEQ ID NO: 124420 - DNA, 25 bp, Homo sapien
ccgccatcgctgtcatttaagatcg

SEQ ID NO: 124421 - DNA, 25 bp, Homo sapien
cctgcagatggggtcctgcgcctac

SEQ ID NO: 124422 - DNA, 25 bp, Homo sapien
acatatccggcgtctccggggccag

SEQ ID NO: 124423 - DNA, 25 bp, Homo sapien
ctcctacttctgttgcctggcttgg

SEQ ID NO: 124424 - DNA, 25 bp, Homo sapien
ttcttggcgaagatgcccgtcttga

SEQ ID NO: 124425 - DNA, 25 bp, Homo sapien
cgcttctggacgttcttggcgaaga

SEQ ID NO: 124426 - DNA, 25 bp, Homo sapien
cggttgagtcgcttctggacgttct

SEQ ID NO: 124427 - DNA, 25 bp, Homo sapien
ctgaccttttcctgcgcgcggttga

SEQ ID NO: 124428 - DNA, 25 bp, Homo sapien
gcccgtcttgatgtcggccatggct

SEQ ID NO: 124429 - DNA, 25 bp, Homo sapien
cggagctggacatatccggcgtctc

SEQ ID NO: 124430 - DNA, 25 bp, Homo sapien
tcccaagaaggcgatgccaggagca

SEQ ID NO: 124431 - DNA, 25 bp, Homo sapien
tctgctgcctaagtccgaggacgca

SEQ ID NO: 124432 - DNA, 25 bp, Homo sapien
gaggacgcaggacgccaaaaccacc

SEQ ID NO: 124433 - DNA, 25 bp, Homo sapien
tgcactacagaggacgcaggacgcc

SEQ ID NO: 124434 - DNA, 25 bp, Homo sapien
ggaacccaggctgcactacagagga

SEQ ID NO: 124435 - DNA, 25 bp, Homo sapien
tttctgtctagtgtccgcccaggcg

SEQ ID NO: 124436 - DNA, 25 bp, Homo sapien
accggctctgctgcctaagtccgag

SEQ ID NO: 124437 - DNA, 25 bp, Homo sapien
gtcccgtcacctggctttctgtcta

SEQ ID NO: 124438 - DNA, 25 bp, Homo sapien
tgtgcgtccttaagactgcgggtgc

SEQ ID NO: 124439 - DNA, 25 bp, Homo sapien
cggacttgacaggaagctttgctgc

SEQ ID NO: 124440 - DNA, 25 bp, Homo sapien
ggcctgggaccctcttgatggtaaa

SEQ ID NO: 124441 - DNA, 25 bp, Homo sapien
tcccagggactcgtaatatgcaaac

SEQ ID NO: 124442 - DNA, 25 bp, Homo sapien
cgcggtgatttctgtgctgttttga

SEQ ID NO: 124443 - DNA, 25 bp, Homo sapien
tgcaggaagccattcacactcattc

SEQ ID NO: 124444 - DNA, 25 bp, Homo sapien
ctggcagagcccacttcaaaaaatg

SEQ ID NO: 124445 - DNA, 25 bp, Homo sapien
tgttttgagggcacacacctacata

SEQ ID NO: 124446 - DNA, 25 bp, Homo sapien
atcaacactgccaaccgagggagcc

SEQ ID NO: 124447 - DNA, 25 bp, Homo sapien
ctcgatggttacttgaaagcgtgta

SEQ ID NO: 124448 - DNA, 25 bp, Homo sapien
ggaaatctgcctcgctcacaactca

SEQ ID NO: 124449 - DNA, 25 bp, Homo sapien
gggagcccaaaatcaccgcaagcga

SEQ ID NO: 124450 - DNA, 25 bp, Homo sapien
atgtcgtgggttcaagcagcctcct

SEQ ID NO: 124451 - DNA, 25 bp, Homo sapien
cccgcgtcttgctaggatttctcga

SEQ ID NO: 124452 - DNA, 25 bp, Homo sapien
agcgcctacgggatgcgttagaaac

SEQ ID NO: 124453 - DNA, 25 bp, Homo sapien
cgcagcgggaatggcagagtaacat

SEQ ID NO: 124454 - DNA, 25 bp, Homo sapien
gtcacgcccgacctctgggatttgg

SEQ ID NO: 124455 - DNA, 25 bp, Homo sapien
cacgctgcacatctgggatttgggg

SEQ ID NO: 124456 - DNA, 25 bp, Homo sapien
gggtcacgctgcacatctgggattt

SEQ ID NO: 124457 - DNA, 25 bp, Homo sapien
ggtcacgctgcacatctgggatttg

SEQ ID NO: 124458 - DNA, 25 bp, Homo sapien
gtcatgcccgacctctgggatttgg

SEQ ID NO: 124459 - DNA, 25 bp, Homo sapien
cctctgggatttggaggtcatgccc

SEQ ID NO: 124460 - DNA, 25 bp, Homo sapien
atttgggggtcacgcccgacctctg

SEQ ID NO: 124461 - DNA, 25 bp, Homo sapien
ggtcacgcccgacctctgggatttg

SEQ ID NO: 124462 - DNA, 25 bp, Homo sapien
agcggggcgacaccgaagcagccca

SEQ ID NO: 124463 - DNA, 25 bp, Homo sapien
ttgggacgcaactactgccgcgtcc

SEQ ID NO: 124464 - DNA, 25 bp, Homo sapien
aggttgggacgcaactactgccgcg

SEQ ID NO: 124465 - DNA, 25 bp, Homo sapien
aagcagcccacggagctcgaggcga

SEQ ID NO: 124466 - DNA, 25 bp, Homo sapien
aggcgacgctgctgagcctggttcc

SEQ ID NO: 124467 - DNA, 25 bp, Homo sapien
cggaggttgggacgcaactactgcc

SEQ ID NO: 124468 - DNA, 25 bp, Homo sapien
cccaccgcgaccctgcagcagcctg

SEQ ID NO: 124469 - DNA, 25 bp, Homo sapien
ccaccgccggcgtttcagacgcaaa

SEQ ID NO: 124470 - DNA, 25 bp, Homo sapien
agctgcacgttagagctgggccacc

SEQ ID NO: 124471 - DNA, 25 bp, Homo sapien
ctggcgttgccacggtggcccttga

SEQ ID NO: 124472 - DNA, 25 bp, Homo sapien
tggcccttgaggcaagagtcagacc

SEQ ID NO: 124473 - DNA, 25 bp, Homo sapien
acagaaccagctctcgaggggccct

SEQ ID NO: 124474 - DNA, 25 bp, Homo sapien
cgtccacagtctcggcggaccaagg

SEQ ID NO: 124475 - DNA, 25 bp, Homo sapien
gagatcggcctttgagcctgcggcc

SEQ ID NO: 124476 - DNA, 25 bp, Homo sapien
ccgcatcactgcaggagctggcgtt

SEQ ID NO: 124477 - DNA, 25 bp, Homo sapien
ccgcacgctagagctgcacgttaga

SEQ ID NO: 124478 - DNA, 25 bp, Homo sapien
atgacttcacctcgcggagctcaga

SEQ ID NO: 124479 - DNA, 25 bp, Homo sapien
ttccaggcgacaaggaccgagtacc

SEQ ID NO: 124480 - DNA, 25 bp, Homo sapien
tgccgagattgcacatcccacgttc

SEQ ID NO: 124481 - DNA, 25 bp, Homo sapien
cctcctgggatttggcccgtgacaa

SEQ ID NO: 124482 - DNA, 25 bp, Homo sapien
gctgaccctctagaagcaagatggc

SEQ ID NO: 124483 - DNA, 25 bp, Homo sapien
tcaaccctgagacgcccagggaaca

SEQ ID NO: 124484 - DNA, 25 bp, Homo sapien
tcagcccacggacaggaagtcgctc

SEQ ID NO: 124485 - DNA, 25 bp, Homo sapien
ccagagcaaagcgtcggagtcctcc

SEQ ID NO: 124486 - DNA, 25 bp, Homo sapien
ccgtgacaacggcaagctggctgca

SEQ ID NO: 124487 - DNA, 25 bp, Homo sapien
cgacgaagctgcgtctctcagactg

SEQ ID NO: 124488 - DNA, 25 bp, Homo sapien
cagaggcggctacacccggagaacc

SEQ ID NO: 124489 - DNA, 25 bp, Homo sapien
tggctgcaacgaagccgcccacgta

SEQ ID NO: 124490 - DNA, 25 bp, Homo sapien
cgccggaggagatttccgtgacaac

SEQ ID NO: 124491 - DNA, 25 bp, Homo sapien
ggctatttcctctcccgctgtggtc

SEQ ID NO: 124492 - DNA, 25 bp, Homo sapien
ctcgcgggctaacgctgtgaagcct

SEQ ID NO: 124493 - DNA, 25 bp, Homo sapien
ccgctatctcgttggtggctatttc

SEQ ID NO: 124494 - DNA, 25 bp, Homo sapien
cacgtaagagtacagaaatctgcag

SEQ ID NO: 124495 - DNA, 25 bp, Homo sapien
taagagtacagaaatctgcagagac

SEQ ID NO: 124496 - DNA, 25 bp, Homo sapien
ttttatatccttgaaacaaatgttg

SEQ ID NO: 124497 - DNA, 25 bp, Homo sapien
aatatgtaattgagagggcggcggc

SEQ ID NO: 124498 - DNA, 25 bp, Homo sapien
tgaaatatgtaattgagagggcggc

SEQ ID NO: 124499 - DNA, 25 bp, Homo sapien
tccttgaaacaaatgttgaaatatg

SEQ ID NO: 124500 - DNA, 25 bp, Homo sapien
cattcaatataaaatgtatatgacc

SEQ ID NO: 124501 - DNA, 25 bp, Homo sapien
atgtatatgaccataatattccaaa

SEQ ID NO: 124502 - DNA, 25 bp, Homo sapien
ttgcacccaacgtcagggcgcgatg

SEQ ID NO: 124503 - DNA, 25 bp, Homo sapien
cgacgaaggtggtacttccgcgttg

SEQ ID NO: 124504 - DNA, 25 bp, Homo sapien
gcgcatctggtgttttcgctgccga

SEQ ID NO: 124505 - DNA, 25 bp, Homo sapien
aggcgtgttgttgtctcgcccactc

SEQ ID NO: 124506 - DNA, 25 bp, Homo sapien
gacgacgagcgcaatcgggagctcc

SEQ ID NO: 124507 - DNA, 25 bp, Homo sapien
gacccggattatcgtggcgcttttc

SEQ ID NO: 124508 - DNA, 25 bp, Homo sapien
tggctctaggcgatgccgagcagct

SEQ ID NO: 124509 - DNA, 25 bp, Homo sapien
tggaatacgaggatgtgagctccca

SEQ ID NO: 124510 - DNA, 25 bp, Homo sapien
gggccgaaaattctgtcgctgcata

SEQ ID NO: 124511 - DNA, 25 bp, Homo sapien
cgcagtcaggtaccctccgagattc

SEQ ID NO: 124512 - DNA, 25 bp, Homo sapien
gcagagaactgctagtcctttacca

SEQ ID NO: 124513 - DNA, 25 bp, Homo sapien
ctttccagtctgagtgcccttggtc

SEQ ID NO: 124514 - DNA, 25 bp, Homo sapien
tcgctgcatatcaggagccaaagcc

SEQ ID NO: 124515 - DNA, 25 bp, Homo sapien
tcagttccggcgtcacaaaggttcc

SEQ ID NO: 124516 - DNA, 25 bp, Homo sapien
gcggcgggattacctaaatcactga

SEQ ID NO: 124517 - DNA, 25 bp, Homo sapien
aaatcactgacttggcgagagactc

SEQ ID NO: 124518 - DNA, 25 bp, Homo sapien
ttgcatggctctgttctcgcctcga

SEQ ID NO: 124519 - DNA, 25 bp, Homo sapien
tctcgcctcgaggagcagccactag

SEQ ID NO: 124520 - DNA, 25 bp, Homo sapien
ctccacgctggagcatttgcatggc

SEQ ID NO: 124521 - DNA, 25 bp, Homo sapien
ctccagcgactgcactagcaaagtg

SEQ ID NO: 124522 - DNA, 25 bp, Homo sapien
gctgccaccgcgttattcacctagt

SEQ ID NO: 124523 - DNA, 25 bp, Homo sapien
tattcacctagtggaggcggcctga

SEQ ID NO: 124524 - DNA, 25 bp, Homo sapien
gcggcctgatttactggcgacttca

SEQ ID NO: 124525 - DNA, 25 bp, Homo sapien
agccactagcgaacccggtggagca

SEQ ID NO: 124526 - DNA, 25 bp, Homo sapien
agtgctgctcgtaccctgcttggtt

SEQ ID NO: 124527 - DNA, 25 bp, Homo sapien
ggagctgacttcgttccactgaatg

SEQ ID NO: 124528 - DNA, 25 bp, Homo sapien
gggaatttaaatactgcaccacgtc

SEQ ID NO: 124529 - DNA, 25 bp, Homo sapien
cgtcgtccggcaggaaatcctcatc

SEQ ID NO: 124530 - DNA, 25 bp, Homo sapien
catcgttcaggttggcatcagcgtc

SEQ ID NO: 124531 - DNA, 25 bp, Homo sapien
gctgcacctcctcggggcatgaact

SEQ ID NO: 124532 - DNA, 25 bp, Homo sapien
aggcgcgtcttcaggctcatcctct

SEQ ID NO: 124533 - DNA, 25 bp, Homo sapien
gcggcccacacttgagcttggagga

SEQ ID NO: 124534 - DNA, 25 bp, Homo sapien
ctggtttcctccgacggtggcaagg

SEQ ID NO: 124535 - DNA, 25 bp, Homo sapien
tgtcgagttcccttcaggttctggt

SEQ ID NO: 124536 - DNA, 25 bp, Homo sapien
cggtggcaagggatgtttttcacgc

SEQ ID NO: 124537 - DNA, 25 bp, Homo sapien
gggatgtttttcacgcctttcacca

SEQ ID NO: 124538 - DNA, 25 bp, Homo sapien
ttctctgcgctttcctgtcgagttc

SEQ ID NO: 124539 - DNA, 25 bp, Homo sapien
tccatcatcattacatcagcgcggg

SEQ ID NO: 124540 - DNA, 25 bp, Homo sapien
atcattacatcagcgcggggaagtc

SEQ ID NO: 124541 - DNA, 25 bp, Homo sapien
gcggggaagtccacgccgagttctc

SEQ ID NO: 124542 - DNA, 25 bp, Homo sapien
cagagatcccggtgcaatcgaggcc

SEQ ID NO: 124543 - DNA, 25 bp, Homo sapien
tattgtctcccagttacccgtggcc

SEQ ID NO: 124544 - DNA, 25 bp, Homo sapien
gttttccgcatattgtctcccagtt

SEQ ID NO: 124545 - DNA, 25 bp, Homo sapien
ccacctccgtgttttccgcatattg

SEQ ID NO: 124546 - DNA, 25 bp, Homo sapien
ttcacagctacgtgaggcggggcat

SEQ ID NO: 124547 - DNA, 25 bp, Homo sapien
cacccttcacagctacgtgaggcgg

SEQ ID NO: 124548 - DNA, 25 bp, Homo sapien
gcacagcagagatcccggtgcaatc

SEQ ID NO: 124549 - DNA, 25 bp, Homo sapien
atcccggtgcaatcgaggccgggtc

SEQ ID NO: 124550 - DNA, 25 bp, Homo sapien
gtcaccaaagccaaggtaacacgtc

SEQ ID NO: 124551 - DNA, 25 bp, Homo sapien
cgcctttgctgtttctcacagtcca

SEQ ID NO: 124552 - DNA, 25 bp, Homo sapien
atcattggatttggttctgcacttc

SEQ ID NO: 124553 - DNA, 25 bp, Homo sapien
atttcgtgggagctggaatcatcca

SEQ ID NO: 124554 - DNA, 25 bp, Homo sapien
tgaagaagttgatcctaatcctgcg

SEQ ID NO: 124555 - DNA, 25 bp, Homo sapien
gggtcctcattctcctgtttctttg

SEQ ID NO: 124556 - DNA, 25 bp, Homo sapien
tccacagcaggaagtgcagaacatc

SEQ ID NO: 124557 - DNA, 25 bp, Homo sapien
gcctggctgagaacactcgcctttg

SEQ ID NO: 124558 - DNA, 25 bp, Homo sapien
agctccggcatcagtttcggggatc

SEQ ID NO: 124559 - DNA, 25 bp, Homo sapien
agccctgagtgacagttctgatttg

SEQ ID NO: 124560 - DNA, 25 bp, Homo sapien
gggcgccttttgacagccattttca

SEQ ID NO: 124561 - DNA, 25 bp, Homo sapien
ttggagtgctgctcgccttactttt

SEQ ID NO: 124562 - DNA, 25 bp, Homo sapien
tcctggcatccaatcgactttctgg

SEQ ID NO: 124563 - DNA, 25 bp, Homo sapien
cctgcactactcacggggtggaaaa

SEQ ID NO: 124564 - DNA, 25 bp, Homo sapien
tggaaaagttgtccctcggctccgc

SEQ ID NO: 124565 - DNA, 25 bp, Homo sapien
tttaacagatgttgccggactctcc

SEQ ID NO: 124566 - DNA, 25 bp, Homo sapien
agggagaagctgagcgacagcccca

SEQ ID NO: 124567 - DNA, 25 bp, Homo sapien
taaatgtctgcggttgctctgccgg

SEQ ID NO: 124568 - DNA, 25 bp, Homo sapien
ggaaaataaatgtctgcggttgctc

SEQ ID NO: 124569 - DNA, 25 bp, Homo sapien
gcggcggtgttattcggagaaggaa

SEQ ID NO: 124570 - DNA, 25 bp, Homo sapien
tcgtttccacccagcgcggcggtgt

SEQ ID NO: 124571 - DNA, 25 bp, Homo sapien
tgtgggctctcgggttcgtttccac

SEQ ID NO: 124572 - DNA, 25 bp, Homo sapien
agcagggacctactgctggcgccca

SEQ ID NO: 124573 - DNA, 25 bp, Homo sapien
atgtctgcggttgctctgccgggct

SEQ ID NO: 124574 - DNA, 25 bp, Homo sapien
gccgggaaatctcaaccgggcagcc

SEQ ID NO: 124575 - DNA, 25 bp, Homo sapien
gggcacctcctgcatcacgtggttc

SEQ ID NO: 124576 - DNA, 25 bp, Homo sapien
cgggtgacgccaaacctgcgattcc

SEQ ID NO: 124577 - DNA, 25 bp, Homo sapien
gtcggccactcgatcgcaaccgggt

SEQ ID NO: 124578 - DNA, 25 bp, Homo sapien
ggcggccatgtttattgagggcacc

SEQ ID NO: 124579 - DNA, 25 bp, Homo sapien
tttattgagggcacctggcttctcc

SEQ ID NO: 124580 - DNA, 25 bp, Homo sapien
ggtgagcctgaaggcgcgcacccac

SEQ ID NO: 124581 - DNA, 25 bp, Homo sapien
ctgcgattcccaagcggcagcgcgg

SEQ ID NO: 124582 - DNA, 25 bp, Homo sapien
gtagcagacgcagcttacacagttc

SEQ ID NO: 124583 - DNA, 25 bp, Homo sapien
cgaaactactgggagcgactgctac

SEQ ID NO: 124584 - DNA, 25 bp, Homo sapien
tgtgcctgtgcgcatgctgaaagca

SEQ ID NO: 124585 - DNA, 25 bp, Homo sapien
ctgctccaagagcatgcggggtgtt

SEQ ID NO: 124586 - DNA, 25 bp, Homo sapien
tttacccgaagagccaaagcacagc

SEQ ID NO: 124587 - DNA, 25 bp, Homo sapien
actacgctgaagacctcgagggccc

SEQ ID NO: 124588 - DNA, 25 bp, Homo sapien
ggacgtagttcgtgacattcccata

SEQ ID NO: 124589 - DNA, 25 bp, Homo sapien
catgcgcactgtggccgatttcctt

SEQ ID NO: 124590 - DNA, 25 bp, Homo sapien
tctcccgcgaggttcaattgtcagc

SEQ ID NO: 124591 - DNA, 25 bp, Homo sapien
ggaacaccgtgcgactctgaccgaa

SEQ ID NO: 124592 - DNA, 25 bp, Homo sapien
aggagcatgatctgtgcccaggcca

SEQ ID NO: 124593 - DNA, 25 bp, Homo sapien
cccttgtgaaccaaagctctggatt

SEQ ID NO: 124594 - DNA, 25 bp, Homo sapien
agctctggatttgcgcttcgccttg

SEQ ID NO: 124595 - DNA, 25 bp, Homo sapien
cagctctaatctgcgcgctgacagg

SEQ ID NO: 124596 - DNA, 25 bp, Homo sapien
gtgtcccatgcaatgcccgtggtta

SEQ ID NO: 124597 - DNA, 25 bp, Homo sapien
gggctcgcttttgaacaattgtgtc

SEQ ID NO: 124598 - DNA, 25 bp, Homo sapien
ctcccgtgaggagaccaatcgccta

SEQ ID NO: 124599 - DNA, 25 bp, Homo sapien
cctccatcagaactcgggtcatctg

SEQ ID NO: 124600 - DNA, 25 bp, Homo sapien
ctgggtgtgactccgccactaacat

SEQ ID NO: 124601 - DNA, 25 bp, Homo sapien
cgccactaacattttcccagcagga

SEQ ID NO: 124602 - DNA, 25 bp, Homo sapien
ataaaactgtcctggtgagtcgctc

SEQ ID NO: 124603 - DNA, 25 bp, Homo sapien
gctcacagcctgtcccagtaactgt

SEQ ID NO: 124604 - DNA, 25 bp, Homo sapien
taactgttccggagcgtcagcctga

SEQ ID NO: 124605 - DNA, 25 bp, Homo sapien
ctagcgtgagtcttcttccgggatt

SEQ ID NO: 124606 - DNA, 25 bp, Homo sapien
ctcaaggactcctcggagaaggatg

SEQ ID NO: 124607 - DNA, 25 bp, Homo sapien
cctagcgggcacgtggaaagaagcc

SEQ ID NO: 124608 - DNA, 25 bp, Homo sapien
gtcggtacccgactccatgcagagc

SEQ ID NO: 124609 - DNA, 25 bp, Homo sapien
agaacagcgcgttcgagtcggtacc

SEQ ID NO: 124610 - DNA, 25 bp, Homo sapien
agagcacggtcttctcctcgcaaga

SEQ ID NO: 124611 - DNA, 25 bp, Homo sapien
gacagcgccaagatctccgagagca

SEQ ID NO: 124612 - DNA, 25 bp, Homo sapien
cgtcctgctacagcagctcgtgcta

SEQ ID NO: 124613 - DNA, 25 bp, Homo sapien
ctgctacaacggcaacaggttcgcc

SEQ ID NO: 124614 - DNA, 25 bp, Homo sapien
aagtggcgttgctgctgccgataac

SEQ ID NO: 124615 - DNA, 25 bp, Homo sapien
gaagcgggcctgaacaccatgatcc

SEQ ID NO: 124616 - DNA, 25 bp, Homo sapien
catgatccctttggagaagccaggc

SEQ ID NO: 124617 - DNA, 25 bp, Homo sapien
ataacgcgcgttgtgacttggcaca

SEQ ID NO: 124618 - DNA, 25 bp, Homo sapien
cccagcaagcgagtggtggtaactc

SEQ ID NO: 124619 - DNA, 25 bp, Homo sapien
cagccctttcgttctctgtggcgtt

SEQ ID NO: 124620 - DNA, 25 bp, Homo sapien
ctgtggcgtttcgaatggctattta

SEQ ID NO: 124621 - DNA, 25 bp, Homo sapien
cttccaggacggctacagcctgtgc

SEQ ID NO: 124622 - DNA, 25 bp, Homo sapien
cgcgggagactaacctgtgagcaac

SEQ ID NO: 124623 - DNA, 25 bp, Homo sapien
ggctcacgttgctcctcacaggtat

SEQ ID NO: 124624 - DNA, 25 bp, Homo sapien
gcgtccggttattgcaaatgcattc

SEQ ID NO: 124625 - DNA, 25 bp, Homo sapien
cggccggctgatccagaacttaggt

SEQ ID NO: 124626 - DNA, 25 bp, Homo sapien
cggacggagccactgaaggttacca

SEQ ID NO: 124627 - DNA, 25 bp, Homo sapien
gcatgacgagttcttccaggcttgg

SEQ ID NO: 124628 - DNA, 25 bp, Homo sapien
tgacccgtgagggaactctccaaga

SEQ ID NO: 124629 - DNA, 25 bp, Homo sapien
aggcttcagctcacctcggattgta

SEQ ID NO: 124630 - DNA, 25 bp, Homo sapien
tccatttcggttaagactgcccgta

SEQ ID NO: 124631 - DNA, 25 bp, Homo sapien
ccggcaaggggctttctcaactaca

SEQ ID NO: 124632 - DNA, 25 bp, Homo sapien
ttccatagagcgctagggcctgagc

SEQ ID NO: 124633 - DNA, 25 bp, Homo sapien
tcgccaccaagctgggtgcagagaa

SEQ ID NO: 124634 - DNA, 25 bp, Homo sapien
ggcggataagagagatgcgacaccc

SEQ ID NO: 124635 - DNA, 25 bp, Homo sapien
ccaatgggatccagtgggttctacg

SEQ ID NO: 124636 - DNA, 25 bp, Homo sapien
ggggccactaaataccaatgggatc

SEQ ID NO: 124637 - DNA, 25 bp, Homo sapien
gtttttatgtagacccaagagggca

SEQ ID NO: 124638 - DNA, 25 bp, Homo sapien
tctcctccgagcgaaggggacatca

SEQ ID NO: 124639 - DNA, 25 bp, Homo sapien
gccgcagctcaaggtactactggcg

SEQ ID NO: 124640 - DNA, 25 bp, Homo sapien
ggggttgacgccacagcgatgactt

SEQ ID NO: 124641 - DNA, 25 bp, Homo sapien
cagcgatgacttgggccacgggtct

SEQ ID NO: 124642 - DNA, 25 bp, Homo sapien
ctgtctttcgggattagggtctctc

SEQ ID NO: 124643 - DNA, 25 bp, Homo sapien
attagggtctctcccacagggtttg

SEQ ID NO: 124644 - DNA, 25 bp, Homo sapien
ccgggtgcgccgcatatatagcagc

SEQ ID NO: 124645 - DNA, 25 bp, Homo sapien
cacccgcctatgatggcccagagga

SEQ ID NO: 124646 - DNA, 25 bp, Homo sapien
agagacctccggctggcggcccgtt

SEQ ID NO: 124647 - DNA, 25 bp, Homo sapien
tgtgcggagcccgagctttcgcaac

SEQ ID NO: 124648 - DNA, 25 bp, Homo sapien
agcccgagctttcgcaacgcggcgg

SEQ ID NO: 124649 - DNA, 25 bp, Homo sapien
tccgcggtgaccgtcagacacgcag

SEQ ID NO: 124650 - DNA, 25 bp, Homo sapien
ccaggaccgccctgcgccgctcctt

SEQ ID NO: 124651 - DNA, 25 bp, Homo sapien
ttcctctttctgtgcggagcccgag

SEQ ID NO: 124652 - DNA, 25 bp, Homo sapien
gtgaggcatgacgtcaccgcgaggt

SEQ ID NO: 124653 - DNA, 25 bp, Homo sapien
agcgccgatccggcccggtgttcag

SEQ ID NO: 124654 - DNA, 25 bp, Homo sapien
ttgtgaatgctcatcccgccgctgt

SEQ ID NO: 124655 - DNA, 25 bp, Homo sapien
gcttgcatagggtttcagatccgga

SEQ ID NO: 124656 - DNA, 25 bp, Homo sapien
cgcggtatgctgctagctgttactc

SEQ ID NO: 124657 - DNA, 25 bp, Homo sapien
accaagtcggagctcgtactctgta

SEQ ID NO: 124658 - DNA, 25 bp, Homo sapien
ccctcggggctcgaagaggagccaa

SEQ ID NO: 124659 - DNA, 25 bp, Homo sapien
ttcgacaacctcacgctagtacggg

SEQ ID NO: 124660 - DNA, 25 bp, Homo sapien
tgaggatgcgaaacgtgagattttc

SEQ ID NO: 124661 - DNA, 25 bp, Homo sapien
gccctgtgaatgctcagccttgtga

SEQ ID NO: 124662 - DNA, 25 bp, Homo sapien
tctgcccggatcctgacattctggg

SEQ ID NO: 124663 - DNA, 25 bp, Homo sapien
cgccggagcgaagcatttccaggcc

SEQ ID NO: 124664 - DNA, 25 bp, Homo sapien
aggaacatcgataccaggcgccgga

SEQ ID NO: 124665 - DNA, 25 bp, Homo sapien
gtccactcccaacgcgagcaagttt

SEQ ID NO: 124666 - DNA, 25 bp, Homo sapien
acgacgcggcaaacaagcgtccact

SEQ ID NO: 124667 - DNA, 25 bp, Homo sapien
tgacattctgggtacgtctcaacga

SEQ ID NO: 124668 - DNA, 25 bp, Homo sapien
tgtcagcaaagggtctgcatctgcc

SEQ ID NO: 124669 - DNA, 25 bp, Homo sapien
gtacgtctcaacgacgcggcaaaca

SEQ ID NO: 124670 - DNA, 25 bp, Homo sapien
cgcgcgtctccgtaaagccaacgag

SEQ ID NO: 124671 - DNA, 25 bp, Homo sapien
ccgcgcagcctgaaaagcgaacgca

SEQ ID NO: 124672 - DNA, 25 bp, Homo sapien
agtcgcggatacacctgcctgggaa

SEQ ID NO: 124673 - DNA, 25 bp, Homo sapien
ccgctgccgtgaagtgaaaggtgac

SEQ ID NO: 124674 - DNA, 25 bp, Homo sapien
caactctttgggtgtccgaagcgtc

SEQ ID NO: 124675 - DNA, 25 bp, Homo sapien
gcggatccagaaggtacgcactttc

SEQ ID NO: 124676 - DNA, 25 bp, Homo sapien
acgcagcctgagaaagggattgcgc

SEQ ID NO: 124677 - DNA, 25 bp, Homo sapien
ccttgctgactagtggtcgaagcca

SEQ ID NO: 124678 - DNA, 25 bp, Homo sapien
tcgatgtccacgagcttggtgatga

SEQ ID NO: 124679 - DNA, 25 bp, Homo sapien
aagggcggagcaaacgtcagcagta

SEQ ID NO: 124680 - DNA, 25 bp, Homo sapien
gcggagcaaacgtcagcagtaggct

SEQ ID NO: 124681 - DNA, 25 bp, Homo sapien
cttctcctcgatgtccacgagcttg

SEQ ID NO: 124682 - DNA, 25 bp, Homo sapien
tccacgagcttggtgatgaagtcct

SEQ ID NO: 124683 - DNA, 25 bp, Homo sapien
aagtccttcagctgcgccacgccct

SEQ ID NO: 124684 - DNA, 25 bp, Homo sapien
tggggccacgagaggaacaaacagc

SEQ ID NO: 124685 - DNA, 25 bp, Homo sapien
caaacgtcagcagtaggctgtgggc

SEQ ID NO: 124686 - DNA, 25 bp, Homo sapien
tgggcagaagcacaaacacacatgc

SEQ ID NO: 124687 - DNA, 25 bp, Homo sapien
tcgccggagccggtagggaacactc

SEQ ID NO: 124688 - DNA, 25 bp, Homo sapien
ccggtagggaacactctgcagtcca

SEQ ID NO: 124689 - DNA, 25 bp, Homo sapien
tgacggcgatgaacggtacattctg

SEQ ID NO: 124690 - DNA, 25 bp, Homo sapien
agcgccagggccacgacaggaacag

SEQ ID NO: 124691 - DNA, 25 bp, Homo sapien
cacaggggacaatacacgggtgggc

SEQ ID NO: 124692 - DNA, 25 bp, Homo sapien
cacacatgctgacagggcctgatcc

SEQ ID NO: 124693 - DNA, 25 bp, Homo sapien
cacgacaggaacagtggctctcaca

SEQ ID NO: 124694 - DNA, 25 bp, Homo sapien
gcatgctagaccagctggccggaca

SEQ ID NO: 124695 - DNA, 25 bp, Homo sapien
cttcgcgggcttccatgttggatcc

SEQ ID NO: 124696 - DNA, 25 bp, Homo sapien
aggagtgctgtctcaccctcgtgac

SEQ ID NO: 124697 - DNA, 25 bp, Homo sapien
tccacaccgcagcaggagtgctgtc

SEQ ID NO: 124698 - DNA, 25 bp, Homo sapien
ggccagcgctgcaagaggcctacgt

SEQ ID NO: 124699 - DNA, 25 bp, Homo sapien
taccatttccgcttcctgccgtggg

SEQ ID NO: 124700 - DNA, 25 bp, Homo sapien
gcattcgcgggacctgcatgctaga

SEQ ID NO: 124701 - DNA, 25 bp, Homo sapien
catggcggcgaacctgagccggaac

SEQ ID NO: 124702 - DNA, 25 bp, Homo sapien
tctgccttgttgaggcctgtgaggc

SEQ ID NO: 124703 - DNA, 25 bp, Homo sapien
gatgtcgaaggagcgcctccagatc

SEQ ID NO: 124704 - DNA, 25 bp, Homo sapien
tgccgctcattgaggcgccaagtgc

SEQ ID NO: 124705 - DNA, 25 bp, Homo sapien
cacatctggtccgtgccgtccagga

SEQ ID NO: 124706 - DNA, 25 bp, Homo sapien
tggcccgcttcagcactgacgtgta

SEQ ID NO: 124707 - DNA, 25 bp, Homo sapien
atcttggcatccttgatggccttgg

SEQ ID NO: 124708 - DNA, 25 bp, Homo sapien
tgcatcgaaccagccacagaaacgg

SEQ ID NO: 124709 - DNA, 25 bp, Homo sapien
gaaacggttctcctggttccatgtg

SEQ ID NO: 124710 - DNA, 25 bp, Homo sapien
agcattgggacgacagcctccagca

SEQ ID NO: 124711 - DNA, 25 bp, Homo sapien
ttaatgtctcggaaagcgctgttcg

SEQ ID NO: 124712 - DNA, 25 bp, Homo sapien
tgcaaataacggcagaggacccgcc

SEQ ID NO: 124713 - DNA, 25 bp, Homo sapien
tgcgacccatgcgaggctcgaccag

SEQ ID NO: 124714 - DNA, 25 bp, Homo sapien
ccgggctcctacaggattgggtgtc

SEQ ID NO: 124715 - DNA, 25 bp, Homo sapien
ctcgaccaggtagatggcgactccc

SEQ ID NO: 124716 - DNA, 25 bp, Homo sapien
cgacacgcgggtttccaatgcgctg

SEQ ID NO: 124717 - DNA, 25 bp, Homo sapien
ggaagacccgcctccatgcaaataa

SEQ ID NO: 124718 - DNA, 25 bp, Homo sapien
gagcttcgccttgacctggcccttg

SEQ ID NO: 124719 - DNA, 25 bp, Homo sapien
gggcttaagagctccgtcaccatcg

SEQ ID NO: 124720 - DNA, 25 bp, Homo sapien
atgttctccgaagcgaacggaccct

SEQ ID NO: 124721 - DNA, 25 bp, Homo sapien
ggccttcaggccgatgttctccgaa

SEQ ID NO: 124722 - DNA, 25 bp, Homo sapien
gtggaactcgtcctcctcgtacttc

SEQ ID NO: 124723 - DNA, 25 bp, Homo sapien
ttgaacgcgtgcaggacgggttcct

SEQ ID NO: 124724 - DNA, 25 bp, Homo sapien
gtcaccatcgcatcctcggggctgg

SEQ ID NO: 124725 - DNA, 25 bp, Homo sapien
acgcttctttgaagacgtggaactc

SEQ ID NO: 124726 - DNA, 25 bp, Homo sapien
ctacaccggcggcatgggcatcgtc

SEQ ID NO: 124727 - DNA, 25 bp, Homo sapien
atatggcccgcacgcctacccagga

SEQ ID NO: 124728 - DNA, 25 bp, Homo sapien
atgggcatcgtcaacggggccaagt

SEQ ID NO: 124729 - DNA, 25 bp, Homo sapien
tcttccggtggcttgccatctcctt

SEQ ID NO: 124730 - DNA, 25 bp, Homo sapien
agcccaggactacaccggcggcatg

SEQ ID NO: 124731 - DNA, 25 bp, Homo sapien
gcggcgagcggctagtatcctaccc

SEQ ID NO: 124732 - DNA, 25 bp, Homo sapien
atgaggacgaggtctccgaggccca

SEQ ID NO: 124733 - DNA, 25 bp, Homo sapien
gaccacgccatcttccggtggcttg

SEQ ID NO: 124734 - DNA, 25 bp, Homo sapien
agccgcactgcgttggcgagctcat

SEQ ID NO: 124735 - DNA, 25 bp, Homo sapien
gaaaccctctgccatgacagccaga

SEQ ID NO: 124736 - DNA, 25 bp, Homo sapien
tcgcggccggctatgcccatcagtt

SEQ ID NO: 124737 - DNA, 25 bp, Homo sapien
cctccttctggatttctcgtttgta

SEQ ID NO: 124738 - DNA, 25 bp, Homo sapien
tctcgtttgtagtttcctgtgtccc

SEQ ID NO: 124739 - DNA, 25 bp, Homo sapien
gtctccacttcacagtaagctcacg

SEQ ID NO: 124740 - DNA, 25 bp, Homo sapien
aagctcacgccatatagccgcactg

SEQ ID NO: 124741 - DNA, 25 bp, Homo sapien
ctttttgagcatgtgaaaccctctg

SEQ ID NO: 124742 - DNA, 25 bp, Homo sapien
ttcatcctggctcgctccaactgga

SEQ ID NO: 124743 - DNA, 25 bp, Homo sapien
ttgactatgacatcggggccactca

SEQ ID NO: 124744 - DNA, 25 bp, Homo sapien
cggggccactcagtgcaacttcatc

SEQ ID NO: 124745 - DNA, 25 bp, Homo sapien
ccaagacctgcaatgttgactatga

SEQ ID NO: 124746 - DNA, 25 bp, Homo sapien
actggcgaatcttgaacccgggtga

SEQ ID NO: 124747 - DNA, 25 bp, Homo sapien
ggaaccggcctatcccacacataga

SEQ ID NO: 124748 - DNA, 25 bp, Homo sapien
atcatggccatgaacgggaaccggc

SEQ ID NO: 124749 - DNA, 25 bp, Homo sapien
aagcgcatccgggagatcatggcca

SEQ ID NO: 124750 - DNA, 25 bp, Homo sapien
agctgcccacttgtagcgatggcga

SEQ ID NO: 124751 - DNA, 25 bp, Homo sapien
agaacgcggagccacaccctcggtt

SEQ ID NO: 124752 - DNA, 25 bp, Homo sapien
gacacgcgaggaggatcccaacaga

SEQ ID NO: 124753 - DNA, 25 bp, Homo sapien
ccagcgtctgcgtccgggaaacgca

SEQ ID NO: 124754 - DNA, 25 bp, Homo sapien
taactcttcctgaagggatggcgcg

SEQ ID NO: 124755 - DNA, 25 bp, Homo sapien
cgcacacgtgtctaacgagtgactc

SEQ ID NO: 124756 - DNA, 25 bp, Homo sapien
acgagtgactcgttaggagcttttg

SEQ ID NO: 124757 - DNA, 25 bp, Homo sapien
gagcttttggctcgaacgtgcttga

SEQ ID NO: 124758 - DNA, 25 bp, Homo sapien
gaaccgctccttgaagctgggcaga

SEQ ID NO: 124759 - DNA, 25 bp, Homo sapien
ctgagtgtcgctccgacagtccatc

SEQ ID NO: 124760 - DNA, 25 bp, Homo sapien
cagcgtgctcaggatgttgtagatc

SEQ ID NO: 124761 - DNA, 25 bp, Homo sapien
cgcccacagtgatgcgcattacgtc

SEQ ID NO: 124762 - DNA, 25 bp, Homo sapien
cgaaatcttggagcttgggaaccgc

SEQ ID NO: 124763 - DNA, 25 bp, Homo sapien
tgatctcgcagctgggcgtcagcct

SEQ ID NO: 124764 - DNA, 25 bp, Homo sapien
tgccctcctccgactcgatgaaggt

SEQ ID NO: 124765 - DNA, 25 bp, Homo sapien
tgcagcttgtacacggagccatcca

SEQ ID NO: 124766 - DNA, 25 bp, Homo sapien
gcgtcgccctgagaccaagtctgca

SEQ ID NO: 124767 - DNA, 25 bp, Homo sapien
acacgaagcgcgtctcgaaggctcc

SEQ ID NO: 124768 - DNA, 25 bp, Homo sapien
acctgcgacacgaagcgcgtctcga

SEQ ID NO: 124769 - DNA, 25 bp, Homo sapien
aaggctccgcgtgtgcgcagctgct

SEQ ID NO: 124770 - DNA, 25 bp, Homo sapien
tgtgcgcagctgctcggaggcctcc

SEQ ID NO: 124771 - DNA, 25 bp, Homo sapien
gaagagcaggttttcgtccacgagc

SEQ ID NO: 124772 - DNA, 25 bp, Homo sapien
gtccacgagcctgagcagcacaagc

SEQ ID NO: 124773 - DNA, 25 bp, Homo sapien
ctgggactcagcgtcgccctgagac

SEQ ID NO: 124774 - DNA, 25 bp, Homo sapien
tcgctgcattgtacttccgggctca

SEQ ID NO: 124775 - DNA, 25 bp, Homo sapien
ccgactccacctggcgagcagggag

SEQ ID NO: 124776 - DNA, 25 bp, Homo sapien
caagcttacgcgaggcgtggcatcc

SEQ ID NO: 124777 - DNA, 25 bp, Homo sapien
cgggctcacatttctgcatccggag

SEQ ID NO: 124778 - DNA, 25 bp, Homo sapien
ctgcatccggagtatgagaaccctc

SEQ ID NO: 124779 - DNA, 25 bp, Homo sapien
gtatgagaaccctcaaccaggctga

SEQ ID NO: 124780 - DNA, 25 bp, Homo sapien
tcaaccaggctgaccggatccggaa

SEQ ID NO: 124781 - DNA, 25 bp, Homo sapien
ccctgagaacgggtcccgcagctgg

SEQ ID NO: 124782 - DNA, 25 bp, Homo sapien
agtgcacgttctgccacttgccgtc

SEQ ID NO: 124783 - DNA, 25 bp, Homo sapien
ccctgcccgtcaatgtactgcgtga

SEQ ID NO: 124784 - DNA, 25 bp, Homo sapien
caatgtactgcgtgagccggatgta

SEQ ID NO: 124785 - DNA, 25 bp, Homo sapien
atgcaggcggcatcctctccaatga

SEQ ID NO: 124786 - DNA, 25 bp, Homo sapien
atcggcttgctgttcttggccagca

SEQ ID NO: 124787 - DNA, 25 bp, Homo sapien
ttggccagcactgtggacagcaggc

SEQ ID NO: 124788 - DNA, 25 bp, Homo sapien
tcctctccaatgacgtgcacgtgtg

SEQ ID NO: 124789 - DNA, 25 bp, Homo sapien
cccgagcagtggaagtgcacgttct

SEQ ID NO: 124790 - DNA, 25 bp, Homo sapien
agacacatctaccttgttccaccag

SEQ ID NO: 124791 - DNA, 25 bp, Homo sapien
ccactgttagcaccgggttagagac

SEQ ID NO: 124792 - DNA, 25 bp, Homo sapien
tgcccactgttagcaccgggttaga

SEQ ID NO: 124793 - DNA, 25 bp, Homo sapien
gtctgcccactgttagcaccgggtt

SEQ ID NO: 124794 - DNA, 25 bp, Homo sapien
ccggagcggtggtctgtctgcccac

SEQ ID NO: 124795 - DNA, 25 bp, Homo sapien
tggtcgagacacatctaccttgttc

SEQ ID NO: 124796 - DNA, 25 bp, Homo sapien
cgctggtcgagacacatctaccttg

SEQ ID NO: 124797 - DNA, 25 bp, Homo sapien
gggacgctggtcgagacacatctac

SEQ ID NO: 124798 - DNA, 25 bp, Homo sapien
gacaccagcccatcggaagaaactg

SEQ ID NO: 124799 - DNA, 25 bp, Homo sapien
cggcgtcccagctgtggaaaggaca

SEQ ID NO: 124800 - DNA, 25 bp, Homo sapien
cagcgaccttcaaaggcggcgctta

SEQ ID NO: 124801 - DNA, 25 bp, Homo sapien
gcggcgcttaagagccggtcacgcc

SEQ ID NO: 124802 - DNA, 25 bp, Homo sapien
tcaccctagcagtgggacctgagtg

SEQ ID NO: 124803 - DNA, 25 bp, Homo sapien
gagagattccgacgccagcaccgta

SEQ ID NO: 124804 - DNA, 25 bp, Homo sapien
agtcaccgcgcctgagcagccagaa

SEQ ID NO: 124805 - DNA, 25 bp, Homo sapien
gacctgagtggatccaaaagccaga

SEQ ID NO: 124806 - DNA, 25 bp, Homo sapien
catcaactcgggcagcgctaagtgg

SEQ ID NO: 124807 - DNA, 25 bp, Homo sapien
actgccgctgttgccagagcgggtc

SEQ ID NO: 124808 - DNA, 25 bp, Homo sapien
gtcaggggaggcactcccaggttca

SEQ ID NO: 124809 - DNA, 25 bp, Homo sapien
gaggcactcccaggttcagccgatc

SEQ ID NO: 124810 - DNA, 25 bp, Homo sapien
ccaggttcagccgatccaggctcag

SEQ ID NO: 124811 - DNA, 25 bp, Homo sapien
gttcagccgatccaggctcaggtgg

SEQ ID NO: 124812 - DNA, 25 bp, Homo sapien
tcctcctcggagggacgcacctggg

SEQ ID NO: 124813 - DNA, 25 bp, Homo sapien
cctggactgccgctgttgccagagc

SEQ ID NO: 124814 - DNA, 25 bp, Homo sapien
cgagcgcacgcgagatctgctcgct

SEQ ID NO: 124815 - DNA, 25 bp, Homo sapien
cgccaaatgcgtcacgtctgccggg

SEQ ID NO: 124816 - DNA, 25 bp, Homo sapien
tagagctggtactcgtcggtgaagc

SEQ ID NO: 124817 - DNA, 25 bp, Homo sapien
tatcctcgtagagctggtactcgtc

SEQ ID NO: 124818 - DNA, 25 bp, Homo sapien
acttgccaatatcctcgtagagctg

SEQ ID NO: 124819 - DNA, 25 bp, Homo sapien
cgctgctcttacttgccaatatcct

SEQ ID NO: 124820 - DNA, 25 bp, Homo sapien
aaatgcgtcacgtctgccgggcgct

SEQ ID NO: 124821 - DNA, 25 bp, Homo sapien
gagcaggcgcaagcaggtcccgcca

SEQ ID NO: 124822 - DNA, 25 bp, Homo sapien
agtagggctcttaacagtcggctta

SEQ ID NO: 124823 - DNA, 25 bp, Homo sapien
cccacgtgctgcaggatgcccaaaa

SEQ ID NO: 124824 - DNA, 25 bp, Homo sapien
ggaaatcctggacgttgcccacgtg

SEQ ID NO: 124825 - DNA, 25 bp, Homo sapien
ctgtcttgcggtagaggaagccaaa

SEQ ID NO: 124826 - DNA, 25 bp, Homo sapien
gtcggcttactacttctgaaacctc

SEQ ID NO: 124827 - DNA, 25 bp, Homo sapien
tgtcacgtgactgctcggatttttg

SEQ ID NO: 124828 - DNA, 25 bp, Homo sapien
ccaaaagggcctggtcatacagctc

SEQ ID NO: 124829 - DNA, 25 bp, Homo sapien
ccggagcgaacacctcagcggaata

SEQ ID NO: 124830 - DNA, 25 bp, Homo sapien
cgacatgttggcgactccggagtct

SEQ ID NO: 124831 - DNA, 25 bp, Homo sapien
ctggaagctcttggtcccgaaattc

SEQ ID NO: 124832 - DNA, 25 bp, Homo sapien
atccagcgggaagctgcccttgtcc

SEQ ID NO: 124833 - DNA, 25 bp, Homo sapien
tcacctaagtgatccagcgggaagc

SEQ ID NO: 124834 - DNA, 25 bp, Homo sapien
ggtccatgccgcagcagtgacccag

SEQ ID NO: 124835 - DNA, 25 bp, Homo sapien
acccggaagcctgacgcaaggagtc

SEQ ID NO: 124836 - DNA, 25 bp, Homo sapien
aggcaccgtctaagcctcggctgca

SEQ ID NO: 124837 - DNA, 25 bp, Homo sapien
cccgaaattcatggcggtcgacatg

SEQ ID NO: 124838 - DNA, 25 bp, Homo sapien
ctctgcttggttagggttagtgtcc

SEQ ID NO: 124839 - DNA, 25 bp, Homo sapien
tctcgcgacctgcaggagaagcctc

SEQ ID NO: 124840 - DNA, 25 bp, Homo sapien
tcgacggggtactttggactacaga

SEQ ID NO: 124841 - DNA, 25 bp, Homo sapien
gcccagtgcttcagagtcctccatg

SEQ ID NO: 124842 - DNA, 25 bp, Homo sapien
gcccatgtgttcgaagcccagtgct

SEQ ID NO: 124843 - DNA, 25 bp, Homo sapien
agcccagatcggtgacagcctagga

SEQ ID NO: 124844 - DNA, 25 bp, Homo sapien
ttctcctggatcagcgtaggtcgcg

SEQ ID NO: 124845 - DNA, 25 bp, Homo sapien
cggaatagcataagcggccgtcttc

SEQ ID NO: 124846 - DNA, 25 bp, Homo sapien
tcccacatctgggtacgatagttgc

SEQ ID NO: 124847 - DNA, 25 bp, Homo sapien
tgcctgcggggcagacacatagtca

SEQ ID NO: 124848 - DNA, 25 bp, Homo sapien
ctgagctgggtacaaagggcctccc

SEQ ID NO: 124849 - DNA, 25 bp, Homo sapien
cgtcggggatttcctcgatgaaaca

SEQ ID NO: 124850 - DNA, 25 bp, Homo sapien
acgcctgcgcagtgatatgtactcg

SEQ ID NO: 124851 - DNA, 25 bp, Homo sapien
cctgaagcgtgccttttgggttctc

SEQ ID NO: 124852 - DNA, 25 bp, Homo sapien
tcagctcgggctcacaagtgttttc

SEQ ID NO: 124853 - DNA, 25 bp, Homo sapien
tgcgtgtccacctatctgactcgta

SEQ ID NO: 124854 - DNA, 25 bp, Homo sapien
agggctacgtgttgacgccatacgc

SEQ ID NO: 124855 - DNA, 25 bp, Homo sapien
gactgcctgtttggattaccgcgca

SEQ ID NO: 124856 - DNA, 25 bp, Homo sapien
cctgctcgagttgcgtcggagcatc

SEQ ID NO: 124857 - DNA, 25 bp, Homo sapien
ctgagccggagacaggtaaccgtgc

SEQ ID NO: 124858 - DNA, 25 bp, Homo sapien
ggcattcttctccaggggagggcta

SEQ ID NO: 124859 - DNA, 25 bp, Homo sapien
tcctctgtaagaggggagggcattc

SEQ ID NO: 124860 - DNA, 25 bp, Homo sapien
tgtgacgtcacgaatcggtcctctg

SEQ ID NO: 124861 - DNA, 25 bp, Homo sapien
accgcgtcgctttgtccgaaagaca

SEQ ID NO: 124862 - DNA, 25 bp, Homo sapien
gtcgcgatcaggctgcgtctcctgc

SEQ ID NO: 124863 - DNA, 25 bp, Homo sapien
caggtcgcgatcaggctgcgtctcc

SEQ ID NO: 124864 - DNA, 25 bp, Homo sapien
cgcaggtcgcgatcaggctgcgtct

SEQ ID NO: 124865 - DNA, 25 bp, Homo sapien
atgcatatgcatgagcggcgcggcg

SEQ ID NO: 124866 - DNA, 25 bp, Homo sapien
ctgcgcggcgtcatgcatatgcatg

SEQ ID NO: 124867 - DNA, 25 bp, Homo sapien
gctgcgcggcgtcatgcatatgcat

SEQ ID NO: 124868 - DNA, 25 bp, Homo sapien
cctgccgctttgggccgctcgggct

SEQ ID NO: 124869 - DNA, 25 bp, Homo sapien
aggtcgcgatcaggctgcgtctcct

SEQ ID NO: 124870 - DNA, 25 bp, Homo sapien
ttacgtgcccaccagcacggcgatg

SEQ ID NO: 124871 - DNA, 25 bp, Homo sapien
gggccttcgctccaacctgatcgtt

SEQ ID NO: 124872 - DNA, 25 bp, Homo sapien
cctgatcgttcctagctttggggcc

SEQ ID NO: 124873 - DNA, 25 bp, Homo sapien
aggcagtctcacctacatggtacgc

SEQ ID NO: 124874 - DNA, 25 bp, Homo sapien
cgtgcccaccagcacggcgatgtgg

SEQ ID NO: 124875 - DNA, 25 bp, Homo sapien
agctgttccgctcctgggctgaacg

SEQ ID NO: 124876 - DNA, 25 bp, Homo sapien
gctcctgggctgaacgacgctgagc

SEQ ID NO: 124877 - DNA, 25 bp, Homo sapien
tggggccaggcagtctcacctacat

SEQ ID NO: 124878 - DNA, 25 bp, Homo sapien
ggaaaaccgtgtactattagccatg

SEQ ID NO: 124879 - DNA, 25 bp, Homo sapien
tgaggcctgcgttcgcctcagttgc

SEQ ID NO: 124880 - DNA, 25 bp, Homo sapien
ccatttcctgacgaggggccatttt

SEQ ID NO: 124881 - DNA, 25 bp, Homo sapien
gctcgtgccgttttgcagacgccac

SEQ ID NO: 124882 - DNA, 25 bp, Homo sapien
atcgcttgacaacggccgaagagcc

SEQ ID NO: 124883 - DNA, 25 bp, Homo sapien
cgccggcttccgtctataggccaga

SEQ ID NO: 124884 - DNA, 25 bp, Homo sapien
gatgcactgtcactctggcgaagtc

SEQ ID NO: 124885 - DNA, 25 bp, Homo sapien
ggagacgcgcctcatcgcttgacaa

SEQ ID NO: 124886 - DNA, 25 bp, Homo sapien
gcaccgccttcctaacggctgtttg

SEQ ID NO: 124887 - DNA, 25 bp, Homo sapien
gccactgggaaggacagcaaaatta

SEQ ID NO: 124888 - DNA, 25 bp, Homo sapien
ccaatgagattggacgcctcgcaga

SEQ ID NO: 124889 - DNA, 25 bp, Homo sapien
tcctccttctaagacgggcggtgca

SEQ ID NO: 124890 - DNA, 25 bp, Homo sapien
cgtcacaagcgtcgggacagatcta

SEQ ID NO: 124891 - DNA, 25 bp, Homo sapien
tatccggctcggaacagacttcgcg

SEQ ID NO: 124892 - DNA, 25 bp, Homo sapien
atagtgacgcgctctctgcctttca

SEQ ID NO: 124893 - DNA, 25 bp, Homo sapien
atgcccgcttgtcttgctggttcga

SEQ ID NO: 124894 - DNA, 25 bp, Homo sapien
ccgaggcttcgaggttttcatgaaa

SEQ ID NO: 124895 - DNA, 25 bp, Homo sapien
tccctctcggggagaatctcatttc

SEQ ID NO: 124896 - DNA, 25 bp, Homo sapien
tgcccgcgccaaagcctggtggaat

SEQ ID NO: 124897 - DNA, 25 bp, Homo sapien
tggcatcgtcatttcttaaccgcgg

SEQ ID NO: 124898 - DNA, 25 bp, Homo sapien
acaactggcttgtctacgtggcatc

SEQ ID NO: 124899 - DNA, 25 bp, Homo sapien
ggcgagtcctctttatcagtgcagc

SEQ ID NO: 124900 - DNA, 25 bp, Homo sapien
ctgggacatcgcctccgaaagctgc

SEQ ID NO: 124901 - DNA, 25 bp, Homo sapien
tcggtagttcagtagcacgttgtgc

SEQ ID NO: 124902 - DNA, 25 bp, Homo sapien
gcccgcagggcgaataagcctagaa

SEQ ID NO: 124903 - DNA, 25 bp, Homo sapien
tagaaacacgctaggcctcagtgca

SEQ ID NO: 124904 - DNA, 25 bp, Homo sapien
ctcggggaacaaaggtgacgctgac

SEQ ID NO: 124905 - DNA, 25 bp, Homo sapien
acggagcccttcctgtgaatgactc

SEQ ID NO: 124906 - DNA, 25 bp, Homo sapien
agatgctgatctggccctatccaga

SEQ ID NO: 124907 - DNA, 25 bp, Homo sapien
agggcatcggatgagcgcatcttca

SEQ ID NO: 124908 - DNA, 25 bp, Homo sapien
agccttgtcaacaccacagcagata

SEQ ID NO: 124909 - DNA, 25 bp, Homo sapien
gcagataccgaacaacgccggcttg

SEQ ID NO: 124910 - DNA, 25 bp, Homo sapien
cccaacgcggttgtccaatggcggc

SEQ ID NO: 124911 - DNA, 25 bp, Homo sapien
aggcacaccacgaggtcgtcctggc

SEQ ID NO: 124912 - DNA, 25 bp, Homo sapien
agcggtgcaggcacaccacgaggtc

SEQ ID NO: 124913 - DNA, 25 bp, Homo sapien
gatgcagtcggagacgcgaacctcc

SEQ ID NO: 124914 - DNA, 25 bp, Homo sapien
ctccacggagatgaggcgccggacc

SEQ ID NO: 124915 - DNA, 25 bp, Homo sapien
ggctgactcagaaggtttatttgca

SEQ ID NO: 124916 - DNA, 25 bp, Homo sapien
tccggcctgggctccacggagatga

SEQ ID NO: 124917 - DNA, 25 bp, Homo sapien
tcggagacgcgaacctccagggtgc

SEQ ID NO: 124918 - DNA, 25 bp, Homo sapien
gcttggtctccaagaatcactggtg

SEQ ID NO: 124919 - DNA, 25 bp, Homo sapien
ttgttaccctcctttagtgaccaga

SEQ ID NO: 124920 - DNA, 25 bp, Homo sapien
ggagtctctcgaccgccctttgtta

SEQ ID NO: 124921 - DNA, 25 bp, Homo sapien
tgcgtctgcgtgtcaactcagtgga

SEQ ID NO: 124922 - DNA, 25 bp, Homo sapien
cggagtacaggtctgccagccaaga

SEQ ID NO: 124923 - DNA, 25 bp, Homo sapien
cgctgcgactacgaagtacggagta

SEQ ID NO: 124924 - DNA, 25 bp, Homo sapien
tggatgactagactgccgaagaccg

SEQ ID NO: 124925 - DNA, 25 bp, Homo sapien
ctcaggaatggtcaggcaacacgtg

SEQ ID NO: 124926 - DNA, 25 bp, Homo sapien
gagcgtttccggctctcctgaagga

SEQ ID NO: 124927 - DNA, 25 bp, Homo sapien
attgaaaaagttggagctgctcccg

SEQ ID NO: 124928 - DNA, 25 bp, Homo sapien
atcttcagcctgtgggcggtgctct

SEQ ID NO: 124929 - DNA, 25 bp, Homo sapien
ccaacgggccgtgttctccctgaag

SEQ ID NO: 124930 - DNA, 25 bp, Homo sapien
tcggattcccttgggcctgaaagtg

SEQ ID NO: 124931 - DNA, 25 bp, Homo sapien
ctgaaagtgaggatgagcgacaacc

SEQ ID NO: 124932 - DNA, 25 bp, Homo sapien
ctcgcggccgtgcagaagcgaagta

SEQ ID NO: 124933 - DNA, 25 bp, Homo sapien
cttttcagagacctgagctccgcct

SEQ ID NO: 124934 - DNA, 25 bp, Homo sapien
ctgccagctctcagaacgctacggg

SEQ ID NO: 124935 - DNA, 25 bp, Homo sapien
cagctctcagaacgctacgggccgg

SEQ ID NO: 124936 - DNA, 25 bp, Homo sapien
ctctcagaacgctacgggccggtgt

SEQ ID NO: 124937 - DNA, 25 bp, Homo sapien
ctcagaacgctacgggccggtgttc

SEQ ID NO: 124938 - DNA, 25 bp, Homo sapien
ctacgggccggtgttcaccgtgcac

SEQ ID NO: 124939 - DNA, 25 bp, Homo sapien
ccggtgttcaccgtgcacctggggc

SEQ ID NO: 124940 - DNA, 25 bp, Homo sapien
ggcgccagaagacggtggtgctgac

SEQ ID NO: 124941 - DNA, 25 bp, Homo sapien
tcaccgtgcacctggggcgccagaa

SEQ ID NO: 124942 - DNA, 25 bp, Homo sapien
caggctggcagctcggtgcaaacaa

SEQ ID NO: 124943 - DNA, 25 bp, Homo sapien
cacgatccctgggtcggaagccaag

SEQ ID NO: 124944 - DNA, 25 bp, Homo sapien
ccacgttctttctggctcgcggcgg

SEQ ID NO: 124945 - DNA, 25 bp, Homo sapien
tcccggtggtcacctgatcgtactg

SEQ ID NO: 124946 - DNA, 25 bp, Homo sapien
gtgcaactgaggaccctcccggtgg

SEQ ID NO: 124947 - DNA, 25 bp, Homo sapien
acagaccgggtgcaactgaggaccc

SEQ ID NO: 124948 - DNA, 25 bp, Homo sapien
ccggcccaggacagaccgggtgcaa

SEQ ID NO: 124949 - DNA, 25 bp, Homo sapien
tcggtgcaaacaacgggatgcagcg

SEQ ID NO: 124950 - DNA, 25 bp, Homo sapien
cagtacgccatcctcatacggagtg

SEQ ID NO: 124951 - DNA, 25 bp, Homo sapien
cggagcgataggtcatgggaaactt

SEQ ID NO: 124952 - DNA, 25 bp, Homo sapien
cggccacacctttcggcgggtgaca

SEQ ID NO: 124953 - DNA, 25 bp, Homo sapien
gttgtgcactcgaaacccacgatca

SEQ ID NO: 124954 - DNA, 25 bp, Homo sapien
gccacgcctgtgttgtgcactcgaa

SEQ ID NO: 124955 - DNA, 25 bp, Homo sapien
ccagcacggaacgagcagacggcca

SEQ ID NO: 124956 - DNA, 25 bp, Homo sapien
tgccacaagacctacgcagcgagca

SEQ ID NO: 124957 - DNA, 25 bp, Homo sapien
tgcgggagacgaccctttgttgtcg

SEQ ID NO: 124958 - DNA, 25 bp, Homo sapien
actctggcgggcaagggaggcacag

SEQ ID NO: 124959 - DNA, 25 bp, Homo sapien
tccttctagttgtgatgtcccccca

SEQ ID NO: 124960 - DNA, 25 bp, Homo sapien
gaagctgaaggcgaaggactctggc

SEQ ID NO: 124961 - DNA, 25 bp, Homo sapien
cgcacagtgaccctggcgggattcc

SEQ ID NO: 124962 - DNA, 25 bp, Homo sapien
ctgcgccgcggtccttcccttgccc

SEQ ID NO: 124963 - DNA, 25 bp, Homo sapien
ccagccatggagactggagcgctgc

SEQ ID NO: 124964 - DNA, 25 bp, Homo sapien
cagcgggaccgagcgtgacccagct

SEQ ID NO: 124965 - DNA, 25 bp, Homo sapien
cccacatctggaggcaacggggcac

SEQ ID NO: 124966 - DNA, 25 bp, Homo sapien
ggtgtgttcaaggtcactcctacga

SEQ ID NO: 124967 - DNA, 25 bp, Homo sapien
gtcaccttcgtgtcctatgccttgc

SEQ ID NO: 124968 - DNA, 25 bp, Homo sapien
cggacacacttgctgggacgatgct

SEQ ID NO: 124969 - DNA, 25 bp, Homo sapien
cgcccacgtctctggaggacggtaa

SEQ ID NO: 124970 - DNA, 25 bp, Homo sapien
acgaggagttcgcttgcccagagct

SEQ ID NO: 124971 - DNA, 25 bp, Homo sapien
tggtaaccaacgtccggtccctgca

SEQ ID NO: 124972 - DNA, 25 bp, Homo sapien
ccgaacaaggggtttggcagctcct

SEQ ID NO: 124973 - DNA, 25 bp, Homo sapien
tggcagctccttttggtcaccttcg

SEQ ID NO: 124974 - DNA, 25 bp, Homo sapien
tgagtggcggtctcctgcgaagtca

SEQ ID NO: 124975 - DNA, 25 bp, Homo sapien
gcggtctcctgcgaagtcacaagag

SEQ ID NO: 124976 - DNA, 25 bp, Homo sapien
ggtctcctgcgaagtcacaagagcg

SEQ ID NO: 124977 - DNA, 25 bp, Homo sapien
gtggcggtctcctgcgaagtcacaa

SEQ ID NO: 124978 - DNA, 25 bp, Homo sapien
cgccacaggagcgggtgttcgccta

SEQ ID NO: 124979 - DNA, 25 bp, Homo sapien
tccgcgacgccacaggagcgggtgt

SEQ ID NO: 124980 - DNA, 25 bp, Homo sapien
ctcctgcgaagtcacaagagcgcgc

SEQ ID NO: 124981 - DNA, 25 bp, Homo sapien
tctcctgcgaagtcacaagagcgcg

SEQ ID NO: 124982 - DNA, 25 bp, Homo sapien
ccacagagaccttccggagcgagtt

SEQ ID NO: 124983 - DNA, 25 bp, Homo sapien
tgctcgcttggaaagcgtcctcgga

SEQ ID NO: 124984 - DNA, 25 bp, Homo sapien
tgcaacgcacctctccgtgggaagg

SEQ ID NO: 124985 - DNA, 25 bp, Homo sapien
acagctcggtgctcagtgcttctga

SEQ ID NO: 124986 - DNA, 25 bp, Homo sapien
cagatgctgcatccaacgagccaga

SEQ ID NO: 124987 - DNA, 25 bp, Homo sapien
tttttatgaatgagcactcggggcc

SEQ ID NO: 124988 - DNA, 25 bp, Homo sapien
gaggcccaacttgaccgctcggtga

SEQ ID NO: 124989 - DNA, 25 bp, Homo sapien
cgcctttagatttcgggcagcaagt

SEQ ID NO: 124990 - DNA, 25 bp, Homo sapien
tgctcctgctgactgtccaggtcgg

SEQ ID NO: 124991 - DNA, 25 bp, Homo sapien
tccaccatcacttgcccagagtttg

SEQ ID NO: 124992 - DNA, 25 bp, Homo sapien
gctgtgtccagcgagcatcggccac

SEQ ID NO: 124993 - DNA, 25 bp, Homo sapien
ccctttataaggtgcgcgctgtgtc

SEQ ID NO: 124994 - DNA, 25 bp, Homo sapien
tggcgcggcctgtgccctttataag

SEQ ID NO: 124995 - DNA, 25 bp, Homo sapien
ttaacctcctggtgcaagtggcgcg

SEQ ID NO: 124996 - DNA, 25 bp, Homo sapien
gcgctgccaatcattaacctcctgg

SEQ ID NO: 124997 - DNA, 25 bp, Homo sapien
ctgcgtgcaggagtctgacgcctcc

SEQ ID NO: 124998 - DNA, 25 bp, Homo sapien
gcccgggtcaccttgtcgtctacaa

SEQ ID NO: 124999 - DNA, 25 bp, Homo sapien
cgctatatagaagccggggtggccc

SEQ ID NO: 125000 - DNA, 25 bp, Homo sapien
ggaagcggctgatcctcagcgccca

SEQ ID NO: 125001 - DNA, 25 bp, Homo sapien
acacggcgcgaagctgtggaatcca

SEQ ID NO: 125002 - DNA, 25 bp, Homo sapien
cgctcagtgcgcacgtcaggcagca

SEQ ID NO: 125003 - DNA, 25 bp, Homo sapien
tgtagatgccgcacggctggccctc

SEQ ID NO: 125004 - DNA, 25 bp, Homo sapien
ctgacggcactagcgttgacgcaga

SEQ ID NO: 125005 - DNA, 25 bp, Homo sapien
gtcgtctacaagaaccaaggtgtgc

SEQ ID NO: 125006 - DNA, 25 bp, Homo sapien
tatagcccgtctccctacaggagat

SEQ ID NO: 125007 - DNA, 25 bp, Homo sapien
ctacagggaatctcactacagggaa

SEQ ID NO: 125008 - DNA, 25 bp, Homo sapien
cctacagggaatctcactacaggga

SEQ ID NO: 125009 - DNA, 25 bp, Homo sapien
gcccgtctccctacaggagatctcg

SEQ ID NO: 125010 - DNA, 25 bp, Homo sapien
tagcccgtctccctacaggagatct

SEQ ID NO: 125011 - DNA, 25 bp, Homo sapien
gggaatctcactacagggaatctcg

SEQ ID NO: 125012 - DNA, 25 bp, Homo sapien
agggaatctcactacagggaatctc

SEQ ID NO: 125013 - DNA, 25 bp, Homo sapien
acagggaatctcactacagggaatc

SEQ ID NO: 125014 - DNA, 25 bp, Homo sapien
cacaccgggaccagcggcacccaca

SEQ ID NO: 125015 - DNA, 25 bp, Homo sapien
gtcctcggctcagcttcggaagcgc

SEQ ID NO: 125016 - DNA, 25 bp, Homo sapien
cggcgtcctcggctcagcttcggaa

SEQ ID NO: 125017 - DNA, 25 bp, Homo sapien
ctgagccaggctcaggtcgcggagt

SEQ ID NO: 125018 - DNA, 25 bp, Homo sapien
accctgcgcggaagcacgcctggca

SEQ ID NO: 125019 - DNA, 25 bp, Homo sapien
agatctcgacggttcctatctattc

SEQ ID NO: 125020 - DNA, 25 bp, Homo sapien
agaacgtccggccaccctgcgcgga

SEQ ID NO: 125021 - DNA, 25 bp, Homo sapien
ccctgcgagatctcgacggttccta

SEQ ID NO: 125022 - DNA, 25 bp, Homo sapien
cctggacgtgcctgaggcccgtctc

SEQ ID NO: 125023 - DNA, 25 bp, Homo sapien
tcggccgccgatttgactaccggga

SEQ ID NO: 125024 - DNA, 25 bp, Homo sapien
tcttcggccgccgatttgactaccg

SEQ ID NO: 125025 - DNA, 25 bp, Homo sapien
ggctccctccaatatcaccttcgcg

SEQ ID NO: 125026 - DNA, 25 bp, Homo sapien
caatatcaccttcgcgctcctcttc

SEQ ID NO: 125027 - DNA, 25 bp, Homo sapien
gctgggctccctccaatatcacctt

SEQ ID NO: 125028 - DNA, 25 bp, Homo sapien
aggcccgtctccctcgcaggccggc

SEQ ID NO: 125029 - DNA, 25 bp, Homo sapien
cttcggccgccgatttgactaccgg

SEQ ID NO: 125030 - DNA, 25 bp, Homo sapien
ctctctgggcagctggatggctaca

SEQ ID NO: 125031 - DNA, 25 bp, Homo sapien
gagctgaaatgcctctctgggcagc

SEQ ID NO: 125032 - DNA, 25 bp, Homo sapien
caggagctgaaatgcctctctgggc

SEQ ID NO: 125033 - DNA, 25 bp, Homo sapien
ctgcaggagctgaaatgcctctctg

SEQ ID NO: 125034 - DNA, 25 bp, Homo sapien
ttctgcaggagctgaaatgcctctc

SEQ ID NO: 125035 - DNA, 25 bp, Homo sapien
caagattctgcaggagctgaaatgc

SEQ ID NO: 125036 - DNA, 25 bp, Homo sapien
agccggtggctgacaagattctgca

SEQ ID NO: 125037 - DNA, 25 bp, Homo sapien
gcccgccagttcacggtgcgtgccc

SEQ ID NO: 125038 - DNA, 25 bp, Homo sapien
attggaattaccgacgcgccgcgct

SEQ ID NO: 125039 - DNA, 25 bp, Homo sapien
tcagacgccgggaacaaaagccagg

SEQ ID NO: 125040 - DNA, 25 bp, Homo sapien
tttcaaacctctccgagaacgctgg

SEQ ID NO: 125041 - DNA, 25 bp, Homo sapien
ggcgtccctccatctgacacgaatt

SEQ ID NO: 125042 - DNA, 25 bp, Homo sapien
ctgcggacacaagtcccaggaaatg

SEQ ID NO: 125043 - DNA, 25 bp, Homo sapien
tgcagccgccatctgattggaatta

SEQ ID NO: 125044 - DNA, 25 bp, Homo sapien
cgcagggttcagctttactaggatt

SEQ ID NO: 125045 - DNA, 25 bp, Homo sapien
ggctgagccgccaaacactgggaaa

SEQ ID NO: 125046 - DNA, 25 bp, Homo sapien
acgggtcccactcgagtggtcctgc

SEQ ID NO: 125047 - DNA, 25 bp, Homo sapien
tcctagggagcaaagtccgctcggt

SEQ ID NO: 125048 - DNA, 25 bp, Homo sapien
cgaaacaaagaggaccgcggcgcgt

SEQ ID NO: 125049 - DNA, 25 bp, Homo sapien
gtcccgacagcgactgcgacatagc

SEQ ID NO: 125050 - DNA, 25 bp, Homo sapien
agcgactgcgacatagctgctccgg

SEQ ID NO: 125051 - DNA, 25 bp, Homo sapien
agcaaagtccgctcggtcccgacag

SEQ ID NO: 125052 - DNA, 25 bp, Homo sapien
gtctctgccctcagtccagggcgcc

SEQ ID NO: 125053 - DNA, 25 bp, Homo sapien
tgcgacatagctgctccggtctctg

SEQ ID NO: 125054 - DNA, 25 bp, Homo sapien
cgtccacgatcttggcccgaaactt

SEQ ID NO: 125055 - DNA, 25 bp, Homo sapien
ggctacgcgactcttaccagggtta

SEQ ID NO: 125056 - DNA, 25 bp, Homo sapien
gtcacgggtcaaggatcacaggtca

SEQ ID NO: 125057 - DNA, 25 bp, Homo sapien
ccggaaacacggcagcgcgaacagt

SEQ ID NO: 125058 - DNA, 25 bp, Homo sapien
acagaaaagcgtcgcgccctgagtg

SEQ ID NO: 125059 - DNA, 25 bp, Homo sapien
gcgggcctctgtgggtaacagaaaa

SEQ ID NO: 125060 - DNA, 25 bp, Homo sapien
gcccgaaacttcatggccgcggatg

SEQ ID NO: 125061 - DNA, 25 bp, Homo sapien
agtctccgggtatgcctccgcgctg

SEQ ID NO: 125062 - DNA, 25 bp, Homo sapien
tgcagccagccagccgtgtaaaaac

SEQ ID NO: 125063 - DNA, 25 bp, Homo sapien
tgcctgtactggatacccggcgtga

SEQ ID NO: 125064 - DNA, 25 bp, Homo sapien
cgcacgcacgtgtctctgctgaata

SEQ ID NO: 125065 - DNA, 25 bp, Homo sapien
tcctgctgtataccggcgtgatgtg

SEQ ID NO: 125066 - DNA, 25 bp, Homo sapien
ctgctgtataccctgcatggaagtg

SEQ ID NO: 125067 - DNA, 25 bp, Homo sapien
cgcggattttgcttttgcagctgca

SEQ ID NO: 125068 - DNA, 25 bp, Homo sapien
agcatctgtcttttcccgcagcgtg

SEQ ID NO: 125069 - DNA, 25 bp, Homo sapien
gcagctcctggcaactggtcaagca

SEQ ID NO: 125070 - DNA, 25 bp, Homo sapien
gccggtttgaggcagttcggccact

SEQ ID NO: 125071 - DNA, 25 bp, Homo sapien
gaccaggaaagacgcctgagacgga

SEQ ID NO: 125072 - DNA, 25 bp, Homo sapien
acgcctgagacggagagtgggcacc

SEQ ID NO: 125073 - DNA, 25 bp, Homo sapien
tttgaggcagttcggccacttagct

SEQ ID NO: 125074 - DNA, 25 bp, Homo sapien
cggccacttagctgcgactcgaagt

SEQ ID NO: 125075 - DNA, 25 bp, Homo sapien
cttagctgcgactcgaagtgaatga

SEQ ID NO: 125076 - DNA, 25 bp, Homo sapien
gctgcgactcgaagtgaatgagtca

SEQ ID NO: 125077 - DNA, 25 bp, Homo sapien
agaggaccaggaaagacgcctgaga

SEQ ID NO: 125078 - DNA, 25 bp, Homo sapien
caagcgggaactcccaggatcagga

SEQ ID NO: 125079 - DNA, 25 bp, Homo sapien
ctcccaggatcaggaaggtcccaga

SEQ ID NO: 125080 - DNA, 25 bp, Homo sapien
gccgtccagagagatccagggtaca

SEQ ID NO: 125081 - DNA, 25 bp, Homo sapien
tccagggtacacacagtgacagtgc

SEQ ID NO: 125082 - DNA, 25 bp, Homo sapien
acacacagtgacagtgccagctcca

SEQ ID NO: 125083 - DNA, 25 bp, Homo sapien
gctggttccacgctgtcatttctct

SEQ ID NO: 125084 - DNA, 25 bp, Homo sapien
cgtgaccttgggttagtcctagagc

SEQ ID NO: 125085 - DNA, 25 bp, Homo sapien
ctagagccgcttctagcccggtttc

SEQ ID NO: 125086 - DNA, 25 bp, Homo sapien
gggcgaaggcatcctggaaagcatc

SEQ ID NO: 125087 - DNA, 25 bp, Homo sapien
cttgacccagcgctgcacgggagag

SEQ ID NO: 125088 - DNA, 25 bp, Homo sapien
gaaagcatccagagcgtccagcatc

SEQ ID NO: 125089 - DNA, 25 bp, Homo sapien
gggcagaccctcagactcaatccag

SEQ ID NO: 125090 - DNA, 25 bp, Homo sapien
tcgcaggccaagttcgccagggcac

SEQ ID NO: 125091 - DNA, 25 bp, Homo sapien
tcaatccagtccagggcggattaag

SEQ ID NO: 125092 - DNA, 25 bp, Homo sapien
ccggcctctttctgggttcaggatc

SEQ ID NO: 125093 - DNA, 25 bp, Homo sapien
cgggcctcaccgagtcagctacgga

SEQ ID NO: 125094 - DNA, 25 bp, Homo sapien
agctttcagagttcagatggcgtca

SEQ ID NO: 125095 - DNA, 25 bp, Homo sapien
ggccacgtgcccatttacctgtagg

SEQ ID NO: 125096 - DNA, 25 bp, Homo sapien
ggaactccgcagctcgtcgacacgt

SEQ ID NO: 125097 - DNA, 25 bp, Homo sapien
tggcaacctgttcttggacctggca

SEQ ID NO: 125098 - DNA, 25 bp, Homo sapien
ggcagctccgcagagaaacttcaca

SEQ ID NO: 125099 - DNA, 25 bp, Homo sapien
aggatgattgttacgcgagctttca

SEQ ID NO: 125100 - DNA, 25 bp, Homo sapien
gtggccatcgagtcaacatttaaca

SEQ ID NO: 125101 - DNA, 25 bp, Homo sapien
tgtcatcgagttatctggcagctcc

SEQ ID NO: 125102 - DNA, 25 bp, Homo sapien
ctttaggtgcataaaggggacactc

SEQ ID NO: 125103 - DNA, 25 bp, Homo sapien
ggcccgcaactgtgcagggcgtcca

SEQ ID NO: 125104 - DNA, 25 bp, Homo sapien
cgctctaagcgcagcggagctcaca

SEQ ID NO: 125105 - DNA, 25 bp, Homo sapien
caaggcccagcttccgcactttagg

SEQ ID NO: 125106 - DNA, 25 bp, Homo sapien
ggggacactcaagggagtcctcatg

SEQ ID NO: 125107 - DNA, 25 bp, Homo sapien
attcccatggctgcgagatgccgca

SEQ ID NO: 125108 - DNA, 25 bp, Homo sapien
gggcctgcgtcgcattcccatggct

SEQ ID NO: 125109 - DNA, 25 bp, Homo sapien
gcaaacgaggcaaagcgctgtcacc

SEQ ID NO: 125110 - DNA, 25 bp, Homo sapien
ggccgcagccggtcagggagcaacg

SEQ ID NO: 125111 - DNA, 25 bp, Homo sapien
cggccgcagccggtcagggagcaac

SEQ ID NO: 125112 - DNA, 25 bp, Homo sapien
cacagagcggccttgcggggatggc

SEQ ID NO: 125113 - DNA, 25 bp, Homo sapien
acagagcggccttgcggggatggcc

SEQ ID NO: 125114 - DNA, 25 bp, Homo sapien
cagagcggccttgcggggatggccg

SEQ ID NO: 125115 - DNA, 25 bp, Homo sapien
agagcggccttgcggggatggccgg

SEQ ID NO: 125116 - DNA, 25 bp, Homo sapien
gagcggccttgcggggatggccgga

SEQ ID NO: 125117 - DNA, 25 bp, Homo sapien
gcacagagcggccttgcggggatgg

SEQ ID NO: 125118 - DNA, 25 bp, Homo sapien
tgaagggctatatcatactgacatc

SEQ ID NO: 125119 - DNA, 25 bp, Homo sapien
ttgccagattgagtggtccaaagtc

SEQ ID NO: 125120 - DNA, 25 bp, Homo sapien
tgtacatttgatgcactctttggtc

SEQ ID NO: 125121 - DNA, 25 bp, Homo sapien
ctttggtctgctgtagagaatggca

SEQ ID NO: 125122 - DNA, 25 bp, Homo sapien
aaacgaaggcgatcggtgatgtcca

SEQ ID NO: 125123 - DNA, 25 bp, Homo sapien
cctgcagcgtggagctgcgcatctt

SEQ ID NO: 125124 - DNA, 25 bp, Homo sapien
ttttaaaccatgaactgaagggcta

SEQ ID NO: 125125 - DNA, 25 bp, Homo sapien
gtccaaagtcttcggagaagttctc

SEQ ID NO: 125126 - DNA, 25 bp, Homo sapien
cgtccctgcaatgccgctctgtgcc

SEQ ID NO: 125127 - DNA, 25 bp, Homo sapien
cccgccgtccctgcaatgccgctct

SEQ ID NO: 125128 - DNA, 25 bp, Homo sapien
ggctcccgccgtccctgcaatgccg

SEQ ID NO: 125129 - DNA, 25 bp, Homo sapien
ccggctcccgccgtccctgcaatgc

SEQ ID NO: 125130 - DNA, 25 bp, Homo sapien
tgcaccaccgcctcttttcgggctc

SEQ ID NO: 125131 - DNA, 25 bp, Homo sapien
gccgtccctgcaatgccgctctgtg

SEQ ID NO: 125132 - DNA, 25 bp, Homo sapien
ggcactggcgccagccttggcggcg

SEQ ID NO: 125133 - DNA, 25 bp, Homo sapien
ctcccgccgtccctgcaatgccgct

SEQ ID NO: 125134 - DNA, 25 bp, Homo sapien
tttggctgaatttccagagactgga

SEQ ID NO: 125135 - DNA, 25 bp, Homo sapien
tccaggtggttgctatgacaagagc

SEQ ID NO: 125136 - DNA, 25 bp, Homo sapien
tgatgtcagtatgatatagcccttc

SEQ ID NO: 125137 - DNA, 25 bp, Homo sapien
tagcccttcagttcatggtttaaaa

SEQ ID NO: 125138 - DNA, 25 bp, Homo sapien
tggacatcaccgatcgccttcgttt

SEQ ID NO: 125139 - DNA, 25 bp, Homo sapien
tccgaagactttggaccactcaatc

SEQ ID NO: 125140 - DNA, 25 bp, Homo sapien
cgccttcgttttgccattctctaca

SEQ ID NO: 125141 - DNA, 25 bp, Homo sapien
ttctctacagcagaccaaagagtgc

SEQ ID NO: 125142 - DNA, 25 bp, Homo sapien
ttaatctagagctatgccggagccc

SEQ ID NO: 125143 - DNA, 25 bp, Homo sapien
ccgtcgcccagctcgttaatctaga

SEQ ID NO: 125144 - DNA, 25 bp, Homo sapien
cggtgtcgttcttggatttcgcttc

SEQ ID NO: 125145 - DNA, 25 bp, Homo sapien
tacgtggttcaaggcagagctttgc

SEQ ID NO: 125146 - DNA, 25 bp, Homo sapien
ccctgggtgcctgaattacgtggtt

SEQ ID NO: 125147 - DNA, 25 bp, Homo sapien
gtccgtctctaactccactgctgaa

SEQ ID NO: 125148 - DNA, 25 bp, Homo sapien
ggagtcctaggagaagctttgttta

SEQ ID NO: 125149 - DNA, 25 bp, Homo sapien
gcatcctttcatgcagcggggctta

SEQ ID NO: 125150 - DNA, 25 bp, Homo sapien
tcaacgtctacccatggctcggggc

SEQ ID NO: 125151 - DNA, 25 bp, Homo sapien
agccgctggggacgatcaccgcctg

SEQ ID NO: 125152 - DNA, 25 bp, Homo sapien
tggggctgcgtccttatctccgctc

SEQ ID NO: 125153 - DNA, 25 bp, Homo sapien
tgcgtccttatctccgctcctcctg

SEQ ID NO: 125154 - DNA, 25 bp, Homo sapien
gcctcctgcccagctgttcaacgtc

SEQ ID NO: 125155 - DNA, 25 bp, Homo sapien
cagctgttcaacgtctacccatggc

SEQ ID NO: 125156 - DNA, 25 bp, Homo sapien
gctgttcaacgtctacccatggctc

SEQ ID NO: 125157 - DNA, 25 bp, Homo sapien
tgttcaacgtctacccatggctcgg

SEQ ID NO: 125158 - DNA, 25 bp, Homo sapien
ctgatgagggcacccgcaccaggaa

SEQ ID NO: 125159 - DNA, 25 bp, Homo sapien
aagctgcggttgtccctgcggagcc

SEQ ID NO: 125160 - DNA, 25 bp, Homo sapien
gcacgtgacacaagaaaaggcaatt

SEQ ID NO: 125161 - DNA, 25 bp, Homo sapien
cgcggaccctcacctgatgagggca

SEQ ID NO: 125162 - DNA, 25 bp, Homo sapien
ccggaacaacggacctgatggacgt

SEQ ID NO: 125163 - DNA, 25 bp, Homo sapien
aagggcgaaggcctccatccacacg

SEQ ID NO: 125164 - DNA, 25 bp, Homo sapien
tccgcgcggaaggtcgttaggcaac

SEQ ID NO: 125165 - DNA, 25 bp, Homo sapien
aggtcgttaggcaacgcgcgcccac

SEQ ID NO: 125166 - DNA, 25 bp, Homo sapien
gaaataaaggctgcttctccgcgct

SEQ ID NO: 125167 - DNA, 25 bp, Homo sapien
tcagctggacactgggcgcccgcca

SEQ ID NO: 125168 - DNA, 25 bp, Homo sapien
tgctgttctccgctggcctgcgcgt

SEQ ID NO: 125169 - DNA, 25 bp, Homo sapien
tcggtgctgttctccgctggcctgc

SEQ ID NO: 125170 - DNA, 25 bp, Homo sapien
ccgcctggggaaggcttgtgcggcg

SEQ ID NO: 125171 - DNA, 25 bp, Homo sapien
tgcgcagtgtggtgggttcggtgct

SEQ ID NO: 125172 - DNA, 25 bp, Homo sapien
ggaaataaaggctgcttctccgcgc

SEQ ID NO: 125173 - DNA, 25 bp, Homo sapien
gttcggtgctgttctccgctggcct

SEQ ID NO: 125174 - DNA, 25 bp, Homo sapien
gtctgggaaaatgaattgcaccttc

SEQ ID NO: 125175 - DNA, 25 bp, Homo sapien
cgctgtcagatgtggcattcccgtt

SEQ ID NO: 125176 - DNA, 25 bp, Homo sapien
ctcccttgcggaggatcaacttttc

SEQ ID NO: 125177 - DNA, 25 bp, Homo sapien
gccatcctaacttctgccgtgagca

SEQ ID NO: 125178 - DNA, 25 bp, Homo sapien
ggccaacatggaaggcgccatccta

SEQ ID NO: 125179 - DNA, 25 bp, Homo sapien
cacttgtgtgtgcacccaggccaac

SEQ ID NO: 125180 - DNA, 25 bp, Homo sapien
ctgcgggattgcttcgctgtcacct

SEQ ID NO: 125181 - DNA, 25 bp, Homo sapien
cacggtgtcttacacgccagggaga

SEQ ID NO: 125182 - DNA, 25 bp, Homo sapien
agcagggaccgccagcgtgcgtcac

SEQ ID NO: 125183 - DNA, 25 bp, Homo sapien
tgcgagtgagcaacttcaggaagtc

SEQ ID NO: 125184 - DNA, 25 bp, Homo sapien
ttcgcacccgaggatcagtcttggc

SEQ ID NO: 125185 - DNA, 25 bp, Homo sapien
tcaggaagtcattgtgaaagaaagc

SEQ ID NO: 125186 - DNA, 25 bp, Homo sapien
gcggccaagttagcaggacactcta

SEQ ID NO: 125187 - DNA, 25 bp, Homo sapien
ctctaacaagtgactgcgcggcccg

SEQ ID NO: 125188 - DNA, 25 bp, Homo sapien
tccgaggttgctcttcgcacccgag

SEQ ID NO: 125189 - DNA, 25 bp, Homo sapien
aaatggggaacaatgcgagtgagca

SEQ ID NO: 125190 - DNA, 25 bp, Homo sapien
ggctgcgtagctgagtctattaata

SEQ ID NO: 125191 - DNA, 25 bp, Homo sapien
cgtgaggctctccttgcacgtgggc

SEQ ID NO: 125192 - DNA, 25 bp, Homo sapien
tgggccttcgcggtttgcactacgg

SEQ ID NO: 125193 - DNA, 25 bp, Homo sapien
tttgcactacggaagctggactgtc

SEQ ID NO: 125194 - DNA, 25 bp, Homo sapien
tggactgtcattctcaccgcaaatg

SEQ ID NO: 125195 - DNA, 25 bp, Homo sapien
agccgcactggggaggccttattcc

SEQ ID NO: 125196 - DNA, 25 bp, Homo sapien
taaagaagcagagaacgaggcctcc

SEQ ID NO: 125197 - DNA, 25 bp, Homo sapien
gggctcttcggccttgaccgtgcgc

SEQ ID NO: 125198 - DNA, 25 bp, Homo sapien
gctgctctccaaggccaagttggtg

SEQ ID NO: 125199 - DNA, 25 bp, Homo sapien
cagcgcagcggtctcatctacctga

SEQ ID NO: 125200 - DNA, 25 bp, Homo sapien
tacaagtgcgaacactgccgggtgc

SEQ ID NO: 125201 - DNA, 25 bp, Homo sapien
acggcttccgtgatccttttgagtg

SEQ ID NO: 125202 - DNA, 25 bp, Homo sapien
tttgagtgcaacatgtgcggctacc

SEQ ID NO: 125203 - DNA, 25 bp, Homo sapien
gcggctaccacagccaggaccggta

SEQ ID NO: 125204 - DNA, 25 bp, Homo sapien
gggagcaccgcttccacatgagcta

SEQ ID NO: 125205 - DNA, 25 bp, Homo sapien
ccggtacgagttctcgtcgcacata

SEQ ID NO: 125206 - DNA, 25 bp, Homo sapien
tccgaccagtggtgttctataaacg

SEQ ID NO: 125207 - DNA, 25 bp, Homo sapien
ctgggcccagtaaatgcctgcggta

SEQ ID NO: 125208 - DNA, 25 bp, Homo sapien
tcgaaggattcccatagagcgtggc

SEQ ID NO: 125209 - DNA, 25 bp, Homo sapien
cacccgggagagcaaacaatggctc

SEQ ID NO: 125210 - DNA, 25 bp, Homo sapien
ccggacaggctctgccaaaggaagc

SEQ ID NO: 125211 - DNA, 25 bp, Homo sapien
gcggatccacttaggtcagcggtta

SEQ ID NO: 125212 - DNA, 25 bp, Homo sapien
ccctcttgaattcaggcctagcaca

SEQ ID NO: 125213 - DNA, 25 bp, Homo sapien
tcctaatcctggatgagtctggttc

SEQ ID NO: 125214 - DNA, 25 bp, Homo sapien
acacgtgtcatacgagtggttcctc

SEQ ID NO: 125215 - DNA, 25 bp, Homo sapien
tgctcattctaagcccgcggataca

SEQ ID NO: 125216 - DNA, 25 bp, Homo sapien
ggtggctgggacaaaaacacgtgtc

SEQ ID NO: 125217 - DNA, 25 bp, Homo sapien
agtggttcctcgtcatgccaccaga

SEQ ID NO: 125218 - DNA, 25 bp, Homo sapien
agcgccaaagacctcggcctcatgg

SEQ ID NO: 125219 - DNA, 25 bp, Homo sapien
aagacctcggcctcatgggcgatcc

SEQ ID NO: 125220 - DNA, 25 bp, Homo sapien
gtgccttgctcattctaagcccgcg

SEQ ID NO: 125221 - DNA, 25 bp, Homo sapien
tgccaccagagagcgccaaagacct

SEQ ID NO: 125222 - DNA, 25 bp, Homo sapien
ataatactgtcctatggctggcggc

SEQ ID NO: 125223 - DNA, 25 bp, Homo sapien
gcgcacactggccactctgacgatg

SEQ ID NO: 125224 - DNA, 25 bp, Homo sapien
cccggatccctggttctcatggcaa

SEQ ID NO: 125225 - DNA, 25 bp, Homo sapien
ggaatcccaggaccaaacccatgtg

SEQ ID NO: 125226 - DNA, 25 bp, Homo sapien
ccggtcctggagcacaacaggaatc

SEQ ID NO: 125227 - DNA, 25 bp, Homo sapien
cggagcccacctgagtacctggaga

SEQ ID NO: 125228 - DNA, 25 bp, Homo sapien
ctgacgatgccgaaagccctccatg

SEQ ID NO: 125229 - DNA, 25 bp, Homo sapien
aacgaagctcgggatctcggactgc

SEQ ID NO: 125230 - DNA, 25 bp, Homo sapien
cgaactgtttgaaacgcacaaagta

SEQ ID NO: 125231 - DNA, 25 bp, Homo sapien
cagatcctttatcctgggcgcagca

SEQ ID NO: 125232 - DNA, 25 bp, Homo sapien
gcttcgccagtgaaaggacaaattg

SEQ ID NO: 125233 - DNA, 25 bp, Homo sapien
tgcgcagtccagatcctttatcctg

SEQ ID NO: 125234 - DNA, 25 bp, Homo sapien
agacaatttataagcgaactgtttg

SEQ ID NO: 125235 - DNA, 25 bp, Homo sapien
tcctgctgtcctcgggactcgggcg

SEQ ID NO: 125236 - DNA, 25 bp, Homo sapien
gcacaaagtattaactgcgcagtcc

SEQ ID NO: 125237 - DNA, 25 bp, Homo sapien
tggacctgtcccgaaagacaattta

SEQ ID NO: 125238 - DNA, 25 bp, Homo sapien
acggaaggggctggaatcgtctcta

SEQ ID NO: 125239 - DNA, 25 bp, Homo sapien
actttttccgcgctgacccatcgtc

SEQ ID NO: 125240 - DNA, 25 bp, Homo sapien
acccgggtgcccaaagtacacagca

SEQ ID NO: 125241 - DNA, 25 bp, Homo sapien
ccataaggacgcctgcatacaaacc

SEQ ID NO: 125242 - DNA, 25 bp, Homo sapien
atccgaacaccttccgagaacgcgg

SEQ ID NO: 125243 - DNA, 25 bp, Homo sapien
cgggcaatccgaacaccttccgaga

SEQ ID NO: 125244 - DNA, 25 bp, Homo sapien
agctgctgccatgaaaccctccggg

SEQ ID NO: 125245 - DNA, 25 bp, Homo sapien
caggggagaccctggaataaaggca

SEQ ID NO: 125246 - DNA, 25 bp, Homo sapien
gggctcagacaccgattctaacaca

SEQ ID NO: 125247 - DNA, 25 bp, Homo sapien
ggctcagacaccgattccaacacgg

SEQ ID NO: 125248 - DNA, 25 bp, Homo sapien
cgattctaacacagaccctcacggg

SEQ ID NO: 125249 - DNA, 25 bp, Homo sapien
accgattccaacacggaccctcacg

SEQ ID NO: 125250 - DNA, 25 bp, Homo sapien
gctcagacaccgattccaacacgga

SEQ ID NO: 125251 - DNA, 25 bp, Homo sapien
ccgattccaacacggaccctcacgg

SEQ ID NO: 125252 - DNA, 25 bp, Homo sapien
ggctcagacaccgattctaacacag

SEQ ID NO: 125253 - DNA, 25 bp, Homo sapien
agacaccgattctaacacagaccct

SEQ ID NO: 125254 - DNA, 25 bp, Homo sapien
agcggttcatcacgctcctgccgca

SEQ ID NO: 125255 - DNA, 25 bp, Homo sapien
ggctctgccctacacaagcgccgtg

SEQ ID NO: 125256 - DNA, 25 bp, Homo sapien
ggcgcctggcgagacggctccttct

SEQ ID NO: 125257 - DNA, 25 bp, Homo sapien
gtgcagcggttcatcacgctcctgc

SEQ ID NO: 125258 - DNA, 25 bp, Homo sapien
tgcaggaggagctagaccgcgtgct

SEQ ID NO: 125259 - DNA, 25 bp, Homo sapien
gggacgagggatggcgctgccaccc

SEQ ID NO: 125260 - DNA, 25 bp, Homo sapien
ggtgcagcggttcatcacgctcctg

SEQ ID NO: 125261 - DNA, 25 bp, Homo sapien
tgccctacacaagcgccgtgctcca

SEQ ID NO: 125262 - DNA, 25 bp, Homo sapien
cacccggacgtgcagggtgagaccc

SEQ ID NO: 125263 - DNA, 25 bp, Homo sapien
acttctgatgggccggcacccggac

SEQ ID NO: 125264 - DNA, 25 bp, Homo sapien
accctggacatggtcatggccggga

SEQ ID NO: 125265 - DNA, 25 bp, Homo sapien
ccctggacatggtcatggccgggac

SEQ ID NO: 125266 - DNA, 25 bp, Homo sapien
ggacggagacgacctcggccacgct

SEQ ID NO: 125267 - DNA, 25 bp, Homo sapien
ccacgctgcagtgggccgcacttct

SEQ ID NO: 125268 - DNA, 25 bp, Homo sapien
cagtgggccgcacttctgatgggcc

SEQ ID NO: 125269 - DNA, 25 bp, Homo sapien
ggccgcacttctgatgggccggcac

SEQ ID NO: 125270 - DNA, 25 bp, Homo sapien
gtccaaagaccttattggaaggcca

SEQ ID NO: 125271 - DNA, 25 bp, Homo sapien
agaccttattggaaggccagagtct

SEQ ID NO: 125272 - DNA, 25 bp, Homo sapien
aagaccttattggaaggccagagtc

SEQ ID NO: 125273 - DNA, 25 bp, Homo sapien
caaagaccttattggaaggccagag

SEQ ID NO: 125274 - DNA, 25 bp, Homo sapien
ccaaagaccttattggaaggccaga

SEQ ID NO: 125275 - DNA, 25 bp, Homo sapien
ccactgtgaagccgaggctgggccc

SEQ ID NO: 125276 - DNA, 25 bp, Homo sapien
tccaaagaccttattggaaggccag

SEQ ID NO: 125277 - DNA, 25 bp, Homo sapien
aaagaccttattggaaggccagagt

SEQ ID NO: 125278 - DNA, 25 bp, Homo sapien
ctttctttgtttttcatgcaacata

SEQ ID NO: 125279 - DNA, 25 bp, Homo sapien
gccgaccggccgaatagcgctgctt

SEQ ID NO: 125280 - DNA, 25 bp, Homo sapien
accggccgaatagcgctgctttctt

SEQ ID NO: 125281 - DNA, 25 bp, Homo sapien
gccgaatagcgctgctttctttgtt

SEQ ID NO: 125282 - DNA, 25 bp, Homo sapien
agcgctgctttctttgtttttcatg

SEQ ID NO: 125283 - DNA, 25 bp, Homo sapien
tgcaacataattccatggccagtcc

SEQ ID NO: 125284 - DNA, 25 bp, Homo sapien
attccatggccagtccaggcgctgc

SEQ ID NO: 125285 - DNA, 25 bp, Homo sapien
acataattccatggccagtccaggc

SEQ ID NO: 125286 - DNA, 25 bp, Homo sapien
ggtcctgcactagcgcgaaggtcag

SEQ ID NO: 125287 - DNA, 25 bp, Homo sapien
ggagtgttgacagccaccgctttga

SEQ ID NO: 125288 - DNA, 25 bp, Homo sapien
agctgcggtccaagccagctcctgg

SEQ ID NO: 125289 - DNA, 25 bp, Homo sapien
gcgttcgtgcttagctgcagcgcct

SEQ ID NO: 125290 - DNA, 25 bp, Homo sapien
cagcgctctgtcactctgggaagga

SEQ ID NO: 125291 - DNA, 25 bp, Homo sapien
tctggcaccacagggctgcatgcgg

SEQ ID NO: 125292 - DNA, 25 bp, Homo sapien
cggcattccctgacctggcggggaa

SEQ ID NO: 125293 - DNA, 25 bp, Homo sapien
aaggtcagctccatgccggcgaggc

SEQ ID NO: 125294 - DNA, 25 bp, Homo sapien
cgagtccgcagacctcgggaacttc

SEQ ID NO: 125295 - DNA, 25 bp, Homo sapien
gcagacctcgggaacttctggaagg

SEQ ID NO: 125296 - DNA, 25 bp, Homo sapien
tggcggctcccatgagcaggtcacc

SEQ ID NO: 125297 - DNA, 25 bp, Homo sapien
agagccatattcagtacttccagtg

SEQ ID NO: 125298 - DNA, 25 bp, Homo sapien
cgctctggggcgagacctctcctgt

SEQ ID NO: 125299 - DNA, 25 bp, Homo sapien
ctgtgtcgtgcctggaacccaggac

SEQ ID NO: 125300 - DNA, 25 bp, Homo sapien
tggaacccaggacggacctggagcc

SEQ ID NO: 125301 - DNA, 25 bp, Homo sapien
gaggtccctgactcagagccatatt

SEQ ID NO: 125302 - DNA, 25 bp, Homo sapien
gccaccgtgcctaccgcgaggatga

SEQ ID NO: 125303 - DNA, 25 bp, Homo sapien
tgagctcggcctcggtcaccgcttt

SEQ ID NO: 125304 - DNA, 25 bp, Homo sapien
tttcgagaaggagcatctctggatg

SEQ ID NO: 125305 - DNA, 25 bp, Homo sapien
cctaccgcgaggatgagctcggcct

SEQ ID NO: 125306 - DNA, 25 bp, Homo sapien
tctctggatgtatctgcaggcgctc

SEQ ID NO: 125307 - DNA, 25 bp, Homo sapien
cgcgacctcaggctgaccgtaggga

SEQ ID NO: 125308 - DNA, 25 bp, Homo sapien
ccattgcctgcggaaagatcgtgtc

SEQ ID NO: 125309 - DNA, 25 bp, Homo sapien
aagatcgtgtcgcacacgcacctcg

SEQ ID NO: 125310 - DNA, 25 bp, Homo sapien
cgggactgggaatgccgcactttcc

SEQ ID NO: 125311 - DNA, 25 bp, Homo sapien
cctgtttccttgaaagctggacatg

SEQ ID NO: 125312 - DNA, 25 bp, Homo sapien
ttattggggctccaccagaggggac

SEQ ID NO: 125313 - DNA, 25 bp, Homo sapien
ttctctctgcgctgtgtgcggctga

SEQ ID NO: 125314 - DNA, 25 bp, Homo sapien
cgagtacccagacgccggttttgcg

SEQ ID NO: 125315 - DNA, 25 bp, Homo sapien
cccggtgggtggaattcacagaatt

SEQ ID NO: 125316 - DNA, 25 bp, Homo sapien
cgcggtttcaggttcctcactgcgg

SEQ ID NO: 125317 - DNA, 25 bp, Homo sapien
agcggcggttattggggctccacca

SEQ ID NO: 125318 - DNA, 25 bp, Homo sapien
gagcgatctgatccgccgagccaga

SEQ ID NO: 125319 - DNA, 25 bp, Homo sapien
cgccgagccagaaagacacccgatg

SEQ ID NO: 125320 - DNA, 25 bp, Homo sapien
cagcgcgcacagagttaaaggcatc

SEQ ID NO: 125321 - DNA, 25 bp, Homo sapien
aaggcatcatcgcagccattagagg

SEQ ID NO: 125322 - DNA, 25 bp, Homo sapien
ccattagagggaaaagttgcggcgc

SEQ ID NO: 125323 - DNA, 25 bp, Homo sapien
cagtgatcacgcaagccggagcggc

SEQ ID NO: 125324 - DNA, 25 bp, Homo sapien
actgtattgtcctcctcggcaccga

SEQ ID NO: 125325 - DNA, 25 bp, Homo sapien
cgccgcaatcccgtcactgtattgt

SEQ ID NO: 125326 - DNA, 25 bp, Homo sapien
atgtcctgcgccttccagagcggct

SEQ ID NO: 125327 - DNA, 25 bp, Homo sapien
ttccgcggaacgtgacggcgaccga

SEQ ID NO: 125328 - DNA, 25 bp, Homo sapien
atgtggagatgtcctgcgccttcca

SEQ ID NO: 125329 - DNA, 25 bp, Homo sapien
ccgcctcggtgtatctggagatcca

SEQ ID NO: 125330 - DNA, 25 bp, Homo sapien
cctcggtgtatctggagatccaatg

SEQ ID NO: 125331 - DNA, 25 bp, Homo sapien
tatctggagatccaatggtggttcc

SEQ ID NO: 125332 - DNA, 25 bp, Homo sapien
tcgctcgcccggtcctcagggtgtc

SEQ ID NO: 125333 - DNA, 25 bp, Homo sapien
cagaatgtggagatgtcctgcgcct

SEQ ID NO: 125334 - DNA, 25 bp, Homo sapien
ccagcgctgcaggacagccggacag

SEQ ID NO: 125335 - DNA, 25 bp, Homo sapien
ctccttgcccgcaggtggagctctt

SEQ ID NO: 125336 - DNA, 25 bp, Homo sapien
agctcttgcccgacagagacccgga

SEQ ID NO: 125337 - DNA, 25 bp, Homo sapien
cgggactgagcgttcgctccttgcc

SEQ ID NO: 125338 - DNA, 25 bp, Homo sapien
acgggaccaagatcagcgtgagtgc

SEQ ID NO: 125339 - DNA, 25 bp, Homo sapien
gcgcgaaaattcgtcccggagcact

SEQ ID NO: 125340 - DNA, 25 bp, Homo sapien
ccggagccgcgaaggctatgctcgc

SEQ ID NO: 125341 - DNA, 25 bp, Homo sapien
ccctgcgagccagcaagagaatctg

SEQ ID NO: 125342 - DNA, 25 bp, Homo sapien
actgtgacagtctccgcagttggca

SEQ ID NO: 125343 - DNA, 25 bp, Homo sapien
ccgtcctgggctgcaataatcaatc

SEQ ID NO: 125344 - DNA, 25 bp, Homo sapien
cccactggacagtggctaattgatc

SEQ ID NO: 125345 - DNA, 25 bp, Homo sapien
ccaccaagggaagcaattagacaca

SEQ ID NO: 125346 - DNA, 25 bp, Homo sapien
atcaatctgtgctgcatgctggccc

SEQ ID NO: 125347 - DNA, 25 bp, Homo sapien
ccattcacgagggaagacgcagatc

SEQ ID NO: 125348 - DNA, 25 bp, Homo sapien
tctgcaccaggagcactcagctttc

SEQ ID NO: 125349 - DNA, 25 bp, Homo sapien
gcctccgcgagaaagactgtgcctg

SEQ ID NO: 125350 - DNA, 25 bp, Homo sapien
ccgcagggtccctaagtcatgggtg

SEQ ID NO: 125351 - DNA, 25 bp, Homo sapien
cggtgtgatgggacacctgctgtct

SEQ ID NO: 125352 - DNA, 25 bp, Homo sapien
tgggacacctgctgtctgagacggc

SEQ ID NO: 125353 - DNA, 25 bp, Homo sapien
gtcccagcgctgaccatgcacgtga

SEQ ID NO: 125354 - DNA, 25 bp, Homo sapien
ctgaccatgcacgtgagcggcaggc

SEQ ID NO: 125355 - DNA, 25 bp, Homo sapien
agaagagaggataagccgtggcaca

SEQ ID NO: 125356 - DNA, 25 bp, Homo sapien
gataagccgtggcacattcccacct

SEQ ID NO: 125357 - DNA, 25 bp, Homo sapien
acacacgggtgcacggcaggcctca

SEQ ID NO: 125358 - DNA, 25 bp, Homo sapien
acgcgtcaacctccgcggcctggca

SEQ ID NO: 125359 - DNA, 25 bp, Homo sapien
gtcgcctagcagctgaggagctggc

SEQ ID NO: 125360 - DNA, 25 bp, Homo sapien
cttagtcccacagagggacgggacg

SEQ ID NO: 125361 - DNA, 25 bp, Homo sapien
ccgtgtccttagtcccacagaggga

SEQ ID NO: 125362 - DNA, 25 bp, Homo sapien
ggacccgtgtccttagtcccacaga

SEQ ID NO: 125363 - DNA, 25 bp, Homo sapien
cactgctgggcacttacgcgggtca

SEQ ID NO: 125364 - DNA, 25 bp, Homo sapien
tgcgcgctgccatggacgcgtcaac

SEQ ID NO: 125365 - DNA, 25 bp, Homo sapien
gtcaggacccgtgtccttagtccca

SEQ ID NO: 125366 - DNA, 25 bp, Homo sapien
cgggtgttctcggtccaccctgcag

SEQ ID NO: 125367 - DNA, 25 bp, Homo sapien
agcactttttcctgctccgggtgtt

SEQ ID NO: 125368 - DNA, 25 bp, Homo sapien
atagctgaaggtggaggttgaccca

SEQ ID NO: 125369 - DNA, 25 bp, Homo sapien
cggcgctcagcaccgagcacttttt

SEQ ID NO: 125370 - DNA, 25 bp, Homo sapien
ccctccagagtgtgaaattgcctct

SEQ ID NO: 125371 - DNA, 25 bp, Homo sapien
cccgggtggaagaagttagactgca

SEQ ID NO: 125372 - DNA, 25 bp, Homo sapien
cgtccgttctggagcgagagttcac

SEQ ID NO: 125373 - DNA, 25 bp, Homo sapien
gaccagcgggcattggcgtgaaccc

SEQ ID NO: 125374 - DNA, 25 bp, Homo sapien
cggaatccgggtttctgccaacagc

SEQ ID NO: 125375 - DNA, 25 bp, Homo sapien
ccttccttaggagtgtgagtctagc

SEQ ID NO: 125376 - DNA, 25 bp, Homo sapien
acgcttcctggaagagatgcattgc

SEQ ID NO: 125377 - DNA, 25 bp, Homo sapien
ggttccttacgcgaaacctcagtgc

SEQ ID NO: 125378 - DNA, 25 bp, Homo sapien
cagggacacgtagcactggagcttg

SEQ ID NO: 125379 - DNA, 25 bp, Homo sapien
tgagtctagcgttatcccttttttc

SEQ ID NO: 125380 - DNA, 25 bp, Homo sapien
gatgcattgcggagctcgctagttg

SEQ ID NO: 125381 - DNA, 25 bp, Homo sapien
tctgccttccgccagaggccgagtt

SEQ ID NO: 125382 - DNA, 25 bp, Homo sapien
tccgagcctggatgagtaatgacgc

SEQ ID NO: 125383 - DNA, 25 bp, Homo sapien
ctcttccataatgcagggctgagtg

SEQ ID NO: 125384 - DNA, 25 bp, Homo sapien
acgaggctgaagtgccgcttgtttc

SEQ ID NO: 125385 - DNA, 25 bp, Homo sapien
agtaatgacgcgtttcttttccaga

SEQ ID NO: 125386 - DNA, 25 bp, Homo sapien
aatctggcttgaggctggcacaaca

SEQ ID NO: 125387 - DNA, 25 bp, Homo sapien
tgcggctgccgaatcttcgcgaagc

SEQ ID NO: 125388 - DNA, 25 bp, Homo sapien
gggagcgttcatcccgaaccgtgtc

SEQ ID NO: 125389 - DNA, 25 bp, Homo sapien
tgcagcgacgctgagtgactcttcc

SEQ ID NO: 125390 - DNA, 25 bp, Homo sapien
tcactgcagcgggatttccaagctc

SEQ ID NO: 125391 - DNA, 25 bp, Homo sapien
aaaaacacccatcagcacgccgtgg

SEQ ID NO: 125392 - DNA, 25 bp, Homo sapien
cagggccgtgctcgtcaaagacgga

SEQ ID NO: 125393 - DNA, 25 bp, Homo sapien
ggctctggacctgatttcttattta

SEQ ID NO: 125394 - DNA, 25 bp, Homo sapien
cgaatgccttgaactcggctctgga

SEQ ID NO: 125395 - DNA, 25 bp, Homo sapien
acggacaggcagtggctacacatga

SEQ ID NO: 125396 - DNA, 25 bp, Homo sapien
acctgctcttgggagcgcggacaga

SEQ ID NO: 125397 - DNA, 25 bp, Homo sapien
tacacatgaagccacgaatgccttg

SEQ ID NO: 125398 - DNA, 25 bp, Homo sapien
aattaacttaggtcagcgcgaggga

SEQ ID NO: 125399 - DNA, 25 bp, Homo sapien
tgtttctgcacagaaatgagggaaa

SEQ ID NO: 125400 - DNA, 25 bp, Homo sapien
gatcttgaagatgtttctgcacaga

SEQ ID NO: 125401 - DNA, 25 bp, Homo sapien
aatgatctctatgatcttgaagatg

SEQ ID NO: 125402 - DNA, 25 bp, Homo sapien
ccgacgttgttaggaaaatgatctc

SEQ ID NO: 125403 - DNA, 25 bp, Homo sapien
tacccaggaatgttgctgccgcagc

SEQ ID NO: 125404 - DNA, 25 bp, Homo sapien
gggagcgctacccaggaatgttgct

SEQ ID NO: 125405 - DNA, 25 bp, Homo sapien
cagaatttgatagctcaacagggtg

SEQ ID NO: 125406 - DNA, 25 bp, Homo sapien
tccgcggaaaccctagctcagaaag

SEQ ID NO: 125407 - DNA, 25 bp, Homo sapien
ctcagaaagacccattagagagaag

SEQ ID NO: 125408 - DNA, 25 bp, Homo sapien
tccgcaggagggaccactgtgcccg

SEQ ID NO: 125409 - DNA, 25 bp, Homo sapien
ccctagctcagaaagacccattaga

SEQ ID NO: 125410 - DNA, 25 bp, Homo sapien
cccgagtccgcaggagggaccactg

SEQ ID NO: 125411 - DNA, 25 bp, Homo sapien
tcagtccgcggaaaccctagctcag

SEQ ID NO: 125412 - DNA, 25 bp, Homo sapien
aaggagaaggcgatctcagggcttg

SEQ ID NO: 125413 - DNA, 25 bp, Homo sapien
gcggaaaccctagctcagaaagacc

SEQ ID NO: 125414 - DNA, 25 bp, Homo sapien
atctgcgacagcaggacacgccttc

SEQ ID NO: 125415 - DNA, 25 bp, Homo sapien
caggttcagcgcaggatcagagtcc

SEQ ID NO: 125416 - DNA, 25 bp, Homo sapien
ccctattagcgtgtccatctgcgac

SEQ ID NO: 125417 - DNA, 25 bp, Homo sapien
ccagttaatcgccttggtcccaggc

SEQ ID NO: 125418 - DNA, 25 bp, Homo sapien
gcccgcgcaggacaggccagttaat

SEQ ID NO: 125419 - DNA, 25 bp, Homo sapien
agctattgtgaaagggcgctggccc

SEQ ID NO: 125420 - DNA, 25 bp, Homo sapien
cacgcgaagggacgcaggattgaca

SEQ ID NO: 125421 - DNA, 25 bp, Homo sapien
ttgacagcgaccctgaagaaatgca

SEQ ID NO: 125422 - DNA, 25 bp, Homo sapien
acaggcggctttctgagaggacctc

SEQ ID NO: 125423 - DNA, 25 bp, Homo sapien
ccctgactccgtccagtattgatcg

SEQ ID NO: 125424 - DNA, 25 bp, Homo sapien
gctgaggaaggaacccaaaaataca

SEQ ID NO: 125425 - DNA, 25 bp, Homo sapien
ctgcactgtttagggaagctgagga

SEQ ID NO: 125426 - DNA, 25 bp, Homo sapien
acccgccgagactgcactgtttagg

SEQ ID NO: 125427 - DNA, 25 bp, Homo sapien
gtttccttgagatcagctgcgccgc

SEQ ID NO: 125428 - DNA, 25 bp, Homo sapien
cgtcctttcctgtttccttgagatc

SEQ ID NO: 125429 - DNA, 25 bp, Homo sapien
tccagtattgatcgggagagccgga

SEQ ID NO: 125430 - DNA, 25 bp, Homo sapien
cggcgccctggaaaacagaactgtt

SEQ ID NO: 125431 - DNA, 25 bp, Homo sapien
gtgcatcgtggcgtttcctattttc

SEQ ID NO: 125432 - DNA, 25 bp, Homo sapien
aacaggcttcctcttgtcacagacg

SEQ ID NO: 125433 - DNA, 25 bp, Homo sapien
ccagcgccctggaattgtcagtctg

SEQ ID NO: 125434 - DNA, 25 bp, Homo sapien
ggcgagctctcttttccacctgtct

SEQ ID NO: 125435 - DNA, 25 bp, Homo sapien
ggccgctccgtgtgacaatgcaaga

SEQ ID NO: 125436 - DNA, 25 bp, Homo sapien
tgagcacacagatccagcacagcgt

SEQ ID NO: 125437 - DNA, 25 bp, Homo sapien
ctgtgagtgtaacggccctctgtta

SEQ ID NO: 125438 - DNA, 25 bp, Homo sapien
gaacgtgttccgcttggcaccaaca

SEQ ID NO: 125439 - DNA, 25 bp, Homo sapien
ggcctgtgacctcttagggtatcca

SEQ ID NO: 125440 - DNA, 25 bp, Homo sapien
cattagcgtcagctgcaggcagtcc

SEQ ID NO: 125441 - DNA, 25 bp, Homo sapien
gtcctcgtcgagctctatgtccgca

SEQ ID NO: 125442 - DNA, 25 bp, Homo sapien
cgtgcatccggctatctggaaggtc

SEQ ID NO: 125443 - DNA, 25 bp, Homo sapien
ccgtcttcttcacggccaaggagaa

SEQ ID NO: 125444 - DNA, 25 bp, Homo sapien
actgggacccatgccctggactgtt

SEQ ID NO: 125445 - DNA, 25 bp, Homo sapien
accgacggctttcttgccgacatta

SEQ ID NO: 125446 - DNA, 25 bp, Homo sapien
gccacgtctgcctcgtcttctgaaa

SEQ ID NO: 125447 - DNA, 25 bp, Homo sapien
ccttcagactgtggcttctgctgtc

SEQ ID NO: 125448 - DNA, 25 bp, Homo sapien
tgggcccatctagggaaagaaagac

SEQ ID NO: 125449 - DNA, 25 bp, Homo sapien
gaaagacaaacatctcagggtgctg

SEQ ID NO: 125450 - DNA, 25 bp, Homo sapien
ctcttagaacaaaggcaccgggaga

SEQ ID NO: 125451 - DNA, 25 bp, Homo sapien
aggaggcaacgctgctcatctctta

SEQ ID NO: 125452 - DNA, 25 bp, Homo sapien
gggcaaaagactcccgggcagctgt

SEQ ID NO: 125453 - DNA, 25 bp, Homo sapien
tcgtcttctgaaacctccagttctt

SEQ ID NO: 125454 - DNA, 25 bp, Homo sapien
gaccgtcagggaagatgctgccatg

SEQ ID NO: 125455 - DNA, 25 bp, Homo sapien
agcactttgatttcccgacccgaga

SEQ ID NO: 125456 - DNA, 25 bp, Homo sapien
cagttccacccgcagcgagttagca

SEQ ID NO: 125457 - DNA, 25 bp, Homo sapien
gcagccctttcccttattcattcag

SEQ ID NO: 125458 - DNA, 25 bp, Homo sapien
tggtttgcgcccattctcagtcagg

SEQ ID NO: 125459 - DNA, 25 bp, Homo sapien
tggccacctcccgagttgtcagtct

SEQ ID NO: 125460 - DNA, 25 bp, Homo sapien
tcatcacttcctgggcagcgcgttc

SEQ ID NO: 125461 - DNA, 25 bp, Homo sapien
ttcgtgaccaagcaactggacctgc

SEQ ID NO: 125462 - DNA, 25 bp, Homo sapien
ggatgatagcgcctagcacctgtct

SEQ ID NO: 125463 - DNA, 25 bp, Homo sapien
cgacgcgcacacaccttgagtgaca

SEQ ID NO: 125464 - DNA, 25 bp, Homo sapien
agcgacctcttctctacaggttttc

SEQ ID NO: 125465 - DNA, 25 bp, Homo sapien
ccatgtcaaagaggctgaagctcca

SEQ ID NO: 125466 - DNA, 25 bp, Homo sapien
ggcctcccttttcatcaggacggga

SEQ ID NO: 125467 - DNA, 25 bp, Homo sapien
ccgtgggcttcagctgcatgaacca

SEQ ID NO: 125468 - DNA, 25 bp, Homo sapien
atacgcggacagtgcgctttccttc

SEQ ID NO: 125469 - DNA, 25 bp, Homo sapien
atgaaccacgttccagcagttcggc

SEQ ID NO: 125470 - DNA, 25 bp, Homo sapien
acgcgcaggtcagggacacccgtcc

SEQ ID NO: 125471 - DNA, 25 bp, Homo sapien
cgcccgtgcctcaggcggtcccgat

SEQ ID NO: 125472 - DNA, 25 bp, Homo sapien
gcgcttctcccggatggaccgggac

SEQ ID NO: 125473 - DNA, 25 bp, Homo sapien
tcagggacacccgtccacctgcgtc

SEQ ID NO: 125474 - DNA, 25 bp, Homo sapien
tgcgtctgccatcgcttcggggcct

SEQ ID NO: 125475 - DNA, 25 bp, Homo sapien
ggtcctcgttcagctgcagcgccag

SEQ ID NO: 125476 - DNA, 25 bp, Homo sapien
ggcgcaggacagatggggagacgac

SEQ ID NO: 125477 - DNA, 25 bp, Homo sapien
aggcggtcccgatcccgcggcacag

SEQ ID NO: 125478 - DNA, 25 bp, Homo sapien
aggtcgtcctgtcgccctagactaa

SEQ ID NO: 125479 - DNA, 25 bp, Homo sapien
cggctcggcacccatcctttcctaa

SEQ ID NO: 125480 - DNA, 25 bp, Homo sapien
tgtcgccctagactaaacccaggaa

SEQ ID NO: 125481 - DNA, 25 bp, Homo sapien
cttcccaagggaggtcgtcctgtcg

SEQ ID NO: 125482 - DNA, 25 bp, Homo sapien
caggcaaggtcctctggggcgcctc

SEQ ID NO: 125483 - DNA, 25 bp, Homo sapien
tgcgctcccaggcaaggtcctctgg

SEQ ID NO: 125484 - DNA, 25 bp, Homo sapien
ggcggacggtgcacaaaggtcaccc

SEQ ID NO: 125485 - DNA, 25 bp, Homo sapien
ggtccatccgatcctcggccctctg

SEQ ID NO: 125486 - DNA, 25 bp, Homo sapien
cagcacgatttaggcctgcagaggt

SEQ ID NO: 125487 - DNA, 25 bp, Homo sapien
ccactgagagccacgagctgggctg

SEQ ID NO: 125488 - DNA, 25 bp, Homo sapien
ctgggaaggccactgagagccacga

SEQ ID NO: 125489 - DNA, 25 bp, Homo sapien
gcacgatttaggcctgcagaggtcg

SEQ ID NO: 125490 - DNA, 25 bp, Homo sapien
gccactgagagccacgagctgggct

SEQ ID NO: 125491 - DNA, 25 bp, Homo sapien
aaggccactgagagccacgagctgg

SEQ ID NO: 125492 - DNA, 25 bp, Homo sapien
gaaggccactgagagccacgagctg

SEQ ID NO: 125493 - DNA, 25 bp, Homo sapien
ggaaggccactgagagccacgagct

SEQ ID NO: 125494 - DNA, 25 bp, Homo sapien
gagcctgccgaagcgccctttgtct

SEQ ID NO: 125495 - DNA, 25 bp, Homo sapien
tcaccgggcgtcattggctcaggct

SEQ ID NO: 125496 - DNA, 25 bp, Homo sapien
ggggtccgcatagtcccgatgaaaa

SEQ ID NO: 125497 - DNA, 25 bp, Homo sapien
ccagcgcatgcgtattggggatctg

SEQ ID NO: 125498 - DNA, 25 bp, Homo sapien
aggagcccagtcaccgggcgtcatt

SEQ ID NO: 125499 - DNA, 25 bp, Homo sapien
tgaggccagcgtcttgcgccgccat

SEQ ID NO: 125500 - DNA, 25 bp, Homo sapien
ccattgcggggaggctgtcctcaga

SEQ ID NO: 125501 - DNA, 25 bp, Homo sapien
tgtcctcagagcaggtctggcgcgc

SEQ ID NO: 125502 - DNA, 25 bp, Homo sapien
gtccagcgtttgtccgtggtattga

SEQ ID NO: 125503 - DNA, 25 bp, Homo sapien
tcaaaagcagcccaagtcatccgtc

SEQ ID NO: 125504 - DNA, 25 bp, Homo sapien
cgaatcgcttcgtctgacctcgggg

SEQ ID NO: 125505 - DNA, 25 bp, Homo sapien
gagagccctgagagcgaatcgcttc

SEQ ID NO: 125506 - DNA, 25 bp, Homo sapien
tccgcccacggctaaggagatgcac

SEQ ID NO: 125507 - DNA, 25 bp, Homo sapien
gcgcgcgttaggaaaccagaggtca

SEQ ID NO: 125508 - DNA, 25 bp, Homo sapien
actgtccactagctgcgcgcgttag

SEQ ID NO: 125509 - DNA, 25 bp, Homo sapien
gtggaatggcttgtgaactgatctc

SEQ ID NO: 125510 - DNA, 25 bp, Homo sapien
gagtaaagcattgtcccgggccagc

SEQ ID NO: 125511 - DNA, 25 bp, Homo sapien
tgatcggcttgcactgactgcgctt

SEQ ID NO: 125512 - DNA, 25 bp, Homo sapien
actgactgcgcttgggcttcgcgct

SEQ ID NO: 125513 - DNA, 25 bp, Homo sapien
tcgccggaggctgttccaagcctga

SEQ ID NO: 125514 - DNA, 25 bp, Homo sapien
cgtctgccgaggacgttggtgaccc

SEQ ID NO: 125515 - DNA, 25 bp, Homo sapien
acgttggtgaccctggtctctgagg

SEQ ID NO: 125516 - DNA, 25 bp, Homo sapien
gagtagggaataaaagagtaaagca

SEQ ID NO: 125517 - DNA, 25 bp, Homo sapien
tcctcccgctgaagtgatcggcttg

SEQ ID NO: 125518 - DNA, 25 bp, Homo sapien
cacggtccgggaagctccaatgaaa

SEQ ID NO: 125519 - DNA, 25 bp, Homo sapien
ggaacaagctcctcccgtgcgcgat

SEQ ID NO: 125520 - DNA, 25 bp, Homo sapien
tttcctccgctggagcagctatggc

SEQ ID NO: 125521 - DNA, 25 bp, Homo sapien
cagacgggccgacttttccagaaga

SEQ ID NO: 125522 - DNA, 25 bp, Homo sapien
tccaacgccggaaccaaggagcacg

SEQ ID NO: 125523 - DNA, 25 bp, Homo sapien
cgcatcgatgcagtctccgcggaga

SEQ ID NO: 125524 - DNA, 25 bp, Homo sapien
ggcccaagggcaccatgaagatgta

SEQ ID NO: 125525 - DNA, 25 bp, Homo sapien
tgcttatcagactcgcgtgtggccc

SEQ ID NO: 125526 - DNA, 25 bp, Homo sapien
atgtgcataggggtcgactgccgct

SEQ ID NO: 125527 - DNA, 25 bp, Homo sapien
ctaggtcagtgaaccggccgtccat

SEQ ID NO: 125528 - DNA, 25 bp, Homo sapien
agtgaaccggccgtccatcctgggg

SEQ ID NO: 125529 - DNA, 25 bp, Homo sapien
ctgacgggagagagccttaggccct

SEQ ID NO: 125530 - DNA, 25 bp, Homo sapien
gagagagccttaggcccttctgccg

SEQ ID NO: 125531 - DNA, 25 bp, Homo sapien
gtggtgtggccagtcctccgcctcg

SEQ ID NO: 125532 - DNA, 25 bp, Homo sapien
tcctgaaggtggtgtggccagtcct

SEQ ID NO: 125533 - DNA, 25 bp, Homo sapien
cagcctgcgcatgtgcataggggtc

SEQ ID NO: 125534 - DNA, 25 bp, Homo sapien
ccagcacacaggcagagaacttccg

SEQ ID NO: 125535 - DNA, 25 bp, Homo sapien
tgaacttggcgccaggatctttaaa

SEQ ID NO: 125536 - DNA, 25 bp, Homo sapien
tcctgtggttcatccgcgaaccttg

SEQ ID NO: 125537 - DNA, 25 bp, Homo sapien
gtctccgcaggcctgaagttcattg

SEQ ID NO: 125538 - DNA, 25 bp, Homo sapien
ctaagcgacttctgaggagaccgga

SEQ ID NO: 125539 - DNA, 25 bp, Homo sapien
cttcgcggtcaacgccctgaacttg

SEQ ID NO: 125540 - DNA, 25 bp, Homo sapien
ttcattggaagagcaggacgtcacg

SEQ ID NO: 125541 - DNA, 25 bp, Homo sapien
tttggtctcaaaccctgcgatggtc

SEQ ID NO: 125542 - DNA, 25 bp, Homo sapien
tgcgcacaagtaaggaagccgtttc

SEQ ID NO: 125543 - DNA, 25 bp, Homo sapien
tctgtttcagatgtaccggctcacg

SEQ ID NO: 125544 - DNA, 25 bp, Homo sapien
tgctctcagcgcagttttagtcctg

SEQ ID NO: 125545 - DNA, 25 bp, Homo sapien
gttgtcttcgtctgtgccgtttgtc

SEQ ID NO: 125546 - DNA, 25 bp, Homo sapien
gccgtttgtcttcgtggccatcctg

SEQ ID NO: 125547 - DNA, 25 bp, Homo sapien
atcctgcagatgagcaccgtgtcca

SEQ ID NO: 125548 - DNA, 25 bp, Homo sapien
gttgacctgctgtgctctctgtttc

SEQ ID NO: 125549 - DNA, 25 bp, Homo sapien
caggctcgtgtgtcttgtgttgtct

SEQ ID NO: 125550 - DNA, 25 bp, Homo sapien
cagggaaagagcacacgacggccac

SEQ ID NO: 125551 - DNA, 25 bp, Homo sapien
tgcagggaaagagcacacgacggcc

SEQ ID NO: 125552 - DNA, 25 bp, Homo sapien
ggaaagagcgcacgacggccacagc

SEQ ID NO: 125553 - DNA, 25 bp, Homo sapien
gcacgacggccatactgcagggaaa

SEQ ID NO: 125554 - DNA, 25 bp, Homo sapien
cacgacggccatactgcagggaaag

SEQ ID NO: 125555 - DNA, 25 bp, Homo sapien
cacagcgcagggaaagagcacacga

SEQ ID NO: 125556 - DNA, 25 bp, Homo sapien
ccacagcgcagggaaagagcacacg

SEQ ID NO: 125557 - DNA, 25 bp, Homo sapien
agggaaagagcgcacgacggccaca

SEQ ID NO: 125558 - DNA, 25 bp, Homo sapien
tccctaatacggttccctcagaggc

SEQ ID NO: 125559 - DNA, 25 bp, Homo sapien
ggttccctcagaggcagccgactct

SEQ ID NO: 125560 - DNA, 25 bp, Homo sapien
cgagtgcgcatcttgggatgcagct

SEQ ID NO: 125561 - DNA, 25 bp, Homo sapien
tagtccaggcagtcgtaaagctcct

SEQ ID NO: 125562 - DNA, 25 bp, Homo sapien
gtgccttcggcgacgccacagaggc

SEQ ID NO: 125563 - DNA, 25 bp, Homo sapien
cgacgccacagaggcggaccttcga

SEQ ID NO: 125564 - DNA, 25 bp, Homo sapien
cagaggcggaccttcgacgacgtca

SEQ ID NO: 125565 - DNA, 25 bp, Homo sapien
cgcatcttgggatgcagctggcgct

SEQ ID NO: 125566 - DNA, 25 bp, Homo sapien
cgtctgcagtcaggaagtcccaggc

SEQ ID NO: 125567 - DNA, 25 bp, Homo sapien
gacagcgtttgtccgagaagccttc

SEQ ID NO: 125568 - DNA, 25 bp, Homo sapien
cggaagcgcgactgaccgtggcctt

SEQ ID NO: 125569 - DNA, 25 bp, Homo sapien
aaggccagaggcactccctgggctg

SEQ ID NO: 125570 - DNA, 25 bp, Homo sapien
tggctctgtgctccggtgaaggcca

SEQ ID NO: 125571 - DNA, 25 bp, Homo sapien
cctctgcgggccaaacgcggagcga

SEQ ID NO: 125572 - DNA, 25 bp, Homo sapien
tccaggctagctcggacctggcagt

SEQ ID NO: 125573 - DNA, 25 bp, Homo sapien
gccacgcaccgtctgcagtcaggaa

SEQ ID NO: 125574 - DNA, 25 bp, Homo sapien
ccagcccgacgctgtaacttgagtc

SEQ ID NO: 125575 - DNA, 25 bp, Homo sapien
tgtaacttgagtccggaaccgcggc

SEQ ID NO: 125576 - DNA, 25 bp, Homo sapien
cgctcacgctgcagacagtctgctg

SEQ ID NO: 125577 - DNA, 25 bp, Homo sapien
acagtctgctgctaagcgcgggtct

SEQ ID NO: 125578 - DNA, 25 bp, Homo sapien
cgggtctcagctctggcctagcgac

SEQ ID NO: 125579 - DNA, 25 bp, Homo sapien
ctcagctctggcctagcgactggac

SEQ ID NO: 125580 - DNA, 25 bp, Homo sapien
gcctagcgactggacgctcgcgctg

SEQ ID NO: 125581 - DNA, 25 bp, Homo sapien
tcgcgctgccggttgttaaaggacc

SEQ ID NO: 125582 - DNA, 25 bp, Homo sapien
cgttagccggcgctcgagctgtttc

SEQ ID NO: 125583 - DNA, 25 bp, Homo sapien
tggcgttggcgctgcagccgtgacg

SEQ ID NO: 125584 - DNA, 25 bp, Homo sapien
actacggcgacgactagggccgctc

SEQ ID NO: 125585 - DNA, 25 bp, Homo sapien
ctacggcgacgactagggccgctct

SEQ ID NO: 125586 - DNA, 25 bp, Homo sapien
cggcgacgactagggccgctctccc

SEQ ID NO: 125587 - DNA, 25 bp, Homo sapien
ggcgctcgagctgtttcccttcctg

SEQ ID NO: 125588 - DNA, 25 bp, Homo sapien
agccggcgctcgagctgtttccctt

SEQ ID NO: 125589 - DNA, 25 bp, Homo sapien
gctcgagctgtttcccttcctgggg

SEQ ID NO: 125590 - DNA, 25 bp, Homo sapien
ctctctgcgtgggatgtgccggcgt

SEQ ID NO: 125591 - DNA, 25 bp, Homo sapien
tgtgccggcgtgagccaaggggtca

SEQ ID NO: 125592 - DNA, 25 bp, Homo sapien
atgtgccggcgtgagccaaggggtc

SEQ ID NO: 125593 - DNA, 25 bp, Homo sapien
cctctctctgcgtgggatgtgccgg

SEQ ID NO: 125594 - DNA, 25 bp, Homo sapien
tgacctctctctgcgtgggatgtgc

SEQ ID NO: 125595 - DNA, 25 bp, Homo sapien
acctctctctgcgtgggatgtgccg

SEQ ID NO: 125596 - DNA, 25 bp, Homo sapien
ctctgcgtgggatgtgccggcgtga

SEQ ID NO: 125597 - DNA, 25 bp, Homo sapien
ctctctctgcgtgggatgtgccggc

SEQ ID NO: 125598 - DNA, 25 bp, Homo sapien
ttgtgccggccttgctgtgcatgct

SEQ ID NO: 125599 - DNA, 25 bp, Homo sapien
ggtagctcttaacggttctcagccc

SEQ ID NO: 125600 - DNA, 25 bp, Homo sapien
cgaagtccggttgtgccggccttgc

SEQ ID NO: 125601 - DNA, 25 bp, Homo sapien
cgccctttcaagagcttcgggacta

SEQ ID NO: 125602 - DNA, 25 bp, Homo sapien
ggactacaatcctagcatgccccag

SEQ ID NO: 125603 - DNA, 25 bp, Homo sapien
ctcgggagcctggtgaagttctcgg

SEQ ID NO: 125604 - DNA, 25 bp, Homo sapien
cctttcaagagcttcgggactacaa

SEQ ID NO: 125605 - DNA, 25 bp, Homo sapien
acggtagctcttaacggttctcagc

SEQ ID NO: 125606 - DNA, 25 bp, Homo sapien
agaacacagataagcaggccatagg

SEQ ID NO: 125607 - DNA, 25 bp, Homo sapien
gaaaattgtgtcataaatttggctg

SEQ ID NO: 125608 - DNA, 25 bp, Homo sapien
ggccatagggacttacacaattatg

SEQ ID NO: 125609 - DNA, 25 bp, Homo sapien
gcaggccatagggacttacacaatt

SEQ ID NO: 125610 - DNA, 25 bp, Homo sapien
gtcagaataaaatgaaaggccagga

SEQ ID NO: 125611 - DNA, 25 bp, Homo sapien
taagctaatataatcaggacgaaga

SEQ ID NO: 125612 - DNA, 25 bp, Homo sapien
cccagctaatattataagctaatat

SEQ ID NO: 125613 - DNA, 25 bp, Homo sapien
gggacttacacaattatgaaaattg

SEQ ID NO: 125614 - DNA, 25 bp, Homo sapien
cactagcgctggagtacaaagaggc

SEQ ID NO: 125615 - DNA, 25 bp, Homo sapien
gctgcactcggccacctcattcttc

SEQ ID NO: 125616 - DNA, 25 bp, Homo sapien
cagtgggaaatataaccctccctgg

SEQ ID NO: 125617 - DNA, 25 bp, Homo sapien
gaagacagtgggaaatataaccctc

SEQ ID NO: 125618 - DNA, 25 bp, Homo sapien
acggaaacacctgtcctagcaccag

SEQ ID NO: 125619 - DNA, 25 bp, Homo sapien
gcaaattctcactagcgctggagta

SEQ ID NO: 125620 - DNA, 25 bp, Homo sapien
gtctgcaaattctcactagcgctgg

SEQ ID NO: 125621 - DNA, 25 bp, Homo sapien
tgtcctagcaccaggaagacagtgg

SEQ ID NO: 125622 - DNA, 25 bp, Homo sapien
accatggccaggatgacgtggttga

SEQ ID NO: 125623 - DNA, 25 bp, Homo sapien
tgcagatgcacaggtcagtgacgta

SEQ ID NO: 125624 - DNA, 25 bp, Homo sapien
acaggtcagtgacgtactcggggaa

SEQ ID NO: 125625 - DNA, 25 bp, Homo sapien
agaggaaccagtcgatccctaagta

SEQ ID NO: 125626 - DNA, 25 bp, Homo sapien
tccctaagtagatggaggacaccag

SEQ ID NO: 125627 - DNA, 25 bp, Homo sapien
agacggagaccatggccaggatgac

SEQ ID NO: 125628 - DNA, 25 bp, Homo sapien
gcgctgctgttgatgcagatgcaca

SEQ ID NO: 125629 - DNA, 25 bp, Homo sapien
gggcccgctggaagaccaccctgag

SEQ ID NO: 125630 - DNA, 25 bp, Homo sapien
gtggacgccgtgacaccccttattc

SEQ ID NO: 125631 - DNA, 25 bp, Homo sapien
cccttattctaggtgcagtcagcac

SEQ ID NO: 125632 - DNA, 25 bp, Homo sapien
taggtgcagtcagcactcagggaga

SEQ ID NO: 125633 - DNA, 25 bp, Homo sapien
gacggacaggaacgggcagcagcct

SEQ ID NO: 125634 - DNA, 25 bp, Homo sapien
cagcagcctgtgctggtaagcgccg

SEQ ID NO: 125635 - DNA, 25 bp, Homo sapien
ggctgtggagcccacgccaaagcct

SEQ ID NO: 125636 - DNA, 25 bp, Homo sapien
tggagcccacgccaaagcctctgac

SEQ ID NO: 125637 - DNA, 25 bp, Homo sapien
ctgcaatcctgcaccgtccacccag

SEQ ID NO: 125638 - DNA, 25 bp, Homo sapien
ggacctggagagacggactcgagga

SEQ ID NO: 125639 - DNA, 25 bp, Homo sapien
tggacctggagagacggactcgagg

SEQ ID NO: 125640 - DNA, 25 bp, Homo sapien
ctggacctggagagacggactcgag

SEQ ID NO: 125641 - DNA, 25 bp, Homo sapien
gctggacctggagagacggactcga

SEQ ID NO: 125642 - DNA, 25 bp, Homo sapien
agctggacctggagagacggactcg

SEQ ID NO: 125643 - DNA, 25 bp, Homo sapien
gacctggagagacggactcgaggaa

SEQ ID NO: 125644 - DNA, 25 bp, Homo sapien
gagctggacctggagagacggactc

SEQ ID NO: 125645 - DNA, 25 bp, Homo sapien
tgacgtcgcgaaagaccagctcata

SEQ ID NO: 125646 - DNA, 25 bp, Homo sapien
gggccagcggccacaagaattacga

SEQ ID NO: 125647 - DNA, 25 bp, Homo sapien
tcctggagtgcgcatacatgggcca

SEQ ID NO: 125648 - DNA, 25 bp, Homo sapien
ggaccgactctcatacgcagccaat

SEQ ID NO: 125649 - DNA, 25 bp, Homo sapien
atggcgtcacagaggaccgactctc

SEQ ID NO: 125650 - DNA, 25 bp, Homo sapien
tctgagacgtcaatgaaggcgcgcc

SEQ ID NO: 125651 - DNA, 25 bp, Homo sapien
ggacttttcgaatgggcgcctctga

SEQ ID NO: 125652 - DNA, 25 bp, Homo sapien
ccagctcataggacttttcgaatgg

SEQ ID NO: 125653 - DNA, 25 bp, Homo sapien
tggcccgaaaggatcctctcgcgtc

SEQ ID NO: 125654 - DNA, 25 bp, Homo sapien
gccacgcgcagccaattggaactcg

SEQ ID NO: 125655 - DNA, 25 bp, Homo sapien
cctgtgacgtcgctgaaagcgcgcg

SEQ ID NO: 125656 - DNA, 25 bp, Homo sapien
ctgaggagactgaccagctccaggt

SEQ ID NO: 125657 - DNA, 25 bp, Homo sapien
tccagccaggaatacacaggacctg

SEQ ID NO: 125658 - DNA, 25 bp, Homo sapien
cttctccagccaggaatacacagga

SEQ ID NO: 125659 - DNA, 25 bp, Homo sapien
cctctgagacgtcaccgaagtcgcg

SEQ ID NO: 125660 - DNA, 25 bp, Homo sapien
agacgtcaccgaagtcgcgccctaa

SEQ ID NO: 125661 - DNA, 25 bp, Homo sapien
tttccgcagcccagcggtctaagct

SEQ ID NO: 125662 - DNA, 25 bp, Homo sapien
gcggcgacgagcacagcccaggcca

SEQ ID NO: 125663 - DNA, 25 bp, Homo sapien
gcagacaaaggctccgacaggtccc

SEQ ID NO: 125664 - DNA, 25 bp, Homo sapien
gccgcagacaaaggctccgacaggt

SEQ ID NO: 125665 - DNA, 25 bp, Homo sapien
gtctaagctgctccaactcctgtgg

SEQ ID NO: 125666 - DNA, 25 bp, Homo sapien
ttccgcagcccagcggtctaagctg

SEQ ID NO: 125667 - DNA, 25 bp, Homo sapien
gcggtctaagctgctccaactcctg

SEQ ID NO: 125668 - DNA, 25 bp, Homo sapien
agcccagcggtctaagctgctccaa

SEQ ID NO: 125669 - DNA, 25 bp, Homo sapien
caccaaggagctggccaagcggcag

SEQ ID NO: 125670 - DNA, 25 bp, Homo sapien
accaccaaggagctggccaagcggc

SEQ ID NO: 125671 - DNA, 25 bp, Homo sapien
caccaccaaggagctggccaagcgg

SEQ ID NO: 125672 - DNA, 25 bp, Homo sapien
aagagccgacccaagaagagagagg

SEQ ID NO: 125673 - DNA, 25 bp, Homo sapien
caagagccgacccaagaagagagag

SEQ ID NO: 125674 - DNA, 25 bp, Homo sapien
ggcccactccccaggcaagaagacg

SEQ ID NO: 125675 - DNA, 25 bp, Homo sapien
ggccaagagccgacccaagaagaga

SEQ ID NO: 125676 - DNA, 25 bp, Homo sapien
gccaagagccgacccaagaagagag

SEQ ID NO: 125677 - DNA, 25 bp, Homo sapien
atgtagttcatgacggccggaggcg

SEQ ID NO: 125678 - DNA, 25 bp, Homo sapien
ccggctgtagagttccggggcctcg

SEQ ID NO: 125679 - DNA, 25 bp, Homo sapien
aggagcaggaagatgtagttcatga

SEQ ID NO: 125680 - DNA, 25 bp, Homo sapien
agcaggaagatgtagttcatgacgg

SEQ ID NO: 125681 - DNA, 25 bp, Homo sapien
gaggcggcagcatcgcgatctgctc

SEQ ID NO: 125682 - DNA, 25 bp, Homo sapien
tcgcgatctgctcgatggtcaggaa

SEQ ID NO: 125683 - DNA, 25 bp, Homo sapien
cagcatcgcgatctgctcgatggtc

SEQ ID NO: 125684 - DNA, 25 bp, Homo sapien
gatctgctcgatggtcaggaagccc

SEQ ID NO: 125685 - DNA, 25 bp, Homo sapien
aggtagcccacatcggcgctggcca

SEQ ID NO: 125686 - DNA, 25 bp, Homo sapien
aggctcacgccggtaaggaacatgc

SEQ ID NO: 125687 - DNA, 25 bp, Homo sapien
cgccggtaaggaacatgcagagccc

SEQ ID NO: 125688 - DNA, 25 bp, Homo sapien
acccggcacacgctgcggatgtagt

SEQ ID NO: 125689 - DNA, 25 bp, Homo sapien
tagtcggcaaacgtgcccaggaagc

SEQ ID NO: 125690 - DNA, 25 bp, Homo sapien
ccttgctgaagaggtagcccacatc

SEQ ID NO: 125691 - DNA, 25 bp, Homo sapien
ttcctcttgatggagaagccgaaaa

SEQ ID NO: 125692 - DNA, 25 bp, Homo sapien
ggatggagaacaccgccttgctgaa

SEQ ID NO: 125693 - DNA, 25 bp, Homo sapien
agaccaagaagtaccaggacagcga

SEQ ID NO: 125694 - DNA, 25 bp, Homo sapien
gctataccagtcctcgcatgtggac

SEQ ID NO: 125695 - DNA, 25 bp, Homo sapien
accagtcctcgcatgtggacgaaaa

SEQ ID NO: 125696 - DNA, 25 bp, Homo sapien
tcgcatgtggacgaaaatgacgtgc

SEQ ID NO: 125697 - DNA, 25 bp, Homo sapien
tgtggacgaaaatgacgtgcagacg

SEQ ID NO: 125698 - DNA, 25 bp, Homo sapien
gacgaaaatgacgtgcagacggtgt

SEQ ID NO: 125699 - DNA, 25 bp, Homo sapien
cagatgctgaagaccaagaagtacc

SEQ ID NO: 125700 - DNA, 25 bp, Homo sapien
gacagcgagggcctgtactacctcg

SEQ ID NO: 125701 - DNA, 25 bp, Homo sapien
ggcgggcatgccgctggggtagacg

SEQ ID NO: 125702 - DNA, 25 bp, Homo sapien
gttgctgatgcccatgagcagtgag

SEQ ID NO: 125703 - DNA, 25 bp, Homo sapien
gccgttgctgatgcccatgagcagt

SEQ ID NO: 125704 - DNA, 25 bp, Homo sapien
agccgttgctgatgcccatgagcag

SEQ ID NO: 125705 - DNA, 25 bp, Homo sapien
ccgctgcttggggctcactttgcct

SEQ ID NO: 125706 - DNA, 25 bp, Homo sapien
ctcccgctgcttggggctcactttg

SEQ ID NO: 125707 - DNA, 25 bp, Homo sapien
gctcccgctgcttggggctcacttt

SEQ ID NO: 125708 - DNA, 25 bp, Homo sapien
ggcattgcgctgctgggaggacgcc

SEQ ID NO: 125709 - DNA, 25 bp, Homo sapien
cactccgtgccatcggccgccctat

SEQ ID NO: 125710 - DNA, 25 bp, Homo sapien
ctatgctcgcgctcactgtcctgga

SEQ ID NO: 125711 - DNA, 25 bp, Homo sapien
gctcactgtcctggaccaggcaatt

SEQ ID NO: 125712 - DNA, 25 bp, Homo sapien
cccaaggctgtgaccacgacgtgag

SEQ ID NO: 125713 - DNA, 25 bp, Homo sapien
tgtgaccacgacgtgagcgacctca

SEQ ID NO: 125714 - DNA, 25 bp, Homo sapien
gtgagcgacctcagctatcttggga

SEQ ID NO: 125715 - DNA, 25 bp, Homo sapien
acctcagctatcttgggatgacaca

SEQ ID NO: 125716 - DNA, 25 bp, Homo sapien
atcttgggatgacacaggcgggccc

SEQ ID NO: 125717 - DNA, 25 bp, Homo sapien
gcagctccagcgccaccgacaccag

SEQ ID NO: 125718 - DNA, 25 bp, Homo sapien
tgcggctcagagagatcatcacgcc

SEQ ID NO: 125719 - DNA, 25 bp, Homo sapien
ggtgcgcacttacgaagtggacgtc

SEQ ID NO: 125720 - DNA, 25 bp, Homo sapien
tgcgcacttacgaagtggacgtccc

SEQ ID NO: 125721 - DNA, 25 bp, Homo sapien
gccgtgtggtatagaagagcacgaa

SEQ ID NO: 125722 - DNA, 25 bp, Homo sapien
gatgcggctcagagagatcatcacg

SEQ ID NO: 125723 - DNA, 25 bp, Homo sapien
gaggatgcggctcagagagatcatc

SEQ ID NO: 125724 - DNA, 25 bp, Homo sapien
ggctcagagagatcatcacgcccgc

SEQ ID NO: 125725 - DNA, 25 bp, Homo sapien
cttggccaccgtctgcagggctaag

SEQ ID NO: 125726 - DNA, 25 bp, Homo sapien
aagccctggcgtcggttgtccaaat

SEQ ID NO: 125727 - DNA, 25 bp, Homo sapien
acttctccttaaagccctggcgtcg

SEQ ID NO: 125728 - DNA, 25 bp, Homo sapien
ctgcggacaggtcgcatcaggtacc

SEQ ID NO: 125729 - DNA, 25 bp, Homo sapien
tgtccactaggtcacgctttccact

SEQ ID NO: 125730 - DNA, 25 bp, Homo sapien
aacagcggcccaaacgccgtgcagg

SEQ ID NO: 125731 - DNA, 25 bp, Homo sapien
tgtccaaatcggcagggaagctcca

SEQ ID NO: 125732 - DNA, 25 bp, Homo sapien
atcaggtacctgagacgatccgcgc

SEQ ID NO: 125733 - DNA, 25 bp, Homo sapien
tctcgcagccgaggaccgtaacact

SEQ ID NO: 125734 - DNA, 25 bp, Homo sapien
tcccagttgggctcccagtctcaag

SEQ ID NO: 125735 - DNA, 25 bp, Homo sapien
agtctcaaggcgctcaggtgaagga

SEQ ID NO: 125736 - DNA, 25 bp, Homo sapien
ggaccgtaacactgctcctagaagc

SEQ ID NO: 125737 - DNA, 25 bp, Homo sapien
gcagcaccataactgcgccagaacg

SEQ ID NO: 125738 - DNA, 25 bp, Homo sapien
gaacgccgccaggataacctccaga

SEQ ID NO: 125739 - DNA, 25 bp, Homo sapien
acatgtcacgtgatgcgcctgaggc

SEQ ID NO: 125740 - DNA, 25 bp, Homo sapien
agaggccgtccagcttcttgagctc

SEQ ID NO: 125741 - DNA, 25 bp, Homo sapien
gaaactgtagctctcaacggttccc

SEQ ID NO: 125742 - DNA, 25 bp, Homo sapien
ggctactgatttcggacacctcctt

SEQ ID NO: 125743 - DNA, 25 bp, Homo sapien
ctggctactgatttcggacacctcc

SEQ ID NO: 125744 - DNA, 25 bp, Homo sapien
atgctggctactgatttcggacacc

SEQ ID NO: 125745 - DNA, 25 bp, Homo sapien
cctagcaggcgatatgcgagaaggc

SEQ ID NO: 125746 - DNA, 25 bp, Homo sapien
ctagaatcctagcaggcgatatgcg

SEQ ID NO: 125747 - DNA, 25 bp, Homo sapien
tggactagaatcctagcaggcgata

SEQ ID NO: 125748 - DNA, 25 bp, Homo sapien
tgatttcggacacctccttgccatg

SEQ ID NO: 125749 - DNA, 25 bp, Homo sapien
agcgcgcttctctggcttgtcccag

SEQ ID NO: 125750 - DNA, 25 bp, Homo sapien
cgcgcagcacagacgggctgtcgct

SEQ ID NO: 125751 - DNA, 25 bp, Homo sapien
gcacagacgggctgtcgctcgcctt

SEQ ID NO: 125752 - DNA, 25 bp, Homo sapien
gctgttccacatcctgtacgaccgg

SEQ ID NO: 125753 - DNA, 25 bp, Homo sapien
ggagaacgtcagaggcacaccatca

SEQ ID NO: 125754 - DNA, 25 bp, Homo sapien
ccagagcgcggtcctggaacagagc

SEQ ID NO: 125755 - DNA, 25 bp, Homo sapien
cccgaggagaacgtcagaggcacac

SEQ ID NO: 125756 - DNA, 25 bp, Homo sapien
tgcgcacgctgttccacatcctgta

SEQ ID NO: 125757 - DNA, 25 bp, Homo sapien
gcccgggattcctgaagttagctga

SEQ ID NO: 125758 - DNA, 25 bp, Homo sapien
gtgggccttgtgcactggccgccac

SEQ ID NO: 125759 - DNA, 25 bp, Homo sapien
agttagctgatgatgggctggcctc

SEQ ID NO: 125760 - DNA, 25 bp, Homo sapien
aggcatcactcacagccgcttgcga

SEQ ID NO: 125761 - DNA, 25 bp, Homo sapien
ctctgccttttgtcttgcccgtggg

SEQ ID NO: 125762 - DNA, 25 bp, Homo sapien
ctggaagccctggtcgctgcccggt

SEQ ID NO: 125763 - DNA, 25 bp, Homo sapien
ctggtcagccctggtctggagcctt

SEQ ID NO: 125764 - DNA, 25 bp, Homo sapien
aggaggcatcactcacagccgcttg

SEQ ID NO: 125765 - DNA, 25 bp, Homo sapien
agcgtccagcctatccgcggggact

SEQ ID NO: 125766 - DNA, 25 bp, Homo sapien
accgggcagcgaccagggcttccag

SEQ ID NO: 125767 - DNA, 25 bp, Homo sapien
aacttcaggaatcccgggccagctg

SEQ ID NO: 125768 - DNA, 25 bp, Homo sapien
tcagctaacttcaggaatcccgggc

SEQ ID NO: 125769 - DNA, 25 bp, Homo sapien
gaggccagcccatcatcagctaact

SEQ ID NO: 125770 - DNA, 25 bp, Homo sapien
ggcggccagtgcacaaggcccacga

SEQ ID NO: 125771 - DNA, 25 bp, Homo sapien
gaaggctccagaccagggctgacca

SEQ ID NO: 125772 - DNA, 25 bp, Homo sapien
caagcggctgtgagtgatgcctcct

SEQ ID NO: 125773 - DNA, 25 bp, Homo sapien
acgcgagggcttggcttttctcgtc

SEQ ID NO: 125774 - DNA, 25 bp, Homo sapien
ggagcccggtcatcaagatctccta

SEQ ID NO: 125775 - DNA, 25 bp, Homo sapien
caagttgaaactgacacggcctgtg

SEQ ID NO: 125776 - DNA, 25 bp, Homo sapien
agttcgggtgaggacgatgacttca

SEQ ID NO: 125777 - DNA, 25 bp, Homo sapien
ttttctcgtcagctgccctgagggg

SEQ ID NO: 125778 - DNA, 25 bp, Homo sapien
acagcctggacgaggccagatcgtc

SEQ ID NO: 125779 - DNA, 25 bp, Homo sapien
caggtgctctgtgagaagtgcaaga

SEQ ID NO: 125780 - DNA, 25 bp, Homo sapien
tggcggacttgtcttctggaagttc

SEQ ID NO: 125781 - DNA, 25 bp, Homo sapien
tctcgtgaccctgaagaccgtcggc

SEQ ID NO: 125782 - DNA, 25 bp, Homo sapien
tgaagagctatttaccggacactgg

SEQ ID NO: 125783 - DNA, 25 bp, Homo sapien
tttaccggacactggcgtctcccga

SEQ ID NO: 125784 - DNA, 25 bp, Homo sapien
ttctgcctcgcccagtggctgggca

SEQ ID NO: 125785 - DNA, 25 bp, Homo sapien
ggcagatggacgtattgtatcaccc

SEQ ID NO: 125786 - DNA, 25 bp, Homo sapien
gatagcgctcatctcgtgaccctga

SEQ ID NO: 125787 - DNA, 25 bp, Homo sapien
cgtgcttacctgaccgatagcgctc

SEQ ID NO: 125788 - DNA, 25 bp, Homo sapien
cacaggcaccgtcctggcacaggtg

SEQ ID NO: 125789 - DNA, 25 bp, Homo sapien
gccagtgcattgtgatgtgtgtgca

SEQ ID NO: 125790 - DNA, 25 bp, Homo sapien
ctgggcatcctgctcagctcaactc

SEQ ID NO: 125791 - DNA, 25 bp, Homo sapien
tgctcagctcaactccccggaaatt

SEQ ID NO: 125792 - DNA, 25 bp, Homo sapien
ccggaaattctttcctctgcgccgc

SEQ ID NO: 125793 - DNA, 25 bp, Homo sapien
ctgcgccttcaaagggcgtttgtga

SEQ ID NO: 125794 - DNA, 25 bp, Homo sapien
ctggcctacggctgactcagcctgg

SEQ ID NO: 125795 - DNA, 25 bp, Homo sapien
ggcaccttgtgtgccggagtgagcc

SEQ ID NO: 125796 - DNA, 25 bp, Homo sapien
ccggagtgagccagtgcattgtgat

SEQ ID NO: 125797 - DNA, 25 bp, Homo sapien
ggtggcgaggtcaaaaagccgcaaa

SEQ ID NO: 125798 - DNA, 25 bp, Homo sapien
ccgcgtcggcaaaacccatggtgga

SEQ ID NO: 125799 - DNA, 25 bp, Homo sapien
cgcgtcggcaaaacccatggtggag

SEQ ID NO: 125800 - DNA, 25 bp, Homo sapien
gcggcggaggcaaaatgccacaacg

SEQ ID NO: 125801 - DNA, 25 bp, Homo sapien
ggcggaggcaaaatgccacaacgga

SEQ ID NO: 125802 - DNA, 25 bp, Homo sapien
gaggcaaaatgccacaacggaaaaa

SEQ ID NO: 125803 - DNA, 25 bp, Homo sapien
atgccacaacggaaaaaagcctcgg

SEQ ID NO: 125804 - DNA, 25 bp, Homo sapien
tgccacaacggaaaaaagcctcggc

SEQ ID NO: 125805 - DNA, 25 bp, Homo sapien
ttttggcaccagacaccgtggcttt

SEQ ID NO: 125806 - DNA, 25 bp, Homo sapien
tggcaccagacaccgtggctttttg

SEQ ID NO: 125807 - DNA, 25 bp, Homo sapien
gcaccagacaccgtggctttttgag

SEQ ID NO: 125808 - DNA, 25 bp, Homo sapien
ttgaccccgctgtcgcggctttctg

SEQ ID NO: 125809 - DNA, 25 bp, Homo sapien
agcttttggcaccagacaccgtggc

SEQ ID NO: 125810 - DNA, 25 bp, Homo sapien
gaccccgacgatgcggctttttatg

SEQ ID NO: 125811 - DNA, 25 bp, Homo sapien
tgcagcttttggcaccagacaccgt

SEQ ID NO: 125812 - DNA, 25 bp, Homo sapien
tttttgcagcttttggcaccagaca

SEQ ID NO: 125813 - DNA, 25 bp, Homo sapien
ctccaggagcaaggcacagaccaga

SEQ ID NO: 125814 - DNA, 25 bp, Homo sapien
caggagcaaggcacagaccagagtg

SEQ ID NO: 125815 - DNA, 25 bp, Homo sapien
gcgttagggcggagccctccttggc

SEQ ID NO: 125816 - DNA, 25 bp, Homo sapien
tggccttcagcatctttgtccgccg

SEQ ID NO: 125817 - DNA, 25 bp, Homo sapien
ccactttcggcacgctgggctgaaa

SEQ ID NO: 125818 - DNA, 25 bp, Homo sapien
ctttcggcacgctgggctgaaagtg

SEQ ID NO: 125819 - DNA, 25 bp, Homo sapien
tcttggccttcagcatctttgtccg

SEQ ID NO: 125820 - DNA, 25 bp, Homo sapien
atgggactcggccactttcggcacg

SEQ ID NO: 125821 - DNA, 25 bp, Homo sapien
ctgctctgcgggaacacgggcacca

SEQ ID NO: 125822 - DNA, 25 bp, Homo sapien
cttcccactgaggagagatccaagg

SEQ ID NO: 125823 - DNA, 25 bp, Homo sapien
tcggctctcgtctcaggaatcccag

SEQ ID NO: 125824 - DNA, 25 bp, Homo sapien
cagcttaggacgctcggctctcgtc

SEQ ID NO: 125825 - DNA, 25 bp, Homo sapien
aagctacagtgcgtttcccgaggga

SEQ ID NO: 125826 - DNA, 25 bp, Homo sapien
ggtgtctgctgctctgcgggaacac

SEQ ID NO: 125827 - DNA, 25 bp, Homo sapien
gccgcggagtgcattccctcatgct

SEQ ID NO: 125828 - DNA, 25 bp, Homo sapien
cggcccggaggccaagctacagtgc

SEQ ID NO: 125829 - DNA, 25 bp, Homo sapien
tagtccagccgcctcgtcatcaacg

SEQ ID NO: 125830 - DNA, 25 bp, Homo sapien
gcctcctctcatgtttcctgctggg

SEQ ID NO: 125831 - DNA, 25 bp, Homo sapien
gcagccctgcttcgcccttcaagac

SEQ ID NO: 125832 - DNA, 25 bp, Homo sapien
cctctcatgtttcctgctgggattc

SEQ ID NO: 125833 - DNA, 25 bp, Homo sapien
catgtttcctgctgggattctagtc

SEQ ID NO: 125834 - DNA, 25 bp, Homo sapien
gtttcctgctgggattctagtccag

SEQ ID NO: 125835 - DNA, 25 bp, Homo sapien
cctcgtcatcaacgggcggggaaca

SEQ ID NO: 125836 - DNA, 25 bp, Homo sapien
agactgcgcgccgtcccgtgttcat

SEQ ID NO: 125837 - DNA, 25 bp, Homo sapien
gccgcaccgcctgttgtccagatgt

SEQ ID NO: 125838 - DNA, 25 bp, Homo sapien
tccagcgcggtgctctgggacagct

SEQ ID NO: 125839 - DNA, 25 bp, Homo sapien
ccgcctgttgtccagatgtggaaca

SEQ ID NO: 125840 - DNA, 25 bp, Homo sapien
actggatctcgtgcaggtgcctgca

SEQ ID NO: 125841 - DNA, 25 bp, Homo sapien
gtggctgctcccacgtgttggcgcc

SEQ ID NO: 125842 - DNA, 25 bp, Homo sapien
ccgccatcgggctcagcagcgtggt

SEQ ID NO: 125843 - DNA, 25 bp, Homo sapien
cgcggctcttcagcgggcgctaaca

SEQ ID NO: 125844 - DNA, 25 bp, Homo sapien
tctgcactccggctcggttccagcg

SEQ ID NO: 125845 - DNA, 25 bp, Homo sapien
tcaggatctgcagccataggccggt

SEQ ID NO: 125846 - DNA, 25 bp, Homo sapien
ccgttctagaggtccttgagcccct

SEQ ID NO: 125847 - DNA, 25 bp, Homo sapien
atctgcagccataggccggtgtgtt

SEQ ID NO: 125848 - DNA, 25 bp, Homo sapien
ccataggccggtgtgttccgcgttt

SEQ ID NO: 125849 - DNA, 25 bp, Homo sapien
gtgttccgcgtttgtgctgctccag

SEQ ID NO: 125850 - DNA, 25 bp, Homo sapien
atccggtctcgatcccatccagagg

SEQ ID NO: 125851 - DNA, 25 bp, Homo sapien
tcgatcccatccagaggagcgtttc

SEQ ID NO: 125852 - DNA, 25 bp, Homo sapien
tcccatccagaggagcgtttcccaa

SEQ ID NO: 125853 - DNA, 25 bp, Homo sapien
tggtgccagcgctcgtccggctgca

SEQ ID NO: 125854 - DNA, 25 bp, Homo sapien
aacgccgccctggagacaagagccg

SEQ ID NO: 125855 - DNA, 25 bp, Homo sapien
ccctggagacaagagccgcagagca

SEQ ID NO: 125856 - DNA, 25 bp, Homo sapien
cagcgctgccgtcaggccgtccctg

SEQ ID NO: 125857 - DNA, 25 bp, Homo sapien
tccggctgcagctacgacctcccgc

SEQ ID NO: 125858 - DNA, 25 bp, Homo sapien
tcccgcgtctggctgctgtggaact

SEQ ID NO: 125859 - DNA, 25 bp, Homo sapien
gcgacagtgcgcacgcgggatccat

SEQ ID NO: 125860 - DNA, 25 bp, Homo sapien
cgggacgccatgaccgcgacagtgc

SEQ ID NO: 125861 - DNA, 25 bp, Homo sapien
caggcattcgcaccaccccccactc

SEQ ID NO: 125862 - DNA, 25 bp, Homo sapien
cgcaggagcaaaccgcgccatgtct

SEQ ID NO: 125863 - DNA, 25 bp, Homo sapien
gctaaaactactcctgcctgcatac

SEQ ID NO: 125864 - DNA, 25 bp, Homo sapien
ggctaaaactactcctgcctgcata

SEQ ID NO: 125865 - DNA, 25 bp, Homo sapien
cgcctgcgatcaacggccggaagcg

SEQ ID NO: 125866 - DNA, 25 bp, Homo sapien
tgatcgcctgcgatcaacggccgga

SEQ ID NO: 125867 - DNA, 25 bp, Homo sapien
gatcgcctgcgatcaacggccggaa

SEQ ID NO: 125868 - DNA, 25 bp, Homo sapien
atcgcctgcgatcaacggccggaag

SEQ ID NO: 125869 - DNA, 25 bp, Homo sapien
agacatggcgcggtttgctcctgcg

SEQ ID NO: 125870 - DNA, 25 bp, Homo sapien
tatgcaggcaggagtagttttagcc

SEQ ID NO: 125871 - DNA, 25 bp, Homo sapien
atgcaggcaggagtagttttagccg

SEQ ID NO: 125872 - DNA, 25 bp, Homo sapien
cgcttccggccgttgatcgcaggcg

SEQ ID NO: 125873 - DNA, 25 bp, Homo sapien
cttccggccgttgatcgcaggcgat

SEQ ID NO: 125874 - DNA, 25 bp, Homo sapien
tccggccgttgatcgcaggcgatca

SEQ ID NO: 125875 - DNA, 25 bp, Homo sapien
gccgttgatcgcaggcgatcaacta

SEQ ID NO: 125876 - DNA, 25 bp, Homo sapien
cggtttgctcctgcggggtatgcag

SEQ ID NO: 125877 - DNA, 25 bp, Homo sapien
ggggctgaccacttaccgcagcatc

SEQ ID NO: 125878 - DNA, 25 bp, Homo sapien
cgccttcggggcttgagcttctgag

SEQ ID NO: 125879 - DNA, 25 bp, Homo sapien
cgcgtcagcaaaaacgccagggacg

SEQ ID NO: 125880 - DNA, 25 bp, Homo sapien
atacttcccgactgtcgccgtaatg

SEQ ID NO: 125881 - DNA, 25 bp, Homo sapien
ctgatcccgaccagctgggcgaaga

SEQ ID NO: 125882 - DNA, 25 bp, Homo sapien
ccgactgtcgccgtaatgagggtcg

SEQ ID NO: 125883 - DNA, 25 bp, Homo sapien
tgccgtgcgcgcgtcagcaaaaacg

SEQ ID NO: 125884 - DNA, 25 bp, Homo sapien
ggtctcttccgtgtcgcgtcctgat

SEQ ID NO: 125885 - DNA, 25 bp, Homo sapien
ctgctctgcggctcttgtctccagg

SEQ ID NO: 125886 - DNA, 25 bp, Homo sapien
caccagccgggcaccgcgcatggat

SEQ ID NO: 125887 - DNA, 25 bp, Homo sapien
catggatcccgcgtgcgcactgtcg

SEQ ID NO: 125888 - DNA, 25 bp, Homo sapien
ccgcgtgcgcactgtcgcggtcatg

SEQ ID NO: 125889 - DNA, 25 bp, Homo sapien
cactgtcgcggtcatggcgtcccgg

SEQ ID NO: 125890 - DNA, 25 bp, Homo sapien
cggctcttgtctccagggcggcgtt

SEQ ID NO: 125891 - DNA, 25 bp, Homo sapien
agttccacagcagccagacgcggga

SEQ ID NO: 125892 - DNA, 25 bp, Homo sapien
tgcagccggacgagcgctggcacca

SEQ ID NO: 125893 - DNA, 25 bp, Homo sapien
cacaggcaggcacacgtgagctcct

SEQ ID NO: 125894 - DNA, 25 bp, Homo sapien
ggctgctacaaagcgcggcgacgtc

SEQ ID NO: 125895 - DNA, 25 bp, Homo sapien
gcggagcacaggacgcttcctgcca

SEQ ID NO: 125896 - DNA, 25 bp, Homo sapien
ccctgcagagcatgggacgcttcct

SEQ ID NO: 125897 - DNA, 25 bp, Homo sapien
ttcctgccatggtgccgtggcaatg

SEQ ID NO: 125898 - DNA, 25 bp, Homo sapien
gcgtgaggtctgatgcacagccaca

SEQ ID NO: 125899 - DNA, 25 bp, Homo sapien
cacagacgagcagatgtgggcatcc

SEQ ID NO: 125900 - DNA, 25 bp, Homo sapien
tgggcatccgagtatttacaaggtc

SEQ ID NO: 125901 - DNA, 25 bp, Homo sapien
ggatctgagacatgtgcactccttc

SEQ ID NO: 125902 - DNA, 25 bp, Homo sapien
ggcctgtggatctgagacatgtgca

SEQ ID NO: 125903 - DNA, 25 bp, Homo sapien
ctacagcagcttgtcgtccaagggg

SEQ ID NO: 125904 - DNA, 25 bp, Homo sapien
tgtggatctgagacatgtgcactcc

SEQ ID NO: 125905 - DNA, 25 bp, Homo sapien
tggatcgtgaggcaagactgaagcc

SEQ ID NO: 125906 - DNA, 25 bp, Homo sapien
atcgtgaggcaagactgaagccagg

SEQ ID NO: 125907 - DNA, 25 bp, Homo sapien
gcctacagcagcttgtcgtccaagg

SEQ ID NO: 125908 - DNA, 25 bp, Homo sapien
caagactgaagccaggggtgtctgc

SEQ ID NO: 125909 - DNA, 25 bp, Homo sapien
cgcgcgctttcagcgacgtcacagg

SEQ ID NO: 125910 - DNA, 25 bp, Homo sapien
acgcgagaggatcctttcgggccaa

SEQ ID NO: 125911 - DNA, 25 bp, Homo sapien
gtcctgtgtattcctggctggagaa

SEQ ID NO: 125912 - DNA, 25 bp, Homo sapien
acaggggcgatatagtacctggagc

SEQ ID NO: 125913 - DNA, 25 bp, Homo sapien
acgtcatacacgctggccttccgcg

SEQ ID NO: 125914 - DNA, 25 bp, Homo sapien
cttagggcgcgacttcggtgacgtc

SEQ ID NO: 125915 - DNA, 25 bp, Homo sapien
ctcgagttccaattggctgcgcgtg

SEQ ID NO: 125916 - DNA, 25 bp, Homo sapien
acctggagctggtcagtctcctcag

SEQ ID NO: 125917 - DNA, 25 bp, Homo sapien
gatatccatgtgaactcgtgcccgg

SEQ ID NO: 125918 - DNA, 25 bp, Homo sapien
tccatgtgaactcgtgcccgtgtaa

SEQ ID NO: 125919 - DNA, 25 bp, Homo sapien
cgcgtgcagatatccatgtgaactc

SEQ ID NO: 125920 - DNA, 25 bp, Homo sapien
agacgcatgatcgtgtgtgcacaca

SEQ ID NO: 125921 - DNA, 25 bp, Homo sapien
atccttgtgaactcgtgcccgtgta

SEQ ID NO: 125922 - DNA, 25 bp, Homo sapien
tgcccgtgtaagacgcatgatcgtg

SEQ ID NO: 125923 - DNA, 25 bp, Homo sapien
atatccttgtgaactcgtgcccgtg

SEQ ID NO: 125924 - DNA, 25 bp, Homo sapien
atccatgtgaactcgtgcccgggta

SEQ ID NO: 125925 - DNA, 25 bp, Homo sapien
tcggcaggcccaacttccgcctacc

SEQ ID NO: 125926 - DNA, 25 bp, Homo sapien
cttcggcaggcccaacttccgccta

SEQ ID NO: 125927 - DNA, 25 bp, Homo sapien
ttcggcaggcccaacttccgcctac

SEQ ID NO: 125928 - DNA, 25 bp, Homo sapien
ggcaggcccaacttccgcctaccag

SEQ ID NO: 125929 - DNA, 25 bp, Homo sapien
caggcccaacttccgcctaccagtg

SEQ ID NO: 125930 - DNA, 25 bp, Homo sapien
ccaacttccgcctaccagtggcctc

SEQ ID NO: 125931 - DNA, 25 bp, Homo sapien
tggcctcttggcggcctctccaagt

SEQ ID NO: 125932 - DNA, 25 bp, Homo sapien
acagcctctgcaggtcccgaacttg

SEQ ID NO: 125933 - DNA, 25 bp, Homo sapien
tcctcgagtccgtctctccaggtcc

SEQ ID NO: 125934 - DNA, 25 bp, Homo sapien
cctcgagtccgtctctccaggtcca

SEQ ID NO: 125935 - DNA, 25 bp, Homo sapien
ctcgagtccgtctctccaggtccag

SEQ ID NO: 125936 - DNA, 25 bp, Homo sapien
cgagtccgtctctccaggtccagct

SEQ ID NO: 125937 - DNA, 25 bp, Homo sapien
gagtccgtctctccaggtccagctc

SEQ ID NO: 125938 - DNA, 25 bp, Homo sapien
tcgagtccgtctctccaggtccagc

SEQ ID NO: 125939 - DNA, 25 bp, Homo sapien
ttcctcgagtccgtctctccaggtc

SEQ ID NO: 125940 - DNA, 25 bp, Homo sapien
aggccctctcaagggtcacgcggcg

SEQ ID NO: 125941 - DNA, 25 bp, Homo sapien
caccgcctcctcagaagataaaaga

SEQ ID NO: 125942 - DNA, 25 bp, Homo sapien
agcctcttgaaggagctgccggcct

SEQ ID NO: 125943 - DNA, 25 bp, Homo sapien
cccgagtgaagctatcccaattgtt

SEQ ID NO: 125944 - DNA, 25 bp, Homo sapien
gagtctttgctttagttgacacagc

SEQ ID NO: 125945 - DNA, 25 bp, Homo sapien
gttgacacagcttcgcactagcacc

SEQ ID NO: 125946 - DNA, 25 bp, Homo sapien
gggccgccttgcctcaggcaagaaa

SEQ ID NO: 125947 - DNA, 25 bp, Homo sapien
ctggaaccagatccagccggctgga

SEQ ID NO: 125948 - DNA, 25 bp, Homo sapien
cgcggcctccagaagtgatagctaa

SEQ ID NO: 125949 - DNA, 25 bp, Homo sapien
ggcctccagaagtgatagctaattg

SEQ ID NO: 125950 - DNA, 25 bp, Homo sapien
ccggggatgtttgcagattacgtca

SEQ ID NO: 125951 - DNA, 25 bp, Homo sapien
ctgccgccggggatgtttgcagatt

SEQ ID NO: 125952 - DNA, 25 bp, Homo sapien
agagaaagggcccaattgtctggcg

SEQ ID NO: 125953 - DNA, 25 bp, Homo sapien
agtgatagctaattggggagagaaa

SEQ ID NO: 125954 - DNA, 25 bp, Homo sapien
cagattacgtcagcgctggcgagca

SEQ ID NO: 125955 - DNA, 25 bp, Homo sapien
tgtttgcagattacgtcagcgctgg

SEQ ID NO: 125956 - DNA, 25 bp, Homo sapien
gctccgctgcgcttggctccagata

SEQ ID NO: 125957 - DNA, 25 bp, Homo sapien
ccgatcgggcctccagggtagttgc

SEQ ID NO: 125958 - DNA, 25 bp, Homo sapien
cctccagggtagttgcgctctctgt

SEQ ID NO: 125959 - DNA, 25 bp, Homo sapien
tagttgcgctctctgtccactcctt

SEQ ID NO: 125960 - DNA, 25 bp, Homo sapien
tctgtccactccttcggcgcctgcg

SEQ ID NO: 125961 - DNA, 25 bp, Homo sapien
agaaggtgacctgatacgcagtgtg

SEQ ID NO: 125962 - DNA, 25 bp, Homo sapien
tgaagcgctccgctgcgcttggctc

SEQ ID NO: 125963 - DNA, 25 bp, Homo sapien
gacctgatacgcagtgtgcgctgcc

SEQ ID NO: 125964 - DNA, 25 bp, Homo sapien
gatcgcgtgcacttccttgccaaag

SEQ ID NO: 125965 - DNA, 25 bp, Homo sapien
ggttggacacggcaatgtggacctc

SEQ ID NO: 125966 - DNA, 25 bp, Homo sapien
ttggacacggcaatgtggacctcgc

SEQ ID NO: 125967 - DNA, 25 bp, Homo sapien
ctgatcgcgtgcacttccttgccaa

SEQ ID NO: 125968 - DNA, 25 bp, Homo sapien
cgtgcacttccttgccaaagaaagt

SEQ ID NO: 125969 - DNA, 25 bp, Homo sapien
gcgtgacgccgcgatgtacacctcg

SEQ ID NO: 125970 - DNA, 25 bp, Homo sapien
cgcgtgcacttccttgccaaagaaa

SEQ ID NO: 125971 - DNA, 25 bp, Homo sapien
gacacggcaatgtggacctcgccgc

SEQ ID NO: 125972 - DNA, 25 bp, Homo sapien
cgctactgcagggtatttggcagga

SEQ ID NO: 125973 - DNA, 25 bp, Homo sapien
tatttggcaggagtagtgtcttagc

SEQ ID NO: 125974 - DNA, 25 bp, Homo sapien
gcaggagtagtgtcttagccgcttc

SEQ ID NO: 125975 - DNA, 25 bp, Homo sapien
ctcgccaggcatgctgggagaagta

SEQ ID NO: 125976 - DNA, 25 bp, Homo sapien
ctgggagaagtagtttcttcaccgc

SEQ ID NO: 125977 - DNA, 25 bp, Homo sapien
tcttcaccgctttcggccgttgttc

SEQ ID NO: 125978 - DNA, 25 bp, Homo sapien
ttgttcgcagggctgcgagactaca

SEQ ID NO: 125979 - DNA, 25 bp, Homo sapien
cgcggtgcgctactgcagggtattt

SEQ ID NO: 125980 - DNA, 25 bp, Homo sapien
ggtcatatttcccatggacgccatc

SEQ ID NO: 125981 - DNA, 25 bp, Homo sapien
gggccgtggtggtcatatttcccat

SEQ ID NO: 125982 - DNA, 25 bp, Homo sapien
ccagggacggccttacaacaacgca

SEQ ID NO: 125983 - DNA, 25 bp, Homo sapien
cccaaggcggctttgggttctgaat

SEQ ID NO: 125984 - DNA, 25 bp, Homo sapien
acacggcgcatggattccgcgagta

SEQ ID NO: 125985 - DNA, 25 bp, Homo sapien
gccaggcccgcgacatcgaaatcgg

SEQ ID NO: 125986 - DNA, 25 bp, Homo sapien
aacgctccactgcacgggatcgaga

SEQ ID NO: 125987 - DNA, 25 bp, Homo sapien
tcgaaatcggcgtccgttgcccacg

SEQ ID NO: 125988 - DNA, 25 bp, Homo sapien
cctctgagcgtctagagcggttccc

SEQ ID NO: 125989 - DNA, 25 bp, Homo sapien
acggcgatggcacccgtttcaactc

SEQ ID NO: 125990 - DNA, 25 bp, Homo sapien
ggagcgattaagagagtacagctcc

SEQ ID NO: 125991 - DNA, 25 bp, Homo sapien
ggctaggagcgattaagagagtaca

SEQ ID NO: 125992 - DNA, 25 bp, Homo sapien
gtcactaaggggctaggagcgatta

SEQ ID NO: 125993 - DNA, 25 bp, Homo sapien
tcgctttgtcactaaggggctagga

SEQ ID NO: 125994 - DNA, 25 bp, Homo sapien
tactgtcgctttgtcactaaggggc

SEQ ID NO: 125995 - DNA, 25 bp, Homo sapien
cagccctgcgaaataatactgtcgc

SEQ ID NO: 125996 - DNA, 25 bp, Homo sapien
ccctacaggaagttaaaggtcaatg

SEQ ID NO: 125997 - DNA, 25 bp, Homo sapien
tcgcccttcttagccggggctgacg

SEQ ID NO: 125998 - DNA, 25 bp, Homo sapien
acttggacagtcgacgccagggctt

SEQ ID NO: 125999 - DNA, 25 bp, Homo sapien
acagtcgacgccagggcttcgagga

SEQ ID NO: 126000 - DNA, 25 bp, Homo sapien
ggctgacggtgagcgtcccacttcc

SEQ ID NO: 126001 - DNA, 25 bp, Homo sapien
tgctgccgaaccctctcacgagacg

SEQ ID NO: 126002 - DNA, 25 bp, Homo sapien
gagctggcgccctacaggaagttaa

SEQ ID NO: 126003 - DNA, 25 bp, Homo sapien
cttccgcgccgacttggacagtcga

SEQ ID NO: 126004 - DNA, 25 bp, Homo sapien
gtgctgtaacagtggatgcacagtg

SEQ ID NO: 126005 - DNA, 25 bp, Homo sapien
aaaacccacagagcatgccatacca

SEQ ID NO: 126006 - DNA, 25 bp, Homo sapien
gatgcacagtggatattcatttatc

SEQ ID NO: 126007 - DNA, 25 bp, Homo sapien
cactattcagggtgcagggtgttga

SEQ ID NO: 126008 - DNA, 25 bp, Homo sapien
ctgctgcgtgtggtgctgtaacagt

SEQ ID NO: 126009 - DNA, 25 bp, Homo sapien
gccgtgtagggtcatcactgttgta

SEQ ID NO: 126010 - DNA, 25 bp, Homo sapien
cactgttgtaaatgcactattcagg

SEQ ID NO: 126011 - DNA, 25 bp, Homo sapien
gagcatgccataccaagaggggccc

SEQ ID NO: 126012 - DNA, 25 bp, Homo sapien
ggcgcttcgtcgcacccagcctctc

SEQ ID NO: 126013 - DNA, 25 bp, Homo sapien
ctggtgtttgcaccggcggacgatc

SEQ ID NO: 126014 - DNA, 25 bp, Homo sapien
tttgcaccggcggacgatctgctga

SEQ ID NO: 126015 - DNA, 25 bp, Homo sapien
gacgatctgctgacggttctggaga

SEQ ID NO: 126016 - DNA, 25 bp, Homo sapien
agagcgctgcgctggaacggagacc

SEQ ID NO: 126017 - DNA, 25 bp, Homo sapien
gggaacaccggaggcacaccatcac

SEQ ID NO: 126018 - DNA, 25 bp, Homo sapien
ctgcagcgccttggaggcggattca

SEQ ID NO: 126019 - DNA, 25 bp, Homo sapien
ctggactccacctttatctttcccg

SEQ ID NO: 126020 - DNA, 25 bp, Homo sapien
gtcaccaggtgtgagtgtcaccgtg

SEQ ID NO: 126021 - DNA, 25 bp, Homo sapien
ctcagccggcacaaggcaaaggttc

SEQ ID NO: 126022 - DNA, 25 bp, Homo sapien
ttcaaggacacggaacgggtgcctg

SEQ ID NO: 126023 - DNA, 25 bp, Homo sapien
tgaagatcgcagctggagccacctg

SEQ ID NO: 126024 - DNA, 25 bp, Homo sapien
acctgcagtggccaaagtgacaccc

SEQ ID NO: 126025 - DNA, 25 bp, Homo sapien
cacccaaccgtgaggacgctgcagg

SEQ ID NO: 126026 - DNA, 25 bp, Homo sapien
cgaggcgaagaaagactcagccggc

SEQ ID NO: 126027 - DNA, 25 bp, Homo sapien
cgcagcgtttgatgtggcacctgca

SEQ ID NO: 126028 - DNA, 25 bp, Homo sapien
tctagagctgttctcccgtgcggag

SEQ ID NO: 126029 - DNA, 25 bp, Homo sapien
ttgtaatactgtcgccttgccacca

SEQ ID NO: 126030 - DNA, 25 bp, Homo sapien
gccaccaacgggctacgagcggtta

SEQ ID NO: 126031 - DNA, 25 bp, Homo sapien
cccagacttgcgcatgctgggattg

SEQ ID NO: 126032 - DNA, 25 bp, Homo sapien
caacgggctacgagcggttaagaga

SEQ ID NO: 126033 - DNA, 25 bp, Homo sapien
cctctgcgcgtctagagctgttctc

SEQ ID NO: 126034 - DNA, 25 bp, Homo sapien
catgctgggattgtaatactgtcgc

SEQ ID NO: 126035 - DNA, 25 bp, Homo sapien
acggtgatggcacccgtttggactc

SEQ ID NO: 126036 - DNA, 25 bp, Homo sapien
aggccaggctttctggaagcgcctc

SEQ ID NO: 126037 - DNA, 25 bp, Homo sapien
ggcagctgaggctgcgccattcatg

SEQ ID NO: 126038 - DNA, 25 bp, Homo sapien
cgccattcatggctgcaggaccgag

SEQ ID NO: 126039 - DNA, 25 bp, Homo sapien
cggccacagccgctgattgggcgtc

SEQ ID NO: 126040 - DNA, 25 bp, Homo sapien
tctgccgggccatgctgcggctcga

SEQ ID NO: 126041 - DNA, 25 bp, Homo sapien
gccattcatgaaagcgcagcggaga

SEQ ID NO: 126042 - DNA, 25 bp, Homo sapien
cgggggttcagccaatcggctgttt

SEQ ID NO: 126043 - DNA, 25 bp, Homo sapien
aagcggggccattcatgaaagcgca

SEQ ID NO: 126044 - DNA, 25 bp, Homo sapien
tcacaggcgacgagatgttcacaac

SEQ ID NO: 126045 - DNA, 25 bp, Homo sapien
acacactgtgtagttgtcggcagga

SEQ ID NO: 126046 - DNA, 25 bp, Homo sapien
agggtggcgttgtcaccttcacaca

SEQ ID NO: 126047 - DNA, 25 bp, Homo sapien
acgcgggtcacatgctcgtccatga

SEQ ID NO: 126048 - DNA, 25 bp, Homo sapien
gacgtggacaatgaggtagacctga

SEQ ID NO: 126049 - DNA, 25 bp, Homo sapien
ccaggcaaagcaggttcacattacc

SEQ ID NO: 126050 - DNA, 25 bp, Homo sapien
tgccgctgctcagtagtctgtcatc

SEQ ID NO: 126051 - DNA, 25 bp, Homo sapien
acaggatgttggagcggttcagcca

SEQ ID NO: 126052 - DNA, 25 bp, Homo sapien
tgcactgggtggcaacgccacgccg

SEQ ID NO: 126053 - DNA, 25 bp, Homo sapien
ggttctgatctctctgccacctgca

SEQ ID NO: 126054 - DNA, 25 bp, Homo sapien
gtccctgccgaggttcgcttggctt

SEQ ID NO: 126055 - DNA, 25 bp, Homo sapien
ccctgccgaggttcgcttggcttgg

SEQ ID NO: 126056 - DNA, 25 bp, Homo sapien
agggttctgatctctctgccacctg

SEQ ID NO: 126057 - DNA, 25 bp, Homo sapien
tgatctctctgccacctgcactggg

SEQ ID NO: 126058 - DNA, 25 bp, Homo sapien
gatctctctgccacctgcactgggt

SEQ ID NO: 126059 - DNA, 25 bp, Homo sapien
gagggttctgatctctctgccacct

SEQ ID NO: 126060 - DNA, 25 bp, Homo sapien
aatggtagtcgcaggcagccctttt

SEQ ID NO: 126061 - DNA, 25 bp, Homo sapien
tcacgaatgcgcatgtgccagtggc

SEQ ID NO: 126062 - DNA, 25 bp, Homo sapien
cgagacttttatagtcccgcaatgg

SEQ ID NO: 126063 - DNA, 25 bp, Homo sapien
cgaggcagcctcacgaatgcgcatg

SEQ ID NO: 126064 - DNA, 25 bp, Homo sapien
tgcaccattgtccttgcttaggcgg

SEQ ID NO: 126065 - DNA, 25 bp, Homo sapien
aggccctgtggtcgagacttttata

SEQ ID NO: 126066 - DNA, 25 bp, Homo sapien
agtcccgcaatggtagtcgcaggca

SEQ ID NO: 126067 - DNA, 25 bp, Homo sapien
ttgtccttgcttaggcgggctgaca

SEQ ID NO: 126068 - DNA, 25 bp, Homo sapien
gagcgcctccttttccggtggccaa

SEQ ID NO: 126069 - DNA, 25 bp, Homo sapien
ggagcacaccacacccaagaagaga

SEQ ID NO: 126070 - DNA, 25 bp, Homo sapien
agagaaacctccgagcgcctccttt

SEQ ID NO: 126071 - DNA, 25 bp, Homo sapien
agaccctagcagtcctgtgcgcagg

SEQ ID NO: 126072 - DNA, 25 bp, Homo sapien
ctcgaattcggttcccagccgagca

SEQ ID NO: 126073 - DNA, 25 bp, Homo sapien
cctccatcgtctcgggatttcattc

SEQ ID NO: 126074 - DNA, 25 bp, Homo sapien
ctggtctagaaagaagaggagcaca

SEQ ID NO: 126075 - DNA, 25 bp, Homo sapien
gggctccttgaatccacctcgaatt

SEQ ID NO: 126076 - DNA, 25 bp, Homo sapien
ttctaggtcgccctggttcctggca

SEQ ID NO: 126077 - DNA, 25 bp, Homo sapien
tctcctacctagagcgcagccgttt

SEQ ID NO: 126078 - DNA, 25 bp, Homo sapien
agccgttttgcggaaggcacagtcc

SEQ ID NO: 126079 - DNA, 25 bp, Homo sapien
cccaacagctggtgctgagggtccg

SEQ ID NO: 126080 - DNA, 25 bp, Homo sapien
ctctacggtctcctctgacctgaga

SEQ ID NO: 126081 - DNA, 25 bp, Homo sapien
cccgcaaacgctcgggatgcggttt

SEQ ID NO: 126082 - DNA, 25 bp, Homo sapien
ccctgcagtcatggggtcaccggct

SEQ ID NO: 126083 - DNA, 25 bp, Homo sapien
tgtagctggacaccgagcaccatcc

SEQ ID NO: 126084 - DNA, 25 bp, Homo sapien
ttctgggcgtccacaggagctgcat

SEQ ID NO: 126085 - DNA, 25 bp, Homo sapien
ttggtgtccggcttcactcccaaac

SEQ ID NO: 126086 - DNA, 25 bp, Homo sapien
tctcatgtcaggcaagccagttccg

SEQ ID NO: 126087 - DNA, 25 bp, Homo sapien
cagaggtctccagcgacctggcgtc

SEQ ID NO: 126088 - DNA, 25 bp, Homo sapien
tttagagtggtctccaggccctagt

SEQ ID NO: 126089 - DNA, 25 bp, Homo sapien
tcgggacgctccacaccctgtgtgg

SEQ ID NO: 126090 - DNA, 25 bp, Homo sapien
gacttcctggcgctttgccctttgg

SEQ ID NO: 126091 - DNA, 25 bp, Homo sapien
gccgccgagccagtttagagtggtc

SEQ ID NO: 126092 - DNA, 25 bp, Homo sapien
ccagctcactcctttcggggcggtt

SEQ ID NO: 126093 - DNA, 25 bp, Homo sapien
gtcgcctcaatctccgcccgcagat

SEQ ID NO: 126094 - DNA, 25 bp, Homo sapien
ccctcgcgcgcgtcgcctcaatctc

SEQ ID NO: 126095 - DNA, 25 bp, Homo sapien
tccagctcactcctttcggggcggt

SEQ ID NO: 126096 - DNA, 25 bp, Homo sapien
atctacgcctaccatgtggagaggc

SEQ ID NO: 126097 - DNA, 25 bp, Homo sapien
tctacgcctaccatgtggagaggca

SEQ ID NO: 126098 - DNA, 25 bp, Homo sapien
gcctccccggcggttgcgcactccg

SEQ ID NO: 126099 - DNA, 25 bp, Homo sapien
agctcactcctttcggggcggttgg

SEQ ID NO: 126100 - DNA, 25 bp, Homo sapien
ccagcctgtttcctcgccttaggtg

SEQ ID NO: 126101 - DNA, 25 bp, Homo sapien
cccactgtgtctggatccctcgtga

SEQ ID NO: 126102 - DNA, 25 bp, Homo sapien
cccgtctaagaaccgcgaggcttca

SEQ ID NO: 126103 - DNA, 25 bp, Homo sapien
cagccgaaaggtagagtccagatgc

SEQ ID NO: 126104 - DNA, 25 bp, Homo sapien
tctccgaattccgtgatgacaggtg

SEQ ID NO: 126105 - DNA, 25 bp, Homo sapien
cagcggcagctggaattacacacca

SEQ ID NO: 126106 - DNA, 25 bp, Homo sapien
cccacagctgtggttttaagcacta

SEQ ID NO: 126107 - DNA, 25 bp, Homo sapien
accgtcagggttgttagattcgtgc

SEQ ID NO: 126108 - DNA, 25 bp, Homo sapien
ctggaagctgtgcagacggaattta

SEQ ID NO: 126109 - DNA, 25 bp, Homo sapien
cttctgcagaacatggaaaaggtcc

SEQ ID NO: 126110 - DNA, 25 bp, Homo sapien
gggctctgaacaacaccacgtttta

SEQ ID NO: 126111 - DNA, 25 bp, Homo sapien
tccttactaatgttactgccgttta

SEQ ID NO: 126112 - DNA, 25 bp, Homo sapien
tgcccagggactccacaattcctta

SEQ ID NO: 126113 - DNA, 25 bp, Homo sapien
tggccacatgctccagaataggact

SEQ ID NO: 126114 - DNA, 25 bp, Homo sapien
gctgtctcacttatgctaaggctca

SEQ ID NO: 126115 - DNA, 25 bp, Homo sapien
agaataggacttgggctccgcactg

SEQ ID NO: 126116 - DNA, 25 bp, Homo sapien
tgccagcatgggttgttcatcaccg

SEQ ID NO: 126117 - DNA, 25 bp, Homo sapien
tctcggtgcgcagggtgcctcaccg

SEQ ID NO: 126118 - DNA, 25 bp, Homo sapien
atgggttgttcatcaccgctgctgt

SEQ ID NO: 126119 - DNA, 25 bp, Homo sapien
gagcagcatgcgcatgtgtggagga

SEQ ID NO: 126120 - DNA, 25 bp, Homo sapien
tcctgatgccagcatgggttgttca

SEQ ID NO: 126121 - DNA, 25 bp, Homo sapien
gccagtcctgatgccagcatgggtt

SEQ ID NO: 126122 - DNA, 25 bp, Homo sapien
ggcgcgccagtcctgatgccagcat

SEQ ID NO: 126123 - DNA, 25 bp, Homo sapien
aggcgactgccaccgtggtgcgtga

SEQ ID NO: 126124 - DNA, 25 bp, Homo sapien
ctcgccgagggaaacggaatgtgtc

SEQ ID NO: 126125 - DNA, 25 bp, Homo sapien
tgccctcgacgacaacaaagtgctc

SEQ ID NO: 126126 - DNA, 25 bp, Homo sapien
gtgtcagtctgagtaatgcgccttc

SEQ ID NO: 126127 - DNA, 25 bp, Homo sapien
gggcactaaatctcctctcatcata

SEQ ID NO: 126128 - DNA, 25 bp, Homo sapien
tcctcgctttccatgactagtcctg

SEQ ID NO: 126129 - DNA, 25 bp, Homo sapien
tccatggggcttacggtgatttata

SEQ ID NO: 126130 - DNA, 25 bp, Homo sapien
tgcgccttcaatgcttctcaggagc

SEQ ID NO: 126131 - DNA, 25 bp, Homo sapien
tagtaatgatgaagcccgcggcgtc

SEQ ID NO: 126132 - DNA, 25 bp, Homo sapien
ggtggtcgtaaactcctcctcatag

SEQ ID NO: 126133 - DNA, 25 bp, Homo sapien
taaactcctcctcatagcttatggg

SEQ ID NO: 126134 - DNA, 25 bp, Homo sapien
tagtccaggtggtcgtaaactcctc

SEQ ID NO: 126135 - DNA, 25 bp, Homo sapien
tcacgcaggtggtagtagtccaggt

SEQ ID NO: 126136 - DNA, 25 bp, Homo sapien
tgcacatacccaggctcagctgagg

SEQ ID NO: 126137 - DNA, 25 bp, Homo sapien
ggggtgcacatacccaggctcagct

SEQ ID NO: 126138 - DNA, 25 bp, Homo sapien
cccagcacgaatggcaccgggcggt

SEQ ID NO: 126139 - DNA, 25 bp, Homo sapien
acccagcacctggagttccgattgg

SEQ ID NO: 126140 - DNA, 25 bp, Homo sapien
gaagagattttgtttcattcacagc

SEQ ID NO: 126141 - DNA, 25 bp, Homo sapien
ttgggtggcatctggcacaaatagg

SEQ ID NO: 126142 - DNA, 25 bp, Homo sapien
atctcagtgccttgggtggcatctg

SEQ ID NO: 126143 - DNA, 25 bp, Homo sapien
agattttgtttcattcacagctgca

SEQ ID NO: 126144 - DNA, 25 bp, Homo sapien
gagctttatgtaggaagagattttg

SEQ ID NO: 126145 - DNA, 25 bp, Homo sapien
agaacatgagctttatgtaggaaga

SEQ ID NO: 126146 - DNA, 25 bp, Homo sapien
ttttttaccctgcaagaacatgagc

SEQ ID NO: 126147 - DNA, 25 bp, Homo sapien
tttgtttcattcacagctgcatctc

SEQ ID NO: 126148 - DNA, 25 bp, Homo sapien
tgtgacatggaatgttaaacaatta

SEQ ID NO: 126149 - DNA, 25 bp, Homo sapien
gcttactgaagcaagggaatttgga

SEQ ID NO: 126150 - DNA, 25 bp, Homo sapien
ggcctagagaagcttactgaagcaa

SEQ ID NO: 126151 - DNA, 25 bp, Homo sapien
tgccgaaggaacattggcctagaga

SEQ ID NO: 126152 - DNA, 25 bp, Homo sapien
tcacaggaagaaaatgggtaatgcc

SEQ ID NO: 126153 - DNA, 25 bp, Homo sapien
tccatgtttatgtgatttgcattca

SEQ ID NO: 126154 - DNA, 25 bp, Homo sapien
ttggagtgagactttctcccgctgc

SEQ ID NO: 126155 - DNA, 25 bp, Homo sapien
ggtcaaatgtacttccatgtttatg

SEQ ID NO: 126156 - DNA, 25 bp, Homo sapien
tgtccttctggctacgggtccagga

SEQ ID NO: 126157 - DNA, 25 bp, Homo sapien
tcggcaaggaccagcccgcggaaca

SEQ ID NO: 126158 - DNA, 25 bp, Homo sapien
agggctggcatgagaccaatcgcga

SEQ ID NO: 126159 - DNA, 25 bp, Homo sapien
cctcccggaatctggtgggcaaaga

SEQ ID NO: 126160 - DNA, 25 bp, Homo sapien
cagggctcctggatcgtctggctcg

SEQ ID NO: 126161 - DNA, 25 bp, Homo sapien
aatcgcgaccctgcggttccagagc

SEQ ID NO: 126162 - DNA, 25 bp, Homo sapien
caaagagggcggctccttacgtagg

SEQ ID NO: 126163 - DNA, 25 bp, Homo sapien
ctcagtctcccagagggtggcgacc

SEQ ID NO: 126164 - DNA, 25 bp, Homo sapien
tcattggctgcggaggtcagaccgt

SEQ ID NO: 126165 - DNA, 25 bp, Homo sapien
accactgaggagtcgcgctgggtat

SEQ ID NO: 126166 - DNA, 25 bp, Homo sapien
tgtcacccgtgttcccgtggctctg

SEQ ID NO: 126167 - DNA, 25 bp, Homo sapien
cgctgggtatcggaccaggaactca

SEQ ID NO: 126168 - DNA, 25 bp, Homo sapien
ccacgccaggcgtgctcttctgttt

SEQ ID NO: 126169 - DNA, 25 bp, Homo sapien
gctcttctgtttctggctgtcccac

SEQ ID NO: 126170 - DNA, 25 bp, Homo sapien
cctgacaattgtctcggggtgccga

SEQ ID NO: 126171 - DNA, 25 bp, Homo sapien
aggaactcactgctttcattggctg

SEQ ID NO: 126172 - DNA, 25 bp, Homo sapien
aagcttcaaaggccgcttcggcggg

SEQ ID NO: 126173 - DNA, 25 bp, Homo sapien
aaaagcttcaaaggccgcttcggcg

SEQ ID NO: 126174 - DNA, 25 bp, Homo sapien
cgaaaagcttcaaaggccgcttcgg

SEQ ID NO: 126175 - DNA, 25 bp, Homo sapien
gacgaaaagcttcaaaggccgcttc

SEQ ID NO: 126176 - DNA, 25 bp, Homo sapien
ctgcaaaagcctcggtgcgggtgaa

SEQ ID NO: 126177 - DNA, 25 bp, Homo sapien
agccgcggcggagtggggcgaaaag

SEQ ID NO: 126178 - DNA, 25 bp, Homo sapien
cggcggcccaggcaaaaggccgcaa

SEQ ID NO: 126179 - DNA, 25 bp, Homo sapien
gaaaagcttcaaaggccgcttcggc

SEQ ID NO: 126180 - DNA, 25 bp, Homo sapien
ggcattacccattttcttcctgtga

SEQ ID NO: 126181 - DNA, 25 bp, Homo sapien
gaaagtctcactccaaattcccttg

SEQ ID NO: 126182 - DNA, 25 bp, Homo sapien
tcccttgcttcagtaagcttctcta

SEQ ID NO: 126183 - DNA, 25 bp, Homo sapien
tgttccttcggcattacccattttc

SEQ ID NO: 126184 - DNA, 25 bp, Homo sapien
tcttcctgtgaatgcaaatcacata

SEQ ID NO: 126185 - DNA, 25 bp, Homo sapien
catggaagtacatttgaccatttta

SEQ ID NO: 126186 - DNA, 25 bp, Homo sapien
gcttctctaggccaatgttccttcg

SEQ ID NO: 126187 - DNA, 25 bp, Homo sapien
cgcagcgggagaaagtctcactcca

SEQ ID NO: 126188 - DNA, 25 bp, Homo sapien
gagatgcagctgtgaatgaaacaaa

SEQ ID NO: 126189 - DNA, 25 bp, Homo sapien
gctgtgaatgaaacaaaatctcttc

SEQ ID NO: 126190 - DNA, 25 bp, Homo sapien
aatctcttcctacataaagctcatg

SEQ ID NO: 126191 - DNA, 25 bp, Homo sapien
ctcttcctacataaagctcatgttc

SEQ ID NO: 126192 - DNA, 25 bp, Homo sapien
agctcatgttcttgcagggtaaaaa

SEQ ID NO: 126193 - DNA, 25 bp, Homo sapien
cagatgccacccaaggcactgagat

SEQ ID NO: 126194 - DNA, 25 bp, Homo sapien
gcctatttgtgccagatgccaccca

SEQ ID NO: 126195 - DNA, 25 bp, Homo sapien
aagcctatttgtgccagatgccacc

SEQ ID NO: 126196 - DNA, 25 bp, Homo sapien
agctgaatctgctgctggcgtaggc

SEQ ID NO: 126197 - DNA, 25 bp, Homo sapien
cgcttactgggacccgggtcctctg

SEQ ID NO: 126198 - DNA, 25 bp, Homo sapien
cgctgcgcttactgggacccgggtc

SEQ ID NO: 126199 - DNA, 25 bp, Homo sapien
cgggctttcggtcattaacctggtg

SEQ ID NO: 126200 - DNA, 25 bp, Homo sapien
ttcggtcattaacctggtgatggca

SEQ ID NO: 126201 - DNA, 25 bp, Homo sapien
ctccggccgcgctccgagctgagcc

SEQ ID NO: 126202 - DNA, 25 bp, Homo sapien
cctggtgatggcagctgaatctgct

SEQ ID NO: 126203 - DNA, 25 bp, Homo sapien
gccgccaccggctctcccatgtccg

SEQ ID NO: 126204 - DNA, 25 bp, Homo sapien
cgtggcctctaagatgaaggagacc

SEQ ID NO: 126205 - DNA, 25 bp, Homo sapien
acttgcagagtcttttcacgcggcg

SEQ ID NO: 126206 - DNA, 25 bp, Homo sapien
ctctgacatatctgctcctccgagg

SEQ ID NO: 126207 - DNA, 25 bp, Homo sapien
acggccgagaagctgtgcatctaca

SEQ ID NO: 126208 - DNA, 25 bp, Homo sapien
tcgctggagcccgtgaaaaagagcc

SEQ ID NO: 126209 - DNA, 25 bp, Homo sapien
gaactacctggaccgcttcctgtcg

SEQ ID NO: 126210 - DNA, 25 bp, Homo sapien
cctccgtaggtctgcgaggaacaga

SEQ ID NO: 126211 - DNA, 25 bp, Homo sapien
cgaggagctgctggtaaccactgga

SEQ ID NO: 126212 - DNA, 25 bp, Homo sapien
acggattccagtagggccgagcaca

SEQ ID NO: 126213 - DNA, 25 bp, Homo sapien
tcagccggacagtcgccttattacg

SEQ ID NO: 126214 - DNA, 25 bp, Homo sapien
tcctgcccgtctttacagatgaaca

SEQ ID NO: 126215 - DNA, 25 bp, Homo sapien
ctccggaaccgtaatgcgcgctttt

SEQ ID NO: 126216 - DNA, 25 bp, Homo sapien
ccctgcttgttgagtgtccggataa

SEQ ID NO: 126217 - DNA, 25 bp, Homo sapien
cgctttcaagcgttccaagggcatt

SEQ ID NO: 126218 - DNA, 25 bp, Homo sapien
ggcccggttctgtcactttcttcag

SEQ ID NO: 126219 - DNA, 25 bp, Homo sapien
tatgttcggcaccacagctggactg

SEQ ID NO: 126220 - DNA, 25 bp, Homo sapien
gtttgcgataatattggggaccctc

SEQ ID NO: 126221 - DNA, 25 bp, Homo sapien
cctgtgcgccggaatgaaacttgca

SEQ ID NO: 126222 - DNA, 25 bp, Homo sapien
cgcatgctaagctgaaatcccttta

SEQ ID NO: 126223 - DNA, 25 bp, Homo sapien
tggccaccatcttgggctgctgctg

SEQ ID NO: 126224 - DNA, 25 bp, Homo sapien
tcagtcccagggcaaattctaaagg

SEQ ID NO: 126225 - DNA, 25 bp, Homo sapien
ttgttctgaattatgccggctcctg

SEQ ID NO: 126226 - DNA, 25 bp, Homo sapien
ccgtccttgcatgctaaattagttc

SEQ ID NO: 126227 - DNA, 25 bp, Homo sapien
ggggaccctctcatgtaaccacgaa

SEQ ID NO: 126228 - DNA, 25 bp, Homo sapien
agcacttactgccaggaacagggta

SEQ ID NO: 126229 - DNA, 25 bp, Homo sapien
ctgagatcccgggtccgcaaacttg

SEQ ID NO: 126230 - DNA, 25 bp, Homo sapien
gaacagggtactccagtgcgccata

SEQ ID NO: 126231 - DNA, 25 bp, Homo sapien
atccggatagtgcatcccggccacg

SEQ ID NO: 126232 - DNA, 25 bp, Homo sapien
ctggcgttcaacattagcggggcgc

SEQ ID NO: 126233 - DNA, 25 bp, Homo sapien
gcgtccatttcttcctgcgtcgatg

SEQ ID NO: 126234 - DNA, 25 bp, Homo sapien
aaaaagcggctctagtgtgcggcgt

SEQ ID NO: 126235 - DNA, 25 bp, Homo sapien
ggcccaaagggaccataaagatgta

SEQ ID NO: 126236 - DNA, 25 bp, Homo sapien
tggtacttgctcaggccattgagga

SEQ ID NO: 126237 - DNA, 25 bp, Homo sapien
ggtacttgctcaggccattgaggag

SEQ ID NO: 126238 - DNA, 25 bp, Homo sapien
tacttgctcaggccattgaggagct

SEQ ID NO: 126239 - DNA, 25 bp, Homo sapien
ctggcgctggctggtacttgctcag

SEQ ID NO: 126240 - DNA, 25 bp, Homo sapien
cgctggctggtacttgctcaggcca

SEQ ID NO: 126241 - DNA, 25 bp, Homo sapien
ctggctggtacttgctcaggccatt

SEQ ID NO: 126242 - DNA, 25 bp, Homo sapien
ggctggtacttgctcaggccattga

SEQ ID NO: 126243 - DNA, 25 bp, Homo sapien
ctggtacttgctcaggccattgagg

SEQ ID NO: 126244 - DNA, 25 bp, Homo sapien
ccttgcaatgtgctagttagaccgc

SEQ ID NO: 126245 - DNA, 25 bp, Homo sapien
ctcttcggccgttgcgcactccacc

SEQ ID NO: 126246 - DNA, 25 bp, Homo sapien
tgcaatgtgctagttagaccgctcc

SEQ ID NO: 126247 - DNA, 25 bp, Homo sapien
caatgtgctagttagaccgctcctt

SEQ ID NO: 126248 - DNA, 25 bp, Homo sapien
atgtgctagttagaccgctccttta

SEQ ID NO: 126249 - DNA, 25 bp, Homo sapien
gtgctagttagaccgctcctttaag

SEQ ID NO: 126250 - DNA, 25 bp, Homo sapien
tccgcccgccgatccggcctcttcg

SEQ ID NO: 126251 - DNA, 25 bp, Homo sapien
catccttgcaatgtgctagttagac

SEQ ID NO: 126252 - DNA, 25 bp, Homo sapien
cgtctgcggcgctaagaaaagcgcg

SEQ ID NO: 126253 - DNA, 25 bp, Homo sapien
ttggttgaggacgagtgccaggcct

SEQ ID NO: 126254 - DNA, 25 bp, Homo sapien
gtcgtgatgcgcctgaagccatccg

SEQ ID NO: 126255 - DNA, 25 bp, Homo sapien
gtgatgcgcctgaagccatccgcgc

SEQ ID NO: 126256 - DNA, 25 bp, Homo sapien
ccatccgcgccatcttggttgagga

SEQ ID NO: 126257 - DNA, 25 bp, Homo sapien
cggccaccgtctgcggcgctaagaa

SEQ ID NO: 126258 - DNA, 25 bp, Homo sapien
gagcgccgcccaggcaaccgccgac

SEQ ID NO: 126259 - DNA, 25 bp, Homo sapien
ccgcgccatcttggttgaggacgag

SEQ ID NO: 126260 - DNA, 25 bp, Homo sapien
cccagacacaggttgtggaggttcg

SEQ ID NO: 126261 - DNA, 25 bp, Homo sapien
tcggctctcagaggtccaactgtta

SEQ ID NO: 126262 - DNA, 25 bp, Homo sapien
tgttaggctcctcgcgtaccaaaag

SEQ ID NO: 126263 - DNA, 25 bp, Homo sapien
taccaaaagggacgcgtccagacta

SEQ ID NO: 126264 - DNA, 25 bp, Homo sapien
cagactagagtctggacttccatga

SEQ ID NO: 126265 - DNA, 25 bp, Homo sapien
ggcgtgttcctgtatccttcgccca

SEQ ID NO: 126266 - DNA, 25 bp, Homo sapien
ttccatgaggtccagactcgtcgcc

SEQ ID NO: 126267 - DNA, 25 bp, Homo sapien
gactcggaacctcgcgccgcaggtt

SEQ ID NO: 126268 - DNA, 25 bp, Homo sapien
aggaccgaagcttccggacgacgag

SEQ ID NO: 126269 - DNA, 25 bp, Homo sapien
ggtcttgtcttccagacccggagga

SEQ ID NO: 126270 - DNA, 25 bp, Homo sapien
gtcgtcagtccggtcttgtcttcca

SEQ ID NO: 126271 - DNA, 25 bp, Homo sapien
gggctgcgctccctcaagcgcagtg

SEQ ID NO: 126272 - DNA, 25 bp, Homo sapien
ggcgcgacactatccgtgcggccag

SEQ ID NO: 126273 - DNA, 25 bp, Homo sapien
cgcttagcctccagctcagcgggag

SEQ ID NO: 126274 - DNA, 25 bp, Homo sapien
attggaggatggaggcaacgcccac

SEQ ID NO: 126275 - DNA, 25 bp, Homo sapien
aggaaccgcccaacatggcctcgga

SEQ ID NO: 126276 - DNA, 25 bp, Homo sapien
cgggacgtcatggaagtgtaagtct

SEQ ID NO: 126277 - DNA, 25 bp, Homo sapien
acagctgtgaagtgtgaggttcttt

SEQ ID NO: 126278 - DNA, 25 bp, Homo sapien
aagtgtaagtcttctcgggcgcgtc

SEQ ID NO: 126279 - DNA, 25 bp, Homo sapien
cgaggagcccaacggtttgaccgct

SEQ ID NO: 126280 - DNA, 25 bp, Homo sapien
acggtttgaccgctgagagctgaga

SEQ ID NO: 126281 - DNA, 25 bp, Homo sapien
ggacgaacgggactctcgctttgcc

SEQ ID NO: 126282 - DNA, 25 bp, Homo sapien
gggactctcgctttgcccttccgaa

SEQ ID NO: 126283 - DNA, 25 bp, Homo sapien
aagtgtgaggttctttgtctgctgg

SEQ ID NO: 126284 - DNA, 25 bp, Homo sapien
cccgttgtacgtagtcctgtctgca

SEQ ID NO: 126285 - DNA, 25 bp, Homo sapien
agtcctgtctgcatggcagtcgccc

SEQ ID NO: 126286 - DNA, 25 bp, Homo sapien
acgcgcgctgttgctagggcaacca

SEQ ID NO: 126287 - DNA, 25 bp, Homo sapien
agccggccggaactcacgaatcaga

SEQ ID NO: 126288 - DNA, 25 bp, Homo sapien
atcagagcagccgacacatcgtccg

SEQ ID NO: 126289 - DNA, 25 bp, Homo sapien
tccgctcagccaatcgtagcagatg

SEQ ID NO: 126290 - DNA, 25 bp, Homo sapien
tctcgccgggatcggacatttgccc

SEQ ID NO: 126291 - DNA, 25 bp, Homo sapien
agcagatgtgtgatcccgccacctc

SEQ ID NO: 126292 - DNA, 25 bp, Homo sapien
ccgacgggaaccagttctgggcctg

SEQ ID NO: 126293 - DNA, 25 bp, Homo sapien
ctggggcctacaacggctgccagga

SEQ ID NO: 126294 - DNA, 25 bp, Homo sapien
acgagatgagcctcctcaagaggcc

SEQ ID NO: 126295 - DNA, 25 bp, Homo sapien
cacgagccgggcctagagaagcctt

SEQ ID NO: 126296 - DNA, 25 bp, Homo sapien
ccacgggcgcagacgcgagcaaaga

SEQ ID NO: 126297 - DNA, 25 bp, Homo sapien
gcctactttgggacgctttgggcca

SEQ ID NO: 126298 - DNA, 25 bp, Homo sapien
acgctttgggccactttgggccaca

SEQ ID NO: 126299 - DNA, 25 bp, Homo sapien
tgggccacatcgaggaaggcagctt

SEQ ID NO: 126300 - DNA, 25 bp, Homo sapien
tgcctgggtcggctcccattcagct

SEQ ID NO: 126301 - DNA, 25 bp, Homo sapien
gacaaagatgccacactcatccctg

SEQ ID NO: 126302 - DNA, 25 bp, Homo sapien
cgatggggccgacaaagatgccaca

SEQ ID NO: 126303 - DNA, 25 bp, Homo sapien
gaagttgtttattctctcgggatga

SEQ ID NO: 126304 - DNA, 25 bp, Homo sapien
caaggccgaagttgtttattctctc

SEQ ID NO: 126305 - DNA, 25 bp, Homo sapien
tttctaagttgttacggcgcccagc

SEQ ID NO: 126306 - DNA, 25 bp, Homo sapien
tctctcgggatgaagtctcggatgg

SEQ ID NO: 126307 - DNA, 25 bp, Homo sapien
cctctctttaacaaggccgaagttg

SEQ ID NO: 126308 - DNA, 25 bp, Homo sapien
atgctctgcaagtggcgtccctgca

SEQ ID NO: 126309 - DNA, 25 bp, Homo sapien
tacgcattaggagtgagcaccgctc

SEQ ID NO: 126310 - DNA, 25 bp, Homo sapien
agcaccgctcagtagatgacacaga

SEQ ID NO: 126311 - DNA, 25 bp, Homo sapien
cgggcacaccggaaacagcgacatc

SEQ ID NO: 126312 - DNA, 25 bp, Homo sapien
aggaacccagaaggcttgacgcgca

SEQ ID NO: 126313 - DNA, 25 bp, Homo sapien
cccaggaaatcgcagtcggagccca

SEQ ID NO: 126314 - DNA, 25 bp, Homo sapien
cagcacggggtcttggaagaaaaga

SEQ ID NO: 126315 - DNA, 25 bp, Homo sapien
acgccgcagcctaggaagcatcttc

SEQ ID NO: 126316 - DNA, 25 bp, Homo sapien
agctcctcaatggacagcacaagcc

SEQ ID NO: 126317 - DNA, 25 bp, Homo sapien
agcacaagcccgctagagccagctg

SEQ ID NO: 126318 - DNA, 25 bp, Homo sapien
aagggcttgacgctactggagcacg

SEQ ID NO: 126319 - DNA, 25 bp, Homo sapien
cggcggcaggcaacaataagctaca

SEQ ID NO: 126320 - DNA, 25 bp, Homo sapien
agaggtgcgcccaatcggaactcga

SEQ ID NO: 126321 - DNA, 25 bp, Homo sapien
tgacatcgccgaagacacgcgcctt

SEQ ID NO: 126322 - DNA, 25 bp, Homo sapien
agagccagctgcagtccttgccacg

SEQ ID NO: 126323 - DNA, 25 bp, Homo sapien
cccagcgggcacaagcacaaggtgg

SEQ ID NO: 126324 - DNA, 25 bp, Homo sapien
ccaagaccgacaggcggcatcgatg

SEQ ID NO: 126325 - DNA, 25 bp, Homo sapien
ggtgccaagaccgacaggcggcatc

SEQ ID NO: 126326 - DNA, 25 bp, Homo sapien
ggctggccaagccagacacggcgca

SEQ ID NO: 126327 - DNA, 25 bp, Homo sapien
ggtgctccggctggccaagccagac

SEQ ID NO: 126328 - DNA, 25 bp, Homo sapien
ggcatcgatgcacaccgggcaccga

SEQ ID NO: 126329 - DNA, 25 bp, Homo sapien
tgccggacatctcgcagacttcggg

SEQ ID NO: 126330 - DNA, 25 bp, Homo sapien
tctcgcagacttcgggcagcgatcg

SEQ ID NO: 126331 - DNA, 25 bp, Homo sapien
ggactgccggacatctcgcagactt

SEQ ID NO: 126332 - DNA, 25 bp, Homo sapien
tccgaggaaaaaccagcgcagctcc

SEQ ID NO: 126333 - DNA, 25 bp, Homo sapien
tagggtccgcaggcccagaccaggc

SEQ ID NO: 126334 - DNA, 25 bp, Homo sapien
tttaccgctgcctgtactactactg

SEQ ID NO: 126335 - DNA, 25 bp, Homo sapien
ctactgcctgcgctacttcccagcc

SEQ ID NO: 126336 - DNA, 25 bp, Homo sapien
agggcacgttcaggcagaagctcct

SEQ ID NO: 126337 - DNA, 25 bp, Homo sapien
tcagtggccacaagtccgctagctc

SEQ ID NO: 126338 - DNA, 25 bp, Homo sapien
taccaggctccactccgaggaaaaa

SEQ ID NO: 126339 - DNA, 25 bp, Homo sapien
aggcgcgcccctgtgatatctcaca

SEQ ID NO: 126340 - DNA, 25 bp, Homo sapien
agtggatccacttcctctgcgccga

SEQ ID NO: 126341 - DNA, 25 bp, Homo sapien
tgcagtctacgtcggtcacgcagta

SEQ ID NO: 126342 - DNA, 25 bp, Homo sapien
tcacgcagtacttggccgagtccga

SEQ ID NO: 126343 - DNA, 25 bp, Homo sapien
tcggggaagtagtccaccatgtgtg

SEQ ID NO: 126344 - DNA, 25 bp, Homo sapien
attgtcctccagcaggtccttcttg

SEQ ID NO: 126345 - DNA, 25 bp, Homo sapien
tggcgctgacgtaccgatgctcaaa

SEQ ID NO: 126346 - DNA, 25 bp, Homo sapien
tggccttgttctgctccaacttgta

SEQ ID NO: 126347 - DNA, 25 bp, Homo sapien
accaggacttggtcgtattcactga

SEQ ID NO: 126348 - DNA, 25 bp, Homo sapien
ggccaacgagccacagacagtcctg

SEQ ID NO: 126349 - DNA, 25 bp, Homo sapien
cagcggctgcaaccagtgcaggacc

SEQ ID NO: 126350 - DNA, 25 bp, Homo sapien
gtggcagcagcagactatccttatg

SEQ ID NO: 126351 - DNA, 25 bp, Homo sapien
agcgcctggcgtttacgctggccaa

SEQ ID NO: 126352 - DNA, 25 bp, Homo sapien
tcgcgactggtaccagcagcggctg

SEQ ID NO: 126353 - DNA, 25 bp, Homo sapien
agccagagcggacccagagcgcaag

SEQ ID NO: 126354 - DNA, 25 bp, Homo sapien
cgcggacgcaggttcattggcctgc

SEQ ID NO: 126355 - DNA, 25 bp, Homo sapien
agtcggaggctcaccatcaccagcg

SEQ ID NO: 126356 - DNA, 25 bp, Homo sapien
agacgccggcaaccagcgcctgaga

SEQ ID NO: 126357 - DNA, 25 bp, Homo sapien
cgcgtcgttcgggtaggtctcgact

SEQ ID NO: 126358 - DNA, 25 bp, Homo sapien
agagccgcgctgctcttggccctag

SEQ ID NO: 126359 - DNA, 25 bp, Homo sapien
tcccggcaccgccagaatgcacgtt

SEQ ID NO: 126360 - DNA, 25 bp, Homo sapien
atgcacgttacgcacggcgtgcaaa

SEQ ID NO: 126361 - DNA, 25 bp, Homo sapien
taggtctcgactccgcggtccgcta

SEQ ID NO: 126362 - DNA, 25 bp, Homo sapien
ttacgcacggcgtgcaaacgtcact

SEQ ID NO: 126363 - DNA, 25 bp, Homo sapien
gcctgagacagagaagccgcgcact

SEQ ID NO: 126364 - DNA, 25 bp, Homo sapien
ggctgctcaggccttccattgagga

SEQ ID NO: 126365 - DNA, 25 bp, Homo sapien
cctgtgtgaagggataaggcgtcta

SEQ ID NO: 126366 - DNA, 25 bp, Homo sapien
tgagaaccctcttcacggcagactc

SEQ ID NO: 126367 - DNA, 25 bp, Homo sapien
gaagacgactttctggagccggcca

SEQ ID NO: 126368 - DNA, 25 bp, Homo sapien
ggcagactccgacgcccagttatga

SEQ ID NO: 126369 - DNA, 25 bp, Homo sapien
cctgctcttcgactgggcgagcttc

SEQ ID NO: 126370 - DNA, 25 bp, Homo sapien
ccatgtccagctctgacgccgaaga

SEQ ID NO: 126371 - DNA, 25 bp, Homo sapien
ctggggccagacacacgagtaagtc

SEQ ID NO: 126372 - DNA, 25 bp, Homo sapien
atgacctctctggaacgcgcctagc

SEQ ID NO: 126373 - DNA, 25 bp, Homo sapien
cccggacaagcccttgaaggcctga

SEQ ID NO: 126374 - DNA, 25 bp, Homo sapien
cggacaacggagaccagacctactg

SEQ ID NO: 126375 - DNA, 25 bp, Homo sapien
gtgacgtttgcacggcttgcgtatc

SEQ ID NO: 126376 - DNA, 25 bp, Homo sapien
ttcctccggtgaagagccaaaggcc

SEQ ID NO: 126377 - DNA, 25 bp, Homo sapien
cgaccctttggatccggctcacatt

SEQ ID NO: 126378 - DNA, 25 bp, Homo sapien
ccacagactaggaaaggcaggcttc

SEQ ID NO: 126379 - DNA, 25 bp, Homo sapien
agaccacagctcttggccgcgacag

SEQ ID NO: 126380 - DNA, 25 bp, Homo sapien
cgctgtccttcttcccatattctgg

SEQ ID NO: 126381 - DNA, 25 bp, Homo sapien
acggcctgacctggatcacttcctg

SEQ ID NO: 126382 - DNA, 25 bp, Homo sapien
gcgcggaggctaccctcttctattt

SEQ ID NO: 126383 - DNA, 25 bp, Homo sapien
gcggactggggaacccagacctgcc

SEQ ID NO: 126384 - DNA, 25 bp, Homo sapien
cccggaagtgatgtttgcgcgccgt

SEQ ID NO: 126385 - DNA, 25 bp, Homo sapien
aacatctgtggtcgcgcgggaccca

SEQ ID NO: 126386 - DNA, 25 bp, Homo sapien
gagcggcaccctactctgtgtaagc

SEQ ID NO: 126387 - DNA, 25 bp, Homo sapien
cacagactaggaaacgttggtttct

SEQ ID NO: 126388 - DNA, 25 bp, Homo sapien
cgtccagcgggtatgggccctgctc

SEQ ID NO: 126389 - DNA, 25 bp, Homo sapien
cctgagacccgcagcgccggacccg

SEQ ID NO: 126390 - DNA, 25 bp, Homo sapien
acgcggaccctgagacccgcagcgc

SEQ ID NO: 126391 - DNA, 25 bp, Homo sapien
caggtctggatctactcgccctccc

SEQ ID NO: 126392 - DNA, 25 bp, Homo sapien
gactccaggtctggatctactcgcc

SEQ ID NO: 126393 - DNA, 25 bp, Homo sapien
ccgtccacccgcgactccaggtctg

SEQ ID NO: 126394 - DNA, 25 bp, Homo sapien
ccggttcggtctccggtgtgcgcat

SEQ ID NO: 126395 - DNA, 25 bp, Homo sapien
cgcaggagagtggagcgaccctcat

SEQ ID NO: 126396 - DNA, 25 bp, Homo sapien
ccgcgcgtaacgtgcgttcgctggc

SEQ ID NO: 126397 - DNA, 25 bp, Homo sapien
aagtgacgtttacgcgccgcgcgta

SEQ ID NO: 126398 - DNA, 25 bp, Homo sapien
ctccgaagcagcgtctgtggtcgca

SEQ ID NO: 126399 - DNA, 25 bp, Homo sapien
ctgctcggctctcagctacaggagc

SEQ ID NO: 126400 - DNA, 25 bp, Homo sapien
cagacgctagttgccgggatctcca

SEQ ID NO: 126401 - DNA, 25 bp, Homo sapien
gccctccagctgttgcgcgtcggaa

SEQ ID NO: 126402 - DNA, 25 bp, Homo sapien
gggacttgatcccacgtcaccctag

SEQ ID NO: 126403 - DNA, 25 bp, Homo sapien
agcgacagactaggaaacgccggtt

SEQ ID NO: 126404 - DNA, 25 bp, Homo sapien
tgtcctcactggtggccatgtactc

SEQ ID NO: 126405 - DNA, 25 bp, Homo sapien
acctacatggccagcgtgtacaaca

SEQ ID NO: 126406 - DNA, 25 bp, Homo sapien
acacggtcatcatctcgcgagggaa

SEQ ID NO: 126407 - DNA, 25 bp, Homo sapien
cactatctgatcctgctggggcaca

SEQ ID NO: 126408 - DNA, 25 bp, Homo sapien
ggctctggacgccacactatctgat

SEQ ID NO: 126409 - DNA, 25 bp, Homo sapien
acgccacgctggtgttcatcggcta

SEQ ID NO: 126410 - DNA, 25 bp, Homo sapien
gctcttctacatctgcagccatgtg

SEQ ID NO: 126411 - DNA, 25 bp, Homo sapien
acccgcgcgctagagtgcgccaaga

SEQ ID NO: 126412 - DNA, 25 bp, Homo sapien
tcgcgccggtagtagtagcacaggc

SEQ ID NO: 126413 - DNA, 25 bp, Homo sapien
agcttctgcccgaccttctgtttgt

SEQ ID NO: 126414 - DNA, 25 bp, Homo sapien
agcacaggcagtgggaaagctcctc

SEQ ID NO: 126415 - DNA, 25 bp, Homo sapien
ttccgattggttccacatgaggggc

SEQ ID NO: 126416 - DNA, 25 bp, Homo sapien
ggcgacgcaatagcgccaggccttc

SEQ ID NO: 126417 - DNA, 25 bp, Homo sapien
aggccttccgcgtcgtcagagtgac

SEQ ID NO: 126418 - DNA, 25 bp, Homo sapien
ctagccggcttgcagtggccattaa

SEQ ID NO: 126419 - DNA, 25 bp, Homo sapien
ttgtagcttactggtgttggccgcc

SEQ ID NO: 126420 - DNA, 25 bp, Homo sapien
ggccattttctagccggcctcgcgg

SEQ ID NO: 126421 - DNA, 25 bp, Homo sapien
cgccgatggcccgtgtgggcccaaa

SEQ ID NO: 126422 - DNA, 25 bp, Homo sapien
gcgttctcaagatggcccttccagg

SEQ ID NO: 126423 - DNA, 25 bp, Homo sapien
gtctcgcggctcaaggcgttctcaa

SEQ ID NO: 126424 - DNA, 25 bp, Homo sapien
ctcaggcgtcacagtggcgtctcca

SEQ ID NO: 126425 - DNA, 25 bp, Homo sapien
tcgcggtagcctcaacaagcccagc

SEQ ID NO: 126426 - DNA, 25 bp, Homo sapien
gtgtgggcccaaagcgtcctgaagt

SEQ ID NO: 126427 - DNA, 25 bp, Homo sapien
tttctagccggcctcgcggtagcct

SEQ ID NO: 126428 - DNA, 25 bp, Homo sapien
ccggccatgctcgtgccggcttccc

SEQ ID NO: 126429 - DNA, 25 bp, Homo sapien
cacactcctgcctttcggtggcctc

SEQ ID NO: 126430 - DNA, 25 bp, Homo sapien
ggcctgactcctgcgtcccaatggc

SEQ ID NO: 126431 - DNA, 25 bp, Homo sapien
gggcccagctccttgctcgtggctg

SEQ ID NO: 126432 - DNA, 25 bp, Homo sapien
agcggcctccgtagacccgaagcct

SEQ ID NO: 126433 - DNA, 25 bp, Homo sapien
tgcctcccgctgatggcctgtgcgg

SEQ ID NO: 126434 - DNA, 25 bp, Homo sapien
ccaaggctcccttcctcaacgtcgg

SEQ ID NO: 126435 - DNA, 25 bp, Homo sapien
cccgacggcgtctcccagcccaagg

SEQ ID NO: 126436 - DNA, 25 bp, Homo sapien
gacttcccacgtctggagccgaggc

SEQ ID NO: 126437 - DNA, 25 bp, Homo sapien
ttggggagtgtttgcgtttcttctc

SEQ ID NO: 126438 - DNA, 25 bp, Homo sapien
cgggaaacatcttggtcgtttgcca

SEQ ID NO: 126439 - DNA, 25 bp, Homo sapien
gccgaggcctggataattcggattt

SEQ ID NO: 126440 - DNA, 25 bp, Homo sapien
cggcttttttcaccgcttctcaggg

SEQ ID NO: 126441 - DNA, 25 bp, Homo sapien
ctgcctctgacgaagcttgtcccgg

SEQ ID NO: 126442 - DNA, 25 bp, Homo sapien
ttccctgccggccttggagatggcg

SEQ ID NO: 126443 - DNA, 25 bp, Homo sapien
ttcggatttggcacgggaaacatct

SEQ ID NO: 126444 - DNA, 25 bp, Homo sapien
cacggccacattggttaggcggatc

SEQ ID NO: 126445 - DNA, 25 bp, Homo sapien
agcgacgtctcatgctcacagcagg

SEQ ID NO: 126446 - DNA, 25 bp, Homo sapien
gtgaagatcgacatcgcggctgttc

SEQ ID NO: 126447 - DNA, 25 bp, Homo sapien
cgcggctgttcaaagacccagaagc

SEQ ID NO: 126448 - DNA, 25 bp, Homo sapien
caggcttacttactgcgcaggcgtc

SEQ ID NO: 126449 - DNA, 25 bp, Homo sapien
tctgacaggatgctcgcggatgttt

SEQ ID NO: 126450 - DNA, 25 bp, Homo sapien
agcctggcccattcactcgacttgg

SEQ ID NO: 126451 - DNA, 25 bp, Homo sapien
tagcaggcgatttcgaagcgcttcc

SEQ ID NO: 126452 - DNA, 25 bp, Homo sapien
catcgggctatccaggtccgagatc

SEQ ID NO: 126453 - DNA, 25 bp, Homo sapien
cgcggtaccagtgcgaatcatcggg

SEQ ID NO: 126454 - DNA, 25 bp, Homo sapien
cggtaccagtgcgaatcatcgggct

SEQ ID NO: 126455 - DNA, 25 bp, Homo sapien
taccagtgcgaatcatcgggctatc

SEQ ID NO: 126456 - DNA, 25 bp, Homo sapien
ccagtgcgaatcatcgggctatcca

SEQ ID NO: 126457 - DNA, 25 bp, Homo sapien
agtgcgaatcatcgggctatccagg

SEQ ID NO: 126458 - DNA, 25 bp, Homo sapien
aatcatcgggctatccaggtccgag

SEQ ID NO: 126459 - DNA, 25 bp, Homo sapien
cgaatcatcgggctatccaggtccg

SEQ ID NO: 126460 - DNA, 25 bp, Homo sapien
ttccttcggagactgttgcacttga

SEQ ID NO: 126461 - DNA, 25 bp, Homo sapien
aggtccgagatcctagtctcctgtc

SEQ ID NO: 126462 - DNA, 25 bp, Homo sapien
gatcctagtctcctgtcggctctga

SEQ ID NO: 126463 - DNA, 25 bp, Homo sapien
atgggtaagggcactcggcgggcaa

SEQ ID NO: 126464 - DNA, 25 bp, Homo sapien
tcggagactgttgcacttgacagca

SEQ ID NO: 126465 - DNA, 25 bp, Homo sapien
tgttgcacttgacagcaccggctag

SEQ ID NO: 126466 - DNA, 25 bp, Homo sapien
tccaggtccgagatcctagtctcct

SEQ ID NO: 126467 - DNA, 25 bp, Homo sapien
cctagtctcctgtcggctctgagga

SEQ ID NO: 126468 - DNA, 25 bp, Homo sapien
gaagaaccgctctcagatagtcctg

SEQ ID NO: 126469 - DNA, 25 bp, Homo sapien
gaagaaccgctctcgcatacccttg

SEQ ID NO: 126470 - DNA, 25 bp, Homo sapien
aggactccaaacaaaacatcttcca

SEQ ID NO: 126471 - DNA, 25 bp, Homo sapien
tcctcagctacctggccaatgacat

SEQ ID NO: 126472 - DNA, 25 bp, Homo sapien
tgcccctgagcagcaacctgatttc

SEQ ID NO: 126473 - DNA, 25 bp, Homo sapien
tcagccggaggcctctcctggtggt

SEQ ID NO: 126474 - DNA, 25 bp, Homo sapien
ctctgggaagctgacctcagccgga

SEQ ID NO: 126475 - DNA, 25 bp, Homo sapien
tctcagatagtcctgttccagaaac

SEQ ID NO: 126476 - DNA, 25 bp, Homo sapien
tattagctccgtcaaaggtcgagtc

SEQ ID NO: 126477 - DNA, 25 bp, Homo sapien
aacgccgtggttctcaaggaggacg

SEQ ID NO: 126478 - DNA, 25 bp, Homo sapien
cttaaggcgcaaccaaggagcactg

SEQ ID NO: 126479 - DNA, 25 bp, Homo sapien
ccagtcgtagcctcggacggtttct

SEQ ID NO: 126480 - DNA, 25 bp, Homo sapien
taaaaccttatcacgggcgcggcgc

SEQ ID NO: 126481 - DNA, 25 bp, Homo sapien
taccggctctctaacgtgcaaggca

SEQ ID NO: 126482 - DNA, 25 bp, Homo sapien
cggcgttggccacctacaggtagga

SEQ ID NO: 126483 - DNA, 25 bp, Homo sapien
agggtcacaagggagatgtccgccc

SEQ ID NO: 126484 - DNA, 25 bp, Homo sapien
cgcacgcaggcctcgtagtagggca

SEQ ID NO: 126485 - DNA, 25 bp, Homo sapien
ctcgtagtagggcaggtggtatacc

SEQ ID NO: 126486 - DNA, 25 bp, Homo sapien
tagtagggcaggtggtatacctgca

SEQ ID NO: 126487 - DNA, 25 bp, Homo sapien
atggcggggcatcaggctttgccac

SEQ ID NO: 126488 - DNA, 25 bp, Homo sapien
atcaggctttgccacctgcagggcc

SEQ ID NO: 126489 - DNA, 25 bp, Homo sapien
aggcagccacggcatcgcacagaca

SEQ ID NO: 126490 - DNA, 25 bp, Homo sapien
ggcaccacgtggacctcagccctga

SEQ ID NO: 126491 - DNA, 25 bp, Homo sapien
gccactgtcacacccacatgcgtcg

SEQ ID NO: 126492 - DNA, 25 bp, Homo sapien
cgagcgaaagcacgaacgagcgagc

SEQ ID NO: 126493 - DNA, 25 bp, Homo sapien
ccgctggagatttctttctgctttc

SEQ ID NO: 126494 - DNA, 25 bp, Homo sapien
tctgctttcctcatcgactgactga

SEQ ID NO: 126495 - DNA, 25 bp, Homo sapien
ttgaggaagggtgacctcttctctg

SEQ ID NO: 126496 - DNA, 25 bp, Homo sapien
ctcttctctgggactggaaaaaata

SEQ ID NO: 126497 - DNA, 25 bp, Homo sapien
gcagcgacagggtttgcttcttctc

SEQ ID NO: 126498 - DNA, 25 bp, Homo sapien
ctctcttccgctaatgattgcatta

SEQ ID NO: 126499 - DNA, 25 bp, Homo sapien
agtgagttttctccgaggcgtgtgt

SEQ ID NO: 126500 - DNA, 25 bp, Homo sapien
cccaccgtgggtgtctttgctagcc

SEQ ID NO: 126501 - DNA, 25 bp, Homo sapien
agccaatccgctggtgcactgcagg

SEQ ID NO: 126502 - DNA, 25 bp, Homo sapien
ttcacacggtactgagccgcgggct

SEQ ID NO: 126503 - DNA, 25 bp, Homo sapien
cttctgagctaattaggagacggtc

SEQ ID NO: 126504 - DNA, 25 bp, Homo sapien
agcggatcagaagctgcgcgcgctc

SEQ ID NO: 126505 - DNA, 25 bp, Homo sapien
cggcgagttgcagtcttctgagcta

SEQ ID NO: 126506 - DNA, 25 bp, Homo sapien
tagatcgctcgcgtctgatcgccgc

SEQ ID NO: 126507 - DNA, 25 bp, Homo sapien
tgccaggactcgttccagctccagt

SEQ ID NO: 126508 - DNA, 25 bp, Homo sapien
tcccgagtacagatcacggctcagc

SEQ ID NO: 126509 - DNA, 25 bp, Homo sapien
agggctctcttcaggacacgcagta

SEQ ID NO: 126510 - DNA, 25 bp, Homo sapien
ctcagcatctcatgggaaagggaca

SEQ ID NO: 126511 - DNA, 25 bp, Homo sapien
tgcacctgtcagaacacgccagggt

SEQ ID NO: 126512 - DNA, 25 bp, Homo sapien
ttcctggacaagctccatggcgctg

SEQ ID NO: 126513 - DNA, 25 bp, Homo sapien
gacacgactcggtgagttcccgcca

SEQ ID NO: 126514 - DNA, 25 bp, Homo sapien
cacggatgcctctcaataggcggca

SEQ ID NO: 126515 - DNA, 25 bp, Homo sapien
ggcacttttaatactccgcgatcca

SEQ ID NO: 126516 - DNA, 25 bp, Homo sapien
tcgccttgaagagaacaccagggca

SEQ ID NO: 126517 - DNA, 25 bp, Homo sapien
caggttagggagttccgagactctc

SEQ ID NO: 126518 - DNA, 25 bp, Homo sapien
tgcacatgcgtgtctgcactgctgt

SEQ ID NO: 126519 - DNA, 25 bp, Homo sapien
tgtctgcactgctgtgtgcgtgtcg

SEQ ID NO: 126520 - DNA, 25 bp, Homo sapien
ctcgtttcagaggaagcgtccaatg

SEQ ID NO: 126521 - DNA, 25 bp, Homo sapien
tccaatgggccgttcaggttaggga

SEQ ID NO: 126522 - DNA, 25 bp, Homo sapien
gactctccatgatttctgaaccgtg

SEQ ID NO: 126523 - DNA, 25 bp, Homo sapien
ctgctggctcgccttgaagagaaca

SEQ ID NO: 126524 - DNA, 25 bp, Homo sapien
gcgccggcgagatccgcacaaaatc

SEQ ID NO: 126525 - DNA, 25 bp, Homo sapien
caaaccatgaacttggggctgaccg

SEQ ID NO: 126526 - DNA, 25 bp, Homo sapien
cttcgggagccctgctaaagaacca

SEQ ID NO: 126527 - DNA, 25 bp, Homo sapien
ggtctttgacgatcgcccttcggga

SEQ ID NO: 126528 - DNA, 25 bp, Homo sapien
cccagagactcttgtggacagagcc

SEQ ID NO: 126529 - DNA, 25 bp, Homo sapien
ctccgctctcggactttggcgagga

SEQ ID NO: 126530 - DNA, 25 bp, Homo sapien
gcttgcctacctctcgcggtcggaa

SEQ ID NO: 126531 - DNA, 25 bp, Homo sapien
catggtctcctttgtcctgtcgccg

SEQ ID NO: 126532 - DNA, 25 bp, Homo sapien
gcgggcaaccagaacggactcctca

SEQ ID NO: 126533 - DNA, 25 bp, Homo sapien
gaagaccatgacctgcctccagagg

SEQ ID NO: 126534 - DNA, 25 bp, Homo sapien
ccttgagggatccttaccgagaact

SEQ ID NO: 126535 - DNA, 25 bp, Homo sapien
cgagaacttgacattcaccggagag

SEQ ID NO: 126536 - DNA, 25 bp, Homo sapien
gtacgaagccgaccgctccttcagg

SEQ ID NO: 126537 - DNA, 25 bp, Homo sapien
cctggacaggactcgcatgatgacc

SEQ ID NO: 126538 - DNA, 25 bp, Homo sapien
tcagagaagactacgagcacacgcg

SEQ ID NO: 126539 - DNA, 25 bp, Homo sapien
agcgcttgcacatgctcagagaaga

SEQ ID NO: 126540 - DNA, 25 bp, Homo sapien
aaatccctggcctttcgcggagacg

SEQ ID NO: 126541 - DNA, 25 bp, Homo sapien
taattgagacttgagcgtgactgcg

SEQ ID NO: 126542 - DNA, 25 bp, Homo sapien
acttgctggtgcagaagagaaaccc

SEQ ID NO: 126543 - DNA, 25 bp, Homo sapien
gggctgtttgatggcttcactgaga

SEQ ID NO: 126544 - DNA, 25 bp, Homo sapien
gcgaggacttccatgtgagcgattc

SEQ ID NO: 126545 - DNA, 25 bp, Homo sapien
cccgagcatccttgaggtgggacga

SEQ ID NO: 126546 - DNA, 25 bp, Homo sapien
tgctgtgacttttgaggtccgactc

SEQ ID NO: 126547 - DNA, 25 bp, Homo sapien
tagaggtccagaggcgaaccacttg

SEQ ID NO: 126548 - DNA, 25 bp, Homo sapien
cagctccacggaaggcaaggtggcc

SEQ ID NO: 126549 - DNA, 25 bp, Homo sapien
gttgcgcgccctagaaactccatgc

SEQ ID NO: 126550 - DNA, 25 bp, Homo sapien
gttcagcccatgtgcgcggctgcct

SEQ ID NO: 126551 - DNA, 25 bp, Homo sapien
tgtcctctgctctcgtctggggacg

SEQ ID NO: 126552 - DNA, 25 bp, Homo sapien
ctcgtcgactcggagcgcgatctgg

SEQ ID NO: 126553 - DNA, 25 bp, Homo sapien
ggcactcacctcttgctgggccggg

SEQ ID NO: 126554 - DNA, 25 bp, Homo sapien
gaggcgctgtctgccaaccatctgc

SEQ ID NO: 126555 - DNA, 25 bp, Homo sapien
cccagtgtcggagccaacaggtacg

SEQ ID NO: 126556 - DNA, 25 bp, Homo sapien
actgtgggcagctacgacgctgcca

SEQ ID NO: 126557 - DNA, 25 bp, Homo sapien
tgggcagctacgacgctgccaggcc

SEQ ID NO: 126558 - DNA, 25 bp, Homo sapien
cccaaaggttcgcactggtactgcg

SEQ ID NO: 126559 - DNA, 25 bp, Homo sapien
aaggttcgcactggtactgcgagac

SEQ ID NO: 126560 - DNA, 25 bp, Homo sapien
ggcgttagcgccgtaccgagtggct

SEQ ID NO: 126561 - DNA, 25 bp, Homo sapien
tggctgcagaactgtgggcagctac

SEQ ID NO: 126562 - DNA, 25 bp, Homo sapien
cagaactgtgggcagctacgacgct

SEQ ID NO: 126563 - DNA, 25 bp, Homo sapien
gtgtccagaaataagcaccgcccgg

SEQ ID NO: 126564 - DNA, 25 bp, Homo sapien
gtcaagtgcaacagtctccgaagga

SEQ ID NO: 126565 - DNA, 25 bp, Homo sapien
ctagccggtgctgtcaagtgcaaca

SEQ ID NO: 126566 - DNA, 25 bp, Homo sapien
ttgcccgccgagtgcccttacccat

SEQ ID NO: 126567 - DNA, 25 bp, Homo sapien
ctcctcagagccgacaggagactag

SEQ ID NO: 126568 - DNA, 25 bp, Homo sapien
tcagagccgacaggagactaggatc

SEQ ID NO: 126569 - DNA, 25 bp, Homo sapien
aggagactaggatctcggacctgga

SEQ ID NO: 126570 - DNA, 25 bp, Homo sapien
tcctgattggttcagaggacgaaga

SEQ ID NO: 126571 - DNA, 25 bp, Homo sapien
agctccgggaaaggaagccagtgcc

SEQ ID NO: 126572 - DNA, 25 bp, Homo sapien
ccgcctaaccaatgtggccgtggta

SEQ ID NO: 126573 - DNA, 25 bp, Homo sapien
ttgaacagccgcgatgtcgatcttc

SEQ ID NO: 126574 - DNA, 25 bp, Homo sapien
gccggcttctgggtctttgaacagc

SEQ ID NO: 126575 - DNA, 25 bp, Homo sapien
cggctgcctgaagctagtgagtcgc

SEQ ID NO: 126576 - DNA, 25 bp, Homo sapien
gacgcctgcgcagtaagtaagcctg

SEQ ID NO: 126577 - DNA, 25 bp, Homo sapien
cgcgagcatcctgtcagagctctca

SEQ ID NO: 126578 - DNA, 25 bp, Homo sapien
cggtcactaaacatccgcgagcatc

SEQ ID NO: 126579 - DNA, 25 bp, Homo sapien
ggaagcgcttcgaaatcgcctgcta

SEQ ID NO: 126580 - DNA, 25 bp, Homo sapien
tgaaaggacagaggcctccttcctc

SEQ ID NO: 126581 - DNA, 25 bp, Homo sapien
tgtccacattggacgcggcagcctg

SEQ ID NO: 126582 - DNA, 25 bp, Homo sapien
cccgttagaaacttcgcagacaccg

SEQ ID NO: 126583 - DNA, 25 bp, Homo sapien
gcccgggaagcaaagtgaaaggaca

SEQ ID NO: 126584 - DNA, 25 bp, Homo sapien
cgcagcgagttttctggcagcgcta

SEQ ID NO: 126585 - DNA, 25 bp, Homo sapien
cctactccagcaagaaagagcctga

SEQ ID NO: 126586 - DNA, 25 bp, Homo sapien
agctgtaaagcggtacgggattccg

SEQ ID NO: 126587 - DNA, 25 bp, Homo sapien
acaccgcgaagctgctctttggagt

SEQ ID NO: 126588 - DNA, 25 bp, Homo sapien
tgtgcatttctggttgcaccgcggc

SEQ ID NO: 126589 - DNA, 25 bp, Homo sapien
agaacacggctcacgcttacctcaa

SEQ ID NO: 126590 - DNA, 25 bp, Homo sapien
gctgcggcgtctgtctgaaccacgc

SEQ ID NO: 126591 - DNA, 25 bp, Homo sapien
acgctttgtctgtcgtgatggggca

SEQ ID NO: 126592 - DNA, 25 bp, Homo sapien
ggcaagggcacaagtcctggatgtt

SEQ ID NO: 126593 - DNA, 25 bp, Homo sapien
ttgtgtgtatcgagaggccaaaggc

SEQ ID NO: 126594 - DNA, 25 bp, Homo sapien
tctgtcctgtgacgcgcaagtctga

SEQ ID NO: 126595 - DNA, 25 bp, Homo sapien
tgccctggcagggtcatcctgtgct

SEQ ID NO: 126596 - DNA, 25 bp, Homo sapien
gcacttctattctctcacttaagtg

SEQ ID NO: 126597 - DNA, 25 bp, Homo sapien
acttctattctctcacttaagtgtc

SEQ ID NO: 126598 - DNA, 25 bp, Homo sapien
cagcacttctattctctcacttaag

SEQ ID NO: 126599 - DNA, 25 bp, Homo sapien
tcagcacttctattctctcacttaa

SEQ ID NO: 126600 - DNA, 25 bp, Homo sapien
gtcagcacttctattctctcactta

SEQ ID NO: 126601 - DNA, 25 bp, Homo sapien
cgtcagcacttctattctctcactt

SEQ ID NO: 126602 - DNA, 25 bp, Homo sapien
tgaaacttctcagcatttcagagca

SEQ ID NO: 126603 - DNA, 25 bp, Homo sapien
ttctattctctcacttaagtgtctg

SEQ ID NO: 126604 - DNA, 25 bp, Homo sapien
gggcctgtcgctggttggcctctta

SEQ ID NO: 126605 - DNA, 25 bp, Homo sapien
ctcctgggcctgtcgctggttggcc

SEQ ID NO: 126606 - DNA, 25 bp, Homo sapien
aaccagttgggtctcgggcgctgcc

SEQ ID NO: 126607 - DNA, 25 bp, Homo sapien
tccaaaccagttgggtctcgggcgc

SEQ ID NO: 126608 - DNA, 25 bp, Homo sapien
gcattttccaaaccagttgggtctc

SEQ ID NO: 126609 - DNA, 25 bp, Homo sapien
aggcggcattttccaaaccagttgg

SEQ ID NO: 126610 - DNA, 25 bp, Homo sapien
cgcggaaaacctcaagagtcagaaa

SEQ ID NO: 126611 - DNA, 25 bp, Homo sapien
ggcaggcggcattttccaaaccagt

SEQ ID NO: 126612 - DNA, 25 bp, Homo sapien
agccacggccacctggtgtgcacga

SEQ ID NO: 126613 - DNA, 25 bp, Homo sapien
tctggaacaggacggtttgtgcgct

SEQ ID NO: 126614 - DNA, 25 bp, Homo sapien
caggctcggaggctgcacacgcaca

SEQ ID NO: 126615 - DNA, 25 bp, Homo sapien
gcacaggtgccacccgcgtgacggt

SEQ ID NO: 126616 - DNA, 25 bp, Homo sapien
tgtgcacgacgtgacacaccatctc

SEQ ID NO: 126617 - DNA, 25 bp, Homo sapien
tctgatcacgggagcagagtgcagc

SEQ ID NO: 126618 - DNA, 25 bp, Homo sapien
tttgtgcgctgcctgcgagcaccgt

SEQ ID NO: 126619 - DNA, 25 bp, Homo sapien
acaccatctcaagcgcaggaggcac

SEQ ID NO: 126620 - DNA, 25 bp, Homo sapien
ggtccaagggcatgcccttccggga

SEQ ID NO: 126621 - DNA, 25 bp, Homo sapien
gacttccggggtccaagggcatgcc

SEQ ID NO: 126622 - DNA, 25 bp, Homo sapien
agcttcttcgcactgaggaggccgg

SEQ ID NO: 126623 - DNA, 25 bp, Homo sapien
ctgcagcttcttcgcactgaggagg

SEQ ID NO: 126624 - DNA, 25 bp, Homo sapien
cggggctgaaaccagatgacaaagc

SEQ ID NO: 126625 - DNA, 25 bp, Homo sapien
cagcggggctgaaaccagatgacaa

SEQ ID NO: 126626 - DNA, 25 bp, Homo sapien
gaatgcgacgctgcgagcccgtttc

SEQ ID NO: 126627 - DNA, 25 bp, Homo sapien
gcggctgcagcttcttcgcactgag

SEQ ID NO: 126628 - DNA, 25 bp, Homo sapien
ttgttacagcgaacaccagctgctc

SEQ ID NO: 126629 - DNA, 25 bp, Homo sapien
gtttgttacagcgaacaccagctgc

SEQ ID NO: 126630 - DNA, 25 bp, Homo sapien
gttgtttgttacagcgaacaccagc

SEQ ID NO: 126631 - DNA, 25 bp, Homo sapien
caagttgtttgttacagcgaacacc

SEQ ID NO: 126632 - DNA, 25 bp, Homo sapien
tggcaagttgtttgttacagcgaac

SEQ ID NO: 126633 - DNA, 25 bp, Homo sapien
tgagtggcaagttgtttgttacagc

SEQ ID NO: 126634 - DNA, 25 bp, Homo sapien
accggcgtttgagtggcaagttgtt

SEQ ID NO: 126635 - DNA, 25 bp, Homo sapien
cgtttgagtggcaagttgtttgtta

SEQ ID NO: 126636 - DNA, 25 bp, Homo sapien
agtggttttggcagcaccctcgcca

SEQ ID NO: 126637 - DNA, 25 bp, Homo sapien
agccagcccactctgacgttcagta

SEQ ID NO: 126638 - DNA, 25 bp, Homo sapien
ctgacgttcagtaacacgagcaccc

SEQ ID NO: 126639 - DNA, 25 bp, Homo sapien
gcagcgctgccgactttagtggttt

SEQ ID NO: 126640 - DNA, 25 bp, Homo sapien
cacgttcaacattccctttggctca

SEQ ID NO: 126641 - DNA, 25 bp, Homo sapien
agctctttcacttttggaaactctg

SEQ ID NO: 126642 - DNA, 25 bp, Homo sapien
ttccctttggctcaagcgccaagtc

SEQ ID NO: 126643 - DNA, 25 bp, Homo sapien
ccagcccgcatttggggccgctgag

SEQ ID NO: 126644 - DNA, 25 bp, Homo sapien
tgccgtagcagacccggcagcttca

SEQ ID NO: 126645 - DNA, 25 bp, Homo sapien
atcgaatatgtcctgactgccagcc

SEQ ID NO: 126646 - DNA, 25 bp, Homo sapien
actgccagccatagcggcaagcagc

SEQ ID NO: 126647 - DNA, 25 bp, Homo sapien
gcttcaggcacaaatgctccgcttg

SEQ ID NO: 126648 - DNA, 25 bp, Homo sapien
gagggcccaaagcagcctgtacatg

SEQ ID NO: 126649 - DNA, 25 bp, Homo sapien
ccagctccagcaaagggcctgtctg

SEQ ID NO: 126650 - DNA, 25 bp, Homo sapien
gaccagagcatcaggcccacacttg

SEQ ID NO: 126651 - DNA, 25 bp, Homo sapien
gagacgagacccacttccggaagcg

SEQ ID NO: 126652 - DNA, 25 bp, Homo sapien
ttctcctcctggcagagggagcacg

SEQ ID NO: 126653 - DNA, 25 bp, Homo sapien
acccgggaacgtgctcaggcctcgg

SEQ ID NO: 126654 - DNA, 25 bp, Homo sapien
gcgcatctcgcaccacgtcttcatt

SEQ ID NO: 126655 - DNA, 25 bp, Homo sapien
cacgtggagtagacgagccgctgca

SEQ ID NO: 126656 - DNA, 25 bp, Homo sapien
agggctcgctgctggaaccctgcca

SEQ ID NO: 126657 - DNA, 25 bp, Homo sapien
tggaaccctgccagggcatgcagac

SEQ ID NO: 126658 - DNA, 25 bp, Homo sapien
cagtgctcggcacccgggaacgtgc

SEQ ID NO: 126659 - DNA, 25 bp, Homo sapien
gggttctgctgcagcgcatctcgca

SEQ ID NO: 126660 - DNA, 25 bp, Homo sapien
aagtcgccctgcaaggcgtgtgtgt

SEQ ID NO: 126661 - DNA, 25 bp, Homo sapien
gccggtcgaagtcgccctgcaaggc

SEQ ID NO: 126662 - DNA, 25 bp, Homo sapien
tctgtggcaaaacgcacccggctcg

SEQ ID NO: 126663 - DNA, 25 bp, Homo sapien
agctgcagcatacagccccatgttc

SEQ ID NO: 126664 - DNA, 25 bp, Homo sapien
cacgccggccaacacgcctgcagct

SEQ ID NO: 126665 - DNA, 25 bp, Homo sapien
cagagctgagaccagatgacaaagc

SEQ ID NO: 126666 - DNA, 25 bp, Homo sapien
gagtgcgacgctgcagcccgtttcg

SEQ ID NO: 126667 - DNA, 25 bp, Homo sapien
ccgtgcacggcagcagagctgagac

SEQ ID NO: 126668 - DNA, 25 bp, Homo sapien
tgcccttacggctggctgtgccctt

SEQ ID NO: 126669 - DNA, 25 bp, Homo sapien
tcggcatcgaagaaggtgagttcgc

SEQ ID NO: 126670 - DNA, 25 bp, Homo sapien
ggacctgttcagcttgcccttacgg

SEQ ID NO: 126671 - DNA, 25 bp, Homo sapien
gtgagttcgccctgctcatagtgca

SEQ ID NO: 126672 - DNA, 25 bp, Homo sapien
caggtgctgtagtcgaagcgctcag

SEQ ID NO: 126673 - DNA, 25 bp, Homo sapien
gatatcacctcaggcgggacccagc

SEQ ID NO: 126674 - DNA, 25 bp, Homo sapien
agcttgccctggaagtcggcctgga

SEQ ID NO: 126675 - DNA, 25 bp, Homo sapien
caggcaaaggcttcgtacacccggc

SEQ ID NO: 126676 - DNA, 25 bp, Homo sapien
tcctggtccttctcgcagaaaaggc

SEQ ID NO: 126677 - DNA, 25 bp, Homo sapien
tcgcagaaaaggctgagcgggttcc

SEQ ID NO: 126678 - DNA, 25 bp, Homo sapien
ggttccggtggtgcacgcagacctt

SEQ ID NO: 126679 - DNA, 25 bp, Homo sapien
tggtgcacgcagaccttgggctccg

SEQ ID NO: 126680 - DNA, 25 bp, Homo sapien
ccagggagcctcagggcttcgatca

SEQ ID NO: 126681 - DNA, 25 bp, Homo sapien
cagggcttcgatcaccctggccagg

SEQ ID NO: 126682 - DNA, 25 bp, Homo sapien
atcaccctggccagggagacgttgg

SEQ ID NO: 126683 - DNA, 25 bp, Homo sapien
gaccgcagaggccacagatgagctc

SEQ ID NO: 126684 - DNA, 25 bp, Homo sapien
tgaaaattcaaatggccagtagggg

SEQ ID NO: 126685 - DNA, 25 bp, Homo sapien
gggaggtttattctccgcctgcacg

SEQ ID NO: 126686 - DNA, 25 bp, Homo sapien
aggtaagttccgacgcttctgcagc

SEQ ID NO: 126687 - DNA, 25 bp, Homo sapien
tcccgaagcggcgagtgaaaattca

SEQ ID NO: 126688 - DNA, 25 bp, Homo sapien
ccaacatctggacggcaggtaagtt

SEQ ID NO: 126689 - DNA, 25 bp, Homo sapien
ggggaagaggccaccaacatctgga

SEQ ID NO: 126690 - DNA, 25 bp, Homo sapien
gagactgtgaaatccgcaaccatga

SEQ ID NO: 126691 - DNA, 25 bp, Homo sapien
tccgcctgcacgagactgtgaaatc

SEQ ID NO: 126692 - DNA, 25 bp, Homo sapien
attacggatcatacctcgcacctca

SEQ ID NO: 126693 - DNA, 25 bp, Homo sapien
gcgcttccattacggatcatacctc

SEQ ID NO: 126694 - DNA, 25 bp, Homo sapien
tcgtgcgcttccattacggatcata

SEQ ID NO: 126695 - DNA, 25 bp, Homo sapien
catcatgtttcgtgcgcttccatta

SEQ ID NO: 126696 - DNA, 25 bp, Homo sapien
gcctcatcatgacccgcacgctatg

SEQ ID NO: 126697 - DNA, 25 bp, Homo sapien
cacgtccgtgcctcatcatgacccg

SEQ ID NO: 126698 - DNA, 25 bp, Homo sapien
gtcccatcatgtttcgtgcgcttcc

SEQ ID NO: 126699 - DNA, 25 bp, Homo sapien
atgtttcgtgcgcttccattacgga

SEQ ID NO: 126700 - DNA, 25 bp, Homo sapien
cagtccctgtacgagcggttaagtc

SEQ ID NO: 126701 - DNA, 25 bp, Homo sapien
gaggcctggctttcattctccatca

SEQ ID NO: 126702 - DNA, 25 bp, Homo sapien
cctgatgcttcggtgctaggtacgc

SEQ ID NO: 126703 - DNA, 25 bp, Homo sapien
gcgtgctgaaggacgtcatccgaga

SEQ ID NO: 126704 - DNA, 25 bp, Homo sapien
aagcgcgttaaaccagggagtcctg

SEQ ID NO: 126705 - DNA, 25 bp, Homo sapien
ggtcccgttacgtgtcccatcatgt

SEQ ID NO: 126706 - DNA, 25 bp, Homo sapien
atcgtgctctctgtcgctccagtta

SEQ ID NO: 126707 - DNA, 25 bp, Homo sapien
ccatcatgctctgcgtgctcgttag

SEQ ID NO: 126708 - DNA, 25 bp, Homo sapien
cgtgtgtgtttgcaaaagtccttga

SEQ ID NO: 126709 - DNA, 25 bp, Homo sapien
atgaaaggggcctctgtctgcgccc

SEQ ID NO: 126710 - DNA, 25 bp, Homo sapien
ttccgcccgcgtttgtgttggcagc

SEQ ID NO: 126711 - DNA, 25 bp, Homo sapien
cacgtcagcagagcggaaacgcgga

SEQ ID NO: 126712 - DNA, 25 bp, Homo sapien
cccagcggaggttctcttggaattt

SEQ ID NO: 126713 - DNA, 25 bp, Homo sapien
cgcgattcctgcacgtcagcagagc

SEQ ID NO: 126714 - DNA, 25 bp, Homo sapien
ttccaaaaatacatgtgcgtgcgtg

SEQ ID NO: 126715 - DNA, 25 bp, Homo sapien
cacttcatttttaacccagcggagg

SEQ ID NO: 126716 - DNA, 25 bp, Homo sapien
ggacgctggggcctctttcctggtc

SEQ ID NO: 126717 - DNA, 25 bp, Homo sapien
cgctgcagaatttccctccgagttg

SEQ ID NO: 126718 - DNA, 25 bp, Homo sapien
ctccgagttggataaataagcagca

SEQ ID NO: 126719 - DNA, 25 bp, Homo sapien
tccaacgtcaacgaaacaggagctc

SEQ ID NO: 126720 - DNA, 25 bp, Homo sapien
tcaacgaaacaggagctcgctgggc

SEQ ID NO: 126721 - DNA, 25 bp, Homo sapien
caaaagcggctttcagcagcggcgg

SEQ ID NO: 126722 - DNA, 25 bp, Homo sapien
cgacgctgcgatcacggcctcagag

SEQ ID NO: 126723 - DNA, 25 bp, Homo sapien
taagcagcagagtccaacgtcaacg

SEQ ID NO: 126724 - DNA, 25 bp, Homo sapien
gctgcgcgcccatcatggagcagtt

SEQ ID NO: 126725 - DNA, 25 bp, Homo sapien
aacgtctactcgctggccttcctga

SEQ ID NO: 126726 - DNA, 25 bp, Homo sapien
cccgagaagttccagtacgtggaga

SEQ ID NO: 126727 - DNA, 25 bp, Homo sapien
acgctggtcttcctactgctctact

SEQ ID NO: 126728 - DNA, 25 bp, Homo sapien
ggcccacggcagctatttccacatg

SEQ ID NO: 126729 - DNA, 25 bp, Homo sapien
tcgtcatcctgaccctgcgcaaggt

SEQ ID NO: 126730 - DNA, 25 bp, Homo sapien
gagcagttcaacttcggctggccgg

SEQ ID NO: 126731 - DNA, 25 bp, Homo sapien
cgctctacgtgatccaggagggcct

SEQ ID NO: 126732 - DNA, 25 bp, Homo sapien
agcctattggctcggaggagctgcc

SEQ ID NO: 126733 - DNA, 25 bp, Homo sapien
aaaggtcacgttatgtaagcgcccg

SEQ ID NO: 126734 - DNA, 25 bp, Homo sapien
cgcgcggctggaaaaggatactccc

SEQ ID NO: 126735 - DNA, 25 bp, Homo sapien
cgacagtcatggagcggaacgccac

SEQ ID NO: 126736 - DNA, 25 bp, Homo sapien
tcagcagcaccggaggaaattattg

SEQ ID NO: 126737 - DNA, 25 bp, Homo sapien
tggcgaatgctccaataggcggaga

SEQ ID NO: 126738 - DNA, 25 bp, Homo sapien
ctggtcagcgctcacagcctattgg

SEQ ID NO: 126739 - DNA, 25 bp, Homo sapien
tgcagcgcactagagggcagtctga

SEQ ID NO: 126740 - DNA, 25 bp, Homo sapien
tcgccgctctgggacggtgtccctg

SEQ ID NO: 126741 - DNA, 25 bp, Homo sapien
tgctctcagggcaacctcgcggctt

SEQ ID NO: 126742 - DNA, 25 bp, Homo sapien
taaaggggcaccgaaggcaccttgc

SEQ ID NO: 126743 - DNA, 25 bp, Homo sapien
aaggggcaccgaaggcaccttgcag

SEQ ID NO: 126744 - DNA, 25 bp, Homo sapien
ggcaccttgcagaccgcgccctgca

SEQ ID NO: 126745 - DNA, 25 bp, Homo sapien
tcagggcaacctcgcggcttccgag

SEQ ID NO: 126746 - DNA, 25 bp, Homo sapien
tctcttcgccgctctgggacggtgt

SEQ ID NO: 126747 - DNA, 25 bp, Homo sapien
cggggcccattccagtcaccgccac

SEQ ID NO: 126748 - DNA, 25 bp, Homo sapien
cctctgacctcacgccgacgccagc

SEQ ID NO: 126749 - DNA, 25 bp, Homo sapien
cgcacgtgcttgtggtcagggcgag

SEQ ID NO: 126750 - DNA, 25 bp, Homo sapien
ccgccgcagcgtcacagcggccgtc

SEQ ID NO: 126751 - DNA, 25 bp, Homo sapien
aagacaccggggatcgcgcgcctca

SEQ ID NO: 126752 - DNA, 25 bp, Homo sapien
cgcccggaccgaccggcccgacatg

SEQ ID NO: 126753 - DNA, 25 bp, Homo sapien
cgcactttctcgatggccgccatca

SEQ ID NO: 126754 - DNA, 25 bp, Homo sapien
gtcggctcccacctgacccgccagt

SEQ ID NO: 126755 - DNA, 25 bp, Homo sapien
cctgacccgccagtcccacgctcct

SEQ ID NO: 126756 - DNA, 25 bp, Homo sapien
cccgccgggtattgtagagatgaat

SEQ ID NO: 126757 - DNA, 25 bp, Homo sapien
aagcggccagtgatgtcaaaggaca

SEQ ID NO: 126758 - DNA, 25 bp, Homo sapien
gatgaatactactgccactggccaa

SEQ ID NO: 126759 - DNA, 25 bp, Homo sapien
ccgggtattgtagagatgaatacta

SEQ ID NO: 126760 - DNA, 25 bp, Homo sapien
tggcgatacactcgccatggacccg

SEQ ID NO: 126761 - DNA, 25 bp, Homo sapien
ggccagtgatgtcaaaggacaagtt

SEQ ID NO: 126762 - DNA, 25 bp, Homo sapien
ccagaaagcggccagtgatgtcaaa

SEQ ID NO: 126763 - DNA, 25 bp, Homo sapien
caaaggacaagttggcgatacactc

SEQ ID NO: 126764 - DNA, 25 bp, Homo sapien
gctcacgttaccagaggagaaactg

SEQ ID NO: 126765 - DNA, 25 bp, Homo sapien
cgagagctccatgttggtggaacca

SEQ ID NO: 126766 - DNA, 25 bp, Homo sapien
tgccacctcagctagtgagtacgcg

SEQ ID NO: 126767 - DNA, 25 bp, Homo sapien
ggcctggccgttaaagcacctcaag

SEQ ID NO: 126768 - DNA, 25 bp, Homo sapien
gagttagagcatctccacccgccga

SEQ ID NO: 126769 - DNA, 25 bp, Homo sapien
cacccgccgagcctagttattagag

SEQ ID NO: 126770 - DNA, 25 bp, Homo sapien
gtctctggaagcgaagctcacgtta

SEQ ID NO: 126771 - DNA, 25 bp, Homo sapien
tagaacatctcgaggggcagggctc

SEQ ID NO: 126772 - DNA, 25 bp, Homo sapien
actgacccgcttcttgtagtagatg

SEQ ID NO: 126773 - DNA, 25 bp, Homo sapien
gtattcccgcatcaccacctcgatg

SEQ ID NO: 126774 - DNA, 25 bp, Homo sapien
cacttgtggtattcccgcatcacca

SEQ ID NO: 126775 - DNA, 25 bp, Homo sapien
cgccacttgtggtattcccgcatca

SEQ ID NO: 126776 - DNA, 25 bp, Homo sapien
cccgcttcttgtagtagatgcgcca

SEQ ID NO: 126777 - DNA, 25 bp, Homo sapien
cctttccagggatcttccgaggcgg

SEQ ID NO: 126778 - DNA, 25 bp, Homo sapien
gcccgggactgaatggagggcccga

SEQ ID NO: 126779 - DNA, 25 bp, Homo sapien
tcttgtagtagatgcgccacttgtg

SEQ ID NO: 126780 - DNA, 25 bp, Homo sapien
ccgccacccttaatgtagcagatca

SEQ ID NO: 126781 - DNA, 25 bp, Homo sapien
gagctgcgcctcttggacatttctg

SEQ ID NO: 126782 - DNA, 25 bp, Homo sapien
tgcggcgacgacaccatgaagtgac

SEQ ID NO: 126783 - DNA, 25 bp, Homo sapien
ggccagttccagtccactttggtta

SEQ ID NO: 126784 - DNA, 25 bp, Homo sapien
ccactttggttatgaactgggacaa

SEQ ID NO: 126785 - DNA, 25 bp, Homo sapien
gggagtatctcagggtccaggaata

SEQ ID NO: 126786 - DNA, 25 bp, Homo sapien
atcagaaatgcgtgggtccgtcagg

SEQ ID NO: 126787 - DNA, 25 bp, Homo sapien
tgtaggccaggctcaagcactcgaa

SEQ ID NO: 126788 - DNA, 25 bp, Homo sapien
ctgccgctgcaggaaacatttctga

SEQ ID NO: 126789 - DNA, 25 bp, Homo sapien
catctacagctttctcggggagacc

SEQ ID NO: 126790 - DNA, 25 bp, Homo sapien
ctgaaggccgtcattccagacagca

SEQ ID NO: 126791 - DNA, 25 bp, Homo sapien
ttcagcagtgccgtgtagacagcct

SEQ ID NO: 126792 - DNA, 25 bp, Homo sapien
acggccacgtcatgtctctaaactg

SEQ ID NO: 126793 - DNA, 25 bp, Homo sapien
caccctggggctgcttaggaaacct

SEQ ID NO: 126794 - DNA, 25 bp, Homo sapien
ggaaacctcacgactggtcaccttg

SEQ ID NO: 126795 - DNA, 25 bp, Homo sapien
gggccgctccctgcaagcagtcttt

SEQ ID NO: 126796 - DNA, 25 bp, Homo sapien
ccgccggctcgtgcccgctcacctt

SEQ ID NO: 126797 - DNA, 25 bp, Homo sapien
cgctcagccgctcagaggcctgtgg

SEQ ID NO: 126798 - DNA, 25 bp, Homo sapien
cttctctccttagcacgtgggcggc

SEQ ID NO: 126799 - DNA, 25 bp, Homo sapien
ccgaggtgtcctttgccccttgatc

SEQ ID NO: 126800 - DNA, 25 bp, Homo sapien
tgatctggtgcctccttctctcctt

SEQ ID NO: 126801 - DNA, 25 bp, Homo sapien
tctccttagcacgtgggcggcagcc

SEQ ID NO: 126802 - DNA, 25 bp, Homo sapien
gtgggcagagaaagacgctgggacc

SEQ ID NO: 126803 - DNA, 25 bp, Homo sapien
cccggcttttagcagcgggtgtgga

SEQ ID NO: 126804 - DNA, 25 bp, Homo sapien
ctgcaaattgtaaccgcccggggtg

SEQ ID NO: 126805 - DNA, 25 bp, Homo sapien
agtcagaaatttgttgttgccatcc

SEQ ID NO: 126806 - DNA, 25 bp, Homo sapien
acgtgcacgggctctgcaaattgta

SEQ ID NO: 126807 - DNA, 25 bp, Homo sapien
tttgggatcctcagcaccgggcagc

SEQ ID NO: 126808 - DNA, 25 bp, Homo sapien
agctccgggacctgcttcaggatga

SEQ ID NO: 126809 - DNA, 25 bp, Homo sapien
tgcttcaggatgagcccaagctgga

SEQ ID NO: 126810 - DNA, 25 bp, Homo sapien
aggcgtgtcctacagcggatgctcc

SEQ ID NO: 126811 - DNA, 25 bp, Homo sapien
gttgccatccgaggggaaaacgtgc

SEQ ID NO: 126812 - DNA, 25 bp, Homo sapien
tcgccctgggaataagtcctcgctc

SEQ ID NO: 126813 - DNA, 25 bp, Homo sapien
agcccggaaatacgttcgcaagtga

SEQ ID NO: 126814 - DNA, 25 bp, Homo sapien
ttttatgacgagacagaagcccgga

SEQ ID NO: 126815 - DNA, 25 bp, Homo sapien
gcggccaccgcgtctgaattattcc

SEQ ID NO: 126816 - DNA, 25 bp, Homo sapien
catggctgccatgttgaattgattc

SEQ ID NO: 126817 - DNA, 25 bp, Homo sapien
gccgagcagatcatacagcgccgtg

SEQ ID NO: 126818 - DNA, 25 bp, Homo sapien
taagccgccttgatttgggcctgcg

SEQ ID NO: 126819 - DNA, 25 bp, Homo sapien
gctgatgacataaaaaccgggtgcc

SEQ ID NO: 126820 - DNA, 25 bp, Homo sapien
aaactttctggacagcgtggagtgc

SEQ ID NO: 126821 - DNA, 25 bp, Homo sapien
gtggcgttgtactccgacatgacct

SEQ ID NO: 126822 - DNA, 25 bp, Homo sapien
ttcctcttgctcgatggactgctcg

SEQ ID NO: 126823 - DNA, 25 bp, Homo sapien
gaggagcggttcaggccttcctctt

SEQ ID NO: 126824 - DNA, 25 bp, Homo sapien
gggaccgacccagagactcaggtgc

SEQ ID NO: 126825 - DNA, 25 bp, Homo sapien
gacatgacctccacaaactttctgg

SEQ ID NO: 126826 - DNA, 25 bp, Homo sapien
ctttgcagcgctcgcggtagtcgga

SEQ ID NO: 126827 - DNA, 25 bp, Homo sapien
gtgtcttccggatcctcaggtcagc

SEQ ID NO: 126828 - DNA, 25 bp, Homo sapien
ttctctgcagtcctctcacgcagga

SEQ ID NO: 126829 - DNA, 25 bp, Homo sapien
cccgctgttcacaaaggagctggtt

SEQ ID NO: 126830 - DNA, 25 bp, Homo sapien
tctaaaatgctttgtcccgctgttc

SEQ ID NO: 126831 - DNA, 25 bp, Homo sapien
ggcaccgagcaattttgagactcta

SEQ ID NO: 126832 - DNA, 25 bp, Homo sapien
cacggcagaggcaccgagcaatttt

SEQ ID NO: 126833 - DNA, 25 bp, Homo sapien
tccgagtacacggagcacggcagag

SEQ ID NO: 126834 - DNA, 25 bp, Homo sapien
ggactccgccataaaacctgaaaca

SEQ ID NO: 126835 - DNA, 25 bp, Homo sapien
aaacctgaaacaggcgctccgagta

SEQ ID NO: 126836 - DNA, 25 bp, Homo sapien
ggagctcctgggttcggtccttcat

SEQ ID NO: 126837 - DNA, 25 bp, Homo sapien
acccgacgatcaggtttccgcagcg

SEQ ID NO: 126838 - DNA, 25 bp, Homo sapien
ggacgttccgcacgcgtgatcgctc

SEQ ID NO: 126839 - DNA, 25 bp, Homo sapien
ggtctcgtcctggacgttccgcacg

SEQ ID NO: 126840 - DNA, 25 bp, Homo sapien
gtccttcatgctcccgggagtggca

SEQ ID NO: 126841 - DNA, 25 bp, Homo sapien
tcgtctgtctacaccaaggaggttc

SEQ ID NO: 126842 - DNA, 25 bp, Homo sapien
tgtctacaccaaggaggttcccacc

SEQ ID NO: 126843 - DNA, 25 bp, Homo sapien
gaagccctggggtctcgtcctggac

SEQ ID NO: 126844 - DNA, 25 bp, Homo sapien
tcggttctggttgcagcttagggct

SEQ ID NO: 126845 - DNA, 25 bp, Homo sapien
gaaagctcaccctacggcctgtctg

SEQ ID NO: 126846 - DNA, 25 bp, Homo sapien
tgctgccgaagagcccgtgcaaaaa

SEQ ID NO: 126847 - DNA, 25 bp, Homo sapien
ccgtccagaagcctgtaggaaagcg

SEQ ID NO: 126848 - DNA, 25 bp, Homo sapien
catcgctcactgacctgggtggctg

SEQ ID NO: 126849 - DNA, 25 bp, Homo sapien
atgcttgcaagctgttggccggctc

SEQ ID NO: 126850 - DNA, 25 bp, Homo sapien
cggctcgcatctcacaaggtacgtc

SEQ ID NO: 126851 - DNA, 25 bp, Homo sapien
agaatctgggaattcggtctgcgcc

SEQ ID NO: 126852 - DNA, 25 bp, Homo sapien
gctctccagggcctaaggacagtga

SEQ ID NO: 126853 - DNA, 25 bp, Homo sapien
caccttcaccgagcgtcctgggagg

SEQ ID NO: 126854 - DNA, 25 bp, Homo sapien
tcccagatgttctgcgacgtgatga

SEQ ID NO: 126855 - DNA, 25 bp, Homo sapien
tgtcgtcctgcacgcagttggtgca

SEQ ID NO: 126856 - DNA, 25 bp, Homo sapien
acgcctgccacgatggtgatcttgg

SEQ ID NO: 126857 - DNA, 25 bp, Homo sapien
gcgagaaggaacagcacgcctgcca

SEQ ID NO: 126858 - DNA, 25 bp, Homo sapien
agacgaccttggtggccgtgtactt

SEQ ID NO: 126859 - DNA, 25 bp, Homo sapien
ccggtgcgtcttagctaagtgccca

SEQ ID NO: 126860 - DNA, 25 bp, Homo sapien
ggcagcaacattgtcacctcgcaga

SEQ ID NO: 126861 - DNA, 25 bp, Homo sapien
tcccgtggacgctgaacaatggcct

SEQ ID NO: 126862 - DNA, 25 bp, Homo sapien
ggggcaagtgtaccaactgcctgga

SEQ ID NO: 126863 - DNA, 25 bp, Homo sapien
aatggcctccatggggctacaggta

SEQ ID NO: 126864 - DNA, 25 bp, Homo sapien
tggccggccttatggtgatagtgcc

SEQ ID NO: 126865 - DNA, 25 bp, Homo sapien
ctcgcagaccatctgggagggccta

SEQ ID NO: 126866 - DNA, 25 bp, Homo sapien
caagacttctacaatccgctggtgg

SEQ ID NO: 126867 - DNA, 25 bp, Homo sapien
ggacggcccacaacatcatccaaga

SEQ ID NO: 126868 - DNA, 25 bp, Homo sapien
gcgacatccggagcgaaacggtctc

SEQ ID NO: 126869 - DNA, 25 bp, Homo sapien
tcttttccgccctccgactgagaga

SEQ ID NO: 126870 - DNA, 25 bp, Homo sapien
tccgccctccgactgagagagggtc

SEQ ID NO: 126871 - DNA, 25 bp, Homo sapien
tccggagcgaaacggtctcgaagga

SEQ ID NO: 126872 - DNA, 25 bp, Homo sapien
gagtcagaactcaccgccaatccag

SEQ ID NO: 126873 - DNA, 25 bp, Homo sapien
tggaggaaggacctatcttcctctt

SEQ ID NO: 126874 - DNA, 25 bp, Homo sapien
cgcctgcccgcaatgattggttttc

SEQ ID NO: 126875 - DNA, 25 bp, Homo sapien
aaggaggccggagtcagaactcacc

SEQ ID NO: 126876 - DNA, 25 bp, Homo sapien
tcctgcttctcctctcatcctgggt

SEQ ID NO: 126877 - DNA, 25 bp, Homo sapien
agacctcagaggtgggcttcctgct

SEQ ID NO: 126878 - DNA, 25 bp, Homo sapien
ccgatgggtacccaggctggcagac

SEQ ID NO: 126879 - DNA, 25 bp, Homo sapien
accaagcgagtctttgggaactctc

SEQ ID NO: 126880 - DNA, 25 bp, Homo sapien
cacctgagagccgatgggtacccag

SEQ ID NO: 126881 - DNA, 25 bp, Homo sapien
cggccgcgctgcagtcctgcaccct

SEQ ID NO: 126882 - DNA, 25 bp, Homo sapien
tctccacccactagcgcggggcgcc

SEQ ID NO: 126883 - DNA, 25 bp, Homo sapien
cgagtctttgggaactctccaccca

SEQ ID NO: 126884 - DNA, 25 bp, Homo sapien
tgaggccagtcacacgagcgacagg

SEQ ID NO: 126885 - DNA, 25 bp, Homo sapien
ccgcaccagacaccgctgttgagtg

SEQ ID NO: 126886 - DNA, 25 bp, Homo sapien
ccgccaggtctcttctggggacttg

SEQ ID NO: 126887 - DNA, 25 bp, Homo sapien
tctgggcagacagagctgacacgcc

SEQ ID NO: 126888 - DNA, 25 bp, Homo sapien
acagagctgacacgccgccatctag

SEQ ID NO: 126889 - DNA, 25 bp, Homo sapien
atctagccgccggaagcagactctt

SEQ ID NO: 126890 - DNA, 25 bp, Homo sapien
acaccgctgttgagtgcgtggaagc

SEQ ID NO: 126891 - DNA, 25 bp, Homo sapien
gaagcagactcttgacctgtgaagc

SEQ ID NO: 126892 - DNA, 25 bp, Homo sapien
cgagtgcatgaggttgacgctactt

SEQ ID NO: 126893 - DNA, 25 bp, Homo sapien
atgaggttgacgctactttgttgca

SEQ ID NO: 126894 - DNA, 25 bp, Homo sapien
ttgacgctactttgttgcacctgga

SEQ ID NO: 126895 - DNA, 25 bp, Homo sapien
gctactttgttgcacctggagggaa

SEQ ID NO: 126896 - DNA, 25 bp, Homo sapien
tccgggatgagctcgtccttacgaa

SEQ ID NO: 126897 - DNA, 25 bp, Homo sapien
agctcgtccttacgaagcccgcagg

SEQ ID NO: 126898 - DNA, 25 bp, Homo sapien
gcctccatccgcgtgctctgtccac

SEQ ID NO: 126899 - DNA, 25 bp, Homo sapien
cccgtcgagtgcatgaggttgacgc

SEQ ID NO: 126900 - DNA, 25 bp, Homo sapien
tcgacacctacgacgatcgggccta

SEQ ID NO: 126901 - DNA, 25 bp, Homo sapien
gccagcacataatgggccgcgtagg

SEQ ID NO: 126902 - DNA, 25 bp, Homo sapien
ggcaaatggcggacttcgacaccta

SEQ ID NO: 126903 - DNA, 25 bp, Homo sapien
acgtgttggtttttgccctgccttg

SEQ ID NO: 126904 - DNA, 25 bp, Homo sapien
ctcccgccaacgacaacgtgttggt

SEQ ID NO: 126905 - DNA, 25 bp, Homo sapien
gcctgcgtccaagggatttgcgatc

SEQ ID NO: 126906 - DNA, 25 bp, Homo sapien
cggcagccaagaggggcgattccct

SEQ ID NO: 126907 - DNA, 25 bp, Homo sapien
cctctcggagcggagacggcaaatg

SEQ ID NO: 126908 - DNA, 25 bp, Homo sapien
cgcgcccattctttacggcctggga

SEQ ID NO: 126909 - DNA, 25 bp, Homo sapien
gccttccgagaaagcaggtcgctct

SEQ ID NO: 126910 - DNA, 25 bp, Homo sapien
tcgctctcggaacggacgtttgtgt

SEQ ID NO: 126911 - DNA, 25 bp, Homo sapien
tctgaatgtcctagtgagctgctcc

SEQ ID NO: 126912 - DNA, 25 bp, Homo sapien
cgagactccgctcgcagagtttaga

SEQ ID NO: 126913 - DNA, 25 bp, Homo sapien
gtttagaccggccactctcgatcca

SEQ ID NO: 126914 - DNA, 25 bp, Homo sapien
catgtccgtcgccttcttgaaatca

SEQ ID NO: 126915 - DNA, 25 bp, Homo sapien
gggacctcaccacggcagttcgtag

SEQ ID NO: 126916 - DNA, 25 bp, Homo sapien
cgggccggcagccttatatagtagc

SEQ ID NO: 126917 - DNA, 25 bp, Homo sapien
ccggccaggatccatacgtggacca

SEQ ID NO: 126918 - DNA, 25 bp, Homo sapien
tcgtggccctagatcctggacgcag

SEQ ID NO: 126919 - DNA, 25 bp, Homo sapien
ggtgcccaagacacccgagcatttc

SEQ ID NO: 126920 - DNA, 25 bp, Homo sapien
gaaaagcctcacctcggccttagtg

SEQ ID NO: 126921 - DNA, 25 bp, Homo sapien
tatcgggattgcatcaagcctccgc

SEQ ID NO: 126922 - DNA, 25 bp, Homo sapien
agcaatcgacaactggggcccttcc

SEQ ID NO: 126923 - DNA, 25 bp, Homo sapien
ttcaccctctgtcgggaaaagcctc

SEQ ID NO: 126924 - DNA, 25 bp, Homo sapien
cccacaaaggacagctgcggcctgg

SEQ ID NO: 126925 - DNA, 25 bp, Homo sapien
aacgcgatgtaagcaccaccaggtg

SEQ ID NO: 126926 - DNA, 25 bp, Homo sapien
cgccttcccagagacgtggcgcgag

SEQ ID NO: 126927 - DNA, 25 bp, Homo sapien
ggccctgagcacctatcgcggggat

SEQ ID NO: 126928 - DNA, 25 bp, Homo sapien
ccgccgcttagcctgatgctggaag

SEQ ID NO: 126929 - DNA, 25 bp, Homo sapien
ggcactgaggcctgaaaaccgcgag

SEQ ID NO: 126930 - DNA, 25 bp, Homo sapien
gaagaggttgctccgcgttttccgc

SEQ ID NO: 126931 - DNA, 25 bp, Homo sapien
tgctttccgcgaggcactgaggcct

SEQ ID NO: 126932 - DNA, 25 bp, Homo sapien
cagccggggcttgtctctgggaaac

SEQ ID NO: 126933 - DNA, 25 bp, Homo sapien
cagctgaaatggaaggcgtgaaatg

SEQ ID NO: 126934 - DNA, 25 bp, Homo sapien
agagagccacgtccggggtctctgc

SEQ ID NO: 126935 - DNA, 25 bp, Homo sapien
gggcttgtctctgggaaacggcatc

SEQ ID NO: 126936 - DNA, 25 bp, Homo sapien
cctgattggcagagttccgaggctg

SEQ ID NO: 126937 - DNA, 25 bp, Homo sapien
aggctggcccgccaaaccaagatgg

SEQ ID NO: 126938 - DNA, 25 bp, Homo sapien
agatgggctttccactgctctattt

SEQ ID NO: 126939 - DNA, 25 bp, Homo sapien
ccgccaaaccaagatgggctttcca

SEQ ID NO: 126940 - DNA, 25 bp, Homo sapien
gctccgtgaagactggcaacgagtc

SEQ ID NO: 126941 - DNA, 25 bp, Homo sapien
gatgcccactccgtggagtcgctga

SEQ ID NO: 126942 - DNA, 25 bp, Homo sapien
gctgactgcccagaacctgtcattg

SEQ ID NO: 126943 - DNA, 25 bp, Homo sapien
gcaacgagtcgggatccaacctctc

SEQ ID NO: 126944 - DNA, 25 bp, Homo sapien
agagacgcagttcgcaccgggccag

SEQ ID NO: 126945 - DNA, 25 bp, Homo sapien
ctcagacagcggctctgtgaagcgg

SEQ ID NO: 126946 - DNA, 25 bp, Homo sapien
ctgtcattgcattcgggcacggcca

SEQ ID NO: 126947 - DNA, 25 bp, Homo sapien
agcgtcctcaacagctccgtgaaga

SEQ ID NO: 126948 - DNA, 25 bp, Homo sapien
ggataaatacgagaaggccctgaag

SEQ ID NO: 126949 - DNA, 25 bp, Homo sapien
tcaccctgcgccgaggtgaaatcga

SEQ ID NO: 126950 - DNA, 25 bp, Homo sapien
ggtgaaatcgaggagctccagcagt

SEQ ID NO: 126951 - DNA, 25 bp, Homo sapien
ctctcggccagcaaggaacaccaga

SEQ ID NO: 126952 - DNA, 25 bp, Homo sapien
tgctgcgggataaatacgagaaggc

SEQ ID NO: 126953 - DNA, 25 bp, Homo sapien
gctccgcgcggccaacgagaagtac

SEQ ID NO: 126954 - DNA, 25 bp, Homo sapien
caacgagaagtacgcacaggaggtg

SEQ ID NO: 126955 - DNA, 25 bp, Homo sapien
gccagcaaggaacaccagagggaga

SEQ ID NO: 126956 - DNA, 25 bp, Homo sapien
aggcttttctaatccggcgctggtg

SEQ ID NO: 126957 - DNA, 25 bp, Homo sapien
cccaggcttttctaatccggcgctg

SEQ ID NO: 126958 - DNA, 25 bp, Homo sapien
cggctgctctcccagtggtggtggg

SEQ ID NO: 126959 - DNA, 25 bp, Homo sapien
gggtgaccttgaccctccaacttca

SEQ ID NO: 126960 - DNA, 25 bp, Homo sapien
gctgggtgaccttgaccctccaact

SEQ ID NO: 126961 - DNA, 25 bp, Homo sapien
tccgcgcgttccagctgggtgacct

SEQ ID NO: 126962 - DNA, 25 bp, Homo sapien
gcctccgcgcgttccagctgggtga

SEQ ID NO: 126963 - DNA, 25 bp, Homo sapien
ggcttttctaatccggcgctggtgg

SEQ ID NO: 126964 - DNA, 25 bp, Homo sapien
ggactgcgatttctcatcctggtca

SEQ ID NO: 126965 - DNA, 25 bp, Homo sapien
gctgacagcccggagattagtctcc

SEQ ID NO: 126966 - DNA, 25 bp, Homo sapien
tggaaacctgaaccgcggagccgtc

SEQ ID NO: 126967 - DNA, 25 bp, Homo sapien
tcatcctggtcacgcaggcaggcgg

SEQ ID NO: 126968 - DNA, 25 bp, Homo sapien
ttgccataggcacgcaggcccgcgt

SEQ ID NO: 126969 - DNA, 25 bp, Homo sapien
aggccacaacgccagttgccatagg

SEQ ID NO: 126970 - DNA, 25 bp, Homo sapien
gagattagtctccaaggccacaacg

SEQ ID NO: 126971 - DNA, 25 bp, Homo sapien
ggagccaggctcaggctttaaataa

SEQ ID NO: 126972 - DNA, 25 bp, Homo sapien
cgggcactgccatcccgtgcatgga

SEQ ID NO: 126973 - DNA, 25 bp, Homo sapien
ctgagactgtgcccgcgggcactgc

SEQ ID NO: 126974 - DNA, 25 bp, Homo sapien
caccgctcagatccgcggccagagc

SEQ ID NO: 126975 - DNA, 25 bp, Homo sapien
tggcgcctgtcggtcgtctagaccc

SEQ ID NO: 126976 - DNA, 25 bp, Homo sapien
ccagccttctgtcccaccgttccgt

SEQ ID NO: 126977 - DNA, 25 bp, Homo sapien
ccatcccgtgcatggagagggcgca

SEQ ID NO: 126978 - DNA, 25 bp, Homo sapien
gggaacccgatcctccttcatccgc

SEQ ID NO: 126979 - DNA, 25 bp, Homo sapien
cgatcctccttcatccgcgcaaagg

SEQ ID NO: 126980 - DNA, 25 bp, Homo sapien
aaacgaggctcgctcctgagtcttg

SEQ ID NO: 126981 - DNA, 25 bp, Homo sapien
cagccgcccaggttccttgcagggt

SEQ ID NO: 126982 - DNA, 25 bp, Homo sapien
cagggtggaccgtcccgtgtcccag

SEQ ID NO: 126983 - DNA, 25 bp, Homo sapien
ggcgtgcctcctgagagggcccact

SEQ ID NO: 126984 - DNA, 25 bp, Homo sapien
cgcagctctctgcaatgaggggccg

SEQ ID NO: 126985 - DNA, 25 bp, Homo sapien
cccaggcaatcacaagcaaggaggt

SEQ ID NO: 126986 - DNA, 25 bp, Homo sapien
ctgctcggcctccagaaaacgaggc

SEQ ID NO: 126987 - DNA, 25 bp, Homo sapien
tcacaagcaaggaggtgcgcgtcgc

SEQ ID NO: 126988 - DNA, 25 bp, Homo sapien
tggaaaaagcgtcgtggtcgccacc

SEQ ID NO: 126989 - DNA, 25 bp, Homo sapien
aggatggccgtcgtggcccgaatcc

SEQ ID NO: 126990 - DNA, 25 bp, Homo sapien
gaaaaagcgtcgtggtcgccaccta

SEQ ID NO: 126991 - DNA, 25 bp, Homo sapien
gctggaaaaagcgtcgtggtcgcca

SEQ ID NO: 126992 - DNA, 25 bp, Homo sapien
ttctcgctagcgacaaaggcttgga

SEQ ID NO: 126993 - DNA, 25 bp, Homo sapien
aaagttttctcgctagcgacaaagg

SEQ ID NO: 126994 - DNA, 25 bp, Homo sapien
cggaaagttttctcgctagcgacaa

SEQ ID NO: 126995 - DNA, 25 bp, Homo sapien
aagcgtcgtggtcgccacctaccga

SEQ ID NO: 126996 - DNA, 25 bp, Homo sapien
cagtgatcggatcaaggcgctgagc

SEQ ID NO: 126997 - DNA, 25 bp, Homo sapien
ccgccgcgttgacggggaacgcatc

SEQ ID NO: 126998 - DNA, 25 bp, Homo sapien
gggaacgcatccgaaactacaactc

SEQ ID NO: 126999 - DNA, 25 bp, Homo sapien
cgcaacgcgccttcgaggaacaaaa

SEQ ID NO: 127000 - DNA, 25 bp, Homo sapien
gcgcttgcctcgtcctcgggttcgg

SEQ ID NO: 127001 - DNA, 25 bp, Homo sapien
gagttgtagtccacgaccgccgccg

SEQ ID NO: 127002 - DNA, 25 bp, Homo sapien
ctttattagagactttgccccgccg

SEQ ID NO: 127003 - DNA, 25 bp, Homo sapien
tgacaggagcgcgaccgacacgcac

SEQ ID NO: 127004 - DNA, 25 bp, Homo sapien
actcactgtcgcgggtgtccgcgtg

SEQ ID NO: 127005 - DNA, 25 bp, Homo sapien
ccggagccaagagtgtctgcgtccc

SEQ ID NO: 127006 - DNA, 25 bp, Homo sapien
cagccgcttgatgcccagcaggtag

SEQ ID NO: 127007 - DNA, 25 bp, Homo sapien
atgcccagcaggtagtcgccggcgc

SEQ ID NO: 127008 - DNA, 25 bp, Homo sapien
actctgaggagcagtgcgcgcctcc

SEQ ID NO: 127009 - DNA, 25 bp, Homo sapien
gaggccgagccgctatatatatagc

SEQ ID NO: 127010 - DNA, 25 bp, Homo sapien
gccgctatatatatagcccggcgcc

SEQ ID NO: 127011 - DNA, 25 bp, Homo sapien
ccgccgagggtctcagagtgtgact

SEQ ID NO: 127012 - DNA, 25 bp, Homo sapien
ttcgctctgtctaggccatagcttg

SEQ ID NO: 127013 - DNA, 25 bp, Homo sapien
agcggcagacgcagcgctctaaacc

SEQ ID NO: 127014 - DNA, 25 bp, Homo sapien
acttcctcggaccaggggtgcccat

SEQ ID NO: 127015 - DNA, 25 bp, Homo sapien
tgggccaggtcgtccatccgcaacg

SEQ ID NO: 127016 - DNA, 25 bp, Homo sapien
gagcgatccctaagaggcggagtca

SEQ ID NO: 127017 - DNA, 25 bp, Homo sapien
agcgtccgttttctgcagcagcgac

SEQ ID NO: 127018 - DNA, 25 bp, Homo sapien
aaccgctgcagcgagagcaccaagc

SEQ ID NO: 127019 - DNA, 25 bp, Homo sapien
tatcgccgcaacagcgtccgttttc

SEQ ID NO: 127020 - DNA, 25 bp, Homo sapien
gaaggcagcctcgactcgtgtgtcc

SEQ ID NO: 127021 - DNA, 25 bp, Homo sapien
gccctcaggaggaggacgttccgaa

SEQ ID NO: 127022 - DNA, 25 bp, Homo sapien
acctgggcctctaggcaacgcgtga

SEQ ID NO: 127023 - DNA, 25 bp, Homo sapien
tcgcgaggaccatacccacggacaa

SEQ ID NO: 127024 - DNA, 25 bp, Homo sapien
agtctggattggttttccgccaaca

SEQ ID NO: 127025 - DNA, 25 bp, Homo sapien
ctcggcctttttccttgggagtctg

SEQ ID NO: 127026 - DNA, 25 bp, Homo sapien
ccgtttccggtgctgtcgaatccaa

SEQ ID NO: 127027 - DNA, 25 bp, Homo sapien
tcgaatccaatttagccgcgctgtg

SEQ ID NO: 127028 - DNA, 25 bp, Homo sapien
cccattaggtgcgccttgaagccga

SEQ ID NO: 127029 - DNA, 25 bp, Homo sapien
agccagtacatgcaggtgggctcca

SEQ ID NO: 127030 - DNA, 25 bp, Homo sapien
gccagtacatgcaggtgggctccac

SEQ ID NO: 127031 - DNA, 25 bp, Homo sapien
cccagcgatccggtgcccattaggt

SEQ ID NO: 127032 - DNA, 25 bp, Homo sapien
cagcgatccggtgcccattaggtgc

SEQ ID NO: 127033 - DNA, 25 bp, Homo sapien
atccggtgcccattaggtgcgcctt

SEQ ID NO: 127034 - DNA, 25 bp, Homo sapien
tgcccattaggtgcgccttgaagcc

SEQ ID NO: 127035 - DNA, 25 bp, Homo sapien
cggtgcccattaggtgcgccttgaa

SEQ ID NO: 127036 - DNA, 25 bp, Homo sapien
cgtgtcctgttttgctcccttgcta

SEQ ID NO: 127037 - DNA, 25 bp, Homo sapien
agtcctcgccggaagaggctacggc

SEQ ID NO: 127038 - DNA, 25 bp, Homo sapien
aggctacggccacttttactcctgg

SEQ ID NO: 127039 - DNA, 25 bp, Homo sapien
tactcctggttgaaggcaaaggcgc

SEQ ID NO: 127040 - DNA, 25 bp, Homo sapien
tcttgcgtgacccttaacaccagtc

SEQ ID NO: 127041 - DNA, 25 bp, Homo sapien
ttgtcccttagcgaaactgcgtgtc

SEQ ID NO: 127042 - DNA, 25 bp, Homo sapien
cgacatttcttacctggccttgctg

SEQ ID NO: 127043 - DNA, 25 bp, Homo sapien
gcgggattaggattcttgtccctta

SEQ ID NO: 127044 - DNA, 25 bp, Homo sapien
cagacgcgcttgattggttagataa

SEQ ID NO: 127045 - DNA, 25 bp, Homo sapien
gcgctgcgtgcagacgcgcttgatt

SEQ ID NO: 127046 - DNA, 25 bp, Homo sapien
cgctgcgtgcagacgcgcttgattg

SEQ ID NO: 127047 - DNA, 25 bp, Homo sapien
gcagacgcgcttgattggttagata

SEQ ID NO: 127048 - DNA, 25 bp, Homo sapien
agacgcgcttgattggttagataag

SEQ ID NO: 127049 - DNA, 25 bp, Homo sapien
gacgcgcttgattggttagataagg

SEQ ID NO: 127050 - DNA, 25 bp, Homo sapien
acgcgcttgattggttagataaggg

SEQ ID NO: 127051 - DNA, 25 bp, Homo sapien
gtgcagacgcgcttgattggttaga

SEQ ID NO: 127052 - DNA, 25 bp, Homo sapien
tggcggaaaaccaatccagactccc

SEQ ID NO: 127053 - DNA, 25 bp, Homo sapien
atttcccgttgcaattctggtttcg

SEQ ID NO: 127054 - DNA, 25 bp, Homo sapien
tccatcccacaatcagcgatggctg

SEQ ID NO: 127055 - DNA, 25 bp, Homo sapien
acgtcacgcgttgcctagaggccca

SEQ ID NO: 127056 - DNA, 25 bp, Homo sapien
ttcggaacgtcctcctcctgagggc

SEQ ID NO: 127057 - DNA, 25 bp, Homo sapien
acacacgagtcgaggctgccttcca

SEQ ID NO: 127058 - DNA, 25 bp, Homo sapien
tggattcgacagcaccggaaacggc

SEQ ID NO: 127059 - DNA, 25 bp, Homo sapien
tgcacagcgcggctaaattggattc

SEQ ID NO: 127060 - DNA, 25 bp, Homo sapien
tgactccgcctcttagggatcgctc

SEQ ID NO: 127061 - DNA, 25 bp, Homo sapien
gctatggcctagacagagcgaaccc

SEQ ID NO: 127062 - DNA, 25 bp, Homo sapien
ccaagctatggcctagacagagcga

SEQ ID NO: 127063 - DNA, 25 bp, Homo sapien
ttgcggatggacgacctggcccagc

SEQ ID NO: 127064 - DNA, 25 bp, Homo sapien
tcgctgctgcagaaaacggacgctg

SEQ ID NO: 127065 - DNA, 25 bp, Homo sapien
gtttagagcgctgcgtctgccgctc

SEQ ID NO: 127066 - DNA, 25 bp, Homo sapien
gctctcgctgcagcggttcaggatg

SEQ ID NO: 127067 - DNA, 25 bp, Homo sapien
gaaaacggacgctgttgcggcgata

SEQ ID NO: 127068 - DNA, 25 bp, Homo sapien
gattagaattgcacgcggcgcagca

SEQ ID NO: 127069 - DNA, 25 bp, Homo sapien
attgtcccgttctggctttgccggc

SEQ ID NO: 127070 - DNA, 25 bp, Homo sapien
gcccagcagatgcagagctcacatt

SEQ ID NO: 127071 - DNA, 25 bp, Homo sapien
cagagctcacattttctcctgctag

SEQ ID NO: 127072 - DNA, 25 bp, Homo sapien
gatagccaggcccattgcccgtcag

SEQ ID NO: 127073 - DNA, 25 bp, Homo sapien
ggaaggaatattgtcccgttctggc

SEQ ID NO: 127074 - DNA, 25 bp, Homo sapien
ctttgccggccaggattagaattgc

SEQ ID NO: 127075 - DNA, 25 bp, Homo sapien
acccacagccaagcgggaggcctgg

SEQ ID NO: 127076 - DNA, 25 bp, Homo sapien
gtggctatccaaactaaacctcctc

SEQ ID NO: 127077 - DNA, 25 bp, Homo sapien
taaacggtgtggaacatcgcaggcc

SEQ ID NO: 127078 - DNA, 25 bp, Homo sapien
acggagcccaccacatgtctgagag

SEQ ID NO: 127079 - DNA, 25 bp, Homo sapien
ccacatgtctgagagcagacctctg

SEQ ID NO: 127080 - DNA, 25 bp, Homo sapien
agcagacctctgcagcgtgcgggcc

SEQ ID NO: 127081 - DNA, 25 bp, Homo sapien
gcgggtgcagccagttcacacataa

SEQ ID NO: 127082 - DNA, 25 bp, Homo sapien
gcagccagttcacacataaacggtg

SEQ ID NO: 127083 - DNA, 25 bp, Homo sapien
ggaaaggcgtttacgtggctatcca

SEQ ID NO: 127084 - DNA, 25 bp, Homo sapien
gctccaggttatccgggctctgctt

SEQ ID NO: 127085 - DNA, 25 bp, Homo sapien
caaactcgcactcggcgctgtagtg

SEQ ID NO: 127086 - DNA, 25 bp, Homo sapien
tatagcccagctcgtggatccgctc

SEQ ID NO: 127087 - DNA, 25 bp, Homo sapien
agccgggaggcatacgtattatagc

SEQ ID NO: 127088 - DNA, 25 bp, Homo sapien
ggcccttgccgttcacagacacgta

SEQ ID NO: 127089 - DNA, 25 bp, Homo sapien
caggcgtactagacaccgtccggta

SEQ ID NO: 127090 - DNA, 25 bp, Homo sapien
acgtaccacagtctctcggcgctgg

SEQ ID NO: 127091 - DNA, 25 bp, Homo sapien
gtagctgccgcaccatctcgtggtc

SEQ ID NO: 127092 - DNA, 25 bp, Homo sapien
cagagagcacgatggggcacttaca

SEQ ID NO: 127093 - DNA, 25 bp, Homo sapien
ggaggcactcatcgtttcgttccaa

SEQ ID NO: 127094 - DNA, 25 bp, Homo sapien
caggactccctggtttaacgcgctt

SEQ ID NO: 127095 - DNA, 25 bp, Homo sapien
ttaaccgctcgtacagggactgatg

SEQ ID NO: 127096 - DNA, 25 bp, Homo sapien
gctccttctcggatgacgtccttca

SEQ ID NO: 127097 - DNA, 25 bp, Homo sapien
gggcgtacctagcaccgaagcatca

SEQ ID NO: 127098 - DNA, 25 bp, Homo sapien
gggcacctaacgagcacgcagagca

SEQ ID NO: 127099 - DNA, 25 bp, Homo sapien
agcatcaggcgccactaggtctcca

SEQ ID NO: 127100 - DNA, 25 bp, Homo sapien
cgacggtcagcgctttgtcatctgg

SEQ ID NO: 127101 - DNA, 25 bp, Homo sapien
ggccacacagaacgtgaagcagctg

SEQ ID NO: 127102 - DNA, 25 bp, Homo sapien
gaacgtgaagcagctgtacgcgctg

SEQ ID NO: 127103 - DNA, 25 bp, Homo sapien
agctgtacgcgctggtgtgcgaaac

SEQ ID NO: 127104 - DNA, 25 bp, Homo sapien
ctggtgtgcgaaacgcagcgctact

SEQ ID NO: 127105 - DNA, 25 bp, Homo sapien
tgtgcgaaacgcagcgctactccgc

SEQ ID NO: 127106 - DNA, 25 bp, Homo sapien
agcgctactccgccgtgctggatgc

SEQ ID NO: 127107 - DNA, 25 bp, Homo sapien
acagagccgtaaaggcgcgcgggaa

SEQ ID NO: 127108 - DNA, 25 bp, Homo sapien
gcgcttgagccaaagggaatgttga

SEQ ID NO: 127109 - DNA, 25 bp, Homo sapien
aaccactaaagtcggcagcgctgct

SEQ ID NO: 127110 - DNA, 25 bp, Homo sapien
gggtgctgccaaaaccactaaagtc

SEQ ID NO: 127111 - DNA, 25 bp, Homo sapien
tggcgagggtgctgccaaaaccact

SEQ ID NO: 127112 - DNA, 25 bp, Homo sapien
agaagacagcagtggagccgccaaa

SEQ ID NO: 127113 - DNA, 25 bp, Homo sapien
ggggtgctcgtgttactgaacgtca

SEQ ID NO: 127114 - DNA, 25 bp, Homo sapien
ggggctgcagagtttccaaaagtga

SEQ ID NO: 127115 - DNA, 25 bp, Homo sapien
ttactgaacgtcagagtgggctggc

SEQ ID NO: 127116 - DNA, 25 bp, Homo sapien
gccgccggagacatcgcggctccgc

SEQ ID NO: 127117 - DNA, 25 bp, Homo sapien
ctctaggaggtttccgttggctgtc

SEQ ID NO: 127118 - DNA, 25 bp, Homo sapien
cggctctaggaggtttccgttggct

SEQ ID NO: 127119 - DNA, 25 bp, Homo sapien
gtcaggtccttcgagcagggtccgc

SEQ ID NO: 127120 - DNA, 25 bp, Homo sapien
gcgaagcgaacagtgttcgccgatg

SEQ ID NO: 127121 - DNA, 25 bp, Homo sapien
caaggggcgcgaacctcggggctcg

SEQ ID NO: 127122 - DNA, 25 bp, Homo sapien
aggaggtttccgttggctgtcgact

SEQ ID NO: 127123 - DNA, 25 bp, Homo sapien
gtttccgttggctgtcgacttggcc

SEQ ID NO: 127124 - DNA, 25 bp, Homo sapien
taagtgagagaatagaagtgctgac

SEQ ID NO: 127125 - DNA, 25 bp, Homo sapien
cttaagtgagagaatagaagtgctg

SEQ ID NO: 127126 - DNA, 25 bp, Homo sapien
tgctctgaaatgctgagaagtttca

SEQ ID NO: 127127 - DNA, 25 bp, Homo sapien
ttaagtgagagaatagaagtgctga

SEQ ID NO: 127128 - DNA, 25 bp, Homo sapien
aagtgagagaatagaagtgctgacg

SEQ ID NO: 127129 - DNA, 25 bp, Homo sapien
cagacacttaagtgagagaatagaa

SEQ ID NO: 127130 - DNA, 25 bp, Homo sapien
cacttaagtgagagaatagaagtgc

SEQ ID NO: 127131 - DNA, 25 bp, Homo sapien
cggcctagtctaggccgccaaggac

SEQ ID NO: 127132 - DNA, 25 bp, Homo sapien
gctctgggcccgaaaatcccagact

SEQ ID NO: 127133 - DNA, 25 bp, Homo sapien
gctcaccatacagcgacggcctagt

SEQ ID NO: 127134 - DNA, 25 bp, Homo sapien
cgcaggctatgcgatgctcgtccac

SEQ ID NO: 127135 - DNA, 25 bp, Homo sapien
agcaagcggcgacctgaagactcac

SEQ ID NO: 127136 - DNA, 25 bp, Homo sapien
gcgacctgaagactcacaggaagcg

SEQ ID NO: 127137 - DNA, 25 bp, Homo sapien
tgcccgaacacgcacgccgggagag

SEQ ID NO: 127138 - DNA, 25 bp, Homo sapien
gatgctcgtccactgcaggccaaac

SEQ ID NO: 127139 - DNA, 25 bp, Homo sapien
agctcgctgacgtggcccttcagct

SEQ ID NO: 127140 - DNA, 25 bp, Homo sapien
ggaattcacagtcgtcggccgcctg

SEQ ID NO: 127141 - DNA, 25 bp, Homo sapien
gccagatctgcttccagctcgctga

SEQ ID NO: 127142 - DNA, 25 bp, Homo sapien
tgctcggccagatctgcttccagct

SEQ ID NO: 127143 - DNA, 25 bp, Homo sapien
ccactgccacgggtcacgggcatgg

SEQ ID NO: 127144 - DNA, 25 bp, Homo sapien
tgagctcgtccagttctgcccgcag

SEQ ID NO: 127145 - DNA, 25 bp, Homo sapien
ttctgcccgcaggaattcacagtcg

SEQ ID NO: 127146 - DNA, 25 bp, Homo sapien
ggactccggtcatgaggccaaccgc

SEQ ID NO: 127147 - DNA, 25 bp, Homo sapien
cggcgaggatgtgatttgaataaca

SEQ ID NO: 127148 - DNA, 25 bp, Homo sapien
cgggaaatcccggaatcagctggcg

SEQ ID NO: 127149 - DNA, 25 bp, Homo sapien
tcacatccatgaccgaggctgcggg

SEQ ID NO: 127150 - DNA, 25 bp, Homo sapien
acttaccatcttgctcacatccatg

SEQ ID NO: 127151 - DNA, 25 bp, Homo sapien
agtccctggagtccagcgcgatctc

SEQ ID NO: 127152 - DNA, 25 bp, Homo sapien
gggccaacaggcaggatcaacaatc

SEQ ID NO: 127153 - DNA, 25 bp, Homo sapien
aactttcaatggatcgcgccggcta

SEQ ID NO: 127154 - DNA, 25 bp, Homo sapien
ggcaggatcaacaatccagaaactt

SEQ ID NO: 127155 - DNA, 25 bp, Homo sapien
ctgcaaggatcgcagagcccaggtc

SEQ ID NO: 127156 - DNA, 25 bp, Homo sapien
tgagtccgctcgaagctctcgcgct

SEQ ID NO: 127157 - DNA, 25 bp, Homo sapien
gtgagttctgccagtcttccagaga

SEQ ID NO: 127158 - DNA, 25 bp, Homo sapien
catccgatccatgtcgccgcgagga

SEQ ID NO: 127159 - DNA, 25 bp, Homo sapien
ccgcctgccattggctgtgagttct

SEQ ID NO: 127160 - DNA, 25 bp, Homo sapien
gatccggctcaatgggtggccgccc

SEQ ID NO: 127161 - DNA, 25 bp, Homo sapien
agcccgcctgcgaatagcccgttag

SEQ ID NO: 127162 - DNA, 25 bp, Homo sapien
agtcctgtcagtcaccgtggtcccg

SEQ ID NO: 127163 - DNA, 25 bp, Homo sapien
gaggcagacggtcttttcccggaca

SEQ ID NO: 127164 - DNA, 25 bp, Homo sapien
tacttcgtggcgcagtagagcttgc

SEQ ID NO: 127165 - DNA, 25 bp, Homo sapien
tagcagccagattaggcccatcgtg

SEQ ID NO: 127166 - DNA, 25 bp, Homo sapien
ctcttctcccggacgtgtaggttga

SEQ ID NO: 127167 - DNA, 25 bp, Homo sapien
ggcttaaacttgtcagagctgccca

SEQ ID NO: 127168 - DNA, 25 bp, Homo sapien
ttctccgacacattcaaagggctta

SEQ ID NO: 127169 - DNA, 25 bp, Homo sapien
gatgataaatgccttgtccggctcc

SEQ ID NO: 127170 - DNA, 25 bp, Homo sapien
cggcactcactgtaggcgctgttct

SEQ ID NO: 127171 - DNA, 25 bp, Homo sapien
ttcccgccagaatacctcgagatgc

SEQ ID NO: 127172 - DNA, 25 bp, Homo sapien
cacgggtgactttcggtccagatgc

SEQ ID NO: 127173 - DNA, 25 bp, Homo sapien
ctgcgtccagggctacagtaatgag

SEQ ID NO: 127174 - DNA, 25 bp, Homo sapien
ggaggacaccaatgccggcaccttc

SEQ ID NO: 127175 - DNA, 25 bp, Homo sapien
ccagcgcatgtggtagcaaaatccc

SEQ ID NO: 127176 - DNA, 25 bp, Homo sapien
tgccaggaaggaaagcgcacacacc

SEQ ID NO: 127177 - DNA, 25 bp, Homo sapien
cgggccaaggtctccaaatctaacg

SEQ ID NO: 127178 - DNA, 25 bp, Homo sapien
agacacggaggctacgcaaatctgc

SEQ ID NO: 127179 - DNA, 25 bp, Homo sapien
gctcctctgctgttgccaagggaaa

SEQ ID NO: 127180 - DNA, 25 bp, Homo sapien
tcggcgctaccggattggacaactt

SEQ ID NO: 127181 - DNA, 25 bp, Homo sapien
ttgccaagggaaactgccgcgagga

SEQ ID NO: 127182 - DNA, 25 bp, Homo sapien
tcacgctgaagtccgaggcccttcg

SEQ ID NO: 127183 - DNA, 25 bp, Homo sapien
aggcccttcgcaactggcaaggtga

SEQ ID NO: 127184 - DNA, 25 bp, Homo sapien
tgtcctccgactttgccggttcctg

SEQ ID NO: 127185 - DNA, 25 bp, Homo sapien
ttcctgggctctagcctccgggact

SEQ ID NO: 127186 - DNA, 25 bp, Homo sapien
tgcttgtgtcccgaggtgccatccg

SEQ ID NO: 127187 - DNA, 25 bp, Homo sapien
tgggcctgaagcctcgccaatttca

SEQ ID NO: 127188 - DNA, 25 bp, Homo sapien
aggagacaatgtggcgatcacaagc

SEQ ID NO: 127189 - DNA, 25 bp, Homo sapien
tgccagcggtgagtgctatctttcg

SEQ ID NO: 127190 - DNA, 25 bp, Homo sapien
tgagggtcgacttttccacagcttg

SEQ ID NO: 127191 - DNA, 25 bp, Homo sapien
gatcacaagcaagcggcggcccgaa

SEQ ID NO: 127192 - DNA, 25 bp, Homo sapien
acccagggagacgacttgggcctga

SEQ ID NO: 127193 - DNA, 25 bp, Homo sapien
cgggccgtaccaagagcgcaaattt

SEQ ID NO: 127194 - DNA, 25 bp, Homo sapien
gcgcacagccacagttctgcagtga

SEQ ID NO: 127195 - DNA, 25 bp, Homo sapien
ctcaggcggccgctctcttctggga

SEQ ID NO: 127196 - DNA, 25 bp, Homo sapien
ggcctggactgcactgactgtgcca

SEQ ID NO: 127197 - DNA, 25 bp, Homo sapien
ggctgcagcgccagtagccagtagt

SEQ ID NO: 127198 - DNA, 25 bp, Homo sapien
agtcctgctgtagatcctcccagtc

SEQ ID NO: 127199 - DNA, 25 bp, Homo sapien
cgctaacctggatgttctggaagtc

SEQ ID NO: 127200 - DNA, 25 bp, Homo sapien
gcagcggcgctaacctggatgttct

SEQ ID NO: 127201 - DNA, 25 bp, Homo sapien
aaggccctcattggaagccgaggtc

SEQ ID NO: 127202 - DNA, 25 bp, Homo sapien
tggacaccaggaccaggggcctcgc

SEQ ID NO: 127203 - DNA, 25 bp, Homo sapien
gttgccaggatggtcccacagcttt

SEQ ID NO: 127204 - DNA, 25 bp, Homo sapien
cggccacacagacggctacgctaga

SEQ ID NO: 127205 - DNA, 25 bp, Homo sapien
agcacctcggcccaggtaggccaga

SEQ ID NO: 127206 - DNA, 25 bp, Homo sapien
atctcacgagatcccggaggcgagc

SEQ ID NO: 127207 - DNA, 25 bp, Homo sapien
tctaaggcgcttccagcctaaagcc

SEQ ID NO: 127208 - DNA, 25 bp, Homo sapien
cccacctggaaaaatggctcctcta

SEQ ID NO: 127209 - DNA, 25 bp, Homo sapien
tccacctcttgggtgcagactggcc

SEQ ID NO: 127210 - DNA, 25 bp, Homo sapien
accggaagtccggtcactctcgcga

SEQ ID NO: 127211 - DNA, 25 bp, Homo sapien
cgtggctgcgccagtggtgccaaga

SEQ ID NO: 127212 - DNA, 25 bp, Homo sapien
cagcaccggcgcatgccaggcaccg

SEQ ID NO: 127213 - DNA, 25 bp, Homo sapien
gcaccggcgcatgccaggcaccgag

SEQ ID NO: 127214 - DNA, 25 bp, Homo sapien
ctcgcagactgcgggaagcaatcgt

SEQ ID NO: 127215 - DNA, 25 bp, Homo sapien
cagactgcgggaagcaatcgtggcg

SEQ ID NO: 127216 - DNA, 25 bp, Homo sapien
gcgggaagcaatcgtggcggccgcc

SEQ ID NO: 127217 - DNA, 25 bp, Homo sapien
aggcccccgaccagacacccagagg

SEQ ID NO: 127218 - DNA, 25 bp, Homo sapien
ccggctgcatgaagcccggcatggt

SEQ ID NO: 127219 - DNA, 25 bp, Homo sapien
agtaggcggcgggttagtgtccgca

SEQ ID NO: 127220 - DNA, 25 bp, Homo sapien
ctcagtggccaccacaagcccgcta

SEQ ID NO: 127221 - DNA, 25 bp, Homo sapien
ggagggcactgtcgggcagaagctc

SEQ ID NO: 127222 - DNA, 25 bp, Homo sapien
gcccggagggcactgtcgggcagaa

SEQ ID NO: 127223 - DNA, 25 bp, Homo sapien
tgtccgcaggctccgactcggccgc

SEQ ID NO: 127224 - DNA, 25 bp, Homo sapien
ttagtgtccgcaggctccgactcgg

SEQ ID NO: 127225 - DNA, 25 bp, Homo sapien
ggttagtgtccgcaggctccgactc

SEQ ID NO: 127226 - DNA, 25 bp, Homo sapien
gtggccaccacaagcccgctagctc

SEQ ID NO: 127227 - DNA, 25 bp, Homo sapien
tcagcggtgaggtgagagcgcctgt

SEQ ID NO: 127228 - DNA, 25 bp, Homo sapien
gtgcgctgtccagcatttcagcaag

SEQ ID NO: 127229 - DNA, 25 bp, Homo sapien
tgtccagcatttcagcaagcggcgg

SEQ ID NO: 127230 - DNA, 25 bp, Homo sapien
cagcatttcagcaagcggcggcagc

SEQ ID NO: 127231 - DNA, 25 bp, Homo sapien
ccgctgcgggcgttcctccaggcct

SEQ ID NO: 127232 - DNA, 25 bp, Homo sapien
tgccctgcccaactcagcccagact

SEQ ID NO: 127233 - DNA, 25 bp, Homo sapien
agcgcccggtagatcgcggcggtca

SEQ ID NO: 127234 - DNA, 25 bp, Homo sapien
aactcagcccagactaggcggcagc

SEQ ID NO: 127235 - DNA, 25 bp, Homo sapien
caccgtgaacaacggggcggccagc

SEQ ID NO: 127236 - DNA, 25 bp, Homo sapien
gccagcatgcagtccacacccgacg

SEQ ID NO: 127237 - DNA, 25 bp, Homo sapien
cgacgccgcgaacggcttcccgcag

SEQ ID NO: 127238 - DNA, 25 bp, Homo sapien
cgaagaagtgaccatcccgcctcgt

SEQ ID NO: 127239 - DNA, 25 bp, Homo sapien
gcaccgcgagatcctggaccacgag

SEQ ID NO: 127240 - DNA, 25 bp, Homo sapien
tgaagcgcgcgcaccgcgagatcct

SEQ ID NO: 127241 - DNA, 25 bp, Homo sapien
tgaccatcccgcctcgtgtctgtgt

SEQ ID NO: 127242 - DNA, 25 bp, Homo sapien
acgatgtcctccaccgtgaacaacg

SEQ ID NO: 127243 - DNA, 25 bp, Homo sapien
gggcctggagtacgcgccctttgac

SEQ ID NO: 127244 - DNA, 25 bp, Homo sapien
cagccgggtagcagcccgcagactt

SEQ ID NO: 127245 - DNA, 25 bp, Homo sapien
agcagcccgcagacttgcggggcta

SEQ ID NO: 127246 - DNA, 25 bp, Homo sapien
cccgagactggtggtgagcgtccct

SEQ ID NO: 127247 - DNA, 25 bp, Homo sapien
tacgcgccctttgacgatgacgacg

SEQ ID NO: 127248 - DNA, 25 bp, Homo sapien
cctttgacgatgacgacggcccagt

SEQ ID NO: 127249 - DNA, 25 bp, Homo sapien
gtgaagaaaagtcgtcccgagactg

SEQ ID NO: 127250 - DNA, 25 bp, Homo sapien
acggcccagtggactgtgactgccc

SEQ ID NO: 127251 - DNA, 25 bp, Homo sapien
ccgcggtagagggaggtcttctctc

SEQ ID NO: 127252 - DNA, 25 bp, Homo sapien
cttggctgccggctcgctatgccag

SEQ ID NO: 127253 - DNA, 25 bp, Homo sapien
tccgaggatttgttctgcttggctg

SEQ ID NO: 127254 - DNA, 25 bp, Homo sapien
ccgcgcaccagctcgggttgcacgc

SEQ ID NO: 127255 - DNA, 25 bp, Homo sapien
ggcctccgaggatttgttctgcttg

SEQ ID NO: 127256 - DNA, 25 bp, Homo sapien
ctctctgtggccacgcttcgggaca

SEQ ID NO: 127257 - DNA, 25 bp, Homo sapien
gaaggcctccgaggatttgttctgc

SEQ ID NO: 127258 - DNA, 25 bp, Homo sapien
agagggaggtcttctctctgtggcc

SEQ ID NO: 127259 - DNA, 25 bp, Homo sapien
cactgcagttctaggaccggcttcc

SEQ ID NO: 127260 - DNA, 25 bp, Homo sapien
acgcccacgcaggatgatgacatga

SEQ ID NO: 127261 - DNA, 25 bp, Homo sapien
cactacagttctacggaccggcttc

SEQ ID NO: 127262 - DNA, 25 bp, Homo sapien
tcactacagttctacggaccggctt

SEQ ID NO: 127263 - DNA, 25 bp, Homo sapien
gacgcccacgcaggatgatgacatc

SEQ ID NO: 127264 - DNA, 25 bp, Homo sapien
gacgcccacgcaggatgatgacatg

SEQ ID NO: 127265 - DNA, 25 bp, Homo sapien
ccaacgcccatgcaggatgatgaca

SEQ ID NO: 127266 - DNA, 25 bp, Homo sapien
tgcagttctaggaccggcttccatc

SEQ ID NO: 127267 - DNA, 25 bp, Homo sapien
ccaagcaccgagacgaagggcgaaa

SEQ ID NO: 127268 - DNA, 25 bp, Homo sapien
tcgctttgcggagggttcccgcgcc

SEQ ID NO: 127269 - DNA, 25 bp, Homo sapien
atgtacgtacgcttcgctttgcgga

SEQ ID NO: 127270 - DNA, 25 bp, Homo sapien
cgcccgatgtacgtacgcttcgctt

SEQ ID NO: 127271 - DNA, 25 bp, Homo sapien
agcaccgagacgaagggcgaaagac

SEQ ID NO: 127272 - DNA, 25 bp, Homo sapien
gcaaagcgggtgtcccacgccgact

SEQ ID NO: 127273 - DNA, 25 bp, Homo sapien
cgcaactgcttgcaaagcgggtgtc

SEQ ID NO: 127274 - DNA, 25 bp, Homo sapien
cggtccagcggaagccggtcgcctt

SEQ ID NO: 127275 - DNA, 25 bp, Homo sapien
tccgtcccatcgggggggcaatgcc

SEQ ID NO: 127276 - DNA, 25 bp, Homo sapien
tgccgggaatcgtccgtcccatcgg

SEQ ID NO: 127277 - DNA, 25 bp, Homo sapien
ttctctctgccgggaatcgtccgtc

SEQ ID NO: 127278 - DNA, 25 bp, Homo sapien
tcttctctctgccgggaatcgtccg

SEQ ID NO: 127279 - DNA, 25 bp, Homo sapien
tctcttctctctgccgggaatcgtc

SEQ ID NO: 127280 - DNA, 25 bp, Homo sapien
ctcccggtgccgctctctcttctct

SEQ ID NO: 127281 - DNA, 25 bp, Homo sapien
ccgatgcctgtcctggagcccctcc

SEQ ID NO: 127282 - DNA, 25 bp, Homo sapien
ggggcaatgccagccccgatgcctg

SEQ ID NO: 127283 - DNA, 25 bp, Homo sapien
ggcgccgggactcgccaagcttcat

SEQ ID NO: 127284 - DNA, 25 bp, Homo sapien
ttcactgcgcactccgcgcgaactg

SEQ ID NO: 127285 - DNA, 25 bp, Homo sapien
cgctgacccggatcagggacagaga

SEQ ID NO: 127286 - DNA, 25 bp, Homo sapien
cgcatcaccaggtatggagggtctt

SEQ ID NO: 127287 - DNA, 25 bp, Homo sapien
ctcgccaagcttcatggagccgcgg

SEQ ID NO: 127288 - DNA, 25 bp, Homo sapien
ccgcgcaaggcactctgaggccgag

SEQ ID NO: 127289 - DNA, 25 bp, Homo sapien
ggagccgcggcgcatcaccaggtat

SEQ ID NO: 127290 - DNA, 25 bp, Homo sapien
gcgaactgaccacaaactacacgga

SEQ ID NO: 127291 - DNA, 25 bp, Homo sapien
cgcctgctaaaaatacccgactgga

SEQ ID NO: 127292 - DNA, 25 bp, Homo sapien
gagacctcaaacaccgcctgctaaa

SEQ ID NO: 127293 - DNA, 25 bp, Homo sapien
gcacttttctgagcagacgtccaga

SEQ ID NO: 127294 - DNA, 25 bp, Homo sapien
gtgtccctggatgtcaaccacttcg

SEQ ID NO: 127295 - DNA, 25 bp, Homo sapien
gcaccgggaaaaacaggactcctga

SEQ ID NO: 127296 - DNA, 25 bp, Homo sapien
aagggcgctttctgctctgtaatcc

SEQ ID NO: 127297 - DNA, 25 bp, Homo sapien
gccctcaaacgggtcattgccatta

SEQ ID NO: 127298 - DNA, 25 bp, Homo sapien
tccagagcagagtcagccagcatga

SEQ ID NO: 127299 - DNA, 25 bp, Homo sapien
tagaaacctgtcttacgtcgaggaa

SEQ ID NO: 127300 - DNA, 25 bp, Homo sapien
ggaaagccagcttcagagccgggaa

SEQ ID NO: 127301 - DNA, 25 bp, Homo sapien
ggccctagcaacagtccgaccattg

SEQ ID NO: 127302 - DNA, 25 bp, Homo sapien
tgattggctcttgccatgcccgagg

SEQ ID NO: 127303 - DNA, 25 bp, Homo sapien
gggacgaacggctcgccaatgcaaa

SEQ ID NO: 127304 - DNA, 25 bp, Homo sapien
acatccgggcttccgcgtagtccgg

SEQ ID NO: 127305 - DNA, 25 bp, Homo sapien
cggcaggcagcaaaaggcttccttg

SEQ ID NO: 127306 - DNA, 25 bp, Homo sapien
tctgcaccgtcctagaaacctgtct

SEQ ID NO: 127307 - DNA, 25 bp, Homo sapien
tcttggccaagtggcacgcttgctc

SEQ ID NO: 127308 - DNA, 25 bp, Homo sapien
ttaattgttgccttcgccgccatcg

SEQ ID NO: 127309 - DNA, 25 bp, Homo sapien
tcgtcgaacgcggtcttggccaagt

SEQ ID NO: 127310 - DNA, 25 bp, Homo sapien
gagtccttgtaggagtcctcgttga

SEQ ID NO: 127311 - DNA, 25 bp, Homo sapien
tcgtcctgctggtcgctcgtccaga

SEQ ID NO: 127312 - DNA, 25 bp, Homo sapien
agtcctcgttgagggtgtcaagctc

SEQ ID NO: 127313 - DNA, 25 bp, Homo sapien
ctcgtccagagcgtgaggttgtcgc

SEQ ID NO: 127314 - DNA, 25 bp, Homo sapien
gcatgatgagcgtggagtccttgta

SEQ ID NO: 127315 - DNA, 25 bp, Homo sapien
aggggaggagacactcacgttcttc

SEQ ID NO: 127316 - DNA, 25 bp, Homo sapien
caaaggggcggtcaagactacaact

SEQ ID NO: 127317 - DNA, 25 bp, Homo sapien
aacctgcagtgcactgaggcgctga

SEQ ID NO: 127318 - DNA, 25 bp, Homo sapien
gcccacgccgcatgacgaaggcagg

SEQ ID NO: 127319 - DNA, 25 bp, Homo sapien
accgacccacagagcgagcagctga

SEQ ID NO: 127320 - DNA, 25 bp, Homo sapien
tcacgttcttcatggccgcggccat

SEQ ID NO: 127321 - DNA, 25 bp, Homo sapien
gactccgaaaagaggccgcgtcaca

SEQ ID NO: 127322 - DNA, 25 bp, Homo sapien
ttctgcaccagttgctcgcggtcca

SEQ ID NO: 127323 - DNA, 25 bp, Homo sapien
ctggctgtgacaggctgtgccagtc

SEQ ID NO: 127324 - DNA, 25 bp, Homo sapien
ctctgcaactggctgtgacaggctg

SEQ ID NO: 127325 - DNA, 25 bp, Homo sapien
ccgcctcaccaggactctgcaactg

SEQ ID NO: 127326 - DNA, 25 bp, Homo sapien
ccgtgactcagcaggaaggcgcgac

SEQ ID NO: 127327 - DNA, 25 bp, Homo sapien
ccagtcgcaggctctccaatcagga

SEQ ID NO: 127328 - DNA, 25 bp, Homo sapien
cgcaggctctccaatcaggaggctg

SEQ ID NO: 127329 - DNA, 25 bp, Homo sapien
gcgaattccctctcccggtagtctc

SEQ ID NO: 127330 - DNA, 25 bp, Homo sapien
ctgtgccagtcgcaggctctccaat

SEQ ID NO: 127331 - DNA, 25 bp, Homo sapien
cctcgagggcaccagtgtgtgagcc

SEQ ID NO: 127332 - DNA, 25 bp, Homo sapien
gggcaagcggtcagcaccacagtct

SEQ ID NO: 127333 - DNA, 25 bp, Homo sapien
tcgcggtgtccgtgcagggattcac

SEQ ID NO: 127334 - DNA, 25 bp, Homo sapien
gtcagggacgacactgccacagcca

SEQ ID NO: 127335 - DNA, 25 bp, Homo sapien
accgaggtcacactcacgtcaggga

SEQ ID NO: 127336 - DNA, 25 bp, Homo sapien
cagtgcatacgccaccgaggtcaca

SEQ ID NO: 127337 - DNA, 25 bp, Homo sapien
taagtctggggcagtgcatacgcca

SEQ ID NO: 127338 - DNA, 25 bp, Homo sapien
cagggattcaccgagagtccagacc

SEQ ID NO: 127339 - DNA, 25 bp, Homo sapien
ctttctcgaactgggatcggcctta

SEQ ID NO: 127340 - DNA, 25 bp, Homo sapien
ggaagcagtcgctcaggcgagcctc

SEQ ID NO: 127341 - DNA, 25 bp, Homo sapien
cgtagccgaagtggcccagtcccgt

SEQ ID NO: 127342 - DNA, 25 bp, Homo sapien
ccattttccactgcagaaggctctc

SEQ ID NO: 127343 - DNA, 25 bp, Homo sapien
ggatcggccttagccctgaccttcg

SEQ ID NO: 127344 - DNA, 25 bp, Homo sapien
ggtctagatttagccgggagcaaac

SEQ ID NO: 127345 - DNA, 25 bp, Homo sapien
cggacttgatgcctttctcgaactg

SEQ ID NO: 127346 - DNA, 25 bp, Homo sapien
aaagtcccagtcatcgtcgcacacg

SEQ ID NO: 127347 - DNA, 25 bp, Homo sapien
cactcggccctgacacaggttcgcg

SEQ ID NO: 127348 - DNA, 25 bp, Homo sapien
gccactgtgcaggatctccactcgg

SEQ ID NO: 127349 - DNA, 25 bp, Homo sapien
cacaggccactgtgcaggatctcca

SEQ ID NO: 127350 - DNA, 25 bp, Homo sapien
tgacgacagaccacagcggcatccg

SEQ ID NO: 127351 - DNA, 25 bp, Homo sapien
tgccatagccgaagaaggcgttggt

SEQ ID NO: 127352 - DNA, 25 bp, Homo sapien
ggatgtgtccggtgccatagccgaa

SEQ ID NO: 127353 - DNA, 25 bp, Homo sapien
ccttcgcagtgcacgttgtccagca

SEQ ID NO: 127354 - DNA, 25 bp, Homo sapien
tcgccgccttcgcagtgcacgttgt

SEQ ID NO: 127355 - DNA, 25 bp, Homo sapien
tcgcccacctaagcgtgaacagctg

SEQ ID NO: 127356 - DNA, 25 bp, Homo sapien
caggtaagcgttagtcccgccttca

SEQ ID NO: 127357 - DNA, 25 bp, Homo sapien
cctcccattggacgaggtctgcgtc

SEQ ID NO: 127358 - DNA, 25 bp, Homo sapien
gcgggctactgacgccatctctaga

SEQ ID NO: 127359 - DNA, 25 bp, Homo sapien
ctagaggcctagagttgcttggaga

SEQ ID NO: 127360 - DNA, 25 bp, Homo sapien
gccctgcccagaacaagtgcagatg

SEQ ID NO: 127361 - DNA, 25 bp, Homo sapien
agtgcagatgactaggtttgggccc

SEQ ID NO: 127362 - DNA, 25 bp, Homo sapien
ctcggctcggagtcgaaatggatga

SEQ ID NO: 127363 - DNA, 25 bp, Homo sapien
tgccgcactcgctcagcgcagcttc

SEQ ID NO: 127364 - DNA, 25 bp, Homo sapien
ccgcggcactccacgttgtccagca

SEQ ID NO: 127365 - DNA, 25 bp, Homo sapien
cagctggcgacacactacgttggcg

SEQ ID NO: 127366 - DNA, 25 bp, Homo sapien
ggcgacacactacgttggcgtccac

SEQ ID NO: 127367 - DNA, 25 bp, Homo sapien
ttggcgtccaccacgtcccagtcgt

SEQ ID NO: 127368 - DNA, 25 bp, Homo sapien
gtcccagtcgtcatcacagacgctg

SEQ ID NO: 127369 - DNA, 25 bp, Homo sapien
caggagccaccgtgcatgacttcca

SEQ ID NO: 127370 - DNA, 25 bp, Homo sapien
agccaccgtgcatgacttccaggcg

SEQ ID NO: 127371 - DNA, 25 bp, Homo sapien
gccgagtttcactctggctgccttc

SEQ ID NO: 127372 - DNA, 25 bp, Homo sapien
tctccgggatcaaggtcctgagggc

SEQ ID NO: 127373 - DNA, 25 bp, Homo sapien
atcggtctccgggatcaaggtcctg

SEQ ID NO: 127374 - DNA, 25 bp, Homo sapien
tggctgccttctcctgagagtcgga

SEQ ID NO: 127375 - DNA, 25 bp, Homo sapien
ctgcgacgccgagtttcactctggc

SEQ ID NO: 127376 - DNA, 25 bp, Homo sapien
ctcggaagctgcgacgccgagtttc

SEQ ID NO: 127377 - DNA, 25 bp, Homo sapien
gtgcgccttgggttgagcccttccc

SEQ ID NO: 127378 - DNA, 25 bp, Homo sapien
ccttctcctgagagtcggagccaca

SEQ ID NO: 127379 - DNA, 25 bp, Homo sapien
gggtcggttcctcactcaatgtgcg

SEQ ID NO: 127380 - DNA, 25 bp, Homo sapien
ggctctgtgcctggcgctgagctct

SEQ ID NO: 127381 - DNA, 25 bp, Homo sapien
tttgcccgacggagctcggggctct

SEQ ID NO: 127382 - DNA, 25 bp, Homo sapien
tcttctgcatcctccatggctcctg

SEQ ID NO: 127383 - DNA, 25 bp, Homo sapien
gctgctgtttctgctcttctgcatc

SEQ ID NO: 127384 - DNA, 25 bp, Homo sapien
tgactcttccgcgcagcctcagaag

SEQ ID NO: 127385 - DNA, 25 bp, Homo sapien
cctcactcaatgtgcgcggggatgc

SEQ ID NO: 127386 - DNA, 25 bp, Homo sapien
agcggctgtctgactcttccgcgca

SEQ ID NO: 127387 - DNA, 25 bp, Homo sapien
tgcgctcccggaccttctaatgtga

SEQ ID NO: 127388 - DNA, 25 bp, Homo sapien
tgaaggtcaggactctaggcctccc

SEQ ID NO: 127389 - DNA, 25 bp, Homo sapien
tccctccgccaagccagagggatga

SEQ ID NO: 127390 - DNA, 25 bp, Homo sapien
agcaatcacgcctgagagcccactg

SEQ ID NO: 127391 - DNA, 25 bp, Homo sapien
gccgcagcggttttctagatggaga

SEQ ID NO: 127392 - DNA, 25 bp, Homo sapien
tctaatgtgaccacggctcccggca

SEQ ID NO: 127393 - DNA, 25 bp, Homo sapien
ccagtgtgcatgctcgctgctattc

SEQ ID NO: 127394 - DNA, 25 bp, Homo sapien
cctccgaggcggtagcagatgccac

SEQ ID NO: 127395 - DNA, 25 bp, Homo sapien
cacaataactaagttcagttagata

SEQ ID NO: 127396 - DNA, 25 bp, Homo sapien
agattattaggtgccacaataacta

SEQ ID NO: 127397 - DNA, 25 bp, Homo sapien
attaggtgccacaataactaagttc

SEQ ID NO: 127398 - DNA, 25 bp, Homo sapien
ttaggtgccacaataactaagttca

SEQ ID NO: 127399 - DNA, 25 bp, Homo sapien
taggtgccacaataactaagttcag

SEQ ID NO: 127400 - DNA, 25 bp, Homo sapien
ggtgccacaataactaagttcagtt

SEQ ID NO: 127401 - DNA, 25 bp, Homo sapien
gtgccacaataactaagttcagtta

SEQ ID NO: 127402 - DNA, 25 bp, Homo sapien
gccacaataactaagttcagttaga

SEQ ID NO: 127403 - DNA, 25 bp, Homo sapien
tcgctttgtaaggagctccgacctc

SEQ ID NO: 127404 - DNA, 25 bp, Homo sapien
cgggaccgtcgaagctcagacaact

SEQ ID NO: 127405 - DNA, 25 bp, Homo sapien
ggtacacagagaagcggctcccgtc

SEQ ID NO: 127406 - DNA, 25 bp, Homo sapien
tgccctaactagctggcgccgagga

SEQ ID NO: 127407 - DNA, 25 bp, Homo sapien
cccgcagtgttcgagcaataccaga

SEQ ID NO: 127408 - DNA, 25 bp, Homo sapien
aggccaggacccagttcgtgcagat

SEQ ID NO: 127409 - DNA, 25 bp, Homo sapien
taccacggcaatctggggtcgcttt

SEQ ID NO: 127410 - DNA, 25 bp, Homo sapien
gggctgcaatttactcgtctggctg

SEQ ID NO: 127411 - DNA, 25 bp, Homo sapien
gcgcgtctcgaagtcgtccttcatg

SEQ ID NO: 127412 - DNA, 25 bp, Homo sapien
ccacacaagccgcagaggggatcct

SEQ ID NO: 127413 - DNA, 25 bp, Homo sapien
tcatgttcccgttgaagttgccaca

SEQ ID NO: 127414 - DNA, 25 bp, Homo sapien
ccgtgtagtttctgtccgccagcac

SEQ ID NO: 127415 - DNA, 25 bp, Homo sapien
gagttcaccaactccagctcgctgg

SEQ ID NO: 127416 - DNA, 25 bp, Homo sapien
gatgtccacgacaaggctcagcgca

SEQ ID NO: 127417 - DNA, 25 bp, Homo sapien
ccagatgagcgtcaggttgtacctc

SEQ ID NO: 127418 - DNA, 25 bp, Homo sapien
aggatggtcatgtgcctgttccaga

SEQ ID NO: 127419 - DNA, 25 bp, Homo sapien
agggacctcagtctccgatccgggc

SEQ ID NO: 127420 - DNA, 25 bp, Homo sapien
ggggtggatagtatcagacacaatg

SEQ ID NO: 127421 - DNA, 25 bp, Homo sapien
tgtacggcctggcttggcaagccca

SEQ ID NO: 127422 - DNA, 25 bp, Homo sapien
tgcagtgtccactccttcagagttc

SEQ ID NO: 127423 - DNA, 25 bp, Homo sapien
tcgtcgtacttcacctgcaggccgt

SEQ ID NO: 127424 - DNA, 25 bp, Homo sapien
agatcctcgtcgtacttcacctgca

SEQ ID NO: 127425 - DNA, 25 bp, Homo sapien
agacacaatggccatctcctccaga

SEQ ID NO: 127426 - DNA, 25 bp, Homo sapien
cacagtcggacctgacggagacaga

SEQ ID NO: 127427 - DNA, 25 bp, Homo sapien
tctcgcaaatgtggggacaaactgt

SEQ ID NO: 127428 - DNA, 25 bp, Homo sapien
caaactgttccaccgttaggtatag

SEQ ID NO: 127429 - DNA, 25 bp, Homo sapien
ggtggtcacggattctttctcaaaa

SEQ ID NO: 127430 - DNA, 25 bp, Homo sapien
tttctcaaaacgtgaagcttccagg

SEQ ID NO: 127431 - DNA, 25 bp, Homo sapien
aggagcactcctgtcttggcaaagc

SEQ ID NO: 127432 - DNA, 25 bp, Homo sapien
gcgaagagccatcgcccggacacga

SEQ ID NO: 127433 - DNA, 25 bp, Homo sapien
cctgagccacggacacggttcaaca

SEQ ID NO: 127434 - DNA, 25 bp, Homo sapien
gagcacgtccttcccgaggtcgaag

SEQ ID NO: 127435 - DNA, 25 bp, Homo sapien
ttctcgaagtgtccggtcgcttctc

SEQ ID NO: 127436 - DNA, 25 bp, Homo sapien
tttcagcagccgcactcctagcaga

SEQ ID NO: 127437 - DNA, 25 bp, Homo sapien
gtaaactcaggtgtcctcctccgta

SEQ ID NO: 127438 - DNA, 25 bp, Homo sapien
gaaagaacctcgacactggcaccga

SEQ ID NO: 127439 - DNA, 25 bp, Homo sapien
ctgcccgcggcctacggggatttat

SEQ ID NO: 127440 - DNA, 25 bp, Homo sapien
cagcagatggaagagacgtaaactc

SEQ ID NO: 127441 - DNA, 25 bp, Homo sapien
agcagacagccggactcccagcaga

SEQ ID NO: 127442 - DNA, 25 bp, Homo sapien
agcaagcagccggactttcagcagc

SEQ ID NO: 127443 - DNA, 25 bp, Homo sapien
atcagaatcctactctgacccacta

SEQ ID NO: 127444 - DNA, 25 bp, Homo sapien
acagaccgtgacttgtagtcccagc

SEQ ID NO: 127445 - DNA, 25 bp, Homo sapien
gtaggcggtgagaccgcaaattcca

SEQ ID NO: 127446 - DNA, 25 bp, Homo sapien
gtgcgggactcctgaaaactgcttt

SEQ ID NO: 127447 - DNA, 25 bp, Homo sapien
cctggactccacagaccgtgacttg

SEQ ID NO: 127448 - DNA, 25 bp, Homo sapien
cgaacgtggcggtgacactactaca

SEQ ID NO: 127449 - DNA, 25 bp, Homo sapien
ggcggtgacactactacagctccca

SEQ ID NO: 127450 - DNA, 25 bp, Homo sapien
actgcttttcctccctagtaggcgg

SEQ ID NO: 127451 - DNA, 25 bp, Homo sapien
gccatgaagagtcctgaccacaatg

SEQ ID NO: 127452 - DNA, 25 bp, Homo sapien
ctgaggaaattcatccagagggtcc

SEQ ID NO: 127453 - DNA, 25 bp, Homo sapien
accacaatggggaggacaacttcgc

SEQ ID NO: 127454 - DNA, 25 bp, Homo sapien
aacttcgcccgggacttcatggtga

SEQ ID NO: 127455 - DNA, 25 bp, Homo sapien
cctcgctgtcgcgttttcttgccgg

SEQ ID NO: 127456 - DNA, 25 bp, Homo sapien
ggccgccagtgctttgtgtacctct

SEQ ID NO: 127457 - DNA, 25 bp, Homo sapien
gtggctcgcgaccacctattgttta

SEQ ID NO: 127458 - DNA, 25 bp, Homo sapien
agcaagtggagatcctgaggaaatt

SEQ ID NO: 127459 - DNA, 25 bp, Homo sapien
gctaacgccaagtcgcgcagaccta

SEQ ID NO: 127460 - DNA, 25 bp, Homo sapien
tccgggttctctgtccgccaagaag

SEQ ID NO: 127461 - DNA, 25 bp, Homo sapien
accgtttggcaagctgcaactctcc

SEQ ID NO: 127462 - DNA, 25 bp, Homo sapien
atccctcagcgtggcttgcccaatg

SEQ ID NO: 127463 - DNA, 25 bp, Homo sapien
ttggctcttaggtggatccctcagc

SEQ ID NO: 127464 - DNA, 25 bp, Homo sapien
ccttcgtctgatgtttgtgcctttg

SEQ ID NO: 127465 - DNA, 25 bp, Homo sapien
ttcacgccagcgacagtggaaagcc

SEQ ID NO: 127466 - DNA, 25 bp, Homo sapien
gagacgatcgctacctcggccatgg

SEQ ID NO: 127467 - DNA, 25 bp, Homo sapien
aaacgactgcggtagaggatctctc

SEQ ID NO: 127468 - DNA, 25 bp, Homo sapien
ggatctctcagttctacctcagtgc

SEQ ID NO: 127469 - DNA, 25 bp, Homo sapien
cctataggtagagaggacgccaatc

SEQ ID NO: 127470 - DNA, 25 bp, Homo sapien
tccgcggtaattggaccatttgtcc

SEQ ID NO: 127471 - DNA, 25 bp, Homo sapien
ttgtccgccagtgcaaaccaaccga

SEQ ID NO: 127472 - DNA, 25 bp, Homo sapien
gcctctctactgtcacgggttagta

SEQ ID NO: 127473 - DNA, 25 bp, Homo sapien
ctcctacggtaagagcggcatcacc

SEQ ID NO: 127474 - DNA, 25 bp, Homo sapien
ccattgggcccacagatgttaatca

SEQ ID NO: 127475 - DNA, 25 bp, Homo sapien
cacacgggttcaggtggtggtccct

SEQ ID NO: 127476 - DNA, 25 bp, Homo sapien
atgaggggatcctgaggatcccgca

SEQ ID NO: 127477 - DNA, 25 bp, Homo sapien
gttacacctcccacggagacgtcta

SEQ ID NO: 127478 - DNA, 25 bp, Homo sapien
gatgacgttacacctcccacggaga

SEQ ID NO: 127479 - DNA, 25 bp, Homo sapien
ggcaatcgggatgacgttacacctc

SEQ ID NO: 127480 - DNA, 25 bp, Homo sapien
aggtcacctcgccttggagacagcc

SEQ ID NO: 127481 - DNA, 25 bp, Homo sapien
aagcgcgggatgacttctgggaacc

SEQ ID NO: 127482 - DNA, 25 bp, Homo sapien
atcccgcaggtagacgtagagcagc

SEQ ID NO: 127483 - DNA, 25 bp, Homo sapien
tgcgctcctagcaccgcgccttctt

SEQ ID NO: 127484 - DNA, 25 bp, Homo sapien
ccagcactagactgcgctcctagca

SEQ ID NO: 127485 - DNA, 25 bp, Homo sapien
accgcgccttcttccggagcctcct

SEQ ID NO: 127486 - DNA, 25 bp, Homo sapien
agcgcaggggttagtcagtacgcac

SEQ ID NO: 127487 - DNA, 25 bp, Homo sapien
caggggttagtcagtacgcacgtga

SEQ ID NO: 127488 - DNA, 25 bp, Homo sapien
ttagtcagtacgcacgtgacgcgcg

SEQ ID NO: 127489 - DNA, 25 bp, Homo sapien
tcagtacgcacgtgacgcgcgatgc

SEQ ID NO: 127490 - DNA, 25 bp, Homo sapien
agtacgcacgtgacgcgcgatgccc

SEQ ID NO: 127491 - DNA, 25 bp, Homo sapien
cccttcttttcttcgccagcggtgg

SEQ ID NO: 127492 - DNA, 25 bp, Homo sapien
cgatgcccacatgacacgaccgtga

SEQ ID NO: 127493 - DNA, 25 bp, Homo sapien
tcacggatccctaagggacagctgg

SEQ ID NO: 127494 - DNA, 25 bp, Homo sapien
agcgcccaaagcaatttgtcccttc

SEQ ID NO: 127495 - DNA, 25 bp, Homo sapien
ccagcggtggctcacggatccctaa

SEQ ID NO: 127496 - DNA, 25 bp, Homo sapien
gaagacccgtcaaagcgcccaaagc

SEQ ID NO: 127497 - DNA, 25 bp, Homo sapien
agttacagaagacccgtcaaagcgc

SEQ ID NO: 127498 - DNA, 25 bp, Homo sapien
cccagaaacgctggacgcagttctc

SEQ ID NO: 127499 - DNA, 25 bp, Homo sapien
gtatcgcacgttagctagcatcagg

SEQ ID NO: 127500 - DNA, 25 bp, Homo sapien
ttagctagcatcaggctctgagcgc

SEQ ID NO: 127501 - DNA, 25 bp, Homo sapien
tagctagcatcaggctccgagcgcc

SEQ ID NO: 127502 - DNA, 25 bp, Homo sapien
cacgttagctagcatcaggctccga

SEQ ID NO: 127503 - DNA, 25 bp, Homo sapien
ttagctagcatcaggctccgagcgc

SEQ ID NO: 127504 - DNA, 25 bp, Homo sapien
gcacgttagctagcatcaggctccg

SEQ ID NO: 127505 - DNA, 25 bp, Homo sapien
cacgttagctagcatcaggctctga

SEQ ID NO: 127506 - DNA, 25 bp, Homo sapien
tagctagcatcaggctctgagcgcc

SEQ ID NO: 127507 - DNA, 25 bp, Homo sapien
tccttgcagtgtttgatcacggcca

SEQ ID NO: 127508 - DNA, 25 bp, Homo sapien
gcagtgtttgatcacggccagcacg

SEQ ID NO: 127509 - DNA, 25 bp, Homo sapien
agtgtttgatcacggccagcacgtc

SEQ ID NO: 127510 - DNA, 25 bp, Homo sapien
ttgcagtgtttgatcacggccagca

SEQ ID NO: 127511 - DNA, 25 bp, Homo sapien
tgatcacggccagcacgtccctgat

SEQ ID NO: 127512 - DNA, 25 bp, Homo sapien
atcacggccagcacgtccctgatgg

SEQ ID NO: 127513 - DNA, 25 bp, Homo sapien
acgtccctgatggtgagccccgcca

SEQ ID NO: 127514 - DNA, 25 bp, Homo sapien
tttgatcacggccagcacgtccctg

SEQ ID NO: 127515 - DNA, 25 bp, Homo sapien
tgcttgacacacttgagccggaggg

SEQ ID NO: 127516 - DNA, 25 bp, Homo sapien
accgcccggcaaaacactgagcaag

SEQ ID NO: 127517 - DNA, 25 bp, Homo sapien
ggcaaaacactgagcaagccgctgc

SEQ ID NO: 127518 - DNA, 25 bp, Homo sapien
ccttgcttgacacacttgagccgga

SEQ ID NO: 127519 - DNA, 25 bp, Homo sapien
cggcgaaactcacttgcactgcggg

SEQ ID NO: 127520 - DNA, 25 bp, Homo sapien
ctcacttgcactgcgggtgctctct

SEQ ID NO: 127521 - DNA, 25 bp, Homo sapien
gcgcggccaccctttcattgccctg

SEQ ID NO: 127522 - DNA, 25 bp, Homo sapien
gctctcaccttgcttgacacacttg

SEQ ID NO: 127523 - DNA, 25 bp, Homo sapien
tgggtgtgtgttgttagctgatatc

SEQ ID NO: 127524 - DNA, 25 bp, Homo sapien
ctagttctactgtactggcagacgg

SEQ ID NO: 127525 - DNA, 25 bp, Homo sapien
agcccagtgcggacctttcttcagc

SEQ ID NO: 127526 - DNA, 25 bp, Homo sapien
cctgggctccgatggagcagaaata

SEQ ID NO: 127527 - DNA, 25 bp, Homo sapien
tcactgtgtagagaggtttcatgtc

SEQ ID NO: 127528 - DNA, 25 bp, Homo sapien
tctcgaaattccctcttagagaagg

SEQ ID NO: 127529 - DNA, 25 bp, Homo sapien
actggaggctgcgtaccctgattac

SEQ ID NO: 127530 - DNA, 25 bp, Homo sapien
tgatatccatggcagctgcagtggc

SEQ ID NO: 127531 - DNA, 25 bp, Homo sapien
gcacagctccctccgtgtgagtaaa

SEQ ID NO: 127532 - DNA, 25 bp, Homo sapien
aagcagagcctggtcgtgaggaaca

SEQ ID NO: 127533 - DNA, 25 bp, Homo sapien
ccctcgactccgcttaggaagtggt

SEQ ID NO: 127534 - DNA, 25 bp, Homo sapien
gcccgctaggagagagaaaggattc

SEQ ID NO: 127535 - DNA, 25 bp, Homo sapien
ggcaggctctcgctttcggcaccat

SEQ ID NO: 127536 - DNA, 25 bp, Homo sapien
tgatcgaccgcaacctccgtgagga

SEQ ID NO: 127537 - DNA, 25 bp, Homo sapien
gagtgcagcggccactgtacccaga

SEQ ID NO: 127538 - DNA, 25 bp, Homo sapien
ggcgcgtcacttcactcggatgctt

SEQ ID NO: 127539 - DNA, 25 bp, Homo sapien
cgctccacggtttttgttgccggcg

SEQ ID NO: 127540 - DNA, 25 bp, Homo sapien
acctcggagtgaatggaaagtggcc

SEQ ID NO: 127541 - DNA, 25 bp, Homo sapien
cggctggccagacgcaagaatgcgc

SEQ ID NO: 127542 - DNA, 25 bp, Homo sapien
gacccttagagctcgcggctggcca

SEQ ID NO: 127543 - DNA, 25 bp, Homo sapien
ctcctttcgcagtccgcggcggagt

SEQ ID NO: 127544 - DNA, 25 bp, Homo sapien
tgagcaacttgctgggtgcgctcca

SEQ ID NO: 127545 - DNA, 25 bp, Homo sapien
gcgtcgctcaatcaagcacctcgga

SEQ ID NO: 127546 - DNA, 25 bp, Homo sapien
agcgctcttggtgtccgattacagc

SEQ ID NO: 127547 - DNA, 25 bp, Homo sapien
accacatgtgccctctgctcgggga

SEQ ID NO: 127548 - DNA, 25 bp, Homo sapien
ctttctcctctctgcaccgcccaga

SEQ ID NO: 127549 - DNA, 25 bp, Homo sapien
ccgcccagacccgtgcgtggcaccc

SEQ ID NO: 127550 - DNA, 25 bp, Homo sapien
ttcctgcctggcagtgcaaaggagc

SEQ ID NO: 127551 - DNA, 25 bp, Homo sapien
gcttcctttccgctgcccgcctttc

SEQ ID NO: 127552 - DNA, 25 bp, Homo sapien
cacccacaccgtcgctgctttgctc

SEQ ID NO: 127553 - DNA, 25 bp, Homo sapien
tcggggaccgctgttgacccgacag

SEQ ID NO: 127554 - DNA, 25 bp, Homo sapien
gataacacggagcacggcgaggtca

SEQ ID NO: 127555 - DNA, 25 bp, Homo sapien
ccatgtagaggcctgggaggcttct

SEQ ID NO: 127556 - DNA, 25 bp, Homo sapien
accagctagcaacgacccatgtaga

SEQ ID NO: 127557 - DNA, 25 bp, Homo sapien
ggacactgtcgagcctcaccagcta

SEQ ID NO: 127558 - DNA, 25 bp, Homo sapien
acactgcggcagttcccggtaacca

SEQ ID NO: 127559 - DNA, 25 bp, Homo sapien
ccgacaaagtggttcctcaaagcaa

SEQ ID NO: 127560 - DNA, 25 bp, Homo sapien
ttgttccaaaaataggcgcgtccga

SEQ ID NO: 127561 - DNA, 25 bp, Homo sapien
ataggcgcgtccgacttcgttcccg

SEQ ID NO: 127562 - DNA, 25 bp, Homo sapien
tccggctctgcaccatctgacggtg

SEQ ID NO: 127563 - DNA, 25 bp, Homo sapien
ctctgaagtctagagaatcccgtta

SEQ ID NO: 127564 - DNA, 25 bp, Homo sapien
tccgccgccatcaagggcgactttg

SEQ ID NO: 127565 - DNA, 25 bp, Homo sapien
gacccactagcgtgcgtcggctgct

SEQ ID NO: 127566 - DNA, 25 bp, Homo sapien
aagtgtcagagtcaaggccagcagg

SEQ ID NO: 127567 - DNA, 25 bp, Homo sapien
cgccgacttacgtgacggccgaagg

SEQ ID NO: 127568 - DNA, 25 bp, Homo sapien
ctttggaaacagacctcggcgagcc

SEQ ID NO: 127569 - DNA, 25 bp, Homo sapien
tcccgttagagacgggctgagacgc

SEQ ID NO: 127570 - DNA, 25 bp, Homo sapien
cagtacggctgcactctgaagtcta

SEQ ID NO: 127571 - DNA, 25 bp, Homo sapien
tcttcgctcagctggctcaaatccg

SEQ ID NO: 127572 - DNA, 25 bp, Homo sapien
ctcgttgcccatggctcagggagac

SEQ ID NO: 127573 - DNA, 25 bp, Homo sapien
gttagtcccgctcgcaggtaacgcc

SEQ ID NO: 127574 - DNA, 25 bp, Homo sapien
ctcgctctcagcaccgatttaaagg

SEQ ID NO: 127575 - DNA, 25 bp, Homo sapien
cctccatgttggacagcgccaggca

SEQ ID NO: 127576 - DNA, 25 bp, Homo sapien
gaagcagatctgagcggtgccagcc

SEQ ID NO: 127577 - DNA, 25 bp, Homo sapien
gcgcctctcggaacaggtgatgccc

SEQ ID NO: 127578 - DNA, 25 bp, Homo sapien
cccttgacatgacagcggcgatctg

SEQ ID NO: 127579 - DNA, 25 bp, Homo sapien
gacgagagatgtccccgcaactggg

SEQ ID NO: 127580 - DNA, 25 bp, Homo sapien
cgcaactgggacttgctctcagcga

SEQ ID NO: 127581 - DNA, 25 bp, Homo sapien
actgggacttgctctcagcgaggtg

SEQ ID NO: 127582 - DNA, 25 bp, Homo sapien
acggcagctgtttgcgccgcctatg

SEQ ID NO: 127583 - DNA, 25 bp, Homo sapien
cgcctatgctgccaattccctgggg

SEQ ID NO: 127584 - DNA, 25 bp, Homo sapien
atgctgccaattccctggggcgtaa

SEQ ID NO: 127585 - DNA, 25 bp, Homo sapien
tgccaattccctggggcgtaaggtg

SEQ ID NO: 127586 - DNA, 25 bp, Homo sapien
ccgatgcgacggcagctgtttgcgc

SEQ ID NO: 127587 - DNA, 25 bp, Homo sapien
gtgagcagacgtccaggcttcccga

SEQ ID NO: 127588 - DNA, 25 bp, Homo sapien
tccagtgagcagacgtccaggcttc

SEQ ID NO: 127589 - DNA, 25 bp, Homo sapien
ccagtgagcagacgtccaggcttcc

SEQ ID NO: 127590 - DNA, 25 bp, Homo sapien
cagtgagcagacgtccaggcttccc

SEQ ID NO: 127591 - DNA, 25 bp, Homo sapien
ctccagtgagcagacgtccaggctt

SEQ ID NO: 127592 - DNA, 25 bp, Homo sapien
agtgagcagacgtccaggcttcccg

SEQ ID NO: 127593 - DNA, 25 bp, Homo sapien
tgagcagacgtccaggcttcccgaa

SEQ ID NO: 127594 - DNA, 25 bp, Homo sapien
gagcagacgtccaggcttcccgaag

SEQ ID NO: 127595 - DNA, 25 bp, Homo sapien
ggcgctcttctgatgcgggaaccag

SEQ ID NO: 127596 - DNA, 25 bp, Homo sapien
ctgatgcgggaaccagggccactca

SEQ ID NO: 127597 - DNA, 25 bp, Homo sapien
ccaactgataagacggtctgggagc

SEQ ID NO: 127598 - DNA, 25 bp, Homo sapien
caagtttggctacagcacgcgcggc

SEQ ID NO: 127599 - DNA, 25 bp, Homo sapien
cgcagacctccaggggtgacttcgt

SEQ ID NO: 127600 - DNA, 25 bp, Homo sapien
tgacttcgtcgctccctagtctgga

SEQ ID NO: 127601 - DNA, 25 bp, Homo sapien
ctagtctggactcgctaggtcccgg

SEQ ID NO: 127602 - DNA, 25 bp, Homo sapien
cccacagtcggtgagtatccagggc

SEQ ID NO: 127603 - DNA, 25 bp, Homo sapien
gcacgagtcaaatccggcctttcca

SEQ ID NO: 127604 - DNA, 25 bp, Homo sapien
cccaggaggttgaactcgagtcatc

SEQ ID NO: 127605 - DNA, 25 bp, Homo sapien
ccagggtagcccattaacgcattaa

SEQ ID NO: 127606 - DNA, 25 bp, Homo sapien
gccgcgattactgcgcaccgatttc

SEQ ID NO: 127607 - DNA, 25 bp, Homo sapien
cgtctcaggaggaaaactttgtgca

SEQ ID NO: 127608 - DNA, 25 bp, Homo sapien
gccggggacacattcatagacgctc

SEQ ID NO: 127609 - DNA, 25 bp, Homo sapien
tggggaccgcactcctggttaaatg

SEQ ID NO: 127610 - DNA, 25 bp, Homo sapien
cggatgttcccgactaaagcgtctc

SEQ ID NO: 127611 - DNA, 25 bp, Homo sapien
catggctgagatcttgcgcttcttc

SEQ ID NO: 127612 - DNA, 25 bp, Homo sapien
tgattactttgccaggaccgtgccc

SEQ ID NO: 127613 - DNA, 25 bp, Homo sapien
gcgcttcttcaactggacctacgtg

SEQ ID NO: 127614 - DNA, 25 bp, Homo sapien
ccgcaagtcctacgacagcgtgatc

SEQ ID NO: 127615 - DNA, 25 bp, Homo sapien
agcgtgatccgagaactgttgcaga

SEQ ID NO: 127616 - DNA, 25 bp, Homo sapien
agagcatcatcaagggcagcgagca

SEQ ID NO: 127617 - DNA, 25 bp, Homo sapien
ccagcgccaaactcagtgataagtc

SEQ ID NO: 127618 - DNA, 25 bp, Homo sapien
tacgtgtccacagtagcctccgagg

SEQ ID NO: 127619 - DNA, 25 bp, Homo sapien
cccgctgacagctctgctgcgctcg

SEQ ID NO: 127620 - DNA, 25 bp, Homo sapien
ctccgtcacccgctgcccgtccgcc

SEQ ID NO: 127621 - DNA, 25 bp, Homo sapien
cagccagcgccgatgctcccgtcac

SEQ ID NO: 127622 - DNA, 25 bp, Homo sapien
cgatgctcccgtcacgccggaggga

SEQ ID NO: 127623 - DNA, 25 bp, Homo sapien
tcgcctcgcgctagagggcgagaga

SEQ ID NO: 127624 - DNA, 25 bp, Homo sapien
ggaccccgtggagtagcctgtctca

SEQ ID NO: 127625 - DNA, 25 bp, Homo sapien
cccgtggagtagcctgtctcaggtc

SEQ ID NO: 127626 - DNA, 25 bp, Homo sapien
ggccgcgactgctgtgcgctcgtct

SEQ ID NO: 127627 - DNA, 25 bp, Homo sapien
gcgcgccgacacagccggaagtgac

SEQ ID NO: 127628 - DNA, 25 bp, Homo sapien
cggaagtgacgcgtacagccagcac

SEQ ID NO: 127629 - DNA, 25 bp, Homo sapien
taagtgcgatggaaccttcaggttc

SEQ ID NO: 127630 - DNA, 25 bp, Homo sapien
cccaaaacaggaagtaagtgcgatg

SEQ ID NO: 127631 - DNA, 25 bp, Homo sapien
tcctggttcttccaaagtgcccgga

SEQ ID NO: 127632 - DNA, 25 bp, Homo sapien
cctggtattttttggagcttccatc

SEQ ID NO: 127633 - DNA, 25 bp, Homo sapien
ggctgcttcctccatcctggtattt

SEQ ID NO: 127634 - DNA, 25 bp, Homo sapien
gccttcctgacgttgcagctgccgt

SEQ ID NO: 127635 - DNA, 25 bp, Homo sapien
acaaacactgcgtggcagactctca

SEQ ID NO: 127636 - DNA, 25 bp, Homo sapien
ccggctagcacagcaaatcgcagtc

SEQ ID NO: 127637 - DNA, 25 bp, Homo sapien
ggtaagcacgtattccttcatgttc

SEQ ID NO: 127638 - DNA, 25 bp, Homo sapien
gggccgacccaagcaacttggattc

SEQ ID NO: 127639 - DNA, 25 bp, Homo sapien
acttggattccctctcatgtgttgc

SEQ ID NO: 127640 - DNA, 25 bp, Homo sapien
cgctctctgccggaactgcagcagg

SEQ ID NO: 127641 - DNA, 25 bp, Homo sapien
ctgcagcaggagtacggtctaggca

SEQ ID NO: 127642 - DNA, 25 bp, Homo sapien
aaatctcagcccttggcgccgcgtg

SEQ ID NO: 127643 - DNA, 25 bp, Homo sapien
cgcggctccatcgttttccagttaa

SEQ ID NO: 127644 - DNA, 25 bp, Homo sapien
cggggcagcgagacaaaggccaaaa

SEQ ID NO: 127645 - DNA, 25 bp, Homo sapien
caggcctttgttgccggagcctcgt

SEQ ID NO: 127646 - DNA, 25 bp, Homo sapien
tggtctttgtttaccaggctccgag

SEQ ID NO: 127647 - DNA, 25 bp, Homo sapien
cgacagtttcacatccagggaggga

SEQ ID NO: 127648 - DNA, 25 bp, Homo sapien
acgcggccggattagctttcgcagc

SEQ ID NO: 127649 - DNA, 25 bp, Homo sapien
gcgtccatccgatttcaggcctttg

SEQ ID NO: 127650 - DNA, 25 bp, Homo sapien
gggaaaacaattaggccgcaagtgc

SEQ ID NO: 127651 - DNA, 25 bp, Homo sapien
aggcccgcagcccagaatagagccg

SEQ ID NO: 127652 - DNA, 25 bp, Homo sapien
ggaccctcgcggctttctatccaat

SEQ ID NO: 127653 - DNA, 25 bp, Homo sapien
ttgcagctgtccgtccagtcccgtt

SEQ ID NO: 127654 - DNA, 25 bp, Homo sapien
agggtcgggtcccactaccgcgcag

SEQ ID NO: 127655 - DNA, 25 bp, Homo sapien
ttcagtccaattcccgcacctttga

SEQ ID NO: 127656 - DNA, 25 bp, Homo sapien
ccactggagacagggtcgggtccca

SEQ ID NO: 127657 - DNA, 25 bp, Homo sapien
gaccctagcggccttcagtccaatt

SEQ ID NO: 127658 - DNA, 25 bp, Homo sapien
gcccagaatagagccggggcccaag

SEQ ID NO: 127659 - DNA, 25 bp, Homo sapien
gcctcaagatccatctcagcctgag

SEQ ID NO: 127660 - DNA, 25 bp, Homo sapien
gaaaccacagcctcagaaccaagta

SEQ ID NO: 127661 - DNA, 25 bp, Homo sapien
aagaccgagatcaggctggagcctc

SEQ ID NO: 127662 - DNA, 25 bp, Homo sapien
gaaacgcctaccgttgcagccaggg

SEQ ID NO: 127663 - DNA, 25 bp, Homo sapien
tcgcaggataagaccgagatcaggc

SEQ ID NO: 127664 - DNA, 25 bp, Homo sapien
gaaccagcccggtcgcaggataaga

SEQ ID NO: 127665 - DNA, 25 bp, Homo sapien
gcgccaggctgttccgttctttgcc

SEQ ID NO: 127666 - DNA, 25 bp, Homo sapien
tgttccgttctttgccgcctcaaga

SEQ ID NO: 127667 - DNA, 25 bp, Homo sapien
agcatctccacgaaggcagagttgg

SEQ ID NO: 127668 - DNA, 25 bp, Homo sapien
cccgtcgaagccagagagcagtaag

SEQ ID NO: 127669 - DNA, 25 bp, Homo sapien
tgctctggccgcgatgggcactgca

SEQ ID NO: 127670 - DNA, 25 bp, Homo sapien
gtgcgcggggtctccagcatctcca

SEQ ID NO: 127671 - DNA, 25 bp, Homo sapien
gttctggactttgcccgccgccagt

SEQ ID NO: 127672 - DNA, 25 bp, Homo sapien
gctccgggcaacatggtccagtgcc

SEQ ID NO: 127673 - DNA, 25 bp, Homo sapien
gtccagtgccactacggtttgggcg

SEQ ID NO: 127674 - DNA, 25 bp, Homo sapien
gcactgcaggggctttcctgtgcgc

SEQ ID NO: 127675 - DNA, 25 bp, Homo sapien
agcggcctctgcttctttgagcttg

SEQ ID NO: 127676 - DNA, 25 bp, Homo sapien
ttcctgtggcaaagagagcgaagcg

SEQ ID NO: 127677 - DNA, 25 bp, Homo sapien
acggccaccaagacgtgaaattttg

SEQ ID NO: 127678 - DNA, 25 bp, Homo sapien
gcgctccttggaacggccaccaaga

SEQ ID NO: 127679 - DNA, 25 bp, Homo sapien
taaaggaaacgaacagcggcctctg

SEQ ID NO: 127680 - DNA, 25 bp, Homo sapien
tttgagcttggaagagccgctactc

SEQ ID NO: 127681 - DNA, 25 bp, Homo sapien
tactcgaatgagctcaggcttcctg

SEQ ID NO: 127682 - DNA, 25 bp, Homo sapien
tttggaagaagatactccgacttta

SEQ ID NO: 127683 - DNA, 25 bp, Homo sapien
agaagtactcgacgctcccggccga

SEQ ID NO: 127684 - DNA, 25 bp, Homo sapien
cggaaaatctgaccggcgcggccac

SEQ ID NO: 127685 - DNA, 25 bp, Homo sapien
atcatcaacatctgcgccatcgagg

SEQ ID NO: 127686 - DNA, 25 bp, Homo sapien
cgccatcgaggacatcggctacctg

SEQ ID NO: 127687 - DNA, 25 bp, Homo sapien
cgatgagggtcaacgagaagtactc

SEQ ID NO: 127688 - DNA, 25 bp, Homo sapien
tggcgtccaagttcctgaccaggcg

SEQ ID NO: 127689 - DNA, 25 bp, Homo sapien
atatctttaaggcaaaggcgggccg

SEQ ID NO: 127690 - DNA, 25 bp, Homo sapien
gggcggagagcgcttatatctttaa

SEQ ID NO: 127691 - DNA, 25 bp, Homo sapien
ggcttgagcccgctgctttaaaagg

SEQ ID NO: 127692 - DNA, 25 bp, Homo sapien
actagacgcgccaagaaggagattc

SEQ ID NO: 127693 - DNA, 25 bp, Homo sapien
cgcgctgctttctaggcaggcactg

SEQ ID NO: 127694 - DNA, 25 bp, Homo sapien
gcaggcactgaagctacggcagcca

SEQ ID NO: 127695 - DNA, 25 bp, Homo sapien
acggcagccacgcaaataggtatca

SEQ ID NO: 127696 - DNA, 25 bp, Homo sapien
taggtatcagccgttaaagcttggc

SEQ ID NO: 127697 - DNA, 25 bp, Homo sapien
cgggccattgtgttgctgtttatta

SEQ ID NO: 127698 - DNA, 25 bp, Homo sapien
ctgctttaaaaggtccgcgcggccg

SEQ ID NO: 127699 - DNA, 25 bp, Homo sapien
gccgcagcccactcgtttgtgcttt

SEQ ID NO: 127700 - DNA, 25 bp, Homo sapien
tcttttcttctgaccggcctctggg

SEQ ID NO: 127701 - DNA, 25 bp, Homo sapien
cccgttcagtgttttgcctaagaag

SEQ ID NO: 127702 - DNA, 25 bp, Homo sapien
gtggttccaccattgattcttcaga

SEQ ID NO: 127703 - DNA, 25 bp, Homo sapien
cggcgctaactgcatccactaggtt

SEQ ID NO: 127704 - DNA, 25 bp, Homo sapien
ccagacgtccgaccagtggaaaatt

SEQ ID NO: 127705 - DNA, 25 bp, Homo sapien
gccggcagtcctggcaaacctagaa

SEQ ID NO: 127706 - DNA, 25 bp, Homo sapien
gtttggtcaacacagagccgcgcca

SEQ ID NO: 127707 - DNA, 25 bp, Homo sapien
tgggaggcgctagaaaccacttagc

SEQ ID NO: 127708 - DNA, 25 bp, Homo sapien
aaccgcttcgtggagcgccagagca

SEQ ID NO: 127709 - DNA, 25 bp, Homo sapien
tgagggtcagggtcattattttcgc

SEQ ID NO: 127710 - DNA, 25 bp, Homo sapien
tggaagccttcggtcaaagcctgtt

SEQ ID NO: 127711 - DNA, 25 bp, Homo sapien
ggaatctttggagccctcaggcgta

SEQ ID NO: 127712 - DNA, 25 bp, Homo sapien
tgggccataccatttcccgggaatc

SEQ ID NO: 127713 - DNA, 25 bp, Homo sapien
aagttagccgtcctctgtgcctttg

SEQ ID NO: 127714 - DNA, 25 bp, Homo sapien
aagcgtccgcgaagcacaatgcagc

SEQ ID NO: 127715 - DNA, 25 bp, Homo sapien
tttcacgccgcgtatccgagaagcc

SEQ ID NO: 127716 - DNA, 25 bp, Homo sapien
gcagcatctccaaggtggcctctta

SEQ ID NO: 127717 - DNA, 25 bp, Homo sapien
gggtacgccatgctgcagactgcgc

SEQ ID NO: 127718 - DNA, 25 bp, Homo sapien
ctgcctgcgcgcttcttcgtatctt

SEQ ID NO: 127719 - DNA, 25 bp, Homo sapien
cggcgctaatgcagtgcacgactga

SEQ ID NO: 127720 - DNA, 25 bp, Homo sapien
gactgaaggtccagtggcggcctac

SEQ ID NO: 127721 - DNA, 25 bp, Homo sapien
tcgtatctttgccattacggcgcta

SEQ ID NO: 127722 - DNA, 25 bp, Homo sapien
aaggagcccgggtagccgcccagca

SEQ ID NO: 127723 - DNA, 25 bp, Homo sapien
agccacctcgtcagagcagcatgtg

SEQ ID NO: 127724 - DNA, 25 bp, Homo sapien
gaattcctgattccctggtggaccc

SEQ ID NO: 127725 - DNA, 25 bp, Homo sapien
gtagtcgctgttgccgctgagaaac

SEQ ID NO: 127726 - DNA, 25 bp, Homo sapien
ggctgctgctggatcttcacactgc

SEQ ID NO: 127727 - DNA, 25 bp, Homo sapien
tggtggaccctggaagttgtcctta

SEQ ID NO: 127728 - DNA, 25 bp, Homo sapien
agcgctttggcgctcccaaggactc

SEQ ID NO: 127729 - DNA, 25 bp, Homo sapien
tcgcctggtgaggagttgagactct

SEQ ID NO: 127730 - DNA, 25 bp, Homo sapien
taaataaatatatcgctggcccgcg

SEQ ID NO: 127731 - DNA, 25 bp, Homo sapien
tgacccagctctatcagggattatg

SEQ ID NO: 127732 - DNA, 25 bp, Homo sapien
tgcgcgcaccaaaggcttgcaggcg

SEQ ID NO: 127733 - DNA, 25 bp, Homo sapien
aaccaccgtaagttcttcagactca

SEQ ID NO: 127734 - DNA, 25 bp, Homo sapien
ggactgcgcgcaccaaaggcttgca

SEQ ID NO: 127735 - DNA, 25 bp, Homo sapien
gtaagttcttcagactcagtcgtca

SEQ ID NO: 127736 - DNA, 25 bp, Homo sapien
gcagagacgtccctcatgccgggcg

SEQ ID NO: 127737 - DNA, 25 bp, Homo sapien
gagagcagagacgtccctcatgccg

SEQ ID NO: 127738 - DNA, 25 bp, Homo sapien
ctctatcagggattatgaaaaaaca

SEQ ID NO: 127739 - DNA, 25 bp, Homo sapien
agagcgtttcctggaagccgcgcag

SEQ ID NO: 127740 - DNA, 25 bp, Homo sapien
tcctggcggctgaccgtagccaccc

SEQ ID NO: 127741 - DNA, 25 bp, Homo sapien
ccgtgtctccctgcgggatgacctg

SEQ ID NO: 127742 - DNA, 25 bp, Homo sapien
gcgctctgcaaaccgatgctgttta

SEQ ID NO: 127743 - DNA, 25 bp, Homo sapien
gacctgagagcgtttcctggaagcc

SEQ ID NO: 127744 - DNA, 25 bp, Homo sapien
gcgggatgacctgagagcgtttcct

SEQ ID NO: 127745 - DNA, 25 bp, Homo sapien
tctccctgcgggatgacctgagagc

SEQ ID NO: 127746 - DNA, 25 bp, Homo sapien
gcaaaccgatgctgtttaattaacg

SEQ ID NO: 127747 - DNA, 25 bp, Homo sapien
tgggtgagtcccttgaatcgttctc

SEQ ID NO: 127748 - DNA, 25 bp, Homo sapien
ggcagacggcatttgagaggaaact

SEQ ID NO: 127749 - DNA, 25 bp, Homo sapien
gagtcttagcctccaaggacgttcc

SEQ ID NO: 127750 - DNA, 25 bp, Homo sapien
ttgaatcgttctcactggccgtttg

SEQ ID NO: 127751 - DNA, 25 bp, Homo sapien
actggccgtttgctcctcgagtccg

SEQ ID NO: 127752 - DNA, 25 bp, Homo sapien
tgtagcgggtcgcaagccttctcgt

SEQ ID NO: 127753 - DNA, 25 bp, Homo sapien
tcgcaagccttctcgtgacctggac

SEQ ID NO: 127754 - DNA, 25 bp, Homo sapien
tgcgacttggggagtcttagcctcc

SEQ ID NO: 127755 - DNA, 25 bp, Homo sapien
tgcaaccgccagtcggaggtgcagt

SEQ ID NO: 127756 - DNA, 25 bp, Homo sapien
aagatgcagtctgcgccacgcgctg

SEQ ID NO: 127757 - DNA, 25 bp, Homo sapien
agttgagggtcaagatgcagtctgc

SEQ ID NO: 127758 - DNA, 25 bp, Homo sapien
aggtgcagtccgtaggccctggccc

SEQ ID NO: 127759 - DNA, 25 bp, Homo sapien
cgactccagtcagcgttcctcgggc

SEQ ID NO: 127760 - DNA, 25 bp, Homo sapien
agccaggcggatactcagccgctcg

SEQ ID NO: 127761 - DNA, 25 bp, Homo sapien
ctgttcgcgatccagcttgggtagg

SEQ ID NO: 127762 - DNA, 25 bp, Homo sapien
cacagcccggctcccttcacacacc

SEQ ID NO: 127763 - DNA, 25 bp, Homo sapien
caacgcgctggcttgtgttaacaac

SEQ ID NO: 127764 - DNA, 25 bp, Homo sapien
tacctaccgaggtgcatcctgcagg

SEQ ID NO: 127765 - DNA, 25 bp, Homo sapien
attttgggacctttcgcgactctag

SEQ ID NO: 127766 - DNA, 25 bp, Homo sapien
tttcgcgactctagcgactctcagg

SEQ ID NO: 127767 - DNA, 25 bp, Homo sapien
gcgcactgtaggacaggaagatccc

SEQ ID NO: 127768 - DNA, 25 bp, Homo sapien
atccggcatcaggaacaagtctagc

SEQ ID NO: 127769 - DNA, 25 bp, Homo sapien
tagcagttccagtcaaatcccggtg

SEQ ID NO: 127770 - DNA, 25 bp, Homo sapien
aacacaccgggagcctaaggcacca

SEQ ID NO: 127771 - DNA, 25 bp, Homo sapien
ccgatggactaccacgaggatgaca

SEQ ID NO: 127772 - DNA, 25 bp, Homo sapien
agcgggacgaggacgtaactatctc

SEQ ID NO: 127773 - DNA, 25 bp, Homo sapien
atgacaagcgcttccgcagggagga

SEQ ID NO: 127774 - DNA, 25 bp, Homo sapien
ctctggggctcgcagcgtcaagcag

SEQ ID NO: 127775 - DNA, 25 bp, Homo sapien
tcgggcaaccggaccctggtcagga

SEQ ID NO: 127776 - DNA, 25 bp, Homo sapien
cacaagaggccctcgggcaaccgga

SEQ ID NO: 127777 - DNA, 25 bp, Homo sapien
ctacatcctggtgtaccatcacaag

SEQ ID NO: 127778 - DNA, 25 bp, Homo sapien
gccggcgcaaggtggactacatcct

SEQ ID NO: 127779 - DNA, 25 bp, Homo sapien
gctgggaccgcgatccttttctaga

SEQ ID NO: 127780 - DNA, 25 bp, Homo sapien
gccacgcggggttcccgagacagac

SEQ ID NO: 127781 - DNA, 25 bp, Homo sapien
caagctcgctcagcggaaccgtctc

SEQ ID NO: 127782 - DNA, 25 bp, Homo sapien
cacttcccgaggcaggcgaactggg

SEQ ID NO: 127783 - DNA, 25 bp, Homo sapien
agtcgaggacctctggtcgccgtcc

SEQ ID NO: 127784 - DNA, 25 bp, Homo sapien
cccacgaggaaccagaggtttcagc

SEQ ID NO: 127785 - DNA, 25 bp, Homo sapien
cgatccttttctagaggctgagtga

SEQ ID NO: 127786 - DNA, 25 bp, Homo sapien
cctgcccacgaggaaccagaggttt

SEQ ID NO: 127787 - DNA, 25 bp, Homo sapien
gcccgagagcatcacacaacgcatg

SEQ ID NO: 127788 - DNA, 25 bp, Homo sapien
tactgtcctttgtcccacggcttct

SEQ ID NO: 127789 - DNA, 25 bp, Homo sapien
caacgcatgcgccagtccgcaggtg

SEQ ID NO: 127790 - DNA, 25 bp, Homo sapien
gatgacgtaaaaaggccgcgctgta

SEQ ID NO: 127791 - DNA, 25 bp, Homo sapien
ccgtggggtgcaaagcacagcgcat

SEQ ID NO: 127792 - DNA, 25 bp, Homo sapien
tcccacggcttctcgagattatctc

SEQ ID NO: 127793 - DNA, 25 bp, Homo sapien
gctgtactgcggcttgtgccgcttc

SEQ ID NO: 127794 - DNA, 25 bp, Homo sapien
tttaatagataaaacgccttctctc

SEQ ID NO: 127795 - DNA, 25 bp, Homo sapien
cgcagccggccgagaagatcggcaa

SEQ ID NO: 127796 - DNA, 25 bp, Homo sapien
cgcaactctgggctgagaacttctc

SEQ ID NO: 127797 - DNA, 25 bp, Homo sapien
gcgcttctctccgttacaaaggagg

SEQ ID NO: 127798 - DNA, 25 bp, Homo sapien
cccagatgtgtgacctcattgagcc

SEQ ID NO: 127799 - DNA, 25 bp, Homo sapien
actttgtcggagagtttcagtcgca

SEQ ID NO: 127800 - DNA, 25 bp, Homo sapien
tcagtcgcattggtgagtagcgcgc

SEQ ID NO: 127801 - DNA, 25 bp, Homo sapien
accagccatgcagctgccagcgggg

SEQ ID NO: 127802 - DNA, 25 bp, Homo sapien
cctcgccgttgtctgagctgtgcct

SEQ ID NO: 127803 - DNA, 25 bp, Homo sapien
gccatcgaagccaactcacagtatt

SEQ ID NO: 127804 - DNA, 25 bp, Homo sapien
ccctctagtgaaagtgcagtgttcc

SEQ ID NO: 127805 - DNA, 25 bp, Homo sapien
ccatcatcttcttgtccggctgtta

SEQ ID NO: 127806 - DNA, 25 bp, Homo sapien
acggtgcttacgtacctggtggaca

SEQ ID NO: 127807 - DNA, 25 bp, Homo sapien
gcttctcgcgcacctggattggcat

SEQ ID NO: 127808 - DNA, 25 bp, Homo sapien
cgaccaaggtgtatgggctcatgta

SEQ ID NO: 127809 - DNA, 25 bp, Homo sapien
ctcaagtgtgagaagttcccggtgc

SEQ ID NO: 127810 - DNA, 25 bp, Homo sapien
acagtattttcacctggccgcctgg

SEQ ID NO: 127811 - DNA, 25 bp, Homo sapien
gtgactaacgcgatgccgatgaaca

SEQ ID NO: 127812 - DNA, 25 bp, Homo sapien
tggcggtacttcagcccttcgcagc

SEQ ID NO: 127813 - DNA, 25 bp, Homo sapien
agcgcggggtattgaacgccaaaga

SEQ ID NO: 127814 - DNA, 25 bp, Homo sapien
cgtggggaactgtaaggcatcttat

SEQ ID NO: 127815 - DNA, 25 bp, Homo sapien
aggcatcttatagggatcctacagg

SEQ ID NO: 127816 - DNA, 25 bp, Homo sapien
gccgacgacacgtggtggaaaagta

SEQ ID NO: 127817 - DNA, 25 bp, Homo sapien
acatgcgtgttgcagtttttgataa

SEQ ID NO: 127818 - DNA, 25 bp, Homo sapien
gcgattgctgctgctaatgtgacta

SEQ ID NO: 127819 - DNA, 25 bp, Homo sapien
cttcccgtgcggctgaggacgatcc

SEQ ID NO: 127820 - DNA, 25 bp, Homo sapien
cgccacctgtgagccgttgatgtgc

SEQ ID NO: 127821 - DNA, 25 bp, Homo sapien
agcgccggaccgaatcggctctcta

SEQ ID NO: 127822 - DNA, 25 bp, Homo sapien
ctctacggcgggatcctcgctggta

SEQ ID NO: 127823 - DNA, 25 bp, Homo sapien
atcggctctctaggccgtggagctt

SEQ ID NO: 127824 - DNA, 25 bp, Homo sapien
cggctgcgcggacagacgttccagc

SEQ ID NO: 127825 - DNA, 25 bp, Homo sapien
tgagcgcggagactgcttccacttc

SEQ ID NO: 127826 - DNA, 25 bp, Homo sapien
cctcgccgtgtgtttacgtggagac

SEQ ID NO: 127827 - DNA, 25 bp, Homo sapien
acacaaggcaatggcgggtgctaca

SEQ ID NO: 127828 - DNA, 25 bp, Homo sapien
cgcgctctgtgattgcaccgcgagc

SEQ ID NO: 127829 - DNA, 25 bp, Homo sapien
tgatctcggcctacatcgcgtcagc

SEQ ID NO: 127830 - DNA, 25 bp, Homo sapien
caatccctgagaatcgcgggcgacc

SEQ ID NO: 127831 - DNA, 25 bp, Homo sapien
cagaccctaaagaatgtacgtacca

SEQ ID NO: 127832 - DNA, 25 bp, Homo sapien
gctcctcccaatcgacggaacgaga

SEQ ID NO: 127833 - DNA, 25 bp, Homo sapien
cttacctgaagaggcgatcaatccc

SEQ ID NO: 127834 - DNA, 25 bp, Homo sapien
aacactctgtgaagccgtggtcttc

SEQ ID NO: 127835 - DNA, 25 bp, Homo sapien
tctccgcgttatcggaaagtttgca

SEQ ID NO: 127836 - DNA, 25 bp, Homo sapien
cgcgcctcaccggttattagacagc

SEQ ID NO: 127837 - DNA, 25 bp, Homo sapien
tttctgcggcctgataataagagtc

SEQ ID NO: 127838 - DNA, 25 bp, Homo sapien
cgccggcttctgctgattctttctg

SEQ ID NO: 127839 - DNA, 25 bp, Homo sapien
ctaagatcacacagcgtcccagagg

SEQ ID NO: 127840 - DNA, 25 bp, Homo sapien
tggctaggaccaggaccagtgtctc

SEQ ID NO: 127841 - DNA, 25 bp, Homo sapien
aaagtttgcagcgtttcccgagcag

SEQ ID NO: 127842 - DNA, 25 bp, Homo sapien
gggcgttgccgctaattgctgctaa

SEQ ID NO: 127843 - DNA, 25 bp, Homo sapien
tcccatgcagttgtttggaggaaca

SEQ ID NO: 127844 - DNA, 25 bp, Homo sapien
tgacaaggaggcgattatgaaattt

SEQ ID NO: 127845 - DNA, 25 bp, Homo sapien
ttaaatgcagcgtctcccaggaccg

SEQ ID NO: 127846 - DNA, 25 bp, Homo sapien
cactcggctgtagaaaaagggattt

SEQ ID NO: 127847 - DNA, 25 bp, Homo sapien
tctgacaatgtcactcggctgtaga

SEQ ID NO: 127848 - DNA, 25 bp, Homo sapien
cgagtcgtgtgcgtcttattatcaa

SEQ ID NO: 127849 - DNA, 25 bp, Homo sapien
cccgaatcaaagtagcggcggctgc

SEQ ID NO: 127850 - DNA, 25 bp, Homo sapien
ggcctctgaagagctctcgagccgg

SEQ ID NO: 127851 - DNA, 25 bp, Homo sapien
acgtgcagcggcgagcccatggacc

SEQ ID NO: 127852 - DNA, 25 bp, Homo sapien
ccaggccagtttcggggccttctcg

SEQ ID NO: 127853 - DNA, 25 bp, Homo sapien
gaccctgatcggcaagggccacttc

SEQ ID NO: 127854 - DNA, 25 bp, Homo sapien
gtggagagcctcctgtccgactcgc

SEQ ID NO: 127855 - DNA, 25 bp, Homo sapien
ccagcccattcagcgtggagagcct

SEQ ID NO: 127856 - DNA, 25 bp, Homo sapien
ccaggtcgccctgcggacaaggacg

SEQ ID NO: 127857 - DNA, 25 bp, Homo sapien
ttctacccgagccaaagaagcggcg

SEQ ID NO: 127858 - DNA, 25 bp, Homo sapien
tgctgaagagccagggccgccactt

SEQ ID NO: 127859 - DNA, 25 bp, Homo sapien
tccagcaattgcgaggacctccgca

SEQ ID NO: 127860 - DNA, 25 bp, Homo sapien
gcctgcattcaattccctaagaggg

SEQ ID NO: 127861 - DNA, 25 bp, Homo sapien
gtcacactgggatactcgaggagga

SEQ ID NO: 127862 - DNA, 25 bp, Homo sapien
tggccatcggtcacactgggatact

SEQ ID NO: 127863 - DNA, 25 bp, Homo sapien
cgtttgtgagctggccatcggtcac

SEQ ID NO: 127864 - DNA, 25 bp, Homo sapien
cacccactgcgcgtttgtgagctgg

SEQ ID NO: 127865 - DNA, 25 bp, Homo sapien
ctggggcctgcattcaattccctaa

SEQ ID NO: 127866 - DNA, 25 bp, Homo sapien
ggccgcacccactgcgcgtttgtga

SEQ ID NO: 127867 - DNA, 25 bp, Homo sapien
ccgccgttaccgtggctatgaaatc

SEQ ID NO: 127868 - DNA, 25 bp, Homo sapien
tctggccgctacattcaactaaatg

SEQ ID NO: 127869 - DNA, 25 bp, Homo sapien
caactaaatgggtgggacagtcacc

SEQ ID NO: 127870 - DNA, 25 bp, Homo sapien
cccaggtcttcaaaggccttagctt

SEQ ID NO: 127871 - DNA, 25 bp, Homo sapien
tggctatgaaatcgcttccgggttc

SEQ ID NO: 127872 - DNA, 25 bp, Homo sapien
ttcactggacctgcagtctctcagg

SEQ ID NO: 127873 - DNA, 25 bp, Homo sapien
tacctgaggtcaccagctcggctgt

SEQ ID NO: 127874 - DNA, 25 bp, Homo sapien
ccctcagtcgccaaaagaaagccgt

SEQ ID NO: 127875 - DNA, 25 bp, Homo sapien
ttctttccgaacgtaggtctctgcc

SEQ ID NO: 127876 - DNA, 25 bp, Homo sapien
ggtgcgtgctggagtctctcccgtc

SEQ ID NO: 127877 - DNA, 25 bp, Homo sapien
cctttgttacagatgttctttccga

SEQ ID NO: 127878 - DNA, 25 bp, Homo sapien
tgctgccaagatggggacggttccc

SEQ ID NO: 127879 - DNA, 25 bp, Homo sapien
agccttggcagtgagcttacggccc

SEQ ID NO: 127880 - DNA, 25 bp, Homo sapien
cagaacccgagtcagccttggcagt

SEQ ID NO: 127881 - DNA, 25 bp, Homo sapien
taaaacgcccagaacccgagtcagc

SEQ ID NO: 127882 - DNA, 25 bp, Homo sapien
gtctctgccgtctcttacttgttta

SEQ ID NO: 127883 - DNA, 25 bp, Homo sapien
agcggcctggtcctttcaccggcag

SEQ ID NO: 127884 - DNA, 25 bp, Homo sapien
ttcccagtgcctcgggccagggaat

SEQ ID NO: 127885 - DNA, 25 bp, Homo sapien
ggggccagctcaccgccggaagtct

SEQ ID NO: 127886 - DNA, 25 bp, Homo sapien
ctgaagcccacctgcagcgtatgca

SEQ ID NO: 127887 - DNA, 25 bp, Homo sapien
cggcaagcaggtgagctcctccggc

SEQ ID NO: 127888 - DNA, 25 bp, Homo sapien
tgcagcgtatgcaagaccacgtcgt

SEQ ID NO: 127889 - DNA, 25 bp, Homo sapien
accacgtcgtcctccatgtggaaga

SEQ ID NO: 127890 - DNA, 25 bp, Homo sapien
ggggagatcctctgccatcattgca

SEQ ID NO: 127891 - DNA, 25 bp, Homo sapien
ggcggcacctcgttcatcaaatctt

SEQ ID NO: 127892 - DNA, 25 bp, Homo sapien
tggcgtgaagaaccctcggtcagtt

SEQ ID NO: 127893 - DNA, 25 bp, Homo sapien
tagcgccatatgaccagcctacgga

SEQ ID NO: 127894 - DNA, 25 bp, Homo sapien
tggtttcattcgctctcctcggtag

SEQ ID NO: 127895 - DNA, 25 bp, Homo sapien
gcggtatgcgacacacgggccaaat

SEQ ID NO: 127896 - DNA, 25 bp, Homo sapien
tttgatcaccacgtccagagggcgg

SEQ ID NO: 127897 - DNA, 25 bp, Homo sapien
tcttcgcacgcaggaaacgatggcc

SEQ ID NO: 127898 - DNA, 25 bp, Homo sapien
gcgcatcctgccgtaagcctgtagt

SEQ ID NO: 127899 - DNA, 25 bp, Homo sapien
ccctcgcggttctaagtgggcactg

SEQ ID NO: 127900 - DNA, 25 bp, Homo sapien
gggcctaagtcttcggagttacatg

SEQ ID NO: 127901 - DNA, 25 bp, Homo sapien
cgcacagtagcacgccgagggaaac

SEQ ID NO: 127902 - DNA, 25 bp, Homo sapien
ccggtcgttcattaggcacccaaga

SEQ ID NO: 127903 - DNA, 25 bp, Homo sapien
ccgcgtacagcaggcaagagtgcaa

SEQ ID NO: 127904 - DNA, 25 bp, Homo sapien
gctgagtactcaccacccgattgtc

SEQ ID NO: 127905 - DNA, 25 bp, Homo sapien
tgggaaccctaaagcgccaactgcg

SEQ ID NO: 127906 - DNA, 25 bp, Homo sapien
cgggagcctgcttgtcgctaaaacc

SEQ ID NO: 127907 - DNA, 25 bp, Homo sapien
ggggatcctgcgactaaaataagcg

SEQ ID NO: 127908 - DNA, 25 bp, Homo sapien
accaatcccgtctcagttcgtaagg

SEQ ID NO: 127909 - DNA, 25 bp, Homo sapien
cctagctcccttctacgagtcgggg

SEQ ID NO: 127910 - DNA, 25 bp, Homo sapien
tacggatacgtggaagcaggatctc

SEQ ID NO: 127911 - DNA, 25 bp, Homo sapien
gagcgcacagctcctcacctgaggg

SEQ ID NO: 127912 - DNA, 25 bp, Homo sapien
agtgtgcaaattaaagccttccgga

SEQ ID NO: 127913 - DNA, 25 bp, Homo sapien
ttaccagcactctctccggcgaggg

SEQ ID NO: 127914 - DNA, 25 bp, Homo sapien
tccggctttcgctgaaactgtagta

SEQ ID NO: 127915 - DNA, 25 bp, Homo sapien
tgcaatcagacagcccagaagcctt

SEQ ID NO: 127916 - DNA, 25 bp, Homo sapien
acctgaccacgttggggtgctcgaa

SEQ ID NO: 127917 - DNA, 25 bp, Homo sapien
aacggcctccgttcttcaagtcgcg

SEQ ID NO: 127918 - DNA, 25 bp, Homo sapien
gcgggccttgaacaccttcccatag

SEQ ID NO: 127919 - DNA, 25 bp, Homo sapien
cgccacgcattcgtactgctggtca

SEQ ID NO: 127920 - DNA, 25 bp, Homo sapien
cccggagatcggtctagctttactt

SEQ ID NO: 127921 - DNA, 25 bp, Homo sapien
ctcgcggctctgtcgacaaaactta

SEQ ID NO: 127922 - DNA, 25 bp, Homo sapien
agcgcgtctcagtccagaatcattg

SEQ ID NO: 127923 - DNA, 25 bp, Homo sapien
cccgctcgccttttgccaggaatta

SEQ ID NO: 127924 - DNA, 25 bp, Homo sapien
attcagcagctatctgggacctagg

SEQ ID NO: 127925 - DNA, 25 bp, Homo sapien
ggcctcggcaggactttcaccacga

SEQ ID NO: 127926 - DNA, 25 bp, Homo sapien
agcagagcttctggcactcactaca

SEQ ID NO: 127927 - DNA, 25 bp, Homo sapien
tcgcttgtcgtctccttaaagaata

SEQ ID NO: 127928 - DNA, 25 bp, Homo sapien
ggggtgttcgccacaatttcgcttg

SEQ ID NO: 127929 - DNA, 25 bp, Homo sapien
caaagcgccagagtagggtacccta

SEQ ID NO: 127930 - DNA, 25 bp, Homo sapien
ggggatagcataatcgcgcctcgtc

SEQ ID NO: 127931 - DNA, 25 bp, Homo sapien
gcagagacgcgggaacataaaacac

SEQ ID NO: 127932 - DNA, 25 bp, Homo sapien
gagacgcgggaacataaaacacatt

SEQ ID NO: 127933 - DNA, 25 bp, Homo sapien
cgcgggaacataaaacacattccag

SEQ ID NO: 127934 - DNA, 25 bp, Homo sapien
cataaaacacattccagcggttggc

SEQ ID NO: 127935 - DNA, 25 bp, Homo sapien
aaaacacattccagcggttggcatc

SEQ ID NO: 127936 - DNA, 25 bp, Homo sapien
acattccagcggttggcatctgggc

SEQ ID NO: 127937 - DNA, 25 bp, Homo sapien
attccagcggttggcatctgggcgc

SEQ ID NO: 127938 - DNA, 25 bp, Homo sapien
cgccaggcctgcagaaagcggcctg

SEQ ID NO: 127939 - DNA, 25 bp, Homo sapien
cagcagaattgatgagagccagccc

SEQ ID NO: 127940 - DNA, 25 bp, Homo sapien
cgagctggtgagctccgtgcgcctc

SEQ ID NO: 127941 - DNA, 25 bp, Homo sapien
cggctgctgtctcgctccagtcagg

SEQ ID NO: 127942 - DNA, 25 bp, Homo sapien
ctgctgtctcgctccagtcagggct

SEQ ID NO: 127943 - DNA, 25 bp, Homo sapien
tcaccctgcgagtccgggagactaa

SEQ ID NO: 127944 - DNA, 25 bp, Homo sapien
tgcgagtccgggagactaaagcgcc

SEQ ID NO: 127945 - DNA, 25 bp, Homo sapien
tccgggagactaaagcgccgcgtaa

SEQ ID NO: 127946 - DNA, 25 bp, Homo sapien
aaagcgccgcgtaaacacaggaagc

SEQ ID NO: 127947 - DNA, 25 bp, Homo sapien
agcctcccaggtgtagaaattgttg

SEQ ID NO: 127948 - DNA, 25 bp, Homo sapien
ccgtacaggaactggcggcagctct

SEQ ID NO: 127949 - DNA, 25 bp, Homo sapien
agctctgcgtgtacctgtcgtagta

SEQ ID NO: 127950 - DNA, 25 bp, Homo sapien
tctccgcgttatttcctgaagaagg

SEQ ID NO: 127951 - DNA, 25 bp, Homo sapien
gctcctaggaggaaagaacatcccg

SEQ ID NO: 127952 - DNA, 25 bp, Homo sapien
tcctggagcggccagatacctgttg

SEQ ID NO: 127953 - DNA, 25 bp, Homo sapien
gctgattcatgcacggggactgtca

SEQ ID NO: 127954 - DNA, 25 bp, Homo sapien
ttctatcctccagcaagcatcgtcg

SEQ ID NO: 127955 - DNA, 25 bp, Homo sapien
agcgccacgacatcagtggagtcta

SEQ ID NO: 127956 - DNA, 25 bp, Homo sapien
cggaccgcgtcttcagtaccagggc

SEQ ID NO: 127957 - DNA, 25 bp, Homo sapien
agggcccagcgaaacaccaacttct

SEQ ID NO: 127958 - DNA, 25 bp, Homo sapien
tggagtctaaacaccgcgccggatg

SEQ ID NO: 127959 - DNA, 25 bp, Homo sapien
acggcgctcattggagccctgggaa

SEQ ID NO: 127960 - DNA, 25 bp, Homo sapien
gtagttcaccaacgcataacgtgtt

SEQ ID NO: 127961 - DNA, 25 bp, Homo sapien
ggtctctgatccaacgttcccgctg

SEQ ID NO: 127962 - DNA, 25 bp, Homo sapien
gactgcggctctgattctgggtctc

SEQ ID NO: 127963 - DNA, 25 bp, Homo sapien
agtgtgagaacttccggagcccgca

SEQ ID NO: 127964 - DNA, 25 bp, Homo sapien
gaagcatccagcacccaggttccag

SEQ ID NO: 127965 - DNA, 25 bp, Homo sapien
gagcgaagcatccagcacccaggtt

SEQ ID NO: 127966 - DNA, 25 bp, Homo sapien
cagccgctgccttcagagcgaagca

SEQ ID NO: 127967 - DNA, 25 bp, Homo sapien
ccctgatgccaattccagatgtgtg

SEQ ID NO: 127968 - DNA, 25 bp, Homo sapien
tgagtcgtgaagtgtgagaacttcc

SEQ ID NO: 127969 - DNA, 25 bp, Homo sapien
ccaaactccggtttaatgagtcgtg

SEQ ID NO: 127970 - DNA, 25 bp, Homo sapien
ccaattccagatgtgtgagttggga

SEQ ID NO: 127971 - DNA, 25 bp, Homo sapien
ggacctggccaaaagtgctgctgag

SEQ ID NO: 127972 - DNA, 25 bp, Homo sapien
gcgggagatcaaccactacttcagc

SEQ ID NO: 127973 - DNA, 25 bp, Homo sapien
caggcgcagccgctattaaggcagg

SEQ ID NO: 127974 - DNA, 25 bp, Homo sapien
tacaacctgggcaagcgggagatca

SEQ ID NO: 127975 - DNA, 25 bp, Homo sapien
ctccgccgcgcactgttgtcatgga

SEQ ID NO: 127976 - DNA, 25 bp, Homo sapien
actacttcagcgtgaggagcgccaa

SEQ ID NO: 127977 - DNA, 25 bp, Homo sapien
gcgcccgaggccaactgagtggacc

SEQ ID NO: 127978 - DNA, 25 bp, Homo sapien
ccaaaggacaatggctggtggttct

SEQ ID NO: 127979 - DNA, 25 bp, Homo sapien
ttcgacggccctgaactcaggagcc

SEQ ID NO: 127980 - DNA, 25 bp, Homo sapien
atttcctgttgtctctctgggccgg

SEQ ID NO: 127981 - DNA, 25 bp, Homo sapien
acacggagagccatccgcctggacg

SEQ ID NO: 127982 - DNA, 25 bp, Homo sapien
cgcctggacgtagatatcctgcaga

SEQ ID NO: 127983 - DNA, 25 bp, Homo sapien
acgtagatatcctgcagacctgtca

SEQ ID NO: 127984 - DNA, 25 bp, Homo sapien
agacctgtcaggacaggctccatcg

SEQ ID NO: 127985 - DNA, 25 bp, Homo sapien
ctgcctgagtcctgcacttcgacgg

SEQ ID NO: 127986 - DNA, 25 bp, Homo sapien
ctctgggccggttgggcgatcacct

SEQ ID NO: 127987 - DNA, 25 bp, Homo sapien
ggaccaagtccagatacgggctgta

SEQ ID NO: 127988 - DNA, 25 bp, Homo sapien
tgctcttcaaatgcgctaccaagtg

SEQ ID NO: 127989 - DNA, 25 bp, Homo sapien
aattgcattcttggcctggctaggc

SEQ ID NO: 127990 - DNA, 25 bp, Homo sapien
gcaaaacttgtcacgccttcactgg

SEQ ID NO: 127991 - DNA, 25 bp, Homo sapien
ggtacacgcgcttcaacttcggttg

SEQ ID NO: 127992 - DNA, 25 bp, Homo sapien
cctcggtgcaacctatataaggctc

SEQ ID NO: 127993 - DNA, 25 bp, Homo sapien
gcttggccagttcagcatcagcatc

SEQ ID NO: 127994 - DNA, 25 bp, Homo sapien
ttcctgtcttcgcagaggagtcctc

SEQ ID NO: 127995 - DNA, 25 bp, Homo sapien
gcctcaaagtcttcgccggcgggaa

SEQ ID NO: 127996 - DNA, 25 bp, Homo sapien
ttgtcctgccaaggcctcaaagtct

SEQ ID NO: 127997 - DNA, 25 bp, Homo sapien
gaggtcactacgctgacaattgtcc

SEQ ID NO: 127998 - DNA, 25 bp, Homo sapien
tctactgtggaacaggaggtcacta

SEQ ID NO: 127999 - DNA, 25 bp, Homo sapien
ccaggtagatccaaccgagccggtg

SEQ ID NO: 128000 - DNA, 25 bp, Homo sapien
ctggtgttgcctcacattgcaagcc

SEQ ID NO: 128001 - DNA, 25 bp, Homo sapien
gctgtagagggaccttcagcgaccg

SEQ ID NO: 128002 - DNA, 25 bp, Homo sapien
cccgcatgcgcctgacgcaggaaga

SEQ ID NO: 128003 - DNA, 25 bp, Homo sapien
ttcgcccttccttggccgccagagg

SEQ ID NO: 128004 - DNA, 25 bp, Homo sapien
ctctctgcggccctagagttaatcc

SEQ ID NO: 128005 - DNA, 25 bp, Homo sapien
tcccgggattttgctgccgggctcc

SEQ ID NO: 128006 - DNA, 25 bp, Homo sapien
gcggccctagagttaatcccatcag

SEQ ID NO: 128007 - DNA, 25 bp, Homo sapien
gagttaatcccatcagccgaggtga

SEQ ID NO: 128008 - DNA, 25 bp, Homo sapien
tcccatcagccgaggtgaggcacct

SEQ ID NO: 128009 - DNA, 25 bp, Homo sapien
tcctccattacaccgcggccgccga

SEQ ID NO: 128010 - DNA, 25 bp, Homo sapien
gtggcgaccgcacgtgggccaaacc

SEQ ID NO: 128011 - DNA, 25 bp, Homo sapien
gtcggcagctagctgggccgaccag

SEQ ID NO: 128012 - DNA, 25 bp, Homo sapien
ggccgaccaggtgcacagaaggcgt

SEQ ID NO: 128013 - DNA, 25 bp, Homo sapien
accgacgggctaggaggctctgcct

SEQ ID NO: 128014 - DNA, 25 bp, Homo sapien
aaagggatcgatgggcgcagacacc

SEQ ID NO: 128015 - DNA, 25 bp, Homo sapien
atagacaaagggatcgatgggcgca

SEQ ID NO: 128016 - DNA, 25 bp, Homo sapien
cttcgccatggtcggggatagacaa

SEQ ID NO: 128017 - DNA, 25 bp, Homo sapien
cgcaatcagcttcgccatggtcggg

SEQ ID NO: 128018 - DNA, 25 bp, Homo sapien
cacagaaggcgtggcttgcggtcag

SEQ ID NO: 128019 - DNA, 25 bp, Homo sapien
agacgccctgtcaagatgccactca

SEQ ID NO: 128020 - DNA, 25 bp, Homo sapien
aggccagacgtgaggcgacactgaa

SEQ ID NO: 128021 - DNA, 25 bp, Homo sapien
gcgacactgaattgctcccgagacg

SEQ ID NO: 128022 - DNA, 25 bp, Homo sapien
tacctcaattcctcagatggcctga

SEQ ID NO: 128023 - DNA, 25 bp, Homo sapien
ggagtttgctcctaacacccgcgaa

SEQ ID NO: 128024 - DNA, 25 bp, Homo sapien
ggaactccggacttctgcaaggcca

SEQ ID NO: 128025 - DNA, 25 bp, Homo sapien
gatgccactcacctaaacgccagga

SEQ ID NO: 128026 - DNA, 25 bp, Homo sapien
cacgattccttgttttttgggcaga

SEQ ID NO: 128027 - DNA, 25 bp, Homo sapien
acctacctgagtgccagaagcctct

SEQ ID NO: 128028 - DNA, 25 bp, Homo sapien
gcgcgggagtcccacctacctgagt

SEQ ID NO: 128029 - DNA, 25 bp, Homo sapien
gtgccagaagcctctcgcccaggag

SEQ ID NO: 128030 - DNA, 25 bp, Homo sapien
gtcccacctacctgagtgccagaag

SEQ ID NO: 128031 - DNA, 25 bp, Homo sapien
gggagtcccacctacctgagtgcca

SEQ ID NO: 128032 - DNA, 25 bp, Homo sapien
tccgtgggcggtgccatcttcccgg

SEQ ID NO: 128033 - DNA, 25 bp, Homo sapien
atcttcccggctcgatggtgccggc

SEQ ID NO: 128034 - DNA, 25 bp, Homo sapien
cgtcctccgcctaggccgagtccct

SEQ ID NO: 128035 - DNA, 25 bp, Homo sapien
ctttaaggagcaggagtacagcacg

SEQ ID NO: 128036 - DNA, 25 bp, Homo sapien
gctggtggccttctacgtggaacac

SEQ ID NO: 128037 - DNA, 25 bp, Homo sapien
aacacggggccatagtggacagcgt

SEQ ID NO: 128038 - DNA, 25 bp, Homo sapien
ctactgggccctccgctttaaggag

SEQ ID NO: 128039 - DNA, 25 bp, Homo sapien
gtctgccgcatgctgcttgactaca

SEQ ID NO: 128040 - DNA, 25 bp, Homo sapien
aagccgaagtcaatgcccgagatga

SEQ ID NO: 128041 - DNA, 25 bp, Homo sapien
tggacagcgtgaatgcccacatgga

SEQ ID NO: 128042 - DNA, 25 bp, Homo sapien
tacagcacggagcaccacctggtct

SEQ ID NO: 128043 - DNA, 25 bp, Homo sapien
tgaactccaggtcgcgccaatcaga

SEQ ID NO: 128044 - DNA, 25 bp, Homo sapien
caggctcgcccttgtttacaactcg

SEQ ID NO: 128045 - DNA, 25 bp, Homo sapien
tccagccgcggtcatcacagaatgg

SEQ ID NO: 128046 - DNA, 25 bp, Homo sapien
actggaacttggaaacgcgtcctga

SEQ ID NO: 128047 - DNA, 25 bp, Homo sapien
cccgagtcccaaacaggaggagtca

SEQ ID NO: 128048 - DNA, 25 bp, Homo sapien
gtggttcgagattcaagttcaagtc

SEQ ID NO: 128049 - DNA, 25 bp, Homo sapien
tgtagcgcgagaaatgctccacctc

SEQ ID NO: 128050 - DNA, 25 bp, Homo sapien
acagaatggcctggcacggtgacca

SEQ ID NO: 128051 - DNA, 25 bp, Homo sapien
ccggtgtcgtctgcgctgggaacca

SEQ ID NO: 128052 - DNA, 25 bp, Homo sapien
agggtcgtggtgtcaccacctggtc

SEQ ID NO: 128053 - DNA, 25 bp, Homo sapien
ctgcgtgctccgctgagcccgaagg

SEQ ID NO: 128054 - DNA, 25 bp, Homo sapien
aaactggagcgggatgtcgccgctc

SEQ ID NO: 128055 - DNA, 25 bp, Homo sapien
cgagcgcgtccaggtaaactggagc

SEQ ID NO: 128056 - DNA, 25 bp, Homo sapien
gcgcagcgtgagacagcacatcctg

SEQ ID NO: 128057 - DNA, 25 bp, Homo sapien
gagggatagacgaattgacctttcc

SEQ ID NO: 128058 - DNA, 25 bp, Homo sapien
ccctctcggcagagccgagagacta

SEQ ID NO: 128059 - DNA, 25 bp, Homo sapien
ccatgaagatgatgctggtgcgccg

SEQ ID NO: 128060 - DNA, 25 bp, Homo sapien
tcatcctgatggtgttcctggtggc

SEQ ID NO: 128061 - DNA, 25 bp, Homo sapien
ttccctctgcaaaccgcgggcagga

SEQ ID NO: 128062 - DNA, 25 bp, Homo sapien
gcaggaggagccctctccttagcgg

SEQ ID NO: 128063 - DNA, 25 bp, Homo sapien
ggctccgccaatctgtgggcgctga

SEQ ID NO: 128064 - DNA, 25 bp, Homo sapien
cgggatggacccacacgcccgatga

SEQ ID NO: 128065 - DNA, 25 bp, Homo sapien
accgatggaccttgacccgcgaggc

SEQ ID NO: 128066 - DNA, 25 bp, Homo sapien
cccgcgcggccatgaagatgatgct

SEQ ID NO: 128067 - DNA, 25 bp, Homo sapien
ctgcaggctctcaggacacccaagg

SEQ ID NO: 128068 - DNA, 25 bp, Homo sapien
cgctttgcaaacaggtggactcggc

SEQ ID NO: 128069 - DNA, 25 bp, Homo sapien
taacggtcgaaaacgcgctcttgtc

SEQ ID NO: 128070 - DNA, 25 bp, Homo sapien
cgcgctcttgtcgatttcctgtagt

SEQ ID NO: 128071 - DNA, 25 bp, Homo sapien
tccagcctgtcgagcagcgagctga

SEQ ID NO: 128072 - DNA, 25 bp, Homo sapien
gctgaccgagctcaagttcctatgc

SEQ ID NO: 128073 - DNA, 25 bp, Homo sapien
gagcggcctagacctcttctccatg

SEQ ID NO: 128074 - DNA, 25 bp, Homo sapien
tgctgctggagcagaacgacctgga

SEQ ID NO: 128075 - DNA, 25 bp, Homo sapien
cacgcaacaacaacacgagtcgggg

SEQ ID NO: 128076 - DNA, 25 bp, Homo sapien
ccacacgacatctggggaccaaacg

SEQ ID NO: 128077 - DNA, 25 bp, Homo sapien
cccgagatgacgatttcgttattta

SEQ ID NO: 128078 - DNA, 25 bp, Homo sapien
cttagctcggtgcagatgtaacatc

SEQ ID NO: 128079 - DNA, 25 bp, Homo sapien
atctcatttacagcgtggcctccgg

SEQ ID NO: 128080 - DNA, 25 bp, Homo sapien
tggcctccgggcatagaaacaattg

SEQ ID NO: 128081 - DNA, 25 bp, Homo sapien
tggaagccacgaatcccacacgaca

SEQ ID NO: 128082 - DNA, 25 bp, Homo sapien
attggcaacaaaagagtaactccgg

SEQ ID NO: 128083 - DNA, 25 bp, Homo sapien
gcagaggtaacttggccgtgtgcaa

SEQ ID NO: 128084 - DNA, 25 bp, Homo sapien
ggcggctcacttctagtcccggcgg

SEQ ID NO: 128085 - DNA, 25 bp, Homo sapien
ctgtggcaccaacccagacacgtga

SEQ ID NO: 128086 - DNA, 25 bp, Homo sapien
tgtccggcccacaaagtttccgctg

SEQ ID NO: 128087 - DNA, 25 bp, Homo sapien
ccggagtcaacaaccagcggggtca

SEQ ID NO: 128088 - DNA, 25 bp, Homo sapien
cgtaataggatcaggcttcagcccg

SEQ ID NO: 128089 - DNA, 25 bp, Homo sapien
gcggagcccttgaaacgtaatagga

SEQ ID NO: 128090 - DNA, 25 bp, Homo sapien
caaagtttccgctgcgaggtcgggc

SEQ ID NO: 128091 - DNA, 25 bp, Homo sapien
acgctgacgctaccatagagacttg

SEQ ID NO: 128092 - DNA, 25 bp, Homo sapien
tgagtcaccgttcgcgcgacacaga

SEQ ID NO: 128093 - DNA, 25 bp, Homo sapien
gttaccttcggcagggaactcttca

SEQ ID NO: 128094 - DNA, 25 bp, Homo sapien
caaactcgtcgtcttcctctaacag

SEQ ID NO: 128095 - DNA, 25 bp, Homo sapien
cagacctaagtctaccggctgcttt

SEQ ID NO: 128096 - DNA, 25 bp, Homo sapien
acctcccagataagcagaaaagttg

SEQ ID NO: 128097 - DNA, 25 bp, Homo sapien
aagctacctccacacggaggcctga

SEQ ID NO: 128098 - DNA, 25 bp, Homo sapien
tgctttttctctgacatctcgactg

SEQ ID NO: 128099 - DNA, 25 bp, Homo sapien
tgcgggctggactagtgcaaacaag

SEQ ID NO: 128100 - DNA, 25 bp, Homo sapien
agagtgactccaaccgccttacttc

SEQ ID NO: 128101 - DNA, 25 bp, Homo sapien
gccttacttcagctcattaccgtca

SEQ ID NO: 128102 - DNA, 25 bp, Homo sapien
tgaaggactgggaagccaatctgcc

SEQ ID NO: 128103 - DNA, 25 bp, Homo sapien
tgccgcgttcaattggagagaaatg

SEQ ID NO: 128104 - DNA, 25 bp, Homo sapien
aaatgactgtcggaagaggccctgc

SEQ ID NO: 128105 - DNA, 25 bp, Homo sapien
gccctgcggtaaatagcctctgagc

SEQ ID NO: 128106 - DNA, 25 bp, Homo sapien
tgagccgcgaactctatgcgccgtg

SEQ ID NO: 128107 - DNA, 25 bp, Homo sapien
ccattcgactcgtggcgtctgcatc

SEQ ID NO: 128108 - DNA, 25 bp, Homo sapien
cggaaggtaggcgaagaactctgca

SEQ ID NO: 128109 - DNA, 25 bp, Homo sapien
tgcaagtcgcgcacacgccagtaga

SEQ ID NO: 128110 - DNA, 25 bp, Homo sapien
acgccagtagaagccgtgcgcctgt

SEQ ID NO: 128111 - DNA, 25 bp, Homo sapien
tgaccaatggggaggcactgccctt

SEQ ID NO: 128112 - DNA, 25 bp, Homo sapien
ccctttggagacaaaccattcgact

SEQ ID NO: 128113 - DNA, 25 bp, Homo sapien
gtctgaaagcagacgcgcaactttc

SEQ ID NO: 128114 - DNA, 25 bp, Homo sapien
cgtggcgtctgcatcaagtctgaaa

SEQ ID NO: 128115 - DNA, 25 bp, Homo sapien
agggaactcctacaaccaccgctcg

SEQ ID NO: 128116 - DNA, 25 bp, Homo sapien
ccaccaccacggctcgccctacgcg

SEQ ID NO: 128117 - DNA, 25 bp, Homo sapien
cagcggccggctcgcaccaccacca

SEQ ID NO: 128118 - DNA, 25 bp, Homo sapien
taccctctgcactgcctgcactcgg

SEQ ID NO: 128119 - DNA, 25 bp, Homo sapien
atggcaggcgcgcactaccctctgc

SEQ ID NO: 128120 - DNA, 25 bp, Homo sapien
acgcgaggggacgacacaggtgaga

SEQ ID NO: 128121 - DNA, 25 bp, Homo sapien
tccagtcctaccacaacagcagcgc

SEQ ID NO: 128122 - DNA, 25 bp, Homo sapien
agcacagcccttacctccagtccta

SEQ ID NO: 128123 - DNA, 25 bp, Homo sapien
atccgagtgtgagtggacaggctcc

SEQ ID NO: 128124 - DNA, 25 bp, Homo sapien
aaaggaaccagaggaggccagccga

SEQ ID NO: 128125 - DNA, 25 bp, Homo sapien
ttggcaagatcccagtgaccattgg

SEQ ID NO: 128126 - DNA, 25 bp, Homo sapien
gcgtccggtgggatcaaaggaacca

SEQ ID NO: 128127 - DNA, 25 bp, Homo sapien
tagagagctctaggttggcaagatc

SEQ ID NO: 128128 - DNA, 25 bp, Homo sapien
cccagaatacaaggaagcgctaaga

SEQ ID NO: 128129 - DNA, 25 bp, Homo sapien
tttgtgcggatcaacgctctcgggc

SEQ ID NO: 128130 - DNA, 25 bp, Homo sapien
gttccagcaggcatcccaggctctt

SEQ ID NO: 128131 - DNA, 25 bp, Homo sapien
ttagcctgagaccaccgcgagaaca

SEQ ID NO: 128132 - DNA, 25 bp, Homo sapien
ggaggtatctccagaccgctgatga

SEQ ID NO: 128133 - DNA, 25 bp, Homo sapien
ccgaggaggctctacattgttaaga

SEQ ID NO: 128134 - DNA, 25 bp, Homo sapien
ttggcggcgactcgaacattcttta

SEQ ID NO: 128135 - DNA, 25 bp, Homo sapien
cgcggcgaaggtctccaaaacaatc

SEQ ID NO: 128136 - DNA, 25 bp, Homo sapien
taccgccaagaagctatgccttagg

SEQ ID NO: 128137 - DNA, 25 bp, Homo sapien
cacgttaccgggacactcagaggtc

SEQ ID NO: 128138 - DNA, 25 bp, Homo sapien
cgcttgctttcaacccgcgaaattg

SEQ ID NO: 128139 - DNA, 25 bp, Homo sapien
tgctccttcacttcagcagcaagcg

SEQ ID NO: 128140 - DNA, 25 bp, Homo sapien
accctacttctgtcggcgtctgttc

SEQ ID NO: 128141 - DNA, 25 bp, Homo sapien
ttctgtcggcgtctgttcgggcgcc

SEQ ID NO: 128142 - DNA, 25 bp, Homo sapien
ccgcagaagccagactcttgggcag

SEQ ID NO: 128143 - DNA, 25 bp, Homo sapien
tctccaaagttcaaagacccacaag

SEQ ID NO: 128144 - DNA, 25 bp, Homo sapien
ttcacttcagcagcaagcggtcggg

SEQ ID NO: 128145 - DNA, 25 bp, Homo sapien
cgctaaccgaggtctccaaagttca

SEQ ID NO: 128146 - DNA, 25 bp, Homo sapien
cccaggcttcaaggaggtggccctg

SEQ ID NO: 128147 - DNA, 25 bp, Homo sapien
cgattcctgagacggatggtgcata

SEQ ID NO: 128148 - DNA, 25 bp, Homo sapien
tgaggcgcagcacagccttggttaa

SEQ ID NO: 128149 - DNA, 25 bp, Homo sapien
gctggggacccttctgtcaaacact

SEQ ID NO: 128150 - DNA, 25 bp, Homo sapien
actcgggcaaagttggcgattcctg

SEQ ID NO: 128151 - DNA, 25 bp, Homo sapien
ccgtagggctgtagtagtcagaatc

SEQ ID NO: 128152 - DNA, 25 bp, Homo sapien
cagcgtcctagtcgccctgtatctg

SEQ ID NO: 128153 - DNA, 25 bp, Homo sapien
ctgggagtcgtgaagtctctgtctc

SEQ ID NO: 128154 - DNA, 25 bp, Homo sapien
gttcacgccgtgatactgatactgg

SEQ ID NO: 128155 - DNA, 25 bp, Homo sapien
gacagcgcttgcgtactcgggccaa

SEQ ID NO: 128156 - DNA, 25 bp, Homo sapien
ggctgctttcgtcggctcccaagct

SEQ ID NO: 128157 - DNA, 25 bp, Homo sapien
gcggtagacactcagcaaaggcctc

SEQ ID NO: 128158 - DNA, 25 bp, Homo sapien
ctgcaaggtgcgaatccagagcctc

SEQ ID NO: 128159 - DNA, 25 bp, Homo sapien
agcctcggttcgctcttctgcaagg

SEQ ID NO: 128160 - DNA, 25 bp, Homo sapien
tgccggacgcgtccagctcagaact

SEQ ID NO: 128161 - DNA, 25 bp, Homo sapien
ggccacgcagccgattagatgtctc

SEQ ID NO: 128162 - DNA, 25 bp, Homo sapien
ctcagaactcgaggcgcggtagaca

SEQ ID NO: 128163 - DNA, 25 bp, Homo sapien
cctgggcgaccagtacgtgaaagac

SEQ ID NO: 128164 - DNA, 25 bp, Homo sapien
tccggttcactaatacgcaagttcg

SEQ ID NO: 128165 - DNA, 25 bp, Homo sapien
acgtttctcgagtccgggcattgta

SEQ ID NO: 128166 - DNA, 25 bp, Homo sapien
ccaaaccggatagaggtcgcgcgcc

SEQ ID NO: 128167 - DNA, 25 bp, Homo sapien
acctgattgtgcaagggaccaaacc

SEQ ID NO: 128168 - DNA, 25 bp, Homo sapien
ttaggagacataagaccgttggttc

SEQ ID NO: 128169 - DNA, 25 bp, Homo sapien
accgttggttctgacgaggcacagc

SEQ ID NO: 128170 - DNA, 25 bp, Homo sapien
tccgggcattgtacaagcgcgtctt

SEQ ID NO: 128171 - DNA, 25 bp, Homo sapien
agctcgagatatgtcagtgcggtta

SEQ ID NO: 128172 - DNA, 25 bp, Homo sapien
gccgaacgcgctgacggatccatta

SEQ ID NO: 128173 - DNA, 25 bp, Homo sapien
tggcatgatcatcgcaccggcctgc

SEQ ID NO: 128174 - DNA, 25 bp, Homo sapien
gtcacctccgaccacagacattgtt

SEQ ID NO: 128175 - DNA, 25 bp, Homo sapien
tttccgacagttctcaggagcagtg

SEQ ID NO: 128176 - DNA, 25 bp, Homo sapien
cattaggtttttcagtgtgccgctc

SEQ ID NO: 128177 - DNA, 25 bp, Homo sapien
tgcggccattcagcaaagccatctg

SEQ ID NO: 128178 - DNA, 25 bp, Homo sapien
tgtgccgctcaagtcagttaaattg

SEQ ID NO: 128179 - DNA, 25 bp, Homo sapien
cgagatcctcacaaggcgggaaatc

SEQ ID NO: 128180 - DNA, 25 bp, Homo sapien
gcctaaccggtacaggtgagacttc

SEQ ID NO: 128181 - DNA, 25 bp, Homo sapien
ttcatccgttgtggggcagaaaatt

SEQ ID NO: 128182 - DNA, 25 bp, Homo sapien
acatgaaaatcctcgtggccttggc

SEQ ID NO: 128183 - DNA, 25 bp, Homo sapien
agcaccctagttaacgtggcacgca

SEQ ID NO: 128184 - DNA, 25 bp, Homo sapien
attcaagtttcttcccgagggctgc

SEQ ID NO: 128185 - DNA, 25 bp, Homo sapien
ccacgggattttgtgcccacgattc

SEQ ID NO: 128186 - DNA, 25 bp, Homo sapien
cctgccttcacgtttgttttgcgga

SEQ ID NO: 128187 - DNA, 25 bp, Homo sapien
gctagctgtcaggtgcgtaacaatc

SEQ ID NO: 128188 - DNA, 25 bp, Homo sapien
tttacaggggctcaaactgccgctg

SEQ ID NO: 128189 - DNA, 25 bp, Homo sapien
cagaaaggtccttccgctagctgtc

SEQ ID NO: 128190 - DNA, 25 bp, Homo sapien
ctcgatgcttcagggaaccaggaca

SEQ ID NO: 128191 - DNA, 25 bp, Homo sapien
cgcttataccgacctggctcctgta

SEQ ID NO: 128192 - DNA, 25 bp, Homo sapien
cgcaaggaggagctcttttgtttcc

SEQ ID NO: 128193 - DNA, 25 bp, Homo sapien
gtttccagcgccttgcgtctcagtg

SEQ ID NO: 128194 - DNA, 25 bp, Homo sapien
ggccgcagtctcttcctagatcagg

SEQ ID NO: 128195 - DNA, 25 bp, Homo sapien
cccagagaaagcagccacctgctag

SEQ ID NO: 128196 - DNA, 25 bp, Homo sapien
caggaagaagaacccgcctcgcagc

SEQ ID NO: 128197 - DNA, 25 bp, Homo sapien
tcgccgccgaccaggaagaagaacc

SEQ ID NO: 128198 - DNA, 25 bp, Homo sapien
aggaagaagaacccgcctcgcagcg

SEQ ID NO: 128199 - DNA, 25 bp, Homo sapien
cgaccaggaagaagaacccgcctcg

SEQ ID NO: 128200 - DNA, 25 bp, Homo sapien
ccaggaagaagaacccgcctcgcag

SEQ ID NO: 128201 - DNA, 25 bp, Homo sapien
gaccaggaagaagaacccgcctcgc

SEQ ID NO: 128202 - DNA, 25 bp, Homo sapien
accaggaagaagaacccgcctcgca

SEQ ID NO: 128203 - DNA, 25 bp, Homo sapien
agtgattagggagatttctgccgca

SEQ ID NO: 128204 - DNA, 25 bp, Homo sapien
cggaccgaggtttggcagaagcaac

SEQ ID NO: 128205 - DNA, 25 bp, Homo sapien
cgtcacatgacgcagcccatcatgg

SEQ ID NO: 128206 - DNA, 25 bp, Homo sapien
tggccgccctgtccatcacgacatc

SEQ ID NO: 128207 - DNA, 25 bp, Homo sapien
ggtcctcctgatcgccggcagtgct

SEQ ID NO: 128208 - DNA, 25 bp, Homo sapien
gcgccacttccgcaaacaggtgcag

SEQ ID NO: 128209 - DNA, 25 bp, Homo sapien
ttccgcaaacaggtgcaggtgagcg

SEQ ID NO: 128210 - DNA, 25 bp, Homo sapien
gaagcaacgtgtgctcgggagcaac

SEQ ID NO: 128211 - DNA, 25 bp, Homo sapien
gggactcacagaccatgctgctgca

SEQ ID NO: 128212 - DNA, 25 bp, Homo sapien
acctgaaggcgtatctgcgcagcga

SEQ ID NO: 128213 - DNA, 25 bp, Homo sapien
ggctgacttttgcagggtgacctga

SEQ ID NO: 128214 - DNA, 25 bp, Homo sapien
tggaaactcacacgggctgactttt

SEQ ID NO: 128215 - DNA, 25 bp, Homo sapien
ttcctgtggctcgtttggaaactca

SEQ ID NO: 128216 - DNA, 25 bp, Homo sapien
taagcgctcactttattcctgtggc

SEQ ID NO: 128217 - DNA, 25 bp, Homo sapien
ggcacgtatttaagcgctcacttta

SEQ ID NO: 128218 - DNA, 25 bp, Homo sapien
caagctgcacttcctgcacaggtgg

SEQ ID NO: 128219 - DNA, 25 bp, Homo sapien
ggaccaacacgaacgaactccttgc

SEQ ID NO: 128220 - DNA, 25 bp, Homo sapien
tgacttcgagacacaggacgatcgc

SEQ ID NO: 128221 - DNA, 25 bp, Homo sapien
tgcgggccttcaacctgcatagcct

SEQ ID NO: 128222 - DNA, 25 bp, Homo sapien
tgtcagggatgctcgacctctcaga

SEQ ID NO: 128223 - DNA, 25 bp, Homo sapien
gagccggacatcgaagggaagtacc

SEQ ID NO: 128224 - DNA, 25 bp, Homo sapien
tgcggagtctgttgaagcccacagc

SEQ ID NO: 128225 - DNA, 25 bp, Homo sapien
attctgcgctggacaagtccctgtc

SEQ ID NO: 128226 - DNA, 25 bp, Homo sapien
ctcagcaacgaggacggaaggcacc

SEQ ID NO: 128227 - DNA, 25 bp, Homo sapien
cccgggactcttgcgggccaagacg

SEQ ID NO: 128228 - DNA, 25 bp, Homo sapien
gcgagctctgcagactcgccacagg

SEQ ID NO: 128229 - DNA, 25 bp, Homo sapien
gcaacgctacttccgggcgagctct

SEQ ID NO: 128230 - DNA, 25 bp, Homo sapien
accgctcttccgcttgcggtttcgg

SEQ ID NO: 128231 - DNA, 25 bp, Homo sapien
cggactcagggcacgtgcgtctcct

SEQ ID NO: 128232 - DNA, 25 bp, Homo sapien
acgcatgtggccctttcttggaggg

SEQ ID NO: 128233 - DNA, 25 bp, Homo sapien
gctcgcgtccctggcacgcatgtgg

SEQ ID NO: 128234 - DNA, 25 bp, Homo sapien
ccgggctagcgcttagccagctgcg

SEQ ID NO: 128235 - DNA, 25 bp, Homo sapien
cgccatgcctgtctgatcattttaa

SEQ ID NO: 128236 - DNA, 25 bp, Homo sapien
ctcgccatttgctgacatgagattg

SEQ ID NO: 128237 - DNA, 25 bp, Homo sapien
tcctcaacaggaagcagcgaagacg

SEQ ID NO: 128238 - DNA, 25 bp, Homo sapien
agacggctcttagctgcgttcaagg

SEQ ID NO: 128239 - DNA, 25 bp, Homo sapien
taaaaacccagctttgtcgtctcgc

SEQ ID NO: 128240 - DNA, 25 bp, Homo sapien
acccgcttccgttcctgtggtgcag

SEQ ID NO: 128241 - DNA, 25 bp, Homo sapien
agcagcgacatccactcgccatttg

SEQ ID NO: 128242 - DNA, 25 bp, Homo sapien
tgtggtgcagcgcacatgccatcca

SEQ ID NO: 128243 - DNA, 25 bp, Homo sapien
cgttttcgcggagcggctcgtcccg

SEQ ID NO: 128244 - DNA, 25 bp, Homo sapien
atgcccgcgttttcgcggagcggct

SEQ ID NO: 128245 - DNA, 25 bp, Homo sapien
ctgggacttgggatctgtgtgctga

SEQ ID NO: 128246 - DNA, 25 bp, Homo sapien
ggctcccagagacctgtttcccatt

SEQ ID NO: 128247 - DNA, 25 bp, Homo sapien
cagagacctgtttcccattggcgga

SEQ ID NO: 128248 - DNA, 25 bp, Homo sapien
agacctgtttcccattggcggaatg

SEQ ID NO: 128249 - DNA, 25 bp, Homo sapien
ctgtttcccattggcggaatgggcc

SEQ ID NO: 128250 - DNA, 25 bp, Homo sapien
gctcgtcccggagtgctcctgggac

SEQ ID NO: 128251 - DNA, 25 bp, Homo sapien
gacacagctcccgtcattcaatatg

SEQ ID NO: 128252 - DNA, 25 bp, Homo sapien
gtccgcgttgtcctggagatgcagc

SEQ ID NO: 128253 - DNA, 25 bp, Homo sapien
gcaggtggcatgacacccacccggg

SEQ ID NO: 128254 - DNA, 25 bp, Homo sapien
tcgaggttggggttccgtgaacaca

SEQ ID NO: 128255 - DNA, 25 bp, Homo sapien
ccactgtggaggcgaaaggtaagaa

SEQ ID NO: 128256 - DNA, 25 bp, Homo sapien
tcaatatggcaaagtgtggtggtgc

SEQ ID NO: 128257 - DNA, 25 bp, Homo sapien
tcccgtcattcaatatggcaaagtg

SEQ ID NO: 128258 - DNA, 25 bp, Homo sapien
tgcagccgacatcggcctgcttgtc

SEQ ID NO: 128259 - DNA, 25 bp, Homo sapien
gctcatttgcatgcgtccgcggccc

SEQ ID NO: 128260 - DNA, 25 bp, Homo sapien
ggcggctaaagcgacgtgtccttgt

SEQ ID NO: 128261 - DNA, 25 bp, Homo sapien
gcggctaaagcgacgtgtccttgtc

SEQ ID NO: 128262 - DNA, 25 bp, Homo sapien
cggctaaagcgacgtgtccttgtcc

SEQ ID NO: 128263 - DNA, 25 bp, Homo sapien
ggctaaagcgacgtgtccttgtccc

SEQ ID NO: 128264 - DNA, 25 bp, Homo sapien
gctaaagcgacgtgtccttgtcccc

SEQ ID NO: 128265 - DNA, 25 bp, Homo sapien
ccttgtcccccgtgggcagcctcgg

SEQ ID NO: 128266 - DNA, 25 bp, Homo sapien
cgtgtggccgcggatccccaggtaa

SEQ ID NO: 128267 - DNA, 25 bp, Homo sapien
gctaaataacgccttccaggccctg

SEQ ID NO: 128268 - DNA, 25 bp, Homo sapien
cgtcgtgacagcagcatccagcggc

SEQ ID NO: 128269 - DNA, 25 bp, Homo sapien
gctcacgctggccaagaactacatc

SEQ ID NO: 128270 - DNA, 25 bp, Homo sapien
ggccaagaactacatcaaatcgctg

SEQ ID NO: 128271 - DNA, 25 bp, Homo sapien
aagatcgagacgctcacgctggcca

SEQ ID NO: 128272 - DNA, 25 bp, Homo sapien
cggcagcggatgcacaagctaaata

SEQ ID NO: 128273 - DNA, 25 bp, Homo sapien
gtggccgtcgtgacagcagcatcca

SEQ ID NO: 128274 - DNA, 25 bp, Homo sapien
ggatgcacaagctaaataacgcctt

SEQ ID NO: 128275 - DNA, 25 bp, Homo sapien
tcaggagtccagagtcggctgaagc

SEQ ID NO: 128276 - DNA, 25 bp, Homo sapien
ctccaggacccggtctgcaggagcg

SEQ ID NO: 128277 - DNA, 25 bp, Homo sapien
gctgaagcgagttgccgcgttctct

SEQ ID NO: 128278 - DNA, 25 bp, Homo sapien
caccttccaggtgtgcaggcgagat

SEQ ID NO: 128279 - DNA, 25 bp, Homo sapien
acgctgcgacctgggacgtgcgatt

SEQ ID NO: 128280 - DNA, 25 bp, Homo sapien
gagatgacaagtgcggtccctcctt

SEQ ID NO: 128281 - DNA, 25 bp, Homo sapien
tcctatggctccagtccaaaggctg

SEQ ID NO: 128282 - DNA, 25 bp, Homo sapien
aacttcgctagcctgtgggcgttcc

SEQ ID NO: 128283 - DNA, 25 bp, Homo sapien
ggctctagtcctcgggcccgtcgta

SEQ ID NO: 128284 - DNA, 25 bp, Homo sapien
ctacctcgtcacaggtgggcccgta

SEQ ID NO: 128285 - DNA, 25 bp, Homo sapien
gtcatgaccctatggggcgtctctg

SEQ ID NO: 128286 - DNA, 25 bp, Homo sapien
tccgcgagccctaaaggtcatgacc

SEQ ID NO: 128287 - DNA, 25 bp, Homo sapien
ccagatgaactttgtgtcacgaggc

SEQ ID NO: 128288 - DNA, 25 bp, Homo sapien
tttgtgtcacgaggcgctcgctgtt

SEQ ID NO: 128289 - DNA, 25 bp, Homo sapien
ctcgctgttggcagattagcgccga

SEQ ID NO: 128290 - DNA, 25 bp, Homo sapien
attagcgccgaatcaggcccgcggt

SEQ ID NO: 128291 - DNA, 25 bp, Homo sapien
gcgcgtctccgctgcgaaaatgtca

SEQ ID NO: 128292 - DNA, 25 bp, Homo sapien
atgtcaaaacttgcggcagcgccgc

SEQ ID NO: 128293 - DNA, 25 bp, Homo sapien
tccgctgcgaaaatgtcaaaacttg

SEQ ID NO: 128294 - DNA, 25 bp, Homo sapien
gtgctctccgtgagccggttcacct

SEQ ID NO: 128295 - DNA, 25 bp, Homo sapien
cttacccggtaggtgctctccgtga

SEQ ID NO: 128296 - DNA, 25 bp, Homo sapien
tgggcttacccggtaggtgctctcc

SEQ ID NO: 128297 - DNA, 25 bp, Homo sapien
ccctggccttcttcgaggagcagag

SEQ ID NO: 128298 - DNA, 25 bp, Homo sapien
ctgcgaaaatgtcaaaacttgcggc

SEQ ID NO: 128299 - DNA, 25 bp, Homo sapien
cacctcaggccctacctcgtcaagg

SEQ ID NO: 128300 - DNA, 25 bp, Homo sapien
tccctctgcaggtccaggtacgtgt

SEQ ID NO: 128301 - DNA, 25 bp, Homo sapien
ggggtcctcttcaccacgcacgtca

SEQ ID NO: 128302 - DNA, 25 bp, Homo sapien
ccgcaatgcccgagaggcggcaacg

SEQ ID NO: 128303 - DNA, 25 bp, Homo sapien
caatgcccgagaggcggcaacgtca

SEQ ID NO: 128304 - DNA, 25 bp, Homo sapien
cgtccctctgcaggtccaggtacgt

SEQ ID NO: 128305 - DNA, 25 bp, Homo sapien
cctctccagcctctcgagtcctgtc

SEQ ID NO: 128306 - DNA, 25 bp, Homo sapien
caggtccaggtacgtgtggccaagt

SEQ ID NO: 128307 - DNA, 25 bp, Homo sapien
tcaaggaccgcctggagagcctcga

SEQ ID NO: 128308 - DNA, 25 bp, Homo sapien
gcaaggacactatgggcgacctgcc

SEQ ID NO: 128309 - DNA, 25 bp, Homo sapien
atccgcgagctcacgggcaagctag

SEQ ID NO: 128310 - DNA, 25 bp, Homo sapien
tgcgcgagaccgtcgtgcagcagaa

SEQ ID NO: 128311 - DNA, 25 bp, Homo sapien
tagccgcttcgtgtgcacggcactg

SEQ ID NO: 128312 - DNA, 25 bp, Homo sapien
cgcggctactgccagcagcgaaggc

SEQ ID NO: 128313 - DNA, 25 bp, Homo sapien
ctgtgagacggcaggagacttctgc

SEQ ID NO: 128314 - DNA, 25 bp, Homo sapien
ctcgagacgacagcgcggctactgc

SEQ ID NO: 128315 - DNA, 25 bp, Homo sapien
ggccgcaacatctcgcagcagcttt

SEQ ID NO: 128316 - DNA, 25 bp, Homo sapien
ggccgctttcgctttcttctgccga

SEQ ID NO: 128317 - DNA, 25 bp, Homo sapien
cttctgccgaatggaacgtggtgac

SEQ ID NO: 128318 - DNA, 25 bp, Homo sapien
gccgctattgtctggctgcctgaca

SEQ ID NO: 128319 - DNA, 25 bp, Homo sapien
ccgctcgctctagagggcacagcaa

SEQ ID NO: 128320 - DNA, 25 bp, Homo sapien
ctgagacgtctgcaaggccgcaaca

SEQ ID NO: 128321 - DNA, 25 bp, Homo sapien
ccgcccagtcttcgttccgatttga

SEQ ID NO: 128322 - DNA, 25 bp, Homo sapien
ctgtggtatccggagacttcgtttc

SEQ ID NO: 128323 - DNA, 25 bp, Homo sapien
ggacagacggaatccatgtgttcag

SEQ ID NO: 128324 - DNA, 25 bp, Homo sapien
cacggacagacggaatccatgtgtt

SEQ ID NO: 128325 - DNA, 25 bp, Homo sapien
acagacggaatccatgtgttcagtg

SEQ ID NO: 128326 - DNA, 25 bp, Homo sapien
gtgttcagtgcagcgagcgaagcgt

SEQ ID NO: 128327 - DNA, 25 bp, Homo sapien
cggacagacggaatccatgtgttca

SEQ ID NO: 128328 - DNA, 25 bp, Homo sapien
tgcagcgagcgaagcgtgtgcacac

SEQ ID NO: 128329 - DNA, 25 bp, Homo sapien
atgtgttcagtgcagcgagcgaagc

SEQ ID NO: 128330 - DNA, 25 bp, Homo sapien
acggacagacggaatccatgtgttc

SEQ ID NO: 128331 - DNA, 25 bp, Homo sapien
caggcaagccagaggatgcggccga

SEQ ID NO: 128332 - DNA, 25 bp, Homo sapien
agctcgagaactgcggcggtcgctc

SEQ ID NO: 128333 - DNA, 25 bp, Homo sapien
gatgccgccggctctgactcagcgt

SEQ ID NO: 128334 - DNA, 25 bp, Homo sapien
aggcatcgacggatgcgccggccac

SEQ ID NO: 128335 - DNA, 25 bp, Homo sapien
cctccagtgcccaggcgactttggg

SEQ ID NO: 128336 - DNA, 25 bp, Homo sapien
agtgcccaggcgactttggggaaca

SEQ ID NO: 128337 - DNA, 25 bp, Homo sapien
ggaggccggattgcccagcgcctta

SEQ ID NO: 128338 - DNA, 25 bp, Homo sapien
acggtgccacctccgcaatccctgc

SEQ ID NO: 128339 - DNA, 25 bp, Homo sapien
gaaggtagcggcgaccacagcgccc

SEQ ID NO: 128340 - DNA, 25 bp, Homo sapien
cgtcaaggctgtcggggatttaaag

SEQ ID NO: 128341 - DNA, 25 bp, Homo sapien
cactggactcgttaggcccggcgcg

SEQ ID NO: 128342 - DNA, 25 bp, Homo sapien
cgggaaatggaagagttgacgactt

SEQ ID NO: 128343 - DNA, 25 bp, Homo sapien
ctctacgccggcactggactcgtta

SEQ ID NO: 128344 - DNA, 25 bp, Homo sapien
aaccggagggccgtttgtgagctga

SEQ ID NO: 128345 - DNA, 25 bp, Homo sapien
cgctcgccgtagctcggcctgggac

SEQ ID NO: 128346 - DNA, 25 bp, Homo sapien
tttgcggccgagctgagaggaagct

SEQ ID NO: 128347 - DNA, 25 bp, Homo sapien
acatgctggactcgctgcggatcta

SEQ ID NO: 128348 - DNA, 25 bp, Homo sapien
tgacaacaacaagaaccgcaacagc

SEQ ID NO: 128349 - DNA, 25 bp, Homo sapien
tgcgtggacccagcctgcaagtaca

SEQ ID NO: 128350 - DNA, 25 bp, Homo sapien
agcggacacttgctcctggcgcaca

SEQ ID NO: 128351 - DNA, 25 bp, Homo sapien
gcacattatcgccaaattcgccata

SEQ ID NO: 128352 - DNA, 25 bp, Homo sapien
cgccatacacaagaagatcgtcctg

SEQ ID NO: 128353 - DNA, 25 bp, Homo sapien
tcgtcctgcaggtattttgcaagcc

SEQ ID NO: 128354 - DNA, 25 bp, Homo sapien
ctgcggatctacctgctgcagtacg

SEQ ID NO: 128355 - DNA, 25 bp, Homo sapien
ctgcgccgtaattgatcggtgctta

SEQ ID NO: 128356 - DNA, 25 bp, Homo sapien
ggttaccacgagcatgaaattgaca

SEQ ID NO: 128357 - DNA, 25 bp, Homo sapien
gtgacaccggcttgtctgcgccgta

SEQ ID NO: 128358 - DNA, 25 bp, Homo sapien
aattgatcggtgcttaggagcaggc

SEQ ID NO: 128359 - DNA, 25 bp, Homo sapien
gctctttcttaaatggttaccacga

SEQ ID NO: 128360 - DNA, 25 bp, Homo sapien
ctttttacaaacacaaacgctgctg

SEQ ID NO: 128361 - DNA, 25 bp, Homo sapien
cattgtgaatcacatgtgacaccgg

SEQ ID NO: 128362 - DNA, 25 bp, Homo sapien
cgctgctgatttcttatcaaatgta

SEQ ID NO: 128363 - DNA, 25 bp, Homo sapien
cgtcagacaggcgatggccattctg

SEQ ID NO: 128364 - DNA, 25 bp, Homo sapien
cgcaatggaagctcgagcgatcgtc

SEQ ID NO: 128365 - DNA, 25 bp, Homo sapien
aggacgggcaccagatgctgaccca

SEQ ID NO: 128366 - DNA, 25 bp, Homo sapien
atgctgacccactggacccggaaga

SEQ ID NO: 128367 - DNA, 25 bp, Homo sapien
actggacccggaagatcattgtgga

SEQ ID NO: 128368 - DNA, 25 bp, Homo sapien
gctggtccacattctgcacctgata

SEQ ID NO: 128369 - DNA, 25 bp, Homo sapien
ctgcacctgatagtgcaacacttca

SEQ ID NO: 128370 - DNA, 25 bp, Homo sapien
acacttcaaggtgtgtaggagggac

SEQ ID NO: 128371 - DNA, 25 bp, Homo sapien
cgtgcacacgcctctcctacaggtg

SEQ ID NO: 128372 - DNA, 25 bp, Homo sapien
ctacaggtgcgtgcggtgcccccat

SEQ ID NO: 128373 - DNA, 25 bp, Homo sapien
acgtagtgtcccacgtgcacacgcc

SEQ ID NO: 128374 - DNA, 25 bp, Homo sapien
cttcatcgagcgcctggtggagatg

SEQ ID NO: 128375 - DNA, 25 bp, Homo sapien
gagcagcagctcagcttcatcgagc

SEQ ID NO: 128376 - DNA, 25 bp, Homo sapien
tgtggcctgtcgcagccaagcgccg

SEQ ID NO: 128377 - DNA, 25 bp, Homo sapien
ggcctgtggcctgtcgcagccaagc

SEQ ID NO: 128378 - DNA, 25 bp, Homo sapien
ccatgcgagcacaggcctgtggcct

SEQ ID NO: 128379 - DNA, 25 bp, Homo sapien
tctgagtttctgaccaccatcgggg

SEQ ID NO: 128380 - DNA, 25 bp, Homo sapien
tccatgattgcggtcgcccggtgct

SEQ ID NO: 128381 - DNA, 25 bp, Homo sapien
cggtgcttcgcccagccaaacttta

SEQ ID NO: 128382 - DNA, 25 bp, Homo sapien
ggatgccaaccgtcctgtcccattt

SEQ ID NO: 128383 - DNA, 25 bp, Homo sapien
tgggtctccacgtcgtcctatcaca

SEQ ID NO: 128384 - DNA, 25 bp, Homo sapien
cgatttgacataaacgacgcgactg

SEQ ID NO: 128385 - DNA, 25 bp, Homo sapien
ctcacgcccaacatttctgagtttc

SEQ ID NO: 128386 - DNA, 25 bp, Homo sapien
ggcccgttgacagcgtccatgattg

SEQ ID NO: 128387 - DNA, 25 bp, Homo sapien
ctgagcccgcagcttttacgacttc

SEQ ID NO: 128388 - DNA, 25 bp, Homo sapien
gccacccggaatgtgaagggcgctc

SEQ ID NO: 128389 - DNA, 25 bp, Homo sapien
actggtgtccctggttcagaaagcc

SEQ ID NO: 128390 - DNA, 25 bp, Homo sapien
ctggacaatctgtgccgcatggacc

SEQ ID NO: 128391 - DNA, 25 bp, Homo sapien
cgggacgagatcattgcttggcaca

SEQ ID NO: 128392 - DNA, 25 bp, Homo sapien
gccgcggcaaacagcctggacaatc

SEQ ID NO: 128393 - DNA, 25 bp, Homo sapien
acatggacagccagcaactggtgtc

SEQ ID NO: 128394 - DNA, 25 bp, Homo sapien
tcagaaagccgtcaccgccatcatg

SEQ ID NO: 128395 - DNA, 25 bp, Homo sapien
acgtcagtcaccttgcaaagccttg

SEQ ID NO: 128396 - DNA, 25 bp, Homo sapien
ggccacacagtgcttcagccgcgtg

SEQ ID NO: 128397 - DNA, 25 bp, Homo sapien
cagccgcgtgttcgacttccagtcg

SEQ ID NO: 128398 - DNA, 25 bp, Homo sapien
tggccctcctttcttcatcgaacgt

SEQ ID NO: 128399 - DNA, 25 bp, Homo sapien
ccttgcaaagccttgaagccttgga

SEQ ID NO: 128400 - DNA, 25 bp, Homo sapien
tagacgcgtcatcgaatagccctgc

SEQ ID NO: 128401 - DNA, 25 bp, Homo sapien
caccgcacgatgttgctgtcggcca

SEQ ID NO: 128402 - DNA, 25 bp, Homo sapien
gtggacccagtcacaaactgcagga

SEQ ID NO: 128403 - DNA, 25 bp, Homo sapien
cgtacctgtcagacggatcttgatg

SEQ ID NO: 128404 - DNA, 25 bp, Homo sapien
gtcttcacccttcctgtggtcggtg

SEQ ID NO: 128405 - DNA, 25 bp, Homo sapien
agatcggcgcttgctgcggcgctct

SEQ ID NO: 128406 - DNA, 25 bp, Homo sapien
tccgagccgggacacaaactccgcg

SEQ ID NO: 128407 - DNA, 25 bp, Homo sapien
cgccggccgtacctgtcagacggat

SEQ ID NO: 128408 - DNA, 25 bp, Homo sapien
tccaagggcgccctgcggggaattc

SEQ ID NO: 128409 - DNA, 25 bp, Homo sapien
gggttcgacatctcccgccaacgat

SEQ ID NO: 128410 - DNA, 25 bp, Homo sapien
gatcttgatgctggagccgttcctg

SEQ ID NO: 128411 - DNA, 25 bp, Homo sapien
tgtgagacgccggacttgtcgtaca

SEQ ID NO: 128412 - DNA, 25 bp, Homo sapien
gctccgtgcacacccagcggcccag

SEQ ID NO: 128413 - DNA, 25 bp, Homo sapien
gagccaccttccagggagcagtgtc

SEQ ID NO: 128414 - DNA, 25 bp, Homo sapien
atgtggtaacaaaggagccaccttc

SEQ ID NO: 128415 - DNA, 25 bp, Homo sapien
ggcctggcgtcaaatgtggtaacaa

SEQ ID NO: 128416 - DNA, 25 bp, Homo sapien
cgggccacagggctcgtcctacctg

SEQ ID NO: 128417 - DNA, 25 bp, Homo sapien
ccggacttgtcgtacacagccatga

SEQ ID NO: 128418 - DNA, 25 bp, Homo sapien
tcgtacacagccatgagggcaccgt

SEQ ID NO: 128419 - DNA, 25 bp, Homo sapien
ccgtgtccacttccgggatctgtca

SEQ ID NO: 128420 - DNA, 25 bp, Homo sapien
agcatctcctctgaagggccgccga

SEQ ID NO: 128421 - DNA, 25 bp, Homo sapien
aggatctcccgtaatcgagcgaccc

SEQ ID NO: 128422 - DNA, 25 bp, Homo sapien
attgtgtcaagtaggaggatctccc

SEQ ID NO: 128423 - DNA, 25 bp, Homo sapien
ggggcatttgtcaccgtctctaaaa

SEQ ID NO: 128424 - DNA, 25 bp, Homo sapien
tcaggatgttcgagctcctagccgc

SEQ ID NO: 128425 - DNA, 25 bp, Homo sapien
agcgccacacttcggctcgcgattg

SEQ ID NO: 128426 - DNA, 25 bp, Homo sapien
agggtcctacttgcacctctgctgg

SEQ ID NO: 128427 - DNA, 25 bp, Homo sapien
cgtccgggctcagaggacgtgactc

SEQ ID NO: 128428 - DNA, 25 bp, Homo sapien
acgtctgcgcgggtaccggcagcac

SEQ ID NO: 128429 - DNA, 25 bp, Homo sapien
gcgggacctggatctcgcgaccgct

SEQ ID NO: 128430 - DNA, 25 bp, Homo sapien
cccgcccacgaggaagtggctgctg

SEQ ID NO: 128431 - DNA, 25 bp, Homo sapien
cgcctggaagtgaggacgcatagat

SEQ ID NO: 128432 - DNA, 25 bp, Homo sapien
acgcatagatgtggggcgccgccca

SEQ ID NO: 128433 - DNA, 25 bp, Homo sapien
cagactgtggaaacgcgggctccca

SEQ ID NO: 128434 - DNA, 25 bp, Homo sapien
cccattggtaaagcattgacggtgg

SEQ ID NO: 128435 - DNA, 25 bp, Homo sapien
cggggcccatcttgatctcaccata

SEQ ID NO: 128436 - DNA, 25 bp, Homo sapien
ccgtctgtatccttgagctggcatc

SEQ ID NO: 128437 - DNA, 25 bp, Homo sapien
gactcgctgcggaataacatcgtta

SEQ ID NO: 128438 - DNA, 25 bp, Homo sapien
cttggcgccgtactaaaaccgcgtg

SEQ ID NO: 128439 - DNA, 25 bp, Homo sapien
tcggctcgcccagaaacagcgtcgg

SEQ ID NO: 128440 - DNA, 25 bp, Homo sapien
cgggcctagactcgctgcacaagaa

SEQ ID NO: 128441 - DNA, 25 bp, Homo sapien
ggctggacgttcctaagcagagctc

SEQ ID NO: 128442 - DNA, 25 bp, Homo sapien
gcttcccggtgctgttcacctatga

SEQ ID NO: 128443 - DNA, 25 bp, Homo sapien
ggctccgcaaggacctcatgcctta

SEQ ID NO: 128444 - DNA, 25 bp, Homo sapien
agcgcatcctagatccggctttcta

SEQ ID NO: 128445 - DNA, 25 bp, Homo sapien
gacggagtgactctgggacaccaca

SEQ ID NO: 128446 - DNA, 25 bp, Homo sapien
ccggaaatagcttgggctcgacttc

SEQ ID NO: 128447 - DNA, 25 bp, Homo sapien
tcagttcctagccagccaaagagtg

SEQ ID NO: 128448 - DNA, 25 bp, Homo sapien
ttctcgattaccttggcaacggctg

SEQ ID NO: 128449 - DNA, 25 bp, Homo sapien
caggagcttccggtatgtgttttcc

SEQ ID NO: 128450 - DNA, 25 bp, Homo sapien
tcatgccttagagatcgcctgaaga

SEQ ID NO: 128451 - DNA, 25 bp, Homo sapien
gcccgggaagatacgcagatcccta

SEQ ID NO: 128452 - DNA, 25 bp, Homo sapien
aacggcgtcactcctttcgtgcagc

SEQ ID NO: 128453 - DNA, 25 bp, Homo sapien
tgcagccaagttccaggcgcattgt

SEQ ID NO: 128454 - DNA, 25 bp, Homo sapien
ggcgcattgtgtactggtccgaact

SEQ ID NO: 128455 - DNA, 25 bp, Homo sapien
tcacaatttgggattagagcaaatc

SEQ ID NO: 128456 - DNA, 25 bp, Homo sapien
agtatttttctgcttgcctgcccgc

SEQ ID NO: 128457 - DNA, 25 bp, Homo sapien
gaaaggaagatccaagcggggctta

SEQ ID NO: 128458 - DNA, 25 bp, Homo sapien
ggtccgaacttgagctcacaatttg

SEQ ID NO: 128459 - DNA, 25 bp, Homo sapien
ggcgcagtggcatcgtctcactgtc

SEQ ID NO: 128460 - DNA, 25 bp, Homo sapien
ctttcagagcatcggcctatggaac

SEQ ID NO: 128461 - DNA, 25 bp, Homo sapien
cgctgtctatcagctgtgatttgta

SEQ ID NO: 128462 - DNA, 25 bp, Homo sapien
tctctatggggaaggcttcgctgtc

SEQ ID NO: 128463 - DNA, 25 bp, Homo sapien
gcccgagttggagcacggtctctat

SEQ ID NO: 128464 - DNA, 25 bp, Homo sapien
gactctggacttcgcaggttcctgc

SEQ ID NO: 128465 - DNA, 25 bp, Homo sapien
gccgcatcatcgagtgcacacactg

SEQ ID NO: 128466 - DNA, 25 bp, Homo sapien
tgcacacactgtggctgtcgtggct

SEQ ID NO: 128467 - DNA, 25 bp, Homo sapien
agtctcgattggcagtgcctggaca

SEQ ID NO: 128468 - DNA, 25 bp, Homo sapien
tgcggccgtccttcctcggagagac

SEQ ID NO: 128469 - DNA, 25 bp, Homo sapien
ggatcacacaggaactcacttgaag

SEQ ID NO: 128470 - DNA, 25 bp, Homo sapien
gcggcgaaccagtctcttcctcggg

SEQ ID NO: 128471 - DNA, 25 bp, Homo sapien
tgcaggaaatcatcgccagcgtgga

SEQ ID NO: 128472 - DNA, 25 bp, Homo sapien
gcgtggaccacatcaagtttgactt

SEQ ID NO: 128473 - DNA, 25 bp, Homo sapien
gcaagagcgactcgaacccgggacc

SEQ ID NO: 128474 - DNA, 25 bp, Homo sapien
cacttgaagtgtccggcgcagtgca

SEQ ID NO: 128475 - DNA, 25 bp, Homo sapien
aacagtggcccaaggcggcgcattc

SEQ ID NO: 128476 - DNA, 25 bp, Homo sapien
tctggcgcgcctcaagtgaggtcgt

SEQ ID NO: 128477 - DNA, 25 bp, Homo sapien
ccaaggcggcgcattcccaggccca

SEQ ID NO: 128478 - DNA, 25 bp, Homo sapien
tttcttagcggaaagaggaacagtg

SEQ ID NO: 128479 - DNA, 25 bp, Homo sapien
cggctatttcttagcggaaagagga

SEQ ID NO: 128480 - DNA, 25 bp, Homo sapien
aagcggctatttcttagcggaaaga

SEQ ID NO: 128481 - DNA, 25 bp, Homo sapien
agggaagcggctatttcttagcgga

SEQ ID NO: 128482 - DNA, 25 bp, Homo sapien
ctccacgcctaacccggttggcgca

SEQ ID NO: 128483 - DNA, 25 bp, Homo sapien
gggcgccactctctttgtctgacaa

SEQ ID NO: 128484 - DNA, 25 bp, Homo sapien
cacgtgactctctcggtgctgtctc

SEQ ID NO: 128485 - DNA, 25 bp, Homo sapien
tctgacaagagagtcgtgaagcctc

SEQ ID NO: 128486 - DNA, 25 bp, Homo sapien
cgcggaccagacagacctcgggtca

SEQ ID NO: 128487 - DNA, 25 bp, Homo sapien
agattcggagccgtcagcaggtttg

SEQ ID NO: 128488 - DNA, 25 bp, Homo sapien
tatttttggcggtgtcaagtcttcg

SEQ ID NO: 128489 - DNA, 25 bp, Homo sapien
tcttcggcagcgagaggagcaaagt

SEQ ID NO: 128490 - DNA, 25 bp, Homo sapien
gcaccagcttttgagtatttttggc

SEQ ID NO: 128491 - DNA, 25 bp, Homo sapien
gcctaaagtgcagtcgagaagtttc

SEQ ID NO: 128492 - DNA, 25 bp, Homo sapien
gtgaggtgcatctcgctggtttatc

SEQ ID NO: 128493 - DNA, 25 bp, Homo sapien
tgcgcctacaactctctcggtcaaa

SEQ ID NO: 128494 - DNA, 25 bp, Homo sapien
gggcggtcaagctggaattcatctt

SEQ ID NO: 128495 - DNA, 25 bp, Homo sapien
tcacgggcaaaagtccgtcgcgttg

SEQ ID NO: 128496 - DNA, 25 bp, Homo sapien
ccgggtgagtcttcctccactttca

SEQ ID NO: 128497 - DNA, 25 bp, Homo sapien
tcctggtaacgcagctgcctaaagt

SEQ ID NO: 128498 - DNA, 25 bp, Homo sapien
tcgggtctcagccaccgacgacaga

SEQ ID NO: 128499 - DNA, 25 bp, Homo sapien
ccgggtgcacgacgccagaatcact

SEQ ID NO: 128500 - DNA, 25 bp, Homo sapien
gcgcccttcgcctactgagaggaga

SEQ ID NO: 128501 - DNA, 25 bp, Homo sapien
cagaatcactgaggtgccggctccc

SEQ ID NO: 128502 - DNA, 25 bp, Homo sapien
ccgcggtgaaggctccaaggaacgc

SEQ ID NO: 128503 - DNA, 25 bp, Homo sapien
aaggctccaaggaacgcgcctgggc

SEQ ID NO: 128504 - DNA, 25 bp, Homo sapien
tggagcagcagttctccggcagccc

SEQ ID NO: 128505 - DNA, 25 bp, Homo sapien
ttcgcctactgagaggagaatgagg

SEQ ID NO: 128506 - DNA, 25 bp, Homo sapien
cccttcctcgagttgggcctttgag

SEQ ID NO: 128507 - DNA, 25 bp, Homo sapien
tggacttggttacttccggcgagga

SEQ ID NO: 128508 - DNA, 25 bp, Homo sapien
ggccaatcagacacgagcaacctca

SEQ ID NO: 128509 - DNA, 25 bp, Homo sapien
tcctagagaggacgcggaagtgctt

SEQ ID NO: 128510 - DNA, 25 bp, Homo sapien
caccttctgataggctcgcgagacc

SEQ ID NO: 128511 - DNA, 25 bp, Homo sapien
tgtgacgttgaagatgtcggccttc

SEQ ID NO: 128512 - DNA, 25 bp, Homo sapien
cagacctacttcaaatcggggcgca

SEQ ID NO: 128513 - DNA, 25 bp, Homo sapien
ctctccgtgggaagaaccgcatctt

SEQ ID NO: 128514 - DNA, 25 bp, Homo sapien
ccctggagacgtccgagtcactgag

SEQ ID NO: 128515 - DNA, 25 bp, Homo sapien
ggagcactggagtcttctgtataac

SEQ ID NO: 128516 - DNA, 25 bp, Homo sapien
ttttgcttgtgtcccacgctccaga

SEQ ID NO: 128517 - DNA, 25 bp, Homo sapien
agttctggctctggattttccgaga

SEQ ID NO: 128518 - DNA, 25 bp, Homo sapien
attttccgagatcgcgactgtggcc

SEQ ID NO: 128519 - DNA, 25 bp, Homo sapien
atgctcacaatgctcacctgcaggc

SEQ ID NO: 128520 - DNA, 25 bp, Homo sapien
aggcgccaaccgcatgctcacaatg

SEQ ID NO: 128521 - DNA, 25 bp, Homo sapien
gggcaccagcaaccagtggcgctca

SEQ ID NO: 128522 - DNA, 25 bp, Homo sapien
gtgcctcaccgtcccttttgcttgt

SEQ ID NO: 128523 - DNA, 25 bp, Homo sapien
cgaggggattgcaggacacagccat

SEQ ID NO: 128524 - DNA, 25 bp, Homo sapien
agccatgcacgtccaactctgtccc

SEQ ID NO: 128525 - DNA, 25 bp, Homo sapien
aagtgcgtcacacccgccttccgga

SEQ ID NO: 128526 - DNA, 25 bp, Homo sapien
aagcgtcacaaaagccggaagtgcg

SEQ ID NO: 128527 - DNA, 25 bp, Homo sapien
ccctggccttcagagcccagggaaa

SEQ ID NO: 128528 - DNA, 25 bp, Homo sapien
ggaccaggagcactagactcacatc

SEQ ID NO: 128529 - DNA, 25 bp, Homo sapien
tgactttggggaccaggagcactag

SEQ ID NO: 128530 - DNA, 25 bp, Homo sapien
cccgcccggagaagtctgggatgct

SEQ ID NO: 128531 - DNA, 25 bp, Homo sapien
tgcgttgctctcaggattccgggaa

SEQ ID NO: 128532 - DNA, 25 bp, Homo sapien
aggacgccgctcaaacctgttcgaa

SEQ ID NO: 128533 - DNA, 25 bp, Homo sapien
gctggtctgtatgtcctcactggtc

SEQ ID NO: 128534 - DNA, 25 bp, Homo sapien
ctggttcattcacctcgcggaccga

SEQ ID NO: 128535 - DNA, 25 bp, Homo sapien
agcttgttttgccttcacgggagta

SEQ ID NO: 128536 - DNA, 25 bp, Homo sapien
cgagccttcgaatcatggacgcgcg

SEQ ID NO: 128537 - DNA, 25 bp, Homo sapien
actggtcgcagtcattgttggtata

SEQ ID NO: 128538 - DNA, 25 bp, Homo sapien
tagagacgcccagtgagttagcatg

SEQ ID NO: 128539 - DNA, 25 bp, Homo sapien
gcgcagcggaccacgcggtttccat

SEQ ID NO: 128540 - DNA, 25 bp, Homo sapien
ttgcggggcttctgatcgcaggggc

SEQ ID NO: 128541 - DNA, 25 bp, Homo sapien
cagcttgcggggcttctgatcgcag

SEQ ID NO: 128542 - DNA, 25 bp, Homo sapien
gctggaaacgcagttggcggcgggg

SEQ ID NO: 128543 - DNA, 25 bp, Homo sapien
cccgtagcggctggaaacgcagttg

SEQ ID NO: 128544 - DNA, 25 bp, Homo sapien
gtgggctagctgtgcgccccagtgc

SEQ ID NO: 128545 - DNA, 25 bp, Homo sapien
cggaccacgcggtttccatgcgccc

SEQ ID NO: 128546 - DNA, 25 bp, Homo sapien
cgcagcggaccacgcggtttccatg

SEQ ID NO: 128547 - DNA, 25 bp, Homo sapien
ttgaagcctccctgtcataattggc

SEQ ID NO: 128548 - DNA, 25 bp, Homo sapien
tctccctgctgaagcgaccatctgg

SEQ ID NO: 128549 - DNA, 25 bp, Homo sapien
accatctggctgatagactcggcgc

SEQ ID NO: 128550 - DNA, 25 bp, Homo sapien
cgctgacccgcggaatcacggctaa

SEQ ID NO: 128551 - DNA, 25 bp, Homo sapien
tatttattcacaacagatcgggctg

SEQ ID NO: 128552 - DNA, 25 bp, Homo sapien
cagcctggtccacccgacattgaag

SEQ ID NO: 128553 - DNA, 25 bp, Homo sapien
gaggcccgccgtgaaatcggtttga

SEQ ID NO: 128554 - DNA, 25 bp, Homo sapien
atggcgtgtcaggtttttctctccc

SEQ ID NO: 128555 - DNA, 25 bp, Homo sapien
ggaagctccaggagcgcggtggagc

SEQ ID NO: 128556 - DNA, 25 bp, Homo sapien
cgcgaaaccgcctacgacggtgccg

SEQ ID NO: 128557 - DNA, 25 bp, Homo sapien
gctctgggacgcgaaaccgcctacg

SEQ ID NO: 128558 - DNA, 25 bp, Homo sapien
gcctctggggccaacggaagctcca

SEQ ID NO: 128559 - DNA, 25 bp, Homo sapien
gcgtctcctccgcagagctggagct

SEQ ID NO: 128560 - DNA, 25 bp, Homo sapien
ggcagacgccagggcctggtttccc

SEQ ID NO: 128561 - DNA, 25 bp, Homo sapien
aagccggtactgtgggcagacgcca

SEQ ID NO: 128562 - DNA, 25 bp, Homo sapien
ctgggacgcgaaaccgcctacgacg

SEQ ID NO: 128563 - DNA, 25 bp, Homo sapien
tgtatctggcgatgcaccgagtcct

SEQ ID NO: 128564 - DNA, 25 bp, Homo sapien
gagtctttccttacgcacctgtcta

SEQ ID NO: 128565 - DNA, 25 bp, Homo sapien
ctgggatcagcaaccatcgagacgc

SEQ ID NO: 128566 - DNA, 25 bp, Homo sapien
cgagtcctttccacggagggcaagc

SEQ ID NO: 128567 - DNA, 25 bp, Homo sapien
cgcgcattgaccgactggactctaa

SEQ ID NO: 128568 - DNA, 25 bp, Homo sapien
tcgcagccggaatagtcgcgcattg

SEQ ID NO: 128569 - DNA, 25 bp, Homo sapien
cctcttaagtgagccggttagatcc

SEQ ID NO: 128570 - DNA, 25 bp, Homo sapien
caggtgctgtgtccagtagtgtatc

SEQ ID NO: 128571 - DNA, 25 bp, Homo sapien
caagaccggaagctgctgggtatcc

SEQ ID NO: 128572 - DNA, 25 bp, Homo sapien
tggatgtcctcagcttccatgctgc

SEQ ID NO: 128573 - DNA, 25 bp, Homo sapien
ggcaggtcaactcctcctggatgtc

SEQ ID NO: 128574 - DNA, 25 bp, Homo sapien
ggaggccagacgacttccgaaccgc

SEQ ID NO: 128575 - DNA, 25 bp, Homo sapien
gacaccgggtcctggaaatagtcca

SEQ ID NO: 128576 - DNA, 25 bp, Homo sapien
acgcagtttctcttccggggttcag

SEQ ID NO: 128577 - DNA, 25 bp, Homo sapien
tgcgtcttctcagtcagcctggcca

SEQ ID NO: 128578 - DNA, 25 bp, Homo sapien
tcaccgcctcacgtaaaagggtaca

SEQ ID NO: 128579 - DNA, 25 bp, Homo sapien
ccagtatagggaaccaccgagatgc

SEQ ID NO: 128580 - DNA, 25 bp, Homo sapien
ctccgaagtcctagagagggcgcct

SEQ ID NO: 128581 - DNA, 25 bp, Homo sapien
cggttctgtttgttgctgtcactgc

SEQ ID NO: 128582 - DNA, 25 bp, Homo sapien
ccagcggctaggtgtgtagttgctt

SEQ ID NO: 128583 - DNA, 25 bp, Homo sapien
tcgtagggtacacgccctgggaatc

SEQ ID NO: 128584 - DNA, 25 bp, Homo sapien
gggctcctagcacgaggcctctgtc

SEQ ID NO: 128585 - DNA, 25 bp, Homo sapien
acgcagcgccagtctccggctgttg

SEQ ID NO: 128586 - DNA, 25 bp, Homo sapien
tgctgtttgttcttgccagcggcta

SEQ ID NO: 128587 - DNA, 25 bp, Homo sapien
caggtcggtctcgtacttgttctcc

SEQ ID NO: 128588 - DNA, 25 bp, Homo sapien
tggacggctccttcacgatgatggt

SEQ ID NO: 128589 - DNA, 25 bp, Homo sapien
ctcggcgccacccacgaaatggttt

SEQ ID NO: 128590 - DNA, 25 bp, Homo sapien
cctgtgagtgggtggacataattcc

SEQ ID NO: 128591 - DNA, 25 bp, Homo sapien
gggtccctgttgagactccttcatg

SEQ ID NO: 128592 - DNA, 25 bp, Homo sapien
aggctgggccgcattttggtatcaa

SEQ ID NO: 128593 - DNA, 25 bp, Homo sapien
gaaacaccttctggcacctcggacg

SEQ ID NO: 128594 - DNA, 25 bp, Homo sapien
ctgggacgtgtccatgatgtcgatc

SEQ ID NO: 128595 - DNA, 25 bp, Homo sapien
ctgttgtgcgaagagagtccatgcc

SEQ ID NO: 128596 - DNA, 25 bp, Homo sapien
cttccggcctttgtgactcattgtg

SEQ ID NO: 128597 - DNA, 25 bp, Homo sapien
cctggtccagcgattcggaaaccga

SEQ ID NO: 128598 - DNA, 25 bp, Homo sapien
tgattccggtgaggtgtctttttcc

SEQ ID NO: 128599 - DNA, 25 bp, Homo sapien
gtcgccatttgctttgattccggtg

SEQ ID NO: 128600 - DNA, 25 bp, Homo sapien
tctgctctcccttagtcgccatttg

SEQ ID NO: 128601 - DNA, 25 bp, Homo sapien
gaaagcgccgttcttcctgggagac

SEQ ID NO: 128602 - DNA, 25 bp, Homo sapien
catcgccctttgacgtttctgcaaa

SEQ ID NO: 128603 - DNA, 25 bp, Homo sapien
gctgggtcgccgttaaagtcacaaa

SEQ ID NO: 128604 - DNA, 25 bp, Homo sapien
ccctcgtgctaactgcgtacgctta

SEQ ID NO: 128605 - DNA, 25 bp, Homo sapien
tcctcgcctctctgtggtttgctga

SEQ ID NO: 128606 - DNA, 25 bp, Homo sapien
aggccctgttggaccctgtcacaga

SEQ ID NO: 128607 - DNA, 25 bp, Homo sapien
cctctgctggccacgaatgtgcgaa

SEQ ID NO: 128608 - DNA, 25 bp, Homo sapien
ccaagttagggtcgctgtcattagc

SEQ ID NO: 128609 - DNA, 25 bp, Homo sapien
gccacgggcgcgaataactgtgtta

SEQ ID NO: 128610 - DNA, 25 bp, Homo sapien
acgcccacttgttctgtctaggaaa

SEQ ID NO: 128611 - DNA, 25 bp, Homo sapien
gagggcggagcagcaacatctttcc

SEQ ID NO: 128612 - DNA, 25 bp, Homo sapien
caggggttcgttgaggcctccctgt

SEQ ID NO: 128613 - DNA, 25 bp, Homo sapien
ggagcagcaacatctttccctggga

SEQ ID NO: 128614 - DNA, 25 bp, Homo sapien
ggggacaccgaacatgcgccgctcg

SEQ ID NO: 128615 - DNA, 25 bp, Homo sapien
gagacctccttcaggggttcgttga

SEQ ID NO: 128616 - DNA, 25 bp, Homo sapien
gcacgccgcggggacaccgaacatg

SEQ ID NO: 128617 - DNA, 25 bp, Homo sapien
gtggcttccggagacctccttcagg

SEQ ID NO: 128618 - DNA, 25 bp, Homo sapien
gaacatgcgccgctcgccttacgga

SEQ ID NO: 128619 - DNA, 25 bp, Homo sapien
taccaggtgggattactagcttttc

SEQ ID NO: 128620 - DNA, 25 bp, Homo sapien
ctagcttttcttcaacatcgatggc

SEQ ID NO: 128621 - DNA, 25 bp, Homo sapien
tagcgcgtagtccttcagtgccatc

SEQ ID NO: 128622 - DNA, 25 bp, Homo sapien
gcaagccaatcaccgtgcgggccta

SEQ ID NO: 128623 - DNA, 25 bp, Homo sapien
ggccagcgcacacgcgttcttttgt

SEQ ID NO: 128624 - DNA, 25 bp, Homo sapien
tgtctactctccagaacggccatga

SEQ ID NO: 128625 - DNA, 25 bp, Homo sapien
attcttcattctgtcctccaagggg

SEQ ID NO: 128626 - DNA, 25 bp, Homo sapien
ggggacccgctcatctacaaagact

SEQ ID NO: 128627 - DNA, 25 bp, Homo sapien
aggacggtcgcccactgctccattt

SEQ ID NO: 128628 - DNA, 25 bp, Homo sapien
ctactctgtggtggttctgctgcag

SEQ ID NO: 128629 - DNA, 25 bp, Homo sapien
agtctgggcgataccattttgggca

SEQ ID NO: 128630 - DNA, 25 bp, Homo sapien
tgacgggcaaggacgtacgtaccgc

SEQ ID NO: 128631 - DNA, 25 bp, Homo sapien
gctggtctcgcacgacttctgcctt

SEQ ID NO: 128632 - DNA, 25 bp, Homo sapien
tcacatcgggaacttggggctgttc

SEQ ID NO: 128633 - DNA, 25 bp, Homo sapien
ctttcttcgagtgaggcaagaccta

SEQ ID NO: 128634 - DNA, 25 bp, Homo sapien
acgggcactcggatcacatcgggaa

SEQ ID NO: 128635 - DNA, 25 bp, Homo sapien
cgggaaacagcgcttcgcactggct

SEQ ID NO: 128636 - DNA, 25 bp, Homo sapien
atcaacgtgcgcctccgggaaacag

SEQ ID NO: 128637 - DNA, 25 bp, Homo sapien
acgtggccactgtccaatcctcatg

SEQ ID NO: 128638 - DNA, 25 bp, Homo sapien
tcctcatgctagaggcggggctaaa

SEQ ID NO: 128639 - DNA, 25 bp, Homo sapien
ggcctgaagccggaagctacctatc

SEQ ID NO: 128640 - DNA, 25 bp, Homo sapien
gctacctatctggtagggagctccc

SEQ ID NO: 128641 - DNA, 25 bp, Homo sapien
ccagcaccgaagactgcgatggtga

SEQ ID NO: 128642 - DNA, 25 bp, Homo sapien
gaggggatatcaccaatcaacgtgc

SEQ ID NO: 128643 - DNA, 25 bp, Homo sapien
cccagtggttcttgtgccctggacc

SEQ ID NO: 128644 - DNA, 25 bp, Homo sapien
aggaaggatgtctgttttcataacc

SEQ ID NO: 128645 - DNA, 25 bp, Homo sapien
tgcacattaacatcctcgggccgca

SEQ ID NO: 128646 - DNA, 25 bp, Homo sapien
cccggcccgtgcagatttaattagg

SEQ ID NO: 128647 - DNA, 25 bp, Homo sapien
cgccataaatatcggcctcgcgcag

SEQ ID NO: 128648 - DNA, 25 bp, Homo sapien
cgcagctgagctgaaacagaggctt

SEQ ID NO: 128649 - DNA, 25 bp, Homo sapien
ctcgccgactgctgtgaaatcactc

SEQ ID NO: 128650 - DNA, 25 bp, Homo sapien
acagaggctttttgtctgcgtggcc

SEQ ID NO: 128651 - DNA, 25 bp, Homo sapien
cccaagtacagatggttgcgccggg

SEQ ID NO: 128652 - DNA, 25 bp, Homo sapien
ggttgccagttctgcccaggctcct

SEQ ID NO: 128653 - DNA, 25 bp, Homo sapien
ccggcagcgcaacaccagcagaaaa

SEQ ID NO: 128654 - DNA, 25 bp, Homo sapien
accagcagaaaacggacagtctccc

SEQ ID NO: 128655 - DNA, 25 bp, Homo sapien
cacggccgggaagtacatcgagtag

SEQ ID NO: 128656 - DNA, 25 bp, Homo sapien
accggggtactgagccgaatgactg

SEQ ID NO: 128657 - DNA, 25 bp, Homo sapien
ctgagccgaatgactggagagaaac

SEQ ID NO: 128658 - DNA, 25 bp, Homo sapien
acatcgagtagtcgcactgggactc

SEQ ID NO: 128659 - DNA, 25 bp, Homo sapien
tcgtgtcccagtgcggccgttttca

SEQ ID NO: 128660 - DNA, 25 bp, Homo sapien
tgcccgtccaggtcgtgtcccagtg

SEQ ID NO: 128661 - DNA, 25 bp, Homo sapien
agctgtagccgacgccgccgtgtcg

SEQ ID NO: 128662 - DNA, 25 bp, Homo sapien
ccaccttgagctcggggttgttgac

SEQ ID NO: 128663 - DNA, 25 bp, Homo sapien
caagtacctgcgagcagagcagccc

SEQ ID NO: 128664 - DNA, 25 bp, Homo sapien
gtccgctgccatgcgagagtctccg

SEQ ID NO: 128665 - DNA, 25 bp, Homo sapien
gagagtctccgcacaccgtcaggga

SEQ ID NO: 128666 - DNA, 25 bp, Homo sapien
cgttttcattctggccgtggccgcc

SEQ ID NO: 128667 - DNA, 25 bp, Homo sapien
agtctggtccaaaacccgcccaatg

SEQ ID NO: 128668 - DNA, 25 bp, Homo sapien
aacctcgcgatagctactggccctg

SEQ ID NO: 128669 - DNA, 25 bp, Homo sapien
cccgcccaatggagtaggagattga

SEQ ID NO: 128670 - DNA, 25 bp, Homo sapien
ttaagccaatgtagcgcggaagctc

SEQ ID NO: 128671 - DNA, 25 bp, Homo sapien
gcgctgctccggaaaactgaatacc

SEQ ID NO: 128672 - DNA, 25 bp, Homo sapien
tgtcttgtacgttcccgcgcttttc

SEQ ID NO: 128673 - DNA, 25 bp, Homo sapien
gcgcttgcgcacagcgtgtcttgta

SEQ ID NO: 128674 - DNA, 25 bp, Homo sapien
cgtgactcaaacgtggcgcgcatca

SEQ ID NO: 128675 - DNA, 25 bp, Homo sapien
cgagcccacagtgcgcccggcggct

SEQ ID NO: 128676 - DNA, 25 bp, Homo sapien
gagacgcagggacctgcgcgtcgca

SEQ ID NO: 128677 - DNA, 25 bp, Homo sapien
atcatctgacgagcccacagtgcgc

SEQ ID NO: 128678 - DNA, 25 bp, Homo sapien
aatcatctgacgagcccacagtgcg

SEQ ID NO: 128679 - DNA, 25 bp, Homo sapien
acaatcatctgacgagcccacagtg

SEQ ID NO: 128680 - DNA, 25 bp, Homo sapien
aggagcccccacaatcatctgacga

SEQ ID NO: 128681 - DNA, 25 bp, Homo sapien
cctgggcgtcatcccgcgcgagcat

SEQ ID NO: 128682 - DNA, 25 bp, Homo sapien
atcccgcgcgagcatccgcaggctg

SEQ ID NO: 128683 - DNA, 25 bp, Homo sapien
ctgcggggctctcccggtgctgctg

SEQ ID NO: 128684 - DNA, 25 bp, Homo sapien
tgtagtccgcctgcggggctctccc

SEQ ID NO: 128685 - DNA, 25 bp, Homo sapien
ttgtagtccgcctgcggggctctcc

SEQ ID NO: 128686 - DNA, 25 bp, Homo sapien
cttgtagtccgcctgcggggctctc

SEQ ID NO: 128687 - DNA, 25 bp, Homo sapien
tcacggatccgtcactgcagccgcc

SEQ ID NO: 128688 - DNA, 25 bp, Homo sapien
tccattcacggatccgtcactgcag

SEQ ID NO: 128689 - DNA, 25 bp, Homo sapien
atccattcacggatccgtcactgca

SEQ ID NO: 128690 - DNA, 25 bp, Homo sapien
attcacggatccgtcactgcagccg

SEQ ID NO: 128691 - DNA, 25 bp, Homo sapien
ccgtaggtgaacagcgggatactct

SEQ ID NO: 128692 - DNA, 25 bp, Homo sapien
cttggcgacgctggcaacttgcagc

SEQ ID NO: 128693 - DNA, 25 bp, Homo sapien
acaggaaggcaagtttgatcaggcc

SEQ ID NO: 128694 - DNA, 25 bp, Homo sapien
tggcaacttgcagccggtgctccag

SEQ ID NO: 128695 - DNA, 25 bp, Homo sapien
agcgggatactctccttggcgacgc

SEQ ID NO: 128696 - DNA, 25 bp, Homo sapien
gtgctccaggatgtggagttccatc

SEQ ID NO: 128697 - DNA, 25 bp, Homo sapien
tccggctttgtcagacgcgagcgaa

SEQ ID NO: 128698 - DNA, 25 bp, Homo sapien
gatgtggagttccatcgtccgcccg

SEQ ID NO: 128699 - DNA, 25 bp, Homo sapien
gtggagcccacctgcatgtactggc

SEQ ID NO: 128700 - DNA, 25 bp, Homo sapien
ggagcccacctgcatgtactggctc

SEQ ID NO: 128701 - DNA, 25 bp, Homo sapien
gtttccgaccgttggtgtctggcac

SEQ ID NO: 128702 - DNA, 25 bp, Homo sapien
ttccgagcgttggtgtctggcggtt

SEQ ID NO: 128703 - DNA, 25 bp, Homo sapien
cacctaatgggcaccggatcgctgg

SEQ ID NO: 128704 - DNA, 25 bp, Homo sapien
caaggcgcacctaatgggcaccgga

SEQ ID NO: 128705 - DNA, 25 bp, Homo sapien
ggcttcaaggcgcacctaatgggca

SEQ ID NO: 128706 - DNA, 25 bp, Homo sapien
cccaacatgcacggcaggagcggcg

SEQ ID NO: 128707 - DNA, 25 bp, Homo sapien
cgcacgctgcgtttaccaaacttaa

SEQ ID NO: 128708 - DNA, 25 bp, Homo sapien
ctcccagagccgttaagttggttcg

SEQ ID NO: 128709 - DNA, 25 bp, Homo sapien
tcctcaggaacaagggtcgggtgtc

SEQ ID NO: 128710 - DNA, 25 bp, Homo sapien
cgggtgtcaaggagaccttttcaca

SEQ ID NO: 128711 - DNA, 25 bp, Homo sapien
gacctatcgcgttttactgagccca

SEQ ID NO: 128712 - DNA, 25 bp, Homo sapien
ggggaggtttgctaccaacagctca

SEQ ID NO: 128713 - DNA, 25 bp, Homo sapien
cgctccctcggaagcgcttctaaga

SEQ ID NO: 128714 - DNA, 25 bp, Homo sapien
tcgtagtctgatgcgcgcgcaacca

SEQ ID NO: 128715 - DNA, 25 bp, Homo sapien
agagccaatttctccctgagcgcgg

SEQ ID NO: 128716 - DNA, 25 bp, Homo sapien
cagcggatctggaacgactttctca

SEQ ID NO: 128717 - DNA, 25 bp, Homo sapien
tgcaggctcaccaggtcccggaaga

SEQ ID NO: 128718 - DNA, 25 bp, Homo sapien
cctgttgtcgctcccaggcgtcatt

SEQ ID NO: 128719 - DNA, 25 bp, Homo sapien
gacgctccaacggtcaggggacaca

SEQ ID NO: 128720 - DNA, 25 bp, Homo sapien
acggccttcgcagcatcaaagtggc

SEQ ID NO: 128721 - DNA, 25 bp, Homo sapien
gactttctcagctgttcctccacgg

SEQ ID NO: 128722 - DNA, 25 bp, Homo sapien
ctgagcgcggcattcagaacctgtt

SEQ ID NO: 128723 - DNA, 25 bp, Homo sapien
acacgtccagcgaccgcggcgataa

SEQ ID NO: 128724 - DNA, 25 bp, Homo sapien
agtccgccgaagctgtggggctcca

SEQ ID NO: 128725 - DNA, 25 bp, Homo sapien
ggtctcgctcataaacatccacaca

SEQ ID NO: 128726 - DNA, 25 bp, Homo sapien
agcgaccgcggcgataaggctctcc

SEQ ID NO: 128727 - DNA, 25 bp, Homo sapien
gcggcgataaggctctcccaggccg

SEQ ID NO: 128728 - DNA, 25 bp, Homo sapien
tctcccaggccgtggggcagcttca

SEQ ID NO: 128729 - DNA, 25 bp, Homo sapien
cagcttcaccacccggaaacgggag

SEQ ID NO: 128730 - DNA, 25 bp, Homo sapien
gggctccaggtctcgctcataaaca

SEQ ID NO: 128731 - DNA, 25 bp, Homo sapien
tccgaggaaagtttgctctccggaa

SEQ ID NO: 128732 - DNA, 25 bp, Homo sapien
ctctgctcccggtggcagccagcga

SEQ ID NO: 128733 - DNA, 25 bp, Homo sapien
cgcctaagaggtcgggctgtccgtt

SEQ ID NO: 128734 - DNA, 25 bp, Homo sapien
gcgatcagaggctgtcccgtcctct

SEQ ID NO: 128735 - DNA, 25 bp, Homo sapien
catctccgaggaaagtttgctctcc

SEQ ID NO: 128736 - DNA, 25 bp, Homo sapien
ccagcgagtgggtgtcccgagtctc

SEQ ID NO: 128737 - DNA, 25 bp, Homo sapien
cccgagtctcctcccgcgtgaccct

SEQ ID NO: 128738 - DNA, 25 bp, Homo sapien
atcctgccaggcatctccgaggaaa

SEQ ID NO: 128739 - DNA, 25 bp, Homo sapien
agcggacgcccaaagaccgcgacgg

SEQ ID NO: 128740 - DNA, 25 bp, Homo sapien
gggagaccgaactcagcaccgaccg

SEQ ID NO: 128741 - DNA, 25 bp, Homo sapien
gcgagccaactcaggtgctctcctg

SEQ ID NO: 128742 - DNA, 25 bp, Homo sapien
agcccagacggtggaacgagatccg

SEQ ID NO: 128743 - DNA, 25 bp, Homo sapien
cggatagctttgagcccagacggtg

SEQ ID NO: 128744 - DNA, 25 bp, Homo sapien
caggtcgaccctggtcgttgcgagc

SEQ ID NO: 128745 - DNA, 25 bp, Homo sapien
gtcaaaggtcacgagaggaggactc

SEQ ID NO: 128746 - DNA, 25 bp, Homo sapien
tggccacactcaggtcgaccctggt

SEQ ID NO: 128747 - DNA, 25 bp, Homo sapien
ccaagtaatcagtcggaacagcctc

SEQ ID NO: 128748 - DNA, 25 bp, Homo sapien
tgcctgggtaattggagacgaactc

SEQ ID NO: 128749 - DNA, 25 bp, Homo sapien
atctggcccaatattcattagtgtg

SEQ ID NO: 128750 - DNA, 25 bp, Homo sapien
gtgtggcttgatcgttaaacagtta

SEQ ID NO: 128751 - DNA, 25 bp, Homo sapien
ccgtgtttggttcatgacaaggccc

SEQ ID NO: 128752 - DNA, 25 bp, Homo sapien
gccgataattcacaggcgcctccag

SEQ ID NO: 128753 - DNA, 25 bp, Homo sapien
cacccgctcactcctgtttatgaag

SEQ ID NO: 128754 - DNA, 25 bp, Homo sapien
cgtggggctttctgacagccgataa

SEQ ID NO: 128755 - DNA, 25 bp, Homo sapien
ctctgaagagagtgaggccatctat

SEQ ID NO: 128756 - DNA, 25 bp, Homo sapien
ggaaggccgggccaatggccctcca

SEQ ID NO: 128757 - DNA, 25 bp, Homo sapien
gccacaacagcctcacgcccttccg

SEQ ID NO: 128758 - DNA, 25 bp, Homo sapien
gagagtgaggccatctatgaagaga

SEQ ID NO: 128759 - DNA, 25 bp, Homo sapien
ggcgccgactcggactctgaagaga

SEQ ID NO: 128760 - DNA, 25 bp, Homo sapien
aatggccctccaccattgacggcaa

SEQ ID NO: 128761 - DNA, 25 bp, Homo sapien
tctatgaagagatgaagtacccgct

SEQ ID NO: 128762 - DNA, 25 bp, Homo sapien
tgaagagatgaagtacccgctgccg

SEQ ID NO: 128763 - DNA, 25 bp, Homo sapien
tcctctgggacaccgccatctgagg

SEQ ID NO: 128764 - DNA, 25 bp, Homo sapien
cggcagtgcggacccgtccggtcat

SEQ ID NO: 128765 - DNA, 25 bp, Homo sapien
agcgctgcgtgtgcaaggagatcaa

SEQ ID NO: 128766 - DNA, 25 bp, Homo sapien
caaggagatcaaggcgcgccaccgc

SEQ ID NO: 128767 - DNA, 25 bp, Homo sapien
accgcccggaccgaggcctctgcaa

SEQ ID NO: 128768 - DNA, 25 bp, Homo sapien
gacccgtccggtcatgctgaggtcc

SEQ ID NO: 128769 - DNA, 25 bp, Homo sapien
aagcaggagagcatgcccatcctcc

SEQ ID NO: 128770 - DNA, 25 bp, Homo sapien
cggcagcacacggtcctctgggaca

SEQ ID NO: 128771 - DNA, 25 bp, Homo sapien
tcggggtctccacggagactgagtc

SEQ ID NO: 128772 - DNA, 25 bp, Homo sapien
ctctcgtaaagaacaaaggctccgc

SEQ ID NO: 128773 - DNA, 25 bp, Homo sapien
cagcgtacctccaaaatgaactttc

SEQ ID NO: 128774 - DNA, 25 bp, Homo sapien
atgaactttcttcttgaaccgtgaa

SEQ ID NO: 128775 - DNA, 25 bp, Homo sapien
accgtgaattctcggccatcctttc

SEQ ID NO: 128776 - DNA, 25 bp, Homo sapien
ttctaacctgggtgtgaccatctca

SEQ ID NO: 128777 - DNA, 25 bp, Homo sapien
ggcaggactgcccaagtcccacggt

SEQ ID NO: 128778 - DNA, 25 bp, Homo sapien
tgtgaccatctcactcggaccactg

SEQ ID NO: 128779 - DNA, 25 bp, Homo sapien
cgggaattaacgtcatcagtcggga

SEQ ID NO: 128780 - DNA, 25 bp, Homo sapien
tcatcagtcgggaggacgacagcta

SEQ ID NO: 128781 - DNA, 25 bp, Homo sapien
ctgtctcgcgcgctaactttgcagc

SEQ ID NO: 128782 - DNA, 25 bp, Homo sapien
caatcaaaattagcgtcggagcccg

SEQ ID NO: 128783 - DNA, 25 bp, Homo sapien
gaggactcaccaatcggaactagga

SEQ ID NO: 128784 - DNA, 25 bp, Homo sapien
tctctgccggccaataggagaggcc

SEQ ID NO: 128785 - DNA, 25 bp, Homo sapien
ctagccaatcagtgtgcaggacggg

SEQ ID NO: 128786 - DNA, 25 bp, Homo sapien
ccgctcccgagcttctgtcagggga

SEQ ID NO: 128787 - DNA, 25 bp, Homo sapien
tgcaccaccagcaagtgcgcagatg

SEQ ID NO: 128788 - DNA, 25 bp, Homo sapien
cgtgatacaacaccctgctcgagga

SEQ ID NO: 128789 - DNA, 25 bp, Homo sapien
aaactccagttcctgggcgacgtga

SEQ ID NO: 128790 - DNA, 25 bp, Homo sapien
aggggcaacagtcaccgggacactc

SEQ ID NO: 128791 - DNA, 25 bp, Homo sapien
ccgcagtcagctgatcggtagagac

SEQ ID NO: 128792 - DNA, 25 bp, Homo sapien
tgttccgagagcgagcagaagtttc

SEQ ID NO: 128793 - DNA, 25 bp, Homo sapien
cctataaaggctcagtcttggggtc

SEQ ID NO: 128794 - DNA, 25 bp, Homo sapien
gacactcgctgtgcgcagagtcctt

SEQ ID NO: 128795 - DNA, 25 bp, Homo sapien
gggctcggcgacaaatgagacgcaa

SEQ ID NO: 128796 - DNA, 25 bp, Homo sapien
tttattgcggctgacacgacacctg

SEQ ID NO: 128797 - DNA, 25 bp, Homo sapien
ggcttctggcttctgtttattgcgg

SEQ ID NO: 128798 - DNA, 25 bp, Homo sapien
tcaccacgtgcttctctgagagcgc

SEQ ID NO: 128799 - DNA, 25 bp, Homo sapien
gcgacgcacgtgctctcagacacag

SEQ ID NO: 128800 - DNA, 25 bp, Homo sapien
cgcaagaaagctgtcagcgataaca

SEQ ID NO: 128801 - DNA, 25 bp, Homo sapien
cagcgataacagaagggaggtgaca

SEQ ID NO: 128802 - DNA, 25 bp, Homo sapien
cagttacacctgagggccacccaga

SEQ ID NO: 128803 - DNA, 25 bp, Homo sapien
aggcgggtgagctagaactttaaga

SEQ ID NO: 128804 - DNA, 25 bp, Homo sapien
acctccgactgtgaagcctctggca

SEQ ID NO: 128805 - DNA, 25 bp, Homo sapien
tccgaagggaatctggacctgcctc

SEQ ID NO: 128806 - DNA, 25 bp, Homo sapien
gagtgactgtcaagaaggccaatta

SEQ ID NO: 128807 - DNA, 25 bp, Homo sapien
ggacaccggcactccactagcagga

SEQ ID NO: 128808 - DNA, 25 bp, Homo sapien
agcgcagctgcacccaatcacaatg

SEQ ID NO: 128809 - DNA, 25 bp, Homo sapien
gacgcgtcagaagcggccaatcaga

SEQ ID NO: 128810 - DNA, 25 bp, Homo sapien
tgagggacggctctacctaccaata

SEQ ID NO: 128811 - DNA, 25 bp, Homo sapien
ctggcggcagaagtctcccttgcaa

SEQ ID NO: 128812 - DNA, 25 bp, Homo sapien
cttgcaatgtttcaggcggggacct

SEQ ID NO: 128813 - DNA, 25 bp, Homo sapien
ctctccagcctgaaaggggactctg

SEQ ID NO: 128814 - DNA, 25 bp, Homo sapien
tctcctgaagctgaccgagggtctc

SEQ ID NO: 128815 - DNA, 25 bp, Homo sapien
ggcatcagctgttcctggcacatca

SEQ ID NO: 128816 - DNA, 25 bp, Homo sapien
ccagcttgcagccagcagagattta

SEQ ID NO: 128817 - DNA, 25 bp, Homo sapien
cctggtataacacgcgggcctgtca

SEQ ID NO: 128818 - DNA, 25 bp, Homo sapien
gtgcgccaggacttgaccttgccaa

SEQ ID NO: 128819 - DNA, 25 bp, Homo sapien
aactgcgcttcgcttccgaggtaaa

SEQ ID NO: 128820 - DNA, 25 bp, Homo sapien
cggatctagtattcagggcggacca

SEQ ID NO: 128821 - DNA, 25 bp, Homo sapien
cgagcgaccgttttgaggcagaagc

SEQ ID NO: 128822 - DNA, 25 bp, Homo sapien
tggcaggtgctttaaccacaaggtg

SEQ ID NO: 128823 - DNA, 25 bp, Homo sapien
ggactctctggaacatggcaacatt

SEQ ID NO: 128824 - DNA, 25 bp, Homo sapien
gtcctagccaatgacagaggccgta

SEQ ID NO: 128825 - DNA, 25 bp, Homo sapien
gtctttcagcacaccaatcggcgta

SEQ ID NO: 128826 - DNA, 25 bp, Homo sapien
gtacaactgttacgtcaccggaatc

SEQ ID NO: 128827 - DNA, 25 bp, Homo sapien
cgctaagcgcattggctgccccttg

SEQ ID NO: 128828 - DNA, 25 bp, Homo sapien
gccccttgcagcgtccaggtgagca

SEQ ID NO: 128829 - DNA, 25 bp, Homo sapien
agcagggctagctgacgccggaaac

SEQ ID NO: 128830 - DNA, 25 bp, Homo sapien
tagctgacgccggaaacggctctcc

SEQ ID NO: 128831 - DNA, 25 bp, Homo sapien
cgccggaaacggctctcctggaagc

SEQ ID NO: 128832 - DNA, 25 bp, Homo sapien
gcgtgtggtctccacggcccatgaa

SEQ ID NO: 128833 - DNA, 25 bp, Homo sapien
tctccacggcccatgaagatgtggc

SEQ ID NO: 128834 - DNA, 25 bp, Homo sapien
acggcccatgaagatgtggcggaac

SEQ ID NO: 128835 - DNA, 25 bp, Homo sapien
atgcgtgtcagtcgctcgtctctct

SEQ ID NO: 128836 - DNA, 25 bp, Homo sapien
gccgagtacacccactgcagggtca

SEQ ID NO: 128837 - DNA, 25 bp, Homo sapien
agcttttccgccgcccggatgtagt

SEQ ID NO: 128838 - DNA, 25 bp, Homo sapien
tccgagctgtagatctcctgccgca

SEQ ID NO: 128839 - DNA, 25 bp, Homo sapien
gggcggggcctcacccgcattatgc

SEQ ID NO: 128840 - DNA, 25 bp, Homo sapien
ccgcattatgcgcacgttgtacatg

SEQ ID NO: 128841 - DNA, 25 bp, Homo sapien
atgcgcacgttgtacatgcgtgtca

SEQ ID NO: 128842 - DNA, 25 bp, Homo sapien
agctgtagatctcctgccgcagctt

SEQ ID NO: 128843 - DNA, 25 bp, Homo sapien
gatgggatcgaacccagcaaggtga

SEQ ID NO: 128844 - DNA, 25 bp, Homo sapien
agctcatcttcggagaccgcgcggc

SEQ ID NO: 128845 - DNA, 25 bp, Homo sapien
cggctccgagcgaccaggaacgccc

SEQ ID NO: 128846 - DNA, 25 bp, Homo sapien
gtcactccgcggtgagtggcgccat

SEQ ID NO: 128847 - DNA, 25 bp, Homo sapien
gcctattttccgacacccgcctgca

SEQ ID NO: 128848 - DNA, 25 bp, Homo sapien
cgagtgcagattcccgcctattttc

SEQ ID NO: 128849 - DNA, 25 bp, Homo sapien
cgggcgccagatgggatcgaaccca

SEQ ID NO: 128850 - DNA, 25 bp, Homo sapien
gcagattcccgcctattttccgaca

SEQ ID NO: 128851 - DNA, 25 bp, Homo sapien
cgcgcactcacggatccgggaattg

SEQ ID NO: 128852 - DNA, 25 bp, Homo sapien
tcccgaaggctggtttgcctaagcg

SEQ ID NO: 128853 - DNA, 25 bp, Homo sapien
ggtccacacgtggtccagcttctgg

SEQ ID NO: 128854 - DNA, 25 bp, Homo sapien
cccacgtagtgcgtgtcggtccaca

SEQ ID NO: 128855 - DNA, 25 bp, Homo sapien
ccgcgcgaatgtcctgagtcagagc

SEQ ID NO: 128856 - DNA, 25 bp, Homo sapien
cctcatcgacccagtgcagggtgtt

SEQ ID NO: 128857 - DNA, 25 bp, Homo sapien
gcagtagacgtcagggtcctccagc

SEQ ID NO: 128858 - DNA, 25 bp, Homo sapien
ggcgtacaccagctctccctgggga

SEQ ID NO: 128859 - DNA, 25 bp, Homo sapien
cgggcacgtagctcccaatggtctt

SEQ ID NO: 128860 - DNA, 25 bp, Homo sapien
tccttacccgacatgccagagaggc

SEQ ID NO: 128861 - DNA, 25 bp, Homo sapien
agaggctgcggcctcttgccgtcct

SEQ ID NO: 128862 - DNA, 25 bp, Homo sapien
gcgccgcccagcctgttgagcgatg

SEQ ID NO: 128863 - DNA, 25 bp, Homo sapien
cccagcctgttgagcgatggggacc

SEQ ID NO: 128864 - DNA, 25 bp, Homo sapien
cgtagctcccaatggtcttcgcggc

SEQ ID NO: 128865 - DNA, 25 bp, Homo sapien
ttcccttggcgtctgccactcctta

SEQ ID NO: 128866 - DNA, 25 bp, Homo sapien
ggcttgctgggcatctgctgcagca

SEQ ID NO: 128867 - DNA, 25 bp, Homo sapien
actcgacccgctcgtgcgcggaggt

SEQ ID NO: 128868 - DNA, 25 bp, Homo sapien
gagcctgagactcgacccgctcgtg

SEQ ID NO: 128869 - DNA, 25 bp, Homo sapien
cgggagacccgagcctgagactcga

SEQ ID NO: 128870 - DNA, 25 bp, Homo sapien
tgccaggcgagacaatgaccgaccg

SEQ ID NO: 128871 - DNA, 25 bp, Homo sapien
cccgctcatagtgcccgctgcgctg

SEQ ID NO: 128872 - DNA, 25 bp, Homo sapien
cgattggctgccaggcgagacaatg

SEQ ID NO: 128873 - DNA, 25 bp, Homo sapien
actctcagcggccaattgggaggcc

SEQ ID NO: 128874 - DNA, 25 bp, Homo sapien
gaggctcgctcacctccgccgtaga

SEQ ID NO: 128875 - DNA, 25 bp, Homo sapien
cggaggcggttgcaccctcatttct

SEQ ID NO: 128876 - DNA, 25 bp, Homo sapien
ccaagtgcagtgtgtacggccggat

SEQ ID NO: 128877 - DNA, 25 bp, Homo sapien
tacccacgatttgggtgctgcccgt

SEQ ID NO: 128878 - DNA, 25 bp, Homo sapien
tcttttaggcaaaatggaggtcgta

SEQ ID NO: 128879 - DNA, 25 bp, Homo sapien
tagagtaaggagttctgcccgcacc

SEQ ID NO: 128880 - DNA, 25 bp, Homo sapien
gcactggcgtagaaagctgaactta

SEQ ID NO: 128881 - DNA, 25 bp, Homo sapien
cgccggctgctatatccctagagtc

SEQ ID NO: 128882 - DNA, 25 bp, Homo sapien
cctcgttgcggagccgtaattactc

SEQ ID NO: 128883 - DNA, 25 bp, Homo sapien
agtcaggggcccagatctgcccgtc

SEQ ID NO: 128884 - DNA, 25 bp, Homo sapien
taaaagcagctgtcaccacggccgc

SEQ ID NO: 128885 - DNA, 25 bp, Homo sapien
cggcctagagaagaggccagacgca

SEQ ID NO: 128886 - DNA, 25 bp, Homo sapien
gccagacgcacaatgaaacctgctg

SEQ ID NO: 128887 - DNA, 25 bp, Homo sapien
aaacctgctgcacgttctcgaagtc

SEQ ID NO: 128888 - DNA, 25 bp, Homo sapien
gcttctttggtaaaagcagctgtca

SEQ ID NO: 128889 - DNA, 25 bp, Homo sapien
cgttctcgaagtcaggggcccagat

SEQ ID NO: 128890 - DNA, 25 bp, Homo sapien
cgccttcttcgatgcttctttggta

SEQ ID NO: 128891 - DNA, 25 bp, Homo sapien
ggcgcttctctagctcgcgggctcg

SEQ ID NO: 128892 - DNA, 25 bp, Homo sapien
ggccactgggcgcttaccgcgggcg

SEQ ID NO: 128893 - DNA, 25 bp, Homo sapien
gtgtttgtgtttgtagcaagatggc

SEQ ID NO: 128894 - DNA, 25 bp, Homo sapien
ttgtgtttgtagcaagatggctgcc

SEQ ID NO: 128895 - DNA, 25 bp, Homo sapien
gcctcgcaccacgtgacgcggacgc

SEQ ID NO: 128896 - DNA, 25 bp, Homo sapien
gccactgcccggacgcccgtcgccc

SEQ ID NO: 128897 - DNA, 25 bp, Homo sapien
acctctcctcgtgcgctgctcgcgt

SEQ ID NO: 128898 - DNA, 25 bp, Homo sapien
cggccaccctaggacgctagggtcg

SEQ ID NO: 128899 - DNA, 25 bp, Homo sapien
tcgggccacagggacattagactag

SEQ ID NO: 128900 - DNA, 25 bp, Homo sapien
ccctgtggaacgaagagagtaagca

SEQ ID NO: 128901 - DNA, 25 bp, Homo sapien
agccgggaaggcgattcatagctcg

SEQ ID NO: 128902 - DNA, 25 bp, Homo sapien
gcccggaagtctcgcgtttctcaaa

SEQ ID NO: 128903 - DNA, 25 bp, Homo sapien
tgtagatcccgtcacgcccggaagt

SEQ ID NO: 128904 - DNA, 25 bp, Homo sapien
cgggaactccgccaggcctagagac

SEQ ID NO: 128905 - DNA, 25 bp, Homo sapien
ggggaccggctatgtccctcagttc

SEQ ID NO: 128906 - DNA, 25 bp, Homo sapien
agttcccgaggcgtacacgtgtaga

SEQ ID NO: 128907 - DNA, 25 bp, Homo sapien
gtccctgtttgagcggggatttagc

SEQ ID NO: 128908 - DNA, 25 bp, Homo sapien
atgacccacacgcacgtctgcagca

SEQ ID NO: 128909 - DNA, 25 bp, Homo sapien
cggcgagcctcaacccaggcgtcct

SEQ ID NO: 128910 - DNA, 25 bp, Homo sapien
gcacgcacacatgcagataacagcc

SEQ ID NO: 128911 - DNA, 25 bp, Homo sapien
tgcaccgccgagcttcccgggatga

SEQ ID NO: 128912 - DNA, 25 bp, Homo sapien
caccgccgagcttcccgggatgagg

SEQ ID NO: 128913 - DNA, 25 bp, Homo sapien
cagtcccaagggtgcgcaaccggct

SEQ ID NO: 128914 - DNA, 25 bp, Homo sapien
ggtgcacggtgagtactcgcgggct

SEQ ID NO: 128915 - DNA, 25 bp, Homo sapien
caacctgtgcgaagccagtgggcct

SEQ ID NO: 128916 - DNA, 25 bp, Homo sapien
catagtagaagacggtgaaggtctc

SEQ ID NO: 128917 - DNA, 25 bp, Homo sapien
gacaggcactcgagcatggtgaagc

SEQ ID NO: 128918 - DNA, 25 bp, Homo sapien
actcgagcatggtgaagcgcagcgt

SEQ ID NO: 128919 - DNA, 25 bp, Homo sapien
cgccgtgggacccaacctgtgcgaa

SEQ ID NO: 128920 - DNA, 25 bp, Homo sapien
ggggcacgctgcacgtcacacactt

SEQ ID NO: 128921 - DNA, 25 bp, Homo sapien
gtgtccgcatcgctctcatagtaga

SEQ ID NO: 128922 - DNA, 25 bp, Homo sapien
gtcacacacttcgtaggtgcgcacg

SEQ ID NO: 128923 - DNA, 25 bp, Homo sapien
acacacccagcagcaacacggaggg

SEQ ID NO: 128924 - DNA, 25 bp, Homo sapien
cgcgctgtccaggaccgagcatgtc

SEQ ID NO: 128925 - DNA, 25 bp, Homo sapien
agctcacgctactgaataattcatg

SEQ ID NO: 128926 - DNA, 25 bp, Homo sapien
cgcgctgattggagctcacgctact

SEQ ID NO: 128927 - DNA, 25 bp, Homo sapien
ggacgccgatactccgcgcgggact

SEQ ID NO: 128928 - DNA, 25 bp, Homo sapien
cctcactcgggtaggatccgaactg

SEQ ID NO: 128929 - DNA, 25 bp, Homo sapien
agcagagcagcacccggagctccat

SEQ ID NO: 128930 - DNA, 25 bp, Homo sapien
accttccaaagctgcggccaacgaa

SEQ ID NO: 128931 - DNA, 25 bp, Homo sapien
tctctgaagccatcatagtcgccgc

SEQ ID NO: 128932 - DNA, 25 bp, Homo sapien
tcgttggttgccctctctctgaagc

SEQ ID NO: 128933 - DNA, 25 bp, Homo sapien
ggcgtcctctcgttggttgccctct

SEQ ID NO: 128934 - DNA, 25 bp, Homo sapien
aggcctccgactgctggcgtgcagt

SEQ ID NO: 128935 - DNA, 25 bp, Homo sapien
cgcaaccgcagaaaaagcggcggtg

SEQ ID NO: 128936 - DNA, 25 bp, Homo sapien
gccgtcagtcacgtgggcagcacgc

SEQ ID NO: 128937 - DNA, 25 bp, Homo sapien
gacccgcccgtagccacacaattcg

SEQ ID NO: 128938 - DNA, 25 bp, Homo sapien
cttcccaggacgcaaccgcagaaaa

SEQ ID NO: 128939 - DNA, 25 bp, Homo sapien
gaggacggctgagcccacacagcag

SEQ ID NO: 128940 - DNA, 25 bp, Homo sapien
agcaccgctcagtgggacatgggcc

SEQ ID NO: 128941 - DNA, 25 bp, Homo sapien
cacacagcagcaccgctcagtggga

SEQ ID NO: 128942 - DNA, 25 bp, Homo sapien
tgaggacggctgagcccacacagca

SEQ ID NO: 128943 - DNA, 25 bp, Homo sapien
tgcagattctgaggacggctgagcc

SEQ ID NO: 128944 - DNA, 25 bp, Homo sapien
ttctgaggacggctgagcccacaca

SEQ ID NO: 128945 - DNA, 25 bp, Homo sapien
cagattctgaggacggctgagccca

SEQ ID NO: 128946 - DNA, 25 bp, Homo sapien
cagcagcaccgctcagtgggacatg

SEQ ID NO: 128947 - DNA, 25 bp, Homo sapien
tggcattggcagaactcatgaggga

SEQ ID NO: 128948 - DNA, 25 bp, Homo sapien
aggtggcgctggcagagttcacggg

SEQ ID NO: 128949 - DNA, 25 bp, Homo sapien
acagaggtggcactggcagagttca

SEQ ID NO: 128950 - DNA, 25 bp, Homo sapien
aggtggcattggcagaactcatgag

SEQ ID NO: 128951 - DNA, 25 bp, Homo sapien
agaggtggcattggcagaactcatg

SEQ ID NO: 128952 - DNA, 25 bp, Homo sapien
gacagaggtggcattggcagaactc

SEQ ID NO: 128953 - DNA, 25 bp, Homo sapien
ttggcagaactcatgagggacagag

SEQ ID NO: 128954 - DNA, 25 bp, Homo sapien
gcattggcagaactcatgagggaca

SEQ ID NO: 128955 - DNA, 25 bp, Homo sapien
catcagacggtgcaaagcgaccctg

SEQ ID NO: 128956 - DNA, 25 bp, Homo sapien
gccggatttcccgtgacgcacctgg

SEQ ID NO: 128957 - DNA, 25 bp, Homo sapien
ctgcggcgacgattgtttgtaccta

SEQ ID NO: 128958 - DNA, 25 bp, Homo sapien
tacctaagtgaaggaggctccgaga

SEQ ID NO: 128959 - DNA, 25 bp, Homo sapien
aggatatcttggctcccttgcaccc

SEQ ID NO: 128960 - DNA, 25 bp, Homo sapien
acgcttgtctgcagggctgcattgc

SEQ ID NO: 128961 - DNA, 25 bp, Homo sapien
ccagaagtccctgaacgaagtgggc

SEQ ID NO: 128962 - DNA, 25 bp, Homo sapien
cacgtcctgccggagacgcttgtct

SEQ ID NO: 128963 - DNA, 25 bp, Homo sapien
ccgccagccgatcccgcccgatacc

SEQ ID NO: 128964 - DNA, 25 bp, Homo sapien
ctgcgggcactgctgagccaactga

SEQ ID NO: 128965 - DNA, 25 bp, Homo sapien
tgagccaactgaggatccgggctga

SEQ ID NO: 128966 - DNA, 25 bp, Homo sapien
aaggggactttgtgaacagtgggcg

SEQ ID NO: 128967 - DNA, 25 bp, Homo sapien
gccctggcacgcagcgccaacgccc

SEQ ID NO: 128968 - DNA, 25 bp, Homo sapien
aacgccctggttcgggcccagcagg

SEQ ID NO: 128969 - DNA, 25 bp, Homo sapien
tcctgtacttgcctcggccgccagc

SEQ ID NO: 128970 - DNA, 25 bp, Homo sapien
cttggcatagcgcccggctccggat

SEQ ID NO: 128971 - DNA, 25 bp, Homo sapien
acatggctggatgagaaccgtctta

SEQ ID NO: 128972 - DNA, 25 bp, Homo sapien
cgactacgaccgttcccgcgagaga

SEQ ID NO: 128973 - DNA, 25 bp, Homo sapien
ccctcagaccgtgccatgggtgaca

SEQ ID NO: 128974 - DNA, 25 bp, Homo sapien
aggtcgccctgaaatctagcccgtc

SEQ ID NO: 128975 - DNA, 25 bp, Homo sapien
ttgttagttccagttccggccgcga

SEQ ID NO: 128976 - DNA, 25 bp, Homo sapien
cttcgcgctcggtttgttagttcca

SEQ ID NO: 128977 - DNA, 25 bp, Homo sapien
caggtgagccgtttttaacttcatc

SEQ ID NO: 128978 - DNA, 25 bp, Homo sapien
gttatcgtctcgaaaagccgcgcga

SEQ ID NO: 128979 - DNA, 25 bp, Homo sapien
ggatgagaagttgattaaggtgcca

SEQ ID NO: 128980 - DNA, 25 bp, Homo sapien
cgcaaaacccgatcttgaagaatat

SEQ ID NO: 128981 - DNA, 25 bp, Homo sapien
cttgaagaatatcaccgactacctg

SEQ ID NO: 128982 - DNA, 25 bp, Homo sapien
caccgactacctgatcgaggaagta

SEQ ID NO: 128983 - DNA, 25 bp, Homo sapien
acctgatcgaggaagtaagcgccga

SEQ ID NO: 128984 - DNA, 25 bp, Homo sapien
acccggcagagatcaacgtggagcg

SEQ ID NO: 128985 - DNA, 25 bp, Homo sapien
agttgattaaggtgccagtggcagc

SEQ ID NO: 128986 - DNA, 25 bp, Homo sapien
ggaacccggcagagatcaacgtgga

SEQ ID NO: 128987 - DNA, 25 bp, Homo sapien
cgttgatcaccgcaggccgcaatag

SEQ ID NO: 128988 - DNA, 25 bp, Homo sapien
ttccagtgcaccatgtaggagctcc

SEQ ID NO: 128989 - DNA, 25 bp, Homo sapien
atcctgcttgctgtagtggtcgaac

SEQ ID NO: 128990 - DNA, 25 bp, Homo sapien
ggtcacaggtctgagcagcgatcct

SEQ ID NO: 128991 - DNA, 25 bp, Homo sapien
cgtctgtgttatagcccagccctga

SEQ ID NO: 128992 - DNA, 25 bp, Homo sapien
ctcagcctgagacatgcagaggacc

SEQ ID NO: 128993 - DNA, 25 bp, Homo sapien
tgtaacagtttattggcagcccaga

SEQ ID NO: 128994 - DNA, 25 bp, Homo sapien
gcacactcccgtggctgtaacagtt

SEQ ID NO: 128995 - DNA, 25 bp, Homo sapien
cgcatcagtcgctgggcgaagattt

SEQ ID NO: 128996 - DNA, 25 bp, Homo sapien
cgaagattttctcctctgccgtgta

SEQ ID NO: 128997 - DNA, 25 bp, Homo sapien
gaactcgatctcgtagccgtggggc

SEQ ID NO: 128998 - DNA, 25 bp, Homo sapien
aactcggcccggctgatgagagact

SEQ ID NO: 128999 - DNA, 25 bp, Homo sapien
tggaagcacggtgttcaaagacgta

SEQ ID NO: 129000 - DNA, 25 bp, Homo sapien
ccacggggcacacgacattgtggtc

SEQ ID NO: 129001 - DNA, 25 bp, Homo sapien
ccagtctgtgtaatgcaggaccaca

SEQ ID NO: 129002 - DNA, 25 bp, Homo sapien
ggggatcccaaagatgaactcgatc

SEQ ID NO: 129003 - DNA, 25 bp, Homo sapien
tggttcaccaggacctgcgctggtc

SEQ ID NO: 129004 - DNA, 25 bp, Homo sapien
agcacgtgccattcgtggttcacca

SEQ ID NO: 129005 - DNA, 25 bp, Homo sapien
acgctttcttgaggcagcacgtgcc

SEQ ID NO: 129006 - DNA, 25 bp, Homo sapien
acagcgtcactgatgtcgggtcacc

SEQ ID NO: 129007 - DNA, 25 bp, Homo sapien
acagcaggtgcatgcccaccgaggc

SEQ ID NO: 129008 - DNA, 25 bp, Homo sapien
ggctaccagctctgtgtcattccca

SEQ ID NO: 129009 - DNA, 25 bp, Homo sapien
tccgaaggcaggctaccagctctgt

SEQ ID NO: 129010 - DNA, 25 bp, Homo sapien
ggagaaccggaagacgctttcttga

SEQ ID NO: 129011 - DNA, 25 bp, Homo sapien
accgacgacagagcgcagtgacaga

SEQ ID NO: 129012 - DNA, 25 bp, Homo sapien
gtgacagacgcgacccaaagacctg

SEQ ID NO: 129013 - DNA, 25 bp, Homo sapien
tagacacccacgtgacagacagacg

SEQ ID NO: 129014 - DNA, 25 bp, Homo sapien
acactcctggggatgaaaggacacc

SEQ ID NO: 129015 - DNA, 25 bp, Homo sapien
cagaaaaggtgacgtgggacactcc

SEQ ID NO: 129016 - DNA, 25 bp, Homo sapien
ggacggacacacttggacaccctgt

SEQ ID NO: 129017 - DNA, 25 bp, Homo sapien
gggacgactttcacagacggacgga

SEQ ID NO: 129018 - DNA, 25 bp, Homo sapien
cagacggacgacctcatgcagtgac

SEQ ID NO: 129019 - DNA, 25 bp, Homo sapien
cttgatctaaagtggaatcccgccc

SEQ ID NO: 129020 - DNA, 25 bp, Homo sapien
cgtccgcttgttctacggtggattc

SEQ ID NO: 129021 - DNA, 25 bp, Homo sapien
caccagggccagtgcgttctagaga

SEQ ID NO: 129022 - DNA, 25 bp, Homo sapien
aggatgaagcctagcctcacgcgcc

SEQ ID NO: 129023 - DNA, 25 bp, Homo sapien
tgtcaccaaatgcacgtcgggcgtg

SEQ ID NO: 129024 - DNA, 25 bp, Homo sapien
cgcctccttgatggggttgagtcca

SEQ ID NO: 129025 - DNA, 25 bp, Homo sapien
cccttcgttctagggctgaaccttg

SEQ ID NO: 129026 - DNA, 25 bp, Homo sapien
tgctccgtcgccctaaagtgtagcc

SEQ ID NO: 129027 - DNA, 25 bp, Homo sapien
tgaaacgcttctccctcaacggcga

SEQ ID NO: 129028 - DNA, 25 bp, Homo sapien
gctagcgcacggctctatctcatca

SEQ ID NO: 129029 - DNA, 25 bp, Homo sapien
acggcgactacaagggcaccgtgcc

SEQ ID NO: 129030 - DNA, 25 bp, Homo sapien
gaaccgggcactgaaacgcttctcc

SEQ ID NO: 129031 - DNA, 25 bp, Homo sapien
cggatgagcagaaccgggcactgaa

SEQ ID NO: 129032 - DNA, 25 bp, Homo sapien
cggatgcctggagacaagcggtccc

SEQ ID NO: 129033 - DNA, 25 bp, Homo sapien
agcgcggtggccttctccgctagcg

SEQ ID NO: 129034 - DNA, 25 bp, Homo sapien
gatcaccgggctctgtcccttcggt

SEQ ID NO: 129035 - DNA, 25 bp, Homo sapien
cgcgtcatgtgagccgggctactct

SEQ ID NO: 129036 - DNA, 25 bp, Homo sapien
ctgcttttgtgctcagggcattgag

SEQ ID NO: 129037 - DNA, 25 bp, Homo sapien
catgagtgagctcgagccccagtta

SEQ ID NO: 129038 - DNA, 25 bp, Homo sapien
ctcagggcattgaggaagaggcacc

SEQ ID NO: 129039 - DNA, 25 bp, Homo sapien
caccgcggagggttaacgcggatca

SEQ ID NO: 129040 - DNA, 25 bp, Homo sapien
ccagttatccaaggaaactcgggct

SEQ ID NO: 129041 - DNA, 25 bp, Homo sapien
taacgcggatcaggcgtcctcgagc

SEQ ID NO: 129042 - DNA, 25 bp, Homo sapien
gagccgggctactctgcttttgtgc

SEQ ID NO: 129043 - DNA, 25 bp, Homo sapien
ggaagaaacgatcccgtttccagca

SEQ ID NO: 129044 - DNA, 25 bp, Homo sapien
accgagaggcatctgcggccaacgc

SEQ ID NO: 129045 - DNA, 25 bp, Homo sapien
cgcccggctccgagtagagagaact

SEQ ID NO: 129046 - DNA, 25 bp, Homo sapien
atcgttgacgcgtccaggaagaaac

SEQ ID NO: 129047 - DNA, 25 bp, Homo sapien
cagcgcttcacgctctccgggagga

SEQ ID NO: 129048 - DNA, 25 bp, Homo sapien
acgctctccgggaggaagctccgga

SEQ ID NO: 129049 - DNA, 25 bp, Homo sapien
tggagcgcgctcaatgcacgcccgt

SEQ ID NO: 129050 - DNA, 25 bp, Homo sapien
cgaacgagctcatcgttgacgcgtc

SEQ ID NO: 129051 - DNA, 25 bp, Homo sapien
gaaaatcacggcatcactgacaagg

SEQ ID NO: 129052 - DNA, 25 bp, Homo sapien
ggtgaagaaaatcacggcatcactg

SEQ ID NO: 129053 - DNA, 25 bp, Homo sapien
tgacaaggccgccatgaggatcgcg

SEQ ID NO: 129054 - DNA, 25 bp, Homo sapien
ggcatcactgacaaggccgccatga

SEQ ID NO: 129055 - DNA, 25 bp, Homo sapien
cctcgcctgagggtgaagaaaatca

SEQ ID NO: 129056 - DNA, 25 bp, Homo sapien
ccggacctcgcctgagggtgaagaa

SEQ ID NO: 129057 - DNA, 25 bp, Homo sapien
acaggtgacgcaggcttcagagggc

SEQ ID NO: 129058 - DNA, 25 bp, Homo sapien
caaggccgccatgaggatcgcgtga

SEQ ID NO: 129059 - DNA, 25 bp, Homo sapien
tcatagaaacgatgcggaaagccca

SEQ ID NO: 129060 - DNA, 25 bp, Homo sapien
tgttcatagaaacgatgcggaaagc

SEQ ID NO: 129061 - DNA, 25 bp, Homo sapien
gttcatagaaacgatgcggaaagcc

SEQ ID NO: 129062 - DNA, 25 bp, Homo sapien
ttcatagaaacgatgcggaaagccc

SEQ ID NO: 129063 - DNA, 25 bp, Homo sapien
gtgttcatagaaacgatgcggaaag

SEQ ID NO: 129064 - DNA, 25 bp, Homo sapien
agaaacgatgcggaaagcccaggcc

SEQ ID NO: 129065 - DNA, 25 bp, Homo sapien
atagaaacgatgcggaaagcccagg

SEQ ID NO: 129066 - DNA, 25 bp, Homo sapien
catagaaacgatgcggaaagcccag

SEQ ID NO: 129067 - DNA, 25 bp, Homo sapien
gtctgttttctgacacctggtacca

SEQ ID NO: 129068 - DNA, 25 bp, Homo sapien
accagccggaggtgttcatagaaac

SEQ ID NO: 129069 - DNA, 25 bp, Homo sapien
actcctggtcttgcagccagcattg

SEQ ID NO: 129070 - DNA, 25 bp, Homo sapien
gaaaccgagaaaccgcacgctcatg

SEQ ID NO: 129071 - DNA, 25 bp, Homo sapien
ctcatgagcggctgcaaaacccgca

SEQ ID NO: 129072 - DNA, 25 bp, Homo sapien
aggatgtcctttgtcaccgtctcga

SEQ ID NO: 129073 - DNA, 25 bp, Homo sapien
tctcgaggtagctgggaaactgcct

SEQ ID NO: 129074 - DNA, 25 bp, Homo sapien
ggatcctgggattcgactcctggtc

SEQ ID NO: 129075 - DNA, 25 bp, Homo sapien
tcgcggtgagaccagctggtgtctt

SEQ ID NO: 129076 - DNA, 25 bp, Homo sapien
agtcttgggccaagtgccgccctgc

SEQ ID NO: 129077 - DNA, 25 bp, Homo sapien
gaagctgctgggacgcctgacttga

SEQ ID NO: 129078 - DNA, 25 bp, Homo sapien
tcgaagtcaggcctcgcggtgagac

SEQ ID NO: 129079 - DNA, 25 bp, Homo sapien
actcgctgctctggctcgaagtcag

SEQ ID NO: 129080 - DNA, 25 bp, Homo sapien
cggagacgcaatgtactcgctgctc

SEQ ID NO: 129081 - DNA, 25 bp, Homo sapien
gcccttgccacacggagacgcaatg

SEQ ID NO: 129082 - DNA, 25 bp, Homo sapien
tgggacgcctgacttgagcctcccg

SEQ ID NO: 129083 - DNA, 25 bp, Homo sapien
tgctcttacgttttcagatgcctgg

SEQ ID NO: 129084 - DNA, 25 bp, Homo sapien
agggcgtcttcttcagcgtcgataa

SEQ ID NO: 129085 - DNA, 25 bp, Homo sapien
agggctgacaaacgtcccgacgagc

SEQ ID NO: 129086 - DNA, 25 bp, Homo sapien
acgagctctgcggatctggtacact

SEQ ID NO: 129087 - DNA, 25 bp, Homo sapien
ccacagacacgtcgctgggtgcttc

SEQ ID NO: 129088 - DNA, 25 bp, Homo sapien
ttactgcaggtgtttccgatggccc

SEQ ID NO: 129089 - DNA, 25 bp, Homo sapien
acaagggctatcagcgagggcactc

SEQ ID NO: 129090 - DNA, 25 bp, Homo sapien
agggcaacccacagacatgtcatta

SEQ ID NO: 129091 - DNA, 25 bp, Homo sapien
ggcgggatcttaagctcgagttaca

SEQ ID NO: 129092 - DNA, 25 bp, Homo sapien
gtcctcggcatgcagcagcagcact

SEQ ID NO: 129093 - DNA, 25 bp, Homo sapien
tcgagttacagctccgcgaccacga

SEQ ID NO: 129094 - DNA, 25 bp, Homo sapien
cgcacaccacagaggcgggatctta

SEQ ID NO: 129095 - DNA, 25 bp, Homo sapien
cagctgtgccgacttcactcgggtc

SEQ ID NO: 129096 - DNA, 25 bp, Homo sapien
cacccagtcggtgatgtcgtggcac

SEQ ID NO: 129097 - DNA, 25 bp, Homo sapien
ttacactttggaccacggctgcctc

SEQ ID NO: 129098 - DNA, 25 bp, Homo sapien
tgtcttggctacagtacagcctcgg

SEQ ID NO: 129099 - DNA, 25 bp, Homo sapien
tcgccatatgatgagagagacacgc

SEQ ID NO: 129100 - DNA, 25 bp, Homo sapien
gaagccgtcgccatatgatcagaga

SEQ ID NO: 129101 - DNA, 25 bp, Homo sapien
cctgcgaagccgtcgccatatgatc

SEQ ID NO: 129102 - DNA, 25 bp, Homo sapien
cgcctgcgaagccatcgccatatga

SEQ ID NO: 129103 - DNA, 25 bp, Homo sapien
cctgcgaagccatcgccatatgatg

SEQ ID NO: 129104 - DNA, 25 bp, Homo sapien
gaagccatcgccatatgatgagaga

SEQ ID NO: 129105 - DNA, 25 bp, Homo sapien
agccgtcgccatatgatcagagaga

SEQ ID NO: 129106 - DNA, 25 bp, Homo sapien
cgccatatgatgagagagacacgcc

SEQ ID NO: 129107 - DNA, 25 bp, Homo sapien
acgaaggcttcgtcgtcactctgca

SEQ ID NO: 129108 - DNA, 25 bp, Homo sapien
tcgtcgtcactctgcagtcttttga

SEQ ID NO: 129109 - DNA, 25 bp, Homo sapien
gtcttttgaggatgcacccagggaa

SEQ ID NO: 129110 - DNA, 25 bp, Homo sapien
cccgcggtgacaaaggcttcgtcat

SEQ ID NO: 129111 - DNA, 25 bp, Homo sapien
ccgcggtgacaaaggcttcgtcatc

SEQ ID NO: 129112 - DNA, 25 bp, Homo sapien
cttttgaggatgcacccagggaagc

SEQ ID NO: 129113 - DNA, 25 bp, Homo sapien
cacgaaggcttcgtcgtcactctgc

SEQ ID NO: 129114 - DNA, 25 bp, Homo sapien
tcgtcactctgcagtcttttgagga

SEQ ID NO: 129115 - DNA, 25 bp, Homo sapien
taacggtcacgcagacacagcagcc

SEQ ID NO: 129116 - DNA, 25 bp, Homo sapien
ctgacctcaggcacctcgtcgttga

SEQ ID NO: 129117 - DNA, 25 bp, Homo sapien
ccatacggacgctgcctgaggcaga

SEQ ID NO: 129118 - DNA, 25 bp, Homo sapien
tggaagaaggagtaacggtcacgca

SEQ ID NO: 129119 - DNA, 25 bp, Homo sapien
agggataaggattcgtgtaggcaaa

SEQ ID NO: 129120 - DNA, 25 bp, Homo sapien
ctgacgccacggtgcggctctgagt

SEQ ID NO: 129121 - DNA, 25 bp, Homo sapien
cggctctgagtgctgccatacggac

SEQ ID NO: 129122 - DNA, 25 bp, Homo sapien
tcgtcgttgaggctactgagcagca

SEQ ID NO: 129123 - DNA, 25 bp, Homo sapien
cgccacacgcgctgttccagaggaa

SEQ ID NO: 129124 - DNA, 25 bp, Homo sapien
cgcgccagagactacgtggtccatg

SEQ ID NO: 129125 - DNA, 25 bp, Homo sapien
ggtccatgcgcgcaggagataaagc

SEQ ID NO: 129126 - DNA, 25 bp, Homo sapien
ccctgcccgggaagaaaggcatgca

SEQ ID NO: 129127 - DNA, 25 bp, Homo sapien
tcctgcataattcacggacggtggc

SEQ ID NO: 129128 - DNA, 25 bp, Homo sapien
ggaagggctctctacggaaaatcga

SEQ ID NO: 129129 - DNA, 25 bp, Homo sapien
tctctgggtccaggactgcgcttac

SEQ ID NO: 129130 - DNA, 25 bp, Homo sapien
cgggtctccctatcccagctggtga

SEQ ID NO: 129131 - DNA, 25 bp, Homo sapien
ttattactcgcgttacttccgcgcc

SEQ ID NO: 129132 - DNA, 25 bp, Homo sapien
agcaaccatggacagccacttattc

SEQ ID NO: 129133 - DNA, 25 bp, Homo sapien
gcccgaagcgtaaattaacgtcata

SEQ ID NO: 129134 - DNA, 25 bp, Homo sapien
gcctgattacataccgataccgcga

SEQ ID NO: 129135 - DNA, 25 bp, Homo sapien
ccctttttacgctgccgcctgatta

SEQ ID NO: 129136 - DNA, 25 bp, Homo sapien
tacattccacgattttcccgcctta

SEQ ID NO: 129137 - DNA, 25 bp, Homo sapien
ccaccctctgaatcgggcgttaata

SEQ ID NO: 129138 - DNA, 25 bp, Homo sapien
tcctcgcgcccatattggttctgcg

SEQ ID NO: 129139 - DNA, 25 bp, Homo sapien
aggaggcatcgcaagcctccctgga

SEQ ID NO: 129140 - DNA, 25 bp, Homo sapien
gcggcaggaggcatcgcaagcctcc

SEQ ID NO: 129141 - DNA, 25 bp, Homo sapien
ccaccgtggaggagcctgcatgcga

SEQ ID NO: 129142 - DNA, 25 bp, Homo sapien
gcctccctggaggtcttttaggaga

SEQ ID NO: 129143 - DNA, 25 bp, Homo sapien
tcttttaggagagcggcgccagcgg

SEQ ID NO: 129144 - DNA, 25 bp, Homo sapien
aggggctacgtgagaccctccgcca

SEQ ID NO: 129145 - DNA, 25 bp, Homo sapien
cacggccaccgtggaggagcctgca

SEQ ID NO: 129146 - DNA, 25 bp, Homo sapien
tctcaggggctacgtgagaccctcc

SEQ ID NO: 129147 - DNA, 25 bp, Homo sapien
tcacgatgccgtttgagagggaaag

SEQ ID NO: 129148 - DNA, 25 bp, Homo sapien
tgcctcaggtcatctgtcacgatgc

SEQ ID NO: 129149 - DNA, 25 bp, Homo sapien
gcacgcctcaggtcatctgtcacga

SEQ ID NO: 129150 - DNA, 25 bp, Homo sapien
acgcctcaggtcatctgtcacgatg

SEQ ID NO: 129151 - DNA, 25 bp, Homo sapien
atctgtcacgatgccgtttgagacg

SEQ ID NO: 129152 - DNA, 25 bp, Homo sapien
ggtcatctgtcacgatgccgtttga

SEQ ID NO: 129153 - DNA, 25 bp, Homo sapien
cgcctcaggtcatctgtcacgatgc

SEQ ID NO: 129154 - DNA, 25 bp, Homo sapien
gaactggcccgcatgcctcaggtca

SEQ ID NO: 129155 - DNA, 25 bp, Homo sapien
tcgctttccctggaggcttcttctc

SEQ ID NO: 129156 - DNA, 25 bp, Homo sapien
ctgcgcgaggtggaagtttaaccct

SEQ ID NO: 129157 - DNA, 25 bp, Homo sapien
agccctgcctggattaaagtgttag

SEQ ID NO: 129158 - DNA, 25 bp, Homo sapien
cgacccgtgacgcatttttacttga

SEQ ID NO: 129159 - DNA, 25 bp, Homo sapien
gcagtcagatccacagcatccggga

SEQ ID NO: 129160 - DNA, 25 bp, Homo sapien
tagactccgtaggtaaatcgcgccc

SEQ ID NO: 129161 - DNA, 25 bp, Homo sapien
cccgtcgtgggaacttagtgcttca

SEQ ID NO: 129162 - DNA, 25 bp, Homo sapien
gcgtgaaatttaagccctgcctgga

SEQ ID NO: 129163 - DNA, 25 bp, Homo sapien
tgctcagcgccactcacgggttcat

SEQ ID NO: 129164 - DNA, 25 bp, Homo sapien
gaggaggccaccttcagcttcatcg

SEQ ID NO: 129165 - DNA, 25 bp, Homo sapien
tcagcttcatcgctgggcacgggtg

SEQ ID NO: 129166 - DNA, 25 bp, Homo sapien
ttctccctgcaaacggaggaggcca

SEQ ID NO: 129167 - DNA, 25 bp, Homo sapien
actcacgggttcatcctgcggcgca

SEQ ID NO: 129168 - DNA, 25 bp, Homo sapien
cgcggatgctcttcgggactctcct

SEQ ID NO: 129169 - DNA, 25 bp, Homo sapien
ggccgcgtccacgtatcgggagcct

SEQ ID NO: 129170 - DNA, 25 bp, Homo sapien
gcgccggagcctggaaccaaaattc

SEQ ID NO: 129171 - DNA, 25 bp, Homo sapien
agatgctcaccaccgctggaacaca

SEQ ID NO: 129172 - DNA, 25 bp, Homo sapien
cgttggaagatgctcaccaccgctg

SEQ ID NO: 129173 - DNA, 25 bp, Homo sapien
tgaggcgactgatggagttggatga

SEQ ID NO: 129174 - DNA, 25 bp, Homo sapien
caacagaagcccagcaatgcggctg

SEQ ID NO: 129175 - DNA, 25 bp, Homo sapien
tcgaaacaacagaagcccagcaatg

SEQ ID NO: 129176 - DNA, 25 bp, Homo sapien
aattcgggagccagtgtcttggttc

SEQ ID NO: 129177 - DNA, 25 bp, Homo sapien
gccagtgtcttggttcgaaacaaca

SEQ ID NO: 129178 - DNA, 25 bp, Homo sapien
tcttggttcgaaacaacagaagccc

SEQ ID NO: 129179 - DNA, 25 bp, Homo sapien
tgcgagcacaacttccagtgttttc

SEQ ID NO: 129180 - DNA, 25 bp, Homo sapien
tccctggttgacgactcggatttta

SEQ ID NO: 129181 - DNA, 25 bp, Homo sapien
ccggaggttctacaggctctctgca

SEQ ID NO: 129182 - DNA, 25 bp, Homo sapien
tcctgcacaggcttcccggaaaggc

SEQ ID NO: 129183 - DNA, 25 bp, Homo sapien
gtgccctgaccactgacagagtgtg

SEQ ID NO: 129184 - DNA, 25 bp, Homo sapien
cccgagggaaggtatcgctttcata

SEQ ID NO: 129185 - DNA, 25 bp, Homo sapien
aagggtctccttggcaacctggatc

SEQ ID NO: 129186 - DNA, 25 bp, Homo sapien
accgacgcgcttcgcagcttattgc

SEQ ID NO: 129187 - DNA, 25 bp, Homo sapien
cttcctcctatacggggcggcagcg

SEQ ID NO: 129188 - DNA, 25 bp, Homo sapien
ccgggcaccatctcaggttccctgc

SEQ ID NO: 129189 - DNA, 25 bp, Homo sapien
cacctcaccgcggacgggaaagtgg

SEQ ID NO: 129190 - DNA, 25 bp, Homo sapien
ggttccctgcgcacattcctccatc

SEQ ID NO: 129191 - DNA, 25 bp, Homo sapien
acattcctccatctggggccgcacg

SEQ ID NO: 129192 - DNA, 25 bp, Homo sapien
cagcttcctcctatacggggcggca

SEQ ID NO: 129193 - DNA, 25 bp, Homo sapien
cggggacggtccagctgttccgtca

SEQ ID NO: 129194 - DNA, 25 bp, Homo sapien
ggacggtccagctgttccgtcacct

SEQ ID NO: 129195 - DNA, 25 bp, Homo sapien
agctgggacccagcctgtaccgcga

SEQ ID NO: 129196 - DNA, 25 bp, Homo sapien
gtcgctgctggatgcttttaggaaa

SEQ ID NO: 129197 - DNA, 25 bp, Homo sapien
cctggctggggtctcggacagaccc

SEQ ID NO: 129198 - DNA, 25 bp, Homo sapien
ctggggtctcggacagacccggcct

SEQ ID NO: 129199 - DNA, 25 bp, Homo sapien
gttcaaaatccacgggtcgctgctg

SEQ ID NO: 129200 - DNA, 25 bp, Homo sapien
gctggatgcttttaggaaagggacc

SEQ ID NO: 129201 - DNA, 25 bp, Homo sapien
ccattgttcaaaatccacgggtcgc

SEQ ID NO: 129202 - DNA, 25 bp, Homo sapien
gggacccagcctgtaccgcgaggct

SEQ ID NO: 129203 - DNA, 25 bp, Homo sapien
cgaaaacttgtgcagccgcgcgaca

SEQ ID NO: 129204 - DNA, 25 bp, Homo sapien
cgaaagcggtgcaggcatctctcta

SEQ ID NO: 129205 - DNA, 25 bp, Homo sapien
gtcaagcatgccctctgggtggtca

SEQ ID NO: 129206 - DNA, 25 bp, Homo sapien
ggacacccactgcatggcttctgga

SEQ ID NO: 129207 - DNA, 25 bp, Homo sapien
atcctgtcttcctgggcctcggact

SEQ ID NO: 129208 - DNA, 25 bp, Homo sapien
gcgttgaaaccgcagggctgactta

SEQ ID NO: 129209 - DNA, 25 bp, Homo sapien
cccagctagagtttagggccacctg

SEQ ID NO: 129210 - DNA, 25 bp, Homo sapien
ttcttcggccagttatcccggagtg

SEQ ID NO: 129211 - DNA, 25 bp, Homo sapien
cccgggctcagagtcgttctttgta

SEQ ID NO: 129212 - DNA, 25 bp, Homo sapien
tgtcgctccgggctataaatattaa

SEQ ID NO: 129213 - DNA, 25 bp, Homo sapien
atattaataagctgcgcggctccgg

SEQ ID NO: 129214 - DNA, 25 bp, Homo sapien
cagggccgcatgtacctactgtctc

SEQ ID NO: 129215 - DNA, 25 bp, Homo sapien
tgggcctgcaaatccgcttccagcg

SEQ ID NO: 129216 - DNA, 25 bp, Homo sapien
gacctaactgggcttccgaaatgct

SEQ ID NO: 129217 - DNA, 25 bp, Homo sapien
tgggccatttccttaacgcgcggtc

SEQ ID NO: 129218 - DNA, 25 bp, Homo sapien
gcggctccgggcttaattatctccc

SEQ ID NO: 129219 - DNA, 25 bp, Homo sapien
cagtaggccaggctgcccatcaggt

SEQ ID NO: 129220 - DNA, 25 bp, Homo sapien
ttggccacccggaagatgtagtagc

SEQ ID NO: 129221 - DNA, 25 bp, Homo sapien
atccgtgcggcggaacaggtccttc

SEQ ID NO: 129222 - DNA, 25 bp, Homo sapien
cggatgtgtaggagcactcgatgac

SEQ ID NO: 129223 - DNA, 25 bp, Homo sapien
gcctctgcccatcggcggatgtgta

SEQ ID NO: 129224 - DNA, 25 bp, Homo sapien
ccagcagcttgctgtggtgcctctg

SEQ ID NO: 129225 - DNA, 25 bp, Homo sapien
tcaggtcgccgacgtagttgaagtg

SEQ ID NO: 129226 - DNA, 25 bp, Homo sapien
gatgtagtagcccaccaggcccagc

SEQ ID NO: 129227 - DNA, 25 bp, Homo sapien
gggtggacagaaagacagcctccta

SEQ ID NO: 129228 - DNA, 25 bp, Homo sapien
ctctcgctgttggaaatcgcggctc

SEQ ID NO: 129229 - DNA, 25 bp, Homo sapien
tcgcggctccatttatgggtggaca

SEQ ID NO: 129230 - DNA, 25 bp, Homo sapien
agacagcctcctagcaccgggctta

SEQ ID NO: 129231 - DNA, 25 bp, Homo sapien
tagcaccgggcttatagcttccacg

SEQ ID NO: 129232 - DNA, 25 bp, Homo sapien
ttatagcttccacgccctgttcttc

SEQ ID NO: 129233 - DNA, 25 bp, Homo sapien
cgacgctgcccgctgaggcgtcaga

SEQ ID NO: 129234 - DNA, 25 bp, Homo sapien
ggctgcttgtcacgtttcctccaca

SEQ ID NO: 129235 - DNA, 25 bp, Homo sapien
tcccatcactgttgggtgtgacaga

SEQ ID NO: 129236 - DNA, 25 bp, Homo sapien
ggagggcccagttcccatcactgtt

SEQ ID NO: 129237 - DNA, 25 bp, Homo sapien
cagagacgtcatacgcgacagcagc

SEQ ID NO: 129238 - DNA, 25 bp, Homo sapien
tgttgggtgtgacagagacgtcata

SEQ ID NO: 129239 - DNA, 25 bp, Homo sapien
agccgtgaatgtcctctgcaccaga

SEQ ID NO: 129240 - DNA, 25 bp, Homo sapien
cactttagagatgagcagtgtcaga

SEQ ID NO: 129241 - DNA, 25 bp, Homo sapien
tgtcagaggagttaaggaacgtgcc

SEQ ID NO: 129242 - DNA, 25 bp, Homo sapien
gacagcagctccacagccgtgaatg

SEQ ID NO: 129243 - DNA, 25 bp, Homo sapien
cacgcatcgtaaccgccagcagggg

SEQ ID NO: 129244 - DNA, 25 bp, Homo sapien
gtgaactgcaatgacctcgcttgtc

SEQ ID NO: 129245 - DNA, 25 bp, Homo sapien
ggaagcttctctgcactggcctcac

SEQ ID NO: 129246 - DNA, 25 bp, Homo sapien
tggctcacgtcatcactgcgggatc

SEQ ID NO: 129247 - DNA, 25 bp, Homo sapien
tgcgggatccaagacacatttaagg

SEQ ID NO: 129248 - DNA, 25 bp, Homo sapien
cggcttcctctccaattaggggcaa

SEQ ID NO: 129249 - DNA, 25 bp, Homo sapien
ttaggggcaagatcaatctcacagc

SEQ ID NO: 129250 - DNA, 25 bp, Homo sapien
acgggacaggagcaacatcaggtga

SEQ ID NO: 129251 - DNA, 25 bp, Homo sapien
gccacgttttttctccaggtgtgac

SEQ ID NO: 129252 - DNA, 25 bp, Homo sapien
agctggggcttagtcttctgtgaaa

SEQ ID NO: 129253 - DNA, 25 bp, Homo sapien
tgtgaaagagtaaagtgcctcctgc

SEQ ID NO: 129254 - DNA, 25 bp, Homo sapien
cctcctgcggagagcgggtaaactc

SEQ ID NO: 129255 - DNA, 25 bp, Homo sapien
gggtaaactcgccaagggcctgcga

SEQ ID NO: 129256 - DNA, 25 bp, Homo sapien
cgcagtggtcggatttttctgggcc

SEQ ID NO: 129257 - DNA, 25 bp, Homo sapien
tgagctggtctagagccggctccac

SEQ ID NO: 129258 - DNA, 25 bp, Homo sapien
gctggggcttctcatgccacgtttt

SEQ ID NO: 129259 - DNA, 25 bp, Homo sapien
tgtcccgctgacactagagccgctg

SEQ ID NO: 129260 - DNA, 25 bp, Homo sapien
atgaatgtagctctgtcgccggccc

SEQ ID NO: 129261 - DNA, 25 bp, Homo sapien
caccctcagcaggtgttgatgaatg

SEQ ID NO: 129262 - DNA, 25 bp, Homo sapien
gggaaacggtctgtcctcaacacca

SEQ ID NO: 129263 - DNA, 25 bp, Homo sapien
agccgctgggaagacacactagaga

SEQ ID NO: 129264 - DNA, 25 bp, Homo sapien
gcctgccgggaacctaggaatgtcc

SEQ ID NO: 129265 - DNA, 25 bp, Homo sapien
gtgctacgcacagatgcagcctgcg

SEQ ID NO: 129266 - DNA, 25 bp, Homo sapien
agaagcttcctctgaacagccgggg

SEQ ID NO: 129267 - DNA, 25 bp, Homo sapien
tttgtattcttaggagtcactgcca

SEQ ID NO: 129268 - DNA, 25 bp, Homo sapien
ggacgtccaggaacggagtcacata

SEQ ID NO: 129269 - DNA, 25 bp, Homo sapien
acaccgtcaataacgcggaacagtc

SEQ ID NO: 129270 - DNA, 25 bp, Homo sapien
gcacggagtcattctgcttttggaa

SEQ ID NO: 129271 - DNA, 25 bp, Homo sapien
aggagtcactgccaagacggccggc

SEQ ID NO: 129272 - DNA, 25 bp, Homo sapien
gtgcctgtggatcgggaacagttcc

SEQ ID NO: 129273 - DNA, 25 bp, Homo sapien
cggaacagtcttccgcacggagtca

SEQ ID NO: 129274 - DNA, 25 bp, Homo sapien
ttcggataattagaagggcctctgg

SEQ ID NO: 129275 - DNA, 25 bp, Homo sapien
aggcccgctgtgctcatagcccaga

SEQ ID NO: 129276 - DNA, 25 bp, Homo sapien
atctcttcctatgcgggacgccaca

SEQ ID NO: 129277 - DNA, 25 bp, Homo sapien
agcccatctcttcctatgcgggacg

SEQ ID NO: 129278 - DNA, 25 bp, Homo sapien
ggagacacactaggaagcccatctc

SEQ ID NO: 129279 - DNA, 25 bp, Homo sapien
cccgggaggagacacactaggaagc

SEQ ID NO: 129280 - DNA, 25 bp, Homo sapien
tcatagcccagaccagagaccgtct

SEQ ID NO: 129281 - DNA, 25 bp, Homo sapien
atgcgggacgccacacgcgtgtgca

SEQ ID NO: 129282 - DNA, 25 bp, Homo sapien
gcccagaccagagaccgtctggaca

SEQ ID NO: 129283 - DNA, 25 bp, Homo sapien
ggcccagcagcttccgtgggaaaca

SEQ ID NO: 129284 - DNA, 25 bp, Homo sapien
gctgcgccagcaaccacggttaggt

SEQ ID NO: 129285 - DNA, 25 bp, Homo sapien
agctgtccctctgccgtttgtttcg

SEQ ID NO: 129286 - DNA, 25 bp, Homo sapien
gatgtacgtcacacaccctgggctg

SEQ ID NO: 129287 - DNA, 25 bp, Homo sapien
gaaaacacacttcagcgggcgagcc

SEQ ID NO: 129288 - DNA, 25 bp, Homo sapien
ggtcagctcctgtgccagcgtttaa

SEQ ID NO: 129289 - DNA, 25 bp, Homo sapien
tcctcgggacgacagcgaaaacaca

SEQ ID NO: 129290 - DNA, 25 bp, Homo sapien
ccgtgtgagacgagcctttccttct

SEQ ID NO: 129291 - DNA, 25 bp, Homo sapien
gtcccgcccgagtgagggtgcacac

SEQ ID NO: 129292 - DNA, 25 bp, Homo sapien
gccgtggcctcacgtggacactgca

SEQ ID NO: 129293 - DNA, 25 bp, Homo sapien
ggaccctccgtgaccttagcagcgt

SEQ ID NO: 129294 - DNA, 25 bp, Homo sapien
gaccttagcagcgtcctcgaggcta

SEQ ID NO: 129295 - DNA, 25 bp, Homo sapien
cctcgaggctacaagtgacaaactg

SEQ ID NO: 129296 - DNA, 25 bp, Homo sapien
caaactgcttgtgctgagaaatgga

SEQ ID NO: 129297 - DNA, 25 bp, Homo sapien
agaaatggagaagccgcgtcccttc

SEQ ID NO: 129298 - DNA, 25 bp, Homo sapien
gagtcactccggacatcggtccctt

SEQ ID NO: 129299 - DNA, 25 bp, Homo sapien
tatcagctccggaagcagagtgggc

SEQ ID NO: 129300 - DNA, 25 bp, Homo sapien
ggccagacctcgaaatagctcgtgc

SEQ ID NO: 129301 - DNA, 25 bp, Homo sapien
tcgaaatagctcgtgctgggcagcc

SEQ ID NO: 129302 - DNA, 25 bp, Homo sapien
ccaccggaggccagacctcgaaata

SEQ ID NO: 129303 - DNA, 25 bp, Homo sapien
ttcccagaaacacagcgcgatgggg

SEQ ID NO: 129304 - DNA, 25 bp, Homo sapien
tcctgtgctatcagctccggaagca

SEQ ID NO: 129305 - DNA, 25 bp, Homo sapien
ccctgagtcatttcctgtgctatca

SEQ ID NO: 129306 - DNA, 25 bp, Homo sapien
cggaaacaaatgagtaaatgccctc

SEQ ID NO: 129307 - DNA, 25 bp, Homo sapien
tcagcggctcgcgacgcacattgat

SEQ ID NO: 129308 - DNA, 25 bp, Homo sapien
attgcctgccaatcggaggcggacc

SEQ ID NO: 129309 - DNA, 25 bp, Homo sapien
ccggactcgagattgacggcccagg

SEQ ID NO: 129310 - DNA, 25 bp, Homo sapien
gcttcttcgggatcccagctgacca

SEQ ID NO: 129311 - DNA, 25 bp, Homo sapien
gaacgcgccaggctcatcacctgga

SEQ ID NO: 129312 - DNA, 25 bp, Homo sapien
acctggatcatcgtgcctcagtttc

SEQ ID NO: 129313 - DNA, 25 bp, Homo sapien
cccggatgatgtcagcgattgcctg

SEQ ID NO: 129314 - DNA, 25 bp, Homo sapien
accctctagccaggggtcggagtca

SEQ ID NO: 129315 - DNA, 25 bp, Homo sapien
ggagccaaacgcaggcgcaaaaggc

SEQ ID NO: 129316 - DNA, 25 bp, Homo sapien
gctgggtcaaacagaaccgccctgg

SEQ ID NO: 129317 - DNA, 25 bp, Homo sapien
aaggcagccgttgtttgatcgtgaa

SEQ ID NO: 129318 - DNA, 25 bp, Homo sapien
actcacggctgggacgttccaagct

SEQ ID NO: 129319 - DNA, 25 bp, Homo sapien
tttgatcgtgaagtcgtcggtccta

SEQ ID NO: 129320 - DNA, 25 bp, Homo sapien
ggggtctctaagcacgtcgctctcc

SEQ ID NO: 129321 - DNA, 25 bp, Homo sapien
agatgttaacatcccatgtggtggg

SEQ ID NO: 129322 - DNA, 25 bp, Homo sapien
ctggtgtattcatcggcctcggatc

SEQ ID NO: 129323 - DNA, 25 bp, Homo sapien
aaagactgtatcgtccacctctgca

SEQ ID NO: 129324 - DNA, 25 bp, Homo sapien
ccagagactgtctgccgtcctgcag

SEQ ID NO: 129325 - DNA, 25 bp, Homo sapien
agttcctccgggagcacttcgagaa

SEQ ID NO: 129326 - DNA, 25 bp, Homo sapien
gcaggtcctcaaagactgtatcgtc

SEQ ID NO: 129327 - DNA, 25 bp, Homo sapien
cgggatccagcaggtcctcaaagac

SEQ ID NO: 129328 - DNA, 25 bp, Homo sapien
gacaggaaggaagcagccaccctcg

SEQ ID NO: 129329 - DNA, 25 bp, Homo sapien
gtcctgcaggtccttccagaagcgc

SEQ ID NO: 129330 - DNA, 25 bp, Homo sapien
gcttcccttcgcacgtgtcctgggg

SEQ ID NO: 129331 - DNA, 25 bp, Homo sapien
ctgcgcctggcgcttgtgcagctgc

SEQ ID NO: 129332 - DNA, 25 bp, Homo sapien
gcgagctgcaccctcccgagacctt

SEQ ID NO: 129333 - DNA, 25 bp, Homo sapien
agcacgacaagagcacaggcccacg

SEQ ID NO: 129334 - DNA, 25 bp, Homo sapien
cggaccggaagtgctgccgtaatct

SEQ ID NO: 129335 - DNA, 25 bp, Homo sapien
ctgccgtaatctgcgctgagagtcg

SEQ ID NO: 129336 - DNA, 25 bp, Homo sapien
ctgagagtcgcgaaagcgctgttcc

SEQ ID NO: 129337 - DNA, 25 bp, Homo sapien
cgcgctggcagtgcacctgctggat

SEQ ID NO: 129338 - DNA, 25 bp, Homo sapien
acagcgggcgagcacgacaagagca

SEQ ID NO: 129339 - DNA, 25 bp, Homo sapien
gctgtccgtagctctgtttcacaga

SEQ ID NO: 129340 - DNA, 25 bp, Homo sapien
atcatccagctagtaagtgtcggag

SEQ ID NO: 129341 - DNA, 25 bp, Homo sapien
gtggcctgctgaaatcatccagcta

SEQ ID NO: 129342 - DNA, 25 bp, Homo sapien
gcctggcgattaagtggcctgctga

SEQ ID NO: 129343 - DNA, 25 bp, Homo sapien
cattggctgtcagaaaggaccattc

SEQ ID NO: 129344 - DNA, 25 bp, Homo sapien
gcgcggtgctggtacttttacaatg

SEQ ID NO: 129345 - DNA, 25 bp, Homo sapien
atgcttcgtgaacctgctgtccgta

SEQ ID NO: 129346 - DNA, 25 bp, Homo sapien
tcggagctgtgatttggaccaactc

SEQ ID NO: 129347 - DNA, 25 bp, Homo sapien
tacaccgagggtgaaaaagccacga

SEQ ID NO: 129348 - DNA, 25 bp, Homo sapien
aggcccgcctggaaaacaccatcag

SEQ ID NO: 129349 - DNA, 25 bp, Homo sapien
tcagcccatcgttccgcactgtgaa

SEQ ID NO: 129350 - DNA, 25 bp, Homo sapien
cggggttgaacgtgagtaactcagc

SEQ ID NO: 129351 - DNA, 25 bp, Homo sapien
cctgaaatcacacacgcggggttga

SEQ ID NO: 129352 - DNA, 25 bp, Homo sapien
cacagccaaactcgccttcaaaagg

SEQ ID NO: 129353 - DNA, 25 bp, Homo sapien
cgtacgggatcagaaccagcagctc

SEQ ID NO: 129354 - DNA, 25 bp, Homo sapien
actgtgaatctgctccaatacctgc

SEQ ID NO: 129355 - DNA, 25 bp, Homo sapien
ccacgccaggaagatcgagtttctg

SEQ ID NO: 129356 - DNA, 25 bp, Homo sapien
acgccgcgaagatccgagtttctga

SEQ ID NO: 129357 - DNA, 25 bp, Homo sapien
gccacgccaggaagatccgagtttc

SEQ ID NO: 129358 - DNA, 25 bp, Homo sapien
gaagatccgagtttctgacgccgcg

SEQ ID NO: 129359 - DNA, 25 bp, Homo sapien
acgccgggaagatccgagtttctga

SEQ ID NO: 129360 - DNA, 25 bp, Homo sapien
cggccacgccaggaagatcgagttt

SEQ ID NO: 129361 - DNA, 25 bp, Homo sapien
gccacgccaggaagatcgagtttct

SEQ ID NO: 129362 - DNA, 25 bp, Homo sapien
ggccacgccaggaagatcgagtttc

SEQ ID NO: 129363 - DNA, 25 bp, Homo sapien
tggaaactgcgacactcacgcgggt

SEQ ID NO: 129364 - DNA, 25 bp, Homo sapien
aaactgcgacactcacgcgggtgcc

SEQ ID NO: 129365 - DNA, 25 bp, Homo sapien
ctcagcagctcacggtgtggaaact

SEQ ID NO: 129366 - DNA, 25 bp, Homo sapien
tctcagcagctcacggtgtggaaac

SEQ ID NO: 129367 - DNA, 25 bp, Homo sapien
tgtggaaactgcgacactcacgcgg

SEQ ID NO: 129368 - DNA, 25 bp, Homo sapien
ggaaactgcgacactcacgcgggtg

SEQ ID NO: 129369 - DNA, 25 bp, Homo sapien
acacgggtgccatctcagcagctca

SEQ ID NO: 129370 - DNA, 25 bp, Homo sapien
tcacacgggtgccatctcagcagct

SEQ ID NO: 129371 - DNA, 25 bp, Homo sapien
agggacatggctccgacctctgagc

SEQ ID NO: 129372 - DNA, 25 bp, Homo sapien
agacaccacaatcgcgatgccacaa

SEQ ID NO: 129373 - DNA, 25 bp, Homo sapien
agcttcacggcagggacatggctcc

SEQ ID NO: 129374 - DNA, 25 bp, Homo sapien
agccaagacaccacaatcgcgatgc

SEQ ID NO: 129375 - DNA, 25 bp, Homo sapien
ggctctaacgtctgtgctcaccggg

SEQ ID NO: 129376 - DNA, 25 bp, Homo sapien
taacgtctgtgctcaccgggctcac

SEQ ID NO: 129377 - DNA, 25 bp, Homo sapien
aaccctcagagcttcacggcaggga

SEQ ID NO: 129378 - DNA, 25 bp, Homo sapien
gcgatgccacaatcgcccctgatgt

SEQ ID NO: 129379 - DNA, 25 bp, Homo sapien
cgtgcgagaagtgtccatggcccgt

SEQ ID NO: 129380 - DNA, 25 bp, Homo sapien
ccctcgtttgtccactcagtcccag

SEQ ID NO: 129381 - DNA, 25 bp, Homo sapien
tcagtcccagttcagccgtcagccc

SEQ ID NO: 129382 - DNA, 25 bp, Homo sapien
cctgcacacactcggcgtgcgagaa

SEQ ID NO: 129383 - DNA, 25 bp, Homo sapien
gctcgaggcctcaacagcaagccaa

SEQ ID NO: 129384 - DNA, 25 bp, Homo sapien
tgctctcgttcactccctcgtttgt

SEQ ID NO: 129385 - DNA, 25 bp, Homo sapien
aacagcaagccaagcgcttggcctc

SEQ ID NO: 129386 - DNA, 25 bp, Homo sapien
cctcccatgctgtccttcacgagcc

SEQ ID NO: 129387 - DNA, 25 bp, Homo sapien
ctggacggtcacctctacgccgtgg

SEQ ID NO: 129388 - DNA, 25 bp, Homo sapien
tatcgcctgctcaagtatgacccgc

SEQ ID NO: 129389 - DNA, 25 bp, Homo sapien
tacaactacctcttcgtggcgggcg

SEQ ID NO: 129390 - DNA, 25 bp, Homo sapien
gcggcctgtgcgtcctctacaacta

SEQ ID NO: 129391 - DNA, 25 bp, Homo sapien
gcttcatgagcgaccactatctgga

SEQ ID NO: 129392 - DNA, 25 bp, Homo sapien
gcgacgccgcctactgcttcatgag

SEQ ID NO: 129393 - DNA, 25 bp, Homo sapien
tggccaactgctacgaggtcctgag

SEQ ID NO: 129394 - DNA, 25 bp, Homo sapien
cgcagctgagcctggccaactgcta

SEQ ID NO: 129395 - DNA, 25 bp, Homo sapien
ggcctcggacaagcagccaatggga

SEQ ID NO: 129396 - DNA, 25 bp, Homo sapien
ccgacagccaatgcggatgcgcggc

SEQ ID NO: 129397 - DNA, 25 bp, Homo sapien
cgcgcttgcgatcgtccagcgaatc

SEQ ID NO: 129398 - DNA, 25 bp, Homo sapien
gtcctgtaaagggaacgcgtcagcc

SEQ ID NO: 129399 - DNA, 25 bp, Homo sapien
cagagtgcggtattcccggtagagc

SEQ ID NO: 129400 - DNA, 25 bp, Homo sapien
cccgtggtacgcttcagagtgcggt

SEQ ID NO: 129401 - DNA, 25 bp, Homo sapien
cgccactccgccaaacagggaagtg

SEQ ID NO: 129402 - DNA, 25 bp, Homo sapien
ccaatgggaggcgtcaacgtcatcg

SEQ ID NO: 129403 - DNA, 25 bp, Homo sapien
gcttcaacaatctgggcctgcgcgg

SEQ ID NO: 129404 - DNA, 25 bp, Homo sapien
gtgaaccgggcctcctatgcgttcc

SEQ ID NO: 129405 - DNA, 25 bp, Homo sapien
ccgcgtggacctgcgcttcaacaat

SEQ ID NO: 129406 - DNA, 25 bp, Homo sapien
cagcttctggatgcaggctgcctgc

SEQ ID NO: 129407 - DNA, 25 bp, Homo sapien
ctcctatgcgttcctgcgggaggca

SEQ ID NO: 129408 - DNA, 25 bp, Homo sapien
ggacctgcccatgcgcaacactgtg

SEQ ID NO: 129409 - DNA, 25 bp, Homo sapien
tcctgcgggaggcactccgaagcag

SEQ ID NO: 129410 - DNA, 25 bp, Homo sapien
gcggcctgtctgtgatcatcccaca

SEQ ID NO: 129411 - DNA, 25 bp, Homo sapien
ggggcacctttctccaggtcaccaa

SEQ ID NO: 129412 - DNA, 25 bp, Homo sapien
aggattcccgagtgcaacgttcccg

SEQ ID NO: 129413 - DNA, 25 bp, Homo sapien
ttccacctttactgacggagcatgc

SEQ ID NO: 129414 - DNA, 25 bp, Homo sapien
ctagcagtggatctcgtaggcgacc

SEQ ID NO: 129415 - DNA, 25 bp, Homo sapien
tgacgaacatctcgtggccgcgctc

SEQ ID NO: 129416 - DNA, 25 bp, Homo sapien
tcctctagctgtgcgaacgtacagg

SEQ ID NO: 129417 - DNA, 25 bp, Homo sapien
agtcgttgacgaacagcgctccctc

SEQ ID NO: 129418 - DNA, 25 bp, Homo sapien
ttggaggcctcgcactcgtacttac

SEQ ID NO: 129419 - DNA, 25 bp, Homo sapien
ccttccgcggttcagccgcagacgc

SEQ ID NO: 129420 - DNA, 25 bp, Homo sapien
gccatctcccgaggcccggttcctc

SEQ ID NO: 129421 - DNA, 25 bp, Homo sapien
accgcagggcgccacactccaccgt

SEQ ID NO: 129422 - DNA, 25 bp, Homo sapien
tcccgcagctccacacggtgcccac

SEQ ID NO: 129423 - DNA, 25 bp, Homo sapien
ctcccggctctaggcgggcgatgtt

SEQ ID NO: 129424 - DNA, 25 bp, Homo sapien
cgcaagccgcgcagccggttgctag

SEQ ID NO: 129425 - DNA, 25 bp, Homo sapien
cggttgctagtgagcgccagctcca

SEQ ID NO: 129426 - DNA, 25 bp, Homo sapien
ggcctacgaaggcgccgctgcgcaa

SEQ ID NO: 129427 - DNA, 25 bp, Homo sapien
aggtagcacagcaccatgcggttga

SEQ ID NO: 129428 - DNA, 25 bp, Homo sapien
cgtagtgcgcgatgcactgctcgta

SEQ ID NO: 129429 - DNA, 25 bp, Homo sapien
tgctcgtagaactcgtgcgggatca

SEQ ID NO: 129430 - DNA, 25 bp, Homo sapien
accctccatgaagctggtgtccagg

SEQ ID NO: 129431 - DNA, 25 bp, Homo sapien
gctccaggacacagaaggcactttc

SEQ ID NO: 129432 - DNA, 25 bp, Homo sapien
atctccttgcgggtgttctcgaaga

SEQ ID NO: 129433 - DNA, 25 bp, Homo sapien
tgagcacccgcaggaaggacatctc

SEQ ID NO: 129434 - DNA, 25 bp, Homo sapien
atccatcttggtgaccgcgacgttg

SEQ ID NO: 129435 - DNA, 25 bp, Homo sapien
gattccgcgacgactgtcactgcct

SEQ ID NO: 129436 - DNA, 25 bp, Homo sapien
gccagtgcctgacgtctcgagcgca

SEQ ID NO: 129437 - DNA, 25 bp, Homo sapien
cccaagctggtctttgggcggccct

SEQ ID NO: 129438 - DNA, 25 bp, Homo sapien
aagaggatggaacgccctgtgtctg

SEQ ID NO: 129439 - DNA, 25 bp, Homo sapien
gccggttgattttcggccgggctca

SEQ ID NO: 129440 - DNA, 25 bp, Homo sapien
gggtgtcacacgcaggattccgcga

SEQ ID NO: 129441 - DNA, 25 bp, Homo sapien
gcccgtactcgaagcaggcgctgag

SEQ ID NO: 129442 - DNA, 25 bp, Homo sapien
agcgctgcgacctggtgcctgtatc

SEQ ID NO: 129443 - DNA, 25 bp, Homo sapien
tagtagaaatactcgcgggtccgcg

SEQ ID NO: 129444 - DNA, 25 bp, Homo sapien
cctggtggtccacgtagtagaaata

SEQ ID NO: 129445 - DNA, 25 bp, Homo sapien
acagagtccgaagctgcacaacgca

SEQ ID NO: 129446 - DNA, 25 bp, Homo sapien
gactctggccctgcgtgtaggaaac

SEQ ID NO: 129447 - DNA, 25 bp, Homo sapien
ctttattcactcgtgtcgtcgcctc

SEQ ID NO: 129448 - DNA, 25 bp, Homo sapien
gcgcagggtccatgtgcactttatt

SEQ ID NO: 129449 - DNA, 25 bp, Homo sapien
gctgccttttgacagggcttccaaa

SEQ ID NO: 129450 - DNA, 25 bp, Homo sapien
ctcccggacatgcagctgccttttg

SEQ ID NO: 129451 - DNA, 25 bp, Homo sapien
gttgccgtggcacctgaagatgccc

SEQ ID NO: 129452 - DNA, 25 bp, Homo sapien
cgttcttggcatgccggatctcctc

SEQ ID NO: 129453 - DNA, 25 bp, Homo sapien
acgggctgaacacggcgttcttggc

SEQ ID NO: 129454 - DNA, 25 bp, Homo sapien
ctgccgaacatggacgggctgaaca

SEQ ID NO: 129455 - DNA, 25 bp, Homo sapien
tgacctcctgcagtgcgctgccgaa

SEQ ID NO: 129456 - DNA, 25 bp, Homo sapien
tggtcaccgttgagcgccagcacct

SEQ ID NO: 129457 - DNA, 25 bp, Homo sapien
tctgtctggtcaccgttgagcgcca

SEQ ID NO: 129458 - DNA, 25 bp, Homo sapien
cctgaagatgccctctgtctggtca

SEQ ID NO: 129459 - DNA, 25 bp, Homo sapien
gcttcttgatggactcgctgctcca

SEQ ID NO: 129460 - DNA, 25 bp, Homo sapien
cacagctggatgtagagctcgtccc

SEQ ID NO: 129461 - DNA, 25 bp, Homo sapien
cttgtcacgatcatgggcttcttga

SEQ ID NO: 129462 - DNA, 25 bp, Homo sapien
ccctgcgtgtgcttgttgaagtgct

SEQ ID NO: 129463 - DNA, 25 bp, Homo sapien
gcttgaagagctcgcaggcctcctt

SEQ ID NO: 129464 - DNA, 25 bp, Homo sapien
aggcccagttctcgatgtccgtctc

SEQ ID NO: 129465 - DNA, 25 bp, Homo sapien
cgccggtcacccatgtacatctgga

SEQ ID NO: 129466 - DNA, 25 bp, Homo sapien
cagcatgttggcgatggacaccttc

SEQ ID NO: 129467 - DNA, 25 bp, Homo sapien
tggcttggcacaaagagggctttct

SEQ ID NO: 129468 - DNA, 25 bp, Homo sapien
ctctgggaagaagatggtgccgtca

SEQ ID NO: 129469 - DNA, 25 bp, Homo sapien
gccagcctcgaattgcacgtccatg

SEQ ID NO: 129470 - DNA, 25 bp, Homo sapien
tcgggacacttctgcttggtgagca

SEQ ID NO: 129471 - DNA, 25 bp, Homo sapien
ggactgtactccaggctcaggaagc

SEQ ID NO: 129472 - DNA, 25 bp, Homo sapien
tgcaaggagtacgaaccaccgccgg

SEQ ID NO: 129473 - DNA, 25 bp, Homo sapien
ggctggaccaggacatggcatcctc

SEQ ID NO: 129474 - DNA, 25 bp, Homo sapien
ccatggtgctgtagtctccggactt

SEQ ID NO: 129475 - DNA, 25 bp, Homo sapien
aactcctgcgctttctcagtgtcgg

SEQ ID NO: 129476 - DNA, 25 bp, Homo sapien
caccggtgaccaggttggcgtacat

SEQ ID NO: 129477 - DNA, 25 bp, Homo sapien
accactggttctcgctggtgcgctt

SEQ ID NO: 129478 - DNA, 25 bp, Homo sapien
tgttggggtcgaacagctcccacca

SEQ ID NO: 129479 - DNA, 25 bp, Homo sapien
gctgcgtgctggcattgtagtagta

SEQ ID NO: 129480 - DNA, 25 bp, Homo sapien
gccagcgggatgatgtcgcagccct

SEQ ID NO: 129481 - DNA, 25 bp, Homo sapien
actccgtgttctgcttcagcgtctg

SEQ ID NO: 129482 - DNA, 25 bp, Homo sapien
tgcgcggttcgatgatctccaccca

SEQ ID NO: 129483 - DNA, 25 bp, Homo sapien
ctgggaaactctcggccctgggcat

SEQ ID NO: 129484 - DNA, 25 bp, Homo sapien
ctgcccaagcgactgcggccaggat

SEQ ID NO: 129485 - DNA, 25 bp, Homo sapien
tgcgcactcaaccagtgggccctgg

SEQ ID NO: 129486 - DNA, 25 bp, Homo sapien
cgagcgatatacaaggcacggttaa

SEQ ID NO: 129487 - DNA, 25 bp, Homo sapien
cctcgtcgggaagtgagtgtttata

SEQ ID NO: 129488 - DNA, 25 bp, Homo sapien
acctcgctgggaccctggtcttgct

SEQ ID NO: 129489 - DNA, 25 bp, Homo sapien
tagttcccggggacgagcgatatac

SEQ ID NO: 129490 - DNA, 25 bp, Homo sapien
cacggttaagaaaagtctggcggct

SEQ ID NO: 129491 - DNA, 25 bp, Homo sapien
caggactcttgtgcgtgctcaccgc

SEQ ID NO: 129492 - DNA, 25 bp, Homo sapien
catggccaacgtgggcaggactctt

SEQ ID NO: 129493 - DNA, 25 bp, Homo sapien
ctgggccaccatggccaacgtgggc

SEQ ID NO: 129494 - DNA, 25 bp, Homo sapien
gggaacacagcaaagcctcagcagc

SEQ ID NO: 129495 - DNA, 25 bp, Homo sapien
acccagcgagggtcagactcacagc

SEQ ID NO: 129496 - DNA, 25 bp, Homo sapien
ctgtctccgtcaaacccagcgaggg

SEQ ID NO: 129497 - DNA, 25 bp, Homo sapien
gggctctcgccaagccatctggaga

SEQ ID NO: 129498 - DNA, 25 bp, Homo sapien
aagccatctggagaaactcggccca

SEQ ID NO: 129499 - DNA, 25 bp, Homo sapien
cagctgaggaagaaaacggtctgga

SEQ ID NO: 129500 - DNA, 25 bp, Homo sapien
aaacggtctggagccgatgaaaggc

SEQ ID NO: 129501 - DNA, 25 bp, Homo sapien
ccaagtgtgggcctcgaacccagct

SEQ ID NO: 129502 - DNA, 25 bp, Homo sapien
tcgaacccagctcgacacaggaggg

SEQ ID NO: 129503 - DNA, 25 bp, Homo sapien
ccgcacccgcaatggaaaaggacac

SEQ ID NO: 129504 - DNA, 25 bp, Homo sapien
caatggaaaaggacacgggcctcac

SEQ ID NO: 129505 - DNA, 25 bp, Homo sapien
ggctcctggggtcttcactgagaca

SEQ ID NO: 129506 - DNA, 25 bp, Homo sapien
gggtcttcactgagacagctgagga

SEQ ID NO: 129507 - DNA, 25 bp, Homo sapien
gccctttccgcattgcgtgtaaagg

SEQ ID NO: 129508 - DNA, 25 bp, Homo sapien
gcatggcctcgaaggctggacacct

SEQ ID NO: 129509 - DNA, 25 bp, Homo sapien
tggcctcgaaggctggacacctgcg

SEQ ID NO: 129510 - DNA, 25 bp, Homo sapien
gcattgcgtgtaaaggggaaattcg

SEQ ID NO: 129511 - DNA, 25 bp, Homo sapien
gaaggctggacacctgcggggccct

SEQ ID NO: 129512 - DNA, 25 bp, Homo sapien
cccggcatggcctcgaaggctggac

SEQ ID NO: 129513 - DNA, 25 bp, Homo sapien
gggccctttccgcattgcgtgtaaa

SEQ ID NO: 129514 - DNA, 25 bp, Homo sapien
ccgcattgcgtgtaaaggggaaatt

SEQ ID NO: 129515 - DNA, 25 bp, Homo sapien
agaaagcagttccacccactcgtga

SEQ ID NO: 129516 - DNA, 25 bp, Homo sapien
ggaacagccagcgacgaatccattc

SEQ ID NO: 129517 - DNA, 25 bp, Homo sapien
tggacagacgtcagggcaccatacg

SEQ ID NO: 129518 - DNA, 25 bp, Homo sapien
taccgagtgttcgaccctggaatcc

SEQ ID NO: 129519 - DNA, 25 bp, Homo sapien
actccggcaggtcgacattatggct

SEQ ID NO: 129520 - DNA, 25 bp, Homo sapien
attatggctcctgcactcgtagtcc

SEQ ID NO: 129521 - DNA, 25 bp, Homo sapien
tcctgcgtctgggacatcgctgttt

SEQ ID NO: 129522 - DNA, 25 bp, Homo sapien
cagtgctgatatggaagacgcctca

SEQ ID NO: 129523 - DNA, 25 bp, Homo sapien
acagcaggtatgctcgtgtgcgcgt

SEQ ID NO: 129524 - DNA, 25 bp, Homo sapien
cggcacgcagcatgcatgtgggcct

SEQ ID NO: 129525 - DNA, 25 bp, Homo sapien
cagcatgcatgtgggcctgtgtgtc

SEQ ID NO: 129526 - DNA, 25 bp, Homo sapien
tcccagagggagagtgtgtgcccat

SEQ ID NO: 129527 - DNA, 25 bp, Homo sapien
tgagcccgtgtgtccctgagacagc

SEQ ID NO: 129528 - DNA, 25 bp, Homo sapien
tgtgtccctgagacagcaggtatgc

SEQ ID NO: 129529 - DNA, 25 bp, Homo sapien
ggcgacgcccgccatagaccagggt

SEQ ID NO: 129530 - DNA, 25 bp, Homo sapien
cagcatctgcctgggctggcgacgc

SEQ ID NO: 129531 - DNA, 25 bp, Homo sapien
ggagcacccactgcacactgcggca

SEQ ID NO: 129532 - DNA, 25 bp, Homo sapien
cggttcacggagcactcactgcaca

SEQ ID NO: 129533 - DNA, 25 bp, Homo sapien
ggagcactcactgcacactgcggca

SEQ ID NO: 129534 - DNA, 25 bp, Homo sapien
acggagcactcactgcacactgcgg

SEQ ID NO: 129535 - DNA, 25 bp, Homo sapien
ttcacggagcactcactgcacactg

SEQ ID NO: 129536 - DNA, 25 bp, Homo sapien
cggagcacccactgcacactgcggc

SEQ ID NO: 129537 - DNA, 25 bp, Homo sapien
ggttcacggagcactcactgcacac

SEQ ID NO: 129538 - DNA, 25 bp, Homo sapien
ggcggcccggttcacggagcactca

SEQ ID NO: 129539 - DNA, 25 bp, Homo sapien
accctgtgagttagcggtgtcttcc

SEQ ID NO: 129540 - DNA, 25 bp, Homo sapien
ttcccgtctctttcggtgcagagca

SEQ ID NO: 129541 - DNA, 25 bp, Homo sapien
tttactcggtaattcactcagctgc

SEQ ID NO: 129542 - DNA, 25 bp, Homo sapien
agttaccatctgacacgtctcggtg

SEQ ID NO: 129543 - DNA, 25 bp, Homo sapien
tgggcttcccgagtctgagatttca

SEQ ID NO: 129544 - DNA, 25 bp, Homo sapien
tcttctcaaaacgtgggctgccctg

SEQ ID NO: 129545 - DNA, 25 bp, Homo sapien
gctcgtgtctcttcacctcctgtta

SEQ ID NO: 129546 - DNA, 25 bp, Homo sapien
ctgcagctcgactagtgctctattc

SEQ ID NO: 129547 - DNA, 25 bp, Homo sapien
tcacagggcgggatctacgaaggat

SEQ ID NO: 129548 - DNA, 25 bp, Homo sapien
tcacggagcggagccaataaaagcg

SEQ ID NO: 129549 - DNA, 25 bp, Homo sapien
cggtgaattggactgactggtgacc

SEQ ID NO: 129550 - DNA, 25 bp, Homo sapien
tgtcccaccagtcgggcggtgaatt

SEQ ID NO: 129551 - DNA, 25 bp, Homo sapien
ctgtgacccgctgacctgtccttgt

SEQ ID NO: 129552 - DNA, 25 bp, Homo sapien
cggtcctcgacagcactcattcagt

SEQ ID NO: 129553 - DNA, 25 bp, Homo sapien
cggccatttcccgagggtctcaggc

SEQ ID NO: 129554 - DNA, 25 bp, Homo sapien
ttctcctacgaaggcgcgaacgttc

SEQ ID NO: 129555 - DNA, 25 bp, Homo sapien
cgtcatcgcgtcagccacgttttca

SEQ ID NO: 129556 - DNA, 25 bp, Homo sapien
gccctagattcttcggcgccttaaa

SEQ ID NO: 129557 - DNA, 25 bp, Homo sapien
agaccctgaggtgaggcttcctgta

SEQ ID NO: 129558 - DNA, 25 bp, Homo sapien
tgccgtctgaccataggtttcttgc

SEQ ID NO: 129559 - DNA, 25 bp, Homo sapien
ttctgagggaaaacctggcgtcatc

SEQ ID NO: 129560 - DNA, 25 bp, Homo sapien
caccggggatgtcgctaatgagtcc

SEQ ID NO: 129561 - DNA, 25 bp, Homo sapien
cagtgctcctttcggctccagggaa

SEQ ID NO: 129562 - DNA, 25 bp, Homo sapien
ttgcctcgctgatcgttcctctacg

SEQ ID NO: 129563 - DNA, 25 bp, Homo sapien
ggcatgtgacgctgcgacggggcgt

SEQ ID NO: 129564 - DNA, 25 bp, Homo sapien
tgacactggcatgtgacgctgcgac

SEQ ID NO: 129565 - DNA, 25 bp, Homo sapien
atgtgacgctgcgacggggcgtccc

SEQ ID NO: 129566 - DNA, 25 bp, Homo sapien
gacactggcatgtgacgctgcgacg

SEQ ID NO: 129567 - DNA, 25 bp, Homo sapien
acactggcatgtgacgctgcgacgg

SEQ ID NO: 129568 - DNA, 25 bp, Homo sapien
cactggcatgtgacgctgcgacggg

SEQ ID NO: 129569 - DNA, 25 bp, Homo sapien
gggtgacactggcatgtgacgctgc

SEQ ID NO: 129570 - DNA, 25 bp, Homo sapien
gtgacactggcatgtgacgctgcga

SEQ ID NO: 129571 - DNA, 25 bp, Homo sapien
acggaaagcacagcgcgtgccgctg

SEQ ID NO: 129572 - DNA, 25 bp, Homo sapien
cagaggccttccgtggtaagacagc

SEQ ID NO: 129573 - DNA, 25 bp, Homo sapien
gaggccttccgtggtaagacagcca

SEQ ID NO: 129574 - DNA, 25 bp, Homo sapien
ggccttccgtggtaagacagccacg

SEQ ID NO: 129575 - DNA, 25 bp, Homo sapien
tggtaagacagccacggaaagcaca

SEQ ID NO: 129576 - DNA, 25 bp, Homo sapien
agacagccacggaaagcacagcgcg

SEQ ID NO: 129577 - DNA, 25 bp, Homo sapien
agccacggaaagcacagcgcgtgcc

SEQ ID NO: 129578 - DNA, 25 bp, Homo sapien
cccagaggccttccgtggtaagaca

SEQ ID NO: 129579 - DNA, 25 bp, Homo sapien
attcaccgaggcaggcggtagcacc

SEQ ID NO: 129580 - DNA, 25 bp, Homo sapien
tgggcattaaagcagcggattcacc

SEQ ID NO: 129581 - DNA, 25 bp, Homo sapien
gctcttgttgggaatgggcattaaa

SEQ ID NO: 129582 - DNA, 25 bp, Homo sapien
agcttgtgtcctggcgtcgccgact

SEQ ID NO: 129583 - DNA, 25 bp, Homo sapien
gccttccactctgctcttgttggga

SEQ ID NO: 129584 - DNA, 25 bp, Homo sapien
gagcgtctccactctcgggctcaga

SEQ ID NO: 129585 - DNA, 25 bp, Homo sapien
cagcattgcctgactcgtctttgga

SEQ ID NO: 129586 - DNA, 25 bp, Homo sapien
ggcgagttctgcagctggctttgca

SEQ ID NO: 129587 - DNA, 25 bp, Homo sapien
gaagccagctgtggtcctcagtcca

SEQ ID NO: 129588 - DNA, 25 bp, Homo sapien
cggtcaccatacatcgtgtgtcccg

SEQ ID NO: 129589 - DNA, 25 bp, Homo sapien
cccgtcggtcaccatacatcgtgtg

SEQ ID NO: 129590 - DNA, 25 bp, Homo sapien
cagtacgcctccgagaacgccggga

SEQ ID NO: 129591 - DNA, 25 bp, Homo sapien
gcagtcgcaccgagcccggaacgga

SEQ ID NO: 129592 - DNA, 25 bp, Homo sapien
cacctgtttgctcgacccggggaag

SEQ ID NO: 129593 - DNA, 25 bp, Homo sapien
gtggtcctcagtccagccttctagg

SEQ ID NO: 129594 - DNA, 25 bp, Homo sapien
cgctccttcctggtccgacactgcc

SEQ ID NO: 129595 - DNA, 25 bp, Homo sapien
gcagtccgtactcggggccttgtcc

SEQ ID NO: 129596 - DNA, 25 bp, Homo sapien
gccgtaaagcgggaatgctgccacc

SEQ ID NO: 129597 - DNA, 25 bp, Homo sapien
catcgggacgcagaagccgctctgt

SEQ ID NO: 129598 - DNA, 25 bp, Homo sapien
tccctcgaacaggaagtgccgctga

SEQ ID NO: 129599 - DNA, 25 bp, Homo sapien
cagcaccgcgagaggaccgggcaca

SEQ ID NO: 129600 - DNA, 25 bp, Homo sapien
ccaatcggaaccgatccggaagtga

SEQ ID NO: 129601 - DNA, 25 bp, Homo sapien
ggaagtgacgtcagccgactgtctg

SEQ ID NO: 129602 - DNA, 25 bp, Homo sapien
cccgcgaatggcaaagccgtaaagc

SEQ ID NO: 129603 - DNA, 25 bp, Homo sapien
gaacacagttctcaacacgggcctc

SEQ ID NO: 129604 - DNA, 25 bp, Homo sapien
ctggtgagcgggaaacatgacgcct

SEQ ID NO: 129605 - DNA, 25 bp, Homo sapien
atccaacaccgccatctgctggtga

SEQ ID NO: 129606 - DNA, 25 bp, Homo sapien
gaaccgcaggtcgaaggccagtacc

SEQ ID NO: 129607 - DNA, 25 bp, Homo sapien
tccgcgtaaccaggaaccgcaggtc

SEQ ID NO: 129608 - DNA, 25 bp, Homo sapien
gctccagggtctcgaaaatttccgc

SEQ ID NO: 129609 - DNA, 25 bp, Homo sapien
ggtgatgtgattcagaccgcggctc

SEQ ID NO: 129610 - DNA, 25 bp, Homo sapien
tctgggttctcaccgtaaaagaaga

SEQ ID NO: 129611 - DNA, 25 bp, Homo sapien
ggccgcaaggatgacctacctgttc

SEQ ID NO: 129612 - DNA, 25 bp, Homo sapien
tggcaaatgtccgtctccctgatga

SEQ ID NO: 129613 - DNA, 25 bp, Homo sapien
gcaccttgacgatgcccttgatgta

SEQ ID NO: 129614 - DNA, 25 bp, Homo sapien
gtagccgtgccgctcagcgaaatcc

SEQ ID NO: 129615 - DNA, 25 bp, Homo sapien
tgtccacggatcacacggcccatgg

SEQ ID NO: 129616 - DNA, 25 bp, Homo sapien
tacctgttcaccagcgcggccgaaa

SEQ ID NO: 129617 - DNA, 25 bp, Homo sapien
cccactcgtggaacgtcatggtttg

SEQ ID NO: 129618 - DNA, 25 bp, Homo sapien
agcgcctttacggtgcttcacgtgc

SEQ ID NO: 129619 - DNA, 25 bp, Homo sapien
tttcccgcagcgttcatttaccctg

SEQ ID NO: 129620 - DNA, 25 bp, Homo sapien
gatggcgggctcttcccggcagcct

SEQ ID NO: 129621 - DNA, 25 bp, Homo sapien
ggagcggacccgcagccgtcactgt

SEQ ID NO: 129622 - DNA, 25 bp, Homo sapien
gcccgtcgggcctgggactgatacc

SEQ ID NO: 129623 - DNA, 25 bp, Homo sapien
aagccgtcgagacgcgagcgccatc

SEQ ID NO: 129624 - DNA, 25 bp, Homo sapien
caaggggtgaacgttcgctgcctcc

SEQ ID NO: 129625 - DNA, 25 bp, Homo sapien
gactgatacccggtctggcccggaa

SEQ ID NO: 129626 - DNA, 25 bp, Homo sapien
gagcgccgagaacgtcgacgccctt

SEQ ID NO: 129627 - DNA, 25 bp, Homo sapien
ggccttcaagcaaagctccatcctg

SEQ ID NO: 129628 - DNA, 25 bp, Homo sapien
cgttccgcaggagctacacgctgaa

SEQ ID NO: 129629 - DNA, 25 bp, Homo sapien
caaggccttcggtcgcaagtccaac

SEQ ID NO: 129630 - DNA, 25 bp, Homo sapien
gcgttcagatacaactcgctgcttc

SEQ ID NO: 129631 - DNA, 25 bp, Homo sapien
gagggtcctcgctcctgaagcacca

SEQ ID NO: 129632 - DNA, 25 bp, Homo sapien
tgcagcaccagaagttccacaccgg

SEQ ID NO: 129633 - DNA, 25 bp, Homo sapien
ggcaccagctgatccacactgagga

SEQ ID NO: 129634 - DNA, 25 bp, Homo sapien
tacacgctgaacgagcactaccggc

SEQ ID NO: 129635 - DNA, 25 bp, Homo sapien
tctgccggacgcagaaggaacccga

SEQ ID NO: 129636 - DNA, 25 bp, Homo sapien
accagcgcccgaagctggtgatccg

SEQ ID NO: 129637 - DNA, 25 bp, Homo sapien
gctccagccgctcactggggacaag

SEQ ID NO: 129638 - DNA, 25 bp, Homo sapien
cctgaacagcctcggtgggaaccag

SEQ ID NO: 129639 - DNA, 25 bp, Homo sapien
actcgggttgccctcggtccgagtg

SEQ ID NO: 129640 - DNA, 25 bp, Homo sapien
tgccctcggtccgagtgatccctgg

SEQ ID NO: 129641 - DNA, 25 bp, Homo sapien
agtgatccctggtcgcttccttagc

SEQ ID NO: 129642 - DNA, 25 bp, Homo sapien
tcactggggacaaggcccgagccag

SEQ ID NO: 129643 - DNA, 25 bp, Homo sapien
cgcagtatccagagctctccgaaca

SEQ ID NO: 129644 - DNA, 25 bp, Homo sapien
cacagcggcgaagcagcctttccta

SEQ ID NO: 129645 - DNA, 25 bp, Homo sapien
atgcagccaaaagcgggcctggtcc

SEQ ID NO: 129646 - DNA, 25 bp, Homo sapien
ccgctctaggaaggcagcaatgacc

SEQ ID NO: 129647 - DNA, 25 bp, Homo sapien
ggggtcccagacctcgtcttagaca

SEQ ID NO: 129648 - DNA, 25 bp, Homo sapien
ttctgaggtagaaactgcggcctgc

SEQ ID NO: 129649 - DNA, 25 bp, Homo sapien
ggaaaccgcgagaccttgaggatca

SEQ ID NO: 129650 - DNA, 25 bp, Homo sapien
ggaccttggtgcacagagtcaaatt

SEQ ID NO: 129651 - DNA, 25 bp, Homo sapien
cactcggccctggtgtttgcttttt

SEQ ID NO: 129652 - DNA, 25 bp, Homo sapien
tcgttgcaacactgaagtcctcttg

SEQ ID NO: 129653 - DNA, 25 bp, Homo sapien
ccacgattcgtgtggaggacgcacc

SEQ ID NO: 129654 - DNA, 25 bp, Homo sapien
cctggagggcaagcatgtttacgtc

SEQ ID NO: 129655 - DNA, 25 bp, Homo sapien
tgtttacgtcatttggcccgcctgc

SEQ ID NO: 129656 - DNA, 25 bp, Homo sapien
gccgtcctggaactcgagctcgttc

SEQ ID NO: 129657 - DNA, 25 bp, Homo sapien
tgcgaatgtcgccttctcaggggcc

SEQ ID NO: 129658 - DNA, 25 bp, Homo sapien
tccgagccttttgcccttgcggttc

SEQ ID NO: 129659 - DNA, 25 bp, Homo sapien
tagcctctctagatggcgggaggcc

SEQ ID NO: 129660 - DNA, 25 bp, Homo sapien
ctcgttctatctggggcagcgtagc

SEQ ID NO: 129661 - DNA, 25 bp, Homo sapien
agacgtctcagccaacgccggctga

SEQ ID NO: 129662 - DNA, 25 bp, Homo sapien
caccgtggcacgaagacgtctcagc

SEQ ID NO: 129663 - DNA, 25 bp, Homo sapien
taacctcaacgggtcgcgcttggaa

SEQ ID NO: 129664 - DNA, 25 bp, Homo sapien
tggagcttcgcggaactaacctcaa

SEQ ID NO: 129665 - DNA, 25 bp, Homo sapien
ggcatcagggacaaccagacgcagg

SEQ ID NO: 129666 - DNA, 25 bp, Homo sapien
tccgcccgagctcgaatggtggcac

SEQ ID NO: 129667 - DNA, 25 bp, Homo sapien
tgccggaccctcagctctgtcgccg

SEQ ID NO: 129668 - DNA, 25 bp, Homo sapien
ctcagggtttgcttccttcccaggc

SEQ ID NO: 129669 - DNA, 25 bp, Homo sapien
tcagggagtctcagggtttgcttcc

SEQ ID NO: 129670 - DNA, 25 bp, Homo sapien
acattggtttcctctgttgggggcg

SEQ ID NO: 129671 - DNA, 25 bp, Homo sapien
gcggctccaaggcttcagccacaga

SEQ ID NO: 129672 - DNA, 25 bp, Homo sapien
tgatgggtccggcttgtcagcgcca

SEQ ID NO: 129673 - DNA, 25 bp, Homo sapien
ccatctgggtctcagtgtctgtctg

SEQ ID NO: 129674 - DNA, 25 bp, Homo sapien
ggcttcagccacagacattggtttc

SEQ ID NO: 129675 - DNA, 25 bp, Homo sapien
gcacttcccacctgtagtcttttga

SEQ ID NO: 129676 - DNA, 25 bp, Homo sapien
gactcactcggctcgaccacgggaa

SEQ ID NO: 129677 - DNA, 25 bp, Homo sapien
cctgggccggaaatgcctaatctga

SEQ ID NO: 129678 - DNA, 25 bp, Homo sapien
attccaggtttcgtgggtccgctct

SEQ ID NO: 129679 - DNA, 25 bp, Homo sapien
cgctctaggcggctgatagtactca

SEQ ID NO: 129680 - DNA, 25 bp, Homo sapien
cctccaagtagtgatcaagctcaga

SEQ ID NO: 129681 - DNA, 25 bp, Homo sapien
gacgcgtcctctacgggtcactgag

SEQ ID NO: 129682 - DNA, 25 bp, Homo sapien
atagtactcaatgctccggcagtcc

SEQ ID NO: 129683 - DNA, 25 bp, Homo sapien
tccacgtcccgagacgccggcctct

SEQ ID NO: 129684 - DNA, 25 bp, Homo sapien
cgaccgcgccctgaccctcgctctt

SEQ ID NO: 129685 - DNA, 25 bp, Homo sapien
gagcctccacgtcccgagacgccgg

SEQ ID NO: 129686 - DNA, 25 bp, Homo sapien
cctccacgtcccgagacgccggcct

SEQ ID NO: 129687 - DNA, 25 bp, Homo sapien
agacgccggcctctcaaacgaccgc

SEQ ID NO: 129688 - DNA, 25 bp, Homo sapien
ggcctctcaaacgaccgcgccctga

SEQ ID NO: 129689 - DNA, 25 bp, Homo sapien
aacgaccgcgccctgaccctcgctc

SEQ ID NO: 129690 - DNA, 25 bp, Homo sapien
cctctcaaacgaccgcgccctgacc

SEQ ID NO: 129691 - DNA, 25 bp, Homo sapien
ggcacgtagtcagcgcccgcgatca

SEQ ID NO: 129692 - DNA, 25 bp, Homo sapien
tatccggaaaggtgccgggcacgta

SEQ ID NO: 129693 - DNA, 25 bp, Homo sapien
gagagctttgaacttttatccggaa

SEQ ID NO: 129694 - DNA, 25 bp, Homo sapien
gacacaccctcgtggagagctttga

SEQ ID NO: 129695 - DNA, 25 bp, Homo sapien
gtgagccttgagaagacacaccctc

SEQ ID NO: 129696 - DNA, 25 bp, Homo sapien
cgtgctgtttacttgcttttccctc

SEQ ID NO: 129697 - DNA, 25 bp, Homo sapien
gccgtagctgctcacgtgctgttta

SEQ ID NO: 129698 - DNA, 25 bp, Homo sapien
ctcttgcgccgtagctgctcacgtg

SEQ ID NO: 129699 - DNA, 25 bp, Homo sapien
cgtgcagtaacgctgactccagagc

SEQ ID NO: 129700 - DNA, 25 bp, Homo sapien
agcaacctacgtgcagtaacgctga

SEQ ID NO: 129701 - DNA, 25 bp, Homo sapien
gtctctgcccagagcaacctacgtg

SEQ ID NO: 129702 - DNA, 25 bp, Homo sapien
cagagcgcacccgttgggcgatgaa

SEQ ID NO: 129703 - DNA, 25 bp, Homo sapien
ggcggcacagcgtcgaaaaaacaaa

SEQ ID NO: 129704 - DNA, 25 bp, Homo sapien
agaaaacgcggaacagggcctctgt

SEQ ID NO: 129705 - DNA, 25 bp, Homo sapien
tggaatccacgggtgcgaatccacg

SEQ ID NO: 129706 - DNA, 25 bp, Homo sapien
cgaatccacgggcacgtgtgatctg

SEQ ID NO: 129707 - DNA, 25 bp, Homo sapien
ctcgtgcacagtgccacaggcggcg

SEQ ID NO: 129708 - DNA, 25 bp, Homo sapien
aacctgcagcgggtctcagttctcc

SEQ ID NO: 129709 - DNA, 25 bp, Homo sapien
caccctgggtctcggacaggcctta

SEQ ID NO: 129710 - DNA, 25 bp, Homo sapien
aggtctctggacagccgtgatgcta

SEQ ID NO: 129711 - DNA, 25 bp, Homo sapien
tccagctccgataccgggactttct

SEQ ID NO: 129712 - DNA, 25 bp, Homo sapien
ataccgggactttctgtgcgatgtg

SEQ ID NO: 129713 - DNA, 25 bp, Homo sapien
gaagcctcttggtggctcgtgcaca

SEQ ID NO: 129714 - DNA, 25 bp, Homo sapien
aagcgctggtccatcggagccgtgt

SEQ ID NO: 129715 - DNA, 25 bp, Homo sapien
tggcctgagcgaaccttcggagata

SEQ ID NO: 129716 - DNA, 25 bp, Homo sapien
gctgtcagcaaaccggcatggcctg

SEQ ID NO: 129717 - DNA, 25 bp, Homo sapien
cttatgtgttccgagtgctgtcagc

SEQ ID NO: 129718 - DNA, 25 bp, Homo sapien
ttgacctcatggaagggaagtctta

SEQ ID NO: 129719 - DNA, 25 bp, Homo sapien
ccgagatatgccgtgtttgacctca

SEQ ID NO: 129720 - DNA, 25 bp, Homo sapien
tcaacgcccagacggctgtgagatc

SEQ ID NO: 129721 - DNA, 25 bp, Homo sapien
ggacctcgcggttttcactgccagt

SEQ ID NO: 129722 - DNA, 25 bp, Homo sapien
tgggatagcgacaacagagcatttc

SEQ ID NO: 129723 - DNA, 25 bp, Homo sapien
tcgccagccttcacagcgtgtctgt

SEQ ID NO: 129724 - DNA, 25 bp, Homo sapien
cggcttgacggaaggctcactctac

SEQ ID NO: 129725 - DNA, 25 bp, Homo sapien
ggctcactctacgagttcaaaatcg

SEQ ID NO: 129726 - DNA, 25 bp, Homo sapien
cgagttcaaaatcgccgccgtcaac

SEQ ID NO: 129727 - DNA, 25 bp, Homo sapien
gatcccagtgagcacttcaagtgtg

SEQ ID NO: 129728 - DNA, 25 bp, Homo sapien
tgaggcctggaccatgccggagccc

SEQ ID NO: 129729 - DNA, 25 bp, Homo sapien
gtgcgactctggactcgccagcctt

SEQ ID NO: 129730 - DNA, 25 bp, Homo sapien
tcacagcgtgtctgttcctccgaca

SEQ ID NO: 129731 - DNA, 25 bp, Homo sapien
cagtacctcggcgtgacgcggtgac

SEQ ID NO: 129732 - DNA, 25 bp, Homo sapien
gtgacgcagccgcaggcaggcagta

SEQ ID NO: 129733 - DNA, 25 bp, Homo sapien
ggcaggcagtacctcggcgtgacgc

SEQ ID NO: 129734 - DNA, 25 bp, Homo sapien
gacgcagccgcaggcaggcagtacc

SEQ ID NO: 129735 - DNA, 25 bp, Homo sapien
caggcagtacctcggcgtgacgcgg

SEQ ID NO: 129736 - DNA, 25 bp, Homo sapien
aggcaggcagtacctcggcgtgacg

SEQ ID NO: 129737 - DNA, 25 bp, Homo sapien
agtacctcggcgtgacgcggtgacg

SEQ ID NO: 129738 - DNA, 25 bp, Homo sapien
tgacgcagccgcaggcaggcagtac

SEQ ID NO: 129739 - DNA, 25 bp, Homo sapien
ccaattatttgatggtgtcaaggca

SEQ ID NO: 129740 - DNA, 25 bp, Homo sapien
cggtggctttttaacgatctcttcg

SEQ ID NO: 129741 - DNA, 25 bp, Homo sapien
gatctcttcgctatccaaaggatga

SEQ ID NO: 129742 - DNA, 25 bp, Homo sapien
ggatgacgtgttcaggccaattatt

SEQ ID NO: 129743 - DNA, 25 bp, Homo sapien
tgtcaaggcacccagatgttaacgc

SEQ ID NO: 129744 - DNA, 25 bp, Homo sapien
tgttaacgcccgtcagtacactgta

SEQ ID NO: 129745 - DNA, 25 bp, Homo sapien
accctgcctttagatatcatagtta

SEQ ID NO: 129746 - DNA, 25 bp, Homo sapien
tcaccgcagataaaagtggacttca

SEQ ID NO: 129747 - DNA, 25 bp, Homo sapien
ctgggagattcggaacatctgcgtc

SEQ ID NO: 129748 - DNA, 25 bp, Homo sapien
ggcctcctgggagattcggaacatc

SEQ ID NO: 129749 - DNA, 25 bp, Homo sapien
gctctgcaagctgtggctccgggtt

SEQ ID NO: 129750 - DNA, 25 bp, Homo sapien
tgacggcacccggcgaggttatcag

SEQ ID NO: 129751 - DNA, 25 bp, Homo sapien
atcacgtggccacagctgcagcctg

SEQ ID NO: 129752 - DNA, 25 bp, Homo sapien
gccacagctgcagcctgagaagtgg

SEQ ID NO: 129753 - DNA, 25 bp, Homo sapien
cgtcggccatggctttgggcatcac

SEQ ID NO: 129754 - DNA, 25 bp, Homo sapien
tggctttgggcatcacgtggccaca

SEQ ID NO: 129755 - DNA, 25 bp, Homo sapien
gcttggtccgcatttcaggctgtgc

SEQ ID NO: 129756 - DNA, 25 bp, Homo sapien
cgaggcctggtctgcaggatttcca

SEQ ID NO: 129757 - DNA, 25 bp, Homo sapien
aggatttccaggctttctgtcctga

SEQ ID NO: 129758 - DNA, 25 bp, Homo sapien
gcctcctgcttgaattacgcctgtg

SEQ ID NO: 129759 - DNA, 25 bp, Homo sapien
ccgcgacaatcgctgtggccactag

SEQ ID NO: 129760 - DNA, 25 bp, Homo sapien
agtagcccgacgttccttaggaatg

SEQ ID NO: 129761 - DNA, 25 bp, Homo sapien
tattttgctttgctgagtagcccga

SEQ ID NO: 129762 - DNA, 25 bp, Homo sapien
tgactttcaacacacgcaacgccgt

SEQ ID NO: 129763 - DNA, 25 bp, Homo sapien
gctggtgacacgttgccgtattctt

SEQ ID NO: 129764 - DNA, 25 bp, Homo sapien
cgctggtgacatgttgccgtattct

SEQ ID NO: 129765 - DNA, 25 bp, Homo sapien
ctggtgacacgttgccgtattcttg

SEQ ID NO: 129766 - DNA, 25 bp, Homo sapien
gacacgttgccgtattcttgggcga

SEQ ID NO: 129767 - DNA, 25 bp, Homo sapien
tggtgacacgttgccgtattcttgg

SEQ ID NO: 129768 - DNA, 25 bp, Homo sapien
ctggtgacatgttgccgtattcttg

SEQ ID NO: 129769 - DNA, 25 bp, Homo sapien
acgctggtgacacgttgccgtattc

SEQ ID NO: 129770 - DNA, 25 bp, Homo sapien
acgctggtgacatgttgccgtattc

SEQ ID NO: 129771 - DNA, 25 bp, Homo sapien
gcccgtctacacgtctgtctggtga

SEQ ID NO: 129772 - DNA, 25 bp, Homo sapien
gcccgtctacacgtctgtctggtgg

SEQ ID NO: 129773 - DNA, 25 bp, Homo sapien
tggcccgtctacacgtctgtctggt

SEQ ID NO: 129774 - DNA, 25 bp, Homo sapien
tctacacgtctgtctggtgggacgc

SEQ ID NO: 129775 - DNA, 25 bp, Homo sapien
cccgtctacacgtctgtctggtgag

SEQ ID NO: 129776 - DNA, 25 bp, Homo sapien
ccgtctacacgtctgtctggtgaga

SEQ ID NO: 129777 - DNA, 25 bp, Homo sapien
ccgtctacacgtctgtctggtggga

SEQ ID NO: 129778 - DNA, 25 bp, Homo sapien
ggcccgtctacacgtctgtctggtg

SEQ ID NO: 129779 - DNA, 25 bp, Homo sapien
cctcaggccgaagagatggtgctgt

SEQ ID NO: 129780 - DNA, 25 bp, Homo sapien
gtccacggcaggactcccgagcagt

SEQ ID NO: 129781 - DNA, 25 bp, Homo sapien
gtggggtctcgaacaccacccgtca

SEQ ID NO: 129782 - DNA, 25 bp, Homo sapien
tgtggccgagagtcacagagcctca

SEQ ID NO: 129783 - DNA, 25 bp, Homo sapien
gggacgcaccgtacaaacacacatg

SEQ ID NO: 129784 - DNA, 25 bp, Homo sapien
cacatggtaatccactgcgttgagc

SEQ ID NO: 129785 - DNA, 25 bp, Homo sapien
tctcaaaggcgtgatagagtttccg

SEQ ID NO: 129786 - DNA, 25 bp, Homo sapien
gcccacttccctcaaaggtgacaag

SEQ ID NO: 129787 - DNA, 25 bp, Homo sapien
acctagtggccacagcgattgtcgc

SEQ ID NO: 129788 - DNA, 25 bp, Homo sapien
ctcaggacagaaagcctggaaatcc

SEQ ID NO: 129789 - DNA, 25 bp, Homo sapien
caggcgtaattcaagcaggaggctc

SEQ ID NO: 129790 - DNA, 25 bp, Homo sapien
cggcgttgcgtgtgttgaaagtcac

SEQ ID NO: 129791 - DNA, 25 bp, Homo sapien
tcgggctactcagcaaagcaaaata

SEQ ID NO: 129792 - DNA, 25 bp, Homo sapien
ttcctaaggaacgtcgggctactca

SEQ ID NO: 129793 - DNA, 25 bp, Homo sapien
tggaaatcctgcagaccaggcctcg

SEQ ID NO: 129794 - DNA, 25 bp, Homo sapien
cacagcctgaaatgcggaccaagcc

SEQ ID NO: 129795 - DNA, 25 bp, Homo sapien
tgagacccgccctatgtccaggaca

SEQ ID NO: 129796 - DNA, 25 bp, Homo sapien
gcaattccaagctctggatgcgtcc

SEQ ID NO: 129797 - DNA, 25 bp, Homo sapien
tcgctctgtccacggccagaaaaag

SEQ ID NO: 129798 - DNA, 25 bp, Homo sapien
attcaggacacggacagaaggggcc

SEQ ID NO: 129799 - DNA, 25 bp, Homo sapien
gccagaggaagaagcgatgagaccc

SEQ ID NO: 129800 - DNA, 25 bp, Homo sapien
tgcctccaggaacgggaacccacga

SEQ ID NO: 129801 - DNA, 25 bp, Homo sapien
gggcttgagccttggcgcaattcca

SEQ ID NO: 129802 - DNA, 25 bp, Homo sapien
ccttgctccgttgcggtgcaggaaa

SEQ ID NO: 129803 - DNA, 25 bp, Homo sapien
tcggggcaacaacgactacccattg

SEQ ID NO: 129804 - DNA, 25 bp, Homo sapien
tcccaccagggacatctacaagttg

SEQ ID NO: 129805 - DNA, 25 bp, Homo sapien
tgagaagtcccatgcagtccacgct

SEQ ID NO: 129806 - DNA, 25 bp, Homo sapien
aagagcactgttggcgttcagcgag

SEQ ID NO: 129807 - DNA, 25 bp, Homo sapien
atcgagcatctgaggaagagcactg

SEQ ID NO: 129808 - DNA, 25 bp, Homo sapien
taaagacacttttgccgcctacata

SEQ ID NO: 129809 - DNA, 25 bp, Homo sapien
tgggttcatactgacctcacaccag

SEQ ID NO: 129810 - DNA, 25 bp, Homo sapien
gcggccgagagtaggaagcaaaaca

SEQ ID NO: 129811 - DNA, 25 bp, Homo sapien
gcatccggaatgcacccgcaatccc

SEQ ID NO: 129812 - DNA, 25 bp, Homo sapien
ccgcaatcccacagcgtccggaatg

SEQ ID NO: 129813 - DNA, 25 bp, Homo sapien
acagcatccggaatgcacccgcaat

SEQ ID NO: 129814 - DNA, 25 bp, Homo sapien
ggaatgcacccgcaatcccacagca

SEQ ID NO: 129815 - DNA, 25 bp, Homo sapien
gaatgcacccgcaatcccacagcat

SEQ ID NO: 129816 - DNA, 25 bp, Homo sapien
agcatctggaatgcacccgcaatcc

SEQ ID NO: 129817 - DNA, 25 bp, Homo sapien
acagcatccggaatacacccgcaat

SEQ ID NO: 129818 - DNA, 25 bp, Homo sapien
gcaatcccacagcatctggaatgca

SEQ ID NO: 129819 - DNA, 25 bp, Homo sapien
ggtccagaactcctagcctgtttca

SEQ ID NO: 129820 - DNA, 25 bp, Homo sapien
cccgtgcgcccacagtgaatgtatc

SEQ ID NO: 129821 - DNA, 25 bp, Homo sapien
ccctgaccagcgtagaaggaggata

SEQ ID NO: 129822 - DNA, 25 bp, Homo sapien
ggagcttatgttctttcccggagaa

SEQ ID NO: 129823 - DNA, 25 bp, Homo sapien
ctcccgggaacatctatggaagtgc

SEQ ID NO: 129824 - DNA, 25 bp, Homo sapien
cgaccacgagcttgggtgactaaga

SEQ ID NO: 129825 - DNA, 25 bp, Homo sapien
ggcgaccttctagaggcagctactc

SEQ ID NO: 129826 - DNA, 25 bp, Homo sapien
tgactaagacccactgtttgcgatc

SEQ ID NO: 129827 - DNA, 25 bp, Homo sapien
tgccgtggtgcttcgttacataggt

SEQ ID NO: 129828 - DNA, 25 bp, Homo sapien
ccgtggtgcttcgttacataggtac

SEQ ID NO: 129829 - DNA, 25 bp, Homo sapien
ttcgttacataggtacgcgggtgcc

SEQ ID NO: 129830 - DNA, 25 bp, Homo sapien
ttcgttacataggtacgcgcgtgcc

SEQ ID NO: 129831 - DNA, 25 bp, Homo sapien
ttagttacataggtacgcgcgtgcc

SEQ ID NO: 129832 - DNA, 25 bp, Homo sapien
cttcgttacataggtacgcgcgtgc

SEQ ID NO: 129833 - DNA, 25 bp, Homo sapien
gccgtggtgcttcgttacataggta

SEQ ID NO: 129834 - DNA, 25 bp, Homo sapien
tcgttacataggtacgcgcgtgccg

SEQ ID NO: 129835 - DNA, 25 bp, Homo sapien
gtcactaatggaaatagaaggctaa

SEQ ID NO: 129836 - DNA, 25 bp, Homo sapien
cagctcaggtgagcccagatgaggc

SEQ ID NO: 129837 - DNA, 25 bp, Homo sapien
cgtccgcgagggaatgactgtgccc

SEQ ID NO: 129838 - DNA, 25 bp, Homo sapien
cggtgccgaaagtccgcacaaagcc

SEQ ID NO: 129839 - DNA, 25 bp, Homo sapien
ctgaacagtaacgtggcgcgccagc

SEQ ID NO: 129840 - DNA, 25 bp, Homo sapien
ccctccgttgggtctgaggtctcgg

SEQ ID NO: 129841 - DNA, 25 bp, Homo sapien
gcgccgggtagcttctaagtcacta

SEQ ID NO: 129842 - DNA, 25 bp, Homo sapien
cgtctggccctgaacagtaacgtgg

SEQ ID NO: 129843 - DNA, 25 bp, Homo sapien
aggccatggatagtacacgcggtgc

SEQ ID NO: 129844 - DNA, 25 bp, Homo sapien
ggtgaccatgtgtgatcagcaaggc

SEQ ID NO: 129845 - DNA, 25 bp, Homo sapien
tgaccgtgtgtgatcggcaaggcca

SEQ ID NO: 129846 - DNA, 25 bp, Homo sapien
tgaccatgtgtgatcggcaaggcca

SEQ ID NO: 129847 - DNA, 25 bp, Homo sapien
caaggccatggatagtacacgcggt

SEQ ID NO: 129848 - DNA, 25 bp, Homo sapien
tcggcaaggccatggatagtgcacg

SEQ ID NO: 129849 - DNA, 25 bp, Homo sapien
gaccgtgtgtgatcggcaaggccat

SEQ ID NO: 129850 - DNA, 25 bp, Homo sapien
gtgaccatgtgtgatcggcaaggcc

SEQ ID NO: 129851 - DNA, 25 bp, Homo sapien
gcgtggtgtccatgtatgatcagca

SEQ ID NO: 129852 - DNA, 25 bp, Homo sapien
cgtgttgcggtgaccatgtgtgatt

SEQ ID NO: 129853 - DNA, 25 bp, Homo sapien
tgaccatgtgtgattggcatgacca

SEQ ID NO: 129854 - DNA, 25 bp, Homo sapien
ttggcatgaccatcgacagtgctta

SEQ ID NO: 129855 - DNA, 25 bp, Homo sapien
tccgcaaggccatggatagtgagtg

SEQ ID NO: 129856 - DNA, 25 bp, Homo sapien
tgtgtgatcggtaaggccatgatag

SEQ ID NO: 129857 - DNA, 25 bp, Homo sapien
tgatagagcatgcagtgcggtgacc

SEQ ID NO: 129858 - DNA, 25 bp, Homo sapien
ccatcgacagtgcttatggtgtggt

SEQ ID NO: 129859 - DNA, 25 bp, Homo sapien
gctgtagtacttgaggcccaggtca

SEQ ID NO: 129860 - DNA, 25 bp, Homo sapien
ttaatgggcatgttcgctgcgcctg

SEQ ID NO: 129861 - DNA, 25 bp, Homo sapien
ttcctgaaaagcctacacgcacgtg

SEQ ID NO: 129862 - DNA, 25 bp, Homo sapien
aagccgtgaatcctgttcctgaaaa

SEQ ID NO: 129863 - DNA, 25 bp, Homo sapien
aacctggtgatagaagccgtgaatc

SEQ ID NO: 129864 - DNA, 25 bp, Homo sapien
cccaggtcaacgtgcgtgggagacc

SEQ ID NO: 129865 - DNA, 25 bp, Homo sapien
ctttcccgcgtggaggctgtagtac

SEQ ID NO: 129866 - DNA, 25 bp, Homo sapien
ggagacccgttccagaacctggtga

SEQ ID NO: 129867 - DNA, 25 bp, Homo sapien
agcatggtgctcttcttcttcgaga

SEQ ID NO: 129868 - DNA, 25 bp, Homo sapien
ctctaattgtgtgcatcccggcgcc

SEQ ID NO: 129869 - DNA, 25 bp, Homo sapien
agctgtactgcaactgtcggcccaa

SEQ ID NO: 129870 - DNA, 25 bp, Homo sapien
tgtgagcatccctgagccatcgatc

SEQ ID NO: 129871 - DNA, 25 bp, Homo sapien
ccgagctgagaagatgctgctgtcc

SEQ ID NO: 129872 - DNA, 25 bp, Homo sapien
gaccggctctactgcgtctaccaga

SEQ ID NO: 129873 - DNA, 25 bp, Homo sapien
tggtgctccacacgtactccatgcg

SEQ ID NO: 129874 - DNA, 25 bp, Homo sapien
tcttcgagaattacaccggggtcca

SEQ ID NO: 129875 - DNA, 25 bp, Homo sapien
cggcccgtgtcaggtcttcctcaat

SEQ ID NO: 129876 - DNA, 25 bp, Homo sapien
atcttcctccctggtatctttaacg

SEQ ID NO: 129877 - DNA, 25 bp, Homo sapien
agcccatgtcgggtcttcctcgctg

SEQ ID NO: 129878 - DNA, 25 bp, Homo sapien
caggtcttcctcaatggtgtccaca

SEQ ID NO: 129879 - DNA, 25 bp, Homo sapien
ggtgtcggatcttcctcactggcgt

SEQ ID NO: 129880 - DNA, 25 bp, Homo sapien
cggccggtgtcggatcttcctcact

SEQ ID NO: 129881 - DNA, 25 bp, Homo sapien
tcctcgctagcgtccgcaccatctt

SEQ ID NO: 129882 - DNA, 25 bp, Homo sapien
tggcccgtgtcaggtcttcctcgct

SEQ ID NO: 129883 - DNA, 25 bp, Homo sapien
aaatgcagccggtctacgtgaggtc

SEQ ID NO: 129884 - DNA, 25 bp, Homo sapien
tgaggtccgctctgcactaaggacg

SEQ ID NO: 129885 - DNA, 25 bp, Homo sapien
tgtctccggacatcagtgtacgctg

SEQ ID NO: 129886 - DNA, 25 bp, Homo sapien
tgaccttgggcttctgtgatagaca

SEQ ID NO: 129887 - DNA, 25 bp, Homo sapien
tgtcgggacagacgtggtgactcaa

SEQ ID NO: 129888 - DNA, 25 bp, Homo sapien
acctgtgaggagcatccggctatct

SEQ ID NO: 129889 - DNA, 25 bp, Homo sapien
cctgtccttcctgcggacctgtgag

SEQ ID NO: 129890 - DNA, 25 bp, Homo sapien
aagcgggagcttctcacgcactgga

SEQ ID NO: 129891 - DNA, 25 bp, Homo sapien
ctctgcccgggaaaaagcttccgca

SEQ ID NO: 129892 - DNA, 25 bp, Homo sapien
ctgcttctgcgaggggatcttgcat

SEQ ID NO: 129893 - DNA, 25 bp, Homo sapien
gcagcactttgcaaagcttgtgatg

SEQ ID NO: 129894 - DNA, 25 bp, Homo sapien
gcacatcttggcatcgcagcacttt

SEQ ID NO: 129895 - DNA, 25 bp, Homo sapien
ccagacttgcgctcagcacatcttg

SEQ ID NO: 129896 - DNA, 25 bp, Homo sapien
ttacgcgttcaaaccagaagggcgc

SEQ ID NO: 129897 - DNA, 25 bp, Homo sapien
ccggcactgaaggagttacgcgttc

SEQ ID NO: 129898 - DNA, 25 bp, Homo sapien
catgcgtgggcatctactaaggacg

SEQ ID NO: 129899 - DNA, 25 bp, Homo sapien
tcccttctcatcctttccgtgatcg

SEQ ID NO: 129900 - DNA, 25 bp, Homo sapien
ttcagtgtccaggtgacccaagctc

SEQ ID NO: 129901 - DNA, 25 bp, Homo sapien
gttcagtgtccaggtgacccaagct

SEQ ID NO: 129902 - DNA, 25 bp, Homo sapien
agttcagtgtccaggtgacccaagc

SEQ ID NO: 129903 - DNA, 25 bp, Homo sapien
gagttcagtgtccaggtgacccaag

SEQ ID NO: 129904 - DNA, 25 bp, Homo sapien
cttctcatcctttccgtgatcggcc

SEQ ID NO: 129905 - DNA, 25 bp, Homo sapien
cccttctcatcctttccgtgatcgg

SEQ ID NO: 129906 - DNA, 25 bp, Homo sapien
ccttctcatcctttccgtgatcggc

SEQ ID NO: 129907 - DNA, 25 bp, Homo sapien
caaaaacagcggcctcttcaaagcc

SEQ ID NO: 129908 - DNA, 25 bp, Homo sapien
cgtctcggccttgcaaaaacagcgg

SEQ ID NO: 129909 - DNA, 25 bp, Homo sapien
gtctcggccttgcaaaaacagcggc

SEQ ID NO: 129910 - DNA, 25 bp, Homo sapien
tctcggccttgcaaaaacagcggcc

SEQ ID NO: 129911 - DNA, 25 bp, Homo sapien
ttgcaaaaacagcggcctcttcaaa

SEQ ID NO: 129912 - DNA, 25 bp, Homo sapien
gcaaaaacagcggcctcttcaaagc

SEQ ID NO: 129913 - DNA, 25 bp, Homo sapien
cagcggcctcttcaaagcccctacc

SEQ ID NO: 129914 - DNA, 25 bp, Homo sapien
tgcaaaaacagcggcctcttcaaag

SEQ ID NO: 129915 - DNA, 25 bp, Homo sapien
ggcggaagcagccttcgtccacatg

SEQ ID NO: 129916 - DNA, 25 bp, Homo sapien
cgggaagtcccattgggcgtctttg

SEQ ID NO: 129917 - DNA, 25 bp, Homo sapien
tctgcgcccttagggcgtcaggatc

SEQ ID NO: 129918 - DNA, 25 bp, Homo sapien
tctgcgagagcgaagatggccgccc

SEQ ID NO: 129919 - DNA, 25 bp, Homo sapien
ccttcctctgcgagagcgaagatgg

SEQ ID NO: 129920 - DNA, 25 bp, Homo sapien
ttcgtccacatgagaggcccagcca

SEQ ID NO: 129921 - DNA, 25 bp, Homo sapien
gaagcagccttcgtccacatgagag

SEQ ID NO: 129922 - DNA, 25 bp, Homo sapien
ggaagtcccattgggcgtctttggc

SEQ ID NO: 129923 - DNA, 25 bp, Homo sapien
agcttgggtcacctggacactgaac

SEQ ID NO: 129924 - DNA, 25 bp, Homo sapien
ttctctgagatcccgggagaaggag

SEQ ID NO: 129925 - DNA, 25 bp, Homo sapien
gcttgggtcacctggacactgaact

SEQ ID NO: 129926 - DNA, 25 bp, Homo sapien
cttgggtcacctggacactgaactc

SEQ ID NO: 129927 - DNA, 25 bp, Homo sapien
gagcttgggtcacctggacactgaa

SEQ ID NO: 129928 - DNA, 25 bp, Homo sapien
gggccgatcacggaaaggatgagaa

SEQ ID NO: 129929 - DNA, 25 bp, Homo sapien
cagggccgatcacggaaaggatgag

SEQ ID NO: 129930 - DNA, 25 bp, Homo sapien
cgatcacggaaaggatgagaaggga

SEQ ID NO: 129931 - DNA, 25 bp, Homo sapien
accctgtgcccagtaggggccttgg

SEQ ID NO: 129932 - DNA, 25 bp, Homo sapien
ctgtgcccagtaggggccttggaag

SEQ ID NO: 129933 - DNA, 25 bp, Homo sapien
tcaccctgtgcccagtaggggcctt

SEQ ID NO: 129934 - DNA, 25 bp, Homo sapien
cacggtggggtcaccctgtgcccag

SEQ ID NO: 129935 - DNA, 25 bp, Homo sapien
agccacggtggggtcaccctgtgcc

SEQ ID NO: 129936 - DNA, 25 bp, Homo sapien
agggtccgccgagagccacgatttt

SEQ ID NO: 129937 - DNA, 25 bp, Homo sapien
ccagggtccgccgagagccacgatt

SEQ ID NO: 129938 - DNA, 25 bp, Homo sapien
tggtggaggggcagaccccctacaa

SEQ ID NO: 129939 - DNA, 25 bp, Homo sapien
ccctcggcgaggacagagacgcggc

SEQ ID NO: 129940 - DNA, 25 bp, Homo sapien
ctcggcgaggacagagacgcggcgc

SEQ ID NO: 129941 - DNA, 25 bp, Homo sapien
cctcgtgaggacagagacgcggcgg

SEQ ID NO: 129942 - DNA, 25 bp, Homo sapien
cctcgtgaggacagagacgcggcgc

SEQ ID NO: 129943 - DNA, 25 bp, Homo sapien
ctcgtgaggacagagacgcggcgcc

SEQ ID NO: 129944 - DNA, 25 bp, Homo sapien
ccctcgtgaggacagagacgcggcg

SEQ ID NO: 129945 - DNA, 25 bp, Homo sapien
cccctcgtgaggacagagacgcggc

SEQ ID NO: 129946 - DNA, 25 bp, Homo sapien
ctcgtgaggacagagacgcggcggc

SEQ ID NO: 129947 - DNA, 25 bp, Homo sapien
aagacaaacgtcctgcggtgacctc

SEQ ID NO: 129948 - DNA, 25 bp, Homo sapien
cgggccaggagccaagagacctgcc

SEQ ID NO: 129949 - DNA, 25 bp, Homo sapien
tgcccaggctccgattcaggcttgc

SEQ ID NO: 129950 - DNA, 25 bp, Homo sapien
accgagactgggtcccttccagatc

SEQ ID NO: 129951 - DNA, 25 bp, Homo sapien
aaagcgccatccagggaggtgagct

SEQ ID NO: 129952 - DNA, 25 bp, Homo sapien
gccgcaaccgaacttggaccaagta

SEQ ID NO: 129953 - DNA, 25 bp, Homo sapien
ctccaatctcagcttcgggccagga

SEQ ID NO: 129954 - DNA, 25 bp, Homo sapien
agcttgggcctaggctccaatctca

SEQ ID NO: 129955 - DNA, 25 bp, Homo sapien
actggggcggccatcttcgctctcg

SEQ ID NO: 129956 - DNA, 25 bp, Homo sapien
tcctgacgccctaagggcgcagaaa

SEQ ID NO: 129957 - DNA, 25 bp, Homo sapien
ggcggccatcttcgctctcgcagag

SEQ ID NO: 129958 - DNA, 25 bp, Homo sapien
tggctgggcctctcatgtggacgaa

SEQ ID NO: 129959 - DNA, 25 bp, Homo sapien
tctcatgtggacgaaggctgcttcc

SEQ ID NO: 129960 - DNA, 25 bp, Homo sapien
catgtggacgaaggctgcttccgcc

SEQ ID NO: 129961 - DNA, 25 bp, Homo sapien
gccaaagacgcccaatgggacttcc

SEQ ID NO: 129962 - DNA, 25 bp, Homo sapien
ccatcttcgctctcgcagaggaagg

SEQ ID NO: 129963 - DNA, 25 bp, Homo sapien
ggtggcattatcactaagatcatca

SEQ ID NO: 129964 - DNA, 25 bp, Homo sapien
ccctccacatagagggaatcaatcg

SEQ ID NO: 129965 - DNA, 25 bp, Homo sapien
caatttccatttgatcttccaaaag

SEQ ID NO: 129966 - DNA, 25 bp, Homo sapien
aatttcagtgattcagactcaggtc

SEQ ID NO: 129967 - DNA, 25 bp, Homo sapien
tttcctttatttctgtgaggccaga

SEQ ID NO: 129968 - DNA, 25 bp, Homo sapien
gggaccctaacactcattacctcag

SEQ ID NO: 129969 - DNA, 25 bp, Homo sapien
cattaacagtgttggtggcattatc

SEQ ID NO: 129970 - DNA, 25 bp, Homo sapien
ttgttattgccattaacagtgttgg

SEQ ID NO: 129971 - DNA, 25 bp, Homo sapien
cttggggaagttcaggcaagcctga

SEQ ID NO: 129972 - DNA, 25 bp, Homo sapien
aagctgagattggagcctaggccca

SEQ ID NO: 129973 - DNA, 25 bp, Homo sapien
gcaagcctgaatcggagcctgggca

SEQ ID NO: 129974 - DNA, 25 bp, Homo sapien
aggtcaccgcaggacgtttgtcttg

SEQ ID NO: 129975 - DNA, 25 bp, Homo sapien
agctcacctccctggatggcgcttt

SEQ ID NO: 129976 - DNA, 25 bp, Homo sapien
tacttggtccaagttcggttgcggc

SEQ ID NO: 129977 - DNA, 25 bp, Homo sapien
tcctgcccatctggggcgacgtact

SEQ ID NO: 129978 - DNA, 25 bp, Homo sapien
caggtctcttggctcctggcccgaa

SEQ ID NO: 129979 - DNA, 25 bp, Homo sapien
ttgagagccgcttcctagtggcgcg

SEQ ID NO: 129980 - DNA, 25 bp, Homo sapien
agggttttgagagccgcttcctagt

SEQ ID NO: 129981 - DNA, 25 bp, Homo sapien
gggttttgagagccgcttcctagtg

SEQ ID NO: 129982 - DNA, 25 bp, Homo sapien
ttttgagagccgcttcctagtggcg

SEQ ID NO: 129983 - DNA, 25 bp, Homo sapien
tttgagagccgcttcctagtggcgc

SEQ ID NO: 129984 - DNA, 25 bp, Homo sapien
tgagagccgcttcctagtggcgcgc

SEQ ID NO: 129985 - DNA, 25 bp, Homo sapien
gcccgcttcatgtcgatccagttgt

SEQ ID NO: 129986 - DNA, 25 bp, Homo sapien
gtactgggaagcagacacgatctcg

SEQ ID NO: 129987 - DNA, 25 bp, Homo sapien
ttcatcatcatcagggcccgcttca

SEQ ID NO: 129988 - DNA, 25 bp, Homo sapien
tgcagtgcaccagcagcaggttctc

SEQ ID NO: 129989 - DNA, 25 bp, Homo sapien
ctccagcccgttgcagagttgcaga

SEQ ID NO: 129990 - DNA, 25 bp, Homo sapien
ggtgatgaccaccacgcagtcctgc

SEQ ID NO: 129991 - DNA, 25 bp, Homo sapien
tgtctggaactcatcgaacttgcgg

SEQ ID NO: 129992 - DNA, 25 bp, Homo sapien
gcccggcttctgcttggccttcaaa

SEQ ID NO: 129993 - DNA, 25 bp, Homo sapien
gagcgcgattctcgaatgaatcaaa

SEQ ID NO: 129994 - DNA, 25 bp, Homo sapien
tctcgaatgaatcaaaaacaccctc

SEQ ID NO: 129995 - DNA, 25 bp, Homo sapien
tgcgaccacgctcgccagacaaaaa

SEQ ID NO: 129996 - DNA, 25 bp, Homo sapien
cgccagacaaaaagaggccgaattt

SEQ ID NO: 129997 - DNA, 25 bp, Homo sapien
aaaagaggccgaatttggagagcgc

SEQ ID NO: 129998 - DNA, 25 bp, Homo sapien
ccggagcattgttcgcagaaggtct

SEQ ID NO: 129999 - DNA, 25 bp, Homo sapien
attgttcgcagaaggtctgcgcgcg

SEQ ID NO: 130000 - DNA, 25 bp, Homo sapien
cccgttttaaagagcgcgattctcg

SEQ ID NO: 130001 - DNA, 25 bp, Homo sapien
acccagggctgaagtcggcagaact

SEQ ID NO: 130002 - DNA, 25 bp, Homo sapien
ggtctggcacaacaaacgctaagcg

SEQ ID NO: 130003 - DNA, 25 bp, Homo sapien
aacgctcacgtttgcacaagctttg

SEQ ID NO: 130004 - DNA, 25 bp, Homo sapien
tctgaggctccaaggacatcccggc

SEQ ID NO: 130005 - DNA, 25 bp, Homo sapien
gcgcgcggtcaaattcctcaggcac

SEQ ID NO: 130006 - DNA, 25 bp, Homo sapien
aggcacccaatgcagttcccggctg

SEQ ID NO: 130007 - DNA, 25 bp, Homo sapien
tcccgacgttctcgcagaaaaggta

SEQ ID NO: 130008 - DNA, 25 bp, Homo sapien
agacggcacccaggtttcccgagca

SEQ ID NO: 130009 - DNA, 25 bp, Homo sapien
cgccaggagggaactagcctaagtg

SEQ ID NO: 130010 - DNA, 25 bp, Homo sapien
gacaaagagcgtccctggagcgatc

SEQ ID NO: 130011 - DNA, 25 bp, Homo sapien
cttcctgaaccagccagtggacgtg

SEQ ID NO: 130012 - DNA, 25 bp, Homo sapien
accagtggggctacttcgaggccca

SEQ ID NO: 130013 - DNA, 25 bp, Homo sapien
gcaggacgagcccaacttcgtgctg

SEQ ID NO: 130014 - DNA, 25 bp, Homo sapien
gcctcatcccggtgtcctggtacaa

SEQ ID NO: 130015 - DNA, 25 bp, Homo sapien
tgtcctggtacaaccacttcttggg

SEQ ID NO: 130016 - DNA, 25 bp, Homo sapien
tcacggtgcaggtcagctacagcct

SEQ ID NO: 130017 - DNA, 25 bp, Homo sapien
cccgacgttagaaggaagagcccag

SEQ ID NO: 130018 - DNA, 25 bp, Homo sapien
ctgctgcctgtaaaacccggggcgc

SEQ ID NO: 130019 - DNA, 25 bp, Homo sapien
taggcgaaagcgaatcccactcggc

SEQ ID NO: 130020 - DNA, 25 bp, Homo sapien
ctcccacctgtttgagggtgcaaaa

SEQ ID NO: 130021 - DNA, 25 bp, Homo sapien
cactgaatttgtccgctgagcccac

SEQ ID NO: 130022 - DNA, 25 bp, Homo sapien
tagatcctggacaacccgacgctgc

SEQ ID NO: 130023 - DNA, 25 bp, Homo sapien
accagcgtggccaatcccggcgaaa

SEQ ID NO: 130024 - DNA, 25 bp, Homo sapien
ccgacccaccgagatctaggcgaaa

SEQ ID NO: 130025 - DNA, 25 bp, Homo sapien
tccaaactggccagctcgcagaagc

SEQ ID NO: 130026 - DNA, 25 bp, Homo sapien
gcggtcttcaggttgccactgtcca

SEQ ID NO: 130027 - DNA, 25 bp, Homo sapien
gcggttattatccagccacaaggtg

SEQ ID NO: 130028 - DNA, 25 bp, Homo sapien
ctggttgcgactaaggtagagctcc

SEQ ID NO: 130029 - DNA, 25 bp, Homo sapien
tgcagcccgttgttgtctagcatga

SEQ ID NO: 130030 - DNA, 25 bp, Homo sapien
ggcacgcagggcactgatatcctca

SEQ ID NO: 130031 - DNA, 25 bp, Homo sapien
tctagcatgaggctctccaaactgg

SEQ ID NO: 130032 - DNA, 25 bp, Homo sapien
cagtgagctggttgtgatccacgtc

SEQ ID NO: 130033 - DNA, 25 bp, Homo sapien
caagggcaggacaggtacatcccgc

SEQ ID NO: 130034 - DNA, 25 bp, Homo sapien
tcgtccgcccacaagtccttggaaa

SEQ ID NO: 130035 - DNA, 25 bp, Homo sapien
agtccttggaaagcgcaggcctcgt

SEQ ID NO: 130036 - DNA, 25 bp, Homo sapien
aggacaggtacatcccgcgtgctgc

SEQ ID NO: 130037 - DNA, 25 bp, Homo sapien
atcccgcgtgctgcggtggcgatca

SEQ ID NO: 130038 - DNA, 25 bp, Homo sapien
tggctcaccgcttcaggagcaggcg

SEQ ID NO: 130039 - DNA, 25 bp, Homo sapien
agcaagcgggtctgagctccagcac

SEQ ID NO: 130040 - DNA, 25 bp, Homo sapien
tctgagctccagcacctttggcagc

SEQ ID NO: 130041 - DNA, 25 bp, Homo sapien
cggtgctaccctccagtgactggac

SEQ ID NO: 130042 - DNA, 25 bp, Homo sapien
cgggaacacacgtgccggtgctacc

SEQ ID NO: 130043 - DNA, 25 bp, Homo sapien
ctggactagatccttgcgcaacttc

SEQ ID NO: 130044 - DNA, 25 bp, Homo sapien
gtgtggacgccacacgctcccggaa

SEQ ID NO: 130045 - DNA, 25 bp, Homo sapien
agttagcaagtgtccggctccagca

SEQ ID NO: 130046 - DNA, 25 bp, Homo sapien
agcaactctcctctggcgtgacagc

SEQ ID NO: 130047 - DNA, 25 bp, Homo sapien
acagccggcatggaggatccacaga

SEQ ID NO: 130048 - DNA, 25 bp, Homo sapien
tccacagagtaaagagcctgccggc

SEQ ID NO: 130049 - DNA, 25 bp, Homo sapien
ttcgaagccagaacaacaggtggta

SEQ ID NO: 130050 - DNA, 25 bp, Homo sapien
cgaagcggcttgtccttaagctcca

SEQ ID NO: 130051 - DNA, 25 bp, Homo sapien
acaggtggtaaagggatcagccgcc

SEQ ID NO: 130052 - DNA, 25 bp, Homo sapien
ggggccagctacctagagtgttcca

SEQ ID NO: 130053 - DNA, 25 bp, Homo sapien
tcggactcgagacttggggagctac

SEQ ID NO: 130054 - DNA, 25 bp, Homo sapien
caagtgtatttcctcgcgttttata

SEQ ID NO: 130055 - DNA, 25 bp, Homo sapien
acgtaccgggttcagctcataagtc

SEQ ID NO: 130056 - DNA, 25 bp, Homo sapien
ggcctgagagcctaccaagtgtatt

SEQ ID NO: 130057 - DNA, 25 bp, Homo sapien
cccgcaccgggccatagatctaaag

SEQ ID NO: 130058 - DNA, 25 bp, Homo sapien
tcgccaggacagaggaccctaggtt

SEQ ID NO: 130059 - DNA, 25 bp, Homo sapien
agctgagcccttaccgagtggttta

SEQ ID NO: 130060 - DNA, 25 bp, Homo sapien
tgagactcacatgcacacgggaccc

SEQ ID NO: 130061 - DNA, 25 bp, Homo sapien
acaggtacacctgcccgcaagcgga

SEQ ID NO: 130062 - DNA, 25 bp, Homo sapien
cttgtgcccagtaatattgccttta

SEQ ID NO: 130063 - DNA, 25 bp, Homo sapien
gccatatttacatcggctgctgctt

SEQ ID NO: 130064 - DNA, 25 bp, Homo sapien
tttctgcgctacgaagtgcttcttc

SEQ ID NO: 130065 - DNA, 25 bp, Homo sapien
gccctcataatgctcatcctagccc

SEQ ID NO: 130066 - DNA, 25 bp, Homo sapien
tgagcgcttctcctggtctggtctt

SEQ ID NO: 130067 - DNA, 25 bp, Homo sapien
gagcgcttctcctggtctggtctta

SEQ ID NO: 130068 - DNA, 25 bp, Homo sapien
agcgcttctcctggtctggtcttag

SEQ ID NO: 130069 - DNA, 25 bp, Homo sapien
gcgcttctcctggtctggtcttagc

SEQ ID NO: 130070 - DNA, 25 bp, Homo sapien
cgcttctcctggtctggtcttagcc

SEQ ID NO: 130071 - DNA, 25 bp, Homo sapien
ctcgccctcataatgctcatcctag

SEQ ID NO: 130072 - DNA, 25 bp, Homo sapien
gcttctcctggtctggtcttagccc

SEQ ID NO: 130073 - DNA, 25 bp, Homo sapien
tggtcccagcggtttctacttcatc

SEQ ID NO: 130074 - DNA, 25 bp, Homo sapien
taaatgcaaaggacatggccggccg

SEQ ID NO: 130075 - DNA, 25 bp, Homo sapien
tggtggacgcggcaaacgtaaatgc

SEQ ID NO: 130076 - DNA, 25 bp, Homo sapien
tctacttcatctgccgctggggtcg

SEQ ID NO: 130077 - DNA, 25 bp, Homo sapien
tgcagtaccaccagcacaatctgta

SEQ ID NO: 130078 - DNA, 25 bp, Homo sapien
gttgacggtaccagctgttgcagta

SEQ ID NO: 130079 - DNA, 25 bp, Homo sapien
ggcgtcgcgtcgctctcagcatcat

SEQ ID NO: 130080 - DNA, 25 bp, Homo sapien
agccggcagtggcagtaacaattca

SEQ ID NO: 130081 - DNA, 25 bp, Homo sapien
taggagttccaggtctgcatgattc

SEQ ID NO: 130082 - DNA, 25 bp, Homo sapien
ggctcggccacccttggaagcaaag

SEQ ID NO: 130083 - DNA, 25 bp, Homo sapien
ggatgtaccctcgtctcaattcgtc

SEQ ID NO: 130084 - DNA, 25 bp, Homo sapien
gagaatgcctcttgcgtgctgggaa

SEQ ID NO: 130085 - DNA, 25 bp, Homo sapien
ggggctcatcctagaaagaccctga

SEQ ID NO: 130086 - DNA, 25 bp, Homo sapien
tccatctggcgctagagtgaaatcg

SEQ ID NO: 130087 - DNA, 25 bp, Homo sapien
cagtccctggcgtttgtagccctga

SEQ ID NO: 130088 - DNA, 25 bp, Homo sapien
aggccgcaggtactgaagtggatca

SEQ ID NO: 130089 - DNA, 25 bp, Homo sapien
gtatggacatttaaatcaaggtccg

SEQ ID NO: 130090 - DNA, 25 bp, Homo sapien
cggaggaagggaccacagcatcctc

SEQ ID NO: 130091 - DNA, 25 bp, Homo sapien
tcacacagacaatgagataacagcg

SEQ ID NO: 130092 - DNA, 25 bp, Homo sapien
taacagcgacgtcttccaaaggctc

SEQ ID NO: 130093 - DNA, 25 bp, Homo sapien
catcctttcgcatccaggctttttc

SEQ ID NO: 130094 - DNA, 25 bp, Homo sapien
tcgcccaggaaactgaaggggacta

SEQ ID NO: 130095 - DNA, 25 bp, Homo sapien
gcctctttacctccatcgctgagtg

SEQ ID NO: 130096 - DNA, 25 bp, Homo sapien
gagagagaggcctttctcctgagga

SEQ ID NO: 130097 - DNA, 25 bp, Homo sapien
ggaaatccagcccttcgcgtgaact

SEQ ID NO: 130098 - DNA, 25 bp, Homo sapien
ggctgaggtcgagctcctttttaaa

SEQ ID NO: 130099 - DNA, 25 bp, Homo sapien
cgggcgtcaaatcgacacctgactc

SEQ ID NO: 130100 - DNA, 25 bp, Homo sapien
gccgcatctgctgacggttccgaaa

SEQ ID NO: 130101 - DNA, 25 bp, Homo sapien
caagaggattaggagcccgtccaca

SEQ ID NO: 130102 - DNA, 25 bp, Homo sapien
atgaataataacaccgcgccgcgca

SEQ ID NO: 130103 - DNA, 25 bp, Homo sapien
aggcagcaccctcggatgaataata

SEQ ID NO: 130104 - DNA, 25 bp, Homo sapien
gcgcttccgtttatccgtttctatc

SEQ ID NO: 130105 - DNA, 25 bp, Homo sapien
gctggacgggagcacgccgtaccca

SEQ ID NO: 130106 - DNA, 25 bp, Homo sapien
tctaccctgctggacgggagcacgc

SEQ ID NO: 130107 - DNA, 25 bp, Homo sapien
ggagcacgccatacctacgggtctg

SEQ ID NO: 130108 - DNA, 25 bp, Homo sapien
gtctaccctgctggacgggagcacg

SEQ ID NO: 130109 - DNA, 25 bp, Homo sapien
ggagcacgccgtacccacgggtcta

SEQ ID NO: 130110 - DNA, 25 bp, Homo sapien
ggtctaccctgctggacgggagcac

SEQ ID NO: 130111 - DNA, 25 bp, Homo sapien
gtacccacgggtctaccctgctgga

SEQ ID NO: 130112 - DNA, 25 bp, Homo sapien
gagcacgccatacctacgggtctgc

SEQ ID NO: 130113 - DNA, 25 bp, Homo sapien
gagggcctgtcagtttcagtccgct

SEQ ID NO: 130114 - DNA, 25 bp, Homo sapien
ggagaaggaaccctgcagccctgca

SEQ ID NO: 130115 - DNA, 25 bp, Homo sapien
tccacaaagcggcactcgcctgcag

SEQ ID NO: 130116 - DNA, 25 bp, Homo sapien
tcgcctgcagctctggtttccaaaa

SEQ ID NO: 130117 - DNA, 25 bp, Homo sapien
gcagctctggtttccaaaagtggtc

SEQ ID NO: 130118 - DNA, 25 bp, Homo sapien
cgaaaacgatgcacatggaggcagg

SEQ ID NO: 130119 - DNA, 25 bp, Homo sapien
ggctctggcgaaaacgatgcacatg

SEQ ID NO: 130120 - DNA, 25 bp, Homo sapien
ttccaaaagtggtcggggctctggc

SEQ ID NO: 130121 - DNA, 25 bp, Homo sapien
ggggcgacacggcagcaactttaaa

SEQ ID NO: 130122 - DNA, 25 bp, Homo sapien
cggtctcacttacccggagtgcata

SEQ ID NO: 130123 - DNA, 25 bp, Homo sapien
ctcgtcatcttctggagccaaactg

SEQ ID NO: 130124 - DNA, 25 bp, Homo sapien
ggcaactcggcctcgaacatcgtca

SEQ ID NO: 130125 - DNA, 25 bp, Homo sapien
gagcgcacttgttctctgtccgaga

SEQ ID NO: 130126 - DNA, 25 bp, Homo sapien
acttcgtacgacaggagcgcacttg

SEQ ID NO: 130127 - DNA, 25 bp, Homo sapien
ggcctctgcagcttcacgtacttcg

SEQ ID NO: 130128 - DNA, 25 bp, Homo sapien
ctcggcgtgttttttggcctctgca

SEQ ID NO: 130129 - DNA, 25 bp, Homo sapien
gtgggaccatttaactccagcgcgc

SEQ ID NO: 130130 - DNA, 25 bp, Homo sapien
gaagcagggtttgccgtttcctaca

SEQ ID NO: 130131 - DNA, 25 bp, Homo sapien
aattcccgttgattgtgtcgcagcc

SEQ ID NO: 130132 - DNA, 25 bp, Homo sapien
cgccaccgaggcaatgttcatttaa

SEQ ID NO: 130133 - DNA, 25 bp, Homo sapien
atcagagctttcatgtttgccacga

SEQ ID NO: 130134 - DNA, 25 bp, Homo sapien
aatgtgccttactccctctggtggg

SEQ ID NO: 130135 - DNA, 25 bp, Homo sapien
tttgccacgaaagccagagagccgg

SEQ ID NO: 130136 - DNA, 25 bp, Homo sapien
cgcttttatttctgtggcgccaaga

SEQ ID NO: 130137 - DNA, 25 bp, Homo sapien
gcccgcccacgtggatggcttcaaa

SEQ ID NO: 130138 - DNA, 25 bp, Homo sapien
catggcagatggtgaccaaaatggg

SEQ ID NO: 130139 - DNA, 25 bp, Homo sapien
ggtgaccaaaatgggcttgctggca

SEQ ID NO: 130140 - DNA, 25 bp, Homo sapien
gccgtcagcagctgcttctgacagg

SEQ ID NO: 130141 - DNA, 25 bp, Homo sapien
cttctgacaggtgcgcgggctctcc

SEQ ID NO: 130142 - DNA, 25 bp, Homo sapien
tggatggcttcaaagtgaacagttg

SEQ ID NO: 130143 - DNA, 25 bp, Homo sapien
cgggtgtgggatccatcacgcccgc

SEQ ID NO: 130144 - DNA, 25 bp, Homo sapien
tgaacagttggcattcctgcggggt

SEQ ID NO: 130145 - DNA, 25 bp, Homo sapien
acaatgctgcagaggaaaagtggca

SEQ ID NO: 130146 - DNA, 25 bp, Homo sapien
cggggaaaggcctgtgagaccgcct

SEQ ID NO: 130147 - DNA, 25 bp, Homo sapien
agcgaggaaggactcgcgggtccca

SEQ ID NO: 130148 - DNA, 25 bp, Homo sapien
agtggcagaagcaggacaatgagcc

SEQ ID NO: 130149 - DNA, 25 bp, Homo sapien
tgctgataacgggaacaatgctgca

SEQ ID NO: 130150 - DNA, 25 bp, Homo sapien
ctgcagggtgtaggatgctgataac

SEQ ID NO: 130151 - DNA, 25 bp, Homo sapien
gacacctgggccgtccgtgcagcct

SEQ ID NO: 130152 - DNA, 25 bp, Homo sapien
tgagccggcggcaggactctcccag

SEQ ID NO: 130153 - DNA, 25 bp, Homo sapien
gccgagggaggcagactgctcatgc

SEQ ID NO: 130154 - DNA, 25 bp, Homo sapien
gatgctccgggcccatcgacggcat

SEQ ID NO: 130155 - DNA, 25 bp, Homo sapien
gattgcgcctccctaactatgggtg

SEQ ID NO: 130156 - DNA, 25 bp, Homo sapien
tgcgcctccctaactatgggtgaag

SEQ ID NO: 130157 - DNA, 25 bp, Homo sapien
cctaactatgggtgaagaaaaatca

SEQ ID NO: 130158 - DNA, 25 bp, Homo sapien
aactatgggtgaagaaaaatcaggt

SEQ ID NO: 130159 - DNA, 25 bp, Homo sapien
gggcgattgcgcctccctaactatg

SEQ ID NO: 130160 - DNA, 25 bp, Homo sapien
gcccatcgacggcatccgggcccag

SEQ ID NO: 130161 - DNA, 25 bp, Homo sapien
cctgcaggtcgtcactccttaaaga

SEQ ID NO: 130162 - DNA, 25 bp, Homo sapien
tgtccttgcgtctctgcctgcaggt

SEQ ID NO: 130163 - DNA, 25 bp, Homo sapien
tgctcggtgccctgtccttgcgtct

SEQ ID NO: 130164 - DNA, 25 bp, Homo sapien
ctggctgacgagtccgaagaagccc

SEQ ID NO: 130165 - DNA, 25 bp, Homo sapien
atccctcatgagagccggtgctggc

SEQ ID NO: 130166 - DNA, 25 bp, Homo sapien
cccattcgctggatccctcatgaga

SEQ ID NO: 130167 - DNA, 25 bp, Homo sapien
cttgccttgcctggacagccctggg

SEQ ID NO: 130168 - DNA, 25 bp, Homo sapien
tccttaaagatgaaagactcagggc

SEQ ID NO: 130169 - DNA, 25 bp, Homo sapien
accataggagcgtgtcctcgccgac

SEQ ID NO: 130170 - DNA, 25 bp, Homo sapien
gttgctaggaccaggcctttctggc

SEQ ID NO: 130171 - DNA, 25 bp, Homo sapien
cccgactgagctggcgtgtcctgag

SEQ ID NO: 130172 - DNA, 25 bp, Homo sapien
gcggaccttcttcttcatgtcatcg

SEQ ID NO: 130173 - DNA, 25 bp, Homo sapien
tgccgtcctcattcatgcggacctt

SEQ ID NO: 130174 - DNA, 25 bp, Homo sapien
tcctccgggaccataggagcgtgtc

SEQ ID NO: 130175 - DNA, 25 bp, Homo sapien
gaccaggtggaagcggactttcatc

SEQ ID NO: 130176 - DNA, 25 bp, Homo sapien
gactttcatctccacggacaggctg

SEQ ID NO: 130177 - DNA, 25 bp, Homo sapien
gtacgtgtccacactgctcggggtg

SEQ ID NO: 130178 - DNA, 25 bp, Homo sapien
tacgggtacgtgtccacactgctcg

SEQ ID NO: 130179 - DNA, 25 bp, Homo sapien
cgcttctcttctccggcagggcgtt

SEQ ID NO: 130180 - DNA, 25 bp, Homo sapien
cgggtccacgcgcttgcacagccgc

SEQ ID NO: 130181 - DNA, 25 bp, Homo sapien
ttgcacagccgcttggcctgcttct

SEQ ID NO: 130182 - DNA, 25 bp, Homo sapien
tccgcctcgtccacgtacggcctct

SEQ ID NO: 130183 - DNA, 25 bp, Homo sapien
cgtccacgtacggcctcttctggga

SEQ ID NO: 130184 - DNA, 25 bp, Homo sapien
cgtacgggtacgtgtccacactgct

SEQ ID NO: 130185 - DNA, 25 bp, Homo sapien
gctctgaactccgacgaaaaaagga

SEQ ID NO: 130186 - DNA, 25 bp, Homo sapien
ggcctgcggctttagccagcagaaa

SEQ ID NO: 130187 - DNA, 25 bp, Homo sapien
tttagccagcagaaagaggggcgtc

SEQ ID NO: 130188 - DNA, 25 bp, Homo sapien
ggcgtcagtcctatccccaaagttc

SEQ ID NO: 130189 - DNA, 25 bp, Homo sapien
tccgcctcgggaaagagccctgagc

SEQ ID NO: 130190 - DNA, 25 bp, Homo sapien
gagccctgagctctgaactccgacg

SEQ ID NO: 130191 - DNA, 25 bp, Homo sapien
cctgagctctgaactccgacgaaaa

SEQ ID NO: 130192 - DNA, 25 bp, Homo sapien
tcgggtgcccttcttacagggcctg

SEQ ID NO: 130193 - DNA, 25 bp, Homo sapien
taaaatttactgagcgccacccatg

SEQ ID NO: 130194 - DNA, 25 bp, Homo sapien
tccgcacaaaagagatggctgggtt

SEQ ID NO: 130195 - DNA, 25 bp, Homo sapien
tctagagccggggacaattttcatc

SEQ ID NO: 130196 - DNA, 25 bp, Homo sapien
cgacggctaagacccggcaagtgta

SEQ ID NO: 130197 - DNA, 25 bp, Homo sapien
agcgaccgatgccttgcatgcaaca

SEQ ID NO: 130198 - DNA, 25 bp, Homo sapien
ccgtgagcctgagtccggatttcaa

SEQ ID NO: 130199 - DNA, 25 bp, Homo sapien
ccctgcctgtgatgcttgatgttaa

SEQ ID NO: 130200 - DNA, 25 bp, Homo sapien
ttcaggtgactgaacgcgcgactct

SEQ ID NO: 130201 - DNA, 25 bp, Homo sapien
tgtgctgcacccagatgttctcatc

SEQ ID NO: 130202 - DNA, 25 bp, Homo sapien
ccacgtctggcttcatagacttatg

SEQ ID NO: 130203 - DNA, 25 bp, Homo sapien
aatggacccgcccacatgtgctgca

SEQ ID NO: 130204 - DNA, 25 bp, Homo sapien
cgtctctcagtaggatgtgctgtac

SEQ ID NO: 130205 - DNA, 25 bp, Homo sapien
taggtggtctattcccgtgtctctc

SEQ ID NO: 130206 - DNA, 25 bp, Homo sapien
tgtgctgcacagaggtgacctcttc

SEQ ID NO: 130207 - DNA, 25 bp, Homo sapien
tatgtgtttactggggaaccgaatg

SEQ ID NO: 130208 - DNA, 25 bp, Homo sapien
atggcacccaggaacccacgtctgg

SEQ ID NO: 130209 - DNA, 25 bp, Homo sapien
tattgatgtgagtaaagcccgcctg

SEQ ID NO: 130210 - DNA, 25 bp, Homo sapien
acttgcggtctctctcactagcaga

SEQ ID NO: 130211 - DNA, 25 bp, Homo sapien
actagcagacctgcggccaactttc

SEQ ID NO: 130212 - DNA, 25 bp, Homo sapien
gacactcacgttcagccagcataga

SEQ ID NO: 130213 - DNA, 25 bp, Homo sapien
gacatgtcggagagcctgtgatacc

SEQ ID NO: 130214 - DNA, 25 bp, Homo sapien
agtacgtattcgctcattggctaga

SEQ ID NO: 130215 - DNA, 25 bp, Homo sapien
tgtctgccgcggagcataagctcac

SEQ ID NO: 130216 - DNA, 25 bp, Homo sapien
ccaggagaatcaggacgtgcgtaac

SEQ ID NO: 130217 - DNA, 25 bp, Homo sapien
cggcgtatctagagcagtccgcgga

SEQ ID NO: 130218 - DNA, 25 bp, Homo sapien
cagcagggctcagacgatccggctc

SEQ ID NO: 130219 - DNA, 25 bp, Homo sapien
cagacaacaagctagatcctgagcc

SEQ ID NO: 130220 - DNA, 25 bp, Homo sapien
ctctcgaggcgcagacaacaagcta

SEQ ID NO: 130221 - DNA, 25 bp, Homo sapien
gcttcaaagcgggtagcgccttcgc

SEQ ID NO: 130222 - DNA, 25 bp, Homo sapien
atctagagcagtccgcggaggacgc

SEQ ID NO: 130223 - DNA, 25 bp, Homo sapien
agggcggccagctggactaaaagcc

SEQ ID NO: 130224 - DNA, 25 bp, Homo sapien
atccggctcggtttggtcagcagac

SEQ ID NO: 130225 - DNA, 25 bp, Homo sapien
tcctggcgcctcagaaatctttgtt

SEQ ID NO: 130226 - DNA, 25 bp, Homo sapien
ctcagaaatctttgttgagcgaatg

SEQ ID NO: 130227 - DNA, 25 bp, Homo sapien
tgaaggaacgaatgacggaagtaaa

SEQ ID NO: 130228 - DNA, 25 bp, Homo sapien
gacggaagtaaaaggtatgagcgcc

SEQ ID NO: 130229 - DNA, 25 bp, Homo sapien
tctggcttgcgttttccctctccag

SEQ ID NO: 130230 - DNA, 25 bp, Homo sapien
ccgacaggcagctgcggagccatct

SEQ ID NO: 130231 - DNA, 25 bp, Homo sapien
ggcgccgctccagtgtttgtttaca

SEQ ID NO: 130232 - DNA, 25 bp, Homo sapien
cggagactctggcttgcgttttccc

SEQ ID NO: 130233 - DNA, 25 bp, Homo sapien
gcaaatgaatacgaggcccaaggtc

SEQ ID NO: 130234 - DNA, 25 bp, Homo sapien
gtctatgttgtttgttatgatggtc

SEQ ID NO: 130235 - DNA, 25 bp, Homo sapien
tttacacctttaagtctatgagccc

SEQ ID NO: 130236 - DNA, 25 bp, Homo sapien
ggcaataacccaagtgaaagtcctc

SEQ ID NO: 130237 - DNA, 25 bp, Homo sapien
cccaaggtcaggctgggacccaaga

SEQ ID NO: 130238 - DNA, 25 bp, Homo sapien
gctgggacccaagaaggtgatttaa

SEQ ID NO: 130239 - DNA, 25 bp, Homo sapien
gtgatttaaggtggcccagcaccct

SEQ ID NO: 130240 - DNA, 25 bp, Homo sapien
cagggtttcatacaacctcatttta

SEQ ID NO: 130241 - DNA, 25 bp, Homo sapien
cggaatcgtacctcttcgtgggctc

SEQ ID NO: 130242 - DNA, 25 bp, Homo sapien
tgccatggagttgctctgagtaacc

SEQ ID NO: 130243 - DNA, 25 bp, Homo sapien
cgtcagtacttatggcgcctgccgg

SEQ ID NO: 130244 - DNA, 25 bp, Homo sapien
tcccggtaagcatcgcgtcagtact

SEQ ID NO: 130245 - DNA, 25 bp, Homo sapien
gcgctgtgagcgcacaattagttta

SEQ ID NO: 130246 - DNA, 25 bp, Homo sapien
gctctgcctcgcgattctccggaat

SEQ ID NO: 130247 - DNA, 25 bp, Homo sapien
cttttaggcctgagcacccgcaggg

SEQ ID NO: 130248 - DNA, 25 bp, Homo sapien
cccggcctgtacttgaaggcaaaga

SEQ ID NO: 130249 - DNA, 25 bp, Homo sapien
gccagcacgatccacaggcagtcga

SEQ ID NO: 130250 - DNA, 25 bp, Homo sapien
gccatcggatttcgccgccatcttg

SEQ ID NO: 130251 - DNA, 25 bp, Homo sapien
accgcctcgtccaggttgtgcagct

SEQ ID NO: 130252 - DNA, 25 bp, Homo sapien
cccagtagcacgaggaggtgttgca

SEQ ID NO: 130253 - DNA, 25 bp, Homo sapien
gtcagcccgaagtagacgtagtccc

SEQ ID NO: 130254 - DNA, 25 bp, Homo sapien
gtgtagtcctgcacgaaccagcgga

SEQ ID NO: 130255 - DNA, 25 bp, Homo sapien
accgactgccagatccacacggaga

SEQ ID NO: 130256 - DNA, 25 bp, Homo sapien
ggcagatgtgcatcgagctgctctc

SEQ ID NO: 130257 - DNA, 25 bp, Homo sapien
gaggaccaacttccggctgcgactt

SEQ ID NO: 130258 - DNA, 25 bp, Homo sapien
ctgacgggccaccacttgatcctgt

SEQ ID NO: 130259 - DNA, 25 bp, Homo sapien
atgtggtgctgcaccggcctttcta

SEQ ID NO: 130260 - DNA, 25 bp, Homo sapien
aagcggattctgaggcggctttctc

SEQ ID NO: 130261 - DNA, 25 bp, Homo sapien
ggctccagcagcgagtagccacttc

SEQ ID NO: 130262 - DNA, 25 bp, Homo sapien
agtttcgagacctgctgcttccgcc

SEQ ID NO: 130263 - DNA, 25 bp, Homo sapien
cttccgcgtcttccgagtttcgaga

SEQ ID NO: 130264 - DNA, 25 bp, Homo sapien
tggctcctccattcaaacatcgacg

SEQ ID NO: 130265 - DNA, 25 bp, Homo sapien
aactctgggttcgtagtttgcgctg

SEQ ID NO: 130266 - DNA, 25 bp, Homo sapien
tccagagtgcggatttcggtcgcgt

SEQ ID NO: 130267 - DNA, 25 bp, Homo sapien
gctaaacagcaagaccgcgcgctct

SEQ ID NO: 130268 - DNA, 25 bp, Homo sapien
tgggagccgagccacatcttggagt

SEQ ID NO: 130269 - DNA, 25 bp, Homo sapien
tttgtacagactttgggaagccatc

SEQ ID NO: 130270 - DNA, 25 bp, Homo sapien
caggctgagacctcgtgtcctagtc

SEQ ID NO: 130271 - DNA, 25 bp, Homo sapien
tcacttgccagggagccgctaaaca

SEQ ID NO: 130272 - DNA, 25 bp, Homo sapien
cgctggagactctgcattcccgggc

SEQ ID NO: 130273 - DNA, 25 bp, Homo sapien
gagttcataggacccgcggccacga

SEQ ID NO: 130274 - DNA, 25 bp, Homo sapien
cccaattgtggcaacgtgactgcgc

SEQ ID NO: 130275 - DNA, 25 bp, Homo sapien
tcggcgctgctcctttcggaaagga

SEQ ID NO: 130276 - DNA, 25 bp, Homo sapien
cccaaacggcaggagttcataggac

SEQ ID NO: 130277 - DNA, 25 bp, Homo sapien
agctccggtgaattctcggcgctgc

SEQ ID NO: 130278 - DNA, 25 bp, Homo sapien
tcagaagtttgtccgcatggagggc

SEQ ID NO: 130279 - DNA, 25 bp, Homo sapien
tgactgcgccactgtcagaagtttg

SEQ ID NO: 130280 - DNA, 25 bp, Homo sapien
ggagaggaactacatgccttcgcca

SEQ ID NO: 130281 - DNA, 25 bp, Homo sapien
cctgtgacaagctggacatcgcgtg

SEQ ID NO: 130282 - DNA, 25 bp, Homo sapien
agctgttccgtgtcgttacctgtga

SEQ ID NO: 130283 - DNA, 25 bp, Homo sapien
tcaggactggtaagcgactgtcatc

SEQ ID NO: 130284 - DNA, 25 bp, Homo sapien
cctcgcacggtcatccggagtacta

SEQ ID NO: 130285 - DNA, 25 bp, Homo sapien
ccgcttcatttgtagagggctgtaa

SEQ ID NO: 130286 - DNA, 25 bp, Homo sapien
gaggacttctacacggccaccgagc

SEQ ID NO: 130287 - DNA, 25 bp, Homo sapien
accttcgagttcctgcagtcggtgc

SEQ ID NO: 130288 - DNA, 25 bp, Homo sapien
gcgctgtggcctcataaatccgtgg

SEQ ID NO: 130289 - DNA, 25 bp, Homo sapien
taatgactgatagccgtggaaacgg

SEQ ID NO: 130290 - DNA, 25 bp, Homo sapien
acgaggaagacgctgaggaagcgca

SEQ ID NO: 130291 - DNA, 25 bp, Homo sapien
cccggccagggtggatcgcaccaga

SEQ ID NO: 130292 - DNA, 25 bp, Homo sapien
ggccagggtggatcgcaccagataa

SEQ ID NO: 130293 - DNA, 25 bp, Homo sapien
cagggtggatcgcaccagataatga

SEQ ID NO: 130294 - DNA, 25 bp, Homo sapien
gtggatcgcaccagataatgactga

SEQ ID NO: 130295 - DNA, 25 bp, Homo sapien
cgtggaaacggggagacaagataga

SEQ ID NO: 130296 - DNA, 25 bp, Homo sapien
ctgaggaagcgcagaggaagtgcta

SEQ ID NO: 130297 - DNA, 25 bp, Homo sapien
gtcaacaccgcggtctgagccgaga

SEQ ID NO: 130298 - DNA, 25 bp, Homo sapien
acctgcaggatacagggagtggcta

SEQ ID NO: 130299 - DNA, 25 bp, Homo sapien
ctgctctacgcggtggcggaactct

SEQ ID NO: 130300 - DNA, 25 bp, Homo sapien
ctgatatcgagtctgtaggcgtgtc

SEQ ID NO: 130301 - DNA, 25 bp, Homo sapien
tcacggccgtagattggctgatatc

SEQ ID NO: 130302 - DNA, 25 bp, Homo sapien
cacgggcggtcagtcaactacatca

SEQ ID NO: 130303 - DNA, 25 bp, Homo sapien
gcaggaatgcccaatccgaatacgg

SEQ ID NO: 130304 - DNA, 25 bp, Homo sapien
gggtccgcccacaacagcaggaatg

SEQ ID NO: 130305 - DNA, 25 bp, Homo sapien
gcatttcgatcaatctggcgccaca

SEQ ID NO: 130306 - DNA, 25 bp, Homo sapien
ctcaaagtcacatcgccggggtctc

SEQ ID NO: 130307 - DNA, 25 bp, Homo sapien
aatccctgttgtgtgtcgccgaata

SEQ ID NO: 130308 - DNA, 25 bp, Homo sapien
ggggaaaacataacgcgcgcctgta

SEQ ID NO: 130309 - DNA, 25 bp, Homo sapien
cccggctcaatctttggtgcaaagc

SEQ ID NO: 130310 - DNA, 25 bp, Homo sapien
gccggggaatctctgcaagtaacta

SEQ ID NO: 130311 - DNA, 25 bp, Homo sapien
agccggtttgctttggatgcatttc

SEQ ID NO: 130312 - DNA, 25 bp, Homo sapien
cttggaccagttgctaaaggacttc

SEQ ID NO: 130313 - DNA, 25 bp, Homo sapien
tgctcatgcggatctagattgaatc

SEQ ID NO: 130314 - DNA, 25 bp, Homo sapien
attcccgtgaaactatgctcatgcg

SEQ ID NO: 130315 - DNA, 25 bp, Homo sapien
ctcccgtgcacagcgtgagtaattc

SEQ ID NO: 130316 - DNA, 25 bp, Homo sapien
ttgaccggtgtcctgaattttctcc

SEQ ID NO: 130317 - DNA, 25 bp, Homo sapien
gcaggtgtatttacgttgatttctc

SEQ ID NO: 130318 - DNA, 25 bp, Homo sapien
ctcgccgtctttatacgcaggtgta

SEQ ID NO: 130319 - DNA, 25 bp, Homo sapien
aaatttcacgcaagacctcgccgtc

SEQ ID NO: 130320 - DNA, 25 bp, Homo sapien
attgaatctgatccttcgggccgcg

SEQ ID NO: 130321 - DNA, 25 bp, Homo sapien
actgttccttctgcacgcttggcgg

SEQ ID NO: 130322 - DNA, 25 bp, Homo sapien
cctccagctctgaagtccagcggga

SEQ ID NO: 130323 - DNA, 25 bp, Homo sapien
ctctgaagtccagcgggagactcct

SEQ ID NO: 130324 - DNA, 25 bp, Homo sapien
ggagactcctgcgttcctgcccaga

SEQ ID NO: 130325 - DNA, 25 bp, Homo sapien
ccctcggctgatcccttggccaggc

SEQ ID NO: 130326 - DNA, 25 bp, Homo sapien
catctgggcgggttggtccgccacc

SEQ ID NO: 130327 - DNA, 25 bp, Homo sapien
gcaggtgcgcactgttccttctgca

SEQ ID NO: 130328 - DNA, 25 bp, Homo sapien
ggaggttccccgagtccactggctc

SEQ ID NO: 130329 - DNA, 25 bp, Homo sapien
ctctgggttgacctcgtcccggtcg

SEQ ID NO: 130330 - DNA, 25 bp, Homo sapien
gccctggactctgggttgacctcgt

SEQ ID NO: 130331 - DNA, 25 bp, Homo sapien
ggcttcgcgcttccttgacactttc

SEQ ID NO: 130332 - DNA, 25 bp, Homo sapien
gcgggtgtccctaccataaccactg

SEQ ID NO: 130333 - DNA, 25 bp, Homo sapien
aggctgttttcgcacttgggcttcg

SEQ ID NO: 130334 - DNA, 25 bp, Homo sapien
ggctcagggaatgccagatctctgg

SEQ ID NO: 130335 - DNA, 25 bp, Homo sapien
ccgagctggctcagggaatgccaga

SEQ ID NO: 130336 - DNA, 25 bp, Homo sapien
gggcgtcttctccaactccgggtca

SEQ ID NO: 130337 - DNA, 25 bp, Homo sapien
ggaggctctacgtccactccgtatc

SEQ ID NO: 130338 - DNA, 25 bp, Homo sapien
tgcgcgggtcaccttgaatgtctgt

SEQ ID NO: 130339 - DNA, 25 bp, Homo sapien
tttttccttcagcagggacgcatcc

SEQ ID NO: 130340 - DNA, 25 bp, Homo sapien
gtgttgcaggactcggcattcgttc

SEQ ID NO: 130341 - DNA, 25 bp, Homo sapien
ttgaatgtctgtccggatccctcgc

SEQ ID NO: 130342 - DNA, 25 bp, Homo sapien
cagctgaattcgttctccatttttc

SEQ ID NO: 130343 - DNA, 25 bp, Homo sapien
tccgaggcacggaccatagcaagtg

SEQ ID NO: 130344 - DNA, 25 bp, Homo sapien
aaggagtatcgcagaccggcgccca

SEQ ID NO: 130345 - DNA, 25 bp, Homo sapien
gaggtcaccttcttctctactggcc

SEQ ID NO: 130346 - DNA, 25 bp, Homo sapien
agcacttgggcattttccgcggaga

SEQ ID NO: 130347 - DNA, 25 bp, Homo sapien
ggcttcggtctctacgctctgattt

SEQ ID NO: 130348 - DNA, 25 bp, Homo sapien
tcccgaccatctccctgggattttg

SEQ ID NO: 130349 - DNA, 25 bp, Homo sapien
acgtcccttggattggtgcagagcc

SEQ ID NO: 130350 - DNA, 25 bp, Homo sapien
tttagacctgtctgagggactctcc

SEQ ID NO: 130351 - DNA, 25 bp, Homo sapien
agtctgggtgtctcctgaacctcca

SEQ ID NO: 130352 - DNA, 25 bp, Homo sapien
gggccctgtgattgctctattaacc

SEQ ID NO: 130353 - DNA, 25 bp, Homo sapien
tacccggcttacatggccgacgtgg

SEQ ID NO: 130354 - DNA, 25 bp, Homo sapien
tcgcagggaccatgtatcagagctt

SEQ ID NO: 130355 - DNA, 25 bp, Homo sapien
ccaatctcggtgagtaggagcgcga

SEQ ID NO: 130356 - DNA, 25 bp, Homo sapien
tcgagggcctcttgtttttccacca

SEQ ID NO: 130357 - DNA, 25 bp, Homo sapien
ggggatggtgcttcactacctcgag

SEQ ID NO: 130358 - DNA, 25 bp, Homo sapien
ctacctcgagtttctagggaaggca

SEQ ID NO: 130359 - DNA, 25 bp, Homo sapien
atcgttgttgccgtcgttttctctc

SEQ ID NO: 130360 - DNA, 25 bp, Homo sapien
gttcctcccacgcatattatcgttg

SEQ ID NO: 130361 - DNA, 25 bp, Homo sapien
ctgatttattcctcgcagtggcgca

SEQ ID NO: 130362 - DNA, 25 bp, Homo sapien
gggcagtgcacaccttttacttgga

SEQ ID NO: 130363 - DNA, 25 bp, Homo sapien
tctcatgcagggtcgttagggccca

SEQ ID NO: 130364 - DNA, 25 bp, Homo sapien
gccgtcacaggtcagagatctcatg

SEQ ID NO: 130365 - DNA, 25 bp, Homo sapien
aaccaggtctcgatgcccacgttcg

SEQ ID NO: 130366 - DNA, 25 bp, Homo sapien
ttcgcctgacggtgaatgatggtta

SEQ ID NO: 130367 - DNA, 25 bp, Homo sapien
cagtgcccggcgctcactggttatt

SEQ ID NO: 130368 - DNA, 25 bp, Homo sapien
gctctcctcgggcagcagaaacctt

SEQ ID NO: 130369 - DNA, 25 bp, Homo sapien
gccctccggtagatctgcggcctgg

SEQ ID NO: 130370 - DNA, 25 bp, Homo sapien
ttcagcgactcttcgaagtcccttc

SEQ ID NO: 130371 - DNA, 25 bp, Homo sapien
ctcggaagagaacggcggagacaac

SEQ ID NO: 130372 - DNA, 25 bp, Homo sapien
aggccggagtccacgcccacttggg

SEQ ID NO: 130373 - DNA, 25 bp, Homo sapien
cccacctcgggcactcggaagagaa

SEQ ID NO: 130374 - DNA, 25 bp, Homo sapien
ttgggaaagcagtggtcttagaccc

SEQ ID NO: 130375 - DNA, 25 bp, Homo sapien
cgcaccccgaggcagagttgggaaa

SEQ ID NO: 130376 - DNA, 25 bp, Homo sapien
cgtctcagccgcctgcggaggtgct

SEQ ID NO: 130377 - DNA, 25 bp, Homo sapien
ttctacaacctggtgcgcttccgga

SEQ ID NO: 130378 - DNA, 25 bp, Homo sapien
catgagcgacttttgcgtggttccc

SEQ ID NO: 130379 - DNA, 25 bp, Homo sapien
atggagttcgtgaaatgccttggcc

SEQ ID NO: 130380 - DNA, 25 bp, Homo sapien
gtctccttccgcgactgattggccg

SEQ ID NO: 130381 - DNA, 25 bp, Homo sapien
tctagagtgttatcacgccagtctc

SEQ ID NO: 130382 - DNA, 25 bp, Homo sapien
cggcctccaatgagcttctagagtg

SEQ ID NO: 130383 - DNA, 25 bp, Homo sapien
ttttcacggttttaggctctacaga

SEQ ID NO: 130384 - DNA, 25 bp, Homo sapien
gacacgtgggcgacttattgaccaa

SEQ ID NO: 130385 - DNA, 25 bp, Homo sapien
cccagcgcagggttttgtaactaag

SEQ ID NO: 130386 - DNA, 25 bp, Homo sapien
tggttgctaagcgaggcgctaccca

SEQ ID NO: 130387 - DNA, 25 bp, Homo sapien
gtaattattacagccctgcgcggag

SEQ ID NO: 130388 - DNA, 25 bp, Homo sapien
cggctgttgctgtctccggctcctt

SEQ ID NO: 130389 - DNA, 25 bp, Homo sapien
ggctccttcgctaacgattgcagga

SEQ ID NO: 130390 - DNA, 25 bp, Homo sapien
cgctaacgattgcaggagaaataat

SEQ ID NO: 130391 - DNA, 25 bp, Homo sapien
ggtgtgaaattctccgctctgcctg

SEQ ID NO: 130392 - DNA, 25 bp, Homo sapien
gcccggctctccaagtgcgagcgag

SEQ ID NO: 130393 - DNA, 25 bp, Homo sapien
aagtgcgctgggttcccttagcggc

SEQ ID NO: 130394 - DNA, 25 bp, Homo sapien
gggtccgcgattcccatggccgcag

SEQ ID NO: 130395 - DNA, 25 bp, Homo sapien
ccagatctgcttgagtctatggagg

SEQ ID NO: 130396 - DNA, 25 bp, Homo sapien
cgagcgagccgctcggaagtgcgct

SEQ ID NO: 130397 - DNA, 25 bp, Homo sapien
cgcttcccagatctgcttgagtcta

SEQ ID NO: 130398 - DNA, 25 bp, Homo sapien
tcgggcgcttcccagatctgcttga

SEQ ID NO: 130399 - DNA, 25 bp, Homo sapien
tattcgagtagagggcgagcccgtc

SEQ ID NO: 130400 - DNA, 25 bp, Homo sapien
tcggcccagcgcgtattcgagtaga

SEQ ID NO: 130401 - DNA, 25 bp, Homo sapien
agatgccggcagatgcgattatgtc

SEQ ID NO: 130402 - DNA, 25 bp, Homo sapien
tttggcccggagacaccgaggccca

SEQ ID NO: 130403 - DNA, 25 bp, Homo sapien
tcccaggcagcagtctccggacccg

SEQ ID NO: 130404 - DNA, 25 bp, Homo sapien
cccggccgagctcttcctcgcaggc

SEQ ID NO: 130405 - DNA, 25 bp, Homo sapien
cgggcggagctgttttctgcttttc

SEQ ID NO: 130406 - DNA, 25 bp, Homo sapien
tttctgcttttctcgccgacgcttc

SEQ ID NO: 130407 - DNA, 25 bp, Homo sapien
ttttctcgccgacgcttcggagcgc

SEQ ID NO: 130408 - DNA, 25 bp, Homo sapien
cgattatgtcggcagtttggcccgg

SEQ ID NO: 130409 - DNA, 25 bp, Homo sapien
ccgctagcgcgtgatcgttgtcaac

SEQ ID NO: 130410 - DNA, 25 bp, Homo sapien
cacgcaagcacgtgatgcggggaaa

SEQ ID NO: 130411 - DNA, 25 bp, Homo sapien
gcgtaaccgtacacgcaagcacgtg

SEQ ID NO: 130412 - DNA, 25 bp, Homo sapien
gcgtgatcgttgtcaaccaatggga

SEQ ID NO: 130413 - DNA, 25 bp, Homo sapien
ccgcttggccgcctcagtcaatacc

SEQ ID NO: 130414 - DNA, 25 bp, Homo sapien
gacggcgtccgtgaggagcccttcc

SEQ ID NO: 130415 - DNA, 25 bp, Homo sapien
agtcctcgttctcgctgctgtagca

SEQ ID NO: 130416 - DNA, 25 bp, Homo sapien
caatgggaaggcgtaaccgtacacg

SEQ ID NO: 130417 - DNA, 25 bp, Homo sapien
gtacaaatagaaaagagtggctgtc

SEQ ID NO: 130418 - DNA, 25 bp, Homo sapien
gtacccacaaaacactacagctacg

SEQ ID NO: 130419 - DNA, 25 bp, Homo sapien
acagaacagcctttagaagggccac

SEQ ID NO: 130420 - DNA, 25 bp, Homo sapien
cagcctttagaagggccactttgtt

SEQ ID NO: 130421 - DNA, 25 bp, Homo sapien
aagggccactttgttgttcagagaa

SEQ ID NO: 130422 - DNA, 25 bp, Homo sapien
tgttcagagaacgtacccacaaaac

SEQ ID NO: 130423 - DNA, 25 bp, Homo sapien
aacactacagctacgtacaaataga

SEQ ID NO: 130424 - DNA, 25 bp, Homo sapien
gccactttgttgttcagagaacgta

SEQ ID NO: 130425 - DNA, 25 bp, Homo sapien
acacacgcctgttggagcatcctga

SEQ ID NO: 130426 - DNA, 25 bp, Homo sapien
agctgggaaacagcggccacctcat

SEQ ID NO: 130427 - DNA, 25 bp, Homo sapien
aggagccttcccacgaggacagatg

SEQ ID NO: 130428 - DNA, 25 bp, Homo sapien
cctctgtggcttctgttgtgacgca

SEQ ID NO: 130429 - DNA, 25 bp, Homo sapien
tgtgacgcaagcgttccctccgcga

SEQ ID NO: 130430 - DNA, 25 bp, Homo sapien
gaagctctcccgtgaggtatgtctc

SEQ ID NO: 130431 - DNA, 25 bp, Homo sapien
gcgccgccctcgattaatgctggca

SEQ ID NO: 130432 - DNA, 25 bp, Homo sapien
ccacctcattccaaggaagcgggga

SEQ ID NO: 130433 - DNA, 25 bp, Homo sapien
tgacgcctcctcgaggtacagattc

SEQ ID NO: 130434 - DNA, 25 bp, Homo sapien
ctttgatgtattggaatagccactc

SEQ ID NO: 130435 - DNA, 25 bp, Homo sapien
tgtctgttctctcaaacctagttgg

SEQ ID NO: 130436 - DNA, 25 bp, Homo sapien
ttccgtcctttcctcatgtctgttc

SEQ ID NO: 130437 - DNA, 25 bp, Homo sapien
gtcttgatcacccttgaaccctggc

SEQ ID NO: 130438 - DNA, 25 bp, Homo sapien
acactggacggtgcttttcattccg

SEQ ID NO: 130439 - DNA, 25 bp, Homo sapien
tctggcttcacccacactggacggt

SEQ ID NO: 130440 - DNA, 25 bp, Homo sapien
gccctgggtcgcatctaatgatctg

SEQ ID NO: 130441 - DNA, 25 bp, Homo sapien
tgcagccttgcgtctgtacttaccg

SEQ ID NO: 130442 - DNA, 25 bp, Homo sapien
gcgccagcactacggtctcgtttaa

SEQ ID NO: 130443 - DNA, 25 bp, Homo sapien
ccttgagtctcagccagtcggcgtc

SEQ ID NO: 130444 - DNA, 25 bp, Homo sapien
cctaccttagtcacattgttaggga

SEQ ID NO: 130445 - DNA, 25 bp, Homo sapien
cggatgtgacgttgacctaccttag

SEQ ID NO: 130446 - DNA, 25 bp, Homo sapien
ccgcccactaaaccggatgtgacgt

SEQ ID NO: 130447 - DNA, 25 bp, Homo sapien
tgagcggaagaacccaccagaatcc

SEQ ID NO: 130448 - DNA, 25 bp, Homo sapien
tccgggactcaccaaacgcatgcgt

SEQ ID NO: 130449 - DNA, 25 bp, Homo sapien
agcgcgagcttgctgggtccgcgag

SEQ ID NO: 130450 - DNA, 25 bp, Homo sapien
gagcgcgagcttgctgggtccgcga

SEQ ID NO: 130451 - DNA, 25 bp, Homo sapien
caccagctgtcactccgtgccgccg

SEQ ID NO: 130452 - DNA, 25 bp, Homo sapien
tcaccagctgtcactccgtgccgcc

SEQ ID NO: 130453 - DNA, 25 bp, Homo sapien
gtcaccagctgtcactccgtgccgc

SEQ ID NO: 130454 - DNA, 25 bp, Homo sapien
cgtcaccagctgtcactccgtgccg

SEQ ID NO: 130455 - DNA, 25 bp, Homo sapien
ctctcccgcacaccgccgccacgcc

SEQ ID NO: 130456 - DNA, 25 bp, Homo sapien
taccccgtgtcgcaggcacccccgc

SEQ ID NO: 130457 - DNA, 25 bp, Homo sapien
ccagccatccctacctcagggcttg

SEQ ID NO: 130458 - DNA, 25 bp, Homo sapien
agaagaaggacccagcgcgagcgtc

SEQ ID NO: 130459 - DNA, 25 bp, Homo sapien
gaagaaggacccagcgcgagcgtcc

SEQ ID NO: 130460 - DNA, 25 bp, Homo sapien
aagaaggacccagcgcgagcgtcct

SEQ ID NO: 130461 - DNA, 25 bp, Homo sapien
agaaggacccagcgcgagcgtcctc

SEQ ID NO: 130462 - DNA, 25 bp, Homo sapien
gcggtcccttcagcatcagtggcac

SEQ ID NO: 130463 - DNA, 25 bp, Homo sapien
cggtagttgaacaccaggcagtcca

SEQ ID NO: 130464 - DNA, 25 bp, Homo sapien
tggcggagccggtagttgaacacca

SEQ ID NO: 130465 - DNA, 25 bp, Homo sapien
ttcagcatcagtggcactggcggtg

SEQ ID NO: 130466 - DNA, 25 bp, Homo sapien
ttctgaagtctgaagcggcgatggc

SEQ ID NO: 130467 - DNA, 25 bp, Homo sapien
tgaggacgacgctggttctgaagtc

SEQ ID NO: 130468 - DNA, 25 bp, Homo sapien
ccggaaaccacttctcggccaggtg

SEQ ID NO: 130469 - DNA, 25 bp, Homo sapien
acggtcaccggctcgctcaggaagc

SEQ ID NO: 130470 - DNA, 25 bp, Homo sapien
gcagccctcggctctgatgcaaaag

SEQ ID NO: 130471 - DNA, 25 bp, Homo sapien
agagaagcttctgttgcgccctaga

SEQ ID NO: 130472 - DNA, 25 bp, Homo sapien
accggagcactgacaatggtctgca

SEQ ID NO: 130473 - DNA, 25 bp, Homo sapien
cgctgtgactactcgcaacgggaga

SEQ ID NO: 130474 - DNA, 25 bp, Homo sapien
cgcctcgctgcaacttctctttgga

SEQ ID NO: 130475 - DNA, 25 bp, Homo sapien
cggggcgtcttctcctacgcaggaa

SEQ ID NO: 130476 - DNA, 25 bp, Homo sapien
caagcgtcgtcgtcacccaaggtac

SEQ ID NO: 130477 - DNA, 25 bp, Homo sapien
tgccagtcgccacaccgtgcggaaa

SEQ ID NO: 130478 - DNA, 25 bp, Homo sapien
gtcgggaggcgagcttccttcctct

SEQ ID NO: 130479 - DNA, 25 bp, Homo sapien
ctgtcgccttgttacgaaaatagtc

SEQ ID NO: 130480 - DNA, 25 bp, Homo sapien
ggcttccaagaagctgtcgccttgt

SEQ ID NO: 130481 - DNA, 25 bp, Homo sapien
cttcggagggatcaaaggctcgccc

SEQ ID NO: 130482 - DNA, 25 bp, Homo sapien
gcacctccttcggagggatcaaagg

SEQ ID NO: 130483 - DNA, 25 bp, Homo sapien
gcaaactacacgcagcagggtgctg

SEQ ID NO: 130484 - DNA, 25 bp, Homo sapien
gctcgcggacgcagcaaactacacg

SEQ ID NO: 130485 - DNA, 25 bp, Homo sapien
ctgaaggacgctcgcggacgcagca

SEQ ID NO: 130486 - DNA, 25 bp, Homo sapien
ccggagactctgcagaaagcgttta

SEQ ID NO: 130487 - DNA, 25 bp, Homo sapien
cccaggcaaaaggtaatcaagagtc

SEQ ID NO: 130488 - DNA, 25 bp, Homo sapien
ttcccttcacgggttgcgaccgatc

SEQ ID NO: 130489 - DNA, 25 bp, Homo sapien
acaaggcggggtgacactttctcgc

SEQ ID NO: 130490 - DNA, 25 bp, Homo sapien
agcccgacggcaagacgcaagtcta

SEQ ID NO: 130491 - DNA, 25 bp, Homo sapien
cgcaagtctagcttacgtgttagga

SEQ ID NO: 130492 - DNA, 25 bp, Homo sapien
ccggcttctttctgcacatcaagca

SEQ ID NO: 130493 - DNA, 25 bp, Homo sapien
gagcacagaacaggcaccgacttga

SEQ ID NO: 130494 - DNA, 25 bp, Homo sapien
ggcagtccaggtgacctcgcgtttt

SEQ ID NO: 130495 - DNA, 25 bp, Homo sapien
ctcctgggtcacatagcaggtcttc

SEQ ID NO: 130496 - DNA, 25 bp, Homo sapien
aatgactcacctgggtccgcgccgg

SEQ ID NO: 130497 - DNA, 25 bp, Homo sapien
ctgtgcaacccaatgactcacctgg

SEQ ID NO: 130498 - DNA, 25 bp, Homo sapien
gtctcgcttcctgtgcaacccaatg

SEQ ID NO: 130499 - DNA, 25 bp, Homo sapien
acagctatccggaggcgtctcgctt

SEQ ID NO: 130500 - DNA, 25 bp, Homo sapien
gcgagctgcagcacagctatccgga

SEQ ID NO: 130501 - DNA, 25 bp, Homo sapien
tctggaaagacttaccctgcgccgg

SEQ ID NO: 130502 - DNA, 25 bp, Homo sapien
tctgtccatggagcgcaactaaacg

SEQ ID NO: 130503 - DNA, 25 bp, Homo sapien
gtccaggttcgttgatctgtccatg

SEQ ID NO: 130504 - DNA, 25 bp, Homo sapien
cttgagctcctcaatgtccaggttc

SEQ ID NO: 130505 - DNA, 25 bp, Homo sapien
ctcggacaactttgctgggaaagca

SEQ ID NO: 130506 - DNA, 25 bp, Homo sapien
tctccgagcggaaatgcactgtccc

SEQ ID NO: 130507 - DNA, 25 bp, Homo sapien
atgcctctgtcacgcgaatctccga

SEQ ID NO: 130508 - DNA, 25 bp, Homo sapien
aaaacgggctgtcgttgcagatgcc

SEQ ID NO: 130509 - DNA, 25 bp, Homo sapien
tgcaactgcgggaggaaacactgcc

SEQ ID NO: 130510 - DNA, 25 bp, Homo sapien
ggtcttctcccggtgaaccggatgc

SEQ ID NO: 130511 - DNA, 25 bp, Homo sapien
gtgaaccggatgctctgtcagtctc

SEQ ID NO: 130512 - DNA, 25 bp, Homo sapien
cgtggagttagcagggttctgactt

SEQ ID NO: 130513 - DNA, 25 bp, Homo sapien
cgtgttgctaggcagcctggtcgcc

SEQ ID NO: 130514 - DNA, 25 bp, Homo sapien
gggcgctccttcacgccgtaggcaa

SEQ ID NO: 130515 - DNA, 25 bp, Homo sapien
ggaggagacactgccctgccgcgat

SEQ ID NO: 130516 - DNA, 25 bp, Homo sapien
gccaggcagccctgccgtgttgcta

SEQ ID NO: 130517 - DNA, 25 bp, Homo sapien
ctaccgcgcgtggaggagacactgc

SEQ ID NO: 130518 - DNA, 25 bp, Homo sapien
ctgggattcggcagacgccagtcct

SEQ ID NO: 130519 - DNA, 25 bp, Homo sapien
ggatgtcacaggctcggcaaccgcc

SEQ ID NO: 130520 - DNA, 25 bp, Homo sapien
gcccggaaatgctccgaagcctgtc

SEQ ID NO: 130521 - DNA, 25 bp, Homo sapien
cagctgccagatctgcgtctgtgtc

SEQ ID NO: 130522 - DNA, 25 bp, Homo sapien
gtgccctccgctttttgtggccaaa

SEQ ID NO: 130523 - DNA, 25 bp, Homo sapien
ttcggcatgtggcttgtcttccatc

SEQ ID NO: 130524 - DNA, 25 bp, Homo sapien
ctggtctccgcggatgtcacaggct

SEQ ID NO: 130525 - DNA, 25 bp, Homo sapien
ctgtgtccggttccgtcactgaggt

SEQ ID NO: 130526 - DNA, 25 bp, Homo sapien
gctcgagaacgtcgcacctcgtctg

SEQ ID NO: 130527 - DNA, 25 bp, Homo sapien
cgcgcggatggccatcttaagtggc

SEQ ID NO: 130528 - DNA, 25 bp, Homo sapien
tccttcgcaggtttggggaactcga

SEQ ID NO: 130529 - DNA, 25 bp, Homo sapien
ggactggatctcctcgggtgaatga

SEQ ID NO: 130530 - DNA, 25 bp, Homo sapien
tgggagaactgagaagcgctgaatt

SEQ ID NO: 130531 - DNA, 25 bp, Homo sapien
gccatggagtggaatcagaccttta

SEQ ID NO: 130532 - DNA, 25 bp, Homo sapien
cccgccagagtaagaatcttcagaa

SEQ ID NO: 130533 - DNA, 25 bp, Homo sapien
ctttctactagacgggccagggatc

SEQ ID NO: 130534 - DNA, 25 bp, Homo sapien
ctgcagagagcttcgtcaggaatgc

SEQ ID NO: 130535 - DNA, 25 bp, Homo sapien
gggctgtgagccttttctgcagaga

SEQ ID NO: 130536 - DNA, 25 bp, Homo sapien
cgcaggggcaggaaaagcccgtcct

SEQ ID NO: 130537 - DNA, 25 bp, Homo sapien
tgcgaaacacccatgcctgagctta

SEQ ID NO: 130538 - DNA, 25 bp, Homo sapien
cttcgtcaggaatgcccagaccaga

SEQ ID NO: 130539 - DNA, 25 bp, Homo sapien
ccgggtgctgcagagaccgaatgaa

SEQ ID NO: 130540 - DNA, 25 bp, Homo sapien
ggagcaccaggcgatatcacgtacc

SEQ ID NO: 130541 - DNA, 25 bp, Homo sapien
atgtgtcaccgtcaccgagggctgt

SEQ ID NO: 130542 - DNA, 25 bp, Homo sapien
tcgggatgctagtacgtaccgaaga

SEQ ID NO: 130543 - DNA, 25 bp, Homo sapien
acgtaccgaagaggctgtggtcctg

SEQ ID NO: 130544 - DNA, 25 bp, Homo sapien
cggcgacaaaccagcaggaaaattt

SEQ ID NO: 130545 - DNA, 25 bp, Homo sapien
gctgctctggccagcccttcagccc

SEQ ID NO: 130546 - DNA, 25 bp, Homo sapien
ccagcctgcgtcttgcaccggatgg

SEQ ID NO: 130547 - DNA, 25 bp, Homo sapien
ctgcgtcttgcaccggatgggtcca

SEQ ID NO: 130548 - DNA, 25 bp, Homo sapien
cggcgatgacgcccttggcaggcaa

SEQ ID NO: 130549 - DNA, 25 bp, Homo sapien
aagccggtgcggcaatagagctgcc

SEQ ID NO: 130550 - DNA, 25 bp, Homo sapien
cctcagttacgctgactcggctgtg

SEQ ID NO: 130551 - DNA, 25 bp, Homo sapien
ggacagcctaggatccggtcaccca

SEQ ID NO: 130552 - DNA, 25 bp, Homo sapien
gaacttcccgtgagcgaggctgaca

SEQ ID NO: 130553 - DNA, 25 bp, Homo sapien
atgtgaccttcgtgccgggtacgca

SEQ ID NO: 130554 - DNA, 25 bp, Homo sapien
tatgctaccagctgtacggggaccc

SEQ ID NO: 130555 - DNA, 25 bp, Homo sapien
accgctacgctgaaggtggcgtcgc

SEQ ID NO: 130556 - DNA, 25 bp, Homo sapien
tcttccatgatcttcccgggccgaa

SEQ ID NO: 130557 - DNA, 25 bp, Homo sapien
ggctggcgcggttatttatgactgc

SEQ ID NO: 130558 - DNA, 25 bp, Homo sapien
tactggatcccggtggtgttcatca

SEQ ID NO: 130559 - DNA, 25 bp, Homo sapien
cgccgctaaaagcagcctcggggca

SEQ ID NO: 130560 - DNA, 25 bp, Homo sapien
acgccatccagctgtgcataggtga

SEQ ID NO: 130561 - DNA, 25 bp, Homo sapien
cggtggtgttcatcaccctcctgct

SEQ ID NO: 130562 - DNA, 25 bp, Homo sapien
caactctcgggttaaggtggcgcct

SEQ ID NO: 130563 - DNA, 25 bp, Homo sapien
cccggaatccagaggccgagccgga

SEQ ID NO: 130564 - DNA, 25 bp, Homo sapien
gcgcggaagcgctcgcgacctaact

SEQ ID NO: 130565 - DNA, 25 bp, Homo sapien
tgctcggctggtcctactacgccta

SEQ ID NO: 130566 - DNA, 25 bp, Homo sapien
ccgtaaggctgcagcggatgcaaga

SEQ ID NO: 130567 - DNA, 25 bp, Homo sapien
aaagcctttgcgtcatcactacgcg

SEQ ID NO: 130568 - DNA, 25 bp, Homo sapien
agatctacttgtgtcgctgagctcg

SEQ ID NO: 130569 - DNA, 25 bp, Homo sapien
tcctcgccatagagacagcactcgg

SEQ ID NO: 130570 - DNA, 25 bp, Homo sapien
acctctcgcccagcgaagggaaagg

SEQ ID NO: 130571 - DNA, 25 bp, Homo sapien
cgtcgcttttcgcacgtcctgacgg

SEQ ID NO: 130572 - DNA, 25 bp, Homo sapien
gctagatgatgacgcgacacgcaga

SEQ ID NO: 130573 - DNA, 25 bp, Homo sapien
tacgaagaggtgaggatctaggcca

SEQ ID NO: 130574 - DNA, 25 bp, Homo sapien
ctctctcttaacaggggcagccggc

SEQ ID NO: 130575 - DNA, 25 bp, Homo sapien
aaccttgggcgtacggatgtgctcc

SEQ ID NO: 130576 - DNA, 25 bp, Homo sapien
gatgtgctccatggctggcccacgt

SEQ ID NO: 130577 - DNA, 25 bp, Homo sapien
cccgggatgctcaggcaatgcctgc

SEQ ID NO: 130578 - DNA, 25 bp, Homo sapien
ctcgctctctcttaacaggggcagc

SEQ ID NO: 130579 - DNA, 25 bp, Homo sapien
cggagcactatacggccactgttct

SEQ ID NO: 130580 - DNA, 25 bp, Homo sapien
cagccggcggagcactatacggcca

SEQ ID NO: 130581 - DNA, 25 bp, Homo sapien
gctggtgtcaccaaccttgggcgta

SEQ ID NO: 130582 - DNA, 25 bp, Homo sapien
acgtgtgctcggctccaggcaaacc

SEQ ID NO: 130583 - DNA, 25 bp, Homo sapien
gaagtttatcctcgcgcgcagcctc

SEQ ID NO: 130584 - DNA, 25 bp, Homo sapien
cccagtaagttgctaggtctccagc

SEQ ID NO: 130585 - DNA, 25 bp, Homo sapien
tccagcgagtcttcgtcagggagtc

SEQ ID NO: 130586 - DNA, 25 bp, Homo sapien
tgaagccgtggaccttcgtcctcgg

SEQ ID NO: 130587 - DNA, 25 bp, Homo sapien
cgcggggacccttcagtcactattt

SEQ ID NO: 130588 - DNA, 25 bp, Homo sapien
cgccttcgctccttttcggttcttg

SEQ ID NO: 130589 - DNA, 25 bp, Homo sapien
gcttaaattagaaagccggcttgga

SEQ ID NO: 130590 - DNA, 25 bp, Homo sapien
atgaaggtctggctgctgcttggtc

SEQ ID NO: 130591 - DNA, 25 bp, Homo sapien
aacgttcggccctcggtggctcagc

SEQ ID NO: 130592 - DNA, 25 bp, Homo sapien
tcctgccagctcttggtctaacgtt

SEQ ID NO: 130593 - DNA, 25 bp, Homo sapien
ccacctagcttgtgccctgacttta

SEQ ID NO: 130594 - DNA, 25 bp, Homo sapien
tgcttggtcttctgctggtgcacga

SEQ ID NO: 130595 - DNA, 25 bp, Homo sapien
tccgaggttcccgagatgaaggtct

SEQ ID NO: 130596 - DNA, 25 bp, Homo sapien
ctcttggtctaacgttcggccctcg

SEQ ID NO: 130597 - DNA, 25 bp, Homo sapien
ttctgctggtgcacgaagcgctgga

SEQ ID NO: 130598 - DNA, 25 bp, Homo sapien
ggcggcgtaaggagtccacagtcaa

SEQ ID NO: 130599 - DNA, 25 bp, Homo sapien
ctttcaaggtgacagcgacgagatc

SEQ ID NO: 130600 - DNA, 25 bp, Homo sapien
gggaacagattccagcgcgcactta

SEQ ID NO: 130601 - DNA, 25 bp, Homo sapien
ctccttcaagcgctccgggagcaaa

SEQ ID NO: 130602 - DNA, 25 bp, Homo sapien
agggctggcgccctttgcaccactg

SEQ ID NO: 130603 - DNA, 25 bp, Homo sapien
ttgtaaatagccgaactcgggcctc

SEQ ID NO: 130604 - DNA, 25 bp, Homo sapien
gcgctgcacctgttgccacgtgcga

SEQ ID NO: 130605 - DNA, 25 bp, Homo sapien
gctcccggactaagtgcggacgcgc

SEQ ID NO: 130606 - DNA, 25 bp, Homo sapien
cagccaggaaacgtgtgggcctctc

SEQ ID NO: 130607 - DNA, 25 bp, Homo sapien
tccctctgtggaactctcggtgtcc

SEQ ID NO: 130608 - DNA, 25 bp, Homo sapien
cactgggtcgagttcttagagaaac

SEQ ID NO: 130609 - DNA, 25 bp, Homo sapien
tggtgattgcaggactcccttcttg

SEQ ID NO: 130610 - DNA, 25 bp, Homo sapien
tgtagaggtaatgcctgcgcgtccc

SEQ ID NO: 130611 - DNA, 25 bp, Homo sapien
tgggatttgtagtcctccacctgtg

SEQ ID NO: 130612 - DNA, 25 bp, Homo sapien
aacgcgaggtctagttggcattctg

SEQ ID NO: 130613 - DNA, 25 bp, Homo sapien
tgactccagtctagctcgcattgcg

SEQ ID NO: 130614 - DNA, 25 bp, Homo sapien
ccgcgcgctcctgtttgcggaactt

SEQ ID NO: 130615 - DNA, 25 bp, Homo sapien
ggccgcaaggctcgagtgagatcct

SEQ ID NO: 130616 - DNA, 25 bp, Homo sapien
agtgagatcctggttcggaaagaac

SEQ ID NO: 130617 - DNA, 25 bp, Homo sapien
actccttggaatcgtcgtcctcgga

SEQ ID NO: 130618 - DNA, 25 bp, Homo sapien
gggctgcacgtggactccttggaat

SEQ ID NO: 130619 - DNA, 25 bp, Homo sapien
ccacagtgcgcccttgagcggctgt

SEQ ID NO: 130620 - DNA, 25 bp, Homo sapien
caagccttaagtagttcggccgctc

SEQ ID NO: 130621 - DNA, 25 bp, Homo sapien
cggctgccaagccttaagtagttcg

SEQ ID NO: 130622 - DNA, 25 bp, Homo sapien
ggctttcgtgccatccgtggacaca

SEQ ID NO: 130623 - DNA, 25 bp, Homo sapien
cctcggtgaaaagcgcgctgagact

SEQ ID NO: 130624 - DNA, 25 bp, Homo sapien
tacctgcagaaggagagtcgcgatc

SEQ ID NO: 130625 - DNA, 25 bp, Homo sapien
gaccgcaccattccaggcagtaggg

SEQ ID NO: 130626 - DNA, 25 bp, Homo sapien
ctcgggtcctccaagctgttggtta

SEQ ID NO: 130627 - DNA, 25 bp, Homo sapien
cccagcccgatgcagcagttcatta

SEQ ID NO: 130628 - DNA, 25 bp, Homo sapien
tgtgtttcctcctaactggcgaagg

SEQ ID NO: 130629 - DNA, 25 bp, Homo sapien
cggcccgaaatgagttgagttattc

SEQ ID NO: 130630 - DNA, 25 bp, Homo sapien
atggagcaggtgtccagtgagagca

SEQ ID NO: 130631 - DNA, 25 bp, Homo sapien
gacataaggccgcatgttgcccttt

SEQ ID NO: 130632 - DNA, 25 bp, Homo sapien
atgttgccctttcaactgcagtgga

SEQ ID NO: 130633 - DNA, 25 bp, Homo sapien
gccctttcaactgcagtggaaaatt

SEQ ID NO: 130634 - DNA, 25 bp, Homo sapien
gtggaaaattgtgcatcggagactc

SEQ ID NO: 130635 - DNA, 25 bp, Homo sapien
ttgtgcatcggagactcacaggtcc

SEQ ID NO: 130636 - DNA, 25 bp, Homo sapien
tcacaggtccgtcatggagcaggtg

SEQ ID NO: 130637 - DNA, 25 bp, Homo sapien
tcggagactcacaggtccgtcatgg

SEQ ID NO: 130638 - DNA, 25 bp, Homo sapien
ctttttgccgcagctctttcgcttc

SEQ ID NO: 130639 - DNA, 25 bp, Homo sapien
tcacacaaggactcggaggggctcc

SEQ ID NO: 130640 - DNA, 25 bp, Homo sapien
tccaggtcctggacgggatcgtccc

SEQ ID NO: 130641 - DNA, 25 bp, Homo sapien
ccgccttcttcctgcttaggttttg

SEQ ID NO: 130642 - DNA, 25 bp, Homo sapien
ctaggcgttccggattgtcgcgccc

SEQ ID NO: 130643 - DNA, 25 bp, Homo sapien
ttcacgttggcctccagctctcgtg

SEQ ID NO: 130644 - DNA, 25 bp, Homo sapien
ccggagttcagcagcgcccggactt

SEQ ID NO: 130645 - DNA, 25 bp, Homo sapien
ctcctcgagactcgcgggacagaga

SEQ ID NO: 130646 - DNA, 25 bp, Homo sapien
tttcctctcaggaagggccgtgtga

SEQ ID NO: 130647 - DNA, 25 bp, Homo sapien
gcctgttgctttgtcttcttccttc

SEQ ID NO: 130648 - DNA, 25 bp, Homo sapien
ccgcgagcgaaaacctgcctgttgc

SEQ ID NO: 130649 - DNA, 25 bp, Homo sapien
aggcgatccagaccctcgcagtgca

SEQ ID NO: 130650 - DNA, 25 bp, Homo sapien
ccgtcgagccctgaaagggccattt

SEQ ID NO: 130651 - DNA, 25 bp, Homo sapien
tccgtcctttgatctgtgccgcaga

SEQ ID NO: 130652 - DNA, 25 bp, Homo sapien
cggggagaggtcacttaaaactgca

SEQ ID NO: 130653 - DNA, 25 bp, Homo sapien
cccagtaacgtcaaagcgaaggcgg

SEQ ID NO: 130654 - DNA, 25 bp, Homo sapien
tgcaggacaccaaggtcaagactgg

SEQ ID NO: 130655 - DNA, 25 bp, Homo sapien
accagaggacatctgcgagctgccg

SEQ ID NO: 130656 - DNA, 25 bp, Homo sapien
agaaatagtgctgcggcctggagaa

SEQ ID NO: 130657 - DNA, 25 bp, Homo sapien
atacgtgcccaaggactgcccggga

SEQ ID NO: 130658 - DNA, 25 bp, Homo sapien
ccctactggtcctgtgatacgtgcc

SEQ ID NO: 130659 - DNA, 25 bp, Homo sapien
aggtggccgccgtcaccctactggt

SEQ ID NO: 130660 - DNA, 25 bp, Homo sapien
aacaagggatgtgcgcggctcgtcc

SEQ ID NO: 130661 - DNA, 25 bp, Homo sapien
gagaagcgcatcagccaggaccaga

SEQ ID NO: 130662 - DNA, 25 bp, Homo sapien
ctagcaggagcacgtcctcgacttg

SEQ ID NO: 130663 - DNA, 25 bp, Homo sapien
gcgggacggctacaagagctgtttt

SEQ ID NO: 130664 - DNA, 25 bp, Homo sapien
ggctggcctagagtttctagactcc

SEQ ID NO: 130665 - DNA, 25 bp, Homo sapien
ttcggggaagttctggaatccggca

SEQ ID NO: 130666 - DNA, 25 bp, Homo sapien
atttcctcggaggttgcatgggtgc

SEQ ID NO: 130667 - DNA, 25 bp, Homo sapien
ccggagtatttgctcagcccgcctg

SEQ ID NO: 130668 - DNA, 25 bp, Homo sapien
acaagagctgttttgcgtccgggcc

SEQ ID NO: 130669 - DNA, 25 bp, Homo sapien
cctcgacttgcgcatggaaatcttc

SEQ ID NO: 130670 - DNA, 25 bp, Homo sapien
accatggggggcgtatccgcacagc

SEQ ID NO: 130671 - DNA, 25 bp, Homo sapien
ggccacattcaccatggggggcgta

SEQ ID NO: 130672 - DNA, 25 bp, Homo sapien
cacattcaccatggggggcgtatcc

SEQ ID NO: 130673 - DNA, 25 bp, Homo sapien
cacagcggccacattcaccatgggg

SEQ ID NO: 130674 - DNA, 25 bp, Homo sapien
ccacattcaccatggggggcgtatc

SEQ ID NO: 130675 - DNA, 25 bp, Homo sapien
gcacagcggccacattcaccatggg

SEQ ID NO: 130676 - DNA, 25 bp, Homo sapien
ccgcacagcggccacattcaccatg

SEQ ID NO: 130677 - DNA, 25 bp, Homo sapien
gccacattcaccatggggggcgtat

SEQ ID NO: 130678 - DNA, 25 bp, Homo sapien
tgggcgcgtcccagggaacacgaca

SEQ ID NO: 130679 - DNA, 25 bp, Homo sapien
gagcagggaggaacgaccgccttcc

SEQ ID NO: 130680 - DNA, 25 bp, Homo sapien
gaggaacgaccgccttcccgaagca

SEQ ID NO: 130681 - DNA, 25 bp, Homo sapien
gaacacgacacccaaggagagggcg

SEQ ID NO: 130682 - DNA, 25 bp, Homo sapien
ggaccgagcgcatctgcccacagcg

SEQ ID NO: 130683 - DNA, 25 bp, Homo sapien
ttcgccgcacaacgccgctggtgag

SEQ ID NO: 130684 - DNA, 25 bp, Homo sapien
aagcaccgcagggttcgccgcacaa

SEQ ID NO: 130685 - DNA, 25 bp, Homo sapien
cacacgctggaaaacggtgggagca

SEQ ID NO: 130686 - DNA, 25 bp, Homo sapien
tggacaccaagagccggagaagttt

SEQ ID NO: 130687 - DNA, 25 bp, Homo sapien
gcggcacgtggaaaggctacttttc

SEQ ID NO: 130688 - DNA, 25 bp, Homo sapien
gctacttttcagtgggttttgcaga

SEQ ID NO: 130689 - DNA, 25 bp, Homo sapien
ccacgagaaacgctggtgaagccaa

SEQ ID NO: 130690 - DNA, 25 bp, Homo sapien
aaccgcagtcatcgcgcggcacgtg

SEQ ID NO: 130691 - DNA, 25 bp, Homo sapien
ccatggggtccttactcttgcagga

SEQ ID NO: 130692 - DNA, 25 bp, Homo sapien
agaggtgtccaatctccatggggtc

SEQ ID NO: 130693 - DNA, 25 bp, Homo sapien
gcggtttacgcgtgactggacacca

SEQ ID NO: 130694 - DNA, 25 bp, Homo sapien
gcccgcaggaatgaaaatccacttc

SEQ ID NO: 130695 - DNA, 25 bp, Homo sapien
ggacggcatccaccaaagcgctttc

SEQ ID NO: 130696 - DNA, 25 bp, Homo sapien
cgtttgttggagaaaccggtgcata

SEQ ID NO: 130697 - DNA, 25 bp, Homo sapien
ccggagctcacgctttgcacgatca

SEQ ID NO: 130698 - DNA, 25 bp, Homo sapien
tctccgcattttcgaggtgacctgg

SEQ ID NO: 130699 - DNA, 25 bp, Homo sapien
gcggttcaactgctctggcttctca

SEQ ID NO: 130700 - DNA, 25 bp, Homo sapien
ctgctcgcaaaacccggaaaagctt

SEQ ID NO: 130701 - DNA, 25 bp, Homo sapien
ccggcagactttaacatccaggtga

SEQ ID NO: 130702 - DNA, 25 bp, Homo sapien
gttcaacccgttgtgtccagctccg

SEQ ID NO: 130703 - DNA, 25 bp, Homo sapien
cgagcgtcctccctattactcaatg

SEQ ID NO: 130704 - DNA, 25 bp, Homo sapien
attactcaatggagccggcgggata

SEQ ID NO: 130705 - DNA, 25 bp, Homo sapien
gtgggtctcagcgaaaacgcgctcc

SEQ ID NO: 130706 - DNA, 25 bp, Homo sapien
cgccagctcctcacgcgtgtaaatg

SEQ ID NO: 130707 - DNA, 25 bp, Homo sapien
tcagtgaggtcgatcttgagcgcca

SEQ ID NO: 130708 - DNA, 25 bp, Homo sapien
gcacctgcacgcgagcctcagtgag

SEQ ID NO: 130709 - DNA, 25 bp, Homo sapien
ctgggaagaacttgtagggcactgc

SEQ ID NO: 130710 - DNA, 25 bp, Homo sapien
gtggccactgccacccgaactgagg

SEQ ID NO: 130711 - DNA, 25 bp, Homo sapien
gctatcccttccactctggctggga

SEQ ID NO: 130712 - DNA, 25 bp, Homo sapien
gccgaccgtaagttttgcgcgcaaa

SEQ ID NO: 130713 - DNA, 25 bp, Homo sapien
gtgacctcgccttggttggcactgc

SEQ ID NO: 130714 - DNA, 25 bp, Homo sapien
cgtttggccaccctttctgtcctgg

SEQ ID NO: 130715 - DNA, 25 bp, Homo sapien
tggcgcagccaccagcaatctgtgg

SEQ ID NO: 130716 - DNA, 25 bp, Homo sapien
tctcctcccgatcgtgaagcggcgg

SEQ ID NO: 130717 - DNA, 25 bp, Homo sapien
ccctgagaacccagcgaggggctga

SEQ ID NO: 130718 - DNA, 25 bp, Homo sapien
ggccgccttggtatatctgcgcgtg

SEQ ID NO: 130719 - DNA, 25 bp, Homo sapien
ttcgaaatggatatcagctgacgtt

SEQ ID NO: 130720 - DNA, 25 bp, Homo sapien
atatcagctgacgttggcctgcacg

SEQ ID NO: 130721 - DNA, 25 bp, Homo sapien
acgttggcctgcacgcgtttgcctt

SEQ ID NO: 130722 - DNA, 25 bp, Homo sapien
tgcgcctctctttcggctggctttc

SEQ ID NO: 130723 - DNA, 25 bp, Homo sapien
tcttgctcgcaagcaggtctggccc

SEQ ID NO: 130724 - DNA, 25 bp, Homo sapien
tcagctcctcttgctcgcaagcagg

SEQ ID NO: 130725 - DNA, 25 bp, Homo sapien
gtcacgaaagcccattcgaaatgga

SEQ ID NO: 130726 - DNA, 25 bp, Homo sapien
gtgcctgcttccgttggcactgaaa

SEQ ID NO: 130727 - DNA, 25 bp, Homo sapien
gggtgcctgcttccgttggcactga

SEQ ID NO: 130728 - DNA, 25 bp, Homo sapien
ggcactgaaagcaaacgcttgttga

SEQ ID NO: 130729 - DNA, 25 bp, Homo sapien
cgcttgttgagtcaggacctgcagc

SEQ ID NO: 130730 - DNA, 25 bp, Homo sapien
acgggtgcctgcttccgttggcact

SEQ ID NO: 130731 - DNA, 25 bp, Homo sapien
cgttggcactgaaagcaaacgcttg

SEQ ID NO: 130732 - DNA, 25 bp, Homo sapien
ttggcactgaaagcaaacgcttgtt

SEQ ID NO: 130733 - DNA, 25 bp, Homo sapien
gcttgttgcgtcaggacctgcagcc

SEQ ID NO: 130734 - DNA, 25 bp, Homo sapien
gcagctccgcctcgttcttcttgcg

SEQ ID NO: 130735 - DNA, 25 bp, Homo sapien
aggacatctggtcatggccttgccg

SEQ ID NO: 130736 - DNA, 25 bp, Homo sapien
tgggcggccccatgtcgcgggccag

SEQ ID NO: 130737 - DNA, 25 bp, Homo sapien
acatctggtcatggccttgccgctc

SEQ ID NO: 130738 - DNA, 25 bp, Homo sapien
gacatctggtcatggccttgccgct

SEQ ID NO: 130739 - DNA, 25 bp, Homo sapien
ggacatctggtcatggccttgccgc

SEQ ID NO: 130740 - DNA, 25 bp, Homo sapien
ctggaagcccgaggacatctggtca

SEQ ID NO: 130741 - DNA, 25 bp, Homo sapien
agcagctccgcctcgttcttcttgc

SEQ ID NO: 130742 - DNA, 25 bp, Homo sapien
ggcgggcagagaaactttcggcctc

SEQ ID NO: 130743 - DNA, 25 bp, Homo sapien
gcctcgggcgcacttgagacttttt

SEQ ID NO: 130744 - DNA, 25 bp, Homo sapien
agccacggacacagacagacaaaga

SEQ ID NO: 130745 - DNA, 25 bp, Homo sapien
tttttccagagctgctgagcgggcc

SEQ ID NO: 130746 - DNA, 25 bp, Homo sapien
agaccctgacagctccacgcggaga

SEQ ID NO: 130747 - DNA, 25 bp, Homo sapien
acaaagacaggaggacagacgcaca

SEQ ID NO: 130748 - DNA, 25 bp, Homo sapien
catcggtgctgggaatagacgaacc

SEQ ID NO: 130749 - DNA, 25 bp, Homo sapien
tccacgcggagacaaagacacctcg

SEQ ID NO: 130750 - DNA, 25 bp, Homo sapien
agttgggcttctccttgtcctcata

SEQ ID NO: 130751 - DNA, 25 bp, Homo sapien
gcggcactcaccgacacaggtggtc

SEQ ID NO: 130752 - DNA, 25 bp, Homo sapien
acacgccacgcaggtccaggcagtt

SEQ ID NO: 130753 - DNA, 25 bp, Homo sapien
aagagcatgcggtaggtgtactcgc

SEQ ID NO: 130754 - DNA, 25 bp, Homo sapien
gcacccggtcgaagaactggcgcag

SEQ ID NO: 130755 - DNA, 25 bp, Homo sapien
acgcctggtcttggcaggagcagaa

SEQ ID NO: 130756 - DNA, 25 bp, Homo sapien
gacacaggtggtcagtccggcacac

SEQ ID NO: 130757 - DNA, 25 bp, Homo sapien
aggtgtactcgctgggcacccggtc

SEQ ID NO: 130758 - DNA, 25 bp, Homo sapien
gcactgccgcagagtgcggtagcga

SEQ ID NO: 130759 - DNA, 25 bp, Homo sapien
tacagcgggctctcctgcaagacct

SEQ ID NO: 130760 - DNA, 25 bp, Homo sapien
cagcggcagtcgtacagcgggctct

SEQ ID NO: 130761 - DNA, 25 bp, Homo sapien
tggcactccttgttggccagcatgg

SEQ ID NO: 130762 - DNA, 25 bp, Homo sapien
attggcccggacacagtccactggg

SEQ ID NO: 130763 - DNA, 25 bp, Homo sapien
ctgcagttggattcggcggcacaca

SEQ ID NO: 130764 - DNA, 25 bp, Homo sapien
gcggcacacagctcattggcccgga

SEQ ID NO: 130765 - DNA, 25 bp, Homo sapien
gggctctcctgcaagacctccaagg

SEQ ID NO: 130766 - DNA, 25 bp, Homo sapien
cccttgcccgctacaatcaaatata

SEQ ID NO: 130767 - DNA, 25 bp, Homo sapien
gggctcgaacccactcaagcgtcgg

SEQ ID NO: 130768 - DNA, 25 bp, Homo sapien
ctgccttggccggaaactgactggc

SEQ ID NO: 130769 - DNA, 25 bp, Homo sapien
aatggaattccagtgaccgtgtgtc

SEQ ID NO: 130770 - DNA, 25 bp, Homo sapien
gctcggctcacttttttctaatgga

SEQ ID NO: 130771 - DNA, 25 bp, Homo sapien
tggagtcgcttctttcgcaccaaga

SEQ ID NO: 130772 - DNA, 25 bp, Homo sapien
cgcgtatctgtgtatcggctttcta

SEQ ID NO: 130773 - DNA, 25 bp, Homo sapien
gtcagcgcccaagaacaatccagtc

SEQ ID NO: 130774 - DNA, 25 bp, Homo sapien
agtccgaccctccatacagtgaggc

SEQ ID NO: 130775 - DNA, 25 bp, Homo sapien
tcacaccgacgaggcttctccgggc

SEQ ID NO: 130776 - DNA, 25 bp, Homo sapien
ggcagtcactgaggcggatgacctt

SEQ ID NO: 130777 - DNA, 25 bp, Homo sapien
cgggccaaggcgcagtccgaccctc

SEQ ID NO: 130778 - DNA, 25 bp, Homo sapien
tgaggcgccgaagcggcgccatttc

SEQ ID NO: 130779 - DNA, 25 bp, Homo sapien
gcgccatttctgtgccagaggcgtg

SEQ ID NO: 130780 - DNA, 25 bp, Homo sapien
ccgcgcgactcacggggaaggccag

SEQ ID NO: 130781 - DNA, 25 bp, Homo sapien
caggcagtcactgaggcggatgacc

SEQ ID NO: 130782 - DNA, 25 bp, Homo sapien
tccaaatcgtacagcccggagggcc

SEQ ID NO: 130783 - DNA, 25 bp, Homo sapien
catgaatggagcaaaatggcggatc

SEQ ID NO: 130784 - DNA, 25 bp, Homo sapien
ctgcagggacaggaacgggcatccc

SEQ ID NO: 130785 - DNA, 25 bp, Homo sapien
agcccacaacgttcgtcagtcactg

SEQ ID NO: 130786 - DNA, 25 bp, Homo sapien
cgccatccctcagcagataacaaaa

SEQ ID NO: 130787 - DNA, 25 bp, Homo sapien
ggaaacctcgcgctgataaacctcg

SEQ ID NO: 130788 - DNA, 25 bp, Homo sapien
gctgataaacctcgctctccggagt

SEQ ID NO: 130789 - DNA, 25 bp, Homo sapien
ggtgctgcgcattctccaaccacgg

SEQ ID NO: 130790 - DNA, 25 bp, Homo sapien
cactcagcccgggtgcaacgcaagt

SEQ ID NO: 130791 - DNA, 25 bp, Homo sapien
taaccgagttattccgatctggccc

SEQ ID NO: 130792 - DNA, 25 bp, Homo sapien
ttcaattcgctctgataaccgagtt

SEQ ID NO: 130793 - DNA, 25 bp, Homo sapien
cggcgctcgtgtgaagaagttaatt

SEQ ID NO: 130794 - DNA, 25 bp, Homo sapien
atccggaccagaccttcggtctcta

SEQ ID NO: 130795 - DNA, 25 bp, Homo sapien
tgaggtaggagtagtccatcggccc

SEQ ID NO: 130796 - DNA, 25 bp, Homo sapien
ccgccacgcacgagtcgtacgaatt

SEQ ID NO: 130797 - DNA, 25 bp, Homo sapien
tctctacacagcgtccgaggccaga

SEQ ID NO: 130798 - DNA, 25 bp, Homo sapien
cgctggaagagcgaggtcttaattg

SEQ ID NO: 130799 - DNA, 25 bp, Homo sapien
cgcacatgggatgccctagggttcg

SEQ ID NO: 130800 - DNA, 25 bp, Homo sapien
ccctgctccgaagaacgcggtggct

SEQ ID NO: 130801 - DNA, 25 bp, Homo sapien
gcaggcagccgcagtgctaatcagc

SEQ ID NO: 130802 - DNA, 25 bp, Homo sapien
gagttcacacgcaccgtggcttgca

SEQ ID NO: 130803 - DNA, 25 bp, Homo sapien
cttaattgctttgcgggagcgttcc

SEQ ID NO: 130804 - DNA, 25 bp, Homo sapien
cactcaggtgtccacggcctctgtt

SEQ ID NO: 130805 - DNA, 25 bp, Homo sapien
tgcctggcagaggttcgagttcaca

SEQ ID NO: 130806 - DNA, 25 bp, Homo sapien
ctcgtcctccaggagttgccggtga

SEQ ID NO: 130807 - DNA, 25 bp, Homo sapien
cacagaggcttttgagtcaggccca

SEQ ID NO: 130808 - DNA, 25 bp, Homo sapien
gcctttcaagcctgagctcggtgga

SEQ ID NO: 130809 - DNA, 25 bp, Homo sapien
gtggacagctccctctcccgtgagt

SEQ ID NO: 130810 - DNA, 25 bp, Homo sapien
catgaatctcagtagcgccagtagc

SEQ ID NO: 130811 - DNA, 25 bp, Homo sapien
tctctgcccggagccatgaatctca

SEQ ID NO: 130812 - DNA, 25 bp, Homo sapien
ctctggcatcctccagtcgagggtc

SEQ ID NO: 130813 - DNA, 25 bp, Homo sapien
aaaaggcagtgacgaccgtgctctg

SEQ ID NO: 130814 - DNA, 25 bp, Homo sapien
agaagcagttcgagtttgtgggctc

SEQ ID NO: 130815 - DNA, 25 bp, Homo sapien
agcgcgaggcccacttcatcaagcg

SEQ ID NO: 130816 - DNA, 25 bp, Homo sapien
tggttcatggccttcacgcggcagg

SEQ ID NO: 130817 - DNA, 25 bp, Homo sapien
acgcccggcacgagggctggttcat

SEQ ID NO: 130818 - DNA, 25 bp, Homo sapien
gagaacaactatacggccttccaga

SEQ ID NO: 130819 - DNA, 25 bp, Homo sapien
cacggagatcgtgctggagaacaac

SEQ ID NO: 130820 - DNA, 25 bp, Homo sapien
cagcccagcgggaagagcaaagact

SEQ ID NO: 130821 - DNA, 25 bp, Homo sapien
agagcaaagactgcgtgttcacgga

SEQ ID NO: 130822 - DNA, 25 bp, Homo sapien
cacactctggattctgcgagcgcgt

SEQ ID NO: 130823 - DNA, 25 bp, Homo sapien
ccctacactctggattctgcgagcg

SEQ ID NO: 130824 - DNA, 25 bp, Homo sapien
tctacacggtacatgcctgcacgtc

SEQ ID NO: 130825 - DNA, 25 bp, Homo sapien
ctacactctggattctgcgagcgcg

SEQ ID NO: 130826 - DNA, 25 bp, Homo sapien
actctggattctgcgagcgcgtcca

SEQ ID NO: 130827 - DNA, 25 bp, Homo sapien
acactctggattctgcgagcgcgtc

SEQ ID NO: 130828 - DNA, 25 bp, Homo sapien
cgcgtctacacggtacatgcctgca

SEQ ID NO: 130829 - DNA, 25 bp, Homo sapien
ccacactctggattctgcgagcgcg

SEQ ID NO: 130830 - DNA, 25 bp, Homo sapien
tgttatttgtgctccggggaagcgc

SEQ ID NO: 130831 - DNA, 25 bp, Homo sapien
tttcctgttatttgtgctccgggga

SEQ ID NO: 130832 - DNA, 25 bp, Homo sapien
cctaagccggcatttttcctgttat

SEQ ID NO: 130833 - DNA, 25 bp, Homo sapien
agaggggagatcagaccgctcagcc

SEQ ID NO: 130834 - DNA, 25 bp, Homo sapien
gccgtgcgttgcagagaagcagggt

SEQ ID NO: 130835 - DNA, 25 bp, Homo sapien
atccaggcggccgtgcgttgcagag

SEQ ID NO: 130836 - DNA, 25 bp, Homo sapien
aggggagatcagaccgctcagccga

SEQ ID NO: 130837 - DNA, 25 bp, Homo sapien
tcctgttatttgtgctccggggaag

SEQ ID NO: 130838 - DNA, 25 bp, Homo sapien
gccagagaacaatggctcaaaaaca

SEQ ID NO: 130839 - DNA, 25 bp, Homo sapien
tgccgtcatttcctttgaagccaga

SEQ ID NO: 130840 - DNA, 25 bp, Homo sapien
ggctcaaaaacaagcgcagcccgtc

SEQ ID NO: 130841 - DNA, 25 bp, Homo sapien
aaaacaagcgcagcccgtccttcgg

SEQ ID NO: 130842 - DNA, 25 bp, Homo sapien
ggaacgcgccagctgctttcgcggc

SEQ ID NO: 130843 - DNA, 25 bp, Homo sapien
cgcgccgagcctgacacgctgtcct

SEQ ID NO: 130844 - DNA, 25 bp, Homo sapien
tgcatggaacggctgcagaaggtgc

SEQ ID NO: 130845 - DNA, 25 bp, Homo sapien
agcggatgggaagcctcagccgcaa

SEQ ID NO: 130846 - DNA, 25 bp, Homo sapien
cgggcgccatcatgctgagccggct

SEQ ID NO: 130847 - DNA, 25 bp, Homo sapien
ccatcatgctgagccggctcggggc

SEQ ID NO: 130848 - DNA, 25 bp, Homo sapien
tgcctcctccgcctagagcgctgcc

SEQ ID NO: 130849 - DNA, 25 bp, Homo sapien
gggcgccatcatgctgagccggctc

SEQ ID NO: 130850 - DNA, 25 bp, Homo sapien
ggcgccatcatgctgagccggctcg

SEQ ID NO: 130851 - DNA, 25 bp, Homo sapien
gcgccatcatgctgagccggctcgg

SEQ ID NO: 130852 - DNA, 25 bp, Homo sapien
cgccatcatgctgagccggctcggg

SEQ ID NO: 130853 - DNA, 25 bp, Homo sapien
cccagccggggttagccagcgccac

SEQ ID NO: 130854 - DNA, 25 bp, Homo sapien
cggagtctctcccaattcccgaact

SEQ ID NO: 130855 - DNA, 25 bp, Homo sapien
ccgggacgctccctgtcaccgcttg

SEQ ID NO: 130856 - DNA, 25 bp, Homo sapien
tcaccgcttggggtgtttcctgccc

SEQ ID NO: 130857 - DNA, 25 bp, Homo sapien
cctcgcctgggcttgaaaaaatcgc

SEQ ID NO: 130858 - DNA, 25 bp, Homo sapien
gcctgggcttgaaaaaatcgccgtc

SEQ ID NO: 130859 - DNA, 25 bp, Homo sapien
gtctgatctcccagacaactccagg

SEQ ID NO: 130860 - DNA, 25 bp, Homo sapien
tcccagacaactccaggaccttgtt

SEQ ID NO: 130861 - DNA, 25 bp, Homo sapien
aactccaggaccttgttggggtgca

SEQ ID NO: 130862 - DNA, 25 bp, Homo sapien
ggacgaacgcaggacacagatgcga

SEQ ID NO: 130863 - DNA, 25 bp, Homo sapien
ctttgcaaaactgggaagcgccacg

SEQ ID NO: 130864 - DNA, 25 bp, Homo sapien
tcacctgctcgctgaggaacacggc

SEQ ID NO: 130865 - DNA, 25 bp, Homo sapien
gccggatcctcgcagaccgactgag

SEQ ID NO: 130866 - DNA, 25 bp, Homo sapien
gagctcacgagaacgcggaagcgca

SEQ ID NO: 130867 - DNA, 25 bp, Homo sapien
cgacggtgacgtcatctttcctgca

SEQ ID NO: 130868 - DNA, 25 bp, Homo sapien
cgcgacaatccggtgacgtcacgga

SEQ ID NO: 130869 - DNA, 25 bp, Homo sapien
tggaaccactgtcccgctgttgccg

SEQ ID NO: 130870 - DNA, 25 bp, Homo sapien
cacggggagaatgagccctttgttc

SEQ ID NO: 130871 - DNA, 25 bp, Homo sapien
ccctgcgggaaacaggagcccgtga

SEQ ID NO: 130872 - DNA, 25 bp, Homo sapien
cgtcgggcttcctaactttcaggtg

SEQ ID NO: 130873 - DNA, 25 bp, Homo sapien
ttcaggtgtcagaatgtgtggccca

SEQ ID NO: 130874 - DNA, 25 bp, Homo sapien
tcgccagaagcgcaactgagagtgg

SEQ ID NO: 130875 - DNA, 25 bp, Homo sapien
gcaccgcaggctcggctcagaaatc

SEQ ID NO: 130876 - DNA, 25 bp, Homo sapien
actccgggatctgcaggatgcggca

SEQ ID NO: 130877 - DNA, 25 bp, Homo sapien
aggacctctgatcgccatcgccaga

SEQ ID NO: 130878 - DNA, 25 bp, Homo sapien
cccagcccgaggatctgggacagtg

SEQ ID NO: 130879 - DNA, 25 bp, Homo sapien
tttcggcttcatttcaccggctgca

SEQ ID NO: 130880 - DNA, 25 bp, Homo sapien
cctagtattttgcattgcagccctc

SEQ ID NO: 130881 - DNA, 25 bp, Homo sapien
ccctatcggggactccaggcgaagg

SEQ ID NO: 130882 - DNA, 25 bp, Homo sapien
tccgaggaaatgaacaaatgatccc

SEQ ID NO: 130883 - DNA, 25 bp, Homo sapien
ccctgtgagaatccgaggaaatgaa

SEQ ID NO: 130884 - DNA, 25 bp, Homo sapien
tctgggacagtggattgtaaacttg

SEQ ID NO: 130885 - DNA, 25 bp, Homo sapien
ttgcagccctcttcgtagttccgcg

SEQ ID NO: 130886 - DNA, 25 bp, Homo sapien
gtcctgtcctgggagtgtttcttcg

SEQ ID NO: 130887 - DNA, 25 bp, Homo sapien
cccagtagtcacattccggccggaa

SEQ ID NO: 130888 - DNA, 25 bp, Homo sapien
aacagggtggagttgcgcactacct

SEQ ID NO: 130889 - DNA, 25 bp, Homo sapien
ggcgcgttcgaagacgccgcgaaca

SEQ ID NO: 130890 - DNA, 25 bp, Homo sapien
gtgctgaccacgtccaacatggctg

SEQ ID NO: 130891 - DNA, 25 bp, Homo sapien
cagcatcttgacagctgcttcgata

SEQ ID NO: 130892 - DNA, 25 bp, Homo sapien
cagccgcgaggcatttggtatcgaa

SEQ ID NO: 130893 - DNA, 25 bp, Homo sapien
atttggtatcgaagcgtcctccctg

SEQ ID NO: 130894 - DNA, 25 bp, Homo sapien
acggcctccgactgtgcagttcagg

SEQ ID NO: 130895 - DNA, 25 bp, Homo sapien
cctacagggcggagttcgcaactca

SEQ ID NO: 130896 - DNA, 25 bp, Homo sapien
ggacaccatcttgccggcctttggg

SEQ ID NO: 130897 - DNA, 25 bp, Homo sapien
tccacgcatctgtttgcagtgtgtg

SEQ ID NO: 130898 - DNA, 25 bp, Homo sapien
ggtccgttaacccttgcatggagtg

SEQ ID NO: 130899 - DNA, 25 bp, Homo sapien
tctgagggcggccatactcacacca

SEQ ID NO: 130900 - DNA, 25 bp, Homo sapien
agaaagttcctcctcccactagacg

SEQ ID NO: 130901 - DNA, 25 bp, Homo sapien
agccgctcagaaggacgttcactca

SEQ ID NO: 130902 - DNA, 25 bp, Homo sapien
cgctcccgcgatccggctcgggaga

SEQ ID NO: 130903 - DNA, 25 bp, Homo sapien
tgcactcactgccttgtggaggcgc

SEQ ID NO: 130904 - DNA, 25 bp, Homo sapien
gggcacatgcactcactgccttgtg

SEQ ID NO: 130905 - DNA, 25 bp, Homo sapien
tctgcacgggcacatgcactcactg

SEQ ID NO: 130906 - DNA, 25 bp, Homo sapien
acctgtctctgcacgggcacatgca

SEQ ID NO: 130907 - DNA, 25 bp, Homo sapien
gcctctgctgggcacgactgtgcgc

SEQ ID NO: 130908 - DNA, 25 bp, Homo sapien
gagtgcatgcgtgtgagcttgtgct

SEQ ID NO: 130909 - DNA, 25 bp, Homo sapien
ctgtgtgctctaccgggcggtctct

SEQ ID NO: 130910 - DNA, 25 bp, Homo sapien
gttcgtgagaacatccagccaggta

SEQ ID NO: 130911 - DNA, 25 bp, Homo sapien
ggcttctggcacgaacacactcggc

SEQ ID NO: 130912 - DNA, 25 bp, Homo sapien
acgtcgtcggcttctggcacgaaca

SEQ ID NO: 130913 - DNA, 25 bp, Homo sapien
cgccacgtttccatcgttcgtgaga

SEQ ID NO: 130914 - DNA, 25 bp, Homo sapien
cattgtggtccacgagctgggccac

SEQ ID NO: 130915 - DNA, 25 bp, Homo sapien
ctgtgacaagttcggcattgtggtc

SEQ ID NO: 130916 - DNA, 25 bp, Homo sapien
tccatcggcaagaactgtgacaagt

SEQ ID NO: 130917 - DNA, 25 bp, Homo sapien
aggccatctccatcggcaagaactg

SEQ ID NO: 130918 - DNA, 25 bp, Homo sapien
aggccgtgtacatgcagtagaagtc

SEQ ID NO: 130919 - DNA, 25 bp, Homo sapien
tagtggtaggccgtgtacatgcagt

SEQ ID NO: 130920 - DNA, 25 bp, Homo sapien
acatgcagtagaagtccgcaaagta

SEQ ID NO: 130921 - DNA, 25 bp, Homo sapien
agtccgcaaagtagaggttggtgct

SEQ ID NO: 130922 - DNA, 25 bp, Homo sapien
cccgtgttgaactccgtgttgcagc

SEQ ID NO: 130923 - DNA, 25 bp, Homo sapien
ctccgtgttgcagctgaagaagacc

SEQ ID NO: 130924 - DNA, 25 bp, Homo sapien
gctggcccgtgttgaactccgtgtt

SEQ ID NO: 130925 - DNA, 25 bp, Homo sapien
ccagcaccaggatggcgtagtggta

SEQ ID NO: 130926 - DNA, 25 bp, Homo sapien
tttgttgggtcggatctctgcatcg

SEQ ID NO: 130927 - DNA, 25 bp, Homo sapien
cggcacctctccctgcggaggcctc

SEQ ID NO: 130928 - DNA, 25 bp, Homo sapien
cccgtggtgtcgtcacttctcggct

SEQ ID NO: 130929 - DNA, 25 bp, Homo sapien
tgtcgtcacttctcggctgctcacg

SEQ ID NO: 130930 - DNA, 25 bp, Homo sapien
gctgctcacgctgcgacgttgtttt

SEQ ID NO: 130931 - DNA, 25 bp, Homo sapien
ctcacgctgcgacgttgttttgttg

SEQ ID NO: 130932 - DNA, 25 bp, Homo sapien
cgctgcgacgttgttttgttgggtc

SEQ ID NO: 130933 - DNA, 25 bp, Homo sapien
cgttgttttgttgggtcggatctct

SEQ ID NO: 130934 - DNA, 25 bp, Homo sapien
tgagacgatgttcccagctgagcag

SEQ ID NO: 130935 - DNA, 25 bp, Homo sapien
caccaatgggatcagcggctgcgca

SEQ ID NO: 130936 - DNA, 25 bp, Homo sapien
gaatctgcctccaccaatgggatca

SEQ ID NO: 130937 - DNA, 25 bp, Homo sapien
gagagccagaccgaatctgcctcca

SEQ ID NO: 130938 - DNA, 25 bp, Homo sapien
aagaagagaggcaagagcgaaatca

SEQ ID NO: 130939 - DNA, 25 bp, Homo sapien
ccctggtgagacgatgttcccagct

SEQ ID NO: 130940 - DNA, 25 bp, Homo sapien
tcctgtctggctgtgcagcgcgtcg

SEQ ID NO: 130941 - DNA, 25 bp, Homo sapien
agagcgaaatcaaagcagcgtggag

SEQ ID NO: 130942 - DNA, 25 bp, Homo sapien
tccgccgaggcgaatcctcacattg

SEQ ID NO: 130943 - DNA, 25 bp, Homo sapien
ttctctcccaggcaacatgtcggaa

SEQ ID NO: 130944 - DNA, 25 bp, Homo sapien
gaagcgccgcctgataaatactgtg

SEQ ID NO: 130945 - DNA, 25 bp, Homo sapien
agtcaagaaggtacccaacggcgcg

SEQ ID NO: 130946 - DNA, 25 bp, Homo sapien
gccaaaggctctcacctgggtggtc

SEQ ID NO: 130947 - DNA, 25 bp, Homo sapien
cagcatagcgtagcccagaccagtc

SEQ ID NO: 130948 - DNA, 25 bp, Homo sapien
tcaccatggagaacccgcagacagg

SEQ ID NO: 130949 - DNA, 25 bp, Homo sapien
tcgctgcccggaggtaatgaccact

SEQ ID NO: 130950 - DNA, 25 bp, Homo sapien
cctcgaagagcggaaattggccctg

SEQ ID NO: 130951 - DNA, 25 bp, Homo sapien
aattggccctggagcatgtgggccc

SEQ ID NO: 130952 - DNA, 25 bp, Homo sapien
gaggcccaagtggacgtcttatttg

SEQ ID NO: 130953 - DNA, 25 bp, Homo sapien
gaagtcgttattcgaggcccggcgc

SEQ ID NO: 130954 - DNA, 25 bp, Homo sapien
cagcgcggagcacgcacccagggat

SEQ ID NO: 130955 - DNA, 25 bp, Homo sapien
ttggcctgagagaggagatagaacc

SEQ ID NO: 130956 - DNA, 25 bp, Homo sapien
gccttgcttctggttaggcccgagt

SEQ ID NO: 130957 - DNA, 25 bp, Homo sapien
ttgggtttttgctcaagcacgtggg

SEQ ID NO: 130958 - DNA, 25 bp, Homo sapien
gtgtctacgcggacgcaccggctaa

SEQ ID NO: 130959 - DNA, 25 bp, Homo sapien
acgcgccgggtatatagccgggcat

SEQ ID NO: 130960 - DNA, 25 bp, Homo sapien
tcctcgggagtcacggccggatgaa

SEQ ID NO: 130961 - DNA, 25 bp, Homo sapien
gacgcaccggctaagctgcttctgc

SEQ ID NO: 130962 - DNA, 25 bp, Homo sapien
atgctagagccgcagaagggtgccc

SEQ ID NO: 130963 - DNA, 25 bp, Homo sapien
agcaggtcttcacgggaggtttccg

SEQ ID NO: 130964 - DNA, 25 bp, Homo sapien
ctagagccgcagaagggtgcccaga

SEQ ID NO: 130965 - DNA, 25 bp, Homo sapien
tccggccgctgacgcgccgggtata

SEQ ID NO: 130966 - DNA, 25 bp, Homo sapien
cacactccttgagacaaagcgggtg

SEQ ID NO: 130967 - DNA, 25 bp, Homo sapien
acggctccgggcagctaaggctgcc

SEQ ID NO: 130968 - DNA, 25 bp, Homo sapien
tggccgcgcccttctggtgctcgga

SEQ ID NO: 130969 - DNA, 25 bp, Homo sapien
ccctcgtcctgtcagtggcgtcgga

SEQ ID NO: 130970 - DNA, 25 bp, Homo sapien
gccgagctctactgcctcgcgggaa

SEQ ID NO: 130971 - DNA, 25 bp, Homo sapien
aagaagcgaaaatgggcggttagca

SEQ ID NO: 130972 - DNA, 25 bp, Homo sapien
cacgcgggcgggtttcagatgttcc

SEQ ID NO: 130973 - DNA, 25 bp, Homo sapien
ccgaccgcgtcatcaaaggtgcctg

SEQ ID NO: 130974 - DNA, 25 bp, Homo sapien
gtcgaacttgctgaaccatggccca

SEQ ID NO: 130975 - DNA, 25 bp, Homo sapien
ggccacaccgatgacctctggggaa

SEQ ID NO: 130976 - DNA, 25 bp, Homo sapien
gccacagaggggactgttaaacctc

SEQ ID NO: 130977 - DNA, 25 bp, Homo sapien
tcgcagtttccgcaggttacgtacg

SEQ ID NO: 130978 - DNA, 25 bp, Homo sapien
ttacgtacgtcccaggcatggaacc

SEQ ID NO: 130979 - DNA, 25 bp, Homo sapien
ccatggcccattgatcttgttcacc

SEQ ID NO: 130980 - DNA, 25 bp, Homo sapien
cggatctcatagctctgccggagca

SEQ ID NO: 130981 - DNA, 25 bp, Homo sapien
cgcaccctggttctcgttcttgatg

SEQ ID NO: 130982 - DNA, 25 bp, Homo sapien
gctcgcttcccacactctggaaatg

SEQ ID NO: 130983 - DNA, 25 bp, Homo sapien
tccctgtgcttgcacgtgtgtgagc

SEQ ID NO: 130984 - DNA, 25 bp, Homo sapien
tacgcgcgcgtgtttgtttgcacac

SEQ ID NO: 130985 - DNA, 25 bp, Homo sapien
ccacgtttgcagtgtacgcgcgcgt

SEQ ID NO: 130986 - DNA, 25 bp, Homo sapien
actctggaaatgtcgctggaaactc

SEQ ID NO: 130987 - DNA, 25 bp, Homo sapien
ctggaaactctgagtggcccgtgtc

SEQ ID NO: 130988 - DNA, 25 bp, Homo sapien
gacggacggagagcactcgcacgtc

SEQ ID NO: 130989 - DNA, 25 bp, Homo sapien
ggctgatttcctccctgtgcttgca

SEQ ID NO: 130990 - DNA, 25 bp, Homo sapien
ccgaggagcctttctaagcggactc

SEQ ID NO: 130991 - DNA, 25 bp, Homo sapien
gccaccgagggcagctaactcctag

SEQ ID NO: 130992 - DNA, 25 bp, Homo sapien
gcgggctcgctcctccataaataaa

SEQ ID NO: 130993 - DNA, 25 bp, Homo sapien
tgcgggcaattgagacccgactgcc

SEQ ID NO: 130994 - DNA, 25 bp, Homo sapien
ccttgcttttcacagtcgatctttg

SEQ ID NO: 130995 - DNA, 25 bp, Homo sapien
acagggcgtcgactttcgcaagtga

SEQ ID NO: 130996 - DNA, 25 bp, Homo sapien
taactcctagcagaggaccggggtc

SEQ ID NO: 130997 - DNA, 25 bp, Homo sapien
cgagccgcgaacttttccggaggcg

SEQ ID NO: 130998 - DNA, 25 bp, Homo sapien
tccctggagcctcgcatcagcgggg

SEQ ID NO: 130999 - DNA, 25 bp, Homo sapien
cggagtccactgaccggctcaaagg

SEQ ID NO: 131000 - DNA, 25 bp, Homo sapien
ctccagaactggtagagccgggcca

SEQ ID NO: 131001 - DNA, 25 bp, Homo sapien
gcagggtactttgccctcggagcga

SEQ ID NO: 131002 - DNA, 25 bp, Homo sapien
accggctggacggtcgcagcctgca

SEQ ID NO: 131003 - DNA, 25 bp, Homo sapien
accggctctgctgtgctccgggcag

SEQ ID NO: 131004 - DNA, 25 bp, Homo sapien
ccctcgatcgtctgcgaagtggggc

SEQ ID NO: 131005 - DNA, 25 bp, Homo sapien
tgccctcggagcgaaggaggctcca

SEQ ID NO: 131006 - DNA, 25 bp, Homo sapien
cgcgcgttctgcagttgtaaaagat

SEQ ID NO: 131007 - DNA, 25 bp, Homo sapien
agtccgtgccttcgacctcgttctt

SEQ ID NO: 131008 - DNA, 25 bp, Homo sapien
gggacccttattttggccacagcca

SEQ ID NO: 131009 - DNA, 25 bp, Homo sapien
gcagaacagctgatcgggaccctta

SEQ ID NO: 131010 - DNA, 25 bp, Homo sapien
aagacggacgctgcgtgtgaacccg

SEQ ID NO: 131011 - DNA, 25 bp, Homo sapien
cagcacgtggggctcccatttcctt

SEQ ID NO: 131012 - DNA, 25 bp, Homo sapien
aaagatttcccggtgggcaggatcg

SEQ ID NO: 131013 - DNA, 25 bp, Homo sapien
ccaggtttccgagcggccaagagac

SEQ ID NO: 131014 - DNA, 25 bp, Homo sapien
ttgggcccaggcgttaaaccagcca

SEQ ID NO: 131015 - DNA, 25 bp, Homo sapien
ccttcccgctccttctgaggatgtg

SEQ ID NO: 131016 - DNA, 25 bp, Homo sapien
cttctgaggatgtgggaatccgccc

SEQ ID NO: 131017 - DNA, 25 bp, Homo sapien
gtcatcaggggacgccatgcaggct

SEQ ID NO: 131018 - DNA, 25 bp, Homo sapien
cgctccttctgaggatgtgggaatc

SEQ ID NO: 131019 - DNA, 25 bp, Homo sapien
ctgggttggcattcggctcccgcgt

SEQ ID NO: 131020 - DNA, 25 bp, Homo sapien
ctagcctgtttcccgtaccgttcat

SEQ ID NO: 131021 - DNA, 25 bp, Homo sapien
gtaccgttcattccgccaggacgcc

SEQ ID NO: 131022 - DNA, 25 bp, Homo sapien
catcctgagtttcgggtgagccaga

SEQ ID NO: 131023 - DNA, 25 bp, Homo sapien
cgcccggtaagaagccgaggagtca

SEQ ID NO: 131024 - DNA, 25 bp, Homo sapien
agcgcgaagggctgcgtctcactcc

SEQ ID NO: 131025 - DNA, 25 bp, Homo sapien
aagggctgcgtctcactcccaagac

SEQ ID NO: 131026 - DNA, 25 bp, Homo sapien
cctgcatcttctgttccctctgccg

SEQ ID NO: 131027 - DNA, 25 bp, Homo sapien
ctgcatcctgagtttcgggtgagcc

SEQ ID NO: 131028 - DNA, 25 bp, Homo sapien
ttcgggtgagccagaagcgagcacc

SEQ ID NO: 131029 - DNA, 25 bp, Homo sapien
cctgagtttcgggtgagccagaagc

SEQ ID NO: 131030 - DNA, 25 bp, Homo sapien
aggacactaccgaggcgcgacttcc

SEQ ID NO: 131031 - DNA, 25 bp, Homo sapien
aaggaatgtcatcggggctctctcg

SEQ ID NO: 131032 - DNA, 25 bp, Homo sapien
ggagagggcccacacagtctcctcg

SEQ ID NO: 131033 - DNA, 25 bp, Homo sapien
ccaccagccggtcgaggaaacaacg

SEQ ID NO: 131034 - DNA, 25 bp, Homo sapien
tctttggactgcaagtcccgtctcc

SEQ ID NO: 131035 - DNA, 25 bp, Homo sapien
tccgaccagtggtcgcgcttccgga

SEQ ID NO: 131036 - DNA, 25 bp, Homo sapien
accatatccgggagagcggcagctt

SEQ ID NO: 131037 - DNA, 25 bp, Homo sapien
atccgatccgggaaggcgcacttcc

SEQ ID NO: 131038 - DNA, 25 bp, Homo sapien
ccacaactcgtttctctagggtcac

SEQ ID NO: 131039 - DNA, 25 bp, Homo sapien
ccaggaagtgacgtaagcccgcctc

SEQ ID NO: 131040 - DNA, 25 bp, Homo sapien
ggcgcgttaacccttctgctgctgc

SEQ ID NO: 131041 - DNA, 25 bp, Homo sapien
tctagggtcacttccggattcaacc

SEQ ID NO: 131042 - DNA, 25 bp, Homo sapien
ggattcaaccagtctccaggaagtg

SEQ ID NO: 131043 - DNA, 25 bp, Homo sapien
gctcatggtcccgaacctgcgtctg

SEQ ID NO: 131044 - DNA, 25 bp, Homo sapien
gtcctgctgagagactgcgactccg

SEQ ID NO: 131045 - DNA, 25 bp, Homo sapien
cgcgagtccggcaaaacgggtcaga

SEQ ID NO: 131046 - DNA, 25 bp, Homo sapien
gccaagccgggaagagccatacaag

SEQ ID NO: 131047 - DNA, 25 bp, Homo sapien
gaactcccgagctgcacgttgtggt

SEQ ID NO: 131048 - DNA, 25 bp, Homo sapien
tcctatactagggagccacagcgcc

SEQ ID NO: 131049 - DNA, 25 bp, Homo sapien
cccgaaggctgcagtgcccatgtct

SEQ ID NO: 131050 - DNA, 25 bp, Homo sapien
gccatacaaggagcggatccggtga

SEQ ID NO: 131051 - DNA, 25 bp, Homo sapien
tccttctcgatttggctgcagattc

SEQ ID NO: 131052 - DNA, 25 bp, Homo sapien
ctgcagattccggtcccaagatttg

SEQ ID NO: 131053 - DNA, 25 bp, Homo sapien
ttaaaggaaccgcacaggctgtagc

SEQ ID NO: 131054 - DNA, 25 bp, Homo sapien
gatctgcttgtctttgaatgccttg

SEQ ID NO: 131055 - DNA, 25 bp, Homo sapien
ctccgcatgcagatccggcactgga

SEQ ID NO: 131056 - DNA, 25 bp, Homo sapien
ctcgcccgtatgagtgcggatgtga

SEQ ID NO: 131057 - DNA, 25 bp, Homo sapien
cgcagaactcgcaggcaaagggctt

SEQ ID NO: 131058 - DNA, 25 bp, Homo sapien
tggctttcccgctgctttcaggcta

SEQ ID NO: 131059 - DNA, 25 bp, Homo sapien
caaagcgggctagacgccacctttc

SEQ ID NO: 131060 - DNA, 25 bp, Homo sapien
cttgatggtctccagaggggtaata

SEQ ID NO: 131061 - DNA, 25 bp, Homo sapien
ctctgcgctttggtgcgctccttac

SEQ ID NO: 131062 - DNA, 25 bp, Homo sapien
ggacgcggcctcagtattgatctca

SEQ ID NO: 131063 - DNA, 25 bp, Homo sapien
ccaggagaggggatcttctcttttt

SEQ ID NO: 131064 - DNA, 25 bp, Homo sapien
gaagcctctaccgtggcgtcgccaa

SEQ ID NO: 131065 - DNA, 25 bp, Homo sapien
gccaacctagccttctcgatcgagg

SEQ ID NO: 131066 - DNA, 25 bp, Homo sapien
gcccttacctgtagccatctgattg

SEQ ID NO: 131067 - DNA, 25 bp, Homo sapien
tctgattgtaatggactaccgagtc

SEQ ID NO: 131068 - DNA, 25 bp, Homo sapien
ctcctcggggtacagattgtcaggc

SEQ ID NO: 131069 - DNA, 25 bp, Homo sapien
agtttgccggtcatagcactcccga

SEQ ID NO: 131070 - DNA, 25 bp, Homo sapien
atactcactgtgactcaccggctgc

SEQ ID NO: 131071 - DNA, 25 bp, Homo sapien
ctgctccgagatgcctcccggtttt

SEQ ID NO: 131072 - DNA, 25 bp, Homo sapien
ctcccggttttctcatcgcagtctg

SEQ ID NO: 131073 - DNA, 25 bp, Homo sapien
atcgcagtctggctgctctgagccc

SEQ ID NO: 131074 - DNA, 25 bp, Homo sapien
gggtgattaccctgccgtcattaaa

SEQ ID NO: 131075 - DNA, 25 bp, Homo sapien
tgccgtcattaaaagccggtaaata

SEQ ID NO: 131076 - DNA, 25 bp, Homo sapien
gccggtaaatagcacccagggacga

SEQ ID NO: 131077 - DNA, 25 bp, Homo sapien
gcccagcgctgcatactcactgtga

SEQ ID NO: 131078 - DNA, 25 bp, Homo sapien
cccgccctcgtgacctgtccaggcc

SEQ ID NO: 131079 - DNA, 25 bp, Homo sapien
aggccgagcggttagcgcgccgctc

SEQ ID NO: 131080 - DNA, 25 bp, Homo sapien
cacagttggaggatcttgcggtcgc

SEQ ID NO: 131081 - DNA, 25 bp, Homo sapien
cctccgcagggcgaccagggtctgg

SEQ ID NO: 131082 - DNA, 25 bp, Homo sapien
cgggccctcaccgcacagttggagg

SEQ ID NO: 131083 - DNA, 25 bp, Homo sapien
cgcacagttggaggatcttgcggtc

SEQ ID NO: 131084 - DNA, 25 bp, Homo sapien
gcgcttgctgcagcgggattcctgc

SEQ ID NO: 131085 - DNA, 25 bp, Homo sapien
aagctcgctgcgcttgctgcagcgg

SEQ ID NO: 131086 - DNA, 25 bp, Homo sapien
atgccatttctgaaacagcctgggg

SEQ ID NO: 131087 - DNA, 25 bp, Homo sapien
gaggcccacgttctcctgtgactca

SEQ ID NO: 131088 - DNA, 25 bp, Homo sapien
ctcaggtctgactcaatgccatttc

SEQ ID NO: 131089 - DNA, 25 bp, Homo sapien
aaacaactccttgctcagggcagcc

SEQ ID NO: 131090 - DNA, 25 bp, Homo sapien
tcctgctcagaaaagcctcggatgc

SEQ ID NO: 131091 - DNA, 25 bp, Homo sapien
aggcaaaggaagactccgttccagc

SEQ ID NO: 131092 - DNA, 25 bp, Homo sapien
cgggctcgaactcccgacaagactg

SEQ ID NO: 131093 - DNA, 25 bp, Homo sapien
cgacaagactgagcgcagggcccac

SEQ ID NO: 131094 - DNA, 25 bp, Homo sapien
gagcctttgcgcctcgccaggtgga

SEQ ID NO: 131095 - DNA, 25 bp, Homo sapien
cccgtcacatgtagtggtgtaagta

SEQ ID NO: 131096 - DNA, 25 bp, Homo sapien
cgtcgtcccaacttgcaggcgcgga

SEQ ID NO: 131097 - DNA, 25 bp, Homo sapien
cgtgctcagcaggaagagatgtgtt

SEQ ID NO: 131098 - DNA, 25 bp, Homo sapien
ggctgtcgtcttgggtgcgattttt

SEQ ID NO: 131099 - DNA, 25 bp, Homo sapien
tttcactaaaatgagcgtgctcagc

SEQ ID NO: 131100 - DNA, 25 bp, Homo sapien
tttccaccaactgcgcgcggcagtg

SEQ ID NO: 131101 - DNA, 25 bp, Homo sapien
gagatgtgttcctcacgctagaagc

SEQ ID NO: 131102 - DNA, 25 bp, Homo sapien
gctgcactcatctcccgccgccacc

SEQ ID NO: 131103 - DNA, 25 bp, Homo sapien
cccgatcatcgtggtgcccgaccct

SEQ ID NO: 131104 - DNA, 25 bp, Homo sapien
aggacccgctctgcgcggacgtcat

SEQ ID NO: 131105 - DNA, 25 bp, Homo sapien
catcaaggacgtctttgacaacgcc

SEQ ID NO: 131106 - DNA, 25 bp, Homo sapien
tccgcaatgtgcagcggcctctgct

SEQ ID NO: 131107 - DNA, 25 bp, Homo sapien
cgtggtggcccagttcggcatcaag

SEQ ID NO: 131108 - DNA, 25 bp, Homo sapien
ttcggcatcaaggacgtctttgaca

SEQ ID NO: 131109 - DNA, 25 bp, Homo sapien
ctttgacaacgccatccgagctgca

SEQ ID NO: 131110 - DNA, 25 bp, Homo sapien
cggggcgaatcagatccaatgtgca

SEQ ID NO: 131111 - DNA, 25 bp, Homo sapien
cgatctgcaatgagcgcctttagga

SEQ ID NO: 131112 - DNA, 25 bp, Homo sapien
tcacgcagcttactcgggaattccc

SEQ ID NO: 131113 - DNA, 25 bp, Homo sapien
catggcggtagggaacgctcttata

SEQ ID NO: 131114 - DNA, 25 bp, Homo sapien
tcttatagtctctcaggcccgtggg

SEQ ID NO: 131115 - DNA, 25 bp, Homo sapien
ggccgcgtgctgatttatgtgtcca

SEQ ID NO: 131116 - DNA, 25 bp, Homo sapien
gctgtactttcactgcctccgggca

SEQ ID NO: 131117 - DNA, 25 bp, Homo sapien
cggcgacaacgagcacaagggtctt

SEQ ID NO: 131118 - DNA, 25 bp, Homo sapien
gggaaccataccatggcccggatcc

SEQ ID NO: 131119 - DNA, 25 bp, Homo sapien
cgcttcctaccgttagggaactctg

SEQ ID NO: 131120 - DNA, 25 bp, Homo sapien
ctgatagatttttgggagtttgacc

SEQ ID NO: 131121 - DNA, 25 bp, Homo sapien
cgcgcacgaactcagccaacgattt

SEQ ID NO: 131122 - DNA, 25 bp, Homo sapien
gtgggaacctctccacgcgcacgaa

SEQ ID NO: 131123 - DNA, 25 bp, Homo sapien
gctgcgctccgattctggcagtgca

SEQ ID NO: 131124 - DNA, 25 bp, Homo sapien
tataaattcagaggcgctgcgctcc

SEQ ID NO: 131125 - DNA, 25 bp, Homo sapien
gaccctaaagttcgtcgtcgtcatc

SEQ ID NO: 131126 - DNA, 25 bp, Homo sapien
gggtggatcgaaagcgccaaaaatc

SEQ ID NO: 131127 - DNA, 25 bp, Homo sapien
ggcggagactcaccggcagcagaac

SEQ ID NO: 131128 - DNA, 25 bp, Homo sapien
tggatagcgccctgctcgagcgctc

SEQ ID NO: 131129 - DNA, 25 bp, Homo sapien
cccgtagtttgtgcgcgtgcaaagg

SEQ ID NO: 131130 - DNA, 25 bp, Homo sapien
tgcaaaggttctcgcagctacactg

SEQ ID NO: 131131 - DNA, 25 bp, Homo sapien
actgccagaatagaacgtgctcctc

SEQ ID NO: 131132 - DNA, 25 bp, Homo sapien
gaacgtgctcctccgcttttatacc

SEQ ID NO: 131133 - DNA, 25 bp, Homo sapien
cgaacttaaggatcttggggtccag

SEQ ID NO: 131134 - DNA, 25 bp, Homo sapien
cagacagtgggtgccctcctcttca

SEQ ID NO: 131135 - DNA, 25 bp, Homo sapien
tgctcttcagggcattgctcccagg

SEQ ID NO: 131136 - DNA, 25 bp, Homo sapien
tcttcagggcattgctcccaggcgg

SEQ ID NO: 131137 - DNA, 25 bp, Homo sapien
tcagggcattgctcccaggcggacg

SEQ ID NO: 131138 - DNA, 25 bp, Homo sapien
gacggtcggcgccatcctgttcacg

SEQ ID NO: 131139 - DNA, 25 bp, Homo sapien
gtcggcgccatcctgttcacggcgt

SEQ ID NO: 131140 - DNA, 25 bp, Homo sapien
ccatcctgttcacggcgtcgctccc

SEQ ID NO: 131141 - DNA, 25 bp, Homo sapien
ctcccgggcagacagtgggtgccct

SEQ ID NO: 131142 - DNA, 25 bp, Homo sapien
tcgggagttgacctcagcctttctg

SEQ ID NO: 131143 - DNA, 25 bp, Homo sapien
cttcgcattcggagttcagggcacc

SEQ ID NO: 131144 - DNA, 25 bp, Homo sapien
agcctttctgtgacccagttcctgg

SEQ ID NO: 131145 - DNA, 25 bp, Homo sapien
ggctcctgttggctaaccctgaact

SEQ ID NO: 131146 - DNA, 25 bp, Homo sapien
agcagcgtgcttggctatgacaaga

SEQ ID NO: 131147 - DNA, 25 bp, Homo sapien
atcctgccaggtcaatccaagaagc

SEQ ID NO: 131148 - DNA, 25 bp, Homo sapien
tcactgccaggaacgcacctagatg

SEQ ID NO: 131149 - DNA, 25 bp, Homo sapien
ttcggagtcgttttgccacttggtc

SEQ ID NO: 131150 - DNA, 25 bp, Homo sapien
ttgccgaactccagaatcttgaagg

SEQ ID NO: 131151 - DNA, 25 bp, Homo sapien
gcgcaagcctttctttcggcacaaa

SEQ ID NO: 131152 - DNA, 25 bp, Homo sapien
cgctcggtgtctctctgaaaagaac

SEQ ID NO: 131153 - DNA, 25 bp, Homo sapien
aacgcatgcgccttgaagacttatg

SEQ ID NO: 131154 - DNA, 25 bp, Homo sapien
tggaacttatttcacgctcagggcg

SEQ ID NO: 131155 - DNA, 25 bp, Homo sapien
agccgctgtacaacgctttgccgaa

SEQ ID NO: 131156 - DNA, 25 bp, Homo sapien
atgtccttcctgttctccgctttca

SEQ ID NO: 131157 - DNA, 25 bp, Homo sapien
tgaagccacaggtcagaagccgctg

SEQ ID NO: 131158 - DNA, 25 bp, Homo sapien
tgcgtctctgcagcggcccgggtct

SEQ ID NO: 131159 - DNA, 25 bp, Homo sapien
ccgagccttggaccagagggtttct

SEQ ID NO: 131160 - DNA, 25 bp, Homo sapien
gcactctcccgttcctgcgttacct

SEQ ID NO: 131161 - DNA, 25 bp, Homo sapien
ctcagcatccgaccgcaggcgggga

SEQ ID NO: 131162 - DNA, 25 bp, Homo sapien
agccttggaccagagggtttctaag

SEQ ID NO: 131163 - DNA, 25 bp, Homo sapien
aggccctttcggtgccggcgttgcg

SEQ ID NO: 131164 - DNA, 25 bp, Homo sapien
agatccgggggtctgtgctctgatt

SEQ ID NO: 131165 - DNA, 25 bp, Homo sapien
tgtgctctgattcccggccctgccc

SEQ ID NO: 131166 - DNA, 25 bp, Homo sapien
tcgtccggcttgaggaagacctgct

SEQ ID NO: 131167 - DNA, 25 bp, Homo sapien
cgcgtttctccgcagagcggcttct

SEQ ID NO: 131168 - DNA, 25 bp, Homo sapien
cccgcctgaggaattggacaacagc

SEQ ID NO: 131169 - DNA, 25 bp, Homo sapien
acaacagcgatgaggatgtggtgca

SEQ ID NO: 131170 - DNA, 25 bp, Homo sapien
gtgcagcaccaggaccatgctcgca

SEQ ID NO: 131171 - DNA, 25 bp, Homo sapien
tcggtcagcgcgtccgcgacagctt

SEQ ID NO: 131172 - DNA, 25 bp, Homo sapien
ttccagctggcctgctgtcagcctg

SEQ ID NO: 131173 - DNA, 25 bp, Homo sapien
aggccctggagcagtcgcccatctg

SEQ ID NO: 131174 - DNA, 25 bp, Homo sapien
gccagaattccggagacgctgtccc

SEQ ID NO: 131175 - DNA, 25 bp, Homo sapien
ccgatggctggagaaagcaagcacc

SEQ ID NO: 131176 - DNA, 25 bp, Homo sapien
caccgagacttgacgggctctgtcc

SEQ ID NO: 131177 - DNA, 25 bp, Homo sapien
ttcaagcagtggacgctacagctcc

SEQ ID NO: 131178 - DNA, 25 bp, Homo sapien
ctcaagattgggatcagctgtagcc

SEQ ID NO: 131179 - DNA, 25 bp, Homo sapien
ccaccggaccaacggctcaagattg

SEQ ID NO: 131180 - DNA, 25 bp, Homo sapien
cgggaagcgctcttacttggtttca

SEQ ID NO: 131181 - DNA, 25 bp, Homo sapien
gttgtaggcacttcagaccaccgga

SEQ ID NO: 131182 - DNA, 25 bp, Homo sapien
agcgtacttaggacaccgcagttta

SEQ ID NO: 131183 - DNA, 25 bp, Homo sapien
ctcggaaggcaacctcacctgcttg

SEQ ID NO: 131184 - DNA, 25 bp, Homo sapien
ccttagcgctcctaacggttatgga

SEQ ID NO: 131185 - DNA, 25 bp, Homo sapien
tcgtcagcgagcctcagcgtactta

SEQ ID NO: 131186 - DNA, 25 bp, Homo sapien
cacccagtactgtggcgtggtgctc

SEQ ID NO: 131187 - DNA, 25 bp, Homo sapien
cacgccagtgtgctgtgcacgggaa

SEQ ID NO: 131188 - DNA, 25 bp, Homo sapien
accagtgggcagcatcacggccagc

SEQ ID NO: 131189 - DNA, 25 bp, Homo sapien
aatgtcatcatttaaagcggcaggc

SEQ ID NO: 131190 - DNA, 25 bp, Homo sapien
tctctcgactagtggcagctcttta

SEQ ID NO: 131191 - DNA, 25 bp, Homo sapien
aggtggctcccactttaagaagtga

SEQ ID NO: 131192 - DNA, 25 bp, Homo sapien
acagtcttaccacgctggccgttcg

SEQ ID NO: 131193 - DNA, 25 bp, Homo sapien
gacgcgatcgctgaagctctgcaca

SEQ ID NO: 131194 - DNA, 25 bp, Homo sapien
actcggtcatgtacccggtggactc

SEQ ID NO: 131195 - DNA, 25 bp, Homo sapien
ggatcctggagcactcggtcatgta

SEQ ID NO: 131196 - DNA, 25 bp, Homo sapien
gaggactacgagaacctgccgacta

SEQ ID NO: 131197 - DNA, 25 bp, Homo sapien
gggccggcaagtcttctctcgacta

SEQ ID NO: 131198 - DNA, 25 bp, Homo sapien
tatggccaatgccttccggacggtg

SEQ ID NO: 131199 - DNA, 25 bp, Homo sapien
cttccggacggtgtaccagctcaac

SEQ ID NO: 131200 - DNA, 25 bp, Homo sapien
tggccaacatcagcggccggctgtc

SEQ ID NO: 131201 - DNA, 25 bp, Homo sapien
agaacgtggccctctcgctggccaa

SEQ ID NO: 131202 - DNA, 25 bp, Homo sapien
tctgaacactcaggagaacgtggcc

SEQ ID NO: 131203 - DNA, 25 bp, Homo sapien
tggacgtctgtaagacccttctgaa

SEQ ID NO: 131204 - DNA, 25 bp, Homo sapien
tcccacatcatctcaggcgggctgg

SEQ ID NO: 131205 - DNA, 25 bp, Homo sapien
cctggccggctacttcaaaggcatc

SEQ ID NO: 131206 - DNA, 25 bp, Homo sapien
tggctcggtctctgccagcgtctcg

SEQ ID NO: 131207 - DNA, 25 bp, Homo sapien
cccggtgctcagctggtcgttctgc

SEQ ID NO: 131208 - DNA, 25 bp, Homo sapien
ctgtctctggctgctcgtgcggccg

SEQ ID NO: 131209 - DNA, 25 bp, Homo sapien
ggcccgcaccgctttcactttccgc

SEQ ID NO: 131210 - DNA, 25 bp, Homo sapien
cccggctcgcttatagcccagggga

SEQ ID NO: 131211 - DNA, 25 bp, Homo sapien
gccgatctgcgagccctgagcactg

SEQ ID NO: 131212 - DNA, 25 bp, Homo sapien
acgctggggctcagggttcattccg

SEQ ID NO: 131213 - DNA, 25 bp, Homo sapien
gcttacctggctcggtctctgccag

SEQ ID NO: 131214 - DNA, 25 bp, Homo sapien
tggccagccagttccagcgacttgt

SEQ ID NO: 131215 - DNA, 25 bp, Homo sapien
ttgggtagcagcttccttccagcgc

SEQ ID NO: 131216 - DNA, 25 bp, Homo sapien
atctggccctggttggcagagtcaa

SEQ ID NO: 131217 - DNA, 25 bp, Homo sapien
tggcattctggccaccgtgtccgaa

SEQ ID NO: 131218 - DNA, 25 bp, Homo sapien
cgacactgctgcactgtaggggctg

SEQ ID NO: 131219 - DNA, 25 bp, Homo sapien
ctggcgctgtctcttgcatttgtag

SEQ ID NO: 131220 - DNA, 25 bp, Homo sapien
agcacctgcgcctgcgaaaagagca

SEQ ID NO: 131221 - DNA, 25 bp, Homo sapien
ctccgctgtagcctccgtagcaaga

SEQ ID NO: 131222 - DNA, 25 bp, Homo sapien
ggaggctccgaaccatccagctttc

SEQ ID NO: 131223 - DNA, 25 bp, Homo sapien
gaacttcccgtcttgtcgctgcagg

SEQ ID NO: 131224 - DNA, 25 bp, Homo sapien
ccacgagggttccactgctttgatg

SEQ ID NO: 131225 - DNA, 25 bp, Homo sapien
cgctccagtcgcaggatgtccttga

SEQ ID NO: 131226 - DNA, 25 bp, Homo sapien
ctctgcgtccattctcaggtactga

SEQ ID NO: 131227 - DNA, 25 bp, Homo sapien
cgccaccagcgttgtgaacctctga

SEQ ID NO: 131228 - DNA, 25 bp, Homo sapien
gctttgatggccacacgcttttgca

SEQ ID NO: 131229 - DNA, 25 bp, Homo sapien
aagggcccagttaggagtgacctca

SEQ ID NO: 131230 - DNA, 25 bp, Homo sapien
caagcacagcgagaaccgctctgta

SEQ ID NO: 131231 - DNA, 25 bp, Homo sapien
tgtggacgtcgtgatgtggccatcc

SEQ ID NO: 131232 - DNA, 25 bp, Homo sapien
cgtgatgtggccatcccgccacaag

SEQ ID NO: 131233 - DNA, 25 bp, Homo sapien
aagcacagcgagaaccgctctgtac

SEQ ID NO: 131234 - DNA, 25 bp, Homo sapien
acgtcgtgatgtggccatcccgcca

SEQ ID NO: 131235 - DNA, 25 bp, Homo sapien
gtggacgtcgtgatgtggccatccc

SEQ ID NO: 131236 - DNA, 25 bp, Homo sapien
tgtacacgatcatgtggaggagctg

SEQ ID NO: 131237 - DNA, 25 bp, Homo sapien
gaaccgctctgtacacgatcatgtg

SEQ ID NO: 131238 - DNA, 25 bp, Homo sapien
cagcgccttatcagttggtggaatt

SEQ ID NO: 131239 - DNA, 25 bp, Homo sapien
tccttccaggggatactgacgactc

SEQ ID NO: 131240 - DNA, 25 bp, Homo sapien
acagtcgcgctctacctaagtcgta

SEQ ID NO: 131241 - DNA, 25 bp, Homo sapien
gtggaaccggtacctcgaatctcgc

SEQ ID NO: 131242 - DNA, 25 bp, Homo sapien
atctcgctcattccgggtcaattgg

SEQ ID NO: 131243 - DNA, 25 bp, Homo sapien
ttgcagtgcaacagaggctcgagtg

SEQ ID NO: 131244 - DNA, 25 bp, Homo sapien
ttacccgccgctttccaagagcagg

SEQ ID NO: 131245 - DNA, 25 bp, Homo sapien
tgagttcaaatcgtagccctaggtc

SEQ ID NO: 131246 - DNA, 25 bp, Homo sapien
cactccttcagcgtggaaaagaaaa

SEQ ID NO: 131247 - DNA, 25 bp, Homo sapien
cgccagctccgtttcaattaacatt

SEQ ID NO: 131248 - DNA, 25 bp, Homo sapien
ggccttcccggatcgctgattcggg

SEQ ID NO: 131249 - DNA, 25 bp, Homo sapien
ttcaattaacattccagtgccgccg

SEQ ID NO: 131250 - DNA, 25 bp, Homo sapien
gcgcgttccactccttcagcgtgga

SEQ ID NO: 131251 - DNA, 25 bp, Homo sapien
gagaccgtttagttctgggacagac

SEQ ID NO: 131252 - DNA, 25 bp, Homo sapien
cggcctcttagcttctcggctttgg

SEQ ID NO: 131253 - DNA, 25 bp, Homo sapien
acgctgctgggcgacgcttatctgc

SEQ ID NO: 131254 - DNA, 25 bp, Homo sapien
ccctctgagggcaccgcagtgtctg

SEQ ID NO: 131255 - DNA, 25 bp, Homo sapien
tcccgtccatcagcgtccatgtggg

SEQ ID NO: 131256 - DNA, 25 bp, Homo sapien
tcgaggcgagaaggcccagagaccc

SEQ ID NO: 131257 - DNA, 25 bp, Homo sapien
gcagccaccgctggaccatggtgca

SEQ ID NO: 131258 - DNA, 25 bp, Homo sapien
atgcggctccaacggccggtcctgg

SEQ ID NO: 131259 - DNA, 25 bp, Homo sapien
ccggtcctgggtgccttatataggc

SEQ ID NO: 131260 - DNA, 25 bp, Homo sapien
gccttatataggctggcgggccctc

SEQ ID NO: 131261 - DNA, 25 bp, Homo sapien
ccatgtgggccagccgagttgtcga

SEQ ID NO: 131262 - DNA, 25 bp, Homo sapien
ttcagaggctgagttcttaacacca

SEQ ID NO: 131263 - DNA, 25 bp, Homo sapien
cggggacgtccttgtcattccaaca

SEQ ID NO: 131264 - DNA, 25 bp, Homo sapien
ggccacctcctaggcgcttcttgga

SEQ ID NO: 131265 - DNA, 25 bp, Homo sapien
aggacgcgagctatctggaaccaca

SEQ ID NO: 131266 - DNA, 25 bp, Homo sapien
agggcacttccttgtagccaccacg

SEQ ID NO: 131267 - DNA, 25 bp, Homo sapien
cgcgagcccacacagagcggtgaaa

SEQ ID NO: 131268 - DNA, 25 bp, Homo sapien
aaagtacgtcgctgactcgaagctg

SEQ ID NO: 131269 - DNA, 25 bp, Homo sapien
ggctcctgcgacaaggcgaacacca

SEQ ID NO: 131270 - DNA, 25 bp, Homo sapien
catcacggtggagcgcaaagactac

SEQ ID NO: 131271 - DNA, 25 bp, Homo sapien
ggcctccaagatgagctacacgttg

SEQ ID NO: 131272 - DNA, 25 bp, Homo sapien
tacacgttggactcgctgggcaacc

SEQ ID NO: 131273 - DNA, 25 bp, Homo sapien
gaacgaccgctttgccggctacata

SEQ ID NO: 131274 - DNA, 25 bp, Homo sapien
ctcggaccacctggaggaagacatc

SEQ ID NO: 131275 - DNA, 25 bp, Homo sapien
aggaaatccgctcccagctcgaaag

SEQ ID NO: 131276 - DNA, 25 bp, Homo sapien
agagtggttcaaatgccgctacgcc

SEQ ID NO: 131277 - DNA, 25 bp, Homo sapien
ccggctacatagagaaggtgcacta

SEQ ID NO: 131278 - DNA, 25 bp, Homo sapien
tccaatggcggagctttctgcaaag

SEQ ID NO: 131279 - DNA, 25 bp, Homo sapien
tggagaaagatccagcaaaaccctg

SEQ ID NO: 131280 - DNA, 25 bp, Homo sapien
cgttaaactcagactccagagcggc

SEQ ID NO: 131281 - DNA, 25 bp, Homo sapien
ccgtccagaatgactgcggatgccc

SEQ ID NO: 131282 - DNA, 25 bp, Homo sapien
cccatgttggagtctggggtcccag

SEQ ID NO: 131283 - DNA, 25 bp, Homo sapien
gcggcagaagttccctaagaggaca

SEQ ID NO: 131284 - DNA, 25 bp, Homo sapien
cactcagtcctctggccactgggtt

SEQ ID NO: 131285 - DNA, 25 bp, Homo sapien
ccactgggtttctggccgcagatct

SEQ ID NO: 131286 - DNA, 25 bp, Homo sapien
ggcgatctcctcttcgtgcactttc

SEQ ID NO: 131287 - DNA, 25 bp, Homo sapien
cctgcttctcgttggtggcatcttc

SEQ ID NO: 131288 - DNA, 25 bp, Homo sapien
tcgcggatctcctgctcgtacagcg

SEQ ID NO: 131289 - DNA, 25 bp, Homo sapien
gctcggcttccaggaccttgttctg

SEQ ID NO: 131290 - DNA, 25 bp, Homo sapien
cggctcgtagctgaaggaactcatg

SEQ ID NO: 131291 - DNA, 25 bp, Homo sapien
tctgcatgttcttggcggccagctt

SEQ ID NO: 131292 - DNA, 25 bp, Homo sapien
cggtgaagcggctcttgaaccattc

SEQ ID NO: 131293 - DNA, 25 bp, Homo sapien
ttggtcacgtccatctccacggaga

SEQ ID NO: 131294 - DNA, 25 bp, Homo sapien
tgggtacagtacagctccacagcgc

SEQ ID NO: 131295 - DNA, 25 bp, Homo sapien
tgcaaagaaagctccgtgccacgcc

SEQ ID NO: 131296 - DNA, 25 bp, Homo sapien
cggggtcatcatagctgcgctcttc

SEQ ID NO: 131297 - DNA, 25 bp, Homo sapien
cggcagcctccattctttggtagaa

SEQ ID NO: 131298 - DNA, 25 bp, Homo sapien
atcgcctacagcttgtgctctgaga

SEQ ID NO: 131299 - DNA, 25 bp, Homo sapien
cgcacccagagctggcggtatgtca

SEQ ID NO: 131300 - DNA, 25 bp, Homo sapien
gcgggacatctgttttacactcacc

SEQ ID NO: 131301 - DNA, 25 bp, Homo sapien
tgcgctcttcgatggacactaaatg

SEQ ID NO: 131302 - DNA, 25 bp, Homo sapien
tccggcacttcacaccagggaaatg

SEQ ID NO: 131303 - DNA, 25 bp, Homo sapien
gtccagcgaagtttggcggaacatg

SEQ ID NO: 131304 - DNA, 25 bp, Homo sapien
agcccgaggagctgtagcagcctta

SEQ ID NO: 131305 - DNA, 25 bp, Homo sapien
atcccgaccaagaggcagaagtacg

SEQ ID NO: 131306 - DNA, 25 bp, Homo sapien
ggagtcctctccagggagcgccgat

SEQ ID NO: 131307 - DNA, 25 bp, Homo sapien
gggactccgagtgcttccaagtgca

SEQ ID NO: 131308 - DNA, 25 bp, Homo sapien
gcaaagtgccgccagcgtcaaagtc

SEQ ID NO: 131309 - DNA, 25 bp, Homo sapien
gcagctgagcttcgggaccgtaatc

SEQ ID NO: 131310 - DNA, 25 bp, Homo sapien
gcgttactccgcgagactctcctga

SEQ ID NO: 131311 - DNA, 25 bp, Homo sapien
tctccgagactgacactctgccgta

SEQ ID NO: 131312 - DNA, 25 bp, Homo sapien
ccggacagagtccagccaatcagca

SEQ ID NO: 131313 - DNA, 25 bp, Homo sapien
cttccagcgttactgagcaggcgca

SEQ ID NO: 131314 - DNA, 25 bp, Homo sapien
ccctctagtttaggtagcgcttatc

SEQ ID NO: 131315 - DNA, 25 bp, Homo sapien
ctgattgggtaagagccagctcgtc

SEQ ID NO: 131316 - DNA, 25 bp, Homo sapien
cgtcgctctgttaggattggttgaa

SEQ ID NO: 131317 - DNA, 25 bp, Homo sapien
gtcttttcgaagtttgcagcatcca

SEQ ID NO: 131318 - DNA, 25 bp, Homo sapien
ggcacatttccggattcttattctg

SEQ ID NO: 131319 - DNA, 25 bp, Homo sapien
gtggatctacactctgcgcccgtct

SEQ ID NO: 131320 - DNA, 25 bp, Homo sapien
cctgcgacatcagagaggtggaatc

SEQ ID NO: 131321 - DNA, 25 bp, Homo sapien
tgcgagcgctcagtcctgaaagtta

SEQ ID NO: 131322 - DNA, 25 bp, Homo sapien
ggcggctcttacctacacatcactt

SEQ ID NO: 131323 - DNA, 25 bp, Homo sapien
gcgtcaggagaactcggcacatttc

SEQ ID NO: 131324 - DNA, 25 bp, Homo sapien
ggagactttccacgtagccggagga

SEQ ID NO: 131325 - DNA, 25 bp, Homo sapien
gagtcgttctgagtcccaatggtta

SEQ ID NO: 131326 - DNA, 25 bp, Homo sapien
acggcactgttcatcacacacgcgg

SEQ ID NO: 131327 - DNA, 25 bp, Homo sapien
gctgtacacggcactgttcatcaca

SEQ ID NO: 131328 - DNA, 25 bp, Homo sapien
acggcactgttcaccacacagggct

SEQ ID NO: 131329 - DNA, 25 bp, Homo sapien
acacggcactgttcaccacacaggg

SEQ ID NO: 131330 - DNA, 25 bp, Homo sapien
ggcactgttcatcacacacgcggct

SEQ ID NO: 131331 - DNA, 25 bp, Homo sapien
cctgcgctgtacacggcactgttca

SEQ ID NO: 131332 - DNA, 25 bp, Homo sapien
actgttcaccacacagggctcctga

SEQ ID NO: 131333 - DNA, 25 bp, Homo sapien
tgttcatcacacacgcggctccaga

SEQ ID NO: 131334 - DNA, 25 bp, Homo sapien
aaagtccacgaaggccgtccgctcg

SEQ ID NO: 131335 - DNA, 25 bp, Homo sapien
gtcagtccataaccaggcgctacta

SEQ ID NO: 131336 - DNA, 25 bp, Homo sapien
cgctactaaggcctccaggctcggt

SEQ ID NO: 131337 - DNA, 25 bp, Homo sapien
gaggttcgggaaatcgactgattta

SEQ ID NO: 131338 - DNA, 25 bp, Homo sapien
gggtgagtagcctcgatttatcatc

SEQ ID NO: 131339 - DNA, 25 bp, Homo sapien
catccctgatggtgagagtggaaaa

SEQ ID NO: 131340 - DNA, 25 bp, Homo sapien
cagatggaatctttagtgcttcgca

SEQ ID NO: 131341 - DNA, 25 bp, Homo sapien
ccctgcctgtcatagagcgccagga

SEQ ID NO: 131342 - DNA, 25 bp, Homo sapien
gtagtccacacagcggtacacgatc

SEQ ID NO: 131343 - DNA, 25 bp, Homo sapien
aagagcccatcaggcaggtcgcgca

SEQ ID NO: 131344 - DNA, 25 bp, Homo sapien
cttgagcgccgaggaaacatcatcc

SEQ ID NO: 131345 - DNA, 25 bp, Homo sapien
ccctccttgaggtgcacagagcgcg

SEQ ID NO: 131346 - DNA, 25 bp, Homo sapien
agcagccgctgtgtcttcgatgtct

SEQ ID NO: 131347 - DNA, 25 bp, Homo sapien
tgtctgcccacacttgcggtagatg

SEQ ID NO: 131348 - DNA, 25 bp, Homo sapien
accgcactgcgtgatgtagtccaca

SEQ ID NO: 131349 - DNA, 25 bp, Homo sapien
ggtacacgatcaccgggatatccga

SEQ ID NO: 131350 - DNA, 25 bp, Homo sapien
agccgtggtcccgaactttgacaga

SEQ ID NO: 131351 - DNA, 25 bp, Homo sapien
acccgcgcgaaacatgcgttggttg

SEQ ID NO: 131352 - DNA, 25 bp, Homo sapien
ccctcaggaagcgaatgaattgttc

SEQ ID NO: 131353 - DNA, 25 bp, Homo sapien
agggcaccagcttttctcggcggta

SEQ ID NO: 131354 - DNA, 25 bp, Homo sapien
tttgatcagctgtacctccacgttg

SEQ ID NO: 131355 - DNA, 25 bp, Homo sapien
gacatgcctatgagcccggtgattt

SEQ ID NO: 131356 - DNA, 25 bp, Homo sapien
tggaacagccgtgagcccttcaaga

SEQ ID NO: 131357 - DNA, 25 bp, Homo sapien
aggctccggccaactagctcggttc

SEQ ID NO: 131358 - DNA, 25 bp, Homo sapien
tgcctctctcgcagacaaggacctg

SEQ ID NO: 131359 - DNA, 25 bp, Homo sapien
tgcggtgctgccttatttcccttag

SEQ ID NO: 131360 - DNA, 25 bp, Homo sapien
agtcccggagcgataaaacttctgc

SEQ ID NO: 131361 - DNA, 25 bp, Homo sapien
ggaggccacaaatcccaactcagta

SEQ ID NO: 131362 - DNA, 25 bp, Homo sapien
ccgtaatgtcttcgtagggtggcac

SEQ ID NO: 131363 - DNA, 25 bp, Homo sapien
ggtatttactatcccagcacgcaga

SEQ ID NO: 131364 - DNA, 25 bp, Homo sapien
ttcagggatccgcaaaaccagaggc

SEQ ID NO: 131365 - DNA, 25 bp, Homo sapien
cccagctaaggaaatgcgcggcaca

SEQ ID NO: 131366 - DNA, 25 bp, Homo sapien
tccctggatcctgcctctagatgta

SEQ ID NO: 131367 - DNA, 25 bp, Homo sapien
gggcaagtgctgctcaaatacagtg

SEQ ID NO: 131368 - DNA, 25 bp, Homo sapien
ctgacttagggtagcaggtctctgc

SEQ ID NO: 131369 - DNA, 25 bp, Homo sapien
cggatctgtgtgcatgcttgtgagc

SEQ ID NO: 131370 - DNA, 25 bp, Homo sapien
cgtggccacatgtgcttatgttttg

SEQ ID NO: 131371 - DNA, 25 bp, Homo sapien
ctcctggagttccatggtgatatca

SEQ ID NO: 131372 - DNA, 25 bp, Homo sapien
tatcagatgttgtgtgcggcttgca

SEQ ID NO: 131373 - DNA, 25 bp, Homo sapien
gcggcccgataaggagcctcatttg

SEQ ID NO: 131374 - DNA, 25 bp, Homo sapien
tcacccagggagagaatgcgacttc

SEQ ID NO: 131375 - DNA, 25 bp, Homo sapien
tactggtctctgtctcccgagagcc

SEQ ID NO: 131376 - DNA, 25 bp, Homo sapien
gcggctcgcctgacactactggtct

SEQ ID NO: 131377 - DNA, 25 bp, Homo sapien
cccgtcgatgagtggttcacagaga

SEQ ID NO: 131378 - DNA, 25 bp, Homo sapien
tggatcttcggtttctacgacaaac

SEQ ID NO: 131379 - DNA, 25 bp, Homo sapien
ctcgaggagctctgaaatggatctt

SEQ ID NO: 131380 - DNA, 25 bp, Homo sapien
gcggaactcgctagataattgaaga

SEQ ID NO: 131381 - DNA, 25 bp, Homo sapien
cgacttcattcctaggaggctgtgc

SEQ ID NO: 131382 - DNA, 25 bp, Homo sapien
gcacggatttctacaggctgctttc

SEQ ID NO: 131383 - DNA, 25 bp, Homo sapien
cccttgaaaaggctgcgcgcaaagc

SEQ ID NO: 131384 - DNA, 25 bp, Homo sapien
acaggctgctttcccttgaaaaggc

SEQ ID NO: 131385 - DNA, 25 bp, Homo sapien
gcaggaagcaaagcacggatttcta

SEQ ID NO: 131386 - DNA, 25 bp, Homo sapien
acgccaaacgatccgggcacctggg

SEQ ID NO: 131387 - DNA, 25 bp, Homo sapien
ggagcagttccacgccaaacgatcc

SEQ ID NO: 131388 - DNA, 25 bp, Homo sapien
ccctggagcaccgtatgtagcagtg

SEQ ID NO: 131389 - DNA, 25 bp, Homo sapien
ctctacccgccgtgcaggaagcaaa

SEQ ID NO: 131390 - DNA, 25 bp, Homo sapien
cgctagtgctcgaggctgggacact

SEQ ID NO: 131391 - DNA, 25 bp, Homo sapien
tgggacactgctaggtgcacacagc

SEQ ID NO: 131392 - DNA, 25 bp, Homo sapien
ccctaggtgacgtcactggccaggc

SEQ ID NO: 131393 - DNA, 25 bp, Homo sapien
ccgctgccggagaaagagcacgagc

SEQ ID NO: 131394 - DNA, 25 bp, Homo sapien
tgaaatctagcatcctgccggctgg

SEQ ID NO: 131395 - DNA, 25 bp, Homo sapien
cagggtcaccatttgcagcgcaaca

SEQ ID NO: 131396 - DNA, 25 bp, Homo sapien
caacatggcaggtaaaggagaaatc

SEQ ID NO: 131397 - DNA, 25 bp, Homo sapien
cctgacaaggcaccgcttccttatt

SEQ ID NO: 131398 - DNA, 25 bp, Homo sapien
aatgtcgtcccacctagtcgagccg

SEQ ID NO: 131399 - DNA, 25 bp, Homo sapien
gcatgggatgtccaggtgactgaca

SEQ ID NO: 131400 - DNA, 25 bp, Homo sapien
ggagcgcacttcctcattccgtttc

SEQ ID NO: 131401 - DNA, 25 bp, Homo sapien
aaggcagctcattggctcaggcatg

SEQ ID NO: 131402 - DNA, 25 bp, Homo sapien
tgccagctgtccgacaatgtcgtcc

SEQ ID NO: 131403 - DNA, 25 bp, Homo sapien
cggtcgcttgttgtgttgtcatcac

SEQ ID NO: 131404 - DNA, 25 bp, Homo sapien
acgcaagagttcgttcccggcgcgc

SEQ ID NO: 131405 - DNA, 25 bp, Homo sapien
cggtcatcccaagtcacacgcaaga

SEQ ID NO: 131406 - DNA, 25 bp, Homo sapien
ctgctttcttctgcacagggagttg

SEQ ID NO: 131407 - DNA, 25 bp, Homo sapien
ctcggctaaaccacggctgtgcgga

SEQ ID NO: 131408 - DNA, 25 bp, Homo sapien
agagactaagtgtagcgcgccgccc

SEQ ID NO: 131409 - DNA, 25 bp, Homo sapien
tggatttagtcctttctgtcggctc

SEQ ID NO: 131410 - DNA, 25 bp, Homo sapien
cggtcaggcttgtagcagaaggttc

SEQ ID NO: 131411 - DNA, 25 bp, Homo sapien
cggtctggggtttctgccattctaa

SEQ ID NO: 131412 - DNA, 25 bp, Homo sapien
ttacctcgtctgtgctctgtgtttg

SEQ ID NO: 131413 - DNA, 25 bp, Homo sapien
gcagccggctcgtttttacctcgtc

SEQ ID NO: 131414 - DNA, 25 bp, Homo sapien
ttcgattcctcttcggctctgctct

SEQ ID NO: 131415 - DNA, 25 bp, Homo sapien
agctttcgattcctcttcggctctg

SEQ ID NO: 131416 - DNA, 25 bp, Homo sapien
tctgaagctttcgattcctcttcgg

SEQ ID NO: 131417 - DNA, 25 bp, Homo sapien
gtcacaccgcgtttctgaagctttc

SEQ ID NO: 131418 - DNA, 25 bp, Homo sapien
tggtcacaccgcgtttctgaagctt

SEQ ID NO: 131419 - DNA, 25 bp, Homo sapien
gacgctggtcacaccgcgtttctga

SEQ ID NO: 131420 - DNA, 25 bp, Homo sapien
tccaggaggacgctggtcacaccgc

SEQ ID NO: 131421 - DNA, 25 bp, Homo sapien
tttgtccaggaggacgctggtcaca

SEQ ID NO: 131422 - DNA, 25 bp, Homo sapien
tgcagaacatcaacgaccaggtcgg

SEQ ID NO: 131423 - DNA, 25 bp, Homo sapien
ccatctgttgaatcgggccggaagg

SEQ ID NO: 131424 - DNA, 25 bp, Homo sapien
ccggcggagagccatctgttgaatc

SEQ ID NO: 131425 - DNA, 25 bp, Homo sapien
atcgacttcgactcgctgtcggtgg

SEQ ID NO: 131426 - DNA, 25 bp, Homo sapien
ccggcagaaattctgtggcatgttc

SEQ ID NO: 131427 - DNA, 25 bp, Homo sapien
cttgtgcacacagcgagggagactt

SEQ ID NO: 131428 - DNA, 25 bp, Homo sapien
ggcaaagaagccctgcagaacatca

SEQ ID NO: 131429 - DNA, 25 bp, Homo sapien
tgcccgcgtctccttgagcttgaga

SEQ ID NO: 131430 - DNA, 25 bp, Homo sapien
tggccgacttgaaccgaggctttta

SEQ ID NO: 131431 - DNA, 25 bp, Homo sapien
tctctcgaagcggatggcttttgcc

SEQ ID NO: 131432 - DNA, 25 bp, Homo sapien
cagcgaagcggttgcacccttttca

SEQ ID NO: 131433 - DNA, 25 bp, Homo sapien
cgcatcacggtgagtttggtacttg

SEQ ID NO: 131434 - DNA, 25 bp, Homo sapien
tacttgggaaatctgcggtcggcca

SEQ ID NO: 131435 - DNA, 25 bp, Homo sapien
ggccagccaccttttgtagcacaga

SEQ ID NO: 131436 - DNA, 25 bp, Homo sapien
gtcgcatcgtttgcaaggcattaaa

SEQ ID NO: 131437 - DNA, 25 bp, Homo sapien
aggtagccttaggtaacgcgccaga

SEQ ID NO: 131438 - DNA, 25 bp, Homo sapien
tcatggagggaaggcaaatatacgc

SEQ ID NO: 131439 - DNA, 25 bp, Homo sapien
acatatgtggaatggtaataccaga

SEQ ID NO: 131440 - DNA, 25 bp, Homo sapien
cactcggtcgccagaaaagattttt

SEQ ID NO: 131441 - DNA, 25 bp, Homo sapien
aaggcaaatatacgcgcggctgagc

SEQ ID NO: 131442 - DNA, 25 bp, Homo sapien
ctttatcggatagtgttggagatca

SEQ ID NO: 131443 - DNA, 25 bp, Homo sapien
cctcagttgcttctactttatcgga

SEQ ID NO: 131444 - DNA, 25 bp, Homo sapien
ctttttctcagttccagctcctttc

SEQ ID NO: 131445 - DNA, 25 bp, Homo sapien
ttctctttcacggtacctcagttgc

SEQ ID NO: 131446 - DNA, 25 bp, Homo sapien
tcatcctctgtagtggtgggcagcg

SEQ ID NO: 131447 - DNA, 25 bp, Homo sapien
gctcagctctgccaaatgccgctta

SEQ ID NO: 131448 - DNA, 25 bp, Homo sapien
cagctctgccaaatgccgcttagca

SEQ ID NO: 131449 - DNA, 25 bp, Homo sapien
caaatgccgcttagcaggcagcggg

SEQ ID NO: 131450 - DNA, 25 bp, Homo sapien
ccctcatcctctgtagtggtgggca

SEQ ID NO: 131451 - DNA, 25 bp, Homo sapien
atgtggcgcttcatgggcacaggcc

SEQ ID NO: 131452 - DNA, 25 bp, Homo sapien
cggcacgggtggaacgctcagctct

SEQ ID NO: 131453 - DNA, 25 bp, Homo sapien
gaagatgtggcgcttcatgggcaca

SEQ ID NO: 131454 - DNA, 25 bp, Homo sapien
tctgcccgagttcaggatccgaagc

SEQ ID NO: 131455 - DNA, 25 bp, Homo sapien
tggcccgcagttacctacattttga

SEQ ID NO: 131456 - DNA, 25 bp, Homo sapien
ggaacctgcctagcgcactctactg

SEQ ID NO: 131457 - DNA, 25 bp, Homo sapien
ctccagcttctaggagcacaggtca

SEQ ID NO: 131458 - DNA, 25 bp, Homo sapien
cgcgctgtcttattcgtcctggctg

SEQ ID NO: 131459 - DNA, 25 bp, Homo sapien
cgagaatctgcttttccgcgctgtc

SEQ ID NO: 131460 - DNA, 25 bp, Homo sapien
cgagcgcaggtaccacgaaattaaa

SEQ ID NO: 131461 - DNA, 25 bp, Homo sapien
tttgaccgcgtccacctgaaagagc

SEQ ID NO: 131462 - DNA, 25 bp, Homo sapien
atagaaagacagctcgccctcctca

SEQ ID NO: 131463 - DNA, 25 bp, Homo sapien
ccctgcgtgcggcagacataccaga

SEQ ID NO: 131464 - DNA, 25 bp, Homo sapien
gacataccagaagcccgagcgtgtg

SEQ ID NO: 131465 - DNA, 25 bp, Homo sapien
tagcagctgtgtgagtggccctcag

SEQ ID NO: 131466 - DNA, 25 bp, Homo sapien
ccctgtgagaagacacgggagccca

SEQ ID NO: 131467 - DNA, 25 bp, Homo sapien
tggcgctccgcgtcatagaaagaca

SEQ ID NO: 131468 - DNA, 25 bp, Homo sapien
tgacgctggtgaggtcgtcagacac

SEQ ID NO: 131469 - DNA, 25 bp, Homo sapien
aagcgttccgggttctccacctgca

SEQ ID NO: 131470 - DNA, 25 bp, Homo sapien
tacccgaaagtcgtgggcagtgtcc

SEQ ID NO: 131471 - DNA, 25 bp, Homo sapien
cccacttccggtgtgcgcgggaaat

SEQ ID NO: 131472 - DNA, 25 bp, Homo sapien
cccgagtgctgggaatcgcccagtc

SEQ ID NO: 131473 - DNA, 25 bp, Homo sapien
acggcgcagagcaactcctccttga

SEQ ID NO: 131474 - DNA, 25 bp, Homo sapien
tcgctgctcttacccgaaagtcgtg

SEQ ID NO: 131475 - DNA, 25 bp, Homo sapien
cgcctcgtgcaaatcgctgctctta

SEQ ID NO: 131476 - DNA, 25 bp, Homo sapien
cagagccaagggattccgggttcca

SEQ ID NO: 131477 - DNA, 25 bp, Homo sapien
gggactccgctccatggcacgagca

SEQ ID NO: 131478 - DNA, 25 bp, Homo sapien
agccgtgggtgctgtgcacatgccc

SEQ ID NO: 131479 - DNA, 25 bp, Homo sapien
acggccagacccaggaaatcggagc

SEQ ID NO: 131480 - DNA, 25 bp, Homo sapien
agtagtcgctggagtccgcgcctcc

SEQ ID NO: 131481 - DNA, 25 bp, Homo sapien
gagaaacggccagacccaggaaatc

SEQ ID NO: 131482 - DNA, 25 bp, Homo sapien
gacaattccgggatcctgggcacct

SEQ ID NO: 131483 - DNA, 25 bp, Homo sapien
cccggcagaagttggaggcttgacc

SEQ ID NO: 131484 - DNA, 25 bp, Homo sapien
tgcccggccgacttacctgtacttg

SEQ ID NO: 131485 - DNA, 25 bp, Homo sapien
tgctgtgcacatgcccggagctcgc

SEQ ID NO: 131486 - DNA, 25 bp, Homo sapien
tgcccgtggcattgacgatggccca

SEQ ID NO: 131487 - DNA, 25 bp, Homo sapien
ttgtaggtgcccgtggcattgacga

SEQ ID NO: 131488 - DNA, 25 bp, Homo sapien
acttcttgctgttgtaggtgcccgt

SEQ ID NO: 131489 - DNA, 25 bp, Homo sapien
cggcgcagcagtcgtacttcttgct

SEQ ID NO: 131490 - DNA, 25 bp, Homo sapien
agtgacagcagcaccgaaatgcaca

SEQ ID NO: 131491 - DNA, 25 bp, Homo sapien
cagtcgtacttcttgctgttgtagg

SEQ ID NO: 131492 - DNA, 25 bp, Homo sapien
gtggcattgacgatggcccactcgc

SEQ ID NO: 131493 - DNA, 25 bp, Homo sapien
atctcggcgcagcagtcgtacttct

SEQ ID NO: 131494 - DNA, 25 bp, Homo sapien
cgctgccagcggtgttcggcgtcct

SEQ ID NO: 131495 - DNA, 25 bp, Homo sapien
cgcggccgtcttcgaccttgacggg

SEQ ID NO: 131496 - DNA, 25 bp, Homo sapien
cgtcttcgaccttgacggggtgctg

SEQ ID NO: 131497 - DNA, 25 bp, Homo sapien
tcttcgaccttgacggggtgctggc

SEQ ID NO: 131498 - DNA, 25 bp, Homo sapien
ctgccagcggtgttcggcgtcctcg

SEQ ID NO: 131499 - DNA, 25 bp, Homo sapien
tggccttcgcgcatctcccaggtta

SEQ ID NO: 131500 - DNA, 25 bp, Homo sapien
tcccaggttagctgcgtgtccgggt

SEQ ID NO: 131501 - DNA, 25 bp, Homo sapien
ggccttcgcgcatctcccaggttag

SEQ ID NO: 131502 - DNA, 25 bp, Homo sapien
aagttgcaataacgtggaaggatgg

SEQ ID NO: 131503 - DNA, 25 bp, Homo sapien
gcatccaagaagttgcaataacgtg

SEQ ID NO: 131504 - DNA, 25 bp, Homo sapien
ctgctcgcagcatccaagaagttgc

SEQ ID NO: 131505 - DNA, 25 bp, Homo sapien
agtcggtgcgcgtgacccggcttct

SEQ ID NO: 131506 - DNA, 25 bp, Homo sapien
tttccaggtcctcgtttctcccagc

SEQ ID NO: 131507 - DNA, 25 bp, Homo sapien
atcgctgatgcgatccacgtgcctc

SEQ ID NO: 131508 - DNA, 25 bp, Homo sapien
tgaggggcatcgctgatgcgatcca

SEQ ID NO: 131509 - DNA, 25 bp, Homo sapien
gtgacccggcttctgctcgcagcat

SEQ ID NO: 131510 - DNA, 25 bp, Homo sapien
agacggggacatctcaccggtcagc

SEQ ID NO: 131511 - DNA, 25 bp, Homo sapien
ggggcgcatcatcaccacgaatagc

SEQ ID NO: 131512 - DNA, 25 bp, Homo sapien
ggctggctgcaaacctgcatgactc

SEQ ID NO: 131513 - DNA, 25 bp, Homo sapien
accacgaatagctgtgctggctcca

SEQ ID NO: 131514 - DNA, 25 bp, Homo sapien
ttccagtagggaagagcctgaactc

SEQ ID NO: 131515 - DNA, 25 bp, Homo sapien
ctgaactcgcgtgcccatctgggag

SEQ ID NO: 131516 - DNA, 25 bp, Homo sapien
gccgtatttatagcgctctgctcgc

SEQ ID NO: 131517 - DNA, 25 bp, Homo sapien
gactgcgagctgtgtcatccctctc

SEQ ID NO: 131518 - DNA, 25 bp, Homo sapien
cataagatgggcgagaaaaacgtgc

SEQ ID NO: 131519 - DNA, 25 bp, Homo sapien
cgtgcagggctaaaatctggggtcc

SEQ ID NO: 131520 - DNA, 25 bp, Homo sapien
agccacttggcggtcccgatagtga

SEQ ID NO: 131521 - DNA, 25 bp, Homo sapien
ttggcggtcccgatagtgaaatgga

SEQ ID NO: 131522 - DNA, 25 bp, Homo sapien
aatggactaagatcaaggagctctc

SEQ ID NO: 131523 - DNA, 25 bp, Homo sapien
tgaaaataccaaggaagttgatctg

SEQ ID NO: 131524 - DNA, 25 bp, Homo sapien
ccagaggaagagaccatgaaaggta

SEQ ID NO: 131525 - DNA, 25 bp, Homo sapien
cccaggccctcgacatcataagatg

SEQ ID NO: 131526 - DNA, 25 bp, Homo sapien
ggcactcgcatccagaaggcatttt

SEQ ID NO: 131527 - DNA, 25 bp, Homo sapien
gccgtgggcgccatttttaatcctg

SEQ ID NO: 131528 - DNA, 25 bp, Homo sapien
tcacgaagctcaggataccagactc

SEQ ID NO: 131529 - DNA, 25 bp, Homo sapien
agcagcagcgctcaactcacgaagc

SEQ ID NO: 131530 - DNA, 25 bp, Homo sapien
tagaacaccatgatcccgggagcgg

SEQ ID NO: 131531 - DNA, 25 bp, Homo sapien
cattttagagcgagggtcaggcgca

SEQ ID NO: 131532 - DNA, 25 bp, Homo sapien
tacaaacatagcagtggcatcgccc

SEQ ID NO: 131533 - DNA, 25 bp, Homo sapien
ctgctgctggtgaagtagaacacca

SEQ ID NO: 131534 - DNA, 25 bp, Homo sapien
ttccgactgtctcctgaggctcagg

SEQ ID NO: 131535 - DNA, 25 bp, Homo sapien
cccgcctagtcacggtcctggagtt

SEQ ID NO: 131536 - DNA, 25 bp, Homo sapien
cgccaccgccaaattgcagcaaggg

SEQ ID NO: 131537 - DNA, 25 bp, Homo sapien
tgagtaaagactccacgcggggacc

SEQ ID NO: 131538 - DNA, 25 bp, Homo sapien
gccgcactgacctgttttgagtaaa

SEQ ID NO: 131539 - DNA, 25 bp, Homo sapien
tggcccgctggcttatcctcaagag

SEQ ID NO: 131540 - DNA, 25 bp, Homo sapien
aacagacaagatgacccggggaagc

SEQ ID NO: 131541 - DNA, 25 bp, Homo sapien
cctcggcgttcctttctgcagaatg

SEQ ID NO: 131542 - DNA, 25 bp, Homo sapien
ggaggatcctgcagtggaatgtgaa

SEQ ID NO: 131543 - DNA, 25 bp, Homo sapien
gatcctgcagtggaatgtgaaggga

SEQ ID NO: 131544 - DNA, 25 bp, Homo sapien
ggggagtgttaggaggatcctgcag

SEQ ID NO: 131545 - DNA, 25 bp, Homo sapien
cttgggggtaccctgaagtgagaag

SEQ ID NO: 131546 - DNA, 25 bp, Homo sapien
tcagtgcgcaactgcagagggtgcg

SEQ ID NO: 131547 - DNA, 25 bp, Homo sapien
tcagtgcgcattggcggaaggggta

SEQ ID NO: 131548 - DNA, 25 bp, Homo sapien
ccggcggtcagtgcgcacctgaaga

SEQ ID NO: 131549 - DNA, 25 bp, Homo sapien
gacgatctgggggtcagtgcgcatt

SEQ ID NO: 131550 - DNA, 25 bp, Homo sapien
gctgggttctggtctttggtgttgt

SEQ ID NO: 131551 - DNA, 25 bp, Homo sapien
ctgggttctggtctttggtgttgtg

SEQ ID NO: 131552 - DNA, 25 bp, Homo sapien
gttctggtctttggtgttgtgggga

SEQ ID NO: 131553 - DNA, 25 bp, Homo sapien
gctgggttctggtctttggtgacgt

SEQ ID NO: 131554 - DNA, 25 bp, Homo sapien
ctgcgttctggtctttggtgacgtg

SEQ ID NO: 131555 - DNA, 25 bp, Homo sapien
ggggatgcagtgaggtgctgcgttc

SEQ ID NO: 131556 - DNA, 25 bp, Homo sapien
ttctggtctttggtgttgtggggag

SEQ ID NO: 131557 - DNA, 25 bp, Homo sapien
gttctggtctttggtgacgtgggga

SEQ ID NO: 131558 - DNA, 25 bp, Homo sapien
agcctggcgcgcgattatttgaaga

SEQ ID NO: 131559 - DNA, 25 bp, Homo sapien
ctctgaggcgcaggtaacctctgga

SEQ ID NO: 131560 - DNA, 25 bp, Homo sapien
gcgtggtttccctcagagatttttc

SEQ ID NO: 131561 - DNA, 25 bp, Homo sapien
gtggccaatcggaacgcagcggctt

SEQ ID NO: 131562 - DNA, 25 bp, Homo sapien
ccagggcgcgagaatcttggaaaca

SEQ ID NO: 131563 - DNA, 25 bp, Homo sapien
agatttttcacctcaccagggcgcg

SEQ ID NO: 131564 - DNA, 25 bp, Homo sapien
cccgagaccgaagaagccactgact

SEQ ID NO: 131565 - DNA, 25 bp, Homo sapien
aagagcttttgctcggcgctcggca

SEQ ID NO: 131566 - DNA, 25 bp, Homo sapien
gtctcaccgcctggaaggaaaggtc

SEQ ID NO: 131567 - DNA, 25 bp, Homo sapien
cccgcaggcgccaaagacgagggaa

SEQ ID NO: 131568 - DNA, 25 bp, Homo sapien
ctggctttcaaaaagtcgcgcgctg

SEQ ID NO: 131569 - DNA, 25 bp, Homo sapien
gcaattcgaaccctcctggctttca

SEQ ID NO: 131570 - DNA, 25 bp, Homo sapien
ggcagctgccgttgcaattcgaacc

SEQ ID NO: 131571 - DNA, 25 bp, Homo sapien
tcttcaaaattggtcccgagcggcc

SEQ ID NO: 131572 - DNA, 25 bp, Homo sapien
tgaaaataagtcgtggccaagtacc

SEQ ID NO: 131573 - DNA, 25 bp, Homo sapien
aaaagctcctcttaccagagtctca

SEQ ID NO: 131574 - DNA, 25 bp, Homo sapien
gaatcgagctgtgcggtacacctcc

SEQ ID NO: 131575 - DNA, 25 bp, Homo sapien
ttaccttgcccgaatcgagctgtgc

SEQ ID NO: 131576 - DNA, 25 bp, Homo sapien
cacaccgcggaagccgagcatgcgg

SEQ ID NO: 131577 - DNA, 25 bp, Homo sapien
caacgccggtcgtggtacacttcca

SEQ ID NO: 131578 - DNA, 25 bp, Homo sapien
tcgtgcggacctgagccattcacca

SEQ ID NO: 131579 - DNA, 25 bp, Homo sapien
tgagccattcaccaggcggatcatc

SEQ ID NO: 131580 - DNA, 25 bp, Homo sapien
aggcggatcatcatcggggcctcca

SEQ ID NO: 131581 - DNA, 25 bp, Homo sapien
gaagccgagcatgcggcacaccacg

SEQ ID NO: 131582 - DNA, 25 bp, Homo sapien
tgaccgcgttgagcatggccagctc

SEQ ID NO: 131583 - DNA, 25 bp, Homo sapien
tcagctgcagctccatgcctacgtg

SEQ ID NO: 131584 - DNA, 25 bp, Homo sapien
gcgatggagtgctcccagtccttga

SEQ ID NO: 131585 - DNA, 25 bp, Homo sapien
ggctactgttgctctccacctgcag

SEQ ID NO: 131586 - DNA, 25 bp, Homo sapien
acgagtctgactggttctgcagcgc

SEQ ID NO: 131587 - DNA, 25 bp, Homo sapien
cggaagctctcattcagccggttca

SEQ ID NO: 131588 - DNA, 25 bp, Homo sapien
cctttcgcgagggagatgttccgca

SEQ ID NO: 131589 - DNA, 25 bp, Homo sapien
cagccggttcacattgcgagtcagg

SEQ ID NO: 131590 - DNA, 25 bp, Homo sapien
tccgggaagagctttacgatacatt

SEQ ID NO: 131591 - DNA, 25 bp, Homo sapien
ctttgtgcacgtcggcttccgggaa

SEQ ID NO: 131592 - DNA, 25 bp, Homo sapien
gctgaaccgaacttttaccgcgaga

SEQ ID NO: 131593 - DNA, 25 bp, Homo sapien
gagaatccgctacccagtccagtcg

SEQ ID NO: 131594 - DNA, 25 bp, Homo sapien
cgacattttacgacaggcgggattg

SEQ ID NO: 131595 - DNA, 25 bp, Homo sapien
gctgcatttttatctctggtggctc

SEQ ID NO: 131596 - DNA, 25 bp, Homo sapien
gggcgaacgcccaggcaatcaaatg

SEQ ID NO: 131597 - DNA, 25 bp, Homo sapien
ccgcctgctaccctgttagttgcaa

SEQ ID NO: 131598 - DNA, 25 bp, Homo sapien
ctcgctgttgtttttccaggcctgc

SEQ ID NO: 131599 - DNA, 25 bp, Homo sapien
ataagtgcccgagcgactcctcgcg

SEQ ID NO: 131600 - DNA, 25 bp, Homo sapien
gcgcacatgcgcacttgaacctgac

SEQ ID NO: 131601 - DNA, 25 bp, Homo sapien
cctcgatcggaaccggcagctgcag

SEQ ID NO: 131602 - DNA, 25 bp, Homo sapien
agcccggagccaaacttgaggcttg

SEQ ID NO: 131603 - DNA, 25 bp, Homo sapien
aacttgaggcttggcttttcgcacc

SEQ ID NO: 131604 - DNA, 25 bp, Homo sapien
ttttcgcaccgagccaaagtttctc

SEQ ID NO: 131605 - DNA, 25 bp, Homo sapien
tgcctctgggacaggctcctccgag

SEQ ID NO: 131606 - DNA, 25 bp, Homo sapien
ggaaagcaggcgagacattttttaa

SEQ ID NO: 131607 - DNA, 25 bp, Homo sapien
cctggcgtccgcctactagcggcgg

SEQ ID NO: 131608 - DNA, 25 bp, Homo sapien
ccggcccgtgccgagtgcccagcca

SEQ ID NO: 131609 - DNA, 25 bp, Homo sapien
tgccgcgcacgtgactcttgttgta

SEQ ID NO: 131610 - DNA, 25 bp, Homo sapien
cgcgcacgtgactcttgttgtaggc

SEQ ID NO: 131611 - DNA, 25 bp, Homo sapien
cggcaaggaaagcaggcgagacatt

SEQ ID NO: 131612 - DNA, 25 bp, Homo sapien
cgcacgtgactcttgttgtaggcgg

SEQ ID NO: 131613 - DNA, 25 bp, Homo sapien
gccaggagtaaacagcaccccagtc

SEQ ID NO: 131614 - DNA, 25 bp, Homo sapien
gtctgatccgttggcgcgcgccctg

SEQ ID NO: 131615 - DNA, 25 bp, Homo sapien
ctctgcagcgcggtgcgagttcctg

SEQ ID NO: 131616 - DNA, 25 bp, Homo sapien
gcgagttcctggaaaggctgcgttt

SEQ ID NO: 131617 - DNA, 25 bp, Homo sapien
aggctgcccggtctgatccgttggc

SEQ ID NO: 131618 - DNA, 25 bp, Homo sapien
ccggcaggcctgagcactgagcact

SEQ ID NO: 131619 - DNA, 25 bp, Homo sapien
gagcactgagcactgcacccgcttt

SEQ ID NO: 131620 - DNA, 25 bp, Homo sapien
cacccgcttttctttgggcgcgtgg

SEQ ID NO: 131621 - DNA, 25 bp, Homo sapien
atcctggggagccaaaccgagcgcg

SEQ ID NO: 131622 - DNA, 25 bp, Homo sapien
cgctctcgtcgatgttctccagtga

SEQ ID NO: 131623 - DNA, 25 bp, Homo sapien
agtgagtccgcatgctgcaccgaca

SEQ ID NO: 131624 - DNA, 25 bp, Homo sapien
caacgggctctgctccgggtgcagc

SEQ ID NO: 131625 - DNA, 25 bp, Homo sapien
tgcagccacggcttgaagtgaggca

SEQ ID NO: 131626 - DNA, 25 bp, Homo sapien
aggcaggtgcttctgtttccactcg

SEQ ID NO: 131627 - DNA, 25 bp, Homo sapien
tttccactcggggtacttgaggcac

SEQ ID NO: 131628 - DNA, 25 bp, Homo sapien
gaggcacgccttgtacatcttcttc

SEQ ID NO: 131629 - DNA, 25 bp, Homo sapien
acatcttcttcatggcctgtgggcc

SEQ ID NO: 131630 - DNA, 25 bp, Homo sapien
tcactcagggcgagaggcagagaac

SEQ ID NO: 131631 - DNA, 25 bp, Homo sapien
ggccgtaggcggaagacaatgctcc

SEQ ID NO: 131632 - DNA, 25 bp, Homo sapien
cctcggggacgcctagtttgaggct

SEQ ID NO: 131633 - DNA, 25 bp, Homo sapien
gtcgcggccacaacaaaagccttgg

SEQ ID NO: 131634 - DNA, 25 bp, Homo sapien
tcctcagggatcgttcctctcgtcg

SEQ ID NO: 131635 - DNA, 25 bp, Homo sapien
tgctcgcgaaagctcgctgtcgctg

SEQ ID NO: 131636 - DNA, 25 bp, Homo sapien
gagctttcggccgagcgtactcagt

SEQ ID NO: 131637 - DNA, 25 bp, Homo sapien
tcccgtccatcagtttgcaaagtcc

SEQ ID NO: 131638 - DNA, 25 bp, Homo sapien
aagcggcgagctgctaaaatttaga

SEQ ID NO: 131639 - DNA, 25 bp, Homo sapien
tcttcgtcgtgccaacgggagaagc

SEQ ID NO: 131640 - DNA, 25 bp, Homo sapien
tggggcctgcacgacagtcttgaac

SEQ ID NO: 131641 - DNA, 25 bp, Homo sapien
cgcactctaagcatccggctcattt

SEQ ID NO: 131642 - DNA, 25 bp, Homo sapien
cgtttccttatgtcgctaagcggga

SEQ ID NO: 131643 - DNA, 25 bp, Homo sapien
cgattgcaagctcgcggtccatgtc

SEQ ID NO: 131644 - DNA, 25 bp, Homo sapien
ctgggtttctacagaggcgggaatt

SEQ ID NO: 131645 - DNA, 25 bp, Homo sapien
gacggcttcgcacttctcgctgtag

SEQ ID NO: 131646 - DNA, 25 bp, Homo sapien
cctttatcacgtcggggacaccatg

SEQ ID NO: 131647 - DNA, 25 bp, Homo sapien
cgtgtgtctcaagtctcaggatgtc

SEQ ID NO: 131648 - DNA, 25 bp, Homo sapien
accgtgtgtctcaagtctcaggatg

SEQ ID NO: 131649 - DNA, 25 bp, Homo sapien
tatcacgtcggggacaccatgtgtc

SEQ ID NO: 131650 - DNA, 25 bp, Homo sapien
atgtggtcctttatcacgtcgggga

SEQ ID NO: 131651 - DNA, 25 bp, Homo sapien
cgtgtgtctcaagtctcaggatgtg

SEQ ID NO: 131652 - DNA, 25 bp, Homo sapien
ccgtgtgtctcaagtctcaggatgt

SEQ ID NO: 131653 - DNA, 25 bp, Homo sapien
agtctcgggatgtggtcctttatca

SEQ ID NO: 131654 - DNA, 25 bp, Homo sapien
gcgccctgcatctcaagtcttggta

SEQ ID NO: 131655 - DNA, 25 bp, Homo sapien
tcgggtatgccgtgtatatgaagtc

SEQ ID NO: 131656 - DNA, 25 bp, Homo sapien
atggtcctttatcacgtcgggtatg

SEQ ID NO: 131657 - DNA, 25 bp, Homo sapien
acggtcctttatcatgtcggggacg

SEQ ID NO: 131658 - DNA, 25 bp, Homo sapien
tggtatgtggtcctttatcacatcg

SEQ ID NO: 131659 - DNA, 25 bp, Homo sapien
tgccctgcgtctcaagtctcgcgag

SEQ ID NO: 131660 - DNA, 25 bp, Homo sapien
tcacatcggggacaccgtgtgtctc

SEQ ID NO: 131661 - DNA, 25 bp, Homo sapien
cggtcctttatcacgtcaggggtgc

SEQ ID NO: 131662 - DNA, 25 bp, Homo sapien
ggcgcccttcggcaagttccgcagt

SEQ ID NO: 131663 - DNA, 25 bp, Homo sapien
tccgcagtcgcctgtcggaaatggc

SEQ ID NO: 131664 - DNA, 25 bp, Homo sapien
atgcagcctccgagcggagtaggcc

SEQ ID NO: 131665 - DNA, 25 bp, Homo sapien
ccctgagctggaagccggtaggact

SEQ ID NO: 131666 - DNA, 25 bp, Homo sapien
ttctgggacgccgactttcgcgcag

SEQ ID NO: 131667 - DNA, 25 bp, Homo sapien
ctggctctttttgccgggctcgcct

SEQ ID NO: 131668 - DNA, 25 bp, Homo sapien
tttcaggagccacagtcagaggagc

SEQ ID NO: 131669 - DNA, 25 bp, Homo sapien
tctctcgtcccagtttgggctgctc

SEQ ID NO: 131670 - DNA, 25 bp, Homo sapien
tgatgaggcaggcaagcggattttt

SEQ ID NO: 131671 - DNA, 25 bp, Homo sapien
aacggaggtcagacctgcatgctgc

SEQ ID NO: 131672 - DNA, 25 bp, Homo sapien
tgcatgctgcgctggtccaaccgca

SEQ ID NO: 131673 - DNA, 25 bp, Homo sapien
gctctttgtcatcctggtcttcttc

SEQ ID NO: 131674 - DNA, 25 bp, Homo sapien
aagcacgtgctggatctgtgccgca

SEQ ID NO: 131675 - DNA, 25 bp, Homo sapien
tgctggatctgtgccgcatccggga

SEQ ID NO: 131676 - DNA, 25 bp, Homo sapien
ggcaggcaagcggatttttggtccc

SEQ ID NO: 131677 - DNA, 25 bp, Homo sapien
gtggctcagcttcacgctctttgtc

SEQ ID NO: 131678 - DNA, 25 bp, Homo sapien
attctgaggtgagtcgagcggtttt

SEQ ID NO: 131679 - DNA, 25 bp, Homo sapien
gcttccgagtgggtgacccagacgc

SEQ ID NO: 131680 - DNA, 25 bp, Homo sapien
tcgagcggttttgaagccggactac

SEQ ID NO: 131681 - DNA, 25 bp, Homo sapien
gaactcagcgaggattctgaggtga

SEQ ID NO: 131682 - DNA, 25 bp, Homo sapien
agccggactacctcaagtctctttc

SEQ ID NO: 131683 - DNA, 25 bp, Homo sapien
cctatctcagcccttcgtactggga

SEQ ID NO: 131684 - DNA, 25 bp, Homo sapien
ttcctcacttctttctcttcactta

SEQ ID NO: 131685 - DNA, 25 bp, Homo sapien
cagcccttcgtactgggacgttggg

SEQ ID NO: 131686 - DNA, 25 bp, Homo sapien
acgctgtgggagaagtacccgctag

SEQ ID NO: 131687 - DNA, 25 bp, Homo sapien
acccacgtgccctcttggaagtcgg

SEQ ID NO: 131688 - DNA, 25 bp, Homo sapien
gtacccgctagaggcttcactcagg

SEQ ID NO: 131689 - DNA, 25 bp, Homo sapien
cgtatctcaccacgcccgttttgtg

SEQ ID NO: 131690 - DNA, 25 bp, Homo sapien
acggtgacgaactcgccctctcgga

SEQ ID NO: 131691 - DNA, 25 bp, Homo sapien
ctcggaatcagaggccagggcctgt

SEQ ID NO: 131692 - DNA, 25 bp, Homo sapien
cccagccagcatgcgcgagaaggag

SEQ ID NO: 131693 - DNA, 25 bp, Homo sapien
ggacctcgtcagcttcctcggaatc

SEQ ID NO: 131694 - DNA, 25 bp, Homo sapien
cttgtagttccccagggtcgtcgtg

SEQ ID NO: 131695 - DNA, 25 bp, Homo sapien
ccgctgtatggcgggacttgtagtt

SEQ ID NO: 131696 - DNA, 25 bp, Homo sapien
gccggttcatgggtcgtatccgcac

SEQ ID NO: 131697 - DNA, 25 bp, Homo sapien
tcggctctcacctcgccggttcatg

SEQ ID NO: 131698 - DNA, 25 bp, Homo sapien
gccaccggcgactcttcggggttga

SEQ ID NO: 131699 - DNA, 25 bp, Homo sapien
gaggaactcgttcggcttccgtctg

SEQ ID NO: 131700 - DNA, 25 bp, Homo sapien
ttcatgggtcgtatccgcaccgcca

SEQ ID NO: 131701 - DNA, 25 bp, Homo sapien
gcagccgccgaggaactcgttcggc

SEQ ID NO: 131702 - DNA, 25 bp, Homo sapien
ccggaaagctgaagacgaactgcga

SEQ ID NO: 131703 - DNA, 25 bp, Homo sapien
cgtttcttcatcatcaggtaggcca

SEQ ID NO: 131704 - DNA, 25 bp, Homo sapien
ttaacgaactcgaaggcctcctcca

SEQ ID NO: 131705 - DNA, 25 bp, Homo sapien
gaggggctagcagcctccgcagcac

SEQ ID NO: 131706 - DNA, 25 bp, Homo sapien
agtgcacgcccacggagaccggaaa

SEQ ID NO: 131707 - DNA, 25 bp, Homo sapien
gctgcttaacgaactcgaaggcctc

SEQ ID NO: 131708 - DNA, 25 bp, Homo sapien
cctgggactcgaactgcagcagctg

SEQ ID NO: 131709 - DNA, 25 bp, Homo sapien
gcagcacaggacgtggccagcacct

SEQ ID NO: 131710 - DNA, 25 bp, Homo sapien
ggctgcagagtagcgtattccattc

SEQ ID NO: 131711 - DNA, 25 bp, Homo sapien
atgcgattcctgagacgttagcgta

SEQ ID NO: 131712 - DNA, 25 bp, Homo sapien
tcctgtccacgcttcctaaaagatg

SEQ ID NO: 131713 - DNA, 25 bp, Homo sapien
ggaaacgtcttcaccctatcttgca

SEQ ID NO: 131714 - DNA, 25 bp, Homo sapien
cggagctggaccctggaaaatgtac

SEQ ID NO: 131715 - DNA, 25 bp, Homo sapien
ttacaggactcgctcgcagtttcgg

SEQ ID NO: 131716 - DNA, 25 bp, Homo sapien
ttttcctggtcacgtagcagccctc

SEQ ID NO: 131717 - DNA, 25 bp, Homo sapien
gctctgggtccgattcatgtttctg

SEQ ID NO: 131718 - DNA, 25 bp, Homo sapien
cagcacgcgatttttccaggatttc

SEQ ID NO: 131719 - DNA, 25 bp, Homo sapien
ttgcgtcccagaggaattgccctca

SEQ ID NO: 131720 - DNA, 25 bp, Homo sapien
tggcactttctcttggagcgctttg

SEQ ID NO: 131721 - DNA, 25 bp, Homo sapien
ccagggctcgctaaaatccggcacg

SEQ ID NO: 131722 - DNA, 25 bp, Homo sapien
caagctcaaacaatggcgcggacgc

SEQ ID NO: 131723 - DNA, 25 bp, Homo sapien
cgcgccgccatcagatagtcgaaaa

SEQ ID NO: 131724 - DNA, 25 bp, Homo sapien
ccgggctgaacaaaaggtgatcatt

SEQ ID NO: 131725 - DNA, 25 bp, Homo sapien
gctcctccgcactgaacagttttgt

SEQ ID NO: 131726 - DNA, 25 bp, Homo sapien
cgtcgtagacgatgaccgccgagta

SEQ ID NO: 131727 - DNA, 25 bp, Homo sapien
agccttttgagcacactgcagtcca

SEQ ID NO: 131728 - DNA, 25 bp, Homo sapien
tcgtcccggttcatcagccttttga

SEQ ID NO: 131729 - DNA, 25 bp, Homo sapien
cgcctgcagaagtggccgcaaactt

SEQ ID NO: 131730 - DNA, 25 bp, Homo sapien
cgccgcacgatggtgttacagcgca

SEQ ID NO: 131731 - DNA, 25 bp, Homo sapien
ttacagcgcacgttgaccgaaccta

SEQ ID NO: 131732 - DNA, 25 bp, Homo sapien
gccagagttttctcctcggcttaga

SEQ ID NO: 131733 - DNA, 25 bp, Homo sapien
cggagccctcgtttacctttgagca

SEQ ID NO: 131734 - DNA, 25 bp, Homo sapien
gtttggggacgggaatcagtgcgct

SEQ ID NO: 131735 - DNA, 25 bp, Homo sapien
cgacaacgtcgacgcggctgcagat

SEQ ID NO: 131736 - DNA, 25 bp, Homo sapien
cgcggaggctccgacaacgtcgacg

SEQ ID NO: 131737 - DNA, 25 bp, Homo sapien
ggctgcagatgctgacgccaccttc

SEQ ID NO: 131738 - DNA, 25 bp, Homo sapien
tgcagatgctgacgccaccttcctg

SEQ ID NO: 131739 - DNA, 25 bp, Homo sapien
cctgggacctgcaagaccggtttgg

SEQ ID NO: 131740 - DNA, 25 bp, Homo sapien
gcgacctgctcaactaactcgcagc

SEQ ID NO: 131741 - DNA, 25 bp, Homo sapien
accttcctgggacctgcaagaccgg

SEQ ID NO: 131742 - DNA, 25 bp, Homo sapien
tcccgcaggcgattcacacggaaag

SEQ ID NO: 131743 - DNA, 25 bp, Homo sapien
cgctctgggccagcttttgtctacc

SEQ ID NO: 131744 - DNA, 25 bp, Homo sapien
ctcacgtggccagtaaataacagtc

SEQ ID NO: 131745 - DNA, 25 bp, Homo sapien
ggggaggaaaatgcccatagaacaa

SEQ ID NO: 131746 - DNA, 25 bp, Homo sapien
caaagaggcttgctttctgcacctg

SEQ ID NO: 131747 - DNA, 25 bp, Homo sapien
ctgcacctgacagtaatcgctggtg

SEQ ID NO: 131748 - DNA, 25 bp, Homo sapien
tcgctggtggagaagccctaaatcc

SEQ ID NO: 131749 - DNA, 25 bp, Homo sapien
gggccaatttcacgcgtgtcgcagg

SEQ ID NO: 131750 - DNA, 25 bp, Homo sapien
atgttcagcctgctcgctcctgcag

SEQ ID NO: 131751 - DNA, 25 bp, Homo sapien
gcagcccttcggctctctgcgtggg

SEQ ID NO: 131752 - DNA, 25 bp, Homo sapien
ctcccagggtcgcttcgacgagcgg

SEQ ID NO: 131753 - DNA, 25 bp, Homo sapien
tcctgcacagcaggcgcggagcagc

SEQ ID NO: 131754 - DNA, 25 bp, Homo sapien
tgcggcggcagcactttccacggca

SEQ ID NO: 131755 - DNA, 25 bp, Homo sapien
gctccagccgtggttaacgggacca

SEQ ID NO: 131756 - DNA, 25 bp, Homo sapien
ttcgacgagcggctaggtgcactgc

SEQ ID NO: 131757 - DNA, 25 bp, Homo sapien
aagcgccttagtcgggtccaaaatg

SEQ ID NO: 131758 - DNA, 25 bp, Homo sapien
tggcagcactcaccagggtcgttcc

SEQ ID NO: 131759 - DNA, 25 bp, Homo sapien
gggcccgcggtcagcagaaacaaat

SEQ ID NO: 131760 - DNA, 25 bp, Homo sapien
aggagcaagcagtacccggccgctc

SEQ ID NO: 131761 - DNA, 25 bp, Homo sapien
ccatggcgctcgatgaagatggcgc

SEQ ID NO: 131762 - DNA, 25 bp, Homo sapien
aaggaacggcccgactgcagagctg

SEQ ID NO: 131763 - DNA, 25 bp, Homo sapien
agctgcagccgcaacggatccgtgc

SEQ ID NO: 131764 - DNA, 25 bp, Homo sapien
gcacgaacagcaaagaggtcagaca

SEQ ID NO: 131765 - DNA, 25 bp, Homo sapien
tcagacatggggaatccgggcaccc

SEQ ID NO: 131766 - DNA, 25 bp, Homo sapien
aagaacgcactctcggaagcccgtc

SEQ ID NO: 131767 - DNA, 25 bp, Homo sapien
aacttccagcggcagtgtggacacc

SEQ ID NO: 131768 - DNA, 25 bp, Homo sapien
ccagtagtctctgtgtggctgcctc

SEQ ID NO: 131769 - DNA, 25 bp, Homo sapien
cgcgagcgaggatctccagtagtct

SEQ ID NO: 131770 - DNA, 25 bp, Homo sapien
aaatgcttcttggacccacaggctg

SEQ ID NO: 131771 - DNA, 25 bp, Homo sapien
aagcgcccgcggcaaatgcttcttg

SEQ ID NO: 131772 - DNA, 25 bp, Homo sapien
gcccgtctgccacacagatactgta

SEQ ID NO: 131773 - DNA, 25 bp, Homo sapien
ctgtactgtgatagaaagcgcccgc

SEQ ID NO: 131774 - DNA, 25 bp, Homo sapien
gcccgaggctttacaggctcccgaa

SEQ ID NO: 131775 - DNA, 25 bp, Homo sapien
gccagctatggaaaaccagtcattt

SEQ ID NO: 131776 - DNA, 25 bp, Homo sapien
cggccacacacgttttgcaggagtt

SEQ ID NO: 131777 - DNA, 25 bp, Homo sapien
gacgtcaccgccatggcaggcatca

SEQ ID NO: 131778 - DNA, 25 bp, Homo sapien
gcgatctgcacacccgcggagaaga

SEQ ID NO: 131779 - DNA, 25 bp, Homo sapien
gaattcaagacctggcgcctgctca

SEQ ID NO: 131780 - DNA, 25 bp, Homo sapien
gtgcatccaaaggacggccgctacc

SEQ ID NO: 131781 - DNA, 25 bp, Homo sapien
ccagaccggccctgacaggaattca

SEQ ID NO: 131782 - DNA, 25 bp, Homo sapien
acaagagtcgcaagcttccgggtcc

SEQ ID NO: 131783 - DNA, 25 bp, Homo sapien
tgacgtcagctttttcctggggaag

SEQ ID NO: 131784 - DNA, 25 bp, Homo sapien
tctcatcctgggcattcgggccgaa

SEQ ID NO: 131785 - DNA, 25 bp, Homo sapien
tggaacctgttcctggtcgccaatg

SEQ ID NO: 131786 - DNA, 25 bp, Homo sapien
cttttctcagctttccgtaggggtg

SEQ ID NO: 131787 - DNA, 25 bp, Homo sapien
ggtgtcgatctacgttccaattggg

SEQ ID NO: 131788 - DNA, 25 bp, Homo sapien
tgccaggctctccaatcgcatgtgg

SEQ ID NO: 131789 - DNA, 25 bp, Homo sapien
tcgcatgtggaattatcgctctacc

SEQ ID NO: 131790 - DNA, 25 bp, Homo sapien
cggcaaagccgagaaggagaacacc

SEQ ID NO: 131791 - DNA, 25 bp, Homo sapien
cgggaagatgaacaacggcggcaaa

SEQ ID NO: 131792 - DNA, 25 bp, Homo sapien
tcccggggcccgattgtctcggtgc

SEQ ID NO: 131793 - DNA, 25 bp, Homo sapien
tggagcgcgtactcagcggctctcg

SEQ ID NO: 131794 - DNA, 25 bp, Homo sapien
agcctgcctggagcgcgtactcagc

SEQ ID NO: 131795 - DNA, 25 bp, Homo sapien
gggagctgcttccatcccggacttc

SEQ ID NO: 131796 - DNA, 25 bp, Homo sapien
cgagagaaagggagctgcttccatc

SEQ ID NO: 131797 - DNA, 25 bp, Homo sapien
taaaagtcgcacacatcccaggtcc

SEQ ID NO: 131798 - DNA, 25 bp, Homo sapien
cccgtgaacttggaggcttggaaga

SEQ ID NO: 131799 - DNA, 25 bp, Homo sapien
gcggcagaccgcgaattttccctct

SEQ ID NO: 131800 - DNA, 25 bp, Homo sapien
gtttgctcaatgaacctctggccta

SEQ ID NO: 131801 - DNA, 25 bp, Homo sapien
ctctggcctaaagacaatgctccgg

SEQ ID NO: 131802 - DNA, 25 bp, Homo sapien
tttcgcttcgagaacggcggtccca

SEQ ID NO: 131803 - DNA, 25 bp, Homo sapien
gaactatcccgctctggcgtcctgg

SEQ ID NO: 131804 - DNA, 25 bp, Homo sapien
tcctggggcctccatgacaacgagg

SEQ ID NO: 131805 - DNA, 25 bp, Homo sapien
ccactgaagatggaaggcagctttc

SEQ ID NO: 131806 - DNA, 25 bp, Homo sapien
accggcggtactcacgcaagtgcca

SEQ ID NO: 131807 - DNA, 25 bp, Homo sapien
ggccctggtcaatatcgcatccgtg

SEQ ID NO: 131808 - DNA, 25 bp, Homo sapien
gccataggaacgagcacaggctgtc

SEQ ID NO: 131809 - DNA, 25 bp, Homo sapien
gtgactaagcatgcgcccgccgcta

SEQ ID NO: 131810 - DNA, 25 bp, Homo sapien
gccgctaggcaagacccaggaggat

SEQ ID NO: 131811 - DNA, 25 bp, Homo sapien
tagccttctgaagtccggtggatcg

SEQ ID NO: 131812 - DNA, 25 bp, Homo sapien
gcaagcgcagcctcacggtgactaa

SEQ ID NO: 131813 - DNA, 25 bp, Homo sapien
caccaggtagtcataggaggccacg

SEQ ID NO: 131814 - DNA, 25 bp, Homo sapien
tctcgcacagcgtccgcacttggtt

SEQ ID NO: 131815 - DNA, 25 bp, Homo sapien
gaccaacctcctgcttggctcaggg

SEQ ID NO: 131816 - DNA, 25 bp, Homo sapien
tcgctagtccactcgggaaatgcta

SEQ ID NO: 131817 - DNA, 25 bp, Homo sapien
tcggcctagctctcgccggacgaag

SEQ ID NO: 131818 - DNA, 25 bp, Homo sapien
ggtttccgtcatcgctcgggcattt

SEQ ID NO: 131819 - DNA, 25 bp, Homo sapien
ttggtgaacgccttgtcgtccatgg

SEQ ID NO: 131820 - DNA, 25 bp, Homo sapien
cacttggttctcgttcagctgctta

SEQ ID NO: 131821 - DNA, 25 bp, Homo sapien
acacggcgccctaggagcagaacag

SEQ ID NO: 131822 - DNA, 25 bp, Homo sapien
cgactctgctcttgctcgatgacag

SEQ ID NO: 131823 - DNA, 25 bp, Homo sapien
ggtccgcgcaatccgggcgcctcca

SEQ ID NO: 131824 - DNA, 25 bp, Homo sapien
tgctcatgccggtgccggcatcact

SEQ ID NO: 131825 - DNA, 25 bp, Homo sapien
actctgctcttgctcgatgacagcc

SEQ ID NO: 131826 - DNA, 25 bp, Homo sapien
gggcgcactgcacccagcgctgctt

SEQ ID NO: 131827 - DNA, 25 bp, Homo sapien
ggccgaatgacaaccggggagcctc

SEQ ID NO: 131828 - DNA, 25 bp, Homo sapien
tctcgctggttctgtgccgctgctc

SEQ ID NO: 131829 - DNA, 25 bp, Homo sapien
tgccggtgccggcatcactgccgga

SEQ ID NO: 131830 - DNA, 25 bp, Homo sapien
ttacggttatcttcgctcaggcgcc

SEQ ID NO: 131831 - DNA, 25 bp, Homo sapien
gcaaactggagaccgcggtgaattc

SEQ ID NO: 131832 - DNA, 25 bp, Homo sapien
cacgtgcaggttctggcatccatca

SEQ ID NO: 131833 - DNA, 25 bp, Homo sapien
ggggactccagcatctcagtcatcg

SEQ ID NO: 131834 - DNA, 25 bp, Homo sapien
atcgtccttctgaccggggactcca

SEQ ID NO: 131835 - DNA, 25 bp, Homo sapien
acagcccaacaacggcggcgatctg

SEQ ID NO: 131836 - DNA, 25 bp, Homo sapien
tcggctccactttggttgagacgtc

SEQ ID NO: 131837 - DNA, 25 bp, Homo sapien
cgcaggcgctctttggtgtttacag

SEQ ID NO: 131838 - DNA, 25 bp, Homo sapien
gctgccttctgctgactacaaactg

SEQ ID NO: 131839 - DNA, 25 bp, Homo sapien
ggacgcggctcacacgaaactgagg

SEQ ID NO: 131840 - DNA, 25 bp, Homo sapien
agcgagtttctcctcagctgcaaac

SEQ ID NO: 131841 - DNA, 25 bp, Homo sapien
ccgagcattccaaacgcggaaactc

SEQ ID NO: 131842 - DNA, 25 bp, Homo sapien
ggccatgcgcctcaaaccgagcatt

SEQ ID NO: 131843 - DNA, 25 bp, Homo sapien
tcccacaggagtcccgagttgcggt

SEQ ID NO: 131844 - DNA, 25 bp, Homo sapien
aggggtttcactcccttcactgagc

SEQ ID NO: 131845 - DNA, 25 bp, Homo sapien
ttcactgagccgagccaggaagcca

SEQ ID NO: 131846 - DNA, 25 bp, Homo sapien
atcggtgcaggagctagctcagcgc

SEQ ID NO: 131847 - DNA, 25 bp, Homo sapien
gccgcagcatcacttcacacaaagg

SEQ ID NO: 131848 - DNA, 25 bp, Homo sapien
gcagagtccgaaccgacagccagaa

SEQ ID NO: 131849 - DNA, 25 bp, Homo sapien
ttggcaccacaggtaaacaggctgg

SEQ ID NO: 131850 - DNA, 25 bp, Homo sapien
gcacgcacctcgcaccatgagatgg

SEQ ID NO: 131851 - DNA, 25 bp, Homo sapien
cttcgcctttctgtggttccatcca

SEQ ID NO: 131852 - DNA, 25 bp, Homo sapien
cacacaaaggactgtcacccgcgga

SEQ ID NO: 131853 - DNA, 25 bp, Homo sapien
gggacctgtcactccctgtaactga

SEQ ID NO: 131854 - DNA, 25 bp, Homo sapien
cgagatgtccgagcgcaaagaaggc

SEQ ID NO: 131855 - DNA, 25 bp, Homo sapien
tagagcgctccgtctccggcgagat

SEQ ID NO: 131856 - DNA, 25 bp, Homo sapien
agcggtgggacccatcgacgacttc

SEQ ID NO: 131857 - DNA, 25 bp, Homo sapien
tgagcaggacggtgataacctctcc

SEQ ID NO: 131858 - DNA, 25 bp, Homo sapien
aacttgttggaactccgggctcgcg

SEQ ID NO: 131859 - DNA, 25 bp, Homo sapien
gctgcggggcaattgaaaaagagcc

SEQ ID NO: 131860 - DNA, 25 bp, Homo sapien
ctctgagcgcccgttgagtcgcgcg

SEQ ID NO: 131861 - DNA, 25 bp, Homo sapien
gcaagggacagcagtcccggccgca

SEQ ID NO: 131862 - DNA, 25 bp, Homo sapien
ggccacggccctatggaaagttctc

SEQ ID NO: 131863 - DNA, 25 bp, Homo sapien
agcgtctttccgtgtctcagcatca

SEQ ID NO: 131864 - DNA, 25 bp, Homo sapien
actcccggaggtagtgtcccagctt

SEQ ID NO: 131865 - DNA, 25 bp, Homo sapien
ggttttcactcgtgccctgttcaca

SEQ ID NO: 131866 - DNA, 25 bp, Homo sapien
atgatcttggttcgcagtccgcctg

SEQ ID NO: 131867 - DNA, 25 bp, Homo sapien
ggctctgcctttgcgccactaagtc

SEQ ID NO: 131868 - DNA, 25 bp, Homo sapien
aggcttcaatctcaggcagtggctc

SEQ ID NO: 131869 - DNA, 25 bp, Homo sapien
tcacaagctcttgggacccgggttc

SEQ ID NO: 131870 - DNA, 25 bp, Homo sapien
gacggcgcctccactgtgtgtgtga

SEQ ID NO: 131871 - DNA, 25 bp, Homo sapien
acgacgcctccactgtgtgtgtgac

SEQ ID NO: 131872 - DNA, 25 bp, Homo sapien
gtgaccaggacagacgacgcctcca

SEQ ID NO: 131873 - DNA, 25 bp, Homo sapien
acggcgcctccactgtgtgtgtgac

SEQ ID NO: 131874 - DNA, 25 bp, Homo sapien
tgtgaccaggacagacggcgcctcc

SEQ ID NO: 131875 - DNA, 25 bp, Homo sapien
agacgacgcctccactgtgtgtgtg

SEQ ID NO: 131876 - DNA, 25 bp, Homo sapien
gacagacggcgcctccactgtgtgt

SEQ ID NO: 131877 - DNA, 25 bp, Homo sapien
tgtgaccaggacagacgacgcctcc

SEQ ID NO: 131878 - DNA, 25 bp, Homo sapien
gcgcccatgaacaagcccagcattg

SEQ ID NO: 131879 - DNA, 25 bp, Homo sapien
taagcgtccttctcatccatgtgcg

SEQ ID NO: 131880 - DNA, 25 bp, Homo sapien
ggggtcccatcctcatgaacggtca

SEQ ID NO: 131881 - DNA, 25 bp, Homo sapien
gatccgaccggaagttgcacgctga

SEQ ID NO: 131882 - DNA, 25 bp, Homo sapien
tgtgagtctcctccggttgttctta

SEQ ID NO: 131883 - DNA, 25 bp, Homo sapien
tgcgcagggaattttgcccattttc

SEQ ID NO: 131884 - DNA, 25 bp, Homo sapien
tccaacataggttctcacgcgtgtc

SEQ ID NO: 131885 - DNA, 25 bp, Homo sapien
ttcgtgcctaccaatgcaggacgtc

SEQ ID NO: 131886 - DNA, 25 bp, Homo sapien
ccttcagttcccgaggagctgcttc

SEQ ID NO: 131887 - DNA, 25 bp, Homo sapien
cgtcaattgcgcctccagggttcca

SEQ ID NO: 131888 - DNA, 25 bp, Homo sapien
gctgctcggagagggactcttattc

SEQ ID NO: 131889 - DNA, 25 bp, Homo sapien
agcccgaggaggcaaacttcatttg

SEQ ID NO: 131890 - DNA, 25 bp, Homo sapien
ctttcctggagggtagaattgcgtc

SEQ ID NO: 131891 - DNA, 25 bp, Homo sapien
gctgcttccatttaggaccttgtga

SEQ ID NO: 131892 - DNA, 25 bp, Homo sapien
attgcgtccgattggccttcagttc

SEQ ID NO: 131893 - DNA, 25 bp, Homo sapien
ctcatagcttccacggtttcgcagg

SEQ ID NO: 131894 - DNA, 25 bp, Homo sapien
ggggactcaccgttacaccactgga

SEQ ID NO: 131895 - DNA, 25 bp, Homo sapien
gcctggggaaacttcggtctgcaga

SEQ ID NO: 131896 - DNA, 25 bp, Homo sapien
ctcgactgtcccatttcaggagaaa

SEQ ID NO: 131897 - DNA, 25 bp, Homo sapien
catcaatgaagtcgcggttggcttc

SEQ ID NO: 131898 - DNA, 25 bp, Homo sapien
cgaggctggtgttcagcccaacaaa

SEQ ID NO: 131899 - DNA, 25 bp, Homo sapien
aaacctttgccggaggctcggatcg

SEQ ID NO: 131900 - DNA, 25 bp, Homo sapien
ttccgaaactgacacccggcggtgc

SEQ ID NO: 131901 - DNA, 25 bp, Homo sapien
atagtttcaaattccgcgctgtgca

SEQ ID NO: 131902 - DNA, 25 bp, Homo sapien
tttttaagccatgacacacacgtcg

SEQ ID NO: 131903 - DNA, 25 bp, Homo sapien
ctgcccaagacaggttgacagatta

SEQ ID NO: 131904 - DNA, 25 bp, Homo sapien
cacacgtcgaagcagggttcaaatc

SEQ ID NO: 131905 - DNA, 25 bp, Homo sapien
tgcgctggtgacataaagggactcg

SEQ ID NO: 131906 - DNA, 25 bp, Homo sapien
tctcacattcggtggcccgagtcgc

SEQ ID NO: 131907 - DNA, 25 bp, Homo sapien
cggtcgcctttgtaacaggtccatg

SEQ ID NO: 131908 - DNA, 25 bp, Homo sapien
tacctctttgcaagcgctgcgctgg

SEQ ID NO: 131909 - DNA, 25 bp, Homo sapien
gcctcagtccgaaaggcggatcgcc

SEQ ID NO: 131910 - DNA, 25 bp, Homo sapien
ctcggtggtgaaggctgtgcctaca

SEQ ID NO: 131911 - DNA, 25 bp, Homo sapien
tgccaggggtttggcttcttaccca

SEQ ID NO: 131912 - DNA, 25 bp, Homo sapien
gcagatttgaggaccgagccttctt

SEQ ID NO: 131913 - DNA, 25 bp, Homo sapien
accgagccttcttgatgctgacggc

SEQ ID NO: 131914 - DNA, 25 bp, Homo sapien
tcagacatggggttaaaaatccatg

SEQ ID NO: 131915 - DNA, 25 bp, Homo sapien
taagccctacgtggtccaggctctc

SEQ ID NO: 131916 - DNA, 25 bp, Homo sapien
aatccatgggcctgtaagccctacg

SEQ ID NO: 131917 - DNA, 25 bp, Homo sapien
gctaatggtttctcatcagacatgg

SEQ ID NO: 131918 - DNA, 25 bp, Homo sapien
ccttatgccttgagcctgtgcgtta

SEQ ID NO: 131919 - DNA, 25 bp, Homo sapien
caaaaggcgcttttcctggagctgg

SEQ ID NO: 131920 - DNA, 25 bp, Homo sapien
tgcggcttcgggaccgtacgcaaaa

SEQ ID NO: 131921 - DNA, 25 bp, Homo sapien
agcgcgctggaaacgccacatcgtg

SEQ ID NO: 131922 - DNA, 25 bp, Homo sapien
tgcttatgaccctcgcagccacagg

SEQ ID NO: 131923 - DNA, 25 bp, Homo sapien
aggggcttgatcagtgcacttagtc

SEQ ID NO: 131924 - DNA, 25 bp, Homo sapien
acttgtccagagcagccacttattg

SEQ ID NO: 131925 - DNA, 25 bp, Homo sapien
cccacttaggtgaacatttcggacg

SEQ ID NO: 131926 - DNA, 25 bp, Homo sapien
cgatcgtggagcagagtcactctct

SEQ ID NO: 131927 - DNA, 25 bp, Homo sapien
agaagagccgccctccggaacgcgg

SEQ ID NO: 131928 - DNA, 25 bp, Homo sapien
gaagactcccgagacccattcgact

SEQ ID NO: 131929 - DNA, 25 bp, Homo sapien
cccgctgctttaggaagcgatcgtg

SEQ ID NO: 131930 - DNA, 25 bp, Homo sapien
cctttctcggggtgcccattcagcg

SEQ ID NO: 131931 - DNA, 25 bp, Homo sapien
aagctatggggacgcgccctttctc

SEQ ID NO: 131932 - DNA, 25 bp, Homo sapien
gtctcattagcgatgcggactctcg

SEQ ID NO: 131933 - DNA, 25 bp, Homo sapien
ctcccggagcgtgaagaagagccgc

SEQ ID NO: 131934 - DNA, 25 bp, Homo sapien
tcccggcgcctactctggcttggaa

SEQ ID NO: 131935 - DNA, 25 bp, Homo sapien
tactctggcttggaagcgcgggccc

SEQ ID NO: 131936 - DNA, 25 bp, Homo sapien
cctactctggcttggaagcgcgggc

SEQ ID NO: 131937 - DNA, 25 bp, Homo sapien
ttcccggcgcctactctggcttgga

SEQ ID NO: 131938 - DNA, 25 bp, Homo sapien
cgcctactctggcttggaagcgcgg

SEQ ID NO: 131939 - DNA, 25 bp, Homo sapien
ggcgcctactctggcttggaagcgc

SEQ ID NO: 131940 - DNA, 25 bp, Homo sapien
cccggcgcctactctggcttggaag

SEQ ID NO: 131941 - DNA, 25 bp, Homo sapien
cggcgcctactctggcttggaagcg

SEQ ID NO: 131942 - DNA, 25 bp, Homo sapien
cgtccttagcccgaggtcccagcca

SEQ ID NO: 131943 - DNA, 25 bp, Homo sapien
ggcccgaggctgctcaccaggcgcc

SEQ ID NO: 131944 - DNA, 25 bp, Homo sapien
gatgagcacttggcccgaggctgct

SEQ ID NO: 131945 - DNA, 25 bp, Homo sapien
cagccgggatgagcacttggcccga

SEQ ID NO: 131946 - DNA, 25 bp, Homo sapien
atcccagtttaaccgcgcctgcagt

SEQ ID NO: 131947 - DNA, 25 bp, Homo sapien
ggcgtgcaccatcccagtttaaccg

SEQ ID NO: 131948 - DNA, 25 bp, Homo sapien
agcggcgtgcaccatcccagtttaa

SEQ ID NO: 131949 - DNA, 25 bp, Homo sapien
cgggagagcggcgtgcaccatccca

SEQ ID NO: 131950 - DNA, 25 bp, Homo sapien
accggctcccgatcagggtcctgaa

SEQ ID NO: 131951 - DNA, 25 bp, Homo sapien
gctgcctcctccaaatgagcgattc

SEQ ID NO: 131952 - DNA, 25 bp, Homo sapien
tcgcccttcggagctccgtgttttc

SEQ ID NO: 131953 - DNA, 25 bp, Homo sapien
ttcgcccgctggatctaacccaagg

SEQ ID NO: 131954 - DNA, 25 bp, Homo sapien
gtcctgaagatgctgagcgctcaca

SEQ ID NO: 131955 - DNA, 25 bp, Homo sapien
ccacgccgggctgttttctttgaag

SEQ ID NO: 131956 - DNA, 25 bp, Homo sapien
cagtttccagccaggagttggtctc

SEQ ID NO: 131957 - DNA, 25 bp, Homo sapien
ctcggtgcgacacccaagtctggtc

SEQ ID NO: 131958 - DNA, 25 bp, Homo sapien
cggcaccttggttcttctcatcttc

SEQ ID NO: 131959 - DNA, 25 bp, Homo sapien
gatgcgacgatgactcaagaccttg

SEQ ID NO: 131960 - DNA, 25 bp, Homo sapien
ttgaagccattctcagtccggagga

SEQ ID NO: 131961 - DNA, 25 bp, Homo sapien
ggcctggctcgtccattttcttgag

SEQ ID NO: 131962 - DNA, 25 bp, Homo sapien
cctgaccagagggtaaaggcacctg

SEQ ID NO: 131963 - DNA, 25 bp, Homo sapien
tctgcgctgtttttggttgtccaca

SEQ ID NO: 131964 - DNA, 25 bp, Homo sapien
cacctgctgagagggttgcttctca

SEQ ID NO: 131965 - DNA, 25 bp, Homo sapien
gccaatgggacgctctgcaaaaccg

SEQ ID NO: 131966 - DNA, 25 bp, Homo sapien
tgacggttttcttgctcgtgggctc

SEQ ID NO: 131967 - DNA, 25 bp, Homo sapien
tgcagtcagtcaccatagttccaga

SEQ ID NO: 131968 - DNA, 25 bp, Homo sapien
cacgcacgcacagctgaactttgca

SEQ ID NO: 131969 - DNA, 25 bp, Homo sapien
gccgccacggtaaaataagcgcctc

SEQ ID NO: 131970 - DNA, 25 bp, Homo sapien
acgcaactgcagatcggtagccgga

SEQ ID NO: 131971 - DNA, 25 bp, Homo sapien
tctcgcgtgaattgatggcgtcatc

SEQ ID NO: 131972 - DNA, 25 bp, Homo sapien
gcgcttgaccctctctcggaacggg

SEQ ID NO: 131973 - DNA, 25 bp, Homo sapien
agttccagatcattcagcgttcagg

SEQ ID NO: 131974 - DNA, 25 bp, Homo sapien
gctttgctcttcacgtctcctttga

SEQ ID NO: 131975 - DNA, 25 bp, Homo sapien
ggaatcgttgtcacctcatccagga

SEQ ID NO: 131976 - DNA, 25 bp, Homo sapien
gcctcacgatcgtgctgtctcgttg

SEQ ID NO: 131977 - DNA, 25 bp, Homo sapien
cagaccctctgagatggcgcgcttg

SEQ ID NO: 131978 - DNA, 25 bp, Homo sapien
cactgtgacttcagattgccgttca

SEQ ID NO: 131979 - DNA, 25 bp, Homo sapien
tggaagctccacttcacggttggtg

SEQ ID NO: 131980 - DNA, 25 bp, Homo sapien
tctggcgtcctcgaacatgctgcga

SEQ ID NO: 131981 - DNA, 25 bp, Homo sapien
gacgtttgccgtcttccgaagcttc

SEQ ID NO: 131982 - DNA, 25 bp, Homo sapien
cctcgggaaaatgacttagtgccta

SEQ ID NO: 131983 - DNA, 25 bp, Homo sapien
agcctccttaccttgagtctgttag

SEQ ID NO: 131984 - DNA, 25 bp, Homo sapien
agcaatgattggttcacacggcgca

SEQ ID NO: 131985 - DNA, 25 bp, Homo sapien
taggctccatttccaggttcgcggg

SEQ ID NO: 131986 - DNA, 25 bp, Homo sapien
ttctgcctcacaaaagtcccttggg

SEQ ID NO: 131987 - DNA, 25 bp, Homo sapien
cccgagtataggatgcgtttctgcc

SEQ ID NO: 131988 - DNA, 25 bp, Homo sapien
agtgcccaagaaatgccagtgccgc

SEQ ID NO: 131989 - DNA, 25 bp, Homo sapien
agcgtctcacctgctaagtgcccaa

SEQ ID NO: 131990 - DNA, 25 bp, Homo sapien
ggctggccttgtcccttcaattggg

SEQ ID NO: 131991 - DNA, 25 bp, Homo sapien
tgagtaccctaccaggccagttccg

SEQ ID NO: 131992 - DNA, 25 bp, Homo sapien
ggccttctgcctaacggcaccgtta

SEQ ID NO: 131993 - DNA, 25 bp, Homo sapien
cttcagagatttctggacaggcctg

SEQ ID NO: 131994 - DNA, 25 bp, Homo sapien
tgctcaggaaagatcgacgctcgtg

SEQ ID NO: 131995 - DNA, 25 bp, Homo sapien
tggtcctaaccactacggtcgcgtc

SEQ ID NO: 131996 - DNA, 25 bp, Homo sapien
tctccggatttacctggctggcctt

SEQ ID NO: 131997 - DNA, 25 bp, Homo sapien
gcaccgttaccctgtgagtacccta

SEQ ID NO: 131998 - DNA, 25 bp, Homo sapien
ttcactcaccactgtgccaggcgga

SEQ ID NO: 131999 - DNA, 25 bp, Homo sapien
tctattctccgggagtccagctagg

SEQ ID NO: 132000 - DNA, 25 bp, Homo sapien
aggcctgcggcaagaaccggctcaa

SEQ ID NO: 132001 - DNA, 25 bp, Homo sapien
cgagagcggcagtctgcacaacagc

SEQ ID NO: 132002 - DNA, 25 bp, Homo sapien
agaaggagagccatcgccgctcgta

SEQ ID NO: 132003 - DNA, 25 bp, Homo sapien
ggctgcatgaagaccggactctgga

SEQ ID NO: 132004 - DNA, 25 bp, Homo sapien
acttcctgtacttggccatgtgggc

SEQ ID NO: 132005 - DNA, 25 bp, Homo sapien
tctggaagagcgaaactaccgtcta

SEQ ID NO: 132006 - DNA, 25 bp, Homo sapien
cagcaaccgtgaggcagcaagaagt

SEQ ID NO: 132007 - DNA, 25 bp, Homo sapien
gagattgccctcgtcgctgaaggta

SEQ ID NO: 132008 - DNA, 25 bp, Homo sapien
gccgcggaagccttcagagactcct

SEQ ID NO: 132009 - DNA, 25 bp, Homo sapien
gaggggacacttcaaagggttgcac

SEQ ID NO: 132010 - DNA, 25 bp, Homo sapien
ctctgcgaatagtgcgagtcttcca

SEQ ID NO: 132011 - DNA, 25 bp, Homo sapien
agcacaccagctggctctgcgaata

SEQ ID NO: 132012 - DNA, 25 bp, Homo sapien
tcctgggtctgcaacagcaaccgtg

SEQ ID NO: 132013 - DNA, 25 bp, Homo sapien
tcgctgaaggtagtggtaaggaccc

SEQ ID NO: 132014 - DNA, 25 bp, Homo sapien
gcttgggacccgctatccgctcttt

SEQ ID NO: 132015 - DNA, 25 bp, Homo sapien
acccaggctgccgactgtacttgtg

SEQ ID NO: 132016 - DNA, 25 bp, Homo sapien
ccgtgagcatcagcgagtaagagtg

SEQ ID NO: 132017 - DNA, 25 bp, Homo sapien
tcaggatgctttttacccaacaagg

SEQ ID NO: 132018 - DNA, 25 bp, Homo sapien
ccgaggcatattcccactgggcagt

SEQ ID NO: 132019 - DNA, 25 bp, Homo sapien
ggtctgtctctgctccgaggcatat

SEQ ID NO: 132020 - DNA, 25 bp, Homo sapien
ttagccacccggctagccgcgtttg

SEQ ID NO: 132021 - DNA, 25 bp, Homo sapien
gctgaagaaggctgccaagcggacc

SEQ ID NO: 132022 - DNA, 25 bp, Homo sapien
gccagccgagaccattagggacatg

SEQ ID NO: 132023 - DNA, 25 bp, Homo sapien
tcgcggtgcagatcccgcaggtcca

SEQ ID NO: 132024 - DNA, 25 bp, Homo sapien
ccaggaacttgtcgaggccgagcag

SEQ ID NO: 132025 - DNA, 25 bp, Homo sapien
ccggcttactctcgaagggtccagc

SEQ ID NO: 132026 - DNA, 25 bp, Homo sapien
ggcgggcgcatcgagaatctaatct

SEQ ID NO: 132027 - DNA, 25 bp, Homo sapien
tggtgacgataacactccagaagcg

SEQ ID NO: 132028 - DNA, 25 bp, Homo sapien
caggccactttaaggcttccggcca

SEQ ID NO: 132029 - DNA, 25 bp, Homo sapien
cgacacggaggtggcgtacttctcc

SEQ ID NO: 132030 - DNA, 25 bp, Homo sapien
aggagtcccatcaccaggtcggctg

SEQ ID NO: 132031 - DNA, 25 bp, Homo sapien
tacctacccgtcgagccgttggcaa

SEQ ID NO: 132032 - DNA, 25 bp, Homo sapien
agctggcgcgtagccaccacgaaaa

SEQ ID NO: 132033 - DNA, 25 bp, Homo sapien
cccgcgcgtagacgaagagcatcac

SEQ ID NO: 132034 - DNA, 25 bp, Homo sapien
acagcagcacgtagggcatgttgga

SEQ ID NO: 132035 - DNA, 25 bp, Homo sapien
tacgcgccaccactggctcatgatg

SEQ ID NO: 132036 - DNA, 25 bp, Homo sapien
tcatgatgggcgcaaacgacaccgc

SEQ ID NO: 132037 - DNA, 25 bp, Homo sapien
ttggtgaccagtgcgccgtaacgca

SEQ ID NO: 132038 - DNA, 25 bp, Homo sapien
cttcccgaagcacgccgagttttgt

SEQ ID NO: 132039 - DNA, 25 bp, Homo sapien
cgcgctctgactgaggttcggatct

SEQ ID NO: 132040 - DNA, 25 bp, Homo sapien
ggatcccacgtggaagcagcgtcct

SEQ ID NO: 132041 - DNA, 25 bp, Homo sapien
caagggcgccgtgattggaaagaac

SEQ ID NO: 132042 - DNA, 25 bp, Homo sapien
gagtgcgtcttccagacccgagtta

SEQ ID NO: 132043 - DNA, 25 bp, Homo sapien
ctctttctgttaggtgtcagacagc

SEQ ID NO: 132044 - DNA, 25 bp, Homo sapien
cctggcctggtgtttttatgggatg

SEQ ID NO: 132045 - DNA, 25 bp, Homo sapien
agctgacacctaacaaacacgcacg

SEQ ID NO: 132046 - DNA, 25 bp, Homo sapien
ggatctctgctgctccgacagttga

SEQ ID NO: 132047 - DNA, 25 bp, Homo sapien
cccaggagcggtcgcaaatgcaaca

SEQ ID NO: 132048 - DNA, 25 bp, Homo sapien
cgcgcgcgagagaagagagtattct

SEQ ID NO: 132049 - DNA, 25 bp, Homo sapien
gcctggccttaaagcggtcgtggaa

SEQ ID NO: 132050 - DNA, 25 bp, Homo sapien
gcagaatatccagtcgtagccacga

SEQ ID NO: 132051 - DNA, 25 bp, Homo sapien
ttcgctttccgcctctcacagtagg

SEQ ID NO: 132052 - DNA, 25 bp, Homo sapien
gcgaccctgcgcagaaaaccaaatt

SEQ ID NO: 132053 - DNA, 25 bp, Homo sapien
tgctagactccaaggaagacgtttc

SEQ ID NO: 132054 - DNA, 25 bp, Homo sapien
gaggccagcgcgtccaaaacctctt

SEQ ID NO: 132055 - DNA, 25 bp, Homo sapien
gctgccggaagctcctccatattac

SEQ ID NO: 132056 - DNA, 25 bp, Homo sapien
gagttccatcgcttggggctcacca

SEQ ID NO: 132057 - DNA, 25 bp, Homo sapien
cggtgccaggcatatagttcatttt

SEQ ID NO: 132058 - DNA, 25 bp, Homo sapien
gcccgggactcattctacaagcttc

SEQ ID NO: 132059 - DNA, 25 bp, Homo sapien
acgcccggattgagctcagaacaca

SEQ ID NO: 132060 - DNA, 25 bp, Homo sapien
ctccctcttaaggaacacggtgtct

SEQ ID NO: 132061 - DNA, 25 bp, Homo sapien
tcactgtcaatgtcctcgatgaggc

SEQ ID NO: 132062 - DNA, 25 bp, Homo sapien
tatcccgaggatcattccgactttc

SEQ ID NO: 132063 - DNA, 25 bp, Homo sapien
agaagtgtccttctggtgcctgcgg

SEQ ID NO: 132064 - DNA, 25 bp, Homo sapien
cccgccctacgaggcagcttagaag

SEQ ID NO: 132065 - DNA, 25 bp, Homo sapien
aatggagccgaaagccggcgtctgc

SEQ ID NO: 132066 - DNA, 25 bp, Homo sapien
ggcaccctgtgaaccctgtggtctg

SEQ ID NO: 132067 - DNA, 25 bp, Homo sapien
ctgccgtcacggatactagaaactg

SEQ ID NO: 132068 - DNA, 25 bp, Homo sapien
ttggagaggtagaaacagctggtca

SEQ ID NO: 132069 - DNA, 25 bp, Homo sapien
cggacactcgaaactgatcttgaag

SEQ ID NO: 132070 - DNA, 25 bp, Homo sapien
ctcggtgcccattattctccaggtg

SEQ ID NO: 132071 - DNA, 25 bp, Homo sapien
tcaggcgcccgttattctccaggtg

SEQ ID NO: 132072 - DNA, 25 bp, Homo sapien
gccaggcgcccgttattctccaggt

SEQ ID NO: 132073 - DNA, 25 bp, Homo sapien
tgtcaggcgcccattattctccagg

SEQ ID NO: 132074 - DNA, 25 bp, Homo sapien
caagcgcccgttattctccaggtgg

SEQ ID NO: 132075 - DNA, 25 bp, Homo sapien
gtcaggcgcccgttattctccaggt

SEQ ID NO: 132076 - DNA, 25 bp, Homo sapien
tcaggcgcccgttattctccaggtc

SEQ ID NO: 132077 - DNA, 25 bp, Homo sapien
ctgttattctccaggtgcggtgcca

SEQ ID NO: 132078 - DNA, 25 bp, Homo sapien
tggggaaatactccgcctccacgta

SEQ ID NO: 132079 - DNA, 25 bp, Homo sapien
ccggccgtggatctttcttacagga

SEQ ID NO: 132080 - DNA, 25 bp, Homo sapien
gcgtacggtccatcatcagcagctc

SEQ ID NO: 132081 - DNA, 25 bp, Homo sapien
ggttccggtagagccacatctcctc

SEQ ID NO: 132082 - DNA, 25 bp, Homo sapien
caaacatcggcttggtggggaaata

SEQ ID NO: 132083 - DNA, 25 bp, Homo sapien
ggatcttaaacactcgagccctagg

SEQ ID NO: 132084 - DNA, 25 bp, Homo sapien
gagcgcccgggaaaacgttgtctca

SEQ ID NO: 132085 - DNA, 25 bp, Homo sapien
ctccggctggatgagtctctggaac

SEQ ID NO: 132086 - DNA, 25 bp, Homo sapien
ggtaaaactgggatcggcgcgttca

SEQ ID NO: 132087 - DNA, 25 bp, Homo sapien
gctgattaaagaacaacgcgcaacc

SEQ ID NO: 132088 - DNA, 25 bp, Homo sapien
ggtgactcggctctctagctcttaa

SEQ ID NO: 132089 - DNA, 25 bp, Homo sapien
ggttagaagcgaccctcgcacggtc

SEQ ID NO: 132090 - DNA, 25 bp, Homo sapien
tctcccgtcctacggctgtcaggga

SEQ ID NO: 132091 - DNA, 25 bp, Homo sapien
ccggtagggtctgcatttggaaagc

SEQ ID NO: 132092 - DNA, 25 bp, Homo sapien
cccggttgcaagcagtaggagaccc

SEQ ID NO: 132093 - DNA, 25 bp, Homo sapien
actgtacgtgggagagtgacacaca

SEQ ID NO: 132094 - DNA, 25 bp, Homo sapien
attaaccgccgcctcaggtgtcgtc

SEQ ID NO: 132095 - DNA, 25 bp, Homo sapien
ttcggcgatgtaaacgcgactttgc

SEQ ID NO: 132096 - DNA, 25 bp, Homo sapien
ttggcgatgtcgtcactcagagtga

SEQ ID NO: 132097 - DNA, 25 bp, Homo sapien
agagacttggcttcgggcccttcta

SEQ ID NO: 132098 - DNA, 25 bp, Homo sapien
ctcatcagagcatgatccaggcttc

SEQ ID NO: 132099 - DNA, 25 bp, Homo sapien
cgatcatccacgagggtcgtcgttc

SEQ ID NO: 132100 - DNA, 25 bp, Homo sapien
tggcagaaaaacgtcaccttcgggc

SEQ ID NO: 132101 - DNA, 25 bp, Homo sapien
agcacagcgcgaactctgaagctcg

SEQ ID NO: 132102 - DNA, 25 bp, Homo sapien
tcctgcgttagaggacggacgagcc

SEQ ID NO: 132103 - DNA, 25 bp, Homo sapien
caagcccaagacgagggcggtcacg

SEQ ID NO: 132104 - DNA, 25 bp, Homo sapien
ctgagggaaccgctctgtccagagc

SEQ ID NO: 132105 - DNA, 25 bp, Homo sapien
agcgcttaagaagcaagacttgccc

SEQ ID NO: 132106 - DNA, 25 bp, Homo sapien
ccgacggcagcgttagcaaggacca

SEQ ID NO: 132107 - DNA, 25 bp, Homo sapien
gatgctgaagggacatcaatcctcc

SEQ ID NO: 132108 - DNA, 25 bp, Homo sapien
ccctctgtcggaaaggcaactcaca

SEQ ID NO: 132109 - DNA, 25 bp, Homo sapien
cggcaagtcggtgacaagcccaaga

SEQ ID NO: 132110 - DNA, 25 bp, Homo sapien
ctgcgcaatccagaaagcacccgga

SEQ ID NO: 132111 - DNA, 25 bp, Homo sapien
caagatgcctctttactgcgcaatc

SEQ ID NO: 132112 - DNA, 25 bp, Homo sapien
ggatgaaccgttcgcgagtggcacc

SEQ ID NO: 132113 - DNA, 25 bp, Homo sapien
gcagctccagctataacacaaggga

SEQ ID NO: 132114 - DNA, 25 bp, Homo sapien
cacaagggagagaaagcaacgcttt

SEQ ID NO: 132115 - DNA, 25 bp, Homo sapien
tttggttccagaaacttccatcgtc

SEQ ID NO: 132116 - DNA, 25 bp, Homo sapien
ttccatcgtcaaggccagttctggc

SEQ ID NO: 132117 - DNA, 25 bp, Homo sapien
tctagcggatgaaccgttcgcgagt

SEQ ID NO: 132118 - DNA, 25 bp, Homo sapien
aatgcgctacgaggggtctcggtcc

SEQ ID NO: 132119 - DNA, 25 bp, Homo sapien
ggcggcgcctcactttccttgcaga

SEQ ID NO: 132120 - DNA, 25 bp, Homo sapien
gggttccgcggcttttcaagcagcg

SEQ ID NO: 132121 - DNA, 25 bp, Homo sapien
actttccttgcagaccgggctccat

SEQ ID NO: 132122 - DNA, 25 bp, Homo sapien
tgcccgactgcagcacgggtaccgt

SEQ ID NO: 132123 - DNA, 25 bp, Homo sapien
agctcggaccggagaaaagtccttg

SEQ ID NO: 132124 - DNA, 25 bp, Homo sapien
cgaggtcgccgcaatgcgctacgag

SEQ ID NO: 132125 - DNA, 25 bp, Homo sapien
gctcttacctcgctcggcgtggagg

SEQ ID NO: 132126 - DNA, 25 bp, Homo sapien
aaacatccaaagtgagccgagctgg

SEQ ID NO: 132127 - DNA, 25 bp, Homo sapien
tcgcgcacatctggcttcaatgccg

SEQ ID NO: 132128 - DNA, 25 bp, Homo sapien
ctgtattcagctagtcagcgttccc

SEQ ID NO: 132129 - DNA, 25 bp, Homo sapien
gcggctttcccgctgtattcagcta

SEQ ID NO: 132130 - DNA, 25 bp, Homo sapien
cccagaacaaatggcggctttcccg

SEQ ID NO: 132131 - DNA, 25 bp, Homo sapien
aatcgtgcgagtttaaaaacatcca

SEQ ID NO: 132132 - DNA, 25 bp, Homo sapien
atctggcttcaatgccggccgccag

SEQ ID NO: 132133 - DNA, 25 bp, Homo sapien
cggtgttcggaagaaaatcgtgcga

SEQ ID NO: 132134 - DNA, 25 bp, Homo sapien
tggcggcatctgaagccacctcctt

SEQ ID NO: 132135 - DNA, 25 bp, Homo sapien
cggcctcgtccaagcagaaaacgca

SEQ ID NO: 132136 - DNA, 25 bp, Homo sapien
caagttctgcgccatgggaggctcc

SEQ ID NO: 132137 - DNA, 25 bp, Homo sapien
gggccctgcaatccgcggagaagtt

SEQ ID NO: 132138 - DNA, 25 bp, Homo sapien
aggggctccgcatctccaggcggca

SEQ ID NO: 132139 - DNA, 25 bp, Homo sapien
cccgtgccacctaggagtttccttg

SEQ ID NO: 132140 - DNA, 25 bp, Homo sapien
agtacacgctgtactggggagacaa

SEQ ID NO: 132141 - DNA, 25 bp, Homo sapien
cacggagaccgcgtgagtcccagag

SEQ ID NO: 132142 - DNA, 25 bp, Homo sapien
cccgtttcgctaggagagttccgca

SEQ ID NO: 132143 - DNA, 25 bp, Homo sapien
tcaggatcttctgtcctcccgtggg

SEQ ID NO: 132144 - DNA, 25 bp, Homo sapien
ccacactggagcaacgtcactgatc

SEQ ID NO: 132145 - DNA, 25 bp, Homo sapien
gctggcctcggtcactttctctaag

SEQ ID NO: 132146 - DNA, 25 bp, Homo sapien
ctgtcaccggttccctccattttga

SEQ ID NO: 132147 - DNA, 25 bp, Homo sapien
agccgagaccaaatccttgagtttc

SEQ ID NO: 132148 - DNA, 25 bp, Homo sapien
gtttcaggcaagtacacggcgtccc

SEQ ID NO: 132149 - DNA, 25 bp, Homo sapien
cgtgtgcgtccgaaagttcaggatc

SEQ ID NO: 132150 - DNA, 25 bp, Homo sapien
gctgggttttgctttaatgcgaaac

SEQ ID NO: 132151 - DNA, 25 bp, Homo sapien
ggctccgcggagcattgtactcaca

SEQ ID NO: 132152 - DNA, 25 bp, Homo sapien
ttggcaggcagacccagaaatccct

SEQ ID NO: 132153 - DNA, 25 bp, Homo sapien
cgcagggctgaatacgccggtccta

SEQ ID NO: 132154 - DNA, 25 bp, Homo sapien
gctgagctgcattttctcacgtttg

SEQ ID NO: 132155 - DNA, 25 bp, Homo sapien
acgtttgcagcagcgaaacttctct

SEQ ID NO: 132156 - DNA, 25 bp, Homo sapien
cgaaacttctctgcgggttctggcg

SEQ ID NO: 132157 - DNA, 25 bp, Homo sapien
aatacgccggtcctagtggctgaca

SEQ ID NO: 132158 - DNA, 25 bp, Homo sapien
gtatatgcagaggtatgccaggctc

SEQ ID NO: 132159 - DNA, 25 bp, Homo sapien
gccctcggaacactttctaactctg

SEQ ID NO: 132160 - DNA, 25 bp, Homo sapien
tctcatttaggagggtttgcaggtc

SEQ ID NO: 132161 - DNA, 25 bp, Homo sapien
tttgcaggtccagagtaaagtcact

SEQ ID NO: 132162 - DNA, 25 bp, Homo sapien
aggatgattagacctcagctgcgga

SEQ ID NO: 132163 - DNA, 25 bp, Homo sapien
ccggggctgaaaagctacataccca

SEQ ID NO: 132164 - DNA, 25 bp, Homo sapien
ctggaggagcgtaaaggaacaagac

SEQ ID NO: 132165 - DNA, 25 bp, Homo sapien
tgagaccgcacagttcgcgcctggt

SEQ ID NO: 132166 - DNA, 25 bp, Homo sapien
accgcgagtgggttcacacgctcat

SEQ ID NO: 132167 - DNA, 25 bp, Homo sapien
gcgtgtcacagcaagcgggttcaca

SEQ ID NO: 132168 - DNA, 25 bp, Homo sapien
gcatgtcaccgcgagtgggttcaca

SEQ ID NO: 132169 - DNA, 25 bp, Homo sapien
ccgcgagtggattcacacgctcatc

SEQ ID NO: 132170 - DNA, 25 bp, Homo sapien
ccgcgagtggattcacagcctcatc

SEQ ID NO: 132171 - DNA, 25 bp, Homo sapien
tcaccgcgagtggattcacagcctc

SEQ ID NO: 132172 - DNA, 25 bp, Homo sapien
acgtgtcaccgcgagtggactcaca

SEQ ID NO: 132173 - DNA, 25 bp, Homo sapien
accgcgagtgggttcacagcctcat

SEQ ID NO: 132174 - DNA, 25 bp, Homo sapien
ggatttttccctacgtcagcgcagc

SEQ ID NO: 132175 - DNA, 25 bp, Homo sapien
agaaatcctattctcgcgccgggga

SEQ ID NO: 132176 - DNA, 25 bp, Homo sapien
agtgctgagaggaacctgcggaatc

SEQ ID NO: 132177 - DNA, 25 bp, Homo sapien
tgccaccgccggtttagaaatccta

SEQ ID NO: 132178 - DNA, 25 bp, Homo sapien
tgcgttctccaatcggatccgtcga

SEQ ID NO: 132179 - DNA, 25 bp, Homo sapien
gctcctccttcttttgcgccgaatg

SEQ ID NO: 132180 - DNA, 25 bp, Homo sapien
ccaactagaaaaggtcgagcagacg

SEQ ID NO: 132181 - DNA, 25 bp, Homo sapien
ctggccgcacagaagtaagtaacta

SEQ ID NO: 132182 - DNA, 25 bp, Homo sapien
atgttccgcctctggttgctgctgg

SEQ ID NO: 132183 - DNA, 25 bp, Homo sapien
agtggctccagcaaccacgcggctg

SEQ ID NO: 132184 - DNA, 25 bp, Homo sapien
atgttttagcctcggggcgcacgct

SEQ ID NO: 132185 - DNA, 25 bp, Homo sapien
tgttccggacgctaaacaccgagag

SEQ ID NO: 132186 - DNA, 25 bp, Homo sapien
gcctccggagaacgctgtcccatga

SEQ ID NO: 132187 - DNA, 25 bp, Homo sapien
acgctgtcccatgaacgtgcgggga

SEQ ID NO: 132188 - DNA, 25 bp, Homo sapien
tcctggcgtcaagacccggtgagcc

SEQ ID NO: 132189 - DNA, 25 bp, Homo sapien
agaccctgacactagtccgggcgct

SEQ ID NO: 132190 - DNA, 25 bp, Homo sapien
caccgggctgacctggcaaaacttt

SEQ ID NO: 132191 - DNA, 25 bp, Homo sapien
gtaaccagctcccttctagcgtgag

SEQ ID NO: 132192 - DNA, 25 bp, Homo sapien
ttggcgtctctgaaaacctctggta

SEQ ID NO: 132193 - DNA, 25 bp, Homo sapien
acggcaccctgagaggagaagcgca

SEQ ID NO: 132194 - DNA, 25 bp, Homo sapien
tcccgttgcagcaccggtacagaca

SEQ ID NO: 132195 - DNA, 25 bp, Homo sapien
actggccaagcctgcggaacttgtc

SEQ ID NO: 132196 - DNA, 25 bp, Homo sapien
ggtccgtggttgaactttgtctcca

SEQ ID NO: 132197 - DNA, 25 bp, Homo sapien
tagcgcataactggacggcttgaac

SEQ ID NO: 132198 - DNA, 25 bp, Homo sapien
cctgcagggctctttacttacgtgg

SEQ ID NO: 132199 - DNA, 25 bp, Homo sapien
ccgttgtccttggaacggctgcagc

SEQ ID NO: 132200 - DNA, 25 bp, Homo sapien
gcccaggcctgagaggatcagcaag

SEQ ID NO: 132201 - DNA, 25 bp, Homo sapien
ggatcagcaagagagacagcattgc

SEQ ID NO: 132202 - DNA, 25 bp, Homo sapien
acagcattgcgtagccggcggccca

SEQ ID NO: 132203 - DNA, 25 bp, Homo sapien
acccacagtgggctgcaccggagga

SEQ ID NO: 132204 - DNA, 25 bp, Homo sapien
acagggatggccgttgtccttggaa

SEQ ID NO: 132205 - DNA, 25 bp, Homo sapien
cgaaagcggaaaggcggcctcctct

SEQ ID NO: 132206 - DNA, 25 bp, Homo sapien
agaggtaccttttccgcgaggcaga

SEQ ID NO: 132207 - DNA, 25 bp, Homo sapien
tagcgatgcacttagcaattatctg

SEQ ID NO: 132208 - DNA, 25 bp, Homo sapien
cagacctttcggcagctcggaccaa

SEQ ID NO: 132209 - DNA, 25 bp, Homo sapien
ccctgccgagcagtagagcgaagct

SEQ ID NO: 132210 - DNA, 25 bp, Homo sapien
gctggagcacgctgaggattacacg

SEQ ID NO: 132211 - DNA, 25 bp, Homo sapien
ggattacacgttcctgtctctgcga

SEQ ID NO: 132212 - DNA, 25 bp, Homo sapien
tcggaccaactgtgctagcgatgca

SEQ ID NO: 132213 - DNA, 25 bp, Homo sapien
gtctctgcgaccagacctttcggca

SEQ ID NO: 132214 - DNA, 25 bp, Homo sapien
tcacgtagtcgtactcgctggccga

SEQ ID NO: 132215 - DNA, 25 bp, Homo sapien
agaactgcatgaccggctcgcacga

SEQ ID NO: 132216 - DNA, 25 bp, Homo sapien
cgatgtccgactggaagctcacgta

SEQ ID NO: 132217 - DNA, 25 bp, Homo sapien
aggcagccttaccttggggcttgga

SEQ ID NO: 132218 - DNA, 25 bp, Homo sapien
cacttaagcatctcgggccagtaga

SEQ ID NO: 132219 - DNA, 25 bp, Homo sapien
tagcccacgttgtggcacagccgca

SEQ ID NO: 132220 - DNA, 25 bp, Homo sapien
ggttgggcagcaccatcttcttgta

SEQ ID NO: 132221 - DNA, 25 bp, Homo sapien
ctcggggaacttgtcacacttaagc

SEQ ID NO: 132222 - DNA, 25 bp, Homo sapien
tgtccggaaaggtgttcattcagcg

SEQ ID NO: 132223 - DNA, 25 bp, Homo sapien
ctttttgcggcaggacgtaagtgac

SEQ ID NO: 132224 - DNA, 25 bp, Homo sapien
gtgtcctgtcctcgccatgaggccg

SEQ ID NO: 132225 - DNA, 25 bp, Homo sapien
tcagcgagactacagcagtggcaca

SEQ ID NO: 132226 - DNA, 25 bp, Homo sapien
gagaaccgggtacgcaacctggctc

SEQ ID NO: 132227 - DNA, 25 bp, Homo sapien
ctctggcgagggagagagactcacc

SEQ ID NO: 132228 - DNA, 25 bp, Homo sapien
tcccagacctgaggtaggaggccga

SEQ ID NO: 132229 - DNA, 25 bp, Homo sapien
acgctgccagttccagaccaagttc

SEQ ID NO: 132230 - DNA, 25 bp, Homo sapien
cccgacgctcttgggtagtgcaacc

SEQ ID NO: 132231 - DNA, 25 bp, Homo sapien
tccttgagcagtttgttcctctgtc

SEQ ID NO: 132232 - DNA, 25 bp, Homo sapien
ggtcccggcaagtccttgagcagtt

SEQ ID NO: 132233 - DNA, 25 bp, Homo sapien
cctgggcggaaactttgcgagagta

SEQ ID NO: 132234 - DNA, 25 bp, Homo sapien
cagcgtcgcccttgcgcgatgacgt

SEQ ID NO: 132235 - DNA, 25 bp, Homo sapien
gccgcctcaagtccttgggttgctg

SEQ ID NO: 132236 - DNA, 25 bp, Homo sapien
ctgtggagtgcctcgctgtctccca

SEQ ID NO: 132237 - DNA, 25 bp, Homo sapien
agtgcaacccggaccgcacagcgga

SEQ ID NO: 132238 - DNA, 25 bp, Homo sapien
tttagagcgtgctcagcggcctttc

SEQ ID NO: 132239 - DNA, 25 bp, Homo sapien
gcgacggttcgggagcaaataaata

SEQ ID NO: 132240 - DNA, 25 bp, Homo sapien
attcccgctgggaagctgtttctca

SEQ ID NO: 132241 - DNA, 25 bp, Homo sapien
acggtgccacgtggttcttcttgca

SEQ ID NO: 132242 - DNA, 25 bp, Homo sapien
tctccagtttcaggggacaccgtgg

SEQ ID NO: 132243 - DNA, 25 bp, Homo sapien
cccagcgacccaagaagcaagttgt

SEQ ID NO: 132244 - DNA, 25 bp, Homo sapien
ccgtccagttctgcttctctttaga

SEQ ID NO: 132245 - DNA, 25 bp, Homo sapien
tcggtgcactggtttgaagccactg

SEQ ID NO: 132246 - DNA, 25 bp, Homo sapien
tcctaacgcagggaagcgctccgct

SEQ ID NO: 132247 - DNA, 25 bp, Homo sapien
gggagccagtatcgggtcctaacgc

SEQ ID NO: 132248 - DNA, 25 bp, Homo sapien
tagtccgccagagggcgactccgcg

SEQ ID NO: 132249 - DNA, 25 bp, Homo sapien
cgcgcacgtcctgacgcagcttggg

SEQ ID NO: 132250 - DNA, 25 bp, Homo sapien
atttggagctgcctagcctcgcggt

SEQ ID NO: 132251 - DNA, 25 bp, Homo sapien
tcaaagtctccgacctccggggagc

SEQ ID NO: 132252 - DNA, 25 bp, Homo sapien
ctgcgccggcgtcaggaggcaccat

SEQ ID NO: 132253 - DNA, 25 bp, Homo sapien
acacacaagcgaacctccggggagg

SEQ ID NO: 132254 - DNA, 25 bp, Homo sapien
accacacctgcgatgagaaagaatg

SEQ ID NO: 132255 - DNA, 25 bp, Homo sapien
gagcaccgagaaggcggcgcggtgc

SEQ ID NO: 132256 - DNA, 25 bp, Homo sapien
gggcgtcagacgctgtgcgctccca

SEQ ID NO: 132257 - DNA, 25 bp, Homo sapien
acacctgcgatgagaaagaatgtga

SEQ ID NO: 132258 - DNA, 25 bp, Homo sapien
ggaaccacacctgcgatgagaaaga

SEQ ID NO: 132259 - DNA, 25 bp, Homo sapien
agggcgctcttcttccgccacttgg

SEQ ID NO: 132260 - DNA, 25 bp, Homo sapien
agcggcttgttgtactcgtcgtcct

SEQ ID NO: 132261 - DNA, 25 bp, Homo sapien
tccagcggcttgttgtactcgtcgt

SEQ ID NO: 132262 - DNA, 25 bp, Homo sapien
tcagctcggtttctgtagtcggctc

SEQ ID NO: 132263 - DNA, 25 bp, Homo sapien
ttggctcggtatgcatgttcagctc

SEQ ID NO: 132264 - DNA, 25 bp, Homo sapien
tgcatgttcagctcggtttccgtgg

SEQ ID NO: 132265 - DNA, 25 bp, Homo sapien
agcttggtttctgtggtcagctcgg

SEQ ID NO: 132266 - DNA, 25 bp, Homo sapien
tgtgcatgttcagctcggtgtgcgt

SEQ ID NO: 132267 - DNA, 25 bp, Homo sapien
cggtatgcatgttcagctcggtttc

SEQ ID NO: 132268 - DNA, 25 bp, Homo sapien
tcggtttccatggtcagctcggtgt

SEQ ID NO: 132269 - DNA, 25 bp, Homo sapien
gctcggtgtgcatgttcagctcggt

SEQ ID NO: 132270 - DNA, 25 bp, Homo sapien
ccgcctcgccagtcttggcccgtgt

SEQ ID NO: 132271 - DNA, 25 bp, Homo sapien
ggaggacccgtactcactgttgctg

SEQ ID NO: 132272 - DNA, 25 bp, Homo sapien
tgctcaggatgtccgtgatcccgtg

SEQ ID NO: 132273 - DNA, 25 bp, Homo sapien
cagccacgggcctgctcaggatgtc

SEQ ID NO: 132274 - DNA, 25 bp, Homo sapien
gtagtagaccccctgcgagctgagc

SEQ ID NO: 132275 - DNA, 25 bp, Homo sapien
tgtccgcccagcagttccgggtccg

SEQ ID NO: 132276 - DNA, 25 bp, Homo sapien
gtactcactgttgctgcactgccgc

SEQ ID NO: 132277 - DNA, 25 bp, Homo sapien
tcgggtactcgttcccagccttgga

SEQ ID NO: 132278 - DNA, 25 bp, Homo sapien
cagaccaggtgctcgccatccatgt

SEQ ID NO: 132279 - DNA, 25 bp, Homo sapien
tgaagaccagttatggcgccggcca

SEQ ID NO: 132280 - DNA, 25 bp, Homo sapien
atccaggaatcacgggtgggagtca

SEQ ID NO: 132281 - DNA, 25 bp, Homo sapien
gccaccgttcactctagcttgaagg

SEQ ID NO: 132282 - DNA, 25 bp, Homo sapien
gaaggtcccgcttcctcagggagga

SEQ ID NO: 132283 - DNA, 25 bp, Homo sapien
gaggagcactccctccagggtcgag

SEQ ID NO: 132284 - DNA, 25 bp, Homo sapien
tcccactgaatcgacagagagaatg

SEQ ID NO: 132285 - DNA, 25 bp, Homo sapien
ccgcttctctgtggcgatggtatcc

SEQ ID NO: 132286 - DNA, 25 bp, Homo sapien
ctcctactagcagccggagcgtgca

SEQ ID NO: 132287 - DNA, 25 bp, Homo sapien
ctcaggcccggagctagagcttcct

SEQ ID NO: 132288 - DNA, 25 bp, Homo sapien
gaatcggtcccagccgcgctgtgcg

SEQ ID NO: 132289 - DNA, 25 bp, Homo sapien
ccagccggagcagaggtgccaaagc

SEQ ID NO: 132290 - DNA, 25 bp, Homo sapien
cttccttgggccgtcaccgaatcgg

SEQ ID NO: 132291 - DNA, 25 bp, Homo sapien
gcttctgtgctacttggaaggttta

SEQ ID NO: 132292 - DNA, 25 bp, Homo sapien
tgtgtcccgaggacactcccgcaga

SEQ ID NO: 132293 - DNA, 25 bp, Homo sapien
tgggccgtcaccgaatcggtcccag

SEQ ID NO: 132294 - DNA, 25 bp, Homo sapien
ctggtttcatccgtgacgaccttga

SEQ ID NO: 132295 - DNA, 25 bp, Homo sapien
ctgctgcccggaaagctggtcccgc

SEQ ID NO: 132296 - DNA, 25 bp, Homo sapien
aggaggacaagctcccacccgtcgg

SEQ ID NO: 132297 - DNA, 25 bp, Homo sapien
caggcacgcctgtgcgccaggctga

SEQ ID NO: 132298 - DNA, 25 bp, Homo sapien
ggggagaggcagacataccacgaaa

SEQ ID NO: 132299 - DNA, 25 bp, Homo sapien
ggcagacataccacgaaactggttt

SEQ ID NO: 132300 - DNA, 25 bp, Homo sapien
cgaaactggtttcatccgtgacgac

SEQ ID NO: 132301 - DNA, 25 bp, Homo sapien
atccgtgacgaccttgagcacgtcg

SEQ ID NO: 132302 - DNA, 25 bp, Homo sapien
accgccagaggcgtgaagccgtcct

SEQ ID NO: 132303 - DNA, 25 bp, Homo sapien
ctcaccttggaaagcacgtccgggt

SEQ ID NO: 132304 - DNA, 25 bp, Homo sapien
aaatgctttgctctgactcgtctga

SEQ ID NO: 132305 - DNA, 25 bp, Homo sapien
tgcacgctcggttctcctgcctggg

SEQ ID NO: 132306 - DNA, 25 bp, Homo sapien
acgacgttctcatggccctgctgca

SEQ ID NO: 132307 - DNA, 25 bp, Homo sapien
gttggggtcgttctgcagcagcacc

SEQ ID NO: 132308 - DNA, 25 bp, Homo sapien
cccttggtgccgtagttgatgaggt

SEQ ID NO: 132309 - DNA, 25 bp, Homo sapien
gatgaggtgcgcgacgacgttctca

SEQ ID NO: 132310 - DNA, 25 bp, Homo sapien
gcctgccgctaatgggatctcttca

SEQ ID NO: 132311 - DNA, 25 bp, Homo sapien
agctcgtgcactcaccgcagggtct

SEQ ID NO: 132312 - DNA, 25 bp, Homo sapien
tctggctaaaaatacaggcgccctc

SEQ ID NO: 132313 - DNA, 25 bp, Homo sapien
tctggatcctgctagaagcctcggc

SEQ ID NO: 132314 - DNA, 25 bp, Homo sapien
atgggaaagttaatgcgaagcgctc

SEQ ID NO: 132315 - DNA, 25 bp, Homo sapien
gcgccagcaagttacgcggcatctg

SEQ ID NO: 132316 - DNA, 25 bp, Homo sapien
cagccttcaggccagaggaattttc

SEQ ID NO: 132317 - DNA, 25 bp, Homo sapien
tgaggagctccaagctgcatggcct

SEQ ID NO: 132318 - DNA, 25 bp, Homo sapien
ccacacgctgagagggtagtaaatg

SEQ ID NO: 132319 - DNA, 25 bp, Homo sapien
caaagctgctcttgctcgcgtgctg

SEQ ID NO: 132320 - DNA, 25 bp, Homo sapien
ggaccgcagattacaagagcacctc

SEQ ID NO: 132321 - DNA, 25 bp, Homo sapien
gcccagagttggacatcaggccaca

SEQ ID NO: 132322 - DNA, 25 bp, Homo sapien
gcgggaatttctttttagtggcatc

SEQ ID NO: 132323 - DNA, 25 bp, Homo sapien
ttctccgcgtgctttcactagggcc

SEQ ID NO: 132324 - DNA, 25 bp, Homo sapien
cccatgctgcttagtggccgatttg

SEQ ID NO: 132325 - DNA, 25 bp, Homo sapien
tgcagggaatctgggcacaatctta

SEQ ID NO: 132326 - DNA, 25 bp, Homo sapien
ggcgctcgtaatgaaacaggaactg

SEQ ID NO: 132327 - DNA, 25 bp, Homo sapien
gctcctgagtgcctctgttaatttg

SEQ ID NO: 132328 - DNA, 25 bp, Homo sapien
ggcgctccaaccacgtgctgtttat

SEQ ID NO: 132329 - DNA, 25 bp, Homo sapien
ttcgcactacaatgaccgggctgga

SEQ ID NO: 132330 - DNA, 25 bp, Homo sapien
tccaccgccgcagttgaaagaatta

SEQ ID NO: 132331 - DNA, 25 bp, Homo sapien
gggattcccataccgaggcctcttc

SEQ ID NO: 132332 - DNA, 25 bp, Homo sapien
gtttattactctgtggggattccca

SEQ ID NO: 132333 - DNA, 25 bp, Homo sapien
cgcaatctctgctgtcccattctgg

SEQ ID NO: 132334 - DNA, 25 bp, Homo sapien
caggttctctggccgcgactcagca

SEQ ID NO: 132335 - DNA, 25 bp, Homo sapien
cggtcgtctctctcccggtcgcgca

SEQ ID NO: 132336 - DNA, 25 bp, Homo sapien
acctcgcaggttcgcggcccgcaac

SEQ ID NO: 132337 - DNA, 25 bp, Homo sapien
cgacttccttgtcctagagctcgga

SEQ ID NO: 132338 - DNA, 25 bp, Homo sapien
gaaaccgacttccttgtcctagagc

SEQ ID NO: 132339 - DNA, 25 bp, Homo sapien
cagggcaggagcttccaccaatccc

SEQ ID NO: 132340 - DNA, 25 bp, Homo sapien
tccttgtcctagagctcggagcggc

SEQ ID NO: 132341 - DNA, 25 bp, Homo sapien
tgcccaaatatagaaaccgacttcc

SEQ ID NO: 132342 - DNA, 25 bp, Homo sapien
cttcttctttcggtcacgggagcgg

SEQ ID NO: 132343 - DNA, 25 bp, Homo sapien
tcacgggagcggtttctccgcttcc

SEQ ID NO: 132344 - DNA, 25 bp, Homo sapien
tccgcttcctgttggattcctcctt

SEQ ID NO: 132345 - DNA, 25 bp, Homo sapien
tctccttctgctcctggagggcctg

SEQ ID NO: 132346 - DNA, 25 bp, Homo sapien
gcctgcgcctcgatgtctttgattt

SEQ ID NO: 132347 - DNA, 25 bp, Homo sapien
tttcttcagctgtttggccgcttga

SEQ ID NO: 132348 - DNA, 25 bp, Homo sapien
ctccacagaggggacagcgttcgtg

SEQ ID NO: 132349 - DNA, 25 bp, Homo sapien
gagcgccgagcttccgcctttgcag

SEQ ID NO: 132350 - DNA, 25 bp, Homo sapien
ccgggcgccgaacaagcgagcaagc

SEQ ID NO: 132351 - DNA, 25 bp, Homo sapien
ccaagccgcgaggttgacaggcgcc

SEQ ID NO: 132352 - DNA, 25 bp, Homo sapien
aaggagttcagagcggtgcatagcc

SEQ ID NO: 132353 - DNA, 25 bp, Homo sapien
acaatgaaatcacgtgaaggagttc

SEQ ID NO: 132354 - DNA, 25 bp, Homo sapien
cgctgcaccgtttccacgcgatgga

SEQ ID NO: 132355 - DNA, 25 bp, Homo sapien
taaaaacttggatctgcacagcccg

SEQ ID NO: 132356 - DNA, 25 bp, Homo sapien
ctcttttcaaagagcgagaaacttt

SEQ ID NO: 132357 - DNA, 25 bp, Homo sapien
cacgtcttcgcgctctcttttcaaa

SEQ ID NO: 132358 - DNA, 25 bp, Homo sapien
ccgtgggtgagtgttctccgagccc

SEQ ID NO: 132359 - DNA, 25 bp, Homo sapien
tgggtgagtgttctccgagcccctt

SEQ ID NO: 132360 - DNA, 25 bp, Homo sapien
cttgccgtgggtgagtgttctccga

SEQ ID NO: 132361 - DNA, 25 bp, Homo sapien
cccttgccgtgggtgagtgttctcc

SEQ ID NO: 132362 - DNA, 25 bp, Homo sapien
ggtgagtgttctccgagccccttgc

SEQ ID NO: 132363 - DNA, 25 bp, Homo sapien
tctccgaaccccttgccgtgggtga

SEQ ID NO: 132364 - DNA, 25 bp, Homo sapien
tgccgtgggtgagtgttctccgaac

SEQ ID NO: 132365 - DNA, 25 bp, Homo sapien
ggtgagtgttctccgaaccccttgc

SEQ ID NO: 132366 - DNA, 25 bp, Homo sapien
cgtggcgctctacatcttcttgtgc

SEQ ID NO: 132367 - DNA, 25 bp, Homo sapien
gacttcaagtacgtgctgctgcctg

SEQ ID NO: 132368 - DNA, 25 bp, Homo sapien
cttgtctgttacgtgctcatggctc

SEQ ID NO: 132369 - DNA, 25 bp, Homo sapien
gtgccctttgccgtcatccttgtct

SEQ ID NO: 132370 - DNA, 25 bp, Homo sapien
tggtctattactacgcccgcggcga

SEQ ID NO: 132371 - DNA, 25 bp, Homo sapien
acctggctgtgtctgatgcactgta

SEQ ID NO: 132372 - DNA, 25 bp, Homo sapien
ttgtgccgcctcaagacctggaatg

SEQ ID NO: 132373 - DNA, 25 bp, Homo sapien
ctcggcgactgctaaagccagccta

SEQ ID NO: 132374 - DNA, 25 bp, Homo sapien
cttcagtgtggcacggaaatccggc

SEQ ID NO: 132375 - DNA, 25 bp, Homo sapien
gtctcacgcgtttaagtcagacggc

SEQ ID NO: 132376 - DNA, 25 bp, Homo sapien
cgcgtttaagtcagacggcgacccg

SEQ ID NO: 132377 - DNA, 25 bp, Homo sapien
tgcacagcgactttccggagcccga

SEQ ID NO: 132378 - DNA, 25 bp, Homo sapien
gtttacagttagtgagccctccctc

SEQ ID NO: 132379 - DNA, 25 bp, Homo sapien
ctcggcggcgtctgtttacagttag

SEQ ID NO: 132380 - DNA, 25 bp, Homo sapien
tggcacggaaatccggcagccacgc

SEQ ID NO: 132381 - DNA, 25 bp, Homo sapien
gcagccacgcaggatgggaactctc

SEQ ID NO: 132382 - DNA, 25 bp, Homo sapien
accttccgagactagcggctcatta

SEQ ID NO: 132383 - DNA, 25 bp, Homo sapien
ccgggtcctgctccgcattgttatt

SEQ ID NO: 132384 - DNA, 25 bp, Homo sapien
gtctcttaggaacaggcacaacccg

SEQ ID NO: 132385 - DNA, 25 bp, Homo sapien
cattattgaaagtcagtgccggtcc

SEQ ID NO: 132386 - DNA, 25 bp, Homo sapien
gtcactggcagctgttgtcaaaaga

SEQ ID NO: 132387 - DNA, 25 bp, Homo sapien
aaggcacctctttgtctccagggga

SEQ ID NO: 132388 - DNA, 25 bp, Homo sapien
ctcaagagttgtgtcccagcgaagg

SEQ ID NO: 132389 - DNA, 25 bp, Homo sapien
gctgtttcagcgcaagccggatctc

SEQ ID NO: 132390 - DNA, 25 bp, Homo sapien
ggcaagccgccaacagcgatcaatc

SEQ ID NO: 132391 - DNA, 25 bp, Homo sapien
gtcttcgacctccaatcaggactcg

SEQ ID NO: 132392 - DNA, 25 bp, Homo sapien
ccagccctttgtgactggatgagtg

SEQ ID NO: 132393 - DNA, 25 bp, Homo sapien
tgtcagcaactcgtgcccggaagcc

SEQ ID NO: 132394 - DNA, 25 bp, Homo sapien
tcaggatttatcaaccgcgaggcgc

SEQ ID NO: 132395 - DNA, 25 bp, Homo sapien
gagcggctcccagatacccaatcag

SEQ ID NO: 132396 - DNA, 25 bp, Homo sapien
ggcgcttcccaaaggcaccgatgga

SEQ ID NO: 132397 - DNA, 25 bp, Homo sapien
ctcggagctgtaccaatcggagatg

SEQ ID NO: 132398 - DNA, 25 bp, Homo sapien
ctgtgccgctgggaagtcgcagctt

SEQ ID NO: 132399 - DNA, 25 bp, Homo sapien
ggccaacgtgctccgtgacgtcaga

SEQ ID NO: 132400 - DNA, 25 bp, Homo sapien
agcactcgcagcatccggacctggt

SEQ ID NO: 132401 - DNA, 25 bp, Homo sapien
cgtgacgtcagagcaggaagtgttt

SEQ ID NO: 132402 - DNA, 25 bp, Homo sapien
ctgcccgcgttaagattcccgcatt

SEQ ID NO: 132403 - DNA, 25 bp, Homo sapien
cgcgttaagattcccgcattttaat

SEQ ID NO: 132404 - DNA, 25 bp, Homo sapien
gcgtccctgccgacaggtgagtccc

SEQ ID NO: 132405 - DNA, 25 bp, Homo sapien
cgtttcacttgtgcgggttggagtt

SEQ ID NO: 132406 - DNA, 25 bp, Homo sapien
ggggaatcaccgacatgctcacagg

SEQ ID NO: 132407 - DNA, 25 bp, Homo sapien
tgcaggccgccatgagcaaacggaa

SEQ ID NO: 132408 - DNA, 25 bp, Homo sapien
atgctcacaggttagcaccgggccg

SEQ ID NO: 132409 - DNA, 25 bp, Homo sapien
gcccaggacgcgtgacgtcacaaca

SEQ ID NO: 132410 - DNA, 25 bp, Homo sapien
ggcaaccattgttccgccggtcgcg

SEQ ID NO: 132411 - DNA, 25 bp, Homo sapien
agtcctggtacctccttcaagctgg

SEQ ID NO: 132412 - DNA, 25 bp, Homo sapien
cttcaagctgggagagggctctagt

SEQ ID NO: 132413 - DNA, 25 bp, Homo sapien
ctctagtccctggttctgaacactc

SEQ ID NO: 132414 - DNA, 25 bp, Homo sapien
agcaacctcgcgcattctcgcgaga

SEQ ID NO: 132415 - DNA, 25 bp, Homo sapien
tggcaacagttaactagcaacctcg

SEQ ID NO: 132416 - DNA, 25 bp, Homo sapien
ttgaagaccttcagcgttgccctgg

SEQ ID NO: 132417 - DNA, 25 bp, Homo sapien
cacctcaggcgatggagccgcagca

SEQ ID NO: 132418 - DNA, 25 bp, Homo sapien
cctcccaggggtcagctagaaagga

SEQ ID NO: 132419 - DNA, 25 bp, Homo sapien
tctagggaagttggatcctcgaacc

SEQ ID NO: 132420 - DNA, 25 bp, Homo sapien
agggtgccctgcgtgcaattcaaaa

SEQ ID NO: 132421 - DNA, 25 bp, Homo sapien
gcggccgcacccatggcaacagtta

SEQ ID NO: 132422 - DNA, 25 bp, Homo sapien
gcgcccttaatcgtgggctcctctg

SEQ ID NO: 132423 - DNA, 25 bp, Homo sapien
ggccttgcccagcttcgaacaaatc

SEQ ID NO: 132424 - DNA, 25 bp, Homo sapien
cgcttcctcggctacccttgagaag

SEQ ID NO: 132425 - DNA, 25 bp, Homo sapien
ccctgagcgttctcggtaaacgctc

SEQ ID NO: 132426 - DNA, 25 bp, Homo sapien
agcgcgaggggcgttttcacatccc

SEQ ID NO: 132427 - DNA, 25 bp, Homo sapien
cctctcaggtaagggtggtcggata

SEQ ID NO: 132428 - DNA, 25 bp, Homo sapien
ggtcggatactagcgccaccggcct

SEQ ID NO: 132429 - DNA, 25 bp, Homo sapien
ctcggctacccttgagaagcaaagc

SEQ ID NO: 132430 - DNA, 25 bp, Homo sapien
tgtgcagcagatctttgtagagccc

SEQ ID NO: 132431 - DNA, 25 bp, Homo sapien
taactgttgtttcggcgcagcagcc

SEQ ID NO: 132432 - DNA, 25 bp, Homo sapien
gcccacaaatggctgcggtgtagca

SEQ ID NO: 132433 - DNA, 25 bp, Homo sapien
gcagcagccggtagttgctttcctg

SEQ ID NO: 132434 - DNA, 25 bp, Homo sapien
ccgagtctttgtgcacggtgtggta

SEQ ID NO: 132435 - DNA, 25 bp, Homo sapien
gtggtacacatgaccgtcgctcctg

SEQ ID NO: 132436 - DNA, 25 bp, Homo sapien
cgccgtgagcaaaggacccgaaaca

SEQ ID NO: 132437 - DNA, 25 bp, Homo sapien
ccaccgcgttacagtagctcgagta

SEQ ID NO: 132438 - DNA, 25 bp, Homo sapien
actcgcaggtaatgcccggtccctg

SEQ ID NO: 132439 - DNA, 25 bp, Homo sapien
ttccggaagcgcacacgggccagtt

SEQ ID NO: 132440 - DNA, 25 bp, Homo sapien
gctcctcgtttcatccggaaaccga

SEQ ID NO: 132441 - DNA, 25 bp, Homo sapien
agttttcgcaaaggcgccgcacggc

SEQ ID NO: 132442 - DNA, 25 bp, Homo sapien
cggcggaaacgtccctagagcctcg

SEQ ID NO: 132443 - DNA, 25 bp, Homo sapien
ctgccacttccgtcgagttttcgca

SEQ ID NO: 132444 - DNA, 25 bp, Homo sapien
attgcgcctggtgggacaatgtaca

SEQ ID NO: 132445 - DNA, 25 bp, Homo sapien
cgctgcgtctctccggctcaaaaaa

SEQ ID NO: 132446 - DNA, 25 bp, Homo sapien
cgaacgcgtcaacccaggccgtgag

SEQ ID NO: 132447 - DNA, 25 bp, Homo sapien
acccaggccgtgagcgaagcctgca

SEQ ID NO: 132448 - DNA, 25 bp, Homo sapien
ggccgtgagcgaagcctgcaaccag

SEQ ID NO: 132449 - DNA, 25 bp, Homo sapien
gtgggctccgaacgcgtcaacccag

SEQ ID NO: 132450 - DNA, 25 bp, Homo sapien
cgcgccaccctaggcatcgcccgtg

SEQ ID NO: 132451 - DNA, 25 bp, Homo sapien
cgcgtcaacccaggccgtgagcgaa

SEQ ID NO: 132452 - DNA, 25 bp, Homo sapien
tcaacccaggccgtgagcgaagcct

SEQ ID NO: 132453 - DNA, 25 bp, Homo sapien
taggcatcgcccgtgggctccgaac

SEQ ID NO: 132454 - DNA, 25 bp, Homo sapien
gcggagcaggactgcaccatccttc

SEQ ID NO: 132455 - DNA, 25 bp, Homo sapien
tgttctcagtgtcgctgcgctcggt

SEQ ID NO: 132456 - DNA, 25 bp, Homo sapien
tgtcgtagcggttcttgcagccgta

SEQ ID NO: 132457 - DNA, 25 bp, Homo sapien
aaacgggcttgtccttgtcgtagcg

SEQ ID NO: 132458 - DNA, 25 bp, Homo sapien
ctcacttgtggaaagaaacgggctt

SEQ ID NO: 132459 - DNA, 25 bp, Homo sapien
cgcgcagggtcctcacttgtggaaa

SEQ ID NO: 132460 - DNA, 25 bp, Homo sapien
ttccaggagcgcgagaaacggctgc

SEQ ID NO: 132461 - DNA, 25 bp, Homo sapien
tgcaaccagggcctgttccaggagc

SEQ ID NO: 132462 - DNA, 25 bp, Homo sapien
ctgctgccgccgtctacacggtccc

SEQ ID NO: 132463 - DNA, 25 bp, Homo sapien
gctttgctctggctcctctgggttc

SEQ ID NO: 132464 - DNA, 25 bp, Homo sapien
ggttcgcctcctagcagcgcctggg

SEQ ID NO: 132465 - DNA, 25 bp, Homo sapien
cgagtgacatctgggccggaccagc

SEQ ID NO: 132466 - DNA, 25 bp, Homo sapien
catctgggccggaccagctggtgct

SEQ ID NO: 132467 - DNA, 25 bp, Homo sapien
gggatacagggaggcctgcccactc

SEQ ID NO: 132468 - DNA, 25 bp, Homo sapien
tgccgctttgctctggctcctctgg

SEQ ID NO: 132469 - DNA, 25 bp, Homo sapien
ctcatttgacgggttcgcctcctag

SEQ ID NO: 132470 - DNA, 25 bp, Homo sapien
tgcagccagtgtttgttgggcttca

SEQ ID NO: 132471 - DNA, 25 bp, Homo sapien
ggcccttcgtcctcacttgctttga

SEQ ID NO: 132472 - DNA, 25 bp, Homo sapien
cacagaacgactttgctattgcttt

SEQ ID NO: 132473 - DNA, 25 bp, Homo sapien
accaaatgtgttgctaaatggtgcc

SEQ ID NO: 132474 - DNA, 25 bp, Homo sapien
ggtgtgcattccaacagtctgttcg

SEQ ID NO: 132475 - DNA, 25 bp, Homo sapien
tggaaaagggtacatttcatggctc

SEQ ID NO: 132476 - DNA, 25 bp, Homo sapien
acaacttggtgggtaaatctgagaa

SEQ ID NO: 132477 - DNA, 25 bp, Homo sapien
tgttttccaaggcacggagcagctg

SEQ ID NO: 132478 - DNA, 25 bp, Homo sapien
tcaacctcacctctcgcgaggggtg

SEQ ID NO: 132479 - DNA, 25 bp, Homo sapien
ggccggattcctggggcatcctcca

SEQ ID NO: 132480 - DNA, 25 bp, Homo sapien
cgtctcccatctccaagatggcgga

SEQ ID NO: 132481 - DNA, 25 bp, Homo sapien
ggtgcgtcccactgtctctgattag

SEQ ID NO: 132482 - DNA, 25 bp, Homo sapien
ccgaggtcagaggtaacgtttcctg

SEQ ID NO: 132483 - DNA, 25 bp, Homo sapien
aagctaactattggctgaggccagg

SEQ ID NO: 132484 - DNA, 25 bp, Homo sapien
ctgttcccgtgggttaattgatgcg

SEQ ID NO: 132485 - DNA, 25 bp, Homo sapien
tcctgggaagctaactattggctga

SEQ ID NO: 132486 - DNA, 25 bp, Homo sapien
cgcctcgacacgcagcgaactggtg

SEQ ID NO: 132487 - DNA, 25 bp, Homo sapien
gcccagggtccgagagagacttgcc

SEQ ID NO: 132488 - DNA, 25 bp, Homo sapien
aagatgttcagcgtagagtcgctgg

SEQ ID NO: 132489 - DNA, 25 bp, Homo sapien
ggagctgtgcgagagcctcctcact

SEQ ID NO: 132490 - DNA, 25 bp, Homo sapien
agcctcctcacttgggtacgtgggg

SEQ ID NO: 132491 - DNA, 25 bp, Homo sapien
tgcgggcgacggtgccgtcacatcc

SEQ ID NO: 132492 - DNA, 25 bp, Homo sapien
tccgagagagacttgccgggcctga

SEQ ID NO: 132493 - DNA, 25 bp, Homo sapien
cctttctaatttggagtgcgggtgc

SEQ ID NO: 132494 - DNA, 25 bp, Homo sapien
tcaggcgtcgcgattcgtaaatata

SEQ ID NO: 132495 - DNA, 25 bp, Homo sapien
tctggcccgcacctctatggtagga

SEQ ID NO: 132496 - DNA, 25 bp, Homo sapien
cgccctcctatgtcctgtacaggta

SEQ ID NO: 132497 - DNA, 25 bp, Homo sapien
ggtctcggctttccgcctgctttaa

SEQ ID NO: 132498 - DNA, 25 bp, Homo sapien
cctgctttaagccacgcggaaactg

SEQ ID NO: 132499 - DNA, 25 bp, Homo sapien
gcactcgttcagctgttcaggcgtc

SEQ ID NO: 132500 - DNA, 25 bp, Homo sapien
cacggcttcccagaacgctgtgtcg

SEQ ID NO: 132501 - DNA, 25 bp, Homo sapien
gcggaaactgctgcacccttgactg

SEQ ID NO: 132502 - DNA, 25 bp, Homo sapien
cgttcgctccggcttcagtgcacgg

SEQ ID NO: 132503 - DNA, 25 bp, Homo sapien
cggcctgtccggaggctccctagga

SEQ ID NO: 132504 - DNA, 25 bp, Homo sapien
gaccctgtacgtggcctgggccgca

SEQ ID NO: 132505 - DNA, 25 bp, Homo sapien
cagtaggcccagtgcgtgctggccc

SEQ ID NO: 132506 - DNA, 25 bp, Homo sapien
ggacgcgcttccgaacgcgcaagcg

SEQ ID NO: 132507 - DNA, 25 bp, Homo sapien
caggacgcgcttccgaacgcgcaag

SEQ ID NO: 132508 - DNA, 25 bp, Homo sapien
gctccggcttcagtgcacggccgga

SEQ ID NO: 132509 - DNA, 25 bp, Homo sapien
cgctcacccgcccaggacgcgcttc

SEQ ID NO: 132510 - DNA, 25 bp, Homo sapien
cgagggctctaacacccgtgcggag

SEQ ID NO: 132511 - DNA, 25 bp, Homo sapien
tcaaggcagggcctagcatggcccg

SEQ ID NO: 132512 - DNA, 25 bp, Homo sapien
ctccctcaaggcagggcctagcatg

SEQ ID NO: 132513 - DNA, 25 bp, Homo sapien
acactcccaacgcaggggcgcagag

SEQ ID NO: 132514 - DNA, 25 bp, Homo sapien
gacaaacactcccaacgcaggggcg

SEQ ID NO: 132515 - DNA, 25 bp, Homo sapien
cgaagacaaacactcccaacgcagg

SEQ ID NO: 132516 - DNA, 25 bp, Homo sapien
gcctctcttccggctgtttttcctc

SEQ ID NO: 132517 - DNA, 25 bp, Homo sapien
agtttggcagaatgcggctggagaa

SEQ ID NO: 132518 - DNA, 25 bp, Homo sapien
taccgtgattgcacaactggcttgc

SEQ ID NO: 132519 - DNA, 25 bp, Homo sapien
aactggcttgctctccgaactcggt

SEQ ID NO: 132520 - DNA, 25 bp, Homo sapien
tgcgctggcttaagaggcgctcagc

SEQ ID NO: 132521 - DNA, 25 bp, Homo sapien
gccgtgcgacccattggcttcagcg

SEQ ID NO: 132522 - DNA, 25 bp, Homo sapien
tccactgttcggagggacttagagc

SEQ ID NO: 132523 - DNA, 25 bp, Homo sapien
cgtctaaacagaggccgcggatcgg

SEQ ID NO: 132524 - DNA, 25 bp, Homo sapien
gtcctggcgccttccgtctaaacag

SEQ ID NO: 132525 - DNA, 25 bp, Homo sapien
aggcgctcagctcataccgtgattg

SEQ ID NO: 132526 - DNA, 25 bp, Homo sapien
ctgcgcgcggaagcaagtgaaatcc

SEQ ID NO: 132527 - DNA, 25 bp, Homo sapien
agaacacctgtgaataccgcgccct

SEQ ID NO: 132528 - DNA, 25 bp, Homo sapien
gactctgatggaagaacacctgtga

SEQ ID NO: 132529 - DNA, 25 bp, Homo sapien
gtgaaatccagcctcaaagactctg

SEQ ID NO: 132530 - DNA, 25 bp, Homo sapien
accaggaacgttccgggctcttctg

SEQ ID NO: 132531 - DNA, 25 bp, Homo sapien
gcttagcgtctaggccacgccaggc

SEQ ID NO: 132532 - DNA, 25 bp, Homo sapien
cggctgcagcttagcgtctaggcca

SEQ ID NO: 132533 - DNA, 25 bp, Homo sapien
ccagcctcaaagactctgatggaag

SEQ ID NO: 132534 - DNA, 25 bp, Homo sapien
cgaacatctaagaaccaggaccaga

SEQ ID NO: 132535 - DNA, 25 bp, Homo sapien
cacgaggaagcgcttcagcttctgg

SEQ ID NO: 132536 - DNA, 25 bp, Homo sapien
gcggactgcttctggccagcggtcc

SEQ ID NO: 132537 - DNA, 25 bp, Homo sapien
cgcctgctctccgaacatctaagaa

SEQ ID NO: 132538 - DNA, 25 bp, Homo sapien
cgcgcacgcattccggaggtcgcca

SEQ ID NO: 132539 - DNA, 25 bp, Homo sapien
tcgccaggccatgctccgtcgcctg

SEQ ID NO: 132540 - DNA, 25 bp, Homo sapien
acactgccagcatcgcagagccggg

SEQ ID NO: 132541 - DNA, 25 bp, Homo sapien
ccagaagtcccggtgctgcggccaa

SEQ ID NO: 132542 - DNA, 25 bp, Homo sapien
ccatgcacgaagagctgctttaggc

SEQ ID NO: 132543 - DNA, 25 bp, Homo sapien
tcgccagggcccatgcctgccatgc

SEQ ID NO: 132544 - DNA, 25 bp, Homo sapien
ctgcaagcagcagcgagccatggcc

SEQ ID NO: 132545 - DNA, 25 bp, Homo sapien
ctgccaggcagcgaagtgcgcccgt

SEQ ID NO: 132546 - DNA, 25 bp, Homo sapien
aagcagcagcgagccatggccaccg

SEQ ID NO: 132547 - DNA, 25 bp, Homo sapien
tgcacgaagagctgctttaggccgc

SEQ ID NO: 132548 - DNA, 25 bp, Homo sapien
caagcaggcgacaacgggctgcctc

SEQ ID NO: 132549 - DNA, 25 bp, Homo sapien
atggccaccgcagtggccctcttgg

SEQ ID NO: 132550 - DNA, 25 bp, Homo sapien
cccggagtgagttacgccactatgg

SEQ ID NO: 132551 - DNA, 25 bp, Homo sapien
cagagggtcgcctcagtctgcaagt

SEQ ID NO: 132552 - DNA, 25 bp, Homo sapien
tttcttcttcggctcctccctgatt

SEQ ID NO: 132553 - DNA, 25 bp, Homo sapien
agagaaacctctgctccggtctctg

SEQ ID NO: 132554 - DNA, 25 bp, Homo sapien
cacagaaacttgagccgcggcagag

SEQ ID NO: 132555 - DNA, 25 bp, Homo sapien
tttgcaacaaaagggtgccaggagc

SEQ ID NO: 132556 - DNA, 25 bp, Homo sapien
gcctctgccgcaaagtttatttgca

SEQ ID NO: 132557 - DNA, 25 bp, Homo sapien
cagctttaccgcagcgtctcgttca

SEQ ID NO: 132558 - DNA, 25 bp, Homo sapien
cgcgtgatgtcccagacagcctgga

SEQ ID NO: 132559 - DNA, 25 bp, Homo sapien
gtggacactgcgctcagaagcgtca

SEQ ID NO: 132560 - DNA, 25 bp, Homo sapien
ccgaccctgggatgttgaggacgaa

SEQ ID NO: 132561 - DNA, 25 bp, Homo sapien
gagctccgggtggacactgcgctca

SEQ ID NO: 132562 - DNA, 25 bp, Homo sapien
gcagggtctccgaccctgggatgtt

SEQ ID NO: 132563 - DNA, 25 bp, Homo sapien
tgatgtcccagacagcctggaggtg

SEQ ID NO: 132564 - DNA, 25 bp, Homo sapien
ccaaggaccggctttgcctgttggc

SEQ ID NO: 132565 - DNA, 25 bp, Homo sapien
tcagaagcgtcactggctcctggga

SEQ ID NO: 132566 - DNA, 25 bp, Homo sapien
cacggcggtcatctcacgttgatca

SEQ ID NO: 132567 - DNA, 25 bp, Homo sapien
tcatctcacgttcatcagggtcggg

SEQ ID NO: 132568 - DNA, 25 bp, Homo sapien
tctcacgttcatcagggtcggggtt

SEQ ID NO: 132569 - DNA, 25 bp, Homo sapien
atgttcatcagggtcggggttcatc

SEQ ID NO: 132570 - DNA, 25 bp, Homo sapien
ttcatcagtttaccacacggcggtc

SEQ ID NO: 132571 - DNA, 25 bp, Homo sapien
gtcatctcacgttcatcagggtcgg

SEQ ID NO: 132572 - DNA, 25 bp, Homo sapien
ggtcggggttcatcagtttaccaca

SEQ ID NO: 132573 - DNA, 25 bp, Homo sapien
ggggttcatcagtttaccacacggc

SEQ ID NO: 132574 - DNA, 25 bp, Homo sapien
cctgagccgaacacgacacgacgat

SEQ ID NO: 132575 - DNA, 25 bp, Homo sapien
cgacacgacgatgggaagctcctcg

SEQ ID NO: 132576 - DNA, 25 bp, Homo sapien
acacgacgatgggaaggtcctcgtc

SEQ ID NO: 132577 - DNA, 25 bp, Homo sapien
agccgaacacgacacgacgatggga

SEQ ID NO: 132578 - DNA, 25 bp, Homo sapien
ctgagccgaacacgacacgacgatg

SEQ ID NO: 132579 - DNA, 25 bp, Homo sapien
acgacacgacgatgggaaggtcctc

SEQ ID NO: 132580 - DNA, 25 bp, Homo sapien
acgacacgacgatgggaagctcctc

SEQ ID NO: 132581 - DNA, 25 bp, Homo sapien
cacgacgatgggaaggtcctcgtca

SEQ ID NO: 132582 - DNA, 25 bp, Homo sapien
cgtctcccggatagccatcttcatg

SEQ ID NO: 132583 - DNA, 25 bp, Homo sapien
gagcagctcgactcgcactgtgtcc

SEQ ID NO: 132584 - DNA, 25 bp, Homo sapien
ggaaccatctttctactgggacgtc

SEQ ID NO: 132585 - DNA, 25 bp, Homo sapien
tcagggcgggaaccatctttctact

SEQ ID NO: 132586 - DNA, 25 bp, Homo sapien
ctgcagcacgcaggggatgttcttg

SEQ ID NO: 132587 - DNA, 25 bp, Homo sapien
atcttcatgttttcacgccacggcg

SEQ ID NO: 132588 - DNA, 25 bp, Homo sapien
ctttctactgggacgtccgagcccg

SEQ ID NO: 132589 - DNA, 25 bp, Homo sapien
tgttttcacgccacggcgaagcgcc

SEQ ID NO: 132590 - DNA, 25 bp, Homo sapien
aagctgaagagcgcatcctcgcctc

SEQ ID NO: 132591 - DNA, 25 bp, Homo sapien
cgcaacaatagctgggcgtccgccc

SEQ ID NO: 132592 - DNA, 25 bp, Homo sapien
gtcggctcaccagggcgcaaacagg

SEQ ID NO: 132593 - DNA, 25 bp, Homo sapien
ctggcgcttataccggctgggctgc

SEQ ID NO: 132594 - DNA, 25 bp, Homo sapien
cttataccggctgggctgctgtaat

SEQ ID NO: 132595 - DNA, 25 bp, Homo sapien
taccggctgggctgctgtaatgcgt

SEQ ID NO: 132596 - DNA, 25 bp, Homo sapien
ctgcgaggatcaaccagcgcgtgca

SEQ ID NO: 132597 - DNA, 25 bp, Homo sapien
cgaggatcaaccagcgcgtgcagag

SEQ ID NO: 132598 - DNA, 25 bp, Homo sapien
attggcaaaggcctgtaggacccgg

SEQ ID NO: 132599 - DNA, 25 bp, Homo sapien
tggtgcactcaagcctctccggagg

SEQ ID NO: 132600 - DNA, 25 bp, Homo sapien
ccgtctttgtccttaaggtggagtg

SEQ ID NO: 132601 - DNA, 25 bp, Homo sapien
cagggatgcagagccgctgcctttc

SEQ ID NO: 132602 - DNA, 25 bp, Homo sapien
gggtgtcagggattctcccattcga

SEQ ID NO: 132603 - DNA, 25 bp, Homo sapien
gggattctcccattcgatttctgtc

SEQ ID NO: 132604 - DNA, 25 bp, Homo sapien
ttcgatttctgtctgtttgcgaccc

SEQ ID NO: 132605 - DNA, 25 bp, Homo sapien
ttgtccttaaggtggagtgccgccc

SEQ ID NO: 132606 - DNA, 25 bp, Homo sapien
ccagagcagcgccactcggagacgg

SEQ ID NO: 132607 - DNA, 25 bp, Homo sapien
gagaccttgggacccgcgcaatgtg

SEQ ID NO: 132608 - DNA, 25 bp, Homo sapien
cctctgtcagagaccttgggacccg

SEQ ID NO: 132609 - DNA, 25 bp, Homo sapien
gggtgtcgactctagccctctgtca

SEQ ID NO: 132610 - DNA, 25 bp, Homo sapien
tctgcaggtgccctacacccgggag

SEQ ID NO: 132611 - DNA, 25 bp, Homo sapien
caccgggagccgtcaccgcagggaa

SEQ ID NO: 132612 - DNA, 25 bp, Homo sapien
gggagcctccatttccaggagccgc

SEQ ID NO: 132613 - DNA, 25 bp, Homo sapien
agtcaccggcgggagcctccatttc

SEQ ID NO: 132614 - DNA, 25 bp, Homo sapien
caggctccacgagttctcccggtga

SEQ ID NO: 132615 - DNA, 25 bp, Homo sapien
tccacgagttctcccggtgatgtga

SEQ ID NO: 132616 - DNA, 25 bp, Homo sapien
gtagcctttcctcaggctccacgag

SEQ ID NO: 132617 - DNA, 25 bp, Homo sapien
gtgataggaatgcaatcttccgccc

SEQ ID NO: 132618 - DNA, 25 bp, Homo sapien
gccgcaccgtctcaggcccacttct

SEQ ID NO: 132619 - DNA, 25 bp, Homo sapien
ggctatggtcgacgccgcaccgtct

SEQ ID NO: 132620 - DNA, 25 bp, Homo sapien
cggcgaacgtgataggaatgcaatc

SEQ ID NO: 132621 - DNA, 25 bp, Homo sapien
ccctgtgcgccacggcgaacgtgat

SEQ ID NO: 132622 - DNA, 25 bp, Homo sapien
cttcctgccgcactcggaggggact

SEQ ID NO: 132623 - DNA, 25 bp, Homo sapien
cgcggataatccactgtcaactctg

SEQ ID NO: 132624 - DNA, 25 bp, Homo sapien
gactgtgcggctgactgcccaatcc

SEQ ID NO: 132625 - DNA, 25 bp, Homo sapien
ctttttgattctggtgtaatgtacc

SEQ ID NO: 132626 - DNA, 25 bp, Homo sapien
cgctgcctcgggttccagaacggga

SEQ ID NO: 132627 - DNA, 25 bp, Homo sapien
tggccttactcttgtctctttttga

SEQ ID NO: 132628 - DNA, 25 bp, Homo sapien
ccctcagcggcggtacggaaagcga

SEQ ID NO: 132629 - DNA, 25 bp, Homo sapien
tgtaccaaaccgcagggaatcctgg

SEQ ID NO: 132630 - DNA, 25 bp, Homo sapien
atggcgctctcgtcgtcgtacatgg

SEQ ID NO: 132631 - DNA, 25 bp, Homo sapien
gcgaagagctcgtcgtggcacagct

SEQ ID NO: 132632 - DNA, 25 bp, Homo sapien
cgcccgccttgtgattgctgttgaa

SEQ ID NO: 132633 - DNA, 25 bp, Homo sapien
aagctcaccacggtctgtgcgcacg

SEQ ID NO: 132634 - DNA, 25 bp, Homo sapien
ctctgcgtccaagcgaggctgtcac

SEQ ID NO: 132635 - DNA, 25 bp, Homo sapien
gcgctgctgggaatgacactccctc

SEQ ID NO: 132636 - DNA, 25 bp, Homo sapien
ctcttcttcctgtttgtgggcttgg

SEQ ID NO: 132637 - DNA, 25 bp, Homo sapien
atcaaaaccaggacttggccgcagc

SEQ ID NO: 132638 - DNA, 25 bp, Homo sapien
ttcaccatcgcgctggaagacatgc

SEQ ID NO: 132639 - DNA, 25 bp, Homo sapien
atggtgaagaccctggcccagttca

SEQ ID NO: 132640 - DNA, 25 bp, Homo sapien
ccgcatgctgcagatggtgaagacc

SEQ ID NO: 132641 - DNA, 25 bp, Homo sapien
cagatcgacgctggaactgaccacc

SEQ ID NO: 132642 - DNA, 25 bp, Homo sapien
ctttgtccacgggtgtgcgccgact

SEQ ID NO: 132643 - DNA, 25 bp, Homo sapien
gacggaaagtacatgtcggcgcctt

SEQ ID NO: 132644 - DNA, 25 bp, Homo sapien
tattccgtgtaggtgtgttcgtgcc

SEQ ID NO: 132645 - DNA, 25 bp, Homo sapien
aagacatgcgcgatatgggcccagc

SEQ ID NO: 132646 - DNA, 25 bp, Homo sapien
tgaaaacgttgtgtctcgccctcca

SEQ ID NO: 132647 - DNA, 25 bp, Homo sapien
agcggcgccaagtccgtctggccgt

SEQ ID NO: 132648 - DNA, 25 bp, Homo sapien
cgctctgcagcgttgaaaacgttgt

SEQ ID NO: 132649 - DNA, 25 bp, Homo sapien
agcttctgaagaccgagcggcgcca

SEQ ID NO: 132650 - DNA, 25 bp, Homo sapien
ctccaggccgggagctggatcccaa

SEQ ID NO: 132651 - DNA, 25 bp, Homo sapien
agaggcgccttccacaccatcaagg

SEQ ID NO: 132652 - DNA, 25 bp, Homo sapien
accatcaagggcgtggcggacacct

SEQ ID NO: 132653 - DNA, 25 bp, Homo sapien
cgggagacgcagcagcttctgaaga

SEQ ID NO: 132654 - DNA, 25 bp, Homo sapien
ggagcaccgcgagggatttttctta

SEQ ID NO: 132655 - DNA, 25 bp, Homo sapien
agcgagggccagtgaagtcctgcca

SEQ ID NO: 132656 - DNA, 25 bp, Homo sapien
ccgccgcattggtccctgaagcgag

SEQ ID NO: 132657 - DNA, 25 bp, Homo sapien
ggacgccgcggctacggagtctcca

SEQ ID NO: 132658 - DNA, 25 bp, Homo sapien
catttctaggcggaatggacgccgc

SEQ ID NO: 132659 - DNA, 25 bp, Homo sapien
tgcatcctaatgacccatttctagg

SEQ ID NO: 132660 - DNA, 25 bp, Homo sapien
cccttcttacaaatgcatcctaatg

SEQ ID NO: 132661 - DNA, 25 bp, Homo sapien
ctggcgctgaactggagcaccgcga

SEQ ID NO: 132662 - DNA, 25 bp, Homo sapien
aagcgcgcctctttggcccgaatca

SEQ ID NO: 132663 - DNA, 25 bp, Homo sapien
gcccgaatcaacatggaaacctaag

SEQ ID NO: 132664 - DNA, 25 bp, Homo sapien
gaaaaacgtctgacctgcggaggta

SEQ ID NO: 132665 - DNA, 25 bp, Homo sapien
gctacttggtgttggacttggctaa

SEQ ID NO: 132666 - DNA, 25 bp, Homo sapien
ctaagggataaagaagcacacgctc

SEQ ID NO: 132667 - DNA, 25 bp, Homo sapien
cgagcgaggcctacttctggtttac

SEQ ID NO: 132668 - DNA, 25 bp, Homo sapien
gcaagcggccgcctttccacggtaa

SEQ ID NO: 132669 - DNA, 25 bp, Homo sapien
tctggtttacgcacgggcgctgaaa

SEQ ID NO: 132670 - DNA, 25 bp, Homo sapien
tcagagtcgtatggccttggttaac

SEQ ID NO: 132671 - DNA, 25 bp, Homo sapien
gtggacccaccatgctgaaactttc

SEQ ID NO: 132672 - DNA, 25 bp, Homo sapien
actttcagggcttctcagagtcgta

SEQ ID NO: 132673 - DNA, 25 bp, Homo sapien
tggcaggtgtctgctgtattcagga

SEQ ID NO: 132674 - DNA, 25 bp, Homo sapien
cgcacccatgttggggctgcatctg

SEQ ID NO: 132675 - DNA, 25 bp, Homo sapien
ccactgttgagttggcctttggtga

SEQ ID NO: 132676 - DNA, 25 bp, Homo sapien
caggctctgttggattcatgtggac

SEQ ID NO: 132677 - DNA, 25 bp, Homo sapien
tattggaaatcagttcgaggggtcc

SEQ ID NO: 132678 - DNA, 25 bp, Homo sapien
gagaagatggcggtctccacaggtc

SEQ ID NO: 132679 - DNA, 25 bp, Homo sapien
tgcgctgtctcgaatgccgcgctct

SEQ ID NO: 132680 - DNA, 25 bp, Homo sapien
agaagcccgagtgcgctgtctcgaa

SEQ ID NO: 132681 - DNA, 25 bp, Homo sapien
ggctgcgtgattttccgctccgacc

SEQ ID NO: 132682 - DNA, 25 bp, Homo sapien
cgctctccgcagagcgtagcctggg

SEQ ID NO: 132683 - DNA, 25 bp, Homo sapien
ccgagttgtaggctgaaggctctac

SEQ ID NO: 132684 - DNA, 25 bp, Homo sapien
tccggcaccgaagatgggtcaggcc

SEQ ID NO: 132685 - DNA, 25 bp, Homo sapien
gggtgtcaacctccggcaccgaaga

SEQ ID NO: 132686 - DNA, 25 bp, Homo sapien
gcggccaggggttgtcccgcttctc

SEQ ID NO: 132687 - DNA, 25 bp, Homo sapien
ccaacggcagaatgcggaccgtggt

SEQ ID NO: 132688 - DNA, 25 bp, Homo sapien
ctctcccagtgatgagcggcccagt

SEQ ID NO: 132689 - DNA, 25 bp, Homo sapien
agcggcccagtcgtgctcctttact

SEQ ID NO: 132690 - DNA, 25 bp, Homo sapien
agtcgtgctcctttactcccgtgct

SEQ ID NO: 132691 - DNA, 25 bp, Homo sapien
cgaggccaacggcagaatgcggacc

SEQ ID NO: 132692 - DNA, 25 bp, Homo sapien
tcccgtgctcccacacttaggaaat

SEQ ID NO: 132693 - DNA, 25 bp, Homo sapien
cccacacttaggaaatgatagtgtg

SEQ ID NO: 132694 - DNA, 25 bp, Homo sapien
ttgcgctgggagcttcagaaaaagc

SEQ ID NO: 132695 - DNA, 25 bp, Homo sapien
cgtccgagctgcacccaaggggcag

SEQ ID NO: 132696 - DNA, 25 bp, Homo sapien
ccagtactgggcgtccgagctgcac

SEQ ID NO: 132697 - DNA, 25 bp, Homo sapien
atacggtaggcctggcccagtactg

SEQ ID NO: 132698 - DNA, 25 bp, Homo sapien
tcctctccgagggtctgagagcacc

SEQ ID NO: 132699 - DNA, 25 bp, Homo sapien
ggcaaacgtggacgcgcgcagctaa

SEQ ID NO: 132700 - DNA, 25 bp, Homo sapien
cctactcttgttggttggcggcttt

SEQ ID NO: 132701 - DNA, 25 bp, Homo sapien
tgccgcgagctcttacctactcttg

SEQ ID NO: 132702 - DNA, 25 bp, Homo sapien
ggcgacaaccgcgaagaggacttcc

SEQ ID NO: 132703 - DNA, 25 bp, Homo sapien
cgtggggctagaagcacttccagtg

SEQ ID NO: 132704 - DNA, 25 bp, Homo sapien
ttccagtgattctttgcaaggttca

SEQ ID NO: 132705 - DNA, 25 bp, Homo sapien
accagtcaaagggagctcgcgttca

SEQ ID NO: 132706 - DNA, 25 bp, Homo sapien
gctcgcgttcaggttcctgttattc

SEQ ID NO: 132707 - DNA, 25 bp, Homo sapien
cctgttattcggactatgctgggcc

SEQ ID NO: 132708 - DNA, 25 bp, Homo sapien
aacgggacctatggcctacagactc

SEQ ID NO: 132709 - DNA, 25 bp, Homo sapien
ctgtgctctgcgctgagtgcccagc

SEQ ID NO: 132710 - DNA, 25 bp, Homo sapien
aggagccaagcatcgtcgcagggca

SEQ ID NO: 132711 - DNA, 25 bp, Homo sapien
ggcctccgtctgtggcctgcgcagc

SEQ ID NO: 132712 - DNA, 25 bp, Homo sapien
cgcagggcaaccagcagaacggaga

SEQ ID NO: 132713 - DNA, 25 bp, Homo sapien
atcgtcgcagggcaaccagcagaac

SEQ ID NO: 132714 - DNA, 25 bp, Homo sapien
attcacgccgggcaggacacctggc

SEQ ID NO: 132715 - DNA, 25 bp, Homo sapien
gtgggaagcacctctcccattcacg

SEQ ID NO: 132716 - DNA, 25 bp, Homo sapien
gcagtgggaagcacctctcccattc

SEQ ID NO: 132717 - DNA, 25 bp, Homo sapien
aggcaggagccaagcatcgtcgcag

SEQ ID NO: 132718 - DNA, 25 bp, Homo sapien
gtcaggtcggcggacaatatacgtc

SEQ ID NO: 132719 - DNA, 25 bp, Homo sapien
cctgggtcccagagcacatccgccg

SEQ ID NO: 132720 - DNA, 25 bp, Homo sapien
tccctgcctgagtcccggggcacgt

SEQ ID NO: 132721 - DNA, 25 bp, Homo sapien
cggcggacaatatacgtcctgtccc

SEQ ID NO: 132722 - DNA, 25 bp, Homo sapien
gcctttcccggccacaggtcaggtc

SEQ ID NO: 132723 - DNA, 25 bp, Homo sapien
ccctgccttgagtccgggggcacat

SEQ ID NO: 132724 - DNA, 25 bp, Homo sapien
tgccttcggtcccatcagggctcct

SEQ ID NO: 132725 - DNA, 25 bp, Homo sapien
ccctcaactactcggaggcccagga

SEQ ID NO: 132726 - DNA, 25 bp, Homo sapien
tcatcatttgatttccgccagcgtc

SEQ ID NO: 132727 - DNA, 25 bp, Homo sapien
tccgcaaaagacaggtggcagtggc

SEQ ID NO: 132728 - DNA, 25 bp, Homo sapien
gccaaaggctcatctgccgggcttg

SEQ ID NO: 132729 - DNA, 25 bp, Homo sapien
cgcaagacttcccttggccaaaaga

SEQ ID NO: 132730 - DNA, 25 bp, Homo sapien
tccaacctggaactcggagggctgt

SEQ ID NO: 132731 - DNA, 25 bp, Homo sapien
accgtgtgatacctttgccgtgggc

SEQ ID NO: 132732 - DNA, 25 bp, Homo sapien
tcgttccactcgctgcgctctgtga

SEQ ID NO: 132733 - DNA, 25 bp, Homo sapien
gtggcagtcttgcatgatacttgtc

SEQ ID NO: 132734 - DNA, 25 bp, Homo sapien
tctgacgatgagtcttcgcccagcc

SEQ ID NO: 132735 - DNA, 25 bp, Homo sapien
gccctcgcctgaggtatgggtctgc

SEQ ID NO: 132736 - DNA, 25 bp, Homo sapien
atgggtctgcaacagcgacggctac

SEQ ID NO: 132737 - DNA, 25 bp, Homo sapien
ccgtctggctcgtagctgctgtcat

SEQ ID NO: 132738 - DNA, 25 bp, Homo sapien
ctccgtcgctgaggagtcctccaga

SEQ ID NO: 132739 - DNA, 25 bp, Homo sapien
catctccattgcaggctcgggcttg

SEQ ID NO: 132740 - DNA, 25 bp, Homo sapien
cccagagctggtgccctttgacagt

SEQ ID NO: 132741 - DNA, 25 bp, Homo sapien
ccctttgacagtgactctgacgatg

SEQ ID NO: 132742 - DNA, 25 bp, Homo sapien
cgccaccggcctggtctgctcacgt

SEQ ID NO: 132743 - DNA, 25 bp, Homo sapien
tgacgtcagcccgcgcgcatgagct

SEQ ID NO: 132744 - DNA, 25 bp, Homo sapien
ggcaggccggccctccacaaacagc

SEQ ID NO: 132745 - DNA, 25 bp, Homo sapien
cggcgcccttcagtctcaggcggag

SEQ ID NO: 132746 - DNA, 25 bp, Homo sapien
cccttcagtctcaggcggagcggac

SEQ ID NO: 132747 - DNA, 25 bp, Homo sapien
ccgcgcgcatgagctctggccagcg

SEQ ID NO: 132748 - DNA, 25 bp, Homo sapien
ccgctaggcggctagtgatggatag

SEQ ID NO: 132749 - DNA, 25 bp, Homo sapien
tgatggatagctgggcttgagcccc

SEQ ID NO: 132750 - DNA, 25 bp, Homo sapien
tggcccggattgacgagcctccgat

SEQ ID NO: 132751 - DNA, 25 bp, Homo sapien
ggtcggtcattagcgcgcgctctcc

SEQ ID NO: 132752 - DNA, 25 bp, Homo sapien
atggagtcagctgcctagcgccagg

SEQ ID NO: 132753 - DNA, 25 bp, Homo sapien
ccgcggcacatctggatggagtcag

SEQ ID NO: 132754 - DNA, 25 bp, Homo sapien
acgagcctccgatgcccatttactg

SEQ ID NO: 132755 - DNA, 25 bp, Homo sapien
accgcaattgctctggcccggattg

SEQ ID NO: 132756 - DNA, 25 bp, Homo sapien
gcgcgcacctttccgagtgccagtg

SEQ ID NO: 132757 - DNA, 25 bp, Homo sapien
atgcccatttactgcgcgcggcagc

SEQ ID NO: 132758 - DNA, 25 bp, Homo sapien
cgcggtgaggtctcagttactgatc

SEQ ID NO: 132759 - DNA, 25 bp, Homo sapien
cggttcatgtctggcgctcagagaa

SEQ ID NO: 132760 - DNA, 25 bp, Homo sapien
gctgcccgcgacgtagccaaagcta

SEQ ID NO: 132761 - DNA, 25 bp, Homo sapien
tgtagccaaggcaacggctcagccc

SEQ ID NO: 132762 - DNA, 25 bp, Homo sapien
agttactgatctcgtgcgcggccct

SEQ ID NO: 132763 - DNA, 25 bp, Homo sapien
gcggccctaacagacggtgtagcca

SEQ ID NO: 132764 - DNA, 25 bp, Homo sapien
tctggcgctcagagaatcgggccgc

SEQ ID NO: 132765 - DNA, 25 bp, Homo sapien
cgtagccaaagctacagctgggccc

SEQ ID NO: 132766 - DNA, 25 bp, Homo sapien
tctcctcgaagtgcctttacgctta

SEQ ID NO: 132767 - DNA, 25 bp, Homo sapien
cgaagtgcctttacgcttaggtaga

SEQ ID NO: 132768 - DNA, 25 bp, Homo sapien
accgactggcagcaagcgtccggga

SEQ ID NO: 132769 - DNA, 25 bp, Homo sapien
gggacactggcgcacagagcagaga

SEQ ID NO: 132770 - DNA, 25 bp, Homo sapien
ggcaaaggctctcctcgaagtgcct

SEQ ID NO: 132771 - DNA, 25 bp, Homo sapien
tgcctttacgcttaggtagaatttc

SEQ ID NO: 132772 - DNA, 25 bp, Homo sapien
gcttaggtagaatttccatgcctcc

SEQ ID NO: 132773 - DNA, 25 bp, Homo sapien
aggaccgactggcagcaagcgtccg

SEQ ID NO: 132774 - DNA, 25 bp, Homo sapien
gtcagaccgcagacggcctgtatga

SEQ ID NO: 132775 - DNA, 25 bp, Homo sapien
gcagacggcctgtacccacagtcag

SEQ ID NO: 132776 - DNA, 25 bp, Homo sapien
cagacggcctgtacccacagtcaaa

SEQ ID NO: 132777 - DNA, 25 bp, Homo sapien
gcagacggcctgtacccacagtcaa

SEQ ID NO: 132778 - DNA, 25 bp, Homo sapien
acagtcaaaccgcagacggcctgta

SEQ ID NO: 132779 - DNA, 25 bp, Homo sapien
tgtacccacagtcagaccgcagacg

SEQ ID NO: 132780 - DNA, 25 bp, Homo sapien
acagtcaaaccacagacggcctgta

SEQ ID NO: 132781 - DNA, 25 bp, Homo sapien
cagacggcctgtacccacagtcaga

SEQ ID NO: 132782 - DNA, 25 bp, Homo sapien
gctttgtttcctctgctcccgacgg

SEQ ID NO: 132783 - DNA, 25 bp, Homo sapien
tccttttttggagtgagcactgaac

SEQ ID NO: 132784 - DNA, 25 bp, Homo sapien
cgcacccgcaggactttctttgagg

SEQ ID NO: 132785 - DNA, 25 bp, Homo sapien
ccaggtaaataaagagctcggtgtc

SEQ ID NO: 132786 - DNA, 25 bp, Homo sapien
accttatcggaaagtgggcagcgcc

SEQ ID NO: 132787 - DNA, 25 bp, Homo sapien
gacgggcatcctgccctgcggaaca

SEQ ID NO: 132788 - DNA, 25 bp, Homo sapien
ctccctagaaggctcgggcatgtcg

SEQ ID NO: 132789 - DNA, 25 bp, Homo sapien
ggacgcccttagtcaccttatcgga

SEQ ID NO: 132790 - DNA, 25 bp, Homo sapien
ctgaaggcgataccttctattatcg

SEQ ID NO: 132791 - DNA, 25 bp, Homo sapien
actattctgtgaatccgggatccgg

SEQ ID NO: 132792 - DNA, 25 bp, Homo sapien
tggcttccgggggatcctgttttca

SEQ ID NO: 132793 - DNA, 25 bp, Homo sapien
gtccccattcctagcggcaaacgtg

SEQ ID NO: 132794 - DNA, 25 bp, Homo sapien
aaacgtggagcgcaggcaccttcca

SEQ ID NO: 132795 - DNA, 25 bp, Homo sapien
tgctctcccgctgtgtgcgactgaa

SEQ ID NO: 132796 - DNA, 25 bp, Homo sapien
tgtgtgcgactgaaggcgatacctt

SEQ ID NO: 132797 - DNA, 25 bp, Homo sapien
cccagcgcactattctgtgaatccg

SEQ ID NO: 132798 - DNA, 25 bp, Homo sapien
ggcatgtcattacacagatccgcgt

SEQ ID NO: 132799 - DNA, 25 bp, Homo sapien
tgtggcgccagcaccatgtggtaaa

SEQ ID NO: 132800 - DNA, 25 bp, Homo sapien
ctctgctcagacacagcggagggca

SEQ ID NO: 132801 - DNA, 25 bp, Homo sapien
tcagacgaaacaggtgctctgctca

SEQ ID NO: 132802 - DNA, 25 bp, Homo sapien
cgctgatggcgtgagtcagacgaaa

SEQ ID NO: 132803 - DNA, 25 bp, Homo sapien
gcgagtaacacgtatgcccgtgtga

SEQ ID NO: 132804 - DNA, 25 bp, Homo sapien
cagatccgcgtgctagcgagtaaca

SEQ ID NO: 132805 - DNA, 25 bp, Homo sapien
gcgtcaggacgtgcggccacaccta

SEQ ID NO: 132806 - DNA, 25 bp, Homo sapien
ggctcggtgctccagaaggcaccgc

SEQ ID NO: 132807 - DNA, 25 bp, Homo sapien
gatgggacgcccagggctcgaaccc

SEQ ID NO: 132808 - DNA, 25 bp, Homo sapien
cttgaactggaagcccgccgtacca

SEQ ID NO: 132809 - DNA, 25 bp, Homo sapien
cacttgggacggttctcactgcccg

SEQ ID NO: 132810 - DNA, 25 bp, Homo sapien
gcacatggggctcgccttgaccacg

SEQ ID NO: 132811 - DNA, 25 bp, Homo sapien
gacggttctcactgcccgcgcaggg

SEQ ID NO: 132812 - DNA, 25 bp, Homo sapien
gcctacccttcttgaactggaagcc

SEQ ID NO: 132813 - DNA, 25 bp, Homo sapien
caccgcgctctccttgggtgggaag

SEQ ID NO: 132814 - DNA, 25 bp, Homo sapien
cccagggaaataaagccgttgctgc

SEQ ID NO: 132815 - DNA, 25 bp, Homo sapien
ttcctgtgagtaaatacgcggcctg

SEQ ID NO: 132816 - DNA, 25 bp, Homo sapien
gtgattcccggctcagtaacgtttc

SEQ ID NO: 132817 - DNA, 25 bp, Homo sapien
gcccactggaactccactggctgtg

SEQ ID NO: 132818 - DNA, 25 bp, Homo sapien
cgggaacgcgctctaatccttgatg

SEQ ID NO: 132819 - DNA, 25 bp, Homo sapien
gcacaacgtctaggacttccctgta

SEQ ID NO: 132820 - DNA, 25 bp, Homo sapien
ccacagcccgggagaaattagtgtt

SEQ ID NO: 132821 - DNA, 25 bp, Homo sapien
cgtttcctgcgtgtgcagctccaca

SEQ ID NO: 132822 - DNA, 25 bp, Homo sapien
ggcccagccggcgattcattcaaaa

SEQ ID NO: 132823 - DNA, 25 bp, Homo sapien
attcattcaaaaggcgcgcaggctg

SEQ ID NO: 132824 - DNA, 25 bp, Homo sapien
accggccaccgccagtctccgagcc

SEQ ID NO: 132825 - DNA, 25 bp, Homo sapien
aaacttggaccgagaccaggttgtg

SEQ ID NO: 132826 - DNA, 25 bp, Homo sapien
ctggatggtgtcagcccgtgactgt

SEQ ID NO: 132827 - DNA, 25 bp, Homo sapien
cagggccacccgttactgtgagtgt

SEQ ID NO: 132828 - DNA, 25 bp, Homo sapien
ccacccgttactgtgagtgtgaaat

SEQ ID NO: 132829 - DNA, 25 bp, Homo sapien
ggagcgcccatccagagtctgctct

SEQ ID NO: 132830 - DNA, 25 bp, Homo sapien
cgcggggacaccaagtcattgtacc

SEQ ID NO: 132831 - DNA, 25 bp, Homo sapien
ttcccggaaccacagggtgtgcatg

SEQ ID NO: 132832 - DNA, 25 bp, Homo sapien
cccgtaaacgttggagccatcgatg

SEQ ID NO: 132833 - DNA, 25 bp, Homo sapien
tctgctctcgtgcatagactgaatc

SEQ ID NO: 132834 - DNA, 25 bp, Homo sapien
actgtgtggtccaagtcgtgctcta

SEQ ID NO: 132835 - DNA, 25 bp, Homo sapien
gtacttcgcatggaaacaccggttg

SEQ ID NO: 132836 - DNA, 25 bp, Homo sapien
tggccatcctgttgtgttcccggaa

SEQ ID NO: 132837 - DNA, 25 bp, Homo sapien
gcctgcgagctgtgcatccagataa

SEQ ID NO: 132838 - DNA, 25 bp, Homo sapien
cacggtcttacggtgtaggagcatt

SEQ ID NO: 132839 - DNA, 25 bp, Homo sapien
gaagggcgctcactgacttaggtga

SEQ ID NO: 132840 - DNA, 25 bp, Homo sapien
cccgcggacgccaaagtcaacaagg

SEQ ID NO: 132841 - DNA, 25 bp, Homo sapien
caaacaacgcgaggccttgacaggc

SEQ ID NO: 132842 - DNA, 25 bp, Homo sapien
agatcacgcgagagcatggcctcca

SEQ ID NO: 132843 - DNA, 25 bp, Homo sapien
aggctttcagtggtctcagggctac

SEQ ID NO: 132844 - DNA, 25 bp, Homo sapien
cattcctggatttggaggcgaaccc

SEQ ID NO: 132845 - DNA, 25 bp, Homo sapien
ctttgcattgaaggacacggtctta

SEQ ID NO: 132846 - DNA, 25 bp, Homo sapien
agatctccgcgccttgggctcaaag

SEQ ID NO: 132847 - DNA, 25 bp, Homo sapien
agcaccgcgttctcttccgcgtggg

SEQ ID NO: 132848 - DNA, 25 bp, Homo sapien
acccagtagggtaactgccgcgtcg

SEQ ID NO: 132849 - DNA, 25 bp, Homo sapien
atggggacatcgtacctgcgctccg

SEQ ID NO: 132850 - DNA, 25 bp, Homo sapien
aagcaacggcttgggctccttatcc

SEQ ID NO: 132851 - DNA, 25 bp, Homo sapien
ttaaggggccgcatgttcgcaagcc

SEQ ID NO: 132852 - DNA, 25 bp, Homo sapien
gagctgcactgggactcggtcctca

SEQ ID NO: 132853 - DNA, 25 bp, Homo sapien
ggtcctcagtgtgccgaagcctaag

SEQ ID NO: 132854 - DNA, 25 bp, Homo sapien
aggccgaccggaaccctggaccatg

SEQ ID NO: 132855 - DNA, 25 bp, Homo sapien
ggagcatcgactcgaaccgcttttg

SEQ ID NO: 132856 - DNA, 25 bp, Homo sapien
acctccggcagcctagtggagcatc

SEQ ID NO: 132857 - DNA, 25 bp, Homo sapien
caactaggccgggtactaagcggca

SEQ ID NO: 132858 - DNA, 25 bp, Homo sapien
ctagtcctcggcagcggttaccaac

SEQ ID NO: 132859 - DNA, 25 bp, Homo sapien
ccgcggcttggtttgttattgtcga

SEQ ID NO: 132860 - DNA, 25 bp, Homo sapien
gccgcctgttatggtgctagctgcc

SEQ ID NO: 132861 - DNA, 25 bp, Homo sapien
aatttgaccttctttgcgacagcta

SEQ ID NO: 132862 - DNA, 25 bp, Homo sapien
aactccgccgtgctgtacgtgttgc

SEQ ID NO: 132863 - DNA, 25 bp, Homo sapien
gaacctccgccagctgataacttgc

SEQ ID NO: 132864 - DNA, 25 bp, Homo sapien
tgaccttcctggtggtggcaatcct

SEQ ID NO: 132865 - DNA, 25 bp, Homo sapien
accagttgtctacgcggtgatctgc

SEQ ID NO: 132866 - DNA, 25 bp, Homo sapien
gtgtcctctataccaccctgctgtg

SEQ ID NO: 132867 - DNA, 25 bp, Homo sapien
ctcatgtgcaagctcatcgtggcta

SEQ ID NO: 132868 - DNA, 25 bp, Homo sapien
gctggtcatcgctatctcctacttc

SEQ ID NO: 132869 - DNA, 25 bp, Homo sapien
tggtgctgcccatcaacatcgccga

SEQ ID NO: 132870 - DNA, 25 bp, Homo sapien
cggatggtctccgagtggagctctt

SEQ ID NO: 132871 - DNA, 25 bp, Homo sapien
gcccagcacacaccagggtttctag

SEQ ID NO: 132872 - DNA, 25 bp, Homo sapien
cgcttgctggatgagtgaacagatg

SEQ ID NO: 132873 - DNA, 25 bp, Homo sapien
tgcgtgaatgacttgtcgcttcttc

SEQ ID NO: 132874 - DNA, 25 bp, Homo sapien
tggctgcactccgtcttcccggagg

SEQ ID NO: 132875 - DNA, 25 bp, Homo sapien
gagtggtttccaacacgctttcttg

SEQ ID NO: 132876 - DNA, 25 bp, Homo sapien
agggtttctaggaacgcttgctgga

SEQ ID NO: 132877 - DNA, 25 bp, Homo sapien
aaagtcccaccgcttcctgcgaggg

SEQ ID NO: 132878 - DNA, 25 bp, Homo sapien
gggcgaagagcgctcgctccttctc

SEQ ID NO: 132879 - DNA, 25 bp, Homo sapien
ttacctatggttcccagagacaggc

SEQ ID NO: 132880 - DNA, 25 bp, Homo sapien
tcgaaagcccaaagcttacctatgg

SEQ ID NO: 132881 - DNA, 25 bp, Homo sapien
tcccagcacggagctctacctagaa

SEQ ID NO: 132882 - DNA, 25 bp, Homo sapien
agaacggacttctcgctgcctttcc

SEQ ID NO: 132883 - DNA, 25 bp, Homo sapien
tagaccgccgtgatgatgaccggga

SEQ ID NO: 132884 - DNA, 25 bp, Homo sapien
tggacgcggagaggcaaactttgcc

SEQ ID NO: 132885 - DNA, 25 bp, Homo sapien
tacctagaactgcacctcgaaagcc

SEQ ID NO: 132886 - DNA, 25 bp, Homo sapien
gttccctggtgtcgggaagccacgc

SEQ ID NO: 132887 - DNA, 25 bp, Homo sapien
gatgccgtggacgtgaaggcgacga

SEQ ID NO: 132888 - DNA, 25 bp, Homo sapien
atgggctaggctcatcttagagaag

SEQ ID NO: 132889 - DNA, 25 bp, Homo sapien
acgaggcatgggtgacgggttccct

SEQ ID NO: 132890 - DNA, 25 bp, Homo sapien
tcagacgccccggtccgatgggcta

SEQ ID NO: 132891 - DNA, 25 bp, Homo sapien
ccaagggcggcatggctcagacgcc

SEQ ID NO: 132892 - DNA, 25 bp, Homo sapien
tcagcatcccaagggcggcatggct

SEQ ID NO: 132893 - DNA, 25 bp, Homo sapien
gcagctcagcatcccaagggcggca

SEQ ID NO: 132894 - DNA, 25 bp, Homo sapien
cgggtcgtgctccataaatgaggtt

SEQ ID NO: 132895 - DNA, 25 bp, Homo sapien
tcggctctgtgcgtttgagaaaaca

SEQ ID NO: 132896 - DNA, 25 bp, Homo sapien
agtcgtaaacactatcggtctcttc

SEQ ID NO: 132897 - DNA, 25 bp, Homo sapien
ggcagtttgtgcagaatccgaaata

SEQ ID NO: 132898 - DNA, 25 bp, Homo sapien
gaggaaacgcaaacccatctgactg

SEQ ID NO: 132899 - DNA, 25 bp, Homo sapien
cagagccaaggtgcgccctacagac

SEQ ID NO: 132900 - DNA, 25 bp, Homo sapien
atagactgaggcaggctcagcctcg

SEQ ID NO: 132901 - DNA, 25 bp, Homo sapien
ttccgacagagaaggcgatcccatg

SEQ ID NO: 132902 - DNA, 25 bp, Homo sapien
ttgttcggtgcggacaactggattc

SEQ ID NO: 132903 - DNA, 25 bp, Homo sapien
ccgcgtcagagccaagtaggcgtct

SEQ ID NO: 132904 - DNA, 25 bp, Homo sapien
gccgggagactccaaagcagcaaga

SEQ ID NO: 132905 - DNA, 25 bp, Homo sapien
actggattcccgagtccgtaacttg

SEQ ID NO: 132906 - DNA, 25 bp, Homo sapien
gtcccgcaccaaggagacgttgagg

SEQ ID NO: 132907 - DNA, 25 bp, Homo sapien
agggcggccttacctcgcgaatcct

SEQ ID NO: 132908 - DNA, 25 bp, Homo sapien
agcagaggccaaaacgctcttattg

SEQ ID NO: 132909 - DNA, 25 bp, Homo sapien
gtaggcgtctcctgtcaggtccaga

SEQ ID NO: 132910 - DNA, 25 bp, Homo sapien
ctccggtcacggacagtggaataaa

SEQ ID NO: 132911 - DNA, 25 bp, Homo sapien
gtctcctcaccggtgagcagctgca

SEQ ID NO: 132912 - DNA, 25 bp, Homo sapien
gcccttgtcttctccggaggctacg

SEQ ID NO: 132913 - DNA, 25 bp, Homo sapien
ctgtgaggaaagtcaggtcgcccga

SEQ ID NO: 132914 - DNA, 25 bp, Homo sapien
ctcggctctgaatcctctgcagtag

SEQ ID NO: 132915 - DNA, 25 bp, Homo sapien
tttgtagactcaaagaccacctgtg

SEQ ID NO: 132916 - DNA, 25 bp, Homo sapien
caaccatccgctggcgaattttgta

SEQ ID NO: 132917 - DNA, 25 bp, Homo sapien
gtggaataaagccaaccatccgctg

SEQ ID NO: 132918 - DNA, 25 bp, Homo sapien
ggcgccaagaccgatttccaagtcg

SEQ ID NO: 132919 - DNA, 25 bp, Homo sapien
cagaacagtgctgggcgctctcttt

SEQ ID NO: 132920 - DNA, 25 bp, Homo sapien
tcaggctttaggtcgccaggaaccc

SEQ ID NO: 132921 - DNA, 25 bp, Homo sapien
tctcgacttcttagcgtggggtccc

SEQ ID NO: 132922 - DNA, 25 bp, Homo sapien
cctcatgaatgagaatgggttgcta

SEQ ID NO: 132923 - DNA, 25 bp, Homo sapien
tctgggacccacgaaaggctttgga

SEQ ID NO: 132924 - DNA, 25 bp, Homo sapien
tcgcggcttcccagaaagggcctca

SEQ ID NO: 132925 - DNA, 25 bp, Homo sapien
ttccaccgccgaaagaatacaggcc

SEQ ID NO: 132926 - DNA, 25 bp, Homo sapien
cactcttgggacttgctaatgcggg

SEQ ID NO: 132927 - DNA, 25 bp, Homo sapien
agccctccgcgctgcaatattgaga

SEQ ID NO: 132928 - DNA, 25 bp, Homo sapien
ttcattcacgaggtccgagcacgca

SEQ ID NO: 132929 - DNA, 25 bp, Homo sapien
tggcttcgcatccacactcttggga

SEQ ID NO: 132930 - DNA, 25 bp, Homo sapien
gctcgtgagtatcccagttcctcga

SEQ ID NO: 132931 - DNA, 25 bp, Homo sapien
actctctttcttcgtctcgggctcg

SEQ ID NO: 132932 - DNA, 25 bp, Homo sapien
atcgcgccaccaggatcaatatgtc

SEQ ID NO: 132933 - DNA, 25 bp, Homo sapien
ggaacgcgggagtctagtctttaga

SEQ ID NO: 132934 - DNA, 25 bp, Homo sapien
aggggcgagcccatgttcccgccag

SEQ ID NO: 132935 - DNA, 25 bp, Homo sapien
agcgacaatcgaacaccgcgcgcga

SEQ ID NO: 132936 - DNA, 25 bp, Homo sapien
ccaactgactgcagatcgctggtga

SEQ ID NO: 132937 - DNA, 25 bp, Homo sapien
gcccggttttgctgcgcgttcacct

SEQ ID NO: 132938 - DNA, 25 bp, Homo sapien
tgcatcgggacatcccggagtttta

SEQ ID NO: 132939 - DNA, 25 bp, Homo sapien
gagttttagaactcgcggaggccca

SEQ ID NO: 132940 - DNA, 25 bp, Homo sapien
gcggaggcccaagtatctcgaaacg

SEQ ID NO: 132941 - DNA, 25 bp, Homo sapien
acgtgcaggcgctaccaactgactg

SEQ ID NO: 132942 - DNA, 25 bp, Homo sapien
tgttattgccgcacatacaccgcct

SEQ ID NO: 132943 - DNA, 25 bp, Homo sapien
ttcctccgcaatgcagggaggagct

SEQ ID NO: 132944 - DNA, 25 bp, Homo sapien
gcctacgccactcaccgcagcggtg

SEQ ID NO: 132945 - DNA, 25 bp, Homo sapien
ggttgacatgttattgccgcacata

SEQ ID NO: 132946 - DNA, 25 bp, Homo sapien
gcctcagctcacagcgcaagcggaa

SEQ ID NO: 132947 - DNA, 25 bp, Homo sapien
gctcacagcgcaagcggaaggaaga

SEQ ID NO: 132948 - DNA, 25 bp, Homo sapien
gcagcggggttgacatgttattgcc

SEQ ID NO: 132949 - DNA, 25 bp, Homo sapien
ggcacctcacaatgtccgggcggct

SEQ ID NO: 132950 - DNA, 25 bp, Homo sapien
gcccttgaaagttcttggatctgcg

SEQ ID NO: 132951 - DNA, 25 bp, Homo sapien
cccgagaccacgtggcctccgagca

SEQ ID NO: 132952 - DNA, 25 bp, Homo sapien
tgtgagcctggccaacttaaagccg

SEQ ID NO: 132953 - DNA, 25 bp, Homo sapien
gttcttggatctgcgggttatggcc

SEQ ID NO: 132954 - DNA, 25 bp, Homo sapien
atctgcgggttatggccggtccctt

SEQ ID NO: 132955 - DNA, 25 bp, Homo sapien
ctggccaacttaaagccgaatcccg

SEQ ID NO: 132956 - DNA, 25 bp, Homo sapien
ctcagggcgcccttgaaagttcttg

SEQ ID NO: 132957 - DNA, 25 bp, Homo sapien
gggcgcccttgaaagttcttggatc

SEQ ID NO: 132958 - DNA, 25 bp, Homo sapien
gcgcaattagtagccaggagccctg

SEQ ID NO: 132959 - DNA, 25 bp, Homo sapien
gggtccttcccgatcgacttgagtg

SEQ ID NO: 132960 - DNA, 25 bp, Homo sapien
ccgagttaatttctgcgcccgctga

SEQ ID NO: 132961 - DNA, 25 bp, Homo sapien
agtcgcttccttgcccagcctttag

SEQ ID NO: 132962 - DNA, 25 bp, Homo sapien
accctggaccgtgcagtgctaacgc

SEQ ID NO: 132963 - DNA, 25 bp, Homo sapien
gccgcccgcgcacgatttataaatg

SEQ ID NO: 132964 - DNA, 25 bp, Homo sapien
taccattgtctagtcatccacgggc

SEQ ID NO: 132965 - DNA, 25 bp, Homo sapien
cggtgtactcggctcttacttgtga

SEQ ID NO: 132966 - DNA, 25 bp, Homo sapien
tgtagcggccacgtcctttcttaag

SEQ ID NO: 132967 - DNA, 25 bp, Homo sapien
ctgtttttcgaacgaccgggtgatg

SEQ ID NO: 132968 - DNA, 25 bp, Homo sapien
cgcgaatcgctaggccgatttctta

SEQ ID NO: 132969 - DNA, 25 bp, Homo sapien
caggagtcccagatctccctcttta

SEQ ID NO: 132970 - DNA, 25 bp, Homo sapien
caaactgttctttgcgagcctgacg

SEQ ID NO: 132971 - DNA, 25 bp, Homo sapien
cccggttgcgcaattcaaagtctga

SEQ ID NO: 132972 - DNA, 25 bp, Homo sapien
ccttccactgtgcaggcaagtcgtg

SEQ ID NO: 132973 - DNA, 25 bp, Homo sapien
ctggcgcagcagaatccagacctgc

SEQ ID NO: 132974 - DNA, 25 bp, Homo sapien
tcggcctaagccacggtgactcgaa

SEQ ID NO: 132975 - DNA, 25 bp, Homo sapien
gcttagattctctgtgggccacatg

SEQ ID NO: 132976 - DNA, 25 bp, Homo sapien
aatcaaaccctgtagccgtccgctg

SEQ ID NO: 132977 - DNA, 25 bp, Homo sapien
cggcgctagatgaagtgctcgttta

SEQ ID NO: 132978 - DNA, 25 bp, Homo sapien
gccgcattaacaaggatctggattc

SEQ ID NO: 132979 - DNA, 25 bp, Homo sapien
cccgctgctacattaggccgcatta

SEQ ID NO: 132980 - DNA, 25 bp, Homo sapien
gcctctgcacgttctttcctgtgga

SEQ ID NO: 132981 - DNA, 25 bp, Homo sapien
cgcgccaaggcttcggaagttctca

SEQ ID NO: 132982 - DNA, 25 bp, Homo sapien
gcacatggctctggtcgtactcccg

SEQ ID NO: 132983 - DNA, 25 bp, Homo sapien
gcaggtctctactgcaagcccgcag

SEQ ID NO: 132984 - DNA, 25 bp, Homo sapien
tcatcgctgggcctactggcgaccc

SEQ ID NO: 132985 - DNA, 25 bp, Homo sapien
agctgacgccgcctccaaagacgcg

SEQ ID NO: 132986 - DNA, 25 bp, Homo sapien
caaagacgcgccctgctggacggcg

SEQ ID NO: 132987 - DNA, 25 bp, Homo sapien
ggagtctcctgggaacagcccaggc

SEQ ID NO: 132988 - DNA, 25 bp, Homo sapien
cagccagcggagtctcctgggaaca

SEQ ID NO: 132989 - DNA, 25 bp, Homo sapien
accagcagctaagcgcaggtctcta

SEQ ID NO: 132990 - DNA, 25 bp, Homo sapien
tccgggacatccgtagccgatccaa

SEQ ID NO: 132991 - DNA, 25 bp, Homo sapien
gctcttcccgcgtctagatctgttc

SEQ ID NO: 132992 - DNA, 25 bp, Homo sapien
cctcctaagtcgctgatcctcatgg

SEQ ID NO: 132993 - DNA, 25 bp, Homo sapien
gagctgacctcacccttctgggatg

SEQ ID NO: 132994 - DNA, 25 bp, Homo sapien
gtccggaccaggcttcatcctttta

SEQ ID NO: 132995 - DNA, 25 bp, Homo sapien
ggcttgcctcgatccagcaccgatt

SEQ ID NO: 132996 - DNA, 25 bp, Homo sapien
aatgcccatcgttaggcgcctggtg

SEQ ID NO: 132997 - DNA, 25 bp, Homo sapien
tgcggtcggcaatacccattcctga

SEQ ID NO: 132998 - DNA, 25 bp, Homo sapien
cggagcctagtggtcttcaggaatg

SEQ ID NO: 132999 - DNA, 25 bp, Homo sapien
agcagccgggccattagcgcgcact

SEQ ID NO: 133000 - DNA, 25 bp, Homo sapien
tagacctggacaaagcccgtcggcg

SEQ ID NO: 133001 - DNA, 25 bp, Homo sapien
ggtgcagcctgtagacctggacaaa

SEQ ID NO: 133002 - DNA, 25 bp, Homo sapien
ttcccacggcaggaaggtgcagcct

SEQ ID NO: 133003 - DNA, 25 bp, Homo sapien
ttcaggaatggcgacccgaagacga

SEQ ID NO: 133004 - DNA, 25 bp, Homo sapien
ggacggcgagtcctacctatgttcc

SEQ ID NO: 133005 - DNA, 25 bp, Homo sapien
gagtcctacctatgttcccacggca

SEQ ID NO: 133006 - DNA, 25 bp, Homo sapien
gtgtcgctcaaatccacccagcgtt

SEQ ID NO: 133007 - DNA, 25 bp, Homo sapien
agaactcggaccactcgggctcggt

SEQ ID NO: 133008 - DNA, 25 bp, Homo sapien
ccgctaaatcagacgggaggctgaa

SEQ ID NO: 133009 - DNA, 25 bp, Homo sapien
gtggaggcatcatggccgctaaatc

SEQ ID NO: 133010 - DNA, 25 bp, Homo sapien
ggtgtcagataaaggagggctctcc

SEQ ID NO: 133011 - DNA, 25 bp, Homo sapien
ccagcgttccgaaatcccgggagtg

SEQ ID NO: 133012 - DNA, 25 bp, Homo sapien
tccgaccggaatacaaagaggcctg

SEQ ID NO: 133013 - DNA, 25 bp, Homo sapien
tgaggtcatcctctccctcggagtc

SEQ ID NO: 133014 - DNA, 25 bp, Homo sapien
caaaagtcgtaaacgcgaggagttg

SEQ ID NO: 133015 - DNA, 25 bp, Homo sapien
tcgtaaacgcgaggagttgtcttca

SEQ ID NO: 133016 - DNA, 25 bp, Homo sapien
gtcgtaaacgcgaggagttgtcttc

SEQ ID NO: 133017 - DNA, 25 bp, Homo sapien
ggcacaaaagtcgtaaacgcgagga

SEQ ID NO: 133018 - DNA, 25 bp, Homo sapien
gcagggactagggctgtacacacaa

SEQ ID NO: 133019 - DNA, 25 bp, Homo sapien
cctcactactgccgagggccgggcc

SEQ ID NO: 133020 - DNA, 25 bp, Homo sapien
tgggcacaaaagtcgtaaacgcgag

SEQ ID NO: 133021 - DNA, 25 bp, Homo sapien
gtaaacgcgaggagttgtcttcacg

SEQ ID NO: 133022 - DNA, 25 bp, Homo sapien
cggacagatttgcacggcggattcc

SEQ ID NO: 133023 - DNA, 25 bp, Homo sapien
gcattaggatgaaacgcgccgaacc

SEQ ID NO: 133024 - DNA, 25 bp, Homo sapien
ggggcagctctcctttaccctagag

SEQ ID NO: 133025 - DNA, 25 bp, Homo sapien
gattcctccgaagcaacccgtgtga

SEQ ID NO: 133026 - DNA, 25 bp, Homo sapien
gcgggccagtttctatctcctcatc

SEQ ID NO: 133027 - DNA, 25 bp, Homo sapien
cgaggcctgttttaagtctccagta

SEQ ID NO: 133028 - DNA, 25 bp, Homo sapien
gctgcctccgaagtggtaaaatgtg

SEQ ID NO: 133029 - DNA, 25 bp, Homo sapien
tgcccgcgaagagactggggattcc

SEQ ID NO: 133030 - DNA, 25 bp, Homo sapien
ggactcctcggattgtgcaatctga

SEQ ID NO: 133031 - DNA, 25 bp, Homo sapien
tagatgtcttcagccgacgggtgac

SEQ ID NO: 133032 - DNA, 25 bp, Homo sapien
ggcggcgaaggctcttagatgtctt

SEQ ID NO: 133033 - DNA, 25 bp, Homo sapien
ccgaaactttcaccgcgagcgggtg

SEQ ID NO: 133034 - DNA, 25 bp, Homo sapien
tctgaactcaagtcaccgtggagct

SEQ ID NO: 133035 - DNA, 25 bp, Homo sapien
cgccctccgggctcaatatgcaaat

SEQ ID NO: 133036 - DNA, 25 bp, Homo sapien
ttctgtgccttcaaagccctgcgcg

SEQ ID NO: 133037 - DNA, 25 bp, Homo sapien
agactgagtcgccaggtttctgtgc

SEQ ID NO: 133038 - DNA, 25 bp, Homo sapien
aagctcgtcgcttttcgcccaattc

SEQ ID NO: 133039 - DNA, 25 bp, Homo sapien
aattcggtgaattgccacctccggc

SEQ ID NO: 133040 - DNA, 25 bp, Homo sapien
cggcttgttagggtgattcgaattc

SEQ ID NO: 133041 - DNA, 25 bp, Homo sapien
atagcacgcttgcatccgggtccca

SEQ ID NO: 133042 - DNA, 25 bp, Homo sapien
tacgaccgcgtcttcctcaaaaaga

SEQ ID NO: 133043 - DNA, 25 bp, Homo sapien
ggagcgtgcggaccaaaaatcctca

SEQ ID NO: 133044 - DNA, 25 bp, Homo sapien
tgccctcaggagcacgaactcgaaa

SEQ ID NO: 133045 - DNA, 25 bp, Homo sapien
cgaatgcactgacccttttccaagg

SEQ ID NO: 133046 - DNA, 25 bp, Homo sapien
tccaccgatggggaaaactcgctcc

SEQ ID NO: 133047 - DNA, 25 bp, Homo sapien
actgatcaagatgttcgcgggcttc

SEQ ID NO: 133048 - DNA, 25 bp, Homo sapien
gggcttcaggtccaagtgcacaatg

SEQ ID NO: 133049 - DNA, 25 bp, Homo sapien
agccaccacgcgcacgatgttatcg

SEQ ID NO: 133050 - DNA, 25 bp, Homo sapien
gcgcagccttgctacgttgagctca

SEQ ID NO: 133051 - DNA, 25 bp, Homo sapien
agtcggttcttggtgcacttgttca

SEQ ID NO: 133052 - DNA, 25 bp, Homo sapien
ttatggccacaggaacaccgcggta

SEQ ID NO: 133053 - DNA, 25 bp, Homo sapien
gacgttgccaccgaactccatgatg

SEQ ID NO: 133054 - DNA, 25 bp, Homo sapien
acggtgccaggccacacgctcacgt

SEQ ID NO: 133055 - DNA, 25 bp, Homo sapien
cccgtcacacaagaagtcaggcgtc

SEQ ID NO: 133056 - DNA, 25 bp, Homo sapien
atctcacctgcctgggtggcacaac

SEQ ID NO: 133057 - DNA, 25 bp, Homo sapien
agtcaggcgtctttaggagtggccc

SEQ ID NO: 133058 - DNA, 25 bp, Homo sapien
tgtcaggcctcacacggtgccaggc

SEQ ID NO: 133059 - DNA, 25 bp, Homo sapien
agtgtccctgtcaggcctcacacgg

SEQ ID NO: 133060 - DNA, 25 bp, Homo sapien
ggccgtggcacacacagtgtccctg

SEQ ID NO: 133061 - DNA, 25 bp, Homo sapien
tggcacaacccgtcacacaagaagt

SEQ ID NO: 133062 - DNA, 25 bp, Homo sapien
agagcgcgagtattgcaaccgtgca

SEQ ID NO: 133063 - DNA, 25 bp, Homo sapien
ccagaggttacagtgcgaagagcgc

SEQ ID NO: 133064 - DNA, 25 bp, Homo sapien
ggggaccgccaggttaagagatctc

SEQ ID NO: 133065 - DNA, 25 bp, Homo sapien
ggcagtcttaaaaaggcccagaagc

SEQ ID NO: 133066 - DNA, 25 bp, Homo sapien
cgtcgtcttttggaaggcagtctta

SEQ ID NO: 133067 - DNA, 25 bp, Homo sapien
ttctctttagagtcatcacgtcgtc

SEQ ID NO: 133068 - DNA, 25 bp, Homo sapien
ggtggctctgcctttcttgattccc

SEQ ID NO: 133069 - DNA, 25 bp, Homo sapien
accaacgtggttggctttctgggca

SEQ ID NO: 133070 - DNA, 25 bp, Homo sapien
caggtcgtacacctaggccgtccgg

SEQ ID NO: 133071 - DNA, 25 bp, Homo sapien
cccggcaggttctggcactcctcgt

SEQ ID NO: 133072 - DNA, 25 bp, Homo sapien
gaatgcaggcgtcacatccacgccg

SEQ ID NO: 133073 - DNA, 25 bp, Homo sapien
gcatcatccgcgtccttagcgcggg

SEQ ID NO: 133074 - DNA, 25 bp, Homo sapien
agacccgcgcgccagggaaagcggc

SEQ ID NO: 133075 - DNA, 25 bp, Homo sapien
ggcgagctgcgctccgcacaaaatt

SEQ ID NO: 133076 - DNA, 25 bp, Homo sapien
ctgcgctccgcacaaaattgcggtg

SEQ ID NO: 133077 - DNA, 25 bp, Homo sapien
gtccaggtgccgcagactcttagcc

SEQ ID NO: 133078 - DNA, 25 bp, Homo sapien
atcgccatcgccttcctggtttgga

SEQ ID NO: 133079 - DNA, 25 bp, Homo sapien
ggctggagcccttacgtcacttaca

SEQ ID NO: 133080 - DNA, 25 bp, Homo sapien
gtttccactggcgtcaaaagaagcc

SEQ ID NO: 133081 - DNA, 25 bp, Homo sapien
gcaggttaggtttccactggcgtca

SEQ ID NO: 133082 - DNA, 25 bp, Homo sapien
cgccttcctggtttggacagctcta

SEQ ID NO: 133083 - DNA, 25 bp, Homo sapien
aggggagccacgcactcaccgcttt

SEQ ID NO: 133084 - DNA, 25 bp, Homo sapien
cagggtaaaaactcggccactggcg

SEQ ID NO: 133085 - DNA, 25 bp, Homo sapien
gtttggacagctctaccggctcctc

SEQ ID NO: 133086 - DNA, 25 bp, Homo sapien
gatcagatgctgacgggctacaccg

SEQ ID NO: 133087 - DNA, 25 bp, Homo sapien
aagatgacctctgcctagtccgggc

SEQ ID NO: 133088 - DNA, 25 bp, Homo sapien
gctgcgtgagccattgacgtgtttg

SEQ ID NO: 133089 - DNA, 25 bp, Homo sapien
tgcgcgctacttaaggtcctgctgc

SEQ ID NO: 133090 - DNA, 25 bp, Homo sapien
ctcggcacagcaaggtgtgttcacc

SEQ ID NO: 133091 - DNA, 25 bp, Homo sapien
gccgcccgtcaagccgaagtgttaa

SEQ ID NO: 133092 - DNA, 25 bp, Homo sapien
tttccagcagccattgtagtgtatg

SEQ ID NO: 133093 - DNA, 25 bp, Homo sapien
ctgtgtagcctctgaagcgcagtta

SEQ ID NO: 133094 - DNA, 25 bp, Homo sapien
gctacccggtgcagctgctttctca

SEQ ID NO: 133095 - DNA, 25 bp, Homo sapien
ggtgtttatccaggcgccgcccaag

SEQ ID NO: 133096 - DNA, 25 bp, Homo sapien
gagctcagtcaggttcaggtgttta

SEQ ID NO: 133097 - DNA, 25 bp, Homo sapien
gtccgcggagaagccggcctcgtct

SEQ ID NO: 133098 - DNA, 25 bp, Homo sapien
gacgacctcggcaacttacccagga

SEQ ID NO: 133099 - DNA, 25 bp, Homo sapien
ctgctttctcaccagctcgcgggtg

SEQ ID NO: 133100 - DNA, 25 bp, Homo sapien
tctgcgttagccgtagccacgggag

SEQ ID NO: 133101 - DNA, 25 bp, Homo sapien
ttgcgagcgacccagcgtgaaacca

SEQ ID NO: 133102 - DNA, 25 bp, Homo sapien
ccagacatgagagaattgaggaact

SEQ ID NO: 133103 - DNA, 25 bp, Homo sapien
tcatgttttgtggacgaccgcccgt

SEQ ID NO: 133104 - DNA, 25 bp, Homo sapien
ggttcccgattctacaccagacatg

SEQ ID NO: 133105 - DNA, 25 bp, Homo sapien
tgaagcatcctctaggttcccgatt

SEQ ID NO: 133106 - DNA, 25 bp, Homo sapien
ttccctaggcaattttgaagcatcc

SEQ ID NO: 133107 - DNA, 25 bp, Homo sapien
tcctgcgtcctgtaatgcccggggc

SEQ ID NO: 133108 - DNA, 25 bp, Homo sapien
gcccgtacttactgctgaggacctc

SEQ ID NO: 133109 - DNA, 25 bp, Homo sapien
aactgcaagtgtgtgacgctgtccc

SEQ ID NO: 133110 - DNA, 25 bp, Homo sapien
tcccggccgacagcttttaggtaga

SEQ ID NO: 133111 - DNA, 25 bp, Homo sapien
ggctgctggagccactttataatta

SEQ ID NO: 133112 - DNA, 25 bp, Homo sapien
agccgggttcagacacgactctaga

SEQ ID NO: 133113 - DNA, 25 bp, Homo sapien
gcttcgggcaaattcactcacgttg

SEQ ID NO: 133114 - DNA, 25 bp, Homo sapien
cgtcgagcaaaagcccgcaggaatg

SEQ ID NO: 133115 - DNA, 25 bp, Homo sapien
acgtcgcgcaatcctggctgcattc

SEQ ID NO: 133116 - DNA, 25 bp, Homo sapien
cgtactgttgcggaaactctgtctc

SEQ ID NO: 133117 - DNA, 25 bp, Homo sapien
ctcacgttgacgctgttcggatgga

SEQ ID NO: 133118 - DNA, 25 bp, Homo sapien
cttgagagcgctgtccagggtgtcc

SEQ ID NO: 133119 - DNA, 25 bp, Homo sapien
cctactgccttgagagcgctgtcca

SEQ ID NO: 133120 - DNA, 25 bp, Homo sapien
tcgaagacctactgccttgagagcg

SEQ ID NO: 133121 - DNA, 25 bp, Homo sapien
gggctcccaagtcgaagacctactg

SEQ ID NO: 133122 - DNA, 25 bp, Homo sapien
agaggatccgtgtttaaccagctcc

SEQ ID NO: 133123 - DNA, 25 bp, Homo sapien
tgtaatgtcagcgcgccaggagtgt

SEQ ID NO: 133124 - DNA, 25 bp, Homo sapien
ttcagccactgtgggagaggatccg

SEQ ID NO: 133125 - DNA, 25 bp, Homo sapien
gactgcgcgcttttcagccactgtg

SEQ ID NO: 133126 - DNA, 25 bp, Homo sapien
cccggccggggcatcacggtagcaa

SEQ ID NO: 133127 - DNA, 25 bp, Homo sapien
caggcctcaatgtgcgggcttgaca

SEQ ID NO: 133128 - DNA, 25 bp, Homo sapien
tcagttctccgcaggcctcaatgtg

SEQ ID NO: 133129 - DNA, 25 bp, Homo sapien
cagcgctctcctgcgtaggctgggc

SEQ ID NO: 133130 - DNA, 25 bp, Homo sapien
atagtcgctagagggcagcgctctc

SEQ ID NO: 133131 - DNA, 25 bp, Homo sapien
gcatgtcccattatagtcgctagag

SEQ ID NO: 133132 - DNA, 25 bp, Homo sapien
gccgcgctgcatgtcccattatagt

SEQ ID NO: 133133 - DNA, 25 bp, Homo sapien
tgcgggcttgacacgcagccctcgg

SEQ ID NO: 133134 - DNA, 25 bp, Homo sapien
agttgcgccgcgaagaccaccaacg

SEQ ID NO: 133135 - DNA, 25 bp, Homo sapien
ctggtccgacttccacgttagccta

SEQ ID NO: 133136 - DNA, 25 bp, Homo sapien
ccaagaagcccgagtagaggtggta

SEQ ID NO: 133137 - DNA, 25 bp, Homo sapien
agcatctcgcgcaagtccacggtgc

SEQ ID NO: 133138 - DNA, 25 bp, Homo sapien
acttctcgtggaggacgttgctctc

SEQ ID NO: 133139 - DNA, 25 bp, Homo sapien
acatcttgcggttggacagcacgtc

SEQ ID NO: 133140 - DNA, 25 bp, Homo sapien
ggcggtcttgagcaggtagaacatc

SEQ ID NO: 133141 - DNA, 25 bp, Homo sapien
agcgcgctctaggttcttccgccgg

SEQ ID NO: 133142 - DNA, 25 bp, Homo sapien
gccacaattgttccctaagaccgtc

SEQ ID NO: 133143 - DNA, 25 bp, Homo sapien
agtatcatcagtaccacgggctcca

SEQ ID NO: 133144 - DNA, 25 bp, Homo sapien
ctcctagacagaggtggattgccgc

SEQ ID NO: 133145 - DNA, 25 bp, Homo sapien
tgagcctttcagtcgccttccagta

SEQ ID NO: 133146 - DNA, 25 bp, Homo sapien
gagcagtctctagtctgagcctttc

SEQ ID NO: 133147 - DNA, 25 bp, Homo sapien
ccagggcgcaaagttgagagcagtc

SEQ ID NO: 133148 - DNA, 25 bp, Homo sapien
ttgccgcgacatttcagggaggaga

SEQ ID NO: 133149 - DNA, 25 bp, Homo sapien
gcgtcggcgatccacgccacaattg

SEQ ID NO: 133150 - DNA, 25 bp, Homo sapien
ctgacgtgtctgtgccagtgaaaaa

SEQ ID NO: 133151 - DNA, 25 bp, Homo sapien
ctcctctagtgagactcggtcctta

SEQ ID NO: 133152 - DNA, 25 bp, Homo sapien
tcagggtttttcttagacgagacgc

SEQ ID NO: 133153 - DNA, 25 bp, Homo sapien
ggcctcctagacgagagccctctaa

SEQ ID NO: 133154 - DNA, 25 bp, Homo sapien
cttcaggagagaaagtccggcgtcc

SEQ ID NO: 133155 - DNA, 25 bp, Homo sapien
ccaggacgcacgtgcactgaaacta

SEQ ID NO: 133156 - DNA, 25 bp, Homo sapien
ctgcttgtaatgactgggcacattc

SEQ ID NO: 133157 - DNA, 25 bp, Homo sapien
gcaaactctgtggatgccagtgaca

SEQ ID NO: 133158 - DNA, 25 bp, Homo sapien
attagcgatggcgttgatgggtgcg

SEQ ID NO: 133159 - DNA, 25 bp, Homo sapien
agcgtggctctgagcgaccactgga

SEQ ID NO: 133160 - DNA, 25 bp, Homo sapien
ctgatgcatgggtctaggtgagaac

SEQ ID NO: 133161 - DNA, 25 bp, Homo sapien
gtctaggtgagaacggtgcattagc

SEQ ID NO: 133162 - DNA, 25 bp, Homo sapien
taggtgagaacggtgcattagcgat

SEQ ID NO: 133163 - DNA, 25 bp, Homo sapien
aacggtgcattagcgatggcgttga

SEQ ID NO: 133164 - DNA, 25 bp, Homo sapien
aaggctgtgcttcgcggaggcctgc

SEQ ID NO: 133165 - DNA, 25 bp, Homo sapien
gtgcctgcccggagcgtggctctga

SEQ ID NO: 133166 - DNA, 25 bp, Homo sapien
attttgcccgctggtgtgccaccgt

SEQ ID NO: 133167 - DNA, 25 bp, Homo sapien
gaacgagcttcagcagaccaatggg

SEQ ID NO: 133168 - DNA, 25 bp, Homo sapien
aggttgacttgaactggcgggtctt

SEQ ID NO: 133169 - DNA, 25 bp, Homo sapien
ttgaactggcgggtcttgttgtgcc

SEQ ID NO: 133170 - DNA, 25 bp, Homo sapien
tggtgtgccaccgtcagcgcttccg

SEQ ID NO: 133171 - DNA, 25 bp, Homo sapien
ccggggctgccacgttatttccagc

SEQ ID NO: 133172 - DNA, 25 bp, Homo sapien
ccagcttttgaggtggattttgccc

SEQ ID NO: 133173 - DNA, 25 bp, Homo sapien
ccctgggaaccgaacgagcttcagc

SEQ ID NO: 133174 - DNA, 25 bp, Homo sapien
tgcagaagagccatgtgacgggatc

SEQ ID NO: 133175 - DNA, 25 bp, Homo sapien
gacatgcgagaagacggaacgtttt

SEQ ID NO: 133176 - DNA, 25 bp, Homo sapien
gtccgaatagacatctggcagggtg

SEQ ID NO: 133177 - DNA, 25 bp, Homo sapien
aacgtctgagaaggtcgcaggattc

SEQ ID NO: 133178 - DNA, 25 bp, Homo sapien
ttcgcaggagcatcgggaaaagatt

SEQ ID NO: 133179 - DNA, 25 bp, Homo sapien
aaagattgcctgcttgcccgaagga

SEQ ID NO: 133180 - DNA, 25 bp, Homo sapien
ccaaaggtcagaggctcgcgtgaac

SEQ ID NO: 133181 - DNA, 25 bp, Homo sapien
gcccgaaggaatggcaagttccaaa

SEQ ID NO: 133182 - DNA, 25 bp, Homo sapien
cagatgccttctaggcgcctaattc

SEQ ID NO: 133183 - DNA, 25 bp, Homo sapien
agcctccgccctgaacttatgtgca

SEQ ID NO: 133184 - DNA, 25 bp, Homo sapien
agttaccacctgcacatggcacggg

SEQ ID NO: 133185 - DNA, 25 bp, Homo sapien
cagcagcatagactccaggaccata

SEQ ID NO: 133186 - DNA, 25 bp, Homo sapien
cagcacccgcgacctagcaatatgg

SEQ ID NO: 133187 - DNA, 25 bp, Homo sapien
acttggcgaaactcaggacgtctgg

SEQ ID NO: 133188 - DNA, 25 bp, Homo sapien
gcaacccgggctatttccgtgacta

SEQ ID NO: 133189 - DNA, 25 bp, Homo sapien
ccacctgaatatggcggggtcagca

SEQ ID NO: 133190 - DNA, 25 bp, Homo sapien
ggccagtccacaggcgtctcagcag

SEQ ID NO: 133191 - DNA, 25 bp, Homo sapien
cagcagaggtggcaactctcaacgc

SEQ ID NO: 133192 - DNA, 25 bp, Homo sapien
gtggcaactctcaacgctgcccgag

SEQ ID NO: 133193 - DNA, 25 bp, Homo sapien
cagcagcgcctaattcgggcggccg

SEQ ID NO: 133194 - DNA, 25 bp, Homo sapien
gcactcaagacctcgcgctcaaaag

SEQ ID NO: 133195 - DNA, 25 bp, Homo sapien
ctcgcgctcaaaagagggcacagga

SEQ ID NO: 133196 - DNA, 25 bp, Homo sapien
tcgttaggcgggccctgagacagct

SEQ ID NO: 133197 - DNA, 25 bp, Homo sapien
ctcggctctagggagctcggccagt

SEQ ID NO: 133198 - DNA, 25 bp, Homo sapien
tcactctccggcgaagcctgcctga

SEQ ID NO: 133199 - DNA, 25 bp, Homo sapien
tcggcttggctgcacgtcccgggct

SEQ ID NO: 133200 - DNA, 25 bp, Homo sapien
cccgactgcggacaatgcgggagct

SEQ ID NO: 133201 - DNA, 25 bp, Homo sapien
cctgagccctcccactcggtgcaga

SEQ ID NO: 133202 - DNA, 25 bp, Homo sapien
tgggactacgaaggatggggactcc

SEQ ID NO: 133203 - DNA, 25 bp, Homo sapien
gtacactggctcagggacacgcgct

SEQ ID NO: 133204 - DNA, 25 bp, Homo sapien
tacgaggggcgtgtacactggctca

SEQ ID NO: 133205 - DNA, 25 bp, Homo sapien
tcggtgcagaccgaaccatcgcggc

SEQ ID NO: 133206 - DNA, 25 bp, Homo sapien
ccacgctcaaagtgttcggcaacca

SEQ ID NO: 133207 - DNA, 25 bp, Homo sapien
gagaacctgaagctggagatcctga

SEQ ID NO: 133208 - DNA, 25 bp, Homo sapien
gccaggaggtgatcaacgccaagca

SEQ ID NO: 133209 - DNA, 25 bp, Homo sapien
aacaaggggccagactacttccgca

SEQ ID NO: 133210 - DNA, 25 bp, Homo sapien
tgcccacggagaccctacagacagg

SEQ ID NO: 133211 - DNA, 25 bp, Homo sapien
ctctgttgctagagccgtgatgtca

SEQ ID NO: 133212 - DNA, 25 bp, Homo sapien
gcccttggcgcttcatgtacatgtg

SEQ ID NO: 133213 - DNA, 25 bp, Homo sapien
catgtgtctattcaggccttgcgga

SEQ ID NO: 133214 - DNA, 25 bp, Homo sapien
cggaggccctgagcccggcgagcag

SEQ ID NO: 133215 - DNA, 25 bp, Homo sapien
atttgcaggtgaggcgaggagccgg

SEQ ID NO: 133216 - DNA, 25 bp, Homo sapien
ctggtgcgagttggaggccacctct

SEQ ID NO: 133217 - DNA, 25 bp, Homo sapien
cccgtctggggatagaatccggcgc

SEQ ID NO: 133218 - DNA, 25 bp, Homo sapien
cgtctggggatagaatccggcgccc

SEQ ID NO: 133219 - DNA, 25 bp, Homo sapien
cgcacgcaccttgcgcgtcttcgcc

SEQ ID NO: 133220 - DNA, 25 bp, Homo sapien
caaccggccccggaagttgcggcag

SEQ ID NO: 133221 - DNA, 25 bp, Homo sapien
cgctagccagcggaagatggcggag

SEQ ID NO: 133222 - DNA, 25 bp, Homo sapien
atcctggtcgcagccgttttcgcga

SEQ ID NO: 133223 - DNA, 25 bp, Homo sapien
ggccacttcacagactgcatcctgg

SEQ ID NO: 133224 - DNA, 25 bp, Homo sapien
cctcagaagtccgtgccagtgaccg

SEQ ID NO: 133225 - DNA, 25 bp, Homo sapien
tggagctgcaggaacgacccacacc

SEQ ID NO: 133226 - DNA, 25 bp, Homo sapien
ccactttgccggatacctggagctg

SEQ ID NO: 133227 - DNA, 25 bp, Homo sapien
cgacgagaaccaagcgaccgtgagc

SEQ ID NO: 133228 - DNA, 25 bp, Homo sapien
accgtgagctgcgatgcacacagta

SEQ ID NO: 133229 - DNA, 25 bp, Homo sapien
agactgggagcataaccgctgggca

SEQ ID NO: 133230 - DNA, 25 bp, Homo sapien
aggatccgacctcacacactaaacg

SEQ ID NO: 133231 - DNA, 25 bp, Homo sapien
tcttccggataaacgccatggaggg

SEQ ID NO: 133232 - DNA, 25 bp, Homo sapien
ctcctgctgcttcttccggataaac

SEQ ID NO: 133233 - DNA, 25 bp, Homo sapien
ctccttggagtagagctgcagctgc

SEQ ID NO: 133234 - DNA, 25 bp, Homo sapien
ggcgcgcacctctccttggagtaga

SEQ ID NO: 133235 - DNA, 25 bp, Homo sapien
cggatagctcggcatgcctcggctc

SEQ ID NO: 133236 - DNA, 25 bp, Homo sapien
ccgggacctgcactgccggatagct

SEQ ID NO: 133237 - DNA, 25 bp, Homo sapien
cgccgagtgcctggacccgattaag

SEQ ID NO: 133238 - DNA, 25 bp, Homo sapien
gccggtggaaggtagacattcgagc

SEQ ID NO: 133239 - DNA, 25 bp, Homo sapien
gacgcgcaccatggagccggtggaa

SEQ ID NO: 133240 - DNA, 25 bp, Homo sapien
caggatgcagtgagcgcacagccct

SEQ ID NO: 133241 - DNA, 25 bp, Homo sapien
gcactcaggatgcagtgagcgcaca

SEQ ID NO: 133242 - DNA, 25 bp, Homo sapien
cagcctgtgggatcggcagcatcca

SEQ ID NO: 133243 - DNA, 25 bp, Homo sapien
gacggactccgcagcctgtgggatc

SEQ ID NO: 133244 - DNA, 25 bp, Homo sapien
ccacgggtcggcaactctgggcagt

SEQ ID NO: 133245 - DNA, 25 bp, Homo sapien
gagagtccacgggtcggcaactctg

SEQ ID NO: 133246 - DNA, 25 bp, Homo sapien
tgaccacaccttcctggacgagaag

SEQ ID NO: 133247 - DNA, 25 bp, Homo sapien
gaggccgacagccactgtctcgagg

SEQ ID NO: 133248 - DNA, 25 bp, Homo sapien
tctcgagggctttgcgcctgtggac

SEQ ID NO: 133249 - DNA, 25 bp, Homo sapien
tggccaagtgctcctgttaccaccg

SEQ ID NO: 133250 - DNA, 25 bp, Homo sapien
gttaccaccgcggtctctacctgga

SEQ ID NO: 133251 - DNA, 25 bp, Homo sapien
caccgcggtctctacctggaggcgg

SEQ ID NO: 133252 - DNA, 25 bp, Homo sapien
aagaacgatggtgggtacctgctcg

SEQ ID NO: 133253 - DNA, 25 bp, Homo sapien
agccactgtctcgagggctttgcgc

SEQ ID NO: 133254 - DNA, 25 bp, Homo sapien
caccttgttgcaatagtaggggtcc

SEQ ID NO: 133255 - DNA, 25 bp, Homo sapien
tcgtgtcactttccgcacaatcgcg

SEQ ID NO: 133256 - DNA, 25 bp, Homo sapien
ccggcaaacctaggcagggatcctt

SEQ ID NO: 133257 - DNA, 25 bp, Homo sapien
cacaatcgcggtgtttggcaagccc

SEQ ID NO: 133258 - DNA, 25 bp, Homo sapien
cggagctactccacaatatttacta

SEQ ID NO: 133259 - DNA, 25 bp, Homo sapien
tatttactacccaagcgcacgcagg

SEQ ID NO: 133260 - DNA, 25 bp, Homo sapien
ctcccaggatcaagcagcaagaaca

SEQ ID NO: 133261 - DNA, 25 bp, Homo sapien
cagggatccttagccgcgaacagca

SEQ ID NO: 133262 - DNA, 25 bp, Homo sapien
cgccgcttctgagggcggagaaccc

SEQ ID NO: 133263 - DNA, 25 bp, Homo sapien
cttctgagggcggagaacccacagg

SEQ ID NO: 133264 - DNA, 25 bp, Homo sapien
ggagaacccacagggagtgcgaccc

SEQ ID NO: 133265 - DNA, 25 bp, Homo sapien
gattcgtgccccactggacggtttg

SEQ ID NO: 133266 - DNA, 25 bp, Homo sapien
ccgatcgaagggtgaggaccagctc

SEQ ID NO: 133267 - DNA, 25 bp, Homo sapien
agtgcgacccctttgcacgctgtga

SEQ ID NO: 133268 - DNA, 25 bp, Homo sapien
tccgagggactcgagccgatcgaag

SEQ ID NO: 133269 - DNA, 25 bp, Homo sapien
ggcaactgtccgagggactcgagcc

SEQ ID NO: 133270 - DNA, 25 bp, Homo sapien
cttgccctgagtctcgcgagtgcca

SEQ ID NO: 133271 - DNA, 25 bp, Homo sapien
taaaccagctgctctcgccagcttg

SEQ ID NO: 133272 - DNA, 25 bp, Homo sapien
agtgtcccagcgcttctattaaacc

SEQ ID NO: 133273 - DNA, 25 bp, Homo sapien
ccgcccttggatgggctcctgcttt

SEQ ID NO: 133274 - DNA, 25 bp, Homo sapien
agtctcgcgagtgccagcattgccc

SEQ ID NO: 133275 - DNA, 25 bp, Homo sapien
cagtgcacagggagggcttgctaac

SEQ ID NO: 133276 - DNA, 25 bp, Homo sapien
agggcttgctaactctcgtgggctt

SEQ ID NO: 133277 - DNA, 25 bp, Homo sapien
gctaactctcgtgggcttgccctga

SEQ ID NO: 133278 - DNA, 25 bp, Homo sapien
ttcggaccgagtgttccagagaccc

SEQ ID NO: 133279 - DNA, 25 bp, Homo sapien
aaggcgacggtatcttcgatgaagc

SEQ ID NO: 133280 - DNA, 25 bp, Homo sapien
tcttcgatgaagctcaggtccgcca

SEQ ID NO: 133281 - DNA, 25 bp, Homo sapien
tcatcctcttccttctcggggaagg

SEQ ID NO: 133282 - DNA, 25 bp, Homo sapien
caagtcacggaaacctcggcgcatc

SEQ ID NO: 133283 - DNA, 25 bp, Homo sapien
ctcggggcgactagtcccaagtcac

SEQ ID NO: 133284 - DNA, 25 bp, Homo sapien
agcgcctggcgaattttatacccga

SEQ ID NO: 133285 - DNA, 25 bp, Homo sapien
ggagccgacagttagaatgcgcctc

SEQ ID NO: 133286 - DNA, 25 bp, Homo sapien
agtacatcataatcggcgacacagg

SEQ ID NO: 133287 - DNA, 25 bp, Homo sapien
tggcgtacgcctatctcttcaagta

SEQ ID NO: 133288 - DNA, 25 bp, Homo sapien
ggtgtcagttcgtccggcttcctca

SEQ ID NO: 133289 - DNA, 25 bp, Homo sapien
cggctgttattgttcggctgggctc

SEQ ID NO: 133290 - DNA, 25 bp, Homo sapien
tcaaacgtggcggaacaaccggagc

SEQ ID NO: 133291 - DNA, 25 bp, Homo sapien
ggctcgcccgctcaaacgtggcgga

SEQ ID NO: 133292 - DNA, 25 bp, Homo sapien
ttgcgacgcccgattcaggaagtgt

SEQ ID NO: 133293 - DNA, 25 bp, Homo sapien
gccgctccatttccgcagtgctgga

SEQ ID NO: 133294 - DNA, 25 bp, Homo sapien
gacaatgtcctgcattcaccgcggc

SEQ ID NO: 133295 - DNA, 25 bp, Homo sapien
ccgactcctaagctgtgcggaagtg

SEQ ID NO: 133296 - DNA, 25 bp, Homo sapien
ggggcgctgctgatcagccaatcag

SEQ ID NO: 133297 - DNA, 25 bp, Homo sapien
cgctgtccctttaagatgatcctcc

SEQ ID NO: 133298 - DNA, 25 bp, Homo sapien
cgcacccattttgatcccaggaagg

SEQ ID NO: 133299 - DNA, 25 bp, Homo sapien
tctagtcggccatctgcggctaatc

SEQ ID NO: 133300 - DNA, 25 bp, Homo sapien
acggccgcgaccagacaatgtcctg

SEQ ID NO: 133301 - DNA, 25 bp, Homo sapien
tgcggctaatccagtcagagcgcgc

SEQ ID NO: 133302 - DNA, 25 bp, Homo sapien
gggtcacttcctcgcatgtaaatgg

SEQ ID NO: 133303 - DNA, 25 bp, Homo sapien
cggagcccgctctgcgttttgtttt

SEQ ID NO: 133304 - DNA, 25 bp, Homo sapien
aatggctttttgttgtgctgccggc

SEQ ID NO: 133305 - DNA, 25 bp, Homo sapien
ccgagcacgagttgccggctccatt

SEQ ID NO: 133306 - DNA, 25 bp, Homo sapien
ctccaactcaagtgcgagcgggcga

SEQ ID NO: 133307 - DNA, 25 bp, Homo sapien
gcaccggcgcgaacaaagtgcgttc

SEQ ID NO: 133308 - DNA, 25 bp, Homo sapien
aacaaagtgcgttcctcccggcgcg

SEQ ID NO: 133309 - DNA, 25 bp, Homo sapien
tgaaactcaccagagacccgttcgc

SEQ ID NO: 133310 - DNA, 25 bp, Homo sapien
ctggcacgcggaaggccctcataag

SEQ ID NO: 133311 - DNA, 25 bp, Homo sapien
gaaggccctcataaggccctcgctg

SEQ ID NO: 133312 - DNA, 25 bp, Homo sapien
ggcaccgtggcctcccacccactcg

SEQ ID NO: 133313 - DNA, 25 bp, Homo sapien
ggcgctcgcttcacctcatgcccgc

SEQ ID NO: 133314 - DNA, 25 bp, Homo sapien
tcatgcccgcctcagtggctcgggg

SEQ ID NO: 133315 - DNA, 25 bp, Homo sapien
ctgcggccacttcctgaccggaagg

SEQ ID NO: 133316 - DNA, 25 bp, Homo sapien
gcaggagtcagcgaggccatctcgc

SEQ ID NO: 133317 - DNA, 25 bp, Homo sapien
tcatcgctggcacgcggaaggccct

SEQ ID NO: 133318 - DNA, 25 bp, Homo sapien
cctcgcttctggcacgggaggaaag

SEQ ID NO: 133319 - DNA, 25 bp, Homo sapien
aagcctgtccagatgggcgtcctga

SEQ ID NO: 133320 - DNA, 25 bp, Homo sapien
gctctcgcgcagatgtcgcacgctg

SEQ ID NO: 133321 - DNA, 25 bp, Homo sapien
cgccgcagcgtttaaccttgacttc

SEQ ID NO: 133322 - DNA, 25 bp, Homo sapien
ggggacatctgaggcccgacagacc

SEQ ID NO: 133323 - DNA, 25 bp, Homo sapien
acagacccgcgctcatggacaagtg

SEQ ID NO: 133324 - DNA, 25 bp, Homo sapien
tggagacagaccacgcagtgacagg

SEQ ID NO: 133325 - DNA, 25 bp, Homo sapien
tctccggaaacaatggtgagcctgt

SEQ ID NO: 133326 - DNA, 25 bp, Homo sapien
gacccaccgtggctctatattcact

SEQ ID NO: 133327 - DNA, 25 bp, Homo sapien
aggggacccatatctcgtgagctgc

SEQ ID NO: 133328 - DNA, 25 bp, Homo sapien
gcctggctacctttctttcctataa

SEQ ID NO: 133329 - DNA, 25 bp, Homo sapien
tctcgtttgaaaactgccagcgttc

SEQ ID NO: 133330 - DNA, 25 bp, Homo sapien
gtttatcccatttcccgggtgtgca

SEQ ID NO: 133331 - DNA, 25 bp, Homo sapien
gggtcatttcccatcttgccgtcga

SEQ ID NO: 133332 - DNA, 25 bp, Homo sapien
aagtcagttctagaggggtcgtctc

SEQ ID NO: 133333 - DNA, 25 bp, Homo sapien
gcctgctgtacagaggccatgctta

SEQ ID NO: 133334 - DNA, 25 bp, Homo sapien
gcagcagcaaaggatgagcggaacc

SEQ ID NO: 133335 - DNA, 25 bp, Homo sapien
gcacatgcggctgcctggcgttgaa

SEQ ID NO: 133336 - DNA, 25 bp, Homo sapien
aacgtagattccacgcacgcggggc

SEQ ID NO: 133337 - DNA, 25 bp, Homo sapien
ttgcacagctagaggccgcgcagca

SEQ ID NO: 133338 - DNA, 25 bp, Homo sapien
ccggtcttcggtttgcacagctaga

SEQ ID NO: 133339 - DNA, 25 bp, Homo sapien
agcagattcctttccacccggggcg

SEQ ID NO: 133340 - DNA, 25 bp, Homo sapien
cgttgaaggggctgagcagattcct

SEQ ID NO: 133341 - DNA, 25 bp, Homo sapien
aaggtccttcccagcagcacatgcg

SEQ ID NO: 133342 - DNA, 25 bp, Homo sapien
tccgtgacgtttccctcacggaatc

SEQ ID NO: 133343 - DNA, 25 bp, Homo sapien
tgtgacgtttccctcacggaatctc

SEQ ID NO: 133344 - DNA, 25 bp, Homo sapien
gtgatgtttccctcacggaatctca

SEQ ID NO: 133345 - DNA, 25 bp, Homo sapien
cgtgatgtttccctcacggaatctc

SEQ ID NO: 133346 - DNA, 25 bp, Homo sapien
cgtgacgtttccctcacggaatctc

SEQ ID NO: 133347 - DNA, 25 bp, Homo sapien
tctgtgacgtttccctcacggaatc

SEQ ID NO: 133348 - DNA, 25 bp, Homo sapien
gtgacgtttccctcacggaatctca

SEQ ID NO: 133349 - DNA, 25 bp, Homo sapien
cgggacctctgtgacgtttccctca

SEQ ID NO: 133350 - DNA, 25 bp, Homo sapien
ctccgcgctttaagatggctttgtc

SEQ ID NO: 133351 - DNA, 25 bp, Homo sapien
ctcctcaaaacgcacgcgggcagtg

SEQ ID NO: 133352 - DNA, 25 bp, Homo sapien
cagagggcagcattgagacacgaac

SEQ ID NO: 133353 - DNA, 25 bp, Homo sapien
cgatgtcaccttctccgcgctttaa

SEQ ID NO: 133354 - DNA, 25 bp, Homo sapien
ttccgcgtcggttctgtttatcagg

SEQ ID NO: 133355 - DNA, 25 bp, Homo sapien
ctttgtccttcacggtctcagttga

SEQ ID NO: 133356 - DNA, 25 bp, Homo sapien
gctccctcttgtgccgtcgcagatt

SEQ ID NO: 133357 - DNA, 25 bp, Homo sapien
ttcggcagaatgaaaatgagttgtc

SEQ ID NO: 133358 - DNA, 25 bp, Homo sapien
tcggctttccagtttgtctcggtcc

SEQ ID NO: 133359 - DNA, 25 bp, Homo sapien
tctcggtcctttggaacgtggcaaa

SEQ ID NO: 133360 - DNA, 25 bp, Homo sapien
cctgctcacttagggctgttcgggc

SEQ ID NO: 133361 - DNA, 25 bp, Homo sapien
ctgggacccaatcgcaagggccctt

SEQ ID NO: 133362 - DNA, 25 bp, Homo sapien
cctcgcgtgtacgaacctgtgactc

SEQ ID NO: 133363 - DNA, 25 bp, Homo sapien
tgcagcacctgggaagacttcaccc

SEQ ID NO: 133364 - DNA, 25 bp, Homo sapien
ggcattcttacgctgggccattgca

SEQ ID NO: 133365 - DNA, 25 bp, Homo sapien
gttgccgctgctcttggcattctta

SEQ ID NO: 133366 - DNA, 25 bp, Homo sapien
cggcatgagcagtagcgacttaggc

SEQ ID NO: 133367 - DNA, 25 bp, Homo sapien
cttgcccgcgaacacaaccttgttg

SEQ ID NO: 133368 - DNA, 25 bp, Homo sapien
acaaccttgttgtccgcgtctgaga

SEQ ID NO: 133369 - DNA, 25 bp, Homo sapien
cgggatctctttagccggtaaagca

SEQ ID NO: 133370 - DNA, 25 bp, Homo sapien
agtcaccgctgcagtcatgttcctg

SEQ ID NO: 133371 - DNA, 25 bp, Homo sapien
agctgctcagcagacgtggatccca

SEQ ID NO: 133372 - DNA, 25 bp, Homo sapien
atctccttctggagcggcatgagca

SEQ ID NO: 133373 - DNA, 25 bp, Homo sapien
ggatattcccatggacatctccttc

SEQ ID NO: 133374 - DNA, 25 bp, Homo sapien
acaccggtcaacgagggtctccatc

SEQ ID NO: 133375 - DNA, 25 bp, Homo sapien
tgggtctacccagttacaccggtca

SEQ ID NO: 133376 - DNA, 25 bp, Homo sapien
ctcttaactagacaggccgatcctc

SEQ ID NO: 133377 - DNA, 25 bp, Homo sapien
ctcagcaagaaagcccagctgggtc

SEQ ID NO: 133378 - DNA, 25 bp, Homo sapien
cgccctaattcacgctcattcatat

SEQ ID NO: 133379 - DNA, 25 bp, Homo sapien
aaacagacctgcacagtgggacgca

SEQ ID NO: 133380 - DNA, 25 bp, Homo sapien
acgaggatctctggcagtcagcgcc

SEQ ID NO: 133381 - DNA, 25 bp, Homo sapien
tggggcagctcaactaagccgtgtc

SEQ ID NO: 133382 - DNA, 25 bp, Homo sapien
caactccgggcgtctactttgaagc

SEQ ID NO: 133383 - DNA, 25 bp, Homo sapien
ctccttaccgatgatgggcttcttg

SEQ ID NO: 133384 - DNA, 25 bp, Homo sapien
agcttcctctgatcaaccgcggtca

SEQ ID NO: 133385 - DNA, 25 bp, Homo sapien
acgcacaggcgcatcactagggtca

SEQ ID NO: 133386 - DNA, 25 bp, Homo sapien
cctaagcggagactctggaaacgcc

SEQ ID NO: 133387 - DNA, 25 bp, Homo sapien
caactgttacgtcgatgtggacttc

SEQ ID NO: 133388 - DNA, 25 bp, Homo sapien
gtggacttcagtcacccgtacaaag

SEQ ID NO: 133389 - DNA, 25 bp, Homo sapien
atctccgggaatggtgacaacgttc

SEQ ID NO: 133390 - DNA, 25 bp, Homo sapien
cactctccagcctggcagggcggtc

SEQ ID NO: 133391 - DNA, 25 bp, Homo sapien
ccaggccaggtccagatcgaaatcc

SEQ ID NO: 133392 - DNA, 25 bp, Homo sapien
cgcgttacccgccagggtcctgcct

SEQ ID NO: 133393 - DNA, 25 bp, Homo sapien
tgcctgcaccctgggcttcggcagg

SEQ ID NO: 133394 - DNA, 25 bp, Homo sapien
gcacgcacgcttacccgccaggcca

SEQ ID NO: 133395 - DNA, 25 bp, Homo sapien
tccagatcgaaatcccgggcgcgca

SEQ ID NO: 133396 - DNA, 25 bp, Homo sapien
tgcccgtcgcacaaccactctccag

SEQ ID NO: 133397 - DNA, 25 bp, Homo sapien
tgaggtgcgcactgccgagcgccct

SEQ ID NO: 133398 - DNA, 25 bp, Homo sapien
ccgccgtgacttcagcaaggcacta

SEQ ID NO: 133399 - DNA, 25 bp, Homo sapien
cttaggggccttaggacagatcctg

SEQ ID NO: 133400 - DNA, 25 bp, Homo sapien
ttgcggtgaagaatgtcagccacta

SEQ ID NO: 133401 - DNA, 25 bp, Homo sapien
gcggctggaacaatcactcggccaa

SEQ ID NO: 133402 - DNA, 25 bp, Homo sapien
ggccctcattttgggttctcagcga

SEQ ID NO: 133403 - DNA, 25 bp, Homo sapien
tgcaagcggaaaagacgggcctctt

SEQ ID NO: 133404 - DNA, 25 bp, Homo sapien
tccgccattgtggacccgagaagca

SEQ ID NO: 133405 - DNA, 25 bp, Homo sapien
tcctgcccggagtgcaacaaaatcc

SEQ ID NO: 133406 - DNA, 25 bp, Homo sapien
ctttctagtttctgcctcggccaga

SEQ ID NO: 133407 - DNA, 25 bp, Homo sapien
tatcctgcgctccttggcgtacgca

SEQ ID NO: 133408 - DNA, 25 bp, Homo sapien
gcggcccgagacttacttctgcttt

SEQ ID NO: 133409 - DNA, 25 bp, Homo sapien
agcggacccacagcttctgaggaaa

SEQ ID NO: 133410 - DNA, 25 bp, Homo sapien
caacgcatgcaagcgtgggtcgcca

SEQ ID NO: 133411 - DNA, 25 bp, Homo sapien
ccctatggccagacgagtaaaagtc

SEQ ID NO: 133412 - DNA, 25 bp, Homo sapien
agtcggttagtgttttatgcgcctg

SEQ ID NO: 133413 - DNA, 25 bp, Homo sapien
ggaaacagctgcctcgggcctaagg

SEQ ID NO: 133414 - DNA, 25 bp, Homo sapien
cgaagcttacacttttcgcacgtga

SEQ ID NO: 133415 - DNA, 25 bp, Homo sapien
tcaggacttattcttgccggggttg

SEQ ID NO: 133416 - DNA, 25 bp, Homo sapien
tcagacacgcttgggagacagaatg

SEQ ID NO: 133417 - DNA, 25 bp, Homo sapien
caggtcacagagatccctaagcttg

SEQ ID NO: 133418 - DNA, 25 bp, Homo sapien
ggcgtgcagaacacgatcctggttg

SEQ ID NO: 133419 - DNA, 25 bp, Homo sapien
ttttggttcacaggggcttcttcga

SEQ ID NO: 133420 - DNA, 25 bp, Homo sapien
cgccggctgtaagtaccatcctttc

SEQ ID NO: 133421 - DNA, 25 bp, Homo sapien
cctggttgactttgatgcggtgact

SEQ ID NO: 133422 - DNA, 25 bp, Homo sapien
ctttgaactttgaggacgcatgcgc

SEQ ID NO: 133423 - DNA, 25 bp, Homo sapien
gcctcctgaagaacgcggtacgcga

SEQ ID NO: 133424 - DNA, 25 bp, Homo sapien
gtacgcgatgctcaccgaacaggtg

SEQ ID NO: 133425 - DNA, 25 bp, Homo sapien
gcggttggggatcctctgtacatcc

SEQ ID NO: 133426 - DNA, 25 bp, Homo sapien
ggcctcttggtgttgagcccacctc

SEQ ID NO: 133427 - DNA, 25 bp, Homo sapien
acgcttctcggggactcacttccgg

SEQ ID NO: 133428 - DNA, 25 bp, Homo sapien
cggcgcctttgaggattcagagcga

SEQ ID NO: 133429 - DNA, 25 bp, Homo sapien
ctcaggcgtatcgaggactttgaac

SEQ ID NO: 133430 - DNA, 25 bp, Homo sapien
ggtctctgcgcaagaccagctctca

SEQ ID NO: 133431 - DNA, 25 bp, Homo sapien
tgcggactcgttttcactgctccag

SEQ ID NO: 133432 - DNA, 25 bp, Homo sapien
ctgggactgcacagaaggaccatct

SEQ ID NO: 133433 - DNA, 25 bp, Homo sapien
actgctccagctcccgaaatcgttt

SEQ ID NO: 133434 - DNA, 25 bp, Homo sapien
aatcgtttctctggacgcggcagta

SEQ ID NO: 133435 - DNA, 25 bp, Homo sapien
ggtcctgtcctcttgtcaccttgta

SEQ ID NO: 133436 - DNA, 25 bp, Homo sapien
gcctccctaacactgcgctttgatt

SEQ ID NO: 133437 - DNA, 25 bp, Homo sapien
ttctgtttttcaggggcgcattctg

SEQ ID NO: 133438 - DNA, 25 bp, Homo sapien
agcatacacagggttcgggccccag

SEQ ID NO: 133439 - DNA, 25 bp, Homo sapien
cccatggcggttccgctgttggggt

SEQ ID NO: 133440 - DNA, 25 bp, Homo sapien
ccttacacagggttcgggccccatg

SEQ ID NO: 133441 - DNA, 25 bp, Homo sapien
cgcggttggggttgaccttacacag

SEQ ID NO: 133442 - DNA, 25 bp, Homo sapien
gttgagcatacacagggttcgggcc

SEQ ID NO: 133443 - DNA, 25 bp, Homo sapien
atggcggttccgctgttggggttga

SEQ ID NO: 133444 - DNA, 25 bp, Homo sapien
ttgagcatacacagggttcgggccc

SEQ ID NO: 133445 - DNA, 25 bp, Homo sapien
cttacacagggttcgggccccatgg

SEQ ID NO: 133446 - DNA, 25 bp, Homo sapien
cggagaattcccacggctctcagtg

SEQ ID NO: 133447 - DNA, 25 bp, Homo sapien
tgcaacttcaaggtcaatgtgcctc

SEQ ID NO: 133448 - DNA, 25 bp, Homo sapien
agtgggcgagtcaagtgcaacttca

SEQ ID NO: 133449 - DNA, 25 bp, Homo sapien
agctccctcagctgcgtgggtttca

SEQ ID NO: 133450 - DNA, 25 bp, Homo sapien
tgacctctggggctaatctctctgc

SEQ ID NO: 133451 - DNA, 25 bp, Homo sapien
acgacgccgaaaggcttgacctctg

SEQ ID NO: 133452 - DNA, 25 bp, Homo sapien
tgtggacccagtctctctgaagtga

SEQ ID NO: 133453 - DNA, 25 bp, Homo sapien
gatattccgggttggattcttcctc

SEQ ID NO: 133454 - DNA, 25 bp, Homo sapien
aggggctgccctgcatgtaaacagc

SEQ ID NO: 133455 - DNA, 25 bp, Homo sapien
ccagacgagacaagtgggaccgctc

SEQ ID NO: 133456 - DNA, 25 bp, Homo sapien
agacaagtgggaccgctcaagcctg

SEQ ID NO: 133457 - DNA, 25 bp, Homo sapien
ctttctcagtctttaggttccagga

SEQ ID NO: 133458 - DNA, 25 bp, Homo sapien
ctgcatgtaaacagcctcggggtcc

SEQ ID NO: 133459 - DNA, 25 bp, Homo sapien
ccgacgtctacgtagtatttctgtc

SEQ ID NO: 133460 - DNA, 25 bp, Homo sapien
acatccaaaggagcgtaggtaaccg

SEQ ID NO: 133461 - DNA, 25 bp, Homo sapien
taggttccaggacatccaaaggagc

SEQ ID NO: 133462 - DNA, 25 bp, Homo sapien
gctgctagtaggttcagccggcgtt

SEQ ID NO: 133463 - DNA, 25 bp, Homo sapien
ggcgaggacgacctcttcctgcaca

SEQ ID NO: 133464 - DNA, 25 bp, Homo sapien
ttcctgcacaagagcctgagcgcct

SEQ ID NO: 133465 - DNA, 25 bp, Homo sapien
ctccaagcgcttggaagcggctttc

SEQ ID NO: 133466 - DNA, 25 bp, Homo sapien
ggggcgaccctagcctaagcagcct

SEQ ID NO: 133467 - DNA, 25 bp, Homo sapien
gccctttgcctcaagtacggcgaaa

SEQ ID NO: 133468 - DNA, 25 bp, Homo sapien
cttaacatcaatgcccgagagcgcc

SEQ ID NO: 133469 - DNA, 25 bp, Homo sapien
aggcgctgcggcttaacatcaatgc

SEQ ID NO: 133470 - DNA, 25 bp, Homo sapien
caactcgcactcttggtctagcacg

SEQ ID NO: 133471 - DNA, 25 bp, Homo sapien
cttggtctagcacgcggaaaccgaa

SEQ ID NO: 133472 - DNA, 25 bp, Homo sapien
cctccaagaccctgtgttacgctta

SEQ ID NO: 133473 - DNA, 25 bp, Homo sapien
cctgtgttacgcttaaattcctctc

SEQ ID NO: 133474 - DNA, 25 bp, Homo sapien
ttaaattcctctccctcctatcgta

SEQ ID NO: 133475 - DNA, 25 bp, Homo sapien
catccatccttacagcagggaggcc

SEQ ID NO: 133476 - DNA, 25 bp, Homo sapien
cagggaggccgagactcacagaatt

SEQ ID NO: 133477 - DNA, 25 bp, Homo sapien
ggccgagactcacagaattcccttc

SEQ ID NO: 133478 - DNA, 25 bp, Homo sapien
aaacccgaagcatccgcgaaagcgc

SEQ ID NO: 133479 - DNA, 25 bp, Homo sapien
cagcaggcatgtgggttcacacgca

SEQ ID NO: 133480 - DNA, 25 bp, Homo sapien
tcaaactgtccttcgagggtggctc

SEQ ID NO: 133481 - DNA, 25 bp, Homo sapien
ggggctctgcctcaaactgtccttc

SEQ ID NO: 133482 - DNA, 25 bp, Homo sapien
tccttgggacaaaaagagaacttca

SEQ ID NO: 133483 - DNA, 25 bp, Homo sapien
tgcgggcgcaattgtccttcaaccg

SEQ ID NO: 133484 - DNA, 25 bp, Homo sapien
ttttgcttgcgcagtgctcccgaag

SEQ ID NO: 133485 - DNA, 25 bp, Homo sapien
gcccaccgcgctgtttttgcttgcg

SEQ ID NO: 133486 - DNA, 25 bp, Homo sapien
tcaagatgcttgtgaaggtgcccgc

SEQ ID NO: 133487 - DNA, 25 bp, Homo sapien
gagcgactctgcttgtccctcaaga

SEQ ID NO: 133488 - DNA, 25 bp, Homo sapien
ttgggttcctcacttcttagcccgc

SEQ ID NO: 133489 - DNA, 25 bp, Homo sapien
ttcgcttcttagttggacgggagcc

SEQ ID NO: 133490 - DNA, 25 bp, Homo sapien
cttctggaaaacagcgcccttgatc

SEQ ID NO: 133491 - DNA, 25 bp, Homo sapien
ctcccaggctgaatgacaaaagttc

SEQ ID NO: 133492 - DNA, 25 bp, Homo sapien
aggaatgtcaccgtggtctcccagg

SEQ ID NO: 133493 - DNA, 25 bp, Homo sapien
tgcgctctgacaccggcgatctctt

SEQ ID NO: 133494 - DNA, 25 bp, Homo sapien
ccggactaactcagggagccaaaga

SEQ ID NO: 133495 - DNA, 25 bp, Homo sapien
gggtagagcgtgctaaagcgcctca

SEQ ID NO: 133496 - DNA, 25 bp, Homo sapien
taaagcgcctcactgggacccacta

SEQ ID NO: 133497 - DNA, 25 bp, Homo sapien
ggacccactactggatctgacaaga

SEQ ID NO: 133498 - DNA, 25 bp, Homo sapien
caggcggattcgctgcctcggtaca

SEQ ID NO: 133499 - DNA, 25 bp, Homo sapien
tccagagctttaggagtccagagcc

SEQ ID NO: 133500 - DNA, 25 bp, Homo sapien
cggcgatcgcaagcaaccggactaa

SEQ ID NO: 133501 - DNA, 25 bp, Homo sapien
cagggccacacctacggatgaggta

SEQ ID NO: 133502 - DNA, 25 bp, Homo sapien
tgctgcgcccttaacgggctcagga

SEQ ID NO: 133503 - DNA, 25 bp, Homo sapien
tgacttgccctgaaggctgagactc

SEQ ID NO: 133504 - DNA, 25 bp, Homo sapien
ctggaaacagtcagaacaggagctg

SEQ ID NO: 133505 - DNA, 25 bp, Homo sapien
gtgcgcacaccgactgtgactctca

SEQ ID NO: 133506 - DNA, 25 bp, Homo sapien
gcgtcctctgccgagcttcttgtgc

SEQ ID NO: 133507 - DNA, 25 bp, Homo sapien
ttggctgattggcagcaacgccacg

SEQ ID NO: 133508 - DNA, 25 bp, Homo sapien
aacgccacgggacagccaagctaga

SEQ ID NO: 133509 - DNA, 25 bp, Homo sapien
gaactcggaaaagcggttggctagc

SEQ ID NO: 133510 - DNA, 25 bp, Homo sapien
tcccagccaggacggtttctaacag

SEQ ID NO: 133511 - DNA, 25 bp, Homo sapien
gcctagggttctctccatgactttc

SEQ ID NO: 133512 - DNA, 25 bp, Homo sapien
ctgccagctcctacttgggtgcgga

SEQ ID NO: 133513 - DNA, 25 bp, Homo sapien
ttcgcctttaattggctgacccgtc

SEQ ID NO: 133514 - DNA, 25 bp, Homo sapien
accggcctcgctgtcgattggttac

SEQ ID NO: 133515 - DNA, 25 bp, Homo sapien
gcacttcctcttttatgggcccagc

SEQ ID NO: 133516 - DNA, 25 bp, Homo sapien
ggccgtgtcttaagtgcacttcctc

SEQ ID NO: 133517 - DNA, 25 bp, Homo sapien
tggacagtcaatcccaaggcgcgcg

SEQ ID NO: 133518 - DNA, 25 bp, Homo sapien
tcgagcgcagcacgaacggagcaaa

SEQ ID NO: 133519 - DNA, 25 bp, Homo sapien
cgagcccggcgtaattcacactttg

SEQ ID NO: 133520 - DNA, 25 bp, Homo sapien
ttcacactttgcagccgcggacctt

SEQ ID NO: 133521 - DNA, 25 bp, Homo sapien
ggcgacagtagccttccttgtgttc

SEQ ID NO: 133522 - DNA, 25 bp, Homo sapien
gtcactgctggcttttccctccttg

SEQ ID NO: 133523 - DNA, 25 bp, Homo sapien
aattcgtgcgttccagcgcgcctag

SEQ ID NO: 133524 - DNA, 25 bp, Homo sapien
tgttggagtcgcctcccgacaaacg

SEQ ID NO: 133525 - DNA, 25 bp, Homo sapien
caggtacccggactgcagagttcga

SEQ ID NO: 133526 - DNA, 25 bp, Homo sapien
ccagacacctgggttgagggccttt

SEQ ID NO: 133527 - DNA, 25 bp, Homo sapien
ccggagcgttctgtctttctgcgca

SEQ ID NO: 133528 - DNA, 25 bp, Homo sapien
tctgtgctgaacctcaggggacgcc

SEQ ID NO: 133529 - DNA, 25 bp, Homo sapien
agcgctccggtttttctgtgctgaa

SEQ ID NO: 133530 - DNA, 25 bp, Homo sapien
gcgctcctcggattacgcatgctca

SEQ ID NO: 133531 - DNA, 25 bp, Homo sapien
cgcatgctcagtgcaatcttcggtt

SEQ ID NO: 133532 - DNA, 25 bp, Homo sapien
atcttcggttgcctggactagcgct

SEQ ID NO: 133533 - DNA, 25 bp, Homo sapien
tctttctgcgcacgcgtagagcaca

SEQ ID NO: 133534 - DNA, 25 bp, Homo sapien
gtccaggtcacccacggtccaggtc

SEQ ID NO: 133535 - DNA, 25 bp, Homo sapien
tccaggtcacgcacggtccaggtca

SEQ ID NO: 133536 - DNA, 25 bp, Homo sapien
ggtcacccacggtccaggtcacaca

SEQ ID NO: 133537 - DNA, 25 bp, Homo sapien
tcacccacggtccaggtcacacacg

SEQ ID NO: 133538 - DNA, 25 bp, Homo sapien
acggtccaggtcacgcacggtccag

SEQ ID NO: 133539 - DNA, 25 bp, Homo sapien
ccaggtcacccacggtccaggtcac

SEQ ID NO: 133540 - DNA, 25 bp, Homo sapien
tcacccacggtccaggtcacgcacg

SEQ ID NO: 133541 - DNA, 25 bp, Homo sapien
aggtcacccacggtccaggtcacgc

SEQ ID NO: 133542 - DNA, 25 bp, Homo sapien
tctcgagagacgcagaaccaggggt

SEQ ID NO: 133543 - DNA, 25 bp, Homo sapien
ccacatatcggtttggcatcgaacg

SEQ ID NO: 133544 - DNA, 25 bp, Homo sapien
gcatcgaacgatgcgtccgctgctg

SEQ ID NO: 133545 - DNA, 25 bp, Homo sapien
ctgctggctcccgtgctcggtttct

SEQ ID NO: 133546 - DNA, 25 bp, Homo sapien
tgcgcgattcagctccaggagcgtg

SEQ ID NO: 133547 - DNA, 25 bp, Homo sapien
ctgcgctcggccttagggaaagaag

SEQ ID NO: 133548 - DNA, 25 bp, Homo sapien
cccttgtccatcagggttctcgaga

SEQ ID NO: 133549 - DNA, 25 bp, Homo sapien
gttagggacccacacctagaggtga

SEQ ID NO: 133550 - DNA, 25 bp, Homo sapien
tgctgcagcaacacgcggaaaaagt

SEQ ID NO: 133551 - DNA, 25 bp, Homo sapien
tactcctctcccatgcggagcagga

SEQ ID NO: 133552 - DNA, 25 bp, Homo sapien
cagccgcatgttaggggcactcgct

SEQ ID NO: 133553 - DNA, 25 bp, Homo sapien
ttggttagagttcgctcagctggga

SEQ ID NO: 133554 - DNA, 25 bp, Homo sapien
ttcctacgggactgccttagacgtg

SEQ ID NO: 133555 - DNA, 25 bp, Homo sapien
gggctttggcctcagtgattcggat

SEQ ID NO: 133556 - DNA, 25 bp, Homo sapien
tgcagggctccgcacctaagctcat

SEQ ID NO: 133557 - DNA, 25 bp, Homo sapien
cccaggcggaggaagtactcctctc

SEQ ID NO: 133558 - DNA, 25 bp, Homo sapien
ttcgccaagcggattcaggccaaga

SEQ ID NO: 133559 - DNA, 25 bp, Homo sapien
atctgcacgtggttatgctgccgga

SEQ ID NO: 133560 - DNA, 25 bp, Homo sapien
ttgggccgccactgtaggaaaagta

SEQ ID NO: 133561 - DNA, 25 bp, Homo sapien
gctgcagtttgacctgggcaacctg

SEQ ID NO: 133562 - DNA, 25 bp, Homo sapien
tggcgccagcctaaaggtcccgctt

SEQ ID NO: 133563 - DNA, 25 bp, Homo sapien
gcgcgggacaacacgcaactgctca

SEQ ID NO: 133564 - DNA, 25 bp, Homo sapien
cgcccgggacgacaccaaagaatgg

SEQ ID NO: 133565 - DNA, 25 bp, Homo sapien
gaatcgtagtcccaatcctgctctg

SEQ ID NO: 133566 - DNA, 25 bp, Homo sapien
aggcctacggagcagttaccttcta

SEQ ID NO: 133567 - DNA, 25 bp, Homo sapien
gtgtgacccgctcagatcctgcgca

SEQ ID NO: 133568 - DNA, 25 bp, Homo sapien
gcgcagtcttctccgcttactttca

SEQ ID NO: 133569 - DNA, 25 bp, Homo sapien
agctggcgttctggttcttactccg

SEQ ID NO: 133570 - DNA, 25 bp, Homo sapien
ttactccgtgggaaaatggccctga

SEQ ID NO: 133571 - DNA, 25 bp, Homo sapien
aagaggactccaagcgccatggccg

SEQ ID NO: 133572 - DNA, 25 bp, Homo sapien
tcgcgtacttgctgaggcaactgca

SEQ ID NO: 133573 - DNA, 25 bp, Homo sapien
gcccgactggcttgaggcttagaca

SEQ ID NO: 133574 - DNA, 25 bp, Homo sapien
cgaatttttgagatctggacggcca

SEQ ID NO: 133575 - DNA, 25 bp, Homo sapien
ccgcgtctgctttgacttcgcagtt

SEQ ID NO: 133576 - DNA, 25 bp, Homo sapien
gcgtcgggaaccactagatggcagc

SEQ ID NO: 133577 - DNA, 25 bp, Homo sapien
ctcgggtgttttaattccagatttg

SEQ ID NO: 133578 - DNA, 25 bp, Homo sapien
gtatctaccgagacccaaccactgg

SEQ ID NO: 133579 - DNA, 25 bp, Homo sapien
tggacaaggtcttctgggcaaccca

SEQ ID NO: 133580 - DNA, 25 bp, Homo sapien
ctgtccaggaaataggagacgacca

SEQ ID NO: 133581 - DNA, 25 bp, Homo sapien
ggccactgagatcaacccttttcct

SEQ ID NO: 133582 - DNA, 25 bp, Homo sapien
gtggtgatcgagtcggacctgtaca

SEQ ID NO: 133583 - DNA, 25 bp, Homo sapien
gagtcggacctgtacacgcaccagc

SEQ ID NO: 133584 - DNA, 25 bp, Homo sapien
accgccgcaggtttgggcggctcca

SEQ ID NO: 133585 - DNA, 25 bp, Homo sapien
gcctctgccagacccggtacgtgag

SEQ ID NO: 133586 - DNA, 25 bp, Homo sapien
tgccagacccggtacgtgagtcccg

SEQ ID NO: 133587 - DNA, 25 bp, Homo sapien
cgcagagacccactcagagccacca

SEQ ID NO: 133588 - DNA, 25 bp, Homo sapien
agagccaccacaagcccaggtcagg

SEQ ID NO: 133589 - DNA, 25 bp, Homo sapien
cacaagcccaggtcagggcagcgtt

SEQ ID NO: 133590 - DNA, 25 bp, Homo sapien
ttagccaccagctccacgagtactg

SEQ ID NO: 133591 - DNA, 25 bp, Homo sapien
atcaacgacgccttcgaggggctgc

SEQ ID NO: 133592 - DNA, 25 bp, Homo sapien
gaggacgacttcttcaccgaccagt

SEQ ID NO: 133593 - DNA, 25 bp, Homo sapien
gcctagacgcctttccttcttcgta

SEQ ID NO: 133594 - DNA, 25 bp, Homo sapien
tcggacgggccttagaaactcacca

SEQ ID NO: 133595 - DNA, 25 bp, Homo sapien
ttataagaatcctcgcgtgccggcc

SEQ ID NO: 133596 - DNA, 25 bp, Homo sapien
gcacgcgcctatggatgttgttata

SEQ ID NO: 133597 - DNA, 25 bp, Homo sapien
gagaagcgcctctccaaggtggaca

SEQ ID NO: 133598 - DNA, 25 bp, Homo sapien
gatgcgccctttgtggactccattg

SEQ ID NO: 133599 - DNA, 25 bp, Homo sapien
ctcctccttccggtgaaagtcgtcg

SEQ ID NO: 133600 - DNA, 25 bp, Homo sapien
gctttgctacaatacctctccgggg

SEQ ID NO: 133601 - DNA, 25 bp, Homo sapien
tacccagcttcctttgtatgagtgc

SEQ ID NO: 133602 - DNA, 25 bp, Homo sapien
cacactcaacgtgggacgaagcttc

SEQ ID NO: 133603 - DNA, 25 bp, Homo sapien
cgaagcttcgcctactgtttgacta

SEQ ID NO: 133604 - DNA, 25 bp, Homo sapien
tgtttgactacgtgcgtgcagcctc

SEQ ID NO: 133605 - DNA, 25 bp, Homo sapien
tgtcggccctcgaaaagagcatgca

SEQ ID NO: 133606 - DNA, 25 bp, Homo sapien
agacgtttgtccgaagggcctgtca

SEQ ID NO: 133607 - DNA, 25 bp, Homo sapien
agggctcgggccacacaaaaggcgc

SEQ ID NO: 133608 - DNA, 25 bp, Homo sapien
acacacttctggcaggtgcgggcca

SEQ ID NO: 133609 - DNA, 25 bp, Homo sapien
ccggcgggttgtgcatttatgcagc

SEQ ID NO: 133610 - DNA, 25 bp, Homo sapien
ccatctggtgtctggcgtgcacaaa

SEQ ID NO: 133611 - DNA, 25 bp, Homo sapien
atccctaatcgcgtcccatctggtg

SEQ ID NO: 133612 - DNA, 25 bp, Homo sapien
tcccgccaaaatgtccgtagtagta

SEQ ID NO: 133613 - DNA, 25 bp, Homo sapien
cctgtcacagggaagacgttctttt

SEQ ID NO: 133614 - DNA, 25 bp, Homo sapien
tctcctgcagggttttgtccgcacc

SEQ ID NO: 133615 - DNA, 25 bp, Homo sapien
aagagccgccgtttgaatctgcgca

SEQ ID NO: 133616 - DNA, 25 bp, Homo sapien
acgcggccctgaacctcattggctg

SEQ ID NO: 133617 - DNA, 25 bp, Homo sapien
cgagctgtcataggacccggaacgc

SEQ ID NO: 133618 - DNA, 25 bp, Homo sapien
ccaacatgtcaggaggcgcgatccc

SEQ ID NO: 133619 - DNA, 25 bp, Homo sapien
aacgcacgtcctcgacagggcagga

SEQ ID NO: 133620 - DNA, 25 bp, Homo sapien
cttcaagtaccgcataggagcaggc

SEQ ID NO: 133621 - DNA, 25 bp, Homo sapien
tagcagttctgcagggctcgcagtc

SEQ ID NO: 133622 - DNA, 25 bp, Homo sapien
tgtttgtccattccatagcgagcta

SEQ ID NO: 133623 - DNA, 25 bp, Homo sapien
cccagtaaggcgcaatcgaacagtt

SEQ ID NO: 133624 - DNA, 25 bp, Homo sapien
ttcatgtcccggagaagcttggccc

SEQ ID NO: 133625 - DNA, 25 bp, Homo sapien
ggattctccggtctctccgcttcaa

SEQ ID NO: 133626 - DNA, 25 bp, Homo sapien
tccgcagcaggttgtgtagcactac

SEQ ID NO: 133627 - DNA, 25 bp, Homo sapien
atagacgcgcctgacacttcggatc

SEQ ID NO: 133628 - DNA, 25 bp, Homo sapien
gggcagctcccggaaaggattctcc

SEQ ID NO: 133629 - DNA, 25 bp, Homo sapien
gcccagggcgaagcactttcctttc

SEQ ID NO: 133630 - DNA, 25 bp, Homo sapien
ggccgctgcctgtcctcggaaaaag

SEQ ID NO: 133631 - DNA, 25 bp, Homo sapien
ctatctgaggtcgaaagtgggtgca

SEQ ID NO: 133632 - DNA, 25 bp, Homo sapien
cgccgagcagggagaccctatctga

SEQ ID NO: 133633 - DNA, 25 bp, Homo sapien
ctcgagattcctaaacgcccaaggg

SEQ ID NO: 133634 - DNA, 25 bp, Homo sapien
acccactgtgtcctcttgaactttg

SEQ ID NO: 133635 - DNA, 25 bp, Homo sapien
ctcccggagagtttgtggtctttgt

SEQ ID NO: 133636 - DNA, 25 bp, Homo sapien
ttgaactttgcacagcgcgtgacgg

SEQ ID NO: 133637 - DNA, 25 bp, Homo sapien
ttccacgaggtgaattcagatcctg

SEQ ID NO: 133638 - DNA, 25 bp, Homo sapien
tcacacgtggcgtcgtgtctagttc

SEQ ID NO: 133639 - DNA, 25 bp, Homo sapien
acatggcgtcgtgtctagttctctc

SEQ ID NO: 133640 - DNA, 25 bp, Homo sapien
gtctagttctctcacacatggcgtc

SEQ ID NO: 133641 - DNA, 25 bp, Homo sapien
tctagttctctcacacatggcgtcg

SEQ ID NO: 133642 - DNA, 25 bp, Homo sapien
tggcgtcgtgtctagttccctcaca

SEQ ID NO: 133643 - DNA, 25 bp, Homo sapien
cgtgtctagttctctctcacatggc

SEQ ID NO: 133644 - DNA, 25 bp, Homo sapien
tcgtgtctagttccctcacacatgg

SEQ ID NO: 133645 - DNA, 25 bp, Homo sapien
tggcgtcgtgtctagttctctcaca

SEQ ID NO: 133646 - DNA, 25 bp, Homo sapien
gctgaccgagccatattcgggcgtg

SEQ ID NO: 133647 - DNA, 25 bp, Homo sapien
cccggtgccatttccgcgcccatca

SEQ ID NO: 133648 - DNA, 25 bp, Homo sapien
cgaggaacccttggcggagaacagc

SEQ ID NO: 133649 - DNA, 25 bp, Homo sapien
ctcatcgagcttgcgcgaggaaccc

SEQ ID NO: 133650 - DNA, 25 bp, Homo sapien
cgtgtggctcatcgagcttgcgcga

SEQ ID NO: 133651 - DNA, 25 bp, Homo sapien
tgcccgaaggtaagcgtgtggctca

SEQ ID NO: 133652 - DNA, 25 bp, Homo sapien
gtggcggcgcttcccattcgccatg

SEQ ID NO: 133653 - DNA, 25 bp, Homo sapien
accgagccatattcgggcgtggccg

SEQ ID NO: 133654 - DNA, 25 bp, Homo sapien
gttggacctaagaccgcgatcactc

SEQ ID NO: 133655 - DNA, 25 bp, Homo sapien
aggggagatgagacccgcaccttag

SEQ ID NO: 133656 - DNA, 25 bp, Homo sapien
catgactaacggctcttcgcgcttc

SEQ ID NO: 133657 - DNA, 25 bp, Homo sapien
cgcaaatggcttgtggggaaagctc

SEQ ID NO: 133658 - DNA, 25 bp, Homo sapien
cggcacgtagaggagttggacctaa

SEQ ID NO: 133659 - DNA, 25 bp, Homo sapien
ctgggcacccatatggcggaggaac

SEQ ID NO: 133660 - DNA, 25 bp, Homo sapien
tagccttttggcctacgcagcagcc

SEQ ID NO: 133661 - DNA, 25 bp, Homo sapien
agacagctcttaggcactccggtgg

SEQ ID NO: 133662 - DNA, 25 bp, Homo sapien
gccggctttgcttttcaggggcaaa

SEQ ID NO: 133663 - DNA, 25 bp, Homo sapien
aggcggcttagagggtcattaatca

SEQ ID NO: 133664 - DNA, 25 bp, Homo sapien
cgatgcccaagtcgacggctgtttc

SEQ ID NO: 133665 - DNA, 25 bp, Homo sapien
tcacctttcctggagcggctgagtg

SEQ ID NO: 133666 - DNA, 25 bp, Homo sapien
gcacagctcaggatcagcactcgtt

SEQ ID NO: 133667 - DNA, 25 bp, Homo sapien
acgcgatttgcttccggacgtctgg

SEQ ID NO: 133668 - DNA, 25 bp, Homo sapien
caagcgagctcgttttgcctgggac

SEQ ID NO: 133669 - DNA, 25 bp, Homo sapien
gttcgcgcttgggtgactttatcca

SEQ ID NO: 133670 - DNA, 25 bp, Homo sapien
ctccagtttggtcggtttcatcggc

SEQ ID NO: 133671 - DNA, 25 bp, Homo sapien
ttagcttgaagaggccgtgaggcat

SEQ ID NO: 133672 - DNA, 25 bp, Homo sapien
ccgactagagtcctgttagcttgaa

SEQ ID NO: 133673 - DNA, 25 bp, Homo sapien
ggtcactaggccgactccgactaga

SEQ ID NO: 133674 - DNA, 25 bp, Homo sapien
aatctcgcgacatcgcaggctgctc

SEQ ID NO: 133675 - DNA, 25 bp, Homo sapien
caagcgccgctcacgagaaatctcg

SEQ ID NO: 133676 - DNA, 25 bp, Homo sapien
cgggacagtccggtagctaactcca

SEQ ID NO: 133677 - DNA, 25 bp, Homo sapien
gtccctacgcagaccagcggcggtt

SEQ ID NO: 133678 - DNA, 25 bp, Homo sapien
cgtagctcgtactgttgtgaccgta

SEQ ID NO: 133679 - DNA, 25 bp, Homo sapien
gtccgcgacgatcctctagagcact

SEQ ID NO: 133680 - DNA, 25 bp, Homo sapien
ccggcatcggtgactacgagttatg

SEQ ID NO: 133681 - DNA, 25 bp, Homo sapien
ttacacggtccggattcctgggcca

SEQ ID NO: 133682 - DNA, 25 bp, Homo sapien
agcggttccttggttcccatgcgcc

SEQ ID NO: 133683 - DNA, 25 bp, Homo sapien
gctgtaacctcttcggtccgcgacg

SEQ ID NO: 133684 - DNA, 25 bp, Homo sapien
tgcgcactgctttgctagtaaaact

SEQ ID NO: 133685 - DNA, 25 bp, Homo sapien
gaggtctgtcatgctgttcccgctc

SEQ ID NO: 133686 - DNA, 25 bp, Homo sapien
ctttctgggtctcctgtcccgagcg

SEQ ID NO: 133687 - DNA, 25 bp, Homo sapien
tcgtcgtgccctcacctagtcaggt

SEQ ID NO: 133688 - DNA, 25 bp, Homo sapien
ctcacctagtcaggtcccgcagccg

SEQ ID NO: 133689 - DNA, 25 bp, Homo sapien
cccgcgcaggtaccgcctcagcagc

SEQ ID NO: 133690 - DNA, 25 bp, Homo sapien
ggtcagcgccgagaacgtgtcgccc

SEQ ID NO: 133691 - DNA, 25 bp, Homo sapien
aggacccatagccagcgctcgcgaa

SEQ ID NO: 133692 - DNA, 25 bp, Homo sapien
gcgccacgctggtcagcgccgagaa

SEQ ID NO: 133693 - DNA, 25 bp, Homo sapien
cggtcgctcccactcgtcgtgccct

SEQ ID NO: 133694 - DNA, 25 bp, Homo sapien
gccgagttcctgtcaactccagaca

SEQ ID NO: 133695 - DNA, 25 bp, Homo sapien
cttgtcggccaatatcttctccaga

SEQ ID NO: 133696 - DNA, 25 bp, Homo sapien
agcccgggtcaggaacatgttcttc

SEQ ID NO: 133697 - DNA, 25 bp, Homo sapien
ccctcatacatggacgcagagaagg

SEQ ID NO: 133698 - DNA, 25 bp, Homo sapien
caagaagccgtacctcgagggccgc

SEQ ID NO: 133699 - DNA, 25 bp, Homo sapien
cgagagaagggctaccctggctact

SEQ ID NO: 133700 - DNA, 25 bp, Homo sapien
cctggctactgtggggattagcacc

SEQ ID NO: 133701 - DNA, 25 bp, Homo sapien
atgttgggaggaaacgacgcgtcac

SEQ ID NO: 133702 - DNA, 25 bp, Homo sapien
agttcctggtgtcggtgagtgtccc

SEQ ID NO: 133703 - DNA, 25 bp, Homo sapien
gccgccgaccatgagcgaggacagc

SEQ ID NO: 133704 - DNA, 25 bp, Homo sapien
gagaagcagcttcgcctgcgcgtgt

SEQ ID NO: 133705 - DNA, 25 bp, Homo sapien
tgcgtgctcagcgagctccagaaga

SEQ ID NO: 133706 - DNA, 25 bp, Homo sapien
ctccagaagaccgagcgggactatg

SEQ ID NO: 133707 - DNA, 25 bp, Homo sapien
actatgtgggcacgctggagttcct

SEQ ID NO: 133708 - DNA, 25 bp, Homo sapien
cgcgggaatccacgtgtggactctg

SEQ ID NO: 133709 - DNA, 25 bp, Homo sapien
ccgagagcgccaaggacctggagaa

SEQ ID NO: 133710 - DNA, 25 bp, Homo sapien
ctgccgcccagaggagaaaggaacc

SEQ ID NO: 133711 - DNA, 25 bp, Homo sapien
caggcttacctggagaagaacaaga

SEQ ID NO: 133712 - DNA, 25 bp, Homo sapien
atggcgtctcatccgcaaacccgga

SEQ ID NO: 133713 - DNA, 25 bp, Homo sapien
ggcgggcacttagccagttacctga

SEQ ID NO: 133714 - DNA, 25 bp, Homo sapien
gaaaggaacctctgcctcgaatttc

SEQ ID NO: 133715 - DNA, 25 bp, Homo sapien
aaaggaggtacacacagtcgcgcgc

SEQ ID NO: 133716 - DNA, 25 bp, Homo sapien
cagcccgggctgtttgttccgtcac

SEQ ID NO: 133717 - DNA, 25 bp, Homo sapien
ccctcgcctcggagttgtctgagtt

SEQ ID NO: 133718 - DNA, 25 bp, Homo sapien
tcccagagcgcggtatcaaacgaaa

SEQ ID NO: 133719 - DNA, 25 bp, Homo sapien
agtgaagctgccgacctgcaaagca

SEQ ID NO: 133720 - DNA, 25 bp, Homo sapien
gctgcagtctccagtcccggaacaa

SEQ ID NO: 133721 - DNA, 25 bp, Homo sapien
ggcggagactctccctcattgtctg

SEQ ID NO: 133722 - DNA, 25 bp, Homo sapien
gtgaactaactgcagcctttccgta

SEQ ID NO: 133723 - DNA, 25 bp, Homo sapien
tgtggcccgcactaagtcccagagc

SEQ ID NO: 133724 - DNA, 25 bp, Homo sapien
aatccgtctgctttgccgagagcta

SEQ ID NO: 133725 - DNA, 25 bp, Homo sapien
acgtgtgcgcgactagatttgaatc

SEQ ID NO: 133726 - DNA, 25 bp, Homo sapien
cggtgcctctctcaaggcacgtttt

SEQ ID NO: 133727 - DNA, 25 bp, Homo sapien
ttaggcccgaaaggcttcaaacagc

SEQ ID NO: 133728 - DNA, 25 bp, Homo sapien
tagagctccgattaggcccgaaagg

SEQ ID NO: 133729 - DNA, 25 bp, Homo sapien
gccctctgatgtagagctccgatta

SEQ ID NO: 133730 - DNA, 25 bp, Homo sapien
ggcacgttttccaaagtgtgttgaa

SEQ ID NO: 133731 - DNA, 25 bp, Homo sapien
agccggcgtccatgtgttctgcacc

SEQ ID NO: 133732 - DNA, 25 bp, Homo sapien
gcttgcggttcccagatccagaggc

SEQ ID NO: 133733 - DNA, 25 bp, Homo sapien
cgggaatcgatcgaaaatttcaagg

SEQ ID NO: 133734 - DNA, 25 bp, Homo sapien
ggcaggcatgaacagacaccacgtg

SEQ ID NO: 133735 - DNA, 25 bp, Homo sapien
gcgtgaacagacaccacgtgagaca

SEQ ID NO: 133736 - DNA, 25 bp, Homo sapien
tggcaggcgtgaacagacaccacgt

SEQ ID NO: 133737 - DNA, 25 bp, Homo sapien
gtgaacagacaccacgtgagacagg

SEQ ID NO: 133738 - DNA, 25 bp, Homo sapien
aacgtggcaggcatgaacagacacc

SEQ ID NO: 133739 - DNA, 25 bp, Homo sapien
aacgtggcaggcgtgaacagacacc

SEQ ID NO: 133740 - DNA, 25 bp, Homo sapien
acgtggcaggcgtgaacagacacca

SEQ ID NO: 133741 - DNA, 25 bp, Homo sapien
aggcatgaacagacaccacgtgaga

SEQ ID NO: 133742 - DNA, 25 bp, Homo sapien
ccggcgggtcttgagatcaatgagc

SEQ ID NO: 133743 - DNA, 25 bp, Homo sapien
aaccgaacacgtgtgctacccaggg

SEQ ID NO: 133744 - DNA, 25 bp, Homo sapien
ctggggtcgctcacttaactcatca

SEQ ID NO: 133745 - DNA, 25 bp, Homo sapien
tccaaaacgaactgcgccagcgagt

SEQ ID NO: 133746 - DNA, 25 bp, Homo sapien
tccgacctcagggatctgcaacttg

SEQ ID NO: 133747 - DNA, 25 bp, Homo sapien
ccaagcagggtcatgactcagaaat

SEQ ID NO: 133748 - DNA, 25 bp, Homo sapien
tcattctaccaggactattggggcc

SEQ ID NO: 133749 - DNA, 25 bp, Homo sapien
agacaggcagcaagttcaccgaggc

SEQ ID NO: 133750 - DNA, 25 bp, Homo sapien
cgggatgcaactcccgttttccgcg

SEQ ID NO: 133751 - DNA, 25 bp, Homo sapien
cgcaaggcgctggagcgcctccttt

SEQ ID NO: 133752 - DNA, 25 bp, Homo sapien
ccagaaagttcagtcaggggcgagc

SEQ ID NO: 133753 - DNA, 25 bp, Homo sapien
ggactcgtctcctgagctctcgcaa

SEQ ID NO: 133754 - DNA, 25 bp, Homo sapien
aggattcaccttctcggctctgccg

SEQ ID NO: 133755 - DNA, 25 bp, Homo sapien
ttaaagaatgcaccttcccaggatt

SEQ ID NO: 133756 - DNA, 25 bp, Homo sapien
gccgctccgcgcttccattaaagaa

SEQ ID NO: 133757 - DNA, 25 bp, Homo sapien
gcacacaaaaacagcctctcggagg

SEQ ID NO: 133758 - DNA, 25 bp, Homo sapien
agcaggaagaccatcgccacacagg

SEQ ID NO: 133759 - DNA, 25 bp, Homo sapien
atgcgcaccagggagacgacgctcc

SEQ ID NO: 133760 - DNA, 25 bp, Homo sapien
gctgccacgtaacccttcgcgggaa

SEQ ID NO: 133761 - DNA, 25 bp, Homo sapien
ggtgcttttcttgcgaatcgccatg

SEQ ID NO: 133762 - DNA, 25 bp, Homo sapien
gaggcccaccgggactttgcatctc

SEQ ID NO: 133763 - DNA, 25 bp, Homo sapien
gggcgggctcacctcaaacatgagc

SEQ ID NO: 133764 - DNA, 25 bp, Homo sapien
cgcgtgattctgcaggacgaattcg

SEQ ID NO: 133765 - DNA, 25 bp, Homo sapien
agggaaggcctgcacctcagggact

SEQ ID NO: 133766 - DNA, 25 bp, Homo sapien
cccactaggtaggtgttggtgcctt

SEQ ID NO: 133767 - DNA, 25 bp, Homo sapien
cgtattttagctagcttcgagatcc

SEQ ID NO: 133768 - DNA, 25 bp, Homo sapien
ttcgagatccgagtgtctgcgtgca

SEQ ID NO: 133769 - DNA, 25 bp, Homo sapien
gcgatcagtcaaagcccgggctccg

SEQ ID NO: 133770 - DNA, 25 bp, Homo sapien
aacacacgcacgactcgattggaca

SEQ ID NO: 133771 - DNA, 25 bp, Homo sapien
ccggcgtgtcgcctatctggatact

SEQ ID NO: 133772 - DNA, 25 bp, Homo sapien
ctggatactccagcgcggaagaagc

SEQ ID NO: 133773 - DNA, 25 bp, Homo sapien
agtagcgtccacgtgatgcctcgca

SEQ ID NO: 133774 - DNA, 25 bp, Homo sapien
aggcaatagtgcacggttcttttta

SEQ ID NO: 133775 - DNA, 25 bp, Homo sapien
ctctggcagtccgaaggagcaaccc

SEQ ID NO: 133776 - DNA, 25 bp, Homo sapien
ctctgtgttttcagccatggcgacc

SEQ ID NO: 133777 - DNA, 25 bp, Homo sapien
ccacctcactgaagggcatcggaga

SEQ ID NO: 133778 - DNA, 25 bp, Homo sapien
atcggagaccaaccgcagggtgttc

SEQ ID NO: 133779 - DNA, 25 bp, Homo sapien
gcgccgcgagagaacaacagtccca

SEQ ID NO: 133780 - DNA, 25 bp, Homo sapien
ggctaccactagcaagctgcctttg

SEQ ID NO: 133781 - DNA, 25 bp, Homo sapien
tgttcgtaacagctcctgccgcggc

SEQ ID NO: 133782 - DNA, 25 bp, Homo sapien
cttccaggtgactttcgcgtacctg

SEQ ID NO: 133783 - DNA, 25 bp, Homo sapien
cttccagaaattcgagccagcggtg

SEQ ID NO: 133784 - DNA, 25 bp, Homo sapien
cgcggctgcacttacttgtgtcaca

SEQ ID NO: 133785 - DNA, 25 bp, Homo sapien
acttgtgtcacaactgcggcgacgg

SEQ ID NO: 133786 - DNA, 25 bp, Homo sapien
tgaggaaccggttcttccaaaagca

SEQ ID NO: 133787 - DNA, 25 bp, Homo sapien
tctttcctctctaaacgctcctgtg

SEQ ID NO: 133788 - DNA, 25 bp, Homo sapien
ctcagggtcagatttagtttcacaa

SEQ ID NO: 133789 - DNA, 25 bp, Homo sapien
tcgtcacggcaacccaactggaggc

SEQ ID NO: 133790 - DNA, 25 bp, Homo sapien
cgtcggtttctcctcctagcgctag

SEQ ID NO: 133791 - DNA, 25 bp, Homo sapien
tcccggcggcgcctattactagcag

SEQ ID NO: 133792 - DNA, 25 bp, Homo sapien
cacaaggtttcgatggacagggaca

SEQ ID NO: 133793 - DNA, 25 bp, Homo sapien
aacgcccaggaagcactaaccgatg

SEQ ID NO: 133794 - DNA, 25 bp, Homo sapien
tccactgtcagcgtcggctagaagc

SEQ ID NO: 133795 - DNA, 25 bp, Homo sapien
ggaaccgcgccgagctagactagct

SEQ ID NO: 133796 - DNA, 25 bp, Homo sapien
gcgcctagctgtaaagggccctaat

SEQ ID NO: 133797 - DNA, 25 bp, Homo sapien
tgcttagcccttcgaggatcggttt

SEQ ID NO: 133798 - DNA, 25 bp, Homo sapien
cgtctcgtcacgaaaggaagctctt

SEQ ID NO: 133799 - DNA, 25 bp, Homo sapien
tgtcccgacgcggatctcacgtcta

SEQ ID NO: 133800 - DNA, 25 bp, Homo sapien
ctgggaagtgtgtctccacctagcc

SEQ ID NO: 133801 - DNA, 25 bp, Homo sapien
cgcctgcctgattagaaaaagccgg

SEQ ID NO: 133802 - DNA, 25 bp, Homo sapien
atcacttgctatggtaagccgccca

SEQ ID NO: 133803 - DNA, 25 bp, Homo sapien
ggcagcagccgagagttagtctaca

SEQ ID NO: 133804 - DNA, 25 bp, Homo sapien
gcacgtgtgcgatgaatctggctcc

SEQ ID NO: 133805 - DNA, 25 bp, Homo sapien
gcgcgttccctatcgcaggatcact

SEQ ID NO: 133806 - DNA, 25 bp, Homo sapien
atagcggtcctcctgcaacagctgc

SEQ ID NO: 133807 - DNA, 25 bp, Homo sapien
cacgtagccgttctcatagcggtcc

SEQ ID NO: 133808 - DNA, 25 bp, Homo sapien
gttccgctgcgactgcttgcactct

SEQ ID NO: 133809 - DNA, 25 bp, Homo sapien
ctaccaggttcactgggtgcacgta

SEQ ID NO: 133810 - DNA, 25 bp, Homo sapien
tgagcgatgtaactggaagccagcc

SEQ ID NO: 133811 - DNA, 25 bp, Homo sapien
tcctctgccgacgagttgtcactgg

SEQ ID NO: 133812 - DNA, 25 bp, Homo sapien
ttggcgcccaagtccagaatccgcg

SEQ ID NO: 133813 - DNA, 25 bp, Homo sapien
aattcttcccaacgggctgaccctg

SEQ ID NO: 133814 - DNA, 25 bp, Homo sapien
tgccactctcaggtggggtgacttt

SEQ ID NO: 133815 - DNA, 25 bp, Homo sapien
aaggagagctgtgtccgtgtcacga

SEQ ID NO: 133816 - DNA, 25 bp, Homo sapien
gggattcctgctccgcggagaactg

SEQ ID NO: 133817 - DNA, 25 bp, Homo sapien
ctcaaggcttgcaggtcgtctccag

SEQ ID NO: 133818 - DNA, 25 bp, Homo sapien
ttgtcgagcgaactctcaaggcttg

SEQ ID NO: 133819 - DNA, 25 bp, Homo sapien
aagtcactgccctcgcgcttgtcga

SEQ ID NO: 133820 - DNA, 25 bp, Homo sapien
cccagtatgagcgaacctcaagtca

SEQ ID NO: 133821 - DNA, 25 bp, Homo sapien
tcctgggtcagtggcgcatccacct

SEQ ID NO: 133822 - DNA, 25 bp, Homo sapien
aaaagtcgctctgcggaagccctgg

SEQ ID NO: 133823 - DNA, 25 bp, Homo sapien
aggcccgcgctacttttgtagtgca

SEQ ID NO: 133824 - DNA, 25 bp, Homo sapien
gaaacgcggagctccttcgcaaaga

SEQ ID NO: 133825 - DNA, 25 bp, Homo sapien
cgcactgacggagtcaagcgtgtca

SEQ ID NO: 133826 - DNA, 25 bp, Homo sapien
gcgattccttgaaatcctccgtgtc

SEQ ID NO: 133827 - DNA, 25 bp, Homo sapien
tgcagcagcgcactgacggagtcaa

SEQ ID NO: 133828 - DNA, 25 bp, Homo sapien
cagagtaccttaagcgattccttga

SEQ ID NO: 133829 - DNA, 25 bp, Homo sapien
gaaatcctccgtgtcgtccggcaca

SEQ ID NO: 133830 - DNA, 25 bp, Homo sapien
cactcgagacactcggcagcgttta

SEQ ID NO: 133831 - DNA, 25 bp, Homo sapien
cgagacactcggcagcgtttaaaaa

SEQ ID NO: 133832 - DNA, 25 bp, Homo sapien
agcgtctctccaacagtggtctaca

SEQ ID NO: 133833 - DNA, 25 bp, Homo sapien
tgcagcgtctctccaacagtggtct

SEQ ID NO: 133834 - DNA, 25 bp, Homo sapien
gcagcgtctctccaacagtggtcta

SEQ ID NO: 133835 - DNA, 25 bp, Homo sapien
cggtggtctacactcgagaaacttg

SEQ ID NO: 133836 - DNA, 25 bp, Homo sapien
gcagcgtctctccaacggtggtcta

SEQ ID NO: 133837 - DNA, 25 bp, Homo sapien
agcgtctctcccacagtggtctaca

SEQ ID NO: 133838 - DNA, 25 bp, Homo sapien
caaggaaacctcgagccgaaccgcg

SEQ ID NO: 133839 - DNA, 25 bp, Homo sapien
ggtagaaacacagacctccctagca

SEQ ID NO: 133840 - DNA, 25 bp, Homo sapien
gtaccttaagcggttccttgcagtc

SEQ ID NO: 133841 - DNA, 25 bp, Homo sapien
gttccttgcagtcctccgtgtcgtc

SEQ ID NO: 133842 - DNA, 25 bp, Homo sapien
ggacgccatctggtgcatctgctcc

SEQ ID NO: 133843 - DNA, 25 bp, Homo sapien
aggcagcgaaaatctcgctccgcga

SEQ ID NO: 133844 - DNA, 25 bp, Homo sapien
cgctccgcgagagccctggagaact

SEQ ID NO: 133845 - DNA, 25 bp, Homo sapien
ctacttacagtgcaggaagcaagcg

SEQ ID NO: 133846 - DNA, 25 bp, Homo sapien
tctccgcagctctttctccaggaaa

SEQ ID NO: 133847 - DNA, 25 bp, Homo sapien
cagatcttatctgcgctcctagtta

SEQ ID NO: 133848 - DNA, 25 bp, Homo sapien
tccctctagtccagtgcagccgggt

SEQ ID NO: 133849 - DNA, 25 bp, Homo sapien
ggctgcgtccctctagtccagtgca

SEQ ID NO: 133850 - DNA, 25 bp, Homo sapien
tctccaggaaaataatcctggcacc

SEQ ID NO: 133851 - DNA, 25 bp, Homo sapien
ctcctagttatctccgcagctcttt

SEQ ID NO: 133852 - DNA, 25 bp, Homo sapien
gtgccgcgaggaaagtcagatctta

SEQ ID NO: 133853 - DNA, 25 bp, Homo sapien
ggacagccctgcagttggaagcaga

SEQ ID NO: 133854 - DNA, 25 bp, Homo sapien
caggaacaggtgtcggccaatcaga

SEQ ID NO: 133855 - DNA, 25 bp, Homo sapien
cctgccctagactggcggcaaattc

SEQ ID NO: 133856 - DNA, 25 bp, Homo sapien
ccggaacaggtgtcggccaatcaga

SEQ ID NO: 133857 - DNA, 25 bp, Homo sapien
agaagccaggcttgaaccgctcgcc

SEQ ID NO: 133858 - DNA, 25 bp, Homo sapien
gccctcgaatgcgagccaatcgttg

SEQ ID NO: 133859 - DNA, 25 bp, Homo sapien
agccaatcgttgctcggcgcctgaa

SEQ ID NO: 133860 - DNA, 25 bp, Homo sapien
ttaacatggcggaggatgtttcctc

SEQ ID NO: 133861 - DNA, 25 bp, Homo sapien
cgctcagtatggagtcgtccggttt

SEQ ID NO: 133862 - DNA, 25 bp, Homo sapien
tcctggaccagagaccgaaagcctc

SEQ ID NO: 133863 - DNA, 25 bp, Homo sapien
gcgcccgtttgctcgctggacacgg

SEQ ID NO: 133864 - DNA, 25 bp, Homo sapien
gggtgccttacctgcctctcagcaa

SEQ ID NO: 133865 - DNA, 25 bp, Homo sapien
cctcggttccacagtctcacggaga

SEQ ID NO: 133866 - DNA, 25 bp, Homo sapien
tgctccacgatcactgcgctcggga

SEQ ID NO: 133867 - DNA, 25 bp, Homo sapien
agcttggtatttgcagcgcccaccc

SEQ ID NO: 133868 - DNA, 25 bp, Homo sapien
atccgggaggactagcttggtattt

SEQ ID NO: 133869 - DNA, 25 bp, Homo sapien
gccctctgaccgagggtggcccaag

SEQ ID NO: 133870 - DNA, 25 bp, Homo sapien
cgagcgggcattttcactctaaagc

SEQ ID NO: 133871 - DNA, 25 bp, Homo sapien
caggcttggtcgcagaaacacgtcc

SEQ ID NO: 133872 - DNA, 25 bp, Homo sapien
ggggaggccacatttcctggctcta

SEQ ID NO: 133873 - DNA, 25 bp, Homo sapien
ctgtgcccgttggttgcaggctaac

SEQ ID NO: 133874 - DNA, 25 bp, Homo sapien
ctcgatgggcaccaaacgtgtctca

SEQ ID NO: 133875 - DNA, 25 bp, Homo sapien
ccctgtcgtagtcgaagcagcagtc

SEQ ID NO: 133876 - DNA, 25 bp, Homo sapien
aacgcctggggacacattaacgagc

SEQ ID NO: 133877 - DNA, 25 bp, Homo sapien
ctaaactgtacttctaacgcctggg

SEQ ID NO: 133878 - DNA, 25 bp, Homo sapien
ctgccgtacgcacaccagttgctag

SEQ ID NO: 133879 - DNA, 25 bp, Homo sapien
aggggagggatttctttgcgatcct

SEQ ID NO: 133880 - DNA, 25 bp, Homo sapien
gatttctttgcgatcctggccgttg

SEQ ID NO: 133881 - DNA, 25 bp, Homo sapien
tctttgcgatcctggccgttgcggc

SEQ ID NO: 133882 - DNA, 25 bp, Homo sapien
tcaccactcctggggtgagcatgcc

SEQ ID NO: 133883 - DNA, 25 bp, Homo sapien
gtacgcacaccagttgctaggcgcc

SEQ ID NO: 133884 - DNA, 25 bp, Homo sapien
acaccagttgctaggcgcccggggc

SEQ ID NO: 133885 - DNA, 25 bp, Homo sapien
aggtggccgcgagctcccacattca

SEQ ID NO: 133886 - DNA, 25 bp, Homo sapien
agtagtctaactcgcggctgtcacc

SEQ ID NO: 133887 - DNA, 25 bp, Homo sapien
cccggagcgctctgacttgcaagcg

SEQ ID NO: 133888 - DNA, 25 bp, Homo sapien
caccctctcgcaacttgggtcgagt

SEQ ID NO: 133889 - DNA, 25 bp, Homo sapien
catgagggcagttcgagtagtctaa

SEQ ID NO: 133890 - DNA, 25 bp, Homo sapien
cgcgatgaacatcgtggtggagttc

SEQ ID NO: 133891 - DNA, 25 bp, Homo sapien
gtggagttcttcgtggtcactttca

SEQ ID NO: 133892 - DNA, 25 bp, Homo sapien
actttcaaagtgctctgggcgttcg

SEQ ID NO: 133893 - DNA, 25 bp, Homo sapien
tcgagttgacaactcccgcggcagc

SEQ ID NO: 133894 - DNA, 25 bp, Homo sapien
ttcgagcagggaccgcgcagctccg

SEQ ID NO: 133895 - DNA, 25 bp, Homo sapien
tgcctgcactgtgggaacgcaagtg

SEQ ID NO: 133896 - DNA, 25 bp, Homo sapien
aacgcaagtggacagccggtccctg

SEQ ID NO: 133897 - DNA, 25 bp, Homo sapien
ggccagtgctcagcgcgggaatatt

SEQ ID NO: 133898 - DNA, 25 bp, Homo sapien
gggaatattcccaccgccacgtgcg

SEQ ID NO: 133899 - DNA, 25 bp, Homo sapien
ccaacagcggccttcgagcagggac

SEQ ID NO: 133900 - DNA, 25 bp, Homo sapien
acgtcgcgtgcctgcactgtgggaa

SEQ ID NO: 133901 - DNA, 25 bp, Homo sapien
cagcccgggttttcctcaaggatga

SEQ ID NO: 133902 - DNA, 25 bp, Homo sapien
ccgtgctgcggaactgcagggctcc

SEQ ID NO: 133903 - DNA, 25 bp, Homo sapien
tttctggtccgcaccctgtgctctg

SEQ ID NO: 133904 - DNA, 25 bp, Homo sapien
cgactgaccgtctgctctttctggt

SEQ ID NO: 133905 - DNA, 25 bp, Homo sapien
cgcggccattgttcgcgacgcagct

SEQ ID NO: 133906 - DNA, 25 bp, Homo sapien
acattggcaaacactacagagaact

SEQ ID NO: 133907 - DNA, 25 bp, Homo sapien
tttgcagacggctccaacattggca

SEQ ID NO: 133908 - DNA, 25 bp, Homo sapien
cccgatgagggtatttaccttcttg

SEQ ID NO: 133909 - DNA, 25 bp, Homo sapien
cttcttgccggggacactttgcaga

SEQ ID NO: 133910 - DNA, 25 bp, Homo sapien
tctcgttactgaggagacacggctc

SEQ ID NO: 133911 - DNA, 25 bp, Homo sapien
cacgggcacaggattaagagtcaaa

SEQ ID NO: 133912 - DNA, 25 bp, Homo sapien
cacggctccagttttgacccgacta

SEQ ID NO: 133913 - DNA, 25 bp, Homo sapien
ggcgctctgagtactttctgtctca

SEQ ID NO: 133914 - DNA, 25 bp, Homo sapien
tcacctgcattgacgccatgatgga

SEQ ID NO: 133915 - DNA, 25 bp, Homo sapien
cgacgccctgagctgagggaaaaca

SEQ ID NO: 133916 - DNA, 25 bp, Homo sapien
ggagccgattctgagaccgccaacg

SEQ ID NO: 133917 - DNA, 25 bp, Homo sapien
gtccgcgagaataccgaggctgatg

SEQ ID NO: 133918 - DNA, 25 bp, Homo sapien
tgtcgctcacttccgtctggaggta

SEQ ID NO: 133919 - DNA, 25 bp, Homo sapien
cctatgaacgcaaccggcaaatttc

SEQ ID NO: 133920 - DNA, 25 bp, Homo sapien
cgcaaccggcaaatttcgaccaatc

SEQ ID NO: 133921 - DNA, 25 bp, Homo sapien
cctatagtaggccagcctatgaacg

SEQ ID NO: 133922 - DNA, 25 bp, Homo sapien
ggacgcagagtgtgtcgctcacttc

SEQ ID NO: 133923 - DNA, 25 bp, Homo sapien
gtcagagccgctttcggcgacgcgc

SEQ ID NO: 133924 - DNA, 25 bp, Homo sapien
gggcagtcgaaagaattacttccgc

SEQ ID NO: 133925 - DNA, 25 bp, Homo sapien
aattacttccgctgggtcagagccg

SEQ ID NO: 133926 - DNA, 25 bp, Homo sapien
tgtggaaacaccgtgcgggtcctga

SEQ ID NO: 133927 - DNA, 25 bp, Homo sapien
tcctgacagtgtgtggaaaggccgc

SEQ ID NO: 133928 - DNA, 25 bp, Homo sapien
tcctgactgtgcgtggaaaggccgt

SEQ ID NO: 133929 - DNA, 25 bp, Homo sapien
gatcctgagtgtgtgtggaaacacc

SEQ ID NO: 133930 - DNA, 25 bp, Homo sapien
tggaaacaccgtgcgggtcctgact

SEQ ID NO: 133931 - DNA, 25 bp, Homo sapien
cagatcctgagtgtgtgtggaaaca

SEQ ID NO: 133932 - DNA, 25 bp, Homo sapien
tgcagatcctgagtgtgtgtggaaa

SEQ ID NO: 133933 - DNA, 25 bp, Homo sapien
gaaacaccgtgcgggtcctgactgt

SEQ ID NO: 133934 - DNA, 25 bp, Homo sapien
ctctctgcggaaggaggactgcatt

SEQ ID NO: 133935 - DNA, 25 bp, Homo sapien
tccgaggtctggtgtcccaagtgag

SEQ ID NO: 133936 - DNA, 25 bp, Homo sapien
agctgccagtcaggcgtcccgggct

SEQ ID NO: 133937 - DNA, 25 bp, Homo sapien
cccgggctgggcatgcgccacttgt

SEQ ID NO: 133938 - DNA, 25 bp, Homo sapien
tgtctcgcagtcgtggactcgtgca

SEQ ID NO: 133939 - DNA, 25 bp, Homo sapien
cgtcacccgcgtgatgctgtttctg

SEQ ID NO: 133940 - DNA, 25 bp, Homo sapien
ctgtttctggcgttgggcagcccgt

SEQ ID NO: 133941 - DNA, 25 bp, Homo sapien
gtcgaactgcctctctgcggaagga

SEQ ID NO: 133942 - DNA, 25 bp, Homo sapien
tggaagttgagcacgaaaccgccgc

SEQ ID NO: 133943 - DNA, 25 bp, Homo sapien
ttggcatcgctggaactaattctgc

SEQ ID NO: 133944 - DNA, 25 bp, Homo sapien
caaagctgatcgtggagttggcatc

SEQ ID NO: 133945 - DNA, 25 bp, Homo sapien
ctaattctgctcatggccgcgtcgc

SEQ ID NO: 133946 - DNA, 25 bp, Homo sapien
aagccgttgcgcttgtcgttcttcc

SEQ ID NO: 133947 - DNA, 25 bp, Homo sapien
tgcgcttgctcgagatggaagactt

SEQ ID NO: 133948 - DNA, 25 bp, Homo sapien
cttccaccgggcaaaaatcacaatc

SEQ ID NO: 133949 - DNA, 25 bp, Homo sapien
tcggacttgcgaagtttcatgcttc

SEQ ID NO: 133950 - DNA, 25 bp, Homo sapien
agcgacgctacgtgcatgcgcaagc

SEQ ID NO: 133951 - DNA, 25 bp, Homo sapien
cgcagcgggtagctgtgattcaaaa

SEQ ID NO: 133952 - DNA, 25 bp, Homo sapien
tgtgattcaaaacccgcgctagata

SEQ ID NO: 133953 - DNA, 25 bp, Homo sapien
aagctccgacctcggctctcaggta

SEQ ID NO: 133954 - DNA, 25 bp, Homo sapien
ggcgctcaccgatcgcgcagatctt

SEQ ID NO: 133955 - DNA, 25 bp, Homo sapien
tcgagtaccgggtggcaaagcagct

SEQ ID NO: 133956 - DNA, 25 bp, Homo sapien
cgcagatcttgcgatcgtctagcca

SEQ ID NO: 133957 - DNA, 25 bp, Homo sapien
tcgtctagccagacgccagtgtagg

SEQ ID NO: 133958 - DNA, 25 bp, Homo sapien
gccatcgtcgaagtcgaaccttccg

SEQ ID NO: 133959 - DNA, 25 bp, Homo sapien
agtgtggatacacggcccgctccaa

SEQ ID NO: 133960 - DNA, 25 bp, Homo sapien
tccaagaacggggtcagatccagcc

SEQ ID NO: 133961 - DNA, 25 bp, Homo sapien
gtcttgcagcccgttactccaggta

SEQ ID NO: 133962 - DNA, 25 bp, Homo sapien
actccaggtaccctcgtagcgagcg

SEQ ID NO: 133963 - DNA, 25 bp, Homo sapien
ggtgtagcctccgaccacctcgaag

SEQ ID NO: 133964 - DNA, 25 bp, Homo sapien
cccagtagccctggtaggtgttgcc

SEQ ID NO: 133965 - DNA, 25 bp, Homo sapien
cggccaggtacattcacgcctagct

SEQ ID NO: 133966 - DNA, 25 bp, Homo sapien
tcgatcggagatgatcctatgtggc

SEQ ID NO: 133967 - DNA, 25 bp, Homo sapien
ccgacgcggaggttaagctcattct

SEQ ID NO: 133968 - DNA, 25 bp, Homo sapien
agctcattctgtaccattggacgca

SEQ ID NO: 133969 - DNA, 25 bp, Homo sapien
ggacgcattcgttcagctctcaaaa

SEQ ID NO: 133970 - DNA, 25 bp, Homo sapien
tctgccgccggcgaaactacatttc

SEQ ID NO: 133971 - DNA, 25 bp, Homo sapien
cagggaagccggtccacctagaaat

SEQ ID NO: 133972 - DNA, 25 bp, Homo sapien
tcctatgtggctatggcccaggctc

SEQ ID NO: 133973 - DNA, 25 bp, Homo sapien
ctctcaaaaggtacaacaggccttg

SEQ ID NO: 133974 - DNA, 25 bp, Homo sapien
tgcagctactgctcagaaacgctgg

SEQ ID NO: 133975 - DNA, 25 bp, Homo sapien
ccctggcagactaacgaagcagctc

SEQ ID NO: 133976 - DNA, 25 bp, Homo sapien
caactgcaggtctaattttggacgc

SEQ ID NO: 133977 - DNA, 25 bp, Homo sapien
tggacgctttgcctgccatttcttc

SEQ ID NO: 133978 - DNA, 25 bp, Homo sapien
tttcttccaggttgagggagccgca

SEQ ID NO: 133979 - DNA, 25 bp, Homo sapien
ggaggctcgcgtattcctgcagtca

SEQ ID NO: 133980 - DNA, 25 bp, Homo sapien
tggcttcgctgcgttccggagaagc

SEQ ID NO: 133981 - DNA, 25 bp, Homo sapien
cgctggggccgcaataaatgctcgc

SEQ ID NO: 133982 - DNA, 25 bp, Homo sapien
cgactcgcccgcatagtggagattc

SEQ ID NO: 133983 - DNA, 25 bp, Homo sapien
aggcggagactgatccgctctagcc

SEQ ID NO: 133984 - DNA, 25 bp, Homo sapien
cccagcatatggtctaaaatctttg

SEQ ID NO: 133985 - DNA, 25 bp, Homo sapien
ccctgtcgccattgagcaaagctaa

SEQ ID NO: 133986 - DNA, 25 bp, Homo sapien
tcgataggactgtgagagtcaggcc

SEQ ID NO: 133987 - DNA, 25 bp, Homo sapien
cattgagtctgctggttactgttta

SEQ ID NO: 133988 - DNA, 25 bp, Homo sapien
cgctgctttcagttttcattgagtc

SEQ ID NO: 133989 - DNA, 25 bp, Homo sapien
tcccagcctgggaaaagtgcggcgc

SEQ ID NO: 133990 - DNA, 25 bp, Homo sapien
agtggcccaacgttccgtgagggcg

SEQ ID NO: 133991 - DNA, 25 bp, Homo sapien
cctctactcctttcactttgaaata

SEQ ID NO: 133992 - DNA, 25 bp, Homo sapien
cctgtaaagtgttgaagaggatcta

SEQ ID NO: 133993 - DNA, 25 bp, Homo sapien
agcggcagggaaacctctactcctt

SEQ ID NO: 133994 - DNA, 25 bp, Homo sapien
tctagggaaagttctcggagcggca

SEQ ID NO: 133995 - DNA, 25 bp, Homo sapien
cgcgcagagtttagggacagtggaa

SEQ ID NO: 133996 - DNA, 25 bp, Homo sapien
tggggttgccctgtaaagtgttgaa

SEQ ID NO: 133997 - DNA, 25 bp, Homo sapien
tgaagaggatctagggaaagttctc

SEQ ID NO: 133998 - DNA, 25 bp, Homo sapien
attccaagaggctggggtgaacgct

SEQ ID NO: 133999 - DNA, 25 bp, Homo sapien
tccgcactcatcctctgaaagtttg

SEQ ID NO: 134000 - DNA, 25 bp, Homo sapien
gggatgactggtcctccgcactcat

SEQ ID NO: 134001 - DNA, 25 bp, Homo sapien
gaagctgtcagctccgcaacggcgc

SEQ ID NO: 134002 - DNA, 25 bp, Homo sapien
gcaggcactaccgagggctgctctc

SEQ ID NO: 134003 - DNA, 25 bp, Homo sapien
cggctgcttgctccgaacggaacgc

SEQ ID NO: 134004 - DNA, 25 bp, Homo sapien
gtgtgcgttagaccagcggatagac

SEQ ID NO: 134005 - DNA, 25 bp, Homo sapien
cctctgaaagtttggacgttggtcg

SEQ ID NO: 134006 - DNA, 25 bp, Homo sapien
ggccggaagaactctgtctctgatt

SEQ ID NO: 134007 - DNA, 25 bp, Homo sapien
accttaggagtctgcgaaacgccca

SEQ ID NO: 134008 - DNA, 25 bp, Homo sapien
ctgattggcaggagagtcacgaacc

SEQ ID NO: 134009 - DNA, 25 bp, Homo sapien
ctctctagggcagacactgacctta

SEQ ID NO: 134010 - DNA, 25 bp, Homo sapien
tggatggccaaacaaccgcgaacgc

SEQ ID NO: 134011 - DNA, 25 bp, Homo sapien
gccgaatctggattaccaaggcttc

SEQ ID NO: 134012 - DNA, 25 bp, Homo sapien
gcttgtcttttcctagccgaatctg

SEQ ID NO: 134013 - DNA, 25 bp, Homo sapien
ataggctgtttatctctgcaggctc

SEQ ID NO: 134014 - DNA, 25 bp, Homo sapien
ccggcgcgagctgaccgagcactcg

SEQ ID NO: 134015 - DNA, 25 bp, Homo sapien
cagcgatcgtcgagcgccgtttcca

SEQ ID NO: 134016 - DNA, 25 bp, Homo sapien
tccccccgtggctggcgcggaatgt

SEQ ID NO: 134017 - DNA, 25 bp, Homo sapien
ggatgacttcatgcagccggagctc

SEQ ID NO: 134018 - DNA, 25 bp, Homo sapien
acctgcgctgactaggtccggggaa

SEQ ID NO: 134019 - DNA, 25 bp, Homo sapien
atgacttcatgcagccggagctccg

SEQ ID NO: 134020 - DNA, 25 bp, Homo sapien
tggccgcactgcgtggagctttccg

SEQ ID NO: 134021 - DNA, 25 bp, Homo sapien
cgcggaatgtggtgatccgtcccgg

SEQ ID NO: 134022 - DNA, 25 bp, Homo sapien
tgtatgttttaagtggcaaagccga

SEQ ID NO: 134023 - DNA, 25 bp, Homo sapien
cggaaatgtgcgttgtatgttttaa

SEQ ID NO: 134024 - DNA, 25 bp, Homo sapien
tggcaaagccgagcagaaagcaccg

SEQ ID NO: 134025 - DNA, 25 bp, Homo sapien
gccgagcagaaagcaccgtgaaagc

SEQ ID NO: 134026 - DNA, 25 bp, Homo sapien
ccgtgaaagcggtgacactgcatgc

SEQ ID NO: 134027 - DNA, 25 bp, Homo sapien
gtgacactgcatgcccgtgacagtg

SEQ ID NO: 134028 - DNA, 25 bp, Homo sapien
catgcccgtgacagtggtggcaccc

SEQ ID NO: 134029 - DNA, 25 bp, Homo sapien
tggaaagtcacggaaatgtgcgttg

SEQ ID NO: 134030 - DNA, 25 bp, Homo sapien
cccgcagttgcggaaccaatgggag

SEQ ID NO: 134031 - DNA, 25 bp, Homo sapien
ttgcaacctgaagcggctcccggct

SEQ ID NO: 134032 - DNA, 25 bp, Homo sapien
accaatgggagctcggaatgttagc

SEQ ID NO: 134033 - DNA, 25 bp, Homo sapien
ctggacaccagtagcaggaaggcga

SEQ ID NO: 134034 - DNA, 25 bp, Homo sapien
gtggagctaacgctaccaggctgcc

SEQ ID NO: 134035 - DNA, 25 bp, Homo sapien
tcagacggtcttcaactgggctttc

SEQ ID NO: 134036 - DNA, 25 bp, Homo sapien
ccgttgcatcgcagattgcaacctg

SEQ ID NO: 134037 - DNA, 25 bp, Homo sapien
ctgctgaaggagtctcgctgagctc

SEQ ID NO: 134038 - DNA, 25 bp, Homo sapien
tctggaaaatatagacgagttcgtc

SEQ ID NO: 134039 - DNA, 25 bp, Homo sapien
ttcgtcacggaccaaaacaagatcg

SEQ ID NO: 134040 - DNA, 25 bp, Homo sapien
tcgtgagcagctactactggggaac

SEQ ID NO: 134041 - DNA, 25 bp, Homo sapien
agccttgaccctctgtctgcttgtg

SEQ ID NO: 134042 - DNA, 25 bp, Homo sapien
tgactagtttgacccttcgagggcc

SEQ ID NO: 134043 - DNA, 25 bp, Homo sapien
cgtcgggaaggtcctccagcacaca

SEQ ID NO: 134044 - DNA, 25 bp, Homo sapien
tgcgccgtctccctgactagtttga

SEQ ID NO: 134045 - DNA, 25 bp, Homo sapien
cgcaccatggcggaccagctttatc

SEQ ID NO: 134046 - DNA, 25 bp, Homo sapien
tccaaagtgcaaggccgggctattc

SEQ ID NO: 134047 - DNA, 25 bp, Homo sapien
tgatctctgcagctggttcctctta

SEQ ID NO: 134048 - DNA, 25 bp, Homo sapien
gactgcagtttcatccatcccaagg

SEQ ID NO: 134049 - DNA, 25 bp, Homo sapien
agccagtgctctccgcaggtccaaa

SEQ ID NO: 134050 - DNA, 25 bp, Homo sapien
ctgcagcgttccctctcaggacaga

SEQ ID NO: 134051 - DNA, 25 bp, Homo sapien
agcttcgctttcacttctctaggga

SEQ ID NO: 134052 - DNA, 25 bp, Homo sapien
ggctctgcgctttgccttttccata

SEQ ID NO: 134053 - DNA, 25 bp, Homo sapien
gggctattcccggacttgcctagga

SEQ ID NO: 134054 - DNA, 25 bp, Homo sapien
ttgcgggaaaagcttctagaaccta

SEQ ID NO: 134055 - DNA, 25 bp, Homo sapien
ccgttttgtgggtcagacagtgcca

SEQ ID NO: 134056 - DNA, 25 bp, Homo sapien
tcagggccttcatccgcaattggtc

SEQ ID NO: 134057 - DNA, 25 bp, Homo sapien
aattggtcttgtgccttgagtgccc

SEQ ID NO: 134058 - DNA, 25 bp, Homo sapien
cgaaaggactccatctgcgcggctc

SEQ ID NO: 134059 - DNA, 25 bp, Homo sapien
ttgagctgtatgcagtcctggaacc

SEQ ID NO: 134060 - DNA, 25 bp, Homo sapien
cgcggcttccaagagagacctgacc

SEQ ID NO: 134061 - DNA, 25 bp, Homo sapien
ctctgcagaaaagctggctcgagcc

SEQ ID NO: 134062 - DNA, 25 bp, Homo sapien
ctagtccttcaatgatgctcagata

SEQ ID NO: 134063 - DNA, 25 bp, Homo sapien
gtgaccacagggagcaccggtccga

SEQ ID NO: 134064 - DNA, 25 bp, Homo sapien
atgctcagataacgcgcaacttctg

SEQ ID NO: 134065 - DNA, 25 bp, Homo sapien
tccgatagtccatagcaagggcgtg

SEQ ID NO: 134066 - DNA, 25 bp, Homo sapien
cccagggaatgtgtccgaggcccgc

SEQ ID NO: 134067 - DNA, 25 bp, Homo sapien
cgggtcagaggcatctagtccttca

SEQ ID NO: 134068 - DNA, 25 bp, Homo sapien
tagttgttgagatgcgaaaccagtc

SEQ ID NO: 134069 - DNA, 25 bp, Homo sapien
ccagtcgaactcgaagcgggtcaga

SEQ ID NO: 134070 - DNA, 25 bp, Homo sapien
gtgaacctgtaatcggagcctgggc

SEQ ID NO: 134071 - DNA, 25 bp, Homo sapien
aatccggtttctcgcgccgctgatt

SEQ ID NO: 134072 - DNA, 25 bp, Homo sapien
gatggtctcgtccagctcgctgtcc

SEQ ID NO: 134073 - DNA, 25 bp, Homo sapien
tgtactcggggtgagctcgcttcat

SEQ ID NO: 134074 - DNA, 25 bp, Homo sapien
agctcgcttcatgctggctccctgg

SEQ ID NO: 134075 - DNA, 25 bp, Homo sapien
ggagttaactacagcggcgcctctc

SEQ ID NO: 134076 - DNA, 25 bp, Homo sapien
tgcctctggttaaaactcaaccatc

SEQ ID NO: 134077 - DNA, 25 bp, Homo sapien
cgctcacgctttgcctctggttaaa

SEQ ID NO: 134078 - DNA, 25 bp, Homo sapien
ggccagcgctgagattccctcaaca

SEQ ID NO: 134079 - DNA, 25 bp, Homo sapien
ggttcccacgctcctattgttggcg

SEQ ID NO: 134080 - DNA, 25 bp, Homo sapien
gtaactgacctctcgcgtgacctgg

SEQ ID NO: 134081 - DNA, 25 bp, Homo sapien
gctctctcccaacaaagggtaactg

SEQ ID NO: 134082 - DNA, 25 bp, Homo sapien
ggaggatatttgatgaccgtctttc

SEQ ID NO: 134083 - DNA, 25 bp, Homo sapien
gcagagtcccaagtccctacggtgg

SEQ ID NO: 134084 - DNA, 25 bp, Homo sapien
cagggtccctctctctcgtatatac

SEQ ID NO: 134085 - DNA, 25 bp, Homo sapien
accagctagttagggtgatcccagg

SEQ ID NO: 134086 - DNA, 25 bp, Homo sapien
gtcgataaatgaaacgtcagctccc

SEQ ID NO: 134087 - DNA, 25 bp, Homo sapien
cttggtggcggctggtttttcacac

SEQ ID NO: 134088 - DNA, 25 bp, Homo sapien
ggtttttcacacaggaatcctcctc

SEQ ID NO: 134089 - DNA, 25 bp, Homo sapien
aagaccagcgccctttggcggctag

SEQ ID NO: 134090 - DNA, 25 bp, Homo sapien
tcgctcagtcgataaatgaaacgtc

SEQ ID NO: 134091 - DNA, 25 bp, Homo sapien
gcggctggtttttcacacaggaatc

SEQ ID NO: 134092 - DNA, 25 bp, Homo sapien
gcctttttcagagtcgctcagtcga

SEQ ID NO: 134093 - DNA, 25 bp, Homo sapien
gcacaggggcctttttcagagtcgc

SEQ ID NO: 134094 - DNA, 25 bp, Homo sapien
caccgcgtcgttggcgtaattcccg

SEQ ID NO: 134095 - DNA, 25 bp, Homo sapien
cgtgtcttcctttcatctgggagtg

SEQ ID NO: 134096 - DNA, 25 bp, Homo sapien
acacagcgccgccatgacttcttta

SEQ ID NO: 134097 - DNA, 25 bp, Homo sapien
cactcgcagaaaatggctctcggca

SEQ ID NO: 134098 - DNA, 25 bp, Homo sapien
aggctccttggcattggaactacca

SEQ ID NO: 134099 - DNA, 25 bp, Homo sapien
atttcgccttcctgggcatccgttg

SEQ ID NO: 134100 - DNA, 25 bp, Homo sapien
agtgcgtttaacttgcaggaatttc

SEQ ID NO: 134101 - DNA, 25 bp, Homo sapien
tgtaaattctgctaacgcgacgctc

SEQ ID NO: 134102 - DNA, 25 bp, Homo sapien
tggggcgtcacccaaccacctgacc

SEQ ID NO: 134103 - DNA, 25 bp, Homo sapien
cctggagcgctttcctggggcgtca

SEQ ID NO: 134104 - DNA, 25 bp, Homo sapien
gagatgcaacttgcggcgccggccc

SEQ ID NO: 134105 - DNA, 25 bp, Homo sapien
atccggatccgggagatgcaacttg

SEQ ID NO: 134106 - DNA, 25 bp, Homo sapien
cccaggatgccagatccggatccgg

SEQ ID NO: 134107 - DNA, 25 bp, Homo sapien
acactcacacatgcagtcccatctg

SEQ ID NO: 134108 - DNA, 25 bp, Homo sapien
tttccacccaaagcgcatcacggcc

SEQ ID NO: 134109 - DNA, 25 bp, Homo sapien
cgtgctcccttcacgcggctttcca

SEQ ID NO: 134110 - DNA, 25 bp, Homo sapien
ggtccggaagtgttaggagcctcgc

SEQ ID NO: 134111 - DNA, 25 bp, Homo sapien
acggtccaccggaagatgcagctgg

SEQ ID NO: 134112 - DNA, 25 bp, Homo sapien
gcctcgcacggtccaccggaagatg

SEQ ID NO: 134113 - DNA, 25 bp, Homo sapien
atgcctcgcacggtccaccggaaga

SEQ ID NO: 134114 - DNA, 25 bp, Homo sapien
aaacacctggaggtggtctaggacg

SEQ ID NO: 134115 - DNA, 25 bp, Homo sapien
tgccgtcaaacacctggaggtggtc

SEQ ID NO: 134116 - DNA, 25 bp, Homo sapien
ctttcttgtcgtagagcggtgagat

SEQ ID NO: 134117 - DNA, 25 bp, Homo sapien
tccgctttcttgtcgtagagcggtg

SEQ ID NO: 134118 - DNA, 25 bp, Homo sapien
cgccggtgtttcagcaaagaatcca

SEQ ID NO: 134119 - DNA, 25 bp, Homo sapien
cgtcctgagttcgtggacgagtcca

SEQ ID NO: 134120 - DNA, 25 bp, Homo sapien
gcacacctcagcatcgccggtgttt

SEQ ID NO: 134121 - DNA, 25 bp, Homo sapien
ataagggttagcgactcctgctgct

SEQ ID NO: 134122 - DNA, 25 bp, Homo sapien
gaacaggaccatcgcgagccacttt

SEQ ID NO: 134123 - DNA, 25 bp, Homo sapien
tgaggaaatccaccgaagccctttg

SEQ ID NO: 134124 - DNA, 25 bp, Homo sapien
ccttggtgcaggtgcataagggtta

SEQ ID NO: 134125 - DNA, 25 bp, Homo sapien
tggacgagtccacgggtcctgccag

SEQ ID NO: 134126 - DNA, 25 bp, Homo sapien
attttaattagcgtctgggtctgcg

SEQ ID NO: 134127 - DNA, 25 bp, Homo sapien
tctgcgccgggagatgggaatcaaa

SEQ ID NO: 134128 - DNA, 25 bp, Homo sapien
cgctttacaagcgaaaacaaacacg

SEQ ID NO: 134129 - DNA, 25 bp, Homo sapien
gcgaaaacaaacacggccacaagca

SEQ ID NO: 134130 - DNA, 25 bp, Homo sapien
ccgcccggtcaaagccggctttgtg

SEQ ID NO: 134131 - DNA, 25 bp, Homo sapien
ggcccaggcgattttaattagcgtc

SEQ ID NO: 134132 - DNA, 25 bp, Homo sapien
cgcggccgcgctttacaagcgaaaa

SEQ ID NO: 134133 - DNA, 25 bp, Homo sapien
cgcggcccaggcgattttaattagc

SEQ ID NO: 134134 - DNA, 25 bp, Homo sapien
gaaccgtcggactctggccttccga

SEQ ID NO: 134135 - DNA, 25 bp, Homo sapien
gccgagcagtttagcgtgcctctca

SEQ ID NO: 134136 - DNA, 25 bp, Homo sapien
gcactccgctgctcaacttcgaagg

SEQ ID NO: 134137 - DNA, 25 bp, Homo sapien
cgcgcgccatgtcgttcagtgaaat

SEQ ID NO: 134138 - DNA, 25 bp, Homo sapien
tcagtgaaatgaaccgcaggacgct

SEQ ID NO: 134139 - DNA, 25 bp, Homo sapien
ccctgctagcggaaaggaaccgtcg

SEQ ID NO: 134140 - DNA, 25 bp, Homo sapien
gggtctcggcaacaatggcagtagc

SEQ ID NO: 134141 - DNA, 25 bp, Homo sapien
ggcggctccacgaacaataacgctg

SEQ ID NO: 134142 - DNA, 25 bp, Homo sapien
atgggaaggcgggtgccgcttccga

SEQ ID NO: 134143 - DNA, 25 bp, Homo sapien
tctcgccaagggagagagccctaga

SEQ ID NO: 134144 - DNA, 25 bp, Homo sapien
ccgagggctcctctcgccaagggag

SEQ ID NO: 134145 - DNA, 25 bp, Homo sapien
tcctctcgccaagggagagagccct

SEQ ID NO: 134146 - DNA, 25 bp, Homo sapien
tcgccaagggagagagccctagacc

SEQ ID NO: 134147 - DNA, 25 bp, Homo sapien
cgccaagggagagagccctagaccc

SEQ ID NO: 134148 - DNA, 25 bp, Homo sapien
ccaagggagagagccctagacccgt

SEQ ID NO: 134149 - DNA, 25 bp, Homo sapien
cgagggctcctctcgccaagggaga

SEQ ID NO: 134150 - DNA, 25 bp, Homo sapien
gtgacagctgcgctctaccgcgcta

SEQ ID NO: 134151 - DNA, 25 bp, Homo sapien
taagaccaccgcgaatctgctcgcc

SEQ ID NO: 134152 - DNA, 25 bp, Homo sapien
agctgcgctctaccgcgctaccttc

SEQ ID NO: 134153 - DNA, 25 bp, Homo sapien
gccggggtgacagctgcgctctacc

SEQ ID NO: 134154 - DNA, 25 bp, Homo sapien
ccgaggcttaagaccaccgcgaatc

SEQ ID NO: 134155 - DNA, 25 bp, Homo sapien
ggcttaagaccaccgcgaatctgct

SEQ ID NO: 134156 - DNA, 25 bp, Homo sapien
gaggcttaagaccaccgcgaatctg

SEQ ID NO: 134157 - DNA, 25 bp, Homo sapien
gccccatcccggaggtgtcactggg

SEQ ID NO: 134158 - DNA, 25 bp, Homo sapien
cccgacacggcctttgaggaaagcg

SEQ ID NO: 134159 - DNA, 25 bp, Homo sapien
cgccgctgaccgtcctcggccaggc

SEQ ID NO: 134160 - DNA, 25 bp, Homo sapien
gcaaatcaacagttcctcgcgctgc

SEQ ID NO: 134161 - DNA, 25 bp, Homo sapien
ggcgcaggcaaatcaacagttcctc

SEQ ID NO: 134162 - DNA, 25 bp, Homo sapien
ggcccaaggcgcaggcaaatcaaca

SEQ ID NO: 134163 - DNA, 25 bp, Homo sapien
caacaaacccgacacggcctttgag

SEQ ID NO: 134164 - DNA, 25 bp, Homo sapien
cctccgtggtcccatcacccaagtt

SEQ ID NO: 134165 - DNA, 25 bp, Homo sapien
caaggcgcaggcaaatcaacagttc

SEQ ID NO: 134166 - DNA, 25 bp, Homo sapien
gcgcctgcatgcctgagcgcggggt

SEQ ID NO: 134167 - DNA, 25 bp, Homo sapien
ccggagagtttgtcacctcctcttc

SEQ ID NO: 134168 - DNA, 25 bp, Homo sapien
cgcttggctagacgccgcgcctgca

SEQ ID NO: 134169 - DNA, 25 bp, Homo sapien
ttggctagacgccgcgcctgcatgc

SEQ ID NO: 134170 - DNA, 25 bp, Homo sapien
gggccggagagtttgtcacctcctc

SEQ ID NO: 134171 - DNA, 25 bp, Homo sapien
ggccggagagtttgtcacctcctct

SEQ ID NO: 134172 - DNA, 25 bp, Homo sapien
gccggagagtttgtcacctcctctt

SEQ ID NO: 134173 - DNA, 25 bp, Homo sapien
gcttggctagacgccgcgcctgcat

SEQ ID NO: 134174 - DNA, 25 bp, Homo sapien
gttccataacaaaaacaagcgcctg

SEQ ID NO: 134175 - DNA, 25 bp, Homo sapien
ttcacttttctgcaagggcgcacgc

SEQ ID NO: 134176 - DNA, 25 bp, Homo sapien
gctcggggttacaatgcggattcct

SEQ ID NO: 134177 - DNA, 25 bp, Homo sapien
tgcaacgagattttggcgccacagc

SEQ ID NO: 134178 - DNA, 25 bp, Homo sapien
tccggagctgtcagttactcgaaca

SEQ ID NO: 134179 - DNA, 25 bp, Homo sapien
cggctgctattggaggagcccatcc

SEQ ID NO: 134180 - DNA, 25 bp, Homo sapien
gcagccggctgcctgtaaacacgcg

SEQ ID NO: 134181 - DNA, 25 bp, Homo sapien
cgagcgaactccacgtcctggtttt

SEQ ID NO: 134182 - DNA, 25 bp, Homo sapien
tgcaccagtcgccttggctcagctg

SEQ ID NO: 134183 - DNA, 25 bp, Homo sapien
cgagtgcgcatgatcctggccgcag

SEQ ID NO: 134184 - DNA, 25 bp, Homo sapien
ggagaaaaaccgatgcgctgccgca

SEQ ID NO: 134185 - DNA, 25 bp, Homo sapien
aatcacggctcaattagggacctgc

SEQ ID NO: 134186 - DNA, 25 bp, Homo sapien
tctctggctccaagggaatcacggc

SEQ ID NO: 134187 - DNA, 25 bp, Homo sapien
gccagggcacacgactcagcgaggc

SEQ ID NO: 134188 - DNA, 25 bp, Homo sapien
gaggcagcctctgcaaactccggcg

SEQ ID NO: 134189 - DNA, 25 bp, Homo sapien
cccagtcggctggtcacatcgcggg

SEQ ID NO: 134190 - DNA, 25 bp, Homo sapien
gtggtccacctacctctgcttcttt

SEQ ID NO: 134191 - DNA, 25 bp, Homo sapien
ccgttttcttcatggggacgcggtg

SEQ ID NO: 134192 - DNA, 25 bp, Homo sapien
ttccgcattgcttcctgtcctttag

SEQ ID NO: 134193 - DNA, 25 bp, Homo sapien
cagtttcccgcagaaatcctgtgga

SEQ ID NO: 134194 - DNA, 25 bp, Homo sapien
cgcaagattccggaggtggtccacc

SEQ ID NO: 134195 - DNA, 25 bp, Homo sapien
aggagctggttagcacctcccgacc

SEQ ID NO: 134196 - DNA, 25 bp, Homo sapien
ggcgctacagcttcagcttgcattc

SEQ ID NO: 134197 - DNA, 25 bp, Homo sapien
ctgtcgcatcttttgttccctgtgg

SEQ ID NO: 134198 - DNA, 25 bp, Homo sapien
ggctacgtctgaatcaaataatatg

SEQ ID NO: 134199 - DNA, 25 bp, Homo sapien
gactctcggcgaagaccgtctccgc

SEQ ID NO: 134200 - DNA, 25 bp, Homo sapien
cccagcttaaaaagaacaggttatg

SEQ ID NO: 134201 - DNA, 25 bp, Homo sapien
gcaatattttggctacgtctgaatc

SEQ ID NO: 134202 - DNA, 25 bp, Homo sapien
aacaggttatgcctcactaggaata

SEQ ID NO: 134203 - DNA, 25 bp, Homo sapien
atgcctcactaggaataactccata

SEQ ID NO: 134204 - DNA, 25 bp, Homo sapien
atttctgttctagcaatattttggc

SEQ ID NO: 134205 - DNA, 25 bp, Homo sapien
aagaacaggttatgcctcactagga

SEQ ID NO: 134206 - DNA, 25 bp, Homo sapien
tgcgccatctcttacggtgactacc

SEQ ID NO: 134207 - DNA, 25 bp, Homo sapien
tggtgctatccagcctcagtgcttt

SEQ ID NO: 134208 - DNA, 25 bp, Homo sapien
ggcctcacctcgagttgtcctgcta

SEQ ID NO: 134209 - DNA, 25 bp, Homo sapien
cagggcagctccagataacgtggca

SEQ ID NO: 134210 - DNA, 25 bp, Homo sapien
acatcgggagtgttcctggtcaccc

SEQ ID NO: 134211 - DNA, 25 bp, Homo sapien
aagtgatctctctgccatctgtcgg

SEQ ID NO: 134212 - DNA, 25 bp, Homo sapien
tcgccgcttcttaagcccatcaatg

SEQ ID NO: 134213 - DNA, 25 bp, Homo sapien
tgggatgcgccaagtttctctaagc

SEQ ID NO: 134214 - DNA, 25 bp, Homo sapien
gtctgtctcccttcgcaggtgagga

SEQ ID NO: 134215 - DNA, 25 bp, Homo sapien
ggagttctataactggtcctgccca

SEQ ID NO: 134216 - DNA, 25 bp, Homo sapien
tttgatcctcccagacaggtcagtg

SEQ ID NO: 134217 - DNA, 25 bp, Homo sapien
agggtctgccgagccctccacattt

SEQ ID NO: 134218 - DNA, 25 bp, Homo sapien
cactgagctgtacgttggagttcta

SEQ ID NO: 134219 - DNA, 25 bp, Homo sapien
cagtgaggtccgtggaagccacttc

SEQ ID NO: 134220 - DNA, 25 bp, Homo sapien
acggcacatacggagacacctgtta

SEQ ID NO: 134221 - DNA, 25 bp, Homo sapien
ttcatggccacgtgcaagtacaaca

SEQ ID NO: 134222 - DNA, 25 bp, Homo sapien
gcccatggcatgcttgcggctgtct

SEQ ID NO: 134223 - DNA, 25 bp, Homo sapien
cacgcccatggcatgcttgcggctg

SEQ ID NO: 134224 - DNA, 25 bp, Homo sapien
catggcatgcttgcggctgtctctc

SEQ ID NO: 134225 - DNA, 25 bp, Homo sapien
cgtggcatgcttgcggctgtctctc

SEQ ID NO: 134226 - DNA, 25 bp, Homo sapien
tcgccggtcccacgtccgtggcaca

SEQ ID NO: 134227 - DNA, 25 bp, Homo sapien
gaggacagaggcacctgtaagccct

SEQ ID NO: 134228 - DNA, 25 bp, Homo sapien
ggacagaggcacctgtaagccctcc

SEQ ID NO: 134229 - DNA, 25 bp, Homo sapien
cacgcccgtggcatgcttgcggctg

SEQ ID NO: 134230 - DNA, 25 bp, Homo sapien
accgcactcgtctcttccggaggta

SEQ ID NO: 134231 - DNA, 25 bp, Homo sapien
cgctactccaatgccggaactgttc

SEQ ID NO: 134232 - DNA, 25 bp, Homo sapien
aggggctactcgcaacaggaagttc

SEQ ID NO: 134233 - DNA, 25 bp, Homo sapien
ccggctagctctgtgaacggtgtta

SEQ ID NO: 134234 - DNA, 25 bp, Homo sapien
tctcaccttgagtcggaggacgtcc

SEQ ID NO: 134235 - DNA, 25 bp, Homo sapien
gtgcggtgaggaaaataacggtctc

SEQ ID NO: 134236 - DNA, 25 bp, Homo sapien
gcagctccggataacgcagcaggca

SEQ ID NO: 134237 - DNA, 25 bp, Homo sapien
gaactgttcccggtcgcccagggca

SEQ ID NO: 134238 - DNA, 25 bp, Homo sapien
caggaattgcatggcttccttccaa

SEQ ID NO: 134239 - DNA, 25 bp, Homo sapien
attgcatggcttccttccaaggaga

SEQ ID NO: 134240 - DNA, 25 bp, Homo sapien
cttccaaggagaccacacgtcattt

SEQ ID NO: 134241 - DNA, 25 bp, Homo sapien
ggagaccacacgtcatttcaaaagc

SEQ ID NO: 134242 - DNA, 25 bp, Homo sapien
gtcatttcaaaagctcacggccaaa

SEQ ID NO: 134243 - DNA, 25 bp, Homo sapien
gaattgcatggcttccttccaagga

SEQ ID NO: 134244 - DNA, 25 bp, Homo sapien
ttccaaggagaccacacgtcatttc

SEQ ID NO: 134245 - DNA, 25 bp, Homo sapien
cacgtcatttcaaaagctcacggcc

SEQ ID NO: 134246 - DNA, 25 bp, Homo sapien
actgctcggacacggcacactcgaa

SEQ ID NO: 134247 - DNA, 25 bp, Homo sapien
aaccagctgtgcgatttgtcctagg

SEQ ID NO: 134248 - DNA, 25 bp, Homo sapien
ggcaatgctccacctggcagtgctg

SEQ ID NO: 134249 - DNA, 25 bp, Homo sapien
ggatcacctcgctgccggcaatgct

SEQ ID NO: 134250 - DNA, 25 bp, Homo sapien
cccgcgctcagcagagtaagtgtga

SEQ ID NO: 134251 - DNA, 25 bp, Homo sapien
ctgcaaggtacgttttcaggaattg

SEQ ID NO: 134252 - DNA, 25 bp, Homo sapien
gtaagtgtgagccacgcgatccagc

SEQ ID NO: 134253 - DNA, 25 bp, Homo sapien
ctgcctcaggaattgcatggcttcc

SEQ ID NO: 134254 - DNA, 25 bp, Homo sapien
cagccgacgtcccagcggtggcctc

SEQ ID NO: 134255 - DNA, 25 bp, Homo sapien
gggccgaactggcagccaggaaatg

SEQ ID NO: 134256 - DNA, 25 bp, Homo sapien
gaaatgccctggagtgtgtgtcacc

SEQ ID NO: 134257 - DNA, 25 bp, Homo sapien
agtgtgtgtcacctgtccaggacga

SEQ ID NO: 134258 - DNA, 25 bp, Homo sapien
cctgtccaggacgacttgttgattc

SEQ ID NO: 134259 - DNA, 25 bp, Homo sapien
caggacgacttgttgattcccagga

SEQ ID NO: 134260 - DNA, 25 bp, Homo sapien
gagaggactgccttgctcacctgtc

SEQ ID NO: 134261 - DNA, 25 bp, Homo sapien
acgacttgttgattcccaggagggc

SEQ ID NO: 134262 - DNA, 25 bp, Homo sapien
gcgaccgcctgtcctgaggtaatga

SEQ ID NO: 134263 - DNA, 25 bp, Homo sapien
gtcacgggtcttccgcactgcaggc

SEQ ID NO: 134264 - DNA, 25 bp, Homo sapien
ttgccgcccgccagacatcaaggtt

SEQ ID NO: 134265 - DNA, 25 bp, Homo sapien
atcaaggttgcaggtgtcacccgta

SEQ ID NO: 134266 - DNA, 25 bp, Homo sapien
tcagcagcgagaagcctcacgtgac

SEQ ID NO: 134267 - DNA, 25 bp, Homo sapien
ggactctccttaaccgcagcttttc

SEQ ID NO: 134268 - DNA, 25 bp, Homo sapien
tcctgaggtaatgacccagtcttta

SEQ ID NO: 134269 - DNA, 25 bp, Homo sapien
tcggcgatcccgaacgagcgcgctt

SEQ ID NO: 134270 - DNA, 25 bp, Homo sapien
gctcctcctcttcgcaatgagtaaa

SEQ ID NO: 134271 - DNA, 25 bp, Homo sapien
atctccgggcagtgtccgagcccga

SEQ ID NO: 134272 - DNA, 25 bp, Homo sapien
accaaagtccgttccctgcttcagg

SEQ ID NO: 134273 - DNA, 25 bp, Homo sapien
ccctgcttcaggatcgttttctaga

SEQ ID NO: 134274 - DNA, 25 bp, Homo sapien
tctagatgtgcgcaaaatacagtcc

SEQ ID NO: 134275 - DNA, 25 bp, Homo sapien
cctgtaagttctccgagggccactt

SEQ ID NO: 134276 - DNA, 25 bp, Homo sapien
cagagaccgcatattccggaggggc

SEQ ID NO: 134277 - DNA, 25 bp, Homo sapien
tggagacatttccagagccttgagg

SEQ ID NO: 134278 - DNA, 25 bp, Homo sapien
ctgcggggatgtatgcttcatggac

SEQ ID NO: 134279 - DNA, 25 bp, Homo sapien
cgcaccgcagatgctgtaaaaacga

SEQ ID NO: 134280 - DNA, 25 bp, Homo sapien
ttgaatgagccgtggatgccttccc

SEQ ID NO: 134281 - DNA, 25 bp, Homo sapien
cataagtgaacgcagtctggctttc

SEQ ID NO: 134282 - DNA, 25 bp, Homo sapien
gcggcactgctttaccaagaccata

SEQ ID NO: 134283 - DNA, 25 bp, Homo sapien
ttccgggaggcttgtcccaagctca

SEQ ID NO: 134284 - DNA, 25 bp, Homo sapien
ggattccagttttgcgtcaccgtca

SEQ ID NO: 134285 - DNA, 25 bp, Homo sapien
gcccacagttgggacgaggattcca

SEQ ID NO: 134286 - DNA, 25 bp, Homo sapien
gccacgctgggctctcgacaaagag

SEQ ID NO: 134287 - DNA, 25 bp, Homo sapien
aaccgagtgtctgttgctctgcgtc

SEQ ID NO: 134288 - DNA, 25 bp, Homo sapien
ctggggctgctcactaccaagttcg

SEQ ID NO: 134289 - DNA, 25 bp, Homo sapien
gcggcgtcacttcctgccatttaaa

SEQ ID NO: 134290 - DNA, 25 bp, Homo sapien
gcaccgagcggacgcgtaaccaatg

SEQ ID NO: 134291 - DNA, 25 bp, Homo sapien
ctaccaagttcgtgtcgctgctgca

SEQ ID NO: 134292 - DNA, 25 bp, Homo sapien
ttctggatctcaaagcggtgagctc

SEQ ID NO: 134293 - DNA, 25 bp, Homo sapien
gcacacctgttgtttgcagcagcca

SEQ ID NO: 134294 - DNA, 25 bp, Homo sapien
gtcccgcccatagagtgagttccca

SEQ ID NO: 134295 - DNA, 25 bp, Homo sapien
caccatctggcacgtacggcgtcta

SEQ ID NO: 134296 - DNA, 25 bp, Homo sapien
cccgaggtgcttctgagactgcaca

SEQ ID NO: 134297 - DNA, 25 bp, Homo sapien
cgtgggtacttgtgcagaaacttcc

SEQ ID NO: 134298 - DNA, 25 bp, Homo sapien
ttccgcggtgttgcagacttatcct

SEQ ID NO: 134299 - DNA, 25 bp, Homo sapien
ttagcatcccttgtcttccgcggtg

SEQ ID NO: 134300 - DNA, 25 bp, Homo sapien
tcggaagtccagtctcattagcatc

SEQ ID NO: 134301 - DNA, 25 bp, Homo sapien
cgccagccctccagaaaacttaatt

SEQ ID NO: 134302 - DNA, 25 bp, Homo sapien
gctgctcagtcacatctttctcttc

SEQ ID NO: 134303 - DNA, 25 bp, Homo sapien
acggtgagcgccttttcctgatcca

SEQ ID NO: 134304 - DNA, 25 bp, Homo sapien
cgagcacaacggtgagcgccttttc

SEQ ID NO: 134305 - DNA, 25 bp, Homo sapien
cgagggaccatgtcgaggctcagct

SEQ ID NO: 134306 - DNA, 25 bp, Homo sapien
ggtcccgccctagcaggctccttcc

SEQ ID NO: 134307 - DNA, 25 bp, Homo sapien
ggaccgggttcacggtctcgcactc

SEQ ID NO: 134308 - DNA, 25 bp, Homo sapien
cagctggggataccgcgagcacaac

SEQ ID NO: 134309 - DNA, 25 bp, Homo sapien
tctttctcgctgctcagtcacatct

SEQ ID NO: 134310 - DNA, 25 bp, Homo sapien
cgctcgggcgcatttgtactttgcc

SEQ ID NO: 134311 - DNA, 25 bp, Homo sapien
tgtgctcgccaagggcttcaggcgc

SEQ ID NO: 134312 - DNA, 25 bp, Homo sapien
catttgtactttgccgcgggaagca

SEQ ID NO: 134313 - DNA, 25 bp, Homo sapien
cggtggattggccacccgagaaaca

SEQ ID NO: 134314 - DNA, 25 bp, Homo sapien
attggccacccgagaaacaggccca

SEQ ID NO: 134315 - DNA, 25 bp, Homo sapien
ctcctctcttgtgcgggtctccggg

SEQ ID NO: 134316 - DNA, 25 bp, Homo sapien
cccgcgacgccaagaatgcaggagg

SEQ ID NO: 134317 - DNA, 25 bp, Homo sapien
ggagacctcaggtggaactttcagg

SEQ ID NO: 134318 - DNA, 25 bp, Homo sapien
ctgcatttctgcacgtcggcgccgg

SEQ ID NO: 134319 - DNA, 25 bp, Homo sapien
ccagtcacaacggtgagtgcaggca

SEQ ID NO: 134320 - DNA, 25 bp, Homo sapien
ccctcgctgacctaataaggccatg

SEQ ID NO: 134321 - DNA, 25 bp, Homo sapien
aattcattggcttcctctacccggc

SEQ ID NO: 134322 - DNA, 25 bp, Homo sapien
acagctgtcccgctcttggaattca

SEQ ID NO: 134323 - DNA, 25 bp, Homo sapien
ccaggagccacgactcccgggagag

SEQ ID NO: 134324 - DNA, 25 bp, Homo sapien
tcggcgccggttagaaaccctgcag

SEQ ID NO: 134325 - DNA, 25 bp, Homo sapien
aaccctgcagttttgagagagaaga

SEQ ID NO: 134326 - DNA, 25 bp, Homo sapien
agacgcagagccctgtgccgcttgc

SEQ ID NO: 134327 - DNA, 25 bp, Homo sapien
acagagagccgtgtcggccgagacc

SEQ ID NO: 134328 - DNA, 25 bp, Homo sapien
agtgactgcgcagcaagactctgtg

SEQ ID NO: 134329 - DNA, 25 bp, Homo sapien
tgctgccgtttgcttgagtgactgc

SEQ ID NO: 134330 - DNA, 25 bp, Homo sapien
tctcatttgctttggccgttggagc

SEQ ID NO: 134331 - DNA, 25 bp, Homo sapien
gggcgtcttcatgggtctcatttgc

SEQ ID NO: 134332 - DNA, 25 bp, Homo sapien
aggcttcgctggtgagtgatgaccc

SEQ ID NO: 134333 - DNA, 25 bp, Homo sapien
ccgttggagcgtttgcatttgctgc

SEQ ID NO: 134334 - DNA, 25 bp, Homo sapien
cggggacaccagagactgagccctt

SEQ ID NO: 134335 - DNA, 25 bp, Homo sapien
ctgcgcctctaggatcgtatcccta

SEQ ID NO: 134336 - DNA, 25 bp, Homo sapien
agactgagcccttcgcgctggagac

SEQ ID NO: 134337 - DNA, 25 bp, Homo sapien
ccggggccaagagacaggtcacaat

SEQ ID NO: 134338 - DNA, 25 bp, Homo sapien
gcgggagcctataaaagctggtgcc

SEQ ID NO: 134339 - DNA, 25 bp, Homo sapien
gccgccagatcggtgccgattcctg

SEQ ID NO: 134340 - DNA, 25 bp, Homo sapien
ggtacggcaaacacaacggtgagtg

SEQ ID NO: 134341 - DNA, 25 bp, Homo sapien
cacatgctgtttaccgcggccgcgg

SEQ ID NO: 134342 - DNA, 25 bp, Homo sapien
acttggggcaacgtgatgctcgtct

SEQ ID NO: 134343 - DNA, 25 bp, Homo sapien
ccgcgagattcctgagggagcgctt

SEQ ID NO: 134344 - DNA, 25 bp, Homo sapien
agctcagcaggatggcttggacttg

SEQ ID NO: 134345 - DNA, 25 bp, Homo sapien
tgactccggaaaacctggtgttgta

SEQ ID NO: 134346 - DNA, 25 bp, Homo sapien
gccatgcgtggtgtagcacatctca

SEQ ID NO: 134347 - DNA, 25 bp, Homo sapien
ccaaggcgtagattcctggataagc

SEQ ID NO: 134348 - DNA, 25 bp, Homo sapien
gcgtctctggacaactctttcttga

SEQ ID NO: 134349 - DNA, 25 bp, Homo sapien
aggtgtcgtacaccactcgcatgtc

SEQ ID NO: 134350 - DNA, 25 bp, Homo sapien
tcgcaaccgactctcccttcaaacg

SEQ ID NO: 134351 - DNA, 25 bp, Homo sapien
ggagccaggtggagcttccccactt

SEQ ID NO: 134352 - DNA, 25 bp, Homo sapien
accttcgctgttggtgttgtcgccg

SEQ ID NO: 134353 - DNA, 25 bp, Homo sapien
ggagagttctcgtgggattagaacc

SEQ ID NO: 134354 - DNA, 25 bp, Homo sapien
aggcccggcttctggaccttcgctg

SEQ ID NO: 134355 - DNA, 25 bp, Homo sapien
caggtccgagtactcgggcctcttc

SEQ ID NO: 134356 - DNA, 25 bp, Homo sapien
tgcggccactcgctttgccgaggct

SEQ ID NO: 134357 - DNA, 25 bp, Homo sapien
ccttcaaacgggaaacaagatggcg

SEQ ID NO: 134358 - DNA, 25 bp, Homo sapien
tggcgctttacctggcaaggacccg

SEQ ID NO: 134359 - DNA, 25 bp, Homo sapien
ccctttatcaaagagcagctgcgag

SEQ ID NO: 134360 - DNA, 25 bp, Homo sapien
tcggaagcgagccacctgtatcctc

SEQ ID NO: 134361 - DNA, 25 bp, Homo sapien
ccaggatacccgctaacgaccgaga

SEQ ID NO: 134362 - DNA, 25 bp, Homo sapien
taacgaccgagacgcctggatcatc

SEQ ID NO: 134363 - DNA, 25 bp, Homo sapien
acgcctggatcatcgctggtcaccg

SEQ ID NO: 134364 - DNA, 25 bp, Homo sapien
cttggttttgaccttcgtgcttggc

SEQ ID NO: 134365 - DNA, 25 bp, Homo sapien
cgttcctccgccctttatcaaagag

SEQ ID NO: 134366 - DNA, 25 bp, Homo sapien
gagtcctcctgccttcgcaaatttt

SEQ ID NO: 134367 - DNA, 25 bp, Homo sapien
tttgctaagtcatgtccctggcaca

SEQ ID NO: 134368 - DNA, 25 bp, Homo sapien
ctcagtgcgaggcatgggcctaaga

SEQ ID NO: 134369 - DNA, 25 bp, Homo sapien
ttcgctaagtcaccagctcagtgcg

SEQ ID NO: 134370 - DNA, 25 bp, Homo sapien
ccgagggccacatcttcgctaagtc

SEQ ID NO: 134371 - DNA, 25 bp, Homo sapien
ttagctcacgtccatgcagtgccgg

SEQ ID NO: 134372 - DNA, 25 bp, Homo sapien
tcgcaaattttagctcacgtccatg

SEQ ID NO: 134373 - DNA, 25 bp, Homo sapien
ctaagagccgcgtctttgctaagtc

SEQ ID NO: 134374 - DNA, 25 bp, Homo sapien
agcgaagtgtttccgtgactctgca

SEQ ID NO: 134375 - DNA, 25 bp, Homo sapien
gcaaaggcctgtgccagtgatcctg

SEQ ID NO: 134376 - DNA, 25 bp, Homo sapien
cttgcccggagttcgccctggcaaa

SEQ ID NO: 134377 - DNA, 25 bp, Homo sapien
agcggagttttcctaaggcagcatc

SEQ ID NO: 134378 - DNA, 25 bp, Homo sapien
cgctagactgctcggaagacccgga

SEQ ID NO: 134379 - DNA, 25 bp, Homo sapien
agcgcgagcttagagcagcctcttc

SEQ ID NO: 134380 - DNA, 25 bp, Homo sapien
cgccgaccggaaagtcaaattagca

SEQ ID NO: 134381 - DNA, 25 bp, Homo sapien
caaattagcagtgcccagcgcgagc

SEQ ID NO: 134382 - DNA, 25 bp, Homo sapien
gggtacctcgaagccgcggaatcga

SEQ ID NO: 134383 - DNA, 25 bp, Homo sapien
ggagccggaacccactgagtaggaa

SEQ ID NO: 134384 - DNA, 25 bp, Homo sapien
ggacttaatggactttccgcgcctg

SEQ ID NO: 134385 - DNA, 25 bp, Homo sapien
gcggctccacgtcggaaaggcagaa

SEQ ID NO: 134386 - DNA, 25 bp, Homo sapien
agccagcgccatgacctgcaacttg

SEQ ID NO: 134387 - DNA, 25 bp, Homo sapien
cgggctgaccctgcactacttcagg

SEQ ID NO: 134388 - DNA, 25 bp, Homo sapien
tgaggccgtgagagcgctctcttca

SEQ ID NO: 134389 - DNA, 25 bp, Homo sapien
ggttcaccacattccttaggcagcg

SEQ ID NO: 134390 - DNA, 25 bp, Homo sapien
gtccagccctaggttctcctgaatc

SEQ ID NO: 134391 - DNA, 25 bp, Homo sapien
tctaagactcccacgtgagtgcggg

SEQ ID NO: 134392 - DNA, 25 bp, Homo sapien
ggtgaggcagcagcccagcaaccgt

SEQ ID NO: 134393 - DNA, 25 bp, Homo sapien
gataggctgggatccgccctccttc

SEQ ID NO: 134394 - DNA, 25 bp, Homo sapien
tgacaggtcccgaaatcgctgcagc

SEQ ID NO: 134395 - DNA, 25 bp, Homo sapien
aaatcgctgcagcaccacgcgggga

SEQ ID NO: 134396 - DNA, 25 bp, Homo sapien
agagggatagggtacccacaccacg

SEQ ID NO: 134397 - DNA, 25 bp, Homo sapien
acgtccgtggtgaagccaatgccca

SEQ ID NO: 134398 - DNA, 25 bp, Homo sapien
gtcgcggtcttttgctctccatttc

SEQ ID NO: 134399 - DNA, 25 bp, Homo sapien
tctccatttcgttcggcggatgttc

SEQ ID NO: 134400 - DNA, 25 bp, Homo sapien
aggtcgacccggacgagattcttcg

SEQ ID NO: 134401 - DNA, 25 bp, Homo sapien
gagattcttcgtcgccttggcccaa

SEQ ID NO: 134402 - DNA, 25 bp, Homo sapien
atcccgaatgctctgaggtgccctg

SEQ ID NO: 134403 - DNA, 25 bp, Homo sapien
aggtgccctgacataactctcgtta

SEQ ID NO: 134404 - DNA, 25 bp, Homo sapien
ctctcgttagaatcgcgtgatctga

SEQ ID NO: 134405 - DNA, 25 bp, Homo sapien
tctgaaacaagagttccgctgcttc

SEQ ID NO: 134406 - DNA, 25 bp, Homo sapien
cgcttcttaaaggagacggctcata

SEQ ID NO: 134407 - DNA, 25 bp, Homo sapien
cccactacggtagggcgcaccggag

SEQ ID NO: 134408 - DNA, 25 bp, Homo sapien
accggaggtatccagcccgcgacaa

SEQ ID NO: 134409 - DNA, 25 bp, Homo sapien
cgacaagggccctggtttgagcaca

SEQ ID NO: 134410 - DNA, 25 bp, Homo sapien
tgagcacagctcttcgacagtatct

SEQ ID NO: 134411 - DNA, 25 bp, Homo sapien
acccaggaacttgggcggctccatt

SEQ ID NO: 134412 - DNA, 25 bp, Homo sapien
gccgcctcgcatctaaaaacgagtg

SEQ ID NO: 134413 - DNA, 25 bp, Homo sapien
tcagaggagcgcctggtcactgagc

SEQ ID NO: 134414 - DNA, 25 bp, Homo sapien
gtggccgtgaagcacctgcacatcc

SEQ ID NO: 134415 - DNA, 25 bp, Homo sapien
caaaaagggtcttgccggcctcgct

SEQ ID NO: 134416 - DNA, 25 bp, Homo sapien
caacttccggaagacctgtggccca

SEQ ID NO: 134417 - DNA, 25 bp, Homo sapien
ccggtggtcgctaaccaatccgaca

SEQ ID NO: 134418 - DNA, 25 bp, Homo sapien
ccgctgacgtaacctgcgaagtttg

SEQ ID NO: 134419 - DNA, 25 bp, Homo sapien
agaggaagctctttcgcggcgctac

SEQ ID NO: 134420 - DNA, 25 bp, Homo sapien
taccgcgttggcaccagtctctaga

SEQ ID NO: 134421 - DNA, 25 bp, Homo sapien
gaagtcagctctggttcggagaagc

SEQ ID NO: 134422 - DNA, 25 bp, Homo sapien
gctccctggccggtcatttcaggtg

SEQ ID NO: 134423 - DNA, 25 bp, Homo sapien
ccggcagcgcgaggaaatgcccaaa

SEQ ID NO: 134424 - DNA, 25 bp, Homo sapien
gcccgagttcgcagcagcttctctt

SEQ ID NO: 134425 - DNA, 25 bp, Homo sapien
atttcaggtgacttcctcgccgggg

SEQ ID NO: 134426 - DNA, 25 bp, Homo sapien
aagccgctatctggaggcggactcc

SEQ ID NO: 134427 - DNA, 25 bp, Homo sapien
gtggctccaccaatcgcagacttcg

SEQ ID NO: 134428 - DNA, 25 bp, Homo sapien
gatgccgcgctctcgagctttttgg

SEQ ID NO: 134429 - DNA, 25 bp, Homo sapien
tgaccgaggtctaggtctcgattgc

SEQ ID NO: 134430 - DNA, 25 bp, Homo sapien
gcttacaaacagacgcggcggctgc

SEQ ID NO: 134431 - DNA, 25 bp, Homo sapien
cttacaaacagacgcggcggctgcg

SEQ ID NO: 134432 - DNA, 25 bp, Homo sapien
tgcagggcttacaaacagacgcggc

SEQ ID NO: 134433 - DNA, 25 bp, Homo sapien
ccctgcagggcttacaaacagacgc

SEQ ID NO: 134434 - DNA, 25 bp, Homo sapien
acaaacagacgcggcggctgcgaga

SEQ ID NO: 134435 - DNA, 25 bp, Homo sapien
tgccgacacctcctagcatcgcgtc

SEQ ID NO: 134436 - DNA, 25 bp, Homo sapien
cgcgagtcccgtgcgcggggacttc

SEQ ID NO: 134437 - DNA, 25 bp, Homo sapien
agggcttacaaacagacgcggcggc

SEQ ID NO: 134438 - DNA, 25 bp, Homo sapien
cgggtgccatggacctcgtccaaga

SEQ ID NO: 134439 - DNA, 25 bp, Homo sapien
tggcagcatgctaattgctttaacc

SEQ ID NO: 134440 - DNA, 25 bp, Homo sapien
ccctgccgcaggacaatatgttggc

SEQ ID NO: 134441 - DNA, 25 bp, Homo sapien
tgcggatagcctctaatactcacgg

SEQ ID NO: 134442 - DNA, 25 bp, Homo sapien
acgcgctcattgacgtggcaccgta

SEQ ID NO: 134443 - DNA, 25 bp, Homo sapien
gggtttgtctcctttgtggccaaga

SEQ ID NO: 134444 - DNA, 25 bp, Homo sapien
gccgaggtcgcttagccagaaagcc

SEQ ID NO: 134445 - DNA, 25 bp, Homo sapien
tccaagagcaattaaagcgaggccg

SEQ ID NO: 134446 - DNA, 25 bp, Homo sapien
gccaatcggcttcagacaagtcgga

SEQ ID NO: 134447 - DNA, 25 bp, Homo sapien
actaagtttcagtcgcacctgcctc

SEQ ID NO: 134448 - DNA, 25 bp, Homo sapien
acggcagacagtgtaggcggcaacc

SEQ ID NO: 134449 - DNA, 25 bp, Homo sapien
ggacgtctaacctcaagtcccagca

SEQ ID NO: 134450 - DNA, 25 bp, Homo sapien
gcgccagcaagacccaaactacgga

SEQ ID NO: 134451 - DNA, 25 bp, Homo sapien
gctgtcagctccagccaatcggctt

SEQ ID NO: 134452 - DNA, 25 bp, Homo sapien
tacggatcccgattgactccgcgcg

SEQ ID NO: 134453 - DNA, 25 bp, Homo sapien
ccacgccttagtaactgcgacgcga

SEQ ID NO: 134454 - DNA, 25 bp, Homo sapien
tgcgcttgccatacagcgtactcgc

SEQ ID NO: 134455 - DNA, 25 bp, Homo sapien
tgcccgggaagaatatgcgcttgcc

SEQ ID NO: 134456 - DNA, 25 bp, Homo sapien
tgtggtccgcccatgctaacttcct

SEQ ID NO: 134457 - DNA, 25 bp, Homo sapien
ggacgcgacgcaggaatcacccgca

SEQ ID NO: 134458 - DNA, 25 bp, Homo sapien
tgcaaccgcgtaaccggggctgcta

SEQ ID NO: 134459 - DNA, 25 bp, Homo sapien
gagccacgcaggctgccttggatga

SEQ ID NO: 134460 - DNA, 25 bp, Homo sapien
cgaggcagtcgctaccgggaaaata

SEQ ID NO: 134461 - DNA, 25 bp, Homo sapien
gggcagcagtttccacatcggtccg

SEQ ID NO: 134462 - DNA, 25 bp, Homo sapien
cccgagttctggagactcaacatga

SEQ ID NO: 134463 - DNA, 25 bp, Homo sapien
ataatatgtgacttggcgccacgcg

SEQ ID NO: 134464 - DNA, 25 bp, Homo sapien
tttcgcccttgataggcagtgtatg

SEQ ID NO: 134465 - DNA, 25 bp, Homo sapien
tctctgccatacaaagcactcctgg

SEQ ID NO: 134466 - DNA, 25 bp, Homo sapien
gcccagagagcaggaaagagcatca

SEQ ID NO: 134467 - DNA, 25 bp, Homo sapien
cgttctggagcgctaagagagcaca

SEQ ID NO: 134468 - DNA, 25 bp, Homo sapien
gtgaggccgtgttttacatccaaca

SEQ ID NO: 134469 - DNA, 25 bp, Homo sapien
cggaagctgcccttagtgtttttca

SEQ ID NO: 134470 - DNA, 25 bp, Homo sapien
acgatgaagcccacgacgaagagca

SEQ ID NO: 134471 - DNA, 25 bp, Homo sapien
caggggaaagagaccacgatgaagc

SEQ ID NO: 134472 - DNA, 25 bp, Homo sapien
gcccgttaggcagctgcccttcatg

SEQ ID NO: 134473 - DNA, 25 bp, Homo sapien
cccacagctgcggagggaaaccact

SEQ ID NO: 134474 - DNA, 25 bp, Homo sapien
tggcgctccagataggcgccgagca

SEQ ID NO: 134475 - DNA, 25 bp, Homo sapien
ggcaccaacaggtgctgccgaggca

SEQ ID NO: 134476 - DNA, 25 bp, Homo sapien
tccacccacagcaggaggtggtgaa

SEQ ID NO: 134477 - DNA, 25 bp, Homo sapien
ctgtgttctggtccgctcccgtgac

SEQ ID NO: 134478 - DNA, 25 bp, Homo sapien
aggcagcaacattgccacgcggatc

SEQ ID NO: 134479 - DNA, 25 bp, Homo sapien
gacaggaccaggcagcaacattgcc

SEQ ID NO: 134480 - DNA, 25 bp, Homo sapien
acaggaccaggcagcaacattgcca

SEQ ID NO: 134481 - DNA, 25 bp, Homo sapien
ggcgacaggaccaggcagcaacatt

SEQ ID NO: 134482 - DNA, 25 bp, Homo sapien
ccaggcagcaacattgccacgcgga

SEQ ID NO: 134483 - DNA, 25 bp, Homo sapien
gccgcccacaggtgcaccgcgcgtc

SEQ ID NO: 134484 - DNA, 25 bp, Homo sapien
accaggcagcaacattgccacgcgg

SEQ ID NO: 134485 - DNA, 25 bp, Homo sapien
gcgacaggaccaggcagcaacattg

SEQ ID NO: 134486 - DNA, 25 bp, Homo sapien
cgccgcgcaggcctaaatctcaggt

SEQ ID NO: 134487 - DNA, 25 bp, Homo sapien
gtgcctactacgcaggcgcacgctg

SEQ ID NO: 134488 - DNA, 25 bp, Homo sapien
atcgcagggatctcaggcactgacc

SEQ ID NO: 134489 - DNA, 25 bp, Homo sapien
aatctcaggtcttcaccgtcatctc

SEQ ID NO: 134490 - DNA, 25 bp, Homo sapien
gtgaagacccggaccggcgtcgtca

SEQ ID NO: 134491 - DNA, 25 bp, Homo sapien
gtcctcaggccacgagaacacctga

SEQ ID NO: 134492 - DNA, 25 bp, Homo sapien
cgggcacgcacattctcagggacgc

SEQ ID NO: 134493 - DNA, 25 bp, Homo sapien
tctcccagcgatcgcagggatctca

SEQ ID NO: 134494 - DNA, 25 bp, Homo sapien
ttgagtgcttactgagtgccacctc

SEQ ID NO: 134495 - DNA, 25 bp, Homo sapien
tcctcgtcctcctgagtcgtgtatt

SEQ ID NO: 134496 - DNA, 25 bp, Homo sapien
ctcgtcctcctgagtcgtgtattga

SEQ ID NO: 134497 - DNA, 25 bp, Homo sapien
tgtcctccagagtcgtgtattgagt

SEQ ID NO: 134498 - DNA, 25 bp, Homo sapien
ctcctcgtcctcctgagtcgtgtat

SEQ ID NO: 134499 - DNA, 25 bp, Homo sapien
tcgtcctcctgagtcgtgtattgag

SEQ ID NO: 134500 - DNA, 25 bp, Homo sapien
tgagtgcttactgagtgccacctcc

SEQ ID NO: 134501 - DNA, 25 bp, Homo sapien
agtgcttactgagcgccacctcctt

SEQ ID NO: 134502 - DNA, 25 bp, Homo sapien
tggctgctcaggacaaacgccctgc

SEQ ID NO: 134503 - DNA, 25 bp, Homo sapien
ggaagattcccaggagacatcgccg

SEQ ID NO: 134504 - DNA, 25 bp, Homo sapien
ttgccagagccggtgcgtccgccta

SEQ ID NO: 134505 - DNA, 25 bp, Homo sapien
cagacgccgtcaactacgggaagga

SEQ ID NO: 134506 - DNA, 25 bp, Homo sapien
gacatggatccagacgccgtcaact

SEQ ID NO: 134507 - DNA, 25 bp, Homo sapien
aggctatctccagccgtggccgatg

SEQ ID NO: 134508 - DNA, 25 bp, Homo sapien
ccttaccttgcgctttggctgctca

SEQ ID NO: 134509 - DNA, 25 bp, Homo sapien
ctacgtgcggggatgacatggatcc

SEQ ID NO: 134510 - DNA, 25 bp, Homo sapien
gaggcgctgacaggctagccctcga

SEQ ID NO: 134511 - DNA, 25 bp, Homo sapien
tagccacttaccgactcaaaatcca

SEQ ID NO: 134512 - DNA, 25 bp, Homo sapien
cgctgacaggctagccctcgacggg

SEQ ID NO: 134513 - DNA, 25 bp, Homo sapien
cgtggccctgcttgtgcgaagactg

SEQ ID NO: 134514 - DNA, 25 bp, Homo sapien
cagaccgtggccctgcttgtgcgaa

SEQ ID NO: 134515 - DNA, 25 bp, Homo sapien
gctcagcccacacgcggaggccgag

SEQ ID NO: 134516 - DNA, 25 bp, Homo sapien
cgactcaaaatccacggggatttcg

SEQ ID NO: 134517 - DNA, 25 bp, Homo sapien
cacccagagccggtcgtctagggta

SEQ ID NO: 134518 - DNA, 25 bp, Homo sapien
ctttgcttagatccggtgccgcctt

SEQ ID NO: 134519 - DNA, 25 bp, Homo sapien
cctactagccggtgcaggtttcttc

SEQ ID NO: 134520 - DNA, 25 bp, Homo sapien
tctggggaatctcaaggcgtgactt

SEQ ID NO: 134521 - DNA, 25 bp, Homo sapien
ggcgtgacttatctggatcacccta

SEQ ID NO: 134522 - DNA, 25 bp, Homo sapien
ccctagtagcaagtggcctcttctc

SEQ ID NO: 134523 - DNA, 25 bp, Homo sapien
ctcgtctttgcagtggctttgctta

SEQ ID NO: 134524 - DNA, 25 bp, Homo sapien
gccaagagcctagcgcgtagcttta

SEQ ID NO: 134525 - DNA, 25 bp, Homo sapien
tcggctctggcgctctagccaattc

SEQ ID NO: 134526 - DNA, 25 bp, Homo sapien
ttcctgctcgcataccgtgactatg

SEQ ID NO: 134527 - DNA, 25 bp, Homo sapien
agggccacctgccaaatgcactgtg

SEQ ID NO: 134528 - DNA, 25 bp, Homo sapien
ttgcagccgggtcccaaagttaaga

SEQ ID NO: 134529 - DNA, 25 bp, Homo sapien
ggctccgagctgcaaataaaacttc

SEQ ID NO: 134530 - DNA, 25 bp, Homo sapien
atgttcctctttgccctggtgcgta

SEQ ID NO: 134531 - DNA, 25 bp, Homo sapien
tgcgtagtcctaccctaattgagcg

SEQ ID NO: 134532 - DNA, 25 bp, Homo sapien
tcagtgtcatcgcagaccggagtca

SEQ ID NO: 134533 - DNA, 25 bp, Homo sapien
gcctcgcggtcgaataatccaaacg

SEQ ID NO: 134534 - DNA, 25 bp, Homo sapien
tcctgactattttgcggtgaactgc

SEQ ID NO: 134535 - DNA, 25 bp, Homo sapien
tccttgcgggcttcacgagatcgat

SEQ ID NO: 134536 - DNA, 25 bp, Homo sapien
cacaggcatcgaagacgctagcttc

SEQ ID NO: 134537 - DNA, 25 bp, Homo sapien
acagcttgggaagcacacaggcatc

SEQ ID NO: 134538 - DNA, 25 bp, Homo sapien
ggtgaactgcacaactcacgcagta

SEQ ID NO: 134539 - DNA, 25 bp, Homo sapien
cgagatcgattcctgactattttgc

SEQ ID NO: 134540 - DNA, 25 bp, Homo sapien
agcacccgcaggtctaaatcggggt

SEQ ID NO: 134541 - DNA, 25 bp, Homo sapien
tcacgcagtaatgtagcttcacata

SEQ ID NO: 134542 - DNA, 25 bp, Homo sapien
ttctcggggcttgtctccgtgtcct

SEQ ID NO: 134543 - DNA, 25 bp, Homo sapien
cgcctcttttcgttgccgttacctg

SEQ ID NO: 134544 - DNA, 25 bp, Homo sapien
cgttacctgtttccggcagtcgaca

SEQ ID NO: 134545 - DNA, 25 bp, Homo sapien
tgtttccggcagtcgacacgctctt

SEQ ID NO: 134546 - DNA, 25 bp, Homo sapien
agtcgacacgctcttcgcttctcgg

SEQ ID NO: 134547 - DNA, 25 bp, Homo sapien
cccaaccgccactgactacagcctg

SEQ ID NO: 134548 - DNA, 25 bp, Homo sapien
gcgaatgagacctgcggacctgccc

SEQ ID NO: 134549 - DNA, 25 bp, Homo sapien
tcttccgggcttcggcgaatgagac

SEQ ID NO: 134550 - DNA, 25 bp, Homo sapien
cgcgagtaatcggtcagcacaaagg

SEQ ID NO: 134551 - DNA, 25 bp, Homo sapien
gcgcgttccttagcaaccgcaatgg

SEQ ID NO: 134552 - DNA, 25 bp, Homo sapien
ggtccttcagtgatcaccgtaccta

SEQ ID NO: 134553 - DNA, 25 bp, Homo sapien
cggactccgggtttctcttgcagag

SEQ ID NO: 134554 - DNA, 25 bp, Homo sapien
ctcccagggacggaacgatcgtctc

SEQ ID NO: 134555 - DNA, 25 bp, Homo sapien
acgatcgtctcccaaacgctttagg

SEQ ID NO: 134556 - DNA, 25 bp, Homo sapien
ggcaagggccgacaaacttcgtgtc

SEQ ID NO: 134557 - DNA, 25 bp, Homo sapien
aatgttgctgtccacggttctgtca

SEQ ID NO: 134558 - DNA, 25 bp, Homo sapien
atgaggcgcaccctggaaaaccggt

SEQ ID NO: 134559 - DNA, 25 bp, Homo sapien
tctgcgccgaattccgaccctgagt

SEQ ID NO: 134560 - DNA, 25 bp, Homo sapien
ctggggcctaattccttgggctgca

SEQ ID NO: 134561 - DNA, 25 bp, Homo sapien
ctgtgcctacacagtccggatagtg

SEQ ID NO: 134562 - DNA, 25 bp, Homo sapien
gtttccatagaaacgcccggcctgc

SEQ ID NO: 134563 - DNA, 25 bp, Homo sapien
ttctcacagccttcgccggcaggga

SEQ ID NO: 134564 - DNA, 25 bp, Homo sapien
cggacgcgtctggtacgagactaca

SEQ ID NO: 134565 - DNA, 25 bp, Homo sapien
cgagactacaagtcgcacaggcgga

SEQ ID NO: 134566 - DNA, 25 bp, Homo sapien
gagacacattcagggctcagccggt

SEQ ID NO: 134567 - DNA, 25 bp, Homo sapien
tgagaatcttcggtagacaactgtc

SEQ ID NO: 134568 - DNA, 25 bp, Homo sapien
tcagccggtagatgtgctgagaatc

SEQ ID NO: 134569 - DNA, 25 bp, Homo sapien
ctacgctagatactggcgcggccgc

SEQ ID NO: 134570 - DNA, 25 bp, Homo sapien
ggaactgcttcgcacttggcaataa

SEQ ID NO: 134571 - DNA, 25 bp, Homo sapien
gagggaactcttcgtcgcagcagcc

SEQ ID NO: 134572 - DNA, 25 bp, Homo sapien
ggtttatctgcccatgcgctctgca

SEQ ID NO: 134573 - DNA, 25 bp, Homo sapien
ctcgactttcaacgggagaaattca

SEQ ID NO: 134574 - DNA, 25 bp, Homo sapien
tgggttgtccaatcagctcagcgaa

SEQ ID NO: 134575 - DNA, 25 bp, Homo sapien
cgcgcagggttggtaacctagcaac

SEQ ID NO: 134576 - DNA, 25 bp, Homo sapien
gcaacacgagcagtgacttccggta

SEQ ID NO: 134577 - DNA, 25 bp, Homo sapien
gcaatggcggtttggtccctcttat

SEQ ID NO: 134578 - DNA, 25 bp, Homo sapien
ttccagcgtcggtaccatggcgacg

SEQ ID NO: 134579 - DNA, 25 bp, Homo sapien
cagtgacttccggtacccggacttg

SEQ ID NO: 134580 - DNA, 25 bp, Homo sapien
gtgaggcttccagcgtcggtaccat

SEQ ID NO: 134581 - DNA, 25 bp, Homo sapien
tagcaaccaagcaacacgagcagtg

SEQ ID NO: 134582 - DNA, 25 bp, Homo sapien
cgccgaatggaagggattgtctgac

SEQ ID NO: 134583 - DNA, 25 bp, Homo sapien
cctcctcgtcgggaagaatcgtttg

SEQ ID NO: 134584 - DNA, 25 bp, Homo sapien
ttcgtctggactgaaacgggcaccc

SEQ ID NO: 134585 - DNA, 25 bp, Homo sapien
tccagctgtcagcacgaagggcgcc

SEQ ID NO: 134586 - DNA, 25 bp, Homo sapien
tgcgctccagctgtcagcacgaagg

SEQ ID NO: 134587 - DNA, 25 bp, Homo sapien
cagccaatcggcaggcgggaagcac

SEQ ID NO: 134588 - DNA, 25 bp, Homo sapien
tgccgtgcccggttcgtattcccta

SEQ ID NO: 134589 - DNA, 25 bp, Homo sapien
gatcctccacccgtccaaagttgtg

SEQ ID NO: 134590 - DNA, 25 bp, Homo sapien
ccgcggggcttttccgtgacgtcag

SEQ ID NO: 134591 - DNA, 25 bp, Homo sapien
caacgagcggggagtgctgcgctgt

SEQ ID NO: 134592 - DNA, 25 bp, Homo sapien
cgcgctgggatacccgggccaacga

SEQ ID NO: 134593 - DNA, 25 bp, Homo sapien
cggggcttttccgtgacgtcagcgc

SEQ ID NO: 134594 - DNA, 25 bp, Homo sapien
gtccgcgctgggatacccgggccaa

SEQ ID NO: 134595 - DNA, 25 bp, Homo sapien
gcgtcagcgtatcgcgtgggtccgc

SEQ ID NO: 134596 - DNA, 25 bp, Homo sapien
ggcggtttataaccagcccagccga

SEQ ID NO: 134597 - DNA, 25 bp, Homo sapien
cccttacttggctcggccggatcgg

SEQ ID NO: 134598 - DNA, 25 bp, Homo sapien
agaaggccacttcggtcgctcctgc

SEQ ID NO: 134599 - DNA, 25 bp, Homo sapien
ggcgtccctggcacttcagaccaaa

SEQ ID NO: 134600 - DNA, 25 bp, Homo sapien
cctcggcgaagccaatcgcggacga

SEQ ID NO: 134601 - DNA, 25 bp, Homo sapien
cggagaagctcaaggatcccgcctc

SEQ ID NO: 134602 - DNA, 25 bp, Homo sapien
ctggccctgcaaagaagtccttctg

SEQ ID NO: 134603 - DNA, 25 bp, Homo sapien
aatctgacagaaaccactggccctg

SEQ ID NO: 134604 - DNA, 25 bp, Homo sapien
tgctttgtcccgcacgagcctacag

SEQ ID NO: 134605 - DNA, 25 bp, Homo sapien
gacgcaccggcgaaaatctgacaga

SEQ ID NO: 134606 - DNA, 25 bp, Homo sapien
gagtccaccgccatgtttgccgcgg

SEQ ID NO: 134607 - DNA, 25 bp, Homo sapien
gcctccgcgacagcgactcaggaga

SEQ ID NO: 134608 - DNA, 25 bp, Homo sapien
gaaacagagggacttccggtgacca

SEQ ID NO: 134609 - DNA, 25 bp, Homo sapien
tgaccagagcactagcgccgcaaac

SEQ ID NO: 134610 - DNA, 25 bp, Homo sapien
aacgcatcttgttgcccggagttgc

SEQ ID NO: 134611 - DNA, 25 bp, Homo sapien
gactacggggtctccagtggttcaa

SEQ ID NO: 134612 - DNA, 25 bp, Homo sapien
cgcgttacagagctacagcggtctc

SEQ ID NO: 134613 - DNA, 25 bp, Homo sapien
cctgtcgttcctccgcgttacagag

SEQ ID NO: 134614 - DNA, 25 bp, Homo sapien
tcctaccaggaaacgagacggcgcg

SEQ ID NO: 134615 - DNA, 25 bp, Homo sapien
agctgagcacctgggaaccgcgcac

SEQ ID NO: 134616 - DNA, 25 bp, Homo sapien
cactgcaatgcaatctgggtggttt

SEQ ID NO: 134617 - DNA, 25 bp, Homo sapien
ctactgcagtaagccagccggaacc

SEQ ID NO: 134618 - DNA, 25 bp, Homo sapien
gccggaacccatttatgactccgca

SEQ ID NO: 134619 - DNA, 25 bp, Homo sapien
tgactccgcactctgaagttcagga

SEQ ID NO: 134620 - DNA, 25 bp, Homo sapien
cctctggaactcaagcagtggacga

SEQ ID NO: 134621 - DNA, 25 bp, Homo sapien
gagagctgccacctgtatcacggga

SEQ ID NO: 134622 - DNA, 25 bp, Homo sapien
ggagcagctggacgtgcgcctcaac

SEQ ID NO: 134623 - DNA, 25 bp, Homo sapien
gctggaagcctcctacgtgttcttc

SEQ ID NO: 134624 - DNA, 25 bp, Homo sapien
tgctggcactcatcggcctcatctt

SEQ ID NO: 134625 - DNA, 25 bp, Homo sapien
ttccagtgctactgcttcggcggcc

SEQ ID NO: 134626 - DNA, 25 bp, Homo sapien
ctcacgcacaaccacatcgaggtgg

SEQ ID NO: 134627 - DNA, 25 bp, Homo sapien
catcgtaggcgccaacctgacggtg

SEQ ID NO: 134628 - DNA, 25 bp, Homo sapien
cctagcgggcaacgcgctgagccgt

SEQ ID NO: 134629 - DNA, 25 bp, Homo sapien
tgcagctcaaccacgcgctggtgcg

SEQ ID NO: 134630 - DNA, 25 bp, Homo sapien
cttcgttccctgcagccggtattct

SEQ ID NO: 134631 - DNA, 25 bp, Homo sapien
ctcctgctgtttgcactgaaagttg

SEQ ID NO: 134632 - DNA, 25 bp, Homo sapien
tgtgttggctcaggagctgcttttc

SEQ ID NO: 134633 - DNA, 25 bp, Homo sapien
cttttccggggatctgcagttgccc

SEQ ID NO: 134634 - DNA, 25 bp, Homo sapien
tgcacctggccttttcgcttgaccg

SEQ ID NO: 134635 - DNA, 25 bp, Homo sapien
agaaccttcggcttcgttccctgca

SEQ ID NO: 134636 - DNA, 25 bp, Homo sapien
ataactgcgtcctggggagtgacta

SEQ ID NO: 134637 - DNA, 25 bp, Homo sapien
ttcgcttgaccgttcagaaccttcg

SEQ ID NO: 134638 - DNA, 25 bp, Homo sapien
agagtcagctccattttgccaattg

SEQ ID NO: 134639 - DNA, 25 bp, Homo sapien
cttccagggcttttccgacctatcg

SEQ ID NO: 134640 - DNA, 25 bp, Homo sapien
gagctttgattctgcgtccggaccc

SEQ ID NO: 134641 - DNA, 25 bp, Homo sapien
acccgtgcttctctaccttcggagg

SEQ ID NO: 134642 - DNA, 25 bp, Homo sapien
agtgctagttagaccggatcagttg

SEQ ID NO: 134643 - DNA, 25 bp, Homo sapien
atagacgtcgaaagcctgtcctcgg

SEQ ID NO: 134644 - DNA, 25 bp, Homo sapien
ttgggaccgacattcactagttttc

SEQ ID NO: 134645 - DNA, 25 bp, Homo sapien
ctggaccaagccctccgacaggtga

SEQ ID NO: 134646 - DNA, 25 bp, Homo sapien
tgcactcccggcgtggagtctcctt

SEQ ID NO: 134647 - DNA, 25 bp, Homo sapien
gctgatgatcgtctctgactcgcta

SEQ ID NO: 134648 - DNA, 25 bp, Homo sapien
cgctaagtcgcggagtcacaaaagt

SEQ ID NO: 134649 - DNA, 25 bp, Homo sapien
atgccctcactttttgggaagagta

SEQ ID NO: 134650 - DNA, 25 bp, Homo sapien
cgccctagccttcgcagaaacgatg

SEQ ID NO: 134651 - DNA, 25 bp, Homo sapien
agcggagcaaatggcccgaagtttt

SEQ ID NO: 134652 - DNA, 25 bp, Homo sapien
caacggctgccagtggtctcgggaa

SEQ ID NO: 134653 - DNA, 25 bp, Homo sapien
caaaagtggcggaaagcatgccctc

SEQ ID NO: 134654 - DNA, 25 bp, Homo sapien
accggcccgcatccaagtgtcaggt

SEQ ID NO: 134655 - DNA, 25 bp, Homo sapien
cgcttcgcctttacgaaaatattga

SEQ ID NO: 134656 - DNA, 25 bp, Homo sapien
tgaggcccgttgcaaccctagatga

SEQ ID NO: 134657 - DNA, 25 bp, Homo sapien
ccgcagacctgctggtttgagtttc

SEQ ID NO: 134658 - DNA, 25 bp, Homo sapien
gaggttgtctcattttctcgctgga

SEQ ID NO: 134659 - DNA, 25 bp, Homo sapien
cgccgccattttggattgtgtgagt

SEQ ID NO: 134660 - DNA, 25 bp, Homo sapien
tggagaaacatctgcgcaagccctg

SEQ ID NO: 134661 - DNA, 25 bp, Homo sapien
ctcgctggagaactgtcagggaaca

SEQ ID NO: 134662 - DNA, 25 bp, Homo sapien
ggtatgtatcaaccctgctttccgg

SEQ ID NO: 134663 - DNA, 25 bp, Homo sapien
tggctgcagaatgtaaacaccactc

SEQ ID NO: 134664 - DNA, 25 bp, Homo sapien
gctgtcccgccaaggcctcagggaa

SEQ ID NO: 134665 - DNA, 25 bp, Homo sapien
tcccactgcaactcctggatttcgg

SEQ ID NO: 134666 - DNA, 25 bp, Homo sapien
tctcccgccagtttgcttttgcttc

SEQ ID NO: 134667 - DNA, 25 bp, Homo sapien
tagggaaactctcaggggctccttc

SEQ ID NO: 134668 - DNA, 25 bp, Homo sapien
caacccaatatataggccgggccgg

SEQ ID NO: 134669 - DNA, 25 bp, Homo sapien
agggaaggcatttccagcccgccca

SEQ ID NO: 134670 - DNA, 25 bp, Homo sapien
gcgcagaacgttttttcctgtgaga

SEQ ID NO: 134671 - DNA, 25 bp, Homo sapien
cttttgttgttgtgcagcgctcgca

SEQ ID NO: 134672 - DNA, 25 bp, Homo sapien
cggccagtccaagtccttttgttgt

SEQ ID NO: 134673 - DNA, 25 bp, Homo sapien
agcgctcgcaacagctgatcggccg

SEQ ID NO: 134674 - DNA, 25 bp, Homo sapien
cgccctgcgagaggttgtcaccaac

SEQ ID NO: 134675 - DNA, 25 bp, Homo sapien
agctccgaaacaagcccgggcaaca

SEQ ID NO: 134676 - DNA, 25 bp, Homo sapien
gaggtggatctctccctcagcgacc

SEQ ID NO: 134677 - DNA, 25 bp, Homo sapien
acctcgttcaggtacccagacggca

SEQ ID NO: 134678 - DNA, 25 bp, Homo sapien
gagtgcttactgagcgccacctcct

SEQ ID NO: 134679 - DNA, 25 bp, Homo sapien
agtgcttactgagcgccacctcctt

SEQ ID NO: 134680 - DNA, 25 bp, Homo sapien
cgtcctccagagtcgtgtattgagt

SEQ ID NO: 134681 - DNA, 25 bp, Homo sapien
tccagagtcgtgtattgagtgctta

SEQ ID NO: 134682 - DNA, 25 bp, Homo sapien
ttgagtgcttactgagcgccacctc

SEQ ID NO: 134683 - DNA, 25 bp, Homo sapien
gtcctccagagtcgtgtattgagtg

SEQ ID NO: 134684 - DNA, 25 bp, Homo sapien
tcctccagagtcgtgtattgagtgc

SEQ ID NO: 134685 - DNA, 25 bp, Homo sapien
tcctgagtcgtgtattgagtgctta

SEQ ID NO: 134686 - DNA, 25 bp, Homo sapien
gtgagcgagcacgaccttccctggc

SEQ ID NO: 134687 - DNA, 25 bp, Homo sapien
cgtctggcctgacgtttgagcgagc

SEQ ID NO: 134688 - DNA, 25 bp, Homo sapien
ggggcactgaccactactgcctgga

SEQ ID NO: 134689 - DNA, 25 bp, Homo sapien
agaggctgccttcccgcgactcaaa

SEQ ID NO: 134690 - DNA, 25 bp, Homo sapien
ggctcttctttgagcggcgtccaga

SEQ ID NO: 134691 - DNA, 25 bp, Homo sapien
ccagatgcagaggaccacagcgaca

SEQ ID NO: 134692 - DNA, 25 bp, Homo sapien
ttcctggaacgaaggccaaagagtc

SEQ ID NO: 134693 - DNA, 25 bp, Homo sapien
ctcaaaggagcataggggaacctgc

SEQ ID NO: 134694 - DNA, 25 bp, Homo sapien
tcggcgagggtgtcattgcttatat

SEQ ID NO: 134695 - DNA, 25 bp, Homo sapien
cccagggaatatccgggctcgcaga

SEQ ID NO: 134696 - DNA, 25 bp, Homo sapien
cgtcgcattctcagcaagatgaggc

SEQ ID NO: 134697 - DNA, 25 bp, Homo sapien
ttcctctggggatgccaaaagccac

SEQ ID NO: 134698 - DNA, 25 bp, Homo sapien
gcttcctgaggccaaagcgggtctc

SEQ ID NO: 134699 - DNA, 25 bp, Homo sapien
gacagtgtttctgcgcttcctgagg

SEQ ID NO: 134700 - DNA, 25 bp, Homo sapien
ccgaccggacggaaggatgccgcat

SEQ ID NO: 134701 - DNA, 25 bp, Homo sapien
cattgcttatatggctgcggggacc

SEQ ID NO: 134702 - DNA, 25 bp, Homo sapien
tccgcgaccaggaggatcggacctt

SEQ ID NO: 134703 - DNA, 25 bp, Homo sapien
ttctggccgaaaagtttgcagggtc

SEQ ID NO: 134704 - DNA, 25 bp, Homo sapien
gcgtctcagggtcgcgacaaatttc

SEQ ID NO: 134705 - DNA, 25 bp, Homo sapien
aggatcggaccttcgccttcgctgt

SEQ ID NO: 134706 - DNA, 25 bp, Homo sapien
tgcggacagcacacaccctggaagg

SEQ ID NO: 134707 - DNA, 25 bp, Homo sapien
ccaggcagccgttgtcgggttcgac

SEQ ID NO: 134708 - DNA, 25 bp, Homo sapien
acgtgcacctcaacgcgtcgcggga

SEQ ID NO: 134709 - DNA, 25 bp, Homo sapien
cgccatgttggggtctgtgagaaac

SEQ ID NO: 134710 - DNA, 25 bp, Homo sapien
cccgtgcgtgtattgtgtgtcaacc

SEQ ID NO: 134711 - DNA, 25 bp, Homo sapien
cagcatgcctgtgccacgggttagt

SEQ ID NO: 134712 - DNA, 25 bp, Homo sapien
ccaatgctgggtgtcagcgagctgt

SEQ ID NO: 134713 - DNA, 25 bp, Homo sapien
aggagagctggtactagatcccgcg

SEQ ID NO: 134714 - DNA, 25 bp, Homo sapien
cgcagaaccaggacgcaatcggagc

SEQ ID NO: 134715 - DNA, 25 bp, Homo sapien
tttgtcgcccatggtccgcgacggt

SEQ ID NO: 134716 - DNA, 25 bp, Homo sapien
gcgtcagcgcccaggctggaaaatc

SEQ ID NO: 134717 - DNA, 25 bp, Homo sapien
ccactgcgtgtgatgagcgtgtgct

SEQ ID NO: 134718 - DNA, 25 bp, Homo sapien
cgggcccacgttgtaaccacaagca

SEQ ID NO: 134719 - DNA, 25 bp, Homo sapien
tctctgcagtgtgtctgtgtgactc

SEQ ID NO: 134720 - DNA, 25 bp, Homo sapien
cttcatccaagagctcgtccaggtc

SEQ ID NO: 134721 - DNA, 25 bp, Homo sapien
gtgtgcaaaacttggactcgacttc

SEQ ID NO: 134722 - DNA, 25 bp, Homo sapien
cccgtcttagaaggtcaggtgtgca

SEQ ID NO: 134723 - DNA, 25 bp, Homo sapien
tgagcgtctctttcgccttggcttg

SEQ ID NO: 134724 - DNA, 25 bp, Homo sapien
agcagggctttaccagaacagtcca

SEQ ID NO: 134725 - DNA, 25 bp, Homo sapien
cagcacagccctctcggggttaaga

SEQ ID NO: 134726 - DNA, 25 bp, Homo sapien
gcgcatctctgcgaacaggttcttg

SEQ ID NO: 134727 - DNA, 25 bp, Homo sapien
cctcgtactccaggggcgcgataat

SEQ ID NO: 134728 - DNA, 25 bp, Homo sapien
ttgcgctgggatctggtgaatacca

SEQ ID NO: 134729 - DNA, 25 bp, Homo sapien
cctcgcagtgataggcctcgtactc

SEQ ID NO: 134730 - DNA, 25 bp, Homo sapien
ggaagtcgcatacaccctcgcagtg

SEQ ID NO: 134731 - DNA, 25 bp, Homo sapien
cagcgtagcctggacttcttgccgt

SEQ ID NO: 134732 - DNA, 25 bp, Homo sapien
aggccctgccacacgtcgaagactt

SEQ ID NO: 134733 - DNA, 25 bp, Homo sapien
ctttgtctgagagcatggacacatc

SEQ ID NO: 134734 - DNA, 25 bp, Homo sapien
gcgcctttgaagatgctgtccgggt

SEQ ID NO: 134735 - DNA, 25 bp, Homo sapien
ttccctttatcaagctggggctgca

SEQ ID NO: 134736 - DNA, 25 bp, Homo sapien
gggtcccttccatcacgggagacga

SEQ ID NO: 134737 - DNA, 25 bp, Homo sapien
accctcaattagatcgctgagttga

SEQ ID NO: 134738 - DNA, 25 bp, Homo sapien
aacactccaatcaggggcccgatgc

SEQ ID NO: 134739 - DNA, 25 bp, Homo sapien
tcaccgccggtgacacatcaaatca

SEQ ID NO: 134740 - DNA, 25 bp, Homo sapien
tcgacggcgatttaaacatccctta

SEQ ID NO: 134741 - DNA, 25 bp, Homo sapien
atcccttaggcaaggcgccaagtta

SEQ ID NO: 134742 - DNA, 25 bp, Homo sapien
catctgcagaaaccactcgtgttga

SEQ ID NO: 134743 - DNA, 25 bp, Homo sapien
cacccagcgcagggaccaacggaaa

SEQ ID NO: 134744 - DNA, 25 bp, Homo sapien
cacgctggagcaaaaaagccggagg

SEQ ID NO: 134745 - DNA, 25 bp, Homo sapien
accacgctggagcaaaaaagccgga

SEQ ID NO: 134746 - DNA, 25 bp, Homo sapien
agcaccacgctggagcaaaaaagcc

SEQ ID NO: 134747 - DNA, 25 bp, Homo sapien
cactcgtgttgaggcctcggagcag

SEQ ID NO: 134748 - DNA, 25 bp, Homo sapien
aaaccactcgtgttgaggcctcgga

SEQ ID NO: 134749 - DNA, 25 bp, Homo sapien
tgcagaaaccactcgtgttgaggcc

SEQ ID NO: 134750 - DNA, 25 bp, Homo sapien
gaccctcgaggtcaggcaaaggcca

SEQ ID NO: 134751 - DNA, 25 bp, Homo sapien
gggtatcgctctccacaaagacagg

SEQ ID NO: 134752 - DNA, 25 bp, Homo sapien
atcttgccttccttgcggcttcgca

SEQ ID NO: 134753 - DNA, 25 bp, Homo sapien
ccattttctcggttgggtatcgctc

SEQ ID NO: 134754 - DNA, 25 bp, Homo sapien
aggccacgagtctttagagtttgga

SEQ ID NO: 134755 - DNA, 25 bp, Homo sapien
caggaccctgggagtatccatggcg

SEQ ID NO: 134756 - DNA, 25 bp, Homo sapien
gcctgctggaaaccgggcaaatccc

SEQ ID NO: 134757 - DNA, 25 bp, Homo sapien
cttcgcatgcccttggtggaaccca

SEQ ID NO: 134758 - DNA, 25 bp, Homo sapien
tccggctcgctattcctctgaagtc

SEQ ID NO: 134759 - DNA, 25 bp, Homo sapien
gtcagcctcatgtacttcgccttta

SEQ ID NO: 134760 - DNA, 25 bp, Homo sapien
attgacttcttctaccggccgcata

SEQ ID NO: 134761 - DNA, 25 bp, Homo sapien
tccggatgatcaacgagcagcaagt

SEQ ID NO: 134762 - DNA, 25 bp, Homo sapien
ttcctcgagtggtagagatgcctca

SEQ ID NO: 134763 - DNA, 25 bp, Homo sapien
gcccggtgtctcacagtacgctagc

SEQ ID NO: 134764 - DNA, 25 bp, Homo sapien
cagcgggctacgtgctctgaaaaga

SEQ ID NO: 134765 - DNA, 25 bp, Homo sapien
gggcagctcctgctttacctgtggc

SEQ ID NO: 134766 - DNA, 25 bp, Homo sapien
gcgccgtttagggtgtttgaagcta

SEQ ID NO: 134767 - DNA, 25 bp, Homo sapien
atccgctgggacaaatgcgctcgtc

SEQ ID NO: 134768 - DNA, 25 bp, Homo sapien
ccgagaattgcggtttggtctagcc

SEQ ID NO: 134769 - DNA, 25 bp, Homo sapien
gcgccagctttcctgtttgactgca

SEQ ID NO: 134770 - DNA, 25 bp, Homo sapien
ttttgtttgatgctccctgcggcta

SEQ ID NO: 134771 - DNA, 25 bp, Homo sapien
ccgcgagtgtccagagagaaaagtt

SEQ ID NO: 134772 - DNA, 25 bp, Homo sapien
aggcttcgttttgccctggttgcaa

SEQ ID NO: 134773 - DNA, 25 bp, Homo sapien
gccagatttaagagacccgcgagtg

SEQ ID NO: 134774 - DNA, 25 bp, Homo sapien
caccgtaaggctaggccgcgagctt

SEQ ID NO: 134775 - DNA, 25 bp, Homo sapien
tcaattttctaacaggagccacagc

SEQ ID NO: 134776 - DNA, 25 bp, Homo sapien
agccgccctatcaggtgtgtttgca

SEQ ID NO: 134777 - DNA, 25 bp, Homo sapien
tttgcagccgaactggcagtgcccg

SEQ ID NO: 134778 - DNA, 25 bp, Homo sapien
ggacggacttccagcatcgctcatt

SEQ ID NO: 134779 - DNA, 25 bp, Homo sapien
agtggagtcaccgagcctagaaatg

SEQ ID NO: 134780 - DNA, 25 bp, Homo sapien
ggacccagggcgacactcaattttc

SEQ ID NO: 134781 - DNA, 25 bp, Homo sapien
gcttctgaaaagcacgcggccctgg

SEQ ID NO: 134782 - DNA, 25 bp, Homo sapien
ggcaaccgccgacgtcacgaacgta

SEQ ID NO: 134783 - DNA, 25 bp, Homo sapien
ctctcagggtctcgttgaacaaggc

SEQ ID NO: 134784 - DNA, 25 bp, Homo sapien
tgccatttcatctcttccgcgcggg

SEQ ID NO: 134785 - DNA, 25 bp, Homo sapien
agtttctctgatatgcgctcgcggg

SEQ ID NO: 134786 - DNA, 25 bp, Homo sapien
cgtacaactgtaccgtcgcgagagg

SEQ ID NO: 134787 - DNA, 25 bp, Homo sapien
ttcaaagacacgctgtgaccctgcg

SEQ ID NO: 134788 - DNA, 25 bp, Homo sapien
ggttcccgctgttcccacgaagaca

SEQ ID NO: 134789 - DNA, 25 bp, Homo sapien
catctcgcgcggactcgctttaggt

SEQ ID NO: 134790 - DNA, 25 bp, Homo sapien
tcctttcctttcagcggagcgcggc

SEQ ID NO: 134791 - DNA, 25 bp, Homo sapien
ggcagtgcaaatatccaagaagagg

SEQ ID NO: 134792 - DNA, 25 bp, Homo sapien
ttctcggggtgccaccgcgaggcct

SEQ ID NO: 134793 - DNA, 25 bp, Homo sapien
aagcggcctaggcttcctggcgttc

SEQ ID NO: 134794 - DNA, 25 bp, Homo sapien
gttccaagtgaagcgcagagagatg

SEQ ID NO: 134795 - DNA, 25 bp, Homo sapien
gagcatttgtcggtcaacggaatta

SEQ ID NO: 134796 - DNA, 25 bp, Homo sapien
cccggagaaggcgtttgtgagcatt

SEQ ID NO: 134797 - DNA, 25 bp, Homo sapien
gcggcaagatggcagtgcaaatatc

SEQ ID NO: 134798 - DNA, 25 bp, Homo sapien
gagacgttggccaggatcatggccc

SEQ ID NO: 134799 - DNA, 25 bp, Homo sapien
tggcagtcatggataccggccatca

SEQ ID NO: 134800 - DNA, 25 bp, Homo sapien
cgtggccactgtagtcccctgtggc

SEQ ID NO: 134801 - DNA, 25 bp, Homo sapien
gcttcttagctactggggtcgaggc

SEQ ID NO: 134802 - DNA, 25 bp, Homo sapien
cagcagcttcttagctactggggtc

SEQ ID NO: 134803 - DNA, 25 bp, Homo sapien
cggccatcatcagcagcttcttagc

SEQ ID NO: 134804 - DNA, 25 bp, Homo sapien
ggataccggccatcatcagcagctt

SEQ ID NO: 134805 - DNA, 25 bp, Homo sapien
tgtggccaccaacgccttgaacctg

SEQ ID NO: 134806 - DNA, 25 bp, Homo sapien
aaatgctctcggtcggcctaggctt

SEQ ID NO: 134807 - DNA, 25 bp, Homo sapien
gtccgagaagcccaaagtgagtatg

SEQ ID NO: 134808 - DNA, 25 bp, Homo sapien
ctgctgtttctgctgggctacggct

SEQ ID NO: 134809 - DNA, 25 bp, Homo sapien
gtcatcctgcgagtccctctgacgg

SEQ ID NO: 134810 - DNA, 25 bp, Homo sapien
cattgttccgccgagggaggacagc

SEQ ID NO: 134811 - DNA, 25 bp, Homo sapien
gatcgcggcccaagccgccattgtt

SEQ ID NO: 134812 - DNA, 25 bp, Homo sapien
agcttctggtctacagtaacgggtc

SEQ ID NO: 134813 - DNA, 25 bp, Homo sapien
tgctgaagaatctccggagcgagga

SEQ ID NO: 134814 - DNA, 25 bp, Homo sapien
cctggacgcggttctactccaacag

SEQ ID NO: 134815 - DNA, 25 bp, Homo sapien
gcggtcgacgctcctgaaaacttgc

SEQ ID NO: 134816 - DNA, 25 bp, Homo sapien
cgcatattttgcagctctgtggtta

SEQ ID NO: 134817 - DNA, 25 bp, Homo sapien
agggtgcacgctgatggatttactc

SEQ ID NO: 134818 - DNA, 25 bp, Homo sapien
tgccgagcacgtgtttcctttcttc

SEQ ID NO: 134819 - DNA, 25 bp, Homo sapien
ccggggcagacaaactgagcttatc

SEQ ID NO: 134820 - DNA, 25 bp, Homo sapien
tgtcaatgctcgttctccctggccg

SEQ ID NO: 134821 - DNA, 25 bp, Homo sapien
gcgctcatccgcctaaagttgtatt

SEQ ID NO: 134822 - DNA, 25 bp, Homo sapien
tcccacgagcgatccccgaggagag

SEQ ID NO: 134823 - DNA, 25 bp, Homo sapien
ccgacgaggaagacccgggtggctg

SEQ ID NO: 134824 - DNA, 25 bp, Homo sapien
gcctcgaagtgcaggcggaccgacc

SEQ ID NO: 134825 - DNA, 25 bp, Homo sapien
ccaccgacagaataccgagcctggg

SEQ ID NO: 134826 - DNA, 25 bp, Homo sapien
gacagaataccgagcctgggctgcc

SEQ ID NO: 134827 - DNA, 25 bp, Homo sapien
ctccctgcgcaggacaagccgcgct

SEQ ID NO: 134828 - DNA, 25 bp, Homo sapien
cgctgtggcacgcagcggggacgcc

SEQ ID NO: 134829 - DNA, 25 bp, Homo sapien
ctcggcgaggcgaagaggccgacga

SEQ ID NO: 134830 - DNA, 25 bp, Homo sapien
tttaggatccggagttacaaatggc

SEQ ID NO: 134831 - DNA, 25 bp, Homo sapien
tcggtaggagcccactcaccaacag

SEQ ID NO: 134832 - DNA, 25 bp, Homo sapien
gttacaaatggcaacccgcaaagct

SEQ ID NO: 134833 - DNA, 25 bp, Homo sapien
tcaccaacagcagccgctaagatgg

SEQ ID NO: 134834 - DNA, 25 bp, Homo sapien
cgtgaatcgtcttccgggcctggcc

SEQ ID NO: 134835 - DNA, 25 bp, Homo sapien
cccaacctagaagagacagagaaca

SEQ ID NO: 134836 - DNA, 25 bp, Homo sapien
gaacaggacaggaattttaggatcc

SEQ ID NO: 134837 - DNA, 25 bp, Homo sapien
gcgctgcctaaacctcggtcggtag

SEQ ID NO: 134838 - DNA, 25 bp, Homo sapien
gcgaccacggtctcaatgccgctga

SEQ ID NO: 134839 - DNA, 25 bp, Homo sapien
gccgctgaattcatctttgtcctga

SEQ ID NO: 134840 - DNA, 25 bp, Homo sapien
ccgcatttactctccgcttggtaga

SEQ ID NO: 134841 - DNA, 25 bp, Homo sapien
tccgcttggtagaagcagctgtgtc

SEQ ID NO: 134842 - DNA, 25 bp, Homo sapien
ggcgccctgctcgagtttcccaaaa

SEQ ID NO: 134843 - DNA, 25 bp, Homo sapien
actcgccttttgtgactgtgttagc

SEQ ID NO: 134844 - DNA, 25 bp, Homo sapien
ctgtgttagcgtgaacttgtgagcc

SEQ ID NO: 134845 - DNA, 25 bp, Homo sapien
tgagccgagtttgcactgagagcgc

SEQ ID NO: 134846 - DNA, 25 bp, Homo sapien
gctggattcaccctgtccgctgatg

SEQ ID NO: 134847 - DNA, 25 bp, Homo sapien
cttccaaatctggagcggcgctgct

SEQ ID NO: 134848 - DNA, 25 bp, Homo sapien
tgcagttgccttcggttcccggttc

SEQ ID NO: 134849 - DNA, 25 bp, Homo sapien
gggacaaagcgcgatttccttccaa

SEQ ID NO: 134850 - DNA, 25 bp, Homo sapien
cgcttgcgctctacgcccaagggag

SEQ ID NO: 134851 - DNA, 25 bp, Homo sapien
aaacttccgcggctacgggtgcagt

SEQ ID NO: 134852 - DNA, 25 bp, Homo sapien
atgcgagcagaacccgggacaaagc

SEQ ID NO: 134853 - DNA, 25 bp, Homo sapien
cgacacccgcgcagggctgagacag

SEQ ID NO: 134854 - DNA, 25 bp, Homo sapien
tttcggcgacgctccaggccacgtg

SEQ ID NO: 134855 - DNA, 25 bp, Homo sapien
atcgtttctctctcagactccgctg

SEQ ID NO: 134856 - DNA, 25 bp, Homo sapien
ttcctcacagcgtctggcaggttgg

SEQ ID NO: 134857 - DNA, 25 bp, Homo sapien
tactgtcgcggaggcttgtcattct

SEQ ID NO: 134858 - DNA, 25 bp, Homo sapien
gaactgtagtttcggcgacgctcca

SEQ ID NO: 134859 - DNA, 25 bp, Homo sapien
gcttgtcattctgacccggggattc

SEQ ID NO: 134860 - DNA, 25 bp, Homo sapien
tacgtcagtcatttcccttcattgc

SEQ ID NO: 134861 - DNA, 25 bp, Homo sapien
ttctgacccggggattcctcacagc

SEQ ID NO: 134862 - DNA, 25 bp, Homo sapien
agtgcttactgagcgccacctcctt

SEQ ID NO: 134863 - DNA, 25 bp, Homo sapien
tcctccagagtcgtgtattgagtgc

SEQ ID NO: 134864 - DNA, 25 bp, Homo sapien
ttgagtgcttactgagcgccacctc

SEQ ID NO: 134865 - DNA, 25 bp, Homo sapien
cgtcctcctgagtcgtgtattgagt

SEQ ID NO: 134866 - DNA, 25 bp, Homo sapien
tcctgagtcgtgtattgagtgctta

SEQ ID NO: 134867 - DNA, 25 bp, Homo sapien
tccagagtcgtgtattgagtgctta

SEQ ID NO: 134868 - DNA, 25 bp, Homo sapien
gagtgcttactgagcgccacctcct

SEQ ID NO: 134869 - DNA, 25 bp, Homo sapien
tcctcgtcctcctgagtcgtgtatt

SEQ ID NO: 134870 - DNA, 25 bp, Homo sapien
gggaaacattgcatgtcacctcttc

SEQ ID NO: 134871 - DNA, 25 bp, Homo sapien
ttccgctgggccagtgtctgcatcc

SEQ ID NO: 134872 - DNA, 25 bp, Homo sapien
attcagtgacagctcgtccagggcg

SEQ ID NO: 134873 - DNA, 25 bp, Homo sapien
cccgtacgtgaaattcagtgacagc

SEQ ID NO: 134874 - DNA, 25 bp, Homo sapien
taccagtcgcccgagagggagccgt

SEQ ID NO: 134875 - DNA, 25 bp, Homo sapien
ttacctggttcctgcggtaccagtc

SEQ ID NO: 134876 - DNA, 25 bp, Homo sapien
tcccactcggagaggccgggtgtct

SEQ ID NO: 134877 - DNA, 25 bp, Homo sapien
cggacttaggtcaatgcgggaaaca

SEQ ID NO: 134878 - DNA, 25 bp, Homo sapien
acgcccaccttgtccgtgttgacgc

SEQ ID NO: 134879 - DNA, 25 bp, Homo sapien
acagctgcaagtgaggacatgggcc

SEQ ID NO: 134880 - DNA, 25 bp, Homo sapien
tggcgcccccaatcacgaagagctt

SEQ ID NO: 134881 - DNA, 25 bp, Homo sapien
tgtgcaggcgcctcaggccgtcgaa

SEQ ID NO: 134882 - DNA, 25 bp, Homo sapien
ggccgtcgaagccacccaccgcgaa

SEQ ID NO: 134883 - DNA, 25 bp, Homo sapien
ccgcgaacagctgcaagtgaggaca

SEQ ID NO: 134884 - DNA, 25 bp, Homo sapien
ggccttagggccctcggcctcatcg

SEQ ID NO: 134885 - DNA, 25 bp, Homo sapien
acccaccgcgaacagctgcaagtga

SEQ ID NO: 134886 - DNA, 25 bp, Homo sapien
gggtggagctgtgctaatagaaaca

SEQ ID NO: 134887 - DNA, 25 bp, Homo sapien
gcgggaccacgcagccacctgtgag

SEQ ID NO: 134888 - DNA, 25 bp, Homo sapien
cacctgtgagccttcggcagctgcg

SEQ ID NO: 134889 - DNA, 25 bp, Homo sapien
gtgctcccaggtaagcgcttccaga

SEQ ID NO: 134890 - DNA, 25 bp, Homo sapien
agcgcttccagaacgcgcagggcga

SEQ ID NO: 134891 - DNA, 25 bp, Homo sapien
tgcccgtgcgtatctcagctccggt

SEQ ID NO: 134892 - DNA, 25 bp, Homo sapien
ggcctgcccatggacaaggtcagca

SEQ ID NO: 134893 - DNA, 25 bp, Homo sapien
catggacaaggtcagcatgcagccc

SEQ ID NO: 134894 - DNA, 25 bp, Homo sapien
ccgattcgttacctcttaggcgccg

SEQ ID NO: 134895 - DNA, 25 bp, Homo sapien
cgcggcgggacactcggacccgcct

SEQ ID NO: 134896 - DNA, 25 bp, Homo sapien
gctgcccacccgactttccacgcgc

SEQ ID NO: 134897 - DNA, 25 bp, Homo sapien
caccggccggccgagcctagggcac

SEQ ID NO: 134898 - DNA, 25 bp, Homo sapien
ccctcgcccgtggacagacgcggcg

SEQ ID NO: 134899 - DNA, 25 bp, Homo sapien
tggtggacggcgaaggccgaaagga

SEQ ID NO: 134900 - DNA, 25 bp, Homo sapien
gatctccctcccgcttaggagcgcg

SEQ ID NO: 134901 - DNA, 25 bp, Homo sapien
cccgactttccacgcgccaggcctg

SEQ ID NO: 134902 - DNA, 25 bp, Homo sapien
cgctggggtcagaactggtatcttt

SEQ ID NO: 134903 - DNA, 25 bp, Homo sapien
gtgggtccgaaaaatccgtctcaga

SEQ ID NO: 134904 - DNA, 25 bp, Homo sapien
tcgactcggcctagtacacgcaatc

SEQ ID NO: 134905 - DNA, 25 bp, Homo sapien
gagaagcttattggccctgagaata

SEQ ID NO: 134906 - DNA, 25 bp, Homo sapien
cacgcgactctttctctgcagcaaa

SEQ ID NO: 134907 - DNA, 25 bp, Homo sapien
tcaactccagggaagtctgtgtctg

SEQ ID NO: 134908 - DNA, 25 bp, Homo sapien
ccaacagtgcgggaagttcaaatgc

SEQ ID NO: 134909 - DNA, 25 bp, Homo sapien
cgctgacgcgctgttttaaaagata

SEQ ID NO: 134910 - DNA, 25 bp, Homo sapien
aagacgtggatctgctctcgcttta

SEQ ID NO: 134911 - DNA, 25 bp, Homo sapien
gactcctgcgactccgcgcggaaaa

SEQ ID NO: 134912 - DNA, 25 bp, Homo sapien
tttgccaggcgtggactcaatgacc

SEQ ID NO: 134913 - DNA, 25 bp, Homo sapien
ctgctcgcggtcctccagatcatgt

SEQ ID NO: 134914 - DNA, 25 bp, Homo sapien
gtccacagactctgacgaagacgtg

SEQ ID NO: 134915 - DNA, 25 bp, Homo sapien
ggtctttacacagtccgcgtccaca

SEQ ID NO: 134916 - DNA, 25 bp, Homo sapien
gcggggccgctactaaagcccaaga

SEQ ID NO: 134917 - DNA, 25 bp, Homo sapien
gactcaatgacctttccaagctgtg

SEQ ID NO: 134918 - DNA, 25 bp, Homo sapien
gtgggatctcacgacccatccgtta

SEQ ID NO: 134919 - DNA, 25 bp, Homo sapien
cccggcctgctagcattggcattgc

SEQ ID NO: 134920 - DNA, 25 bp, Homo sapien
gcggttgactgagcttcgcctaaca

SEQ ID NO: 134921 - DNA, 25 bp, Homo sapien
gtcttccgctccgtatctgcctaga

SEQ ID NO: 134922 - DNA, 25 bp, Homo sapien
ctcgccagtggagcacttcttgttc

SEQ ID NO: 134923 - DNA, 25 bp, Homo sapien
ccttggattatagtcacggtctctc

SEQ ID NO: 134924 - DNA, 25 bp, Homo sapien
tccggcctctgattcctggaagaaa

SEQ ID NO: 134925 - DNA, 25 bp, Homo sapien
accactggacgctggggtatcccaa

SEQ ID NO: 134926 - DNA, 25 bp, Homo sapien
gccttcggcttgaccaacggaggaa

SEQ ID NO: 134927 - DNA, 25 bp, Homo sapien
tcaccgacggccaaagagggccttc

SEQ ID NO: 134928 - DNA, 25 bp, Homo sapien
ctccgggtgaaagaacaggcttgtc

SEQ ID NO: 134929 - DNA, 25 bp, Homo sapien
ccagtctctgaatctccgggtgaaa

SEQ ID NO: 134930 - DNA, 25 bp, Homo sapien
gccagacaggccgtgcccaatgctt

SEQ ID NO: 134931 - DNA, 25 bp, Homo sapien
cggctcatggcttaggggccacaga

SEQ ID NO: 134932 - DNA, 25 bp, Homo sapien
gcccttcagtgccttccgggaactg

SEQ ID NO: 134933 - DNA, 25 bp, Homo sapien
cgtcttcgtgtggagatcgatttcc

SEQ ID NO: 134934 - DNA, 25 bp, Homo sapien
gagttgcttctccagtcggtgaacg

SEQ ID NO: 134935 - DNA, 25 bp, Homo sapien
agcttctgcggctacagatggcgca

SEQ ID NO: 134936 - DNA, 25 bp, Homo sapien
gagaagccctatccaactctgcgga

SEQ ID NO: 134937 - DNA, 25 bp, Homo sapien
aacgctccgttgagccacgtctatg

SEQ ID NO: 134938 - DNA, 25 bp, Homo sapien
ggactatactgcagtgtgaccgcca

SEQ ID NO: 134939 - DNA, 25 bp, Homo sapien
acccgagcagaaatagggacttctc

SEQ ID NO: 134940 - DNA, 25 bp, Homo sapien
cacgtggccgacttcccttagagaa

SEQ ID NO: 134941 - DNA, 25 bp, Homo sapien
acgtctatgcgcttgctcatggata

SEQ ID NO: 134942 - DNA, 25 bp, Homo sapien
ggagcgccacttccggatctcgagt

SEQ ID NO: 134943 - DNA, 25 bp, Homo sapien
ctttgtcctaactagcagggtcgga

SEQ ID NO: 134944 - DNA, 25 bp, Homo sapien
ggaccctggctagcagaacgcaaga

SEQ ID NO: 134945 - DNA, 25 bp, Homo sapien
ctccttcacgaagacgcgcagagta

SEQ ID NO: 134946 - DNA, 25 bp, Homo sapien
ctccagcctgagaaatccggtccgg

SEQ ID NO: 134947 - DNA, 25 bp, Homo sapien
gctttggttctatggtggcagatcc

SEQ ID NO: 134948 - DNA, 25 bp, Homo sapien
gggacttactgctttcggcctgaga

SEQ ID NO: 134949 - DNA, 25 bp, Homo sapien
ggcctgagataacgaacgctctttc

SEQ ID NO: 134950 - DNA, 25 bp, Homo sapien
gtcacgactaaatccgaggcagaga

SEQ ID NO: 134951 - DNA, 25 bp, Homo sapien
cggcggagacacacagtcacgacta

SEQ ID NO: 134952 - DNA, 25 bp, Homo sapien
tcactccgaagccagctgggttctc

SEQ ID NO: 134953 - DNA, 25 bp, Homo sapien
tagggatgcaaaagggaccggactc

SEQ ID NO: 134954 - DNA, 25 bp, Homo sapien
caccaacgtccttcctgactaaagg

SEQ ID NO: 134955 - DNA, 25 bp, Homo sapien
gcgacggtagccgaaggagttcaaa

SEQ ID NO: 134956 - DNA, 25 bp, Homo sapien
gttcaaaagacctctagtgcgccca

SEQ ID NO: 134957 - DNA, 25 bp, Homo sapien
tgccgttgtgacaacccgcagtgtc

SEQ ID NO: 134958 - DNA, 25 bp, Homo sapien
gctgccctttcatgcgtttctgcca

SEQ ID NO: 134959 - DNA, 25 bp, Homo sapien
tgcggataagcccagtgcctgttgg

SEQ ID NO: 134960 - DNA, 25 bp, Homo sapien
ggtccatgaatctggcgtgcggata

SEQ ID NO: 134961 - DNA, 25 bp, Homo sapien
cacgatcacttcagctaggtccatg

SEQ ID NO: 134962 - DNA, 25 bp, Homo sapien
tcaggagacctttgcggtcgcaacc

SEQ ID NO: 134963 - DNA, 25 bp, Homo sapien
ctctctggatggtaggcatcggcga

SEQ ID NO: 134964 - DNA, 25 bp, Homo sapien
cgtagacgtcattgcggagagcaca

SEQ ID NO: 134965 - DNA, 25 bp, Homo sapien
gccctcaccggagacgtagacgtca

SEQ ID NO: 134966 - DNA, 25 bp, Homo sapien
accggcgaggacgtgaaattcgtca

SEQ ID NO: 134967 - DNA, 25 bp, Homo sapien
tgaccgctgctcaggtccgttattc

SEQ ID NO: 134968 - DNA, 25 bp, Homo sapien
aattcgttactgtggtgaccgctgc

SEQ ID NO: 134969 - DNA, 25 bp, Homo sapien
gactccactggcagcgaattcgtta

SEQ ID NO: 134970 - DNA, 25 bp, Homo sapien
agcttagacaatacggccgcccagg

SEQ ID NO: 134971 - DNA, 25 bp, Homo sapien
tgaagcccttttttctcatgtctgg

SEQ ID NO: 134972 - DNA, 25 bp, Homo sapien
taacgtggtgccagcataaaccggc

SEQ ID NO: 134973 - DNA, 25 bp, Homo sapien
gtgagcctcttctcgggcatgccgt

SEQ ID NO: 134974 - DNA, 25 bp, Homo sapien
aacggtctcaccagggcgtcaaaga

SEQ ID NO: 134975 - DNA, 25 bp, Homo sapien
gtcaaagatccgctaggcccagaaa

SEQ ID NO: 134976 - DNA, 25 bp, Homo sapien
tccgctaggcccagaaagccaaggg

SEQ ID NO: 134977 - DNA, 25 bp, Homo sapien
ggcccagcacctggaagacacaggg

SEQ ID NO: 134978 - DNA, 25 bp, Homo sapien
cgggagacccgctaacgggcactcg

SEQ ID NO: 134979 - DNA, 25 bp, Homo sapien
cgctgcctttacctccttaggtttg

SEQ ID NO: 134980 - DNA, 25 bp, Homo sapien
ccgcaggcctgggtcctcgcttgag

SEQ ID NO: 134981 - DNA, 25 bp, Homo sapien
cgcccggggtaaccgctaagcgcag

SEQ ID NO: 134982 - DNA, 25 bp, Homo sapien
cctgccggccgggaatataggactt

SEQ ID NO: 134983 - DNA, 25 bp, Homo sapien
gatgccgtttcttttcggtctccga

SEQ ID NO: 134984 - DNA, 25 bp, Homo sapien
catagaaaccgttgccacggcggga

SEQ ID NO: 134985 - DNA, 25 bp, Homo sapien
cctggcgccgctgtacatagaaacc

SEQ ID NO: 134986 - DNA, 25 bp, Homo sapien
ggctggggagcaatctgagaccatt

SEQ ID NO: 134987 - DNA, 25 bp, Homo sapien
gtcagccctggtgacccaagccagg

SEQ ID NO: 134988 - DNA, 25 bp, Homo sapien
agagacccagcttttcgcgttagta

SEQ ID NO: 134989 - DNA, 25 bp, Homo sapien
aggacttgtcgcatctcagcccttc

SEQ ID NO: 134990 - DNA, 25 bp, Homo sapien
tgacctcagtgagcagcacctggga

SEQ ID NO: 134991 - DNA, 25 bp, Homo sapien
ctcccaggtgactaagagcgccgtg

SEQ ID NO: 134992 - DNA, 25 bp, Homo sapien
ggcatcgctgcattcctcccaggtg

SEQ ID NO: 134993 - DNA, 25 bp, Homo sapien
ccggcaagtactcggcggcaatcgc

SEQ ID NO: 134994 - DNA, 25 bp, Homo sapien
aactgctcccggtgatgcaaaccct

SEQ ID NO: 134995 - DNA, 25 bp, Homo sapien
gcacctgggaatgccggcatgttcc

SEQ ID NO: 134996 - DNA, 25 bp, Homo sapien
agccgtgcgtcatgggcaacatcca

SEQ ID NO: 134997 - DNA, 25 bp, Homo sapien
agccagggcaacgagctgttccgaa

SEQ ID NO: 134998 - DNA, 25 bp, Homo sapien
ccggacttccgaatccatttctgtc

SEQ ID NO: 134999 - DNA, 25 bp, Homo sapien
tgttcccttgcgcacgttcgttccg

SEQ ID NO: 135000 - DNA, 25 bp, Homo sapien
ctcctccgcagttgtggctcgacgg

SEQ ID NO: 135001 - DNA, 25 bp, Homo sapien
ggcgggcgagtaggcccatctccca

SEQ ID NO: 135002 - DNA, 25 bp, Homo sapien
ctcggcccgtcataatatcgccggg

SEQ ID NO: 135003 - DNA, 25 bp, Homo sapien
agagctccctgggtcgtaagcgaga

SEQ ID NO: 135004 - DNA, 25 bp, Homo sapien
gacactggaggagacgcctttccca

SEQ ID NO: 135005 - DNA, 25 bp, Homo sapien
cctttaactcctcagagcggcggca

SEQ ID NO: 135006 - DNA, 25 bp, Homo sapien
gggccaagtacctgcgactcgaacg

SEQ ID NO: 135007 - DNA, 25 bp, Homo sapien
gactcgaacgagcagcagcgacagc

SEQ ID NO: 135008 - DNA, 25 bp, Homo sapien
cggtgcaggagatatcaagtggctc

SEQ ID NO: 135009 - DNA, 25 bp, Homo sapien
aaacgagaaccctcgcaggcctctg

SEQ ID NO: 135010 - DNA, 25 bp, Homo sapien
ggccaggcctactggacctccagtg

SEQ ID NO: 135011 - DNA, 25 bp, Homo sapien
cctccagtgctacagggacggtgca

SEQ ID NO: 135012 - DNA, 25 bp, Homo sapien
gaagaagccatcacggacccgcggt

SEQ ID NO: 135013 - DNA, 25 bp, Homo sapien
ctcgtgaacacacagaccgcgaaga

SEQ ID NO: 135014 - DNA, 25 bp, Homo sapien
ggcctgccacgcgactcagagcgaa

SEQ ID NO: 135015 - DNA, 25 bp, Homo sapien
tctgaactcggcagcggtggacgca

SEQ ID NO: 135016 - DNA, 25 bp, Homo sapien
ctgggacaccgggatacagaaatgc

SEQ ID NO: 135017 - DNA, 25 bp, Homo sapien
caccgggatacagaaatgcatcttc

SEQ ID NO: 135018 - DNA, 25 bp, Homo sapien
agaaatgcatcttcatggctgagcg

SEQ ID NO: 135019 - DNA, 25 bp, Homo sapien
gtcttgggagtagcgctgggaaccc

SEQ ID NO: 135020 - DNA, 25 bp, Homo sapien
cgcgtcggaccgctgctgggacacc

SEQ ID NO: 135021 - DNA, 25 bp, Homo sapien
atcttcatggctgagcggtgtcttg

SEQ ID NO: 135022 - DNA, 25 bp, Homo sapien
atcaaccggaattgaaaactactca

SEQ ID NO: 135023 - DNA, 25 bp, Homo sapien
tcaaccggaattgaaaactactcaa

SEQ ID NO: 135024 - DNA, 25 bp, Homo sapien
agaaggggaagcaccgcctcctgca

SEQ ID NO: 135025 - DNA, 25 bp, Homo sapien
gcctcctgcaccctctacttatacc

SEQ ID NO: 135026 - DNA, 25 bp, Homo sapien
ccgcgcgtctgacgccagggcccct

SEQ ID NO: 135027 - DNA, 25 bp, Homo sapien
ccagggcccctacgcgagcgtcagc

SEQ ID NO: 135028 - DNA, 25 bp, Homo sapien
cgtcagcgccggagtaggaggagac

SEQ ID NO: 135029 - DNA, 25 bp, Homo sapien
caggaggagcgttaacccgtcaccg

SEQ ID NO: 135030 - DNA, 25 bp, Homo sapien
agctcctctacgcttgtcccgagtg

SEQ ID NO: 135031 - DNA, 25 bp, Homo sapien
ggctgagactctgtccctggatctc

SEQ ID NO: 135032 - DNA, 25 bp, Homo sapien
ctggatctcgctgctcacaggctac

SEQ ID NO: 135033 - DNA, 25 bp, Homo sapien
cgcacgatgacgtcaaacgctgcta

SEQ ID NO: 135034 - DNA, 25 bp, Homo sapien
acgctgctatggcaaccgttgattg

SEQ ID NO: 135035 - DNA, 25 bp, Homo sapien
aaccgttgattggtgcccacagcga

SEQ ID NO: 135036 - DNA, 25 bp, Homo sapien
gccgggttcctcacctgtgtccgga

SEQ ID NO: 135037 - DNA, 25 bp, Homo sapien
gagtcattatctcgggcggaagcga

SEQ ID NO: 135038 - DNA, 25 bp, Homo sapien
acccacctgcgtggtgagtcagggg

SEQ ID NO: 135039 - DNA, 25 bp, Homo sapien
accgcaggtgctgtgagtcacccac

SEQ ID NO: 135040 - DNA, 25 bp, Homo sapien
ggcctcgcttacaccgcaggtgctg

SEQ ID NO: 135041 - DNA, 25 bp, Homo sapien
gaagagtcaccctcagcgtcacctt

SEQ ID NO: 135042 - DNA, 25 bp, Homo sapien
agggacagaaggcagaagagtcacc

SEQ ID NO: 135043 - DNA, 25 bp, Homo sapien
tcccgggctgtcagccgactgccac

SEQ ID NO: 135044 - DNA, 25 bp, Homo sapien
aggcagaagagtcaccctcagcgtc

SEQ ID NO: 135045 - DNA, 25 bp, Homo sapien
caccgtcaccatggctacgcggctc

SEQ ID NO: 135046 - DNA, 25 bp, Homo sapien
ggagctactggcaccactggcacca

SEQ ID NO: 135047 - DNA, 25 bp, Homo sapien
tccgtacacgtagtcgagcaccacg

SEQ ID NO: 135048 - DNA, 25 bp, Homo sapien
agcgcatggccgcttcaaacacggc

SEQ ID NO: 135049 - DNA, 25 bp, Homo sapien
ttgaccatttgttcagcgactctcc

SEQ ID NO: 135050 - DNA, 25 bp, Homo sapien
cggccgcgaacaagctgcggaagta

SEQ ID NO: 135051 - DNA, 25 bp, Homo sapien
catcctgccggggagagaacacaaa

SEQ ID NO: 135052 - DNA, 25 bp, Homo sapien
aacacaaacagcgtcggggaagcca

SEQ ID NO: 135053 - DNA, 25 bp, Homo sapien
ggcgacagccctcatccgtttattt

SEQ ID NO: 135054 - DNA, 25 bp, Homo sapien
ggctctgcagccgtgactcagctcg

SEQ ID NO: 135055 - DNA, 25 bp, Homo sapien
gggctgtgcgggcaccaaacaaagc

SEQ ID NO: 135056 - DNA, 25 bp, Homo sapien
gcgggcaccaaacaaagcagcgctc

SEQ ID NO: 135057 - DNA, 25 bp, Homo sapien
cgccttgctcgtttccctccaggag

SEQ ID NO: 135058 - DNA, 25 bp, Homo sapien
ttccctcggcaaggggcgctcgata

SEQ ID NO: 135059 - DNA, 25 bp, Homo sapien
gccttccttggctgccagacagaca

SEQ ID NO: 135060 - DNA, 25 bp, Homo sapien
agacagacagcgttcccaaggagga

SEQ ID NO: 135061 - DNA, 25 bp, Homo sapien
catcggactcgccagcttcaggaag

SEQ ID NO: 135062 - DNA, 25 bp, Homo sapien
gtgatcccggtcctggttggtgacc

SEQ ID NO: 135063 - DNA, 25 bp, Homo sapien
agtcttgcgtcggagagacagtgca

SEQ ID NO: 135064 - DNA, 25 bp, Homo sapien
gcctcagccttaggggagaccacta

SEQ ID NO: 135065 - DNA, 25 bp, Homo sapien
atgtgcctttctgcggctgcctcct

SEQ ID NO: 135066 - DNA, 25 bp, Homo sapien
aaacttcaggggacgtcgccttctg

SEQ ID NO: 135067 - DNA, 25 bp, Homo sapien
ccgcggcgtgtttcacaagtcgctc

SEQ ID NO: 135068 - DNA, 25 bp, Homo sapien
cggtggctgagtcacattcccggag

SEQ ID NO: 135069 - DNA, 25 bp, Homo sapien
cgggccctggctgacacaaacttca

SEQ ID NO: 135070 - DNA, 25 bp, Homo sapien
tgcctctgacggtggaaatgccaga

SEQ ID NO: 135071 - DNA, 25 bp, Homo sapien
gcctcactcgcacccggattgttgt

SEQ ID NO: 135072 - DNA, 25 bp, Homo sapien
actgcgtctctgatgtcccttggta

SEQ ID NO: 135073 - DNA, 25 bp, Homo sapien
gagcctccagctgtcatgtgttcca

SEQ ID NO: 135074 - DNA, 25 bp, Homo sapien
tgcaccctgcagctgtgatgccatc

SEQ ID NO: 135075 - DNA, 25 bp, Homo sapien
aacgcgggatcttcggactccatgt

SEQ ID NO: 135076 - DNA, 25 bp, Homo sapien
ctcatgagacgggacatcctgatcc

SEQ ID NO: 135077 - DNA, 25 bp, Homo sapien
ccggattcaggctcagtggcccatc

SEQ ID NO: 135078 - DNA, 25 bp, Homo sapien
ctgcactcggagaagggccttacct

SEQ ID NO: 135079 - DNA, 25 bp, Homo sapien
ttatcccacctttccggctaggtga

SEQ ID NO: 135080 - DNA, 25 bp, Homo sapien
tgcccattgccacgatccaggagga

SEQ ID NO: 135081 - DNA, 25 bp, Homo sapien
agtccgccactttctgctctgtgtc

SEQ ID NO: 135082 - DNA, 25 bp, Homo sapien
cgctccactcgggtaaacttcggag

SEQ ID NO: 135083 - DNA, 25 bp, Homo sapien
attcagctccttgcgagaaagttac

SEQ ID NO: 135084 - DNA, 25 bp, Homo sapien
aacttcggagtgagttacctgcact

SEQ ID NO: 135085 - DNA, 25 bp, Homo sapien
agaaagttacctgtggccgcccaag

SEQ ID NO: 135086 - DNA, 25 bp, Homo sapien
ctcatgtgaggcctcgagttagggc

SEQ ID NO: 135087 - DNA, 25 bp, Homo sapien
gccatcttctcgcaccgggcaggag

SEQ ID NO: 135088 - DNA, 25 bp, Homo sapien
cttctcggggtgctctcgccgtcaa

SEQ ID NO: 135089 - DNA, 25 bp, Homo sapien
actccagacgcgtcggggagccaca

SEQ ID NO: 135090 - DNA, 25 bp, Homo sapien
gccctcggaaggctttgtgcgagcc

SEQ ID NO: 135091 - DNA, 25 bp, Homo sapien
actggctgcgtcctattggaagtgc

SEQ ID NO: 135092 - DNA, 25 bp, Homo sapien
taactttgccgtggcgttgcggcca

SEQ ID NO: 135093 - DNA, 25 bp, Homo sapien
cttcctgaaggtgtctcgccggaga

SEQ ID NO: 135094 - DNA, 25 bp, Homo sapien
gcggccctctgcaaagttgctctct

SEQ ID NO: 135095 - DNA, 25 bp, Homo sapien
gtccgtgttcaaccagcgcctttcg

SEQ ID NO: 135096 - DNA, 25 bp, Homo sapien
ggctgcaactccgactccgctctgg

SEQ ID NO: 135097 - DNA, 25 bp, Homo sapien
tggaaccaggttcccagaaccgcgc

SEQ ID NO: 135098 - DNA, 25 bp, Homo sapien
ccaccctcaaggtctgtaattttgt

SEQ ID NO: 135099 - DNA, 25 bp, Homo sapien
gcctcctgtggcctttccgggcaga

SEQ ID NO: 135100 - DNA, 25 bp, Homo sapien
ccagcgtctgtgtcgcttcgggcga

SEQ ID NO: 135101 - DNA, 25 bp, Homo sapien
ttgacagggtgaactgcacccagga

SEQ ID NO: 135102 - DNA, 25 bp, Homo sapien
ataacatttcctacagcggtcctgc

SEQ ID NO: 135103 - DNA, 25 bp, Homo sapien
ctgaggcctccaagcgtcgtccttg

SEQ ID NO: 135104 - DNA, 25 bp, Homo sapien
gcctccaagcgtcgtccttggctgg

SEQ ID NO: 135105 - DNA, 25 bp, Homo sapien
agcagcgagcgggacgcaaacccaa

SEQ ID NO: 135106 - DNA, 25 bp, Homo sapien
gacgcaaacccaaagtcagctcctt

SEQ ID NO: 135107 - DNA, 25 bp, Homo sapien
gctcgcaacgacgaagccaggctgc

SEQ ID NO: 135108 - DNA, 25 bp, Homo sapien
cctgaccgcggcgaataacatttcc

SEQ ID NO: 135109 - DNA, 25 bp, Homo sapien
cggataaacgcaggggtaagtctca

SEQ ID NO: 135110 - DNA, 25 bp, Homo sapien
cctgctctggactgcttagcctact

SEQ ID NO: 135111 - DNA, 25 bp, Homo sapien
ctgccttggggcaccgcctacctct

SEQ ID NO: 135112 - DNA, 25 bp, Homo sapien
gcctacctctgccagccacgcctcc

SEQ ID NO: 135113 - DNA, 25 bp, Homo sapien
gcctgcggcctaaggaaatctccct

SEQ ID NO: 135114 - DNA, 25 bp, Homo sapien
tgcggcctaaggaaatctccctgct

SEQ ID NO: 135115 - DNA, 25 bp, Homo sapien
ttactctgttgcaccgcccagtcgc

SEQ ID NO: 135116 - DNA, 25 bp, Homo sapien
agtcgcccggctttccactgaggga

SEQ ID NO: 135117 - DNA, 25 bp, Homo sapien
ggactgcttagcctactccagctgg

SEQ ID NO: 135118 - DNA, 25 bp, Homo sapien
cccaaatggagggaagcaaatacgc

SEQ ID NO: 135119 - DNA, 25 bp, Homo sapien
cctcgattgggctgctcaacgttgt

SEQ ID NO: 135120 - DNA, 25 bp, Homo sapien
gttcaacgccgctccttgcgggagg

SEQ ID NO: 135121 - DNA, 25 bp, Homo sapien
cgccagccctattacctgtcattga

SEQ ID NO: 135122 - DNA, 25 bp, Homo sapien
cctgtcattgagctggtcctcggtg

SEQ ID NO: 135123 - DNA, 25 bp, Homo sapien
cccggcagcgggtgaaccacgaaat

SEQ ID NO: 135124 - DNA, 25 bp, Homo sapien
tggacgtcatggtgctttccttctc

SEQ ID NO: 135125 - DNA, 25 bp, Homo sapien
ccgcgcgtcactagcgagaagctgc

SEQ ID NO: 135126 - DNA, 25 bp, Homo sapien
gtttacatcgacaactaccactgcg

SEQ ID NO: 135127 - DNA, 25 bp, Homo sapien
actgcgatcccaacgacaaggtgtc

SEQ ID NO: 135128 - DNA, 25 bp, Homo sapien
atcccaacgacaaggtgtcctgtcc

SEQ ID NO: 135129 - DNA, 25 bp, Homo sapien
taccactgcgatcccaacgacaagg

SEQ ID NO: 135130 - DNA, 25 bp, Homo sapien
gacaacttcggagtttacatcgaca

SEQ ID NO: 135131 - DNA, 25 bp, Homo sapien
tggaggagatcagcccctccgtgga

SEQ ID NO: 135132 - DNA, 25 bp, Homo sapien
tccgtggacaacttcggagtttaca

SEQ ID NO: 135133 - DNA, 25 bp, Homo sapien
cttcggagtttacatcgacaactac

SEQ ID NO: 135134 - DNA, 25 bp, Homo sapien
gcactatgtcaccttcgacggactc

SEQ ID NO: 135135 - DNA, 25 bp, Homo sapien
agggcaactgcacctacgtgctggt

SEQ ID NO: 135136 - DNA, 25 bp, Homo sapien
taccagggcaactgcacctacgtgc

SEQ ID NO: 135137 - DNA, 25 bp, Homo sapien
ggactctactacagctaccagggca

SEQ ID NO: 135138 - DNA, 25 bp, Homo sapien
atgtcaccttcgacggactctacta

SEQ ID NO: 135139 - DNA, 25 bp, Homo sapien
ggggcgacccgcactatgtcacctt

SEQ ID NO: 135140 - DNA, 25 bp, Homo sapien
cccttgcaggctactgcacgggctg

SEQ ID NO: 135141 - DNA, 25 bp, Homo sapien
ccttcgacggactctactacagcta

SEQ ID NO: 135142 - DNA, 25 bp, Homo sapien
ctcttggctgcgctccgatgtcagc

SEQ ID NO: 135143 - DNA, 25 bp, Homo sapien
ccgatgtcagcgtgacctggagtca

SEQ ID NO: 135144 - DNA, 25 bp, Homo sapien
tctccgtcctagaaggggctcaatg

SEQ ID NO: 135145 - DNA, 25 bp, Homo sapien
caatgcctctcggtgttgccgcaaa

SEQ ID NO: 135146 - DNA, 25 bp, Homo sapien
ttgccgcaaatctaaccctaggatg

SEQ ID NO: 135147 - DNA, 25 bp, Homo sapien
cctaggatgcctttcttattaaagc

SEQ ID NO: 135148 - DNA, 25 bp, Homo sapien
tattaaagcgggaaacttctgcagg

SEQ ID NO: 135149 - DNA, 25 bp, Homo sapien
cagttcactgccctgcggttttgca

SEQ ID NO: 135150 - DNA, 25 bp, Homo sapien
ccgcctcttccaaggagtcgtcaga

SEQ ID NO: 135151 - DNA, 25 bp, Homo sapien
accgaagttgagcatggttggctgc

SEQ ID NO: 135152 - DNA, 25 bp, Homo sapien
ccaaatgacttaccgcagtctgctg

SEQ ID NO: 135153 - DNA, 25 bp, Homo sapien
taatgcccatagtctgcaggcagga

SEQ ID NO: 135154 - DNA, 25 bp, Homo sapien
ggtctccatgcggagttgtcccttc

SEQ ID NO: 135155 - DNA, 25 bp, Homo sapien
ggcatctctcctcggtaccaggtga

SEQ ID NO: 135156 - DNA, 25 bp, Homo sapien
gcgttcctgagccagaccgggcatc

SEQ ID NO: 135157 - DNA, 25 bp, Homo sapien
cccgtcttccaagcgtgggttcaga

SEQ ID NO: 135158 - DNA, 25 bp, Homo sapien
gctaaactttctccctccgtattca

SEQ ID NO: 135159 - DNA, 25 bp, Homo sapien
acagtggagaagcaagaaggagggc

SEQ ID NO: 135160 - DNA, 25 bp, Homo sapien
gctcgggctgggagctaaactttct

SEQ ID NO: 135161 - DNA, 25 bp, Homo sapien
caggagagtccgatgatgagtcagc

SEQ ID NO: 135162 - DNA, 25 bp, Homo sapien
gtccgatgatgagtcagcgctcagc

SEQ ID NO: 135163 - DNA, 25 bp, Homo sapien
gatgatgagtcagcgctcagcgctt

SEQ ID NO: 135164 - DNA, 25 bp, Homo sapien
tcagcgcttcagtcagtgagagatg

SEQ ID NO: 135165 - DNA, 25 bp, Homo sapien
cagcgctcagcgcttcagtcagtga

SEQ ID NO: 135166 - DNA, 25 bp, Homo sapien
cgggctcccgctgactcatcagaaa

SEQ ID NO: 135167 - DNA, 25 bp, Homo sapien
tctgcagagggtggttttcgccctc

SEQ ID NO: 135168 - DNA, 25 bp, Homo sapien
gcgatcggcactgaccaggtcacct

SEQ ID NO: 135169 - DNA, 25 bp, Homo sapien
cagcgtctgatgtcagcctggagct

SEQ ID NO: 135170 - DNA, 25 bp, Homo sapien
agcgggctctgcttcggaaactgtt

SEQ ID NO: 135171 - DNA, 25 bp, Homo sapien
tgacttcttgtaaaaggctccggcg

SEQ ID NO: 135172 - DNA, 25 bp, Homo sapien
cgctcgcgctgcgttattgggagaa

SEQ ID NO: 135173 - DNA, 25 bp, Homo sapien
gaaggcggttcctgagcaccagcac

SEQ ID NO: 135174 - DNA, 25 bp, Homo sapien
tccaaacgcctcgaccgccaggtgc

SEQ ID NO: 135175 - DNA, 25 bp, Homo sapien
ccaggcaggattcgagcgccaggga

SEQ ID NO: 135176 - DNA, 25 bp, Homo sapien
gcagcccgagccgtggcagtcacgt

SEQ ID NO: 135177 - DNA, 25 bp, Homo sapien
agcccgagccgtggcagtcacgtct

SEQ ID NO: 135178 - DNA, 25 bp, Homo sapien
caaagtaagagccagccgcagccgc

SEQ ID NO: 135179 - DNA, 25 bp, Homo sapien
ggcgagtcgcagcgccgcaaccacc

SEQ ID NO: 135180 - DNA, 25 bp, Homo sapien
gcgcctccagggctgtgcgcgggcg

SEQ ID NO: 135181 - DNA, 25 bp, Homo sapien
aaggaacgggcttggcgcgcactcg

SEQ ID NO: 135182 - DNA, 25 bp, Homo sapien
gcggcaccgacaccagctgtgtgca

SEQ ID NO: 135183 - DNA, 25 bp, Homo sapien
ctcggctcggtactcacgtgagata

SEQ ID NO: 135184 - DNA, 25 bp, Homo sapien
agcgtcttctctttttcggcggaat

SEQ ID NO: 135185 - DNA, 25 bp, Homo sapien
gatgtggttaccttgagcagaaata

SEQ ID NO: 135186 - DNA, 25 bp, Homo sapien
gcggccgcgatcagagcctgaaagt

SEQ ID NO: 135187 - DNA, 25 bp, Homo sapien
agcagaaatacccaaggcggcctgg

SEQ ID NO: 135188 - DNA, 25 bp, Homo sapien
ggattcggactcgtcacactgcaga

SEQ ID NO: 135189 - DNA, 25 bp, Homo sapien
gccagcgacgccagtatttatatta

SEQ ID NO: 135190 - DNA, 25 bp, Homo sapien
gttactgctgctacttcctcgtttg

SEQ ID NO: 135191 - DNA, 25 bp, Homo sapien
gaagcatgagctccggtcgctgcct

SEQ ID NO: 135192 - DNA, 25 bp, Homo sapien
tacttcctcgtttgacaccttcctg

SEQ ID NO: 135193 - DNA, 25 bp, Homo sapien
atagcgtccgctaggctgtctgcct

SEQ ID NO: 135194 - DNA, 25 bp, Homo sapien
atcgctgagccgatagcgtccgcta

SEQ ID NO: 135195 - DNA, 25 bp, Homo sapien
acgtgacttgttctgtgttcgcttg

SEQ ID NO: 135196 - DNA, 25 bp, Homo sapien
ctgtctgcctcggtacctgttactg

SEQ ID NO: 135197 - DNA, 25 bp, Homo sapien
gagtcctggtcaggccgaagcatga

SEQ ID NO: 135198 - DNA, 25 bp, Homo sapien
ccgctactacgagagctggacccgg

SEQ ID NO: 135199 - DNA, 25 bp, Homo sapien
ctactacgagagctggacccgggag

SEQ ID NO: 135200 - DNA, 25 bp, Homo sapien
ggagccgggcggatgccatcgagcc

SEQ ID NO: 135201 - DNA, 25 bp, Homo sapien
gaatccacctggctcacctacaccg

SEQ ID NO: 135202 - DNA, 25 bp, Homo sapien
tggctcacctacaccgactcggacg

SEQ ID NO: 135203 - DNA, 25 bp, Homo sapien
cctgcactcgggtaagtggccgggc

SEQ ID NO: 135204 - DNA, 25 bp, Homo sapien
gccgccagagccgacagccgagcag

SEQ ID NO: 135205 - DNA, 25 bp, Homo sapien
taatgccggccagacgggtccgagc

SEQ ID NO: 135206 - DNA, 25 bp, Homo sapien
agatttgcgcactttcctttcgacg

SEQ ID NO: 135207 - DNA, 25 bp, Homo sapien
gcagtctcgcgggatcgctcagctc

SEQ ID NO: 135208 - DNA, 25 bp, Homo sapien
ggcccgcacctgagtttcctcggaa

SEQ ID NO: 135209 - DNA, 25 bp, Homo sapien
ggaaccggctctgaaaggcgatgcc

SEQ ID NO: 135210 - DNA, 25 bp, Homo sapien
gcgcaggccaggaacgctgctgtct

SEQ ID NO: 135211 - DNA, 25 bp, Homo sapien
taattcgtaatccggggcctacagc

SEQ ID NO: 135212 - DNA, 25 bp, Homo sapien
cccgggacagatttgcgcactttcc

SEQ ID NO: 135213 - DNA, 25 bp, Homo sapien
ctcccgcaaggggactgccttcgcc

SEQ ID NO: 135214 - DNA, 25 bp, Homo sapien
cctcactgacggaaaggcgcggagc

SEQ ID NO: 135215 - DNA, 25 bp, Homo sapien
aagcggattctacctcggagagggc

SEQ ID NO: 135216 - DNA, 25 bp, Homo sapien
cacactgcgctagccctggagctgg

SEQ ID NO: 135217 - DNA, 25 bp, Homo sapien
agctggggttccgaccctcactgac

SEQ ID NO: 135218 - DNA, 25 bp, Homo sapien
ctgcaaccacggaccggtacggcgg

SEQ ID NO: 135219 - DNA, 25 bp, Homo sapien
actcggctctctctgcaaaacgggg

SEQ ID NO: 135220 - DNA, 25 bp, Homo sapien
agtctttccaggtcccgactcggct

SEQ ID NO: 135221 - DNA, 25 bp, Homo sapien
cgccctgcggaaagcggattctacc

SEQ ID NO: 135222 - DNA, 25 bp, Homo sapien
tcctgacaggccgagcgactgcagt

SEQ ID NO: 135223 - DNA, 25 bp, Homo sapien
aaggggaagcaaaaggcgcagctcc

SEQ ID NO: 135224 - DNA, 25 bp, Homo sapien
aaatgttcatttaggcggcgctgtg

SEQ ID NO: 135225 - DNA, 25 bp, Homo sapien
ggcctattacgggatggaagctccg

SEQ ID NO: 135226 - DNA, 25 bp, Homo sapien
ggagccagacgctgaccacgttcct

SEQ ID NO: 135227 - DNA, 25 bp, Homo sapien
ccatgccatagattgacgacccttg

SEQ ID NO: 135228 - DNA, 25 bp, Homo sapien
gacccttgaaggtggctcgtgtacc

SEQ ID NO: 135229 - DNA, 25 bp, Homo sapien
gtacccaggttaagccacgtgtctc

SEQ ID NO: 135230 - DNA, 25 bp, Homo sapien
caggatccagttgagccagcaggcc

SEQ ID NO: 135231 - DNA, 25 bp, Homo sapien
gcggaactcctagcggacacctcgt

SEQ ID NO: 135232 - DNA, 25 bp, Homo sapien
ctcttaccggcgaagcggatcttca

SEQ ID NO: 135233 - DNA, 25 bp, Homo sapien
ctagcctcggctttcgcggagtaaa

SEQ ID NO: 135234 - DNA, 25 bp, Homo sapien
tccgggaccaacgagaggactctta

SEQ ID NO: 135235 - DNA, 25 bp, Homo sapien
ttctcataccggacgtggcggaata

SEQ ID NO: 135236 - DNA, 25 bp, Homo sapien
caaggttggataagacgccgccgct

SEQ ID NO: 135237 - DNA, 25 bp, Homo sapien
tttccgcaagtcgttgggtctagcc

SEQ ID NO: 135238 - DNA, 25 bp, Homo sapien
ttgtcctccagagtcgtgtattgag

SEQ ID NO: 135239 - DNA, 25 bp, Homo sapien
cctcgtcctcctgagtcgtgtattg

SEQ ID NO: 135240 - DNA, 25 bp, Homo sapien
tccagagtcgtgtattgagtgctta

SEQ ID NO: 135241 - DNA, 25 bp, Homo sapien
ttgagtgcttactgagcgccacctc

SEQ ID NO: 135242 - DNA, 25 bp, Homo sapien
ctcgtcctcctgagtcgtgtattga

SEQ ID NO: 135243 - DNA, 25 bp, Homo sapien
ccttgtcctccagagtcgtgtattg

SEQ ID NO: 135244 - DNA, 25 bp, Homo sapien
agtgcttactgagcgccacctcctt

SEQ ID NO: 135245 - DNA, 25 bp, Homo sapien
tgtcctccagagtcgtgtattgagt

SEQ ID NO: 135246 - DNA, 25 bp, Homo sapien
tgcacgtcggagctcgcctggatcc

SEQ ID NO: 135247 - DNA, 25 bp, Homo sapien
ggaaaccgtcctcgcttcctcacga

SEQ ID NO: 135248 - DNA, 25 bp, Homo sapien
ggatgagttgcttctccgggaaacc

SEQ ID NO: 135249 - DNA, 25 bp, Homo sapien
agttctccctctgtggcgcgcggga

SEQ ID NO: 135250 - DNA, 25 bp, Homo sapien
gtcatatcttctccgctttcgcttc

SEQ ID NO: 135251 - DNA, 25 bp, Homo sapien
actccatcgacccaaggggcggcgg

SEQ ID NO: 135252 - DNA, 25 bp, Homo sapien
acccagcctggagatcgcgctcggg

SEQ ID NO: 135253 - DNA, 25 bp, Homo sapien
tttcgcttctccactctagccgggg

SEQ ID NO: 135254 - DNA, 25 bp, Homo sapien
ggaaagccacgtctcctccgggctg

SEQ ID NO: 135255 - DNA, 25 bp, Homo sapien
ctcccagagccggagtagcctgtct

SEQ ID NO: 135256 - DNA, 25 bp, Homo sapien
gaaaagcgggtcctcgtccaagatg

SEQ ID NO: 135257 - DNA, 25 bp, Homo sapien
agggtcccgtggcaccaacctggct

SEQ ID NO: 135258 - DNA, 25 bp, Homo sapien
ctccaataaattggaggtcccggcg

SEQ ID NO: 135259 - DNA, 25 bp, Homo sapien
gcgagacctcggacgttcactgcga

SEQ ID NO: 135260 - DNA, 25 bp, Homo sapien
aacagcaggagctactcggagcagc

SEQ ID NO: 135261 - DNA, 25 bp, Homo sapien
gcgtatcttgtaccgcgggaaaagc

SEQ ID NO: 135262 - DNA, 25 bp, Homo sapien
cagccacagccgtggagactaggca

SEQ ID NO: 135263 - DNA, 25 bp, Homo sapien
tccgcgaatgcagcatatatcctgc

SEQ ID NO: 135264 - DNA, 25 bp, Homo sapien
cctgctgatggcctaaggaacatac

SEQ ID NO: 135265 - DNA, 25 bp, Homo sapien
tgaagacagcctcacagcagcacga

SEQ ID NO: 135266 - DNA, 25 bp, Homo sapien
ggcttccgggccagagtcacaaaac

SEQ ID NO: 135267 - DNA, 25 bp, Homo sapien
gggagactcgcgtgtcctaaggaca

SEQ ID NO: 135268 - DNA, 25 bp, Homo sapien
caggaggctttgtcgcctctacccg

SEQ ID NO: 135269 - DNA, 25 bp, Homo sapien
ttctggcttccagactgcgggccca

SEQ ID NO: 135270 - DNA, 25 bp, Homo sapien
cacttctgacgacgctcctgttttc

SEQ ID NO: 135271 - DNA, 25 bp, Homo sapien
cagatgagtcggagacaggccaagc

SEQ ID NO: 135272 - DNA, 25 bp, Homo sapien
ccaagccggaacctcgctgggtaag

SEQ ID NO: 135273 - DNA, 25 bp, Homo sapien
gcgctgactcatggcgcgcactgga

SEQ ID NO: 135274 - DNA, 25 bp, Homo sapien
gcgttgcttgcagtctcatcctctc

SEQ ID NO: 135275 - DNA, 25 bp, Homo sapien
cggtggcggcgagagtaaacaactc

SEQ ID NO: 135276 - DNA, 25 bp, Homo sapien
tcctgttttccagcgaggaacctgc

SEQ ID NO: 135277 - DNA, 25 bp, Homo sapien
tgcagtcgccgtcatttaccagctg

SEQ ID NO: 135278 - DNA, 25 bp, Homo sapien
tgacctggccgcatatgcggctcct

SEQ ID NO: 135279 - DNA, 25 bp, Homo sapien
ggccacctccgagaagtcatcgttg

SEQ ID NO: 135280 - DNA, 25 bp, Homo sapien
gaagtcatcgttgaccacgcgaccc

SEQ ID NO: 135281 - DNA, 25 bp, Homo sapien
cttggggtgccctcctgcaaggtcc

SEQ ID NO: 135282 - DNA, 25 bp, Homo sapien
gacgggtttatgacctggccgcata

SEQ ID NO: 135283 - DNA, 25 bp, Homo sapien
cgcgagcccatgaaggggaactgca

SEQ ID NO: 135284 - DNA, 25 bp, Homo sapien
aagtcgtcgatggaccgcgagccca

SEQ ID NO: 135285 - DNA, 25 bp, Homo sapien
ctgcctcaggctgcaaatccggagc

SEQ ID NO: 135286 - DNA, 25 bp, Homo sapien
ggtcgcctcagctttgttcggtcag

SEQ ID NO: 135287 - DNA, 25 bp, Homo sapien
tcgccggtgagagaacttcctaacc

SEQ ID NO: 135288 - DNA, 25 bp, Homo sapien
gctttctcacagtcaagcatctttg

SEQ ID NO: 135289 - DNA, 25 bp, Homo sapien
aaaagcatctccgtgtggggacacc

SEQ ID NO: 135290 - DNA, 25 bp, Homo sapien
ctccaccgcggagactcttttgtgc

SEQ ID NO: 135291 - DNA, 25 bp, Homo sapien
ttttgtgctccagcgacaggccata

SEQ ID NO: 135292 - DNA, 25 bp, Homo sapien
cgcgctccgctggactttccaagtt

SEQ ID NO: 135293 - DNA, 25 bp, Homo sapien
cgacaggccataaccacagcagatg

SEQ ID NO: 135294 - DNA, 25 bp, Homo sapien
taggtgtaaaagttcgcgcctctgc

SEQ ID NO: 135295 - DNA, 25 bp, Homo sapien
aaatcagagcgtcagggtcccgatc

SEQ ID NO: 135296 - DNA, 25 bp, Homo sapien
tgacgtgggactactcttgggaacc

SEQ ID NO: 135297 - DNA, 25 bp, Homo sapien
gggcagtcccgctcctttagacgct

SEQ ID NO: 135298 - DNA, 25 bp, Homo sapien
ttttaattccgacccgcgcacgctg

SEQ ID NO: 135299 - DNA, 25 bp, Homo sapien
gaccgttcgcttgtacattcccatt

SEQ ID NO: 135300 - DNA, 25 bp, Homo sapien
tttgcttgctcatctccgaacgtga

SEQ ID NO: 135301 - DNA, 25 bp, Homo sapien
gcctgagcagtcgaagggacaacta

SEQ ID NO: 135302 - DNA, 25 bp, Homo sapien
tggatgagtgtcatccgccagcctg

SEQ ID NO: 135303 - DNA, 25 bp, Homo sapien
gtcgacgctcactggatgagggttc

SEQ ID NO: 135304 - DNA, 25 bp, Homo sapien
cggttcacgctcactggatgagtgt

SEQ ID NO: 135305 - DNA, 25 bp, Homo sapien
tgagctccggtccatgctcactgga

SEQ ID NO: 135306 - DNA, 25 bp, Homo sapien
tgagctccagtcgacgctcactgga

SEQ ID NO: 135307 - DNA, 25 bp, Homo sapien
gagggttctcatccggcagcctgag

SEQ ID NO: 135308 - DNA, 25 bp, Homo sapien
ccggttcacgctcactggatgagtg

SEQ ID NO: 135309 - DNA, 25 bp, Homo sapien
ggatgagtgtcatccgccagcctga

SEQ ID NO: 135310 - DNA, 25 bp, Homo sapien
cgcctgaaaggacgtgcgattcgga

SEQ ID NO: 135311 - DNA, 25 bp, Homo sapien
gctagccagtgatggtgccagctga

SEQ ID NO: 135312 - DNA, 25 bp, Homo sapien
cctacaaattggagtcctcggcact

SEQ ID NO: 135313 - DNA, 25 bp, Homo sapien
ggctcgagagcgagagtcacgtccc

SEQ ID NO: 135314 - DNA, 25 bp, Homo sapien
ctgccatatatagatcccgggagca

SEQ ID NO: 135315 - DNA, 25 bp, Homo sapien
tcgcactctgaaggacacgctgatc

SEQ ID NO: 135316 - DNA, 25 bp, Homo sapien
attcggagtgggctagcttatgcag

SEQ ID NO: 135317 - DNA, 25 bp, Homo sapien
gtttggaatcgagagcccagggcta

SEQ ID NO: 135318 - DNA, 25 bp, Homo sapien
gcgggagcccggtacccagcgcacc

SEQ ID NO: 135319 - DNA, 25 bp, Homo sapien
ccagcgcaccgagcccagtggagag

SEQ ID NO: 135320 - DNA, 25 bp, Homo sapien
atgcggagccgagtaaggcgcaacc

SEQ ID NO: 135321 - DNA, 25 bp, Homo sapien
gcggagccgagtaaggcgcaaccca

SEQ ID NO: 135322 - DNA, 25 bp, Homo sapien
ggagccgagtaaggcgcaacccagc

SEQ ID NO: 135323 - DNA, 25 bp, Homo sapien
ccgagtaaggcgcaacccagcgggc

SEQ ID NO: 135324 - DNA, 25 bp, Homo sapien
agtaaggcgcaacccagcgggcctc

SEQ ID NO: 135325 - DNA, 25 bp, Homo sapien
taaggcgcaacccagcgggcctcgg

SEQ ID NO: 135326 - DNA, 25 bp, Homo sapien
gctgcgtcaggctgagcccattcac

SEQ ID NO: 135327 - DNA, 25 bp, Homo sapien
gctagagtacccgaggccacatgtt

SEQ ID NO: 135328 - DNA, 25 bp, Homo sapien
ctggaatctgtctcccgctagagta

SEQ ID NO: 135329 - DNA, 25 bp, Homo sapien
cacatcatgatggagtcagcctgga

SEQ ID NO: 135330 - DNA, 25 bp, Homo sapien
caagcgtgtcttgaacagaacggca

SEQ ID NO: 135331 - DNA, 25 bp, Homo sapien
gccaatttgaaagcgggtggccatt

SEQ ID NO: 135332 - DNA, 25 bp, Homo sapien
ctggcgacccgcaagtaagtttgtg

SEQ ID NO: 135333 - DNA, 25 bp, Homo sapien
tctccgagccacttagccaatttga

SEQ ID NO: 135334 - DNA, 25 bp, Homo sapien
agcatggactacctgacgacgttca

SEQ ID NO: 135335 - DNA, 25 bp, Homo sapien
acctggtgagcccacctttctttcg

SEQ ID NO: 135336 - DNA, 25 bp, Homo sapien
cctgacgacgttcaccgagaagagt

SEQ ID NO: 135337 - DNA, 25 bp, Homo sapien
ctgcctcattttgcatttagaagcc

SEQ ID NO: 135338 - DNA, 25 bp, Homo sapien
cctatgtgacaagctaagttctgcc

SEQ ID NO: 135339 - DNA, 25 bp, Homo sapien
cggttccaggaagaatacacctatg

SEQ ID NO: 135340 - DNA, 25 bp, Homo sapien
gaggacccgtccagcttgcttaaaa

SEQ ID NO: 135341 - DNA, 25 bp, Homo sapien
tgcgcttcgaagattacctgaggga

SEQ ID NO: 135342 - DNA, 25 bp, Homo sapien
tgagtgcttactgagcgccacctcc

SEQ ID NO: 135343 - DNA, 25 bp, Homo sapien
tgtcctccagagtcgtgtattgagt

SEQ ID NO: 135344 - DNA, 25 bp, Homo sapien
gagtgcttactgagcgccacctcct

SEQ ID NO: 135345 - DNA, 25 bp, Homo sapien
tcctgagtcgtgtattgagtgctta

SEQ ID NO: 135346 - DNA, 25 bp, Homo sapien
tccagagtcgtgtattgagtgctta

SEQ ID NO: 135347 - DNA, 25 bp, Homo sapien
ttgagtgcttactgagcgccacctc

SEQ ID NO: 135348 - DNA, 25 bp, Homo sapien
tcctccagagtcgtgtattgagtgc

SEQ ID NO: 135349 - DNA, 25 bp, Homo sapien
agtgcttactgagcgccacctcctt

SEQ ID NO: 135350 - DNA, 25 bp, Homo sapien
ccttggcagtggctgtaatccatgc

SEQ ID NO: 135351 - DNA, 25 bp, Homo sapien
gcgcagggctaaaagaacgctctta

SEQ ID NO: 135352 - DNA, 25 bp, Homo sapien
taagctccgacccagcggcataatg

SEQ ID NO: 135353 - DNA, 25 bp, Homo sapien
gcgccttcgcacgtcccaatttaaa

SEQ ID NO: 135354 - DNA, 25 bp, Homo sapien
cgcctctcaaagtctaggaactgga

SEQ ID NO: 135355 - DNA, 25 bp, Homo sapien
tcgcttactgcgtctccatcggttg

SEQ ID NO: 135356 - DNA, 25 bp, Homo sapien
tccgccacgaacctgagagacaaga

SEQ ID NO: 135357 - DNA, 25 bp, Homo sapien
acgctcttaggccatttggagtcca

SEQ ID NO: 135358 - DNA, 25 bp, Homo sapien
ctgccgaatagtgcggtgcttctta

SEQ ID NO: 135359 - DNA, 25 bp, Homo sapien
taaaactttattggtagcgccgaca

SEQ ID NO: 135360 - DNA, 25 bp, Homo sapien
tagatgccgatccaaaaagtgcgcg

SEQ ID NO: 135361 - DNA, 25 bp, Homo sapien
tcgcacgtgtcaggcctaggactac

SEQ ID NO: 135362 - DNA, 25 bp, Homo sapien
gtgcttcttaactgagacgacgcta

SEQ ID NO: 135363 - DNA, 25 bp, Homo sapien
cgttctctagcgaaaccagcgaatc

SEQ ID NO: 135364 - DNA, 25 bp, Homo sapien
ctgcgcatgtgctgtggtaaaactg

SEQ ID NO: 135365 - DNA, 25 bp, Homo sapien
tgtccgtccaggaaccaaactcgcg

SEQ ID NO: 135366 - DNA, 25 bp, Homo sapien
ccggacgcgtactctgcagcgtttc

SEQ ID NO: 135367 - DNA, 25 bp, Homo sapien
ttttggtaccagagccctcactgta

SEQ ID NO: 135368 - DNA, 25 bp, Homo sapien
cgccagcagccagggtatcctgaga

SEQ ID NO: 135369 - DNA, 25 bp, Homo sapien
tatcctgagattgcgggagcgccac

SEQ ID NO: 135370 - DNA, 25 bp, Homo sapien
ccctctgctctcttggccaatgaga

SEQ ID NO: 135371 - DNA, 25 bp, Homo sapien
ccgctgcctctaggttctgggaaga

SEQ ID NO: 135372 - DNA, 25 bp, Homo sapien
agatggcgaaggtctcagagcttta

SEQ ID NO: 135373 - DNA, 25 bp, Homo sapien
cagagctttacgatgtcacttggga

SEQ ID NO: 135374 - DNA, 25 bp, Homo sapien
gggctctcacccttgcattcaaagc

SEQ ID NO: 135375 - DNA, 25 bp, Homo sapien
ccgcctagtactcggagacgaagga

SEQ ID NO: 135376 - DNA, 25 bp, Homo sapien
cgaggaatccggctatccatttctg

SEQ ID NO: 135377 - DNA, 25 bp, Homo sapien
ccaatcaccagctacggcacttgta

SEQ ID NO: 135378 - DNA, 25 bp, Homo sapien
ccatttctggtgaactctgcgccca

SEQ ID NO: 135379 - DNA, 25 bp, Homo sapien
tgcgcccactgaggcattcgaggta

SEQ ID NO: 135380 - DNA, 25 bp, Homo sapien
ttcgaggtacggatgtgtccgccta

SEQ ID NO: 135381 - DNA, 25 bp, Homo sapien
tccagctctgctaggctccagggct

SEQ ID NO: 135382 - DNA, 25 bp, Homo sapien
cgacggcaaggtctgaactctgtta

SEQ ID NO: 135383 - DNA, 25 bp, Homo sapien
cggggatccaacagaggtctcttca

SEQ ID NO: 135384 - DNA, 25 bp, Homo sapien
tcacccgtagggagcaattagccgc

SEQ ID NO: 135385 - DNA, 25 bp, Homo sapien
tgcatgctgggctatgtagttctcc

SEQ ID NO: 135386 - DNA, 25 bp, Homo sapien
tcctcagcgcaagggtcatttcgtc

SEQ ID NO: 135387 - DNA, 25 bp, Homo sapien
tgctaccggagttggcctgaaacca

SEQ ID NO: 135388 - DNA, 25 bp, Homo sapien
gggccgcagcgtgagaattaataaa

SEQ ID NO: 135389 - DNA, 25 bp, Homo sapien
ggcccgcgctggttaaattctcaca

SEQ ID NO: 135390 - DNA, 25 bp, Homo sapien
gcttggttctcccgcgaaggttcca

SEQ ID NO: 135391 - DNA, 25 bp, Homo sapien
gctgcgagcggagggcaccaactcc

SEQ ID NO: 135392 - DNA, 25 bp, Homo sapien
cagctgcgagcggagggcaccaact

SEQ ID NO: 135393 - DNA, 25 bp, Homo sapien
agcactagagccagctgcgagcgga

SEQ ID NO: 135394 - DNA, 25 bp, Homo sapien
cgagctccagcactagagccagctg

SEQ ID NO: 135395 - DNA, 25 bp, Homo sapien
aagcgggcccgccagcgagtcgcag

SEQ ID NO: 135396 - DNA, 25 bp, Homo sapien
cagctctcccgggacgaagcgggcc

SEQ ID NO: 135397 - DNA, 25 bp, Homo sapien
ctcccgcgaaggttccagggtgtgt

SEQ ID NO: 135398 - DNA, 25 bp, Homo sapien
tagtcaacgccatgttcttcaagcg

SEQ ID NO: 135399 - DNA, 25 bp, Homo sapien
acggacggcgccctgctagtcaacg

SEQ ID NO: 135400 - DNA, 25 bp, Homo sapien
cccgaggtcaccaaggacgtggagc

SEQ ID NO: 135401 - DNA, 25 bp, Homo sapien
gcgacaagcgcagcgcgctgcagtc

SEQ ID NO: 135402 - DNA, 25 bp, Homo sapien
agctgggcagccgactgtacggacc

SEQ ID NO: 135403 - DNA, 25 bp, Homo sapien
tccaagatcaacttccgcgacaagc

SEQ ID NO: 135404 - DNA, 25 bp, Homo sapien
ccgactgtacggacccagctcagtg

SEQ ID NO: 135405 - DNA, 25 bp, Homo sapien
ccatgttcttcaagcgtgagtcggg

SEQ ID NO: 135406 - DNA, 25 bp, Homo sapien
agggctcattggctcccagtctcga

SEQ ID NO: 135407 - DNA, 25 bp, Homo sapien
ctctcacctattgggccagccagga

SEQ ID NO: 135408 - DNA, 25 bp, Homo sapien
ccagccctagcctctggggcattgt

SEQ ID NO: 135409 - DNA, 25 bp, Homo sapien
ggacccaggcgtgcagcattcgcca

SEQ ID NO: 135410 - DNA, 25 bp, Homo sapien
atttgcgtgaccttactgccctccg

SEQ ID NO: 135411 - DNA, 25 bp, Homo sapien
cttgtacctctccaggccgattttt

SEQ ID NO: 135412 - DNA, 25 bp, Homo sapien
ccagcaacttagagcgtttcacgtc

SEQ ID NO: 135413 - DNA, 25 bp, Homo sapien
gccttcctcagggaaatttgcgtga

SEQ ID NO: 135414 - DNA, 25 bp, Homo sapien
tggtgccgcactcgctagaggcagc

SEQ ID NO: 135415 - DNA, 25 bp, Homo sapien
ctctccaaggagctcggcccggtgt

SEQ ID NO: 135416 - DNA, 25 bp, Homo sapien
tccttaccttgctctcgcggagggg

SEQ ID NO: 135417 - DNA, 25 bp, Homo sapien
cggcggctcttggtgaggctccaac

SEQ ID NO: 135418 - DNA, 25 bp, Homo sapien
tcttggtgaggctccaacgcgccgc

SEQ ID NO: 135419 - DNA, 25 bp, Homo sapien
tgccgccgattgctctgggctccga

SEQ ID NO: 135420 - DNA, 25 bp, Homo sapien
acctgcggccttcggggcaactcga

SEQ ID NO: 135421 - DNA, 25 bp, Homo sapien
ttcggggcaactcgaccgcgcctgg

SEQ ID NO: 135422 - DNA, 25 bp, Homo sapien
gaagaccatcagttgccctcccgtg

SEQ ID NO: 135423 - DNA, 25 bp, Homo sapien
tgccctcattgtaccgaagaccatc

SEQ ID NO: 135424 - DNA, 25 bp, Homo sapien
cgtgtccgcgggcactgacagcaga

SEQ ID NO: 135425 - DNA, 25 bp, Homo sapien
tgacagcagagaccgcataggcgcc

SEQ ID NO: 135426 - DNA, 25 bp, Homo sapien
ccttagcccggcttggacacgtggt

SEQ ID NO: 135427 - DNA, 25 bp, Homo sapien
accctggatacctcccgcattggaa

SEQ ID NO: 135428 - DNA, 25 bp, Homo sapien
tcccgcattggaaagggtggtcctg

SEQ ID NO: 135429 - DNA, 25 bp, Homo sapien
caggaggaggcacctacgtgcgccc

SEQ ID NO: 135430 - DNA, 25 bp, Homo sapien
tgccgcccacgttgaccgtgaagca

SEQ ID NO: 135431 - DNA, 25 bp, Homo sapien
agcaggaatcgatgctgagctcatc

SEQ ID NO: 135432 - DNA, 25 bp, Homo sapien
gaaggggttacctctccttggcgca

SEQ ID NO: 135433 - DNA, 25 bp, Homo sapien
tctgccgctggaaggcatctctaac

SEQ ID NO: 135434 - DNA, 25 bp, Homo sapien
cctcgctgcagaagacactagagtc

SEQ ID NO: 135435 - DNA, 25 bp, Homo sapien
gggttggcatcgtcgcaaagctcca

SEQ ID NO: 135436 - DNA, 25 bp, Homo sapien
gtagtgcaggacatatcggaacgcc

SEQ ID NO: 135437 - DNA, 25 bp, Homo sapien
cccagtactggatctcctgcaggaa

SEQ ID NO: 135438 - DNA, 25 bp, Homo sapien
tcgcccttcactgttctactgaacg

SEQ ID NO: 135439 - DNA, 25 bp, Homo sapien
attcgacggggctccgaatcccatc

SEQ ID NO: 135440 - DNA, 25 bp, Homo sapien
gccggacgctctgcctgcggctcct

SEQ ID NO: 135441 - DNA, 25 bp, Homo sapien
agcttccacatggtcaggcgggctc

SEQ ID NO: 135442 - DNA, 25 bp, Homo sapien
ggcccagcttccacatggtcaggcg

SEQ ID NO: 135443 - DNA, 25 bp, Homo sapien
tcaccaaggcaacggccgggagcgc

SEQ ID NO: 135444 - DNA, 25 bp, Homo sapien
acgtccgctcgggtcaccaaggcaa

SEQ ID NO: 135445 - DNA, 25 bp, Homo sapien
tgttctactgaacgacgtcctcacc

SEQ ID NO: 135446 - DNA, 25 bp, Homo sapien
ccggcgttcatttagcgtctgcggg

SEQ ID NO: 135447 - DNA, 25 bp, Homo sapien
cgttcattcatttagcgtctgaggc

SEQ ID NO: 135448 - DNA, 25 bp, Homo sapien
cccgttcatttagtgtctgaggcgg

SEQ ID NO: 135449 - DNA, 25 bp, Homo sapien
agaccagcgtccgtttggcgtctga

SEQ ID NO: 135450 - DNA, 25 bp, Homo sapien
ccggcattcatttagcgtctgaggc

SEQ ID NO: 135451 - DNA, 25 bp, Homo sapien
tcatttagcgtctgcggggtgccca

SEQ ID NO: 135452 - DNA, 25 bp, Homo sapien
ggtgcccaggttcgacagcatctca

SEQ ID NO: 135453 - DNA, 25 bp, Homo sapien
tggggagaccggcattcatttagcg

SEQ ID NO: 135454 - DNA, 25 bp, Homo sapien
tccaggagggaaactgtgttccagc

SEQ ID NO: 135455 - DNA, 25 bp, Homo sapien
ctcttagtctacacgtgaggtctga

SEQ ID NO: 135456 - DNA, 25 bp, Homo sapien
gaggtctgactcgaccggtccagga

SEQ ID NO: 135457 - DNA, 25 bp, Homo sapien
cgtactcttcttttgatcctcttag

SEQ ID NO: 135458 - DNA, 25 bp, Homo sapien
tgttccagctgagctctacccagcg

SEQ ID NO: 135459 - DNA, 25 bp, Homo sapien
cctgcgcttacgctaagcgtgtccg

SEQ ID NO: 135460 - DNA, 25 bp, Homo sapien
ggcgccgcaggtaacgtactcttct

SEQ ID NO: 135461 - DNA, 25 bp, Homo sapien
ggcacatctggtctgcgcacaaccg

SEQ ID NO: 135462 - DNA, 25 bp, Homo sapien
ttatttgagtgaggacagcgctgcg

SEQ ID NO: 135463 - DNA, 25 bp, Homo sapien
aaagcgctgttacccgccaggcgtt

SEQ ID NO: 135464 - DNA, 25 bp, Homo sapien
gtcctgggaacattaaagcgctgtt

SEQ ID NO: 135465 - DNA, 25 bp, Homo sapien
cactggccatctggagtcctgggaa

SEQ ID NO: 135466 - DNA, 25 bp, Homo sapien
cttcatcgtgacagcagtggtcgca

SEQ ID NO: 135467 - DNA, 25 bp, Homo sapien
gacgttgcagaggagccacaatccc

SEQ ID NO: 135468 - DNA, 25 bp, Homo sapien
cccgagtgcgtcttagataagttat

SEQ ID NO: 135469 - DNA, 25 bp, Homo sapien
aaagggagcttcctccgcacttcta

SEQ ID NO: 135470 - DNA, 25 bp, Homo sapien
cggcctccacgcagctggcagggca

SEQ ID NO: 135471 - DNA, 25 bp, Homo sapien
cgcagctcctgttgtgtcgccgctg

SEQ ID NO: 135472 - DNA, 25 bp, Homo sapien
atgagagaggtaaccggagggaacg

SEQ ID NO: 135473 - DNA, 25 bp, Homo sapien
acaactgcttccgcaggacttcctg

SEQ ID NO: 135474 - DNA, 25 bp, Homo sapien
aggacttcctgcgataacacgccca

SEQ ID NO: 135475 - DNA, 25 bp, Homo sapien
ggctcctgcgagagcgaacgccagc

SEQ ID NO: 135476 - DNA, 25 bp, Homo sapien
agagcgaacgccagcgacacacacg

SEQ ID NO: 135477 - DNA, 25 bp, Homo sapien
acacgcagctcctgttgtgtcgccg

SEQ ID NO: 135478 - DNA, 25 bp, Homo sapien
ggcacagaccgctcggccaagctgt

SEQ ID NO: 135479 - DNA, 25 bp, Homo sapien
tcaaccgcatcgcagaggaagtctg

SEQ ID NO: 135480 - DNA, 25 bp, Homo sapien
aggcatttaatcaccggccagtgtc

SEQ ID NO: 135481 - DNA, 25 bp, Homo sapien
ccaagctgtcctgagccgctctgag

SEQ ID NO: 135482 - DNA, 25 bp, Homo sapien
gacacatggcgcatcaaccgcatcg

SEQ ID NO: 135483 - DNA, 25 bp, Homo sapien
gtctgtccgcttggatgtcccaccg

SEQ ID NO: 135484 - DNA, 25 bp, Homo sapien
tgtcccaccgctgtcaggcatttaa

SEQ ID NO: 135485 - DNA, 25 bp, Homo sapien
ccacatggtacggacagggcacaga

SEQ ID NO: 135486 - DNA, 25 bp, Homo sapien
tggggtccattgtgtgaggactaac

SEQ ID NO: 135487 - DNA, 25 bp, Homo sapien
cgaaagtgtcgctccagtccgagtt

SEQ ID NO: 135488 - DNA, 25 bp, Homo sapien
gtgaggactaacatcgcggcctttc

SEQ ID NO: 135489 - DNA, 25 bp, Homo sapien
agccaggccttctagcggcccaaag

SEQ ID NO: 135490 - DNA, 25 bp, Homo sapien
ctgctgtttccgagccgagagccct

SEQ ID NO: 135491 - DNA, 25 bp, Homo sapien
ccatccagtttcagcgggtcgcctt

SEQ ID NO: 135492 - DNA, 25 bp, Homo sapien
tggggagcctcccattccagagacc

SEQ ID NO: 135493 - DNA, 25 bp, Homo sapien
tgtcccttgtccacatagaccgtct

SEQ ID NO: 135494 - DNA, 25 bp, Homo sapien
tcggagcgccgcaaatgagagcggc

SEQ ID NO: 135495 - DNA, 25 bp, Homo sapien
cacctcccgtctgtgaacgtgcggg

SEQ ID NO: 135496 - DNA, 25 bp, Homo sapien
ctcccgtctgtgaacgtgcgggctg

SEQ ID NO: 135497 - DNA, 25 bp, Homo sapien
atccgaacgcgttaggaataatgtg

SEQ ID NO: 135498 - DNA, 25 bp, Homo sapien
cgcgttaggaataatgtgataaaga

SEQ ID NO: 135499 - DNA, 25 bp, Homo sapien
tgataaagacgaggacttaccttgg

SEQ ID NO: 135500 - DNA, 25 bp, Homo sapien
gctgcgcgagaacttcgcccgagtc

SEQ ID NO: 135501 - DNA, 25 bp, Homo sapien
agaacttcgcccgagtcggagcgcc

SEQ ID NO: 135502 - DNA, 25 bp, Homo sapien
agagaaacgtgagttaccggaagcg

SEQ ID NO: 135503 - DNA, 25 bp, Homo sapien
accggaagcggaagtacaagtctcg

SEQ ID NO: 135504 - DNA, 25 bp, Homo sapien
tacaagtctcgcgtgacgtcactcg

SEQ ID NO: 135505 - DNA, 25 bp, Homo sapien
ccatctttccaagcagacaggaaga

SEQ ID NO: 135506 - DNA, 25 bp, Homo sapien
gcgggacgccatctttccaagcaga

SEQ ID NO: 135507 - DNA, 25 bp, Homo sapien
ggtaccttccttgcgggacgccatc

SEQ ID NO: 135508 - DNA, 25 bp, Homo sapien
ggctgaatctcccgagccgcctttg

SEQ ID NO: 135509 - DNA, 25 bp, Homo sapien
acgtcactcgcaggccggcgttcga

SEQ ID NO: 135510 - DNA, 25 bp, Homo sapien
cgagctcaggaggtgcaaaacgccc

SEQ ID NO: 135511 - DNA, 25 bp, Homo sapien
ccagcggttttccagcgtacgcaca

SEQ ID NO: 135512 - DNA, 25 bp, Homo sapien
cgtacgcacaagttccgccctaagg

SEQ ID NO: 135513 - DNA, 25 bp, Homo sapien
cgcgctggtctggacatgacgtaaa

SEQ ID NO: 135514 - DNA, 25 bp, Homo sapien
tccgtggccaaaggcgcttcatttc

SEQ ID NO: 135515 - DNA, 25 bp, Homo sapien
gcgtgaggcgtttactgatgcttcc

SEQ ID NO: 135516 - DNA, 25 bp, Homo sapien
gcgagccgtaccagatcctgctgga

SEQ ID NO: 135517 - DNA, 25 bp, Homo sapien
cgttgctcacagaccttcattgcga

SEQ ID NO: 135518 - DNA, 25 bp, Homo sapien
gacagccatttttacccgcggagta

SEQ ID NO: 135519 - DNA, 25 bp, Homo sapien
ctgagcaagcgcaaaggtgattctc

SEQ ID NO: 135520 - DNA, 25 bp, Homo sapien
ccgccctctgtttgtggagtccaca

SEQ ID NO: 135521 - DNA, 25 bp, Homo sapien
ggcgcaggcgcaatgactatttcct

SEQ ID NO: 135522 - DNA, 25 bp, Homo sapien
tcaaaatggtacctgtgcgcctgcg

SEQ ID NO: 135523 - DNA, 25 bp, Homo sapien
atcggcaggatgtttacggtcaaaa

SEQ ID NO: 135524 - DNA, 25 bp, Homo sapien
tctcttaccttgctctccgctggga

SEQ ID NO: 135525 - DNA, 25 bp, Homo sapien
tggacctgcagggtaacagcctttg

SEQ ID NO: 135526 - DNA, 25 bp, Homo sapien
ggactcccaggtagagcggagcttt

SEQ ID NO: 135527 - DNA, 25 bp, Homo sapien
gacttccgccgctgcagagagagaa

SEQ ID NO: 135528 - DNA, 25 bp, Homo sapien
agagagagaatttcccaggggctcc

SEQ ID NO: 135529 - DNA, 25 bp, Homo sapien
agcggagctttggttcccacctcgt

SEQ ID NO: 135530 - DNA, 25 bp, Homo sapien
tcccgcgtgcgacttcttcggggac

SEQ ID NO: 135531 - DNA, 25 bp, Homo sapien
acggcaggagcacggacatccagga

SEQ ID NO: 135532 - DNA, 25 bp, Homo sapien
tggaggacctcagacgacggctgac

SEQ ID NO: 135533 - DNA, 25 bp, Homo sapien
cctcaggtctggacacggcgttgac

SEQ ID NO: 135534 - DNA, 25 bp, Homo sapien
gagatcttccagctcctgaggaaca

SEQ ID NO: 135535 - DNA, 25 bp, Homo sapien
aggggtccaatccaatccagcccgg

SEQ ID NO: 135536 - DNA, 25 bp, Homo sapien
gctccgctcggagacagttcgccga

SEQ ID NO: 135537 - DNA, 25 bp, Homo sapien
gggcggtgtctatgacgttttctga

SEQ ID NO: 135538 - DNA, 25 bp, Homo sapien
aagtcgcggccgctgttttgaaatc

SEQ ID NO: 135539 - DNA, 25 bp, Homo sapien
ggggtctctcaagctggttccaacg

SEQ ID NO: 135540 - DNA, 25 bp, Homo sapien
ggacatcgtgtaccgcaccatggag

SEQ ID NO: 135541 - DNA, 25 bp, Homo sapien
cccgggaagtcaacacggcgtcgct

SEQ ID NO: 135542 - DNA, 25 bp, Homo sapien
atccgggtctgcgttcagcccaggc

SEQ ID NO: 135543 - DNA, 25 bp, Homo sapien
ctgcgttcagcccaggcgcgtaagg

SEQ ID NO: 135544 - DNA, 25 bp, Homo sapien
cccaggcgcgtaagggtgacgccat

SEQ ID NO: 135545 - DNA, 25 bp, Homo sapien
tgacgccatccgggtctccgttcag

SEQ ID NO: 135546 - DNA, 25 bp, Homo sapien
ggtctgcgttcagcccaggcgcgta

SEQ ID NO: 135547 - DNA, 25 bp, Homo sapien
gacgccatccgggtctgcgttcagc

SEQ ID NO: 135548 - DNA, 25 bp, Homo sapien
taagggtgacgccatccgggtctgc

SEQ ID NO: 135549 - DNA, 25 bp, Homo sapien
ccaggcgcgtaagggtgacgccatc

SEQ ID NO: 135550 - DNA, 25 bp, Homo sapien
gtcgccgaatgttacccggttctga

SEQ ID NO: 135551 - DNA, 25 bp, Homo sapien
gggcggtgcttccgctgcgcccatt

SEQ ID NO: 135552 - DNA, 25 bp, Homo sapien
cgctgccattggccgagcgtcacgt

SEQ ID NO: 135553 - DNA, 25 bp, Homo sapien
acagcgctgacctcatccatccacg

SEQ ID NO: 135554 - DNA, 25 bp, Homo sapien
tccattcccgacacgacagcgctga

SEQ ID NO: 135555 - DNA, 25 bp, Homo sapien
gttacacttacacattccattcccg

SEQ ID NO: 135556 - DNA, 25 bp, Homo sapien
gccgcgttcggtcgccgaatgttac

SEQ ID NO: 135557 - DNA, 25 bp, Homo sapien
cccggttctgaatgttacacttaca

SEQ ID NO: 135558 - DNA, 25 bp, Homo sapien
tcagagcttccctaacgcatgcata

SEQ ID NO: 135559 - DNA, 25 bp, Homo sapien
atcgccaagcttcatcggggatgtg

SEQ ID NO: 135560 - DNA, 25 bp, Homo sapien
cataattttcttggccgaggtactc

SEQ ID NO: 135561 - DNA, 25 bp, Homo sapien
tcctctcgctttcgcctaaatattc

SEQ ID NO: 135562 - DNA, 25 bp, Homo sapien
gcctaaatattctgcgcttatctgc

SEQ ID NO: 135563 - DNA, 25 bp, Homo sapien
gcttatctgctccaggaccaacctg

SEQ ID NO: 135564 - DNA, 25 bp, Homo sapien
aacctgccgcggtcacgcaaagcga

SEQ ID NO: 135565 - DNA, 25 bp, Homo sapien
cctcccttcgctcggactggggaga

SEQ ID NO: 135566 - DNA, 25 bp, Homo sapien
ggacttaccacgagcgcgcagcaca

SEQ ID NO: 135567 - DNA, 25 bp, Homo sapien
cagcccgtgcgctcatcacgttata

SEQ ID NO: 135568 - DNA, 25 bp, Homo sapien
cgcgcagcacagcaagttgttcatt

SEQ ID NO: 135569 - DNA, 25 bp, Homo sapien
ccgtgcgctcatcacgttatatata

SEQ ID NO: 135570 - DNA, 25 bp, Homo sapien
acagcaagttgttcattgtggtccc

SEQ ID NO: 135571 - DNA, 25 bp, Homo sapien
gttatatatagcgtcccggcaacag

SEQ ID NO: 135572 - DNA, 25 bp, Homo sapien
tggcccagggacttaccacgagcgc

SEQ ID NO: 135573 - DNA, 25 bp, Homo sapien
cgtcggctggcccagggacttacca

SEQ ID NO: 135574 - DNA, 25 bp, Homo sapien
cctaggagagtctgtagagtccctc

SEQ ID NO: 135575 - DNA, 25 bp, Homo sapien
tcctgaccggccaatgtggttccca

SEQ ID NO: 135576 - DNA, 25 bp, Homo sapien
ggccacgccatgatgctagctgaaa

SEQ ID NO: 135577 - DNA, 25 bp, Homo sapien
agcgatgtccgctttgtccaactgg

SEQ ID NO: 135578 - DNA, 25 bp, Homo sapien
ggtggcctccgagtacttggtgaaa

SEQ ID NO: 135579 - DNA, 25 bp, Homo sapien
caggctcggtaatcctgccgcatca

SEQ ID NO: 135580 - DNA, 25 bp, Homo sapien
gagtccctcgattaccggtcgcaaa

SEQ ID NO: 135581 - DNA, 25 bp, Homo sapien
cgcaaacgcctttgggagcgcagtc

SEQ ID NO: 135582 - DNA, 25 bp, Homo sapien
acctttgtcctctcgctgggcgaaa

SEQ ID NO: 135583 - DNA, 25 bp, Homo sapien
tggagtgtgtcccagacctttgtcc

SEQ ID NO: 135584 - DNA, 25 bp, Homo sapien
gacgcagttggagtgtgtcccagac

SEQ ID NO: 135585 - DNA, 25 bp, Homo sapien
tccagccaagatccggacgcagttg

SEQ ID NO: 135586 - DNA, 25 bp, Homo sapien
gaaagctgtgagtttccgccgtacc

SEQ ID NO: 135587 - DNA, 25 bp, Homo sapien
ccctgagagtccgatccagccaaga

SEQ ID NO: 135588 - DNA, 25 bp, Homo sapien
gtgcttgtgtctcctccaccctgag

SEQ ID NO: 135589 - DNA, 25 bp, Homo sapien
cacacgctgggcagctgctgtgctt

SEQ ID NO: 135590 - DNA, 25 bp, Homo sapien
ctccttcccttcgacgtggctttgt

SEQ ID NO: 135591 - DNA, 25 bp, Homo sapien
tgcaatagccgcacctgtgcacgtg

SEQ ID NO: 135592 - DNA, 25 bp, Homo sapien
gccttcgtctgcctggagattgtaa

SEQ ID NO: 135593 - DNA, 25 bp, Homo sapien
gacgtggctttgtcctgcgctccct

SEQ ID NO: 135594 - DNA, 25 bp, Homo sapien
tagcacctgttacgcgggcacctgc

SEQ ID NO: 135595 - DNA, 25 bp, Homo sapien
ggcgcctttagaaacccagggcatg

SEQ ID NO: 135596 - DNA, 25 bp, Homo sapien
ttggccggagcgagctcctggctct

SEQ ID NO: 135597 - DNA, 25 bp, Homo sapien
gacatcctgcggacctactcgggcg

SEQ ID NO: 135598 - DNA, 25 bp, Homo sapien
ctgcactgcagccaaccggcttgtg

SEQ ID NO: 135599 - DNA, 25 bp, Homo sapien
gtcccagctgagtggtttctccttg

SEQ ID NO: 135600 - DNA, 25 bp, Homo sapien
tcctgggacaggtaagtggcacacc

SEQ ID NO: 135601 - DNA, 25 bp, Homo sapien
agtgcctttgcctgaccttcctgct

SEQ ID NO: 135602 - DNA, 25 bp, Homo sapien
tttgtctccgaaagcagtgcctttg

SEQ ID NO: 135603 - DNA, 25 bp, Homo sapien
tgtgcagagcacgagcttttgtctc

SEQ ID NO: 135604 - DNA, 25 bp, Homo sapien
tataaaacctgtgctgggcgtgatc

SEQ ID NO: 135605 - DNA, 25 bp, Homo sapien
gagcagtgccaatctacagcgaaga

SEQ ID NO: 135606 - DNA, 25 bp, Homo sapien
tcgctccttcgactagctcctagaa

SEQ ID NO: 135607 - DNA, 25 bp, Homo sapien
agccgccgtcgacaagcttctgtca

SEQ ID NO: 135608 - DNA, 25 bp, Homo sapien
cttctgtcacagagatgctcctctc

SEQ ID NO: 135609 - DNA, 25 bp, Homo sapien
tgctcctctccgcaagggctcgaag

SEQ ID NO: 135610 - DNA, 25 bp, Homo sapien
agggctcgaagctaccatccgccga

SEQ ID NO: 135611 - DNA, 25 bp, Homo sapien
ccgacatcttgtctgtaacctctga

SEQ ID NO: 135612 - DNA, 25 bp, Homo sapien
tgacctccgacgtcagcggaagtgg

SEQ ID NO: 135613 - DNA, 25 bp, Homo sapien
tacggggcattactagtctttggca

SEQ ID NO: 135614 - DNA, 25 bp, Homo sapien
agctccagcaggcagaagtcgccgg

SEQ ID NO: 135615 - DNA, 25 bp, Homo sapien
cgctgagaaaataacgtggccggcc

SEQ ID NO: 135616 - DNA, 25 bp, Homo sapien
ttggcgatctgcagcgtcgcatcca

SEQ ID NO: 135617 - DNA, 25 bp, Homo sapien
ctcttcatcgcagcgccgggtctag

SEQ ID NO: 135618 - DNA, 25 bp, Homo sapien
aaacctgagcgtttgaaagcgcgcc

SEQ ID NO: 135619 - DNA, 25 bp, Homo sapien
cgactgcaggaaggaaacgcggctt

SEQ ID NO: 135620 - DNA, 25 bp, Homo sapien
ggtttccagccgatgctcccatttc

SEQ ID NO: 135621 - DNA, 25 bp, Homo sapien
agctcggccgcattcagcttggcga

SEQ ID NO: 135622 - DNA, 25 bp, Homo sapien
atagggattccctctccagccaatc

SEQ ID NO: 135623 - DNA, 25 bp, Homo sapien
gcgcgtctgcctacccatagggatt

SEQ ID NO: 135624 - DNA, 25 bp, Homo sapien
tccagccaatccagtcagagcagcg

SEQ ID NO: 135625 - DNA, 25 bp, Homo sapien
agccgcacggccctaaaaccatgga

SEQ ID NO: 135626 - DNA, 25 bp, Homo sapien
cagctacggtaaggcaagagacaca

SEQ ID NO: 135627 - DNA, 25 bp, Homo sapien
ggtgagctcacgatggcactgccaa

SEQ ID NO: 135628 - DNA, 25 bp, Homo sapien
agcctgcgcctcatccgcgaagaga

SEQ ID NO: 135629 - DNA, 25 bp, Homo sapien
agctcaagtttctggggccggacta

SEQ ID NO: 135630 - DNA, 25 bp, Homo sapien
cgcgtagacactagatggcgctctc

SEQ ID NO: 135631 - DNA, 25 bp, Homo sapien
gtctcctaaaaagctgcgccggccg

SEQ ID NO: 135632 - DNA, 25 bp, Homo sapien
gcctggcctaagagaattgcgttca

SEQ ID NO: 135633 - DNA, 25 bp, Homo sapien
cctgtggctgaacttaggccaattc

SEQ ID NO: 135634 - DNA, 25 bp, Homo sapien
gcgttcagtgaagcgcagaagccga

SEQ ID NO: 135635 - DNA, 25 bp, Homo sapien
gcgctctccctttgcagtccttgga

SEQ ID NO: 135636 - DNA, 25 bp, Homo sapien
aggccaattccgagcgagaccgaga

SEQ ID NO: 135637 - DNA, 25 bp, Homo sapien
cagaagccgaaaggcgccttgctgc

SEQ ID NO: 135638 - DNA, 25 bp, Homo sapien
aaggtcaaggcttcagcagaaggtg

SEQ ID NO: 135639 - DNA, 25 bp, Homo sapien
cttgctgtaaggatgcaggatgcga

SEQ ID NO: 135640 - DNA, 25 bp, Homo sapien
gccaggacaagccttgctgtaagga

SEQ ID NO: 135641 - DNA, 25 bp, Homo sapien
cgcagagaaggagccgtgctgcact

SEQ ID NO: 135642 - DNA, 25 bp, Homo sapien
ggtgtgcagatgacaccagctgcca

SEQ ID NO: 135643 - DNA, 25 bp, Homo sapien
acttggaaaggtcaaggcttcagca

SEQ ID NO: 135644 - DNA, 25 bp, Homo sapien
tccctgggccacacttggaaaggtc

SEQ ID NO: 135645 - DNA, 25 bp, Homo sapien
gatgacaccagctgccaggacaagc

SEQ ID NO: 135646 - DNA, 25 bp, Homo sapien
aataccatgtgctgctccgggaagc

SEQ ID NO: 135647 - DNA, 25 bp, Homo sapien
caactagcggcggagcttcgatctt

SEQ ID NO: 135648 - DNA, 25 bp, Homo sapien
cttcgatcttgcctaggcgcggaga

SEQ ID NO: 135649 - DNA, 25 bp, Homo sapien
gcccagcacaggtcagttcgtcttt

SEQ ID NO: 135650 - DNA, 25 bp, Homo sapien
gctcggcttcgaagtccattcatga

SEQ ID NO: 135651 - DNA, 25 bp, Homo sapien
gacgggtacacctggatgccttttc

SEQ ID NO: 135652 - DNA, 25 bp, Homo sapien
ttcccagtgtttgagtgacgtgagc

SEQ ID NO: 135653 - DNA, 25 bp, Homo sapien
atggactttcttttcacgcgcgcgc

SEQ ID NO: 135654 - DNA, 25 bp, Homo sapien
gtacgtccttctcctagtagccacg

SEQ ID NO: 135655 - DNA, 25 bp, Homo sapien
gaggacataatttccagccgaccta

SEQ ID NO: 135656 - DNA, 25 bp, Homo sapien
cgctaacacccaagcaggacagttc

SEQ ID NO: 135657 - DNA, 25 bp, Homo sapien
aggacagttcctagcccgtcgagca

SEQ ID NO: 135658 - DNA, 25 bp, Homo sapien
tccagtcttctccacggcagcaatt

SEQ ID NO: 135659 - DNA, 25 bp, Homo sapien
atatctcgcttggtggaaaaactgc

SEQ ID NO: 135660 - DNA, 25 bp, Homo sapien
cgaagggaaccggaaatgcgtcata

SEQ ID NO: 135661 - DNA, 25 bp, Homo sapien
ctgcggaaaaccgacggaggacata

SEQ ID NO: 135662 - DNA, 25 bp, Homo sapien
gccaagcagagcctcaggtgcggtt

SEQ ID NO: 135663 - DNA, 25 bp, Homo sapien
ggtctaggctgtttctctcgcgcca

SEQ ID NO: 135664 - DNA, 25 bp, Homo sapien
tgcctgcaccgcacgtgcttggttt

SEQ ID NO: 135665 - DNA, 25 bp, Homo sapien
tgataaagtgttgcgctccgggacg

SEQ ID NO: 135666 - DNA, 25 bp, Homo sapien
cccgttgtgaggtgataaagtgttg

SEQ ID NO: 135667 - DNA, 25 bp, Homo sapien
ctgggcgggcttcagccatgaagac

SEQ ID NO: 135668 - DNA, 25 bp, Homo sapien
atgaagaccctcatagccgcctact

SEQ ID NO: 135669 - DNA, 25 bp, Homo sapien
tgaccggagccagcgctctcacgga

SEQ ID NO: 135670 - DNA, 25 bp, Homo sapien
aagccagcagccagttgcaaaaccc

SEQ ID NO: 135671 - DNA, 25 bp, Homo sapien
tcttgctgatgaggatgggcatctt

SEQ ID NO: 135672 - DNA, 25 bp, Homo sapien
cgccacgcttctggttcgagatgga

SEQ ID NO: 135673 - DNA, 25 bp, Homo sapien
ttcgagatggactcgggcacctgct

SEQ ID NO: 135674 - DNA, 25 bp, Homo sapien
ccctgcagaacgagccattggtggc

SEQ ID NO: 135675 - DNA, 25 bp, Homo sapien
tcgctgctcagaaccagggcgtcct

SEQ ID NO: 135676 - DNA, 25 bp, Homo sapien
agaactttgtgccagcgatcccgca

SEQ ID NO: 135677 - DNA, 25 bp, Homo sapien
ttggcagctgcactcaggctggttc

SEQ ID NO: 135678 - DNA, 25 bp, Homo sapien
cctgttcacagggacccatttcgga

SEQ ID NO: 135679 - DNA, 25 bp, Homo sapien
tccaagtattcagcgcggacgtttg

SEQ ID NO: 135680 - DNA, 25 bp, Homo sapien
ccacgtcggaattggctctggggac

SEQ ID NO: 135681 - DNA, 25 bp, Homo sapien
cccaaggtgttgattatccatccca

SEQ ID NO: 135682 - DNA, 25 bp, Homo sapien
ttccgtggtcagaggaaaaaggctc

SEQ ID NO: 135683 - DNA, 25 bp, Homo sapien
cagcgcctctttgcagctttaatta

SEQ ID NO: 135684 - DNA, 25 bp, Homo sapien
gggaactggcacctaagactgtgta

SEQ ID NO: 135685 - DNA, 25 bp, Homo sapien
gacacaggtcttgcaagtcctcctc

SEQ ID NO: 135686 - DNA, 25 bp, Homo sapien
tattcaatgatctcgctcgcgcctc

SEQ ID NO: 135687 - DNA, 25 bp, Homo sapien
ttccattttggaacgcccgtgccgc

SEQ ID NO: 135688 - DNA, 25 bp, Homo sapien
gagccttctcattatcattccggga

SEQ ID NO: 135689 - DNA, 25 bp, Homo sapien
gcgcggggtcgtgcttaatattcaa

SEQ ID NO: 135690 - DNA, 25 bp, Homo sapien
cgcagaaattccaccgagtccgtta

SEQ ID NO: 135691 - DNA, 25 bp, Homo sapien
ttgtaactttctgcggaacccgagc

SEQ ID NO: 135692 - DNA, 25 bp, Homo sapien
ccttggccagtaaccagcgccttta

SEQ ID NO: 135693 - DNA, 25 bp, Homo sapien
attttggccatcgttctccgtacgg

SEQ ID NO: 135694 - DNA, 25 bp, Homo sapien
ctccggtaagtacctgaaagcgata

SEQ ID NO: 135695 - DNA, 25 bp, Homo sapien
aggcagccttctgaggcgaaacttc

SEQ ID NO: 135696 - DNA, 25 bp, Homo sapien
gctccgcgactgttaggtgtctagg

SEQ ID NO: 135697 - DNA, 25 bp, Homo sapien
tagccaagatgcacaagaccgcccg

SEQ ID NO: 135698 - DNA, 25 bp, Homo sapien
gtccgacatcttcgacccacaggta

SEQ ID NO: 135699 - DNA, 25 bp, Homo sapien
tcctgaaccagtctccgatgtccga

SEQ ID NO: 135700 - DNA, 25 bp, Homo sapien
ggcggcgaaccaatagcgcgtgatc

SEQ ID NO: 135701 - DNA, 25 bp, Homo sapien
cgtgaccagaagtcccgccgcttaa

SEQ ID NO: 135702 - DNA, 25 bp, Homo sapien
agagcactgacctaggcaacaagga

SEQ ID NO: 135703 - DNA, 25 bp, Homo sapien
ccgcatccctgggttggatgacctg

SEQ ID NO: 135704 - DNA, 25 bp, Homo sapien
cagcgttccgggttctggctctgac

SEQ ID NO: 135705 - DNA, 25 bp, Homo sapien
gcaacaaggagagcggcaagatatg

SEQ ID NO: 135706 - DNA, 25 bp, Homo sapien
atgacctgcggtggaacagatggct

SEQ ID NO: 135707 - DNA, 25 bp, Homo sapien
cttcgccatgcagagcactgaccta

SEQ ID NO: 135708 - DNA, 25 bp, Homo sapien
tcgtgggcaagcttcgccatgcaga

SEQ ID NO: 135709 - DNA, 25 bp, Homo sapien
gcaagatatggcaccgcaagccgtc

SEQ ID NO: 135710 - DNA, 25 bp, Homo sapien
taccctaacccagagctgtgcgcga

SEQ ID NO: 135711 - DNA, 25 bp, Homo sapien
cccggactttgacaagcaaacaacg

SEQ ID NO: 135712 - DNA, 25 bp, Homo sapien
cgcgacggccagtgcccaagggcaa

SEQ ID NO: 135713 - DNA, 25 bp, Homo sapien
ggcccttacacgtgctctttcctgg

SEQ ID NO: 135714 - DNA, 25 bp, Homo sapien
ttatcaggttcacctggtcccagga

SEQ ID NO: 135715 - DNA, 25 bp, Homo sapien
tgttgcctccattagacggccttga

SEQ ID NO: 135716 - DNA, 25 bp, Homo sapien
actcgtcgcagatatgtcttttccc

SEQ ID NO: 135717 - DNA, 25 bp, Homo sapien
ggtcccaggacactcgtcgcagata

SEQ ID NO: 135718 - DNA, 25 bp, Homo sapien
gatgtcttccttgccctacgtcagc

SEQ ID NO: 135719 - DNA, 25 bp, Homo sapien
cctctgtagagacggggatgtcttc

SEQ ID NO: 135720 - DNA, 25 bp, Homo sapien
ctaggcctgatgtgtcctgccctca

SEQ ID NO: 135721 - DNA, 25 bp, Homo sapien
agtggaatgaaactcgaacggcttc

SEQ ID NO: 135722 - DNA, 25 bp, Homo sapien
aagaccttctgagccttcgagtgga

SEQ ID NO: 135723 - DNA, 25 bp, Homo sapien
gtgcagatatttcgctccgtaaagt

SEQ ID NO: 135724 - DNA, 25 bp, Homo sapien
aattagcctagggacacaccgcgcc

SEQ ID NO: 135725 - DNA, 25 bp, Homo sapien
cgccactagccggtacagggtacca

SEQ ID NO: 135726 - DNA, 25 bp, Homo sapien
ttgacgaggagttccgccacctcta

SEQ ID NO: 135727 - DNA, 25 bp, Homo sapien
tacgcctcctccaagcctgtgatgg

SEQ ID NO: 135728 - DNA, 25 bp, Homo sapien
caagcctgtgatgggcctgaagtcc

SEQ ID NO: 135729 - DNA, 25 bp, Homo sapien
agtggctccgccagtgaccgcacgt

SEQ ID NO: 135730 - DNA, 25 bp, Homo sapien
agctgtttgacgaggagttccgcca

SEQ ID NO: 135731 - DNA, 25 bp, Homo sapien
atcctctccaagttcacaggccagg

SEQ ID NO: 135732 - DNA, 25 bp, Homo sapien
tacccgaagtgtgtccgcgtcttca

SEQ ID NO: 135733 - DNA, 25 bp, Homo sapien
cggacacgtgcaccggaacatcctc

SEQ ID NO: 135734 - DNA, 25 bp, Homo sapien
tgccaggctgtgcactggtgaaatt

SEQ ID NO: 135735 - DNA, 25 bp, Homo sapien
ccagggagctctgtgatgccgatga

SEQ ID NO: 135736 - DNA, 25 bp, Homo sapien
gttttgccagggagctctgtgatgc

SEQ ID NO: 135737 - DNA, 25 bp, Homo sapien
cgtgagcccgggtgcctgcactctg

SEQ ID NO: 135738 - DNA, 25 bp, Homo sapien
gcactctggtcgttggacgtcagca

SEQ ID NO: 135739 - DNA, 25 bp, Homo sapien
ttttgcgagggagctctgtgatgcc

SEQ ID NO: 135740 - DNA, 25 bp, Homo sapien
tgatgccgatgagcccggtgcctgc

SEQ ID NO: 135741 - DNA, 25 bp, Homo sapien
cagcaggctgtgcactggtgaaatc

SEQ ID NO: 135742 - DNA, 25 bp, Homo sapien
tcaccgttttgggaggcctgactgc

SEQ ID NO: 135743 - DNA, 25 bp, Homo sapien
gcagtgaagacaaacgggaggtacc

SEQ ID NO: 135744 - DNA, 25 bp, Homo sapien
agccaggccggccaaatgccaagtg

SEQ ID NO: 135745 - DNA, 25 bp, Homo sapien
ccaagtgggagtcaagccgcttaca

SEQ ID NO: 135746 - DNA, 25 bp, Homo sapien
agccgcttacaacgcggggattctc

SEQ ID NO: 135747 - DNA, 25 bp, Homo sapien
gattctcgcccatggacccggaatg

SEQ ID NO: 135748 - DNA, 25 bp, Homo sapien
acttgtagtctttgagggcgacgcg

SEQ ID NO: 135749 - DNA, 25 bp, Homo sapien
gcctgactgcccagctgtaagagca

SEQ ID NO: 135750 - DNA, 25 bp, Homo sapien
ccggttctccctaatcaggtgactc

SEQ ID NO: 135751 - DNA, 25 bp, Homo sapien
tcacgccgggaaaagactgcacaag

SEQ ID NO: 135752 - DNA, 25 bp, Homo sapien
cacaaggggcctgccaaggcagaca

SEQ ID NO: 135753 - DNA, 25 bp, Homo sapien
aggcagacaagcgatcgccacccag

SEQ ID NO: 135754 - DNA, 25 bp, Homo sapien
caccggaggcctgttaccacggcaa

SEQ ID NO: 135755 - DNA, 25 bp, Homo sapien
aagtggctcagaagaccggttctcc

SEQ ID NO: 135756 - DNA, 25 bp, Homo sapien
ctgcacgtgacaccggagcccagaa

SEQ ID NO: 135757 - DNA, 25 bp, Homo sapien
taccacggcaaccagtgagggcgga

SEQ ID NO: 135758 - DNA, 25 bp, Homo sapien
gtcaactctgacctgtgaaccctaa

SEQ ID NO: 135759 - DNA, 25 bp, Homo sapien
ccggctgcacttttcagggagtcaa

SEQ ID NO: 135760 - DNA, 25 bp, Homo sapien
agcatgctggcttctactgaaacgc

SEQ ID NO: 135761 - DNA, 25 bp, Homo sapien
cactgctggatcgtgagaggtaagc

SEQ ID NO: 135762 - DNA, 25 bp, Homo sapien
agtcgagggcttcacatcccgtcgg

SEQ ID NO: 135763 - DNA, 25 bp, Homo sapien
tccgccttcctaatgtcactgctgg

SEQ ID NO: 135764 - DNA, 25 bp, Homo sapien
cctggtcttctctcgggtcagcaca

SEQ ID NO: 135765 - DNA, 25 bp, Homo sapien
cccgctgacaccgaaagttcagttc

SEQ ID NO: 135766 - DNA, 25 bp, Homo sapien
tccgatcccgagagcttccatttta

SEQ ID NO: 135767 - DNA, 25 bp, Homo sapien
tctcctcccatttgtagagcgaagg

SEQ ID NO: 135768 - DNA, 25 bp, Homo sapien
caccaccgtagaacagcaggctcga

SEQ ID NO: 135769 - DNA, 25 bp, Homo sapien
tgcgtagcccgtttggaattttggc

SEQ ID NO: 135770 - DNA, 25 bp, Homo sapien
agctgctgcggagaaccaccatctt

SEQ ID NO: 135771 - DNA, 25 bp, Homo sapien
ggccgatgtgctccagactgaggaa

SEQ ID NO: 135772 - DNA, 25 bp, Homo sapien
ggtggtgaccaaatgcttagtcctc

SEQ ID NO: 135773 - DNA, 25 bp, Homo sapien
ttcttcacatagttccggctcgctg

SEQ ID NO: 135774 - DNA, 25 bp, Homo sapien
atagtgcattacctgtgcctggcgc

SEQ ID NO: 135775 - DNA, 25 bp, Homo sapien
cctacgtctggtccagtcggtcttc

SEQ ID NO: 135776 - DNA, 25 bp, Homo sapien
cagctagccggccatggaaggtaat

SEQ ID NO: 135777 - DNA, 25 bp, Homo sapien
cctgcgtctacagcagctgctactg

SEQ ID NO: 135778 - DNA, 25 bp, Homo sapien
aatggcagctctcgtctcttgagta

SEQ ID NO: 135779 - DNA, 25 bp, Homo sapien
ctcttgagtagagcgtgggctattg

SEQ ID NO: 135780 - DNA, 25 bp, Homo sapien
tccggaatcatagggtcgatagtgc

SEQ ID NO: 135781 - DNA, 25 bp, Homo sapien
gccgggaactcgtgctgctagtccc

SEQ ID NO: 135782 - DNA, 25 bp, Homo sapien
ccacgtggctttgtttatgggctcg

SEQ ID NO: 135783 - DNA, 25 bp, Homo sapien
tgcgcgactccggtgtccttaaagc

SEQ ID NO: 135784 - DNA, 25 bp, Homo sapien
cacttggagacactgaccttgaaca

SEQ ID NO: 135785 - DNA, 25 bp, Homo sapien
ccggtggtccgaagacctctgcaga

SEQ ID NO: 135786 - DNA, 25 bp, Homo sapien
ggtcgctcacgaaactgccgctctt

SEQ ID NO: 135787 - DNA, 25 bp, Homo sapien
tgagcgaacgtttggggacacgatc

SEQ ID NO: 135788 - DNA, 25 bp, Homo sapien
gccgcagctctttgttgccggaaga

SEQ ID NO: 135789 - DNA, 25 bp, Homo sapien
atctcaagcgttgcaggctccggga

SEQ ID NO: 135790 - DNA, 25 bp, Homo sapien
tccacaggactcgactggcgccttt

SEQ ID NO: 135791 - DNA, 25 bp, Homo sapien
gaaacttggagctgttcaggcgatc

SEQ ID NO: 135792 - DNA, 25 bp, Homo sapien
gagcgcaccgcactccaatgtaaag

SEQ ID NO: 135793 - DNA, 25 bp, Homo sapien
tcccaggtcgcttttctctgaaaac

SEQ ID NO: 135794 - DNA, 25 bp, Homo sapien
tgcctccggctttacaatttgagta

SEQ ID NO: 135795 - DNA, 25 bp, Homo sapien
gcgactatcgccgttcattcagaga

SEQ ID NO: 135796 - DNA, 25 bp, Homo sapien
ctgctgctcttgtactcggttggcc

SEQ ID NO: 135797 - DNA, 25 bp, Homo sapien
ctgggtcatcagcaacggcaacgca

SEQ ID NO: 135798 - DNA, 25 bp, Homo sapien
ctccgggacctgatcagcacgtacc

SEQ ID NO: 135799 - DNA, 25 bp, Homo sapien
tccacgccaacggtgccgcgcagat

SEQ ID NO: 135800 - DNA, 25 bp, Homo sapien
catacaccgctatgacgtgggcgcc

SEQ ID NO: 135801 - DNA, 25 bp, Homo sapien
tccatgaccagttcgcagacctgcg

SEQ ID NO: 135802 - DNA, 25 bp, Homo sapien
cctactcgcagtagggcaccctact

SEQ ID NO: 135803 - DNA, 25 bp, Homo sapien
agcacgtaccttacccgcgccgagg

SEQ ID NO: 135804 - DNA, 25 bp, Homo sapien
atgtcccagcactacaggagcagcc

SEQ ID NO: 135805 - DNA, 25 bp, Homo sapien
tcgcagacctgcgagaactgctcgc

SEQ ID NO: 135806 - DNA, 25 bp, Homo sapien
ctgtagatgaagtcgcgcgcgccct

SEQ ID NO: 135807 - DNA, 25 bp, Homo sapien
ccctagcggcagcagaagtgggaac

SEQ ID NO: 135808 - DNA, 25 bp, Homo sapien
cctccgatgggaaaaactttctctg

SEQ ID NO: 135809 - DNA, 25 bp, Homo sapien
ctagtgtgtgtctctgtcagtctga

SEQ ID NO: 135810 - DNA, 25 bp, Homo sapien
tgtcagtctgatcttccagaggatg

SEQ ID NO: 135811 - DNA, 25 bp, Homo sapien
ttccagaggatgagtcagccacgca

SEQ ID NO: 135812 - DNA, 25 bp, Homo sapien
tgtaaggttcccgagccctcaaagc

SEQ ID NO: 135813 - DNA, 25 bp, Homo sapien
cagctcctctccgtggagtgcaggc

SEQ ID NO: 135814 - DNA, 25 bp, Homo sapien
agccggttctgcatcgtgctccaga

SEQ ID NO: 135815 - DNA, 25 bp, Homo sapien
atcttcctccggctctttggtaagg

SEQ ID NO: 135816 - DNA, 25 bp, Homo sapien
gtgccctgcctttacatcatcgacg

SEQ ID NO: 135817 - DNA, 25 bp, Homo sapien
ggagtcagaccttagccagccggaa

SEQ ID NO: 135818 - DNA, 25 bp, Homo sapien
ttttgatccgcggaagcaccgactc

SEQ ID NO: 135819 - DNA, 25 bp, Homo sapien
caggcagctctgaaccatgtttatg

SEQ ID NO: 135820 - DNA, 25 bp, Homo sapien
agagggtggcatcctttggcttttc

SEQ ID NO: 135821 - DNA, 25 bp, Homo sapien
atttctcctggcgtcggctttcaga

SEQ ID NO: 135822 - DNA, 25 bp, Homo sapien
cgctacgccacctcgagtcgtggtg

SEQ ID NO: 135823 - DNA, 25 bp, Homo sapien
ttgcggctttataagcgggcgctac

SEQ ID NO: 135824 - DNA, 25 bp, Homo sapien
tgacccatcagcaaaaggtgttgcg

SEQ ID NO: 135825 - DNA, 25 bp, Homo sapien
tcagcgccgtaatggcgttcttggc

SEQ ID NO: 135826 - DNA, 25 bp, Homo sapien
agtcacccgcagcaggcgtgcagtt

SEQ ID NO: 135827 - DNA, 25 bp, Homo sapien
tcatgactgcgcatggaggacctcc

SEQ ID NO: 135828 - DNA, 25 bp, Homo sapien
taaacttgaagcgactcatgactgc

SEQ ID NO: 135829 - DNA, 25 bp, Homo sapien
gcgtggaaaacgctcctcttaccga

SEQ ID NO: 135830 - DNA, 25 bp, Homo sapien
aagacacgagcgaggacagggaccc

SEQ ID NO: 135831 - DNA, 25 bp, Homo sapien
ccttggagctggcttgagtgagcct

SEQ ID NO: 135832 - DNA, 25 bp, Homo sapien
ggccagcctcacctgacctgggatg

SEQ ID NO: 135833 - DNA, 25 bp, Homo sapien
acctgacctgggatgcgcttccttc

SEQ ID NO: 135834 - DNA, 25 bp, Homo sapien
agataaaccacgctcggtgccggca

SEQ ID NO: 135835 - DNA, 25 bp, Homo sapien
ccgcggcagcctgggagataaacca

SEQ ID NO: 135836 - DNA, 25 bp, Homo sapien
gcggatggtcttggagcatttagcc

SEQ ID NO: 135837 - DNA, 25 bp, Homo sapien
ttcggggcatcaggctggaccagaa

SEQ ID NO: 135838 - DNA, 25 bp, Homo sapien
ccctgcatgtggagctgccgtctca

SEQ ID NO: 135839 - DNA, 25 bp, Homo sapien
cccgttacaggagatgggcttgtta

SEQ ID NO: 135840 - DNA, 25 bp, Homo sapien
tgccgtctcagcaggtaagcccgcg

SEQ ID NO: 135841 - DNA, 25 bp, Homo sapien
aggggtccagtgatggccgaacctc

SEQ ID NO: 135842 - DNA, 25 bp, Homo sapien
atggccgaacctccgggagatcccg

SEQ ID NO: 135843 - DNA, 25 bp, Homo sapien
ggagtcctaggagaatcccgttaca

SEQ ID NO: 135844 - DNA, 25 bp, Homo sapien
ttgttaagggacaagcagccagcca

SEQ ID NO: 135845 - DNA, 25 bp, Homo sapien
ccctggatcgagatgagcgcctccg

SEQ ID NO: 135846 - DNA, 25 bp, Homo sapien
aatgccgggagaagactgacaatca

SEQ ID NO: 135847 - DNA, 25 bp, Homo sapien
cggcgtcctaccttcatgtcgctga

SEQ ID NO: 135848 - DNA, 25 bp, Homo sapien
aaccgctctgtagggtattcgccta

SEQ ID NO: 135849 - DNA, 25 bp, Homo sapien
cggggccagcgccattgaaaaacgc

SEQ ID NO: 135850 - DNA, 25 bp, Homo sapien
ccactggtgcccactacggaaacgg

SEQ ID NO: 135851 - DNA, 25 bp, Homo sapien
ggaaacggcaaagcccatcttgatg

SEQ ID NO: 135852 - DNA, 25 bp, Homo sapien
tcttgatgcagagaaaatcgcccgc

SEQ ID NO: 135853 - DNA, 25 bp, Homo sapien
gaccgactgttctctgcccaaaata

SEQ ID NO: 135854 - DNA, 25 bp, Homo sapien
tccgaggccatcttttgttggagaa

SEQ ID NO: 135855 - DNA, 25 bp, Homo sapien
aacatcgccctagcgcctttcgggg

SEQ ID NO: 135856 - DNA, 25 bp, Homo sapien
cctccgattggccaaacgcggcata

SEQ ID NO: 135857 - DNA, 25 bp, Homo sapien
tgcgacggttactctggttactggg

SEQ ID NO: 135858 - DNA, 25 bp, Homo sapien
gccgccatctgagggaggtaccctg

SEQ ID NO: 135859 - DNA, 25 bp, Homo sapien
cagcgaaacgggaggcctctaaatc

SEQ ID NO: 135860 - DNA, 25 bp, Homo sapien
aatctttaggttggggctgcattgc

SEQ ID NO: 135861 - DNA, 25 bp, Homo sapien
agccgcactcttgagtccgaggcca

SEQ ID NO: 135862 - DNA, 25 bp, Homo sapien
tcccggacctggagcgggtcagacc

SEQ ID NO: 135863 - DNA, 25 bp, Homo sapien
cacatgaccgaagcggctgggagca

SEQ ID NO: 135864 - DNA, 25 bp, Homo sapien
aggggcatcatgtgaccactcgccg

SEQ ID NO: 135865 - DNA, 25 bp, Homo sapien
cactcgccggcgacggctgatgacg

SEQ ID NO: 135866 - DNA, 25 bp, Homo sapien
gctgatgacgcaagagcccgctctc

SEQ ID NO: 135867 - DNA, 25 bp, Homo sapien
cgctctcacttttcagcggcaggcg

SEQ ID NO: 135868 - DNA, 25 bp, Homo sapien
ttctatccgcagtcccggacctgga

SEQ ID NO: 135869 - DNA, 25 bp, Homo sapien
aggcggcggtcctcttctatccgca

SEQ ID NO: 135870 - DNA, 25 bp, Homo sapien
tgctggagactcatcgctttgggaa

SEQ ID NO: 135871 - DNA, 25 bp, Homo sapien
aagtgcatttgcttcgtggctccgc

SEQ ID NO: 135872 - DNA, 25 bp, Homo sapien
cggcagcctcggcaacaatagtggc

SEQ ID NO: 135873 - DNA, 25 bp, Homo sapien
gagcctgctgaatcctgtcctcgcg

SEQ ID NO: 135874 - DNA, 25 bp, Homo sapien
cagcccattgtgcttactgtgaatg

SEQ ID NO: 135875 - DNA, 25 bp, Homo sapien
cttactgtgaatgaggcgcgcgcac

SEQ ID NO: 135876 - DNA, 25 bp, Homo sapien
tcaggatcccgagcgccgcgaaaaa

SEQ ID NO: 135877 - DNA, 25 bp, Homo sapien
agtcactctctctgagcgcgtctcg

SEQ ID NO: 135878 - DNA, 25 bp, Homo sapien
gacgcagaacgttcccacagtctac

SEQ ID NO: 135879 - DNA, 25 bp, Homo sapien
tgggttttccgcaactcacctgaca

SEQ ID NO: 135880 - DNA, 25 bp, Homo sapien
tttcacccgaaagataggatcaccc

SEQ ID NO: 135881 - DNA, 25 bp, Homo sapien
ccagagcaccctcgggccgctcctt

SEQ ID NO: 135882 - DNA, 25 bp, Homo sapien
tcccacagtctactttatgcgagcg

SEQ ID NO: 135883 - DNA, 25 bp, Homo sapien
cctcctgcgcgggtagacgcagaac

SEQ ID NO: 135884 - DNA, 25 bp, Homo sapien
gccgctccttttcacccgaaagata

SEQ ID NO: 135885 - DNA, 25 bp, Homo sapien
tctactttatgcgagcgtggcaccc

SEQ ID NO: 135886 - DNA, 25 bp, Homo sapien
ggtgtagcgagctttccctcgtttc

SEQ ID NO: 135887 - DNA, 25 bp, Homo sapien
gcctggccctggcaaaagcccattg

SEQ ID NO: 135888 - DNA, 25 bp, Homo sapien
aactccagggtcatttgcacaggtc

SEQ ID NO: 135889 - DNA, 25 bp, Homo sapien
ggttgcccatcacgctgcggacaca

SEQ ID NO: 135890 - DNA, 25 bp, Homo sapien
ggctccacgtcctcatcgtcattgg

SEQ ID NO: 135891 - DNA, 25 bp, Homo sapien
ctcaggctcgggttacctgcacaaa

SEQ ID NO: 135892 - DNA, 25 bp, Homo sapien
cgtcccggtagaacacggagcattc

SEQ ID NO: 135893 - DNA, 25 bp, Homo sapien
tctggtagatgcattcgtcccggta

SEQ ID NO: 135894 - DNA, 25 bp, Homo sapien
aattcaggagtttaaggttatagtg

SEQ ID NO: 135895 - DNA, 25 bp, Homo sapien
gggtgacaaagtgaggccctagctt

SEQ ID NO: 135896 - DNA, 25 bp, Homo sapien
ggtgacaaagtgaggccctagcttt

SEQ ID NO: 135897 - DNA, 25 bp, Homo sapien
gacaaagtgaggccctagctttaaa

SEQ ID NO: 135898 - DNA, 25 bp, Homo sapien
tgacaaagtgaggccctagctttaa

SEQ ID NO: 135899 - DNA, 25 bp, Homo sapien
gtgacaaagtgaggccctagcttta

SEQ ID NO: 135900 - DNA, 25 bp, Homo sapien
tctgctgccagtagagggcacactt

SEQ ID NO: 135901 - DNA, 25 bp, Homo sapien
tccagcatagcgattggttgctccc

SEQ ID NO: 135902 - DNA, 25 bp, Homo sapien
aaaccttgcacctcggacgctcctg

SEQ ID NO: 135903 - DNA, 25 bp, Homo sapien
cctcgttgacatccaggcgcgatga

SEQ ID NO: 135904 - DNA, 25 bp, Homo sapien
ggcgcgatgatctctgctgccagta

SEQ ID NO: 135905 - DNA, 25 bp, Homo sapien
gggcacacttactttactttcgcaa

SEQ ID NO: 135906 - DNA, 25 bp, Homo sapien
ctttcgcaaacctgaacgcgggtgc

SEQ ID NO: 135907 - DNA, 25 bp, Homo sapien
tttgcagcaaaatccagcatagcga

SEQ ID NO: 135908 - DNA, 25 bp, Homo sapien
tggcgcagttgcatctccgtattga

SEQ ID NO: 135909 - DNA, 25 bp, Homo sapien
tgaatatattcacgctgactcccgg

SEQ ID NO: 135910 - DNA, 25 bp, Homo sapien
ccggtcggacattcctgctttattg

SEQ ID NO: 135911 - DNA, 25 bp, Homo sapien
ccgcatatcgcctgtgtgagccaga

SEQ ID NO: 135912 - DNA, 25 bp, Homo sapien
ttcggctcaccgcatttctgacagc

SEQ ID NO: 135913 - DNA, 25 bp, Homo sapien
ttctgacagccggagacggacactg

SEQ ID NO: 135914 - DNA, 25 bp, Homo sapien
ggttccagaacagctgctacccttg

SEQ ID NO: 135915 - DNA, 25 bp, Homo sapien
ccgccctgatccttttaagaagttg

SEQ ID NO: 135916 - DNA, 25 bp, Homo sapien
aagaccgtggaaagctcggcgcaca

SEQ ID NO: 135917 - DNA, 25 bp, Homo sapien
cgggtttgcaactcggcttctggaa

SEQ ID NO: 135918 - DNA, 25 bp, Homo sapien
tggtacccaaagaggcgctcagatc

SEQ ID NO: 135919 - DNA, 25 bp, Homo sapien
tggccctcctatttcactgaactcg

SEQ ID NO: 135920 - DNA, 25 bp, Homo sapien
aagaccgcttgcttccaggacggtg

SEQ ID NO: 135921 - DNA, 25 bp, Homo sapien
cgcacaagcgagctggcatcaccgg

SEQ ID NO: 135922 - DNA, 25 bp, Homo sapien
acgagctgcgagcaaagatgtgccc

SEQ ID NO: 135923 - DNA, 25 bp, Homo sapien
tcctcagcaggaaagtgggaagacc

SEQ ID NO: 135924 - DNA, 25 bp, Homo sapien
ccaaagggaggaagcgacacacgca

SEQ ID NO: 135925 - DNA, 25 bp, Homo sapien
acgcacagaggggacatacgcacag

SEQ ID NO: 135926 - DNA, 25 bp, Homo sapien
acacacgcgtagtcccaaagggagg

SEQ ID NO: 135927 - DNA, 25 bp, Homo sapien
cccaaagggaggaagcgacacacgc

SEQ ID NO: 135928 - DNA, 25 bp, Homo sapien
cgcacagaggggacatacgcacagg

SEQ ID NO: 135929 - DNA, 25 bp, Homo sapien
cacacgcgtagtcccaaagggagga

SEQ ID NO: 135930 - DNA, 25 bp, Homo sapien
tcccaaagggaggaagcgacacacg

SEQ ID NO: 135931 - DNA, 25 bp, Homo sapien
gacacacgcgtagtcccaaagggag

SEQ ID NO: 135932 - DNA, 25 bp, Homo sapien
aatgcacagggttgactcacgcacg

SEQ ID NO: 135933 - DNA, 25 bp, Homo sapien
gggatgcacgcacaagggcaacgca

SEQ ID NO: 135934 - DNA, 25 bp, Homo sapien
gcaacgcacgcacgggaggacacag

SEQ ID NO: 135935 - DNA, 25 bp, Homo sapien
acacacagcagggactcatgcacaa

SEQ ID NO: 135936 - DNA, 25 bp, Homo sapien
tgcgcacaggggtgacaaatgcaca

SEQ ID NO: 135937 - DNA, 25 bp, Homo sapien
aggacgcatgcaaggtgggacacat

SEQ ID NO: 135938 - DNA, 25 bp, Homo sapien
cgcacgcacaaggaggacatgtgca

SEQ ID NO: 135939 - DNA, 25 bp, Homo sapien
tgcacgggaggacacacgcacggaa

SEQ ID NO: 135940 - DNA, 25 bp, Homo sapien
tggggaccgcgcttcgctccgcaaa

SEQ ID NO: 135941 - DNA, 25 bp, Homo sapien
tgcgttccggaagcagctcctgtgg

SEQ ID NO: 135942 - DNA, 25 bp, Homo sapien
ttccctgtgcgttccggaagcagct

SEQ ID NO: 135943 - DNA, 25 bp, Homo sapien
gcgacacccgatggggaccgcgctt

SEQ ID NO: 135944 - DNA, 25 bp, Homo sapien
ttcgctccgcaaacattgtcactgc

SEQ ID NO: 135945 - DNA, 25 bp, Homo sapien
cctgcgcggtgactccaagagccga

SEQ ID NO: 135946 - DNA, 25 bp, Homo sapien
cccacgaagaggtgccgtggagcac

SEQ ID NO: 135947 - DNA, 25 bp, Homo sapien
tgccgtggagcacgtgacctgaccc

SEQ ID NO: 135948 - DNA, 25 bp, Homo sapien
tgagccctgcgaagttgccatattc

SEQ ID NO: 135949 - DNA, 25 bp, Homo sapien
acgagccaacgagccaggagtcact

SEQ ID NO: 135950 - DNA, 25 bp, Homo sapien
gcctcttcgccaaaatggggtcgca

SEQ ID NO: 135951 - DNA, 25 bp, Homo sapien
gggcagcaccttcgcaaatatcgcg

SEQ ID NO: 135952 - DNA, 25 bp, Homo sapien
atcgcgccgagatagcttctgagtg

SEQ ID NO: 135953 - DNA, 25 bp, Homo sapien
ttccagccttccagatgtacagatg

SEQ ID NO: 135954 - DNA, 25 bp, Homo sapien
acctcgggactcgatgctgagccct

SEQ ID NO: 135955 - DNA, 25 bp, Homo sapien
tgcctcttgtcagcgggcttggaaa

SEQ ID NO: 135956 - DNA, 25 bp, Homo sapien
ctcccgctgggtgcggaaccgggtg

SEQ ID NO: 135957 - DNA, 25 bp, Homo sapien
cataaagccgatcttcgccggggcc

SEQ ID NO: 135958 - DNA, 25 bp, Homo sapien
cccgggagcacgtcctgcgcatcgc

SEQ ID NO: 135959 - DNA, 25 bp, Homo sapien
acgtcctgcgcatcgccgggctccg

SEQ ID NO: 135960 - DNA, 25 bp, Homo sapien
accagccacagggatgcggggacgc

SEQ ID NO: 135961 - DNA, 25 bp, Homo sapien
gaagcgctgccccataaagccgatc

SEQ ID NO: 135962 - DNA, 25 bp, Homo sapien
ctctgcaccagccacagggatgcgg

SEQ ID NO: 135963 - DNA, 25 bp, Homo sapien
gaaccgggtgcaagaggccgaagcg

SEQ ID NO: 135964 - DNA, 25 bp, Homo sapien
ctcgcacaaaaggaggacgctcgcc

SEQ ID NO: 135965 - DNA, 25 bp, Homo sapien
tcaccgccacaggtttgcgagctgc

SEQ ID NO: 135966 - DNA, 25 bp, Homo sapien
ccaggcgagaaataactataaaagg

SEQ ID NO: 135967 - DNA, 25 bp, Homo sapien
ataactataaaaggaagaggcgcgg

SEQ ID NO: 135968 - DNA, 25 bp, Homo sapien
aagaggaagcgctgtttaccttcga

SEQ ID NO: 135969 - DNA, 25 bp, Homo sapien
ttaccttcgagaagccgagccgccg

SEQ ID NO: 135970 - DNA, 25 bp, Homo sapien
cgccggcgctcgcacaaaaggagga

SEQ ID NO: 135971 - DNA, 25 bp, Homo sapien
gggctcacgtcaccgccacaggttt

SEQ ID NO: 135972 - DNA, 25 bp, Homo sapien
acggtgttcctgcagttgtgcagcc

SEQ ID NO: 135973 - DNA, 25 bp, Homo sapien
ctcgttgcgcgagcgttttgcaaga

SEQ ID NO: 135974 - DNA, 25 bp, Homo sapien
tcctccagcagcgtgacggtgttcc

SEQ ID NO: 135975 - DNA, 25 bp, Homo sapien
agcggttacttcagcgagctcgttg

SEQ ID NO: 135976 - DNA, 25 bp, Homo sapien
cggggccaaacaaggaagtgctctg

SEQ ID NO: 135977 - DNA, 25 bp, Homo sapien
ggcctgactgactgagcgcacactc

SEQ ID NO: 135978 - DNA, 25 bp, Homo sapien
ttcttttttagtcgcgtgtgggtgc

SEQ ID NO: 135979 - DNA, 25 bp, Homo sapien
tgaactccgagacagagatctggtc

SEQ ID NO: 135980 - DNA, 25 bp, Homo sapien
ctgggcattattccatcgcgggttc

SEQ ID NO: 135981 - DNA, 25 bp, Homo sapien
ggcgcccttcttcgcgcgagagact

SEQ ID NO: 135982 - DNA, 25 bp, Homo sapien
aagcgaactgcgaccgggaagcgcc

SEQ ID NO: 135983 - DNA, 25 bp, Homo sapien
gaatcctgactaagcattcccggcc

SEQ ID NO: 135984 - DNA, 25 bp, Homo sapien
tgggatttatccacagaaaaccctg

SEQ ID NO: 135985 - DNA, 25 bp, Homo sapien
ctggacgcggaaggtgcctttctaa

SEQ ID NO: 135986 - DNA, 25 bp, Homo sapien
ttcctcggctgcaccagagacaatg

SEQ ID NO: 135987 - DNA, 25 bp, Homo sapien
tccaaacacttcgacaggaaatcgg

SEQ ID NO: 135988 - DNA, 25 bp, Homo sapien
cctagttcgggagcaaggactgaca

SEQ ID NO: 135989 - DNA, 25 bp, Homo sapien
ggtcccagcctgagctataagacga

SEQ ID NO: 135990 - DNA, 25 bp, Homo sapien
tcagctgtgctttcgaagggtcgca

SEQ ID NO: 135991 - DNA, 25 bp, Homo sapien
agggtcgcagcacacagttctcatc

SEQ ID NO: 135992 - DNA, 25 bp, Homo sapien
gcctcggcgctaacaattcaccaaa

SEQ ID NO: 135993 - DNA, 25 bp, Homo sapien
acgaggtcaacgctttcagctgtgc

SEQ ID NO: 135994 - DNA, 25 bp, Homo sapien
acgcctctggatctagggaagcgcc

SEQ ID NO: 135995 - DNA, 25 bp, Homo sapien
ggctggaatcatcgcccttcggaga

SEQ ID NO: 135996 - DNA, 25 bp, Homo sapien
gacagcctaactcggcgtccgtatc

SEQ ID NO: 135997 - DNA, 25 bp, Homo sapien
ctgagcagagccaggaagtgtctgc

SEQ ID NO: 135998 - DNA, 25 bp, Homo sapien
gcggtaccattgtcagtcccttctc

SEQ ID NO: 135999 - DNA, 25 bp, Homo sapien
attgaaaataactgcggtaccattg

SEQ ID NO: 136000 - DNA, 25 bp, Homo sapien
acacggcttcgtgggactttatgga

SEQ ID NO: 136001 - DNA, 25 bp, Homo sapien
ttcggcttagccttccggagatggc

SEQ ID NO: 136002 - DNA, 25 bp, Homo sapien
gatcgccatgcctacccgtgagtgg

SEQ ID NO: 136003 - DNA, 25 bp, Homo sapien
cccgttgcacggatcgggaaactga

SEQ ID NO: 136004 - DNA, 25 bp, Homo sapien
gtgtctgtgtccgtctcaccctcgg

SEQ ID NO: 136005 - DNA, 25 bp, Homo sapien
tctcgcgtgatgctacgtctctgcc

SEQ ID NO: 136006 - DNA, 25 bp, Homo sapien
agaggtgtgtcactgtctcgcgtga

SEQ ID NO: 136007 - DNA, 25 bp, Homo sapien
ccgacatcagggacagaggtgtgtc

SEQ ID NO: 136008 - DNA, 25 bp, Homo sapien
agctcctcgtggttgaccgacatca

SEQ ID NO: 136009 - DNA, 25 bp, Homo sapien
tgctgaagccacttggagacctctc

SEQ ID NO: 136010 - DNA, 25 bp, Homo sapien
cacataatcatctctgtcctgggag

SEQ ID NO: 136011 - DNA, 25 bp, Homo sapien
cccattggggccgaacacataatca

SEQ ID NO: 136012 - DNA, 25 bp, Homo sapien
gtcttggccaggagcccgatgccct

SEQ ID NO: 136013 - DNA, 25 bp, Homo sapien
cagcagggtcccgtctttgtcggct

SEQ ID NO: 136014 - DNA, 25 bp, Homo sapien
caaggtgacttgctccacgtcgccg

SEQ ID NO: 136015 - DNA, 25 bp, Homo sapien
gcccgggaactccaatgccatgatc

SEQ ID NO: 136016 - DNA, 25 bp, Homo sapien
gagcccaagacagcatcgcagttta

SEQ ID NO: 136017 - DNA, 25 bp, Homo sapien
agtttatttacaagcccggtgccag

SEQ ID NO: 136018 - DNA, 25 bp, Homo sapien
ccaccgctgattgtctggggaccca

SEQ ID NO: 136019 - DNA, 25 bp, Homo sapien
gggacccaggatcgcctgggctacc

SEQ ID NO: 136020 - DNA, 25 bp, Homo sapien
cgaaggcgtgtctcccagcgtggcc

SEQ ID NO: 136021 - DNA, 25 bp, Homo sapien
ctggctcgaattaggcgcggccgaa

SEQ ID NO: 136022 - DNA, 25 bp, Homo sapien
gcgtcccgcgcctggctcgaattag

SEQ ID NO: 136023 - DNA, 25 bp, Homo sapien
tgatgccatagcacacgccggtctg

SEQ ID NO: 136024 - DNA, 25 bp, Homo sapien
cagccacttgatgccatagcacacg

SEQ ID NO: 136025 - DNA, 25 bp, Homo sapien
agaaggacgctcagaggacaaggct

SEQ ID NO: 136026 - DNA, 25 bp, Homo sapien
cgctcagaggacaaggctgagagcc

SEQ ID NO: 136027 - DNA, 25 bp, Homo sapien
ggggtccctactcacagccacttga

SEQ ID NO: 136028 - DNA, 25 bp, Homo sapien
cccggacctcgaatgacgcttttca

SEQ ID NO: 136029 - DNA, 25 bp, Homo sapien
aaacccagtcttcgtcctcgtcgca

SEQ ID NO: 136030 - DNA, 25 bp, Homo sapien
aaacaagccgcgtttcctgagctcc

SEQ ID NO: 136031 - DNA, 25 bp, Homo sapien
ctcgaatgacgcttttcacccttca

SEQ ID NO: 136032 - DNA, 25 bp, Homo sapien
agccggacccggacctcgaatgacg

SEQ ID NO: 136033 - DNA, 25 bp, Homo sapien
tccacaaggggaacgatcgaggacg

SEQ ID NO: 136034 - DNA, 25 bp, Homo sapien
gactacttccacaaggggaacgatc

SEQ ID NO: 136035 - DNA, 25 bp, Homo sapien
gagccatggcaacggggactctacg

SEQ ID NO: 136036 - DNA, 25 bp, Homo sapien
cctctgtggaccgagcgcatagacc

SEQ ID NO: 136037 - DNA, 25 bp, Homo sapien
cacgcctctgtggacccagcgtgta

SEQ ID NO: 136038 - DNA, 25 bp, Homo sapien
ctgagacgtgcctctgtggaccgag

SEQ ID NO: 136039 - DNA, 25 bp, Homo sapien
tgtggacccagcgtgtagacatctg

SEQ ID NO: 136040 - DNA, 25 bp, Homo sapien
gacccagcgtgtagacatctgcctc

SEQ ID NO: 136041 - DNA, 25 bp, Homo sapien
agcgtgtagacatctgcctccatct

SEQ ID NO: 136042 - DNA, 25 bp, Homo sapien
atctccgtggctttcagacacgcct

SEQ ID NO: 136043 - DNA, 25 bp, Homo sapien
gtggctttcagacacgcctctgtgg

SEQ ID NO: 136044 - DNA, 25 bp, Homo sapien
ctagcggtccgtcaacgaccgcaaa

SEQ ID NO: 136045 - DNA, 25 bp, Homo sapien
atggcagcggaccctgagcgagctt

SEQ ID NO: 136046 - DNA, 25 bp, Homo sapien
cgcgttctttcctccagtaaccaga

SEQ ID NO: 136047 - DNA, 25 bp, Homo sapien
cctcgtgagtcacgtgacaaggcca

SEQ ID NO: 136048 - DNA, 25 bp, Homo sapien
ggcccaaccctcgtgagtcacgtga

SEQ ID NO: 136049 - DNA, 25 bp, Homo sapien
gtcacgtgacaaggccaggcccgct

SEQ ID NO: 136050 - DNA, 25 bp, Homo sapien
agcttgagggctcggacccagctcc

SEQ ID NO: 136051 - DNA, 25 bp, Homo sapien
gttctttcctccagtaaccagagcc

SEQ ID NO: 136052 - DNA, 25 bp, Homo sapien
gcggatggtgaactgacgagcttca

SEQ ID NO: 136053 - DNA, 25 bp, Homo sapien
acaccgccctgtgtgtgctacggga

SEQ ID NO: 136054 - DNA, 25 bp, Homo sapien
tgctacgggactgaagcgccaccag

SEQ ID NO: 136055 - DNA, 25 bp, Homo sapien
cgccaggaaacgctatcctggtatt

SEQ ID NO: 136056 - DNA, 25 bp, Homo sapien
ttcagcggtgtctgcacccaaagcc

SEQ ID NO: 136057 - DNA, 25 bp, Homo sapien
ttactcctggagtacgcggggctac

SEQ ID NO: 136058 - DNA, 25 bp, Homo sapien
tgacgagcttcagcaccagctggga

SEQ ID NO: 136059 - DNA, 25 bp, Homo sapien
gagccaggcgaggtttgtttacgtc

SEQ ID NO: 136060 - DNA, 25 bp, Homo sapien
ggggtctcccttcgaatgtcttcca

SEQ ID NO: 136061 - DNA, 25 bp, Homo sapien
gtgcaatgtcactggggctgctttc

SEQ ID NO: 136062 - DNA, 25 bp, Homo sapien
tcagctctcttgtcccgggtgtcaa

SEQ ID NO: 136063 - DNA, 25 bp, Homo sapien
tcagagtttcgagttgccactaaca

SEQ ID NO: 136064 - DNA, 25 bp, Homo sapien
attatttcttgggagctgcgacgcc

SEQ ID NO: 136065 - DNA, 25 bp, Homo sapien
agaatcccggggtcttcagtcccag

SEQ ID NO: 136066 - DNA, 25 bp, Homo sapien
ttcagttcccgggtccagacaatca

SEQ ID NO: 136067 - DNA, 25 bp, Homo sapien
cacgagagacacaggcaagttgcta

SEQ ID NO: 136068 - DNA, 25 bp, Homo sapien
gtactctccctgcagcgtatcgatg

SEQ ID NO: 136069 - DNA, 25 bp, Homo sapien
tccctgcagcgtatcgatgagcaca

SEQ ID NO: 136070 - DNA, 25 bp, Homo sapien
accctggagtactcgccctgcagaa

SEQ ID NO: 136071 - DNA, 25 bp, Homo sapien
tgagcacatgcacacgacgccctgg

SEQ ID NO: 136072 - DNA, 25 bp, Homo sapien
tgagcacatgcacacaacgccctgg

SEQ ID NO: 136073 - DNA, 25 bp, Homo sapien
gccctgcagcgtatcgatgagcaca

SEQ ID NO: 136074 - DNA, 25 bp, Homo sapien
tcgccctgcagcgtatcgatgagca

SEQ ID NO: 136075 - DNA, 25 bp, Homo sapien
cacatgcacatgacgccctggagta

SEQ ID NO: 136076 - DNA, 25 bp, Homo sapien
tgctcggcaagctccacggacgctt

SEQ ID NO: 136077 - DNA, 25 bp, Homo sapien
tacagtttaggaggcaccagtgcgc

SEQ ID NO: 136078 - DNA, 25 bp, Homo sapien
gccctgcgtgtagacagtcaccgtc

SEQ ID NO: 136079 - DNA, 25 bp, Homo sapien
ccggtccagcgtaacaacaaagtca

SEQ ID NO: 136080 - DNA, 25 bp, Homo sapien
tgctggaccgtctcctggatcatga

SEQ ID NO: 136081 - DNA, 25 bp, Homo sapien
ctcctggatcatgaccgtgtggttg

SEQ ID NO: 136082 - DNA, 25 bp, Homo sapien
cgtagacgatgaactccgaggcctc

SEQ ID NO: 136083 - DNA, 25 bp, Homo sapien
tgcgggagcacgtccattctccacg

SEQ ID NO: 136084 - DNA, 25 bp, Homo sapien
gcgaatctgcggcatccaacatggc

SEQ ID NO: 136085 - DNA, 25 bp, Homo sapien
ccctgctgacgcttcgctttttatt

SEQ ID NO: 136086 - DNA, 25 bp, Homo sapien
ccaacatggcggatggagtcttcgc

SEQ ID NO: 136087 - DNA, 25 bp, Homo sapien
agctaacgcgcatgctcgcagtcgg

SEQ ID NO: 136088 - DNA, 25 bp, Homo sapien
gtcggaggccgtgctttttatccca

SEQ ID NO: 136089 - DNA, 25 bp, Homo sapien
aggcctctgctagcgcgaccctaga

SEQ ID NO: 136090 - DNA, 25 bp, Homo sapien
tgagccgcagaacgcaactacgttc

SEQ ID NO: 136091 - DNA, 25 bp, Homo sapien
cgactcgacgctcgaaacggctttc

SEQ ID NO: 136092 - DNA, 25 bp, Homo sapien
aatttgaccaatcccgtgaggagga

SEQ ID NO: 136093 - DNA, 25 bp, Homo sapien
gctgcctcccggaatttgaccaatc

SEQ ID NO: 136094 - DNA, 25 bp, Homo sapien
gtccgcactgagaaagcagcctccg

SEQ ID NO: 136095 - DNA, 25 bp, Homo sapien
tgctccctcgcctttagtttgacct

SEQ ID NO: 136096 - DNA, 25 bp, Homo sapien
tagtttgacctttccctccagtgtg

SEQ ID NO: 136097 - DNA, 25 bp, Homo sapien
actgtgcacgttctggggccctcac

SEQ ID NO: 136098 - DNA, 25 bp, Homo sapien
gcctgacgtcactgccatggcaacg

SEQ ID NO: 136099 - DNA, 25 bp, Homo sapien
cgcgcgtgtacatgtctctgtgtgt

SEQ ID NO: 136100 - DNA, 25 bp, Homo sapien
ggcacagccggtttatgacctaaga

SEQ ID NO: 136101 - DNA, 25 bp, Homo sapien
gcggtcccgctgctattcctcagag

SEQ ID NO: 136102 - DNA, 25 bp, Homo sapien
tctcttataagtacgaggggacagc

SEQ ID NO: 136103 - DNA, 25 bp, Homo sapien
caagtcgggatgacaaagacgccca

SEQ ID NO: 136104 - DNA, 25 bp, Homo sapien
ggacagcaacgcgacataacttaga

SEQ ID NO: 136105 - DNA, 25 bp, Homo sapien
aagctttagagagcagggcggtccc

SEQ ID NO: 136106 - DNA, 25 bp, Homo sapien
tcagacgcggctcactcagctgtgt

SEQ ID NO: 136107 - DNA, 25 bp, Homo sapien
ttatgtaaccgacctctgagctggc

SEQ ID NO: 136108 - DNA, 25 bp, Homo sapien
cccagcgagagcgtatcgacgagct

SEQ ID NO: 136109 - DNA, 25 bp, Homo sapien
catcccgcgcccgatcggccgccgc

SEQ ID NO: 136110 - DNA, 25 bp, Homo sapien
gagccttcgctgacgccaagaggca

SEQ ID NO: 136111 - DNA, 25 bp, Homo sapien
ccagcgagagcgtatcgacgagctg

SEQ ID NO: 136112 - DNA, 25 bp, Homo sapien
acacccagcgagagcgtatcgacga

SEQ ID NO: 136113 - DNA, 25 bp, Homo sapien
cccgccccgcgatgcgtgtgtgaag

SEQ ID NO: 136114 - DNA, 25 bp, Homo sapien
agccttcgctgacgccaagaggcag

SEQ ID NO: 136115 - DNA, 25 bp, Homo sapien
ctgccggccgctccggccaccgctc

SEQ ID NO: 136116 - DNA, 25 bp, Homo sapien
tggaggagaagtacctgcccgagct

SEQ ID NO: 136117 - DNA, 25 bp, Homo sapien
cgagcatggaggagaagtacctgcc

SEQ ID NO: 136118 - DNA, 25 bp, Homo sapien
gcatggaggagaagtacctgcccga

SEQ ID NO: 136119 - DNA, 25 bp, Homo sapien
gtgccctctgctgtcagcggacgcg

SEQ ID NO: 136120 - DNA, 25 bp, Homo sapien
cctggtgaaccaaggtgaggcgccg

SEQ ID NO: 136121 - DNA, 25 bp, Homo sapien
cctgcgcctggtgaaccaaggtgag

SEQ ID NO: 136122 - DNA, 25 bp, Homo sapien
acgccctgcgcctggtgaaccaagg

SEQ ID NO: 136123 - DNA, 25 bp, Homo sapien
gaggcgccggccgttaactgccggc

SEQ ID NO: 136124 - DNA, 25 bp, Homo sapien
cgccagcgccgcaagaaagcaagga

SEQ ID NO: 136125 - DNA, 25 bp, Homo sapien
gcttgcagaagcgtcactaccaccg

SEQ ID NO: 136126 - DNA, 25 bp, Homo sapien
accaccgacgagagagttttgcagc

SEQ ID NO: 136127 - DNA, 25 bp, Homo sapien
tccgcagcacctgcgagctggtgtt

SEQ ID NO: 136128 - DNA, 25 bp, Homo sapien
cgctgttccgtgacagaaagccatc

SEQ ID NO: 136129 - DNA, 25 bp, Homo sapien
ctgatgcggttgctatggttatgga

SEQ ID NO: 136130 - DNA, 25 bp, Homo sapien
tccaactggcaaccacgcttgcaga

SEQ ID NO: 136131 - DNA, 25 bp, Homo sapien
aaaagggtccctgcagatatccggg

SEQ ID NO: 136132 - DNA, 25 bp, Homo sapien
agcgcgtgtccatctgcaaagcaca

SEQ ID NO: 136133 - DNA, 25 bp, Homo sapien
tcagcgcatctctatgttaaatagc

SEQ ID NO: 136134 - DNA, 25 bp, Homo sapien
gtctgcgatgacgtgcgattcacta

SEQ ID NO: 136135 - DNA, 25 bp, Homo sapien
cagctccagctcgagtggtggccgt

SEQ ID NO: 136136 - DNA, 25 bp, Homo sapien
tgtccatctgcaaagcacacgacag

SEQ ID NO: 136137 - DNA, 25 bp, Homo sapien
ctatgttaaatagcgcgtgtccatc

SEQ ID NO: 136138 - DNA, 25 bp, Homo sapien
gctttctagtgtctgcgatgacgtg

SEQ ID NO: 136139 - DNA, 25 bp, Homo sapien
gattcactaatcacccggactcagc

SEQ ID NO: 136140 - DNA, 25 bp, Homo sapien
cccggatcttgtcgatggcattgaa

SEQ ID NO: 136141 - DNA, 25 bp, Homo sapien
gagtcccaactcgaaggccgtggtg

SEQ ID NO: 136142 - DNA, 25 bp, Homo sapien
tcctgcgagccaaagagtcccaact

SEQ ID NO: 136143 - DNA, 25 bp, Homo sapien
cgcgtctcccgtgttggtgttgccc

SEQ ID NO: 136144 - DNA, 25 bp, Homo sapien
cgtgatgtagcggagcgcgtctccc

SEQ ID NO: 136145 - DNA, 25 bp, Homo sapien
actttcacaaagacggcgccgcagc

SEQ ID NO: 136146 - DNA, 25 bp, Homo sapien
ccgggcgcactcactttcacaaaga

SEQ ID NO: 136147 - DNA, 25 bp, Homo sapien
cgtaggatccctatctgcccgagga

SEQ ID NO: 136148 - DNA, 25 bp, Homo sapien
aacatgaccagtgtcagcgggatgc

SEQ ID NO: 136149 - DNA, 25 bp, Homo sapien
gcacgaaggtgttcatgcgctcgcc

SEQ ID NO: 136150 - DNA, 25 bp, Homo sapien
agcaggtagcgcacgaaggtgttca

SEQ ID NO: 136151 - DNA, 25 bp, Homo sapien
cagcacttcttaatgcgcttcagca

SEQ ID NO: 136152 - DNA, 25 bp, Homo sapien
acacgtcagtgttgcgcatgccaca

SEQ ID NO: 136153 - DNA, 25 bp, Homo sapien
tgttctccatagacacgtcagtgtt

SEQ ID NO: 136154 - DNA, 25 bp, Homo sapien
ccacagtcaccatgttctccataga

SEQ ID NO: 136155 - DNA, 25 bp, Homo sapien
tgcaggagaagaagcccacagtcac

SEQ ID NO: 136156 - DNA, 25 bp, Homo sapien
cagcttcaggcagattgggcagaga

SEQ ID NO: 136157 - DNA, 25 bp, Homo sapien
tgcgcgaagtttgctcggctcaacc

SEQ ID NO: 136158 - DNA, 25 bp, Homo sapien
gatgggaggataaacgcggcttctt

SEQ ID NO: 136159 - DNA, 25 bp, Homo sapien
ccaagagcgcaagcagccctggcgg

SEQ ID NO: 136160 - DNA, 25 bp, Homo sapien
gaggaaaacgggattcagccagaga

SEQ ID NO: 136161 - DNA, 25 bp, Homo sapien
aaacgggattcagccagagatggca

SEQ ID NO: 136162 - DNA, 25 bp, Homo sapien
gcaggctgacagcttcaggcagatt

SEQ ID NO: 136163 - DNA, 25 bp, Homo sapien
gcagcagcggttcacgaagtcttcc

SEQ ID NO: 136164 - DNA, 25 bp, Homo sapien
cacgcaccgcgtcgaggtagaaggt

SEQ ID NO: 136165 - DNA, 25 bp, Homo sapien
cccacgaaggagacggtgtcgtgca

SEQ ID NO: 136166 - DNA, 25 bp, Homo sapien
tcgtagttgtgcacgccgttctggt

SEQ ID NO: 136167 - DNA, 25 bp, Homo sapien
cacgccgttctggtggtcctggaag

SEQ ID NO: 136168 - DNA, 25 bp, Homo sapien
ggtcacatggctgtccgtccaccag

SEQ ID NO: 136169 - DNA, 25 bp, Homo sapien
tgtccgtccaccagcacatctgtaa

SEQ ID NO: 136170 - DNA, 25 bp, Homo sapien
tctgtaagggacacgagactgtcgg

SEQ ID NO: 136171 - DNA, 25 bp, Homo sapien
cagcacatctgtaagggacacgaga

SEQ ID NO: 136172 - DNA, 25 bp, Homo sapien
ggggagccctgcattccgagtcaca

SEQ ID NO: 136173 - DNA, 25 bp, Homo sapien
ggggagcactgcattccgagtcaca

SEQ ID NO: 136174 - DNA, 25 bp, Homo sapien
gagcactgcattccgagtcacacgg

SEQ ID NO: 136175 - DNA, 25 bp, Homo sapien
gagccctgcattccgagtcacacgg

SEQ ID NO: 136176 - DNA, 25 bp, Homo sapien
ggagccctgcattccgagtcacacg

SEQ ID NO: 136177 - DNA, 25 bp, Homo sapien
ccctgcattccgagtcacacggggg

SEQ ID NO: 136178 - DNA, 25 bp, Homo sapien
gggagccctgcattccgagtcacac

SEQ ID NO: 136179 - DNA, 25 bp, Homo sapien
attccgagtcacacgggggagccct

SEQ ID NO: 136180 - DNA, 25 bp, Homo sapien
cacaaaacacatgctcctcggcgga

SEQ ID NO: 136181 - DNA, 25 bp, Homo sapien
tgcagaagctcagtcaatccacctg

SEQ ID NO: 136182 - DNA, 25 bp, Homo sapien
agtcaatccacctgcagtgcacggg

SEQ ID NO: 136183 - DNA, 25 bp, Homo sapien
ggacagctcgcatttcggtatgcta

SEQ ID NO: 136184 - DNA, 25 bp, Homo sapien
gctaagaatagtccgggttgcgcta

SEQ ID NO: 136185 - DNA, 25 bp, Homo sapien
ggttgcgctaagagcccgaatgcga

SEQ ID NO: 136186 - DNA, 25 bp, Homo sapien
cccgaatgcgaagggtatggaagtc

SEQ ID NO: 136187 - DNA, 25 bp, Homo sapien
tatggaagtcgttctctgcggaggc

SEQ ID NO: 136188 - DNA, 25 bp, Homo sapien
cactcagctaggtctcagtgcgcag

SEQ ID NO: 136189 - DNA, 25 bp, Homo sapien
tgccgcagtccgcagggtactgacg

SEQ ID NO: 136190 - DNA, 25 bp, Homo sapien
gggagacacccagctaggtctctgc

SEQ ID NO: 136191 - DNA, 25 bp, Homo sapien
actcagctaggtctcagtgcgcagc

SEQ ID NO: 136192 - DNA, 25 bp, Homo sapien
agccgtgcacaggggaggacaccca

SEQ ID NO: 136193 - DNA, 25 bp, Homo sapien
acccagctaggtctctgcgcagctg

SEQ ID NO: 136194 - DNA, 25 bp, Homo sapien
cagccgtgcacaggggaggacaccc

SEQ ID NO: 136195 - DNA, 25 bp, Homo sapien
aagacactcagctaggtctcagtgc

SEQ ID NO: 136196 - DNA, 25 bp, Homo sapien
cgtccgcagggaagacactcagcta

SEQ ID NO: 136197 - DNA, 25 bp, Homo sapien
tcccgggatccacaaagtaatgacg

SEQ ID NO: 136198 - DNA, 25 bp, Homo sapien
gcgcaactgcagtagtgccgcaatc

SEQ ID NO: 136199 - DNA, 25 bp, Homo sapien
caccgcagggtaagacactcagcta

SEQ ID NO: 136200 - DNA, 25 bp, Homo sapien
cagcgttctgcaagggagacaccca

SEQ ID NO: 136201 - DNA, 25 bp, Homo sapien
tcagctgcttcagtatcccgggatc

SEQ ID NO: 136202 - DNA, 25 bp, Homo sapien
ggtactgacgctctcctgaatcttc

SEQ ID NO: 136203 - DNA, 25 bp, Homo sapien
cgctaggccattcacagggtaaaca

SEQ ID NO: 136204 - DNA, 25 bp, Homo sapien
gaagtctccaagaggggctccagga

SEQ ID NO: 136205 - DNA, 25 bp, Homo sapien
tgtgctgcctgtcttcgcttgaggc

SEQ ID NO: 136206 - DNA, 25 bp, Homo sapien
tgccagggcaaacctcgccaaactt

SEQ ID NO: 136207 - DNA, 25 bp, Homo sapien
agcctgacctttgggacatccgccg

SEQ ID NO: 136208 - DNA, 25 bp, Homo sapien
gcaagtgactctcctgtgccacaca

SEQ ID NO: 136209 - DNA, 25 bp, Homo sapien
gctatctttgcgcatggaagtctcc

SEQ ID NO: 136210 - DNA, 25 bp, Homo sapien
gctcggctgtaatgaagcgcctcta

SEQ ID NO: 136211 - DNA, 25 bp, Homo sapien
tgctgcgtttgtgcgcaagtgactc

SEQ ID NO: 136212 - DNA, 25 bp, Homo sapien
ggcttcggcgctgcggcaccgcccg

SEQ ID NO: 136213 - DNA, 25 bp, Homo sapien
ggaaggggcttcggcgctgcggcac

SEQ ID NO: 136214 - DNA, 25 bp, Homo sapien
gaaggggcttcggcgctgcggcacc

SEQ ID NO: 136215 - DNA, 25 bp, Homo sapien
aaggggcttcggcgctgcggcaccg

SEQ ID NO: 136216 - DNA, 25 bp, Homo sapien
aggggcttcggcgctgcggcaccgc

SEQ ID NO: 136217 - DNA, 25 bp, Homo sapien
ggggcttcggcgctgcggcaccgcc

SEQ ID NO: 136218 - DNA, 25 bp, Homo sapien
gcttcggcgctgcggcaccgcccgc

SEQ ID NO: 136219 - DNA, 25 bp, Homo sapien
gggcttcggcgctgcggcaccgccc

SEQ ID NO: 136220 - DNA, 25 bp, Homo sapien
ctccctccgaccgtgagtgcgtaaa

SEQ ID NO: 136221 - DNA, 25 bp, Homo sapien
gtccagcctcgcacttcctcgcggg

SEQ ID NO: 136222 - DNA, 25 bp, Homo sapien
gagaaggaatctcccggcccacgcg

SEQ ID NO: 136223 - DNA, 25 bp, Homo sapien
ccggcaggcgagaaggaatctcccg

SEQ ID NO: 136224 - DNA, 25 bp, Homo sapien
aagcctttccgcctccgtgcgctgc

SEQ ID NO: 136225 - DNA, 25 bp, Homo sapien
gccagcctggggaaagcctttccgc

SEQ ID NO: 136226 - DNA, 25 bp, Homo sapien
gctgctgagtcacccgcgaagggaa

SEQ ID NO: 136227 - DNA, 25 bp, Homo sapien
tgagtgcgtaaaacccgggagcagc

SEQ ID NO: 136228 - DNA, 25 bp, Homo sapien
gctcagagaaaaccaacgccaccag

SEQ ID NO: 136229 - DNA, 25 bp, Homo sapien
cctacaggccgacaggaaacggctc

SEQ ID NO: 136230 - DNA, 25 bp, Homo sapien
agagaaaaccaacgccaccagacgg

SEQ ID NO: 136231 - DNA, 25 bp, Homo sapien
gacggccacctacaggccgacagga

SEQ ID NO: 136232 - DNA, 25 bp, Homo sapien
agacggccacctacaggccgacggg

SEQ ID NO: 136233 - DNA, 25 bp, Homo sapien
gacggccacctacaggccgacggga

SEQ ID NO: 136234 - DNA, 25 bp, Homo sapien
acaggccgacgggaaacggctcaga

SEQ ID NO: 136235 - DNA, 25 bp, Homo sapien
acaggccgacaggaaacggctcaga

SEQ ID NO: 136236 - DNA, 25 bp, Homo sapien
aggcacgcaaggagagggcacacaa

SEQ ID NO: 136237 - DNA, 25 bp, Homo sapien
ctggcagaggttccgcttcagagcg

SEQ ID NO: 136238 - DNA, 25 bp, Homo sapien
accctggcagaggttccgcttcaga

SEQ ID NO: 136239 - DNA, 25 bp, Homo sapien
cgaccctggcagaggttccgcttca

SEQ ID NO: 136240 - DNA, 25 bp, Homo sapien
agacgaccctggcagaggttccgct

SEQ ID NO: 136241 - DNA, 25 bp, Homo sapien
aggcagacgaccctggcagaggttc

SEQ ID NO: 136242 - DNA, 25 bp, Homo sapien
cgcgcgagggaaggcagacgaccct

SEQ ID NO: 136243 - DNA, 25 bp, Homo sapien
gggcacacgacggaagggcacagag

SEQ ID NO: 136244 - DNA, 25 bp, Homo sapien
cccggacaggtgtccgccgagtctt

SEQ ID NO: 136245 - DNA, 25 bp, Homo sapien
gccaacaggagcaagggcgcctcga

SEQ ID NO: 136246 - DNA, 25 bp, Homo sapien
gcagccggtccgaattgcctgaccg

SEQ ID NO: 136247 - DNA, 25 bp, Homo sapien
ctttgcacttacacagccggtggcc

SEQ ID NO: 136248 - DNA, 25 bp, Homo sapien
cgtcccgggttttgcaagagacgcg

SEQ ID NO: 136249 - DNA, 25 bp, Homo sapien
gggacacggccttggacagatgtaa

SEQ ID NO: 136250 - DNA, 25 bp, Homo sapien
gacagatgtaagcagagcgccaaca

SEQ ID NO: 136251 - DNA, 25 bp, Homo sapien
tgtccgccgagtcttcagcgggtgt

SEQ ID NO: 136252 - DNA, 25 bp, Homo sapien
ccgggtgtgcttaaggctcagcaga

SEQ ID NO: 136253 - DNA, 25 bp, Homo sapien
catctacaaatgacggcagccgggt

SEQ ID NO: 136254 - DNA, 25 bp, Homo sapien
acccgggcagcgacatctacaaatg

SEQ ID NO: 136255 - DNA, 25 bp, Homo sapien
ttggagtgaatgcagggatgcattc

SEQ ID NO: 136256 - DNA, 25 bp, Homo sapien
cctcgaggacggcacacagcaaggc

SEQ ID NO: 136257 - DNA, 25 bp, Homo sapien
tggccacttcttgctcctgtctggg

SEQ ID NO: 136258 - DNA, 25 bp, Homo sapien
ctcagccgtcgaggtggccacttct

SEQ ID NO: 136259 - DNA, 25 bp, Homo sapien
gctcagcagactcacagggacgtgc

SEQ ID NO: 136260 - DNA, 25 bp, Homo sapien
aaagccgcgcgcttgtgacgatgtc

SEQ ID NO: 136261 - DNA, 25 bp, Homo sapien
tcaacactgtgactcgtacgccctg

SEQ ID NO: 136262 - DNA, 25 bp, Homo sapien
attccctccggctgcgtggaaatcc

SEQ ID NO: 136263 - DNA, 25 bp, Homo sapien
atcccggagcactggatttcccaga

SEQ ID NO: 136264 - DNA, 25 bp, Homo sapien
cgccggtagctgaggcatcaatttc

SEQ ID NO: 136265 - DNA, 25 bp, Homo sapien
atcaatttcccgcagcgcctagggg

SEQ ID NO: 136266 - DNA, 25 bp, Homo sapien
tcggaacctatcctacacaaggctg

SEQ ID NO: 136267 - DNA, 25 bp, Homo sapien
accgaagattcattttggacagccc

SEQ ID NO: 136268 - DNA, 25 bp, Homo sapien
tgtccagcatcaaccaggaggcgtt

SEQ ID NO: 136269 - DNA, 25 bp, Homo sapien
ggtcctagtacagcgcaggcgctta

SEQ ID NO: 136270 - DNA, 25 bp, Homo sapien
agagggctttgcttgcccattcaca

SEQ ID NO: 136271 - DNA, 25 bp, Homo sapien
ctcacccgcggatcaaagtcgtatt

SEQ ID NO: 136272 - DNA, 25 bp, Homo sapien
tcccgcatccgggtcatcatgaaga

SEQ ID NO: 136273 - DNA, 25 bp, Homo sapien
gtttctctcgcgcttccattcggca

SEQ ID NO: 136274 - DNA, 25 bp, Homo sapien
ttccattcggcaaacccgtaagctc

SEQ ID NO: 136275 - DNA, 25 bp, Homo sapien
caaagtcgtattccgcgaccgcagc

SEQ ID NO: 136276 - DNA, 25 bp, Homo sapien
cttcggcaacacaggcatctcgtta

SEQ ID NO: 136277 - DNA, 25 bp, Homo sapien
ccaagactctgtccgaaggggactc

SEQ ID NO: 136278 - DNA, 25 bp, Homo sapien
ggatgccagcgtgactacacaggta

SEQ ID NO: 136279 - DNA, 25 bp, Homo sapien
ctacacaggtagaagtcgaactcgg

SEQ ID NO: 136280 - DNA, 25 bp, Homo sapien
tgggtgattttcgtgtccacagtcg

SEQ ID NO: 136281 - DNA, 25 bp, Homo sapien
ccacagtcgtgcctgctggaatgtt

SEQ ID NO: 136282 - DNA, 25 bp, Homo sapien
gctggaatgtttccacttttcccaa

SEQ ID NO: 136283 - DNA, 25 bp, Homo sapien
gcatctcgttagacacggccaggga

SEQ ID NO: 136284 - DNA, 25 bp, Homo sapien
ggcccgcatacgtgttcttcaggtg

SEQ ID NO: 136285 - DNA, 25 bp, Homo sapien
cctggatgggcatgccggcgtctct

SEQ ID NO: 136286 - DNA, 25 bp, Homo sapien
ccctgcgcgtatttgcagaagcacg

SEQ ID NO: 136287 - DNA, 25 bp, Homo sapien
catacgtgttcttcaggtgccggaa

SEQ ID NO: 136288 - DNA, 25 bp, Homo sapien
gctgcaggcccgcatacgtgttctt

SEQ ID NO: 136289 - DNA, 25 bp, Homo sapien
cgtcttgccgggcaggatgaccacc

SEQ ID NO: 136290 - DNA, 25 bp, Homo sapien
acacctaccgtacacgggcgtcttg

SEQ ID NO: 136291 - DNA, 25 bp, Homo sapien
tcaggtgccggaacatgggctccac

SEQ ID NO: 136292 - DNA, 25 bp, Homo sapien
agcaggagaacacctgaccgttttt

SEQ ID NO: 136293 - DNA, 25 bp, Homo sapien
gagaccgccttctactctgcattta

SEQ ID NO: 136294 - DNA, 25 bp, Homo sapien
gggccacaacggagcgcgccacaga

SEQ ID NO: 136295 - DNA, 25 bp, Homo sapien
tctggaatgagaacgagccgcgcac

SEQ ID NO: 136296 - DNA, 25 bp, Homo sapien
ggcgacagccctaactacaggaatt

SEQ ID NO: 136297 - DNA, 25 bp, Homo sapien
tgccggcaacaagaagggccacaac

SEQ ID NO: 136298 - DNA, 25 bp, Homo sapien
caacaaggggtgctacaggaatcca

SEQ ID NO: 136299 - DNA, 25 bp, Homo sapien
ttttccagagaaaggccgactagca

SEQ ID NO: 136300 - DNA, 25 bp, Homo sapien
cccagcctggctctttaagttacta

SEQ ID NO: 136301 - DNA, 25 bp, Homo sapien
cagaaacacggaggtcgggaagctc

SEQ ID NO: 136302 - DNA, 25 bp, Homo sapien
cagcccggagcttgaacttgaacgc

SEQ ID NO: 136303 - DNA, 25 bp, Homo sapien
cccagataatccgtttaaagcactg

SEQ ID NO: 136304 - DNA, 25 bp, Homo sapien
actgtagctggtatcagggatcaga

SEQ ID NO: 136305 - DNA, 25 bp, Homo sapien
cagggatcagatcagcggacacgcc

SEQ ID NO: 136306 - DNA, 25 bp, Homo sapien
tcgtgcacctccgagcgtttctgtc

SEQ ID NO: 136307 - DNA, 25 bp, Homo sapien
ggacacgcccattccagcagtcagg

SEQ ID NO: 136308 - DNA, 25 bp, Homo sapien
cgcaagtctggatgggccgaactaa

SEQ ID NO: 136309 - DNA, 25 bp, Homo sapien
tcaagccagagttcgagaatcaacc

SEQ ID NO: 136310 - DNA, 25 bp, Homo sapien
ggacgggagcctcgcccgcaagtct

SEQ ID NO: 136311 - DNA, 25 bp, Homo sapien
tccagagacgtgacttgggcgccgc

SEQ ID NO: 136312 - DNA, 25 bp, Homo sapien
ctgcctttcactgcgggtgctgggc

SEQ ID NO: 136313 - DNA, 25 bp, Homo sapien
tcctcgctaaatgcggggccgactc

SEQ ID NO: 136314 - DNA, 25 bp, Homo sapien
caccaaacgcgtgcgtcaagccaga

SEQ ID NO: 136315 - DNA, 25 bp, Homo sapien
acccacgcgcaggacgggattaatg

SEQ ID NO: 136316 - DNA, 25 bp, Homo sapien
gctaggctctgctcgcgtaatttgt

SEQ ID NO: 136317 - DNA, 25 bp, Homo sapien
gccgctaggctctgctcgcgtaatt

SEQ ID NO: 136318 - DNA, 25 bp, Homo sapien
tgaggcgcgcgtcctctctcggcag

SEQ ID NO: 136319 - DNA, 25 bp, Homo sapien
tcccacgcctcacgccgcgggctca

SEQ ID NO: 136320 - DNA, 25 bp, Homo sapien
agcccacgaccgctgcacagaagga

SEQ ID NO: 136321 - DNA, 25 bp, Homo sapien
ccggacgaggaaagccctggtctcg

SEQ ID NO: 136322 - DNA, 25 bp, Homo sapien
atttgtcctgtagtgaccgcgccgg

SEQ ID NO: 136323 - DNA, 25 bp, Homo sapien
gctcgcgtaatttgtcctgtagtga

SEQ ID NO: 136324 - DNA, 25 bp, Homo sapien
tctcttcagtcgctcccatcttggg

SEQ ID NO: 136325 - DNA, 25 bp, Homo sapien
tcgctcccatcttgggcaggtgctt

SEQ ID NO: 136326 - DNA, 25 bp, Homo sapien
ggaccctttgcgtcctggagccttg

SEQ ID NO: 136327 - DNA, 25 bp, Homo sapien
cgcggtatcctctggggctctccag

SEQ ID NO: 136328 - DNA, 25 bp, Homo sapien
agtctccgaagtctcgagcaggtga

SEQ ID NO: 136329 - DNA, 25 bp, Homo sapien
cgcggactttccgagggctgagtcc

SEQ ID NO: 136330 - DNA, 25 bp, Homo sapien
cttttgagagctgcgaacttggtcc

SEQ ID NO: 136331 - DNA, 25 bp, Homo sapien
ggcccttggtgtgagacatgtcttt

SEQ ID NO: 136332 - DNA, 25 bp, Homo sapien
gccacctggtggagattttcgcata

SEQ ID NO: 136333 - DNA, 25 bp, Homo sapien
ttttcgcataaccacctggtgcctg

SEQ ID NO: 136334 - DNA, 25 bp, Homo sapien
ggaaatttcctcctgagcctgtgac

SEQ ID NO: 136335 - DNA, 25 bp, Homo sapien
gtcgtcctggactcaactgtggcca

SEQ ID NO: 136336 - DNA, 25 bp, Homo sapien
tgacagcgccgacttccttcctgtg

SEQ ID NO: 136337 - DNA, 25 bp, Homo sapien
tgtggccatgatagcggattcccta

SEQ ID NO: 136338 - DNA, 25 bp, Homo sapien
aggcatcgctgttgacgctttggta

SEQ ID NO: 136339 - DNA, 25 bp, Homo sapien
cttttagttgctgccgtgacgactc

SEQ ID NO: 136340 - DNA, 25 bp, Homo sapien
tctggtgctcgctcaggtgggccag

SEQ ID NO: 136341 - DNA, 25 bp, Homo sapien
ccaaagcccagccacgagtctgggg

SEQ ID NO: 136342 - DNA, 25 bp, Homo sapien
tgtgttcccaaagcccagccacgag

SEQ ID NO: 136343 - DNA, 25 bp, Homo sapien
aggaagctgttctcgctcgctgcct

SEQ ID NO: 136344 - DNA, 25 bp, Homo sapien
tgcaggaagctgttctcgctcgctg

SEQ ID NO: 136345 - DNA, 25 bp, Homo sapien
cgcagcaccgggtgttccctcctag

SEQ ID NO: 136346 - DNA, 25 bp, Homo sapien
tggtggggtgtcgattccgcctccc

SEQ ID NO: 136347 - DNA, 25 bp, Homo sapien
actgcttcaggcctgtccaggggcg

SEQ ID NO: 136348 - DNA, 25 bp, Homo sapien
acgccaagtacctgaagcgcagctc

SEQ ID NO: 136349 - DNA, 25 bp, Homo sapien
ggagggctcctccaaaagcaacgcc

SEQ ID NO: 136350 - DNA, 25 bp, Homo sapien
ctggacagcgacagcacctatcgga

SEQ ID NO: 136351 - DNA, 25 bp, Homo sapien
ccagttcgagaagcagctgccgctg

SEQ ID NO: 136352 - DNA, 25 bp, Homo sapien
ggcttccacacgctgcagtaccaga

SEQ ID NO: 136353 - DNA, 25 bp, Homo sapien
aggcctaccgcaagagctcgctgaa

SEQ ID NO: 136354 - DNA, 25 bp, Homo sapien
ggtacactccgtgcagaagctcttc

SEQ ID NO: 136355 - DNA, 25 bp, Homo sapien
agctcctggtctacgctgacggtca

SEQ ID NO: 136356 - DNA, 25 bp, Homo sapien
gcgcaatggcgctttgcagacaaga

SEQ ID NO: 136357 - DNA, 25 bp, Homo sapien
gtccctctcgggcaaggctatcagc

SEQ ID NO: 136358 - DNA, 25 bp, Homo sapien
ccgccttgttactgcatccgtctga

SEQ ID NO: 136359 - DNA, 25 bp, Homo sapien
tgcatccgtctgaggtacaaggtta

SEQ ID NO: 136360 - DNA, 25 bp, Homo sapien
acccacacaagctgcgggcgcaatg

SEQ ID NO: 136361 - DNA, 25 bp, Homo sapien
ttgcagacaagacagcctgcccgtc

SEQ ID NO: 136362 - DNA, 25 bp, Homo sapien
tcggcttcccttaagacacaaggtg

SEQ ID NO: 136363 - DNA, 25 bp, Homo sapien
tacaaggttagaagccacagacacc

SEQ ID NO: 136364 - DNA, 25 bp, Homo sapien
accagaacgactgtgcggagccctc

SEQ ID NO: 136365 - DNA, 25 bp, Homo sapien
tgtcccgattccagcgtcgagcagg

SEQ ID NO: 136366 - DNA, 25 bp, Homo sapien
agacgtctgcgtccctttgcacctg

SEQ ID NO: 136367 - DNA, 25 bp, Homo sapien
cgggccttagctgtcccagacgtct

SEQ ID NO: 136368 - DNA, 25 bp, Homo sapien
ctgggagctctgctctcaggaatcc

SEQ ID NO: 136369 - DNA, 25 bp, Homo sapien
aaggcatggagttccgacaggttcc

SEQ ID NO: 136370 - DNA, 25 bp, Homo sapien
gcctcctaggagagtccttcagacg

SEQ ID NO: 136371 - DNA, 25 bp, Homo sapien
ccagcaaatggtttagagacgaatc

SEQ ID NO: 136372 - DNA, 25 bp, Homo sapien
tgagcttcagcacggtgggcttttc

SEQ ID NO: 136373 - DNA, 25 bp, Homo sapien
tgggcttttcgctgttcccaccggc

SEQ ID NO: 136374 - DNA, 25 bp, Homo sapien
agggttccgcggtgtctctgctccc

SEQ ID NO: 136375 - DNA, 25 bp, Homo sapien
gcggctcagaccacggactctgtct

SEQ ID NO: 136376 - DNA, 25 bp, Homo sapien
tgtaaacgggagtgcggctcagacc

SEQ ID NO: 136377 - DNA, 25 bp, Homo sapien
cccactggaatgtgtgtaaacggga

SEQ ID NO: 136378 - DNA, 25 bp, Homo sapien
cacccgcccactggaatgtgtgtaa

SEQ ID NO: 136379 - DNA, 25 bp, Homo sapien
cacagcatctgcagggttccgcggt

SEQ ID NO: 136380 - DNA, 25 bp, Homo sapien
ccttcgaagatgacctggcccatga

SEQ ID NO: 136381 - DNA, 25 bp, Homo sapien
gccgagtcgcttttgctgcgcatga

SEQ ID NO: 136382 - DNA, 25 bp, Homo sapien
ccgtttgggactttagcttcattca

SEQ ID NO: 136383 - DNA, 25 bp, Homo sapien
gggacccaagcttgccgtagtagga

SEQ ID NO: 136384 - DNA, 25 bp, Homo sapien
cgctgccgcttctgcatgtcgtaca

SEQ ID NO: 136385 - DNA, 25 bp, Homo sapien
tccctgggcatcttcagcatggaga

SEQ ID NO: 136386 - DNA, 25 bp, Homo sapien
tggcccatgaagtcggtgtagaaca

SEQ ID NO: 136387 - DNA, 25 bp, Homo sapien
ctgtactgctcctcgtcgatgctga

SEQ ID NO: 136388 - DNA, 25 bp, Homo sapien
atgttgagggccatgtcctgctcct

SEQ ID NO: 136389 - DNA, 25 bp, Homo sapien
cacccagccttggtgcggcagcgtt

SEQ ID NO: 136390 - DNA, 25 bp, Homo sapien
ccagcagataggcacggatgggccc

SEQ ID NO: 136391 - DNA, 25 bp, Homo sapien
ccctcggtggcatcggcgctgaagt

SEQ ID NO: 136392 - DNA, 25 bp, Homo sapien
cagcaccgtgagcacgatgccaatg

SEQ ID NO: 136393 - DNA, 25 bp, Homo sapien
gcacgatgccaatgggctgccggtt

SEQ ID NO: 136394 - DNA, 25 bp, Homo sapien
ccgagggccagacctgcgcagagca

SEQ ID NO: 136395 - DNA, 25 bp, Homo sapien
tgtccaccacgtccagcagataggc

SEQ ID NO: 136396 - DNA, 25 bp, Homo sapien
taactgcggctgtcgtgtgactacc

SEQ ID NO: 136397 - DNA, 25 bp, Homo sapien
tctccgggttttgtagtctcgtgta

SEQ ID NO: 136398 - DNA, 25 bp, Homo sapien
gcgcttctcattggcgtcagtcaag

SEQ ID NO: 136399 - DNA, 25 bp, Homo sapien
cactgccttcgttgccgttctaagc

SEQ ID NO: 136400 - DNA, 25 bp, Homo sapien
ggcgctgctgtcagtattaccgacg

SEQ ID NO: 136401 - DNA, 25 bp, Homo sapien
ctctgccgttgcctttcattaactg

SEQ ID NO: 136402 - DNA, 25 bp, Homo sapien
tggacccttgagaaaacctggcagt

SEQ ID NO: 136403 - DNA, 25 bp, Homo sapien
agcactgtgggcattgtagtcactc

SEQ ID NO: 136404 - DNA, 25 bp, Homo sapien
aggtgcctctgtgtacacgcacgca

SEQ ID NO: 136405 - DNA, 25 bp, Homo sapien
ttaccgatggcagagccgttaagga

SEQ ID NO: 136406 - DNA, 25 bp, Homo sapien
caaagaggacgccaacgcagagggc

SEQ ID NO: 136407 - DNA, 25 bp, Homo sapien
agggtgcaccggtcactcgcagacc

SEQ ID NO: 136408 - DNA, 25 bp, Homo sapien
ctcgcagacccaatgagaggtgtga

SEQ ID NO: 136409 - DNA, 25 bp, Homo sapien
tcaggaaccaggtgaggctgtagta

SEQ ID NO: 136410 - DNA, 25 bp, Homo sapien
tccggaaggcctgcaagggacacga

SEQ ID NO: 136411 - DNA, 25 bp, Homo sapien
aggctgtagtactgctccggaaggc

SEQ ID NO: 136412 - DNA, 25 bp, Homo sapien
cacgatgctcagtgcggcgagcagc

SEQ ID NO: 136413 - DNA, 25 bp, Homo sapien
cacccacgatgctcagtgcggcgag

SEQ ID NO: 136414 - DNA, 25 bp, Homo sapien
gggtgctctcaatgctggtgcgcaa

SEQ ID NO: 136415 - DNA, 25 bp, Homo sapien
ctctcaatgctggtgcgcaaggtgc

SEQ ID NO: 136416 - DNA, 25 bp, Homo sapien
atgctggtgcgcaaggtgccctgcc

SEQ ID NO: 136417 - DNA, 25 bp, Homo sapien
tggcaccaagcatctacacccaacg

SEQ ID NO: 136418 - DNA, 25 bp, Homo sapien
tcctgctggggtgctctcaatgctg

SEQ ID NO: 136419 - DNA, 25 bp, Homo sapien
cacgtgctttccctggaaggggcgg

SEQ ID NO: 136420 - DNA, 25 bp, Homo sapien
gaaatactgtgtcaccgctcggccg

SEQ ID NO: 136421 - DNA, 25 bp, Homo sapien
ggctccaaacacacacaacgctggg

SEQ ID NO: 136422 - DNA, 25 bp, Homo sapien
ggctctccgttcacaggaaatactg

SEQ ID NO: 136423 - DNA, 25 bp, Homo sapien
caatggtgagaccaggaaggctctc

SEQ ID NO: 136424 - DNA, 25 bp, Homo sapien
acacacacaacgctgggcccagtaa

SEQ ID NO: 136425 - DNA, 25 bp, Homo sapien
tgacggggcatttcccagcccggct

SEQ ID NO: 136426 - DNA, 25 bp, Homo sapien
tgcctcgcaggtcctgctctgacgt

SEQ ID NO: 136427 - DNA, 25 bp, Homo sapien
cccagggaaaagttgaacaacaatg

SEQ ID NO: 136428 - DNA, 25 bp, Homo sapien
gcccacctgcgtctgtgaatttccg

SEQ ID NO: 136429 - DNA, 25 bp, Homo sapien
acctgcgtgtctgtgaatttccgtg

SEQ ID NO: 136430 - DNA, 25 bp, Homo sapien
tgcccacctgcgtctgtgaatttcc

SEQ ID NO: 136431 - DNA, 25 bp, Homo sapien
cgcccacctgcgagtgtctgtgaat

SEQ ID NO: 136432 - DNA, 25 bp, Homo sapien
gcccacctgtgcgtctgtgaatttc

SEQ ID NO: 136433 - DNA, 25 bp, Homo sapien
cccacctgtgcgtctgtgaatttcc

SEQ ID NO: 136434 - DNA, 25 bp, Homo sapien
acctgtgcgtctgtgaatttccgtg

SEQ ID NO: 136435 - DNA, 25 bp, Homo sapien
acgcccacctgcgagtgtctgtgaa

SEQ ID NO: 136436 - DNA, 25 bp, Homo sapien
aacttgcatagattccgggtcggca

SEQ ID NO: 136437 - DNA, 25 bp, Homo sapien
ccctcgctgatggtctcgcagttct

SEQ ID NO: 136438 - DNA, 25 bp, Homo sapien
ttccatggcgtaacagaactccctg

SEQ ID NO: 136439 - DNA, 25 bp, Homo sapien
cggggaggagacttaccaatctgca

SEQ ID NO: 136440 - DNA, 25 bp, Homo sapien
tcagcgttcactgcgcacagacggg

SEQ ID NO: 136441 - DNA, 25 bp, Homo sapien
atctgcaacagtattggtgtgacca

SEQ ID NO: 136442 - DNA, 25 bp, Homo sapien
ggggcacggataactcttgaacttg

SEQ ID NO: 136443 - DNA, 25 bp, Homo sapien
acccacaggcgcatggggattcggt

SEQ ID NO: 136444 - DNA, 25 bp, Homo sapien
agccgcgacatctggcacctggggc

SEQ ID NO: 136445 - DNA, 25 bp, Homo sapien
ctgagcgcgacctgcgtgtcctgct

SEQ ID NO: 136446 - DNA, 25 bp, Homo sapien
gctttcgtgccggttcagaagaaca

SEQ ID NO: 136447 - DNA, 25 bp, Homo sapien
tcagaagaacaaggccggaaggttg

SEQ ID NO: 136448 - DNA, 25 bp, Homo sapien
gttgcggtctcagcgctcgctccat

SEQ ID NO: 136449 - DNA, 25 bp, Homo sapien
gcgttcctctctgcactcaggagct

SEQ ID NO: 136450 - DNA, 25 bp, Homo sapien
cccgttccgtgctggcgatgaggac

SEQ ID NO: 136451 - DNA, 25 bp, Homo sapien
ggagaagacggcagccgcgacatct

SEQ ID NO: 136452 - DNA, 25 bp, Homo sapien
cccgttgtgcttggcgtgttcacgg

SEQ ID NO: 136453 - DNA, 25 bp, Homo sapien
ggaccctactctttatttgacatga

SEQ ID NO: 136454 - DNA, 25 bp, Homo sapien
ttgacatgaagaggttcggactccc

SEQ ID NO: 136455 - DNA, 25 bp, Homo sapien
cggactcccagttttattcggcatg

SEQ ID NO: 136456 - DNA, 25 bp, Homo sapien
agttttattcggcatgttcacgggc

SEQ ID NO: 136457 - DNA, 25 bp, Homo sapien
cccattttgtttggcgtgttcacgg

SEQ ID NO: 136458 - DNA, 25 bp, Homo sapien
agccctgttttattcggcgtgttca

SEQ ID NO: 136459 - DNA, 25 bp, Homo sapien
ggttttctcctcttctagtgtcttc

SEQ ID NO: 136460 - DNA, 25 bp, Homo sapien
tcctgccttcagcacgtggtcactg

SEQ ID NO: 136461 - DNA, 25 bp, Homo sapien
cgccctgggataacgaggaccaaca

SEQ ID NO: 136462 - DNA, 25 bp, Homo sapien
caagtcctgtgaggtctgcactcca

SEQ ID NO: 136463 - DNA, 25 bp, Homo sapien
gggtataaaccgcacacgagcagtc

SEQ ID NO: 136464 - DNA, 25 bp, Homo sapien
gtcatgtttttctgcggaaggaccc

SEQ ID NO: 136465 - DNA, 25 bp, Homo sapien
cccgaggtcacggtgtgtcatgttt

SEQ ID NO: 136466 - DNA, 25 bp, Homo sapien
gggcctcgcctacgttggaagatag

SEQ ID NO: 136467 - DNA, 25 bp, Homo sapien
tggcttccttcactgccgtggctga

SEQ ID NO: 136468 - DNA, 25 bp, Homo sapien
ctcatgactatgcagcacccgccgc

SEQ ID NO: 136469 - DNA, 25 bp, Homo sapien
ctctcgccactctgtcgcagagggg

SEQ ID NO: 136470 - DNA, 25 bp, Homo sapien
tcctccgctgcaggagaaaactctc

SEQ ID NO: 136471 - DNA, 25 bp, Homo sapien
actctgtcgcagaggggtccggcta

SEQ ID NO: 136472 - DNA, 25 bp, Homo sapien
ccctaaagcgctggcccgcaatcca

SEQ ID NO: 136473 - DNA, 25 bp, Homo sapien
gcaggagaaaactctcctgttttcc

SEQ ID NO: 136474 - DNA, 25 bp, Homo sapien
ttatcgggtcggaaacagccgctcc

SEQ ID NO: 136475 - DNA, 25 bp, Homo sapien
gacaacgccgctttatcgggtcgga

SEQ ID NO: 136476 - DNA, 25 bp, Homo sapien
agtagatcggtcaccaccaggttga

SEQ ID NO: 136477 - DNA, 25 bp, Homo sapien
gcagggacagccctaccagtagatc

SEQ ID NO: 136478 - DNA, 25 bp, Homo sapien
ccctggcgccgtagtacacagcgaa

SEQ ID NO: 136479 - DNA, 25 bp, Homo sapien
ctccaggacagtcagcgcaaagaca

SEQ ID NO: 136480 - DNA, 25 bp, Homo sapien
agaagacgtacagcgccagcccgtt

SEQ ID NO: 136481 - DNA, 25 bp, Homo sapien
cggccggtaaacacgctgatgacca

SEQ ID NO: 136482 - DNA, 25 bp, Homo sapien
ggccgcgacagtgcacacatgatgc

SEQ ID NO: 136483 - DNA, 25 bp, Homo sapien
cctggaagccactggtgacgaagca

SEQ ID NO: 136484 - DNA, 25 bp, Homo sapien
gagacccgcggcacagatagacccc

SEQ ID NO: 136485 - DNA, 25 bp, Homo sapien
tggcacagatagacccgccgcacag

SEQ ID NO: 136486 - DNA, 25 bp, Homo sapien
agcacagggagacccgcgacacagg

SEQ ID NO: 136487 - DNA, 25 bp, Homo sapien
gggagacccgcgacacagggagtcc

SEQ ID NO: 136488 - DNA, 25 bp, Homo sapien
tccccgcagcacagatagacccgtg

SEQ ID NO: 136489 - DNA, 25 bp, Homo sapien
agacccgccgcacagggagacccgc

SEQ ID NO: 136490 - DNA, 25 bp, Homo sapien
ccagggagaccccgtggcacagata

SEQ ID NO: 136491 - DNA, 25 bp, Homo sapien
gtggcacagatagacccgccgcaca

SEQ ID NO: 136492 - DNA, 25 bp, Homo sapien
tctgcctcttcgctcgggcttcaaa

SEQ ID NO: 136493 - DNA, 25 bp, Homo sapien
ttctgagcaccacgcgtcccgtggg

SEQ ID NO: 136494 - DNA, 25 bp, Homo sapien
gcaggcacaggagccaaggtcagtc

SEQ ID NO: 136495 - DNA, 25 bp, Homo sapien
cgtcctgataacacggcggtccggg

SEQ ID NO: 136496 - DNA, 25 bp, Homo sapien
gtgggctccctacccgtcctgataa

SEQ ID NO: 136497 - DNA, 25 bp, Homo sapien
gtttcgtgaactccctggcttcgtc

SEQ ID NO: 136498 - DNA, 25 bp, Homo sapien
tcttcgctcgggcttcaaaactgcc

SEQ ID NO: 136499 - DNA, 25 bp, Homo sapien
tgagaactccagaagtttcgtgaac

SEQ ID NO: 136500 - DNA, 25 bp, Homo sapien
tattcgaggccccagccggagcgtt

SEQ ID NO: 136501 - DNA, 25 bp, Homo sapien
gctgttacagggccctagggaccgc

SEQ ID NO: 136502 - DNA, 25 bp, Homo sapien
ccagccggagcgttccgggatcctt

SEQ ID NO: 136503 - DNA, 25 bp, Homo sapien
agccggagcgttccgggatccttcg

SEQ ID NO: 136504 - DNA, 25 bp, Homo sapien
ccgcctcccacatgactccgggtgg

SEQ ID NO: 136505 - DNA, 25 bp, Homo sapien
catgactccgggtgggcccttttga

SEQ ID NO: 136506 - DNA, 25 bp, Homo sapien
gctcccgctgttacagggccctagg

SEQ ID NO: 136507 - DNA, 25 bp, Homo sapien
tcccgctgttacagggccctaggga

SEQ ID NO: 136508 - DNA, 25 bp, Homo sapien
cggcgcagcttacttctcctgagac

SEQ ID NO: 136509 - DNA, 25 bp, Homo sapien
gcggcgcagcttacttctcctgaga

SEQ ID NO: 136510 - DNA, 25 bp, Homo sapien
cgcggcgcagcttacttctcctgag

SEQ ID NO: 136511 - DNA, 25 bp, Homo sapien
atatttaggcggcaggtgtgggagc

SEQ ID NO: 136512 - DNA, 25 bp, Homo sapien
cggctatatttaggcggcaggtgtg

SEQ ID NO: 136513 - DNA, 25 bp, Homo sapien
cagggcgcggctatatttaggcggc

SEQ ID NO: 136514 - DNA, 25 bp, Homo sapien
ccaggccggcgcgtatggaggcggt

SEQ ID NO: 136515 - DNA, 25 bp, Homo sapien
ggcgcagcttacttctcctgagacc

SEQ ID NO: 136516 - DNA, 25 bp, Homo sapien
acagcctcgcttttggatgtgggtc

SEQ ID NO: 136517 - DNA, 25 bp, Homo sapien
ccgcccggcaaggtagtggaagact

SEQ ID NO: 136518 - DNA, 25 bp, Homo sapien
gtgaaggccaagttctgtgaggccc

SEQ ID NO: 136519 - DNA, 25 bp, Homo sapien
tagggctcgccatgtcaggtggttg

SEQ ID NO: 136520 - DNA, 25 bp, Homo sapien
catctcgtggtctgacagcctcgct

SEQ ID NO: 136521 - DNA, 25 bp, Homo sapien
cgcttttggatgtgggtcttgaaca

SEQ ID NO: 136522 - DNA, 25 bp, Homo sapien
tgggtcttgaacacacgtccacgcg

SEQ ID NO: 136523 - DNA, 25 bp, Homo sapien
tgggcatctcgtggtctgacagcct

SEQ ID NO: 136524 - DNA, 25 bp, Homo sapien
catagcccaggtccccgctgtaagg

SEQ ID NO: 136525 - DNA, 25 bp, Homo sapien
cagggtaagcgcacagcccacgtcc

SEQ ID NO: 136526 - DNA, 25 bp, Homo sapien
ggacagggtgagcacacagtccggg

SEQ ID NO: 136527 - DNA, 25 bp, Homo sapien
cacgtccccgctgtaaggaccaggt

SEQ ID NO: 136528 - DNA, 25 bp, Homo sapien
cacagtccgggtccccgctgtaagg

SEQ ID NO: 136529 - DNA, 25 bp, Homo sapien
acagggtgagcgcatagcccaggtc

SEQ ID NO: 136530 - DNA, 25 bp, Homo sapien
agggtgagcgcatagcccaggtccc

SEQ ID NO: 136531 - DNA, 25 bp, Homo sapien
acagggtaagcgcacagcccacgtc

SEQ ID NO: 136532 - DNA, 25 bp, Homo sapien
tcgcttgtgagtgacggagaaaccc

SEQ ID NO: 136533 - DNA, 25 bp, Homo sapien
agtgacggagaaacccgcggcactg

SEQ ID NO: 136534 - DNA, 25 bp, Homo sapien
ccctcgcttgtgagtgacggagaaa

SEQ ID NO: 136535 - DNA, 25 bp, Homo sapien
cactggccctcgcttgtgagtgacg

SEQ ID NO: 136536 - DNA, 25 bp, Homo sapien
tgagtgacggagaaacccgcggcac

SEQ ID NO: 136537 - DNA, 25 bp, Homo sapien
cgcttgtgagtgacggagaaacccg

SEQ ID NO: 136538 - DNA, 25 bp, Homo sapien
ctcgcttgtgagtgacggagaaacc

SEQ ID NO: 136539 - DNA, 25 bp, Homo sapien
ggcactggccctcgcttgtgagtga

SEQ ID NO: 136540 - DNA, 25 bp, Homo sapien
accggccctcgcttgtgagtgcacg

SEQ ID NO: 136541 - DNA, 25 bp, Homo sapien
gtggcgtagcggagcccagagaagt

SEQ ID NO: 136542 - DNA, 25 bp, Homo sapien
gacatggagaaacccgcggcactgg

SEQ ID NO: 136543 - DNA, 25 bp, Homo sapien
gcccttgcttgtgagtgacggagaa

SEQ ID NO: 136544 - DNA, 25 bp, Homo sapien
tgagtgcacggcttgtggtgtcacc

SEQ ID NO: 136545 - DNA, 25 bp, Homo sapien
ttgcttgtgagtgacggagaaaccc

SEQ ID NO: 136546 - DNA, 25 bp, Homo sapien
cctcgcttgtgagtgcacggcttgt

SEQ ID NO: 136547 - DNA, 25 bp, Homo sapien
ctcctgccctcagaggacatggaga

SEQ ID NO: 136548 - DNA, 25 bp, Homo sapien
gtccgaaggtgcagtgaacatattc

SEQ ID NO: 136549 - DNA, 25 bp, Homo sapien
gcttttctgcacacactccgacagg

SEQ ID NO: 136550 - DNA, 25 bp, Homo sapien
cccgagagcgaacagaataaataaa

SEQ ID NO: 136551 - DNA, 25 bp, Homo sapien
cagacttcgacttcctgctgcgcgg

SEQ ID NO: 136552 - DNA, 25 bp, Homo sapien
atccgcgtgctcaccgagaacttca

SEQ ID NO: 136553 - DNA, 25 bp, Homo sapien
tcccggacatctacggcggggacgc

SEQ ID NO: 136554 - DNA, 25 bp, Homo sapien
catattcgcagtagaaacggtgacg

SEQ ID NO: 136555 - DNA, 25 bp, Homo sapien
ctgggcaagcaggacgacttcgcca

SEQ ID NO: 136556 - DNA, 25 bp, Homo sapien
gttggggtgtctgcacctcgttact

SEQ ID NO: 136557 - DNA, 25 bp, Homo sapien
gcacctcgttactgggggactgtgt

SEQ ID NO: 136558 - DNA, 25 bp, Homo sapien
gttggggtgtctgcgcctcgttact

SEQ ID NO: 136559 - DNA, 25 bp, Homo sapien
gtccgcgcctcattactggggggct

SEQ ID NO: 136560 - DNA, 25 bp, Homo sapien
ttggggtgtccgtgcctcgttactg

SEQ ID NO: 136561 - DNA, 25 bp, Homo sapien
gtccgtgcctcgttactgcggggac

SEQ ID NO: 136562 - DNA, 25 bp, Homo sapien
agtgtccgggtgtccgcgcctcgtt

SEQ ID NO: 136563 - DNA, 25 bp, Homo sapien
tgtccgcgcctcgttactgggggac

SEQ ID NO: 136564 - DNA, 25 bp, Homo sapien
ttcaggtgccgagggtggtgcgcac

SEQ ID NO: 136565 - DNA, 25 bp, Homo sapien
ggcaaagacgtcaacaccagggctg

SEQ ID NO: 136566 - DNA, 25 bp, Homo sapien
gggcaaagacgtcaacaccagggct

SEQ ID NO: 136567 - DNA, 25 bp, Homo sapien
aaagacgtcaacaccagggctgtgg

SEQ ID NO: 136568 - DNA, 25 bp, Homo sapien
tggggattgggcaaagacgtcaaca

SEQ ID NO: 136569 - DNA, 25 bp, Homo sapien
tgggcaaagacgtcaacaccagggc

SEQ ID NO: 136570 - DNA, 25 bp, Homo sapien
ggattgggcaaagacgtcaacacca

SEQ ID NO: 136571 - DNA, 25 bp, Homo sapien
aagacgtcaacaccagggctgtgga

SEQ ID NO: 136572 - DNA, 25 bp, Homo sapien
tcggggcctgaatcactgtaactgc

SEQ ID NO: 136573 - DNA, 25 bp, Homo sapien
gggcagagttgcttacattgacttc

SEQ ID NO: 136574 - DNA, 25 bp, Homo sapien
ctggaacgcagagggatgattttta

SEQ ID NO: 136575 - DNA, 25 bp, Homo sapien
tccctaactcatgctggaacgcaga

SEQ ID NO: 136576 - DNA, 25 bp, Homo sapien
acagcgtcctgggtagcagcgtccg

SEQ ID NO: 136577 - DNA, 25 bp, Homo sapien
ccggggcaggtttacgcacagccca

SEQ ID NO: 136578 - DNA, 25 bp, Homo sapien
gagacgcactccctaactcatgctg

SEQ ID NO: 136579 - DNA, 25 bp, Homo sapien
ttcgttctccgcgagagacgcactc

SEQ ID NO: 136580 - DNA, 25 bp, Homo sapien
aggccggacagtcactccacggaga

SEQ ID NO: 136581 - DNA, 25 bp, Homo sapien
gccggacagtcactccacggagagc

SEQ ID NO: 136582 - DNA, 25 bp, Homo sapien
gacactcactccacggagagcaggc

SEQ ID NO: 136583 - DNA, 25 bp, Homo sapien
gagagcaggccggacactcactcca

SEQ ID NO: 136584 - DNA, 25 bp, Homo sapien
ggacactcactccacggacagcagg

SEQ ID NO: 136585 - DNA, 25 bp, Homo sapien
cggacactcactccacggagagcag

SEQ ID NO: 136586 - DNA, 25 bp, Homo sapien
ccacggagagcaggccggacactca

SEQ ID NO: 136587 - DNA, 25 bp, Homo sapien
ctcactccacggagagcaggccgga

SEQ ID NO: 136588 - DNA, 25 bp, Homo sapien
agcatcacagtgatccaaagcagga

SEQ ID NO: 136589 - DNA, 25 bp, Homo sapien
gcccgagttgtcctctgtcctctgt

SEQ ID NO: 136590 - DNA, 25 bp, Homo sapien
tggtcagacggtgcccgagttgtcc

SEQ ID NO: 136591 - DNA, 25 bp, Homo sapien
cacagtgatccaaagcaggagcagt

SEQ ID NO: 136592 - DNA, 25 bp, Homo sapien
ccctcggggtgtgagagcatcacag

SEQ ID NO: 136593 - DNA, 25 bp, Homo sapien
tccacggaacagagaacgcggcgcc

SEQ ID NO: 136594 - DNA, 25 bp, Homo sapien
ggcagcccagctagtccacggaaca

SEQ ID NO: 136595 - DNA, 25 bp, Homo sapien
cccacccggcggtggtcagcttgga

SEQ ID NO: 136596 - DNA, 25 bp, Homo sapien
agaggcccacactgcagaagtccag

SEQ ID NO: 136597 - DNA, 25 bp, Homo sapien
gccgtcgtaggcaggagacaaactg

SEQ ID NO: 136598 - DNA, 25 bp, Homo sapien
catcgccaccctgggagagtgaagg

SEQ ID NO: 136599 - DNA, 25 bp, Homo sapien
cggcatccagagtgttccgcaggtc

SEQ ID NO: 136600 - DNA, 25 bp, Homo sapien
cgggcacgctttgctcagaggccca

SEQ ID NO: 136601 - DNA, 25 bp, Homo sapien
caaactgctggatgagctgagtgcc

SEQ ID NO: 136602 - DNA, 25 bp, Homo sapien
gccagagaaccttgatgcgcaaaca

SEQ ID NO: 136603 - DNA, 25 bp, Homo sapien
tgcagaagtccagtctcagcagact

SEQ ID NO: 136604 - DNA, 25 bp, Homo sapien
ctcacgggtgcctgccctcacggtg

SEQ ID NO: 136605 - DNA, 25 bp, Homo sapien
gctcacgggtgcctgcgctcacggt

SEQ ID NO: 136606 - DNA, 25 bp, Homo sapien
gctcacggtgcctgcgctcacgggt

SEQ ID NO: 136607 - DNA, 25 bp, Homo sapien
gcgctcacgggtgcctgcgctcacg

SEQ ID NO: 136608 - DNA, 25 bp, Homo sapien
tgcgctcacggtgcctgggctcacg

SEQ ID NO: 136609 - DNA, 25 bp, Homo sapien
ctcacggtgcctgggctcacggtgc

SEQ ID NO: 136610 - DNA, 25 bp, Homo sapien
tgcgctcacgggtgcctgccctcac

SEQ ID NO: 136611 - DNA, 25 bp, Homo sapien
tgcgctcacgggtgcctgcgctcac

SEQ ID NO: 136612 - DNA, 25 bp, Homo sapien
gctcccgctcccgtcattaatttat

SEQ ID NO: 136613 - DNA, 25 bp, Homo sapien
tctcacgcgctgatatgatgaatgc

SEQ ID NO: 136614 - DNA, 25 bp, Homo sapien
gccaatgggcccgaactgcaggctt

SEQ ID NO: 136615 - DNA, 25 bp, Homo sapien
ctgcaggcttaactcacgtttcaca

SEQ ID NO: 136616 - DNA, 25 bp, Homo sapien
ggtgttttaagagccgcccacttga

SEQ ID NO: 136617 - DNA, 25 bp, Homo sapien
ccacttgaggaccagcagggcaagc

SEQ ID NO: 136618 - DNA, 25 bp, Homo sapien
gtttcacaaacgaggaagctgcggc

SEQ ID NO: 136619 - DNA, 25 bp, Homo sapien
cccgatccacgtgaagccaatgggc

SEQ ID NO: 136620 - DNA, 25 bp, Homo sapien
tctgtcttcagggcccgggcaccat

SEQ ID NO: 136621 - DNA, 25 bp, Homo sapien
gggcaccatgtacccgccacccgcg

SEQ ID NO: 136622 - DNA, 25 bp, Homo sapien
cccgcgttctctatctgcagggccc

SEQ ID NO: 136623 - DNA, 25 bp, Homo sapien
ttctctgtcttcagggcccgggcac

SEQ ID NO: 136624 - DNA, 25 bp, Homo sapien
cgcgttctctatctgcagggcccgg

SEQ ID NO: 136625 - DNA, 25 bp, Homo sapien
cgttctctatctgcagggcccgggc

SEQ ID NO: 136626 - DNA, 25 bp, Homo sapien
tcgcgttctctatctgcagggcccg

SEQ ID NO: 136627 - DNA, 25 bp, Homo sapien
gttctctatctgcagggcccgggca

SEQ ID NO: 136628 - DNA, 25 bp, Homo sapien
aggaagcacggagccagcatcaccc

SEQ ID NO: 136629 - DNA, 25 bp, Homo sapien
tgcagacgaggcctgaccagacaga

SEQ ID NO: 136630 - DNA, 25 bp, Homo sapien
caccctcagagccagcgtcaccctt

SEQ ID NO: 136631 - DNA, 25 bp, Homo sapien
ctctgcttcgaagggtgtgccacca

SEQ ID NO: 136632 - DNA, 25 bp, Homo sapien
aggagctcctggcacggtgtcttga

SEQ ID NO: 136633 - DNA, 25 bp, Homo sapien
ccaccatatgcggaggacggcgaag

SEQ ID NO: 136634 - DNA, 25 bp, Homo sapien
tgaccagacagaaacgcctggcttc

SEQ ID NO: 136635 - DNA, 25 bp, Homo sapien
tgtgccaccatatgcggaggacggc

SEQ ID NO: 136636 - DNA, 25 bp, Homo sapien
aggtcccgccacttgtgcttgaggt

SEQ ID NO: 136637 - DNA, 25 bp, Homo sapien
gtcccgccacttgtgcttgaggtcc

SEQ ID NO: 136638 - DNA, 25 bp, Homo sapien
ggcggcagtagcccagcgcgttcac

SEQ ID NO: 136639 - DNA, 25 bp, Homo sapien
cgttcactgcctgcaggatgcggct

SEQ ID NO: 136640 - DNA, 25 bp, Homo sapien
ttcactgcctgcaggatgcggctcc

SEQ ID NO: 136641 - DNA, 25 bp, Homo sapien
tgctttcgggcaggtgtgccccgca

SEQ ID NO: 136642 - DNA, 25 bp, Homo sapien
agcgggtagtggcgccgcaccctct

SEQ ID NO: 136643 - DNA, 25 bp, Homo sapien
cgcaggtcccgccacttgtgcttga

SEQ ID NO: 136644 - DNA, 25 bp, Homo sapien
gtcaccgggacctgctgcagaccgt

SEQ ID NO: 136645 - DNA, 25 bp, Homo sapien
gggagggcttcctaaaggctaatga

SEQ ID NO: 136646 - DNA, 25 bp, Homo sapien
tgatgcagtgaggtgtacagacgcc

SEQ ID NO: 136647 - DNA, 25 bp, Homo sapien
tacagacgccttccaagaacgactc

SEQ ID NO: 136648 - DNA, 25 bp, Homo sapien
cacgctggagttactgtcaccggga

SEQ ID NO: 136649 - DNA, 25 bp, Homo sapien
acagcctctcatgcgtcacgctgga

SEQ ID NO: 136650 - DNA, 25 bp, Homo sapien
tggctgcagagcaatcgggccagca

SEQ ID NO: 136651 - DNA, 25 bp, Homo sapien
cgaggtgcgtaacacagctccacaa

SEQ ID NO: 136652 - DNA, 25 bp, Homo sapien
gagatgctgctcaaccactttttat

SEQ ID NO: 136653 - DNA, 25 bp, Homo sapien
tccctgctggaccatcttgagatgc

SEQ ID NO: 136654 - DNA, 25 bp, Homo sapien
ccgggtgaacagatcattttaattc

SEQ ID NO: 136655 - DNA, 25 bp, Homo sapien
ggtttcctgcagctcatgtcccgag

SEQ ID NO: 136656 - DNA, 25 bp, Homo sapien
agtagctgcactctgcttgggtttc

SEQ ID NO: 136657 - DNA, 25 bp, Homo sapien
cctccttggaacctcagtagctgca

SEQ ID NO: 136658 - DNA, 25 bp, Homo sapien
aggtgcttatgtccatgccgtttcc

SEQ ID NO: 136659 - DNA, 25 bp, Homo sapien
tagctggaagcatagccgagggtcc

SEQ ID NO: 136660 - DNA, 25 bp, Homo sapien
gaggaaactgcctgcacggaccacc

SEQ ID NO: 136661 - DNA, 25 bp, Homo sapien
cgtccacggcccacagagtcaaaga

SEQ ID NO: 136662 - DNA, 25 bp, Homo sapien
taagcgcagcgcctcccgtaagagg

SEQ ID NO: 136663 - DNA, 25 bp, Homo sapien
agaaacgcctctcagaatcgcaacc

SEQ ID NO: 136664 - DNA, 25 bp, Homo sapien
aggagccattcgcttcacgaggaaa

SEQ ID NO: 136665 - DNA, 25 bp, Homo sapien
caccaagccgcgtgaaggagccatt

SEQ ID NO: 136666 - DNA, 25 bp, Homo sapien
tcaaagacgtggtaggcactgaccg

SEQ ID NO: 136667 - DNA, 25 bp, Homo sapien
ttgctcagcacctcacgtaagcgca

SEQ ID NO: 136668 - DNA, 25 bp, Homo sapien
tgcttctccaggttctgcagggaaa

SEQ ID NO: 136669 - DNA, 25 bp, Homo sapien
ggcgcatctgcttctccaggttctg

SEQ ID NO: 136670 - DNA, 25 bp, Homo sapien
atcacggccagctggcgcatctgct

SEQ ID NO: 136671 - DNA, 25 bp, Homo sapien
cgtcgtacagcatgggcgggatcac

SEQ ID NO: 136672 - DNA, 25 bp, Homo sapien
ctggtcagcgtcgtacagcatgggc

SEQ ID NO: 136673 - DNA, 25 bp, Homo sapien
acttgatgcgctgctggtcagcgtc

SEQ ID NO: 136674 - DNA, 25 bp, Homo sapien
tgttgatgaacttgatgcgctgctg

SEQ ID NO: 136675 - DNA, 25 bp, Homo sapien
ggccataagcccgttcatgttgatg

SEQ ID NO: 136676 - DNA, 25 bp, Homo sapien
tcacactgtacgcatgaagcgggta

SEQ ID NO: 136677 - DNA, 25 bp, Homo sapien
cggctcacactgtacgcgtgaagcg

SEQ ID NO: 136678 - DNA, 25 bp, Homo sapien
tatggccagcggctcacactgtacg

SEQ ID NO: 136679 - DNA, 25 bp, Homo sapien
gccagcggctcacactgtacgcgtg

SEQ ID NO: 136680 - DNA, 25 bp, Homo sapien
gcggctcacactgtacgcgtgaagc

SEQ ID NO: 136681 - DNA, 25 bp, Homo sapien
ctgtacgcatgaagcgggtatggcc

SEQ ID NO: 136682 - DNA, 25 bp, Homo sapien
atggccagcggctcacactgtacgc

SEQ ID NO: 136683 - DNA, 25 bp, Homo sapien
agcggctcacactgcacgcgtgaag

SEQ ID NO: 136684 - DNA, 25 bp, Homo sapien
atgacgaaccagcaccagcgaaggg

SEQ ID NO: 136685 - DNA, 25 bp, Homo sapien
cgagacggatgaggaaccagcacca

SEQ ID NO: 136686 - DNA, 25 bp, Homo sapien
atgagacggatgaggaaccagcacc

SEQ ID NO: 136687 - DNA, 25 bp, Homo sapien
acgagacggatgaggaaccagcacc

SEQ ID NO: 136688 - DNA, 25 bp, Homo sapien
gcacgagacggatgacgaaccagca

SEQ ID NO: 136689 - DNA, 25 bp, Homo sapien
atgagacggatgacgaaccagcacc

SEQ ID NO: 136690 - DNA, 25 bp, Homo sapien
gatgacgaaccagcaccagcgaagg

SEQ ID NO: 136691 - DNA, 25 bp, Homo sapien
tgagacggatgaggaaccagcacca

SEQ ID NO: 136692 - DNA, 25 bp, Homo sapien
cccaagtccagaaggacacgccatc

SEQ ID NO: 136693 - DNA, 25 bp, Homo sapien
ggacacgccatcacctcgccacact

SEQ ID NO: 136694 - DNA, 25 bp, Homo sapien
gccacactgcatccgctcacccaag

SEQ ID NO: 136695 - DNA, 25 bp, Homo sapien
caagtccagaaggacacgccatcac

SEQ ID NO: 136696 - DNA, 25 bp, Homo sapien
gctcacccaagtccagaaggacacg

SEQ ID NO: 136697 - DNA, 25 bp, Homo sapien
atccgctcacccaagtccagaagga

SEQ ID NO: 136698 - DNA, 25 bp, Homo sapien
ccaagtccagaaggacacgccatca

SEQ ID NO: 136699 - DNA, 25 bp, Homo sapien
gacacgccatcacctcgccacactg

SEQ ID NO: 136700 - DNA, 25 bp, Homo sapien
cgtaacagacgctgtacactgcggg

SEQ ID NO: 136701 - DNA, 25 bp, Homo sapien
gggactctatagcagacgctgtaca

SEQ ID NO: 136702 - DNA, 25 bp, Homo sapien
gctgtacactgcaggggactctata

SEQ ID NO: 136703 - DNA, 25 bp, Homo sapien
acactgctggggactctgtaacaga

SEQ ID NO: 136704 - DNA, 25 bp, Homo sapien
actgctggggactctgtaacagacg

SEQ ID NO: 136705 - DNA, 25 bp, Homo sapien
ccgtaacagacgctgtacactgctg

SEQ ID NO: 136706 - DNA, 25 bp, Homo sapien
gggactccgtaacagaagctgtaca

SEQ ID NO: 136707 - DNA, 25 bp, Homo sapien
ggggactccgtaacagaagctgtac

SEQ ID NO: 136708 - DNA, 25 bp, Homo sapien
tgagctgcagggcaccaacccttgc

SEQ ID NO: 136709 - DNA, 25 bp, Homo sapien
gggcgggcacccaaacatcacgtga

SEQ ID NO: 136710 - DNA, 25 bp, Homo sapien
agtcggctgtcctcacctgcctggt

SEQ ID NO: 136711 - DNA, 25 bp, Homo sapien
cccgttttgcatatggggatgacgg

SEQ ID NO: 136712 - DNA, 25 bp, Homo sapien
tcacacgggccaaagctggagcttc

SEQ ID NO: 136713 - DNA, 25 bp, Homo sapien
ccaaagctggagcttctgcggggct

SEQ ID NO: 136714 - DNA, 25 bp, Homo sapien
ccttgcacccagcaagtaggcgctg

SEQ ID NO: 136715 - DNA, 25 bp, Homo sapien
agcccaccgacctggggtctgaaca

SEQ ID NO: 136716 - DNA, 25 bp, Homo sapien
acaaaagtgtgctcgtggacactgc

SEQ ID NO: 136717 - DNA, 25 bp, Homo sapien
tggacactgcgtggtactgtgcaca

SEQ ID NO: 136718 - DNA, 25 bp, Homo sapien
cacacgggttctgtgaacacgaaca

SEQ ID NO: 136719 - DNA, 25 bp, Homo sapien
ccaggactgtgcacgtgtgcgcaca

SEQ ID NO: 136720 - DNA, 25 bp, Homo sapien
tctgcagcccaggactgtgcacgtg

SEQ ID NO: 136721 - DNA, 25 bp, Homo sapien
acgtgtgcgcacacgggttctgtga

SEQ ID NO: 136722 - DNA, 25 bp, Homo sapien
ctgtgaacacgaacacaaaagtgtg

SEQ ID NO: 136723 - DNA, 25 bp, Homo sapien
cgtggtactgtgcacacagcgcacg

SEQ ID NO: 136724 - DNA, 25 bp, Homo sapien
ctgtgaggggccaggacccataccg

SEQ ID NO: 136725 - DNA, 25 bp, Homo sapien
ccaggctcgcacctgtgaggggcca

SEQ ID NO: 136726 - DNA, 25 bp, Homo sapien
cagcgtccacagtcactgggccagg

SEQ ID NO: 136727 - DNA, 25 bp, Homo sapien
gtatcggaggcctgctctcccacag

SEQ ID NO: 136728 - DNA, 25 bp, Homo sapien
agtcccagccctgcgtatcggaggc

SEQ ID NO: 136729 - DNA, 25 bp, Homo sapien
ctcaaaactgggaccgtgggtaatg

SEQ ID NO: 136730 - DNA, 25 bp, Homo sapien
caagcctcaaaactgggaccgtggg

SEQ ID NO: 136731 - DNA, 25 bp, Homo sapien
ttttccgtcaccgtcaagcctcaaa

SEQ ID NO: 136732 - DNA, 25 bp, Homo sapien
tccagtttcagagagcgagagattg

SEQ ID NO: 136733 - DNA, 25 bp, Homo sapien
ctagcgctccccctctaatgtgtga

SEQ ID NO: 136734 - DNA, 25 bp, Homo sapien
taaagcctgatgtaatccgtaatgc

SEQ ID NO: 136735 - DNA, 25 bp, Homo sapien
tgtaatccgtaatgcagtctctggc

SEQ ID NO: 136736 - DNA, 25 bp, Homo sapien
ccgtaatgcagtctctggctcccga

SEQ ID NO: 136737 - DNA, 25 bp, Homo sapien
cgcgcgtgtgtgcattttatccgcc

SEQ ID NO: 136738 - DNA, 25 bp, Homo sapien
aatgcagtctctggctcccgattcg

SEQ ID NO: 136739 - DNA, 25 bp, Homo sapien
tcccgattcgggatccagtttcaga

SEQ ID NO: 136740 - DNA, 25 bp, Homo sapien
tctaagtttcttggagcgcaggcgc

SEQ ID NO: 136741 - DNA, 25 bp, Homo sapien
cccggcagcctgaagagaacgccta

SEQ ID NO: 136742 - DNA, 25 bp, Homo sapien
cctgggctgcaactccggagtagtt

SEQ ID NO: 136743 - DNA, 25 bp, Homo sapien
cagaggagccgcttgtcgtttgtgt

SEQ ID NO: 136744 - DNA, 25 bp, Homo sapien
gctccatcctgggaacccacggaga

SEQ ID NO: 136745 - DNA, 25 bp, Homo sapien
agctgggtcccttttctatctggga

SEQ ID NO: 136746 - DNA, 25 bp, Homo sapien
gaggcgactgtcacgtctcctagaa

SEQ ID NO: 136747 - DNA, 25 bp, Homo sapien
aatcaccgcgaagcgatgcgaccgg

SEQ ID NO: 136748 - DNA, 25 bp, Homo sapien
acctgtgtcaccctcgaacccgccg

SEQ ID NO: 136749 - DNA, 25 bp, Homo sapien
cggtcctcacctgtgtcaccctcga

SEQ ID NO: 136750 - DNA, 25 bp, Homo sapien
cgccggtcctcacctgtgtcaccct

SEQ ID NO: 136751 - DNA, 25 bp, Homo sapien
ctgtgtcaccctcgaacccgccggt

SEQ ID NO: 136752 - DNA, 25 bp, Homo sapien
ggtcctcacctgtgtcaccctcgac

SEQ ID NO: 136753 - DNA, 25 bp, Homo sapien
ggtcctcacctgtgtcaccctcgaa

SEQ ID NO: 136754 - DNA, 25 bp, Homo sapien
ctcacctgtgtcaccctggaacccg

SEQ ID NO: 136755 - DNA, 25 bp, Homo sapien
ccggtcctcacctgtgtcaccctcg

SEQ ID NO: 136756 - DNA, 25 bp, Homo sapien
tgaaattaactttcactccgcggcc

SEQ ID NO: 136757 - DNA, 25 bp, Homo sapien
ggaacgacctcccacctagaagcaa

SEQ ID NO: 136758 - DNA, 25 bp, Homo sapien
ccgaaatcgtctgtgcggcaggaag

SEQ ID NO: 136759 - DNA, 25 bp, Homo sapien
tccaacgcgtccgaaatcgtctgtg

SEQ ID NO: 136760 - DNA, 25 bp, Homo sapien
gggcgactccaacgcgtccgaaatc

SEQ ID NO: 136761 - DNA, 25 bp, Homo sapien
gcggctacgggcgactccaacgcgt

SEQ ID NO: 136762 - DNA, 25 bp, Homo sapien
ctgcagcaggggacaccagcagcgc

SEQ ID NO: 136763 - DNA, 25 bp, Homo sapien
acgacctcccacctagaagcaatga

SEQ ID NO: 136764 - DNA, 25 bp, Homo sapien
aggacatgggtcagcacgagcacac

SEQ ID NO: 136765 - DNA, 25 bp, Homo sapien
gtgcctgtctacacacgcagagggg

SEQ ID NO: 136766 - DNA, 25 bp, Homo sapien
tcccattgtgggctcacgaggacat

SEQ ID NO: 136767 - DNA, 25 bp, Homo sapien
cggcccgaaaacctgtgtcccattg

SEQ ID NO: 136768 - DNA, 25 bp, Homo sapien
acattcatcacagtgggcgggcggc

SEQ ID NO: 136769 - DNA, 25 bp, Homo sapien
gcacaagacgcaggccacattcatc

SEQ ID NO: 136770 - DNA, 25 bp, Homo sapien
cacagcctgttgagtgccgctgcca

SEQ ID NO: 136771 - DNA, 25 bp, Homo sapien
gaggttcagacctacagaccgcacg

SEQ ID NO: 136772 - DNA, 25 bp, Homo sapien
agccgtgccgcctgccagatgctgt

SEQ ID NO: 136773 - DNA, 25 bp, Homo sapien
caccgacgacttctccgtggagtac

SEQ ID NO: 136774 - DNA, 25 bp, Homo sapien
aagttcttcggctacttctccgcgg

SEQ ID NO: 136775 - DNA, 25 bp, Homo sapien
ccagcaagcagttcctgcagatgcg

SEQ ID NO: 136776 - DNA, 25 bp, Homo sapien
ccggaccctggcatgtcaagacctg

SEQ ID NO: 136777 - DNA, 25 bp, Homo sapien
taccagttcgactccttcctcgagt

SEQ ID NO: 136778 - DNA, 25 bp, Homo sapien
cgcggcgctacactctctacatgaa

SEQ ID NO: 136779 - DNA, 25 bp, Homo sapien
ctctctacatgaaggtggccaaggc

SEQ ID NO: 136780 - DNA, 25 bp, Homo sapien
gacttacccgtccaggccacgagcc

SEQ ID NO: 136781 - DNA, 25 bp, Homo sapien
gggtcgccagtgcaaccgcgaggcc

SEQ ID NO: 136782 - DNA, 25 bp, Homo sapien
ctggaggagggtcgccagtgcaacc

SEQ ID NO: 136783 - DNA, 25 bp, Homo sapien
ggcctccagacgcggacgcgcacct

SEQ ID NO: 136784 - DNA, 25 bp, Homo sapien
gcgggcttagcacccccatgactta

SEQ ID NO: 136785 - DNA, 25 bp, Homo sapien
tggaagctgtggtccctgtggggcg

SEQ ID NO: 136786 - DNA, 25 bp, Homo sapien
atgacttacccgtccaggccacgag

SEQ ID NO: 136787 - DNA, 25 bp, Homo sapien
ctgtggggcgaatgcacgcgggact

SEQ ID NO: 136788 - DNA, 25 bp, Homo sapien
gcttctgcgtgtcctcctcctacag

SEQ ID NO: 136789 - DNA, 25 bp, Homo sapien
cgcgagcagcggctgtgcaacaact

SEQ ID NO: 136790 - DNA, 25 bp, Homo sapien
gagcagcggctgtgcaacaactctg

SEQ ID NO: 136791 - DNA, 25 bp, Homo sapien
ggctgtgcaacaactctgccgtgtg

SEQ ID NO: 136792 - DNA, 25 bp, Homo sapien
tgcaacaactctgccgtgtgcccag

SEQ ID NO: 136793 - DNA, 25 bp, Homo sapien
tccgtccctctgcagtgcatggtgc

SEQ ID NO: 136794 - DNA, 25 bp, Homo sapien
tcctacagcacgcagtgcagcggac

SEQ ID NO: 136795 - DNA, 25 bp, Homo sapien
tgggcagcagcaccttccgtccctc

SEQ ID NO: 136796 - DNA, 25 bp, Homo sapien
cttggggtacggccacccgcgtgct

SEQ ID NO: 136797 - DNA, 25 bp, Homo sapien
cccaggcgcctcaaaggcccagagg

SEQ ID NO: 136798 - DNA, 25 bp, Homo sapien
atgcaccggctatgaagagggagct

SEQ ID NO: 136799 - DNA, 25 bp, Homo sapien
agcatgcaccggctatgaagaggga

SEQ ID NO: 136800 - DNA, 25 bp, Homo sapien
agggagcatgcaccggctatgaaga

SEQ ID NO: 136801 - DNA, 25 bp, Homo sapien
cagttctgggagtgggcttcctaga

SEQ ID NO: 136802 - DNA, 25 bp, Homo sapien
gccagttctgggagtgggcttccta

SEQ ID NO: 136803 - DNA, 25 bp, Homo sapien
gctcaaaagagcgccacccttgggg

SEQ ID NO: 136804 - DNA, 25 bp, Homo sapien
ttcgccatcttagcccagctcagcg

SEQ ID NO: 136805 - DNA, 25 bp, Homo sapien
tgaccggctctccaccttcgccatc

SEQ ID NO: 136806 - DNA, 25 bp, Homo sapien
cccaggagatgagccgcaggcacca

SEQ ID NO: 136807 - DNA, 25 bp, Homo sapien
agcggtcccaaggtcgtcagctcca

SEQ ID NO: 136808 - DNA, 25 bp, Homo sapien
gggaagtttccagcggcaagcctcc

SEQ ID NO: 136809 - DNA, 25 bp, Homo sapien
cgcagagggaagtttccagcggcaa

SEQ ID NO: 136810 - DNA, 25 bp, Homo sapien
tccggacgcgctgcctctgtgaccg

SEQ ID NO: 136811 - DNA, 25 bp, Homo sapien
tgtctgtcccaggagatgagccgca

SEQ ID NO: 136812 - DNA, 25 bp, Homo sapien
acaccggtctatgtgtgcacgcaca

SEQ ID NO: 136813 - DNA, 25 bp, Homo sapien
acgcatgggcacacacacgtgggca

SEQ ID NO: 136814 - DNA, 25 bp, Homo sapien
cacacacgtgggcatacacatgcca

SEQ ID NO: 136815 - DNA, 25 bp, Homo sapien
tacacatgccacgaggacctgcacg

SEQ ID NO: 136816 - DNA, 25 bp, Homo sapien
acgaggacctgcacgaggtccctgc

SEQ ID NO: 136817 - DNA, 25 bp, Homo sapien
agctccctcgcagacacacggaaag

SEQ ID NO: 136818 - DNA, 25 bp, Homo sapien
aggggcacccagtacaccggtctat

SEQ ID NO: 136819 - DNA, 25 bp, Homo sapien
cctgtgtggccgtgtaggtctcgcc

SEQ ID NO: 136820 - DNA, 25 bp, Homo sapien
tcttcgctgtcttcgactcgctgga

SEQ ID NO: 136821 - DNA, 25 bp, Homo sapien
gcttcgtcatcgtcatggtgcactg

SEQ ID NO: 136822 - DNA, 25 bp, Homo sapien
tggtgcactgtatcctccgtagaga

SEQ ID NO: 136823 - DNA, 25 bp, Homo sapien
ctgtatcctccgtagagaggtgggt

SEQ ID NO: 136824 - DNA, 25 bp, Homo sapien
tcgactcgctggagggcttcgtcat

SEQ ID NO: 136825 - DNA, 25 bp, Homo sapien
cgctgacctggatgtcggctgtgct

SEQ ID NO: 136826 - DNA, 25 bp, Homo sapien
ttccagatcctcttcgctgtcttcg

SEQ ID NO: 136827 - DNA, 25 bp, Homo sapien
tgtcggctgtgctcgccgtcaccga

SEQ ID NO: 136828 - DNA, 25 bp, Homo sapien
accctcaagagggacaaggcgccca

SEQ ID NO: 136829 - DNA, 25 bp, Homo sapien
ctgaagctggcccatgccaaggggc

SEQ ID NO: 136830 - DNA, 25 bp, Homo sapien
aggggccgcccaccaatttcaacag

SEQ ID NO: 136831 - DNA, 25 bp, Homo sapien
accatcacgggcacactgaagcggc

SEQ ID NO: 136832 - DNA, 25 bp, Homo sapien
tccttcgtcggtgacggggacatct

SEQ ID NO: 136833 - DNA, 25 bp, Homo sapien
atcttcaagaagctggactcggagc

SEQ ID NO: 136834 - DNA, 25 bp, Homo sapien
ggctctggacacgagctacgtgatc

SEQ ID NO: 136835 - DNA, 25 bp, Homo sapien
ccctgcagtgctgaacaaggacatc

SEQ ID NO: 136836 - DNA, 25 bp, Homo sapien
cagaggccgaaggtgcctcagactc

SEQ ID NO: 136837 - DNA, 25 bp, Homo sapien
cgtcgccgctggagcttcgcagcgt

SEQ ID NO: 136838 - DNA, 25 bp, Homo sapien
ggacatcatcgacctccagaccgag

SEQ ID NO: 136839 - DNA, 25 bp, Homo sapien
cctccagaccgaggtctgagcgggt

SEQ ID NO: 136840 - DNA, 25 bp, Homo sapien
aggagggatgctgctccgcccgctc

SEQ ID NO: 136841 - DNA, 25 bp, Homo sapien
acgggcacagacacgctcgcgggca

SEQ ID NO: 136842 - DNA, 25 bp, Homo sapien
cacagggcccgcagtgctgggacca

SEQ ID NO: 136843 - DNA, 25 bp, Homo sapien
gtgggccaggacatcatcgacctcc

SEQ ID NO: 136844 - DNA, 25 bp, Homo sapien
ggagcaagcgcaccggcctacggat

SEQ ID NO: 136845 - DNA, 25 bp, Homo sapien
gcctacggatgtgtgactctcctca

SEQ ID NO: 136846 - DNA, 25 bp, Homo sapien
tggtaatagatgacttcctcctccg

SEQ ID NO: 136847 - DNA, 25 bp, Homo sapien
tgggcagcgcttggtaatagatgac

SEQ ID NO: 136848 - DNA, 25 bp, Homo sapien
cctctcatcaggaaggtgggtttcc

SEQ ID NO: 136849 - DNA, 25 bp, Homo sapien
gctatctgccgtcctctcatcagga

SEQ ID NO: 136850 - DNA, 25 bp, Homo sapien
ttcacggtatgcacaggagtgcgca

SEQ ID NO: 136851 - DNA, 25 bp, Homo sapien
agcggccgggcttcacggtatgcac

SEQ ID NO: 136852 - DNA, 25 bp, Homo sapien
agagcagcaccgaatccacccagga

SEQ ID NO: 136853 - DNA, 25 bp, Homo sapien
gacagccgcgcacagaggatgtccc

SEQ ID NO: 136854 - DNA, 25 bp, Homo sapien
tctacaactccacggacagcctgga

SEQ ID NO: 136855 - DNA, 25 bp, Homo sapien
cctggacagcaacaaggccatgaac

SEQ ID NO: 136856 - DNA, 25 bp, Homo sapien
atgaacctcgcgctggaaacggccg

SEQ ID NO: 136857 - DNA, 25 bp, Homo sapien
ctgctcctccatcgggattcaggta

SEQ ID NO: 136858 - DNA, 25 bp, Homo sapien
attcaggtagctgctcttggccgcc

SEQ ID NO: 136859 - DNA, 25 bp, Homo sapien
tccaagcctctgatctcggtgacgg

SEQ ID NO: 136860 - DNA, 25 bp, Homo sapien
aagcccacgatatgcaggagaagcc

SEQ ID NO: 136861 - DNA, 25 bp, Homo sapien
aagcccatgatacgcaggagaagcc

SEQ ID NO: 136862 - DNA, 25 bp, Homo sapien
caggagaagcccacgatatgcagga

SEQ ID NO: 136863 - DNA, 25 bp, Homo sapien
gagaggcccacgatatgcaggagaa

SEQ ID NO: 136864 - DNA, 25 bp, Homo sapien
caggagaagcccacgacatgcagga

SEQ ID NO: 136865 - DNA, 25 bp, Homo sapien
caggagaggcccatgatatgcagga

SEQ ID NO: 136866 - DNA, 25 bp, Homo sapien
gcaggagaagcccatgatacacagg

SEQ ID NO: 136867 - DNA, 25 bp, Homo sapien
gcccacgatacgcaggagaagccca

SEQ ID NO: 136868 - DNA, 25 bp, Homo sapien
tgccctcgctgtactgcaggaactc

SEQ ID NO: 136869 - DNA, 25 bp, Homo sapien
cggcacttcccgatctgcaggatca

SEQ ID NO: 136870 - DNA, 25 bp, Homo sapien
tgggacagccagtactcctcagagc

SEQ ID NO: 136871 - DNA, 25 bp, Homo sapien
cctgccgcaagtactcctctaggtg

SEQ ID NO: 136872 - DNA, 25 bp, Homo sapien
cctctaggtggctcaggaactctcg

SEQ ID NO: 136873 - DNA, 25 bp, Homo sapien
gtcctcgaagatctgcgtgtccacg

SEQ ID NO: 136874 - DNA, 25 bp, Homo sapien
caggcaggccttgatggacttcttc

SEQ ID NO: 136875 - DNA, 25 bp, Homo sapien
acgtagccgtccaggttgctctcca

SEQ ID NO: 136876 - DNA, 25 bp, Homo sapien
ctccgccgtcctggtcagcttttgg

SEQ ID NO: 136877 - DNA, 25 bp, Homo sapien
caggactgcgtcaaaggccacggcc

SEQ ID NO: 136878 - DNA, 25 bp, Homo sapien
ctccgcaaagcgcaggactgcgtca

SEQ ID NO: 136879 - DNA, 25 bp, Homo sapien
tgaagcatggctgccgctccgcaaa

SEQ ID NO: 136880 - DNA, 25 bp, Homo sapien
tggagtcttttctgaactccacaca

SEQ ID NO: 136881 - DNA, 25 bp, Homo sapien
ttcctgcgcactgaagcatggctgc

SEQ ID NO: 136882 - DNA, 25 bp, Homo sapien
cctggtcagcttttggagtcttttc

SEQ ID NO: 136883 - DNA, 25 bp, Homo sapien
tgctggctccggaacacggcacgca

SEQ ID NO: 136884 - DNA, 25 bp, Homo sapien
aagcacagggcttcgggttccgagc

SEQ ID NO: 136885 - DNA, 25 bp, Homo sapien
gaggctcgcttaaaaagcgtccgta

SEQ ID NO: 136886 - DNA, 25 bp, Homo sapien
tcagtctgggacaagaacaagaaca

SEQ ID NO: 136887 - DNA, 25 bp, Homo sapien
tactggcgaggctcgcttaaaaagc

SEQ ID NO: 136888 - DNA, 25 bp, Homo sapien
tcgtgaccaagcctctctgagagtg

SEQ ID NO: 136889 - DNA, 25 bp, Homo sapien
ccgtttgtgggtagaaattcagtct

SEQ ID NO: 136890 - DNA, 25 bp, Homo sapien
gcaagcggacctcgtgaccaagcct

SEQ ID NO: 136891 - DNA, 25 bp, Homo sapien
ttttaagggcaagcggacctcgtga

SEQ ID NO: 136892 - DNA, 25 bp, Homo sapien
ccaggccgtgagaacggagcgttca

SEQ ID NO: 136893 - DNA, 25 bp, Homo sapien
actcccagcgaacgggtgagcctgg

SEQ ID NO: 136894 - DNA, 25 bp, Homo sapien
gtggacagacgccaacctgactgcg

SEQ ID NO: 136895 - DNA, 25 bp, Homo sapien
ccaacagcagcacaaggcgggactc

SEQ ID NO: 136896 - DNA, 25 bp, Homo sapien
ccagacccaagggagaactcctttg

SEQ ID NO: 136897 - DNA, 25 bp, Homo sapien
acttccacagccgtcggccgggaga

SEQ ID NO: 136898 - DNA, 25 bp, Homo sapien
ctgagaaccgttcaagctgcgggag

SEQ ID NO: 136899 - DNA, 25 bp, Homo sapien
tgactgcgagacaacgagatccaga

SEQ ID NO: 136900 - DNA, 25 bp, Homo sapien
gctcgctgtctttgcgctgctggac

SEQ ID NO: 136901 - DNA, 25 bp, Homo sapien
tgacctgctagctgagcagcgcttc

SEQ ID NO: 136902 - DNA, 25 bp, Homo sapien
tgctgcacatgaacaacgcgcgcta

SEQ ID NO: 136903 - DNA, 25 bp, Homo sapien
cctttgcgctcagacgaagggccga

SEQ ID NO: 136904 - DNA, 25 bp, Homo sapien
gcagaagctaggttcccgcagagtc

SEQ ID NO: 136905 - DNA, 25 bp, Homo sapien
gtgattcgccctgagccgctgcgaa

SEQ ID NO: 136906 - DNA, 25 bp, Homo sapien
cacggggaccatgagcgtgattcgc

SEQ ID NO: 136907 - DNA, 25 bp, Homo sapien
tgctgccctcggacttggacctgct

SEQ ID NO: 136908 - DNA, 25 bp, Homo sapien
ggctctctgaactctgtgctgcgga

SEQ ID NO: 136909 - DNA, 25 bp, Homo sapien
ccttggctccaatcgaggcccgggt

SEQ ID NO: 136910 - DNA, 25 bp, Homo sapien
agatgcggcgacttcttgctccgtc

SEQ ID NO: 136911 - DNA, 25 bp, Homo sapien
cctcccagggataggggcacctgct

SEQ ID NO: 136912 - DNA, 25 bp, Homo sapien
gacggtcacggatgcgacgcccact

SEQ ID NO: 136913 - DNA, 25 bp, Homo sapien
agctttacccacgtcctgcgacggt

SEQ ID NO: 136914 - DNA, 25 bp, Homo sapien
aagactagcgctggctggtctgacc

SEQ ID NO: 136915 - DNA, 25 bp, Homo sapien
ctcccaaagagcctggaggcctcat

SEQ ID NO: 136916 - DNA, 25 bp, Homo sapien
gtctctcacgacacatttgcccagg

SEQ ID NO: 136917 - DNA, 25 bp, Homo sapien
ctaatcgtaggcgtgtctgtgtgtc

SEQ ID NO: 136918 - DNA, 25 bp, Homo sapien
tctggatctccgacacagaggcagc

SEQ ID NO: 136919 - DNA, 25 bp, Homo sapien
aggcagccacgcagtgattccctgg

SEQ ID NO: 136920 - DNA, 25 bp, Homo sapien
ctcagactcacgtgttcagcccgga

SEQ ID NO: 136921 - DNA, 25 bp, Homo sapien
ctgtgaccttcaccaccgtgaggta

SEQ ID NO: 136922 - DNA, 25 bp, Homo sapien
aggtgcctgcctgagtctaatcgta

SEQ ID NO: 136923 - DNA, 25 bp, Homo sapien
gcgggactatcagggtgacctcacc

SEQ ID NO: 136924 - DNA, 25 bp, Homo sapien
gcctcaggcagcactgctgtctgtg

SEQ ID NO: 136925 - DNA, 25 bp, Homo sapien
tctgtgtgagactccgccagcttct

SEQ ID NO: 136926 - DNA, 25 bp, Homo sapien
ctgctgtctgtgtgagactccgcca

SEQ ID NO: 136927 - DNA, 25 bp, Homo sapien
gctgcagaagctcatgtcccgtagg

SEQ ID NO: 136928 - DNA, 25 bp, Homo sapien
cagaagctcatgtcccgtagggaaa

SEQ ID NO: 136929 - DNA, 25 bp, Homo sapien
cagcactgctgtctgtgtgagactc

SEQ ID NO: 136930 - DNA, 25 bp, Homo sapien
agctcatgtcccgtagggaaaggga

SEQ ID NO: 136931 - DNA, 25 bp, Homo sapien
cgctcgaccaagtcgggaaatggcg

SEQ ID NO: 136932 - DNA, 25 bp, Homo sapien
tacccggttctcgtcgtagatgatc

SEQ ID NO: 136933 - DNA, 25 bp, Homo sapien
gacacatacccggttctcgtcgtag

SEQ ID NO: 136934 - DNA, 25 bp, Homo sapien
tgacacgggcttctcaggctcgggc

SEQ ID NO: 136935 - DNA, 25 bp, Homo sapien
accaggctgcggtgcttcgactcga

SEQ ID NO: 136936 - DNA, 25 bp, Homo sapien
ggcagaacgtgagggatgagcaccc

SEQ ID NO: 136937 - DNA, 25 bp, Homo sapien
cggttctcgtcgtagatgatctgca

SEQ ID NO: 136938 - DNA, 25 bp, Homo sapien
cggtgacacgggcttctcaggctcg

SEQ ID NO: 136939 - DNA, 25 bp, Homo sapien
tcgtagatgatctgcaccaggctgc

SEQ ID NO: 136940 - DNA, 25 bp, Homo sapien
caggcgtgagactggagtctgccca

SEQ ID NO: 136941 - DNA, 25 bp, Homo sapien
gctgaggcagcctcctcgtcagctg

SEQ ID NO: 136942 - DNA, 25 bp, Homo sapien
ggcacgcacactgcggggctccgag

SEQ ID NO: 136943 - DNA, 25 bp, Homo sapien
acccaggcgtgagactggagtctgc

SEQ ID NO: 136944 - DNA, 25 bp, Homo sapien
cgaggggcacaggtcagtttcctga

SEQ ID NO: 136945 - DNA, 25 bp, Homo sapien
ggaggctcagatggctggaggcggc

SEQ ID NO: 136946 - DNA, 25 bp, Homo sapien
aggcagcctcctcgtcagctgcttg

SEQ ID NO: 136947 - DNA, 25 bp, Homo sapien
ctccgaggggcacaggtcagtttcc

SEQ ID NO: 136948 - DNA, 25 bp, Homo sapien
catccctccgggatctggcggacgt

SEQ ID NO: 136949 - DNA, 25 bp, Homo sapien
tcttgattgccgctggggcggccca

SEQ ID NO: 136950 - DNA, 25 bp, Homo sapien
tcagattcttgattgccgctggggc

SEQ ID NO: 136951 - DNA, 25 bp, Homo sapien
taacagtcagattcttgattgccgc

SEQ ID NO: 136952 - DNA, 25 bp, Homo sapien
cctcggagctttaacagtcagattc

SEQ ID NO: 136953 - DNA, 25 bp, Homo sapien
cagcctgcgttcctcggagctttaa

SEQ ID NO: 136954 - DNA, 25 bp, Homo sapien
cttcattcagcctgcgttcctcgga

SEQ ID NO: 136955 - DNA, 25 bp, Homo sapien
acacggcccacctcctgcttccttt

SEQ ID NO: 136956 - DNA, 25 bp, Homo sapien
gtgctcacacccaaacacgtctgct

SEQ ID NO: 136957 - DNA, 25 bp, Homo sapien
gtccaggtgtcagtgacggtcaccc

SEQ ID NO: 136958 - DNA, 25 bp, Homo sapien
ctgtccaggtgtcagtgacggtcac

SEQ ID NO: 136959 - DNA, 25 bp, Homo sapien
cacaacgaggactgtccaggtgtca

SEQ ID NO: 136960 - DNA, 25 bp, Homo sapien
cccgaacacaacgaggactgtccag

SEQ ID NO: 136961 - DNA, 25 bp, Homo sapien
aacacgtctgctcacccgtgggctt

SEQ ID NO: 136962 - DNA, 25 bp, Homo sapien
tcgccaggtcagcacccgccgcgcg

SEQ ID NO: 136963 - DNA, 25 bp, Homo sapien
cctgtccggcctcgccaggtcagca

SEQ ID NO: 136964 - DNA, 25 bp, Homo sapien
caggcctccccgaatgtttccaaag

SEQ ID NO: 136965 - DNA, 25 bp, Homo sapien
cctggctcctctacgtgggccggga

SEQ ID NO: 136966 - DNA, 25 bp, Homo sapien
gggcacgggaccttgcagagctcct

SEQ ID NO: 136967 - DNA, 25 bp, Homo sapien
cccgcttcttgttttggcactggtg

SEQ ID NO: 136968 - DNA, 25 bp, Homo sapien
ttcttgttttggcactggtggtgct

SEQ ID NO: 136969 - DNA, 25 bp, Homo sapien
cttgcggtgaggtccaaggagccca

SEQ ID NO: 136970 - DNA, 25 bp, Homo sapien
cccagcctccctgagtggaccgccg

SEQ ID NO: 136971 - DNA, 25 bp, Homo sapien
agacgctcctggctcctctacgtgg

SEQ ID NO: 136972 - DNA, 25 bp, Homo sapien
tctgcccgcggatgagcctctggag

SEQ ID NO: 136973 - DNA, 25 bp, Homo sapien
ttcgtttcggggctctggacctgag

SEQ ID NO: 136974 - DNA, 25 bp, Homo sapien
atgagcctctggaggatgggcggcc

SEQ ID NO: 136975 - DNA, 25 bp, Homo sapien
catctgcccgcggatgagcctctgg

SEQ ID NO: 136976 - DNA, 25 bp, Homo sapien
ttcccagcatctgcccgcggatgag

SEQ ID NO: 136977 - DNA, 25 bp, Homo sapien
ccagtctccacaccggcccggaact

SEQ ID NO: 136978 - DNA, 25 bp, Homo sapien
tgggatttcccagtctccacaccgg

SEQ ID NO: 136979 - DNA, 25 bp, Homo sapien
cctctggaggatgggcggcccgtcc

SEQ ID NO: 136980 - DNA, 25 bp, Homo sapien
cctcgggattcctgtttgaggagac

SEQ ID NO: 136981 - DNA, 25 bp, Homo sapien
ggggctcctgtttgagaagacagcc

SEQ ID NO: 136982 - DNA, 25 bp, Homo sapien
cgtcgtcctcgggattcctgtttga

SEQ ID NO: 136983 - DNA, 25 bp, Homo sapien
ctcgtggtccctgtttgaggagaca

SEQ ID NO: 136984 - DNA, 25 bp, Homo sapien
tgtttgaggagacagccgtcatccc

SEQ ID NO: 136985 - DNA, 25 bp, Homo sapien
cggggctcctgtttgagaagacagc

SEQ ID NO: 136986 - DNA, 25 bp, Homo sapien
agaagacagccatcatcctcggggt

SEQ ID NO: 136987 - DNA, 25 bp, Homo sapien
gggctcctgtttgagaagacagcca

SEQ ID NO: 136988 - DNA, 25 bp, Homo sapien
gtgtagacctgccacgttcgacgtc

SEQ ID NO: 136989 - DNA, 25 bp, Homo sapien
caccagcccagtggtgtagacctga

SEQ ID NO: 136990 - DNA, 25 bp, Homo sapien
tgccacgttcgacgtcccagggtaa

SEQ ID NO: 136991 - DNA, 25 bp, Homo sapien
cagcccagtggtgtagacctgccac

SEQ ID NO: 136992 - DNA, 25 bp, Homo sapien
ttcgacgtcccagggtaacgcacca

SEQ ID NO: 136993 - DNA, 25 bp, Homo sapien
cagggtaacgcaccagcccagtggt

SEQ ID NO: 136994 - DNA, 25 bp, Homo sapien
tgtagacctgccacgttcgacgtcc

SEQ ID NO: 136995 - DNA, 25 bp, Homo sapien
ccagtggtgtagacctgccacgttc

SEQ ID NO: 136996 - DNA, 25 bp, Homo sapien
agcatcggtcaggagaccccaaaga

SEQ ID NO: 136997 - DNA, 25 bp, Homo sapien
gggagctgtgcccttcggtctccct

SEQ ID NO: 136998 - DNA, 25 bp, Homo sapien
ccagcctcaggatgcaaccttctcc

SEQ ID NO: 136999 - DNA, 25 bp, Homo sapien
gtgacagctcgagacgcctccgccc

SEQ ID NO: 137000 - DNA, 25 bp, Homo sapien
ttcggtctccctgcggaccggaatc

SEQ ID NO: 137001 - DNA, 25 bp, Homo sapien
cagcctcgtctttcggggaacgcag

SEQ ID NO: 137002 - DNA, 25 bp, Homo sapien
tctttcggggaacgcagccgcagac

SEQ ID NO: 137003 - DNA, 25 bp, Homo sapien
agagcgtccgccgtcacagcatccc

SEQ ID NO: 137004 - DNA, 25 bp, Homo sapien
aggggcggcctcttttcacctgctt

SEQ ID NO: 137005 - DNA, 25 bp, Homo sapien
gacttctccgctccggacacgcctg

SEQ ID NO: 137006 - DNA, 25 bp, Homo sapien
ccagggctgaaagggccgcttacac

SEQ ID NO: 137007 - DNA, 25 bp, Homo sapien
cacacggctggtccagcgtcccggg

SEQ ID NO: 137008 - DNA, 25 bp, Homo sapien
ctctgtcggaagaccctctcctccc

SEQ ID NO: 137009 - DNA, 25 bp, Homo sapien
tcgccggtcttctccgaggcttctt

SEQ ID NO: 137010 - DNA, 25 bp, Homo sapien
tgctcgccggtcttctccgaggctt

SEQ ID NO: 137011 - DNA, 25 bp, Homo sapien
attgaccggtcaggaggccgcctcc

SEQ ID NO: 137012 - DNA, 25 bp, Homo sapien
agaccaagtatgtcccaagcccgcg

SEQ ID NO: 137013 - DNA, 25 bp, Homo sapien
cgtgcccacgcaccatttcccgggt

SEQ ID NO: 137014 - DNA, 25 bp, Homo sapien
tcgcgtgtccagaccgagtgcgtcc

SEQ ID NO: 137015 - DNA, 25 bp, Homo sapien
cacgcaccatttcccgggtcacctg

SEQ ID NO: 137016 - DNA, 25 bp, Homo sapien
gggtcacctgctcagaccaagtatg

SEQ ID NO: 137017 - DNA, 25 bp, Homo sapien
gtcacctgctcagaccaagtatgtc

SEQ ID NO: 137018 - DNA, 25 bp, Homo sapien
acctgctcagaccaagtatgtccca

SEQ ID NO: 137019 - DNA, 25 bp, Homo sapien
tgctcagaccaagtatgtcccaagc

SEQ ID NO: 137020 - DNA, 25 bp, Homo sapien
tggcgctgatttcaaaccagacatg

SEQ ID NO: 137021 - DNA, 25 bp, Homo sapien
accagacatgggcaccgagccaagc

SEQ ID NO: 137022 - DNA, 25 bp, Homo sapien
agagcctcgggagcgcccacgatca

SEQ ID NO: 137023 - DNA, 25 bp, Homo sapien
tgccctcctgaagtcaactccggga

SEQ ID NO: 137024 - DNA, 25 bp, Homo sapien
accaaggagaggagcacagtgccca

SEQ ID NO: 137025 - DNA, 25 bp, Homo sapien
cgagcgctcttttccgtgactgcag

SEQ ID NO: 137026 - DNA, 25 bp, Homo sapien
aacttcgtccgatgagacagccctg

SEQ ID NO: 137027 - DNA, 25 bp, Homo sapien
gtgactgcagcaacttcgtccgatg

SEQ ID NO: 137028 - DNA, 25 bp, Homo sapien
tccttccgcgctgaaggcggagaca

SEQ ID NO: 137029 - DNA, 25 bp, Homo sapien
ggcgcctgccatagacgactgtaaa

SEQ ID NO: 137030 - DNA, 25 bp, Homo sapien
cacgcgcgtcggatccggagagtct

SEQ ID NO: 137031 - DNA, 25 bp, Homo sapien
ctggagaggcgtcggttctccttcc

SEQ ID NO: 137032 - DNA, 25 bp, Homo sapien
agacagcgacttcccgtggaggcaa

SEQ ID NO: 137033 - DNA, 25 bp, Homo sapien
gcagcctacgtgacagggtcggctc

SEQ ID NO: 137034 - DNA, 25 bp, Homo sapien
cgtctccagccaggtactcactggg

SEQ ID NO: 137035 - DNA, 25 bp, Homo sapien
ggtcccgcatctagggctctccttt

SEQ ID NO: 137036 - DNA, 25 bp, Homo sapien
aaagcctttaactgcggctccaatc

SEQ ID NO: 137037 - DNA, 25 bp, Homo sapien
tctgacgtcaccaaacaccagagga

SEQ ID NO: 137038 - DNA, 25 bp, Homo sapien
tgcggctccaatctcctgaaacatc

SEQ ID NO: 137039 - DNA, 25 bp, Homo sapien
tgaaacatcagaagacgcacaccgg

SEQ ID NO: 137040 - DNA, 25 bp, Homo sapien
aagccctacgaatgcacgcactgtg

SEQ ID NO: 137041 - DNA, 25 bp, Homo sapien
tgggaaagcctttgcctacagctcc

SEQ ID NO: 137042 - DNA, 25 bp, Homo sapien
tcagaaacgccaccctcggaagaag

SEQ ID NO: 137043 - DNA, 25 bp, Homo sapien
aaggccttccggcacagctctgacg

SEQ ID NO: 137044 - DNA, 25 bp, Homo sapien
cgtgcacttactacagaagaggctt

SEQ ID NO: 137045 - DNA, 25 bp, Homo sapien
tgcacttactacagaagaggcttcc

SEQ ID NO: 137046 - DNA, 25 bp, Homo sapien
tgcggaatatcacgtgcacttacta

SEQ ID NO: 137047 - DNA, 25 bp, Homo sapien
cggtatgcggaatatcacgtgcact

SEQ ID NO: 137048 - DNA, 25 bp, Homo sapien
cagaagaggcttcccgccctgggga

SEQ ID NO: 137049 - DNA, 25 bp, Homo sapien
ctggggaaagagacgattcggccct

SEQ ID NO: 137050 - DNA, 25 bp, Homo sapien
tatcacgtgcacttactacagaaga

SEQ ID NO: 137051 - DNA, 25 bp, Homo sapien
cggaatatcacgtgcacttactaca

SEQ ID NO: 137052 - DNA, 25 bp, Homo sapien
gtgttagtgagatcacggctcgccc

SEQ ID NO: 137053 - DNA, 25 bp, Homo sapien
gtgttcttgagatcagggctcgccc

SEQ ID NO: 137054 - DNA, 25 bp, Homo sapien
ccgcgtgctagagttagtgagatca

SEQ ID NO: 137055 - DNA, 25 bp, Homo sapien
cccacgtgctggagttagtgagatc

SEQ ID NO: 137056 - DNA, 25 bp, Homo sapien
gtgttcttgagatcagggctcaccc

SEQ ID NO: 137057 - DNA, 25 bp, Homo sapien
cgcgtgctggtgttagtgagatcac

SEQ ID NO: 137058 - DNA, 25 bp, Homo sapien
ggtgttcttgagatcagggctcgcc

SEQ ID NO: 137059 - DNA, 25 bp, Homo sapien
cccgcgtgctagagttagtgagatc

SEQ ID NO: 137060 - DNA, 25 bp, Homo sapien
ggggacggcgccgtcatctcccgaa

SEQ ID NO: 137061 - DNA, 25 bp, Homo sapien
catcgctgcggacacatcccgagga

SEQ ID NO: 137062 - DNA, 25 bp, Homo sapien
ggccagcgtgtacgcgaaagccacg

SEQ ID NO: 137063 - DNA, 25 bp, Homo sapien
cacatcccgaggagggaacccaaga

SEQ ID NO: 137064 - DNA, 25 bp, Homo sapien
gtgcctgggaccagcccagtccgag

SEQ ID NO: 137065 - DNA, 25 bp, Homo sapien
tgtcgtcatcgccactctgcagatg

SEQ ID NO: 137066 - DNA, 25 bp, Homo sapien
gctctgtgccgagctcccggcgatt

SEQ ID NO: 137067 - DNA, 25 bp, Homo sapien
cgcgagctgaacgtggaagcaactc

SEQ ID NO: 137068 - DNA, 25 bp, Homo sapien
accagcgggtgcactaccgcgagta

SEQ ID NO: 137069 - DNA, 25 bp, Homo sapien
gcctgcggcaagagtttcaagtata

SEQ ID NO: 137070 - DNA, 25 bp, Homo sapien
agtataactcgctgctcctgaagca

SEQ ID NO: 137071 - DNA, 25 bp, Homo sapien
gctggtcgggcttcatccagcacca

SEQ ID NO: 137072 - DNA, 25 bp, Homo sapien
tctggagctccgtgctcatcgagca

SEQ ID NO: 137073 - DNA, 25 bp, Homo sapien
gagtcaacttcggtcggagccggca

SEQ ID NO: 137074 - DNA, 25 bp, Homo sapien
cgcctctgccgtttctcatttcaga

SEQ ID NO: 137075 - DNA, 25 bp, Homo sapien
gcaaggccttcatctggagctccgt

SEQ ID NO: 137076 - DNA, 25 bp, Homo sapien
ccaggcgtggacttttaagggcatt

SEQ ID NO: 137077 - DNA, 25 bp, Homo sapien
acggtagccttcgtcttcaacagga

SEQ ID NO: 137078 - DNA, 25 bp, Homo sapien
ccggacgtgatattcctgagccctc

SEQ ID NO: 137079 - DNA, 25 bp, Homo sapien
ccgggtttatcagcgtgcagttgaa

SEQ ID NO: 137080 - DNA, 25 bp, Homo sapien
ggctgattctcgaacgtgccatctg

SEQ ID NO: 137081 - DNA, 25 bp, Homo sapien
tacgtctttcccagtgtcctcagtg

SEQ ID NO: 137082 - DNA, 25 bp, Homo sapien
cgccgtcccagatagtcccggaagt

SEQ ID NO: 137083 - DNA, 25 bp, Homo sapien
gcgccgggtcctaaactctctgcaa

SEQ ID NO: 137084 - DNA, 25 bp, Homo sapien
cctgcttgggccagaatcgggtcct

SEQ ID NO: 137085 - DNA, 25 bp, Homo sapien
ccagaatcgggtcctgcacctcaga

SEQ ID NO: 137086 - DNA, 25 bp, Homo sapien
cccgtgctagttcacagcctcgcga

SEQ ID NO: 137087 - DNA, 25 bp, Homo sapien
agccgcgcgagcaacgccaggcact

SEQ ID NO: 137088 - DNA, 25 bp, Homo sapien
cagtcttccgaacgggtcctccgag

SEQ ID NO: 137089 - DNA, 25 bp, Homo sapien
cgaacgggtcctccgagctgcctag

SEQ ID NO: 137090 - DNA, 25 bp, Homo sapien
ctagagcgcccggaaatgccctcgg

SEQ ID NO: 137091 - DNA, 25 bp, Homo sapien
cccggaaatgccctcggcatggggc

SEQ ID NO: 137092 - DNA, 25 bp, Homo sapien
ctgtgacgcagtccaggatcttcgc

SEQ ID NO: 137093 - DNA, 25 bp, Homo sapien
ggatcttcgccaaggcacctgctgg

SEQ ID NO: 137094 - DNA, 25 bp, Homo sapien
gctgcggactcctagaggttcagtg

SEQ ID NO: 137095 - DNA, 25 bp, Homo sapien
aagcggcacagggaacagcatgaca

SEQ ID NO: 137096 - DNA, 25 bp, Homo sapien
aacagcatgacacgggcctgaggca

SEQ ID NO: 137097 - DNA, 25 bp, Homo sapien
cctgaggcagggcacatttggaaag

SEQ ID NO: 137098 - DNA, 25 bp, Homo sapien
atacagaggcagtcgggacccgtct

SEQ ID NO: 137099 - DNA, 25 bp, Homo sapien
cgcagactcgcgtgcttggagtacc

SEQ ID NO: 137100 - DNA, 25 bp, Homo sapien
tgaacgaatgagagctcggtccctg

SEQ ID NO: 137101 - DNA, 25 bp, Homo sapien
gcaagggcttctctgcagcggagac

SEQ ID NO: 137102 - DNA, 25 bp, Homo sapien
cccggcttctcttgctggggtgtcg

SEQ ID NO: 137103 - DNA, 25 bp, Homo sapien
tcctcagttggctcgagccggatcc

SEQ ID NO: 137104 - DNA, 25 bp, Homo sapien
gcctgcgggcaaccgatgagctgaa

SEQ ID NO: 137105 - DNA, 25 bp, Homo sapien
gtagcgggtgcagtccagctgctct

SEQ ID NO: 137106 - DNA, 25 bp, Homo sapien
tgcgtacccggggtccgacacgtgc

SEQ ID NO: 137107 - DNA, 25 bp, Homo sapien
tccctggtgagaaagagcccagagc

SEQ ID NO: 137108 - DNA, 25 bp, Homo sapien
ttccgactgagcgagcaccgccagg

SEQ ID NO: 137109 - DNA, 25 bp, Homo sapien
cgcagcaggaatttggccgggaccc

SEQ ID NO: 137110 - DNA, 25 bp, Homo sapien
cgctattcgcggctgctgactcgcg

SEQ ID NO: 137111 - DNA, 25 bp, Homo sapien
ggctgcctttcgctcatctctattc

SEQ ID NO: 137112 - DNA, 25 bp, Homo sapien
ctcatctctattctggggccgttgg

SEQ ID NO: 137113 - DNA, 25 bp, Homo sapien
ggacatgcagctctacagcagcgtc

SEQ ID NO: 137114 - DNA, 25 bp, Homo sapien
gcacagatcaccgtgcgggccctgg

SEQ ID NO: 137115 - DNA, 25 bp, Homo sapien
gggcccgatcggaacttccgactga

SEQ ID NO: 137116 - DNA, 25 bp, Homo sapien
ccgtgaacgagacgtcgggcctcca

SEQ ID NO: 137117 - DNA, 25 bp, Homo sapien
gactacgactcccatcccggccctg

SEQ ID NO: 137118 - DNA, 25 bp, Homo sapien
cccacggctgggccgtgaacgagac

SEQ ID NO: 137119 - DNA, 25 bp, Homo sapien
accggcgacaagtgcggggccgcct

SEQ ID NO: 137120 - DNA, 25 bp, Homo sapien
caaggcccaccggcgacaagtgcgg

SEQ ID NO: 137121 - DNA, 25 bp, Homo sapien
ggctcccagcccgatgccccccaaa

SEQ ID NO: 137122 - DNA, 25 bp, Homo sapien
tgaacgagacgtcgggcctccagcg

SEQ ID NO: 137123 - DNA, 25 bp, Homo sapien
gacgtcgggcctccagcgatccgtt

SEQ ID NO: 137124 - DNA, 25 bp, Homo sapien
cgaggcccggtcacttctgagaaaa

SEQ ID NO: 137125 - DNA, 25 bp, Homo sapien
gacagagtggcctcgagtcagacgt

SEQ ID NO: 137126 - DNA, 25 bp, Homo sapien
agtcagacgtccctccgaacgcagg

SEQ ID NO: 137127 - DNA, 25 bp, Homo sapien
tggccgcagcttcaagtgctcctcg

SEQ ID NO: 137128 - DNA, 25 bp, Homo sapien
ttcctgcacagctcgaacgtggtcc

SEQ ID NO: 137129 - DNA, 25 bp, Homo sapien
ggcaaagcaccggagcatccactcg

SEQ ID NO: 137130 - DNA, 25 bp, Homo sapien
ggaaggccttcatccacagctcgca

SEQ ID NO: 137131 - DNA, 25 bp, Homo sapien
agtgctcctcggacgcggcaaagca

SEQ ID NO: 137132 - DNA, 25 bp, Homo sapien
cagagggtcccgtgtggcagagaag

SEQ ID NO: 137133 - DNA, 25 bp, Homo sapien
gcagcagaggatcccacgtggcaga

SEQ ID NO: 137134 - DNA, 25 bp, Homo sapien
agagggtcccacgtggcagagaaga

SEQ ID NO: 137135 - DNA, 25 bp, Homo sapien
cagagggtcccacgtggcagagaag

SEQ ID NO: 137136 - DNA, 25 bp, Homo sapien
agagggtcccgtgtggcagagaaga

SEQ ID NO: 137137 - DNA, 25 bp, Homo sapien
agcagagggtcctgcgtggcagaga

SEQ ID NO: 137138 - DNA, 25 bp, Homo sapien
gcagaggatcccacgtggcagagaa

SEQ ID NO: 137139 - DNA, 25 bp, Homo sapien
agaggatcccacgtggcagagaaga

SEQ ID NO: 137140 - DNA, 25 bp, Homo sapien
ggtgcacgcgaaacacatgccgagc

SEQ ID NO: 137141 - DNA, 25 bp, Homo sapien
gcacgcgaaacacatgccgagcgtc

SEQ ID NO: 137142 - DNA, 25 bp, Homo sapien
cgcgaaacacatgccgagcgtcagc

SEQ ID NO: 137143 - DNA, 25 bp, Homo sapien
gtgggaggcaccctctggacagtct

SEQ ID NO: 137144 - DNA, 25 bp, Homo sapien
gaggcaccctctggacagtctgtgc

SEQ ID NO: 137145 - DNA, 25 bp, Homo sapien
gcaccctctggacagtctgtgcgtc

SEQ ID NO: 137146 - DNA, 25 bp, Homo sapien
acgggtgcacgcgaaacacatgccg

SEQ ID NO: 137147 - DNA, 25 bp, Homo sapien
gaaacacatgccgagcgtcagcgcc

SEQ ID NO: 137148 - DNA, 25 bp, Homo sapien
gacagacaacgccaggaagcccgga

SEQ ID NO: 137149 - DNA, 25 bp, Homo sapien
aggcgcctcatggccgccaagcgag

SEQ ID NO: 137150 - DNA, 25 bp, Homo sapien
gcagaattccgcctccgagcgcgcg

SEQ ID NO: 137151 - DNA, 25 bp, Homo sapien
tccgagcgcgcggacagcatcgaga

SEQ ID NO: 137152 - DNA, 25 bp, Homo sapien
tccgctttcccggacgcttgtgcag

SEQ ID NO: 137153 - DNA, 25 bp, Homo sapien
ttcccggacgcttgtgcagcgcggc

SEQ ID NO: 137154 - DNA, 25 bp, Homo sapien
gccgccctggtggtttctgtctcct

SEQ ID NO: 137155 - DNA, 25 bp, Homo sapien
cctcctcccgctgaacacgtcctcg

SEQ ID NO: 137156 - DNA, 25 bp, Homo sapien
cgtctggggaggaaaatggtctcta

SEQ ID NO: 137157 - DNA, 25 bp, Homo sapien
gtcagcctgtcgaagaggtcgtccc

SEQ ID NO: 137158 - DNA, 25 bp, Homo sapien
agccggcttacggtcagcctgtcga

SEQ ID NO: 137159 - DNA, 25 bp, Homo sapien
tgctgaggaaacacgagccggctta

SEQ ID NO: 137160 - DNA, 25 bp, Homo sapien
tggtctctataattacgtggttttg

SEQ ID NO: 137161 - DNA, 25 bp, Homo sapien
gcccgtccatcagctcctggaggtg

SEQ ID NO: 137162 - DNA, 25 bp, Homo sapien
taggtccggaacaccttggccgtca

SEQ ID NO: 137163 - DNA, 25 bp, Homo sapien
tcagccgttgggtcaggacaaaacc

SEQ ID NO: 137164 - DNA, 25 bp, Homo sapien
tccaccacgtgttggcagccatcgg

SEQ ID NO: 137165 - DNA, 25 bp, Homo sapien
ggaagtcaaattccaccacgtgttg

SEQ ID NO: 137166 - DNA, 25 bp, Homo sapien
tgtagtagcggatgcagtccttccc

SEQ ID NO: 137167 - DNA, 25 bp, Homo sapien
cggcactctgttgtagtagcggatg

SEQ ID NO: 137168 - DNA, 25 bp, Homo sapien
cttctccaccggcactctgttgtag

SEQ ID NO: 137169 - DNA, 25 bp, Homo sapien
agcaaatacgtgtcacatagcgggg

SEQ ID NO: 137170 - DNA, 25 bp, Homo sapien
cccagacatccagagcaaatacgtg

SEQ ID NO: 137171 - DNA, 25 bp, Homo sapien
ggaacagcagcccacggtgtcggcc

SEQ ID NO: 137172 - DNA, 25 bp, Homo sapien
ccgcaccacgcgcatctgccagcct

SEQ ID NO: 137173 - DNA, 25 bp, Homo sapien
gcatgctctcctggcccgacttttg

SEQ ID NO: 137174 - DNA, 25 bp, Homo sapien
agggcaaggccgtcccacgaggcct

SEQ ID NO: 137175 - DNA, 25 bp, Homo sapien
ctgctcactgggacaccttacctgg

SEQ ID NO: 137176 - DNA, 25 bp, Homo sapien
tgggacaccttacctggctccactg

SEQ ID NO: 137177 - DNA, 25 bp, Homo sapien
tgcccttctgcgtcctgcgcgagcc

SEQ ID NO: 137178 - DNA, 25 bp, Homo sapien
gggacctccccgagcagcgtcagag

SEQ ID NO: 137179 - DNA, 25 bp, Homo sapien
gggccggtcacaccgcggcacgcat

SEQ ID NO: 137180 - DNA, 25 bp, Homo sapien
tcgtcaccaacagcgcgacctgggt

SEQ ID NO: 137181 - DNA, 25 bp, Homo sapien
agcgcgacctgggtcacccacagga

SEQ ID NO: 137182 - DNA, 25 bp, Homo sapien
tcacccacaggaagagggccactga

SEQ ID NO: 137183 - DNA, 25 bp, Homo sapien
ttcctgggccgacgtgctgttggct

SEQ ID NO: 137184 - DNA, 25 bp, Homo sapien
ccgacgtgctgttggcttccgcgac

SEQ ID NO: 137185 - DNA, 25 bp, Homo sapien
cttccgcgacgtggtggagtctcgc

SEQ ID NO: 137186 - DNA, 25 bp, Homo sapien
gatgtgggaggtcgtcaccaacagc

SEQ ID NO: 137187 - DNA, 25 bp, Homo sapien
cgacgtggtggagtctcgccagtcc

SEQ ID NO: 137188 - DNA, 25 bp, Homo sapien
cgcctattgggcaatggccagcttc

SEQ ID NO: 137189 - DNA, 25 bp, Homo sapien
cctggaactctggttggctgatata

SEQ ID NO: 137190 - DNA, 25 bp, Homo sapien
tagctgtccgtcgaagcggcattgc

SEQ ID NO: 137191 - DNA, 25 bp, Homo sapien
gtcggaggactcacacaagcacttg

SEQ ID NO: 137192 - DNA, 25 bp, Homo sapien
ggccactcatgtgagccgggaaatg

SEQ ID NO: 137193 - DNA, 25 bp, Homo sapien
tctggatcatcctcaccgctgaagc

SEQ ID NO: 137194 - DNA, 25 bp, Homo sapien
ctctcagcttgggacgttccgtata

SEQ ID NO: 137195 - DNA, 25 bp, Homo sapien
ccgggaaatgcggacagccaaagtc

SEQ ID NO: 137196 - DNA, 25 bp, Homo sapien
gcccagccacccgtccacgactacg

SEQ ID NO: 137197 - DNA, 25 bp, Homo sapien
ctggcccactaccacgtagccatgg

SEQ ID NO: 137198 - DNA, 25 bp, Homo sapien
aaggccgagtacttccgctccctgg

SEQ ID NO: 137199 - DNA, 25 bp, Homo sapien
ggtgcatgtcaaggccgagtacttc

SEQ ID NO: 137200 - DNA, 25 bp, Homo sapien
cacgactacgtgcctgtctcctgga

SEQ ID NO: 137201 - DNA, 25 bp, Homo sapien
gctagtgcaccggaccatggcccag

SEQ ID NO: 137202 - DNA, 25 bp, Homo sapien
gcagccgagtacaggctagtgcacc

SEQ ID NO: 137203 - DNA, 25 bp, Homo sapien
ctggactgccctggtgcatgtcaag

SEQ ID NO: 137204 - DNA, 25 bp, Homo sapien
ccatggtaaccctggcgggcttcca

SEQ ID NO: 137205 - DNA, 25 bp, Homo sapien
cttccagccgacactcgggagctga

SEQ ID NO: 137206 - DNA, 25 bp, Homo sapien
tcgggagctgaaacactgtgaggcc

SEQ ID NO: 137207 - DNA, 25 bp, Homo sapien
cactgtgaggcctttttatagctcg

SEQ ID NO: 137208 - DNA, 25 bp, Homo sapien
ttatagctcggctcttcgctcgctg

SEQ ID NO: 137209 - DNA, 25 bp, Homo sapien
ttcgctcgctggcaggcgaaagaga

SEQ ID NO: 137210 - DNA, 25 bp, Homo sapien
acctccaacctgagcgtagctctgg

SEQ ID NO: 137211 - DNA, 25 bp, Homo sapien
gagcgtagctctggcgccttggctc

SEQ ID NO: 137212 - DNA, 25 bp, Homo sapien
cgggctgtgatctcccagacgctgc

SEQ ID NO: 137213 - DNA, 25 bp, Homo sapien
tgaggatgacttctgtgaggctgcc

SEQ ID NO: 137214 - DNA, 25 bp, Homo sapien
tcgaccgtgaggatgacttctgtga

SEQ ID NO: 137215 - DNA, 25 bp, Homo sapien
ctgcagcgctcactggccaagtatg

SEQ ID NO: 137216 - DNA, 25 bp, Homo sapien
acctgcttcgggctgtgatctccca

SEQ ID NO: 137217 - DNA, 25 bp, Homo sapien
cgtcctgcgcgaggtggacctgctt

SEQ ID NO: 137218 - DNA, 25 bp, Homo sapien
cacacctgaagcgtgccatcctggg

SEQ ID NO: 137219 - DNA, 25 bp, Homo sapien
ccaagtatgcggagctcgaccgtga

SEQ ID NO: 137220 - DNA, 25 bp, Homo sapien
cggcgtgtcacctctcctgccatcc

SEQ ID NO: 137221 - DNA, 25 bp, Homo sapien
cacgtggcccctccagataagcaga

SEQ ID NO: 137222 - DNA, 25 bp, Homo sapien
tggcagtcggcgtgtcacctctcct

SEQ ID NO: 137223 - DNA, 25 bp, Homo sapien
ctagccgggcaactgcggggagaca

SEQ ID NO: 137224 - DNA, 25 bp, Homo sapien
cccgcgcacgtgcactggccgcccg

SEQ ID NO: 137225 - DNA, 25 bp, Homo sapien
acgtccgctgccgtctgtcggtcgt

SEQ ID NO: 137226 - DNA, 25 bp, Homo sapien
cgcatttctcgcttctgctctcgcc

SEQ ID NO: 137227 - DNA, 25 bp, Homo sapien
agacagctgtgcccgcgcgcggtac

SEQ ID NO: 137228 - DNA, 25 bp, Homo sapien
actgcagcaaatgggcaggagaccc

SEQ ID NO: 137229 - DNA, 25 bp, Homo sapien
cccagcactgcagcaaatgggcagg

SEQ ID NO: 137230 - DNA, 25 bp, Homo sapien
gcgactgcgtgtctacaggtgccgc

SEQ ID NO: 137231 - DNA, 25 bp, Homo sapien
cacaccgcgactgcgtgtctacagg

SEQ ID NO: 137232 - DNA, 25 bp, Homo sapien
tggggtaatggtcccagcaccgctg

SEQ ID NO: 137233 - DNA, 25 bp, Homo sapien
caccacgctggggtaatggtcccag

SEQ ID NO: 137234 - DNA, 25 bp, Homo sapien
cggggcctaacgcttctgagacagg

SEQ ID NO: 137235 - DNA, 25 bp, Homo sapien
gcttctgagacaggcgagccgtgct

SEQ ID NO: 137236 - DNA, 25 bp, Homo sapien
cacctcgaacttcatcaggtcgaag

SEQ ID NO: 137237 - DNA, 25 bp, Homo sapien
ttcacgtggtcaactccggggcggc

SEQ ID NO: 137238 - DNA, 25 bp, Homo sapien
cagctcggcgcccatcgccagctcc

SEQ ID NO: 137239 - DNA, 25 bp, Homo sapien
cttcttcacctcgaacttcatcagg

SEQ ID NO: 137240 - DNA, 25 bp, Homo sapien
ggtagccgctcatccagtacagatc

SEQ ID NO: 137241 - DNA, 25 bp, Homo sapien
aggtgatgctggtagccgctcatcc

SEQ ID NO: 137242 - DNA, 25 bp, Homo sapien
gccgcggaaagcctcgtaggctgcg

SEQ ID NO: 137243 - DNA, 25 bp, Homo sapien
cgcagggaaaagtttcacgtggtca

SEQ ID NO: 137244 - DNA, 25 bp, Homo sapien
agcccggctgagtggcagcccaggt

SEQ ID NO: 137245 - DNA, 25 bp, Homo sapien
cggccgtggttcagcgcgtccaccc

SEQ ID NO: 137246 - DNA, 25 bp, Homo sapien
cccgccgccgtcgtagcgcctaggc

SEQ ID NO: 137247 - DNA, 25 bp, Homo sapien
cctaggcggggcctctcgtagcgac

SEQ ID NO: 137248 - DNA, 25 bp, Homo sapien
tgtttgaggccggccagtcgtgact

SEQ ID NO: 137249 - DNA, 25 bp, Homo sapien
actgggcggcaatgaggtcagtgac

SEQ ID NO: 137250 - DNA, 25 bp, Homo sapien
gtcagtgactgccgggagtcctgca

SEQ ID NO: 137251 - DNA, 25 bp, Homo sapien
cgggccgtgcggttcccggacagca

SEQ ID NO: 137252 - DNA, 25 bp, Homo sapien
atggtcgcaaatttgcagcccgccg

SEQ ID NO: 137253 - DNA, 25 bp, Homo sapien
ctcagcggagctgttgcagaaggct

SEQ ID NO: 137254 - DNA, 25 bp, Homo sapien
ctgcagcaagcatcttccattaacg

SEQ ID NO: 137255 - DNA, 25 bp, Homo sapien
tcttccattaacgttacgaccgtga

SEQ ID NO: 137256 - DNA, 25 bp, Homo sapien
tgcgtggggtttatcgtcactcaaa

SEQ ID NO: 137257 - DNA, 25 bp, Homo sapien
gttacgaccgtgaaatatgacaata

SEQ ID NO: 137258 - DNA, 25 bp, Homo sapien
tgatagccgtatggtcgcaaatttg

SEQ ID NO: 137259 - DNA, 25 bp, Homo sapien
caggcatttgagtgtgctcagcgga

SEQ ID NO: 137260 - DNA, 25 bp, Homo sapien
caatgcggcggtctgtcggcactgc

SEQ ID NO: 137261 - DNA, 25 bp, Homo sapien
gcccaggctgccagtgacactgcga

SEQ ID NO: 137262 - DNA, 25 bp, Homo sapien
gcggtctgtcggcactgctggttcc

SEQ ID NO: 137263 - DNA, 25 bp, Homo sapien
ccaggctgccagtgacactgcgacg

SEQ ID NO: 137264 - DNA, 25 bp, Homo sapien
gcacgccctcacacctgccagcctg

SEQ ID NO: 137265 - DNA, 25 bp, Homo sapien
cagtccagacggcacgggcacgccc

SEQ ID NO: 137266 - DNA, 25 bp, Homo sapien
gggtgctcagggcagcccccgttct

SEQ ID NO: 137267 - DNA, 25 bp, Homo sapien
tggttcccagtctctcgcccaggct

SEQ ID NO: 137268 - DNA, 25 bp, Homo sapien
cgaagtcagcagaagaggagcggcc

SEQ ID NO: 137269 - DNA, 25 bp, Homo sapien
ggcgccgcagcgaatccccaagtag

SEQ ID NO: 137270 - DNA, 25 bp, Homo sapien
tcaggcagagctgcgccatgacagg

SEQ ID NO: 137271 - DNA, 25 bp, Homo sapien
tgacaggcactaaactgcttaagtg

SEQ ID NO: 137272 - DNA, 25 bp, Homo sapien
agtggggctttccactggaaacgct

SEQ ID NO: 137273 - DNA, 25 bp, Homo sapien
tccccaagtaggtcaggcagagctg

SEQ ID NO: 137274 - DNA, 25 bp, Homo sapien
taaactgcttaagtggggctttcca

SEQ ID NO: 137275 - DNA, 25 bp, Homo sapien
tgcgccatgacaggcactaaactgc

SEQ ID NO: 137276 - DNA, 25 bp, Homo sapien
gctacacggccccaccaccacgaag

SEQ ID NO: 137277 - DNA, 25 bp, Homo sapien
catcaccacgaagctcacacacaga

SEQ ID NO: 137278 - DNA, 25 bp, Homo sapien
caccaccacgaagctcagacacaga

SEQ ID NO: 137279 - DNA, 25 bp, Homo sapien
accaccacgaagctcagacacagaa

SEQ ID NO: 137280 - DNA, 25 bp, Homo sapien
ggccccatcaccacgaagctcagac

SEQ ID NO: 137281 - DNA, 25 bp, Homo sapien
cggccccatcaccacgaagctcaga

SEQ ID NO: 137282 - DNA, 25 bp, Homo sapien
ccatcaccacgaagctcacacacag

SEQ ID NO: 137283 - DNA, 25 bp, Homo sapien
caccaccacgaagctcacacacaga

SEQ ID NO: 137284 - DNA, 25 bp, Homo sapien
tgaccagtgttcacgtgtgctcaca

SEQ ID NO: 137285 - DNA, 25 bp, Homo sapien
cacacagcagcacggggcaagcggc

SEQ ID NO: 137286 - DNA, 25 bp, Homo sapien
agtgttcacgtgtgctcacactggc

SEQ ID NO: 137287 - DNA, 25 bp, Homo sapien
gcaggatctgaccagtgttcacgtg

SEQ ID NO: 137288 - DNA, 25 bp, Homo sapien
gcaggcaggatctgaccagtgttca

SEQ ID NO: 137289 - DNA, 25 bp, Homo sapien
aggctgcccggaggcaagccccaag

SEQ ID NO: 137290 - DNA, 25 bp, Homo sapien
aaacggaggctcaggctgcccggag

SEQ ID NO: 137291 - DNA, 25 bp, Homo sapien
tgtgctcacactggcacccgtggga

SEQ ID NO: 137292 - DNA, 25 bp, Homo sapien
gcaggtctcactcgctgtgtcacgc

SEQ ID NO: 137293 - DNA, 25 bp, Homo sapien
agcaggtctcactcgctgtgtcacg

SEQ ID NO: 137294 - DNA, 25 bp, Homo sapien
agcagcaggtctcactcgctgtgtc

SEQ ID NO: 137295 - DNA, 25 bp, Homo sapien
acacccaccactcactcgctcaagg

SEQ ID NO: 137296 - DNA, 25 bp, Homo sapien
aggtctcactcgctgtgtcacgctc

SEQ ID NO: 137297 - DNA, 25 bp, Homo sapien
acagtgtggactgagccccacgcct

SEQ ID NO: 137298 - DNA, 25 bp, Homo sapien
tgtgggccacagtgtggactgagcc

SEQ ID NO: 137299 - DNA, 25 bp, Homo sapien
ccaccactcactcgctcaaggccgc

SEQ ID NO: 137300 - DNA, 25 bp, Homo sapien
cgacgtcatcgctacgcgacctttt

SEQ ID NO: 137301 - DNA, 25 bp, Homo sapien
gcccttagcctgctctgccgaaatg

SEQ ID NO: 137302 - DNA, 25 bp, Homo sapien
ggttactaagcgacggccctgcctc

SEQ ID NO: 137303 - DNA, 25 bp, Homo sapien
ctcgacaaagctggagccggggact

SEQ ID NO: 137304 - DNA, 25 bp, Homo sapien
ctaccctgcagtaggcggatctgcc

SEQ ID NO: 137305 - DNA, 25 bp, Homo sapien
tctgccgccgtaatatctccttttc

SEQ ID NO: 137306 - DNA, 25 bp, Homo sapien
acgtcactagtgagcgccgggaagt

SEQ ID NO: 137307 - DNA, 25 bp, Homo sapien
gccgaaatgagccatgaactagtcc

SEQ ID NO: 137308 - DNA, 25 bp, Homo sapien
gccaggctgcttcgtggccgtctct

SEQ ID NO: 137309 - DNA, 25 bp, Homo sapien
ctgctgtgcacaccggtgttcggaa

SEQ ID NO: 137310 - DNA, 25 bp, Homo sapien
gagtcacctaaaccgcctgctgtgc

SEQ ID NO: 137311 - DNA, 25 bp, Homo sapien
ggaagcagagtcacctaaaccgcct

SEQ ID NO: 137312 - DNA, 25 bp, Homo sapien
acaacccaccttggcgggaagcaga

SEQ ID NO: 137313 - DNA, 25 bp, Homo sapien
ctggcacgtgtgaaactggcaaacg

SEQ ID NO: 137314 - DNA, 25 bp, Homo sapien
cgcagttacgctgaaagctctggca

SEQ ID NO: 137315 - DNA, 25 bp, Homo sapien
cgctgaaagctctggcacgtgtgaa

SEQ ID NO: 137316 - DNA, 25 bp, Homo sapien
tgtggacagagcacctgtcctcgcc

SEQ ID NO: 137317 - DNA, 25 bp, Homo sapien
gcttgtcttggctcctagaaccagg

SEQ ID NO: 137318 - DNA, 25 bp, Homo sapien
tcactctgcacacgcagcagaaggg

SEQ ID NO: 137319 - DNA, 25 bp, Homo sapien
cccgttcggggtgatgattgaagaa

SEQ ID NO: 137320 - DNA, 25 bp, Homo sapien
gaggtaacttcgtcactgcccgttg

SEQ ID NO: 137321 - DNA, 25 bp, Homo sapien
ggtgggccacaccttgctcagccgt

SEQ ID NO: 137322 - DNA, 25 bp, Homo sapien
agggttctgccctcaacacttctgg

SEQ ID NO: 137323 - DNA, 25 bp, Homo sapien
ctcggggattacctctctggctggt

SEQ ID NO: 137324 - DNA, 25 bp, Homo sapien
agtttcacttttagctctgggcacc

SEQ ID NO: 137325 - DNA, 25 bp, Homo sapien
cccagggagagcagacgcgccagac

SEQ ID NO: 137326 - DNA, 25 bp, Homo sapien
ccagctcctgctcgccggacggctc

SEQ ID NO: 137327 - DNA, 25 bp, Homo sapien
ttcacttttagctctgggcacctcc

SEQ ID NO: 137328 - DNA, 25 bp, Homo sapien
gcgtcaggttgcagtttcactttta

SEQ ID NO: 137329 - DNA, 25 bp, Homo sapien
ggccctgcgtcaggttgcagtttca

SEQ ID NO: 137330 - DNA, 25 bp, Homo sapien
acttttagctctgggcacctccagc

SEQ ID NO: 137331 - DNA, 25 bp, Homo sapien
caggttgcagtttcacttttagctc

SEQ ID NO: 137332 - DNA, 25 bp, Homo sapien
acaacgtgtacgtggtgactgaggt

SEQ ID NO: 137333 - DNA, 25 bp, Homo sapien
ccctgcgcttggctgcggagccgaa

SEQ ID NO: 137334 - DNA, 25 bp, Homo sapien
cccggagccacgtgcttgcaggtgt

SEQ ID NO: 137335 - DNA, 25 bp, Homo sapien
gaggtggaagtcacgcgcacccaca

SEQ ID NO: 137336 - DNA, 25 bp, Homo sapien
ccagaacacaaagtcctgcagcagc

SEQ ID NO: 137337 - DNA, 25 bp, Homo sapien
tgcggcagccagaacacaaagtcct

SEQ ID NO: 137338 - DNA, 25 bp, Homo sapien
tttgctgctcctcggacacaggcac

SEQ ID NO: 137339 - DNA, 25 bp, Homo sapien
acgcgcacccacaagcgggagggct

SEQ ID NO: 137340 - DNA, 25 bp, Homo sapien
gttagacaggtaccggtcagattac

SEQ ID NO: 137341 - DNA, 25 bp, Homo sapien
caggtaccggtcagattacggtggc

SEQ ID NO: 137342 - DNA, 25 bp, Homo sapien
agacaggtaccggtcagattacggt

SEQ ID NO: 137343 - DNA, 25 bp, Homo sapien
ggtaccggtcagattacggtggcac

SEQ ID NO: 137344 - DNA, 25 bp, Homo sapien
gtaccggtcagattacggtggcaca

SEQ ID NO: 137345 - DNA, 25 bp, Homo sapien
ccggtcagattacggtggcacaggc

SEQ ID NO: 137346 - DNA, 25 bp, Homo sapien
ggttagacaggtaccggtcagatta

SEQ ID NO: 137347 - DNA, 25 bp, Homo sapien
aggtaccggtcagattacggtggca

SEQ ID NO: 137348 - DNA, 25 bp, Homo sapien
tctgcagtcgccctaggtctgcgag

SEQ ID NO: 137349 - DNA, 25 bp, Homo sapien
atcgccacctgctgagcggacacgt

SEQ ID NO: 137350 - DNA, 25 bp, Homo sapien
gtcgctctgcagtcgccctaggtct

SEQ ID NO: 137351 - DNA, 25 bp, Homo sapien
tcgccctaggtctgcgaggagatcg

SEQ ID NO: 137352 - DNA, 25 bp, Homo sapien
ctgcgaggagatcgcggctcaggct

SEQ ID NO: 137353 - DNA, 25 bp, Homo sapien
gtccactccgccctagcaccagcca

SEQ ID NO: 137354 - DNA, 25 bp, Homo sapien
ctggaaggggctgtcggcgaagact

SEQ ID NO: 137355 - DNA, 25 bp, Homo sapien
ctgctgagcggacacgtgcgctgcc

SEQ ID NO: 137356 - DNA, 25 bp, Homo sapien
cgctgcgattcagggatcaagtcca

SEQ ID NO: 137357 - DNA, 25 bp, Homo sapien
ctctgcaacagctaggcgaggcaca

SEQ ID NO: 137358 - DNA, 25 bp, Homo sapien
ggagtcgctccaggatgacctcctc

SEQ ID NO: 137359 - DNA, 25 bp, Homo sapien
tctccctgccaggtgaggagtcgct

SEQ ID NO: 137360 - DNA, 25 bp, Homo sapien
gcccaaccagcgcacagtgggttcg

SEQ ID NO: 137361 - DNA, 25 bp, Homo sapien
ccttcctgcgattcagcgcgaggtg

SEQ ID NO: 137362 - DNA, 25 bp, Homo sapien
tttgctcacgtcgtccagtagcgga

SEQ ID NO: 137363 - DNA, 25 bp, Homo sapien
ccctgtgaagaaggccatagccgtg

SEQ ID NO: 137364 - DNA, 25 bp, Homo sapien
agtgcgctcagcactcgcagggccg

SEQ ID NO: 137365 - DNA, 25 bp, Homo sapien
gccagtgcgctcagcactcgcaggg

SEQ ID NO: 137366 - DNA, 25 bp, Homo sapien
agggccagtgcgctcagcactcgca

SEQ ID NO: 137367 - DNA, 25 bp, Homo sapien
acacaccacgtcccgcgcatgctcc

SEQ ID NO: 137368 - DNA, 25 bp, Homo sapien
ggggtagcagcgcacacaccacgtc

SEQ ID NO: 137369 - DNA, 25 bp, Homo sapien
agagcggggtagcagcgcacacacc

SEQ ID NO: 137370 - DNA, 25 bp, Homo sapien
tgggttaccgatcggcgggcagaga

SEQ ID NO: 137371 - DNA, 25 bp, Homo sapien
ccctccgctaggctgggcacctgcg

SEQ ID NO: 137372 - DNA, 25 bp, Homo sapien
tcgaagaacgcaggatccgtgtctg

SEQ ID NO: 137373 - DNA, 25 bp, Homo sapien
ggcccgaaggtgctcgaagaacgca

SEQ ID NO: 137374 - DNA, 25 bp, Homo sapien
ctgcacgtctggaaacgaggtaact

SEQ ID NO: 137375 - DNA, 25 bp, Homo sapien
gcgcactccctgtggggcttatcgt

SEQ ID NO: 137376 - DNA, 25 bp, Homo sapien
gggacaaggacttccaccggccata

SEQ ID NO: 137377 - DNA, 25 bp, Homo sapien
cacctggcgtagctgaccaggcaga

SEQ ID NO: 137378 - DNA, 25 bp, Homo sapien
gcgccaatagcccaacgccatggtg

SEQ ID NO: 137379 - DNA, 25 bp, Homo sapien
agcggcggaagaagagctcgaactc

SEQ ID NO: 137380 - DNA, 25 bp, Homo sapien
ctcaagtcgccaagcgagggttccc

SEQ ID NO: 137381 - DNA, 25 bp, Homo sapien
tcggcactctgaacgcggccaaggt

SEQ ID NO: 137382 - DNA, 25 bp, Homo sapien
gactgcgcgcagacactgaccttca

SEQ ID NO: 137383 - DNA, 25 bp, Homo sapien
cgctctatataagtgggcagtggcc

SEQ ID NO: 137384 - DNA, 25 bp, Homo sapien
ggagttccacttcgcggcgctctat

SEQ ID NO: 137385 - DNA, 25 bp, Homo sapien
gggaacgtcggaacagtgcatcatc

SEQ ID NO: 137386 - DNA, 25 bp, Homo sapien
acaggtctcgccttgtcccgaaagc

SEQ ID NO: 137387 - DNA, 25 bp, Homo sapien
gactctcctagaacgttgccacaag

SEQ ID NO: 137388 - DNA, 25 bp, Homo sapien
aactgcgtcccgacaaacggtcagc

SEQ ID NO: 137389 - DNA, 25 bp, Homo sapien
agcgactctttcaactgcgtcccga

SEQ ID NO: 137390 - DNA, 25 bp, Homo sapien
tctctcctaacagagaccaagtctg

SEQ ID NO: 137391 - DNA, 25 bp, Homo sapien
agcttcaaagcttgcgcagacgaca

SEQ ID NO: 137392 - DNA, 25 bp, Homo sapien
gacgacaggcacgtgcaagcctctc

SEQ ID NO: 137393 - DNA, 25 bp, Homo sapien
ctctccagcaggagagcccggagca

SEQ ID NO: 137394 - DNA, 25 bp, Homo sapien
cggagcaggacacagcgactctttc

SEQ ID NO: 137395 - DNA, 25 bp, Homo sapien
gcttcccgcattcccaagcatggga

SEQ ID NO: 137396 - DNA, 25 bp, Homo sapien
tgcgccaccacaaccaggacaagtt

SEQ ID NO: 137397 - DNA, 25 bp, Homo sapien
acgagcccaagctgcgctggttcct

SEQ ID NO: 137398 - DNA, 25 bp, Homo sapien
atctacgggcccgagtgcaccttca

SEQ ID NO: 137399 - DNA, 25 bp, Homo sapien
tccagccagcgcttctacggcgagg

SEQ ID NO: 137400 - DNA, 25 bp, Homo sapien
cgagcagatttacagcgccagcgtc

SEQ ID NO: 137401 - DNA, 25 bp, Homo sapien
gtcaccggcctctactggaagctgc

SEQ ID NO: 137402 - DNA, 25 bp, Homo sapien
ccacaagctgaagccgctggtcatc

SEQ ID NO: 137403 - DNA, 25 bp, Homo sapien
tccatcaaggacaagctgcaggcca

SEQ ID NO: 137404 - DNA, 25 bp, Homo sapien
agctgccatcttgttgcctcggacg

SEQ ID NO: 137405 - DNA, 25 bp, Homo sapien
gcggcacctagccacgtgtgactca

SEQ ID NO: 137406 - DNA, 25 bp, Homo sapien
caccctcgccgattggttactggga

SEQ ID NO: 137407 - DNA, 25 bp, Homo sapien
attggttactgggacggcacactcc

SEQ ID NO: 137408 - DNA, 25 bp, Homo sapien
gtccgcactctacaagttcgcaagg

SEQ ID NO: 137409 - DNA, 25 bp, Homo sapien
tctcgctgcttattggcccgaaagg

SEQ ID NO: 137410 - DNA, 25 bp, Homo sapien
tgcgaggagcacatgttggttttcc

SEQ ID NO: 137411 - DNA, 25 bp, Homo sapien
gtgtgactcaaatcttcccgcagcc

SEQ ID NO: 137412 - DNA, 25 bp, Homo sapien
tgcaccttgtggatgaggccaggca

SEQ ID NO: 137413 - DNA, 25 bp, Homo sapien
tgccgctggcctcttactgaggctg

SEQ ID NO: 137414 - DNA, 25 bp, Homo sapien
cgcaccagcgagtatatgaactgcc

SEQ ID NO: 137415 - DNA, 25 bp, Homo sapien
gcacgtggccatcctcgatgttgaa

SEQ ID NO: 137416 - DNA, 25 bp, Homo sapien
actcttggccaggtgcaccttgtgg

SEQ ID NO: 137417 - DNA, 25 bp, Homo sapien
atcggacggacgcactcactcttgg

SEQ ID NO: 137418 - DNA, 25 bp, Homo sapien
tatatgaactgcctccgcggattcc

SEQ ID NO: 137419 - DNA, 25 bp, Homo sapien
aggtgcagccgtactgctggaagta

SEQ ID NO: 137420 - DNA, 25 bp, Homo sapien
gggttgtcgtcccaagcacttgcac

SEQ ID NO: 137421 - DNA, 25 bp, Homo sapien
aacaacaccagagttacggcgaatc

SEQ ID NO: 137422 - DNA, 25 bp, Homo sapien
tacggcgaatcacgttgggtgactg

SEQ ID NO: 137423 - DNA, 25 bp, Homo sapien
tcacggcgggttaagaaggatcaca

SEQ ID NO: 137424 - DNA, 25 bp, Homo sapien
atcggatcacgatgggtcacggcga

SEQ ID NO: 137425 - DNA, 25 bp, Homo sapien
gcggctcacagtggttcccacggtc

SEQ ID NO: 137426 - DNA, 25 bp, Homo sapien
tgactctcacggagcatccagggcc

SEQ ID NO: 137427 - DNA, 25 bp, Homo sapien
cagcctcttggattccggccgcgat

SEQ ID NO: 137428 - DNA, 25 bp, Homo sapien
ctagaacggcgcaggaagtttccca

SEQ ID NO: 137429 - DNA, 25 bp, Homo sapien
catgttttacggtgtggcaggactg

SEQ ID NO: 137430 - DNA, 25 bp, Homo sapien
aggttgatgccgcagacatgtttta

SEQ ID NO: 137431 - DNA, 25 bp, Homo sapien
ccttggctagtcagtctcccggacg

SEQ ID NO: 137432 - DNA, 25 bp, Homo sapien
gcgagctccagacccgagtttccga

SEQ ID NO: 137433 - DNA, 25 bp, Homo sapien
tgaagtttggccctcacggtattta

SEQ ID NO: 137434 - DNA, 25 bp, Homo sapien
ctggatcctcgcctcctgagaagct

SEQ ID NO: 137435 - DNA, 25 bp, Homo sapien
gagccgatccctggcgctcctagaa

SEQ ID NO: 137436 - DNA, 25 bp, Homo sapien
tcagttaccgtcctcggcagggcac

SEQ ID NO: 137437 - DNA, 25 bp, Homo sapien
ggcagggcactgtcacatcctaacg

SEQ ID NO: 137438 - DNA, 25 bp, Homo sapien
cctaacgtgaggacgaaatgggctt

SEQ ID NO: 137439 - DNA, 25 bp, Homo sapien
gaaatgggcttgacctcccagcagc

SEQ ID NO: 137440 - DNA, 25 bp, Homo sapien
ctgaccagggaggaaccggtgtcaa

SEQ ID NO: 137441 - DNA, 25 bp, Homo sapien
gaaccggtgtcaacgcgctcagatt

SEQ ID NO: 137442 - DNA, 25 bp, Homo sapien
tttccatctcagttaccgtcctcgg

SEQ ID NO: 137443 - DNA, 25 bp, Homo sapien
cgccttaactcgttttccatctcag

SEQ ID NO: 137444 - DNA, 25 bp, Homo sapien
tggggtgcagcgttctaaccagatg

SEQ ID NO: 137445 - DNA, 25 bp, Homo sapien
cagcgttctaaccagatggggtgca

SEQ ID NO: 137446 - DNA, 25 bp, Homo sapien
tgcagcgttctaaccagatggggtg

SEQ ID NO: 137447 - DNA, 25 bp, Homo sapien
cagcgttctaacgagatggggtgca

SEQ ID NO: 137448 - DNA, 25 bp, Homo sapien
aaccagatggggtgcagcgttctaa

SEQ ID NO: 137449 - DNA, 25 bp, Homo sapien
gcagcgttctaaccagatggggtgc

SEQ ID NO: 137450 - DNA, 25 bp, Homo sapien
cagcgttctaacgagacggggtgca

SEQ ID NO: 137451 - DNA, 25 bp, Homo sapien
taacgagatggggtgcagcgttcta

SEQ ID NO: 137452 - DNA, 25 bp, Homo sapien
acggcccaggaatacggccactgcg

SEQ ID NO: 137453 - DNA, 25 bp, Homo sapien
tactccctgtttacctgcagacaca

SEQ ID NO: 137454 - DNA, 25 bp, Homo sapien
tccgagcctagatactccctgttta

SEQ ID NO: 137455 - DNA, 25 bp, Homo sapien
agccgtctgtaaccatccgagccta

SEQ ID NO: 137456 - DNA, 25 bp, Homo sapien
gcctgcgcagcttgcatagggccca

SEQ ID NO: 137457 - DNA, 25 bp, Homo sapien
gaagctttagaatttgcccgggaga

SEQ ID NO: 137458 - DNA, 25 bp, Homo sapien
cccgctagggaagctttagaatttg

SEQ ID NO: 137459 - DNA, 25 bp, Homo sapien
gacgggtgcagcgttctaacgagat

SEQ ID NO: 137460 - DNA, 25 bp, Homo sapien
cttgcaggtttgtcaggacccggtt

SEQ ID NO: 137461 - DNA, 25 bp, Homo sapien
accaccgagacgtgggctcctagag

SEQ ID NO: 137462 - DNA, 25 bp, Homo sapien
ttcggataacaacttccgctcggga

SEQ ID NO: 137463 - DNA, 25 bp, Homo sapien
ttgtaaaagtctgggctaccggcgc

SEQ ID NO: 137464 - DNA, 25 bp, Homo sapien
gcggcgtagtggatgcagcatccta

SEQ ID NO: 137465 - DNA, 25 bp, Homo sapien
gggtcgtgggctgtcaaaccttcta

SEQ ID NO: 137466 - DNA, 25 bp, Homo sapien
ctcgctccttacacttgcaggtttg

SEQ ID NO: 137467 - DNA, 25 bp, Homo sapien
ggacccggttgcgtatcctcttgaa

SEQ ID NO: 137468 - DNA, 25 bp, Homo sapien
ttcccgtgtcaggtgctcacgcagc

SEQ ID NO: 137469 - DNA, 25 bp, Homo sapien
cttccggaccaaggagaacctcagc

SEQ ID NO: 137470 - DNA, 25 bp, Homo sapien
tcttcacgcggcatcagaggactca

SEQ ID NO: 137471 - DNA, 25 bp, Homo sapien
cttccgtcacctggggttcttcacg

SEQ ID NO: 137472 - DNA, 25 bp, Homo sapien
agcacaggccctactcgtgtggcga

SEQ ID NO: 137473 - DNA, 25 bp, Homo sapien
caccagaagaaccacacgcgcgaga

SEQ ID NO: 137474 - DNA, 25 bp, Homo sapien
ggtgggcttcaaacctgcagcgcca

SEQ ID NO: 137475 - DNA, 25 bp, Homo sapien
agctgtcattcatctgcggcacgtg

SEQ ID NO: 137476 - DNA, 25 bp, Homo sapien
agcacgggccacgacagggcaggga

SEQ ID NO: 137477 - DNA, 25 bp, Homo sapien
caagcacgggccacgacagggcagg

SEQ ID NO: 137478 - DNA, 25 bp, Homo sapien
gcctggctcatggccaagcacgggc

SEQ ID NO: 137479 - DNA, 25 bp, Homo sapien
acgcgggctctgtcggggtggcagc

SEQ ID NO: 137480 - DNA, 25 bp, Homo sapien
aggagcaattagaggccaggaagga

SEQ ID NO: 137481 - DNA, 25 bp, Homo sapien
agccggcaggagcaattagaggcca

SEQ ID NO: 137482 - DNA, 25 bp, Homo sapien
cggcagcacggaaaggccagctgtc

SEQ ID NO: 137483 - DNA, 25 bp, Homo sapien
ccacgcggcagcacggaaaggccag

SEQ ID NO: 137484 - DNA, 25 bp, Homo sapien
caaggggcaaaggaggccaccacca

SEQ ID NO: 137485 - DNA, 25 bp, Homo sapien
ccgggctgagcgccacagacctgct

SEQ ID NO: 137486 - DNA, 25 bp, Homo sapien
ggaggccaccaccaacccgcagagc

SEQ ID NO: 137487 - DNA, 25 bp, Homo sapien
tctagccctgggcactcgctggtcg

SEQ ID NO: 137488 - DNA, 25 bp, Homo sapien
agccctgggcactcgctggtcgcgt

SEQ ID NO: 137489 - DNA, 25 bp, Homo sapien
ctcgctggtcgcgtcgcggccacga

SEQ ID NO: 137490 - DNA, 25 bp, Homo sapien
cggccacgaggaaggttgagcgcga

SEQ ID NO: 137491 - DNA, 25 bp, Homo sapien
gacaaggggcaaaggaggccaccac

SEQ ID NO: 137492 - DNA, 25 bp, Homo sapien
caggaaggcgttctctcgcagcacc

SEQ ID NO: 137493 - DNA, 25 bp, Homo sapien
ccgttgtccgctttgatggcctgcg

SEQ ID NO: 137494 - DNA, 25 bp, Homo sapien
tgcgtgtgctccacgcgcatatgca

SEQ ID NO: 137495 - DNA, 25 bp, Homo sapien
ctcactggccttgtagggctgcagc

SEQ ID NO: 137496 - DNA, 25 bp, Homo sapien
tgccagtggatctgcgctaggtcca

SEQ ID NO: 137497 - DNA, 25 bp, Homo sapien
ctcgtccagccggacgatggctttg

SEQ ID NO: 137498 - DNA, 25 bp, Homo sapien
tggtcaacgctctcctcgcaggtgt

SEQ ID NO: 137499 - DNA, 25 bp, Homo sapien
tagctggcgtagagccggttctcct

SEQ ID NO: 137500 - DNA, 25 bp, Homo sapien
tccggagatacctactcaggcggca

SEQ ID NO: 137501 - DNA, 25 bp, Homo sapien
acggcaaccgactcaacagtaaggc

SEQ ID NO: 137502 - DNA, 25 bp, Homo sapien
ttcctcatggggtaacacgatcctg

SEQ ID NO: 137503 - DNA, 25 bp, Homo sapien
ttcccgggtgcacacgacgctctgg

SEQ ID NO: 137504 - DNA, 25 bp, Homo sapien
ccagaggcctcaggcagagggatcc

SEQ ID NO: 137505 - DNA, 25 bp, Homo sapien
tggaccctcgcattgtccggagata

SEQ ID NO: 137506 - DNA, 25 bp, Homo sapien
gccatgtgcaccgtagtggaccctc

SEQ ID NO: 137507 - DNA, 25 bp, Homo sapien
tgttccgtcacacactggcgtcctg

SEQ ID NO: 137508 - DNA, 25 bp, Homo sapien
aggacgtccacgtgcgctccatctt

SEQ ID NO: 137509 - DNA, 25 bp, Homo sapien
gcacgttgtgcaccgggaccagaag

SEQ ID NO: 137510 - DNA, 25 bp, Homo sapien
tctgcagccgtccaatgtgctcctg

SEQ ID NO: 137511 - DNA, 25 bp, Homo sapien
ctcctggatgccaactgcacagtga

SEQ ID NO: 137512 - DNA, 25 bp, Homo sapien
ctgtgtgactttggcctggcccgct

SEQ ID NO: 137513 - DNA, 25 bp, Homo sapien
gccgtgacagagtacgtggccacac

SEQ ID NO: 137514 - DNA, 25 bp, Homo sapien
tgctgctctcttcgcaccggtaata

SEQ ID NO: 137515 - DNA, 25 bp, Homo sapien
cgtggccacacgctggtaccgagca

SEQ ID NO: 137516 - DNA, 25 bp, Homo sapien
agcagctccgccaccttggtggaag

SEQ ID NO: 137517 - DNA, 25 bp, Homo sapien
gggctgggcccttgtacttctccag

SEQ ID NO: 137518 - DNA, 25 bp, Homo sapien
gagcggaatgagtcctgcttggcca

SEQ ID NO: 137519 - DNA, 25 bp, Homo sapien
gggagccagcacgtcgtcttcgtaa

SEQ ID NO: 137520 - DNA, 25 bp, Homo sapien
gtcttcgtaagcctccgcttccatg

SEQ ID NO: 137521 - DNA, 25 bp, Homo sapien
cgctcaagtaggaggccaaacgcca

SEQ ID NO: 137522 - DNA, 25 bp, Homo sapien
acgcctgggacacgacggccttgct

SEQ ID NO: 137523 - DNA, 25 bp, Homo sapien
agctgctgtgcaaaggagtcgcgca

SEQ ID NO: 137524 - DNA, 25 bp, Homo sapien
cgcgttcatctcatccagcaggatg

SEQ ID NO: 137525 - DNA, 25 bp, Homo sapien
aagtgctgcgcgttcatctcatcca

SEQ ID NO: 137526 - DNA, 25 bp, Homo sapien
gcacttgtcggccatgtccaggaag

SEQ ID NO: 137527 - DNA, 25 bp, Homo sapien
gttgacacggcacttgtcggccatg

SEQ ID NO: 137528 - DNA, 25 bp, Homo sapien
ctcacatccacgtgctgcaggttga

SEQ ID NO: 137529 - DNA, 25 bp, Homo sapien
cgggaactcacatccacgtgctgca

SEQ ID NO: 137530 - DNA, 25 bp, Homo sapien
gccacagtccgtacgcgcaggaact

SEQ ID NO: 137531 - DNA, 25 bp, Homo sapien
gagtcagatctctcccacgggtcct

SEQ ID NO: 137532 - DNA, 25 bp, Homo sapien
taggaaacgagcgagcccgacgcca

SEQ ID NO: 137533 - DNA, 25 bp, Homo sapien
cggagaccgtgaggcccgcacttca

SEQ ID NO: 137534 - DNA, 25 bp, Homo sapien
ttccggctcagtcgctaggaaacga

SEQ ID NO: 137535 - DNA, 25 bp, Homo sapien
gtgactcggaagttccggctcagtc

SEQ ID NO: 137536 - DNA, 25 bp, Homo sapien
aaggctcaaagttcccagcctgacc

SEQ ID NO: 137537 - DNA, 25 bp, Homo sapien
gcccaactgttgacccaaggctcaa

SEQ ID NO: 137538 - DNA, 25 bp, Homo sapien
ccagactccagctaggccgcgaggg

SEQ ID NO: 137539 - DNA, 25 bp, Homo sapien
tgacccaaggctcaaagttcccagc

SEQ ID NO: 137540 - DNA, 25 bp, Homo sapien
ccagagtgcctgctgtgcgcagcaa

SEQ ID NO: 137541 - DNA, 25 bp, Homo sapien
ctgagaggctgactaacgcgctgac

SEQ ID NO: 137542 - DNA, 25 bp, Homo sapien
gaggctgactaacgcgctgacacgg

SEQ ID NO: 137543 - DNA, 25 bp, Homo sapien
actaacgcgctgacacggcggcacg

SEQ ID NO: 137544 - DNA, 25 bp, Homo sapien
tgacacggcggcacggggctttaca

SEQ ID NO: 137545 - DNA, 25 bp, Homo sapien
cagcgcagcagccagagtgcctgct

SEQ ID NO: 137546 - DNA, 25 bp, Homo sapien
cagcaacgggcgtgcctggtcctgc

SEQ ID NO: 137547 - DNA, 25 bp, Homo sapien
gggctttacaggccacgggccctgc

SEQ ID NO: 137548 - DNA, 25 bp, Homo sapien
tgagagttgcacttctgcccggctc

SEQ ID NO: 137549 - DNA, 25 bp, Homo sapien
cggccacgtggcctcgaaggaatgc

SEQ ID NO: 137550 - DNA, 25 bp, Homo sapien
ccggaacggtctgggcccgccaatg

SEQ ID NO: 137551 - DNA, 25 bp, Homo sapien
gtctgggcccgccaatgacagcatg

SEQ ID NO: 137552 - DNA, 25 bp, Homo sapien
gcccgccaatgacagcatggtgggt

SEQ ID NO: 137553 - DNA, 25 bp, Homo sapien
cttctggtttcctttgagagttgca

SEQ ID NO: 137554 - DNA, 25 bp, Homo sapien
ccctcaggataacggcgcgggcctg

SEQ ID NO: 137555 - DNA, 25 bp, Homo sapien
gagggcactcggtctgcccagcgac

SEQ ID NO: 137556 - DNA, 25 bp, Homo sapien
cgcgcgcttgcgtgtcatgtacaca

SEQ ID NO: 137557 - DNA, 25 bp, Homo sapien
tgcgctgttcccgaccggtgtcggc

SEQ ID NO: 137558 - DNA, 25 bp, Homo sapien
ggatcgccttctcaggctctgcagc

SEQ ID NO: 137559 - DNA, 25 bp, Homo sapien
gcgccgccctcaggtggcaggaaac

SEQ ID NO: 137560 - DNA, 25 bp, Homo sapien
cgtgtacgcgcacctgtgagcgctc

SEQ ID NO: 137561 - DNA, 25 bp, Homo sapien
acacatgtgcttgtgcgcgcacgtg

SEQ ID NO: 137562 - DNA, 25 bp, Homo sapien
tgcgtgtcatgtacacatgtgcttg

SEQ ID NO: 137563 - DNA, 25 bp, Homo sapien
aacgcgaactcgtcgtcggtctcca

SEQ ID NO: 137564 - DNA, 25 bp, Homo sapien
gtcacacagcaaaccagagagcaca

SEQ ID NO: 137565 - DNA, 25 bp, Homo sapien
caaaccagagagcacacacccgatg

SEQ ID NO: 137566 - DNA, 25 bp, Homo sapien
agagagcacacacccgatgcgcagc

SEQ ID NO: 137567 - DNA, 25 bp, Homo sapien
ccaggtgccgggagatgcagcttcc

SEQ ID NO: 137568 - DNA, 25 bp, Homo sapien
gcgcagcacgcttccaccttccacg

SEQ ID NO: 137569 - DNA, 25 bp, Homo sapien
cgttcccactgagggccgcacagtt

SEQ ID NO: 137570 - DNA, 25 bp, Homo sapien
cactgagggccgcacagttccggga

SEQ ID NO: 137571 - DNA, 25 bp, Homo sapien
gcagcgagagcctgaaggtcacaca

SEQ ID NO: 137572 - DNA, 25 bp, Homo sapien
gcgggccctgaagacccatcctgaa

SEQ ID NO: 137573 - DNA, 25 bp, Homo sapien
aaccagggcgtcaatgcgggtttcg

SEQ ID NO: 137574 - DNA, 25 bp, Homo sapien
cccatcctgaaccagggcgtcaatg

SEQ ID NO: 137575 - DNA, 25 bp, Homo sapien
ggacctcctggtgcgagccgaagac

SEQ ID NO: 137576 - DNA, 25 bp, Homo sapien
ctttggacttaggaagactgcgcgg

SEQ ID NO: 137577 - DNA, 25 bp, Homo sapien
cgagggttttctgcgctcggcatcg

SEQ ID NO: 137578 - DNA, 25 bp, Homo sapien
cccgagaagggacccggagcatctc

SEQ ID NO: 137579 - DNA, 25 bp, Homo sapien
catggggtcgactttggacttagga

SEQ ID NO: 137580 - DNA, 25 bp, Homo sapien
acctcagaggcgtggaccgtggcct

SEQ ID NO: 137581 - DNA, 25 bp, Homo sapien
tcagatcgggctccgacctcagagg

SEQ ID NO: 137582 - DNA, 25 bp, Homo sapien
tgaggctcagatcgggctccgacct

SEQ ID NO: 137583 - DNA, 25 bp, Homo sapien
ggccagagcgatccagggcgccttc

SEQ ID NO: 137584 - DNA, 25 bp, Homo sapien
gaggttcccgcagacctgggtcctc

SEQ ID NO: 137585 - DNA, 25 bp, Homo sapien
tcagtccagccttcgctcgctgggg

SEQ ID NO: 137586 - DNA, 25 bp, Homo sapien
gggctgtgatgagccctcccaggcc

SEQ ID NO: 137587 - DNA, 25 bp, Homo sapien
tccagcggggctgtgatgagccctc

SEQ ID NO: 137588 - DNA, 25 bp, Homo sapien
tatggccaggctggagcttcgggag

SEQ ID NO: 137589 - DNA, 25 bp, Homo sapien
aggaggcgctggctatggccaggct

SEQ ID NO: 137590 - DNA, 25 bp, Homo sapien
ctggctatggccaggctggagcttc

SEQ ID NO: 137591 - DNA, 25 bp, Homo sapien
ctatggccaggctggagcttcggga

SEQ ID NO: 137592 - DNA, 25 bp, Homo sapien
atggccaggctggagcttcgggagc

SEQ ID NO: 137593 - DNA, 25 bp, Homo sapien
ccaggctggagcttcgggagcagac

SEQ ID NO: 137594 - DNA, 25 bp, Homo sapien
caggctggagcttcgggagcagacg

SEQ ID NO: 137595 - DNA, 25 bp, Homo sapien
tggctatggccaggctggagcttcg

SEQ ID NO: 137596 - DNA, 25 bp, Homo sapien
gtaggcaaccgcatccgtgccgatg

SEQ ID NO: 137597 - DNA, 25 bp, Homo sapien
catccgtgccgatggccggtcagtt

SEQ ID NO: 137598 - DNA, 25 bp, Homo sapien
ggccggtcagttctccgggccagac

SEQ ID NO: 137599 - DNA, 25 bp, Homo sapien
ctgcacgatgtgctgatgaaagatg

SEQ ID NO: 137600 - DNA, 25 bp, Homo sapien
ggctgaagtgccaggtcaccgagct

SEQ ID NO: 137601 - DNA, 25 bp, Homo sapien
ctgatgaaagatgtaggcaaccgca

SEQ ID NO: 137602 - DNA, 25 bp, Homo sapien
caggtcaccgagctgcacgatgtgc

SEQ ID NO: 137603 - DNA, 25 bp, Homo sapien
cttgcctgtcagctgcactctgcta

SEQ ID NO: 137604 - DNA, 25 bp, Homo sapien
gccctcggagctcagcctcgcctcg

SEQ ID NO: 137605 - DNA, 25 bp, Homo sapien
ctgccaggcacaggcctctagtgct

SEQ ID NO: 137606 - DNA, 25 bp, Homo sapien
cagtcccaataaaacgtgtgccccg

SEQ ID NO: 137607 - DNA, 25 bp, Homo sapien
ggtgctgcatctgtgctgcgtgcgt

SEQ ID NO: 137608 - DNA, 25 bp, Homo sapien
agcggtggcgtgtgccagtccagga

SEQ ID NO: 137609 - DNA, 25 bp, Homo sapien
cggacatgggtctgcaggcacttgg

SEQ ID NO: 137610 - DNA, 25 bp, Homo sapien
gggtgcagccctcggagctcagcct

SEQ ID NO: 137611 - DNA, 25 bp, Homo sapien
tgctggccccagtcccaataaaacg

SEQ ID NO: 137612 - DNA, 25 bp, Homo sapien
tgttcccagtcgtgcagcggcagct

SEQ ID NO: 137613 - DNA, 25 bp, Homo sapien
caggagaggtacctgtcgctgctgc

SEQ ID NO: 137614 - DNA, 25 bp, Homo sapien
aggtacctgtcgctgctgcggccca

SEQ ID NO: 137615 - DNA, 25 bp, Homo sapien
ccacggacgggcctgagtatagccc

SEQ ID NO: 137616 - DNA, 25 bp, Homo sapien
ccacgcagttccaggagcagcggct

SEQ ID NO: 137617 - DNA, 25 bp, Homo sapien
ttcgtcaccaaggtccagtggccgc

SEQ ID NO: 137618 - DNA, 25 bp, Homo sapien
aggaagacctgttcccagtcgtgca

SEQ ID NO: 137619 - DNA, 25 bp, Homo sapien
tctttttcgtcaccaaggtccagtg

SEQ ID NO: 137620 - DNA, 25 bp, Homo sapien
gttcacgtgcctcgtcctacttgga

SEQ ID NO: 137621 - DNA, 25 bp, Homo sapien
tgtcagcggctcacaacaccttggg

SEQ ID NO: 137622 - DNA, 25 bp, Homo sapien
gtgctggcctcaaagccgtcacaga

SEQ ID NO: 137623 - DNA, 25 bp, Homo sapien
aggctctgctggttcacctccaaca

SEQ ID NO: 137624 - DNA, 25 bp, Homo sapien
tcaccttggagatgaagatgccctc

SEQ ID NO: 137625 - DNA, 25 bp, Homo sapien
gccttctggatgcacagttcccgta

SEQ ID NO: 137626 - DNA, 25 bp, Homo sapien
tgactgcttcttggtgcgtggcatc

SEQ ID NO: 137627 - DNA, 25 bp, Homo sapien
acgtcttgcccgttcactgccagga

SEQ ID NO: 137628 - DNA, 25 bp, Homo sapien
cggcgtgatggtgaccgcgttctca

SEQ ID NO: 137629 - DNA, 25 bp, Homo sapien
ccagggaccacgtgcgtattcagga

SEQ ID NO: 137630 - DNA, 25 bp, Homo sapien
actcgcatctgcacggcagtgccgg

SEQ ID NO: 137631 - DNA, 25 bp, Homo sapien
ctgtaatcatcctcgggccgcagcg

SEQ ID NO: 137632 - DNA, 25 bp, Homo sapien
ctgtagggtgtggagcctttcccac

SEQ ID NO: 137633 - DNA, 25 bp, Homo sapien
gagtgcggctgtcagctctagagca

SEQ ID NO: 137634 - DNA, 25 bp, Homo sapien
cgccctcggcaatgcgggagacgaa

SEQ ID NO: 137635 - DNA, 25 bp, Homo sapien
gtattcaggacccagtgccgccaca

SEQ ID NO: 137636 - DNA, 25 bp, Homo sapien
gcctcagagactgtgctggcagatg

SEQ ID NO: 137637 - DNA, 25 bp, Homo sapien
gcagatgggcgagagtcttcactca

SEQ ID NO: 137638 - DNA, 25 bp, Homo sapien
ggcgagagtcttcactcaggccaga

SEQ ID NO: 137639 - DNA, 25 bp, Homo sapien
agtcttcactcaggccagactcggc

SEQ ID NO: 137640 - DNA, 25 bp, Homo sapien
tcagccgcttctcctgcggcgggaa

SEQ ID NO: 137641 - DNA, 25 bp, Homo sapien
gtcaggcttcgacggagctcccgac

SEQ ID NO: 137642 - DNA, 25 bp, Homo sapien
acggagctcccgactcacaggctgg

SEQ ID NO: 137643 - DNA, 25 bp, Homo sapien
cgaccaggcaccgttaacgggctca

SEQ ID NO: 137644 - DNA, 25 bp, Homo sapien
cagctctgtcgtgtgggccagctct

SEQ ID NO: 137645 - DNA, 25 bp, Homo sapien
ctgccagccacagggccttgagatt

SEQ ID NO: 137646 - DNA, 25 bp, Homo sapien
atgggctgcgcctggttctctgcca

SEQ ID NO: 137647 - DNA, 25 bp, Homo sapien
tcctccgtctggaaccggagcatgg

SEQ ID NO: 137648 - DNA, 25 bp, Homo sapien
gtccgggcatcatcctccgtctgga

SEQ ID NO: 137649 - DNA, 25 bp, Homo sapien
gcagcaagtagcaggtgagcacctt

SEQ ID NO: 137650 - DNA, 25 bp, Homo sapien
ggttgccaacaacctaccgaggctg

SEQ ID NO: 137651 - DNA, 25 bp, Homo sapien
tgcccagcatcctctgcagcaggtg

SEQ ID NO: 137652 - DNA, 25 bp, Homo sapien
cagcctccgcagcaggttctgggac

SEQ ID NO: 137653 - DNA, 25 bp, Homo sapien
cggttttccgacacgtccaggcaca

SEQ ID NO: 137654 - DNA, 25 bp, Homo sapien
acactaaccgatgccgtcgggcagc

SEQ ID NO: 137655 - DNA, 25 bp, Homo sapien
acgtccaggcacaccaggcgccgca

SEQ ID NO: 137656 - DNA, 25 bp, Homo sapien
ccgcagcaggttctgggacagcagc

SEQ ID NO: 137657 - DNA, 25 bp, Homo sapien
tcagtgagcagcaccagcccgccga

SEQ ID NO: 137658 - DNA, 25 bp, Homo sapien
gcccgccgagctcagcaggcagctc

SEQ ID NO: 137659 - DNA, 25 bp, Homo sapien
caggcacactaaccgatgccgtcgg

SEQ ID NO: 137660 - DNA, 25 bp, Homo sapien
ccatagagggacagtgtgacggcca

SEQ ID NO: 137661 - DNA, 25 bp, Homo sapien
cacagggtgctcctgatggagtcac

SEQ ID NO: 137662 - DNA, 25 bp, Homo sapien
atgtactgctgtgcgggtcgtgcac

SEQ ID NO: 137663 - DNA, 25 bp, Homo sapien
tgtgctgcggctcatgtactgctgt

SEQ ID NO: 137664 - DNA, 25 bp, Homo sapien
ccactgcagagtcctgtgctgcggc

SEQ ID NO: 137665 - DNA, 25 bp, Homo sapien
attgctggtgtcagcgcccactgca

SEQ ID NO: 137666 - DNA, 25 bp, Homo sapien
tgtggagagacagtgtgacatctgt

SEQ ID NO: 137667 - DNA, 25 bp, Homo sapien
gatggagtcacttttcagtgtgttg

SEQ ID NO: 137668 - DNA, 25 bp, Homo sapien
tcgcaaagtagtggcatcccaagta

SEQ ID NO: 137669 - DNA, 25 bp, Homo sapien
tgggtcttcccagtcgtgcccaagt

SEQ ID NO: 137670 - DNA, 25 bp, Homo sapien
ggggtaccatctccaagggctttca

SEQ ID NO: 137671 - DNA, 25 bp, Homo sapien
cccacgcctaggagggacaaggctg

SEQ ID NO: 137672 - DNA, 25 bp, Homo sapien
ctctagacaagggtctgggtcttcc

SEQ ID NO: 137673 - DNA, 25 bp, Homo sapien
caatgaggcgtcaccagccacggga

SEQ ID NO: 137674 - DNA, 25 bp, Homo sapien
tcggcttgctcctcctgcaagtgtc

SEQ ID NO: 137675 - DNA, 25 bp, Homo sapien
cccgcgctgcccgatggaaaataag

SEQ ID NO: 137676 - DNA, 25 bp, Homo sapien
cctgcagcgaacagtgccgcttgtc

SEQ ID NO: 137677 - DNA, 25 bp, Homo sapien
ccacagcgggatgcacttgagcatg

SEQ ID NO: 137678 - DNA, 25 bp, Homo sapien
ccggcgggtctcagactcttaggaa

SEQ ID NO: 137679 - DNA, 25 bp, Homo sapien
gcgcgggatattgggagctacaatc

SEQ ID NO: 137680 - DNA, 25 bp, Homo sapien
ggtagatctcctccggcacggcctg

SEQ ID NO: 137681 - DNA, 25 bp, Homo sapien
gctacaatccacgagaggcggcgcc

SEQ ID NO: 137682 - DNA, 25 bp, Homo sapien
tctgcggcacaaaagcactggcagc

SEQ ID NO: 137683 - DNA, 25 bp, Homo sapien
cccgcggcatttggccacgaatctt

SEQ ID NO: 137684 - DNA, 25 bp, Homo sapien
tgacatcagtcgctagacccgcagc

SEQ ID NO: 137685 - DNA, 25 bp, Homo sapien
cttgccggacctagcggacaggaac

SEQ ID NO: 137686 - DNA, 25 bp, Homo sapien
ttgcggccactgctacgcttctctt

SEQ ID NO: 137687 - DNA, 25 bp, Homo sapien
aaaggcccgcgtgtttcaggctgac

SEQ ID NO: 137688 - DNA, 25 bp, Homo sapien
accgatgaccctaggttggctgaca

SEQ ID NO: 137689 - DNA, 25 bp, Homo sapien
acttacgagagctatggtcgccgtc

SEQ ID NO: 137690 - DNA, 25 bp, Homo sapien
attggcagctttttctccttccagg

SEQ ID NO: 137691 - DNA, 25 bp, Homo sapien
tttttggagaaaacgctgtcgcgtg

SEQ ID NO: 137692 - DNA, 25 bp, Homo sapien
cagcttcatccggtcgtcctgcgga

SEQ ID NO: 137693 - DNA, 25 bp, Homo sapien
cgctcacatgccagcgcgccttgtc

SEQ ID NO: 137694 - DNA, 25 bp, Homo sapien
tccagcaccagaagcagagtgagct

SEQ ID NO: 137695 - DNA, 25 bp, Homo sapien
ggtcttccagcaccagaagcagagt

SEQ ID NO: 137696 - DNA, 25 bp, Homo sapien
ctacttgggagcaggtcgtaggtca

SEQ ID NO: 137697 - DNA, 25 bp, Homo sapien
cctcgtggaggaagccatagtgcac

SEQ ID NO: 137698 - DNA, 25 bp, Homo sapien
ttcatccggtcgtcctgcggaagga

SEQ ID NO: 137699 - DNA, 25 bp, Homo sapien
cgcccagcgcacctcgtggaggaag

SEQ ID NO: 137700 - DNA, 25 bp, Homo sapien
cgactccgtcggtcgggtgggcgca

SEQ ID NO: 137701 - DNA, 25 bp, Homo sapien
ctcacctgagcgcagacaggatctg

SEQ ID NO: 137702 - DNA, 25 bp, Homo sapien
gcagacaggatctgcgtgcaccagc

SEQ ID NO: 137703 - DNA, 25 bp, Homo sapien
cagacaggatctgcgtgcaccagcg

SEQ ID NO: 137704 - DNA, 25 bp, Homo sapien
cctggcggcggacgcacgactccgt

SEQ ID NO: 137705 - DNA, 25 bp, Homo sapien
cggcggacgcacgactccgtcggtc

SEQ ID NO: 137706 - DNA, 25 bp, Homo sapien
acgcacgactccgtcggtcgggtgg

SEQ ID NO: 137707 - DNA, 25 bp, Homo sapien
aggccctcacctgagcgcagacagg

SEQ ID NO: 137708 - DNA, 25 bp, Homo sapien
gtcgcttttgccagcgaccacacgg

SEQ ID NO: 137709 - DNA, 25 bp, Homo sapien
cacacgggctttcctccaggatgtc

SEQ ID NO: 137710 - DNA, 25 bp, Homo sapien
acctgctcccgtcgcttttgccagc

SEQ ID NO: 137711 - DNA, 25 bp, Homo sapien
tcgcttttgccagcgaccacacggg

SEQ ID NO: 137712 - DNA, 25 bp, Homo sapien
gcttttgccagcgaccacacgggct

SEQ ID NO: 137713 - DNA, 25 bp, Homo sapien
accacacgggctttcctccaggatg

SEQ ID NO: 137714 - DNA, 25 bp, Homo sapien
ccacacgggctttcctccaggatgt

SEQ ID NO: 137715 - DNA, 25 bp, Homo sapien
ccgcggagaggtttccagccgccgc

SEQ ID NO: 137716 - DNA, 25 bp, Homo sapien
agctgcagaagaccccgcgggctcg

SEQ ID NO: 137717 - DNA, 25 bp, Homo sapien
caagggacaggtcgaaggggcaccg

SEQ ID NO: 137718 - DNA, 25 bp, Homo sapien
cgggctcgaaagcgggacccgctct

SEQ ID NO: 137719 - DNA, 25 bp, Homo sapien
tctcgcggttgctcccctaggatct

SEQ ID NO: 137720 - DNA, 25 bp, Homo sapien
gctctcctggccacgcactcattcc

SEQ ID NO: 137721 - DNA, 25 bp, Homo sapien
aagcccacggcaccctccagctgca

SEQ ID NO: 137722 - DNA, 25 bp, Homo sapien
acggcaccctccagctgcagaagac

SEQ ID NO: 137723 - DNA, 25 bp, Homo sapien
ggagcgcccacttctctcgcggttg

SEQ ID NO: 137724 - DNA, 25 bp, Homo sapien
gtcctccatgagctcttgcgtcgtg

SEQ ID NO: 137725 - DNA, 25 bp, Homo sapien
ttgacgcggtcgtcctccatgagct

SEQ ID NO: 137726 - DNA, 25 bp, Homo sapien
ctccaggtagcgcttgacgcggtcg

SEQ ID NO: 137727 - DNA, 25 bp, Homo sapien
cttccacatggcctggtagatgctc

SEQ ID NO: 137728 - DNA, 25 bp, Homo sapien
acgcccttccacatggcctggtaga

SEQ ID NO: 137729 - DNA, 25 bp, Homo sapien
atgagctcttgcgtcgtgctccgtc

SEQ ID NO: 137730 - DNA, 25 bp, Homo sapien
gcttctcctggatctcgccgcccac

SEQ ID NO: 137731 - DNA, 25 bp, Homo sapien
accgacagcctcaggttgcgcacgg

SEQ ID NO: 137732 - DNA, 25 bp, Homo sapien
ctcctccacggtcagcttccggttc

SEQ ID NO: 137733 - DNA, 25 bp, Homo sapien
cagcttcacgtaggtttctttcccg

SEQ ID NO: 137734 - DNA, 25 bp, Homo sapien
ttctttcccgaacattcctgctttg

SEQ ID NO: 137735 - DNA, 25 bp, Homo sapien
aacattcctgctttgaacgcctcct

SEQ ID NO: 137736 - DNA, 25 bp, Homo sapien
tcagcttccggttctccacggggtc

SEQ ID NO: 137737 - DNA, 25 bp, Homo sapien
tccggttctccacggggtcgatgat

SEQ ID NO: 137738 - DNA, 25 bp, Homo sapien
cgacagcagcttcacgtaggtttct

SEQ ID NO: 137739 - DNA, 25 bp, Homo sapien
tcccgaacattcctgctttgaacgc

SEQ ID NO: 137740 - DNA, 25 bp, Homo sapien
tcaagcactgtgtctgagggcagtg

SEQ ID NO: 137741 - DNA, 25 bp, Homo sapien
ggtcgtccacctcaagcactgtgtc

SEQ ID NO: 137742 - DNA, 25 bp, Homo sapien
gagggcagtggcaacagcaacaatc

SEQ ID NO: 137743 - DNA, 25 bp, Homo sapien
tggcaacagcaacaatccggtctcg

SEQ ID NO: 137744 - DNA, 25 bp, Homo sapien
aacaatccggtctcggagtcgcaca

SEQ ID NO: 137745 - DNA, 25 bp, Homo sapien
gtctcggagtcgcacacgcagcgct

SEQ ID NO: 137746 - DNA, 25 bp, Homo sapien
tccctgagctgctggtaggtcacct

SEQ ID NO: 137747 - DNA, 25 bp, Homo sapien
accgcggtgtggtcgtccacctcaa

SEQ ID NO: 137748 - DNA, 25 bp, Homo sapien
tcagtgtagccagtgacagcgcgct

SEQ ID NO: 137749 - DNA, 25 bp, Homo sapien
tcagcatctgatcgaagtagccgcg

SEQ ID NO: 137750 - DNA, 25 bp, Homo sapien
cacttggtccaacagctgctggtca

SEQ ID NO: 137751 - DNA, 25 bp, Homo sapien
tggtcaatgataccggcctccagga

SEQ ID NO: 137752 - DNA, 25 bp, Homo sapien
gcagcatgatgtccgcctgtctctg

SEQ ID NO: 137753 - DNA, 25 bp, Homo sapien
tgcggccctcgctgaagtactcaga

SEQ ID NO: 137754 - DNA, 25 bp, Homo sapien
cagagttgatcagctcccacgcgga

SEQ ID NO: 137755 - DNA, 25 bp, Homo sapien
gggtccaacaggatcaagttcagca

SEQ ID NO: 137756 - DNA, 25 bp, Homo sapien
tgctcggctctttaattaacgagcc

SEQ ID NO: 137757 - DNA, 25 bp, Homo sapien
gggaaacgcagccttgcctgctctt

SEQ ID NO: 137758 - DNA, 25 bp, Homo sapien
cagggagacgcggtgtcattaagta

SEQ ID NO: 137759 - DNA, 25 bp, Homo sapien
tcattaagtagtgagcgcaaagggc

SEQ ID NO: 137760 - DNA, 25 bp, Homo sapien
cagtgtctgcagaaggagccacgcg

SEQ ID NO: 137761 - DNA, 25 bp, Homo sapien
cacgcggccgcgcttaatgaacagt

SEQ ID NO: 137762 - DNA, 25 bp, Homo sapien
cagtgacatctgctcggctctttaa

SEQ ID NO: 137763 - DNA, 25 bp, Homo sapien
gccgcgcttaatgaacagtgacatc

SEQ ID NO: 137764 - DNA, 25 bp, Homo sapien
acacagacggcaaatgctgaggagg

SEQ ID NO: 137765 - DNA, 25 bp, Homo sapien
cgtgggcatggacggcaaatgctga

SEQ ID NO: 137766 - DNA, 25 bp, Homo sapien
cgtggacacagacggcaaatgctga

SEQ ID NO: 137767 - DNA, 25 bp, Homo sapien
gcatggacacagagggcaaatgctg

SEQ ID NO: 137768 - DNA, 25 bp, Homo sapien
ggacacagacggcaaatgctgagga

SEQ ID NO: 137769 - DNA, 25 bp, Homo sapien
tgcgtggacacagacggcaaatgct

SEQ ID NO: 137770 - DNA, 25 bp, Homo sapien
acacagggcaaatgctgaggagggc

SEQ ID NO: 137771 - DNA, 25 bp, Homo sapien
ccggctgcatggacacagagggcaa

SEQ ID NO: 137772 - DNA, 25 bp, Homo sapien
tccagcagctggtggtatgtcagcc

SEQ ID NO: 137773 - DNA, 25 bp, Homo sapien
aggtagcgccgcacctcggcacgtg

SEQ ID NO: 137774 - DNA, 25 bp, Homo sapien
cgtgcactcacgtccactgcggcca

SEQ ID NO: 137775 - DNA, 25 bp, Homo sapien
tcttgaggggcagcaaggctagccc

SEQ ID NO: 137776 - DNA, 25 bp, Homo sapien
ggcacgcacacacctttccagcagc

SEQ ID NO: 137777 - DNA, 25 bp, Homo sapien
ggtggtatgtcagccgctccagcgt

SEQ ID NO: 137778 - DNA, 25 bp, Homo sapien
ccacgctgccggtaccctccaggta

SEQ ID NO: 137779 - DNA, 25 bp, Homo sapien
agctggtggtatgtcagccgctcca

SEQ ID NO: 137780 - DNA, 25 bp, Homo sapien
ctgcagggaaaaccgctgggcctgc

SEQ ID NO: 137781 - DNA, 25 bp, Homo sapien
gtgaccgcttacctgacccggagtg

SEQ ID NO: 137782 - DNA, 25 bp, Homo sapien
cctctcaatttgtcggcctagctgc

SEQ ID NO: 137783 - DNA, 25 bp, Homo sapien
tcggactcggagctcaaattgccca

SEQ ID NO: 137784 - DNA, 25 bp, Homo sapien
gaggcgtcctgtgcccttcagaaca

SEQ ID NO: 137785 - DNA, 25 bp, Homo sapien
tttggagtgaaacgcggaccggcca

SEQ ID NO: 137786 - DNA, 25 bp, Homo sapien
ctccaggcgaccgtgtgaccgctta

SEQ ID NO: 137787 - DNA, 25 bp, Homo sapien
cagcagggagtcaccgcgaaggaac

SEQ ID NO: 137788 - DNA, 25 bp, Homo sapien
aggagaaagtgcagctccacgcacg

SEQ ID NO: 137789 - DNA, 25 bp, Homo sapien
agaaagtgcagctccacgcacggtg

SEQ ID NO: 137790 - DNA, 25 bp, Homo sapien
cacgtggcatggatgccgctgagaa

SEQ ID NO: 137791 - DNA, 25 bp, Homo sapien
gagcaggacgagcttgtctgagccc

SEQ ID NO: 137792 - DNA, 25 bp, Homo sapien
cactcaccaggccagcaaaggaaac

SEQ ID NO: 137793 - DNA, 25 bp, Homo sapien
ccagcaaaggaaacgcaatgcgtcc

SEQ ID NO: 137794 - DNA, 25 bp, Homo sapien
tgcgtcccgggcaaaccaataagcg

SEQ ID NO: 137795 - DNA, 25 bp, Homo sapien
ctgagaagagcaggacgagcttgtc

SEQ ID NO: 137796 - DNA, 25 bp, Homo sapien
cgccttgtacgtcaccagctggagt

SEQ ID NO: 137797 - DNA, 25 bp, Homo sapien
gccatgaagcccaagcctcgaaacg

SEQ ID NO: 137798 - DNA, 25 bp, Homo sapien
gggtctgcactctcgcggtagtaac

SEQ ID NO: 137799 - DNA, 25 bp, Homo sapien
gcctcaccttgatggcgttgatgta

SEQ ID NO: 137800 - DNA, 25 bp, Homo sapien
gatgacactctctgatcccgactgg

SEQ ID NO: 137801 - DNA, 25 bp, Homo sapien
atcccgactggaccttgggcttctt

SEQ ID NO: 137802 - DNA, 25 bp, Homo sapien
tcgaaacgataccttcagagaggcc

SEQ ID NO: 137803 - DNA, 25 bp, Homo sapien
gtcctgtggcaatgcactgcggtca

SEQ ID NO: 137804 - DNA, 25 bp, Homo sapien
cggtccagcgcgtccttataggaga

SEQ ID NO: 137805 - DNA, 25 bp, Homo sapien
ccgtctcctcagtggggtctgacca

SEQ ID NO: 137806 - DNA, 25 bp, Homo sapien
ccgtgatgttatccaccaggttccg

SEQ ID NO: 137807 - DNA, 25 bp, Homo sapien
tccaccaggcccttgttgacggcgt

SEQ ID NO: 137808 - DNA, 25 bp, Homo sapien
gtccaccatgatcttgtccaccagg

SEQ ID NO: 137809 - DNA, 25 bp, Homo sapien
tcctcgaagccgcagaaggccttct

SEQ ID NO: 137810 - DNA, 25 bp, Homo sapien
cctcgtagtagagccagcccttctt

SEQ ID NO: 137811 - DNA, 25 bp, Homo sapien
ggtactgcacctccaggaagcgctg

SEQ ID NO: 137812 - DNA, 25 bp, Homo sapien
tcccgctgtagcaggctgtcctttt

SEQ ID NO: 137813 - DNA, 25 bp, Homo sapien
gcagtgacctcctctgagtgcgcca

SEQ ID NO: 137814 - DNA, 25 bp, Homo sapien
gccatcaagtgcatcccggccattg

SEQ ID NO: 137815 - DNA, 25 bp, Homo sapien
ggccttcagcaacagccctgcgata

SEQ ID NO: 137816 - DNA, 25 bp, Homo sapien
agcttctcattggtggccttcagca

SEQ ID NO: 137817 - DNA, 25 bp, Homo sapien
ggcggcgtaaacactcagcttctca

SEQ ID NO: 137818 - DNA, 25 bp, Homo sapien
ttcacagcctcgttgacggtcagcc

SEQ ID NO: 137819 - DNA, 25 bp, Homo sapien
gggcggtacctcctcagacttgagc

SEQ ID NO: 137820 - DNA, 25 bp, Homo sapien
cagcgagactcttcctgtgcacctg

SEQ ID NO: 137821 - DNA, 25 bp, Homo sapien
cagctgcagccggatgtctttgagc

SEQ ID NO: 137822 - DNA, 25 bp, Homo sapien
gctgcaggagccgtactcgcgctca

SEQ ID NO: 137823 - DNA, 25 bp, Homo sapien
aggaaggcctggtagtgcagctcca

SEQ ID NO: 137824 - DNA, 25 bp, Homo sapien
tctttgagctcggagatgcagcgct

SEQ ID NO: 137825 - DNA, 25 bp, Homo sapien
tgcagcgctggcagcgagactcttc

SEQ ID NO: 137826 - DNA, 25 bp, Homo sapien
tgccggctctttgtccagcggcagc

SEQ ID NO: 137827 - DNA, 25 bp, Homo sapien
cctggggaacacatgtgggtcactc

SEQ ID NO: 137828 - DNA, 25 bp, Homo sapien
cctcaatctcctcgaagctggaggg

SEQ ID NO: 137829 - DNA, 25 bp, Homo sapien
ggctgagggacatccacgtctgcag

SEQ ID NO: 137830 - DNA, 25 bp, Homo sapien
aggccacgcagacgtaccctcaggg

SEQ ID NO: 137831 - DNA, 25 bp, Homo sapien
gatgatggacttctcgtcgggctga

SEQ ID NO: 137832 - DNA, 25 bp, Homo sapien
tggcgtcatacagcgacgagacgta

SEQ ID NO: 137833 - DNA, 25 bp, Homo sapien
tggtgtcgcatccactgaagcagca

SEQ ID NO: 137834 - DNA, 25 bp, Homo sapien
aacctgcgttcctcaaaggcggccg

SEQ ID NO: 137835 - DNA, 25 bp, Homo sapien
cgagacgtaggtgatgatggacttc

SEQ ID NO: 137836 - DNA, 25 bp, Homo sapien
gcgaggcccagacccaaagaacctg

SEQ ID NO: 137837 - DNA, 25 bp, Homo sapien
ggagccctggttcggcccacggaca

SEQ ID NO: 137838 - DNA, 25 bp, Homo sapien
caagacctccctcggcgaggcaaag

SEQ ID NO: 137839 - DNA, 25 bp, Homo sapien
agcacggccgctccagcaagacctc

SEQ ID NO: 137840 - DNA, 25 bp, Homo sapien
tgcacccacctacgcagcacagctg

SEQ ID NO: 137841 - DNA, 25 bp, Homo sapien
ccttctgtgccaccggccacgccac

SEQ ID NO: 137842 - DNA, 25 bp, Homo sapien
cccactaggtgagagcgatggtggc

SEQ ID NO: 137843 - DNA, 25 bp, Homo sapien
actgcgggagcgaggcccagaccca

SEQ ID NO: 137844 - DNA, 25 bp, Homo sapien
ctggcagccaccagcggggcttacc

SEQ ID NO: 137845 - DNA, 25 bp, Homo sapien
acacagcggccagggtgacaacgtg

SEQ ID NO: 137846 - DNA, 25 bp, Homo sapien
ggccagggtgacaacgtgacccaca

SEQ ID NO: 137847 - DNA, 25 bp, Homo sapien
acgtgacccacaaccaccagggagg

SEQ ID NO: 137848 - DNA, 25 bp, Homo sapien
gggcttaccttgctcgtcctgcgcc

SEQ ID NO: 137849 - DNA, 25 bp, Homo sapien
gagggctccatagccgccacgcgga

SEQ ID NO: 137850 - DNA, 25 bp, Homo sapien
aacaggctgcccgagggctccatag

SEQ ID NO: 137851 - DNA, 25 bp, Homo sapien
tgacccacaaccaccagggagggaa

SEQ ID NO: 137852 - DNA, 25 bp, Homo sapien
acttggaacatgacgcacggcgcca

SEQ ID NO: 137853 - DNA, 25 bp, Homo sapien
gggcccaggggatataaatatccga

SEQ ID NO: 137854 - DNA, 25 bp, Homo sapien
tataaatatccgaggagggcgcgca

SEQ ID NO: 137855 - DNA, 25 bp, Homo sapien
ctaatataatagagcagggcgcggg

SEQ ID NO: 137856 - DNA, 25 bp, Homo sapien
accacccagacttggaacatgacgc

SEQ ID NO: 137857 - DNA, 25 bp, Homo sapien
tctggctggacggtgccacccgaca

SEQ ID NO: 137858 - DNA, 25 bp, Homo sapien
ccagctcccacagggggttctaata

SEQ ID NO: 137859 - DNA, 25 bp, Homo sapien
gagggcgcgcaaggaccgtcaccac

SEQ ID NO: 137860 - DNA, 25 bp, Homo sapien
tctgagtcacaggacgaagattcca

SEQ ID NO: 137861 - DNA, 25 bp, Homo sapien
cgcgtctcttttgaagtctgagtca

SEQ ID NO: 137862 - DNA, 25 bp, Homo sapien
caggacgaagattccatttaacgcc

SEQ ID NO: 137863 - DNA, 25 bp, Homo sapien
cccgataaagcaaaaccactgagaa

SEQ ID NO: 137864 - DNA, 25 bp, Homo sapien
ctgagaaaacaaacgagaggctgcc

SEQ ID NO: 137865 - DNA, 25 bp, Homo sapien
ggctgcccaggcatgaaaacgccca

SEQ ID NO: 137866 - DNA, 25 bp, Homo sapien
acccaggaggtcacgcgtctctttt

SEQ ID NO: 137867 - DNA, 25 bp, Homo sapien
cccaggcagcttaacccaggaggtc

SEQ ID NO: 137868 - DNA, 25 bp, Homo sapien
gcaccaggcaaaggtctcgcggacc

SEQ ID NO: 137869 - DNA, 25 bp, Homo sapien
ggtaccagtaaaagtggcaccaggc

SEQ ID NO: 137870 - DNA, 25 bp, Homo sapien
catggcacgcatgacctgcaggttg

SEQ ID NO: 137871 - DNA, 25 bp, Homo sapien
ctcgcggaagagcacctcatagatg

SEQ ID NO: 137872 - DNA, 25 bp, Homo sapien
cacctcatagatggcccgcagctgg

SEQ ID NO: 137873 - DNA, 25 bp, Homo sapien
tggcatgagcatgccggccaccatg

SEQ ID NO: 137874 - DNA, 25 bp, Homo sapien
aagctcccgcgctacagggtgtgac

SEQ ID NO: 137875 - DNA, 25 bp, Homo sapien
cgatgccttcattggtgaggtacca

SEQ ID NO: 137876 - DNA, 25 bp, Homo sapien
cggggtagtgcacccgcatttcctc

SEQ ID NO: 137877 - DNA, 25 bp, Homo sapien
cgcggggtagtgcacccgcatttcc

SEQ ID NO: 137878 - DNA, 25 bp, Homo sapien
gtagtgcacccgcatttcctcgttt

SEQ ID NO: 137879 - DNA, 25 bp, Homo sapien
ccgcggggtagtgcacccgcatttc

SEQ ID NO: 137880 - DNA, 25 bp, Homo sapien
tcctagttgccttgagaggtgccgc

SEQ ID NO: 137881 - DNA, 25 bp, Homo sapien
cggggtagtgcacccgcatttccta

SEQ ID NO: 137882 - DNA, 25 bp, Homo sapien
gcggggtagtgcacccgcatttcct

SEQ ID NO: 137883 - DNA, 25 bp, Homo sapien
tttcctagttgccttgagaggtgcc

SEQ ID NO: 137884 - DNA, 25 bp, Homo sapien
acacacgtgcgagggccttgaagcc

SEQ ID NO: 137885 - DNA, 25 bp, Homo sapien
gccatgcttagaacagcctgtggga

SEQ ID NO: 137886 - DNA, 25 bp, Homo sapien
ctcgcgaggggtccatgtctgcgcc

SEQ ID NO: 137887 - DNA, 25 bp, Homo sapien
ctgagggcggctgtgccaccaccag

SEQ ID NO: 137888 - DNA, 25 bp, Homo sapien
cggggcttcagctgatcaatgcgcc

SEQ ID NO: 137889 - DNA, 25 bp, Homo sapien
tcagctgatcaatgcgccggacagg

SEQ ID NO: 137890 - DNA, 25 bp, Homo sapien
tgccaggtcaccaggccggatccag

SEQ ID NO: 137891 - DNA, 25 bp, Homo sapien
agtccactgcaacgagccatgctta

SEQ ID NO: 137892 - DNA, 25 bp, Homo sapien
aggcgctcccggtacagctcatact

SEQ ID NO: 137893 - DNA, 25 bp, Homo sapien
aacagaggtcgcagtcagagttccc

SEQ ID NO: 137894 - DNA, 25 bp, Homo sapien
cgcctgggttcacgttcacgtttat

SEQ ID NO: 137895 - DNA, 25 bp, Homo sapien
tattcaaacaacagagccgactcgg

SEQ ID NO: 137896 - DNA, 25 bp, Homo sapien
agatgcagtccacggcgctgtcgta

SEQ ID NO: 137897 - DNA, 25 bp, Homo sapien
acgaacaccgccttatggccatcgg

SEQ ID NO: 137898 - DNA, 25 bp, Homo sapien
aggcctcaccgttgcggccgcagaa

SEQ ID NO: 137899 - DNA, 25 bp, Homo sapien
tggcgaaatacacgcccttcccgta

SEQ ID NO: 137900 - DNA, 25 bp, Homo sapien
caatgtcggccaccctgtctgggat

SEQ ID NO: 137901 - DNA, 25 bp, Homo sapien
cgaggactggaatagcccattcaca

SEQ ID NO: 137902 - DNA, 25 bp, Homo sapien
cctcgtaggcctggatgaagtcctg

SEQ ID NO: 137903 - DNA, 25 bp, Homo sapien
gccgtacctttgtacttctcgcgca

SEQ ID NO: 137904 - DNA, 25 bp, Homo sapien
ccgagccgcgcgatgccctattaag

SEQ ID NO: 137905 - DNA, 25 bp, Homo sapien
ttgcaacattggagacgactgagtc

SEQ ID NO: 137906 - DNA, 25 bp, Homo sapien
tcctgcgtgcagctgagaactttcc

SEQ ID NO: 137907 - DNA, 25 bp, Homo sapien
cgccaccgtggacgacaaggtgctc

SEQ ID NO: 137908 - DNA, 25 bp, Homo sapien
cagttacctgcgatgcgaatgaccg

SEQ ID NO: 137909 - DNA, 25 bp, Homo sapien
ctcaccgggtcatcagggaaggaca

SEQ ID NO: 137910 - DNA, 25 bp, Homo sapien
tccgctgcgttttcccaaggttcca

SEQ ID NO: 137911 - DNA, 25 bp, Homo sapien
ggggtgactaccttcactcagatgc

SEQ ID NO: 137912 - DNA, 25 bp, Homo sapien
tgcactctgctgtacccacatattg

SEQ ID NO: 137913 - DNA, 25 bp, Homo sapien
ctgcctgttcaggagtggactctgc

SEQ ID NO: 137914 - DNA, 25 bp, Homo sapien
cgagccactgcttccattggagaca

SEQ ID NO: 137915 - DNA, 25 bp, Homo sapien
gaggggtcacatctctgcctgttca

SEQ ID NO: 137916 - DNA, 25 bp, Homo sapien
caggcctccggttgcttgtgagaaa

SEQ ID NO: 137917 - DNA, 25 bp, Homo sapien
cggttgcttgtgagaaacgacccaa

SEQ ID NO: 137918 - DNA, 25 bp, Homo sapien
ctgggatagaaatagccgccggctc

SEQ ID NO: 137919 - DNA, 25 bp, Homo sapien
ttggtcacagatggcccggggattt

SEQ ID NO: 137920 - DNA, 25 bp, Homo sapien
gctcgggcctttgttggtcacagat

SEQ ID NO: 137921 - DNA, 25 bp, Homo sapien
cggatcttgcgcatccgagcgtggc

SEQ ID NO: 137922 - DNA, 25 bp, Homo sapien
agcggacaccgtgcgtaccggcctg

SEQ ID NO: 137923 - DNA, 25 bp, Homo sapien
cttaaagctgcttaaggggcgggat

SEQ ID NO: 137924 - DNA, 25 bp, Homo sapien
gcatgctcgccgacgcgctgctgct

SEQ ID NO: 137925 - DNA, 25 bp, Homo sapien
gcctcagccagctggcgcacgatga

SEQ ID NO: 137926 - DNA, 25 bp, Homo sapien
gctggtgaacgcttatggcatcctg

SEQ ID NO: 137927 - DNA, 25 bp, Homo sapien
cttatggcatcctgcgagagcgccc

SEQ ID NO: 137928 - DNA, 25 bp, Homo sapien
ccgtggacttcctgcagcgtgtggt

SEQ ID NO: 137929 - DNA, 25 bp, Homo sapien
atggcatcctgcgagagcgcccgga

SEQ ID NO: 137930 - DNA, 25 bp, Homo sapien
aacgcttatggcatcctgcgagagc

SEQ ID NO: 137931 - DNA, 25 bp, Homo sapien
acaccgtggacttcctgcagcgtgt

SEQ ID NO: 137932 - DNA, 25 bp, Homo sapien
aaccgtcgtccatgtggtcttccga

SEQ ID NO: 137933 - DNA, 25 bp, Homo sapien
gccaccgtctcgtagtagcccatgt

SEQ ID NO: 137934 - DNA, 25 bp, Homo sapien
ccagggtcacgttgttcatgcagcc

SEQ ID NO: 137935 - DNA, 25 bp, Homo sapien
cccgcggtgcgttgagattaccaaa

SEQ ID NO: 137936 - DNA, 25 bp, Homo sapien
ggcccagtgccgctgaagtcaaaca

SEQ ID NO: 137937 - DNA, 25 bp, Homo sapien
tgaagtcaaacacggcgctgccctg

SEQ ID NO: 137938 - DNA, 25 bp, Homo sapien
tgactcaggctgatctgcacacgga

SEQ ID NO: 137939 - DNA, 25 bp, Homo sapien
ggaggttccaaaggcacgcaacatg

SEQ ID NO: 137940 - DNA, 25 bp, Homo sapien
aagctccatggggtagggccacaag

SEQ ID NO: 137941 - DNA, 25 bp, Homo sapien
ccctcctcaggtgtcaggtctttga

SEQ ID NO: 137942 - DNA, 25 bp, Homo sapien
ggcctattccatgctgacctgcgtg

SEQ ID NO: 137943 - DNA, 25 bp, Homo sapien
ggatttgagatcaggtccctttcgg

SEQ ID NO: 137944 - DNA, 25 bp, Homo sapien
tcaccggctttgcacacaggctgtg

SEQ ID NO: 137945 - DNA, 25 bp, Homo sapien
ggatgcaccgacgagtcagcttgtc

SEQ ID NO: 137946 - DNA, 25 bp, Homo sapien
ggccgaagagctaggtgtaccatgc

SEQ ID NO: 137947 - DNA, 25 bp, Homo sapien
ggtctttgaactcaggcgcccgaca

SEQ ID NO: 137948 - DNA, 25 bp, Homo sapien
ggagcacgagctcttccgctgtttc

SEQ ID NO: 137949 - DNA, 25 bp, Homo sapien
cttcgataactgctggaaaggtcca

SEQ ID NO: 137950 - DNA, 25 bp, Homo sapien
gtcctcctaaggcaagcacagatga

SEQ ID NO: 137951 - DNA, 25 bp, Homo sapien
ggcactgggacgaccctcaacctga

SEQ ID NO: 137952 - DNA, 25 bp, Homo sapien
tcggcgcctggactacatcacgtac

SEQ ID NO: 137953 - DNA, 25 bp, Homo sapien
ttgcgacctggatgtaggcactgcc

SEQ ID NO: 137954 - DNA, 25 bp, Homo sapien
gggcccttgcgcagcaaacagctga

SEQ ID NO: 137955 - DNA, 25 bp, Homo sapien
tgctcctgggcgacctaaacttcga

SEQ ID NO: 137956 - DNA, 25 bp, Homo sapien
ctcaggtatgacaaagccaaactcc

SEQ ID NO: 137957 - DNA, 25 bp, Homo sapien
ggaagccacgtaccgctccacaaag

SEQ ID NO: 137958 - DNA, 25 bp, Homo sapien
atccggagtcaggaagccacgtacc

SEQ ID NO: 137959 - DNA, 25 bp, Homo sapien
tgacaaagccaaactccctcatgta

SEQ ID NO: 137960 - DNA, 25 bp, Homo sapien
ccaccggccgctcaggtatgacaaa

SEQ ID NO: 137961 - DNA, 25 bp, Homo sapien
atcctcgaggcgaagaccactgcgg

SEQ ID NO: 137962 - DNA, 25 bp, Homo sapien
gggcatcctcgaggcgaagaccact

SEQ ID NO: 137963 - DNA, 25 bp, Homo sapien
ccagggatccggagtcaggaagcca

SEQ ID NO: 137964 - DNA, 25 bp, Homo sapien
agaagccctgcacgtagcgctggat

SEQ ID NO: 137965 - DNA, 25 bp, Homo sapien
ccgaggacagtgacacgtgcgtgaa

SEQ ID NO: 137966 - DNA, 25 bp, Homo sapien
agcgcatgaacaacacctgcacatc

SEQ ID NO: 137967 - DNA, 25 bp, Homo sapien
agagcacagcactggagccgctgaa

SEQ ID NO: 137968 - DNA, 25 bp, Homo sapien
gccgccatcggagcgcatgaacaac

SEQ ID NO: 137969 - DNA, 25 bp, Homo sapien
gacgatgcgcaccatgggcatggcc

SEQ ID NO: 137970 - DNA, 25 bp, Homo sapien
caccatgggcatggcctccgaggac

SEQ ID NO: 137971 - DNA, 25 bp, Homo sapien
ggggtgcctcacagcctcaccttga

SEQ ID NO: 137972 - DNA, 25 bp, Homo sapien
acccacgggcacgactctgggaaga

SEQ ID NO: 137973 - DNA, 25 bp, Homo sapien
tcacctgcgagtgggactagaggct

SEQ ID NO: 137974 - DNA, 25 bp, Homo sapien
gagtcccacaggagctcttcagctg

SEQ ID NO: 137975 - DNA, 25 bp, Homo sapien
cgatggcaaagtggaagcggccctc

SEQ ID NO: 137976 - DNA, 25 bp, Homo sapien
agagcagttttaagacccgcacgtg

SEQ ID NO: 137977 - DNA, 25 bp, Homo sapien
atgccttcggttggcgcgtccgcat

SEQ ID NO: 137978 - DNA, 25 bp, Homo sapien
tccctcagcacgaaagaggcacggg

SEQ ID NO: 137979 - DNA, 25 bp, Homo sapien
gtccgcatagttggcagggtcctct

SEQ ID NO: 137980 - DNA, 25 bp, Homo sapien
aggacacggtgtcgttgttgttgaa

SEQ ID NO: 137981 - DNA, 25 bp, Homo sapien
cctgcccactgcaggacatggtgtc

SEQ ID NO: 137982 - DNA, 25 bp, Homo sapien
aaccaggggccctggacgtctgtgc

SEQ ID NO: 137983 - DNA, 25 bp, Homo sapien
tgcttttgtgcctgaactccctgtg

SEQ ID NO: 137984 - DNA, 25 bp, Homo sapien
tgacgatgtagtcgctctccgagcc

SEQ ID NO: 137985 - DNA, 25 bp, Homo sapien
aagaccaggatgttgggcatgacga

SEQ ID NO: 137986 - DNA, 25 bp, Homo sapien
gggcagcctcaccaagaccaggatg

SEQ ID NO: 137987 - DNA, 25 bp, Homo sapien
cgctgcatgggacgtttcccttcta

SEQ ID NO: 137988 - DNA, 25 bp, Homo sapien
cgtgactgggcaattcctccttcgg

SEQ ID NO: 137989 - DNA, 25 bp, Homo sapien
tcagcaccgcatctcactcggagta

SEQ ID NO: 137990 - DNA, 25 bp, Homo sapien
ctcggcctacattgagcagggcaac

SEQ ID NO: 137991 - DNA, 25 bp, Homo sapien
agctcttgtcggaccagggctaccg

SEQ ID NO: 137992 - DNA, 25 bp, Homo sapien
ttctcccgcggctcagagaagtagg

SEQ ID NO: 137993 - DNA, 25 bp, Homo sapien
tgaactccagttcaccaggacagga

SEQ ID NO: 137994 - DNA, 25 bp, Homo sapien
ctgaatgcaggcaccactggtcacg

SEQ ID NO: 137995 - DNA, 25 bp, Homo sapien
tcggagtaaacgcaagtccttagtg

SEQ ID NO: 137996 - DNA, 25 bp, Homo sapien
ggtgcactgcgagtccgactctagt

SEQ ID NO: 137997 - DNA, 25 bp, Homo sapien
catctctgctgtcctccggctgtag

SEQ ID NO: 137998 - DNA, 25 bp, Homo sapien
catgtcggagaacgccatgggctcc

SEQ ID NO: 137999 - DNA, 25 bp, Homo sapien
cccagcgcacttacatgtcggagaa

SEQ ID NO: 138000 - DNA, 25 bp, Homo sapien
cgcctggttcttggcgctggttttc

SEQ ID NO: 138001 - DNA, 25 bp, Homo sapien
ctctcacagcgtgctgagctacgtg

SEQ ID NO: 138002 - DNA, 25 bp, Homo sapien
gtcccgatgcaggactccgggttta

SEQ ID NO: 138003 - DNA, 25 bp, Homo sapien
tagtgctgcgcctcaacgcgccgtt

SEQ ID NO: 138004 - DNA, 25 bp, Homo sapien
cggccacatcttgtggggaggactc

SEQ ID NO: 138005 - DNA, 25 bp, Homo sapien
gtccgtgcctgcaggtcttcttgcg

SEQ ID NO: 138006 - DNA, 25 bp, Homo sapien
tctcatcgcacagggtccgtgcctg

SEQ ID NO: 138007 - DNA, 25 bp, Homo sapien
aggaccaagtctctcatcgcacagg

SEQ ID NO: 138008 - DNA, 25 bp, Homo sapien
agaggggccgctccttcatcaggac

SEQ ID NO: 138009 - DNA, 25 bp, Homo sapien
tgaaggccgcgaaggacggcaccaa

SEQ ID NO: 138010 - DNA, 25 bp, Homo sapien
tctccgtcgcagatgcagaagctcg

SEQ ID NO: 138011 - DNA, 25 bp, Homo sapien
tgcagaagctcgtgaaggccgcgaa

SEQ ID NO: 138012 - DNA, 25 bp, Homo sapien
gctcttgcggctggctgtccaaact

SEQ ID NO: 138013 - DNA, 25 bp, Homo sapien
gctttcccgaatggcgcgcccagga

SEQ ID NO: 138014 - DNA, 25 bp, Homo sapien
tgccgaccttgagcgtgtgggatca

SEQ ID NO: 138015 - DNA, 25 bp, Homo sapien
ccgcatctccgtgaaggtcacggcg

SEQ ID NO: 138016 - DNA, 25 bp, Homo sapien
tcccgctacggacacctcaggtgag

SEQ ID NO: 138017 - DNA, 25 bp, Homo sapien
tcacggcaacagagagacgcgacgg

SEQ ID NO: 138018 - DNA, 25 bp, Homo sapien
agtttccacgacaacccgaagagcg

SEQ ID NO: 138019 - DNA, 25 bp, Homo sapien
cggctttcgcgaggttttgactctc

SEQ ID NO: 138020 - DNA, 25 bp, Homo sapien
tggctttgcccacaaatggacacgg

SEQ ID NO: 138021 - DNA, 25 bp, Homo sapien
cgtagatgcatccagcgtgcgacta

SEQ ID NO: 138022 - DNA, 25 bp, Homo sapien
gtgcgactatcccagcgcctaacgg

SEQ ID NO: 138023 - DNA, 25 bp, Homo sapien
gcctaacggcagctggacttcgctc

SEQ ID NO: 138024 - DNA, 25 bp, Homo sapien
gggacctccaatgggctgccacctt

SEQ ID NO: 138025 - DNA, 25 bp, Homo sapien
acgcccacacgtcgcactaggttgg

SEQ ID NO: 138026 - DNA, 25 bp, Homo sapien
tacggcacccgatggctattcgagc

SEQ ID NO: 138027 - DNA, 25 bp, Homo sapien
ctccgatcttgaagagcccgcgctg

SEQ ID NO: 138028 - DNA, 25 bp, Homo sapien
ctgcgctgactgcaacacaggctga

SEQ ID NO: 138029 - DNA, 25 bp, Homo sapien
gccgtgctcaccttcgatctgcatg

SEQ ID NO: 138030 - DNA, 25 bp, Homo sapien
ctgcatgcctggactctcgtagatg

SEQ ID NO: 138031 - DNA, 25 bp, Homo sapien
tgcgccgggatttgcacaaaacgtg

SEQ ID NO: 138032 - DNA, 25 bp, Homo sapien
gtagcaccatctcggacctggctta

SEQ ID NO: 138033 - DNA, 25 bp, Homo sapien
tgggccacacaggtgctctgagttc

SEQ ID NO: 138034 - DNA, 25 bp, Homo sapien
gtgctcccgaacacgaccctggtgt

SEQ ID NO: 138035 - DNA, 25 bp, Homo sapien
aatggtgacagcttcccgggacagc

SEQ ID NO: 138036 - DNA, 25 bp, Homo sapien
tctccgagacgctgaagagcttctg

SEQ ID NO: 138037 - DNA, 25 bp, Homo sapien
ggccaaggcctgcatcgggaataaa

SEQ ID NO: 138038 - DNA, 25 bp, Homo sapien
tgacacctacagctgaccggactgg

SEQ ID NO: 138039 - DNA, 25 bp, Homo sapien
tgcagcgctactttctgccagcgga

SEQ ID NO: 138040 - DNA, 25 bp, Homo sapien
atcgacgcgctcaacttcttctgtg

SEQ ID NO: 138041 - DNA, 25 bp, Homo sapien
agctccgtctcagagtgctctccga

SEQ ID NO: 138042 - DNA, 25 bp, Homo sapien
agaatttctttctgcaggatgccgc

SEQ ID NO: 138043 - DNA, 25 bp, Homo sapien
tgggccagctgaaccctcctctttg

SEQ ID NO: 138044 - DNA, 25 bp, Homo sapien
gaggaatattgtaccggacagcccg

SEQ ID NO: 138045 - DNA, 25 bp, Homo sapien
ggaggaatattctaccggacagccc

SEQ ID NO: 138046 - DNA, 25 bp, Homo sapien
gcccgcggtggaggaatattgtacc

SEQ ID NO: 138047 - DNA, 25 bp, Homo sapien
gtggaggaatattgtaccggacagc

SEQ ID NO: 138048 - DNA, 25 bp, Homo sapien
gaggaatattctaccggacagcccg

SEQ ID NO: 138049 - DNA, 25 bp, Homo sapien
aggaatattgtaccggacagcccgc

SEQ ID NO: 138050 - DNA, 25 bp, Homo sapien
gaatattctaccggacagcccgcgg

SEQ ID NO: 138051 - DNA, 25 bp, Homo sapien
ggaggaatattgtaccggacagccc

SEQ ID NO: 138052 - DNA, 25 bp, Homo sapien
ttctaccagcagctggtcgctggtc

SEQ ID NO: 138053 - DNA, 25 bp, Homo sapien
atattctactggacagcccgcactg

SEQ ID NO: 138054 - DNA, 25 bp, Homo sapien
ggacagcccgcactgcaggaatatt

SEQ ID NO: 138055 - DNA, 25 bp, Homo sapien
gcccgcactgcaggaatattctacc

SEQ ID NO: 138056 - DNA, 25 bp, Homo sapien
cactgcaggaatattctaccggaca

SEQ ID NO: 138057 - DNA, 25 bp, Homo sapien
cggccctcggtggaggaatattctc

SEQ ID NO: 138058 - DNA, 25 bp, Homo sapien
gggaatattctaccagcagctggtc

SEQ ID NO: 138059 - DNA, 25 bp, Homo sapien
cctcggcggggaatattctaccagc

SEQ ID NO: 138060 - DNA, 25 bp, Homo sapien
ccggcctgcacgagacattgctggc

SEQ ID NO: 138061 - DNA, 25 bp, Homo sapien
tcgggacatcacagcgctcagtctc

SEQ ID NO: 138062 - DNA, 25 bp, Homo sapien
ccagtgcgcagcctcggattggcca

SEQ ID NO: 138063 - DNA, 25 bp, Homo sapien
gtgacacctcccaacaggtgcgtgg

SEQ ID NO: 138064 - DNA, 25 bp, Homo sapien
ctaagcggaccgctggcaccggtcg

SEQ ID NO: 138065 - DNA, 25 bp, Homo sapien
tggcagcagagtgtcgctcgacatg

SEQ ID NO: 138066 - DNA, 25 bp, Homo sapien
gcgcgctcgtgaacttggccgccga

SEQ ID NO: 138067 - DNA, 25 bp, Homo sapien
ccgagactacatggacgcttccagc

SEQ ID NO: 138068 - DNA, 25 bp, Homo sapien
tgctgctttgcaaatgaaggtgggc

SEQ ID NO: 138069 - DNA, 25 bp, Homo sapien
agtctgcgcactgctgctttgcaaa

SEQ ID NO: 138070 - DNA, 25 bp, Homo sapien
gtcgtcagggctgtatgcgtccgac

SEQ ID NO: 138071 - DNA, 25 bp, Homo sapien
ccagctggcgcttccggggcagaca

SEQ ID NO: 138072 - DNA, 25 bp, Homo sapien
catcgctcttatcgcgtcccgagtt

SEQ ID NO: 138073 - DNA, 25 bp, Homo sapien
caggagtggacatcctgcccgcgct

SEQ ID NO: 138074 - DNA, 25 bp, Homo sapien
ctccggccaggagtggacatcctgc

SEQ ID NO: 138075 - DNA, 25 bp, Homo sapien
cccgaccaataagtgcagagatcgc

SEQ ID NO: 138076 - DNA, 25 bp, Homo sapien
caactccgggttggtcactcggcag

SEQ ID NO: 138077 - DNA, 25 bp, Homo sapien
gcattgcacattctgctccagccgg

SEQ ID NO: 138078 - DNA, 25 bp, Homo sapien
atgcctcgatgctgacggcggatct

SEQ ID NO: 138079 - DNA, 25 bp, Homo sapien
cgctcctgatgcctcgatgctgacg

SEQ ID NO: 138080 - DNA, 25 bp, Homo sapien
cactggagatcactgcagagcgctc

SEQ ID NO: 138081 - DNA, 25 bp, Homo sapien
tggcaaaattgctggctgcactgga

SEQ ID NO: 138082 - DNA, 25 bp, Homo sapien
aaaccgttgccactcgacggtggca

SEQ ID NO: 138083 - DNA, 25 bp, Homo sapien
ccactcgacggtggcaaaattgctg

SEQ ID NO: 138084 - DNA, 25 bp, Homo sapien
tccgcatcctcaccaatatttgaga

SEQ ID NO: 138085 - DNA, 25 bp, Homo sapien
tccatttctttgatacccagaagtg

SEQ ID NO: 138086 - DNA, 25 bp, Homo sapien
ctacattcccaacggcacacatggg

SEQ ID NO: 138087 - DNA, 25 bp, Homo sapien
gttttctcaagtgaccatcctaatg

SEQ ID NO: 138088 - DNA, 25 bp, Homo sapien
cctaatgggtatgagtgtgtctcac

SEQ ID NO: 138089 - DNA, 25 bp, Homo sapien
agtgtgtctcactgattctcatttc

SEQ ID NO: 138090 - DNA, 25 bp, Homo sapien
atttccctaacgatgagcgagtgtc

SEQ ID NO: 138091 - DNA, 25 bp, Homo sapien
ttgatacccagaagtggggttgccc

SEQ ID NO: 138092 - DNA, 25 bp, Homo sapien
cttctgctccggtaagaggcggcct

SEQ ID NO: 138093 - DNA, 25 bp, Homo sapien
gccgtgctgcacaccctcgccagcc

SEQ ID NO: 138094 - DNA, 25 bp, Homo sapien
aagccttggcggaggcctttgacgg

SEQ ID NO: 138095 - DNA, 25 bp, Homo sapien
ctctcggtggccaacggtaggtgac

SEQ ID NO: 138096 - DNA, 25 bp, Homo sapien
ccttcctgccatccgtcctgagctc

SEQ ID NO: 138097 - DNA, 25 bp, Homo sapien
tggccttctgctccggtaagaggcg

SEQ ID NO: 138098 - DNA, 25 bp, Homo sapien
ccagcctctcggtggccaacggtag

SEQ ID NO: 138099 - DNA, 25 bp, Homo sapien
ctctctcacagcgttcggcgtagtc

SEQ ID NO: 138100 - DNA, 25 bp, Homo sapien
agcgtcagctctctgtggaggggtt

SEQ ID NO: 138101 - DNA, 25 bp, Homo sapien
ctggagaggagcgtcagctctctgt

SEQ ID NO: 138102 - DNA, 25 bp, Homo sapien
gcgctcgctctgtgtggagtactct

SEQ ID NO: 138103 - DNA, 25 bp, Homo sapien
ctctgtgtggagtactctgtagagg

SEQ ID NO: 138104 - DNA, 25 bp, Homo sapien
gtcctggagaggagcgtcagctctc

SEQ ID NO: 138105 - DNA, 25 bp, Homo sapien
ctcgctctgtgtggagtactctgta

SEQ ID NO: 138106 - DNA, 25 bp, Homo sapien
gttgggagaggagcacccgctgtct

SEQ ID NO: 138107 - DNA, 25 bp, Homo sapien
agcgcccaatgtctgtggaggggca

SEQ ID NO: 138108 - DNA, 25 bp, Homo sapien
caccaccgtggacaggatgagtcac

SEQ ID NO: 138109 - DNA, 25 bp, Homo sapien
ggcaggctgtgtcctcaggcccaga

SEQ ID NO: 138110 - DNA, 25 bp, Homo sapien
gtcagcaccaccgtggacaggatga

SEQ ID NO: 138111 - DNA, 25 bp, Homo sapien
gtgcgcaccctctacctggtcagca

SEQ ID NO: 138112 - DNA, 25 bp, Homo sapien
tgcgggccatcagcgtgcgcaccct

SEQ ID NO: 138113 - DNA, 25 bp, Homo sapien
gcccacgcacgcctttgccttttgc

SEQ ID NO: 138114 - DNA, 25 bp, Homo sapien
gccatggccgcccacgcacgccttt

SEQ ID NO: 138115 - DNA, 25 bp, Homo sapien
acaggatgagtcacgtgagtgcacg

SEQ ID NO: 138116 - DNA, 25 bp, Homo sapien
acagtcagatgtggagcccgctcaa

SEQ ID NO: 138117 - DNA, 25 bp, Homo sapien
gcccgctcaagacccacagtgatgg

SEQ ID NO: 138118 - DNA, 25 bp, Homo sapien
acccacagtgatgggacttggggcc

SEQ ID NO: 138119 - DNA, 25 bp, Homo sapien
cctgactgtgtcacctccctgggga

SEQ ID NO: 138120 - DNA, 25 bp, Homo sapien
gtgcccagcctgaggacacagtcct

SEQ ID NO: 138121 - DNA, 25 bp, Homo sapien
ctgtccctgatggaatctcaactga

SEQ ID NO: 138122 - DNA, 25 bp, Homo sapien
tcaactgaaataagaggcgatgcca

SEQ ID NO: 138123 - DNA, 25 bp, Homo sapien
gagaagggatctcccatccactgaa

SEQ ID NO: 138124 - DNA, 25 bp, Homo sapien
gagcgagaccgcaccaacagcgtga

SEQ ID NO: 138125 - DNA, 25 bp, Homo sapien
agagacggaacgatgcccccaaaga

SEQ ID NO: 138126 - DNA, 25 bp, Homo sapien
ccaaagcgtggccacagaaggccga

SEQ ID NO: 138127 - DNA, 25 bp, Homo sapien
cgccgctataaaggcgcagctcggg

SEQ ID NO: 138128 - DNA, 25 bp, Homo sapien
agcagcgcgcgacagagctgacgcc

SEQ ID NO: 138129 - DNA, 25 bp, Homo sapien
agctcgggctccgacgagaaaccct

SEQ ID NO: 138130 - DNA, 25 bp, Homo sapien
cgggacgccgctataaaggcgcagc

SEQ ID NO: 138131 - DNA, 25 bp, Homo sapien
cgagaaaccctgtcgcgtgcacgcg

SEQ ID NO: 138132 - DNA, 25 bp, Homo sapien
ggcagcccacccgaatccactcgta

SEQ ID NO: 138133 - DNA, 25 bp, Homo sapien
ctgagctgcaccggtagcagcggcc

SEQ ID NO: 138134 - DNA, 25 bp, Homo sapien
tgcaccggtagcagcggccgagggc

SEQ ID NO: 138135 - DNA, 25 bp, Homo sapien
cccggcccgccagccagcaagaggg

SEQ ID NO: 138136 - DNA, 25 bp, Homo sapien
ccgtcaccctccactgctccagaaa

SEQ ID NO: 138137 - DNA, 25 bp, Homo sapien
cccacccgaatccactcgtagctca

SEQ ID NO: 138138 - DNA, 25 bp, Homo sapien
tcgtagctcacagccgccgggcaga

SEQ ID NO: 138139 - DNA, 25 bp, Homo sapien
aggaacactccgtcaccctccactg

SEQ ID NO: 138140 - DNA, 25 bp, Homo sapien
gcaggtggccagtggttttatgccc

SEQ ID NO: 138141 - DNA, 25 bp, Homo sapien
tgtccacactcctgatccgtcgtgg

SEQ ID NO: 138142 - DNA, 25 bp, Homo sapien
cccaccttaaggacctgctgcttga

SEQ ID NO: 138143 - DNA, 25 bp, Homo sapien
ggcaccatcacgatcatgacagcgc

SEQ ID NO: 138144 - DNA, 25 bp, Homo sapien
ctttggcggagcagcccatgtctgc

SEQ ID NO: 138145 - DNA, 25 bp, Homo sapien
gcctcgtggccgctgagccaaaacg

SEQ ID NO: 138146 - DNA, 25 bp, Homo sapien
ggcggcaccacggaagcaacctgtc

SEQ ID NO: 138147 - DNA, 25 bp, Homo sapien
tgcttgatgagcgacggcaccatca

SEQ ID NO: 138148 - DNA, 25 bp, Homo sapien
ccctctccgattacaatgcgggtag

SEQ ID NO: 138149 - DNA, 25 bp, Homo sapien
ccgcctcctcccgtgtctgtctgcg

SEQ ID NO: 138150 - DNA, 25 bp, Homo sapien
gccggcccacctctggaatccttca

SEQ ID NO: 138151 - DNA, 25 bp, Homo sapien
acaatgcgggtagtgttcagcgttc

SEQ ID NO: 138152 - DNA, 25 bp, Homo sapien
gtagtgttcagcgttcgcgccgctc

SEQ ID NO: 138153 - DNA, 25 bp, Homo sapien
ccctgcacaaaacgcccgcctgtct

SEQ ID NO: 138154 - DNA, 25 bp, Homo sapien
gccacacggccttcctgtgcgacgt

SEQ ID NO: 138155 - DNA, 25 bp, Homo sapien
gcccgcctgtctcggagcgccacac

SEQ ID NO: 138156 - DNA, 25 bp, Homo sapien
gacaggatgtggctgccgacagcca

SEQ ID NO: 138157 - DNA, 25 bp, Homo sapien
tcatcatcgatttctcaaaatacca

SEQ ID NO: 138158 - DNA, 25 bp, Homo sapien
ttgttttgtctctgttctctgaacg

SEQ ID NO: 138159 - DNA, 25 bp, Homo sapien
tccgcgctccgtttacaatcatcat

SEQ ID NO: 138160 - DNA, 25 bp, Homo sapien
cccgctctgagtgagcccgctgctc

SEQ ID NO: 138161 - DNA, 25 bp, Homo sapien
aagtagccgacaggatgtggctgcc

SEQ ID NO: 138162 - DNA, 25 bp, Homo sapien
gcgctccgtttacaatcatcatcga

SEQ ID NO: 138163 - DNA, 25 bp, Homo sapien
ctgctccggccaggaaaccaattta

SEQ ID NO: 138164 - DNA, 25 bp, Homo sapien
ggtctccagcaccacccgcagtgtg

SEQ ID NO: 138165 - DNA, 25 bp, Homo sapien
tgcctggagtcagcccggattctcc

SEQ ID NO: 138166 - DNA, 25 bp, Homo sapien
cccatgcctggagtcagcccggatt

SEQ ID NO: 138167 - DNA, 25 bp, Homo sapien
gacaacggaacatgagcccacgcca

SEQ ID NO: 138168 - DNA, 25 bp, Homo sapien
cgcaaggacgaggtgccagcaggat

SEQ ID NO: 138169 - DNA, 25 bp, Homo sapien
cccgatggagcacgagagttgcgtg

SEQ ID NO: 138170 - DNA, 25 bp, Homo sapien
cgacacagacaacggaacatgagcc

SEQ ID NO: 138171 - DNA, 25 bp, Homo sapien
gccacgctccggactcctggggaca

SEQ ID NO: 138172 - DNA, 25 bp, Homo sapien
cagctaaagcacaggacacgcgggc

SEQ ID NO: 138173 - DNA, 25 bp, Homo sapien
tcggcccctcagctaaagcacagga

SEQ ID NO: 138174 - DNA, 25 bp, Homo sapien
agctaaagcacaggacacgcgggca

SEQ ID NO: 138175 - DNA, 25 bp, Homo sapien
ctcagctaaagcacaggacacgcgg

SEQ ID NO: 138176 - DNA, 25 bp, Homo sapien
tcagctaaagcacaggacacgcggg

SEQ ID NO: 138177 - DNA, 25 bp, Homo sapien
cctcagctaaagcacaggacacgcg

SEQ ID NO: 138178 - DNA, 25 bp, Homo sapien
taaagcacaggacacgcgggcaggt

SEQ ID NO: 138179 - DNA, 25 bp, Homo sapien
aagcacaggacacgcgggcagatgc

SEQ ID NO: 138180 - DNA, 25 bp, Homo sapien
caccttagcgcttcccagtgcagga

SEQ ID NO: 138181 - DNA, 25 bp, Homo sapien
tacggagcatggtcagcccacttta

SEQ ID NO: 138182 - DNA, 25 bp, Homo sapien
cactttagcgcttcccggtgcaggg

SEQ ID NO: 138183 - DNA, 25 bp, Homo sapien
gtgcaggacactgttcacaacatgc

SEQ ID NO: 138184 - DNA, 25 bp, Homo sapien
cctgttcacaacatgctgccaggta

SEQ ID NO: 138185 - DNA, 25 bp, Homo sapien
tcgggatctggattgccttcacctc

SEQ ID NO: 138186 - DNA, 25 bp, Homo sapien
acggaaactctcaagcacctgcagg

SEQ ID NO: 138187 - DNA, 25 bp, Homo sapien
ggagcgctgtcagcccaccttagcg

SEQ ID NO: 138188 - DNA, 25 bp, Homo sapien
tccctccttgctcgagatggatctg

SEQ ID NO: 138189 - DNA, 25 bp, Homo sapien
ggcgtctcttgtattgggcttctgc

SEQ ID NO: 138190 - DNA, 25 bp, Homo sapien
gcggctacgagacccacactcggtt

SEQ ID NO: 138191 - DNA, 25 bp, Homo sapien
tgctcagacccagagccttaagttg

SEQ ID NO: 138192 - DNA, 25 bp, Homo sapien
cacttcagcttacgcgcggtgagcc

SEQ ID NO: 138193 - DNA, 25 bp, Homo sapien
ctgaccaagctgtggaccctcgtga

SEQ ID NO: 138194 - DNA, 25 bp, Homo sapien
ctcaggctccagttcgggctcagac

SEQ ID NO: 138195 - DNA, 25 bp, Homo sapien
gacaccgacgcgctcatctgctgga

SEQ ID NO: 138196 - DNA, 25 bp, Homo sapien
cgctaactaatggacggccgcctct

SEQ ID NO: 138197 - DNA, 25 bp, Homo sapien
gcgttgctccggagccgctaactaa

SEQ ID NO: 138198 - DNA, 25 bp, Homo sapien
gccgcctctctcgtccatttgtagt

SEQ ID NO: 138199 - DNA, 25 bp, Homo sapien
ctcgtcccacttgtgtacacacggg

SEQ ID NO: 138200 - DNA, 25 bp, Homo sapien
cggcgagtcactccgggcaatcatt

SEQ ID NO: 138201 - DNA, 25 bp, Homo sapien
cacccagcgcgttggtttctgcgca

SEQ ID NO: 138202 - DNA, 25 bp, Homo sapien
tgcgcacgcagcttacagtaacgtc

SEQ ID NO: 138203 - DNA, 25 bp, Homo sapien
caggaacctgcttttcttcgcctta

SEQ ID NO: 138204 - DNA, 25 bp, Homo sapien
catgacgtcaggctcagcggccaat

SEQ ID NO: 138205 - DNA, 25 bp, Homo sapien
tgcgatactggagcgcgctcgttgc

SEQ ID NO: 138206 - DNA, 25 bp, Homo sapien
tcgttgcggcgcaaaatgaccttgc

SEQ ID NO: 138207 - DNA, 25 bp, Homo sapien
tgcggcgcaaaatgaccttgcgcgg

SEQ ID NO: 138208 - DNA, 25 bp, Homo sapien
gcgcgctgcacttgctgagctcagc

SEQ ID NO: 138209 - DNA, 25 bp, Homo sapien
ggagaccacggacccgctttgtgcc

SEQ ID NO: 138210 - DNA, 25 bp, Homo sapien
gcgggacattcatcttgcgtggcag

SEQ ID NO: 138211 - DNA, 25 bp, Homo sapien
attcatcttgcgtggcaggcgctcc

SEQ ID NO: 138212 - DNA, 25 bp, Homo sapien
acgcgtctaacactgccgggagttc

SEQ ID NO: 138213 - DNA, 25 bp, Homo sapien
ctcagtaactctagaggcggcggca

SEQ ID NO: 138214 - DNA, 25 bp, Homo sapien
gcgaggggatacctgattctcagta

SEQ ID NO: 138215 - DNA, 25 bp, Homo sapien
gcagcttcgcatgcagtgcgcatta

SEQ ID NO: 138216 - DNA, 25 bp, Homo sapien
tcggcttcggactacctaagaggga

SEQ ID NO: 138217 - DNA, 25 bp, Homo sapien
gggctgcatgcagtgacgtcacaaa

SEQ ID NO: 138218 - DNA, 25 bp, Homo sapien
ctgacccgagtgcaatccgttcata

SEQ ID NO: 138219 - DNA, 25 bp, Homo sapien
gggaatccgtcctccaacacgaatg

SEQ ID NO: 138220 - DNA, 25 bp, Homo sapien
ttgtccttgaacttgggcaccctta

SEQ ID NO: 138221 - DNA, 25 bp, Homo sapien
ctctcctgcatgctgacagttgtcc

SEQ ID NO: 138222 - DNA, 25 bp, Homo sapien
ggcctcagagtcacatggtcccatg

SEQ ID NO: 138223 - DNA, 25 bp, Homo sapien
tcccagcatgatcagcccttgtgtg

SEQ ID NO: 138224 - DNA, 25 bp, Homo sapien
ttataccggtagctgcagttgctcc

SEQ ID NO: 138225 - DNA, 25 bp, Homo sapien
gagggcagcatcacttataccggta

SEQ ID NO: 138226 - DNA, 25 bp, Homo sapien
tgggtcctaccctgttcaacattgc

SEQ ID NO: 138227 - DNA, 25 bp, Homo sapien
tggccttctggttcctccaacaagc

SEQ ID NO: 138228 - DNA, 25 bp, Homo sapien
aagaggcatcacagcggcacacatg

SEQ ID NO: 138229 - DNA, 25 bp, Homo sapien
ggctttggccatcagtctgcaccga

SEQ ID NO: 138230 - DNA, 25 bp, Homo sapien
gggtccaggctttggccatcagtct

SEQ ID NO: 138231 - DNA, 25 bp, Homo sapien
ccatcagtctgcaccgaccggggtg

SEQ ID NO: 138232 - DNA, 25 bp, Homo sapien
cacatgtgtcccgtggccaggcgct

SEQ ID NO: 138233 - DNA, 25 bp, Homo sapien
gcgcacatgcgacccgggcgcaatt

SEQ ID NO: 138234 - DNA, 25 bp, Homo sapien
gcgacccgggcgcaattacttgggc

SEQ ID NO: 138235 - DNA, 25 bp, Homo sapien
gcggcacacatgtgtcccgtggcca

SEQ ID NO: 138236 - DNA, 25 bp, Homo sapien
tccacagtgtgtccaggtagtattc

SEQ ID NO: 138237 - DNA, 25 bp, Homo sapien
ctgaccaggaccacgctgatgatga

SEQ ID NO: 138238 - DNA, 25 bp, Homo sapien
tctctcagggagctgaagctgacca

SEQ ID NO: 138239 - DNA, 25 bp, Homo sapien
cggcccgttaccatcggagctgagc

SEQ ID NO: 138240 - DNA, 25 bp, Homo sapien
tgtaacggcccaagtattccatttg

SEQ ID NO: 138241 - DNA, 25 bp, Homo sapien
ccaggcgcacgtagaccagatgcaa

SEQ ID NO: 138242 - DNA, 25 bp, Homo sapien
ccagcaccgaagaccgtgttgtatt

SEQ ID NO: 138243 - DNA, 25 bp, Homo sapien
gttgtatttaccctctgcgtgcgga

SEQ ID NO: 138244 - DNA, 25 bp, Homo sapien
agactcgggaacagccgccattttg

SEQ ID NO: 138245 - DNA, 25 bp, Homo sapien
tctgctgatactggggttctaaggc

SEQ ID NO: 138246 - DNA, 25 bp, Homo sapien
tcccgcattagcgaaggcctcaaga

SEQ ID NO: 138247 - DNA, 25 bp, Homo sapien
agaagggactacttttcctcgcctg

SEQ ID NO: 138248 - DNA, 25 bp, Homo sapien
agaactgcgacccaaatcccggctg

SEQ ID NO: 138249 - DNA, 25 bp, Homo sapien
cccgaataagagctttcccgcatta

SEQ ID NO: 138250 - DNA, 25 bp, Homo sapien
tgcgacggaactagctgtgccacac

SEQ ID NO: 138251 - DNA, 25 bp, Homo sapien
cacccggcgcgtccttatataatca

SEQ ID NO: 138252 - DNA, 25 bp, Homo sapien
cagcagcatgctgtcggactgcagc

SEQ ID NO: 138253 - DNA, 25 bp, Homo sapien
caccagcgttacctgcccaggaagg

SEQ ID NO: 138254 - DNA, 25 bp, Homo sapien
ctgcaccaggatttccaagggaatg

SEQ ID NO: 138255 - DNA, 25 bp, Homo sapien
tggggcagccatgaccaccgacggc

SEQ ID NO: 138256 - DNA, 25 bp, Homo sapien
ggcgaggcttatagaccgacaaccc

SEQ ID NO: 138257 - DNA, 25 bp, Homo sapien
tcgcccacctgacggtaccgagagg

SEQ ID NO: 138258 - DNA, 25 bp, Homo sapien
gggatctgacttggctcttgcggtc

SEQ ID NO: 138259 - DNA, 25 bp, Homo sapien
caacaacccgaaaatctgcaccagg

SEQ ID NO: 138260 - DNA, 25 bp, Homo sapien
ccgcaagtagctgacaccgcaggcg

SEQ ID NO: 138261 - DNA, 25 bp, Homo sapien
ccgggcgccaaaaggtaagcctctg

SEQ ID NO: 138262 - DNA, 25 bp, Homo sapien
ggcgcccgagatcctgcacaccagc

SEQ ID NO: 138263 - DNA, 25 bp, Homo sapien
agctgacaccgcaggcgtgaccgct

SEQ ID NO: 138264 - DNA, 25 bp, Homo sapien
ctcccggccgactctgtttagcaga

SEQ ID NO: 138265 - DNA, 25 bp, Homo sapien
actctgtttagcagagtcggggtct

SEQ ID NO: 138266 - DNA, 25 bp, Homo sapien
ctcccggaatcacggacgcctccct

SEQ ID NO: 138267 - DNA, 25 bp, Homo sapien
atgtggcgaccggtgaggactctcc

SEQ ID NO: 138268 - DNA, 25 bp, Homo sapien
ctgcgctccatggtgctcaggtaca

SEQ ID NO: 138269 - DNA, 25 bp, Homo sapien
acaccgtgcgcgctatcaacgtggc

SEQ ID NO: 138270 - DNA, 25 bp, Homo sapien
gtggaccgctacttccttatggcta

SEQ ID NO: 138271 - DNA, 25 bp, Homo sapien
ccagtacctggagacctagggtgca

SEQ ID NO: 138272 - DNA, 25 bp, Homo sapien
caggaggccgtgtaatgaccacaca

SEQ ID NO: 138273 - DNA, 25 bp, Homo sapien
cactatgtctggtgtggtgccgatc

SEQ ID NO: 138274 - DNA, 25 bp, Homo sapien
gatcttcttggctagctcgctgcgc

SEQ ID NO: 138275 - DNA, 25 bp, Homo sapien
ccaaggtcgtctgggagatgctcaa

SEQ ID NO: 138276 - DNA, 25 bp, Homo sapien
tatcctcgaagtagcggaaacgcgc

SEQ ID NO: 138277 - DNA, 25 bp, Homo sapien
aagtagcggaaacgcgccacgcggc

SEQ ID NO: 138278 - DNA, 25 bp, Homo sapien
gacagttgacattgtggaatggagc

SEQ ID NO: 138279 - DNA, 25 bp, Homo sapien
tcggccggtcaccaagagccagtga

SEQ ID NO: 138280 - DNA, 25 bp, Homo sapien
cgaaagagtcgaccgggccgtcgat

SEQ ID NO: 138281 - DNA, 25 bp, Homo sapien
cattgtggaatggagcgaaagagtc

SEQ ID NO: 138282 - DNA, 25 bp, Homo sapien
ggatgaggccgcgtctcccttctac

SEQ ID NO: 138283 - DNA, 25 bp, Homo sapien
ccctgagtagccataaatatcctcg

SEQ ID NO: 138284 - DNA, 25 bp, Homo sapien
aacatgccgctgaggtctcggtaca

SEQ ID NO: 138285 - DNA, 25 bp, Homo sapien
ggcggctctcagtggtgaacatgcc

SEQ ID NO: 138286 - DNA, 25 bp, Homo sapien
tctcggtacaggcacagcgtaatca

SEQ ID NO: 138287 - DNA, 25 bp, Homo sapien
agcgtaatcaccttggactgctgtg

SEQ ID NO: 138288 - DNA, 25 bp, Homo sapien
cggccaccgtaggagtcactcttca

SEQ ID NO: 138289 - DNA, 25 bp, Homo sapien
ggagtcactcttcagcaggaacatg

SEQ ID NO: 138290 - DNA, 25 bp, Homo sapien
gtggccctcggcactcatgatgacc

SEQ ID NO: 138291 - DNA, 25 bp, Homo sapien
catgatgaccacataggggtcggcc

SEQ ID NO: 138292 - DNA, 25 bp, Homo sapien
aggcggagaggcctgtccaccgccc

SEQ ID NO: 138293 - DNA, 25 bp, Homo sapien
ggaagacaatgagccgcccgcgccg

SEQ ID NO: 138294 - DNA, 25 bp, Homo sapien
ggccggaagacaatgagccgcccgc

SEQ ID NO: 138295 - DNA, 25 bp, Homo sapien
cgggtcggaggagcagctcccgctc

SEQ ID NO: 138296 - DNA, 25 bp, Homo sapien
cacggaagcaggagcagaagccgaa

SEQ ID NO: 138297 - DNA, 25 bp, Homo sapien
gctcccgctcgcaggtgctcggaga

SEQ ID NO: 138298 - DNA, 25 bp, Homo sapien
tcccggggttgctccgcttggctct

SEQ ID NO: 138299 - DNA, 25 bp, Homo sapien
cggggatcggctgtccggagcgaac

SEQ ID NO: 138300 - DNA, 25 bp, Homo sapien
catggagaactccagaccggtgggc

SEQ ID NO: 138301 - DNA, 25 bp, Homo sapien
ggggctccgagaaagcttcctagag

SEQ ID NO: 138302 - DNA, 25 bp, Homo sapien
ggagaagcgactccgctcgtagctc

SEQ ID NO: 138303 - DNA, 25 bp, Homo sapien
aaccgggacagcagcgaactcagtc

SEQ ID NO: 138304 - DNA, 25 bp, Homo sapien
cgcctgtttgtacacggcgtacatg

SEQ ID NO: 138305 - DNA, 25 bp, Homo sapien
tgcgctcgctgttgttgaagaagtt

SEQ ID NO: 138306 - DNA, 25 bp, Homo sapien
aggtcccggccactaccaggttgcg

SEQ ID NO: 138307 - DNA, 25 bp, Homo sapien
cagttggagccgactcgagaggaac

SEQ ID NO: 138308 - DNA, 25 bp, Homo sapien
tgcgggcgagtccacattaacagct

SEQ ID NO: 138309 - DNA, 25 bp, Homo sapien
aggagccttgagtaagtcccgcccg

SEQ ID NO: 138310 - DNA, 25 bp, Homo sapien
gtagcctcaactctgcgggcgcaga

SEQ ID NO: 138311 - DNA, 25 bp, Homo sapien
cacccagctcgtgtggcaactcgtg

SEQ ID NO: 138312 - DNA, 25 bp, Homo sapien
aggccaggttcagcagcagtgcttg

SEQ ID NO: 138313 - DNA, 25 bp, Homo sapien
aaccgcgagtgccacgtagagacca

SEQ ID NO: 138314 - DNA, 25 bp, Homo sapien
atcctgaccatgtcgcagagtgcta

SEQ ID NO: 138315 - DNA, 25 bp, Homo sapien
ggcgtcgcccagagtgatcatatag

SEQ ID NO: 138316 - DNA, 25 bp, Homo sapien
tggggctgttacctttccacacggc

SEQ ID NO: 138317 - DNA, 25 bp, Homo sapien
cagcgtatttaacaggccgcccaga

SEQ ID NO: 138318 - DNA, 25 bp, Homo sapien
cggtccgccagcgtatttaacaggc

SEQ ID NO: 138319 - DNA, 25 bp, Homo sapien
agtgcacacggtccgccagcgtatt

SEQ ID NO: 138320 - DNA, 25 bp, Homo sapien
tccagagcgccctggccagaggtga

SEQ ID NO: 138321 - DNA, 25 bp, Homo sapien
ttggcgcagtgcacacggtccgcca

SEQ ID NO: 138322 - DNA, 25 bp, Homo sapien
acacggcccgttggcgcagtgcaca

SEQ ID NO: 138323 - DNA, 25 bp, Homo sapien
gagcctcttgatccagagcgccctg

SEQ ID NO: 138324 - DNA, 25 bp, Homo sapien
tcgggctggatctgagacacacaca

SEQ ID NO: 138325 - DNA, 25 bp, Homo sapien
tgtccatgaccgtgatgaagagctg

SEQ ID NO: 138326 - DNA, 25 bp, Homo sapien
atccatggcgcggatctccaggcgc

SEQ ID NO: 138327 - DNA, 25 bp, Homo sapien
gtgcacatgaggctcgcgtgtccac

SEQ ID NO: 138328 - DNA, 25 bp, Homo sapien
atcagctctcgcaggtcgggctgga

SEQ ID NO: 138329 - DNA, 25 bp, Homo sapien
tggtctccatcagctctcgcaggtc

SEQ ID NO: 138330 - DNA, 25 bp, Homo sapien
cggtgcatggtctccatcagctctc

SEQ ID NO: 138331 - DNA, 25 bp, Homo sapien
aggcgcagcttgtccatgaccgtga

SEQ ID NO: 138332 - DNA, 25 bp, Homo sapien
agactgggctcttcgcttcgggaag

SEQ ID NO: 138333 - DNA, 25 bp, Homo sapien
cgtcaacaggttggcatccagactg

SEQ ID NO: 138334 - DNA, 25 bp, Homo sapien
tcagatccggcctccgagtgtggcc

SEQ ID NO: 138335 - DNA, 25 bp, Homo sapien
agtgtggcctccatgcttgtgagca

SEQ ID NO: 138336 - DNA, 25 bp, Homo sapien
ctccatgcttgtgagcacctgctca

SEQ ID NO: 138337 - DNA, 25 bp, Homo sapien
agcacctgctcagcttccaagcggg

SEQ ID NO: 138338 - DNA, 25 bp, Homo sapien
acgcgtcagccggaacgcagcgttc

SEQ ID NO: 138339 - DNA, 25 bp, Homo sapien
ctcagcttccaagcgggaagacgtc

SEQ ID NO: 138340 - DNA, 25 bp, Homo sapien
ccgctcatgtaggtagggaacgtct

SEQ ID NO: 138341 - DNA, 25 bp, Homo sapien
gaacgtctgggtcaagctctccgag

SEQ ID NO: 138342 - DNA, 25 bp, Homo sapien
acgttctgcggccacaagcaaatgt

SEQ ID NO: 138343 - DNA, 25 bp, Homo sapien
tgtgcaaaacaacctcgcagagtgg

SEQ ID NO: 138344 - DNA, 25 bp, Homo sapien
acaacgagcaaggaaagccagtttc

SEQ ID NO: 138345 - DNA, 25 bp, Homo sapien
taacgtgacttttgcggcgctcagc

SEQ ID NO: 138346 - DNA, 25 bp, Homo sapien
tgcctaacagcgaaagcggacgttc

SEQ ID NO: 138347 - DNA, 25 bp, Homo sapien
agccagtttctagaacatgccaata

SEQ ID NO: 138348 - DNA, 25 bp, Homo sapien
cccgcggcaggctccagggaacaaa

SEQ ID NO: 138349 - DNA, 25 bp, Homo sapien
aggctccagggaacaaactcgcttt

SEQ ID NO: 138350 - DNA, 25 bp, Homo sapien
aggcgtctgctgcacagctgcagtt

SEQ ID NO: 138351 - DNA, 25 bp, Homo sapien
ggaagagggcagacctcagcgctgc

SEQ ID NO: 138352 - DNA, 25 bp, Homo sapien
tgcgcggctatcttgtcccacaggc

SEQ ID NO: 138353 - DNA, 25 bp, Homo sapien
gagctgcgcggctatcttgtcccac

SEQ ID NO: 138354 - DNA, 25 bp, Homo sapien
gtctgctgcacagctgcagttcccg

SEQ ID NO: 138355 - DNA, 25 bp, Homo sapien
gctccagggaacaaactcgctttcg

SEQ ID NO: 138356 - DNA, 25 bp, Homo sapien
tctgcagaccaggagacgtaagccc

SEQ ID NO: 138357 - DNA, 25 bp, Homo sapien
aggactgactcttcgccccacgtgt

SEQ ID NO: 138358 - DNA, 25 bp, Homo sapien
agccacctcgaagtggccacagttg

SEQ ID NO: 138359 - DNA, 25 bp, Homo sapien
cgaagtggccacagttgagggcatc

SEQ ID NO: 138360 - DNA, 25 bp, Homo sapien
tggccacctgggtcgtccactgcgg

SEQ ID NO: 138361 - DNA, 25 bp, Homo sapien
cggacaatttctgcagaccaggaga

SEQ ID NO: 138362 - DNA, 25 bp, Homo sapien
gagacgtaagcccagctcccgatgc

SEQ ID NO: 138363 - DNA, 25 bp, Homo sapien
aagcggacaatttctgcagaccagg

SEQ ID NO: 138364 - DNA, 25 bp, Homo sapien
gcttcctcatggtgtgcgcacactc

SEQ ID NO: 138365 - DNA, 25 bp, Homo sapien
acagcgggtacctgtgcaataacca

SEQ ID NO: 138366 - DNA, 25 bp, Homo sapien
tccaagcagcgcatagcctgggagt

SEQ ID NO: 138367 - DNA, 25 bp, Homo sapien
atgaaccgcttcctcatggtgtgcg

SEQ ID NO: 138368 - DNA, 25 bp, Homo sapien
gcagcactcgctctccatgaaccgc

SEQ ID NO: 138369 - DNA, 25 bp, Homo sapien
ggtacctgtgcaataaccacgcagc

SEQ ID NO: 138370 - DNA, 25 bp, Homo sapien
agctcggagccacgcacagcgggta

SEQ ID NO: 138371 - DNA, 25 bp, Homo sapien
tgtgcaataaccacgcagcactcgc

SEQ ID NO: 138372 - DNA, 25 bp, Homo sapien
agtgctgctccagagcctcggcgta

SEQ ID NO: 138373 - DNA, 25 bp, Homo sapien
catcctcggagttctcgtgcgggag

SEQ ID NO: 138374 - DNA, 25 bp, Homo sapien
tcatgctcggatcgccgcgggatcc

SEQ ID NO: 138375 - DNA, 25 bp, Homo sapien
gcgccttggctttcgccttgctcag

SEQ ID NO: 138376 - DNA, 25 bp, Homo sapien
gcacagcccagagggtcgtcagcgc

SEQ ID NO: 138377 - DNA, 25 bp, Homo sapien
cgatcttgcggtgggccacggcaca

SEQ ID NO: 138378 - DNA, 25 bp, Homo sapien
gccaggcgctctccgatcttgcggt

SEQ ID NO: 138379 - DNA, 25 bp, Homo sapien
aacttacggcgaagctcgcgctcca

SEQ ID NO: 138380 - DNA, 25 bp, Homo sapien
agccagcagcttgttgcactccacg

SEQ ID NO: 138381 - DNA, 25 bp, Homo sapien
gtgaacctgggcgtctcatagtaca

SEQ ID NO: 138382 - DNA, 25 bp, Homo sapien
gccttcaggacccacgtctggttca

SEQ ID NO: 138383 - DNA, 25 bp, Homo sapien
gagtcgttgactcgagccttcagga

SEQ ID NO: 138384 - DNA, 25 bp, Homo sapien
ccgtctcgttgctctcgttggtgaa

SEQ ID NO: 138385 - DNA, 25 bp, Homo sapien
cgcaggttgatgttcttggcagcca

SEQ ID NO: 138386 - DNA, 25 bp, Homo sapien
cgcatgcagacttgccctgtgttgg

SEQ ID NO: 138387 - DNA, 25 bp, Homo sapien
cttgagcagcaggaaggagcactcc

SEQ ID NO: 138388 - DNA, 25 bp, Homo sapien
cgccctgtccgggtagatgctgccg

SEQ ID NO: 138389 - DNA, 25 bp, Homo sapien
tccgggtagatgctgccgggccttg

SEQ ID NO: 138390 - DNA, 25 bp, Homo sapien
gccttggcgccctgtccgggtagat

SEQ ID NO: 138391 - DNA, 25 bp, Homo sapien
gcgccctgtccgggtagatgctgcc

SEQ ID NO: 138392 - DNA, 25 bp, Homo sapien
cttggcgccctgtccgggtaggtgc

SEQ ID NO: 138393 - DNA, 25 bp, Homo sapien
ttggcgccctgtccgggtaggtgct

SEQ ID NO: 138394 - DNA, 25 bp, Homo sapien
cttggcgccctgtccgggtagatgc

SEQ ID NO: 138395 - DNA, 25 bp, Homo sapien
ttggcgccctgtccgggtagatgct

SEQ ID NO: 138396 - DNA, 25 bp, Homo sapien
aggtccaggcacacggtgcagcaca

SEQ ID NO: 138397 - DNA, 25 bp, Homo sapien
tacacggaggccttgggcaggtcca

SEQ ID NO: 138398 - DNA, 25 bp, Homo sapien
caagcgattcagatcgggaagtacc

SEQ ID NO: 138399 - DNA, 25 bp, Homo sapien
gcggccctacctggtacacggaggc

SEQ ID NO: 138400 - DNA, 25 bp, Homo sapien
gacaacgaggagcttcggagcagcc

SEQ ID NO: 138401 - DNA, 25 bp, Homo sapien
taaagccctgagagaaagacaacga

SEQ ID NO: 138402 - DNA, 25 bp, Homo sapien
gggaagtaccgtggatcagaaaaca

SEQ ID NO: 138403 - DNA, 25 bp, Homo sapien
tgcagcacagcaccgagtagagccg

SEQ ID NO: 138404 - DNA, 25 bp, Homo sapien
tctctgtcgggtgcgggacccctta

SEQ ID NO: 138405 - DNA, 25 bp, Homo sapien
ggcacccacgctccacgagccagtg

SEQ ID NO: 138406 - DNA, 25 bp, Homo sapien
aggcttgtgttaggggctctcgccc

SEQ ID NO: 138407 - DNA, 25 bp, Homo sapien
actcaggcttgtgttaggggctctc

SEQ ID NO: 138408 - DNA, 25 bp, Homo sapien
ccaagactcaggcttgtgttagggg

SEQ ID NO: 138409 - DNA, 25 bp, Homo sapien
cacaagtgaaaaatcccgccggcca

SEQ ID NO: 138410 - DNA, 25 bp, Homo sapien
cccttaggtctccacaggagcaagc

SEQ ID NO: 138411 - DNA, 25 bp, Homo sapien
ggaggcccacgcgagctgtggcgcc

SEQ ID NO: 138412 - DNA, 25 bp, Homo sapien
gtgttgaaggctccgcgaaaccgga

SEQ ID NO: 138413 - DNA, 25 bp, Homo sapien
cgccgtgagaaacggcgggtctcca

SEQ ID NO: 138414 - DNA, 25 bp, Homo sapien
gccgcgggcacctgtttctagtacc

SEQ ID NO: 138415 - DNA, 25 bp, Homo sapien
tcccatgtacgccttttactcgttg

SEQ ID NO: 138416 - DNA, 25 bp, Homo sapien
ttactcgttgctcatctacatcttc

SEQ ID NO: 138417 - DNA, 25 bp, Homo sapien
tctacagcctcttccgcagggatgg

SEQ ID NO: 138418 - DNA, 25 bp, Homo sapien
cccgatgctggaagcgtagacttcg

SEQ ID NO: 138419 - DNA, 25 bp, Homo sapien
ctctcagcccggtgtccgcggtgta

SEQ ID NO: 138420 - DNA, 25 bp, Homo sapien
ccgggcaggcccatctcagaattaa

SEQ ID NO: 138421 - DNA, 25 bp, Homo sapien
gggatggtgttctccaccgtcaaga

SEQ ID NO: 138422 - DNA, 25 bp, Homo sapien
caagacctttgagccgcctgagcga

SEQ ID NO: 138423 - DNA, 25 bp, Homo sapien
gctctataccggcagcagccgcgga

SEQ ID NO: 138424 - DNA, 25 bp, Homo sapien
gttaacccttctcttgctgcggcag

SEQ ID NO: 138425 - DNA, 25 bp, Homo sapien
tcctgggcagttaccgctctatacc

SEQ ID NO: 138426 - DNA, 25 bp, Homo sapien
tcagaattaacgctttgatggcatc

SEQ ID NO: 138427 - DNA, 25 bp, Homo sapien
tggcatcaccgcgtcgggaatccct

SEQ ID NO: 138428 - DNA, 25 bp, Homo sapien
ggaggcccagaccataaaccgctcg

SEQ ID NO: 138429 - DNA, 25 bp, Homo sapien
agacagtctgctccctcaagttcgc

SEQ ID NO: 138430 - DNA, 25 bp, Homo sapien
tcaagttcgccgaccgagtgggtca

SEQ ID NO: 138431 - DNA, 25 bp, Homo sapien
gcatgccctggtcacgctgacgctg

SEQ ID NO: 138432 - DNA, 25 bp, Homo sapien
aggcaccgcaggtaccacggccggt

SEQ ID NO: 138433 - DNA, 25 bp, Homo sapien
gacctggcgggatccgaacgcgcac

SEQ ID NO: 138434 - DNA, 25 bp, Homo sapien
cgccttccagatgctgaaactgggg

SEQ ID NO: 138435 - DNA, 25 bp, Homo sapien
tctcggggagacagtctgctccctc

SEQ ID NO: 138436 - DNA, 25 bp, Homo sapien
ccaccttgcggaagcatcggttgga

SEQ ID NO: 138437 - DNA, 25 bp, Homo sapien
gcctcagctgggatcaggctcacgt

SEQ ID NO: 138438 - DNA, 25 bp, Homo sapien
cccaaccttggatgctcaggacttc

SEQ ID NO: 138439 - DNA, 25 bp, Homo sapien
gaatggagtctttccagccctcgta

SEQ ID NO: 138440 - DNA, 25 bp, Homo sapien
cagccctcgtagtcttccctgaaga

SEQ ID NO: 138441 - DNA, 25 bp, Homo sapien
gcctggacctgacggatgatctgaa

SEQ ID NO: 138442 - DNA, 25 bp, Homo sapien
gaaggacatttctgcgcggaagcgc

SEQ ID NO: 138443 - DNA, 25 bp, Homo sapien
tcgaccgcccagaagttgcccttgg

SEQ ID NO: 138444 - DNA, 25 bp, Homo sapien
gcttcgcgttttgttccaaggcgaa

SEQ ID NO: 138445 - DNA, 25 bp, Homo sapien
caggtgccaacggtcaggaaaggca

SEQ ID NO: 138446 - DNA, 25 bp, Homo sapien
cgcggcttccggctatgggtaccgc

SEQ ID NO: 138447 - DNA, 25 bp, Homo sapien
tggagcactttgagccattcccgtc

SEQ ID NO: 138448 - DNA, 25 bp, Homo sapien
ttgcccgcgatgactcggttttgtc

SEQ ID NO: 138449 - DNA, 25 bp, Homo sapien
ataaatcaatgaccaccgtcccggg

SEQ ID NO: 138450 - DNA, 25 bp, Homo sapien
cggttttgtccagcataaatcaatg

SEQ ID NO: 138451 - DNA, 25 bp, Homo sapien
ccaaggcgaaggtgtgtggattctc

SEQ ID NO: 138452 - DNA, 25 bp, Homo sapien
gccaagctgctggagctgaagcaca

SEQ ID NO: 138453 - DNA, 25 bp, Homo sapien
caggcatcacccaggacagcatcga

SEQ ID NO: 138454 - DNA, 25 bp, Homo sapien
ccagaactgcgcatgctggacgaca

SEQ ID NO: 138455 - DNA, 25 bp, Homo sapien
tcgcagccgccaacgggttcagcga

SEQ ID NO: 138456 - DNA, 25 bp, Homo sapien
ccagcctgagcgctaaggaccaaga

SEQ ID NO: 138457 - DNA, 25 bp, Homo sapien
cctgcgcccacttctcagatgtgtg

SEQ ID NO: 138458 - DNA, 25 bp, Homo sapien
gggtgagcctaacccagcgcaccga

SEQ ID NO: 138459 - DNA, 25 bp, Homo sapien
acctgaacgcaaagtccctgatgga

SEQ ID NO: 138460 - DNA, 25 bp, Homo sapien
ttgcgcccttccaggtgtaccagga

SEQ ID NO: 138461 - DNA, 25 bp, Homo sapien
gcgctctgtgtcatcaaccctggca

SEQ ID NO: 138462 - DNA, 25 bp, Homo sapien
gccgtgatccgcttcgccttcgaag

SEQ ID NO: 138463 - DNA, 25 bp, Homo sapien
tcctttgcgcagttccaggctgtga

SEQ ID NO: 138464 - DNA, 25 bp, Homo sapien
acctccaagggctacatgggcgagt

SEQ ID NO: 138465 - DNA, 25 bp, Homo sapien
gcgggttcgcagttccactcattca

SEQ ID NO: 138466 - DNA, 25 bp, Homo sapien
ccactcattcaagaaggtgctcatg

SEQ ID NO: 138467 - DNA, 25 bp, Homo sapien
tgtaccaggacaacgtgtacgccgc

SEQ ID NO: 138468 - DNA, 25 bp, Homo sapien
ctcacctgcggtatcgcagagcatg

SEQ ID NO: 138469 - DNA, 25 bp, Homo sapien
ttcttctggggtgttgatgctccta

SEQ ID NO: 138470 - DNA, 25 bp, Homo sapien
tcctaaagcccgagagcacgtgtcc

SEQ ID NO: 138471 - DNA, 25 bp, Homo sapien
tgctgctgttgttgaacctgggtgc

SEQ ID NO: 138472 - DNA, 25 bp, Homo sapien
ctggccaaggttctgtacgctccgt

SEQ ID NO: 138473 - DNA, 25 bp, Homo sapien
gcacgtgtccagaccctagcctgta

SEQ ID NO: 138474 - DNA, 25 bp, Homo sapien
tagcctgtacgacgctgactctgcc

SEQ ID NO: 138475 - DNA, 25 bp, Homo sapien
cgagaaactgctgagagtccggccc

SEQ ID NO: 138476 - DNA, 25 bp, Homo sapien
tgcatgaaggctcgctgtacccgcc

SEQ ID NO: 138477 - DNA, 25 bp, Homo sapien
acggggacaccagctctgtccatgc

SEQ ID NO: 138478 - DNA, 25 bp, Homo sapien
ggagcgcagcgatccgctctgtgtc

SEQ ID NO: 138479 - DNA, 25 bp, Homo sapien
cacggcctgcacgtagctctcgaag

SEQ ID NO: 138480 - DNA, 25 bp, Homo sapien
ggcaactggccctgcatgaaggctc

SEQ ID NO: 138481 - DNA, 25 bp, Homo sapien
ccggctgcacatgcccgcgtggtag

SEQ ID NO: 138482 - DNA, 25 bp, Homo sapien
accatgtgtgcccaaggtgggtcca

SEQ ID NO: 138483 - DNA, 25 bp, Homo sapien
tgcacgtagctctcgaagcttgggg

SEQ ID NO: 138484 - DNA, 25 bp, Homo sapien
gccgccgcctctagagttactgaga

SEQ ID NO: 138485 - DNA, 25 bp, Homo sapien
gggctctgtcctccatatcgaataa

SEQ ID NO: 138486 - DNA, 25 bp, Homo sapien
aactcccggcagtgttagacgcgtt

SEQ ID NO: 138487 - DNA, 25 bp, Homo sapien
cattcgtgttggaggacggattccc

SEQ ID NO: 138488 - DNA, 25 bp, Homo sapien
tttatgaacggattgcactcgggtc

SEQ ID NO: 138489 - DNA, 25 bp, Homo sapien
ggatgtccgggattactttccacgc

SEQ ID NO: 138490 - DNA, 25 bp, Homo sapien
ggttgccaactttcgcccgtctatg

SEQ ID NO: 138491 - DNA, 25 bp, Homo sapien
tccctcttaggtagtccgaagccga

SEQ ID NO: 138492 - DNA, 25 bp, Homo sapien
gcgccaggccctaattggggacaga

SEQ ID NO: 138493 - DNA, 25 bp, Homo sapien
gccacgcaagatgaatgtcccgccg

SEQ ID NO: 138494 - DNA, 25 bp, Homo sapien
cacaaagcgggtccgtggtctccgc

SEQ ID NO: 138495 - DNA, 25 bp, Homo sapien
attggccgctgagcctgacgtcatg

SEQ ID NO: 138496 - DNA, 25 bp, Homo sapien
ctgagctcagcaagtgcagcgcgcc

SEQ ID NO: 138497 - DNA, 25 bp, Homo sapien
gcaaggtcattttgcgccgcaacga

SEQ ID NO: 138498 - DNA, 25 bp, Homo sapien
gagcgcctgccacgcaagatgaatg

SEQ ID NO: 138499 - DNA, 25 bp, Homo sapien
aacgagcgcgctccagtatcgcacg

SEQ ID NO: 138500 - DNA, 25 bp, Homo sapien
accggtataagtgatgctgccctcc

SEQ ID NO: 138501 - DNA, 25 bp, Homo sapien
cctgcagctcgtccctgtgaaagtg

SEQ ID NO: 138502 - DNA, 25 bp, Homo sapien
catgggaccatgtgactctgaggcc

SEQ ID NO: 138503 - DNA, 25 bp, Homo sapien
ggagcaactgcagctaccggtataa

SEQ ID NO: 138504 - DNA, 25 bp, Homo sapien
agatccatcttgtgcctggggagca

SEQ ID NO: 138505 - DNA, 25 bp, Homo sapien
ccgctgtgcaccatgtgacttgaga

SEQ ID NO: 138506 - DNA, 25 bp, Homo sapien
gtgcccaagttcaaggacaactgtc

SEQ ID NO: 138507 - DNA, 25 bp, Homo sapien
gtgcttgcctgtgtgccactacatg

SEQ ID NO: 138508 - DNA, 25 bp, Homo sapien
cgcgccagggacgttactgtaagct

SEQ ID NO: 138509 - DNA, 25 bp, Homo sapien
ggccgcggactacaaatggacgaga

SEQ ID NO: 138510 - DNA, 25 bp, Homo sapien
tgcgtgcgcagaaaccaacgcgctg

SEQ ID NO: 138511 - DNA, 25 bp, Homo sapien
cgtggcgcactaggcgcttcctaaa

SEQ ID NO: 138512 - DNA, 25 bp, Homo sapien
gctccggagcaacgcagccgttgtc

SEQ ID NO: 138513 - DNA, 25 bp, Homo sapien
aatgattgcccggagtgactcgccg

SEQ ID NO: 138514 - DNA, 25 bp, Homo sapien
cccgtgtgtacacaagtgggacgag

SEQ ID NO: 138515 - DNA, 25 bp, Homo sapien
ccgtccattagttagcggctccgga

SEQ ID NO: 138516 - DNA, 25 bp, Homo sapien
tgaatcttgtcttcgtcttggtgcg

SEQ ID NO: 138517 - DNA, 25 bp, Homo sapien
gccgatacacagatacgcgtatatt

SEQ ID NO: 138518 - DNA, 25 bp, Homo sapien
tcttggtgcgaaagaagcgactcca

SEQ ID NO: 138519 - DNA, 25 bp, Homo sapien
tcgtcctcgaagctccgactggatt

SEQ ID NO: 138520 - DNA, 25 bp, Homo sapien
actggattgttcttgggcgctgaca

SEQ ID NO: 138521 - DNA, 25 bp, Homo sapien
cacccgtctgtggatttcttttcta

SEQ ID NO: 138522 - DNA, 25 bp, Homo sapien
gacacacggtcactggaattccatt

SEQ ID NO: 138523 - DNA, 25 bp, Homo sapien
agccagtcagtttccggccaaggca

SEQ ID NO: 138524 - DNA, 25 bp, Homo sapien
gaactgtaactgactttgccgctga

SEQ ID NO: 138525 - DNA, 25 bp, Homo sapien
tccgggttgtgttatcgcgagaact

SEQ ID NO: 138526 - DNA, 25 bp, Homo sapien
gccgtgagacttccgggttgtgtta

SEQ ID NO: 138527 - DNA, 25 bp, Homo sapien
gaccagcagagcaatccgaaaccca

SEQ ID NO: 138528 - DNA, 25 bp, Homo sapien
cccttgatgttgtagcgccggcgca

SEQ ID NO: 138529 - DNA, 25 bp, Homo sapien
ggggatgtcttaccctccagttcca

SEQ ID NO: 138530 - DNA, 25 bp, Homo sapien
ccctgggaaatctccgaaatccagc

SEQ ID NO: 138531 - DNA, 25 bp, Homo sapien
ttgcaagagaaacccagcgaagagg

SEQ ID NO: 138532 - DNA, 25 bp, Homo sapien
gagagcccgctgtacgactgccgct

SEQ ID NO: 138533 - DNA, 25 bp, Homo sapien
tccgggccaatgagctgtgtgccgc

SEQ ID NO: 138534 - DNA, 25 bp, Homo sapien
tgtgtgccgccgaatccaactgcag

SEQ ID NO: 138535 - DNA, 25 bp, Homo sapien
cgcactctgcggcagtgcctggcag

SEQ ID NO: 138536 - DNA, 25 bp, Homo sapien
aggccgcgaccgcaacaccatgctg

SEQ ID NO: 138537 - DNA, 25 bp, Homo sapien
ccttggaggtcttgcaggagagccc

SEQ ID NO: 138538 - DNA, 25 bp, Homo sapien
cccagtggactgtgtccgggccaat

SEQ ID NO: 138539 - DNA, 25 bp, Homo sapien
ccatgctggccaacaaggagtgcca

SEQ ID NO: 138540 - DNA, 25 bp, Homo sapien
caggcgtttcctgtctcagtgtgtg

SEQ ID NO: 138541 - DNA, 25 bp, Homo sapien
tttccgggatagagcgaatcctctc

SEQ ID NO: 138542 - DNA, 25 bp, Homo sapien
gactgtcgactagacgccgaacttc

SEQ ID NO: 138543 - DNA, 25 bp, Homo sapien
tgtattcgatgctccgcacgtgctc

SEQ ID NO: 138544 - DNA, 25 bp, Homo sapien
agaccgtgactgctaacatgcgttc

SEQ ID NO: 138545 - DNA, 25 bp, Homo sapien
tgcgttcacactgatgcacttcgga

SEQ ID NO: 138546 - DNA, 25 bp, Homo sapien
gcacttcggaacatgcgtggcatcc

SEQ ID NO: 138547 - DNA, 25 bp, Homo sapien
cgctcgttctcgctacttctgacag

SEQ ID NO: 138548 - DNA, 25 bp, Homo sapien
ccgatcccctctgcgcagggaagta

SEQ ID NO: 138549 - DNA, 25 bp, Homo sapien
gtgaccaagcaagggctggaagagt

SEQ ID NO: 138550 - DNA, 25 bp, Homo sapien
agggaagtagcacgactccgtcacc

SEQ ID NO: 138551 - DNA, 25 bp, Homo sapien
ctgagatgcggactcccgagggcct

SEQ ID NO: 138552 - DNA, 25 bp, Homo sapien
agggcctctctgtcagccttggggc

SEQ ID NO: 138553 - DNA, 25 bp, Homo sapien
cgcagggaagtagcacgactccgtc

SEQ ID NO: 138554 - DNA, 25 bp, Homo sapien
gaagagtgggcgatcgtcttcctct

SEQ ID NO: 138555 - DNA, 25 bp, Homo sapien
ccgagggcctctctgtcagccttgg

SEQ ID NO: 138556 - DNA, 25 bp, Homo sapien
ccgcggtttatactttcgaagtgct

SEQ ID NO: 138557 - DNA, 25 bp, Homo sapien
gttgtcttccgagcgtcaggccgcc

SEQ ID NO: 138558 - DNA, 25 bp, Homo sapien
tgggcacggaactcacgctcactcc

SEQ ID NO: 138559 - DNA, 25 bp, Homo sapien
aagctccggggcgagcccaagacgc

SEQ ID NO: 138560 - DNA, 25 bp, Homo sapien
tggcttccctgctagggccgggcaa

SEQ ID NO: 138561 - DNA, 25 bp, Homo sapien
aagagccgcgcgaggcttcccagaa

SEQ ID NO: 138562 - DNA, 25 bp, Homo sapien
aagctcagggccaagctgtccgcca

SEQ ID NO: 138563 - DNA, 25 bp, Homo sapien
ttatactttcgaagtgctcggagcc

SEQ ID NO: 138564 - DNA, 25 bp, Homo sapien
gacgacagcgcgctccggatgaagt

SEQ ID NO: 138565 - DNA, 25 bp, Homo sapien
acggacgacagcgcgctccggatga

SEQ ID NO: 138566 - DNA, 25 bp, Homo sapien
cgacggacgacagcgcgctccggat

SEQ ID NO: 138567 - DNA, 25 bp, Homo sapien
cgacagcgcgctccggatgaagttg

SEQ ID NO: 138568 - DNA, 25 bp, Homo sapien
tgggcgggtagctgcgctggccctg

SEQ ID NO: 138569 - DNA, 25 bp, Homo sapien
cgacctcgacggccgtcctgccgaa

SEQ ID NO: 138570 - DNA, 25 bp, Homo sapien
acgacagcgcgctccggatgaagtt

SEQ ID NO: 138571 - DNA, 25 bp, Homo sapien
cacaagcccgatcccagagcctgct

SEQ ID NO: 138572 - DNA, 25 bp, Homo sapien
acacgcggacgaggccttagatcca

SEQ ID NO: 138573 - DNA, 25 bp, Homo sapien
cgtcgcgctttacagagaaacccta

SEQ ID NO: 138574 - DNA, 25 bp, Homo sapien
tgacgctttgcatcgagtcgcatta

SEQ ID NO: 138575 - DNA, 25 bp, Homo sapien
tatcgcaccgcattttgacgctttg

SEQ ID NO: 138576 - DNA, 25 bp, Homo sapien
gcagcctgaccgactactaaaaata

SEQ ID NO: 138577 - DNA, 25 bp, Homo sapien
gcccttggtgacactcgccttcttg

SEQ ID NO: 138578 - DNA, 25 bp, Homo sapien
gctcgcgattctcaccttcaacagt

SEQ ID NO: 138579 - DNA, 25 bp, Homo sapien
gcactgccgtttccctcgattcttg

SEQ ID NO: 138580 - DNA, 25 bp, Homo sapien
gagagggtacgcttgcaaatgatcc

SEQ ID NO: 138581 - DNA, 25 bp, Homo sapien
actcgggactcacttgccgcgcgag

SEQ ID NO: 138582 - DNA, 25 bp, Homo sapien
accgccgtgaaggtgagatgagccc

SEQ ID NO: 138583 - DNA, 25 bp, Homo sapien
tcccgtgcagacatggcctctggca

SEQ ID NO: 138584 - DNA, 25 bp, Homo sapien
tgcagattcctttcccgtgcagaca

SEQ ID NO: 138585 - DNA, 25 bp, Homo sapien
ccaccgctctgtggctcgcttggtt

SEQ ID NO: 138586 - DNA, 25 bp, Homo sapien
tcactcccgcgcagtgaggttggca

SEQ ID NO: 138587 - DNA, 25 bp, Homo sapien
ccaatccagctgtcccggggaggaa

SEQ ID NO: 138588 - DNA, 25 bp, Homo sapien
cgtcttgctcctgggctgtaggccg

SEQ ID NO: 138589 - DNA, 25 bp, Homo sapien
ccaccagccgaaatgcagactggca

SEQ ID NO: 138590 - DNA, 25 bp, Homo sapien
ggcgatgttcccagacggatgccgc

SEQ ID NO: 138591 - DNA, 25 bp, Homo sapien
gactctgggaatggcgatgttccca

SEQ ID NO: 138592 - DNA, 25 bp, Homo sapien
tggactctgggaatggcgatgttcc

SEQ ID NO: 138593 - DNA, 25 bp, Homo sapien
agactggcagaggtgagacgggccc

SEQ ID NO: 138594 - DNA, 25 bp, Homo sapien
ccgaaatgcagactggcagaggtga

SEQ ID NO: 138595 - DNA, 25 bp, Homo sapien
accagccgaaatgcagactggcaga

SEQ ID NO: 138596 - DNA, 25 bp, Homo sapien
cgcgccaaccttgccctagccggag

SEQ ID NO: 138597 - DNA, 25 bp, Homo sapien
cgcacggtcaacaccttctcccaga

SEQ ID NO: 138598 - DNA, 25 bp, Homo sapien
agagcgtcagcagcctgttcggcga

SEQ ID NO: 138599 - DNA, 25 bp, Homo sapien
agcctgttcggcgaggacaacgtgc

SEQ ID NO: 138600 - DNA, 25 bp, Homo sapien
tcgccacgcacctggctaccggggc

SEQ ID NO: 138601 - DNA, 25 bp, Homo sapien
ttggaccttgcctccgcggtcggcg

SEQ ID NO: 138602 - DNA, 25 bp, Homo sapien
gagaagaacagctaccgccgcacgg

SEQ ID NO: 138603 - DNA, 25 bp, Homo sapien
cgaggacaacgtgcgcgccgctcag

SEQ ID NO: 138604 - DNA, 25 bp, Homo sapien
cgcatgtgcacgcagttaggcgagc

SEQ ID NO: 138605 - DNA, 25 bp, Homo sapien
tgacagtgcatctggggcagggcac

SEQ ID NO: 138606 - DNA, 25 bp, Homo sapien
gtgcacatgtgtgacggtgcgtctg

SEQ ID NO: 138607 - DNA, 25 bp, Homo sapien
cacgtcaagtttgctggtgcgtctg

SEQ ID NO: 138608 - DNA, 25 bp, Homo sapien
acaagtttcacgtcaagtttgctgg

SEQ ID NO: 138609 - DNA, 25 bp, Homo sapien
tctacgtccagatcctcaaacctga

SEQ ID NO: 138610 - DNA, 25 bp, Homo sapien
aggccagcccgtctgcactgaccaa

SEQ ID NO: 138611 - DNA, 25 bp, Homo sapien
cgcctgggccgtgaaggacttcgcc

SEQ ID NO: 138612 - DNA, 25 bp, Homo sapien
tctacatcaacatcaccaaggagga

SEQ ID NO: 138613 - DNA, 25 bp, Homo sapien
gtacctgaagttgccggtgcctctg

SEQ ID NO: 138614 - DNA, 25 bp, Homo sapien
cctctgcccaggtatggcgtgtgcc

SEQ ID NO: 138615 - DNA, 25 bp, Homo sapien
aagagcatcctgctgaacccggggc

SEQ ID NO: 138616 - DNA, 25 bp, Homo sapien
actcggccttcatcttcaagcagga

SEQ ID NO: 138617 - DNA, 25 bp, Homo sapien
gtgcacagcatcatcgcctccatgg

SEQ ID NO: 138618 - DNA, 25 bp, Homo sapien
actctggtgatttgcaggaagggca

SEQ ID NO: 138619 - DNA, 25 bp, Homo sapien
ctgaagcgggaggacaacaagagca

SEQ ID NO: 138620 - DNA, 25 bp, Homo sapien
tgcagaccatgttccggtgcgtcca

SEQ ID NO: 138621 - DNA, 25 bp, Homo sapien
gtgtccggggctcggctctaaacca

SEQ ID NO: 138622 - DNA, 25 bp, Homo sapien
tcaacgtgcagaccatgttccggtg

SEQ ID NO: 138623 - DNA, 25 bp, Homo sapien
atcgtcaacgtgcagaccatgttcc

SEQ ID NO: 138624 - DNA, 25 bp, Homo sapien
accatgttccggtgcgtccagtgtc

SEQ ID NO: 138625 - DNA, 25 bp, Homo sapien
atggcggacgccaagaccatcgtca

SEQ ID NO: 138626 - DNA, 25 bp, Homo sapien
ggacgccaagaccatcgtcaacgtg

SEQ ID NO: 138627 - DNA, 25 bp, Homo sapien
aggaggactacatggcggacgccaa

SEQ ID NO: 138628 - DNA, 25 bp, Homo sapien
cccggcttcacctccactggggctc

SEQ ID NO: 138629 - DNA, 25 bp, Homo sapien
gccatcgccaatcacccacgctccg

SEQ ID NO: 138630 - DNA, 25 bp, Homo sapien
cttcccgccaggcagccatcgccaa

SEQ ID NO: 138631 - DNA, 25 bp, Homo sapien
ggtcagcaagcacgcagccaacacg

SEQ ID NO: 138632 - DNA, 25 bp, Homo sapien
ttgaagtttgggtcagcaagcacgc

SEQ ID NO: 138633 - DNA, 25 bp, Homo sapien
gtcccacaaggtggcttgaagtttg

SEQ ID NO: 138634 - DNA, 25 bp, Homo sapien
cctctctgtcccacaaggtggcttg

SEQ ID NO: 138635 - DNA, 25 bp, Homo sapien
tccggcctcagccttgcacctctct

SEQ ID NO: 138636 - DNA, 25 bp, Homo sapien
gccaagaacagtcggccacggcgtc

SEQ ID NO: 138637 - DNA, 25 bp, Homo sapien
ggtcgggccacagccaagaacagtc

SEQ ID NO: 138638 - DNA, 25 bp, Homo sapien
caccaccggctacggtaagggcaca

SEQ ID NO: 138639 - DNA, 25 bp, Homo sapien
ctctccgagctggtgaagaaccgca

SEQ ID NO: 138640 - DNA, 25 bp, Homo sapien
gagcacccactgctacggcgcaaga

SEQ ID NO: 138641 - DNA, 25 bp, Homo sapien
aaccgcatgaagcacctggggctgc

SEQ ID NO: 138642 - DNA, 25 bp, Homo sapien
tgctacggcgcaagagcctgcagtg

SEQ ID NO: 138643 - DNA, 25 bp, Homo sapien
gctgagccgcaaggcgcccaagcag

SEQ ID NO: 138644 - DNA, 25 bp, Homo sapien
gcgctcatggaagaccctcgctctg

SEQ ID NO: 138645 - DNA, 25 bp, Homo sapien
cggctctgtgcttttccccacgatg

SEQ ID NO: 138646 - DNA, 25 bp, Homo sapien
cactgtggtgctcggacctgcagct

SEQ ID NO: 138647 - DNA, 25 bp, Homo sapien
gacctgcagctagcggccttcatga

SEQ ID NO: 138648 - DNA, 25 bp, Homo sapien
tagcggccttcatgagtgggatgcc

SEQ ID NO: 138649 - DNA, 25 bp, Homo sapien
gccttcatgagtgggatgcctgcgt

SEQ ID NO: 138650 - DNA, 25 bp, Homo sapien
agtgggatgcctgcgtcgcccgctc

SEQ ID NO: 138651 - DNA, 25 bp, Homo sapien
tcacccgccaaagcttcctgcggct

SEQ ID NO: 138652 - DNA, 25 bp, Homo sapien
cgcagctatctcatccgctccgacc

SEQ ID NO: 138653 - DNA, 25 bp, Homo sapien
caccaagcccggggtcctcaggaag

SEQ ID NO: 138654 - DNA, 25 bp, Homo sapien
tgcacggagctcaggccaccaagcc

SEQ ID NO: 138655 - DNA, 25 bp, Homo sapien
agctctgagccagccctgcacggag

SEQ ID NO: 138656 - DNA, 25 bp, Homo sapien
gagacacagctctgagccagccctg

SEQ ID NO: 138657 - DNA, 25 bp, Homo sapien
tcgcgacgagacacagctctgagcc

SEQ ID NO: 138658 - DNA, 25 bp, Homo sapien
ccgagactcgcgacgagacacagct

SEQ ID NO: 138659 - DNA, 25 bp, Homo sapien
gcagccacaagctgtcgtcctgcaa

SEQ ID NO: 138660 - DNA, 25 bp, Homo sapien
ttcttcggctttgacttgggcttgc

SEQ ID NO: 138661 - DNA, 25 bp, Homo sapien
tactcctgcttgatgagctcgcgcc

SEQ ID NO: 138662 - DNA, 25 bp, Homo sapien
cagctttgcgcctgagagaaacaca

SEQ ID NO: 138663 - DNA, 25 bp, Homo sapien
tccacaagcgggacacagaggctgc

SEQ ID NO: 138664 - DNA, 25 bp, Homo sapien
ggcagtcctgcagatgacccaccga

SEQ ID NO: 138665 - DNA, 25 bp, Homo sapien
gcaacgcacgtcctcactgaagatc

SEQ ID NO: 138666 - DNA, 25 bp, Homo sapien
tccatgggaggagtaagaccgtcac

SEQ ID NO: 138667 - DNA, 25 bp, Homo sapien
accaggctcctgctcagtctgcttt

SEQ ID NO: 138668 - DNA, 25 bp, Homo sapien
tcgtcccacctcagccacagcccgg

SEQ ID NO: 138669 - DNA, 25 bp, Homo sapien
tcgcgtccaccatctgcagacaaag

SEQ ID NO: 138670 - DNA, 25 bp, Homo sapien
aggtggcacccgcaggcctgtgcct

SEQ ID NO: 138671 - DNA, 25 bp, Homo sapien
cccgttgctttcctcaggctctaag

SEQ ID NO: 138672 - DNA, 25 bp, Homo sapien
agctgccctcttttagcgccgtgtc

SEQ ID NO: 138673 - DNA, 25 bp, Homo sapien
ccatctgcagacaaagggctgaggc

SEQ ID NO: 138674 - DNA, 25 bp, Homo sapien
ttcctcaggctctaaggcccgcggt

SEQ ID NO: 138675 - DNA, 25 bp, Homo sapien
cttccgcaggcgcagtaggacccgc

SEQ ID NO: 138676 - DNA, 25 bp, Homo sapien
ccagtgcctcaaagcggacgccttt

SEQ ID NO: 138677 - DNA, 25 bp, Homo sapien
gcagatctccataaaagggtcccgg

SEQ ID NO: 138678 - DNA, 25 bp, Homo sapien
cgcgtgggctttaacagcagatctc

SEQ ID NO: 138679 - DNA, 25 bp, Homo sapien
caggcccagtatgcgtgtgctcagt

SEQ ID NO: 138680 - DNA, 25 bp, Homo sapien
tctcagcctgcttcggaggttactg

SEQ ID NO: 138681 - DNA, 25 bp, Homo sapien
tcagggcctcgaacagccatgctta

SEQ ID NO: 138682 - DNA, 25 bp, Homo sapien
tgcgaaccagcaatctcccgagaag

SEQ ID NO: 138683 - DNA, 25 bp, Homo sapien
gctcgtgacgcgtgcttacaaagga

SEQ ID NO: 138684 - DNA, 25 bp, Homo sapien
ctttcagcgtcctgcacgtggtgtt

SEQ ID NO: 138685 - DNA, 25 bp, Homo sapien
cctgcgtgtacatcctgcacaagta

SEQ ID NO: 138686 - DNA, 25 bp, Homo sapien
tgaccctgggcttcactttcagcgt

SEQ ID NO: 138687 - DNA, 25 bp, Homo sapien
ctggcctactggttcttgtccctga

SEQ ID NO: 138688 - DNA, 25 bp, Homo sapien
atcgtgcgggtcgtcctgttttcca

SEQ ID NO: 138689 - DNA, 25 bp, Homo sapien
tgttcggccgcttcttctggatcgt

SEQ ID NO: 138690 - DNA, 25 bp, Homo sapien
cctgttttccatgtcctgcgtgtac

SEQ ID NO: 138691 - DNA, 25 bp, Homo sapien
tcgtggtggccgtctacttcatgac

SEQ ID NO: 138692 - DNA, 25 bp, Homo sapien
tgctccagaacccatctacggacgg

SEQ ID NO: 138693 - DNA, 25 bp, Homo sapien
agaacgcgcattcccgacctcaggg

SEQ ID NO: 138694 - DNA, 25 bp, Homo sapien
actgcatgcaaaccgcgaccaggtt

SEQ ID NO: 138695 - DNA, 25 bp, Homo sapien
agctgcatgtgcaggaccagccaac

SEQ ID NO: 138696 - DNA, 25 bp, Homo sapien
gtggatccacgctcaccagaggaca

SEQ ID NO: 138697 - DNA, 25 bp, Homo sapien
gcgaccaggttaaaacgtggatcca

SEQ ID NO: 138698 - DNA, 25 bp, Homo sapien
ggcacgtggtgtttactcacccaga

SEQ ID NO: 138699 - DNA, 25 bp, Homo sapien
ccaacgggagcgaacgcagcatctc

SEQ ID NO: 138700 - DNA, 25 bp, Homo sapien
tgagcttctccaccgaggtgtcctc

SEQ ID NO: 138701 - DNA, 25 bp, Homo sapien
tgaggcagcgctccttgagcttctc

SEQ ID NO: 138702 - DNA, 25 bp, Homo sapien
tcggacgcgcagatgtgcagccgca

SEQ ID NO: 138703 - DNA, 25 bp, Homo sapien
gcgaagatcttctcctcctgcacga

SEQ ID NO: 138704 - DNA, 25 bp, Homo sapien
agatgtggttctcggacaggcgcct

SEQ ID NO: 138705 - DNA, 25 bp, Homo sapien
gtggccaccgcaaaggaagtgcgtc

SEQ ID NO: 138706 - DNA, 25 bp, Homo sapien
agttctctggtagcttcgttcctcc

SEQ ID NO: 138707 - DNA, 25 bp, Homo sapien
cccggccttacgtgcttgaggcagc

SEQ ID NO: 138708 - DNA, 25 bp, Homo sapien
ggcctagggcgtccttctccagcat

SEQ ID NO: 138709 - DNA, 25 bp, Homo sapien
gacctagggcgtccttctccagcat

SEQ ID NO: 138710 - DNA, 25 bp, Homo sapien
atcacctggccgagacggacctagg

SEQ ID NO: 138711 - DNA, 25 bp, Homo sapien
catcacctggccgagacgggcctag

SEQ ID NO: 138712 - DNA, 25 bp, Homo sapien
gggcctagggcgtccttctccagca

SEQ ID NO: 138713 - DNA, 25 bp, Homo sapien
atcacctggccgagacgggcctagg

SEQ ID NO: 138714 - DNA, 25 bp, Homo sapien
ggacctagggcgtccttctccagca

SEQ ID NO: 138715 - DNA, 25 bp, Homo sapien
tcacctggccgagacggacctaggg

SEQ ID NO: 138716 - DNA, 25 bp, Homo sapien
tgtgcgaccgactgcgcagcaagct

SEQ ID NO: 138717 - DNA, 25 bp, Homo sapien
ccggttagactacgcagaagtgagc

SEQ ID NO: 138718 - DNA, 25 bp, Homo sapien
ggcgacagcttcccggctgaaacct

SEQ ID NO: 138719 - DNA, 25 bp, Homo sapien
tgtttgcagactgccggcgacagct

SEQ ID NO: 138720 - DNA, 25 bp, Homo sapien
ggatgtttgcagactgccggcgaca

SEQ ID NO: 138721 - DNA, 25 bp, Homo sapien
cgactgcgcagcaagctgtcggtgc

SEQ ID NO: 138722 - DNA, 25 bp, Homo sapien
ctacgcagaagtgagcagtgcccgc

SEQ ID NO: 138723 - DNA, 25 bp, Homo sapien
caggccaggcagcttgtgcgaccga

SEQ ID NO: 138724 - DNA, 25 bp, Homo sapien
atgcgttgctcgaacacctgtgccg

SEQ ID NO: 138725 - DNA, 25 bp, Homo sapien
cggagcccatgaccgtgcggtacat

SEQ ID NO: 138726 - DNA, 25 bp, Homo sapien
ggggcgaagttctgacagtacactg

SEQ ID NO: 138727 - DNA, 25 bp, Homo sapien
cctccggcagcatggacttgatctt

SEQ ID NO: 138728 - DNA, 25 bp, Homo sapien
atgtccgcggcgatcacgttcatct

SEQ ID NO: 138729 - DNA, 25 bp, Homo sapien
cattcacggcgtcagttctcagagc

SEQ ID NO: 138730 - DNA, 25 bp, Homo sapien
ggcggcactcaggtcaacattcacg

SEQ ID NO: 138731 - DNA, 25 bp, Homo sapien
tggacttgatcttgggcagccagcg

SEQ ID NO: 138732 - DNA, 25 bp, Homo sapien
gcacgtggtcagttcctccaggtca

SEQ ID NO: 138733 - DNA, 25 bp, Homo sapien
ctgctcttagcgactcggtctcagc

SEQ ID NO: 138734 - DNA, 25 bp, Homo sapien
ctcgatgtgcagcatctgagacatg

SEQ ID NO: 138735 - DNA, 25 bp, Homo sapien
cccgaagttggggatctcgatgtgc

SEQ ID NO: 138736 - DNA, 25 bp, Homo sapien
gcccagcactgtgttcccgaagttg

SEQ ID NO: 138737 - DNA, 25 bp, Homo sapien
gacacatcgcagtagaggcccagca

SEQ ID NO: 138738 - DNA, 25 bp, Homo sapien
ggcccttgaccacgatggacacatc

SEQ ID NO: 138739 - DNA, 25 bp, Homo sapien
tcaaaaaagttccagcccgcacagg

SEQ ID NO: 138740 - DNA, 25 bp, Homo sapien
ggatgtatcactcagcctcggcgtc

SEQ ID NO: 138741 - DNA, 25 bp, Homo sapien
cgaaacagtgacgtgaggcccagta

SEQ ID NO: 138742 - DNA, 25 bp, Homo sapien
agccgattccaccttgtcctcaatg

SEQ ID NO: 138743 - DNA, 25 bp, Homo sapien
ggccaggactccaggacacattctg

SEQ ID NO: 138744 - DNA, 25 bp, Homo sapien
ctggctgctgcgaactgactgaagc

SEQ ID NO: 138745 - DNA, 25 bp, Homo sapien
tttccctttcgtagacgtcggcagc

SEQ ID NO: 138746 - DNA, 25 bp, Homo sapien
aggacgcatcttcttttatcgggca

SEQ ID NO: 138747 - DNA, 25 bp, Homo sapien
cccacattcagggttcggggtcgca

SEQ ID NO: 138748 - DNA, 25 bp, Homo sapien
ctccgctgagtttcttagagaagga

SEQ ID NO: 138749 - DNA, 25 bp, Homo sapien
tggactttctccgacctcgcccagc

SEQ ID NO: 138750 - DNA, 25 bp, Homo sapien
ctcagctccgcagaggcacagaagc

SEQ ID NO: 138751 - DNA, 25 bp, Homo sapien
gcgcgggtccccagaaatccaggga

SEQ ID NO: 138752 - DNA, 25 bp, Homo sapien
cgcgcgccaagttggcggtacctgc

SEQ ID NO: 138753 - DNA, 25 bp, Homo sapien
gctccggctcccatggactttctcc

SEQ ID NO: 138754 - DNA, 25 bp, Homo sapien
gaagtgcttggcgtcccggcgctcc

SEQ ID NO: 138755 - DNA, 25 bp, Homo sapien
ctgagtttcttagagaaggagctgg

SEQ ID NO: 138756 - DNA, 25 bp, Homo sapien
gctctctctgagctgctgacacagg

SEQ ID NO: 138757 - DNA, 25 bp, Homo sapien
acaggacctttgcacccgctgacgg

SEQ ID NO: 138758 - DNA, 25 bp, Homo sapien
ttcagggaagctgtctctgagctcc

SEQ ID NO: 138759 - DNA, 25 bp, Homo sapien
ttgcagtacactggggctctctctg

SEQ ID NO: 138760 - DNA, 25 bp, Homo sapien
ccacgctgtctcttgcagtacactg

SEQ ID NO: 138761 - DNA, 25 bp, Homo sapien
tgagctgctgatctcgcccactctt

SEQ ID NO: 138762 - DNA, 25 bp, Homo sapien
tgtgctcagagatgtccctcccagc

SEQ ID NO: 138763 - DNA, 25 bp, Homo sapien
gtgaaactgtccctctgtgctcaga

SEQ ID NO: 138764 - DNA, 25 bp, Homo sapien
cgtggatgccatagacgagcagctc

SEQ ID NO: 138765 - DNA, 25 bp, Homo sapien
gcacccgccgcggaatgggcatgac

SEQ ID NO: 138766 - DNA, 25 bp, Homo sapien
ctgcagctaaagtagagtaggaagc

SEQ ID NO: 138767 - DNA, 25 bp, Homo sapien
cgccgcagtgaacaggctgcagcta

SEQ ID NO: 138768 - DNA, 25 bp, Homo sapien
cagcaggacgcgaacgcccaggtac

SEQ ID NO: 138769 - DNA, 25 bp, Homo sapien
cccgcagtacgacccgaagacatgt

SEQ ID NO: 138770 - DNA, 25 bp, Homo sapien
tacacgtcgaagttgttgtacttgg

SEQ ID NO: 138771 - DNA, 25 bp, Homo sapien
cgcccaggtactgtaggcagaagag

SEQ ID NO: 138772 - DNA, 25 bp, Homo sapien
tctggttcttcttcaggattggctg

SEQ ID NO: 138773 - DNA, 25 bp, Homo sapien
tcgccggtgccagtcaggatatcaa

SEQ ID NO: 138774 - DNA, 25 bp, Homo sapien
tcaggatatcaaggtgacagcgccc

SEQ ID NO: 138775 - DNA, 25 bp, Homo sapien
cactggccttggtcgaagggtgact

SEQ ID NO: 138776 - DNA, 25 bp, Homo sapien
attgggcacgcccttttctggttct

SEQ ID NO: 138777 - DNA, 25 bp, Homo sapien
ctatgaaccggaacgcgtcgcgatt

SEQ ID NO: 138778 - DNA, 25 bp, Homo sapien
ctcaggccgatcttccagacgcgga

SEQ ID NO: 138779 - DNA, 25 bp, Homo sapien
ccattgctaagctccgattgggcac

SEQ ID NO: 138780 - DNA, 25 bp, Homo sapien
tgcgataaccaaagggcgcctcagg

SEQ ID NO: 138781 - DNA, 25 bp, Homo sapien
aggcatcttttgcacctggtgcgga

SEQ ID NO: 138782 - DNA, 25 bp, Homo sapien
gtgagccagccagcttgcgataacc

SEQ ID NO: 138783 - DNA, 25 bp, Homo sapien
cggcccgcagggttgcaagaagaaa

SEQ ID NO: 138784 - DNA, 25 bp, Homo sapien
ggcgtgaagatgtggcctttccctt

SEQ ID NO: 138785 - DNA, 25 bp, Homo sapien
tggttgctcacaatgccaggcgcga

SEQ ID NO: 138786 - DNA, 25 bp, Homo sapien
gctcctcggcggaatcccgtagctt

SEQ ID NO: 138787 - DNA, 25 bp, Homo sapien
aatggcttcacgtgcatgtacccgc

SEQ ID NO: 138788 - DNA, 25 bp, Homo sapien
cggactcgtcgcttcccgagggcgt

SEQ ID NO: 138789 - DNA, 25 bp, Homo sapien
acgctgcgagcagtccgtagcgttc

SEQ ID NO: 138790 - DNA, 25 bp, Homo sapien
ctaccgcatcccgtggagaggcagt

SEQ ID NO: 138791 - DNA, 25 bp, Homo sapien
cttccgtggagcagtcctttggccc

SEQ ID NO: 138792 - DNA, 25 bp, Homo sapien
cagcagagggcttgaccgtggtcct

SEQ ID NO: 138793 - DNA, 25 bp, Homo sapien
cccggactgaggtgtctgcgacccg

SEQ ID NO: 138794 - DNA, 25 bp, Homo sapien
atccgggtccctgcgtttctgcaga

SEQ ID NO: 138795 - DNA, 25 bp, Homo sapien
ggcccatggacccaggactgtttcc

SEQ ID NO: 138796 - DNA, 25 bp, Homo sapien
ggcctcgtgacccagtccatgcgtg

SEQ ID NO: 138797 - DNA, 25 bp, Homo sapien
agtccatgcgtgcacagcgcaagta

SEQ ID NO: 138798 - DNA, 25 bp, Homo sapien
agcgcaagtagcttcccaggacacc

SEQ ID NO: 138799 - DNA, 25 bp, Homo sapien
agctgcttctggtcctctgcccact

SEQ ID NO: 138800 - DNA, 25 bp, Homo sapien
gatttgtcacgggtttgtcctgacg

SEQ ID NO: 138801 - DNA, 25 bp, Homo sapien
tttgtcctgacgtgtgaggtccagc

SEQ ID NO: 138802 - DNA, 25 bp, Homo sapien
gccaccgtgggttttggcctcgtga

SEQ ID NO: 138803 - DNA, 25 bp, Homo sapien
gtagcttcccaggacaccgatttcc

SEQ ID NO: 138804 - DNA, 25 bp, Homo sapien
cttttcttgcaggagcacaggcggg

SEQ ID NO: 138805 - DNA, 25 bp, Homo sapien
cgggcttttcttgcaggagcacagg

SEQ ID NO: 138806 - DNA, 25 bp, Homo sapien
ttcctcctgagacgggaagagcggc

SEQ ID NO: 138807 - DNA, 25 bp, Homo sapien
agctcgcaccgcctgttcgtggggt

SEQ ID NO: 138808 - DNA, 25 bp, Homo sapien
tactcctgaggtccgctgagcagga

SEQ ID NO: 138809 - DNA, 25 bp, Homo sapien
tcagtttactcctgaggtccgctga

SEQ ID NO: 138810 - DNA, 25 bp, Homo sapien
ggtcacccagcaatcaccagcggtg

SEQ ID NO: 138811 - DNA, 25 bp, Homo sapien
ctgctgcggagcacaggcctcctga

SEQ ID NO: 138812 - DNA, 25 bp, Homo sapien
tgggctcttcacgatgtctcgtccc

SEQ ID NO: 138813 - DNA, 25 bp, Homo sapien
gcgtggccttcgtgggcttcacaat

SEQ ID NO: 138814 - DNA, 25 bp, Homo sapien
gccttcgtgggcttcacaatcaaca

SEQ ID NO: 138815 - DNA, 25 bp, Homo sapien
tcgtgggcttcacaatcaacagagc

SEQ ID NO: 138816 - DNA, 25 bp, Homo sapien
gggcttcacaatcaacagagcccgc

SEQ ID NO: 138817 - DNA, 25 bp, Homo sapien
ccgagctgggctcttcacgatgtct

SEQ ID NO: 138818 - DNA, 25 bp, Homo sapien
agctgggctcttcacgatgtctcgt

SEQ ID NO: 138819 - DNA, 25 bp, Homo sapien
atcagcgtggccttcgtgggcttca

SEQ ID NO: 138820 - DNA, 25 bp, Homo sapien
gctaaagcttccaccgtccgcgaga

SEQ ID NO: 138821 - DNA, 25 bp, Homo sapien
acctgtcagcgcctaaaaggtcccg

SEQ ID NO: 138822 - DNA, 25 bp, Homo sapien
cccgcgggaacagtcggcactttat

SEQ ID NO: 138823 - DNA, 25 bp, Homo sapien
tctgattctgggttcgccctcgcgg

SEQ ID NO: 138824 - DNA, 25 bp, Homo sapien
ccgaattcggggctgacaacccgca

SEQ ID NO: 138825 - DNA, 25 bp, Homo sapien
tccgggattatcgacgcgccgccag

SEQ ID NO: 138826 - DNA, 25 bp, Homo sapien
cgctgcgctccgatcgggaaccgga

SEQ ID NO: 138827 - DNA, 25 bp, Homo sapien
gtcggcactttattaacctgtcagc

SEQ ID NO: 138828 - DNA, 25 bp, Homo sapien
agcagtgctagcagcaggtcgcctc

SEQ ID NO: 138829 - DNA, 25 bp, Homo sapien
ggagctcaacccgaaacgcagaagg

SEQ ID NO: 138830 - DNA, 25 bp, Homo sapien
agaggtctcctaagcccaccctgga

SEQ ID NO: 138831 - DNA, 25 bp, Homo sapien
ggagcagcgcagtgccacaacctca

SEQ ID NO: 138832 - DNA, 25 bp, Homo sapien
gccaggggccctgcaacaaatacag

SEQ ID NO: 138833 - DNA, 25 bp, Homo sapien
gcccggaaaggcctgaggatctcct

SEQ ID NO: 138834 - DNA, 25 bp, Homo sapien
ctgcgtaccggaaccgcaaggtgcc

SEQ ID NO: 138835 - DNA, 25 bp, Homo sapien
cacacgccaggagggctaaggttcc

SEQ ID NO: 138836 - DNA, 25 bp, Homo sapien
gccttcgcggccaagaatttagggc

SEQ ID NO: 138837 - DNA, 25 bp, Homo sapien
aagccgcacacttcggaccgaacga

SEQ ID NO: 138838 - DNA, 25 bp, Homo sapien
ggcgataattccgaccaggggcgaa

SEQ ID NO: 138839 - DNA, 25 bp, Homo sapien
attctaagggtgtgggtatggccca

SEQ ID NO: 138840 - DNA, 25 bp, Homo sapien
gggcggcgccttccctaaaatcgca

SEQ ID NO: 138841 - DNA, 25 bp, Homo sapien
cgattggcaaaaacgggcagcaccc

SEQ ID NO: 138842 - DNA, 25 bp, Homo sapien
cgaggtgttgtaagcgctcttcagc

SEQ ID NO: 138843 - DNA, 25 bp, Homo sapien
gggagcgcttcatgttgcggaaata

SEQ ID NO: 138844 - DNA, 25 bp, Homo sapien
tactcaaacgtctggcttcccgctg

SEQ ID NO: 138845 - DNA, 25 bp, Homo sapien
aagccgatccactgcctttgtgtca

SEQ ID NO: 138846 - DNA, 25 bp, Homo sapien
ttgggcagccgcaaaattacttatg

SEQ ID NO: 138847 - DNA, 25 bp, Homo sapien
caggcctccggggtaaatatcaatg

SEQ ID NO: 138848 - DNA, 25 bp, Homo sapien
tggccactctttctagggactcctc

SEQ ID NO: 138849 - DNA, 25 bp, Homo sapien
ggaaacgggtcttcaccatcacctg

SEQ ID NO: 138850 - DNA, 25 bp, Homo sapien
ccaggccatttcacgaggctgaata

SEQ ID NO: 138851 - DNA, 25 bp, Homo sapien
agctaaggggaaactgacatcggtc

SEQ ID NO: 138852 - DNA, 25 bp, Homo sapien
agtggcgcgagacgcgctcctccta

SEQ ID NO: 138853 - DNA, 25 bp, Homo sapien
gagtcccgcccaaggtgcagacggc

SEQ ID NO: 138854 - DNA, 25 bp, Homo sapien
cagagcggcgggactttctttgcct

SEQ ID NO: 138855 - DNA, 25 bp, Homo sapien
gactttctttgcctggccgctggcc

SEQ ID NO: 138856 - DNA, 25 bp, Homo sapien
gccgcccttgccgtttctgtcctca

SEQ ID NO: 138857 - DNA, 25 bp, Homo sapien
tctgtcctcagtgtcctgctggggc

SEQ ID NO: 138858 - DNA, 25 bp, Homo sapien
ctcagtgtcctgctggggcttaccc

SEQ ID NO: 138859 - DNA, 25 bp, Homo sapien
agacgcgctcctcctaggtcagcgt

SEQ ID NO: 138860 - DNA, 25 bp, Homo sapien
tcccagcgtcaggagtgcacatctg

SEQ ID NO: 138861 - DNA, 25 bp, Homo sapien
gagtgcacatctgaagcccgtcctg

SEQ ID NO: 138862 - DNA, 25 bp, Homo sapien
accgggtgaattcccagcgtcagga

SEQ ID NO: 138863 - DNA, 25 bp, Homo sapien
cctctgataaataaaataccgggtg

SEQ ID NO: 138864 - DNA, 25 bp, Homo sapien
actccaccttgacacctctgataaa

SEQ ID NO: 138865 - DNA, 25 bp, Homo sapien
agctcgtcctgggtctgcgtcacct

SEQ ID NO: 138866 - DNA, 25 bp, Homo sapien
ccgagacttacacgggtgcactcca

SEQ ID NO: 138867 - DNA, 25 bp, Homo sapien
gtgccagcgacacctgaagccagtc

SEQ ID NO: 138868 - DNA, 25 bp, Homo sapien
tgagtgccatctacagccagctggg

SEQ ID NO: 138869 - DNA, 25 bp, Homo sapien
tcgtctgtagtgaagccacggaggt

SEQ ID NO: 138870 - DNA, 25 bp, Homo sapien
ggccatgacgccaagttcctctgca

SEQ ID NO: 138871 - DNA, 25 bp, Homo sapien
tgggcaccgaggacctgaagacact

SEQ ID NO: 138872 - DNA, 25 bp, Homo sapien
gccagctgggcaacgcctacttcta

SEQ ID NO: 138873 - DNA, 25 bp, Homo sapien
gcctacttctacctgaaggagcacg

SEQ ID NO: 138874 - DNA, 25 bp, Homo sapien
ggaataccacaagcatgacctcctg

SEQ ID NO: 138875 - DNA, 25 bp, Homo sapien
cgacttcaagacaggcgtggccttc

SEQ ID NO: 138876 - DNA, 25 bp, Homo sapien
ggcggctgcgagcactcctttgagc

SEQ ID NO: 138877 - DNA, 25 bp, Homo sapien
aacacgcagatggaccgcttccggg

SEQ ID NO: 138878 - DNA, 25 bp, Homo sapien
tgaatgatgtacacgtgtaggaaac

SEQ ID NO: 138879 - DNA, 25 bp, Homo sapien
tacacgtgtaggaaacagcgggctc

SEQ ID NO: 138880 - DNA, 25 bp, Homo sapien
cggcggcggccgttcagtcccttgt

SEQ ID NO: 138881 - DNA, 25 bp, Homo sapien
cctgacagtaagaagaacacgcaga

SEQ ID NO: 138882 - DNA, 25 bp, Homo sapien
agcactcctttgagcggcgctgcac

SEQ ID NO: 138883 - DNA, 25 bp, Homo sapien
gcgctgcactcagcggagggttaca

SEQ ID NO: 138884 - DNA, 25 bp, Homo sapien
aggacaccggtgtgccggctctgca

SEQ ID NO: 138885 - DNA, 25 bp, Homo sapien
ctgtgcaaggcctccgagttctacg

SEQ ID NO: 138886 - DNA, 25 bp, Homo sapien
gtccgagagaccctgtgcaaggcct

SEQ ID NO: 138887 - DNA, 25 bp, Homo sapien
caactgtcctggaacgccgcaaacg

SEQ ID NO: 138888 - DNA, 25 bp, Homo sapien
gtaccacgccaaaggcaagcaactg

SEQ ID NO: 138889 - DNA, 25 bp, Homo sapien
caacatcgggaacgtgtaccacgcc

SEQ ID NO: 138890 - DNA, 25 bp, Homo sapien
ctccgtactgcccacaggttgggga

SEQ ID NO: 138891 - DNA, 25 bp, Homo sapien
gcgagggccctctacaacatcggga

SEQ ID NO: 138892 - DNA, 25 bp, Homo sapien
atgcgggcatggttactgcctctgg

SEQ ID NO: 138893 - DNA, 25 bp, Homo sapien
ggcatggttactgcctctggtgccc

SEQ ID NO: 138894 - DNA, 25 bp, Homo sapien
gtgcgacatcgcgatggcccagctc

SEQ ID NO: 138895 - DNA, 25 bp, Homo sapien
cgcgcgcaggtaccgtgcgacatcg

SEQ ID NO: 138896 - DNA, 25 bp, Homo sapien
cgcaggtaccgtgcgacatcgcgat

SEQ ID NO: 138897 - DNA, 25 bp, Homo sapien
tctatgcgggcatggttactgcctc

SEQ ID NO: 138898 - DNA, 25 bp, Homo sapien
tcccgggcagcgtcgtgcacgggtc

SEQ ID NO: 138899 - DNA, 25 bp, Homo sapien
taccgtgcgacatcgcgatggccca

SEQ ID NO: 138900 - DNA, 25 bp, Homo sapien
tggtgtcccgttgataaacacaagg

SEQ ID NO: 138901 - DNA, 25 bp, Homo sapien
gcgcggctcagtcagcgtattaatc

SEQ ID NO: 138902 - DNA, 25 bp, Homo sapien
cgacgttttctttcttggagccaag

SEQ ID NO: 138903 - DNA, 25 bp, Homo sapien
acgctggaacaatgcagcttctgtc

SEQ ID NO: 138904 - DNA, 25 bp, Homo sapien
ggaggcaggctgcacacctagagcc

SEQ ID NO: 138905 - DNA, 25 bp, Homo sapien
ccttgctgttgtgggcgtggtccat

SEQ ID NO: 138906 - DNA, 25 bp, Homo sapien
acaaggagacttacgtgcggctgga

SEQ ID NO: 138907 - DNA, 25 bp, Homo sapien
ggacaaagagccttggcgcggctca

SEQ ID NO: 138908 - DNA, 25 bp, Homo sapien
aacgcctcagccgactgtgcagaca

SEQ ID NO: 138909 - DNA, 25 bp, Homo sapien
tttccaaacgttgccctcgcaggcg

SEQ ID NO: 138910 - DNA, 25 bp, Homo sapien
agtttccaaacgttgccctcgcagg

SEQ ID NO: 138911 - DNA, 25 bp, Homo sapien
tgctgggagaagtttccaaacgttg

SEQ ID NO: 138912 - DNA, 25 bp, Homo sapien
actgtgcagacagagggtgcattga

SEQ ID NO: 138913 - DNA, 25 bp, Homo sapien
cagagggtgcattgagccaggcgca

SEQ ID NO: 138914 - DNA, 25 bp, Homo sapien
accgtccgtgcctggccatgagggc

SEQ ID NO: 138915 - DNA, 25 bp, Homo sapien
cgctggactcacactcaacgcctca

SEQ ID NO: 138916 - DNA, 25 bp, Homo sapien
cgccacaagcacactgggaacgatg

SEQ ID NO: 138917 - DNA, 25 bp, Homo sapien
tgatgaatgctgaaggttacgctgc

SEQ ID NO: 138918 - DNA, 25 bp, Homo sapien
ggttacgctgcccagaacgcttctg

SEQ ID NO: 138919 - DNA, 25 bp, Homo sapien
gtctggagctcctaacacacggcca

SEQ ID NO: 138920 - DNA, 25 bp, Homo sapien
cctggtttgctcactgtttcgccga

SEQ ID NO: 138921 - DNA, 25 bp, Homo sapien
ttctgcaaataaacaggctgctgtg

SEQ ID NO: 138922 - DNA, 25 bp, Homo sapien
tttgctcgctttcataaacacggga

SEQ ID NO: 138923 - DNA, 25 bp, Homo sapien
cacgggaacatcctgcgcacagaca

SEQ ID NO: 138924 - DNA, 25 bp, Homo sapien
gcctccgcaaaatgagtgccgctta

SEQ ID NO: 138925 - DNA, 25 bp, Homo sapien
cgcttcctgtgaagacaggtgtctc

SEQ ID NO: 138926 - DNA, 25 bp, Homo sapien
cccagcccgttttggagaagcctgg

SEQ ID NO: 138927 - DNA, 25 bp, Homo sapien
ggcctttcagggcaccagattcctc

SEQ ID NO: 138928 - DNA, 25 bp, Homo sapien
agattcctcgttccaggccaagtca

SEQ ID NO: 138929 - DNA, 25 bp, Homo sapien
tctgcatcttcctgagggcgcgctt

SEQ ID NO: 138930 - DNA, 25 bp, Homo sapien
atcctgaagttacacagatggcgtg

SEQ ID NO: 138931 - DNA, 25 bp, Homo sapien
gcgggtcacccgtgctgtttattta

SEQ ID NO: 138932 - DNA, 25 bp, Homo sapien
agcacaaggccgaccctcagtgagg

SEQ ID NO: 138933 - DNA, 25 bp, Homo sapien
ctgacgggacagcacaaggccgacc

SEQ ID NO: 138934 - DNA, 25 bp, Homo sapien
aggctccggaggacgtcaagccgct

SEQ ID NO: 138935 - DNA, 25 bp, Homo sapien
gctatggcctgacgggacagcacaa

SEQ ID NO: 138936 - DNA, 25 bp, Homo sapien
agctgcagctcatccgccttctcgc

SEQ ID NO: 138937 - DNA, 25 bp, Homo sapien
agtagctgcgcctcacactggaaca

SEQ ID NO: 138938 - DNA, 25 bp, Homo sapien
aggcccaccaggacgagcgtctcca

SEQ ID NO: 138939 - DNA, 25 bp, Homo sapien
tgtgcgtgcagctcctcccgcgtgg

SEQ ID NO: 138940 - DNA, 25 bp, Homo sapien
agctgcaggtcacggttccgcatga

SEQ ID NO: 138941 - DNA, 25 bp, Homo sapien
agtcatctttggagctcagcagcgc

SEQ ID NO: 138942 - DNA, 25 bp, Homo sapien
cgtcactcaccgatgatcatggaga

SEQ ID NO: 138943 - DNA, 25 bp, Homo sapien
cccgcagctccttgatgaagtcatc

SEQ ID NO: 138944 - DNA, 25 bp, Homo sapien
tgagcctctgcacacgctcctggtg

SEQ ID NO: 138945 - DNA, 25 bp, Homo sapien
gttctcctccttgcagcgcttgagc

SEQ ID NO: 138946 - DNA, 25 bp, Homo sapien
gctccttgcctgtgaccttcttgta

SEQ ID NO: 138947 - DNA, 25 bp, Homo sapien
ccttcttgtacagctgcgggtagta

SEQ ID NO: 138948 - DNA, 25 bp, Homo sapien
gctgcagaacaagagcgccgcgcgc

SEQ ID NO: 138949 - DNA, 25 bp, Homo sapien
ctgctcgctgcgtgaactggggaaa

SEQ ID NO: 138950 - DNA, 25 bp, Homo sapien
acgatgggcgtttaggcactggctt

SEQ ID NO: 138951 - DNA, 25 bp, Homo sapien
cctccacggggagagccctgaagct

SEQ ID NO: 138952 - DNA, 25 bp, Homo sapien
aggcgaacggctcgatgctgccctc

SEQ ID NO: 138953 - DNA, 25 bp, Homo sapien
ttaggcactggcttgggagacagac

SEQ ID NO: 138954 - DNA, 25 bp, Homo sapien
actagagaggcgaacggctcgatgc

SEQ ID NO: 138955 - DNA, 25 bp, Homo sapien
ggcgactgcagactcgacgcttccg

SEQ ID NO: 138956 - DNA, 25 bp, Homo sapien
cgtgaggctcacttactgcgtcgta

SEQ ID NO: 138957 - DNA, 25 bp, Homo sapien
accctctcggggtgagtctgctcga

SEQ ID NO: 138958 - DNA, 25 bp, Homo sapien
cagtgtcactcaacgcccacgaggg

SEQ ID NO: 138959 - DNA, 25 bp, Homo sapien
ccggagacacgcgagaatcagtgtc

SEQ ID NO: 138960 - DNA, 25 bp, Homo sapien
gcaaagtctgcgctaggactccctg

SEQ ID NO: 138961 - DNA, 25 bp, Homo sapien
cagagactctccatgaaccgcaaag

SEQ ID NO: 138962 - DNA, 25 bp, Homo sapien
cgcaggtgcctgtctcccagagact

SEQ ID NO: 138963 - DNA, 25 bp, Homo sapien
gtcgtaacttatctgcagcgtccgc

SEQ ID NO: 138964 - DNA, 25 bp, Homo sapien
acctatcctggtgaccttggcgtgc

SEQ ID NO: 138965 - DNA, 25 bp, Homo sapien
ccaggggcttatataggtgcgacta

SEQ ID NO: 138966 - DNA, 25 bp, Homo sapien
tgcgactaggatgttgcctcgtttt

SEQ ID NO: 138967 - DNA, 25 bp, Homo sapien
ctccaggtgaattgaaagtcgtttc

SEQ ID NO: 138968 - DNA, 25 bp, Homo sapien
tggcatgccctgaaactgcaagtcg

SEQ ID NO: 138969 - DNA, 25 bp, Homo sapien
ctcggcccgaagtaagtgcagcaga

SEQ ID NO: 138970 - DNA, 25 bp, Homo sapien
ctcgtttttcactcggggctgcgaa

SEQ ID NO: 138971 - DNA, 25 bp, Homo sapien
agggcattgctctttctgatggctg

SEQ ID NO: 138972 - DNA, 25 bp, Homo sapien
acgtgcacgttgcatccacatctgt

SEQ ID NO: 138973 - DNA, 25 bp, Homo sapien
tggaaccacgcacgtgcacgttgca

SEQ ID NO: 138974 - DNA, 25 bp, Homo sapien
tgcacgttgcatccacatctgtttc

SEQ ID NO: 138975 - DNA, 25 bp, Homo sapien
cgtgcacgttgcatccacatctgtt

SEQ ID NO: 138976 - DNA, 25 bp, Homo sapien
gaaccacgcacgtgcacgttgcatc

SEQ ID NO: 138977 - DNA, 25 bp, Homo sapien
gcatccacgtctgtttcctggaacc

SEQ ID NO: 138978 - DNA, 25 bp, Homo sapien
gtgcacgttgcatccacatctgttt

SEQ ID NO: 138979 - DNA, 25 bp, Homo sapien
ttgcatccacgtctgtttcctggaa

SEQ ID NO: 138980 - DNA, 25 bp, Homo sapien
tgtctatttcgtggaaccacgcacg

SEQ ID NO: 138981 - DNA, 25 bp, Homo sapien
cgtgcacattgcatccatgtctatt

SEQ ID NO: 138982 - DNA, 25 bp, Homo sapien
tacgtgcacgttgcatccacatctg

SEQ ID NO: 138983 - DNA, 25 bp, Homo sapien
tccacatctgtttcacggaatcacg

SEQ ID NO: 138984 - DNA, 25 bp, Homo sapien
catgtgtttcatggaaccacgtacg

SEQ ID NO: 138985 - DNA, 25 bp, Homo sapien
catgcacgtcgcatccacgtctgtt

SEQ ID NO: 138986 - DNA, 25 bp, Homo sapien
ctgtttcacggaatcacgcacatgc

SEQ ID NO: 138987 - DNA, 25 bp, Homo sapien
cgcatgttgcatccacgtctgtttc

SEQ ID NO: 138988 - DNA, 25 bp, Homo sapien
aacagcgactttactgcgtgccggg

SEQ ID NO: 138989 - DNA, 25 bp, Homo sapien
acctaccgcgtgctccttcaggagg

SEQ ID NO: 138990 - DNA, 25 bp, Homo sapien
ggctcgagtctttctggacgctccg

SEQ ID NO: 138991 - DNA, 25 bp, Homo sapien
agaccggcgctcatagaacgctgga

SEQ ID NO: 138992 - DNA, 25 bp, Homo sapien
ggacgctccgtcttcggtttctaca

SEQ ID NO: 138993 - DNA, 25 bp, Homo sapien
tttctacaggtgacatggcgcccgt

SEQ ID NO: 138994 - DNA, 25 bp, Homo sapien
tgcggtctgtccgttgatctctgac

SEQ ID NO: 138995 - DNA, 25 bp, Homo sapien
cagctctgttagacccgcagggttc

SEQ ID NO: 138996 - DNA, 25 bp, Homo sapien
tggcatccgacggcgctcctgacgc

SEQ ID NO: 138997 - DNA, 25 bp, Homo sapien
ctcctgacgcggcatgggtggctca

SEQ ID NO: 138998 - DNA, 25 bp, Homo sapien
cgctcgtgacacagcgtgggtggct

SEQ ID NO: 138999 - DNA, 25 bp, Homo sapien
ctgacggcgctcgtgacacagcgtg

SEQ ID NO: 139000 - DNA, 25 bp, Homo sapien
tctgacggcgctcgtgacacagcgt

SEQ ID NO: 139001 - DNA, 25 bp, Homo sapien
gtctgacggcgctcgtgacacagcg

SEQ ID NO: 139002 - DNA, 25 bp, Homo sapien
cgtctgacggcgctcgtgacacagc

SEQ ID NO: 139003 - DNA, 25 bp, Homo sapien
cggcatgggtggctcagccagctct

SEQ ID NO: 139004 - DNA, 25 bp, Homo sapien
taactattcggtgcgttgggcagcg

SEQ ID NO: 139005 - DNA, 25 bp, Homo sapien
ctggatcggcctccgaccgtaacta

SEQ ID NO: 139006 - DNA, 25 bp, Homo sapien
cggagaatcgaagcgctacctgatt

SEQ ID NO: 139007 - DNA, 25 bp, Homo sapien
agggaccgcggtatctttccaggca

SEQ ID NO: 139008 - DNA, 25 bp, Homo sapien
tgctcggaggaggtgctattaactc

SEQ ID NO: 139009 - DNA, 25 bp, Homo sapien
actccgagcacttagcgaatgtggc

SEQ ID NO: 139010 - DNA, 25 bp, Homo sapien
caaaggcgtgtttgagtgcgttcac

SEQ ID NO: 139011 - DNA, 25 bp, Homo sapien
gtcagccgaaggctccatgctgctc

SEQ ID NO: 139012 - DNA, 25 bp, Homo sapien
aggcgcaggccacactgttatcgtc

SEQ ID NO: 139013 - DNA, 25 bp, Homo sapien
cgcaggccacactgttatcgtcttg

SEQ ID NO: 139014 - DNA, 25 bp, Homo sapien
gccacactgttatcgtcttgccctt

SEQ ID NO: 139015 - DNA, 25 bp, Homo sapien
tgcccttcttcgcaggttcgagaaa

SEQ ID NO: 139016 - DNA, 25 bp, Homo sapien
ttcttcgcaggttcgagaaatggta

SEQ ID NO: 139017 - DNA, 25 bp, Homo sapien
cggaaccgtggacacggtaagtgca

SEQ ID NO: 139018 - DNA, 25 bp, Homo sapien
accgtggacacggtaagtgcagtgt

SEQ ID NO: 139019 - DNA, 25 bp, Homo sapien
aagtgcagtgtggcgccatttccag

SEQ ID NO: 139020 - DNA, 25 bp, Homo sapien
acctgactgacctgcccacgtatga

SEQ ID NO: 139021 - DNA, 25 bp, Homo sapien
cacccacgcggtttgcattcttttg

SEQ ID NO: 139022 - DNA, 25 bp, Homo sapien
tcgcttctaagatgctccgagggaa

SEQ ID NO: 139023 - DNA, 25 bp, Homo sapien
agcttttctaacatggaggccttcc

SEQ ID NO: 139024 - DNA, 25 bp, Homo sapien
ctggcatctttcttagcacggtgtt

SEQ ID NO: 139025 - DNA, 25 bp, Homo sapien
tccctggtaataaagagctggcatc

SEQ ID NO: 139026 - DNA, 25 bp, Homo sapien
ccaccgtgctgggtaccaggactca

SEQ ID NO: 139027 - DNA, 25 bp, Homo sapien
tgacacgcgtttgccctctgcacta

SEQ ID NO: 139028 - DNA, 25 bp, Homo sapien
aagctcaggacgctgcctcttcaga

SEQ ID NO: 139029 - DNA, 25 bp, Homo sapien
gggtccttggcgtgcatcttagcaa

SEQ ID NO: 139030 - DNA, 25 bp, Homo sapien
cagccagtgacatttccgcctcgga

SEQ ID NO: 139031 - DNA, 25 bp, Homo sapien
ctaaagcgccgcacctctggactgt

SEQ ID NO: 139032 - DNA, 25 bp, Homo sapien
tacagtcctggtgtagtccagcagc

SEQ ID NO: 139033 - DNA, 25 bp, Homo sapien
ccactaaccgtgctaaagaaccgcg

SEQ ID NO: 139034 - DNA, 25 bp, Homo sapien
gccactcaggcggaagttgaagtct

SEQ ID NO: 139035 - DNA, 25 bp, Homo sapien
tccggatgctcgagtctccctaaag

SEQ ID NO: 139036 - DNA, 25 bp, Homo sapien
tctccaagcacgagtctgtccaacg

SEQ ID NO: 139037 - DNA, 25 bp, Homo sapien
aaacacgcctcacgttggccctcgg

SEQ ID NO: 139038 - DNA, 25 bp, Homo sapien
ctcggcctgtttccctctccaagca

SEQ ID NO: 139039 - DNA, 25 bp, Homo sapien
caagcacgagtctgtccaacgacca

SEQ ID NO: 139040 - DNA, 25 bp, Homo sapien
ctgtatgaccctcccgtcaccatga

SEQ ID NO: 139041 - DNA, 25 bp, Homo sapien
accttgagcaggtgattctcggcca

SEQ ID NO: 139042 - DNA, 25 bp, Homo sapien
tgagcaggtgattctcggccaggcc

SEQ ID NO: 139043 - DNA, 25 bp, Homo sapien
ggcagcctctgacacaccaaacacg

SEQ ID NO: 139044 - DNA, 25 bp, Homo sapien
tccagcccttgtcgtccagggacag

SEQ ID NO: 139045 - DNA, 25 bp, Homo sapien
actggtcccattccgggcttccagg

SEQ ID NO: 139046 - DNA, 25 bp, Homo sapien
gggatttcctgcaaggaggtgctca

SEQ ID NO: 139047 - DNA, 25 bp, Homo sapien
agtctgcaagatccgagtcgacctt

SEQ ID NO: 139048 - DNA, 25 bp, Homo sapien
agctgtccttggagcgtcctccctt

SEQ ID NO: 139049 - DNA, 25 bp, Homo sapien
cgcgcggagcttgtagtctgcaaga

SEQ ID NO: 139050 - DNA, 25 bp, Homo sapien
gccgcagattctccgccttggacgg

SEQ ID NO: 139051 - DNA, 25 bp, Homo sapien
gtcgaccttgtttgctgtcctcagg

SEQ ID NO: 139052 - DNA, 25 bp, Homo sapien
gcttccaaatgctctgcgctcactg

SEQ ID NO: 139053 - DNA, 25 bp, Homo sapien
cgcgagtggagcgacaaagtccgca

SEQ ID NO: 139054 - DNA, 25 bp, Homo sapien
gtcccgcttgggttcaggacgtcaa

SEQ ID NO: 139055 - DNA, 25 bp, Homo sapien
aggacgtcaacgtagcgagctctgg

SEQ ID NO: 139056 - DNA, 25 bp, Homo sapien
gctctggttcctgctgcaaagggga

SEQ ID NO: 139057 - DNA, 25 bp, Homo sapien
gtgaacgcgccaggtggcctccagc

SEQ ID NO: 139058 - DNA, 25 bp, Homo sapien
tgcgctcactgcgtcagaggaaaag

SEQ ID NO: 139059 - DNA, 25 bp, Homo sapien
gaagcaaattgaggtgaacgcgcca

SEQ ID NO: 139060 - DNA, 25 bp, Homo sapien
tgggacccgagtcggcacgatccca

SEQ ID NO: 139061 - DNA, 25 bp, Homo sapien
gagtcggcacgatcccaccctgggg

SEQ ID NO: 139062 - DNA, 25 bp, Homo sapien
tccgagtctggcaccgtcctcgagg

SEQ ID NO: 139063 - DNA, 25 bp, Homo sapien
ctgcctgtccgggtctctttgtttc

SEQ ID NO: 139064 - DNA, 25 bp, Homo sapien
ttcgtttctttcttggctgcctgtc

SEQ ID NO: 139065 - DNA, 25 bp, Homo sapien
caggctgtactaccttcttaggttc

SEQ ID NO: 139066 - DNA, 25 bp, Homo sapien
gtgggcaggctgtactaccttctta

SEQ ID NO: 139067 - DNA, 25 bp, Homo sapien
tgggaagcgtgcctcctgcccaaac

SEQ ID NO: 139068 - DNA, 25 bp, Homo sapien
tgttcatagcgcttggtcccacaga

SEQ ID NO: 139069 - DNA, 25 bp, Homo sapien
cggagctgagtaaggacctggcaca

SEQ ID NO: 139070 - DNA, 25 bp, Homo sapien
ggcctgcgtggatgccatgttcata

SEQ ID NO: 139071 - DNA, 25 bp, Homo sapien
tggcaggcattattgggcagcactc

SEQ ID NO: 139072 - DNA, 25 bp, Homo sapien
cgaactgagatccagccggttggca

SEQ ID NO: 139073 - DNA, 25 bp, Homo sapien
cgttactcgcactcgaactgagatc

SEQ ID NO: 139074 - DNA, 25 bp, Homo sapien
gtgtgtgtgacgcacgttactcgca

SEQ ID NO: 139075 - DNA, 25 bp, Homo sapien
agacacctggacacccgctgtcgga

SEQ ID NO: 139076 - DNA, 25 bp, Homo sapien
tctgggctggcccttccaccgacgg

SEQ ID NO: 139077 - DNA, 25 bp, Homo sapien
ggcatctggacttgactccctggag

SEQ ID NO: 139078 - DNA, 25 bp, Homo sapien
cccagacacggtgcggctgaggctc

SEQ ID NO: 139079 - DNA, 25 bp, Homo sapien
tctggacttgactccctggagctct

SEQ ID NO: 139080 - DNA, 25 bp, Homo sapien
cgcgctggtgaggttcactgacgaa

SEQ ID NO: 139081 - DNA, 25 bp, Homo sapien
tcatccaggcatgcggacctgcgtg

SEQ ID NO: 139082 - DNA, 25 bp, Homo sapien
cgtgctcatccaggcatgcggacct

SEQ ID NO: 139083 - DNA, 25 bp, Homo sapien
gttcactgacgaaggaagccgagaa

SEQ ID NO: 139084 - DNA, 25 bp, Homo sapien
cccataagggtctctgtgcggatcg

SEQ ID NO: 139085 - DNA, 25 bp, Homo sapien
tgttgtcacgtttctcgggcctaga

SEQ ID NO: 139086 - DNA, 25 bp, Homo sapien
ggggccgaggcacaacacagcacac

SEQ ID NO: 139087 - DNA, 25 bp, Homo sapien
gggccctctgacgtgcaacgttaga

SEQ ID NO: 139088 - DNA, 25 bp, Homo sapien
gttagagaagtactgcgaatgcgtc

SEQ ID NO: 139089 - DNA, 25 bp, Homo sapien
cgaatgcgtctccagtgtggtcact

SEQ ID NO: 139090 - DNA, 25 bp, Homo sapien
gatcggggtcatcgtcaaaactccc

SEQ ID NO: 139091 - DNA, 25 bp, Homo sapien
aggatcgtacctccagttgttgtca

SEQ ID NO: 139092 - DNA, 25 bp, Homo sapien
ctcgcagcaggaggaccggacaaag

SEQ ID NO: 139093 - DNA, 25 bp, Homo sapien
cgaagtgaggccacggcttcccgtc

SEQ ID NO: 139094 - DNA, 25 bp, Homo sapien
ggacacacgccagaattcacgctta

SEQ ID NO: 139095 - DNA, 25 bp, Homo sapien
cctggcaggaaatgtgaaatcacag

SEQ ID NO: 139096 - DNA, 25 bp, Homo sapien
gcttaagcgcctcaaagcctcaagg

SEQ ID NO: 139097 - DNA, 25 bp, Homo sapien
cggacaccacagcaagaggcacggc

SEQ ID NO: 139098 - DNA, 25 bp, Homo sapien
acaaaggacccgaagtgaggccacg

SEQ ID NO: 139099 - DNA, 25 bp, Homo sapien
agcaaaacagactcatccttggcca

SEQ ID NO: 139100 - DNA, 25 bp, Homo sapien
ggagcagcgtgcatctcatctcttg

SEQ ID NO: 139101 - DNA, 25 bp, Homo sapien
cgcggccagtgaaatcccaatcgtc

SEQ ID NO: 139102 - DNA, 25 bp, Homo sapien
cccaggtccgcagttatgataacgg

SEQ ID NO: 139103 - DNA, 25 bp, Homo sapien
tcacatcgctcctgcggaaagtgcg

SEQ ID NO: 139104 - DNA, 25 bp, Homo sapien
cgcggtggagtgataattggaccta

SEQ ID NO: 139105 - DNA, 25 bp, Homo sapien
ggacctagcgtctaaattcttgttg

SEQ ID NO: 139106 - DNA, 25 bp, Homo sapien
ggacctcgttccagctgccagttaa

SEQ ID NO: 139107 - DNA, 25 bp, Homo sapien
tgccagttaagcctctgggatccgc

SEQ ID NO: 139108 - DNA, 25 bp, Homo sapien
acggcaaagagtactgaggctggta

SEQ ID NO: 139109 - DNA, 25 bp, Homo sapien
gcatcgtacaaaggccggtagtagt

SEQ ID NO: 139110 - DNA, 25 bp, Homo sapien
cgactcgactcttacctggtaatag

SEQ ID NO: 139111 - DNA, 25 bp, Homo sapien
aggctggtaggcatcgtacaaaggc

SEQ ID NO: 139112 - DNA, 25 bp, Homo sapien
tggccacggctgctctgacggcaca

SEQ ID NO: 139113 - DNA, 25 bp, Homo sapien
ctgctctgacggcacagctgcctgg

SEQ ID NO: 139114 - DNA, 25 bp, Homo sapien
ccggagccactggacaccagagaca

SEQ ID NO: 139115 - DNA, 25 bp, Homo sapien
cagagacacgctagaggactgagga

SEQ ID NO: 139116 - DNA, 25 bp, Homo sapien
tcagtctgcaggaccgatgccagca

SEQ ID NO: 139117 - DNA, 25 bp, Homo sapien
gtcttccacgccttatcctgtagtt

SEQ ID NO: 139118 - DNA, 25 bp, Homo sapien
gtcgttcctcgcctcattctttcgt

SEQ ID NO: 139119 - DNA, 25 bp, Homo sapien
ttcttcaatcaaggccacaagcggg

SEQ ID NO: 139120 - DNA, 25 bp, Homo sapien
caggctcacgcaccgagaacggcta

SEQ ID NO: 139121 - DNA, 25 bp, Homo sapien
gagaacggctactccgcccagctga

SEQ ID NO: 139122 - DNA, 25 bp, Homo sapien
ctcctcgcattcttccgttgggctg

SEQ ID NO: 139123 - DNA, 25 bp, Homo sapien
tcgccctgtttacgctggctctttc

SEQ ID NO: 139124 - DNA, 25 bp, Homo sapien
gcggtccatatgatccgtgatgtcc

SEQ ID NO: 139125 - DNA, 25 bp, Homo sapien
cacgatgtcgtgatgcatgcgctcc

SEQ ID NO: 139126 - DNA, 25 bp, Homo sapien
caccaggttgtactcgtccagcagc

SEQ ID NO: 139127 - DNA, 25 bp, Homo sapien
tgtcccggttggcaaagtggtccag

SEQ ID NO: 139128 - DNA, 25 bp, Homo sapien
ggcttgcggaccttcttgccctgca

SEQ ID NO: 139129 - DNA, 25 bp, Homo sapien
cagcagcaccttggcggtctcgtag

SEQ ID NO: 139130 - DNA, 25 bp, Homo sapien
tgggacttcttcctccgtgccttga

SEQ ID NO: 139131 - DNA, 25 bp, Homo sapien
ggccacgtctgacaggtagccatgg

SEQ ID NO: 139132 - DNA, 25 bp, Homo sapien
cggcatccacattgttcacggcggc

SEQ ID NO: 139133 - DNA, 25 bp, Homo sapien
ggtttggccctcacttctctgtgga

SEQ ID NO: 139134 - DNA, 25 bp, Homo sapien
tctctgtggattcagccctcacgtc

SEQ ID NO: 139135 - DNA, 25 bp, Homo sapien
cgcgctcaccctgttgttctgcata

SEQ ID NO: 139136 - DNA, 25 bp, Homo sapien
gcggacttgcctgcgtgaaagaagc

SEQ ID NO: 139137 - DNA, 25 bp, Homo sapien
tcgtgccatcatgcatgcgggcatc

SEQ ID NO: 139138 - DNA, 25 bp, Homo sapien
agacgagaccctcctgagatcggca

SEQ ID NO: 139139 - DNA, 25 bp, Homo sapien
ctcacccaggtcatctacggcgttg

SEQ ID NO: 139140 - DNA, 25 bp, Homo sapien
ccctggtagatgaagtcggagatga

SEQ ID NO: 139141 - DNA, 25 bp, Homo sapien
tcgctgttgcccgtctccaggccgc

SEQ ID NO: 139142 - DNA, 25 bp, Homo sapien
ccaggtgcaaggcggtctcgcccgt

SEQ ID NO: 139143 - DNA, 25 bp, Homo sapien
ccagcaggcgcttggcggcatcaga

SEQ ID NO: 139144 - DNA, 25 bp, Homo sapien
gtcctggatgttggcatctgcgctg

SEQ ID NO: 139145 - DNA, 25 bp, Homo sapien
ccatgttgtcctggatgttggcatc

SEQ ID NO: 139146 - DNA, 25 bp, Homo sapien
tgcggcccatgttgtcctggatgtt

SEQ ID NO: 139147 - DNA, 25 bp, Homo sapien
acacagccgcatgcagcggggtgcg

SEQ ID NO: 139148 - DNA, 25 bp, Homo sapien
cgcggacattgacgtccatgcagtc

SEQ ID NO: 139149 - DNA, 25 bp, Homo sapien
cacgtacatgaagtgcagctgcgcc

SEQ ID NO: 139150 - DNA, 25 bp, Homo sapien
cagacactttgaagccctcagggaa

SEQ ID NO: 139151 - DNA, 25 bp, Homo sapien
cgcttcttcttgctggcctcagaca

SEQ ID NO: 139152 - DNA, 25 bp, Homo sapien
agggcaccgtctgaagcgttcttca

SEQ ID NO: 139153 - DNA, 25 bp, Homo sapien
ccactcattctggttgtcgtccatg

SEQ ID NO: 139154 - DNA, 25 bp, Homo sapien
ccacgggctcctcgaactacataga

SEQ ID NO: 139155 - DNA, 25 bp, Homo sapien
gcgactcacccggaacttcttggtc

SEQ ID NO: 139156 - DNA, 25 bp, Homo sapien
tcaagagcttccacagtgatctagc

SEQ ID NO: 139157 - DNA, 25 bp, Homo sapien
ggagaactcaaaacatcaagagctt

SEQ ID NO: 139158 - DNA, 25 bp, Homo sapien
aactcaactcaaggtgttggaggcc

SEQ ID NO: 139159 - DNA, 25 bp, Homo sapien
cctgcccttgttgagcactgaaaga

SEQ ID NO: 139160 - DNA, 25 bp, Homo sapien
tgcctcagcagcgtggaatccacgc

SEQ ID NO: 139161 - DNA, 25 bp, Homo sapien
acggtgtcgagttgggcccgctcct

SEQ ID NO: 139162 - DNA, 25 bp, Homo sapien
ggaatccacgccatgaaaccataac

SEQ ID NO: 139163 - DNA, 25 bp, Homo sapien
ctgaaagacagaaggttaggacatg

SEQ ID NO: 139164 - DNA, 25 bp, Homo sapien
tgggtagcaactggcacaaacagcc

SEQ ID NO: 139165 - DNA, 25 bp, Homo sapien
tgcacggcctcgatcttgtagggga

SEQ ID NO: 139166 - DNA, 25 bp, Homo sapien
cgggatggggccacacttactctgc

SEQ ID NO: 139167 - DNA, 25 bp, Homo sapien
gcctcgatcttgtaggggatgttga

SEQ ID NO: 139168 - DNA, 25 bp, Homo sapien
cacaaacagccagcgtgtctggggc

SEQ ID NO: 139169 - DNA, 25 bp, Homo sapien
acacccgtgggtagcaactggcaca

SEQ ID NO: 139170 - DNA, 25 bp, Homo sapien
gctcacacccgtgggtagcaactgg

SEQ ID NO: 139171 - DNA, 25 bp, Homo sapien
tgcaggcagagcctgttcccgggat

SEQ ID NO: 139172 - DNA, 25 bp, Homo sapien
agtggccgtcactgaagtacttcca

SEQ ID NO: 139173 - DNA, 25 bp, Homo sapien
gccaggccacatccaagttcaggtc

SEQ ID NO: 139174 - DNA, 25 bp, Homo sapien
cttagaactgcatgctggcctccgg

SEQ ID NO: 139175 - DNA, 25 bp, Homo sapien
agtggtccttgcagtactggtcgta

SEQ ID NO: 139176 - DNA, 25 bp, Homo sapien
tctcgggtacatgctccgcacagtc

SEQ ID NO: 139177 - DNA, 25 bp, Homo sapien
ccgtgtgcgtcacgcttgaagacca

SEQ ID NO: 139178 - DNA, 25 bp, Homo sapien
ccgtagtaggggaagatcatctgct

SEQ ID NO: 139179 - DNA, 25 bp, Homo sapien
cgctggcagtcaaagccgtcgaaga

SEQ ID NO: 139180 - DNA, 25 bp, Homo sapien
ggtccacgcaggtgccgttgttaaa

SEQ ID NO: 139181 - DNA, 25 bp, Homo sapien
cagtcgtccacgttgatctcacagt

SEQ ID NO: 139182 - DNA, 25 bp, Homo sapien
cccattcttgcagggcttgcctttg

SEQ ID NO: 139183 - DNA, 25 bp, Homo sapien
ttggacaggcactcgttgacatccc

SEQ ID NO: 139184 - DNA, 25 bp, Homo sapien
cactcgcagtggaagtcattgacgc

SEQ ID NO: 139185 - DNA, 25 bp, Homo sapien
cagccattgatgacggactcgcagc

SEQ ID NO: 139186 - DNA, 25 bp, Homo sapien
gcacctaccgcagggcacttgcaga

SEQ ID NO: 139187 - DNA, 25 bp, Homo sapien
gccaggtttcgtcagtggcccaagc

SEQ ID NO: 139188 - DNA, 25 bp, Homo sapien
cgctgggcacgtcgcagtaaaggcc

SEQ ID NO: 139189 - DNA, 25 bp, Homo sapien
tactgggtgtgggtctgccagcatt

SEQ ID NO: 139190 - DNA, 25 bp, Homo sapien
ccgctggggcactcgcagcggtact

SEQ ID NO: 139191 - DNA, 25 bp, Homo sapien
cgtcgcagtaaaggccggtccagcc

SEQ ID NO: 139192 - DNA, 25 bp, Homo sapien
ggagtcacaccagtgcacaaggttc

SEQ ID NO: 139193 - DNA, 25 bp, Homo sapien
accagtgcacaaggttctggggaca

SEQ ID NO: 139194 - DNA, 25 bp, Homo sapien
ctgccagcatttgccgccgttcttg

SEQ ID NO: 139195 - DNA, 25 bp, Homo sapien
ttcttgcagggcgaggagtcacacc

SEQ ID NO: 139196 - DNA, 25 bp, Homo sapien
cggacctccaagatctcggaacggc

SEQ ID NO: 139197 - DNA, 25 bp, Homo sapien
agcgaggtcatctcattgctctatc

SEQ ID NO: 139198 - DNA, 25 bp, Homo sapien
cgtcctcgcgtagaatggttgtctt

SEQ ID NO: 139199 - DNA, 25 bp, Homo sapien
taaactaaaccgctgcacgcctctg

SEQ ID NO: 139200 - DNA, 25 bp, Homo sapien
gcctctgacgcgacatctggacacg

SEQ ID NO: 139201 - DNA, 25 bp, Homo sapien
ccgagtcctttgtgtctagcccatt

SEQ ID NO: 139202 - DNA, 25 bp, Homo sapien
ccgctcctcttctagatttggaaaa

SEQ ID NO: 139203 - DNA, 25 bp, Homo sapien
ttaaccttcacgacagccgcggagc

SEQ ID NO: 139204 - DNA, 25 bp, Homo sapien
aggcgtgttgttctcacagtggatc

SEQ ID NO: 139205 - DNA, 25 bp, Homo sapien
gggtcactggcacactcgttgatgt

SEQ ID NO: 139206 - DNA, 25 bp, Homo sapien
gctgtccacgcagtccgtgcagttg

SEQ ID NO: 139207 - DNA, 25 bp, Homo sapien
gcaggtgcacgtgtagctgtccacg

SEQ ID NO: 139208 - DNA, 25 bp, Homo sapien
ttctcacagtggatcccgctgaagc

SEQ ID NO: 139209 - DNA, 25 bp, Homo sapien
aggctgccagctactgcgtgtggcc

SEQ ID NO: 139210 - DNA, 25 bp, Homo sapien
tgttgatgccgtctgtgcaggagcc

SEQ ID NO: 139211 - DNA, 25 bp, Homo sapien
tcgcagaaggccgtgttgatgccgt

SEQ ID NO: 139212 - DNA, 25 bp, Homo sapien
ggtctcgcagttgcgcccactgtag

SEQ ID NO: 139213 - DNA, 25 bp, Homo sapien
tcgtcgatgtcggtctcgcagttgc

SEQ ID NO: 139214 - DNA, 25 bp, Homo sapien
cagtcgtcgatgtcggtctcgcagt

SEQ ID NO: 139215 - DNA, 25 bp, Homo sapien
cactgtagccggcctggcagtggca

SEQ ID NO: 139216 - DNA, 25 bp, Homo sapien
cgcggggctactcactgggccggca

SEQ ID NO: 139217 - DNA, 25 bp, Homo sapien
agttgcgcccactgtagccggcctg

SEQ ID NO: 139218 - DNA, 25 bp, Homo sapien
cactgggccggcagtcgtcgatgtc

SEQ ID NO: 139219 - DNA, 25 bp, Homo sapien
atgtcggtctcgcagttgcgcccac

SEQ ID NO: 139220 - DNA, 25 bp, Homo sapien
gtcccgccgggaggcaaatgtgcac

SEQ ID NO: 139221 - DNA, 25 bp, Homo sapien
gcctgctggtctttccgccatcaga

SEQ ID NO: 139222 - DNA, 25 bp, Homo sapien
ctgctggtctttccgccatcagagt

SEQ ID NO: 139223 - DNA, 25 bp, Homo sapien
tggtctttccgccatcagagtgccg

SEQ ID NO: 139224 - DNA, 25 bp, Homo sapien
ttccgccatcagagtgccgtctgct

SEQ ID NO: 139225 - DNA, 25 bp, Homo sapien
ccgccgggaggcaaatgtgcaccga

SEQ ID NO: 139226 - DNA, 25 bp, Homo sapien
gggaggcaaatgtgcaccgagaccc

SEQ ID NO: 139227 - DNA, 25 bp, Homo sapien
tctttccgccatcagagtgccgtct

SEQ ID NO: 139228 - DNA, 25 bp, Homo sapien
acgtcaacctcgatttccctgtctg

SEQ ID NO: 139229 - DNA, 25 bp, Homo sapien
gatgttacacatgctccctaagggc

SEQ ID NO: 139230 - DNA, 25 bp, Homo sapien
catacccgttgaggctgtcccggca

SEQ ID NO: 139231 - DNA, 25 bp, Homo sapien
tgctgttgcactcattgacctcaga

SEQ ID NO: 139232 - DNA, 25 bp, Homo sapien
gcactcattgacctcagacaggcag

SEQ ID NO: 139233 - DNA, 25 bp, Homo sapien
cagcggcaggtgaagccattgatgc

SEQ ID NO: 139234 - DNA, 25 bp, Homo sapien
ccattgatgccgtcctcgcaggtgc

SEQ ID NO: 139235 - DNA, 25 bp, Homo sapien
cactcatcgatgttgatgttacaca

SEQ ID NO: 139236 - DNA, 25 bp, Homo sapien
agcactcgttgatgttggtctcgca

SEQ ID NO: 139237 - DNA, 25 bp, Homo sapien
atcgatcttgtccagacaggtgccc

SEQ ID NO: 139238 - DNA, 25 bp, Homo sapien
ctgctggcacagtcatccaggttga

SEQ ID NO: 139239 - DNA, 25 bp, Homo sapien
tccaggttgatctcgcagttgggtc

SEQ ID NO: 139240 - DNA, 25 bp, Homo sapien
caggaagacttaggactggcggccc

SEQ ID NO: 139241 - DNA, 25 bp, Homo sapien
cggggtcgcactcatcgatgtccac

SEQ ID NO: 139242 - DNA, 25 bp, Homo sapien
cgacgccgtccttgcaggagccgta

SEQ ID NO: 139243 - DNA, 25 bp, Homo sapien
ggcacactcgtagccatcgatcttg

SEQ ID NO: 139244 - DNA, 25 bp, Homo sapien
aagacgccggatctagctgggcatc

SEQ ID NO: 139245 - DNA, 25 bp, Homo sapien
tcactctctcgctggctcgaggggc

SEQ ID NO: 139246 - DNA, 25 bp, Homo sapien
cgcaactcgggccaactgcggggca

SEQ ID NO: 139247 - DNA, 25 bp, Homo sapien
ctgctggcgctgactgcgctccagt

SEQ ID NO: 139248 - DNA, 25 bp, Homo sapien
ttctcaagtccctggcagcgcgcat

SEQ ID NO: 139249 - DNA, 25 bp, Homo sapien
gcgcatctcccggacttggacagac

SEQ ID NO: 139250 - DNA, 25 bp, Homo sapien
acttggacagacctggggagaccct

SEQ ID NO: 139251 - DNA, 25 bp, Homo sapien
actgcgctccagtgcccaggtaacg

SEQ ID NO: 139252 - DNA, 25 bp, Homo sapien
ggttcgagacgcactcgttgacgtc

SEQ ID NO: 139253 - DNA, 25 bp, Homo sapien
cgtcgttctggcacgggttcgagac

SEQ ID NO: 139254 - DNA, 25 bp, Homo sapien
tcgttgacgtcgatctcgcatcggg

SEQ ID NO: 139255 - DNA, 25 bp, Homo sapien
tgcagacactggcactcgaaggagc

SEQ ID NO: 139256 - DNA, 25 bp, Homo sapien
cgtgttgatgcacttgcccgcatgc

SEQ ID NO: 139257 - DNA, 25 bp, Homo sapien
acttgcccgcatgctcgcaggggtt

SEQ ID NO: 139258 - DNA, 25 bp, Homo sapien
acgcaccgggcatgcagatgcactg

SEQ ID NO: 139259 - DNA, 25 bp, Homo sapien
gagcccagcgtgttgatgcacttgc

SEQ ID NO: 139260 - DNA, 25 bp, Homo sapien
gcagtctggggaactcgccatcccg

SEQ ID NO: 139261 - DNA, 25 bp, Homo sapien
cgggcttctggccacactcgttgac

SEQ ID NO: 139262 - DNA, 25 bp, Homo sapien
aggtgcctccgtggcggcaaagccc

SEQ ID NO: 139263 - DNA, 25 bp, Homo sapien
ccgacctcgttgtggcaggtgcctc

SEQ ID NO: 139264 - DNA, 25 bp, Homo sapien
caggcacactcgtgggtgacgtcgc

SEQ ID NO: 139265 - DNA, 25 bp, Homo sapien
agcgggcagcactacctggcaggca

SEQ ID NO: 139266 - DNA, 25 bp, Homo sapien
cgacaccacacgcagtctggggaac

SEQ ID NO: 139267 - DNA, 25 bp, Homo sapien
tctggccacactcgttgacatcctg

SEQ ID NO: 139268 - DNA, 25 bp, Homo sapien
gcatcggacaccacagggaaggccc

SEQ ID NO: 139269 - DNA, 25 bp, Homo sapien
cataaatcaggcgtcggtgctcgga

SEQ ID NO: 139270 - DNA, 25 bp, Homo sapien
taacgaggctgtatcacgccgggcc

SEQ ID NO: 139271 - DNA, 25 bp, Homo sapien
ccggacgcatcccagttaacgaggc

SEQ ID NO: 139272 - DNA, 25 bp, Homo sapien
ggactgtgggagaatctgcccaacc

SEQ ID NO: 139273 - DNA, 25 bp, Homo sapien
cagcctgggcatcggacaccacagg

SEQ ID NO: 139274 - DNA, 25 bp, Homo sapien
ccacggcttggaggttccgtgagac

SEQ ID NO: 139275 - DNA, 25 bp, Homo sapien
cttggaggttccgtgagacgcgcta

SEQ ID NO: 139276 - DNA, 25 bp, Homo sapien
aggaatcctcctctcggaacaccgc

SEQ ID NO: 139277 - DNA, 25 bp, Homo sapien
gccgcagatggacggcggcttcagt

SEQ ID NO: 139278 - DNA, 25 bp, Homo sapien
cactggtgaaagagggacgaagccg

SEQ ID NO: 139279 - DNA, 25 bp, Homo sapien
ccctgctctctgaccacacgaggca

SEQ ID NO: 139280 - DNA, 25 bp, Homo sapien
agtggtggccccagaggtcacctca

SEQ ID NO: 139281 - DNA, 25 bp, Homo sapien
tgtgcctcccgattcggccgcagat

SEQ ID NO: 139282 - DNA, 25 bp, Homo sapien
aacaccgctcgcctgccggcccagt

SEQ ID NO: 139283 - DNA, 25 bp, Homo sapien
cggaggagcactcctggcatcccgg

SEQ ID NO: 139284 - DNA, 25 bp, Homo sapien
ttgtcatctcggcacgagggcgacc

SEQ ID NO: 139285 - DNA, 25 bp, Homo sapien
gcatctctaataaagccaggtctcc

SEQ ID NO: 139286 - DNA, 25 bp, Homo sapien
agtttcctcctttggacttgatgag

SEQ ID NO: 139287 - DNA, 25 bp, Homo sapien
ggcacgaacgcatctctaataaagc

SEQ ID NO: 139288 - DNA, 25 bp, Homo sapien
ggccatgagtcacgctgggtaaccc

SEQ ID NO: 139289 - DNA, 25 bp, Homo sapien
caggaagctgggagccaccgcctct

SEQ ID NO: 139290 - DNA, 25 bp, Homo sapien
tctgtgcccggttgtcatctcggca

SEQ ID NO: 139291 - DNA, 25 bp, Homo sapien
tttggacttgatgaggcacgaacgc

SEQ ID NO: 139292 - DNA, 25 bp, Homo sapien
ctcggccaagtccacgggcagacga

SEQ ID NO: 139293 - DNA, 25 bp, Homo sapien
gcagcatcatgcaccggtcgggtga

SEQ ID NO: 139294 - DNA, 25 bp, Homo sapien
cgcaggtaccctgcaacgtcgcggt

SEQ ID NO: 139295 - DNA, 25 bp, Homo sapien
gtggctgtgcgcaggtaccctgcaa

SEQ ID NO: 139296 - DNA, 25 bp, Homo sapien
aaaataaagtcgttgtgggcggctg

SEQ ID NO: 139297 - DNA, 25 bp, Homo sapien
cagccttcatcgaattaggtgggtg

SEQ ID NO: 139298 - DNA, 25 bp, Homo sapien
cccgttggcagccttcatcgaatta

SEQ ID NO: 139299 - DNA, 25 bp, Homo sapien
catcatgcaccggtcgggtgagagt

SEQ ID NO: 139300 - DNA, 25 bp, Homo sapien
gctcagagtcgaggtgcgctccgcc

SEQ ID NO: 139301 - DNA, 25 bp, Homo sapien
cgaggcactagtgaggctcagagtc

SEQ ID NO: 139302 - DNA, 25 bp, Homo sapien
accggcctcctaactcggctccagg

SEQ ID NO: 139303 - DNA, 25 bp, Homo sapien
tcgaaaaatagtaggcagcccgccc

SEQ ID NO: 139304 - DNA, 25 bp, Homo sapien
ttcaaatcgaaaaatagtaggcagc

SEQ ID NO: 139305 - DNA, 25 bp, Homo sapien
ccaaaaccgactctattcaaatcga

SEQ ID NO: 139306 - DNA, 25 bp, Homo sapien
tggcccggagaagcaacaggaaacc

SEQ ID NO: 139307 - DNA, 25 bp, Homo sapien
agaaagaagataaatggcccggaga

SEQ ID NO: 139308 - DNA, 25 bp, Homo sapien
taggaacgagagaaggcgccatctc

SEQ ID NO: 139309 - DNA, 25 bp, Homo sapien
acctcccacagacaccgagagagtg

SEQ ID NO: 139310 - DNA, 25 bp, Homo sapien
cagacaccgagagagtgaacgttta

SEQ ID NO: 139311 - DNA, 25 bp, Homo sapien
ctcccacagacaccgacagagtgaa

SEQ ID NO: 139312 - DNA, 25 bp, Homo sapien
cctcccacagacaccgagagagtga

SEQ ID NO: 139313 - DNA, 25 bp, Homo sapien
ttaggaacgagagaaggcgccatct

SEQ ID NO: 139314 - DNA, 25 bp, Homo sapien
cagacgccgacagagtgaaagtgtc

SEQ ID NO: 139315 - DNA, 25 bp, Homo sapien
tttaggaacgagagaaggcgccatc

SEQ ID NO: 139316 - DNA, 25 bp, Homo sapien
cccttccccgtatgcgggcaggtga

SEQ ID NO: 139317 - DNA, 25 bp, Homo sapien
aggacctgtgcgaggcctcgcagat

SEQ ID NO: 139318 - DNA, 25 bp, Homo sapien
tttgtggagagcgttgatcagcgct

SEQ ID NO: 139319 - DNA, 25 bp, Homo sapien
agagcgttgatcagcgctgccgtca

SEQ ID NO: 139320 - DNA, 25 bp, Homo sapien
cggcggtgactcagccctgcagcct

SEQ ID NO: 139321 - DNA, 25 bp, Homo sapien
gcaggtgatgcggacgcctccgacc

SEQ ID NO: 139322 - DNA, 25 bp, Homo sapien
gcgctgccgtcagaacaggacctgt

SEQ ID NO: 139323 - DNA, 25 bp, Homo sapien
aacaggacctgtgcgaggcctcgca

SEQ ID NO: 139324 - DNA, 25 bp, Homo sapien
gaacttctccttccgtcgcgggaga

SEQ ID NO: 139325 - DNA, 25 bp, Homo sapien
ctaaaagcttggagcgcctggtccc

SEQ ID NO: 139326 - DNA, 25 bp, Homo sapien
ttcctcttgacgttaacggctgccc

SEQ ID NO: 139327 - DNA, 25 bp, Homo sapien
cttccgtcgcgggagatgaagtgct

SEQ ID NO: 139328 - DNA, 25 bp, Homo sapien
cacaggccctgagctctcgggaact

SEQ ID NO: 139329 - DNA, 25 bp, Homo sapien
aacgcagcacctgctcacaggcgta

SEQ ID NO: 139330 - DNA, 25 bp, Homo sapien
ggcgtacaccgtctctcccgctatt

SEQ ID NO: 139331 - DNA, 25 bp, Homo sapien
ggccctgagctctcgggaacttctc

SEQ ID NO: 139332 - DNA, 25 bp, Homo sapien
aatcggggtttcgtctctggaagag

SEQ ID NO: 139333 - DNA, 25 bp, Homo sapien
caccaccggctcctcgtgcagcgct

SEQ ID NO: 139334 - DNA, 25 bp, Homo sapien
cggccactgggtggcggtgttgccc

SEQ ID NO: 139335 - DNA, 25 bp, Homo sapien
tccgggtgggctcagtccgggctcc

SEQ ID NO: 139336 - DNA, 25 bp, Homo sapien
caaatcggggtttcgtctctggaag

SEQ ID NO: 139337 - DNA, 25 bp, Homo sapien
ttgctgccccaggagtccgcttcgt

SEQ ID NO: 139338 - DNA, 25 bp, Homo sapien
aggagtccgcttcgtcctccgctga

SEQ ID NO: 139339 - DNA, 25 bp, Homo sapien
cttcgtcctccgctgactctgagcg

SEQ ID NO: 139340 - DNA, 25 bp, Homo sapien
caggactggactttgtgctgagtgt

SEQ ID NO: 139341 - DNA, 25 bp, Homo sapien
tgcagttcaagtttgccaggccacc

SEQ ID NO: 139342 - DNA, 25 bp, Homo sapien
aggaggtcacacaacccgatgtgtc

SEQ ID NO: 139343 - DNA, 25 bp, Homo sapien
ggcgccttaggaggaggtcacacaa

SEQ ID NO: 139344 - DNA, 25 bp, Homo sapien
gagcaccggcaggactggactttgt

SEQ ID NO: 139345 - DNA, 25 bp, Homo sapien
tttgccaggccaccaacgggtgaca

SEQ ID NO: 139346 - DNA, 25 bp, Homo sapien
cgtctcgctgcagttcaagtttgcc

SEQ ID NO: 139347 - DNA, 25 bp, Homo sapien
ggggactccgcactttctgcgcacc

SEQ ID NO: 139348 - DNA, 25 bp, Homo sapien
acatccgtggctgacagagccagcc

SEQ ID NO: 139349 - DNA, 25 bp, Homo sapien
cgcactctgcttcactccctcctcc

SEQ ID NO: 139350 - DNA, 25 bp, Homo sapien
cgtggctgacagagccagcccgtcc

SEQ ID NO: 139351 - DNA, 25 bp, Homo sapien
atccgtggctgacagagccagcccg

SEQ ID NO: 139352 - DNA, 25 bp, Homo sapien
cacatccgtggctgacagagccagc

SEQ ID NO: 139353 - DNA, 25 bp, Homo sapien
ccacatccgtggctgacagagccag

SEQ ID NO: 139354 - DNA, 25 bp, Homo sapien
tccaccacatccgtggctgacagag

SEQ ID NO: 139355 - DNA, 25 bp, Homo sapien
tccgtggctgacagagccagcccgt

SEQ ID NO: 139356 - DNA, 25 bp, Homo sapien
acgtcctctgatgggaaggttccac

SEQ ID NO: 139357 - DNA, 25 bp, Homo sapien
gatgggaaggttccaccacatccgt

SEQ ID NO: 139358 - DNA, 25 bp, Homo sapien
tctgatgggaaggttccaccacatc

SEQ ID NO: 139359 - DNA, 25 bp, Homo sapien
gtcctctgatgggaaggttccacca

SEQ ID NO: 139360 - DNA, 25 bp, Homo sapien
ggacgtcctctgatgggaaggttcc

SEQ ID NO: 139361 - DNA, 25 bp, Homo sapien
cgtcgggtccgggacgtcctctgat

SEQ ID NO: 139362 - DNA, 25 bp, Homo sapien
gctcgggagcagacggctcctctgc

SEQ ID NO: 139363 - DNA, 25 bp, Homo sapien
cctctgatgggaaggttccaccaca

SEQ ID NO: 139364 - DNA, 25 bp, Homo sapien
gaccggactgctggtccacctggcg

SEQ ID NO: 139365 - DNA, 25 bp, Homo sapien
tgcggacccggcctctcgcgggtgg

SEQ ID NO: 139366 - DNA, 25 bp, Homo sapien
cacggggaccggactgctggtccac

SEQ ID NO: 139367 - DNA, 25 bp, Homo sapien
ccgacccggcgcgactcagcgcctc

SEQ ID NO: 139368 - DNA, 25 bp, Homo sapien
gcgtttgcgtcagccccgggttcca

SEQ ID NO: 139369 - DNA, 25 bp, Homo sapien
ctcagaggcgcgtttgcgtcagccc

SEQ ID NO: 139370 - DNA, 25 bp, Homo sapien
gcggccgggcttggtcgtgcgtccc

SEQ ID NO: 139371 - DNA, 25 bp, Homo sapien
gggttccagcagagtcactgcccgc

SEQ ID NO: 139372 - DNA, 25 bp, Homo sapien
cgctggcgacgggacattattactt

SEQ ID NO: 139373 - DNA, 25 bp, Homo sapien
tgtgacacttcaaactcgtaccgtg

SEQ ID NO: 139374 - DNA, 25 bp, Homo sapien
tgtctgcatccagcgcagcattctg

SEQ ID NO: 139375 - DNA, 25 bp, Homo sapien
accgtgagtaataatgcgccgtcca

SEQ ID NO: 139376 - DNA, 25 bp, Homo sapien
caccgcatcgaaaacgccgctgaga

SEQ ID NO: 139377 - DNA, 25 bp, Homo sapien
cccgacgtacttaggcggcatagcc

SEQ ID NO: 139378 - DNA, 25 bp, Homo sapien
atagccctgagacctctggccagcg

SEQ ID NO: 139379 - DNA, 25 bp, Homo sapien
ttacttttggtacgcgctgtgacac

SEQ ID NO: 139380 - DNA, 25 bp, Homo sapien
acagcgcgcagtacagggcgacctt

SEQ ID NO: 139381 - DNA, 25 bp, Homo sapien
accgtgaagcacagcgcgcagtaca

SEQ ID NO: 139382 - DNA, 25 bp, Homo sapien
gccacggcggacaccgtgaagcaca

SEQ ID NO: 139383 - DNA, 25 bp, Homo sapien
ttgcctcatgttctccaccgtccgg

SEQ ID NO: 139384 - DNA, 25 bp, Homo sapien
tacagggcgaccttggcgtagaact

SEQ ID NO: 139385 - DNA, 25 bp, Homo sapien
cccatcatggcttgccggtggctcg

SEQ ID NO: 139386 - DNA, 25 bp, Homo sapien
accttggcgtagaactcggccgcgc

SEQ ID NO: 139387 - DNA, 25 bp, Homo sapien
ccttctgccaggttaccgaggctct

SEQ ID NO: 139388 - DNA, 25 bp, Homo sapien
agaaacggcaagacctccaggaagg

SEQ ID NO: 139389 - DNA, 25 bp, Homo sapien
ttcggggctcagcatcgaaagccgg

SEQ ID NO: 139390 - DNA, 25 bp, Homo sapien
tcttccaccaaatgagagaaacggc

SEQ ID NO: 139391 - DNA, 25 bp, Homo sapien
acgaggctgcagcttcctttggtga

SEQ ID NO: 139392 - DNA, 25 bp, Homo sapien
cttcctttggtgaagcgtccgaggg

SEQ ID NO: 139393 - DNA, 25 bp, Homo sapien
tctggcgcctacaggggcttccgac

SEQ ID NO: 139394 - DNA, 25 bp, Homo sapien
ctgggtccttctcaggctgagcgcc

SEQ ID NO: 139395 - DNA, 25 bp, Homo sapien
ctgggtgccacaggccgtgacctct

SEQ ID NO: 139396 - DNA, 25 bp, Homo sapien
cagccggcaaagaattccgttttca

SEQ ID NO: 139397 - DNA, 25 bp, Homo sapien
tggaatgcacacctccggccaacgg

SEQ ID NO: 139398 - DNA, 25 bp, Homo sapien
ctacatcggcgatctaggttccagc

SEQ ID NO: 139399 - DNA, 25 bp, Homo sapien
aggagctgtcgcaccttctccacta

SEQ ID NO: 139400 - DNA, 25 bp, Homo sapien
ttcctaggagacctgggctcagctt

SEQ ID NO: 139401 - DNA, 25 bp, Homo sapien
cttctgggaaaaagcgcctagcgcg

SEQ ID NO: 139402 - DNA, 25 bp, Homo sapien
gcctgcccaaagatgctaggacgca

SEQ ID NO: 139403 - DNA, 25 bp, Homo sapien
cgggcttttcctggcgctcaagaac

SEQ ID NO: 139404 - DNA, 25 bp, Homo sapien
gcctgcatgactggagctgcacagg

SEQ ID NO: 139405 - DNA, 25 bp, Homo sapien
cggctctgcctgcatgactggagct

SEQ ID NO: 139406 - DNA, 25 bp, Homo sapien
agcggccctgagactgcggctctgc

SEQ ID NO: 139407 - DNA, 25 bp, Homo sapien
gaaccagcatggagcggccctgaga

SEQ ID NO: 139408 - DNA, 25 bp, Homo sapien
ccgggccgctagtgggaaccagcat

SEQ ID NO: 139409 - DNA, 25 bp, Homo sapien
ccctccaatactcagcagcgccagg

SEQ ID NO: 139410 - DNA, 25 bp, Homo sapien
cgagtcctctgatgagcgctgggct

SEQ ID NO: 139411 - DNA, 25 bp, Homo sapien
cacaatccgagtcctctgatgagcg

SEQ ID NO: 139412 - DNA, 25 bp, Homo sapien
tgtctgtgccacagcaccggttcta

SEQ ID NO: 139413 - DNA, 25 bp, Homo sapien
agggctggtgaacctgttccctgga

SEQ ID NO: 139414 - DNA, 25 bp, Homo sapien
gttccctggaggaatttacacacca

SEQ ID NO: 139415 - DNA, 25 bp, Homo sapien
atttacacaccacgggctcacacgg

SEQ ID NO: 139416 - DNA, 25 bp, Homo sapien
cgcctgctgtctttgcacgtccatg

SEQ ID NO: 139417 - DNA, 25 bp, Homo sapien
ctcacacggccagtgccgatgtgca

SEQ ID NO: 139418 - DNA, 25 bp, Homo sapien
ccttacgtgacatgggacggtgaca

SEQ ID NO: 139419 - DNA, 25 bp, Homo sapien
tccatgtgccctgagtgtctccggc

SEQ ID NO: 139420 - DNA, 25 bp, Homo sapien
tgttccctgtgactcggacgctgaa

SEQ ID NO: 139421 - DNA, 25 bp, Homo sapien
ggacgctgaacgttgctcacacgtt

SEQ ID NO: 139422 - DNA, 25 bp, Homo sapien
ttgacagcatggagacggtttcacc

SEQ ID NO: 139423 - DNA, 25 bp, Homo sapien
cggtttcaccgtctgctactttcga

SEQ ID NO: 139424 - DNA, 25 bp, Homo sapien
gtctctctgcgtcaccctcattttg

SEQ ID NO: 139425 - DNA, 25 bp, Homo sapien
ggacatcctcacaaagcagacgttt

SEQ ID NO: 139426 - DNA, 25 bp, Homo sapien
gcccgcaggattcaggtttgtctcc

SEQ ID NO: 139427 - DNA, 25 bp, Homo sapien
cattttgagcagctgtggaggatcc

SEQ ID NO: 139428 - DNA, 25 bp, Homo sapien
cccgaggctgaaagtccgttcttgg

SEQ ID NO: 139429 - DNA, 25 bp, Homo sapien
ccttagtggctacagaaactggagc

SEQ ID NO: 139430 - DNA, 25 bp, Homo sapien
cgtaaccacggcaaagctcgcggca

SEQ ID NO: 139431 - DNA, 25 bp, Homo sapien
tttcatgcgtggagcattctggccc

SEQ ID NO: 139432 - DNA, 25 bp, Homo sapien
ctaaactggctgctgagggcgtctc

SEQ ID NO: 139433 - DNA, 25 bp, Homo sapien
gtctcgggctctcctcccagtagtt

SEQ ID NO: 139434 - DNA, 25 bp, Homo sapien
ccagtagttcactccttagtggcta

SEQ ID NO: 139435 - DNA, 25 bp, Homo sapien
cccagcgctgactttcatgcgtgga

SEQ ID NO: 139436 - DNA, 25 bp, Homo sapien
cccaggtgtttaccgaagtgcaatg

SEQ ID NO: 139437 - DNA, 25 bp, Homo sapien
tcacacggaacctgcctatggaggc

SEQ ID NO: 139438 - DNA, 25 bp, Homo sapien
ctatggaggcggcaacggctcatcc

SEQ ID NO: 139439 - DNA, 25 bp, Homo sapien
tgtcctcccggcgagtggccaaggc

SEQ ID NO: 139440 - DNA, 25 bp, Homo sapien
cccatcctgaggacccaggggaagg

SEQ ID NO: 139441 - DNA, 25 bp, Homo sapien
cccgcagcaccgttgcatgaggggc

SEQ ID NO: 139442 - DNA, 25 bp, Homo sapien
ttcggacacgaagggttcatgagcc

SEQ ID NO: 139443 - DNA, 25 bp, Homo sapien
tgaaagcttctgttcacacggaacc

SEQ ID NO: 139444 - DNA, 25 bp, Homo sapien
ccaagatcgccatcggcctgctgga

SEQ ID NO: 139445 - DNA, 25 bp, Homo sapien
agtgcaagggcgacctcatccagcc

SEQ ID NO: 139446 - DNA, 25 bp, Homo sapien
tgggcacacagctgcgcacctgtac

SEQ ID NO: 139447 - DNA, 25 bp, Homo sapien
gtgggctacacagccacctacgact

SEQ ID NO: 139448 - DNA, 25 bp, Homo sapien
tccagcccaacctggccaaggtgtg

SEQ ID NO: 139449 - DNA, 25 bp, Homo sapien
cggctcttacgggactttctacatg

SEQ ID NO: 139450 - DNA, 25 bp, Homo sapien
tggaggagctcttccacggctctta

SEQ ID NO: 139451 - DNA, 25 bp, Homo sapien
cgacttcaagatggccgacctgcag

SEQ ID NO: 139452 - DNA, 25 bp, Homo sapien
gcgccttttatagcgcgtacggcgg

SEQ ID NO: 139453 - DNA, 25 bp, Homo sapien
ctgcgctgtgtcctgggacctcggt

SEQ ID NO: 139454 - DNA, 25 bp, Homo sapien
tacggcggcccgcaagagtcaatcc

SEQ ID NO: 139455 - DNA, 25 bp, Homo sapien
tggtcccagccattggggcggctcc

SEQ ID NO: 139456 - DNA, 25 bp, Homo sapien
ggctcccgtgactgtcgagcagcgc

SEQ ID NO: 139457 - DNA, 25 bp, Homo sapien
gcgggtacacaccaggcgcctaatg

SEQ ID NO: 139458 - DNA, 25 bp, Homo sapien
ccaggcgcctaatgagtgctgaggc

SEQ ID NO: 139459 - DNA, 25 bp, Homo sapien
tgactagcgccctgtctgcgctgtg

SEQ ID NO: 139460 - DNA, 25 bp, Homo sapien
gatgcagcatctgctccggacgcct

SEQ ID NO: 139461 - DNA, 25 bp, Homo sapien
cgcctggtcggatgcagcatctgct

SEQ ID NO: 139462 - DNA, 25 bp, Homo sapien
acagccacggcatcgcctggtcgga

SEQ ID NO: 139463 - DNA, 25 bp, Homo sapien
ggcaccacgagaacacagccatgca

SEQ ID NO: 139464 - DNA, 25 bp, Homo sapien
tcgtcttgggcaccacgagaacaca

SEQ ID NO: 139465 - DNA, 25 bp, Homo sapien
tccatgcgtgctcgtcttgggcacc

SEQ ID NO: 139466 - DNA, 25 bp, Homo sapien
gctccctggttccatgcgtgctcgt

SEQ ID NO: 139467 - DNA, 25 bp, Homo sapien
ggacgcctctcgctgtcggtgccag

SEQ ID NO: 139468 - DNA, 25 bp, Homo sapien
ggacactcccattcacttcctgaga

SEQ ID NO: 139469 - DNA, 25 bp, Homo sapien
cctgagagatcctcagtgccagatc

SEQ ID NO: 139470 - DNA, 25 bp, Homo sapien
cgatgcccggaaacctgttctcgga

SEQ ID NO: 139471 - DNA, 25 bp, Homo sapien
tgccagatctccaccaggaacgctg

SEQ ID NO: 139472 - DNA, 25 bp, Homo sapien
aacgctgaatgctgctgaggacaca

SEQ ID NO: 139473 - DNA, 25 bp, Homo sapien
tgaggacacaacaggagactcgaca

SEQ ID NO: 139474 - DNA, 25 bp, Homo sapien
agactcgacagacgggaggttcgcc

SEQ ID NO: 139475 - DNA, 25 bp, Homo sapien
gcaaaacccagcaaaggtgcaatgg

SEQ ID NO: 139476 - DNA, 25 bp, Homo sapien
ccggtgactgtcacgtcagacacgt

SEQ ID NO: 139477 - DNA, 25 bp, Homo sapien
cgcaacagcagcacggcagaaacgc

SEQ ID NO: 139478 - DNA, 25 bp, Homo sapien
tcacgtcagacacgtgacgtgtggc

SEQ ID NO: 139479 - DNA, 25 bp, Homo sapien
acggcagaaacgcaggagaaacagc

SEQ ID NO: 139480 - DNA, 25 bp, Homo sapien
tcccgccatgccaggaagggccagt

SEQ ID NO: 139481 - DNA, 25 bp, Homo sapien
gaagggccagtgtccctccagacgc

SEQ ID NO: 139482 - DNA, 25 bp, Homo sapien
tccagacgccggtgactgtcacgtc

SEQ ID NO: 139483 - DNA, 25 bp, Homo sapien
gacgtgtggctgtgcccagattctt

SEQ ID NO: 139484 - DNA, 25 bp, Homo sapien
tccgtccgtaactgcgcaggcctgt

SEQ ID NO: 139485 - DNA, 25 bp, Homo sapien
gtcacagggcccaagctcctagagg

SEQ ID NO: 139486 - DNA, 25 bp, Homo sapien
tgcgctctagcaggctcgatccatg

SEQ ID NO: 139487 - DNA, 25 bp, Homo sapien
aggtcgcgtctccaaagtcccgtct

SEQ ID NO: 139488 - DNA, 25 bp, Homo sapien
gccctgccaaccatggtgaacttgg

SEQ ID NO: 139489 - DNA, 25 bp, Homo sapien
caagcacccggtgagaaggccggtc

SEQ ID NO: 139490 - DNA, 25 bp, Homo sapien
ggacgacgccgtggctgccaagcac

SEQ ID NO: 139491 - DNA, 25 bp, Homo sapien
accatggtgaacttgggtctgtccc

SEQ ID NO: 139492 - DNA, 25 bp, Homo sapien
caggggcacggcaacatcattgatg

SEQ ID NO: 139493 - DNA, 25 bp, Homo sapien
catcattgatgggttctgcagccca

SEQ ID NO: 139494 - DNA, 25 bp, Homo sapien
tccagggcactttggtacactgtcc

SEQ ID NO: 139495 - DNA, 25 bp, Homo sapien
gtacactgtcccacaaggcacctgt

SEQ ID NO: 139496 - DNA, 25 bp, Homo sapien
tcccacaaggcacctgtctcagagg

SEQ ID NO: 139497 - DNA, 25 bp, Homo sapien
tcctggcaggcagtgtggcaactcc

SEQ ID NO: 139498 - DNA, 25 bp, Homo sapien
cagtgtggcaactcccttccagagc

SEQ ID NO: 139499 - DNA, 25 bp, Homo sapien
ccctcgtgtccagggcactttggta

SEQ ID NO: 139500 - DNA, 25 bp, Homo sapien
tgccgcagcaccatggaggtaacca

SEQ ID NO: 139501 - DNA, 25 bp, Homo sapien
acctgctgtatttggacctgctgga

SEQ ID NO: 139502 - DNA, 25 bp, Homo sapien
atccgccagctggagaacaacatcg

SEQ ID NO: 139503 - DNA, 25 bp, Homo sapien
cgcgtgaacatgcacaacctactga

SEQ ID NO: 139504 - DNA, 25 bp, Homo sapien
ccactagatgttgcggagccgacga

SEQ ID NO: 139505 - DNA, 25 bp, Homo sapien
gcctgcgggaaaaacttgcctttgc

SEQ ID NO: 139506 - DNA, 25 bp, Homo sapien
tccgcagtatgaccagtggaccatc

SEQ ID NO: 139507 - DNA, 25 bp, Homo sapien
cgcaagtacgtcttcgaccgcgtga

SEQ ID NO: 139508 - DNA, 25 bp, Homo sapien
gggaagatgttttccgccctgaaga

SEQ ID NO: 139509 - DNA, 25 bp, Homo sapien
gacatggaccacagctacgtccctt

SEQ ID NO: 139510 - DNA, 25 bp, Homo sapien
ttcgcgcgccgagatcaagaggcag

SEQ ID NO: 139511 - DNA, 25 bp, Homo sapien
tcggtctcacctgcttgccggttgt

SEQ ID NO: 139512 - DNA, 25 bp, Homo sapien
ccctgctttgctacacaaataaaca

SEQ ID NO: 139513 - DNA, 25 bp, Homo sapien
aacatttttccaggactgctgcgga

SEQ ID NO: 139514 - DNA, 25 bp, Homo sapien
ggaactgcgcgccagaaccgcgtgc

SEQ ID NO: 139515 - DNA, 25 bp, Homo sapien
gccgggacatggtgccagtcgcacc

SEQ ID NO: 139516 - DNA, 25 bp, Homo sapien
ttttgattggcatccgcctctcctc

SEQ ID NO: 139517 - DNA, 25 bp, Homo sapien
gcgatttccagggattcccgatttc

SEQ ID NO: 139518 - DNA, 25 bp, Homo sapien
cgcgatggcattttgattggcatcc

SEQ ID NO: 139519 - DNA, 25 bp, Homo sapien
atggcgccgcagaccggcttgtaca

SEQ ID NO: 139520 - DNA, 25 bp, Homo sapien
gtgagcaaataaaggctccttcctg

SEQ ID NO: 139521 - DNA, 25 bp, Homo sapien
gtcctcaggccctgcgatttccagg

SEQ ID NO: 139522 - DNA, 25 bp, Homo sapien
cggcctgactggctgcgtcctcagg

SEQ ID NO: 139523 - DNA, 25 bp, Homo sapien
agaccggcttgtacaggccgcgcgc

SEQ ID NO: 139524 - DNA, 25 bp, Homo sapien
ccgagatatgaccagaggcgttgaa

SEQ ID NO: 139525 - DNA, 25 bp, Homo sapien
ccctctggaggttttgccgcagcgc

SEQ ID NO: 139526 - DNA, 25 bp, Homo sapien
ctctgttctccaagttctccgcggg

SEQ ID NO: 139527 - DNA, 25 bp, Homo sapien
gggctgctgtgctctccacaggccg

SEQ ID NO: 139528 - DNA, 25 bp, Homo sapien
ccgcatgtggaaaccaccgggaagc

SEQ ID NO: 139529 - DNA, 25 bp, Homo sapien
acccggagacgggaccaccgcatgt

SEQ ID NO: 139530 - DNA, 25 bp, Homo sapien
cggtcgctgtgaccgtctctgcgct

SEQ ID NO: 139531 - DNA, 25 bp, Homo sapien
accaagggacgtcagcgcgttggtt

SEQ ID NO: 139532 - DNA, 25 bp, Homo sapien
gcgtgctgggaaactaccgggacat

SEQ ID NO: 139533 - DNA, 25 bp, Homo sapien
tgccggacgacgtgcgtgacttcat

SEQ ID NO: 139534 - DNA, 25 bp, Homo sapien
acgacgtgcgtgacttcatcgacaa

SEQ ID NO: 139535 - DNA, 25 bp, Homo sapien
tgcgtgacttcatcgacaacctgga

SEQ ID NO: 139536 - DNA, 25 bp, Homo sapien
tgacttcatcgacaacctggacagg

SEQ ID NO: 139537 - DNA, 25 bp, Homo sapien
ccagggaggggttaacgttagcatg

SEQ ID NO: 139538 - DNA, 25 bp, Homo sapien
taacgttagcatggggcccggcgga

SEQ ID NO: 139539 - DNA, 25 bp, Homo sapien
gcgagcaccgagtcatcctgccgga

SEQ ID NO: 139540 - DNA, 25 bp, Homo sapien
ccgactttgagagcgagggatcaga

SEQ ID NO: 139541 - DNA, 25 bp, Homo sapien
agggatcagacacacagcgcagggc

SEQ ID NO: 139542 - DNA, 25 bp, Homo sapien
atgctgtccttcgtcatggatgacc

SEQ ID NO: 139543 - DNA, 25 bp, Homo sapien
cccgagggacccattgctgcacaaa

SEQ ID NO: 139544 - DNA, 25 bp, Homo sapien
caggcctcctcgtcggagagtgacc

SEQ ID NO: 139545 - DNA, 25 bp, Homo sapien
gttcgcacaggtccggagaagcgca

SEQ ID NO: 139546 - DNA, 25 bp, Homo sapien
ccaggcggtgtctctgttcgcacag

SEQ ID NO: 139547 - DNA, 25 bp, Homo sapien
gcagggcggtaagacgagtcctccc

SEQ ID NO: 139548 - DNA, 25 bp, Homo sapien
gcctggggaggcatttgcctctgta

SEQ ID NO: 139549 - DNA, 25 bp, Homo sapien
tttgcctctgtaccatcgcctttgc

SEQ ID NO: 139550 - DNA, 25 bp, Homo sapien
gggagaggacggctgccgatgagct

SEQ ID NO: 139551 - DNA, 25 bp, Homo sapien
cactgcctggggaggcatttgcctc

SEQ ID NO: 139552 - DNA, 25 bp, Homo sapien
ctggggaggcatttgcctctgtacc

SEQ ID NO: 139553 - DNA, 25 bp, Homo sapien
gaggcatttgcctctgtaccatcgc

SEQ ID NO: 139554 - DNA, 25 bp, Homo sapien
atttgcctctgtaccatcgcctttg

SEQ ID NO: 139555 - DNA, 25 bp, Homo sapien
ctgtaccatcgcctttgccgctgcc

SEQ ID NO: 139556 - DNA, 25 bp, Homo sapien
gacctcgctctcattcctgatgtgg

SEQ ID NO: 139557 - DNA, 25 bp, Homo sapien
ggctggatttcatcaccacccattc

SEQ ID NO: 139558 - DNA, 25 bp, Homo sapien
gattcacgtgtacggctattccatg

SEQ ID NO: 139559 - DNA, 25 bp, Homo sapien
ggcgcatctcccaccagagtcagga

SEQ ID NO: 139560 - DNA, 25 bp, Homo sapien
cccagcggacatctacgacaaagtg

SEQ ID NO: 139561 - DNA, 25 bp, Homo sapien
tccgacggcgtcttcaagtatgtgc

SEQ ID NO: 139562 - DNA, 25 bp, Homo sapien
attgcgattggtcagcacgtgcctc

SEQ ID NO: 139563 - DNA, 25 bp, Homo sapien
ccctgctaggtttgacccaggctga

SEQ ID NO: 139564 - DNA, 25 bp, Homo sapien
acctgctggtgtcgaccgtgtacca

SEQ ID NO: 139565 - DNA, 25 bp, Homo sapien
ccgcgcctttcaacaagcgccactg

SEQ ID NO: 139566 - DNA, 25 bp, Homo sapien
ccgcaaggcagtgtgagctggagcc

SEQ ID NO: 139567 - DNA, 25 bp, Homo sapien
ctccggacctgctggtgtcgaccgt

SEQ ID NO: 139568 - DNA, 25 bp, Homo sapien
tggggcaacacctataaataaggcc

SEQ ID NO: 139569 - DNA, 25 bp, Homo sapien
ggtgtcgaccgtgtaccaggacatc

SEQ ID NO: 139570 - DNA, 25 bp, Homo sapien
tcgaccgtgtaccaggacatcaagg

SEQ ID NO: 139571 - DNA, 25 bp, Homo sapien
taccaggacatcaaggtggcgaccc

SEQ ID NO: 139572 - DNA, 25 bp, Homo sapien
gtcgaggccaacaggcgcttcacgc

SEQ ID NO: 139573 - DNA, 25 bp, Homo sapien
cagctttgcgagttcgtcgaggcca

SEQ ID NO: 139574 - DNA, 25 bp, Homo sapien
cgcgcgtctacgagcagctttgcga

SEQ ID NO: 139575 - DNA, 25 bp, Homo sapien
gcggcgtcttcctgcgccacgagtt

SEQ ID NO: 139576 - DNA, 25 bp, Homo sapien
gcgaggtggccttcatccacatcca

SEQ ID NO: 139577 - DNA, 25 bp, Homo sapien
cgcctctacgaaccggcagagtgct

SEQ ID NO: 139578 - DNA, 25 bp, Homo sapien
ccaacctgctggacgacatcatgtg

SEQ ID NO: 139579 - DNA, 25 bp, Homo sapien
tgtgcatgatcatggccgcctccga

SEQ ID NO: 139580 - DNA, 25 bp, Homo sapien
gcgtcccattggctggctgcacgcg

SEQ ID NO: 139581 - DNA, 25 bp, Homo sapien
gccgtagggcccttcttgcgcagca

SEQ ID NO: 139582 - DNA, 25 bp, Homo sapien
tagggcccttcttgcgcagcaccgt

SEQ ID NO: 139583 - DNA, 25 bp, Homo sapien
ctcagcggcagctgctagagacctg

SEQ ID NO: 139584 - DNA, 25 bp, Homo sapien
gccattcggcgttcggctcgtctga

SEQ ID NO: 139585 - DNA, 25 bp, Homo sapien
gtctccgctctagccgtgcggccgc

SEQ ID NO: 139586 - DNA, 25 bp, Homo sapien
acctgcgctcgaggaccagggccgt

SEQ ID NO: 139587 - DNA, 25 bp, Homo sapien
ggcacttcccgtgctcggggccatt

SEQ ID NO: 139588 - DNA, 25 bp, Homo sapien
aaaccaagtccgagcgtggctggcg

SEQ ID NO: 139589 - DNA, 25 bp, Homo sapien
cccgaggggatttctctgagccgct

SEQ ID NO: 139590 - DNA, 25 bp, Homo sapien
gttggctcccatgtccgtccgtcag

SEQ ID NO: 139591 - DNA, 25 bp, Homo sapien
ggccaatggctctcgctacagcttc

SEQ ID NO: 139592 - DNA, 25 bp, Homo sapien
gacttaggtacccacgccgtctcag

SEQ ID NO: 139593 - DNA, 25 bp, Homo sapien
aagcagagggcgacttaggtaccca

SEQ ID NO: 139594 - DNA, 25 bp, Homo sapien
cccggcgcgctctttgaggaaaaag

SEQ ID NO: 139595 - DNA, 25 bp, Homo sapien
gaagcaagggcctcgctgtctcgcc

SEQ ID NO: 139596 - DNA, 25 bp, Homo sapien
ctcgttcagccggtcaccgcgtgtg

SEQ ID NO: 139597 - DNA, 25 bp, Homo sapien
tcaccgcgtgtgtgagagtccccac

SEQ ID NO: 139598 - DNA, 25 bp, Homo sapien
gccggtcaccgcgtgtgtgagtccc

SEQ ID NO: 139599 - DNA, 25 bp, Homo sapien
ccaccgcacgctcgttcagccggtc

SEQ ID NO: 139600 - DNA, 25 bp, Homo sapien
tcgttcagccggtcaccgcgtgtgt

SEQ ID NO: 139601 - DNA, 25 bp, Homo sapien
gtcaccgcgtgtgtgagagtcccca

SEQ ID NO: 139602 - DNA, 25 bp, Homo sapien
caccgcacgctcgttcagccggtca

SEQ ID NO: 139603 - DNA, 25 bp, Homo sapien
ttcagccggtcaccgcgtgtgtgag

SEQ ID NO: 139604 - DNA, 25 bp, Homo sapien
cacacgctcgttcagctggtcacca

SEQ ID NO: 139605 - DNA, 25 bp, Homo sapien
accgcgtgtgagtccccactgcacg

SEQ ID NO: 139606 - DNA, 25 bp, Homo sapien
tcaccgcatgtgtgataatcacccc

SEQ ID NO: 139607 - DNA, 25 bp, Homo sapien
tgcttgttcagctcgtcaccgcgtg

SEQ ID NO: 139608 - DNA, 25 bp, Homo sapien
catgcttgttcagctcgtcaccgcg

SEQ ID NO: 139609 - DNA, 25 bp, Homo sapien
cattcagtcggtcaccgcatgtgtg

SEQ ID NO: 139610 - DNA, 25 bp, Homo sapien
cgcatgcttgttcagctcgtcaccg

SEQ ID NO: 139611 - DNA, 25 bp, Homo sapien
gtgtgataatcacccccgcatgctt

SEQ ID NO: 139612 - DNA, 25 bp, Homo sapien
agccaggctgccaactcattcggga

SEQ ID NO: 139613 - DNA, 25 bp, Homo sapien
gtcctgtcctggctcaagggccaca

SEQ ID NO: 139614 - DNA, 25 bp, Homo sapien
atcctcatcatcgagcggcagcggg

SEQ ID NO: 139615 - DNA, 25 bp, Homo sapien
cacctgcgagaagtgcatcctcatc

SEQ ID NO: 139616 - DNA, 25 bp, Homo sapien
caacgagagcttggagagcctcatc

SEQ ID NO: 139617 - DNA, 25 bp, Homo sapien
agagctggctcagaccttaatcaga

SEQ ID NO: 139618 - DNA, 25 bp, Homo sapien
tcgccaagccaggtaagagcgtctg

SEQ ID NO: 139619 - DNA, 25 bp, Homo sapien
gccgcttcaaggactgcacctgcga

SEQ ID NO: 139620 - DNA, 25 bp, Homo sapien
tgccttgagacaggccagtggttcc

SEQ ID NO: 139621 - DNA, 25 bp, Homo sapien
gtgccaagtgcaccctgatcgccga

SEQ ID NO: 139622 - DNA, 25 bp, Homo sapien
atttctcgggaatggagcggtcaca

SEQ ID NO: 139623 - DNA, 25 bp, Homo sapien
ctcccagcagggttagctgcggtca

SEQ ID NO: 139624 - DNA, 25 bp, Homo sapien
gtcgtcccaactccttccgagtgga

SEQ ID NO: 139625 - DNA, 25 bp, Homo sapien
tggctggaggcacaaaggcattaac

SEQ ID NO: 139626 - DNA, 25 bp, Homo sapien
ggcagagccgagaatccacagtcca

SEQ ID NO: 139627 - DNA, 25 bp, Homo sapien
agcctctctagccttgccttcttgg

SEQ ID NO: 139628 - DNA, 25 bp, Homo sapien
tgggccagcgttgcgagtcttgcca

SEQ ID NO: 139629 - DNA, 25 bp, Homo sapien
cagcgttgcgagtcttgccagggac

SEQ ID NO: 139630 - DNA, 25 bp, Homo sapien
gttgcgagtcttgccagggacgcgc

SEQ ID NO: 139631 - DNA, 25 bp, Homo sapien
ggatgcacctgtcctagaccccctg

SEQ ID NO: 139632 - DNA, 25 bp, Homo sapien
acaggttcagctcccgccggtccct

SEQ ID NO: 139633 - DNA, 25 bp, Homo sapien
tctcacacaggttcagctcccgccg

SEQ ID NO: 139634 - DNA, 25 bp, Homo sapien
gcaccgcggtgccaccgcgtcctgc

SEQ ID NO: 139635 - DNA, 25 bp, Homo sapien
ccctcttggaggctgggccagcgtt

SEQ ID NO: 139636 - DNA, 25 bp, Homo sapien
gtgaagctgtggctgcccaaatgtc

SEQ ID NO: 139637 - DNA, 25 bp, Homo sapien
gcccaaatgtcccacgcgagttcta

SEQ ID NO: 139638 - DNA, 25 bp, Homo sapien
cctcctttcgttgctagagctgcca

SEQ ID NO: 139639 - DNA, 25 bp, Homo sapien
tgcccgctcatgctgaccgaatgtc

SEQ ID NO: 139640 - DNA, 25 bp, Homo sapien
gctgaccgaatgtcccgcgtgcaaa

SEQ ID NO: 139641 - DNA, 25 bp, Homo sapien
tccgccttggtgaaaaggagcgcca

SEQ ID NO: 139642 - DNA, 25 bp, Homo sapien
agccagcgctacatcgccttgtgtc

SEQ ID NO: 139643 - DNA, 25 bp, Homo sapien
cgagttctactgacgcttcctcctt

SEQ ID NO: 139644 - DNA, 25 bp, Homo sapien
ctggagggtgaccacgtgctcctgc

SEQ ID NO: 139645 - DNA, 25 bp, Homo sapien
gtttcacgtggcttccaaatctcct

SEQ ID NO: 139646 - DNA, 25 bp, Homo sapien
ctcctctggtggcttgggtctccct

SEQ ID NO: 139647 - DNA, 25 bp, Homo sapien
gctggcagaacaaacaaagcgttaa

SEQ ID NO: 139648 - DNA, 25 bp, Homo sapien
ttgccctgagctggcagaacaaaca

SEQ ID NO: 139649 - DNA, 25 bp, Homo sapien
caaagcgttaagatctccgaggctc

SEQ ID NO: 139650 - DNA, 25 bp, Homo sapien
ttaagatctccgaggctcctgggtg

SEQ ID NO: 139651 - DNA, 25 bp, Homo sapien
gccgttgtttcacgtggcttccaaa

SEQ ID NO: 139652 - DNA, 25 bp, Homo sapien
ttgcaggcgaggctcaacgaacgct

SEQ ID NO: 139653 - DNA, 25 bp, Homo sapien
ccctgagcaagtggcttcatgaacc

SEQ ID NO: 139654 - DNA, 25 bp, Homo sapien
cccaggctcaggaagatctggtaga

SEQ ID NO: 139655 - DNA, 25 bp, Homo sapien
cactcgggcgcattgggaacagcgc

SEQ ID NO: 139656 - DNA, 25 bp, Homo sapien
ggccggcttttctttgtgcgcctgc

SEQ ID NO: 139657 - DNA, 25 bp, Homo sapien
agagcgggcgtcctgttcctccagc

SEQ ID NO: 139658 - DNA, 25 bp, Homo sapien
gctcaacgaacgctggttcgggacc

SEQ ID NO: 139659 - DNA, 25 bp, Homo sapien
tccatcgtgacattctgcccaggcg

SEQ ID NO: 139660 - DNA, 25 bp, Homo sapien
cccgcatggtcttgaggtcgaacac

SEQ ID NO: 139661 - DNA, 25 bp, Homo sapien
gtgaacgatcccagctttgcctgtg

SEQ ID NO: 139662 - DNA, 25 bp, Homo sapien
gccctgcctgcgtttgttttcactg

SEQ ID NO: 139663 - DNA, 25 bp, Homo sapien
agggcagcttcctacctcagtggtg

SEQ ID NO: 139664 - DNA, 25 bp, Homo sapien
cgcggctgttcacgtacaggtacct

SEQ ID NO: 139665 - DNA, 25 bp, Homo sapien
tccctgctgacgtccaggaagatga

SEQ ID NO: 139666 - DNA, 25 bp, Homo sapien
gctcctggggactgaagaccactga

SEQ ID NO: 139667 - DNA, 25 bp, Homo sapien
cccatgccgatgatgtgtccgtgta

SEQ ID NO: 139668 - DNA, 25 bp, Homo sapien
cgcccgtgctcacctaggctgatga

SEQ ID NO: 139669 - DNA, 25 bp, Homo sapien
ctgatgacagcaatctcgccggatg

SEQ ID NO: 139670 - DNA, 25 bp, Homo sapien
gtcgttgctccagatctgttcggca

SEQ ID NO: 139671 - DNA, 25 bp, Homo sapien
ggggcctgctactacacagccatga

SEQ ID NO: 139672 - DNA, 25 bp, Homo sapien
accttcacagtgcagtccttggagc

SEQ ID NO: 139673 - DNA, 25 bp, Homo sapien
tccacgcagggcaccgtgtcataca

SEQ ID NO: 139674 - DNA, 25 bp, Homo sapien
gccaaacacgtcatagggcttgttc

SEQ ID NO: 139675 - DNA, 25 bp, Homo sapien
gtctcggtgagccaacagccaaaca

SEQ ID NO: 139676 - DNA, 25 bp, Homo sapien
ctcaaggacgccttgcagaaggcgc

SEQ ID NO: 139677 - DNA, 25 bp, Homo sapien
cctccaccaatcacgttagacggga

SEQ ID NO: 139678 - DNA, 25 bp, Homo sapien
cgcctctcaaggacgccttgcagaa

SEQ ID NO: 139679 - DNA, 25 bp, Homo sapien
aatcacgttagacgggaggagcagc

SEQ ID NO: 139680 - DNA, 25 bp, Homo sapien
ggaggagcagcacctgcgtctgccc

SEQ ID NO: 139681 - DNA, 25 bp, Homo sapien
aggcgcgccgaacccattgtcgtgt

SEQ ID NO: 139682 - DNA, 25 bp, Homo sapien
gcaggtgcctcaaggcccgcgtcct

SEQ ID NO: 139683 - DNA, 25 bp, Homo sapien
tcccaaagcgctgggctcactggcg

SEQ ID NO: 139684 - DNA, 25 bp, Homo sapien
ggcaacagcttcaggccggagcaca

SEQ ID NO: 139685 - DNA, 25 bp, Homo sapien
agtggctgtccctgccgttccaagc

SEQ ID NO: 139686 - DNA, 25 bp, Homo sapien
ctttgaggtgtggaatgcgatgact

SEQ ID NO: 139687 - DNA, 25 bp, Homo sapien
ctaagtgatgatggccgctttgagg

SEQ ID NO: 139688 - DNA, 25 bp, Homo sapien
acagggcgctgctgaacgctttcac

SEQ ID NO: 139689 - DNA, 25 bp, Homo sapien
ccgcaacttttgagctaagtgatga

SEQ ID NO: 139690 - DNA, 25 bp, Homo sapien
ctgaacgctttcaccgcaacttttg

SEQ ID NO: 139691 - DNA, 25 bp, Homo sapien
ggtcccagccgccagtggctcaggt

SEQ ID NO: 139692 - DNA, 25 bp, Homo sapien
gctgtatgggccaggcgctcagcca

SEQ ID NO: 139693 - DNA, 25 bp, Homo sapien
cggtcagttccctggttgtggacat

SEQ ID NO: 139694 - DNA, 25 bp, Homo sapien
ctcagccagggcacagaatcgggac

SEQ ID NO: 139695 - DNA, 25 bp, Homo sapien
gccaggaatgcgacgtcctctgccg

SEQ ID NO: 139696 - DNA, 25 bp, Homo sapien
agggatggcgacaaacactccgtgc

SEQ ID NO: 139697 - DNA, 25 bp, Homo sapien
ccagaggacacacgagcgcacgttc

SEQ ID NO: 139698 - DNA, 25 bp, Homo sapien
cctgatgggccacgcagacaccggg

SEQ ID NO: 139699 - DNA, 25 bp, Homo sapien
gtccgcagagctgagccgaagaccc

SEQ ID NO: 139700 - DNA, 25 bp, Homo sapien
tggtcactccactgatctcagattc

SEQ ID NO: 139701 - DNA, 25 bp, Homo sapien
gcctcaggctcgatctctctgcaga

SEQ ID NO: 139702 - DNA, 25 bp, Homo sapien
tcccgggtgagtagaccatggccat

SEQ ID NO: 139703 - DNA, 25 bp, Homo sapien
tccttgttttgcagtgaggggtcca

SEQ ID NO: 139704 - DNA, 25 bp, Homo sapien
ccaagcgcaataaacaccctgaatg

SEQ ID NO: 139705 - DNA, 25 bp, Homo sapien
accctgaatgcctgtggcgctgtgc

SEQ ID NO: 139706 - DNA, 25 bp, Homo sapien
tgggacttttctacctccgcacgga

SEQ ID NO: 139707 - DNA, 25 bp, Homo sapien
tctcagattcgggacagaagtgccc

SEQ ID NO: 139708 - DNA, 25 bp, Homo sapien
tttggagcacctgcttcacgccgga

SEQ ID NO: 139709 - DNA, 25 bp, Homo sapien
tccaggatgtatccgcagagccacg

SEQ ID NO: 139710 - DNA, 25 bp, Homo sapien
cagagccacggagggaacctggact

SEQ ID NO: 139711 - DNA, 25 bp, Homo sapien
aactcggcctctagtcgcctgaagc

SEQ ID NO: 139712 - DNA, 25 bp, Homo sapien
ggaagtcgttcttccgcgcaggagc

SEQ ID NO: 139713 - DNA, 25 bp, Homo sapien
cccgcttcgtgtgctactgcgaagg

SEQ ID NO: 139714 - DNA, 25 bp, Homo sapien
cggcggcttcaacctctagtgagtg

SEQ ID NO: 139715 - DNA, 25 bp, Homo sapien
ttacgattagagttaggaagcttcc

SEQ ID NO: 139716 - DNA, 25 bp, Homo sapien
tctgtcttggcgtcgctgtcataga

SEQ ID NO: 139717 - DNA, 25 bp, Homo sapien
cgaagtccttcagcacgtccgggga

SEQ ID NO: 139718 - DNA, 25 bp, Homo sapien
agcgtctcctccagaaagtcctcga

SEQ ID NO: 139719 - DNA, 25 bp, Homo sapien
tgttggactccctgtaacgaggcgc

SEQ ID NO: 139720 - DNA, 25 bp, Homo sapien
ttccgtgctcacgtcgacgatgtgc

SEQ ID NO: 139721 - DNA, 25 bp, Homo sapien
aagtcctcgatctgcagcgtgtctg

SEQ ID NO: 139722 - DNA, 25 bp, Homo sapien
tgtgcggacacgtgtatttgaactc

SEQ ID NO: 139723 - DNA, 25 bp, Homo sapien
gaactctttctcctgcatcgcgctg

SEQ ID NO: 139724 - DNA, 25 bp, Homo sapien
ccgggccgggtcagcctttggcaca

SEQ ID NO: 139725 - DNA, 25 bp, Homo sapien
cctttggcacaattaggggcggcaa

SEQ ID NO: 139726 - DNA, 25 bp, Homo sapien
agcagggcaagggtgtacgcagccc

SEQ ID NO: 139727 - DNA, 25 bp, Homo sapien
ccgaggctttaaggcaaagcagggc

SEQ ID NO: 139728 - DNA, 25 bp, Homo sapien
gaaaagctggttccgaggccgggca

SEQ ID NO: 139729 - DNA, 25 bp, Homo sapien
cttcatcgtaagagagaaaagctgg

SEQ ID NO: 139730 - DNA, 25 bp, Homo sapien
gcatcagccttcatcgtaagagaga

SEQ ID NO: 139731 - DNA, 25 bp, Homo sapien
ttggcacaattaggggcggcaaccg

SEQ ID NO: 139732 - DNA, 25 bp, Homo sapien
cgggccgcgggtttctggaatccat

SEQ ID NO: 139733 - DNA, 25 bp, Homo sapien
agctcaatccgagcgcaggcgcaga

SEQ ID NO: 139734 - DNA, 25 bp, Homo sapien
cctgaagggtcaaagctcaatccga

SEQ ID NO: 139735 - DNA, 25 bp, Homo sapien
gtttctgggtctgaatccggtgagc

SEQ ID NO: 139736 - DNA, 25 bp, Homo sapien
tcgcgataggaccaagaggatcctg

SEQ ID NO: 139737 - DNA, 25 bp, Homo sapien
cattctctgcaccactcgcgatagg

SEQ ID NO: 139738 - DNA, 25 bp, Homo sapien
gcccagcgctccctgaagggtcaaa

SEQ ID NO: 139739 - DNA, 25 bp, Homo sapien
ggcccagatagtttcctcgcgcagg

SEQ ID NO: 139740 - DNA, 25 bp, Homo sapien
cttagcctcggcgtccaaaatggac

SEQ ID NO: 139741 - DNA, 25 bp, Homo sapien
ttgccagtgcaacacaggaatcctg

SEQ ID NO: 139742 - DNA, 25 bp, Homo sapien
ctctaggaacttcgcgggcacaacc

SEQ ID NO: 139743 - DNA, 25 bp, Homo sapien
cttgcctgctgtgactcgaagctgc

SEQ ID NO: 139744 - DNA, 25 bp, Homo sapien
ccgcaacgggctgagctctaggaac

SEQ ID NO: 139745 - DNA, 25 bp, Homo sapien
aacagtttccttcttgcgctacacg

SEQ ID NO: 139746 - DNA, 25 bp, Homo sapien
taacgcgcacgaggggatcatcatt

SEQ ID NO: 139747 - DNA, 25 bp, Homo sapien
gtgttcccgcccagagttcggacta

SEQ ID NO: 139748 - DNA, 25 bp, Homo sapien
ttgaaggtgctggtcttgcccgcac

SEQ ID NO: 139749 - DNA, 25 bp, Homo sapien
aggagcccgaagcactcgccaggac

SEQ ID NO: 139750 - DNA, 25 bp, Homo sapien
gagatcccacgcagccgcgtgtaca

SEQ ID NO: 139751 - DNA, 25 bp, Homo sapien
aacggccaggatacggccaatcttc

SEQ ID NO: 139752 - DNA, 25 bp, Homo sapien
tgagctcgtcgaacagcgcgtcaca

SEQ ID NO: 139753 - DNA, 25 bp, Homo sapien
agcagctccttcagcacgctgggga

SEQ ID NO: 139754 - DNA, 25 bp, Homo sapien
tgtgtccattgacgaaggcctcgcc

SEQ ID NO: 139755 - DNA, 25 bp, Homo sapien
tcgccggtcagcatcttgaaggtgc

SEQ ID NO: 139756 - DNA, 25 bp, Homo sapien
agacaacgaagctggccggcacgaa

SEQ ID NO: 139757 - DNA, 25 bp, Homo sapien
ttctcggccacgaggaagacaacga

SEQ ID NO: 139758 - DNA, 25 bp, Homo sapien
gccgctgacaaactgcaggtgcttg

SEQ ID NO: 139759 - DNA, 25 bp, Homo sapien
acgtagttcgccagccagtagatga

SEQ ID NO: 139760 - DNA, 25 bp, Homo sapien
cggcaggtcgaacacaaacaggatg

SEQ ID NO: 139761 - DNA, 25 bp, Homo sapien
tccgcttacccatagagcaggaaga

SEQ ID NO: 139762 - DNA, 25 bp, Homo sapien
tacatgatgggcgtgatggaccacc

SEQ ID NO: 139763 - DNA, 25 bp, Homo sapien
ccaccttgtcgtgctcgaagagctg

SEQ ID NO: 139764 - DNA, 25 bp, Homo sapien
acccgtcgccataggtgcccttgag

SEQ ID NO: 139765 - DNA, 25 bp, Homo sapien
agccgcagcacttgagcttcccatg

SEQ ID NO: 139766 - DNA, 25 bp, Homo sapien
ttcccatgggagatgatggcaatgc

SEQ ID NO: 139767 - DNA, 25 bp, Homo sapien
aggtcagcctcatccatgtggtggg

SEQ ID NO: 139768 - DNA, 25 bp, Homo sapien
tgcggcctaggacaaggccagaccc

SEQ ID NO: 139769 - DNA, 25 bp, Homo sapien
cactcacctggcttgtacttcagga

SEQ ID NO: 139770 - DNA, 25 bp, Homo sapien
acttcaggatgaggtcccagatggc

SEQ ID NO: 139771 - DNA, 25 bp, Homo sapien
cacggacagcttgcgcttcatgcca

SEQ ID NO: 139772 - DNA, 25 bp, Homo sapien
tctcggatcgccacgtacatgtagg

SEQ ID NO: 139773 - DNA, 25 bp, Homo sapien
ccagcactcactcatcgcgtgtgta

SEQ ID NO: 139774 - DNA, 25 bp, Homo sapien
tggccttggagtacagcacagacac

SEQ ID NO: 139775 - DNA, 25 bp, Homo sapien
tggcccgcgctcaccagaacatgat

SEQ ID NO: 139776 - DNA, 25 bp, Homo sapien
gtgcataagcacctggccgtacttc

SEQ ID NO: 139777 - DNA, 25 bp, Homo sapien
gttgttcaggcccatggtcttcatc

SEQ ID NO: 139778 - DNA, 25 bp, Homo sapien
cagcggcatcatgtgctcaatgaca

SEQ ID NO: 139779 - DNA, 25 bp, Homo sapien
gcacttctcgaaggccgtgatctta

SEQ ID NO: 139780 - DNA, 25 bp, Homo sapien
ccagacccgtgcaccttgaggatga

SEQ ID NO: 139781 - DNA, 25 bp, Homo sapien
ctgctccttgctcgtgaagcccagg

SEQ ID NO: 139782 - DNA, 25 bp, Homo sapien
aggaggcccaggttccgctgctcct

SEQ ID NO: 139783 - DNA, 25 bp, Homo sapien
gcccgcaggcgcgtacaggattttg

SEQ ID NO: 139784 - DNA, 25 bp, Homo sapien
atgacgcggtcgacctcagagcccg

SEQ ID NO: 139785 - DNA, 25 bp, Homo sapien
cagcgcctcgggttcaatggtgctg

SEQ ID NO: 139786 - DNA, 25 bp, Homo sapien
gtcccagacccgtgcaccttgagga

SEQ ID NO: 139787 - DNA, 25 bp, Homo sapien
accttgaggatgacgcggtcgacct

SEQ ID NO: 139788 - DNA, 25 bp, Homo sapien
gcaccatggcggatgtcactcactg

SEQ ID NO: 139789 - DNA, 25 bp, Homo sapien
actcacgtggagttggcgtactgca

SEQ ID NO: 139790 - DNA, 25 bp, Homo sapien
tccgggcacagcgattgcatgacag

SEQ ID NO: 139791 - DNA, 25 bp, Homo sapien
gggcccgcactgagggcctccagat

SEQ ID NO: 139792 - DNA, 25 bp, Homo sapien
cctccagatgctggcgtagggcctc

SEQ ID NO: 139793 - DNA, 25 bp, Homo sapien
ctgggtcaaacaggttgccttcctc

SEQ ID NO: 139794 - DNA, 25 bp, Homo sapien
gcgctcaagcagctgcgtgaccctg

SEQ ID NO: 139795 - DNA, 25 bp, Homo sapien
tgcaggaagccgaactcgtctcgct

SEQ ID NO: 139796 - DNA, 25 bp, Homo sapien
gagcgtcacgttcttccagagcagc

SEQ ID NO: 139797 - DNA, 25 bp, Homo sapien
ctccggcgtttgagcgtcacgttct

SEQ ID NO: 139798 - DNA, 25 bp, Homo sapien
accgcgctggcgactctgcagaggc

SEQ ID NO: 139799 - DNA, 25 bp, Homo sapien
agggtctcctgtgtgctttgtaaac

SEQ ID NO: 139800 - DNA, 25 bp, Homo sapien
gctttgtaaaccagcacttggagtc

SEQ ID NO: 139801 - DNA, 25 bp, Homo sapien
ccgcgattccgagcagccagcggaa

SEQ ID NO: 139802 - DNA, 25 bp, Homo sapien
cccaggaacgctcgccgtgagcgga

SEQ ID NO: 139803 - DNA, 25 bp, Homo sapien
tgctgcacgcggctcgtttttctcc

SEQ ID NO: 139804 - DNA, 25 bp, Homo sapien
tcccgccagtcggtgaacagtcgca

SEQ ID NO: 139805 - DNA, 25 bp, Homo sapien
gccagcaggcttcggttggcactca

SEQ ID NO: 139806 - DNA, 25 bp, Homo sapien
cgttggtatcggctctcattcatgc

SEQ ID NO: 139807 - DNA, 25 bp, Homo sapien
gtcatccacatgcacgaaggcgtca

SEQ ID NO: 139808 - DNA, 25 bp, Homo sapien
tgccgctcctggaagttgctgacca

SEQ ID NO: 139809 - DNA, 25 bp, Homo sapien
ctccgtaatgtagtcgcggtgctga

SEQ ID NO: 139810 - DNA, 25 bp, Homo sapien
agtgcgttgcgccagaatttctccg

SEQ ID NO: 139811 - DNA, 25 bp, Homo sapien
cggtagctcagcacccagttgaaga

SEQ ID NO: 139812 - DNA, 25 bp, Homo sapien
ggtgtctcggcacctgcggtctctg

SEQ ID NO: 139813 - DNA, 25 bp, Homo sapien
gcgctcccggcggaagaagccatga

SEQ ID NO: 139814 - DNA, 25 bp, Homo sapien
aggatgcgctcccttctggcctctt

SEQ ID NO: 139815 - DNA, 25 bp, Homo sapien
ctctctcggcctcagggtgtctcgg

SEQ ID NO: 139816 - DNA, 25 bp, Homo sapien
ggccaggcctgtttattccatcgtg

SEQ ID NO: 139817 - DNA, 25 bp, Homo sapien
tacgcctctgggaaccggcagaagc

SEQ ID NO: 139818 - DNA, 25 bp, Homo sapien
aagccatgaatgtaaggtacgcctc

SEQ ID NO: 139819 - DNA, 25 bp, Homo sapien
tgtgggcctagcctcgcgagcgcac

SEQ ID NO: 139820 - DNA, 25 bp, Homo sapien
ccagaggtggttacagtcaagttta

SEQ ID NO: 139821 - DNA, 25 bp, Homo sapien
cgcggtgcccgacaaaggtaaggca

SEQ ID NO: 139822 - DNA, 25 bp, Homo sapien
tcaagtttagggactgcaggagcga

SEQ ID NO: 139823 - DNA, 25 bp, Homo sapien
gcacatcccagggagaacgcgcctt

SEQ ID NO: 139824 - DNA, 25 bp, Homo sapien
ttccagcctccagcgaagtggcgcg

SEQ ID NO: 139825 - DNA, 25 bp, Homo sapien
ccgcagacggcgaaaaccagaggtg

SEQ ID NO: 139826 - DNA, 25 bp, Homo sapien
agcgaattcccgaaggcttgcagga

SEQ ID NO: 139827 - DNA, 25 bp, Homo sapien
tagcgacccttagagacgcaacgtg

SEQ ID NO: 139828 - DNA, 25 bp, Homo sapien
ctaaatggtgcttggcagcttggcg

SEQ ID NO: 139829 - DNA, 25 bp, Homo sapien
cggagtgcacctgacgcagcagcag

SEQ ID NO: 139830 - DNA, 25 bp, Homo sapien
gcccggacacgaatggcaagaccga

SEQ ID NO: 139831 - DNA, 25 bp, Homo sapien
tgcgaggccagagaccaccacacag

SEQ ID NO: 139832 - DNA, 25 bp, Homo sapien
tggcacccgagcttgcagctgggac

SEQ ID NO: 139833 - DNA, 25 bp, Homo sapien
tcttctggaagatcacgccgccgaa

SEQ ID NO: 139834 - DNA, 25 bp, Homo sapien
cccaggagctgaagtctgtgccctt

SEQ ID NO: 139835 - DNA, 25 bp, Homo sapien
ggatcaggttggtcaggttcagcat

SEQ ID NO: 139836 - DNA, 25 bp, Homo sapien
gcacgtttttacacctgctcggccg

SEQ ID NO: 139837 - DNA, 25 bp, Homo sapien
acgcggctggagcacgtttttacac

SEQ ID NO: 139838 - DNA, 25 bp, Homo sapien
tggagcacgtttttacacctgctcg

SEQ ID NO: 139839 - DNA, 25 bp, Homo sapien
ggctggagcacgtttttacacctgc

SEQ ID NO: 139840 - DNA, 25 bp, Homo sapien
gcggctggagcacgtttttacacct

SEQ ID NO: 139841 - DNA, 25 bp, Homo sapien
gctggagcacgtttttacacctgct

SEQ ID NO: 139842 - DNA, 25 bp, Homo sapien
cggctggagcacgtttttacacctg

SEQ ID NO: 139843 - DNA, 25 bp, Homo sapien
gagcacgtttttacacctgctcggc

SEQ ID NO: 139844 - DNA, 25 bp, Homo sapien
ccagaaaaacctgtgcctgtcctca

SEQ ID NO: 139845 - DNA, 25 bp, Homo sapien
aactcaagacccgaaatggccaact

SEQ ID NO: 139846 - DNA, 25 bp, Homo sapien
tgccgctagccgcatccttctatcg

SEQ ID NO: 139847 - DNA, 25 bp, Homo sapien
atgcaaacgcttgccgctagccgca

SEQ ID NO: 139848 - DNA, 25 bp, Homo sapien
cgactatgcaaacgcttgccgctag

SEQ ID NO: 139849 - DNA, 25 bp, Homo sapien
aaatggccaactcttcaccgagggg

SEQ ID NO: 139850 - DNA, 25 bp, Homo sapien
cccttcgccaagctcaatccctttt

SEQ ID NO: 139851 - DNA, 25 bp, Homo sapien
cgaaatggccaactcttcaccgagg

SEQ ID NO: 139852 - DNA, 25 bp, Homo sapien
acgcacagcagtaggaggccggcga

SEQ ID NO: 139853 - DNA, 25 bp, Homo sapien
cacccagggggcatcgctgggctat

SEQ ID NO: 139854 - DNA, 25 bp, Homo sapien
ggcggcagcagtgaccgcaccttcc

SEQ ID NO: 139855 - DNA, 25 bp, Homo sapien
gggcggacaggtttcgcctccgctc

SEQ ID NO: 139856 - DNA, 25 bp, Homo sapien
tccgctcccaagcttccgccgtccg

SEQ ID NO: 139857 - DNA, 25 bp, Homo sapien
aggaggccagactcgcttgcaggaa

SEQ ID NO: 139858 - DNA, 25 bp, Homo sapien
cagactcgcttgcaggaatgaggca

SEQ ID NO: 139859 - DNA, 25 bp, Homo sapien
actcccgggacttgttccttcagca

SEQ ID NO: 139860 - DNA, 25 bp, Homo sapien
gagctcagcccacggcgacaatagc

SEQ ID NO: 139861 - DNA, 25 bp, Homo sapien
agcccgtcccatctgctctctgata

SEQ ID NO: 139862 - DNA, 25 bp, Homo sapien
gcggcgtcagccctcattaacatgc

SEQ ID NO: 139863 - DNA, 25 bp, Homo sapien
acggcgacaatagcgactacttttg

SEQ ID NO: 139864 - DNA, 25 bp, Homo sapien
cagcagctgtgggactgcggtttct

SEQ ID NO: 139865 - DNA, 25 bp, Homo sapien
cccttgtgggaaatgcacgggcagc

SEQ ID NO: 139866 - DNA, 25 bp, Homo sapien
ggtcccgtcccttgtgggaaatgca

SEQ ID NO: 139867 - DNA, 25 bp, Homo sapien
gcgactacttttgaatggggccctc

SEQ ID NO: 139868 - DNA, 25 bp, Homo sapien
caggtacgtcatgaccagcgagttc

SEQ ID NO: 139869 - DNA, 25 bp, Homo sapien
tcctcgctactttgagacgtgtctc

SEQ ID NO: 139870 - DNA, 25 bp, Homo sapien
cctggagcggaaagacaaagttgcc

SEQ ID NO: 139871 - DNA, 25 bp, Homo sapien
ccgccaacgtggtcatgtttgagca

SEQ ID NO: 139872 - DNA, 25 bp, Homo sapien
gggagcacaacttcttccacctgga

SEQ ID NO: 139873 - DNA, 25 bp, Homo sapien
atttctctgaacaaggtggccgtcc

SEQ ID NO: 139874 - DNA, 25 bp, Homo sapien
cccaggtttccgtcagatttctctg

SEQ ID NO: 139875 - DNA, 25 bp, Homo sapien
ggccgagttcttcagggagcacaac

SEQ ID NO: 139876 - DNA, 25 bp, Homo sapien
ctgccggacgcatgcgcaatgaacc

SEQ ID NO: 139877 - DNA, 25 bp, Homo sapien
gctgggactctctgccaacatggcg

SEQ ID NO: 139878 - DNA, 25 bp, Homo sapien
gctacgctcgtagcacacctgggca

SEQ ID NO: 139879 - DNA, 25 bp, Homo sapien
ccgtcgccaccactgtagtcatgta

SEQ ID NO: 139880 - DNA, 25 bp, Homo sapien
tcgcagcagttgtctgacgcagtcg

SEQ ID NO: 139881 - DNA, 25 bp, Homo sapien
gagctctcggttcctctcagtcgga

SEQ ID NO: 139882 - DNA, 25 bp, Homo sapien
cctcatcgggacttcatctcggtga

SEQ ID NO: 139883 - DNA, 25 bp, Homo sapien
tccaggcccatgaggcgaaccacgt

SEQ ID NO: 139884 - DNA, 25 bp, Homo sapien
ggtcggtggtgttacattcacgctg

SEQ ID NO: 139885 - DNA, 25 bp, Homo sapien
catgcaggtcggtggtgttacacac

SEQ ID NO: 139886 - DNA, 25 bp, Homo sapien
cggtggtgttacattcacgctgttg

SEQ ID NO: 139887 - DNA, 25 bp, Homo sapien
tggtgttacattcacgctgttgcag

SEQ ID NO: 139888 - DNA, 25 bp, Homo sapien
ggcgtgcaggttggtgttacacaca

SEQ ID NO: 139889 - DNA, 25 bp, Homo sapien
cacacattcacacttgcaggcgtgc

SEQ ID NO: 139890 - DNA, 25 bp, Homo sapien
caggttggtgttacacacattcaca

SEQ ID NO: 139891 - DNA, 25 bp, Homo sapien
tgcaggtcggtggtgttacattcac

SEQ ID NO: 139892 - DNA, 25 bp, Homo sapien
cccagccctcggtgagcctgtcccg

SEQ ID NO: 139893 - DNA, 25 bp, Homo sapien
accacggaagcaggatcttctgggt

SEQ ID NO: 139894 - DNA, 25 bp, Homo sapien
cctccgcacctgaggtcgaggtggt

SEQ ID NO: 139895 - DNA, 25 bp, Homo sapien
cgaggtggtgcgctcccccctggat

SEQ ID NO: 139896 - DNA, 25 bp, Homo sapien
cgccgatgatggtggcctccagctt

SEQ ID NO: 139897 - DNA, 25 bp, Homo sapien
gcctcaaccacggaagcaggatctt

SEQ ID NO: 139898 - DNA, 25 bp, Homo sapien
cgcgcctcaaccacggaagcaggat

SEQ ID NO: 139899 - DNA, 25 bp, Homo sapien
tcaaccacggaagcaggatcttctg

SEQ ID NO: 139900 - DNA, 25 bp, Homo sapien
ccagctccgcgacgaaggccgagtt

SEQ ID NO: 139901 - DNA, 25 bp, Homo sapien
acgtgctccgcgaagaccagtagag

SEQ ID NO: 139902 - DNA, 25 bp, Homo sapien
agcgacttcccgtagtagcgctggg

SEQ ID NO: 139903 - DNA, 25 bp, Homo sapien
actgcgcaccgaacggcagcgactt

SEQ ID NO: 139904 - DNA, 25 bp, Homo sapien
gtcgccctcgttcccagtgtagaag

SEQ ID NO: 139905 - DNA, 25 bp, Homo sapien
cccgacaccaggaagcgctgaggga

SEQ ID NO: 139906 - DNA, 25 bp, Homo sapien
cttgttgccgaagcgctcgaagttg

SEQ ID NO: 139907 - DNA, 25 bp, Homo sapien
ctcgaagttgaagtggtccagacgc

SEQ ID NO: 139908 - DNA, 25 bp, Homo sapien
ggggctttcagactcggctccagcc

SEQ ID NO: 139909 - DNA, 25 bp, Homo sapien
gcacagaaccgtccgcgtgtgagca

SEQ ID NO: 139910 - DNA, 25 bp, Homo sapien
gagacccggtcctgtaaaagactga

SEQ ID NO: 139911 - DNA, 25 bp, Homo sapien
ctctgcgtcaccgaaatgaagtcct

SEQ ID NO: 139912 - DNA, 25 bp, Homo sapien
gcagttcttgctgttgccgtagctc

SEQ ID NO: 139913 - DNA, 25 bp, Homo sapien
cctatgcgcctgcactgagagctca

SEQ ID NO: 139914 - DNA, 25 bp, Homo sapien
cggtgcatggtcctccagcactgtt

SEQ ID NO: 139915 - DNA, 25 bp, Homo sapien
tgccgtagctctcgccaaagctctg

SEQ ID NO: 139916 - DNA, 25 bp, Homo sapien
cccgcgaacgccaagtgacagaagc

SEQ ID NO: 139917 - DNA, 25 bp, Homo sapien
cccttttttgcagcgggaaggcaat

SEQ ID NO: 139918 - DNA, 25 bp, Homo sapien
ctgcagactccagggatcaaaggtc

SEQ ID NO: 139919 - DNA, 25 bp, Homo sapien
gggacaagcctataacagcgacatc

SEQ ID NO: 139920 - DNA, 25 bp, Homo sapien
tgcagtctcccaagcgctgaacggc

SEQ ID NO: 139921 - DNA, 25 bp, Homo sapien
ggggcggatttctcgcttcttcctc

SEQ ID NO: 139922 - DNA, 25 bp, Homo sapien
gcgccctctcggctgagacggaaaa

SEQ ID NO: 139923 - DNA, 25 bp, Homo sapien
gctctggggctgaatattttctgtc

SEQ ID NO: 139924 - DNA, 25 bp, Homo sapien
aaaagttgtcaggtctccagcccgg

SEQ ID NO: 139925 - DNA, 25 bp, Homo sapien
ttcctctccgtgtatccggaagatg

SEQ ID NO: 139926 - DNA, 25 bp, Homo sapien
ttaatttccgaaggcacgagctccc

SEQ ID NO: 139927 - DNA, 25 bp, Homo sapien
ctggcatccgcaaatgtgacccgca

SEQ ID NO: 139928 - DNA, 25 bp, Homo sapien
acaggcagttccagctccgggtaag

SEQ ID NO: 139929 - DNA, 25 bp, Homo sapien
ccgcggactgtatcgcctacctgga

SEQ ID NO: 139930 - DNA, 25 bp, Homo sapien
tcacgcggaccacgtgcagatctgg

SEQ ID NO: 139931 - DNA, 25 bp, Homo sapien
ttcccggcagaagtctccagggctg

SEQ ID NO: 139932 - DNA, 25 bp, Homo sapien
atcgtcaacattggcgcggtgctga

SEQ ID NO: 139933 - DNA, 25 bp, Homo sapien
ggtgacgactcttgcgcgcacacac

SEQ ID NO: 139934 - DNA, 25 bp, Homo sapien
acgtttccaaactgagctccctgca

SEQ ID NO: 139935 - DNA, 25 bp, Homo sapien
tatcgctgactgtgggtgacgactc

SEQ ID NO: 139936 - DNA, 25 bp, Homo sapien
cacgcggaagcacgagcagatgttc

SEQ ID NO: 139937 - DNA, 25 bp, Homo sapien
agatgttccgcgaggccgtgaacca

SEQ ID NO: 139938 - DNA, 25 bp, Homo sapien
cacggctcctggaagattcagctca

SEQ ID NO: 139939 - DNA, 25 bp, Homo sapien
gcacgacgcgttcggtcctattaaa

SEQ ID NO: 139940 - DNA, 25 bp, Homo sapien
tttgccattagtcgaaatctccttc

SEQ ID NO: 139941 - DNA, 25 bp, Homo sapien
tccagcgtgtggtttgagatgatgc

SEQ ID NO: 139942 - DNA, 25 bp, Homo sapien
atgatgcgtgtctacagctggaacc

SEQ ID NO: 139943 - DNA, 25 bp, Homo sapien
agctggaaccacatcatcctgctgg

SEQ ID NO: 139944 - DNA, 25 bp, Homo sapien
tccgtgtgtgacaccctcttctttc

SEQ ID NO: 139945 - DNA, 25 bp, Homo sapien
ctcttctttccatcgtgcatggtca

SEQ ID NO: 139946 - DNA, 25 bp, Homo sapien
tgcatggtcagcaccaccacgtctg

SEQ ID NO: 139947 - DNA, 25 bp, Homo sapien
tgtcctcggctcatttcactcgctt

SEQ ID NO: 139948 - DNA, 25 bp, Homo sapien
tctgcaacctgaccgaaagaaagtc

SEQ ID NO: 139949 - DNA, 25 bp, Homo sapien
cgagtgggacgttaactggccaata

SEQ ID NO: 139950 - DNA, 25 bp, Homo sapien
ggccaatagtttgcaactgccggtc

SEQ ID NO: 139951 - DNA, 25 bp, Homo sapien
ccagtcggggaagaactctgcaacc

SEQ ID NO: 139952 - DNA, 25 bp, Homo sapien
gtgtcagggtccgagactcccaagt

SEQ ID NO: 139953 - DNA, 25 bp, Homo sapien
agcgaagtcaccacgttggggacta

SEQ ID NO: 139954 - DNA, 25 bp, Homo sapien
gacggcgaatttatccaaacactta

SEQ ID NO: 139955 - DNA, 25 bp, Homo sapien
caggagtaacttctgcaccgaggca

SEQ ID NO: 139956 - DNA, 25 bp, Homo sapien
caagagcacagcttcgtggcaggga

SEQ ID NO: 139957 - DNA, 25 bp, Homo sapien
tggtgtgattgctttagcgccgtca

SEQ ID NO: 139958 - DNA, 25 bp, Homo sapien
gcgccgtcattttcaaccgtttata

SEQ ID NO: 139959 - DNA, 25 bp, Homo sapien
tcctatgacaacaagcgcggaccca

SEQ ID NO: 139960 - DNA, 25 bp, Homo sapien
cgcggacccaaggtatatatgcatg

SEQ ID NO: 139961 - DNA, 25 bp, Homo sapien
tatatgcatggacgtgcacgccacc

SEQ ID NO: 139962 - DNA, 25 bp, Homo sapien
ctctccgggaagtgcatgcgaatct

SEQ ID NO: 139963 - DNA, 25 bp, Homo sapien
tttctcccgagagcgaccgtttcca

SEQ ID NO: 139964 - DNA, 25 bp, Homo sapien
cgaggacgatgctgccactgtatac

SEQ ID NO: 139965 - DNA, 25 bp, Homo sapien
tgtataccgcgcagccgcgatgctg

SEQ ID NO: 139966 - DNA, 25 bp, Homo sapien
cgcgatgctgaacatgacgggctcc

SEQ ID NO: 139967 - DNA, 25 bp, Homo sapien
tgagtcgcatgctcgcctaggcatc

SEQ ID NO: 139968 - DNA, 25 bp, Homo sapien
gggctgcagctcatcaacggcaaga

SEQ ID NO: 139969 - DNA, 25 bp, Homo sapien
tcctcgagaaggagaacatcaccga

SEQ ID NO: 139970 - DNA, 25 bp, Homo sapien
gctgcgtgggcaacaccaacatctg

SEQ ID NO: 139971 - DNA, 25 bp, Homo sapien
ccaacatctggaagaccgggccgct

SEQ ID NO: 139972 - DNA, 25 bp, Homo sapien
cccagattgtgacgatccaccagga

SEQ ID NO: 139973 - DNA, 25 bp, Homo sapien
ccaggagcccttcgtgtacgtcaag

SEQ ID NO: 139974 - DNA, 25 bp, Homo sapien
tacgtcaagcccacgctgagtgatg

SEQ ID NO: 139975 - DNA, 25 bp, Homo sapien
ggacatgcaaggaggagttcacagt

SEQ ID NO: 139976 - DNA, 25 bp, Homo sapien
gttcacagtcaacggcgacccagtc

SEQ ID NO: 139977 - DNA, 25 bp, Homo sapien
cgacccagtcaagaaggtgatctgc

SEQ ID NO: 139978 - DNA, 25 bp, Homo sapien
cctcagtgttgctacggcttttgca

SEQ ID NO: 139979 - DNA, 25 bp, Homo sapien
cggcttttgcatcgacctgctcatc

SEQ ID NO: 139980 - DNA, 25 bp, Homo sapien
gactcgttcatgcagccgttccaga

SEQ ID NO: 139981 - DNA, 25 bp, Homo sapien
tgatgctgtacctgctggaccgctt

SEQ ID NO: 139982 - DNA, 25 bp, Homo sapien
ggatatctacttccggcgccaggtg

SEQ ID NO: 139983 - DNA, 25 bp, Homo sapien
ctcaactccggcatcggggaaggta

SEQ ID NO: 139984 - DNA, 25 bp, Homo sapien
gctgagcaccatgtaccggcatatg

SEQ ID NO: 139985 - DNA, 25 bp, Homo sapien
gccatccaggccgtgagagacaagt

SEQ ID NO: 139986 - DNA, 25 bp, Homo sapien
ggccggctttgccatgatcatcgtg

SEQ ID NO: 139987 - DNA, 25 bp, Homo sapien
ggacaagtttatctacgccacggtg

SEQ ID NO: 139988 - DNA, 25 bp, Homo sapien
aggaatgtgactcgcgcagcaacgc

SEQ ID NO: 139989 - DNA, 25 bp, Homo sapien
cggtgcgttctccttcatccattct

SEQ ID NO: 139990 - DNA, 25 bp, Homo sapien
cttttgagaacatggccggtgcgtt

SEQ ID NO: 139991 - DNA, 25 bp, Homo sapien
cctgcgacccttacttttgagaaca

SEQ ID NO: 139992 - DNA, 25 bp, Homo sapien
ggccgggatcttcctgattttcatc

SEQ ID NO: 139993 - DNA, 25 bp, Homo sapien
ttcatcgagattgcctacaagcggc

SEQ ID NO: 139994 - DNA, 25 bp, Homo sapien
ttcatccattctcgggtgggttctc

SEQ ID NO: 139995 - DNA, 25 bp, Homo sapien
ggcacaaggatgctcgccggaagca

SEQ ID NO: 139996 - DNA, 25 bp, Homo sapien
tggctcgggactgtcttcaaccctg

SEQ ID NO: 139997 - DNA, 25 bp, Homo sapien
ccacctcccggtgtatgcagtggtg

SEQ ID NO: 139998 - DNA, 25 bp, Homo sapien
tcacgcagttttcggtctgtgtcgc

SEQ ID NO: 139999 - DNA, 25 bp, Homo sapien
cgtctcggcctctgtgggacacaga

SEQ ID NO: 140000 - DNA, 25 bp, Homo sapien
cgagcgtgtaaaccacggccaggtc

SEQ ID NO: 140001 - DNA, 25 bp, Homo sapien
tgttgacgccggcagacagtgtaaa

SEQ ID NO: 140002 - DNA, 25 bp, Homo sapien
tcctccagactcgagagggctgagc

SEQ ID NO: 140003 - DNA, 25 bp, Homo sapien
tgcctaaaggaatgtcacgcagttt

SEQ ID NO: 140004 - DNA, 25 bp, Homo sapien
gggtagcaagcactaagccctagga

SEQ ID NO: 140005 - DNA, 25 bp, Homo sapien
aggcgtgttggcctagaggtcattc

SEQ ID NO: 140006 - DNA, 25 bp, Homo sapien
ggtcattcgccagcctcagcaattc

SEQ ID NO: 140007 - DNA, 25 bp, Homo sapien
ccgagacctcctggccgagcgtgtg

SEQ ID NO: 140008 - DNA, 25 bp, Homo sapien
ccttctaaaggccagaggcgcagga

SEQ ID NO: 140009 - DNA, 25 bp, Homo sapien
tctggcgggtagcaagcactaagcc

SEQ ID NO: 140010 - DNA, 25 bp, Homo sapien
tgacgtggaccttcacgtgccgctc

SEQ ID NO: 140011 - DNA, 25 bp, Homo sapien
taagccctaggacgtggctgcctga

SEQ ID NO: 140012 - DNA, 25 bp, Homo sapien
ggatggcgtgccaagtctcacctaa

SEQ ID NO: 140013 - DNA, 25 bp, Homo sapien
cgtgccaagtctcacctaaggctgg

SEQ ID NO: 140014 - DNA, 25 bp, Homo sapien
ccttctgcgcggttactggcacgcg

SEQ ID NO: 140015 - DNA, 25 bp, Homo sapien
agcgagaccgcctgttggttaaact

SEQ ID NO: 140016 - DNA, 25 bp, Homo sapien
gctccgagcgcagtagcgagaccgc

SEQ ID NO: 140017 - DNA, 25 bp, Homo sapien
aatgtcatttgcctgtttcccgcgc

SEQ ID NO: 140018 - DNA, 25 bp, Homo sapien
caggagcgctaggagaatgtcattt

SEQ ID NO: 140019 - DNA, 25 bp, Homo sapien
agtctcacctaaggctgggaaggcg

SEQ ID NO: 140020 - DNA, 25 bp, Homo sapien
gatggccagcgcgtcacaggcctca

SEQ ID NO: 140021 - DNA, 25 bp, Homo sapien
caccgctcggggctgaagctgaact

SEQ ID NO: 140022 - DNA, 25 bp, Homo sapien
agcagcgagcggtactcattgatga

SEQ ID NO: 140023 - DNA, 25 bp, Homo sapien
tcattgatgaagaggtccttgctgc

SEQ ID NO: 140024 - DNA, 25 bp, Homo sapien
ccgtagatgctgaccagcaggctga

SEQ ID NO: 140025 - DNA, 25 bp, Homo sapien
ccagcaggctgatgatgtccgatga

SEQ ID NO: 140026 - DNA, 25 bp, Homo sapien
tgatgtccgatgaacgccgcttgga

SEQ ID NO: 140027 - DNA, 25 bp, Homo sapien
tccttgctgccgtagatgctgacca

SEQ ID NO: 140028 - DNA, 25 bp, Homo sapien
ctggaggctggagcacatcaaaacc

SEQ ID NO: 140029 - DNA, 25 bp, Homo sapien
tgcaggaacaccttgccgagccagc

SEQ ID NO: 140030 - DNA, 25 bp, Homo sapien
gcaggaccacctcggacgatgctga

SEQ ID NO: 140031 - DNA, 25 bp, Homo sapien
acccgctcgatccactgtcaggaga

SEQ ID NO: 140032 - DNA, 25 bp, Homo sapien
tcaggagaacgctagtgtgagctgc

SEQ ID NO: 140033 - DNA, 25 bp, Homo sapien
cgtagatgcggtagaagaacctttg

SEQ ID NO: 140034 - DNA, 25 bp, Homo sapien
acgatgctgaagagctcctcgatgc

SEQ ID NO: 140035 - DNA, 25 bp, Homo sapien
tgatggcccaaaaggcgacgtcccg

SEQ ID NO: 140036 - DNA, 25 bp, Homo sapien
ccgaagctatggaagggctgtcagc

SEQ ID NO: 140037 - DNA, 25 bp, Homo sapien
acagagccgtatgaacccgagggta

SEQ ID NO: 140038 - DNA, 25 bp, Homo sapien
tgctcacggtgttccaggccactaa

SEQ ID NO: 140039 - DNA, 25 bp, Homo sapien
ctgactctggcttcctcgggtggaa

SEQ ID NO: 140040 - DNA, 25 bp, Homo sapien
aggccactaacaactcctgtccggg

SEQ ID NO: 140041 - DNA, 25 bp, Homo sapien
gcgctcagcgatgacgcgctagttc

SEQ ID NO: 140042 - DNA, 25 bp, Homo sapien
gcgcggcgctgcagaactacaacaa

SEQ ID NO: 140043 - DNA, 25 bp, Homo sapien
ggcccgcgtcaacgagaacctggca

SEQ ID NO: 140044 - DNA, 25 bp, Homo sapien
gctttgctgttcagccctccggctg

SEQ ID NO: 140045 - DNA, 25 bp, Homo sapien
aggccgggaatttgcccagactgag

SEQ ID NO: 140046 - DNA, 25 bp, Homo sapien
cccggcggtacatggcttccagctt

SEQ ID NO: 140047 - DNA, 25 bp, Homo sapien
cagcttctcaagtcgggccctcagg

SEQ ID NO: 140048 - DNA, 25 bp, Homo sapien
cggctgctggcttagagccaaagga

SEQ ID NO: 140049 - DNA, 25 bp, Homo sapien
ccagactgaggcgtgtcctgtctcc

SEQ ID NO: 140050 - DNA, 25 bp, Homo sapien
gggttcctgtagaggctgctcctcc

SEQ ID NO: 140051 - DNA, 25 bp, Homo sapien
tgtctctagccctccggttcgtgct

SEQ ID NO: 140052 - DNA, 25 bp, Homo sapien
cgggcaccgtctcgatgatgaggac

SEQ ID NO: 140053 - DNA, 25 bp, Homo sapien
gtgaaggagttgctgccggtcttct

SEQ ID NO: 140054 - DNA, 25 bp, Homo sapien
cgaccattggggaaagcccgctctc

SEQ ID NO: 140055 - DNA, 25 bp, Homo sapien
ccatgctgcgaacgcggcagcggac

SEQ ID NO: 140056 - DNA, 25 bp, Homo sapien
tgccggtcttctggaggaagtcgct

SEQ ID NO: 140057 - DNA, 25 bp, Homo sapien
cctccagcagcatgaacgggttctc

SEQ ID NO: 140058 - DNA, 25 bp, Homo sapien
aacctctccagtaggcggctgacgc

SEQ ID NO: 140059 - DNA, 25 bp, Homo sapien
tccaggatctcacgcttccaagcgg

SEQ ID NO: 140060 - DNA, 25 bp, Homo sapien
tcgctgtcttggagtcttgatctgt

SEQ ID NO: 140061 - DNA, 25 bp, Homo sapien
acccgcctcgctgtcttggagtctt

SEQ ID NO: 140062 - DNA, 25 bp, Homo sapien
gaggagttcggtggctgttcacacc

SEQ ID NO: 140063 - DNA, 25 bp, Homo sapien
caagccgtccgtgccgctagggagc

SEQ ID NO: 140064 - DNA, 25 bp, Homo sapien
gaaccaagccgtccgtgccgctagg

SEQ ID NO: 140065 - DNA, 25 bp, Homo sapien
ctaagatctgatcgccaggactgcg

SEQ ID NO: 140066 - DNA, 25 bp, Homo sapien
cggctaagatctgatcgccaggact

SEQ ID NO: 140067 - DNA, 25 bp, Homo sapien
gttcggtggctgttcacacccgcct

SEQ ID NO: 140068 - DNA, 25 bp, Homo sapien
ctcgtagagaatctgcaggcactgc

SEQ ID NO: 140069 - DNA, 25 bp, Homo sapien
tccctgaagaagcagcgagcgaggc

SEQ ID NO: 140070 - DNA, 25 bp, Homo sapien
caggcaggcgctactacatgatgga

SEQ ID NO: 140071 - DNA, 25 bp, Homo sapien
agtactgccggaaggtctggtagca

SEQ ID NO: 140072 - DNA, 25 bp, Homo sapien
tgaagagcacagtctcacggcggca

SEQ ID NO: 140073 - DNA, 25 bp, Homo sapien
aatgacctcatcctctggggccacg

SEQ ID NO: 140074 - DNA, 25 bp, Homo sapien
gccaggccgaatcacgtactgattc

SEQ ID NO: 140075 - DNA, 25 bp, Homo sapien
ctcaggatggacgtgttgacagcca

SEQ ID NO: 140076 - DNA, 25 bp, Homo sapien
agccctgcgcatagggtctggcttg

SEQ ID NO: 140077 - DNA, 25 bp, Homo sapien
agaccgcacctgctctaggcagagc

SEQ ID NO: 140078 - DNA, 25 bp, Homo sapien
gctgccacgctgtgaccagctctgg

SEQ ID NO: 140079 - DNA, 25 bp, Homo sapien
atcgctgtgactctaaggggcaaga

SEQ ID NO: 140080 - DNA, 25 bp, Homo sapien
ccggtgccgtagctcagatagatcg

SEQ ID NO: 140081 - DNA, 25 bp, Homo sapien
attcaggaggagaatccggctgttc

SEQ ID NO: 140082 - DNA, 25 bp, Homo sapien
gcgagtgtcactcagaagagcaata

SEQ ID NO: 140083 - DNA, 25 bp, Homo sapien
ctcacagtaggaggcctcaggactc

SEQ ID NO: 140084 - DNA, 25 bp, Homo sapien
cctttcctgagaacgtgagcttcgc

SEQ ID NO: 140085 - DNA, 25 bp, Homo sapien
agcacctccaggagacgcgcggacg

SEQ ID NO: 140086 - DNA, 25 bp, Homo sapien
tagacccgcagcacgacacggtgga

SEQ ID NO: 140087 - DNA, 25 bp, Homo sapien
gccatgtccagcgtggattccagaa

SEQ ID NO: 140088 - DNA, 25 bp, Homo sapien
tggattccagaacccgccgcctaga

SEQ ID NO: 140089 - DNA, 25 bp, Homo sapien
gggcaccatgattcagacccggaaa

SEQ ID NO: 140090 - DNA, 25 bp, Homo sapien
ttcgccggaactaccgcggcacgaa

SEQ ID NO: 140091 - DNA, 25 bp, Homo sapien
cgcggctcgccaatcaggcgtagtg

SEQ ID NO: 140092 - DNA, 25 bp, Homo sapien
ctgaccttcgcactgcagagcagca

SEQ ID NO: 140093 - DNA, 25 bp, Homo sapien
cgccacctgtttgcgggcacggagc

SEQ ID NO: 140094 - DNA, 25 bp, Homo sapien
tgcctggtcctcatagtcaagctgc

SEQ ID NO: 140095 - DNA, 25 bp, Homo sapien
gtcaagctgctcaactctgtgctgc

SEQ ID NO: 140096 - DNA, 25 bp, Homo sapien
cccaggtcgtgaggacagtcatcaa

SEQ ID NO: 140097 - DNA, 25 bp, Homo sapien
tgaggacagtcatcaatgcgggtga

SEQ ID NO: 140098 - DNA, 25 bp, Homo sapien
tacctggccctccttgtgggcgctg

SEQ ID NO: 140099 - DNA, 25 bp, Homo sapien
ccctcatgggtgagcaggcaggaca

SEQ ID NO: 140100 - DNA, 25 bp, Homo sapien
ccaaatcggcgccaaggtaagttgc

SEQ ID NO: 140101 - DNA, 25 bp, Homo sapien
ggctgcggctgaccaataaagacca

SEQ ID NO: 140102 - DNA, 25 bp, Homo sapien
aacacccaatggacggagcactgcg

SEQ ID NO: 140103 - DNA, 25 bp, Homo sapien
tctggcagcccattccgagactagc

SEQ ID NO: 140104 - DNA, 25 bp, Homo sapien
cccgctcttctgctgctgtttgtct

SEQ ID NO: 140105 - DNA, 25 bp, Homo sapien
tgtttgtctacttcctcctgcttcc

SEQ ID NO: 140106 - DNA, 25 bp, Homo sapien
aaatcgtgcacttgcaggccgggca

SEQ ID NO: 140107 - DNA, 25 bp, Homo sapien
aatcaaacgagggagcttgccagcc

SEQ ID NO: 140108 - DNA, 25 bp, Homo sapien
gaagttttccggctttctgctggtg

SEQ ID NO: 140109 - DNA, 25 bp, Homo sapien
gcgttttccacgcttatgtacacga

SEQ ID NO: 140110 - DNA, 25 bp, Homo sapien
tcagatctcagttttggcgacagcg

SEQ ID NO: 140111 - DNA, 25 bp, Homo sapien
tttcacgcggaggaacccacgctca

SEQ ID NO: 140112 - DNA, 25 bp, Homo sapien
ccgcgagatctgcaagagcgttttc

SEQ ID NO: 140113 - DNA, 25 bp, Homo sapien
cacgaaattcactcggctgcgacga

SEQ ID NO: 140114 - DNA, 25 bp, Homo sapien
ctgaaggagaccctgaccaactgca

SEQ ID NO: 140115 - DNA, 25 bp, Homo sapien
cggagccgctcaaggccatcgagca

SEQ ID NO: 140116 - DNA, 25 bp, Homo sapien
tgggtgaaatctgcaccgtggaccc

SEQ ID NO: 140117 - DNA, 25 bp, Homo sapien
ctgacagtgcctcttgctgcaggtg

SEQ ID NO: 140118 - DNA, 25 bp, Homo sapien
ctgtacgacatggtgctgcagtttc

SEQ ID NO: 140119 - DNA, 25 bp, Homo sapien
gctgcagtttctgcgcacgctcttc

SEQ ID NO: 140120 - DNA, 25 bp, Homo sapien
tgcgcacgcggaatgtgcactactg

SEQ ID NO: 140121 - DNA, 25 bp, Homo sapien
tgcactactgcacgctgcgggctga

SEQ ID NO: 140122 - DNA, 25 bp, Homo sapien
tgcgggctgagctgctcatgtccct

SEQ ID NO: 140123 - DNA, 25 bp, Homo sapien
gcacgacctggacgtgggtgaaatc

SEQ ID NO: 140124 - DNA, 25 bp, Homo sapien
acgaccttgagattgccgcgctagc

SEQ ID NO: 140125 - DNA, 25 bp, Homo sapien
gccggtgacacttccactaaaattg

SEQ ID NO: 140126 - DNA, 25 bp, Homo sapien
attggcgttcccacagcagctgacg

SEQ ID NO: 140127 - DNA, 25 bp, Homo sapien
ctgactgctacgtttgcgccgtttc

SEQ ID NO: 140128 - DNA, 25 bp, Homo sapien
ctgctgcaaccatcggaggaaagtc

SEQ ID NO: 140129 - DNA, 25 bp, Homo sapien
aaagtccgctgtctctggtgcgacc

SEQ ID NO: 140130 - DNA, 25 bp, Homo sapien
caggttatgcgtcacttccggccgt

SEQ ID NO: 140131 - DNA, 25 bp, Homo sapien
gggttgccataaccagttgcgcttc

SEQ ID NO: 140132 - DNA, 25 bp, Homo sapien
acagctggatcaccggaagcccagc

SEQ ID NO: 140133 - DNA, 25 bp, Homo sapien
gcagtgaaggagctttactcccagc

SEQ ID NO: 140134 - DNA, 25 bp, Homo sapien
tgaaggagctttactcccagctcgg

SEQ ID NO: 140135 - DNA, 25 bp, Homo sapien
gagctttactcccagctcggcgaga

SEQ ID NO: 140136 - DNA, 25 bp, Homo sapien
tttactcccagctcggcgagaagct

SEQ ID NO: 140137 - DNA, 25 bp, Homo sapien
tggaacagctggatcaccggaagcc

SEQ ID NO: 140138 - DNA, 25 bp, Homo sapien
cctgctcagccggaagaggctcccg

SEQ ID NO: 140139 - DNA, 25 bp, Homo sapien
cccatggtgtggttccccgcagagc

SEQ ID NO: 140140 - DNA, 25 bp, Homo sapien
cagtgctgaagtggggttctcattc

SEQ ID NO: 140141 - DNA, 25 bp, Homo sapien
tctagtgaatttgtggctgcccggc

SEQ ID NO: 140142 - DNA, 25 bp, Homo sapien
gtggccacggtgaacctcctgtagt

SEQ ID NO: 140143 - DNA, 25 bp, Homo sapien
gcggatcagcttggagctctgcttc

SEQ ID NO: 140144 - DNA, 25 bp, Homo sapien
cctcagagtccggagtctgtccctg

SEQ ID NO: 140145 - DNA, 25 bp, Homo sapien
gttcccatggtacaaggatgatctc

SEQ ID NO: 140146 - DNA, 25 bp, Homo sapien
tcagggccaacaattcccggggtca

SEQ ID NO: 140147 - DNA, 25 bp, Homo sapien
aggtcacgcgcttcgtgctgcagaa

SEQ ID NO: 140148 - DNA, 25 bp, Homo sapien
ctaaggggtacctgccgcttcctct

SEQ ID NO: 140149 - DNA, 25 bp, Homo sapien
aatggcccggctggttttgaatgta

SEQ ID NO: 140150 - DNA, 25 bp, Homo sapien
ccggctggttttgaatgtagagatc

SEQ ID NO: 140151 - DNA, 25 bp, Homo sapien
tgaatgtagagatcgggctttgtga

SEQ ID NO: 140152 - DNA, 25 bp, Homo sapien
tcccgagctagcaaagcccacatgg

SEQ ID NO: 140153 - DNA, 25 bp, Homo sapien
cgagagaagaaagaccgacagacgg

SEQ ID NO: 140154 - DNA, 25 bp, Homo sapien
agccacgagtcgctaaggggtacct

SEQ ID NO: 140155 - DNA, 25 bp, Homo sapien
cattagcatagcagctgctcgccga

SEQ ID NO: 140156 - DNA, 25 bp, Homo sapien
cgcgtacttcgccttggtgatgaga

SEQ ID NO: 140157 - DNA, 25 bp, Homo sapien
tgatgagatagagcacgatgtcctg

SEQ ID NO: 140158 - DNA, 25 bp, Homo sapien
agcagcttcacgagctccaggttgc

SEQ ID NO: 140159 - DNA, 25 bp, Homo sapien
agttggtcatgttctgcagcagcga

SEQ ID NO: 140160 - DNA, 25 bp, Homo sapien
tttgcataacaatggcagcccgtga

SEQ ID NO: 140161 - DNA, 25 bp, Homo sapien
ttcacgttgaactcgcagttggtca

SEQ ID NO: 140162 - DNA, 25 bp, Homo sapien
gcgccgaacttgaccagcagcttca

SEQ ID NO: 140163 - DNA, 25 bp, Homo sapien
tcgggcccgaacgagttcacgttga

SEQ ID NO: 140164 - DNA, 25 bp, Homo sapien
ccggccttggaaacggccactcagg

SEQ ID NO: 140165 - DNA, 25 bp, Homo sapien
cgcccggcggagattcaaaagctaa

SEQ ID NO: 140166 - DNA, 25 bp, Homo sapien
gattcaaaagctaacggccgcccgc

SEQ ID NO: 140167 - DNA, 25 bp, Homo sapien
caggagcggtgatggtcccgccatc

SEQ ID NO: 140168 - DNA, 25 bp, Homo sapien
cgggcgtgcccattccaaccaatgg

SEQ ID NO: 140169 - DNA, 25 bp, Homo sapien
ttggaaacggccactcagggcgccc

SEQ ID NO: 140170 - DNA, 25 bp, Homo sapien
actccctccaggagcggtgatggtc

SEQ ID NO: 140171 - DNA, 25 bp, Homo sapien
tgcccattccaaccaatggggccgg

SEQ ID NO: 140172 - DNA, 25 bp, Homo sapien
cggaaagactcgctgcgctggccca

SEQ ID NO: 140173 - DNA, 25 bp, Homo sapien
cgccggcgctagagggcgtgtctgc

SEQ ID NO: 140174 - DNA, 25 bp, Homo sapien
gcgtgtctgcggaaagactcgctgc

SEQ ID NO: 140175 - DNA, 25 bp, Homo sapien
tgtctgcggaaagactcgctgcgct

SEQ ID NO: 140176 - DNA, 25 bp, Homo sapien
agccgaacttgcgtgagaggcgcgg

SEQ ID NO: 140177 - DNA, 25 bp, Homo sapien
ctgcggaaagactcgctgcgctggc

SEQ ID NO: 140178 - DNA, 25 bp, Homo sapien
gagcgggagccgaacttgcgtgaga

SEQ ID NO: 140179 - DNA, 25 bp, Homo sapien
gaaagactcgctgcgctggcccagg

SEQ ID NO: 140180 - DNA, 25 bp, Homo sapien
gaccacgagggatgctctgccgaca

SEQ ID NO: 140181 - DNA, 25 bp, Homo sapien
cgagggatgctctgccgacacctca

SEQ ID NO: 140182 - DNA, 25 bp, Homo sapien
accacgagggatgctctgccgacac

SEQ ID NO: 140183 - DNA, 25 bp, Homo sapien
agacccacgagggatgctctgccga

SEQ ID NO: 140184 - DNA, 25 bp, Homo sapien
acccacgagggatgctctgccgaca

SEQ ID NO: 140185 - DNA, 25 bp, Homo sapien
acccacgagggatgatctgccgaca

SEQ ID NO: 140186 - DNA, 25 bp, Homo sapien
ccggacccacgagggatgatctgcc

SEQ ID NO: 140187 - DNA, 25 bp, Homo sapien
cccacgagggatgatctgccgacac

SEQ ID NO: 140188 - DNA, 25 bp, Homo sapien
cgacaatacgtggaagccgcccgca

SEQ ID NO: 140189 - DNA, 25 bp, Homo sapien
aagccgcccgcattcttcaggacgt

SEQ ID NO: 140190 - DNA, 25 bp, Homo sapien
attcttcaggacgtccgctgccctt

SEQ ID NO: 140191 - DNA, 25 bp, Homo sapien
ttgcacctctctggtgactctcagc

SEQ ID NO: 140192 - DNA, 25 bp, Homo sapien
acggacgctgccgtctgcctggaac

SEQ ID NO: 140193 - DNA, 25 bp, Homo sapien
gtctgcctggaacgaggcccagtca

SEQ ID NO: 140194 - DNA, 25 bp, Homo sapien
gaggcccagtcaggctctactgatg

SEQ ID NO: 140195 - DNA, 25 bp, Homo sapien
gttcccacgtggacgacaatacgtg

SEQ ID NO: 140196 - DNA, 25 bp, Homo sapien
ggcctgagctgctattaataatttc

SEQ ID NO: 140197 - DNA, 25 bp, Homo sapien
tgggaaagcctcgagccggcttcca

SEQ ID NO: 140198 - DNA, 25 bp, Homo sapien
ggggcctttccctgcgcagcgctga

SEQ ID NO: 140199 - DNA, 25 bp, Homo sapien
aaatgacccacgagagcagcccgcg

SEQ ID NO: 140200 - DNA, 25 bp, Homo sapien
aataatttccataagccgcgctccc

SEQ ID NO: 140201 - DNA, 25 bp, Homo sapien
ctgcacgtaccacgggcctgagctg

SEQ ID NO: 140202 - DNA, 25 bp, Homo sapien
tccaaggccacactggctgcgatcg

SEQ ID NO: 140203 - DNA, 25 bp, Homo sapien
cgcgctcccatagccagcaaaaatg

SEQ ID NO: 140204 - DNA, 25 bp, Homo sapien
cgctgccctcgacatgaaatatcgc

SEQ ID NO: 140205 - DNA, 25 bp, Homo sapien
atgcccgtgcccaggttccaatgca

SEQ ID NO: 140206 - DNA, 25 bp, Homo sapien
tcgcagcacattgagtcgtgagtcc

SEQ ID NO: 140207 - DNA, 25 bp, Homo sapien
tcgtgagtcccagctaatccgagcg

SEQ ID NO: 140208 - DNA, 25 bp, Homo sapien
aatccgagcggacaggcctgaatgc

SEQ ID NO: 140209 - DNA, 25 bp, Homo sapien
ctcggggacaatggctttcttcgca

SEQ ID NO: 140210 - DNA, 25 bp, Homo sapien
ctttcttcgcagaaggggcctgtgc

SEQ ID NO: 140211 - DNA, 25 bp, Homo sapien
catcctgcattgtcctgtgccggga

SEQ ID NO: 140212 - DNA, 25 bp, Homo sapien
tgctccggcgatttgaaagcttacc

SEQ ID NO: 140213 - DNA, 25 bp, Homo sapien
ctgctggctccagccacgggatgcg

SEQ ID NO: 140214 - DNA, 25 bp, Homo sapien
caagagggtgagttcccagctgctg

SEQ ID NO: 140215 - DNA, 25 bp, Homo sapien
cgatgtggatggtgtgctctccacg

SEQ ID NO: 140216 - DNA, 25 bp, Homo sapien
tccaggagcaacatcctgaggctgc

SEQ ID NO: 140217 - DNA, 25 bp, Homo sapien
tgttctcgtccctgcgatgtggatg

SEQ ID NO: 140218 - DNA, 25 bp, Homo sapien
gaaagcacttgctccggcgatttga

SEQ ID NO: 140219 - DNA, 25 bp, Homo sapien
ctgccgcgcagctttgaaagcactt

SEQ ID NO: 140220 - DNA, 25 bp, Homo sapien
tggactccctgctgagcaagagaga

SEQ ID NO: 140221 - DNA, 25 bp, Homo sapien
agcctgacaggcactccggaattca

SEQ ID NO: 140222 - DNA, 25 bp, Homo sapien
aaacctgagtctttcgcgctgggca

SEQ ID NO: 140223 - DNA, 25 bp, Homo sapien
tcagccctccatgacgcagagtgtg

SEQ ID NO: 140224 - DNA, 25 bp, Homo sapien
ctcgggacacggacacaaaggctcc

SEQ ID NO: 140225 - DNA, 25 bp, Homo sapien
gctcgtcatggccagtgtctgtctg

SEQ ID NO: 140226 - DNA, 25 bp, Homo sapien
ggaattcatcatcggcctcagccct

SEQ ID NO: 140227 - DNA, 25 bp, Homo sapien
aggcactgtgcgagaccagtccgca

SEQ ID NO: 140228 - DNA, 25 bp, Homo sapien
gtgacggtgaccgttgcctggggcc

SEQ ID NO: 140229 - DNA, 25 bp, Homo sapien
ttgtgggtgacggtgaccattgcct

SEQ ID NO: 140230 - DNA, 25 bp, Homo sapien
ttgcgggtgacggtgaccgttgcct

SEQ ID NO: 140231 - DNA, 25 bp, Homo sapien
ttgtgggtgacggtgaccgttgcct

SEQ ID NO: 140232 - DNA, 25 bp, Homo sapien
ctgtgtgaggggtacagggtttgtg

SEQ ID NO: 140233 - DNA, 25 bp, Homo sapien
gtttgtgggtgacggtgaccgttgc

SEQ ID NO: 140234 - DNA, 25 bp, Homo sapien
gccgaggggaatggggcatctgtgt

SEQ ID NO: 140235 - DNA, 25 bp, Homo sapien
tgtgggtgacggtgaccgttgcctg

SEQ ID NO: 140236 - DNA, 25 bp, Homo sapien
gcaaccgcgtctccgtgacacatgt

SEQ ID NO: 140237 - DNA, 25 bp, Homo sapien
accgcgtctccgtgacacatgtgca

SEQ ID NO: 140238 - DNA, 25 bp, Homo sapien
gtgacacgcgtccaacatcctcgta

SEQ ID NO: 140239 - DNA, 25 bp, Homo sapien
gcgtccaacatcctcgtaacacgtg

SEQ ID NO: 140240 - DNA, 25 bp, Homo sapien
gtccaacatcctcgtaacacgtgca

SEQ ID NO: 140241 - DNA, 25 bp, Homo sapien
tcgtaacacgtgcacaccgacatcc

SEQ ID NO: 140242 - DNA, 25 bp, Homo sapien
aggcaaccgcgtctccgtgacacat

SEQ ID NO: 140243 - DNA, 25 bp, Homo sapien
tgacacgcgtccaacatcctcgtaa

SEQ ID NO: 140244 - DNA, 25 bp, Homo sapien
aggctgggtctccgtttcccaccag

SEQ ID NO: 140245 - DNA, 25 bp, Homo sapien
gcccgttcacagaggcaccggagcg

SEQ ID NO: 140246 - DNA, 25 bp, Homo sapien
ccgcatctgctgcacccggagtggt

SEQ ID NO: 140247 - DNA, 25 bp, Homo sapien
gcctgccctaaataccgcagaggtg

SEQ ID NO: 140248 - DNA, 25 bp, Homo sapien
gctcgccagcaaacccgcccgttca

SEQ ID NO: 140249 - DNA, 25 bp, Homo sapien
gaggtgcggagccaacactgcctcc

SEQ ID NO: 140250 - DNA, 25 bp, Homo sapien
ctgtgaccgggaaggccccgcatct

SEQ ID NO: 140251 - DNA, 25 bp, Homo sapien
ccctaaataccgcagaggtgactgc

SEQ ID NO: 140252 - DNA, 25 bp, Homo sapien
ttcctcggaaagtcgaacacagcga

SEQ ID NO: 140253 - DNA, 25 bp, Homo sapien
tgacgaccgagctcccgggcaaagc

SEQ ID NO: 140254 - DNA, 25 bp, Homo sapien
ccgccacgaacggaacaggaggtcg

SEQ ID NO: 140255 - DNA, 25 bp, Homo sapien
cgtttcccgacagacgcggccagaa

SEQ ID NO: 140256 - DNA, 25 bp, Homo sapien
gatggccagtttcccacggcttgtc

SEQ ID NO: 140257 - DNA, 25 bp, Homo sapien
gatcaacaccaagggtcggtaggcc

SEQ ID NO: 140258 - DNA, 25 bp, Homo sapien
acacacgggtctggactcgcacaga

SEQ ID NO: 140259 - DNA, 25 bp, Homo sapien
aactccacgggagggtctgaccaag

SEQ ID NO: 140260 - DNA, 25 bp, Homo sapien
atcctgccgactcgactgctcgggg

SEQ ID NO: 140261 - DNA, 25 bp, Homo sapien
gtgctgggcgcgctacccagccaag

SEQ ID NO: 140262 - DNA, 25 bp, Homo sapien
tacccagccaaggtgaggcaggagc

SEQ ID NO: 140263 - DNA, 25 bp, Homo sapien
tcaggactctctccggacgtgcggt

SEQ ID NO: 140264 - DNA, 25 bp, Homo sapien
gtgggcaggtctcaggactctctcc

SEQ ID NO: 140265 - DNA, 25 bp, Homo sapien
acccgctgcagacgcggtcggcgaa

SEQ ID NO: 140266 - DNA, 25 bp, Homo sapien
gagcggccggatcctgccgactcga

SEQ ID NO: 140267 - DNA, 25 bp, Homo sapien
ggcgctcggcttttgggaagctccc

SEQ ID NO: 140268 - DNA, 25 bp, Homo sapien
ggctcactcccagctacggccctca

SEQ ID NO: 140269 - DNA, 25 bp, Homo sapien
cggagggctttatccggcgcaccaa

SEQ ID NO: 140270 - DNA, 25 bp, Homo sapien
ggccgcacctgagctaagcgaggcc

SEQ ID NO: 140271 - DNA, 25 bp, Homo sapien
cttcaacgcgggctgcgtgcacctg

SEQ ID NO: 140272 - DNA, 25 bp, Homo sapien
ccgccaggctgtgcttcaacgcggg

SEQ ID NO: 140273 - DNA, 25 bp, Homo sapien
gcgcacaaagctcccggcggaagtc

SEQ ID NO: 140274 - DNA, 25 bp, Homo sapien
ggaagccgggcgcacaaagctcccg

SEQ ID NO: 140275 - DNA, 25 bp, Homo sapien
tttatccggcgcaccaaggccagcg

SEQ ID NO: 140276 - DNA, 25 bp, Homo sapien
gggaggcagtcacctgctttcggaa

SEQ ID NO: 140277 - DNA, 25 bp, Homo sapien
ctcctcgctgaacccgtagccctcg

SEQ ID NO: 140278 - DNA, 25 bp, Homo sapien
agtcacctgctttcggaactcgagg

SEQ ID NO: 140279 - DNA, 25 bp, Homo sapien
tagcccagtgtccagccaatgtcca

SEQ ID NO: 140280 - DNA, 25 bp, Homo sapien
gttcagcatgtagcccagtgtccag

SEQ ID NO: 140281 - DNA, 25 bp, Homo sapien
gggatcatcccggtcaggttcagca

SEQ ID NO: 140282 - DNA, 25 bp, Homo sapien
ccgtagctctctgcccgccactgag

SEQ ID NO: 140283 - DNA, 25 bp, Homo sapien
ctttcggaactcgaggctgggccag

SEQ ID NO: 140284 - DNA, 25 bp, Homo sapien
tagcacgggtgacggagcagggcag

SEQ ID NO: 140285 - DNA, 25 bp, Homo sapien
cagggtgactcatacagcgggccca

SEQ ID NO: 140286 - DNA, 25 bp, Homo sapien
ccgctgaggtagcacgggtgacgga

SEQ ID NO: 140287 - DNA, 25 bp, Homo sapien
gcctgagcaccagccgcacacctgc

SEQ ID NO: 140288 - DNA, 25 bp, Homo sapien
accagccgcacacctgcggccctgt

SEQ ID NO: 140289 - DNA, 25 bp, Homo sapien
ccccggtgccggatgacccacgcca

SEQ ID NO: 140290 - DNA, 25 bp, Homo sapien
cacagggtgactcatacagcgggcc

SEQ ID NO: 140291 - DNA, 25 bp, Homo sapien
agggtgactcatacagcgggcccag

SEQ ID NO: 140292 - DNA, 25 bp, Homo sapien
tggccatagaggcatccccggggct

SEQ ID NO: 140293 - DNA, 25 bp, Homo sapien
cctcccgtggccatagaggcatccc

SEQ ID NO: 140294 - DNA, 25 bp, Homo sapien
cccggggctcagacggtctcccgtg

SEQ ID NO: 140295 - DNA, 25 bp, Homo sapien
ggcctcccgtggccatagaggcatc

SEQ ID NO: 140296 - DNA, 25 bp, Homo sapien
agacggcctcccgtggccatagagg

SEQ ID NO: 140297 - DNA, 25 bp, Homo sapien
gacggcctcccgtggccatagaggc

SEQ ID NO: 140298 - DNA, 25 bp, Homo sapien
cagacggcctcccgtggccatagag

SEQ ID NO: 140299 - DNA, 25 bp, Homo sapien
ccgtggccatagaggcatccccggg

SEQ ID NO: 140300 - DNA, 25 bp, Homo sapien
caaggaggaagctgtgcttagacgc

SEQ ID NO: 140301 - DNA, 25 bp, Homo sapien
agctgtgcttagacgcttctgtgtc

SEQ ID NO: 140302 - DNA, 25 bp, Homo sapien
ctgcctttcccgctcgccgtgggtc

SEQ ID NO: 140303 - DNA, 25 bp, Homo sapien
gcgcccgtcgttttccatttgcagc

SEQ ID NO: 140304 - DNA, 25 bp, Homo sapien
ggcgcccgtcgttttccatttgcag

SEQ ID NO: 140305 - DNA, 25 bp, Homo sapien
caggtcggagtcaggtgaccccgaa

SEQ ID NO: 140306 - DNA, 25 bp, Homo sapien
gtctgtctcggtgcccagggtcgcc

SEQ ID NO: 140307 - DNA, 25 bp, Homo sapien
cttagacgcttctgtgtccgcgcac

SEQ ID NO: 140308 - DNA, 25 bp, Homo sapien
tcacaggacgtcgtcaaagtccagc

SEQ ID NO: 140309 - DNA, 25 bp, Homo sapien
agtacgtctcgatcatctgcttccc

SEQ ID NO: 140310 - DNA, 25 bp, Homo sapien
ccggaagtcaaagtacgtctcgatc

SEQ ID NO: 140311 - DNA, 25 bp, Homo sapien
cagcagcttcgagtgctggcggctc

SEQ ID NO: 140312 - DNA, 25 bp, Homo sapien
gagccacacagtcccggggagcacg

SEQ ID NO: 140313 - DNA, 25 bp, Homo sapien
ctgagcaacgtctgaggtgccctga

SEQ ID NO: 140314 - DNA, 25 bp, Homo sapien
cgctgagcatccacgggccacaggg

SEQ ID NO: 140315 - DNA, 25 bp, Homo sapien
tccacaggcgatacaaccggaagtc

SEQ ID NO: 140316 - DNA, 25 bp, Homo sapien
cgcgagagctccgtgtgtaaccaag

SEQ ID NO: 140317 - DNA, 25 bp, Homo sapien
ctcaggatgaggagcctccgctatc

SEQ ID NO: 140318 - DNA, 25 bp, Homo sapien
ctcagaaagaagttaaggcacccgc

SEQ ID NO: 140319 - DNA, 25 bp, Homo sapien
cccacgtctgttctcttgccttgga

SEQ ID NO: 140320 - DNA, 25 bp, Homo sapien
ttgccttggagatgctgatccgctc

SEQ ID NO: 140321 - DNA, 25 bp, Homo sapien
tagctaactgttaccgtcgggcctg

SEQ ID NO: 140322 - DNA, 25 bp, Homo sapien
ccaggccaggcatgtaccaattcta

SEQ ID NO: 140323 - DNA, 25 bp, Homo sapien
gcgaaggttgcgaacagacctcctc

SEQ ID NO: 140324 - DNA, 25 bp, Homo sapien
cgccgctcagcgaacgctgcagaga

SEQ ID NO: 140325 - DNA, 25 bp, Homo sapien
aaggcgcgtgcaggcatcagctcca

SEQ ID NO: 140326 - DNA, 25 bp, Homo sapien
ccgcctttgcgatcggagatgctga

SEQ ID NO: 140327 - DNA, 25 bp, Homo sapien
ttcaggagtgcaaaagcgcagccca

SEQ ID NO: 140328 - DNA, 25 bp, Homo sapien
ggcacctactgtctcgggagtcgtg

SEQ ID NO: 140329 - DNA, 25 bp, Homo sapien
agtcgtgggaagtgtcggctttcat

SEQ ID NO: 140330 - DNA, 25 bp, Homo sapien
gtcgctccaggaccggctgaagctc

SEQ ID NO: 140331 - DNA, 25 bp, Homo sapien
gctgcagagagcaaaacccgcatta

SEQ ID NO: 140332 - DNA, 25 bp, Homo sapien
cagcaggccctgctgcgacctcggt

SEQ ID NO: 140333 - DNA, 25 bp, Homo sapien
cgcggaatcattctcccgtttccgg

SEQ ID NO: 140334 - DNA, 25 bp, Homo sapien
tgcctcacctgtcgaggcccagctc

SEQ ID NO: 140335 - DNA, 25 bp, Homo sapien
gagggacacagacgtcgggacagtg

SEQ ID NO: 140336 - DNA, 25 bp, Homo sapien
ggaaaccaccgcgagtcagcactgc

SEQ ID NO: 140337 - DNA, 25 bp, Homo sapien
cctgggaaaccaccgcgagtcagca

SEQ ID NO: 140338 - DNA, 25 bp, Homo sapien
tgaacaccctgggaaaccaccgcga

SEQ ID NO: 140339 - DNA, 25 bp, Homo sapien
aatcattctcccgtttccggcgctt

SEQ ID NO: 140340 - DNA, 25 bp, Homo sapien
ggagcccacacacccttggtcctgg

SEQ ID NO: 140341 - DNA, 25 bp, Homo sapien
cgcactcaccgcactttggccgcca

SEQ ID NO: 140342 - DNA, 25 bp, Homo sapien
ggccacggcacgaccctcccaaaca

SEQ ID NO: 140343 - DNA, 25 bp, Homo sapien
gtactctccaaacgctcgggctgct

SEQ ID NO: 140344 - DNA, 25 bp, Homo sapien
tgggacaggtactctccaaacgctc

SEQ ID NO: 140345 - DNA, 25 bp, Homo sapien
gtgactctgggacaggtactctcca

SEQ ID NO: 140346 - DNA, 25 bp, Homo sapien
ccgttgcggttctcagggtgactct

SEQ ID NO: 140347 - DNA, 25 bp, Homo sapien
ctacctgcgccgttgcggttctcag

SEQ ID NO: 140348 - DNA, 25 bp, Homo sapien
gtcttcacagaagacactgtgggga

SEQ ID NO: 140349 - DNA, 25 bp, Homo sapien
cgtctcccaggatttgtcttcacag

SEQ ID NO: 140350 - DNA, 25 bp, Homo sapien
ggaacgctggcttccagcatgaacg

SEQ ID NO: 140351 - DNA, 25 bp, Homo sapien
ggcactctctccactcacgaatgtg

SEQ ID NO: 140352 - DNA, 25 bp, Homo sapien
actcacgaatgtgcgggtggttccc

SEQ ID NO: 140353 - DNA, 25 bp, Homo sapien
aagcggagcttcagtcaagtgagcc

SEQ ID NO: 140354 - DNA, 25 bp, Homo sapien
acttggagaatcgagcagcgggatc

SEQ ID NO: 140355 - DNA, 25 bp, Homo sapien
aagtgagcctgactcccggctggca

SEQ ID NO: 140356 - DNA, 25 bp, Homo sapien
gctggtagcccacttcctgtgcaca

SEQ ID NO: 140357 - DNA, 25 bp, Homo sapien
agatgtcaaacaccgtgcgcccgtg

SEQ ID NO: 140358 - DNA, 25 bp, Homo sapien
ggcgcaggtactcgcagtagtcact

SEQ ID NO: 140359 - DNA, 25 bp, Homo sapien
tcacgcagatctcgttgaacttgcc

SEQ ID NO: 140360 - DNA, 25 bp, Homo sapien
aacttgccgaagtccagggtgctgt

SEQ ID NO: 140361 - DNA, 25 bp, Homo sapien
gcgcgtctgaatctctgccatgttc

SEQ ID NO: 140362 - DNA, 25 bp, Homo sapien
ccatcctctggggtaggtaggttct

SEQ ID NO: 140363 - DNA, 25 bp, Homo sapien
agctgccgcacgcaacacacgtagg

SEQ ID NO: 140364 - DNA, 25 bp, Homo sapien
gcacggatcagaccgcctcccacca

SEQ ID NO: 140365 - DNA, 25 bp, Homo sapien
tcagacccgggcacggatcagaccg

SEQ ID NO: 140366 - DNA, 25 bp, Homo sapien
tcagacccgggcacggatcagacca

SEQ ID NO: 140367 - DNA, 25 bp, Homo sapien
ccgggcacggatcagaccacctccc

SEQ ID NO: 140368 - DNA, 25 bp, Homo sapien
catcacctcagacccgggcacggat

SEQ ID NO: 140369 - DNA, 25 bp, Homo sapien
cccgggcacggatcagaccacctcc

SEQ ID NO: 140370 - DNA, 25 bp, Homo sapien
gtctccaccaactcagacccgggca

SEQ ID NO: 140371 - DNA, 25 bp, Homo sapien
gcacagatcagaccgcctcccacca

SEQ ID NO: 140372 - DNA, 25 bp, Homo sapien
tcactagtcagcagcagggtcgggc

SEQ ID NO: 140373 - DNA, 25 bp, Homo sapien
cagcggagccaaggcgccgttttat

SEQ ID NO: 140374 - DNA, 25 bp, Homo sapien
tggcggcacgcacctgtccagggca

SEQ ID NO: 140375 - DNA, 25 bp, Homo sapien
cagcaaggtaccgacgccgagccag

SEQ ID NO: 140376 - DNA, 25 bp, Homo sapien
tgaaaacaccaccaccagtaacgga

SEQ ID NO: 140377 - DNA, 25 bp, Homo sapien
gttgtcactagtcagcagcagggtc

SEQ ID NO: 140378 - DNA, 25 bp, Homo sapien
aaggcgccgttttatgttgtcacta

SEQ ID NO: 140379 - DNA, 25 bp, Homo sapien
gcagcccacctccaacgccaacaag

SEQ ID NO: 140380 - DNA, 25 bp, Homo sapien
ttctgagtcccgaacggcatgcacc

SEQ ID NO: 140381 - DNA, 25 bp, Homo sapien
cttgatggacgtgagggctcctgcc

SEQ ID NO: 140382 - DNA, 25 bp, Homo sapien
ttggccaattctgagtcccgaacgg

SEQ ID NO: 140383 - DNA, 25 bp, Homo sapien
tcctgccggcagcttggccaattct

SEQ ID NO: 140384 - DNA, 25 bp, Homo sapien
gaacggcatgcaccgtggtcgcccg

SEQ ID NO: 140385 - DNA, 25 bp, Homo sapien
ctgtccctgacagcctccggtgcct

SEQ ID NO: 140386 - DNA, 25 bp, Homo sapien
gcctgccagagccacacatgacacc

SEQ ID NO: 140387 - DNA, 25 bp, Homo sapien
tccacaccgcaaggcggaggcagtc

SEQ ID NO: 140388 - DNA, 25 bp, Homo sapien
cagtcgtggaaaatctgggttctca

SEQ ID NO: 140389 - DNA, 25 bp, Homo sapien
gcgtcctgacacacgagagggctca

SEQ ID NO: 140390 - DNA, 25 bp, Homo sapien
ttctcaagggctccgtgcagcgagc

SEQ ID NO: 140391 - DNA, 25 bp, Homo sapien
cggtttcatgatttcacgagcagtc

SEQ ID NO: 140392 - DNA, 25 bp, Homo sapien
tttcggcagcgtctacggtttcatg

SEQ ID NO: 140393 - DNA, 25 bp, Homo sapien
gggcatggacttcactggaaacatt

SEQ ID NO: 140394 - DNA, 25 bp, Homo sapien
gccgacctgatcagctctgggcatg

SEQ ID NO: 140395 - DNA, 25 bp, Homo sapien
gactgtccctggcaaatgcgcgtca

SEQ ID NO: 140396 - DNA, 25 bp, Homo sapien
ggaatacagaggaaccgcgcagaca

SEQ ID NO: 140397 - DNA, 25 bp, Homo sapien
agcgagtcatctgcactgcggtttc

SEQ ID NO: 140398 - DNA, 25 bp, Homo sapien
actgcggtttcccatccatactgga

SEQ ID NO: 140399 - DNA, 25 bp, Homo sapien
tactggaattcgcaacacccatttc

SEQ ID NO: 140400 - DNA, 25 bp, Homo sapien
aggcacagatccagcccttcgtgtg

SEQ ID NO: 140401 - DNA, 25 bp, Homo sapien
cgcagacactaaccgcagacacatg

SEQ ID NO: 140402 - DNA, 25 bp, Homo sapien
gggtcacgcacttccaggcacagat

SEQ ID NO: 140403 - DNA, 25 bp, Homo sapien
cacccatttctcagcggaatacaga

SEQ ID NO: 140404 - DNA, 25 bp, Homo sapien
tgccagacaccaacctgagcgggct

SEQ ID NO: 140405 - DNA, 25 bp, Homo sapien
acaccaacctgagcgggcttcctaa

SEQ ID NO: 140406 - DNA, 25 bp, Homo sapien
gtcaggagccaccactgtcaaatgc

SEQ ID NO: 140407 - DNA, 25 bp, Homo sapien
tgtcaaatgcccaccgccacagtgg

SEQ ID NO: 140408 - DNA, 25 bp, Homo sapien
cctaggacagggagcgcgcactgcc

SEQ ID NO: 140409 - DNA, 25 bp, Homo sapien
cccaggtgaggagccacagtggctc

SEQ ID NO: 140410 - DNA, 25 bp, Homo sapien
tctacgtccgacatcagcgtcggta

SEQ ID NO: 140411 - DNA, 25 bp, Homo sapien
tcgccaaagggcgtgccagacacca

SEQ ID NO: 140412 - DNA, 25 bp, Homo sapien
aagcagcaccttctcggatttgagc

SEQ ID NO: 140413 - DNA, 25 bp, Homo sapien
gagaaatgcgccctgggccacaggc

SEQ ID NO: 140414 - DNA, 25 bp, Homo sapien
gcctgggctgagatctgagaaatgc

SEQ ID NO: 140415 - DNA, 25 bp, Homo sapien
cttctcggatttgagcctttgcggc

SEQ ID NO: 140416 - DNA, 25 bp, Homo sapien
tccactgtctcgaaagcagcacctt

SEQ ID NO: 140417 - DNA, 25 bp, Homo sapien
ggaacgcgcttccactgtctcgaaa

SEQ ID NO: 140418 - DNA, 25 bp, Homo sapien
gattggggcggaacgcgcttccact

SEQ ID NO: 140419 - DNA, 25 bp, Homo sapien
atttgagcctttgcggcgcgcctgg

SEQ ID NO: 140420 - DNA, 25 bp, Homo sapien
caagacggccaagctggagccaggc

SEQ ID NO: 140421 - DNA, 25 bp, Homo sapien
ggtgagaattcttcacgtcaaactc

SEQ ID NO: 140422 - DNA, 25 bp, Homo sapien
cagcatgtacagaacttccgatggc

SEQ ID NO: 140423 - DNA, 25 bp, Homo sapien
ttccgatggcaggtgagaattcttc

SEQ ID NO: 140424 - DNA, 25 bp, Homo sapien
cttcacgtcaaactccgtgaggtcg

SEQ ID NO: 140425 - DNA, 25 bp, Homo sapien
cgctcttaccgaacgtttttcagca

SEQ ID NO: 140426 - DNA, 25 bp, Homo sapien
cccaacacaagacggccaagctgga

SEQ ID NO: 140427 - DNA, 25 bp, Homo sapien
ccgaacgtttttcagcatgtacaga

SEQ ID NO: 140428 - DNA, 25 bp, Homo sapien
tcgtgcagatcaaggagatggtccc

SEQ ID NO: 140429 - DNA, 25 bp, Homo sapien
ccctaccagattggggccgctattg

SEQ ID NO: 140430 - DNA, 25 bp, Homo sapien
gtcgtcccggatctgaccggcttca

SEQ ID NO: 140431 - DNA, 25 bp, Homo sapien
tgaccggcttcaagctcaagcccta

SEQ ID NO: 140432 - DNA, 25 bp, Homo sapien
aatcggagccgctcttgctgcgacg

SEQ ID NO: 140433 - DNA, 25 bp, Homo sapien
accgcgctgagagcgatcactcatc

SEQ ID NO: 140434 - DNA, 25 bp, Homo sapien
acctggcggacgaacacaggcagtg

SEQ ID NO: 140435 - DNA, 25 bp, Homo sapien
cgaatgagcaagtggacgagcaagc

SEQ ID NO: 140436 - DNA, 25 bp, Homo sapien
actaccaccgtctgagtctgcagtc

SEQ ID NO: 140437 - DNA, 25 bp, Homo sapien
gccggcagctcctgactcatcgggg

SEQ ID NO: 140438 - DNA, 25 bp, Homo sapien
tctgcctgttactgtcgagtgggtc

SEQ ID NO: 140439 - DNA, 25 bp, Homo sapien
tgtgggccttcgtacccgggctaca

SEQ ID NO: 140440 - DNA, 25 bp, Homo sapien
acattgaggctgtcttgggcttcac

SEQ ID NO: 140441 - DNA, 25 bp, Homo sapien
ggctggggtgttcggatttccaata

SEQ ID NO: 140442 - DNA, 25 bp, Homo sapien
agagtgatgctcctgtgtctgaccg

SEQ ID NO: 140443 - DNA, 25 bp, Homo sapien
tctgaccgggtttgtgagacattga

SEQ ID NO: 140444 - DNA, 25 bp, Homo sapien
attcggtgcgcctttcggcctcaac

SEQ ID NO: 140445 - DNA, 25 bp, Homo sapien
gtttggagacggcaagttagtgaca

SEQ ID NO: 140446 - DNA, 25 bp, Homo sapien
cagctcggtgtccaccgtttgcagg

SEQ ID NO: 140447 - DNA, 25 bp, Homo sapien
cgtttgcagggcgaaacagcccatc

SEQ ID NO: 140448 - DNA, 25 bp, Homo sapien
aggcttcgggaaatccgctcctcca

SEQ ID NO: 140449 - DNA, 25 bp, Homo sapien
cgctcctccacaaagcaggtttgga

SEQ ID NO: 140450 - DNA, 25 bp, Homo sapien
caacagcgagctgcggtagcgcacc

SEQ ID NO: 140451 - DNA, 25 bp, Homo sapien
acagagccgtaggtttgaagccgcc

SEQ ID NO: 140452 - DNA, 25 bp, Homo sapien
acccaatttgaagtcggtcatggcc

SEQ ID NO: 140453 - DNA, 25 bp, Homo sapien
ccgacgtcagtttcgcgggaagctt

SEQ ID NO: 140454 - DNA, 25 bp, Homo sapien
agctctgcgagctggctgcttttcg

SEQ ID NO: 140455 - DNA, 25 bp, Homo sapien
tgcttttcgcctcccttgcggtagc

SEQ ID NO: 140456 - DNA, 25 bp, Homo sapien
gcggtagcctccgtaagctgtttcc

SEQ ID NO: 140457 - DNA, 25 bp, Homo sapien
tgtttctggagagacagcggacgcc

SEQ ID NO: 140458 - DNA, 25 bp, Homo sapien
ccgcaacaaccaataggaggagggc

SEQ ID NO: 140459 - DNA, 25 bp, Homo sapien
gccgagccgcacgatacccaatttg

SEQ ID NO: 140460 - DNA, 25 bp, Homo sapien
acgcacgggacgcttgcgcctcaag

SEQ ID NO: 140461 - DNA, 25 bp, Homo sapien
gcgcccgacgcagcgcagcacctac

SEQ ID NO: 140462 - DNA, 25 bp, Homo sapien
gcagcacctacccagccgggacagg

SEQ ID NO: 140463 - DNA, 25 bp, Homo sapien
cggcatggggcgagtgcagctcttc

SEQ ID NO: 140464 - DNA, 25 bp, Homo sapien
gcaccgctgccgttccgaggtgggc

SEQ ID NO: 140465 - DNA, 25 bp, Homo sapien
cccgcggagtcgctgtcttcgccgc

SEQ ID NO: 140466 - DNA, 25 bp, Homo sapien
ctgaagcgggtccactgtggaggac

SEQ ID NO: 140467 - DNA, 25 bp, Homo sapien
ttgcgcctcaagtcccttaagcggc

SEQ ID NO: 140468 - DNA, 25 bp, Homo sapien
acgggaacctgcctgaaccagagca

SEQ ID NO: 140469 - DNA, 25 bp, Homo sapien
agggagtcagccttccgcgcaagcc

SEQ ID NO: 140470 - DNA, 25 bp, Homo sapien
caagccggcgaaatcaaagtgcgtc

SEQ ID NO: 140471 - DNA, 25 bp, Homo sapien
gccagcccaccaaaacgtcaattta

SEQ ID NO: 140472 - DNA, 25 bp, Homo sapien
tgttgaaaatgggacggctactccc

SEQ ID NO: 140473 - DNA, 25 bp, Homo sapien
tccactactacgactctggcgggcg

SEQ ID NO: 140474 - DNA, 25 bp, Homo sapien
cagccggagcataccctcggcaggg

SEQ ID NO: 140475 - DNA, 25 bp, Homo sapien
gcaggggcattcctcccaaccgagg

SEQ ID NO: 140476 - DNA, 25 bp, Homo sapien
tggctcaggacgctggccgataccc

SEQ ID NO: 140477 - DNA, 25 bp, Homo sapien
cacacagtggcgcaggacgctggcc

SEQ ID NO: 140478 - DNA, 25 bp, Homo sapien
acacagtggcgcaggacgctggccg

SEQ ID NO: 140479 - DNA, 25 bp, Homo sapien
ggcgcaggacgctggccgataccca

SEQ ID NO: 140480 - DNA, 25 bp, Homo sapien
tggcgcaggacgctggccgataccc

SEQ ID NO: 140481 - DNA, 25 bp, Homo sapien
aggacgctggccgatacccaccagg

SEQ ID NO: 140482 - DNA, 25 bp, Homo sapien
ccacacagtggcgcaggacgctggc

SEQ ID NO: 140483 - DNA, 25 bp, Homo sapien
cccacacagtggcgcaggacgctgg

SEQ ID NO: 140484 - DNA, 25 bp, Homo sapien
acgcgcaccgtgctgattttcacac

SEQ ID NO: 140485 - DNA, 25 bp, Homo sapien
ctcacgcgcaccgtgctgattttca

SEQ ID NO: 140486 - DNA, 25 bp, Homo sapien
ctcacacgcaccgtgctgattttca

SEQ ID NO: 140487 - DNA, 25 bp, Homo sapien
caccgtgatgattttcacacacagg

SEQ ID NO: 140488 - DNA, 25 bp, Homo sapien
catgattttcacacgcagggtgcgc

SEQ ID NO: 140489 - DNA, 25 bp, Homo sapien
tgcaccatgattttcacacgcaggg

SEQ ID NO: 140490 - DNA, 25 bp, Homo sapien
cctcgcatgcaccatgattttcaca

SEQ ID NO: 140491 - DNA, 25 bp, Homo sapien
gcttcacacacagggcgcgcccacc

SEQ ID NO: 140492 - DNA, 25 bp, Homo sapien
tgatgacgccgagacgtgtggtgat

SEQ ID NO: 140493 - DNA, 25 bp, Homo sapien
atgacgccgagacgtgtggtgatga

SEQ ID NO: 140494 - DNA, 25 bp, Homo sapien
cactgagatgtgtggtgatgacgcc

SEQ ID NO: 140495 - DNA, 25 bp, Homo sapien
gtgatgacggcatctcactgagatg

SEQ ID NO: 140496 - DNA, 25 bp, Homo sapien
atgtgtggtgatgacgctgagatgt

SEQ ID NO: 140497 - DNA, 25 bp, Homo sapien
ccgagacgtgtggtgatgacgccga

SEQ ID NO: 140498 - DNA, 25 bp, Homo sapien
tgacgccgagacgtgtggtgatgac

SEQ ID NO: 140499 - DNA, 25 bp, Homo sapien
gatgtgtggtgatgacggcatctca

SEQ ID NO: 140500 - DNA, 25 bp, Homo sapien
actcttagagctttcttggactttg

SEQ ID NO: 140501 - DNA, 25 bp, Homo sapien
cggcttcgaccttggagtcccaggc

SEQ ID NO: 140502 - DNA, 25 bp, Homo sapien
caggtctgtttggaaatgccgccgc

SEQ ID NO: 140503 - DNA, 25 bp, Homo sapien
tgcccttgcacactcgggtctgtct

SEQ ID NO: 140504 - DNA, 25 bp, Homo sapien
ttggactttgtctcagtgccctgtg

SEQ ID NO: 140505 - DNA, 25 bp, Homo sapien
ggtgtcgctctgactcttccttttg

SEQ ID NO: 140506 - DNA, 25 bp, Homo sapien
cgcgacctgtttcttggcgctggca

SEQ ID NO: 140507 - DNA, 25 bp, Homo sapien
tcccaggctgtgtgggacttggtca

SEQ ID NO: 140508 - DNA, 25 bp, Homo sapien
acccttgttcctgccgggaagtgca

SEQ ID NO: 140509 - DNA, 25 bp, Homo sapien
tggcagcaccgtggagagaaaagtc

SEQ ID NO: 140510 - DNA, 25 bp, Homo sapien
tgccaatccacgcaagggactctgc

SEQ ID NO: 140511 - DNA, 25 bp, Homo sapien
ggggcgtcgcttgccaatccacgca

SEQ ID NO: 140512 - DNA, 25 bp, Homo sapien
ttggagcgggttcttactcaccgtg

SEQ ID NO: 140513 - DNA, 25 bp, Homo sapien
ggacaaatcaagatcccggggtgga

SEQ ID NO: 140514 - DNA, 25 bp, Homo sapien
cccgaaagaaggacgatcttattga

SEQ ID NO: 140515 - DNA, 25 bp, Homo sapien
tgcagccagcgcgaaagaaaatggt

SEQ ID NO: 140516 - DNA, 25 bp, Homo sapien
ctcaaatggaagcagagcctgcggg

SEQ ID NO: 140517 - DNA, 25 bp, Homo sapien
tcgctgaccattcccgaggggaagg

SEQ ID NO: 140518 - DNA, 25 bp, Homo sapien
agatcgctgaccattcccgagggga

SEQ ID NO: 140519 - DNA, 25 bp, Homo sapien
catctgggaagatcgctgaccattc

SEQ ID NO: 140520 - DNA, 25 bp, Homo sapien
ttggtttatggcatctgggaagatc

SEQ ID NO: 140521 - DNA, 25 bp, Homo sapien
tcagccgccgcagcaaagcggtcag

SEQ ID NO: 140522 - DNA, 25 bp, Homo sapien
cagagctcaaatggaagcagagcct

SEQ ID NO: 140523 - DNA, 25 bp, Homo sapien
cgccgcagcaaagcggtcagtcagg

SEQ ID NO: 140524 - DNA, 25 bp, Homo sapien
gccgacgcatgcgaacttcccggtt

SEQ ID NO: 140525 - DNA, 25 bp, Homo sapien
atcaacagcgcctctgcgggtgccg

SEQ ID NO: 140526 - DNA, 25 bp, Homo sapien
gatccgggcaagttaggctggtccc

SEQ ID NO: 140527 - DNA, 25 bp, Homo sapien
catccctgagttccgtgcggacctg

SEQ ID NO: 140528 - DNA, 25 bp, Homo sapien
agtcaccctgtggaactggcatcca

SEQ ID NO: 140529 - DNA, 25 bp, Homo sapien
ccacagcttcggcactgtggggctg

SEQ ID NO: 140530 - DNA, 25 bp, Homo sapien
ttccgcaaccgctagggtctctgtg

SEQ ID NO: 140531 - DNA, 25 bp, Homo sapien
ggccctagaggaacgctcactcatc

SEQ ID NO: 140532 - DNA, 25 bp, Homo sapien
gcgcctctcttctcagtactgcgtg

SEQ ID NO: 140533 - DNA, 25 bp, Homo sapien
tctgcaaaaacagtgcaggcgtctg

SEQ ID NO: 140534 - DNA, 25 bp, Homo sapien
agtgccgctggtccgggtctgcaaa

SEQ ID NO: 140535 - DNA, 25 bp, Homo sapien
ctcaggtggtaagtgccgctggtcc

SEQ ID NO: 140536 - DNA, 25 bp, Homo sapien
tcagcatgcgctgctggtacgacaa

SEQ ID NO: 140537 - DNA, 25 bp, Homo sapien
tgcatgtgcggccagctcagcatgc

SEQ ID NO: 140538 - DNA, 25 bp, Homo sapien
tgctcctccagcaactgcatgtgcg

SEQ ID NO: 140539 - DNA, 25 bp, Homo sapien
agtactgcgtgtgcatcgacgactg

SEQ ID NO: 140540 - DNA, 25 bp, Homo sapien
ccgtgtaccgagaccgtagagaggc

SEQ ID NO: 140541 - DNA, 25 bp, Homo sapien
cgccgtgtaccgagaccgtagagag

SEQ ID NO: 140542 - DNA, 25 bp, Homo sapien
gccatgtaccgagaccgtagagagg

SEQ ID NO: 140543 - DNA, 25 bp, Homo sapien
gcgccgtgtaccgagactgtagaga

SEQ ID NO: 140544 - DNA, 25 bp, Homo sapien
cgtgtaccgagaccgtagagaggcc

SEQ ID NO: 140545 - DNA, 25 bp, Homo sapien
gcgccatgtaccgagaccgtagaga

SEQ ID NO: 140546 - DNA, 25 bp, Homo sapien
gcgccgtgtaccgagaccgtagaga

SEQ ID NO: 140547 - DNA, 25 bp, Homo sapien
taccgagactgtagagaggccgact

SEQ ID NO: 140548 - DNA, 25 bp, Homo sapien
gctcgcctggtttactgtcttgtca

SEQ ID NO: 140549 - DNA, 25 bp, Homo sapien
actgcccgcgccgtgaaggttgacg

SEQ ID NO: 140550 - DNA, 25 bp, Homo sapien
ttaatgttcatgctggggcaggttg

SEQ ID NO: 140551 - DNA, 25 bp, Homo sapien
tctcggaactcggtcctggaaagcc

SEQ ID NO: 140552 - DNA, 25 bp, Homo sapien
ctgtcgtctgtggtgttgcctcttc

SEQ ID NO: 140553 - DNA, 25 bp, Homo sapien
tgcctcttcccgtcgctgggtaaca

SEQ ID NO: 140554 - DNA, 25 bp, Homo sapien
cgtcgctgggtaacaaaccacgcca

SEQ ID NO: 140555 - DNA, 25 bp, Homo sapien
agagctgctctcgtccacgccttta

SEQ ID NO: 140556 - DNA, 25 bp, Homo sapien
ctacgggaacgtcagccggttcatc

SEQ ID NO: 140557 - DNA, 25 bp, Homo sapien
ctcgcattgctttcctgggcttgtc

SEQ ID NO: 140558 - DNA, 25 bp, Homo sapien
tctcgggtttatgctagtggttttc

SEQ ID NO: 140559 - DNA, 25 bp, Homo sapien
tcgacttggagccttggttctgttc

SEQ ID NO: 140560 - DNA, 25 bp, Homo sapien
caggtttgactatggagagcgcttc

SEQ ID NO: 140561 - DNA, 25 bp, Homo sapien
gattccgcacgcaaccgaaagggtc

SEQ ID NO: 140562 - DNA, 25 bp, Homo sapien
tttactgcatcgacgcgcggttcta

SEQ ID NO: 140563 - DNA, 25 bp, Homo sapien
ctgggacatcaaaggcaagctcttc

SEQ ID NO: 140564 - DNA, 25 bp, Homo sapien
tccacgccaccgtccctcctgtatc

SEQ ID NO: 140565 - DNA, 25 bp, Homo sapien
cctccgtatcctccatgccaccgtc

SEQ ID NO: 140566 - DNA, 25 bp, Homo sapien
cccgtatcctccatgccaccgtccc

SEQ ID NO: 140567 - DNA, 25 bp, Homo sapien
ctccgtatcctccatgccaccgtcc

SEQ ID NO: 140568 - DNA, 25 bp, Homo sapien
cctgtatcctccacgccaccgtccc

SEQ ID NO: 140569 - DNA, 25 bp, Homo sapien
ccctgtatcctccacgccaccgtcc

SEQ ID NO: 140570 - DNA, 25 bp, Homo sapien
ccctccgtatcctccatgccaccgt

SEQ ID NO: 140571 - DNA, 25 bp, Homo sapien
cctgtatcctccatgccaccgtccc

SEQ ID NO: 140572 - DNA, 25 bp, Homo sapien
aacatttctgttctggaatttccta

SEQ ID NO: 140573 - DNA, 25 bp, Homo sapien
ccagacaccaatctgttcctgtcag

SEQ ID NO: 140574 - DNA, 25 bp, Homo sapien
tggagtgcgcacttcattgcctctg

SEQ ID NO: 140575 - DNA, 25 bp, Homo sapien
gggtccatggagtgcgcacttcatt

SEQ ID NO: 140576 - DNA, 25 bp, Homo sapien
ttctggaatttcctataattgggtc

SEQ ID NO: 140577 - DNA, 25 bp, Homo sapien
accaatctgttcctgtcagtataga

SEQ ID NO: 140578 - DNA, 25 bp, Homo sapien
gaatttcctataattgggtccatgg

SEQ ID NO: 140579 - DNA, 25 bp, Homo sapien
tcctgtcagtatagattaacatttc

SEQ ID NO: 140580 - DNA, 25 bp, Homo sapien
gcgaggacaacgtcgtccgcaaata

SEQ ID NO: 140581 - DNA, 25 bp, Homo sapien
cgtccgcaaatacgcgaagcgcatc

SEQ ID NO: 140582 - DNA, 25 bp, Homo sapien
ggccagcgggtcctctacaagcaat

SEQ ID NO: 140583 - DNA, 25 bp, Homo sapien
gctcttcgtcttcagcgaggacaac

SEQ ID NO: 140584 - DNA, 25 bp, Homo sapien
tacaagcaatcgatcgcgcagcgcg

SEQ ID NO: 140585 - DNA, 25 bp, Homo sapien
cgcgcggaccatggcgctgtacaac

SEQ ID NO: 140586 - DNA, 25 bp, Homo sapien
catcccggtcaagcagaactgcttc

SEQ ID NO: 140587 - DNA, 25 bp, Homo sapien
aagcgcatcaccgagtggccatatc

SEQ ID NO: 140588 - DNA, 25 bp, Homo sapien
cttcgaggcagggatcaaaatcatc

SEQ ID NO: 140589 - DNA, 25 bp, Homo sapien
tctgggctttgtcttccacaagggc

SEQ ID NO: 140590 - DNA, 25 bp, Homo sapien
cacaagggctcttacctgcggaacg

SEQ ID NO: 140591 - DNA, 25 bp, Homo sapien
gaacggctggaacgtcatggacttc

SEQ ID NO: 140592 - DNA, 25 bp, Homo sapien
catggacttcgtggtcgtcctcaca

SEQ ID NO: 140593 - DNA, 25 bp, Homo sapien
ttcatcgggatcttttgcttcgagg

SEQ ID NO: 140594 - DNA, 25 bp, Homo sapien
ggacgacacggagccctatttcatc

SEQ ID NO: 140595 - DNA, 25 bp, Homo sapien
gttctgcgcttctcctaggacgaca

SEQ ID NO: 140596 - DNA, 25 bp, Homo sapien
taaatgcgtgaagtcggcgttttcc

SEQ ID NO: 140597 - DNA, 25 bp, Homo sapien
ctgcgtgaatgttcttcccggctct

SEQ ID NO: 140598 - DNA, 25 bp, Homo sapien
agccgcctgcgtgaatgttcttccc

SEQ ID NO: 140599 - DNA, 25 bp, Homo sapien
aatgcgtgaagtcggcgttttccct

SEQ ID NO: 140600 - DNA, 25 bp, Homo sapien
aggtaaatgcgtgaagtcggcgttt

SEQ ID NO: 140601 - DNA, 25 bp, Homo sapien
tgcgtgaatgttcttcccggctctg

SEQ ID NO: 140602 - DNA, 25 bp, Homo sapien
ggagccgcctgcgtgaatgttcttc

SEQ ID NO: 140603 - DNA, 25 bp, Homo sapien
gtaaatgcgtgaagtcggcgttttc

SEQ ID NO: 140604 - DNA, 25 bp, Homo sapien
cacattgcccgctttgttgccgaga

SEQ ID NO: 140605 - DNA, 25 bp, Homo sapien
cgcgggccgtgattaaacacattgc

SEQ ID NO: 140606 - DNA, 25 bp, Homo sapien
cgctttgttgccgagatggtgtttc

SEQ ID NO: 140607 - DNA, 25 bp, Homo sapien
ttcggaaggcgctgtgaatgcactt

SEQ ID NO: 140608 - DNA, 25 bp, Homo sapien
aatgcacttccctttgcggggctca

SEQ ID NO: 140609 - DNA, 25 bp, Homo sapien
tttgcggggctcacacagacaagat

SEQ ID NO: 140610 - DNA, 25 bp, Homo sapien
acagacaagatgtgtgttgcaagga

SEQ ID NO: 140611 - DNA, 25 bp, Homo sapien
tgttgcaaggatgaggcgcctgctc

SEQ ID NO: 140612 - DNA, 25 bp, Homo sapien
gcatgatctcctcgccggcagggac

SEQ ID NO: 140613 - DNA, 25 bp, Homo sapien
cagggaccgtctcgggttcctagcg

SEQ ID NO: 140614 - DNA, 25 bp, Homo sapien
cgacttggtccgcagaagccgcgcg

SEQ ID NO: 140615 - DNA, 25 bp, Homo sapien
caggcgaggcctctcagtacccgag

SEQ ID NO: 140616 - DNA, 25 bp, Homo sapien
gaggctcccttttctcgagcccgca

SEQ ID NO: 140617 - DNA, 25 bp, Homo sapien
gaaagcaaggaagaggccagatccc

SEQ ID NO: 140618 - DNA, 25 bp, Homo sapien
ggcccggatgcaggcaattccacca

SEQ ID NO: 140619 - DNA, 25 bp, Homo sapien
atgcaggcaattccaccagtcgcta

SEQ ID NO: 140620 - DNA, 25 bp, Homo sapien
gcgttcggagaacatgatcagcacc

SEQ ID NO: 140621 - DNA, 25 bp, Homo sapien
gcgttcggagaacatggtcagcacc

SEQ ID NO: 140622 - DNA, 25 bp, Homo sapien
atcctgggagcagagtaaagcgttc

SEQ ID NO: 140623 - DNA, 25 bp, Homo sapien
cgttcggagaacacgatcagcacca

SEQ ID NO: 140624 - DNA, 25 bp, Homo sapien
cgcacagcatcctgggagcagagta

SEQ ID NO: 140625 - DNA, 25 bp, Homo sapien
cgttcggagaacatggtcagcacca

SEQ ID NO: 140626 - DNA, 25 bp, Homo sapien
cgcacagcatcctgggagcagaata

SEQ ID NO: 140627 - DNA, 25 bp, Homo sapien
tcctgggagcagagtaaagcgttcg

SEQ ID NO: 140628 - DNA, 25 bp, Homo sapien
accggcaccaggatccgagcaagga

SEQ ID NO: 140629 - DNA, 25 bp, Homo sapien
attgctgtgtgtgcattgtggcctc

SEQ ID NO: 140630 - DNA, 25 bp, Homo sapien
cagcaggcagcagaactcggccaag

SEQ ID NO: 140631 - DNA, 25 bp, Homo sapien
gggccagccagctacggctgcagaa

SEQ ID NO: 140632 - DNA, 25 bp, Homo sapien
aggcgctgtacagcgagatggaccc

SEQ ID NO: 140633 - DNA, 25 bp, Homo sapien
ccgtgggaggcaaagcccgacctga

SEQ ID NO: 140634 - DNA, 25 bp, Homo sapien
accggcaccgcgacaaggacaagac

SEQ ID NO: 140635 - DNA, 25 bp, Homo sapien
tgcgccattactccattgctgtgtg

SEQ ID NO: 140636 - DNA, 25 bp, Homo sapien
gtgcgcacagactcgcccaggaaca

SEQ ID NO: 140637 - DNA, 25 bp, Homo sapien
ggctgctgaggacccagtgcgcaca

SEQ ID NO: 140638 - DNA, 25 bp, Homo sapien
tggtcatcgccttgagcagcatcgc

SEQ ID NO: 140639 - DNA, 25 bp, Homo sapien
ggccttgtggtgatccgtgccttcc

SEQ ID NO: 140640 - DNA, 25 bp, Homo sapien
aggtggtcattctcgtggtcatcgc

SEQ ID NO: 140641 - DNA, 25 bp, Homo sapien
accatgaggtacttcgaggtggtca

SEQ ID NO: 140642 - DNA, 25 bp, Homo sapien
cacagactcgcccaggaacaacgtg

SEQ ID NO: 140643 - DNA, 25 bp, Homo sapien
ggtgatccgtgccttccctcacagg

SEQ ID NO: 140644 - DNA, 25 bp, Homo sapien
gagtccttcggggagctatggcccg

SEQ ID NO: 140645 - DNA, 25 bp, Homo sapien
cccgtgggactcatctttgcagcac

SEQ ID NO: 140646 - DNA, 25 bp, Homo sapien
tgggactcatctttgcagcaccacc

SEQ ID NO: 140647 - DNA, 25 bp, Homo sapien
tagccaggcgtcgtcgcaccaccac

SEQ ID NO: 140648 - DNA, 25 bp, Homo sapien
gccaccgccgcagggacaggaagca

SEQ ID NO: 140649 - DNA, 25 bp, Homo sapien
ccgcagggacaggaagcagaggtcc

SEQ ID NO: 140650 - DNA, 25 bp, Homo sapien
cctgtctgccgatatggatggcggt

SEQ ID NO: 140651 - DNA, 25 bp, Homo sapien
gcccagcctgtctgccgatatggat

SEQ ID NO: 140652 - DNA, 25 bp, Homo sapien
ccagcacaggacaagatgccggtta

SEQ ID NO: 140653 - DNA, 25 bp, Homo sapien
cccagcacaggacaagatgccggtt

SEQ ID NO: 140654 - DNA, 25 bp, Homo sapien
gcgtttcccgtctggccatttgtac

SEQ ID NO: 140655 - DNA, 25 bp, Homo sapien
cgcgtttcccgtctggccatttgta

SEQ ID NO: 140656 - DNA, 25 bp, Homo sapien
ggcgcgtttcccgtctggccatttg

SEQ ID NO: 140657 - DNA, 25 bp, Homo sapien
acagggagacgctccgggacacctg

SEQ ID NO: 140658 - DNA, 25 bp, Homo sapien
gacagggagacgctccgggacacct

SEQ ID NO: 140659 - DNA, 25 bp, Homo sapien
cagcacaggacaagatgccggttac

SEQ ID NO: 140660 - DNA, 25 bp, Homo sapien
tttgtacctgggcttcactttgtgc

SEQ ID NO: 140661 - DNA, 25 bp, Homo sapien
ttgtacctgggcttcactttgtgca

SEQ ID NO: 140662 - DNA, 25 bp, Homo sapien
ctgggcttcactttgtgcaagcgtc

SEQ ID NO: 140663 - DNA, 25 bp, Homo sapien
tgtacctgggcttcactttgtgcaa

SEQ ID NO: 140664 - DNA, 25 bp, Homo sapien
tacctgggcttcactttgtgcaagc

SEQ ID NO: 140665 - DNA, 25 bp, Homo sapien
acctgggcttcactttgtgcaagcg

SEQ ID NO: 140666 - DNA, 25 bp, Homo sapien
cctgggcttcactttgtgcaagcgt

SEQ ID NO: 140667 - DNA, 25 bp, Homo sapien
gtacctgggcttcactttgtgcaag

SEQ ID NO: 140668 - DNA, 25 bp, Homo sapien
ctactgatgtccctgccgggagctg

SEQ ID NO: 140669 - DNA, 25 bp, Homo sapien
agctactgatgtccctgccgggagc

SEQ ID NO: 140670 - DNA, 25 bp, Homo sapien
gagctactgatgtccctgccgggag

SEQ ID NO: 140671 - DNA, 25 bp, Homo sapien
ggagctactgatgtccctgccggga

SEQ ID NO: 140672 - DNA, 25 bp, Homo sapien
aggagctactgatgtccctgccggg

SEQ ID NO: 140673 - DNA, 25 bp, Homo sapien
tttctatgtgcgatgacgttttctc

SEQ ID NO: 140674 - DNA, 25 bp, Homo sapien
taagacccgctctggaggagcgttg

SEQ ID NO: 140675 - DNA, 25 bp, Homo sapien
gcgatgacgttttctcacgaggcta

SEQ ID NO: 140676 - DNA, 25 bp, Homo sapien
gacgttttctcacgaggctagcgaa

SEQ ID NO: 140677 - DNA, 25 bp, Homo sapien
tctcacgaggctagcgaaatggggc

SEQ ID NO: 140678 - DNA, 25 bp, Homo sapien
gggcaacttgtcctgttcttttatc

SEQ ID NO: 140679 - DNA, 25 bp, Homo sapien
tcttttatcttaagacccgctctgg

SEQ ID NO: 140680 - DNA, 25 bp, Homo sapien
tttatcttaagacccgctctggagg

SEQ ID NO: 140681 - DNA, 25 bp, Homo sapien
gctggaggaaaccacgtcccacctg

SEQ ID NO: 140682 - DNA, 25 bp, Homo sapien
agaggatcggcaccgtcggccttta

SEQ ID NO: 140683 - DNA, 25 bp, Homo sapien
gcgcccagctcagcgagctgcgttt

SEQ ID NO: 140684 - DNA, 25 bp, Homo sapien
tcagcgagctgcgtttggatggtaa

SEQ ID NO: 140685 - DNA, 25 bp, Homo sapien
acgtcccacctgcagaggatcggca

SEQ ID NO: 140686 - DNA, 25 bp, Homo sapien
caccgtgcacccaggaaacgagcga

SEQ ID NO: 140687 - DNA, 25 bp, Homo sapien
gaagggcaacgccatccgtccagga

SEQ ID NO: 140688 - DNA, 25 bp, Homo sapien
tgacttcaggaagggcaacgccatc

SEQ ID NO: 140689 - DNA, 25 bp, Homo sapien
ggtgcccacagctctctatggcaat

SEQ ID NO: 140690 - DNA, 25 bp, Homo sapien
gcccaggttccgacgccggttgcag

SEQ ID NO: 140691 - DNA, 25 bp, Homo sapien
tgccaccgcgtcctagttgcgttca

SEQ ID NO: 140692 - DNA, 25 bp, Homo sapien
cgcgtcctagttgcgttcaccggtg

SEQ ID NO: 140693 - DNA, 25 bp, Homo sapien
tagttgcgttcaccggtgcccacag

SEQ ID NO: 140694 - DNA, 25 bp, Homo sapien
ggtctgcggtgctaataaaaattta

SEQ ID NO: 140695 - DNA, 25 bp, Homo sapien
ggtgggtctgcggtgctaataaaaa

SEQ ID NO: 140696 - DNA, 25 bp, Homo sapien
ccacagctctctatggcaattgggg

SEQ ID NO: 140697 - DNA, 25 bp, Homo sapien
ctccaaattggaaggcggttgactt

SEQ ID NO: 140698 - DNA, 25 bp, Homo sapien
tcttgactgtccctctccaaattgg

SEQ ID NO: 140699 - DNA, 25 bp, Homo sapien
tcgagaatctcctcaaaatcaaggg

SEQ ID NO: 140700 - DNA, 25 bp, Homo sapien
ttcctttgctctggcgctggatgct

SEQ ID NO: 140701 - DNA, 25 bp, Homo sapien
cagcttggagatggcaccaggttcc

SEQ ID NO: 140702 - DNA, 25 bp, Homo sapien
ttcggacctgctagcggaaaacgca

SEQ ID NO: 140703 - DNA, 25 bp, Homo sapien
gcgaatatctatggcttcggacctg

SEQ ID NO: 140704 - DNA, 25 bp, Homo sapien
aaccgagttcctgagcggcaaacgt

SEQ ID NO: 140705 - DNA, 25 bp, Homo sapien
cactctgaggtagaccggtgagagc

SEQ ID NO: 140706 - DNA, 25 bp, Homo sapien
ctcagactcgcactggcgcgggagg

SEQ ID NO: 140707 - DNA, 25 bp, Homo sapien
cacaacaggcggtgctgtgggcaaa

SEQ ID NO: 140708 - DNA, 25 bp, Homo sapien
cacactctgaggtagaccggtgaga

SEQ ID NO: 140709 - DNA, 25 bp, Homo sapien
cccacactctgaggtagaccggtga

SEQ ID NO: 140710 - DNA, 25 bp, Homo sapien
ggcaaagaggcagcgctttgccgcc

SEQ ID NO: 140711 - DNA, 25 bp, Homo sapien
tggagtccacgccaactcagactcg

SEQ ID NO: 140712 - DNA, 25 bp, Homo sapien
gatgctaagctctcgcgccgccggg

SEQ ID NO: 140713 - DNA, 25 bp, Homo sapien
tggtccaacgccctcaaaggcatgg

SEQ ID NO: 140714 - DNA, 25 bp, Homo sapien
caaggacttcctagctggaggcatc

SEQ ID NO: 140715 - DNA, 25 bp, Homo sapien
tggcatcgatcaagcgggtccagct

SEQ ID NO: 140716 - DNA, 25 bp, Homo sapien
ttttcaagggtgtgtggtccaacgc

SEQ ID NO: 140717 - DNA, 25 bp, Homo sapien
gcagcctacttcagggtgtacgata

SEQ ID NO: 140718 - DNA, 25 bp, Homo sapien
cgctatctccaagacagccgtggca

SEQ ID NO: 140719 - DNA, 25 bp, Homo sapien
tgcagatgcagcacgccagcatgcc

SEQ ID NO: 140720 - DNA, 25 bp, Homo sapien
tcccggcgcaaaggagctgacatca

SEQ ID NO: 140721 - DNA, 25 bp, Homo sapien
cccgctgcttgggtcaggttcgccg

SEQ ID NO: 140722 - DNA, 25 bp, Homo sapien
ctgtatccctcgagagtcggtgcgg

SEQ ID NO: 140723 - DNA, 25 bp, Homo sapien
gcacgggaacgcgtcccgctgcttg

SEQ ID NO: 140724 - DNA, 25 bp, Homo sapien
cttcttcggctagctgcccgtccgt

SEQ ID NO: 140725 - DNA, 25 bp, Homo sapien
aggagcccttcgcaaccctagcctc

SEQ ID NO: 140726 - DNA, 25 bp, Homo sapien
ctcccacttccagcggaggagccct

SEQ ID NO: 140727 - DNA, 25 bp, Homo sapien
tcgagagtcggtgcgggcctttacc

SEQ ID NO: 140728 - DNA, 25 bp, Homo sapien
ggcctttaccgaggtgcccgaggca

SEQ ID NO: 140729 - DNA, 25 bp, Homo sapien
gcctcactagctttaaagccgggta

SEQ ID NO: 140730 - DNA, 25 bp, Homo sapien
ggctgttttgcctcgggctagtttc

SEQ ID NO: 140731 - DNA, 25 bp, Homo sapien
atcgaaagtgcaactagcggcgggc

SEQ ID NO: 140732 - DNA, 25 bp, Homo sapien
tttccgaggaaatgaggccggacgc

SEQ ID NO: 140733 - DNA, 25 bp, Homo sapien
cgcaggctgtgcctcactagcttta

SEQ ID NO: 140734 - DNA, 25 bp, Homo sapien
cctctgcttgcagctagctacgttc

SEQ ID NO: 140735 - DNA, 25 bp, Homo sapien
gcggagctgcataggaactttaata

SEQ ID NO: 140736 - DNA, 25 bp, Homo sapien
gctcggtggtcatgccggcctctgc

SEQ ID NO: 140737 - DNA, 25 bp, Homo sapien
tactggtactcagccactggggaca

SEQ ID NO: 140738 - DNA, 25 bp, Homo sapien
ggctcgatttacaggggttcccaca

SEQ ID NO: 140739 - DNA, 25 bp, Homo sapien
tcacgcgcggcagttcaagaacatc

SEQ ID NO: 140740 - DNA, 25 bp, Homo sapien
accaaactgccgtgctcggggctta

SEQ ID NO: 140741 - DNA, 25 bp, Homo sapien
ctaagcggcccgttgccagattcta

SEQ ID NO: 140742 - DNA, 25 bp, Homo sapien
gaagtctctcacctcctgttgtacg

SEQ ID NO: 140743 - DNA, 25 bp, Homo sapien
ctctgcggaaacttaggaaattatc

SEQ ID NO: 140744 - DNA, 25 bp, Homo sapien
tcttccagctttagagccagacgta

SEQ ID NO: 140745 - DNA, 25 bp, Homo sapien
ggaagcacccgatgtcactcacata

SEQ ID NO: 140746 - DNA, 25 bp, Homo sapien
gacgcttcggtcagctccatgccat

SEQ ID NO: 140747 - DNA, 25 bp, Homo sapien
agctcggcatcgtcgaggacgcttc

SEQ ID NO: 140748 - DNA, 25 bp, Homo sapien
ctgcgacgttctggctgacgttgta

SEQ ID NO: 140749 - DNA, 25 bp, Homo sapien
ctgacgttgtacaggaggtcggcca

SEQ ID NO: 140750 - DNA, 25 bp, Homo sapien
aggtcggccagcagtctctgcctct

SEQ ID NO: 140751 - DNA, 25 bp, Homo sapien
gggcctgctcatcacacagtagctg

SEQ ID NO: 140752 - DNA, 25 bp, Homo sapien
tggcgaaaagcactgaggaagcacc

SEQ ID NO: 140753 - DNA, 25 bp, Homo sapien
ctggaaggagcagtgatagaaaccc

SEQ ID NO: 140754 - DNA, 25 bp, Homo sapien
gggcccttcgtcattcttcggagta

SEQ ID NO: 140755 - DNA, 25 bp, Homo sapien
acgcagagaccctccgaacttcgaa

SEQ ID NO: 140756 - DNA, 25 bp, Homo sapien
tcaaagcattcctatggggcccaaa

SEQ ID NO: 140757 - DNA, 25 bp, Homo sapien
ggcccaaagagcctgggattgcagt

SEQ ID NO: 140758 - DNA, 25 bp, Homo sapien
ggcctcgccgcgtcaataaattttc

SEQ ID NO: 140759 - DNA, 25 bp, Homo sapien
ttgcagtgttgttagcctggcctcg

SEQ ID NO: 140760 - DNA, 25 bp, Homo sapien
cgaatctacgcaagtagggcccttc

SEQ ID NO: 140761 - DNA, 25 bp, Homo sapien
tattacgtcacatcctggttccgcc

SEQ ID NO: 140762 - DNA, 25 bp, Homo sapien
gccgcagtttctcatccggagtgta

SEQ ID NO: 140763 - DNA, 25 bp, Homo sapien
tcatgtcgccgctggtaccaacgca

SEQ ID NO: 140764 - DNA, 25 bp, Homo sapien
tggtaccaacgcaaaaggacacggc

SEQ ID NO: 140765 - DNA, 25 bp, Homo sapien
ggcgcaccctcgaactacggactag

SEQ ID NO: 140766 - DNA, 25 bp, Homo sapien
gactagttacttaagcgcgctcccg

SEQ ID NO: 140767 - DNA, 25 bp, Homo sapien
gccgcgcgcggttattacgtcacat

SEQ ID NO: 140768 - DNA, 25 bp, Homo sapien
tgcaaagcgaccttgcgggaacgcc

SEQ ID NO: 140769 - DNA, 25 bp, Homo sapien
cgggactcagagtttcgtcagattg

SEQ ID NO: 140770 - DNA, 25 bp, Homo sapien
gagaacaaagcggtggccctctctc

SEQ ID NO: 140771 - DNA, 25 bp, Homo sapien
cccgacgcacggcaagcatttaatc

SEQ ID NO: 140772 - DNA, 25 bp, Homo sapien
ggcaagcatttaatctacaagcagg

SEQ ID NO: 140773 - DNA, 25 bp, Homo sapien
ttaatctacaagcagggtgccaggg

SEQ ID NO: 140774 - DNA, 25 bp, Homo sapien
cggggagcagctgccaagccgctac

SEQ ID NO: 140775 - DNA, 25 bp, Homo sapien
taccacgacgcctcgcccgtagtct

SEQ ID NO: 140776 - DNA, 25 bp, Homo sapien
atagggagtttgcatttaccacgac

SEQ ID NO: 140777 - DNA, 25 bp, Homo sapien
tctaaacgcaagagcatcctggctg

SEQ ID NO: 140778 - DNA, 25 bp, Homo sapien
gcaacgtcagggtcaagttcggaca

SEQ ID NO: 140779 - DNA, 25 bp, Homo sapien
tccgagtggacatgacgatcgccga

SEQ ID NO: 140780 - DNA, 25 bp, Homo sapien
gccagggcccactgatccgagtgga

SEQ ID NO: 140781 - DNA, 25 bp, Homo sapien
gctctcccaggtggcccgttgtggt

SEQ ID NO: 140782 - DNA, 25 bp, Homo sapien
atgagatcaagaaccacgccagcga

SEQ ID NO: 140783 - DNA, 25 bp, Homo sapien
gttcggacagaacgatgctgactcc

SEQ ID NO: 140784 - DNA, 25 bp, Homo sapien
aggcctgccagaaatctaaacgcaa

SEQ ID NO: 140785 - DNA, 25 bp, Homo sapien
ctaactcctcggatcccggactggg

SEQ ID NO: 140786 - DNA, 25 bp, Homo sapien
agctcggatattgcaacggctgccc

SEQ ID NO: 140787 - DNA, 25 bp, Homo sapien
ctgagcctgctctgacagtgatgta

SEQ ID NO: 140788 - DNA, 25 bp, Homo sapien
agtgatgtaacaaggccaggctcgc

SEQ ID NO: 140789 - DNA, 25 bp, Homo sapien
cccggagggacatctccagctggca

SEQ ID NO: 140790 - DNA, 25 bp, Homo sapien
ctgccgtcagtcacccggatttgta

SEQ ID NO: 140791 - DNA, 25 bp, Homo sapien
ccgggaccaaagcagtcctcgggca

SEQ ID NO: 140792 - DNA, 25 bp, Homo sapien
tcgctccgctgcaagagcgctttcg

SEQ ID NO: 140793 - DNA, 25 bp, Homo sapien
cgcctaccaaggagccagggagaca

SEQ ID NO: 140794 - DNA, 25 bp, Homo sapien
ttgcccagatcgaaccaagcccggt

SEQ ID NO: 140795 - DNA, 25 bp, Homo sapien
tccagctgaggattccgccgcggct

SEQ ID NO: 140796 - DNA, 25 bp, Homo sapien
gggcgccctccagctgaggattccg

SEQ ID NO: 140797 - DNA, 25 bp, Homo sapien
cagggagacaaggatcccggagacc

SEQ ID NO: 140798 - DNA, 25 bp, Homo sapien
cagtgtaactgctgttgcccagatc

SEQ ID NO: 140799 - DNA, 25 bp, Homo sapien
caagcccggtcccagtgacgagcag

SEQ ID NO: 140800 - DNA, 25 bp, Homo sapien
caaggatcccggagacctctggggc

SEQ ID NO: 140801 - DNA, 25 bp, Homo sapien
ttgagcccagccagcagaagagata

SEQ ID NO: 140802 - DNA, 25 bp, Homo sapien
atcactcaagggtaggagcagcctc

SEQ ID NO: 140803 - DNA, 25 bp, Homo sapien
gcagcgtcattcaaggcacatcact

SEQ ID NO: 140804 - DNA, 25 bp, Homo sapien
gcgcccgctgaaacagcccaaggta

SEQ ID NO: 140805 - DNA, 25 bp, Homo sapien
tgtcgggagcacacgtgaacaaacg

SEQ ID NO: 140806 - DNA, 25 bp, Homo sapien
tgcgaccaaggtacatacaggtgtc

SEQ ID NO: 140807 - DNA, 25 bp, Homo sapien
ggacagggcccattctctaatattt

SEQ ID NO: 140808 - DNA, 25 bp, Homo sapien
tgacgaccgccttacctccagaagt

SEQ ID NO: 140809 - DNA, 25 bp, Homo sapien
tgcgtctgcatccacgtcccacata

SEQ ID NO: 140810 - DNA, 25 bp, Homo sapien
ggcagctgtgatcaccctagccatc

SEQ ID NO: 140811 - DNA, 25 bp, Homo sapien
cccggggcagctgtgatcaccctag

SEQ ID NO: 140812 - DNA, 25 bp, Homo sapien
tctgctaggacctgacacgtgcggt

SEQ ID NO: 140813 - DNA, 25 bp, Homo sapien
ctgcgtttctgctaggacctgacac

SEQ ID NO: 140814 - DNA, 25 bp, Homo sapien
ccttggccacagacgctgcgtttct

SEQ ID NO: 140815 - DNA, 25 bp, Homo sapien
cggccgcattcctggcccttggcca

SEQ ID NO: 140816 - DNA, 25 bp, Homo sapien
acgctgagggtgaatatgtgcggcc

SEQ ID NO: 140817 - DNA, 25 bp, Homo sapien
ttcggctacaaaagaggacggctgc

SEQ ID NO: 140818 - DNA, 25 bp, Homo sapien
cggaactttccagaacgctcggtga

SEQ ID NO: 140819 - DNA, 25 bp, Homo sapien
cctcagcccgcaccggtgagtttga

SEQ ID NO: 140820 - DNA, 25 bp, Homo sapien
taggaccgctgtcagttcctgggcc

SEQ ID NO: 140821 - DNA, 25 bp, Homo sapien
ccacgatttcccttttggagggctg

SEQ ID NO: 140822 - DNA, 25 bp, Homo sapien
cggcacgcacagtgaatgggcccga

SEQ ID NO: 140823 - DNA, 25 bp, Homo sapien
gaatgggcccgagacctttcctaga

SEQ ID NO: 140824 - DNA, 25 bp, Homo sapien
aaggagctactgtcttcggctgccc

SEQ ID NO: 140825 - DNA, 25 bp, Homo sapien
acagtgacgtcacccgacgtctgca

SEQ ID NO: 140826 - DNA, 25 bp, Homo sapien
taagacgatgtgaccgccaattttg

SEQ ID NO: 140827 - DNA, 25 bp, Homo sapien
aagatgggactcctacctccgacca

SEQ ID NO: 140828 - DNA, 25 bp, Homo sapien
ctgcaggccctgacagttggctcta

SEQ ID NO: 140829 - DNA, 25 bp, Homo sapien
agccttcaatgctggagggacggcc

SEQ ID NO: 140830 - DNA, 25 bp, Homo sapien
ccgccaattttgtaacagtgacgtc

SEQ ID NO: 140831 - DNA, 25 bp, Homo sapien
tgccaccggcccttaagacgatgtg

SEQ ID NO: 140832 - DNA, 25 bp, Homo sapien
gctctagcgggtgcgcagtctccct

SEQ ID NO: 140833 - DNA, 25 bp, Homo sapien
ccgcaggactcactccgaagattcg

SEQ ID NO: 140834 - DNA, 25 bp, Homo sapien
cgatttcgatcgacatagccgtatc

SEQ ID NO: 140835 - DNA, 25 bp, Homo sapien
tccggcggacacctaacgtcacttc

SEQ ID NO: 140836 - DNA, 25 bp, Homo sapien
acgtcacttccgcttgggtcggcgt

SEQ ID NO: 140837 - DNA, 25 bp, Homo sapien
ctggagatagagtgaacgaagagta

SEQ ID NO: 140838 - DNA, 25 bp, Homo sapien
tcactccgaagattcgatttcgatc

SEQ ID NO: 140839 - DNA, 25 bp, Homo sapien
tggctcccgctctggagatagagtg

SEQ ID NO: 140840 - DNA, 25 bp, Homo sapien
atagccgtatctctccgggagcagg

SEQ ID NO: 140841 - DNA, 25 bp, Homo sapien
agcggtgtggagactccgaccagtt

SEQ ID NO: 140842 - DNA, 25 bp, Homo sapien
agtatgactgcagctccgacgcttg

SEQ ID NO: 140843 - DNA, 25 bp, Homo sapien
ggccagaatccacgactgggctgga

SEQ ID NO: 140844 - DNA, 25 bp, Homo sapien
ctcccgagcctttgcggcggagctt

SEQ ID NO: 140845 - DNA, 25 bp, Homo sapien
ccgccgccgctttaagaagggtgtg

SEQ ID NO: 140846 - DNA, 25 bp, Homo sapien
taaacgagggtgacgccaaggtgca

SEQ ID NO: 140847 - DNA, 25 bp, Homo sapien
ggagcggctcccgaagcctcatctt

SEQ ID NO: 140848 - DNA, 25 bp, Homo sapien
tcgcggccagccaggtagtaaacga

SEQ ID NO: 140849 - DNA, 25 bp, Homo sapien
tccaggtcgcttcctcactcagggt

SEQ ID NO: 140850 - DNA, 25 bp, Homo sapien
cgcttctggaggacacgtgactaaa

SEQ ID NO: 140851 - DNA, 25 bp, Homo sapien
cggagaagctcaaacacccaggatc

SEQ ID NO: 140852 - DNA, 25 bp, Homo sapien
ccggccacatggaaaagtgtacaga

SEQ ID NO: 140853 - DNA, 25 bp, Homo sapien
ggttttcttcttcatccgcggcctg

SEQ ID NO: 140854 - DNA, 25 bp, Homo sapien
tatgccgcgttagttgcctccaggc

SEQ ID NO: 140855 - DNA, 25 bp, Homo sapien
tctccgagagcaccaagtccttttg

SEQ ID NO: 140856 - DNA, 25 bp, Homo sapien
cgcacttgttgaccgcccagcgatg

SEQ ID NO: 140857 - DNA, 25 bp, Homo sapien
tcctatgtccgcaatcccatctggg

SEQ ID NO: 140858 - DNA, 25 bp, Homo sapien
tctgcaggctagctcacggagttga

SEQ ID NO: 140859 - DNA, 25 bp, Homo sapien
tccgctcccgcgattagctctggga

SEQ ID NO: 140860 - DNA, 25 bp, Homo sapien
ggttgacttagccacaggcgactta

SEQ ID NO: 140861 - DNA, 25 bp, Homo sapien
cctccattctgcagttggggaaagc

SEQ ID NO: 140862 - DNA, 25 bp, Homo sapien
tttcaaatgccggtcgccaccctgg

SEQ ID NO: 140863 - DNA, 25 bp, Homo sapien
ctcgggatgctcagacgttttcaaa

SEQ ID NO: 140864 - DNA, 25 bp, Homo sapien
gctttccgcagaaggaggtgccttc

SEQ ID NO: 140865 - DNA, 25 bp, Homo sapien
tttctgcacgaggtcgcaggtgcgt

SEQ ID NO: 140866 - DNA, 25 bp, Homo sapien
tgggaacgacgtgtgagcagaaaac

SEQ ID NO: 140867 - DNA, 25 bp, Homo sapien
ctgcacgtttctgcacgaggtcgca

SEQ ID NO: 140868 - DNA, 25 bp, Homo sapien
tggaaagcactgctgcacgtttctg

SEQ ID NO: 140869 - DNA, 25 bp, Homo sapien
tgtacatcacctgccaccagctgga

SEQ ID NO: 140870 - DNA, 25 bp, Homo sapien
ctctgtctccgtaccatgtacatca

SEQ ID NO: 140871 - DNA, 25 bp, Homo sapien
agctcgtcatgactggtcatccagg

SEQ ID NO: 140872 - DNA, 25 bp, Homo sapien
acggcaggacttttagctcgtcatg

SEQ ID NO: 140873 - DNA, 25 bp, Homo sapien
acacctggcgcgtctatctgacgtc

SEQ ID NO: 140874 - DNA, 25 bp, Homo sapien
tcagtgacgaagttctagggcctca

SEQ ID NO: 140875 - DNA, 25 bp, Homo sapien
gaggcgcctcctgtctcaggtattg

SEQ ID NO: 140876 - DNA, 25 bp, Homo sapien
tggctgtacagctcgatctaggttc

SEQ ID NO: 140877 - DNA, 25 bp, Homo sapien
agggcctcagccactcatatcgcga

SEQ ID NO: 140878 - DNA, 25 bp, Homo sapien
tgcgaatattctcgcggcgccggaa

SEQ ID NO: 140879 - DNA, 25 bp, Homo sapien
catatcgcgagagtagcacatgcta

SEQ ID NO: 140880 - DNA, 25 bp, Homo sapien
cccgcgcatcgtgcgtacgaagatc

SEQ ID NO: 140881 - DNA, 25 bp, Homo sapien
cggtagcggatgtggagcatctccc

SEQ ID NO: 140882 - DNA, 25 bp, Homo sapien
gcagcgggacaccagctccttctgt

SEQ ID NO: 140883 - DNA, 25 bp, Homo sapien
gcgggacaccagctccttctgtcga

SEQ ID NO: 140884 - DNA, 25 bp, Homo sapien
agctccttctgtcgacccatggcgg

SEQ ID NO: 140885 - DNA, 25 bp, Homo sapien
tccttctgtcgacccatggcggggc

SEQ ID NO: 140886 - DNA, 25 bp, Homo sapien
ctggtggctccctttataggagcgc

SEQ ID NO: 140887 - DNA, 25 bp, Homo sapien
ttataggagcgctggagacacgggc

SEQ ID NO: 140888 - DNA, 25 bp, Homo sapien
ccagcgcctgtcggagcagccggta

SEQ ID NO: 140889 - DNA, 25 bp, Homo sapien
agaggatctccccggtttctcgcgg

SEQ ID NO: 140890 - DNA, 25 bp, Homo sapien
caacctaacgctccaccagagaggc

SEQ ID NO: 140891 - DNA, 25 bp, Homo sapien
aacctaacgctccaccagagaggcc

SEQ ID NO: 140892 - DNA, 25 bp, Homo sapien
ggggagagggcagaacgcggcgaat

SEQ ID NO: 140893 - DNA, 25 bp, Homo sapien
aagaggatctccccggtttctcgcg

SEQ ID NO: 140894 - DNA, 25 bp, Homo sapien
gagagggcagaacgcggcgaatggc

SEQ ID NO: 140895 - DNA, 25 bp, Homo sapien
taagaggatctccccggtttctcgc

SEQ ID NO: 140896 - DNA, 25 bp, Homo sapien
tcaacctaacgctccaccagagagg

SEQ ID NO: 140897 - DNA, 25 bp, Homo sapien
ctgggaaacaatggcgcgagcgtga

SEQ ID NO: 140898 - DNA, 25 bp, Homo sapien
gcggctgggaaacaatggcgcgagc

SEQ ID NO: 140899 - DNA, 25 bp, Homo sapien
ggccgggaacagcctggaatcagct

SEQ ID NO: 140900 - DNA, 25 bp, Homo sapien
tggccgggaacagcctggaatcagc

SEQ ID NO: 140901 - DNA, 25 bp, Homo sapien
gcggggaggcttttacaagaagcga

SEQ ID NO: 140902 - DNA, 25 bp, Homo sapien
ggtcctgctaaaacgctgtcaacct

SEQ ID NO: 140903 - DNA, 25 bp, Homo sapien
gcggtcctgctaaaacgctgtcaac

SEQ ID NO: 140904 - DNA, 25 bp, Homo sapien
cggtcctgctaaaacgctgtcaacc

SEQ ID NO: 140905 - DNA, 25 bp, Homo sapien
atgaggaagctcctcagttttggga

SEQ ID NO: 140906 - DNA, 25 bp, Homo sapien
accatgaggaagctcctcagttttg

SEQ ID NO: 140907 - DNA, 25 bp, Homo sapien
gggatctcgaatttggagctgggtg

SEQ ID NO: 140908 - DNA, 25 bp, Homo sapien
tcactctatcgagaggtcggaggct

SEQ ID NO: 140909 - DNA, 25 bp, Homo sapien
ttactgggctcactctatcgagagg

SEQ ID NO: 140910 - DNA, 25 bp, Homo sapien
taaccgctttactgggctcactcta

SEQ ID NO: 140911 - DNA, 25 bp, Homo sapien
tgcagtcaccctctgcgggccacgc

SEQ ID NO: 140912 - DNA, 25 bp, Homo sapien
cgctttactgggctcactctatcga

SEQ ID NO: 140913 - DNA, 25 bp, Homo sapien
catctccaagggaaggtcaagggcc

SEQ ID NO: 140914 - DNA, 25 bp, Homo sapien
gagacatctccaagggaaggtcaag

SEQ ID NO: 140915 - DNA, 25 bp, Homo sapien
acatctccaagggaaggtcaagggc

SEQ ID NO: 140916 - DNA, 25 bp, Homo sapien
tctccaagggaaggtcaagggcctg

SEQ ID NO: 140917 - DNA, 25 bp, Homo sapien
gacagggaggggataccgactggga

SEQ ID NO: 140918 - DNA, 25 bp, Homo sapien
gggataccgactgggaggggctcag

SEQ ID NO: 140919 - DNA, 25 bp, Homo sapien
atggaggctcctctaggggaggacg

SEQ ID NO: 140920 - DNA, 25 bp, Homo sapien
ccaagggaaggtcaagggcctggag

SEQ ID NO: 140921 - DNA, 25 bp, Homo sapien
tgggtgactcaggaaccagcctctc

SEQ ID NO: 140922 - DNA, 25 bp, Homo sapien
ccaggaagcctggaatctaataaca

SEQ ID NO: 140923 - DNA, 25 bp, Homo sapien
cctgaggccaggaagcctggaatct

SEQ ID NO: 140924 - DNA, 25 bp, Homo sapien
ttgttagctgcgatacacaaataca

SEQ ID NO: 140925 - DNA, 25 bp, Homo sapien
gactgcctttccttgttagctgcga

SEQ ID NO: 140926 - DNA, 25 bp, Homo sapien
cagctcacatagctctgggcactgg

SEQ ID NO: 140927 - DNA, 25 bp, Homo sapien
ccgcgagtcaggtctgccgcgttgc

SEQ ID NO: 140928 - DNA, 25 bp, Homo sapien
aggaaccagcctctcctgaagcaca

SEQ ID NO: 140929 - DNA, 25 bp, Homo sapien
tcgagctgaaatccctgcaggagga

SEQ ID NO: 140930 - DNA, 25 bp, Homo sapien
ccgccgctttctgcagttcctggga

SEQ ID NO: 140931 - DNA, 25 bp, Homo sapien
acaccctctacgaaggcggctactt

SEQ ID NO: 140932 - DNA, 25 bp, Homo sapien
tccggatcaccctggtggacgagtc

SEQ ID NO: 140933 - DNA, 25 bp, Homo sapien
tcctgggaccaggagtatgagcacg

SEQ ID NO: 140934 - DNA, 25 bp, Homo sapien
aggccctgatgctcgagctgaaatc

SEQ ID NO: 140935 - DNA, 25 bp, Homo sapien
gtagcgaattctcctaactccctcg

SEQ ID NO: 140936 - DNA, 25 bp, Homo sapien
gacgagtccgacctctacaactggg

SEQ ID NO: 140937 - DNA, 25 bp, Homo sapien
cgccctgtgctcatcacgtgatgtg

SEQ ID NO: 140938 - DNA, 25 bp, Homo sapien
ccaaatgttgcacgaggggaccacg

SEQ ID NO: 140939 - DNA, 25 bp, Homo sapien
taataccattggatgccgcccgcca

SEQ ID NO: 140940 - DNA, 25 bp, Homo sapien
tcggagtcatcaggagagtattacc

SEQ ID NO: 140941 - DNA, 25 bp, Homo sapien
agcctttctccagcgggcttctaga

SEQ ID NO: 140942 - DNA, 25 bp, Homo sapien
cgtcgcgccgtgatgacctcacaaa

SEQ ID NO: 140943 - DNA, 25 bp, Homo sapien
aggatggcaattaccgctgctgctc

SEQ ID NO: 140944 - DNA, 25 bp, Homo sapien
tgccaatgtgcctcttacaaagcgg

SEQ ID NO: 140945 - DNA, 25 bp, Homo sapien
ggcgctttccgcttcctgctaacta

SEQ ID NO: 140946 - DNA, 25 bp, Homo sapien
tgcggaccctaagcccatcttggtt

SEQ ID NO: 140947 - DNA, 25 bp, Homo sapien
cctgctaactactttccgggccata

SEQ ID NO: 140948 - DNA, 25 bp, Homo sapien
ggcgagcggctagaaccaaaacacc

SEQ ID NO: 140949 - DNA, 25 bp, Homo sapien
gcacttcggatagcgtcgccacgga

SEQ ID NO: 140950 - DNA, 25 bp, Homo sapien
aagatagttctctggtgtttcccgg

SEQ ID NO: 140951 - DNA, 25 bp, Homo sapien
cgccaggccattttcaacggttgtt

SEQ ID NO: 140952 - DNA, 25 bp, Homo sapien
acggttgtttggctactgctggatg

SEQ ID NO: 140953 - DNA, 25 bp, Homo sapien
gctgccacgctgctagcgcgggtcc

SEQ ID NO: 140954 - DNA, 25 bp, Homo sapien
tgtagccggtaccaccgctgatcag

SEQ ID NO: 140955 - DNA, 25 bp, Homo sapien
gagaaacacccgctggaccgcccgc

SEQ ID NO: 140956 - DNA, 25 bp, Homo sapien
atcaggtagtccaccacgctgctgg

SEQ ID NO: 140957 - DNA, 25 bp, Homo sapien
ggcatgtagccggtaccaccgctga

SEQ ID NO: 140958 - DNA, 25 bp, Homo sapien
tcctcgggcatgtagccggtaccac

SEQ ID NO: 140959 - DNA, 25 bp, Homo sapien
cccgtcctcgggcatgtagccggta

SEQ ID NO: 140960 - DNA, 25 bp, Homo sapien
agaccctgcgacccgagagaaacac

SEQ ID NO: 140961 - DNA, 25 bp, Homo sapien
gctcctcccattggtccgggcgtgt

SEQ ID NO: 140962 - DNA, 25 bp, Homo sapien
aggtggtggcgttcgctctccctag

SEQ ID NO: 140963 - DNA, 25 bp, Homo sapien
aagtgggatgcggaaaaatgagttc

SEQ ID NO: 140964 - DNA, 25 bp, Homo sapien
aaaagtggccggagatccgcgattc

SEQ ID NO: 140965 - DNA, 25 bp, Homo sapien
tgccagcacctttcggcttctgaga

SEQ ID NO: 140966 - DNA, 25 bp, Homo sapien
ctccctaggggctgtcgggagctca

SEQ ID NO: 140967 - DNA, 25 bp, Homo sapien
agtaggacttcaacatggcggctgc

SEQ ID NO: 140968 - DNA, 25 bp, Homo sapien
cgccatgacgtcagacgcccaaatg

SEQ ID NO: 140969 - DNA, 25 bp, Homo sapien
tggccggtattctggatcactgcgt

SEQ ID NO: 140970 - DNA, 25 bp, Homo sapien
cagcagcgggaaggccagcatgccc

SEQ ID NO: 140971 - DNA, 25 bp, Homo sapien
cccgttcaggaatagcaccaggttg

SEQ ID NO: 140972 - DNA, 25 bp, Homo sapien
ccaggttggacgtgatgccgtagaa

SEQ ID NO: 140973 - DNA, 25 bp, Homo sapien
cgggcctgagatgtccctattgggc

SEQ ID NO: 140974 - DNA, 25 bp, Homo sapien
ttggccttgacggtggccacgccca

SEQ ID NO: 140975 - DNA, 25 bp, Homo sapien
gatcactgcgtgtcttggggagctt

SEQ ID NO: 140976 - DNA, 25 bp, Homo sapien
atgccgtagaaagcggcgcgctcca

SEQ ID NO: 140977 - DNA, 25 bp, Homo sapien
cttcagagagaagagtgtagaccgc

SEQ ID NO: 140978 - DNA, 25 bp, Homo sapien
gcgtgcctcggccaatcagtattca

SEQ ID NO: 140979 - DNA, 25 bp, Homo sapien
aatggtgacttctctcttgcaggca

SEQ ID NO: 140980 - DNA, 25 bp, Homo sapien
atcagaggacgtaaagctccggggc

SEQ ID NO: 140981 - DNA, 25 bp, Homo sapien
gccagtggcgctgcgctgaatgcaa

SEQ ID NO: 140982 - DNA, 25 bp, Homo sapien
tgcaggcaccgtcatacctcgggtt

SEQ ID NO: 140983 - DNA, 25 bp, Homo sapien
atacctcgggtttagattctggaca

SEQ ID NO: 140984 - DNA, 25 bp, Homo sapien
cagtctgcagactgaagccagtggc

SEQ ID NO: 140985 - DNA, 25 bp, Homo sapien
ccagcttgacctagccctgacaggt

SEQ ID NO: 140986 - DNA, 25 bp, Homo sapien
aatttccatgacaagcgcagtgcgc

SEQ ID NO: 140987 - DNA, 25 bp, Homo sapien
ggctcgagagcgagactcccgtctt

SEQ ID NO: 140988 - DNA, 25 bp, Homo sapien
aagctgtgcagtcgcctgtagggac

SEQ ID NO: 140989 - DNA, 25 bp, Homo sapien
aaggcagccacgctggccgaacaca

SEQ ID NO: 140990 - DNA, 25 bp, Homo sapien
tcctggcaccgcagagaagctgagc

SEQ ID NO: 140991 - DNA, 25 bp, Homo sapien
gccttggcgaccgaggtgaagaaac

SEQ ID NO: 140992 - DNA, 25 bp, Homo sapien
tgacaggtccatcgtggtgcacgca

SEQ ID NO: 140993 - DNA, 25 bp, Homo sapien
gaccttcagccaatcgttccgcttg

SEQ ID NO: 140994 - DNA, 25 bp, Homo sapien
ttgagggaagatctcgcgacgtttc

SEQ ID NO: 140995 - DNA, 25 bp, Homo sapien
tgggcgtaactctcaatttccgacc

SEQ ID NO: 140996 - DNA, 25 bp, Homo sapien
tctgaagaaaccgtgggcgtaactc

SEQ ID NO: 140997 - DNA, 25 bp, Homo sapien
gacgttcgttgacttctcctctgga

SEQ ID NO: 140998 - DNA, 25 bp, Homo sapien
gcatccaaggaatcggttgacgttc

SEQ ID NO: 140999 - DNA, 25 bp, Homo sapien
ctcggtctgccctgtctgagaagag

SEQ ID NO: 141000 - DNA, 25 bp, Homo sapien
cgtttcagtgtgagacgcgcacctt

SEQ ID NO: 141001 - DNA, 25 bp, Homo sapien
agtcattgactttgatggcggccgc

SEQ ID NO: 141002 - DNA, 25 bp, Homo sapien
acgcacactcggtagctcagctctg

SEQ ID NO: 141003 - DNA, 25 bp, Homo sapien
ctggcacccttgacggcttgttgaa

SEQ ID NO: 141004 - DNA, 25 bp, Homo sapien
tggcgttggggaatttgacctcatc

SEQ ID NO: 141005 - DNA, 25 bp, Homo sapien
gtacagcgcccatgtggaccaaatg

SEQ ID NO: 141006 - DNA, 25 bp, Homo sapien
ctgttgggcaaaacgcagcaccttg

SEQ ID NO: 141007 - DNA, 25 bp, Homo sapien
caggtgtgtacatgtcgtcgatttc

SEQ ID NO: 141008 - DNA, 25 bp, Homo sapien
ctcgcccgcgtcgaacttgaaggaa

SEQ ID NO: 141009 - DNA, 25 bp, Homo sapien
atagcctggaatactccacagccgc

SEQ ID NO: 141010 - DNA, 25 bp, Homo sapien
cgccctgaaggctatactgtccgaa

SEQ ID NO: 141011 - DNA, 25 bp, Homo sapien
cccattcatcggtgggagcgaaagt

SEQ ID NO: 141012 - DNA, 25 bp, Homo sapien
cgagtgactgcctacatagcctgga

SEQ ID NO: 141013 - DNA, 25 bp, Homo sapien
cttgaaccagagtgaagctgccgcc

SEQ ID NO: 141014 - DNA, 25 bp, Homo sapien
gggtgaaagagcttcccgccgatcc

SEQ ID NO: 141015 - DNA, 25 bp, Homo sapien
cccattgcagttacagcccggcaga

SEQ ID NO: 141016 - DNA, 25 bp, Homo sapien
tcaggaatcgtgctccttcagcagc

SEQ ID NO: 141017 - DNA, 25 bp, Homo sapien
accaaaccagcggtgtccgaggtca

SEQ ID NO: 141018 - DNA, 25 bp, Homo sapien
agtatctcagctcccaatgcaggtg

SEQ ID NO: 141019 - DNA, 25 bp, Homo sapien
atgcaggtgcttccaatcgagggcc

SEQ ID NO: 141020 - DNA, 25 bp, Homo sapien
gagtccaagctgtcggttcccaccg

SEQ ID NO: 141021 - DNA, 25 bp, Homo sapien
tcagggactgagaagaccggtttct

SEQ ID NO: 141022 - DNA, 25 bp, Homo sapien
ttctgctcggtgttttgcaacgtca

SEQ ID NO: 141023 - DNA, 25 bp, Homo sapien
gctgtagttccaacccgccgcgagt

SEQ ID NO: 141024 - DNA, 25 bp, Homo sapien
cggaattccgcgagtatctcagctc

SEQ ID NO: 141025 - DNA, 25 bp, Homo sapien
agtgtgtgcgcgttagacttaccta

SEQ ID NO: 141026 - DNA, 25 bp, Homo sapien
gcacactgcattccgggccggtgct

SEQ ID NO: 141027 - DNA, 25 bp, Homo sapien
tgtaacagcacactgcattccgggc

SEQ ID NO: 141028 - DNA, 25 bp, Homo sapien
gggagttgtaacagcacactgcatt

SEQ ID NO: 141029 - DNA, 25 bp, Homo sapien
tgcgcgttagacttacctaaggttc

SEQ ID NO: 141030 - DNA, 25 bp, Homo sapien
accaagccttcagggtgcgtgtgca

SEQ ID NO: 141031 - DNA, 25 bp, Homo sapien
gagcgttctcatcccgtctaccaga

SEQ ID NO: 141032 - DNA, 25 bp, Homo sapien
cctaaggttcggatatgggtagtat

SEQ ID NO: 141033 - DNA, 25 bp, Homo sapien
tgccgccgcgtgcaggacgaatgcc

SEQ ID NO: 141034 - DNA, 25 bp, Homo sapien
tgcaggacgaatgccgagctgcagt

SEQ ID NO: 141035 - DNA, 25 bp, Homo sapien
ctcagttttcttagcagtaacacgc

SEQ ID NO: 141036 - DNA, 25 bp, Homo sapien
ttcttagcagtaacacgcgagggtg

SEQ ID NO: 141037 - DNA, 25 bp, Homo sapien
taacacgcgagggtgcctacctccg

SEQ ID NO: 141038 - DNA, 25 bp, Homo sapien
cagagccattctggtaaagtggtca

SEQ ID NO: 141039 - DNA, 25 bp, Homo sapien
taaagtggtcaccatttcccggctc

SEQ ID NO: 141040 - DNA, 25 bp, Homo sapien
ctacctccgcaggtggtgcgggatc

SEQ ID NO: 141041 - DNA, 25 bp, Homo sapien
gtccatcccgcgcagacagtagtgg

SEQ ID NO: 141042 - DNA, 25 bp, Homo sapien
atgttcaccatcacttcgcgctctg

SEQ ID NO: 141043 - DNA, 25 bp, Homo sapien
gcggcccgagcaagcactttcgtaa

SEQ ID NO: 141044 - DNA, 25 bp, Homo sapien
cagtgagttcagcatgttcaccatc

SEQ ID NO: 141045 - DNA, 25 bp, Homo sapien
cgcggcagctgctggttccgcgaca

SEQ ID NO: 141046 - DNA, 25 bp, Homo sapien
ctttcgtaaccatggaagggcaggc

SEQ ID NO: 141047 - DNA, 25 bp, Homo sapien
ctggcgtagtagtccatcccgcgca

SEQ ID NO: 141048 - DNA, 25 bp, Homo sapien
tggttccgcgacagtgagttcagca

SEQ ID NO: 141049 - DNA, 25 bp, Homo sapien
cgtggcctggcagcacatgcacgtg

SEQ ID NO: 141050 - DNA, 25 bp, Homo sapien
ggggatctcatctaaccggtagccg

SEQ ID NO: 141051 - DNA, 25 bp, Homo sapien
cccgctactgaatgtggcaggcggt

SEQ ID NO: 141052 - DNA, 25 bp, Homo sapien
aggacgtggcctggcagcacatgca

SEQ ID NO: 141053 - DNA, 25 bp, Homo sapien
gggatgaggtctaggtcctcgtcgt

SEQ ID NO: 141054 - DNA, 25 bp, Homo sapien
ctcgtcgtcggggatctcatctaac

SEQ ID NO: 141055 - DNA, 25 bp, Homo sapien
cgtcggggatctcatctaaccggta

SEQ ID NO: 141056 - DNA, 25 bp, Homo sapien
cccgcccgctactgaatgtggcagg

SEQ ID NO: 141057 - DNA, 25 bp, Homo sapien
tgacaccgcgagctcggacgtctgt

SEQ ID NO: 141058 - DNA, 25 bp, Homo sapien
gaagggccactctgtgacaccgtga

SEQ ID NO: 141059 - DNA, 25 bp, Homo sapien
aagggccactctgctgacaccggga

SEQ ID NO: 141060 - DNA, 25 bp, Homo sapien
tgacaccgcgatcccggacgtctgt

SEQ ID NO: 141061 - DNA, 25 bp, Homo sapien
gctgacaccgtgagcccggacgtct

SEQ ID NO: 141062 - DNA, 25 bp, Homo sapien
cggacgtctgtcctccagaggcgga

SEQ ID NO: 141063 - DNA, 25 bp, Homo sapien
aagggccactctgtgacaccgcgag

SEQ ID NO: 141064 - DNA, 25 bp, Homo sapien
ggaggaagggccactctgtgacacc

SEQ ID NO: 141065 - DNA, 25 bp, Homo sapien
ccggtcgatctcctccatcatggtg

SEQ ID NO: 141066 - DNA, 25 bp, Homo sapien
acggaattcccaggttctgcaccaa

SEQ ID NO: 141067 - DNA, 25 bp, Homo sapien
ggcccagcgttcctgtccgtatatc

SEQ ID NO: 141068 - DNA, 25 bp, Homo sapien
ttcccaatctctcttagcctgacgg

SEQ ID NO: 141069 - DNA, 25 bp, Homo sapien
ccggcaatacgttttcagggatctc

SEQ ID NO: 141070 - DNA, 25 bp, Homo sapien
actccgtgggcttgcctagcactac

SEQ ID NO: 141071 - DNA, 25 bp, Homo sapien
cgcccggatcttgcattattcatga

SEQ ID NO: 141072 - DNA, 25 bp, Homo sapien
tcccacggttttcttgtcctgcaag

SEQ ID NO: 141073 - DNA, 25 bp, Homo sapien
gcttctgtcgctggcgcgactgcca

SEQ ID NO: 141074 - DNA, 25 bp, Homo sapien
cgcgcaagctgagccgcacgcccaa

SEQ ID NO: 141075 - DNA, 25 bp, Homo sapien
tccggaggcagcaggccaccgaggt

SEQ ID NO: 141076 - DNA, 25 bp, Homo sapien
gtcctgcctgaagggccacaagcgc

SEQ ID NO: 141077 - DNA, 25 bp, Homo sapien
gccagtgcgccaactgcctgctggt

SEQ ID NO: 141078 - DNA, 25 bp, Homo sapien
tgccagtgcgccaactgcctgctgg

SEQ ID NO: 141079 - DNA, 25 bp, Homo sapien
cgcgactgccagtgcgccaactgcc

SEQ ID NO: 141080 - DNA, 25 bp, Homo sapien
ccacagtggaggtgggggagttgga

SEQ ID NO: 141081 - DNA, 25 bp, Homo sapien
ccggttcccgcaccattggtggtgc

SEQ ID NO: 141082 - DNA, 25 bp, Homo sapien
cagcgaagagcctcgcctcctggga

SEQ ID NO: 141083 - DNA, 25 bp, Homo sapien
cttacctgagttgagcctggtgcgc

SEQ ID NO: 141084 - DNA, 25 bp, Homo sapien
cggcggccagcaaaaacagcgaaga

SEQ ID NO: 141085 - DNA, 25 bp, Homo sapien
gagaccagcagaggcgacgtccgct

SEQ ID NO: 141086 - DNA, 25 bp, Homo sapien
cgccgactaaggcttgggagcctgc

SEQ ID NO: 141087 - DNA, 25 bp, Homo sapien
gggaggcccttcttacctgagttga

SEQ ID NO: 141088 - DNA, 25 bp, Homo sapien
gccgccactcaattggctggccgaa

SEQ ID NO: 141089 - DNA, 25 bp, Homo sapien
tggccactgacctgggtccccacgc

SEQ ID NO: 141090 - DNA, 25 bp, Homo sapien
cgcggtgagcgacgagggccgagcc

SEQ ID NO: 141091 - DNA, 25 bp, Homo sapien
agaagcaacccccacagcggtcccg

SEQ ID NO: 141092 - DNA, 25 bp, Homo sapien
cagccggaacgacccgggaggcaga

SEQ ID NO: 141093 - DNA, 25 bp, Homo sapien
gtcctccggccctgtggccactgac

SEQ ID NO: 141094 - DNA, 25 bp, Homo sapien
gtgacaagtcctccggccctgtggc

SEQ ID NO: 141095 - DNA, 25 bp, Homo sapien
gggtgacaagtcctccggccctgtg

SEQ ID NO: 141096 - DNA, 25 bp, Homo sapien
cccgagtgagcgaccgggcaagcgg

SEQ ID NO: 141097 - DNA, 25 bp, Homo sapien
aagcctccactggaatgaaggggta

SEQ ID NO: 141098 - DNA, 25 bp, Homo sapien
cctccggtctggctgcaacatagga

SEQ ID NO: 141099 - DNA, 25 bp, Homo sapien
catgcctccagtgtctccgatgaca

SEQ ID NO: 141100 - DNA, 25 bp, Homo sapien
ataggaggctcactcccttcgcagc

SEQ ID NO: 141101 - DNA, 25 bp, Homo sapien
gtgttcactgcactcgtccctgggc

SEQ ID NO: 141102 - DNA, 25 bp, Homo sapien
tctgaggccacgtgaaagcgcaatg

SEQ ID NO: 141103 - DNA, 25 bp, Homo sapien
cttggatttgtcacctgacccttga

SEQ ID NO: 141104 - DNA, 25 bp, Homo sapien
gggtgcactctcaatgccgggcaca

SEQ ID NO: 141105 - DNA, 25 bp, Homo sapien
tttccaggggccagtcgaaccagat

SEQ ID NO: 141106 - DNA, 25 bp, Homo sapien
cgaaccagatcttgtgcagggagcc

SEQ ID NO: 141107 - DNA, 25 bp, Homo sapien
tccatagccacggtctcttccaggg

SEQ ID NO: 141108 - DNA, 25 bp, Homo sapien
ggacagttccctgcggtagaaagga

SEQ ID NO: 141109 - DNA, 25 bp, Homo sapien
ggctggcgttagctgttgagcaaac

SEQ ID NO: 141110 - DNA, 25 bp, Homo sapien
ttcaccgtgggtgcgaacaaaggct

SEQ ID NO: 141111 - DNA, 25 bp, Homo sapien
ggcgagagccttagttaccgacttc

SEQ ID NO: 141112 - DNA, 25 bp, Homo sapien
tgagcttcgacctcatcctgtgggc

SEQ ID NO: 141113 - DNA, 25 bp, Homo sapien
agtctcgcactcgtacgggtacagg

SEQ ID NO: 141114 - DNA, 25 bp, Homo sapien
tcgagcacctgcttcgccatgatgg

SEQ ID NO: 141115 - DNA, 25 bp, Homo sapien
tacttcatgtacctaggggcggaca

SEQ ID NO: 141116 - DNA, 25 bp, Homo sapien
cagctggtcaagtcccacagccgga

SEQ ID NO: 141117 - DNA, 25 bp, Homo sapien
cctcgcgccgattgctgtctatggc

SEQ ID NO: 141118 - DNA, 25 bp, Homo sapien
ccacactttgcggttgatgacttcc

SEQ ID NO: 141119 - DNA, 25 bp, Homo sapien
ccctgccaagccgaagagcggagta

SEQ ID NO: 141120 - DNA, 25 bp, Homo sapien
cggtcaccaggcgaaacagagcgta

SEQ ID NO: 141121 - DNA, 25 bp, Homo sapien
cctgtctgcgctgagcgatgggccc

SEQ ID NO: 141122 - DNA, 25 bp, Homo sapien
gaacaattagctgcggcctgattaa

SEQ ID NO: 141123 - DNA, 25 bp, Homo sapien
cgcgcctttggacccgaacaattag

SEQ ID NO: 141124 - DNA, 25 bp, Homo sapien
tgattaatgggggaaaattatcggc

SEQ ID NO: 141125 - DNA, 25 bp, Homo sapien
ccgaacaattagctgcggcctgatt

SEQ ID NO: 141126 - DNA, 25 bp, Homo sapien
gcgatgggccccagttaattcctta

SEQ ID NO: 141127 - DNA, 25 bp, Homo sapien
cgccggccagtcctgacaaaggggc

SEQ ID NO: 141128 - DNA, 25 bp, Homo sapien
ctttggacccgaacaattagctgcg

SEQ ID NO: 141129 - DNA, 25 bp, Homo sapien
tctttccagccagcttcgggggcag

SEQ ID NO: 141130 - DNA, 25 bp, Homo sapien
ttgagatatagggaaagaccaagac

SEQ ID NO: 141131 - DNA, 25 bp, Homo sapien
accaagacagcaggaaacggacaga

SEQ ID NO: 141132 - DNA, 25 bp, Homo sapien
gagagattagaaagagacagttaaa

SEQ ID NO: 141133 - DNA, 25 bp, Homo sapien
acagttaaatagagagggaccgaca

SEQ ID NO: 141134 - DNA, 25 bp, Homo sapien
aatagagagggaccgacagagacag

SEQ ID NO: 141135 - DNA, 25 bp, Homo sapien
ctgtgctcctctggcggctgtgcgc

SEQ ID NO: 141136 - DNA, 25 bp, Homo sapien
cctgtgggatctgccgctctcagct

SEQ ID NO: 141137 - DNA, 25 bp, Homo sapien
gccgcagctccacgatcagacgaga

SEQ ID NO: 141138 - DNA, 25 bp, Homo sapien
atggcgccttcggaaccctaggctc

SEQ ID NO: 141139 - DNA, 25 bp, Homo sapien
tacggctcgccctgaccaatcggag

SEQ ID NO: 141140 - DNA, 25 bp, Homo sapien
ttcgcgctggaagacgaagctctgc

SEQ ID NO: 141141 - DNA, 25 bp, Homo sapien
aactgcgctatctcttcgcgctgga

SEQ ID NO: 141142 - DNA, 25 bp, Homo sapien
gcgaggtctgacctagctagcgcca

SEQ ID NO: 141143 - DNA, 25 bp, Homo sapien
tgcagaaggcacatggcgcccatcc

SEQ ID NO: 141144 - DNA, 25 bp, Homo sapien
gctagcgccactctacatacggata

SEQ ID NO: 141145 - DNA, 25 bp, Homo sapien
agcaggatccgcagggatgcgcagc

SEQ ID NO: 141146 - DNA, 25 bp, Homo sapien
ggctaccctggtgatggaccccacg

SEQ ID NO: 141147 - DNA, 25 bp, Homo sapien
cgcctggcgccggaacctgcgagct

SEQ ID NO: 141148 - DNA, 25 bp, Homo sapien
tgcggccacacaccggcaacgcggt

SEQ ID NO: 141149 - DNA, 25 bp, Homo sapien
agccgcgcgcacaaacggatgggcc

SEQ ID NO: 141150 - DNA, 25 bp, Homo sapien
aaggcctcgctgcagaagcaggatg

SEQ ID NO: 141151 - DNA, 25 bp, Homo sapien
tgccctcgcggatcgggtctcggct

SEQ ID NO: 141152 - DNA, 25 bp, Homo sapien
tgccttctgcgtggcgcgcgtgtcc

SEQ ID NO: 141153 - DNA, 25 bp, Homo sapien
ctgtacgagcagcaggccaattggc

SEQ ID NO: 141154 - DNA, 25 bp, Homo sapien
ccctccgaaggttggaacgctcatc

SEQ ID NO: 141155 - DNA, 25 bp, Homo sapien
gccaattggcgctgggaaagtccaa

SEQ ID NO: 141156 - DNA, 25 bp, Homo sapien
tcccgagccagaccgacaaggcgta

SEQ ID NO: 141157 - DNA, 25 bp, Homo sapien
gcagcagcaaccttccgggcaaacg

SEQ ID NO: 141158 - DNA, 25 bp, Homo sapien
cgcgcagtggaaccgatcctcagca

SEQ ID NO: 141159 - DNA, 25 bp, Homo sapien
gccctgcagattttccagcggatcc

SEQ ID NO: 141160 - DNA, 25 bp, Homo sapien
aacggtaactgcaccgcggcaggga

SEQ ID NO: 141161 - DNA, 25 bp, Homo sapien
agactgagtcccgtccatgcccggg

SEQ ID NO: 141162 - DNA, 25 bp, Homo sapien
attcccgacatgtcctgggctccga

SEQ ID NO: 141163 - DNA, 25 bp, Homo sapien
ccgccacatgcgaagccaggggaaa

SEQ ID NO: 141164 - DNA, 25 bp, Homo sapien
gacagctcatcaggcctcgcagagg

SEQ ID NO: 141165 - DNA, 25 bp, Homo sapien
caggccgctggacagacagctcatc

SEQ ID NO: 141166 - DNA, 25 bp, Homo sapien
ctgtcagtacggaacagagcccgtg

SEQ ID NO: 141167 - DNA, 25 bp, Homo sapien
aatctttaatgcactggctggctgg

SEQ ID NO: 141168 - DNA, 25 bp, Homo sapien
cccgatgggtcctcagagactgagt

SEQ ID NO: 141169 - DNA, 25 bp, Homo sapien
tttgcgttgcaaaacacggccatgc

SEQ ID NO: 141170 - DNA, 25 bp, Homo sapien
cggccatgccatctgcaaaggtgtc

SEQ ID NO: 141171 - DNA, 25 bp, Homo sapien
ccctgctcaggagtttgctttattc

SEQ ID NO: 141172 - DNA, 25 bp, Homo sapien
ggtaggagcctcctcccaacgatga

SEQ ID NO: 141173 - DNA, 25 bp, Homo sapien
ggataatcctgtctgcctgactgtc

SEQ ID NO: 141174 - DNA, 25 bp, Homo sapien
cgggaggccatgatccggataatcc

SEQ ID NO: 141175 - DNA, 25 bp, Homo sapien
tcccagggacttgttcaaagggctc

SEQ ID NO: 141176 - DNA, 25 bp, Homo sapien
gtgtcgcgatgcacttccctaaata

SEQ ID NO: 141177 - DNA, 25 bp, Homo sapien
ggacccggactagatggttagtgta

SEQ ID NO: 141178 - DNA, 25 bp, Homo sapien
gcatgaatgtgcgtatcccgaactg

SEQ ID NO: 141179 - DNA, 25 bp, Homo sapien
atcccgaactgtgtctgtggggctc

SEQ ID NO: 141180 - DNA, 25 bp, Homo sapien
gtgagcgtgcccatgcatctccctt

SEQ ID NO: 141181 - DNA, 25 bp, Homo sapien
ggctgtgaccctgcgagctcctcag

SEQ ID NO: 141182 - DNA, 25 bp, Homo sapien
atccgatgacctgggccgacagtta

SEQ ID NO: 141183 - DNA, 25 bp, Homo sapien
caggggagtcaaccaagttcgtggt

SEQ ID NO: 141184 - DNA, 25 bp, Homo sapien
tggttagtgtatgtcgcatgcatga

SEQ ID NO: 141185 - DNA, 25 bp, Homo sapien
aacaaagtgttagcggcctcagccc

SEQ ID NO: 141186 - DNA, 25 bp, Homo sapien
cgaatgccagcgtcgtgagcctgga

SEQ ID NO: 141187 - DNA, 25 bp, Homo sapien
gcgaaagtcgctggaagagtcattc

SEQ ID NO: 141188 - DNA, 25 bp, Homo sapien
agagtcattctcacccttacgggca

SEQ ID NO: 141189 - DNA, 25 bp, Homo sapien
gcagttggccggctgtttcagtccc

SEQ ID NO: 141190 - DNA, 25 bp, Homo sapien
agctgattcgggaggccagtacctc

SEQ ID NO: 141191 - DNA, 25 bp, Homo sapien
ctgccggccaagaaagcctcgcgtg

SEQ ID NO: 141192 - DNA, 25 bp, Homo sapien
cagggccggcagtatagagtccgcc

SEQ ID NO: 141193 - DNA, 25 bp, Homo sapien
cacctcgcgcgggtgcacacgccgc

SEQ ID NO: 141194 - DNA, 25 bp, Homo sapien
gtccgccgtcctcccgcattcccac

SEQ ID NO: 141195 - DNA, 25 bp, Homo sapien
gggccgtctgctcatcggagccgtc

SEQ ID NO: 141196 - DNA, 25 bp, Homo sapien
gcacctgggccgtctgctcatcgga

SEQ ID NO: 141197 - DNA, 25 bp, Homo sapien
gcgggcactgtccttgccgcagtcg

SEQ ID NO: 141198 - DNA, 25 bp, Homo sapien
tgctggtggcggcatccacccggac

SEQ ID NO: 141199 - DNA, 25 bp, Homo sapien
gcacgtgctggtggcggcatccacc

SEQ ID NO: 141200 - DNA, 25 bp, Homo sapien
ggccctgctggatgagtcattctcc

SEQ ID NO: 141201 - DNA, 25 bp, Homo sapien
agcggctgtctcacggaccacggcg

SEQ ID NO: 141202 - DNA, 25 bp, Homo sapien
gggcagcggctgtctcacggaccac

SEQ ID NO: 141203 - DNA, 25 bp, Homo sapien
acaggaagacggttcaatgggcggc

SEQ ID NO: 141204 - DNA, 25 bp, Homo sapien
aggctgagctgagtgacaggaagac

SEQ ID NO: 141205 - DNA, 25 bp, Homo sapien
caagccgcttgttgaaaactgccca

SEQ ID NO: 141206 - DNA, 25 bp, Homo sapien
tgggcggctatcaccaagccgcttg

SEQ ID NO: 141207 - DNA, 25 bp, Homo sapien
gaggatgggcggctatcaccaagcc

SEQ ID NO: 141208 - DNA, 25 bp, Homo sapien
aaaactgcccaatcacagtggaggc

SEQ ID NO: 141209 - DNA, 25 bp, Homo sapien
tgaggccttcacatggcgcaaagtc

SEQ ID NO: 141210 - DNA, 25 bp, Homo sapien
gtcgcagacgcttcgctgagactga

SEQ ID NO: 141211 - DNA, 25 bp, Homo sapien
cctcagtgatgcgacacgcctagta

SEQ ID NO: 141212 - DNA, 25 bp, Homo sapien
gacgtccgttctaagggagccaatc

SEQ ID NO: 141213 - DNA, 25 bp, Homo sapien
ccgaatcatcggaagggaagctgct

SEQ ID NO: 141214 - DNA, 25 bp, Homo sapien
gggcgaacaacgctggctcctgatc

SEQ ID NO: 141215 - DNA, 25 bp, Homo sapien
atgacacagcacgatccggcccagg

SEQ ID NO: 141216 - DNA, 25 bp, Homo sapien
aggaaattcgcttgcggcctggctc

SEQ ID NO: 141217 - DNA, 25 bp, Homo sapien
tgcggttggtcctcttgaagagtta

SEQ ID NO: 141218 - DNA, 25 bp, Homo sapien
tcttgaagagttagttcccgcggga

SEQ ID NO: 141219 - DNA, 25 bp, Homo sapien
ccgcccaggctttccaggacagatg

SEQ ID NO: 141220 - DNA, 25 bp, Homo sapien
tcggggaggaaacgagtcagcaacc

SEQ ID NO: 141221 - DNA, 25 bp, Homo sapien
ggcgctccgtaatcgtccatccttt

SEQ ID NO: 141222 - DNA, 25 bp, Homo sapien
ccaaacaggcttaggcgggctagaa

SEQ ID NO: 141223 - DNA, 25 bp, Homo sapien
tggtgtttccagaaagcggtaactg

SEQ ID NO: 141224 - DNA, 25 bp, Homo sapien
cacgctcaccaaggtcggctttcta

SEQ ID NO: 141225 - DNA, 25 bp, Homo sapien
gggagactcccttacttcagggtga

SEQ ID NO: 141226 - DNA, 25 bp, Homo sapien
cacagagatgcgtgcgccagacaga

SEQ ID NO: 141227 - DNA, 25 bp, Homo sapien
ctcacctgcaatggcacccggaagt

SEQ ID NO: 141228 - DNA, 25 bp, Homo sapien
agccgcggtactgagcaccttggtt

SEQ ID NO: 141229 - DNA, 25 bp, Homo sapien
aggcacgaccttcgccacgcaagga

SEQ ID NO: 141230 - DNA, 25 bp, Homo sapien
gggaggagtcactctccgcttccgg

SEQ ID NO: 141231 - DNA, 25 bp, Homo sapien
tacccagtggaaagggatcgaagcc

SEQ ID NO: 141232 - DNA, 25 bp, Homo sapien
cctgcgacctggcagcacagagatg

SEQ ID NO: 141233 - DNA, 25 bp, Homo sapien
aaggtgctttagctcgaagtattga

SEQ ID NO: 141234 - DNA, 25 bp, Homo sapien
gagtgatacgcgacgacacagtgcc

SEQ ID NO: 141235 - DNA, 25 bp, Homo sapien
gtattgagtgatacgcgacgacaca

SEQ ID NO: 141236 - DNA, 25 bp, Homo sapien
ctcgaagtattgagtgatacgcgac

SEQ ID NO: 141237 - DNA, 25 bp, Homo sapien
tagctcgaagtattgagtgatacgc

SEQ ID NO: 141238 - DNA, 25 bp, Homo sapien
gtgctttagctcgaagtattgagtg

SEQ ID NO: 141239 - DNA, 25 bp, Homo sapien
tggaaaggtgctttagctcgaagta

SEQ ID NO: 141240 - DNA, 25 bp, Homo sapien
cccgtggccgcagaccgaggcccac

SEQ ID NO: 141241 - DNA, 25 bp, Homo sapien
accctctggaaaggttgcctcgctc

SEQ ID NO: 141242 - DNA, 25 bp, Homo sapien
agtttgcccaccagagcgtagtatc

SEQ ID NO: 141243 - DNA, 25 bp, Homo sapien
tttcgcgggcattatcactcagaca

SEQ ID NO: 141244 - DNA, 25 bp, Homo sapien
gtaatctctgtcctgaccctctgga

SEQ ID NO: 141245 - DNA, 25 bp, Homo sapien
tttccagcggagaacccaggtaatc

SEQ ID NO: 141246 - DNA, 25 bp, Homo sapien
cctcggtcctgaaggcatctccata

SEQ ID NO: 141247 - DNA, 25 bp, Homo sapien
tgcggcacgaacagtaccacggtgt

SEQ ID NO: 141248 - DNA, 25 bp, Homo sapien
gcgcgtcaagttgttccctgggaaa

SEQ ID NO: 141249 - DNA, 25 bp, Homo sapien
ccaacccagacaaagggtggctcag

SEQ ID NO: 141250 - DNA, 25 bp, Homo sapien
tgtgcaacactagcgggccctggcg

SEQ ID NO: 141251 - DNA, 25 bp, Homo sapien
ctcccaaattggctccgcggaggtg

SEQ ID NO: 141252 - DNA, 25 bp, Homo sapien
tgctaggctcttcgctgttcagctt

SEQ ID NO: 141253 - DNA, 25 bp, Homo sapien
ttcgtgtgcaacactagcgggccct

SEQ ID NO: 141254 - DNA, 25 bp, Homo sapien
cctgctctgctaggctcttcgctgt

SEQ ID NO: 141255 - DNA, 25 bp, Homo sapien
ccagacaaagggtggctcaggctga

SEQ ID NO: 141256 - DNA, 25 bp, Homo sapien
tcgctgttcagcttcgtgtgcaaca

SEQ ID NO: 141257 - DNA, 25 bp, Homo sapien
ccacgtgcggcttctgtgatgacaa

SEQ ID NO: 141258 - DNA, 25 bp, Homo sapien
aaccaggatccgctggctctgattg

SEQ ID NO: 141259 - DNA, 25 bp, Homo sapien
cagcctggcagaagtcgcgccaaga

SEQ ID NO: 141260 - DNA, 25 bp, Homo sapien
ggcagttactgagcagccctagctg

SEQ ID NO: 141261 - DNA, 25 bp, Homo sapien
tcccgttgcacttggggacgtggta

SEQ ID NO: 141262 - DNA, 25 bp, Homo sapien
cacacctgtagttccgtgggtcccg

SEQ ID NO: 141263 - DNA, 25 bp, Homo sapien
gtctccagatcgtctgcaaagcgca

SEQ ID NO: 141264 - DNA, 25 bp, Homo sapien
acaaagtgatggtcgcaggtcgcct

SEQ ID NO: 141265 - DNA, 25 bp, Homo sapien
cactgcgactgtggaatacactgtc

SEQ ID NO: 141266 - DNA, 25 bp, Homo sapien
cctgtggacccgagagagtgatcat

SEQ ID NO: 141267 - DNA, 25 bp, Homo sapien
atcaaaagccgacggggacttcctg

SEQ ID NO: 141268 - DNA, 25 bp, Homo sapien
gaggcaccggggttttgaagatcaa

SEQ ID NO: 141269 - DNA, 25 bp, Homo sapien
cgtgcggtcggaaaactttcatcca

SEQ ID NO: 141270 - DNA, 25 bp, Homo sapien
actgtgattttcacccgtgcggtcg

SEQ ID NO: 141271 - DNA, 25 bp, Homo sapien
tgcctccttggttggccaaactgtg

SEQ ID NO: 141272 - DNA, 25 bp, Homo sapien
ctgcaagagcgggaatacaggtaac

SEQ ID NO: 141273 - DNA, 25 bp, Homo sapien
cacccttccagtggacgtccggtga

SEQ ID NO: 141274 - DNA, 25 bp, Homo sapien
ctacccggagttcgctcagacggtg

SEQ ID NO: 141275 - DNA, 25 bp, Homo sapien
acgctacctgcgaccgggaccatga

SEQ ID NO: 141276 - DNA, 25 bp, Homo sapien
gggaccatgaggagctgccagaccc

SEQ ID NO: 141277 - DNA, 25 bp, Homo sapien
taacgagagcagtcgcggcacctgc

SEQ ID NO: 141278 - DNA, 25 bp, Homo sapien
gatcctcggccatgtcactgctctg

SEQ ID NO: 141279 - DNA, 25 bp, Homo sapien
acctcccagcgatggcgtcgctgtg

SEQ ID NO: 141280 - DNA, 25 bp, Homo sapien
gcggcagaggcttgcccgatcctcg

SEQ ID NO: 141281 - DNA, 25 bp, Homo sapien
agggcaacccagatcggaccatcgc

SEQ ID NO: 141282 - DNA, 25 bp, Homo sapien
caagtccctgtgacggctttgggga

SEQ ID NO: 141283 - DNA, 25 bp, Homo sapien
tcccttagcgggaaagctctgcgcg

SEQ ID NO: 141284 - DNA, 25 bp, Homo sapien
aaagctctgcgcgtgactcggctgc

SEQ ID NO: 141285 - DNA, 25 bp, Homo sapien
gagggcctgtcttcccacctatgtg

SEQ ID NO: 141286 - DNA, 25 bp, Homo sapien
ctcgcgcccagtagtcaccttggta

SEQ ID NO: 141287 - DNA, 25 bp, Homo sapien
gcgagaaacgaggtaggaacgcctc

SEQ ID NO: 141288 - DNA, 25 bp, Homo sapien
cctcaggcgaagctgggactcacac

SEQ ID NO: 141289 - DNA, 25 bp, Homo sapien
tctccgagggacagcgttctttgag

SEQ ID NO: 141290 - DNA, 25 bp, Homo sapien
ctcaggccggagcttatttgacccg

SEQ ID NO: 141291 - DNA, 25 bp, Homo sapien
tcccgttattcaagctcaggccgga

SEQ ID NO: 141292 - DNA, 25 bp, Homo sapien
gactccctgggcagctaagcttcgc

SEQ ID NO: 141293 - DNA, 25 bp, Homo sapien
tgagcccgaccctcaacggacagta

SEQ ID NO: 141294 - DNA, 25 bp, Homo sapien
ttgctaggctacctctgattgcggc

SEQ ID NO: 141295 - DNA, 25 bp, Homo sapien
ggtatcacaacctcccgtgaaggta

SEQ ID NO: 141296 - DNA, 25 bp, Homo sapien
aggacctggactctcttctttattg

SEQ ID NO: 141297 - DNA, 25 bp, Homo sapien
gtgacgtcacggctctccaggacgc

SEQ ID NO: 141298 - DNA, 25 bp, Homo sapien
cggtgcacgtcggattcaggcgcac

SEQ ID NO: 141299 - DNA, 25 bp, Homo sapien
ggcacactcacaggggagaatccgc

SEQ ID NO: 141300 - DNA, 25 bp, Homo sapien
gcatccagtgtgagaccggaagccc

SEQ ID NO: 141301 - DNA, 25 bp, Homo sapien
tgaccgctgtcgaggggagcatcca

SEQ ID NO: 141302 - DNA, 25 bp, Homo sapien
gctgctccgacttgaccgctgtcga

SEQ ID NO: 141303 - DNA, 25 bp, Homo sapien
tcaggcgcaccggatgaaggtgaat

SEQ ID NO: 141304 - DNA, 25 bp, Homo sapien
tccaggacgcagttggctgctccga

SEQ ID NO: 141305 - DNA, 25 bp, Homo sapien
agaaccgggtgcttcgaggagatct

SEQ ID NO: 141306 - DNA, 25 bp, Homo sapien
tggcgcgacgctgagccatcttcag

SEQ ID NO: 141307 - DNA, 25 bp, Homo sapien
tcccagtgggtaggcgggactccaa

SEQ ID NO: 141308 - DNA, 25 bp, Homo sapien
cggactcagtcctaagcgggcgaag

SEQ ID NO: 141309 - DNA, 25 bp, Homo sapien
tcctccagggtaaagctctcacgtc

SEQ ID NO: 141310 - DNA, 25 bp, Homo sapien
ctgcatcccgcctgcgcagaagtgg

SEQ ID NO: 141311 - DNA, 25 bp, Homo sapien
cgttccgcgaacttgggaggcgact

SEQ ID NO: 141312 - DNA, 25 bp, Homo sapien
gagccatcttcagaagcaccgcagc

SEQ ID NO: 141313 - DNA, 25 bp, Homo sapien
ggcgaccaccgctcaaggatcaacg

SEQ ID NO: 141314 - DNA, 25 bp, Homo sapien
cgggcacacccaggtaccagctagg

SEQ ID NO: 141315 - DNA, 25 bp, Homo sapien
cagaggcattgtggctagcagaata

SEQ ID NO: 141316 - DNA, 25 bp, Homo sapien
acgtcctcagcttcacagagtagta

SEQ ID NO: 141317 - DNA, 25 bp, Homo sapien
cgggatacgcttcttggcggacttt

SEQ ID NO: 141318 - DNA, 25 bp, Homo sapien
cgcactgcctgcgtaactagaggga

SEQ ID NO: 141319 - DNA, 25 bp, Homo sapien
cgtcgcggcttttgtgctgtacaag

SEQ ID NO: 141320 - DNA, 25 bp, Homo sapien
aacagagtcctcagtgtgtagccta

SEQ ID NO: 141321 - DNA, 25 bp, Homo sapien
ggactctgcagagcctccaccatca

SEQ ID NO: 141322 - DNA, 25 bp, Homo sapien
gcctccaccatcatcactcgccggg

SEQ ID NO: 141323 - DNA, 25 bp, Homo sapien
accatcatcactcgccgggactctg

SEQ ID NO: 141324 - DNA, 25 bp, Homo sapien
ctctgcagagcctccaccatcatca

SEQ ID NO: 141325 - DNA, 25 bp, Homo sapien
atcatcactcgccgggactctgcag

SEQ ID NO: 141326 - DNA, 25 bp, Homo sapien
agcctccaccatcatcactcgccgg

SEQ ID NO: 141327 - DNA, 25 bp, Homo sapien
gcagagcctccaccatcatcactcg

SEQ ID NO: 141328 - DNA, 25 bp, Homo sapien
ccaccatcatcactcgccgggactc

SEQ ID NO: 141329 - DNA, 25 bp, Homo sapien
ccgctcggtctctagcagctcccgg

SEQ ID NO: 141330 - DNA, 25 bp, Homo sapien
gcagtccgcggcagattcaaatccc

SEQ ID NO: 141331 - DNA, 25 bp, Homo sapien
agattcaaatcccaaccgctcgcgg

SEQ ID NO: 141332 - DNA, 25 bp, Homo sapien
ccaccgccagagcggcgctttaggt

SEQ ID NO: 141333 - DNA, 25 bp, Homo sapien
ggatcgacacttccggctgcagtcc

SEQ ID NO: 141334 - DNA, 25 bp, Homo sapien
tgagggatcgacacttccggctgca

SEQ ID NO: 141335 - DNA, 25 bp, Homo sapien
gggcacgctgctcttgcaccgggca

SEQ ID NO: 141336 - DNA, 25 bp, Homo sapien
ggtgcaggcgcgtttccgctcccag

SEQ ID NO: 141337 - DNA, 25 bp, Homo sapien
gcacactgtggaaggccaccgtttc

SEQ ID NO: 141338 - DNA, 25 bp, Homo sapien
ctttgccagagttgacgaggccttg

SEQ ID NO: 141339 - DNA, 25 bp, Homo sapien
gtccttttcagatccacgtggttca

SEQ ID NO: 141340 - DNA, 25 bp, Homo sapien
tgcctcctgggctagagatggctct

SEQ ID NO: 141341 - DNA, 25 bp, Homo sapien
cgcctgcgcaacaatggccacagtg

SEQ ID NO: 141342 - DNA, 25 bp, Homo sapien
ggcgtcagacttcctcactatactc

SEQ ID NO: 141343 - DNA, 25 bp, Homo sapien
tccctaagttcctgacctaggcgtc

SEQ ID NO: 141344 - DNA, 25 bp, Homo sapien
gtggttcacctcagcaccgcctttg

SEQ ID NO: 141345 - DNA, 25 bp, Homo sapien
ctccgtgcttcctctgagtgacagc

SEQ ID NO: 141346 - DNA, 25 bp, Homo sapien
tcggcccaaaccttgtaggggcaga

SEQ ID NO: 141347 - DNA, 25 bp, Homo sapien
gtctcatcgggagcttggggaaact

SEQ ID NO: 141348 - DNA, 25 bp, Homo sapien
agtccctctaggtttgcgttatcga

SEQ ID NO: 141349 - DNA, 25 bp, Homo sapien
gctcctcggcagtttgagtgcctca

SEQ ID NO: 141350 - DNA, 25 bp, Homo sapien
ccggattaaatgtctctcgggaggc

SEQ ID NO: 141351 - DNA, 25 bp, Homo sapien
tccctgccagccgtcggaggaaaaa

SEQ ID NO: 141352 - DNA, 25 bp, Homo sapien
gcagcagccgctacccttaatttag

SEQ ID NO: 141353 - DNA, 25 bp, Homo sapien
cgttctcgatgctcgggagccgcca

SEQ ID NO: 141354 - DNA, 25 bp, Homo sapien
agaactcttcctttttctagcttgg

SEQ ID NO: 141355 - DNA, 25 bp, Homo sapien
cccaagcctcttctcagttggaggg

SEQ ID NO: 141356 - DNA, 25 bp, Homo sapien
tcagttggagggaactccaagtccc

SEQ ID NO: 141357 - DNA, 25 bp, Homo sapien
tccaagtcccacagtgccacggggt

SEQ ID NO: 141358 - DNA, 25 bp, Homo sapien
cactttcgctgcgttggaggctgag

SEQ ID NO: 141359 - DNA, 25 bp, Homo sapien
ggataggtgcccgaggcctacagct

SEQ ID NO: 141360 - DNA, 25 bp, Homo sapien
gcccgagttccctttcaggctagaa

SEQ ID NO: 141361 - DNA, 25 bp, Homo sapien
gtttcgttgcttccttcctcggagc

SEQ ID NO: 141362 - DNA, 25 bp, Homo sapien
tttcgttgcttccttcctcggagcc

SEQ ID NO: 141363 - DNA, 25 bp, Homo sapien
cgttgcttccttcctcggagcccgg

SEQ ID NO: 141364 - DNA, 25 bp, Homo sapien
ggcttggctcggtttgcgcgtttaa

SEQ ID NO: 141365 - DNA, 25 bp, Homo sapien
cgattgtttcgttgcttccttcctc

SEQ ID NO: 141366 - DNA, 25 bp, Homo sapien
attgtttcgttgcttccttcctcgg

SEQ ID NO: 141367 - DNA, 25 bp, Homo sapien
ttgtttcgttgcttccttcctcgga

SEQ ID NO: 141368 - DNA, 25 bp, Homo sapien
tgtttcgttgcttccttcctcggag

SEQ ID NO: 141369 - DNA, 25 bp, Homo sapien
ggctctgaacaggacgctccaagtg

SEQ ID NO: 141370 - DNA, 25 bp, Homo sapien
gtttaagaacgagcgcctaggcctc

SEQ ID NO: 141371 - DNA, 25 bp, Homo sapien
cgggcaagggtctagagctcccgca

SEQ ID NO: 141372 - DNA, 25 bp, Homo sapien
ttcactgggtgacctcctcctgtcg

SEQ ID NO: 141373 - DNA, 25 bp, Homo sapien
tcctgtcggggccatttgtcttcag

SEQ ID NO: 141374 - DNA, 25 bp, Homo sapien
gagcgcgcctttcatgaatccggga

SEQ ID NO: 141375 - DNA, 25 bp, Homo sapien
catttgtcttcagggcctctctttg

SEQ ID NO: 141376 - DNA, 25 bp, Homo sapien
ccctggattgttgctagagaccctc

SEQ ID NO: 141377 - DNA, 25 bp, Homo sapien
ggctctccttcggttgtctctgtag

SEQ ID NO: 141378 - DNA, 25 bp, Homo sapien
tcgactatgcgaggtgactagcggc

SEQ ID NO: 141379 - DNA, 25 bp, Homo sapien
gtgccgatccctagtgtcgactatg

SEQ ID NO: 141380 - DNA, 25 bp, Homo sapien
atgacccgagccctttccggtctgg

SEQ ID NO: 141381 - DNA, 25 bp, Homo sapien
cgacgattagctcgcccggccaaag

SEQ ID NO: 141382 - DNA, 25 bp, Homo sapien
cgtcgtcattgagccgacgattagc

SEQ ID NO: 141383 - DNA, 25 bp, Homo sapien
cccgagccctcggatactaagtatc

SEQ ID NO: 141384 - DNA, 25 bp, Homo sapien
agcctattccagatgcgggcgccgg

SEQ ID NO: 141385 - DNA, 25 bp, Homo sapien
cttctgtcgtggtgtcgctacgggc

SEQ ID NO: 141386 - DNA, 25 bp, Homo sapien
tcacttagtgggcttctgtcgtggt

SEQ ID NO: 141387 - DNA, 25 bp, Homo sapien
agcagagggtcacttagtgggcttc

SEQ ID NO: 141388 - DNA, 25 bp, Homo sapien
ttctgggagcagagggtcacttagt

SEQ ID NO: 141389 - DNA, 25 bp, Homo sapien
ggccctctggtgagtcacagccgac

SEQ ID NO: 141390 - DNA, 25 bp, Homo sapien
gccgctggccctctggtgagtcaca

SEQ ID NO: 141391 - DNA, 25 bp, Homo sapien
cgcactacacgcttgggaacaagga

SEQ ID NO: 141392 - DNA, 25 bp, Homo sapien
ctggcgcgcactacacgcttgggaa

SEQ ID NO: 141393 - DNA, 25 bp, Homo sapien
agcctcgtggactttctaaggactg

SEQ ID NO: 141394 - DNA, 25 bp, Homo sapien
tggactttctaaggactggtgggaa

SEQ ID NO: 141395 - DNA, 25 bp, Homo sapien
gttgagtcccaagcaagaaggagcc

SEQ ID NO: 141396 - DNA, 25 bp, Homo sapien
gccgagagttgagtcccaagcaaga

SEQ ID NO: 141397 - DNA, 25 bp, Homo sapien
tcgaggccctgactgagcagatggt

SEQ ID NO: 141398 - DNA, 25 bp, Homo sapien
gagacaaaagaaaatcgaggccctg

SEQ ID NO: 141399 - DNA, 25 bp, Homo sapien
ctgcgctgtgcaggagacaaaagaa

SEQ ID NO: 141400 - DNA, 25 bp, Homo sapien
gttacaggctttccccaggcgccag

SEQ ID NO: 141401 - DNA, 25 bp, Homo sapien
ggcccgttagtccaagcaggagctc

SEQ ID NO: 141402 - DNA, 25 bp, Homo sapien
cgaggcgacctgacccggacgagcg

SEQ ID NO: 141403 - DNA, 25 bp, Homo sapien
gccgccgtagctccggatgggacca

SEQ ID NO: 141404 - DNA, 25 bp, Homo sapien
cgtagctccggatgggaccagcgcc

SEQ ID NO: 141405 - DNA, 25 bp, Homo sapien
ccgggcccgttagtccaagcaggag

SEQ ID NO: 141406 - DNA, 25 bp, Homo sapien
gaatccttcacagggagatttaccc

SEQ ID NO: 141407 - DNA, 25 bp, Homo sapien
tgcccatgatcccagtccttccgcg

SEQ ID NO: 141408 - DNA, 25 bp, Homo sapien
caggagctccgggagaatccttcac

SEQ ID NO: 141409 - DNA, 25 bp, Homo sapien
agactcgttggtctccatcttcaga

SEQ ID NO: 141410 - DNA, 25 bp, Homo sapien
tagggttccgctggcttaagacctc

SEQ ID NO: 141411 - DNA, 25 bp, Homo sapien
cctagtgctgttagggaggtccgct

SEQ ID NO: 141412 - DNA, 25 bp, Homo sapien
ggcggaagtcttcagcctagtgctg

SEQ ID NO: 141413 - DNA, 25 bp, Homo sapien
cgcagaagtacagctgggcggactt

SEQ ID NO: 141414 - DNA, 25 bp, Homo sapien
gcattccgcctcagacggggtttta

SEQ ID NO: 141415 - DNA, 25 bp, Homo sapien
tccagctactgggttgccatagaga

SEQ ID NO: 141416 - DNA, 25 bp, Homo sapien
cgcgatccctccgtagactcgttgg

SEQ ID NO: 141417 - DNA, 25 bp, Homo sapien
gccgtccgctttcctgtgcgagtcg

SEQ ID NO: 141418 - DNA, 25 bp, Homo sapien
tccgggacccgcagactcaaaagag

SEQ ID NO: 141419 - DNA, 25 bp, Homo sapien
agggtatccgggacccgcagactca

SEQ ID NO: 141420 - DNA, 25 bp, Homo sapien
gccgcctccatttgttattttccca

SEQ ID NO: 141421 - DNA, 25 bp, Homo sapien
accagcaggtaaggtctgcggccgc

SEQ ID NO: 141422 - DNA, 25 bp, Homo sapien
gccgtcccgagctaccagcaggtaa

SEQ ID NO: 141423 - DNA, 25 bp, Homo sapien
gacccgcagactcaaaagaggagga

SEQ ID NO: 141424 - DNA, 25 bp, Homo sapien
ttcctgtgcgagtcgccggacgcac

SEQ ID NO: 141425 - DNA, 25 bp, Homo sapien
ccgcgcgcaacccagcagccagcac

SEQ ID NO: 141426 - DNA, 25 bp, Homo sapien
atcagcaccagctcgttctccggag

SEQ ID NO: 141427 - DNA, 25 bp, Homo sapien
gcgggaatcagcaccagctcgttct

SEQ ID NO: 141428 - DNA, 25 bp, Homo sapien
tcgttctccggagccaccagttcga

SEQ ID NO: 141429 - DNA, 25 bp, Homo sapien
accagttcgacctcaccacacagcc

SEQ ID NO: 141430 - DNA, 25 bp, Homo sapien
cactgaccctgtcccgacctcggcg

SEQ ID NO: 141431 - DNA, 25 bp, Homo sapien
cgggaacctctcacccgggtcagca

SEQ ID NO: 141432 - DNA, 25 bp, Homo sapien
gggcgagccctgctaccccattgga

SEQ ID NO: 141433 - DNA, 25 bp, Homo sapien
ggaacgcctagtagtctccgtggca

SEQ ID NO: 141434 - DNA, 25 bp, Homo sapien
cgtcacgccgacgtcaagtcgaggc

SEQ ID NO: 141435 - DNA, 25 bp, Homo sapien
cgagcccagagggtttacttctgaa

SEQ ID NO: 141436 - DNA, 25 bp, Homo sapien
gaggatagggttcctttgagacatc

SEQ ID NO: 141437 - DNA, 25 bp, Homo sapien
agtctgtgtgtcctcgaagcccagc

SEQ ID NO: 141438 - DNA, 25 bp, Homo sapien
ctcgaagcccagcaggactaagttg

SEQ ID NO: 141439 - DNA, 25 bp, Homo sapien
cgggctttactgacagggaccaatc

SEQ ID NO: 141440 - DNA, 25 bp, Homo sapien
gtcaccagggcaaccggaacgccta

SEQ ID NO: 141441 - DNA, 25 bp, Homo sapien
cattcccgcagacggggacctggtt

SEQ ID NO: 141442 - DNA, 25 bp, Homo sapien
acaattatctgtacgcagcctgcga

SEQ ID NO: 141443 - DNA, 25 bp, Homo sapien
tgctgcgcacacacaattatctgta

SEQ ID NO: 141444 - DNA, 25 bp, Homo sapien
ggccctacggccagtgcaagctgct

SEQ ID NO: 141445 - DNA, 25 bp, Homo sapien
atgcgtggacgactgcgggccctac

SEQ ID NO: 141446 - DNA, 25 bp, Homo sapien
ccgaggtgcggatgcgcaccttcct

SEQ ID NO: 141447 - DNA, 25 bp, Homo sapien
ccaggtgactgcgagtttgtgcgca

SEQ ID NO: 141448 - DNA, 25 bp, Homo sapien
tacgcagcctgcgagtgcaaggccg

SEQ ID NO: 141449 - DNA, 25 bp, Homo sapien
cgctaccgattgaactctccttgta

SEQ ID NO: 141450 - DNA, 25 bp, Homo sapien
gaggtcttttacatcctcagttaaa

SEQ ID NO: 141451 - DNA, 25 bp, Homo sapien
tattggtttatagaaacactactta

SEQ ID NO: 141452 - DNA, 25 bp, Homo sapien
tcagctagtttgttattggtttata

SEQ ID NO: 141453 - DNA, 25 bp, Homo sapien
actctccttgtagaggtcttttaca

SEQ ID NO: 141454 - DNA, 25 bp, Homo sapien
ggcgtgactattgtaaataaaattg

SEQ ID NO: 141455 - DNA, 25 bp, Homo sapien
tttctaggtatttttggcgtgacta

SEQ ID NO: 141456 - DNA, 25 bp, Homo sapien
acatcctcagttaaatttatttcta

SEQ ID NO: 141457 - DNA, 25 bp, Homo sapien
tacttgttacttgacccgcacttgg

SEQ ID NO: 141458 - DNA, 25 bp, Homo sapien
tgcgggtgagtaacctccagagcaa

SEQ ID NO: 141459 - DNA, 25 bp, Homo sapien
ccgcacttggttcataacgaccttg

SEQ ID NO: 141460 - DNA, 25 bp, Homo sapien
ctaccgcggccctagttagttattg

SEQ ID NO: 141461 - DNA, 25 bp, Homo sapien
ggatttcggatacgcagccgcccta

SEQ ID NO: 141462 - DNA, 25 bp, Homo sapien
cgtcgcgaggtttagatgggatttc

SEQ ID NO: 141463 - DNA, 25 bp, Homo sapien
ttgcctctgctgcttgtcagaaaag

SEQ ID NO: 141464 - DNA, 25 bp, Homo sapien
tccagagcaacggttcgaagctgtc

SEQ ID NO: 141465 - DNA, 25 bp, Homo sapien
aggctccacgctaccggggtccagt

SEQ ID NO: 141466 - DNA, 25 bp, Homo sapien
agactccggagagaaactccggctc

SEQ ID NO: 141467 - DNA, 25 bp, Homo sapien
tccgtagcgtcttcttcagtgcgtg

SEQ ID NO: 141468 - DNA, 25 bp, Homo sapien
gcgtcttcttcagtgcgtgctgcga

SEQ ID NO: 141469 - DNA, 25 bp, Homo sapien
ttcagtgcgtgctgcgagtgctgaa

SEQ ID NO: 141470 - DNA, 25 bp, Homo sapien
aggggaagcactcggccgacgctgt

SEQ ID NO: 141471 - DNA, 25 bp, Homo sapien
ctgtcatcggcgtcattggcgggca

SEQ ID NO: 141472 - DNA, 25 bp, Homo sapien
tccagactccggagagaaactccgg

SEQ ID NO: 141473 - DNA, 25 bp, Homo sapien
ttccagacgcaggtaacgccaggca

SEQ ID NO: 141474 - DNA, 25 bp, Homo sapien
tccgggaacccattccagacgcagg

SEQ ID NO: 141475 - DNA, 25 bp, Homo sapien
ttttgcctagcgctgctccgggaac

SEQ ID NO: 141476 - DNA, 25 bp, Homo sapien
agcgcctgcttttcttcccaagatc

SEQ ID NO: 141477 - DNA, 25 bp, Homo sapien
tcggcgcctaagaaaccgggtgctg

SEQ ID NO: 141478 - DNA, 25 bp, Homo sapien
tgcaaacggtggacctttcggcgcc

SEQ ID NO: 141479 - DNA, 25 bp, Homo sapien
ggtgtgtgcaaacggtggacctttc

SEQ ID NO: 141480 - DNA, 25 bp, Homo sapien
acgccaggcaacgttttccttctca

SEQ ID NO: 141481 - DNA, 25 bp, Homo sapien
gccctcagctgtcgctccttataag

SEQ ID NO: 141482 - DNA, 25 bp, Homo sapien
aagtgtgacaacagctctcgctgcg

SEQ ID NO: 141483 - DNA, 25 bp, Homo sapien
gcgtgtcctaggagaggagcatccc

SEQ ID NO: 141484 - DNA, 25 bp, Homo sapien
tcaggaggccagacttagagttgga

SEQ ID NO: 141485 - DNA, 25 bp, Homo sapien
gccaagttgggcttcccgaccctga

SEQ ID NO: 141486 - DNA, 25 bp, Homo sapien
aaggcgtggcttctgctttgtttca

SEQ ID NO: 141487 - DNA, 25 bp, Homo sapien
gctctcgctgcgaagcagtttgccc

SEQ ID NO: 141488 - DNA, 25 bp, Homo sapien
gactggcattagagggcgtgtccta

SEQ ID NO: 141489 - DNA, 25 bp, Homo sapien
taccgcgaaaccagaaccacgatga

SEQ ID NO: 141490 - DNA, 25 bp, Homo sapien
accacgatgaccacaagtttttatg

SEQ ID NO: 141491 - DNA, 25 bp, Homo sapien
tgcacgaacagcagttccacagacg

SEQ ID NO: 141492 - DNA, 25 bp, Homo sapien
cgccagccaggaatctgtccgagtc

SEQ ID NO: 141493 - DNA, 25 bp, Homo sapien
ctgccgtttgaattccagggtcgcg

SEQ ID NO: 141494 - DNA, 25 bp, Homo sapien
cgcgcctcttttccatcctggagag

SEQ ID NO: 141495 - DNA, 25 bp, Homo sapien
ttatgaagggagcagccacgaacgc

SEQ ID NO: 141496 - DNA, 25 bp, Homo sapien
gcccagaagagacgcgaggtagcca

SEQ ID NO: 141497 - DNA, 25 bp, Homo sapien
gtgactcgtgctccttgctgaatta

SEQ ID NO: 141498 - DNA, 25 bp, Homo sapien
ctggcccggtctttcagaaacctag

SEQ ID NO: 141499 - DNA, 25 bp, Homo sapien
ctggaaactcggtccacagtgggtc

SEQ ID NO: 141500 - DNA, 25 bp, Homo sapien
ggcgagaggacttgtctggaaactc

SEQ ID NO: 141501 - DNA, 25 bp, Homo sapien
gaacgacgaggccttcgccatcctg

SEQ ID NO: 141502 - DNA, 25 bp, Homo sapien
tgcggccttcttggcgcagcaagag

SEQ ID NO: 141503 - DNA, 25 bp, Homo sapien
tctcaccgttggtgtccgtgccgtt

SEQ ID NO: 141504 - DNA, 25 bp, Homo sapien
cctgttcggttctcagcatgtttga

SEQ ID NO: 141505 - DNA, 25 bp, Homo sapien
tcctcgcgtcttccctgacgcagtc

SEQ ID NO: 141506 - DNA, 25 bp, Homo sapien
tcccattgcttctcctcgcgtcttc

SEQ ID NO: 141507 - DNA, 25 bp, Homo sapien
ggcctgtccggatcccattgcttct

SEQ ID NO: 141508 - DNA, 25 bp, Homo sapien
tcactgtggcctgtccggatcccat

SEQ ID NO: 141509 - DNA, 25 bp, Homo sapien
cgatgtcactgtggcctgtccggat

SEQ ID NO: 141510 - DNA, 25 bp, Homo sapien
atcgatgtcactgtggcctgtccgg

SEQ ID NO: 141511 - DNA, 25 bp, Homo sapien
ctcatcgatgtcactgtggcctgtc

SEQ ID NO: 141512 - DNA, 25 bp, Homo sapien
cggactcatcgatgtcactgtggcc

SEQ ID NO: 141513 - DNA, 25 bp, Homo sapien
gtagacgactcgtcgctcgaccttg

SEQ ID NO: 141514 - DNA, 25 bp, Homo sapien
cagcggtccctgacgttaacccttg

SEQ ID NO: 141515 - DNA, 25 bp, Homo sapien
gccacccgagagagctcgcgtgatt

SEQ ID NO: 141516 - DNA, 25 bp, Homo sapien
cttcccggcggtattttgaggcgca

SEQ ID NO: 141517 - DNA, 25 bp, Homo sapien
gctgaccagcggaccatcttccatg

SEQ ID NO: 141518 - DNA, 25 bp, Homo sapien
aagcccgagtcttcccgctgggtag

SEQ ID NO: 141519 - DNA, 25 bp, Homo sapien
cttgcacccaaggagggatttcttg

SEQ ID NO: 141520 - DNA, 25 bp, Homo sapien
actatactgtcgtgtagcgcggcca

SEQ ID NO: 141521 - DNA, 25 bp, Homo sapien
tgacagagtcgcctaacgcctcgga

SEQ ID NO: 141522 - DNA, 25 bp, Homo sapien
gactcggaccagttccggcaacaga

SEQ ID NO: 141523 - DNA, 25 bp, Homo sapien
ctgcacgcccagagatgacagagtc

SEQ ID NO: 141524 - DNA, 25 bp, Homo sapien
gccgcgccaggaaacgacggctgca

SEQ ID NO: 141525 - DNA, 25 bp, Homo sapien
ggccgaggcaaaccttagcccaaga

SEQ ID NO: 141526 - DNA, 25 bp, Homo sapien
tcacctgcgtctcggcaaaaaggga

SEQ ID NO: 141527 - DNA, 25 bp, Homo sapien
gcgttctcctgggtgacatcatttc

SEQ ID NO: 141528 - DNA, 25 bp, Homo sapien
ggctccaacttaggcactgtcactg

SEQ ID NO: 141529 - DNA, 25 bp, Homo sapien
cggaactcggcccagatagctactg

SEQ ID NO: 141530 - DNA, 25 bp, Homo sapien
ggcccagatagctactgctcgcagc

SEQ ID NO: 141531 - DNA, 25 bp, Homo sapien
aggggtatcctcagtctccgccgct

SEQ ID NO: 141532 - DNA, 25 bp, Homo sapien
cggcgccgaggggtatcctcagtct

SEQ ID NO: 141533 - DNA, 25 bp, Homo sapien
gctccggggccggacaaagctgacc

SEQ ID NO: 141534 - DNA, 25 bp, Homo sapien
gaaaacgctttgtgagcgctcggcg

SEQ ID NO: 141535 - DNA, 25 bp, Homo sapien
ggacaaagctgacccggacaacgct

SEQ ID NO: 141536 - DNA, 25 bp, Homo sapien
gtgggaaaacgctttgtgagcgctc

SEQ ID NO: 141537 - DNA, 25 bp, Homo sapien
ccacaacccggcgatcgaaaagatt

SEQ ID NO: 141538 - DNA, 25 bp, Homo sapien
agatttgattcccttggcgggcgga

SEQ ID NO: 141539 - DNA, 25 bp, Homo sapien
acccggcgatcgaaaagattcttag

SEQ ID NO: 141540 - DNA, 25 bp, Homo sapien
aagattcttaggaacgccgtaccag

SEQ ID NO: 141541 - DNA, 25 bp, Homo sapien
ttaggaacgccgtaccagccgcgtc

SEQ ID NO: 141542 - DNA, 25 bp, Homo sapien
gtaccagccgcgtctctcaggacag

SEQ ID NO: 141543 - DNA, 25 bp, Homo sapien
ctgcccgccgcagtcgcagttgatg

SEQ ID NO: 141544 - DNA, 25 bp, Homo sapien
tttcacggctccacagcgaccgcga

SEQ ID NO: 141545 - DNA, 25 bp, Homo sapien
atagactgcgggatgttctccggga

SEQ ID NO: 141546 - DNA, 25 bp, Homo sapien
ccttaatagactgcgggatgttctc

SEQ ID NO: 141547 - DNA, 25 bp, Homo sapien
cgccttaatagactgcgggatgttc

SEQ ID NO: 141548 - DNA, 25 bp, Homo sapien
cgcggcggccgccttaatagactgc

SEQ ID NO: 141549 - DNA, 25 bp, Homo sapien
tgcacgcagagcctgcggcagctcg

SEQ ID NO: 141550 - DNA, 25 bp, Homo sapien
ctaatttatgcacgcagagcctgcg

SEQ ID NO: 141551 - DNA, 25 bp, Homo sapien
gccgcctcctaatttatgcacgcag

SEQ ID NO: 141552 - DNA, 25 bp, Homo sapien
tcctaatttatgcacgcagagcctg

SEQ ID NO: 141553 - DNA, 25 bp, Homo sapien
agacgccgacagtgcaaactcacca

SEQ ID NO: 141554 - DNA, 25 bp, Homo sapien
tcgtgctcgccaagtcacggcctga

SEQ ID NO: 141555 - DNA, 25 bp, Homo sapien
tccctgtcagcgtcggtgctgagta

SEQ ID NO: 141556 - DNA, 25 bp, Homo sapien
cacatttgtcacgtttggacgctga

SEQ ID NO: 141557 - DNA, 25 bp, Homo sapien
ccctggacgcttctgcacatttgtc

SEQ ID NO: 141558 - DNA, 25 bp, Homo sapien
cacggcctgaggaatcaaagcaaca

SEQ ID NO: 141559 - DNA, 25 bp, Homo sapien
gtgctgagtagctgccctgtccagc

SEQ ID NO: 141560 - DNA, 25 bp, Homo sapien
atcacagggtgagcatcttcgcggc

SEQ ID NO: 141561 - DNA, 25 bp, Homo sapien
aactcaattgttctcagcggggccc

SEQ ID NO: 141562 - DNA, 25 bp, Homo sapien
atcttgggatatgactcggtgcgcc

SEQ ID NO: 141563 - DNA, 25 bp, Homo sapien
gcttcctgccgccaatgtcaattaa

SEQ ID NO: 141564 - DNA, 25 bp, Homo sapien
tccacgtcgcgcaggaaatccaggt

SEQ ID NO: 141565 - DNA, 25 bp, Homo sapien
cgccggccgccgattagttttatct

SEQ ID NO: 141566 - DNA, 25 bp, Homo sapien
gttcggccgcagctgaattcatttc

SEQ ID NO: 141567 - DNA, 25 bp, Homo sapien
tggctttcttcaccggccacgagta

SEQ ID NO: 141568 - DNA, 25 bp, Homo sapien
agccttctctttgcgccacgttcgg

SEQ ID NO: 141569 - DNA, 25 bp, Homo sapien
actggtaacttgtcgtgcggagcga

SEQ ID NO: 141570 - DNA, 25 bp, Homo sapien
acgcctcgcctgaactagtcttctg

SEQ ID NO: 141571 - DNA, 25 bp, Homo sapien
agagccgctgcttcgcctcgtttct

SEQ ID NO: 141572 - DNA, 25 bp, Homo sapien
tcgccctcttgacgggcgccgaggt

SEQ ID NO: 141573 - DNA, 25 bp, Homo sapien
tgcgtgggcttctgagcattgaaca

SEQ ID NO: 141574 - DNA, 25 bp, Homo sapien
ttgaacaatggttctgcctcctctg

SEQ ID NO: 141575 - DNA, 25 bp, Homo sapien
cttcagagtcttccggcggccgcga

SEQ ID NO: 141576 - DNA, 25 bp, Homo sapien
cttcttcctcctttcggaaggactg

SEQ ID NO: 141577 - DNA, 25 bp, Homo sapien
acgtgatgcccaggatgccgctgat

SEQ ID NO: 141578 - DNA, 25 bp, Homo sapien
accttcgtctctcttgcgcttgttg

SEQ ID NO: 141579 - DNA, 25 bp, Homo sapien
cgtgttcacgaaaaggacagcgtgc

SEQ ID NO: 141580 - DNA, 25 bp, Homo sapien
gaccggctgtcaccgcacgtgaggc

SEQ ID NO: 141581 - DNA, 25 bp, Homo sapien
cgtcacggagccagtggacactgcg

SEQ ID NO: 141582 - DNA, 25 bp, Homo sapien
tcaccgaggacacctgcgtcacgga

SEQ ID NO: 141583 - DNA, 25 bp, Homo sapien
gccgaatccgtgctcaccgaggaca

SEQ ID NO: 141584 - DNA, 25 bp, Homo sapien
atgccgctgatggagtacgacgagc

SEQ ID NO: 141585 - DNA, 25 bp, Homo sapien
tcaccgtgagaggagcgctcatctc

SEQ ID NO: 141586 - DNA, 25 bp, Homo sapien
cagcaaacagaaaggaaacgcgatt

SEQ ID NO: 141587 - DNA, 25 bp, Homo sapien
tgaattggcaggatccctgcgggcc

SEQ ID NO: 141588 - DNA, 25 bp, Homo sapien
cgaggctgccgaagcctgtcacctt

SEQ ID NO: 141589 - DNA, 25 bp, Homo sapien
cgcgattcgttccacttggaatttc

SEQ ID NO: 141590 - DNA, 25 bp, Homo sapien
tgaaatctccgaatctaatccggcg

SEQ ID NO: 141591 - DNA, 25 bp, Homo sapien
aatccggcgttaactcaccgtgaga

SEQ ID NO: 141592 - DNA, 25 bp, Homo sapien
gctcatctcacaggaggctgtggta

SEQ ID NO: 141593 - DNA, 25 bp, Homo sapien
atgggtgcccttgtaacggagtcca

SEQ ID NO: 141594 - DNA, 25 bp, Homo sapien
gaacgggatgggtgcccttataaca

SEQ ID NO: 141595 - DNA, 25 bp, Homo sapien
atgggtgcccttgtaacagagtccg

SEQ ID NO: 141596 - DNA, 25 bp, Homo sapien
tgggtgcccttataacagagtccgg

SEQ ID NO: 141597 - DNA, 25 bp, Homo sapien
atgggtgcccttataacagagtccg

SEQ ID NO: 141598 - DNA, 25 bp, Homo sapien
tggctgcccttgtaacagagtccgg

SEQ ID NO: 141599 - DNA, 25 bp, Homo sapien
ggatgggtgcccttataacagagtc

SEQ ID NO: 141600 - DNA, 25 bp, Homo sapien
gatgggtgcccttgtaacagagtcc

SEQ ID NO: 141601 - DNA, 25 bp, Homo sapien
caatcggcccttgacttcactcagg

SEQ ID NO: 141602 - DNA, 25 bp, Homo sapien
tcggtctccgccagatcctttcttt

SEQ ID NO: 141603 - DNA, 25 bp, Homo sapien
ccctcgtgggtctgattccactgtc

SEQ ID NO: 141604 - DNA, 25 bp, Homo sapien
ggggtgtctacctcgtgccaaccaa

SEQ ID NO: 141605 - DNA, 25 bp, Homo sapien
agcgtgcagccctccaacactgaga

SEQ ID NO: 141606 - DNA, 25 bp, Homo sapien
gctgggctcagaaaacactgctgga

SEQ ID NO: 141607 - DNA, 25 bp, Homo sapien
ccgacgtctcggacgaagttgcaaa

SEQ ID NO: 141608 - DNA, 25 bp, Homo sapien
gcaaagaacttcctctccggcagcg

SEQ ID NO: 141609 - DNA, 25 bp, Homo sapien
gtcttacctgtgcacccagagcagc

SEQ ID NO: 141610 - DNA, 25 bp, Homo sapien
ttcccgcaactctcggcgttcttgg

SEQ ID NO: 141611 - DNA, 25 bp, Homo sapien
tccctctggataggggtgattcatc

SEQ ID NO: 141612 - DNA, 25 bp, Homo sapien
tacccgtgaggcttgcatagaatcc

SEQ ID NO: 141613 - DNA, 25 bp, Homo sapien
atatgcccgcacacgcaggttttcc

SEQ ID NO: 141614 - DNA, 25 bp, Homo sapien
tgctgccaaatcgaagaactcggct

SEQ ID NO: 141615 - DNA, 25 bp, Homo sapien
ggtgattcatcaccgcccgagcggg

SEQ ID NO: 141616 - DNA, 25 bp, Homo sapien
agtagcgccgattctccctttcaca

SEQ ID NO: 141617 - DNA, 25 bp, Homo sapien
agcgactcgccacccggaaatactt

SEQ ID NO: 141618 - DNA, 25 bp, Homo sapien
acgtggtaccgcatcttcggcaggc

SEQ ID NO: 141619 - DNA, 25 bp, Homo sapien
gggcccagttcttcgaaagcctgtg

SEQ ID NO: 141620 - DNA, 25 bp, Homo sapien
ccaaggtcgggctctttaactcagc

SEQ ID NO: 141621 - DNA, 25 bp, Homo sapien
caaaaagtgcacatcgcgggccagc

SEQ ID NO: 141622 - DNA, 25 bp, Homo sapien
gcgagttggtcccttgcggtataaa

SEQ ID NO: 141623 - DNA, 25 bp, Homo sapien
gaaatacttgggttgcgctagaata

SEQ ID NO: 141624 - DNA, 25 bp, Homo sapien
gcctcagggaacgactctggcactg

SEQ ID NO: 141625 - DNA, 25 bp, Homo sapien
ccgggcagagcagaacatctcagta

SEQ ID NO: 141626 - DNA, 25 bp, Homo sapien
cgtccgaaggcaccgtgaaatgatt

SEQ ID NO: 141627 - DNA, 25 bp, Homo sapien
gagcttctcgccatgtgagatcatg

SEQ ID NO: 141628 - DNA, 25 bp, Homo sapien
agatcatgtcctgttctcgccaaca

SEQ ID NO: 141629 - DNA, 25 bp, Homo sapien
tccagccgcaccttctattaagaca

SEQ ID NO: 141630 - DNA, 25 bp, Homo sapien
ggcctgtgacatctccatgtgcaaa

SEQ ID NO: 141631 - DNA, 25 bp, Homo sapien
aaatccgggcttccgctttggagca

SEQ ID NO: 141632 - DNA, 25 bp, Homo sapien
gaagaaattaactgctcggccaagc

SEQ ID NO: 141633 - DNA, 25 bp, Homo sapien
tgtccgcgcctggagatcaaaagcc

SEQ ID NO: 141634 - DNA, 25 bp, Homo sapien
tccgcggtgtttagatgtgttttga

SEQ ID NO: 141635 - DNA, 25 bp, Homo sapien
aagccctcccggaattgacatttca

SEQ ID NO: 141636 - DNA, 25 bp, Homo sapien
tgtgtgtcgtttgtaaggcttttcc

SEQ ID NO: 141637 - DNA, 25 bp, Homo sapien
attaggccaagcatcacgaatcgta

SEQ ID NO: 141638 - DNA, 25 bp, Homo sapien
acgaatcgtaggttcgccgtgctcc

SEQ ID NO: 141639 - DNA, 25 bp, Homo sapien
cgctggtcgtcaaaacctcgcgggc

SEQ ID NO: 141640 - DNA, 25 bp, Homo sapien
tttgctctgtaagtcctggtctttg

SEQ ID NO: 141641 - DNA, 25 bp, Homo sapien
gcacttagtacgcatgcgcatacca

SEQ ID NO: 141642 - DNA, 25 bp, Homo sapien
caagggctaaggtcgtgattctagg

SEQ ID NO: 141643 - DNA, 25 bp, Homo sapien
tctcgccagccgagctgtggaacta

SEQ ID NO: 141644 - DNA, 25 bp, Homo sapien
tttggtccctgtttggtgctttctg

SEQ ID NO: 141645 - DNA, 25 bp, Homo sapien
ggcagagaaaggttcgcacttagta

SEQ ID NO: 141646 - DNA, 25 bp, Homo sapien
gggcaaagcatggaaggcaaatcta

SEQ ID NO: 141647 - DNA, 25 bp, Homo sapien
tgcccgataaatagcatctcttttg

SEQ ID NO: 141648 - DNA, 25 bp, Homo sapien
ctttctgtttgcagctacggcagtg

SEQ ID NO: 141649 - DNA, 25 bp, Homo sapien
tcatgcacgcgatcagctaggctcc

SEQ ID NO: 141650 - DNA, 25 bp, Homo sapien
tcccgcgccacgtggcactgagaag

SEQ ID NO: 141651 - DNA, 25 bp, Homo sapien
actgagaaggcgtccaccgagcgcc

SEQ ID NO: 141652 - DNA, 25 bp, Homo sapien
tgcagcctaggtagcttcaagagaa

SEQ ID NO: 141653 - DNA, 25 bp, Homo sapien
gaacggttcgcacccactacgcatg

SEQ ID NO: 141654 - DNA, 25 bp, Homo sapien
cccggtaaatagcatctccttcgta

SEQ ID NO: 141655 - DNA, 25 bp, Homo sapien
gcttcctgttcgcagctgcggcagt

SEQ ID NO: 141656 - DNA, 25 bp, Homo sapien
agggctaatgccgtgattctagagc

SEQ ID NO: 141657 - DNA, 25 bp, Homo sapien
aggtgttcgtcacccgcaggatacc

SEQ ID NO: 141658 - DNA, 25 bp, Homo sapien
gcgactcatgaaggtgttcgtcacc

SEQ ID NO: 141659 - DNA, 25 bp, Homo sapien
accggtgcgactcatgaaggtgttc

SEQ ID NO: 141660 - DNA, 25 bp, Homo sapien
cactgcggatgagaccggtgcgact

SEQ ID NO: 141661 - DNA, 25 bp, Homo sapien
cttctgtactgccaggtccgggtcg

SEQ ID NO: 141662 - DNA, 25 bp, Homo sapien
cgggccagcttctgtactgccaggt

SEQ ID NO: 141663 - DNA, 25 bp, Homo sapien
accgctcagccgcaacccggcgctc

SEQ ID NO: 141664 - DNA, 25 bp, Homo sapien
cggcagagtaagagcctcgcgcgcc

SEQ ID NO: 141665 - DNA, 25 bp, Homo sapien
gcggctgttcgctgcaaccaatcaa

SEQ ID NO: 141666 - DNA, 25 bp, Homo sapien
ctggagattgagttcccacttcata

SEQ ID NO: 141667 - DNA, 25 bp, Homo sapien
ggctagcgggctttccgcctaaatc

SEQ ID NO: 141668 - DNA, 25 bp, Homo sapien
ctaccgactgaatccgtgagctctc

SEQ ID NO: 141669 - DNA, 25 bp, Homo sapien
ccctgaagtctggttgtgtttacta

SEQ ID NO: 141670 - DNA, 25 bp, Homo sapien
ttcgccgcagcactctgagaacacg

SEQ ID NO: 141671 - DNA, 25 bp, Homo sapien
gggtgaattcccttcgctgaacaca

SEQ ID NO: 141672 - DNA, 25 bp, Homo sapien
accgccattggctggttctgaagga

SEQ ID NO: 141673 - DNA, 25 bp, Homo sapien
agccaatcaggtgctgcgcctcggc

SEQ ID NO: 141674 - DNA, 25 bp, Homo sapien
cagtcaagcgggtgtgtggcacctt

SEQ ID NO: 141675 - DNA, 25 bp, Homo sapien
accttgtgggcggagaccacgcctc

SEQ ID NO: 141676 - DNA, 25 bp, Homo sapien
cgtgtttaaaagtgcgcttgtggct

SEQ ID NO: 141677 - DNA, 25 bp, Homo sapien
ggctgctgctgtcttaactcctgtg

SEQ ID NO: 141678 - DNA, 25 bp, Homo sapien
aactcctgtgcttggcggacagaca

SEQ ID NO: 141679 - DNA, 25 bp, Homo sapien
cgcgagcgctgagccaatcaggtgc

SEQ ID NO: 141680 - DNA, 25 bp, Homo sapien
tgggctcccgcgtgtttaaaagtgc

SEQ ID NO: 141681 - DNA, 25 bp, Homo sapien
cttcagctgctgctcgagtgcttca

SEQ ID NO: 141682 - DNA, 25 bp, Homo sapien
aatttctacctgtccggggtgctgc

SEQ ID NO: 141683 - DNA, 25 bp, Homo sapien
tgcggctcaagtacacgccacgctg

SEQ ID NO: 141684 - DNA, 25 bp, Homo sapien
gccgcctctggaacctcatggagaa

SEQ ID NO: 141685 - DNA, 25 bp, Homo sapien
agcaccttcgtgctcgtctccgtgg

SEQ ID NO: 141686 - DNA, 25 bp, Homo sapien
cgctcaacaccgtggaggagatgca

SEQ ID NO: 141687 - DNA, 25 bp, Homo sapien
catgggcttcttcacgctcgagtac

SEQ ID NO: 141688 - DNA, 25 bp, Homo sapien
cggccgtcttccagctggtctacaa

SEQ ID NO: 141689 - DNA, 25 bp, Homo sapien
cgggagggtaaaccaaggcatagct

SEQ ID NO: 141690 - DNA, 25 bp, Homo sapien
accaaggcatagctctccgtcggcg

SEQ ID NO: 141691 - DNA, 25 bp, Homo sapien
atagctctccgtcggcgcgcctgag

SEQ ID NO: 141692 - DNA, 25 bp, Homo sapien
ggtacgcctcatggtcctgccagac

SEQ ID NO: 141693 - DNA, 25 bp, Homo sapien
catgctccgcgtccggtagttttac

SEQ ID NO: 141694 - DNA, 25 bp, Homo sapien
tcagcctcggccaggactgagcggc

SEQ ID NO: 141695 - DNA, 25 bp, Homo sapien
ggagatacatgctccgcgtccggta

SEQ ID NO: 141696 - DNA, 25 bp, Homo sapien
cgccgccgtcatgtgacgcgcaagg

SEQ ID NO: 141697 - DNA, 25 bp, Homo sapien
ggtcatctcaactctgcgcgcattt

SEQ ID NO: 141698 - DNA, 25 bp, Homo sapien
aggaaaactagaagccagcccgctc

SEQ ID NO: 141699 - DNA, 25 bp, Homo sapien
cttctcagtgagatttccttggtga

SEQ ID NO: 141700 - DNA, 25 bp, Homo sapien
tgctccgtctcctgtggaggcttta

SEQ ID NO: 141701 - DNA, 25 bp, Homo sapien
ctgagaccacgaggacgcaaggcca

SEQ ID NO: 141702 - DNA, 25 bp, Homo sapien
ttccgctactcgctggtcatctcaa

SEQ ID NO: 141703 - DNA, 25 bp, Homo sapien
caataaggtttttgtgagcaggccc

SEQ ID NO: 141704 - DNA, 25 bp, Homo sapien
tgcgcaggcgtcacccaataaggtt

SEQ ID NO: 141705 - DNA, 25 bp, Homo sapien
gctttcgccttaaaaatttgtctgc

SEQ ID NO: 141706 - DNA, 25 bp, Homo sapien
tccaggcgaacaagagaccgtctca

SEQ ID NO: 141707 - DNA, 25 bp, Homo sapien
gcacatcctggagacccggagcgca

SEQ ID NO: 141708 - DNA, 25 bp, Homo sapien
accctttcggagtgacagctgtgag

SEQ ID NO: 141709 - DNA, 25 bp, Homo sapien
tcctgagttgctctccggagtccaa

SEQ ID NO: 141710 - DNA, 25 bp, Homo sapien
ccgcaaggaccgcatccggaacgga

SEQ ID NO: 141711 - DNA, 25 bp, Homo sapien
catccggaacggaacggaggcgatc

SEQ ID NO: 141712 - DNA, 25 bp, Homo sapien
ctgtttacccgagcgaagagtggcc

SEQ ID NO: 141713 - DNA, 25 bp, Homo sapien
atgcctgcacgggacaatccacgtc

SEQ ID NO: 141714 - DNA, 25 bp, Homo sapien
gttccgtatggaggagatcacatcc

SEQ ID NO: 141715 - DNA, 25 bp, Homo sapien
tgccacactcgacgatggatgcctg

SEQ ID NO: 141716 - DNA, 25 bp, Homo sapien
tcacagcccgggagacactcactga

SEQ ID NO: 141717 - DNA, 25 bp, Homo sapien
agggccacgtagatgagaaagttcc

SEQ ID NO: 141718 - DNA, 25 bp, Homo sapien
ccgctaccgttcagctcagttcgaa

SEQ ID NO: 141719 - DNA, 25 bp, Homo sapien
gtgcacttcagtgcccggaccctga

SEQ ID NO: 141720 - DNA, 25 bp, Homo sapien
gaggccctcaatccggaacatcgcg

SEQ ID NO: 141721 - DNA, 25 bp, Homo sapien
tagtgagtggaaacagcggcaacgc

SEQ ID NO: 141722 - DNA, 25 bp, Homo sapien
tcctggcaccgcaaagttttgggga

SEQ ID NO: 141723 - DNA, 25 bp, Homo sapien
gcgtccgtgggctagctcaggacct

SEQ ID NO: 141724 - DNA, 25 bp, Homo sapien
aggacctgccatcgtgaactgtttg

SEQ ID NO: 141725 - DNA, 25 bp, Homo sapien
actgtttgcacagtagcgatgtgtg

SEQ ID NO: 141726 - DNA, 25 bp, Homo sapien
gcgatgtgtgcttaagtttccgaga

SEQ ID NO: 141727 - DNA, 25 bp, Homo sapien
ttccgagatctgcatggtgtagtga

SEQ ID NO: 141728 - DNA, 25 bp, Homo sapien
agcgtcagcccgctaggtccttgtc

SEQ ID NO: 141729 - DNA, 25 bp, Homo sapien
cgcagctccctaccgccagggctgg

SEQ ID NO: 141730 - DNA, 25 bp, Homo sapien
ccctgcaggtgaaaaactacaattt

SEQ ID NO: 141731 - DNA, 25 bp, Homo sapien
cccacgagcaccctgcaggtgaaaa

SEQ ID NO: 141732 - DNA, 25 bp, Homo sapien
ctacaatttccagaatgccattcgg

SEQ ID NO: 141733 - DNA, 25 bp, Homo sapien
gtctgtcctgggacgtccgcctccc

SEQ ID NO: 141734 - DNA, 25 bp, Homo sapien
ccattcggagcggagttacgaagcg

SEQ ID NO: 141735 - DNA, 25 bp, Homo sapien
atcaggtacgctgtccgctggttaa

SEQ ID NO: 141736 - DNA, 25 bp, Homo sapien
cagaatgccattcggagcggagtta

SEQ ID NO: 141737 - DNA, 25 bp, Homo sapien
gcattcaggctcaacggtcgctcca

SEQ ID NO: 141738 - DNA, 25 bp, Homo sapien
gggagcaccacctgacctagtactg

SEQ ID NO: 141739 - DNA, 25 bp, Homo sapien
attcagccgcgacagacgcaggttc

SEQ ID NO: 141740 - DNA, 25 bp, Homo sapien
cagtttatgaagcttgatggccgtc

SEQ ID NO: 141741 - DNA, 25 bp, Homo sapien
gtcagctcacgggtccctgtccaag

SEQ ID NO: 141742 - DNA, 25 bp, Homo sapien
accgcgcagcttggtccatcgaaaa

SEQ ID NO: 141743 - DNA, 25 bp, Homo sapien
cgcgagcacgctctagcattcaggc

SEQ ID NO: 141744 - DNA, 25 bp, Homo sapien
ccgttggattcggaccagtttatga

SEQ ID NO: 141745 - DNA, 25 bp, Homo sapien
tgccaatcgcgaggtggattacgcc

SEQ ID NO: 141746 - DNA, 25 bp, Homo sapien
ggattacgcccgttctcttcagagg

SEQ ID NO: 141747 - DNA, 25 bp, Homo sapien
cttgcgccctgtcgagagtgagcac

SEQ ID NO: 141748 - DNA, 25 bp, Homo sapien
cttcagaggcttactggtttcgagc

SEQ ID NO: 141749 - DNA, 25 bp, Homo sapien
gcaaccgaggaggtgtttcgccacc

SEQ ID NO: 141750 - DNA, 25 bp, Homo sapien
agcgcgtgcctcctctcctggttat

SEQ ID NO: 141751 - DNA, 25 bp, Homo sapien
gtgcgtgtgtttccttgccaatcgc

SEQ ID NO: 141752 - DNA, 25 bp, Homo sapien
acgagtgtctcgaacccggcttcaa

SEQ ID NO: 141753 - DNA, 25 bp, Homo sapien
cgttgatcatgtttccctttgggcc

SEQ ID NO: 141754 - DNA, 25 bp, Homo sapien
ccaaacccggcggtgtctcagcttt

SEQ ID NO: 141755 - DNA, 25 bp, Homo sapien
gatgctcagtcgctcacacaggtaa

SEQ ID NO: 141756 - DNA, 25 bp, Homo sapien
ccggcgcgggacaattttcgcacca

SEQ ID NO: 141757 - DNA, 25 bp, Homo sapien
ttcgcaccatgactagcctctacgg

SEQ ID NO: 141758 - DNA, 25 bp, Homo sapien
ggcgccgtcttcaacctcgagtact

SEQ ID NO: 141759 - DNA, 25 bp, Homo sapien
gcctcctggcactttctgaagcgca

SEQ ID NO: 141760 - DNA, 25 bp, Homo sapien
tcgccactacatcccggggctgatg

SEQ ID NO: 141761 - DNA, 25 bp, Homo sapien
tagccaccatgcttcacccttgatg

SEQ ID NO: 141762 - DNA, 25 bp, Homo sapien
acccttgatgccgtacggtggcctc

SEQ ID NO: 141763 - DNA, 25 bp, Homo sapien
cgtgccagaaacagccaacgcgttc

SEQ ID NO: 141764 - DNA, 25 bp, Homo sapien
aacgcgttctctagcgcgctgcctg

SEQ ID NO: 141765 - DNA, 25 bp, Homo sapien
cgcccgaatgaagggacagcgcctt

SEQ ID NO: 141766 - DNA, 25 bp, Homo sapien
ctcatgcgaagaaagcccggtgctt

SEQ ID NO: 141767 - DNA, 25 bp, Homo sapien
gatgtcgccagcctacttctcctgg

SEQ ID NO: 141768 - DNA, 25 bp, Homo sapien
gcacacctgtcaggatgcgggctcc

SEQ ID NO: 141769 - DNA, 25 bp, Homo sapien
gccgcagtagtccaggcggcacatg

SEQ ID NO: 141770 - DNA, 25 bp, Homo sapien
tgccgcgggaacttctcggcgtcct

SEQ ID NO: 141771 - DNA, 25 bp, Homo sapien
agcgccgcccaagctaggaatctcg

SEQ ID NO: 141772 - DNA, 25 bp, Homo sapien
gccaagttcaagttcttgccgccgc

SEQ ID NO: 141773 - DNA, 25 bp, Homo sapien
tacttgtttagccacttggccatgg

SEQ ID NO: 141774 - DNA, 25 bp, Homo sapien
tgcccaagctgaagtacttgtttag

SEQ ID NO: 141775 - DNA, 25 bp, Homo sapien
ggtcctcgaagtctcgctccttctg

SEQ ID NO: 141776 - DNA, 25 bp, Homo sapien
cgcagtttgcgcagcgacgagccag

SEQ ID NO: 141777 - DNA, 25 bp, Homo sapien
ggctttagccctgttcgctgccagc

SEQ ID NO: 141778 - DNA, 25 bp, Homo sapien
ctgaggaagtcgaggctttagccct

SEQ ID NO: 141779 - DNA, 25 bp, Homo sapien
tgtttgcttaccttttcacctctga

SEQ ID NO: 141780 - DNA, 25 bp, Homo sapien
gtcggaatgtttgcttaccttttca

SEQ ID NO: 141781 - DNA, 25 bp, Homo sapien
attagcagtccagatgacggatgtg

SEQ ID NO: 141782 - DNA, 25 bp, Homo sapien
tgagtgtattagcagtccagatgac

SEQ ID NO: 141783 - DNA, 25 bp, Homo sapien
gcgccaggtcttcggaggaatcttt

SEQ ID NO: 141784 - DNA, 25 bp, Homo sapien
cggaggaatctttatgctaatgagt

SEQ ID NO: 141785 - DNA, 25 bp, Homo sapien
cgcgacaacggccacgggaaatgac

SEQ ID NO: 141786 - DNA, 25 bp, Homo sapien
tcaccgcacacgtgggaccgagaca

SEQ ID NO: 141787 - DNA, 25 bp, Homo sapien
cgcgaggattttggcccttgcaaga

SEQ ID NO: 141788 - DNA, 25 bp, Homo sapien
ccgctgctgttatgcctcctcttga

SEQ ID NO: 141789 - DNA, 25 bp, Homo sapien
cggaatttctattggtccgctgctg

SEQ ID NO: 141790 - DNA, 25 bp, Homo sapien
aagaggtggagcttcccagagaata

SEQ ID NO: 141791 - DNA, 25 bp, Homo sapien
cccttgcaagaatccgtcgggcgga

SEQ ID NO: 141792 - DNA, 25 bp, Homo sapien
accgagacagctcgcgcagcggatc

SEQ ID NO: 141793 - DNA, 25 bp, Homo sapien
cgggagagcatctccgcggcagctt

SEQ ID NO: 141794 - DNA, 25 bp, Homo sapien
gagagcatctccgcggcagcttgca

SEQ ID NO: 141795 - DNA, 25 bp, Homo sapien
ggcagcttgcagggcccgctgtctc

SEQ ID NO: 141796 - DNA, 25 bp, Homo sapien
ggcgtacgcgcgtctctcgaagccg

SEQ ID NO: 141797 - DNA, 25 bp, Homo sapien
tacgcgcgtctctcgaagccgggac

SEQ ID NO: 141798 - DNA, 25 bp, Homo sapien
cggggaggctgcactggctggaaac

SEQ ID NO: 141799 - DNA, 25 bp, Homo sapien
gctggaaacagcgcctgggcgctcc

SEQ ID NO: 141800 - DNA, 25 bp, Homo sapien
cgcggctcccacctcagagatgtcc

SEQ ID NO: 141801 - DNA, 25 bp, Homo sapien
tttgatgaaattggactactgtatg

SEQ ID NO: 141802 - DNA, 25 bp, Homo sapien
gaagaagggtttgtaatgctgaaaa

SEQ ID NO: 141803 - DNA, 25 bp, Homo sapien
gaagggtttgtaatgctgaaaaata

SEQ ID NO: 141804 - DNA, 25 bp, Homo sapien
gaaaatttacaatggagaggaggtc

SEQ ID NO: 141805 - DNA, 25 bp, Homo sapien
aattggactactgtatgtgaaaatt

SEQ ID NO: 141806 - DNA, 25 bp, Homo sapien
gatgaaattggactactgtatgtga

SEQ ID NO: 141807 - DNA, 25 bp, Homo sapien
atgacatataatttgaagaattttg

SEQ ID NO: 141808 - DNA, 25 bp, Homo sapien
gtctttcattcttctaaatgacata

SEQ ID NO: 141809 - DNA, 25 bp, Homo sapien
ctgcaggtaactaacgctggtctcc

SEQ ID NO: 141810 - DNA, 25 bp, Homo sapien
cagttcccgcggatagagaaggtcc

SEQ ID NO: 141811 - DNA, 25 bp, Homo sapien
ttggacaagcccaaaggttgcgccc

SEQ ID NO: 141812 - DNA, 25 bp, Homo sapien
ccatagcccagaggcttggacaagc

SEQ ID NO: 141813 - DNA, 25 bp, Homo sapien
ttaccacgttagctcgacctcaaca

SEQ ID NO: 141814 - DNA, 25 bp, Homo sapien
tccgccgttgcactgtaggactctc

SEQ ID NO: 141815 - DNA, 25 bp, Homo sapien
ccggaaccagaacccaagcgtgatc

SEQ ID NO: 141816 - DNA, 25 bp, Homo sapien
aagcgtgatcctgaaccggagcccg

SEQ ID NO: 141817 - DNA, 25 bp, Homo sapien
tcgcggatcccaaggctcggggaca

SEQ ID NO: 141818 - DNA, 25 bp, Homo sapien
acaagcgcggcatggcttgctccgg

SEQ ID NO: 141819 - DNA, 25 bp, Homo sapien
ctggccggcacggaccacacttggg

SEQ ID NO: 141820 - DNA, 25 bp, Homo sapien
agccgcactcgtcgagcgccgagat

SEQ ID NO: 141821 - DNA, 25 bp, Homo sapien
tcgcgcataccaggccggggccaca

SEQ ID NO: 141822 - DNA, 25 bp, Homo sapien
acgagcgaccgtcggagccgcagac

SEQ ID NO: 141823 - DNA, 25 bp, Homo sapien
tgactcaccgaactcgcaagggccg

SEQ ID NO: 141824 - DNA, 25 bp, Homo sapien
caagagcagagacaagcgcggcatg

SEQ ID NO: 141825 - DNA, 25 bp, Homo sapien
ctaggcacggaggagacctgccgga

SEQ ID NO: 141826 - DNA, 25 bp, Homo sapien
cccttgccagcgggctaggcacgga

SEQ ID NO: 141827 - DNA, 25 bp, Homo sapien
aggtggcccgcagtgctaagaagat

SEQ ID NO: 141828 - DNA, 25 bp, Homo sapien
ctaagaagatggacgagatagtgca

SEQ ID NO: 141829 - DNA, 25 bp, Homo sapien
atagtgcaggagaagaacacggccg

SEQ ID NO: 141830 - DNA, 25 bp, Homo sapien
cccgcagtgctaagaagatggacga

SEQ ID NO: 141831 - DNA, 25 bp, Homo sapien
tctaggcggaggcctaggcccagcc

SEQ ID NO: 141832 - DNA, 25 bp, Homo sapien
gacgagatagtgcaggagaagaaca

SEQ ID NO: 141833 - DNA, 25 bp, Homo sapien
gctcgcccagatcagtgcgccactg

SEQ ID NO: 141834 - DNA, 25 bp, Homo sapien
gccgactcggatccagcccgtcccg

SEQ ID NO: 141835 - DNA, 25 bp, Homo sapien
cgggcaccctcacagagatcaacag

SEQ ID NO: 141836 - DNA, 25 bp, Homo sapien
ccagctcgcggagcatttcgggctc

SEQ ID NO: 141837 - DNA, 25 bp, Homo sapien
tcgcggagcatttcgggctcgccca

SEQ ID NO: 141838 - DNA, 25 bp, Homo sapien
gagcatttcgggctcgcccagatca

SEQ ID NO: 141839 - DNA, 25 bp, Homo sapien
gcatttcgggctcgcccagatcagt

SEQ ID NO: 141840 - DNA, 25 bp, Homo sapien
ttcgggctcgcccagatcagtgcgc

SEQ ID NO: 141841 - DNA, 25 bp, Homo sapien
gtggtgggtgctctatatggcggcg

SEQ ID NO: 141842 - DNA, 25 bp, Homo sapien
ccctcgcttcttgcgcccgccaagc

SEQ ID NO: 141843 - DNA, 25 bp, Homo sapien
ctccctcgcttcttgcgcccgccaa

SEQ ID NO: 141844 - DNA, 25 bp, Homo sapien
gcggaggcgcttctctgagcatgac

SEQ ID NO: 141845 - DNA, 25 bp, Homo sapien
ggaggcgcttctctgagcatgacgc

SEQ ID NO: 141846 - DNA, 25 bp, Homo sapien
gaggcgcttctctgagcatgacgcg

SEQ ID NO: 141847 - DNA, 25 bp, Homo sapien
agaggtggtgggtgctctatatggc

SEQ ID NO: 141848 - DNA, 25 bp, Homo sapien
ccaagcgaaggccagtggccgcagc

SEQ ID NO: 141849 - DNA, 25 bp, Homo sapien
gcagccactgctacacctagcgggt

SEQ ID NO: 141850 - DNA, 25 bp, Homo sapien
gccaggctgggagcgccagccatct

SEQ ID NO: 141851 - DNA, 25 bp, Homo sapien
tgggcacttggcagtcactccggat

SEQ ID NO: 141852 - DNA, 25 bp, Homo sapien
cggctcctcgtctgctgaagctcgg

SEQ ID NO: 141853 - DNA, 25 bp, Homo sapien
actgctacacctagcgggtcgggcg

SEQ ID NO: 141854 - DNA, 25 bp, Homo sapien
ctgcacaaagtcaactcagacagga

SEQ ID NO: 141855 - DNA, 25 bp, Homo sapien
ctgctcggctcctcgtctgctgaag

SEQ ID NO: 141856 - DNA, 25 bp, Homo sapien
cccgctgcagggcagaccacctagc

SEQ ID NO: 141857 - DNA, 25 bp, Homo sapien
tgaactaagagccacgggagggacc

SEQ ID NO: 141858 - DNA, 25 bp, Homo sapien
ttggacctgtgtaacaatgtactga

SEQ ID NO: 141859 - DNA, 25 bp, Homo sapien
aacgggcaaaggagaggcatcactg

SEQ ID NO: 141860 - DNA, 25 bp, Homo sapien
gcccgctgcgtacgcgaaggacaca

SEQ ID NO: 141861 - DNA, 25 bp, Homo sapien
cttgaatgctctttggtccaaccaa

SEQ ID NO: 141862 - DNA, 25 bp, Homo sapien
catatgaacgcgctgaacgtctctc

SEQ ID NO: 141863 - DNA, 25 bp, Homo sapien
tctgctgagcagaaacgggcaaagg

SEQ ID NO: 141864 - DNA, 25 bp, Homo sapien
gtcaggaaggcgctcttgaatgctc

SEQ ID NO: 141865 - DNA, 25 bp, Homo sapien
gtggagaacgccaggctttatcact

SEQ ID NO: 141866 - DNA, 25 bp, Homo sapien
aacgcgagtcaagaagcgagcggga

SEQ ID NO: 141867 - DNA, 25 bp, Homo sapien
cgtcccggacactaggcgcgggagg

SEQ ID NO: 141868 - DNA, 25 bp, Homo sapien
gttcaggcgcgtcccggacactagg

SEQ ID NO: 141869 - DNA, 25 bp, Homo sapien
aggttcaggcgcgtcccggacacta

SEQ ID NO: 141870 - DNA, 25 bp, Homo sapien
cccagctgcgtctccgaggtcggcc

SEQ ID NO: 141871 - DNA, 25 bp, Homo sapien
agtctctagctctcttcctcacgca

SEQ ID NO: 141872 - DNA, 25 bp, Homo sapien
tgtccagtctctagctctcttcctc

SEQ ID NO: 141873 - DNA, 25 bp, Homo sapien
ctggctgagcacagtcgaccttgtc

SEQ ID NO: 141874 - DNA, 25 bp, Homo sapien
gagggtccatgctcagcgtctgaac

SEQ ID NO: 141875 - DNA, 25 bp, Homo sapien
ctgaacgttacattggcatctgggg

SEQ ID NO: 141876 - DNA, 25 bp, Homo sapien
tgaactccgagaacgaacctggctg

SEQ ID NO: 141877 - DNA, 25 bp, Homo sapien
ggtgcgttacgtagatgactcgtta

SEQ ID NO: 141878 - DNA, 25 bp, Homo sapien
gctctagtggctaactcagtgcgtc

SEQ ID NO: 141879 - DNA, 25 bp, Homo sapien
ctcagtgcgtccatgaaggctgtgc

SEQ ID NO: 141880 - DNA, 25 bp, Homo sapien
ctccatgtgtggtcacgtgaactcc

SEQ ID NO: 141881 - DNA, 25 bp, Homo sapien
acttcgaggacctgcccagtggcat

SEQ ID NO: 141882 - DNA, 25 bp, Homo sapien
gagcggcacccacttcgaggacctg

SEQ ID NO: 141883 - DNA, 25 bp, Homo sapien
gacctgcccagtggcatgaccactg

SEQ ID NO: 141884 - DNA, 25 bp, Homo sapien
aagttcctgcgcctcaggaagaggc

SEQ ID NO: 141885 - DNA, 25 bp, Homo sapien
cccacattaaggtgaccgctaagcc

SEQ ID NO: 141886 - DNA, 25 bp, Homo sapien
ccgctaagccagacaatcctgatgg

SEQ ID NO: 141887 - DNA, 25 bp, Homo sapien
cgtgcctgccatctgctcctggaga

SEQ ID NO: 141888 - DNA, 25 bp, Homo sapien
gcaagaagtgggagcggcacccact

SEQ ID NO: 141889 - DNA, 25 bp, Homo sapien
gctgttcacccaacgcaggggctgc

SEQ ID NO: 141890 - DNA, 25 bp, Homo sapien
gtccagtctctagctctcttcctca

SEQ ID NO: 141891 - DNA, 25 bp, Homo sapien
aggttcaggcgcgtcccggacacta

SEQ ID NO: 141892 - DNA, 25 bp, Homo sapien
gtggagaacgccaggctttatcact

SEQ ID NO: 141893 - DNA, 25 bp, Homo sapien
ctgtcctgtttgagttcaaataggg

SEQ ID NO: 141894 - DNA, 25 bp, Homo sapien
gggaagatggggcagaaataactct

SEQ ID NO: 141895 - DNA, 25 bp, Homo sapien
cagaaataactctgcggcgtgtact

SEQ ID NO: 141896 - DNA, 25 bp, Homo sapien
tcaaatagggaagatggggcagaaa

SEQ ID NO: 141897 - DNA, 25 bp, Homo sapien
cctgtcacctttcacggccctccgg

SEQ ID NO: 141898 - DNA, 25 bp, Homo sapien
taataaccctgtcacctttcacggc

SEQ ID NO: 141899 - DNA, 25 bp, Homo sapien
tgtaataaccctgtcacctttcacg

SEQ ID NO: 141900 - DNA, 25 bp, Homo sapien
ctcaccggcgggcgaccttaggcag

SEQ ID NO: 141901 - DNA, 25 bp, Homo sapien
ggtaaaggacaagatttgcccagac

SEQ ID NO: 141902 - DNA, 25 bp, Homo sapien
tgccgggtaaaggacaagatttgcc

SEQ ID NO: 141903 - DNA, 25 bp, Homo sapien
tggtttgaaagctctggagcgaccc

SEQ ID NO: 141904 - DNA, 25 bp, Homo sapien
gaagctggtttgaaagctctggagc

SEQ ID NO: 141905 - DNA, 25 bp, Homo sapien
cccactcgcagaaccgcctggaccc

SEQ ID NO: 141906 - DNA, 25 bp, Homo sapien
ctgcttatctctgtctacctcaggt

SEQ ID NO: 141907 - DNA, 25 bp, Homo sapien
ttatctctgtctacctcaggtctga

SEQ ID NO: 141908 - DNA, 25 bp, Homo sapien
ctcaggtctgacttttgatgccaaa

SEQ ID NO: 141909 - DNA, 25 bp, Homo sapien
ggtctgacttttgatgccaaaatct

SEQ ID NO: 141910 - DNA, 25 bp, Homo sapien
ggaatcctgcgtgtcgtgcctgtgt

SEQ ID NO: 141911 - DNA, 25 bp, Homo sapien
tgtcgggaatcctgcgtgtcgtgcc

SEQ ID NO: 141912 - DNA, 25 bp, Homo sapien
ggccggcaccgtagcagcacaatca

SEQ ID NO: 141913 - DNA, 25 bp, Homo sapien
acggtgtccgagtctttaggtctgc

SEQ ID NO: 141914 - DNA, 25 bp, Homo sapien
acgcacgggcttacgggaactgtag

SEQ ID NO: 141915 - DNA, 25 bp, Homo sapien
ctgtagttttcaatgttaacgcgcc

SEQ ID NO: 141916 - DNA, 25 bp, Homo sapien
atgttaacgcgcctaccgcgcagca

SEQ ID NO: 141917 - DNA, 25 bp, Homo sapien
ctgaaagggacacggtgtccgagtc

SEQ ID NO: 141918 - DNA, 25 bp, Homo sapien
acagcagcaggcagtctcaggagtc

SEQ ID NO: 141919 - DNA, 25 bp, Homo sapien
tccgagtctttaggtctgcgcggga

SEQ ID NO: 141920 - DNA, 25 bp, Homo sapien
ctcgctctgcgcatgtgtaaaccca

SEQ ID NO: 141921 - DNA, 25 bp, Homo sapien
actacagttcccgtaagcccgtgcg

SEQ ID NO: 141922 - DNA, 25 bp, Homo sapien
aggcgcgttaacattgaaaactaca

SEQ ID NO: 141923 - DNA, 25 bp, Homo sapien
gggtttacacatgcgcagagcgagc

SEQ ID NO: 141924 - DNA, 25 bp, Homo sapien
actcggacaccgtgtccctttcagg

SEQ ID NO: 141925 - DNA, 25 bp, Homo sapien
cagacctaaagactcggacaccgtg

SEQ ID NO: 141926 - DNA, 25 bp, Homo sapien
tcccgcgcagacctaaagactcgga

SEQ ID NO: 141927 - DNA, 25 bp, Homo sapien
gactcctgagactgcctgctgctgt

SEQ ID NO: 141928 - DNA, 25 bp, Homo sapien
tgctgcgcggtaggcgcgttaacat

SEQ ID NO: 141929 - DNA, 25 bp, Homo sapien
ggcacgacacgcaggattcccgaca

SEQ ID NO: 141930 - DNA, 25 bp, Homo sapien
cccttcccggggtgattgtgctgct

SEQ ID NO: 141931 - DNA, 25 bp, Homo sapien
acctgaggtagacagagataagcag

SEQ ID NO: 141932 - DNA, 25 bp, Homo sapien
gtcagacctgaggtagacagagata

SEQ ID NO: 141933 - DNA, 25 bp, Homo sapien
cacgggagcgcaacacacgcagccc

SEQ ID NO: 141934 - DNA, 25 bp, Homo sapien
tgattgtgctgctacggtgccggcc

SEQ ID NO: 141935 - DNA, 25 bp, Homo sapien
acacaggcacgacacgcaggattcc

SEQ ID NO: 141936 - DNA, 25 bp, Homo sapien
ttttggcatcaaaagtcagacctga

SEQ ID NO: 141937 - DNA, 25 bp, Homo sapien
tgcgtgaggaagagagctagagact

SEQ ID NO: 141938 - DNA, 25 bp, Homo sapien
cccatcttccctatttgaactcaaa

SEQ ID NO: 141939 - DNA, 25 bp, Homo sapien
ccctatttgaactcaaacaggacag

SEQ ID NO: 141940 - DNA, 25 bp, Homo sapien
gtgataaagcctggcgttctccacc

SEQ ID NO: 141941 - DNA, 25 bp, Homo sapien
cccgctcgcttcttgactcgcgttg

SEQ ID NO: 141942 - DNA, 25 bp, Homo sapien
cctagtgtccgggacgcgcctgaac

SEQ ID NO: 141943 - DNA, 25 bp, Homo sapien
acgcgcctgaacctgccgcctccgt

SEQ ID NO: 141944 - DNA, 25 bp, Homo sapien
gtacacgccgcagagttatttctgc

SEQ ID NO: 141945 - DNA, 25 bp, Homo sapien
gtgcaaggacatcggctacaacatg

SEQ ID NO: 141946 - DNA, 25 bp, Homo sapien
cggcaaatgccagcccatcgagatc

SEQ ID NO: 141947 - DNA, 25 bp, Homo sapien
ccgccatcagctccatggacatgga

SEQ ID NO: 141948 - DNA, 25 bp, Homo sapien
cgaggacacgtccaacgccagcatg

SEQ ID NO: 141949 - DNA, 25 bp, Homo sapien
cgcttcccggtattgtttgcaaact

SEQ ID NO: 141950 - DNA, 25 bp, Homo sapien
cgggacgcaaacctcgaaacagctg

SEQ ID NO: 141951 - DNA, 25 bp, Homo sapien
ttgcgagtcttctcatcccgggacg

SEQ ID NO: 141952 - DNA, 25 bp, Homo sapien
catgactcgtatgcccaacctgatg

SEQ ID NO: 141953 - DNA, 25 bp, Homo sapien
cggcaaacatgcagtaatgtaaatt

SEQ ID NO: 141954 - DNA, 25 bp, Homo sapien
agagcattcaagagcgccttcctga

SEQ ID NO: 141955 - DNA, 25 bp, Homo sapien
gttggaccaaagagcattcaagagc

SEQ ID NO: 141956 - DNA, 25 bp, Homo sapien
tggctcttagttcaaagccctgacc

SEQ ID NO: 141957 - DNA, 25 bp, Homo sapien
ccctcccgtggctcttagttcaaag

SEQ ID NO: 141958 - DNA, 25 bp, Homo sapien
tgtgtccttcgcgtacgcagcgggc

SEQ ID NO: 141959 - DNA, 25 bp, Homo sapien
cctttgcccgtttctgctcagcaga

SEQ ID NO: 141960 - DNA, 25 bp, Homo sapien
agtgatgcctctcctttgcccgttt

SEQ ID NO: 141961 - DNA, 25 bp, Homo sapien
tagcgcgcaaaagagccgcaacttc

SEQ ID NO: 141962 - DNA, 25 bp, Homo sapien
ggcagtgcccggtacttcaccatca

SEQ ID NO: 141963 - DNA, 25 bp, Homo sapien
gttgcacctccagccgcagagattt

SEQ ID NO: 141964 - DNA, 25 bp, Homo sapien
actgtccaggccgaaagagctgctc

SEQ ID NO: 141965 - DNA, 25 bp, Homo sapien
tcctccgtcacaaagcgcagttgca

SEQ ID NO: 141966 - DNA, 25 bp, Homo sapien
ggcacgctggaaagctgcaactccc

SEQ ID NO: 141967 - DNA, 25 bp, Homo sapien
ggcaacatagcgcaccgcgggtaca

SEQ ID NO: 141968 - DNA, 25 bp, Homo sapien
gctcccgttgcaagttcagtcttcg

SEQ ID NO: 141969 - DNA, 25 bp, Homo sapien
tcactggctgcctctcggcggtgcg

SEQ ID NO: 141970 - DNA, 25 bp, Homo sapien
gactagtggcttcactggctgcctc

SEQ ID NO: 141971 - DNA, 25 bp, Homo sapien
gccctaactgtgtgttccccttctg

SEQ ID NO: 141972 - DNA, 25 bp, Homo sapien
tagtggcttcactggctgcctctcg

SEQ ID NO: 141973 - DNA, 25 bp, Homo sapien
gcggcgactagtggcttcactggct

SEQ ID NO: 141974 - DNA, 25 bp, Homo sapien
gcttcactggctgcctctcggcggt

SEQ ID NO: 141975 - DNA, 25 bp, Homo sapien
gccgctgcgccctaactgtgtgttc

SEQ ID NO: 141976 - DNA, 25 bp, Homo sapien
gcgactagtggcttcactggctgcc

SEQ ID NO: 141977 - DNA, 25 bp, Homo sapien
cctgcctaaggtcgcccgccggtga

SEQ ID NO: 141978 - DNA, 25 bp, Homo sapien
gctccagagctttcaaaccagcttc

SEQ ID NO: 141979 - DNA, 25 bp, Homo sapien
tggggtcgctccagagctttcaaac

SEQ ID NO: 141980 - DNA, 25 bp, Homo sapien
gtctgggcaaatcttgtcctttacc

SEQ ID NO: 141981 - DNA, 25 bp, Homo sapien
cacgcgcggcttcaccctccctcca

SEQ ID NO: 141982 - DNA, 25 bp, Homo sapien
cgtgaaaggtgacagggttattaca

SEQ ID NO: 141983 - DNA, 25 bp, Homo sapien
gccgtgaaaggtgacagggttatta

SEQ ID NO: 141984 - DNA, 25 bp, Homo sapien
ggcaaatcttgtcctttacccggca

SEQ ID NO: 141985 - DNA, 25 bp, Homo sapien
gtgcaccagcgtcgagttccaggat

SEQ ID NO: 141986 - DNA, 25 bp, Homo sapien
cacccactcaggtctgagaagcgat

SEQ ID NO: 141987 - DNA, 25 bp, Homo sapien
cccactcaggtctgagaagcgatcc

SEQ ID NO: 141988 - DNA, 25 bp, Homo sapien
ctactgccatttgcgccgttgtcgg

SEQ ID NO: 141989 - DNA, 25 bp, Homo sapien
taggtcccgcgtcggtgcgcatcct

SEQ ID NO: 141990 - DNA, 25 bp, Homo sapien
tcccgcgtcggtgcgcatcctcaga

SEQ ID NO: 141991 - DNA, 25 bp, Homo sapien
tggactactgccatttgcgccgttg

SEQ ID NO: 141992 - DNA, 25 bp, Homo sapien
acgcgtcgtgctgacccggagctcg

SEQ ID NO: 141993 - DNA, 25 bp, Homo sapien
tggaaaaaagcactagactggaaga

SEQ ID NO: 141994 - DNA, 25 bp, Homo sapien
gatctggaaaaaagcactagactgg

SEQ ID NO: 141995 - DNA, 25 bp, Homo sapien
tggggacctcagagattctctccag

SEQ ID NO: 141996 - DNA, 25 bp, Homo sapien
aatgggtggattcgggtccagattc

SEQ ID NO: 141997 - DNA, 25 bp, Homo sapien
gagtttgggatcgagatctggaaaa

SEQ ID NO: 141998 - DNA, 25 bp, Homo sapien
cactagactggaagaggacgcgatg

SEQ ID NO: 141999 - DNA, 25 bp, Homo sapien
aggacgcgatggagtcggagccgct

SEQ ID NO: 142000 - DNA, 25 bp, Homo sapien
actttacctgcgcacgcgtcgcagc

SEQ ID NO: 142001 - DNA, 25 bp, Homo sapien
cccgggaaaagagcgcctgttgctc

SEQ ID NO: 142002 - DNA, 25 bp, Homo sapien
tcatccgcccgggaaaagagcgcct

SEQ ID NO: 142003 - DNA, 25 bp, Homo sapien
tatggcgtacagacacgaggccggc

SEQ ID NO: 142004 - DNA, 25 bp, Homo sapien
tactgggcgtatggcgtacagacac

SEQ ID NO: 142005 - DNA, 25 bp, Homo sapien
cgctttccgccgttactgggcgtat

SEQ ID NO: 142006 - DNA, 25 bp, Homo sapien
gaaaccgccgtttgcggggcagcca

SEQ ID NO: 142007 - DNA, 25 bp, Homo sapien
cggccacatcagaaaccgccgtttg

SEQ ID NO: 142008 - DNA, 25 bp, Homo sapien
aaagagcgcctgttgctcgctgccc

SEQ ID NO: 142009 - DNA, 25 bp, Homo sapien
tgtgccgccgctttttagtttctga

SEQ ID NO: 142010 - DNA, 25 bp, Homo sapien
ggtagcgtcagcctcctggcttttc

SEQ ID NO: 142011 - DNA, 25 bp, Homo sapien
ctatggcgagggaagaatccacttt

SEQ ID NO: 142012 - DNA, 25 bp, Homo sapien
cgtcccggagccacgagagagtaac

SEQ ID NO: 142013 - DNA, 25 bp, Homo sapien
cagccagctttgtacagagacgtcc

SEQ ID NO: 142014 - DNA, 25 bp, Homo sapien
tgcgaggggtactatctgtgaaacg

SEQ ID NO: 142015 - DNA, 25 bp, Homo sapien
tcctctcggagggacgttactacac

SEQ ID NO: 142016 - DNA, 25 bp, Homo sapien
cggccctcactccataacgaaaaag

SEQ ID NO: 142017 - DNA, 25 bp, Homo sapien
tcttgacgggcgagggttactgtac

SEQ ID NO: 142018 - DNA, 25 bp, Homo sapien
cttgacgggcgagggttactgtact

SEQ ID NO: 142019 - DNA, 25 bp, Homo sapien
agccctggcccgtcttgacgggcga

SEQ ID NO: 142020 - DNA, 25 bp, Homo sapien
gcgagggttactgtacttgtcccaa

SEQ ID NO: 142021 - DNA, 25 bp, Homo sapien
gctgcgacgcgtgcgcaggtaaagt

SEQ ID NO: 142022 - DNA, 25 bp, Homo sapien
ctgcgacgcgtgcgcaggtaaagtc

SEQ ID NO: 142023 - DNA, 25 bp, Homo sapien
cgccagcggctccgactccatcgcg

SEQ ID NO: 142024 - DNA, 25 bp, Homo sapien
ggcgagggttactgtacttgtccca

SEQ ID NO: 142025 - DNA, 25 bp, Homo sapien
atcgcatttctcagacctgggtggg

SEQ ID NO: 142026 - DNA, 25 bp, Homo sapien
tcgcatttctcagacctgggtgggt

SEQ ID NO: 142027 - DNA, 25 bp, Homo sapien
gatcgcatttctcagacctgggtgg

SEQ ID NO: 142028 - DNA, 25 bp, Homo sapien
ggatcgcatttctcagacctgggtg

SEQ ID NO: 142029 - DNA, 25 bp, Homo sapien
agcaaagggctgcagtccatgtcgg

SEQ ID NO: 142030 - DNA, 25 bp, Homo sapien
ggagcaaagggctgcagtccatgtc

SEQ ID NO: 142031 - DNA, 25 bp, Homo sapien
cggagcaaagggctgcagtccatgt

SEQ ID NO: 142032 - DNA, 25 bp, Homo sapien
cgcatttctcagacctgggtgggtg

SEQ ID NO: 142033 - DNA, 25 bp, Homo sapien
gatggatgctctcgccgtcttcagc

SEQ ID NO: 142034 - DNA, 25 bp, Homo sapien
gttctctgagcgcttttcttttcgt

SEQ ID NO: 142035 - DNA, 25 bp, Homo sapien
ccgctcgcatagaatgtaccgctca

SEQ ID NO: 142036 - DNA, 25 bp, Homo sapien
ccgctcaacggtttttaggcgtgtg

SEQ ID NO: 142037 - DNA, 25 bp, Homo sapien
acgttaggtggaagcgtctttggca

SEQ ID NO: 142038 - DNA, 25 bp, Homo sapien
tctttggcagagctggtagcgaatc

SEQ ID NO: 142039 - DNA, 25 bp, Homo sapien
tttttaagttgtggccagagagacc

SEQ ID NO: 142040 - DNA, 25 bp, Homo sapien
actgcggggacctgagagctctgca

SEQ ID NO: 142041 - DNA, 25 bp, Homo sapien
acccacccatgtctgaaaagcgatc

SEQ ID NO: 142042 - DNA, 25 bp, Homo sapien
ccgacgtggactgcagccgtttgcg

SEQ ID NO: 142043 - DNA, 25 bp, Homo sapien
ctgaaaagcgatccgacgtggactg

SEQ ID NO: 142044 - DNA, 25 bp, Homo sapien
cacccatgtctgaaaagcgatccga

SEQ ID NO: 142045 - DNA, 25 bp, Homo sapien
acgtggactgcagccgtttgcgccg

SEQ ID NO: 142046 - DNA, 25 bp, Homo sapien
ctgtattctttattcttcccagcag

SEQ ID NO: 142047 - DNA, 25 bp, Homo sapien
gagtctgtattctttattcttccca

SEQ ID NO: 142048 - DNA, 25 bp, Homo sapien
tgtctgaaaagcgatccgacgtgga

SEQ ID NO: 142049 - DNA, 25 bp, Homo sapien
cttgtatcttcgagggcaaccggcc

SEQ ID NO: 142050 - DNA, 25 bp, Homo sapien
tcgatccagcggcagcaatgcttgc

SEQ ID NO: 142051 - DNA, 25 bp, Homo sapien
cgaagccctcgacccgttgatgtag

SEQ ID NO: 142052 - DNA, 25 bp, Homo sapien
ggccatgctgcaccaccatgtggtt

SEQ ID NO: 142053 - DNA, 25 bp, Homo sapien
gcccagaagcaagtgaagtcctccc

SEQ ID NO: 142054 - DNA, 25 bp, Homo sapien
actcctccaggcgttcggtcttgaa

SEQ ID NO: 142055 - DNA, 25 bp, Homo sapien
ggggacaaggacagcgctctcttct

SEQ ID NO: 142056 - DNA, 25 bp, Homo sapien
tggaccttctcgatgtgccgcacga

SEQ ID NO: 142057 - DNA, 25 bp, Homo sapien
acgtgactgtgcagtggacaccgcg

SEQ ID NO: 142058 - DNA, 25 bp, Homo sapien
tgtcacagtcttgccgtcaccacgg

SEQ ID NO: 142059 - DNA, 25 bp, Homo sapien
gtgtcacagtcttgccgtcaccacg

SEQ ID NO: 142060 - DNA, 25 bp, Homo sapien
gactgtgcagtggacaccgcgtggg

SEQ ID NO: 142061 - DNA, 25 bp, Homo sapien
cgtgactgtgcagtggacaccgcgt

SEQ ID NO: 142062 - DNA, 25 bp, Homo sapien
tgtgtcacagtcttgccgtcaccac

SEQ ID NO: 142063 - DNA, 25 bp, Homo sapien
cacgtgactgtgcagtggacaccgc

SEQ ID NO: 142064 - DNA, 25 bp, Homo sapien
tgactgtgcagtggacaccgcgtgg

SEQ ID NO: 142065 - DNA, 25 bp, Homo sapien
cagcctctccatctcgcaagtttta

SEQ ID NO: 142066 - DNA, 25 bp, Homo sapien
gttttcaattatctctccttaatgg

SEQ ID NO: 142067 - DNA, 25 bp, Homo sapien
tgggagcctgcggatcccagattcc

SEQ ID NO: 142068 - DNA, 25 bp, Homo sapien
aagccctttacgatcgtcagcagca

SEQ ID NO: 142069 - DNA, 25 bp, Homo sapien
ttacgatcgtcagcagcatgaaaga

SEQ ID NO: 142070 - DNA, 25 bp, Homo sapien
cgtcagcagcatgaaagatgctgca

SEQ ID NO: 142071 - DNA, 25 bp, Homo sapien
gagcctgcggatcccagattccgaa

SEQ ID NO: 142072 - DNA, 25 bp, Homo sapien
ccatctcgcaagttttaattaacgc

SEQ ID NO: 142073 - DNA, 25 bp, Homo sapien
gctgtttggctagcccaggagtctc

SEQ ID NO: 142074 - DNA, 25 bp, Homo sapien
ctgtttggctagcccaggagtctct

SEQ ID NO: 142075 - DNA, 25 bp, Homo sapien
gtttggctagcccaggagtctctcc

SEQ ID NO: 142076 - DNA, 25 bp, Homo sapien
tttggctagcccaggagtctctccc

SEQ ID NO: 142077 - DNA, 25 bp, Homo sapien
ttggctagcccaggagtctctccct

SEQ ID NO: 142078 - DNA, 25 bp, Homo sapien
cctgctgtttggctagcccaggagt

SEQ ID NO: 142079 - DNA, 25 bp, Homo sapien
tgctgtttggctagcccaggagtct

SEQ ID NO: 142080 - DNA, 25 bp, Homo sapien
ctgctgtttggctagcccaggagtc

SEQ ID NO: 142081 - DNA, 25 bp, Homo sapien
caagcgaagaccatcttttaacctt

SEQ ID NO: 142082 - DNA, 25 bp, Homo sapien
gagcctctgctcttcgcttctaaaa

SEQ ID NO: 142083 - DNA, 25 bp, Homo sapien
gcctctgctcttcgcttctaaaata

SEQ ID NO: 142084 - DNA, 25 bp, Homo sapien
tctgctcttcgcttctaaaataaaa

SEQ ID NO: 142085 - DNA, 25 bp, Homo sapien
ggaattttcaatagtccaacttgtc

SEQ ID NO: 142086 - DNA, 25 bp, Homo sapien
ttcaatagtccaacttgtcaagcga

SEQ ID NO: 142087 - DNA, 25 bp, Homo sapien
tccaacttgtcaagcgaagaccatc

SEQ ID NO: 142088 - DNA, 25 bp, Homo sapien
cttgtcaagcgaagaccatctttta

SEQ ID NO: 142089 - DNA, 25 bp, Homo sapien
tccagaaggaagtcctccacgtggg

SEQ ID NO: 142090 - DNA, 25 bp, Homo sapien
gaaaatcttggtgctcggtgggctc

SEQ ID NO: 142091 - DNA, 25 bp, Homo sapien
ctgtcttccagaaggaagtcctcca

SEQ ID NO: 142092 - DNA, 25 bp, Homo sapien
tggccgagcggctgaaccgacagcc

SEQ ID NO: 142093 - DNA, 25 bp, Homo sapien
tgtttccgaagccaaaccgcgactc

SEQ ID NO: 142094 - DNA, 25 bp, Homo sapien
gcggccacggtgtttccgaagccaa

SEQ ID NO: 142095 - DNA, 25 bp, Homo sapien
tcgtcgttcctgaggaggccaccag

SEQ ID NO: 142096 - DNA, 25 bp, Homo sapien
ccctgtgcttcaccgggaaccagga

SEQ ID NO: 142097 - DNA, 25 bp, Homo sapien
agcgccactgttctgccttggcagg

SEQ ID NO: 142098 - DNA, 25 bp, Homo sapien
cagcctctccatctcgcaagtttta

SEQ ID NO: 142099 - DNA, 25 bp, Homo sapien
cgatcgtcagcagcatgaaagatgc

SEQ ID NO: 142100 - DNA, 25 bp, Homo sapien
tggaaggtctctgagcatctgaccg

SEQ ID NO: 142101 - DNA, 25 bp, Homo sapien
gccctttacgatcgtcagcagcatg

SEQ ID NO: 142102 - DNA, 25 bp, Homo sapien
gttttcaattatctctccttaatgg

SEQ ID NO: 142103 - DNA, 25 bp, Homo sapien
gacagcttgtgcctgcgcagcagac

SEQ ID NO: 142104 - DNA, 25 bp, Homo sapien
gagcctgcggatcccagattccgaa

SEQ ID NO: 142105 - DNA, 25 bp, Homo sapien
ccctagtttgcgtctctgagcttta

SEQ ID NO: 142106 - DNA, 25 bp, Homo sapien
ctcgcctgcgagcaaagttcctatg

SEQ ID NO: 142107 - DNA, 25 bp, Homo sapien
ccggctcagcgtagaaaactatttg

SEQ ID NO: 142108 - DNA, 25 bp, Homo sapien
tgaggtgcgcgtatccttaaacccg

SEQ ID NO: 142109 - DNA, 25 bp, Homo sapien
atcagtctcagtcagcgcaggtctc

SEQ ID NO: 142110 - DNA, 25 bp, Homo sapien
ctgtcttctacactgggcgctctta

SEQ ID NO: 142111 - DNA, 25 bp, Homo sapien
cctctgcccgctctacttgaaatga

SEQ ID NO: 142112 - DNA, 25 bp, Homo sapien
cgtcctgtaacgtgccctgattgtg

SEQ ID NO: 142113 - DNA, 25 bp, Homo sapien
ggagctctttgtcccgccggagacc

SEQ ID NO: 142114 - DNA, 25 bp, Homo sapien
gttgtcaatccttttcgccgacgcg

SEQ ID NO: 142115 - DNA, 25 bp, Homo sapien
ttccgctttgggtgtgtgaaggcct

SEQ ID NO: 142116 - DNA, 25 bp, Homo sapien
cctggcccacgtgaggagattcttc

SEQ ID NO: 142117 - DNA, 25 bp, Homo sapien
agattcttcggtcccggagcaattg

SEQ ID NO: 142118 - DNA, 25 bp, Homo sapien
ctgagcggtctcttttctaggatca

SEQ ID NO: 142119 - DNA, 25 bp, Homo sapien
tctaggatcaagatgaacacactgc

SEQ ID NO: 142120 - DNA, 25 bp, Homo sapien
cacactgcagacgaggacacgagcc

SEQ ID NO: 142121 - DNA, 25 bp, Homo sapien
cgaagggcgctctgcctttgctagg

SEQ ID NO: 142122 - DNA, 25 bp, Homo sapien
gcctctctgcctttgcgaagggcgc

SEQ ID NO: 142123 - DNA, 25 bp, Homo sapien
ttgcgaagggcgctctgcctttgct

SEQ ID NO: 142124 - DNA, 25 bp, Homo sapien
gaaacaagagctgctggcttccggg

SEQ ID NO: 142125 - DNA, 25 bp, Homo sapien
acaagagctgctggcttccgggttc

SEQ ID NO: 142126 - DNA, 25 bp, Homo sapien
agagctgctggcttccgggttctcc

SEQ ID NO: 142127 - DNA, 25 bp, Homo sapien
cctcgttccgagatgtgggaagtga

SEQ ID NO: 142128 - DNA, 25 bp, Homo sapien
gagatcggggccgttggtatgggcc

SEQ ID NO: 142129 - DNA, 25 bp, Homo sapien
aagcctctctctcactcaaaggcag

SEQ ID NO: 142130 - DNA, 25 bp, Homo sapien
actaccgtctctctcttaagtctct

SEQ ID NO: 142131 - DNA, 25 bp, Homo sapien
gcttctcacgcctcttgccctgccc

SEQ ID NO: 142132 - DNA, 25 bp, Homo sapien
gcctctctctcactcaaaggcagta

SEQ ID NO: 142133 - DNA, 25 bp, Homo sapien
ctctctctcactcaaaggcagtata

SEQ ID NO: 142134 - DNA, 25 bp, Homo sapien
tctctcactcaaaggcagtatagaa

SEQ ID NO: 142135 - DNA, 25 bp, Homo sapien
ctctcactcaaaggcagtatagaag

SEQ ID NO: 142136 - DNA, 25 bp, Homo sapien
ctcactcaaaggcagtatagaagtc

SEQ ID NO: 142137 - DNA, 25 bp, Homo sapien
ttggactattgaaaattccttcttc

SEQ ID NO: 142138 - DNA, 25 bp, Homo sapien
tgacaagttggactattgaaaattc

SEQ ID NO: 142139 - DNA, 25 bp, Homo sapien
ttcgcttgacaagttggactattga

SEQ ID NO: 142140 - DNA, 25 bp, Homo sapien
tttattttagaagcgaagagcagag

SEQ ID NO: 142141 - DNA, 25 bp, Homo sapien
ggtcttcgcttgacaagttggacta

SEQ ID NO: 142142 - DNA, 25 bp, Homo sapien
agatggtcttcgcttgacaagttgg

SEQ ID NO: 142143 - DNA, 25 bp, Homo sapien
aggttaaaagatggtcttcgcttga

SEQ ID NO: 142144 - DNA, 25 bp, Homo sapien
ttttttattttagaagcgaagagca

SEQ ID NO: 142145 - DNA, 25 bp, Homo sapien
tcctgacctggccacgaacattaaa

SEQ ID NO: 142146 - DNA, 25 bp, Homo sapien
accgatcgcagagctgcctccaata

SEQ ID NO: 142147 - DNA, 25 bp, Homo sapien
gggccggatatattcaccgatcgca

SEQ ID NO: 142148 - DNA, 25 bp, Homo sapien
tgcgctaccggatctcgacaggaag

SEQ ID NO: 142149 - DNA, 25 bp, Homo sapien
cagatctgcatcttgcgctaccgga

SEQ ID NO: 142150 - DNA, 25 bp, Homo sapien
aaagcacgttggtcatgcgcctacc

SEQ ID NO: 142151 - DNA, 25 bp, Homo sapien
gcgaataacatcgtcaaagcacgtt

SEQ ID NO: 142152 - DNA, 25 bp, Homo sapien
acgggactcacgtctgactcagatc

SEQ ID NO: 142153 - DNA, 25 bp, Homo sapien
ggcacaagctgtcgggccaggccct

SEQ ID NO: 142154 - DNA, 25 bp, Homo sapien
tgccaaggcagaacagtggcgcttc

SEQ ID NO: 142155 - DNA, 25 bp, Homo sapien
cggtcagatgctcagagaccttcca

SEQ ID NO: 142156 - DNA, 25 bp, Homo sapien
ttcggaatctgggatccgcaggctc

SEQ ID NO: 142157 - DNA, 25 bp, Homo sapien
attaaaacttgcgagatggagaggc

SEQ ID NO: 142158 - DNA, 25 bp, Homo sapien
gcatctttcatgctgctgacgatcg

SEQ ID NO: 142159 - DNA, 25 bp, Homo sapien
tgctgctgacgatcgtaaagggctt

SEQ ID NO: 142160 - DNA, 25 bp, Homo sapien
gtctgctgcgcaggcacaagctgtc

SEQ ID NO: 142161 - DNA, 25 bp, Homo sapien
ctggtacctgatgtcctcagggtca

SEQ ID NO: 142162 - DNA, 25 bp, Homo sapien
cctggtacctgatgtcctcagggtc

SEQ ID NO: 142163 - DNA, 25 bp, Homo sapien
ggtacctgatgtcctcagggtcaag

SEQ ID NO: 142164 - DNA, 25 bp, Homo sapien
atgtcctcagggtcaagtgcatcgc

SEQ ID NO: 142165 - DNA, 25 bp, Homo sapien
ctgatgtcctcagggtcaagtgcat

SEQ ID NO: 142166 - DNA, 25 bp, Homo sapien
cctgatgtcctcagggtcaagtgca

SEQ ID NO: 142167 - DNA, 25 bp, Homo sapien
tacctgatgtcctcagggtcaagtg

SEQ ID NO: 142168 - DNA, 25 bp, Homo sapien
gggcctggtacctgatgtcctcagg

SEQ ID NO: 142169 - DNA, 25 bp, Homo sapien
tgcacttgaccctgaggacatcagg

SEQ ID NO: 142170 - DNA, 25 bp, Homo sapien
accctgaggacatcaggtaccaggc

SEQ ID NO: 142171 - DNA, 25 bp, Homo sapien
ttgaccctgaggacatcaggtacca

SEQ ID NO: 142172 - DNA, 25 bp, Homo sapien
cacttgaccctgaggacatcaggta

SEQ ID NO: 142173 - DNA, 25 bp, Homo sapien
atgcacttgaccctgaggacatcag

SEQ ID NO: 142174 - DNA, 25 bp, Homo sapien
cgatgcacttgaccctgaggacatc

SEQ ID NO: 142175 - DNA, 25 bp, Homo sapien
gcgatgcacttgaccctgaggacat

SEQ ID NO: 142176 - DNA, 25 bp, Homo sapien
cttgaccctgaggacatcaggtacc

SEQ ID NO: 142177 - DNA, 25 bp, Homo sapien
cagcgcacaatagcggcgacagcca

SEQ ID NO: 142178 - DNA, 25 bp, Homo sapien
ctgccacgcaaaactaccgggctgg

SEQ ID NO: 142179 - DNA, 25 bp, Homo sapien
cacgcaaaactaccgggctggcagg

SEQ ID NO: 142180 - DNA, 25 bp, Homo sapien
cctgtgcacccgcatctcgccgcgc

SEQ ID NO: 142181 - DNA, 25 bp, Homo sapien
cgagcccagcgcacaatagcggcga

SEQ ID NO: 142182 - DNA, 25 bp, Homo sapien
agcccagcgcacaatagcggcgaca

SEQ ID NO: 142183 - DNA, 25 bp, Homo sapien
taccacgcctgctccctagggaccc

SEQ ID NO: 142184 - DNA, 25 bp, Homo sapien
ctgggcgccctaccacgcctgctcc

SEQ ID NO: 142185 - DNA, 25 bp, Homo sapien
cttcctgaagaataactgggtgttg

SEQ ID NO: 142186 - DNA, 25 bp, Homo sapien
gaataactgggtgttgctgtccacc

SEQ ID NO: 142187 - DNA, 25 bp, Homo sapien
ggaagcgcttcctgaagaataactg

SEQ ID NO: 142188 - DNA, 25 bp, Homo sapien
tgttgctgtccaccgtggccgcggt

SEQ ID NO: 142189 - DNA, 25 bp, Homo sapien
cgcgcaccctcacgcgctctctgcg

SEQ ID NO: 142190 - DNA, 25 bp, Homo sapien
gcactccatgcagggtccctcgatg

SEQ ID NO: 142191 - DNA, 25 bp, Homo sapien
acagccatggggaaaccggcgagga

SEQ ID NO: 142192 - DNA, 25 bp, Homo sapien
cgagtggaagcgcttcctgaagaat

SEQ ID NO: 142193 - DNA, 25 bp, Homo sapien
cagaccatgcgcgagacagcccagg

SEQ ID NO: 142194 - DNA, 25 bp, Homo sapien
agagcccagtccagctacgcctgcc

SEQ ID NO: 142195 - DNA, 25 bp, Homo sapien
caacacctggggcccgcttaggacg

SEQ ID NO: 142196 - DNA, 25 bp, Homo sapien
aggcggccaccctctcgctgggact

SEQ ID NO: 142197 - DNA, 25 bp, Homo sapien
gaccatgcgcgagacagcccaggcg

SEQ ID NO: 142198 - DNA, 25 bp, Homo sapien
tacgcccaagcaccaccatcgccgc

SEQ ID NO: 142199 - DNA, 25 bp, Homo sapien
cggcggccagaccatgcgcgagaca

SEQ ID NO: 142200 - DNA, 25 bp, Homo sapien
agcccaggcgccagagacctccatc

SEQ ID NO: 142201 - DNA, 25 bp, Homo sapien
tcccaccggcttggacggttgcagt

SEQ ID NO: 142202 - DNA, 25 bp, Homo sapien
cgcccacgctccagtccttccggga

SEQ ID NO: 142203 - DNA, 25 bp, Homo sapien
cggttgcagtgacgctgaatgaatg

SEQ ID NO: 142204 - DNA, 25 bp, Homo sapien
atgaatacaattgcctgggagtccg

SEQ ID NO: 142205 - DNA, 25 bp, Homo sapien
atacaattgcctgggagtccgggga

SEQ ID NO: 142206 - DNA, 25 bp, Homo sapien
cctacggtaccgctattaccaggcg

SEQ ID NO: 142207 - DNA, 25 bp, Homo sapien
aagcccgcatgactccaggcgtcat

SEQ ID NO: 142208 - DNA, 25 bp, Homo sapien
cctggctcaggaccaatgtggcacc

SEQ ID NO: 142209 - DNA, 25 bp, Homo sapien
tcggctaccctttccacggtcattg

SEQ ID NO: 142210 - DNA, 25 bp, Homo sapien
gcttcctcgccagcaggctacaaaa

SEQ ID NO: 142211 - DNA, 25 bp, Homo sapien
tgagcgccacgcagatcaaacagga

SEQ ID NO: 142212 - DNA, 25 bp, Homo sapien
gcgacctgtacttcgtgccactgga

SEQ ID NO: 142213 - DNA, 25 bp, Homo sapien
ccttgcgctggtgtagtgttttaga

SEQ ID NO: 142214 - DNA, 25 bp, Homo sapien
ccatgccagtcagtctgccaggtga

SEQ ID NO: 142215 - DNA, 25 bp, Homo sapien
ggtagatgtacccagccatgccagt

SEQ ID NO: 142216 - DNA, 25 bp, Homo sapien
acaaacacctggatcgcggcttcaa

SEQ ID NO: 142217 - DNA, 25 bp, Homo sapien
tgccaacaagaggtgccagagaccg

SEQ ID NO: 142218 - DNA, 25 bp, Homo sapien
catcgcccagggcagcaccgctccg

SEQ ID NO: 142219 - DNA, 25 bp, Homo sapien
cgaaccgtccagagcgggaggctcc

SEQ ID NO: 142220 - DNA, 25 bp, Homo sapien
gcagggtcccactcacctgggagcg

SEQ ID NO: 142221 - DNA, 25 bp, Homo sapien
cagagcgggaggctccatcgcccag

SEQ ID NO: 142222 - DNA, 25 bp, Homo sapien
ctgcaacggcgacgctgccaacaag

SEQ ID NO: 142223 - DNA, 25 bp, Homo sapien
gcgacgctgccaacaagaggtgcca

SEQ ID NO: 142224 - DNA, 25 bp, Homo sapien
aggtgccagagaccgcggcgcaacc

SEQ ID NO: 142225 - DNA, 25 bp, Homo sapien
cagcggctccgactccatcgcgtcc

SEQ ID NO: 142226 - DNA, 25 bp, Homo sapien
cctcttccagtctagtgcttttttc

SEQ ID NO: 142227 - DNA, 25 bp, Homo sapien
ctgcgacgcgtgcgcaggtaaagtc

SEQ ID NO: 142228 - DNA, 25 bp, Homo sapien
catcgcgtcctcttccagtctagtg

SEQ ID NO: 142229 - DNA, 25 bp, Homo sapien
ccagtctagtgcttttttccagatc

SEQ ID NO: 142230 - DNA, 25 bp, Homo sapien
ttttccagatctcgatcccaaactc

SEQ ID NO: 142231 - DNA, 25 bp, Homo sapien
aatctggacccgaatccacccattg

SEQ ID NO: 142232 - DNA, 25 bp, Homo sapien
ctggagagaatctctgaggtcccca

SEQ ID NO: 142233 - DNA, 25 bp, Homo sapien
cgagctccgggtcagcacgacgcgt

SEQ ID NO: 142234 - DNA, 25 bp, Homo sapien
ggatcgcttctcagacctgagtggg

SEQ ID NO: 142235 - DNA, 25 bp, Homo sapien
caacggcgcaaatggcagtagtcca

SEQ ID NO: 142236 - DNA, 25 bp, Homo sapien
atcgcttctcagacctgagtgggtg

SEQ ID NO: 142237 - DNA, 25 bp, Homo sapien
ccgacaacggcgcaaatggcagtag

SEQ ID NO: 142238 - DNA, 25 bp, Homo sapien
atcctggaactcgacgctggtgcac

SEQ ID NO: 142239 - DNA, 25 bp, Homo sapien
gcgtctggctcctctccgagctccg

SEQ ID NO: 142240 - DNA, 25 bp, Homo sapien
aggatgcgcaccgacgcgggaccta

SEQ ID NO: 142241 - DNA, 25 bp, Homo sapien
gctttgccggctgccgggcatcttc

SEQ ID NO: 142242 - DNA, 25 bp, Homo sapien
tcgatgtgctctcggggaagcgcaa

SEQ ID NO: 142243 - DNA, 25 bp, Homo sapien
cgggcatcttcagaggccgccgcag

SEQ ID NO: 142244 - DNA, 25 bp, Homo sapien
ccgcgccttctgctttcttcggtgc

SEQ ID NO: 142245 - DNA, 25 bp, Homo sapien
ttcctacgccggagaaagctgccat

SEQ ID NO: 142246 - DNA, 25 bp, Homo sapien
tgcagcagagcgtaagggcgtctcc

SEQ ID NO: 142247 - DNA, 25 bp, Homo sapien
tcctcccaaggctgaggaccaagtg

SEQ ID NO: 142248 - DNA, 25 bp, Homo sapien
tcccaaggctgaggaccaagtgagg

SEQ ID NO: 142249 - DNA, 25 bp, Homo sapien
cgtgcctgaattctgggatgtgcca

SEQ ID NO: 142250 - DNA, 25 bp, Homo sapien
ctcatcctgggcagtgcgtggaaag

SEQ ID NO: 142251 - DNA, 25 bp, Homo sapien
tgagaacgctgtcgccgctcatcct

SEQ ID NO: 142252 - DNA, 25 bp, Homo sapien
ggaaaggtgccttcccacgcggcga

SEQ ID NO: 142253 - DNA, 25 bp, Homo sapien
ctgcacccgggctctgaaaagctgc

SEQ ID NO: 142254 - DNA, 25 bp, Homo sapien
gaaaagctgccagattcgtgcctga

SEQ ID NO: 142255 - DNA, 25 bp, Homo sapien
tgagtgtggattacagttctcagtc

SEQ ID NO: 142256 - DNA, 25 bp, Homo sapien
tcagtcgaattggaagaggcaccct

SEQ ID NO: 142257 - DNA, 25 bp, Homo sapien
gtgactgtgcagtggacaccgcgtg

SEQ ID NO: 142258 - DNA, 25 bp, Homo sapien
gtgtcacagtcttgccgtcaccacg

SEQ ID NO: 142259 - DNA, 25 bp, Homo sapien
gactgtgcagtggacaccgcgtggg

SEQ ID NO: 142260 - DNA, 25 bp, Homo sapien
tgtcacagtcttgccgtcaccacgg

SEQ ID NO: 142261 - DNA, 25 bp, Homo sapien
cgcgtggggccgccgtgtgtcacag

SEQ ID NO: 142262 - DNA, 25 bp, Homo sapien
cgtgactgtgcagtggacaccgcgt

SEQ ID NO: 142263 - DNA, 25 bp, Homo sapien
tgactgtgcagtggacaccgcgtgg

SEQ ID NO: 142264 - DNA, 25 bp, Homo sapien
tgtgtcacagtcttgccgtcaccac

SEQ ID NO: 142265 - DNA, 25 bp, Homo sapien
tgtttttcgaaccaaagcacgctgc

SEQ ID NO: 142266 - DNA, 25 bp, Homo sapien
ttcccagcacatccgaattgccttg

SEQ ID NO: 142267 - DNA, 25 bp, Homo sapien
cgcgaagagcaaagcaagacagtta

SEQ ID NO: 142268 - DNA, 25 bp, Homo sapien
ttctctagaatacctgcatgctgtc

SEQ ID NO: 142269 - DNA, 25 bp, Homo sapien
gaaaagcatcgccaagcacgccggg

SEQ ID NO: 142270 - DNA, 25 bp, Homo sapien
cgcgtccactcacgggaaaagcatc

SEQ ID NO: 142271 - DNA, 25 bp, Homo sapien
cgggcagggaagatgctattctcta

SEQ ID NO: 142272 - DNA, 25 bp, Homo sapien
ctgtccaaggtgttctgcgcgaaga

SEQ ID NO: 142273 - DNA, 25 bp, Homo sapien
aggcagttccacagcgtgcccggca

SEQ ID NO: 142274 - DNA, 25 bp, Homo sapien
cgcacgagtggcctgcgctcccaga

SEQ ID NO: 142275 - DNA, 25 bp, Homo sapien
ctagcgggaggcagttccacagcgt

SEQ ID NO: 142276 - DNA, 25 bp, Homo sapien
ggcagttccacagcgtgcccggcag

SEQ ID NO: 142277 - DNA, 25 bp, Homo sapien
gaaatctcagccattcagtgtttgg

SEQ ID NO: 142278 - DNA, 25 bp, Homo sapien
agctctagcgggaggcagttccaca

SEQ ID NO: 142279 - DNA, 25 bp, Homo sapien
atctcagccattcagtgtttgggtg

SEQ ID NO: 142280 - DNA, 25 bp, Homo sapien
cccgcagctctagcgggaggcagtt

SEQ ID NO: 142281 - DNA, 25 bp, Homo sapien
tcgatggccgtcctgctaaagtacc

SEQ ID NO: 142282 - DNA, 25 bp, Homo sapien
tcgatggacgacagcacgctctgga

SEQ ID NO: 142283 - DNA, 25 bp, Homo sapien
cagcacgctctggataaagttgggc

SEQ ID NO: 142284 - DNA, 25 bp, Homo sapien
ataaagttgggcaggtagttgcgct

SEQ ID NO: 142285 - DNA, 25 bp, Homo sapien
gagattgcttctgccttcctgtaaa

SEQ ID NO: 142286 - DNA, 25 bp, Homo sapien
tctgccttcctgtaaagttttctcc

SEQ ID NO: 142287 - DNA, 25 bp, Homo sapien
cccaaaagcctgattccagggcctg

SEQ ID NO: 142288 - DNA, 25 bp, Homo sapien
ggccatctgcaccacgatctcgatg

SEQ ID NO: 142289 - DNA, 25 bp, Homo sapien
cgaggtgctgatgaacctgctcttc

SEQ ID NO: 142290 - DNA, 25 bp, Homo sapien
ggcaccctctactgcctgtgcagga

SEQ ID NO: 142291 - DNA, 25 bp, Homo sapien
aagctgctggagatctcgggacacg

SEQ ID NO: 142292 - DNA, 25 bp, Homo sapien
ctgctggccatcgacctgtggctgt

SEQ ID NO: 142293 - DNA, 25 bp, Homo sapien
ccgtgcatcggagagcccagttcac

SEQ ID NO: 142294 - DNA, 25 bp, Homo sapien
cggcagcaggtttgagttccagtcc

SEQ ID NO: 142295 - DNA, 25 bp, Homo sapien
tggccttgatcaaagggctggtccg

SEQ ID NO: 142296 - DNA, 25 bp, Homo sapien
gtctccgcttcgagcagcagcagca

SEQ ID NO: 142297 - DNA, 25 bp, Homo sapien
ttcctcaacgtgatgctgcagagca

SEQ ID NO: 142298 - DNA, 25 bp, Homo sapien
agtcctttggactgggtgccatctg

SEQ ID NO: 142299 - DNA, 25 bp, Homo sapien
tccgccttatctggagtgcgagaac

SEQ ID NO: 142300 - DNA, 25 bp, Homo sapien
accagctgaagcgagccaactgctc

SEQ ID NO: 142301 - DNA, 25 bp, Homo sapien
tggcctcttacctctacaccgggga

SEQ ID NO: 142302 - DNA, 25 bp, Homo sapien
cgatggcaccatcttggcgcagaaa

SEQ ID NO: 142303 - DNA, 25 bp, Homo sapien
ctgactgttgagaaactgacgatcc

SEQ ID NO: 142304 - DNA, 25 bp, Homo sapien
actcctcgaaaaagtctgactgttg

SEQ ID NO: 142305 - DNA, 25 bp, Homo sapien
acgggctggatttaggatggtgact

SEQ ID NO: 142306 - DNA, 25 bp, Homo sapien
ctgccggacactcggcccggcatca

SEQ ID NO: 142307 - DNA, 25 bp, Homo sapien
ggcatcacgggctggatttaggatg

SEQ ID NO: 142308 - DNA, 25 bp, Homo sapien
atggtgactgccggacactcggccc

SEQ ID NO: 142309 - DNA, 25 bp, Homo sapien
cacgggctggatttaggatggtgac

SEQ ID NO: 142310 - DNA, 25 bp, Homo sapien
gatggtgactgccggacactcggcc

SEQ ID NO: 142311 - DNA, 25 bp, Homo sapien
cggcatcacgggctggatttaggat

SEQ ID NO: 142312 - DNA, 25 bp, Homo sapien
tggtgactgccggacactcggcccg

SEQ ID NO: 142313 - DNA, 25 bp, Homo sapien
tttcacgctaccaggatccagtgcg

SEQ ID NO: 142314 - DNA, 25 bp, Homo sapien
ttcttggggaccatgagaggaaaaa

SEQ ID NO: 142315 - DNA, 25 bp, Homo sapien
ccctctgtgaagcagagtgctctag

SEQ ID NO: 142316 - DNA, 25 bp, Homo sapien
agcttcctgggcaagtttcacgcta

SEQ ID NO: 142317 - DNA, 25 bp, Homo sapien
cggcagaggcttgcaagaaaacgca

SEQ ID NO: 142318 - DNA, 25 bp, Homo sapien
gactccgaagagaaattccggcttc

SEQ ID NO: 142319 - DNA, 25 bp, Homo sapien
agcagagtgctctagtcaggcgtga

SEQ ID NO: 142320 - DNA, 25 bp, Homo sapien
tcacaccagggaggaagaacgcgca

SEQ ID NO: 142321 - DNA, 25 bp, Homo sapien
ccgcgacgacaaaaagccgtggagg

SEQ ID NO: 142322 - DNA, 25 bp, Homo sapien
aataatcgcggcaccaggcgggggc

SEQ ID NO: 142323 - DNA, 25 bp, Homo sapien
gaaagccgccgcggtaggggagcaa

SEQ ID NO: 142324 - DNA, 25 bp, Homo sapien
caccgggaggtgtaaaaagctgcgg

SEQ ID NO: 142325 - DNA, 25 bp, Homo sapien
gccgcgacgacaaaaagccgtggag

SEQ ID NO: 142326 - DNA, 25 bp, Homo sapien
agccgcgacgacaaaaagccgtgga

SEQ ID NO: 142327 - DNA, 25 bp, Homo sapien
caaaaagctgcggcttttggcggcg

SEQ ID NO: 142328 - DNA, 25 bp, Homo sapien
ccgggaggtgtaaaaagctgcggcg

SEQ ID NO: 142329 - DNA, 25 bp, Homo sapien
ccgaggtggtgcttggggcaaaaag

SEQ ID NO: 142330 - DNA, 25 bp, Homo sapien
aaaagccgaggtggtgcttggggca

SEQ ID NO: 142331 - DNA, 25 bp, Homo sapien
gaggtggtgcttggggcaaaaagcc

SEQ ID NO: 142332 - DNA, 25 bp, Homo sapien
aaagccgaggtggtgcttggggcaa

SEQ ID NO: 142333 - DNA, 25 bp, Homo sapien
aagccgaggtggtgcttggggcaaa

SEQ ID NO: 142334 - DNA, 25 bp, Homo sapien
gccgaggtggtgcttggggcaaaaa

SEQ ID NO: 142335 - DNA, 25 bp, Homo sapien
cgaggtggtgcttggggcaaaaagc

SEQ ID NO: 142336 - DNA, 25 bp, Homo sapien
agccgaggtggtgcttggggcaaaa

SEQ ID NO: 142337 - DNA, 25 bp, Homo sapien
caaaaagccgccatagcgggggagc

SEQ ID NO: 142338 - DNA, 25 bp, Homo sapien
gcgccaaaaagttgcggagggcaaa

SEQ ID NO: 142339 - DNA, 25 bp, Homo sapien
cgaagggcaaaagagccgctgtgat

SEQ ID NO: 142340 - DNA, 25 bp, Homo sapien
aagggcaaaagagccgctgtgatga

SEQ ID NO: 142341 - DNA, 25 bp, Homo sapien
caaaagagccgctgtgatgagggtc

SEQ ID NO: 142342 - DNA, 25 bp, Homo sapien
aagagccgctgtgatgagggtcaaa

SEQ ID NO: 142343 - DNA, 25 bp, Homo sapien
gagccgctgtgatgagggtcaaaaa

SEQ ID NO: 142344 - DNA, 25 bp, Homo sapien
agccgccatagcgggggagcaaaaa

SEQ ID NO: 142345 - DNA, 25 bp, Homo sapien
tggtcccagcggttcagctgaggta

SEQ ID NO: 142346 - DNA, 25 bp, Homo sapien
gcagcgtcgctcaggttcacagaac

SEQ ID NO: 142347 - DNA, 25 bp, Homo sapien
gtcgctcaggttcacagaacacgcc

SEQ ID NO: 142348 - DNA, 25 bp, Homo sapien
cccaggggcgtgtccagctgtcgtc

SEQ ID NO: 142349 - DNA, 25 bp, Homo sapien
tccagctgtcgtcggggagagccca

SEQ ID NO: 142350 - DNA, 25 bp, Homo sapien
ttctcgtccagagcccaggtaatcc

SEQ ID NO: 142351 - DNA, 25 bp, Homo sapien
agcccaggtaatccgggcgggatca

SEQ ID NO: 142352 - DNA, 25 bp, Homo sapien
tacggcgtgttggtcccagcggttc

SEQ ID NO: 142353 - DNA, 25 bp, Homo sapien
ttcggtatagggaacaccagataac

SEQ ID NO: 142354 - DNA, 25 bp, Homo sapien
cacagcgccattagcggttaggttt

SEQ ID NO: 142355 - DNA, 25 bp, Homo sapien
cagtgccgaagagctgcaagaaaac

SEQ ID NO: 142356 - DNA, 25 bp, Homo sapien
cactacacgcaaagggcccgggacg

SEQ ID NO: 142357 - DNA, 25 bp, Homo sapien
cagcaggttccattcacgccaagtc

SEQ ID NO: 142358 - DNA, 25 bp, Homo sapien
gacatggaacaaccgtggccgcctc

SEQ ID NO: 142359 - DNA, 25 bp, Homo sapien
aagagagtgacttcgacgtgttccc

SEQ ID NO: 142360 - DNA, 25 bp, Homo sapien
atggagtggtgctgtcgccaaaccc

SEQ ID NO: 142361 - DNA, 25 bp, Homo sapien
cacaggctgcaaagcgcagcgatta

SEQ ID NO: 142362 - DNA, 25 bp, Homo sapien
cgcacatggccagggcgtttagcac

SEQ ID NO: 142363 - DNA, 25 bp, Homo sapien
gagcgaggccgtgtcttccaactcc

SEQ ID NO: 142364 - DNA, 25 bp, Homo sapien
ttccaactccctcgacaggcgtgag

SEQ ID NO: 142365 - DNA, 25 bp, Homo sapien
ggcggctgtttgcaccaactcattt

SEQ ID NO: 142366 - DNA, 25 bp, Homo sapien
ctgggaagcatttgcacaggctgca

SEQ ID NO: 142367 - DNA, 25 bp, Homo sapien
tatacctcgcgctcgctgggaagca

SEQ ID NO: 142368 - DNA, 25 bp, Homo sapien
accaactcatttgccggcgtatacc

SEQ ID NO: 142369 - DNA, 25 bp, Homo sapien
cttcctgactgcacagagcaagagg

SEQ ID NO: 142370 - DNA, 25 bp, Homo sapien
gccttcctgactgcacagagcaaga

SEQ ID NO: 142371 - DNA, 25 bp, Homo sapien
gtgaccagacctggccgccttcctg

SEQ ID NO: 142372 - DNA, 25 bp, Homo sapien
attcagtggcggagtaaattaaacg

SEQ ID NO: 142373 - DNA, 25 bp, Homo sapien
caatcaattcagtggcggagtaaat

SEQ ID NO: 142374 - DNA, 25 bp, Homo sapien
acaatcaattcagtggcggagtaaa

SEQ ID NO: 142375 - DNA, 25 bp, Homo sapien
aaacaatcaattcagtggcggagta

SEQ ID NO: 142376 - DNA, 25 bp, Homo sapien
tttaaacaatcaattcagtggcgga

SEQ ID NO: 142377 - DNA, 25 bp, Homo sapien
gtagcgtgaaacttgcccaggaagc

SEQ ID NO: 142378 - DNA, 25 bp, Homo sapien
tgtgcgttttcttgcaagcctctgc

SEQ ID NO: 142379 - DNA, 25 bp, Homo sapien
tcacgcctgactagagcactctgct

SEQ ID NO: 142380 - DNA, 25 bp, Homo sapien
tctgcttcacagaggggcgttctgc

SEQ ID NO: 142381 - DNA, 25 bp, Homo sapien
ccgcactggatcctggtagcgtgaa

SEQ ID NO: 142382 - DNA, 25 bp, Homo sapien
ctccctggtgtgattttcgttcttt

SEQ ID NO: 142383 - DNA, 25 bp, Homo sapien
gaagccggaatttctcttcggagtc

SEQ ID NO: 142384 - DNA, 25 bp, Homo sapien
cgcgttcttcctccctggtgtgatt

SEQ ID NO: 142385 - DNA, 25 bp, Homo sapien
acggccatcgagatcgtggtgcaga

SEQ ID NO: 142386 - DNA, 25 bp, Homo sapien
tttacaggaaggcagaagcaatctc

SEQ ID NO: 142387 - DNA, 25 bp, Homo sapien
catcgagatcgtggtgcagatggcc

SEQ ID NO: 142388 - DNA, 25 bp, Homo sapien
agcgcaactacctgcccaactttat

SEQ ID NO: 142389 - DNA, 25 bp, Homo sapien
gcccaactttatccagagcgtgctg

SEQ ID NO: 142390 - DNA, 25 bp, Homo sapien
gccctggaatcaggcttttgggaca

SEQ ID NO: 142391 - DNA, 25 bp, Homo sapien
caggtactttagcaggacggccatc

SEQ ID NO: 142392 - DNA, 25 bp, Homo sapien
cagagcgtgctgtcgtccatcgacc

SEQ ID NO: 142393 - DNA, 25 bp, Homo sapien
tgcatctctgctgaaacccgtcggt

SEQ ID NO: 142394 - DNA, 25 bp, Homo sapien
tgtttcgcagggcttcaagacgctg

SEQ ID NO: 142395 - DNA, 25 bp, Homo sapien
ccgataacttgcagactgtggcgca

SEQ ID NO: 142396 - DNA, 25 bp, Homo sapien
tccactttgcctgtctgcgttgtgc

SEQ ID NO: 142397 - DNA, 25 bp, Homo sapien
gaagcgacaacgtcccgataacttg

SEQ ID NO: 142398 - DNA, 25 bp, Homo sapien
cactgctctcccttcgctgtgggga

SEQ ID NO: 142399 - DNA, 25 bp, Homo sapien
aggtgctgcaaaccggtctgccttc

SEQ ID NO: 142400 - DNA, 25 bp, Homo sapien
gtgaggtaagtttcctgtgcgtccc

SEQ ID NO: 142401 - DNA, 25 bp, Homo sapien
gcagccgcttgcaccagatcaaaca

SEQ ID NO: 142402 - DNA, 25 bp, Homo sapien
acgcattaagcaggcgccgcgagta

SEQ ID NO: 142403 - DNA, 25 bp, Homo sapien
ggaatcctaggtccctgactgagca

SEQ ID NO: 142404 - DNA, 25 bp, Homo sapien
cctcagtgacacttcgccggtgttc

SEQ ID NO: 142405 - DNA, 25 bp, Homo sapien
tgccgcgcacatattacgcattaag

SEQ ID NO: 142406 - DNA, 25 bp, Homo sapien
agagggcatggacttgatcaaccga

SEQ ID NO: 142407 - DNA, 25 bp, Homo sapien
cgcgagcttgcgctcaatagctatt

SEQ ID NO: 142408 - DNA, 25 bp, Homo sapien
ttcagcctgagtgacaacgacgtgg

SEQ ID NO: 142409 - DNA, 25 bp, Homo sapien
gcatggggctcgctaaaccttccga

SEQ ID NO: 142410 - DNA, 25 bp, Homo sapien
aacggaaagtcgatcgcctgcagga

SEQ ID NO: 142411 - DNA, 25 bp, Homo sapien
tgcaggatgcgcttctcgttcagta

SEQ ID NO: 142412 - DNA, 25 bp, Homo sapien
gcgtcctgagccgttcgaactgatc

SEQ ID NO: 142413 - DNA, 25 bp, Homo sapien
cctgctggtcgatgaggagattctc

SEQ ID NO: 142414 - DNA, 25 bp, Homo sapien
tggcgaaaccgaagtccgtcacctg

SEQ ID NO: 142415 - DNA, 25 bp, Homo sapien
cagtatgtgctcgacctgcttcatc

SEQ ID NO: 142416 - DNA, 25 bp, Homo sapien
caccaccttctgcttgttgaggatc

SEQ ID NO: 142417 - DNA, 25 bp, Homo sapien
cgcagtaagtatccgcgccgggaac

SEQ ID NO: 142418 - DNA, 25 bp, Homo sapien
tgcgcaccgacatcgatgcgacctg

SEQ ID NO: 142419 - DNA, 25 bp, Homo sapien
ggtacgcgcgctggactagctcacc

SEQ ID NO: 142420 - DNA, 25 bp, Homo sapien
ggaagcggccttgcaactcccttct

SEQ ID NO: 142421 - DNA, 25 bp, Homo sapien
cttctctggttctcccggttgcatt

SEQ ID NO: 142422 - DNA, 25 bp, Homo sapien
tcccggttgcatttacactggcttc

SEQ ID NO: 142423 - DNA, 25 bp, Homo sapien
cactggcttctgctttccgaaggaa

SEQ ID NO: 142424 - DNA, 25 bp, Homo sapien
acattttgtcctgcggtgcgactgc

SEQ ID NO: 142425 - DNA, 25 bp, Homo sapien
aggcacaggattccgcgggaagatc

SEQ ID NO: 142426 - DNA, 25 bp, Homo sapien
agcgccgtgtagctgtacctgcgaa

SEQ ID NO: 142427 - DNA, 25 bp, Homo sapien
caagctctcagtgcttctgtgggaa

SEQ ID NO: 142428 - DNA, 25 bp, Homo sapien
ttctgcgcctgtcttcttggaagga

SEQ ID NO: 142429 - DNA, 25 bp, Homo sapien
tgcccacacagactgcggggttccg

SEQ ID NO: 142430 - DNA, 25 bp, Homo sapien
gaagatcccgcagtttcgggccgtc

SEQ ID NO: 142431 - DNA, 25 bp, Homo sapien
ccgagtcagtctgctggtcactgga

SEQ ID NO: 142432 - DNA, 25 bp, Homo sapien
caggatgctgcctaacacagccgtc

SEQ ID NO: 142433 - DNA, 25 bp, Homo sapien
cccgactttggccagggaatgattt

SEQ ID NO: 142434 - DNA, 25 bp, Homo sapien
tcactcaagggatggaaactgtttc

SEQ ID NO: 142435 - DNA, 25 bp, Homo sapien
cgctgtgtacttcatcgggcattta

SEQ ID NO: 142436 - DNA, 25 bp, Homo sapien
cagcgcgagtaaacgggttgacatc

SEQ ID NO: 142437 - DNA, 25 bp, Homo sapien
ctttgaatttctgttggcgcagcca

SEQ ID NO: 142438 - DNA, 25 bp, Homo sapien
tcacaataatatacgggagcagccg

SEQ ID NO: 142439 - DNA, 25 bp, Homo sapien
cctccggtctcaaggaagcaggtga

SEQ ID NO: 142440 - DNA, 25 bp, Homo sapien
tttctctgcagagtgcgctgtgtac

SEQ ID NO: 142441 - DNA, 25 bp, Homo sapien
tgggattctcccatccggacgtggg

SEQ ID NO: 142442 - DNA, 25 bp, Homo sapien
tggtagcggccaatttgacagtttc

SEQ ID NO: 142443 - DNA, 25 bp, Homo sapien
ctcgcgtgctgctctgaagttgttc

SEQ ID NO: 142444 - DNA, 25 bp, Homo sapien
tggctccgcgtaagtgcctccttgt

SEQ ID NO: 142445 - DNA, 25 bp, Homo sapien
acctgtgtccgaaatgccggtgcga

SEQ ID NO: 142446 - DNA, 25 bp, Homo sapien
aaacaccgcggacagtcgggccagc

SEQ ID NO: 142447 - DNA, 25 bp, Homo sapien
tcagagcactgtccggtggtgccca

SEQ ID NO: 142448 - DNA, 25 bp, Homo sapien
taggtttcaccgtccgggctgatga

SEQ ID NO: 142449 - DNA, 25 bp, Homo sapien
gcctaaccctgattagcgctctaca

SEQ ID NO: 142450 - DNA, 25 bp, Homo sapien
cacgtgactaggggccaccgcctaa

SEQ ID NO: 142451 - DNA, 25 bp, Homo sapien
ggcgctttagccctcacgtgactag

SEQ ID NO: 142452 - DNA, 25 bp, Homo sapien
ccgtaatcggatccgggcgctttag

SEQ ID NO: 142453 - DNA, 25 bp, Homo sapien
ggctccatcagatcccgtaatcgga

SEQ ID NO: 142454 - DNA, 25 bp, Homo sapien
ggcatgggctccatcagatcccgta

SEQ ID NO: 142455 - DNA, 25 bp, Homo sapien
gggccctggcatgggctccatcaga

SEQ ID NO: 142456 - DNA, 25 bp, Homo sapien
gcgaccacccggtgctcagctcagg

SEQ ID NO: 142457 - DNA, 25 bp, Homo sapien
ccgcgaagtccgacccgggtgacag

SEQ ID NO: 142458 - DNA, 25 bp, Homo sapien
gaggtgcttcagctcgaagtgtgta

SEQ ID NO: 142459 - DNA, 25 bp, Homo sapien
tttcgtgctcccttgacaaccctgg

SEQ ID NO: 142460 - DNA, 25 bp, Homo sapien
cttggtttcgggatccacccgcatc

SEQ ID NO: 142461 - DNA, 25 bp, Homo sapien
cctcggagccgcttggtttcgggat

SEQ ID NO: 142462 - DNA, 25 bp, Homo sapien
attcccagccggatagaccgcgctc

SEQ ID NO: 142463 - DNA, 25 bp, Homo sapien
gttcccggaagtgagccgacagccc

SEQ ID NO: 142464 - DNA, 25 bp, Homo sapien
ttcagctcgaagtgtgtagtgatgc

SEQ ID NO: 142465 - DNA, 25 bp, Homo sapien
agcgagcctatcaccgggcctacga

SEQ ID NO: 142466 - DNA, 25 bp, Homo sapien
ctcctgatgaaaagcagagcgaacg

SEQ ID NO: 142467 - DNA, 25 bp, Homo sapien
cctacagcccggagtacaggcgcgg

SEQ ID NO: 142468 - DNA, 25 bp, Homo sapien
ggcctacgacccagactacgagcgg

SEQ ID NO: 142469 - DNA, 25 bp, Homo sapien
gcctggaccacgactttgggccatc

SEQ ID NO: 142470 - DNA, 25 bp, Homo sapien
ggcctggaccaagaccatgcgcgca

SEQ ID NO: 142471 - DNA, 25 bp, Homo sapien
gcccatcggggtcctcctgatgaaa

SEQ ID NO: 142472 - DNA, 25 bp, Homo sapien
gccggagcattgaccaggactacga

SEQ ID NO: 142473 - DNA, 25 bp, Homo sapien
ggagccgctggtgtcgtccatcacc

SEQ ID NO: 142474 - DNA, 25 bp, Homo sapien
cactgacaatgagctggatgagcca

SEQ ID NO: 142475 - DNA, 25 bp, Homo sapien
cgaagaccgcatgtcctacttaacc

SEQ ID NO: 142476 - DNA, 25 bp, Homo sapien
tgtcctacttaaccgccatgggcgc

SEQ ID NO: 142477 - DNA, 25 bp, Homo sapien
cgcggactatctgagttgcgacagc

SEQ ID NO: 142478 - DNA, 25 bp, Homo sapien
gacagccgcctcatcagtgactttg

SEQ ID NO: 142479 - DNA, 25 bp, Homo sapien
aaggaggcgcctacactgacaatga

SEQ ID NO: 142480 - DNA, 25 bp, Homo sapien
gtgactttgaagacacggacggtga

SEQ ID NO: 142481 - DNA, 25 bp, Homo sapien
ttggcttacacctcttcccatcgag

SEQ ID NO: 142482 - DNA, 25 bp, Homo sapien
ggcctctctcgtggctggacagaga

SEQ ID NO: 142483 - DNA, 25 bp, Homo sapien
ggacagagaaggctcctcgctcttc

SEQ ID NO: 142484 - DNA, 25 bp, Homo sapien
cacctcgagggacttacttaaatat

SEQ ID NO: 142485 - DNA, 25 bp, Homo sapien
ttgggccgtgcgcatttccttccct

SEQ ID NO: 142486 - DNA, 25 bp, Homo sapien
gctgctgtcacttgggctgcttcag

SEQ ID NO: 142487 - DNA, 25 bp, Homo sapien
tcagctgatcttgggctgctgcatg

SEQ ID NO: 142488 - DNA, 25 bp, Homo sapien
tccttcccgaagtccttggcttaca

SEQ ID NO: 142489 - DNA, 25 bp, Homo sapien
atctcgccgcgaaggcgcagagctt

SEQ ID NO: 142490 - DNA, 25 bp, Homo sapien
ttgctggttccagcgtggttcccac

SEQ ID NO: 142491 - DNA, 25 bp, Homo sapien
cgtcgcgattattgtccaagacttt

SEQ ID NO: 142492 - DNA, 25 bp, Homo sapien
agactttctcctagcagcagtggca

SEQ ID NO: 142493 - DNA, 25 bp, Homo sapien
gcttgtggggatccagcgcccacca

SEQ ID NO: 142494 - DNA, 25 bp, Homo sapien
cccgcttctggtgcagaatggagcc

SEQ ID NO: 142495 - DNA, 25 bp, Homo sapien
atcccggctattgggagacgctgcg

SEQ ID NO: 142496 - DNA, 25 bp, Homo sapien
ggctgcaggctaactccacgagcca

SEQ ID NO: 142497 - DNA, 25 bp, Homo sapien
tggcctccttgatgtccttgatggc

SEQ ID NO: 142498 - DNA, 25 bp, Homo sapien
cctctggtcgtcacagtccctggtg

SEQ ID NO: 142499 - DNA, 25 bp, Homo sapien
ggctaatgtcctggcgcatgaccca

SEQ ID NO: 142500 - DNA, 25 bp, Homo sapien
ggcgcatgacccagatgggctcttt

SEQ ID NO: 142501 - DNA, 25 bp, Homo sapien
ggtcctggttttcacctcctcgatg

SEQ ID NO: 142502 - DNA, 25 bp, Homo sapien
ccttgatggccagcgagatggcatc

SEQ ID NO: 142503 - DNA, 25 bp, Homo sapien
cccagatgggctctttgggctcgtc

SEQ ID NO: 142504 - DNA, 25 bp, Homo sapien
tccatcggcctctggtcgtcacagt

SEQ ID NO: 142505 - DNA, 25 bp, Homo sapien
ccggtactgcacagcataggcgctc

SEQ ID NO: 142506 - DNA, 25 bp, Homo sapien
cgtgtagacgtagcctgagtaggcc

SEQ ID NO: 142507 - DNA, 25 bp, Homo sapien
ctgagtaggccgcattcatggcttc

SEQ ID NO: 142508 - DNA, 25 bp, Homo sapien
tcgtgctccagcgagtggaagtgca

SEQ ID NO: 142509 - DNA, 25 bp, Homo sapien
ctccaagtggttcatggtgggagtc

SEQ ID NO: 142510 - DNA, 25 bp, Homo sapien
gcggcccacatagtgctgctgctgc

SEQ ID NO: 142511 - DNA, 25 bp, Homo sapien
tgctgttcctcttccacctcggggt

SEQ ID NO: 142512 - DNA, 25 bp, Homo sapien
attcatggcttcctcgtgctccagc

SEQ ID NO: 142513 - DNA, 25 bp, Homo sapien
attgacggcgtctccggaatgcgtc

SEQ ID NO: 142514 - DNA, 25 bp, Homo sapien
tgggaataaagctccgctccagccg

SEQ ID NO: 142515 - DNA, 25 bp, Homo sapien
cctgcctttcggaatgggttccaca

SEQ ID NO: 142516 - DNA, 25 bp, Homo sapien
cccagtttcctagccagcagctgtg

SEQ ID NO: 142517 - DNA, 25 bp, Homo sapien
tggccaacctctgcgcgaagcaacg

SEQ ID NO: 142518 - DNA, 25 bp, Homo sapien
cgcctgcgcttcaaattcggagatt

SEQ ID NO: 142519 - DNA, 25 bp, Homo sapien
tggtaccttgcctgacagctgggtc

SEQ ID NO: 142520 - DNA, 25 bp, Homo sapien
gtgttctctccggagtgactcccga

SEQ ID NO: 142521 - DNA, 25 bp, Homo sapien
ccacatcgttgtgtgcgcccgagta

SEQ ID NO: 142522 - DNA, 25 bp, Homo sapien
tccagtgagtggagaagttcgcctc

SEQ ID NO: 142523 - DNA, 25 bp, Homo sapien
gtgatgtccttcacaacccgctgca

SEQ ID NO: 142524 - DNA, 25 bp, Homo sapien
cctcctgaaggcgttagtgatgtcc

SEQ ID NO: 142525 - DNA, 25 bp, Homo sapien
actcacatgtgtgggttcctcctga

SEQ ID NO: 142526 - DNA, 25 bp, Homo sapien
tgcctcctccctagaagggctcgtg

SEQ ID NO: 142527 - DNA, 25 bp, Homo sapien
cacttctagggactcgaccgcgagc

SEQ ID NO: 142528 - DNA, 25 bp, Homo sapien
tgcgcccgagtaccttaaacacagg

SEQ ID NO: 142529 - DNA, 25 bp, Homo sapien
ccgctctgcaaagttgggcagctca

SEQ ID NO: 142530 - DNA, 25 bp, Homo sapien
cagctcagagcgcaagctttgcctc

SEQ ID NO: 142531 - DNA, 25 bp, Homo sapien
tccctgaaacgcgaccatgctgtta

SEQ ID NO: 142532 - DNA, 25 bp, Homo sapien
tccctttcactaggagcagccagtc

SEQ ID NO: 142533 - DNA, 25 bp, Homo sapien
tgggccatccgagggcgcctcctga

SEQ ID NO: 142534 - DNA, 25 bp, Homo sapien
tcctcctggcgttgcaaggtaaggc

SEQ ID NO: 142535 - DNA, 25 bp, Homo sapien
accatgctgttaaggggcgtcctcc

SEQ ID NO: 142536 - DNA, 25 bp, Homo sapien
agcgcaagctttgcctctcgacttc

SEQ ID NO: 142537 - DNA, 25 bp, Homo sapien
gccgccaccccgacctcagccagcg

SEQ ID NO: 142538 - DNA, 25 bp, Homo sapien
gccgggaggtgaagcagtcctccct

SEQ ID NO: 142539 - DNA, 25 bp, Homo sapien
ccgggaggtgaagcagtcctccctc

SEQ ID NO: 142540 - DNA, 25 bp, Homo sapien
ctcagccagcgtgcgctccccgggg

SEQ ID NO: 142541 - DNA, 25 bp, Homo sapien
ggcctctgctgacagatgtccgggc

SEQ ID NO: 142542 - DNA, 25 bp, Homo sapien
gcctctgctgacagatgtccgggcc

SEQ ID NO: 142543 - DNA, 25 bp, Homo sapien
cctctgctgacagatgtccgggccc

SEQ ID NO: 142544 - DNA, 25 bp, Homo sapien
ccacctggacctacccagacctaag

SEQ ID NO: 142545 - DNA, 25 bp, Homo sapien
gcatctcgatggagaacttcctgta

SEQ ID NO: 142546 - DNA, 25 bp, Homo sapien
aggtcccgagcaagaggaagaattc

SEQ ID NO: 142547 - DNA, 25 bp, Homo sapien
tgcctgctgtttcgccctcagtctg

SEQ ID NO: 142548 - DNA, 25 bp, Homo sapien
gccttccaagagagctctcccgaga

SEQ ID NO: 142549 - DNA, 25 bp, Homo sapien
cttcctgtaagttgcccggaggccg

SEQ ID NO: 142550 - DNA, 25 bp, Homo sapien
tccgggcctttcgtggaaggctcta

SEQ ID NO: 142551 - DNA, 25 bp, Homo sapien
gaaggctctatcgtccgcatctcga

SEQ ID NO: 142552 - DNA, 25 bp, Homo sapien
tggcgactccgagcaagaagacgtc

SEQ ID NO: 142553 - DNA, 25 bp, Homo sapien
gttccaaaccacgtggacgcgtctg

SEQ ID NO: 142554 - DNA, 25 bp, Homo sapien
tccggggcgctggtagtaaacagct

SEQ ID NO: 142555 - DNA, 25 bp, Homo sapien
cacgtctcttcggagagcgcgcaca

SEQ ID NO: 142556 - DNA, 25 bp, Homo sapien
cctcagctacgcagggtgcaacttc

SEQ ID NO: 142557 - DNA, 25 bp, Homo sapien
gtgcaacttcttgcgccaacgtctg

SEQ ID NO: 142558 - DNA, 25 bp, Homo sapien
caacgtctggtcctgtctaccctga

SEQ ID NO: 142559 - DNA, 25 bp, Homo sapien
cgtgtagcaacaaatccctggcgtc

SEQ ID NO: 142560 - DNA, 25 bp, Homo sapien
ggtgtctagtctctccgtcttcctg

SEQ ID NO: 142561 - DNA, 25 bp, Homo sapien
ccggctcccttggaaagatgccaca

SEQ ID NO: 142562 - DNA, 25 bp, Homo sapien
gccgctaacctgtatgcactctgta

SEQ ID NO: 142563 - DNA, 25 bp, Homo sapien
acacgtggcggtcgcaagtttattc

SEQ ID NO: 142564 - DNA, 25 bp, Homo sapien
actgggcagccacgaagtccatgta

SEQ ID NO: 142565 - DNA, 25 bp, Homo sapien
ccgcagcgcggttcgaaatggaaac

SEQ ID NO: 142566 - DNA, 25 bp, Homo sapien
gtgaccagtgtgcagtaatccttcc

SEQ ID NO: 142567 - DNA, 25 bp, Homo sapien
ggactttccagactgtcgctgcaca

SEQ ID NO: 142568 - DNA, 25 bp, Homo sapien
gtcacgtcgctgtcggatcccatat

SEQ ID NO: 142569 - DNA, 25 bp, Homo sapien
cccttggtaaatatagcgctcacgt

SEQ ID NO: 142570 - DNA, 25 bp, Homo sapien
gcgagttcatctgaggacagtccca

SEQ ID NO: 142571 - DNA, 25 bp, Homo sapien
gcccacgtgagctaaccttgaaatt

SEQ ID NO: 142572 - DNA, 25 bp, Homo sapien
gtcctcctaggaacactgcagagta

SEQ ID NO: 142573 - DNA, 25 bp, Homo sapien
ggtgtcgagatgacatcagcttcta

SEQ ID NO: 142574 - DNA, 25 bp, Homo sapien
actttgcaggaattgcgctcccaga

SEQ ID NO: 142575 - DNA, 25 bp, Homo sapien
cactcttggatcgaatgtgccttta

SEQ ID NO: 142576 - DNA, 25 bp, Homo sapien
ctcccagagtttgccggcagatctc

SEQ ID NO: 142577 - DNA, 25 bp, Homo sapien
cgcctgaggctgttgatgcgccgca

SEQ ID NO: 142578 - DNA, 25 bp, Homo sapien
agggcccacgcctgaggctgttgat

SEQ ID NO: 142579 - DNA, 25 bp, Homo sapien
acctgcgcccgagccagctttcttt

SEQ ID NO: 142580 - DNA, 25 bp, Homo sapien
cccgcgattggctcaactgtgggct

SEQ ID NO: 142581 - DNA, 25 bp, Homo sapien
tctcggttggcgctgcctttgcctc

SEQ ID NO: 142582 - DNA, 25 bp, Homo sapien
ttcttccccatgagaagttcgcctc

SEQ ID NO: 142583 - DNA, 25 bp, Homo sapien
atttccgccgcatccctccacttct

SEQ ID NO: 142584 - DNA, 25 bp, Homo sapien
ttttccacgactcggcaaacctgcc

SEQ ID NO: 142585 - DNA, 25 bp, Homo sapien
cccatcacccgtaaagagatttcca

SEQ ID NO: 142586 - DNA, 25 bp, Homo sapien
ccacaaatgttctgagcgtccagtc

SEQ ID NO: 142587 - DNA, 25 bp, Homo sapien
ctctgcctggaggtgaaatactctc

SEQ ID NO: 142588 - DNA, 25 bp, Homo sapien
ggcagctcttctggtcccttggagc

SEQ ID NO: 142589 - DNA, 25 bp, Homo sapien
ctgtcagaagaaccagcctgctctg

SEQ ID NO: 142590 - DNA, 25 bp, Homo sapien
accctcggctgcgtcagactttgag

SEQ ID NO: 142591 - DNA, 25 bp, Homo sapien
aaggctggtactgcgcctgtcactc

SEQ ID NO: 142592 - DNA, 25 bp, Homo sapien
gcagctgccgctcgtactcaactgg

SEQ ID NO: 142593 - DNA, 25 bp, Homo sapien
ttgcctcacttccaccaatcagagg

SEQ ID NO: 142594 - DNA, 25 bp, Homo sapien
tgagccaggagttggccactgactg

SEQ ID NO: 142595 - DNA, 25 bp, Homo sapien
agccaggtcttccttctctttaatc

SEQ ID NO: 142596 - DNA, 25 bp, Homo sapien
ctcatttcgaagaaagtgggacttg

SEQ ID NO: 142597 - DNA, 25 bp, Homo sapien
tgggacttgttctccgggtttgaga

SEQ ID NO: 142598 - DNA, 25 bp, Homo sapien
cgtggagtggcttggcttaacagca

SEQ ID NO: 142599 - DNA, 25 bp, Homo sapien
gcgctgtcctccacaaggcgagatc

SEQ ID NO: 142600 - DNA, 25 bp, Homo sapien
atttgatggactacacattcgggcc

SEQ ID NO: 142601 - DNA, 25 bp, Homo sapien
ctcgcgggagaaaaatcctattggc

SEQ ID NO: 142602 - DNA, 25 bp, Homo sapien
gccgctgacatgtgtgccgctcaga

SEQ ID NO: 142603 - DNA, 25 bp, Homo sapien
tggcgcacatcttccgagggacgtt

SEQ ID NO: 142604 - DNA, 25 bp, Homo sapien
gggacgttcgtccactccacctgga

SEQ ID NO: 142605 - DNA, 25 bp, Homo sapien
ggatcacctcctcggcgtgagcgac

SEQ ID NO: 142606 - DNA, 25 bp, Homo sapien
caacgcagagagaaccctggcgcta

SEQ ID NO: 142607 - DNA, 25 bp, Homo sapien
cgtgctaacgccacaactggctcga

SEQ ID NO: 142608 - DNA, 25 bp, Homo sapien
gagtctttggctcttgggcaacgca

SEQ ID NO: 142609 - DNA, 25 bp, Homo sapien
taagggcccgctgatggcgctcttc

SEQ ID NO: 142610 - DNA, 25 bp, Homo sapien
ttgctgtgccttctcgcggagccca

SEQ ID NO: 142611 - DNA, 25 bp, Homo sapien
cccgcgtaggagatgcacacagctc

SEQ ID NO: 142612 - DNA, 25 bp, Homo sapien
ggccgcagcggctaacgctgctcga

SEQ ID NO: 142613 - DNA, 25 bp, Homo sapien
ggggtcttcctttgttcctgcagca

SEQ ID NO: 142614 - DNA, 25 bp, Homo sapien
ctgcagggtcccaaatgcgaaagcc

SEQ ID NO: 142615 - DNA, 25 bp, Homo sapien
cggtgccctgtcagtaggtccagga

SEQ ID NO: 142616 - DNA, 25 bp, Homo sapien
gagtcctgtggaggatgcgtttcta

SEQ ID NO: 142617 - DNA, 25 bp, Homo sapien
ataaattcaaaactaactctgccgg

SEQ ID NO: 142618 - DNA, 25 bp, Homo sapien
ccgaagtttacccaaatagcgctcg

SEQ ID NO: 142619 - DNA, 25 bp, Homo sapien
tttacccaaatagcgctcggcaaag

SEQ ID NO: 142620 - DNA, 25 bp, Homo sapien
ctcggcaaagcgctgccataaattc

SEQ ID NO: 142621 - DNA, 25 bp, Homo sapien
tgcgagacagggaccgaacgtgaaa

SEQ ID NO: 142622 - DNA, 25 bp, Homo sapien
cgcgtctcttgcctccgaaggtttt

SEQ ID NO: 142623 - DNA, 25 bp, Homo sapien
tcttgcctccgaaggttttccgtga

SEQ ID NO: 142624 - DNA, 25 bp, Homo sapien
ttctctgcccagttcggacagtctc

SEQ ID NO: 142625 - DNA, 25 bp, Homo sapien
ccctgtgatcaacgccgctgcagct

SEQ ID NO: 142626 - DNA, 25 bp, Homo sapien
tttgtctgggcaaagagtttccggc

SEQ ID NO: 142627 - DNA, 25 bp, Homo sapien
ttgtctgggcaaagagtttccggct

SEQ ID NO: 142628 - DNA, 25 bp, Homo sapien
tgtctgggcaaagagtttccggcta

SEQ ID NO: 142629 - DNA, 25 bp, Homo sapien
gtctgggcaaagagtttccggctaa

SEQ ID NO: 142630 - DNA, 25 bp, Homo sapien
tctgggcaaagagtttccggctaac

SEQ ID NO: 142631 - DNA, 25 bp, Homo sapien
gtttccggctaaccccctgtgatca

SEQ ID NO: 142632 - DNA, 25 bp, Homo sapien
actttgtctgggcaaagagtttccg

SEQ ID NO: 142633 - DNA, 25 bp, Homo sapien
ggcattctccatccgctgcaagata

SEQ ID NO: 142634 - DNA, 25 bp, Homo sapien
ctgcaagataaactttgtctgggca

SEQ ID NO: 142635 - DNA, 25 bp, Homo sapien
tccatccgctgcaagataaactttg

SEQ ID NO: 142636 - DNA, 25 bp, Homo sapien
cacgctgaagggcattctccatccg

SEQ ID NO: 142637 - DNA, 25 bp, Homo sapien
accgacatgccagcagggcgagccg

SEQ ID NO: 142638 - DNA, 25 bp, Homo sapien
caagcagcaccgacatgccagcagg

SEQ ID NO: 142639 - DNA, 25 bp, Homo sapien
ccgagacgatcctgaattccaagca

SEQ ID NO: 142640 - DNA, 25 bp, Homo sapien
tccgctgcaagataaactttgtctg

SEQ ID NO: 142641 - DNA, 25 bp, Homo sapien
cacggcgtccgcctaaagggatggt

SEQ ID NO: 142642 - DNA, 25 bp, Homo sapien
cttttttgcttgtcgctctcgggtg

SEQ ID NO: 142643 - DNA, 25 bp, Homo sapien
ggttcttaccagtccttgagttgca

SEQ ID NO: 142644 - DNA, 25 bp, Homo sapien
gagacaggctagttggttcttacca

SEQ ID NO: 142645 - DNA, 25 bp, Homo sapien
ttgcgggaaggtgttgatgtctttc

SEQ ID NO: 142646 - DNA, 25 bp, Homo sapien
gggagcagcttcatgactacgcgga

SEQ ID NO: 142647 - DNA, 25 bp, Homo sapien
ccttcttcactcgtgctgagcggga

SEQ ID NO: 142648 - DNA, 25 bp, Homo sapien
agcggccacaccatgcgaggtaagc

SEQ ID NO: 142649 - DNA, 25 bp, Homo sapien
tcaggtttccttcgcgctgtgctcg

SEQ ID NO: 142650 - DNA, 25 bp, Homo sapien
caggaccctcgcagtcgcaggcggt

SEQ ID NO: 142651 - DNA, 25 bp, Homo sapien
cggggagtcacttggtctcctctcc

SEQ ID NO: 142652 - DNA, 25 bp, Homo sapien
cttgccggagacctcaggtttcctt

SEQ ID NO: 142653 - DNA, 25 bp, Homo sapien
cgccagggactgtagcgttacgctt

SEQ ID NO: 142654 - DNA, 25 bp, Homo sapien
gacctcaggtttccttcgcgctgtg

SEQ ID NO: 142655 - DNA, 25 bp, Homo sapien
tgtagcgttacgcttgctccggctg

SEQ ID NO: 142656 - DNA, 25 bp, Homo sapien
gttacgcttgctccggctggactct

SEQ ID NO: 142657 - DNA, 25 bp, Homo sapien
ccctgccgtccagtcgcccaggggt

SEQ ID NO: 142658 - DNA, 25 bp, Homo sapien
gctgcggtggaacttacacgggtta

SEQ ID NO: 142659 - DNA, 25 bp, Homo sapien
ggtctcacgctgttgaagtcctcca

SEQ ID NO: 142660 - DNA, 25 bp, Homo sapien
cgctgttgaagtcctccaggttgaa

SEQ ID NO: 142661 - DNA, 25 bp, Homo sapien
tgttgaagtcctccaggttgaaggg

SEQ ID NO: 142662 - DNA, 25 bp, Homo sapien
ccctggcctgcatggctagtcaaag

SEQ ID NO: 142663 - DNA, 25 bp, Homo sapien
tgcatggctagtcaaagcggccggt

SEQ ID NO: 142664 - DNA, 25 bp, Homo sapien
acgatcggctgacgccagcgaggac

SEQ ID NO: 142665 - DNA, 25 bp, Homo sapien
ggagcggaatcagagctgcctcctc

SEQ ID NO: 142666 - DNA, 25 bp, Homo sapien
gtgtttaccgtaaccggcgctgtca

SEQ ID NO: 142667 - DNA, 25 bp, Homo sapien
ggacggccgtctgggcacttctcca

SEQ ID NO: 142668 - DNA, 25 bp, Homo sapien
tccgggtctgagatctgtgcccgtg

SEQ ID NO: 142669 - DNA, 25 bp, Homo sapien
gatctgtgcccgtggcagctcaaaa

SEQ ID NO: 142670 - DNA, 25 bp, Homo sapien
gtggcagctcaaaacgcgccttctc

SEQ ID NO: 142671 - DNA, 25 bp, Homo sapien
tcctccggattctcagctcaagcca

SEQ ID NO: 142672 - DNA, 25 bp, Homo sapien
tggccgcatcccagctcttgaaacg

SEQ ID NO: 142673 - DNA, 25 bp, Homo sapien
cggagattcgaacctgcgcacaacg

SEQ ID NO: 142674 - DNA, 25 bp, Homo sapien
catggtccctgcgtcgattttgcgc

SEQ ID NO: 142675 - DNA, 25 bp, Homo sapien
tcagcgaagtcgcaaagcaggagcc

SEQ ID NO: 142676 - DNA, 25 bp, Homo sapien
gctttctgcccatcggactctcggg

SEQ ID NO: 142677 - DNA, 25 bp, Homo sapien
ttccaaggcacgtggaacgtcaccg

SEQ ID NO: 142678 - DNA, 25 bp, Homo sapien
cccggacgttgagaagcaaccgcga

SEQ ID NO: 142679 - DNA, 25 bp, Homo sapien
ggcgtcttaacctacacaagtcatg

SEQ ID NO: 142680 - DNA, 25 bp, Homo sapien
ggatcgcctgtctccagaccgtggt

SEQ ID NO: 142681 - DNA, 25 bp, Homo sapien
tgacgtcacaaccacgcttccaagg

SEQ ID NO: 142682 - DNA, 25 bp, Homo sapien
agggctcccagaaccaatgcgcatg

SEQ ID NO: 142683 - DNA, 25 bp, Homo sapien
cgccaggtcttcagggctcccagaa

SEQ ID NO: 142684 - DNA, 25 bp, Homo sapien
gctgcttggccttcctctagacggc

SEQ ID NO: 142685 - DNA, 25 bp, Homo sapien
caacgcccggcggaaaactgcactt

SEQ ID NO: 142686 - DNA, 25 bp, Homo sapien
gatcttccagaagtgctcacgctca

SEQ ID NO: 142687 - DNA, 25 bp, Homo sapien
cccgtagtagcggaaggcattaatg

SEQ ID NO: 142688 - DNA, 25 bp, Homo sapien
tgggacttaaaagccggcgagtgcc

SEQ ID NO: 142689 - DNA, 25 bp, Homo sapien
ggcgctcttagttttgcgttcgctg

SEQ ID NO: 142690 - DNA, 25 bp, Homo sapien
tggcgccagttcgagtcctcccaaa

SEQ ID NO: 142691 - DNA, 25 bp, Homo sapien
ctcctcctgggttagagggatgcca

SEQ ID NO: 142692 - DNA, 25 bp, Homo sapien
ccgggagccaattagcgctcggcta

SEQ ID NO: 142693 - DNA, 25 bp, Homo sapien
ggcgcacggttgtaagccagacaaa

SEQ ID NO: 142694 - DNA, 25 bp, Homo sapien
ggggtctttaggatttgcagctcca

SEQ ID NO: 142695 - DNA, 25 bp, Homo sapien
cgagatgtcgaagccgccacccaaa

SEQ ID NO: 142696 - DNA, 25 bp, Homo sapien
caaacacagcggcagaggcgacagc

SEQ ID NO: 142697 - DNA, 25 bp, Homo sapien
ggagcgctcttctcagtcctttgga

SEQ ID NO: 142698 - DNA, 25 bp, Homo sapien
atcttcagggcggttaattcgcacc

SEQ ID NO: 142699 - DNA, 25 bp, Homo sapien
acccggaggcgctaggacctcgtca

SEQ ID NO: 142700 - DNA, 25 bp, Homo sapien
cgtttagaacgaggatgaatgaatc

SEQ ID NO: 142701 - DNA, 25 bp, Homo sapien
gaaagacttgcctttactgcccgga

SEQ ID NO: 142702 - DNA, 25 bp, Homo sapien
cgcaccggcgtgtaaatttctttag

SEQ ID NO: 142703 - DNA, 25 bp, Homo sapien
cgggaagtggcggtaaattcataca

SEQ ID NO: 142704 - DNA, 25 bp, Homo sapien
gtaaattcatacaaatccagcaggg

SEQ ID NO: 142705 - DNA, 25 bp, Homo sapien
gaaagcctttcctgctcggacctga

SEQ ID NO: 142706 - DNA, 25 bp, Homo sapien
ttcctcttgggcgagagaacctctg

SEQ ID NO: 142707 - DNA, 25 bp, Homo sapien
ttttccaagccacgcgggactggta

SEQ ID NO: 142708 - DNA, 25 bp, Homo sapien
taactcttgggcgatgctctgtctc

SEQ ID NO: 142709 - DNA, 25 bp, Homo sapien
atgtgctctagcagctgttgcccta

SEQ ID NO: 142710 - DNA, 25 bp, Homo sapien
cggattcatcaacataggacaggta

SEQ ID NO: 142711 - DNA, 25 bp, Homo sapien
aggccaaccgtatcgccagcaagta

SEQ ID NO: 142712 - DNA, 25 bp, Homo sapien
tggcttcagagacggctggaccttt

SEQ ID NO: 142713 - DNA, 25 bp, Homo sapien
gaggatgatggatggcgcctttcca

SEQ ID NO: 142714 - DNA, 25 bp, Homo sapien
cgcctttccagcaggcgcgctttgg

SEQ ID NO: 142715 - DNA, 25 bp, Homo sapien
acgcaccctgcgtgctctgccaggg

SEQ ID NO: 142716 - DNA, 25 bp, Homo sapien
agagtacggacagtttctgaggcca

SEQ ID NO: 142717 - DNA, 25 bp, Homo sapien
tacggacagtttctgaggccattgc

SEQ ID NO: 142718 - DNA, 25 bp, Homo sapien
tttctgaggccattgcgttccacgc

SEQ ID NO: 142719 - DNA, 25 bp, Homo sapien
ggccattgcgttccacgcccaggaa

SEQ ID NO: 142720 - DNA, 25 bp, Homo sapien
cgagaatccgctggaatgggaggtg

SEQ ID NO: 142721 - DNA, 25 bp, Homo sapien
tcaccgggacctaagcagagcgcct

SEQ ID NO: 142722 - DNA, 25 bp, Homo sapien
gccgggtctccatgagtctgatttc

SEQ ID NO: 142723 - DNA, 25 bp, Homo sapien
tttcccgcggaaaagcacagaatgc

SEQ ID NO: 142724 - DNA, 25 bp, Homo sapien
aaggacgaccgcacccgaacacagg

SEQ ID NO: 142725 - DNA, 25 bp, Homo sapien
gggaatcccagcctcgtcgtcacta

SEQ ID NO: 142726 - DNA, 25 bp, Homo sapien
gcgcctgcccgagaatagggagaca

SEQ ID NO: 142727 - DNA, 25 bp, Homo sapien
cttggagggcctgaaatttctacgt

SEQ ID NO: 142728 - DNA, 25 bp, Homo sapien
acacacacttcatgctcctgcaggg

SEQ ID NO: 142729 - DNA, 25 bp, Homo sapien
cctcataatgcagtccgctcgggga

SEQ ID NO: 142730 - DNA, 25 bp, Homo sapien
cctgttcataacaatccggaagcca

SEQ ID NO: 142731 - DNA, 25 bp, Homo sapien
cctgagagccgcgaaagcacaattc

SEQ ID NO: 142732 - DNA, 25 bp, Homo sapien
gcctaatgtctggatcccgggcttc

SEQ ID NO: 142733 - DNA, 25 bp, Homo sapien
gtcctccgccacagacaaggggatg

SEQ ID NO: 142734 - DNA, 25 bp, Homo sapien
tcctgcgattcatctcgggcttccg

SEQ ID NO: 142735 - DNA, 25 bp, Homo sapien
accaactgtaccttggctggccaag

SEQ ID NO: 142736 - DNA, 25 bp, Homo sapien
tggcgatgggaactaatgtggaaac

SEQ ID NO: 142737 - DNA, 25 bp, Homo sapien
gggtcagacgcccactccaggtaac

SEQ ID NO: 142738 - DNA, 25 bp, Homo sapien
ggaaccgcgagtccgcagcaagtcc

SEQ ID NO: 142739 - DNA, 25 bp, Homo sapien
actaggatcgcagcgctactcccag

SEQ ID NO: 142740 - DNA, 25 bp, Homo sapien
gctgggcatcctcctgagactccgg

SEQ ID NO: 142741 - DNA, 25 bp, Homo sapien
cctggtccgtgtagcttagatgtcg

SEQ ID NO: 142742 - DNA, 25 bp, Homo sapien
cttcattttccgtccgctcagtggg

SEQ ID NO: 142743 - DNA, 25 bp, Homo sapien
caggtaaccggctctccctcgtgtt

SEQ ID NO: 142744 - DNA, 25 bp, Homo sapien
tcctcctgagactccggggtcagac

SEQ ID NO: 142745 - DNA, 25 bp, Homo sapien
cacgcaacgcacgttcgtggggaac

SEQ ID NO: 142746 - DNA, 25 bp, Homo sapien
ttagcagagcagctcgttcgatgcg

SEQ ID NO: 142747 - DNA, 25 bp, Homo sapien
acttagcagagcagctcgttcgatg

SEQ ID NO: 142748 - DNA, 25 bp, Homo sapien
gagcctcggttggcctcggatagcc

SEQ ID NO: 142749 - DNA, 25 bp, Homo sapien
tcggttggcctcggatagccggtcc

SEQ ID NO: 142750 - DNA, 25 bp, Homo sapien
cgcaacgcacgttcgtggggaacct

SEQ ID NO: 142751 - DNA, 25 bp, Homo sapien
ccctcgcccgtcacgcaacgcacgt

SEQ ID NO: 142752 - DNA, 25 bp, Homo sapien
cgtcacgcaacgcacgttcgtgggg

SEQ ID NO: 142753 - DNA, 25 bp, Homo sapien
ttcgcagaccttgacccgccgggta

SEQ ID NO: 142754 - DNA, 25 bp, Homo sapien
cagcctggaggtcgttcagagccgt

SEQ ID NO: 142755 - DNA, 25 bp, Homo sapien
tgttcgcgtcgccacttcggcttct

SEQ ID NO: 142756 - DNA, 25 bp, Homo sapien
caaccgggaggctgagttcgaagct

SEQ ID NO: 142757 - DNA, 25 bp, Homo sapien
attcggggagactgcaggccaaccg

SEQ ID NO: 142758 - DNA, 25 bp, Homo sapien
gcccggtctcctgccattcggggag

SEQ ID NO: 142759 - DNA, 25 bp, Homo sapien
agggtgagtcactcccggccgcttc

SEQ ID NO: 142760 - DNA, 25 bp, Homo sapien
aggggccgtcccaggaatctccacg

SEQ ID NO: 142761 - DNA, 25 bp, Homo sapien
ccagtttagatttggcgcgttgcaa

SEQ ID NO: 142762 - DNA, 25 bp, Homo sapien
cttaatgatctggtcggctggcctg

SEQ ID NO: 142763 - DNA, 25 bp, Homo sapien
ttgcaaaaattcttccatgtcgtgg

SEQ ID NO: 142764 - DNA, 25 bp, Homo sapien
gcacccgactctgccctaataagga

SEQ ID NO: 142765 - DNA, 25 bp, Homo sapien
cgcgccgaaagctgctgcaaccatg

SEQ ID NO: 142766 - DNA, 25 bp, Homo sapien
gcactccggcggtcacttaatgatc

SEQ ID NO: 142767 - DNA, 25 bp, Homo sapien
gctttgctcactcaacttaccagtt

SEQ ID NO: 142768 - DNA, 25 bp, Homo sapien
cccagaagtgcgagccaagtgcaag

SEQ ID NO: 142769 - DNA, 25 bp, Homo sapien
aggcagtgtacacagccgcggtgtt

SEQ ID NO: 142770 - DNA, 25 bp, Homo sapien
tcagacgagagcctggggtcaatgt

SEQ ID NO: 142771 - DNA, 25 bp, Homo sapien
cgcgagcggaggtgctagaaacttt

SEQ ID NO: 142772 - DNA, 25 bp, Homo sapien
actgcgagagaaagccgtgtgcacc

SEQ ID NO: 142773 - DNA, 25 bp, Homo sapien
gctgtctttcttggccggtggcact

SEQ ID NO: 142774 - DNA, 25 bp, Homo sapien
ctcgcctcgaagagtggagatttaa

SEQ ID NO: 142775 - DNA, 25 bp, Homo sapien
cggtgttcgagacgaatctcgcctc

SEQ ID NO: 142776 - DNA, 25 bp, Homo sapien
ctttgcggagtgagtttcggtcaga

SEQ ID NO: 142777 - DNA, 25 bp, Homo sapien
agggatgcacttcgcagagatgtca

SEQ ID NO: 142778 - DNA, 25 bp, Homo sapien
ctggaggcgacggattcctaaaacg

SEQ ID NO: 142779 - DNA, 25 bp, Homo sapien
atgtcaggtcgggttggtgacgctg

SEQ ID NO: 142780 - DNA, 25 bp, Homo sapien
acgctggaggcgacggattcctaaa

SEQ ID NO: 142781 - DNA, 25 bp, Homo sapien
cttcgcagagatgtcaggtcgggtt

SEQ ID NO: 142782 - DNA, 25 bp, Homo sapien
atgcacttcgcagagatgtcaggtc

SEQ ID NO: 142783 - DNA, 25 bp, Homo sapien
cccagctgcgcagctcctgagctcc

SEQ ID NO: 142784 - DNA, 25 bp, Homo sapien
cacttcgcagagatgtcaggtcggg

SEQ ID NO: 142785 - DNA, 25 bp, Homo sapien
cgaagtccggagagcccttaagtgt

SEQ ID NO: 142786 - DNA, 25 bp, Homo sapien
gatccctttgctcgagctgcgtgtg

SEQ ID NO: 142787 - DNA, 25 bp, Homo sapien
tgctgttccagcaacccgcggaagg

SEQ ID NO: 142788 - DNA, 25 bp, Homo sapien
tgtctgcgctctaggcagcaattgc

SEQ ID NO: 142789 - DNA, 25 bp, Homo sapien
gcgcctgcaaaacttgtcggaatta

SEQ ID NO: 142790 - DNA, 25 bp, Homo sapien
ctccgagactgttttgtcccaggtt

SEQ ID NO: 142791 - DNA, 25 bp, Homo sapien
ggctcattttttgtgctcagggttc

SEQ ID NO: 142792 - DNA, 25 bp, Homo sapien
ggttcgcgttatgcgcccaagattt

SEQ ID NO: 142793 - DNA, 25 bp, Homo sapien
ttcatcaagattccgcggaggcccg

SEQ ID NO: 142794 - DNA, 25 bp, Homo sapien
tggcaatccagcactcggccgagaa

SEQ ID NO: 142795 - DNA, 25 bp, Homo sapien
cgaccagcctggcaagggtagcttc

SEQ ID NO: 142796 - DNA, 25 bp, Homo sapien
ccatactcacttgcacgcgggaagc

SEQ ID NO: 142797 - DNA, 25 bp, Homo sapien
cgccgcacatggtacactatttcca

SEQ ID NO: 142798 - DNA, 25 bp, Homo sapien
agccagctccagcactcagtctttg

SEQ ID NO: 142799 - DNA, 25 bp, Homo sapien
ggggccagaagttgccagcttccga

SEQ ID NO: 142800 - DNA, 25 bp, Homo sapien
caaggtcggagacaccaggcaattc

SEQ ID NO: 142801 - DNA, 25 bp, Homo sapien
gcctagaagacctgttgcgcgccga

SEQ ID NO: 142802 - DNA, 25 bp, Homo sapien
ctgctgcagagctgctctgggagtg

SEQ ID NO: 142803 - DNA, 25 bp, Homo sapien
tgccgctgccgcatcaactaggcaa

SEQ ID NO: 142804 - DNA, 25 bp, Homo sapien
gcatcaactaggcaagcgcgcccag

SEQ ID NO: 142805 - DNA, 25 bp, Homo sapien
accgccgcctagaagacctgttgcg

SEQ ID NO: 142806 - DNA, 25 bp, Homo sapien
tagaagacctgttgcgcgccgacac

SEQ ID NO: 142807 - DNA, 25 bp, Homo sapien
accgcagagttcttggtgggtgaaa

SEQ ID NO: 142808 - DNA, 25 bp, Homo sapien
ctcgagctgcgggaagggaaccctt

SEQ ID NO: 142809 - DNA, 25 bp, Homo sapien
tccggctgggtaagcgccagataca

SEQ ID NO: 142810 - DNA, 25 bp, Homo sapien
cagcgctttccagcgggagcccgga

SEQ ID NO: 142811 - DNA, 25 bp, Homo sapien
tcaggtctggcagccggtcccgcat

SEQ ID NO: 142812 - DNA, 25 bp, Homo sapien
accgccgtcaggtctggcagccggt

SEQ ID NO: 142813 - DNA, 25 bp, Homo sapien
tgacggacagggagccacgctcgaa

SEQ ID NO: 142814 - DNA, 25 bp, Homo sapien
atccgccaagcggagtgacggacag

SEQ ID NO: 142815 - DNA, 25 bp, Homo sapien
cgccagatacaatccgccaagcgga

SEQ ID NO: 142816 - DNA, 25 bp, Homo sapien
cggaccacagttaggccagtgggct

SEQ ID NO: 142817 - DNA, 25 bp, Homo sapien
ccacggctgaggaacatggttttcg

SEQ ID NO: 142818 - DNA, 25 bp, Homo sapien
catgagtgcgggatgaaaaggtcta

SEQ ID NO: 142819 - DNA, 25 bp, Homo sapien
ggcctccgccctcgagttgtttata

SEQ ID NO: 142820 - DNA, 25 bp, Homo sapien
cgcctgtgggtcaagttacgtaaag

SEQ ID NO: 142821 - DNA, 25 bp, Homo sapien
ctctctctgggcatctggaaaggta

SEQ ID NO: 142822 - DNA, 25 bp, Homo sapien
aaggtctatattttccgagcggagc

SEQ ID NO: 142823 - DNA, 25 bp, Homo sapien
ttggacacgtcccagctctctctgg

SEQ ID NO: 142824 - DNA, 25 bp, Homo sapien
agccggtgaaccgaattacctcgag

SEQ ID NO: 142825 - DNA, 25 bp, Homo sapien
agtttcgccaactcactcgctcgga

SEQ ID NO: 142826 - DNA, 25 bp, Homo sapien
ttgcctggaaagttctgaaaacctc

SEQ ID NO: 142827 - DNA, 25 bp, Homo sapien
tcccgctagcgtttgtggctctaag

SEQ ID NO: 142828 - DNA, 25 bp, Homo sapien
aggcggagcatcttgaacctgcagc

SEQ ID NO: 142829 - DNA, 25 bp, Homo sapien
gtcccggccaaggtttgctgtaatc

SEQ ID NO: 142830 - DNA, 25 bp, Homo sapien
ttccgacaggtgagtgagtttcgcc

SEQ ID NO: 142831 - DNA, 25 bp, Homo sapien
ggccgacttgagctttggagtaaga

SEQ ID NO: 142832 - DNA, 25 bp, Homo sapien
gcgcgtccttcttgtcccgacgaag

SEQ ID NO: 142833 - DNA, 25 bp, Homo sapien
cctggcggcgagagctcattcaccg

SEQ ID NO: 142834 - DNA, 25 bp, Homo sapien
ccgcaccctcggcagagtccgcggg

SEQ ID NO: 142835 - DNA, 25 bp, Homo sapien
ctctgcggacgcctactgctcccgc

SEQ ID NO: 142836 - DNA, 25 bp, Homo sapien
ctcccagtgcggctctcgcctcgcc

SEQ ID NO: 142837 - DNA, 25 bp, Homo sapien
tctctgaactggagcacagatccgg

SEQ ID NO: 142838 - DNA, 25 bp, Homo sapien
gcggagcggctgctcagtgcgagcc

SEQ ID NO: 142839 - DNA, 25 bp, Homo sapien
agtctgggccgacgggagaagagag

SEQ ID NO: 142840 - DNA, 25 bp, Homo sapien
tttctctgaactggagcacagatcc

SEQ ID NO: 142841 - DNA, 25 bp, Homo sapien
tcaaggcgaagaccctgcacgcagc

SEQ ID NO: 142842 - DNA, 25 bp, Homo sapien
tgcacgcagcgctcaccaccacctg

SEQ ID NO: 142843 - DNA, 25 bp, Homo sapien
gcttagacttgctgtagcccttgtc

SEQ ID NO: 142844 - DNA, 25 bp, Homo sapien
agtacctctgcttagacttgctgta

SEQ ID NO: 142845 - DNA, 25 bp, Homo sapien
tatggttgaaaacgcagtacctctg

SEQ ID NO: 142846 - DNA, 25 bp, Homo sapien
cgtcctcgttatggttgaaaacgca

SEQ ID NO: 142847 - DNA, 25 bp, Homo sapien
ccctgatggcattgcggtagcggaa

SEQ ID NO: 142848 - DNA, 25 bp, Homo sapien
ccagcaccctgatggcattgcggta

SEQ ID NO: 142849 - DNA, 25 bp, Homo sapien
tgttcgaccttcacgcccaagacgg

SEQ ID NO: 142850 - DNA, 25 bp, Homo sapien
tccggctgatcacgcgcatggatta

SEQ ID NO: 142851 - DNA, 25 bp, Homo sapien
ggtctactacctactacagcctgga

SEQ ID NO: 142852 - DNA, 25 bp, Homo sapien
ttggagctgatcaagttccggaccc

SEQ ID NO: 142853 - DNA, 25 bp, Homo sapien
gccaaggggtacactggtctcagga

SEQ ID NO: 142854 - DNA, 25 bp, Homo sapien
tggactttgagaagcccgactgtga

SEQ ID NO: 142855 - DNA, 25 bp, Homo sapien
ttcccagaggagatggctacgtacc

SEQ ID NO: 142856 - DNA, 25 bp, Homo sapien
agcttgacaggtacggcgtgctaca

SEQ ID NO: 142857 - DNA, 25 bp, Homo sapien
atcccggcgcctcagaggactatga

SEQ ID NO: 142858 - DNA, 25 bp, Homo sapien
tgctggatttcaacgccgaccgcct

SEQ ID NO: 142859 - DNA, 25 bp, Homo sapien
ggccatgatcgactccgtgaagctg

SEQ ID NO: 142860 - DNA, 25 bp, Homo sapien
cgcacagcgagcacgttgacgtctt

SEQ ID NO: 142861 - DNA, 25 bp, Homo sapien
cggatcgatcagtaaactctttcgc

SEQ ID NO: 142862 - DNA, 25 bp, Homo sapien
tcaggtagcagcgaactcacccgtc

SEQ ID NO: 142863 - DNA, 25 bp, Homo sapien
cactacgagtacctgtgcgcgctgc

SEQ ID NO: 142864 - DNA, 25 bp, Homo sapien
ggccttgcgtcttccgaccgaatca

SEQ ID NO: 142865 - DNA, 25 bp, Homo sapien
atcagcgtgcacagcgggatcagca

SEQ ID NO: 142866 - DNA, 25 bp, Homo sapien
cctaggcgctttgcatcagcgtgca

SEQ ID NO: 142867 - DNA, 25 bp, Homo sapien
gccaagctgccgcactcagtaagtc

SEQ ID NO: 142868 - DNA, 25 bp, Homo sapien
gctccttcgcgcgaaccaattagcg

SEQ ID NO: 142869 - DNA, 25 bp, Homo sapien
cgaccaatggggatgtgagctcctt

SEQ ID NO: 142870 - DNA, 25 bp, Homo sapien
ctcggctcagaagcgcgaccaatgg

SEQ ID NO: 142871 - DNA, 25 bp, Homo sapien
ggagcaactgcttcgactcggctca

SEQ ID NO: 142872 - DNA, 25 bp, Homo sapien
cgcgcgctccttgcattgatcaaaa

SEQ ID NO: 142873 - DNA, 25 bp, Homo sapien
ctcttccgaaccaaaggagtttgtg

SEQ ID NO: 142874 - DNA, 25 bp, Homo sapien
gccgcaagcgtttcactcttttatt

SEQ ID NO: 142875 - DNA, 25 bp, Homo sapien
agctgctgctaaatttggtcaaaga

SEQ ID NO: 142876 - DNA, 25 bp, Homo sapien
ccgcggaagattgtgaatatgtatc

SEQ ID NO: 142877 - DNA, 25 bp, Homo sapien
tctggccgtattctcaggcagggtc

SEQ ID NO: 142878 - DNA, 25 bp, Homo sapien
ggcgattaatgttcagccacctctg

SEQ ID NO: 142879 - DNA, 25 bp, Homo sapien
gggcactaacacagaacggcgatta

SEQ ID NO: 142880 - DNA, 25 bp, Homo sapien
ctggcttgccatttgtcagcagtga

SEQ ID NO: 142881 - DNA, 25 bp, Homo sapien
cgcaagtgcccaatgctcctcgagc

SEQ ID NO: 142882 - DNA, 25 bp, Homo sapien
tgcgccttcggccgggtgctcgcag

SEQ ID NO: 142883 - DNA, 25 bp, Homo sapien
agagcagtcccgcaagtgcccaatg

SEQ ID NO: 142884 - DNA, 25 bp, Homo sapien
gagcagtcccgcaagtgcccaatgc

SEQ ID NO: 142885 - DNA, 25 bp, Homo sapien
agtcccgcaagtgcccaatgctcct

SEQ ID NO: 142886 - DNA, 25 bp, Homo sapien
agtgcccaatgctcctcgagcccgg

SEQ ID NO: 142887 - DNA, 25 bp, Homo sapien
gaagcgcctccccaacgatcctggc

SEQ ID NO: 142888 - DNA, 25 bp, Homo sapien
agcagtcccgcaagtgcccaatgct

SEQ ID NO: 142889 - DNA, 25 bp, Homo sapien
ggggctactccaccgagagcagtcc

SEQ ID NO: 142890 - DNA, 25 bp, Homo sapien
gcaactcaattctccggtcaatttc

SEQ ID NO: 142891 - DNA, 25 bp, Homo sapien
cctcagggccacattagtgggcgcc

SEQ ID NO: 142892 - DNA, 25 bp, Homo sapien
gccagtcctgggcaaacaaatccag

SEQ ID NO: 142893 - DNA, 25 bp, Homo sapien
gtcctgggcaaacaaatccagacgg

SEQ ID NO: 142894 - DNA, 25 bp, Homo sapien
ctgcttttctttgctcttctcctgg

SEQ ID NO: 142895 - DNA, 25 bp, Homo sapien
cgacggggctactccaccgagagca

SEQ ID NO: 142896 - DNA, 25 bp, Homo sapien
actcggtgttctccgcggttgcaca

SEQ ID NO: 142897 - DNA, 25 bp, Homo sapien
tgactcctttttcttaactctagcg

SEQ ID NO: 142898 - DNA, 25 bp, Homo sapien
gaagccacgcgcgaactcctggaag

SEQ ID NO: 142899 - DNA, 25 bp, Homo sapien
tggttcggccacttgagggaacgtc

SEQ ID NO: 142900 - DNA, 25 bp, Homo sapien
gtccagccgctggaatactgcctcg

SEQ ID NO: 142901 - DNA, 25 bp, Homo sapien
actctagcggatcttggaaaagtca

SEQ ID NO: 142902 - DNA, 25 bp, Homo sapien
agctcacactcgcacctgggaatga

SEQ ID NO: 142903 - DNA, 25 bp, Homo sapien
ggccattgggtctgcacacctgcaa

SEQ ID NO: 142904 - DNA, 25 bp, Homo sapien
cctgggaatgaacttggcttcgtcc

SEQ ID NO: 142905 - DNA, 25 bp, Homo sapien
tgcctccgcaggaacgccgcgatgg

SEQ ID NO: 142906 - DNA, 25 bp, Homo sapien
acgcttctggaaggtatcgcgaccc

SEQ ID NO: 142907 - DNA, 25 bp, Homo sapien
ctttccagcctcagtcggacgggcg

SEQ ID NO: 142908 - DNA, 25 bp, Homo sapien
tgaattgcgcttccgccatctttcc

SEQ ID NO: 142909 - DNA, 25 bp, Homo sapien
ctgaccacgtctgcccgagcgagta

SEQ ID NO: 142910 - DNA, 25 bp, Homo sapien
ctggaagccgcgtgcctgaccacgt

SEQ ID NO: 142911 - DNA, 25 bp, Homo sapien
cacggggcacagacaaggacaggct

SEQ ID NO: 142912 - DNA, 25 bp, Homo sapien
gtctccggcgtttgaattgcgcttc

SEQ ID NO: 142913 - DNA, 25 bp, Homo sapien
atggtgcatctcatctcctggctga

SEQ ID NO: 142914 - DNA, 25 bp, Homo sapien
tggatcattttcatggtcctcctgc

SEQ ID NO: 142915 - DNA, 25 bp, Homo sapien
gtgaacccagctgatgcatgccttc

SEQ ID NO: 142916 - DNA, 25 bp, Homo sapien
cctgaggaatcgaaatctggctttc

SEQ ID NO: 142917 - DNA, 25 bp, Homo sapien
agtgggttccttgttctcgcatgcc

SEQ ID NO: 142918 - DNA, 25 bp, Homo sapien
agatctccgagtcgtccagcagccg

SEQ ID NO: 142919 - DNA, 25 bp, Homo sapien
ctgagcgatttgacgctggagctcc

SEQ ID NO: 142920 - DNA, 25 bp, Homo sapien
cctggatgtggcaggagatctccga

SEQ ID NO: 142921 - DNA, 25 bp, Homo sapien
ctcagggaggaagccgctcctgaac

SEQ ID NO: 142922 - DNA, 25 bp, Homo sapien
ctctagcgagaggacgcaaaccacg

SEQ ID NO: 142923 - DNA, 25 bp, Homo sapien
cgcacggcctctagcgagaggacgc

SEQ ID NO: 142924 - DNA, 25 bp, Homo sapien
aagccgctcctgaacaggcggctgc

SEQ ID NO: 142925 - DNA, 25 bp, Homo sapien
gaaggagccgagcttgggttatggc

SEQ ID NO: 142926 - DNA, 25 bp, Homo sapien
ctgggaccgcatccgagctccgggt

SEQ ID NO: 142927 - DNA, 25 bp, Homo sapien
cgagctccgggttcccgctctaaga

SEQ ID NO: 142928 - DNA, 25 bp, Homo sapien
ttcccgctctaagacggggaggctg

SEQ ID NO: 142929 - DNA, 25 bp, Homo sapien
tgcccaaagtgcaggcgaagccagt

SEQ ID NO: 142930 - DNA, 25 bp, Homo sapien
aggctccgagaaaagcggcatcagc

SEQ ID NO: 142931 - DNA, 25 bp, Homo sapien
aaccattgcggtgtcccaaggcgca

SEQ ID NO: 142932 - DNA, 25 bp, Homo sapien
ccacgaacttgggtgtgatctaatt

SEQ ID NO: 142933 - DNA, 25 bp, Homo sapien
tcacctgctggacggagctattctc

SEQ ID NO: 142934 - DNA, 25 bp, Homo sapien
ggggtcttcacggtgactttcatga

SEQ ID NO: 142935 - DNA, 25 bp, Homo sapien
ctttcatgattttgggctccgcgga

SEQ ID NO: 142936 - DNA, 25 bp, Homo sapien
gctattctcgggcacggcgaattcc

SEQ ID NO: 142937 - DNA, 25 bp, Homo sapien
cacaggctgggcactaacgggtccc

SEQ ID NO: 142938 - DNA, 25 bp, Homo sapien
gttgctccagaaatttccgagcgcc

SEQ ID NO: 142939 - DNA, 25 bp, Homo sapien
gcctccgcgtactcaccgggcctcc

SEQ ID NO: 142940 - DNA, 25 bp, Homo sapien
ggggagaggaccagaaccacctgct

SEQ ID NO: 142941 - DNA, 25 bp, Homo sapien
cgggcagggtccaaacgcctcacgt

SEQ ID NO: 142942 - DNA, 25 bp, Homo sapien
cggcgccacggtcttcggggtcaca

SEQ ID NO: 142943 - DNA, 25 bp, Homo sapien
ggtcgttgctccagaaatttccgag

SEQ ID NO: 142944 - DNA, 25 bp, Homo sapien
acggtggcacctgtcactcgagcgg

SEQ ID NO: 142945 - DNA, 25 bp, Homo sapien
tttcaacctctacggtgggaaatgc

SEQ ID NO: 142946 - DNA, 25 bp, Homo sapien
tctacggtgggaaatgcgcccaagt

SEQ ID NO: 142947 - DNA, 25 bp, Homo sapien
tcaacctctacggtgggaaatgcgc

SEQ ID NO: 142948 - DNA, 25 bp, Homo sapien
tgcgcccaagtttcaacctctacgg

SEQ ID NO: 142949 - DNA, 25 bp, Homo sapien
cctctacggtgggaaatgcgcccaa

SEQ ID NO: 142950 - DNA, 25 bp, Homo sapien
atgcgcccaagtttcaacctctacg

SEQ ID NO: 142951 - DNA, 25 bp, Homo sapien
ggaaatgcgcccaagtttcaacctc

SEQ ID NO: 142952 - DNA, 25 bp, Homo sapien
ctacggtgggaaatgcgcccaagtt

SEQ ID NO: 142953 - DNA, 25 bp, Homo sapien
gagttgtgtcccaccaacgcgctgg

SEQ ID NO: 142954 - DNA, 25 bp, Homo sapien
ctgcgataaaacaaagcgctcggtg

SEQ ID NO: 142955 - DNA, 25 bp, Homo sapien
tgcagcgacacgagacgaacacagg

SEQ ID NO: 142956 - DNA, 25 bp, Homo sapien
caagcatctttctacgggttcgtga

SEQ ID NO: 142957 - DNA, 25 bp, Homo sapien
cgtcttttgttgtcgcgagttctcc

SEQ ID NO: 142958 - DNA, 25 bp, Homo sapien
aggcctgagcgcaagcatctttcta

SEQ ID NO: 142959 - DNA, 25 bp, Homo sapien
ggcttgcctgcaaatccgagttgtg

SEQ ID NO: 142960 - DNA, 25 bp, Homo sapien
ctctacggtgggaaaaagacgcctg

SEQ ID NO: 142961 - DNA, 25 bp, Homo sapien
gctcggtcgccacaggcacggccac

SEQ ID NO: 142962 - DNA, 25 bp, Homo sapien
gccctgctaggagggtgcttctcga

SEQ ID NO: 142963 - DNA, 25 bp, Homo sapien
ggtgcttctcgaggcacctgttccc

SEQ ID NO: 142964 - DNA, 25 bp, Homo sapien
cgaggctgtgctccgaccctcagaa

SEQ ID NO: 142965 - DNA, 25 bp, Homo sapien
aggctgtgctccgaccctcagaagc

SEQ ID NO: 142966 - DNA, 25 bp, Homo sapien
cctggactggctggcggactcccag

SEQ ID NO: 142967 - DNA, 25 bp, Homo sapien
actcccagcgggtcagcttgaggca

SEQ ID NO: 142968 - DNA, 25 bp, Homo sapien
gcacggccaccgcagcctttcacag

SEQ ID NO: 142969 - DNA, 25 bp, Homo sapien
agtatggcaccaaccttcgtcgagg

SEQ ID NO: 142970 - DNA, 25 bp, Homo sapien
cgcggcgttgccctgattaggaaac

SEQ ID NO: 142971 - DNA, 25 bp, Homo sapien
accgcgcgatcacagggcctaaaca

SEQ ID NO: 142972 - DNA, 25 bp, Homo sapien
cctgggatttaggagcccgtccatt

SEQ ID NO: 142973 - DNA, 25 bp, Homo sapien
cgtacgcctccgctgtcaataaaca

SEQ ID NO: 142974 - DNA, 25 bp, Homo sapien
gtgtctgtcacgaacacccagttga

SEQ ID NO: 142975 - DNA, 25 bp, Homo sapien
ctccgcttccggttccaaaggtctg

SEQ ID NO: 142976 - DNA, 25 bp, Homo sapien
tgctcgtcctgctccgaccaaaagg

SEQ ID NO: 142977 - DNA, 25 bp, Homo sapien
ctccagctcatcctagaggcacatg

SEQ ID NO: 142978 - DNA, 25 bp, Homo sapien
acgaggtccctagttcccagtgcca

SEQ ID NO: 142979 - DNA, 25 bp, Homo sapien
ttctcgttcgcgcactcactagctg

SEQ ID NO: 142980 - DNA, 25 bp, Homo sapien
ttggcccgaggccacgtcaatcaag

SEQ ID NO: 142981 - DNA, 25 bp, Homo sapien
tccctcaagcggaaaaactgggctc

SEQ ID NO: 142982 - DNA, 25 bp, Homo sapien
tctctaggaccacaacgcggactgc

SEQ ID NO: 142983 - DNA, 25 bp, Homo sapien
actgcctagttcacgcgcacaggga

SEQ ID NO: 142984 - DNA, 25 bp, Homo sapien
tctcgcgagatctaacaactgccta

SEQ ID NO: 142985 - DNA, 25 bp, Homo sapien
ccgaaggggccttctctgccaaatg

SEQ ID NO: 142986 - DNA, 25 bp, Homo sapien
ggggccttctctgccaaatgtcttc

SEQ ID NO: 142987 - DNA, 25 bp, Homo sapien
gctgcagccccggtcgattttatgg

SEQ ID NO: 142988 - DNA, 25 bp, Homo sapien
tttatggctgcaaaggagccgcaga

SEQ ID NO: 142989 - DNA, 25 bp, Homo sapien
ggctgcaaaggagccgcagacacct

SEQ ID NO: 142990 - DNA, 25 bp, Homo sapien
gtcctcgctcaagtccccgatgatg

SEQ ID NO: 142991 - DNA, 25 bp, Homo sapien
ccaaatgtcttcttccgtcggctcg

SEQ ID NO: 142992 - DNA, 25 bp, Homo sapien
ccggcaggcacggtgcgaattgact

SEQ ID NO: 142993 - DNA, 25 bp, Homo sapien
gtgcatgtctacacggccaggatgt

SEQ ID NO: 142994 - DNA, 25 bp, Homo sapien
cgcgcgtgtgtgaactcccacatgc

SEQ ID NO: 142995 - DNA, 25 bp, Homo sapien
tcagagctgaaccaagcacggtttc

SEQ ID NO: 142996 - DNA, 25 bp, Homo sapien
ggatagcttgccctcccttttaggc

SEQ ID NO: 142997 - DNA, 25 bp, Homo sapien
ggttaccaatgcagaacacgttttg

SEQ ID NO: 142998 - DNA, 25 bp, Homo sapien
gggcggtgatccttggttaccaatg

SEQ ID NO: 142999 - DNA, 25 bp, Homo sapien
gctagaattgtgtttggagactccc

SEQ ID NO: 143000 - DNA, 25 bp, Homo sapien
acgtcacttcgccagcagtagcaga

SEQ ID NO: 143001 - DNA, 25 bp, Homo sapien
gacagtgacgtgtgtctggcgtagt

SEQ ID NO: 143002 - DNA, 25 bp, Homo sapien
gtgacagtgacgtgtgtctggcgta

SEQ ID NO: 143003 - DNA, 25 bp, Homo sapien
gtgaccgtgacagtgacgtgtgtct

SEQ ID NO: 143004 - DNA, 25 bp, Homo sapien
tgaccgtgacagtgacgtgtgtctg

SEQ ID NO: 143005 - DNA, 25 bp, Homo sapien
tgtgtctggcgtagtaggtgaccgt

SEQ ID NO: 143006 - DNA, 25 bp, Homo sapien
acagtgacgtgtgtctggcgtagta

SEQ ID NO: 143007 - DNA, 25 bp, Homo sapien
gaccgtgacagtgacgtgtgtctgg

SEQ ID NO: 143008 - DNA, 25 bp, Homo sapien
accgtgacagtgacgtgtgtctggc

SEQ ID NO: 143009 - DNA, 25 bp, Homo sapien
cggctttggcagacccgaggctcct

SEQ ID NO: 143010 - DNA, 25 bp, Homo sapien
catcggcctctctctgctgacatta

SEQ ID NO: 143011 - DNA, 25 bp, Homo sapien
tctcccttcccgcatctgtggataa

SEQ ID NO: 143012 - DNA, 25 bp, Homo sapien
tctgctgacattagaaagacgtccc

SEQ ID NO: 143013 - DNA, 25 bp, Homo sapien
aaagacgtccctacgccgcggcgag

SEQ ID NO: 143014 - DNA, 25 bp, Homo sapien
cctaaaagcactccctttctgtgtg

SEQ ID NO: 143015 - DNA, 25 bp, Homo sapien
ctgtggataactcttcccgcatcgg

SEQ ID NO: 143016 - DNA, 25 bp, Homo sapien
cctttctgtgtgcaggaaaccgccc

SEQ ID NO: 143017 - DNA, 25 bp, Homo sapien
ccacgttcttcaagtcatctttctg

SEQ ID NO: 143018 - DNA, 25 bp, Homo sapien
tctttctgtacactcccaacgaggg

SEQ ID NO: 143019 - DNA, 25 bp, Homo sapien
gataccctccgcaaggtctgggacg

SEQ ID NO: 143020 - DNA, 25 bp, Homo sapien
cctcacgcgtcacatgtgtaacatg

SEQ ID NO: 143021 - DNA, 25 bp, Homo sapien
cgtcagggctttccctcaagaccga

SEQ ID NO: 143022 - DNA, 25 bp, Homo sapien
gaaggcgttttccagacccagtcaa

SEQ ID NO: 143023 - DNA, 25 bp, Homo sapien
ctcagcacctggatcacggcggatc

SEQ ID NO: 143024 - DNA, 25 bp, Homo sapien
catgcgttacacaacccgtcaggta

SEQ ID NO: 143025 - DNA, 25 bp, Homo sapien
ccgctcgagtgacaggtgccaccgt

SEQ ID NO: 143026 - DNA, 25 bp, Homo sapien
gcccagcgcaatttctttctctatg

SEQ ID NO: 143027 - DNA, 25 bp, Homo sapien
ccgagttaggtttcgcccagcgcaa

SEQ ID NO: 143028 - DNA, 25 bp, Homo sapien
ctcggaaatttctggagcaacgacc

SEQ ID NO: 143029 - DNA, 25 bp, Homo sapien
tgccgacacttgacccagaccagtc

SEQ ID NO: 143030 - DNA, 25 bp, Homo sapien
tctatgtactttgcgaataagtttc

SEQ ID NO: 143031 - DNA, 25 bp, Homo sapien
tctccagcaggtggttctggtcctc

SEQ ID NO: 143032 - DNA, 25 bp, Homo sapien
acgtgaggcgtttggaccctgcccg

SEQ ID NO: 143033 - DNA, 25 bp, Homo sapien
gaaaccctctcgctcgtgtgtccga

SEQ ID NO: 143034 - DNA, 25 bp, Homo sapien
ctgcgtagccattgaaaccctctcg

SEQ ID NO: 143035 - DNA, 25 bp, Homo sapien
gctcctcattgctcccggcgaggtt

SEQ ID NO: 143036 - DNA, 25 bp, Homo sapien
ccggtctcgcgatcgtctctaatct

SEQ ID NO: 143037 - DNA, 25 bp, Homo sapien
tctgtccttgcttatgcgcccagtg

SEQ ID NO: 143038 - DNA, 25 bp, Homo sapien
ccaggactccgacagagggtgaaaa

SEQ ID NO: 143039 - DNA, 25 bp, Homo sapien
cgccttcgcgtcacctttctaagaa

SEQ ID NO: 143040 - DNA, 25 bp, Homo sapien
tcgtgctcgcaaccactaaggtcta

SEQ ID NO: 143041 - DNA, 25 bp, Homo sapien
ccgcatcgcctgagactgcagggca

SEQ ID NO: 143042 - DNA, 25 bp, Homo sapien
tttgactttggatgccgacgcgcgt

SEQ ID NO: 143043 - DNA, 25 bp, Homo sapien
gcagaactggaactagtgcgactta

SEQ ID NO: 143044 - DNA, 25 bp, Homo sapien
ccgacgcgcgtgacaaagctcagaa

SEQ ID NO: 143045 - DNA, 25 bp, Homo sapien
cgcgcgtgacaaagctcagaacaaa

SEQ ID NO: 143046 - DNA, 25 bp, Homo sapien
agcgcagccagcgaaggttgcagcc

SEQ ID NO: 143047 - DNA, 25 bp, Homo sapien
ggggtgcacgcttttgactttggat

SEQ ID NO: 143048 - DNA, 25 bp, Homo sapien
cctgagactgcagggcagggaatcc

SEQ ID NO: 143049 - DNA, 25 bp, Homo sapien
tctgcttaaccggaacggccgaaca

SEQ ID NO: 143050 - DNA, 25 bp, Homo sapien
cgggcacgttcagcctctgcttaac

SEQ ID NO: 143051 - DNA, 25 bp, Homo sapien
ctcttgctcacagcccggacagttg

SEQ ID NO: 143052 - DNA, 25 bp, Homo sapien
cgcccgggacttgtttatcgttgca

SEQ ID NO: 143053 - DNA, 25 bp, Homo sapien
cccgccgccaccattgggtgagttg

SEQ ID NO: 143054 - DNA, 25 bp, Homo sapien
cgggcgcattgacgccacaagcttc

SEQ ID NO: 143055 - DNA, 25 bp, Homo sapien
cccggactaaggaagccgacatctt

SEQ ID NO: 143056 - DNA, 25 bp, Homo sapien
aggaatgtcttcaccgccgaggacg

SEQ ID NO: 143057 - DNA, 25 bp, Homo sapien
tggtcttccatcctcggcgtacctg

SEQ ID NO: 143058 - DNA, 25 bp, Homo sapien
tggcctcaatctactctccggatca

SEQ ID NO: 143059 - DNA, 25 bp, Homo sapien
cgcaattcagaggttcaggtcttga

SEQ ID NO: 143060 - DNA, 25 bp, Homo sapien
caggtcttgagaactggcccagctc

SEQ ID NO: 143061 - DNA, 25 bp, Homo sapien
gggcctattcctcctttggtagaga

SEQ ID NO: 143062 - DNA, 25 bp, Homo sapien
tccattcacattcctgggaccggga

SEQ ID NO: 143063 - DNA, 25 bp, Homo sapien
gcgaaggcgctcaacttgctgagtc

SEQ ID NO: 143064 - DNA, 25 bp, Homo sapien
ctccggatcactcaagcaataactt

SEQ ID NO: 143065 - DNA, 25 bp, Homo sapien
agaaggcgcccaagagcactcacca

SEQ ID NO: 143066 - DNA, 25 bp, Homo sapien
ggccagagccgaatgtcttgaccca

SEQ ID NO: 143067 - DNA, 25 bp, Homo sapien
ggccggacagctactctggagtcca

SEQ ID NO: 143068 - DNA, 25 bp, Homo sapien
tgcgcccgcagtctgacaaaaagtg

SEQ ID NO: 143069 - DNA, 25 bp, Homo sapien
gccaagacttatgcacccggagagg

SEQ ID NO: 143070 - DNA, 25 bp, Homo sapien
ggccaggcccgaacttcttaccaga

SEQ ID NO: 143071 - DNA, 25 bp, Homo sapien
gggctaattactggctcgccggata

SEQ ID NO: 143072 - DNA, 25 bp, Homo sapien
gttcctcggtcacccaaactggtgc

SEQ ID NO: 143073 - DNA, 25 bp, Homo sapien
gcttggtggacttgcagttctcgtc

SEQ ID NO: 143074 - DNA, 25 bp, Homo sapien
actttgccgcagtaggtcaggtagc

SEQ ID NO: 143075 - DNA, 25 bp, Homo sapien
gaaaagtttgtccaagtcctgccca

SEQ ID NO: 143076 - DNA, 25 bp, Homo sapien
cctgcccacttcttgcatgagtgtc

SEQ ID NO: 143077 - DNA, 25 bp, Homo sapien
ttcataaatccatgcgcgccgctgg

SEQ ID NO: 143078 - DNA, 25 bp, Homo sapien
ggcttcctggaaatgaacagctgtc

SEQ ID NO: 143079 - DNA, 25 bp, Homo sapien
aacagctgtcgagatctggtcccgc

SEQ ID NO: 143080 - DNA, 25 bp, Homo sapien
gtgcattttgctccgcgcctgcaga

SEQ ID NO: 143081 - DNA, 25 bp, Homo sapien
gctaccttaactggggcgcaacgca

SEQ ID NO: 143082 - DNA, 25 bp, Homo sapien
aggctaaatctcctctccagaagca

SEQ ID NO: 143083 - DNA, 25 bp, Homo sapien
gcaacgcagccttccgccaccagag

SEQ ID NO: 143084 - DNA, 25 bp, Homo sapien
cggcctgtcaaaaactggcgctttt

SEQ ID NO: 143085 - DNA, 25 bp, Homo sapien
cctttccgtggagagactatcaact

SEQ ID NO: 143086 - DNA, 25 bp, Homo sapien
gagagactatcaactccatctgtca

SEQ ID NO: 143087 - DNA, 25 bp, Homo sapien
ccatctgtcacaaaaattaaggcta

SEQ ID NO: 143088 - DNA, 25 bp, Homo sapien
ttccgagctaccttaactggggcgc

SEQ ID NO: 143089 - DNA, 25 bp, Homo sapien
aagcctatggcttcagctgcgacgg

SEQ ID NO: 143090 - DNA, 25 bp, Homo sapien
atgctgtttcctttccgctcccagg

SEQ ID NO: 143091 - DNA, 25 bp, Homo sapien
cggttgtaggacgtggctctttatt

SEQ ID NO: 143092 - DNA, 25 bp, Homo sapien
ttacctccgctgaacctagagcttc

SEQ ID NO: 143093 - DNA, 25 bp, Homo sapien
ctagagcttcagacgccctatggcg

SEQ ID NO: 143094 - DNA, 25 bp, Homo sapien
cggccttgagcgctgagcaagcaaa

SEQ ID NO: 143095 - DNA, 25 bp, Homo sapien
tcgggataacgcctgcaacgacatg

SEQ ID NO: 143096 - DNA, 25 bp, Homo sapien
gatgctgcaattcgtgctgcccgtg

SEQ ID NO: 143097 - DNA, 25 bp, Homo sapien
cgttcgagagtgacctgcactcgct

SEQ ID NO: 143098 - DNA, 25 bp, Homo sapien
ttcgcgttcgagagtgacctgcact

SEQ ID NO: 143099 - DNA, 25 bp, Homo sapien
cgcgttcgagagtgacctgcactcg

SEQ ID NO: 143100 - DNA, 25 bp, Homo sapien
gttcgagagtgacctgcactcgctg

SEQ ID NO: 143101 - DNA, 25 bp, Homo sapien
ttcgagagtgacctgcactcgctgc

SEQ ID NO: 143102 - DNA, 25 bp, Homo sapien
tggatgcacccatccccaatgcacc

SEQ ID NO: 143103 - DNA, 25 bp, Homo sapien
gggccgccaaccgatcccacagcgc

SEQ ID NO: 143104 - DNA, 25 bp, Homo sapien
tcgcgttcgagagtgacctgcactc

SEQ ID NO: 143105 - DNA, 25 bp, Homo sapien
aaaggggcctcgctcgcaaggcccg

SEQ ID NO: 143106 - DNA, 25 bp, Homo sapien
gaaacagattcacacccaggggcct

SEQ ID NO: 143107 - DNA, 25 bp, Homo sapien
ccagccggaaatgtccgcgcgctga

SEQ ID NO: 143108 - DNA, 25 bp, Homo sapien
tgaagtcatcgcagctgcgcctgca

SEQ ID NO: 143109 - DNA, 25 bp, Homo sapien
atgtccgcgcgctgaaaagcagacg

SEQ ID NO: 143110 - DNA, 25 bp, Homo sapien
ccagcgagaggggagaaacagattc

SEQ ID NO: 143111 - DNA, 25 bp, Homo sapien
cgtgtcccgcttggaatgtggagca

SEQ ID NO: 143112 - DNA, 25 bp, Homo sapien
ccattgcagagtcatgaagtcatcg

SEQ ID NO: 143113 - DNA, 25 bp, Homo sapien
cctcgagcaactgggaaggccaagg

SEQ ID NO: 143114 - DNA, 25 bp, Homo sapien
agagagattgctcccagtgaggcgc

SEQ ID NO: 143115 - DNA, 25 bp, Homo sapien
cgagggcttcattcttccgcggcgt

SEQ ID NO: 143116 - DNA, 25 bp, Homo sapien
aggccagtcacttccggagccggtt

SEQ ID NO: 143117 - DNA, 25 bp, Homo sapien
cggagccggttctgatcccaacaga

SEQ ID NO: 143118 - DNA, 25 bp, Homo sapien
gaggacagccggaccgagccaacgc

SEQ ID NO: 143119 - DNA, 25 bp, Homo sapien
ggcgcctatggtcggcctccgacag

SEQ ID NO: 143120 - DNA, 25 bp, Homo sapien
tttgtccgggcagtgcctcgagcaa

SEQ ID NO: 143121 - DNA, 25 bp, Homo sapien
ccacgacatctgtatcagtggtccc

SEQ ID NO: 143122 - DNA, 25 bp, Homo sapien
tctgtagggtccctccgtgagccgc

SEQ ID NO: 143123 - DNA, 25 bp, Homo sapien
cggtgcccagagctaacctcagagc

SEQ ID NO: 143124 - DNA, 25 bp, Homo sapien
gtccagagggacaagacaggcacgc

SEQ ID NO: 143125 - DNA, 25 bp, Homo sapien
cgcacccgcagtcactccgcacaca

SEQ ID NO: 143126 - DNA, 25 bp, Homo sapien
gcacccgcagcgctcattctgcagc

SEQ ID NO: 143127 - DNA, 25 bp, Homo sapien
ttgccaccgcaggaaaagcgtcttc

SEQ ID NO: 143128 - DNA, 25 bp, Homo sapien
cttgcccacgacatctgtatcagtg

SEQ ID NO: 143129 - DNA, 25 bp, Homo sapien
tcgatgccatggacatctgcgcccg

SEQ ID NO: 143130 - DNA, 25 bp, Homo sapien
tggaggacatccagcgcctggtgcc

SEQ ID NO: 143131 - DNA, 25 bp, Homo sapien
acctgcaccgctcctgggctgatga

SEQ ID NO: 143132 - DNA, 25 bp, Homo sapien
gatcaagacagacaacctgcaccgc

SEQ ID NO: 143133 - DNA, 25 bp, Homo sapien
gtcccagccctgatcaagacagaca

SEQ ID NO: 143134 - DNA, 25 bp, Homo sapien
tgccatggacatctgcgcccgggac

SEQ ID NO: 143135 - DNA, 25 bp, Homo sapien
gccgctacaccgtggaggacatcca

SEQ ID NO: 143136 - DNA, 25 bp, Homo sapien
cagcgggaccatggtggacgtccca

SEQ ID NO: 143137 - DNA, 25 bp, Homo sapien
tcgcccagtgcagtaagtcgtgtac

SEQ ID NO: 143138 - DNA, 25 bp, Homo sapien
acttagttgactcgagcgctccagg

SEQ ID NO: 143139 - DNA, 25 bp, Homo sapien
ccagctctgggacagtcagtaaaca

SEQ ID NO: 143140 - DNA, 25 bp, Homo sapien
acccgaggttttagaagcagagtca

SEQ ID NO: 143141 - DNA, 25 bp, Homo sapien
agccctggcaacgagagcgtctacc

SEQ ID NO: 143142 - DNA, 25 bp, Homo sapien
tggcgtcaccgcaaacatcctctga

SEQ ID NO: 143143 - DNA, 25 bp, Homo sapien
ctctgaccgctacagccagtgtgtg

SEQ ID NO: 143144 - DNA, 25 bp, Homo sapien
taaacgtcttttcaggagccactcg

SEQ ID NO: 143145 - DNA, 25 bp, Homo sapien
gtcagcttctacagcgcgcctagga

SEQ ID NO: 143146 - DNA, 25 bp, Homo sapien
ctgaccgttttctcgccattgtacc

SEQ ID NO: 143147 - DNA, 25 bp, Homo sapien
gcagcgtctccattactgaccgttt

SEQ ID NO: 143148 - DNA, 25 bp, Homo sapien
tggggcctcacaatcgctcagccgt

SEQ ID NO: 143149 - DNA, 25 bp, Homo sapien
atagcccgtgagtcctctcagcctg

SEQ ID NO: 143150 - DNA, 25 bp, Homo sapien
tatattttgtccctgttcccgccgc

SEQ ID NO: 143151 - DNA, 25 bp, Homo sapien
tctttaaccctcagcagagtcgcgg

SEQ ID NO: 143152 - DNA, 25 bp, Homo sapien
gggccttctccagtcagcttctaca

SEQ ID NO: 143153 - DNA, 25 bp, Homo sapien
gaaccgctgggaccaacacgccgta

SEQ ID NO: 143154 - DNA, 25 bp, Homo sapien
ttcaggacaatcctcctccgcagga

SEQ ID NO: 143155 - DNA, 25 bp, Homo sapien
ggcgtgttctgtgaacctgagcgac

SEQ ID NO: 143156 - DNA, 25 bp, Homo sapien
tgatcccgcccggattacctgggct

SEQ ID NO: 143157 - DNA, 25 bp, Homo sapien
tacctcagctgaaccgctgggacca

SEQ ID NO: 143158 - DNA, 25 bp, Homo sapien
atccaacagccggtaacattccggc

SEQ ID NO: 143159 - DNA, 25 bp, Homo sapien
ctgtgaacctgagcgacgctgcgga

SEQ ID NO: 143160 - DNA, 25 bp, Homo sapien
ggattacctgggctctggacgagaa

SEQ ID NO: 143161 - DNA, 25 bp, Homo sapien
tgtcgctcagttcacgagaaaaccg

SEQ ID NO: 143162 - DNA, 25 bp, Homo sapien
aagtacctgccgcacagcttcctgg

SEQ ID NO: 143163 - DNA, 25 bp, Homo sapien
tagtcctccgcgttgtgcaatggcg

SEQ ID NO: 143164 - DNA, 25 bp, Homo sapien
tcctcgaaacggaactggctccagt

SEQ ID NO: 143165 - DNA, 25 bp, Homo sapien
ccgaggcctgtgcaatcaaccgtga

SEQ ID NO: 143166 - DNA, 25 bp, Homo sapien
ggctttcgaactggtatgggctgta

SEQ ID NO: 143167 - DNA, 25 bp, Homo sapien
ttcctggcactgctgatgtcgctca

SEQ ID NO: 143168 - DNA, 25 bp, Homo sapien
tgtaggcttcgaccttctccgaggc

SEQ ID NO: 143169 - DNA, 25 bp, Homo sapien
ggggacgaaatacgcttagaagaga

SEQ ID NO: 143170 - DNA, 25 bp, Homo sapien
cgcttagaagagcaggttgccgatg

SEQ ID NO: 143171 - DNA, 25 bp, Homo sapien
tcatgcggtggaagcagtaacaaca

SEQ ID NO: 143172 - DNA, 25 bp, Homo sapien
tatgcttagacgagaacattgccgg

SEQ ID NO: 143173 - DNA, 25 bp, Homo sapien
ttagaagagaatgtcgccgatggtg

SEQ ID NO: 143174 - DNA, 25 bp, Homo sapien
ttagaagagtaagtcgccgatggca

SEQ ID NO: 143175 - DNA, 25 bp, Homo sapien
cgcttagaagagcacgttgccaatc

SEQ ID NO: 143176 - DNA, 25 bp, Homo sapien
gctgcggaagcagggacaacatatg

SEQ ID NO: 143177 - DNA, 25 bp, Homo sapien
tgtggctaccatgttctctcgcgcg

SEQ ID NO: 143178 - DNA, 25 bp, Homo sapien
cctggaccttgcagccgcaatggta

SEQ ID NO: 143179 - DNA, 25 bp, Homo sapien
ccgaccttcagcagggctgtggcta

SEQ ID NO: 143180 - DNA, 25 bp, Homo sapien
gcgaccacggcagcgatcactttct

SEQ ID NO: 143181 - DNA, 25 bp, Homo sapien
cttgatcctgttggcgatagccttg

SEQ ID NO: 143182 - DNA, 25 bp, Homo sapien
ggcactgcttctggcacatctggca

SEQ ID NO: 143183 - DNA, 25 bp, Homo sapien
ctctcgtgcgctgagtagttgactc

SEQ ID NO: 143184 - DNA, 25 bp, Homo sapien
tgcggcctgagtccaaattgacgtc

SEQ ID NO: 143185 - DNA, 25 bp, Homo sapien
aagatcttgtgggtgaacccgagga

SEQ ID NO: 143186 - DNA, 25 bp, Homo sapien
cggctcggttgacccaggtcagatc

SEQ ID NO: 143187 - DNA, 25 bp, Homo sapien
cgaagagtaacgaggggcgagaact

SEQ ID NO: 143188 - DNA, 25 bp, Homo sapien
aggaagatctttaggggtgaacttg

SEQ ID NO: 143189 - DNA, 25 bp, Homo sapien
aatgtgaggcttgaacgagctggat

SEQ ID NO: 143190 - DNA, 25 bp, Homo sapien
cgcccaggtcagatccggaggacct

SEQ ID NO: 143191 - DNA, 25 bp, Homo sapien
ccgcccaggtacgtgtcgggacagc

SEQ ID NO: 143192 - DNA, 25 bp, Homo sapien
agagcggcgagaggaagaatattcc

SEQ ID NO: 143193 - DNA, 25 bp, Homo sapien
gcacgggctgatccacgtgggctct

SEQ ID NO: 143194 - DNA, 25 bp, Homo sapien
tgaaccacacgggatctgggagccg

SEQ ID NO: 143195 - DNA, 25 bp, Homo sapien
ggcacgggctgaaccacccgggatc

SEQ ID NO: 143196 - DNA, 25 bp, Homo sapien
acgggctgaaccacccgggctctgg

SEQ ID NO: 143197 - DNA, 25 bp, Homo sapien
gctgatccacatgggctctgggagc

SEQ ID NO: 143198 - DNA, 25 bp, Homo sapien
acgggctgaaccacccgggatctgg

SEQ ID NO: 143199 - DNA, 25 bp, Homo sapien
tgaaccacccgggatctgggagccg

SEQ ID NO: 143200 - DNA, 25 bp, Homo sapien
cacgggctgaaccacccgggatctg

SEQ ID NO: 143201 - DNA, 25 bp, Homo sapien
atctgagctcgcacgctgttgccta

SEQ ID NO: 143202 - DNA, 25 bp, Homo sapien
gcccaggatgcagtactggtccatc

SEQ ID NO: 143203 - DNA, 25 bp, Homo sapien
tcaccaggagaacggaagctgcgtc

SEQ ID NO: 143204 - DNA, 25 bp, Homo sapien
ccgctgtcacgcagcagcaagctta

SEQ ID NO: 143205 - DNA, 25 bp, Homo sapien
gaacgatgacagcaggcacctccta

SEQ ID NO: 143206 - DNA, 25 bp, Homo sapien
cggaagctccgcacctgtaagtaga

SEQ ID NO: 143207 - DNA, 25 bp, Homo sapien
tagaggttcaggcttcgaccacgcg

SEQ ID NO: 143208 - DNA, 25 bp, Homo sapien
acctccacgtgcttggccttgaaga

SEQ ID NO: 143209 - DNA, 25 bp, Homo sapien
aagctcagatgtcgtgtccagtacc

SEQ ID NO: 143210 - DNA, 25 bp, Homo sapien
tgcggatcagcactagcgccgcttc

SEQ ID NO: 143211 - DNA, 25 bp, Homo sapien
agggtcatccctactctcaggctca

SEQ ID NO: 143212 - DNA, 25 bp, Homo sapien
gccgcatgacctgaagcttctctca

SEQ ID NO: 143213 - DNA, 25 bp, Homo sapien
gcccgcacgagcatctgaacgctga

SEQ ID NO: 143214 - DNA, 25 bp, Homo sapien
cgagcacatcctgtccgaggacctt

SEQ ID NO: 143215 - DNA, 25 bp, Homo sapien
ccgggccagcttcaggatggaaacg

SEQ ID NO: 143216 - DNA, 25 bp, Homo sapien
cacaggacaactcggggactgccca

SEQ ID NO: 143217 - DNA, 25 bp, Homo sapien
agcatctctgcactgacgcgtggag

SEQ ID NO: 143218 - DNA, 25 bp, Homo sapien
cagctctgtcttcgcctggtttcag

SEQ ID NO: 143219 - DNA, 25 bp, Homo sapien
gtctgctcggtgtggccgtattttt

SEQ ID NO: 143220 - DNA, 25 bp, Homo sapien
taggcagggcccttccagtttctgc

SEQ ID NO: 143221 - DNA, 25 bp, Homo sapien
ggggctcgctattcagctccctgtg

SEQ ID NO: 143222 - DNA, 25 bp, Homo sapien
aacctgtacattctgtccgcggtcg

SEQ ID NO: 143223 - DNA, 25 bp, Homo sapien
ggttcctccacgtcacgcaggcaga

SEQ ID NO: 143224 - DNA, 25 bp, Homo sapien
tccacctggttgaccttggcagcca

SEQ ID NO: 143225 - DNA, 25 bp, Homo sapien
gggcactactcctcgggcattgcct

SEQ ID NO: 143226 - DNA, 25 bp, Homo sapien
acggcacgcccggcgcacctgctgc

SEQ ID NO: 143227 - DNA, 25 bp, Homo sapien
acgggtttcccatggcagcaccacg

SEQ ID NO: 143228 - DNA, 25 bp, Homo sapien
cgggtttcccatggcagcaccacgg

SEQ ID NO: 143229 - DNA, 25 bp, Homo sapien
ggtttcccatggcagcaccacggca

SEQ ID NO: 143230 - DNA, 25 bp, Homo sapien
cccatggcagcaccacggcacgccc

SEQ ID NO: 143231 - DNA, 25 bp, Homo sapien
actactcctcgggcattgcctagag

SEQ ID NO: 143232 - DNA, 25 bp, Homo sapien
ggcactactcctcgggcattgccta

SEQ ID NO: 143233 - DNA, 25 bp, Homo sapien
ccttagcgcgcgctttgtttggagc

SEQ ID NO: 143234 - DNA, 25 bp, Homo sapien
aacgaagcccttctcaggctgcctg

SEQ ID NO: 143235 - DNA, 25 bp, Homo sapien
gctgcctgccttccaggaaaagctg

SEQ ID NO: 143236 - DNA, 25 bp, Homo sapien
cgcgcgctcctttgttcgccggccc

SEQ ID NO: 143237 - DNA, 25 bp, Homo sapien
tgcctgccttccaggaaaagctgcg

SEQ ID NO: 143238 - DNA, 25 bp, Homo sapien
gcgcgaacgagcgacggcggaaccc

SEQ ID NO: 143239 - DNA, 25 bp, Homo sapien
aacgttgcataatcccgggccggcg

SEQ ID NO: 143240 - DNA, 25 bp, Homo sapien
cgcaaaaacgaagcccttctcaggc

SEQ ID NO: 143241 - DNA, 25 bp, Homo sapien
acctggtgacctgtaagggcgcgac

SEQ ID NO: 143242 - DNA, 25 bp, Homo sapien
ctgtcgcccaggtatctggggtctc

SEQ ID NO: 143243 - DNA, 25 bp, Homo sapien
tctgagtgtctcattgtcggcgcga

SEQ ID NO: 143244 - DNA, 25 bp, Homo sapien
cgtgtctgcgccatggttgacattc

SEQ ID NO: 143245 - DNA, 25 bp, Homo sapien
cgctgcagaacaaggtggtggcact

SEQ ID NO: 143246 - DNA, 25 bp, Homo sapien
gaagtggtcttcgtgtcagccgacg

SEQ ID NO: 143247 - DNA, 25 bp, Homo sapien
tgtcggcgcgaacacaattgctcca

SEQ ID NO: 143248 - DNA, 25 bp, Homo sapien
ccgctgctctgcgacttctatacgg

SEQ ID NO: 143249 - DNA, 25 bp, Homo sapien
ggtcaggatctggacaacgataatg

SEQ ID NO: 143250 - DNA, 25 bp, Homo sapien
agctcgcccgatgaggacaaggtct

SEQ ID NO: 143251 - DNA, 25 bp, Homo sapien
ttccaagcctgttcccgctgggtct

SEQ ID NO: 143252 - DNA, 25 bp, Homo sapien
gacctcggacctggttccaagcctg

SEQ ID NO: 143253 - DNA, 25 bp, Homo sapien
ctcctattaagaatcggcccaaaca

SEQ ID NO: 143254 - DNA, 25 bp, Homo sapien
cggtgctcggccagttacaaaagaa

SEQ ID NO: 143255 - DNA, 25 bp, Homo sapien
acaaaaacgctgtccggcgccaggc

SEQ ID NO: 143256 - DNA, 25 bp, Homo sapien
acaaaccctcgctgtcagggcgaca

SEQ ID NO: 143257 - DNA, 25 bp, Homo sapien
caccgcacccggagcgtttacaacg

SEQ ID NO: 143258 - DNA, 25 bp, Homo sapien
ggagcgctccacatcagcacccctc

SEQ ID NO: 143259 - DNA, 25 bp, Homo sapien
gccggagcgctccacatcagcaccc

SEQ ID NO: 143260 - DNA, 25 bp, Homo sapien
ggccggagcgctccacatcagcacc

SEQ ID NO: 143261 - DNA, 25 bp, Homo sapien
cggccggagcgctccacatcagcac

SEQ ID NO: 143262 - DNA, 25 bp, Homo sapien
atccccaccgatcccgggcgcgacg

SEQ ID NO: 143263 - DNA, 25 bp, Homo sapien
cgggcgcgacggggacttgggcgcg

SEQ ID NO: 143264 - DNA, 25 bp, Homo sapien
gcggccggagcgctccacatcagca

SEQ ID NO: 143265 - DNA, 25 bp, Homo sapien
ggccgctggaaaagtttagtctctg

SEQ ID NO: 143266 - DNA, 25 bp, Homo sapien
gtttagtctctgactcgctcgggca

SEQ ID NO: 143267 - DNA, 25 bp, Homo sapien
tctctgactcgctcgggcagaggcc

SEQ ID NO: 143268 - DNA, 25 bp, Homo sapien
ggcaacagggactcagggaccagaa

SEQ ID NO: 143269 - DNA, 25 bp, Homo sapien
tgcaggacgcgaccgagcaggaccc

SEQ ID NO: 143270 - DNA, 25 bp, Homo sapien
gaacgacgtcgcgagcgctgagact

SEQ ID NO: 143271 - DNA, 25 bp, Homo sapien
agcccatctggcattcgagcgcagg

SEQ ID NO: 143272 - DNA, 25 bp, Homo sapien
catctggcattcgagcgcaggaccg

SEQ ID NO: 143273 - DNA, 25 bp, Homo sapien
agaccctgcgggagcattaccagta

SEQ ID NO: 143274 - DNA, 25 bp, Homo sapien
ggagctaatcgtctgtgaatgccaa

SEQ ID NO: 143275 - DNA, 25 bp, Homo sapien
cctctcgtggattttggagctaatc

SEQ ID NO: 143276 - DNA, 25 bp, Homo sapien
gaaatgaatgttcctggggcgccct

SEQ ID NO: 143277 - DNA, 25 bp, Homo sapien
cttgctgaatgaagccggaacctca

SEQ ID NO: 143278 - DNA, 25 bp, Homo sapien
tttcaacgccctcgctggagtctgg

SEQ ID NO: 143279 - DNA, 25 bp, Homo sapien
cccttaggcggcgatcgttttatca

SEQ ID NO: 143280 - DNA, 25 bp, Homo sapien
atctgttggcaggagccctttttca

SEQ ID NO: 143281 - DNA, 25 bp, Homo sapien
ccaaggaactctcgggtgaagcagc

SEQ ID NO: 143282 - DNA, 25 bp, Homo sapien
ctccgtccggtgagattcccagtga

SEQ ID NO: 143283 - DNA, 25 bp, Homo sapien
ggcgcgcaaacaggcttgataacta

SEQ ID NO: 143284 - DNA, 25 bp, Homo sapien
cgtcgctctgactgccttacggaaa

SEQ ID NO: 143285 - DNA, 25 bp, Homo sapien
caaatggcaatctgcgcgcgaacta

SEQ ID NO: 143286 - DNA, 25 bp, Homo sapien
agaccttttgctccaggtgctcatg

SEQ ID NO: 143287 - DNA, 25 bp, Homo sapien
tctaggtgtctgaggagcatcttcc

SEQ ID NO: 143288 - DNA, 25 bp, Homo sapien
aaactttagggaccagccacggctg

SEQ ID NO: 143289 - DNA, 25 bp, Homo sapien
tgcgggaattctccggagcctcaca

SEQ ID NO: 143290 - DNA, 25 bp, Homo sapien
cccgatgtgggatagaccagagagc

SEQ ID NO: 143291 - DNA, 25 bp, Homo sapien
cccacagtagacgaggacgtttttg

SEQ ID NO: 143292 - DNA, 25 bp, Homo sapien
agcccgcctgagatggaggatccag

SEQ ID NO: 143293 - DNA, 25 bp, Homo sapien
cggggagattctcaccactgaagtg

SEQ ID NO: 143294 - DNA, 25 bp, Homo sapien
gagcccagacgtgggtgtcaccaac

SEQ ID NO: 143295 - DNA, 25 bp, Homo sapien
ccactgaagtggacgtaaacacacg

SEQ ID NO: 143296 - DNA, 25 bp, Homo sapien
tttttggttgcgcaagcggcttctg

SEQ ID NO: 143297 - DNA, 25 bp, Homo sapien
cctcgccggacaccaagtagggagc

SEQ ID NO: 143298 - DNA, 25 bp, Homo sapien
ccgctgtcaagcgagctgattgcta

SEQ ID NO: 143299 - DNA, 25 bp, Homo sapien
aaagcgcatttgtagttccctcctc

SEQ ID NO: 143300 - DNA, 25 bp, Homo sapien
tttgcttgcctctaacgtgacagtc

SEQ ID NO: 143301 - DNA, 25 bp, Homo sapien
tggtaaaccttttcccaatggatgc

SEQ ID NO: 143302 - DNA, 25 bp, Homo sapien
gaggatggtgccctcccaccgttaa

SEQ ID NO: 143303 - DNA, 25 bp, Homo sapien
atacttggtgcgtggaagcatgccc

SEQ ID NO: 143304 - DNA, 25 bp, Homo sapien
ccgagtcattcctgaagcggttata

SEQ ID NO: 143305 - DNA, 25 bp, Homo sapien
tcaaatccggatcgttgggactgcg

SEQ ID NO: 143306 - DNA, 25 bp, Homo sapien
cgctcttcgcgctctcgtttcattt

SEQ ID NO: 143307 - DNA, 25 bp, Homo sapien
ggatggcccacaagcagatctacta

SEQ ID NO: 143308 - DNA, 25 bp, Homo sapien
gggcaacctcgcaacagatctctga

SEQ ID NO: 143309 - DNA, 25 bp, Homo sapien
gacgtacctatcttccctcgggcaa

SEQ ID NO: 143310 - DNA, 25 bp, Homo sapien
caaagtggacctaggctcctggctc

SEQ ID NO: 143311 - DNA, 25 bp, Homo sapien
atcaccgtgcaaggtcgacagcttc

SEQ ID NO: 143312 - DNA, 25 bp, Homo sapien
tttcattttctgcagcgcgccagca

SEQ ID NO: 143313 - DNA, 25 bp, Homo sapien
tctgaacgtcattctccgctctacg

SEQ ID NO: 143314 - DNA, 25 bp, Homo sapien
ggatcctgcgtttttctgaacgtca

SEQ ID NO: 143315 - DNA, 25 bp, Homo sapien
atagattgttttaaaggatcctgcg

SEQ ID NO: 143316 - DNA, 25 bp, Homo sapien
ccgcgctcttgggaacggatagatt

SEQ ID NO: 143317 - DNA, 25 bp, Homo sapien
cgtctgtggtgcgatgtcacccagc

SEQ ID NO: 143318 - DNA, 25 bp, Homo sapien
ggaaacgctttgtctgtccggcaag

SEQ ID NO: 143319 - DNA, 25 bp, Homo sapien
ggctctgtcgctttgctgtgacgca

SEQ ID NO: 143320 - DNA, 25 bp, Homo sapien
ttgctgtgacgcacttcctggcgtc

SEQ ID NO: 143321 - DNA, 25 bp, Homo sapien
ccctgcaaaacaaccggcacgtgtt

SEQ ID NO: 143322 - DNA, 25 bp, Homo sapien
aggagtcactcacccgggcacacag

SEQ ID NO: 143323 - DNA, 25 bp, Homo sapien
atcgccgctcatctcctgaatcaaa

SEQ ID NO: 143324 - DNA, 25 bp, Homo sapien
aaccggcacgtgttattcacccaca

SEQ ID NO: 143325 - DNA, 25 bp, Homo sapien
cgcaggtgccgtgcttcccacagaa

SEQ ID NO: 143326 - DNA, 25 bp, Homo sapien
gctctcggtctggtgcagagccacg

SEQ ID NO: 143327 - DNA, 25 bp, Homo sapien
gggcacacagaagcatcgccgctca

SEQ ID NO: 143328 - DNA, 25 bp, Homo sapien
gtgttattcacccacacacatgggg

SEQ ID NO: 143329 - DNA, 25 bp, Homo sapien
ccgggaaagattccgagctgcatta

SEQ ID NO: 143330 - DNA, 25 bp, Homo sapien
tattgtgcgccctccatagaaatgc

SEQ ID NO: 143331 - DNA, 25 bp, Homo sapien
cacgccagacctctgctattgtgcg

SEQ ID NO: 143332 - DNA, 25 bp, Homo sapien
agaaagcctcgattgtccctacagc

SEQ ID NO: 143333 - DNA, 25 bp, Homo sapien
actcagggaccacggagtggcactc

SEQ ID NO: 143334 - DNA, 25 bp, Homo sapien
ttacttgtagcagggccagtactgg

SEQ ID NO: 143335 - DNA, 25 bp, Homo sapien
tgcattacctaagctccaggggctg

SEQ ID NO: 143336 - DNA, 25 bp, Homo sapien
gtccagccgcgaagactgcacagca

SEQ ID NO: 143337 - DNA, 25 bp, Homo sapien
cccgccttggagaagctcagcctgt

SEQ ID NO: 143338 - DNA, 25 bp, Homo sapien
ctcagcctgttttgcgaggagagcc

SEQ ID NO: 143339 - DNA, 25 bp, Homo sapien
tcggtgagtacagtcccgtcctgtc

SEQ ID NO: 143340 - DNA, 25 bp, Homo sapien
ctgcactgcatcctcatttcggtga

SEQ ID NO: 143341 - DNA, 25 bp, Homo sapien
cagcgttaacgactgggtgcccagc

SEQ ID NO: 143342 - DNA, 25 bp, Homo sapien
cgtctacgagtcagccaaagtcttg

SEQ ID NO: 143343 - DNA, 25 bp, Homo sapien
gacatcgcgctgcagatccatttta

SEQ ID NO: 143344 - DNA, 25 bp, Homo sapien
acaatgtgaccttctgtgtgctggc

SEQ ID NO: 143345 - DNA, 25 bp, Homo sapien
caaatgagtcggacgctttgcactg

SEQ ID NO: 143346 - DNA, 25 bp, Homo sapien
aggcgcaggcttctccagattggct

SEQ ID NO: 143347 - DNA, 25 bp, Homo sapien
aggtgtgcagctcgccatatgctct

SEQ ID NO: 143348 - DNA, 25 bp, Homo sapien
ttggctggtcttcaaagcaatgaca

SEQ ID NO: 143349 - DNA, 25 bp, Homo sapien
gacatgccgtgtcagatctgccata

SEQ ID NO: 143350 - DNA, 25 bp, Homo sapien
atctgccatagtccaggcacgtggc

SEQ ID NO: 143351 - DNA, 25 bp, Homo sapien
caggcgtccagcatgcaaatgagtc

SEQ ID NO: 143352 - DNA, 25 bp, Homo sapien
ctcgccatatgctctgctgagcgtc

SEQ ID NO: 143353 - DNA, 25 bp, Homo sapien
tccactcgcgcaggacagggcagcg

SEQ ID NO: 143354 - DNA, 25 bp, Homo sapien
gacgatgctgtcagctgctcgcccg

SEQ ID NO: 143355 - DNA, 25 bp, Homo sapien
cgccgccgtgacgatgctgtcagct

SEQ ID NO: 143356 - DNA, 25 bp, Homo sapien
ttcttcagagctccactcgcgcagg

SEQ ID NO: 143357 - DNA, 25 bp, Homo sapien
actccgctcagagcttcttcagagc

SEQ ID NO: 143358 - DNA, 25 bp, Homo sapien
tacctggggaagaacacaactccgc

SEQ ID NO: 143359 - DNA, 25 bp, Homo sapien
ggggaagaacacaactccgctcaga

SEQ ID NO: 143360 - DNA, 25 bp, Homo sapien
ccaatgcggacgcagcgaagccacg

SEQ ID NO: 143361 - DNA, 25 bp, Homo sapien
tcggccgaggtaaaagtgctgaaac

SEQ ID NO: 143362 - DNA, 25 bp, Homo sapien
gtgctgaaaccatgtgaataaaata

SEQ ID NO: 143363 - DNA, 25 bp, Homo sapien
taaaatacaggtgggttccgccagc

SEQ ID NO: 143364 - DNA, 25 bp, Homo sapien
ttacggggaacgacgcgctgctttc

SEQ ID NO: 143365 - DNA, 25 bp, Homo sapien
accgatgcggtccatgtcccgggca

SEQ ID NO: 143366 - DNA, 25 bp, Homo sapien
cttgttctaccttcatcggccgagg

SEQ ID NO: 143367 - DNA, 25 bp, Homo sapien
cgcgctgctttcatgccctttcttg

SEQ ID NO: 143368 - DNA, 25 bp, Homo sapien
cgcgttaaggaagttgcccaaaatg

SEQ ID NO: 143369 - DNA, 25 bp, Homo sapien
gcggtgcatctgtcgtctgtctaac

SEQ ID NO: 143370 - DNA, 25 bp, Homo sapien
ggcagccctgttgcttcttatttaa

SEQ ID NO: 143371 - DNA, 25 bp, Homo sapien
gaggcgcgctcatccatccaagagg

SEQ ID NO: 143372 - DNA, 25 bp, Homo sapien
ccaagaggcttatcccgcgagcaca

SEQ ID NO: 143373 - DNA, 25 bp, Homo sapien
ggtgactttcctctctgatgcggtg

SEQ ID NO: 143374 - DNA, 25 bp, Homo sapien
cctgcctcgtatttggtgacttgga

SEQ ID NO: 143375 - DNA, 25 bp, Homo sapien
tggacggctctgacgttgcaaaacc

SEQ ID NO: 143376 - DNA, 25 bp, Homo sapien
cctccctgcgagacaggtgactttc

SEQ ID NO: 143377 - DNA, 25 bp, Homo sapien
ggccaaaatcctgcccaagaccgtg

SEQ ID NO: 143378 - DNA, 25 bp, Homo sapien
ccctcaagtctttctgaagagtccc

SEQ ID NO: 143379 - DNA, 25 bp, Homo sapien
tgtggctgcgctggactcccttccg

SEQ ID NO: 143380 - DNA, 25 bp, Homo sapien
aggccttccacaggcacggtgagtg

SEQ ID NO: 143381 - DNA, 25 bp, Homo sapien
agaccgtgaattcctcccattaccg

SEQ ID NO: 143382 - DNA, 25 bp, Homo sapien
gcagagttttccgtggccaaaatcc

SEQ ID NO: 143383 - DNA, 25 bp, Homo sapien
tccttccaccgcagagttttccgtg

SEQ ID NO: 143384 - DNA, 25 bp, Homo sapien
acgggcagagcttcatccagatccc

SEQ ID NO: 143385 - DNA, 25 bp, Homo sapien
cccaaacgcgcgtactctcggcctg

SEQ ID NO: 143386 - DNA, 25 bp, Homo sapien
ggaacaatcaagacggacccaaagc

SEQ ID NO: 143387 - DNA, 25 bp, Homo sapien
ccagcgccagaagcgcagggagcac

SEQ ID NO: 143388 - DNA, 25 bp, Homo sapien
gcagtgactaacatagctcccacct

SEQ ID NO: 143389 - DNA, 25 bp, Homo sapien
cccactttacatcctgatttgtaac

SEQ ID NO: 143390 - DNA, 25 bp, Homo sapien
gtcacccgttggcagcgcccagaat

SEQ ID NO: 143391 - DNA, 25 bp, Homo sapien
accctgagtctgtcacccgttggca

SEQ ID NO: 143392 - DNA, 25 bp, Homo sapien
ctcacggctagaccctgagtctgtc

SEQ ID NO: 143393 - DNA, 25 bp, Homo sapien
ggcttcttatctgcaccgcgttcca

SEQ ID NO: 143394 - DNA, 25 bp, Homo sapien
aaccctctcgatgcagcggaaagtc

SEQ ID NO: 143395 - DNA, 25 bp, Homo sapien
caggggtcagaagtcagtgtttaac

SEQ ID NO: 143396 - DNA, 25 bp, Homo sapien
caaaacgtccttctgcgggaagcca

SEQ ID NO: 143397 - DNA, 25 bp, Homo sapien
ctagcgacgggcattgaaggtttta

SEQ ID NO: 143398 - DNA, 25 bp, Homo sapien
ttagccgactccaccctcttgaata

SEQ ID NO: 143399 - DNA, 25 bp, Homo sapien
gcccgcaccgctgggctatttttag

SEQ ID NO: 143400 - DNA, 25 bp, Homo sapien
gggttgcacacgcttgctccaagca

SEQ ID NO: 143401 - DNA, 25 bp, Homo sapien
tgccggcggacgctgcaccttatgc

SEQ ID NO: 143402 - DNA, 25 bp, Homo sapien
gtcctccgtcttcatctcagagctg

SEQ ID NO: 143403 - DNA, 25 bp, Homo sapien
cgtcttcatctcagagctgtagccc

SEQ ID NO: 143404 - DNA, 25 bp, Homo sapien
cgggcagagccacgcactgcaagcg

SEQ ID NO: 143405 - DNA, 25 bp, Homo sapien
cgccagcatgcagggatcccaaggc

SEQ ID NO: 143406 - DNA, 25 bp, Homo sapien
ggccgccatgttgtctgtttacggc

SEQ ID NO: 143407 - DNA, 25 bp, Homo sapien
tctgtttacggcgtggacctgcgac

SEQ ID NO: 143408 - DNA, 25 bp, Homo sapien
caccttatgcccgtcctgagagcga

SEQ ID NO: 143409 - DNA, 25 bp, Homo sapien
cccgcgccagaacaaaggaatgtgg

SEQ ID NO: 143410 - DNA, 25 bp, Homo sapien
aggcgcttctcggtcccgacccgag

SEQ ID NO: 143411 - DNA, 25 bp, Homo sapien
gccgcacggactcgccattggagat

SEQ ID NO: 143412 - DNA, 25 bp, Homo sapien
ctcgccattggagatcgcgatcgga

SEQ ID NO: 143413 - DNA, 25 bp, Homo sapien
tcccacccgagctcgcaaagtaggt

SEQ ID NO: 143414 - DNA, 25 bp, Homo sapien
cccagtataactgccgttcggaggc

SEQ ID NO: 143415 - DNA, 25 bp, Homo sapien
tataactgccgttcggaggcgcttc

SEQ ID NO: 143416 - DNA, 25 bp, Homo sapien
cctggatttgccctgttggaaggag

SEQ ID NO: 143417 - DNA, 25 bp, Homo sapien
ttgttgcgtaacacgactgggaaac

SEQ ID NO: 143418 - DNA, 25 bp, Homo sapien
cgattaaaatgtcccggcgcctctc

SEQ ID NO: 143419 - DNA, 25 bp, Homo sapien
tggcaagctgccaacactcggggcg

SEQ ID NO: 143420 - DNA, 25 bp, Homo sapien
tacctgttgccgactgagcactgcg

SEQ ID NO: 143421 - DNA, 25 bp, Homo sapien
ttttgtcttcctgagagccgcagcc

SEQ ID NO: 143422 - DNA, 25 bp, Homo sapien
cttgctcgcagaggcgctttttgtc

SEQ ID NO: 143423 - DNA, 25 bp, Homo sapien
tgttagtaggtcagttccgagcgcc

SEQ ID NO: 143424 - DNA, 25 bp, Homo sapien
ccattcccggcgcaacgagtgttgc

SEQ ID NO: 143425 - DNA, 25 bp, Homo sapien
gccaggactcgagcgccatctacag

SEQ ID NO: 143426 - DNA, 25 bp, Homo sapien
ccgaatcgcggttagaaattaagca

SEQ ID NO: 143427 - DNA, 25 bp, Homo sapien
tgcgcaagcacttctcttcacacga

SEQ ID NO: 143428 - DNA, 25 bp, Homo sapien
cacagatgaagaagcgcccataatg

SEQ ID NO: 143429 - DNA, 25 bp, Homo sapien
ggggccacccatctgtattaattgt

SEQ ID NO: 143430 - DNA, 25 bp, Homo sapien
tgagaaaatacgctctcccaccagc

SEQ ID NO: 143431 - DNA, 25 bp, Homo sapien
cgggagtcaacacaggcgctgccaa

SEQ ID NO: 143432 - DNA, 25 bp, Homo sapien
tccaggcacgagcaggatccctaga

SEQ ID NO: 143433 - DNA, 25 bp, Homo sapien
cggcggcatacacctctcggaagag

SEQ ID NO: 143434 - DNA, 25 bp, Homo sapien
gccgtgctcgcagcatagcctcatg

SEQ ID NO: 143435 - DNA, 25 bp, Homo sapien
accatgggtctgatctggcccttca

SEQ ID NO: 143436 - DNA, 25 bp, Homo sapien
gggcgttgctcacattgctcactgg

SEQ ID NO: 143437 - DNA, 25 bp, Homo sapien
tggccaggtccttgtgaaccacgtg

SEQ ID NO: 143438 - DNA, 25 bp, Homo sapien
gggaactcgttccagcactcgatca

SEQ ID NO: 143439 - DNA, 25 bp, Homo sapien
ccacatcctggttggagtacccgca

SEQ ID NO: 143440 - DNA, 25 bp, Homo sapien
gcagcttgtagtaatcggcggcata

SEQ ID NO: 143441 - DNA, 25 bp, Homo sapien
gcgaactgtgagcactggtccgaca

SEQ ID NO: 143442 - DNA, 25 bp, Homo sapien
cagcctctcggctgggatgccaatg

SEQ ID NO: 143443 - DNA, 25 bp, Homo sapien
caatgcgcatgcagttggcagcgtc

SEQ ID NO: 143444 - DNA, 25 bp, Homo sapien
cgcctcacacttgggcagctgaagc

SEQ ID NO: 143445 - DNA, 25 bp, Homo sapien
tactcctggcggcacaggtcgctct

SEQ ID NO: 143446 - DNA, 25 bp, Homo sapien
cgcgcgtcgcacagaggaaacacga

SEQ ID NO: 143447 - DNA, 25 bp, Homo sapien
gccgatcatggtgaaggccgctgca

SEQ ID NO: 143448 - DNA, 25 bp, Homo sapien
acaggtgcgtagacgtgccgatcat

SEQ ID NO: 143449 - DNA, 25 bp, Homo sapien
tagacgtcggcgtgtgtctacacca

SEQ ID NO: 143450 - DNA, 25 bp, Homo sapien
gtgtgtctacaccacggcctctgca

SEQ ID NO: 143451 - DNA, 25 bp, Homo sapien
caccgcctctactcgggaaatacaa

SEQ ID NO: 143452 - DNA, 25 bp, Homo sapien
gggttaagctatccctgaccacacc

SEQ ID NO: 143453 - DNA, 25 bp, Homo sapien
gctccggagggttaagctatccctg

SEQ ID NO: 143454 - DNA, 25 bp, Homo sapien
gtctctgcttacaccaccgactgtg

SEQ ID NO: 143455 - DNA, 25 bp, Homo sapien
acaccgcgatctgtctacaccaggg

SEQ ID NO: 143456 - DNA, 25 bp, Homo sapien
ctgtctacaccagggtctctgctta

SEQ ID NO: 143457 - DNA, 25 bp, Homo sapien
ccggtacgattgcaactgccacgtc

SEQ ID NO: 143458 - DNA, 25 bp, Homo sapien
tctgctctgtccgtcatcccatttg

SEQ ID NO: 143459 - DNA, 25 bp, Homo sapien
tcccatttgcatgccggtacgattg

SEQ ID NO: 143460 - DNA, 25 bp, Homo sapien
tgccacgtcctatgccaaggcctga

SEQ ID NO: 143461 - DNA, 25 bp, Homo sapien
caaggcctgagaccggctcgtgtaa

SEQ ID NO: 143462 - DNA, 25 bp, Homo sapien
ctcgtgtaaaccctccagcttgtta

SEQ ID NO: 143463 - DNA, 25 bp, Homo sapien
agcttgttattccaggcggcctcgg

SEQ ID NO: 143464 - DNA, 25 bp, Homo sapien
cctcggctatttttggtgagacgca

SEQ ID NO: 143465 - DNA, 25 bp, Homo sapien
gggacccgcaggaaacaagaaatga

SEQ ID NO: 143466 - DNA, 25 bp, Homo sapien
gcagacggcagacgcaagtcctcca

SEQ ID NO: 143467 - DNA, 25 bp, Homo sapien
acccgcaggaaacaagaaatgagga

SEQ ID NO: 143468 - DNA, 25 bp, Homo sapien
cggggcaatcctccggctgcctgga

SEQ ID NO: 143469 - DNA, 25 bp, Homo sapien
caagatggtcaatgacagcggctga

SEQ ID NO: 143470 - DNA, 25 bp, Homo sapien
tgcctcccgcacaagatggtcaatg

SEQ ID NO: 143471 - DNA, 25 bp, Homo sapien
acggcagacgcaagtcctccagctg

SEQ ID NO: 143472 - DNA, 25 bp, Homo sapien
cccgcacaagatggtcaatgacagc

SEQ ID NO: 143473 - DNA, 25 bp, Homo sapien
caggagatcgcgctgactgacatgg

SEQ ID NO: 143474 - DNA, 25 bp, Homo sapien
ttggcaatacctatcagcaccaggg

SEQ ID NO: 143475 - DNA, 25 bp, Homo sapien
aggcgaccggtacgcaaacctccag

SEQ ID NO: 143476 - DNA, 25 bp, Homo sapien
attggcgcccagacacagtagatga

SEQ ID NO: 143477 - DNA, 25 bp, Homo sapien
tagatgacgcacctcagccaattcg

SEQ ID NO: 143478 - DNA, 25 bp, Homo sapien
gcttctttaaagagccggcacttcc

SEQ ID NO: 143479 - DNA, 25 bp, Homo sapien
ccaggcgacaagaacgcgctctaat

SEQ ID NO: 143480 - DNA, 25 bp, Homo sapien
cgcgctctaatggaacgaagttggc

SEQ ID NO: 143481 - DNA, 25 bp, Homo sapien
tggcgcttcgcaaacgggtccactt

SEQ ID NO: 143482 - DNA, 25 bp, Homo sapien
tccgggacactgagagcagaagcgc

SEQ ID NO: 143483 - DNA, 25 bp, Homo sapien
cagatcctacctgaagtccgggaca

SEQ ID NO: 143484 - DNA, 25 bp, Homo sapien
gcacaagccggaacgccagatccta

SEQ ID NO: 143485 - DNA, 25 bp, Homo sapien
gtgagctaccgtctgcgcacaagcc

SEQ ID NO: 143486 - DNA, 25 bp, Homo sapien
cccagagcgcggcttattgtaacca

SEQ ID NO: 143487 - DNA, 25 bp, Homo sapien
cccagactctggaaacacttaggcg

SEQ ID NO: 143488 - DNA, 25 bp, Homo sapien
cgtgtgcccttgaaggaggaagacc

SEQ ID NO: 143489 - DNA, 25 bp, Homo sapien
ggattcaccggttcccgccatctcg

SEQ ID NO: 143490 - DNA, 25 bp, Homo sapien
taaaagcgctctgcacctttggcac

SEQ ID NO: 143491 - DNA, 25 bp, Homo sapien
tccataaaagcgctctgcacctttg

SEQ ID NO: 143492 - DNA, 25 bp, Homo sapien
gcatccataaaagcgctctgcacct

SEQ ID NO: 143493 - DNA, 25 bp, Homo sapien
gaagcacgaaactcaacctatcccg

SEQ ID NO: 143494 - DNA, 25 bp, Homo sapien
tgacagccacatcgggtaccctgac

SEQ ID NO: 143495 - DNA, 25 bp, Homo sapien
gttcccgccatctcggcagccatct

SEQ ID NO: 143496 - DNA, 25 bp, Homo sapien
gccatcctgacagccacatcgggta

SEQ ID NO: 143497 - DNA, 25 bp, Homo sapien
aggggacccggagcataagaattca

SEQ ID NO: 143498 - DNA, 25 bp, Homo sapien
agtgtcgttatcacctccgcagagg

SEQ ID NO: 143499 - DNA, 25 bp, Homo sapien
cacgtgttcctttccggagcttcca

SEQ ID NO: 143500 - DNA, 25 bp, Homo sapien
ctcaaccgctgggactagaagctcc

SEQ ID NO: 143501 - DNA, 25 bp, Homo sapien
gagcccacctcgtaaagcgcctgta

SEQ ID NO: 143502 - DNA, 25 bp, Homo sapien
ggtcgccatagttagccgcttcctt

SEQ ID NO: 143503 - DNA, 25 bp, Homo sapien
cttccagcaagaggcaccgagtctg

SEQ ID NO: 143504 - DNA, 25 bp, Homo sapien
ggtcacaagcgcgtcccaaaagtgc

SEQ ID NO: 143505 - DNA, 25 bp, Homo sapien
gctcttgagcttgggctgtccgcca

SEQ ID NO: 143506 - DNA, 25 bp, Homo sapien
actgctcttgagcttgggctgtccg

SEQ ID NO: 143507 - DNA, 25 bp, Homo sapien
cgactgctcttgagcttgggctgtc

SEQ ID NO: 143508 - DNA, 25 bp, Homo sapien
gctccgggcgctgtgacttcgcgcc

SEQ ID NO: 143509 - DNA, 25 bp, Homo sapien
aagggagctagccgcagcgtagaaa

SEQ ID NO: 143510 - DNA, 25 bp, Homo sapien
ttgagcttgggctgtccgccatacc

SEQ ID NO: 143511 - DNA, 25 bp, Homo sapien
agcttgggctgtccgccataccggg

SEQ ID NO: 143512 - DNA, 25 bp, Homo sapien
tctgccgactgctcttgagcttggg

SEQ ID NO: 143513 - DNA, 25 bp, Homo sapien
acgaagatcactcaacaatgcctgc

SEQ ID NO: 143514 - DNA, 25 bp, Homo sapien
caagcccagcctgtgaaactgaata

SEQ ID NO: 143515 - DNA, 25 bp, Homo sapien
gcccagcctgtgaaactgaataacg

SEQ ID NO: 143516 - DNA, 25 bp, Homo sapien
cctgtgaaactgaataacgaagatc

SEQ ID NO: 143517 - DNA, 25 bp, Homo sapien
ccctgacggcttacctgtgagtact

SEQ ID NO: 143518 - DNA, 25 bp, Homo sapien
ttacctgtgagtactgcccgcctgt

SEQ ID NO: 143519 - DNA, 25 bp, Homo sapien
gcatcatgctgtctgccgactgctc

SEQ ID NO: 143520 - DNA, 25 bp, Homo sapien
aggacggcatcatgctgtctgccga

SEQ ID NO: 143521 - DNA, 25 bp, Homo sapien
ccgcgggccagcaagcctaaaagca

SEQ ID NO: 143522 - DNA, 25 bp, Homo sapien
aaaagcaactcatccggcgtccacg

SEQ ID NO: 143523 - DNA, 25 bp, Homo sapien
gaggtgatgcaacgcgctgaaaatg

SEQ ID NO: 143524 - DNA, 25 bp, Homo sapien
ctgccaacaagccaggcgccgattg

SEQ ID NO: 143525 - DNA, 25 bp, Homo sapien
cgtgctgcttgtatccgttgcagta

SEQ ID NO: 143526 - DNA, 25 bp, Homo sapien
cttgtgctactgtttcggggttgta

SEQ ID NO: 143527 - DNA, 25 bp, Homo sapien
cgccggacatgattgcgcccactgg

SEQ ID NO: 143528 - DNA, 25 bp, Homo sapien
ttgcagtagtgtagaccgaggtctc

SEQ ID NO: 143529 - DNA, 25 bp, Homo sapien
ccaggcgggtgaatctccacagaca

SEQ ID NO: 143530 - DNA, 25 bp, Homo sapien
ggcatgaactggcattgatcctgtc

SEQ ID NO: 143531 - DNA, 25 bp, Homo sapien
tgcgcgccttgcaagctgagatcgc

SEQ ID NO: 143532 - DNA, 25 bp, Homo sapien
acggcgcccagctgtaaacgcattg

SEQ ID NO: 143533 - DNA, 25 bp, Homo sapien
gcattgcagggtattaactcgttta

SEQ ID NO: 143534 - DNA, 25 bp, Homo sapien
ttggagtagcaaagaacgcgctctc

SEQ ID NO: 143535 - DNA, 25 bp, Homo sapien
gagaagtcccgagtccagtacgtga

SEQ ID NO: 143536 - DNA, 25 bp, Homo sapien
ctgtcatgacgatggcctagagttg

SEQ ID NO: 143537 - DNA, 25 bp, Homo sapien
tgtggaactgactctgacggggaac

SEQ ID NO: 143538 - DNA, 25 bp, Homo sapien
atctggggcaatgggagactgaccc

SEQ ID NO: 143539 - DNA, 25 bp, Homo sapien
gaccctgttgaggaaacggataatg

SEQ ID NO: 143540 - DNA, 25 bp, Homo sapien
caggctcttattgccctctccgtgg

SEQ ID NO: 143541 - DNA, 25 bp, Homo sapien
ctgccatgacggagtcgggcaattc

SEQ ID NO: 143542 - DNA, 25 bp, Homo sapien
gcaattccgggttcgtgacactttc

SEQ ID NO: 143543 - DNA, 25 bp, Homo sapien
cggccatcttaggtactggtagagc

SEQ ID NO: 143544 - DNA, 25 bp, Homo sapien
agcgactcatttccggaacgcggtc

SEQ ID NO: 143545 - DNA, 25 bp, Homo sapien
agtaaatgctgtgcttctcgctgca

SEQ ID NO: 143546 - DNA, 25 bp, Homo sapien
ggctagactcctaccctctgtgcat

SEQ ID NO: 143547 - DNA, 25 bp, Homo sapien
cctctgtgcattagtcacgttaaga

SEQ ID NO: 143548 - DNA, 25 bp, Homo sapien
ttaagattgacctagcaccgccgtc

SEQ ID NO: 143549 - DNA, 25 bp, Homo sapien
tctcgctgcagaacacctggttggc

SEQ ID NO: 143550 - DNA, 25 bp, Homo sapien
acaggcacaggtgtgacttacgctc

SEQ ID NO: 143551 - DNA, 25 bp, Homo sapien
tcatggtccagctcgagcagctcca

SEQ ID NO: 143552 - DNA, 25 bp, Homo sapien
gcagcagcgagttcagcgtcttctt

SEQ ID NO: 143553 - DNA, 25 bp, Homo sapien
cagaggtgacgcttattagagaaat

SEQ ID NO: 143554 - DNA, 25 bp, Homo sapien
tgacgcttattagagaaatcgccac

SEQ ID NO: 143555 - DNA, 25 bp, Homo sapien
gtcacagaggtgacgcttattagag

SEQ ID NO: 143556 - DNA, 25 bp, Homo sapien
acgcttattagagaaatcgccaccc

SEQ ID NO: 143557 - DNA, 25 bp, Homo sapien
tcacagaggtgacgcttattagaga

SEQ ID NO: 143558 - DNA, 25 bp, Homo sapien
gaggtgacgcttattagagaaatcg

SEQ ID NO: 143559 - DNA, 25 bp, Homo sapien
acagaggtgacgcttattagagaaa

SEQ ID NO: 143560 - DNA, 25 bp, Homo sapien
ggtgacgcttattagagaaatcgcc

SEQ ID NO: 143561 - DNA, 25 bp, Homo sapien
ggcgacgtcgctcaccttctttagc

SEQ ID NO: 143562 - DNA, 25 bp, Homo sapien
gatctcctccataagcgcttccttg

SEQ ID NO: 143563 - DNA, 25 bp, Homo sapien
gtgcttgatctggtcacggatgata

SEQ ID NO: 143564 - DNA, 25 bp, Homo sapien
cctcgcggtagtagtccagcatgac

SEQ ID NO: 143565 - DNA, 25 bp, Homo sapien
attggccagctcctcactgaaggtc

SEQ ID NO: 143566 - DNA, 25 bp, Homo sapien
ggccttctctagcagggagaccttc

SEQ ID NO: 143567 - DNA, 25 bp, Homo sapien
gcgacttcagcttgaggatctcctc

SEQ ID NO: 143568 - DNA, 25 bp, Homo sapien
ggtgtctcattgttgcacatgcaca

SEQ ID NO: 143569 - DNA, 25 bp, Homo sapien
agtagtcccgctagcgcaccgacta

SEQ ID NO: 143570 - DNA, 25 bp, Homo sapien
ccgcttggcaagctgaccttggccg

SEQ ID NO: 143571 - DNA, 25 bp, Homo sapien
agctcgtgggacagccgcttcacct

SEQ ID NO: 143572 - DNA, 25 bp, Homo sapien
atcttctcacgcgtggtctcggcca

SEQ ID NO: 143573 - DNA, 25 bp, Homo sapien
tgagctggtgcttctcctcgagcac

SEQ ID NO: 143574 - DNA, 25 bp, Homo sapien
tctcgctgcggatagcctcatagtc

SEQ ID NO: 143575 - DNA, 25 bp, Homo sapien
gagccggatgtaccggcgccttgca

SEQ ID NO: 143576 - DNA, 25 bp, Homo sapien
ctcctcgaactgcagcttgagctgg

SEQ ID NO: 143577 - DNA, 25 bp, Homo sapien
tgcaggtagggagcgttgttcctcc

SEQ ID NO: 143578 - DNA, 25 bp, Homo sapien
agcgttgttcctccgcgggtgccca

SEQ ID NO: 143579 - DNA, 25 bp, Homo sapien
ggtcaggaaagtccaacgcccggca

SEQ ID NO: 143580 - DNA, 25 bp, Homo sapien
ccgatttcaccgaaggtcaggaaag

SEQ ID NO: 143581 - DNA, 25 bp, Homo sapien
aactggatttgctgccttgggcaga

SEQ ID NO: 143582 - DNA, 25 bp, Homo sapien
cctggcgcaacgctgagcagctggc

SEQ ID NO: 143583 - DNA, 25 bp, Homo sapien
gcagcttcccgaggctccgcaccag

SEQ ID NO: 143584 - DNA, 25 bp, Homo sapien
tccaacgcccggcaaactggatttg

SEQ ID NO: 143585 - DNA, 25 bp, Homo sapien
cccgcatctcaaaaccggggctaga

SEQ ID NO: 143586 - DNA, 25 bp, Homo sapien
agccacccgatcaacaggtcagctg

SEQ ID NO: 143587 - DNA, 25 bp, Homo sapien
tctctgagttgacttcgtgcgggca

SEQ ID NO: 143588 - DNA, 25 bp, Homo sapien
atcctctctgagttgacttcgtgcg

SEQ ID NO: 143589 - DNA, 25 bp, Homo sapien
catccggggtgactgccaaatgcct

SEQ ID NO: 143590 - DNA, 25 bp, Homo sapien
actgccaaatgcctatgccagcggc

SEQ ID NO: 143591 - DNA, 25 bp, Homo sapien
accggggctagaggtccctgtagct

SEQ ID NO: 143592 - DNA, 25 bp, Homo sapien
tagaggtccctgtagctgcggccaa

SEQ ID NO: 143593 - DNA, 25 bp, Homo sapien
gcctgccaaggacgcgacgaccagg

SEQ ID NO: 143594 - DNA, 25 bp, Homo sapien
cgcgatgtcacggaggatcacgctg

SEQ ID NO: 143595 - DNA, 25 bp, Homo sapien
ctcgcgatgtcacggaggatcacgc

SEQ ID NO: 143596 - DNA, 25 bp, Homo sapien
ctctcgcgatgtcacggaggatcac

SEQ ID NO: 143597 - DNA, 25 bp, Homo sapien
gctctcgcgatgtcacggaggatca

SEQ ID NO: 143598 - DNA, 25 bp, Homo sapien
tggctctcgcgatgtcacggaggat

SEQ ID NO: 143599 - DNA, 25 bp, Homo sapien
tctggctctcgcgatgtcacggagg

SEQ ID NO: 143600 - DNA, 25 bp, Homo sapien
gtcgttctcttggcgggaggcaccg

SEQ ID NO: 143601 - DNA, 25 bp, Homo sapien
ttcaagtaccggagcacctggggcc

SEQ ID NO: 143602 - DNA, 25 bp, Homo sapien
tgcgcaaacggcatctccttctgga

SEQ ID NO: 143603 - DNA, 25 bp, Homo sapien
gatccggtgaggaagtgaagttccc

SEQ ID NO: 143604 - DNA, 25 bp, Homo sapien
agtgaagttcccttgttacctctgg

SEQ ID NO: 143605 - DNA, 25 bp, Homo sapien
aacggcgtcctgagcgtaccggaag

SEQ ID NO: 143606 - DNA, 25 bp, Homo sapien
gtcctgagcgtaccggaaggcactg

SEQ ID NO: 143607 - DNA, 25 bp, Homo sapien
ggaagtagaattcaaggttcaagta

SEQ ID NO: 143608 - DNA, 25 bp, Homo sapien
ttcaaggttcaagtaccggagcacc

SEQ ID NO: 143609 - DNA, 25 bp, Homo sapien
gtctgtaagttgcatggaaccgccc

SEQ ID NO: 143610 - DNA, 25 bp, Homo sapien
agttcgaaaccaggcggctgcacgc

SEQ ID NO: 143611 - DNA, 25 bp, Homo sapien
gtgcggggctctgcgcccatttcac

SEQ ID NO: 143612 - DNA, 25 bp, Homo sapien
cccagtccaacgtgtgggcgtggtc

SEQ ID NO: 143613 - DNA, 25 bp, Homo sapien
ccttggcccgctgggtatttggtct

SEQ ID NO: 143614 - DNA, 25 bp, Homo sapien
gtagcaacactttccgctcagccgg

SEQ ID NO: 143615 - DNA, 25 bp, Homo sapien
ccggagtagcaacactttccgctca

SEQ ID NO: 143616 - DNA, 25 bp, Homo sapien
cagcaggcgccctagcggagccgaa

SEQ ID NO: 143617 - DNA, 25 bp, Homo sapien
cctcgcggcgtcttaactgacgctg

SEQ ID NO: 143618 - DNA, 25 bp, Homo sapien
cggctgccttgcgagtcgcctgcag

SEQ ID NO: 143619 - DNA, 25 bp, Homo sapien
gtccgtcgccatgacaggtgggcac

SEQ ID NO: 143620 - DNA, 25 bp, Homo sapien
cgaggctacacagccaaagccgggg

SEQ ID NO: 143621 - DNA, 25 bp, Homo sapien
aaggctccaggatcctcgcagcggc

SEQ ID NO: 143622 - DNA, 25 bp, Homo sapien
tgaggggcaaggctccaggatcctc

SEQ ID NO: 143623 - DNA, 25 bp, Homo sapien
ccgcagtcgcatggcagagcaggaa

SEQ ID NO: 143624 - DNA, 25 bp, Homo sapien
gaccttggcccgtcagctgtcggtg

SEQ ID NO: 143625 - DNA, 25 bp, Homo sapien
ccaggcaaactgcatgaaagcgagc

SEQ ID NO: 143626 - DNA, 25 bp, Homo sapien
gggaaccgcagatcgctccagcaca

SEQ ID NO: 143627 - DNA, 25 bp, Homo sapien
tggcgcccacgctgggtttttccca

SEQ ID NO: 143628 - DNA, 25 bp, Homo sapien
gctgtacgctgagagcgcgcagttt

SEQ ID NO: 143629 - DNA, 25 bp, Homo sapien
tgagctcgtactcctcggttcccga

SEQ ID NO: 143630 - DNA, 25 bp, Homo sapien
acagggcctggcaagatcatgcagc

SEQ ID NO: 143631 - DNA, 25 bp, Homo sapien
cctagtaacagcgtcagagagtccg

SEQ ID NO: 143632 - DNA, 25 bp, Homo sapien
ctccgtcgcggacacttttaatcca

SEQ ID NO: 143633 - DNA, 25 bp, Homo sapien
tgcctccgggacagcctagcagaac

SEQ ID NO: 143634 - DNA, 25 bp, Homo sapien
gcttagggcggcgttgtctcatccg

SEQ ID NO: 143635 - DNA, 25 bp, Homo sapien
cgggcctgtgtgtccttggcccaca

SEQ ID NO: 143636 - DNA, 25 bp, Homo sapien
cttggcccacagagatggacggcga

SEQ ID NO: 143637 - DNA, 25 bp, Homo sapien
ccagcgctttctgcggcgcagcgtg

SEQ ID NO: 143638 - DNA, 25 bp, Homo sapien
tgcttctgctctgcaagacgcgccg

SEQ ID NO: 143639 - DNA, 25 bp, Homo sapien
gacggcgtccgctcgccctgtgagt

SEQ ID NO: 143640 - DNA, 25 bp, Homo sapien
agggacaccctagcaggtcctctct

SEQ ID NO: 143641 - DNA, 25 bp, Homo sapien
catcacgctgccagtgtggttctga

SEQ ID NO: 143642 - DNA, 25 bp, Homo sapien
gggagacttccttccagcacacaga

SEQ ID NO: 143643 - DNA, 25 bp, Homo sapien
gcacacagagctacttcattaaagg

SEQ ID NO: 143644 - DNA, 25 bp, Homo sapien
gggccgctctgttaccgatgttcag

SEQ ID NO: 143645 - DNA, 25 bp, Homo sapien
ccgatgttcaggcttcgccctcttg

SEQ ID NO: 143646 - DNA, 25 bp, Homo sapien
ggatccgaatgcgaatggctgctgt

SEQ ID NO: 143647 - DNA, 25 bp, Homo sapien
tcatgtgggctgagccctccgtcca

SEQ ID NO: 143648 - DNA, 25 bp, Homo sapien
agcactgcttcatgtggacgccgta

SEQ ID NO: 143649 - DNA, 25 bp, Homo sapien
cgagagtgacgtcaagatcgtggcc

SEQ ID NO: 143650 - DNA, 25 bp, Homo sapien
ctgcaggtccaggtgacctaccatg

SEQ ID NO: 143651 - DNA, 25 bp, Homo sapien
cgtcaagatcgtggccaagtccatc

SEQ ID NO: 143652 - DNA, 25 bp, Homo sapien
tcgtggccaagtccatccgtgaccg

SEQ ID NO: 143653 - DNA, 25 bp, Homo sapien
accgcgtggccttgatccagtggcg

SEQ ID NO: 143654 - DNA, 25 bp, Homo sapien
ggtgacctaccatgcacaggctggg

SEQ ID NO: 143655 - DNA, 25 bp, Homo sapien
ctgccacctacgttgccgaccagcg

SEQ ID NO: 143656 - DNA, 25 bp, Homo sapien
agtccatccgtgaccgcgtggcctt

SEQ ID NO: 143657 - DNA, 25 bp, Homo sapien
tcgtcctacatcagcagcgacaatg

SEQ ID NO: 143658 - DNA, 25 bp, Homo sapien
cagcagcgacaatgattcggagctc

SEQ ID NO: 143659 - DNA, 25 bp, Homo sapien
attcccagtcgtcctacatcagcag

SEQ ID NO: 143660 - DNA, 25 bp, Homo sapien
agacggcctcctccatcgaggtcgg

SEQ ID NO: 143661 - DNA, 25 bp, Homo sapien
acttcgtgaagaaggccaccgcctt

SEQ ID NO: 143662 - DNA, 25 bp, Homo sapien
gccttcctgcagaggccttctcggg

SEQ ID NO: 143663 - DNA, 25 bp, Homo sapien
agacacccagcagggtgggcatgaa

SEQ ID NO: 143664 - DNA, 25 bp, Homo sapien
acgatcagcgtgacctccttccatt

SEQ ID NO: 143665 - DNA, 25 bp, Homo sapien
ctgcctggcgggatcgctgtcctcg

SEQ ID NO: 143666 - DNA, 25 bp, Homo sapien
gctagcgcacatcagggttcccgcg

SEQ ID NO: 143667 - DNA, 25 bp, Homo sapien
ggcactgcttcgcttctgcctggcg

SEQ ID NO: 143668 - DNA, 25 bp, Homo sapien
tgcggtctcgccagttcacatctaa

SEQ ID NO: 143669 - DNA, 25 bp, Homo sapien
atgggctttctcgtggctagcgcac

SEQ ID NO: 143670 - DNA, 25 bp, Homo sapien
cgtgtgtctcgtggcgcctagagtt

SEQ ID NO: 143671 - DNA, 25 bp, Homo sapien
gcctagagtttgtgcggtctcgcca

SEQ ID NO: 143672 - DNA, 25 bp, Homo sapien
gttcacatctaacgggcttatcctt

SEQ ID NO: 143673 - DNA, 25 bp, Homo sapien
gcgaggcttatgcagagcttcaaga

SEQ ID NO: 143674 - DNA, 25 bp, Homo sapien
ttgctgctgcgttatccctagactc

SEQ ID NO: 143675 - DNA, 25 bp, Homo sapien
ccggtaaaaccctggagactgctag

SEQ ID NO: 143676 - DNA, 25 bp, Homo sapien
cctcagcatctggtacagccgagta

SEQ ID NO: 143677 - DNA, 25 bp, Homo sapien
aggcgcctttccacgttcagtccga

SEQ ID NO: 143678 - DNA, 25 bp, Homo sapien
catgtattttctgagcggctggccc

SEQ ID NO: 143679 - DNA, 25 bp, Homo sapien
ggctccgcacggaccatgtattttc

SEQ ID NO: 143680 - DNA, 25 bp, Homo sapien
cgttccaccgaattggccgcaggta

SEQ ID NO: 143681 - DNA, 25 bp, Homo sapien
cgctcctaggttcctgtggtccacg

SEQ ID NO: 143682 - DNA, 25 bp, Homo sapien
gcttcagaccctgttcgctcctagg

SEQ ID NO: 143683 - DNA, 25 bp, Homo sapien
cggctgcggatcacgtagccttctg

SEQ ID NO: 143684 - DNA, 25 bp, Homo sapien
tgtgggcacagcactcagccgcgag

SEQ ID NO: 143685 - DNA, 25 bp, Homo sapien
aaccaggtgtggtttggcctccgag

SEQ ID NO: 143686 - DNA, 25 bp, Homo sapien
agactgcttcctttgcggcttcaga

SEQ ID NO: 143687 - DNA, 25 bp, Homo sapien
ggtgggcagcaagactgcttccttt

SEQ ID NO: 143688 - DNA, 25 bp, Homo sapien
ggatcacgtagccttctgccctgtc

SEQ ID NO: 143689 - DNA, 25 bp, Homo sapien
cgtgtgcttcccttcgtgaggaatg

SEQ ID NO: 143690 - DNA, 25 bp, Homo sapien
gcgacccacgcaccactcactttgt

SEQ ID NO: 143691 - DNA, 25 bp, Homo sapien
acgatgtagaagagccagggaagta

SEQ ID NO: 143692 - DNA, 25 bp, Homo sapien
aatgttgctgtagctgttctgctcc

SEQ ID NO: 143693 - DNA, 25 bp, Homo sapien
cgttgtcggaagatgacgatgtaga

SEQ ID NO: 143694 - DNA, 25 bp, Homo sapien
tcccttcgtgaggaatgttgctgta

SEQ ID NO: 143695 - DNA, 25 bp, Homo sapien
gttctgctccgtcagattcttcccg

SEQ ID NO: 143696 - DNA, 25 bp, Homo sapien
tccgctgccctcgtcgttgtcggaa

SEQ ID NO: 143697 - DNA, 25 bp, Homo sapien
aggacgcctggagatccactgcttc

SEQ ID NO: 143698 - DNA, 25 bp, Homo sapien
gcctcatttgaaaacacggcctttc

SEQ ID NO: 143699 - DNA, 25 bp, Homo sapien
tcctctcggcttcagtctgcaggca

SEQ ID NO: 143700 - DNA, 25 bp, Homo sapien
tttcggcgtcccacaccatctcctt

SEQ ID NO: 143701 - DNA, 25 bp, Homo sapien
agtttgcaaggacgcctggagatcc

SEQ ID NO: 143702 - DNA, 25 bp, Homo sapien
ctctgagctccgaatcctgcgcctt

SEQ ID NO: 143703 - DNA, 25 bp, Homo sapien
tccaggctgcgcgagcgagataccc

SEQ ID NO: 143704 - DNA, 25 bp, Homo sapien
gcttcagtctgcaggcagctcttcc

SEQ ID NO: 143705 - DNA, 25 bp, Homo sapien
ttcgtcttcttcaacggcgcgctcg

SEQ ID NO: 143706 - DNA, 25 bp, Homo sapien
gccgccaaaggtctggttcctgccg

SEQ ID NO: 143707 - DNA, 25 bp, Homo sapien
cagggcttccaggactacatcgaga

SEQ ID NO: 143708 - DNA, 25 bp, Homo sapien
ggcggcttctacaccgactgggtca

SEQ ID NO: 143709 - DNA, 25 bp, Homo sapien
ccaaggcctgcttcggcggcaacat

SEQ ID NO: 143710 - DNA, 25 bp, Homo sapien
agcgccagacggcacagcagatcgt

SEQ ID NO: 143711 - DNA, 25 bp, Homo sapien
agcagatcgtcagccatgtccagaa

SEQ ID NO: 143712 - DNA, 25 bp, Homo sapien
tggaaccacatgcttggctacctgg

SEQ ID NO: 143713 - DNA, 25 bp, Homo sapien
ggctcttctacatcgtcatcttccg

SEQ ID NO: 143714 - DNA, 25 bp, Homo sapien
tcacgaagggaagcacacgccgctg

SEQ ID NO: 143715 - DNA, 25 bp, Homo sapien
ctacagcaacattcctcacgaaggg

SEQ ID NO: 143716 - DNA, 25 bp, Homo sapien
tcatcttccgacaacgacgagggca

SEQ ID NO: 143717 - DNA, 25 bp, Homo sapien
ggagcagaacagctacagcaacatt

SEQ ID NO: 143718 - DNA, 25 bp, Homo sapien
ttccgacaacgacgagggcagcgga

SEQ ID NO: 143719 - DNA, 25 bp, Homo sapien
cgggaagaatctgacggagcagaac

SEQ ID NO: 143720 - DNA, 25 bp, Homo sapien
tacttccctggctcttctacatcgt

SEQ ID NO: 143721 - DNA, 25 bp, Homo sapien
tgtcagtgaggcctactcccagctt

SEQ ID NO: 143722 - DNA, 25 bp, Homo sapien
agactgcgccgttgaagccggttct

SEQ ID NO: 143723 - DNA, 25 bp, Homo sapien
cgagcgcctggagaaagcgccccgt

SEQ ID NO: 143724 - DNA, 25 bp, Homo sapien
gccaggagagctgcggcgatcccgc

SEQ ID NO: 143725 - DNA, 25 bp, Homo sapien
gccgtgtcagtgaggcctactccca

SEQ ID NO: 143726 - DNA, 25 bp, Homo sapien
tcagtgaggcctactcccagctttt

SEQ ID NO: 143727 - DNA, 25 bp, Homo sapien
agtgaggcctactcccagctttttc

SEQ ID NO: 143728 - DNA, 25 bp, Homo sapien
tgagactgcgccgttgaagccggtt

SEQ ID NO: 143729 - DNA, 25 bp, Homo sapien
ctggtgctgagtccgcttatacaga

SEQ ID NO: 143730 - DNA, 25 bp, Homo sapien
tatacagacagagacgaagggcagc

SEQ ID NO: 143731 - DNA, 25 bp, Homo sapien
acctgctgctctgcggggactcggt

SEQ ID NO: 143732 - DNA, 25 bp, Homo sapien
ttagaagttgacctgctgctctgcg

SEQ ID NO: 143733 - DNA, 25 bp, Homo sapien
ctgagacgcgctttagaagttgacc

SEQ ID NO: 143734 - DNA, 25 bp, Homo sapien
aggcgagactccagcattctagggg

SEQ ID NO: 143735 - DNA, 25 bp, Homo sapien
ttccagagccttctgtggctgggcg

SEQ ID NO: 143736 - DNA, 25 bp, Homo sapien
aggcggtctgagacgcgctttagaa

SEQ ID NO: 143737 - DNA, 25 bp, Homo sapien
ccgcgcgcccttttgtgcccagggc

SEQ ID NO: 143738 - DNA, 25 bp, Homo sapien
cgcgcgtccattcccttttgtgtcc

SEQ ID NO: 143739 - DNA, 25 bp, Homo sapien
cgcccggcattgtgtggacgcgcct

SEQ ID NO: 143740 - DNA, 25 bp, Homo sapien
tgcccgtgtactgcgtctgccggct

SEQ ID NO: 143741 - DNA, 25 bp, Homo sapien
ccctacgacgttacccgcttcatga

SEQ ID NO: 143742 - DNA, 25 bp, Homo sapien
ccctgggtctaccttcagccttggg

SEQ ID NO: 143743 - DNA, 25 bp, Homo sapien
agtgcgacgcctgcaaggactggtt

SEQ ID NO: 143744 - DNA, 25 bp, Homo sapien
tcggcctatcttccaccttcgagat

SEQ ID NO: 143745 - DNA, 25 bp, Homo sapien
tgtgccaaagtccacaggcaccctt

SEQ ID NO: 143746 - DNA, 25 bp, Homo sapien
cccgttccggttggagaacacaatg

SEQ ID NO: 143747 - DNA, 25 bp, Homo sapien
cgcaggtaaggtaaagccaggcaga

SEQ ID NO: 143748 - DNA, 25 bp, Homo sapien
atcgcgccctcttcacagatgagca

SEQ ID NO: 143749 - DNA, 25 bp, Homo sapien
tgagcaaacggaggccagacgtcac

SEQ ID NO: 143750 - DNA, 25 bp, Homo sapien
aggcctcgcacctgcacgggaagca

SEQ ID NO: 143751 - DNA, 25 bp, Homo sapien
cgcacaggctgtgccaaagtccaca

SEQ ID NO: 143752 - DNA, 25 bp, Homo sapien
gaacacaatgcaccgcgcacaggct

SEQ ID NO: 143753 - DNA, 25 bp, Homo sapien
gtccatccgagaggacacgtccgcg

SEQ ID NO: 143754 - DNA, 25 bp, Homo sapien
cgctacggggaagcaaaggattgca

SEQ ID NO: 143755 - DNA, 25 bp, Homo sapien
ggattgcacaaatcgggccatgcag

SEQ ID NO: 143756 - DNA, 25 bp, Homo sapien
cgggccatgcagtgctgccagcatg

SEQ ID NO: 143757 - DNA, 25 bp, Homo sapien
ggtgatcaacccacgtgggtcgagc

SEQ ID NO: 143758 - DNA, 25 bp, Homo sapien
ccacgtgggtcgagcctggagccta

SEQ ID NO: 143759 - DNA, 25 bp, Homo sapien
ggcaatgagagcaaggtagagtcca

SEQ ID NO: 143760 - DNA, 25 bp, Homo sapien
agagcaaggtagagtccatccgaga

SEQ ID NO: 143761 - DNA, 25 bp, Homo sapien
tgtccttaaagcacgcagaaaattg

SEQ ID NO: 143762 - DNA, 25 bp, Homo sapien
ctcggggtcgagtccctctgcgtgt

SEQ ID NO: 143763 - DNA, 25 bp, Homo sapien
atgcgcagcacgagcctcgctaatg

SEQ ID NO: 143764 - DNA, 25 bp, Homo sapien
gagcctcgctaatgcgtttcgcatg

SEQ ID NO: 143765 - DNA, 25 bp, Homo sapien
ccaaggcgcaagagcaagacgctgc

SEQ ID NO: 143766 - DNA, 25 bp, Homo sapien
gtcaaacgcccttctaatgtcctta

SEQ ID NO: 143767 - DNA, 25 bp, Homo sapien
gcacgcagaaaattgcatccttatg

SEQ ID NO: 143768 - DNA, 25 bp, Homo sapien
ttcgcatggcgcgtcagtcaaacgc

SEQ ID NO: 143769 - DNA, 25 bp, Homo sapien
ctgcagcgagagctgcaccagcgtc

SEQ ID NO: 143770 - DNA, 25 bp, Homo sapien
ctttggcagttctcgggtgcacaca

SEQ ID NO: 143771 - DNA, 25 bp, Homo sapien
caagacccagcttctttggcagttc

SEQ ID NO: 143772 - DNA, 25 bp, Homo sapien
cggaaactgcagagggccaaacttc

SEQ ID NO: 143773 - DNA, 25 bp, Homo sapien
gcgcctcctagtgagcggacggaaa

SEQ ID NO: 143774 - DNA, 25 bp, Homo sapien
ccgcctcacagcagccgactcagaa

SEQ ID NO: 143775 - DNA, 25 bp, Homo sapien
tccgcagcgcgatcaggtagagcgc

SEQ ID NO: 143776 - DNA, 25 bp, Homo sapien
tacctggcttggagcgcgtcgaact

SEQ ID NO: 143777 - DNA, 25 bp, Homo sapien
tctactgaccaggagaacgtcttgc

SEQ ID NO: 143778 - DNA, 25 bp, Homo sapien
ctccggccaggatcacaccagtgga

SEQ ID NO: 143779 - DNA, 25 bp, Homo sapien
ggccaccttgaacaaagcacactga

SEQ ID NO: 143780 - DNA, 25 bp, Homo sapien
tgggcccacgccatatctgggtttt

SEQ ID NO: 143781 - DNA, 25 bp, Homo sapien
gtcccgggcctgaaatgaaggatgc

SEQ ID NO: 143782 - DNA, 25 bp, Homo sapien
agagagacaacctcagcgctcggtg

SEQ ID NO: 143783 - DNA, 25 bp, Homo sapien
ccctttacctagagtggcagctttg

SEQ ID NO: 143784 - DNA, 25 bp, Homo sapien
gcccgcggtaagctggaatatccaa

SEQ ID NO: 143785 - DNA, 25 bp, Homo sapien
ggatctcctcaatcatgaagctgcg

SEQ ID NO: 143786 - DNA, 25 bp, Homo sapien
tcggagggatcaaacgacacaggtg

SEQ ID NO: 143787 - DNA, 25 bp, Homo sapien
acggcgtgggccaaacaagattcca

SEQ ID NO: 143788 - DNA, 25 bp, Homo sapien
ttccagacagtgatgtgagggcacc

SEQ ID NO: 143789 - DNA, 25 bp, Homo sapien
caccagagacgccaccgagatgtgc

SEQ ID NO: 143790 - DNA, 25 bp, Homo sapien
tgggaacagctagaaaaccggcggc

SEQ ID NO: 143791 - DNA, 25 bp, Homo sapien
ggtggctccgtgaggatctcctcaa

SEQ ID NO: 143792 - DNA, 25 bp, Homo sapien
cgagatgtgcgcagagagaccaaaa

SEQ ID NO: 143793 - DNA, 25 bp, Homo sapien
tttaagaagcaactgcccgcgttcc

SEQ ID NO: 143794 - DNA, 25 bp, Homo sapien
ttcccatccgcctcataaagggttg

SEQ ID NO: 143795 - DNA, 25 bp, Homo sapien
ctgccttcgacagagccggaggaaa

SEQ ID NO: 143796 - DNA, 25 bp, Homo sapien
ccctgcggattcagaagctgctcca

SEQ ID NO: 143797 - DNA, 25 bp, Homo sapien
tagagactgtagcttccgccgggct

SEQ ID NO: 143798 - DNA, 25 bp, Homo sapien
tctcccaggttagagcccagaagcg

SEQ ID NO: 143799 - DNA, 25 bp, Homo sapien
cgccctgagtatcctgcggaaaatg

SEQ ID NO: 143800 - DNA, 25 bp, Homo sapien
ccgagcccgattgtgtcataaaata

SEQ ID NO: 143801 - DNA, 25 bp, Homo sapien
gggagtatctcctcgaccctgtccg

SEQ ID NO: 143802 - DNA, 25 bp, Homo sapien
aactcggagtgtgtcttgtctttcg

SEQ ID NO: 143803 - DNA, 25 bp, Homo sapien
ctggtcctaagaagatggcgtttgc

SEQ ID NO: 143804 - DNA, 25 bp, Homo sapien
cacggagcgtgcacatttgctcttc

SEQ ID NO: 143805 - DNA, 25 bp, Homo sapien
ttccgtgcgtggcacaacagccatg

SEQ ID NO: 143806 - DNA, 25 bp, Homo sapien
tgtgcccgcttcaaacgaattagta

SEQ ID NO: 143807 - DNA, 25 bp, Homo sapien
gaccctgtccgtgttctgtcctgga

SEQ ID NO: 143808 - DNA, 25 bp, Homo sapien
gggaacttgaacaccgccgcctgct

SEQ ID NO: 143809 - DNA, 25 bp, Homo sapien
gcggaggcttcttccagaacggtca

SEQ ID NO: 143810 - DNA, 25 bp, Homo sapien
tcccagcttctaggcaggttgaggt

SEQ ID NO: 143811 - DNA, 25 bp, Homo sapien
gccctagaagctcggggtcaaattg

SEQ ID NO: 143812 - DNA, 25 bp, Homo sapien
gccgagactggcaacatcttttcta

SEQ ID NO: 143813 - DNA, 25 bp, Homo sapien
tctgattgtccttggcccagcaggc

SEQ ID NO: 143814 - DNA, 25 bp, Homo sapien
agaacggtcagctcacctccggatg

SEQ ID NO: 143815 - DNA, 25 bp, Homo sapien
ggcagtttgtttccgctcccacttg

SEQ ID NO: 143816 - DNA, 25 bp, Homo sapien
gccctctatctaacaggttgacgtc

SEQ ID NO: 143817 - DNA, 25 bp, Homo sapien
gcgcccgttcgaaaatgcccagagc

SEQ ID NO: 143818 - DNA, 25 bp, Homo sapien
caggaggaacaacacaggaagcgcg

SEQ ID NO: 143819 - DNA, 25 bp, Homo sapien
cgacgccgtaagagttgggacgata

SEQ ID NO: 143820 - DNA, 25 bp, Homo sapien
cattggccagcacacgtcacgtgcg

SEQ ID NO: 143821 - DNA, 25 bp, Homo sapien
gccgaccgcagacgacttgtgacac

SEQ ID NO: 143822 - DNA, 25 bp, Homo sapien
acggtccgcttcaggcctccattgg

SEQ ID NO: 143823 - DNA, 25 bp, Homo sapien
cttggaatctcgagcgggaaaaggt

SEQ ID NO: 143824 - DNA, 25 bp, Homo sapien
aggttcggaattcgcagctagttta

SEQ ID NO: 143825 - DNA, 25 bp, Homo sapien
cgtcacttccgctatcaagtttgtg

SEQ ID NO: 143826 - DNA, 25 bp, Homo sapien
ttcaatcaaacttggggcgggcgga

SEQ ID NO: 143827 - DNA, 25 bp, Homo sapien
ggggtcattcttcacattccttacc

SEQ ID NO: 143828 - DNA, 25 bp, Homo sapien
gccattttatttcgcggagactcgc

SEQ ID NO: 143829 - DNA, 25 bp, Homo sapien
tcagacggcttcaccaatgggcttg

SEQ ID NO: 143830 - DNA, 25 bp, Homo sapien
agagcgacgcgcacttcaatcagac

SEQ ID NO: 143831 - DNA, 25 bp, Homo sapien
cgagctcagctaggccaaggcgaaa

SEQ ID NO: 143832 - DNA, 25 bp, Homo sapien
ctctcagccctccactaggaaagaa

SEQ ID NO: 143833 - DNA, 25 bp, Homo sapien
gctgtttaggtagcacccgggccat

SEQ ID NO: 143834 - DNA, 25 bp, Homo sapien
gctcgtcttaccagcagagaaactg

SEQ ID NO: 143835 - DNA, 25 bp, Homo sapien
tgaattaccggtagagcctgggctg

SEQ ID NO: 143836 - DNA, 25 bp, Homo sapien
ttccctcgtggtgtcgtagggagca

SEQ ID NO: 143837 - DNA, 25 bp, Homo sapien
tcgcccgtcgttcaacagcgtgtta

SEQ ID NO: 143838 - DNA, 25 bp, Homo sapien
gcaagtcagtgcacgccacgtcctg

SEQ ID NO: 143839 - DNA, 25 bp, Homo sapien
gagcacctgttcgttcctggagatg

SEQ ID NO: 143840 - DNA, 25 bp, Homo sapien
ctgtggccaaggctgctcgtcttac

SEQ ID NO: 143841 - DNA, 25 bp, Homo sapien
ccctcgcagcattctggatgttgta

SEQ ID NO: 143842 - DNA, 25 bp, Homo sapien
ggatgttgtagtccctcgctccagg

SEQ ID NO: 143843 - DNA, 25 bp, Homo sapien
cagtctgggtagtgtagttccgtgc

SEQ ID NO: 143844 - DNA, 25 bp, Homo sapien
cgtggtgagtgtcctttcacagttc

SEQ ID NO: 143845 - DNA, 25 bp, Homo sapien
cacagttctggtgagctagcccgga

SEQ ID NO: 143846 - DNA, 25 bp, Homo sapien
tgtcgtggccacatgttccttggtg

SEQ ID NO: 143847 - DNA, 25 bp, Homo sapien
actttgggcccagtatgttgacctg

SEQ ID NO: 143848 - DNA, 25 bp, Homo sapien
ttcccgagctacttcgcaggtgcgt

SEQ ID NO: 143849 - DNA, 25 bp, Homo sapien
ctcaaggcgggagcggtccttagcg

SEQ ID NO: 143850 - DNA, 25 bp, Homo sapien
gcctcctggtcatgcttccgctggt

SEQ ID NO: 143851 - DNA, 25 bp, Homo sapien
taatcgcctcctggtcatgcttccg

SEQ ID NO: 143852 - DNA, 25 bp, Homo sapien
taaagttatttgtgattagaaggta

SEQ ID NO: 143853 - DNA, 25 bp, Homo sapien
ggagacgacgcagcgcgagcggaaa

SEQ ID NO: 143854 - DNA, 25 bp, Homo sapien
cccagcatcggttgccggtggttcg

SEQ ID NO: 143855 - DNA, 25 bp, Homo sapien
gggcgaccccatccttgtggccaga

SEQ ID NO: 143856 - DNA, 25 bp, Homo sapien
cgctcccagcatcggttgccggtgg

SEQ ID NO: 143857 - DNA, 25 bp, Homo sapien
ggcgctagacatgggacagtgaata

SEQ ID NO: 143858 - DNA, 25 bp, Homo sapien
aagtcctgatgccaaggggccagtc

SEQ ID NO: 143859 - DNA, 25 bp, Homo sapien
tgcggtcttctgctagcctgatccg

SEQ ID NO: 143860 - DNA, 25 bp, Homo sapien
gggaggcgaattcatcacgaataca

SEQ ID NO: 143861 - DNA, 25 bp, Homo sapien
tcggagttctccgtccctgtaacag

SEQ ID NO: 143862 - DNA, 25 bp, Homo sapien
gcgcagtttctctccaagtctacat

SEQ ID NO: 143863 - DNA, 25 bp, Homo sapien
gggagcatttgaatcagaccgtcga

SEQ ID NO: 143864 - DNA, 25 bp, Homo sapien
cttcggctcttggaaagtcggtcct

SEQ ID NO: 143865 - DNA, 25 bp, Homo sapien
cgcctgcttggatcttcagacaagg

SEQ ID NO: 143866 - DNA, 25 bp, Homo sapien
ttcagacaaggtcggggatcctccc

SEQ ID NO: 143867 - DNA, 25 bp, Homo sapien
tggtcagccatgcttgaaccgggta

SEQ ID NO: 143868 - DNA, 25 bp, Homo sapien
tgccctcctccatgacgaagcgggt

SEQ ID NO: 143869 - DNA, 25 bp, Homo sapien
gtgaatcgcggaaacctttagacgc

SEQ ID NO: 143870 - DNA, 25 bp, Homo sapien
tgcgcaccgccgaagagatggcttt

SEQ ID NO: 143871 - DNA, 25 bp, Homo sapien
aaggcccgactcacaggtgcgcgat

SEQ ID NO: 143872 - DNA, 25 bp, Homo sapien
gagatggctttgactgctgtgcaga

SEQ ID NO: 143873 - DNA, 25 bp, Homo sapien
taacctgttcgctccctgttgggtc

SEQ ID NO: 143874 - DNA, 25 bp, Homo sapien
ctcacttttgctcgaccagcgagga

SEQ ID NO: 143875 - DNA, 25 bp, Homo sapien
cattccgttctgaaggcgacgggga

SEQ ID NO: 143876 - DNA, 25 bp, Homo sapien
cggggacagcatcattccgttctga

SEQ ID NO: 143877 - DNA, 25 bp, Homo sapien
cgccctcctatgaccgcggcagctc

SEQ ID NO: 143878 - DNA, 25 bp, Homo sapien
tggatgacgtcacccggcgcgtgcc

SEQ ID NO: 143879 - DNA, 25 bp, Homo sapien
acgcggctgagacaggtaacctgtt

SEQ ID NO: 143880 - DNA, 25 bp, Homo sapien
cttttgctcgaccagcgaggacccg

SEQ ID NO: 143881 - DNA, 25 bp, Homo sapien
ccagcgaggaggcactccttccgtg

SEQ ID NO: 143882 - DNA, 25 bp, Homo sapien
ccgtactggccgctggcgaacttct

SEQ ID NO: 143883 - DNA, 25 bp, Homo sapien
tggcgaacttctcttccatctgcag

SEQ ID NO: 143884 - DNA, 25 bp, Homo sapien
tgcagcagacacatgccctgtccgg

SEQ ID NO: 143885 - DNA, 25 bp, Homo sapien
aggaactcgcccaggatgcggtagc

SEQ ID NO: 143886 - DNA, 25 bp, Homo sapien
tagctcgtaggtcagctcctgctcc

SEQ ID NO: 143887 - DNA, 25 bp, Homo sapien
aggagagcctaggtgccctcctctc

SEQ ID NO: 143888 - DNA, 25 bp, Homo sapien
tagccctgctgtagctcgtaggtca

SEQ ID NO: 143889 - DNA, 25 bp, Homo sapien
tttccctgcgcgaaagccaccggga

SEQ ID NO: 143890 - DNA, 25 bp, Homo sapien
gaccaggtttccgactccaggagcg

SEQ ID NO: 143891 - DNA, 25 bp, Homo sapien
ggaccctgtcgccttctttgaaatg

SEQ ID NO: 143892 - DNA, 25 bp, Homo sapien
ctcccgcggtaaacttgactgtgtc

SEQ ID NO: 143893 - DNA, 25 bp, Homo sapien
tccaggagcgcgctacgctggctac

SEQ ID NO: 143894 - DNA, 25 bp, Homo sapien
gcgcggccgctatacctttaaggca

SEQ ID NO: 143895 - DNA, 25 bp, Homo sapien
agaacaatacaatgccggcgcgggc

SEQ ID NO: 143896 - DNA, 25 bp, Homo sapien
cacgccgttcgtggggagaacaata

SEQ ID NO: 143897 - DNA, 25 bp, Homo sapien
tccgctgcgtccactgcggacaggg

SEQ ID NO: 143898 - DNA, 25 bp, Homo sapien
ccggcagtgcagctccgcaggcgca

SEQ ID NO: 143899 - DNA, 25 bp, Homo sapien
aagagggagtgtcatcgcctgcagc

SEQ ID NO: 143900 - DNA, 25 bp, Homo sapien
ttttaaagagggagtgtcatcgcct

SEQ ID NO: 143901 - DNA, 25 bp, Homo sapien
actgtgcttggaggaaaggacgaca

SEQ ID NO: 143902 - DNA, 25 bp, Homo sapien
tctgcgaaatcactgtgcttggagg

SEQ ID NO: 143903 - DNA, 25 bp, Homo sapien
cctagcgtctgcgaaatcactgtgc

SEQ ID NO: 143904 - DNA, 25 bp, Homo sapien
agcgtctgcgaaatcactgtgcttg

SEQ ID NO: 143905 - DNA, 25 bp, Homo sapien
gcataggcgtcggaattgtgatttc

SEQ ID NO: 143906 - DNA, 25 bp, Homo sapien
aagtgacataccttgcgggctcagg

SEQ ID NO: 143907 - DNA, 25 bp, Homo sapien
aggcttgggatttctgcagccacgc

SEQ ID NO: 143908 - DNA, 25 bp, Homo sapien
ctgagtggctactgcttgtgctttc

SEQ ID NO: 143909 - DNA, 25 bp, Homo sapien
cttgcttccaagctggcggtaaacc

SEQ ID NO: 143910 - DNA, 25 bp, Homo sapien
gcgtgttttatttaccaggccttca

SEQ ID NO: 143911 - DNA, 25 bp, Homo sapien
ggcaaacacacgttctggggctatc

SEQ ID NO: 143912 - DNA, 25 bp, Homo sapien
ctggggctatcaagaaagttcacac

SEQ ID NO: 143913 - DNA, 25 bp, Homo sapien
ctccggtgcctactgagctgatatc

SEQ ID NO: 143914 - DNA, 25 bp, Homo sapien
tcttgtatttgcagtccaggccttc

SEQ ID NO: 143915 - DNA, 25 bp, Homo sapien
acactggctcagttcagcaggaaca

SEQ ID NO: 143916 - DNA, 25 bp, Homo sapien
agcccttgagcaaaaagccttcgtg

SEQ ID NO: 143917 - DNA, 25 bp, Homo sapien
agccttcgtgtctgtaagtgcccga

SEQ ID NO: 143918 - DNA, 25 bp, Homo sapien
cagcacggtgccagtcatctgcatg

SEQ ID NO: 143919 - DNA, 25 bp, Homo sapien
ggcgcggtgaactctctcttgtatt

SEQ ID NO: 143920 - DNA, 25 bp, Homo sapien
gcaggaacaggagtcgagcccttga

SEQ ID NO: 143921 - DNA, 25 bp, Homo sapien
tatttcccggaatgctcaggaaggc

SEQ ID NO: 143922 - DNA, 25 bp, Homo sapien
aaggatgcagcgtcgttcctcggtc

SEQ ID NO: 143923 - DNA, 25 bp, Homo sapien
gttcctcggtcactcctcgctaggg

SEQ ID NO: 143924 - DNA, 25 bp, Homo sapien
ctgagggtcttatttcccggaatgc

SEQ ID NO: 143925 - DNA, 25 bp, Homo sapien
aatgctcaggaaggcggtgctttcc

SEQ ID NO: 143926 - DNA, 25 bp, Homo sapien
tttccaggcgggtccactcgaggcc

SEQ ID NO: 143927 - DNA, 25 bp, Homo sapien
ctcttccagtcgaggcggcaggtgc

SEQ ID NO: 143928 - DNA, 25 bp, Homo sapien
ggccagtgactgagggtcttatttc

SEQ ID NO: 143929 - DNA, 25 bp, Homo sapien
ggtagaccctatctctcaccactta

SEQ ID NO: 143930 - DNA, 25 bp, Homo sapien
cccagaggccctgacagaccatttt

SEQ ID NO: 143931 - DNA, 25 bp, Homo sapien
catgcagaaaaacggaggtagaccc

SEQ ID NO: 143932 - DNA, 25 bp, Homo sapien
tggtcaagagccaccgcatgcagta

SEQ ID NO: 143933 - DNA, 25 bp, Homo sapien
cgcatgcagtatagcacagtcaatc

SEQ ID NO: 143934 - DNA, 25 bp, Homo sapien
ctgtaccgaaattctactgttgtcc

SEQ ID NO: 143935 - DNA, 25 bp, Homo sapien
actgttgtccaatcgaaggctgccc

SEQ ID NO: 143936 - DNA, 25 bp, Homo sapien
caacacaactgcgagctgggcctgg

SEQ ID NO: 143937 - DNA, 25 bp, Homo sapien
tggcaaagcacacccaccaagagtg

SEQ ID NO: 143938 - DNA, 25 bp, Homo sapien
catgtgtgcacaacctcgctctgga

SEQ ID NO: 143939 - DNA, 25 bp, Homo sapien
cgccctggagaagcgtcacgtgtgt

SEQ ID NO: 143940 - DNA, 25 bp, Homo sapien
acccaagcacgggagccagcgttgg

SEQ ID NO: 143941 - DNA, 25 bp, Homo sapien
gctagaaagccgcacacactatggg

SEQ ID NO: 143942 - DNA, 25 bp, Homo sapien
ccaccaagagtgagcgctagaaagc

SEQ ID NO: 143943 - DNA, 25 bp, Homo sapien
cccagggagctagcgctggcaaagc

SEQ ID NO: 143944 - DNA, 25 bp, Homo sapien
ttcaccggagaagtcacacgcatgc

SEQ ID NO: 143945 - DNA, 25 bp, Homo sapien
ccgcccgggatctgtggcttgaaaa

SEQ ID NO: 143946 - DNA, 25 bp, Homo sapien
cgaccggctcaaaggggcgagcttt

SEQ ID NO: 143947 - DNA, 25 bp, Homo sapien
ggcgagcttttcacggctcccacga

SEQ ID NO: 143948 - DNA, 25 bp, Homo sapien
cgcgcacacgtgtcagcagtgcatt

SEQ ID NO: 143949 - DNA, 25 bp, Homo sapien
gtccgaggcagagaaattcaccttt

SEQ ID NO: 143950 - DNA, 25 bp, Homo sapien
tagctgcctgcgctcaatgaacaaa

SEQ ID NO: 143951 - DNA, 25 bp, Homo sapien
cctttgaagaagacatagctgcctg

SEQ ID NO: 143952 - DNA, 25 bp, Homo sapien
gtactgctccagtgttcccggtttc

SEQ ID NO: 143953 - DNA, 25 bp, Homo sapien
tgatggcccaggtctaaaaggcttt

SEQ ID NO: 143954 - DNA, 25 bp, Homo sapien
ccggtcctggtagtccctatagaga

SEQ ID NO: 143955 - DNA, 25 bp, Homo sapien
tttccaccagcgcacgaagacggga

SEQ ID NO: 143956 - DNA, 25 bp, Homo sapien
ccgcgcgggagacactctttccaaa

SEQ ID NO: 143957 - DNA, 25 bp, Homo sapien
tatagagaccttcgttgatggccca

SEQ ID NO: 143958 - DNA, 25 bp, Homo sapien
cgcgctgtggcatctctggccagaa

SEQ ID NO: 143959 - DNA, 25 bp, Homo sapien
ccagaagcacctttggcggcctgtt

SEQ ID NO: 143960 - DNA, 25 bp, Homo sapien
ggttcccggaactgctgtcttcaga

SEQ ID NO: 143961 - DNA, 25 bp, Homo sapien
ctgtagagacggaagcagtgttacg

SEQ ID NO: 143962 - DNA, 25 bp, Homo sapien
agcagtgttacgtactgacgggtca

SEQ ID NO: 143963 - DNA, 25 bp, Homo sapien
tgcccgtggctactgtagagacgga

SEQ ID NO: 143964 - DNA, 25 bp, Homo sapien
cctggtagtaccctgtgccttctgc

SEQ ID NO: 143965 - DNA, 25 bp, Homo sapien
tgcgatgcctccctggtagtaccct

SEQ ID NO: 143966 - DNA, 25 bp, Homo sapien
gcctcaggtcctcggtgttgacgcc

SEQ ID NO: 143967 - DNA, 25 bp, Homo sapien
ggtgttgacgccctgcgatgcctcc

SEQ ID NO: 143968 - DNA, 25 bp, Homo sapien
actgacgggtcatgacgtttacacg

SEQ ID NO: 143969 - DNA, 25 bp, Homo sapien
gccagctgcaacttacgacaatatt

SEQ ID NO: 143970 - DNA, 25 bp, Homo sapien
gtctgaaatgcaccttggaaatctg

SEQ ID NO: 143971 - DNA, 25 bp, Homo sapien
tggacggctttccagtgctccggaa

SEQ ID NO: 143972 - DNA, 25 bp, Homo sapien
gcgagcctcgtaaacacaatgaacc

SEQ ID NO: 143973 - DNA, 25 bp, Homo sapien
aatgtggcagccgtacaggagttta

SEQ ID NO: 143974 - DNA, 25 bp, Homo sapien
gggcagccacatggatctttccctc

SEQ ID NO: 143975 - DNA, 25 bp, Homo sapien
gagaggcggctcaaaacctggaaaa

SEQ ID NO: 143976 - DNA, 25 bp, Homo sapien
tccgcagactcgcaccgcgaattta

SEQ ID NO: 143977 - DNA, 25 bp, Homo sapien
ctctctaggcgccaagatgtggata

SEQ ID NO: 143978 - DNA, 25 bp, Homo sapien
cggcgcagacatggcctcttcctat

SEQ ID NO: 143979 - DNA, 25 bp, Homo sapien
tataagtaaacactctgcgcggcgc

SEQ ID NO: 143980 - DNA, 25 bp, Homo sapien
gtggtagccgcgcaatcttccgaaa

SEQ ID NO: 143981 - DNA, 25 bp, Homo sapien
ttatacaagtgcacgccagggtttc

SEQ ID NO: 143982 - DNA, 25 bp, Homo sapien
ttctcggaagtttaggccgcaccca

SEQ ID NO: 143983 - DNA, 25 bp, Homo sapien
cggtggagcgcacacatttccttca

SEQ ID NO: 143984 - DNA, 25 bp, Homo sapien
tacaggttcgcaccattgatggctc

SEQ ID NO: 143985 - DNA, 25 bp, Homo sapien
gacacgtctacacaactaggctttt

SEQ ID NO: 143986 - DNA, 25 bp, Homo sapien
gcgcacggtgtatgttcattgaaaa

SEQ ID NO: 143987 - DNA, 25 bp, Homo sapien
gtggctttaagatgcgcacggtgta

SEQ ID NO: 143988 - DNA, 25 bp, Homo sapien
ctggcagtagcgagaagtctagtga

SEQ ID NO: 143989 - DNA, 25 bp, Homo sapien
tattacgttcctccctgcggtagga

SEQ ID NO: 143990 - DNA, 25 bp, Homo sapien
tccagtgtcaccaaggcatcccggg

SEQ ID NO: 143991 - DNA, 25 bp, Homo sapien
gatcgcgaggattcgtcccgacacc

SEQ ID NO: 143992 - DNA, 25 bp, Homo sapien
gacccgcaaacccttgatttgcttc

SEQ ID NO: 143993 - DNA, 25 bp, Homo sapien
actcagaccgcttaaggagcacgtg

SEQ ID NO: 143994 - DNA, 25 bp, Homo sapien
accgcttaaggagcacgtgattttg

SEQ ID NO: 143995 - DNA, 25 bp, Homo sapien
gcgcggaaattcaaaactcagaccg

SEQ ID NO: 143996 - DNA, 25 bp, Homo sapien
gggccagcgcggaaattcaaaactc

SEQ ID NO: 143997 - DNA, 25 bp, Homo sapien
agcaccgggccagcgcggaaattca

SEQ ID NO: 143998 - DNA, 25 bp, Homo sapien
acccgcaaaccgtatgcggtgccgg

SEQ ID NO: 143999 - DNA, 25 bp, Homo sapien
cctaacccgcaaaccgtatgcggtg

SEQ ID NO: 144000 - DNA, 25 bp, Homo sapien
cacgtgattttgtgagtgcctcagg

SEQ ID NO: 144001 - DNA, 25 bp, Homo sapien
tattaagcagttccatggccctcgg

SEQ ID NO: 144002 - DNA, 25 bp, Homo sapien
tgcagcgcggactcacaattacaag

SEQ ID NO: 144003 - DNA, 25 bp, Homo sapien
tctgccgcgccataggcaggacctg

SEQ ID NO: 144004 - DNA, 25 bp, Homo sapien
tcacgtgacggatccgaaaacttta

SEQ ID NO: 144005 - DNA, 25 bp, Homo sapien
aaactcgaggaacgtgctatcagca

SEQ ID NO: 144006 - DNA, 25 bp, Homo sapien
cccgcacacattatttgctaacatt

SEQ ID NO: 144007 - DNA, 25 bp, Homo sapien
gtcgctgcgggtctctttgtctccc

SEQ ID NO: 144008 - DNA, 25 bp, Homo sapien
gacgctgggcttggatttcacatca

SEQ ID NO: 144009 - DNA, 25 bp, Homo sapien
cagggatctttgtgcaagcagaggt

SEQ ID NO: 144010 - DNA, 25 bp, Homo sapien
aggatcacctgccatcgctttaccg

SEQ ID NO: 144011 - DNA, 25 bp, Homo sapien
ctttcagtgaatcgctgtcagctgc

SEQ ID NO: 144012 - DNA, 25 bp, Homo sapien
gcagggctggtttttctttcagtga

SEQ ID NO: 144013 - DNA, 25 bp, Homo sapien
agcgtctacagagctccgagcaggg

SEQ ID NO: 144014 - DNA, 25 bp, Homo sapien
tcacagcgtctacagagctccgagc

SEQ ID NO: 144015 - DNA, 25 bp, Homo sapien
gcttgtggcatcagagcctccctca

SEQ ID NO: 144016 - DNA, 25 bp, Homo sapien
tctttgtgcaagcagaggtggtcgc

SEQ ID NO: 144017 - DNA, 25 bp, Homo sapien
tctcctctctgacctcacgcctgcc

SEQ ID NO: 144018 - DNA, 25 bp, Homo sapien
cttgtcccgcatgagcggcggagcc

SEQ ID NO: 144019 - DNA, 25 bp, Homo sapien
gatgggaatgtccttgtcccgcatg

SEQ ID NO: 144020 - DNA, 25 bp, Homo sapien
gacgcgcacgacaggaggaagcctg

SEQ ID NO: 144021 - DNA, 25 bp, Homo sapien
tctctgacctcacgcctgccctccc

SEQ ID NO: 144022 - DNA, 25 bp, Homo sapien
cccgcagatgggaatgtccttgtcc

SEQ ID NO: 144023 - DNA, 25 bp, Homo sapien
cagatgggaatgtccttgtcccgca

SEQ ID NO: 144024 - DNA, 25 bp, Homo sapien
aacagcgcatctccgcggacggctc

SEQ ID NO: 144025 - DNA, 25 bp, Homo sapien
agcccgtagggctggagacagctca

SEQ ID NO: 144026 - DNA, 25 bp, Homo sapien
tgacagtgtgtgtgatcgcggagga

SEQ ID NO: 144027 - DNA, 25 bp, Homo sapien
cccgtagggctggagacagctcact

SEQ ID NO: 144028 - DNA, 25 bp, Homo sapien
gtagggctggagacagctcactgcc

SEQ ID NO: 144029 - DNA, 25 bp, Homo sapien
tagggctggagacagctcactgccg

SEQ ID NO: 144030 - DNA, 25 bp, Homo sapien
agccgctgcggacggcacagtcccc

SEQ ID NO: 144031 - DNA, 25 bp, Homo sapien
gtctccaccttctccggactccgtg

SEQ ID NO: 144032 - DNA, 25 bp, Homo sapien
gagccggagaggagtcccgaagagg

SEQ ID NO: 144033 - DNA, 25 bp, Homo sapien
ggccgggtcctcctcacacccaggc

SEQ ID NO: 144034 - DNA, 25 bp, Homo sapien
tctcagtgtcccgtcctcttacaga

SEQ ID NO: 144035 - DNA, 25 bp, Homo sapien
cagtgtcccgtcctcttacagacgg

SEQ ID NO: 144036 - DNA, 25 bp, Homo sapien
gtcctcttacagacgggagcctccc

SEQ ID NO: 144037 - DNA, 25 bp, Homo sapien
accagcaggaccgacccagggagct

SEQ ID NO: 144038 - DNA, 25 bp, Homo sapien
cagcaggaccgacccagggagctca

SEQ ID NO: 144039 - DNA, 25 bp, Homo sapien
tggggcacgtcacgcacgatctgcc

SEQ ID NO: 144040 - DNA, 25 bp, Homo sapien
cggggagaaggtcccgcagagctgt

SEQ ID NO: 144041 - DNA, 25 bp, Homo sapien
ttcaggcttccctggccacgacgag

SEQ ID NO: 144042 - DNA, 25 bp, Homo sapien
ggggcactgtcaccgcactggcctg

SEQ ID NO: 144043 - DNA, 25 bp, Homo sapien
ctcccgccggttaggaggcctgtgt

SEQ ID NO: 144044 - DNA, 25 bp, Homo sapien
ggcctgtgtgaaaacctcattatgc

SEQ ID NO: 144045 - DNA, 25 bp, Homo sapien
tgcagcagcataactcgatagcacc

SEQ ID NO: 144046 - DNA, 25 bp, Homo sapien
ggggtccttcaacagctccagcatc

SEQ ID NO: 144047 - DNA, 25 bp, Homo sapien
gcttcatatattagcggcgtgccca

SEQ ID NO: 144048 - DNA, 25 bp, Homo sapien
ctccggacttaagcggggcttcata

SEQ ID NO: 144049 - DNA, 25 bp, Homo sapien
gctccgcccacagaaaggaagattt

SEQ ID NO: 144050 - DNA, 25 bp, Homo sapien
gtgctgcaccaccacggaagaacca

SEQ ID NO: 144051 - DNA, 25 bp, Homo sapien
cgttctcgcgagatcccaatgacaa

SEQ ID NO: 144052 - DNA, 25 bp, Homo sapien
ccaatgacaattcgggagcccgttc

SEQ ID NO: 144053 - DNA, 25 bp, Homo sapien
agcccgagagaactaggtgaacacc

SEQ ID NO: 144054 - DNA, 25 bp, Homo sapien
ggtgaacaccgctttgccagcctca

SEQ ID NO: 144055 - DNA, 25 bp, Homo sapien
tcctccatcctgtggcttcgggttg

SEQ ID NO: 144056 - DNA, 25 bp, Homo sapien
cggctcagcgttctctcgcgttcaa

SEQ ID NO: 144057 - DNA, 25 bp, Homo sapien
gccgacccgcccaggatggaatcag

SEQ ID NO: 144058 - DNA, 25 bp, Homo sapien
gcggcctatgggaaagcagtctcca

SEQ ID NO: 144059 - DNA, 25 bp, Homo sapien
gggccgagtgcctcctttgctctca

SEQ ID NO: 144060 - DNA, 25 bp, Homo sapien
acggggcaaattctcggatagcgac

SEQ ID NO: 144061 - DNA, 25 bp, Homo sapien
gctggaaacgggaaagcgagttctc

SEQ ID NO: 144062 - DNA, 25 bp, Homo sapien
ttaactgatggcttggccggctgga

SEQ ID NO: 144063 - DNA, 25 bp, Homo sapien
cgcctggtgtcagcgcgtttccgaa

SEQ ID NO: 144064 - DNA, 25 bp, Homo sapien
gttcctccgaatcaggctgcttttc

SEQ ID NO: 144065 - DNA, 25 bp, Homo sapien
ggtggattcggaactcagtgagccc

SEQ ID NO: 144066 - DNA, 25 bp, Homo sapien
tcccaggaggtggattcggaactca

SEQ ID NO: 144067 - DNA, 25 bp, Homo sapien
ctcgctggcccgcagaaggctcagg

SEQ ID NO: 144068 - DNA, 25 bp, Homo sapien
ccctgttggcagaacctggcgggag

SEQ ID NO: 144069 - DNA, 25 bp, Homo sapien
aggctcctgtcctgcgatctgcggc

SEQ ID NO: 144070 - DNA, 25 bp, Homo sapien
ctgacgggaacaggctcctgtcctg

SEQ ID NO: 144071 - DNA, 25 bp, Homo sapien
ctctgctgacgggaacaggctcctg

SEQ ID NO: 144072 - DNA, 25 bp, Homo sapien
ttattggggctctgctgacgggaac

SEQ ID NO: 144073 - DNA, 25 bp, Homo sapien
cctttcgctggacagtcggccggac

SEQ ID NO: 144074 - DNA, 25 bp, Homo sapien
gaagcccttggccaatgaaagtaga

SEQ ID NO: 144075 - DNA, 25 bp, Homo sapien
caaagttgtggctccacccaaggca

SEQ ID NO: 144076 - DNA, 25 bp, Homo sapien
gcacgaatttgcttccacgccacgg

SEQ ID NO: 144077 - DNA, 25 bp, Homo sapien
aaggcacctgctccgcacactttaa

SEQ ID NO: 144078 - DNA, 25 bp, Homo sapien
ttggccaatgaaagtagacagaggg

SEQ ID NO: 144079 - DNA, 25 bp, Homo sapien
tggaccggaggctgccatctccagt

SEQ ID NO: 144080 - DNA, 25 bp, Homo sapien
ggaccaaaggcacgaatttgcttcc

SEQ ID NO: 144081 - DNA, 25 bp, Homo sapien
caggcccgggacttacattcccagt

SEQ ID NO: 144082 - DNA, 25 bp, Homo sapien
ctgggagcgcgatgcagttctctgc

SEQ ID NO: 144083 - DNA, 25 bp, Homo sapien
ctctgcgagagcctaggtctgactc

SEQ ID NO: 144084 - DNA, 25 bp, Homo sapien
ggtctgactctaactctgccctgga

SEQ ID NO: 144085 - DNA, 25 bp, Homo sapien
gccctggattctccgctttctagga

SEQ ID NO: 144086 - DNA, 25 bp, Homo sapien
ccgctttctaggagcgcgtgacatc

SEQ ID NO: 144087 - DNA, 25 bp, Homo sapien
tctcagcattcttcgcagcttcatc

SEQ ID NO: 144088 - DNA, 25 bp, Homo sapien
agccttctactgaatctcctccagg

SEQ ID NO: 144089 - DNA, 25 bp, Homo sapien
gttgaatgtcaccactgcgttgctg

SEQ ID NO: 144090 - DNA, 25 bp, Homo sapien
caggggaggagaacgttcctaatgc

SEQ ID NO: 144091 - DNA, 25 bp, Homo sapien
cgcctggcgacgctgctaagaacgc

SEQ ID NO: 144092 - DNA, 25 bp, Homo sapien
gcgacgctgctaagaacgcggagca

SEQ ID NO: 144093 - DNA, 25 bp, Homo sapien
tgaggcggaaggttgaatgtcacca

SEQ ID NO: 144094 - DNA, 25 bp, Homo sapien
cactgcgttgctgaattccggctca

SEQ ID NO: 144095 - DNA, 25 bp, Homo sapien
attccggctcaagattattagtgcg

SEQ ID NO: 144096 - DNA, 25 bp, Homo sapien
gtccatccaggggaggagaacgttc

SEQ ID NO: 144097 - DNA, 25 bp, Homo sapien
tgcctttcctaaatgtccgcggttg

SEQ ID NO: 144098 - DNA, 25 bp, Homo sapien
cgaaacaagagacctgggagccctc

SEQ ID NO: 144099 - DNA, 25 bp, Homo sapien
ccggccttcgtgctccgaaacaaga

SEQ ID NO: 144100 - DNA, 25 bp, Homo sapien
gtccagcagtcctaaccgttcaacg

SEQ ID NO: 144101 - DNA, 25 bp, Homo sapien
ctcactgtggtgaggttgacacttg

SEQ ID NO: 144102 - DNA, 25 bp, Homo sapien
agtcgtttcgattgtgcctttccta

SEQ ID NO: 144103 - DNA, 25 bp, Homo sapien
cgcagatacgtttggccattatcca

SEQ ID NO: 144104 - DNA, 25 bp, Homo sapien
acacttgggccctgggtttcacttg

SEQ ID NO: 144105 - DNA, 25 bp, Homo sapien
gaagccgcgctgttcttatttaaga

SEQ ID NO: 144106 - DNA, 25 bp, Homo sapien
agcgttagcgcaacttccggtattg

SEQ ID NO: 144107 - DNA, 25 bp, Homo sapien
gccgcgcccagtgatggattcaagc

SEQ ID NO: 144108 - DNA, 25 bp, Homo sapien
acagattcgcgcacaccgtaggcca

SEQ ID NO: 144109 - DNA, 25 bp, Homo sapien
tccggcttaggtactgcacccttca

SEQ ID NO: 144110 - DNA, 25 bp, Homo sapien
gcggaagtgcgctccctttgaaacc

SEQ ID NO: 144111 - DNA, 25 bp, Homo sapien
gtcccgccaagtccttcaagttctg

SEQ ID NO: 144112 - DNA, 25 bp, Homo sapien
agttctgggccatgtctgatcttga

SEQ ID NO: 144113 - DNA, 25 bp, Homo sapien
tccttcaaggaaagagctgcttctg

SEQ ID NO: 144114 - DNA, 25 bp, Homo sapien
ggaaagtgactccttcctgtgggca

SEQ ID NO: 144115 - DNA, 25 bp, Homo sapien
tcggctcacacgcacctgagaggtc

SEQ ID NO: 144116 - DNA, 25 bp, Homo sapien
tgcgatgctgtgaacgtcttccttc

SEQ ID NO: 144117 - DNA, 25 bp, Homo sapien
ggaagccgcaccctcttcgtgggtg

SEQ ID NO: 144118 - DNA, 25 bp, Homo sapien
caactgccaggcgatcggccgagac

SEQ ID NO: 144119 - DNA, 25 bp, Homo sapien
acggtcaactcgcacgccctaaggg

SEQ ID NO: 144120 - DNA, 25 bp, Homo sapien
ctccaggaggtgctaagaaagcttc

SEQ ID NO: 144121 - DNA, 25 bp, Homo sapien
ttgtggcctgagtgtagaaagctga

SEQ ID NO: 144122 - DNA, 25 bp, Homo sapien
gtcccgtagaagagcgccgacagca

SEQ ID NO: 144123 - DNA, 25 bp, Homo sapien
gtcagcagcgccttgttgacaagca

SEQ ID NO: 144124 - DNA, 25 bp, Homo sapien
gcctcacccgtaggtggtcagcagc

SEQ ID NO: 144125 - DNA, 25 bp, Homo sapien
cgcgctcaggaagagaacgactttc

SEQ ID NO: 144126 - DNA, 25 bp, Homo sapien
ggcgcctgggaaactcgaccaatgt

SEQ ID NO: 144127 - DNA, 25 bp, Homo sapien
agaacgactttctcaggttgtggcc

SEQ ID NO: 144128 - DNA, 25 bp, Homo sapien
accaatgtgcccagctgagactcga

SEQ ID NO: 144129 - DNA, 25 bp, Homo sapien
atcggggtcgtcctgatgaccgaca

SEQ ID NO: 144130 - DNA, 25 bp, Homo sapien
cacgggtacaccatgaagtcgctga

SEQ ID NO: 144131 - DNA, 25 bp, Homo sapien
tacatttcgcgcctgggcggaacca

SEQ ID NO: 144132 - DNA, 25 bp, Homo sapien
tggcagactgacgtttcccggaatc

SEQ ID NO: 144133 - DNA, 25 bp, Homo sapien
caaaaataacaacctgccgccgcgg

SEQ ID NO: 144134 - DNA, 25 bp, Homo sapien
tgcgcagcagccacctaactagttg

SEQ ID NO: 144135 - DNA, 25 bp, Homo sapien
aactagttgagcagacggcaccggc

SEQ ID NO: 144136 - DNA, 25 bp, Homo sapien
ctggagggccaacagcgttcgaaac

SEQ ID NO: 144137 - DNA, 25 bp, Homo sapien
tgcaagattgaggtcggagccaccc

SEQ ID NO: 144138 - DNA, 25 bp, Homo sapien
ggtggccaaccgcttccatcagctg

SEQ ID NO: 144139 - DNA, 25 bp, Homo sapien
tagggccctcgaaccctggcactga

SEQ ID NO: 144140 - DNA, 25 bp, Homo sapien
ggacccgttcgacatcctgcgcgag

SEQ ID NO: 144141 - DNA, 25 bp, Homo sapien
cactgaggctctacggcaagttgga

SEQ ID NO: 144142 - DNA, 25 bp, Homo sapien
cagcccagcctctgcaagattgagg

SEQ ID NO: 144143 - DNA, 25 bp, Homo sapien
ctggcggggaccttcatcttccagc

SEQ ID NO: 144144 - DNA, 25 bp, Homo sapien
gtcgcagaaggagcgcaagagcctc

SEQ ID NO: 144145 - DNA, 25 bp, Homo sapien
ctgagtggacactccgcggctactt

SEQ ID NO: 144146 - DNA, 25 bp, Homo sapien
gggccaggagaaaccattgtcctcc

SEQ ID NO: 144147 - DNA, 25 bp, Homo sapien
gtggacccagcacgcgtcgtccaga

SEQ ID NO: 144148 - DNA, 25 bp, Homo sapien
cctttagaaacagacttggcccatt

SEQ ID NO: 144149 - DNA, 25 bp, Homo sapien
ttaacacagagaaacacacccaggg

SEQ ID NO: 144150 - DNA, 25 bp, Homo sapien
gcggctacttaaggacacgccaacc

SEQ ID NO: 144151 - DNA, 25 bp, Homo sapien
cattggaagcgagtgagccgttccc

SEQ ID NO: 144152 - DNA, 25 bp, Homo sapien
acttggcccattagagcctccgcgg

SEQ ID NO: 144153 - DNA, 25 bp, Homo sapien
taggggcacctccaagccagcactg

SEQ ID NO: 144154 - DNA, 25 bp, Homo sapien
ggacttcgagcaaaagggctctgcc

SEQ ID NO: 144155 - DNA, 25 bp, Homo sapien
gtctgggaaagctccttagcgatta

SEQ ID NO: 144156 - DNA, 25 bp, Homo sapien
ccaaacgctccgcagaggggacatg

SEQ ID NO: 144157 - DNA, 25 bp, Homo sapien
ggctcacctttgatcacctcggcta

SEQ ID NO: 144158 - DNA, 25 bp, Homo sapien
acgcaagggtcacagccgcccatga

SEQ ID NO: 144159 - DNA, 25 bp, Homo sapien
gtcttatgggaaacgggcatcttca

SEQ ID NO: 144160 - DNA, 25 bp, Homo sapien
ggctcatgactccaaagcatctgga

SEQ ID NO: 144161 - DNA, 25 bp, Homo sapien
gaggagggtgcacaagctaaagtta

SEQ ID NO: 144162 - DNA, 25 bp, Homo sapien
ctgattcagaggttgtgactcgcgc

SEQ ID NO: 144163 - DNA, 25 bp, Homo sapien
gctcgcaatccctgaaggcggaatc

SEQ ID NO: 144164 - DNA, 25 bp, Homo sapien
acaggaactcagaagcagcccgcgg

SEQ ID NO: 144165 - DNA, 25 bp, Homo sapien
accctcggtccatcttgctggtgga

SEQ ID NO: 144166 - DNA, 25 bp, Homo sapien
taaagttaaagctcgcagcccacgc

SEQ ID NO: 144167 - DNA, 25 bp, Homo sapien
ggctgacgcccgcaacttagaaagg

SEQ ID NO: 144168 - DNA, 25 bp, Homo sapien
tcggggaatcctcaggggctgattc

SEQ ID NO: 144169 - DNA, 25 bp, Homo sapien
ggccagatcctctacgtattccttg

SEQ ID NO: 144170 - DNA, 25 bp, Homo sapien
gcccacgctgggaaactcacttgta

SEQ ID NO: 144171 - DNA, 25 bp, Homo sapien
aaggatccctgtacttcgccgtgcg

SEQ ID NO: 144172 - DNA, 25 bp, Homo sapien
cgcaaggtctgcagaagcgggcact

SEQ ID NO: 144173 - DNA, 25 bp, Homo sapien
ctcacttgtaagaaactcctgggga

SEQ ID NO: 144174 - DNA, 25 bp, Homo sapien
cggttctgactcagctctcagggta

SEQ ID NO: 144175 - DNA, 25 bp, Homo sapien
ccgtccacggcgagcaagcattatt

SEQ ID NO: 144176 - DNA, 25 bp, Homo sapien
ttagtaaagcagcaccctcgggccc

SEQ ID NO: 144177 - DNA, 25 bp, Homo sapien
ccaagaatctcggtgctcctggatg

SEQ ID NO: 144178 - DNA, 25 bp, Homo sapien
cggaagtttccagcgccgaccgaca

SEQ ID NO: 144179 - DNA, 25 bp, Homo sapien
tcgcgctcaagatcaacaggtaaga

SEQ ID NO: 144180 - DNA, 25 bp, Homo sapien
ccgccctccaggttcttacaggtgg

SEQ ID NO: 144181 - DNA, 25 bp, Homo sapien
cgcgccacggagtgtctcataaacg

SEQ ID NO: 144182 - DNA, 25 bp, Homo sapien
ataaacggctccttcctttgaggca

SEQ ID NO: 144183 - DNA, 25 bp, Homo sapien
ttcctttgaggcaagtctgagcgcg

SEQ ID NO: 144184 - DNA, 25 bp, Homo sapien
cgaccgacagacgaggtttgcgctt

SEQ ID NO: 144185 - DNA, 25 bp, Homo sapien
ggttcgcctgactcactaaatgcta

SEQ ID NO: 144186 - DNA, 25 bp, Homo sapien
taagctcaggtctcagcgcatcgtg

SEQ ID NO: 144187 - DNA, 25 bp, Homo sapien
gcggtcactactaggcggagttaaa

SEQ ID NO: 144188 - DNA, 25 bp, Homo sapien
ctgtgcgcgcgagactataagcctc

SEQ ID NO: 144189 - DNA, 25 bp, Homo sapien
gcgtagcacaccgactccaggattg

SEQ ID NO: 144190 - DNA, 25 bp, Homo sapien
tcgccctcatgtgctggtgcaacta

SEQ ID NO: 144191 - DNA, 25 bp, Homo sapien
atcgcgaccatcaccctgagaactg

SEQ ID NO: 144192 - DNA, 25 bp, Homo sapien
gggtcacgtgactggactctggatc

SEQ ID NO: 144193 - DNA, 25 bp, Homo sapien
gctccatgggagctggctggctcat

SEQ ID NO: 144194 - DNA, 25 bp, Homo sapien
gtcaccgtggaatgaacgcagcgtg

SEQ ID NO: 144195 - DNA, 25 bp, Homo sapien
tccatttgcttagggaccacgtctg

SEQ ID NO: 144196 - DNA, 25 bp, Homo sapien
gcccgcagctgtgtgattttccatt

SEQ ID NO: 144197 - DNA, 25 bp, Homo sapien
cacgcctgcagtgcccttaagggga

SEQ ID NO: 144198 - DNA, 25 bp, Homo sapien
agtgagcgctcagcacagcacgcct

SEQ ID NO: 144199 - DNA, 25 bp, Homo sapien
acggtgctcaatgaaggcgctccca

SEQ ID NO: 144200 - DNA, 25 bp, Homo sapien
tgtggcacgctccatgagtcaccgt

SEQ ID NO: 144201 - DNA, 25 bp, Homo sapien
gtgcctcgacctcaccggattctgg

SEQ ID NO: 144202 - DNA, 25 bp, Homo sapien
cttcttcaccaaggcggacaggctg

SEQ ID NO: 144203 - DNA, 25 bp, Homo sapien
gcgcgctggtctatttttgggcatc

SEQ ID NO: 144204 - DNA, 25 bp, Homo sapien
actgcgggaaatcgagttctcatgc

SEQ ID NO: 144205 - DNA, 25 bp, Homo sapien
aaggtgtgtctgcaggagccaaatc

SEQ ID NO: 144206 - DNA, 25 bp, Homo sapien
gcagtccaggtacttcagagtttta

SEQ ID NO: 144207 - DNA, 25 bp, Homo sapien
aacaggaatgtctcgggtcttaaca

SEQ ID NO: 144208 - DNA, 25 bp, Homo sapien
ccgctcggaagaggcgaatctccca

SEQ ID NO: 144209 - DNA, 25 bp, Homo sapien
gaaatgtggtttcggacgcgtctcc

SEQ ID NO: 144210 - DNA, 25 bp, Homo sapien
tgccagacgccagagtgcttggatc

SEQ ID NO: 144211 - DNA, 25 bp, Homo sapien
taagagcgtttctgatgccggcaac

SEQ ID NO: 144212 - DNA, 25 bp, Homo sapien
gcccaaccagagaaaagcccatgct

SEQ ID NO: 144213 - DNA, 25 bp, Homo sapien
cccacagatgtagagggtccgcgcc

SEQ ID NO: 144214 - DNA, 25 bp, Homo sapien
ctgcgaagtcgctttcaggcgctga

SEQ ID NO: 144215 - DNA, 25 bp, Homo sapien
cggacatcttctgcggtctaaaaac

SEQ ID NO: 144216 - DNA, 25 bp, Homo sapien
acaactgcccttgcgggctcctgaa

SEQ ID NO: 144217 - DNA, 25 bp, Homo sapien
gcatgctgcgcggtaacccataaca

SEQ ID NO: 144218 - DNA, 25 bp, Homo sapien
tctgcaccagcaaacactaacaggg

SEQ ID NO: 144219 - DNA, 25 bp, Homo sapien
gcgcatatccgttcccagcatgctg

SEQ ID NO: 144220 - DNA, 25 bp, Homo sapien
cgcaccgagcatcttccaactagga

SEQ ID NO: 144221 - DNA, 25 bp, Homo sapien
tggctgcattctggcgcccatacct

SEQ ID NO: 144222 - DNA, 25 bp, Homo sapien
ctgaagccagcaccgcgttttccga

SEQ ID NO: 144223 - DNA, 25 bp, Homo sapien
aaagtggggttgactgcacatgcgc

SEQ ID NO: 144224 - DNA, 25 bp, Homo sapien
tgcgcagacgaaaacgcgcatatcc

SEQ ID NO: 144225 - DNA, 25 bp, Homo sapien
gctgcacaggcgcagaaggagccca

SEQ ID NO: 144226 - DNA, 25 bp, Homo sapien
gtgactcctcacgtttcggcgattc

SEQ ID NO: 144227 - DNA, 25 bp, Homo sapien
tcttgcgtccgccttcgacgtgact

SEQ ID NO: 144228 - DNA, 25 bp, Homo sapien
gatgcagacccaccgtccggggatt

SEQ ID NO: 144229 - DNA, 25 bp, Homo sapien
tgcgcggcgaaccagactcattcag

SEQ ID NO: 144230 - DNA, 25 bp, Homo sapien
cccgggagtctcgagaacccaaatg

SEQ ID NO: 144231 - DNA, 25 bp, Homo sapien
gtcgcccgcgttacaaatgcgcttt

SEQ ID NO: 144232 - DNA, 25 bp, Homo sapien
atttcccataagctcttgcgtccgc

SEQ ID NO: 144233 - DNA, 25 bp, Homo sapien
gcgtcccacttcaggtgagcacctt

SEQ ID NO: 144234 - DNA, 25 bp, Homo sapien
tctcactagaagttgacaggctgtg

SEQ ID NO: 144235 - DNA, 25 bp, Homo sapien
gcgcgcgagccattcggatttaaga

SEQ ID NO: 144236 - DNA, 25 bp, Homo sapien
acctctcagccttagctaggcgtga

SEQ ID NO: 144237 - DNA, 25 bp, Homo sapien
ctaggcgtgaagcagcgagctaagc

SEQ ID NO: 144238 - DNA, 25 bp, Homo sapien
ggttcgcactgaacacctgttccta

SEQ ID NO: 144239 - DNA, 25 bp, Homo sapien
cgagctaagcttgcacatgcgcaga

SEQ ID NO: 144240 - DNA, 25 bp, Homo sapien
atgcgcagacgtcatccagaagacc

SEQ ID NO: 144241 - DNA, 25 bp, Homo sapien
tcccggtggatgtgcctcttcatca

SEQ ID NO: 144242 - DNA, 25 bp, Homo sapien
tgcctcttcatcagacggaattttc

SEQ ID NO: 144243 - DNA, 25 bp, Homo sapien
ttgaagcaatttcccggcaaagtcc

SEQ ID NO: 144244 - DNA, 25 bp, Homo sapien
ggtccgcggtcttgaagcaatttcc

SEQ ID NO: 144245 - DNA, 25 bp, Homo sapien
ctcaggcttcgctccgcgagatctg

SEQ ID NO: 144246 - DNA, 25 bp, Homo sapien
cctctgaatcttggcggggcaccca

SEQ ID NO: 144247 - DNA, 25 bp, Homo sapien
aggccctgacctctgaatcttggcg

SEQ ID NO: 144248 - DNA, 25 bp, Homo sapien
acgcgcccagacgtagaggccctga

SEQ ID NO: 144249 - DNA, 25 bp, Homo sapien
ggctcctacacaggcgcgcggggca

SEQ ID NO: 144250 - DNA, 25 bp, Homo sapien
cgcctcgaggctcctacacaggcgc

SEQ ID NO: 144251 - DNA, 25 bp, Homo sapien
ctcgaggctcctacacaggcgcgcg

SEQ ID NO: 144252 - DNA, 25 bp, Homo sapien
tcgaggctcctacacaggcgcgcgg

SEQ ID NO: 144253 - DNA, 25 bp, Homo sapien
cgaggctcctacacaggcgcgcggg

SEQ ID NO: 144254 - DNA, 25 bp, Homo sapien
aggctcctacacaggcgcgcggggc

SEQ ID NO: 144255 - DNA, 25 bp, Homo sapien
ccgcctcgaggctcctacacaggcg

SEQ ID NO: 144256 - DNA, 25 bp, Homo sapien
gcctcgaggctcctacacaggcgcg

SEQ ID NO: 144257 - DNA, 25 bp, Homo sapien
taccttctaatcacaaataacttta

SEQ ID NO: 144258 - DNA, 25 bp, Homo sapien
accagcggaagcatgaccaggaggc

SEQ ID NO: 144259 - DNA, 25 bp, Homo sapien
ccaccggcaaccgatgctgggagcg

SEQ ID NO: 144260 - DNA, 25 bp, Homo sapien
tgcgtcgtctccctgccccgaacca

SEQ ID NO: 144261 - DNA, 25 bp, Homo sapien
cggaagcatgaccaggaggcgatta

SEQ ID NO: 144262 - DNA, 25 bp, Homo sapien
cgctaaggaccgctcccgccttgag

SEQ ID NO: 144263 - DNA, 25 bp, Homo sapien
gaaccaccggcaaccgatgctggga

SEQ ID NO: 144264 - DNA, 25 bp, Homo sapien
tctggccacaaggatggggtcgccc

SEQ ID NO: 144265 - DNA, 25 bp, Homo sapien
cgtcgacggtctgattcaaatgctc

SEQ ID NO: 144266 - DNA, 25 bp, Homo sapien
ctgttacagggacggagaactccga

SEQ ID NO: 144267 - DNA, 25 bp, Homo sapien
ctgtcccatgtctagcgccttttga

SEQ ID NO: 144268 - DNA, 25 bp, Homo sapien
ctgtaaagttttgtctgcgatgagc

SEQ ID NO: 144269 - DNA, 25 bp, Homo sapien
tgtattcgtgatgaattcgcctccc

SEQ ID NO: 144270 - DNA, 25 bp, Homo sapien
ggaccgactttccaagagccgaagc

SEQ ID NO: 144271 - DNA, 25 bp, Homo sapien
tcaggctagcagaagaccgcagctc

SEQ ID NO: 144272 - DNA, 25 bp, Homo sapien
cgtcatttcgagagcccgtacgact

SEQ ID NO: 144273 - DNA, 25 bp, Homo sapien
ccggcttcagcccacaggatgactg

SEQ ID NO: 144274 - DNA, 25 bp, Homo sapien
gagctccgggcagaagctctcactc

SEQ ID NO: 144275 - DNA, 25 bp, Homo sapien
gcctcctctcagtgtccctaaaggg

SEQ ID NO: 144276 - DNA, 25 bp, Homo sapien
tgcgcaggcaccctcagcaaacaag

SEQ ID NO: 144277 - DNA, 25 bp, Homo sapien
cctcaatacaccctggctgcgggaa

SEQ ID NO: 144278 - DNA, 25 bp, Homo sapien
caagggctcagatctactgactatc

SEQ ID NO: 144279 - DNA, 25 bp, Homo sapien
tgactatcccgacttactgcgctga

SEQ ID NO: 144280 - DNA, 25 bp, Homo sapien
acttgggtctgtgctactcgctccc

SEQ ID NO: 144281 - DNA, 25 bp, Homo sapien
ccagctcgcggagcacttcggagtc

SEQ ID NO: 144282 - DNA, 25 bp, Homo sapien
ctgacccggatccagccggtcccgg

SEQ ID NO: 144283 - DNA, 25 bp, Homo sapien
cccgcaccagcacagagaccaacag

SEQ ID NO: 144284 - DNA, 25 bp, Homo sapien
gagcacttcggagtcgcccagatcc

SEQ ID NO: 144285 - DNA, 25 bp, Homo sapien
gcacttcggagtcgcccagatccgt

SEQ ID NO: 144286 - DNA, 25 bp, Homo sapien
gtcacacttcgggatgcgcggacag

SEQ ID NO: 144287 - DNA, 25 bp, Homo sapien
cacacttcgggatgcgcggacagcc

SEQ ID NO: 144288 - DNA, 25 bp, Homo sapien
ctggatcgcttcctccgggcctagt

SEQ ID NO: 144289 - DNA, 25 bp, Homo sapien
ggggtacaaaccaggatcgctgtga

SEQ ID NO: 144290 - DNA, 25 bp, Homo sapien
ggcctagtgcctcatcctcgctgcg

SEQ ID NO: 144291 - DNA, 25 bp, Homo sapien
ctgctttatgctttgtaagcgaata

SEQ ID NO: 144292 - DNA, 25 bp, Homo sapien
tttgtaagcgaataggggtcaccta

SEQ ID NO: 144293 - DNA, 25 bp, Homo sapien
tccgaggcctttatcttggggagct

SEQ ID NO: 144294 - DNA, 25 bp, Homo sapien
agactaagccgcagagcactgcacc

SEQ ID NO: 144295 - DNA, 25 bp, Homo sapien
gtacaaaccaggatcgctgtgagga

SEQ ID NO: 144296 - DNA, 25 bp, Homo sapien
gcgctccagcgggtcgccacaccca

SEQ ID NO: 144297 - DNA, 25 bp, Homo sapien
ctccgaccaggggtcgtccagaggc

SEQ ID NO: 144298 - DNA, 25 bp, Homo sapien
cagggaaattgaggccacgggccca

SEQ ID NO: 144299 - DNA, 25 bp, Homo sapien
ttcacagcagggaaattgaggccac

SEQ ID NO: 144300 - DNA, 25 bp, Homo sapien
ctgtttctctgtcccgcacgggcag

SEQ ID NO: 144301 - DNA, 25 bp, Homo sapien
accaggaccgggaccgcgacggcat

SEQ ID NO: 144302 - DNA, 25 bp, Homo sapien
ctccagctgcttccgacagggccct

SEQ ID NO: 144303 - DNA, 25 bp, Homo sapien
cttccctctactgcggcgcgagggg

SEQ ID NO: 144304 - DNA, 25 bp, Homo sapien
tagagacgaaggctggtaggaaact

SEQ ID NO: 144305 - DNA, 25 bp, Homo sapien
ccagctgacccacatgcgttgcgga

SEQ ID NO: 144306 - DNA, 25 bp, Homo sapien
cggcgtggaaacctattactaagtg

SEQ ID NO: 144307 - DNA, 25 bp, Homo sapien
acttccagactgtggcgttagctca

SEQ ID NO: 144308 - DNA, 25 bp, Homo sapien
cgtccgctgtcactcaggtagaaca

SEQ ID NO: 144309 - DNA, 25 bp, Homo sapien
gactactgggactgcgacgtctcct

SEQ ID NO: 144310 - DNA, 25 bp, Homo sapien
ctcctctcctgttcgctgcgatatg

SEQ ID NO: 144311 - DNA, 25 bp, Homo sapien
cgcagctctctagaggaccagagtt

SEQ ID NO: 144312 - DNA, 25 bp, Homo sapien
gctctgacgaaacaggcaacttcca

SEQ ID NO: 144313 - DNA, 25 bp, Homo sapien
cagctcgcggaggtgcttctccgag

SEQ ID NO: 144314 - DNA, 25 bp, Homo sapien
ggagtcttacgcaaggggctgactc

SEQ ID NO: 144315 - DNA, 25 bp, Homo sapien
tggagtcttacgcaaggggctgact

SEQ ID NO: 144316 - DNA, 25 bp, Homo sapien
cctgtggagtcttacgcaaggggct

SEQ ID NO: 144317 - DNA, 25 bp, Homo sapien
tcctgtggagtcttacgcaaggggc

SEQ ID NO: 144318 - DNA, 25 bp, Homo sapien
ctcctgtggagtcttacgcaagggg

SEQ ID NO: 144319 - DNA, 25 bp, Homo sapien
agctcgcggaggtgcttctccgagc

SEQ ID NO: 144320 - DNA, 25 bp, Homo sapien
gcagctcgcggaggtgcttctccga

SEQ ID NO: 144321 - DNA, 25 bp, Homo sapien
acgcaaaccctttcaagctggctgg

SEQ ID NO: 144322 - DNA, 25 bp, Homo sapien
ggggacagcacttccggttactctc

SEQ ID NO: 144323 - DNA, 25 bp, Homo sapien
ctccggacactcgaatctgggcttc

SEQ ID NO: 144324 - DNA, 25 bp, Homo sapien
cgcagactctgcgatagtagatcta

SEQ ID NO: 144325 - DNA, 25 bp, Homo sapien
cgatagtagatctaagggccaggct

SEQ ID NO: 144326 - DNA, 25 bp, Homo sapien
gcgaacccggcacggacaagaccta

SEQ ID NO: 144327 - DNA, 25 bp, Homo sapien
gagcaactcccttcgtgcgcctaga

SEQ ID NO: 144328 - DNA, 25 bp, Homo sapien
gccgcccacagagcgctttaacaga

SEQ ID NO: 144329 - DNA, 25 bp, Homo sapien
cagaccgcgtgagcccagcaaagcg

SEQ ID NO: 144330 - DNA, 25 bp, Homo sapien
cagaccgagtgagcttaactaagcc

SEQ ID NO: 144331 - DNA, 25 bp, Homo sapien
ctaagccgttactcgcgtgccagca

SEQ ID NO: 144332 - DNA, 25 bp, Homo sapien
cagttgggcgctccgacctctcaga

SEQ ID NO: 144333 - DNA, 25 bp, Homo sapien
agccgctctcgagctcgcgtggacg

SEQ ID NO: 144334 - DNA, 25 bp, Homo sapien
ctgggctcgcgcaggacatcccgga

SEQ ID NO: 144335 - DNA, 25 bp, Homo sapien
ccgaccaagttccaaatccgcgatc

SEQ ID NO: 144336 - DNA, 25 bp, Homo sapien
ttactcgcgtgccagcagttgggcg

SEQ ID NO: 144337 - DNA, 25 bp, Homo sapien
cggagctgataagcgcgctagtagc

SEQ ID NO: 144338 - DNA, 25 bp, Homo sapien
gttggcccgggcctccataaccatg

SEQ ID NO: 144339 - DNA, 25 bp, Homo sapien
gggcctccataaccatggctgctag

SEQ ID NO: 144340 - DNA, 25 bp, Homo sapien
ctgataagcgcgctagtagcagctc

SEQ ID NO: 144341 - DNA, 25 bp, Homo sapien
cgcgctagtagcagctctggcagaa

SEQ ID NO: 144342 - DNA, 25 bp, Homo sapien
ctctggcagaagcaacggtggcttc

SEQ ID NO: 144343 - DNA, 25 bp, Homo sapien
aagagaaggagaacgtgttggcccg

SEQ ID NO: 144344 - DNA, 25 bp, Homo sapien
taagcgcgctagtagcagctctggc

SEQ ID NO: 144345 - DNA, 25 bp, Homo sapien
gtattattcgcgttcccagagtccc

SEQ ID NO: 144346 - DNA, 25 bp, Homo sapien
accgacaccttgagcgccgttaact

SEQ ID NO: 144347 - DNA, 25 bp, Homo sapien
gacgggcgatttcccaacctcagga

SEQ ID NO: 144348 - DNA, 25 bp, Homo sapien
ctggacctgaacctgagtttgggac

SEQ ID NO: 144349 - DNA, 25 bp, Homo sapien
cggatgcgaattctgcgccgcatta

SEQ ID NO: 144350 - DNA, 25 bp, Homo sapien
cgccgcattagagttccagtcccaa

SEQ ID NO: 144351 - DNA, 25 bp, Homo sapien
ccaaagcctagacgcgtttcctgga

SEQ ID NO: 144352 - DNA, 25 bp, Homo sapien
agtcccttcggatttgcgccatgcg

SEQ ID NO: 144353 - DNA, 25 bp, Homo sapien
gcgcgtacctgcgttgtccaccagg

SEQ ID NO: 144354 - DNA, 25 bp, Homo sapien
agtggttcccgctaccggcgcgaca

SEQ ID NO: 144355 - DNA, 25 bp, Homo sapien
gcggaccaggaagtggttcccgcta

SEQ ID NO: 144356 - DNA, 25 bp, Homo sapien
tgtgttttaaatctctgaagggacc

SEQ ID NO: 144357 - DNA, 25 bp, Homo sapien
tggagttccagagcgttgtgtttta

SEQ ID NO: 144358 - DNA, 25 bp, Homo sapien
cttgaggtgattcccaagccgcggg

SEQ ID NO: 144359 - DNA, 25 bp, Homo sapien
cacgcgcagaaaccgctaggtggcg

SEQ ID NO: 144360 - DNA, 25 bp, Homo sapien
ctgcgttgtccaccaggaggcgctc

SEQ ID NO: 144361 - DNA, 25 bp, Homo sapien
ccaagagggactgagcgtggctccc

SEQ ID NO: 144362 - DNA, 25 bp, Homo sapien
ctcttcctggtaccagcggggaagc

SEQ ID NO: 144363 - DNA, 25 bp, Homo sapien
gcaaaatattcagctgtcgccgccg

SEQ ID NO: 144364 - DNA, 25 bp, Homo sapien
ctgagcgtggctccctctataaata

SEQ ID NO: 144365 - DNA, 25 bp, Homo sapien
cgtggctccctctataaatagctgc

SEQ ID NO: 144366 - DNA, 25 bp, Homo sapien
ctataaatagctgccgcctcgggtt

SEQ ID NO: 144367 - DNA, 25 bp, Homo sapien
gtcgctcaaactcttcctggtacca

SEQ ID NO: 144368 - DNA, 25 bp, Homo sapien
cctcagccatatctgggcaaaatat

SEQ ID NO: 144369 - DNA, 25 bp, Homo sapien
tcgggcctatgatgcgtcctccaac

SEQ ID NO: 144370 - DNA, 25 bp, Homo sapien
tggttccagtacagccgctccctgg

SEQ ID NO: 144371 - DNA, 25 bp, Homo sapien
gagccacgcagcttcagatgcgatg

SEQ ID NO: 144372 - DNA, 25 bp, Homo sapien
caggggcagtggttccagtacagcc

SEQ ID NO: 144373 - DNA, 25 bp, Homo sapien
tggccacagtttcccggtctatatc

SEQ ID NO: 144374 - DNA, 25 bp, Homo sapien
ttcccggtctatatcgggcctatga

SEQ ID NO: 144375 - DNA, 25 bp, Homo sapien
atgatgcgtcctccaacctgcgcag

SEQ ID NO: 144376 - DNA, 25 bp, Homo sapien
acgcagcttcagatgcgatgagctg

SEQ ID NO: 144377 - DNA, 25 bp, Homo sapien
ggccaccgggaaaccattgagaagc

SEQ ID NO: 144378 - DNA, 25 bp, Homo sapien
ctttccataccaaggggcggcacgt

SEQ ID NO: 144379 - DNA, 25 bp, Homo sapien
gtgccagacgttcgtagcccactga

SEQ ID NO: 144380 - DNA, 25 bp, Homo sapien
cgtgacgtcaccaagctccggaagt

SEQ ID NO: 144381 - DNA, 25 bp, Homo sapien
cgccgcgtatttgggtagaaaagct

SEQ ID NO: 144382 - DNA, 25 bp, Homo sapien
tgtctccgcctagcaattgtcactg

SEQ ID NO: 144383 - DNA, 25 bp, Homo sapien
gatgagcacatacccgccagtcctg

SEQ ID NO: 144384 - DNA, 25 bp, Homo sapien
agacagttcctgcagcgcttaccgc

SEQ ID NO: 144385 - DNA, 25 bp, Homo sapien
caggctcaccagacactgcgttcag

SEQ ID NO: 144386 - DNA, 25 bp, Homo sapien
cgcggcccgggtcttgacctcctca

SEQ ID NO: 144387 - DNA, 25 bp, Homo sapien
cggcccgggtcttgacctcctcagg

SEQ ID NO: 144388 - DNA, 25 bp, Homo sapien
tcaggctcaccagacactgcgttca

SEQ ID NO: 144389 - DNA, 25 bp, Homo sapien
tcaccagacactgcgttcaggcctc

SEQ ID NO: 144390 - DNA, 25 bp, Homo sapien
gctcaccagacactgcgttcaggcc

SEQ ID NO: 144391 - DNA, 25 bp, Homo sapien
ggctcaccagacactgcgttcaggc

SEQ ID NO: 144392 - DNA, 25 bp, Homo sapien
aggctcaccagacactgcgttcagg

SEQ ID NO: 144393 - DNA, 25 bp, Homo sapien
agacgccaggctgggatttccgctc

SEQ ID NO: 144394 - DNA, 25 bp, Homo sapien
cgctgtcaggagtaggagttcagcc

SEQ ID NO: 144395 - DNA, 25 bp, Homo sapien
tggccactgagtgcagaacacgccg

SEQ ID NO: 144396 - DNA, 25 bp, Homo sapien
gaacacgccgagcttcggaggtctg

SEQ ID NO: 144397 - DNA, 25 bp, Homo sapien
tctaattgtctgattcgtgaactcg

SEQ ID NO: 144398 - DNA, 25 bp, Homo sapien
tgaactcggaagctgacgtcacgcc

SEQ ID NO: 144399 - DNA, 25 bp, Homo sapien
tcacgcccagacgtcccaaggtatg

SEQ ID NO: 144400 - DNA, 25 bp, Homo sapien
cgtcccaaggtatgagctgtagata

SEQ ID NO: 144401 - DNA, 25 bp, Homo sapien
atacgccagcggagttgacgcgacc

SEQ ID NO: 144402 - DNA, 25 bp, Homo sapien
agcggcctttctgagtgagagcgcc

SEQ ID NO: 144403 - DNA, 25 bp, Homo sapien
gctccgcgggttgctctaaagccgc

SEQ ID NO: 144404 - DNA, 25 bp, Homo sapien
actcggcttgcacgagccagtctgg

SEQ ID NO: 144405 - DNA, 25 bp, Homo sapien
gcggattccctctccgactcgggga

SEQ ID NO: 144406 - DNA, 25 bp, Homo sapien
cccgcgtgcgacagaggaacgctct

SEQ ID NO: 144407 - DNA, 25 bp, Homo sapien
cggggagaatctgcacacatacgcc

SEQ ID NO: 144408 - DNA, 25 bp, Homo sapien
ggtcgtggacaggacgctttgacaa

SEQ ID NO: 144409 - DNA, 25 bp, Homo sapien
cccagtgtacctttcctgcagcgtg

SEQ ID NO: 144410 - DNA, 25 bp, Homo sapien
tgttacgtggcgcacagagaacgtc

SEQ ID NO: 144411 - DNA, 25 bp, Homo sapien
gccatggacgatcgctgggttctag

SEQ ID NO: 144412 - DNA, 25 bp, Homo sapien
aacgtgactggaagctccctggcca

SEQ ID NO: 144413 - DNA, 25 bp, Homo sapien
agggccaggacttccgaggctttag

SEQ ID NO: 144414 - DNA, 25 bp, Homo sapien
cccacttagggaagatggcccaaga

SEQ ID NO: 144415 - DNA, 25 bp, Homo sapien
ttgctccaaggtctcgggtaaccga

SEQ ID NO: 144416 - DNA, 25 bp, Homo sapien
cagagaacgtcgcttccagaggacc

SEQ ID NO: 144417 - DNA, 25 bp, Homo sapien
ggtcatcggcacacggagtttcagc

SEQ ID NO: 144418 - DNA, 25 bp, Homo sapien
acacggagtttcagcccgagtgccg

SEQ ID NO: 144419 - DNA, 25 bp, Homo sapien
acagtcagccgctaggggattagga

SEQ ID NO: 144420 - DNA, 25 bp, Homo sapien
attcaagccattcagcgagacagga

SEQ ID NO: 144421 - DNA, 25 bp, Homo sapien
cattgtgctggggactcgcccaaag

SEQ ID NO: 144422 - DNA, 25 bp, Homo sapien
aggcttcagggcgaatccctgactc

SEQ ID NO: 144423 - DNA, 25 bp, Homo sapien
ttatctgctcacagcgggtggctcc

SEQ ID NO: 144424 - DNA, 25 bp, Homo sapien
cagtgctgccggttatctgctcaca

SEQ ID NO: 144425 - DNA, 25 bp, Homo sapien
cccattcttcaggaaagagccgccg

SEQ ID NO: 144426 - DNA, 25 bp, Homo sapien
ggccgtcgtagaccgtgcagctctc

SEQ ID NO: 144427 - DNA, 25 bp, Homo sapien
gtagaccgtgcagctctccttgggt

SEQ ID NO: 144428 - DNA, 25 bp, Homo sapien
ccgtgcagctctccttgggtggctg

SEQ ID NO: 144429 - DNA, 25 bp, Homo sapien
cagagacgcagcacttacctgggcc

SEQ ID NO: 144430 - DNA, 25 bp, Homo sapien
cagcacttacctgggccggttgtgc

SEQ ID NO: 144431 - DNA, 25 bp, Homo sapien
tctcacgcctcagcggccaggcatg

SEQ ID NO: 144432 - DNA, 25 bp, Homo sapien
cgggccttgtgaaatcgcgcgcgct

SEQ ID NO: 144433 - DNA, 25 bp, Homo sapien
aatcctggactctagacgttgcctg

SEQ ID NO: 144434 - DNA, 25 bp, Homo sapien
ccgtaaagctgctggacctccaagc

SEQ ID NO: 144435 - DNA, 25 bp, Homo sapien
tcaaccgctacttcttccgtggaga

SEQ ID NO: 144436 - DNA, 25 bp, Homo sapien
tctaactgaaatgcgcctgcgggcc

SEQ ID NO: 144437 - DNA, 25 bp, Homo sapien
cccgctagaccgcagaaaatgttac

SEQ ID NO: 144438 - DNA, 25 bp, Homo sapien
cgcccagggtcccagaatctaactg

SEQ ID NO: 144439 - DNA, 25 bp, Homo sapien
cgctgctctgagaacactgagtgtc

SEQ ID NO: 144440 - DNA, 25 bp, Homo sapien
cttgccgagctctgggaaaccgaaa

SEQ ID NO: 144441 - DNA, 25 bp, Homo sapien
cgccctccagctgctatttaacaga

SEQ ID NO: 144442 - DNA, 25 bp, Homo sapien
gccaaggcccggaatcctatacgta

SEQ ID NO: 144443 - DNA, 25 bp, Homo sapien
tggccagaactctcgtcttgggatc

SEQ ID NO: 144444 - DNA, 25 bp, Homo sapien
tggaaggcatgccacccgttactgg

SEQ ID NO: 144445 - DNA, 25 bp, Homo sapien
ccagtgaatggccagggaacgaacc

SEQ ID NO: 144446 - DNA, 25 bp, Homo sapien
ccgcgaggatctcaggttaggacca

SEQ ID NO: 144447 - DNA, 25 bp, Homo sapien
tttgagcgtttccacacaccgggtc

SEQ ID NO: 144448 - DNA, 25 bp, Homo sapien
ctctgccgcagaaggttgtcaagca

SEQ ID NO: 144449 - DNA, 25 bp, Homo sapien
tacccggcttacatgcacgacgcgg

SEQ ID NO: 144450 - DNA, 25 bp, Homo sapien
accagagtccagtcccggtcacgag

SEQ ID NO: 144451 - DNA, 25 bp, Homo sapien
tagcgggtcactcccgagcctctgt

SEQ ID NO: 144452 - DNA, 25 bp, Homo sapien
acgctgggcggcatctacaagttca

SEQ ID NO: 144453 - DNA, 25 bp, Homo sapien
tgcttcctcaagatcccgcgcgagg

SEQ ID NO: 144454 - DNA, 25 bp, Homo sapien
cccaacgcggaggacatgttcgaga

SEQ ID NO: 144455 - DNA, 25 bp, Homo sapien
caagggacccttcagccggagacca

SEQ ID NO: 144456 - DNA, 25 bp, Homo sapien
taagggcaactactgggcgcttgac

SEQ ID NO: 144457 - DNA, 25 bp, Homo sapien
tcaaggcgttgaagacagagcgaca

SEQ ID NO: 144458 - DNA, 25 bp, Homo sapien
gcctcatccacagcggggtcgcggg

SEQ ID NO: 144459 - DNA, 25 bp, Homo sapien
gtacctcggagacagtgcgcgccgc

SEQ ID NO: 144460 - DNA, 25 bp, Homo sapien
cgagtacctcggagacagtgcgcgc

SEQ ID NO: 144461 - DNA, 25 bp, Homo sapien
acaccaagagctcgcgcaccggccg

SEQ ID NO: 144462 - DNA, 25 bp, Homo sapien
tcccaccggccgacgacaccaagag

SEQ ID NO: 144463 - DNA, 25 bp, Homo sapien
gttgaagacagagcgacagcccttc

SEQ ID NO: 144464 - DNA, 25 bp, Homo sapien
gcgttgaagacagagcgacagccct

SEQ ID NO: 144465 - DNA, 25 bp, Homo sapien
tgccttcgccgtaggtaaaagaatg

SEQ ID NO: 144466 - DNA, 25 bp, Homo sapien
tgacgcacgtcagttccagatcgtg

SEQ ID NO: 144467 - DNA, 25 bp, Homo sapien
tgggcctaaacctctccagagtgtg

SEQ ID NO: 144468 - DNA, 25 bp, Homo sapien
gccggtgttggaagttacctgtctc

SEQ ID NO: 144469 - DNA, 25 bp, Homo sapien
gtcccgcgaacccaggagaatgtgc

SEQ ID NO: 144470 - DNA, 25 bp, Homo sapien
tctccatggggcttcgaaccctatc

SEQ ID NO: 144471 - DNA, 25 bp, Homo sapien
gccctcctagggtagaatgcgactc

SEQ ID NO: 144472 - DNA, 25 bp, Homo sapien
agcacatcacgtggtctccgcagca

SEQ ID NO: 144473 - DNA, 25 bp, Homo sapien
ttttcttttgaagggagcgagaagc

SEQ ID NO: 144474 - DNA, 25 bp, Homo sapien
gcgagcgcgcgaggattaactcttt

SEQ ID NO: 144475 - DNA, 25 bp, Homo sapien
gattaactctttgccgcccgcgggc

SEQ ID NO: 144476 - DNA, 25 bp, Homo sapien
agcaaactttgagcgcttcgcccgc

SEQ ID NO: 144477 - DNA, 25 bp, Homo sapien
agccatgtttgcagcctcccgggat

SEQ ID NO: 144478 - DNA, 25 bp, Homo sapien
gtcgaccaaggccaaccgttgtggc

SEQ ID NO: 144479 - DNA, 25 bp, Homo sapien
cgctgggagccatgtttgcagcctc

SEQ ID NO: 144480 - DNA, 25 bp, Homo sapien
acttgcatgtaatggtggccacctg

SEQ ID NO: 144481 - DNA, 25 bp, Homo sapien
gagcgtggacttcgtgcattcggaa

SEQ ID NO: 144482 - DNA, 25 bp, Homo sapien
ccttcgccgaagtgctgtgtccggt

SEQ ID NO: 144483 - DNA, 25 bp, Homo sapien
tcacccgcttaacgacacgaatcag

SEQ ID NO: 144484 - DNA, 25 bp, Homo sapien
gggttccagagaattctcaaccgtc

SEQ ID NO: 144485 - DNA, 25 bp, Homo sapien
ggagctcgcgctacgagtcatttta

SEQ ID NO: 144486 - DNA, 25 bp, Homo sapien
cgtttatcgataaccgcgtgtgcgc

SEQ ID NO: 144487 - DNA, 25 bp, Homo sapien
tgtgaaagtcgagacgagaaagctc

SEQ ID NO: 144488 - DNA, 25 bp, Homo sapien
cgaacgtgtcacgtctgcgtttatc

SEQ ID NO: 144489 - DNA, 25 bp, Homo sapien
cacccgtgcttcatcattgccgaga

SEQ ID NO: 144490 - DNA, 25 bp, Homo sapien
tgcacgcacggataccgcgatggtc

SEQ ID NO: 144491 - DNA, 25 bp, Homo sapien
cctggacgtagccaagcgcatgatc

SEQ ID NO: 144492 - DNA, 25 bp, Homo sapien
gagaccacgctctgggacagcaagc

SEQ ID NO: 144493 - DNA, 25 bp, Homo sapien
agcaagcctcaagcctcgcacagga

SEQ ID NO: 144494 - DNA, 25 bp, Homo sapien
cccagactggtagtgaggctttgga

SEQ ID NO: 144495 - DNA, 25 bp, Homo sapien
gcctcctgcagggaatgcttgctcc

SEQ ID NO: 144496 - DNA, 25 bp, Homo sapien
gtctcgcagcgttgctcacagaaca

SEQ ID NO: 144497 - DNA, 25 bp, Homo sapien
cgtgcatcgtgtcaggatccagcgt

SEQ ID NO: 144498 - DNA, 25 bp, Homo sapien
cagcacttgccagagcgcgtcgaac

SEQ ID NO: 144499 - DNA, 25 bp, Homo sapien
gcgaagcagtcacgagccagcactt

SEQ ID NO: 144500 - DNA, 25 bp, Homo sapien
tcatgccgcccgtcacgtcgtagaa

SEQ ID NO: 144501 - DNA, 25 bp, Homo sapien
ggaaggcccagtactcaaggtcgta

SEQ ID NO: 144502 - DNA, 25 bp, Homo sapien
aaggtcgtagcgcttgaggcaccag

SEQ ID NO: 144503 - DNA, 25 bp, Homo sapien
ctgcacgtcaacctcccagtagtgg

SEQ ID NO: 144504 - DNA, 25 bp, Homo sapien
gggaacccaccaacgcacgtgcaaa

SEQ ID NO: 144505 - DNA, 25 bp, Homo sapien
gccgggcacctttaagctgtttgta

SEQ ID NO: 144506 - DNA, 25 bp, Homo sapien
ccctccggaaagaatgggatatgcc

SEQ ID NO: 144507 - DNA, 25 bp, Homo sapien
ccacagcgcggaagttgagcccaaa

SEQ ID NO: 144508 - DNA, 25 bp, Homo sapien
gcacctgttttctccttctacgcga

SEQ ID NO: 144509 - DNA, 25 bp, Homo sapien
tgtttgtaagcccacgtgactcacc

SEQ ID NO: 144510 - DNA, 25 bp, Homo sapien
gtgcggaacaagtctcccaaatttc

SEQ ID NO: 144511 - DNA, 25 bp, Homo sapien
tcctgggatgcggacctcttaacgc

SEQ ID NO: 144512 - DNA, 25 bp, Homo sapien
tgcgcgccagcaagcctaagttaac

SEQ ID NO: 144513 - DNA, 25 bp, Homo sapien
gagcatcctccgaccagcagggtgc

SEQ ID NO: 144514 - DNA, 25 bp, Homo sapien
acagaagagctcagccacgcggtcg

SEQ ID NO: 144515 - DNA, 25 bp, Homo sapien
agccgcatccctcgacaagctccga

SEQ ID NO: 144516 - DNA, 25 bp, Homo sapien
cgctctgaactttcggtcgaccgct

SEQ ID NO: 144517 - DNA, 25 bp, Homo sapien
gtcgaccgcttagacgccctctggg

SEQ ID NO: 144518 - DNA, 25 bp, Homo sapien
cctctggggcacctttggtttccag

SEQ ID NO: 144519 - DNA, 25 bp, Homo sapien
ttccaggttgtaacccgccactggc

SEQ ID NO: 144520 - DNA, 25 bp, Homo sapien
ctcctcggccgttatgcctgggctg

SEQ ID NO: 144521 - DNA, 25 bp, Homo sapien
gacaagagtcccatggagcacccgg

SEQ ID NO: 144522 - DNA, 25 bp, Homo sapien
agggtcccgacaagagtcccatgga

SEQ ID NO: 144523 - DNA, 25 bp, Homo sapien
cagagtgagcttccctcaccgcggg

SEQ ID NO: 144524 - DNA, 25 bp, Homo sapien
tgcagacagtgctcatgagggcagc

SEQ ID NO: 144525 - DNA, 25 bp, Homo sapien
acagtgctcatgagggcagcgagcc

SEQ ID NO: 144526 - DNA, 25 bp, Homo sapien
accgtttcctgtaccaggaagctga

SEQ ID NO: 144527 - DNA, 25 bp, Homo sapien
ctgaggcccagcaggtaacgcagcc

SEQ ID NO: 144528 - DNA, 25 bp, Homo sapien
cccagcaggtaacgcagccaagagg

SEQ ID NO: 144529 - DNA, 25 bp, Homo sapien
tgaaatggagacagtaaccgcgtcg

SEQ ID NO: 144530 - DNA, 25 bp, Homo sapien
tggagacagtaaccgcgtcggcctc

SEQ ID NO: 144531 - DNA, 25 bp, Homo sapien
gcgccgtgccctcgctgcgtggtgt

SEQ ID NO: 144532 - DNA, 25 bp, Homo sapien
gtgtgggatgaggaacctgacctcc

SEQ ID NO: 144533 - DNA, 25 bp, Homo sapien
tgggatgaggaacctgacctcccgg

SEQ ID NO: 144534 - DNA, 25 bp, Homo sapien
ttgtgaaatggagacagtaaccgcg

SEQ ID NO: 144535 - DNA, 25 bp, Homo sapien
gcgcgcacacgtgctgggaacaggc

SEQ ID NO: 144536 - DNA, 25 bp, Homo sapien
cccgttgtgaaatggagacagtaac

SEQ ID NO: 144537 - DNA, 25 bp, Homo sapien
aggagcagtgctttgtgcaaggtca

SEQ ID NO: 144538 - DNA, 25 bp, Homo sapien
ggggccaccaatgagcaagctatcc

SEQ ID NO: 144539 - DNA, 25 bp, Homo sapien
accttgatgactgccgcgcaggtgg

SEQ ID NO: 144540 - DNA, 25 bp, Homo sapien
cctaccttgatgactgccgcgcagg

SEQ ID NO: 144541 - DNA, 25 bp, Homo sapien
gcaagctatcctgacggggaaactg

SEQ ID NO: 144542 - DNA, 25 bp, Homo sapien
agtgctttgtgcaaggtcacgcaaa

SEQ ID NO: 144543 - DNA, 25 bp, Homo sapien
aggtcacgcaaaggggctgaaagcc

SEQ ID NO: 144544 - DNA, 25 bp, Homo sapien
aatgagcaagctatcctgacgggga

SEQ ID NO: 144545 - DNA, 25 bp, Homo sapien
ccgcgagtaatacagctgacatttc

SEQ ID NO: 144546 - DNA, 25 bp, Homo sapien
cacagagtttcttggggaccgcctc

SEQ ID NO: 144547 - DNA, 25 bp, Homo sapien
cttccctggtagttcgcatagtcac

SEQ ID NO: 144548 - DNA, 25 bp, Homo sapien
tcagcgtccgccttacagtcaaaca

SEQ ID NO: 144549 - DNA, 25 bp, Homo sapien
gctgtctgccactcttctcctggtg

SEQ ID NO: 144550 - DNA, 25 bp, Homo sapien
caccagggacaaatctcggagactc

SEQ ID NO: 144551 - DNA, 25 bp, Homo sapien
ccattggctgaaaggaagaccgctg

SEQ ID NO: 144552 - DNA, 25 bp, Homo sapien
tagtgctttcttgcacccgatgggc

SEQ ID NO: 144553 - DNA, 25 bp, Homo sapien
gcttggcaaatgttaccagctgtgc

SEQ ID NO: 144554 - DNA, 25 bp, Homo sapien
ccggaggttgcctgtgtccaaacca

SEQ ID NO: 144555 - DNA, 25 bp, Homo sapien
gcggcgcccgtgacggatcaatcac

SEQ ID NO: 144556 - DNA, 25 bp, Homo sapien
tcaatcggggatctgaccaaaggcc

SEQ ID NO: 144557 - DNA, 25 bp, Homo sapien
cggatctgctcgatggccagttcca

SEQ ID NO: 144558 - DNA, 25 bp, Homo sapien
tcatagagccgcaggtcgaggaagt

SEQ ID NO: 144559 - DNA, 25 bp, Homo sapien
cggacactcacctccgtgtcataga

SEQ ID NO: 144560 - DNA, 25 bp, Homo sapien
gccacctccttggtgagcggcatga

SEQ ID NO: 144561 - DNA, 25 bp, Homo sapien
gtgttgcccgcctcgtccgagcaat

SEQ ID NO: 144562 - DNA, 25 bp, Homo sapien
agctgcgtgggccttgactttacta

SEQ ID NO: 144563 - DNA, 25 bp, Homo sapien
ccagaaacttcctgtcagggcagag

SEQ ID NO: 144564 - DNA, 25 bp, Homo sapien
tattcgggagtccagggacgctcag

SEQ ID NO: 144565 - DNA, 25 bp, Homo sapien
gtccgagcaatccacgggcaccgga

SEQ ID NO: 144566 - DNA, 25 bp, Homo sapien
agcaggaagcgcaccagcggttcgt

SEQ ID NO: 144567 - DNA, 25 bp, Homo sapien
ttgcggctgttgaccgaggcaccgc

SEQ ID NO: 144568 - DNA, 25 bp, Homo sapien
cctccagtgcccgtattcgggagtc

SEQ ID NO: 144569 - DNA, 25 bp, Homo sapien
ggatccgggtcctggcctccaccgc

SEQ ID NO: 144570 - DNA, 25 bp, Homo sapien
ccgcatctcactgcaccgccgcctg

SEQ ID NO: 144571 - DNA, 25 bp, Homo sapien
gcaccagattaacatctacctcagc

SEQ ID NO: 144572 - DNA, 25 bp, Homo sapien
gctgcaccagattaacatctacctc

SEQ ID NO: 144573 - DNA, 25 bp, Homo sapien
tgcggctgcaccagattaacatcta

SEQ ID NO: 144574 - DNA, 25 bp, Homo sapien
ctcctggcgctactggcgttggccg

SEQ ID NO: 144575 - DNA, 25 bp, Homo sapien
gcagatcgctggctgcagttggcgg

SEQ ID NO: 144576 - DNA, 25 bp, Homo sapien
cgctgttggtgctcctggcgctact

SEQ ID NO: 144577 - DNA, 25 bp, Homo sapien
ctgtgtcccggcatcgtctgccctg

SEQ ID NO: 144578 - DNA, 25 bp, Homo sapien
tctggcccaactctaccctgtagta

SEQ ID NO: 144579 - DNA, 25 bp, Homo sapien
tggaagacgttttctggcccaactc

SEQ ID NO: 144580 - DNA, 25 bp, Homo sapien
cccatctgggtctttatggaagacg

SEQ ID NO: 144581 - DNA, 25 bp, Homo sapien
tggcccttgaagattaaggtatttc

SEQ ID NO: 144582 - DNA, 25 bp, Homo sapien
cccatggcccttgaagattaaggta

SEQ ID NO: 144583 - DNA, 25 bp, Homo sapien
ttcagtagctgtgggagagccccca

SEQ ID NO: 144584 - DNA, 25 bp, Homo sapien
gattaaggtatttcccatctgggtc

SEQ ID NO: 144585 - DNA, 25 bp, Homo sapien
cgccgcctttgttccctgcaggaag

SEQ ID NO: 144586 - DNA, 25 bp, Homo sapien
gatgcgtgcctcattcctggacata

SEQ ID NO: 144587 - DNA, 25 bp, Homo sapien
tcctggacataaaagggagtcttgc

SEQ ID NO: 144588 - DNA, 25 bp, Homo sapien
agggagtcttgccactcagtgcgca

SEQ ID NO: 144589 - DNA, 25 bp, Homo sapien
cccgcgagatggcaccaaggtaaga

SEQ ID NO: 144590 - DNA, 25 bp, Homo sapien
gggctttcctcgcaggttacataag

SEQ ID NO: 144591 - DNA, 25 bp, Homo sapien
ggtgcgacaggtaagcaacccggtc

SEQ ID NO: 144592 - DNA, 25 bp, Homo sapien
aagctccaacgctctgctcgactag

SEQ ID NO: 144593 - DNA, 25 bp, Homo sapien
tgtcacaggctatggtggcttcccg

SEQ ID NO: 144594 - DNA, 25 bp, Homo sapien
cggcctacagtttcgggcctggtgc

SEQ ID NO: 144595 - DNA, 25 bp, Homo sapien
gcctggtgccaatgttggccgccca

SEQ ID NO: 144596 - DNA, 25 bp, Homo sapien
atgttggccgcccagccaggactct

SEQ ID NO: 144597 - DNA, 25 bp, Homo sapien
accttcttcagggacttcgccatca

SEQ ID NO: 144598 - DNA, 25 bp, Homo sapien
ttcgccatcagcgtcgtggtgaagc

SEQ ID NO: 144599 - DNA, 25 bp, Homo sapien
gtggcgtgctcttcgccatcactga

SEQ ID NO: 144600 - DNA, 25 bp, Homo sapien
cgtccgtatcctttgtcacaggcta

SEQ ID NO: 144601 - DNA, 25 bp, Homo sapien
cgtcctccgagcagttacaaagggc

SEQ ID NO: 144602 - DNA, 25 bp, Homo sapien
cacggcgtgaccttgttctggggac

SEQ ID NO: 144603 - DNA, 25 bp, Homo sapien
ctctagggcttcgtccagtgggagt

SEQ ID NO: 144604 - DNA, 25 bp, Homo sapien
ctttctcaaacatggcgcggggccg

SEQ ID NO: 144605 - DNA, 25 bp, Homo sapien
tgtgagctccgagcctctagggctt

SEQ ID NO: 144606 - DNA, 25 bp, Homo sapien
ctcctgctctttctcaaacatggcg

SEQ ID NO: 144607 - DNA, 25 bp, Homo sapien
ccgagcagttacaaagggccggagc

SEQ ID NO: 144608 - DNA, 25 bp, Homo sapien
ggtccgtgccagaggctgccgaacc

SEQ ID NO: 144609 - DNA, 25 bp, Homo sapien
tgctgtgccttgattctcactgagg

SEQ ID NO: 144610 - DNA, 25 bp, Homo sapien
taggactcaaaaggctgggacaacc

SEQ ID NO: 144611 - DNA, 25 bp, Homo sapien
cgtaaacgacgcaccggaaggcaga

SEQ ID NO: 144612 - DNA, 25 bp, Homo sapien
agctccagcaggtcttcaacaggcg

SEQ ID NO: 144613 - DNA, 25 bp, Homo sapien
tggaactcggcctcaaccttgggcg

SEQ ID NO: 144614 - DNA, 25 bp, Homo sapien
atgggcttccgtgccacccagtaca

SEQ ID NO: 144615 - DNA, 25 bp, Homo sapien
ctcactgaggccgatgaccatctgc

SEQ ID NO: 144616 - DNA, 25 bp, Homo sapien
ccttgggcgtctttggttcaaactg

SEQ ID NO: 144617 - DNA, 25 bp, Homo sapien
ttgcgccgtgcttttcctctgtagc

SEQ ID NO: 144618 - DNA, 25 bp, Homo sapien
tccaatatggtatggcggcccttcc

SEQ ID NO: 144619 - DNA, 25 bp, Homo sapien
cgtgcgtcagttaggccacatcagc

SEQ ID NO: 144620 - DNA, 25 bp, Homo sapien
agcgcaaatctgtgagggtctagta

SEQ ID NO: 144621 - DNA, 25 bp, Homo sapien
cttcggtagggattggactttctga

SEQ ID NO: 144622 - DNA, 25 bp, Homo sapien
gccggaggtctctacttcccataca

SEQ ID NO: 144623 - DNA, 25 bp, Homo sapien
cgtaactttctatccgtccgcgtca

SEQ ID NO: 144624 - DNA, 25 bp, Homo sapien
gtcgtagtgcgctgtccagatcttc

SEQ ID NO: 144625 - DNA, 25 bp, Homo sapien
agaagacgctgaaaggaagcctcga

SEQ ID NO: 144626 - DNA, 25 bp, Homo sapien
caggagaaacccatgtcaccacgtg

SEQ ID NO: 144627 - DNA, 25 bp, Homo sapien
gcctcgagggataaacaggagaaac

SEQ ID NO: 144628 - DNA, 25 bp, Homo sapien
gcgcgtcaatgctccagctcgttca

SEQ ID NO: 144629 - DNA, 25 bp, Homo sapien
tatggactgttgacagagcagctgc

SEQ ID NO: 144630 - DNA, 25 bp, Homo sapien
cttgtcttcaaagttctcctacggg

SEQ ID NO: 144631 - DNA, 25 bp, Homo sapien
ccgtagccgaggcagcatatggact

SEQ ID NO: 144632 - DNA, 25 bp, Homo sapien
ctcttgaaagctgctccgtagccga

SEQ ID NO: 144633 - DNA, 25 bp, Homo sapien
cgttccggaccttgtgcatttccta

SEQ ID NO: 144634 - DNA, 25 bp, Homo sapien
cgactccgcttgaaaggccctcagg

SEQ ID NO: 144635 - DNA, 25 bp, Homo sapien
aatggcttttttccgctggtgaaca

SEQ ID NO: 144636 - DNA, 25 bp, Homo sapien
acagccgtgggaagatccgcttcta

SEQ ID NO: 144637 - DNA, 25 bp, Homo sapien
cctcggggcattcatgcattcgttc

SEQ ID NO: 144638 - DNA, 25 bp, Homo sapien
cagactttcttaattcctcggggca

SEQ ID NO: 144639 - DNA, 25 bp, Homo sapien
tggccctcgaaactcgcggctaata

SEQ ID NO: 144640 - DNA, 25 bp, Homo sapien
gccttctcatcgctgtgcccttttg

SEQ ID NO: 144641 - DNA, 25 bp, Homo sapien
aggggaacctactccgctatctgcg

SEQ ID NO: 144642 - DNA, 25 bp, Homo sapien
gaatttagtaacatcgcctgcgtca

SEQ ID NO: 144643 - DNA, 25 bp, Homo sapien
tggatacaatgtagcagcgccctcc

SEQ ID NO: 144644 - DNA, 25 bp, Homo sapien
tctggtcctagctcgaaccttcttc

SEQ ID NO: 144645 - DNA, 25 bp, Homo sapien
tgggtcaactttcggggcattctcc

SEQ ID NO: 144646 - DNA, 25 bp, Homo sapien
agacctggtcgaaccgagtccaaga

SEQ ID NO: 144647 - DNA, 25 bp, Homo sapien
tccgcaccaccgtgtctgaattgga

SEQ ID NO: 144648 - DNA, 25 bp, Homo sapien
agccaggcccgactatatttggttc

SEQ ID NO: 144649 - DNA, 25 bp, Homo sapien
tcggctctagttgtcatggtaatga

SEQ ID NO: 144650 - DNA, 25 bp, Homo sapien
ggctcactttgcaacgctgacggtg

SEQ ID NO: 144651 - DNA, 25 bp, Homo sapien
agtacgtatgagattcgcccagtta

SEQ ID NO: 144652 - DNA, 25 bp, Homo sapien
ggaagcgtcgctcctgaaattgaca

SEQ ID NO: 144653 - DNA, 25 bp, Homo sapien
gcggcccgtaggttctgatctgaaa

SEQ ID NO: 144654 - DNA, 25 bp, Homo sapien
atctctggagctcgtgggattcctc

SEQ ID NO: 144655 - DNA, 25 bp, Homo sapien
agcggctccagcgatgtaattcagg

SEQ ID NO: 144656 - DNA, 25 bp, Homo sapien
cagtgcagatttcgggacagctctc

SEQ ID NO: 144657 - DNA, 25 bp, Homo sapien
agcactacggcgtgcgaacctgcga

SEQ ID NO: 144658 - DNA, 25 bp, Homo sapien
cgcttgagagccacccgtacgggct

SEQ ID NO: 144659 - DNA, 25 bp, Homo sapien
cctcggctacgacccgacggccgct

SEQ ID NO: 144660 - DNA, 25 bp, Homo sapien
cacttcaagccctcgccgccgcatc

SEQ ID NO: 144661 - DNA, 25 bp, Homo sapien
gcgcttcccgctcttccacttcaag

SEQ ID NO: 144662 - DNA, 25 bp, Homo sapien
cgttatgggacgaggcactgccctc

SEQ ID NO: 144663 - DNA, 25 bp, Homo sapien
gctttttcaaggtgagcgcacgccg

SEQ ID NO: 144664 - DNA, 25 bp, Homo sapien
caagggctttttcaaggtgagcgca

SEQ ID NO: 144665 - DNA, 25 bp, Homo sapien
atgacgcgacgctcgatggtagtga

SEQ ID NO: 144666 - DNA, 25 bp, Homo sapien
cattggatccgaagtgcgagcgcca

SEQ ID NO: 144667 - DNA, 25 bp, Homo sapien
atggtggctcctcctgtttttcaga

SEQ ID NO: 144668 - DNA, 25 bp, Homo sapien
tgtttttcagaagtggcggagcctc

SEQ ID NO: 144669 - DNA, 25 bp, Homo sapien
cagacgatgcgagcaggacggcctc

SEQ ID NO: 144670 - DNA, 25 bp, Homo sapien
agacccgcgcatccgttcgctggtg

SEQ ID NO: 144671 - DNA, 25 bp, Homo sapien
actgcgaggaatgacgcgacgctcg

SEQ ID NO: 144672 - DNA, 25 bp, Homo sapien
cggcaagtagggcattggatccgaa

SEQ ID NO: 144673 - DNA, 25 bp, Homo sapien
ggcaaagaactggaagtagtcgtgc

SEQ ID NO: 144674 - DNA, 25 bp, Homo sapien
acctgaggcacagtgtaccgcgctg

SEQ ID NO: 144675 - DNA, 25 bp, Homo sapien
gcacctgaggcacagtgtaccgcgc

SEQ ID NO: 144676 - DNA, 25 bp, Homo sapien
gcgcacctgaggcacagtgtaccgc

SEQ ID NO: 144677 - DNA, 25 bp, Homo sapien
cggcgcacctgaggcacagtgtacc

SEQ ID NO: 144678 - DNA, 25 bp, Homo sapien
ggcggggcgtggacacggcgcacct

SEQ ID NO: 144679 - DNA, 25 bp, Homo sapien
caggaggcggatgaccgcctgcagg

SEQ ID NO: 144680 - DNA, 25 bp, Homo sapien
cctgaggcacagtgtaccgcgctgg

SEQ ID NO: 144681 - DNA, 25 bp, Homo sapien
gatcgcccggcttggggcgtctcac

SEQ ID NO: 144682 - DNA, 25 bp, Homo sapien
cgccgggaagtacctcaacgcactt

SEQ ID NO: 144683 - DNA, 25 bp, Homo sapien
caaatccaaactcacgccgggaagt

SEQ ID NO: 144684 - DNA, 25 bp, Homo sapien
tacccaccgcgctgaaggagggagc

SEQ ID NO: 144685 - DNA, 25 bp, Homo sapien
cgttcacgttgacgggtgctggatc

SEQ ID NO: 144686 - DNA, 25 bp, Homo sapien
ggcgtctcacgtggcttcagccctg

SEQ ID NO: 144687 - DNA, 25 bp, Homo sapien
gtcccaggactgacaccgacacgga

SEQ ID NO: 144688 - DNA, 25 bp, Homo sapien
gggaacacgtgagcctctctgcaca

SEQ ID NO: 144689 - DNA, 25 bp, Homo sapien
agctcctacgccgtgactacgtatc

SEQ ID NO: 144690 - DNA, 25 bp, Homo sapien
cagcggcgaacacccgggacaactt

SEQ ID NO: 144691 - DNA, 25 bp, Homo sapien
cgacactggtttctcaggcctcggg

SEQ ID NO: 144692 - DNA, 25 bp, Homo sapien
acctcggtgcacttcgggaaatgta

SEQ ID NO: 144693 - DNA, 25 bp, Homo sapien
cacgtcgtccgtcatctagaacttc

SEQ ID NO: 144694 - DNA, 25 bp, Homo sapien
ttcccagaaggatgtgcggccgaaa

SEQ ID NO: 144695 - DNA, 25 bp, Homo sapien
ctgacctggctggatatagtgtacc

SEQ ID NO: 144696 - DNA, 25 bp, Homo sapien
actacgtatcagtccctcagggcta

SEQ ID NO: 144697 - DNA, 25 bp, Homo sapien
agtggggcccgattcacacactccg

SEQ ID NO: 144698 - DNA, 25 bp, Homo sapien
caaagcgtggcgcataagtccggcc

SEQ ID NO: 144699 - DNA, 25 bp, Homo sapien
gtcctgcatccatcccagaggcgaa

SEQ ID NO: 144700 - DNA, 25 bp, Homo sapien
cagaggcgaacacaccatgggtttt

SEQ ID NO: 144701 - DNA, 25 bp, Homo sapien
atcgttcctcctactccaagggacg

SEQ ID NO: 144702 - DNA, 25 bp, Homo sapien
acactccgggctaaaactctctcgg

SEQ ID NO: 144703 - DNA, 25 bp, Homo sapien
tgaagctccgcaaacgccctagggg

SEQ ID NO: 144704 - DNA, 25 bp, Homo sapien
ctcccggagcgtgttttcaaatagc

SEQ ID NO: 144705 - DNA, 25 bp, Homo sapien
aggagctcgcgaagcttagactgca

SEQ ID NO: 144706 - DNA, 25 bp, Homo sapien
ttccgggtcacagtgcgcttgcgta

SEQ ID NO: 144707 - DNA, 25 bp, Homo sapien
ggtagtcaagttccgggtcacagtg

SEQ ID NO: 144708 - DNA, 25 bp, Homo sapien
tgggagacacgctgaacggtagtca

SEQ ID NO: 144709 - DNA, 25 bp, Homo sapien
caagtacggtccacgccattcattc

SEQ ID NO: 144710 - DNA, 25 bp, Homo sapien
ctccttccatttgacaagtacggtc

SEQ ID NO: 144711 - DNA, 25 bp, Homo sapien
cgaaatttttgcgactccttccatt

SEQ ID NO: 144712 - DNA, 25 bp, Homo sapien
ttagactgcagtgacgaggaaaacg

SEQ ID NO: 144713 - DNA, 25 bp, Homo sapien
gtgacctgcagtaccgcggtcttcc

SEQ ID NO: 144714 - DNA, 25 bp, Homo sapien
cagtaccgcggtcttcccatcccgg

SEQ ID NO: 144715 - DNA, 25 bp, Homo sapien
ccaggtgacctgcagtaccgcggtc

SEQ ID NO: 144716 - DNA, 25 bp, Homo sapien
ggccggcctgctgcctacaaagccc

SEQ ID NO: 144717 - DNA, 25 bp, Homo sapien
cctctggggtactcagtggcgcgcc

SEQ ID NO: 144718 - DNA, 25 bp, Homo sapien
cgccgcgatgggactcggtgagtag

SEQ ID NO: 144719 - DNA, 25 bp, Homo sapien
ggggaatccaggtgacctgcagtac

SEQ ID NO: 144720 - DNA, 25 bp, Homo sapien
ctggggtactcagtggcgcgcccac

SEQ ID NO: 144721 - DNA, 25 bp, Homo sapien
gtgagaattagtgaggcctgacctt

SEQ ID NO: 144722 - DNA, 25 bp, Homo sapien
tggtatccagttcgctcctaaactg

SEQ ID NO: 144723 - DNA, 25 bp, Homo sapien
actgagtctccaattgtccacttaa

SEQ ID NO: 144724 - DNA, 25 bp, Homo sapien
cactgacgcataacttggaggacca

SEQ ID NO: 144725 - DNA, 25 bp, Homo sapien
gcctgaccttggtacacagtgactc

SEQ ID NO: 144726 - DNA, 25 bp, Homo sapien
gtcctatcagaatgctacaagtcag

SEQ ID NO: 144727 - DNA, 25 bp, Homo sapien
aacttctcctgcataactgtcagtg

SEQ ID NO: 144728 - DNA, 25 bp, Homo sapien
ggctttgaatcagttagtcctatca

SEQ ID NO: 144729 - DNA, 25 bp, Homo sapien
ccgtccaggggcaccagtcatgggc

SEQ ID NO: 144730 - DNA, 25 bp, Homo sapien
tgctgctacacgtcggtgcttctgc

SEQ ID NO: 144731 - DNA, 25 bp, Homo sapien
ctacacgtcggtgcttctgctcttc

SEQ ID NO: 144732 - DNA, 25 bp, Homo sapien
tttgtgacgcggtggcaacggccac

SEQ ID NO: 144733 - DNA, 25 bp, Homo sapien
tcggtgcttctgctcttcgccttct

SEQ ID NO: 144734 - DNA, 25 bp, Homo sapien
ggtggcaacggccacggacacaaag

SEQ ID NO: 144735 - DNA, 25 bp, Homo sapien
ggcaaaggcaagagcatcaactgct

SEQ ID NO: 144736 - DNA, 25 bp, Homo sapien
agcatcaactgctcaggtaggaccg

SEQ ID NO: 144737 - DNA, 25 bp, Homo sapien
ttgcatttcccgcagtaagcgcgcc

SEQ ID NO: 144738 - DNA, 25 bp, Homo sapien
gggaggagccacatgaaaagcgcta

SEQ ID NO: 144739 - DNA, 25 bp, Homo sapien
tgaaaagcgctaatggcgtaacgca

SEQ ID NO: 144740 - DNA, 25 bp, Homo sapien
ctaatggcgtaacgcatgcgcgccg

SEQ ID NO: 144741 - DNA, 25 bp, Homo sapien
tctgcggggcgggtgttctcttccc

SEQ ID NO: 144742 - DNA, 25 bp, Homo sapien
gctctcttgaaaccggctccgcggg

SEQ ID NO: 144743 - DNA, 25 bp, Homo sapien
caggaggagggaattttgcatttcc

SEQ ID NO: 144744 - DNA, 25 bp, Homo sapien
gcaggacagggtggttccagaaccc

SEQ ID NO: 144745 - DNA, 25 bp, Homo sapien
tgctctcccacgcaagcggaatgca

SEQ ID NO: 144746 - DNA, 25 bp, Homo sapien
ctggacgcaatctggctggcttgcc

SEQ ID NO: 144747 - DNA, 25 bp, Homo sapien
ctctggagccagagctgagtctctc

SEQ ID NO: 144748 - DNA, 25 bp, Homo sapien
gctgagtctctcttgagcatgcgca

SEQ ID NO: 144749 - DNA, 25 bp, Homo sapien
gactcgaggcagaagcggtctccaa

SEQ ID NO: 144750 - DNA, 25 bp, Homo sapien
aacaggagatcctgaaacctggacc

SEQ ID NO: 144751 - DNA, 25 bp, Homo sapien
ggaccctgtgcaagctgcagcgcca

SEQ ID NO: 144752 - DNA, 25 bp, Homo sapien
ctgaatgtacctcgctcccgggagc

SEQ ID NO: 144753 - DNA, 25 bp, Homo sapien
ggaaggtgctgtcttcacgcacacc

SEQ ID NO: 144754 - DNA, 25 bp, Homo sapien
gctaggatctctcctcctcagggaa

SEQ ID NO: 144755 - DNA, 25 bp, Homo sapien
ctagaacggaggacgctaggatctc

SEQ ID NO: 144756 - DNA, 25 bp, Homo sapien
ggcttgccataatcacctcctagaa

SEQ ID NO: 144757 - DNA, 25 bp, Homo sapien
tgatgagttactgacaggcttgcca

SEQ ID NO: 144758 - DNA, 25 bp, Homo sapien
ttcggctttctcatcgagctccggt

SEQ ID NO: 144759 - DNA, 25 bp, Homo sapien
ttctcatcgagctccggtgccaaag

SEQ ID NO: 144760 - DNA, 25 bp, Homo sapien
cagtgcggggataaatgatgagtta

SEQ ID NO: 144761 - DNA, 25 bp, Homo sapien
cgccggagtcgaaggtaagtaagca

SEQ ID NO: 144762 - DNA, 25 bp, Homo sapien
ttcgtcgagcctaatttccagcagc

SEQ ID NO: 144763 - DNA, 25 bp, Homo sapien
agccagggatcctcgtattcgtcga

SEQ ID NO: 144764 - DNA, 25 bp, Homo sapien
acagccagggatcgcgtctgatatg

SEQ ID NO: 144765 - DNA, 25 bp, Homo sapien
cggtcatagcgttacttggctgcaa

SEQ ID NO: 144766 - DNA, 25 bp, Homo sapien
ctttccgagcatgacgggagttgta

SEQ ID NO: 144767 - DNA, 25 bp, Homo sapien
cccagtggcaagagctttctttttc

SEQ ID NO: 144768 - DNA, 25 bp, Homo sapien
tcttcgatgagatccacgggcctga

SEQ ID NO: 144769 - DNA, 25 bp, Homo sapien
agcggaaatcccagcctggcgtctc

SEQ ID NO: 144770 - DNA, 25 bp, Homo sapien
ctcataccttgggacgtctgggcgt

SEQ ID NO: 144771 - DNA, 25 bp, Homo sapien
cgtcagcttccgagttcacgaatca

SEQ ID NO: 144772 - DNA, 25 bp, Homo sapien
ttggaactcccagacctccgaagct

SEQ ID NO: 144773 - DNA, 25 bp, Homo sapien
acctccgaagctcggcgtgttctgc

SEQ ID NO: 144774 - DNA, 25 bp, Homo sapien
gcgtgttctgcactcagtggccaca

SEQ ID NO: 144775 - DNA, 25 bp, Homo sapien
tggggctgaactcctactcctgaca

SEQ ID NO: 144776 - DNA, 25 bp, Homo sapien
tgcgtatctacagctcataccttgg

SEQ ID NO: 144777 - DNA, 25 bp, Homo sapien
cacagaaccgtgagctccacaggga

SEQ ID NO: 144778 - DNA, 25 bp, Homo sapien
ggcaggcaggcgactgacaatttta

SEQ ID NO: 144779 - DNA, 25 bp, Homo sapien
ccacagggaacggactgatcctttg

SEQ ID NO: 144780 - DNA, 25 bp, Homo sapien
tgcccgcactaaacctgtcacaagg

SEQ ID NO: 144781 - DNA, 25 bp, Homo sapien
ataacagctgaaccgctgtggcggc

SEQ ID NO: 144782 - DNA, 25 bp, Homo sapien
ccgaggtgggctatctgtttaggcc

SEQ ID NO: 144783 - DNA, 25 bp, Homo sapien
cgctgtgtccggcagtcagaacaag

SEQ ID NO: 144784 - DNA, 25 bp, Homo sapien
acaagcggctgcgaaggagaaacga

SEQ ID NO: 144785 - DNA, 25 bp, Homo sapien
gcagatcgtgcgcaacagaaaccta

SEQ ID NO: 144786 - DNA, 25 bp, Homo sapien
cacacccaggtggatctaattaacc

SEQ ID NO: 144787 - DNA, 25 bp, Homo sapien
ccctggatctagtgtctgtcgctga

SEQ ID NO: 144788 - DNA, 25 bp, Homo sapien
ggcgagggtcttacccagactggca

SEQ ID NO: 144789 - DNA, 25 bp, Homo sapien
ggtcctcgcaatcctccggcaggaa

SEQ ID NO: 144790 - DNA, 25 bp, Homo sapien
ggccgcctctggtattgcccaggct

SEQ ID NO: 144791 - DNA, 25 bp, Homo sapien
gcgtccttctattgacctgtcagcg

SEQ ID NO: 144792 - DNA, 25 bp, Homo sapien
acaccgcgagcgcagtgcgacacta

SEQ ID NO: 144793 - DNA, 25 bp, Homo sapien
actcttagaggtcgtagccaggaga

SEQ ID NO: 144794 - DNA, 25 bp, Homo sapien
gagctggaatctctgcacgggcctt

SEQ ID NO: 144795 - DNA, 25 bp, Homo sapien
cttggtgagtaactgctgcgagttc

SEQ ID NO: 144796 - DNA, 25 bp, Homo sapien
cggggtctcatagtcctatgggctg

SEQ ID NO: 144797 - DNA, 25 bp, Homo sapien
ctatgggctgggttgaagccacttc

SEQ ID NO: 144798 - DNA, 25 bp, Homo sapien
cgcgcttgcccagcgttgctaggga

SEQ ID NO: 144799 - DNA, 25 bp, Homo sapien
tcagcgaggcccgagtactcttaga

SEQ ID NO: 144800 - DNA, 25 bp, Homo sapien
cggcgcttgctcaagcttctcgtgc

SEQ ID NO: 144801 - DNA, 25 bp, Homo sapien
cattgtggacatctggcaacggcca

SEQ ID NO: 144802 - DNA, 25 bp, Homo sapien
ggcctcgtttcccattgtggacatc

SEQ ID NO: 144803 - DNA, 25 bp, Homo sapien
tgggagcacatctccgccgggtaac

SEQ ID NO: 144804 - DNA, 25 bp, Homo sapien
tcgaagacgtcgatcactcgccgca

SEQ ID NO: 144805 - DNA, 25 bp, Homo sapien
tcagagaccctgatttgtccaagtc

SEQ ID NO: 144806 - DNA, 25 bp, Homo sapien
tcatcattgtcaaagtgggagcaca

SEQ ID NO: 144807 - DNA, 25 bp, Homo sapien
caacggccacggctcaaagggtcgg

SEQ ID NO: 144808 - DNA, 25 bp, Homo sapien
tccggcagggacatgaactcctcca

SEQ ID NO: 144809 - DNA, 25 bp, Homo sapien
gcgcagcttcactccactcggtgaa

SEQ ID NO: 144810 - DNA, 25 bp, Homo sapien
ccagcaaagggtggctctgctccga

SEQ ID NO: 144811 - DNA, 25 bp, Homo sapien
tcgttatttttccaccgagtcgcca

SEQ ID NO: 144812 - DNA, 25 bp, Homo sapien
agcgccgacttcattttctctcttc

SEQ ID NO: 144813 - DNA, 25 bp, Homo sapien
cggtctctaggccatgcaagttgga

SEQ ID NO: 144814 - DNA, 25 bp, Homo sapien
ccacttatttcctggggtcgcgttg

SEQ ID NO: 144815 - DNA, 25 bp, Homo sapien
ctcattactgagacccgcagggaga

SEQ ID NO: 144816 - DNA, 25 bp, Homo sapien
acgcgctctcgcctggattcttttc

SEQ ID NO: 144817 - DNA, 25 bp, Homo sapien
agtctttggacctggcttgaacctg

SEQ ID NO: 144818 - DNA, 25 bp, Homo sapien
gtcagcgagtgagtccaaaaacccg

SEQ ID NO: 144819 - DNA, 25 bp, Homo sapien
ctgctgcctcttcttttaaagcgga

SEQ ID NO: 144820 - DNA, 25 bp, Homo sapien
ttggccacaaatagcaactcggctg

SEQ ID NO: 144821 - DNA, 25 bp, Homo sapien
ccagcccagtccagagcgaggaagt

SEQ ID NO: 144822 - DNA, 25 bp, Homo sapien
aatcctcgtaacgtgctggggatcc

SEQ ID NO: 144823 - DNA, 25 bp, Homo sapien
acctggtagttacggctgcagaaga

SEQ ID NO: 144824 - DNA, 25 bp, Homo sapien
gcgcacgcgaggtaaccagaaactg

SEQ ID NO: 144825 - DNA, 25 bp, Homo sapien
ctgcagacacctgaggcctccgatg

SEQ ID NO: 144826 - DNA, 25 bp, Homo sapien
agctgcgtagatccggaaccctggg

SEQ ID NO: 144827 - DNA, 25 bp, Homo sapien
ccacggagctgcgtagatccggaac

SEQ ID NO: 144828 - DNA, 25 bp, Homo sapien
aaacgccaggcgatggaagccgtta

SEQ ID NO: 144829 - DNA, 25 bp, Homo sapien
agcctgccggaacgcagtgtctttg

SEQ ID NO: 144830 - DNA, 25 bp, Homo sapien
cggacccaggtcttgaagccgcggc

SEQ ID NO: 144831 - DNA, 25 bp, Homo sapien
ccactggccggacccaggtcttgaa

SEQ ID NO: 144832 - DNA, 25 bp, Homo sapien
acacctgaggcctccgatgtggctg

SEQ ID NO: 144833 - DNA, 25 bp, Homo sapien
tctgcagtgtgcctaacgcgaacta

SEQ ID NO: 144834 - DNA, 25 bp, Homo sapien
tgcagcaatctgagccaacccgaga

SEQ ID NO: 144835 - DNA, 25 bp, Homo sapien
cccggctagagagttgttctgttcc

SEQ ID NO: 144836 - DNA, 25 bp, Homo sapien
ccgctatggtgaagttcgctttgta

SEQ ID NO: 144837 - DNA, 25 bp, Homo sapien
gctcgcgccgaaattcaaaggaata

SEQ ID NO: 144838 - DNA, 25 bp, Homo sapien
ctgcggctttaatccttcgagtgta

SEQ ID NO: 144839 - DNA, 25 bp, Homo sapien
cggacgccggtgtgaacatacacta

SEQ ID NO: 144840 - DNA, 25 bp, Homo sapien
gactacgatccctttccgacgtgga

SEQ ID NO: 144841 - DNA, 25 bp, Homo sapien
cgagcgctcccatgttgtcacctgg

SEQ ID NO: 144842 - DNA, 25 bp, Homo sapien
tttgctgcccagctatgtcgcggct

SEQ ID NO: 144843 - DNA, 25 bp, Homo sapien
agcatttcgcggagacccttgaaga

SEQ ID NO: 144844 - DNA, 25 bp, Homo sapien
gtggagtcgtagctttccaagccac

SEQ ID NO: 144845 - DNA, 25 bp, Homo sapien
ccgccctctctagacatcaggttga

SEQ ID NO: 144846 - DNA, 25 bp, Homo sapien
agggaattgtcaaccagccgcttgc

SEQ ID NO: 144847 - DNA, 25 bp, Homo sapien
cagtggtggtcagaaggcttttcta

SEQ ID NO: 144848 - DNA, 25 bp, Homo sapien
tctgccaatgatccaggagccgctc

SEQ ID NO: 144849 - DNA, 25 bp, Homo sapien
attctgtcacctctaacgtctgggg

SEQ ID NO: 144850 - DNA, 25 bp, Homo sapien
ttctaacgcggtctctggagccgtc

SEQ ID NO: 144851 - DNA, 25 bp, Homo sapien
ggtatttctgaagcgtgcgagccac

SEQ ID NO: 144852 - DNA, 25 bp, Homo sapien
ctcgttctcagaagcggcctgacca

SEQ ID NO: 144853 - DNA, 25 bp, Homo sapien
ctcagcgccgaagagaaagacgcca

SEQ ID NO: 144854 - DNA, 25 bp, Homo sapien
atctacacaactgcgcatcggagcg

SEQ ID NO: 144855 - DNA, 25 bp, Homo sapien
cgccgcacatttacgaatctacaca

SEQ ID NO: 144856 - DNA, 25 bp, Homo sapien
aaagacgccaactgcgggacctgtc

SEQ ID NO: 144857 - DNA, 25 bp, Homo sapien
tcagaccgcctctccctacagaagc

SEQ ID NO: 144858 - DNA, 25 bp, Homo sapien
ctgtataagcggactcagcaccagg

SEQ ID NO: 144859 - DNA, 25 bp, Homo sapien
ccgcagagcagcaggtcaacttcta

SEQ ID NO: 144860 - DNA, 25 bp, Homo sapien
ggtcaacttctaaagcgcgtctcag

SEQ ID NO: 144861 - DNA, 25 bp, Homo sapien
ttctaaagcgcgtctcagaccgcct

SEQ ID NO: 144862 - DNA, 25 bp, Homo sapien
tacccacctgcaaagccggcgcctc

SEQ ID NO: 144863 - DNA, 25 bp, Homo sapien
ctgcccttcgtctctgtctgtataa

SEQ ID NO: 144864 - DNA, 25 bp, Homo sapien
ctctgtctgtataagcggactcagc

SEQ ID NO: 144865 - DNA, 25 bp, Homo sapien
cggtcttcaccggattcacagtcgg

SEQ ID NO: 144866 - DNA, 25 bp, Homo sapien
tgcaaccaccggtcttcaccggatt

SEQ ID NO: 144867 - DNA, 25 bp, Homo sapien
tcacagtcggaaccgcgagcaaaga

SEQ ID NO: 144868 - DNA, 25 bp, Homo sapien
cgagcaaagacacctagtagagccg

SEQ ID NO: 144869 - DNA, 25 bp, Homo sapien
acacctagtagagccggccgattcc

SEQ ID NO: 144870 - DNA, 25 bp, Homo sapien
cgattcctaggtcctccggccagga

SEQ ID NO: 144871 - DNA, 25 bp, Homo sapien
ggttactcccggtcattccacggca

SEQ ID NO: 144872 - DNA, 25 bp, Homo sapien
gggctttcgcctcaacctcatagtt

SEQ ID NO: 144873 - DNA, 25 bp, Homo sapien
gcctccttggcctcgaaacaaaaca

SEQ ID NO: 144874 - DNA, 25 bp, Homo sapien
tgccgggactagttccttttataga

SEQ ID NO: 144875 - DNA, 25 bp, Homo sapien
tccggtcccatctgagttgcaagtg

SEQ ID NO: 144876 - DNA, 25 bp, Homo sapien
ctggagagcctcttacctgttttcc

SEQ ID NO: 144877 - DNA, 25 bp, Homo sapien
cgcccacgacacatctagggagttg

SEQ ID NO: 144878 - DNA, 25 bp, Homo sapien
tgcaccgagcgcagaggttactatc

SEQ ID NO: 144879 - DNA, 25 bp, Homo sapien
cccggcctctgtttatgtagttcag

SEQ ID NO: 144880 - DNA, 25 bp, Homo sapien
cactctcgctcgcaattacggggtt

SEQ ID NO: 144881 - DNA, 25 bp, Homo sapien
tgtgtattgagcatggggcacagcc

SEQ ID NO: 144882 - DNA, 25 bp, Homo sapien
aggctcctttaatctgcggatcggg

SEQ ID NO: 144883 - DNA, 25 bp, Homo sapien
ccggatcacagagcgcagaccatgc

SEQ ID NO: 144884 - DNA, 25 bp, Homo sapien
acgtcgcgatctcgccgctttaagc

SEQ ID NO: 144885 - DNA, 25 bp, Homo sapien
ccgctttaagctgctgggtaccctc

SEQ ID NO: 144886 - DNA, 25 bp, Homo sapien
gagagcttcttgactcgtttccttc

SEQ ID NO: 144887 - DNA, 25 bp, Homo sapien
agctgcctatggactctggagttgc

SEQ ID NO: 144888 - DNA, 25 bp, Homo sapien
aacgcagagtaagcggcgcgcatgc

SEQ ID NO: 144889 - DNA, 25 bp, Homo sapien
aagggcccggccttgttctggctgc

SEQ ID NO: 144890 - DNA, 25 bp, Homo sapien
gctgccgactcaaaggcgcctctgc

SEQ ID NO: 144891 - DNA, 25 bp, Homo sapien
agtcacacctgagctgcccgtcccg

SEQ ID NO: 144892 - DNA, 25 bp, Homo sapien
cgcccgttttctgtgctcctcgcag

SEQ ID NO: 144893 - DNA, 25 bp, Homo sapien
gagcgcaccgtgcagtccaaagacc

SEQ ID NO: 144894 - DNA, 25 bp, Homo sapien
ccaccgaattccagtttctgcttca

SEQ ID NO: 144895 - DNA, 25 bp, Homo sapien
ttctgcttcattagatattctgtcc

SEQ ID NO: 144896 - DNA, 25 bp, Homo sapien
gccgcctcttgagtaccagccgccg

SEQ ID NO: 144897 - DNA, 25 bp, Homo sapien
cctgcagaggcactagcggtagaca

SEQ ID NO: 144898 - DNA, 25 bp, Homo sapien
tgtgcgatctcgctgagcctcctca

SEQ ID NO: 144899 - DNA, 25 bp, Homo sapien
tgggcttagccactcgccatggact

SEQ ID NO: 144900 - DNA, 25 bp, Homo sapien
tccacggctacttcccgggagcagt

SEQ ID NO: 144901 - DNA, 25 bp, Homo sapien
gagagaccgctatcgctggaggaaa

SEQ ID NO: 144902 - DNA, 25 bp, Homo sapien
gccatggactcccagaaagtaagcg

SEQ ID NO: 144903 - DNA, 25 bp, Homo sapien
ctcacacggttcgtcgtctcgggtt

SEQ ID NO: 144904 - DNA, 25 bp, Homo sapien
cccagtggcctatttcagggccgga

SEQ ID NO: 144905 - DNA, 25 bp, Homo sapien
ggtatcgatggaatgtatctcaaaa

SEQ ID NO: 144906 - DNA, 25 bp, Homo sapien
actaggtatcgatggaatgtatctc

SEQ ID NO: 144907 - DNA, 25 bp, Homo sapien
tcgatggaatgtatctcaaaataat

SEQ ID NO: 144908 - DNA, 25 bp, Homo sapien
taagagctgtttatgcaaacccaca

SEQ ID NO: 144909 - DNA, 25 bp, Homo sapien
agctgtttatgcaaacccacagcca

SEQ ID NO: 144910 - DNA, 25 bp, Homo sapien
cactttgaaaaccagcacagaggga

SEQ ID NO: 144911 - DNA, 25 bp, Homo sapien
ttgaaaaccagcacagagggagaga

SEQ ID NO: 144912 - DNA, 25 bp, Homo sapien
caataaactaggtatcgatggaatg

SEQ ID NO: 144913 - DNA, 25 bp, Homo sapien
agagggatccgccatattggagctg

SEQ ID NO: 144914 - DNA, 25 bp, Homo sapien
tccaagaagccgcacggggacgtga

SEQ ID NO: 144915 - DNA, 25 bp, Homo sapien
aggatgttctccaagaagccgcacg

SEQ ID NO: 144916 - DNA, 25 bp, Homo sapien
cccgtccactccctccactttctgc

SEQ ID NO: 144917 - DNA, 25 bp, Homo sapien
tgttctccaagaagccgcacgggga

SEQ ID NO: 144918 - DNA, 25 bp, Homo sapien
aggctggggagctaatgagcctctc

SEQ ID NO: 144919 - DNA, 25 bp, Homo sapien
ccgagagctccaccttcgtggctct

SEQ ID NO: 144920 - DNA, 25 bp, Homo sapien
atgagcctctctggctagtctcctc

SEQ ID NO: 144921 - DNA, 25 bp, Homo sapien
gcccgggtgcctaggcacgattcca

SEQ ID NO: 144922 - DNA, 25 bp, Homo sapien
gccacttgatggctgccagcggcgt

SEQ ID NO: 144923 - DNA, 25 bp, Homo sapien
atttccttaacgagccacttgatgg

SEQ ID NO: 144924 - DNA, 25 bp, Homo sapien
gcactcacctgcatttccttaacga

SEQ ID NO: 144925 - DNA, 25 bp, Homo sapien
ttctgaaggcaaagtacctgcactc

SEQ ID NO: 144926 - DNA, 25 bp, Homo sapien
ggtcctgctaattattctgaaggca

SEQ ID NO: 144927 - DNA, 25 bp, Homo sapien
ccggcttgggtcctgctaattattc

SEQ ID NO: 144928 - DNA, 25 bp, Homo sapien
cgattccagggatccagggtaaagc

SEQ ID NO: 144929 - DNA, 25 bp, Homo sapien
ctgcagcctgctgttgagtgaggta

SEQ ID NO: 144930 - DNA, 25 bp, Homo sapien
ggctgggtactcctcagtcagtcca

SEQ ID NO: 144931 - DNA, 25 bp, Homo sapien
atgcgacaagagtcacaggaaagcc

SEQ ID NO: 144932 - DNA, 25 bp, Homo sapien
atcgccagggctcagtgaacttctg

SEQ ID NO: 144933 - DNA, 25 bp, Homo sapien
gggcatcctccagcattctgggcac

SEQ ID NO: 144934 - DNA, 25 bp, Homo sapien
tgggcgccttcagacaggtaccgct

SEQ ID NO: 144935 - DNA, 25 bp, Homo sapien
ctggaccgtgggaacgtcccagcag

SEQ ID NO: 144936 - DNA, 25 bp, Homo sapien
acttctggcggtgaggatgcgacaa

SEQ ID NO: 144937 - DNA, 25 bp, Homo sapien
caaagggcggtgtcctataaaggcg

SEQ ID NO: 144938 - DNA, 25 bp, Homo sapien
gcatctcccagagcccttcaaggag

SEQ ID NO: 144939 - DNA, 25 bp, Homo sapien
cgcttttatgcgtgatgccggggac

SEQ ID NO: 144940 - DNA, 25 bp, Homo sapien
ggcccgcgtcgcttttatgcgtgat

SEQ ID NO: 144941 - DNA, 25 bp, Homo sapien
ccgcgagacaaagggcggtgtccta

SEQ ID NO: 144942 - DNA, 25 bp, Homo sapien
taggccgactctctagcgtgttggc

SEQ ID NO: 144943 - DNA, 25 bp, Homo sapien
caccgagccaattcggtgggaagac

SEQ ID NO: 144944 - DNA, 25 bp, Homo sapien
cttggtagcggccaccgagccaatt

SEQ ID NO: 144945 - DNA, 25 bp, Homo sapien
cgcgcactatctagtgtcagtgatg

SEQ ID NO: 144946 - DNA, 25 bp, Homo sapien
ttcccttttttgacatcgcgcacta

SEQ ID NO: 144947 - DNA, 25 bp, Homo sapien
ttctccatgggacgagttggctctg

SEQ ID NO: 144948 - DNA, 25 bp, Homo sapien
gtcggtggtcgttatggattctcca

SEQ ID NO: 144949 - DNA, 25 bp, Homo sapien
tggccgctagcccagacagttcgat

SEQ ID NO: 144950 - DNA, 25 bp, Homo sapien
ggaggctctagtactcctcaaagga

SEQ ID NO: 144951 - DNA, 25 bp, Homo sapien
cggttggtctgacttactgagtgca

SEQ ID NO: 144952 - DNA, 25 bp, Homo sapien
gctgccgcagcgtttcggaaccaca

SEQ ID NO: 144953 - DNA, 25 bp, Homo sapien
cggacacagcacttcggcgaaggca

SEQ ID NO: 144954 - DNA, 25 bp, Homo sapien
aggacgctgattcgtgtcgttaagc

SEQ ID NO: 144955 - DNA, 25 bp, Homo sapien
ctttttaaaatgactcgtagcgcga

SEQ ID NO: 144956 - DNA, 25 bp, Homo sapien
gcgagctttctcgtctcgactttca

SEQ ID NO: 144957 - DNA, 25 bp, Homo sapien
atcctaacgggcacccgcgagcttt

SEQ ID NO: 144958 - DNA, 25 bp, Homo sapien
cgcgcacacgcggttatcgataaac

SEQ ID NO: 144959 - DNA, 25 bp, Homo sapien
agcctcacgcgggacactgagcaca

SEQ ID NO: 144960 - DNA, 25 bp, Homo sapien
ttccgaatgcacgaagtccacgctc

SEQ ID NO: 144961 - DNA, 25 bp, Homo sapien
acgattgttattttcccggtgcaga

SEQ ID NO: 144962 - DNA, 25 bp, Homo sapien
agctttctctatctcggtcgctcga

SEQ ID NO: 144963 - DNA, 25 bp, Homo sapien
cggcagcccgtttaattgcagcgca

SEQ ID NO: 144964 - DNA, 25 bp, Homo sapien
tttcttgagttcaccgcagtcggtc

SEQ ID NO: 144965 - DNA, 25 bp, Homo sapien
ctccggttgccacgaggaatttatg

SEQ ID NO: 144966 - DNA, 25 bp, Homo sapien
cccggtgcagagcttgacagaaaaa

SEQ ID NO: 144967 - DNA, 25 bp, Homo sapien
gggagtcctcccaaagccgcacaaa

SEQ ID NO: 144968 - DNA, 25 bp, Homo sapien
ggcgcgctcacgttctcgcaaaagg

SEQ ID NO: 144969 - DNA, 25 bp, Homo sapien
attgcgtaacttcggcagccgggcg

SEQ ID NO: 144970 - DNA, 25 bp, Homo sapien
ggcaccatgcaggtcaccctgaaga

SEQ ID NO: 144971 - DNA, 25 bp, Homo sapien
catcctgtggtgagctagcggattc

SEQ ID NO: 144972 - DNA, 25 bp, Homo sapien
gcggattccctgcttgtctcgccga

SEQ ID NO: 144973 - DNA, 25 bp, Homo sapien
cagcaatagtcgctaggaggaagcc

SEQ ID NO: 144974 - DNA, 25 bp, Homo sapien
cacgtctcggcgagtcacgatgatg

SEQ ID NO: 144975 - DNA, 25 bp, Homo sapien
aacgcgcctgcgtaatccgggtcca

SEQ ID NO: 144976 - DNA, 25 bp, Homo sapien
tcccgggctacacattgcgtaactt

SEQ ID NO: 144977 - DNA, 25 bp, Homo sapien
tctgcttctgcgcagcgattccaca

SEQ ID NO: 144978 - DNA, 25 bp, Homo sapien
gaccgctcacccgattctgactttg

SEQ ID NO: 144979 - DNA, 25 bp, Homo sapien
ttaaatctggctccgctgcttcctc

SEQ ID NO: 144980 - DNA, 25 bp, Homo sapien
gatccggcggcgcacttaaatctgg

SEQ ID NO: 144981 - DNA, 25 bp, Homo sapien
tgagaacggaaactgcgggacgatc

SEQ ID NO: 144982 - DNA, 25 bp, Homo sapien
cccacacggatctggggactggttt

SEQ ID NO: 144983 - DNA, 25 bp, Homo sapien
acggagcttcaagaacgagctattc

SEQ ID NO: 144984 - DNA, 25 bp, Homo sapien
ttgaacccaaaagcgatcaggcgtg

SEQ ID NO: 144985 - DNA, 25 bp, Homo sapien
cggcccggagcgatactcacgttat

SEQ ID NO: 144986 - DNA, 25 bp, Homo sapien
tatgtcctgtctgcccaattgcgtg

SEQ ID NO: 144987 - DNA, 25 bp, Homo sapien
accctcgttcagtggctcttggtga

SEQ ID NO: 144988 - DNA, 25 bp, Homo sapien
ctgagccaaggacacggaagctatc

SEQ ID NO: 144989 - DNA, 25 bp, Homo sapien
cccaaattggccgagatccttcttc

SEQ ID NO: 144990 - DNA, 25 bp, Homo sapien
tcgcaccacgggcatacacagctga

SEQ ID NO: 144991 - DNA, 25 bp, Homo sapien
ccggaattggcacaccgaggctctc

SEQ ID NO: 144992 - DNA, 25 bp, Homo sapien
tactcacgttattcggggcacctgc

SEQ ID NO: 144993 - DNA, 25 bp, Homo sapien
ccaggcggctgctacacaatgtttc

SEQ ID NO: 144994 - DNA, 25 bp, Homo sapien
ggaggccagacttcctgatcacatg

SEQ ID NO: 144995 - DNA, 25 bp, Homo sapien
gcgcgcaaacataaacacgagactg

SEQ ID NO: 144996 - DNA, 25 bp, Homo sapien
ggccgctgcggaaaactcggctctc

SEQ ID NO: 144997 - DNA, 25 bp, Homo sapien
atctccctacgtcaggcagcgaagg

SEQ ID NO: 144998 - DNA, 25 bp, Homo sapien
tgtcagacagccttccaggattaga

SEQ ID NO: 144999 - DNA, 25 bp, Homo sapien
gatcctgccttaaatatgccggtta

SEQ ID NO: 145000 - DNA, 25 bp, Homo sapien
cgccgggattcctgatcctgcctta

SEQ ID NO: 145001 - DNA, 25 bp, Homo sapien
gcccggcgctggagatgttaagggc

SEQ ID NO: 145002 - DNA, 25 bp, Homo sapien
cgctggagatgttaagggcccggcg

SEQ ID NO: 145003 - DNA, 25 bp, Homo sapien
cccggcgctggagatgtaagggccc

SEQ ID NO: 145004 - DNA, 25 bp, Homo sapien
ccggcgctggagatgttaagggccc

SEQ ID NO: 145005 - DNA, 25 bp, Homo sapien
gcccggcgctggagatgtaagggcc

SEQ ID NO: 145006 - DNA, 25 bp, Homo sapien
cccggcgctggagatgttaagggcc

SEQ ID NO: 145007 - DNA, 25 bp, Homo sapien
ctggagatgtaaaggcccggcgctg

SEQ ID NO: 145008 - DNA, 25 bp, Homo sapien
ccggcgctggagatgtaagggcccg

SEQ ID NO: 145009 - DNA, 25 bp, Homo sapien
tgcttcagcgggttcaccagcttga

SEQ ID NO: 145010 - DNA, 25 bp, Homo sapien
tgcggaagatgtactcccagatgtc

SEQ ID NO: 145011 - DNA, 25 bp, Homo sapien
cttcatcttgagctgagtggccgca

SEQ ID NO: 145012 - DNA, 25 bp, Homo sapien
ctaaagtccacttgcgggtgtcgcc

SEQ ID NO: 145013 - DNA, 25 bp, Homo sapien
ccgcacttgcagtactgggagccca

SEQ ID NO: 145014 - DNA, 25 bp, Homo sapien
tgaccgccttgatcttgtgcacctt

SEQ ID NO: 145015 - DNA, 25 bp, Homo sapien
cgctcctggccaatagtgatgagtt

SEQ ID NO: 145016 - DNA, 25 bp, Homo sapien
ggccgcatagcagcacttcttcttg

SEQ ID NO: 145017 - DNA, 25 bp, Homo sapien
acctgaggcccgcacgccatgttct

SEQ ID NO: 145018 - DNA, 25 bp, Homo sapien
tgtgccagacgacggcgtcctaacg

SEQ ID NO: 145019 - DNA, 25 bp, Homo sapien
caggaacctccaacgacggcgccaa

SEQ ID NO: 145020 - DNA, 25 bp, Homo sapien
cacgccatgttctcccttttcccga

SEQ ID NO: 145021 - DNA, 25 bp, Homo sapien
cactttggccatgcgcttcccgccc

SEQ ID NO: 145022 - DNA, 25 bp, Homo sapien
ctcaactcaccgtggccaatacgga

SEQ ID NO: 145023 - DNA, 25 bp, Homo sapien
accgtggccaatacggaccgctggc

SEQ ID NO: 145024 - DNA, 25 bp, Homo sapien
cgtcctaacggccaccctctcccag

SEQ ID NO: 145025 - DNA, 25 bp, Homo sapien
ccttcgctcgtggatcgatacttca

SEQ ID NO: 145026 - DNA, 25 bp, Homo sapien
taccctggatggatcgcttacctga

SEQ ID NO: 145027 - DNA, 25 bp, Homo sapien
tccgaattgcgcacgcgtctctgtc

SEQ ID NO: 145028 - DNA, 25 bp, Homo sapien
cgccctccaggggaaaacgctgaag

SEQ ID NO: 145029 - DNA, 25 bp, Homo sapien
ccagcgactcaatgggtgcgtcaac

SEQ ID NO: 145030 - DNA, 25 bp, Homo sapien
ggcccgcttctggtcacttacggcg

SEQ ID NO: 145031 - DNA, 25 bp, Homo sapien
ttctttgtaggcctggcaccgtaga

SEQ ID NO: 145032 - DNA, 25 bp, Homo sapien
cgccgccttccatcgtgaattaata

SEQ ID NO: 145033 - DNA, 25 bp, Homo sapien
tttgatctccagtcccgagtcgagg

SEQ ID NO: 145034 - DNA, 25 bp, Homo sapien
ttggattatccagtctctcgccgcc

SEQ ID NO: 145035 - DNA, 25 bp, Homo sapien
cggtccgacaagaacgccgcagtgc

SEQ ID NO: 145036 - DNA, 25 bp, Homo sapien
ctgccgccggagtttggattatcca

SEQ ID NO: 145037 - DNA, 25 bp, Homo sapien
gcgccaggcgccactttacctgaga

SEQ ID NO: 145038 - DNA, 25 bp, Homo sapien
caggctgcgaactggtgacaaagtc

SEQ ID NO: 145039 - DNA, 25 bp, Homo sapien
gctccaccgagcgagttttgatctc

SEQ ID NO: 145040 - DNA, 25 bp, Homo sapien
tttacctgagaaaccagcgggagta

SEQ ID NO: 145041 - DNA, 25 bp, Homo sapien
gctgcactcacagcggcggcaggaa

SEQ ID NO: 145042 - DNA, 25 bp, Homo sapien
ctgcactcacagcggcggcaggaag

SEQ ID NO: 145043 - DNA, 25 bp, Homo sapien
ccagcctcccgaccgacggcacaac

SEQ ID NO: 145044 - DNA, 25 bp, Homo sapien
cgctgcactcacagcggcggcagga

SEQ ID NO: 145045 - DNA, 25 bp, Homo sapien
cccagcctcccgaccgacggcacaa

SEQ ID NO: 145046 - DNA, 25 bp, Homo sapien
agcctcccgaccgacggcacaacgg

SEQ ID NO: 145047 - DNA, 25 bp, Homo sapien
tgcactcacagcggcggcaggaagc

SEQ ID NO: 145048 - DNA, 25 bp, Homo sapien
cagcctcccgaccgacggcacaacg

SEQ ID NO: 145049 - DNA, 25 bp, Homo sapien
ctgctctgtagaatgggaatcacgc

SEQ ID NO: 145050 - DNA, 25 bp, Homo sapien
tcacgcgtgtccatttcctgctctg

SEQ ID NO: 145051 - DNA, 25 bp, Homo sapien
gaatgggaatcacgcgtgtccgttt

SEQ ID NO: 145052 - DNA, 25 bp, Homo sapien
tcacgcgtgtccgtttcctgctctg

SEQ ID NO: 145053 - DNA, 25 bp, Homo sapien
tcacgtgtgtccgtttcctgctctg

SEQ ID NO: 145054 - DNA, 25 bp, Homo sapien
gggaatcacgtgtgtccgtttcctg

SEQ ID NO: 145055 - DNA, 25 bp, Homo sapien
aatcacgcgtgtccgtttcctgctc

SEQ ID NO: 145056 - DNA, 25 bp, Homo sapien
agaatgggaatcacgcgtgtccgtt

SEQ ID NO: 145057 - DNA, 25 bp, Homo sapien
tcgacgccgtagtcgacgaagcaga

SEQ ID NO: 145058 - DNA, 25 bp, Homo sapien
aggcctgcttaatgggcttgtcgaa

SEQ ID NO: 145059 - DNA, 25 bp, Homo sapien
acggtcactgcagcacaggtgtggc

SEQ ID NO: 145060 - DNA, 25 bp, Homo sapien
acccacaggctgctgaagtagtcca

SEQ ID NO: 145061 - DNA, 25 bp, Homo sapien
tgcacgcccaagtagctgccgaggc

SEQ ID NO: 145062 - DNA, 25 bp, Homo sapien
gtgccgcatagcacggcccagagca

SEQ ID NO: 145063 - DNA, 25 bp, Homo sapien
ctccaggatgaagtagaccagcacc

SEQ ID NO: 145064 - DNA, 25 bp, Homo sapien
ccggtgttgtagaaggcctgcttaa

SEQ ID NO: 145065 - DNA, 25 bp, Homo sapien
tcaccctcctccgacaggtagcgca

SEQ ID NO: 145066 - DNA, 25 bp, Homo sapien
tccacgcaggcagatttggcccttc

SEQ ID NO: 145067 - DNA, 25 bp, Homo sapien
gacttccctccacgcaggcagattt

SEQ ID NO: 145068 - DNA, 25 bp, Homo sapien
agcagcttcccttctaccgtccttc

SEQ ID NO: 145069 - DNA, 25 bp, Homo sapien
tgcgcatcctcgctccagcaccgca

SEQ ID NO: 145070 - DNA, 25 bp, Homo sapien
ctccctgcctcggtctgcgcatcct

SEQ ID NO: 145071 - DNA, 25 bp, Homo sapien
aggtagcgcaggtcgtagaactccc

SEQ ID NO: 145072 - DNA, 25 bp, Homo sapien
gcaggcagatttggcccttctggcc

SEQ ID NO: 145073 - DNA, 25 bp, Homo sapien
acttcggtcccgtcgagcaggaaga

SEQ ID NO: 145074 - DNA, 25 bp, Homo sapien
ggcaggtctgagacagccgactcta

SEQ ID NO: 145075 - DNA, 25 bp, Homo sapien
gccgactctagagttagctcccaag

SEQ ID NO: 145076 - DNA, 25 bp, Homo sapien
atccagaagggatcagcagagagca

SEQ ID NO: 145077 - DNA, 25 bp, Homo sapien
ggggatctcctctctgctgtctcat

SEQ ID NO: 145078 - DNA, 25 bp, Homo sapien
ctgctgtctcatcaaggcctgatgg

SEQ ID NO: 145079 - DNA, 25 bp, Homo sapien
ccaggacggcctcacattgatttga

SEQ ID NO: 145080 - DNA, 25 bp, Homo sapien
ccagcaaagggctctgccggtgcaa

SEQ ID NO: 145081 - DNA, 25 bp, Homo sapien
ccctttgcaccgataggaaaacaag

SEQ ID NO: 145082 - DNA, 25 bp, Homo sapien
cctgctgctgtaggtgtgctcacgt

SEQ ID NO: 145083 - DNA, 25 bp, Homo sapien
cgcgtgccctctgggaagcgttgcc

SEQ ID NO: 145084 - DNA, 25 bp, Homo sapien
tgctcacgtgtgtacacgtaggtga

SEQ ID NO: 145085 - DNA, 25 bp, Homo sapien
cgataggaaaacaaggccgcgtgcc

SEQ ID NO: 145086 - DNA, 25 bp, Homo sapien
acacacgtgtttccggcgcccagag

SEQ ID NO: 145087 - DNA, 25 bp, Homo sapien
cgtaggtgagcacacacgtgtttcc

SEQ ID NO: 145088 - DNA, 25 bp, Homo sapien
aaacaaggccgcgtgccctctggga

SEQ ID NO: 145089 - DNA, 25 bp, Homo sapien
tcccggagtcgcacgtcccgggata

SEQ ID NO: 145090 - DNA, 25 bp, Homo sapien
tcgccagcaaaacctggagccgcgg

SEQ ID NO: 145091 - DNA, 25 bp, Homo sapien
tcgagtcgccagcaaaacctggagc

SEQ ID NO: 145092 - DNA, 25 bp, Homo sapien
gcctcgagtcgccagcaaaacctgg

SEQ ID NO: 145093 - DNA, 25 bp, Homo sapien
gatttccgacggagcccggagtcca

SEQ ID NO: 145094 - DNA, 25 bp, Homo sapien
acgtcccgggatagcgccgctgcag

SEQ ID NO: 145095 - DNA, 25 bp, Homo sapien
ccgctcagcaccactcggacgggcg

SEQ ID NO: 145096 - DNA, 25 bp, Homo sapien
gtgccgcccgtgcatcgcgtcgggg

SEQ ID NO: 145097 - DNA, 25 bp, Homo sapien
tattcttcgttttggcagtctgggg

SEQ ID NO: 145098 - DNA, 25 bp, Homo sapien
ggggtacaaatgtatcttccttgat

SEQ ID NO: 145099 - DNA, 25 bp, Homo sapien
gatgaaagcatatccgttccttaag

SEQ ID NO: 145100 - DNA, 25 bp, Homo sapien
gcatatccgttccttaagttgaacc

SEQ ID NO: 145101 - DNA, 25 bp, Homo sapien
ggtgctgctgatgtgaagcctcccg

SEQ ID NO: 145102 - DNA, 25 bp, Homo sapien
tgctgatgtgaagcctcccgggcca

SEQ ID NO: 145103 - DNA, 25 bp, Homo sapien
cgatcgaactcttggctcttaaaaa

SEQ ID NO: 145104 - DNA, 25 bp, Homo sapien
ctaccgatcgaactcttggctctta

SEQ ID NO: 145105 - DNA, 25 bp, Homo sapien
agcgcccagcgaacaacattatcca

SEQ ID NO: 145106 - DNA, 25 bp, Homo sapien
tggtgtttctatagcagccgccgcg

SEQ ID NO: 145107 - DNA, 25 bp, Homo sapien
agctgctctcctctcggcatgttgc

SEQ ID NO: 145108 - DNA, 25 bp, Homo sapien
cattcactttcaaccctccagggga

SEQ ID NO: 145109 - DNA, 25 bp, Homo sapien
gcttcccgttttattcgcaggctgg

SEQ ID NO: 145110 - DNA, 25 bp, Homo sapien
gtgtcttgtctagcgcccagcgaac

SEQ ID NO: 145111 - DNA, 25 bp, Homo sapien
cgaaaccctgaagtggggtgtcttg

SEQ ID NO: 145112 - DNA, 25 bp, Homo sapien
ctgagagagcctgagcattcacttt

SEQ ID NO: 145113 - DNA, 25 bp, Homo sapien
ctgccggcgtcccacgtcctcggct

SEQ ID NO: 145114 - DNA, 25 bp, Homo sapien
ggcggagaactagcgccgggctagc

SEQ ID NO: 145115 - DNA, 25 bp, Homo sapien
ggcgatcgctcggagccgccttgga

SEQ ID NO: 145116 - DNA, 25 bp, Homo sapien
cccaggtgcccactggctcgcgcgc

SEQ ID NO: 145117 - DNA, 25 bp, Homo sapien
ttggaccgcggcctcgggtccatca

SEQ ID NO: 145118 - DNA, 25 bp, Homo sapien
gggtccatcacactccaggggcgga

SEQ ID NO: 145119 - DNA, 25 bp, Homo sapien
tccactggcatctgcccggtggagg

SEQ ID NO: 145120 - DNA, 25 bp, Homo sapien
caccgagacgtcagggcggagaact

SEQ ID NO: 145121 - DNA, 25 bp, Homo sapien
ggggcgcaaagtacccgagagtcta

SEQ ID NO: 145122 - DNA, 25 bp, Homo sapien
atttcagggctgataccgcataggc

SEQ ID NO: 145123 - DNA, 25 bp, Homo sapien
cccggagaggtctgctgatttcgca

SEQ ID NO: 145124 - DNA, 25 bp, Homo sapien
tttcgcagcagccttcgaagccgtg

SEQ ID NO: 145125 - DNA, 25 bp, Homo sapien
gtggctgcctttcatctgctgcgtt

SEQ ID NO: 145126 - DNA, 25 bp, Homo sapien
atcgccgttccggaaaagtcatgga

SEQ ID NO: 145127 - DNA, 25 bp, Homo sapien
cgctgccagacctcagagacatcga

SEQ ID NO: 145128 - DNA, 25 bp, Homo sapien
agtcatggaagacagcccgctgcca

SEQ ID NO: 145129 - DNA, 25 bp, Homo sapien
actggagcagaaccccaggactgcg

SEQ ID NO: 145130 - DNA, 25 bp, Homo sapien
tggactggagcagaaccccaggact

SEQ ID NO: 145131 - DNA, 25 bp, Homo sapien
gcgctggactggagcagaaccccag

SEQ ID NO: 145132 - DNA, 25 bp, Homo sapien
accactccctgcagatgcgctggcc

SEQ ID NO: 145133 - DNA, 25 bp, Homo sapien
gctaccactccctgcagatgcgctg

SEQ ID NO: 145134 - DNA, 25 bp, Homo sapien
cggaggctaccactccctgcagatg

SEQ ID NO: 145135 - DNA, 25 bp, Homo sapien
ggaggctaccactccctgcagatgc

SEQ ID NO: 145136 - DNA, 25 bp, Homo sapien
gaggctaccactccctgcagatgcg

SEQ ID NO: 145137 - DNA, 25 bp, Homo sapien
tgatcagccgcagcgcctgttctga

SEQ ID NO: 145138 - DNA, 25 bp, Homo sapien
cagggacgtcgccaacttgttaagg

SEQ ID NO: 145139 - DNA, 25 bp, Homo sapien
tgccattggaaaggtctgagcccgt

SEQ ID NO: 145140 - DNA, 25 bp, Homo sapien
caaaggtgactcctgccgagaatgc

SEQ ID NO: 145141 - DNA, 25 bp, Homo sapien
atgcgggcaaaacgctatcgcttca

SEQ ID NO: 145142 - DNA, 25 bp, Homo sapien
caactccgttcgaaatgctcccagg

SEQ ID NO: 145143 - DNA, 25 bp, Homo sapien
agctcctggaaacccgactgcagaa

SEQ ID NO: 145144 - DNA, 25 bp, Homo sapien
ctccgctgaggacgccatcttaact

SEQ ID NO: 145145 - DNA, 25 bp, Homo sapien
gatacagcacgcgtcacctttgggg

SEQ ID NO: 145146 - DNA, 25 bp, Homo sapien
gcctagacccgctcccaaagggaga

SEQ ID NO: 145147 - DNA, 25 bp, Homo sapien
tcacatacggaaaggcagcggcggc

SEQ ID NO: 145148 - DNA, 25 bp, Homo sapien
cctatccttgcctggggcctgaatc

SEQ ID NO: 145149 - DNA, 25 bp, Homo sapien
gcgtaccttgctctcgatctgcttc

SEQ ID NO: 145150 - DNA, 25 bp, Homo sapien
caccatcttggctgctggagtctga

SEQ ID NO: 145151 - DNA, 25 bp, Homo sapien
ctgtaaggaccgatggaaatggatc

SEQ ID NO: 145152 - DNA, 25 bp, Homo sapien
tttataaactggcacgcccggcgtg

SEQ ID NO: 145153 - DNA, 25 bp, Homo sapien
tccagactcctcagcagctcgggaa

SEQ ID NO: 145154 - DNA, 25 bp, Homo sapien
gagatgtaatcgacgcgcggcacca

SEQ ID NO: 145155 - DNA, 25 bp, Homo sapien
ggcaccacgtagttcttggacgaga

SEQ ID NO: 145156 - DNA, 25 bp, Homo sapien
tcggacagcagcttgcggacgaaca

SEQ ID NO: 145157 - DNA, 25 bp, Homo sapien
cggaagttgacttcgcccacgctgg

SEQ ID NO: 145158 - DNA, 25 bp, Homo sapien
cgacggggacatctgctgaaaggtc

SEQ ID NO: 145159 - DNA, 25 bp, Homo sapien
tgaaaggtcgcccagcccgaaacga

SEQ ID NO: 145160 - DNA, 25 bp, Homo sapien
cagcgccctttcatctgacactggg

SEQ ID NO: 145161 - DNA, 25 bp, Homo sapien
ttgttccacgtagcacaagtcagca

SEQ ID NO: 145162 - DNA, 25 bp, Homo sapien
tttctgcttgttccacgtagcacaa

SEQ ID NO: 145163 - DNA, 25 bp, Homo sapien
agtcgccactcagggagcgtcagcc

SEQ ID NO: 145164 - DNA, 25 bp, Homo sapien
ttcattggctcgacagcccacggtg

SEQ ID NO: 145165 - DNA, 25 bp, Homo sapien
ggtggccttagcctcccattcatta

SEQ ID NO: 145166 - DNA, 25 bp, Homo sapien
cgagtcgacacacccgcagcgggag

SEQ ID NO: 145167 - DNA, 25 bp, Homo sapien
acgtagcacaagtcagcaacacccg

SEQ ID NO: 145168 - DNA, 25 bp, Homo sapien
tgcaggccggctcgcaagaacgcac

SEQ ID NO: 145169 - DNA, 25 bp, Homo sapien
aacctgaggcctacaaacgccagcg

SEQ ID NO: 145170 - DNA, 25 bp, Homo sapien
ctctgacctgagtcggagccggtct

SEQ ID NO: 145171 - DNA, 25 bp, Homo sapien
atttagaaagagctgagccatcctc

SEQ ID NO: 145172 - DNA, 25 bp, Homo sapien
gctccggtttcaatttcgcaacgtg

SEQ ID NO: 145173 - DNA, 25 bp, Homo sapien
tcgcccaactcacgccggttttata

SEQ ID NO: 145174 - DNA, 25 bp, Homo sapien
tgacggtgcaaacctgaggcctaca

SEQ ID NO: 145175 - DNA, 25 bp, Homo sapien
ttcgcaacgtgacggtgcaaacctg

SEQ ID NO: 145176 - DNA, 25 bp, Homo sapien
ccggttttatatttagaaagagctg

SEQ ID NO: 145177 - DNA, 25 bp, Homo sapien
ctcgctgcgggacaagcttctggaa

SEQ ID NO: 145178 - DNA, 25 bp, Homo sapien
gagtccggttcagcgcctctgcgca

SEQ ID NO: 145179 - DNA, 25 bp, Homo sapien
ttctggaagctctttgcggtggcgt

SEQ ID NO: 145180 - DNA, 25 bp, Homo sapien
ctgtttgcggatgctgatgcaggta

SEQ ID NO: 145181 - DNA, 25 bp, Homo sapien
tgctgatgcaggtactggtcgtccc

SEQ ID NO: 145182 - DNA, 25 bp, Homo sapien
cgggagcagcctaccaacgggctgt

SEQ ID NO: 145183 - DNA, 25 bp, Homo sapien
tgcttctgtgggaggtgcgcactcc

SEQ ID NO: 145184 - DNA, 25 bp, Homo sapien
tttcggaaagctgcacgagcgcgtt

SEQ ID NO: 145185 - DNA, 25 bp, Homo sapien
cccagttgtgcagtccagcaagttc

SEQ ID NO: 145186 - DNA, 25 bp, Homo sapien
gatcctccgagtgcaagacccagcg

SEQ ID NO: 145187 - DNA, 25 bp, Homo sapien
ggctcccaagatcctccgagtgcaa

SEQ ID NO: 145188 - DNA, 25 bp, Homo sapien
tcgggacgtcggctcccaagatcct

SEQ ID NO: 145189 - DNA, 25 bp, Homo sapien
tccaagctctccaaggaactgcggg

SEQ ID NO: 145190 - DNA, 25 bp, Homo sapien
gtgcaagacccagcggtcatttcga

SEQ ID NO: 145191 - DNA, 25 bp, Homo sapien
tgtaaccaagctttcctattccctc

SEQ ID NO: 145192 - DNA, 25 bp, Homo sapien
gcagtccagcaagttccctggccag

SEQ ID NO: 145193 - DNA, 25 bp, Homo sapien
gcgacctttaagatactcacgtttc

SEQ ID NO: 145194 - DNA, 25 bp, Homo sapien
gtggcaaccgcctacgagacactca

SEQ ID NO: 145195 - DNA, 25 bp, Homo sapien
cgaaggaagtagttgctgtagccgc

SEQ ID NO: 145196 - DNA, 25 bp, Homo sapien
gtgacacaccggaagcagcctagtg

SEQ ID NO: 145197 - DNA, 25 bp, Homo sapien
tacggggaaggtgttcagtgacaca

SEQ ID NO: 145198 - DNA, 25 bp, Homo sapien
ccggacactgtggaaggtaaagcgc

SEQ ID NO: 145199 - DNA, 25 bp, Homo sapien
cgaaaaggatgcgtgtgccggacac

SEQ ID NO: 145200 - DNA, 25 bp, Homo sapien
tcccacgtggccctgtgaaagagcc

SEQ ID NO: 145201 - DNA, 25 bp, Homo sapien
cgcgattcctgctcatcctaggggc

SEQ ID NO: 145202 - DNA, 25 bp, Homo sapien
gcttggtagagcagctcaagttgga

SEQ ID NO: 145203 - DNA, 25 bp, Homo sapien
gcccactccagaaggcggccgtggt

SEQ ID NO: 145204 - DNA, 25 bp, Homo sapien
ccctgcagcgcttggtagagcagct

SEQ ID NO: 145205 - DNA, 25 bp, Homo sapien
agagcactgccagctcgctggggtc

SEQ ID NO: 145206 - DNA, 25 bp, Homo sapien
acccaggtttcaggcgctgaggagc

SEQ ID NO: 145207 - DNA, 25 bp, Homo sapien
tcctaggggcgccagcttcgctgga

SEQ ID NO: 145208 - DNA, 25 bp, Homo sapien
caggtgccacccaggtttcaggcgc

SEQ ID NO: 145209 - DNA, 25 bp, Homo sapien
cagtccggacttctttgggagtggc

SEQ ID NO: 145210 - DNA, 25 bp, Homo sapien
tccgtccgcgagtgggcacagccta

SEQ ID NO: 145211 - DNA, 25 bp, Homo sapien
tcctcgggagtgagcagaaccctca

SEQ ID NO: 145212 - DNA, 25 bp, Homo sapien
cacagcctagggaggtaaggattgt

SEQ ID NO: 145213 - DNA, 25 bp, Homo sapien
ggaagacccggcaaagcagtccgga

SEQ ID NO: 145214 - DNA, 25 bp, Homo sapien
tggcggctcccatgttgttagcgag

SEQ ID NO: 145215 - DNA, 25 bp, Homo sapien
ctcccatgttgttagcgaggccggg

SEQ ID NO: 145216 - DNA, 25 bp, Homo sapien
tgagcagaaccctcataacactggg

SEQ ID NO: 145217 - DNA, 25 bp, Homo sapien
aagctcagggaaaggagtagaactg

SEQ ID NO: 145218 - DNA, 25 bp, Homo sapien
tcgcgtggaacccagcaattgatta

SEQ ID NO: 145219 - DNA, 25 bp, Homo sapien
ttaagaatctcaatggccctaatcc

SEQ ID NO: 145220 - DNA, 25 bp, Homo sapien
cctgagaattgaactaagggctccc

SEQ ID NO: 145221 - DNA, 25 bp, Homo sapien
cacagcgatttacatggggcctaga

SEQ ID NO: 145222 - DNA, 25 bp, Homo sapien
cagcctgctcagcagcgagtggttg

SEQ ID NO: 145223 - DNA, 25 bp, Homo sapien
tttctcaacactgtgaagctcaggg

SEQ ID NO: 145224 - DNA, 25 bp, Homo sapien
aagtttctaaagaggatcgcgtgga

SEQ ID NO: 145225 - DNA, 25 bp, Homo sapien
tttcggctatgcctgcaagctgttc

SEQ ID NO: 145226 - DNA, 25 bp, Homo sapien
gcggcacacctgaatgcgaaaatta

SEQ ID NO: 145227 - DNA, 25 bp, Homo sapien
tccaccattttgtggcccgctatgg

SEQ ID NO: 145228 - DNA, 25 bp, Homo sapien
ggggaccacaagatcctcatcgaca

SEQ ID NO: 145229 - DNA, 25 bp, Homo sapien
cggctgcccgataaaacggacatta

SEQ ID NO: 145230 - DNA, 25 bp, Homo sapien
tcaggaacagggacagcacctcatc

SEQ ID NO: 145231 - DNA, 25 bp, Homo sapien
ccctaaggcactggctggaattgcg

SEQ ID NO: 145232 - DNA, 25 bp, Homo sapien
ggacggtgaaacctgccctaaggca

SEQ ID NO: 145233 - DNA, 25 bp, Homo sapien
ccggcgaggagcttcggatcaaaac

SEQ ID NO: 145234 - DNA, 25 bp, Homo sapien
ttccctggtaacatccggcatcctg

SEQ ID NO: 145235 - DNA, 25 bp, Homo sapien
ctcttctgaagtaacgacccggcga

SEQ ID NO: 145236 - DNA, 25 bp, Homo sapien
cggtaccaattagcggctcgcctcg

SEQ ID NO: 145237 - DNA, 25 bp, Homo sapien
ttgcgagtagcaaaggaaacttcta

SEQ ID NO: 145238 - DNA, 25 bp, Homo sapien
cctggggctgccaaatcgcagacaa

SEQ ID NO: 145239 - DNA, 25 bp, Homo sapien
tctaggattatccaccgcggggctg

SEQ ID NO: 145240 - DNA, 25 bp, Homo sapien
atcgcagacaaagacgcccatcagc

SEQ ID NO: 145241 - DNA, 25 bp, Homo sapien
cgagccgccggttttgattagtgcg

SEQ ID NO: 145242 - DNA, 25 bp, Homo sapien
ttggatttctagacaagctccggca

SEQ ID NO: 145243 - DNA, 25 bp, Homo sapien
cagccaggcacagggtcccgagctg

SEQ ID NO: 145244 - DNA, 25 bp, Homo sapien
ctgtggctgatgcatttcatggcta

SEQ ID NO: 145245 - DNA, 25 bp, Homo sapien
catggctatcatctacacgtgagtg

SEQ ID NO: 145246 - DNA, 25 bp, Homo sapien
atctacacgtgagtgagggaccgca

SEQ ID NO: 145247 - DNA, 25 bp, Homo sapien
acaggcgagaatgggaaacgtttgc

SEQ ID NO: 145248 - DNA, 25 bp, Homo sapien
ttctggggcacccaggaacagcagg

SEQ ID NO: 145249 - DNA, 25 bp, Homo sapien
ggaagcgtccgtgcgcccagagtcc

SEQ ID NO: 145250 - DNA, 25 bp, Homo sapien
cggaagcgtgacagcgccgcagaac

SEQ ID NO: 145251 - DNA, 25 bp, Homo sapien
ccttcctcttgtcggggcctgggct

SEQ ID NO: 145252 - DNA, 25 bp, Homo sapien
tgggcttaggacacgcccgttccgc

SEQ ID NO: 145253 - DNA, 25 bp, Homo sapien
ggggacagacactcatcggataatg

SEQ ID NO: 145254 - DNA, 25 bp, Homo sapien
gtgcagagataaggctacaggcgcc

SEQ ID NO: 145255 - DNA, 25 bp, Homo sapien
tcggataatgacacagctggacgca

SEQ ID NO: 145256 - DNA, 25 bp, Homo sapien
cagagcgcgggtccttcctcttgtc

SEQ ID NO: 145257 - DNA, 25 bp, Homo sapien
tacttacccatccatggcccagatg

SEQ ID NO: 145258 - DNA, 25 bp, Homo sapien
cggacggcaactccgcgattccggg

SEQ ID NO: 145259 - DNA, 25 bp, Homo sapien
agcgccgcgcaccattttctgagag

SEQ ID NO: 145260 - DNA, 25 bp, Homo sapien
gcccagacgtgtaccgacgcgtgca

SEQ ID NO: 145261 - DNA, 25 bp, Homo sapien
accatggcttgcgaccaggtcgccg

SEQ ID NO: 145262 - DNA, 25 bp, Homo sapien
tcacagcacaagtcgggagacctcg

SEQ ID NO: 145263 - DNA, 25 bp, Homo sapien
aagcgttaacgtatctcacagcaca

SEQ ID NO: 145264 - DNA, 25 bp, Homo sapien
caagcgagctttggctctgcggagc

SEQ ID NO: 145265 - DNA, 25 bp, Homo sapien
gaggcccactgcatacgcaggcgca

SEQ ID NO: 145266 - DNA, 25 bp, Homo sapien
aggatactgcctgggcacgctctga

SEQ ID NO: 145267 - DNA, 25 bp, Homo sapien
ttctgcccagggctagcgttcctaa

SEQ ID NO: 145268 - DNA, 25 bp, Homo sapien
cctcctctgatctacgaaagtcatg

SEQ ID NO: 145269 - DNA, 25 bp, Homo sapien
gggacggtccagctttagctctctg

SEQ ID NO: 145270 - DNA, 25 bp, Homo sapien
caggagcctgattgtcaccgtacga

SEQ ID NO: 145271 - DNA, 25 bp, Homo sapien
gccgacttcagccacaaaggcaatt

SEQ ID NO: 145272 - DNA, 25 bp, Homo sapien
tgggcactgtgcaccgagaatctgc

SEQ ID NO: 145273 - DNA, 25 bp, Homo sapien
ggttccacacctgtcggggcagtag

SEQ ID NO: 145274 - DNA, 25 bp, Homo sapien
tgtcgttacacacttcctgtgggtc

SEQ ID NO: 145275 - DNA, 25 bp, Homo sapien
atggattgctccaacctctcggtcc

SEQ ID NO: 145276 - DNA, 25 bp, Homo sapien
ccgaccgcgttcctatggacagacg

SEQ ID NO: 145277 - DNA, 25 bp, Homo sapien
acacttcctcggaccatagcgggga

SEQ ID NO: 145278 - DNA, 25 bp, Homo sapien
gtgccgtaggaggtgtcgttacaca

SEQ ID NO: 145279 - DNA, 25 bp, Homo sapien
aggctcgatctacacctcctcgggg

SEQ ID NO: 145280 - DNA, 25 bp, Homo sapien
agggagcagtgctgtacacttcctc

SEQ ID NO: 145281 - DNA, 25 bp, Homo sapien
agtgagacaagagtaggccagattg

SEQ ID NO: 145282 - DNA, 25 bp, Homo sapien
ttagcaagtgagacaagagtaggcc

SEQ ID NO: 145283 - DNA, 25 bp, Homo sapien
ataggtgtcttgcatttagcaagtg

SEQ ID NO: 145284 - DNA, 25 bp, Homo sapien
agagcgagccaagatgctgaggtgc

SEQ ID NO: 145285 - DNA, 25 bp, Homo sapien
gctgaggtgctttcccctgttgaaa

SEQ ID NO: 145286 - DNA, 25 bp, Homo sapien
tgaaagcctggcttgaagggtcgaa

SEQ ID NO: 145287 - DNA, 25 bp, Homo sapien
gtaggccagattgggaagacttttc

SEQ ID NO: 145288 - DNA, 25 bp, Homo sapien
aagacttttctcagcagagggaaca

SEQ ID NO: 145289 - DNA, 25 bp, Homo sapien
ggaggtcgctgcctgtagcaacaaa

SEQ ID NO: 145290 - DNA, 25 bp, Homo sapien
accgcccgtcgtgattcgcacttta

SEQ ID NO: 145291 - DNA, 25 bp, Homo sapien
gaggagctcaactcgcggcactaca

SEQ ID NO: 145292 - DNA, 25 bp, Homo sapien
gcgcgaccacttaggcaagaggagc

SEQ ID NO: 145293 - DNA, 25 bp, Homo sapien
cttacaatcgctgctcttaaagggg

SEQ ID NO: 145294 - DNA, 25 bp, Homo sapien
cagactgtcgtacttacctgggacc

SEQ ID NO: 145295 - DNA, 25 bp, Homo sapien
ttctattgcccggtgcctccagact

SEQ ID NO: 145296 - DNA, 25 bp, Homo sapien
gcaccggagccacacttttctattg

SEQ ID NO: 145297 - DNA, 25 bp, Homo sapien
tcttttccacctctgatttccgtta

SEQ ID NO: 145298 - DNA, 25 bp, Homo sapien
cagccgcagagggacaggcttcgct

SEQ ID NO: 145299 - DNA, 25 bp, Homo sapien
cctccgcgaggcaacgttggacact

SEQ ID NO: 145300 - DNA, 25 bp, Homo sapien
cgcatcagtaaacgcgggtggaacg

SEQ ID NO: 145301 - DNA, 25 bp, Homo sapien
atttccgttagacatttgctccgca

SEQ ID NO: 145302 - DNA, 25 bp, Homo sapien
cttcgctgcctgtgactggtcgcaa

SEQ ID NO: 145303 - DNA, 25 bp, Homo sapien
tgactggtcgcaagcaccggtgaca

SEQ ID NO: 145304 - DNA, 25 bp, Homo sapien
tggaacggaacaggctcctccaacc

SEQ ID NO: 145305 - DNA, 25 bp, Homo sapien
caaattcggctgctacggctgctca

SEQ ID NO: 145306 - DNA, 25 bp, Homo sapien
caggcccaccacaaggttgtagata

SEQ ID NO: 145307 - DNA, 25 bp, Homo sapien
agatggctctctgctgttggtcctc

SEQ ID NO: 145308 - DNA, 25 bp, Homo sapien
taggacgccttcaccacgaggagta

SEQ ID NO: 145309 - DNA, 25 bp, Homo sapien
gctcatgtgacctctctgatgggga

SEQ ID NO: 145310 - DNA, 25 bp, Homo sapien
tgactcctcctcaggccagaaaagg

SEQ ID NO: 145311 - DNA, 25 bp, Homo sapien
tctggctgcagtgacaaggatatgc

SEQ ID NO: 145312 - DNA, 25 bp, Homo sapien
cggctgctcaggtttcagtcccgga

SEQ ID NO: 145313 - DNA, 25 bp, Homo sapien
tgctgcagccgcagataccatctca

SEQ ID NO: 145314 - DNA, 25 bp, Homo sapien
tgcgtgcgcacgtctacgtacgctc

SEQ ID NO: 145315 - DNA, 25 bp, Homo sapien
gtctacgtacgctcgtgtatgctga

SEQ ID NO: 145316 - DNA, 25 bp, Homo sapien
agcaggcattggaacatgacggagc

SEQ ID NO: 145317 - DNA, 25 bp, Homo sapien
gataccatctcagccggcatggcgc

SEQ ID NO: 145318 - DNA, 25 bp, Homo sapien
acagacaggtcaggccggaagcgac

SEQ ID NO: 145319 - DNA, 25 bp, Homo sapien
actgtccgtgaaggtgacgctcata

SEQ ID NO: 145320 - DNA, 25 bp, Homo sapien
tcgtgtatgctgaggagcaggcatt

SEQ ID NO: 145321 - DNA, 25 bp, Homo sapien
ctcctctggacaccggggcggatct

SEQ ID NO: 145322 - DNA, 25 bp, Homo sapien
gggcggatctgaagggaccaatcca

SEQ ID NO: 145323 - DNA, 25 bp, Homo sapien
agagcctgagatgcgcgcaaacggc

SEQ ID NO: 145324 - DNA, 25 bp, Homo sapien
caggtatctgcccactcgcagggta

SEQ ID NO: 145325 - DNA, 25 bp, Homo sapien
tcgcagggtacctctctcctgcagg

SEQ ID NO: 145326 - DNA, 25 bp, Homo sapien
tctcctgcaggtgagacgagccaga

SEQ ID NO: 145327 - DNA, 25 bp, Homo sapien
gcgagccggccaaggcattctctag

SEQ ID NO: 145328 - DNA, 25 bp, Homo sapien
ggccaaggcattctctagggctcct

SEQ ID NO: 145329 - DNA, 25 bp, Homo sapien
attctcatcgttgcactgtcgcgga

SEQ ID NO: 145330 - DNA, 25 bp, Homo sapien
ggatgcatcctctcgattctcatcg

SEQ ID NO: 145331 - DNA, 25 bp, Homo sapien
tgctgcccaaggagctcggcgagac

SEQ ID NO: 145332 - DNA, 25 bp, Homo sapien
aacctgatctctggctgctgcccaa

SEQ ID NO: 145333 - DNA, 25 bp, Homo sapien
ttcctgtggtgatctcgtcgtggtc

SEQ ID NO: 145334 - DNA, 25 bp, Homo sapien
ggcgtttctccctgcgtgattatca

SEQ ID NO: 145335 - DNA, 25 bp, Homo sapien
cgtggtcgtgatcattggatgcatc

SEQ ID NO: 145336 - DNA, 25 bp, Homo sapien
ctgtcgcggagaacactttgttatc

SEQ ID NO: 145337 - DNA, 25 bp, Homo sapien
ttcccaagccaggaagtacgcctgc

SEQ ID NO: 145338 - DNA, 25 bp, Homo sapien
gacccgcccgaatggttgtgtttga

SEQ ID NO: 145339 - DNA, 25 bp, Homo sapien
gcatcttctgcaaagcgccctcttg

SEQ ID NO: 145340 - DNA, 25 bp, Homo sapien
ttgcgaacgtgcgtcgtttccatcg

SEQ ID NO: 145341 - DNA, 25 bp, Homo sapien
ctttctaatgctttgcgggttgcga

SEQ ID NO: 145342 - DNA, 25 bp, Homo sapien
gctgcgtctttcaccggtgtctttc

SEQ ID NO: 145343 - DNA, 25 bp, Homo sapien
cacgcggccgccaggaactacattt

SEQ ID NO: 145344 - DNA, 25 bp, Homo sapien
acctcccacacgagtgcaagggtcg

SEQ ID NO: 145345 - DNA, 25 bp, Homo sapien
gcctctttggtcgtttccgcacttc

SEQ ID NO: 145346 - DNA, 25 bp, Homo sapien
ttgtcagaatctggacgccgctgga

SEQ ID NO: 145347 - DNA, 25 bp, Homo sapien
ggcgcggccatcttggcaaacactc

SEQ ID NO: 145348 - DNA, 25 bp, Homo sapien
tgatgcgatcagagccagccggaac

SEQ ID NO: 145349 - DNA, 25 bp, Homo sapien
gaaccgagttccgttacgcactaca

SEQ ID NO: 145350 - DNA, 25 bp, Homo sapien
tgacaacccactgccggagttcgga

SEQ ID NO: 145351 - DNA, 25 bp, Homo sapien
cggatcgcatcactgccggaagata

SEQ ID NO: 145352 - DNA, 25 bp, Homo sapien
gtccgggaatcacaacgcttagtgc

SEQ ID NO: 145353 - DNA, 25 bp, Homo sapien
cgcgcagcgctaggggacccatttc

SEQ ID NO: 145354 - DNA, 25 bp, Homo sapien
tcgagcttttccaaggcgagggtgc

SEQ ID NO: 145355 - DNA, 25 bp, Homo sapien
cagcccgcccaggtggttgacgact

SEQ ID NO: 145356 - DNA, 25 bp, Homo sapien
gcgcctcgggctgggaacagaacct

SEQ ID NO: 145357 - DNA, 25 bp, Homo sapien
tccctgcatcctggggactccggtg

SEQ ID NO: 145358 - DNA, 25 bp, Homo sapien
aacttgaagcacatctcatctgggg

SEQ ID NO: 145359 - DNA, 25 bp, Homo sapien
ttcctggcgcactgagggcttcctc

SEQ ID NO: 145360 - DNA, 25 bp, Homo sapien
gatctaggccggtgctttggctcct

SEQ ID NO: 145361 - DNA, 25 bp, Homo sapien
ccgagagtcgggcaaatttcgagtg

SEQ ID NO: 145362 - DNA, 25 bp, Homo sapien
ctaggcctcacggtctgattttctc

SEQ ID NO: 145363 - DNA, 25 bp, Homo sapien
ccagccaggtttgagttggttcctc

SEQ ID NO: 145364 - DNA, 25 bp, Homo sapien
gagggccacattttgcccacgacca

SEQ ID NO: 145365 - DNA, 25 bp, Homo sapien
gggtgtgctttcgtcccagcttagt

SEQ ID NO: 145366 - DNA, 25 bp, Homo sapien
ggcaggaatccatctaccgacgtta

SEQ ID NO: 145367 - DNA, 25 bp, Homo sapien
cagtctgcggaggaaaaactccttt

SEQ ID NO: 145368 - DNA, 25 bp, Homo sapien
accgagtcccgcaggttctcttgct

SEQ ID NO: 145369 - DNA, 25 bp, Homo sapien
gcgctggtgcagaatgtttcctctc

SEQ ID NO: 145370 - DNA, 25 bp, Homo sapien
gcaggttaacatttctggcagcaga

SEQ ID NO: 145371 - DNA, 25 bp, Homo sapien
gaagtttcccatgctaatttgtctc

SEQ ID NO: 145372 - DNA, 25 bp, Homo sapien
agttgcaagacaggagaactcttta

SEQ ID NO: 145373 - DNA, 25 bp, Homo sapien
gggtttggattctctgctctgcaca

SEQ ID NO: 145374 - DNA, 25 bp, Homo sapien
tccctccaggagtcactattaaacc

SEQ ID NO: 145375 - DNA, 25 bp, Homo sapien
cttcttgatgaggagccagtttttc

SEQ ID NO: 145376 - DNA, 25 bp, Homo sapien
ctttagcactggttctgggtttgga

SEQ ID NO: 145377 - DNA, 25 bp, Homo sapien
gtgtcaccgcgctgggaaagttcaa

SEQ ID NO: 145378 - DNA, 25 bp, Homo sapien
tcgagctctctccaaatcagactta

SEQ ID NO: 145379 - DNA, 25 bp, Homo sapien
aaactttgccgcgagccgaccatgt

SEQ ID NO: 145380 - DNA, 25 bp, Homo sapien
ttaaccctcttgcagtccgagcgcg

SEQ ID NO: 145381 - DNA, 25 bp, Homo sapien
ttccaggggtgaaatccaatctaca

SEQ ID NO: 145382 - DNA, 25 bp, Homo sapien
tcactcggcgtgctagatttccagg

SEQ ID NO: 145383 - DNA, 25 bp, Homo sapien
tagccaaagattcaagttcactcgg

SEQ ID NO: 145384 - DNA, 25 bp, Homo sapien
gcccaggggtatcaaaacgatctcc

SEQ ID NO: 145385 - DNA, 25 bp, Homo sapien
tgagtcatcaaagaccggggccagg

SEQ ID NO: 145386 - DNA, 25 bp, Homo sapien
actgaggctgtaaccgcagagctga

SEQ ID NO: 145387 - DNA, 25 bp, Homo sapien
ggctctcccggaatcgctgacattc

SEQ ID NO: 145388 - DNA, 25 bp, Homo sapien
aacaccgctgggcttggactcaaac

SEQ ID NO: 145389 - DNA, 25 bp, Homo sapien
ccgggacacatgagttaggggcaaa

SEQ ID NO: 145390 - DNA, 25 bp, Homo sapien
tgaccgcaggagctctgagtcatca

SEQ ID NO: 145391 - DNA, 25 bp, Homo sapien
cgtcccgccctaagatcgtgttttg

SEQ ID NO: 145392 - DNA, 25 bp, Homo sapien
agaacttcttactcactctcggcgc

SEQ ID NO: 145393 - DNA, 25 bp, Homo sapien
gcgccgagagtgagtaagaagttct

SEQ ID NO: 145394 - DNA, 25 bp, Homo sapien
gaccgcggtttgagtccaagcccag

SEQ ID NO: 145395 - DNA, 25 bp, Homo sapien
aacacgatcttagggcgggacgata

SEQ ID NO: 145396 - DNA, 25 bp, Homo sapien
tgcggttacagcctcagttaatttc

SEQ ID NO: 145397 - DNA, 25 bp, Homo sapien
atcccgtcagctctgcggttacagc

SEQ ID NO: 145398 - DNA, 25 bp, Homo sapien
cccggtctttgatgactcagagctc

SEQ ID NO: 145399 - DNA, 25 bp, Homo sapien
ccctaactcatgtgtcccggcgtgg

SEQ ID NO: 145400 - DNA, 25 bp, Homo sapien
tgagtcgctttgttgcggcattaaa

SEQ ID NO: 145401 - DNA, 25 bp, Homo sapien
aactgactcggagcgaggagacccg

SEQ ID NO: 145402 - DNA, 25 bp, Homo sapien
tccggctaggcgagcagttaccgag

SEQ ID NO: 145403 - DNA, 25 bp, Homo sapien
cctctttatttgtccctcctgctgg

SEQ ID NO: 145404 - DNA, 25 bp, Homo sapien
ggtggctctgtggttttcctcttta

SEQ ID NO: 145405 - DNA, 25 bp, Homo sapien
gtctcctggagctgccatctcggca

SEQ ID NO: 145406 - DNA, 25 bp, Homo sapien
accacgtgatccgtgcggccagggt

SEQ ID NO: 145407 - DNA, 25 bp, Homo sapien
caagcctcagcccttgggaacctgg

SEQ ID NO: 145408 - DNA, 25 bp, Homo sapien
cattgccaacagctggaacagggtt

SEQ ID NO: 145409 - DNA, 25 bp, Homo sapien
cgtgtgtgttcacggatcattactg

SEQ ID NO: 145410 - DNA, 25 bp, Homo sapien
tcacggatcagtactgtgtgtgtgc

SEQ ID NO: 145411 - DNA, 25 bp, Homo sapien
tgtgtgttcacggatcagtactgtg

SEQ ID NO: 145412 - DNA, 25 bp, Homo sapien
gtgtgttcacggatcagtactgtgt

SEQ ID NO: 145413 - DNA, 25 bp, Homo sapien
gtgtgcacccgtgtgtgttcacaga

SEQ ID NO: 145414 - DNA, 25 bp, Homo sapien
acggatcattactgtgtgtgcgccc

SEQ ID NO: 145415 - DNA, 25 bp, Homo sapien
tgtgtgttcacggatcattactgtg

SEQ ID NO: 145416 - DNA, 25 bp, Homo sapien
cacggatcattactgtgtgtgcgcc

SEQ ID NO: 145417 - DNA, 25 bp, Homo sapien
ggcgaactccagcacggtctctgga

SEQ ID NO: 145418 - DNA, 25 bp, Homo sapien
tgtcaccgccgacgtcgtaaaatgc

SEQ ID NO: 145419 - DNA, 25 bp, Homo sapien
ccttgcagggattggtcggtaatgc

SEQ ID NO: 145420 - DNA, 25 bp, Homo sapien
ctagtggctggacttgacctggaaa

SEQ ID NO: 145421 - DNA, 25 bp, Homo sapien
gacctggaaaggtaaggcttctctc

SEQ ID NO: 145422 - DNA, 25 bp, Homo sapien
ccctgtgcatgggtaccgtcctttt

SEQ ID NO: 145423 - DNA, 25 bp, Homo sapien
tctctggaccgaaagtagactgggc

SEQ ID NO: 145424 - DNA, 25 bp, Homo sapien
accgaacattgcgttggctttcacc

SEQ ID NO: 145425 - DNA, 25 bp, Homo sapien
agtgacgcacttcctgtcagtgacg

SEQ ID NO: 145426 - DNA, 25 bp, Homo sapien
actcagcggtgtcctacacagcgga

SEQ ID NO: 145427 - DNA, 25 bp, Homo sapien
cgttttcctgatccctaagcgcttt

SEQ ID NO: 145428 - DNA, 25 bp, Homo sapien
tcgcgagcctcttccacggtacaga

SEQ ID NO: 145429 - DNA, 25 bp, Homo sapien
ttccgcgagcttttcctggaggttc

SEQ ID NO: 145430 - DNA, 25 bp, Homo sapien
ttcccagactgcttggagcctctct

SEQ ID NO: 145431 - DNA, 25 bp, Homo sapien
ggaagcccttgactcgctccagagt

SEQ ID NO: 145432 - DNA, 25 bp, Homo sapien
ctcttggcccacgtcttgtcagtga

SEQ ID NO: 145433 - DNA, 25 bp, Homo sapien
gcgggagtgctggagaaaagcctcc

SEQ ID NO: 145434 - DNA, 25 bp, Homo sapien
gctctccgcttcgaccaaagggcga

SEQ ID NO: 145435 - DNA, 25 bp, Homo sapien
ccgcagttccgttcgcctaaagctg

SEQ ID NO: 145436 - DNA, 25 bp, Homo sapien
tcgcaggccgccgaaccgcagttcc

SEQ ID NO: 145437 - DNA, 25 bp, Homo sapien
aaagcctccgggcaccctcgcaggc

SEQ ID NO: 145438 - DNA, 25 bp, Homo sapien
caaagggcgagggttgcccgctcct

SEQ ID NO: 145439 - DNA, 25 bp, Homo sapien
agggttgcccgctcctagtctgccg

SEQ ID NO: 145440 - DNA, 25 bp, Homo sapien
tcaggctcagtacccaccggtgggc

SEQ ID NO: 145441 - DNA, 25 bp, Homo sapien
ccggaaccgccacccagcagcgcac

SEQ ID NO: 145442 - DNA, 25 bp, Homo sapien
ctctggtctttgtgcggccgcatgg

SEQ ID NO: 145443 - DNA, 25 bp, Homo sapien
atgcatattcatcagggcgcccggg

SEQ ID NO: 145444 - DNA, 25 bp, Homo sapien
ggcgcgccgcgatgcatattcatca

SEQ ID NO: 145445 - DNA, 25 bp, Homo sapien
gcgctcctcctgcagtcgcctccct

SEQ ID NO: 145446 - DNA, 25 bp, Homo sapien
gcgcctttgtgcttcccgaccgtgt

SEQ ID NO: 145447 - DNA, 25 bp, Homo sapien
tgcttcccgaccgtgtgtctgcggc

SEQ ID NO: 145448 - DNA, 25 bp, Homo sapien
gctttctctttctccggctcgcggc

SEQ ID NO: 145449 - DNA, 25 bp, Homo sapien
ccaggctctgagctggttctgcggc

SEQ ID NO: 145450 - DNA, 25 bp, Homo sapien
gctgggcggactcgacacccggccc

SEQ ID NO: 145451 - DNA, 25 bp, Homo sapien
ggctccgagcgacggcccgtgtgcg

SEQ ID NO: 145452 - DNA, 25 bp, Homo sapien
ctctgagctggttctgcggctccga

SEQ ID NO: 145453 - DNA, 25 bp, Homo sapien
ggcgcacggccatgtccgccgaggg

SEQ ID NO: 145454 - DNA, 25 bp, Homo sapien
aggaatttaaagagacctgctgccc

SEQ ID NO: 145455 - DNA, 25 bp, Homo sapien
tacaatcgcgatttcattcaacaag

SEQ ID NO: 145456 - DNA, 25 bp, Homo sapien
ctgagctggttctgcggctccgagc

SEQ ID NO: 145457 - DNA, 25 bp, Homo sapien
aggcacgaactgctcaccttttctc

SEQ ID NO: 145458 - DNA, 25 bp, Homo sapien
agcagattgaaaacgcagccgcaag

SEQ ID NO: 145459 - DNA, 25 bp, Homo sapien
caggacccacctgactcacaaggaa

SEQ ID NO: 145460 - DNA, 25 bp, Homo sapien
ccttctcagctgtagggcgtccacg

SEQ ID NO: 145461 - DNA, 25 bp, Homo sapien
ctgcgctgcaggcacgaactgctca

SEQ ID NO: 145462 - DNA, 25 bp, Homo sapien
agaatgtctatagctgccgtcggca

SEQ ID NO: 145463 - DNA, 25 bp, Homo sapien
gcccggacctgacgcagaatgtcta

SEQ ID NO: 145464 - DNA, 25 bp, Homo sapien
tcacaaggaagcagattgaaaacgc

SEQ ID NO: 145465 - DNA, 25 bp, Homo sapien
cacacgcaacgaggcctggccaatt

SEQ ID NO: 145466 - DNA, 25 bp, Homo sapien
cggtctcccacagaccgcgtaagag

SEQ ID NO: 145467 - DNA, 25 bp, Homo sapien
gcaggactcttggtgccacagtccc

SEQ ID NO: 145468 - DNA, 25 bp, Homo sapien
ggcttcaggcgcacagcacaatctg

SEQ ID NO: 145469 - DNA, 25 bp, Homo sapien
aacaaacgctccacgggactccgtg

SEQ ID NO: 145470 - DNA, 25 bp, Homo sapien
gcagcgggataatccagcccaaaca

SEQ ID NO: 145471 - DNA, 25 bp, Homo sapien
ctcgggttctgcatcgatggagtct

SEQ ID NO: 145472 - DNA, 25 bp, Homo sapien
tctgcatcgatggagtctgcccagg

SEQ ID NO: 145473 - DNA, 25 bp, Homo sapien
atccctttaggacccgaggcaggct

SEQ ID NO: 145474 - DNA, 25 bp, Homo sapien
ggctcaatggagcttccgtccgttt

SEQ ID NO: 145475 - DNA, 25 bp, Homo sapien
tccggattttgaagccgcagtggtt

SEQ ID NO: 145476 - DNA, 25 bp, Homo sapien
gtgatcacggcattgggcaggttta

SEQ ID NO: 145477 - DNA, 25 bp, Homo sapien
cgcctccttgatgatcctggtgatc

SEQ ID NO: 145478 - DNA, 25 bp, Homo sapien
ccgggcctccttggagatgttgaca

SEQ ID NO: 145479 - DNA, 25 bp, Homo sapien
cccgctcaccaggatgtggcgtaca

SEQ ID NO: 145480 - DNA, 25 bp, Homo sapien
aggtccatttctctgcttctcgcca

SEQ ID NO: 145481 - DNA, 25 bp, Homo sapien
cctggccgttccaacgcttggggca

SEQ ID NO: 145482 - DNA, 25 bp, Homo sapien
gttccaacgcttggggcagccctac

SEQ ID NO: 145483 - DNA, 25 bp, Homo sapien
ctgcaccgcgtctccctcgggagcc

SEQ ID NO: 145484 - DNA, 25 bp, Homo sapien
agtgggacgccatggagcgctccct

SEQ ID NO: 145485 - DNA, 25 bp, Homo sapien
ctcgggttgcagacgctcctgtccg

SEQ ID NO: 145486 - DNA, 25 bp, Homo sapien
gggagcaacacagccgcctcgggtt

SEQ ID NO: 145487 - DNA, 25 bp, Homo sapien
ttactggggagcaacacagccgcct

SEQ ID NO: 145488 - DNA, 25 bp, Homo sapien
cggcaggtggaactctccccattca

SEQ ID NO: 145489 - DNA, 25 bp, Homo sapien
caactacggagagcgcagtgaggcc

SEQ ID NO: 145490 - DNA, 25 bp, Homo sapien
gccaagcgcagcagcatgatcgaga

SEQ ID NO: 145491 - DNA, 25 bp, Homo sapien
cagcagcatgatcgagacgggccag

SEQ ID NO: 145492 - DNA, 25 bp, Homo sapien
gtggcctctcactgcgtgtgcagaa

SEQ ID NO: 145493 - DNA, 25 bp, Homo sapien
cgtgtgcagaactcgctgcggcgcc

SEQ ID NO: 145494 - DNA, 25 bp, Homo sapien
ttgcctccgacaccaccttgcactg

SEQ ID NO: 145495 - DNA, 25 bp, Homo sapien
cttgcactgctcagacggtgagggc

SEQ ID NO: 145496 - DNA, 25 bp, Homo sapien
cgatgacaactacggagagcgcagt

SEQ ID NO: 145497 - DNA, 25 bp, Homo sapien
ggcgcctttcctgacgtgcagatgc

SEQ ID NO: 145498 - DNA, 25 bp, Homo sapien
tgctcctggcgcctttcctgacgtg

SEQ ID NO: 145499 - DNA, 25 bp, Homo sapien
atgttgccttgagcgccggctgctt

SEQ ID NO: 145500 - DNA, 25 bp, Homo sapien
agcaccgcatgttgccttgagcgcc

SEQ ID NO: 145501 - DNA, 25 bp, Homo sapien
tgctgagcaccgcatgttgccttga

SEQ ID NO: 145502 - DNA, 25 bp, Homo sapien
ctcaccatgctgagcaccgcatgtt

SEQ ID NO: 145503 - DNA, 25 bp, Homo sapien
acccatgctgcaactgccggacagg

SEQ ID NO: 145504 - DNA, 25 bp, Homo sapien
gtctccacgcctcctgcggtcaccg

SEQ ID NO: 145505 - DNA, 25 bp, Homo sapien
cactccccggtttggagcccagata

SEQ ID NO: 145506 - DNA, 25 bp, Homo sapien
agtcagcgcttctgtcgagctccca

SEQ ID NO: 145507 - DNA, 25 bp, Homo sapien
aactgcggagtcagcgcttctgtcg

SEQ ID NO: 145508 - DNA, 25 bp, Homo sapien
tcggaaactgcggagtcagcgcttc

SEQ ID NO: 145509 - DNA, 25 bp, Homo sapien
cgcgggaaccctggagagccggtag

SEQ ID NO: 145510 - DNA, 25 bp, Homo sapien
gggacttttccaggctgcgcggtgc

SEQ ID NO: 145511 - DNA, 25 bp, Homo sapien
gcgagtgtaattggggacttttcca

SEQ ID NO: 145512 - DNA, 25 bp, Homo sapien
agcccgcacactcaggcctacactc

SEQ ID NO: 145513 - DNA, 25 bp, Homo sapien
cctgggcacgtttgcgggctttttg

SEQ ID NO: 145514 - DNA, 25 bp, Homo sapien
ttttgtgggcgcaatcgggagggtc

SEQ ID NO: 145515 - DNA, 25 bp, Homo sapien
cgggctttttgtgggcgcaatcggg

SEQ ID NO: 145516 - DNA, 25 bp, Homo sapien
ctgggcacgtttgcgggctttttgt

SEQ ID NO: 145517 - DNA, 25 bp, Homo sapien
cctcccgcacggacccatgaaccag

SEQ ID NO: 145518 - DNA, 25 bp, Homo sapien
tcctcccgcacggacccatgaacca

SEQ ID NO: 145519 - DNA, 25 bp, Homo sapien
cctcctcccgcacggacccatgaac

SEQ ID NO: 145520 - DNA, 25 bp, Homo sapien
ttgcgggctttttgtgggcgcaatc

SEQ ID NO: 145521 - DNA, 25 bp, Homo sapien
gcaccgtcctctcccgcaaacccga

SEQ ID NO: 145522 - DNA, 25 bp, Homo sapien
cgaacccgagctcccgtctcctagc

SEQ ID NO: 145523 - DNA, 25 bp, Homo sapien
tcctagcaccgtcctctcccgcgaa

SEQ ID NO: 145524 - DNA, 25 bp, Homo sapien
gcgaacccgagctcccgtctcctag

SEQ ID NO: 145525 - DNA, 25 bp, Homo sapien
agcaccgtcctctcccgcaaacccg

SEQ ID NO: 145526 - DNA, 25 bp, Homo sapien
cctagcaccgtcctctcccgcaaac

SEQ ID NO: 145527 - DNA, 25 bp, Homo sapien
tgtctcctagcaccgtcctctcgcg

SEQ ID NO: 145528 - DNA, 25 bp, Homo sapien
ctgtctcctagcaccgtcctctcgc

SEQ ID NO: 145529 - DNA, 25 bp, Homo sapien
atctgcgagttctacagccgggcca

SEQ ID NO: 145530 - DNA, 25 bp, Homo sapien
tgctcagcctgtgccttgaactcgg

SEQ ID NO: 145531 - DNA, 25 bp, Homo sapien
cacgaggtcatcgagctgctcaacg

SEQ ID NO: 145532 - DNA, 25 bp, Homo sapien
accctgctggaactcggtgacggac

SEQ ID NO: 145533 - DNA, 25 bp, Homo sapien
agccgggccaagaagatgaacctca

SEQ ID NO: 145534 - DNA, 25 bp, Homo sapien
ctggaggcgctcaaggagaacttca

SEQ ID NO: 145535 - DNA, 25 bp, Homo sapien
tcggcaaggtctgtgagctcatcaa

SEQ ID NO: 145536 - DNA, 25 bp, Homo sapien
actggtcgtgcgttacccaaaagca

SEQ ID NO: 145537 - DNA, 25 bp, Homo sapien
attaactagcttggggcggtttctg

SEQ ID NO: 145538 - DNA, 25 bp, Homo sapien
ctcaagaagacgtcagaacagggtc

SEQ ID NO: 145539 - DNA, 25 bp, Homo sapien
caccctcaaggtttggactcctagg

SEQ ID NO: 145540 - DNA, 25 bp, Homo sapien
tggggcaaacttgagctggcaaagc

SEQ ID NO: 145541 - DNA, 25 bp, Homo sapien
gtctcttcggtcaggtccgcccaag

SEQ ID NO: 145542 - DNA, 25 bp, Homo sapien
gaacagggtctcctatcaactgcta

SEQ ID NO: 145543 - DNA, 25 bp, Homo sapien
gctacctattgctgtctcgcaaaca

SEQ ID NO: 145544 - DNA, 25 bp, Homo sapien
ttagcctcacaacaggacctaggtc

SEQ ID NO: 145545 - DNA, 25 bp, Homo sapien
cgtctagcaccgcaccgaagcggaa

SEQ ID NO: 145546 - DNA, 25 bp, Homo sapien
gcaccgaagcggaacgccacttctg

SEQ ID NO: 145547 - DNA, 25 bp, Homo sapien
gccgcacgcccggaacacgtcctcc

SEQ ID NO: 145548 - DNA, 25 bp, Homo sapien
gaagcttcactcacccgcgcagcgc

SEQ ID NO: 145549 - DNA, 25 bp, Homo sapien
ggaggcgaagcttcactcacccgcg

SEQ ID NO: 145550 - DNA, 25 bp, Homo sapien
cgtggctggactccggcggctaccc

SEQ ID NO: 145551 - DNA, 25 bp, Homo sapien
ggaacacgtcctcctgcgtgcgcgc

SEQ ID NO: 145552 - DNA, 25 bp, Homo sapien
gaagcggaacgccacttctggaccc

SEQ ID NO: 145553 - DNA, 25 bp, Homo sapien
atgtcctgctctgcacacggagtta

SEQ ID NO: 145554 - DNA, 25 bp, Homo sapien
gtgacccgcgttcttccatgtcctg

SEQ ID NO: 145555 - DNA, 25 bp, Homo sapien
tgaagatctgcttacccgtcgggtg

SEQ ID NO: 145556 - DNA, 25 bp, Homo sapien
aggactcctcgaacctgtctgaaga

SEQ ID NO: 145557 - DNA, 25 bp, Homo sapien
tcatacctgcacctagcggctgttc

SEQ ID NO: 145558 - DNA, 25 bp, Homo sapien
cctgtgggcagcaatgcgacttatc

SEQ ID NO: 145559 - DNA, 25 bp, Homo sapien
caggtgcctcctagccaatttatac

SEQ ID NO: 145560 - DNA, 25 bp, Homo sapien
ccgacagaagggcagatggtacatc

SEQ ID NO: 145561 - DNA, 25 bp, Homo sapien
ctgcggggacccatgaatacaaatg

SEQ ID NO: 145562 - DNA, 25 bp, Homo sapien
agcctcgcacgtagggacccagtaa

SEQ ID NO: 145563 - DNA, 25 bp, Homo sapien
ttgtgcctgtgtaagcatccgtgtg

SEQ ID NO: 145564 - DNA, 25 bp, Homo sapien
ccgtgtgcatgcttctgcgagtgta

SEQ ID NO: 145565 - DNA, 25 bp, Homo sapien
tgcgcctgagcccagatatctgagg

SEQ ID NO: 145566 - DNA, 25 bp, Homo sapien
tctgaggatgcgtttcgtgtgaacc

SEQ ID NO: 145567 - DNA, 25 bp, Homo sapien
tcccagaatgggaccgtgtgtgagc

SEQ ID NO: 145568 - DNA, 25 bp, Homo sapien
cgatatggccaggatagcgtgcatt

SEQ ID NO: 145569 - DNA, 25 bp, Homo sapien
aaggtggagagccaccgcgggccga

SEQ ID NO: 145570 - DNA, 25 bp, Homo sapien
gagactttaaatcgccttcatttcc

SEQ ID NO: 145571 - DNA, 25 bp, Homo sapien
cgagactttaaatcgccttcatttc

SEQ ID NO: 145572 - DNA, 25 bp, Homo sapien
ccgagactttaaatcgccttcattt

SEQ ID NO: 145573 - DNA, 25 bp, Homo sapien
gccgagactttaaatcgccttcatt

SEQ ID NO: 145574 - DNA, 25 bp, Homo sapien
ggccgagactttaaatcgccttcat

SEQ ID NO: 145575 - DNA, 25 bp, Homo sapien
gggccgagactttaaatcgccttca

SEQ ID NO: 145576 - DNA, 25 bp, Homo sapien
cgcgggccgagactttaaatcgcct

SEQ ID NO: 145577 - DNA, 25 bp, Homo sapien
agagttggcgaacgctgcccgccct

SEQ ID NO: 145578 - DNA, 25 bp, Homo sapien
cgccaagggttaataggggctgcgc

SEQ ID NO: 145579 - DNA, 25 bp, Homo sapien
cttccagcggaacgtcagcttcctg

SEQ ID NO: 145580 - DNA, 25 bp, Homo sapien
tcgcttccagcggaacgtcagcttc

SEQ ID NO: 145581 - DNA, 25 bp, Homo sapien
cggtcgcttccagcggaacgtcagc

SEQ ID NO: 145582 - DNA, 25 bp, Homo sapien
gccatgcggtcgcttccagcggaac

SEQ ID NO: 145583 - DNA, 25 bp, Homo sapien
tgctgctccaatctcggggagggcc

SEQ ID NO: 145584 - DNA, 25 bp, Homo sapien
cctgctgctccaatctcggggaggg

SEQ ID NO: 145585 - DNA, 25 bp, Homo sapien
tggctgttcgtgtttgccgtggccc

SEQ ID NO: 145586 - DNA, 25 bp, Homo sapien
gtttgccgtggctgttcatgtttgc

SEQ ID NO: 145587 - DNA, 25 bp, Homo sapien
cgtgtttgccgtggctcgtgtttgc

SEQ ID NO: 145588 - DNA, 25 bp, Homo sapien
tttgccgtggctcgtgtttgccgtg

SEQ ID NO: 145589 - DNA, 25 bp, Homo sapien
tgtttgccgtggctcgtgtttgccg

SEQ ID NO: 145590 - DNA, 25 bp, Homo sapien
tggcccgtgtttgccgtggctgttc

SEQ ID NO: 145591 - DNA, 25 bp, Homo sapien
cgtgtttgccgtggcccgtgtttgc

SEQ ID NO: 145592 - DNA, 25 bp, Homo sapien
gtttgccgtggctcgtgtttgccgt

SEQ ID NO: 145593 - DNA, 25 bp, Homo sapien
tgccatggcttctgggcactgctcc

SEQ ID NO: 145594 - DNA, 25 bp, Homo sapien
tgcctcaggtttgcgcctccaagtt

SEQ ID NO: 145595 - DNA, 25 bp, Homo sapien
ttacacaccctccttgtttgctggg

SEQ ID NO: 145596 - DNA, 25 bp, Homo sapien
ttgctgggtcgttttccactgtaaa

SEQ ID NO: 145597 - DNA, 25 bp, Homo sapien
ccactgtaaagggtcggggatcatg

SEQ ID NO: 145598 - DNA, 25 bp, Homo sapien
cggggatcatgagccagaaatctgc

SEQ ID NO: 145599 - DNA, 25 bp, Homo sapien
cgtcagcaggatcgtggttctaccc

SEQ ID NO: 145600 - DNA, 25 bp, Homo sapien
ttctacccgtgcaccgccaagtgga

SEQ ID NO: 145601 - DNA, 25 bp, Homo sapien
agagctggcactggtgctgagcctc

SEQ ID NO: 145602 - DNA, 25 bp, Homo sapien
gacctcgacatgcacgacgggcgct

SEQ ID NO: 145603 - DNA, 25 bp, Homo sapien
ctcagtggccttcgacctcgacatg

SEQ ID NO: 145604 - DNA, 25 bp, Homo sapien
tgtccgcagccagaaacgcaagctg

SEQ ID NO: 145605 - DNA, 25 bp, Homo sapien
attcctgccgccttgggcacagagc

SEQ ID NO: 145606 - DNA, 25 bp, Homo sapien
cagtcgggcttcatctttacgcagc

SEQ ID NO: 145607 - DNA, 25 bp, Homo sapien
gtcattcctttccagtcgggcttca

SEQ ID NO: 145608 - DNA, 25 bp, Homo sapien
gcaagacggtcgtccacctcgggtc

SEQ ID NO: 145609 - DNA, 25 bp, Homo sapien
aaccctgctgcaggatgaaaatctc

SEQ ID NO: 145610 - DNA, 25 bp, Homo sapien
ctgtgtgtgcctactgcaatcagcc

SEQ ID NO: 145611 - DNA, 25 bp, Homo sapien
aactcggacatagggagcgcaaacc

SEQ ID NO: 145612 - DNA, 25 bp, Homo sapien
gggagcgcaccaatcaccgaaaggc

SEQ ID NO: 145613 - DNA, 25 bp, Homo sapien
ggtggctcctttgcataatccctga

SEQ ID NO: 145614 - DNA, 25 bp, Homo sapien
gcggcaaacaaaggcctccaatccg

SEQ ID NO: 145615 - DNA, 25 bp, Homo sapien
ttctcccgacggagaaactgagtcc

SEQ ID NO: 145616 - DNA, 25 bp, Homo sapien
tgttgctgggtgaacgaatctcaca

SEQ ID NO: 145617 - DNA, 25 bp, Homo sapien
cgggttcctgagagacacaagagtt

SEQ ID NO: 145618 - DNA, 25 bp, Homo sapien
gccgagtcttccagcgagttccgac

SEQ ID NO: 145619 - DNA, 25 bp, Homo sapien
aagcccggactttgcgaactgttga

SEQ ID NO: 145620 - DNA, 25 bp, Homo sapien
agggcgctctagtcccagagcactc

SEQ ID NO: 145621 - DNA, 25 bp, Homo sapien
gtcagcagctacattctggagggca

SEQ ID NO: 145622 - DNA, 25 bp, Homo sapien
ctggcgcacgttggcagacagtaac

SEQ ID NO: 145623 - DNA, 25 bp, Homo sapien
cgcttgaccggactgtccagcagca

SEQ ID NO: 145624 - DNA, 25 bp, Homo sapien
ggcgccgcaaagctgacctgactgc

SEQ ID NO: 145625 - DNA, 25 bp, Homo sapien
agtcgaagaaagaccgctgggcctc

SEQ ID NO: 145626 - DNA, 25 bp, Homo sapien
ccgaggcccgcaaaagtgagtttca

SEQ ID NO: 145627 - DNA, 25 bp, Homo sapien
ctagtcagtctcaggggattcagca

SEQ ID NO: 145628 - DNA, 25 bp, Homo sapien
tgctctcagaatcgctgccgccatg

SEQ ID NO: 145629 - DNA, 25 bp, Homo sapien
aggccgcttgccttgctctcagaat

SEQ ID NO: 145630 - DNA, 25 bp, Homo sapien
tgtgtcagctgacccaaggggcctt

SEQ ID NO: 145631 - DNA, 25 bp, Homo sapien
ctacgctgtgcggtcacgtgacaac

SEQ ID NO: 145632 - DNA, 25 bp, Homo sapien
tcacagaagttcaagagcggtcagc

SEQ ID NO: 145633 - DNA, 25 bp, Homo sapien
cttggccccaaagcgagtccggcgg

SEQ ID NO: 145634 - DNA, 25 bp, Homo sapien
ctcggctgatgaaacgcggcctcca

SEQ ID NO: 145635 - DNA, 25 bp, Homo sapien
cggcgggaacccgtgccccaagatg

SEQ ID NO: 145636 - DNA, 25 bp, Homo sapien
cggctgatgaaacgcggcctccagc

SEQ ID NO: 145637 - DNA, 25 bp, Homo sapien
atgccgtgcacgtggtcggctccgc

SEQ ID NO: 145638 - DNA, 25 bp, Homo sapien
gcgctcggctgatgaaacgcggcct

SEQ ID NO: 145639 - DNA, 25 bp, Homo sapien
cccgtgtcctgcgatccgggcttgg

SEQ ID NO: 145640 - DNA, 25 bp, Homo sapien
cccaagatgccgtgcacgtggtcgg

SEQ ID NO: 145641 - DNA, 25 bp, Homo sapien
agctgcatgtggcagtgcctagcga

SEQ ID NO: 145642 - DNA, 25 bp, Homo sapien
gctcgctctttgaaaactggaaaca

SEQ ID NO: 145643 - DNA, 25 bp, Homo sapien
cgctctttgaaaactggaaacagcc

SEQ ID NO: 145644 - DNA, 25 bp, Homo sapien
tggcagtgcctagcgagctgctccc

SEQ ID NO: 145645 - DNA, 25 bp, Homo sapien
cgcctctgctcgctctttgaaaact

SEQ ID NO: 145646 - DNA, 25 bp, Homo sapien
ctctgctcgctctttgaaaactgga

SEQ ID NO: 145647 - DNA, 25 bp, Homo sapien
agtcagctgcatgtggcagtgccta

SEQ ID NO: 145648 - DNA, 25 bp, Homo sapien
ggaaacagccccctgtgctctgtgc

SEQ ID NO: 145649 - DNA, 25 bp, Homo sapien
gatgggcccaaactcggcacgattc

SEQ ID NO: 145650 - DNA, 25 bp, Homo sapien
cggaaaccacgaagcttgcgccttc

SEQ ID NO: 145651 - DNA, 25 bp, Homo sapien
gcgccttcatgcgtgtctaacatta

SEQ ID NO: 145652 - DNA, 25 bp, Homo sapien
cactttactacttcttgaaattcgg

SEQ ID NO: 145653 - DNA, 25 bp, Homo sapien
attcggaaaactccaccgacgcttg

SEQ ID NO: 145654 - DNA, 25 bp, Homo sapien
gacgcttggactcgctgcaacccag

SEQ ID NO: 145655 - DNA, 25 bp, Homo sapien
aggggctgcctaaagctctcgcacg

SEQ ID NO: 145656 - DNA, 25 bp, Homo sapien
cggcacgattctctaagttcggaaa

SEQ ID NO: 145657 - DNA, 25 bp, Homo sapien
ctccatcggtggaatgggcacactc

SEQ ID NO: 145658 - DNA, 25 bp, Homo sapien
cgggacgcgttcacgctgcaagtgt

SEQ ID NO: 145659 - DNA, 25 bp, Homo sapien
cgctctatttcagcgggcgaggcga

SEQ ID NO: 145660 - DNA, 25 bp, Homo sapien
aaccgtcggacatgcggctctggag

SEQ ID NO: 145661 - DNA, 25 bp, Homo sapien
cgtagctgctccatccctgggagga

SEQ ID NO: 145662 - DNA, 25 bp, Homo sapien
gcacactcggaaggcgtagctgctc

SEQ ID NO: 145663 - DNA, 25 bp, Homo sapien
aggtctccggcagtgatcacaggta

SEQ ID NO: 145664 - DNA, 25 bp, Homo sapien
agcctcactttgctccatcggtgga

SEQ ID NO: 145665 - DNA, 25 bp, Homo sapien
cccggcaaggggtgctcaacggcgc

SEQ ID NO: 145666 - DNA, 25 bp, Homo sapien
agctctgcgaattggcgcccggcaa

SEQ ID NO: 145667 - DNA, 25 bp, Homo sapien
cgcttggggccagctgcacgacaag

SEQ ID NO: 145668 - DNA, 25 bp, Homo sapien
ttggggccagctgcacgacaagccc

SEQ ID NO: 145669 - DNA, 25 bp, Homo sapien
tgacggacagggagctctgcgaatt

SEQ ID NO: 145670 - DNA, 25 bp, Homo sapien
acagggagctctgcgaattggcgcc

SEQ ID NO: 145671 - DNA, 25 bp, Homo sapien
ccggcggtggactcgtcggagccgc

SEQ ID NO: 145672 - DNA, 25 bp, Homo sapien
agtcgtgggccgtggctcagcggcc

SEQ ID NO: 145673 - DNA, 25 bp, Homo sapien
atgaacggaagctctcccgcgcctg

SEQ ID NO: 145674 - DNA, 25 bp, Homo sapien
cacagatgggatgtagtggatctca

SEQ ID NO: 145675 - DNA, 25 bp, Homo sapien
tctcatgagtggcttctgtgcttgc

SEQ ID NO: 145676 - DNA, 25 bp, Homo sapien
atgcggcgacgcttctgccaacgtc

SEQ ID NO: 145677 - DNA, 25 bp, Homo sapien
ctgccaacgtcgctgggcgtacagc

SEQ ID NO: 145678 - DNA, 25 bp, Homo sapien
ggcgtacagcgccacggtgaacacc

SEQ ID NO: 145679 - DNA, 25 bp, Homo sapien
gatgggcacgccaatgacggaattg

SEQ ID NO: 145680 - DNA, 25 bp, Homo sapien
atgacggaattgtgggtttgcagcc

SEQ ID NO: 145681 - DNA, 25 bp, Homo sapien
ggaggctcgacctgaaactggctta

SEQ ID NO: 145682 - DNA, 25 bp, Homo sapien
agctgctggcgaacttttctgatta

SEQ ID NO: 145683 - DNA, 25 bp, Homo sapien
gctgcaaggacaaaccggctctctg

SEQ ID NO: 145684 - DNA, 25 bp, Homo sapien
ttttgcgggttgagcgattccacac

SEQ ID NO: 145685 - DNA, 25 bp, Homo sapien
aactggcttaggatctgggatgctc

SEQ ID NO: 145686 - DNA, 25 bp, Homo sapien
ttccgggatggatcaagcagagctc

SEQ ID NO: 145687 - DNA, 25 bp, Homo sapien
cccggcagctcgttacgcacaaaga

SEQ ID NO: 145688 - DNA, 25 bp, Homo sapien
cctcggagtcggaatcccagttctc

SEQ ID NO: 145689 - DNA, 25 bp, Homo sapien
agaaccaggcgcctcccagttgctt

SEQ ID NO: 145690 - DNA, 25 bp, Homo sapien
caggagggacgcgtcgacgcccatc

SEQ ID NO: 145691 - DNA, 25 bp, Homo sapien
ttaaccacgggaatcaccgccaggc

SEQ ID NO: 145692 - DNA, 25 bp, Homo sapien
tctcctgccttaaccacgggaatca

SEQ ID NO: 145693 - DNA, 25 bp, Homo sapien
ttcccgtgagcagcagaagccagtt

SEQ ID NO: 145694 - DNA, 25 bp, Homo sapien
gactggagatctgaacgctgcgtta

SEQ ID NO: 145695 - DNA, 25 bp, Homo sapien
gcgctgctgcgttttgactggagat

SEQ ID NO: 145696 - DNA, 25 bp, Homo sapien
agttgctttcgcctcccgcgttgtt

SEQ ID NO: 145697 - DNA, 25 bp, Homo sapien
cgcgcctgcgtttatgcgagaatga

SEQ ID NO: 145698 - DNA, 25 bp, Homo sapien
tatgcgagaatgaaaggccgacttt

SEQ ID NO: 145699 - DNA, 25 bp, Homo sapien
ctgactctgcactggagaagggaac

SEQ ID NO: 145700 - DNA, 25 bp, Homo sapien
tctcatcagcgccacggaggacgga

SEQ ID NO: 145701 - DNA, 25 bp, Homo sapien
agcccattgtacagctggcgcagcc

SEQ ID NO: 145702 - DNA, 25 bp, Homo sapien
gcgcagccgcgcaaatgacatctga

SEQ ID NO: 145703 - DNA, 25 bp, Homo sapien
aagccgccggctgctttcaaaaggg

SEQ ID NO: 145704 - DNA, 25 bp, Homo sapien
aggccgactttgtctgctgggtgtt

SEQ ID NO: 145705 - DNA, 25 bp, Homo sapien
cgagcatccaaagggaccgcgcata

SEQ ID NO: 145706 - DNA, 25 bp, Homo sapien
atcctggtgcccttaagcgtgactg

SEQ ID NO: 145707 - DNA, 25 bp, Homo sapien
gcgccgccttacctggagtcaatgt

SEQ ID NO: 145708 - DNA, 25 bp, Homo sapien
aggacgctttttattcggctcggtg

SEQ ID NO: 145709 - DNA, 25 bp, Homo sapien
gcagcctggctcatactcagccgta

SEQ ID NO: 145710 - DNA, 25 bp, Homo sapien
tggtcccgaggacaggcatgaatcc

SEQ ID NO: 145711 - DNA, 25 bp, Homo sapien
gcttccgaggagtgttttgtacatc

SEQ ID NO: 145712 - DNA, 25 bp, Homo sapien
tgtcgcgagtacctgagtgtttctg

SEQ ID NO: 145713 - DNA, 25 bp, Homo sapien
ggacagctcttcctcatggtagaca

SEQ ID NO: 145714 - DNA, 25 bp, Homo sapien
ctgttgcaggtaagaatcatcaggc

SEQ ID NO: 145715 - DNA, 25 bp, Homo sapien
ccacagtaataactgttgcaggtaa

SEQ ID NO: 145716 - DNA, 25 bp, Homo sapien
taggtaaacaccacagtaataactg

SEQ ID NO: 145717 - DNA, 25 bp, Homo sapien
taacaactaggtaaacaccacagta

SEQ ID NO: 145718 - DNA, 25 bp, Homo sapien
cctcatggtagacataatacaacta

SEQ ID NO: 145719 - DNA, 25 bp, Homo sapien
gctcttcctcatggtagacataata

SEQ ID NO: 145720 - DNA, 25 bp, Homo sapien
caggtaagaatcatcaggcggcgcc

SEQ ID NO: 145721 - DNA, 25 bp, Homo sapien
gcgccgctggaattcaaaccacaga

SEQ ID NO: 145722 - DNA, 25 bp, Homo sapien
cggcgcttcttcctacggaaacgag

SEQ ID NO: 145723 - DNA, 25 bp, Homo sapien
tcttgttcagactctggcggcgccg

SEQ ID NO: 145724 - DNA, 25 bp, Homo sapien
catcatggctacagaggtggcgaca

SEQ ID NO: 145725 - DNA, 25 bp, Homo sapien
tcttccaacaccaagtccatcatgg

SEQ ID NO: 145726 - DNA, 25 bp, Homo sapien
gggacggtgacgtcctcttccaaca

SEQ ID NO: 145727 - DNA, 25 bp, Homo sapien
gttagaacgaaatcccaccagctgg

SEQ ID NO: 145728 - DNA, 25 bp, Homo sapien
cgcacgcagtgaagccgaccggctg

SEQ ID NO: 145729 - DNA, 25 bp, Homo sapien
gttgcaatccgaccaaggaagcctc

SEQ ID NO: 145730 - DNA, 25 bp, Homo sapien
cagacgccgggcctagtcatctgct

SEQ ID NO: 145731 - DNA, 25 bp, Homo sapien
ggtcagtcatcttctcctcgttgca

SEQ ID NO: 145732 - DNA, 25 bp, Homo sapien
ccggctttgtctgcccaaagagtgg

SEQ ID NO: 145733 - DNA, 25 bp, Homo sapien
cgcgcctaaccaatgggaagccaca

SEQ ID NO: 145734 - DNA, 25 bp, Homo sapien
tcagccagtcggttggtcagtcatc

SEQ ID NO: 145735 - DNA, 25 bp, Homo sapien
ccgcggagcagacaaaggatgcgcc

SEQ ID NO: 145736 - DNA, 25 bp, Homo sapien
ccaatcagaggacgtccaggagagg

SEQ ID NO: 145737 - DNA, 25 bp, Homo sapien
agcggcttccggtgctgcctgcgtc

SEQ ID NO: 145738 - DNA, 25 bp, Homo sapien
gcggaagcggctgcacttccggtcc

SEQ ID NO: 145739 - DNA, 25 bp, Homo sapien
cggaatcgtgttccgcgcggcactg

SEQ ID NO: 145740 - DNA, 25 bp, Homo sapien
ccgggttcacagctactaggcacgc

SEQ ID NO: 145741 - DNA, 25 bp, Homo sapien
tactaggcacgctcggaccgccaga

SEQ ID NO: 145742 - DNA, 25 bp, Homo sapien
cgcctcgcatacagacccggacctg

SEQ ID NO: 145743 - DNA, 25 bp, Homo sapien
ccgcagcctcacaggggagcggctt

SEQ ID NO: 145744 - DNA, 25 bp, Homo sapien
tcccgggaagctgaacgcgtgccgc

SEQ ID NO: 145745 - DNA, 25 bp, Homo sapien
ggcattccgcgttatgtttcccatg

SEQ ID NO: 145746 - DNA, 25 bp, Homo sapien
ttcccatgcgggtttctgctttttg

SEQ ID NO: 145747 - DNA, 25 bp, Homo sapien
cgagacgccaaaggcattccgcgtt

SEQ ID NO: 145748 - DNA, 25 bp, Homo sapien
tggaagcgtagactgggttcaaccg

SEQ ID NO: 145749 - DNA, 25 bp, Homo sapien
ttctttagggcaaactctgcaacgg

SEQ ID NO: 145750 - DNA, 25 bp, Homo sapien
atggcacgtatttaacaaccttctt

SEQ ID NO: 145751 - DNA, 25 bp, Homo sapien
cggtcccgagaatggcacgtattta

SEQ ID NO: 145752 - DNA, 25 bp, Homo sapien
gtttctgctttttgatagcgaaccc

SEQ ID NO: 145753 - DNA, 25 bp, Homo sapien
acgactgcagccgttatggaggcca

SEQ ID NO: 145754 - DNA, 25 bp, Homo sapien
ctccttgtccctgagatggctatgg

SEQ ID NO: 145755 - DNA, 25 bp, Homo sapien
ccgtgtcaactgtagccagtggttg

SEQ ID NO: 145756 - DNA, 25 bp, Homo sapien
ggctccctcagtctggcgtcatcta

SEQ ID NO: 145757 - DNA, 25 bp, Homo sapien
tctaggtcgctgctcagggaaatgc

SEQ ID NO: 145758 - DNA, 25 bp, Homo sapien
gccagtaggcttacgtgtttaccgc

SEQ ID NO: 145759 - DNA, 25 bp, Homo sapien
tcacgggaagttaaacagcctcgtc

SEQ ID NO: 145760 - DNA, 25 bp, Homo sapien
gggcgctttcctgaacctcgcgaga

SEQ ID NO: 145761 - DNA, 25 bp, Homo sapien
caccaggtccgggtggaccacgcga

SEQ ID NO: 145762 - DNA, 25 bp, Homo sapien
ggcgatggcgcccttcttcagcgcg

SEQ ID NO: 145763 - DNA, 25 bp, Homo sapien
cgggctggtaggacagcaccatctt

SEQ ID NO: 145764 - DNA, 25 bp, Homo sapien
tggggcgagtcccactcgagctcct

SEQ ID NO: 145765 - DNA, 25 bp, Homo sapien
tagcattgctgctggttggtgcgat

SEQ ID NO: 145766 - DNA, 25 bp, Homo sapien
cccgccgcagtagcagtagcattgc

SEQ ID NO: 145767 - DNA, 25 bp, Homo sapien
gccaggctcgctccctatgggcggt

SEQ ID NO: 145768 - DNA, 25 bp, Homo sapien
ccctgctggcgattcttggagacct

SEQ ID NO: 145769 - DNA, 25 bp, Homo sapien
cgctcgcacacttgttgaggaaaca

SEQ ID NO: 145770 - DNA, 25 bp, Homo sapien
ccgcgaattattgacgtcccgctta

SEQ ID NO: 145771 - DNA, 25 bp, Homo sapien
cacttggagtctggccaccaggcgc

SEQ ID NO: 145772 - DNA, 25 bp, Homo sapien
agaactcaccgcgaggctgcgtgtc

SEQ ID NO: 145773 - DNA, 25 bp, Homo sapien
ggccgccaaagttcagggagatttc

SEQ ID NO: 145774 - DNA, 25 bp, Homo sapien
ggcgaggaagaacgacctgtcaccc

SEQ ID NO: 145775 - DNA, 25 bp, Homo sapien
gcgaaatgccaaacgcccgtctgtc

SEQ ID NO: 145776 - DNA, 25 bp, Homo sapien
ccgcagcctgacttcggacgtgagc

SEQ ID NO: 145777 - DNA, 25 bp, Homo sapien
ggaagccgatttggccaccgtttgc

SEQ ID NO: 145778 - DNA, 25 bp, Homo sapien
gtgtatttcaggcagtcgaggcata

SEQ ID NO: 145779 - DNA, 25 bp, Homo sapien
caagacccttttgtaggtgcggatc

SEQ ID NO: 145780 - DNA, 25 bp, Homo sapien
ccaagcaagtcagcgcaggtgtatt

SEQ ID NO: 145781 - DNA, 25 bp, Homo sapien
cagcgcagtggacattcaggagctc

SEQ ID NO: 145782 - DNA, 25 bp, Homo sapien
gtctcctgtggacccggaagattta

SEQ ID NO: 145783 - DNA, 25 bp, Homo sapien
gctcagcttagaaaccctgcctggg

SEQ ID NO: 145784 - DNA, 25 bp, Homo sapien
ctgccttgccctggtacagtgctga

SEQ ID NO: 145785 - DNA, 25 bp, Homo sapien
gcaagccctttttccacgacgcctc

SEQ ID NO: 145786 - DNA, 25 bp, Homo sapien
tggaatgcgagcgccgctcaatgcg

SEQ ID NO: 145787 - DNA, 25 bp, Homo sapien
cgtttggaatgcgagcgccgctcaa

SEQ ID NO: 145788 - DNA, 25 bp, Homo sapien
ctttggccgcgctcccgcgaaggcc

SEQ ID NO: 145789 - DNA, 25 bp, Homo sapien
cctcccacccgcctcgtctgctttg

SEQ ID NO: 145790 - DNA, 25 bp, Homo sapien
tttggaatgcgagcgccgctcaatg

SEQ ID NO: 145791 - DNA, 25 bp, Homo sapien
ctcgtctgctttggccgcgctcccg

SEQ ID NO: 145792 - DNA, 25 bp, Homo sapien
agccccgcgcgtttggaatgcgagc

SEQ ID NO: 145793 - DNA, 25 bp, Homo sapien
gctccatccacgaggagtctctctg

SEQ ID NO: 145794 - DNA, 25 bp, Homo sapien
ctcctggcatctggtgcagcacctg

SEQ ID NO: 145795 - DNA, 25 bp, Homo sapien
ccacgggcactgtgcgcccagttaa

SEQ ID NO: 145796 - DNA, 25 bp, Homo sapien
agcgatccctgtgaggggaaactga

SEQ ID NO: 145797 - DNA, 25 bp, Homo sapien
cgcccagttaactgacacgcgtgta

SEQ ID NO: 145798 - DNA, 25 bp, Homo sapien
ccacatatccagttgcgagggcagc

SEQ ID NO: 145799 - DNA, 25 bp, Homo sapien
gtggctccttatccgtctccttgac

SEQ ID NO: 145800 - DNA, 25 bp, Homo sapien
tgcccgcggaaagaggaatgagccc

SEQ ID NO: 145801 - DNA, 25 bp, Homo sapien
ccctgaggaaagagcccgaacttct

SEQ ID NO: 145802 - DNA, 25 bp, Homo sapien
gcgtcccttccaacagtaccggaga

SEQ ID NO: 145803 - DNA, 25 bp, Homo sapien
cagctttgtctcagcgaaggccaca

SEQ ID NO: 145804 - DNA, 25 bp, Homo sapien
ccctgagaagcgtgtccgtgtttca

SEQ ID NO: 145805 - DNA, 25 bp, Homo sapien
tcatagcgcgcaagcatcagaagtg

SEQ ID NO: 145806 - DNA, 25 bp, Homo sapien
ccctggagggaattcgctttagata

SEQ ID NO: 145807 - DNA, 25 bp, Homo sapien
tgcgtccgctttgaggttcatccga

SEQ ID NO: 145808 - DNA, 25 bp, Homo sapien
atcctagcgcgctggctgcaaaaga

SEQ ID NO: 145809 - DNA, 25 bp, Homo sapien
gcgaagagctgcctttgtactcaga

SEQ ID NO: 145810 - DNA, 25 bp, Homo sapien
tgtactcagagccagacgcggccta

SEQ ID NO: 145811 - DNA, 25 bp, Homo sapien
tgactgctcctgtgctccctcagta

SEQ ID NO: 145812 - DNA, 25 bp, Homo sapien
tgtgctccctcagtatcttcctcgg

SEQ ID NO: 145813 - DNA, 25 bp, Homo sapien
atcttcctcgggctggtccaagatg

SEQ ID NO: 145814 - DNA, 25 bp, Homo sapien
cgcaatgggccggaccacaaaagaa

SEQ ID NO: 145815 - DNA, 25 bp, Homo sapien
tatgcgcaagcgcagtcgcgtgtcc

SEQ ID NO: 145816 - DNA, 25 bp, Homo sapien
atcagccggccggacactacggaag

SEQ ID NO: 145817 - DNA, 25 bp, Homo sapien
tgtcgccaccatggctccgcaccgc

SEQ ID NO: 145818 - DNA, 25 bp, Homo sapien
cgtgcctgcgcccatttagtgtgca

SEQ ID NO: 145819 - DNA, 25 bp, Homo sapien
tgctttgcgcgctgtccctggcgct

SEQ ID NO: 145820 - DNA, 25 bp, Homo sapien
tgtctccaagatccgagacagatcc

SEQ ID NO: 145821 - DNA, 25 bp, Homo sapien
tgggaacccagatgtctccaagatc

SEQ ID NO: 145822 - DNA, 25 bp, Homo sapien
ccgccgtatgtcaggcctggtgctg

SEQ ID NO: 145823 - DNA, 25 bp, Homo sapien
tagcgcccgccgtatgtcaggcctg

SEQ ID NO: 145824 - DNA, 25 bp, Homo sapien
cgcccatttagtgtgcacacagcta

SEQ ID NO: 145825 - DNA, 25 bp, Homo sapien
cgccctcgtgagagttggccaatca

SEQ ID NO: 145826 - DNA, 25 bp, Homo sapien
aagaaaagtcgccttgccgggcaga

SEQ ID NO: 145827 - DNA, 25 bp, Homo sapien
agttccctctgcgtttcctagtccg

SEQ ID NO: 145828 - DNA, 25 bp, Homo sapien
cacgagatagtgcagccctggcatg

SEQ ID NO: 145829 - DNA, 25 bp, Homo sapien
ctcagtctgccaaacagggttcgtg

SEQ ID NO: 145830 - DNA, 25 bp, Homo sapien
agccagaggcacaagacccagattg

SEQ ID NO: 145831 - DNA, 25 bp, Homo sapien
tcgcagtcacttcccgctagttctg

SEQ ID NO: 145832 - DNA, 25 bp, Homo sapien
agccgcggctttgagatctcgccca

SEQ ID NO: 145833 - DNA, 25 bp, Homo sapien
tcgctcttgcgagagtcctgagctc

SEQ ID NO: 145834 - DNA, 25 bp, Homo sapien
agtggctgggcctcttttgccttct

SEQ ID NO: 145835 - DNA, 25 bp, Homo sapien
ggcgaagccctacgcgctctgatca

SEQ ID NO: 145836 - DNA, 25 bp, Homo sapien
ctgatccgcagaaccagggcgccga

SEQ ID NO: 145837 - DNA, 25 bp, Homo sapien
tgatccaccgtttgtttcccgagga

SEQ ID NO: 145838 - DNA, 25 bp, Homo sapien
cagagccttggagatctgatccacc

SEQ ID NO: 145839 - DNA, 25 bp, Homo sapien
aagagcgcgaatgtagacagcggca

SEQ ID NO: 145840 - DNA, 25 bp, Homo sapien
tttcccgaggaaggaagagcgcgaa

SEQ ID NO: 145841 - DNA, 25 bp, Homo sapien
agagcgcttgcacctggcgcgcctg

SEQ ID NO: 145842 - DNA, 25 bp, Homo sapien
ccgtcgccgtctcgcttagctcccg

SEQ ID NO: 145843 - DNA, 25 bp, Homo sapien
cgctgagggccgaaactcctgcaat

SEQ ID NO: 145844 - DNA, 25 bp, Homo sapien
agggccgaaactcctgcaatcgcgc

SEQ ID NO: 145845 - DNA, 25 bp, Homo sapien
gaccgcactctccagagcgcttgca

SEQ ID NO: 145846 - DNA, 25 bp, Homo sapien
tgcacactcaccgtcgccgctggct

SEQ ID NO: 145847 - DNA, 25 bp, Homo sapien
gccgcggacccaggcagaccgcact

SEQ ID NO: 145848 - DNA, 25 bp, Homo sapien
ccgggttccaaacagagcaggtgca

SEQ ID NO: 145849 - DNA, 25 bp, Homo sapien
agccttaccaggtggcatccggagc

SEQ ID NO: 145850 - DNA, 25 bp, Homo sapien
agctccggagcattcacgcggtggt

SEQ ID NO: 145851 - DNA, 25 bp, Homo sapien
cctccgtgggtagctccggagcatt

SEQ ID NO: 145852 - DNA, 25 bp, Homo sapien
ccggagtcaaatgggctcgtgtctc

SEQ ID NO: 145853 - DNA, 25 bp, Homo sapien
atccggagcgcacgctggcagccag

SEQ ID NO: 145854 - DNA, 25 bp, Homo sapien
ggacctgattgatttctttggcctc

SEQ ID NO: 145855 - DNA, 25 bp, Homo sapien
gcgtgtcttcgggacctgattgatt

SEQ ID NO: 145856 - DNA, 25 bp, Homo sapien
tggcagccagtcagtcgcctccgtg

SEQ ID NO: 145857 - DNA, 25 bp, Homo sapien
ccacgcagggcgcacataaaagttt

SEQ ID NO: 145858 - DNA, 25 bp, Homo sapien
agtaaagcaaagtcgcggcccactc

SEQ ID NO: 145859 - DNA, 25 bp, Homo sapien
ccgaaacggaagcagaggttatctc

SEQ ID NO: 145860 - DNA, 25 bp, Homo sapien
cctcagtgtgcctatctgggaaatg

SEQ ID NO: 145861 - DNA, 25 bp, Homo sapien
ggagctctcagcaaacccaccttta

SEQ ID NO: 145862 - DNA, 25 bp, Homo sapien
gtcgattgaccaaacaggtgcgccc

SEQ ID NO: 145863 - DNA, 25 bp, Homo sapien
cgaacacaggcatccgcgtagggct

SEQ ID NO: 145864 - DNA, 25 bp, Homo sapien
cgtaccctcatagcgccgaaacgga

SEQ ID NO: 145865 - DNA, 25 bp, Homo sapien
cggcgctccttcactgtgctgcagt

SEQ ID NO: 145866 - DNA, 25 bp, Homo sapien
tgctgcagtctacaccgaaccacgg

SEQ ID NO: 145867 - DNA, 25 bp, Homo sapien
ctccattcgctgctgtaacaagttg

SEQ ID NO: 145868 - DNA, 25 bp, Homo sapien
aaacagaggccggttccctgcggtg

SEQ ID NO: 145869 - DNA, 25 bp, Homo sapien
ttgttacagcgctgagcagagctgc

SEQ ID NO: 145870 - DNA, 25 bp, Homo sapien
gaaccgtcctggcaagcgaggaacc

SEQ ID NO: 145871 - DNA, 25 bp, Homo sapien
agcggaatgttctcctcggcgctcc

SEQ ID NO: 145872 - DNA, 25 bp, Homo sapien
aggacagcacacagaccaccaaggg

SEQ ID NO: 145873 - DNA, 25 bp, Homo sapien
ttctccaaggccgaccataacgacg

SEQ ID NO: 145874 - DNA, 25 bp, Homo sapien
cggggacacccactttgacgatgac

SEQ ID NO: 145875 - DNA, 25 bp, Homo sapien
gacatccagatcgacttctccaagg

SEQ ID NO: 145876 - DNA, 25 bp, Homo sapien
gtggcctgttctccgtgactcactc

SEQ ID NO: 145877 - DNA, 25 bp, Homo sapien
acgacacggtgcgtgcactcatgta

SEQ ID NO: 145878 - DNA, 25 bp, Homo sapien
gcactcatgtactacgccctcaagg

SEQ ID NO: 145879 - DNA, 25 bp, Homo sapien
gccctcaaggtctggagcgacattg

SEQ ID NO: 145880 - DNA, 25 bp, Homo sapien
ttgacgatgacgaggcctggacctt

SEQ ID NO: 145881 - DNA, 25 bp, Homo sapien
tgcgccctcaggtcgacggtcgaac

SEQ ID NO: 145882 - DNA, 25 bp, Homo sapien
caggaacggaccctaattgaaggtg

SEQ ID NO: 145883 - DNA, 25 bp, Homo sapien
ccgccgattccaggccgggatttct

SEQ ID NO: 145884 - DNA, 25 bp, Homo sapien
gaggtcctcctactactaccggctg

SEQ ID NO: 145885 - DNA, 25 bp, Homo sapien
ggatttctcccgcactgactttccg

SEQ ID NO: 145886 - DNA, 25 bp, Homo sapien
cgcacaagcaggtgtgcaccgtcta

SEQ ID NO: 145887 - DNA, 25 bp, Homo sapien
agtgagggtcgtttctcagcccagc

SEQ ID NO: 145888 - DNA, 25 bp, Homo sapien
tgggagccagaaccctcgggacgac

SEQ ID NO: 145889 - DNA, 25 bp, Homo sapien
ggcgtggattcctccaggtgggtgt

SEQ ID NO: 145890 - DNA, 25 bp, Homo sapien
acctcgcacggggaggacaagctcg

SEQ ID NO: 145891 - DNA, 25 bp, Homo sapien
aaggcgctttgtcaatccccgacgg

SEQ ID NO: 145892 - DNA, 25 bp, Homo sapien
gagcagcgacctcgcagcggaggaa

SEQ ID NO: 145893 - DNA, 25 bp, Homo sapien
ctcatcggtaccaccgagggctgga

SEQ ID NO: 145894 - DNA, 25 bp, Homo sapien
cacgcgcccgctctcatcggtacca

SEQ ID NO: 145895 - DNA, 25 bp, Homo sapien
ccggaatcggggtctaagtggccag

SEQ ID NO: 145896 - DNA, 25 bp, Homo sapien
gccagccggcgcctcagccgaccac

SEQ ID NO: 145897 - DNA, 25 bp, Homo sapien
ctgtgcctccctccggggttaggtg

SEQ ID NO: 145898 - DNA, 25 bp, Homo sapien
tcgcagggaagtcctgcctcgcctg

SEQ ID NO: 145899 - DNA, 25 bp, Homo sapien
ctgcctcgcctgtccgaggtgggca

SEQ ID NO: 145900 - DNA, 25 bp, Homo sapien
ggcctctgccgccaggacccatccc

SEQ ID NO: 145901 - DNA, 25 bp, Homo sapien
agatacaaaaggcattttcggccgg

SEQ ID NO: 145902 - DNA, 25 bp, Homo sapien
ccctgggtatcagatacaaaaggca

SEQ ID NO: 145903 - DNA, 25 bp, Homo sapien
tcgcctgtccgaggtgggcattgtt

SEQ ID NO: 145904 - DNA, 25 bp, Homo sapien
ggtatcagatacaaaaggcattttc

SEQ ID NO: 145905 - DNA, 25 bp, Homo sapien
cccagactcgcacgaaggtggggaa

SEQ ID NO: 145906 - DNA, 25 bp, Homo sapien
tagtccggaatgctctgggagcagc

SEQ ID NO: 145907 - DNA, 25 bp, Homo sapien
cccgacgttagtccggaatgctctg

SEQ ID NO: 145908 - DNA, 25 bp, Homo sapien
gcgcagcccgacgttagtccggaat

SEQ ID NO: 145909 - DNA, 25 bp, Homo sapien
agctggccgcggaatgtcacccgct

SEQ ID NO: 145910 - DNA, 25 bp, Homo sapien
ccaaactggaatgcgccgcgagagc

SEQ ID NO: 145911 - DNA, 25 bp, Homo sapien
cggtggggacccagactcgcacgaa

SEQ ID NO: 145912 - DNA, 25 bp, Homo sapien
ccagcgggccaaactggaatgcgcc

SEQ ID NO: 145913 - DNA, 25 bp, Homo sapien
cacctgtaccgggagaccgacaaga

SEQ ID NO: 145914 - DNA, 25 bp, Homo sapien
agctgtgcctggacgatgtgctcta

SEQ ID NO: 145915 - DNA, 25 bp, Homo sapien
gatgtgctctatgcccgcaccacgg

SEQ ID NO: 145916 - DNA, 25 bp, Homo sapien
accacgggcaagctcaagacggaca

SEQ ID NO: 145917 - DNA, 25 bp, Homo sapien
caagacggacaatgttttctggggc

SEQ ID NO: 145918 - DNA, 25 bp, Homo sapien
gcgagcacttcgagttccacaactt

SEQ ID NO: 145919 - DNA, 25 bp, Homo sapien
cgcaacagttacctgggcctggtga

SEQ ID NO: 145920 - DNA, 25 bp, Homo sapien
cctggacccatgatccgcatcaagg

SEQ ID NO: 145921 - DNA, 25 bp, Homo sapien
gcccacggtgccacggcagaacagt

SEQ ID NO: 145922 - DNA, 25 bp, Homo sapien
tgatcttcagatggccaacggtggc

SEQ ID NO: 145923 - DNA, 25 bp, Homo sapien
tgagctcacacagcaacagcgagga

SEQ ID NO: 145924 - DNA, 25 bp, Homo sapien
cttccagaaccctgtgtaccagatg

SEQ ID NO: 145925 - DNA, 25 bp, Homo sapien
ctgggaagtttcagcactgccgcgg

SEQ ID NO: 145926 - DNA, 25 bp, Homo sapien
ctggcacggcgacagatgtcactga

SEQ ID NO: 145927 - DNA, 25 bp, Homo sapien
agagcctctccatggtggacctcca

SEQ ID NO: 145928 - DNA, 25 bp, Homo sapien
ctcggaagccaacgagcctgatctt

SEQ ID NO: 145929 - DNA, 25 bp, Homo sapien
aggcgggaggaagcacctccttcac

SEQ ID NO: 145930 - DNA, 25 bp, Homo sapien
ccgccgcaagaggaacaggctgttc

SEQ ID NO: 145931 - DNA, 25 bp, Homo sapien
ctgttccagccgagatcatttcgga

SEQ ID NO: 145932 - DNA, 25 bp, Homo sapien
tttcggaaacgatgctgcggctagc

SEQ ID NO: 145933 - DNA, 25 bp, Homo sapien
cggcagggatgactacgcagaccct

SEQ ID NO: 145934 - DNA, 25 bp, Homo sapien
tacagggatccgaggcacgaaccag

SEQ ID NO: 145935 - DNA, 25 bp, Homo sapien
ctagcctgggaatggggatctgttt

SEQ ID NO: 145936 - DNA, 25 bp, Homo sapien
ggtgtcatggccatcccacgccaaa

SEQ ID NO: 145937 - DNA, 25 bp, Homo sapien
agacctctgaggtcgtcctgtccac

SEQ ID NO: 145938 - DNA, 25 bp, Homo sapien
ttccacttgagctggcggatgctga

SEQ ID NO: 145939 - DNA, 25 bp, Homo sapien
tgctgatcttcagggcatccaggga

SEQ ID NO: 145940 - DNA, 25 bp, Homo sapien
aggtcctggccttggagctgtccac

SEQ ID NO: 145941 - DNA, 25 bp, Homo sapien
tgccatgatcgctcaggctcgggtt

SEQ ID NO: 145942 - DNA, 25 bp, Homo sapien
cagtcaccgcatcgagacggggtcc

SEQ ID NO: 145943 - DNA, 25 bp, Homo sapien
cccagcgacctcataggcgaggctg

SEQ ID NO: 145944 - DNA, 25 bp, Homo sapien
ccatgttggaagagggcaaagagcc

SEQ ID NO: 145945 - DNA, 25 bp, Homo sapien
aaccgcggggttcgctacgcgcact

SEQ ID NO: 145946 - DNA, 25 bp, Homo sapien
accgctggccgtgttgaccctgcga

SEQ ID NO: 145947 - DNA, 25 bp, Homo sapien
cctgcgtgaccgctggccgtgttga

SEQ ID NO: 145948 - DNA, 25 bp, Homo sapien
tgtctcttccatgccgtcgccacag

SEQ ID NO: 145949 - DNA, 25 bp, Homo sapien
cggggttcgctacgcgcacttcgga

SEQ ID NO: 145950 - DNA, 25 bp, Homo sapien
gtttccaacagctacagcgcggagg

SEQ ID NO: 145951 - DNA, 25 bp, Homo sapien
aaccgcgtttccaacagctacagcg

SEQ ID NO: 145952 - DNA, 25 bp, Homo sapien
actctaaccggctgtctcttccatg

SEQ ID NO: 145953 - DNA, 25 bp, Homo sapien
cgaaatgaatatgcagcgcgggctg

SEQ ID NO: 145954 - DNA, 25 bp, Homo sapien
ccgccgcactataattttccaaaca

SEQ ID NO: 145955 - DNA, 25 bp, Homo sapien
gtcaatcacgcggagagggaacatc

SEQ ID NO: 145956 - DNA, 25 bp, Homo sapien
aacaattttgtttctcggcactcga

SEQ ID NO: 145957 - DNA, 25 bp, Homo sapien
tcagggccttattcattagcgcata

SEQ ID NO: 145958 - DNA, 25 bp, Homo sapien
acaggatcttgcaatcagggcctta

SEQ ID NO: 145959 - DNA, 25 bp, Homo sapien
tgcggaacctgggactaaatttggc

SEQ ID NO: 145960 - DNA, 25 bp, Homo sapien
gggcgcccgttcatctcgatgcaaa

SEQ ID NO: 145961 - DNA, 25 bp, Homo sapien
gcactcactttgacgcggtggccca

SEQ ID NO: 145962 - DNA, 25 bp, Homo sapien
ggggctccacacaaggatgcctgtc

SEQ ID NO: 145963 - DNA, 25 bp, Homo sapien
cgtctctcggtggacatgcaccttg

SEQ ID NO: 145964 - DNA, 25 bp, Homo sapien
acacgcttcttgtaggaccgaattc

SEQ ID NO: 145965 - DNA, 25 bp, Homo sapien
ctctaggcaaggataggggctccac

SEQ ID NO: 145966 - DNA, 25 bp, Homo sapien
tcccggttaaagctgcgaaggagcc

SEQ ID NO: 145967 - DNA, 25 bp, Homo sapien
aggcccagggtgctacaccagtctc

SEQ ID NO: 145968 - DNA, 25 bp, Homo sapien
agccacgtcgctgtgaacacgcttc

SEQ ID NO: 145969 - DNA, 25 bp, Homo sapien
gaacttttcagcctccagcggggtg

SEQ ID NO: 145970 - DNA, 25 bp, Homo sapien
caagaacttttcagcctccagcggg

SEQ ID NO: 145971 - DNA, 25 bp, Homo sapien
agcgagggagcgtgcgcaataccaa

SEQ ID NO: 145972 - DNA, 25 bp, Homo sapien
tgcccaaccacgagcgagggagcgt

SEQ ID NO: 145973 - DNA, 25 bp, Homo sapien
aggcgtattgccctgcccaaccacg

SEQ ID NO: 145974 - DNA, 25 bp, Homo sapien
cggcaacacgcaggcgtattgccct

SEQ ID NO: 145975 - DNA, 25 bp, Homo sapien
gcatccggcaacacgcaggcgtatt

SEQ ID NO: 145976 - DNA, 25 bp, Homo sapien
tttcgaccgccgagtgccacacggc

SEQ ID NO: 145977 - DNA, 25 bp, Homo sapien
ctcaatgtagccgtgcagggtgacc

SEQ ID NO: 145978 - DNA, 25 bp, Homo sapien
gtacctgcagctgttccgcggtgaa

SEQ ID NO: 145979 - DNA, 25 bp, Homo sapien
gtcctgcgcgaactgcgcctgcata

SEQ ID NO: 145980 - DNA, 25 bp, Homo sapien
ttgactgtcctgttccgagggcact

SEQ ID NO: 145981 - DNA, 25 bp, Homo sapien
cgcgcccggcagttttgaaaccaca

SEQ ID NO: 145982 - DNA, 25 bp, Homo sapien
gtgtgctttttatgacgcgcccggc

SEQ ID NO: 145983 - DNA, 25 bp, Homo sapien
cctcctggagaaggatggccacgtg

SEQ ID NO: 145984 - DNA, 25 bp, Homo sapien
gcgctgcggttacttactctcaatg

SEQ ID NO: 145985 - DNA, 25 bp, Homo sapien
tcccgaatcggctgcaggtcgagag

SEQ ID NO: 145986 - DNA, 25 bp, Homo sapien
ggcggccctcttgaggttctcaatc

SEQ ID NO: 145987 - DNA, 25 bp, Homo sapien
ttctcaatcatggtgtcgtagtgga

SEQ ID NO: 145988 - DNA, 25 bp, Homo sapien
atgcggcagagcaccttctcctcga

SEQ ID NO: 145989 - DNA, 25 bp, Homo sapien
aggccgaactcctcaccagtggaca

SEQ ID NO: 145990 - DNA, 25 bp, Homo sapien
acagctggcgcttgcacgagaagca

SEQ ID NO: 145991 - DNA, 25 bp, Homo sapien
accgggcacacttggtcccgaatcg

SEQ ID NO: 145992 - DNA, 25 bp, Homo sapien
gcacccagtcgctggcgtagatctg

SEQ ID NO: 145993 - DNA, 25 bp, Homo sapien
atccggattgggagcactttctggc

SEQ ID NO: 145994 - DNA, 25 bp, Homo sapien
tacgaaatcgtcctcgcgccagatc

SEQ ID NO: 145995 - DNA, 25 bp, Homo sapien
gctcctcgtggctcagctcagttta

SEQ ID NO: 145996 - DNA, 25 bp, Homo sapien
tctcccgaaatgctggaagctgtcc

SEQ ID NO: 145997 - DNA, 25 bp, Homo sapien
aggcgccgctagtgaactctcagca

SEQ ID NO: 145998 - DNA, 25 bp, Homo sapien
ttggccagggacacgtcaaagactc

SEQ ID NO: 145999 - DNA, 25 bp, Homo sapien
tttgccggaaactccacagggtatg

SEQ ID NO: 146000 - DNA, 25 bp, Homo sapien
gggactctggcatccggttttcata

SEQ ID NO: 146001 - DNA, 25 bp, Homo sapien
gtcctaactttgtagtgggcattta

SEQ ID NO: 146002 - DNA, 25 bp, Homo sapien
caacttttaacacgcgcattctggg

SEQ ID NO: 146003 - DNA, 25 bp, Homo sapien
ctgggagcggttaaagccaacattc

SEQ ID NO: 146004 - DNA, 25 bp, Homo sapien
gggctcaggcagaccctaagtcttg

SEQ ID NO: 146005 - DNA, 25 bp, Homo sapien
tcccttcaagacagcgggtggtcgc

SEQ ID NO: 146006 - DNA, 25 bp, Homo sapien
ggcgccgaacaatgagtcctaactt

SEQ ID NO: 146007 - DNA, 25 bp, Homo sapien
ctgccttggagacaaatctggggcc

SEQ ID NO: 146008 - DNA, 25 bp, Homo sapien
cttgagcagatatcggtccaggatc

SEQ ID NO: 146009 - DNA, 25 bp, Homo sapien
tcctacaggcgaagggtcattactc

SEQ ID NO: 146010 - DNA, 25 bp, Homo sapien
tccttagtaacctgggcgatagctg

SEQ ID NO: 146011 - DNA, 25 bp, Homo sapien
ccgtcgcacgagtctttccttagta

SEQ ID NO: 146012 - DNA, 25 bp, Homo sapien
gcctcctggcttcgtgacgtcacga

SEQ ID NO: 146013 - DNA, 25 bp, Homo sapien
gtaagacctcttagcgggcccatcg

SEQ ID NO: 146014 - DNA, 25 bp, Homo sapien
ttatttccgggccagcgacaggaca

SEQ ID NO: 146015 - DNA, 25 bp, Homo sapien
cgatttctggctgcgaattcctaca

SEQ ID NO: 146016 - DNA, 25 bp, Homo sapien
gagggcggcctcctgtaagacctct

SEQ ID NO: 146017 - DNA, 25 bp, Homo sapien
cccgcgcggacataaaaggagaaag

SEQ ID NO: 146018 - DNA, 25 bp, Homo sapien
acgttggctactggaagccctctca

SEQ ID NO: 146019 - DNA, 25 bp, Homo sapien
ccctgagcctgggaaatgaacgttg

SEQ ID NO: 146020 - DNA, 25 bp, Homo sapien
gctttgaggcgcagattcgaatccc

SEQ ID NO: 146021 - DNA, 25 bp, Homo sapien
gaagcaacacgtggatgtcggcgca

SEQ ID NO: 146022 - DNA, 25 bp, Homo sapien
cacgcatgttacaaggggtgcgacc

SEQ ID NO: 146023 - DNA, 25 bp, Homo sapien
acttaggtgcatggcacagacacgc

SEQ ID NO: 146024 - DNA, 25 bp, Homo sapien
gcctgaatacatgacggccgcctgc

SEQ ID NO: 146025 - DNA, 25 bp, Homo sapien
acagagcgaagaaggggcagtttta

SEQ ID NO: 146026 - DNA, 25 bp, Homo sapien
ggaatggagcactttcttaagagga

SEQ ID NO: 146027 - DNA, 25 bp, Homo sapien
tagctcgctccggatccctttgggc

SEQ ID NO: 146028 - DNA, 25 bp, Homo sapien
aatgcagttacctgccctagctcgc

SEQ ID NO: 146029 - DNA, 25 bp, Homo sapien
ggcagttttacccaagctcgccaac

SEQ ID NO: 146030 - DNA, 25 bp, Homo sapien
cgccctgagcgctaaagagaaaagc

SEQ ID NO: 146031 - DNA, 25 bp, Homo sapien
agaaaagccgccgaagcccgacagc

SEQ ID NO: 146032 - DNA, 25 bp, Homo sapien
ttgcgctcctaaaggagggaccgct

SEQ ID NO: 146033 - DNA, 25 bp, Homo sapien
cccgggttccatccgagtgtcaggt

SEQ ID NO: 146034 - DNA, 25 bp, Homo sapien
gagccggtcgctccgcatcgaaaaa

SEQ ID NO: 146035 - DNA, 25 bp, Homo sapien
ttaacgcgagattacgcaagcccgg

SEQ ID NO: 146036 - DNA, 25 bp, Homo sapien
agggatcccgatctagctctcgcga

SEQ ID NO: 146037 - DNA, 25 bp, Homo sapien
tcggcggaggtttcacgacctcaaa

SEQ ID NO: 146038 - DNA, 25 bp, Homo sapien
cagtgtcgaaggaaggtggccattt

SEQ ID NO: 146039 - DNA, 25 bp, Homo sapien
aaccctcgaggcaccaggggcgaca

SEQ ID NO: 146040 - DNA, 25 bp, Homo sapien
tccatcgggagctacagggacagcc

SEQ ID NO: 146041 - DNA, 25 bp, Homo sapien
gccctcgaagagaaggagaagaccc

SEQ ID NO: 146042 - DNA, 25 bp, Homo sapien
tgcgacgcctctggtgtactaaatc

SEQ ID NO: 146043 - DNA, 25 bp, Homo sapien
tccgcccttctcaactggctgctgc

SEQ ID NO: 146044 - DNA, 25 bp, Homo sapien
tctggtgtactaaatctggagggga

SEQ ID NO: 146045 - DNA, 25 bp, Homo sapien
ttcattggaatcagcctccgccctt

SEQ ID NO: 146046 - DNA, 25 bp, Homo sapien
ctgccacttcattggaatcagcctc

SEQ ID NO: 146047 - DNA, 25 bp, Homo sapien
ctggctttttggagaggccgcctaa

SEQ ID NO: 146048 - DNA, 25 bp, Homo sapien
agcagccgttgctgcgacgcctctg

SEQ ID NO: 146049 - DNA, 25 bp, Homo sapien
aacgcacacgcacggcgccacgcta

SEQ ID NO: 146050 - DNA, 25 bp, Homo sapien
cgctaggtgctgaacgcacacgcac

SEQ ID NO: 146051 - DNA, 25 bp, Homo sapien
gccacgcgctaggtgctgaacgcac

SEQ ID NO: 146052 - DNA, 25 bp, Homo sapien
cacggcgccacgctaggggctgtac

SEQ ID NO: 146053 - DNA, 25 bp, Homo sapien
cacgctaggggctgtacgcacgcac

SEQ ID NO: 146054 - DNA, 25 bp, Homo sapien
ccacgcgctaggtgctgaacgcaca

SEQ ID NO: 146055 - DNA, 25 bp, Homo sapien
gcgctaggtgctgaacgcacacgca

SEQ ID NO: 146056 - DNA, 25 bp, Homo sapien
ccacgctaggggctgtacgcacgca

SEQ ID NO: 146057 - DNA, 25 bp, Homo sapien
agcggctcttctgtagctgggccta

SEQ ID NO: 146058 - DNA, 25 bp, Homo sapien
caatcggaaggctcggaggacaaca

SEQ ID NO: 146059 - DNA, 25 bp, Homo sapien
gtgccttagctcgtaagcgtctgtg

SEQ ID NO: 146060 - DNA, 25 bp, Homo sapien
tgggcactagcttcactgcctacta

SEQ ID NO: 146061 - DNA, 25 bp, Homo sapien
agacaacttccaggtcccatggtcc

SEQ ID NO: 146062 - DNA, 25 bp, Homo sapien
agccctggccggacaaagacaactt

SEQ ID NO: 146063 - DNA, 25 bp, Homo sapien
ggcaccgtactctgggcactagctt

SEQ ID NO: 146064 - DNA, 25 bp, Homo sapien
cccgagagggaatttctgcgttgtg

SEQ ID NO: 146065 - DNA, 25 bp, Homo sapien
aagctgtcttctcatcccgcggggt

SEQ ID NO: 146066 - DNA, 25 bp, Homo sapien
gctcgtcatggtcgcagacctatga

SEQ ID NO: 146067 - DNA, 25 bp, Homo sapien
cggggagccaagctgtcttctcatc

SEQ ID NO: 146068 - DNA, 25 bp, Homo sapien
tcgggccagtggagctgctctcagc

SEQ ID NO: 146069 - DNA, 25 bp, Homo sapien
ggccaatagggtcgctcgtcatggt

SEQ ID NO: 146070 - DNA, 25 bp, Homo sapien
gagaagaggaagctccgcctcgctt

SEQ ID NO: 146071 - DNA, 25 bp, Homo sapien
cgcttcccggtattgggccaatagg

SEQ ID NO: 146072 - DNA, 25 bp, Homo sapien
ggaagaagtcgctctcacgtgagta

SEQ ID NO: 146073 - DNA, 25 bp, Homo sapien
gcggccttatgcacctgccagcgga

SEQ ID NO: 146074 - DNA, 25 bp, Homo sapien
tgccagcggacgcttacgtaaactg

SEQ ID NO: 146075 - DNA, 25 bp, Homo sapien
agcggacgcttacgtaaactgcgtc

SEQ ID NO: 146076 - DNA, 25 bp, Homo sapien
cccgctcgctgcagcacctgagccc

SEQ ID NO: 146077 - DNA, 25 bp, Homo sapien
ggctagcgaaatgcacggaaacttc

SEQ ID NO: 146078 - DNA, 25 bp, Homo sapien
tgcacggaaacttcgtaacttccga

SEQ ID NO: 146079 - DNA, 25 bp, Homo sapien
taacttccgaacctgggagctgcgc

SEQ ID NO: 146080 - DNA, 25 bp, Homo sapien
tccgaacctgggagctgcgccgagc

SEQ ID NO: 146081 - DNA, 25 bp, Homo sapien
cccgagtgcataaccaggggaaagc

SEQ ID NO: 146082 - DNA, 25 bp, Homo sapien
atggcccaggacagcaccgagggac

SEQ ID NO: 146083 - DNA, 25 bp, Homo sapien
gacggcctcggtcacttctgtctca

SEQ ID NO: 146084 - DNA, 25 bp, Homo sapien
tgtaggaatgatactgcgcaccgca

SEQ ID NO: 146085 - DNA, 25 bp, Homo sapien
ccgagaaggattacatgtaggaatg

SEQ ID NO: 146086 - DNA, 25 bp, Homo sapien
agccatcgatggttccctattaccc

SEQ ID NO: 146087 - DNA, 25 bp, Homo sapien
tgtctcagctcagaagccatcgatg

SEQ ID NO: 146088 - DNA, 25 bp, Homo sapien
gcagctgcgtttctcaccactggct

SEQ ID NO: 146089 - DNA, 25 bp, Homo sapien
cgtgggctccttccgctgtgtgtgc

SEQ ID NO: 146090 - DNA, 25 bp, Homo sapien
tgcctcgagggcctcgggagcttcc

SEQ ID NO: 146091 - DNA, 25 bp, Homo sapien
gagcacaacgcgtcctgcctcgagg

SEQ ID NO: 146092 - DNA, 25 bp, Homo sapien
ggcaccggctacgagggcacgcact

SEQ ID NO: 146093 - DNA, 25 bp, Homo sapien
cacgacctggtcaacgggtgagcga

SEQ ID NO: 146094 - DNA, 25 bp, Homo sapien
gggcacgtgccacgacctggtcaac

SEQ ID NO: 146095 - DNA, 25 bp, Homo sapien
ctcgacgagtgccagagccagccgt

SEQ ID NO: 146096 - DNA, 25 bp, Homo sapien
cgttgccagctggacctcgacgagt

SEQ ID NO: 146097 - DNA, 25 bp, Homo sapien
cccgtgagacctgatgtccgcgtgt

SEQ ID NO: 146098 - DNA, 25 bp, Homo sapien
ggcgccttcagcttccgccatgctg

SEQ ID NO: 146099 - DNA, 25 bp, Homo sapien
acgaggacgagtgtgcatcgagccc

SEQ ID NO: 146100 - DNA, 25 bp, Homo sapien
tagcctggtcatagtgaagaggtgc

SEQ ID NO: 146101 - DNA, 25 bp, Homo sapien
tggccctcgctagcctggtcatagt

SEQ ID NO: 146102 - DNA, 25 bp, Homo sapien
gcttattccgagctgcggtcccttg

SEQ ID NO: 146103 - DNA, 25 bp, Homo sapien
cgccattcgtggcttattccgagct

SEQ ID NO: 146104 - DNA, 25 bp, Homo sapien
gggccgatgcctgcagcgctctgac

SEQ ID NO: 146105 - DNA, 25 bp, Homo sapien
tcctgctgcctgaggatctcggtga

SEQ ID NO: 146106 - DNA, 25 bp, Homo sapien
ggacgcgacctttgcaggctgcctc

SEQ ID NO: 146107 - DNA, 25 bp, Homo sapien
ctgcctccaggacgtgcgtgtggat

SEQ ID NO: 146108 - DNA, 25 bp, Homo sapien
cggtgagaacgtcctcctgggctgt

SEQ ID NO: 146109 - DNA, 25 bp, Homo sapien
ctgccttgtgtccacggagggtcct

SEQ ID NO: 146110 - DNA, 25 bp, Homo sapien
catttccgttgcgactgtgcccggc

SEQ ID NO: 146111 - DNA, 25 bp, Homo sapien
tgtggactcatttccgttgcgactg

SEQ ID NO: 146112 - DNA, 25 bp, Homo sapien
cctgtgtggatctgtggactcattt

SEQ ID NO: 146113 - DNA, 25 bp, Homo sapien
ctggctgagaacttcaccggctgct

SEQ ID NO: 146114 - DNA, 25 bp, Homo sapien
gtgcgcatcctgctggctgagaact

SEQ ID NO: 146115 - DNA, 25 bp, Homo sapien
gtgacctcttcgacgcctttgcctg

SEQ ID NO: 146116 - DNA, 25 bp, Homo sapien
acgacggtgcctgccgtgacctctt

SEQ ID NO: 146117 - DNA, 25 bp, Homo sapien
acttcgcgtcttggcctgggacgcc

SEQ ID NO: 146118 - DNA, 25 bp, Homo sapien
tggcgcccgagagcacttcgcgtct

SEQ ID NO: 146119 - DNA, 25 bp, Homo sapien
ttcagcgggcacaacgcgtcgtcag

SEQ ID NO: 146120 - DNA, 25 bp, Homo sapien
tgtcgctggcctttcgcacgcgcga

SEQ ID NO: 146121 - DNA, 25 bp, Homo sapien
gatcgcaccggcttattttttaatg

SEQ ID NO: 146122 - DNA, 25 bp, Homo sapien
ggaagatctgcatctcgggagtttt

SEQ ID NO: 146123 - DNA, 25 bp, Homo sapien
cgtcaggaagcagggacgtgctcca

SEQ ID NO: 146124 - DNA, 25 bp, Homo sapien
gtcacatcgcgtggacaaatcagca

SEQ ID NO: 146125 - DNA, 25 bp, Homo sapien
gcgtggagttcccatgcagatgact

SEQ ID NO: 146126 - DNA, 25 bp, Homo sapien
tctaatgtttggtttaacgtgtcgc

SEQ ID NO: 146127 - DNA, 25 bp, Homo sapien
caggcgaggctgttcctttttaaat

SEQ ID NO: 146128 - DNA, 25 bp, Homo sapien
ttaaataccatgtcagagacacggc

SEQ ID NO: 146129 - DNA, 25 bp, Homo sapien
ccaaggtaaggaagcgcctcggcgc

SEQ ID NO: 146130 - DNA, 25 bp, Homo sapien
cgctgccactgagccgggagcacgg

SEQ ID NO: 146131 - DNA, 25 bp, Homo sapien
gctgcggaggactcaccaaggtaag

SEQ ID NO: 146132 - DNA, 25 bp, Homo sapien
tgcggaggactcaccaaggtaagga

SEQ ID NO: 146133 - DNA, 25 bp, Homo sapien
cagagccggccacacccgctgcgga

SEQ ID NO: 146134 - DNA, 25 bp, Homo sapien
caccaaggtaaggaagcgcctcggc

SEQ ID NO: 146135 - DNA, 25 bp, Homo sapien
ctcaccaaggtaaggaagcgcctcg

SEQ ID NO: 146136 - DNA, 25 bp, Homo sapien
ggaggactcaccaaggtaaggaagc

SEQ ID NO: 146137 - DNA, 25 bp, Homo sapien
aggctgcgtcgcagtcttaaggccc

SEQ ID NO: 146138 - DNA, 25 bp, Homo sapien
taaaggcgactctccaagacccgct

SEQ ID NO: 146139 - DNA, 25 bp, Homo sapien
tccaagacccgctctctaaggtgct

SEQ ID NO: 146140 - DNA, 25 bp, Homo sapien
ccgtcaggctgcgtcgcagtcttaa

SEQ ID NO: 146141 - DNA, 25 bp, Homo sapien
cgccttttcagacagcttccgctgg

SEQ ID NO: 146142 - DNA, 25 bp, Homo sapien
ttttcagacagcttccgctgggcct

SEQ ID NO: 146143 - DNA, 25 bp, Homo sapien
cgtggccttttcgagcgctcctaaa

SEQ ID NO: 146144 - DNA, 25 bp, Homo sapien
tcgagcgctcctaaaggcgactctc

SEQ ID NO: 146145 - DNA, 25 bp, Homo sapien
cgggctttaattctggcgcttgcca

SEQ ID NO: 146146 - DNA, 25 bp, Homo sapien
ccgtcggagtttggcgcgctctgca

SEQ ID NO: 146147 - DNA, 25 bp, Homo sapien
cacggagcagcgagaaagttcgggc

SEQ ID NO: 146148 - DNA, 25 bp, Homo sapien
ctctgtccctcggatgcctctgggc

SEQ ID NO: 146149 - DNA, 25 bp, Homo sapien
tccgtggagttggatgttgcccttc

SEQ ID NO: 146150 - DNA, 25 bp, Homo sapien
gccggctccgcggtacaaagagcgc

SEQ ID NO: 146151 - DNA, 25 bp, Homo sapien
cagctgtcgcccaccgcgggtgaga

SEQ ID NO: 146152 - DNA, 25 bp, Homo sapien
ggaccctctctgaagcggctctccg

SEQ ID NO: 146153 - DNA, 25 bp, Homo sapien
ccggactcctgtccagggcttcagg

SEQ ID NO: 146154 - DNA, 25 bp, Homo sapien
tcacgcccatccaagtgctggcagg

SEQ ID NO: 146155 - DNA, 25 bp, Homo sapien
ctggcaggacgtgggtcctccatcc

SEQ ID NO: 146156 - DNA, 25 bp, Homo sapien
gctccagcggggacagacctaccaa

SEQ ID NO: 146157 - DNA, 25 bp, Homo sapien
tcggctgcctaagagcgccatattc

SEQ ID NO: 146158 - DNA, 25 bp, Homo sapien
agagctgcgggtcctatggtcccgc

SEQ ID NO: 146159 - DNA, 25 bp, Homo sapien
ggcaggccagcacagcatccatttc

SEQ ID NO: 146160 - DNA, 25 bp, Homo sapien
ggcctgagtgcagctactcgatttc

SEQ ID NO: 146161 - DNA, 25 bp, Homo sapien
ccagcctgacgcagagggatgaata

SEQ ID NO: 146162 - DNA, 25 bp, Homo sapien
ttccacgtttcttgagcagcccgcg

SEQ ID NO: 146163 - DNA, 25 bp, Homo sapien
ggaatcccgactgcctgtgtatctg

SEQ ID NO: 146164 - DNA, 25 bp, Homo sapien
ttgagccttttacagacggagcgcg

SEQ ID NO: 146165 - DNA, 25 bp, Homo sapien
gattagcaaagttacccgcctctgg

SEQ ID NO: 146166 - DNA, 25 bp, Homo sapien
tgcagcttctcgcaccgcgtaaatg

SEQ ID NO: 146167 - DNA, 25 bp, Homo sapien
agtggccagacctgaattccgttca

SEQ ID NO: 146168 - DNA, 25 bp, Homo sapien
cgacggaatcgcgtgcctatatgta

SEQ ID NO: 146169 - DNA, 25 bp, Homo sapien
gattacaggttcagtcccagcgaca

SEQ ID NO: 146170 - DNA, 25 bp, Homo sapien
caccttactgaagggcggcgagctg

SEQ ID NO: 146171 - DNA, 25 bp, Homo sapien
tgcctggcggcgtaattactgattt

SEQ ID NO: 146172 - DNA, 25 bp, Homo sapien
agcgacaagagctcgaaacccgatg

SEQ ID NO: 146173 - DNA, 25 bp, Homo sapien
ttcatgattttacgagctctttagc

SEQ ID NO: 146174 - DNA, 25 bp, Homo sapien
agctccattgaatcggcctaattga

SEQ ID NO: 146175 - DNA, 25 bp, Homo sapien
cccggatccgatcctggggaatctc

SEQ ID NO: 146176 - DNA, 25 bp, Homo sapien
cccgatgggttaataacagatcacg

SEQ ID NO: 146177 - DNA, 25 bp, Homo sapien
ccttgctgcgccttcttaggataga

SEQ ID NO: 146178 - DNA, 25 bp, Homo sapien
cacctagcggcttcagggtgaaccc

SEQ ID NO: 146179 - DNA, 25 bp, Homo sapien
ctcttcaattctcccggtggctcga

SEQ ID NO: 146180 - DNA, 25 bp, Homo sapien
cctttctgaagatatcgcaggaagc

SEQ ID NO: 146181 - DNA, 25 bp, Homo sapien
gagaccgcagtgagacgagcatccc

SEQ ID NO: 146182 - DNA, 25 bp, Homo sapien
aagctacacgctgggctgcagattg

SEQ ID NO: 146183 - DNA, 25 bp, Homo sapien
actcggctcgcaggcttcggagaaa

SEQ ID NO: 146184 - DNA, 25 bp, Homo sapien
cgcaggaagctgttcgtatcttaaa

SEQ ID NO: 146185 - DNA, 25 bp, Homo sapien
gtctactgccgcttgcacttcgagg

SEQ ID NO: 146186 - DNA, 25 bp, Homo sapien
ctttcctagggcttgcggagactct

SEQ ID NO: 146187 - DNA, 25 bp, Homo sapien
catggtccctacaggcgcttctctg

SEQ ID NO: 146188 - DNA, 25 bp, Homo sapien
cagcaatttggggagctcttggaaa

SEQ ID NO: 146189 - DNA, 25 bp, Homo sapien
gtgggtgcatttccaggtcttttga

SEQ ID NO: 146190 - DNA, 25 bp, Homo sapien
cgctcgggacttggtttatcacctc

SEQ ID NO: 146191 - DNA, 25 bp, Homo sapien
tgtaacaagatgctgaccacgggcg

SEQ ID NO: 146192 - DNA, 25 bp, Homo sapien
ccaggcctgggtcaaaatctagttc

SEQ ID NO: 146193 - DNA, 25 bp, Homo sapien
cctgagctcctggtggatggagaac

SEQ ID NO: 146194 - DNA, 25 bp, Homo sapien
tgccttcttggggttaggtcaagga

SEQ ID NO: 146195 - DNA, 25 bp, Homo sapien
tctgtttccttcgttgtttgccttc

SEQ ID NO: 146196 - DNA, 25 bp, Homo sapien
gaacgtgactacactggctggggta

SEQ ID NO: 146197 - DNA, 25 bp, Homo sapien
atggtctgttttgctttggagtccc

SEQ ID NO: 146198 - DNA, 25 bp, Homo sapien
tcggccaatgggatgccgatgcgcc

SEQ ID NO: 146199 - DNA, 25 bp, Homo sapien
gtagcaggtccctctcgtctgtttc

SEQ ID NO: 146200 - DNA, 25 bp, Homo sapien
cgcagctgccctgagaaagttcttg

SEQ ID NO: 146201 - DNA, 25 bp, Homo sapien
ttcctgggctccaaaactgggagtg

SEQ ID NO: 146202 - DNA, 25 bp, Homo sapien
gggtctctcacttcctcagcaggct

SEQ ID NO: 146203 - DNA, 25 bp, Homo sapien
actccggagagctgtttcgggctcc

SEQ ID NO: 146204 - DNA, 25 bp, Homo sapien
aaactgggagtgacgcttttgagcc

SEQ ID NO: 146205 - DNA, 25 bp, Homo sapien
cgcttttgagccctcacgtgtgccg

SEQ ID NO: 146206 - DNA, 25 bp, Homo sapien
acgtgtgccgcgtactgcattaggc

SEQ ID NO: 146207 - DNA, 25 bp, Homo sapien
tactgcattaggcagatggcagctc

SEQ ID NO: 146208 - DNA, 25 bp, Homo sapien
tctcacttcctcagcaggctgggtg

SEQ ID NO: 146209 - DNA, 25 bp, Homo sapien
ttccatcaacaaccgggcttacgta

SEQ ID NO: 146210 - DNA, 25 bp, Homo sapien
cacgcagcaggcattcatggagtgc

SEQ ID NO: 146211 - DNA, 25 bp, Homo sapien
gccttatctgataggggctgtgcca

SEQ ID NO: 146212 - DNA, 25 bp, Homo sapien
tgctgcttttgtttttccatcaaca

SEQ ID NO: 146213 - DNA, 25 bp, Homo sapien
ccgggaaacgcctgttgctgctttt

SEQ ID NO: 146214 - DNA, 25 bp, Homo sapien
tgagagctggtcttccaacacatgg

SEQ ID NO: 146215 - DNA, 25 bp, Homo sapien
tcattaactgcctcccgcttgctgg

SEQ ID NO: 146216 - DNA, 25 bp, Homo sapien
ggagaagggttaagaacaagcactc

SEQ ID NO: 146217 - DNA, 25 bp, Homo sapien
tgtgcgtgtgcaccccggagcgtct

SEQ ID NO: 146218 - DNA, 25 bp, Homo sapien
cccggagcgtctggtggcgttgttg

SEQ ID NO: 146219 - DNA, 25 bp, Homo sapien
gccgctgcgccgcaaactcgtgtgg

SEQ ID NO: 146220 - DNA, 25 bp, Homo sapien
aaactcgtgtgggacgcaccgctcc

SEQ ID NO: 146221 - DNA, 25 bp, Homo sapien
gcaaactcgtgtgggacgcaccgct

SEQ ID NO: 146222 - DNA, 25 bp, Homo sapien
gccgcaaactcgtgtgggacgcacc

SEQ ID NO: 146223 - DNA, 25 bp, Homo sapien
tgcgccgcaaactcgtgtgggacgc

SEQ ID NO: 146224 - DNA, 25 bp, Homo sapien
actcgtgtgggacgcaccgctccag

SEQ ID NO: 146225 - DNA, 25 bp, Homo sapien
atcttcccaagaaagcagttccggg

SEQ ID NO: 146226 - DNA, 25 bp, Homo sapien
gtggagcatacaccgacacagccgc

SEQ ID NO: 146227 - DNA, 25 bp, Homo sapien
agaagcctccaactggtggagcata

SEQ ID NO: 146228 - DNA, 25 bp, Homo sapien
cacctgcggcagttatcaaaagaga

SEQ ID NO: 146229 - DNA, 25 bp, Homo sapien
tcagaattctcgtatcacaccttgg

SEQ ID NO: 146230 - DNA, 25 bp, Homo sapien
tgagtcacactagccgcgggccaca

SEQ ID NO: 146231 - DNA, 25 bp, Homo sapien
gcttcaggagaaacccacgcccagg

SEQ ID NO: 146232 - DNA, 25 bp, Homo sapien
cgtgccttaggagacggagataaac

SEQ ID NO: 146233 - DNA, 25 bp, Homo sapien
cctcaacgagtgtttggagagcaag

SEQ ID NO: 146234 - DNA, 25 bp, Homo sapien
ggtgggcaaacttcgcatctccctc

SEQ ID NO: 146235 - DNA, 25 bp, Homo sapien
ccgcagatgcctcgcagacggtgaa

SEQ ID NO: 146236 - DNA, 25 bp, Homo sapien
gtgaacggccacaggcgccaggcca

SEQ ID NO: 146237 - DNA, 25 bp, Homo sapien
tcagaatccaaaacgcgggagcctc

SEQ ID NO: 146238 - DNA, 25 bp, Homo sapien
cgcgaatccaggcagacgtgaacga

SEQ ID NO: 146239 - DNA, 25 bp, Homo sapien
tccctctcgggcctcaacgagtgtt

SEQ ID NO: 146240 - DNA, 25 bp, Homo sapien
acgagggagtgcttttcagaatcca

SEQ ID NO: 146241 - DNA, 25 bp, Homo sapien
ggcgctacgatgaccacacgaggca

SEQ ID NO: 146242 - DNA, 25 bp, Homo sapien
tgggcccacaatgacaggacttatt

SEQ ID NO: 146243 - DNA, 25 bp, Homo sapien
aggaccagctgtactggcgctacga

SEQ ID NO: 146244 - DNA, 25 bp, Homo sapien
agcacgctggacgacgccatgcgct

SEQ ID NO: 146245 - DNA, 25 bp, Homo sapien
cccaccaggagaggggcatcactac

SEQ ID NO: 146246 - DNA, 25 bp, Homo sapien
gggcatcactacagggcagccaaga

SEQ ID NO: 146247 - DNA, 25 bp, Homo sapien
gcagccaagaggttccctgaaagga

SEQ ID NO: 146248 - DNA, 25 bp, Homo sapien
gacttatttctttaaggaccagctg

SEQ ID NO: 146249 - DNA, 25 bp, Homo sapien
accaccgccgtgctggtgttcgacg

SEQ ID NO: 146250 - DNA, 25 bp, Homo sapien
agcgctgaccgcgtgtactcacgtg

SEQ ID NO: 146251 - DNA, 25 bp, Homo sapien
tactcacgtgcagtgggactgtgcc

SEQ ID NO: 146252 - DNA, 25 bp, Homo sapien
tctgcctgagctggcagcgctgacc

SEQ ID NO: 146253 - DNA, 25 bp, Homo sapien
actctctgggcggtggcttctcggt

SEQ ID NO: 146254 - DNA, 25 bp, Homo sapien
gccgacggccgctggcaccatgtgt

SEQ ID NO: 146255 - DNA, 25 bp, Homo sapien
tgcccactgtgtgggtgcgccttct

SEQ ID NO: 146256 - DNA, 25 bp, Homo sapien
ctggcaccatgtgtgcgccacgtgg

SEQ ID NO: 146257 - DNA, 25 bp, Homo sapien
ggcggcgcctctgcgctcaagtgac

SEQ ID NO: 146258 - DNA, 25 bp, Homo sapien
tctccgctgaatgggtgcgttgcta

SEQ ID NO: 146259 - DNA, 25 bp, Homo sapien
agccctcagggcatgcggatgttcc

SEQ ID NO: 146260 - DNA, 25 bp, Homo sapien
tctgcgctcaagtgacggcgccttt

SEQ ID NO: 146261 - DNA, 25 bp, Homo sapien
ggccgctcgtagcaacagagcagct

SEQ ID NO: 146262 - DNA, 25 bp, Homo sapien
tgctagggccgctcgtagcaacaga

SEQ ID NO: 146263 - DNA, 25 bp, Homo sapien
gagaagctgagactcacagcgagga

SEQ ID NO: 146264 - DNA, 25 bp, Homo sapien
gacggcgcctttgtctccgctgaat

SEQ ID NO: 146265 - DNA, 25 bp, Homo sapien
tttccagagtatgagcttcccgagc

SEQ ID NO: 146266 - DNA, 25 bp, Homo sapien
atgtagtttctgatgccctgcccgc

SEQ ID NO: 146267 - DNA, 25 bp, Homo sapien
gtggcggctgcaactttccagagta

SEQ ID NO: 146268 - DNA, 25 bp, Homo sapien
ttccatcacgctctgcgaggccttg

SEQ ID NO: 146269 - DNA, 25 bp, Homo sapien
tcggagaacaatgctgcgccctgca

SEQ ID NO: 146270 - DNA, 25 bp, Homo sapien
gttgctacgtaactcggggaccaga

SEQ ID NO: 146271 - DNA, 25 bp, Homo sapien
ccctaccgggcagagacagttgcta

SEQ ID NO: 146272 - DNA, 25 bp, Homo sapien
tcccgagctaaatacgcgcgctttc

SEQ ID NO: 146273 - DNA, 25 bp, Homo sapien
caaatggcacccttatgcggaggca

SEQ ID NO: 146274 - DNA, 25 bp, Homo sapien
aagcttcgattaagtcctcggcaga

SEQ ID NO: 146275 - DNA, 25 bp, Homo sapien
cgccctcccgagacggctatttaga

SEQ ID NO: 146276 - DNA, 25 bp, Homo sapien
cacaagcactcgtggccaggctgtc

SEQ ID NO: 146277 - DNA, 25 bp, Homo sapien
ccagccgggcccatcttcataaata

SEQ ID NO: 146278 - DNA, 25 bp, Homo sapien
tgccgccgcctcaatggaagtcagg

SEQ ID NO: 146279 - DNA, 25 bp, Homo sapien
gggctgctattcaggccgccttttg

SEQ ID NO: 146280 - DNA, 25 bp, Homo sapien
tgccaggagagaggcactaatttta

SEQ ID NO: 146281 - DNA, 25 bp, Homo sapien
gttcgatgcgcttcgattgggattc

SEQ ID NO: 146282 - DNA, 25 bp, Homo sapien
agagcccgaaaacgcagagccgccg

SEQ ID NO: 146283 - DNA, 25 bp, Homo sapien
tagacgacagacagagacgccgaga

SEQ ID NO: 146284 - DNA, 25 bp, Homo sapien
gagccagagacacaacgatagacga

SEQ ID NO: 146285 - DNA, 25 bp, Homo sapien
ctgagacgcccagctagagagaacc

SEQ ID NO: 146286 - DNA, 25 bp, Homo sapien
tctggcgagagacaacgaccgacgc

SEQ ID NO: 146287 - DNA, 25 bp, Homo sapien
attgggattcgtttgtctgagaaca

SEQ ID NO: 146288 - DNA, 25 bp, Homo sapien
tctgggaacccgacagagacgaagg

SEQ ID NO: 146289 - DNA, 25 bp, Homo sapien
ggggctcgtagtattcaaggaagaa

SEQ ID NO: 146290 - DNA, 25 bp, Homo sapien
ctctagaaagctgagcggtacaagg

SEQ ID NO: 146291 - DNA, 25 bp, Homo sapien
tcccggatcgggacaagaaagagga

SEQ ID NO: 146292 - DNA, 25 bp, Homo sapien
cctcggccagggaaagccgttgcct

SEQ ID NO: 146293 - DNA, 25 bp, Homo sapien
ttcaaggaagaacgctcgaggctgc

SEQ ID NO: 146294 - DNA, 25 bp, Homo sapien
agaggctctgcgttaagggaacccg

SEQ ID NO: 146295 - DNA, 25 bp, Homo sapien
gtggggacttccaacctgaggagcc

SEQ ID NO: 146296 - DNA, 25 bp, Homo sapien
gaggatccaccctgagcgagaccgg

SEQ ID NO: 146297 - DNA, 25 bp, Homo sapien
ggggaagctcctggcaactgttacc

SEQ ID NO: 146298 - DNA, 25 bp, Homo sapien
acgcgcgccgacagtaaggtacgca

SEQ ID NO: 146299 - DNA, 25 bp, Homo sapien
tccttctgccgctagtgctgctgct

SEQ ID NO: 146300 - DNA, 25 bp, Homo sapien
gggtcttctctacccgatgaacgca

SEQ ID NO: 146301 - DNA, 25 bp, Homo sapien
cgaacctgggacttctcagcactga

SEQ ID NO: 146302 - DNA, 25 bp, Homo sapien
tgttacccaacgactcccaggcttg

SEQ ID NO: 146303 - DNA, 25 bp, Homo sapien
tctcagcactgaagccgcaggggca

SEQ ID NO: 146304 - DNA, 25 bp, Homo sapien
gctgagagaccgaacctgggacttc

SEQ ID NO: 146305 - DNA, 25 bp, Homo sapien
gacattgactttgccgtggacgaga

SEQ ID NO: 146306 - DNA, 25 bp, Homo sapien
aggtgatcgtcctgagtcgcttgga

SEQ ID NO: 146307 - DNA, 25 bp, Homo sapien
tacgctttcgacacgcacacgggca

SEQ ID NO: 146308 - DNA, 25 bp, Homo sapien
gcggaactcctacgggaactgcttc

SEQ ID NO: 146309 - DNA, 25 bp, Homo sapien
cgtggacacgtacaaccagcaggaa

SEQ ID NO: 146310 - DNA, 25 bp, Homo sapien
tacgacctacggcagcgcttcgtgg

SEQ ID NO: 146311 - DNA, 25 bp, Homo sapien
ctgcccgacgtggtatatgaggaca

SEQ ID NO: 146312 - DNA, 25 bp, Homo sapien
cgcggacactcggacattgactttg

SEQ ID NO: 146313 - DNA, 25 bp, Homo sapien
agagtgaaattcttcggccagcacg

SEQ ID NO: 146314 - DNA, 25 bp, Homo sapien
gaactgcaagcggtctggcctgcct

SEQ ID NO: 146315 - DNA, 25 bp, Homo sapien
ctgcctgtcagtcctcgtggcttcg

SEQ ID NO: 146316 - DNA, 25 bp, Homo sapien
agtcctcgtggcttcgcagggaccc

SEQ ID NO: 146317 - DNA, 25 bp, Homo sapien
atggagaccgcctgtacacagtttc

SEQ ID NO: 146318 - DNA, 25 bp, Homo sapien
cgtgcggagagtgaaattcttcggc

SEQ ID NO: 146319 - DNA, 25 bp, Homo sapien
agtttcctctttcctctgcccagtc

SEQ ID NO: 146320 - DNA, 25 bp, Homo sapien
cccgcgcgagagctgccctagagtg

SEQ ID NO: 146321 - DNA, 25 bp, Homo sapien
ttgaaatcctccgacgatcccgatg

SEQ ID NO: 146322 - DNA, 25 bp, Homo sapien
tgacctccgcaactactgccgggtg

SEQ ID NO: 146323 - DNA, 25 bp, Homo sapien
agtgggcatctaagcggccagctcc

SEQ ID NO: 146324 - DNA, 25 bp, Homo sapien
ggccagctccttaagccaactttga

SEQ ID NO: 146325 - DNA, 25 bp, Homo sapien
ggccgcctcacttacatcttagaga

SEQ ID NO: 146326 - DNA, 25 bp, Homo sapien
ccgtgccttgggcagagtaacccag

SEQ ID NO: 146327 - DNA, 25 bp, Homo sapien
ggcagatagaatccgcgggctcagc

SEQ ID NO: 146328 - DNA, 25 bp, Homo sapien
cgccttgtagtgctcgcctcattca

SEQ ID NO: 146329 - DNA, 25 bp, Homo sapien
cagcgcgatcctcaacctggctccc

SEQ ID NO: 146330 - DNA, 25 bp, Homo sapien
ggctttcgaggctggatccctaccc

SEQ ID NO: 146331 - DNA, 25 bp, Homo sapien
gcaagttcgagttctcccgcaagga

SEQ ID NO: 146332 - DNA, 25 bp, Homo sapien
gttctcccgcaaggacctgatcggc

SEQ ID NO: 146333 - DNA, 25 bp, Homo sapien
gcacagagaccgtgggcaagttcga

SEQ ID NO: 146334 - DNA, 25 bp, Homo sapien
gccacggcgccttcgcggtggtctt

SEQ ID NO: 146335 - DNA, 25 bp, Homo sapien
tcccacagccggctttcgaggctgg

SEQ ID NO: 146336 - DNA, 25 bp, Homo sapien
cagcccgactttccagttcagactc

SEQ ID NO: 146337 - DNA, 25 bp, Homo sapien
gggcgcccgatcctcagtgacaaaa

SEQ ID NO: 146338 - DNA, 25 bp, Homo sapien
accagcgcagttacggcacacacga

SEQ ID NO: 146339 - DNA, 25 bp, Homo sapien
tagagactccgtggaagggacactg

SEQ ID NO: 146340 - DNA, 25 bp, Homo sapien
ggtgatcccataccgcactccaggt

SEQ ID NO: 146341 - DNA, 25 bp, Homo sapien
tggacgggctcctgcggcaatatcc

SEQ ID NO: 146342 - DNA, 25 bp, Homo sapien
ggcaatatccttccctgacgcggcg

SEQ ID NO: 146343 - DNA, 25 bp, Homo sapien
cctcccttgcaggaaatcgggccta

SEQ ID NO: 146344 - DNA, 25 bp, Homo sapien
cgcatctgagtaaccgagtgatcgg

SEQ ID NO: 146345 - DNA, 25 bp, Homo sapien
agttcgccacgtcagcgagcggcca

SEQ ID NO: 146346 - DNA, 25 bp, Homo sapien
tgttaccacctctgagcggcgactg

SEQ ID NO: 146347 - DNA, 25 bp, Homo sapien
ggcggctactgttaccacctctgag

SEQ ID NO: 146348 - DNA, 25 bp, Homo sapien
cggccttggcggctactgttaccac

SEQ ID NO: 146349 - DNA, 25 bp, Homo sapien
tgatgactgagtctccgaggcctct

SEQ ID NO: 146350 - DNA, 25 bp, Homo sapien
cgaggcctctcggtctttttctatt

SEQ ID NO: 146351 - DNA, 25 bp, Homo sapien
tttctattttaacaggggcgcgtgc

SEQ ID NO: 146352 - DNA, 25 bp, Homo sapien
gcggccagagccacagatgatgact

SEQ ID NO: 146353 - DNA, 25 bp, Homo sapien
tctgtcagtcgattggacgctcggc

SEQ ID NO: 146354 - DNA, 25 bp, Homo sapien
gggctcctctgaccatccggctcct

SEQ ID NO: 146355 - DNA, 25 bp, Homo sapien
cgattggacgctcggcccgtcacat

SEQ ID NO: 146356 - DNA, 25 bp, Homo sapien
gtggacggaaatctgtcagtcgatt

SEQ ID NO: 146357 - DNA, 25 bp, Homo sapien
cagtagtgtggacggaaatctgtca

SEQ ID NO: 146358 - DNA, 25 bp, Homo sapien
gctcccattggctagagcagtagtg

SEQ ID NO: 146359 - DNA, 25 bp, Homo sapien
tcggctcccattggctagagcagta

SEQ ID NO: 146360 - DNA, 25 bp, Homo sapien
cgcgcctctgccaggcttgccgcgg

SEQ ID NO: 146361 - DNA, 25 bp, Homo sapien
gggcgcgaccaactgtttaccgaga

SEQ ID NO: 146362 - DNA, 25 bp, Homo sapien
gggcgaaaatagctcggcctgccgc

SEQ ID NO: 146363 - DNA, 25 bp, Homo sapien
cccaagttcgctttcatgtaacagg

SEQ ID NO: 146364 - DNA, 25 bp, Homo sapien
gatgttgcagcacccggcgaagctg

SEQ ID NO: 146365 - DNA, 25 bp, Homo sapien
cgtctcaacggctcggaatcgcaac

SEQ ID NO: 146366 - DNA, 25 bp, Homo sapien
cgaagagacgccaccacctgaagca

SEQ ID NO: 146367 - DNA, 25 bp, Homo sapien
acgcgcctgctagggagagcaccga

SEQ ID NO: 146368 - DNA, 25 bp, Homo sapien
gctccgaagcggattttctggaaac

SEQ ID NO: 146369 - DNA, 25 bp, Homo sapien
accgcgactggactggatacccggc

SEQ ID NO: 146370 - DNA, 25 bp, Homo sapien
ttttaagaataacaagccgcggcaa

SEQ ID NO: 146371 - DNA, 25 bp, Homo sapien
caaccgggacagcattcgacgactc

SEQ ID NO: 146372 - DNA, 25 bp, Homo sapien
taaacacactgaggccgcgttccgg

SEQ ID NO: 146373 - DNA, 25 bp, Homo sapien
ccttcaggtcgttctctggcaggta

SEQ ID NO: 146374 - DNA, 25 bp, Homo sapien
ggagccgagccttctaaataaagct

SEQ ID NO: 146375 - DNA, 25 bp, Homo sapien
tccacatacttgtccaggtctagcg

SEQ ID NO: 146376 - DNA, 25 bp, Homo sapien
ggtacttgcacagccgcgctatttc

SEQ ID NO: 146377 - DNA, 25 bp, Homo sapien
tcacggctcgcgactggcctaagtc

SEQ ID NO: 146378 - DNA, 25 bp, Homo sapien
ccgaacccggcattgcgcaaatcgt

SEQ ID NO: 146379 - DNA, 25 bp, Homo sapien
cacttggttcccgagaaatgcagag

SEQ ID NO: 146380 - DNA, 25 bp, Homo sapien
taagtcgccgcaggtattgcagtcc

SEQ ID NO: 146381 - DNA, 25 bp, Homo sapien
accgggtctatcacggtctcgggca

SEQ ID NO: 146382 - DNA, 25 bp, Homo sapien
tcgggcagggagtctgaatctttta

SEQ ID NO: 146383 - DNA, 25 bp, Homo sapien
gccactttgaccgaatcagcctgtt

SEQ ID NO: 146384 - DNA, 25 bp, Homo sapien
tgcgcaaatcgtttccaagtagccc

SEQ ID NO: 146385 - DNA, 25 bp, Homo sapien
tggcggcatcgccaatcagacgttc

SEQ ID NO: 146386 - DNA, 25 bp, Homo sapien
cagagggacatcagcaccgcacttc

SEQ ID NO: 146387 - DNA, 25 bp, Homo sapien
gtctagaaatacaggccgcggcgct

SEQ ID NO: 146388 - DNA, 25 bp, Homo sapien
ccaataggtcaatctgtctgtgctg

SEQ ID NO: 146389 - DNA, 25 bp, Homo sapien
caccgtcgcctactcggcttatata

SEQ ID NO: 146390 - DNA, 25 bp, Homo sapien
aggcatttccgctggtaaccgcaca

SEQ ID NO: 146391 - DNA, 25 bp, Homo sapien
ctgcacagacgggtcattccacgtg

SEQ ID NO: 146392 - DNA, 25 bp, Homo sapien
gtcccattggttcagcagctgtcta

SEQ ID NO: 146393 - DNA, 25 bp, Homo sapien
cagtcaccggctagggcgacggctc

SEQ ID NO: 146394 - DNA, 25 bp, Homo sapien
tcttcccgtcagtgtcgggcgaggt

SEQ ID NO: 146395 - DNA, 25 bp, Homo sapien
ggtcctgggctcttcccgtcagtgt

SEQ ID NO: 146396 - DNA, 25 bp, Homo sapien
tgcccggccgtcaggtccaactgac

SEQ ID NO: 146397 - DNA, 25 bp, Homo sapien
tcccgatttagtccgcgggctgtga

SEQ ID NO: 146398 - DNA, 25 bp, Homo sapien
tggtgagtacgcgtcccgatttagt

SEQ ID NO: 146399 - DNA, 25 bp, Homo sapien
ggtccgacagagtcctccgtgtcct

SEQ ID NO: 146400 - DNA, 25 bp, Homo sapien
ccgagtggcggtccgacagagtcct

SEQ ID NO: 146401 - DNA, 25 bp, Homo sapien
ctgcgaaggctccagaaacgggtcc

SEQ ID NO: 146402 - DNA, 25 bp, Homo sapien
cttccacgaggaccgagtccgaggc

SEQ ID NO: 146403 - DNA, 25 bp, Homo sapien
ggccgggaatctagctacggaatcc

SEQ ID NO: 146404 - DNA, 25 bp, Homo sapien
ctgcagttgggtttccgtcgcccag

SEQ ID NO: 146405 - DNA, 25 bp, Homo sapien
tgtttttagggcacccaggttcaca

SEQ ID NO: 146406 - DNA, 25 bp, Homo sapien
gccttggctgggaaatgtcaccctc

SEQ ID NO: 146407 - DNA, 25 bp, Homo sapien
ccgcggagatcccaggtgtttttag

SEQ ID NO: 146408 - DNA, 25 bp, Homo sapien
cgggctcaggagataccgcctggac

SEQ ID NO: 146409 - DNA, 25 bp, Homo sapien
cccgaccgggaaggagcctctggct

SEQ ID NO: 146410 - DNA, 25 bp, Homo sapien
gacgtagtgcgcaagccccagagct

SEQ ID NO: 146411 - DNA, 25 bp, Homo sapien
gcttcccgggttagccctcatgccc

SEQ ID NO: 146412 - DNA, 25 bp, Homo sapien
ggatccacggggaccggcgctcctc

SEQ ID NO: 146413 - DNA, 25 bp, Homo sapien
aagcaaggagcggtagcttcccgcg

SEQ ID NO: 146414 - DNA, 25 bp, Homo sapien
cccagagctgaaagcaaggagcggt

SEQ ID NO: 146415 - DNA, 25 bp, Homo sapien
ctgaaagcaaggagcggtagcttcc

SEQ ID NO: 146416 - DNA, 25 bp, Homo sapien
gagctctgcactctcgggatccacg

SEQ ID NO: 146417 - DNA, 25 bp, Homo sapien
ctggctttcgtgctgcctccgtgtc

SEQ ID NO: 146418 - DNA, 25 bp, Homo sapien
gaccagctggctttcgtgctgcctc

SEQ ID NO: 146419 - DNA, 25 bp, Homo sapien
actcctgctcgctggcagtcagggc

SEQ ID NO: 146420 - DNA, 25 bp, Homo sapien
ggagactcctgctcgctggcagtca

SEQ ID NO: 146421 - DNA, 25 bp, Homo sapien
tttgttgacattgctcctgcggccg

SEQ ID NO: 146422 - DNA, 25 bp, Homo sapien
tggccaaggagatgacctcgggccc

SEQ ID NO: 146423 - DNA, 25 bp, Homo sapien
ctaggccgtgtgtttgttgacattg

SEQ ID NO: 146424 - DNA, 25 bp, Homo sapien
ctggcccacctgtctaggccgtgtg

SEQ ID NO: 146425 - DNA, 25 bp, Homo sapien
tctcattaagcatcttttgtgtgtg

SEQ ID NO: 146426 - DNA, 25 bp, Homo sapien
gcgcaagcaaagttggtgtcgtctc

SEQ ID NO: 146427 - DNA, 25 bp, Homo sapien
ccagagcttggacgaggcgcaagca

SEQ ID NO: 146428 - DNA, 25 bp, Homo sapien
gtgaacctggctggccactcggtgc

SEQ ID NO: 146429 - DNA, 25 bp, Homo sapien
agttggtgtcgtctcattaagcatc

SEQ ID NO: 146430 - DNA, 25 bp, Homo sapien
tcaatccaggatgctgcagactctg

SEQ ID NO: 146431 - DNA, 25 bp, Homo sapien
cgcggcgggatggacgatcaatcca

SEQ ID NO: 146432 - DNA, 25 bp, Homo sapien
caggaagcaggacatcggcgacatc

SEQ ID NO: 146433 - DNA, 25 bp, Homo sapien
cgcaggcggtgataatggatcacgt

SEQ ID NO: 146434 - DNA, 25 bp, Homo sapien
gcttggtgactctccggactccagc

SEQ ID NO: 146435 - DNA, 25 bp, Homo sapien
ctgtccttgcttggtgactctccgg

SEQ ID NO: 146436 - DNA, 25 bp, Homo sapien
ggttcctgtccttgcttggtgactc

SEQ ID NO: 146437 - DNA, 25 bp, Homo sapien
gcctgtgctgagtcaggttcctgtc

SEQ ID NO: 146438 - DNA, 25 bp, Homo sapien
tgggcggtgtccgtccagccccgat

SEQ ID NO: 146439 - DNA, 25 bp, Homo sapien
gaggataatggatgggtgcccagcg

SEQ ID NO: 146440 - DNA, 25 bp, Homo sapien
cggtgataatggatcacgttttggc

SEQ ID NO: 146441 - DNA, 25 bp, Homo sapien
ggtgtaggaggcgtggccgcagccc

SEQ ID NO: 146442 - DNA, 25 bp, Homo sapien
tgtaggaggcgtggccgcagcccca

SEQ ID NO: 146443 - DNA, 25 bp, Homo sapien
aaggggtgtaggaggcgtggccgca

SEQ ID NO: 146444 - DNA, 25 bp, Homo sapien
cagaaggggtgtaggaggcgtggcc

SEQ ID NO: 146445 - DNA, 25 bp, Homo sapien
ccagaaggggtgtaggaggcgtggc

SEQ ID NO: 146446 - DNA, 25 bp, Homo sapien
gcccagaaggggtgtaggaggcgtg

SEQ ID NO: 146447 - DNA, 25 bp, Homo sapien
cagggcccagaaggggtgtaggagg

SEQ ID NO: 146448 - DNA, 25 bp, Homo sapien
gcagggcccagaaggggtgtaggag

SEQ ID NO: 146449 - DNA, 25 bp, Homo sapien
cctaaatcacgcagccgcatgaata

SEQ ID NO: 146450 - DNA, 25 bp, Homo sapien
cacgcagccgcatgaataataaata

SEQ ID NO: 146451 - DNA, 25 bp, Homo sapien
ataataaataaggaccgctcggatc

SEQ ID NO: 146452 - DNA, 25 bp, Homo sapien
aggaccgctcggatccttaacagta

SEQ ID NO: 146453 - DNA, 25 bp, Homo sapien
tcggatccttaacagtagtcgcatg

SEQ ID NO: 146454 - DNA, 25 bp, Homo sapien
acagtagtcgcatgtcttattaaac

SEQ ID NO: 146455 - DNA, 25 bp, Homo sapien
tattctccctgtggttggaggtcgg

SEQ ID NO: 146456 - DNA, 25 bp, Homo sapien
caaacttttattctccctgtggttg

SEQ ID NO: 146457 - DNA, 25 bp, Homo sapien
caaccgtgtccgtgagagggcccag

SEQ ID NO: 146458 - DNA, 25 bp, Homo sapien
actctgtcctgtggaaggcgccgca

SEQ ID NO: 146459 - DNA, 25 bp, Homo sapien
ccaggggttagcgtggaaactctgt

SEQ ID NO: 146460 - DNA, 25 bp, Homo sapien
cgtggaaactctgtcctgtggaagg

SEQ ID NO: 146461 - DNA, 25 bp, Homo sapien
ccctaagcagagcacccaggggtta

SEQ ID NO: 146462 - DNA, 25 bp, Homo sapien
cagggctggaacacagtgcggcgca

SEQ ID NO: 146463 - DNA, 25 bp, Homo sapien
cttaaaccaaccgtgtccgtgagag

SEQ ID NO: 146464 - DNA, 25 bp, Homo sapien
gtctcgcccgggaaccctaagcaga

SEQ ID NO: 146465 - DNA, 25 bp, Homo sapien
gggcagtcggcacagatcttggctt

SEQ ID NO: 146466 - DNA, 25 bp, Homo sapien
taattttttgtattaatcccagcta

SEQ ID NO: 146467 - DNA, 25 bp, Homo sapien
agtcggcacagatcttggcttactg

SEQ ID NO: 146468 - DNA, 25 bp, Homo sapien
cagtcggcacagatcttggcttact

SEQ ID NO: 146469 - DNA, 25 bp, Homo sapien
ggcagtcggcacagatcttggctta

SEQ ID NO: 146470 - DNA, 25 bp, Homo sapien
agggcagtcggcacagatcttggct

SEQ ID NO: 146471 - DNA, 25 bp, Homo sapien
gcagtcggcacagatcttggcttac

SEQ ID NO: 146472 - DNA, 25 bp, Homo sapien
cagtcgccttcggattgtgcgggaa

SEQ ID NO: 146473 - DNA, 25 bp, Homo sapien
aaggggccctaatgaagatctgtgc

SEQ ID NO: 146474 - DNA, 25 bp, Homo sapien
tctggttgacaaggcgccagtcgcc

SEQ ID NO: 146475 - DNA, 25 bp, Homo sapien
tacagagacaaacgggttcggctcc

SEQ ID NO: 146476 - DNA, 25 bp, Homo sapien
tgacatgaattaacgccggcacctg

SEQ ID NO: 146477 - DNA, 25 bp, Homo sapien
tcataccacgcaggatggaggcgca

SEQ ID NO: 146478 - DNA, 25 bp, Homo sapien
gtctttattacgaaattggcgccta

SEQ ID NO: 146479 - DNA, 25 bp, Homo sapien
attggcgcctagttttcataccacg

SEQ ID NO: 146480 - DNA, 25 bp, Homo sapien
agggtccctggaaaagaccagcctg

SEQ ID NO: 146481 - DNA, 25 bp, Homo sapien
gtacagcgaggcctacgagagctaa

SEQ ID NO: 146482 - DNA, 25 bp, Homo sapien
ggaagaccggtcttgcgtacagcga

SEQ ID NO: 146483 - DNA, 25 bp, Homo sapien
gtcttgcgtacagcgaggcctacga

SEQ ID NO: 146484 - DNA, 25 bp, Homo sapien
gggaccatcgatgccccaggctcta

SEQ ID NO: 146485 - DNA, 25 bp, Homo sapien
gatgccccaggctctagaggccgtg

SEQ ID NO: 146486 - DNA, 25 bp, Homo sapien
ctgagggtccctggaaaagaccagc

SEQ ID NO: 146487 - DNA, 25 bp, Homo sapien
cagcgaggcctacgagagctaagtg

SEQ ID NO: 146488 - DNA, 25 bp, Homo sapien
agaacggctggcgttggagatgctc

SEQ ID NO: 146489 - DNA, 25 bp, Homo sapien
gtccatatttcacaaaggccgcctc

SEQ ID NO: 146490 - DNA, 25 bp, Homo sapien
cggagccatttgtccatatttcaca

SEQ ID NO: 146491 - DNA, 25 bp, Homo sapien
gcccggagccatttgtccatatttc

SEQ ID NO: 146492 - DNA, 25 bp, Homo sapien
gcggcccggagccatttgtccatat

SEQ ID NO: 146493 - DNA, 25 bp, Homo sapien
cctggatgggtcgactgcagcccgc

SEQ ID NO: 146494 - DNA, 25 bp, Homo sapien
cgcttcctggatgggtcgactgcag

SEQ ID NO: 146495 - DNA, 25 bp, Homo sapien
atatttcacaaaggccgcctccgtc

SEQ ID NO: 146496 - DNA, 25 bp, Homo sapien
tgtgacatgcggagctccaggaact

SEQ ID NO: 146497 - DNA, 25 bp, Homo sapien
cctcgttttggcagcacagagagca

SEQ ID NO: 146498 - DNA, 25 bp, Homo sapien
acactgttccgtggctaccggcaga

SEQ ID NO: 146499 - DNA, 25 bp, Homo sapien
gatcgccctcgcgaatgtgctgctg

SEQ ID NO: 146500 - DNA, 25 bp, Homo sapien
ggttagagcctaatgacacagcagc

SEQ ID NO: 146501 - DNA, 25 bp, Homo sapien
tttaacccgcagctgcatcgccagg

SEQ ID NO: 146502 - DNA, 25 bp, Homo sapien
ccgcttttaatggacgagggaatga

SEQ ID NO: 146503 - DNA, 25 bp, Homo sapien
agggctccaaggacacatacccagc

SEQ ID NO: 146504 - DNA, 25 bp, Homo sapien
cgcaatctgtgcgccctcgcgggga

SEQ ID NO: 146505 - DNA, 25 bp, Homo sapien
ctccagccaagataacctaaaaagg

SEQ ID NO: 146506 - DNA, 25 bp, Homo sapien
ggcgcttttctccagccaagataac

SEQ ID NO: 146507 - DNA, 25 bp, Homo sapien
gtggcgcttttctccagccaagata

SEQ ID NO: 146508 - DNA, 25 bp, Homo sapien
gtgggtggcgcttttctccagccaa

SEQ ID NO: 146509 - DNA, 25 bp, Homo sapien
ccgcagccagaggggattatgtcgc

SEQ ID NO: 146510 - DNA, 25 bp, Homo sapien
gtcgcgggacatatgttgaaatttc

SEQ ID NO: 146511 - DNA, 25 bp, Homo sapien
gcgggacatatgttgaaatttcatt

SEQ ID NO: 146512 - DNA, 25 bp, Homo sapien
gcgccatgcggcttctgcacagcaa

SEQ ID NO: 146513 - DNA, 25 bp, Homo sapien
gcaccgtcagtgcaagtgtccgcca

SEQ ID NO: 146514 - DNA, 25 bp, Homo sapien
tctaccagtgcctgacggggaaggc

SEQ ID NO: 146515 - DNA, 25 bp, Homo sapien
gcatcggcaccatcgtctaccagtg

SEQ ID NO: 146516 - DNA, 25 bp, Homo sapien
cccatgtacatggtgtgtttacctt

SEQ ID NO: 146517 - DNA, 25 bp, Homo sapien
atccgcgtcaagatcggtcagcccg

SEQ ID NO: 146518 - DNA, 25 bp, Homo sapien
agcgaggacaccatcaggctcttcc

SEQ ID NO: 146519 - DNA, 25 bp, Homo sapien
acctccagagcaacatgatggcggc

SEQ ID NO: 146520 - DNA, 25 bp, Homo sapien
acctggggtggctcccatagactgc

SEQ ID NO: 146521 - DNA, 25 bp, Homo sapien
tgcggcgtccggacctcgtggacct

SEQ ID NO: 146522 - DNA, 25 bp, Homo sapien
ccgcgctacggacgtgtgtttggaa

SEQ ID NO: 146523 - DNA, 25 bp, Homo sapien
tcaatccctcggcaccgcgctacgg

SEQ ID NO: 146524 - DNA, 25 bp, Homo sapien
gcggactggaggcaaatcaatccct

SEQ ID NO: 146525 - DNA, 25 bp, Homo sapien
tccgcggactggaggcaaatcaatc

SEQ ID NO: 146526 - DNA, 25 bp, Homo sapien
ccagcacacacgaggcggagctccg

SEQ ID NO: 146527 - DNA, 25 bp, Homo sapien
caaacacgggttctcacgcggtccg

SEQ ID NO: 146528 - DNA, 25 bp, Homo sapien
gccgtgctcgttgtcatttgtctta

SEQ ID NO: 146529 - DNA, 25 bp, Homo sapien
ctggtcactcaaaccacagattttg

SEQ ID NO: 146530 - DNA, 25 bp, Homo sapien
tttgtcttaacacggagcgcggatt

SEQ ID NO: 146531 - DNA, 25 bp, Homo sapien
tcctgatgcgagtcaacgagtcgtc

SEQ ID NO: 146532 - DNA, 25 bp, Homo sapien
accagctgctacttccgggatcgga

SEQ ID NO: 146533 - DNA, 25 bp, Homo sapien
ccgggatcggaaactgtactgcaaa

SEQ ID NO: 146534 - DNA, 25 bp, Homo sapien
agttgccatccgttgtcccggaatc

SEQ ID NO: 146535 - DNA, 25 bp, Homo sapien
gatggaggacctagcaatcaccttg

SEQ ID NO: 146536 - DNA, 25 bp, Homo sapien
ctatatccgccttggtggcgtggga

SEQ ID NO: 146537 - DNA, 25 bp, Homo sapien
gcatggcggcagaccaccctatatc

SEQ ID NO: 146538 - DNA, 25 bp, Homo sapien
accggccaactcagctgggagcacg

SEQ ID NO: 146539 - DNA, 25 bp, Homo sapien
cttcttcgcttcttcggcaagggaa

SEQ ID NO: 146540 - DNA, 25 bp, Homo sapien
cccaggtagagagaatccgaggctg

SEQ ID NO: 146541 - DNA, 25 bp, Homo sapien
aatgcatgcgcacccggacagacca

SEQ ID NO: 146542 - DNA, 25 bp, Homo sapien
tgcgaaggacccgagaccggccaac

SEQ ID NO: 146543 - DNA, 25 bp, Homo sapien
ctgtttctgccgctgaaatctgagc

SEQ ID NO: 146544 - DNA, 25 bp, Homo sapien
gctggctagagcactgtccttgatc

SEQ ID NO: 146545 - DNA, 25 bp, Homo sapien
ggaagtcggcagctccatctcgcca

SEQ ID NO: 146546 - DNA, 25 bp, Homo sapien
tgaccttccttgtcgtcccagtgtc

SEQ ID NO: 146547 - DNA, 25 bp, Homo sapien
gtcctctaaactctcggtcgcctga

SEQ ID NO: 146548 - DNA, 25 bp, Homo sapien
cctcgtagcgctggagctttacaaa

SEQ ID NO: 146549 - DNA, 25 bp, Homo sapien
ggcagccaacctaatttcttcagag

SEQ ID NO: 146550 - DNA, 25 bp, Homo sapien
ttgccgaggtccactttgcccaggc

SEQ ID NO: 146551 - DNA, 25 bp, Homo sapien
tcactgcaaaccctaggaggcccgg

SEQ ID NO: 146552 - DNA, 25 bp, Homo sapien
ctcttcccaggaaaggtggcactcc

SEQ ID NO: 146553 - DNA, 25 bp, Homo sapien
gtcacgaacacaagtacctaggatg

SEQ ID NO: 146554 - DNA, 25 bp, Homo sapien
tgtgtttgcctcctctgaccgagag

SEQ ID NO: 146555 - DNA, 25 bp, Homo sapien
ggagagtccggccattaaatgtaac

SEQ ID NO: 146556 - DNA, 25 bp, Homo sapien
tccgagggtgaattcctttgttcca

SEQ ID NO: 146557 - DNA, 25 bp, Homo sapien
gacagggctctgtcgtttaatcaga

SEQ ID NO: 146558 - DNA, 25 bp, Homo sapien
ctgggactaatgtcgcagcgctcgc

SEQ ID NO: 146559 - DNA, 25 bp, Homo sapien
gccctttgtcccacggagtgaacga

SEQ ID NO: 146560 - DNA, 25 bp, Homo sapien
tccagccggtatcccgagaggccgc

SEQ ID NO: 146561 - DNA, 25 bp, Homo sapien
taattaaatcctgcgccaagagccc

SEQ ID NO: 146562 - DNA, 25 bp, Homo sapien
cgagaggccgcaaaaacacagacac

SEQ ID NO: 146563 - DNA, 25 bp, Homo sapien
ggctctggctctctaatcctgtatc

SEQ ID NO: 146564 - DNA, 25 bp, Homo sapien
ggctctctaatcctgtatcttttga

SEQ ID NO: 146565 - DNA, 25 bp, Homo sapien
tatcttttgaaagataggcgcaccc

SEQ ID NO: 146566 - DNA, 25 bp, Homo sapien
cgccgcagtaatcgcaggctgattc

SEQ ID NO: 146567 - DNA, 25 bp, Homo sapien
cgcaggctgattccaactaattaaa

SEQ ID NO: 146568 - DNA, 25 bp, Homo sapien
gcattccagccgcgtgattgacgcg

SEQ ID NO: 146569 - DNA, 25 bp, Homo sapien
ccggctgtgcccgtccctccctgtc

SEQ ID NO: 146570 - DNA, 25 bp, Homo sapien
ggctgtgcccgtccctccctgtccc

SEQ ID NO: 146571 - DNA, 25 bp, Homo sapien
gacagcgcccctggcgcggatcaaa

SEQ ID NO: 146572 - DNA, 25 bp, Homo sapien
ccctggcgcggatcaaagggccgag

SEQ ID NO: 146573 - DNA, 25 bp, Homo sapien
gcgcggatcaaagggccgaggggcc

SEQ ID NO: 146574 - DNA, 25 bp, Homo sapien
gccgcgcattccagccgcgtgattg

SEQ ID NO: 146575 - DNA, 25 bp, Homo sapien
ccgcgcattccagccgcgtgattga

SEQ ID NO: 146576 - DNA, 25 bp, Homo sapien
cgactgagacaggaacgcggacacc

SEQ ID NO: 146577 - DNA, 25 bp, Homo sapien
gcggacacctcacgctgaaaagcca

SEQ ID NO: 146578 - DNA, 25 bp, Homo sapien
ccagcgttctcggagtacgtatcca

SEQ ID NO: 146579 - DNA, 25 bp, Homo sapien
tacgtatccaggagctgcaagctga

SEQ ID NO: 146580 - DNA, 25 bp, Homo sapien
gcctgagttgggctgacctgtgaaa

SEQ ID NO: 146581 - DNA, 25 bp, Homo sapien
ttttgctcttattcccgtgggctgc

SEQ ID NO: 146582 - DNA, 25 bp, Homo sapien
ttcacccgtgagacttggagcggcc

SEQ ID NO: 146583 - DNA, 25 bp, Homo sapien
tcctggagtccgtcgtgttccaaca

SEQ ID NO: 146584 - DNA, 25 bp, Homo sapien
gcagctacgcaagggcgacgaattc

SEQ ID NO: 146585 - DNA, 25 bp, Homo sapien
ctgcgtgtgtgaacggcagctacgc

SEQ ID NO: 146586 - DNA, 25 bp, Homo sapien
gagtgcgtgtaccacctgggctgct

SEQ ID NO: 146587 - DNA, 25 bp, Homo sapien
ccaccgagttcgtgatgcgggcgct

SEQ ID NO: 146588 - DNA, 25 bp, Homo sapien
cagcggctgcatggagaagatcgcc

SEQ ID NO: 146589 - DNA, 25 bp, Homo sapien
atccgcaggctcttcgcggccaagt

SEQ ID NO: 146590 - DNA, 25 bp, Homo sapien
ccgctttgtgcatccgcaggctctt

SEQ ID NO: 146591 - DNA, 25 bp, Homo sapien
tgctgtgcaagggtgactacgagaa

SEQ ID NO: 146592 - DNA, 25 bp, Homo sapien
ggaggctcctgatcgtggccaaaga

SEQ ID NO: 146593 - DNA, 25 bp, Homo sapien
tggagccttgttatgcctgacccac

SEQ ID NO: 146594 - DNA, 25 bp, Homo sapien
cccgttttattgctggagatggtga

SEQ ID NO: 146595 - DNA, 25 bp, Homo sapien
cacgcaaccctgagtggatggaagc

SEQ ID NO: 146596 - DNA, 25 bp, Homo sapien
atggaagcgcgcattcccatttcac

SEQ ID NO: 146597 - DNA, 25 bp, Homo sapien
gagtcagtcaggtgtagcccacgtg

SEQ ID NO: 146598 - DNA, 25 bp, Homo sapien
ctcagagatgttaaggagcctgcct

SEQ ID NO: 146599 - DNA, 25 bp, Homo sapien
cgatagcaaccgctttggagccttg

SEQ ID NO: 146600 - DNA, 25 bp, Homo sapien
gacaccgtgatatccgcctggctcg

SEQ ID NO: 146601 - DNA, 25 bp, Homo sapien
gccatgggccaagcgccgtaaaatt

SEQ ID NO: 146602 - DNA, 25 bp, Homo sapien
tgagagagacacttcgcagaaacct

SEQ ID NO: 146603 - DNA, 25 bp, Homo sapien
cgtggcccgagacgaggcccagaaa

SEQ ID NO: 146604 - DNA, 25 bp, Homo sapien
ttcgcagaaacctcagcggcgcggg

SEQ ID NO: 146605 - DNA, 25 bp, Homo sapien
tctcctttctcggtgtccatggtgg

SEQ ID NO: 146606 - DNA, 25 bp, Homo sapien
agagccgcctgacaccgtgatatcc

SEQ ID NO: 146607 - DNA, 25 bp, Homo sapien
cccgtcgatcccaggtgatggatgg

SEQ ID NO: 146608 - DNA, 25 bp, Homo sapien
cgacgcccagctcagacggtaagtc

SEQ ID NO: 146609 - DNA, 25 bp, Homo sapien
ctccagagtgtactgcgcaggcgcc

SEQ ID NO: 146610 - DNA, 25 bp, Homo sapien
aatctgttgcggcagctgaggctac

SEQ ID NO: 146611 - DNA, 25 bp, Homo sapien
gccaccaatgcctgaggcctgacga

SEQ ID NO: 146612 - DNA, 25 bp, Homo sapien
cgacctcgggttcgagccaccaatg

SEQ ID NO: 146613 - DNA, 25 bp, Homo sapien
cgcagaccgcgataccgaggccttt

SEQ ID NO: 146614 - DNA, 25 bp, Homo sapien
ccattccgtggaccggcataccaaa

SEQ ID NO: 146615 - DNA, 25 bp, Homo sapien
tcagacggtaagtcccgcatgcgca

SEQ ID NO: 146616 - DNA, 25 bp, Homo sapien
gtgcagtcggtcgttccacttccgc

SEQ ID NO: 146617 - DNA, 25 bp, Homo sapien
atgggcctccagcttcgcgcgctgt

SEQ ID NO: 146618 - DNA, 25 bp, Homo sapien
acgttggagttgatccgtcagggtc

SEQ ID NO: 146619 - DNA, 25 bp, Homo sapien
gaccgcgtccgtcctggtaatgacc

SEQ ID NO: 146620 - DNA, 25 bp, Homo sapien
gagcctctctggtcccgacgcgggt

SEQ ID NO: 146621 - DNA, 25 bp, Homo sapien
tcctggtaatgaccgcgacgccggg

SEQ ID NO: 146622 - DNA, 25 bp, Homo sapien
tcccgaattagttttgtccgcgctc

SEQ ID NO: 146623 - DNA, 25 bp, Homo sapien
cactggtagcctgcgcatgggcctc

SEQ ID NO: 146624 - DNA, 25 bp, Homo sapien
agcgacagcgccgagttccactaca

SEQ ID NO: 146625 - DNA, 25 bp, Homo sapien
catggatgtgcacgcgacctacgac

SEQ ID NO: 146626 - DNA, 25 bp, Homo sapien
gatccacgtgaagcccgagcgctta

SEQ ID NO: 146627 - DNA, 25 bp, Homo sapien
agcccagcatcatggctcacaaacg

SEQ ID NO: 146628 - DNA, 25 bp, Homo sapien
accgcctgagcacggaaatggcaag

SEQ ID NO: 146629 - DNA, 25 bp, Homo sapien
tcgtccacagagcatgaccgcctga

SEQ ID NO: 146630 - DNA, 25 bp, Homo sapien
gagcacgaatacctgcccagcaact

SEQ ID NO: 146631 - DNA, 25 bp, Homo sapien
ggctcacaaacgctggatccacgtg

SEQ ID NO: 146632 - DNA, 25 bp, Homo sapien
ggtccagaccaaggctgccgctagc

SEQ ID NO: 146633 - DNA, 25 bp, Homo sapien
ctggctagaggtccgccgcgcaacg

SEQ ID NO: 146634 - DNA, 25 bp, Homo sapien
agcctccgcgcctggtcagtcccgc

SEQ ID NO: 146635 - DNA, 25 bp, Homo sapien
cagatggttgagttccctggagagc

SEQ ID NO: 146636 - DNA, 25 bp, Homo sapien
gagccgctgcctcacgccaccgcct

SEQ ID NO: 146637 - DNA, 25 bp, Homo sapien
cttcctccaggtaaacaggcggcgg

SEQ ID NO: 146638 - DNA, 25 bp, Homo sapien
ctccaggtaaacaggcggcggcgac

SEQ ID NO: 146639 - DNA, 25 bp, Homo sapien
ccagacgtctccgtggccactcgcg

SEQ ID NO: 146640 - DNA, 25 bp, Homo sapien
agccggccgatttgcgtgtctccgc

SEQ ID NO: 146641 - DNA, 25 bp, Homo sapien
gattggatgagaggcccgccgctca

SEQ ID NO: 146642 - DNA, 25 bp, Homo sapien
acggttcctactgcggctgggcacc

SEQ ID NO: 146643 - DNA, 25 bp, Homo sapien
cagcggctgcgcactggtacgacca

SEQ ID NO: 146644 - DNA, 25 bp, Homo sapien
tggggaataagatgcgcggctattt

SEQ ID NO: 146645 - DNA, 25 bp, Homo sapien
agatgcgcggctatttctaggcagg

SEQ ID NO: 146646 - DNA, 25 bp, Homo sapien
tcaggccctggagcggacggttcct

SEQ ID NO: 146647 - DNA, 25 bp, Homo sapien
actggtacgaccagccggccgattt

SEQ ID NO: 146648 - DNA, 25 bp, Homo sapien
ctgactcgggcttggagctcagctg

SEQ ID NO: 146649 - DNA, 25 bp, Homo sapien
cgccctaagtggggcgcgctgtttt

SEQ ID NO: 146650 - DNA, 25 bp, Homo sapien
tgcctctgctgactcgggcttggag

SEQ ID NO: 146651 - DNA, 25 bp, Homo sapien
ttggagctcagctgccctggttact

SEQ ID NO: 146652 - DNA, 25 bp, Homo sapien
tgccctggttactggccggttgcct

SEQ ID NO: 146653 - DNA, 25 bp, Homo sapien
ttactggccggttgcctcccctatg

SEQ ID NO: 146654 - DNA, 25 bp, Homo sapien
agctcagctgccctggttactggcc

SEQ ID NO: 146655 - DNA, 25 bp, Homo sapien
ctatgctacgccgcgccctaagtgg

SEQ ID NO: 146656 - DNA, 25 bp, Homo sapien
cttcgagagcccaaggtactgcgga

SEQ ID NO: 146657 - DNA, 25 bp, Homo sapien
ccgctgcgctcctgcggcagaagag

SEQ ID NO: 146658 - DNA, 25 bp, Homo sapien
agcccacccgagtgcgcccgagccc

SEQ ID NO: 146659 - DNA, 25 bp, Homo sapien
tgcagaaagccggcggcaagaaccc

SEQ ID NO: 146660 - DNA, 25 bp, Homo sapien
tcgggcgtccagaagcgtcggtcca

SEQ ID NO: 146661 - DNA, 25 bp, Homo sapien
cgaactccaagggacgacgctcgcg

SEQ ID NO: 146662 - DNA, 25 bp, Homo sapien
acgacgctcgcggaagcagaggttt

SEQ ID NO: 146663 - DNA, 25 bp, Homo sapien
gccttgcgcgagctcagtagtgcag

SEQ ID NO: 146664 - DNA, 25 bp, Homo sapien
gttggaggtaacctgaggacgctca

SEQ ID NO: 146665 - DNA, 25 bp, Homo sapien
gaccgctggagagcctatgagcaca

SEQ ID NO: 146666 - DNA, 25 bp, Homo sapien
ccggccctattggtgaatccgatta

SEQ ID NO: 146667 - DNA, 25 bp, Homo sapien
agcctatgagcacagcgcaagcacc

SEQ ID NO: 146668 - DNA, 25 bp, Homo sapien
taaagtacccgcagtggagctggcc

SEQ ID NO: 146669 - DNA, 25 bp, Homo sapien
acgctcagcgctggagctccgagca

SEQ ID NO: 146670 - DNA, 25 bp, Homo sapien
acccagggcgtcagttccaaaggtg

SEQ ID NO: 146671 - DNA, 25 bp, Homo sapien
tccgagcaggagttaaagtacccgc

SEQ ID NO: 146672 - DNA, 25 bp, Homo sapien
ttatcagtaaccgatggcctcgcgc

SEQ ID NO: 146673 - DNA, 25 bp, Homo sapien
ccgcggagccaaggagccagcaatt

SEQ ID NO: 146674 - DNA, 25 bp, Homo sapien
taccacgtcggctttcccagcagag

SEQ ID NO: 146675 - DNA, 25 bp, Homo sapien
ccagcaattgtgcaagaggagaccg

SEQ ID NO: 146676 - DNA, 25 bp, Homo sapien
gaccggcgcacagggcgcgtatcac

SEQ ID NO: 146677 - DNA, 25 bp, Homo sapien
agcgcatggtacgagccgccggctc

SEQ ID NO: 146678 - DNA, 25 bp, Homo sapien
gagcgaggaccgagcagcacagccc

SEQ ID NO: 146679 - DNA, 25 bp, Homo sapien
cgcgtatcacggagcgcatggtacg

SEQ ID NO: 146680 - DNA, 25 bp, Homo sapien
cccagggcagcgattaaagcggagc

SEQ ID NO: 146681 - DNA, 25 bp, Homo sapien
cccagcgggagcgtctgaccagtct

SEQ ID NO: 146682 - DNA, 25 bp, Homo sapien
accagtctcgccctccgagaggaga

SEQ ID NO: 146683 - DNA, 25 bp, Homo sapien
gacggtctgcttagaggctctctcc

SEQ ID NO: 146684 - DNA, 25 bp, Homo sapien
ggcccaggcataggtcagacgcctc

SEQ ID NO: 146685 - DNA, 25 bp, Homo sapien
ggctgaggcccacgtgcttcgcctt

SEQ ID NO: 146686 - DNA, 25 bp, Homo sapien
taggtcagacgcctccaatacagtc

SEQ ID NO: 146687 - DNA, 25 bp, Homo sapien
caggaactgcagacccgaccgggca

SEQ ID NO: 146688 - DNA, 25 bp, Homo sapien
gctcttttacctctgagcccgcggg

SEQ ID NO: 146689 - DNA, 25 bp, Homo sapien
gagcctcttgctgtgctccgtgccc

SEQ ID NO: 146690 - DNA, 25 bp, Homo sapien
cccggccatccctagcctgcagcgc

SEQ ID NO: 146691 - DNA, 25 bp, Homo sapien
ctcctctcgggacgggcatcgggac

SEQ ID NO: 146692 - DNA, 25 bp, Homo sapien
ccacgagacaggcattgggcctctc

SEQ ID NO: 146693 - DNA, 25 bp, Homo sapien
tcgtggccggctttgccgtcatcac

SEQ ID NO: 146694 - DNA, 25 bp, Homo sapien
tgggcccactcagcttcggcttcgc

SEQ ID NO: 146695 - DNA, 25 bp, Homo sapien
gcctccaggctgtcgtgaccctggg

SEQ ID NO: 146696 - DNA, 25 bp, Homo sapien
ctgctccgggaactttttgcagttc

SEQ ID NO: 146697 - DNA, 25 bp, Homo sapien
tttgcagttcgctgaggtccaaggc

SEQ ID NO: 146698 - DNA, 25 bp, Homo sapien
cttctgcggccaaggtgccagaaca

SEQ ID NO: 146699 - DNA, 25 bp, Homo sapien
tctcagaggcatccaggccatgctg

SEQ ID NO: 146700 - DNA, 25 bp, Homo sapien
tcatggtgttcagcacgagtgcctt

SEQ ID NO: 146701 - DNA, 25 bp, Homo sapien
gccttcggcgcctacttcaagctga

SEQ ID NO: 146702 - DNA, 25 bp, Homo sapien
gcttctgtgccggtacctcccattt

SEQ ID NO: 146703 - DNA, 25 bp, Homo sapien
cggacatttggtacccagcagctgc

SEQ ID NO: 146704 - DNA, 25 bp, Homo sapien
gtgccaacaatgcatgtgactaatg

SEQ ID NO: 146705 - DNA, 25 bp, Homo sapien
aagtgccgtgcatacacgtggcctc

SEQ ID NO: 146706 - DNA, 25 bp, Homo sapien
gtgggcgcacgtgaccaatgcacga

SEQ ID NO: 146707 - DNA, 25 bp, Homo sapien
accaatgcacgagtgcctgatgccc

SEQ ID NO: 146708 - DNA, 25 bp, Homo sapien
cgcatgcgcctgacgtgccaacaat

SEQ ID NO: 146709 - DNA, 25 bp, Homo sapien
tgactaatgcgcagtcgcctgtcgc

SEQ ID NO: 146710 - DNA, 25 bp, Homo sapien
gtgacatgtgcacgtgcccatgatg

SEQ ID NO: 146711 - DNA, 25 bp, Homo sapien
gcggtgcacacaactaatgcgcatg

SEQ ID NO: 146712 - DNA, 25 bp, Homo sapien
gccagttgccagttgccagtcgttt

SEQ ID NO: 146713 - DNA, 25 bp, Homo sapien
tcccagaatccttcgcggctaaatc

SEQ ID NO: 146714 - DNA, 25 bp, Homo sapien
ctcgaggctccatttcgttggattc

SEQ ID NO: 146715 - DNA, 25 bp, Homo sapien
ccctgagcgtgtgtgtatcataaac

SEQ ID NO: 146716 - DNA, 25 bp, Homo sapien
ccgggctgcaggaatgaaaaagact

SEQ ID NO: 146717 - DNA, 25 bp, Homo sapien
tgccggtagattgttgccagttgcc

SEQ ID NO: 146718 - DNA, 25 bp, Homo sapien
gtagatagacccttacgcccagaga

SEQ ID NO: 146719 - DNA, 25 bp, Homo sapien
cttggacagcggttcttgagctctc

SEQ ID NO: 146720 - DNA, 25 bp, Homo sapien
tcccggtctgcgtgactttatgaga

SEQ ID NO: 146721 - DNA, 25 bp, Homo sapien
agtccgcgattcctagagcctcaga

SEQ ID NO: 146722 - DNA, 25 bp, Homo sapien
cccatacggggaaagctttgcacgc

SEQ ID NO: 146723 - DNA, 25 bp, Homo sapien
accagagcacgcaccgactttgatc

SEQ ID NO: 146724 - DNA, 25 bp, Homo sapien
gcggctatcgcgagaactgtcgtca

SEQ ID NO: 146725 - DNA, 25 bp, Homo sapien
agagacgcccttgtcgccatgtttg

SEQ ID NO: 146726 - DNA, 25 bp, Homo sapien
tgctccctcgagcacttgttgtgtg

SEQ ID NO: 146727 - DNA, 25 bp, Homo sapien
agtcccgctcttcattcggagagtc

SEQ ID NO: 146728 - DNA, 25 bp, Homo sapien
catagcagctctgcatcttcagggg

SEQ ID NO: 146729 - DNA, 25 bp, Homo sapien
actccatcttctcatagcagctctg

SEQ ID NO: 146730 - DNA, 25 bp, Homo sapien
gtcgcagcgactccatcttctcata

SEQ ID NO: 146731 - DNA, 25 bp, Homo sapien
ggacacatcaaatcgctgctgcagc

SEQ ID NO: 146732 - DNA, 25 bp, Homo sapien
acggacgtgctggacacatcaaatc

SEQ ID NO: 146733 - DNA, 25 bp, Homo sapien
gctcgctgcttgaacacggacgtgc

SEQ ID NO: 146734 - DNA, 25 bp, Homo sapien
acctcccgcatgtggatctgggctc

SEQ ID NO: 146735 - DNA, 25 bp, Homo sapien
ctcgggtctacctcccgcatgtgga

SEQ ID NO: 146736 - DNA, 25 bp, Homo sapien
gcggtttctccacttcttgctgtcc

SEQ ID NO: 146737 - DNA, 25 bp, Homo sapien
ggttccccgagaagacgatgcgctc

SEQ ID NO: 146738 - DNA, 25 bp, Homo sapien
ggcctcaccgctttgttttcgtaga

SEQ ID NO: 146739 - DNA, 25 bp, Homo sapien
gcacgaggctgaagcggtttctcca

SEQ ID NO: 146740 - DNA, 25 bp, Homo sapien
cttgctgtcctcctggtgctggaag

SEQ ID NO: 146741 - DNA, 25 bp, Homo sapien
cctcctggtgctggaagaggttccc

SEQ ID NO: 146742 - DNA, 25 bp, Homo sapien
cacacatggagaaagcggggaggct

SEQ ID NO: 146743 - DNA, 25 bp, Homo sapien
tgttttcgtagagcaccagcccgta

SEQ ID NO: 146744 - DNA, 25 bp, Homo sapien
cccaaagctggtagcggatgggctt

SEQ ID NO: 146745 - DNA, 25 bp, Homo sapien
tcagtcccgggccttcatgggcgcg

SEQ ID NO: 146746 - DNA, 25 bp, Homo sapien
ctccgccacgtgtaccagggctggg

SEQ ID NO: 146747 - DNA, 25 bp, Homo sapien
ctgggagatcccaaagctggtagcg

SEQ ID NO: 146748 - DNA, 25 bp, Homo sapien
tagcggatgggcttgcaacgcttct

SEQ ID NO: 146749 - DNA, 25 bp, Homo sapien
caggctcagagggaacgagctcgga

SEQ ID NO: 146750 - DNA, 25 bp, Homo sapien
aggagttccgagtccccttgagccg

SEQ ID NO: 146751 - DNA, 25 bp, Homo sapien
ctgggtctgggagatcccaaagctg

SEQ ID NO: 146752 - DNA, 25 bp, Homo sapien
tgtacctaagcagagaaagagacgg

SEQ ID NO: 146753 - DNA, 25 bp, Homo sapien
ttgcccgcgcgggaaaagaatcgcg

SEQ ID NO: 146754 - DNA, 25 bp, Homo sapien
ccgcgcgggaaaagaatcgcgccga

SEQ ID NO: 146755 - DNA, 25 bp, Homo sapien
actggcaggggacgcctggacctac

SEQ ID NO: 146756 - DNA, 25 bp, Homo sapien
ccctcctctaccctgaacagtgccc

SEQ ID NO: 146757 - DNA, 25 bp, Homo sapien
acccgccctgtacctaagcagagaa

SEQ ID NO: 146758 - DNA, 25 bp, Homo sapien
cgccctgtacctaagcagagaaaga

SEQ ID NO: 146759 - DNA, 25 bp, Homo sapien
ctggtggggacatctgaaaaactgg

SEQ ID NO: 146760 - DNA, 25 bp, Homo sapien
ccgtgcgtaaatcgcagtactcttc

SEQ ID NO: 146761 - DNA, 25 bp, Homo sapien
ctccctctccatctgtcctgatcgc

SEQ ID NO: 146762 - DNA, 25 bp, Homo sapien
atctgtcctgatcgccagcctctcc

SEQ ID NO: 146763 - DNA, 25 bp, Homo sapien
cgtgacccgtgcgtaaatcgcagta

SEQ ID NO: 146764 - DNA, 25 bp, Homo sapien
gcgtaaatcgcagtactcttcccac

SEQ ID NO: 146765 - DNA, 25 bp, Homo sapien
cgcgcatgcgcagctgtggacgcac

SEQ ID NO: 146766 - DNA, 25 bp, Homo sapien
atgcgcagctgtggacgcacctgcg

SEQ ID NO: 146767 - DNA, 25 bp, Homo sapien
gccacgtgacccgtgcgtaaatcgc

SEQ ID NO: 146768 - DNA, 25 bp, Homo sapien
agccaggagccggcacgaggcacca

SEQ ID NO: 146769 - DNA, 25 bp, Homo sapien
gactgagcgcgactgttccgcccgc

SEQ ID NO: 146770 - DNA, 25 bp, Homo sapien
agcgcgactgttccgcccgcgtccc

SEQ ID NO: 146771 - DNA, 25 bp, Homo sapien
tgcagcggcctctgcgaatttccgt

SEQ ID NO: 146772 - DNA, 25 bp, Homo sapien
agcggcctctgcgaatttccgtctg

SEQ ID NO: 146773 - DNA, 25 bp, Homo sapien
ggcctctgcgaatttccgtctggca

SEQ ID NO: 146774 - DNA, 25 bp, Homo sapien
cctctgcgaatttccgtctggcacg

SEQ ID NO: 146775 - DNA, 25 bp, Homo sapien
ggagaggccgcatgtgtgagcaggg

SEQ ID NO: 146776 - DNA, 25 bp, Homo sapien
aagtggagccgggatccttccagca

SEQ ID NO: 146777 - DNA, 25 bp, Homo sapien
cagggatcccagcaccgacgggaaa

SEQ ID NO: 146778 - DNA, 25 bp, Homo sapien
agtgggcgctgctagtaagagatct

SEQ ID NO: 146779 - DNA, 25 bp, Homo sapien
agtaagagatctcgcctccaagctc

SEQ ID NO: 146780 - DNA, 25 bp, Homo sapien
caagctccttccgtgggcaggaaaa

SEQ ID NO: 146781 - DNA, 25 bp, Homo sapien
agtccgcgcgtcagtcggtccctag

SEQ ID NO: 146782 - DNA, 25 bp, Homo sapien
cccattggcctcaaagctgttgtcg

SEQ ID NO: 146783 - DNA, 25 bp, Homo sapien
ctcaaagctgttgtcggagagagta

SEQ ID NO: 146784 - DNA, 25 bp, Homo sapien
cctcccaacttatacgacctgattt

SEQ ID NO: 146785 - DNA, 25 bp, Homo sapien
tgagattagtcgtcagatctctccc

SEQ ID NO: 146786 - DNA, 25 bp, Homo sapien
ccttgcactgagattagtcgtcaga

SEQ ID NO: 146787 - DNA, 25 bp, Homo sapien
tcttctcaaggctttgaaatctccc

SEQ ID NO: 146788 - DNA, 25 bp, Homo sapien
gtggtgttctcttctcaaggctttg

SEQ ID NO: 146789 - DNA, 25 bp, Homo sapien
ctcgctgcattgtggtgttctcttc

SEQ ID NO: 146790 - DNA, 25 bp, Homo sapien
gccctctctgctcgctgcattgtgg

SEQ ID NO: 146791 - DNA, 25 bp, Homo sapien
atacgacctgatttccttaggacgg

SEQ ID NO: 146792 - DNA, 25 bp, Homo sapien
tgacggcccaagagctcaagacctc

SEQ ID NO: 146793 - DNA, 25 bp, Homo sapien
cgctgctaagatccgggtgtctgga

SEQ ID NO: 146794 - DNA, 25 bp, Homo sapien
tacagcctcttgtaccctgggaaga

SEQ ID NO: 146795 - DNA, 25 bp, Homo sapien
tgcttttgggctaagtccttgacgg

SEQ ID NO: 146796 - DNA, 25 bp, Homo sapien
caggaaacttcttcgggcgcttctc

SEQ ID NO: 146797 - DNA, 25 bp, Homo sapien
ggaggtttttccacctgcaacagga

SEQ ID NO: 146798 - DNA, 25 bp, Homo sapien
tccagtctccaaagccgatggcatc

SEQ ID NO: 146799 - DNA, 25 bp, Homo sapien
tctcaggcccgttccacagaaggtt

SEQ ID NO: 146800 - DNA, 25 bp, Homo sapien
gtctttcgagtcgtagcgcccgtcc

SEQ ID NO: 146801 - DNA, 25 bp, Homo sapien
cctccacggcggagccttagtaatt

SEQ ID NO: 146802 - DNA, 25 bp, Homo sapien
tgaggtccgaatccgctccttctcg

SEQ ID NO: 146803 - DNA, 25 bp, Homo sapien
ccacaggggttacagtgaggtccga

SEQ ID NO: 146804 - DNA, 25 bp, Homo sapien
aacgcgccgccacaggggttacagt

SEQ ID NO: 146805 - DNA, 25 bp, Homo sapien
acggggcgaattcactcagaactta

SEQ ID NO: 146806 - DNA, 25 bp, Homo sapien
ccagaaccactttcctgaggcgcga

SEQ ID NO: 146807 - DNA, 25 bp, Homo sapien
agccttagtaattgccgctgcctcc

SEQ ID NO: 146808 - DNA, 25 bp, Homo sapien
accgacactcgaggccgaaacactg

SEQ ID NO: 146809 - DNA, 25 bp, Homo sapien
accaacgcggaaccgacactcgagg

SEQ ID NO: 146810 - DNA, 25 bp, Homo sapien
tcctggagtaagacggttgctgatt

SEQ ID NO: 146811 - DNA, 25 bp, Homo sapien
aagcgtctactagccgggctgttta

SEQ ID NO: 146812 - DNA, 25 bp, Homo sapien
ctgtttagggattggtcgcctctgg

SEQ ID NO: 146813 - DNA, 25 bp, Homo sapien
cttccggggctagtaagcgtctact

SEQ ID NO: 146814 - DNA, 25 bp, Homo sapien
gccgaaacactgtgagcaaggaaaa

SEQ ID NO: 146815 - DNA, 25 bp, Homo sapien
tactagccgggctgtttagggattg

SEQ ID NO: 146816 - DNA, 25 bp, Homo sapien
acgctgcgcccgttggcgttcataa

SEQ ID NO: 146817 - DNA, 25 bp, Homo sapien
gcgccttcagtagcgcggcgtcaca

SEQ ID NO: 146818 - DNA, 25 bp, Homo sapien
gcagccaatcgtgttgccaactgtt

SEQ ID NO: 146819 - DNA, 25 bp, Homo sapien
ccctagtgcaggaacggagcttcaa

SEQ ID NO: 146820 - DNA, 25 bp, Homo sapien
caagaagtttggagcccgtcgagca

SEQ ID NO: 146821 - DNA, 25 bp, Homo sapien
cgtcgagcactgaactcaccagtta

SEQ ID NO: 146822 - DNA, 25 bp, Homo sapien
aatggccgaactgaagctagggacc

SEQ ID NO: 146823 - DNA, 25 bp, Homo sapien
acacatcggctcatggctctactca

SEQ ID NO: 146824 - DNA, 25 bp, Homo sapien
gggcaccatgtaccgacggctccag

SEQ ID NO: 146825 - DNA, 25 bp, Homo sapien
cagcaggagaaaggactctacatca

SEQ ID NO: 146826 - DNA, 25 bp, Homo sapien
tctacatcaaccgaggcggtgcgca

SEQ ID NO: 146827 - DNA, 25 bp, Homo sapien
ctgaacaaggccctccgggacgagc

SEQ ID NO: 146828 - DNA, 25 bp, Homo sapien
aacgactttgccgtgcactgctaca

SEQ ID NO: 146829 - DNA, 25 bp, Homo sapien
gccagctgttgctgacctacaacga

SEQ ID NO: 146830 - DNA, 25 bp, Homo sapien
tgctggacatggtgaccgaggacca

SEQ ID NO: 146831 - DNA, 25 bp, Homo sapien
cctccgggacgagcagcaggagaaa

SEQ ID NO: 146832 - DNA, 25 bp, Homo sapien
gcattcgcaaaaggcgcccaaggtg

SEQ ID NO: 146833 - DNA, 25 bp, Homo sapien
ccgcgtttccatggccacggtaact

SEQ ID NO: 146834 - DNA, 25 bp, Homo sapien
ccatcgtagtggctcagaaagaata

SEQ ID NO: 146835 - DNA, 25 bp, Homo sapien
cagcaggaccagaaggtggcctcca

SEQ ID NO: 146836 - DNA, 25 bp, Homo sapien
taaaggatcacgaccacaaagggcg

SEQ ID NO: 146837 - DNA, 25 bp, Homo sapien
cgggccggaagtcgcattcgcaaaa

SEQ ID NO: 146838 - DNA, 25 bp, Homo sapien
tcgttgtggggcagtcaactgcctc

SEQ ID NO: 146839 - DNA, 25 bp, Homo sapien
tggccacggtaactaggggaccatc

SEQ ID NO: 146840 - DNA, 25 bp, Homo sapien
ccagagcgtggaaagcaaggcctcg

SEQ ID NO: 146841 - DNA, 25 bp, Homo sapien
catgatggacatggtgtggaacctg

SEQ ID NO: 146842 - DNA, 25 bp, Homo sapien
tccacggccagcatgatggacatgg

SEQ ID NO: 146843 - DNA, 25 bp, Homo sapien
gtgcagcccaggatgtccacggcca

SEQ ID NO: 146844 - DNA, 25 bp, Homo sapien
aatggtcttgtgcagcagcgctgcc

SEQ ID NO: 146845 - DNA, 25 bp, Homo sapien
gccgccagctgaatggtcttgtgca

SEQ ID NO: 146846 - DNA, 25 bp, Homo sapien
acatggtgtggaacctgtcagagcg

SEQ ID NO: 146847 - DNA, 25 bp, Homo sapien
cgcgaagctgaacatgttgcccata

SEQ ID NO: 146848 - DNA, 25 bp, Homo sapien
aggtcagccgcaagggccagcgtac

SEQ ID NO: 146849 - DNA, 25 bp, Homo sapien
tctcagcggcgcgattacctcatcg

SEQ ID NO: 146850 - DNA, 25 bp, Homo sapien
cgattacctcatcgccttgtcgggg

SEQ ID NO: 146851 - DNA, 25 bp, Homo sapien
gcgcagggaccaaccggctaggcac

SEQ ID NO: 146852 - DNA, 25 bp, Homo sapien
gaaacggaccggcatctaccgcagc

SEQ ID NO: 146853 - DNA, 25 bp, Homo sapien
tcagtcttcagatcccagtccggcg

SEQ ID NO: 146854 - DNA, 25 bp, Homo sapien
aggcatgtccaagcccacctagagg

SEQ ID NO: 146855 - DNA, 25 bp, Homo sapien
acctgcacgaaggagccgcggtaga

SEQ ID NO: 146856 - DNA, 25 bp, Homo sapien
ccaccgcctactccaccggcaggga

SEQ ID NO: 146857 - DNA, 25 bp, Homo sapien
ccttcggcccacagcagtcatgctt

SEQ ID NO: 146858 - DNA, 25 bp, Homo sapien
ctttctcgggccactgagctgcaga

SEQ ID NO: 146859 - DNA, 25 bp, Homo sapien
cggagactgacctgtagaccacgcc

SEQ ID NO: 146860 - DNA, 25 bp, Homo sapien
ggaaggacgctctccgcctcgaaca

SEQ ID NO: 146861 - DNA, 25 bp, Homo sapien
ccatcagtcagtgtcgggaaggcct

SEQ ID NO: 146862 - DNA, 25 bp, Homo sapien
agtcagtgtcgggaaggcctcgccc

SEQ ID NO: 146863 - DNA, 25 bp, Homo sapien
agctgcagagctcagtgccggactc

SEQ ID NO: 146864 - DNA, 25 bp, Homo sapien
tcgggccgtctcctagtcggctctt

SEQ ID NO: 146865 - DNA, 25 bp, Homo sapien
gccaaggcaccttcgggtaaggctg

SEQ ID NO: 146866 - DNA, 25 bp, Homo sapien
aagctcgccaagatcggccaaggca

SEQ ID NO: 146867 - DNA, 25 bp, Homo sapien
gtttccaaatacgagaagctcgcca

SEQ ID NO: 146868 - DNA, 25 bp, Homo sapien
ctggcctctcgggaactacaagtcc

SEQ ID NO: 146869 - DNA, 25 bp, Homo sapien
agtgccctttttgtgatgaagtttc

SEQ ID NO: 146870 - DNA, 25 bp, Homo sapien
cggccatggcaaagcagtacgactc

SEQ ID NO: 146871 - DNA, 25 bp, Homo sapien
cccgagttggtagagaagtcgtctg

SEQ ID NO: 146872 - DNA, 25 bp, Homo sapien
actgatttacactcgcgccggggtc

SEQ ID NO: 146873 - DNA, 25 bp, Homo sapien
ctcggcatgctggttgtcaagtgca

SEQ ID NO: 146874 - DNA, 25 bp, Homo sapien
ggaaacttcttaccatctcggcatg

SEQ ID NO: 146875 - DNA, 25 bp, Homo sapien
tcggtcgttgtgttgtttgtcctca

SEQ ID NO: 146876 - DNA, 25 bp, Homo sapien
ttgggttgttcttgctctctctttc

SEQ ID NO: 146877 - DNA, 25 bp, Homo sapien
cgcgaactttattccgactgcagca

SEQ ID NO: 146878 - DNA, 25 bp, Homo sapien
cggcagctctttccttttcgggcac

SEQ ID NO: 146879 - DNA, 25 bp, Homo sapien
tctctctgcagaattgtcgtgacta

SEQ ID NO: 146880 - DNA, 25 bp, Homo sapien
gacggagtttgagcgcgtcttctga

SEQ ID NO: 146881 - DNA, 25 bp, Homo sapien
gccaccaccaaccagacggagtttg

SEQ ID NO: 146882 - DNA, 25 bp, Homo sapien
gcagtccaccaaccagagtcgcaat

SEQ ID NO: 146883 - DNA, 25 bp, Homo sapien
agggcagccagatcacccagcagtc

SEQ ID NO: 146884 - DNA, 25 bp, Homo sapien
agtacttggcaccaccgcgccggaa

SEQ ID NO: 146885 - DNA, 25 bp, Homo sapien
cctgacgtccatgttcgagtacttg

SEQ ID NO: 146886 - DNA, 25 bp, Homo sapien
tcaaccacgacttcttctggtccga

SEQ ID NO: 146887 - DNA, 25 bp, Homo sapien
gcatcgacagcgatgacgccctcaa

SEQ ID NO: 146888 - DNA, 25 bp, Homo sapien
ctggtgcagttcgactcaggtatgc

SEQ ID NO: 146889 - DNA, 25 bp, Homo sapien
gctccacgcctgctgcagttccctg

SEQ ID NO: 146890 - DNA, 25 bp, Homo sapien
cctgtacagccacagaatgaggatc

SEQ ID NO: 146891 - DNA, 25 bp, Homo sapien
tgcgccgtacttccagcagctgcgg

SEQ ID NO: 146892 - DNA, 25 bp, Homo sapien
cctgagagagcacgctgcgccgtac

SEQ ID NO: 146893 - DNA, 25 bp, Homo sapien
tacagccacagaatgaggatcttga

SEQ ID NO: 146894 - DNA, 25 bp, Homo sapien
tgatgaggcgctcttgatgtgattc

SEQ ID NO: 146895 - DNA, 25 bp, Homo sapien
ttcgactcaggtatgcggcagttgg

SEQ ID NO: 146896 - DNA, 25 bp, Homo sapien
gccgagcatggagtaccaggtatca

SEQ ID NO: 146897 - DNA, 25 bp, Homo sapien
cgctgagccgcagaacatccgggct

SEQ ID NO: 146898 - DNA, 25 bp, Homo sapien
cctcaccaggatggtgcacgcggaa

SEQ ID NO: 146899 - DNA, 25 bp, Homo sapien
ctgcgcgcggcataacgacccaggt

SEQ ID NO: 146900 - DNA, 25 bp, Homo sapien
ctctattcctggcagcggcgtctgc

SEQ ID NO: 146901 - DNA, 25 bp, Homo sapien
gacgaaaggagtgcgtgcccgctaa

SEQ ID NO: 146902 - DNA, 25 bp, Homo sapien
gagcgtacactcataaacctggtcc

SEQ ID NO: 146903 - DNA, 25 bp, Homo sapien
ctgggaattcggagactatagcgtc

SEQ ID NO: 146904 - DNA, 25 bp, Homo sapien
gctgggccttatcctgtgtccagtg

SEQ ID NO: 146905 - DNA, 25 bp, Homo sapien
tgcgctgggccttatcctgtgtcca

SEQ ID NO: 146906 - DNA, 25 bp, Homo sapien
ggcctgtgcgctgggccttatcctg

SEQ ID NO: 146907 - DNA, 25 bp, Homo sapien
ccgcggtccatgctgtccacgtggg

SEQ ID NO: 146908 - DNA, 25 bp, Homo sapien
gtgccgcggtccatgctgtccacgt

SEQ ID NO: 146909 - DNA, 25 bp, Homo sapien
gggctggagttgctgtccgaaggat

SEQ ID NO: 146910 - DNA, 25 bp, Homo sapien
gtcaggagaagtggacacagggacg

SEQ ID NO: 146911 - DNA, 25 bp, Homo sapien
gcgtgggctcgcacggggacccgag

SEQ ID NO: 146912 - DNA, 25 bp, Homo sapien
ggcgacaccgcacccggcaccgtgt

SEQ ID NO: 146913 - DNA, 25 bp, Homo sapien
tttataaggctgtcagcgcgcggca

SEQ ID NO: 146914 - DNA, 25 bp, Homo sapien
ggcgactatttataaggctgtcagc

SEQ ID NO: 146915 - DNA, 25 bp, Homo sapien
cggcaaaggcgactatttataaggc

SEQ ID NO: 146916 - DNA, 25 bp, Homo sapien
gcggccggcaaaggcgactatttat

SEQ ID NO: 146917 - DNA, 25 bp, Homo sapien
cggatcacaaccacggatacacagc

SEQ ID NO: 146918 - DNA, 25 bp, Homo sapien
gggaacacagccacgcaaacacaca

SEQ ID NO: 146919 - DNA, 25 bp, Homo sapien
cacacggatcacaaccacggataca

SEQ ID NO: 146920 - DNA, 25 bp, Homo sapien
cccagaagatgaacacggtttcagg

SEQ ID NO: 146921 - DNA, 25 bp, Homo sapien
cccggaagaggtcgtcaaattgccg

SEQ ID NO: 146922 - DNA, 25 bp, Homo sapien
caaattgccgcatgcggccgggaga

SEQ ID NO: 146923 - DNA, 25 bp, Homo sapien
tggatcacacgcacgaggctgccct

SEQ ID NO: 146924 - DNA, 25 bp, Homo sapien
caggggtccggttgacaaactcctg

SEQ ID NO: 146925 - DNA, 25 bp, Homo sapien
tcagcacgcggaacacactggaatg

SEQ ID NO: 146926 - DNA, 25 bp, Homo sapien
acacactggaatgggccacgacgcg

SEQ ID NO: 146927 - DNA, 25 bp, Homo sapien
acggcatatgcttccatgttgggga

SEQ ID NO: 146928 - DNA, 25 bp, Homo sapien
ggagtcctcccgcagatcgggacgc

SEQ ID NO: 146929 - DNA, 25 bp, Homo sapien
tcagcccaaggctggacgtgcaggc

SEQ ID NO: 146930 - DNA, 25 bp, Homo sapien
ggggctcctaaatccaagacgatgc

SEQ ID NO: 146931 - DNA, 25 bp, Homo sapien
aatccaagacgatgcgggacgctga

SEQ ID NO: 146932 - DNA, 25 bp, Homo sapien
ctgagcccgtgcgtccacctggtgg

SEQ ID NO: 146933 - DNA, 25 bp, Homo sapien
gagccctaaccccagctgggaagaa

SEQ ID NO: 146934 - DNA, 25 bp, Homo sapien
ggcgattagcaatctcctctcccgg

SEQ ID NO: 146935 - DNA, 25 bp, Homo sapien
ggccaggagcatggactcagcccaa

SEQ ID NO: 146936 - DNA, 25 bp, Homo sapien
tgcccgtctcgtcctggaagatctg

SEQ ID NO: 146937 - DNA, 25 bp, Homo sapien
gcgcctggttcatgcggaacacgca

SEQ ID NO: 146938 - DNA, 25 bp, Homo sapien
cacgcttgtgtgtgagacgacacgc

SEQ ID NO: 146939 - DNA, 25 bp, Homo sapien
gcactcggcactgtcgatctcagca

SEQ ID NO: 146940 - DNA, 25 bp, Homo sapien
tgtctcgggccttctggaagtagtg

SEQ ID NO: 146941 - DNA, 25 bp, Homo sapien
cccacaccatgtagagcgtgtctcg

SEQ ID NO: 146942 - DNA, 25 bp, Homo sapien
ccatcatgcgctccgtgaaggtgta

SEQ ID NO: 146943 - DNA, 25 bp, Homo sapien
atctggtcgcagtaggccatcatgc

SEQ ID NO: 146944 - DNA, 25 bp, Homo sapien
cttttcggtcctgccgaatttccag

SEQ ID NO: 146945 - DNA, 25 bp, Homo sapien
ggcggagtctgagtaccagcatctc

SEQ ID NO: 146946 - DNA, 25 bp, Homo sapien
caggcggatcctacgagcgcggcct

SEQ ID NO: 146947 - DNA, 25 bp, Homo sapien
gttcgcaggaggctcgcgatccgcc

SEQ ID NO: 146948 - DNA, 25 bp, Homo sapien
cggccgaatgctaaccgggcgtgca

SEQ ID NO: 146949 - DNA, 25 bp, Homo sapien
ctgccgaatttccagcaggctcctg

SEQ ID NO: 146950 - DNA, 25 bp, Homo sapien
ttcaccgcccttccagattccactg

SEQ ID NO: 146951 - DNA, 25 bp, Homo sapien
atctcccggccgaatgctaaccggg

SEQ ID NO: 146952 - DNA, 25 bp, Homo sapien
attagttaggggatgctgccctctg

SEQ ID NO: 146953 - DNA, 25 bp, Homo sapien
ctctggcgaccatcaggaggaagcg

SEQ ID NO: 146954 - DNA, 25 bp, Homo sapien
aaccggcgttcctggcgtgagccca

SEQ ID NO: 146955 - DNA, 25 bp, Homo sapien
tgagcccatcgtccagatccggaga

SEQ ID NO: 146956 - DNA, 25 bp, Homo sapien
tccacccactggcagaggcgacggg

SEQ ID NO: 146957 - DNA, 25 bp, Homo sapien
agcccgtagactgtggcgagatcca

SEQ ID NO: 146958 - DNA, 25 bp, Homo sapien
cgacgcccaggaaatagcgctgctc

SEQ ID NO: 146959 - DNA, 25 bp, Homo sapien
gactgcgcggttacggtattagtta

SEQ ID NO: 146960 - DNA, 25 bp, Homo sapien
aacccggggtgcatccggcgccaat

SEQ ID NO: 146961 - DNA, 25 bp, Homo sapien
gcttaggccactcacctctcggaga

SEQ ID NO: 146962 - DNA, 25 bp, Homo sapien
ctgtgcacgtggatctcgctcccag

SEQ ID NO: 146963 - DNA, 25 bp, Homo sapien
cttccttggctggtccggatcccga

SEQ ID NO: 146964 - DNA, 25 bp, Homo sapien
tctgcatgacgatgaagtacgtctg

SEQ ID NO: 146965 - DNA, 25 bp, Homo sapien
cggggtagaagacgctctgcatgac

SEQ ID NO: 146966 - DNA, 25 bp, Homo sapien
actcacctctcggagatgcggccgg

SEQ ID NO: 146967 - DNA, 25 bp, Homo sapien
gtatatgatgacctaggacccgccc

SEQ ID NO: 146968 - DNA, 25 bp, Homo sapien
ggttttggtcacttggatactcgca

SEQ ID NO: 146969 - DNA, 25 bp, Homo sapien
ccaggaccagagaacacgggacacc

SEQ ID NO: 146970 - DNA, 25 bp, Homo sapien
cagcctaaaggaggagttggccctg

SEQ ID NO: 146971 - DNA, 25 bp, Homo sapien
cctgtgtcaggtatcgaggagtctc

SEQ ID NO: 146972 - DNA, 25 bp, Homo sapien
agcgacgctccctggcagatgcaca

SEQ ID NO: 146973 - DNA, 25 bp, Homo sapien
ggagctgaagtacacgcaatgcgca

SEQ ID NO: 146974 - DNA, 25 bp, Homo sapien
acagggaacttgacccgttagcagc

SEQ ID NO: 146975 - DNA, 25 bp, Homo sapien
ggtcgcggacgaaagtgataaaatc

SEQ ID NO: 146976 - DNA, 25 bp, Homo sapien
caggttcacacacacagcatcgtgg

SEQ ID NO: 146977 - DNA, 25 bp, Homo sapien
acccaggttcacacggaacgtcgtg

SEQ ID NO: 146978 - DNA, 25 bp, Homo sapien
acccaggttcacatggagcatcatg

SEQ ID NO: 146979 - DNA, 25 bp, Homo sapien
ggcacacccaggttcacatggaacg

SEQ ID NO: 146980 - DNA, 25 bp, Homo sapien
tcgtggaacgacacacccaggttca

SEQ ID NO: 146981 - DNA, 25 bp, Homo sapien
ggcacacccaggttcacacggaacg

SEQ ID NO: 146982 - DNA, 25 bp, Homo sapien
tggaaggacacacccaggttcacac

SEQ ID NO: 146983 - DNA, 25 bp, Homo sapien
acacggaacgtcatggaagggcaca

SEQ ID NO: 146984 - DNA, 25 bp, Homo sapien
atggcgccgactgcggctgcatcca

SEQ ID NO: 146985 - DNA, 25 bp, Homo sapien
cagcttcccgggctttggccgcatt

SEQ ID NO: 146986 - DNA, 25 bp, Homo sapien
ccgaccaatagcatggcgccgactg

SEQ ID NO: 146987 - DNA, 25 bp, Homo sapien
tacctcgcggccgaccaatagcatg

SEQ ID NO: 146988 - DNA, 25 bp, Homo sapien
gaccaatagcatggcgccgactgcg

SEQ ID NO: 146989 - DNA, 25 bp, Homo sapien
ctcgcggccgaccaatagcatggcg

SEQ ID NO: 146990 - DNA, 25 bp, Homo sapien
gcatccaatccacgcgggaggcgct

SEQ ID NO: 146991 - DNA, 25 bp, Homo sapien
gccgccggacattggctggggtccc

SEQ ID NO: 146992 - DNA, 25 bp, Homo sapien
tcaacagatggtagagggctgacta

SEQ ID NO: 146993 - DNA, 25 bp, Homo sapien
gtctaagcttcccattcaacagatg

SEQ ID NO: 146994 - DNA, 25 bp, Homo sapien
gcggcccgatcacggtctaagcttc

SEQ ID NO: 146995 - DNA, 25 bp, Homo sapien
ggcacacggtgccaatctcaccatt

SEQ ID NO: 146996 - DNA, 25 bp, Homo sapien
gaccctctatttcggcgcactaatg

SEQ ID NO: 146997 - DNA, 25 bp, Homo sapien
cctccgcgttgtcgtccgtacaata

SEQ ID NO: 146998 - DNA, 25 bp, Homo sapien
tctcagctgacgaagtgaccctcta

SEQ ID NO: 146999 - DNA, 25 bp, Homo sapien
ggagagaatgctaggcctccgcgtt

SEQ ID NO: 147000 - DNA, 25 bp, Homo sapien
gccagatcatcttccacgcttcttc

SEQ ID NO: 147001 - DNA, 25 bp, Homo sapien
ccaccactcacaggccggctgctcc

SEQ ID NO: 147002 - DNA, 25 bp, Homo sapien
gacgccacgttcctcagggaagcca

SEQ ID NO: 147003 - DNA, 25 bp, Homo sapien
caaagagatgttgggccagatcatc

SEQ ID NO: 147004 - DNA, 25 bp, Homo sapien
agctccgagataggaacgcggtccc

SEQ ID NO: 147005 - DNA, 25 bp, Homo sapien
gcttcttcagctccgagataggaac

SEQ ID NO: 147006 - DNA, 25 bp, Homo sapien
cccttcctctgagaacaaagagatg

SEQ ID NO: 147007 - DNA, 25 bp, Homo sapien
atccggtctcactgggacgccacgt

SEQ ID NO: 147008 - DNA, 25 bp, Homo sapien
ctggtggcaagctggatgccgctca

SEQ ID NO: 147009 - DNA, 25 bp, Homo sapien
atgccgctcagcgtggcagagccat

SEQ ID NO: 147010 - DNA, 25 bp, Homo sapien
ggctcacgaacagccggaggttgct

SEQ ID NO: 147011 - DNA, 25 bp, Homo sapien
tggcagagccatcgcggctcacgaa

SEQ ID NO: 147012 - DNA, 25 bp, Homo sapien
tggcatccgcatcgatccgcgtgtc

SEQ ID NO: 147013 - DNA, 25 bp, Homo sapien
gatcttctccacgatggcatccgca

SEQ ID NO: 147014 - DNA, 25 bp, Homo sapien
gtgaaatcctggctctgcacgatct

SEQ ID NO: 147015 - DNA, 25 bp, Homo sapien
tcaccctcggtgttgctgccatctg

SEQ ID NO: 147016 - DNA, 25 bp, Homo sapien
gagtgctctgtgctgtagcctgtca

SEQ ID NO: 147017 - DNA, 25 bp, Homo sapien
ctctgtgctgtagcctgtcaggggc

SEQ ID NO: 147018 - DNA, 25 bp, Homo sapien
agtgctctgtgctgtagcctgtcag

SEQ ID NO: 147019 - DNA, 25 bp, Homo sapien
gcgagtgctctgtgctgtagcctgt

SEQ ID NO: 147020 - DNA, 25 bp, Homo sapien
gcgcgagtgctctgtgctgtagcct

SEQ ID NO: 147021 - DNA, 25 bp, Homo sapien
cggtgcgtcaggtctgagaggctgg

SEQ ID NO: 147022 - DNA, 25 bp, Homo sapien
cgtgttgcggcggtgcgtcaggtct

SEQ ID NO: 147023 - DNA, 25 bp, Homo sapien
tgctctgtgctgtagcctgtcaggg

SEQ ID NO: 147024 - DNA, 25 bp, Homo sapien
cgccgcttggagaatgcctgggccc

SEQ ID NO: 147025 - DNA, 25 bp, Homo sapien
atcccgccctgatggtggcggagac

SEQ ID NO: 147026 - DNA, 25 bp, Homo sapien
caggtctgagagatccaccagtcca

SEQ ID NO: 147027 - DNA, 25 bp, Homo sapien
agatccaccagtccagttcgcgggc

SEQ ID NO: 147028 - DNA, 25 bp, Homo sapien
ggccggggacctcaccggcatgtaa

SEQ ID NO: 147029 - DNA, 25 bp, Homo sapien
catgtaaacagcagggcatggccca

SEQ ID NO: 147030 - DNA, 25 bp, Homo sapien
ttgcagcatcccgagacgcgatgtc

SEQ ID NO: 147031 - DNA, 25 bp, Homo sapien
cagccagagcccgatgctgcgaggc

SEQ ID NO: 147032 - DNA, 25 bp, Homo sapien
tcccgcagtctaaacagagttagtt

SEQ ID NO: 147033 - DNA, 25 bp, Homo sapien
tcgcctgatcattggtctaaaattg

SEQ ID NO: 147034 - DNA, 25 bp, Homo sapien
gagcacgcctgcttactgtaattcg

SEQ ID NO: 147035 - DNA, 25 bp, Homo sapien
tctaaaattgtgtccgtcgcccaga

SEQ ID NO: 147036 - DNA, 25 bp, Homo sapien
tacttagtgctttcggccgtgaccc

SEQ ID NO: 147037 - DNA, 25 bp, Homo sapien
gcctcgcaactgcagttcacaaatg

SEQ ID NO: 147038 - DNA, 25 bp, Homo sapien
ctgtttcccactggaggctacgatc

SEQ ID NO: 147039 - DNA, 25 bp, Homo sapien
catcaatggaaactggacacggggc

SEQ ID NO: 147040 - DNA, 25 bp, Homo sapien
aagggaaccctcagcgctctcggga

SEQ ID NO: 147041 - DNA, 25 bp, Homo sapien
cgctcgggaacgtttgcagaccgtt

SEQ ID NO: 147042 - DNA, 25 bp, Homo sapien
tgcttccgcctccaaaggctcttgg

SEQ ID NO: 147043 - DNA, 25 bp, Homo sapien
tacgggcgcccattcaaaacaactc

SEQ ID NO: 147044 - DNA, 25 bp, Homo sapien
tccagcccttcctagagtcagtaca

SEQ ID NO: 147045 - DNA, 25 bp, Homo sapien
gcttcctactgtgacccgaaccata

SEQ ID NO: 147046 - DNA, 25 bp, Homo sapien
tctgatttcgcccacgcgaagcggc

SEQ ID NO: 147047 - DNA, 25 bp, Homo sapien
ggccttggaaaccacgtgtctctga

SEQ ID NO: 147048 - DNA, 25 bp, Homo sapien
tccaccttccatccggcgccggctt

SEQ ID NO: 147049 - DNA, 25 bp, Homo sapien
ggctgctggagcaaccttgcatttt

SEQ ID NO: 147050 - DNA, 25 bp, Homo sapien
gcggagatctgctgccgcgttctac

SEQ ID NO: 147051 - DNA, 25 bp, Homo sapien
cgcgttccatcgtcgcgcggccctt

SEQ ID NO: 147052 - DNA, 25 bp, Homo sapien
ctttcggcgcgacggtcgccgcgtt

SEQ ID NO: 147053 - DNA, 25 bp, Homo sapien
accttgcattttcagggctgccctc

SEQ ID NO: 147054 - DNA, 25 bp, Homo sapien
gtctcggaagggaacaaagagccca

SEQ ID NO: 147055 - DNA, 25 bp, Homo sapien
cggcccgtgttctatccgccgcctc

SEQ ID NO: 147056 - DNA, 25 bp, Homo sapien
gcgcagttggcggatgtacattcat

SEQ ID NO: 147057 - DNA, 25 bp, Homo sapien
aacccggtcaccgtggtcctgagct

SEQ ID NO: 147058 - DNA, 25 bp, Homo sapien
agctccgtgggacggcttctctcca

SEQ ID NO: 147059 - DNA, 25 bp, Homo sapien
cagacacagccagctcgcaggcgga

SEQ ID NO: 147060 - DNA, 25 bp, Homo sapien
aggctcggagaccaaggtccgtctg

SEQ ID NO: 147061 - DNA, 25 bp, Homo sapien
gtacattcattcgagggacccaggc

SEQ ID NO: 147062 - DNA, 25 bp, Homo sapien
gtgtcaataacatcggcacccgtcc

SEQ ID NO: 147063 - DNA, 25 bp, Homo sapien
cctgtgggctcgtaaggcccaaatg

SEQ ID NO: 147064 - DNA, 25 bp, Homo sapien
tttggtcggttgtagtggcctcgcc

SEQ ID NO: 147065 - DNA, 25 bp, Homo sapien
gtgacacgatccctgtgaccgtctg

SEQ ID NO: 147066 - DNA, 25 bp, Homo sapien
ctgtgaccgtctggcccggtaaccg

SEQ ID NO: 147067 - DNA, 25 bp, Homo sapien
agcctcgcgagaccgctgtctacgg

SEQ ID NO: 147068 - DNA, 25 bp, Homo sapien
agaccgctgtctacggcgctgacgc

SEQ ID NO: 147069 - DNA, 25 bp, Homo sapien
actccaggaaagacgagtgcgctta

SEQ ID NO: 147070 - DNA, 25 bp, Homo sapien
tgaacaaactagttccgggcggagc

SEQ ID NO: 147071 - DNA, 25 bp, Homo sapien
gctgattggtccgagcctcgcctgc

SEQ ID NO: 147072 - DNA, 25 bp, Homo sapien
cccgcccttgacgtcagagtgtttc

SEQ ID NO: 147073 - DNA, 25 bp, Homo sapien
tgcctgggctgccaatctgcagcga

SEQ ID NO: 147074 - DNA, 25 bp, Homo sapien
ctttcccgggatgtgttggcatgag

SEQ ID NO: 147075 - DNA, 25 bp, Homo sapien
tgtttctccgcaagagcccgtgtcc

SEQ ID NO: 147076 - DNA, 25 bp, Homo sapien
gcagttccataaagccactcaggta

SEQ ID NO: 147077 - DNA, 25 bp, Homo sapien
cggtgggagattatgtaaagtcgcc

SEQ ID NO: 147078 - DNA, 25 bp, Homo sapien
taaagtcgcctcttcacgggtgacc

SEQ ID NO: 147079 - DNA, 25 bp, Homo sapien
tggaagcccagcaagtcacctgagt

SEQ ID NO: 147080 - DNA, 25 bp, Homo sapien
ctaactcaacctggactagtcgtgg

SEQ ID NO: 147081 - DNA, 25 bp, Homo sapien
ggcagcagaattcgcgcgtccataa

SEQ ID NO: 147082 - DNA, 25 bp, Homo sapien
ctaggacttagaggcgcgaaagtga

SEQ ID NO: 147083 - DNA, 25 bp, Homo sapien
ctagtcgtggaagagctaggactta

SEQ ID NO: 147084 - DNA, 25 bp, Homo sapien
ggcggctgaggagcctaactcaacc

SEQ ID NO: 147085 - DNA, 25 bp, Homo sapien
cgctccaaagctctggactggctct

SEQ ID NO: 147086 - DNA, 25 bp, Homo sapien
acgagcgccgctccaaagctctgga

SEQ ID NO: 147087 - DNA, 25 bp, Homo sapien
gcgtccataaatcactgcagtcatg

SEQ ID NO: 147088 - DNA, 25 bp, Homo sapien
aaccggctgcaagacgccttctctg

SEQ ID NO: 147089 - DNA, 25 bp, Homo sapien
ccgcatcccagtccctagaagagga

SEQ ID NO: 147090 - DNA, 25 bp, Homo sapien
cccgctagtctgcaaacgtcgtcaa

SEQ ID NO: 147091 - DNA, 25 bp, Homo sapien
caaccgcggcatggaagatctcatc

SEQ ID NO: 147092 - DNA, 25 bp, Homo sapien
catcctttagggcagacaacgctct

SEQ ID NO: 147093 - DNA, 25 bp, Homo sapien
ggcatggagagagcccgcattactc

SEQ ID NO: 147094 - DNA, 25 bp, Homo sapien
attactcagcgtctccgttgggctc

SEQ ID NO: 147095 - DNA, 25 bp, Homo sapien
tcgagaatttcgtaggcaggtaggc

SEQ ID NO: 147096 - DNA, 25 bp, Homo sapien
gactgccactttcgccctgagattt

SEQ ID NO: 147097 - DNA, 25 bp, Homo sapien
ccgccctaacctctaagaatcattt

SEQ ID NO: 147098 - DNA, 25 bp, Homo sapien
gtctactcgccgcacggtgaggacc

SEQ ID NO: 147099 - DNA, 25 bp, Homo sapien
aacaagggcatctcgccggtgccta

SEQ ID NO: 147100 - DNA, 25 bp, Homo sapien
tgcctctgcatcatcctattccaag

SEQ ID NO: 147101 - DNA, 25 bp, Homo sapien
attttcttggccacgcacctctgcg

SEQ ID NO: 147102 - DNA, 25 bp, Homo sapien
agggtcaccggcaccaacaagggca

SEQ ID NO: 147103 - DNA, 25 bp, Homo sapien
ccttgagatcgaggccgagaccgac

SEQ ID NO: 147104 - DNA, 25 bp, Homo sapien
gccgcactaaggagcaggtgagccc

SEQ ID NO: 147105 - DNA, 25 bp, Homo sapien
tgaccacccacatccgggagcgcga

SEQ ID NO: 147106 - DNA, 25 bp, Homo sapien
tggagcgcatcgtgaccacccacat

SEQ ID NO: 147107 - DNA, 25 bp, Homo sapien
ggagatggagcgcatcgtgaccacc

SEQ ID NO: 147108 - DNA, 25 bp, Homo sapien
tacccgcggctacgggaggagatgg

SEQ ID NO: 147109 - DNA, 25 bp, Homo sapien
tgccctctgtgtacgtggctttctg

SEQ ID NO: 147110 - DNA, 25 bp, Homo sapien
cctctgtgtacgtggctttctgccc

SEQ ID NO: 147111 - DNA, 25 bp, Homo sapien
ccagctccagcagtacccgcggcta

SEQ ID NO: 147112 - DNA, 25 bp, Homo sapien
tcaccggggtggctcccacctggag

SEQ ID NO: 147113 - DNA, 25 bp, Homo sapien
gtaccacgcactgaaggaggcgctc

SEQ ID NO: 147114 - DNA, 25 bp, Homo sapien
gggcggagctgctcatctcgcctct

SEQ ID NO: 147115 - DNA, 25 bp, Homo sapien
tggccgccagaaccggccgtttcta

SEQ ID NO: 147116 - DNA, 25 bp, Homo sapien
cggccgtttctatcccaggcaatcg

SEQ ID NO: 147117 - DNA, 25 bp, Homo sapien
ttctatcccaggcaatcggactctg

SEQ ID NO: 147118 - DNA, 25 bp, Homo sapien
atcggactctgggtgccggagccac

SEQ ID NO: 147119 - DNA, 25 bp, Homo sapien
gatgctgcgcatgtaccacgcactg

SEQ ID NO: 147120 - DNA, 25 bp, Homo sapien
cccggcaaccactgcggaagtcagt

SEQ ID NO: 147121 - DNA, 25 bp, Homo sapien
gtcctaggtccttggagacgccagc

SEQ ID NO: 147122 - DNA, 25 bp, Homo sapien
cgctggaccctcttgcgccattgaa

SEQ ID NO: 147123 - DNA, 25 bp, Homo sapien
ttcacactccgggtcagagttcctg

SEQ ID NO: 147124 - DNA, 25 bp, Homo sapien
gcagctttctgtgcgccagttcaca

SEQ ID NO: 147125 - DNA, 25 bp, Homo sapien
tggcctcaaagatcaaagcccattg

SEQ ID NO: 147126 - DNA, 25 bp, Homo sapien
cttcgctgcggccaatttgctctgt

SEQ ID NO: 147127 - DNA, 25 bp, Homo sapien
ctgtggcgtcacaacaaaagctgcg

SEQ ID NO: 147128 - DNA, 25 bp, Homo sapien
agccggaagaggttcgcattttata

SEQ ID NO: 147129 - DNA, 25 bp, Homo sapien
gctacgccgtcagaatcggtttttc

SEQ ID NO: 147130 - DNA, 25 bp, Homo sapien
acggtagacagttcgcgtgcgtttc

SEQ ID NO: 147131 - DNA, 25 bp, Homo sapien
gccgccatgttccacagccggaaga

SEQ ID NO: 147132 - DNA, 25 bp, Homo sapien
tacttgaagatcacagcacccgctg

SEQ ID NO: 147133 - DNA, 25 bp, Homo sapien
atcccgcaggtgcttccattttagc

SEQ ID NO: 147134 - DNA, 25 bp, Homo sapien
ttgtagctccactgtatcccgcagg

SEQ ID NO: 147135 - DNA, 25 bp, Homo sapien
ttctgcccgtgaagcgatgtttccc

SEQ ID NO: 147136 - DNA, 25 bp, Homo sapien
agccgacgccgggtgagcatagacc

SEQ ID NO: 147137 - DNA, 25 bp, Homo sapien
acgcactgttaccttgctgtctagg

SEQ ID NO: 147138 - DNA, 25 bp, Homo sapien
tgctcttcctacatccgggcgctgg

SEQ ID NO: 147139 - DNA, 25 bp, Homo sapien
gtggactggggtgctcttcctacat

SEQ ID NO: 147140 - DNA, 25 bp, Homo sapien
tgctgggtgtttgctgaactcggcc

SEQ ID NO: 147141 - DNA, 25 bp, Homo sapien
cttagcgagcttctaggtgtggtgc

SEQ ID NO: 147142 - DNA, 25 bp, Homo sapien
tgaaaccgccctcttagcgagcttc

SEQ ID NO: 147143 - DNA, 25 bp, Homo sapien
cagagccggctaaaccctgctgaga

SEQ ID NO: 147144 - DNA, 25 bp, Homo sapien
gctcggcttcctcaacatggctgcg

SEQ ID NO: 147145 - DNA, 25 bp, Homo sapien
atggattgaagtcgtcgggcccaga

SEQ ID NO: 147146 - DNA, 25 bp, Homo sapien
cacggccgaatcactgggtgtccca

SEQ ID NO: 147147 - DNA, 25 bp, Homo sapien
aatgctctctgtgtaccactcggtg

SEQ ID NO: 147148 - DNA, 25 bp, Homo sapien
cgcacattgggagggaaatgctctc

SEQ ID NO: 147149 - DNA, 25 bp, Homo sapien
gctacccgcctaggagagtctgaga

SEQ ID NO: 147150 - DNA, 25 bp, Homo sapien
agaggccagtctctcttggcagtga

SEQ ID NO: 147151 - DNA, 25 bp, Homo sapien
ccgtctgtccggaaatagaggcgca

SEQ ID NO: 147152 - DNA, 25 bp, Homo sapien
cttcttcgggcagtgtcgccgtcca

SEQ ID NO: 147153 - DNA, 25 bp, Homo sapien
cagcccatgggaccgtagtcgcgga

SEQ ID NO: 147154 - DNA, 25 bp, Homo sapien
gctaggtatggtcgggctgttttcc

SEQ ID NO: 147155 - DNA, 25 bp, Homo sapien
gcggcaggagagagtaccgacctcc

SEQ ID NO: 147156 - DNA, 25 bp, Homo sapien
tccagcctggttgttgaagcgtccc

SEQ ID NO: 147157 - DNA, 25 bp, Homo sapien
tcgccgtccagcctggttgttgaag

SEQ ID NO: 147158 - DNA, 25 bp, Homo sapien
atggtcgggctgttttcccactgtc

SEQ ID NO: 147159 - DNA, 25 bp, Homo sapien
caggagagagtaccgacctccctcg

SEQ ID NO: 147160 - DNA, 25 bp, Homo sapien
tggccgcagactcgtacaagaattg

SEQ ID NO: 147161 - DNA, 25 bp, Homo sapien
ctctccgctttcctgtggctgagtc

SEQ ID NO: 147162 - DNA, 25 bp, Homo sapien
tggactagcaagcacgcggatcctg

SEQ ID NO: 147163 - DNA, 25 bp, Homo sapien
ggaccacctagcaggcgctcagcag

SEQ ID NO: 147164 - DNA, 25 bp, Homo sapien
cgtttggacaatcagtggcgaagcc

SEQ ID NO: 147165 - DNA, 25 bp, Homo sapien
ccacaattctcggttggccgcagac

SEQ ID NO: 147166 - DNA, 25 bp, Homo sapien
cagccacagatgtccagccacaatt

SEQ ID NO: 147167 - DNA, 25 bp, Homo sapien
aacgacgcgatcgactgaaggaccc

SEQ ID NO: 147168 - DNA, 25 bp, Homo sapien
agacctcgccggtgaaagctcagcc

SEQ ID NO: 147169 - DNA, 25 bp, Homo sapien
cggtgaaagctcagcctatggcatc

SEQ ID NO: 147170 - DNA, 25 bp, Homo sapien
tcagcctatggcatccgagcgtggc

SEQ ID NO: 147171 - DNA, 25 bp, Homo sapien
gccaagtttacacgaatgttgaaac

SEQ ID NO: 147172 - DNA, 25 bp, Homo sapien
tgttgaaacttctcctcacggggtg

SEQ ID NO: 147173 - DNA, 25 bp, Homo sapien
gtgcgcactgctgggccgcttcact

SEQ ID NO: 147174 - DNA, 25 bp, Homo sapien
accgcaggcctacgggagtccagct

SEQ ID NO: 147175 - DNA, 25 bp, Homo sapien
gggagtccagcttagacccgccggc

SEQ ID NO: 147176 - DNA, 25 bp, Homo sapien
cctgctctgtatcgccggacaggta

SEQ ID NO: 147177 - DNA, 25 bp, Homo sapien
cccttctgcggacctagtgaacttc

SEQ ID NO: 147178 - DNA, 25 bp, Homo sapien
gtttaggcttgacccagcttcctgg

SEQ ID NO: 147179 - DNA, 25 bp, Homo sapien
cgggtcgatctctgcgtttaggctt

SEQ ID NO: 147180 - DNA, 25 bp, Homo sapien
cccggggactctgcttctaaagcct

SEQ ID NO: 147181 - DNA, 25 bp, Homo sapien
tcgagccaagacaagcagcacattc

SEQ ID NO: 147182 - DNA, 25 bp, Homo sapien
tgtcctggcttttcgcccttacctg

SEQ ID NO: 147183 - DNA, 25 bp, Homo sapien
aggtgctctcttccgcgaaggtcca

SEQ ID NO: 147184 - DNA, 25 bp, Homo sapien
tggtccttgccatcctggcccgcaa

SEQ ID NO: 147185 - DNA, 25 bp, Homo sapien
tcctggcccgcaatgccgaacactc

SEQ ID NO: 147186 - DNA, 25 bp, Homo sapien
acttgagcatccacgcacaggggtg

SEQ ID NO: 147187 - DNA, 25 bp, Homo sapien
gagagaaaacttgagcatccacgca

SEQ ID NO: 147188 - DNA, 25 bp, Homo sapien
ccgggccaaggagagaaaacttgag

SEQ ID NO: 147189 - DNA, 25 bp, Homo sapien
ggttcaacgcccaggggttccatga

SEQ ID NO: 147190 - DNA, 25 bp, Homo sapien
gaccgacgcaaggaggtgacgcaca

SEQ ID NO: 147191 - DNA, 25 bp, Homo sapien
ggatcccactctgagggtgcactgc

SEQ ID NO: 147192 - DNA, 25 bp, Homo sapien
aacactattggtcctctcgggcatc

SEQ ID NO: 147193 - DNA, 25 bp, Homo sapien
tcgggcctccacatggcagtcactt

SEQ ID NO: 147194 - DNA, 25 bp, Homo sapien
tctatgggcagaaaccggtaccctc

SEQ ID NO: 147195 - DNA, 25 bp, Homo sapien
agggcttcacctttctctctatggg

SEQ ID NO: 147196 - DNA, 25 bp, Homo sapien
ggcctccgacttcaacgacttcata

SEQ ID NO: 147197 - DNA, 25 bp, Homo sapien
agcccggcgtctatcctgctcagaa

SEQ ID NO: 147198 - DNA, 25 bp, Homo sapien
ggcagtcacttgtacgccctccgta

SEQ ID NO: 147199 - DNA, 25 bp, Homo sapien
tcgatggcgaaacccaagcggctcc

SEQ ID NO: 147200 - DNA, 25 bp, Homo sapien
ttgaaggccctacgcagttccgaca

SEQ ID NO: 147201 - DNA, 25 bp, Homo sapien
gaaaccttctccctagccgttggca

SEQ ID NO: 147202 - DNA, 25 bp, Homo sapien
cgcagttccgacaaaggtcgccttt

SEQ ID NO: 147203 - DNA, 25 bp, Homo sapien
cctttgctactaccgcgactggctg

SEQ ID NO: 147204 - DNA, 25 bp, Homo sapien
cttagccaaccatgccgtctgaggg

SEQ ID NO: 147205 - DNA, 25 bp, Homo sapien
gcgtcccggaagcagaagcctgtgt

SEQ ID NO: 147206 - DNA, 25 bp, Homo sapien
tgattcgagggcttgtttggtcaga

SEQ ID NO: 147207 - DNA, 25 bp, Homo sapien
agcggtggttacctctgcggaacgt

SEQ ID NO: 147208 - DNA, 25 bp, Homo sapien
ggagcgtctctaccgccagggcgta

SEQ ID NO: 147209 - DNA, 25 bp, Homo sapien
ccagggcgtaggcagtgacctcact

SEQ ID NO: 147210 - DNA, 25 bp, Homo sapien
gcattgtcgcttcggctccttccgg

SEQ ID NO: 147211 - DNA, 25 bp, Homo sapien
ggagcgcgcgtagccgcttataaaa

SEQ ID NO: 147212 - DNA, 25 bp, Homo sapien
gccactacccgctgcggagtgaacg

SEQ ID NO: 147213 - DNA, 25 bp, Homo sapien
gccgccgctggaatgtcactgacgg

SEQ ID NO: 147214 - DNA, 25 bp, Homo sapien
ggggctccctcgtcgggatcttcgc

SEQ ID NO: 147215 - DNA, 25 bp, Homo sapien
ggtgcgatgcagacgactgtccgca

SEQ ID NO: 147216 - DNA, 25 bp, Homo sapien
agcgcctcctgcaagacctggaaga

SEQ ID NO: 147217 - DNA, 25 bp, Homo sapien
tgaccggttttgcataccctgtccc

SEQ ID NO: 147218 - DNA, 25 bp, Homo sapien
tctggctgagcagctgattcttcca

SEQ ID NO: 147219 - DNA, 25 bp, Homo sapien
ccaggttcaaagatggcgctgagca

SEQ ID NO: 147220 - DNA, 25 bp, Homo sapien
cgcgctactcctgggcgaggaaact

SEQ ID NO: 147221 - DNA, 25 bp, Homo sapien
agtaacgattcttctcggccagaga

SEQ ID NO: 147222 - DNA, 25 bp, Homo sapien
atgtttgaattggtcgcagcgcctc

SEQ ID NO: 147223 - DNA, 25 bp, Homo sapien
ccagagagagaagcatgaccggttt

SEQ ID NO: 147224 - DNA, 25 bp, Homo sapien
agtcagtaaaaaggagctcaactcc

SEQ ID NO: 147225 - DNA, 25 bp, Homo sapien
ttgtgctccgccatgatgcctcgct

SEQ ID NO: 147226 - DNA, 25 bp, Homo sapien
cctctctttattgtgctccgccatg

SEQ ID NO: 147227 - DNA, 25 bp, Homo sapien
tcccgagaagcctctctttattgtg

SEQ ID NO: 147228 - DNA, 25 bp, Homo sapien
gcccttttttgtgcgcggctgggct

SEQ ID NO: 147229 - DNA, 25 bp, Homo sapien
cacgacggggccgacgagacctcag

SEQ ID NO: 147230 - DNA, 25 bp, Homo sapien
cggccaaagtcagtaaaaaggagct

SEQ ID NO: 147231 - DNA, 25 bp, Homo sapien
tcggcgcccttttttgtgcgcggct

SEQ ID NO: 147232 - DNA, 25 bp, Homo sapien
ctttgggtacatagcgggttctaga

SEQ ID NO: 147233 - DNA, 25 bp, Homo sapien
tgcacagtctccaaatcagtccgcg

SEQ ID NO: 147234 - DNA, 25 bp, Homo sapien
cagagcagacctgatctccgggttc

SEQ ID NO: 147235 - DNA, 25 bp, Homo sapien
tcaagtttgaaagtcctggcggagg

SEQ ID NO: 147236 - DNA, 25 bp, Homo sapien
cagaatcccgcggaattttggatcc

SEQ ID NO: 147237 - DNA, 25 bp, Homo sapien
gcgatgtgcctcctgagcgtccaaa

SEQ ID NO: 147238 - DNA, 25 bp, Homo sapien
ctccaaggccgacgggaattagccg

SEQ ID NO: 147239 - DNA, 25 bp, Homo sapien
ccagagtgtccttaagtcggttctc

SEQ ID NO: 147240 - DNA, 25 bp, Homo sapien
gatgcgctccttcagcagatattta

SEQ ID NO: 147241 - DNA, 25 bp, Homo sapien
atgataagtcacatcgatgcgctcc

SEQ ID NO: 147242 - DNA, 25 bp, Homo sapien
cccgggaaaccggtccatgatgata

SEQ ID NO: 147243 - DNA, 25 bp, Homo sapien
tttattcaggtcttggctccacggc

SEQ ID NO: 147244 - DNA, 25 bp, Homo sapien
cgcatcagtgtgtgcctagagaccc

SEQ ID NO: 147245 - DNA, 25 bp, Homo sapien
gaagctgcgctgctgctagaacaga

SEQ ID NO: 147246 - DNA, 25 bp, Homo sapien
tgcgccgtcatgtttgctctccctg

SEQ ID NO: 147247 - DNA, 25 bp, Homo sapien
cgagttgtgcggttgcagatcacca

SEQ ID NO: 147248 - DNA, 25 bp, Homo sapien
ggaccctcaagccaacaggtgcctg

SEQ ID NO: 147249 - DNA, 25 bp, Homo sapien
ggctcaccggtatcgtgcaggaaga

SEQ ID NO: 147250 - DNA, 25 bp, Homo sapien
caggtcagcacggtgtgcccggtcc

SEQ ID NO: 147251 - DNA, 25 bp, Homo sapien
catctgcggccgaatggaccctcaa

SEQ ID NO: 147252 - DNA, 25 bp, Homo sapien
gccaacaggtgcctgaagaggctga

SEQ ID NO: 147253 - DNA, 25 bp, Homo sapien
taacttttgaaagcgccggagcgcg

SEQ ID NO: 147254 - DNA, 25 bp, Homo sapien
tccctgggcgcttcgaagatccagc

SEQ ID NO: 147255 - DNA, 25 bp, Homo sapien
aggctgcctattggatggcatctgc

SEQ ID NO: 147256 - DNA, 25 bp, Homo sapien
aggccacccgagagaacgcgtcatt

SEQ ID NO: 147257 - DNA, 25 bp, Homo sapien
ctgagcccaacactgctgaatagca

SEQ ID NO: 147258 - DNA, 25 bp, Homo sapien
caggcaaccgagcttccaaatggga

SEQ ID NO: 147259 - DNA, 25 bp, Homo sapien
aaggtgctcctaacctccatctagg

SEQ ID NO: 147260 - DNA, 25 bp, Homo sapien
acatgtcttgcgttctccacgggtg

SEQ ID NO: 147261 - DNA, 25 bp, Homo sapien
ccagcgccctgttgaacatgtcttg

SEQ ID NO: 147262 - DNA, 25 bp, Homo sapien
gaacgcgtcattcagggctctccct

SEQ ID NO: 147263 - DNA, 25 bp, Homo sapien
cccttagcaacagcgatcgggttcc

SEQ ID NO: 147264 - DNA, 25 bp, Homo sapien
cgccggaggcttttgcgcagagccc

SEQ ID NO: 147265 - DNA, 25 bp, Homo sapien
gttctcaaatttggcccgcagggtc

SEQ ID NO: 147266 - DNA, 25 bp, Homo sapien
gcccgcgattgccacgcccaccaga

SEQ ID NO: 147267 - DNA, 25 bp, Homo sapien
ccgtagccgccagtaccgtgtggaa

SEQ ID NO: 147268 - DNA, 25 bp, Homo sapien
ccgccagtaccgtgtggaagcgtga

SEQ ID NO: 147269 - DNA, 25 bp, Homo sapien
aacgcgcaggctagtggctgtgttt

SEQ ID NO: 147270 - DNA, 25 bp, Homo sapien
ctagtggctgtgtttcccgccggag

SEQ ID NO: 147271 - DNA, 25 bp, Homo sapien
tgtcaccggcgggttctcaaatttg

SEQ ID NO: 147272 - DNA, 25 bp, Homo sapien
ccgcagctagtgaggaccctgcact

SEQ ID NO: 147273 - DNA, 25 bp, Homo sapien
gcagagtctgcacacgccgggcagc

SEQ ID NO: 147274 - DNA, 25 bp, Homo sapien
ttacccaaacagacgagccggcgca

SEQ ID NO: 147275 - DNA, 25 bp, Homo sapien
tgcactcagcttacccaaacagacg

SEQ ID NO: 147276 - DNA, 25 bp, Homo sapien
tcgagctcgtgaatgttaccctaga

SEQ ID NO: 147277 - DNA, 25 bp, Homo sapien
ggtttcaagcgtgtcccttcccgca

SEQ ID NO: 147278 - DNA, 25 bp, Homo sapien
accatttgctgttgttggctgcggc

SEQ ID NO: 147279 - DNA, 25 bp, Homo sapien
tgcattcgctttcttctcgagctcg

SEQ ID NO: 147280 - DNA, 25 bp, Homo sapien
taccggcgtcttaaatgcgcaaaga

SEQ ID NO: 147281 - DNA, 25 bp, Homo sapien
cccggtcaggcatcgcagtgacatc

SEQ ID NO: 147282 - DNA, 25 bp, Homo sapien
tggacgacacgttctacctgagcaa

SEQ ID NO: 147283 - DNA, 25 bp, Homo sapien
acttccgcgaggacgactcggtgca

SEQ ID NO: 147284 - DNA, 25 bp, Homo sapien
cgcagctcaagagccgcgagtcgta

SEQ ID NO: 147285 - DNA, 25 bp, Homo sapien
ggcctcggtttgttcttctgcagaa

SEQ ID NO: 147286 - DNA, 25 bp, Homo sapien
ctgctgctcccttctgggttccgag

SEQ ID NO: 147287 - DNA, 25 bp, Homo sapien
cccttggcagtgtttgtgagtggaa

SEQ ID NO: 147288 - DNA, 25 bp, Homo sapien
gagagccaatatcgcccaggggcgt

SEQ ID NO: 147289 - DNA, 25 bp, Homo sapien
gaaagggctccggattcagcatccg

SEQ ID NO: 147290 - DNA, 25 bp, Homo sapien
gttgggcagagtaggtgtccaaata

SEQ ID NO: 147291 - DNA, 25 bp, Homo sapien
gctgtccaatcggagagccaatatc

SEQ ID NO: 147292 - DNA, 25 bp, Homo sapien
cacctccattaagctgtccaatcgg

SEQ ID NO: 147293 - DNA, 25 bp, Homo sapien
tgccaatgagactcgcctcttccgg

SEQ ID NO: 147294 - DNA, 25 bp, Homo sapien
cggattcagcatccggaggcgagca

SEQ ID NO: 147295 - DNA, 25 bp, Homo sapien
taggtgtccaaataggcggcatcgc

SEQ ID NO: 147296 - DNA, 25 bp, Homo sapien
ctgtgcagccactccgttatactta

SEQ ID NO: 147297 - DNA, 25 bp, Homo sapien
cgggcggctcaatcattctgtgcag

SEQ ID NO: 147298 - DNA, 25 bp, Homo sapien
agcagcacgcgcagttgattcccgc

SEQ ID NO: 147299 - DNA, 25 bp, Homo sapien
aagtggcgctccgacacagctactc

SEQ ID NO: 147300 - DNA, 25 bp, Homo sapien
gcgccgctagaattctcctcataaa

SEQ ID NO: 147301 - DNA, 25 bp, Homo sapien
tcctcataaagatggcgacgccctg

SEQ ID NO: 147302 - DNA, 25 bp, Homo sapien
gggcgcgagctgtcacctctcgaaa

SEQ ID NO: 147303 - DNA, 25 bp, Homo sapien
tccgagcgagaatcagcgagcagca

SEQ ID NO: 147304 - DNA, 25 bp, Homo sapien
tgcgggcgctgcacatcaagttcac

SEQ ID NO: 147305 - DNA, 25 bp, Homo sapien
cggctcaccaagaacgcgcaggaca

SEQ ID NO: 147306 - DNA, 25 bp, Homo sapien
tcgatccgtgaggagagcagctaca

SEQ ID NO: 147307 - DNA, 25 bp, Homo sapien
ggcgctccctcaagaagtactcgtt

SEQ ID NO: 147308 - DNA, 25 bp, Homo sapien
agtcatcttctacggcctcatctgc

SEQ ID NO: 147309 - DNA, 25 bp, Homo sapien
ctgcaccgtggacattgagagcctg

SEQ ID NO: 147310 - DNA, 25 bp, Homo sapien
ggggacattgtgtaccgcctctaca

SEQ ID NO: 147311 - DNA, 25 bp, Homo sapien
caagtcacggatcgagcagggtatc

SEQ ID NO: 147312 - DNA, 25 bp, Homo sapien
tcaagcagagggaggcactttcacc

SEQ ID NO: 147313 - DNA, 25 bp, Homo sapien
tggatgctcagcaccactgcaaaca

SEQ ID NO: 147314 - DNA, 25 bp, Homo sapien
acctctttgggcctcgccatcttgg

SEQ ID NO: 147315 - DNA, 25 bp, Homo sapien
tcccatacggttgcgtggatgctca

SEQ ID NO: 147316 - DNA, 25 bp, Homo sapien
ggcgactacggacgccctagacttc

SEQ ID NO: 147317 - DNA, 25 bp, Homo sapien
ggaactccaccgcaggtcacttctg

SEQ ID NO: 147318 - DNA, 25 bp, Homo sapien
gtagacgtcgccactctgcagcctt

SEQ ID NO: 147319 - DNA, 25 bp, Homo sapien
ggcactctcgggtcatatctctaga

SEQ ID NO: 147320 - DNA, 25 bp, Homo sapien
aggcagcagggccaaggcccggctc

SEQ ID NO: 147321 - DNA, 25 bp, Homo sapien
ccgacgccagcttcttcatgttgaa

SEQ ID NO: 147322 - DNA, 25 bp, Homo sapien
gcgtccgacgccagcttcttcatgt

SEQ ID NO: 147323 - DNA, 25 bp, Homo sapien
ggtgaagaagatgcccgcgtccgac

SEQ ID NO: 147324 - DNA, 25 bp, Homo sapien
cgcacggcgcgacgccaggcctcac

SEQ ID NO: 147325 - DNA, 25 bp, Homo sapien
cttccggtcagcaagggctcagggg

SEQ ID NO: 147326 - DNA, 25 bp, Homo sapien
gctcgggccgcacgggctctttccc

SEQ ID NO: 147327 - DNA, 25 bp, Homo sapien
tcatgttgaagtccatggcgtgccc

SEQ ID NO: 147328 - DNA, 25 bp, Homo sapien
cagcgtctttgcaggtctcccagca

SEQ ID NO: 147329 - DNA, 25 bp, Homo sapien
ctcccgtgcagaacgcctccagctt

SEQ ID NO: 147330 - DNA, 25 bp, Homo sapien
tctcagtccagggaaggacccagca

SEQ ID NO: 147331 - DNA, 25 bp, Homo sapien
agcagcaggcgacagagccacaagc

SEQ ID NO: 147332 - DNA, 25 bp, Homo sapien
tctttgcaggtctcccagcagcagg

SEQ ID NO: 147333 - DNA, 25 bp, Homo sapien
gaaggacccagcagccaatcgcagc

SEQ ID NO: 147334 - DNA, 25 bp, Homo sapien
gacagagccacaagcacagctctca

SEQ ID NO: 147335 - DNA, 25 bp, Homo sapien
tccagcttgcacacgccgggaggct

SEQ ID NO: 147336 - DNA, 25 bp, Homo sapien
gcggccctgagagactcagcgatgc

SEQ ID NO: 147337 - DNA, 25 bp, Homo sapien
cagcgatggcatcccgggtgagtat

SEQ ID NO: 147338 - DNA, 25 bp, Homo sapien
caggcgcgcaggtacccgatccgag

SEQ ID NO: 147339 - DNA, 25 bp, Homo sapien
tcagcgatgctcattggccagaaga

SEQ ID NO: 147340 - DNA, 25 bp, Homo sapien
gaggcggaatataagcttggtcaca

SEQ ID NO: 147341 - DNA, 25 bp, Homo sapien
ttggtcacatgacccgcctaattgg

SEQ ID NO: 147342 - DNA, 25 bp, Homo sapien
acccgcctaattggccagaggctgc

SEQ ID NO: 147343 - DNA, 25 bp, Homo sapien
tgtccgggcccaacaggaccaggaa

SEQ ID NO: 147344 - DNA, 25 bp, Homo sapien
tgaggcagcctcaccttctgattgg

SEQ ID NO: 147345 - DNA, 25 bp, Homo sapien
ttctgattggctgttatgctccctg

SEQ ID NO: 147346 - DNA, 25 bp, Homo sapien
atgctccctgttcggtgctggaacc

SEQ ID NO: 147347 - DNA, 25 bp, Homo sapien
ctctgattggccagatgcctacctg

SEQ ID NO: 147348 - DNA, 25 bp, Homo sapien
ctatattggcctccgattgggtgca

SEQ ID NO: 147349 - DNA, 25 bp, Homo sapien
tcacccacgtcgaatatcctgcagg

SEQ ID NO: 147350 - DNA, 25 bp, Homo sapien
atcctgcaggtaaaaggcggtcccg

SEQ ID NO: 147351 - DNA, 25 bp, Homo sapien
aagccttcattcagggcgcaggtcc

SEQ ID NO: 147352 - DNA, 25 bp, Homo sapien
gtccttgctagagccttcgggccaa

SEQ ID NO: 147353 - DNA, 25 bp, Homo sapien
gttgaccggggaatgtcctctaata

SEQ ID NO: 147354 - DNA, 25 bp, Homo sapien
actccgtctggtgtccttgagccta

SEQ ID NO: 147355 - DNA, 25 bp, Homo sapien
gccggcgctcacttgtcttcaggaa

SEQ ID NO: 147356 - DNA, 25 bp, Homo sapien
cgccggccgttaataggcttgctcc

SEQ ID NO: 147357 - DNA, 25 bp, Homo sapien
gggtcagtaccacccacaaagatga

SEQ ID NO: 147358 - DNA, 25 bp, Homo sapien
gtgtgcacctttccaactccgtctg

SEQ ID NO: 147359 - DNA, 25 bp, Homo sapien
ctgtcccggaaaaacatggctgagc

SEQ ID NO: 147360 - DNA, 25 bp, Homo sapien
ctctgagagtctcctgagtgacagg

SEQ ID NO: 147361 - DNA, 25 bp, Homo sapien
gcacgtaggacaccaggaggttctt

SEQ ID NO: 147362 - DNA, 25 bp, Homo sapien
acggcgccaaagcaatgagtctcgg

SEQ ID NO: 147363 - DNA, 25 bp, Homo sapien
gggctactcggctggccaatcagac

SEQ ID NO: 147364 - DNA, 25 bp, Homo sapien
aggcggttcctttgtgctattcaaa

SEQ ID NO: 147365 - DNA, 25 bp, Homo sapien
cgctgctgcctcgaatgttctcctg

SEQ ID NO: 147366 - DNA, 25 bp, Homo sapien
agtctgcagcataggtcgcctggca

SEQ ID NO: 147367 - DNA, 25 bp, Homo sapien
atcttgcgcagggagatgctgatca

SEQ ID NO: 147368 - DNA, 25 bp, Homo sapien
ttggcacattctcccactctgaggt

SEQ ID NO: 147369 - DNA, 25 bp, Homo sapien
gcgagatgcagactccacgcagctc

SEQ ID NO: 147370 - DNA, 25 bp, Homo sapien
ttcgtggattgaagcaaaaccgtgc

SEQ ID NO: 147371 - DNA, 25 bp, Homo sapien
gccaaccgcgatttccttggacttg

SEQ ID NO: 147372 - DNA, 25 bp, Homo sapien
gcagctccagactcttcccgtggga

SEQ ID NO: 147373 - DNA, 25 bp, Homo sapien
ctctttgcaaagctggaactatccc

SEQ ID NO: 147374 - DNA, 25 bp, Homo sapien
ctctgaggtcattccgtaggtggtc

SEQ ID NO: 147375 - DNA, 25 bp, Homo sapien
agaacttcgcctcgcgtgacaccgg

SEQ ID NO: 147376 - DNA, 25 bp, Homo sapien
cattttgagaactttggagtccgcc

SEQ ID NO: 147377 - DNA, 25 bp, Homo sapien
cagctgaccaggaacttagtgcaaa

SEQ ID NO: 147378 - DNA, 25 bp, Homo sapien
cccttacccagtgtccgagagtgtc

SEQ ID NO: 147379 - DNA, 25 bp, Homo sapien
ccaaacgtccctttcggagatagag

SEQ ID NO: 147380 - DNA, 25 bp, Homo sapien
ggcttcccgggtctgacaactgatt

SEQ ID NO: 147381 - DNA, 25 bp, Homo sapien
cacgtggtaggctcctcgctaaaca

SEQ ID NO: 147382 - DNA, 25 bp, Homo sapien
tccctagaaggcgacaatggctcga

SEQ ID NO: 147383 - DNA, 25 bp, Homo sapien
tgcaaagtctccaacgcagtcggcg

SEQ ID NO: 147384 - DNA, 25 bp, Homo sapien
cggcccgggagcactttgtgattaa

SEQ ID NO: 147385 - DNA, 25 bp, Homo sapien
taaacacgtgtctggcttcagcagc

SEQ ID NO: 147386 - DNA, 25 bp, Homo sapien
gactctctcgcctcataaacacgtg

SEQ ID NO: 147387 - DNA, 25 bp, Homo sapien
tggacgacatcctggggaacctctc

SEQ ID NO: 147388 - DNA, 25 bp, Homo sapien
gccgccaggaaggtctacatacaga

SEQ ID NO: 147389 - DNA, 25 bp, Homo sapien
aacgggatcttctccaacggcagca

SEQ ID NO: 147390 - DNA, 25 bp, Homo sapien
aagccctcggatgcaggcgtctaca

SEQ ID NO: 147391 - DNA, 25 bp, Homo sapien
ctctgcggaaaggaacacgacctcg

SEQ ID NO: 147392 - DNA, 25 bp, Homo sapien
ggagttgtagttcaggccctgtccc

SEQ ID NO: 147393 - DNA, 25 bp, Homo sapien
cctccgcaggccttttgaattaatc

SEQ ID NO: 147394 - DNA, 25 bp, Homo sapien
ttgaattaatcctactgcgccgggg

SEQ ID NO: 147395 - DNA, 25 bp, Homo sapien
aggacagttctgtcgcgtactcccg

SEQ ID NO: 147396 - DNA, 25 bp, Homo sapien
ccgggcgctttaaaacgcttgatct

SEQ ID NO: 147397 - DNA, 25 bp, Homo sapien
gtctccgttagccacaccttgattg

SEQ ID NO: 147398 - DNA, 25 bp, Homo sapien
tgatctcgctggaaccttttcggtc

SEQ ID NO: 147399 - DNA, 25 bp, Homo sapien
cccgagacgataagaatgcccagac

SEQ ID NO: 147400 - DNA, 25 bp, Homo sapien
cattggccgcggtttccatggttac

SEQ ID NO: 147401 - DNA, 25 bp, Homo sapien
aatttgacaggggaccatgtgcgcg

SEQ ID NO: 147402 - DNA, 25 bp, Homo sapien
aatacgcggtaagacgtcagcccgg

SEQ ID NO: 147403 - DNA, 25 bp, Homo sapien
gcccagaatttgacaggggaccatg

SEQ ID NO: 147404 - DNA, 25 bp, Homo sapien
ccgggagccgcccagaatttgacag

SEQ ID NO: 147405 - DNA, 25 bp, Homo sapien
ggtaagacgtcagcccggtgagcat

SEQ ID NO: 147406 - DNA, 25 bp, Homo sapien
gtcaagatgtcaaaaatacgcggta

SEQ ID NO: 147407 - DNA, 25 bp, Homo sapien
gaggaaacgctgtcaagatgtcaaa

SEQ ID NO: 147408 - DNA, 25 bp, Homo sapien
aatgtctctgattgggtggccagga

SEQ ID NO: 147409 - DNA, 25 bp, Homo sapien
acagctcctcgggtgtttgcatcca

SEQ ID NO: 147410 - DNA, 25 bp, Homo sapien
tttgcatccaaggtgcccacagcgc

SEQ ID NO: 147411 - DNA, 25 bp, Homo sapien
ctgctcggagatgcatataattacc

SEQ ID NO: 147412 - DNA, 25 bp, Homo sapien
cagcaactggcgctgggtaggcaaa

SEQ ID NO: 147413 - DNA, 25 bp, Homo sapien
actgctgagacgaggttaggattta

SEQ ID NO: 147414 - DNA, 25 bp, Homo sapien
attctggagccatcggaaaccgagg

SEQ ID NO: 147415 - DNA, 25 bp, Homo sapien
tccgccatcagactgggaatgtctc

SEQ ID NO: 147416 - DNA, 25 bp, Homo sapien
gggcttcagccgcagagaaaaggaa

SEQ ID NO: 147417 - DNA, 25 bp, Homo sapien
cctctgggaagcgtgggcttcagcc

SEQ ID NO: 147418 - DNA, 25 bp, Homo sapien
gagcgagccgctctgctcctgataa

SEQ ID NO: 147419 - DNA, 25 bp, Homo sapien
ccacagtcaccttctggcggagaca

SEQ ID NO: 147420 - DNA, 25 bp, Homo sapien
tcctgataagcaggcccggtcctct

SEQ ID NO: 147421 - DNA, 25 bp, Homo sapien
ctcgcagaggagatttaaatatatg

SEQ ID NO: 147422 - DNA, 25 bp, Homo sapien
gcgcctcattcgaggcgacgggctc

SEQ ID NO: 147423 - DNA, 25 bp, Homo sapien
ggacggagacaaatgacggcctttg

SEQ ID NO: 147424 - DNA, 25 bp, Homo sapien
cttccgaagcacgtggaccgggccg

SEQ ID NO: 147425 - DNA, 25 bp, Homo sapien
gtgaggcttccgaagcacgtggacc

SEQ ID NO: 147426 - DNA, 25 bp, Homo sapien
tcgtttccctggcaacagccggtcg

SEQ ID NO: 147427 - DNA, 25 bp, Homo sapien
gaggggtcgtttccctggcaacagc

SEQ ID NO: 147428 - DNA, 25 bp, Homo sapien
tccatctgcgtcctcccacttgccc

SEQ ID NO: 147429 - DNA, 25 bp, Homo sapien
ccatctctccatctgcgtcctccca

SEQ ID NO: 147430 - DNA, 25 bp, Homo sapien
cgatttttgagtctcccccgccgtg

SEQ ID NO: 147431 - DNA, 25 bp, Homo sapien
ttccctggcaacagccggtcggcgg

SEQ ID NO: 147432 - DNA, 25 bp, Homo sapien
cgagtgtgcccacggtgcccgctac

SEQ ID NO: 147433 - DNA, 25 bp, Homo sapien
tgtgcccacggtgcccgctacctcc

SEQ ID NO: 147434 - DNA, 25 bp, Homo sapien
gtgtgcccacggtgcccgctacctc

SEQ ID NO: 147435 - DNA, 25 bp, Homo sapien
ccgagtgtgcccacggtgcccgcta

SEQ ID NO: 147436 - DNA, 25 bp, Homo sapien
gtgcccgctacctcccacctcccga

SEQ ID NO: 147437 - DNA, 25 bp, Homo sapien
cccacctcccgagtgtgccccggtg

SEQ ID NO: 147438 - DNA, 25 bp, Homo sapien
cccgagtgtgcccacggtgcccgct

SEQ ID NO: 147439 - DNA, 25 bp, Homo sapien
ctcccacctcccgagtgtgccccgg

SEQ ID NO: 147440 - DNA, 25 bp, Homo sapien
ggactcaaacgccagagctctctga

SEQ ID NO: 147441 - DNA, 25 bp, Homo sapien
tgcgggcagaagaccgcgttcatta

SEQ ID NO: 147442 - DNA, 25 bp, Homo sapien
tcgcggggcctaaatgaacatggga

SEQ ID NO: 147443 - DNA, 25 bp, Homo sapien
accgcgtcagtttccgagctgtctg

SEQ ID NO: 147444 - DNA, 25 bp, Homo sapien
ggcaaaggcctccactctgcaggta

SEQ ID NO: 147445 - DNA, 25 bp, Homo sapien
gaggttgctcactttcacttcttgg

SEQ ID NO: 147446 - DNA, 25 bp, Homo sapien
ctgtctgtgcatgtctatttctttc

SEQ ID NO: 147447 - DNA, 25 bp, Homo sapien
ggaggcccggattacagcccagtct

SEQ ID NO: 147448 - DNA, 25 bp, Homo sapien
ggcccgctcggcaaacaataacagt

SEQ ID NO: 147449 - DNA, 25 bp, Homo sapien
cccggattgaaccagcaaagagcac

SEQ ID NO: 147450 - DNA, 25 bp, Homo sapien
tcccagacgttttcgaagcgacaga

SEQ ID NO: 147451 - DNA, 25 bp, Homo sapien
gattccttggtttccaggcgctgta

SEQ ID NO: 147452 - DNA, 25 bp, Homo sapien
cctgccattgttccgggcggattcc

SEQ ID NO: 147453 - DNA, 25 bp, Homo sapien
cggcagaaatagcagccaccgcggc

SEQ ID NO: 147454 - DNA, 25 bp, Homo sapien
ccacgaggaacaggaagcggcagaa

SEQ ID NO: 147455 - DNA, 25 bp, Homo sapien
gtgagtaacaccgttgccatggcga

SEQ ID NO: 147456 - DNA, 25 bp, Homo sapien
ttcagaggctgtcaaggctggtttc

SEQ ID NO: 147457 - DNA, 25 bp, Homo sapien
cagcgagtcggtgccatttattttc

SEQ ID NO: 147458 - DNA, 25 bp, Homo sapien
cggaatttgaaatcccagcgagtcg

SEQ ID NO: 147459 - DNA, 25 bp, Homo sapien
tgcttcagcccttaatcacggaatt

SEQ ID NO: 147460 - DNA, 25 bp, Homo sapien
gccgctctatcagcccacggaggga

SEQ ID NO: 147461 - DNA, 25 bp, Homo sapien
ctcctggcaggctcgcaaaaagctg

SEQ ID NO: 147462 - DNA, 25 bp, Homo sapien
aggctgcgtatcagagctcctggca

SEQ ID NO: 147463 - DNA, 25 bp, Homo sapien
cgtgagcgctcgtgataaacagccc

SEQ ID NO: 147464 - DNA, 25 bp, Homo sapien
tgcccggggtgtctaatcacctctc

SEQ ID NO: 147465 - DNA, 25 bp, Homo sapien
atcctttgcccggatctgagcttcg

SEQ ID NO: 147466 - DNA, 25 bp, Homo sapien
attcctttccgctgaactgggcgcc

SEQ ID NO: 147467 - DNA, 25 bp, Homo sapien
ccgggcttcagagccgcagtaaatg

SEQ ID NO: 147468 - DNA, 25 bp, Homo sapien
accagcttgacaggcttttgagtta

SEQ ID NO: 147469 - DNA, 25 bp, Homo sapien
cgccaggagtctggaaccagcttga

SEQ ID NO: 147470 - DNA, 25 bp, Homo sapien
aaataactgattggggtcgcgcacg

SEQ ID NO: 147471 - DNA, 25 bp, Homo sapien
cccatggcagctacataattaattc

SEQ ID NO: 147472 - DNA, 25 bp, Homo sapien
cctgcggcgtctgtttgtgcagagc

SEQ ID NO: 147473 - DNA, 25 bp, Homo sapien
cgagggaaatgacagcccgcggtcc

SEQ ID NO: 147474 - DNA, 25 bp, Homo sapien
catgaatattaatacggcggtaatt

SEQ ID NO: 147475 - DNA, 25 bp, Homo sapien
ggtaattaaaatgcagggacgcagc

SEQ ID NO: 147476 - DNA, 25 bp, Homo sapien
ctttgcaggcgggtgaagcccgctc

SEQ ID NO: 147477 - DNA, 25 bp, Homo sapien
gtctcggggccctgagtcatcgccg

SEQ ID NO: 147478 - DNA, 25 bp, Homo sapien
aagcccacgactcagcccgggaaga

SEQ ID NO: 147479 - DNA, 25 bp, Homo sapien
ctgatgtcatctgcacacaactttc

SEQ ID NO: 147480 - DNA, 25 bp, Homo sapien
tatgatcgcactgcgcaggggtgcc

SEQ ID NO: 147481 - DNA, 25 bp, Homo sapien
tgcctgggccagaatcatgcagatc

SEQ ID NO: 147482 - DNA, 25 bp, Homo sapien
catgcagatccactcccaaaagatg

SEQ ID NO: 147483 - DNA, 25 bp, Homo sapien
cccaaaagatgaacgtcagtcctga

SEQ ID NO: 147484 - DNA, 25 bp, Homo sapien
tcctgacgtgaactgcgagggagct

SEQ ID NO: 147485 - DNA, 25 bp, Homo sapien
cagatgacttcaacggggcccagtg

SEQ ID NO: 147486 - DNA, 25 bp, Homo sapien
cccagtgcaaggctgtgtctgtgga

SEQ ID NO: 147487 - DNA, 25 bp, Homo sapien
cctggaccgcaagatcgagtgcctg

SEQ ID NO: 147488 - DNA, 25 bp, Homo sapien
cgccgcattgggctgtccttcaagg

SEQ ID NO: 147489 - DNA, 25 bp, Homo sapien
cggccgggcttattagtcagctcgc

SEQ ID NO: 147490 - DNA, 25 bp, Homo sapien
tgatcgctaaagaccctaccagctg

SEQ ID NO: 147491 - DNA, 25 bp, Homo sapien
aggacagttttcagcccttccctgc

SEQ ID NO: 147492 - DNA, 25 bp, Homo sapien
accgaggccactaagctctgctagc

SEQ ID NO: 147493 - DNA, 25 bp, Homo sapien
ggttaacgcctttccagccgagctg

SEQ ID NO: 147494 - DNA, 25 bp, Homo sapien
gcgtggcggtcagaagtcaacattc

SEQ ID NO: 147495 - DNA, 25 bp, Homo sapien
cgcgatgaggtaatgccgggaccac

SEQ ID NO: 147496 - DNA, 25 bp, Homo sapien
tgcagatgtaacctctccgcgggcc

SEQ ID NO: 147497 - DNA, 25 bp, Homo sapien
ggcagccctcctgcccgtgtcagag

SEQ ID NO: 147498 - DNA, 25 bp, Homo sapien
tgtcagagcccacgcgaccgctcca

SEQ ID NO: 147499 - DNA, 25 bp, Homo sapien
gaacggttcactggccttctggggc

SEQ ID NO: 147500 - DNA, 25 bp, Homo sapien
gcacttggtgcagatgtaacctctc

SEQ ID NO: 147501 - DNA, 25 bp, Homo sapien
gtctcttccgctgcctcggattctt

SEQ ID NO: 147502 - DNA, 25 bp, Homo sapien
ctcggattctttccctcctgtgttc

SEQ ID NO: 147503 - DNA, 25 bp, Homo sapien
cgcccaggcacttggtgcagatgta

SEQ ID NO: 147504 - DNA, 25 bp, Homo sapien
gggcacccacggcagggccttgaat

SEQ ID NO: 147505 - DNA, 25 bp, Homo sapien
cagggccttgaatgccgggataact

SEQ ID NO: 147506 - DNA, 25 bp, Homo sapien
tgccgggataactcattcctcgctc

SEQ ID NO: 147507 - DNA, 25 bp, Homo sapien
gataactcattcctcgctcctagcg

SEQ ID NO: 147508 - DNA, 25 bp, Homo sapien
tttcaagtcggcctcccggagtctc

SEQ ID NO: 147509 - DNA, 25 bp, Homo sapien
cgctggcgcggacttcaaagcccgc

SEQ ID NO: 147510 - DNA, 25 bp, Homo sapien
ggacctcaggccagcgcctacctgt

SEQ ID NO: 147511 - DNA, 25 bp, Homo sapien
ccgctgggcaagtccctgcagggca

SEQ ID NO: 147512 - DNA, 25 bp, Homo sapien
ctgaacaacaaaagcgagagagagg

SEQ ID NO: 147513 - DNA, 25 bp, Homo sapien
aggcttccgtcctccatctgtggtc

SEQ ID NO: 147514 - DNA, 25 bp, Homo sapien
tcctccatctgtggtctgcggggag

SEQ ID NO: 147515 - DNA, 25 bp, Homo sapien
tgccgcacggctgcaagcctagcaa

SEQ ID NO: 147516 - DNA, 25 bp, Homo sapien
cggctgcaagcctagcaattttggg

SEQ ID NO: 147517 - DNA, 25 bp, Homo sapien
gcctagcaattttgggctgaacaac

SEQ ID NO: 147518 - DNA, 25 bp, Homo sapien
tttgggctgaacaacaaaagcgaga

SEQ ID NO: 147519 - DNA, 25 bp, Homo sapien
aggctgagaagtttcggccgcgcca

SEQ ID NO: 147520 - DNA, 25 bp, Homo sapien
gcgcctcctcgttgctttctgcgag

SEQ ID NO: 147521 - DNA, 25 bp, Homo sapien
gccaacgccgtgttcgacatcctgg

SEQ ID NO: 147522 - DNA, 25 bp, Homo sapien
tgagaatccgcgttgttccgtgttg

SEQ ID NO: 147523 - DNA, 25 bp, Homo sapien
cgacgtagaacagcgccatggccag

SEQ ID NO: 147524 - DNA, 25 bp, Homo sapien
gcgactcgggctccgcgcaaaagat

SEQ ID NO: 147525 - DNA, 25 bp, Homo sapien
cgcacttaagaatccgcgcagccta

SEQ ID NO: 147526 - DNA, 25 bp, Homo sapien
cgcgtagagatgacgtcgggttcta

SEQ ID NO: 147527 - DNA, 25 bp, Homo sapien
gttctacgcgcagtggtgacgtcac

SEQ ID NO: 147528 - DNA, 25 bp, Homo sapien
ctcaccgcaccctcagcgcgcgtgg

SEQ ID NO: 147529 - DNA, 25 bp, Homo sapien
gctgcgtcggaagtctccgtcgcca

SEQ ID NO: 147530 - DNA, 25 bp, Homo sapien
ggaagtctccgtcgccagggagccc

SEQ ID NO: 147531 - DNA, 25 bp, Homo sapien
cctgggcgaagtcgacgccagaaca

SEQ ID NO: 147532 - DNA, 25 bp, Homo sapien
gtcgacgccagaacatgcttggccc

SEQ ID NO: 147533 - DNA, 25 bp, Homo sapien
gggcatagtccagccccaggccata

SEQ ID NO: 147534 - DNA, 25 bp, Homo sapien
cgaagtcgacgccagaacatgcttg

SEQ ID NO: 147535 - DNA, 25 bp, Homo sapien
tcgctgctgcgtcggaagtctccgt

SEQ ID NO: 147536 - DNA, 25 bp, Homo sapien
agctgcggttggcttgtggcgtctc

SEQ ID NO: 147537 - DNA, 25 bp, Homo sapien
tcacgtgcgcgtccccaagaggtct

SEQ ID NO: 147538 - DNA, 25 bp, Homo sapien
gccgcgagctgtcgcgtctggtcgt

SEQ ID NO: 147539 - DNA, 25 bp, Homo sapien
aggctgcgacccctaactgtttcgg

SEQ ID NO: 147540 - DNA, 25 bp, Homo sapien
cccgcccggagtgagtagcgcgagg

SEQ ID NO: 147541 - DNA, 25 bp, Homo sapien
atcttcttctctcggtcccgggagc

SEQ ID NO: 147542 - DNA, 25 bp, Homo sapien
gccggcacaggcctcacgtgcgcgt

SEQ ID NO: 147543 - DNA, 25 bp, Homo sapien
ccggaagtgacgttggcggacaaag

SEQ ID NO: 147544 - DNA, 25 bp, Homo sapien
cccgcccggcttgtggtgataaagt

SEQ ID NO: 147545 - DNA, 25 bp, Homo sapien
ccagatccgagactcaggcgggtcc

SEQ ID NO: 147546 - DNA, 25 bp, Homo sapien
gtggaggatcgagccaagccagatc

SEQ ID NO: 147547 - DNA, 25 bp, Homo sapien
cgcgccgactcagggtgggccatat

SEQ ID NO: 147548 - DNA, 25 bp, Homo sapien
gatgatcctccggaagccgtgcagg

SEQ ID NO: 147549 - DNA, 25 bp, Homo sapien
gaatcgcatccaccagcggctggta

SEQ ID NO: 147550 - DNA, 25 bp, Homo sapien
agttaccggtccagagactcctgcc

SEQ ID NO: 147551 - DNA, 25 bp, Homo sapien
cggctggtactcgaagatgatcctc

SEQ ID NO: 147552 - DNA, 25 bp, Homo sapien
tcgtcgccttcgtctctgggccgcc

SEQ ID NO: 147553 - DNA, 25 bp, Homo sapien
gcacagagctctgtcggccagcgcg

SEQ ID NO: 147554 - DNA, 25 bp, Homo sapien
tgcacagagctctgtcggccagcgc

SEQ ID NO: 147555 - DNA, 25 bp, Homo sapien
tgtgcacagagctctgtcggccagc

SEQ ID NO: 147556 - DNA, 25 bp, Homo sapien
tggtgtgcacagagctctgtcggcc

SEQ ID NO: 147557 - DNA, 25 bp, Homo sapien
ccaggagcctgaggatgcgctgcct

SEQ ID NO: 147558 - DNA, 25 bp, Homo sapien
cccaggagcctgaggatgcgctgcc

SEQ ID NO: 147559 - DNA, 25 bp, Homo sapien
tggggggctcgtcgccttcgtctct

SEQ ID NO: 147560 - DNA, 25 bp, Homo sapien
tacaactggggaaacagagacctga

SEQ ID NO: 147561 - DNA, 25 bp, Homo sapien
ctcccgaacagcctgggaagtgggt

SEQ ID NO: 147562 - DNA, 25 bp, Homo sapien
acctgagtcgggcaaagccgctgag

SEQ ID NO: 147563 - DNA, 25 bp, Homo sapien
cctcccgcacgagctagcgccgccc

SEQ ID NO: 147564 - DNA, 25 bp, Homo sapien
gagctgcacgttggggtttcaaacc

SEQ ID NO: 147565 - DNA, 25 bp, Homo sapien
ctgagctgcacgttggggtttcaaa

SEQ ID NO: 147566 - DNA, 25 bp, Homo sapien
acagagacctgagtcgggcaaagcc

SEQ ID NO: 147567 - DNA, 25 bp, Homo sapien
caaagccgctgagctgcacgttggg

SEQ ID NO: 147568 - DNA, 25 bp, Homo sapien
cttcaccagccagcgagacaatatc

SEQ ID NO: 147569 - DNA, 25 bp, Homo sapien
cccggttaggtttcattagagcagc

SEQ ID NO: 147570 - DNA, 25 bp, Homo sapien
agcagcggcttttcaaggctcgtcg

SEQ ID NO: 147571 - DNA, 25 bp, Homo sapien
tccctcccggaaagcgagcgtatct

SEQ ID NO: 147572 - DNA, 25 bp, Homo sapien
aattacattgctcgcgacacccggc

SEQ ID NO: 147573 - DNA, 25 bp, Homo sapien
ttcctagggaacctggtgctgaacc

SEQ ID NO: 147574 - DNA, 25 bp, Homo sapien
ggcggtcaggacaccttcatggaaa

SEQ ID NO: 147575 - DNA, 25 bp, Homo sapien
ctcgctcctaaagccagttgcggtg

SEQ ID NO: 147576 - DNA, 25 bp, Homo sapien
taccacgcggatggctgcaaacctc

SEQ ID NO: 147577 - DNA, 25 bp, Homo sapien
accagagctggaattaccacgcgga

SEQ ID NO: 147578 - DNA, 25 bp, Homo sapien
aaaatgacatttaaccagagctgga

SEQ ID NO: 147579 - DNA, 25 bp, Homo sapien
gccagagatggcgttattaaaaatg

SEQ ID NO: 147580 - DNA, 25 bp, Homo sapien
cgcagacgtttacacgccagagatg

SEQ ID NO: 147581 - DNA, 25 bp, Homo sapien
tcccttcttgccgtgggcgcagacg

SEQ ID NO: 147582 - DNA, 25 bp, Homo sapien
ctctgcgcgggcctcccgtataaaa

SEQ ID NO: 147583 - DNA, 25 bp, Homo sapien
tgcaaacctcggaatcaaagcggga

SEQ ID NO: 147584 - DNA, 25 bp, Homo sapien
ctcgtctggaaccagatgtgccgcg

SEQ ID NO: 147585 - DNA, 25 bp, Homo sapien
ctgggcgcgggatctattaacgtct

SEQ ID NO: 147586 - DNA, 25 bp, Homo sapien
cgggatctattaacgtctgtgtgtc

SEQ ID NO: 147587 - DNA, 25 bp, Homo sapien
gccaggggctcgtctggaaccagat

SEQ ID NO: 147588 - DNA, 25 bp, Homo sapien
ctcgcacgcactggctggcgcgcac

SEQ ID NO: 147589 - DNA, 25 bp, Homo sapien
tggcatcccctggatttcggaccga

SEQ ID NO: 147590 - DNA, 25 bp, Homo sapien
atgggaaagccacccacgagacggg

SEQ ID NO: 147591 - DNA, 25 bp, Homo sapien
attaacgtctgtgtgtctgggccgc

SEQ ID NO: 147592 - DNA, 25 bp, Homo sapien
gccgccaagcggaagaagaagcagc

SEQ ID NO: 147593 - DNA, 25 bp, Homo sapien
ttgcccggcgcgtcaacctcagcga

SEQ ID NO: 147594 - DNA, 25 bp, Homo sapien
gcgcgttcaggtgagcgctcagtcc

SEQ ID NO: 147595 - DNA, 25 bp, Homo sapien
ggcggaaccgcaccacgttcaacag

SEQ ID NO: 147596 - DNA, 25 bp, Homo sapien
acgttcaacagcagccaactgcagg

SEQ ID NO: 147597 - DNA, 25 bp, Homo sapien
tcaacagcagccaactgcaggcgct

SEQ ID NO: 147598 - DNA, 25 bp, Homo sapien
agcgcgtgttcgagcgcacgcacta

SEQ ID NO: 147599 - DNA, 25 bp, Homo sapien
gcctttgtgcgcgaggagcttgccc

SEQ ID NO: 147600 - DNA, 25 bp, Homo sapien
gcctcactcctaccacacccctaat

SEQ ID NO: 147601 - DNA, 25 bp, Homo sapien
ccctaatcccctcggtgagtgccgc

SEQ ID NO: 147602 - DNA, 25 bp, Homo sapien
gccgcctcgctcataccacacccct

SEQ ID NO: 147603 - DNA, 25 bp, Homo sapien
ctcactcacaccacacccctaatcc

SEQ ID NO: 147604 - DNA, 25 bp, Homo sapien
gcctcgctcataccacacccctaat

SEQ ID NO: 147605 - DNA, 25 bp, Homo sapien
cccctaatcccctcggtgagtgccg

SEQ ID NO: 147606 - DNA, 25 bp, Homo sapien
cgcctcactcctaccacacccctaa

SEQ ID NO: 147607 - DNA, 25 bp, Homo sapien
cctcactcacaccacacccctaatc

SEQ ID NO: 147608 - DNA, 25 bp, Homo sapien
gcctggcaccaagggttctgataaa

SEQ ID NO: 147609 - DNA, 25 bp, Homo sapien
gttcttaactctgtgccagcactga

SEQ ID NO: 147610 - DNA, 25 bp, Homo sapien
gagccgagtgctcagcaagcgcctc

SEQ ID NO: 147611 - DNA, 25 bp, Homo sapien
cattctccattcattggtgttctca

SEQ ID NO: 147612 - DNA, 25 bp, Homo sapien
agtgcctctccattcgttctcattc

SEQ ID NO: 147613 - DNA, 25 bp, Homo sapien
tcagagaggtgacgctgccagccct

SEQ ID NO: 147614 - DNA, 25 bp, Homo sapien
tggtgttctcaatctccaacacata

SEQ ID NO: 147615 - DNA, 25 bp, Homo sapien
ccagcagcaggcgtcatttgtcatc

SEQ ID NO: 147616 - DNA, 25 bp, Homo sapien
cttgtcccgccaaactggctgtaga

SEQ ID NO: 147617 - DNA, 25 bp, Homo sapien
ctggagtctccgtgtcctggttgac

SEQ ID NO: 147618 - DNA, 25 bp, Homo sapien
gcaggatttgggtgctcctggctca

SEQ ID NO: 147619 - DNA, 25 bp, Homo sapien
tgtctgcgccagagatcttgtcccg

SEQ ID NO: 147620 - DNA, 25 bp, Homo sapien
ggcacggcaggtcccatccgttaga

SEQ ID NO: 147621 - DNA, 25 bp, Homo sapien
tgtagacagtcaccggcaagaacgc

SEQ ID NO: 147622 - DNA, 25 bp, Homo sapien
ctgtgtgattaacacccagccaggg

SEQ ID NO: 147623 - DNA, 25 bp, Homo sapien
cctggttgacggagctgataatggc

SEQ ID NO: 147624 - DNA, 25 bp, Homo sapien
tcaccggctacctgtcctacaatga

SEQ ID NO: 147625 - DNA, 25 bp, Homo sapien
atgacatctactgccgcttcgccga

SEQ ID NO: 147626 - DNA, 25 bp, Homo sapien
agcggccgctcaacgcttcgggtac

SEQ ID NO: 147627 - DNA, 25 bp, Homo sapien
tgcgccctgccaaccctattaagta

SEQ ID NO: 147628 - DNA, 25 bp, Homo sapien
cccgttccttgggatcacaggtgga

SEQ ID NO: 147629 - DNA, 25 bp, Homo sapien
ggtgccttcgcaaacagtctccaga

SEQ ID NO: 147630 - DNA, 25 bp, Homo sapien
cggaccactcccaagaacgatggca

SEQ ID NO: 147631 - DNA, 25 bp, Homo sapien
aagtagttttcagacgtgctgcgtc

SEQ ID NO: 147632 - DNA, 25 bp, Homo sapien
tacaaagccctgttttgcttccgga

SEQ ID NO: 147633 - DNA, 25 bp, Homo sapien
tgcttccggaaactcggttctgctc

SEQ ID NO: 147634 - DNA, 25 bp, Homo sapien
aggctgatgggctccaccgcctgca

SEQ ID NO: 147635 - DNA, 25 bp, Homo sapien
ggccatctttcttcagggcagccct

SEQ ID NO: 147636 - DNA, 25 bp, Homo sapien
tcctctcgcggaggccatctttctt

SEQ ID NO: 147637 - DNA, 25 bp, Homo sapien
gccatctttgttcggtacaaagccc

SEQ ID NO: 147638 - DNA, 25 bp, Homo sapien
tgcttgttctcgcgccgaccgcgaa

SEQ ID NO: 147639 - DNA, 25 bp, Homo sapien
agtcccaggctgatgggctccaccg

SEQ ID NO: 147640 - DNA, 25 bp, Homo sapien
agcgccgactgcctcacaaataatg

SEQ ID NO: 147641 - DNA, 25 bp, Homo sapien
ccacccgagctcacagttaacaatg

SEQ ID NO: 147642 - DNA, 25 bp, Homo sapien
gttaacaatgtcagcgaagcgccga

SEQ ID NO: 147643 - DNA, 25 bp, Homo sapien
gagcctcaatttctgcgtccgcaga

SEQ ID NO: 147644 - DNA, 25 bp, Homo sapien
cagcctcttccgattggacggcaga

SEQ ID NO: 147645 - DNA, 25 bp, Homo sapien
cgttgaaagcatccgcgtggcgtct

SEQ ID NO: 147646 - DNA, 25 bp, Homo sapien
tgacttttctttcctcgggctctga

SEQ ID NO: 147647 - DNA, 25 bp, Homo sapien
gatgaccacttctctgcggtgctga

SEQ ID NO: 147648 - DNA, 25 bp, Homo sapien
ccggagcccatcagaagatgagttc

SEQ ID NO: 147649 - DNA, 25 bp, Homo sapien
agcggatgaaggaccgcaagttctc

SEQ ID NO: 147650 - DNA, 25 bp, Homo sapien
gccagcagcgtacaaactcggagca

SEQ ID NO: 147651 - DNA, 25 bp, Homo sapien
ggacgctgatgtggacactgccatg

SEQ ID NO: 147652 - DNA, 25 bp, Homo sapien
actgcgggaggaacctcagcctatg

SEQ ID NO: 147653 - DNA, 25 bp, Homo sapien
agcctatggcccagtacctaccggg

SEQ ID NO: 147654 - DNA, 25 bp, Homo sapien
tgtcctgtgactcgagcagtgaccg

SEQ ID NO: 147655 - DNA, 25 bp, Homo sapien
ctgctgatcccagatgaggcgggcc

SEQ ID NO: 147656 - DNA, 25 bp, Homo sapien
cgagggcccgcatcatttcttccta

SEQ ID NO: 147657 - DNA, 25 bp, Homo sapien
gcctactgccagaacgtgatcaatg

SEQ ID NO: 147658 - DNA, 25 bp, Homo sapien
aggtgggcactacatcgcctactgc

SEQ ID NO: 147659 - DNA, 25 bp, Homo sapien
aggatccctgtgacccgtctgctct

SEQ ID NO: 147660 - DNA, 25 bp, Homo sapien
tgccaaggagtgcacatcccagatc

SEQ ID NO: 147661 - DNA, 25 bp, Homo sapien
tcggcacgaggtgatgtactcattc

SEQ ID NO: 147662 - DNA, 25 bp, Homo sapien
tgtgcattcacctaaagcgctttcg

SEQ ID NO: 147663 - DNA, 25 bp, Homo sapien
ttcttcctagatgaccggcgctctc

SEQ ID NO: 147664 - DNA, 25 bp, Homo sapien
tatatctcccgccatgcaatgcgtc

SEQ ID NO: 147665 - DNA, 25 bp, Homo sapien
agggacttccggcaaagactatatc

SEQ ID NO: 147666 - DNA, 25 bp, Homo sapien
ctcccgcccttaaggaagagcagtg

SEQ ID NO: 147667 - DNA, 25 bp, Homo sapien
agcgatttcgcctcaaagggcctca

SEQ ID NO: 147668 - DNA, 25 bp, Homo sapien
caagaaactgcaagacccaccgggc

SEQ ID NO: 147669 - DNA, 25 bp, Homo sapien
gcttaaccgctgtcgtgcccagatc

SEQ ID NO: 147670 - DNA, 25 bp, Homo sapien
cagcgacttgctctgcgcttgctta

SEQ ID NO: 147671 - DNA, 25 bp, Homo sapien
gcctccttacactccgaggtgcgtg

SEQ ID NO: 147672 - DNA, 25 bp, Homo sapien
accacctctgcggacggaggagccg

SEQ ID NO: 147673 - DNA, 25 bp, Homo sapien
gccatctcgttcctcatcgcagggg

SEQ ID NO: 147674 - DNA, 25 bp, Homo sapien
gccggtatttcctgacccgctggag

SEQ ID NO: 147675 - DNA, 25 bp, Homo sapien
tgcctctgtccaccgccatctcgtt

SEQ ID NO: 147676 - DNA, 25 bp, Homo sapien
ttcttgctccctccactgctgcgct

SEQ ID NO: 147677 - DNA, 25 bp, Homo sapien
gcgctctgccgtctgctcccgccag

SEQ ID NO: 147678 - DNA, 25 bp, Homo sapien
cgggccggtatttcctgacccgctg

SEQ ID NO: 147679 - DNA, 25 bp, Homo sapien
ggtatttcctgacccgctggaggag

SEQ ID NO: 147680 - DNA, 25 bp, Homo sapien
ggatgacatcgacacggatgacatc

SEQ ID NO: 147681 - DNA, 25 bp, Homo sapien
tgtgtcccaccgtctcagtggcctg

SEQ ID NO: 147682 - DNA, 25 bp, Homo sapien
gatgacactttcacaaaaggcactg

SEQ ID NO: 147683 - DNA, 25 bp, Homo sapien
caggggacccgtgatgacactttca

SEQ ID NO: 147684 - DNA, 25 bp, Homo sapien
tgccttgtctcctcaggggacccgt

SEQ ID NO: 147685 - DNA, 25 bp, Homo sapien
cagtccgcctgatgtgcgctggacc

SEQ ID NO: 147686 - DNA, 25 bp, Homo sapien
tgacatcgagtgctcagtccgcctg

SEQ ID NO: 147687 - DNA, 25 bp, Homo sapien
agcgatgaggactgacccgagccat

SEQ ID NO: 147688 - DNA, 25 bp, Homo sapien
ctaggatacctgctggaaagctcgc

SEQ ID NO: 147689 - DNA, 25 bp, Homo sapien
cccagggtctaggatacctgctgga

SEQ ID NO: 147690 - DNA, 25 bp, Homo sapien
tggaaagctcgcagcagggcccgct

SEQ ID NO: 147691 - DNA, 25 bp, Homo sapien
caggcgcgtcaagacgccgcggcta

SEQ ID NO: 147692 - DNA, 25 bp, Homo sapien
aagacgccgcggctacctctgcgga

SEQ ID NO: 147693 - DNA, 25 bp, Homo sapien
gcacgacactttcgggccctgggga

SEQ ID NO: 147694 - DNA, 25 bp, Homo sapien
tgctcaccgggcagactgtacccgg

SEQ ID NO: 147695 - DNA, 25 bp, Homo sapien
gtccctggagcgcacgacactttcg

SEQ ID NO: 147696 - DNA, 25 bp, Homo sapien
ggcccacgtctcattcctagagttg

SEQ ID NO: 147697 - DNA, 25 bp, Homo sapien
tgaggccctgctcatggtcctgcct

SEQ ID NO: 147698 - DNA, 25 bp, Homo sapien
cattcctagagttggacgccgaccc

SEQ ID NO: 147699 - DNA, 25 bp, Homo sapien
catggtcctgcctttcatctgtaac

SEQ ID NO: 147700 - DNA, 25 bp, Homo sapien
ttcatctgtaacctgctgcgccggc

SEQ ID NO: 147701 - DNA, 25 bp, Homo sapien
cgggtcctcgtgcaccgtccacacg

SEQ ID NO: 147702 - DNA, 25 bp, Homo sapien
gtccacacggccctggtgagttgcg

SEQ ID NO: 147703 - DNA, 25 bp, Homo sapien
gacaagggcccacgtctcattccta

SEQ ID NO: 147704 - DNA, 25 bp, Homo sapien
ctccgcggagccaggacagaactcg

SEQ ID NO: 147705 - DNA, 25 bp, Homo sapien
cgctccacagcaaaatggcccgagg

SEQ ID NO: 147706 - DNA, 25 bp, Homo sapien
cggagccaggacagaactcgcggcc

SEQ ID NO: 147707 - DNA, 25 bp, Homo sapien
gggattagggctcggcccgacacac

SEQ ID NO: 147708 - DNA, 25 bp, Homo sapien
cgcctccagagcgaagaccgcactc

SEQ ID NO: 147709 - DNA, 25 bp, Homo sapien
cacgggccagaagtcctcgcctcca

SEQ ID NO: 147710 - DNA, 25 bp, Homo sapien
tcgcctccgaaggacaagccggccc

SEQ ID NO: 147711 - DNA, 25 bp, Homo sapien
ccacagcaaaatggcccgaggaagc

SEQ ID NO: 147712 - DNA, 25 bp, Homo sapien
caccgtgcggctgacacagcttatc

SEQ ID NO: 147713 - DNA, 25 bp, Homo sapien
ccggctgctcccaatgctgggtttg

SEQ ID NO: 147714 - DNA, 25 bp, Homo sapien
ttttcctccgagtcaacgctcagtg

SEQ ID NO: 147715 - DNA, 25 bp, Homo sapien
aatcagttcaatcagtggcccgaca

SEQ ID NO: 147716 - DNA, 25 bp, Homo sapien
acaggctcctcgacgacttcctagg

SEQ ID NO: 147717 - DNA, 25 bp, Homo sapien
ctaggtcgcaatctccaggaaaacg

SEQ ID NO: 147718 - DNA, 25 bp, Homo sapien
tgctggaacaaacatggccgctctg

SEQ ID NO: 147719 - DNA, 25 bp, Homo sapien
ctgcggcctttcactgacaggtggc

SEQ ID NO: 147720 - DNA, 25 bp, Homo sapien
ccctggggccgcgttgagccgaggg

SEQ ID NO: 147721 - DNA, 25 bp, Homo sapien
ttcacatccgatcttccgggccctc

SEQ ID NO: 147722 - DNA, 25 bp, Homo sapien
ctggcctcattcacatccgatcttc

SEQ ID NO: 147723 - DNA, 25 bp, Homo sapien
ggccgggacctggcctcattcacat

SEQ ID NO: 147724 - DNA, 25 bp, Homo sapien
ggcaccccatgaatccgtgtcgaat

SEQ ID NO: 147725 - DNA, 25 bp, Homo sapien
actcctgtcccgtgggccgccgtgt

SEQ ID NO: 147726 - DNA, 25 bp, Homo sapien
ctggggcactcctgtcccgtgggcc

SEQ ID NO: 147727 - DNA, 25 bp, Homo sapien
cgctacctgccgcatcccgcacagc

SEQ ID NO: 147728 - DNA, 25 bp, Homo sapien
tccgcagagctgtcccaacgggcag

SEQ ID NO: 147729 - DNA, 25 bp, Homo sapien
tggtgattcatgcatcacgatgccg

SEQ ID NO: 147730 - DNA, 25 bp, Homo sapien
gattcatgcatcacgatgccgccgc

SEQ ID NO: 147731 - DNA, 25 bp, Homo sapien
gcggggctggtgattcatgcatcac

SEQ ID NO: 147732 - DNA, 25 bp, Homo sapien
ggcctccaatgtggacccctcggag

SEQ ID NO: 147733 - DNA, 25 bp, Homo sapien
ctgctgcgagattggcctgtcgccc

SEQ ID NO: 147734 - DNA, 25 bp, Homo sapien
ggcgagacttggcacagcgctcgtc

SEQ ID NO: 147735 - DNA, 25 bp, Homo sapien
cttggcacagcgctcgtcgtgcggt

SEQ ID NO: 147736 - DNA, 25 bp, Homo sapien
cgcattctggaacgcagtctgagcc

SEQ ID NO: 147737 - DNA, 25 bp, Homo sapien
gatcgatggcgcctcgcgcattctg

SEQ ID NO: 147738 - DNA, 25 bp, Homo sapien
accggctccatgtgggacgaactga

SEQ ID NO: 147739 - DNA, 25 bp, Homo sapien
tggccttcgtcttcgacgtcaccgg

SEQ ID NO: 147740 - DNA, 25 bp, Homo sapien
gctgggaaagtttgagtcacgattg

SEQ ID NO: 147741 - DNA, 25 bp, Homo sapien
ggaggcgcaggtgtccactgcatcc

SEQ ID NO: 147742 - DNA, 25 bp, Homo sapien
cgaacgcacctggacgtcgtgggct

SEQ ID NO: 147743 - DNA, 25 bp, Homo sapien
cctaacctcggatctggacgggcga

SEQ ID NO: 147744 - DNA, 25 bp, Homo sapien
gcgtcagcgagaccttgggtcaaca

SEQ ID NO: 147745 - DNA, 25 bp, Homo sapien
ttgggtcaacacgaccctgcgcaca

SEQ ID NO: 147746 - DNA, 25 bp, Homo sapien
gaagcccggatcagacctccaggtc

SEQ ID NO: 147747 - DNA, 25 bp, Homo sapien
tcgaggagaagcttggtccacgcca

SEQ ID NO: 147748 - DNA, 25 bp, Homo sapien
ggcaagcggagcgtcatcgtctccc

SEQ ID NO: 147749 - DNA, 25 bp, Homo sapien
tcttcgtcttgctcatcgccgtgtc

SEQ ID NO: 147750 - DNA, 25 bp, Homo sapien
accgcaccgagctcagcatgctgga

SEQ ID NO: 147751 - DNA, 25 bp, Homo sapien
cctactaaacgggagagggcattgg

SEQ ID NO: 147752 - DNA, 25 bp, Homo sapien
tcccaccgcgaagcgtttaaattgc

SEQ ID NO: 147753 - DNA, 25 bp, Homo sapien
tccctgcgccagtggaacttttatc

SEQ ID NO: 147754 - DNA, 25 bp, Homo sapien
cgcccatctgcaggtggctgtgaac

SEQ ID NO: 147755 - DNA, 25 bp, Homo sapien
cgggccctgtgcttataacctggga

SEQ ID NO: 147756 - DNA, 25 bp, Homo sapien
aaggggctcccgatgctcaaacgcc

SEQ ID NO: 147757 - DNA, 25 bp, Homo sapien
agccgggtcctttctggactccttg

SEQ ID NO: 147758 - DNA, 25 bp, Homo sapien
gatccggcttcctctgtgtcgtgaa

SEQ ID NO: 147759 - DNA, 25 bp, Homo sapien
ccctgagttacatgggtcgcagcca

SEQ ID NO: 147760 - DNA, 25 bp, Homo sapien
ggtggcgagttcttgcactcctaca

SEQ ID NO: 147761 - DNA, 25 bp, Homo sapien
aggacggctctgtccgctggcctat

SEQ ID NO: 147762 - DNA, 25 bp, Homo sapien
cttgcactcctacaacagcgcttga

SEQ ID NO: 147763 - DNA, 25 bp, Homo sapien
tgtccgctggcctatgctgcagcct

SEQ ID NO: 147764 - DNA, 25 bp, Homo sapien
agccgtgggcacagctagcactagc

SEQ ID NO: 147765 - DNA, 25 bp, Homo sapien
ggttcagaggtctgagcggccactt

SEQ ID NO: 147766 - DNA, 25 bp, Homo sapien
ttccagacctcggatgcgacgctca

SEQ ID NO: 147767 - DNA, 25 bp, Homo sapien
acctcggatgcgacgctcatctgca

SEQ ID NO: 147768 - DNA, 25 bp, Homo sapien
gaccggttcgctggggcacccactg

SEQ ID NO: 147769 - DNA, 25 bp, Homo sapien
tgccacgacccggtcaaagcgtggg

SEQ ID NO: 147770 - DNA, 25 bp, Homo sapien
aggcgcgtcccgaagacgactccgg

SEQ ID NO: 147771 - DNA, 25 bp, Homo sapien
aagagcaggcgcgtcccgaagacga

SEQ ID NO: 147772 - DNA, 25 bp, Homo sapien
actcaccgacggactgcagcgaaag

SEQ ID NO: 147773 - DNA, 25 bp, Homo sapien
cgaaagcgcgggttcagcagaccgc

SEQ ID NO: 147774 - DNA, 25 bp, Homo sapien
gcacaaaggcaagggtcgaaagcgc

SEQ ID NO: 147775 - DNA, 25 bp, Homo sapien
ccgacggactgcagcgaaaggcgaa

SEQ ID NO: 147776 - DNA, 25 bp, Homo sapien
agccacgtcagtccctctgagattc

SEQ ID NO: 147777 - DNA, 25 bp, Homo sapien
tctcccaggtgcctgaagtcgctgg

SEQ ID NO: 147778 - DNA, 25 bp, Homo sapien
ttccgtggagttcctacagccggga

SEQ ID NO: 147779 - DNA, 25 bp, Homo sapien
cgggaccacatccaagcctcgggga

SEQ ID NO: 147780 - DNA, 25 bp, Homo sapien
tgtcaagacgccatcgacggtcctg

SEQ ID NO: 147781 - DNA, 25 bp, Homo sapien
tgagattccaaacggccgacagcgg

SEQ ID NO: 147782 - DNA, 25 bp, Homo sapien
agcctggacccacagtgtagctagc

SEQ ID NO: 147783 - DNA, 25 bp, Homo sapien
cttccgatcggtcgaaggtcacgtg

SEQ ID NO: 147784 - DNA, 25 bp, Homo sapien
agcgtgtgctctccgagatccaggt

SEQ ID NO: 147785 - DNA, 25 bp, Homo sapien
cccgaggagcgcatgccctctgaaa

SEQ ID NO: 147786 - DNA, 25 bp, Homo sapien
gcgcatgccctctgaaatacaggtg

SEQ ID NO: 147787 - DNA, 25 bp, Homo sapien
gaaatacaggtgttgccgccatccc

SEQ ID NO: 147788 - DNA, 25 bp, Homo sapien
tggaggagcgcctgccctcccagat

SEQ ID NO: 147789 - DNA, 25 bp, Homo sapien
ggtgttaggagtgcctcgtccgcaa

SEQ ID NO: 147790 - DNA, 25 bp, Homo sapien
ttaggagtgcctcgtccgcaagggc

SEQ ID NO: 147791 - DNA, 25 bp, Homo sapien
aggagcgtgtgctctccgagatcca

SEQ ID NO: 147792 - DNA, 25 bp, Homo sapien
gcgaaagagtctccggttggccttc

SEQ ID NO: 147793 - DNA, 25 bp, Homo sapien
tcccggaagccgactaggcgaaaga

SEQ ID NO: 147794 - DNA, 25 bp, Homo sapien
tccctgtgcataaaaccgctcgctg

SEQ ID NO: 147795 - DNA, 25 bp, Homo sapien
gctgccgttggctcattaattctta

SEQ ID NO: 147796 - DNA, 25 bp, Homo sapien
cgccgcagaagtgcagaagctgtcc

SEQ ID NO: 147797 - DNA, 25 bp, Homo sapien
cggcatcttctccaagacgtggatc

SEQ ID NO: 147798 - DNA, 25 bp, Homo sapien
cggtgcttctttggcacctccaaca

SEQ ID NO: 147799 - DNA, 25 bp, Homo sapien
gctttgagaattcgcggagagacta

SEQ ID NO: 147800 - DNA, 25 bp, Homo sapien
tctcccgagccttgaaagctaatta

SEQ ID NO: 147801 - DNA, 25 bp, Homo sapien
tccttcatctccgagtctttgtacc

SEQ ID NO: 147802 - DNA, 25 bp, Homo sapien
ggagactcgcgtgccagtcacctgc

SEQ ID NO: 147803 - DNA, 25 bp, Homo sapien
aagctaattacattgggaggggaca

SEQ ID NO: 147804 - DNA, 25 bp, Homo sapien
ccgagtcacgtctgttgaaaccgtt

SEQ ID NO: 147805 - DNA, 25 bp, Homo sapien
cccacgcgaggaaggaatttcctgg

SEQ ID NO: 147806 - DNA, 25 bp, Homo sapien
tcctgggccactgcgaaagattgag

SEQ ID NO: 147807 - DNA, 25 bp, Homo sapien
cgccgccttgatcagcctgggctgt

SEQ ID NO: 147808 - DNA, 25 bp, Homo sapien
ggcacctctgttagcggcatctgaa

SEQ ID NO: 147809 - DNA, 25 bp, Homo sapien
ccaggtgtgagaccctcttagccaa

SEQ ID NO: 147810 - DNA, 25 bp, Homo sapien
ctgcctgcagtttctgagggacttc

SEQ ID NO: 147811 - DNA, 25 bp, Homo sapien
tgctcccacctaggaagggtctcgg

SEQ ID NO: 147812 - DNA, 25 bp, Homo sapien
cttttcccagagacaggctgccagg

SEQ ID NO: 147813 - DNA, 25 bp, Homo sapien
gcctggccttccatgaagctgtctc

SEQ ID NO: 147814 - DNA, 25 bp, Homo sapien
gggcgtctatgccaacaggcgtttg

SEQ ID NO: 147815 - DNA, 25 bp, Homo sapien
ttcccgaggttgcagctcagcaagg

SEQ ID NO: 147816 - DNA, 25 bp, Homo sapien
cgagagtcctgtgcttcggaatgaa

SEQ ID NO: 147817 - DNA, 25 bp, Homo sapien
agcccttcgtgtgccgcttctgcaa

SEQ ID NO: 147818 - DNA, 25 bp, Homo sapien
ccgagtctccctgctgctgtagagc

SEQ ID NO: 147819 - DNA, 25 bp, Homo sapien
cttggcccgtgtcgcagatgaggac

SEQ ID NO: 147820 - DNA, 25 bp, Homo sapien
ccacctgccggccatggtgctgtga

SEQ ID NO: 147821 - DNA, 25 bp, Homo sapien
agaggacttccacccggcggactcg

SEQ ID NO: 147822 - DNA, 25 bp, Homo sapien
gccgcatgcgatgcgtcatctgcca

SEQ ID NO: 147823 - DNA, 25 bp, Homo sapien
atgcgcatccacacgctggacaagc

SEQ ID NO: 147824 - DNA, 25 bp, Homo sapien
gggccgcgacactaagaaacatcta

SEQ ID NO: 147825 - DNA, 25 bp, Homo sapien
gggcacttcgtctgagcatcctaca

SEQ ID NO: 147826 - DNA, 25 bp, Homo sapien
ggcctcgtatccctgtgtgtgtaac

SEQ ID NO: 147827 - DNA, 25 bp, Homo sapien
cggacacaggattcatgcggtacgt

SEQ ID NO: 147828 - DNA, 25 bp, Homo sapien
gggatacaatcactacggacacagg

SEQ ID NO: 147829 - DNA, 25 bp, Homo sapien
tcggatatcgcagctcccgactgag

SEQ ID NO: 147830 - DNA, 25 bp, Homo sapien
tgcgcaactcattggcgccaagatg

SEQ ID NO: 147831 - DNA, 25 bp, Homo sapien
aagcctcttagcgagagactgggcc

SEQ ID NO: 147832 - DNA, 25 bp, Homo sapien
gcgagagtccttcgtcccttacagc

SEQ ID NO: 147833 - DNA, 25 bp, Homo sapien
tggagcggctcgtaatccatcatgg

SEQ ID NO: 147834 - DNA, 25 bp, Homo sapien
cttgcgctcagagaagccacattta

SEQ ID NO: 147835 - DNA, 25 bp, Homo sapien
aggcgggtgcttccttaccactcac

SEQ ID NO: 147836 - DNA, 25 bp, Homo sapien
tgacccggattctcggaggccaatg

SEQ ID NO: 147837 - DNA, 25 bp, Homo sapien
tggctgggagatccaaccctactgc

SEQ ID NO: 147838 - DNA, 25 bp, Homo sapien
acgctaggccggcaagaatctacca

SEQ ID NO: 147839 - DNA, 25 bp, Homo sapien
cgcaatttttccctcgctttggctc

SEQ ID NO: 147840 - DNA, 25 bp, Homo sapien
tggcaccgcgtactgggaaactcgc

SEQ ID NO: 147841 - DNA, 25 bp, Homo sapien
cttctaaagtggagtggagcaggcc

SEQ ID NO: 147842 - DNA, 25 bp, Homo sapien
aactcgccaaaagcggtgcaggttg

SEQ ID NO: 147843 - DNA, 25 bp, Homo sapien
tgttatctggaaggtaagcccgggc

SEQ ID NO: 147844 - DNA, 25 bp, Homo sapien
atctgcctgaagctggtgggctgca

SEQ ID NO: 147845 - DNA, 25 bp, Homo sapien
cgcttccaggcggagaaagacctcc

SEQ ID NO: 147846 - DNA, 25 bp, Homo sapien
ggaaaatgttggagatctgcctgaa

SEQ ID NO: 147847 - DNA, 25 bp, Homo sapien
gtcctcgtcctccagctgttatctg

SEQ ID NO: 147848 - DNA, 25 bp, Homo sapien
tacgagggcgtgtggaagaaataca

SEQ ID NO: 147849 - DNA, 25 bp, Homo sapien
tcaccatgaagcacaagctgggcgg

SEQ ID NO: 147850 - DNA, 25 bp, Homo sapien
tggaacgcacggacatcaccatgaa

SEQ ID NO: 147851 - DNA, 25 bp, Homo sapien
tacgacaagtgggagatggaacgca

SEQ ID NO: 147852 - DNA, 25 bp, Homo sapien
caagcccactgtctatggtgtgtcc

SEQ ID NO: 147853 - DNA, 25 bp, Homo sapien
catcattcaacggtggccgacgggc

SEQ ID NO: 147854 - DNA, 25 bp, Homo sapien
cgcttcaacaccctggccgagttgg

SEQ ID NO: 147855 - DNA, 25 bp, Homo sapien
ggccgagttggttcatcatcattca

SEQ ID NO: 147856 - DNA, 25 bp, Homo sapien
agtcctgggcgcaaagacaaaagcc

SEQ ID NO: 147857 - DNA, 25 bp, Homo sapien
ccggcaaaaacctctacacgttctg

SEQ ID NO: 147858 - DNA, 25 bp, Homo sapien
aggcgctgtgcctcgccatctctag

SEQ ID NO: 147859 - DNA, 25 bp, Homo sapien
tcaacccgagtgtctcttcggaaaa

SEQ ID NO: 147860 - DNA, 25 bp, Homo sapien
gagggcctcaaaaagcccgtgctcc

SEQ ID NO: 147861 - DNA, 25 bp, Homo sapien
tgctgtgaacagtgacgctgccaag

SEQ ID NO: 147862 - DNA, 25 bp, Homo sapien
tctctaggaactccgagcagatggc

SEQ ID NO: 147863 - DNA, 25 bp, Homo sapien
acgagtctggttgatgctgtgaaca

SEQ ID NO: 147864 - DNA, 25 bp, Homo sapien
accggccggatcttcatctcagaga

SEQ ID NO: 147865 - DNA, 25 bp, Homo sapien
cacacccgggtgtgtccatgcagct

SEQ ID NO: 147866 - DNA, 25 bp, Homo sapien
aggcggcacagttgttctctgaatg

SEQ ID NO: 147867 - DNA, 25 bp, Homo sapien
tctctgaatggtcgctgtcacggtc

SEQ ID NO: 147868 - DNA, 25 bp, Homo sapien
tcacggtccttggtggtgaacctca

SEQ ID NO: 147869 - DNA, 25 bp, Homo sapien
ggtgaacctcatgccgctgtgcttc

SEQ ID NO: 147870 - DNA, 25 bp, Homo sapien
cccactggtgttgcatgtgtgagca

SEQ ID NO: 147871 - DNA, 25 bp, Homo sapien
gcaccgcgcaggtactgcccattga

SEQ ID NO: 147872 - DNA, 25 bp, Homo sapien
gccctgcacgtgcattgtcctgttt

SEQ ID NO: 147873 - DNA, 25 bp, Homo sapien
cggctcttggcacagcactgccaag

SEQ ID NO: 147874 - DNA, 25 bp, Homo sapien
aagctgccgtttctcgggtgctgag

SEQ ID NO: 147875 - DNA, 25 bp, Homo sapien
gtcctgtttctgttcaaagtttgaa

SEQ ID NO: 147876 - DNA, 25 bp, Homo sapien
cccacggaggcacgctttctttgca

SEQ ID NO: 147877 - DNA, 25 bp, Homo sapien
cgctttctttgcacgatgaacgaag

SEQ ID NO: 147878 - DNA, 25 bp, Homo sapien
ttgcacgatgaacgaaggaaatgtg

SEQ ID NO: 147879 - DNA, 25 bp, Homo sapien
agcactgccaagctgccgtttctcg

SEQ ID NO: 147880 - DNA, 25 bp, Homo sapien
aaagggaacagaaacatggcggtca

SEQ ID NO: 147881 - DNA, 25 bp, Homo sapien
cgggcccatgagaatcgtttgcgta

SEQ ID NO: 147882 - DNA, 25 bp, Homo sapien
gcgttcgtggcctagtttctccgcg

SEQ ID NO: 147883 - DNA, 25 bp, Homo sapien
aaacatggcggtcaggtcttgggac

SEQ ID NO: 147884 - DNA, 25 bp, Homo sapien
gcccagtccgcgaatccggtgcttt

SEQ ID NO: 147885 - DNA, 25 bp, Homo sapien
aatcgtttgcgtacaagcgcgaggg

SEQ ID NO: 147886 - DNA, 25 bp, Homo sapien
actgtccgacggctcacagcgcgga

SEQ ID NO: 147887 - DNA, 25 bp, Homo sapien
tccgcgaatccggtgctttcttgcc

SEQ ID NO: 147888 - DNA, 25 bp, Homo sapien
ttgaggaaatcagctgcggagaatc

SEQ ID NO: 147889 - DNA, 25 bp, Homo sapien
acagcgaggagcgtgtccgttccct

SEQ ID NO: 147890 - DNA, 25 bp, Homo sapien
aatcagcagtcgtttcccgagcgtc

SEQ ID NO: 147891 - DNA, 25 bp, Homo sapien
cgctggagcgtttaattggcgttga

SEQ ID NO: 147892 - DNA, 25 bp, Homo sapien
ccgtaatgagggatagctgaagagc

SEQ ID NO: 147893 - DNA, 25 bp, Homo sapien
gtcacagctacatccgtaatgaggg

SEQ ID NO: 147894 - DNA, 25 bp, Homo sapien
cggtgaaggccatgccggtctccaa

SEQ ID NO: 147895 - DNA, 25 bp, Homo sapien
ccggcggtaagcgattcccgctgga

SEQ ID NO: 147896 - DNA, 25 bp, Homo sapien
tcacagtacacctggaagccggccg

SEQ ID NO: 147897 - DNA, 25 bp, Homo sapien
cggaatgcccgggttcaggtacaca

SEQ ID NO: 147898 - DNA, 25 bp, Homo sapien
cgcttaggaggacgtccagacagtc

SEQ ID NO: 147899 - DNA, 25 bp, Homo sapien
ggaaagacagagtagacgccatcgt

SEQ ID NO: 147900 - DNA, 25 bp, Homo sapien
ccgtccgtgcgcatgtcacagtaca

SEQ ID NO: 147901 - DNA, 25 bp, Homo sapien
ggttcaggtacacagcctcacggtc

SEQ ID NO: 147902 - DNA, 25 bp, Homo sapien
aggacgtccagacagtctcggggcc

SEQ ID NO: 147903 - DNA, 25 bp, Homo sapien
ccatcgtcctgctgtccgcttagga

SEQ ID NO: 147904 - DNA, 25 bp, Homo sapien
agctggtcggccagcgtgtccagca

SEQ ID NO: 147905 - DNA, 25 bp, Homo sapien
acggcaccggtgacagctacagcca

SEQ ID NO: 147906 - DNA, 25 bp, Homo sapien
cgctctccaggcgtgcgaagctgtc

SEQ ID NO: 147907 - DNA, 25 bp, Homo sapien
gagctgtccgccctttccacagtga

SEQ ID NO: 147908 - DNA, 25 bp, Homo sapien
ccagcagcacggtgcacagcacgta

SEQ ID NO: 147909 - DNA, 25 bp, Homo sapien
tccacagtgaccagggcgctgttgg

SEQ ID NO: 147910 - DNA, 25 bp, Homo sapien
cgtggttcaggaagagcacggcacc

SEQ ID NO: 147911 - DNA, 25 bp, Homo sapien
cctggtgctctgtcagcgcctgcag

SEQ ID NO: 147912 - DNA, 25 bp, Homo sapien
taaaagcatttaatccgcccggagc

SEQ ID NO: 147913 - DNA, 25 bp, Homo sapien
tcccaccagcagcacttttaaaagc

SEQ ID NO: 147914 - DNA, 25 bp, Homo sapien
ctgtggtcgcgagtaccagccgctc

SEQ ID NO: 147915 - DNA, 25 bp, Homo sapien
tcacacaagtcaccatgcgcggggc

SEQ ID NO: 147916 - DNA, 25 bp, Homo sapien
tggatactaaactccgcctccgaaa

SEQ ID NO: 147917 - DNA, 25 bp, Homo sapien
ggtctcggactctctttgcttttta

SEQ ID NO: 147918 - DNA, 25 bp, Homo sapien
atctccgcatcttttctggtctcgg

SEQ ID NO: 147919 - DNA, 25 bp, Homo sapien
ctcacacccgcggacttggatacta

SEQ ID NO: 147920 - DNA, 25 bp, Homo sapien
agagcccgtccatggccttcggcgt

SEQ ID NO: 147921 - DNA, 25 bp, Homo sapien
gtccatggccttcggcgtgcagtac

SEQ ID NO: 147922 - DNA, 25 bp, Homo sapien
cacctggtggcagagcccgtccatg

SEQ ID NO: 147923 - DNA, 25 bp, Homo sapien
tcaccgacttccacagccaggacga

SEQ ID NO: 147924 - DNA, 25 bp, Homo sapien
ctgcctgccggtgttcgagaacgcg

SEQ ID NO: 147925 - DNA, 25 bp, Homo sapien
cgtcggtgcccttgaccatggcggc

SEQ ID NO: 147926 - DNA, 25 bp, Homo sapien
gcactgccgggcacgtccagcaggt

SEQ ID NO: 147927 - DNA, 25 bp, Homo sapien
gtcaacatcaccctccgcctaggta

SEQ ID NO: 147928 - DNA, 25 bp, Homo sapien
cctaccagttctacagcgcctcctg

SEQ ID NO: 147929 - DNA, 25 bp, Homo sapien
acggcccatgggagccctaccagtt

SEQ ID NO: 147930 - DNA, 25 bp, Homo sapien
tcctgccagaagacctacggccggc

SEQ ID NO: 147931 - DNA, 25 bp, Homo sapien
ttctgcacctctgagttcagcgaca

SEQ ID NO: 147932 - DNA, 25 bp, Homo sapien
gcacctctgagttcagcgacatctc

SEQ ID NO: 147933 - DNA, 25 bp, Homo sapien
ttcagcgacatctccccgctgagtg

SEQ ID NO: 147934 - DNA, 25 bp, Homo sapien
ctgagtggcggcaacgtggccttct

SEQ ID NO: 147935 - DNA, 25 bp, Homo sapien
gtggcggcaacgtggccttctccac

SEQ ID NO: 147936 - DNA, 25 bp, Homo sapien
agtgtctgagtgtcacagggcatca

SEQ ID NO: 147937 - DNA, 25 bp, Homo sapien
tctgcgtgagtgtctgagtgtcaca

SEQ ID NO: 147938 - DNA, 25 bp, Homo sapien
cccacgagtgtctgcgtgagtgtct

SEQ ID NO: 147939 - DNA, 25 bp, Homo sapien
aacaccaccggcacagactgtgagc

SEQ ID NO: 147940 - DNA, 25 bp, Homo sapien
gcctgccggtgccagcacaacacca

SEQ ID NO: 147941 - DNA, 25 bp, Homo sapien
cccgacgtggcaggccagttggcct

SEQ ID NO: 147942 - DNA, 25 bp, Homo sapien
tgtcacagggcatcagggacccgag

SEQ ID NO: 147943 - DNA, 25 bp, Homo sapien
actgtgagcgctgcctgcccttctt

SEQ ID NO: 147944 - DNA, 25 bp, Homo sapien
ggcgagctcagcaacaggttccaag

SEQ ID NO: 147945 - DNA, 25 bp, Homo sapien
ttactcttgcaactggggactgggg

SEQ ID NO: 147946 - DNA, 25 bp, Homo sapien
ctggccgagatcaaccgggtaagcc

SEQ ID NO: 147947 - DNA, 25 bp, Homo sapien
tttccgcgtcctccagcagaggggt

SEQ ID NO: 147948 - DNA, 25 bp, Homo sapien
cgtcccgcataatagccgctttgaa

SEQ ID NO: 147949 - DNA, 25 bp, Homo sapien
tcggcttgctcaaagcccggcagga

SEQ ID NO: 147950 - DNA, 25 bp, Homo sapien
cggtctcgggttgcaagttgttact

SEQ ID NO: 147951 - DNA, 25 bp, Homo sapien
caacaggttccaaggtaggcgccgc

SEQ ID NO: 147952 - DNA, 25 bp, Homo sapien
cgcctcctgcttgaacagtttaccg

SEQ ID NO: 147953 - DNA, 25 bp, Homo sapien
cgttgccttggagcccagctgaaag

SEQ ID NO: 147954 - DNA, 25 bp, Homo sapien
cctcccttctttagtcctggcgttg

SEQ ID NO: 147955 - DNA, 25 bp, Homo sapien
agcgttggctgcttcgacacactga

SEQ ID NO: 147956 - DNA, 25 bp, Homo sapien
cgcgccggaaatgcgaggtcaactg

SEQ ID NO: 147957 - DNA, 25 bp, Homo sapien
tgacgtcaccaaagcgcgccggaaa

SEQ ID NO: 147958 - DNA, 25 bp, Homo sapien
cgcggcttcctctgaccaagcttga

SEQ ID NO: 147959 - DNA, 25 bp, Homo sapien
cagtttaccgcgttcacagctctca

SEQ ID NO: 147960 - DNA, 25 bp, Homo sapien
ttgggcgggatcaccaccagcggct

SEQ ID NO: 147961 - DNA, 25 bp, Homo sapien
tacttgggccgccacatgaggacct

SEQ ID NO: 147962 - DNA, 25 bp, Homo sapien
ccacatgaggacctgggcatcgttg

SEQ ID NO: 147963 - DNA, 25 bp, Homo sapien
cttgctcaggattttgggctggtcc

SEQ ID NO: 147964 - DNA, 25 bp, Homo sapien
gggatgggctcattcttgctcagga

SEQ ID NO: 147965 - DNA, 25 bp, Homo sapien
cctcgatgctgagctgcatgcgcca

SEQ ID NO: 147966 - DNA, 25 bp, Homo sapien
gcatcgttggcattgggcttgacca

SEQ ID NO: 147967 - DNA, 25 bp, Homo sapien
ttggggttcacctcgatgctgagct

SEQ ID NO: 147968 - DNA, 25 bp, Homo sapien
ctcgcggcagaagcctgacttcctg

SEQ ID NO: 147969 - DNA, 25 bp, Homo sapien
cgaccgcgcgcaccagcgaataata

SEQ ID NO: 147970 - DNA, 25 bp, Homo sapien
gcgcggtcgaatcaattgcagagca

SEQ ID NO: 147971 - DNA, 25 bp, Homo sapien
agcagtttgtgttcacccggccgag

SEQ ID NO: 147972 - DNA, 25 bp, Homo sapien
agttaagccgaactttgctgcgggg

SEQ ID NO: 147973 - DNA, 25 bp, Homo sapien
cagcgaataatagccgcccgtgaca

SEQ ID NO: 147974 - DNA, 25 bp, Homo sapien
cgcgtcaaggccagcctcaaagtta

SEQ ID NO: 147975 - DNA, 25 bp, Homo sapien
tcggccctcggagggcatagtgccc

SEQ ID NO: 147976 - DNA, 25 bp, Homo sapien
ctgtgctggcgccaggcttagaagc

SEQ ID NO: 147977 - DNA, 25 bp, Homo sapien
tctaggccgggataacgggatagtc

SEQ ID NO: 147978 - DNA, 25 bp, Homo sapien
ccgggataacgggatagtccattgc

SEQ ID NO: 147979 - DNA, 25 bp, Homo sapien
aacgggatagtccattgctgggcca

SEQ ID NO: 147980 - DNA, 25 bp, Homo sapien
gatagtccattgctgggccagggct

SEQ ID NO: 147981 - DNA, 25 bp, Homo sapien
tggggactgccgactgcagtacaga

SEQ ID NO: 147982 - DNA, 25 bp, Homo sapien
ctgccgactgcagtacagacccaga

SEQ ID NO: 147983 - DNA, 25 bp, Homo sapien
gcccggcaaagcctgcccttccgag

SEQ ID NO: 147984 - DNA, 25 bp, Homo sapien
tccgttcggccaaaaagctccatgc

SEQ ID NO: 147985 - DNA, 25 bp, Homo sapien
ggcgctttcagttctcgcgagatga

SEQ ID NO: 147986 - DNA, 25 bp, Homo sapien
gcaggtcacataggcgctttcagtt

SEQ ID NO: 147987 - DNA, 25 bp, Homo sapien
agagggccaacttccgcttagcgca

SEQ ID NO: 147988 - DNA, 25 bp, Homo sapien
tcatcttgaagcagctgaacgcctc

SEQ ID NO: 147989 - DNA, 25 bp, Homo sapien
cgcgttctgggactcgattcacgtt

SEQ ID NO: 147990 - DNA, 25 bp, Homo sapien
ttctccacctaaagccaggatcctg

SEQ ID NO: 147991 - DNA, 25 bp, Homo sapien
ggcgagccttctcctacttgagacc

SEQ ID NO: 147992 - DNA, 25 bp, Homo sapien
agcccacgagcaggagatgccagtg

SEQ ID NO: 147993 - DNA, 25 bp, Homo sapien
tgcgaactgagaaagcgatccgggc

SEQ ID NO: 147994 - DNA, 25 bp, Homo sapien
gcggccttagaaatgcgaactgaga

SEQ ID NO: 147995 - DNA, 25 bp, Homo sapien
caaaataacccaggagcggccttag

SEQ ID NO: 147996 - DNA, 25 bp, Homo sapien
aggtgctaaaataaacccagcgaag

SEQ ID NO: 147997 - DNA, 25 bp, Homo sapien
ctccgtccgagaggtcagaagccca

SEQ ID NO: 147998 - DNA, 25 bp, Homo sapien
ggcgcgcgtcagaacgcacagtctc

SEQ ID NO: 147999 - DNA, 25 bp, Homo sapien
cccagcgaaggatcaggtttcccga

SEQ ID NO: 148000 - DNA, 25 bp, Homo sapien
tgtcccgcgtgatgatcggccgcca

SEQ ID NO: 148001 - DNA, 25 bp, Homo sapien
cagaagctcatcaagcggcgcggcc

SEQ ID NO: 148002 - DNA, 25 bp, Homo sapien
tgctctgggccctctgcgtgggcct

SEQ ID NO: 148003 - DNA, 25 bp, Homo sapien
ctttgtcatcggctacctccagttc

SEQ ID NO: 148004 - DNA, 25 bp, Homo sapien
ccctgcgtgtgctgctggtgctctg

SEQ ID NO: 148005 - DNA, 25 bp, Homo sapien
gccgccatggtgtccaagttcttcc

SEQ ID NO: 148006 - DNA, 25 bp, Homo sapien
ctggactacctcaccatggacatct

SEQ ID NO: 148007 - DNA, 25 bp, Homo sapien
acggacgtcctctccggctttgtca

SEQ ID NO: 148008 - DNA, 25 bp, Homo sapien
actgctagcatctcagcccagctgg

SEQ ID NO: 148009 - DNA, 25 bp, Homo sapien
cccagctggcgtgaaagttcgtcaa

SEQ ID NO: 148010 - DNA, 25 bp, Homo sapien
tcgtcaaaacccatggcggtatctc

SEQ ID NO: 148011 - DNA, 25 bp, Homo sapien
ccaatcggagctggccaatggatga

SEQ ID NO: 148012 - DNA, 25 bp, Homo sapien
ccaatggatgagaggcagctatttc

SEQ ID NO: 148013 - DNA, 25 bp, Homo sapien
tgcagccaaagtcgctcccggaaga

SEQ ID NO: 148014 - DNA, 25 bp, Homo sapien
gagccgtcgtttctttgcgtggatc

SEQ ID NO: 148015 - DNA, 25 bp, Homo sapien
accctgcgggagtcaactgctagca

SEQ ID NO: 148016 - DNA, 25 bp, Homo sapien
ctcgccattgttgtggcggcgccgc

SEQ ID NO: 148017 - DNA, 25 bp, Homo sapien
tgctccatgctaaaaatgtttaata

SEQ ID NO: 148018 - DNA, 25 bp, Homo sapien
tgctgaatgctccatgctaaaaatg

SEQ ID NO: 148019 - DNA, 25 bp, Homo sapien
tttcgaaatgctgaatgctccatgc

SEQ ID NO: 148020 - DNA, 25 bp, Homo sapien
gtttaataataaacaggatgtcgcc

SEQ ID NO: 148021 - DNA, 25 bp, Homo sapien
accagagggttattttcgaaatgct

SEQ ID NO: 148022 - DNA, 25 bp, Homo sapien
ccgcccaattgacggagcagcgcgc

SEQ ID NO: 148023 - DNA, 25 bp, Homo sapien
cctgcccgacctttgtccgcgagcg

SEQ ID NO: 148024 - DNA, 25 bp, Homo sapien
ctgcagagattcttggcggtccaac

SEQ ID NO: 148025 - DNA, 25 bp, Homo sapien
acggcctccgaaagcagcgacttca

SEQ ID NO: 148026 - DNA, 25 bp, Homo sapien
cgcgcggaggacaagagatccttct

SEQ ID NO: 148027 - DNA, 25 bp, Homo sapien
ccacagcggtctagatgccaagagc

SEQ ID NO: 148028 - DNA, 25 bp, Homo sapien
cggcgacctacagacagagactatg

SEQ ID NO: 148029 - DNA, 25 bp, Homo sapien
ccaggcaggcccaaactgtgttctg

SEQ ID NO: 148030 - DNA, 25 bp, Homo sapien
gctcttggcaggaatatggcccttc

SEQ ID NO: 148031 - DNA, 25 bp, Homo sapien
ggccgtggtttcagagagttcactt

SEQ ID NO: 148032 - DNA, 25 bp, Homo sapien
ggaggtcgccgcgtttcacacctgc

SEQ ID NO: 148033 - DNA, 25 bp, Homo sapien
cccgcaggctcggtgaatcgaacgt

SEQ ID NO: 148034 - DNA, 25 bp, Homo sapien
ctcggtgaatcgaacgttgagcagg

SEQ ID NO: 148035 - DNA, 25 bp, Homo sapien
agtaagaactccgtggcgcgtgcag

SEQ ID NO: 148036 - DNA, 25 bp, Homo sapien
gctctgtgtggactcggagaaacgc

SEQ ID NO: 148037 - DNA, 25 bp, Homo sapien
actcggagaaacgcgggtacatttg

SEQ ID NO: 148038 - DNA, 25 bp, Homo sapien
cccgaagtaagaactccgtggcgcg

SEQ ID NO: 148039 - DNA, 25 bp, Homo sapien
actccgtggcgcgtgcagccctagg

SEQ ID NO: 148040 - DNA, 25 bp, Homo sapien
acgtcggagtcggtgtccacgaaga

SEQ ID NO: 148041 - DNA, 25 bp, Homo sapien
caggcgtgcttcagacctcaggacc

SEQ ID NO: 148042 - DNA, 25 bp, Homo sapien
cgagcacaggtaccggcaggcagaa

SEQ ID NO: 148043 - DNA, 25 bp, Homo sapien
gcagaactcctcgaaggccggcttc

SEQ ID NO: 148044 - DNA, 25 bp, Homo sapien
gccggcttcacgaaggtggtgtact

SEQ ID NO: 148045 - DNA, 25 bp, Homo sapien
gcgtcagaatctgctccaggtccct

SEQ ID NO: 148046 - DNA, 25 bp, Homo sapien
gccttacctcttcgagacagcctga

SEQ ID NO: 148047 - DNA, 25 bp, Homo sapien
tggtgtactgcgtcagaatctgctc

SEQ ID NO: 148048 - DNA, 25 bp, Homo sapien
accaacaggtgtggatggtctcagc

SEQ ID NO: 148049 - DNA, 25 bp, Homo sapien
gccttcgtccgagtgcttgcctctg

SEQ ID NO: 148050 - DNA, 25 bp, Homo sapien
tggcccggaaggtgcccgttccgca

SEQ ID NO: 148051 - DNA, 25 bp, Homo sapien
aaggtctcagactcaagtggcccgg

SEQ ID NO: 148052 - DNA, 25 bp, Homo sapien
ctcgagccggctacaaggtctcaga

SEQ ID NO: 148053 - DNA, 25 bp, Homo sapien
ccattgcgccgaaagctggctggca

SEQ ID NO: 148054 - DNA, 25 bp, Homo sapien
aaccggagcgatcacttccgggagg

SEQ ID NO: 148055 - DNA, 25 bp, Homo sapien
ggaggcaaccggagcgatcacttcc

SEQ ID NO: 148056 - DNA, 25 bp, Homo sapien
gaactgcgggaccagcgacgtccca

SEQ ID NO: 148057 - DNA, 25 bp, Homo sapien
gctgccatttctttctagggtccga

SEQ ID NO: 148058 - DNA, 25 bp, Homo sapien
catttctttctagggtccgacacga

SEQ ID NO: 148059 - DNA, 25 bp, Homo sapien
ccacatcggcttcgttggggagccc

SEQ ID NO: 148060 - DNA, 25 bp, Homo sapien
gtgcggaggccgataggtcacttct

SEQ ID NO: 148061 - DNA, 25 bp, Homo sapien
gccgataggtcacttctgtccctgg

SEQ ID NO: 148062 - DNA, 25 bp, Homo sapien
cctccgtgctgtctgcgcgtggtcg

SEQ ID NO: 148063 - DNA, 25 bp, Homo sapien
tgctcacgaccgctgccatttcttt

SEQ ID NO: 148064 - DNA, 25 bp, Homo sapien
cgggtttctactcttcctgctgtcg

SEQ ID NO: 148065 - DNA, 25 bp, Homo sapien
cagcttaacatttgtgccattcgtg

SEQ ID NO: 148066 - DNA, 25 bp, Homo sapien
ccctccaagttactggcgtgctgtg

SEQ ID NO: 148067 - DNA, 25 bp, Homo sapien
ctttacacgtgtagggtggcgagtc

SEQ ID NO: 148068 - DNA, 25 bp, Homo sapien
cattccgtgtctggcatcttgtgtc

SEQ ID NO: 148069 - DNA, 25 bp, Homo sapien
ggcttctctctctcagcgagtgtcc

SEQ ID NO: 148070 - DNA, 25 bp, Homo sapien
gcgcccgttctgttgtgcgtaaatg

SEQ ID NO: 148071 - DNA, 25 bp, Homo sapien
tgcgtaaatgccgttctcagagctg

SEQ ID NO: 148072 - DNA, 25 bp, Homo sapien
gcggcacagtcccacagaagacagc

SEQ ID NO: 148073 - DNA, 25 bp, Homo sapien
cagagggcggcacagtcccacagaa

SEQ ID NO: 148074 - DNA, 25 bp, Homo sapien
ggagttctgccatgcggccaccaga

SEQ ID NO: 148075 - DNA, 25 bp, Homo sapien
gctaggatggaacagtggcggccaa

SEQ ID NO: 148076 - DNA, 25 bp, Homo sapien
cagtggctgccatctgttccaggcg

SEQ ID NO: 148077 - DNA, 25 bp, Homo sapien
tgcgccttgacccagccactgggag

SEQ ID NO: 148078 - DNA, 25 bp, Homo sapien
ggattccacgttgcgccttgaccca

SEQ ID NO: 148079 - DNA, 25 bp, Homo sapien
ccagcggcggacctcgctgggaact

SEQ ID NO: 148080 - DNA, 25 bp, Homo sapien
cgtgcctgctatcgccgagttctac

SEQ ID NO: 148081 - DNA, 25 bp, Homo sapien
aatcgctgcaaactctgggtccaga

SEQ ID NO: 148082 - DNA, 25 bp, Homo sapien
gtgcgaggacaactacaccatcgtg

SEQ ID NO: 148083 - DNA, 25 bp, Homo sapien
tccaacgccggacgcagcaaaatcg

SEQ ID NO: 148084 - DNA, 25 bp, Homo sapien
agagttctggcgctccttcaatcgg

SEQ ID NO: 148085 - DNA, 25 bp, Homo sapien
cccggtgcttcataaagccgctttc

SEQ ID NO: 148086 - DNA, 25 bp, Homo sapien
tgggctcttctcagctgcgcgagca

SEQ ID NO: 148087 - DNA, 25 bp, Homo sapien
tctctggtgtaagcactggcgtcca

SEQ ID NO: 148088 - DNA, 25 bp, Homo sapien
tgcccagcttcgtctgtgtcgtctg

SEQ ID NO: 148089 - DNA, 25 bp, Homo sapien
ctgtgtcgtctgtgtcgtagaaagg

SEQ ID NO: 148090 - DNA, 25 bp, Homo sapien
gaaaggcctgctcagaattcacagc

SEQ ID NO: 148091 - DNA, 25 bp, Homo sapien
aattcacagcggctcaggggctcat

SEQ ID NO: 148092 - DNA, 25 bp, Homo sapien
catgaattatgtacggctccagatc

SEQ ID NO: 148093 - DNA, 25 bp, Homo sapien
atcaatccgtcagcgctctgtcagg

SEQ ID NO: 148094 - DNA, 25 bp, Homo sapien
tgccagacgcagatttgacaaatgt

SEQ ID NO: 148095 - DNA, 25 bp, Homo sapien
cccgtgtgttttgagcgcgttccaa

SEQ ID NO: 148096 - DNA, 25 bp, Homo sapien
cagcaaaaccatccatcatcgcgtg

SEQ ID NO: 148097 - DNA, 25 bp, Homo sapien
gatgctccactcgattccaagattg

SEQ ID NO: 148098 - DNA, 25 bp, Homo sapien
tccaagattgcttccgttttgctgg

SEQ ID NO: 148099 - DNA, 25 bp, Homo sapien
gcttttgatgtctgctccgaggatg

SEQ ID NO: 148100 - DNA, 25 bp, Homo sapien
ccgaggatgtcggtttcagcattcc

SEQ ID NO: 148101 - DNA, 25 bp, Homo sapien
tcctccaagggaggcctcggcaaag

SEQ ID NO: 148102 - DNA, 25 bp, Homo sapien
cggcaaagttggcttccagacgttg

SEQ ID NO: 148103 - DNA, 25 bp, Homo sapien
ccagacgttggttcccgccagcaaa

SEQ ID NO: 148104 - DNA, 25 bp, Homo sapien
aaatgcctagcgagagccgctcacg

SEQ ID NO: 148105 - DNA, 25 bp, Homo sapien
gggaagctgcggctaaatgcctagc

SEQ ID NO: 148106 - DNA, 25 bp, Homo sapien
tcaccggttacacgcgtggtttctg

SEQ ID NO: 148107 - DNA, 25 bp, Homo sapien
ttaacgcgggccctggagatatttg

SEQ ID NO: 148108 - DNA, 25 bp, Homo sapien
tgccagcttcttgctcgcgatgtca

SEQ ID NO: 148109 - DNA, 25 bp, Homo sapien
gggcaggtgacgacgtctcacactc

SEQ ID NO: 148110 - DNA, 25 bp, Homo sapien
tgcacacccgcgtgaatcagggctt

SEQ ID NO: 148111 - DNA, 25 bp, Homo sapien
tgggaactcggaccagaatatcttg

SEQ ID NO: 148112 - DNA, 25 bp, Homo sapien
gcatcccatccttcaggcagtcgaa

SEQ ID NO: 148113 - DNA, 25 bp, Homo sapien
ttgaggtcccggttgaccgaatgta

SEQ ID NO: 148114 - DNA, 25 bp, Homo sapien
ttcgcaagcaaaaaagccgcgctcg

SEQ ID NO: 148115 - DNA, 25 bp, Homo sapien
cttcagccggtacctacttgaggtc

SEQ ID NO: 148116 - DNA, 25 bp, Homo sapien
agcgcagcgcctggatggcactaat

SEQ ID NO: 148117 - DNA, 25 bp, Homo sapien
gcgctcgctgatgacgtatctccga

SEQ ID NO: 148118 - DNA, 25 bp, Homo sapien
gtgcgcaataaaggccttctcccgg

SEQ ID NO: 148119 - DNA, 25 bp, Homo sapien
agtcgaacaccctgctcacgctgga

SEQ ID NO: 148120 - DNA, 25 bp, Homo sapien
cgttcttagcagcatcttaaagggg

SEQ ID NO: 148121 - DNA, 25 bp, Homo sapien
aaactgggagcctgtgagttgcaca

SEQ ID NO: 148122 - DNA, 25 bp, Homo sapien
ttgcaaggatgctcggatgtgtctc

SEQ ID NO: 148123 - DNA, 25 bp, Homo sapien
aaggggtagcttgtctttctggcca

SEQ ID NO: 148124 - DNA, 25 bp, Homo sapien
cggctgctacgagctgagaactgga

SEQ ID NO: 148125 - DNA, 25 bp, Homo sapien
gcccggcaaaggctcggatgcaaaa

SEQ ID NO: 148126 - DNA, 25 bp, Homo sapien
tttaaagggcttcggtgaccatgca

SEQ ID NO: 148127 - DNA, 25 bp, Homo sapien
tcctttccgtcgtgtgtgtgagagt

SEQ ID NO: 148128 - DNA, 25 bp, Homo sapien
ctcgggtagaggcatccaaaccttt

SEQ ID NO: 148129 - DNA, 25 bp, Homo sapien
taggagtcgactgctggaagaatta

SEQ ID NO: 148130 - DNA, 25 bp, Homo sapien
tgttagtgaacagttaggagtcgac

SEQ ID NO: 148131 - DNA, 25 bp, Homo sapien
ggagatccctacctgttagtgaaca

SEQ ID NO: 148132 - DNA, 25 bp, Homo sapien
tgtcccagcagccaggagatcccta

SEQ ID NO: 148133 - DNA, 25 bp, Homo sapien
ggcgtcctggttgtcccagcagcca

SEQ ID NO: 148134 - DNA, 25 bp, Homo sapien
aattaattaggaacgtgctgtgctc

SEQ ID NO: 148135 - DNA, 25 bp, Homo sapien
gtcctgcagctgaaggaaggttgca

SEQ ID NO: 148136 - DNA, 25 bp, Homo sapien
gcgggagaacctctacaagtacttc

SEQ ID NO: 148137 - DNA, 25 bp, Homo sapien
ggcctcaaggagttcttcaccctca

SEQ ID NO: 148138 - DNA, 25 bp, Homo sapien
tggacaacctctacacgcggctgga

SEQ ID NO: 148139 - DNA, 25 bp, Homo sapien
cgcgtgctctgcaccgaggagtact

SEQ ID NO: 148140 - DNA, 25 bp, Homo sapien
agttctacgccgaggactgcatgga

SEQ ID NO: 148141 - DNA, 25 bp, Homo sapien
ccacggtcatggtcctggagaagtc

SEQ ID NO: 148142 - DNA, 25 bp, Homo sapien
ccgacgacgtggtgatgaccttcga

SEQ ID NO: 148143 - DNA, 25 bp, Homo sapien
ccaacatcgaggtcatcggcaggta

SEQ ID NO: 148144 - DNA, 25 bp, Homo sapien
gcctggtgggaactacgagaaagac

SEQ ID NO: 148145 - DNA, 25 bp, Homo sapien
caccctgcttcgcaggagctcggag

SEQ ID NO: 148146 - DNA, 25 bp, Homo sapien
ccaacgtgtgcgacgacgaccagct

SEQ ID NO: 148147 - DNA, 25 bp, Homo sapien
ctgctgtgccagaacggaggcacct

SEQ ID NO: 148148 - DNA, 25 bp, Homo sapien
acggaggcacctgcctgcagaacca

SEQ ID NO: 148149 - DNA, 25 bp, Homo sapien
tggaacagcacgtgcacagctctgg

SEQ ID NO: 148150 - DNA, 25 bp, Homo sapien
gaggctgtccaagtcggcgttagcc

SEQ ID NO: 148151 - DNA, 25 bp, Homo sapien
actgcaggcgcgtctgaagaacagc

SEQ ID NO: 148152 - DNA, 25 bp, Homo sapien
agggcggacacttaacactcgcgtc

SEQ ID NO: 148153 - DNA, 25 bp, Homo sapien
ccagggcggacacttaacactcgcg

SEQ ID NO: 148154 - DNA, 25 bp, Homo sapien
ggccagggcggacacttaacactcg

SEQ ID NO: 148155 - DNA, 25 bp, Homo sapien
ggacacttaacactcgcgtcggccg

SEQ ID NO: 148156 - DNA, 25 bp, Homo sapien
ccggccagggcggacacttaacact

SEQ ID NO: 148157 - DNA, 25 bp, Homo sapien
acacttaacactcgcgtcggccgcg

SEQ ID NO: 148158 - DNA, 25 bp, Homo sapien
ggcggacacttaacactcgcgtcgg

SEQ ID NO: 148159 - DNA, 25 bp, Homo sapien
gctgcggtcacactcgctccctccg

SEQ ID NO: 148160 - DNA, 25 bp, Homo sapien
taacggaagccgaccaatggcgggc

SEQ ID NO: 148161 - DNA, 25 bp, Homo sapien
tcactgtcgccaaaggcctccgctc

SEQ ID NO: 148162 - DNA, 25 bp, Homo sapien
atcagcggcgtaacggaagccgacc

SEQ ID NO: 148163 - DNA, 25 bp, Homo sapien
tactccacatcagcggcgtaacgga

SEQ ID NO: 148164 - DNA, 25 bp, Homo sapien
atcctagcagctccgcaaaccgccg

SEQ ID NO: 148165 - DNA, 25 bp, Homo sapien
tcctcagtgctgtcggcagctgaca

SEQ ID NO: 148166 - DNA, 25 bp, Homo sapien
ttcgacttcggccaactcctcagtg

SEQ ID NO: 148167 - DNA, 25 bp, Homo sapien
gctcctctcgcggctgcgtcattat

SEQ ID NO: 148168 - DNA, 25 bp, Homo sapien
tcaggtgtctcagcggatgtactac

SEQ ID NO: 148169 - DNA, 25 bp, Homo sapien
cgctctaggccaccagcggaagtgc

SEQ ID NO: 148170 - DNA, 25 bp, Homo sapien
accaaccagctgttgccgcgaggta

SEQ ID NO: 148171 - DNA, 25 bp, Homo sapien
gtgtggagggaaccgacactttcca

SEQ ID NO: 148172 - DNA, 25 bp, Homo sapien
gagtttgccgcggaaccttgacctc

SEQ ID NO: 148173 - DNA, 25 bp, Homo sapien
tcttcttttttccacgcctcaggtg

SEQ ID NO: 148174 - DNA, 25 bp, Homo sapien
ccgcagtgtagacaacggaaggaca

SEQ ID NO: 148175 - DNA, 25 bp, Homo sapien
acagctcacacgagaccgcagtgta

SEQ ID NO: 148176 - DNA, 25 bp, Homo sapien
aacccggaagtgctgctgttgagga

SEQ ID NO: 148177 - DNA, 25 bp, Homo sapien
ctcaggccaaaaggcgggtctccca

SEQ ID NO: 148178 - DNA, 25 bp, Homo sapien
tcggcgtcacgctgccatggtaaca

SEQ ID NO: 148179 - DNA, 25 bp, Homo sapien
tgccatggtaacacggctgccgcta

SEQ ID NO: 148180 - DNA, 25 bp, Homo sapien
cccacgctgagtttttacgcgcgca

SEQ ID NO: 148181 - DNA, 25 bp, Homo sapien
aagtagtagtgcgtcgccttccggc

SEQ ID NO: 148182 - DNA, 25 bp, Homo sapien
caaaaggcgggtctcccagaagacg

SEQ ID NO: 148183 - DNA, 25 bp, Homo sapien
tttacgcgcgcattttgaaaaacag

SEQ ID NO: 148184 - DNA, 25 bp, Homo sapien
tctcaccctgtgtttcggcggagtt

SEQ ID NO: 148185 - DNA, 25 bp, Homo sapien
atcccgctctcagggcagggaattc

SEQ ID NO: 148186 - DNA, 25 bp, Homo sapien
gggcccgagtttcttgaatgaagtc

SEQ ID NO: 148187 - DNA, 25 bp, Homo sapien
aagaagtgcaacctgatcgccgaga

SEQ ID NO: 148188 - DNA, 25 bp, Homo sapien
cgcgactgccagtgcaagaagtgca

SEQ ID NO: 148189 - DNA, 25 bp, Homo sapien
gcttctgcatgtggcgcgactgcca

SEQ ID NO: 148190 - DNA, 25 bp, Homo sapien
tgcccaagtgcgcacgctgcaggaa

SEQ ID NO: 148191 - DNA, 25 bp, Homo sapien
gccacgctacatcgccggtctggga

SEQ ID NO: 148192 - DNA, 25 bp, Homo sapien
ttgccttgcgtggtcccaaactttc

SEQ ID NO: 148193 - DNA, 25 bp, Homo sapien
cccggagcacagagagttggctaac

SEQ ID NO: 148194 - DNA, 25 bp, Homo sapien
tgcctccgtaggagaatgttcgccc

SEQ ID NO: 148195 - DNA, 25 bp, Homo sapien
cagccgtctcttaggagatttctcc

SEQ ID NO: 148196 - DNA, 25 bp, Homo sapien
taagcgattcacagcactcagggga

SEQ ID NO: 148197 - DNA, 25 bp, Homo sapien
cgcccgcacttaccaggataagatg

SEQ ID NO: 148198 - DNA, 25 bp, Homo sapien
cttagcaggaacgattaagcgattc

SEQ ID NO: 148199 - DNA, 25 bp, Homo sapien
atccacggcagagccacctgtgagc

SEQ ID NO: 148200 - DNA, 25 bp, Homo sapien
tcagaaccctctcatcgtcaaggtg

SEQ ID NO: 148201 - DNA, 25 bp, Homo sapien
gtcgtgcgggactccatgtttcaga

SEQ ID NO: 148202 - DNA, 25 bp, Homo sapien
cggacatccgttccggcatggagaa

SEQ ID NO: 148203 - DNA, 25 bp, Homo sapien
gcccggacctcacgcgatggaggaa

SEQ ID NO: 148204 - DNA, 25 bp, Homo sapien
ctcaaggatgccagaggccaggagc

SEQ ID NO: 148205 - DNA, 25 bp, Homo sapien
aggggtcctggcatctgagtttccc

SEQ ID NO: 148206 - DNA, 25 bp, Homo sapien
agacgggccgttgcattcgtcctcc

SEQ ID NO: 148207 - DNA, 25 bp, Homo sapien
tgttggcgtcccgtcgccaaggaga

SEQ ID NO: 148208 - DNA, 25 bp, Homo sapien
tctcgatctcataagctgcacagcg

SEQ ID NO: 148209 - DNA, 25 bp, Homo sapien
ctcacacggcaagggccatacatca

SEQ ID NO: 148210 - DNA, 25 bp, Homo sapien
cagcgagatcatgtaaatgcaaatg

SEQ ID NO: 148211 - DNA, 25 bp, Homo sapien
tcgctgccttctccgagtgtaatca

SEQ ID NO: 148212 - DNA, 25 bp, Homo sapien
aaacatgctgttgagttaccggccc

SEQ ID NO: 148213 - DNA, 25 bp, Homo sapien
gttcgccttttgtcaaaacgctgcg

SEQ ID NO: 148214 - DNA, 25 bp, Homo sapien
aggacctgatttcaagctgtcgagg

SEQ ID NO: 148215 - DNA, 25 bp, Homo sapien
gctaagtagcaaataaatctctcga

SEQ ID NO: 148216 - DNA, 25 bp, Homo sapien
gccacgtttccagagttgccttgaa

SEQ ID NO: 148217 - DNA, 25 bp, Homo sapien
gccttgaaaatgcatccctggacga

SEQ ID NO: 148218 - DNA, 25 bp, Homo sapien
agctctggctctgcgtggaataaga

SEQ ID NO: 148219 - DNA, 25 bp, Homo sapien
tgcctcccttgagccacacggattt

SEQ ID NO: 148220 - DNA, 25 bp, Homo sapien
acacggatttctcgaggtctcccta

SEQ ID NO: 148221 - DNA, 25 bp, Homo sapien
tcgccctgaagtgaagccatcggtc

SEQ ID NO: 148222 - DNA, 25 bp, Homo sapien
atcggtctcgtcacttcccaggaag

SEQ ID NO: 148223 - DNA, 25 bp, Homo sapien
ggagcttcgtcaccggcctaatgaa

SEQ ID NO: 148224 - DNA, 25 bp, Homo sapien
ggtcgcttattctcccagtgctcgg

SEQ ID NO: 148225 - DNA, 25 bp, Homo sapien
acgaattcgtttccatataggggca

SEQ ID NO: 148226 - DNA, 25 bp, Homo sapien
gcggggcacaatgatctgtccttga

SEQ ID NO: 148227 - DNA, 25 bp, Homo sapien
gagcaggtttttgtccctccacgca

SEQ ID NO: 148228 - DNA, 25 bp, Homo sapien
ggagccatcgttagcgggcaatgta

SEQ ID NO: 148229 - DNA, 25 bp, Homo sapien
agttctcgccagcttcgggttcttt

SEQ ID NO: 148230 - DNA, 25 bp, Homo sapien
cgcgagatctccagctccagggaca

SEQ ID NO: 148231 - DNA, 25 bp, Homo sapien
cgaggttacacaaacgccacgggca

SEQ ID NO: 148232 - DNA, 25 bp, Homo sapien
cgggtgtacatacgcgtctctgcca

SEQ ID NO: 148233 - DNA, 25 bp, Homo sapien
ccgtggattagtgagtctgtggcct

SEQ ID NO: 148234 - DNA, 25 bp, Homo sapien
ttattcgtgacccatgagcccgtga

SEQ ID NO: 148235 - DNA, 25 bp, Homo sapien
cttcttacaaatgaccaggcgcctg

SEQ ID NO: 148236 - DNA, 25 bp, Homo sapien
ctacagcgaggccagctcgttgttc

SEQ ID NO: 148237 - DNA, 25 bp, Homo sapien
gggccaaatgccaagtccactgagg

SEQ ID NO: 148238 - DNA, 25 bp, Homo sapien
ggtttccttccatcctcaataacga

SEQ ID NO: 148239 - DNA, 25 bp, Homo sapien
ctgagctgtacataccgtgtgcaaa

SEQ ID NO: 148240 - DNA, 25 bp, Homo sapien
tcgcggcctggcaaaattacattcg

SEQ ID NO: 148241 - DNA, 25 bp, Homo sapien
ctctggagctcaatccctgggcagg

SEQ ID NO: 148242 - DNA, 25 bp, Homo sapien
tacattcggccgagagttcacgctg

SEQ ID NO: 148243 - DNA, 25 bp, Homo sapien
ggggaagctctctgaatgcctctga

SEQ ID NO: 148244 - DNA, 25 bp, Homo sapien
gggtagctccctaacaggctctgga

SEQ ID NO: 148245 - DNA, 25 bp, Homo sapien
aggcagttccttggccacctggtag

SEQ ID NO: 148246 - DNA, 25 bp, Homo sapien
gctgcattccgcctcatggtgactc

SEQ ID NO: 148247 - DNA, 25 bp, Homo sapien
cgtgcgtttcctcagcactttagga

SEQ ID NO: 148248 - DNA, 25 bp, Homo sapien
tctttggggacgtgtcttcatgccc

SEQ ID NO: 148249 - DNA, 25 bp, Homo sapien
taaggccggtgtgagtattttactg

SEQ ID NO: 148250 - DNA, 25 bp, Homo sapien
ttgcggctctggactattgtgaata

SEQ ID NO: 148251 - DNA, 25 bp, Homo sapien
ttcccaggacgttgcacagaaaatc

SEQ ID NO: 148252 - DNA, 25 bp, Homo sapien
tgacgcagttttagattcccaggac

SEQ ID NO: 148253 - DNA, 25 bp, Homo sapien
aagccgctgggcgtctgtaaccaac

SEQ ID NO: 148254 - DNA, 25 bp, Homo sapien
gtgacgaatgttcccgcggcgtctc

SEQ ID NO: 148255 - DNA, 25 bp, Homo sapien
gtgacccatggtggctccaagtgcc

SEQ ID NO: 148256 - DNA, 25 bp, Homo sapien
ctttctcgagaaaacgtaacatcta

SEQ ID NO: 148257 - DNA, 25 bp, Homo sapien
tctggtgccgctgacgcacaccgta

SEQ ID NO: 148258 - DNA, 25 bp, Homo sapien
tgcaggctgaaggagctcctctggt

SEQ ID NO: 148259 - DNA, 25 bp, Homo sapien
ggggcctcaaaatctgcaggctgaa

SEQ ID NO: 148260 - DNA, 25 bp, Homo sapien
ccttgcttgcagcttcatccttgga

SEQ ID NO: 148261 - DNA, 25 bp, Homo sapien
tagcggcgagtcaatccagggactc

SEQ ID NO: 148262 - DNA, 25 bp, Homo sapien
tcgatttcaatacggcgctccgaga

SEQ ID NO: 148263 - DNA, 25 bp, Homo sapien
atcctcaccgaggacatcgatttca

SEQ ID NO: 148264 - DNA, 25 bp, Homo sapien
ctctgctgcttcctcagtgccatga

SEQ ID NO: 148265 - DNA, 25 bp, Homo sapien
tccgccaggtaaaaacagcagtcgc

SEQ ID NO: 148266 - DNA, 25 bp, Homo sapien
cctgggatgcagacaacgtggcatt

SEQ ID NO: 148267 - DNA, 25 bp, Homo sapien
agtcgcgatccattgtcacagccca

SEQ ID NO: 148268 - DNA, 25 bp, Homo sapien
gctgtaacctgagcagcccgcgtga

SEQ ID NO: 148269 - DNA, 25 bp, Homo sapien
cagtggtgacttccgggattgaatt

SEQ ID NO: 148270 - DNA, 25 bp, Homo sapien
gaagccggtcccatttcaacagaga

SEQ ID NO: 148271 - DNA, 25 bp, Homo sapien
aattcgggcgcatcgtccgccaggt

SEQ ID NO: 148272 - DNA, 25 bp, Homo sapien
gccgccaagtgacccgattgctatg

SEQ ID NO: 148273 - DNA, 25 bp, Homo sapien
gggtcacggcgacacacgaatcgta

SEQ ID NO: 148274 - DNA, 25 bp, Homo sapien
gattgctatggcaccggcggtaaca

SEQ ID NO: 148275 - DNA, 25 bp, Homo sapien
agctgggcctcctcgtatctgagac

SEQ ID NO: 148276 - DNA, 25 bp, Homo sapien
acaccctcaggtggcttccagctgg

SEQ ID NO: 148277 - DNA, 25 bp, Homo sapien
atagtggcgtccatgtagccgtctc

SEQ ID NO: 148278 - DNA, 25 bp, Homo sapien
cgggtggaaatcctcagcccaactc

SEQ ID NO: 148279 - DNA, 25 bp, Homo sapien
tgtccggtcacctgcatcaactcga

SEQ ID NO: 148280 - DNA, 25 bp, Homo sapien
atcctgtttcccaaggagctgctgg

SEQ ID NO: 148281 - DNA, 25 bp, Homo sapien
ggcctcagagcagcgatcctgtttc

SEQ ID NO: 148282 - DNA, 25 bp, Homo sapien
cgagtcgtttctgcccttcgcttgc

SEQ ID NO: 148283 - DNA, 25 bp, Homo sapien
agagatcttgtgactccgcgaagga

SEQ ID NO: 148284 - DNA, 25 bp, Homo sapien
gaagaggctcttccactcataactg

SEQ ID NO: 148285 - DNA, 25 bp, Homo sapien
gccagccggagatagcgtgtaataa

SEQ ID NO: 148286 - DNA, 25 bp, Homo sapien
ttctcgaaaggaaggatagacggcc

SEQ ID NO: 148287 - DNA, 25 bp, Homo sapien
cccgggatccctaccaagcaagtga

SEQ ID NO: 148288 - DNA, 25 bp, Homo sapien
tcggttttccaaagcggcctccatg

SEQ ID NO: 148289 - DNA, 25 bp, Homo sapien
cgcttcccggagagttgtaaagctc

SEQ ID NO: 148290 - DNA, 25 bp, Homo sapien
tcgggaactttctcttttgctggtc

SEQ ID NO: 148291 - DNA, 25 bp, Homo sapien
aaaatcgcggcgaagagctttccga

SEQ ID NO: 148292 - DNA, 25 bp, Homo sapien
tttcattcaagtgcagccctgggaa

SEQ ID NO: 148293 - DNA, 25 bp, Homo sapien
ctgcaccggtgtgagagtgtatccc

SEQ ID NO: 148294 - DNA, 25 bp, Homo sapien
tctacagagtaacgaaccgagcggg

SEQ ID NO: 148295 - DNA, 25 bp, Homo sapien
cctgcctcatttaagtggtaatttc

SEQ ID NO: 148296 - DNA, 25 bp, Homo sapien
ggtccagtcctgagcctgcacctga

SEQ ID NO: 148297 - DNA, 25 bp, Homo sapien
gagcgcagcttcgagtgccgcatgt

SEQ ID NO: 148298 - DNA, 25 bp, Homo sapien
ggccttcaagcgctcgtccacgctg

SEQ ID NO: 148299 - DNA, 25 bp, Homo sapien
cctgccagttctgcggcaagcgttt

SEQ ID NO: 148300 - DNA, 25 bp, Homo sapien
cttcgagtgccgcatgtgcggcaag

SEQ ID NO: 148301 - DNA, 25 bp, Homo sapien
ctgcggcaagcgtttccaccagaag

SEQ ID NO: 148302 - DNA, 25 bp, Homo sapien
tgctcatccactcagacacgcggcc

SEQ ID NO: 148303 - DNA, 25 bp, Homo sapien
gtccacgctgtccacccacctgctc

SEQ ID NO: 148304 - DNA, 25 bp, Homo sapien
cgcccggtggactaactcgcttaat

SEQ ID NO: 148305 - DNA, 25 bp, Homo sapien
gctgggacgtggttaactctagttc

SEQ ID NO: 148306 - DNA, 25 bp, Homo sapien
ggccgacccaatgcggaaatcaatt

SEQ ID NO: 148307 - DNA, 25 bp, Homo sapien
cgcaagcgccgttggaaacctagtc

SEQ ID NO: 148308 - DNA, 25 bp, Homo sapien
ccctcgctggctagtaggagagact

SEQ ID NO: 148309 - DNA, 25 bp, Homo sapien
ggccctcggattctcattggctgaa

SEQ ID NO: 148310 - DNA, 25 bp, Homo sapien
tttgtgtcttattatcctccgggtc

SEQ ID NO: 148311 - DNA, 25 bp, Homo sapien
ctgcctaacagacgaacgccggatg

SEQ ID NO: 148312 - DNA, 25 bp, Homo sapien
gcggagcctgagaaccaacttcctg

SEQ ID NO: 148313 - DNA, 25 bp, Homo sapien
atgggcagcagctccatgaagcgga

SEQ ID NO: 148314 - DNA, 25 bp, Homo sapien
ctacctggagatcaccaagaagatg

SEQ ID NO: 148315 - DNA, 25 bp, Homo sapien
gccttggtatcaagaggccacaaga

SEQ ID NO: 148316 - DNA, 25 bp, Homo sapien
ttttagcgtcccatgagccttggta

SEQ ID NO: 148317 - DNA, 25 bp, Homo sapien
cccacagatgactccaaggaagctc

SEQ ID NO: 148318 - DNA, 25 bp, Homo sapien
caaggaagctcagatgcctgcagtc

SEQ ID NO: 148319 - DNA, 25 bp, Homo sapien
cctgcagtcattaggttttagcgtc

SEQ ID NO: 148320 - DNA, 25 bp, Homo sapien
cctgggtgggaactgagtgaaataa

SEQ ID NO: 148321 - DNA, 25 bp, Homo sapien
acatgcgctgcaccatggaaggctc

SEQ ID NO: 148322 - DNA, 25 bp, Homo sapien
gctggctgatttctgcagaaggccc

SEQ ID NO: 148323 - DNA, 25 bp, Homo sapien
taggcaccgtttgcgtgtcacgctg

SEQ ID NO: 148324 - DNA, 25 bp, Homo sapien
cacaggccaccgatgtaaacaggga

SEQ ID NO: 148325 - DNA, 25 bp, Homo sapien
cagccgtggtccctactgttggacg

SEQ ID NO: 148326 - DNA, 25 bp, Homo sapien
gtgccgcagaaaaaggtccacctgg

SEQ ID NO: 148327 - DNA, 25 bp, Homo sapien
cgtaaaggctaacgacgcgctgcgg

SEQ ID NO: 148328 - DNA, 25 bp, Homo sapien
tacagctgtgcgcaagctcctcgcg

SEQ ID NO: 148329 - DNA, 25 bp, Homo sapien
ctgacaccacggtctgcaaaccatg

SEQ ID NO: 148330 - DNA, 25 bp, Homo sapien
ggtctgcaaaccatggtcctcctcg

SEQ ID NO: 148331 - DNA, 25 bp, Homo sapien
cctggcctgtttacagctgtgcgca

SEQ ID NO: 148332 - DNA, 25 bp, Homo sapien
tgggttcctgcgatgtcttccgact

SEQ ID NO: 148333 - DNA, 25 bp, Homo sapien
tcgcgacccgaaagcgagacctttg

SEQ ID NO: 148334 - DNA, 25 bp, Homo sapien
gaaagcgagacctttgtctgcggca

SEQ ID NO: 148335 - DNA, 25 bp, Homo sapien
tcctcccgtgtgtgtcacccatgag

SEQ ID NO: 148336 - DNA, 25 bp, Homo sapien
ccggcttgcacagctggctggtctt

SEQ ID NO: 148337 - DNA, 25 bp, Homo sapien
gacggcgcccaaatgctccgcaggg

SEQ ID NO: 148338 - DNA, 25 bp, Homo sapien
tcttccgcctggacagacgtcatga

SEQ ID NO: 148339 - DNA, 25 bp, Homo sapien
acgtcatgaatgtggctcagaccca

SEQ ID NO: 148340 - DNA, 25 bp, Homo sapien
ttgggtttaatttgggcaacatgca

SEQ ID NO: 148341 - DNA, 25 bp, Homo sapien
tgtgagcggaacacgcattcccgtg

SEQ ID NO: 148342 - DNA, 25 bp, Homo sapien
cgtgcgagctgccttgagctgcaaa

SEQ ID NO: 148343 - DNA, 25 bp, Homo sapien
gctgccttgagctgcaaacggggcc

SEQ ID NO: 148344 - DNA, 25 bp, Homo sapien
ctaccatcatcctcagcctcggtgg

SEQ ID NO: 148345 - DNA, 25 bp, Homo sapien
gatgccacctgctggactcggctcg

SEQ ID NO: 148346 - DNA, 25 bp, Homo sapien
ggagctgcgtaagcgcacgctcagc

SEQ ID NO: 148347 - DNA, 25 bp, Homo sapien
tcaccaaatatacacgttcaccctg

SEQ ID NO: 148348 - DNA, 25 bp, Homo sapien
gcgccggcgtcaccaaatatacacg

SEQ ID NO: 148349 - DNA, 25 bp, Homo sapien
cgctaggacctagggccaacctcgc

SEQ ID NO: 148350 - DNA, 25 bp, Homo sapien
gcagccgggcctgttgtccaaggcc

SEQ ID NO: 148351 - DNA, 25 bp, Homo sapien
ccatgtgcggccgatctcacgtgtc

SEQ ID NO: 148352 - DNA, 25 bp, Homo sapien
tacggggtgcagacttactccttgc

SEQ ID NO: 148353 - DNA, 25 bp, Homo sapien
gggaacgcgcctcaactcgctggct

SEQ ID NO: 148354 - DNA, 25 bp, Homo sapien
tctccacggaacgatgggaacgcgc

SEQ ID NO: 148355 - DNA, 25 bp, Homo sapien
acatgcagtcccagcgcaggatgcg

SEQ ID NO: 148356 - DNA, 25 bp, Homo sapien
aggcacagcgaggacacatgcagtc

SEQ ID NO: 148357 - DNA, 25 bp, Homo sapien
tggaaatcaagcaccgaggcacagc

SEQ ID NO: 148358 - DNA, 25 bp, Homo sapien
ggccagtccaccgtccgctggaaat

SEQ ID NO: 148359 - DNA, 25 bp, Homo sapien
gaacggctgtaaaacgctgggcgca

SEQ ID NO: 148360 - DNA, 25 bp, Homo sapien
ctgcgggacccacgacaatctcagg

SEQ ID NO: 148361 - DNA, 25 bp, Homo sapien
ggagaagcagcacctggacctgagc

SEQ ID NO: 148362 - DNA, 25 bp, Homo sapien
aaggaacgcagctcgtgagtggccc

SEQ ID NO: 148363 - DNA, 25 bp, Homo sapien
cccagagagcgggaaccagagcgcc

SEQ ID NO: 148364 - DNA, 25 bp, Homo sapien
acaatctcaggtcacgcctgccggg

SEQ ID NO: 148365 - DNA, 25 bp, Homo sapien
ggagagaccgcaaccagacgtaaaa

SEQ ID NO: 148366 - DNA, 25 bp, Homo sapien
ctgggctcggaaacacgtgctttac

SEQ ID NO: 148367 - DNA, 25 bp, Homo sapien
cacggcgcaaaagcagactgggctc

SEQ ID NO: 148368 - DNA, 25 bp, Homo sapien
atggactgcgggacaggcccgccct

SEQ ID NO: 148369 - DNA, 25 bp, Homo sapien
tctcccggagtgagaatggactgcg

SEQ ID NO: 148370 - DNA, 25 bp, Homo sapien
gaacgggaagggctctccgtccatc

SEQ ID NO: 148371 - DNA, 25 bp, Homo sapien
actcaggagccttcacgggcctcgt

SEQ ID NO: 148372 - DNA, 25 bp, Homo sapien
tcctccgacagggacggcactgatg

SEQ ID NO: 148373 - DNA, 25 bp, Homo sapien
cagggagaactcaggagccttcacg

SEQ ID NO: 148374 - DNA, 25 bp, Homo sapien
accgtctgtgggagccaccgcgtct

SEQ ID NO: 148375 - DNA, 25 bp, Homo sapien
cgggagctggaacgttctttccacg

SEQ ID NO: 148376 - DNA, 25 bp, Homo sapien
actgatcatctccatgcggcgcatg

SEQ ID NO: 148377 - DNA, 25 bp, Homo sapien
cgccgctcgcagaagtcactgatca

SEQ ID NO: 148378 - DNA, 25 bp, Homo sapien
tggtcgcggaactccatgtccacgt

SEQ ID NO: 148379 - DNA, 25 bp, Homo sapien
gagtcaggatctccacgcccacgtg

SEQ ID NO: 148380 - DNA, 25 bp, Homo sapien
ccaggtagtagaaatcgccctcgtc

SEQ ID NO: 148381 - DNA, 25 bp, Homo sapien
gcaggtacttgttcaggtggctctc

SEQ ID NO: 148382 - DNA, 25 bp, Homo sapien
agctgctggtcccacaagtactcgg

SEQ ID NO: 148383 - DNA, 25 bp, Homo sapien
gggcaccgcagtgaacctcagcttc

SEQ ID NO: 148384 - DNA, 25 bp, Homo sapien
cacgccgaggcatccataacttaga

SEQ ID NO: 148385 - DNA, 25 bp, Homo sapien
tgccacggggttcgtgcacaacaaa

SEQ ID NO: 148386 - DNA, 25 bp, Homo sapien
agcctctgctgatgggcacaaactc

SEQ ID NO: 148387 - DNA, 25 bp, Homo sapien
gctgtgccaggcgaaatggaaacta

SEQ ID NO: 148388 - DNA, 25 bp, Homo sapien
aggcacacgccgaggaagtctttgt

SEQ ID NO: 148389 - DNA, 25 bp, Homo sapien
gcagtgaacgttgcgcctgacattt

SEQ ID NO: 148390 - DNA, 25 bp, Homo sapien
gcccaagtggctccaaagtatctcc

SEQ ID NO: 148391 - DNA, 25 bp, Homo sapien
cccgcatctacatcggacaggattg

SEQ ID NO: 148392 - DNA, 25 bp, Homo sapien
agcgtccgcaacacctcggccatgg

SEQ ID NO: 148393 - DNA, 25 bp, Homo sapien
cgcagactgaggaaccttcgcgttc

SEQ ID NO: 148394 - DNA, 25 bp, Homo sapien
ccttgacaccctgtctcccgggcgg

SEQ ID NO: 148395 - DNA, 25 bp, Homo sapien
tctgcgtcccgcagactgaggaacc

SEQ ID NO: 148396 - DNA, 25 bp, Homo sapien
gcattccctgcggtagcggctccct

SEQ ID NO: 148397 - DNA, 25 bp, Homo sapien
aaaatagcagctcatggaaggcggg

SEQ ID NO: 148398 - DNA, 25 bp, Homo sapien
cggtaggtgctgaaaatagcagctc

SEQ ID NO: 148399 - DNA, 25 bp, Homo sapien
agacgaacccgtgaagctgcggccc

SEQ ID NO: 148400 - DNA, 25 bp, Homo sapien
gcggcccttcttgcgggctctgagc

SEQ ID NO: 148401 - DNA, 25 bp, Homo sapien
ttcttcctgcgcaggttctgccgcc

SEQ ID NO: 148402 - DNA, 25 bp, Homo sapien
gggaaagactcagaccaggcctgcg

SEQ ID NO: 148403 - DNA, 25 bp, Homo sapien
aagactcagaccaggcctgcgcgct

SEQ ID NO: 148404 - DNA, 25 bp, Homo sapien
ctgcggcaggatgcggcccttcttg

SEQ ID NO: 148405 - DNA, 25 bp, Homo sapien
caggatgcggcccttcttgcgggct

SEQ ID NO: 148406 - DNA, 25 bp, Homo sapien
ggcccttcttgcgggctctgagcag

SEQ ID NO: 148407 - DNA, 25 bp, Homo sapien
atgcggcccttcttgcgggctctga

SEQ ID NO: 148408 - DNA, 25 bp, Homo sapien
tgcctcttctcttttctgcgctgcg

SEQ ID NO: 148409 - DNA, 25 bp, Homo sapien
cctgcagcaggcgttcgtcgtcacg

SEQ ID NO: 148410 - DNA, 25 bp, Homo sapien
cgttcgtcgtcacggatcttcacgc

SEQ ID NO: 148411 - DNA, 25 bp, Homo sapien
tagttcctcccggtcagcggcgtga

SEQ ID NO: 148412 - DNA, 25 bp, Homo sapien
agcagctgccggtagttcctcccgg

SEQ ID NO: 148413 - DNA, 25 bp, Homo sapien
ggttggtccacttcatcttcgcctc

SEQ ID NO: 148414 - DNA, 25 bp, Homo sapien
ccgccttgtagaggaggttggtcca

SEQ ID NO: 148415 - DNA, 25 bp, Homo sapien
cacgccctccgccttgtagaggagg

SEQ ID NO: 148416 - DNA, 25 bp, Homo sapien
tagccaagcctgactccgccggaag

SEQ ID NO: 148417 - DNA, 25 bp, Homo sapien
ggaaaccaccacacgggcaggcgcg

SEQ ID NO: 148418 - DNA, 25 bp, Homo sapien
cgtccttggcgagtagagaggccat

SEQ ID NO: 148419 - DNA, 25 bp, Homo sapien
ggagcagatcttcttggccaggctc

SEQ ID NO: 148420 - DNA, 25 bp, Homo sapien
cgggccgttcacgactcacaccttc

SEQ ID NO: 148421 - DNA, 25 bp, Homo sapien
aggcgcggccaaacgaacgccgagc

SEQ ID NO: 148422 - DNA, 25 bp, Homo sapien
gcctggcctcagtgcctcaatcacc

SEQ ID NO: 148423 - DNA, 25 bp, Homo sapien
cgcgcctgctgttccggggccgaat

SEQ ID NO: 148424 - DNA, 25 bp, Homo sapien
gcacctccatgctgccgccacactg

SEQ ID NO: 148425 - DNA, 25 bp, Homo sapien
agctaggggcccgtgagaggccaag

SEQ ID NO: 148426 - DNA, 25 bp, Homo sapien
gcgtccttcccaacggaagcgggca

SEQ ID NO: 148427 - DNA, 25 bp, Homo sapien
cgcgcagggcgttgcgcttggcata

SEQ ID NO: 148428 - DNA, 25 bp, Homo sapien
ttggcatagtagtcaatgtcgttgt

SEQ ID NO: 148429 - DNA, 25 bp, Homo sapien
tgtcgttgttgtagggcttcctggt

SEQ ID NO: 148430 - DNA, 25 bp, Homo sapien
cgccacactgccacacctgcgggga

SEQ ID NO: 148431 - DNA, 25 bp, Homo sapien
tcaatgtcgttgttgtagggcttcc

SEQ ID NO: 148432 - DNA, 25 bp, Homo sapien
gggcttagccttgctctggccactc

SEQ ID NO: 148433 - DNA, 25 bp, Homo sapien
gcgccgcggtccgaaaacctagtca

SEQ ID NO: 148434 - DNA, 25 bp, Homo sapien
cccgcctcgatttttagctttatag

SEQ ID NO: 148435 - DNA, 25 bp, Homo sapien
tgagctgtagttccgtggcactata

SEQ ID NO: 148436 - DNA, 25 bp, Homo sapien
ctcctggacgcactcgcattgtttg

SEQ ID NO: 148437 - DNA, 25 bp, Homo sapien
tgccggtatcaactctcgcgatctc

SEQ ID NO: 148438 - DNA, 25 bp, Homo sapien
cgcgatctccgaggccgcatacata

SEQ ID NO: 148439 - DNA, 25 bp, Homo sapien
tcacacgcaggaaaggggatctccg

SEQ ID NO: 148440 - DNA, 25 bp, Homo sapien
tcctgacaggtcacgagctgccctg

SEQ ID NO: 148441 - DNA, 25 bp, Homo sapien
tccgggacgcaggaggcatctgcat

SEQ ID NO: 148442 - DNA, 25 bp, Homo sapien
gctccaggttctgcgagcggcttcc

SEQ ID NO: 148443 - DNA, 25 bp, Homo sapien
cgtttctgcgggagcacccgagcct

SEQ ID NO: 148444 - DNA, 25 bp, Homo sapien
tacacccgcggcaaaaagtaccagc

SEQ ID NO: 148445 - DNA, 25 bp, Homo sapien
cccggccttcgactatgcagagttc

SEQ ID NO: 148446 - DNA, 25 bp, Homo sapien
tatgcagagttcgagccgcacatcg

SEQ ID NO: 148447 - DNA, 25 bp, Homo sapien
cagcaccaagaacccgtaggtggtc

SEQ ID NO: 148448 - DNA, 25 bp, Homo sapien
cgtacgcggtcgctactgatcatgc

SEQ ID NO: 148449 - DNA, 25 bp, Homo sapien
caggccgcacctggtcggcgaagtc

SEQ ID NO: 148450 - DNA, 25 bp, Homo sapien
gcccatcaggtcgttctggcccatg

SEQ ID NO: 148451 - DNA, 25 bp, Homo sapien
tgcggcctccacaggaagtgcccgg

SEQ ID NO: 148452 - DNA, 25 bp, Homo sapien
tccagcggctgccacgtaggccaag

SEQ ID NO: 148453 - DNA, 25 bp, Homo sapien
tgccacgtaggccaagccttaaagg

SEQ ID NO: 148454 - DNA, 25 bp, Homo sapien
tactgatcatgcttgggccagggtc

SEQ ID NO: 148455 - DNA, 25 bp, Homo sapien
aagtcctcggccgtgcccatcaggt

SEQ ID NO: 148456 - DNA, 25 bp, Homo sapien
tggaaaccggatccctgcctctggt

SEQ ID NO: 148457 - DNA, 25 bp, Homo sapien
catccggggtcatcgacctcgagtt

SEQ ID NO: 148458 - DNA, 25 bp, Homo sapien
acctcgagtttgactggggcaagcc

SEQ ID NO: 148459 - DNA, 25 bp, Homo sapien
tagcacccggtagggcagctgagct

SEQ ID NO: 148460 - DNA, 25 bp, Homo sapien
tgcgtcctggactctcgagcctttc

SEQ ID NO: 148461 - DNA, 25 bp, Homo sapien
gtcttgacaggacccggcttagcca

SEQ ID NO: 148462 - DNA, 25 bp, Homo sapien
tccacaaccggctggaaaccggatc

SEQ ID NO: 148463 - DNA, 25 bp, Homo sapien
tttcttccgagtgagcgtcttgaca

SEQ ID NO: 148464 - DNA, 25 bp, Homo sapien
acacgtgatggcttcggacggcgcc

SEQ ID NO: 148465 - DNA, 25 bp, Homo sapien
agcgccacctctctctacgtccgtc

SEQ ID NO: 148466 - DNA, 25 bp, Homo sapien
cagcggacacgtgatggcttcggac

SEQ ID NO: 148467 - DNA, 25 bp, Homo sapien
agcttcggcctggagcacgacggcg

SEQ ID NO: 148468 - DNA, 25 bp, Homo sapien
tgccggccgccttagcgcaactccc

SEQ ID NO: 148469 - DNA, 25 bp, Homo sapien
ccgggtcggaaaactcgctggcgct

SEQ ID NO: 148470 - DNA, 25 bp, Homo sapien
ctccactgcgcccagttagcagatg

SEQ ID NO: 148471 - DNA, 25 bp, Homo sapien
cccagttagcagatggcggcgtcag

SEQ ID NO: 148472 - DNA, 25 bp, Homo sapien
ttcgccagggagcacctggtgagtc

SEQ ID NO: 148473 - DNA, 25 bp, Homo sapien
aactcctgttcccactcacaaaagg

SEQ ID NO: 148474 - DNA, 25 bp, Homo sapien
ggcaggagccttagtcttggtccca

SEQ ID NO: 148475 - DNA, 25 bp, Homo sapien
gtcttggtcccagccaagagccggc

SEQ ID NO: 148476 - DNA, 25 bp, Homo sapien
tcacaaaaggccacgcttccaaacg

SEQ ID NO: 148477 - DNA, 25 bp, Homo sapien
gatgcgcagcctggcctctactaca

SEQ ID NO: 148478 - DNA, 25 bp, Homo sapien
ccaacgagcagtgccgcgtggcctt

SEQ ID NO: 148479 - DNA, 25 bp, Homo sapien
tactacagcgccaacgagcagtgcc

SEQ ID NO: 148480 - DNA, 25 bp, Homo sapien
atctcgactcggaagccggtcggcg

SEQ ID NO: 148481 - DNA, 25 bp, Homo sapien
ggcctcgcgatatgcagcccattgg

SEQ ID NO: 148482 - DNA, 25 bp, Homo sapien
tatgcagcccattggctctctcctg

SEQ ID NO: 148483 - DNA, 25 bp, Homo sapien
tttttgccctcgtccggtcctgctg

SEQ ID NO: 148484 - DNA, 25 bp, Homo sapien
tcagcttctggaggactaggccttc

SEQ ID NO: 148485 - DNA, 25 bp, Homo sapien
taggccttctgaggttacggagctc

SEQ ID NO: 148486 - DNA, 25 bp, Homo sapien
ggacttagtgggatctcgactcgga

SEQ ID NO: 148487 - DNA, 25 bp, Homo sapien
tacggagctccgagatacctgggca

SEQ ID NO: 148488 - DNA, 25 bp, Homo sapien
cagtctgtgagtatccagtcgggga

SEQ ID NO: 148489 - DNA, 25 bp, Homo sapien
ggcgcattagccagctccctgcgaa

SEQ ID NO: 148490 - DNA, 25 bp, Homo sapien
aagcgcccgcctcctttgggagcaa

SEQ ID NO: 148491 - DNA, 25 bp, Homo sapien
tttgggagcaagtcgccgcaaactg

SEQ ID NO: 148492 - DNA, 25 bp, Homo sapien
agggtcccgctcactatgttaatga

SEQ ID NO: 148493 - DNA, 25 bp, Homo sapien
atgttaatgagcacccgcctccctt

SEQ ID NO: 148494 - DNA, 25 bp, Homo sapien
gccggctaccgagccctttgtgagg

SEQ ID NO: 148495 - DNA, 25 bp, Homo sapien
aggctctgaccgctaaggtgtctgc

SEQ ID NO: 148496 - DNA, 25 bp, Homo sapien
gcccacgatactcggctgctctgaa

SEQ ID NO: 148497 - DNA, 25 bp, Homo sapien
acagcggtgctgtcgaagatggact

SEQ ID NO: 148498 - DNA, 25 bp, Homo sapien
tcgaagatggactgcaggtagacca

SEQ ID NO: 148499 - DNA, 25 bp, Homo sapien
accaggatgggcgtgatgcccgtca

SEQ ID NO: 148500 - DNA, 25 bp, Homo sapien
gggctctcaccagcaggacagcggt

SEQ ID NO: 148501 - DNA, 25 bp, Homo sapien
aggcgcatcagcaaggccacggtga

SEQ ID NO: 148502 - DNA, 25 bp, Homo sapien
ggctgctctgaaacacaaggccgcc

SEQ ID NO: 148503 - DNA, 25 bp, Homo sapien
gcgtgatgcccgtcagctgctgcag

SEQ ID NO: 148504 - DNA, 25 bp, Homo sapien
gtcgcgtggcgtctcagggccacct

SEQ ID NO: 148505 - DNA, 25 bp, Homo sapien
agccgagcgccagggtcacagcgaa

SEQ ID NO: 148506 - DNA, 25 bp, Homo sapien
cccagagaggcgaagccgagcgcca

SEQ ID NO: 148507 - DNA, 25 bp, Homo sapien
ctgtcgtactcgctcccgcggggtg

SEQ ID NO: 148508 - DNA, 25 bp, Homo sapien
ctcttgcaggcgtgactgcggcaat

SEQ ID NO: 148509 - DNA, 25 bp, Homo sapien
tgatgctcggatgcggacccggctt

SEQ ID NO: 148510 - DNA, 25 bp, Homo sapien
ccgcaggctgtcctgatgctcggat

SEQ ID NO: 148511 - DNA, 25 bp, Homo sapien
ggtcacagcgaatgcgcacctcgct

SEQ ID NO: 148512 - DNA, 25 bp, Homo sapien
atgaccacacagcacgcagctaacg

SEQ ID NO: 148513 - DNA, 25 bp, Homo sapien
gggaggccgtatcgccgatcactta

SEQ ID NO: 148514 - DNA, 25 bp, Homo sapien
tatcgccgatcacttacggctgctc

SEQ ID NO: 148515 - DNA, 25 bp, Homo sapien
gcccaccgcaggacagatccagagt

SEQ ID NO: 148516 - DNA, 25 bp, Homo sapien
cgagatgaccacacagcacgcagct

SEQ ID NO: 148517 - DNA, 25 bp, Homo sapien
tgaagttggcctttgcatcccgagg

SEQ ID NO: 148518 - DNA, 25 bp, Homo sapien
tttgcatcccgagggagcgaaccgc

SEQ ID NO: 148519 - DNA, 25 bp, Homo sapien
caggacagatccagagtccggggca

SEQ ID NO: 148520 - DNA, 25 bp, Homo sapien
cgcgccctctggagccgttacataa

SEQ ID NO: 148521 - DNA, 25 bp, Homo sapien
gaagttcagcctttccctccgtaca

SEQ ID NO: 148522 - DNA, 25 bp, Homo sapien
cggagccatcagacgggacacctca

SEQ ID NO: 148523 - DNA, 25 bp, Homo sapien
tgctccgtctggacacccgacatgt

SEQ ID NO: 148524 - DNA, 25 bp, Homo sapien
cccgtctgcctgacagctataaagg

SEQ ID NO: 148525 - DNA, 25 bp, Homo sapien
tttctctgggaggacaacctgctga

SEQ ID NO: 148526 - DNA, 25 bp, Homo sapien
tgctgacccgaagccaggtaggcca

SEQ ID NO: 148527 - DNA, 25 bp, Homo sapien
ccctctcttggatgctctttgaagt

SEQ ID NO: 148528 - DNA, 25 bp, Homo sapien
tgtggggatccacatgaaacaagga

SEQ ID NO: 148529 - DNA, 25 bp, Homo sapien
ctgggacgcctgcttatctcaaagg

SEQ ID NO: 148530 - DNA, 25 bp, Homo sapien
ttttccacaggtgaactgggacgcc

SEQ ID NO: 148531 - DNA, 25 bp, Homo sapien
tgccaaagccttccgagccactgtt

SEQ ID NO: 148532 - DNA, 25 bp, Homo sapien
tgggccctgggcaaattgccaaagc

SEQ ID NO: 148533 - DNA, 25 bp, Homo sapien
ggcttgcaccgcctggttgaccaca

SEQ ID NO: 148534 - DNA, 25 bp, Homo sapien
ccaaacagggcatagccatggggca

SEQ ID NO: 148535 - DNA, 25 bp, Homo sapien
agggctctgcctcctgttacaagag

SEQ ID NO: 148536 - DNA, 25 bp, Homo sapien
gtctagacctcctgcacatttgttc

SEQ ID NO: 148537 - DNA, 25 bp, Homo sapien
ctcgtcgagggcttatggagactca

SEQ ID NO: 148538 - DNA, 25 bp, Homo sapien
gcagcccgcagagttcctgtctaga

SEQ ID NO: 148539 - DNA, 25 bp, Homo sapien
gctcccattacctggaagcccaagg

SEQ ID NO: 148540 - DNA, 25 bp, Homo sapien
tcccagatgcctgcgttcagtaata

SEQ ID NO: 148541 - DNA, 25 bp, Homo sapien
ctgtctggttacaaaggcgctccca

SEQ ID NO: 148542 - DNA, 25 bp, Homo sapien
tcagagcgccttttctccacaaaca

SEQ ID NO: 148543 - DNA, 25 bp, Homo sapien
tcctaatttcatgctccgcgggctc

SEQ ID NO: 148544 - DNA, 25 bp, Homo sapien
tctgcagcactgctagagcgcgtca

SEQ ID NO: 148545 - DNA, 25 bp, Homo sapien
tggggaagagatgaaaacgaagttc

SEQ ID NO: 148546 - DNA, 25 bp, Homo sapien
agaaaaagcccgaggtcgtgcgttg

SEQ ID NO: 148547 - DNA, 25 bp, Homo sapien
ccacactcagcagtttacaaaaaga

SEQ ID NO: 148548 - DNA, 25 bp, Homo sapien
gggcctctccacactcagcagttta

SEQ ID NO: 148549 - DNA, 25 bp, Homo sapien
tccagcgcggtccaggaaggagtac

SEQ ID NO: 148550 - DNA, 25 bp, Homo sapien
gggattcggccgagcgccctacctg

SEQ ID NO: 148551 - DNA, 25 bp, Homo sapien
cgaagttctcgaagtttctgcagca

SEQ ID NO: 148552 - DNA, 25 bp, Homo sapien
cgctcggcccttaccttgaagcatg

SEQ ID NO: 148553 - DNA, 25 bp, Homo sapien
accttgaagcatgggaaccgcgctg

SEQ ID NO: 148554 - DNA, 25 bp, Homo sapien
ccgcgaggacttgggcgcacgtgac

SEQ ID NO: 148555 - DNA, 25 bp, Homo sapien
gcggccgctcatgcccaggccacgg

SEQ ID NO: 148556 - DNA, 25 bp, Homo sapien
ccttaccttgaagcatgggaaccgc

SEQ ID NO: 148557 - DNA, 25 bp, Homo sapien
tctccgcctgttctcggggcgttcc

SEQ ID NO: 148558 - DNA, 25 bp, Homo sapien
cgccctgcggtgctccctccgctct

SEQ ID NO: 148559 - DNA, 25 bp, Homo sapien
tggtgctgacggctcgtccgctctc

SEQ ID NO: 148560 - DNA, 25 bp, Homo sapien
cggatgaagccacaaagccaagttg

SEQ ID NO: 148561 - DNA, 25 bp, Homo sapien
ctttaggacggcttcaggcgcgttt

SEQ ID NO: 148562 - DNA, 25 bp, Homo sapien
cacgtgtttcgtgctttaggacggc

SEQ ID NO: 148563 - DNA, 25 bp, Homo sapien
tgccagcgccaagaacaagcacgtg

SEQ ID NO: 148564 - DNA, 25 bp, Homo sapien
gctcctctagcaggccggggaagct

SEQ ID NO: 148565 - DNA, 25 bp, Homo sapien
ttgcggaggccggatgaagccacaa

SEQ ID NO: 148566 - DNA, 25 bp, Homo sapien
tgctgcggcgcttcatgacacacac

SEQ ID NO: 148567 - DNA, 25 bp, Homo sapien
cgacaagggactcgggcactgagcc

SEQ ID NO: 148568 - DNA, 25 bp, Homo sapien
tcggagtcctttacgcatatgtttg

SEQ ID NO: 148569 - DNA, 25 bp, Homo sapien
tgtcaggaacccgtttgtcaagccc

SEQ ID NO: 148570 - DNA, 25 bp, Homo sapien
gcagctcggatagcgccacacgtct

SEQ ID NO: 148571 - DNA, 25 bp, Homo sapien
tgtctctaaccaggggccttccttg

SEQ ID NO: 148572 - DNA, 25 bp, Homo sapien
tcgaggctgcaaaatggttccattc

SEQ ID NO: 148573 - DNA, 25 bp, Homo sapien
cctctcagtctttggtggaaccatc

SEQ ID NO: 148574 - DNA, 25 bp, Homo sapien
cgttgcaacataaagcggcctctca

SEQ ID NO: 148575 - DNA, 25 bp, Homo sapien
ggccttccttgcacctcggagcaaa

SEQ ID NO: 148576 - DNA, 25 bp, Homo sapien
tcctcaaaatggagtcagccgaaaa

SEQ ID NO: 148577 - DNA, 25 bp, Homo sapien
aacgcatgattcctcctcaaaatgg

SEQ ID NO: 148578 - DNA, 25 bp, Homo sapien
cagccgaaaaaagcgtgaatgcaga

SEQ ID NO: 148579 - DNA, 25 bp, Homo sapien
atgcagagcccgaagagactcctgg

SEQ ID NO: 148580 - DNA, 25 bp, Homo sapien
ggcgcaatggcttatctgagggaca

SEQ ID NO: 148581 - DNA, 25 bp, Homo sapien
cccagctacgcaccgtgtcgtggtg

SEQ ID NO: 148582 - DNA, 25 bp, Homo sapien
gcgaaggtgtactcgtctgccagca

SEQ ID NO: 148583 - DNA, 25 bp, Homo sapien
cctggctgctggcaaaatctcggca

SEQ ID NO: 148584 - DNA, 25 bp, Homo sapien
gaggacgcatccacgctggctcaca

SEQ ID NO: 148585 - DNA, 25 bp, Homo sapien
cacccgcaagtcaccgagtactttg

SEQ ID NO: 148586 - DNA, 25 bp, Homo sapien
cgtgagctacactcctgggaaacca

SEQ ID NO: 148587 - DNA, 25 bp, Homo sapien
aaaccatcccgtcgaggggctcaga

SEQ ID NO: 148588 - DNA, 25 bp, Homo sapien
tcgccagccagacaccgagtgctga

SEQ ID NO: 148589 - DNA, 25 bp, Homo sapien
gtactttgtgcagcaccgtgagcta

SEQ ID NO: 148590 - DNA, 25 bp, Homo sapien
ctgagagtatgaaacgcaagaccac

SEQ ID NO: 148591 - DNA, 25 bp, Homo sapien
caccgagtgctgagagtatgaaacg

SEQ ID NO: 148592 - DNA, 25 bp, Homo sapien
atcctcacacgggacgcagtcgtag

SEQ ID NO: 148593 - DNA, 25 bp, Homo sapien
cacacgggacgcagtcgtagatgtc

SEQ ID NO: 148594 - DNA, 25 bp, Homo sapien
gggacgcagtcgtagatgtcctccc

SEQ ID NO: 148595 - DNA, 25 bp, Homo sapien
cccaggtcatgctcgctgcacagga

SEQ ID NO: 148596 - DNA, 25 bp, Homo sapien
tcatgctcgctgcacaggaggaggc

SEQ ID NO: 148597 - DNA, 25 bp, Homo sapien
cagagcacgagggtccacgagggac

SEQ ID NO: 148598 - DNA, 25 bp, Homo sapien
cccgggcctcagtctacaaagtggg

SEQ ID NO: 148599 - DNA, 25 bp, Homo sapien
tcagtctacaaagtggggtgggccc

SEQ ID NO: 148600 - DNA, 25 bp, Homo sapien
agcgctgacacacaagaacctgttt

SEQ ID NO: 148601 - DNA, 25 bp, Homo sapien
tctaaggaggcaccagcattcggtc

SEQ ID NO: 148602 - DNA, 25 bp, Homo sapien
tggaaccgggtcgtacagatggaac

SEQ ID NO: 148603 - DNA, 25 bp, Homo sapien
agaacctgtttgtcaacctggagtc

SEQ ID NO: 148604 - DNA, 25 bp, Homo sapien
tcaacctggagtcagcgcaaaggcc

SEQ ID NO: 148605 - DNA, 25 bp, Homo sapien
ccaggtcgggtcgtacagatggaac

SEQ ID NO: 148606 - DNA, 25 bp, Homo sapien
cgtggctgatcaatccctccgagga

SEQ ID NO: 148607 - DNA, 25 bp, Homo sapien
agccctcctccgtggagtctaagga

SEQ ID NO: 148608 - DNA, 25 bp, Homo sapien
gtcgccacacggcagctttcattgc

SEQ ID NO: 148609 - DNA, 25 bp, Homo sapien
tcctcaggtggcaagggacctgccc

SEQ ID NO: 148610 - DNA, 25 bp, Homo sapien
ccggccttcataaaagcaaaatcta

SEQ ID NO: 148611 - DNA, 25 bp, Homo sapien
ggccagctccaaaggtcaccttcaa

SEQ ID NO: 148612 - DNA, 25 bp, Homo sapien
ggtgattccacccacagccgcgatg

SEQ ID NO: 148613 - DNA, 25 bp, Homo sapien
ttcattgcctgaacctcggagggtg

SEQ ID NO: 148614 - DNA, 25 bp, Homo sapien
gtcaccttcaagaaacggagtttgc

SEQ ID NO: 148615 - DNA, 25 bp, Homo sapien
aggccctagcgacaactctggggtc

SEQ ID NO: 148616 - DNA, 25 bp, Homo sapien
acgagagctggattccaccgtgccc

SEQ ID NO: 148617 - DNA, 25 bp, Homo sapien
gcctgcgaggacgagcctctgcacc

SEQ ID NO: 148618 - DNA, 25 bp, Homo sapien
atgaactgcggcttctcacggctgc

SEQ ID NO: 148619 - DNA, 25 bp, Homo sapien
tgaatcccacatgccgggattcaca

SEQ ID NO: 148620 - DNA, 25 bp, Homo sapien
tgcctgagatgaatcccacatgccg

SEQ ID NO: 148621 - DNA, 25 bp, Homo sapien
ccgtctagttgcctgagatgaatcc

SEQ ID NO: 148622 - DNA, 25 bp, Homo sapien
gtgtcggtgaaagccgtctagttgc

SEQ ID NO: 148623 - DNA, 25 bp, Homo sapien
ctcctgccggatgaactgcggcttc

SEQ ID NO: 148624 - DNA, 25 bp, Homo sapien
caggcagccaggcactaatccgggc

SEQ ID NO: 148625 - DNA, 25 bp, Homo sapien
agccaggatctgaacgcggctgtca

SEQ ID NO: 148626 - DNA, 25 bp, Homo sapien
tgtcagaggctcaacgctgtgtgtg

SEQ ID NO: 148627 - DNA, 25 bp, Homo sapien
tccaccctaggaatgtgtcggccgc

SEQ ID NO: 148628 - DNA, 25 bp, Homo sapien
tccggaactcggacagaggatgttg

SEQ ID NO: 148629 - DNA, 25 bp, Homo sapien
ggacaagcaaatgaagacttcctgc

SEQ ID NO: 148630 - DNA, 25 bp, Homo sapien
ctgcagcagagacacagagcccgga

SEQ ID NO: 148631 - DNA, 25 bp, Homo sapien
ccacgggtctgccacgaggtgctga

SEQ ID NO: 148632 - DNA, 25 bp, Homo sapien
ccggaagttgatgtccttgaggtcg

SEQ ID NO: 148633 - DNA, 25 bp, Homo sapien
gcgccaggtcgaagaccacggccga

SEQ ID NO: 148634 - DNA, 25 bp, Homo sapien
cgagggccacaccacccggtggttg

SEQ ID NO: 148635 - DNA, 25 bp, Homo sapien
aggaccttgcaatcgatgagccagc

SEQ ID NO: 148636 - DNA, 25 bp, Homo sapien
ggcagtgctcgagccaaagtgcagc

SEQ ID NO: 148637 - DNA, 25 bp, Homo sapien
ttcacacacgcaagtgcctgcgggc

SEQ ID NO: 148638 - DNA, 25 bp, Homo sapien
aggctgaggggactttggccaactt

SEQ ID NO: 148639 - DNA, 25 bp, Homo sapien
tttggccaacttcgcgcctcctgag

SEQ ID NO: 148640 - DNA, 25 bp, Homo sapien
tcagcagttccgcttcgggcaagga

SEQ ID NO: 148641 - DNA, 25 bp, Homo sapien
ctccagacctcgtcagtcagcggga

SEQ ID NO: 148642 - DNA, 25 bp, Homo sapien
cctagtcccaggataccacggggtg

SEQ ID NO: 148643 - DNA, 25 bp, Homo sapien
gagccgctccttccggaaaagccta

SEQ ID NO: 148644 - DNA, 25 bp, Homo sapien
ggcttgggcctagaataccggccta

SEQ ID NO: 148645 - DNA, 25 bp, Homo sapien
cctgtctttgagcaagggccgggaa

SEQ ID NO: 148646 - DNA, 25 bp, Homo sapien
tacctagagtgtcgcagcggccacc

SEQ ID NO: 148647 - DNA, 25 bp, Homo sapien
gcgccctccgctgtacctagagtgt

SEQ ID NO: 148648 - DNA, 25 bp, Homo sapien
actgcgatacactgcggcctcggga

SEQ ID NO: 148649 - DNA, 25 bp, Homo sapien
tcgggactgcgaaacaccgcggcct

SEQ ID NO: 148650 - DNA, 25 bp, Homo sapien
ctgcgatacactgcggcctcgggac

SEQ ID NO: 148651 - DNA, 25 bp, Homo sapien
cgggactgtgaaacaccgaggcctc

SEQ ID NO: 148652 - DNA, 25 bp, Homo sapien
aaacactgcggcctcgggactgcga

SEQ ID NO: 148653 - DNA, 25 bp, Homo sapien
cggcctcgggacagtgaaacactgc

SEQ ID NO: 148654 - DNA, 25 bp, Homo sapien
ggactgtgatacactgcggcctcgg

SEQ ID NO: 148655 - DNA, 25 bp, Homo sapien
cctcgggactgtgatacactgcggc

SEQ ID NO: 148656 - DNA, 25 bp, Homo sapien
tgcagccttcagacctcgacacgga

SEQ ID NO: 148657 - DNA, 25 bp, Homo sapien
gccctcagacctcgacacggaaacc

SEQ ID NO: 148658 - DNA, 25 bp, Homo sapien
tgcagccctcagacctcgacacgga

SEQ ID NO: 148659 - DNA, 25 bp, Homo sapien
cagccctcagacctcgacacggaaa

SEQ ID NO: 148660 - DNA, 25 bp, Homo sapien
gcagccctcagacctcgacacggaa

SEQ ID NO: 148661 - DNA, 25 bp, Homo sapien
ccctcagaccgtgacatggaaaccc

SEQ ID NO: 148662 - DNA, 25 bp, Homo sapien
gcagccttcagacctcgacacggaa

SEQ ID NO: 148663 - DNA, 25 bp, Homo sapien
agccctcagacctcgacacggaaac

SEQ ID NO: 148664 - DNA, 25 bp, Homo sapien
ctgacctagcgcaggcatcccagga

SEQ ID NO: 148665 - DNA, 25 bp, Homo sapien
tttcacagatggagaccctgaagcc

SEQ ID NO: 148666 - DNA, 25 bp, Homo sapien
agagacgagacctgaacaaacgctg

SEQ ID NO: 148667 - DNA, 25 bp, Homo sapien
gcacgttcgttcctttgcagcagca

SEQ ID NO: 148668 - DNA, 25 bp, Homo sapien
cccagagacttgatgctgcgctgca

SEQ ID NO: 148669 - DNA, 25 bp, Homo sapien
agtagctcgatctaggccgctgacc

SEQ ID NO: 148670 - DNA, 25 bp, Homo sapien
cccacgggacgtaagtagctcgatc

SEQ ID NO: 148671 - DNA, 25 bp, Homo sapien
gccctgaaagctggcccggacagat

SEQ ID NO: 148672 - DNA, 25 bp, Homo sapien
ttctgcgacagtgaaataaccagtg

SEQ ID NO: 148673 - DNA, 25 bp, Homo sapien
cggccacgtactttcacggtgctga

SEQ ID NO: 148674 - DNA, 25 bp, Homo sapien
gcctcggcatccactggcttgtaga

SEQ ID NO: 148675 - DNA, 25 bp, Homo sapien
taggccgcgtgcttcttggatagca

SEQ ID NO: 148676 - DNA, 25 bp, Homo sapien
cttggatagcatctccctgaggatg

SEQ ID NO: 148677 - DNA, 25 bp, Homo sapien
gtgctccgacagcttgcccttcttg

SEQ ID NO: 148678 - DNA, 25 bp, Homo sapien
tccaggtccttcttgggaggcttga

SEQ ID NO: 148679 - DNA, 25 bp, Homo sapien
acaagacatcagcacccacggcaga

SEQ ID NO: 148680 - DNA, 25 bp, Homo sapien
acggcacctgccgtctagagagcca

SEQ ID NO: 148681 - DNA, 25 bp, Homo sapien
acacttggcaggcacccacgtgctg

SEQ ID NO: 148682 - DNA, 25 bp, Homo sapien
cggctatccacaaacacttggcagg

SEQ ID NO: 148683 - DNA, 25 bp, Homo sapien
cgcgtgccgcacagggcggatagga

SEQ ID NO: 148684 - DNA, 25 bp, Homo sapien
acgtgctgccaagcgccaggcgcgt

SEQ ID NO: 148685 - DNA, 25 bp, Homo sapien
tgccgtctagagagccacccacagt

SEQ ID NO: 148686 - DNA, 25 bp, Homo sapien
caaacacttggcaggcacccacgtg

SEQ ID NO: 148687 - DNA, 25 bp, Homo sapien
ggagccggctatccacaaacacttg

SEQ ID NO: 148688 - DNA, 25 bp, Homo sapien
ggtggacatcctccggcagctcact

SEQ ID NO: 148689 - DNA, 25 bp, Homo sapien
cacagcagcggcttggagaggccct

SEQ ID NO: 148690 - DNA, 25 bp, Homo sapien
tctgtcacagcagcggcttggagag

SEQ ID NO: 148691 - DNA, 25 bp, Homo sapien
ttctgtcacagcagcggcttggaga

SEQ ID NO: 148692 - DNA, 25 bp, Homo sapien
tcctccggcagctcactcactttct

SEQ ID NO: 148693 - DNA, 25 bp, Homo sapien
ggcttgctggggttggagacctccg

SEQ ID NO: 148694 - DNA, 25 bp, Homo sapien
actgtcgtggcggtggacatcctcc

SEQ ID NO: 148695 - DNA, 25 bp, Homo sapien
gcggtggacatcctccggcagctca

SEQ ID NO: 148696 - DNA, 25 bp, Homo sapien
cgtggttgtgacccggcctggctct

SEQ ID NO: 148697 - DNA, 25 bp, Homo sapien
aagcagtgaggttctaccgtaacca

SEQ ID NO: 148698 - DNA, 25 bp, Homo sapien
caacacggacgtttgcagacccaaa

SEQ ID NO: 148699 - DNA, 25 bp, Homo sapien
tttgcagacccaaacacggtgcggg

SEQ ID NO: 148700 - DNA, 25 bp, Homo sapien
agcgaggccaagcagtgaggttcta

SEQ ID NO: 148701 - DNA, 25 bp, Homo sapien
ggccaagcagtgaggttctaccgta

SEQ ID NO: 148702 - DNA, 25 bp, Homo sapien
agaacgggcccaggtttgtgatggc

SEQ ID NO: 148703 - DNA, 25 bp, Homo sapien
tgaggttctaccgtaaccaggagaa

SEQ ID NO: 148704 - DNA, 25 bp, Homo sapien
ctgcaccagtcaaattcggggatta

SEQ ID NO: 148705 - DNA, 25 bp, Homo sapien
tccgtaccagcgatgatcaagaagg

SEQ ID NO: 148706 - DNA, 25 bp, Homo sapien
ctgtctgtggaaacgcgagggcaca

SEQ ID NO: 148707 - DNA, 25 bp, Homo sapien
cggcccgaatcgactccggagacaa

SEQ ID NO: 148708 - DNA, 25 bp, Homo sapien
gagggcacactagcactttcctgta

SEQ ID NO: 148709 - DNA, 25 bp, Homo sapien
taaagcttttaagcgggaagcgcgc

SEQ ID NO: 148710 - DNA, 25 bp, Homo sapien
agctgccgccttgtcgagctgagtc

SEQ ID NO: 148711 - DNA, 25 bp, Homo sapien
cccgtgctgtccctttaaagcgttg

SEQ ID NO: 148712 - DNA, 25 bp, Homo sapien
acacaccagcgcgtgcacgtgcttg

SEQ ID NO: 148713 - DNA, 25 bp, Homo sapien
gacacgcttgccatcagctgtgtta

SEQ ID NO: 148714 - DNA, 25 bp, Homo sapien
atcagctgtgttaagggagcccggc

SEQ ID NO: 148715 - DNA, 25 bp, Homo sapien
gagggaccgcatggcctcacagcgt

SEQ ID NO: 148716 - DNA, 25 bp, Homo sapien
agcgtctcccgtgccttttcagtgt

SEQ ID NO: 148717 - DNA, 25 bp, Homo sapien
cttttcagtgtatgtgaccgggctg

SEQ ID NO: 148718 - DNA, 25 bp, Homo sapien
tgtccttcccggtgctcgggacaca

SEQ ID NO: 148719 - DNA, 25 bp, Homo sapien
tggtaatgctgagggccgtgtcctt

SEQ ID NO: 148720 - DNA, 25 bp, Homo sapien
cacctgtccgtttttattgcagatg

SEQ ID NO: 148721 - DNA, 25 bp, Homo sapien
ccgaacggcaaatacatcctggccg

SEQ ID NO: 148722 - DNA, 25 bp, Homo sapien
gtgtcttttgtgaagttctccccga

SEQ ID NO: 148723 - DNA, 25 bp, Homo sapien
cctcactcagatgtcgcacgtgggg

SEQ ID NO: 148724 - DNA, 25 bp, Homo sapien
cgccgtgtgtcacctgtccgttttt

SEQ ID NO: 148725 - DNA, 25 bp, Homo sapien
tggtggtggccgacctcactcagat

SEQ ID NO: 148726 - DNA, 25 bp, Homo sapien
ttattgcagatgacgacaacccccc

SEQ ID NO: 148727 - DNA, 25 bp, Homo sapien
tgtgcgtggctaggccacccttcgg

SEQ ID NO: 148728 - DNA, 25 bp, Homo sapien
aaccgtatgcgtgttgtcaggcccg

SEQ ID NO: 148729 - DNA, 25 bp, Homo sapien
aggtggcaatgccttaaccgtatgc

SEQ ID NO: 148730 - DNA, 25 bp, Homo sapien
gcgcccgtgtcccaaggaaagaaga

SEQ ID NO: 148731 - DNA, 25 bp, Homo sapien
gtcccgagcgtccttcagagaagta

SEQ ID NO: 148732 - DNA, 25 bp, Homo sapien
agggtgacttcttgttcgctatcca

SEQ ID NO: 148733 - DNA, 25 bp, Homo sapien
tccactcgcctttcggtgagggtga

SEQ ID NO: 148734 - DNA, 25 bp, Homo sapien
ggcttccctgcgcactttatttaag

SEQ ID NO: 148735 - DNA, 25 bp, Homo sapien
tcaaggggagtgctaaccttctctc

SEQ ID NO: 148736 - DNA, 25 bp, Homo sapien
tgtttgtaacagcaaaggcagcttt

SEQ ID NO: 148737 - DNA, 25 bp, Homo sapien
gccctctgtcggctgtttgtaacag

SEQ ID NO: 148738 - DNA, 25 bp, Homo sapien
ttactcgctgctcacgaggcctgcg

SEQ ID NO: 148739 - DNA, 25 bp, Homo sapien
aaaggcggcgtttactcgctgctca

SEQ ID NO: 148740 - DNA, 25 bp, Homo sapien
ctctgtagtcagagccgtgaaaggc

SEQ ID NO: 148741 - DNA, 25 bp, Homo sapien
cggtagagctctccctctgtagtca

SEQ ID NO: 148742 - DNA, 25 bp, Homo sapien
cggtctcgctaaaatgttccatgag

SEQ ID NO: 148743 - DNA, 25 bp, Homo sapien
gctttgtgcgctgttagcagtggtc

SEQ ID NO: 148744 - DNA, 25 bp, Homo sapien
cctctgagggcctcggctttcttag

SEQ ID NO: 148745 - DNA, 25 bp, Homo sapien
ggtgcgttccatccctctgagggcc

SEQ ID NO: 148746 - DNA, 25 bp, Homo sapien
cctcctcgtctctgcggtgcgttcc

SEQ ID NO: 148747 - DNA, 25 bp, Homo sapien
tgagggcctcggctttcttaggccc

SEQ ID NO: 148748 - DNA, 25 bp, Homo sapien
gggtgcgttcaatccacggccgacc

SEQ ID NO: 148749 - DNA, 25 bp, Homo sapien
acacccgcgtgggtgcgttcaatcc

SEQ ID NO: 148750 - DNA, 25 bp, Homo sapien
acggtgagagaagccgacacccgcg

SEQ ID NO: 148751 - DNA, 25 bp, Homo sapien
gagacggtgagagaagccgacaccc

SEQ ID NO: 148752 - DNA, 25 bp, Homo sapien
caggcagagaactacccagggtata

SEQ ID NO: 148753 - DNA, 25 bp, Homo sapien
aatggtcagtccctgtgcctcgcag

SEQ ID NO: 148754 - DNA, 25 bp, Homo sapien
ccttaggtctaggtggtcagcaagc

SEQ ID NO: 148755 - DNA, 25 bp, Homo sapien
actcgcaagtttgcacggcgctctc

SEQ ID NO: 148756 - DNA, 25 bp, Homo sapien
caaagtctgtgtccaactccgggca

SEQ ID NO: 148757 - DNA, 25 bp, Homo sapien
ttgtcctctgccgttggggcacatc

SEQ ID NO: 148758 - DNA, 25 bp, Homo sapien
cctggcggaggcgaactcgcaagtt

SEQ ID NO: 148759 - DNA, 25 bp, Homo sapien
gcagcctgcgtgaatggtcagtccc

SEQ ID NO: 148760 - DNA, 25 bp, Homo sapien
tcgggctgcggcttctagcaggccg

SEQ ID NO: 148761 - DNA, 25 bp, Homo sapien
ctcgccgaccttcgcgtgagttcgg

SEQ ID NO: 148762 - DNA, 25 bp, Homo sapien
ccgaccttcgcgtgagttcgggcgc

SEQ ID NO: 148763 - DNA, 25 bp, Homo sapien
cgaccttcgcgtgagttcgggcgcc

SEQ ID NO: 148764 - DNA, 25 bp, Homo sapien
ttcgcgtgagttcgggcgccgggcc

SEQ ID NO: 148765 - DNA, 25 bp, Homo sapien
ccgcgccgcacaggaacccggccgg

SEQ ID NO: 148766 - DNA, 25 bp, Homo sapien
ggagcaacttctgcgctccgcggct

SEQ ID NO: 148767 - DNA, 25 bp, Homo sapien
aggagcaacttctgcgctccgcggc

SEQ ID NO: 148768 - DNA, 25 bp, Homo sapien
gcaggaagcgctggttccttctcca

SEQ ID NO: 148769 - DNA, 25 bp, Homo sapien
tggctgcaggcgaggcccatccttc

SEQ ID NO: 148770 - DNA, 25 bp, Homo sapien
ctcgcggttacctgccgcttgctgg

SEQ ID NO: 148771 - DNA, 25 bp, Homo sapien
ttgtgtgcaggtcgctcgcggttac

SEQ ID NO: 148772 - DNA, 25 bp, Homo sapien
tccctttctgaaggactggtatcag

SEQ ID NO: 148773 - DNA, 25 bp, Homo sapien
agttctgggttcgagctctggctct

SEQ ID NO: 148774 - DNA, 25 bp, Homo sapien
tgggcttgccgacgcctggagttct

SEQ ID NO: 148775 - DNA, 25 bp, Homo sapien
ccttccggcgcacttgtgtgcaggt

SEQ ID NO: 148776 - DNA, 25 bp, Homo sapien
ggaggcagcggaaccaaaactgctg

SEQ ID NO: 148777 - DNA, 25 bp, Homo sapien
cggaaccaaaactgctgtgtcactg

SEQ ID NO: 148778 - DNA, 25 bp, Homo sapien
accaaaactgctgtgtcactgcacg

SEQ ID NO: 148779 - DNA, 25 bp, Homo sapien
aactgctgtgtcactgcacgctgca

SEQ ID NO: 148780 - DNA, 25 bp, Homo sapien
cgcctgtgggtcctcggcgctgact

SEQ ID NO: 148781 - DNA, 25 bp, Homo sapien
tgctgtgtcactgcacgctgcagct

SEQ ID NO: 148782 - DNA, 25 bp, Homo sapien
gtgagtttcccacgcttgcccgggc

SEQ ID NO: 148783 - DNA, 25 bp, Homo sapien
gcagcggaaccaaaactgctgtgtc

SEQ ID NO: 148784 - DNA, 25 bp, Homo sapien
ccagtactgccgctaccagaagtgc

SEQ ID NO: 148785 - DNA, 25 bp, Homo sapien
cctgattgacaagcggcagcggaac

SEQ ID NO: 148786 - DNA, 25 bp, Homo sapien
ccgctaccagaagtgcctggccatg

SEQ ID NO: 148787 - DNA, 25 bp, Homo sapien
tgcgcaaggacctgacctacacctg

SEQ ID NO: 148788 - DNA, 25 bp, Homo sapien
tacacctgccgcgacaacaaggact

SEQ ID NO: 148789 - DNA, 25 bp, Homo sapien
gcagcggaaccggtgccagtactgc

SEQ ID NO: 148790 - DNA, 25 bp, Homo sapien
cgcgacaacaaggactgcctgattg

SEQ ID NO: 148791 - DNA, 25 bp, Homo sapien
gcgtggacacccgagatggacaaca

SEQ ID NO: 148792 - DNA, 25 bp, Homo sapien
cagccctgaccttcggttttccgag

SEQ ID NO: 148793 - DNA, 25 bp, Homo sapien
tggagagagccgcacaccagcgcca

SEQ ID NO: 148794 - DNA, 25 bp, Homo sapien
ttcccaagaattctgggctggcggc

SEQ ID NO: 148795 - DNA, 25 bp, Homo sapien
cgtgatctggtgctcgtccacgcag

SEQ ID NO: 148796 - DNA, 25 bp, Homo sapien
ccgagcacggtgtttcccaagaatt

SEQ ID NO: 148797 - DNA, 25 bp, Homo sapien
gcctctgggaaggacagccctgacc

SEQ ID NO: 148798 - DNA, 25 bp, Homo sapien
tatgtgctgtacagagagacgcgtg

SEQ ID NO: 148799 - DNA, 25 bp, Homo sapien
gccctgccggaatgtgcagcctgtg

SEQ ID NO: 148800 - DNA, 25 bp, Homo sapien
ccactctgcaccacacgcgcctctg

SEQ ID NO: 148801 - DNA, 25 bp, Homo sapien
cccactctgcaccacacgcgcctct

SEQ ID NO: 148802 - DNA, 25 bp, Homo sapien
actctgcaccacacgcacctctgcc

SEQ ID NO: 148803 - DNA, 25 bp, Homo sapien
ccattagtgcccactctgcgccaca

SEQ ID NO: 148804 - DNA, 25 bp, Homo sapien
actctgcgccacacgcgcctctgcc

SEQ ID NO: 148805 - DNA, 25 bp, Homo sapien
ttagtgcccactctgcgccacacgc

SEQ ID NO: 148806 - DNA, 25 bp, Homo sapien
cactctgcaccacacgcgcctctgc

SEQ ID NO: 148807 - DNA, 25 bp, Homo sapien
attagtgcccactctgcgccacacg

SEQ ID NO: 148808 - DNA, 25 bp, Homo sapien
cgggaaacctgtgcgcggaaatgct

SEQ ID NO: 148809 - DNA, 25 bp, Homo sapien
cctgtgcgcggaaatgctcagcctc

SEQ ID NO: 148810 - DNA, 25 bp, Homo sapien
cgaaagctcagcctcgggaaacctg

SEQ ID NO: 148811 - DNA, 25 bp, Homo sapien
ctgtgcgcggaaatgctcagcctcg

SEQ ID NO: 148812 - DNA, 25 bp, Homo sapien
cctcgggaaacctgtgcgcggaaat

SEQ ID NO: 148813 - DNA, 25 bp, Homo sapien
aacctgtgcgcggaaatgctcagcc

SEQ ID NO: 148814 - DNA, 25 bp, Homo sapien
aaagctcagcctcgggaaacctgtg

SEQ ID NO: 148815 - DNA, 25 bp, Homo sapien
ctcagcctcgggaaacctgtgcgcg

SEQ ID NO: 148816 - DNA, 25 bp, Homo sapien
ggtggcggccttggcttaacaagct

SEQ ID NO: 148817 - DNA, 25 bp, Homo sapien
tccttggagggccatttctgatgtt

SEQ ID NO: 148818 - DNA, 25 bp, Homo sapien
gatccaccgcacgaggccctcctta

SEQ ID NO: 148819 - DNA, 25 bp, Homo sapien
cccagcctgagagagccggctttcg

SEQ ID NO: 148820 - DNA, 25 bp, Homo sapien
agcgagtccttggagggccatttct

SEQ ID NO: 148821 - DNA, 25 bp, Homo sapien
ccgtgccgtagttggccacagagcc

SEQ ID NO: 148822 - DNA, 25 bp, Homo sapien
ttaacaagctccgtgccgtagttgg

SEQ ID NO: 148823 - DNA, 25 bp, Homo sapien
ctgatgttcggggtcccggatccac

SEQ ID NO: 148824 - DNA, 25 bp, Homo sapien
gaaaaaagtgctccgcgccgaaggc

SEQ ID NO: 148825 - DNA, 25 bp, Homo sapien
cgcccgcagaacttttcttccttgg

SEQ ID NO: 148826 - DNA, 25 bp, Homo sapien
cttccttggcctgtggaatgcacgg

SEQ ID NO: 148827 - DNA, 25 bp, Homo sapien
gcatggacgtccatacccgctggaa

SEQ ID NO: 148828 - DNA, 25 bp, Homo sapien
gggccaagaccacgaatgccatttg

SEQ ID NO: 148829 - DNA, 25 bp, Homo sapien
acctcctaaagtggtgcggtccctg

SEQ ID NO: 148830 - DNA, 25 bp, Homo sapien
ccgcctaccggctctcagagaaaga

SEQ ID NO: 148831 - DNA, 25 bp, Homo sapien
agccgccgccacaaagaagaacggg

SEQ ID NO: 148832 - DNA, 25 bp, Homo sapien
actacgaaggagcagccgatcatgg

SEQ ID NO: 148833 - DNA, 25 bp, Homo sapien
tcgcggtccactacgaaggagcagc

SEQ ID NO: 148834 - DNA, 25 bp, Homo sapien
tctccgaagtactcgcggtccacta

SEQ ID NO: 148835 - DNA, 25 bp, Homo sapien
caatgtctccgaagtactcgcggtc

SEQ ID NO: 148836 - DNA, 25 bp, Homo sapien
gccgccatacacctccatgccgggg

SEQ ID NO: 148837 - DNA, 25 bp, Homo sapien
agttctacgttctcgccgccataca

SEQ ID NO: 148838 - DNA, 25 bp, Homo sapien
tgtggcctcactcgccctcaccctg

SEQ ID NO: 148839 - DNA, 25 bp, Homo sapien
tcatcctgttcccagacgctgtggc

SEQ ID NO: 148840 - DNA, 25 bp, Homo sapien
ctcaggtcgaagctgcacaaagttg

SEQ ID NO: 148841 - DNA, 25 bp, Homo sapien
gattaaacccgtgcgatctcgagcc

SEQ ID NO: 148842 - DNA, 25 bp, Homo sapien
tcgagccctcaagtcccggaatcaa

SEQ ID NO: 148843 - DNA, 25 bp, Homo sapien
ctcgctgaagtctctatgggaaata

SEQ ID NO: 148844 - DNA, 25 bp, Homo sapien
gcctcctgagcagcaaaagagattt

SEQ ID NO: 148845 - DNA, 25 bp, Homo sapien
gaaaacccattctggcgccttgctg

SEQ ID NO: 148846 - DNA, 25 bp, Homo sapien
ccctgctggctacctgaggaagatg

SEQ ID NO: 148847 - DNA, 25 bp, Homo sapien
ataagccgcgacgacgtttccctgg

SEQ ID NO: 148848 - DNA, 25 bp, Homo sapien
cgcgagtaggaatattagctattta

SEQ ID NO: 148849 - DNA, 25 bp, Homo sapien
caaacgcgtttgcagtgtgtgcgcg

SEQ ID NO: 148850 - DNA, 25 bp, Homo sapien
tatttttagtgttcacacactgaga

SEQ ID NO: 148851 - DNA, 25 bp, Homo sapien
aggccatcgcttgcgtccccagggt

SEQ ID NO: 148852 - DNA, 25 bp, Homo sapien
gctgattaattaccggaagtcaggc

SEQ ID NO: 148853 - DNA, 25 bp, Homo sapien
gctatttattaggttgtgctgatta

SEQ ID NO: 148854 - DNA, 25 bp, Homo sapien
ggcgattgcgcgagtaggaatatta

SEQ ID NO: 148855 - DNA, 25 bp, Homo sapien
ttgtgctgattaattaccggaagtc

SEQ ID NO: 148856 - DNA, 25 bp, Homo sapien
ggccctcgctcttgcctgttttaaa

SEQ ID NO: 148857 - DNA, 25 bp, Homo sapien
acagccaagccaggatcgttatcta

SEQ ID NO: 148858 - DNA, 25 bp, Homo sapien
cgttatctacgcgtgagcatgcaga

SEQ ID NO: 148859 - DNA, 25 bp, Homo sapien
gggcgtgagatattcccgctgaatc

SEQ ID NO: 148860 - DNA, 25 bp, Homo sapien
gccaaagcaggtcagtcgtcacaga

SEQ ID NO: 148861 - DNA, 25 bp, Homo sapien
cgagttatgaaagcagctggccctc

SEQ ID NO: 148862 - DNA, 25 bp, Homo sapien
cccgtcgtgcatcagaggcgttcac

SEQ ID NO: 148863 - DNA, 25 bp, Homo sapien
acgcatccaagctgccgagttatga

SEQ ID NO: 148864 - DNA, 25 bp, Homo sapien
tcatgcctggtctttgagtcggcca

SEQ ID NO: 148865 - DNA, 25 bp, Homo sapien
agagcacacgggaggctattctgtc

SEQ ID NO: 148866 - DNA, 25 bp, Homo sapien
tcctggaggcgcctgttgttaagga

SEQ ID NO: 148867 - DNA, 25 bp, Homo sapien
cggttccatccctgctcgggcagtg

SEQ ID NO: 148868 - DNA, 25 bp, Homo sapien
cgccgtcacccatgcagttggcttg

SEQ ID NO: 148869 - DNA, 25 bp, Homo sapien
tgcagaagatgggacgccgtcaccc

SEQ ID NO: 148870 - DNA, 25 bp, Homo sapien
aagtggaccgtgtccgatggtgacc

SEQ ID NO: 148871 - DNA, 25 bp, Homo sapien
ctgagccgcctacctctgaagtgga

SEQ ID NO: 148872 - DNA, 25 bp, Homo sapien
gctgtggaaatcacgggccagactc

SEQ ID NO: 148873 - DNA, 25 bp, Homo sapien
aagccgcggctggtgttcacggcac

SEQ ID NO: 148874 - DNA, 25 bp, Homo sapien
tgcctctgcaaatgggtggccttgc

SEQ ID NO: 148875 - DNA, 25 bp, Homo sapien
gggccagactcctccaaactcagag

SEQ ID NO: 148876 - DNA, 25 bp, Homo sapien
tctcgtttccctcagtctggccaga

SEQ ID NO: 148877 - DNA, 25 bp, Homo sapien
cgcgtggaattcccttagaaaagag

SEQ ID NO: 148878 - DNA, 25 bp, Homo sapien
gtttccctcagtctggccagaggcc

SEQ ID NO: 148879 - DNA, 25 bp, Homo sapien
gggccttccatctcggctctcgttt

SEQ ID NO: 148880 - DNA, 25 bp, Homo sapien
ctcgcagcggcctactttaaatacg

SEQ ID NO: 148881 - DNA, 25 bp, Homo sapien
ttggaattccaacgcgggcatcgtt

SEQ ID NO: 148882 - DNA, 25 bp, Homo sapien
cccggaggtctgcatgattcatatt

SEQ ID NO: 148883 - DNA, 25 bp, Homo sapien
ggcccagtggagaggcacaaatcac

SEQ ID NO: 148884 - DNA, 25 bp, Homo sapien
cccgccgcataaatcctggtgtttg

SEQ ID NO: 148885 - DNA, 25 bp, Homo sapien
tcctggtgtttgtgcagctttcggc

SEQ ID NO: 148886 - DNA, 25 bp, Homo sapien
gaataacggggtaacagagcggctc

SEQ ID NO: 148887 - DNA, 25 bp, Homo sapien
cgttctggcctgtaatggttattta

SEQ ID NO: 148888 - DNA, 25 bp, Homo sapien
attcgttcgtgagtgtcccgtgcac

SEQ ID NO: 148889 - DNA, 25 bp, Homo sapien
cgggctcccgagagcaacctcgtga

SEQ ID NO: 148890 - DNA, 25 bp, Homo sapien
tgaatcacatgacctagctgcaccc

SEQ ID NO: 148891 - DNA, 25 bp, Homo sapien
cccacctggagctgaatcacatgac

SEQ ID NO: 148892 - DNA, 25 bp, Homo sapien
ctggacagtgaaggcttctccctcc

SEQ ID NO: 148893 - DNA, 25 bp, Homo sapien
gtgcacgtcctgaccctggacagtg

SEQ ID NO: 148894 - DNA, 25 bp, Homo sapien
agagcaacctcgtgacctcagcatg

SEQ ID NO: 148895 - DNA, 25 bp, Homo sapien
gtgacctcagcatgccattcgttcg

SEQ ID NO: 148896 - DNA, 25 bp, Homo sapien
cctcatcctgatgggcactgaactc

SEQ ID NO: 148897 - DNA, 25 bp, Homo sapien
ccctgcatgccaggtcgttggaggt

SEQ ID NO: 148898 - DNA, 25 bp, Homo sapien
gataaatatgcagagcggaggcttc

SEQ ID NO: 148899 - DNA, 25 bp, Homo sapien
ccggaaccgggacgcgataaatatg

SEQ ID NO: 148900 - DNA, 25 bp, Homo sapien
gagcaaacttttggcacccaccgca

SEQ ID NO: 148901 - DNA, 25 bp, Homo sapien
agtacgtgcatccaacgccattttc

SEQ ID NO: 148902 - DNA, 25 bp, Homo sapien
cactgaactcactcaagtacgtgca

SEQ ID NO: 148903 - DNA, 25 bp, Homo sapien
agcgagacatgcacccggcccggaa

SEQ ID NO: 148904 - DNA, 25 bp, Homo sapien
gagccgagcgagaggaaaaatccac

SEQ ID NO: 148905 - DNA, 25 bp, Homo sapien
acgctggaccgcagcaccggcgtaa

SEQ ID NO: 148906 - DNA, 25 bp, Homo sapien
tggtgggcctcaacaccaccaagct

SEQ ID NO: 148907 - DNA, 25 bp, Homo sapien
ggccatgatcactaactggatgtcc

SEQ ID NO: 148908 - DNA, 25 bp, Homo sapien
gcgagaggaaaaatccacccatttc

SEQ ID NO: 148909 - DNA, 25 bp, Homo sapien
actcctgggcggactggagtttgca

SEQ ID NO: 148910 - DNA, 25 bp, Homo sapien
gatcccaactcctgggcggactgga

SEQ ID NO: 148911 - DNA, 25 bp, Homo sapien
tccacccatttcctgggcggattgc

SEQ ID NO: 148912 - DNA, 25 bp, Homo sapien
gcctctgaactcgtgtgctcgtgca

SEQ ID NO: 148913 - DNA, 25 bp, Homo sapien
caccgagggtgccacgcagacctag

SEQ ID NO: 148914 - DNA, 25 bp, Homo sapien
cacgcagacctaggaggtcacaggc

SEQ ID NO: 148915 - DNA, 25 bp, Homo sapien
gtgctcgtgcaagcccaccgagggt

SEQ ID NO: 148916 - DNA, 25 bp, Homo sapien
gaactcgtgtgctcgtgcaagccca

SEQ ID NO: 148917 - DNA, 25 bp, Homo sapien
cccacacgtggatggcctctgaact

SEQ ID NO: 148918 - DNA, 25 bp, Homo sapien
caggattatcctggctgagccgagg

SEQ ID NO: 148919 - DNA, 25 bp, Homo sapien
accctgcttgccgacaggattatcc

SEQ ID NO: 148920 - DNA, 25 bp, Homo sapien
cggagtttggaacacgtcgagaata

SEQ ID NO: 148921 - DNA, 25 bp, Homo sapien
tgcccgtgaacctgggataggtacg

SEQ ID NO: 148922 - DNA, 25 bp, Homo sapien
ataggtacgtaaacagcagcgcgcg

SEQ ID NO: 148923 - DNA, 25 bp, Homo sapien
agcgcgcgcgtaagacacaatccac

SEQ ID NO: 148924 - DNA, 25 bp, Homo sapien
cgcgtccttccacacggagtttgga

SEQ ID NO: 148925 - DNA, 25 bp, Homo sapien
tgaaacctcgccgtgcaagacccaa

SEQ ID NO: 148926 - DNA, 25 bp, Homo sapien
gaccggcacacggtacacgtacgtg

SEQ ID NO: 148927 - DNA, 25 bp, Homo sapien
cgtacgtgcagatgtgcgagccaca

SEQ ID NO: 148928 - DNA, 25 bp, Homo sapien
gggaggccttcatcatctgcggcac

SEQ ID NO: 148929 - DNA, 25 bp, Homo sapien
tgcggcacgctgtacgtcaccaacg

SEQ ID NO: 148930 - DNA, 25 bp, Homo sapien
cggacatcgacctcatggtggacga

SEQ ID NO: 148931 - DNA, 25 bp, Homo sapien
gtgggccgtgtacgccaccaaccag

SEQ ID NO: 148932 - DNA, 25 bp, Homo sapien
ctggggtggccactcggacatcgac

SEQ ID NO: 148933 - DNA, 25 bp, Homo sapien
atcatctgcggcacgctgtacgtca

SEQ ID NO: 148934 - DNA, 25 bp, Homo sapien
tgcagaccctgcagacctggaacac

SEQ ID NO: 148935 - DNA, 25 bp, Homo sapien
tgcagacctggaacacgagctaccc

SEQ ID NO: 148936 - DNA, 25 bp, Homo sapien
tcccagcttacctgcgggtccgagt

SEQ ID NO: 148937 - DNA, 25 bp, Homo sapien
tatgaaagcgctctccgccaacacg

SEQ ID NO: 148938 - DNA, 25 bp, Homo sapien
cacaactccttcctcgaggtttagg

SEQ ID NO: 148939 - DNA, 25 bp, Homo sapien
ggacagagagcgaacctgtgacttc

SEQ ID NO: 148940 - DNA, 25 bp, Homo sapien
gcgcatcctcgtttgggcgccaacg

SEQ ID NO: 148941 - DNA, 25 bp, Homo sapien
agaccaggcggctcacggaacaccg

SEQ ID NO: 148942 - DNA, 25 bp, Homo sapien
atgcacaggtcgcagctgctcacca

SEQ ID NO: 148943 - DNA, 25 bp, Homo sapien
acttcgggccaggatgacgacctga

SEQ ID NO: 148944 - DNA, 25 bp, Homo sapien
ggcagcaccggacgtcaaggtattg

SEQ ID NO: 148945 - DNA, 25 bp, Homo sapien
ccggacgtcaaggtattgccgagaa

SEQ ID NO: 148946 - DNA, 25 bp, Homo sapien
ttgccgagaacgagatgcaccatca

SEQ ID NO: 148947 - DNA, 25 bp, Homo sapien
gaacgagatgcaccatcatgatggg

SEQ ID NO: 148948 - DNA, 25 bp, Homo sapien
ttttccggcttctcatcatcacaca

SEQ ID NO: 148949 - DNA, 25 bp, Homo sapien
catcatgatggggagaatcttttcc

SEQ ID NO: 148950 - DNA, 25 bp, Homo sapien
ggggagaatcttttccggcttctca

SEQ ID NO: 148951 - DNA, 25 bp, Homo sapien
cttctcatcatcacacaagcgtgag

SEQ ID NO: 148952 - DNA, 25 bp, Homo sapien
gtaccacgagctcatcttcctccaa

SEQ ID NO: 148953 - DNA, 25 bp, Homo sapien
ggaacatcagcgctgcctcgtacca

SEQ ID NO: 148954 - DNA, 25 bp, Homo sapien
tccagaggaacatcagcgctgcctc

SEQ ID NO: 148955 - DNA, 25 bp, Homo sapien
gactccagaggaacatcagcgctgc

SEQ ID NO: 148956 - DNA, 25 bp, Homo sapien
gcaccatgcacggcccaggaggact

SEQ ID NO: 148957 - DNA, 25 bp, Homo sapien
aggaggactccagaggaacatcagc

SEQ ID NO: 148958 - DNA, 25 bp, Homo sapien
agcgctgcctcgtaccacgagctca

SEQ ID NO: 148959 - DNA, 25 bp, Homo sapien
gctgtcagaggaggctccacggtgt

SEQ ID NO: 148960 - DNA, 25 bp, Homo sapien
tgatggatggtctgcccggagcttt

SEQ ID NO: 148961 - DNA, 25 bp, Homo sapien
tggtccctgctcaccagcgggtctt

SEQ ID NO: 148962 - DNA, 25 bp, Homo sapien
gctcttgcgcctctggcagtgtgaa

SEQ ID NO: 148963 - DNA, 25 bp, Homo sapien
cgcctctggcagtgtgaagtgagca

SEQ ID NO: 148964 - DNA, 25 bp, Homo sapien
tgtgaagtgagcaaagcgtctctga

SEQ ID NO: 148965 - DNA, 25 bp, Homo sapien
aaagcgtctctgaagctcgagcgtg

SEQ ID NO: 148966 - DNA, 25 bp, Homo sapien
gctgtcgcctctgcgccttcgggac

SEQ ID NO: 148967 - DNA, 25 bp, Homo sapien
agctttggggagcaccgacacccag

SEQ ID NO: 148968 - DNA, 25 bp, Homo sapien
ggcacgctgggaccgtccgtctaca

SEQ ID NO: 148969 - DNA, 25 bp, Homo sapien
cctgacaaaggggtcggcagtgcca

SEQ ID NO: 148970 - DNA, 25 bp, Homo sapien
agcctctggcacaggtgtcgtccca

SEQ ID NO: 148971 - DNA, 25 bp, Homo sapien
tacagcctctggcacaggtgtcgtc

SEQ ID NO: 148972 - DNA, 25 bp, Homo sapien
cccaggccagattggccctgctgtg

SEQ ID NO: 148973 - DNA, 25 bp, Homo sapien
tgggaccgtccgtctacagcctctg

SEQ ID NO: 148974 - DNA, 25 bp, Homo sapien
ctgtgccgcacggagccctgacaaa

SEQ ID NO: 148975 - DNA, 25 bp, Homo sapien
cagattggccctgctgtgccgcacg

SEQ ID NO: 148976 - DNA, 25 bp, Homo sapien
caactgtatggggtgacttcggtga

SEQ ID NO: 148977 - DNA, 25 bp, Homo sapien
gtgacttcggtgatgccgactgcat

SEQ ID NO: 148978 - DNA, 25 bp, Homo sapien
tgactgaggtgatgccgactgcatg

SEQ ID NO: 148979 - DNA, 25 bp, Homo sapien
gtgacggcggtgatgcccactgtat

SEQ ID NO: 148980 - DNA, 25 bp, Homo sapien
atgccaactgtatggggtgacttcg

SEQ ID NO: 148981 - DNA, 25 bp, Homo sapien
tgacttcggtgatgccgactgcatg

SEQ ID NO: 148982 - DNA, 25 bp, Homo sapien
acttcggtgatgccgactgcatggg

SEQ ID NO: 148983 - DNA, 25 bp, Homo sapien
tgacggtggtgatgccaactgtatg

SEQ ID NO: 148984 - DNA, 25 bp, Homo sapien
ggtgaccaaggtgatgctgactgca

SEQ ID NO: 148985 - DNA, 25 bp, Homo sapien
cgaggtgatgcccactctatggggc

SEQ ID NO: 148986 - DNA, 25 bp, Homo sapien
tgcccactctatggggcgacagcag

SEQ ID NO: 148987 - DNA, 25 bp, Homo sapien
cgacagcagtggtgctgactgcata

SEQ ID NO: 148988 - DNA, 25 bp, Homo sapien
tgatggcagtgatgccaactgcgtg

SEQ ID NO: 148989 - DNA, 25 bp, Homo sapien
catggggcgaccaaggtgatgccaa

SEQ ID NO: 148990 - DNA, 25 bp, Homo sapien
aactgcatggggtgacttcggtgat

SEQ ID NO: 148991 - DNA, 25 bp, Homo sapien
cgaccaaggtgatgccaactgcatg

SEQ ID NO: 148992 - DNA, 25 bp, Homo sapien
tgggtgccatgaacgccgcagctga

SEQ ID NO: 148993 - DNA, 25 bp, Homo sapien
gacaggcgtgggtgccatgaacgcc

SEQ ID NO: 148994 - DNA, 25 bp, Homo sapien
cgcagctgatccctcgctgtggaca

SEQ ID NO: 148995 - DNA, 25 bp, Homo sapien
gctgatccctcgctgtggacaggcg

SEQ ID NO: 148996 - DNA, 25 bp, Homo sapien
gccgcagctgatccctcgctgtgga

SEQ ID NO: 148997 - DNA, 25 bp, Homo sapien
ctgatccctcgctgtggacaggcgt

SEQ ID NO: 148998 - DNA, 25 bp, Homo sapien
tgacccctcgctgtggacaggcgtg

SEQ ID NO: 148999 - DNA, 25 bp, Homo sapien
gggtgccatgaacgccgcagctgac

SEQ ID NO: 149000 - DNA, 25 bp, Homo sapien
ccggctcactatgcctcgctgggtt

SEQ ID NO: 149001 - DNA, 25 bp, Homo sapien
tactggatgtgttggttgaatgaaa

SEQ ID NO: 149002 - DNA, 25 bp, Homo sapien
aggccactgactgtgtgaattctca

SEQ ID NO: 149003 - DNA, 25 bp, Homo sapien
gggccgctcacgacaggcagaattc

SEQ ID NO: 149004 - DNA, 25 bp, Homo sapien
tgacgacaccacaggagctcacggc

SEQ ID NO: 149005 - DNA, 25 bp, Homo sapien
cctcgctgggttggaagatatgcac

SEQ ID NO: 149006 - DNA, 25 bp, Homo sapien
gatatgcacaccagctgccgtctca

SEQ ID NO: 149007 - DNA, 25 bp, Homo sapien
ggcagaattcccgaatcaggcttct

SEQ ID NO: 149008 - DNA, 25 bp, Homo sapien
ccgcgcgtctcagcctgacccaccg

SEQ ID NO: 149009 - DNA, 25 bp, Homo sapien
tgcggctgattctccgcgcgtctca

SEQ ID NO: 149010 - DNA, 25 bp, Homo sapien
ttgcggctgattctccgcgcgtctc

SEQ ID NO: 149011 - DNA, 25 bp, Homo sapien
tttgcggctgattctccgcgcgtct

SEQ ID NO: 149012 - DNA, 25 bp, Homo sapien
ggtttgcggctgattctccgcgcgt

SEQ ID NO: 149013 - DNA, 25 bp, Homo sapien
tgcaggaaggagccaggtggacgcc

SEQ ID NO: 149014 - DNA, 25 bp, Homo sapien
agccggcatttctgcaggaaggagc

SEQ ID NO: 149015 - DNA, 25 bp, Homo sapien
ccagcgcgttcggtggagggaccct

SEQ ID NO: 149016 - DNA, 25 bp, Homo sapien
cccagttgtagccatgggcggcgtt

SEQ ID NO: 149017 - DNA, 25 bp, Homo sapien
gatgcgacgccggtcctctcggatc

SEQ ID NO: 149018 - DNA, 25 bp, Homo sapien
tctcggatccgcgacagtgcgggct

SEQ ID NO: 149019 - DNA, 25 bp, Homo sapien
tacttgatgttgtcgatggctggca

SEQ ID NO: 149020 - DNA, 25 bp, Homo sapien
atggctggcagcacgatgcgacgcc

SEQ ID NO: 149021 - DNA, 25 bp, Homo sapien
gatgatgtacatgcaccagaggccc

SEQ ID NO: 149022 - DNA, 25 bp, Homo sapien
ctgcacctcaaacgtgctgtacttg

SEQ ID NO: 149023 - DNA, 25 bp, Homo sapien
ggcgttcgcatactgctgcacctca

SEQ ID NO: 149024 - DNA, 25 bp, Homo sapien
tgatgcccagccacgggcacggctt

SEQ ID NO: 149025 - DNA, 25 bp, Homo sapien
cgcgtgaacttcggggaggaactcg

SEQ ID NO: 149026 - DNA, 25 bp, Homo sapien
gaactcggccgtgccattcccatga

SEQ ID NO: 149027 - DNA, 25 bp, Homo sapien
actcggccgtgccattcccatgatg

SEQ ID NO: 149028 - DNA, 25 bp, Homo sapien
gtgccattcccatgatgcccagcca

SEQ ID NO: 149029 - DNA, 25 bp, Homo sapien
cgccgccaccgtccggtaggtcgcg

SEQ ID NO: 149030 - DNA, 25 bp, Homo sapien
cctgtctctggcctccgtgcgactc

SEQ ID NO: 149031 - DNA, 25 bp, Homo sapien
ggccgtgccattcccatgatgccca

SEQ ID NO: 149032 - DNA, 25 bp, Homo sapien
cgaagatgaacgtccagcccagaag

SEQ ID NO: 149033 - DNA, 25 bp, Homo sapien
gaagatgaacgtccagcccagaagc

SEQ ID NO: 149034 - DNA, 25 bp, Homo sapien
gcgaagatgaacgtccagcccagaa

SEQ ID NO: 149035 - DNA, 25 bp, Homo sapien
agcgaagatgaacgtccagcccaga

SEQ ID NO: 149036 - DNA, 25 bp, Homo sapien
gttagcgaagatgaacgtccagccc

SEQ ID NO: 149037 - DNA, 25 bp, Homo sapien
cccggttagcgaagatgaacgtcca

SEQ ID NO: 149038 - DNA, 25 bp, Homo sapien
cggttagcgaagatgaacgtccagc

SEQ ID NO: 149039 - DNA, 25 bp, Homo sapien
ttagcgaagatgaacgtccagccca

SEQ ID NO: 149040 - DNA, 25 bp, Homo sapien
taaaggtgggatcaaaaggagcgcc

SEQ ID NO: 149041 - DNA, 25 bp, Homo sapien
gcacaggcgtccgaggcgtccgact

SEQ ID NO: 149042 - DNA, 25 bp, Homo sapien
tgggatcaaaaggagcgccagcgct

SEQ ID NO: 149043 - DNA, 25 bp, Homo sapien
agcagcacagaataaaggtgggatc

SEQ ID NO: 149044 - DNA, 25 bp, Homo sapien
caaggtcacaaccacgcaggagaac

SEQ ID NO: 149045 - DNA, 25 bp, Homo sapien
aggtccaaggtcacaaccacgcagg

SEQ ID NO: 149046 - DNA, 25 bp, Homo sapien
ggaaagcgagtcatgagtgcggcac

SEQ ID NO: 149047 - DNA, 25 bp, Homo sapien
aacgagggcagcacgaagccggcaa

SEQ ID NO: 149048 - DNA, 25 bp, Homo sapien
ttacaaaaagatcggcccagcagcc

SEQ ID NO: 149049 - DNA, 25 bp, Homo sapien
tcctcacgatccaagcaaagcagct

SEQ ID NO: 149050 - DNA, 25 bp, Homo sapien
aagcaaagcagctgcgtctaccgcg

SEQ ID NO: 149051 - DNA, 25 bp, Homo sapien
aaagcagctgcgtctaccgcggacg

SEQ ID NO: 149052 - DNA, 25 bp, Homo sapien
taccgcggacgccaacgccacatgg

SEQ ID NO: 149053 - DNA, 25 bp, Homo sapien
catgggccgcctactactcacatta

SEQ ID NO: 149054 - DNA, 25 bp, Homo sapien
gggccgcctactactcacattacta

SEQ ID NO: 149055 - DNA, 25 bp, Homo sapien
actactcacattactaccagcagtc

SEQ ID NO: 149056 - DNA, 25 bp, Homo sapien
gcagaagcaatcctggacatctcca

SEQ ID NO: 149057 - DNA, 25 bp, Homo sapien
agtgacgggtccctgtccgcaagcc

SEQ ID NO: 149058 - DNA, 25 bp, Homo sapien
gcaatcctggacatctccaagacga

SEQ ID NO: 149059 - DNA, 25 bp, Homo sapien
gccgggcggacacatctgctgagct

SEQ ID NO: 149060 - DNA, 25 bp, Homo sapien
ctggacatctccaagacgatcctgc

SEQ ID NO: 149061 - DNA, 25 bp, Homo sapien
gacatctccaagacgatcctgccgg

SEQ ID NO: 149062 - DNA, 25 bp, Homo sapien
tgagctgatgtgtgcagaagcaatc

SEQ ID NO: 149063 - DNA, 25 bp, Homo sapien
tgtccgcaagcccactcttctactc

SEQ ID NO: 149064 - DNA, 25 bp, Homo sapien
ttcgcccaccagagtcggctgccca

SEQ ID NO: 149065 - DNA, 25 bp, Homo sapien
ctggagcgacttcgcccaccagagt

SEQ ID NO: 149066 - DNA, 25 bp, Homo sapien
gagcgacttcgcccaccagagtcgg

SEQ ID NO: 149067 - DNA, 25 bp, Homo sapien
gacttcgcccaccagagtcggctgc

SEQ ID NO: 149068 - DNA, 25 bp, Homo sapien
aaggcagagatgcagtgtggagggg

SEQ ID NO: 149069 - DNA, 25 bp, Homo sapien
tccgaaggcagagatgcagtgtgga

SEQ ID NO: 149070 - DNA, 25 bp, Homo sapien
cgctccgaaggcagagatgcagtgt

SEQ ID NO: 149071 - DNA, 25 bp, Homo sapien
gcccaccagagtcggctgcccagcc

SEQ ID NO: 149072 - DNA, 25 bp, Homo sapien
cgcgtcctgggttgcgtgcattcgt

SEQ ID NO: 149073 - DNA, 25 bp, Homo sapien
cctgggttgcgtgcattcgtggaaa

SEQ ID NO: 149074 - DNA, 25 bp, Homo sapien
ccctcgagctgtgggttcgcgtcct

SEQ ID NO: 149075 - DNA, 25 bp, Homo sapien
ttcagcgacacctccacggaggaca

SEQ ID NO: 149076 - DNA, 25 bp, Homo sapien
tgacttcagcgacacctccacggag

SEQ ID NO: 149077 - DNA, 25 bp, Homo sapien
gacgaagggtcaacagggatgacca

SEQ ID NO: 149078 - DNA, 25 bp, Homo sapien
tatcgacgaagggtcaacagggatg

SEQ ID NO: 149079 - DNA, 25 bp, Homo sapien
cattcgtggaaagcggcgtagccgt

SEQ ID NO: 149080 - DNA, 25 bp, Homo sapien
attccctgctgggaccgtcgtgtga

SEQ ID NO: 149081 - DNA, 25 bp, Homo sapien
acggggtttaagcactgcaggtcca

SEQ ID NO: 149082 - DNA, 25 bp, Homo sapien
cccgagtctaaattgagacccgaga

SEQ ID NO: 149083 - DNA, 25 bp, Homo sapien
gactcggcgccaggacctctatcta

SEQ ID NO: 149084 - DNA, 25 bp, Homo sapien
ctcggcaggcaacgattggactttt

SEQ ID NO: 149085 - DNA, 25 bp, Homo sapien
ttcacagctcacttggcgggaggcg

SEQ ID NO: 149086 - DNA, 25 bp, Homo sapien
gacccgagatctggctaactttatg

SEQ ID NO: 149087 - DNA, 25 bp, Homo sapien
cgcaggacgtggttcacagctcact

SEQ ID NO: 149088 - DNA, 25 bp, Homo sapien
tggccgggcattcgtgcatgttcat

SEQ ID NO: 149089 - DNA, 25 bp, Homo sapien
cacacagagaggacttccgtcttga

SEQ ID NO: 149090 - DNA, 25 bp, Homo sapien
gccgccgtcacgatgtgcatgtggt

SEQ ID NO: 149091 - DNA, 25 bp, Homo sapien
gtgatgctgccacgggcatctgccc

SEQ ID NO: 149092 - DNA, 25 bp, Homo sapien
agcagctccgatcaattctcctttg

SEQ ID NO: 149093 - DNA, 25 bp, Homo sapien
ttctcctttgcgaggtgaccaccaa

SEQ ID NO: 149094 - DNA, 25 bp, Homo sapien
tgaccaccaaaggactgcagagctg

SEQ ID NO: 149095 - DNA, 25 bp, Homo sapien
gtgcgtgttcatgaccgagaacttt

SEQ ID NO: 149096 - DNA, 25 bp, Homo sapien
tcggagcaccgggacgccatgaact

SEQ ID NO: 149097 - DNA, 25 bp, Homo sapien
tgccacgtgctttccacctagccca

SEQ ID NO: 149098 - DNA, 25 bp, Homo sapien
ccacctgccacgtgctttccaccta

SEQ ID NO: 149099 - DNA, 25 bp, Homo sapien
catgaactcgcagctgcggagcgac

SEQ ID NO: 149100 - DNA, 25 bp, Homo sapien
gacgccatgaactcgcagctgcgga

SEQ ID NO: 149101 - DNA, 25 bp, Homo sapien
gggacgccatgaactcgcagctgcg

SEQ ID NO: 149102 - DNA, 25 bp, Homo sapien
accgggacgccatgaactcgcagct

SEQ ID NO: 149103 - DNA, 25 bp, Homo sapien
gcaccgggacgccatgaactcgcag

SEQ ID NO: 149104 - DNA, 25 bp, Homo sapien
tttttcggagttttgagggctcaga

SEQ ID NO: 149105 - DNA, 25 bp, Homo sapien
ggagtcgtcttgaatctggcttgtg

SEQ ID NO: 149106 - DNA, 25 bp, Homo sapien
ggcttgtgttcaatgaccagtgttg

SEQ ID NO: 149107 - DNA, 25 bp, Homo sapien
gcgcttgggcttttctagccattga

SEQ ID NO: 149108 - DNA, 25 bp, Homo sapien
ctggcgtcttttcctcgctaatctg

SEQ ID NO: 149109 - DNA, 25 bp, Homo sapien
aaatgtttttcagggcaacgcgagg

SEQ ID NO: 149110 - DNA, 25 bp, Homo sapien
ccttcgagtttgacgacggccaatg

SEQ ID NO: 149111 - DNA, 25 bp, Homo sapien
gaccagtgttgaccacggcagagca

SEQ ID NO: 149112 - DNA, 25 bp, Homo sapien
cggattgagcctaagtgcgtgcgtt

SEQ ID NO: 149113 - DNA, 25 bp, Homo sapien
ggcgactcccggattgagcctaagt

SEQ ID NO: 149114 - DNA, 25 bp, Homo sapien
cttaggactcgcctgggtctccagt

SEQ ID NO: 149115 - DNA, 25 bp, Homo sapien
cagttccttaggactcgcctgggtc

SEQ ID NO: 149116 - DNA, 25 bp, Homo sapien
ggccttgtcagttccttaggactcg

SEQ ID NO: 149117 - DNA, 25 bp, Homo sapien
gtgcattgggtgagcgcccacgaca

SEQ ID NO: 149118 - DNA, 25 bp, Homo sapien
acgacagaggccgttttgaccgttg

SEQ ID NO: 149119 - DNA, 25 bp, Homo sapien
accacagaggtggttttgacggttg

SEQ ID NO: 149120 - DNA, 25 bp, Homo sapien
ctcggagctgcggagtcttccagag

SEQ ID NO: 149121 - DNA, 25 bp, Homo sapien
aagatgagcgacctggactccgagg

SEQ ID NO: 149122 - DNA, 25 bp, Homo sapien
gacctggactccgaggtgctgccct

SEQ ID NO: 149123 - DNA, 25 bp, Homo sapien
tccagaacgacgacaggtagggacc

SEQ ID NO: 149124 - DNA, 25 bp, Homo sapien
cggagtcttccagagcccgacttgg

SEQ ID NO: 149125 - DNA, 25 bp, Homo sapien
ggacaccgccggcttcaagatgagc

SEQ ID NO: 149126 - DNA, 25 bp, Homo sapien
cttccagagcccgacttggggcgcg

SEQ ID NO: 149127 - DNA, 25 bp, Homo sapien
tgggcgacccgtccttccagaacga

SEQ ID NO: 149128 - DNA, 25 bp, Homo sapien
gtgaggcttcctccagcactgcggt

SEQ ID NO: 149129 - DNA, 25 bp, Homo sapien
ctttgtgcagtcatggcgcggtgaa

SEQ ID NO: 149130 - DNA, 25 bp, Homo sapien
tccatcggccctttgtgcagtcatg

SEQ ID NO: 149131 - DNA, 25 bp, Homo sapien
agccctgatgtccatcggccctttg

SEQ ID NO: 149132 - DNA, 25 bp, Homo sapien
ccatgtatgggcagccctgatgtcc

SEQ ID NO: 149133 - DNA, 25 bp, Homo sapien
gaatgtgagcgagccgcatccgcag

SEQ ID NO: 149134 - DNA, 25 bp, Homo sapien
tcgttcccagggaatgtgagcgagc

SEQ ID NO: 149135 - DNA, 25 bp, Homo sapien
ttcctccagcactgcggtgggctgt

SEQ ID NO: 149136 - DNA, 25 bp, Homo sapien
ttgttaccattgcttggcttctgcc

SEQ ID NO: 149137 - DNA, 25 bp, Homo sapien
tgcgcgactgtcattgttaccattg

SEQ ID NO: 149138 - DNA, 25 bp, Homo sapien
tggcttctgccaaagcagccgcagg

SEQ ID NO: 149139 - DNA, 25 bp, Homo sapien
accgggtgcttgaaccttctccatg

SEQ ID NO: 149140 - DNA, 25 bp, Homo sapien
aaccttctccatggggcgtcctggc

SEQ ID NO: 149141 - DNA, 25 bp, Homo sapien
ccgcttgtcaaatcgcgcttgcatc

SEQ ID NO: 149142 - DNA, 25 bp, Homo sapien
aaatcgcgcttgcatcctgctcggg

SEQ ID NO: 149143 - DNA, 25 bp, Homo sapien
cccgtgcgcgactgtcattgttacc

SEQ ID NO: 149144 - DNA, 25 bp, Homo sapien
gcccatctactatggcttctccgag

SEQ ID NO: 149145 - DNA, 25 bp, Homo sapien
tctactatggcttctccgagagcgc

SEQ ID NO: 149146 - DNA, 25 bp, Homo sapien
gcttctccgagagcgctgagagcca

SEQ ID NO: 149147 - DNA, 25 bp, Homo sapien
gccaggcctcctcagagcggctggg

SEQ ID NO: 149148 - DNA, 25 bp, Homo sapien
ccacccgggcctggacatggagctg

SEQ ID NO: 149149 - DNA, 25 bp, Homo sapien
gccaggagaccaacgaggtgtgcga

SEQ ID NO: 149150 - DNA, 25 bp, Homo sapien
tatggcttctccgagagcgctgaga

SEQ ID NO: 149151 - DNA, 25 bp, Homo sapien
cccgcacaacggctccctctacggc

SEQ ID NO: 149152 - DNA, 25 bp, Homo sapien
tctcgctttcaggaccaggcccaag

SEQ ID NO: 149153 - DNA, 25 bp, Homo sapien
cttccctgcttggtctcgctttcag

SEQ ID NO: 149154 - DNA, 25 bp, Homo sapien
tgtgcttcaggcgaacataccctcc

SEQ ID NO: 149155 - DNA, 25 bp, Homo sapien
agtgggaactctgaccgtagcaggt

SEQ ID NO: 149156 - DNA, 25 bp, Homo sapien
ctcatccgttccacttcagacagtg

SEQ ID NO: 149157 - DNA, 25 bp, Homo sapien
acatgtaccggtggaagctctcgtc

SEQ ID NO: 149158 - DNA, 25 bp, Homo sapien
cccaaggcgcgcaagcaaggcgtga

SEQ ID NO: 149159 - DNA, 25 bp, Homo sapien
gtgagtcccgcggacatgtaccggt

SEQ ID NO: 149160 - DNA, 25 bp, Homo sapien
aggacagaaggggaacacacagtta

SEQ ID NO: 149161 - DNA, 25 bp, Homo sapien
aggcagccagtgaagccactagtcg

SEQ ID NO: 149162 - DNA, 25 bp, Homo sapien
gcaccgccgagaggcagccagtgaa

SEQ ID NO: 149163 - DNA, 25 bp, Homo sapien
aaggggaacacacagttagggcgca

SEQ ID NO: 149164 - DNA, 25 bp, Homo sapien
aacacacagttagggcgcagcggcg

SEQ ID NO: 149165 - DNA, 25 bp, Homo sapien
agccagtgaagccactagtcgccgc

SEQ ID NO: 149166 - DNA, 25 bp, Homo sapien
cgagaggcagccagtgaagccacta

SEQ ID NO: 149167 - DNA, 25 bp, Homo sapien
tgaagccactagtcgccgcccgcct

SEQ ID NO: 149168 - DNA, 25 bp, Homo sapien
acgttggcccacagacactgcagct

SEQ ID NO: 149169 - DNA, 25 bp, Homo sapien
tcgctgaggattgggaatccgtgac

SEQ ID NO: 149170 - DNA, 25 bp, Homo sapien
gctgaggattgggaatccgtgacca

SEQ ID NO: 149171 - DNA, 25 bp, Homo sapien
ctgaggattgggaatccgtgaccag

SEQ ID NO: 149172 - DNA, 25 bp, Homo sapien
agcccggcctcagcaagtcaggtag

SEQ ID NO: 149173 - DNA, 25 bp, Homo sapien
gcccggcctcagcaagtcaggtagt

SEQ ID NO: 149174 - DNA, 25 bp, Homo sapien
cccggcctcagcaagtcaggtagtc

SEQ ID NO: 149175 - DNA, 25 bp, Homo sapien
cgttggcccacagacactgcagctg

SEQ ID NO: 149176 - DNA, 25 bp, Homo sapien
gccgccgtgagactgtgctcttcac

SEQ ID NO: 149177 - DNA, 25 bp, Homo sapien
gtgctcttcaccgactacggcctgg

SEQ ID NO: 149178 - DNA, 25 bp, Homo sapien
tggctgtcaacacgtccatcctgag

SEQ ID NO: 149179 - DNA, 25 bp, Homo sapien
gctaccagaccttccggcagtactg

SEQ ID NO: 149180 - DNA, 25 bp, Homo sapien
tgtccgcctgctccatcatgtagta

SEQ ID NO: 149181 - DNA, 25 bp, Homo sapien
catcatgtagtagcgcctgcctgcc

SEQ ID NO: 149182 - DNA, 25 bp, Homo sapien
acctgtgggcactcctacaatgtca

SEQ ID NO: 149183 - DNA, 25 bp, Homo sapien
agcagtgcctgcagattctctacga

SEQ ID NO: 149184 - DNA, 25 bp, Homo sapien
aggccgcctgttccgtccgctgaga

SEQ ID NO: 149185 - DNA, 25 bp, Homo sapien
tgcctcgcgccgctcactggcagac

SEQ ID NO: 149186 - DNA, 25 bp, Homo sapien
cttggctgagcttgggacttcctca

SEQ ID NO: 149187 - DNA, 25 bp, Homo sapien
tgagcttgggacttcctcatgctgc

SEQ ID NO: 149188 - DNA, 25 bp, Homo sapien
cctgctttcaccaggggtcctccga

SEQ ID NO: 149189 - DNA, 25 bp, Homo sapien
ccgtggacggtgcacaggccacact

SEQ ID NO: 149190 - DNA, 25 bp, Homo sapien
aggaccgaaggcacccgtgtccgtg

SEQ ID NO: 149191 - DNA, 25 bp, Homo sapien
ctgttccgtccgctgagagcgcggt

SEQ ID NO: 149192 - DNA, 25 bp, Homo sapien
tcgacgtgggcatcaaagaagccga

SEQ ID NO: 149193 - DNA, 25 bp, Homo sapien
tcccgccggctgttgcggacaatct

SEQ ID NO: 149194 - DNA, 25 bp, Homo sapien
ggatcagtccttcccgccggctgtt

SEQ ID NO: 149195 - DNA, 25 bp, Homo sapien
gacccgctgagactggctgtccagc

SEQ ID NO: 149196 - DNA, 25 bp, Homo sapien
gactggctgtccagcctgttccggc

SEQ ID NO: 149197 - DNA, 25 bp, Homo sapien
ccttaccagcccgtgttgaactcga

SEQ ID NO: 149198 - DNA, 25 bp, Homo sapien
ccgtgttgaactcgacgtgggcatc

SEQ ID NO: 149199 - DNA, 25 bp, Homo sapien
ggacaatcttcacgaggcctgggta

SEQ ID NO: 149200 - DNA, 25 bp, Homo sapien
acctcggtgaggctagttgacccga

SEQ ID NO: 149201 - DNA, 25 bp, Homo sapien
gccagcaggtgcacgaagatctcga

SEQ ID NO: 149202 - DNA, 25 bp, Homo sapien
cttgagactcaggaccgtaagtacc

SEQ ID NO: 149203 - DNA, 25 bp, Homo sapien
ctctcctccggtgcgctgcaagtag

SEQ ID NO: 149204 - DNA, 25 bp, Homo sapien
taatgaggccgaaccagagctcccg

SEQ ID NO: 149205 - DNA, 25 bp, Homo sapien
cggtgccttcagactagagagcctc

SEQ ID NO: 149206 - DNA, 25 bp, Homo sapien
tcggctcgaggtcaacattctagtt

SEQ ID NO: 149207 - DNA, 25 bp, Homo sapien
ttctggcacaacagcatctcgaaga

SEQ ID NO: 149208 - DNA, 25 bp, Homo sapien
gagcaccgagcatcaaaagccgttt

SEQ ID NO: 149209 - DNA, 25 bp, Homo sapien
ctgccgacagcgttcccagggagga

SEQ ID NO: 149210 - DNA, 25 bp, Homo sapien
gtccgtgcatgacgttgtttcctgc

SEQ ID NO: 149211 - DNA, 25 bp, Homo sapien
aaagccgtttgcatagccaggtgtc

SEQ ID NO: 149212 - DNA, 25 bp, Homo sapien
ccgactgtccacgtagggcccaggt

SEQ ID NO: 149213 - DNA, 25 bp, Homo sapien
aggttttgttccgtgcgtgacgtag

SEQ ID NO: 149214 - DNA, 25 bp, Homo sapien
atagccaggtgtcagtcatttcaga

SEQ ID NO: 149215 - DNA, 25 bp, Homo sapien
ttcctgcgtgacgttgttctgtgtg

SEQ ID NO: 149216 - DNA, 25 bp, Homo sapien
ttccttcctctgtgcgttcgtgggt

SEQ ID NO: 149217 - DNA, 25 bp, Homo sapien
tgcgtccgtcgaacctaccttgttg

SEQ ID NO: 149218 - DNA, 25 bp, Homo sapien
tatccatacctcgttcgcgcttcgg

SEQ ID NO: 149219 - DNA, 25 bp, Homo sapien
cgcgtcgcgggtagtatatccatac

SEQ ID NO: 149220 - DNA, 25 bp, Homo sapien
ggcgtttggtgtgttagtttctctc

SEQ ID NO: 149221 - DNA, 25 bp, Homo sapien
actacattcactttgggctgccttg

SEQ ID NO: 149222 - DNA, 25 bp, Homo sapien
atactagactcgcacttctgagggg

SEQ ID NO: 149223 - DNA, 25 bp, Homo sapien
ccgtgctgtgtctagagatactaga

SEQ ID NO: 149224 - DNA, 25 bp, Homo sapien
cgaagagcaccagaagctgcgggct

SEQ ID NO: 149225 - DNA, 25 bp, Homo sapien
tgtctggctgccgaagagcaccaga

SEQ ID NO: 149226 - DNA, 25 bp, Homo sapien
acatcctgagccgtgcctgtctggc

SEQ ID NO: 149227 - DNA, 25 bp, Homo sapien
cccagtctctccgacacatcctgag

SEQ ID NO: 149228 - DNA, 25 bp, Homo sapien
cctcaccaccgggtaggagtccagg

SEQ ID NO: 149229 - DNA, 25 bp, Homo sapien
gctctcagagaaaatgcgacgcctt

SEQ ID NO: 149230 - DNA, 25 bp, Homo sapien
gcgacgccttttgggtcgatgaccc

SEQ ID NO: 149231 - DNA, 25 bp, Homo sapien
tagcgagccctcaccaccgggtagg

SEQ ID NO: 149232 - DNA, 25 bp, Homo sapien
ctcgcacgatgtggacggcgtggtg

SEQ ID NO: 149233 - DNA, 25 bp, Homo sapien
gcctcgcacgatgtggacggcgtgg

SEQ ID NO: 149234 - DNA, 25 bp, Homo sapien
aggcctcgcacgatgtggacggcgt

SEQ ID NO: 149235 - DNA, 25 bp, Homo sapien
gcaccggcttggcaaggcctcgcac

SEQ ID NO: 149236 - DNA, 25 bp, Homo sapien
ggcctcgcacgatgtggacggcgtg

SEQ ID NO: 149237 - DNA, 25 bp, Homo sapien
caaggcctcgcacgatgtggacggc

SEQ ID NO: 149238 - DNA, 25 bp, Homo sapien
aaggcctcgcacgatgtggacggcg

SEQ ID NO: 149239 - DNA, 25 bp, Homo sapien
cctcgcacgatgtggacggcgtggt

SEQ ID NO: 149240 - DNA, 25 bp, Homo sapien
gctggaagatgctctcgcccggctt

SEQ ID NO: 149241 - DNA, 25 bp, Homo sapien
ccggcttcgacagctccgtgtacag

SEQ ID NO: 149242 - DNA, 25 bp, Homo sapien
cggagagggctaccagttccgcgtc

SEQ ID NO: 149243 - DNA, 25 bp, Homo sapien
cgacagctccgtgtacagcgacctg

SEQ ID NO: 149244 - DNA, 25 bp, Homo sapien
cgtgtacagcgacctgtgcgaggca

SEQ ID NO: 149245 - DNA, 25 bp, Homo sapien
gaggaacgcaagacctgccggaacc

SEQ ID NO: 149246 - DNA, 25 bp, Homo sapien
taccagttccgcgtcgtgcgctgct

SEQ ID NO: 149247 - DNA, 25 bp, Homo sapien
ccgtgcggcccgaggaacgcaagac

SEQ ID NO: 149248 - DNA, 25 bp, Homo sapien
gcccaggtcacacgtcggtgctgat

SEQ ID NO: 149249 - DNA, 25 bp, Homo sapien
ggtcacacgtcggtgctgatgctgc

SEQ ID NO: 149250 - DNA, 25 bp, Homo sapien
tcacgctcttgtagagcacgcgctc

SEQ ID NO: 149251 - DNA, 25 bp, Homo sapien
ccggcccgttggtcagcaccaggtt

SEQ ID NO: 149252 - DNA, 25 bp, Homo sapien
tccttcttgcagcagtagtactgcg

SEQ ID NO: 149253 - DNA, 25 bp, Homo sapien
aacggcgaagtctggttcctcctcg

SEQ ID NO: 149254 - DNA, 25 bp, Homo sapien
cgagtgaacggcgaagtctggttcc

SEQ ID NO: 149255 - DNA, 25 bp, Homo sapien
aaggcctcccgcatggctgagaggc

SEQ ID NO: 149256 - DNA, 25 bp, Homo sapien
cagaaagccacgacagcggaggcaa

SEQ ID NO: 149257 - DNA, 25 bp, Homo sapien
ccatgacagtcgaggcaaacagccg

SEQ ID NO: 149258 - DNA, 25 bp, Homo sapien
acaagccatgacagtcgaggcaaac

SEQ ID NO: 149259 - DNA, 25 bp, Homo sapien
gctgctctatgcagcctgcagcagc

SEQ ID NO: 149260 - DNA, 25 bp, Homo sapien
gcgctgctctatgcagcctgcagca

SEQ ID NO: 149261 - DNA, 25 bp, Homo sapien
gagcttggcgctgctctatgcagcc

SEQ ID NO: 149262 - DNA, 25 bp, Homo sapien
ccgagcttggcgctgctctatgcag

SEQ ID NO: 149263 - DNA, 25 bp, Homo sapien
atgcggctgcgggtgcaaaaaggcg

SEQ ID NO: 149264 - DNA, 25 bp, Homo sapien
gtatttcatgaacaggcacgcacag

SEQ ID NO: 149265 - DNA, 25 bp, Homo sapien
acctcgccgtatttcatgaacaggc

SEQ ID NO: 149266 - DNA, 25 bp, Homo sapien
gacctcgccgtatttcatgaacagg

SEQ ID NO: 149267 - DNA, 25 bp, Homo sapien
tatttcatgaacaggcacgcacagc

SEQ ID NO: 149268 - DNA, 25 bp, Homo sapien
ctcgccgtatttcatgaacaggcac

SEQ ID NO: 149269 - DNA, 25 bp, Homo sapien
cacgcacagccaaccgcgggcctgt

SEQ ID NO: 149270 - DNA, 25 bp, Homo sapien
gcctgtctgcctttacacgcctgac

SEQ ID NO: 149271 - DNA, 25 bp, Homo sapien
acacgcccgacctcgccgtatttca

SEQ ID NO: 149272 - DNA, 25 bp, Homo sapien
ctgaccctggcctcgccgaatttag

SEQ ID NO: 149273 - DNA, 25 bp, Homo sapien
tctgaccctggcctcgccgaattta

SEQ ID NO: 149274 - DNA, 25 bp, Homo sapien
gaccctggcctcgccgaatttagcc

SEQ ID NO: 149275 - DNA, 25 bp, Homo sapien
gccgtggctttttactgcttattgc

SEQ ID NO: 149276 - DNA, 25 bp, Homo sapien
ccgtggctttttactgcttattgcc

SEQ ID NO: 149277 - DNA, 25 bp, Homo sapien
cgtggctttttactgcttattgccc

SEQ ID NO: 149278 - DNA, 25 bp, Homo sapien
tttggcaccggacgccatggctttt

SEQ ID NO: 149279 - DNA, 25 bp, Homo sapien
tgaccctggcctcgccgaatttagc

SEQ ID NO: 149280 - DNA, 25 bp, Homo sapien
tggtgacggcaagactgtgacacac

SEQ ID NO: 149281 - DNA, 25 bp, Homo sapien
gactgtgacacacggcggccccacg

SEQ ID NO: 149282 - DNA, 25 bp, Homo sapien
gtggtgacggcaagactgtgacaca

SEQ ID NO: 149283 - DNA, 25 bp, Homo sapien
cgtggtgacggcaagactgtgacac

SEQ ID NO: 149284 - DNA, 25 bp, Homo sapien
ccgtggtgacggcaagactgtgaca

SEQ ID NO: 149285 - DNA, 25 bp, Homo sapien
cacgcggtgtccactgcacagtcac

SEQ ID NO: 149286 - DNA, 25 bp, Homo sapien
ccacgcggtgtccactgcacagtca

SEQ ID NO: 149287 - DNA, 25 bp, Homo sapien
acgcggtgtccactgcacagtcacg

SEQ ID NO: 149288 - DNA, 25 bp, Homo sapien
cagtgacgaagagtcacgaaattta

SEQ ID NO: 149289 - DNA, 25 bp, Homo sapien
actgacggacagtgacgaagagtca

SEQ ID NO: 149290 - DNA, 25 bp, Homo sapien
aaagtggcgagaattgacggaaagt

SEQ ID NO: 149291 - DNA, 25 bp, Homo sapien
atcagagggcgacaaagaggaaagc

SEQ ID NO: 149292 - DNA, 25 bp, Homo sapien
aaagcgaaatggtgagatgcagccg

SEQ ID NO: 149293 - DNA, 25 bp, Homo sapien
tcacgaaatttatcagagggcgaca

SEQ ID NO: 149294 - DNA, 25 bp, Homo sapien
aagaactgagtgagggaagatagcc

SEQ ID NO: 149295 - DNA, 25 bp, Homo sapien
ctgcagccggggcagtcgcccgaat

SEQ ID NO: 149296 - DNA, 25 bp, Homo sapien
tgtgctttgctctcagggagccacg

SEQ ID NO: 149297 - DNA, 25 bp, Homo sapien
cctgtcgtgctgaaatggtccgtca

SEQ ID NO: 149298 - DNA, 25 bp, Homo sapien
tcacgcgccctgtcgtgctgaaatg

SEQ ID NO: 149299 - DNA, 25 bp, Homo sapien
ccatttcgcacgaggagtcccggct

SEQ ID NO: 149300 - DNA, 25 bp, Homo sapien
cgatgacgtactgcctgaacaagaa

SEQ ID NO: 149301 - DNA, 25 bp, Homo sapien
cagggagccacgacacgatgacgta

SEQ ID NO: 149302 - DNA, 25 bp, Homo sapien
gactcgtggtgacatgtccgcgtgt

SEQ ID NO: 149303 - DNA, 25 bp, Homo sapien
tgaaatggtccgtcacccaggtacg

SEQ ID NO: 149304 - DNA, 25 bp, Homo sapien
tcttgtgcaaacctcccgggctcat

SEQ ID NO: 149305 - DNA, 25 bp, Homo sapien
acaaatcttgtgcaaacctcccggg

SEQ ID NO: 149306 - DNA, 25 bp, Homo sapien
ctgctagttataaacaaatcttgtg

SEQ ID NO: 149307 - DNA, 25 bp, Homo sapien
tcggccatctggtccctcacttgat

SEQ ID NO: 149308 - DNA, 25 bp, Homo sapien
ggtacccacccagctcgcttactta

SEQ ID NO: 149309 - DNA, 25 bp, Homo sapien
tacccggccagcacctgggtaccca

SEQ ID NO: 149310 - DNA, 25 bp, Homo sapien
tgctgccggccagcacctgggtacc

SEQ ID NO: 149311 - DNA, 25 bp, Homo sapien
acaccaggctgtgtgggtccggact

SEQ ID NO: 149312 - DNA, 25 bp, Homo sapien
agagggcagcatgctcgacttcctg

SEQ ID NO: 149313 - DNA, 25 bp, Homo sapien
cagcgcttcacaccctggttgcgag

SEQ ID NO: 149314 - DNA, 25 bp, Homo sapien
ctgcgcttcacaccctggttgcgag

SEQ ID NO: 149315 - DNA, 25 bp, Homo sapien
actggcaccacgacgctctcttaga

SEQ ID NO: 149316 - DNA, 25 bp, Homo sapien
cgctctcttagaaaaatgggtcctc

SEQ ID NO: 149317 - DNA, 25 bp, Homo sapien
tgggtcctcagttctcgcgagagca

SEQ ID NO: 149318 - DNA, 25 bp, Homo sapien
tgattggtcagctaagtgcgcatgc

SEQ ID NO: 149319 - DNA, 25 bp, Homo sapien
tcctcacagaacctgcaggcactgg

SEQ ID NO: 149320 - DNA, 25 bp, Homo sapien
cctttgtctgccgattcaggggctt

SEQ ID NO: 149321 - DNA, 25 bp, Homo sapien
cctggaactcctgtaggtgcaggtc

SEQ ID NO: 149322 - DNA, 25 bp, Homo sapien
attcaggggcttgctgggcaaacct

SEQ ID NO: 149323 - DNA, 25 bp, Homo sapien
ctgctcagtttctgacgcgcagaaa

SEQ ID NO: 149324 - DNA, 25 bp, Homo sapien
ttctgacgcgcagaaactgtcaagg

SEQ ID NO: 149325 - DNA, 25 bp, Homo sapien
gaaactgtcaaggaagtcgggagcc

SEQ ID NO: 149326 - DNA, 25 bp, Homo sapien
cccttggcccgtcgagggtctgcag

SEQ ID NO: 149327 - DNA, 25 bp, Homo sapien
cccactccgcgcttgggagcgagga

SEQ ID NO: 149328 - DNA, 25 bp, Homo sapien
gtcctcactccatcacggaacaggt

SEQ ID NO: 149329 - DNA, 25 bp, Homo sapien
ggcatcgatccggtctcaacctgcg

SEQ ID NO: 149330 - DNA, 25 bp, Homo sapien
tatccgggcaccagtcgggtctcaa

SEQ ID NO: 149331 - DNA, 25 bp, Homo sapien
gccgagagcactgggctaacgccac

SEQ ID NO: 149332 - DNA, 25 bp, Homo sapien
cacgcactctcacccggggattgag

SEQ ID NO: 149333 - DNA, 25 bp, Homo sapien
cccgagtggatcgagttccaacctg

SEQ ID NO: 149334 - DNA, 25 bp, Homo sapien
gggcaccgatcaagttccaacccga

SEQ ID NO: 149335 - DNA, 25 bp, Homo sapien
tcacccaggcgctgatcagattcca

SEQ ID NO: 149336 - DNA, 25 bp, Homo sapien
ttacggcgcaagttctgcggcgctc

SEQ ID NO: 149337 - DNA, 25 bp, Homo sapien
ggtcatcaccaaggtaaggcggccg

SEQ ID NO: 149338 - DNA, 25 bp, Homo sapien
ggagcctcccttgcgatcccacggc

SEQ ID NO: 149339 - DNA, 25 bp, Homo sapien
tctttccaagttacggcgcaagttc

SEQ ID NO: 149340 - DNA, 25 bp, Homo sapien
gcactttctttccaagttacggcgc

SEQ ID NO: 149341 - DNA, 25 bp, Homo sapien
ccagagcttcgaagcactgcagagc

SEQ ID NO: 149342 - DNA, 25 bp, Homo sapien
ggcgcccagagcttcgaagcactgc

SEQ ID NO: 149343 - DNA, 25 bp, Homo sapien
ccgctggtcatcaccaaggtaaggc

SEQ ID NO: 149344 - DNA, 25 bp, Homo sapien
ccaaggaagatgctggccgagaatt

SEQ ID NO: 149345 - DNA, 25 bp, Homo sapien
acggagtcccatttgcgtctggtgc

SEQ ID NO: 149346 - DNA, 25 bp, Homo sapien
tgaccgtgaagaaagcaggaatttg

SEQ ID NO: 149347 - DNA, 25 bp, Homo sapien
gaagctgggcccatggtcagacatg

SEQ ID NO: 149348 - DNA, 25 bp, Homo sapien
gtcagacatggtttcagctcaaata

SEQ ID NO: 149349 - DNA, 25 bp, Homo sapien
gactcgtcgagtgtgatttccacgc

SEQ ID NO: 149350 - DNA, 25 bp, Homo sapien
aatcgtgaaatagacgccgctggga

SEQ ID NO: 149351 - DNA, 25 bp, Homo sapien
agctcaaataccagaagtgaccgtg

SEQ ID NO: 149352 - DNA, 25 bp, Homo sapien
tggcacaagcgcacgtgcgctgtgt

SEQ ID NO: 149353 - DNA, 25 bp, Homo sapien
atgtgctgtgtgcagtcccgagccc

SEQ ID NO: 149354 - DNA, 25 bp, Homo sapien
tttggcacgagcgtgtgccctgtgt

SEQ ID NO: 149355 - DNA, 25 bp, Homo sapien
acacgcgcatgtgctgtgtgcagtc

SEQ ID NO: 149356 - DNA, 25 bp, Homo sapien
cactgtttggctcgagcgcgcacgc

SEQ ID NO: 149357 - DNA, 25 bp, Homo sapien
ctgcactgttcgtttggcacacgcg

SEQ ID NO: 149358 - DNA, 25 bp, Homo sapien
tttggcacgagagtgcacgtgctgt

SEQ ID NO: 149359 - DNA, 25 bp, Homo sapien
ctgtttggcacgagcacgcgtgcgc

SEQ ID NO: 149360 - DNA, 25 bp, Homo sapien
cgtgcagaaaaagccagccagaggc

SEQ ID NO: 149361 - DNA, 25 bp, Homo sapien
ggcagccagcatcacgtgggcagat

SEQ ID NO: 149362 - DNA, 25 bp, Homo sapien
tgttgcactccctgacccaggaggg

SEQ ID NO: 149363 - DNA, 25 bp, Homo sapien
cctgagagcagtccagaggacagcg

SEQ ID NO: 149364 - DNA, 25 bp, Homo sapien
cagtccagaggacagcgccaccaga

SEQ ID NO: 149365 - DNA, 25 bp, Homo sapien
tgggcaagcccacccgaagaagcga

SEQ ID NO: 149366 - DNA, 25 bp, Homo sapien
acaggacggtgttacccgctggaca

SEQ ID NO: 149367 - DNA, 25 bp, Homo sapien
atgcccgcgagacaggacggtgtta

SEQ ID NO: 149368 - DNA, 25 bp, Homo sapien
cggatgttcattggagacctggaca

SEQ ID NO: 149369 - DNA, 25 bp, Homo sapien
cccggtgatcgggtaaatgcagata

SEQ ID NO: 149370 - DNA, 25 bp, Homo sapien
ctcaataatttggacgacggcgctt

SEQ ID NO: 149371 - DNA, 25 bp, Homo sapien
ggccggcctaaccagtgtctccgtg

SEQ ID NO: 149372 - DNA, 25 bp, Homo sapien
cctggacaaagtggtgaacctcctg

SEQ ID NO: 149373 - DNA, 25 bp, Homo sapien
aagcccagcgagtttgacaagttcc

SEQ ID NO: 149374 - DNA, 25 bp, Homo sapien
atcgtgaaaggcgtctgcaagccca

SEQ ID NO: 149375 - DNA, 25 bp, Homo sapien
cccgggtggagaatgccctcaataa

SEQ ID NO: 149376 - DNA, 25 bp, Homo sapien
ctttggagcagcctggaagtctatg

SEQ ID NO: 149377 - DNA, 25 bp, Homo sapien
ctgtgagagcagagcggctctgact

SEQ ID NO: 149378 - DNA, 25 bp, Homo sapien
cgctgagcgagctttggagcagcct

SEQ ID NO: 149379 - DNA, 25 bp, Homo sapien
agctttggagcagcctggaagtcta

SEQ ID NO: 149380 - DNA, 25 bp, Homo sapien
aagtctatggtaggggcgtcctcgt

SEQ ID NO: 149381 - DNA, 25 bp, Homo sapien
tggagcagcctggaagtctatggta

SEQ ID NO: 149382 - DNA, 25 bp, Homo sapien
tttggagcagcctggaagtctatgg

SEQ ID NO: 149383 - DNA, 25 bp, Homo sapien
agcagagcggctctgactgcgcccg

SEQ ID NO: 149384 - DNA, 25 bp, Homo sapien
ccacccgggctacctgaacggagtg

SEQ ID NO: 149385 - DNA, 25 bp, Homo sapien
cgacggtcgcgtcttttacattgac

SEQ ID NO: 149386 - DNA, 25 bp, Homo sapien
ccgcgccgaggaacgaagatggccg

SEQ ID NO: 149387 - DNA, 25 bp, Homo sapien
tcgcgtcttttacattgaccacaac

SEQ ID NO: 149388 - DNA, 25 bp, Homo sapien
caacacgcgccagacgtcgtggatc

SEQ ID NO: 149389 - DNA, 25 bp, Homo sapien
acgcgccagacgtcgtggatcgacc

SEQ ID NO: 149390 - DNA, 25 bp, Homo sapien
gcgagactacgacggtcgcgtcttt

SEQ ID NO: 149391 - DNA, 25 bp, Homo sapien
gggcccgcgccgtcatgccttggct

SEQ ID NO: 149392 - DNA, 25 bp, Homo sapien
aacaggtcatcgtctcctatgaaga

SEQ ID NO: 149393 - DNA, 25 bp, Homo sapien
ctcctatgaagacgagagctccttg

SEQ ID NO: 149394 - DNA, 25 bp, Homo sapien
ccggcaccacgagctgtggccagga

SEQ ID NO: 149395 - DNA, 25 bp, Homo sapien
ggtgaagaccgaggccctcatccga

SEQ ID NO: 149396 - DNA, 25 bp, Homo sapien
cctcatccgatacctggagaccatg

SEQ ID NO: 149397 - DNA, 25 bp, Homo sapien
cgatacctggagaccatgaagagct

SEQ ID NO: 149398 - DNA, 25 bp, Homo sapien
ggggccaacaggtcatcgtctccta

SEQ ID NO: 149399 - DNA, 25 bp, Homo sapien
agacgagagctccttgcgccggcac

SEQ ID NO: 149400 - DNA, 25 bp, Homo sapien
gactgcgggcacacgcctcggctat

SEQ ID NO: 149401 - DNA, 25 bp, Homo sapien
acgaagacttaccaggcatggcggc

SEQ ID NO: 149402 - DNA, 25 bp, Homo sapien
gggcgagatgctcccttttcagagc

SEQ ID NO: 149403 - DNA, 25 bp, Homo sapien
tacggcctcccgcagtacgagaagc

SEQ ID NO: 149404 - DNA, 25 bp, Homo sapien
aagtaagtgcggatgtggcctcctg

SEQ ID NO: 149405 - DNA, 25 bp, Homo sapien
cgcagtacgagaagcccgacgctga

SEQ ID NO: 149406 - DNA, 25 bp, Homo sapien
ccttcgactctctggggcgagatgc

SEQ ID NO: 149407 - DNA, 25 bp, Homo sapien
gctcggtcagcttcacggacatcta

SEQ ID NO: 149408 - DNA, 25 bp, Homo sapien
tgtgttcagtgactccgcagctgca

SEQ ID NO: 149409 - DNA, 25 bp, Homo sapien
gtcacttcagttatacgtgtgttca

SEQ ID NO: 149410 - DNA, 25 bp, Homo sapien
ttccttccttcgtgtttcagtcagc

SEQ ID NO: 149411 - DNA, 25 bp, Homo sapien
ttccagcgcgttgacactgaagtca

SEQ ID NO: 149412 - DNA, 25 bp, Homo sapien
ccgctggtgtttaacgaagtgttca

SEQ ID NO: 149413 - DNA, 25 bp, Homo sapien
acacttactgctccaaggctctgga

SEQ ID NO: 149414 - DNA, 25 bp, Homo sapien
tggactcgggcacgcccaacactta

SEQ ID NO: 149415 - DNA, 25 bp, Homo sapien
ctgtttgcagccacatccgagtcta

SEQ ID NO: 149416 - DNA, 25 bp, Homo sapien
agggtttctggccatcgaccctcac

SEQ ID NO: 149417 - DNA, 25 bp, Homo sapien
tgacttgggtcttggcgtgcccgcc

SEQ ID NO: 149418 - DNA, 25 bp, Homo sapien
aaaggatgctcgaggatgctgtcca

SEQ ID NO: 149419 - DNA, 25 bp, Homo sapien
cgcctcctggtgatgtcacggcgct

SEQ ID NO: 149420 - DNA, 25 bp, Homo sapien
tgcacacatcaagcgaaacgcctga

SEQ ID NO: 149421 - DNA, 25 bp, Homo sapien
ccgtcgcgctgaagaaaggatgctc

SEQ ID NO: 149422 - DNA, 25 bp, Homo sapien
gatgtcacggcgctcgcagccgtcg

SEQ ID NO: 149423 - DNA, 25 bp, Homo sapien
caggcccacgcgtgacttgggtctt

SEQ ID NO: 149424 - DNA, 25 bp, Homo sapien
tcgactacggccaggcgcctgctaa

SEQ ID NO: 149425 - DNA, 25 bp, Homo sapien
gaacccgacaggagcccgcaagaca

SEQ ID NO: 149426 - DNA, 25 bp, Homo sapien
gtcttcagagcggaaacaccgaacc

SEQ ID NO: 149427 - DNA, 25 bp, Homo sapien
gtctttccgccaaacgcatcgacta

SEQ ID NO: 149428 - DNA, 25 bp, Homo sapien
gtttagaatcccatgacccatccgg

SEQ ID NO: 149429 - DNA, 25 bp, Homo sapien
ctgagcttacctgcctcatgtttag

SEQ ID NO: 149430 - DNA, 25 bp, Homo sapien
aagctctccgcagtaacacgtcgca

SEQ ID NO: 149431 - DNA, 25 bp, Homo sapien
tacgggcagcaaagagcacgttttc

SEQ ID NO: 149432 - DNA, 25 bp, Homo sapien
gggaaccaccacgacccggcagtgc

SEQ ID NO: 149433 - DNA, 25 bp, Homo sapien
cctccggtgcggaggtcctccgaca

SEQ ID NO: 149434 - DNA, 25 bp, Homo sapien
cctccgacaccagcggcagtcccgc

SEQ ID NO: 149435 - DNA, 25 bp, Homo sapien
gacaccagcggcagtcccgccacgc

SEQ ID NO: 149436 - DNA, 25 bp, Homo sapien
cccacccgacgacttcctgccgccg

SEQ ID NO: 149437 - DNA, 25 bp, Homo sapien
ccctcgatgaccctgagctcccgcc

SEQ ID NO: 149438 - DNA, 25 bp, Homo sapien
cccggacttcatggagccgccccca

SEQ ID NO: 149439 - DNA, 25 bp, Homo sapien
cccgccgtcgtacgcagggatcgcg

SEQ ID NO: 149440 - DNA, 25 bp, Homo sapien
ccatgcgcccttcagtgccgtgtgt

SEQ ID NO: 149441 - DNA, 25 bp, Homo sapien
ccgtgtgtgttactgcggcagcagt

SEQ ID NO: 149442 - DNA, 25 bp, Homo sapien
ttactgcggcagcagtggccatgtg

SEQ ID NO: 149443 - DNA, 25 bp, Homo sapien
cacacgttctcagcagggcggtcac

SEQ ID NO: 149444 - DNA, 25 bp, Homo sapien
ggcggtcacacgtgaacagcctgtg

SEQ ID NO: 149445 - DNA, 25 bp, Homo sapien
agccttggggacacgtttgccagcc

SEQ ID NO: 149446 - DNA, 25 bp, Homo sapien
tttgccagccgacgaaactccagtc

SEQ ID NO: 149447 - DNA, 25 bp, Homo sapien
gctgcttctccatgacagacgctgc

SEQ ID NO: 149448 - DNA, 25 bp, Homo sapien
gtcactgctgctctgggttcgggtt

SEQ ID NO: 149449 - DNA, 25 bp, Homo sapien
ttcgaattcctattcatgcgccgca

SEQ ID NO: 149450 - DNA, 25 bp, Homo sapien
ggacggaacccgctctccgtgattg

SEQ ID NO: 149451 - DNA, 25 bp, Homo sapien
cgctctccgtgattgacggaaaata

SEQ ID NO: 149452 - DNA, 25 bp, Homo sapien
cagccacagcggtgaccgagtgaga

SEQ ID NO: 149453 - DNA, 25 bp, Homo sapien
ttggcagcttctcgacctctggtgt

SEQ ID NO: 149454 - DNA, 25 bp, Homo sapien
ctctggtgtcccttcgtttcttcga

SEQ ID NO: 149455 - DNA, 25 bp, Homo sapien
ggaaaatattactcttcagcccgcc

SEQ ID NO: 149456 - DNA, 25 bp, Homo sapien
cgggctcagaccagcgtctcgggca

SEQ ID NO: 149457 - DNA, 25 bp, Homo sapien
gctcagttttttctgcgtgacctgc

SEQ ID NO: 149458 - DNA, 25 bp, Homo sapien
ttctgcgtgacctgctgctctcgct

SEQ ID NO: 149459 - DNA, 25 bp, Homo sapien
tccctggtccgtgggtgtctccacg

SEQ ID NO: 149460 - DNA, 25 bp, Homo sapien
actcccatggggtctttggcactga

SEQ ID NO: 149461 - DNA, 25 bp, Homo sapien
ccagctcactctcgctgaggtcgtg

SEQ ID NO: 149462 - DNA, 25 bp, Homo sapien
tcggtcgacaggagctcccagatct

SEQ ID NO: 149463 - DNA, 25 bp, Homo sapien
tcaagtactgctccgacctggccgt

SEQ ID NO: 149464 - DNA, 25 bp, Homo sapien
ccctcagccgtggacctgtggggag

SEQ ID NO: 149465 - DNA, 25 bp, Homo sapien
cttctcgccgcggtacaccgggtgc

SEQ ID NO: 149466 - DNA, 25 bp, Homo sapien
gggtcacggtgtctctctgagttcc

SEQ ID NO: 149467 - DNA, 25 bp, Homo sapien
agtgctgtgcaaagcgcccctggca

SEQ ID NO: 149468 - DNA, 25 bp, Homo sapien
agcggccgagtctgatgcgatgggc

SEQ ID NO: 149469 - DNA, 25 bp, Homo sapien
tgcgatgggcgggcgtttaattcct

SEQ ID NO: 149470 - DNA, 25 bp, Homo sapien
ggccggcacgcctgcctcctgccac

SEQ ID NO: 149471 - DNA, 25 bp, Homo sapien
gaggccgaacgcgcccacgacaggt

SEQ ID NO: 149472 - DNA, 25 bp, Homo sapien
tgttccaagctcaaggttcccgcgg

SEQ ID NO: 149473 - DNA, 25 bp, Homo sapien
gcagatccatcaccagccttctagg

SEQ ID NO: 149474 - DNA, 25 bp, Homo sapien
tagaaccttcctccggagcccaaga

SEQ ID NO: 149475 - DNA, 25 bp, Homo sapien
tgcagaggctcaagggttgttccaa

SEQ ID NO: 149476 - DNA, 25 bp, Homo sapien
tgcccacggtgggatggaattcccg

SEQ ID NO: 149477 - DNA, 25 bp, Homo sapien
ttccgccggagaggaacacgctatt

SEQ ID NO: 149478 - DNA, 25 bp, Homo sapien
acgctattcgcagcccagccttggg

SEQ ID NO: 149479 - DNA, 25 bp, Homo sapien
gatggcctctaagactccagcaagc

SEQ ID NO: 149480 - DNA, 25 bp, Homo sapien
ggaggcttctcgaatacggtttctg

SEQ ID NO: 149481 - DNA, 25 bp, Homo sapien
acggtttctgtcttcgcgttaaatg

SEQ ID NO: 149482 - DNA, 25 bp, Homo sapien
gcctcgcccatgctttgtcgcgtta

SEQ ID NO: 149483 - DNA, 25 bp, Homo sapien
gatgcttccacttccttccgtcagg

SEQ ID NO: 149484 - DNA, 25 bp, Homo sapien
aagtgctgtgcttcgagcctgaccc

SEQ ID NO: 149485 - DNA, 25 bp, Homo sapien
cgcgagcgagggcatgaaatttaaa

SEQ ID NO: 149486 - DNA, 25 bp, Homo sapien
gccctccgccacgatgagcaaatga

SEQ ID NO: 149487 - DNA, 25 bp, Homo sapien
aaatgtctccttctgtgcggcctgg

SEQ ID NO: 149488 - DNA, 25 bp, Homo sapien
gcctcgggtgcctatcaatggtcct

SEQ ID NO: 149489 - DNA, 25 bp, Homo sapien
ccgcgggcaacttggtgccttattt

SEQ ID NO: 149490 - DNA, 25 bp, Homo sapien
attgcaaagctttcgaggtaggggc

SEQ ID NO: 149491 - DNA, 25 bp, Homo sapien
gcgcgacggggcttaagacaaacga

SEQ ID NO: 149492 - DNA, 25 bp, Homo sapien
attgagttttcctgcctcgggtgcc

SEQ ID NO: 149493 - DNA, 25 bp, Homo sapien
ctggctccctctccattgagttttc

SEQ ID NO: 149494 - DNA, 25 bp, Homo sapien
atcaatggtcctgctcggggatgca

SEQ ID NO: 149495 - DNA, 25 bp, Homo sapien
gcctgcatggatgtcttcagctttg

SEQ ID NO: 149496 - DNA, 25 bp, Homo sapien
gtgctgacgggacccttctgaagtt

SEQ ID NO: 149497 - DNA, 25 bp, Homo sapien
tgaggcccgtgaccgtgtaacctct

SEQ ID NO: 149498 - DNA, 25 bp, Homo sapien
cgtcatcgcgctcaatcagaagctg

SEQ ID NO: 149499 - DNA, 25 bp, Homo sapien
gcagacggcttcgtcagtgacgtca

SEQ ID NO: 149500 - DNA, 25 bp, Homo sapien
ccgggttcacggtgcaccaacatca

SEQ ID NO: 149501 - DNA, 25 bp, Homo sapien
aacctgcagtacgttctggcgcacc

SEQ ID NO: 149502 - DNA, 25 bp, Homo sapien
cctcaccgttgcaggagggttgttc

SEQ ID NO: 149503 - DNA, 25 bp, Homo sapien
agggttgttcgtggccggcatcaac

SEQ ID NO: 149504 - DNA, 25 bp, Homo sapien
gccgggagcgttcccatattatgat

SEQ ID NO: 149505 - DNA, 25 bp, Homo sapien
cagctggttgccatctctgccgctt

SEQ ID NO: 149506 - DNA, 25 bp, Homo sapien
ctcagtgctggtaaagcctcgcacc

SEQ ID NO: 149507 - DNA, 25 bp, Homo sapien
agctgagcctcagtgctggtaaagc

SEQ ID NO: 149508 - DNA, 25 bp, Homo sapien
gcgttcccatattatgatcctcata

SEQ ID NO: 149509 - DNA, 25 bp, Homo sapien
cagaatatttctacgtgccgggagc

SEQ ID NO: 149510 - DNA, 25 bp, Homo sapien
tttcacccacggcagaatatttcta

SEQ ID NO: 149511 - DNA, 25 bp, Homo sapien
tgatcctcataaccaaaaccacgct

SEQ ID NO: 149512 - DNA, 25 bp, Homo sapien
cccaacatcgtgctgttcagcggca

SEQ ID NO: 149513 - DNA, 25 bp, Homo sapien
agctgaacctcagaccagtgcgtgc

SEQ ID NO: 149514 - DNA, 25 bp, Homo sapien
ttggctggtcccagtttccgcgtcc

SEQ ID NO: 149515 - DNA, 25 bp, Homo sapien
gcccgcgcctgcgaagaaaccgagg

SEQ ID NO: 149516 - DNA, 25 bp, Homo sapien
caaggtggtcacgaagaagttcagc

SEQ ID NO: 149517 - DNA, 25 bp, Homo sapien
catcaggacctgtcccagcgcgtgg

SEQ ID NO: 149518 - DNA, 25 bp, Homo sapien
tcagcggcagctcgcatcaggacct

SEQ ID NO: 149519 - DNA, 25 bp, Homo sapien
cagtgcgtgcgactaaaggtttccc

SEQ ID NO: 149520 - DNA, 25 bp, Homo sapien
caagattcggctttgagaggcatcc

SEQ ID NO: 149521 - DNA, 25 bp, Homo sapien
ctttccttgtcctagccagccttta

SEQ ID NO: 149522 - DNA, 25 bp, Homo sapien
ccgcggctaggaaatggaaacgctt

SEQ ID NO: 149523 - DNA, 25 bp, Homo sapien
cggggctgtgctatgacatctttac

SEQ ID NO: 149524 - DNA, 25 bp, Homo sapien
caagtcctttgttctgaggttcatc

SEQ ID NO: 149525 - DNA, 25 bp, Homo sapien
ctctttggtccacagcgttttgaaa

SEQ ID NO: 149526 - DNA, 25 bp, Homo sapien
cgtccctgtgaaggcattccctaaa

SEQ ID NO: 149527 - DNA, 25 bp, Homo sapien
aaaactggcgttttgccgtgccgct

SEQ ID NO: 149528 - DNA, 25 bp, Homo sapien
cggccacacgtgaactgtgtgtgtc

SEQ ID NO: 149529 - DNA, 25 bp, Homo sapien
ggacacgtttgccaactgaccaaac

SEQ ID NO: 149530 - DNA, 25 bp, Homo sapien
tttgccaactgaccaaactccagtc

SEQ ID NO: 149531 - DNA, 25 bp, Homo sapien
gagagaggagaatgccgtcacgccc

SEQ ID NO: 149532 - DNA, 25 bp, Homo sapien
cctctgtgggccacgcctgctcatc

SEQ ID NO: 149533 - DNA, 25 bp, Homo sapien
gggacccaggcttctgttacgagcg

SEQ ID NO: 149534 - DNA, 25 bp, Homo sapien
tcacgggacccaggcttctgttacg

SEQ ID NO: 149535 - DNA, 25 bp, Homo sapien
agcagggcggccacacgtgaactgt

SEQ ID NO: 149536 - DNA, 25 bp, Homo sapien
tcccaagtcaacagggccagcgacg

SEQ ID NO: 149537 - DNA, 25 bp, Homo sapien
tgtgacaagtgtccctccaggtctg

SEQ ID NO: 149538 - DNA, 25 bp, Homo sapien
gtctgcccacaaaacactggcctgg

SEQ ID NO: 149539 - DNA, 25 bp, Homo sapien
tgccctgctttttagacacaaacgg

SEQ ID NO: 149540 - DNA, 25 bp, Homo sapien
cgtgccttgccgtgatgctccggca

SEQ ID NO: 149541 - DNA, 25 bp, Homo sapien
tctgtaaatggaccctgccgaaggc

SEQ ID NO: 149542 - DNA, 25 bp, Homo sapien
caggcttggccgaggtcccaagtca

SEQ ID NO: 149543 - DNA, 25 bp, Homo sapien
cgaaggctgtttcaggttcaggctt

SEQ ID NO: 149544 - DNA, 25 bp, Homo sapien
ccgagcagcacacatggcgcaattg

SEQ ID NO: 149545 - DNA, 25 bp, Homo sapien
attgtccaagaagccagcggagcgc

SEQ ID NO: 149546 - DNA, 25 bp, Homo sapien
gcacacatggcgcaattgtccaaga

SEQ ID NO: 149547 - DNA, 25 bp, Homo sapien
agaaggcatacaccgactgggccgc

SEQ ID NO: 149548 - DNA, 25 bp, Homo sapien
cgccgagaaggcatacaccgactgg

SEQ ID NO: 149549 - DNA, 25 bp, Homo sapien
cgggcgcgccgagaaggcatacacc

SEQ ID NO: 149550 - DNA, 25 bp, Homo sapien
ctgtacctgcgtaggggcacaccgt

SEQ ID NO: 149551 - DNA, 25 bp, Homo sapien
ggcgcaattgtccaagaagccagcg

SEQ ID NO: 149552 - DNA, 25 bp, Homo sapien
gctgcgacgggatttaacctggata

SEQ ID NO: 149553 - DNA, 25 bp, Homo sapien
gggtcccagccagatgtgcacagcc

SEQ ID NO: 149554 - DNA, 25 bp, Homo sapien
ttaacctggataccaggccgggagc

SEQ ID NO: 149555 - DNA, 25 bp, Homo sapien
tgagtgtctgactggcgattggctt

SEQ ID NO: 149556 - DNA, 25 bp, Homo sapien
ttcatccgcagaggagcctcggcca

SEQ ID NO: 149557 - DNA, 25 bp, Homo sapien
cgtccagcttcatccgcagaggagc

SEQ ID NO: 149558 - DNA, 25 bp, Homo sapien
ggacagcacccggtaactgcgagtg

SEQ ID NO: 149559 - DNA, 25 bp, Homo sapien
aggacccgtgcgagaatgcctctgc

SEQ ID NO: 149560 - DNA, 25 bp, Homo sapien
ggcgagcccttattcccagcggaag

SEQ ID NO: 149561 - DNA, 25 bp, Homo sapien
ccgggccgtcatcccaagatgatta

SEQ ID NO: 149562 - DNA, 25 bp, Homo sapien
ggcaggctttgcatgttgctcgacc

SEQ ID NO: 149563 - DNA, 25 bp, Homo sapien
tgtcccgcaaaaaggcgagccctta

SEQ ID NO: 149564 - DNA, 25 bp, Homo sapien
gtcatgcttcaggtttgccagggcc

SEQ ID NO: 149565 - DNA, 25 bp, Homo sapien
tgcgcttttcggtgagtcatgcttc

SEQ ID NO: 149566 - DNA, 25 bp, Homo sapien
ccagtcccggtgatcggaagttctc

SEQ ID NO: 149567 - DNA, 25 bp, Homo sapien
gctgagccttgacgttgtcccagtc

SEQ ID NO: 149568 - DNA, 25 bp, Homo sapien
ttcaggagcaatcgacccgaaggaa

SEQ ID NO: 149569 - DNA, 25 bp, Homo sapien
gggaggacacttcaggagcaatcga

SEQ ID NO: 149570 - DNA, 25 bp, Homo sapien
cccgaacgcagacgggaggacactt

SEQ ID NO: 149571 - DNA, 25 bp, Homo sapien
tcgctgtcgcccgaacgcagacggg

SEQ ID NO: 149572 - DNA, 25 bp, Homo sapien
ttccctccgcgctggacgggagcag

SEQ ID NO: 149573 - DNA, 25 bp, Homo sapien
tctgtcctcattgcgcccagacggg

SEQ ID NO: 149574 - DNA, 25 bp, Homo sapien
agagctcccgggtcgtctttcgtgt

SEQ ID NO: 149575 - DNA, 25 bp, Homo sapien
tcgacccgaaggaaaagcacgatcc

SEQ ID NO: 149576 - DNA, 25 bp, Homo sapien
cggaggccactggtctgttttcaga

SEQ ID NO: 149577 - DNA, 25 bp, Homo sapien
aactttcgccgctaggcctcttatg

SEQ ID NO: 149578 - DNA, 25 bp, Homo sapien
cttctcgggcggaaataaagtcttg

SEQ ID NO: 149579 - DNA, 25 bp, Homo sapien
tcagctcgggaaggctatatttagc

SEQ ID NO: 149580 - DNA, 25 bp, Homo sapien
tgggcaaccaagctcatgcgccgta

SEQ ID NO: 149581 - DNA, 25 bp, Homo sapien
gcagttctcgcgataccctgggatg

SEQ ID NO: 149582 - DNA, 25 bp, Homo sapien
acgcaatgtcagtttccgcggaaga

SEQ ID NO: 149583 - DNA, 25 bp, Homo sapien
ttgctccattccctacctgcagtgg

SEQ ID NO: 149584 - DNA, 25 bp, Homo sapien
ctcgcttacccatggctggagactg

SEQ ID NO: 149585 - DNA, 25 bp, Homo sapien
tgcaggcaaagctcgcggcttcctc

SEQ ID NO: 149586 - DNA, 25 bp, Homo sapien
aagtttgcaggtctcgcgggcacgt

SEQ ID NO: 149587 - DNA, 25 bp, Homo sapien
agcgtcccggcttcgtcgcagaggt

SEQ ID NO: 149588 - DNA, 25 bp, Homo sapien
gtttcgcgcgggcttaaggagaaca

SEQ ID NO: 149589 - DNA, 25 bp, Homo sapien
ccacaggatacaacagggaagcgca

SEQ ID NO: 149590 - DNA, 25 bp, Homo sapien
aaataaagcactagcccgggacgcg

SEQ ID NO: 149591 - DNA, 25 bp, Homo sapien
caggcaagaagcgactctctactgg

SEQ ID NO: 149592 - DNA, 25 bp, Homo sapien
agataagggtcgcttctgcaccgcc

SEQ ID NO: 149593 - DNA, 25 bp, Homo sapien
ttctgcaccggcgagataagggtcg

SEQ ID NO: 149594 - DNA, 25 bp, Homo sapien
ccggaagctgcctgctaatcggcta

SEQ ID NO: 149595 - DNA, 25 bp, Homo sapien
gcaggggcctagttttccttggaga

SEQ ID NO: 149596 - DNA, 25 bp, Homo sapien
tgcgcatcagaagaagccagggccc

SEQ ID NO: 149597 - DNA, 25 bp, Homo sapien
gacctcggctctctgcgcatcagaa

SEQ ID NO: 149598 - DNA, 25 bp, Homo sapien
taattatgagagcaacgtgacgtcc

SEQ ID NO: 149599 - DNA, 25 bp, Homo sapien
aacgtgacgtccaagacctcggctc

SEQ ID NO: 149600 - DNA, 25 bp, Homo sapien
gcctgcacggtcatcccagcaaatg

SEQ ID NO: 149601 - DNA, 25 bp, Homo sapien
gcgagacgggtgcagaaccagacaa

SEQ ID NO: 149602 - DNA, 25 bp, Homo sapien
accagacaaggaggaccctgctgca

SEQ ID NO: 149603 - DNA, 25 bp, Homo sapien
tgggcgtccgttcatcctggaaaga

SEQ ID NO: 149604 - DNA, 25 bp, Homo sapien
cctggaaagagcttccggaatttgc

SEQ ID NO: 149605 - DNA, 25 bp, Homo sapien
ccggaatttgccgtaggctgagttg

SEQ ID NO: 149606 - DNA, 25 bp, Homo sapien
tgatgatgaccctcacgtcggccgc

SEQ ID NO: 149607 - DNA, 25 bp, Homo sapien
taggctgagttgctgatgatgaccc

SEQ ID NO: 149608 - DNA, 25 bp, Homo sapien
ccagacgagaatcgaatgggaccta

SEQ ID NO: 149609 - DNA, 25 bp, Homo sapien
tgttgtgaaagcagagagcccgcga

SEQ ID NO: 149610 - DNA, 25 bp, Homo sapien
cgatacggtatccatctgctccaaa

SEQ ID NO: 149611 - DNA, 25 bp, Homo sapien
agacccaggcgtccgcattggattg

SEQ ID NO: 149612 - DNA, 25 bp, Homo sapien
cttctctgtctacctctgggcggga

SEQ ID NO: 149613 - DNA, 25 bp, Homo sapien
ggcgacggcgacaaccgcaatcaca

SEQ ID NO: 149614 - DNA, 25 bp, Homo sapien
catccacgacggtgatcatggcaga

SEQ ID NO: 149615 - DNA, 25 bp, Homo sapien
cctctgcgaagtcctgggaagggaa

SEQ ID NO: 149616 - DNA, 25 bp, Homo sapien
cccttaagcgcgagatgtaacgtca

SEQ ID NO: 149617 - DNA, 25 bp, Homo sapien
tgtttgtaatcagctgtgccacggc

SEQ ID NO: 149618 - DNA, 25 bp, Homo sapien
gcgcgcttgcttctgattggagaga

SEQ ID NO: 149619 - DNA, 25 bp, Homo sapien
cgtctcctagaagcggccgacggta

SEQ ID NO: 149620 - DNA, 25 bp, Homo sapien
tcacgtccgagagagacgctctgtc

SEQ ID NO: 149621 - DNA, 25 bp, Homo sapien
ctgttccgcagcaccaatctagggc

SEQ ID NO: 149622 - DNA, 25 bp, Homo sapien
actcaccggtgagttccatggccgc

SEQ ID NO: 149623 - DNA, 25 bp, Homo sapien
cctggtttcctggttacagcgtctc

SEQ ID NO: 149624 - DNA, 25 bp, Homo sapien
tgactttctgccacggttgctgggg

SEQ ID NO: 149625 - DNA, 25 bp, Homo sapien
ctggcaggacgcctctcttcgtgct

SEQ ID NO: 149626 - DNA, 25 bp, Homo sapien
agaccgtcgtgtgactttctgccac

SEQ ID NO: 149627 - DNA, 25 bp, Homo sapien
gcgaccagaccgtcgtgtgactttc

SEQ ID NO: 149628 - DNA, 25 bp, Homo sapien
cctccagcgtgtggcttcgtgcagc

SEQ ID NO: 149629 - DNA, 25 bp, Homo sapien
tccttgttgcatagccggcctccag

SEQ ID NO: 149630 - DNA, 25 bp, Homo sapien
gtccctgtccttgttgcatagccgg

SEQ ID NO: 149631 - DNA, 25 bp, Homo sapien
atgccacgtccagtctgagccattc

SEQ ID NO: 149632 - DNA, 25 bp, Homo sapien
ccgggaagagatgctcactcgggta

SEQ ID NO: 149633 - DNA, 25 bp, Homo sapien
ttaagagagtgtgggtccagtagcc

SEQ ID NO: 149634 - DNA, 25 bp, Homo sapien
ggtccagtagcctcaccgtgactca

SEQ ID NO: 149635 - DNA, 25 bp, Homo sapien
cctgcctctcgtgccgggaagagat

SEQ ID NO: 149636 - DNA, 25 bp, Homo sapien
cactcgggtaatttaggcggcactt

SEQ ID NO: 149637 - DNA, 25 bp, Homo sapien
atttaggcggcacttgctgtgctcc

SEQ ID NO: 149638 - DNA, 25 bp, Homo sapien
aggtgctctgatcggcgctccggtc

SEQ ID NO: 149639 - DNA, 25 bp, Homo sapien
tcgggaatgtcactccactctcgct

SEQ ID NO: 149640 - DNA, 25 bp, Homo sapien
cgggcagcgttgtctcaatccttcc

SEQ ID NO: 149641 - DNA, 25 bp, Homo sapien
tccgcatccggagagagatggtgcc

SEQ ID NO: 149642 - DNA, 25 bp, Homo sapien
agtggcccattcctttctgcccggg

SEQ ID NO: 149643 - DNA, 25 bp, Homo sapien
cctgtccgcagcctggtaaccatga

SEQ ID NO: 149644 - DNA, 25 bp, Homo sapien
ctgccgctgctgagcaacatcaggc

SEQ ID NO: 149645 - DNA, 25 bp, Homo sapien
catccgcgtcctgagagagatggtt

SEQ ID NO: 149646 - DNA, 25 bp, Homo sapien
atcaggcctgatttctctgaggctc

SEQ ID NO: 149647 - DNA, 25 bp, Homo sapien
tctgtgatgagaaacggagtggccc

SEQ ID NO: 149648 - DNA, 25 bp, Homo sapien
ggaactgtgccacttgccgcaaaca

SEQ ID NO: 149649 - DNA, 25 bp, Homo sapien
ccttgttgctctgaggggcgtaaca

SEQ ID NO: 149650 - DNA, 25 bp, Homo sapien
tagttggaacgcagagacgtgcctc

SEQ ID NO: 149651 - DNA, 25 bp, Homo sapien
tggcgtagtcgcaagggtgtaaaaa

SEQ ID NO: 149652 - DNA, 25 bp, Homo sapien
gcccttacgtgaaaggcgtggcgta

SEQ ID NO: 149653 - DNA, 25 bp, Homo sapien
gtggcccgaacgagctgactttagc

SEQ ID NO: 149654 - DNA, 25 bp, Homo sapien
gggtcttgcctgttccgagagaatg

SEQ ID NO: 149655 - DNA, 25 bp, Homo sapien
acaggagatgtgtagccagagcgca

SEQ ID NO: 149656 - DNA, 25 bp, Homo sapien
atcctgcgagtattgtctgggtccc

SEQ ID NO: 149657 - DNA, 25 bp, Homo sapien
agctgttgatcctgcgagtattgtc

SEQ ID NO: 149658 - DNA, 25 bp, Homo sapien
gagctaggagagctgttgatcctgc

SEQ ID NO: 149659 - DNA, 25 bp, Homo sapien
agggccgtgattcttcccacgactc

SEQ ID NO: 149660 - DNA, 25 bp, Homo sapien
cgaccagggacaggccgatccagac

SEQ ID NO: 149661 - DNA, 25 bp, Homo sapien
ggttcgtgatctggagagacgctca

SEQ ID NO: 149662 - DNA, 25 bp, Homo sapien
cgtagcttcgatggccggacgtgca

SEQ ID NO: 149663 - DNA, 25 bp, Homo sapien
ggccgatccagacagggccgtgatt

SEQ ID NO: 149664 - DNA, 25 bp, Homo sapien
ttccgtttcaagtcccacgctggtg

SEQ ID NO: 149665 - DNA, 25 bp, Homo sapien
ctctgtgcgcgatgtgacttcatga

SEQ ID NO: 149666 - DNA, 25 bp, Homo sapien
gtacgactttaaccgcctagccaca

SEQ ID NO: 149667 - DNA, 25 bp, Homo sapien
cacaacacgtcctgctagggcgagg

SEQ ID NO: 149668 - DNA, 25 bp, Homo sapien
agcgacaattacttctagggcgggg

SEQ ID NO: 149669 - DNA, 25 bp, Homo sapien
ctgcgcccgagaagatgacgtttcc

SEQ ID NO: 149670 - DNA, 25 bp, Homo sapien
caagctaagtgagccaccgcggcag

SEQ ID NO: 149671 - DNA, 25 bp, Homo sapien
ctgggcaagtgctgaagcgacaatt

SEQ ID NO: 149672 - DNA, 25 bp, Homo sapien
agccacgttcgagctctaatgattc

SEQ ID NO: 149673 - DNA, 25 bp, Homo sapien
tgctgcaactctggaaaaacaagtc

SEQ ID NO: 149674 - DNA, 25 bp, Homo sapien
gattcccgaaccacaggtgccgcga

SEQ ID NO: 149675 - DNA, 25 bp, Homo sapien
gttccggacagcgaagagccacgtt

SEQ ID NO: 149676 - DNA, 25 bp, Homo sapien
acgggattctgcagcgtccttagcc

SEQ ID NO: 149677 - DNA, 25 bp, Homo sapien
ttctgtggagctcgtcacgcattca

SEQ ID NO: 149678 - DNA, 25 bp, Homo sapien
aaggcagccgattggaggtttcttc

SEQ ID NO: 149679 - DNA, 25 bp, Homo sapien
ccgcaaaacttgaggcgattcccga

SEQ ID NO: 149680 - DNA, 25 bp, Homo sapien
tatgcgccctaaccatctagtacgg

SEQ ID NO: 149681 - DNA, 25 bp, Homo sapien
agtgcgcgggtgaactccacgcttc

SEQ ID NO: 149682 - DNA, 25 bp, Homo sapien
tcccgtggctcactttgcaaaggca

SEQ ID NO: 149683 - DNA, 25 bp, Homo sapien
gcgcctaaaaagtgattcctccagc

SEQ ID NO: 149684 - DNA, 25 bp, Homo sapien
tgcaatggtccaaaacaagcgccta

SEQ ID NO: 149685 - DNA, 25 bp, Homo sapien
cacccgggtttgtgcaatggtccaa

SEQ ID NO: 149686 - DNA, 25 bp, Homo sapien
aaggccatgttaccggcgctgatca

SEQ ID NO: 149687 - DNA, 25 bp, Homo sapien
gcgggacaggctccaaccgcactgg

SEQ ID NO: 149688 - DNA, 25 bp, Homo sapien
cgcagagtggagtcaaaggcaacca

SEQ ID NO: 149689 - DNA, 25 bp, Homo sapien
aggccaaagacttcggcagtgagtc

SEQ ID NO: 149690 - DNA, 25 bp, Homo sapien
gtgagtctaccctggctctgggacc

SEQ ID NO: 149691 - DNA, 25 bp, Homo sapien
acttccggacatctccctgggagtc

SEQ ID NO: 149692 - DNA, 25 bp, Homo sapien
aggcaaccagtgctcgctgcggtct

SEQ ID NO: 149693 - DNA, 25 bp, Homo sapien
tgcggtgttcctccgacttccggac

SEQ ID NO: 149694 - DNA, 25 bp, Homo sapien
aggagctcctccaccaggccaaaga

SEQ ID NO: 149695 - DNA, 25 bp, Homo sapien
ttgtcacaactgacgtcaccagggg

SEQ ID NO: 149696 - DNA, 25 bp, Homo sapien
tgttgtgaacctccaccatggagtc

SEQ ID NO: 149697 - DNA, 25 bp, Homo sapien
aacgctgcatttctggagctccgcc

SEQ ID NO: 149698 - DNA, 25 bp, Homo sapien
cacggagagtgaggatctgtctccc

SEQ ID NO: 149699 - DNA, 25 bp, Homo sapien
aaaccgccgcatcgagctcagcttt

SEQ ID NO: 149700 - DNA, 25 bp, Homo sapien
gccaccgctgcggttcacacgagga

SEQ ID NO: 149701 - DNA, 25 bp, Homo sapien
ttcacacgaggagacggggcatctc

SEQ ID NO: 149702 - DNA, 25 bp, Homo sapien
ggcacgaggtccaccttgttgtgaa

SEQ ID NO: 149703 - DNA, 25 bp, Homo sapien
ctgacgtccctcacgtgcaagatga

SEQ ID NO: 149704 - DNA, 25 bp, Homo sapien
acgagtaccttcctatagccagaca

SEQ ID NO: 149705 - DNA, 25 bp, Homo sapien
gtcccactaggatgcacacgaagca

SEQ ID NO: 149706 - DNA, 25 bp, Homo sapien
tctatctgcccttcggtcttgctga

SEQ ID NO: 149707 - DNA, 25 bp, Homo sapien
tgaagcccagcccagtattcaatgc

SEQ ID NO: 149708 - DNA, 25 bp, Homo sapien
cggtcacgtgggaagtctcacatgc

SEQ ID NO: 149709 - DNA, 25 bp, Homo sapien
ctggttacctatagccacgggacga

SEQ ID NO: 149710 - DNA, 25 bp, Homo sapien
cacgggacgaacatccggtcttctt

SEQ ID NO: 149711 - DNA, 25 bp, Homo sapien
tttccgcgaaagatcataacgagta

SEQ ID NO: 149712 - DNA, 25 bp, Homo sapien
gcccgccgtctggttgtgtctccag

SEQ ID NO: 149713 - DNA, 25 bp, Homo sapien
atcgggagggctcacttaagcatcc

SEQ ID NO: 149714 - DNA, 25 bp, Homo sapien
tgcgtgctcttccatcgcgggacag

SEQ ID NO: 149715 - DNA, 25 bp, Homo sapien
ttccatcgcgggacagaagacccga

SEQ ID NO: 149716 - DNA, 25 bp, Homo sapien
acagaagacccgactgctgccagca

SEQ ID NO: 149717 - DNA, 25 bp, Homo sapien
ctgctgccagcaccaaagggtgttc

SEQ ID NO: 149718 - DNA, 25 bp, Homo sapien
ccaaagggtgttcccacggcacacg

SEQ ID NO: 149719 - DNA, 25 bp, Homo sapien
ctcctcgtgcctcgggagcctggag

SEQ ID NO: 149720 - DNA, 25 bp, Homo sapien
tggaacgagacttttcaacccgcgc

SEQ ID NO: 149721 - DNA, 25 bp, Homo sapien
tcggactcctctcgttagccaagag

SEQ ID NO: 149722 - DNA, 25 bp, Homo sapien
cgcatccgccctgggaaaagtgaga

SEQ ID NO: 149723 - DNA, 25 bp, Homo sapien
tgccgccgcttagccaagcaaaatc

SEQ ID NO: 149724 - DNA, 25 bp, Homo sapien
gttctcgagagattactgtgccttc

SEQ ID NO: 149725 - DNA, 25 bp, Homo sapien
ctgtgccttcaaagtctccctgata

SEQ ID NO: 149726 - DNA, 25 bp, Homo sapien
ccctgataatcacggacatgcaatt

SEQ ID NO: 149727 - DNA, 25 bp, Homo sapien
cagggcctcttactctctttactcg

SEQ ID NO: 149728 - DNA, 25 bp, Homo sapien
aggcctcggccagttctgagagaga

SEQ ID NO: 149729 - DNA, 25 bp, Homo sapien
catctcaggctgtgattgggccgcg

SEQ ID NO: 149730 - DNA, 25 bp, Homo sapien
ccgagacgctgcaccaggtgggtcc

SEQ ID NO: 149731 - DNA, 25 bp, Homo sapien
tactccgagctcttcgcgcgctgtg

SEQ ID NO: 149732 - DNA, 25 bp, Homo sapien
cgcgctgggttagttacctggcgct

SEQ ID NO: 149733 - DNA, 25 bp, Homo sapien
gcagcagtgctactccgagctcttc

SEQ ID NO: 149734 - DNA, 25 bp, Homo sapien
tgaggcacaacattcaagcccgggg

SEQ ID NO: 149735 - DNA, 25 bp, Homo sapien
ccgcgcagctgaggcacaacattca

SEQ ID NO: 149736 - DNA, 25 bp, Homo sapien
agagagggtctgtccttcaccaccg

SEQ ID NO: 149737 - DNA, 25 bp, Homo sapien
gtgctgctcatgctggacctatgcg

SEQ ID NO: 149738 - DNA, 25 bp, Homo sapien
actcgctgtgacctcaggtgctgcc

SEQ ID NO: 149739 - DNA, 25 bp, Homo sapien
tccggttgcagcttgcaccttacta

SEQ ID NO: 149740 - DNA, 25 bp, Homo sapien
cttccaggagctcgagagcgacatc

SEQ ID NO: 149741 - DNA, 25 bp, Homo sapien
gagggttgcaactcctgtggtttcc

SEQ ID NO: 149742 - DNA, 25 bp, Homo sapien
gtagcccacaccatgcatgttcagg

SEQ ID NO: 149743 - DNA, 25 bp, Homo sapien
ctcagcacgcttgaccctaagcagg

SEQ ID NO: 149744 - DNA, 25 bp, Homo sapien
cagcaggggacggattatttttagc

SEQ ID NO: 149745 - DNA, 25 bp, Homo sapien
cttgtctaagctcacaggccgggct

SEQ ID NO: 149746 - DNA, 25 bp, Homo sapien
ttcccagtggtcaattaggtgtctc

SEQ ID NO: 149747 - DNA, 25 bp, Homo sapien
tcctcatcagaaggcagcatccatt

SEQ ID NO: 149748 - DNA, 25 bp, Homo sapien
ttcataattctctgcctgtggaccg

SEQ ID NO: 149749 - DNA, 25 bp, Homo sapien
tggactcctgcgatctctctttttg

SEQ ID NO: 149750 - DNA, 25 bp, Homo sapien
ggaatgcagtcctaacgcaacaatg

SEQ ID NO: 149751 - DNA, 25 bp, Homo sapien
agtcctctccattcactgagctgta

SEQ ID NO: 149752 - DNA, 25 bp, Homo sapien
ccttttgcggttgagacatagagtc

SEQ ID NO: 149753 - DNA, 25 bp, Homo sapien
tcggggacgacaggatccttttaca

SEQ ID NO: 149754 - DNA, 25 bp, Homo sapien
tcagtggccagactccgattggtca

SEQ ID NO: 149755 - DNA, 25 bp, Homo sapien
ctgcgagcagttttaccgcgacctc

SEQ ID NO: 149756 - DNA, 25 bp, Homo sapien
agcctccaatttcagccgcggtgtg

SEQ ID NO: 149757 - DNA, 25 bp, Homo sapien
ttccgtcacgggaatacacgatttg

SEQ ID NO: 149758 - DNA, 25 bp, Homo sapien
ctttccgaagcgtcgagtggcctaa

SEQ ID NO: 149759 - DNA, 25 bp, Homo sapien
cccgcgcgtgtaagcttttgagatt

SEQ ID NO: 149760 - DNA, 25 bp, Homo sapien
ctccgcagcaaaaggcgccactgaa

SEQ ID NO: 149761 - DNA, 25 bp, Homo sapien
gcgccactgaaacgcacgcaaaaat

SEQ ID NO: 149762 - DNA, 25 bp, Homo sapien
caaaaatgcagcgagaacgttgctc

SEQ ID NO: 149763 - DNA, 25 bp, Homo sapien
aacgttgctcggtgcctaacatggc

SEQ ID NO: 149764 - DNA, 25 bp, Homo sapien
taacatggcagaaagcccgagctgg

SEQ ID NO: 149765 - DNA, 25 bp, Homo sapien
gtcacaaagaggagcccggcgcaat

SEQ ID NO: 149766 - DNA, 25 bp, Homo sapien
ggcgcaatctggcaaaacccaactt

SEQ ID NO: 149767 - DNA, 25 bp, Homo sapien
gccaccgcggagagaagcaataact

SEQ ID NO: 149768 - DNA, 25 bp, Homo sapien
agctgggaccctactgcctcccggc

SEQ ID NO: 149769 - DNA, 25 bp, Homo sapien
aggagggacaggtgatctcgcccac

SEQ ID NO: 149770 - DNA, 25 bp, Homo sapien
ctttactatatacaccaaggggtgg

SEQ ID NO: 149771 - DNA, 25 bp, Homo sapien
ggcgcccggcctttactatatacac

SEQ ID NO: 149772 - DNA, 25 bp, Homo sapien
ctatatacaccaaggggtgggagga

SEQ ID NO: 149773 - DNA, 25 bp, Homo sapien
cctgtgtcctggcgagtgtgtgtct

SEQ ID NO: 149774 - DNA, 25 bp, Homo sapien
cggcgcccggcctttactatataca

SEQ ID NO: 149775 - DNA, 25 bp, Homo sapien
gcccggcctttactatatacaccaa

SEQ ID NO: 149776 - DNA, 25 bp, Homo sapien
aagtgcggccgcatagatctgtatc

SEQ ID NO: 149777 - DNA, 25 bp, Homo sapien
gcgccgagattgtttcccagccact

SEQ ID NO: 149778 - DNA, 25 bp, Homo sapien
ccggtcaatgactagccaatcctgc

SEQ ID NO: 149779 - DNA, 25 bp, Homo sapien
cggctctgaggtaactgcttggtaa

SEQ ID NO: 149780 - DNA, 25 bp, Homo sapien
gggtgccatccagactcttgacaga

SEQ ID NO: 149781 - DNA, 25 bp, Homo sapien
ccagttgaggcgaggtcactttacc

SEQ ID NO: 149782 - DNA, 25 bp, Homo sapien
ctgggtcctctctgacatcgtgaga

SEQ ID NO: 149783 - DNA, 25 bp, Homo sapien
gtggtaactgcgtacactcgttgtc

SEQ ID NO: 149784 - DNA, 25 bp, Homo sapien
gggaaagcccttggcactttgcctc

SEQ ID NO: 149785 - DNA, 25 bp, Homo sapien
gcggaccatgagacactgtgagccc

SEQ ID NO: 149786 - DNA, 25 bp, Homo sapien
cctccagtctcgtcggtgaaaacaa

SEQ ID NO: 149787 - DNA, 25 bp, Homo sapien
ctcagcccagaccaggcaaagtcta

SEQ ID NO: 149788 - DNA, 25 bp, Homo sapien
cgaagccgaactgagatgggacata

SEQ ID NO: 149789 - DNA, 25 bp, Homo sapien
gaaattctgtcccaccgatcgcgcg

SEQ ID NO: 149790 - DNA, 25 bp, Homo sapien
cttggcaccaggatttgcgcccgca

SEQ ID NO: 149791 - DNA, 25 bp, Homo sapien
gcgggataccctatcgcgaagccga

SEQ ID NO: 149792 - DNA, 25 bp, Homo sapien
cggtgttcatcgatcctcaggcatc

SEQ ID NO: 149793 - DNA, 25 bp, Homo sapien
gtgcacccgggaacacgcttatgtg

SEQ ID NO: 149794 - DNA, 25 bp, Homo sapien
ggactgacggccgacttcctatttc

SEQ ID NO: 149795 - DNA, 25 bp, Homo sapien
atcgcccgtcagtgccttgatcagc

SEQ ID NO: 149796 - DNA, 25 bp, Homo sapien
gccttgatcagcgtggtctttccta

SEQ ID NO: 149797 - DNA, 25 bp, Homo sapien
tgggacaaagccaccgtcgctgttc

SEQ ID NO: 149798 - DNA, 25 bp, Homo sapien
tgcccgcacgtctgtgacacgaacg

SEQ ID NO: 149799 - DNA, 25 bp, Homo sapien
tcctatttctacacgggctcacggc

SEQ ID NO: 149800 - DNA, 25 bp, Homo sapien
ttcgaaaaccagtgccggacgcagc

SEQ ID NO: 149801 - DNA, 25 bp, Homo sapien
ttcctcccttacagcaagagctagg

SEQ ID NO: 149802 - DNA, 25 bp, Homo sapien
gcccacgtctgtgctagaaaagcca

SEQ ID NO: 149803 - DNA, 25 bp, Homo sapien
ccaggcctctggaaaacgaacctcg

SEQ ID NO: 149804 - DNA, 25 bp, Homo sapien
ccagctcgggttcagtcctgactca

SEQ ID NO: 149805 - DNA, 25 bp, Homo sapien
gccggccaacaagaccaaggtcacg

SEQ ID NO: 149806 - DNA, 25 bp, Homo sapien
tccagaggactccacaggggaccga

SEQ ID NO: 149807 - DNA, 25 bp, Homo sapien
agggcctgcagggattcgaaaacca

SEQ ID NO: 149808 - DNA, 25 bp, Homo sapien
cgcaggcgagcttgtataaggaacc

SEQ ID NO: 149809 - DNA, 25 bp, Homo sapien
agcttctcctgagagtggagaccca

SEQ ID NO: 149810 - DNA, 25 bp, Homo sapien
ttcgattagttgtctctgccgctgg

SEQ ID NO: 149811 - DNA, 25 bp, Homo sapien
tgctttcccattggtccgaacgggc

SEQ ID NO: 149812 - DNA, 25 bp, Homo sapien
atcgggcaaaacctgaggtgctttc

SEQ ID NO: 149813 - DNA, 25 bp, Homo sapien
cctcattggctcctaccagaagggg

SEQ ID NO: 149814 - DNA, 25 bp, Homo sapien
ggacaagcgcttcctcctcattggc

SEQ ID NO: 149815 - DNA, 25 bp, Homo sapien
aaccagcgttcttcggcttcggaga

SEQ ID NO: 149816 - DNA, 25 bp, Homo sapien
agagcacctccctgctatcatctgt

SEQ ID NO: 149817 - DNA, 25 bp, Homo sapien
aactttccctcaatcgaggcgccgg

SEQ ID NO: 149818 - DNA, 25 bp, Homo sapien
gaagtgcaccctgctcgggctttgc

SEQ ID NO: 149819 - DNA, 25 bp, Homo sapien
ccattttcccaaccggcaaactgag

SEQ ID NO: 149820 - DNA, 25 bp, Homo sapien
cccacttgccggtcggaagtcagga

SEQ ID NO: 149821 - DNA, 25 bp, Homo sapien
aagtcaggacgtcgccgcttgcggc

SEQ ID NO: 149822 - DNA, 25 bp, Homo sapien
cgtggaaggcttcgcctccggagca

SEQ ID NO: 149823 - DNA, 25 bp, Homo sapien
cttcgcctccggagcaaggaggacg

SEQ ID NO: 149824 - DNA, 25 bp, Homo sapien
ccctctgagggccaagattgtagtc

SEQ ID NO: 149825 - DNA, 25 bp, Homo sapien
gtctccgccgcctagcggaactgga

SEQ ID NO: 149826 - DNA, 25 bp, Homo sapien
ggttcccggacactcacagccttag

SEQ ID NO: 149827 - DNA, 25 bp, Homo sapien
cagccttagtcggttcttgggatgg

SEQ ID NO: 149828 - DNA, 25 bp, Homo sapien
gaggtcgagacttttctaaacgcta

SEQ ID NO: 149829 - DNA, 25 bp, Homo sapien
caaagtccggttggaaagcaagcca

SEQ ID NO: 149830 - DNA, 25 bp, Homo sapien
gggaaccaggttgcctccctgagtc

SEQ ID NO: 149831 - DNA, 25 bp, Homo sapien
gagaaacaggcccttctgccgcggc

SEQ ID NO: 149832 - DNA, 25 bp, Homo sapien
cgaaggttttggagacgcgcgtctc

SEQ ID NO: 149833 - DNA, 25 bp, Homo sapien
ctcgtggctcagtttcccgcgggtt

SEQ ID NO: 149834 - DNA, 25 bp, Homo sapien
gagttggcgtctagcacaccacccg

SEQ ID NO: 149835 - DNA, 25 bp, Homo sapien
aatgcgctcactccgagaccacgag

SEQ ID NO: 149836 - DNA, 25 bp, Homo sapien
tgccgaaatgcgctcactccgagac

SEQ ID NO: 149837 - DNA, 25 bp, Homo sapien
aactcgagtccctgccgaaatgcgc

SEQ ID NO: 149838 - DNA, 25 bp, Homo sapien
gtttcggagcctcgaaactcgagtc

SEQ ID NO: 149839 - DNA, 25 bp, Homo sapien
gcgagtcaggctcgtggctcagttt

SEQ ID NO: 149840 - DNA, 25 bp, Homo sapien
cggtacccatatgcccgtttcagtg

SEQ ID NO: 149841 - DNA, 25 bp, Homo sapien
aggcactgcgggaccctcagatgcc

SEQ ID NO: 149842 - DNA, 25 bp, Homo sapien
atatgcccgtttcagtgtcgcacgc

SEQ ID NO: 149843 - DNA, 25 bp, Homo sapien
cccgtttcagtgtcgcacgctgtaa

SEQ ID NO: 149844 - DNA, 25 bp, Homo sapien
ttcagtgtcgcacgctgtaatgggt

SEQ ID NO: 149845 - DNA, 25 bp, Homo sapien
cagactcagcggctcacctttaggg

SEQ ID NO: 149846 - DNA, 25 bp, Homo sapien
agatgcccggcgtccagcccagcga

SEQ ID NO: 149847 - DNA, 25 bp, Homo sapien
tcagcggctcacctttagggctcgc

SEQ ID NO: 149848 - DNA, 25 bp, Homo sapien
ggcgcagcgcatgacgttattacga

SEQ ID NO: 149849 - DNA, 25 bp, Homo sapien
cgccactgcctgtgcttcatgagga

SEQ ID NO: 149850 - DNA, 25 bp, Homo sapien
ctctggcgctgatacccaatgggca

SEQ ID NO: 149851 - DNA, 25 bp, Homo sapien
agcggaatctaggaaggctcctttc

SEQ ID NO: 149852 - DNA, 25 bp, Homo sapien
ccggtagtcagcagagcggaatcta

SEQ ID NO: 149853 - DNA, 25 bp, Homo sapien
ttcatgaggaagatgctcgccgccg

SEQ ID NO: 149854 - DNA, 25 bp, Homo sapien
attacgactctgtcacgccgcggtg

SEQ ID NO: 149855 - DNA, 25 bp, Homo sapien
tcacgccaaggtccgtgtgaacttc

SEQ ID NO: 149856 - DNA, 25 bp, Homo sapien
ggagctctcactgcgcacgtatact

SEQ ID NO: 149857 - DNA, 25 bp, Homo sapien
gatccgctaggaggcacaagttaca

SEQ ID NO: 149858 - DNA, 25 bp, Homo sapien
ggctgcgatccgctaggaggcacaa

SEQ ID NO: 149859 - DNA, 25 bp, Homo sapien
gaagccgctctcacctgcgtcgtag

SEQ ID NO: 149860 - DNA, 25 bp, Homo sapien
tgcgcacgtatactgcccgcagagc

SEQ ID NO: 149861 - DNA, 25 bp, Homo sapien
gcacaagttacagcagccgcgcagg

SEQ ID NO: 149862 - DNA, 25 bp, Homo sapien
tctcacctgcgtcgtagaaggcgtc

SEQ ID NO: 149863 - DNA, 25 bp, Homo sapien
ctgcgtcgtagaaggcgtcgagcac

SEQ ID NO: 149864 - DNA, 25 bp, Homo sapien
cgcgagactcctcgagaccggagga

SEQ ID NO: 149865 - DNA, 25 bp, Homo sapien
tcaaggctgaagtggacgcccggac

SEQ ID NO: 149866 - DNA, 25 bp, Homo sapien
ggaagtgccgcgagactcctcgaga

SEQ ID NO: 149867 - DNA, 25 bp, Homo sapien
gggccaaacgcctgaccagggtgat

SEQ ID NO: 149868 - DNA, 25 bp, Homo sapien
tggccctggggcatcgaggcaatct

SEQ ID NO: 149869 - DNA, 25 bp, Homo sapien
tcgaggcaatctggaatgagttttc

SEQ ID NO: 149870 - DNA, 25 bp, Homo sapien
cgccgccctcaaggctgaagtggac

SEQ ID NO: 149871 - DNA, 25 bp, Homo sapien
gctgctgctgttgcatcgcggccca

SEQ ID NO: 149872 - DNA, 25 bp, Homo sapien
cgggcttctcggaccagagcgctgc

SEQ ID NO: 149873 - DNA, 25 bp, Homo sapien
cgacgttaacagaggaagatgccgc

SEQ ID NO: 149874 - DNA, 25 bp, Homo sapien
gaggagctgtcccaacagaacccga

SEQ ID NO: 149875 - DNA, 25 bp, Homo sapien
cctcttaacagatgcagggaaccgc

SEQ ID NO: 149876 - DNA, 25 bp, Homo sapien
ggagcgcctcaccaggacaaagcgg

SEQ ID NO: 149877 - DNA, 25 bp, Homo sapien
taacagaggaagatgccgctgcgcg

SEQ ID NO: 149878 - DNA, 25 bp, Homo sapien
ctgtcccaacagaacccgagtcgga

SEQ ID NO: 149879 - DNA, 25 bp, Homo sapien
atcctctactctcccggcgagggtg

SEQ ID NO: 149880 - DNA, 25 bp, Homo sapien
tgcgataagcgcaccggttaccacg

SEQ ID NO: 149881 - DNA, 25 bp, Homo sapien
tgcctctgccaatgggtgacacgcc

SEQ ID NO: 149882 - DNA, 25 bp, Homo sapien
ttcccagaacgcagagagagcgcgc

SEQ ID NO: 149883 - DNA, 25 bp, Homo sapien
gcccttggatgcacgtccggacgat

SEQ ID NO: 149884 - DNA, 25 bp, Homo sapien
aaagggcgtttatctcagctctgcg

SEQ ID NO: 149885 - DNA, 25 bp, Homo sapien
gttctgcgatcttccctgggagaga

SEQ ID NO: 149886 - DNA, 25 bp, Homo sapien
cgcgcttgtagcgtgtgcatgcaat

SEQ ID NO: 149887 - DNA, 25 bp, Homo sapien
cgcccgccacactctggggataata

SEQ ID NO: 149888 - DNA, 25 bp, Homo sapien
tggggggcagtcactcactcacttt

SEQ ID NO: 149889 - DNA, 25 bp, Homo sapien
ttgtagccgtactcctcatacttgc

SEQ ID NO: 149890 - DNA, 25 bp, Homo sapien
ctgagctgagcgttgtagccgtact

SEQ ID NO: 149891 - DNA, 25 bp, Homo sapien
atgctccgatcgagggagatgcggt

SEQ ID NO: 149892 - DNA, 25 bp, Homo sapien
ctcctggccgtcatcacgcagggtg

SEQ ID NO: 149893 - DNA, 25 bp, Homo sapien
gggcagtcacttccctggccagtgt

SEQ ID NO: 149894 - DNA, 25 bp, Homo sapien
ggggagcgctcactttcccggccag

SEQ ID NO: 149895 - DNA, 25 bp, Homo sapien
actcactttctgggccggtagtcgg

SEQ ID NO: 149896 - DNA, 25 bp, Homo sapien
ctgtcgtacggcaccactgagacga

SEQ ID NO: 149897 - DNA, 25 bp, Homo sapien
acgtgctcaccgcagctgtcgtacg

SEQ ID NO: 149898 - DNA, 25 bp, Homo sapien
gccagatcactacggaggcctccga

SEQ ID NO: 149899 - DNA, 25 bp, Homo sapien
ccaccacggagatcacggggaactc

SEQ ID NO: 149900 - DNA, 25 bp, Homo sapien
agcaggtgcctcttcttgcgaagcc

SEQ ID NO: 149901 - DNA, 25 bp, Homo sapien
gctgcagctgcatgaaggattctcc

SEQ ID NO: 149902 - DNA, 25 bp, Homo sapien
cgacacgtcctgttccatgagaaag

SEQ ID NO: 149903 - DNA, 25 bp, Homo sapien
tcggggagaaagtaaaggccagatc

SEQ ID NO: 149904 - DNA, 25 bp, Homo sapien
ctctgacttctttccgggtagcggc

SEQ ID NO: 149905 - DNA, 25 bp, Homo sapien
gcgtctcccggtttcacaagtggct

SEQ ID NO: 149906 - DNA, 25 bp, Homo sapien
ccaggctttatgacgcaggcgtggc

SEQ ID NO: 149907 - DNA, 25 bp, Homo sapien
ccgggcggcattacctttattcttg

SEQ ID NO: 149908 - DNA, 25 bp, Homo sapien
ctgggtgacctgcaatctacgggca

SEQ ID NO: 149909 - DNA, 25 bp, Homo sapien
aaagcccacattctcccgcaggagg

SEQ ID NO: 149910 - DNA, 25 bp, Homo sapien
cacaagtggctgactcgttaacctc

SEQ ID NO: 149911 - DNA, 25 bp, Homo sapien
tgctttgtagcaaacgcgcgtctcc

SEQ ID NO: 149912 - DNA, 25 bp, Homo sapien
tctgggcctcgcctactttcaggaa

SEQ ID NO: 149913 - DNA, 25 bp, Homo sapien
ttccgctcacaacatggcgcctaag

SEQ ID NO: 149914 - DNA, 25 bp, Homo sapien
ctgtctctcaaagcgaggctcggcc

SEQ ID NO: 149915 - DNA, 25 bp, Homo sapien
tcaccgccaagggtccaaggaggtc

SEQ ID NO: 149916 - DNA, 25 bp, Homo sapien
ggcgcatcccgtaatggcccaagac

SEQ ID NO: 149917 - DNA, 25 bp, Homo sapien
gtcacatgctgggaaatcacctgcc

SEQ ID NO: 149918 - DNA, 25 bp, Homo sapien
gctcggctcccggtttgattcaagt

SEQ ID NO: 149919 - DNA, 25 bp, Homo sapien
ggcgcctaagcgatacctgtctctc

SEQ ID NO: 149920 - DNA, 25 bp, Homo sapien
tcctgccggcggttggctaaaagac

SEQ ID NO: 149921 - DNA, 25 bp, Homo sapien
ctggatgaaaggtaatgcccgctgc

SEQ ID NO: 149922 - DNA, 25 bp, Homo sapien
atggctctgataatggaaccggtga

SEQ ID NO: 149923 - DNA, 25 bp, Homo sapien
tatgaactgaagctccctagggacg

SEQ ID NO: 149924 - DNA, 25 bp, Homo sapien
taaaagacgttacagccgcgagacc

SEQ ID NO: 149925 - DNA, 25 bp, Homo sapien
cggagccacgactcctgcacgttta

SEQ ID NO: 149926 - DNA, 25 bp, Homo sapien
ccgccttagcgggaactgagcagac

SEQ ID NO: 149927 - DNA, 25 bp, Homo sapien
agttcgttttgtgtctgagctctgc

SEQ ID NO: 149928 - DNA, 25 bp, Homo sapien
agagtgtcctctacagtgtccatgg

SEQ ID NO: 149929 - DNA, 25 bp, Homo sapien
agtaactcattctacccagggctgg

SEQ ID NO: 149930 - DNA, 25 bp, Homo sapien
cgcgccgccatgagctttgcagtaa

SEQ ID NO: 149931 - DNA, 25 bp, Homo sapien
cctgaagtagtcactggagcacgcc

SEQ ID NO: 149932 - DNA, 25 bp, Homo sapien
ccagggcctcagtgacctgcaggta

SEQ ID NO: 149933 - DNA, 25 bp, Homo sapien
ccctcagcgatgtagggttgagctc

SEQ ID NO: 149934 - DNA, 25 bp, Homo sapien
ctccagcaactctgtacagtgtgcc

SEQ ID NO: 149935 - DNA, 25 bp, Homo sapien
tcggtctccagtgtcacgtcgcaca

SEQ ID NO: 149936 - DNA, 25 bp, Homo sapien
cccgtgccatttccggtactagcaa

SEQ ID NO: 149937 - DNA, 25 bp, Homo sapien
agtgcaggcccttcagccttcgggt

SEQ ID NO: 149938 - DNA, 25 bp, Homo sapien
agtaaataaaacattgccggccgcg

SEQ ID NO: 149939 - DNA, 25 bp, Homo sapien
gagcgcaaggccttcttttctcttc

SEQ ID NO: 149940 - DNA, 25 bp, Homo sapien
gctggactgtcgtctacctgaccga

SEQ ID NO: 149941 - DNA, 25 bp, Homo sapien
ctgccgccatgattccggtgtcgct

SEQ ID NO: 149942 - DNA, 25 bp, Homo sapien
gtgggaaaccgtgccaccgcaagga

SEQ ID NO: 149943 - DNA, 25 bp, Homo sapien
agttcgaactactgcctggacggca

SEQ ID NO: 149944 - DNA, 25 bp, Homo sapien
tcacacaagacctggagatcccggc

SEQ ID NO: 149945 - DNA, 25 bp, Homo sapien
cccggcagatattgtggagctccac

SEQ ID NO: 149946 - DNA, 25 bp, Homo sapien
tgtggagctccacgacatcaatgtg

SEQ ID NO: 149947 - DNA, 25 bp, Homo sapien
ttcctatggaggacattccgacgga

SEQ ID NO: 149948 - DNA, 25 bp, Homo sapien
tggatctacggtggccacaaccatc

SEQ ID NO: 149949 - DNA, 25 bp, Homo sapien
cgccattgatggtgttgcagccgct

SEQ ID NO: 149950 - DNA, 25 bp, Homo sapien
tcttcacgaacacgggctatggcga

SEQ ID NO: 149951 - DNA, 25 bp, Homo sapien
ccatggcctccaacgaagatttctc

SEQ ID NO: 149952 - DNA, 25 bp, Homo sapien
tgatttcaatttgcgcacacacttg

SEQ ID NO: 149953 - DNA, 25 bp, Homo sapien
ggcccagagtccacgtatgtgcaga

SEQ ID NO: 149954 - DNA, 25 bp, Homo sapien
tgtgcagaatgtggcaaagcttttc

SEQ ID NO: 149955 - DNA, 25 bp, Homo sapien
ttgagagctcaaagctgagacgaca

SEQ ID NO: 149956 - DNA, 25 bp, Homo sapien
aagccctttcagtgcacattcgaag

SEQ ID NO: 149957 - DNA, 25 bp, Homo sapien
cacattcgaaggctgcgggaaacgc

SEQ ID NO: 149958 - DNA, 25 bp, Homo sapien
ttacgccgccatgagaaaacatctc

SEQ ID NO: 149959 - DNA, 25 bp, Homo sapien
gctgcgaaaagatgttccgggatta

SEQ ID NO: 149960 - DNA, 25 bp, Homo sapien
cgtttccaccattagcgaggcctca

SEQ ID NO: 149961 - DNA, 25 bp, Homo sapien
atggcacagggcctcgcctcactat

SEQ ID NO: 149962 - DNA, 25 bp, Homo sapien
tcgcctcactatggcagcagcacgg

SEQ ID NO: 149963 - DNA, 25 bp, Homo sapien
ggcacagcacgctcgacttcatgct

SEQ ID NO: 149964 - DNA, 25 bp, Homo sapien
tcgacttcatgctcggcgccaaagg

SEQ ID NO: 149965 - DNA, 25 bp, Homo sapien
tcttgcaggcgggtaaatttccctc

SEQ ID NO: 149966 - DNA, 25 bp, Homo sapien
acgcgcagcgcttgcagaattctca

SEQ ID NO: 149967 - DNA, 25 bp, Homo sapien
agccgactgcgtaggagacggatcc

SEQ ID NO: 149968 - DNA, 25 bp, Homo sapien
cgcttgcaggggcacaagtcaatga

SEQ ID NO: 149969 - DNA, 25 bp, Homo sapien
ctcagtcgcaaagagctgggttcgc

SEQ ID NO: 149970 - DNA, 25 bp, Homo sapien
gggttcgcagtatttcccaccgcca

SEQ ID NO: 149971 - DNA, 25 bp, Homo sapien
gggcatccaccctgtcatttagcac

SEQ ID NO: 149972 - DNA, 25 bp, Homo sapien
tggtttcccaaagcgcgtgccctcg

SEQ ID NO: 149973 - DNA, 25 bp, Homo sapien
tttccctccgcgatcatggtgaatc

SEQ ID NO: 149974 - DNA, 25 bp, Homo sapien
gcggcacctccacgagcagaaatta

SEQ ID NO: 149975 - DNA, 25 bp, Homo sapien
ttagcacctcggctacgcaatggtg

SEQ ID NO: 149976 - DNA, 25 bp, Homo sapien
ctgcctgtctctggaaactgatttt

SEQ ID NO: 149977 - DNA, 25 bp, Homo sapien
ttccagatggctgcctgatgcccag

SEQ ID NO: 149978 - DNA, 25 bp, Homo sapien
acctcatcatccgtggggctcaggc

SEQ ID NO: 149979 - DNA, 25 bp, Homo sapien
catggttccagatggctgcccaatg

SEQ ID NO: 149980 - DNA, 25 bp, Homo sapien
ccaatgcccggcgttctgaggtcag

SEQ ID NO: 149981 - DNA, 25 bp, Homo sapien
tctgaggtcagcaggaccctctttc

SEQ ID NO: 149982 - DNA, 25 bp, Homo sapien
ggaccctctttcttattcagactgg

SEQ ID NO: 149983 - DNA, 25 bp, Homo sapien
acagcagcttctaactcgagagaga

SEQ ID NO: 149984 - DNA, 25 bp, Homo sapien
tcggggccatttctttatttatctc

SEQ ID NO: 149985 - DNA, 25 bp, Homo sapien
cgtgatttccacgttcgagcgtctt

SEQ ID NO: 149986 - DNA, 25 bp, Homo sapien
accttttgagtggacgtgctccaga

SEQ ID NO: 149987 - DNA, 25 bp, Homo sapien
cagttccatcgactgaccgtcatta

SEQ ID NO: 149988 - DNA, 25 bp, Homo sapien
cagcctgctcctttaagcctctgga

SEQ ID NO: 149989 - DNA, 25 bp, Homo sapien
aattctccgtcctcgtgttcctggg

SEQ ID NO: 149990 - DNA, 25 bp, Homo sapien
tctggagcgaccctaaattagagcc

SEQ ID NO: 149991 - DNA, 25 bp, Homo sapien
actgggtgtagcctggaattctccg

SEQ ID NO: 149992 - DNA, 25 bp, Homo sapien
tccctgcacctaagcaaagcgaaga

SEQ ID NO: 149993 - DNA, 25 bp, Homo sapien
gagaccttgtcgctgccttcacaga

SEQ ID NO: 149994 - DNA, 25 bp, Homo sapien
ccttcacagagttgggcaacgctcc

SEQ ID NO: 149995 - DNA, 25 bp, Homo sapien
cgctcgcgccaagggacgtgtttct

SEQ ID NO: 149996 - DNA, 25 bp, Homo sapien
cttctacgcgggtggacaagtgtac

SEQ ID NO: 149997 - DNA, 25 bp, Homo sapien
caaagcgaagagtaggtggtgtccc

SEQ ID NO: 149998 - DNA, 25 bp, Homo sapien
ggagattccggagacacgtgtaccc

SEQ ID NO: 149999 - DNA, 25 bp, Homo sapien
ctcgcgaagaggagtgccacttcta

SEQ ID NO: 150000 - DNA, 25 bp, Homo sapien
taaaagacgcacgagtaccagaccg

SEQ ID NO: 150001 - DNA, 25 bp, Homo sapien
ggcctattctcggttgagtaaacga

SEQ ID NO: 150002 - DNA, 25 bp, Homo sapien
gctacagcgaggaccggcctattct

SEQ ID NO: 150003 - DNA, 25 bp, Homo sapien
ctcaatcagttgtgcgggtcgtgtt

SEQ ID NO: 150004 - DNA, 25 bp, Homo sapien
cagaccgcgcccttgctgaggacag

SEQ ID NO: 150005 - DNA, 25 bp, Homo sapien
cccgaagctctaggggaagacgatg

SEQ ID NO: 150006 - DNA, 25 bp, Homo sapien
atagagcccaaatgcccatgcgtgg

SEQ ID NO: 150007 - DNA, 25 bp, Homo sapien
tgcggagcttcccactcaatcagtt

SEQ ID NO: 150008 - DNA, 25 bp, Homo sapien
ccgagccgggccaatgttcaaatgc

SEQ ID NO: 150009 - DNA, 25 bp, Homo sapien
tgattcacgtcttgaggtctcggcc

SEQ ID NO: 150010 - DNA, 25 bp, Homo sapien
ccgtttcccagagtggggtgattca

SEQ ID NO: 150011 - DNA, 25 bp, Homo sapien
tgccgccgactgcagtgacatactg

SEQ ID NO: 150012 - DNA, 25 bp, Homo sapien
ctcccgggagacgaatgaggaacca

SEQ ID NO: 150013 - DNA, 25 bp, Homo sapien
gccgactggtgtttatccgtcactc

SEQ ID NO: 150014 - DNA, 25 bp, Homo sapien
ctcattggatgagaggtcccacctc

SEQ ID NO: 150015 - DNA, 25 bp, Homo sapien
gcggggcttctttgcgcttaaaagc

SEQ ID NO: 150016 - DNA, 25 bp, Homo sapien
tcggccacgcccactatagagaggt

SEQ ID NO: 150017 - DNA, 25 bp, Homo sapien
gaaactgtctttgcagcggcgactg

SEQ ID NO: 150018 - DNA, 25 bp, Homo sapien
atcacccggttctagaagccgcgtc

SEQ ID NO: 150019 - DNA, 25 bp, Homo sapien
tgcggcgaaggtttagttcaatcac

SEQ ID NO: 150020 - DNA, 25 bp, Homo sapien
tgatttctccaaccgcaagcaggca

SEQ ID NO: 150021 - DNA, 25 bp, Homo sapien
gtgacagctgtgactcgactccacg

SEQ ID NO: 150022 - DNA, 25 bp, Homo sapien
cccagtagaccagtgaatgaaccgc

SEQ ID NO: 150023 - DNA, 25 bp, Homo sapien
tgacggccgtactgcaaactcggtg

SEQ ID NO: 150024 - DNA, 25 bp, Homo sapien
cgctgtcgtcttgacgcggaaggcc

SEQ ID NO: 150025 - DNA, 25 bp, Homo sapien
ccctctggataagtcctgggaaaga

SEQ ID NO: 150026 - DNA, 25 bp, Homo sapien
aaaccagacagtcgggctccgcacg

SEQ ID NO: 150027 - DNA, 25 bp, Homo sapien
ggtcgagcgccaatgccgccatctt

SEQ ID NO: 150028 - DNA, 25 bp, Homo sapien
tccagcctctagtggacggcagtct

SEQ ID NO: 150029 - DNA, 25 bp, Homo sapien
ctgggaaagaagacagcgctgagtc

SEQ ID NO: 150030 - DNA, 25 bp, Homo sapien
acggcagtctgcatcaggaagaacc

SEQ ID NO: 150031 - DNA, 25 bp, Homo sapien
caggctcctcggacgtctacgagca

SEQ ID NO: 150032 - DNA, 25 bp, Homo sapien
ttcctcttttggcaacatggcgggc

SEQ ID NO: 150033 - DNA, 25 bp, Homo sapien
gtgactctagggcagccgcatcttt

SEQ ID NO: 150034 - DNA, 25 bp, Homo sapien
gttttccactcagcctaccgacagg

SEQ ID NO: 150035 - DNA, 25 bp, Homo sapien
gctccagcaacttcgcaccgtgttt

SEQ ID NO: 150036 - DNA, 25 bp, Homo sapien
ggctgccctcagtattgcctgcaca

SEQ ID NO: 150037 - DNA, 25 bp, Homo sapien
ctccacaggaaacggaaatggtctc

SEQ ID NO: 150038 - DNA, 25 bp, Homo sapien
cccgagccgatctcgctttattaaa

SEQ ID NO: 150039 - DNA, 25 bp, Homo sapien
taccaggtctgcgacgaatagctcc

SEQ ID NO: 150040 - DNA, 25 bp, Homo sapien
ttcgctatgtaaatatcggtgaggg

SEQ ID NO: 150041 - DNA, 25 bp, Homo sapien
ggccgggccgattttcgctatgtaa

SEQ ID NO: 150042 - DNA, 25 bp, Homo sapien
gccattgcccttgccgccatgatga

SEQ ID NO: 150043 - DNA, 25 bp, Homo sapien
gaaaattccgctacagcccgtgagg

SEQ ID NO: 150044 - DNA, 25 bp, Homo sapien
gccgccatgatgagcgctcgggctc

SEQ ID NO: 150045 - DNA, 25 bp, Homo sapien
cgtgactggctgcagtttccgctgc

SEQ ID NO: 150046 - DNA, 25 bp, Homo sapien
ttccgctgcgtttcagctgagctgc

SEQ ID NO: 150047 - DNA, 25 bp, Homo sapien
cgtttcagctgagctgccgcaggcg

SEQ ID NO: 150048 - DNA, 25 bp, Homo sapien
gaggctcactcgctgcacttccggg

SEQ ID NO: 150049 - DNA, 25 bp, Homo sapien
acctgaggggtgattgtcgtggcct

SEQ ID NO: 150050 - DNA, 25 bp, Homo sapien
cctgggcttcgcgtctctgagtgct

SEQ ID NO: 150051 - DNA, 25 bp, Homo sapien
cgcgtctctgagtgctgcaccggaa

SEQ ID NO: 150052 - DNA, 25 bp, Homo sapien
ctgagtgctgcaccggaaatgaacg

SEQ ID NO: 150053 - DNA, 25 bp, Homo sapien
agtgctgcaccggaaatgaacggga

SEQ ID NO: 150054 - DNA, 25 bp, Homo sapien
cgcacttgccgcacaccgcagattc

SEQ ID NO: 150055 - DNA, 25 bp, Homo sapien
gggtcagctactgcgcgccgtctgc

SEQ ID NO: 150056 - DNA, 25 bp, Homo sapien
caatctgtttgagggtttctgaaaa

SEQ ID NO: 150057 - DNA, 25 bp, Homo sapien
ctgaaaacatcggtacctgaggggt

SEQ ID NO: 150058 - DNA, 25 bp, Homo sapien
ccaatctgtttgagggtttctgaaa

SEQ ID NO: 150059 - DNA, 25 bp, Homo sapien
ccagggaagcgctacccaatctgtt

SEQ ID NO: 150060 - DNA, 25 bp, Homo sapien
ttctgaaaacatcggtacctgaggg

SEQ ID NO: 150061 - DNA, 25 bp, Homo sapien
acccaatctgtttgagggtttctga

SEQ ID NO: 150062 - DNA, 25 bp, Homo sapien
agggaagcgctacccaatctgtttg

SEQ ID NO: 150063 - DNA, 25 bp, Homo sapien
cagggaagcgctacccaatctgttt

SEQ ID NO: 150064 - DNA, 25 bp, Homo sapien
cgccaggagttgttttgctcacacg

SEQ ID NO: 150065 - DNA, 25 bp, Homo sapien
gcgtcccgcctaggtgagctccgga

SEQ ID NO: 150066 - DNA, 25 bp, Homo sapien
ctgcaggaatgcaaggcgggtaacc

SEQ ID NO: 150067 - DNA, 25 bp, Homo sapien
atgcaaggcgggtaaccttcaaagc

SEQ ID NO: 150068 - DNA, 25 bp, Homo sapien
acgtccggtttgaaccgcacatatg

SEQ ID NO: 150069 - DNA, 25 bp, Homo sapien
ccgcacatatgctagggtggagagt

SEQ ID NO: 150070 - DNA, 25 bp, Homo sapien
cgaatgcaaagagaggctagcgttg

SEQ ID NO: 150071 - DNA, 25 bp, Homo sapien
cccttgggcttccactgcaggaatg

SEQ ID NO: 150072 - DNA, 25 bp, Homo sapien
caggaggctagagatgcaggagccc

SEQ ID NO: 150073 - DNA, 25 bp, Homo sapien
tgcagcgagtgcacatgcgcataga

SEQ ID NO: 150074 - DNA, 25 bp, Homo sapien
agtgcacatgcgcatagacggggcc

SEQ ID NO: 150075 - DNA, 25 bp, Homo sapien
acatgcgcatagacggggcccagga

SEQ ID NO: 150076 - DNA, 25 bp, Homo sapien
cagaacctgcggtgcagcgagtgca

SEQ ID NO: 150077 - DNA, 25 bp, Homo sapien
ccggtgtagcatgcagagacgtgaa

SEQ ID NO: 150078 - DNA, 25 bp, Homo sapien
tcgcttccggtgtagcatgcagaga

SEQ ID NO: 150079 - DNA, 25 bp, Homo sapien
tcccgttcgcttccggtgtagcatg

SEQ ID NO: 150080 - DNA, 25 bp, Homo sapien
attgcaggaccctcatcgcaggcga

SEQ ID NO: 150081 - DNA, 25 bp, Homo sapien
cagaaacggcgtctcattgcaggac

SEQ ID NO: 150082 - DNA, 25 bp, Homo sapien
ccagcctgggacttacccggagaca

SEQ ID NO: 150083 - DNA, 25 bp, Homo sapien
cggatctccgcagcttcggggtaaa

SEQ ID NO: 150084 - DNA, 25 bp, Homo sapien
aaacgtgccctatccgtgcggcttg

SEQ ID NO: 150085 - DNA, 25 bp, Homo sapien
gtgcgcgcttcgcaaacgtgcccta

SEQ ID NO: 150086 - DNA, 25 bp, Homo sapien
gcgcccggacaaaacacaaacgtca

SEQ ID NO: 150087 - DNA, 25 bp, Homo sapien
tcggctacctttcggcagcggagaa

SEQ ID NO: 150088 - DNA, 25 bp, Homo sapien
cacacccgggtttgtttgggcgcag

SEQ ID NO: 150089 - DNA, 25 bp, Homo sapien
tgtgcacggcgacgactgtgagata

SEQ ID NO: 150090 - DNA, 25 bp, Homo sapien
tgattggctttcaggctggcgcctg

SEQ ID NO: 150091 - DNA, 25 bp, Homo sapien
taaggggtcatcacagggcgccaaa

SEQ ID NO: 150092 - DNA, 25 bp, Homo sapien
tcagctctagcttttccctaagggg

SEQ ID NO: 150093 - DNA, 25 bp, Homo sapien
tttcccatcagcatgcgtgcgcttg

SEQ ID NO: 150094 - DNA, 25 bp, Homo sapien
tctgagaaccagagcgccctttctc

SEQ ID NO: 150095 - DNA, 25 bp, Homo sapien
ggctctggggaaaacgatccaacca

SEQ ID NO: 150096 - DNA, 25 bp, Homo sapien
gagcgtgacacttctccactagata

SEQ ID NO: 150097 - DNA, 25 bp, Homo sapien
catgcccgcatccagactgctgtga

SEQ ID NO: 150098 - DNA, 25 bp, Homo sapien
tttacttcaatatcaggcgtctggg

SEQ ID NO: 150099 - DNA, 25 bp, Homo sapien
gagatcaacttcgagcgccaaaatg

SEQ ID NO: 150100 - DNA, 25 bp, Homo sapien
tacaggctcgcatttgcttcccggg

SEQ ID NO: 150101 - DNA, 25 bp, Homo sapien
gtttcggaagcctctacagttaata

SEQ ID NO: 150102 - DNA, 25 bp, Homo sapien
tcagcgcctgtatggagcattcaca

SEQ ID NO: 150103 - DNA, 25 bp, Homo sapien
ccacgctgagtgcaattgcgttata

SEQ ID NO: 150104 - DNA, 25 bp, Homo sapien
tgtcggaacactgccgctccgagga

SEQ ID NO: 150105 - DNA, 25 bp, Homo sapien
ccgtcccttcccttggcgcgctgcg

SEQ ID NO: 150106 - DNA, 25 bp, Homo sapien
actgccgctccgaggaaagtgctca

SEQ ID NO: 150107 - DNA, 25 bp, Homo sapien
agctgggtgtcggaacactgccgct

SEQ ID NO: 150108 - DNA, 25 bp, Homo sapien
ccgaatgccgggctgatgaaagctg

SEQ ID NO: 150109 - DNA, 25 bp, Homo sapien
tacctgccgaatgccgggctgatga

SEQ ID NO: 150110 - DNA, 25 bp, Homo sapien
cgaggctgcgcgttacctgccgaat

SEQ ID NO: 150111 - DNA, 25 bp, Homo sapien
agcggcagtccaagcggagtcgagc

SEQ ID NO: 150112 - DNA, 25 bp, Homo sapien
ccacagagtccaggagccaagcgtc

SEQ ID NO: 150113 - DNA, 25 bp, Homo sapien
cccgttctcgcggtacgacttgctg

SEQ ID NO: 150114 - DNA, 25 bp, Homo sapien
accctacgcgcatacctggtgaaga

SEQ ID NO: 150115 - DNA, 25 bp, Homo sapien
agacgtccgggtagtgcgtcttctg

SEQ ID NO: 150116 - DNA, 25 bp, Homo sapien
ctccagttcctccagctggtagctg

SEQ ID NO: 150117 - DNA, 25 bp, Homo sapien
cggtagcgcctctgtttgcgtttca

SEQ ID NO: 150118 - DNA, 25 bp, Homo sapien
acattaaactgcaacgaccttggga

SEQ ID NO: 150119 - DNA, 25 bp, Homo sapien
cgcctggctgatcttgagcgtgtcc

SEQ ID NO: 150120 - DNA, 25 bp, Homo sapien
ggagtctctctcctccacgtgctga

SEQ ID NO: 150121 - DNA, 25 bp, Homo sapien
tatcttcaccctgagcccgactgtg

SEQ ID NO: 150122 - DNA, 25 bp, Homo sapien
cccgactgtgtctctcttgtttgta

SEQ ID NO: 150123 - DNA, 25 bp, Homo sapien
ggcccaaggcattgcgctgtctatc

SEQ ID NO: 150124 - DNA, 25 bp, Homo sapien
gttcagactcactcggcacttttca

SEQ ID NO: 150125 - DNA, 25 bp, Homo sapien
ctcctcctggtactgattgctcatg

SEQ ID NO: 150126 - DNA, 25 bp, Homo sapien
ttacttttgcactcgggcctctcgg

SEQ ID NO: 150127 - DNA, 25 bp, Homo sapien
gttcgcttttctcttgcggcccaag

SEQ ID NO: 150128 - DNA, 25 bp, Homo sapien
ctgccgggtggctcagtgacttcag

SEQ ID NO: 150129 - DNA, 25 bp, Homo sapien
tttaaactaacattctgcgcgctga

SEQ ID NO: 150130 - DNA, 25 bp, Homo sapien
cgaaagcccattccaggcgcgcggg

SEQ ID NO: 150131 - DNA, 25 bp, Homo sapien
ggtctcatcgcagccaagaggagta

SEQ ID NO: 150132 - DNA, 25 bp, Homo sapien
gccaagaggagtaaagacacttcgg

SEQ ID NO: 150133 - DNA, 25 bp, Homo sapien
cgttggaaatccacaagacccggct

SEQ ID NO: 150134 - DNA, 25 bp, Homo sapien
gtgacttcagagtcggctccgcaca

SEQ ID NO: 150135 - DNA, 25 bp, Homo sapien
tgggagagacggaggcacttttccc

SEQ ID NO: 150136 - DNA, 25 bp, Homo sapien
agatgcagcgggctacccaacgcgt

SEQ ID NO: 150137 - DNA, 25 bp, Homo sapien
ccggtgcagcgttgactcagtagct

SEQ ID NO: 150138 - DNA, 25 bp, Homo sapien
ctagagtaagatgcagcgggctacc

SEQ ID NO: 150139 - DNA, 25 bp, Homo sapien
cagattggagctagagtaagatgca

SEQ ID NO: 150140 - DNA, 25 bp, Homo sapien
tgggcacagattggagctagagtaa

SEQ ID NO: 150141 - DNA, 25 bp, Homo sapien
gtgcagcgttgactcagtagctgct

SEQ ID NO: 150142 - DNA, 25 bp, Homo sapien
cgggctacccaacgcgtgtgtcaat

SEQ ID NO: 150143 - DNA, 25 bp, Homo sapien
cccaacgcgtgtgtcaattcccagg

SEQ ID NO: 150144 - DNA, 25 bp, Homo sapien
cggcctccggaacagggagagcctc

SEQ ID NO: 150145 - DNA, 25 bp, Homo sapien
cctccgaacagggagagcctccgaa

SEQ ID NO: 150146 - DNA, 25 bp, Homo sapien
tccgaacagggagagcctccgaaca

SEQ ID NO: 150147 - DNA, 25 bp, Homo sapien
ccggaacagggagagcctccgaaca

SEQ ID NO: 150148 - DNA, 25 bp, Homo sapien
tccgaacagggacggcctccgaaca

SEQ ID NO: 150149 - DNA, 25 bp, Homo sapien
gcctccggaacagggagagcctcca

SEQ ID NO: 150150 - DNA, 25 bp, Homo sapien
agcctctgaacagggacggcctccg

SEQ ID NO: 150151 - DNA, 25 bp, Homo sapien
ccgaacagggacggcctccgaacag

SEQ ID NO: 150152 - DNA, 25 bp, Homo sapien
cgggtgaatgaggacgctggactta

SEQ ID NO: 150153 - DNA, 25 bp, Homo sapien
ctcgatcgcgcctcgaaaatgaccg

SEQ ID NO: 150154 - DNA, 25 bp, Homo sapien
ggcactcacggcctaggggcctcgt

SEQ ID NO: 150155 - DNA, 25 bp, Homo sapien
ggcctgttcggcaccgacggcgtca

SEQ ID NO: 150156 - DNA, 25 bp, Homo sapien
ctcagggcaccgcttgcccgaggcg

SEQ ID NO: 150157 - DNA, 25 bp, Homo sapien
gtcaaatcgcctccagggtctcggg

SEQ ID NO: 150158 - DNA, 25 bp, Homo sapien
gcacagactcgatcgcgcctcgaaa

SEQ ID NO: 150159 - DNA, 25 bp, Homo sapien
ttgtcaaatcgcctccagggtctcg

SEQ ID NO: 150160 - DNA, 25 bp, Homo sapien
ctgggccctctggagccggcaaatg

SEQ ID NO: 150161 - DNA, 25 bp, Homo sapien
tcaccatggggcaggtcgacgcctt

SEQ ID NO: 150162 - DNA, 25 bp, Homo sapien
cagtggctgccttcaccatggggca

SEQ ID NO: 150163 - DNA, 25 bp, Homo sapien
aggaggctaggtcctcaaatcggcc

SEQ ID NO: 150164 - DNA, 25 bp, Homo sapien
tgattctctcagagcagctgctcgg

SEQ ID NO: 150165 - DNA, 25 bp, Homo sapien
ggctccatggattgattctctcaga

SEQ ID NO: 150166 - DNA, 25 bp, Homo sapien
taaggcccagctgaccgccatgcgt

SEQ ID NO: 150167 - DNA, 25 bp, Homo sapien
ctctggagccggcaaatgcaggact

SEQ ID NO: 150168 - DNA, 25 bp, Homo sapien
cacctcgggcgggacctttagatat

SEQ ID NO: 150169 - DNA, 25 bp, Homo sapien
gctgtcgctctatgcgcgctgcacg

SEQ ID NO: 150170 - DNA, 25 bp, Homo sapien
tggcttagtgctgtcgctctatgcg

SEQ ID NO: 150171 - DNA, 25 bp, Homo sapien
gcctggcttagtgctgtcgctctat

SEQ ID NO: 150172 - DNA, 25 bp, Homo sapien
ctcgcgctctgcctggcttagtgct

SEQ ID NO: 150173 - DNA, 25 bp, Homo sapien
tagtgctgtcgctctatgcgcgctg

SEQ ID NO: 150174 - DNA, 25 bp, Homo sapien
gcgggacctttagatatggagagta

SEQ ID NO: 150175 - DNA, 25 bp, Homo sapien
cctttagatatggagagtacttggg

SEQ ID NO: 150176 - DNA, 25 bp, Homo sapien
tcatcctcatttcccttttgaaggc

SEQ ID NO: 150177 - DNA, 25 bp, Homo sapien
cgctagaacagttacgtccagaagc

SEQ ID NO: 150178 - DNA, 25 bp, Homo sapien
tcatcctgacttccgctttgaaggc

SEQ ID NO: 150179 - DNA, 25 bp, Homo sapien
tccgcctggcggatttgggtcagca

SEQ ID NO: 150180 - DNA, 25 bp, Homo sapien
ggaagtcgtcccaggctgctagata

SEQ ID NO: 150181 - DNA, 25 bp, Homo sapien
cccaggctgctagatactaaggtga

SEQ ID NO: 150182 - DNA, 25 bp, Homo sapien
cactagaacagtgacgtcccgtagc

SEQ ID NO: 150183 - DNA, 25 bp, Homo sapien
tgggctgccggatgtggctcatcct

SEQ ID NO: 150184 - DNA, 25 bp, Homo sapien
gaccacctgtggactcttgagcgcc

SEQ ID NO: 150185 - DNA, 25 bp, Homo sapien
aagcgcagcgtcttcaacaggcccg

SEQ ID NO: 150186 - DNA, 25 bp, Homo sapien
cctatttatacctagcgcgcacgca

SEQ ID NO: 150187 - DNA, 25 bp, Homo sapien
tgccgcgtacgtttgctttgcgctc

SEQ ID NO: 150188 - DNA, 25 bp, Homo sapien
ctgcctcctgggacctatttatacc

SEQ ID NO: 150189 - DNA, 25 bp, Homo sapien
gcttcgcgctcataagcatgttgta

SEQ ID NO: 150190 - DNA, 25 bp, Homo sapien
tttgcgctcgtcagcatgctgtaga

SEQ ID NO: 150191 - DNA, 25 bp, Homo sapien
agccgcctgcgcttgatttgtgctc

SEQ ID NO: 150192 - DNA, 25 bp, Homo sapien
ggcaccagttcgacgcgctttttgg

SEQ ID NO: 150193 - DNA, 25 bp, Homo sapien
taggtccacacagcgactcacgtcg

SEQ ID NO: 150194 - DNA, 25 bp, Homo sapien
attacgattaccaggggccagatgc

SEQ ID NO: 150195 - DNA, 25 bp, Homo sapien
cccactggagggaacaagcagttct

SEQ ID NO: 150196 - DNA, 25 bp, Homo sapien
gaagtgcgctcttttcgccggccag

SEQ ID NO: 150197 - DNA, 25 bp, Homo sapien
tgccaaagggcagtactcgtctccg

SEQ ID NO: 150198 - DNA, 25 bp, Homo sapien
gcgccttctgcctgaatggtcgata

SEQ ID NO: 150199 - DNA, 25 bp, Homo sapien
tgtccctgaaaagcttgcaacggtg

SEQ ID NO: 150200 - DNA, 25 bp, Homo sapien
accgtctcaggcacagggtcactgg

SEQ ID NO: 150201 - DNA, 25 bp, Homo sapien
gggaccaaggccaatcaagtcgaca

SEQ ID NO: 150202 - DNA, 25 bp, Homo sapien
tgggcagtaccagttaccgaagaag

SEQ ID NO: 150203 - DNA, 25 bp, Homo sapien
ctgagcaaacgcttcccatatcgga

SEQ ID NO: 150204 - DNA, 25 bp, Homo sapien
aagctctggcttcagggcttccgtc

SEQ ID NO: 150205 - DNA, 25 bp, Homo sapien
cgaagaagttactgcgcctgcgtgc

SEQ ID NO: 150206 - DNA, 25 bp, Homo sapien
tcctagatccggtctgagcgagagc

SEQ ID NO: 150207 - DNA, 25 bp, Homo sapien
aggcccgcctcgtatttcctagatc

SEQ ID NO: 150208 - DNA, 25 bp, Homo sapien
caagcgctgacttccgtcggaaatc

SEQ ID NO: 150209 - DNA, 25 bp, Homo sapien
aggaagtagcggaagaagttctcca

SEQ ID NO: 150210 - DNA, 25 bp, Homo sapien
cagcagctgaggtgacaagaatggc

SEQ ID NO: 150211 - DNA, 25 bp, Homo sapien
cccggttgaagtagaaggccataga

SEQ ID NO: 150212 - DNA, 25 bp, Homo sapien
aggccatagacaggtacaggtagga

SEQ ID NO: 150213 - DNA, 25 bp, Homo sapien
tgtagagctccagcgtgatgtggct

SEQ ID NO: 150214 - DNA, 25 bp, Homo sapien
ggtgtcgtacttctggcgcacctgc

SEQ ID NO: 150215 - DNA, 25 bp, Homo sapien
gcgtcgcagttggtgtcgtacttct

SEQ ID NO: 150216 - DNA, 25 bp, Homo sapien
tgctcgcgccacaagtgcacggatt

SEQ ID NO: 150217 - DNA, 25 bp, Homo sapien
agtgcacggattgcggccatcagac

SEQ ID NO: 150218 - DNA, 25 bp, Homo sapien
ttccctcatggctgcaagggctccg

SEQ ID NO: 150219 - DNA, 25 bp, Homo sapien
gccgcgcctgtccaagttttgaccg

SEQ ID NO: 150220 - DNA, 25 bp, Homo sapien
aatcagctttttctctccgagcccg

SEQ ID NO: 150221 - DNA, 25 bp, Homo sapien
gacgatttaggaacagccagccttg

SEQ ID NO: 150222 - DNA, 25 bp, Homo sapien
cccttccttctacgagtaagagcga

SEQ ID NO: 150223 - DNA, 25 bp, Homo sapien
gggccgcgatccacttaccctttga

SEQ ID NO: 150224 - DNA, 25 bp, Homo sapien
aatcgcccagacacaccctcgcctg

SEQ ID NO: 150225 - DNA, 25 bp, Homo sapien
cgcctgggcacaccctcacccgggc

SEQ ID NO: 150226 - DNA, 25 bp, Homo sapien
tcacccgggcacagaatcgcccaga

SEQ ID NO: 150227 - DNA, 25 bp, Homo sapien
acagcctcacccgggcacaccctca

SEQ ID NO: 150228 - DNA, 25 bp, Homo sapien
acaccctcgcctgggcacaccctca

SEQ ID NO: 150229 - DNA, 25 bp, Homo sapien
tcgcctgggcacaccctcacccggg

SEQ ID NO: 150230 - DNA, 25 bp, Homo sapien
acccgggcacagaatcgcccagaca

SEQ ID NO: 150231 - DNA, 25 bp, Homo sapien
gaatcgcccagacacaccctcgcct

SEQ ID NO: 150232 - DNA, 25 bp, Homo sapien
ggggagcttgaaaacgcagaaacac

SEQ ID NO: 150233 - DNA, 25 bp, Homo sapien
tgtgtctgaggatggattttccctc

SEQ ID NO: 150234 - DNA, 25 bp, Homo sapien
gacaccttagcgtgggttggttgaa

SEQ ID NO: 150235 - DNA, 25 bp, Homo sapien
cggtccgtttgatgctctccacagc

SEQ ID NO: 150236 - DNA, 25 bp, Homo sapien
tgtgccataaccaaacgccacgtgc

SEQ ID NO: 150237 - DNA, 25 bp, Homo sapien
ctcagcggcattttctggggtctcc

SEQ ID NO: 150238 - DNA, 25 bp, Homo sapien
cggcttttgatgacgtcggtgaatc

SEQ ID NO: 150239 - DNA, 25 bp, Homo sapien
tctcgctgaggatctagtgtgtctg

SEQ ID NO: 150240 - DNA, 25 bp, Homo sapien
tgcgagtggagactggacctccgac

SEQ ID NO: 150241 - DNA, 25 bp, Homo sapien
ctccgacgtgtcttgggatgttccg

SEQ ID NO: 150242 - DNA, 25 bp, Homo sapien
acctccgacgtgtcttgggatgttc

SEQ ID NO: 150243 - DNA, 25 bp, Homo sapien
agtggagactggacctccgacgtgt

SEQ ID NO: 150244 - DNA, 25 bp, Homo sapien
cgagactggacgtccgacgagtctt

SEQ ID NO: 150245 - DNA, 25 bp, Homo sapien
gaccgagactggacgtccgacgagt

SEQ ID NO: 150246 - DNA, 25 bp, Homo sapien
ctccggaccgagactggacgtccga

SEQ ID NO: 150247 - DNA, 25 bp, Homo sapien
ctggacctccgacgtgtcttgggat

SEQ ID NO: 150248 - DNA, 25 bp, Homo sapien
gtcaacagccacgtcaacctggagc

SEQ ID NO: 150249 - DNA, 25 bp, Homo sapien
ggagcacgcccagaagctgataatg

SEQ ID NO: 150250 - DNA, 25 bp, Homo sapien
acgtgaccctggagcgtttcagccg

SEQ ID NO: 150251 - DNA, 25 bp, Homo sapien
tcctgagccagtcgcaagagaagag

SEQ ID NO: 150252 - DNA, 25 bp, Homo sapien
tggagcgtttcagccgctgcttcct

SEQ ID NO: 150253 - DNA, 25 bp, Homo sapien
gctgcttcctgagccagtcgcaaga

SEQ ID NO: 150254 - DNA, 25 bp, Homo sapien
ggtcctgtcacagactcagcgactg

SEQ ID NO: 150255 - DNA, 25 bp, Homo sapien
cgctatggcaagtgcgccaaaacta

SEQ ID NO: 150256 - DNA, 25 bp, Homo sapien
gccgggtaacgtcttctagcaggta

SEQ ID NO: 150257 - DNA, 25 bp, Homo sapien
cctgggatcgcatcactagacagtc

SEQ ID NO: 150258 - DNA, 25 bp, Homo sapien
tcagccgaaggcgtcgtcatcccag

SEQ ID NO: 150259 - DNA, 25 bp, Homo sapien
tcatcccagccgttcctgtagcagg

SEQ ID NO: 150260 - DNA, 25 bp, Homo sapien
ctgatggccaagagctttgtgtgca

SEQ ID NO: 150261 - DNA, 25 bp, Homo sapien
ttccacttcaagcaccaggtcgagg

SEQ ID NO: 150262 - DNA, 25 bp, Homo sapien
ccctgcgagctgtgttcaagaagta

SEQ ID NO: 150263 - DNA, 25 bp, Homo sapien
ctcgacgggatcatgctgatggcca

SEQ ID NO: 150264 - DNA, 25 bp, Homo sapien
ggagaagccgccgagctgccacgcg

SEQ ID NO: 150265 - DNA, 25 bp, Homo sapien
aaaatagcgtacgtgttactccaga

SEQ ID NO: 150266 - DNA, 25 bp, Homo sapien
gcgtacgtgttactccagaacagga

SEQ ID NO: 150267 - DNA, 25 bp, Homo sapien
tccagaacaggaggaatggccacgg

SEQ ID NO: 150268 - DNA, 25 bp, Homo sapien
cgaagccattcctgggcgccgctgt

SEQ ID NO: 150269 - DNA, 25 bp, Homo sapien
ccagcacttggtggcttcggctcca

SEQ ID NO: 150270 - DNA, 25 bp, Homo sapien
ccagttcccagtgccggaggctcgc

SEQ ID NO: 150271 - DNA, 25 bp, Homo sapien
cacagcgccaggaagatgcacacca

SEQ ID NO: 150272 - DNA, 25 bp, Homo sapien
tcgcgcatctcatctccgcgtggat

SEQ ID NO: 150273 - DNA, 25 bp, Homo sapien
acaaccgaggtacccaccgagtctg

SEQ ID NO: 150274 - DNA, 25 bp, Homo sapien
gtacccaccgagtctggtaaatatc

SEQ ID NO: 150275 - DNA, 25 bp, Homo sapien
ccaccgagtctggtaaatatccctg

SEQ ID NO: 150276 - DNA, 25 bp, Homo sapien
cgagtctggtaaatatccctgtggg

SEQ ID NO: 150277 - DNA, 25 bp, Homo sapien
tccacccggaacctccagagactcg

SEQ ID NO: 150278 - DNA, 25 bp, Homo sapien
tctcatctccgcgtggatcctcccg

SEQ ID NO: 150279 - DNA, 25 bp, Homo sapien
tatccctgtggggaatcctgcccgc

SEQ ID NO: 150280 - DNA, 25 bp, Homo sapien
cggcccttgctaggggcgttctaca

SEQ ID NO: 150281 - DNA, 25 bp, Homo sapien
tgcattagatacctcgtcgccacgc

SEQ ID NO: 150282 - DNA, 25 bp, Homo sapien
ctcgaggactcacaagatgacggca

SEQ ID NO: 150283 - DNA, 25 bp, Homo sapien
actcgcgagatgactgcggccaatg

SEQ ID NO: 150284 - DNA, 25 bp, Homo sapien
cagggtgtcccgtttgtttcatcac

SEQ ID NO: 150285 - DNA, 25 bp, Homo sapien
tttcatcaccagcaagaggcaggca

SEQ ID NO: 150286 - DNA, 25 bp, Homo sapien
ctccgcctgcagaaatgagtgaaca

SEQ ID NO: 150287 - DNA, 25 bp, Homo sapien
cttggagtgactggcgacagaatac

SEQ ID NO: 150288 - DNA, 25 bp, Homo sapien
gccctacacggggttgcagaaagcg

SEQ ID NO: 150289 - DNA, 25 bp, Homo sapien
caaaagagttcgtggctgcaagggt

SEQ ID NO: 150290 - DNA, 25 bp, Homo sapien
cgcgcggtagtatttcttgctaata

SEQ ID NO: 150291 - DNA, 25 bp, Homo sapien
tccctgcacagcttccgggaagagg

SEQ ID NO: 150292 - DNA, 25 bp, Homo sapien
agcgcttcctgtgccaggtttccgg

SEQ ID NO: 150293 - DNA, 25 bp, Homo sapien
cgcgactttcagactccgaccatgg

SEQ ID NO: 150294 - DNA, 25 bp, Homo sapien
tcacggctccaatgacagcagtggg

SEQ ID NO: 150295 - DNA, 25 bp, Homo sapien
agcgcaggagcgatcagattgaccg

SEQ ID NO: 150296 - DNA, 25 bp, Homo sapien
gcctcaccggggcacaccctcaccc

SEQ ID NO: 150297 - DNA, 25 bp, Homo sapien
cacagaatcgcccagacacaccctc

SEQ ID NO: 150298 - DNA, 25 bp, Homo sapien
ggcacagcctcaccggggcacaccc

SEQ ID NO: 150299 - DNA, 25 bp, Homo sapien
ggacacgccctcaccggggcacacc

SEQ ID NO: 150300 - DNA, 25 bp, Homo sapien
ccggacacgccctcaccggggcaca

SEQ ID NO: 150301 - DNA, 25 bp, Homo sapien
cctcacccgggcacagaatcgccca

SEQ ID NO: 150302 - DNA, 25 bp, Homo sapien
tcacccgggcacagaatcgcccaga

SEQ ID NO: 150303 - DNA, 25 bp, Homo sapien
acccgggcacagaatcgcccagaca

SEQ ID NO: 150304 - DNA, 25 bp, Homo sapien
cgctgctgggtacctagcgtcttca

SEQ ID NO: 150305 - DNA, 25 bp, Homo sapien
cctgacgctgtatctggatctgggg

SEQ ID NO: 150306 - DNA, 25 bp, Homo sapien
atcttcctgacgctgtatctggatc

SEQ ID NO: 150307 - DNA, 25 bp, Homo sapien
tcggtgttgactccccttgaagctg

SEQ ID NO: 150308 - DNA, 25 bp, Homo sapien
gcagcggcatccaggaatggcttcg

SEQ ID NO: 150309 - DNA, 25 bp, Homo sapien
agccgaagtcaccgggtgctggccc

SEQ ID NO: 150310 - DNA, 25 bp, Homo sapien
tgccttgcgccctactgccaggaga

SEQ ID NO: 150311 - DNA, 25 bp, Homo sapien
tacctagcgtcttcaaggaactgcc

SEQ ID NO: 150312 - DNA, 25 bp, Homo sapien
gcggcgcctacaagcggccggggca

SEQ ID NO: 150313 - DNA, 25 bp, Homo sapien
cgccctgcgcgctccagccgaccct

SEQ ID NO: 150314 - DNA, 25 bp, Homo sapien
ggcagaccggtaactctgacaggtg

SEQ ID NO: 150315 - DNA, 25 bp, Homo sapien
cccggcagaccggtaactctgacag

SEQ ID NO: 150316 - DNA, 25 bp, Homo sapien
tcctggcgcaacgtgcaggctcgcg

SEQ ID NO: 150317 - DNA, 25 bp, Homo sapien
gtcctggcgcaacgtgcaggctcgc

SEQ ID NO: 150318 - DNA, 25 bp, Homo sapien
acctggctacccgatccggccgcgt

SEQ ID NO: 150319 - DNA, 25 bp, Homo sapien
agaccggtaactctgacaggtgggc

SEQ ID NO: 150320 - DNA, 25 bp, Homo sapien
ccatgaggcgcatagctgagcgcag

SEQ ID NO: 150321 - DNA, 25 bp, Homo sapien
cctggcagccgctagccctggccgt

SEQ ID NO: 150322 - DNA, 25 bp, Homo sapien
tccatgaggcgcatagctgagcgca

SEQ ID NO: 150323 - DNA, 25 bp, Homo sapien
gtccatgaggcgcatagctgagcgc

SEQ ID NO: 150324 - DNA, 25 bp, Homo sapien
acgcgtccatgaggcgcatagctga

SEQ ID NO: 150325 - DNA, 25 bp, Homo sapien
cacgcgtccatgaggcgcatagctg

SEQ ID NO: 150326 - DNA, 25 bp, Homo sapien
cagccgctagccctggccgtcgccc

SEQ ID NO: 150327 - DNA, 25 bp, Homo sapien
gcacgcgtccatgaggcgcatagct

SEQ ID NO: 150328 - DNA, 25 bp, Homo sapien
tttctgcttgagcaccagcgcggca

SEQ ID NO: 150329 - DNA, 25 bp, Homo sapien
tctgcgagacgtggtagagcatata

SEQ ID NO: 150330 - DNA, 25 bp, Homo sapien
gacggcacacagagcccggaacttg

SEQ ID NO: 150331 - DNA, 25 bp, Homo sapien
cagcgcttggtgtccatgctgttgc

SEQ ID NO: 150332 - DNA, 25 bp, Homo sapien
tcatcgaagcgattggcgaagcagc

SEQ ID NO: 150333 - DNA, 25 bp, Homo sapien
aggctgccctggtagtcatcgaagc

SEQ ID NO: 150334 - DNA, 25 bp, Homo sapien
gtagagcatatacgccactccggcc

SEQ ID NO: 150335 - DNA, 25 bp, Homo sapien
cttgcccagcggctgcacgtagtcg

SEQ ID NO: 150336 - DNA, 25 bp, Homo sapien
tggcatcagcgctgctccgcctcca

SEQ ID NO: 150337 - DNA, 25 bp, Homo sapien
ctgctccgcctccaggaaggaacct

SEQ ID NO: 150338 - DNA, 25 bp, Homo sapien
cgcaggtggcatcagcgctgctccg

SEQ ID NO: 150339 - DNA, 25 bp, Homo sapien
gtggcatcagcgctgctccgcctcc

SEQ ID NO: 150340 - DNA, 25 bp, Homo sapien
ggcatcagcgctgctccgcctccag

SEQ ID NO: 150341 - DNA, 25 bp, Homo sapien
gcgctgctccgcctccaggaaggaa

SEQ ID NO: 150342 - DNA, 25 bp, Homo sapien
gctgctccgcctccaggaaggaacc

SEQ ID NO: 150343 - DNA, 25 bp, Homo sapien
cgctgctccgcctccaggaaggaac

SEQ ID NO: 150344 - DNA, 25 bp, Homo sapien
aagatacgcttgtttgtcgccgtga

SEQ ID NO: 150345 - DNA, 25 bp, Homo sapien
cctgaagatacgcttgtttgtcgcc

SEQ ID NO: 150346 - DNA, 25 bp, Homo sapien
tctcctgaagatacgcttgtttgtc

SEQ ID NO: 150347 - DNA, 25 bp, Homo sapien
cagtctcctgaagatacgcttgttt

SEQ ID NO: 150348 - DNA, 25 bp, Homo sapien
atttgtgacggagggcatggacgac

SEQ ID NO: 150349 - DNA, 25 bp, Homo sapien
cccagaactgggtatttgtgacgga

SEQ ID NO: 150350 - DNA, 25 bp, Homo sapien
ggacacccagaactgggtatttgtg

SEQ ID NO: 150351 - DNA, 25 bp, Homo sapien
gatacgcttgtttgtcgccgtgacg

SEQ ID NO: 150352 - DNA, 25 bp, Homo sapien
ccggagcgtcccatctaaaagaact

SEQ ID NO: 150353 - DNA, 25 bp, Homo sapien
gtttcaggaaggtacatcaagcaca

SEQ ID NO: 150354 - DNA, 25 bp, Homo sapien
tctgactctcttcaacgtagacaca

SEQ ID NO: 150355 - DNA, 25 bp, Homo sapien
cgtagacacacatcgagaaaactcc

SEQ ID NO: 150356 - DNA, 25 bp, Homo sapien
cagagcctcttgagactcgcgtatc

SEQ ID NO: 150357 - DNA, 25 bp, Homo sapien
gcggagcctcctgagagtcgcgtat

SEQ ID NO: 150358 - DNA, 25 bp, Homo sapien
cggagcctaccaagaccggagcgtc

SEQ ID NO: 150359 - DNA, 25 bp, Homo sapien
atcgagaaaactccgtgacttcaag

SEQ ID NO: 150360 - DNA, 25 bp, Homo sapien
tggtcgctgattctgtgaagggacc

SEQ ID NO: 150361 - DNA, 25 bp, Homo sapien
gaactgggcgctatcagacctctgc

SEQ ID NO: 150362 - DNA, 25 bp, Homo sapien
gagccatgcgggacttccgacaggt

SEQ ID NO: 150363 - DNA, 25 bp, Homo sapien
agaagtgggcggtggagaccgttat

SEQ ID NO: 150364 - DNA, 25 bp, Homo sapien
gtagtgtggtcgctgattctgtgaa

SEQ ID NO: 150365 - DNA, 25 bp, Homo sapien
tgattctgtgaagggaccagaagtg

SEQ ID NO: 150366 - DNA, 25 bp, Homo sapien
tcgctgattctgtgaagggaccaga

SEQ ID NO: 150367 - DNA, 25 bp, Homo sapien
ctgggcgctatcagacctctgcgct

SEQ ID NO: 150368 - DNA, 25 bp, Homo sapien
ccgggaatgtgtccctcttctgatc

SEQ ID NO: 150369 - DNA, 25 bp, Homo sapien
tttacaggctggaagtccgcacaca

SEQ ID NO: 150370 - DNA, 25 bp, Homo sapien
gggtgtcccagcttcaagttcagtc

SEQ ID NO: 150371 - DNA, 25 bp, Homo sapien
tgcccatgagggacgtcccaagctc

SEQ ID NO: 150372 - DNA, 25 bp, Homo sapien
ctctggtgcagagttgctagaaaca

SEQ ID NO: 150373 - DNA, 25 bp, Homo sapien
gtggcgttcgtgtgactttccttta

SEQ ID NO: 150374 - DNA, 25 bp, Homo sapien
ccattgtgcccgtggacattttaac

SEQ ID NO: 150375 - DNA, 25 bp, Homo sapien
acccgtcagatatgcggtagcgttg

SEQ ID NO: 150376 - DNA, 25 bp, Homo sapien
aggtctccaccgctcacttccggtc

SEQ ID NO: 150377 - DNA, 25 bp, Homo sapien
gcataaaggtctccaccgctcactt

SEQ ID NO: 150378 - DNA, 25 bp, Homo sapien
ggtcccttcgcagagcctgtgacca

SEQ ID NO: 150379 - DNA, 25 bp, Homo sapien
cttcgcagagcctgtgaccacacta

SEQ ID NO: 150380 - DNA, 25 bp, Homo sapien
ttcgcagagcctgtgaccacactac

SEQ ID NO: 150381 - DNA, 25 bp, Homo sapien
gcctgtgaccacactaccaccgggc

SEQ ID NO: 150382 - DNA, 25 bp, Homo sapien
gtcgccggtgcgacggtaccaccat

SEQ ID NO: 150383 - DNA, 25 bp, Homo sapien
cggtgcgacggtaccaccatcccag

SEQ ID NO: 150384 - DNA, 25 bp, Homo sapien
cagccgctatttcttgcaccagtgg

SEQ ID NO: 150385 - DNA, 25 bp, Homo sapien
ccctggagagcttcagccgctattt

SEQ ID NO: 150386 - DNA, 25 bp, Homo sapien
atcaaggtcaccctggagctccacg

SEQ ID NO: 150387 - DNA, 25 bp, Homo sapien
ctgcgaggtcgccatcaacatcaag

SEQ ID NO: 150388 - DNA, 25 bp, Homo sapien
gaacaaccatctcagctgcgaggtc

SEQ ID NO: 150389 - DNA, 25 bp, Homo sapien
ctgtcgcaggtgcaccagaacaacc

SEQ ID NO: 150390 - DNA, 25 bp, Homo sapien
cgtcgtccaccatgttgtgctcaga

SEQ ID NO: 150391 - DNA, 25 bp, Homo sapien
ggtcccttcgcagaccctgtggcaa

SEQ ID NO: 150392 - DNA, 25 bp, Homo sapien
acttccgtgcctgagaaggcaggag

SEQ ID NO: 150393 - DNA, 25 bp, Homo sapien
acctcacccacggggctcgggatgg

SEQ ID NO: 150394 - DNA, 25 bp, Homo sapien
acccacagggctcgggatggccgca

SEQ ID NO: 150395 - DNA, 25 bp, Homo sapien
acagggctcgggatggccgcactca

SEQ ID NO: 150396 - DNA, 25 bp, Homo sapien
tcacacctcacccacggggctcggg

SEQ ID NO: 150397 - DNA, 25 bp, Homo sapien
gggatggccgcactgtgacttccgt

SEQ ID NO: 150398 - DNA, 25 bp, Homo sapien
gcaccggccgtcctcacacctcacc

SEQ ID NO: 150399 - DNA, 25 bp, Homo sapien
cgggatggccgcactgtgacttccg

SEQ ID NO: 150400 - DNA, 25 bp, Homo sapien
aaggcggtttgtcacagtaccaggg

SEQ ID NO: 150401 - DNA, 25 bp, Homo sapien
acttggaaggcggtttgtcacagta

SEQ ID NO: 150402 - DNA, 25 bp, Homo sapien
cttggaaggcggtttgtcacagtac

SEQ ID NO: 150403 - DNA, 25 bp, Homo sapien
ttggaaggcggtttgtcacagtacc

SEQ ID NO: 150404 - DNA, 25 bp, Homo sapien
tggaaggcggtttgtcacagtacca

SEQ ID NO: 150405 - DNA, 25 bp, Homo sapien
ggaaggcggtttgtcacagtaccag

SEQ ID NO: 150406 - DNA, 25 bp, Homo sapien
gaaggcggtttgtcacagtaccagg

SEQ ID NO: 150407 - DNA, 25 bp, Homo sapien
aggcggtttgtcacagtaccagggc

SEQ ID NO: 150408 - DNA, 25 bp, Homo sapien
cgcgctggtgctcaagcagaaactc

SEQ ID NO: 150409 - DNA, 25 bp, Homo sapien
ccgactacgtgcagccgctgggcaa

SEQ ID NO: 150410 - DNA, 25 bp, Homo sapien
gtacgccgtggccacgctcgtatac

SEQ ID NO: 150411 - DNA, 25 bp, Homo sapien
ccggagtggcgtatatgctctacca

SEQ ID NO: 150412 - DNA, 25 bp, Homo sapien
cttcgatgactaccagggcagcctg

SEQ ID NO: 150413 - DNA, 25 bp, Homo sapien
gcacgggcaacagcatggacaccaa

SEQ ID NO: 150414 - DNA, 25 bp, Homo sapien
gctgcttcgccaatcgcttcgatga

SEQ ID NO: 150415 - DNA, 25 bp, Homo sapien
tgggtcctgccagagatcacctcgg

SEQ ID NO: 150416 - DNA, 25 bp, Homo sapien
cgctccatggcctgagccgtcgtag

SEQ ID NO: 150417 - DNA, 25 bp, Homo sapien
cccgcagggcgaactgcatcctttt

SEQ ID NO: 150418 - DNA, 25 bp, Homo sapien
gctgacgttgcttttctcgctactg

SEQ ID NO: 150419 - DNA, 25 bp, Homo sapien
gttcctgttcgtggccgagacaacg

SEQ ID NO: 150420 - DNA, 25 bp, Homo sapien
ggagatgaaattcccggcctcggtg

SEQ ID NO: 150421 - DNA, 25 bp, Homo sapien
gggacggtcaccacagagacgcagc

SEQ ID NO: 150422 - DNA, 25 bp, Homo sapien
gctgacgcgcggagatgaaattccc

SEQ ID NO: 150423 - DNA, 25 bp, Homo sapien
atccttttgagctcccgctccatgg

SEQ ID NO: 150424 - DNA, 25 bp, Homo sapien
ttcgggcaacgccaggcgtcacttc

SEQ ID NO: 150425 - DNA, 25 bp, Homo sapien
cagcagcgggaagacccgttttcga

SEQ ID NO: 150426 - DNA, 25 bp, Homo sapien
cgcagtggcgatggtactcctccat

SEQ ID NO: 150427 - DNA, 25 bp, Homo sapien
gtactcctccatggtagcgccggct

SEQ ID NO: 150428 - DNA, 25 bp, Homo sapien
agcgacacgccggtagagcaccgcg

SEQ ID NO: 150429 - DNA, 25 bp, Homo sapien
cctttgtgtcgcagtggcgtcacct

SEQ ID NO: 150430 - DNA, 25 bp, Homo sapien
gtcacttcaggccacgcactttttc

SEQ ID NO: 150431 - DNA, 25 bp, Homo sapien
atggcctagggcctttccctacgca

SEQ ID NO: 150432 - DNA, 25 bp, Homo sapien
agggagatccacgaaggaggctttc

SEQ ID NO: 150433 - DNA, 25 bp, Homo sapien
gagatccacgaaggaggctttcacc

SEQ ID NO: 150434 - DNA, 25 bp, Homo sapien
ttcaccccttggcagcgggcggctg

SEQ ID NO: 150435 - DNA, 25 bp, Homo sapien
ggcgcctggagaccgcgtctctcga

SEQ ID NO: 150436 - DNA, 25 bp, Homo sapien
gagaccgcgtctctcgaggcactag

SEQ ID NO: 150437 - DNA, 25 bp, Homo sapien
tctctcgaggcactaggtcctggta

SEQ ID NO: 150438 - DNA, 25 bp, Homo sapien
cgaggcactaggtcctggtacttgc

SEQ ID NO: 150439 - DNA, 25 bp, Homo sapien
cactaggtcctggtacttgctgggg

SEQ ID NO: 150440 - DNA, 25 bp, Homo sapien
ccgaagagaccaagggactgcgtgc

SEQ ID NO: 150441 - DNA, 25 bp, Homo sapien
agcgggcgcttagctcgcctcggca

SEQ ID NO: 150442 - DNA, 25 bp, Homo sapien
agttctgcgcaaacaaagggcgccc

SEQ ID NO: 150443 - DNA, 25 bp, Homo sapien
cccaccctcgggctgcgaaagagga

SEQ ID NO: 150444 - DNA, 25 bp, Homo sapien
atggtcagttcttcccggcgcgtgc

SEQ ID NO: 150445 - DNA, 25 bp, Homo sapien
cctggagatgggatggtcagttctt

SEQ ID NO: 150446 - DNA, 25 bp, Homo sapien
tctatcccgagcgaagggtcccaac

SEQ ID NO: 150447 - DNA, 25 bp, Homo sapien
cgaaagaggagttctgcgcaaacaa

SEQ ID NO: 150448 - DNA, 25 bp, Homo sapien
cgggaggttcgcatcctcggggact

SEQ ID NO: 150449 - DNA, 25 bp, Homo sapien
ccctcgctgtgggctcgcgcagtga

SEQ ID NO: 150450 - DNA, 25 bp, Homo sapien
gactgggagcccagttatcggaccc

SEQ ID NO: 150451 - DNA, 25 bp, Homo sapien
aggttcgcatcctcggggactggga

SEQ ID NO: 150452 - DNA, 25 bp, Homo sapien
agctccgggaggttcgcatcctcgg

SEQ ID NO: 150453 - DNA, 25 bp, Homo sapien
gagctccgggaggttcgcatcctcg

SEQ ID NO: 150454 - DNA, 25 bp, Homo sapien
cgcgcagtgagggtcatggtgacct

SEQ ID NO: 150455 - DNA, 25 bp, Homo sapien
cagtgagggtcatggtgacctgggg

SEQ ID NO: 150456 - DNA, 25 bp, Homo sapien
acaaacagccgctacgggcaacggg

SEQ ID NO: 150457 - DNA, 25 bp, Homo sapien
tccggagatcaactacaaccgcgct

SEQ ID NO: 150458 - DNA, 25 bp, Homo sapien
ccgcatggcgaaactccggagatca

SEQ ID NO: 150459 - DNA, 25 bp, Homo sapien
tttggtcggggctaaagcagctact

SEQ ID NO: 150460 - DNA, 25 bp, Homo sapien
ggcagtagagaccacgcgccctctg

SEQ ID NO: 150461 - DNA, 25 bp, Homo sapien
tccctcatgccacgggcagtacggg

SEQ ID NO: 150462 - DNA, 25 bp, Homo sapien
gggcgcaactcaccgggcatcagct

SEQ ID NO: 150463 - DNA, 25 bp, Homo sapien
ccctcagtcattcgcgggagcgcaa

SEQ ID NO: 150464 - DNA, 25 bp, Homo sapien
accgaagtctcccaagcgcacgatg

SEQ ID NO: 150465 - DNA, 25 bp, Homo sapien
tggagaccaaacctgtgataacctg

SEQ ID NO: 150466 - DNA, 25 bp, Homo sapien
atcatctactccttcgtcttctggg

SEQ ID NO: 150467 - DNA, 25 bp, Homo sapien
cggtccgtatgatgatgctctgaga

SEQ ID NO: 150468 - DNA, 25 bp, Homo sapien
cggtgactgcaggttgtcgaccttc

SEQ ID NO: 150469 - DNA, 25 bp, Homo sapien
taatctcccgggatagggtcagctc

SEQ ID NO: 150470 - DNA, 25 bp, Homo sapien
gcgcctcttggagctaacctgtggc

SEQ ID NO: 150471 - DNA, 25 bp, Homo sapien
ccggagctctgtagtatggcatcga

SEQ ID NO: 150472 - DNA, 25 bp, Homo sapien
gaggttcggaggcactcactgaccc

SEQ ID NO: 150473 - DNA, 25 bp, Homo sapien
acgaggcaggcgctcctaaggaaaa

SEQ ID NO: 150474 - DNA, 25 bp, Homo sapien
ctcagcctccggaggttcggaggca

SEQ ID NO: 150475 - DNA, 25 bp, Homo sapien
tcctgtagaacctgtgtcttctcca

SEQ ID NO: 150476 - DNA, 25 bp, Homo sapien
ggagaagccggatttcctgtagaac

SEQ ID NO: 150477 - DNA, 25 bp, Homo sapien
acagaagacattcctcgggcctggg

SEQ ID NO: 150478 - DNA, 25 bp, Homo sapien
cccacgtagacagaagacattcctc

SEQ ID NO: 150479 - DNA, 25 bp, Homo sapien
acaggtcacctcaggtcgcctcggg

SEQ ID NO: 150480 - DNA, 25 bp, Homo sapien
ccgcttgcagcgagaacactgaatt

SEQ ID NO: 150481 - DNA, 25 bp, Homo sapien
gaagcactcgctctttaacgccatg

SEQ ID NO: 150482 - DNA, 25 bp, Homo sapien
ccctagcagggtgaataatctaatc

SEQ ID NO: 150483 - DNA, 25 bp, Homo sapien
gggaatcccgccacaccggctatag

SEQ ID NO: 150484 - DNA, 25 bp, Homo sapien
ttcgtctccgtgtatcaaacaggcc

SEQ ID NO: 150485 - DNA, 25 bp, Homo sapien
gcgcggccaccatgatgcaaatctg

SEQ ID NO: 150486 - DNA, 25 bp, Homo sapien
cggccagcttggttgcttgagctca

SEQ ID NO: 150487 - DNA, 25 bp, Homo sapien
ggcgccgtgaacaacatggaccaga

SEQ ID NO: 150488 - DNA, 25 bp, Homo sapien
aaggcggcttgtcttgccctctcag

SEQ ID NO: 150489 - DNA, 25 bp, Homo sapien
atcttgattcgtgggaacagccttg

SEQ ID NO: 150490 - DNA, 25 bp, Homo sapien
gcccaggccaccagatagttaaagg

SEQ ID NO: 150491 - DNA, 25 bp, Homo sapien
agcagagccacagacggtaccggga

SEQ ID NO: 150492 - DNA, 25 bp, Homo sapien
aaggaggaatgctttgcggacccgc

SEQ ID NO: 150493 - DNA, 25 bp, Homo sapien
ctgggagcatcagtgccacactcgc

SEQ ID NO: 150494 - DNA, 25 bp, Homo sapien
tctcagggcgctgggtgtttccaaa

SEQ ID NO: 150495 - DNA, 25 bp, Homo sapien
ccgcctcggtgaggcagtctagctc

SEQ ID NO: 150496 - DNA, 25 bp, Homo sapien
cccacagatttttcctggtgcttgg

SEQ ID NO: 150497 - DNA, 25 bp, Homo sapien
gccgccggagtctgtttatgcatca

SEQ ID NO: 150498 - DNA, 25 bp, Homo sapien
acgcgcacctgtgatgctctgcagc

SEQ ID NO: 150499 - DNA, 25 bp, Homo sapien
agagtcggttcctatttcctgatta

SEQ ID NO: 150500 - DNA, 25 bp, Homo sapien
aatcccggctcgctaggtttaattg

SEQ ID NO: 150501 - DNA, 25 bp, Homo sapien
tcctgttccttggagcaatcccggc

SEQ ID NO: 150502 - DNA, 25 bp, Homo sapien
aacgagccagactcctctgcctttg

SEQ ID NO: 150503 - DNA, 25 bp, Homo sapien
cctttggctgatcccactgcctgga

SEQ ID NO: 150504 - DNA, 25 bp, Homo sapien
ttaggcacaaggcacgtggcgcgcc

SEQ ID NO: 150505 - DNA, 25 bp, Homo sapien
agaaatgccagggacagaacgcgcg

SEQ ID NO: 150506 - DNA, 25 bp, Homo sapien
tccaattaccctgcggccgtgccaa

SEQ ID NO: 150507 - DNA, 25 bp, Homo sapien
cctccgctaatgagcgggcggagcc

SEQ ID NO: 150508 - DNA, 25 bp, Homo sapien
gattcatttccatctggagcgcggc

SEQ ID NO: 150509 - DNA, 25 bp, Homo sapien
cgctcgctggattcatttccatctg

SEQ ID NO: 150510 - DNA, 25 bp, Homo sapien
tcccatatggtgtcgtcgcgttaaa

SEQ ID NO: 150511 - DNA, 25 bp, Homo sapien
tttgcaaacgcacagcagcgcaggg

SEQ ID NO: 150512 - DNA, 25 bp, Homo sapien
gctcccggacgtggcaaatcttgtc

SEQ ID NO: 150513 - DNA, 25 bp, Homo sapien
tgaatctcgcgcttttgtgctcgcc

SEQ ID NO: 150514 - DNA, 25 bp, Homo sapien
cggggaggcagttctaatagttgtc

SEQ ID NO: 150515 - DNA, 25 bp, Homo sapien
ggccctaatggatggagccgctctc

SEQ ID NO: 150516 - DNA, 25 bp, Homo sapien
cttcgatcaatacggctcgctgaga

SEQ ID NO: 150517 - DNA, 25 bp, Homo sapien
ggccctttgtggtcagagatgcctc

SEQ ID NO: 150518 - DNA, 25 bp, Homo sapien
ttgtcctcacactatgcccagtagc

SEQ ID NO: 150519 - DNA, 25 bp, Homo sapien
tttctaattggaggcgaacagcggc

SEQ ID NO: 150520 - DNA, 25 bp, Homo sapien
cccagaccgagacctatgctaatga

SEQ ID NO: 150521 - DNA, 25 bp, Homo sapien
aaagttgccatctgctccggggacc

SEQ ID NO: 150522 - DNA, 25 bp, Homo sapien
gcctcgcttcttccagactgtaatt

SEQ ID NO: 150523 - DNA, 25 bp, Homo sapien
ggaaactccggcttgcagcgaaaca

SEQ ID NO: 150524 - DNA, 25 bp, Homo sapien
ccgtcggcctccaaagagtcgcaga

SEQ ID NO: 150525 - DNA, 25 bp, Homo sapien
gcgcctcgtgggtttagagaactca

SEQ ID NO: 150526 - DNA, 25 bp, Homo sapien
cccgtagctaaatgtttggcctttg

SEQ ID NO: 150527 - DNA, 25 bp, Homo sapien
cctgctgagggtttgcgttgaccca

SEQ ID NO: 150528 - DNA, 25 bp, Homo sapien
tggagggtcacataagccacctggc

SEQ ID NO: 150529 - DNA, 25 bp, Homo sapien
gtataaagaccaacgcacgacgggc

SEQ ID NO: 150530 - DNA, 25 bp, Homo sapien
acctgcctgggttaacagttcctgc

SEQ ID NO: 150531 - DNA, 25 bp, Homo sapien
ggcctccttggcagacatcttcctg

SEQ ID NO: 150532 - DNA, 25 bp, Homo sapien
cctgtgggaggatttcaaacgagcc

SEQ ID NO: 150533 - DNA, 25 bp, Homo sapien
aggacaaagctcacacgccgaaagc

SEQ ID NO: 150534 - DNA, 25 bp, Homo sapien
ccagggcgcaccctaaagaagaggg

SEQ ID NO: 150535 - DNA, 25 bp, Homo sapien
cgagccgtgaaagccagaaactaca

SEQ ID NO: 150536 - DNA, 25 bp, Homo sapien
aagccaccggctacgtctgaaggga

SEQ ID NO: 150537 - DNA, 25 bp, Homo sapien
gcctgctccgtcttgcagaaatctg

SEQ ID NO: 150538 - DNA, 25 bp, Homo sapien
gccggctctgctgaactcttcgaaa

SEQ ID NO: 150539 - DNA, 25 bp, Homo sapien
tgcctacgggtaattgggtttgctc

SEQ ID NO: 150540 - DNA, 25 bp, Homo sapien
gagccgtgcgagacagacttcccat

SEQ ID NO: 150541 - DNA, 25 bp, Homo sapien
ccagatctgcaacgcctaaggctta

SEQ ID NO: 150542 - DNA, 25 bp, Homo sapien
aagcctcgcggagtcctaggacaca

SEQ ID NO: 150543 - DNA, 25 bp, Homo sapien
cgctggcggaccactgacaaaaaga

SEQ ID NO: 150544 - DNA, 25 bp, Homo sapien
cctctccttgaaaggcgggatgctt

SEQ ID NO: 150545 - DNA, 25 bp, Homo sapien
gaagaggaggttcacccagccactc

SEQ ID NO: 150546 - DNA, 25 bp, Homo sapien
cagatcgtaaaccacccgccggaat

SEQ ID NO: 150547 - DNA, 25 bp, Homo sapien
cggaaagccgcccttggacacagcg

SEQ ID NO: 150548 - DNA, 25 bp, Homo sapien
gcgcatccgcccaaggggaagttta

SEQ ID NO: 150549 - DNA, 25 bp, Homo sapien
acagggtcctaagaggctggcaagc

SEQ ID NO: 150550 - DNA, 25 bp, Homo sapien
gggacgcctatccagtgccatgaaa

SEQ ID NO: 150551 - DNA, 25 bp, Homo sapien
ggcaagccttacattcctctcggga

SEQ ID NO: 150552 - DNA, 25 bp, Homo sapien
tctgggttcccttccgatcatacta

SEQ ID NO: 150553 - DNA, 25 bp, Homo sapien
ggcgcagggagaatccgagacctcc

SEQ ID NO: 150554 - DNA, 25 bp, Homo sapien
cgaatctgacgaaaagaaactttgg

SEQ ID NO: 150555 - DNA, 25 bp, Homo sapien
gtcggcaacaaagggattttctctc

SEQ ID NO: 150556 - DNA, 25 bp, Homo sapien
ttccgatcatactagagcgctgctc

SEQ ID NO: 150557 - DNA, 25 bp, Homo sapien
cttacaaagatgtgagccaagcgtc

SEQ ID NO: 150558 - DNA, 25 bp, Homo sapien
gccaagcgtcgcctactgtaacgtg

SEQ ID NO: 150559 - DNA, 25 bp, Homo sapien
agagcgctgctcctctggacgcttc

SEQ ID NO: 150560 - DNA, 25 bp, Homo sapien
tgcaggccagccctctgcaagtggc

SEQ ID NO: 150561 - DNA, 25 bp, Homo sapien
ctgcaagtggcgttctttctctttt

SEQ ID NO: 150562 - DNA, 25 bp, Homo sapien
gaggaactccctacagcgccaacgg

SEQ ID NO: 150563 - DNA, 25 bp, Homo sapien
gcgctctctccgaaaagtctaatgc

SEQ ID NO: 150564 - DNA, 25 bp, Homo sapien
aatggctccgcagtgcgaccgagtg

SEQ ID NO: 150565 - DNA, 25 bp, Homo sapien
tgaagctccggatgtgcgaaatggc

SEQ ID NO: 150566 - DNA, 25 bp, Homo sapien
gactggttactcctccagacgctga

SEQ ID NO: 150567 - DNA, 25 bp, Homo sapien
gtacaggcaggggtaccggacactc

SEQ ID NO: 150568 - DNA, 25 bp, Homo sapien
ctctggccgtgggtagtaactattt

SEQ ID NO: 150569 - DNA, 25 bp, Homo sapien
gcagacgcttggaaagcccttttta

SEQ ID NO: 150570 - DNA, 25 bp, Homo sapien
tggaaacgcttacgcagagcagagc

SEQ ID NO: 150571 - DNA, 25 bp, Homo sapien
ccgcacttcctagcaaggagaattt

SEQ ID NO: 150572 - DNA, 25 bp, Homo sapien
tgaactcaagctggaaaggccgcct

SEQ ID NO: 150573 - DNA, 25 bp, Homo sapien
caatcatggggaagctgtgaacctc

SEQ ID NO: 150574 - DNA, 25 bp, Homo sapien
aaccagcctcatcgtcggagtcaga

SEQ ID NO: 150575 - DNA, 25 bp, Homo sapien
ccactccggctgtttggatcagcaa

SEQ ID NO: 150576 - DNA, 25 bp, Homo sapien
ccgaggcaataaggaggctcctctt

SEQ ID NO: 150577 - DNA, 25 bp, Homo sapien
cagcgcgtccggttttgcaaacaga

SEQ ID NO: 150578 - DNA, 25 bp, Homo sapien
gacggaatcccgtcggccataaaca

SEQ ID NO: 150579 - DNA, 25 bp, Homo sapien
acgagtgtgacctcggggcctaaca

SEQ ID NO: 150580 - DNA, 25 bp, Homo sapien
ttcccggctgggcttagacaaagag

SEQ ID NO: 150581 - DNA, 25 bp, Homo sapien
caagccataccctagccggagttta

SEQ ID NO: 150582 - DNA, 25 bp, Homo sapien
gtgcggtcttcccaataaaagctgg

SEQ ID NO: 150583 - DNA, 25 bp, Homo sapien
aagggccttgtgagctcctttcggc

SEQ ID NO: 150584 - DNA, 25 bp, Homo sapien
cacttgtcaggtcaagggcaggaca

SEQ ID NO: 150585 - DNA, 25 bp, Homo sapien
cggcctggcaaagttcctgtggaaa

SEQ ID NO: 150586 - DNA, 25 bp, Homo sapien
aggttctacagccaccgagcggttt

SEQ ID NO: 150587 - DNA, 25 bp, Homo sapien
gcgcagccgagatccacttgtcagg

SEQ ID NO: 150588 - DNA, 25 bp, Homo sapien
cttgcttgcgaacaggaaatttctc

SEQ ID NO: 150589 - DNA, 25 bp, Homo sapien
atttctccttgatgaggtgctgccc

SEQ ID NO: 150590 - DNA, 25 bp, Homo sapien
catgttttgaaactcctgcggcgtc

SEQ ID NO: 150591 - DNA, 25 bp, Homo sapien
cgcagattagtcaccgctcggctct

SEQ ID NO: 150592 - DNA, 25 bp, Homo sapien
aggccagcctcggattaaacctgga

SEQ ID NO: 150593 - DNA, 25 bp, Homo sapien
gtatacccgcacactgaaggccagc

SEQ ID NO: 150594 - DNA, 25 bp, Homo sapien
ctgcatgcctgtctagaccgatcta

SEQ ID NO: 150595 - DNA, 25 bp, Homo sapien
cgctgggcagtcctatttttatctt

SEQ ID NO: 150596 - DNA, 25 bp, Homo sapien
cttgtctaatcctaaactgggcggg

SEQ ID NO: 150597 - DNA, 25 bp, Homo sapien
cacaggcgtcgtgcttagagaacaa

SEQ ID NO: 150598 - DNA, 25 bp, Homo sapien
gtgcagcccattgatccggagaaca

SEQ ID NO: 150599 - DNA, 25 bp, Homo sapien
cacctactggtgacagcgcctcaaa

SEQ ID NO: 150600 - DNA, 25 bp, Homo sapien
tctgcgcatattttacccggctggg

SEQ ID NO: 150601 - DNA, 25 bp, Homo sapien
cccttctcaaggcaggttgactctg

SEQ ID NO: 150602 - DNA, 25 bp, Homo sapien
gttgactctgcaagacccgctaggg

SEQ ID NO: 150603 - DNA, 25 bp, Homo sapien
gaggcgcatcctcctcccaggattt

SEQ ID NO: 150604 - DNA, 25 bp, Homo sapien
gaccctggccttctaaccttgtgtg

SEQ ID NO: 150605 - DNA, 25 bp, Homo sapien
gttctcagggcgatgacacttggta

SEQ ID NO: 150606 - DNA, 25 bp, Homo sapien
tctgggcttatccaatggcacttta

SEQ ID NO: 150607 - DNA, 25 bp, Homo sapien
cccgcctcggctgcttatttagcaa

SEQ ID NO: 150608 - DNA, 25 bp, Homo sapien
gcgcgtcctgacacgccgccagcac

SEQ ID NO: 150609 - DNA, 25 bp, Homo sapien
ccagcgctcgaacgcggagagcagc

SEQ ID NO: 150610 - DNA, 25 bp, Homo sapien
gagtcgggagctcccagcgctcgaa

SEQ ID NO: 150611 - DNA, 25 bp, Homo sapien
aacaagcgagaagggcgcaacacaa

SEQ ID NO: 150612 - DNA, 25 bp, Homo sapien
cacgagacaaacaagcgagaagggc

SEQ ID NO: 150613 - DNA, 25 bp, Homo sapien
cgaggctcacacgagacaaacaagc

SEQ ID NO: 150614 - DNA, 25 bp, Homo sapien
cggtttacgaggctcacacgagaca

SEQ ID NO: 150615 - DNA, 25 bp, Homo sapien
cccacactttggcaggtcccagagc

SEQ ID NO: 150616 - DNA, 25 bp, Homo sapien
aggccatttatctctcgccagagtg

SEQ ID NO: 150617 - DNA, 25 bp, Homo sapien
ctttcttggcggcttacagtcttga

SEQ ID NO: 150618 - DNA, 25 bp, Homo sapien
cggtgaaatccgaggagctctcttg

SEQ ID NO: 150619 - DNA, 25 bp, Homo sapien
ccgcgagtaacaatggcagcgatca

SEQ ID NO: 150620 - DNA, 25 bp, Homo sapien
ggcacctcgccaccgagtgtcattg

SEQ ID NO: 150621 - DNA, 25 bp, Homo sapien
cggaacgtttccttcacctgctcgg

SEQ ID NO: 150622 - DNA, 25 bp, Homo sapien
tttggcggctaatccaccgagagtc

SEQ ID NO: 150623 - DNA, 25 bp, Homo sapien
atgcacgtgcactctggataccctc

SEQ ID NO: 150624 - DNA, 25 bp, Homo sapien
gcctttactgaccaggtggcctcga

SEQ ID NO: 150625 - DNA, 25 bp, Homo sapien
cctggggcagcttaactcgttcagc

SEQ ID NO: 150626 - DNA, 25 bp, Homo sapien
tctgggcacagctcacttaggaatc

SEQ ID NO: 150627 - DNA, 25 bp, Homo sapien
tgcaaagccattccagcctcggagc

SEQ ID NO: 150628 - DNA, 25 bp, Homo sapien
ccgtggctggcaggaaattaatatt

SEQ ID NO: 150629 - DNA, 25 bp, Homo sapien
cgggtgctacaactgctgtcttgct

SEQ ID NO: 150630 - DNA, 25 bp, Homo sapien
gcgaaaacccagtggctccgagttc

SEQ ID NO: 150631 - DNA, 25 bp, Homo sapien
gggactcctagcgtaattaaagatc

SEQ ID NO: 150632 - DNA, 25 bp, Homo sapien
tgagatcaagtttcaggccgcgctg

SEQ ID NO: 150633 - DNA, 25 bp, Homo sapien
gccacgactgaacggttgcgatcta

SEQ ID NO: 150634 - DNA, 25 bp, Homo sapien
acactgtcctttcgacgtgagatca

SEQ ID NO: 150635 - DNA, 25 bp, Homo sapien
tatactaccggatctaggccattgt

SEQ ID NO: 150636 - DNA, 25 bp, Homo sapien
atttgtctttcgctcactcgggccg

SEQ ID NO: 150637 - DNA, 25 bp, Homo sapien
gggtatccggagagagaaacacctc

SEQ ID NO: 150638 - DNA, 25 bp, Homo sapien
ggatatgctcagaacccaggcgctt

SEQ ID NO: 150639 - DNA, 25 bp, Homo sapien
cctccaagtcactagagtatttgtc

SEQ ID NO: 150640 - DNA, 25 bp, Homo sapien
ccgccgctctagcagctgagaatca

SEQ ID NO: 150641 - DNA, 25 bp, Homo sapien
cccggctttcatggctctgggtttc

SEQ ID NO: 150642 - DNA, 25 bp, Homo sapien
aggtctgcagctgacaaatattatc

SEQ ID NO: 150643 - DNA, 25 bp, Homo sapien
gtccggatctttccctggcagcagc

SEQ ID NO: 150644 - DNA, 25 bp, Homo sapien
cagctggcgatctctcccgagagag

SEQ ID NO: 150645 - DNA, 25 bp, Homo sapien
gaagcccgaggtgccctgtcaccag

SEQ ID NO: 150646 - DNA, 25 bp, Homo sapien
cgtgctgttccttgtgtctgtgtct

SEQ ID NO: 150647 - DNA, 25 bp, Homo sapien
ccatcgatcgcggagtgtacagatg

SEQ ID NO: 150648 - DNA, 25 bp, Homo sapien
tcaacgtgttatcgcttctcccgcg

SEQ ID NO: 150649 - DNA, 25 bp, Homo sapien
gccgtccctggtgaaagcgtggcct

SEQ ID NO: 150650 - DNA, 25 bp, Homo sapien
gactcccgcgatggtcaacgtgtta

SEQ ID NO: 150651 - DNA, 25 bp, Homo sapien
tgagaaacgacctctggttcccgga

SEQ ID NO: 150652 - DNA, 25 bp, Homo sapien
gagcggattttaatcctgagaaacg

SEQ ID NO: 150653 - DNA, 25 bp, Homo sapien
cacgctgacccaggtcggggacgat

SEQ ID NO: 150654 - DNA, 25 bp, Homo sapien
ctcctcgaaacgctggagcggattt

SEQ ID NO: 150655 - DNA, 25 bp, Homo sapien
gaaagcgtggcctgtagtgtcgccc

SEQ ID NO: 150656 - DNA, 25 bp, Homo sapien
ttttgcatcaaggagctcaggaagc

SEQ ID NO: 150657 - DNA, 25 bp, Homo sapien
gggctttgtcatcggaacgcacaca

SEQ ID NO: 150658 - DNA, 25 bp, Homo sapien
gggtctcccagtccacaagtggctc

SEQ ID NO: 150659 - DNA, 25 bp, Homo sapien
cagccgggctttgttttgtctcttg

SEQ ID NO: 150660 - DNA, 25 bp, Homo sapien
ctagcctaagtggaacctgaaactc

SEQ ID NO: 150661 - DNA, 25 bp, Homo sapien
acaaagctacgtggagggtctccca

SEQ ID NO: 150662 - DNA, 25 bp, Homo sapien
cattatggtggctcctgttgctcga

SEQ ID NO: 150663 - DNA, 25 bp, Homo sapien
gaggcctcctacagctcatgaatga

SEQ ID NO: 150664 - DNA, 25 bp, Homo sapien
ctggcgttggggctttttacgcaga

SEQ ID NO: 150665 - DNA, 25 bp, Homo sapien
ctgcctgagcccatctgcgaggaag

SEQ ID NO: 150666 - DNA, 25 bp, Homo sapien
acctggggccggtcacgctgcctga

SEQ ID NO: 150667 - DNA, 25 bp, Homo sapien
tcgctatctgcgaggcagggtgaac

SEQ ID NO: 150668 - DNA, 25 bp, Homo sapien
caccgctgctaaatgaatcacgagg

SEQ ID NO: 150669 - DNA, 25 bp, Homo sapien
acaggctttctgcaccgctgctaaa

SEQ ID NO: 150670 - DNA, 25 bp, Homo sapien
ggctgcggaggtaaacaggctttct

SEQ ID NO: 150671 - DNA, 25 bp, Homo sapien
tttacgcagatcgagtcgcccaggg

SEQ ID NO: 150672 - DNA, 25 bp, Homo sapien
atccatggggtttcgcgagctgaaa

SEQ ID NO: 150673 - DNA, 25 bp, Homo sapien
gagcctctctcaacgccggcaagtg

SEQ ID NO: 150674 - DNA, 25 bp, Homo sapien
ttgcgaaacacggagcgaacaggtc

SEQ ID NO: 150675 - DNA, 25 bp, Homo sapien
gccagcagccgtcatttcccgggaa

SEQ ID NO: 150676 - DNA, 25 bp, Homo sapien
gatgggaacccacaagcctgactgt

SEQ ID NO: 150677 - DNA, 25 bp, Homo sapien
ttcctaaggatactagcgtgcgcgc

SEQ ID NO: 150678 - DNA, 25 bp, Homo sapien
agtgatcgtgagcaacccggaacca

SEQ ID NO: 150679 - DNA, 25 bp, Homo sapien
caacctggactgacgaactgggctc

SEQ ID NO: 150680 - DNA, 25 bp, Homo sapien
gcaaagttcggatcttcctggccac

SEQ ID NO: 150681 - DNA, 25 bp, Homo sapien
tcaccgttgagctggttgtagacca

SEQ ID NO: 150682 - DNA, 25 bp, Homo sapien
cgatgcccacgaacaccaggatgtt

SEQ ID NO: 150683 - DNA, 25 bp, Homo sapien
tacacggagaacaggacgatgccca

SEQ ID NO: 150684 - DNA, 25 bp, Homo sapien
ttcggcttcggggaccatgagccgc

SEQ ID NO: 150685 - DNA, 25 bp, Homo sapien
cctgcaggcggcagtacacggagaa

SEQ ID NO: 150686 - DNA, 25 bp, Homo sapien
atgttcaccgtcagcaaagttcgga

SEQ ID NO: 150687 - DNA, 25 bp, Homo sapien
gctcacgatgcgcacgagctcctgg

SEQ ID NO: 150688 - DNA, 25 bp, Homo sapien
taccgcgactccaagcagacgttgc

SEQ ID NO: 150689 - DNA, 25 bp, Homo sapien
ttgagcaaacgtggtcgcctaattc

SEQ ID NO: 150690 - DNA, 25 bp, Homo sapien
atgcaaatggcgtctcgcgtcgtcc

SEQ ID NO: 150691 - DNA, 25 bp, Homo sapien
agccgcccttactcgactggggtga

SEQ ID NO: 150692 - DNA, 25 bp, Homo sapien
ttgcaagaagactgttccgcgcctt

SEQ ID NO: 150693 - DNA, 25 bp, Homo sapien
ccgcgtggcacctcagaagaacgtg

SEQ ID NO: 150694 - DNA, 25 bp, Homo sapien
aggcgtcttcaagggttctggcaga

SEQ ID NO: 150695 - DNA, 25 bp, Homo sapien
tttcggacctgaacctcgtggacta

SEQ ID NO: 150696 - DNA, 25 bp, Homo sapien
tcctcctccgaggtgagtttttaga

SEQ ID NO: 150697 - DNA, 25 bp, Homo sapien
tgagtttttagactatttggaggcc

SEQ ID NO: 150698 - DNA, 25 bp, Homo sapien
tcagatcgaaagagccacttcacgc

SEQ ID NO: 150699 - DNA, 25 bp, Homo sapien
ggggtgtctcagatcgaaagagcca

SEQ ID NO: 150700 - DNA, 25 bp, Homo sapien
taagatttcactccgctctgggctg

SEQ ID NO: 150701 - DNA, 25 bp, Homo sapien
agcagccacggcttctaagatttca

SEQ ID NO: 150702 - DNA, 25 bp, Homo sapien
gactccagcattccgttcaaaccca

SEQ ID NO: 150703 - DNA, 25 bp, Homo sapien
cgagcagccgcgtgcaaaggagccc

SEQ ID NO: 150704 - DNA, 25 bp, Homo sapien
tgcgtcgccagccagagagaaatgt

SEQ ID NO: 150705 - DNA, 25 bp, Homo sapien
tcgccagccagagagaaatgtgcct

SEQ ID NO: 150706 - DNA, 25 bp, Homo sapien
aaatgtgcctgctgaacagtcagtg

SEQ ID NO: 150707 - DNA, 25 bp, Homo sapien
atggacgccgaacacaactttgctg

SEQ ID NO: 150708 - DNA, 25 bp, Homo sapien
caactttgctgcgtgtgctttctat

SEQ ID NO: 150709 - DNA, 25 bp, Homo sapien
cgtgtgctttctatttggctgggga

SEQ ID NO: 150710 - DNA, 25 bp, Homo sapien
gctccctgcctctcagcgcagacgg

SEQ ID NO: 150711 - DNA, 25 bp, Homo sapien
aggacgcctgaaacggagctccctg

SEQ ID NO: 150712 - DNA, 25 bp, Homo sapien
ccagctggaggcttcccatttaacc

SEQ ID NO: 150713 - DNA, 25 bp, Homo sapien
tctgcccaacgaggtggacggacac

SEQ ID NO: 150714 - DNA, 25 bp, Homo sapien
ttcggattccatcttctgccgcgga

SEQ ID NO: 150715 - DNA, 25 bp, Homo sapien
tcttctgccgcggacgcatccggga

SEQ ID NO: 150716 - DNA, 25 bp, Homo sapien
acgctggggacaccgcctggagcct

SEQ ID NO: 150717 - DNA, 25 bp, Homo sapien
ccgcgcatagcaccggggcgttttt

SEQ ID NO: 150718 - DNA, 25 bp, Homo sapien
cgagcactcggcgtgcagatgtctg

SEQ ID NO: 150719 - DNA, 25 bp, Homo sapien
taacctctaaggtgccagaagatcc

SEQ ID NO: 150720 - DNA, 25 bp, Homo sapien
cccttcagagtacggagatgcattt

SEQ ID NO: 150721 - DNA, 25 bp, Homo sapien
ttaagtcccgcctatcaggctgtcg

SEQ ID NO: 150722 - DNA, 25 bp, Homo sapien
gcgggactgcccgacttttcaatcg

SEQ ID NO: 150723 - DNA, 25 bp, Homo sapien
gaccgtcgctcgagactggcagaaa

SEQ ID NO: 150724 - DNA, 25 bp, Homo sapien
acagacaccctggttggagaccgtc

SEQ ID NO: 150725 - DNA, 25 bp, Homo sapien
gtgctcggcgtctgtatacttgtta

SEQ ID NO: 150726 - DNA, 25 bp, Homo sapien
tggcttcttcccagtaggtgctcgg

SEQ ID NO: 150727 - DNA, 25 bp, Homo sapien
accatggctgtgtttgtcgtgctcc

SEQ ID NO: 150728 - DNA, 25 bp, Homo sapien
aaacctgctgctgatggcgtgccac

SEQ ID NO: 150729 - DNA, 25 bp, Homo sapien
ggagcactttacagcggttacatga

SEQ ID NO: 150730 - DNA, 25 bp, Homo sapien
ggcgtgccactgtaccaacgtgatg

SEQ ID NO: 150731 - DNA, 25 bp, Homo sapien
gggtactcggctttgcgctctattt

SEQ ID NO: 150732 - DNA, 25 bp, Homo sapien
cgtctggagcactttacggtagtca

SEQ ID NO: 150733 - DNA, 25 bp, Homo sapien
ttccgggaatacgtgagcagcactc

SEQ ID NO: 150734 - DNA, 25 bp, Homo sapien
ccgctggctgcctttaaagacatga

SEQ ID NO: 150735 - DNA, 25 bp, Homo sapien
tcccgcagaacattggcatgtagtc

SEQ ID NO: 150736 - DNA, 25 bp, Homo sapien
cccacttgggtgacgtctgacgtct

SEQ ID NO: 150737 - DNA, 25 bp, Homo sapien
cagtgcacatctccatttctgttga

SEQ ID NO: 150738 - DNA, 25 bp, Homo sapien
gaacaggacacttgcgctctgggtc

SEQ ID NO: 150739 - DNA, 25 bp, Homo sapien
caggcagctgcgcagcagtaacagg

SEQ ID NO: 150740 - DNA, 25 bp, Homo sapien
agtaacaggcagtggcccgccttca

SEQ ID NO: 150741 - DNA, 25 bp, Homo sapien
tctcccacttggaaccaggaggttg

SEQ ID NO: 150742 - DNA, 25 bp, Homo sapien
cggcgaccacaagaccagatagcca

SEQ ID NO: 150743 - DNA, 25 bp, Homo sapien
gccttcacccagttcttgtactcgg

SEQ ID NO: 150744 - DNA, 25 bp, Homo sapien
catcgcttcctaagtggggcacaaa

SEQ ID NO: 150745 - DNA, 25 bp, Homo sapien
ccttccgacaggtctgtgtctgttc

SEQ ID NO: 150746 - DNA, 25 bp, Homo sapien
gtcgtcaccgggaacgtcagcagtt

SEQ ID NO: 150747 - DNA, 25 bp, Homo sapien
ccctggcgttgtaaaggcgacaatt

SEQ ID NO: 150748 - DNA, 25 bp, Homo sapien
cgcgcttgtgattctcaggcctttg

SEQ ID NO: 150749 - DNA, 25 bp, Homo sapien
tgcccagagaaatccaccatcgctt

SEQ ID NO: 150750 - DNA, 25 bp, Homo sapien
aacgtacatgttgactgcccgaggc

SEQ ID NO: 150751 - DNA, 25 bp, Homo sapien
ggaggcctcctctaaatgttcgtga

SEQ ID NO: 150752 - DNA, 25 bp, Homo sapien
ccgacctggtagcacaggccgcaga

SEQ ID NO: 150753 - DNA, 25 bp, Homo sapien
atgctcctccgcatcaggacgactt

SEQ ID NO: 150754 - DNA, 25 bp, Homo sapien
gcatcaggacgacttccttctctcg

SEQ ID NO: 150755 - DNA, 25 bp, Homo sapien
acttccttctctcgctggtgctgtg

SEQ ID NO: 150756 - DNA, 25 bp, Homo sapien
ctctttcgcttctagtcgctcagta

SEQ ID NO: 150757 - DNA, 25 bp, Homo sapien
ttctagtcgctcagtaagcctctca

SEQ ID NO: 150758 - DNA, 25 bp, Homo sapien
atccaccagggacggcgcagtgtac

SEQ ID NO: 150759 - DNA, 25 bp, Homo sapien
cctctcaatttcctggcgcatctgg

SEQ ID NO: 150760 - DNA, 25 bp, Homo sapien
cgccatattgacgaggacgggcatc

SEQ ID NO: 150761 - DNA, 25 bp, Homo sapien
ggccagccggaagaaacagtactgc

SEQ ID NO: 150762 - DNA, 25 bp, Homo sapien
ttggtttgccggatccgccatattg

SEQ ID NO: 150763 - DNA, 25 bp, Homo sapien
cgaggagcgagctacttcaaagcca

SEQ ID NO: 150764 - DNA, 25 bp, Homo sapien
tgacgcaggagaaacgcaccgcccg

SEQ ID NO: 150765 - DNA, 25 bp, Homo sapien
tgcagccttttggttgagacgcccg

SEQ ID NO: 150766 - DNA, 25 bp, Homo sapien
agtactgcgcgaacaatctttaccg

SEQ ID NO: 150767 - DNA, 25 bp, Homo sapien
atttctggccgtagcacgaccctga

SEQ ID NO: 150768 - DNA, 25 bp, Homo sapien
ctcaggggcttcacgctgtcaacac

SEQ ID NO: 150769 - DNA, 25 bp, Homo sapien
cacggcagccttccagcaaatcggg

SEQ ID NO: 150770 - DNA, 25 bp, Homo sapien
tagtgctctctctcagtccgcacgg

SEQ ID NO: 150771 - DNA, 25 bp, Homo sapien
gtgtttcggtgagtagtgctctctc

SEQ ID NO: 150772 - DNA, 25 bp, Homo sapien
cgcgtacctggaagacgggagaaca

SEQ ID NO: 150773 - DNA, 25 bp, Homo sapien
agggagatcctaccgcgtacctgga

SEQ ID NO: 150774 - DNA, 25 bp, Homo sapien
tgctggacagagaccgtcacacggg

SEQ ID NO: 150775 - DNA, 25 bp, Homo sapien
atcgggattttatgccaaactcgcc

SEQ ID NO: 150776 - DNA, 25 bp, Homo sapien
ccggttctatcacgcgcatccgtta

SEQ ID NO: 150777 - DNA, 25 bp, Homo sapien
ctcgcgtggagcacgactgcgcaaa

SEQ ID NO: 150778 - DNA, 25 bp, Homo sapien
gaatgaaaaccgtcctgcgaacttg

SEQ ID NO: 150779 - DNA, 25 bp, Homo sapien
ccgggtcttccgaagtgaggatatg

SEQ ID NO: 150780 - DNA, 25 bp, Homo sapien
ttgacatatttcttgctggcggcgt

SEQ ID NO: 150781 - DNA, 25 bp, Homo sapien
tccgttaggaactaagcggcacctg

SEQ ID NO: 150782 - DNA, 25 bp, Homo sapien
acttgaacttcactagggaggcggc

SEQ ID NO: 150783 - DNA, 25 bp, Homo sapien
tgaggatatgctgccctctagaggc

SEQ ID NO: 150784 - DNA, 25 bp, Homo sapien
cgcttcccagcgatgtttgccatga

SEQ ID NO: 150785 - DNA, 25 bp, Homo sapien
ggcggatcagcctccattacaaacc

SEQ ID NO: 150786 - DNA, 25 bp, Homo sapien
ctcaggttggtaactgtgcaaagcc

SEQ ID NO: 150787 - DNA, 25 bp, Homo sapien
acaaaccgctgtaggaggggccaga

SEQ ID NO: 150788 - DNA, 25 bp, Homo sapien
ccgggccgtcgttgaatccctgcat

SEQ ID NO: 150789 - DNA, 25 bp, Homo sapien
tgtttgccatgactgctgcgagttc

SEQ ID NO: 150790 - DNA, 25 bp, Homo sapien
gctgcaaccacggaaaaggcggatc

SEQ ID NO: 150791 - DNA, 25 bp, Homo sapien
ttgcggatttaaacaccacactgtg

SEQ ID NO: 150792 - DNA, 25 bp, Homo sapien
ctccgaggctgagactagggtttta

SEQ ID NO: 150793 - DNA, 25 bp, Homo sapien
tgccgccctctcagtttcgggaatc

SEQ ID NO: 150794 - DNA, 25 bp, Homo sapien
ctcgagagaactgggacagcatttc

SEQ ID NO: 150795 - DNA, 25 bp, Homo sapien
ttcgcaccctaagctccaaggcagg

SEQ ID NO: 150796 - DNA, 25 bp, Homo sapien
agttctcggtactcttcagggatga

SEQ ID NO: 150797 - DNA, 25 bp, Homo sapien
ggaaatcccttgagcttagacctga

SEQ ID NO: 150798 - DNA, 25 bp, Homo sapien
ggtatattagatccgtggccgcgcg

SEQ ID NO: 150799 - DNA, 25 bp, Homo sapien
ggccttcgcggtggaacaaacactc

SEQ ID NO: 150800 - DNA, 25 bp, Homo sapien
accactgtgtcacgcacggttgcca

SEQ ID NO: 150801 - DNA, 25 bp, Homo sapien
gtttcgcaaggacgtgacctttatg

SEQ ID NO: 150802 - DNA, 25 bp, Homo sapien
gaactagttttctgaagcccgcgga

SEQ ID NO: 150803 - DNA, 25 bp, Homo sapien
gcggaaacgtccagcccagtgactc

SEQ ID NO: 150804 - DNA, 25 bp, Homo sapien
tgaggaacgtttctggcaccaggca

SEQ ID NO: 150805 - DNA, 25 bp, Homo sapien
acctaactgtgtccgggcctgccgt

SEQ ID NO: 150806 - DNA, 25 bp, Homo sapien
ggcgcgagcccgcacctaactgtgt

SEQ ID NO: 150807 - DNA, 25 bp, Homo sapien
gcattctgcgactccaggtgcgtga

SEQ ID NO: 150808 - DNA, 25 bp, Homo sapien
tggacctcagccaggtgaccttcgg

SEQ ID NO: 150809 - DNA, 25 bp, Homo sapien
agcatctgctgctcaacgacaacct

SEQ ID NO: 150810 - DNA, 25 bp, Homo sapien
tcctccgatggcctctgtgtggacc

SEQ ID NO: 150811 - DNA, 25 bp, Homo sapien
ggagctgaacctcaccacgtccagt

SEQ ID NO: 150812 - DNA, 25 bp, Homo sapien
ggaccgcaacagcatcgccttcgtg

SEQ ID NO: 150813 - DNA, 25 bp, Homo sapien
tgcgcacgctcaacctgggtggcaa

SEQ ID NO: 150814 - DNA, 25 bp, Homo sapien
ttccgcaacccgtggtgctgcgact

SEQ ID NO: 150815 - DNA, 25 bp, Homo sapien
tggccgagctcgagctgctctacct

SEQ ID NO: 150816 - DNA, 25 bp, Homo sapien
agctcgtacacatcctcgaacagca

SEQ ID NO: 150817 - DNA, 25 bp, Homo sapien
atcctcgaacagcacgtcgtcgtcg

SEQ ID NO: 150818 - DNA, 25 bp, Homo sapien
agcacgtcgtcgtcggccatggtcc

SEQ ID NO: 150819 - DNA, 25 bp, Homo sapien
ccgcagcgtggagggcttcgaaaac

SEQ ID NO: 150820 - DNA, 25 bp, Homo sapien
ggggcgcccaagagctcagtgccca

SEQ ID NO: 150821 - DNA, 25 bp, Homo sapien
ggcgcggcttccagaaccacaggct

SEQ ID NO: 150822 - DNA, 25 bp, Homo sapien
agagactgcggcgccttcctctgca

SEQ ID NO: 150823 - DNA, 25 bp, Homo sapien
ccctcggtgccgaggacgctcgagt

SEQ ID NO: 150824 - DNA, 25 bp, Homo sapien
ggtggcttcctttccttcgacacca

SEQ ID NO: 150825 - DNA, 25 bp, Homo sapien
aatctctgtacgttgcgcggtgtgc

SEQ ID NO: 150826 - DNA, 25 bp, Homo sapien
gtgccgggctcatttgccttcatta

SEQ ID NO: 150827 - DNA, 25 bp, Homo sapien
tccagactgctgaccggaagtcgcc

SEQ ID NO: 150828 - DNA, 25 bp, Homo sapien
atgcttgattcgtcccacttttggg

SEQ ID NO: 150829 - DNA, 25 bp, Homo sapien
ggtgtgccgcaaggatgcttgattc

SEQ ID NO: 150830 - DNA, 25 bp, Homo sapien
acgcactgaatcttctccttcgaca

SEQ ID NO: 150831 - DNA, 25 bp, Homo sapien
ttcgacatcgcgcactgaatcttcc

SEQ ID NO: 150832 - DNA, 25 bp, Homo sapien
ttcagcgcttacaacccgagcagtc

SEQ ID NO: 150833 - DNA, 25 bp, Homo sapien
ctaagagtgggtaccgagaacagcc

SEQ ID NO: 150834 - DNA, 25 bp, Homo sapien
cctgtccgaatggagcgtccgttct

SEQ ID NO: 150835 - DNA, 25 bp, Homo sapien
tccgtctcggatccgctagccagtt

SEQ ID NO: 150836 - DNA, 25 bp, Homo sapien
cagttcccagtggagcacgtcctca

SEQ ID NO: 150837 - DNA, 25 bp, Homo sapien
ccggtcttagcgagagtactgactc

SEQ ID NO: 150838 - DNA, 25 bp, Homo sapien
tactgactccgactccaagagtggc

SEQ ID NO: 150839 - DNA, 25 bp, Homo sapien
accagctcgaactcctccgatgggg

SEQ ID NO: 150840 - DNA, 25 bp, Homo sapien
ggagttgatagaagggtccttccca

SEQ ID NO: 150841 - DNA, 25 bp, Homo sapien
cccgggtatcagctgaaacatcagc

SEQ ID NO: 150842 - DNA, 25 bp, Homo sapien
tatcaaaagaaggatcggctccgcc

SEQ ID NO: 150843 - DNA, 25 bp, Homo sapien
gtgcctacgacccaggagcgtgtca

SEQ ID NO: 150844 - DNA, 25 bp, Homo sapien
cgtgtcagccaaagcatggagaatc

SEQ ID NO: 150845 - DNA, 25 bp, Homo sapien
atcggaggtggcatttcaggtcagt

SEQ ID NO: 150846 - DNA, 25 bp, Homo sapien
ggcgctcccggagtatcagcaaaag

SEQ ID NO: 150847 - DNA, 25 bp, Homo sapien
tatcgcgggccacatgttcgacgta

SEQ ID NO: 150848 - DNA, 25 bp, Homo sapien
actgaggtcactacactgccctccg

SEQ ID NO: 150849 - DNA, 25 bp, Homo sapien
ccgagtcaaaggcttagtgttcaca

SEQ ID NO: 150850 - DNA, 25 bp, Homo sapien
ccaggtctcagtcggtcccagacaa

SEQ ID NO: 150851 - DNA, 25 bp, Homo sapien
gggtctcagtcggtccccggcacag

SEQ ID NO: 150852 - DNA, 25 bp, Homo sapien
gtcggtcccagacaagggccgcagc

SEQ ID NO: 150853 - DNA, 25 bp, Homo sapien
gtctcagtcggtcccagacaagggc

SEQ ID NO: 150854 - DNA, 25 bp, Homo sapien
cccgtgtccttctcctgacctggct

SEQ ID NO: 150855 - DNA, 25 bp, Homo sapien
cctgacctggctgctcacggccacg

SEQ ID NO: 150856 - DNA, 25 bp, Homo sapien
caccacgaccacgtcgcatttgttg

SEQ ID NO: 150857 - DNA, 25 bp, Homo sapien
agcgcctcggcgagccgctatatta

SEQ ID NO: 150858 - DNA, 25 bp, Homo sapien
acgtcgcatttgttgctcatggcgc

SEQ ID NO: 150859 - DNA, 25 bp, Homo sapien
gcgcacagccgcgactaacctgaga

SEQ ID NO: 150860 - DNA, 25 bp, Homo sapien
gcagccacctgtccgagcgcgtgaa

SEQ ID NO: 150861 - DNA, 25 bp, Homo sapien
gcacggcgctctggacccactagag

SEQ ID NO: 150862 - DNA, 25 bp, Homo sapien
cccaaaggagggttcagtgcacggc

SEQ ID NO: 150863 - DNA, 25 bp, Homo sapien
ctgctccgttttctgggcctcgatc

SEQ ID NO: 150864 - DNA, 25 bp, Homo sapien
agtcttgctggccagaacccgggtc

SEQ ID NO: 150865 - DNA, 25 bp, Homo sapien
cctggaagatcctccatgcagtctt

SEQ ID NO: 150866 - DNA, 25 bp, Homo sapien
gcggcctgttcaccttgtcgaccag

SEQ ID NO: 150867 - DNA, 25 bp, Homo sapien
ctgttcaccttgtcgaccaggctga

SEQ ID NO: 150868 - DNA, 25 bp, Homo sapien
ctgcgggtccgtaatgtgcagcagc

SEQ ID NO: 150869 - DNA, 25 bp, Homo sapien
tccgtaatgtgcagcagcgggacgc

SEQ ID NO: 150870 - DNA, 25 bp, Homo sapien
ccatgcagtcttgctggccagaacc

SEQ ID NO: 150871 - DNA, 25 bp, Homo sapien
aagatcctccatgcagtcttgctgg

SEQ ID NO: 150872 - DNA, 25 bp, Homo sapien
gcccttcctactcacgttgcggttg

SEQ ID NO: 150873 - DNA, 25 bp, Homo sapien
ttggcccccacgttgcctggagacg

SEQ ID NO: 150874 - DNA, 25 bp, Homo sapien
cagtgtccgaaaatccagggtccca

SEQ ID NO: 150875 - DNA, 25 bp, Homo sapien
cgctcagtgtccgaaaatccagggt

SEQ ID NO: 150876 - DNA, 25 bp, Homo sapien
ctcacgttgcggttgaagctgttgc

SEQ ID NO: 150877 - DNA, 25 bp, Homo sapien
gggagctgtgacctcggacgccctt

SEQ ID NO: 150878 - DNA, 25 bp, Homo sapien
ggccacgccacgaccctgcctggac

SEQ ID NO: 150879 - DNA, 25 bp, Homo sapien
cggttgaagctgttgcccggcagca

SEQ ID NO: 150880 - DNA, 25 bp, Homo sapien
tcatccggcccaacaacggcttttg

SEQ ID NO: 150881 - DNA, 25 bp, Homo sapien
tcaacgtattcttcgagggcattca

SEQ ID NO: 150882 - DNA, 25 bp, Homo sapien
taaaggtgcctgttaccgatgctcg

SEQ ID NO: 150883 - DNA, 25 bp, Homo sapien
gactcgcgtctctacgacttttttg

SEQ ID NO: 150884 - DNA, 25 bp, Homo sapien
accatcgatatgaggcagggccgta

SEQ ID NO: 150885 - DNA, 25 bp, Homo sapien
cggcttttgggaacagctcatcaat

SEQ ID NO: 150886 - DNA, 25 bp, Homo sapien
tgtgccttgcgtacctcatgaaata

SEQ ID NO: 150887 - DNA, 25 bp, Homo sapien
cgccattgtcaatgcctcggtggaa

SEQ ID NO: 150888 - DNA, 25 bp, Homo sapien
tgccggggaagtttgtgtctccaac

SEQ ID NO: 150889 - DNA, 25 bp, Homo sapien
ccgccgctttcggtgatgaggaaaa

SEQ ID NO: 150890 - DNA, 25 bp, Homo sapien
cgatgtgaccctacagccgaaagcc

SEQ ID NO: 150891 - DNA, 25 bp, Homo sapien
gctcgggcagctagcaagttaagtg

SEQ ID NO: 150892 - DNA, 25 bp, Homo sapien
ccaccggctagaattggcctgcgtc

SEQ ID NO: 150893 - DNA, 25 bp, Homo sapien
aggaagctccctctcggtgacaacc

SEQ ID NO: 150894 - DNA, 25 bp, Homo sapien
ggcaaatgccgtccttggcgtcttc

SEQ ID NO: 150895 - DNA, 25 bp, Homo sapien
gataaagttggtgtgctggtcccgc

SEQ ID NO: 150896 - DNA, 25 bp, Homo sapien
cgagttgacagccagcgtgtagagc

SEQ ID NO: 150897 - DNA, 25 bp, Homo sapien
ccagcgtgtagagcaggcgcagctt

SEQ ID NO: 150898 - DNA, 25 bp, Homo sapien
cgcagcttgtcacggtcggtgaagt

SEQ ID NO: 150899 - DNA, 25 bp, Homo sapien
cacggtcggtgaagtggtccatgaa

SEQ ID NO: 150900 - DNA, 25 bp, Homo sapien
tggtccatgaagatgctgccggcgt

SEQ ID NO: 150901 - DNA, 25 bp, Homo sapien
tctgcatagcgcctgaccacgcgat

SEQ ID NO: 150902 - DNA, 25 bp, Homo sapien
tagcgcctgaccacgcgatccagga

SEQ ID NO: 150903 - DNA, 25 bp, Homo sapien
acgcgatccaggagtcgctgcgaag

SEQ ID NO: 150904 - DNA, 25 bp, Homo sapien
catcattaacactagtggccagggc

SEQ ID NO: 150905 - DNA, 25 bp, Homo sapien
gatacgaacatcacccagccatagg

SEQ ID NO: 150906 - DNA, 25 bp, Homo sapien
tggttatacggctgcgtgcccttca

SEQ ID NO: 150907 - DNA, 25 bp, Homo sapien
ggccagggcaccatgtacaacttca

SEQ ID NO: 150908 - DNA, 25 bp, Homo sapien
acggtggcactgacgttaaacatca

SEQ ID NO: 150909 - DNA, 25 bp, Homo sapien
gacgtcaggtcaactgccgcagagc

SEQ ID NO: 150910 - DNA, 25 bp, Homo sapien
tgtctgcaatcagggcccacaccag

SEQ ID NO: 150911 - DNA, 25 bp, Homo sapien
aagacgattgtcaccagccagagga

SEQ ID NO: 150912 - DNA, 25 bp, Homo sapien
ggagcggtggtcctcatttcccttc

SEQ ID NO: 150913 - DNA, 25 bp, Homo sapien
cgagggagcaccctgacgcaagcgc

SEQ ID NO: 150914 - DNA, 25 bp, Homo sapien
gctgttgcagtctccagctgcagga

SEQ ID NO: 150915 - DNA, 25 bp, Homo sapien
tgaaccctaagggaggcagcttttc

SEQ ID NO: 150916 - DNA, 25 bp, Homo sapien
ccggcagacaatactcaagcaactc

SEQ ID NO: 150917 - DNA, 25 bp, Homo sapien
tcccatggtccctacagtcttcggg

SEQ ID NO: 150918 - DNA, 25 bp, Homo sapien
tggactgtgaagagaagggcaacct

SEQ ID NO: 150919 - DNA, 25 bp, Homo sapien
cgggtaggagatcgcagttttccaa

SEQ ID NO: 150920 - DNA, 25 bp, Homo sapien
ctcgccacggaaaatggtcacacgc

SEQ ID NO: 150921 - DNA, 25 bp, Homo sapien
tgtcctcaagccgaacactatcaga

SEQ ID NO: 150922 - DNA, 25 bp, Homo sapien
atggtcacacgcttttgtcctcaag

SEQ ID NO: 150923 - DNA, 25 bp, Homo sapien
tgggccttttgtaccactcgccacg

SEQ ID NO: 150924 - DNA, 25 bp, Homo sapien
ctttcaggacggagggacacaaaca

SEQ ID NO: 150925 - DNA, 25 bp, Homo sapien
gttgtcagcggcctctgaggtttca

SEQ ID NO: 150926 - DNA, 25 bp, Homo sapien
gcggtccctagttcacactggctgt

SEQ ID NO: 150927 - DNA, 25 bp, Homo sapien
cactatcagaaacacggggtccctg

SEQ ID NO: 150928 - DNA, 25 bp, Homo sapien
cccagccctcggctgccactcccga

SEQ ID NO: 150929 - DNA, 25 bp, Homo sapien
cgaggcaaccgcgtccaccccctgc

SEQ ID NO: 150930 - DNA, 25 bp, Homo sapien
ggacagccctacagagaccgccaat

SEQ ID NO: 150931 - DNA, 25 bp, Homo sapien
caagcctgtgtgcacgcctgccagg

SEQ ID NO: 150932 - DNA, 25 bp, Homo sapien
caccgtcccttccttcgaggccctg

SEQ ID NO: 150933 - DNA, 25 bp, Homo sapien
cccttccttcgaggccctgagcgct

SEQ ID NO: 150934 - DNA, 25 bp, Homo sapien
agacggacagccctacagagaccgc

SEQ ID NO: 150935 - DNA, 25 bp, Homo sapien
ctcggctgccactcccgacccagag

SEQ ID NO: 150936 - DNA, 25 bp, Homo sapien
gcttacttcactgccgacagcctga

SEQ ID NO: 150937 - DNA, 25 bp, Homo sapien
tatgacagtgttcgctctaagggga

SEQ ID NO: 150938 - DNA, 25 bp, Homo sapien
cccgcgcttcagtggttatgacagt

SEQ ID NO: 150939 - DNA, 25 bp, Homo sapien
ggcaacaaagcctgtggccgatgtg

SEQ ID NO: 150940 - DNA, 25 bp, Homo sapien
ccctgggaacgtgaagtcaaagcaa

SEQ ID NO: 150941 - DNA, 25 bp, Homo sapien
agccagtgtgaacgaagcgccaccc

SEQ ID NO: 150942 - DNA, 25 bp, Homo sapien
tgtgaccatttccaacggtaagtcg

SEQ ID NO: 150943 - DNA, 25 bp, Homo sapien
cctgaaacctcaggggcggatgaca

SEQ ID NO: 150944 - DNA, 25 bp, Homo sapien
ccctgttgcgtgatccaggcctcaa

SEQ ID NO: 150945 - DNA, 25 bp, Homo sapien
caacctgaaggtggtgcagcttttc

SEQ ID NO: 150946 - DNA, 25 bp, Homo sapien
ccgctggcggactaacaaggtcatc

SEQ ID NO: 150947 - DNA, 25 bp, Homo sapien
cacccggacgttttctacttgtatg

SEQ ID NO: 150948 - DNA, 25 bp, Homo sapien
gcgaactctttaaccagcacccgga

SEQ ID NO: 150949 - DNA, 25 bp, Homo sapien
gtgtctcgcgagaagcagcacatct

SEQ ID NO: 150950 - DNA, 25 bp, Homo sapien
cgcgccgatttcttcctgaccggtg

SEQ ID NO: 150951 - DNA, 25 bp, Homo sapien
tggcatctatggcaggcgctgtatc

SEQ ID NO: 150952 - DNA, 25 bp, Homo sapien
agtcgacagacagcgctcagttaga

SEQ ID NO: 150953 - DNA, 25 bp, Homo sapien
aacacacggggcctctctagggccg

SEQ ID NO: 150954 - DNA, 25 bp, Homo sapien
cgtgacacgtaccttggccaccagg

SEQ ID NO: 150955 - DNA, 25 bp, Homo sapien
ctcagttagaacctgggagcatcga

SEQ ID NO: 150956 - DNA, 25 bp, Homo sapien
tccgtgtctgaacctgaagagtcga

SEQ ID NO: 150957 - DNA, 25 bp, Homo sapien
tgacggcatccacgttgacggagtc

SEQ ID NO: 150958 - DNA, 25 bp, Homo sapien
gcgaaggtgctctcgatcttgctga

SEQ ID NO: 150959 - DNA, 25 bp, Homo sapien
ctgggagcatcgaacgccttcttca

SEQ ID NO: 150960 - DNA, 25 bp, Homo sapien
aacggaacacgttggcaagtgaagg

SEQ ID NO: 150961 - DNA, 25 bp, Homo sapien
cgcacttccgaaaggggacgccaga

SEQ ID NO: 150962 - DNA, 25 bp, Homo sapien
gagcatcggcttggagtgactagcc

SEQ ID NO: 150963 - DNA, 25 bp, Homo sapien
agtgactagccttgcggtctcgagt

SEQ ID NO: 150964 - DNA, 25 bp, Homo sapien
tgcggtctcgagtcccgtctctggc

SEQ ID NO: 150965 - DNA, 25 bp, Homo sapien
gtgtaacaggggtgctcaccataga

SEQ ID NO: 150966 - DNA, 25 bp, Homo sapien
tgctcaccatagatcatggccagcc

SEQ ID NO: 150967 - DNA, 25 bp, Homo sapien
tctcgtgcagaaagcgcacccggcg

SEQ ID NO: 150968 - DNA, 25 bp, Homo sapien
cgagttacgtatatgggaccgattc

SEQ ID NO: 150969 - DNA, 25 bp, Homo sapien
cctgccttgctctgacttcctgttg

SEQ ID NO: 150970 - DNA, 25 bp, Homo sapien
gagctttctctgactccgaaccctg

SEQ ID NO: 150971 - DNA, 25 bp, Homo sapien
ctcttgaacgcggatagctgaagtc

SEQ ID NO: 150972 - DNA, 25 bp, Homo sapien
aactgctgccgcactctcttgaacg

SEQ ID NO: 150973 - DNA, 25 bp, Homo sapien
atgaaagtcgtgtagccgccgtctc

SEQ ID NO: 150974 - DNA, 25 bp, Homo sapien
catgggctgcttcttctccaagaga

SEQ ID NO: 150975 - DNA, 25 bp, Homo sapien
ctcgagaggctttgattggctcaac

SEQ ID NO: 150976 - DNA, 25 bp, Homo sapien
agcgcacagtgtcaggaatacaata

SEQ ID NO: 150977 - DNA, 25 bp, Homo sapien
gcgccataactgttgcggctctttc

SEQ ID NO: 150978 - DNA, 25 bp, Homo sapien
gttcctgccctttgcctggcttcgg

SEQ ID NO: 150979 - DNA, 25 bp, Homo sapien
ctcccggctacaccgggcaggaatt

SEQ ID NO: 150980 - DNA, 25 bp, Homo sapien
cgcgccctggctgtttagctgttgg

SEQ ID NO: 150981 - DNA, 25 bp, Homo sapien
ggttccacatcgtggtcgcctccgg

SEQ ID NO: 150982 - DNA, 25 bp, Homo sapien
gaatacaatagtgctccgcgccgcc

SEQ ID NO: 150983 - DNA, 25 bp, Homo sapien
ccgggcaggaattgagcgccataac

SEQ ID NO: 150984 - DNA, 25 bp, Homo sapien
aaatctccatcctggcgagtgcccg

SEQ ID NO: 150985 - DNA, 25 bp, Homo sapien
accagattgttgtggaggcctctca

SEQ ID NO: 150986 - DNA, 25 bp, Homo sapien
ggaggcaggctcaaccttcagattc

SEQ ID NO: 150987 - DNA, 25 bp, Homo sapien
tcccgatctcccagaaggcgactga

SEQ ID NO: 150988 - DNA, 25 bp, Homo sapien
cctgaccttcgagccgcctgagaaa

SEQ ID NO: 150989 - DNA, 25 bp, Homo sapien
agatcgcgccaggagactgactgct

SEQ ID NO: 150990 - DNA, 25 bp, Homo sapien
ggcgactgacagctgactgccagaa

SEQ ID NO: 150991 - DNA, 25 bp, Homo sapien
gtcccagcggctctaccagattgtt

SEQ ID NO: 150992 - DNA, 25 bp, Homo sapien
tgggtctgctcatttcctgcatagg

SEQ ID NO: 150993 - DNA, 25 bp, Homo sapien
accctctttgcctccagttgtcgtg

SEQ ID NO: 150994 - DNA, 25 bp, Homo sapien
cgccacgctatataggtcccagatc

SEQ ID NO: 150995 - DNA, 25 bp, Homo sapien
tcccttctcgtcgtcgccattttga

SEQ ID NO: 150996 - DNA, 25 bp, Homo sapien
gctactccttttctccactagggga

SEQ ID NO: 150997 - DNA, 25 bp, Homo sapien
cgggccctgccgaattggctaatag

SEQ ID NO: 150998 - DNA, 25 bp, Homo sapien
gaggcagagcttccgctagtctttc

SEQ ID NO: 150999 - DNA, 25 bp, Homo sapien
ttcggccaggctgagaaatttctta

SEQ ID NO: 151000 - DNA, 25 bp, Homo sapien
cagcctggaaatcgggcaatggagc

SEQ ID NO: 151001 - DNA, 25 bp, Homo sapien
tgccagcctggaaatcgggcaatgg

SEQ ID NO: 151002 - DNA, 25 bp, Homo sapien
atccagctctccaccatcgtggtga

SEQ ID NO: 151003 - DNA, 25 bp, Homo sapien
gaaccgcggctttgccttcatccag

SEQ ID NO: 151004 - DNA, 25 bp, Homo sapien
gcagacccaactgaaccgcggcttt

SEQ ID NO: 151005 - DNA, 25 bp, Homo sapien
ctcctccaacgtgcgcgtcataaag

SEQ ID NO: 151006 - DNA, 25 bp, Homo sapien
acgtgcgcgtcataaaggacaagca

SEQ ID NO: 151007 - DNA, 25 bp, Homo sapien
cgtcataaaggacaagcagacccaa

SEQ ID NO: 151008 - DNA, 25 bp, Homo sapien
ttcagctcatctttggcaggaaggc

SEQ ID NO: 151009 - DNA, 25 bp, Homo sapien
tacgacagaggtggtttgctcttcc

SEQ ID NO: 151010 - DNA, 25 bp, Homo sapien
gcaaactctggcttctcttgtacga

SEQ ID NO: 151011 - DNA, 25 bp, Homo sapien
tgtggtacatcccagacccggggct

SEQ ID NO: 151012 - DNA, 25 bp, Homo sapien
cctctagcaaagcatctgtggtaca

SEQ ID NO: 151013 - DNA, 25 bp, Homo sapien
tcatctgggtctgaaacgggcacca

SEQ ID NO: 151014 - DNA, 25 bp, Homo sapien
ccacaacctgtagggtcatctgggt

SEQ ID NO: 151015 - DNA, 25 bp, Homo sapien
cgcatttgggccgtaccacaacctg

SEQ ID NO: 151016 - DNA, 25 bp, Homo sapien
gtgtgaacgtatctattttcaaaga

SEQ ID NO: 151017 - DNA, 25 bp, Homo sapien
cggcttcgctcaaccacgcacctcc

SEQ ID NO: 151018 - DNA, 25 bp, Homo sapien
actcggttcatcgggagccctccgt

SEQ ID NO: 151019 - DNA, 25 bp, Homo sapien
cgggagccctccgtaagcaagacaa

SEQ ID NO: 151020 - DNA, 25 bp, Homo sapien
ggagggtgtgaacgtatctattttc

SEQ ID NO: 151021 - DNA, 25 bp, Homo sapien
tctattttcaaagatacccgagccc

SEQ ID NO: 151022 - DNA, 25 bp, Homo sapien
cagggagatagtgcccgggctatcc

SEQ ID NO: 151023 - DNA, 25 bp, Homo sapien
ggagccctccgtaagcaagacaagc

SEQ ID NO: 151024 - DNA, 25 bp, Homo sapien
aaaaacgtcctttcactgcgcctcg

SEQ ID NO: 151025 - DNA, 25 bp, Homo sapien
ggtggcagggacaaccacaaccaca

SEQ ID NO: 151026 - DNA, 25 bp, Homo sapien
cgaatgaatcgcaaccgagtaggga

SEQ ID NO: 151027 - DNA, 25 bp, Homo sapien
accgagtagggaactttatgcatga

SEQ ID NO: 151028 - DNA, 25 bp, Homo sapien
atgattcataagtaggcgcggcccg

SEQ ID NO: 151029 - DNA, 25 bp, Homo sapien
tcagcgtccgccatcttgtgtcggc

SEQ ID NO: 151030 - DNA, 25 bp, Homo sapien
cttggcttcggctccttgaggagtt

SEQ ID NO: 151031 - DNA, 25 bp, Homo sapien
gcccgcttgcatccgggtttctggg

SEQ ID NO: 151032 - DNA, 25 bp, Homo sapien
tcacctaggcgctagcaaacttctg

SEQ ID NO: 151033 - DNA, 25 bp, Homo sapien
gggtcctttggtacatgcagtccga

SEQ ID NO: 151034 - DNA, 25 bp, Homo sapien
ctgccaagatcggaactgagtacta

SEQ ID NO: 151035 - DNA, 25 bp, Homo sapien
ggttactggccactgctcacctagg

SEQ ID NO: 151036 - DNA, 25 bp, Homo sapien
tcccgtttgccaccatggggatgta

SEQ ID NO: 151037 - DNA, 25 bp, Homo sapien
gctgcacacgttcactacgggaatg

SEQ ID NO: 151038 - DNA, 25 bp, Homo sapien
tcggcctcgccacagagagcaaatc

SEQ ID NO: 151039 - DNA, 25 bp, Homo sapien
agccgccgtgagcactcggattcaa

SEQ ID NO: 151040 - DNA, 25 bp, Homo sapien
cgtagtgaaactgcgtaggaacctg

SEQ ID NO: 151041 - DNA, 25 bp, Homo sapien
tggtgcagtctgacgcctgagaaca

SEQ ID NO: 151042 - DNA, 25 bp, Homo sapien
ttgattctggcggaagccttcccga

SEQ ID NO: 151043 - DNA, 25 bp, Homo sapien
tgacgcgccgtggtttttgattctg

SEQ ID NO: 151044 - DNA, 25 bp, Homo sapien
ggcgcctgcgaataagcaaagttta

SEQ ID NO: 151045 - DNA, 25 bp, Homo sapien
cctgcgctgcgtaatgcaacttttg

SEQ ID NO: 151046 - DNA, 25 bp, Homo sapien
gtgcctttgaatgaatcgcaacgtc

SEQ ID NO: 151047 - DNA, 25 bp, Homo sapien
aaggtgggttctgctacataaggcg

SEQ ID NO: 151048 - DNA, 25 bp, Homo sapien
ccgcagtgcatctccatgagtccac

SEQ ID NO: 151049 - DNA, 25 bp, Homo sapien
ccgagcccacaacgcattcccgcag

SEQ ID NO: 151050 - DNA, 25 bp, Homo sapien
ttcccgagcccacaacgcattcccg

SEQ ID NO: 151051 - DNA, 25 bp, Homo sapien
gtgcatcttcccgagcccacaacgc

SEQ ID NO: 151052 - DNA, 25 bp, Homo sapien
tcccacagtcatctccctgtgccca

SEQ ID NO: 151053 - DNA, 25 bp, Homo sapien
tgagtccacgatcccacaatgcatc

SEQ ID NO: 151054 - DNA, 25 bp, Homo sapien
tccatgagtccacgatcccacaatg

SEQ ID NO: 151055 - DNA, 25 bp, Homo sapien
catgagtccacgatcccacaatgca

SEQ ID NO: 151056 - DNA, 25 bp, Homo sapien
tacacctggtgggtgcccttacacc

SEQ ID NO: 151057 - DNA, 25 bp, Homo sapien
cgcttctggacttgatctgcacatg

SEQ ID NO: 151058 - DNA, 25 bp, Homo sapien
gccatcttggaagggcggtcatttc

SEQ ID NO: 151059 - DNA, 25 bp, Homo sapien
tcgccagcagcgagagtttaacctc

SEQ ID NO: 151060 - DNA, 25 bp, Homo sapien
gcgggctttccaatttccttcagtg

SEQ ID NO: 151061 - DNA, 25 bp, Homo sapien
cgtgcgtgtcagatttaggccagga

SEQ ID NO: 151062 - DNA, 25 bp, Homo sapien
ggctgtcaccgaacctgtgcagttg

SEQ ID NO: 151063 - DNA, 25 bp, Homo sapien
cgccgcagcctctaggagttagtca

SEQ ID NO: 151064 - DNA, 25 bp, Homo sapien
tctccaaggaacgaccgtccgcgcg

SEQ ID NO: 151065 - DNA, 25 bp, Homo sapien
gtgacggcggttcctgccgactgcc

SEQ ID NO: 151066 - DNA, 25 bp, Homo sapien
gcttctccaaggaacgaccgtccgc

SEQ ID NO: 151067 - DNA, 25 bp, Homo sapien
caaggaacgaccgtccgcgcgccag

SEQ ID NO: 151068 - DNA, 25 bp, Homo sapien
tgacggcggttcctgccgactgccg

SEQ ID NO: 151069 - DNA, 25 bp, Homo sapien
ttcctgccgactgccgggggcttgc

SEQ ID NO: 151070 - DNA, 25 bp, Homo sapien
ccgcagcgcgacggctttttatccg

SEQ ID NO: 151071 - DNA, 25 bp, Homo sapien
ccagcgcatccggtggtgtgcggct

SEQ ID NO: 151072 - DNA, 25 bp, Homo sapien
ccagagctcctctttggggttcccg

SEQ ID NO: 151073 - DNA, 25 bp, Homo sapien
cctcgacgtggcaggaaaactgttc

SEQ ID NO: 151074 - DNA, 25 bp, Homo sapien
ggaatgcccgagcatggcacctcga

SEQ ID NO: 151075 - DNA, 25 bp, Homo sapien
agggacctgccatttcctggcccag

SEQ ID NO: 151076 - DNA, 25 bp, Homo sapien
ttctggaaacgaccgaatctgggtg

SEQ ID NO: 151077 - DNA, 25 bp, Homo sapien
ctggccctccgcgtgttaatttagg

SEQ ID NO: 151078 - DNA, 25 bp, Homo sapien
gaccagagctctcgggcctcctgat

SEQ ID NO: 151079 - DNA, 25 bp, Homo sapien
tcccgttcgcatcgtgaagctgggc

SEQ ID NO: 151080 - DNA, 25 bp, Homo sapien
cccgctaaggtgtccaatgaccttt

SEQ ID NO: 151081 - DNA, 25 bp, Homo sapien
atgacctttccttaccaactgcggg

SEQ ID NO: 151082 - DNA, 25 bp, Homo sapien
cagatcttgacgtttcaggcggccc

SEQ ID NO: 151083 - DNA, 25 bp, Homo sapien
ctcacattccgttggtcttgccttg

SEQ ID NO: 151084 - DNA, 25 bp, Homo sapien
cttgccttgacagacgtgaccctga

SEQ ID NO: 151085 - DNA, 25 bp, Homo sapien
cccaataagggtggaaggctgagtc

SEQ ID NO: 151086 - DNA, 25 bp, Homo sapien
tcccgcagagccaataacgagagtc

SEQ ID NO: 151087 - DNA, 25 bp, Homo sapien
cccgccgggagaatgtcaggattct

SEQ ID NO: 151088 - DNA, 25 bp, Homo sapien
ttctgggccagctgtggtttgggac

SEQ ID NO: 151089 - DNA, 25 bp, Homo sapien
gccagagacggatgtctgacgggta

SEQ ID NO: 151090 - DNA, 25 bp, Homo sapien
gcctctcgcttaccctgtggtgggg

SEQ ID NO: 151091 - DNA, 25 bp, Homo sapien
cagcctctcgcttaccctgtggtgg

SEQ ID NO: 151092 - DNA, 25 bp, Homo sapien
cacacgtgagagtgagcgggtaaga

SEQ ID NO: 151093 - DNA, 25 bp, Homo sapien
agagaaagagcacacgtgagagtga

SEQ ID NO: 151094 - DNA, 25 bp, Homo sapien
ccaaggcctgaaaggtgctgctggc

SEQ ID NO: 151095 - DNA, 25 bp, Homo sapien
actggccgggattggcggccttgac

SEQ ID NO: 151096 - DNA, 25 bp, Homo sapien
ctgcttgaccgcgttggacagcgac

SEQ ID NO: 151097 - DNA, 25 bp, Homo sapien
ttggccataaagttgctgtccgaca

SEQ ID NO: 151098 - DNA, 25 bp, Homo sapien
acgctgcaggtctgtcatgtaccca

SEQ ID NO: 151099 - DNA, 25 bp, Homo sapien
tcgtcgatgaccagcagcaccctgg

SEQ ID NO: 151100 - DNA, 25 bp, Homo sapien
ctcattcgcagaagaacgatctggg

SEQ ID NO: 151101 - DNA, 25 bp, Homo sapien
ggcgctcgataattgctcattcgca

SEQ ID NO: 151102 - DNA, 25 bp, Homo sapien
agctgcgctctcaggcacgacacga

SEQ ID NO: 151103 - DNA, 25 bp, Homo sapien
catgtacccatttggcagattggcc

SEQ ID NO: 151104 - DNA, 25 bp, Homo sapien
acgtggacagcagccgtctctgtga

SEQ ID NO: 151105 - DNA, 25 bp, Homo sapien
tggacagcagccgtctctgtgagtc

SEQ ID NO: 151106 - DNA, 25 bp, Homo sapien
tggacagcagccgtctctgcgagtc

SEQ ID NO: 151107 - DNA, 25 bp, Homo sapien
tgagtctcatctgcgagtcccgtgg

SEQ ID NO: 151108 - DNA, 25 bp, Homo sapien
agccgcctctgtgagtcccgtggac

SEQ ID NO: 151109 - DNA, 25 bp, Homo sapien
acgtggacagcagccgtctctgcga

SEQ ID NO: 151110 - DNA, 25 bp, Homo sapien
agccgcctctgtgagtctcatctgc

SEQ ID NO: 151111 - DNA, 25 bp, Homo sapien
gtgagtctcatctgcgagtcccgtg

SEQ ID NO: 151112 - DNA, 25 bp, Homo sapien
gccgttcatcctcgactgacgcgga

SEQ ID NO: 151113 - DNA, 25 bp, Homo sapien
tcaggaaacccgtaacgcggagctc

SEQ ID NO: 151114 - DNA, 25 bp, Homo sapien
tgcctgccaggacaagtagccaatc

SEQ ID NO: 151115 - DNA, 25 bp, Homo sapien
ccggccaatcaagaagtgcctgcca

SEQ ID NO: 151116 - DNA, 25 bp, Homo sapien
caggagacggggagacaacgaacaa

SEQ ID NO: 151117 - DNA, 25 bp, Homo sapien
tcgctggtaattgtggcattggagc

SEQ ID NO: 151118 - DNA, 25 bp, Homo sapien
ctcgccgagctatttgtcgctggta

SEQ ID NO: 151119 - DNA, 25 bp, Homo sapien
aacgaacaagcacgccggccaatca

SEQ ID NO: 151120 - DNA, 25 bp, Homo sapien
ctccgcaggcactcaccaatgtatg

SEQ ID NO: 151121 - DNA, 25 bp, Homo sapien
ctactttcacttctgggggcaaagc

SEQ ID NO: 151122 - DNA, 25 bp, Homo sapien
attcctgtcagtcacccgccacatg

SEQ ID NO: 151123 - DNA, 25 bp, Homo sapien
gccacatgccaatcccattggtgct

SEQ ID NO: 151124 - DNA, 25 bp, Homo sapien
tgggcccttctactttcacttctgg

SEQ ID NO: 151125 - DNA, 25 bp, Homo sapien
ctcaccaatgtatgcgtaggaagca

SEQ ID NO: 151126 - DNA, 25 bp, Homo sapien
aaacccggctccacattaagctctt

SEQ ID NO: 151127 - DNA, 25 bp, Homo sapien
aatcccattggtgctggcgcccaca

SEQ ID NO: 151128 - DNA, 25 bp, Homo sapien
ggtctgcctcacactgattggctta

SEQ ID NO: 151129 - DNA, 25 bp, Homo sapien
cttgagcaatgccacacgcaggtcc

SEQ ID NO: 151130 - DNA, 25 bp, Homo sapien
ctgcgtttccctacagctcacgtgg

SEQ ID NO: 151131 - DNA, 25 bp, Homo sapien
tcgctgattggccaaagcgctatta

SEQ ID NO: 151132 - DNA, 25 bp, Homo sapien
tccctacagagctgtgccgtgattg

SEQ ID NO: 151133 - DNA, 25 bp, Homo sapien
acgccgattggctcaaggactgacg

SEQ ID NO: 151134 - DNA, 25 bp, Homo sapien
ctgacggactgtgagcaactgaaaa

SEQ ID NO: 151135 - DNA, 25 bp, Homo sapien
ggttaggccacggtcagatccacta

SEQ ID NO: 151136 - DNA, 25 bp, Homo sapien
ccgtctggcaataaaccggccaatg

SEQ ID NO: 151137 - DNA, 25 bp, Homo sapien
ggcaagcgcgctggccaaccaaata

SEQ ID NO: 151138 - DNA, 25 bp, Homo sapien
ccgccagcaataagaacggttggta

SEQ ID NO: 151139 - DNA, 25 bp, Homo sapien
tctcaacgctgggaatcggcttgtc

SEQ ID NO: 151140 - DNA, 25 bp, Homo sapien
agaccatgttgaccgatccagtttg

SEQ ID NO: 151141 - DNA, 25 bp, Homo sapien
gaaggtctcgtagcgcagcactttc

SEQ ID NO: 151142 - DNA, 25 bp, Homo sapien
gcacgtcactgatgaaggtctcgta

SEQ ID NO: 151143 - DNA, 25 bp, Homo sapien
cctcgcccgccaattcaaagggttg

SEQ ID NO: 151144 - DNA, 25 bp, Homo sapien
cctagcgttagaagcgagctggaat

SEQ ID NO: 151145 - DNA, 25 bp, Homo sapien
tgccgtcagacgttgcctagcgtta

SEQ ID NO: 151146 - DNA, 25 bp, Homo sapien
caaggcacctgtgccgtcagacgtt

SEQ ID NO: 151147 - DNA, 25 bp, Homo sapien
ggaacatcgagccaaggcacctgtg

SEQ ID NO: 151148 - DNA, 25 bp, Homo sapien
ccgttagtaacgaggaacatcgagc

SEQ ID NO: 151149 - DNA, 25 bp, Homo sapien
aggccaggttgtttttcatcattca

SEQ ID NO: 151150 - DNA, 25 bp, Homo sapien
catcattcagaacattgcctgaagc

SEQ ID NO: 151151 - DNA, 25 bp, Homo sapien
tccaccgtgccgttagtaacgagga

SEQ ID NO: 151152 - DNA, 25 bp, Homo sapien
ctcagccggggtttgatagttgtca

SEQ ID NO: 151153 - DNA, 25 bp, Homo sapien
cggctgcggttctcgccggttctca

SEQ ID NO: 151154 - DNA, 25 bp, Homo sapien
tccgcttccctcattcatgtgaagt

SEQ ID NO: 151155 - DNA, 25 bp, Homo sapien
cttcaaaggtggttttgcgcacgcg

SEQ ID NO: 151156 - DNA, 25 bp, Homo sapien
ctggctaacagcagcttcaaaggtg

SEQ ID NO: 151157 - DNA, 25 bp, Homo sapien
tccgtaacttctccatgttgactcc

SEQ ID NO: 151158 - DNA, 25 bp, Homo sapien
atgttgactcctggctaacagcagc

SEQ ID NO: 151159 - DNA, 25 bp, Homo sapien
tgatagttgtcaggaggattcgacg

SEQ ID NO: 151160 - DNA, 25 bp, Homo sapien
cgcttcgggaccgactctttggcac

SEQ ID NO: 151161 - DNA, 25 bp, Homo sapien
gcgtgcccaccgtgtccttttgctg

SEQ ID NO: 151162 - DNA, 25 bp, Homo sapien
tgctccaggccagatggcgtgccca

SEQ ID NO: 151163 - DNA, 25 bp, Homo sapien
tgacgtcactgctccaggccagatg

SEQ ID NO: 151164 - DNA, 25 bp, Homo sapien
tagccttgccggtgacgtcactgct

SEQ ID NO: 151165 - DNA, 25 bp, Homo sapien
ccgtccgccaatagtcaacatgggg

SEQ ID NO: 151166 - DNA, 25 bp, Homo sapien
cgcacgctcagtggcgcctttgaga

SEQ ID NO: 151167 - DNA, 25 bp, Homo sapien
tctttggcaccgcagcctaaagggc

SEQ ID NO: 151168 - DNA, 25 bp, Homo sapien
agccgagctctaccagtaacaaaaa

SEQ ID NO: 151169 - DNA, 25 bp, Homo sapien
tccgcagaagcgaattcctaaaacg

SEQ ID NO: 151170 - DNA, 25 bp, Homo sapien
caccagaagaggcacggcctgagca

SEQ ID NO: 151171 - DNA, 25 bp, Homo sapien
agtcctcgtgatatctccgagtttg

SEQ ID NO: 151172 - DNA, 25 bp, Homo sapien
tcccattccagccagaggagaggtg

SEQ ID NO: 151173 - DNA, 25 bp, Homo sapien
cccttccagtcttcccggagagatg

SEQ ID NO: 151174 - DNA, 25 bp, Homo sapien
gagcttatctttcggtggctccgaa

SEQ ID NO: 151175 - DNA, 25 bp, Homo sapien
cgcactgcttctggaggctcccatt

SEQ ID NO: 151176 - DNA, 25 bp, Homo sapien
cgctcgcgcacttcaagaacgcatt

SEQ ID NO: 151177 - DNA, 25 bp, Homo sapien
tcgggtggactacgaacacaaactg

SEQ ID NO: 151178 - DNA, 25 bp, Homo sapien
gtttgccacgctgcgacagcccata

SEQ ID NO: 151179 - DNA, 25 bp, Homo sapien
gcgatccacgatgccgagtttgcca

SEQ ID NO: 151180 - DNA, 25 bp, Homo sapien
tgtacgttcacatcaggtcccggcc

SEQ ID NO: 151181 - DNA, 25 bp, Homo sapien
acggggctcacgttgtacgttcaca

SEQ ID NO: 151182 - DNA, 25 bp, Homo sapien
cgcttcccggcacgcgaaaaatgaa

SEQ ID NO: 151183 - DNA, 25 bp, Homo sapien
gcaaatcgatcttggcctcggaaga

SEQ ID NO: 151184 - DNA, 25 bp, Homo sapien
gaattgtagtctctcctaggctagg

SEQ ID NO: 151185 - DNA, 25 bp, Homo sapien
ccacccgagtcaggttctggtaact

SEQ ID NO: 151186 - DNA, 25 bp, Homo sapien
gtaactctcgatcagcgccctcttg

SEQ ID NO: 151187 - DNA, 25 bp, Homo sapien
gacgggatctcctcctctagtaaca

SEQ ID NO: 151188 - DNA, 25 bp, Homo sapien
gcatcgcttcctctcgcgttaaaga

SEQ ID NO: 151189 - DNA, 25 bp, Homo sapien
tcccgcctggtattgtgggacggca

SEQ ID NO: 151190 - DNA, 25 bp, Homo sapien
ttcacagtagtctgccacccgagtc

SEQ ID NO: 151191 - DNA, 25 bp, Homo sapien
ttcgcactgtcttctgggaattgta

SEQ ID NO: 151192 - DNA, 25 bp, Homo sapien
gctgtctgcgccctccatcacccac

SEQ ID NO: 151193 - DNA, 25 bp, Homo sapien
catcacccacaccagcggcccgcac

SEQ ID NO: 151194 - DNA, 25 bp, Homo sapien
gccctccgcccgcaccaatggcccg

SEQ ID NO: 151195 - DNA, 25 bp, Homo sapien
tcacccacaccagcggcccgcacac

SEQ ID NO: 151196 - DNA, 25 bp, Homo sapien
ctccgcccgcaccaatggcccgcac

SEQ ID NO: 151197 - DNA, 25 bp, Homo sapien
cccgcacactcacgcctcgctgtgc

SEQ ID NO: 151198 - DNA, 25 bp, Homo sapien
gcacactcacgcctcgctgtgctgt

SEQ ID NO: 151199 - DNA, 25 bp, Homo sapien
atcacccacaccagcggcccgcaca

SEQ ID NO: 151200 - DNA, 25 bp, Homo sapien
ctgcagattcttcaagggttccgga

SEQ ID NO: 151201 - DNA, 25 bp, Homo sapien
gcagattcttcaagggttccggagc

SEQ ID NO: 151202 - DNA, 25 bp, Homo sapien
cagattcttcaagggttccggagct

SEQ ID NO: 151203 - DNA, 25 bp, Homo sapien
cgctctgcagattcttcaagggttc

SEQ ID NO: 151204 - DNA, 25 bp, Homo sapien
tgcgctctgcagattcttcaagggt

SEQ ID NO: 151205 - DNA, 25 bp, Homo sapien
ctgcgctctgcagattcttcaaggg

SEQ ID NO: 151206 - DNA, 25 bp, Homo sapien
cactcacacctcgctgtgctgtctg

SEQ ID NO: 151207 - DNA, 25 bp, Homo sapien
ctctgcagattcttcaagggttccg

SEQ ID NO: 151208 - DNA, 25 bp, Homo sapien
caggactttgttggcggcctctcgc

SEQ ID NO: 151209 - DNA, 25 bp, Homo sapien
atctgtagcgcgagtgctaggaccc

SEQ ID NO: 151210 - DNA, 25 bp, Homo sapien
tcctgccaggtaggtcgccagtagt

SEQ ID NO: 151211 - DNA, 25 bp, Homo sapien
aaaggtgcgggcgtgaacgtcctgc

SEQ ID NO: 151212 - DNA, 25 bp, Homo sapien
tcaggctatgtctcctaccaccacc

SEQ ID NO: 151213 - DNA, 25 bp, Homo sapien
acggtctggggctgaaaccgccaca

SEQ ID NO: 151214 - DNA, 25 bp, Homo sapien
ctttccgactctccctcaggctatg

SEQ ID NO: 151215 - DNA, 25 bp, Homo sapien
ctggggctgaaaccgccacaggccg

SEQ ID NO: 151216 - DNA, 25 bp, Homo sapien
gaccggctttgtgttccgttctagc

SEQ ID NO: 151217 - DNA, 25 bp, Homo sapien
agcgggtacagaccttaatgagtcc

SEQ ID NO: 151218 - DNA, 25 bp, Homo sapien
ctcgatgcagattggctacggatcc

SEQ ID NO: 151219 - DNA, 25 bp, Homo sapien
ttcaccattggctcgctccgtaagg

SEQ ID NO: 151220 - DNA, 25 bp, Homo sapien
cccactaggggatgagcccgaacta

SEQ ID NO: 151221 - DNA, 25 bp, Homo sapien
ccagcctaaagagagcccggagcca

SEQ ID NO: 151222 - DNA, 25 bp, Homo sapien
aagatccgtcttctcattgggcagc

SEQ ID NO: 151223 - DNA, 25 bp, Homo sapien
ctaccgcacggttgtccagaggaca

SEQ ID NO: 151224 - DNA, 25 bp, Homo sapien
cggacataacctgagcggcgaagct

SEQ ID NO: 151225 - DNA, 25 bp, Homo sapien
ccgtgaatccggaagtatgctgtca

SEQ ID NO: 151226 - DNA, 25 bp, Homo sapien
gcgtctgcacgctagctgaaataga

SEQ ID NO: 151227 - DNA, 25 bp, Homo sapien
tggcaacagcactctaggcgcaggc

SEQ ID NO: 151228 - DNA, 25 bp, Homo sapien
ggcgtcagtttaacacctccgtgaa

SEQ ID NO: 151229 - DNA, 25 bp, Homo sapien
gcgggacctgagatttcggacataa

SEQ ID NO: 151230 - DNA, 25 bp, Homo sapien
cctgagagcgttagcgacgtacctt

SEQ ID NO: 151231 - DNA, 25 bp, Homo sapien
ccttctcttggcgaacgaggcgtca

SEQ ID NO: 151232 - DNA, 25 bp, Homo sapien
ccactgacacgtaggcttggctttc

SEQ ID NO: 151233 - DNA, 25 bp, Homo sapien
tccgggacgttctcgctacgtactc

SEQ ID NO: 151234 - DNA, 25 bp, Homo sapien
tttatcaatcgtcttccggcgcagc

SEQ ID NO: 151235 - DNA, 25 bp, Homo sapien
gtccctgttttttgtgctcctccga

SEQ ID NO: 151236 - DNA, 25 bp, Homo sapien
catatgtcctgcgaaacggcggctc

SEQ ID NO: 151237 - DNA, 25 bp, Homo sapien
cccgtgcttggaggtgaaacatttc

SEQ ID NO: 151238 - DNA, 25 bp, Homo sapien
gtgaccacgcgacagccgacactta

SEQ ID NO: 151239 - DNA, 25 bp, Homo sapien
gctgtatctgagtgtgaggcctacc

SEQ ID NO: 151240 - DNA, 25 bp, Homo sapien
gtctgttctgaatcgctgtgtgtca

SEQ ID NO: 151241 - DNA, 25 bp, Homo sapien
cggagaacttgccttatgcggctgc

SEQ ID NO: 151242 - DNA, 25 bp, Homo sapien
cttactgtggtgcatgcgcaatggc

SEQ ID NO: 151243 - DNA, 25 bp, Homo sapien
aagcccatgggagcagaacttactg

SEQ ID NO: 151244 - DNA, 25 bp, Homo sapien
cagcaagtcttagcagtggacgcga

SEQ ID NO: 151245 - DNA, 25 bp, Homo sapien
ggacgctcacattccaggcccttgt

SEQ ID NO: 151246 - DNA, 25 bp, Homo sapien
ggacggaactagatcccttcgctcg

SEQ ID NO: 151247 - DNA, 25 bp, Homo sapien
actcgatgtctatggcaatggtcgc

SEQ ID NO: 151248 - DNA, 25 bp, Homo sapien
tccacagtttcggacgcagtatatc

SEQ ID NO: 151249 - DNA, 25 bp, Homo sapien
gcacaccaacgtttccacagtttcg

SEQ ID NO: 151250 - DNA, 25 bp, Homo sapien
gacgcagtatatccgccggcgcagc

SEQ ID NO: 151251 - DNA, 25 bp, Homo sapien
ctgcgtcggcagtacctgaggcttc

SEQ ID NO: 151252 - DNA, 25 bp, Homo sapien
ctctccgagccaggcagtgctcgtg

SEQ ID NO: 151253 - DNA, 25 bp, Homo sapien
ggcagtgctcgtgcctatagcaaca

SEQ ID NO: 151254 - DNA, 25 bp, Homo sapien
tagcaacagcatcgtccgcagtagc

SEQ ID NO: 151255 - DNA, 25 bp, Homo sapien
gcagtagccgcactactcttgaccg

SEQ ID NO: 151256 - DNA, 25 bp, Homo sapien
caaccggaaccgcaaaagcacggct

SEQ ID NO: 151257 - DNA, 25 bp, Homo sapien
gggctctggactggcacccactgcg

SEQ ID NO: 151258 - DNA, 25 bp, Homo sapien
gtgagaaccagcaaccggaaccgca

SEQ ID NO: 151259 - DNA, 25 bp, Homo sapien
gccgctaccgagaagcacagggacc

SEQ ID NO: 151260 - DNA, 25 bp, Homo sapien
cacgacgcagcggtgtgagaaccag

SEQ ID NO: 151261 - DNA, 25 bp, Homo sapien
acagggacccgacttcagtcatcga

SEQ ID NO: 151262 - DNA, 25 bp, Homo sapien
cctgagccaattgccagctcgtgtg

SEQ ID NO: 151263 - DNA, 25 bp, Homo sapien
gagggccgggtcaagactaagtcaa

SEQ ID NO: 151264 - DNA, 25 bp, Homo sapien
ccggctaggcccgaatgtcgttagc

SEQ ID NO: 151265 - DNA, 25 bp, Homo sapien
ttacccattcggtgtccacgcgaga

SEQ ID NO: 151266 - DNA, 25 bp, Homo sapien
tttaaaaggtgaagcagtggaggca

SEQ ID NO: 151267 - DNA, 25 bp, Homo sapien
gagcgctcttctcgcgaggccggct

SEQ ID NO: 151268 - DNA, 25 bp, Homo sapien
tggtgaccgttacccattcggtgtc

SEQ ID NO: 151269 - DNA, 25 bp, Homo sapien
taggcccgaatgtcgttagccgtgg

SEQ ID NO: 151270 - DNA, 25 bp, Homo sapien
cattcggtgtccacgcgagacgccg

SEQ ID NO: 151271 - DNA, 25 bp, Homo sapien
ttcggtcacggctctccggttggtc

SEQ ID NO: 151272 - DNA, 25 bp, Homo sapien
gatcatcttcatggcgttgcacggg

SEQ ID NO: 151273 - DNA, 25 bp, Homo sapien
ttcggattgattgctgaggggaccc

SEQ ID NO: 151274 - DNA, 25 bp, Homo sapien
tccgcctggtgttcttagcttgtcc

SEQ ID NO: 151275 - DNA, 25 bp, Homo sapien
cacctctggcattatctggaaactg

SEQ ID NO: 151276 - DNA, 25 bp, Homo sapien
ctgcaggttacgttaaaggctttct

SEQ ID NO: 151277 - DNA, 25 bp, Homo sapien
atcatgtgaagagtctggcgtgtcc

SEQ ID NO: 151278 - DNA, 25 bp, Homo sapien
gttgcgtcacaccaatgacatctgg

SEQ ID NO: 151279 - DNA, 25 bp, Homo sapien
cgctctccacaggtcgcgttgtgta

SEQ ID NO: 151280 - DNA, 25 bp, Homo sapien
tacgcaactcgtccaggaagcaatc

SEQ ID NO: 151281 - DNA, 25 bp, Homo sapien
cccggagttgattcgcatctgtata

SEQ ID NO: 151282 - DNA, 25 bp, Homo sapien
agagccattctctcctcggtctagg

SEQ ID NO: 151283 - DNA, 25 bp, Homo sapien
ggattcgaacctacgatctccagta

SEQ ID NO: 151284 - DNA, 25 bp, Homo sapien
ccggcctgtagcctcttagtgattc

SEQ ID NO: 151285 - DNA, 25 bp, Homo sapien
gtctcgcggtgaccaatcagagctc

SEQ ID NO: 151286 - DNA, 25 bp, Homo sapien
agagctcagggcaagactttgtccc

SEQ ID NO: 151287 - DNA, 25 bp, Homo sapien
ggcttccagacaggtggacgcttta

SEQ ID NO: 151288 - DNA, 25 bp, Homo sapien
cccacaggtcgccagaaacttggtg

SEQ ID NO: 151289 - DNA, 25 bp, Homo sapien
gctgaagagggttagcgaaacgtta

SEQ ID NO: 151290 - DNA, 25 bp, Homo sapien
gtcgagagacgaggcccaatggaaa

SEQ ID NO: 151291 - DNA, 25 bp, Homo sapien
aaaaagcttgcaccgcagccctgtc

SEQ ID NO: 151292 - DNA, 25 bp, Homo sapien
acgacagcgacgatagccgaggcaa

SEQ ID NO: 151293 - DNA, 25 bp, Homo sapien
gacccgaagggctcctaagtgactg

SEQ ID NO: 151294 - DNA, 25 bp, Homo sapien
tccaatgagtggagcggtgagtaca

SEQ ID NO: 151295 - DNA, 25 bp, Homo sapien
ctgccttttacgtaggcgcagcaca

SEQ ID NO: 151296 - DNA, 25 bp, Homo sapien
gagcccgaagtggagtcctggtttc

SEQ ID NO: 151297 - DNA, 25 bp, Homo sapien
tcttgacaggatgcccgggcgacgc

SEQ ID NO: 151298 - DNA, 25 bp, Homo sapien
cgccagtgactattcccagggatcc

SEQ ID NO: 151299 - DNA, 25 bp, Homo sapien
aacgccgccagtgactattcccagg

SEQ ID NO: 151300 - DNA, 25 bp, Homo sapien
ctcacccggagtcgggatgggtctt

SEQ ID NO: 151301 - DNA, 25 bp, Homo sapien
gccttctgacccatccctaaagatg

SEQ ID NO: 151302 - DNA, 25 bp, Homo sapien
gctccgcgccacttgagaggaccga

SEQ ID NO: 151303 - DNA, 25 bp, Homo sapien
gctgctcacaccgagcccgaagtgg

SEQ ID NO: 151304 - DNA, 25 bp, Homo sapien
gggcacctcaacagctcggggtcca

SEQ ID NO: 151305 - DNA, 25 bp, Homo sapien
ggtaagcaggcttcccagttcctcg

SEQ ID NO: 151306 - DNA, 25 bp, Homo sapien
caggacttaggggttcgcactccac

SEQ ID NO: 151307 - DNA, 25 bp, Homo sapien
cgtcatcgcctttcatcccagaaaa

SEQ ID NO: 151308 - DNA, 25 bp, Homo sapien
tgctttcagtagacagccgtcatcg

SEQ ID NO: 151309 - DNA, 25 bp, Homo sapien
caaccacatactgcctggggacacg

SEQ ID NO: 151310 - DNA, 25 bp, Homo sapien
ccgcaagaatccgtcccagcaagta

SEQ ID NO: 151311 - DNA, 25 bp, Homo sapien
cggagtccgcgcttcccgcaagaat

SEQ ID NO: 151312 - DNA, 25 bp, Homo sapien
acccgcacaggcagagaccaagtca

SEQ ID NO: 151313 - DNA, 25 bp, Homo sapien
cggacgcacaaaagaatcgcgcaca

SEQ ID NO: 151314 - DNA, 25 bp, Homo sapien
cgcgcacagaagtatcccggtatca

SEQ ID NO: 151315 - DNA, 25 bp, Homo sapien
gacgcaccacggcacctttctagga

SEQ ID NO: 151316 - DNA, 25 bp, Homo sapien
agaacacacactttcaaggacacga

SEQ ID NO: 151317 - DNA, 25 bp, Homo sapien
ttggaagcgctcaaaccaaagaaca

SEQ ID NO: 151318 - DNA, 25 bp, Homo sapien
ctttctaggacacttggaagcgctc

SEQ ID NO: 151319 - DNA, 25 bp, Homo sapien
ttaaagcgccttagtgccgtggaca

SEQ ID NO: 151320 - DNA, 25 bp, Homo sapien
aacgtcgccgcaagcggtcaagcca

SEQ ID NO: 151321 - DNA, 25 bp, Homo sapien
ctcaaagatgcatgcctggtgctgc

SEQ ID NO: 151322 - DNA, 25 bp, Homo sapien
gactggcgctccgatctcaaagatg

SEQ ID NO: 151323 - DNA, 25 bp, Homo sapien
ggacacaaggaacaccctgggtctg

SEQ ID NO: 151324 - DNA, 25 bp, Homo sapien
gcagggccggcccaaagatccagaa

SEQ ID NO: 151325 - DNA, 25 bp, Homo sapien
gcggcgctagatccacgcaagtgaa

SEQ ID NO: 151326 - DNA, 25 bp, Homo sapien
gggcctccaggagctactctccagg

SEQ ID NO: 151327 - DNA, 25 bp, Homo sapien
ctcgcttctaaacgtggtgctgctc

SEQ ID NO: 151328 - DNA, 25 bp, Homo sapien
caactctggggatttccggtcaaca

SEQ ID NO: 151329 - DNA, 25 bp, Homo sapien
ggagctttccgcctattaccgggca

SEQ ID NO: 151330 - DNA, 25 bp, Homo sapien
cgattgggtcgctataccgcatgtc

SEQ ID NO: 151331 - DNA, 25 bp, Homo sapien
ggacgcactctcattggccaatcga

SEQ ID NO: 151332 - DNA, 25 bp, Homo sapien
gcctcgttgagagaaggtctcattc

SEQ ID NO: 151333 - DNA, 25 bp, Homo sapien
ggaaaaaccactggcggcaactctg

SEQ ID NO: 151334 - DNA, 25 bp, Homo sapien
tcctgagcgtagtccagttactttc

SEQ ID NO: 151335 - DNA, 25 bp, Homo sapien
cttggcgtcgcagcaatattccgga

SEQ ID NO: 151336 - DNA, 25 bp, Homo sapien
tattggcagcttctccataaggcgc

SEQ ID NO: 151337 - DNA, 25 bp, Homo sapien
cgcttcactgatcgcgctttccaga

SEQ ID NO: 151338 - DNA, 25 bp, Homo sapien
gtggcttttctcctccgctcctaaa

SEQ ID NO: 151339 - DNA, 25 bp, Homo sapien
atggttggactgaaattccgctttc

SEQ ID NO: 151340 - DNA, 25 bp, Homo sapien
ctggggacgaagaaactttgacctg

SEQ ID NO: 151341 - DNA, 25 bp, Homo sapien
tcatcggcccattcctgtcactaga

SEQ ID NO: 151342 - DNA, 25 bp, Homo sapien
tgtctcctagactcattggttcagc

SEQ ID NO: 151343 - DNA, 25 bp, Homo sapien
ggcgccgccctttccgtatcagaaa

SEQ ID NO: 151344 - DNA, 25 bp, Homo sapien
tgggaatccctttgcagcaccgcgc

SEQ ID NO: 151345 - DNA, 25 bp, Homo sapien
tgtggctatccaagactccgtctcg

SEQ ID NO: 151346 - DNA, 25 bp, Homo sapien
cgccaggccgggcttctaagaattc

SEQ ID NO: 151347 - DNA, 25 bp, Homo sapien
actgcgcagtatcctttcctgggaa

SEQ ID NO: 151348 - DNA, 25 bp, Homo sapien
cgctgcgcagattgagcccactgaa

SEQ ID NO: 151349 - DNA, 25 bp, Homo sapien
cccacctggctttgatcaatccgga

SEQ ID NO: 151350 - DNA, 25 bp, Homo sapien
gccaatcggagccagttcttatttg

SEQ ID NO: 151351 - DNA, 25 bp, Homo sapien
aagaccctcatgacggatacctgga

SEQ ID NO: 151352 - DNA, 25 bp, Homo sapien
cgacggctgcaacgaggcttctgca

SEQ ID NO: 151353 - DNA, 25 bp, Homo sapien
ctgcagatctgagttcacggaaagg

SEQ ID NO: 151354 - DNA, 25 bp, Homo sapien
cagcttctgcgggaaaatcattttc

SEQ ID NO: 151355 - DNA, 25 bp, Homo sapien
gttttccagaactgcgagcgggtca

SEQ ID NO: 151356 - DNA, 25 bp, Homo sapien
catgtgtccaggtggccacagctca

SEQ ID NO: 151357 - DNA, 25 bp, Homo sapien
gggctccgccctgcggttctgaaac

SEQ ID NO: 151358 - DNA, 25 bp, Homo sapien
cacgttaattgcctcttaacgcgcg

SEQ ID NO: 151359 - DNA, 25 bp, Homo sapien
cggaaaggaccatgaggagacactc

SEQ ID NO: 151360 - DNA, 25 bp, Homo sapien
tcagtcaaagtcgacaccctggttc

SEQ ID NO: 151361 - DNA, 25 bp, Homo sapien
ggtgccctccgtctcaaatttcagt

SEQ ID NO: 151362 - DNA, 25 bp, Homo sapien
tactcggaagtacgtgggcaaaatc

SEQ ID NO: 151363 - DNA, 25 bp, Homo sapien
tcgcaggttcttgcactaccgggtg

SEQ ID NO: 151364 - DNA, 25 bp, Homo sapien
gcttgttccggccttctgcttcaaa

SEQ ID NO: 151365 - DNA, 25 bp, Homo sapien
gcggcgagtttgtcttagccttctc

SEQ ID NO: 151366 - DNA, 25 bp, Homo sapien
atcgcggcaccggttcgagaaccct

SEQ ID NO: 151367 - DNA, 25 bp, Homo sapien
agtcatggctgcactgccgagtacc

SEQ ID NO: 151368 - DNA, 25 bp, Homo sapien
ctgagtcagcatcgtagaagaattc

SEQ ID NO: 151369 - DNA, 25 bp, Homo sapien
ggtagcggtccagcgtattcttcca

SEQ ID NO: 151370 - DNA, 25 bp, Homo sapien
cagggtcgcgatcgaagaagtactc

SEQ ID NO: 151371 - DNA, 25 bp, Homo sapien
ccaggccgtagaaagccagctcttc

SEQ ID NO: 151372 - DNA, 25 bp, Homo sapien
cggtcccgatactcttcaaggcagc

SEQ ID NO: 151373 - DNA, 25 bp, Homo sapien
ggcattctccttctttcggtcccga

SEQ ID NO: 151374 - DNA, 25 bp, Homo sapien
atggtctccaccacattggcgatga

SEQ ID NO: 151375 - DNA, 25 bp, Homo sapien
gacatcgtcgttcttgggcaccaaa

SEQ ID NO: 151376 - DNA, 25 bp, Homo sapien
tgtaatatctgagccctagaccgcg

SEQ ID NO: 151377 - DNA, 25 bp, Homo sapien
ggtctcctggccaagcttttagctg

SEQ ID NO: 151378 - DNA, 25 bp, Homo sapien
attaagccgctccttgggtcctctg

SEQ ID NO: 151379 - DNA, 25 bp, Homo sapien
ttggttgaaccacgcctctatgttt

SEQ ID NO: 151380 - DNA, 25 bp, Homo sapien
gtctggccacgacccattagcgagg

SEQ ID NO: 151381 - DNA, 25 bp, Homo sapien
aactccacaggaagtgaccgcactg

SEQ ID NO: 151382 - DNA, 25 bp, Homo sapien
ctaagccatggagctagcactgcgc

SEQ ID NO: 151383 - DNA, 25 bp, Homo sapien
cgcgccctctttcggccaatatttg

SEQ ID NO: 151384 - DNA, 25 bp, Homo sapien
gagccggcgcttgcgcacttagtct

SEQ ID NO: 151385 - DNA, 25 bp, Homo sapien
cttagtctccgccactgctgtggtc

SEQ ID NO: 151386 - DNA, 25 bp, Homo sapien
tggaagcggacagacccgagttaga

SEQ ID NO: 151387 - DNA, 25 bp, Homo sapien
ccacggctaacggtagcgcagccga

SEQ ID NO: 151388 - DNA, 25 bp, Homo sapien
ccgccctcgagaaagcgtgtgcgca

SEQ ID NO: 151389 - DNA, 25 bp, Homo sapien
taacggtagcgcagccgaacacggc

SEQ ID NO: 151390 - DNA, 25 bp, Homo sapien
gcaagaaaaatcgaagacccgagcc

SEQ ID NO: 151391 - DNA, 25 bp, Homo sapien
gcgctcccagggcaagaaaaatcga

SEQ ID NO: 151392 - DNA, 25 bp, Homo sapien
gtggaatagacctcagcctgcagcc

SEQ ID NO: 151393 - DNA, 25 bp, Homo sapien
tgctttcctggctatctcggggtag

SEQ ID NO: 151394 - DNA, 25 bp, Homo sapien
gtgagcagccaggacgcctcagata

SEQ ID NO: 151395 - DNA, 25 bp, Homo sapien
cctcagatactgaaagcgtggccga

SEQ ID NO: 151396 - DNA, 25 bp, Homo sapien
cgtggccagtggaaggcacttaaca

SEQ ID NO: 151397 - DNA, 25 bp, Homo sapien
tggtgccttaagcatgctctggctg

SEQ ID NO: 151398 - DNA, 25 bp, Homo sapien
tacaagggaaccaagctagccggcc

SEQ ID NO: 151399 - DNA, 25 bp, Homo sapien
caacgaggcgtgcaccaggatcact

SEQ ID NO: 151400 - DNA, 25 bp, Homo sapien
aacaaagtcgtccagggcgcgtagc

SEQ ID NO: 151401 - DNA, 25 bp, Homo sapien
cctgccggttaatgtggctggacca

SEQ ID NO: 151402 - DNA, 25 bp, Homo sapien
gcgagatgctcccaacccttaaaac

SEQ ID NO: 151403 - DNA, 25 bp, Homo sapien
gcctttgccacgaagcgagatgctc

SEQ ID NO: 151404 - DNA, 25 bp, Homo sapien
ctgccgggaaatcaagcctttgcca

SEQ ID NO: 151405 - DNA, 25 bp, Homo sapien
ctaacacgccgctcaggaaagcagc

SEQ ID NO: 151406 - DNA, 25 bp, Homo sapien
taacctcctaggtggattgcgcagg

SEQ ID NO: 151407 - DNA, 25 bp, Homo sapien
ggctgggcagctttttcctaacctc

SEQ ID NO: 151408 - DNA, 25 bp, Homo sapien
ttcctcaaggccgagactgtctgag

SEQ ID NO: 151409 - DNA, 25 bp, Homo sapien
gggtgtttacatcaggccctacttc

SEQ ID NO: 151410 - DNA, 25 bp, Homo sapien
agcctgtcgcaggaaatgactcacc

SEQ ID NO: 151411 - DNA, 25 bp, Homo sapien
cccagctggaaaaaggcggccaccg

SEQ ID NO: 151412 - DNA, 25 bp, Homo sapien
tcttcggagcatcgcgagtgacagt

SEQ ID NO: 151413 - DNA, 25 bp, Homo sapien
accttccctgctaacaagacgcgga

SEQ ID NO: 151414 - DNA, 25 bp, Homo sapien
agagtagccgcaccggttcgcaaca

SEQ ID NO: 151415 - DNA, 25 bp, Homo sapien
cctagttcccgggtcttcggagcat

SEQ ID NO: 151416 - DNA, 25 bp, Homo sapien
gccaatcaaccatcgaccaatcaga

SEQ ID NO: 151417 - DNA, 25 bp, Homo sapien
ggcagctaccgagaagcgccaatca

SEQ ID NO: 151418 - DNA, 25 bp, Homo sapien
aaccacggtgcgcaggcacagaacc

SEQ ID NO: 151419 - DNA, 25 bp, Homo sapien
gatcatcaccgtcaatcgtcatcga

SEQ ID NO: 151420 - DNA, 25 bp, Homo sapien
ccggccttaagccagttgcttgttc

SEQ ID NO: 151421 - DNA, 25 bp, Homo sapien
gagcccaggcactgaatggcaccca

SEQ ID NO: 151422 - DNA, 25 bp, Homo sapien
tggctccatgtggacgctttcgtgc

SEQ ID NO: 151423 - DNA, 25 bp, Homo sapien
ttccggagtgagaaacgggacagta

SEQ ID NO: 151424 - DNA, 25 bp, Homo sapien
ccgcagagatttccaaggggtgaaa

SEQ ID NO: 151425 - DNA, 25 bp, Homo sapien
ttcagatcgctaggggccggccaaa

SEQ ID NO: 151426 - DNA, 25 bp, Homo sapien
gccgtgggaagtaattgtcgctctt

SEQ ID NO: 151427 - DNA, 25 bp, Homo sapien
gaaatttagtttgggttcagatcgc

SEQ ID NO: 151428 - DNA, 25 bp, Homo sapien
cgtcagcggcaaaacaccctctttg

SEQ ID NO: 151429 - DNA, 25 bp, Homo sapien
cgtgcgagtgaagccgaatgaaatt

SEQ ID NO: 151430 - DNA, 25 bp, Homo sapien
tttcaagaaatccttctcctccgga

SEQ ID NO: 151431 - DNA, 25 bp, Homo sapien
tgtcgctctttcaaacgtggtggga

SEQ ID NO: 151432 - DNA, 25 bp, Homo sapien
tccttccctcgagagcagaggccga

SEQ ID NO: 151433 - DNA, 25 bp, Homo sapien
agagacctggaagaactgttgcctc

SEQ ID NO: 151434 - DNA, 25 bp, Homo sapien
tgagcacgtgcacccagcagacgag

SEQ ID NO: 151435 - DNA, 25 bp, Homo sapien
gacgcagccgagatgacagcaaata

SEQ ID NO: 151436 - DNA, 25 bp, Homo sapien
aggccagacgaaacgccgctcttga

SEQ ID NO: 151437 - DNA, 25 bp, Homo sapien
tcttgacgcctcatgggaccatctc

SEQ ID NO: 151438 - DNA, 25 bp, Homo sapien
tgttgcctccacgagagaggcgttt

SEQ ID NO: 151439 - DNA, 25 bp, Homo sapien
agaggcgtttgctctccttccctcg

SEQ ID NO: 151440 - DNA, 25 bp, Homo sapien
gcttccggacgctcaaagactagaa

SEQ ID NO: 151441 - DNA, 25 bp, Homo sapien
tccggacgctcaaagactagaaatg

SEQ ID NO: 151442 - DNA, 25 bp, Homo sapien
ctgtgtactagcgccgccacatcga

SEQ ID NO: 151443 - DNA, 25 bp, Homo sapien
cggacgctcaaagactagaaatgcc

SEQ ID NO: 151444 - DNA, 25 bp, Homo sapien
cgctcaaagactagaaatgcccctc

SEQ ID NO: 151445 - DNA, 25 bp, Homo sapien
gccgccacatcgaccgcagccctcg

SEQ ID NO: 151446 - DNA, 25 bp, Homo sapien
gcgcccgccctgtgtactagcgccg

SEQ ID NO: 151447 - DNA, 25 bp, Homo sapien
tgcttccggacgctcaaagactaga

SEQ ID NO: 151448 - DNA, 25 bp, Homo sapien
cggtgacctacctggcggccagcaa

SEQ ID NO: 151449 - DNA, 25 bp, Homo sapien
gccaggaggagtgcttggcctcact

SEQ ID NO: 151450 - DNA, 25 bp, Homo sapien
tgcaggcgccgcactctgttaacta

SEQ ID NO: 151451 - DNA, 25 bp, Homo sapien
ggcgccgcactctgttaactaaagg

SEQ ID NO: 151452 - DNA, 25 bp, Homo sapien
cgcactctgttaactaaaggtccta

SEQ ID NO: 151453 - DNA, 25 bp, Homo sapien
tttaaaagcctgacaataccaactg

SEQ ID NO: 151454 - DNA, 25 bp, Homo sapien
gcctgacaataccaactgttgctga

SEQ ID NO: 151455 - DNA, 25 bp, Homo sapien
caactgttgctgaagatatggagga

SEQ ID NO: 151456 - DNA, 25 bp, Homo sapien
atacaggaaccaggcacgggcccgc

SEQ ID NO: 151457 - DNA, 25 bp, Homo sapien
ccgccaccctgtttccagggtctga

SEQ ID NO: 151458 - DNA, 25 bp, Homo sapien
cagatacaggaaccaggcacgggcc

SEQ ID NO: 151459 - DNA, 25 bp, Homo sapien
cccgcagatacaggaaccaggcacg

SEQ ID NO: 151460 - DNA, 25 bp, Homo sapien
ttgctggccgccagataggccaccc

SEQ ID NO: 151461 - DNA, 25 bp, Homo sapien
tctgagcgggtcaccaggtgagcac

SEQ ID NO: 151462 - DNA, 25 bp, Homo sapien
ctcagctaacggaggcctccttgct

SEQ ID NO: 151463 - DNA, 25 bp, Homo sapien
gtcctcagctaacggaggcctcctt

SEQ ID NO: 151464 - DNA, 25 bp, Homo sapien
ctaggtcttcgagcgtccggaagca

SEQ ID NO: 151465 - DNA, 25 bp, Homo sapien
agtgactggcgcagggcctccgctg

SEQ ID NO: 151466 - DNA, 25 bp, Homo sapien
cgcgagctgcggtcgacgtggcagc

SEQ ID NO: 151467 - DNA, 25 bp, Homo sapien
atttctaggtcttcgagcgtccgga

SEQ ID NO: 151468 - DNA, 25 bp, Homo sapien
gaggggcatttctaggtcttcgagc

SEQ ID NO: 151469 - DNA, 25 bp, Homo sapien
tccagggacaccgtgggagcaagcg

SEQ ID NO: 151470 - DNA, 25 bp, Homo sapien
gtcgacgtggcagcgctggtacgca

SEQ ID NO: 151471 - DNA, 25 bp, Homo sapien
gggcatttctaggtcttcgagcgtc

SEQ ID NO: 151472 - DNA, 25 bp, Homo sapien
cagtcgaggacctcacggggtgttc

SEQ ID NO: 151473 - DNA, 25 bp, Homo sapien
gtcggcgttgacctgtcccctcttg

SEQ ID NO: 151474 - DNA, 25 bp, Homo sapien
cgggtatcctgaggggcatttctag

SEQ ID NO: 151475 - DNA, 25 bp, Homo sapien
gggacagcagtgacctccgaaacta

SEQ ID NO: 151476 - DNA, 25 bp, Homo sapien
ttgcagtcaaacagcgatctccagg

SEQ ID NO: 151477 - DNA, 25 bp, Homo sapien
tctaggactattgcagtcaaacagc

SEQ ID NO: 151478 - DNA, 25 bp, Homo sapien
tcaaacagcgatctccagggacacc

SEQ ID NO: 151479 - DNA, 25 bp, Homo sapien
ttcggaggtgtctaggactattgca

SEQ ID NO: 151480 - DNA, 25 bp, Homo sapien
tagtcccgtcatggccagatcgcag

SEQ ID NO: 151481 - DNA, 25 bp, Homo sapien
gcggagacactgagcctacctctga

SEQ ID NO: 151482 - DNA, 25 bp, Homo sapien
cagcgtcagtggtacgacccttcca

SEQ ID NO: 151483 - DNA, 25 bp, Homo sapien
ttcgatccggtcttgacttgccagg

SEQ ID NO: 151484 - DNA, 25 bp, Homo sapien
gcccgggccactctgtaaaggagca

SEQ ID NO: 151485 - DNA, 25 bp, Homo sapien
gtgggtcgatcctgcttgagtaatc

SEQ ID NO: 151486 - DNA, 25 bp, Homo sapien
ccatcccggacgacgctcaagaaga

SEQ ID NO: 151487 - DNA, 25 bp, Homo sapien
cgctgaggatcccaacgaccagatc

SEQ ID NO: 151488 - DNA, 25 bp, Homo sapien
ggacagcctgcgtgaactcatcagt

SEQ ID NO: 151489 - DNA, 25 bp, Homo sapien
gcaaggagcctataacgcatacgga

SEQ ID NO: 151490 - DNA, 25 bp, Homo sapien
cctcctgtttgctgagattgtgagc

SEQ ID NO: 151491 - DNA, 25 bp, Homo sapien
ggcgccgcctttgagtcacttgtaa

SEQ ID NO: 151492 - DNA, 25 bp, Homo sapien
tcgcgcactcgaaagggaatcctcc

SEQ ID NO: 151493 - DNA, 25 bp, Homo sapien
agcccatgccatggcggattctgag

SEQ ID NO: 151494 - DNA, 25 bp, Homo sapien
aagtgagcagatcctccgaggcacc

SEQ ID NO: 151495 - DNA, 25 bp, Homo sapien
gcgtcctcgaaaccacgagcaagtg

SEQ ID NO: 151496 - DNA, 25 bp, Homo sapien
gtcacattgatagtggcgacgtctg

SEQ ID NO: 151497 - DNA, 25 bp, Homo sapien
ccgaaggcactatcatctgggcgca

SEQ ID NO: 151498 - DNA, 25 bp, Homo sapien
tctgacgaccgaaggcactatcatc

SEQ ID NO: 151499 - DNA, 25 bp, Homo sapien
ggtgctctgacgaccgaaggcacta

SEQ ID NO: 151500 - DNA, 25 bp, Homo sapien
tcagacaccagagggtcgcggaagc

SEQ ID NO: 151501 - DNA, 25 bp, Homo sapien
attgatagtggcgacgtctgcttgg

SEQ ID NO: 151502 - DNA, 25 bp, Homo sapien
ggcactatcatctgggcgcaggtta

SEQ ID NO: 151503 - DNA, 25 bp, Homo sapien
gcgggcctccttcagacaccagagg

SEQ ID NO: 151504 - DNA, 25 bp, Homo sapien
agaatcccggcgtgccacgtggcct

SEQ ID NO: 151505 - DNA, 25 bp, Homo sapien
tgtaatccttgcgaccgtcaggcca

SEQ ID NO: 151506 - DNA, 25 bp, Homo sapien
cgtaaacctgacaccctcgtgggag

SEQ ID NO: 151507 - DNA, 25 bp, Homo sapien
cgggcatgtggtctctccgctgcca

SEQ ID NO: 151508 - DNA, 25 bp, Homo sapien
cctgcctagaggtgaactgcacgta

SEQ ID NO: 151509 - DNA, 25 bp, Homo sapien
ctagaggtgaactgcacgtagcccg

SEQ ID NO: 151510 - DNA, 25 bp, Homo sapien
tgcggggcgtcacaaggcacgaccc

SEQ ID NO: 151511 - DNA, 25 bp, Homo sapien
gccgggtcaggcgaatgtaatcctt

SEQ ID NO: 151512 - DNA, 25 bp, Homo sapien
gaatgaatccgtaggctccgcaagg

SEQ ID NO: 151513 - DNA, 25 bp, Homo sapien
ttgctgcccatagtcgccctgaggc

SEQ ID NO: 151514 - DNA, 25 bp, Homo sapien
cgaacacctgcagggagacaaggct

SEQ ID NO: 151515 - DNA, 25 bp, Homo sapien
ctgccggctggttgaccatagtcag

SEQ ID NO: 151516 - DNA, 25 bp, Homo sapien
tccttaaacacgaaccacaggttgc

SEQ ID NO: 151517 - DNA, 25 bp, Homo sapien
ccctgcgtgcaggaatgagcatgcg

SEQ ID NO: 151518 - DNA, 25 bp, Homo sapien
ctctgagtcccagtgcgagaacgtc

SEQ ID NO: 151519 - DNA, 25 bp, Homo sapien
cgagaacgtcgatgtgcagaaaaat

SEQ ID NO: 151520 - DNA, 25 bp, Homo sapien
agaccgggaggttgcagcaagacac

SEQ ID NO: 151521 - DNA, 25 bp, Homo sapien
tgcctcgtctgtgggacattctcct

SEQ ID NO: 151522 - DNA, 25 bp, Homo sapien
cagctccgcggaacgtgaggcagca

SEQ ID NO: 151523 - DNA, 25 bp, Homo sapien
caggaaacaagcgagtgagcagctc

SEQ ID NO: 151524 - DNA, 25 bp, Homo sapien
cgcagcctgtcagaagcccgaggac

SEQ ID NO: 151525 - DNA, 25 bp, Homo sapien
tgcagcaagacactgaccaaacatc

SEQ ID NO: 151526 - DNA, 25 bp, Homo sapien
tgggacattctccttccgtctcact

SEQ ID NO: 151527 - DNA, 25 bp, Homo sapien
gaccaaacatcttcaggaaacaagc

SEQ ID NO: 151528 - DNA, 25 bp, Homo sapien
cgggaatatgcgttgggaaaacaca

SEQ ID NO: 151529 - DNA, 25 bp, Homo sapien
gttgtaccacagtctcaccggcagc

SEQ ID NO: 151530 - DNA, 25 bp, Homo sapien
tgcgcacagcgggttgtaccacagt

SEQ ID NO: 151531 - DNA, 25 bp, Homo sapien
gctcgttggaacagcccaggcggct

SEQ ID NO: 151532 - DNA, 25 bp, Homo sapien
gcgtacctgattcaccacgtccatg

SEQ ID NO: 151533 - DNA, 25 bp, Homo sapien
gctgcggcaaagagcgcactccttt

SEQ ID NO: 151534 - DNA, 25 bp, Homo sapien
gtccacggtgctggagcgcgtacct

SEQ ID NO: 151535 - DNA, 25 bp, Homo sapien
tgcgttgggaaaacacaagtcgagg

SEQ ID NO: 151536 - DNA, 25 bp, Homo sapien
ggaatacgtactccacctgctcctg

SEQ ID NO: 151537 - DNA, 25 bp, Homo sapien
agcccgtaggccacgatcttgagca

SEQ ID NO: 151538 - DNA, 25 bp, Homo sapien
gcgcacccgaccacgacgatgatga

SEQ ID NO: 151539 - DNA, 25 bp, Homo sapien
cggtctgaaagagtcgctttcctga

SEQ ID NO: 151540 - DNA, 25 bp, Homo sapien
ctttcctgagcccagaattcagcgg

SEQ ID NO: 151541 - DNA, 25 bp, Homo sapien
cgatgatgaagtcgagtaggttcca

SEQ ID NO: 151542 - DNA, 25 bp, Homo sapien
gtaggttccagccattgcggatgta

SEQ ID NO: 151543 - DNA, 25 bp, Homo sapien
tcttgagcaccgtctccacagtgaa

SEQ ID NO: 151544 - DNA, 25 bp, Homo sapien
cttttacttggctgcagactggtcg

SEQ ID NO: 151545 - DNA, 25 bp, Homo sapien
gactggtcggatttcgcagctccta

SEQ ID NO: 151546 - DNA, 25 bp, Homo sapien
cccgtgactccaaggtgatctcgtt

SEQ ID NO: 151547 - DNA, 25 bp, Homo sapien
tgctggtgatctccaccatgccatc

SEQ ID NO: 151548 - DNA, 25 bp, Homo sapien
tcagctcgtcggaggcgaagtagtt

SEQ ID NO: 151549 - DNA, 25 bp, Homo sapien
agttgatgtccagggatacgcgcca

SEQ ID NO: 151550 - DNA, 25 bp, Homo sapien
gcatccgggctaaggcttttacttg

SEQ ID NO: 151551 - DNA, 25 bp, Homo sapien
tcaaagaggcgactgtgcgggtacc

SEQ ID NO: 151552 - DNA, 25 bp, Homo sapien
cgaagcccacatccgggactctaaa

SEQ ID NO: 151553 - DNA, 25 bp, Homo sapien
caggccggcacgtaaggacagagcc

SEQ ID NO: 151554 - DNA, 25 bp, Homo sapien
aggcggaccgaatcctcatccattc

SEQ ID NO: 151555 - DNA, 25 bp, Homo sapien
tccgacacggctccaccatggagga

SEQ ID NO: 151556 - DNA, 25 bp, Homo sapien
gcacggagcagggtttctacagctg

SEQ ID NO: 151557 - DNA, 25 bp, Homo sapien
acccgtgacactctgtggaccgcga

SEQ ID NO: 151558 - DNA, 25 bp, Homo sapien
atgcgccgtgctcgctcacagaact

SEQ ID NO: 151559 - DNA, 25 bp, Homo sapien
catccgggactctaaagcccaggac

SEQ ID NO: 151560 - DNA, 25 bp, Homo sapien
acggctgggcttccttttgcgacca

SEQ ID NO: 151561 - DNA, 25 bp, Homo sapien
gcccattggccctctgcaatacttg

SEQ ID NO: 151562 - DNA, 25 bp, Homo sapien
tgtacgtcatccgtgcatggctgcc

SEQ ID NO: 151563 - DNA, 25 bp, Homo sapien
tccggctctcaattcgctgtacgtc

SEQ ID NO: 151564 - DNA, 25 bp, Homo sapien
ggcctctccattgattcctcgatca

SEQ ID NO: 151565 - DNA, 25 bp, Homo sapien
atcgcctgtagccattccacttttc

SEQ ID NO: 151566 - DNA, 25 bp, Homo sapien
tacgcgtgctgaaccgctccttcga

SEQ ID NO: 151567 - DNA, 25 bp, Homo sapien
gacttccgcattagctgtctgcttc

SEQ ID NO: 151568 - DNA, 25 bp, Homo sapien
agaagggccacgaggtcgtcctcct

SEQ ID NO: 151569 - DNA, 25 bp, Homo sapien
cctctactgagattcatctggtagg

SEQ ID NO: 151570 - DNA, 25 bp, Homo sapien
ccggactctttttcctctactgaga

SEQ ID NO: 151571 - DNA, 25 bp, Homo sapien
cgcctcagtgcgcatgttcactggg

SEQ ID NO: 151572 - DNA, 25 bp, Homo sapien
tgccgtccggactctttttcctcta

SEQ ID NO: 151573 - DNA, 25 bp, Homo sapien
ctgtgtggttcctgccgtccggact

SEQ ID NO: 151574 - DNA, 25 bp, Homo sapien
ttcgcccacgtgaagaacgccaggg

SEQ ID NO: 151575 - DNA, 25 bp, Homo sapien
ttcacaggctgcgaggccaccggcg

SEQ ID NO: 151576 - DNA, 25 bp, Homo sapien
cgtctctgggcgtttgtctactcgg

SEQ ID NO: 151577 - DNA, 25 bp, Homo sapien
cttttaaaagctggtcttcttcttg

SEQ ID NO: 151578 - DNA, 25 bp, Homo sapien
ctggtcttcttcttgtcgtttacat

SEQ ID NO: 151579 - DNA, 25 bp, Homo sapien
tttatgaaattaacctgtgtcccta

SEQ ID NO: 151580 - DNA, 25 bp, Homo sapien
ttggtgcttttaaaagctggtcttc

SEQ ID NO: 151581 - DNA, 25 bp, Homo sapien
cctgtgtccctaagttttagaagtg

SEQ ID NO: 151582 - DNA, 25 bp, Homo sapien
tgtccctaagttttagaagtgagac

SEQ ID NO: 151583 - DNA, 25 bp, Homo sapien
agtgagaccacagtgaacaagcagc

SEQ ID NO: 151584 - DNA, 25 bp, Homo sapien
cgccgaaatgatggcctgtcacggc

SEQ ID NO: 151585 - DNA, 25 bp, Homo sapien
ggctcggccgccgaaatgatggcct

SEQ ID NO: 151586 - DNA, 25 bp, Homo sapien
ctcggccgccgaaatgatggcctgt

SEQ ID NO: 151587 - DNA, 25 bp, Homo sapien
tcggccgccgaaatgatggcctgtc

SEQ ID NO: 151588 - DNA, 25 bp, Homo sapien
cggccgccgaaatgatggcctgtca

SEQ ID NO: 151589 - DNA, 25 bp, Homo sapien
ccgccgaaatgatggcctgtcacgg

SEQ ID NO: 151590 - DNA, 25 bp, Homo sapien
gccgccgaaatgatggcctgtcacg

SEQ ID NO: 151591 - DNA, 25 bp, Homo sapien
gctcggccgccgaaatgatggcctg

SEQ ID NO: 151592 - DNA, 25 bp, Homo sapien
tcacagcctcagaaacatttctgga

SEQ ID NO: 151593 - DNA, 25 bp, Homo sapien
cgccttaaagagactgcgcggtccc

SEQ ID NO: 151594 - DNA, 25 bp, Homo sapien
gctggaagcgccttaaagagactgc

SEQ ID NO: 151595 - DNA, 25 bp, Homo sapien
agccgagagctggaagcgccttaaa

SEQ ID NO: 151596 - DNA, 25 bp, Homo sapien
cctgcatagacgaggggaaggacga

SEQ ID NO: 151597 - DNA, 25 bp, Homo sapien
atttctggacttggcacccgctcgg

SEQ ID NO: 151598 - DNA, 25 bp, Homo sapien
aaacatttctggacttggcacccgc

SEQ ID NO: 151599 - DNA, 25 bp, Homo sapien
atggcctgtcacggcttctgcctgc

SEQ ID NO: 151600 - DNA, 25 bp, Homo sapien
cccgatccctctccgcgtcgcagtc

SEQ ID NO: 151601 - DNA, 25 bp, Homo sapien
atccctctccgcgtcgcagtcgtgc

SEQ ID NO: 151602 - DNA, 25 bp, Homo sapien
cacccttccctccgatccaccgcgg

SEQ ID NO: 151603 - DNA, 25 bp, Homo sapien
gcggcaacagcgacgaggttcctcc

SEQ ID NO: 151604 - DNA, 25 bp, Homo sapien
gagcaggagccgaagcaggagctgg

SEQ ID NO: 151605 - DNA, 25 bp, Homo sapien
gtggacgccaccgagaaggtggaga

SEQ ID NO: 151606 - DNA, 25 bp, Homo sapien
gaaggtggacgccaccgagaaggtg

SEQ ID NO: 151607 - DNA, 25 bp, Homo sapien
ccgcgtcgcagtcgtgcgccgcgcc

SEQ ID NO: 151608 - DNA, 25 bp, Homo sapien
gagcccagccctgttctccgagtta

SEQ ID NO: 151609 - DNA, 25 bp, Homo sapien
gcccgcccagtcctcattaaatatg

SEQ ID NO: 151610 - DNA, 25 bp, Homo sapien
tccagccagtgctgagcggcgtttt

SEQ ID NO: 151611 - DNA, 25 bp, Homo sapien
ccgctggttttgtatgggtcttagc

SEQ ID NO: 151612 - DNA, 25 bp, Homo sapien
ctctcggaaaagtagttgctgcgct

SEQ ID NO: 151613 - DNA, 25 bp, Homo sapien
ccttttgccacttaacgcgcgtagc

SEQ ID NO: 151614 - DNA, 25 bp, Homo sapien
tgagcgccttgatccacacgggaaa

SEQ ID NO: 151615 - DNA, 25 bp, Homo sapien
tgtgaatgaagctctgccggctacg

SEQ ID NO: 151616 - DNA, 25 bp, Homo sapien
gtcgctatagtaaggagctccgttc

SEQ ID NO: 151617 - DNA, 25 bp, Homo sapien
cagtgggtccttgggcgtcactcca

SEQ ID NO: 151618 - DNA, 25 bp, Homo sapien
ctgaattctgttgctgggatgcgcg

SEQ ID NO: 151619 - DNA, 25 bp, Homo sapien
cgtcgatggtctttgctgtctgtcc

SEQ ID NO: 151620 - DNA, 25 bp, Homo sapien
gtaggcgcctttgggcaagtactgc

SEQ ID NO: 151621 - DNA, 25 bp, Homo sapien
ggagctccgttcatttccttggcct

SEQ ID NO: 151622 - DNA, 25 bp, Homo sapien
ctgtcctcgatctcggtgtgaggta

SEQ ID NO: 151623 - DNA, 25 bp, Homo sapien
ttgggcaagtactgctggctccagc

SEQ ID NO: 151624 - DNA, 25 bp, Homo sapien
aggcgtttgtcttcacagccgccct

SEQ ID NO: 151625 - DNA, 25 bp, Homo sapien
cgtctccaggcgtttgtcttcacag

SEQ ID NO: 151626 - DNA, 25 bp, Homo sapien
gtctccaggcgtttgtcttcacagc

SEQ ID NO: 151627 - DNA, 25 bp, Homo sapien
tctccaggcgtttgtcttcacagcc

SEQ ID NO: 151628 - DNA, 25 bp, Homo sapien
ctccaggcgtttgtcttcacagccg

SEQ ID NO: 151629 - DNA, 25 bp, Homo sapien
tccaggcgtttgtcttcacagccgc

SEQ ID NO: 151630 - DNA, 25 bp, Homo sapien
caggcgtttgtcttcacagccgccc

SEQ ID NO: 151631 - DNA, 25 bp, Homo sapien
ccaggcgtttgtcttcacagccgcc

SEQ ID NO: 151632 - DNA, 25 bp, Homo sapien
aaggctccgcagcttgggcctctgc

SEQ ID NO: 151633 - DNA, 25 bp, Homo sapien
tgaccgcggctaagaggtgtgtccc

SEQ ID NO: 151634 - DNA, 25 bp, Homo sapien
cactcaatccgtccgctatgtattc

SEQ ID NO: 151635 - DNA, 25 bp, Homo sapien
ccaggagtaccagctcgaagcagcc

SEQ ID NO: 151636 - DNA, 25 bp, Homo sapien
ccaagcaggcgaaggctccgcagct

SEQ ID NO: 151637 - DNA, 25 bp, Homo sapien
ctctgcggcagtgaccgcggctaag

SEQ ID NO: 151638 - DNA, 25 bp, Homo sapien
gtcctcaccaggagtaccagctcga

SEQ ID NO: 151639 - DNA, 25 bp, Homo sapien
ccagctcgaagcagccggcagaggc

SEQ ID NO: 151640 - DNA, 25 bp, Homo sapien
ctctgaggtctaacccgtgggcgct

SEQ ID NO: 151641 - DNA, 25 bp, Homo sapien
gtgtgcgcacacctcttcgtaagca

SEQ ID NO: 151642 - DNA, 25 bp, Homo sapien
gcacaccgcttcaggtctgggcagc

SEQ ID NO: 151643 - DNA, 25 bp, Homo sapien
cctgagtccctaagcctggaaggct

SEQ ID NO: 151644 - DNA, 25 bp, Homo sapien
agcctggaaggctaaagtaccctcg

SEQ ID NO: 151645 - DNA, 25 bp, Homo sapien
cactccatggctggcttggctctga

SEQ ID NO: 151646 - DNA, 25 bp, Homo sapien
ctcagcgtctccctatgctggaaca

SEQ ID NO: 151647 - DNA, 25 bp, Homo sapien
ggtctaacccgtgggcgctcagcgt

SEQ ID NO: 151648 - DNA, 25 bp, Homo sapien
gtctgtctggctcgcctatgctata

SEQ ID NO: 151649 - DNA, 25 bp, Homo sapien
agctggatttcccagccatcagcag

SEQ ID NO: 151650 - DNA, 25 bp, Homo sapien
gtgcttttagctggatttcccagcc

SEQ ID NO: 151651 - DNA, 25 bp, Homo sapien
taggagcctgccttgtgcttttagc

SEQ ID NO: 151652 - DNA, 25 bp, Homo sapien
ctcgcctatgctataggagcctgcc

SEQ ID NO: 151653 - DNA, 25 bp, Homo sapien
agagcaagtcgagagtgccccggca

SEQ ID NO: 151654 - DNA, 25 bp, Homo sapien
agctgaggctatctgggcgtctgtc

SEQ ID NO: 151655 - DNA, 25 bp, Homo sapien
cccaaacttgttaacgcgcgcgcgc

SEQ ID NO: 151656 - DNA, 25 bp, Homo sapien
cacccttaggggatgtctgcacctg

SEQ ID NO: 151657 - DNA, 25 bp, Homo sapien
tgagcggctcacagtgttccagacc

SEQ ID NO: 151658 - DNA, 25 bp, Homo sapien
ttaccttagacactgtgagcggctc

SEQ ID NO: 151659 - DNA, 25 bp, Homo sapien
atcagccgccagttcttaccttaga

SEQ ID NO: 151660 - DNA, 25 bp, Homo sapien
ctcccagccctaagtttcaaagttg

SEQ ID NO: 151661 - DNA, 25 bp, Homo sapien
agctcgtgttccagccacccttagg

SEQ ID NO: 151662 - DNA, 25 bp, Homo sapien
ttctcaacgtgcaggaaatctcgcc

SEQ ID NO: 151663 - DNA, 25 bp, Homo sapien
gtccattcaaagttaggcgccgtta

SEQ ID NO: 151664 - DNA, 25 bp, Homo sapien
cagcagctgcgtcggcggcccacac

SEQ ID NO: 151665 - DNA, 25 bp, Homo sapien
ccgagaatgcgcttcacctcgcaga

SEQ ID NO: 151666 - DNA, 25 bp, Homo sapien
cggacgcgcccgagaatgcgcttca

SEQ ID NO: 151667 - DNA, 25 bp, Homo sapien
cgcttcacctcgcagaagcgggtgg

SEQ ID NO: 151668 - DNA, 25 bp, Homo sapien
ctggcggactggctgactgacacgc

SEQ ID NO: 151669 - DNA, 25 bp, Homo sapien
agaatgcgcttcacctcgcagaagc

SEQ ID NO: 151670 - DNA, 25 bp, Homo sapien
gactggctgactgacacgcctcgct

SEQ ID NO: 151671 - DNA, 25 bp, Homo sapien
tggctgactgacacgcctcgcttgc

SEQ ID NO: 151672 - DNA, 25 bp, Homo sapien
tggagaaactaaagctgggcggttc

SEQ ID NO: 151673 - DNA, 25 bp, Homo sapien
gacgaggtcctgttagtgagtagca

SEQ ID NO: 151674 - DNA, 25 bp, Homo sapien
ctcctgggcgtcttcgaacagaacc

SEQ ID NO: 151675 - DNA, 25 bp, Homo sapien
caagcacagaacgtacgtgtatgta

SEQ ID NO: 151676 - DNA, 25 bp, Homo sapien
ttcaaagtcgaagatgccatcaagg

SEQ ID NO: 151677 - DNA, 25 bp, Homo sapien
atcaaggttctccagtgccacaagc

SEQ ID NO: 151678 - DNA, 25 bp, Homo sapien
cgtgcacgccgaatatctggagaaa

SEQ ID NO: 151679 - DNA, 25 bp, Homo sapien
ggctgcctcgaggatgaagtgcaaa

SEQ ID NO: 151680 - DNA, 25 bp, Homo sapien
acctgggcctcgtgtattacacctg

SEQ ID NO: 151681 - DNA, 25 bp, Homo sapien
ggacaccttctggtacctgggcctc

SEQ ID NO: 151682 - DNA, 25 bp, Homo sapien
agatacacgcgctgctccgaactcg

SEQ ID NO: 151683 - DNA, 25 bp, Homo sapien
tcaccgaaaggaagctggtaggcta

SEQ ID NO: 151684 - DNA, 25 bp, Homo sapien
cctggcggtagcaaagagcatcacc

SEQ ID NO: 151685 - DNA, 25 bp, Homo sapien
cctgctgtccaagctggggtcagga

SEQ ID NO: 151686 - DNA, 25 bp, Homo sapien
gcagccatctcggtaacgggcgtca

SEQ ID NO: 151687 - DNA, 25 bp, Homo sapien
ccgcggcgtccactaatgagatgaa

SEQ ID NO: 151688 - DNA, 25 bp, Homo sapien
ctcggggctgccaatcatagctgct

SEQ ID NO: 151689 - DNA, 25 bp, Homo sapien
cctgctcgtctaagccctgaatctg

SEQ ID NO: 151690 - DNA, 25 bp, Homo sapien
agccgcatcaccctggtagcttctg

SEQ ID NO: 151691 - DNA, 25 bp, Homo sapien
ttctacgtcgagtcaggcaacccag

SEQ ID NO: 151692 - DNA, 25 bp, Homo sapien
tgccgcagtcctcacgaagtttttg

SEQ ID NO: 151693 - DNA, 25 bp, Homo sapien
cgccgccattttcatcaccgatgag

SEQ ID NO: 151694 - DNA, 25 bp, Homo sapien
ggcgttatggccactcagtcagaca

SEQ ID NO: 151695 - DNA, 25 bp, Homo sapien
agctatccctgttccggggcttcta

SEQ ID NO: 151696 - DNA, 25 bp, Homo sapien
ctgtgaaatacaccgcattgtgact

SEQ ID NO: 151697 - DNA, 25 bp, Homo sapien
aggcgcgtcagccagtcggccagtc

SEQ ID NO: 151698 - DNA, 25 bp, Homo sapien
tgactttggccgactgcctccacgt

SEQ ID NO: 151699 - DNA, 25 bp, Homo sapien
gcgcactgtgaaatacaccgcattg

SEQ ID NO: 151700 - DNA, 25 bp, Homo sapien
cgtcgttcgcgcactgtgaaataca

SEQ ID NO: 151701 - DNA, 25 bp, Homo sapien
cgagaacgtcgttcgcgcactgtga

SEQ ID NO: 151702 - DNA, 25 bp, Homo sapien
tgaggcgcattaacggacgcgtccg

SEQ ID NO: 151703 - DNA, 25 bp, Homo sapien
tttgagcgaggtgaggcgcattaac

SEQ ID NO: 151704 - DNA, 25 bp, Homo sapien
ccaggtccagctccttaggggactc

SEQ ID NO: 151705 - DNA, 25 bp, Homo sapien
ccgcaactttcccagccacctcttg

SEQ ID NO: 151706 - DNA, 25 bp, Homo sapien
gcgcttccgccgcaactttcccagc

SEQ ID NO: 151707 - DNA, 25 bp, Homo sapien
gcagcggatctctggagcccgcctc

SEQ ID NO: 151708 - DNA, 25 bp, Homo sapien
tccagctccttaggggactcggcgg

SEQ ID NO: 151709 - DNA, 25 bp, Homo sapien
gtccagctccttaggggactcggcg

SEQ ID NO: 151710 - DNA, 25 bp, Homo sapien
aggtccagctccttaggggactcgg

SEQ ID NO: 151711 - DNA, 25 bp, Homo sapien
caggtccagctccttaggggactcg

SEQ ID NO: 151712 - DNA, 25 bp, Homo sapien
acgatgctttctgcgccctggagca

SEQ ID NO: 151713 - DNA, 25 bp, Homo sapien
atcactgctcctgttcgcggggaca

SEQ ID NO: 151714 - DNA, 25 bp, Homo sapien
tggaccgataggtgacgatgctttc

SEQ ID NO: 151715 - DNA, 25 bp, Homo sapien
caggggcccagaccgcaaagcggac

SEQ ID NO: 151716 - DNA, 25 bp, Homo sapien
tggcggtgctgcttcttcctgcaca

SEQ ID NO: 151717 - DNA, 25 bp, Homo sapien
tgcaatccacgacgcgcagatctgc

SEQ ID NO: 151718 - DNA, 25 bp, Homo sapien
cccgggtactcgaaggtgtccagca

SEQ ID NO: 151719 - DNA, 25 bp, Homo sapien
gtcagagacagctgcgtggaaactc

SEQ ID NO: 151720 - DNA, 25 bp, Homo sapien
tcctggaacacagtgccctctgagg

SEQ ID NO: 151721 - DNA, 25 bp, Homo sapien
gccacctgaccgctgaatattctga

SEQ ID NO: 151722 - DNA, 25 bp, Homo sapien
gctgccacctgaccgctgaatattc

SEQ ID NO: 151723 - DNA, 25 bp, Homo sapien
tgaatattctgactgccgcctgccc

SEQ ID NO: 151724 - DNA, 25 bp, Homo sapien
ggctcactcagaaccatctgcggac

SEQ ID NO: 151725 - DNA, 25 bp, Homo sapien
acagtgccctctgaggtgacgccca

SEQ ID NO: 151726 - DNA, 25 bp, Homo sapien
tcagaaccatctgcggacccgcggg

SEQ ID NO: 151727 - DNA, 25 bp, Homo sapien
aacgcctgagtctccaggaacccgg

SEQ ID NO: 151728 - DNA, 25 bp, Homo sapien
agcatcgtcacctatcggtccaaca

SEQ ID NO: 151729 - DNA, 25 bp, Homo sapien
gccgaggagcacaaggccatccaca

SEQ ID NO: 151730 - DNA, 25 bp, Homo sapien
agagtttccacgcagctgtctctga

SEQ ID NO: 151731 - DNA, 25 bp, Homo sapien
tccagggcgcagaaagcatcgtcac

SEQ ID NO: 151732 - DNA, 25 bp, Homo sapien
gaggaaccgcgccactgctcagcgg

SEQ ID NO: 151733 - DNA, 25 bp, Homo sapien
atctgcgcgtcgtggattgcagctg

SEQ ID NO: 151734 - DNA, 25 bp, Homo sapien
ctgctggacaccttcgagtacccgg

SEQ ID NO: 151735 - DNA, 25 bp, Homo sapien
gcaggaagaagcagcaccgccactt

SEQ ID NO: 151736 - DNA, 25 bp, Homo sapien
gtagctgagtgacgccgtttctccc

SEQ ID NO: 151737 - DNA, 25 bp, Homo sapien
cagagtagctgagtgacgccgtttc

SEQ ID NO: 151738 - DNA, 25 bp, Homo sapien
tggtgacgccgtttctcccgagtag

SEQ ID NO: 151739 - DNA, 25 bp, Homo sapien
ctggtgacgccgtttctcccgagta

SEQ ID NO: 151740 - DNA, 25 bp, Homo sapien
agtgacgccgtttctcccgagtagc

SEQ ID NO: 151741 - DNA, 25 bp, Homo sapien
gctggtgacgccgtttctcccgagt

SEQ ID NO: 151742 - DNA, 25 bp, Homo sapien
ccagagtagctgagtgacgccgttt

SEQ ID NO: 151743 - DNA, 25 bp, Homo sapien
gagtgacgccgtttctcccgagtag

SEQ ID NO: 151744 - DNA, 25 bp, Homo sapien
tgttgagccgccatatctgctgctg

SEQ ID NO: 151745 - DNA, 25 bp, Homo sapien
cgccgcagttgcgaatgcagcatcg

SEQ ID NO: 151746 - DNA, 25 bp, Homo sapien
tccgctcacacacaagaggagagtg

SEQ ID NO: 151747 - DNA, 25 bp, Homo sapien
gctccggcagcaacgatgaaacctg

SEQ ID NO: 151748 - DNA, 25 bp, Homo sapien
tgcctaacgtacacgccgcggagtt

SEQ ID NO: 151749 - DNA, 25 bp, Homo sapien
cgagaccatggattcgggcagcagc

SEQ ID NO: 151750 - DNA, 25 bp, Homo sapien
tgcagctaaggttcgtgtcgctacc

SEQ ID NO: 151751 - DNA, 25 bp, Homo sapien
ccacacagcaagttccgagaccatg

SEQ ID NO: 151752 - DNA, 25 bp, Homo sapien
tgccgtcctgagctgctactgcacg

SEQ ID NO: 151753 - DNA, 25 bp, Homo sapien
gagctgctactgcacgcctcttgga

SEQ ID NO: 151754 - DNA, 25 bp, Homo sapien
gctactgcacgcctcttggagcgtc

SEQ ID NO: 151755 - DNA, 25 bp, Homo sapien
ttcgtgcccactttccgcataccgc

SEQ ID NO: 151756 - DNA, 25 bp, Homo sapien
ctcattttgcccttgccctacttca

SEQ ID NO: 151757 - DNA, 25 bp, Homo sapien
ctgccacatgtttagtacccgcctg

SEQ ID NO: 151758 - DNA, 25 bp, Homo sapien
cacatgtttagtacccgcctggtcc

SEQ ID NO: 151759 - DNA, 25 bp, Homo sapien
cccggctcctgttcgtgcccacttt

SEQ ID NO: 151760 - DNA, 25 bp, Homo sapien
ttccactcgccctctcccggtcctg

SEQ ID NO: 151761 - DNA, 25 bp, Homo sapien
tccagtgcgcatgcgattccgcggg

SEQ ID NO: 151762 - DNA, 25 bp, Homo sapien
ctcgcctactgctgccagcacagca

SEQ ID NO: 151763 - DNA, 25 bp, Homo sapien
tggcgtccgtcctcagcaccaggaa

SEQ ID NO: 151764 - DNA, 25 bp, Homo sapien
ctcgggaactccaatggcgtccgtc

SEQ ID NO: 151765 - DNA, 25 bp, Homo sapien
taccttctcgggaactccaatggcg

SEQ ID NO: 151766 - DNA, 25 bp, Homo sapien
ttcccgccagatccacttcacctct

SEQ ID NO: 151767 - DNA, 25 bp, Homo sapien
ggctggatccttaccttctcgggaa

SEQ ID NO: 151768 - DNA, 25 bp, Homo sapien
ttcctggtgctgaggacggacgcca

SEQ ID NO: 151769 - DNA, 25 bp, Homo sapien
tgctgtgctggcagcagtaggcgag

SEQ ID NO: 151770 - DNA, 25 bp, Homo sapien
cccgcggaatcgcatgcgcactgga

SEQ ID NO: 151771 - DNA, 25 bp, Homo sapien
cgccattggagttcccgagaaggta

SEQ ID NO: 151772 - DNA, 25 bp, Homo sapien
ttcccgagaaggtaaggatccagcc

SEQ ID NO: 151773 - DNA, 25 bp, Homo sapien
acggacgccattggagttcccgaga

SEQ ID NO: 151774 - DNA, 25 bp, Homo sapien
aggtaaggatccagccccagacagg

SEQ ID NO: 151775 - DNA, 25 bp, Homo sapien
agtggaacccgacacgctgcgccct

SEQ ID NO: 151776 - DNA, 25 bp, Homo sapien
ggccggctctcctccgtcttgaggg

SEQ ID NO: 151777 - DNA, 25 bp, Homo sapien
ctggacacgcttctcatgtgacgca

SEQ ID NO: 151778 - DNA, 25 bp, Homo sapien
caggctctactgcatggctgcacca

SEQ ID NO: 151779 - DNA, 25 bp, Homo sapien
ccctgctattgagagttgatggctc

SEQ ID NO: 151780 - DNA, 25 bp, Homo sapien
aggactccttccctgctattgagag

SEQ ID NO: 151781 - DNA, 25 bp, Homo sapien
aggtaggcgctagtctcctcagggt

SEQ ID NO: 151782 - DNA, 25 bp, Homo sapien
tgcgccaccggaaaaagcagctctc

SEQ ID NO: 151783 - DNA, 25 bp, Homo sapien
ggccgtacaaggcagcctcccatag

SEQ ID NO: 151784 - DNA, 25 bp, Homo sapien
cgcatccctgtgacgtgagcacatc

SEQ ID NO: 151785 - DNA, 25 bp, Homo sapien
aatcacaggagaagtcggccgcctc

SEQ ID NO: 151786 - DNA, 25 bp, Homo sapien
gcggctcctctcgatggtcttaacc

SEQ ID NO: 151787 - DNA, 25 bp, Homo sapien
cacgtccgctacagggagtgtcttc

SEQ ID NO: 151788 - DNA, 25 bp, Homo sapien
ttcagtttctcagcggcgtcgcatc

SEQ ID NO: 151789 - DNA, 25 bp, Homo sapien
cggcagccaatcaaaggttcagttt

SEQ ID NO: 151790 - DNA, 25 bp, Homo sapien
ctccggaagcattcggcagtccaca

SEQ ID NO: 151791 - DNA, 25 bp, Homo sapien
gagtgtcttcccatggcctccggaa

SEQ ID NO: 151792 - DNA, 25 bp, Homo sapien
gccgtcagctcccaacagcaaggaa

SEQ ID NO: 151793 - DNA, 25 bp, Homo sapien
gcaatgttgcaccatggagccaccc

SEQ ID NO: 151794 - DNA, 25 bp, Homo sapien
aatttcctctgcagttggcggcgtt

SEQ ID NO: 151795 - DNA, 25 bp, Homo sapien
ggagccattgcgtcccgtaccattc

SEQ ID NO: 151796 - DNA, 25 bp, Homo sapien
ttaccgacgccgtaagcacttcctg

SEQ ID NO: 151797 - DNA, 25 bp, Homo sapien
cgggttgcgttttccggcgctacag

SEQ ID NO: 151798 - DNA, 25 bp, Homo sapien
cccgtgaaggatacaggagccgatc

SEQ ID NO: 151799 - DNA, 25 bp, Homo sapien
cgccgaaccttttccgagagaagag

SEQ ID NO: 151800 - DNA, 25 bp, Homo sapien
cggcctctgggtgttcctgcctcgg

SEQ ID NO: 151801 - DNA, 25 bp, Homo sapien
acccgctcccggcacatatgggtcg

SEQ ID NO: 151802 - DNA, 25 bp, Homo sapien
tcctgacatcttttccgctacccgc

SEQ ID NO: 151803 - DNA, 25 bp, Homo sapien
agtcacgcttcacagaggcccctga

SEQ ID NO: 151804 - DNA, 25 bp, Homo sapien
ggatccctgccaaagtcacgcttca

SEQ ID NO: 151805 - DNA, 25 bp, Homo sapien
ctgacctacggatccctgccaaagt

SEQ ID NO: 151806 - DNA, 25 bp, Homo sapien
ggtgcttcccggaagccaagccagc

SEQ ID NO: 151807 - DNA, 25 bp, Homo sapien
ggcctccgtgtggtgcttcccggaa

SEQ ID NO: 151808 - DNA, 25 bp, Homo sapien
tccggacagaaagttcctgcgccgc

SEQ ID NO: 151809 - DNA, 25 bp, Homo sapien
cagcaactgcgcaataagttcctgc

SEQ ID NO: 151810 - DNA, 25 bp, Homo sapien
tccttccctgcggttaggagctgac

SEQ ID NO: 151811 - DNA, 25 bp, Homo sapien
cgacctcttccatcggaaaacgatg

SEQ ID NO: 151812 - DNA, 25 bp, Homo sapien
atgggcagcgttttttcgctcgcga

SEQ ID NO: 151813 - DNA, 25 bp, Homo sapien
tttcggcaccaagccctgagagatc

SEQ ID NO: 151814 - DNA, 25 bp, Homo sapien
ctcggaaccatagcatccggacaga

SEQ ID NO: 151815 - DNA, 25 bp, Homo sapien
accgaaagccaccaaccacagagga

SEQ ID NO: 151816 - DNA, 25 bp, Homo sapien
cgccgcccgctcgtaattgaagggt

SEQ ID NO: 151817 - DNA, 25 bp, Homo sapien
aagacactccctgtagcggacgtga

SEQ ID NO: 151818 - DNA, 25 bp, Homo sapien
tccggaggccatgggaagacactcc

SEQ ID NO: 151819 - DNA, 25 bp, Homo sapien
ttgtggactgccgaatgcttccgga

SEQ ID NO: 151820 - DNA, 25 bp, Homo sapien
actgaacctttgattggctgccgcg

SEQ ID NO: 151821 - DNA, 25 bp, Homo sapien
cgacgccgctgagaaactgaacctt

SEQ ID NO: 151822 - DNA, 25 bp, Homo sapien
cgaggatgtgctcacgtcacaggga

SEQ ID NO: 151823 - DNA, 25 bp, Homo sapien
ttaagaccatcgagaggagccgccc

SEQ ID NO: 151824 - DNA, 25 bp, Homo sapien
ccgcaatcgtcgtgcctgtcacaaa

SEQ ID NO: 151825 - DNA, 25 bp, Homo sapien
cccagcgggatttgactatgtagaa

SEQ ID NO: 151826 - DNA, 25 bp, Homo sapien
gcccttcacatcttggagccaatcg

SEQ ID NO: 151827 - DNA, 25 bp, Homo sapien
ggggcactctcgcagtaaccaatca

SEQ ID NO: 151828 - DNA, 25 bp, Homo sapien
cggaaaagcttagtcggggcactct

SEQ ID NO: 151829 - DNA, 25 bp, Homo sapien
ctgtcacaaactgaaggccaatggg

SEQ ID NO: 151830 - DNA, 25 bp, Homo sapien
ctgaacttcagctccgcaatcgtcg

SEQ ID NO: 151831 - DNA, 25 bp, Homo sapien
gcctcgaacaggctgggagaaccga

SEQ ID NO: 151832 - DNA, 25 bp, Homo sapien
ttagacatcccgcttggcatcggcg

SEQ ID NO: 151833 - DNA, 25 bp, Homo sapien
cggggacgagctttcaacagctcac

SEQ ID NO: 151834 - DNA, 25 bp, Homo sapien
cgcccgatttagacatcccgcttgg

SEQ ID NO: 151835 - DNA, 25 bp, Homo sapien
catcccgcttggcatcggcggtcag

SEQ ID NO: 151836 - DNA, 25 bp, Homo sapien
tggcaggaatgcacgcgcccgattt

SEQ ID NO: 151837 - DNA, 25 bp, Homo sapien
cctgccagggattaaccgagggcca

SEQ ID NO: 151838 - DNA, 25 bp, Homo sapien
ttaaccgagggccacgcttagtggc

SEQ ID NO: 151839 - DNA, 25 bp, Homo sapien
cacgcttagtggcaggaatgcacgc

SEQ ID NO: 151840 - DNA, 25 bp, Homo sapien
atcagccactgtgcctgaccgtgcg

SEQ ID NO: 151841 - DNA, 25 bp, Homo sapien
tcagatctgtagaacggagacgggc

SEQ ID NO: 151842 - DNA, 25 bp, Homo sapien
tgatcgtcccacaaccgatcgactg

SEQ ID NO: 151843 - DNA, 25 bp, Homo sapien
cagagcggtccttgatgccttcctg

SEQ ID NO: 151844 - DNA, 25 bp, Homo sapien
gcactctctaggtgagcttcccaga

SEQ ID NO: 151845 - DNA, 25 bp, Homo sapien
gtgcatcccgctgtactctgtaaga

SEQ ID NO: 151846 - DNA, 25 bp, Homo sapien
agggacccggctctacgagtgcatc

SEQ ID NO: 151847 - DNA, 25 bp, Homo sapien
cgcccgccctactgtcgaaaggtgg

SEQ ID NO: 151848 - DNA, 25 bp, Homo sapien
tgagcagctccgagtctccacagcg

SEQ ID NO: 151849 - DNA, 25 bp, Homo sapien
gggagccaatcggaaactgatgatg

SEQ ID NO: 151850 - DNA, 25 bp, Homo sapien
cggtcgccatggaccgcccagatga

SEQ ID NO: 151851 - DNA, 25 bp, Homo sapien
tgagctgtacgaacgcggtcgccat

SEQ ID NO: 151852 - DNA, 25 bp, Homo sapien
tcagctctgcttaccggtgcgacta

SEQ ID NO: 151853 - DNA, 25 bp, Homo sapien
gttgcgtgagtctcctcagctctgc

SEQ ID NO: 151854 - DNA, 25 bp, Homo sapien
gcgcatacttcacgctcggtgctga

SEQ ID NO: 151855 - DNA, 25 bp, Homo sapien
ccggctgggattctaccatcgagtc

SEQ ID NO: 151856 - DNA, 25 bp, Homo sapien
cctcggtgtctatgcaaggccgctt

SEQ ID NO: 151857 - DNA, 25 bp, Homo sapien
aggccgcttcgccattgcggtattc

SEQ ID NO: 151858 - DNA, 25 bp, Homo sapien
tgcggtattctttgcggtattcttg

SEQ ID NO: 151859 - DNA, 25 bp, Homo sapien
agtgccgcttcgagtcttttgttta

SEQ ID NO: 151860 - DNA, 25 bp, Homo sapien
ggcctacgcagtatcctgcaacatg

SEQ ID NO: 151861 - DNA, 25 bp, Homo sapien
gcggatcatcctggccaatggcagt

SEQ ID NO: 151862 - DNA, 25 bp, Homo sapien
tctggcgcatgcgtgtagagacatc

SEQ ID NO: 151863 - DNA, 25 bp, Homo sapien
ttgcgtcagaccaatgcggatcatc

SEQ ID NO: 151864 - DNA, 25 bp, Homo sapien
gggcggcctctcaaccctaggtcag

SEQ ID NO: 151865 - DNA, 25 bp, Homo sapien
agggttccgtccagcgtatccttca

SEQ ID NO: 151866 - DNA, 25 bp, Homo sapien
tccttcagatcttgctgtaggcctc

SEQ ID NO: 151867 - DNA, 25 bp, Homo sapien
tctgccgctcacgtgatcgtctgcg

SEQ ID NO: 151868 - DNA, 25 bp, Homo sapien
tcgcaaagggaagccgagtgctcct

SEQ ID NO: 151869 - DNA, 25 bp, Homo sapien
ctcccagactgcaaccaggtgagta

SEQ ID NO: 151870 - DNA, 25 bp, Homo sapien
ccaccctcagtgtctttcgaaacgg

SEQ ID NO: 151871 - DNA, 25 bp, Homo sapien
tcgaaacggttccatgcaggtctgc

SEQ ID NO: 151872 - DNA, 25 bp, Homo sapien
cctgattttcgcgatgtagccaaga

SEQ ID NO: 151873 - DNA, 25 bp, Homo sapien
ccttcatatagtggagaccgagcta

SEQ ID NO: 151874 - DNA, 25 bp, Homo sapien
gttgcgtcacaccaagccctaggaa

SEQ ID NO: 151875 - DNA, 25 bp, Homo sapien
ttccgagcctcgtatacgttgcgtc

SEQ ID NO: 151876 - DNA, 25 bp, Homo sapien
cgctggctatcctactgcttcattc

SEQ ID NO: 151877 - DNA, 25 bp, Homo sapien
ttggaccgcccttaaggactcatgg

SEQ ID NO: 151878 - DNA, 25 bp, Homo sapien
tttctctgcgatgggcctgattttc

SEQ ID NO: 151879 - DNA, 25 bp, Homo sapien
ccatcttggtttgtcagcgtctccc

SEQ ID NO: 151880 - DNA, 25 bp, Homo sapien
actgcatccgcatgttggaaaggat

SEQ ID NO: 151881 - DNA, 25 bp, Homo sapien
ttctcatactcctcaaaggagaact

SEQ ID NO: 151882 - DNA, 25 bp, Homo sapien
ggggttctgtgccttctcatactcc

SEQ ID NO: 151883 - DNA, 25 bp, Homo sapien
caggcttgccctcgaagtacgcggg

SEQ ID NO: 151884 - DNA, 25 bp, Homo sapien
tgcgtagccgctcaaagttcttgtt

SEQ ID NO: 151885 - DNA, 25 bp, Homo sapien
tccagcgaggcaggcttgccctcga

SEQ ID NO: 151886 - DNA, 25 bp, Homo sapien
tctctgaggctgagctgcgtagccg

SEQ ID NO: 151887 - DNA, 25 bp, Homo sapien
caaagttcttgttcatgcggtactg

SEQ ID NO: 151888 - DNA, 25 bp, Homo sapien
actcccacatgctgggggacaccgg

SEQ ID NO: 151889 - DNA, 25 bp, Homo sapien
ggaatcggcgtcttctctggaaagc

SEQ ID NO: 151890 - DNA, 25 bp, Homo sapien
aattttcaggaatcggcgtcttctc

SEQ ID NO: 151891 - DNA, 25 bp, Homo sapien
gcaattttcaggaatcggcgtcttc

SEQ ID NO: 151892 - DNA, 25 bp, Homo sapien
tcaggtcccgccgactcccacatgc

SEQ ID NO: 151893 - DNA, 25 bp, Homo sapien
gagagccttgcaattttcaggaatc

SEQ ID NO: 151894 - DNA, 25 bp, Homo sapien
cgggtagcgtgccacacggcacgtc

SEQ ID NO: 151895 - DNA, 25 bp, Homo sapien
cttgcaattttcaggaatcggcgtc

SEQ ID NO: 151896 - DNA, 25 bp, Homo sapien
gctgtgtaaccggtagtgtcctgga

SEQ ID NO: 151897 - DNA, 25 bp, Homo sapien
gagctcctggatgcgccacggctca

SEQ ID NO: 151898 - DNA, 25 bp, Homo sapien
cgcaggttctggtactggctctcgc

SEQ ID NO: 151899 - DNA, 25 bp, Homo sapien
ttctcctgggtgagctggtccagct

SEQ ID NO: 151900 - DNA, 25 bp, Homo sapien
ctgctggctctcgatgatgttgttc

SEQ ID NO: 151901 - DNA, 25 bp, Homo sapien
ttcagctccagcaggtactccacgg

SEQ ID NO: 151902 - DNA, 25 bp, Homo sapien
tggctctcctctcgcaggtcgcggt

SEQ ID NO: 151903 - DNA, 25 bp, Homo sapien
acggcccgatttgggctctcggatc

SEQ ID NO: 151904 - DNA, 25 bp, Homo sapien
cgctgggctgaaacagaagtgcacc

SEQ ID NO: 151905 - DNA, 25 bp, Homo sapien
tcgcgagaatacgtccaggcctaac

SEQ ID NO: 151906 - DNA, 25 bp, Homo sapien
tacgcccgagaactgaggtagcccg

SEQ ID NO: 151907 - DNA, 25 bp, Homo sapien
gtccgataatctgtcgacccttgta

SEQ ID NO: 151908 - DNA, 25 bp, Homo sapien
ggtttatctcaccagagccattggg

SEQ ID NO: 151909 - DNA, 25 bp, Homo sapien
ggttgtactactccggcaccggata

SEQ ID NO: 151910 - DNA, 25 bp, Homo sapien
gtccgcgacgtttcaggttacatgg

SEQ ID NO: 151911 - DNA, 25 bp, Homo sapien
ggtgaacctctgaaatggtccgata

SEQ ID NO: 151912 - DNA, 25 bp, Homo sapien
gtacgctagtcctttggccagaggg

SEQ ID NO: 151913 - DNA, 25 bp, Homo sapien
gcctggtacgctagtcctttggcca

SEQ ID NO: 151914 - DNA, 25 bp, Homo sapien
gatctctttctcctagttccacggc

SEQ ID NO: 151915 - DNA, 25 bp, Homo sapien
caacagaggcaaagaaccttctacc

SEQ ID NO: 151916 - DNA, 25 bp, Homo sapien
gaggcaaagaaccttctaccttcac

SEQ ID NO: 151917 - DNA, 25 bp, Homo sapien
ttcacgctccgacacgctgctgcca

SEQ ID NO: 151918 - DNA, 25 bp, Homo sapien
gcgtggcctggtacgctagtccttt

SEQ ID NO: 151919 - DNA, 25 bp, Homo sapien
tgctgccatcttgtcgccggccact

SEQ ID NO: 151920 - DNA, 25 bp, Homo sapien
catgcgtgtcctgctcacaaggcgc

SEQ ID NO: 151921 - DNA, 25 bp, Homo sapien
ctcggtgtgtgacagcgacaggtca

SEQ ID NO: 151922 - DNA, 25 bp, Homo sapien
ccagtgcggttggagtgtctccagt

SEQ ID NO: 151923 - DNA, 25 bp, Homo sapien
ggtgcgcgccatctgcgcatgcgct

SEQ ID NO: 151924 - DNA, 25 bp, Homo sapien
ccacaccctgtcttttgggagcggt

SEQ ID NO: 151925 - DNA, 25 bp, Homo sapien
aggtccagagtctagtcgccaccca

SEQ ID NO: 151926 - DNA, 25 bp, Homo sapien
gggcaccgagatccacaggtccaga

SEQ ID NO: 151927 - DNA, 25 bp, Homo sapien
aggacctgtgtatcttggtgcccgc

SEQ ID NO: 151928 - DNA, 25 bp, Homo sapien
tggtcttcgcctcaggtctagttta

SEQ ID NO: 151929 - DNA, 25 bp, Homo sapien
ctcagaggcgtcataaaggcagata

SEQ ID NO: 151930 - DNA, 25 bp, Homo sapien
tctaccggacgggaaaagcctgagc

SEQ ID NO: 151931 - DNA, 25 bp, Homo sapien
cggctcccgcatgcgttgagaacta

SEQ ID NO: 151932 - DNA, 25 bp, Homo sapien
cgcgcctcgcctttaggaaacatga

SEQ ID NO: 151933 - DNA, 25 bp, Homo sapien
cgcgagacctggtgcacactcctaa

SEQ ID NO: 151934 - DNA, 25 bp, Homo sapien
ggcccaggaaatggtgtcgcctcaa

SEQ ID NO: 151935 - DNA, 25 bp, Homo sapien
ctggctgccaaacctcgcgatgaca

SEQ ID NO: 151936 - DNA, 25 bp, Homo sapien
tcagtcgaaagcctcctcgcttcgg

SEQ ID NO: 151937 - DNA, 25 bp, Homo sapien
agcccagggatagacgctcacctcg

SEQ ID NO: 151938 - DNA, 25 bp, Homo sapien
tgccacccgcgagaaaccgagaacg

SEQ ID NO: 151939 - DNA, 25 bp, Homo sapien
tggccatggctaatgccggtacctc

SEQ ID NO: 151940 - DNA, 25 bp, Homo sapien
tactctctctttagggccacttggc

SEQ ID NO: 151941 - DNA, 25 bp, Homo sapien
gcctagtagttacccgcgaagcctg

SEQ ID NO: 151942 - DNA, 25 bp, Homo sapien
ttcggctcagctcaaactcgatttg

SEQ ID NO: 151943 - DNA, 25 bp, Homo sapien
tcctcgaaccagtgagaaacgctga

SEQ ID NO: 151944 - DNA, 25 bp, Homo sapien
gctccattttgagtggggcccgaaa

SEQ ID NO: 151945 - DNA, 25 bp, Homo sapien
tccgggcaaacagggagttcagcta

SEQ ID NO: 151946 - DNA, 25 bp, Homo sapien
aggtgaactcggtgactccaaacta

SEQ ID NO: 151947 - DNA, 25 bp, Homo sapien
gccatcttaggcgaggcagacgttt

SEQ ID NO: 151948 - DNA, 25 bp, Homo sapien
ctttaaggtgcccaatcgccgctga

SEQ ID NO: 151949 - DNA, 25 bp, Homo sapien
tggacccgctcgtctctttaaggtg

SEQ ID NO: 151950 - DNA, 25 bp, Homo sapien
acgcgcgtcgaattctgggatagtc

SEQ ID NO: 151951 - DNA, 25 bp, Homo sapien
gccagccgctcaacggtgcttcaga

SEQ ID NO: 151952 - DNA, 25 bp, Homo sapien
acgtgtcccacgatcagttgcgctg

SEQ ID NO: 151953 - DNA, 25 bp, Homo sapien
tcgccgccaggataggcacaagcct

SEQ ID NO: 151954 - DNA, 25 bp, Homo sapien
ctggcacagcgctgacaagtagccc

SEQ ID NO: 151955 - DNA, 25 bp, Homo sapien
agtagcccagcatggcgttccattg

SEQ ID NO: 151956 - DNA, 25 bp, Homo sapien
gacagcgcttctccaggaactcttg

SEQ ID NO: 151957 - DNA, 25 bp, Homo sapien
cacccatgcttcgtcggtgggcaga

SEQ ID NO: 151958 - DNA, 25 bp, Homo sapien
tgcgcaagcaggataggcgacgatc

SEQ ID NO: 151959 - DNA, 25 bp, Homo sapien
agtgctagcctcacgcagtggctca

SEQ ID NO: 151960 - DNA, 25 bp, Homo sapien
tctgaatgctgtagcgccgctgtta

SEQ ID NO: 151961 - DNA, 25 bp, Homo sapien
ccaactcccgggatttctcgcgaga

SEQ ID NO: 151962 - DNA, 25 bp, Homo sapien
tctccgcgagcctctgaatgctgta

SEQ ID NO: 151963 - DNA, 25 bp, Homo sapien
aactgatttttgacggcatgtaacc

SEQ ID NO: 151964 - DNA, 25 bp, Homo sapien
catacctgccggctttgggattaga

SEQ ID NO: 151965 - DNA, 25 bp, Homo sapien
tctcttagaggaagcacgcgcgaca

SEQ ID NO: 151966 - DNA, 25 bp, Homo sapien
atgcttcttactcctctcctcgatg

SEQ ID NO: 151967 - DNA, 25 bp, Homo sapien
acatctcctgtgtgttccgaagcgc

SEQ ID NO: 151968 - DNA, 25 bp, Homo sapien
aacctgcgtggacacatagcctgcg

SEQ ID NO: 151969 - DNA, 25 bp, Homo sapien
gacacagaccctgcgtggacacata

SEQ ID NO: 151970 - DNA, 25 bp, Homo sapien
agaccctgcgtggacacatagcctg

SEQ ID NO: 151971 - DNA, 25 bp, Homo sapien
tagcctgcgtggacacatagcctgc

SEQ ID NO: 151972 - DNA, 25 bp, Homo sapien
tggacacatagcctgcgtggacaca

SEQ ID NO: 151973 - DNA, 25 bp, Homo sapien
cgtggacacagaacctgcgtggaca

SEQ ID NO: 151974 - DNA, 25 bp, Homo sapien
ggaacctgcgtggacacatagcctg

SEQ ID NO: 151975 - DNA, 25 bp, Homo sapien
aacctgcgtggacacataacctgtg

SEQ ID NO: 151976 - DNA, 25 bp, Homo sapien
tccatgcgcatgtgcaaggcccaga

SEQ ID NO: 151977 - DNA, 25 bp, Homo sapien
gccctgcgttcctgtcaaacaaatg

SEQ ID NO: 151978 - DNA, 25 bp, Homo sapien
tcatgtctctctcggctcttaacgg

SEQ ID NO: 151979 - DNA, 25 bp, Homo sapien
aaggcccagacctcgcaaatctcgg

SEQ ID NO: 151980 - DNA, 25 bp, Homo sapien
tcccgctagacacaagtgcgcatgc

SEQ ID NO: 151981 - DNA, 25 bp, Homo sapien
cctccgggttaccaagcaagcgatc

SEQ ID NO: 151982 - DNA, 25 bp, Homo sapien
gcctccggagcccaacataacaagt

SEQ ID NO: 151983 - DNA, 25 bp, Homo sapien
ccgggcttcagagacacctcatgtc

SEQ ID NO: 151984 - DNA, 25 bp, Homo sapien
cattcccgtggctgatgatccaaca

SEQ ID NO: 151985 - DNA, 25 bp, Homo sapien
gttcctccagcacaagccgcgtgtg

SEQ ID NO: 151986 - DNA, 25 bp, Homo sapien
aagagaagccacgtccactgcgagg

SEQ ID NO: 151987 - DNA, 25 bp, Homo sapien
cgtctccaggatccatcggcagtgg

SEQ ID NO: 151988 - DNA, 25 bp, Homo sapien
cctgctctttgttaaatgggaatga

SEQ ID NO: 151989 - DNA, 25 bp, Homo sapien
gcccagcagggtccaaaatgcacct

SEQ ID NO: 151990 - DNA, 25 bp, Homo sapien
acccgttccactgatgcttggtgtg

SEQ ID NO: 151991 - DNA, 25 bp, Homo sapien
cttcgaccgcgcacgtcatacaggg

SEQ ID NO: 151992 - DNA, 25 bp, Homo sapien
gtagtcccagacgatgctccagccg

SEQ ID NO: 151993 - DNA, 25 bp, Homo sapien
gccttcagccagtagtcccagacga

SEQ ID NO: 151994 - DNA, 25 bp, Homo sapien
cgagaagtcggtcggatccaagtgc

SEQ ID NO: 151995 - DNA, 25 bp, Homo sapien
ggctggttgggaagcgttcttcctc

SEQ ID NO: 151996 - DNA, 25 bp, Homo sapien
cgaatgggaatagatctgggctctc

SEQ ID NO: 151997 - DNA, 25 bp, Homo sapien
accgcagggcaagacccggtggcct

SEQ ID NO: 151998 - DNA, 25 bp, Homo sapien
gggccgccaagagccgaacctgagc

SEQ ID NO: 151999 - DNA, 25 bp, Homo sapien
actctccggtggacggcgagccact

SEQ ID NO: 152000 - DNA, 25 bp, Homo sapien
gtcgtgttgccctcgcttctcagat

SEQ ID NO: 152001 - DNA, 25 bp, Homo sapien
ccgaattgccttttcgcggagtgga

SEQ ID NO: 152002 - DNA, 25 bp, Homo sapien
tgtgaaaccagagatgcccgccaac

SEQ ID NO: 152003 - DNA, 25 bp, Homo sapien
ccgggcagttaggatcgtctattgg

SEQ ID NO: 152004 - DNA, 25 bp, Homo sapien
tcacaatgtgcgctcacctagacgg

SEQ ID NO: 152005 - DNA, 25 bp, Homo sapien
tatttccttaactacggggcaggca

SEQ ID NO: 152006 - DNA, 25 bp, Homo sapien
gcctagctgcgcgagagtttctgct

SEQ ID NO: 152007 - DNA, 25 bp, Homo sapien
agtttctgctcgctcaaccgagttg

SEQ ID NO: 152008 - DNA, 25 bp, Homo sapien
atcttgcagctcacagccggagtga

SEQ ID NO: 152009 - DNA, 25 bp, Homo sapien
ccaattgtccagtggtgagggcgca

SEQ ID NO: 152010 - DNA, 25 bp, Homo sapien
gccacgagtttaccagcgtctctta

SEQ ID NO: 152011 - DNA, 25 bp, Homo sapien
ggggcgttatctctttcggaagtga

SEQ ID NO: 152012 - DNA, 25 bp, Homo sapien
gggcttcgattctcactcttggagc

SEQ ID NO: 152013 - DNA, 25 bp, Homo sapien
ttatcttgggactagacgctcacgg

SEQ ID NO: 152014 - DNA, 25 bp, Homo sapien
ctcgcaagcgcagctgggttatctt

SEQ ID NO: 152015 - DNA, 25 bp, Homo sapien
gggcgcatgcgaaccattgacaatg

SEQ ID NO: 152016 - DNA, 25 bp, Homo sapien
cagtctccgagtttcggaggggctt

SEQ ID NO: 152017 - DNA, 25 bp, Homo sapien
tgagcagccgggtcggcttttggat

SEQ ID NO: 152018 - DNA, 25 bp, Homo sapien
gcttttggatgagagccccgctagg

SEQ ID NO: 152019 - DNA, 25 bp, Homo sapien
ggatctggagaaaacctgccttaag

SEQ ID NO: 152020 - DNA, 25 bp, Homo sapien
tgagtggacgcactcgggaattgta

SEQ ID NO: 152021 - DNA, 25 bp, Homo sapien
taccggatccatccggctgggaagg

SEQ ID NO: 152022 - DNA, 25 bp, Homo sapien
aggaccggatcgtaccggatccatc

SEQ ID NO: 152023 - DNA, 25 bp, Homo sapien
ctgccttaaggaccggatcgtaccg

SEQ ID NO: 152024 - DNA, 25 bp, Homo sapien
ccgaatggtactgcggacctggaga

SEQ ID NO: 152025 - DNA, 25 bp, Homo sapien
tgccagactgagaccacgaccattg

SEQ ID NO: 152026 - DNA, 25 bp, Homo sapien
atgcgctctatcgacctgcggctgg

SEQ ID NO: 152027 - DNA, 25 bp, Homo sapien
cgcatgcgcactatgtttcgctaga

SEQ ID NO: 152028 - DNA, 25 bp, Homo sapien
gaagggccagcactgagaagagcca

SEQ ID NO: 152029 - DNA, 25 bp, Homo sapien
gccagctgctgaatgcgcatgtgca

SEQ ID NO: 152030 - DNA, 25 bp, Homo sapien
tgcgcatgtgcacggtggacatcaa

SEQ ID NO: 152031 - DNA, 25 bp, Homo sapien
tggacatcaaagaaagggctcgtgc

SEQ ID NO: 152032 - DNA, 25 bp, Homo sapien
ggaggtgttccagccctttaagatg

SEQ ID NO: 152033 - DNA, 25 bp, Homo sapien
acaggaagcagttcgctcgcgccta

SEQ ID NO: 152034 - DNA, 25 bp, Homo sapien
gcgggcctggccaacttctgaacag

SEQ ID NO: 152035 - DNA, 25 bp, Homo sapien
cgcaccacttggacttctgagtaga

SEQ ID NO: 152036 - DNA, 25 bp, Homo sapien
tgtaagtaaccggacgcaccacttg

SEQ ID NO: 152037 - DNA, 25 bp, Homo sapien
catctgtgaacttaggtgggcggtc

SEQ ID NO: 152038 - DNA, 25 bp, Homo sapien
cgcgagcacttagcgccagctattc

SEQ ID NO: 152039 - DNA, 25 bp, Homo sapien
tggaaactcctctcgccattcattg

SEQ ID NO: 152040 - DNA, 25 bp, Homo sapien
gacgatccgctgagggtcaggctct

SEQ ID NO: 152041 - DNA, 25 bp, Homo sapien
cacctgcaggtcatgagagccgagc

SEQ ID NO: 152042 - DNA, 25 bp, Homo sapien
gaaaatacatatccgctgcgtttcc

SEQ ID NO: 152043 - DNA, 25 bp, Homo sapien
caaagcgtgatgaccgtggggacca

SEQ ID NO: 152044 - DNA, 25 bp, Homo sapien
accagagctcggactggtaccggcc

SEQ ID NO: 152045 - DNA, 25 bp, Homo sapien
cgaacttaccgtacagggcagcctc

SEQ ID NO: 152046 - DNA, 25 bp, Homo sapien
agctgacgcctgagggacgatccgc

SEQ ID NO: 152047 - DNA, 25 bp, Homo sapien
gaggtcggctcctgtttcctctggg

SEQ ID NO: 152048 - DNA, 25 bp, Homo sapien
gagccggagggcaaagaagtttctc

SEQ ID NO: 152049 - DNA, 25 bp, Homo sapien
ttcacgtctcgaagacgccttcgta

SEQ ID NO: 152050 - DNA, 25 bp, Homo sapien
ctgcgactgtagatgaaaggagaca

SEQ ID NO: 152051 - DNA, 25 bp, Homo sapien
tgtgaatgatctgcccagcgtcatg

SEQ ID NO: 152052 - DNA, 25 bp, Homo sapien
cgtctggaaaacagctgcgactgta

SEQ ID NO: 152053 - DNA, 25 bp, Homo sapien
gaagtttctcgaacctgggccatca

SEQ ID NO: 152054 - DNA, 25 bp, Homo sapien
ttgaagggagcaccttctcgtcgcc

SEQ ID NO: 152055 - DNA, 25 bp, Homo sapien
acctgaggagcaaggcgtctggaaa

SEQ ID NO: 152056 - DNA, 25 bp, Homo sapien
attctaccaatcgtcggcatttttt

SEQ ID NO: 152057 - DNA, 25 bp, Homo sapien
tctatgattctaccaatcgtcggca

SEQ ID NO: 152058 - DNA, 25 bp, Homo sapien
gctggtgttcttctctatgattcta

SEQ ID NO: 152059 - DNA, 25 bp, Homo sapien
ttgctgccatttttcgctgaagccc

SEQ ID NO: 152060 - DNA, 25 bp, Homo sapien
cgagttgctgccatttttcgctgaa

SEQ ID NO: 152061 - DNA, 25 bp, Homo sapien
cccgcacgagttgctgccatttttc

SEQ ID NO: 152062 - DNA, 25 bp, Homo sapien
ccagaggacccgcacgagttgctgc

SEQ ID NO: 152063 - DNA, 25 bp, Homo sapien
ccgtggggcagctaggtgcctccaa

SEQ ID NO: 152064 - DNA, 25 bp, Homo sapien
agctgccgccccgtgctcggtgatt

SEQ ID NO: 152065 - DNA, 25 bp, Homo sapien
tgccgccccgtgctcggtgatttcg

SEQ ID NO: 152066 - DNA, 25 bp, Homo sapien
gctcccgggaagacctcagggtctc

SEQ ID NO: 152067 - DNA, 25 bp, Homo sapien
agctcccgggaagacctcagggtct

SEQ ID NO: 152068 - DNA, 25 bp, Homo sapien
cccagcccacgggagtctctgcgtc

SEQ ID NO: 152069 - DNA, 25 bp, Homo sapien
cagctcccgggaagacctcagggtc

SEQ ID NO: 152070 - DNA, 25 bp, Homo sapien
gcccacgggagtctctgcgtccacg

SEQ ID NO: 152071 - DNA, 25 bp, Homo sapien
cagcccacgggagtctctgcgtcca

SEQ ID NO: 152072 - DNA, 25 bp, Homo sapien
ccagggaaccgcagtcttcatcaca

SEQ ID NO: 152073 - DNA, 25 bp, Homo sapien
cccggctgagcctaaaatcatcaaa

SEQ ID NO: 152074 - DNA, 25 bp, Homo sapien
gcctaaaatcatcaaagtcacggtg

SEQ ID NO: 152075 - DNA, 25 bp, Homo sapien
gtcacggtgaagactcccaaagaga

SEQ ID NO: 152076 - DNA, 25 bp, Homo sapien
acagctcggttcagcagtttaagga

SEQ ID NO: 152077 - DNA, 25 bp, Homo sapien
aagcgatttcgaaacgcttcaaatc

SEQ ID NO: 152078 - DNA, 25 bp, Homo sapien
cttcatcacagaggtaccgtgctcc

SEQ ID NO: 152079 - DNA, 25 bp, Homo sapien
aggcctttctccaccggaggaccag

SEQ ID NO: 152080 - DNA, 25 bp, Homo sapien
agcttccggtcagtagagaggcctc

SEQ ID NO: 152081 - DNA, 25 bp, Homo sapien
ctttttctagcgcagcttccggtca

SEQ ID NO: 152082 - DNA, 25 bp, Homo sapien
gtctcctccttctttttctagcgca

SEQ ID NO: 152083 - DNA, 25 bp, Homo sapien
atcggactcccactagtcgctgctg

SEQ ID NO: 152084 - DNA, 25 bp, Homo sapien
gatccataggcaatgagtgtctcta

SEQ ID NO: 152085 - DNA, 25 bp, Homo sapien
agcagcccggtgcttgcaaaagctg

SEQ ID NO: 152086 - DNA, 25 bp, Homo sapien
ttgcctccgcagtgagcctatggag

SEQ ID NO: 152087 - DNA, 25 bp, Homo sapien
ttgcgggcctcaagtgcacaaatcg

SEQ ID NO: 152088 - DNA, 25 bp, Homo sapien
gcctccgctacgagcctgtggcgaa

SEQ ID NO: 152089 - DNA, 25 bp, Homo sapien
cggccgagtgaatgcttgcaagagc

SEQ ID NO: 152090 - DNA, 25 bp, Homo sapien
tgctgcctccgctacgagcctgtgg

SEQ ID NO: 152091 - DNA, 25 bp, Homo sapien
cctcagccacatcgggattccacca

SEQ ID NO: 152092 - DNA, 25 bp, Homo sapien
atcgggattccaccagtccctgctg

SEQ ID NO: 152093 - DNA, 25 bp, Homo sapien
accggccgagtgaatgcttgcaaga

SEQ ID NO: 152094 - DNA, 25 bp, Homo sapien
cgaccggccgagtgaatgcttgcaa

SEQ ID NO: 152095 - DNA, 25 bp, Homo sapien
cctccgctacgagcctgtggcgaag

SEQ ID NO: 152096 - DNA, 25 bp, Homo sapien
cacgtgccgaaatcggatacctcga

SEQ ID NO: 152097 - DNA, 25 bp, Homo sapien
ccgaaatcggatacctcgatgctgc

SEQ ID NO: 152098 - DNA, 25 bp, Homo sapien
gagacaggcaaagagcactgcagcg

SEQ ID NO: 152099 - DNA, 25 bp, Homo sapien
caggcgactcgctgagtgactgctt

SEQ ID NO: 152100 - DNA, 25 bp, Homo sapien
ggtcaacaggcgactcgctgagtga

SEQ ID NO: 152101 - DNA, 25 bp, Homo sapien
aaggagggtcaacaggcgactcgct

SEQ ID NO: 152102 - DNA, 25 bp, Homo sapien
tcggatacctcgatgctgcctctgc

SEQ ID NO: 152103 - DNA, 25 bp, Homo sapien
acaggcaaagagcactgcagcggtg

SEQ ID NO: 152104 - DNA, 25 bp, Homo sapien
agacctcctgctagctgagccggcc

SEQ ID NO: 152105 - DNA, 25 bp, Homo sapien
cctgttggcgccgaggaccgatcaa

SEQ ID NO: 152106 - DNA, 25 bp, Homo sapien
gttggcgccgaggaccgatcaacct

SEQ ID NO: 152107 - DNA, 25 bp, Homo sapien
tggcgccgaggaccgatcaacctag

SEQ ID NO: 152108 - DNA, 25 bp, Homo sapien
ccgcggggcccactgcgctaggccc

SEQ ID NO: 152109 - DNA, 25 bp, Homo sapien
tgccgccagacctcctgctagctga

SEQ ID NO: 152110 - DNA, 25 bp, Homo sapien
cctgctagctgagccggccgaaccc

SEQ ID NO: 152111 - DNA, 25 bp, Homo sapien
cagagctgccgccagacctcctgct

SEQ ID NO: 152112 - DNA, 25 bp, Homo sapien
ttgcgctttgagaacggcgtcctca

SEQ ID NO: 152113 - DNA, 25 bp, Homo sapien
cttcctggtgctgcttgacccggtg

SEQ ID NO: 152114 - DNA, 25 bp, Homo sapien
accaggacctgctgttgcgctttga

SEQ ID NO: 152115 - DNA, 25 bp, Homo sapien
ggccttcgcgggcacagtcactatc

SEQ ID NO: 152116 - DNA, 25 bp, Homo sapien
ggcacagtcactatccacaaccagg

SEQ ID NO: 152117 - DNA, 25 bp, Homo sapien
agtcactatccacaaccaggacctg

SEQ ID NO: 152118 - DNA, 25 bp, Homo sapien
tggttccagccgagcctctcggacg

SEQ ID NO: 152119 - DNA, 25 bp, Homo sapien
cgcagagatggaaatcccgaagctg

SEQ ID NO: 152120 - DNA, 25 bp, Homo sapien
ccctccgcagggcagccgaagggcc

SEQ ID NO: 152121 - DNA, 25 bp, Homo sapien
cagtgggggccctgcgcagagcagc

SEQ ID NO: 152122 - DNA, 25 bp, Homo sapien
caggaggtcggaccgcagctctggg

SEQ ID NO: 152123 - DNA, 25 bp, Homo sapien
gcaggaggtcggaccgcagctctgg

SEQ ID NO: 152124 - DNA, 25 bp, Homo sapien
agcaggaggtcggaccgcagctctg

SEQ ID NO: 152125 - DNA, 25 bp, Homo sapien
ctagcaggaggtcggaccgcagctc

SEQ ID NO: 152126 - DNA, 25 bp, Homo sapien
tcggctagcaggaggtcggaccgca

SEQ ID NO: 152127 - DNA, 25 bp, Homo sapien
cggctagcaggaggtcggaccgcag

SEQ ID NO: 152128 - DNA, 25 bp, Homo sapien
ccaccgggtcaagcagcaccaggaa

SEQ ID NO: 152129 - DNA, 25 bp, Homo sapien
gtgaggacgccgttctcaaagcgca

SEQ ID NO: 152130 - DNA, 25 bp, Homo sapien
tcttgagcttgtaagaggtggtgaa

SEQ ID NO: 152131 - DNA, 25 bp, Homo sapien
tctcaaagcgcaacagcaggtcctg

SEQ ID NO: 152132 - DNA, 25 bp, Homo sapien
caggtcctggttgtggatagtgact

SEQ ID NO: 152133 - DNA, 25 bp, Homo sapien
gatagtgactgtgcccgcgaaggcc

SEQ ID NO: 152134 - DNA, 25 bp, Homo sapien
gcttcttggcgaaggtttgcccgca

SEQ ID NO: 152135 - DNA, 25 bp, Homo sapien
aggtgcctcttgagcttgtaagagg

SEQ ID NO: 152136 - DNA, 25 bp, Homo sapien
gtttgtattgacacacgcgccctct

SEQ ID NO: 152137 - DNA, 25 bp, Homo sapien
gcgtgcccgtgttcagtttgtattg

SEQ ID NO: 152138 - DNA, 25 bp, Homo sapien
ttcactctggcgaccgggtctttgc

SEQ ID NO: 152139 - DNA, 25 bp, Homo sapien
gcgctagctggcttggcttcactct

SEQ ID NO: 152140 - DNA, 25 bp, Homo sapien
ctgggcttcgcagcgctagctggct

SEQ ID NO: 152141 - DNA, 25 bp, Homo sapien
cttagctgttgtcgatgctggtgcg

SEQ ID NO: 152142 - DNA, 25 bp, Homo sapien
ccgaatcggccacttagctgttgtc

SEQ ID NO: 152143 - DNA, 25 bp, Homo sapien
ctcgcgagtgctgttcgtgccttgc

SEQ ID NO: 152144 - DNA, 25 bp, Homo sapien
agatgccgcagtagcacgttcgctg

SEQ ID NO: 152145 - DNA, 25 bp, Homo sapien
atacccgccgaccaataacagatgc

SEQ ID NO: 152146 - DNA, 25 bp, Homo sapien
ctgaagtcggcagagtccagcattc

SEQ ID NO: 152147 - DNA, 25 bp, Homo sapien
ctggctaccggtcagtctcagtctc

SEQ ID NO: 152148 - DNA, 25 bp, Homo sapien
tcgctcgttttcctaagcttgctcg

SEQ ID NO: 152149 - DNA, 25 bp, Homo sapien
agacactcgttcgatccctgccttg

SEQ ID NO: 152150 - DNA, 25 bp, Homo sapien
tgcctttttattcaccgagcgactg

SEQ ID NO: 152151 - DNA, 25 bp, Homo sapien
tgctagccgcgaccgccaatcagag

SEQ ID NO: 152152 - DNA, 25 bp, Homo sapien
gacgcacgtctgcttatccacaagg

SEQ ID NO: 152153 - DNA, 25 bp, Homo sapien
acctgagagctcacgcgtgtctgtg

SEQ ID NO: 152154 - DNA, 25 bp, Homo sapien
actcagggtgcgatgtgtacacaga

SEQ ID NO: 152155 - DNA, 25 bp, Homo sapien
cagatctgaatgcagacgcacgtgc

SEQ ID NO: 152156 - DNA, 25 bp, Homo sapien
gcacgtccagagagacgcacgtctg

SEQ ID NO: 152157 - DNA, 25 bp, Homo sapien
gtgcccatgagcacgcacgtccaga

SEQ ID NO: 152158 - DNA, 25 bp, Homo sapien
tgccttcgcgtgtgcacacctgaga

SEQ ID NO: 152159 - DNA, 25 bp, Homo sapien
tatccacaaggtgcacgcgtgtctg

SEQ ID NO: 152160 - DNA, 25 bp, Homo sapien
gtgacggagacggtagcactatgtc

SEQ ID NO: 152161 - DNA, 25 bp, Homo sapien
cacaggagcctttgcggccatgtgc

SEQ ID NO: 152162 - DNA, 25 bp, Homo sapien
ccatgtgcgcgccttccttgtcttg

SEQ ID NO: 152163 - DNA, 25 bp, Homo sapien
tgtgcgcgccttccttgtcttgtgt

SEQ ID NO: 152164 - DNA, 25 bp, Homo sapien
tcgccaggtagagcgggctcacagc

SEQ ID NO: 152165 - DNA, 25 bp, Homo sapien
ctgctagttttggtttgcagcatgc

SEQ ID NO: 152166 - DNA, 25 bp, Homo sapien
ttttggtttgcagcatgccgcaggt

SEQ ID NO: 152167 - DNA, 25 bp, Homo sapien
agcatgccgcaggtgtagtctcggt

SEQ ID NO: 152168 - DNA, 25 bp, Homo sapien
tccagtccgtaggagcagagcacgc

SEQ ID NO: 152169 - DNA, 25 bp, Homo sapien
ggggcagtctgtggatgtcccaatc

SEQ ID NO: 152170 - DNA, 25 bp, Homo sapien
tagcccggttattgtccgctgagcc

SEQ ID NO: 152171 - DNA, 25 bp, Homo sapien
gcacgccagcttgagtccgcagaaa

SEQ ID NO: 152172 - DNA, 25 bp, Homo sapien
gtacccgcgttacacagctgttcca

SEQ ID NO: 152173 - DNA, 25 bp, Homo sapien
agagctcctggcctacaaatgcatg

SEQ ID NO: 152174 - DNA, 25 bp, Homo sapien
tccgcaaagcgggttccaaaggaga

SEQ ID NO: 152175 - DNA, 25 bp, Homo sapien
gctcctggctgtacgcaacgcttac

SEQ ID NO: 152176 - DNA, 25 bp, Homo sapien
tgatcctcggcgaaagctcctatcg

SEQ ID NO: 152177 - DNA, 25 bp, Homo sapien
gtggtgcagaccacctctttcccgg

SEQ ID NO: 152178 - DNA, 25 bp, Homo sapien
tggctcaaactctcgtcacctgatc

SEQ ID NO: 152179 - DNA, 25 bp, Homo sapien
ttcccgccaccggaagatctcagtg

SEQ ID NO: 152180 - DNA, 25 bp, Homo sapien
tatgatccatgactgcagttcccgc

SEQ ID NO: 152181 - DNA, 25 bp, Homo sapien
ggctgtcagcctcgcttaactcttc

SEQ ID NO: 152182 - DNA, 25 bp, Homo sapien
cgcccgcaagcagatcctaagaaga

SEQ ID NO: 152183 - DNA, 25 bp, Homo sapien
cgcgacactttgaccgtagccgttc

SEQ ID NO: 152184 - DNA, 25 bp, Homo sapien
cgggcctatcgaattgcagagcatc

SEQ ID NO: 152185 - DNA, 25 bp, Homo sapien
ggagacggtcgtatcccaagtcctc

SEQ ID NO: 152186 - DNA, 25 bp, Homo sapien
actttctaggtcgtaggcctgctgg

SEQ ID NO: 152187 - DNA, 25 bp, Homo sapien
cgcatgcgcacagttgctaggcaac

SEQ ID NO: 152188 - DNA, 25 bp, Homo sapien
cctccacgtcgatggtggtgaagtt

SEQ ID NO: 152189 - DNA, 25 bp, Homo sapien
actcgctcggttctagtgcgccttt

SEQ ID NO: 152190 - DNA, 25 bp, Homo sapien
cgaatcgctgctttctcctgcagaa

SEQ ID NO: 152191 - DNA, 25 bp, Homo sapien
acgtcgctccttctaggccttagga

SEQ ID NO: 152192 - DNA, 25 bp, Homo sapien
gcgccctttgcggagaagcacacga

SEQ ID NO: 152193 - DNA, 25 bp, Homo sapien
cacacgaaggtgaaggaaggaaaga

SEQ ID NO: 152194 - DNA, 25 bp, Homo sapien
tgtgcaaccgcggagaacaccgagt

SEQ ID NO: 152195 - DNA, 25 bp, Homo sapien
cggaccaggagaagagcaaagaaaa

SEQ ID NO: 152196 - DNA, 25 bp, Homo sapien
ccgtctggatttgtttgcccaggac

SEQ ID NO: 152197 - DNA, 25 bp, Homo sapien
ctggatttgtttgcccaggactggc

SEQ ID NO: 152198 - DNA, 25 bp, Homo sapien
ctggggcgcccactaatgtggccct

SEQ ID NO: 152199 - DNA, 25 bp, Homo sapien
cgcccactaatgtggccctgagggc

SEQ ID NO: 152200 - DNA, 25 bp, Homo sapien
accgtgatgcggttaagcgcgtacc

SEQ ID NO: 152201 - DNA, 25 bp, Homo sapien
gcgcgtaccgctgcaacttatggtc

SEQ ID NO: 152202 - DNA, 25 bp, Homo sapien
gtcgtcacagaacagataaaccgtc

SEQ ID NO: 152203 - DNA, 25 bp, Homo sapien
cgagagtggcaacgaccctttccct

SEQ ID NO: 152204 - DNA, 25 bp, Homo sapien
ggattcccacgacatactgagctca

SEQ ID NO: 152205 - DNA, 25 bp, Homo sapien
gtcagcatggccaatcggaacgtca

SEQ ID NO: 152206 - DNA, 25 bp, Homo sapien
aacgtcagaattgggcgccgaccta

SEQ ID NO: 152207 - DNA, 25 bp, Homo sapien
gccgacctaatgacatgcggggtta

SEQ ID NO: 152208 - DNA, 25 bp, Homo sapien
ttgcccttggcctcctcatagagca

SEQ ID NO: 152209 - DNA, 25 bp, Homo sapien
cgtccatctcacagggtcgcagagc

SEQ ID NO: 152210 - DNA, 25 bp, Homo sapien
ggtataccagcacgtcagccgctcg

SEQ ID NO: 152211 - DNA, 25 bp, Homo sapien
gcaccaccgtgtcatctgccaggta

SEQ ID NO: 152212 - DNA, 25 bp, Homo sapien
ttcggaactgcaggaaaggctcatc

SEQ ID NO: 152213 - DNA, 25 bp, Homo sapien
cgcagtcctcaacgtcgcacaggta

SEQ ID NO: 152214 - DNA, 25 bp, Homo sapien
ctgacctcctgcaccttgcggtagg

SEQ ID NO: 152215 - DNA, 25 bp, Homo sapien
aggctcatccatggccacgtcgtcg

SEQ ID NO: 152216 - DNA, 25 bp, Homo sapien
agcctcatagccctttgctgatggc

SEQ ID NO: 152217 - DNA, 25 bp, Homo sapien
ctcatagccctttgctgatggctga

SEQ ID NO: 152218 - DNA, 25 bp, Homo sapien
gctgagcctcatagccctttgctga

SEQ ID NO: 152219 - DNA, 25 bp, Homo sapien
tctggctgagcctcatagccctttg

SEQ ID NO: 152220 - DNA, 25 bp, Homo sapien
tgtcgaccccaatggctctggctga

SEQ ID NO: 152221 - DNA, 25 bp, Homo sapien
tgggcgctgtcgaccccaatggctc

SEQ ID NO: 152222 - DNA, 25 bp, Homo sapien
atgcccaaaacggtgagtgccggag

SEQ ID NO: 152223 - DNA, 25 bp, Homo sapien
catagccctttgctgatggctgagg

SEQ ID NO: 152224 - DNA, 25 bp, Homo sapien
cgaaatcaaactcgggaggctccgc

SEQ ID NO: 152225 - DNA, 25 bp, Homo sapien
gcgccctactctgcctcgctcagca

SEQ ID NO: 152226 - DNA, 25 bp, Homo sapien
ccaacaatggcgcggggacactgag

SEQ ID NO: 152227 - DNA, 25 bp, Homo sapien
tcaaactcgggaggctccgcagcag

SEQ ID NO: 152228 - DNA, 25 bp, Homo sapien
actgagcaagcagaggccacctcgc

SEQ ID NO: 152229 - DNA, 25 bp, Homo sapien
ggacactgagcaagcagaggccacc

SEQ ID NO: 152230 - DNA, 25 bp, Homo sapien
gccttctccgaaatcaaactcggga

SEQ ID NO: 152231 - DNA, 25 bp, Homo sapien
ctctggcgccttcgcttgcgcccta

SEQ ID NO: 152232 - DNA, 25 bp, Homo sapien
catgagttgaccctgaggtgacgtc

SEQ ID NO: 152233 - DNA, 25 bp, Homo sapien
atcccggggccgtcaggcatgagtt

SEQ ID NO: 152234 - DNA, 25 bp, Homo sapien
aaggaactgcaggtggcgcccacag

SEQ ID NO: 152235 - DNA, 25 bp, Homo sapien
ctgaggtgacgtcggcgccatgcct

SEQ ID NO: 152236 - DNA, 25 bp, Homo sapien
tgacatcggcaccatgcctggggtc

SEQ ID NO: 152237 - DNA, 25 bp, Homo sapien
tcaccagggccgtgctgagccaaag

SEQ ID NO: 152238 - DNA, 25 bp, Homo sapien
ctgcgaagctcgtgcacccacgggt

SEQ ID NO: 152239 - DNA, 25 bp, Homo sapien
cagccacggggctggttctgaccca

SEQ ID NO: 152240 - DNA, 25 bp, Homo sapien
ctccaaagccactaggcaggcgtta

SEQ ID NO: 152241 - DNA, 25 bp, Homo sapien
gctgcgccagcacttgtttctccaa

SEQ ID NO: 152242 - DNA, 25 bp, Homo sapien
tccagtgctgtacaggagccgaagg

SEQ ID NO: 152243 - DNA, 25 bp, Homo sapien
gctagccgctccagtgctgtacagg

SEQ ID NO: 152244 - DNA, 25 bp, Homo sapien
ggaaaaagggccgagctagccgctc

SEQ ID NO: 152245 - DNA, 25 bp, Homo sapien
acggtccggagcaagcccagaggca

SEQ ID NO: 152246 - DNA, 25 bp, Homo sapien
aactgttgcatttgctctccacctc

SEQ ID NO: 152247 - DNA, 25 bp, Homo sapien
cgggacccgactcgcaaactgttgc

SEQ ID NO: 152248 - DNA, 25 bp, Homo sapien
cgaggcagctgcgtaccagagtcgc

SEQ ID NO: 152249 - DNA, 25 bp, Homo sapien
cagagtcgcgactactacaactttc

SEQ ID NO: 152250 - DNA, 25 bp, Homo sapien
actacaactttccactggctctggc

SEQ ID NO: 152251 - DNA, 25 bp, Homo sapien
ctcgcatcaagctggagaacccgct

SEQ ID NO: 152252 - DNA, 25 bp, Homo sapien
ggagaacccgctggactacggcagc

SEQ ID NO: 152253 - DNA, 25 bp, Homo sapien
ctatggggacctggcgagcctgcat

SEQ ID NO: 152254 - DNA, 25 bp, Homo sapien
cccacgctcgcatcaagctggagaa

SEQ ID NO: 152255 - DNA, 25 bp, Homo sapien
agcactggacgaggcagctgcgtac

SEQ ID NO: 152256 - DNA, 25 bp, Homo sapien
cgtcagcgacctggcgaaccaggcg

SEQ ID NO: 152257 - DNA, 25 bp, Homo sapien
cctggcgaaccaggcgacgctgaag

SEQ ID NO: 152258 - DNA, 25 bp, Homo sapien
aagcggcccatggacttcggtacaa

SEQ ID NO: 152259 - DNA, 25 bp, Homo sapien
cggcccatggacttcggtacaaagc

SEQ ID NO: 152260 - DNA, 25 bp, Homo sapien
ccatggacttcggtacaaagctgct

SEQ ID NO: 152261 - DNA, 25 bp, Homo sapien
gacgcagaccctaccgccaactctg

SEQ ID NO: 152262 - DNA, 25 bp, Homo sapien
gcagcaagcggcgccttacaattcc

SEQ ID NO: 152263 - DNA, 25 bp, Homo sapien
ccgcacttacccgagtccgctcccg

SEQ ID NO: 152264 - DNA, 25 bp, Homo sapien
tgcctagcaagcagcatgtccctta

SEQ ID NO: 152265 - DNA, 25 bp, Homo sapien
ttaggcatcgccttcccagataagc

SEQ ID NO: 152266 - DNA, 25 bp, Homo sapien
ccggatccttcctgagcaattgcaa

SEQ ID NO: 152267 - DNA, 25 bp, Homo sapien
cgcgacccgcttaaggaagctcata

SEQ ID NO: 152268 - DNA, 25 bp, Homo sapien
cgctggctgctaagacttcttcctg

SEQ ID NO: 152269 - DNA, 25 bp, Homo sapien
gtagcctcgctccatagacactgca

SEQ ID NO: 152270 - DNA, 25 bp, Homo sapien
gaagctcatagcctccgtccctttg

SEQ ID NO: 152271 - DNA, 25 bp, Homo sapien
ccagggagagctaactatcgcagtc

SEQ ID NO: 152272 - DNA, 25 bp, Homo sapien
ctaagcgtgtctagctggacccgtg

SEQ ID NO: 152273 - DNA, 25 bp, Homo sapien
ctccacgtcgcaggttccgcaaaga

SEQ ID NO: 152274 - DNA, 25 bp, Homo sapien
cttgggatctgcgacaaaagggacc

SEQ ID NO: 152275 - DNA, 25 bp, Homo sapien
cggccattgccaggcgccattaggt

SEQ ID NO: 152276 - DNA, 25 bp, Homo sapien
ttccggcgcacgaaaacttgaagtc

SEQ ID NO: 152277 - DNA, 25 bp, Homo sapien
ctctttcctagaggtgccgtgatcg

SEQ ID NO: 152278 - DNA, 25 bp, Homo sapien
ggcactccaagccaactcctgagaa

SEQ ID NO: 152279 - DNA, 25 bp, Homo sapien
atccggcttgagtgttaaaggctaa

SEQ ID NO: 152280 - DNA, 25 bp, Homo sapien
gggcaaaactacccgaggcgccagc

SEQ ID NO: 152281 - DNA, 25 bp, Homo sapien
ggattcgctcagtcccggggcaaaa

SEQ ID NO: 152282 - DNA, 25 bp, Homo sapien
atccaggtgaactgagagccaggca

SEQ ID NO: 152283 - DNA, 25 bp, Homo sapien
tcgctcttgggctgcttagccgcct

SEQ ID NO: 152284 - DNA, 25 bp, Homo sapien
tccggcgttgcggttcccgaagcca

SEQ ID NO: 152285 - DNA, 25 bp, Homo sapien
ttcccgaagccacggacgtggactc

SEQ ID NO: 152286 - DNA, 25 bp, Homo sapien
cgccgcgctgggatccaggtgaact

SEQ ID NO: 152287 - DNA, 25 bp, Homo sapien
tcgccagctcgctcttgggctgctt

SEQ ID NO: 152288 - DNA, 25 bp, Homo sapien
cacttgagctgagtggactcgggtt

SEQ ID NO: 152289 - DNA, 25 bp, Homo sapien
ctttcgagggcatttccaggaagcc

SEQ ID NO: 152290 - DNA, 25 bp, Homo sapien
ctttctctgctttcgagggcatttc

SEQ ID NO: 152291 - DNA, 25 bp, Homo sapien
agcttcaggctctgttgccgggtcg

SEQ ID NO: 152292 - DNA, 25 bp, Homo sapien
gtcttccagcgaagcctcgcgagtg

SEQ ID NO: 152293 - DNA, 25 bp, Homo sapien
atttgggtgactttctggcgagtcc

SEQ ID NO: 152294 - DNA, 25 bp, Homo sapien
tcgggttgacaacggctaagcagcc

SEQ ID NO: 152295 - DNA, 25 bp, Homo sapien
cagctgctcttctggctggcaccgt

SEQ ID NO: 152296 - DNA, 25 bp, Homo sapien
tccgtggaggaatgtgcccccgagc

SEQ ID NO: 152297 - DNA, 25 bp, Homo sapien
atccgtggaggaatgtgcccccgag

SEQ ID NO: 152298 - DNA, 25 bp, Homo sapien
ccgtggaggaatgtgcccccgagcc

SEQ ID NO: 152299 - DNA, 25 bp, Homo sapien
cgtggaggaatgtgcccccgagcca

SEQ ID NO: 152300 - DNA, 25 bp, Homo sapien
gtggaggaatgtgcccccgagccac

SEQ ID NO: 152301 - DNA, 25 bp, Homo sapien
aatccgtggaggaatgtgcccccga

SEQ ID NO: 152302 - DNA, 25 bp, Homo sapien
gaggaatgtgcccccgagccaccat

SEQ ID NO: 152303 - DNA, 25 bp, Homo sapien
caatccgtggaggaatgtgcccccg

SEQ ID NO: 152304 - DNA, 25 bp, Homo sapien
cagctgcgcaaggagtcccagaaag

SEQ ID NO: 152305 - DNA, 25 bp, Homo sapien
accatcatgcctgggcacttacagg

SEQ ID NO: 152306 - DNA, 25 bp, Homo sapien
ggtcaccaaccgattcgaccagtta

SEQ ID NO: 152307 - DNA, 25 bp, Homo sapien
agaccaactccaacgcggcaggcaa

SEQ ID NO: 152308 - DNA, 25 bp, Homo sapien
tgcgcaaggagtcccagaaagaccg

SEQ ID NO: 152309 - DNA, 25 bp, Homo sapien
ggagtcccagaaagaccgcaagaac

SEQ ID NO: 152310 - DNA, 25 bp, Homo sapien
agaaagaccgcaagaacccgctgcc

SEQ ID NO: 152311 - DNA, 25 bp, Homo sapien
accaaccgattcgaccagttatttg

SEQ ID NO: 152312 - DNA, 25 bp, Homo sapien
aacctggagcccgtatcctggagct

SEQ ID NO: 152313 - DNA, 25 bp, Homo sapien
ccacttcttccaagggacagcgatc

SEQ ID NO: 152314 - DNA, 25 bp, Homo sapien
ggcgcctcattttgtctccggcttt

SEQ ID NO: 152315 - DNA, 25 bp, Homo sapien
gcccgcgctgaagtagaagctgtcc

SEQ ID NO: 152316 - DNA, 25 bp, Homo sapien
agggatcccgaagtgcagtctgccc

SEQ ID NO: 152317 - DNA, 25 bp, Homo sapien
gtaacttatctcctctggacgctgg

SEQ ID NO: 152318 - DNA, 25 bp, Homo sapien
cggctttttcgagtgttttcctgcg

SEQ ID NO: 152319 - DNA, 25 bp, Homo sapien
ttctaagtacactgagcagggcccg

SEQ ID NO: 152320 - DNA, 25 bp, Homo sapien
tgcgtctctcgacagcccctgaggg

SEQ ID NO: 152321 - DNA, 25 bp, Homo sapien
gacgaggcctcatgtgtcccactct

SEQ ID NO: 152322 - DNA, 25 bp, Homo sapien
acccgagcctccgtgctgtgcaagg

SEQ ID NO: 152323 - DNA, 25 bp, Homo sapien
tgtgcagcagccactgcgtctctcg

SEQ ID NO: 152324 - DNA, 25 bp, Homo sapien
cgagcctccgtgctgtgcaaggagc

SEQ ID NO: 152325 - DNA, 25 bp, Homo sapien
cgtgacaccagtaccgctatgcgtc

SEQ ID NO: 152326 - DNA, 25 bp, Homo sapien
accgctatgcgtccggcccacccga

SEQ ID NO: 152327 - DNA, 25 bp, Homo sapien
gtctgacgaggcctcatgtgtccca

SEQ ID NO: 152328 - DNA, 25 bp, Homo sapien
catcatcatcttcctgacggtccta

SEQ ID NO: 152329 - DNA, 25 bp, Homo sapien
agcgacatcatcattcccttacgga

SEQ ID NO: 152330 - DNA, 25 bp, Homo sapien
cccttacggactacagagaacaact

SEQ ID NO: 152331 - DNA, 25 bp, Homo sapien
ggactacgggcaccctgtctacatc

SEQ ID NO: 152332 - DNA, 25 bp, Homo sapien
tgtctacatcgtccaagagatgccg

SEQ ID NO: 152333 - DNA, 25 bp, Homo sapien
actacaaggtctgagtgcccggcac

SEQ ID NO: 152334 - DNA, 25 bp, Homo sapien
tgacggtcctactactgaagctacg

SEQ ID NO: 152335 - DNA, 25 bp, Homo sapien
tgaagctacgcaagcggcaccgcaa

SEQ ID NO: 152336 - DNA, 25 bp, Homo sapien
gcgcgtttctgtatgtgtctctccc

SEQ ID NO: 152337 - DNA, 25 bp, Homo sapien
cgtgtctttttgtgggcgtgtgtat

SEQ ID NO: 152338 - DNA, 25 bp, Homo sapien
cgtttctgtatgtgtctctcccggc

SEQ ID NO: 152339 - DNA, 25 bp, Homo sapien
ctgcgcgtttctgtatgtgtctctc

SEQ ID NO: 152340 - DNA, 25 bp, Homo sapien
tttttgtgggcgtgtgtatgcctgc

SEQ ID NO: 152341 - DNA, 25 bp, Homo sapien
tgtgtgtttccgtgtctttttgtgg

SEQ ID NO: 152342 - DNA, 25 bp, Homo sapien
ttccgtgtctttttgtgggcgtgtg

SEQ ID NO: 152343 - DNA, 25 bp, Homo sapien
gtatgcctgcgcgtttctgtatgtg

SEQ ID NO: 152344 - DNA, 25 bp, Homo sapien
gaggcaagtccgcagtcccgcagct

SEQ ID NO: 152345 - DNA, 25 bp, Homo sapien
tgcacgcattcttcccggccaagaa

SEQ ID NO: 152346 - DNA, 25 bp, Homo sapien
tttgctttgatagcctggtccggga

SEQ ID NO: 152347 - DNA, 25 bp, Homo sapien
caggctgcccgccactttgctttga

SEQ ID NO: 152348 - DNA, 25 bp, Homo sapien
cgaagatggagagcccgcgaagctc

SEQ ID NO: 152349 - DNA, 25 bp, Homo sapien
ttgactcgctcctacgcagcagcga

SEQ ID NO: 152350 - DNA, 25 bp, Homo sapien
gccaagaaggaacgcggcgagctaa

SEQ ID NO: 152351 - DNA, 25 bp, Homo sapien
ctaatcagaagcagcgggtctgccc

SEQ ID NO: 152352 - DNA, 25 bp, Homo sapien
tagttgttctatagggctaagttcc

SEQ ID NO: 152353 - DNA, 25 bp, Homo sapien
tctaggtccaaacctcttctggagg

SEQ ID NO: 152354 - DNA, 25 bp, Homo sapien
tggggatgggcaactctaggtccaa

SEQ ID NO: 152355 - DNA, 25 bp, Homo sapien
gcctgctggggtgaaaactgagcaa

SEQ ID NO: 152356 - DNA, 25 bp, Homo sapien
agccttgaccctctgacctggagac

SEQ ID NO: 152357 - DNA, 25 bp, Homo sapien
ggctaagttccttggcccaggctgg

SEQ ID NO: 152358 - DNA, 25 bp, Homo sapien
gtgctcttgaaggttagttctaatt

SEQ ID NO: 152359 - DNA, 25 bp, Homo sapien
agggactccgagcatgggctaattg

SEQ ID NO: 152360 - DNA, 25 bp, Homo sapien
cgaggggcgaacctgaaaagcagtt

SEQ ID NO: 152361 - DNA, 25 bp, Homo sapien
attgtgaagtcagctggagcccgcc

SEQ ID NO: 152362 - DNA, 25 bp, Homo sapien
agaagcagagctctcggatctccga

SEQ ID NO: 152363 - DNA, 25 bp, Homo sapien
ccagcgcccggatgaatcgaggaaa

SEQ ID NO: 152364 - DNA, 25 bp, Homo sapien
ccagaacaggccgatggaggacatg

SEQ ID NO: 152365 - DNA, 25 bp, Homo sapien
gcgccacaccaaaggggttccggca

SEQ ID NO: 152366 - DNA, 25 bp, Homo sapien
ctgccctcccaatagcgatgaaagc

SEQ ID NO: 152367 - DNA, 25 bp, Homo sapien
gccacacgcttttcagagaagcaga

SEQ ID NO: 152368 - DNA, 25 bp, Homo sapien
gtcactcacgcatggtattagcatt

SEQ ID NO: 152369 - DNA, 25 bp, Homo sapien
gctgcagccccttccaattagccca

SEQ ID NO: 152370 - DNA, 25 bp, Homo sapien
tcacgcatggtattagcatttctaa

SEQ ID NO: 152371 - DNA, 25 bp, Homo sapien
cactcacgcatggtattagcatttc

SEQ ID NO: 152372 - DNA, 25 bp, Homo sapien
ctgtcactcacgcatggtattagca

SEQ ID NO: 152373 - DNA, 25 bp, Homo sapien
ctcacgcatggtattagcatttcta

SEQ ID NO: 152374 - DNA, 25 bp, Homo sapien
cattgtcctcgcactgtcactcacg

SEQ ID NO: 152375 - DNA, 25 bp, Homo sapien
ctcctccattgtcctcgcactgtca

SEQ ID NO: 152376 - DNA, 25 bp, Homo sapien
ttgtctccgattaaaagaattccag

SEQ ID NO: 152377 - DNA, 25 bp, Homo sapien
tttcctgcccgcacatttgcatttg

SEQ ID NO: 152378 - DNA, 25 bp, Homo sapien
aaggcagcctattctcaccagcagc

SEQ ID NO: 152379 - DNA, 25 bp, Homo sapien
agtcatttagactttgaaggcagcc

SEQ ID NO: 152380 - DNA, 25 bp, Homo sapien
ccggctgaggcgtttagtcatttag

SEQ ID NO: 152381 - DNA, 25 bp, Homo sapien
atctctcggaattaaaggctttgtc

SEQ ID NO: 152382 - DNA, 25 bp, Homo sapien
cgcacatttgcatttggagcctttc

SEQ ID NO: 152383 - DNA, 25 bp, Homo sapien
ggagcctttcatctgatctctcgga

SEQ ID NO: 152384 - DNA, 25 bp, Homo sapien
ctgctcgctgaccatctgtggctgt

SEQ ID NO: 152385 - DNA, 25 bp, Homo sapien
tcttcttcaccgtgctgctcgctga

SEQ ID NO: 152386 - DNA, 25 bp, Homo sapien
aaaccttgcgccgactccgagcggg

SEQ ID NO: 152387 - DNA, 25 bp, Homo sapien
ggccgagcgacaaaccttgcgccga

SEQ ID NO: 152388 - DNA, 25 bp, Homo sapien
ccgacactatgaggagtgcggcgcc

SEQ ID NO: 152389 - DNA, 25 bp, Homo sapien
ctgcgccgaaccgagacggccggtt

SEQ ID NO: 152390 - DNA, 25 bp, Homo sapien
cgaacacccggagcgcgaacgaagc

SEQ ID NO: 152391 - DNA, 25 bp, Homo sapien
cgctgaccatctgtggctgtgcgcg

SEQ ID NO: 152392 - DNA, 25 bp, Homo sapien
tttcagcccgttcaggcctctagtc

SEQ ID NO: 152393 - DNA, 25 bp, Homo sapien
ttcgcttctgaccttccttcgcttt

SEQ ID NO: 152394 - DNA, 25 bp, Homo sapien
cggttcctttctcccacttcgcgcg

SEQ ID NO: 152395 - DNA, 25 bp, Homo sapien
cagagcgggttcttcctcgtcggtt

SEQ ID NO: 152396 - DNA, 25 bp, Homo sapien
ggcgcctgcagagcgggttcttcct

SEQ ID NO: 152397 - DNA, 25 bp, Homo sapien
tcttctggggccacggaagagccct

SEQ ID NO: 152398 - DNA, 25 bp, Homo sapien
aacgacagagctcgcgaccgcagcc

SEQ ID NO: 152399 - DNA, 25 bp, Homo sapien
aagagccctgactgctgttccccga

SEQ ID NO: 152400 - DNA, 25 bp, Homo sapien
tgggagcactcagcaacctcgagcc

SEQ ID NO: 152401 - DNA, 25 bp, Homo sapien
ctacctagagttgcgctcggagttg

SEQ ID NO: 152402 - DNA, 25 bp, Homo sapien
tctggcaccctaagcagcctcggtg

SEQ ID NO: 152403 - DNA, 25 bp, Homo sapien
tgctgacgttgtgctgctacctaga

SEQ ID NO: 152404 - DNA, 25 bp, Homo sapien
tgacttggaaagtctcgcgcgcgcc

SEQ ID NO: 152405 - DNA, 25 bp, Homo sapien
cctcgagaaaagttggcgacgctcc

SEQ ID NO: 152406 - DNA, 25 bp, Homo sapien
gccgtcacctaagcagcagccattg

SEQ ID NO: 152407 - DNA, 25 bp, Homo sapien
tagccgcctgtcagaggtcgtgaac

SEQ ID NO: 152408 - DNA, 25 bp, Homo sapien
cccacttgctttgtggccggttcca

SEQ ID NO: 152409 - DNA, 25 bp, Homo sapien
cctcggagaagtggacacgaagccc

SEQ ID NO: 152410 - DNA, 25 bp, Homo sapien
cctctgcactcccaggaaggcgatg

SEQ ID NO: 152411 - DNA, 25 bp, Homo sapien
ttcctcacaggtgtcggtggacttc

SEQ ID NO: 152412 - DNA, 25 bp, Homo sapien
ccattttaatttggtctcaacggag

SEQ ID NO: 152413 - DNA, 25 bp, Homo sapien
tgaagctctcgtctcctctctggtt

SEQ ID NO: 152414 - DNA, 25 bp, Homo sapien
ttcgcagccgcactggatgaagctc

SEQ ID NO: 152415 - DNA, 25 bp, Homo sapien
ggccaaggccatggcacacactctg

SEQ ID NO: 152416 - DNA, 25 bp, Homo sapien
ctcggcgagcactacaactccgtga

SEQ ID NO: 152417 - DNA, 25 bp, Homo sapien
gcgccatccaagaccagctggtgtt

SEQ ID NO: 152418 - DNA, 25 bp, Homo sapien
tgccgcaccgccagctacatgaaga

SEQ ID NO: 152419 - DNA, 25 bp, Homo sapien
tcggctacgacgacttcatgatcta

SEQ ID NO: 152420 - DNA, 25 bp, Homo sapien
ccaccttgatcatcggggaggagta

SEQ ID NO: 152421 - DNA, 25 bp, Homo sapien
gtacgtcaagaagccgatcatcctg

SEQ ID NO: 152422 - DNA, 25 bp, Homo sapien
ttccaggctgagatgtcggagcacc

SEQ ID NO: 152423 - DNA, 25 bp, Homo sapien
tcctggtctacctgcgctatgccta

SEQ ID NO: 152424 - DNA, 25 bp, Homo sapien
ccgagctgttcgaaactggtagaca

SEQ ID NO: 152425 - DNA, 25 bp, Homo sapien
cgcgctcaagcgaccggatcttcaa

SEQ ID NO: 152426 - DNA, 25 bp, Homo sapien
tcatggtaaaacagcgcctagggtt

SEQ ID NO: 152427 - DNA, 25 bp, Homo sapien
cctacgacttgtaacgggctgcctg

SEQ ID NO: 152428 - DNA, 25 bp, Homo sapien
cgggctgcctggtaaaatgagtcta

SEQ ID NO: 152429 - DNA, 25 bp, Homo sapien
ctcccggaagtcctttgatgctttg

SEQ ID NO: 152430 - DNA, 25 bp, Homo sapien
tccgcgctcgcctaattcttcttta

SEQ ID NO: 152431 - DNA, 25 bp, Homo sapien
tgaccggagttgcaggttgccaatc

SEQ ID NO: 152432 - DNA, 25 bp, Homo sapien
tcgggcagtccgcactgcaattggt

SEQ ID NO: 152433 - DNA, 25 bp, Homo sapien
tggcgtctccgggacggatttgaaa

SEQ ID NO: 152434 - DNA, 25 bp, Homo sapien
atgctccgcagggtcgaaaagaggc

SEQ ID NO: 152435 - DNA, 25 bp, Homo sapien
tctgggaaccggaagcggatgctcc

SEQ ID NO: 152436 - DNA, 25 bp, Homo sapien
ctgacaattcagtctgggaaccgga

SEQ ID NO: 152437 - DNA, 25 bp, Homo sapien
tcagactccgctcactgacaattca

SEQ ID NO: 152438 - DNA, 25 bp, Homo sapien
tgggcagtccacagcgacctcagac

SEQ ID NO: 152439 - DNA, 25 bp, Homo sapien
gcactgcaattggttggcgtctccg

SEQ ID NO: 152440 - DNA, 25 bp, Homo sapien
catttccggtatctggctggacgca

SEQ ID NO: 152441 - DNA, 25 bp, Homo sapien
caggcgagtttgaatccgtgttccc

SEQ ID NO: 152442 - DNA, 25 bp, Homo sapien
cgccgtgacgtatttgctgaatgcc

SEQ ID NO: 152443 - DNA, 25 bp, Homo sapien
tgccacctgttttccgtgccgcttg

SEQ ID NO: 152444 - DNA, 25 bp, Homo sapien
cttggggactcgtgtccttgactca

SEQ ID NO: 152445 - DNA, 25 bp, Homo sapien
cgagggcaaggtccgatttccacaa

SEQ ID NO: 152446 - DNA, 25 bp, Homo sapien
cagcactggcatcctcgggacaaga

SEQ ID NO: 152447 - DNA, 25 bp, Homo sapien
gttgcactgtagctccaccttgtgg

SEQ ID NO: 152448 - DNA, 25 bp, Homo sapien
cgggctacggcgactggcaagtccc

SEQ ID NO: 152449 - DNA, 25 bp, Homo sapien
tcctaagccagtcccgggcaagagc

SEQ ID NO: 152450 - DNA, 25 bp, Homo sapien
ggggctacagctcgcagaccttgcc

SEQ ID NO: 152451 - DNA, 25 bp, Homo sapien
ccctcgcaccaaggccaagctcatc

SEQ ID NO: 152452 - DNA, 25 bp, Homo sapien
agcctccgggctacggcgactggca

SEQ ID NO: 152453 - DNA, 25 bp, Homo sapien
ctcgcagaccttgccctcgcaggcg

SEQ ID NO: 152454 - DNA, 25 bp, Homo sapien
ggccggtgcctcctaagccagtccc

SEQ ID NO: 152455 - DNA, 25 bp, Homo sapien
gggcaacggcgccagcgcgggttat

SEQ ID NO: 152456 - DNA, 25 bp, Homo sapien
tccctcgaatgccttcgttgcgtgc

SEQ ID NO: 152457 - DNA, 25 bp, Homo sapien
ggctccttctgagaccctcctcagg

SEQ ID NO: 152458 - DNA, 25 bp, Homo sapien
gcgctttctcagcactagatctgga

SEQ ID NO: 152459 - DNA, 25 bp, Homo sapien
cgctttgtgtccgtggtctcccgcg

SEQ ID NO: 152460 - DNA, 25 bp, Homo sapien
gcactagatctggactccgacccgg

SEQ ID NO: 152461 - DNA, 25 bp, Homo sapien
tctacggctctgttctcagcctctt

SEQ ID NO: 152462 - DNA, 25 bp, Homo sapien
gctggcgctttctcagcactagatc

SEQ ID NO: 152463 - DNA, 25 bp, Homo sapien
tcagcctcttttccaacactgcgtg

SEQ ID NO: 152464 - DNA, 25 bp, Homo sapien
agctgccgagttcggccgctcaggc

SEQ ID NO: 152465 - DNA, 25 bp, Homo sapien
cctagggagcacagagtcttggact

SEQ ID NO: 152466 - DNA, 25 bp, Homo sapien
agagctgttgcaaacctagggagca

SEQ ID NO: 152467 - DNA, 25 bp, Homo sapien
cccaacgcttaccagagagctgttg

SEQ ID NO: 152468 - DNA, 25 bp, Homo sapien
ccagagaatcctaggtacgcccgga

SEQ ID NO: 152469 - DNA, 25 bp, Homo sapien
tgcatgccatggttgccagagaatc

SEQ ID NO: 152470 - DNA, 25 bp, Homo sapien
cccgttgatgcaactgcatgccatg

SEQ ID NO: 152471 - DNA, 25 bp, Homo sapien
gctcaggcttcaaagctgcggcttg

SEQ ID NO: 152472 - DNA, 25 bp, Homo sapien
ccttcctaacggctggacaagcgga

SEQ ID NO: 152473 - DNA, 25 bp, Homo sapien
gggcaggcctcgctttcgaaagcag

SEQ ID NO: 152474 - DNA, 25 bp, Homo sapien
gcagttaccaaatcgggcctctgga

SEQ ID NO: 152475 - DNA, 25 bp, Homo sapien
cctaggttgcaggaaagcgcagtta

SEQ ID NO: 152476 - DNA, 25 bp, Homo sapien
attctgagacgccagaagcgtgacc

SEQ ID NO: 152477 - DNA, 25 bp, Homo sapien
ggacaagcggactacggcttcattc

SEQ ID NO: 152478 - DNA, 25 bp, Homo sapien
gcagcctaaggcaggaccttcctaa

SEQ ID NO: 152479 - DNA, 25 bp, Homo sapien
ccacggcacaaccagagacattctg

SEQ ID NO: 152480 - DNA, 25 bp, Homo sapien
tcacccgcatgcgaacctcataggt

SEQ ID NO: 152481 - DNA, 25 bp, Homo sapien
aacctcataggtggtgaagcgcgcg

SEQ ID NO: 152482 - DNA, 25 bp, Homo sapien
acgcccaccgtctgaggattaaaga

SEQ ID NO: 152483 - DNA, 25 bp, Homo sapien
tctccaggaagttacttggcggccc

SEQ ID NO: 152484 - DNA, 25 bp, Homo sapien
tcctgcggcttcgagttaaggcgcc

SEQ ID NO: 152485 - DNA, 25 bp, Homo sapien
ctcccgcttgcaaaataactagcca

SEQ ID NO: 152486 - DNA, 25 bp, Homo sapien
gtgtccgacatctttccgaaggaga

SEQ ID NO: 152487 - DNA, 25 bp, Homo sapien
gtatcagctactgccgtgtccgaca

SEQ ID NO: 152488 - DNA, 25 bp, Homo sapien
gtttcttcttacgacgctgcccttg

SEQ ID NO: 152489 - DNA, 25 bp, Homo sapien
ggtccgctcaccactgctctttcag

SEQ ID NO: 152490 - DNA, 25 bp, Homo sapien
ctctttcaggcattacctccggaga

SEQ ID NO: 152491 - DNA, 25 bp, Homo sapien
gcattacctccggagacactcgttc

SEQ ID NO: 152492 - DNA, 25 bp, Homo sapien
tcgttccacctttgtctctgagaga

SEQ ID NO: 152493 - DNA, 25 bp, Homo sapien
cttgctgacaggtttcttcttacga

SEQ ID NO: 152494 - DNA, 25 bp, Homo sapien
ctgcccttgcgtgggttcactcgcg

SEQ ID NO: 152495 - DNA, 25 bp, Homo sapien
tctctgagagatgttcttgctgaca

SEQ ID NO: 152496 - DNA, 25 bp, Homo sapien
cctcaagagtgaccagggtggcacg

SEQ ID NO: 152497 - DNA, 25 bp, Homo sapien
gtccgcgacgacttctaataattaa

SEQ ID NO: 152498 - DNA, 25 bp, Homo sapien
ctgcagaactcggtttcccgactgg

SEQ ID NO: 152499 - DNA, 25 bp, Homo sapien
agttccacctcgttatatcctgcca

SEQ ID NO: 152500 - DNA, 25 bp, Homo sapien
tggcacgactgcagaactcggtttc

SEQ ID NO: 152501 - DNA, 25 bp, Homo sapien
cgggagatgtagtcctcaagagtga

SEQ ID NO: 152502 - DNA, 25 bp, Homo sapien
cggcgagtggtaaacagagacgtca

SEQ ID NO: 152503 - DNA, 25 bp, Homo sapien
ttcccgactggctttcgaggcgcgt

SEQ ID NO: 152504 - DNA, 25 bp, Homo sapien
tccggggaatgagaattcagccaca

SEQ ID NO: 152505 - DNA, 25 bp, Homo sapien
agagccgatcctgttgccctctcgg

SEQ ID NO: 152506 - DNA, 25 bp, Homo sapien
gagatcgctaaccagccgtccgagc

SEQ ID NO: 152507 - DNA, 25 bp, Homo sapien
catagacctagatcccgacttcgaa

SEQ ID NO: 152508 - DNA, 25 bp, Homo sapien
gaatgagaattcagccacagaggct

SEQ ID NO: 152509 - DNA, 25 bp, Homo sapien
ctccacgtatggatccggggaatga

SEQ ID NO: 152510 - DNA, 25 bp, Homo sapien
cggggaggtccaactccacgtatgg

SEQ ID NO: 152511 - DNA, 25 bp, Homo sapien
agaggctgccgcgatcatagaccta

SEQ ID NO: 152512 - DNA, 25 bp, Homo sapien
cggccttcgggatcttgagctacga

SEQ ID NO: 152513 - DNA, 25 bp, Homo sapien
ggcctcccgatgtttaccctcagga

SEQ ID NO: 152514 - DNA, 25 bp, Homo sapien
cgcctccggaacgtttcatagattt

SEQ ID NO: 152515 - DNA, 25 bp, Homo sapien
tgagtgaaatcgacttgctgccgcc

SEQ ID NO: 152516 - DNA, 25 bp, Homo sapien
cctcctctgcagtcggtattgtccg

SEQ ID NO: 152517 - DNA, 25 bp, Homo sapien
ttccggcaatggtcgagagtttcta

SEQ ID NO: 152518 - DNA, 25 bp, Homo sapien
tgcgttcgaaaatcggggctctgga

SEQ ID NO: 152519 - DNA, 25 bp, Homo sapien
cccaaacagaaggaggtgcgttcga

SEQ ID NO: 152520 - DNA, 25 bp, Homo sapien
tccttaacgttctggccttcgctgc

SEQ ID NO: 152521 - DNA, 25 bp, Homo sapien
ctcctgttccttaacgttctggcct

SEQ ID NO: 152522 - DNA, 25 bp, Homo sapien
agaggaggagctggcagcattacaa

SEQ ID NO: 152523 - DNA, 25 bp, Homo sapien
ttcgctgccctctactaccgtaagg

SEQ ID NO: 152524 - DNA, 25 bp, Homo sapien
tgccctctactaccgtaaggacaaa

SEQ ID NO: 152525 - DNA, 25 bp, Homo sapien
tgcgcctcactgcattgcccgacta

SEQ ID NO: 152526 - DNA, 25 bp, Homo sapien
cacccaccacgagtgtgaggccggt

SEQ ID NO: 152527 - DNA, 25 bp, Homo sapien
agctggcagcattacaactgggccc

SEQ ID NO: 152528 - DNA, 25 bp, Homo sapien
cccagtttgtttttgatgactcatc

SEQ ID NO: 152529 - DNA, 25 bp, Homo sapien
tctgacggctcgctagcaatctgcc

SEQ ID NO: 152530 - DNA, 25 bp, Homo sapien
cttcccagctcggattactagttcc

SEQ ID NO: 152531 - DNA, 25 bp, Homo sapien
aatgaatgttcgtctgcttcccagc

SEQ ID NO: 152532 - DNA, 25 bp, Homo sapien
cacgatctgcgtctaatgaatgttc

SEQ ID NO: 152533 - DNA, 25 bp, Homo sapien
ggcaggctctcaggtcatttgcgga

SEQ ID NO: 152534 - DNA, 25 bp, Homo sapien
ctgagctgcggcaagctgctctgac

SEQ ID NO: 152535 - DNA, 25 bp, Homo sapien
cggagcaaacgtgattgacacgatc

SEQ ID NO: 152536 - DNA, 25 bp, Homo sapien
gagaaaaccgtcttcaccgtcttca

SEQ ID NO: 152537 - DNA, 25 bp, Homo sapien
accgtcttcatgctagctgcctctg

SEQ ID NO: 152538 - DNA, 25 bp, Homo sapien
agctgcctctggcatctgcatcatc

SEQ ID NO: 152539 - DNA, 25 bp, Homo sapien
tggcatctgcatcatcctcaatgtg

SEQ ID NO: 152540 - DNA, 25 bp, Homo sapien
catcatcctcaatgtggccgaggtg

SEQ ID NO: 152541 - DNA, 25 bp, Homo sapien
ggccgaggtggtgtacctcatcatc

SEQ ID NO: 152542 - DNA, 25 bp, Homo sapien
gctccaatccaccttcccgcaaggg

SEQ ID NO: 152543 - DNA, 25 bp, Homo sapien
tgtacctcatcatccgggcctgtgc

SEQ ID NO: 152544 - DNA, 25 bp, Homo sapien
ttcggttcggcttgagcaggcccga

SEQ ID NO: 152545 - DNA, 25 bp, Homo sapien
cggcagggttagtgcaaaggctaca

SEQ ID NO: 152546 - DNA, 25 bp, Homo sapien
tacaagcctagaactgcagacagcg

SEQ ID NO: 152547 - DNA, 25 bp, Homo sapien
cctttaaatggcagcgccgctcgca

SEQ ID NO: 152548 - DNA, 25 bp, Homo sapien
ccagtggccgcctggaaattgcgga

SEQ ID NO: 152549 - DNA, 25 bp, Homo sapien
attgcggagtggaatgcagccacta

SEQ ID NO: 152550 - DNA, 25 bp, Homo sapien
tgcagccactagagacggcgcctga

SEQ ID NO: 152551 - DNA, 25 bp, Homo sapien
agatcccgcttgcaggttcggttcg

SEQ ID NO: 152552 - DNA, 25 bp, Homo sapien
ccgcctcgggagctaaaccttgatt

SEQ ID NO: 152553 - DNA, 25 bp, Homo sapien
cgttcacacgaactcaagcctttgg

SEQ ID NO: 152554 - DNA, 25 bp, Homo sapien
accttgattggcagtttagctaacc

SEQ ID NO: 152555 - DNA, 25 bp, Homo sapien
ctcaactcgcttcgcttcgggcttt

SEQ ID NO: 152556 - DNA, 25 bp, Homo sapien
tctccgaatcttacccgtgtcagta

SEQ ID NO: 152557 - DNA, 25 bp, Homo sapien
cgtgtcagtaagttgccggcctctg

SEQ ID NO: 152558 - DNA, 25 bp, Homo sapien
ccaggccgcttgcacatgcgcatta

SEQ ID NO: 152559 - DNA, 25 bp, Homo sapien
cgtcgccgttactccgaggagatac

SEQ ID NO: 152560 - DNA, 25 bp, Homo sapien
cccgtaacctgcttggagattcttg

SEQ ID NO: 152561 - DNA, 25 bp, Homo sapien
tttcgtgaaatagtgtcctgcgccc

SEQ ID NO: 152562 - DNA, 25 bp, Homo sapien
agcgggcgggactgaatattttctt

SEQ ID NO: 152563 - DNA, 25 bp, Homo sapien
cgctgccctgagatggctctataga

SEQ ID NO: 152564 - DNA, 25 bp, Homo sapien
gacacatgctggtttcgcctactga

SEQ ID NO: 152565 - DNA, 25 bp, Homo sapien
tgccgaccagacagtaggacacatg

SEQ ID NO: 152566 - DNA, 25 bp, Homo sapien
gcgggtttccttttcggcaacatca

SEQ ID NO: 152567 - DNA, 25 bp, Homo sapien
ccctctgttttgagcttccggtaga

SEQ ID NO: 152568 - DNA, 25 bp, Homo sapien
ccagccgcgcctgtagatgacgtca

SEQ ID NO: 152569 - DNA, 25 bp, Homo sapien
cgcgcctgtagatgacgtcaccatc

SEQ ID NO: 152570 - DNA, 25 bp, Homo sapien
gccgcgcctgtagatgacgtcacca

SEQ ID NO: 152571 - DNA, 25 bp, Homo sapien
tatatgacgtcaccgccgtaagacc

SEQ ID NO: 152572 - DNA, 25 bp, Homo sapien
tcctgtatatgacgtcaccgccgta

SEQ ID NO: 152573 - DNA, 25 bp, Homo sapien
gccgctcctgtatatgacgtcaccg

SEQ ID NO: 152574 - DNA, 25 bp, Homo sapien
gcctgtagatgacgtcaccatcgta

SEQ ID NO: 152575 - DNA, 25 bp, Homo sapien
ccagccgctcctgtatatgacgtca

SEQ ID NO: 152576 - DNA, 25 bp, Homo sapien
ggtctcctccaggaaagtctccgtg

SEQ ID NO: 152577 - DNA, 25 bp, Homo sapien
cggcggaccttctcatagcacttgt

SEQ ID NO: 152578 - DNA, 25 bp, Homo sapien
tctggatcttctgatcgcccggctc

SEQ ID NO: 152579 - DNA, 25 bp, Homo sapien
caccctctggctcttgatctggatc

SEQ ID NO: 152580 - DNA, 25 bp, Homo sapien
ccgccgagaacgctttgctgttgga

SEQ ID NO: 152581 - DNA, 25 bp, Homo sapien
cttcttagaggtctgggctttcttc

SEQ ID NO: 152582 - DNA, 25 bp, Homo sapien
atggagctctgcttcttcttagagg

SEQ ID NO: 152583 - DNA, 25 bp, Homo sapien
tgtcgcagcggatcatctcccagta

SEQ ID NO: 152584 - DNA, 25 bp, Homo sapien
cagaaagtagttccggcccatgttg

SEQ ID NO: 152585 - DNA, 25 bp, Homo sapien
ctccaccgtggtgtttgtcgcaatg

SEQ ID NO: 152586 - DNA, 25 bp, Homo sapien
ccagagagtgccctaaccacgagtc

SEQ ID NO: 152587 - DNA, 25 bp, Homo sapien
tcttaagaaacttggccgcttccgc

SEQ ID NO: 152588 - DNA, 25 bp, Homo sapien
cgcgggcacttgattgtaacagaaa

SEQ ID NO: 152589 - DNA, 25 bp, Homo sapien
atggaatctcgactttgcagcttga

SEQ ID NO: 152590 - DNA, 25 bp, Homo sapien
tgcgcggaggactacatggaatctc

SEQ ID NO: 152591 - DNA, 25 bp, Homo sapien
tgaagtcattttgttggcggcgctg

SEQ ID NO: 152592 - DNA, 25 bp, Homo sapien
caggcctggcattgtgctacgtctc

SEQ ID NO: 152593 - DNA, 25 bp, Homo sapien
cggattagtcgtccactgctgcaga

SEQ ID NO: 152594 - DNA, 25 bp, Homo sapien
ccaagcctcggtattcagttcgtta

SEQ ID NO: 152595 - DNA, 25 bp, Homo sapien
ctgcaaatcctacggccggagcgtc

SEQ ID NO: 152596 - DNA, 25 bp, Homo sapien
gccagcagaggcgacaagcaattaa

SEQ ID NO: 152597 - DNA, 25 bp, Homo sapien
gggtcgagtctgaagattcctcctc

SEQ ID NO: 152598 - DNA, 25 bp, Homo sapien
tgcctctgtacgcaggaagaaaatc

SEQ ID NO: 152599 - DNA, 25 bp, Homo sapien
cgcggccgcagctgaataaactcgg

SEQ ID NO: 152600 - DNA, 25 bp, Homo sapien
gcgggcgagcacacgtgaattactg

SEQ ID NO: 152601 - DNA, 25 bp, Homo sapien
cgggtgcccacgctctagtattgaa

SEQ ID NO: 152602 - DNA, 25 bp, Homo sapien
gttcacaggcgcgaagttcaaattt

SEQ ID NO: 152603 - DNA, 25 bp, Homo sapien
tccgggcactataaaggggcctgcg

SEQ ID NO: 152604 - DNA, 25 bp, Homo sapien
tcatcgcagttgctccggatctttg

SEQ ID NO: 152605 - DNA, 25 bp, Homo sapien
cctgatcccggaagcgttacagcta

SEQ ID NO: 152606 - DNA, 25 bp, Homo sapien
tttgcacacactccacgggcagttg

SEQ ID NO: 152607 - DNA, 25 bp, Homo sapien
ttgggacaaataagcaacatccgtg

SEQ ID NO: 152608 - DNA, 25 bp, Homo sapien
gctcccgacgacaacagtgatgatt

SEQ ID NO: 152609 - DNA, 25 bp, Homo sapien
acaacagtgatgattcggaagctcc

SEQ ID NO: 152610 - DNA, 25 bp, Homo sapien
cttccgacgacagcagtgatgattc

SEQ ID NO: 152611 - DNA, 25 bp, Homo sapien
ttcccgacgacagcagtgatgattc

SEQ ID NO: 152612 - DNA, 25 bp, Homo sapien
tcccgacgacaacagtgatgattca

SEQ ID NO: 152613 - DNA, 25 bp, Homo sapien
ttcccgacgacaacagtgatgattc

SEQ ID NO: 152614 - DNA, 25 bp, Homo sapien
tcccgacgacagcagtgatgattcg

SEQ ID NO: 152615 - DNA, 25 bp, Homo sapien
ctcccgacgacaacagtgatgattc

SEQ ID NO: 152616 - DNA, 25 bp, Homo sapien
agtgtccgtttgcagggctggttta

SEQ ID NO: 152617 - DNA, 25 bp, Homo sapien
agcgcagtggcaagggtaagggcaa

SEQ ID NO: 152618 - DNA, 25 bp, Homo sapien
agggctggtttaggcccagagggtg

SEQ ID NO: 152619 - DNA, 25 bp, Homo sapien
cacggccgagacctcaattttgggg

SEQ ID NO: 152620 - DNA, 25 bp, Homo sapien
gctccacggatgaagtgtccgtttg

SEQ ID NO: 152621 - DNA, 25 bp, Homo sapien
ccatgagctccacggatgaagtgtc

SEQ ID NO: 152622 - DNA, 25 bp, Homo sapien
ggcgccatgagctccacggatgaag

SEQ ID NO: 152623 - DNA, 25 bp, Homo sapien
ggccacggccgagacctcaattttg

SEQ ID NO: 152624 - DNA, 25 bp, Homo sapien
gagctctgatgttggggtcgctact

SEQ ID NO: 152625 - DNA, 25 bp, Homo sapien
ttcccggaagttggggagctctgat

SEQ ID NO: 152626 - DNA, 25 bp, Homo sapien
agggctctgaagttcccggaagttg

SEQ ID NO: 152627 - DNA, 25 bp, Homo sapien
tgctgaattctccacgacgcacaga

SEQ ID NO: 152628 - DNA, 25 bp, Homo sapien
cgacgcacagacaggcgaggcagtc

SEQ ID NO: 152629 - DNA, 25 bp, Homo sapien
tgggaagctaaaacagaaacttctg

SEQ ID NO: 152630 - DNA, 25 bp, Homo sapien
tggggtcgctactgctgaattctcc

SEQ ID NO: 152631 - DNA, 25 bp, Homo sapien
ctgtgggtgggaagctaaaacagaa

SEQ ID NO: 152632 - DNA, 25 bp, Homo sapien
gcgtcaagtgcacgcgcagaagcca

SEQ ID NO: 152633 - DNA, 25 bp, Homo sapien
tcaaatgacgggtgtcggggcaaac

SEQ ID NO: 152634 - DNA, 25 bp, Homo sapien
tggccgcaagaccagaccagagcac

SEQ ID NO: 152635 - DNA, 25 bp, Homo sapien
cgtgatgcacgcaaagcacccggtg

SEQ ID NO: 152636 - DNA, 25 bp, Homo sapien
ggggcaccgtagctctcgatcacct

SEQ ID NO: 152637 - DNA, 25 bp, Homo sapien
ggcgaggtgcctgagctttaaccaa

SEQ ID NO: 152638 - DNA, 25 bp, Homo sapien
tgccaaccagcacgccctttgtggg

SEQ ID NO: 152639 - DNA, 25 bp, Homo sapien
catctggtacttccacccggggtga

SEQ ID NO: 152640 - DNA, 25 bp, Homo sapien
tcgctgtcccggacatctggtactt

SEQ ID NO: 152641 - DNA, 25 bp, Homo sapien
cccacaaagggcgtgctggttggca

SEQ ID NO: 152642 - DNA, 25 bp, Homo sapien
gtcccgattggttaaagctcaggca

SEQ ID NO: 152643 - DNA, 25 bp, Homo sapien
cgggcatggaggcaaaccaagagcc

SEQ ID NO: 152644 - DNA, 25 bp, Homo sapien
cgggtgctttgcgtgcatcacgaca

SEQ ID NO: 152645 - DNA, 25 bp, Homo sapien
gcttctgcgcgtgcacttgacgcca

SEQ ID NO: 152646 - DNA, 25 bp, Homo sapien
ctggctgggaacctactttccaatg

SEQ ID NO: 152647 - DNA, 25 bp, Homo sapien
tttccaatgagacctcctctgtgca

SEQ ID NO: 152648 - DNA, 25 bp, Homo sapien
gtgcccagacgccatgcaccctccg

SEQ ID NO: 152649 - DNA, 25 bp, Homo sapien
aggcctcgtgcccagacgccatgca

SEQ ID NO: 152650 - DNA, 25 bp, Homo sapien
caacttccgggaacttcagagccct

SEQ ID NO: 152651 - DNA, 25 bp, Homo sapien
gaattcagcagtagcgaccccaaca

SEQ ID NO: 152652 - DNA, 25 bp, Homo sapien
tctgtgcgtcgtggagaattcagca

SEQ ID NO: 152653 - DNA, 25 bp, Homo sapien
gcctcgcctgtctgtgcgtcgtgga

SEQ ID NO: 152654 - DNA, 25 bp, Homo sapien
tctgttttagcttcccacccacagg

SEQ ID NO: 152655 - DNA, 25 bp, Homo sapien
ctcagaagtttctgttttagcttcc

SEQ ID NO: 152656 - DNA, 25 bp, Homo sapien
ttcctggagacgacgtgggcagctc

SEQ ID NO: 152657 - DNA, 25 bp, Homo sapien
agaggacgtgggcagctcgtgaacc

SEQ ID NO: 152658 - DNA, 25 bp, Homo sapien
gtcccttcctggagacgacgtgggc

SEQ ID NO: 152659 - DNA, 25 bp, Homo sapien
ggacgtgggcagctcgtgaacccgg

SEQ ID NO: 152660 - DNA, 25 bp, Homo sapien
tcccttcctggagacgacgtgggca

SEQ ID NO: 152661 - DNA, 25 bp, Homo sapien
aggacgtgggcagctcgtgaacccg

SEQ ID NO: 152662 - DNA, 25 bp, Homo sapien
gcagctcgtggacccgggtcccttc

SEQ ID NO: 152663 - DNA, 25 bp, Homo sapien
gaggacgtgggcagctcgtgaaccc

SEQ ID NO: 152664 - DNA, 25 bp, Homo sapien
gtggccgctcaacctgctcttcgag

SEQ ID NO: 152665 - DNA, 25 bp, Homo sapien
ggcgctttctgaggacttgtgtccc

SEQ ID NO: 152666 - DNA, 25 bp, Homo sapien
gaatgcccaccctcatcagcggtaa

SEQ ID NO: 152667 - DNA, 25 bp, Homo sapien
cggcacgatgacagctggcttgtca

SEQ ID NO: 152668 - DNA, 25 bp, Homo sapien
gcttgtcagccaggtaggacgagta

SEQ ID NO: 152669 - DNA, 25 bp, Homo sapien
tcgagatcgtggttattcccgtggc

SEQ ID NO: 152670 - DNA, 25 bp, Homo sapien
tcatctggggaatcagagtcgtgcc

SEQ ID NO: 152671 - DNA, 25 bp, Homo sapien
tcctgaagtggccatgccagcgcca

SEQ ID NO: 152672 - DNA, 25 bp, Homo sapien
agctaaatggccgagccgctggctt

SEQ ID NO: 152673 - DNA, 25 bp, Homo sapien
tgccgttctacaggcgcacggtggt

SEQ ID NO: 152674 - DNA, 25 bp, Homo sapien
gccactcgttggctctgctcgagga

SEQ ID NO: 152675 - DNA, 25 bp, Homo sapien
aacttcctgctcttggacccggtcg

SEQ ID NO: 152676 - DNA, 25 bp, Homo sapien
ctcctgtctaggagctcggccactt

SEQ ID NO: 152677 - DNA, 25 bp, Homo sapien
ggccacttcagaaagcgcgccgcag

SEQ ID NO: 152678 - DNA, 25 bp, Homo sapien
aacctgtgcaacttcccgctggagc

SEQ ID NO: 152679 - DNA, 25 bp, Homo sapien
ggcggtggtgcctacaggctttaaa

SEQ ID NO: 152680 - DNA, 25 bp, Homo sapien
gaagcaagcgttgccgcgccgctac

SEQ ID NO: 152681 - DNA, 25 bp, Homo sapien
gaacacgaggctgcttggaagcagc

SEQ ID NO: 152682 - DNA, 25 bp, Homo sapien
cggaacacgaggctgcttggaagca

SEQ ID NO: 152683 - DNA, 25 bp, Homo sapien
ggcgcgatgagtcaccatccctcag

SEQ ID NO: 152684 - DNA, 25 bp, Homo sapien
gcagccggcgcgatgagtcaccatc

SEQ ID NO: 152685 - DNA, 25 bp, Homo sapien
agctcggccagtcaccaggcgcgtg

SEQ ID NO: 152686 - DNA, 25 bp, Homo sapien
gagcagctcggccagtcaccaggcg

SEQ ID NO: 152687 - DNA, 25 bp, Homo sapien
gctgcttttcgtgcgcggagcagct

SEQ ID NO: 152688 - DNA, 25 bp, Homo sapien
acaggcaatgctcgcgttccttgga

SEQ ID NO: 152689 - DNA, 25 bp, Homo sapien
accgaggccctgagcatggataagc

SEQ ID NO: 152690 - DNA, 25 bp, Homo sapien
gctgtctctccagaagctgcgcttg

SEQ ID NO: 152691 - DNA, 25 bp, Homo sapien
caggtctgcggcacaaattaggcca

SEQ ID NO: 152692 - DNA, 25 bp, Homo sapien
gtgctgatttcacccgacaggcaat

SEQ ID NO: 152693 - DNA, 25 bp, Homo sapien
aagggtcaggtcctcacctcaggcc

SEQ ID NO: 152694 - DNA, 25 bp, Homo sapien
ctgctcctagagaaggcaaagtttc

SEQ ID NO: 152695 - DNA, 25 bp, Homo sapien
ctcagggaatcctcccgttccttgg

SEQ ID NO: 152696 - DNA, 25 bp, Homo sapien
tgaacgtgttcctctcctcgggcag

SEQ ID NO: 152697 - DNA, 25 bp, Homo sapien
gcgatcctggatcacgttaatcaaa

SEQ ID NO: 152698 - DNA, 25 bp, Homo sapien
cccgggaatgacttcgatctcactg

SEQ ID NO: 152699 - DNA, 25 bp, Homo sapien
gcatttaattcttcgcgcagggcca

SEQ ID NO: 152700 - DNA, 25 bp, Homo sapien
ccatgcggaggctgttgagatttcc

SEQ ID NO: 152701 - DNA, 25 bp, Homo sapien
tcagacatctcgacaagcccagggg

SEQ ID NO: 152702 - DNA, 25 bp, Homo sapien
atggcgacagccagtgaacgtgttc

SEQ ID NO: 152703 - DNA, 25 bp, Homo sapien
cggcaggatctgtcgaggaaaaatc

SEQ ID NO: 152704 - DNA, 25 bp, Homo sapien
ggatgcctccatgaccctcggattg

SEQ ID NO: 152705 - DNA, 25 bp, Homo sapien
ctgcccgatatgatcccagtcattg

SEQ ID NO: 152706 - DNA, 25 bp, Homo sapien
tcagtctgtgatccctcgcgtttca

SEQ ID NO: 152707 - DNA, 25 bp, Homo sapien
ggctcaaggcctcggcttccggaaa

SEQ ID NO: 152708 - DNA, 25 bp, Homo sapien
accttaggtaatgagcagcctgctc

SEQ ID NO: 152709 - DNA, 25 bp, Homo sapien
cagcggtccagacataccttaggta

SEQ ID NO: 152710 - DNA, 25 bp, Homo sapien
aaaggctccgcctcaacagttcggg

SEQ ID NO: 152711 - DNA, 25 bp, Homo sapien
atgctgcagccaattcgttcgcgcg

SEQ ID NO: 152712 - DNA, 25 bp, Homo sapien
gcgcgccggattttcagctgctccg

SEQ ID NO: 152713 - DNA, 25 bp, Homo sapien
gtcagaaaccgaggccttcccaaca

SEQ ID NO: 152714 - DNA, 25 bp, Homo sapien
cggatacgtcctaagagctcgctaa

SEQ ID NO: 152715 - DNA, 25 bp, Homo sapien
tcgctaactaaacggcttaccatgg

SEQ ID NO: 152716 - DNA, 25 bp, Homo sapien
tccgtcttccggtgcgcgtagaaat

SEQ ID NO: 152717 - DNA, 25 bp, Homo sapien
gtcagaagtcccgagttgaggaacc

SEQ ID NO: 152718 - DNA, 25 bp, Homo sapien
accatggctgcgttaggcaaggaaa

SEQ ID NO: 152719 - DNA, 25 bp, Homo sapien
accaacctcgggctcgcagtctgag

SEQ ID NO: 152720 - DNA, 25 bp, Homo sapien
attccgctgaactcggcccgaaaag

SEQ ID NO: 152721 - DNA, 25 bp, Homo sapien
cccgaagtaaatctgagctttgtgc

SEQ ID NO: 152722 - DNA, 25 bp, Homo sapien
agccgcctgcggtcagtgctaaaac

SEQ ID NO: 152723 - DNA, 25 bp, Homo sapien
cacagcgctagaaagtggcggagcc

SEQ ID NO: 152724 - DNA, 25 bp, Homo sapien
tctgactccaagtccggtgctctgc

SEQ ID NO: 152725 - DNA, 25 bp, Homo sapien
tcgccagcccgcgtttatagggaga

SEQ ID NO: 152726 - DNA, 25 bp, Homo sapien
aggcaagttgcccaaattcgctaac

SEQ ID NO: 152727 - DNA, 25 bp, Homo sapien
ttagcaaagtcggtggaagccaagc

SEQ ID NO: 152728 - DNA, 25 bp, Homo sapien
ccatcataaaattctaaacctagtg

SEQ ID NO: 152729 - DNA, 25 bp, Homo sapien
tcactagaagaatgaagaaatgtta

SEQ ID NO: 152730 - DNA, 25 bp, Homo sapien
gctgaaatagttcatcactagaaga

SEQ ID NO: 152731 - DNA, 25 bp, Homo sapien
ggcatacaaaagctgaaatagttca

SEQ ID NO: 152732 - DNA, 25 bp, Homo sapien
tgaaataaagatttcttcaggcata

SEQ ID NO: 152733 - DNA, 25 bp, Homo sapien
atctgccatcataaaattctaaacc

SEQ ID NO: 152734 - DNA, 25 bp, Homo sapien
aaaaacatctgccatcataaaattc

SEQ ID NO: 152735 - DNA, 25 bp, Homo sapien
taaagatttcttcaggcatacaaaa

SEQ ID NO: 152736 - DNA, 25 bp, Homo sapien
cccggggccgagaatgtgtcaccgt

SEQ ID NO: 152737 - DNA, 25 bp, Homo sapien
ccgagaatgtgtcaccgtaggcaat

SEQ ID NO: 152738 - DNA, 25 bp, Homo sapien
tgtgtcaccgtaggcaatgtgcttt

SEQ ID NO: 152739 - DNA, 25 bp, Homo sapien
tcaccgtaggcaatgtgctttccga

SEQ ID NO: 152740 - DNA, 25 bp, Homo sapien
taggcaatgtgctttccgaggttta

SEQ ID NO: 152741 - DNA, 25 bp, Homo sapien
atgtgctttccgaggtttattttcg

SEQ ID NO: 152742 - DNA, 25 bp, Homo sapien
gcgcgactggttctggcagctgcgc

SEQ ID NO: 152743 - DNA, 25 bp, Homo sapien
gcaatgtgctttccgaggtttattt

SEQ ID NO: 152744 - DNA, 25 bp, Homo sapien
ctctgagaaatagcccgggtgccac

SEQ ID NO: 152745 - DNA, 25 bp, Homo sapien
gttactaattgtcctctgagaaata

SEQ ID NO: 152746 - DNA, 25 bp, Homo sapien
gagttactccggctcctcatggcga

SEQ ID NO: 152747 - DNA, 25 bp, Homo sapien
tcggtccctaaggaacaagtatcca

SEQ ID NO: 152748 - DNA, 25 bp, Homo sapien
ggaacaagtatccaacgctgctcca

SEQ ID NO: 152749 - DNA, 25 bp, Homo sapien
aacgctgctccaccctcgtggtggg

SEQ ID NO: 152750 - DNA, 25 bp, Homo sapien
ctcgtggtgggacgcctgaacacca

SEQ ID NO: 152751 - DNA, 25 bp, Homo sapien
agcgctagcactggcttcccgcggt

SEQ ID NO: 152752 - DNA, 25 bp, Homo sapien
cgagccagttatcaccagccagtta

SEQ ID NO: 152753 - DNA, 25 bp, Homo sapien
ggccggtcatcacgggcggtcatca

SEQ ID NO: 152754 - DNA, 25 bp, Homo sapien
cggtcatcacgggtggtcatcacga

SEQ ID NO: 152755 - DNA, 25 bp, Homo sapien
gggtggtcatcacgagccagttatc

SEQ ID NO: 152756 - DNA, 25 bp, Homo sapien
catcacgggtggtcatcacgagcca

SEQ ID NO: 152757 - DNA, 25 bp, Homo sapien
gtcatcacgagccagttatcaccag

SEQ ID NO: 152758 - DNA, 25 bp, Homo sapien
cagttatcaccagccagttatcacg

SEQ ID NO: 152759 - DNA, 25 bp, Homo sapien
gccagttatcaccagccagttatca

SEQ ID NO: 152760 - DNA, 25 bp, Homo sapien
cgtcgggagattcaagtcgcataaa

SEQ ID NO: 152761 - DNA, 25 bp, Homo sapien
gccctggagaccctgaactttgatg

SEQ ID NO: 152762 - DNA, 25 bp, Homo sapien
gggtgggcaacgtcttcatcaagaa

SEQ ID NO: 152763 - DNA, 25 bp, Homo sapien
aaggcgctgtacaacatcttctcgg

SEQ ID NO: 152764 - DNA, 25 bp, Homo sapien
atcttctcggcgttcggcaacatcc

SEQ ID NO: 152765 - DNA, 25 bp, Homo sapien
tacgggttcgtgcacttccaaaagc

SEQ ID NO: 152766 - DNA, 25 bp, Homo sapien
cactagtgctgacgtcaaggatttc

SEQ ID NO: 152767 - DNA, 25 bp, Homo sapien
atcctctcctgcaaagtggcctgtg

SEQ ID NO: 152768 - DNA, 25 bp, Homo sapien
cctcgtcggtgtcttcctcgaaatc

SEQ ID NO: 152769 - DNA, 25 bp, Homo sapien
ccaccggttgctggtagttgacata

SEQ ID NO: 152770 - DNA, 25 bp, Homo sapien
cagcgccttgttgtcgatggtcttg

SEQ ID NO: 152771 - DNA, 25 bp, Homo sapien
ccgaacgccgagaagatgttgtaca

SEQ ID NO: 152772 - DNA, 25 bp, Homo sapien
tcgtcacaggccactttgcaggaga

SEQ ID NO: 152773 - DNA, 25 bp, Homo sapien
gcttttggaagtgcacgaacccgta

SEQ ID NO: 152774 - DNA, 25 bp, Homo sapien
tgcgacttgaatctcccgacgaaaa

SEQ ID NO: 152775 - DNA, 25 bp, Homo sapien
atgcgcactggcctgccctttatga

SEQ ID NO: 152776 - DNA, 25 bp, Homo sapien
gctcgaccgactacagcaacttggg

SEQ ID NO: 152777 - DNA, 25 bp, Homo sapien
gagtccgatgccagcctccaatttc

SEQ ID NO: 152778 - DNA, 25 bp, Homo sapien
ggcaccggctttctcgcactatatg

SEQ ID NO: 152779 - DNA, 25 bp, Homo sapien
ggggtatcctcatatgcccagcatg

SEQ ID NO: 152780 - DNA, 25 bp, Homo sapien
agcatggatcctcactggccgtctc

SEQ ID NO: 152781 - DNA, 25 bp, Homo sapien
ccgcgagaagactggagcgtgtatc

SEQ ID NO: 152782 - DNA, 25 bp, Homo sapien
tgccggtgaacgacgtgacctctag

SEQ ID NO: 152783 - DNA, 25 bp, Homo sapien
tatcctgggccgtctagtacaatgg

SEQ ID NO: 152784 - DNA, 25 bp, Homo sapien
cccaacatggcggagttcgacacca

SEQ ID NO: 152785 - DNA, 25 bp, Homo sapien
catggcggagttcgacaccatctcg

SEQ ID NO: 152786 - DNA, 25 bp, Homo sapien
aactcttctccgggagcgtggcggc

SEQ ID NO: 152787 - DNA, 25 bp, Homo sapien
tgagcatcctgctgcccaacatggc

SEQ ID NO: 152788 - DNA, 25 bp, Homo sapien
cgaggtcacgtgatgagcatcctgc

SEQ ID NO: 152789 - DNA, 25 bp, Homo sapien
atcgcgaggtcacgtgatgagcatc

SEQ ID NO: 152790 - DNA, 25 bp, Homo sapien
gcaggcgcgtctcctcaaatcctgt

SEQ ID NO: 152791 - DNA, 25 bp, Homo sapien
cgtctgcccaacacgcaggcgcgtc

SEQ ID NO: 152792 - DNA, 25 bp, Homo sapien
cctgagctgcgtgtctgagcttttc

SEQ ID NO: 152793 - DNA, 25 bp, Homo sapien
cgcgcgtctctttctactgcaaaca

SEQ ID NO: 152794 - DNA, 25 bp, Homo sapien
agccaataggggtcttcgagtcacc

SEQ ID NO: 152795 - DNA, 25 bp, Homo sapien
agcaccctgggcattggggtcaatg

SEQ ID NO: 152796 - DNA, 25 bp, Homo sapien
tccggagattcgcttttcctttgcg

SEQ ID NO: 152797 - DNA, 25 bp, Homo sapien
agcgctgtcccggatccggagattc

SEQ ID NO: 152798 - DNA, 25 bp, Homo sapien
ccaggggcgaaataagaagcaaatc

SEQ ID NO: 152799 - DNA, 25 bp, Homo sapien
gcaaatcttgctgggaccgagttca

SEQ ID NO: 152800 - DNA, 25 bp, Homo sapien
gcggcgtttgcacggagtgcaatca

SEQ ID NO: 152801 - DNA, 25 bp, Homo sapien
cggaggcatttaggtagtgcacgac

SEQ ID NO: 152802 - DNA, 25 bp, Homo sapien
catttaggtagtgcacgacggctgg

SEQ ID NO: 152803 - DNA, 25 bp, Homo sapien
tgcacggagtgcaatcactgcgtcc

SEQ ID NO: 152804 - DNA, 25 bp, Homo sapien
gggcctgtttggctgtgacgcccac

SEQ ID NO: 152805 - DNA, 25 bp, Homo sapien
gctttcatccgcctatgccctaggg

SEQ ID NO: 152806 - DNA, 25 bp, Homo sapien
gaagacttaagatggcggcgtttgc

SEQ ID NO: 152807 - DNA, 25 bp, Homo sapien
gccctagggctagtggaagacttaa

SEQ ID NO: 152808 - DNA, 25 bp, Homo sapien
agacaaatgggaccggctcctctcc

SEQ ID NO: 152809 - DNA, 25 bp, Homo sapien
gtggttccggttatctctcagcttg

SEQ ID NO: 152810 - DNA, 25 bp, Homo sapien
aagcgggatgagagctgccaccgcc

SEQ ID NO: 152811 - DNA, 25 bp, Homo sapien
ctgcagcagcgactcggagtggttc

SEQ ID NO: 152812 - DNA, 25 bp, Homo sapien
ctctcccaacgccaagatgtggatc

SEQ ID NO: 152813 - DNA, 25 bp, Homo sapien
tggatccaggttcccatcacggctc

SEQ ID NO: 152814 - DNA, 25 bp, Homo sapien
tgcaccacagaggacgtgtctcaca

SEQ ID NO: 152815 - DNA, 25 bp, Homo sapien
atctctcagcttggcggcctggcaa

SEQ ID NO: 152816 - DNA, 25 bp, Homo sapien
cggcactccgtctgaaatacgcatg

SEQ ID NO: 152817 - DNA, 25 bp, Homo sapien
ttaactcaggtcttctcaaatactg

SEQ ID NO: 152818 - DNA, 25 bp, Homo sapien
cgacgccattcaagccttgcgcatg

SEQ ID NO: 152819 - DNA, 25 bp, Homo sapien
gcgttgttaaatatgcctgcgagtc

SEQ ID NO: 152820 - DNA, 25 bp, Homo sapien
ctggtaccaactcctagcaactttg

SEQ ID NO: 152821 - DNA, 25 bp, Homo sapien
ctcaaatatgcatgagcgccacctc

SEQ ID NO: 152822 - DNA, 25 bp, Homo sapien
aatactgtaagcttgagcgccgccc

SEQ ID NO: 152823 - DNA, 25 bp, Homo sapien
ccatccagatgttgtctcaaatatg

SEQ ID NO: 152824 - DNA, 25 bp, Homo sapien
cgtcaggaatgtccgtgacacgtga

SEQ ID NO: 152825 - DNA, 25 bp, Homo sapien
ggccgtgtgcaaaccttgtatgaca

SEQ ID NO: 152826 - DNA, 25 bp, Homo sapien
tctaagccgcccaaagcggggttgc

SEQ ID NO: 152827 - DNA, 25 bp, Homo sapien
tgggcctgctcattggaagatcgca

SEQ ID NO: 152828 - DNA, 25 bp, Homo sapien
ctagcggaaaacagctaattctttc

SEQ ID NO: 152829 - DNA, 25 bp, Homo sapien
ggaagatcgcatcgcagccatgagc

SEQ ID NO: 152830 - DNA, 25 bp, Homo sapien
agccatgagcagtaaggatttcttc

SEQ ID NO: 152831 - DNA, 25 bp, Homo sapien
tgacatcactgagacacctagcgga

SEQ ID NO: 152832 - DNA, 25 bp, Homo sapien
gggactcccatgtctgcatgcctga

SEQ ID NO: 152833 - DNA, 25 bp, Homo sapien
ggggcctcagtctgcgacatacagt

SEQ ID NO: 152834 - DNA, 25 bp, Homo sapien
ctgggaagacatccgtccgcttgca

SEQ ID NO: 152835 - DNA, 25 bp, Homo sapien
gcccaatcccaaactggcggctgga

SEQ ID NO: 152836 - DNA, 25 bp, Homo sapien
acaaagccctgattgactgcccgga

SEQ ID NO: 152837 - DNA, 25 bp, Homo sapien
agccgagtagcttggtaacgacacc

SEQ ID NO: 152838 - DNA, 25 bp, Homo sapien
cctcgggctcgagaagattgtgtcc

SEQ ID NO: 152839 - DNA, 25 bp, Homo sapien
tgcattagacgcgtagacccttagg

SEQ ID NO: 152840 - DNA, 25 bp, Homo sapien
aaatgggctgaatgcctggcttacc

SEQ ID NO: 152841 - DNA, 25 bp, Homo sapien
aagtgcctgcgcgttctttcccgcg

SEQ ID NO: 152842 - DNA, 25 bp, Homo sapien
cccggaaggcgaggcgctaactcaa

SEQ ID NO: 152843 - DNA, 25 bp, Homo sapien
ttcctacagctactgcaacgacaga

SEQ ID NO: 152844 - DNA, 25 bp, Homo sapien
ccgtgctcgacaaggaaaacatctc

SEQ ID NO: 152845 - DNA, 25 bp, Homo sapien
agcgcaatttgcaaacagccacggg

SEQ ID NO: 152846 - DNA, 25 bp, Homo sapien
agtgagcgcccacaaggccaagtgc

SEQ ID NO: 152847 - DNA, 25 bp, Homo sapien
ctaactcaacagtacttccggggca

SEQ ID NO: 152848 - DNA, 25 bp, Homo sapien
tctgctttaagagatacccgagccc

SEQ ID NO: 152849 - DNA, 25 bp, Homo sapien
ggcgctccctgtaagcaagacaagc

SEQ ID NO: 152850 - DNA, 25 bp, Homo sapien
gttcatcgggcgctccctgtaagca

SEQ ID NO: 152851 - DNA, 25 bp, Homo sapien
gtgaacatttctgctttaagagata

SEQ ID NO: 152852 - DNA, 25 bp, Homo sapien
ttctgctttaagagatacccgagcc

SEQ ID NO: 152853 - DNA, 25 bp, Homo sapien
cgggcgctccctgtaagcaagacaa

SEQ ID NO: 152854 - DNA, 25 bp, Homo sapien
atcgggcgctccctgtaagcaagac

SEQ ID NO: 152855 - DNA, 25 bp, Homo sapien
tcatcgggcgctccctgtaagcaag

SEQ ID NO: 152856 - DNA, 25 bp, Homo sapien
cccacctgcggtcagagcaggggtc

SEQ ID NO: 152857 - DNA, 25 bp, Homo sapien
agacaagcacccacctgcggtcaga

SEQ ID NO: 152858 - DNA, 25 bp, Homo sapien
gtaagcaagacaagcacccacctgc

SEQ ID NO: 152859 - DNA, 25 bp, Homo sapien
actttgaatggtccgttaatgtggt

SEQ ID NO: 152860 - DNA, 25 bp, Homo sapien
ggattcgactttgaatggtccgtta

SEQ ID NO: 152861 - DNA, 25 bp, Homo sapien
ctgcctcgaaaagcctaggattcga

SEQ ID NO: 152862 - DNA, 25 bp, Homo sapien
ccctcaggcgtcttcctgcgaccgg

SEQ ID NO: 152863 - DNA, 25 bp, Homo sapien
tgggacccactaactgcctcgaaaa

SEQ ID NO: 152864 - DNA, 25 bp, Homo sapien
cttcggcatccataactctgtcggg

SEQ ID NO: 152865 - DNA, 25 bp, Homo sapien
ctctgtcgggatcctctactccatg

SEQ ID NO: 152866 - DNA, 25 bp, Homo sapien
tcgccaagtggagttccaagcaggt

SEQ ID NO: 152867 - DNA, 25 bp, Homo sapien
cccacttggcattttgggcaaggtt

SEQ ID NO: 152868 - DNA, 25 bp, Homo sapien
acgcctacggtagagacccgcggca

SEQ ID NO: 152869 - DNA, 25 bp, Homo sapien
ttccagcctcccgaaggtggcttcg

SEQ ID NO: 152870 - DNA, 25 bp, Homo sapien
tggtgcaacggctccatcttcggca

SEQ ID NO: 152871 - DNA, 25 bp, Homo sapien
ccatgctgctagaggaggaaaagga

SEQ ID NO: 152872 - DNA, 25 bp, Homo sapien
gtgaatggatctccgtgccctatga

SEQ ID NO: 152873 - DNA, 25 bp, Homo sapien
cgcctctctgctaccggtggggtgc

SEQ ID NO: 152874 - DNA, 25 bp, Homo sapien
tctcctgccagagaggcgtgaggcc

SEQ ID NO: 152875 - DNA, 25 bp, Homo sapien
gcagtctcctgccagagaggcgtga

SEQ ID NO: 152876 - DNA, 25 bp, Homo sapien
tctgctaccggtggggtgcctcgtt

SEQ ID NO: 152877 - DNA, 25 bp, Homo sapien
gatctccgtgccctatgagccgagc

SEQ ID NO: 152878 - DNA, 25 bp, Homo sapien
cccgcgggagtgaatggatctccgt

SEQ ID NO: 152879 - DNA, 25 bp, Homo sapien
ggccgccgccgttacggcccagctg

SEQ ID NO: 152880 - DNA, 25 bp, Homo sapien
ccctgctattcagacgggaatccgc

SEQ ID NO: 152881 - DNA, 25 bp, Homo sapien
tgccagcaagccagacggatagaca

SEQ ID NO: 152882 - DNA, 25 bp, Homo sapien
ggcctgtcgaggatcttttacaatc

SEQ ID NO: 152883 - DNA, 25 bp, Homo sapien
ccctagcgtcccaagagcgggatca

SEQ ID NO: 152884 - DNA, 25 bp, Homo sapien
gccgagcccacctgccaaatgttaa

SEQ ID NO: 152885 - DNA, 25 bp, Homo sapien
aggcggctgctagcgaaagacctac

SEQ ID NO: 152886 - DNA, 25 bp, Homo sapien
cggggactacacttgggagcatctt

SEQ ID NO: 152887 - DNA, 25 bp, Homo sapien
agccgcgccacggaaatgcatcttc

SEQ ID NO: 152888 - DNA, 25 bp, Homo sapien
tcactcgggccattttgagagaacg

SEQ ID NO: 152889 - DNA, 25 bp, Homo sapien
tcgattcctcgaaaaggctccgcgg

SEQ ID NO: 152890 - DNA, 25 bp, Homo sapien
caacaggaagtgatgatgccgcgtc

SEQ ID NO: 152891 - DNA, 25 bp, Homo sapien
ccgcctccaatgagtagctggttga

SEQ ID NO: 152892 - DNA, 25 bp, Homo sapien
cttcaaagagcctgtcgactatacc

SEQ ID NO: 152893 - DNA, 25 bp, Homo sapien
ggccaccgagaggaagtactaccca

SEQ ID NO: 152894 - DNA, 25 bp, Homo sapien
ggagacgttgctcaggcagccatta

SEQ ID NO: 152895 - DNA, 25 bp, Homo sapien
ctcaactaaaatggcagcggcgact

SEQ ID NO: 152896 - DNA, 25 bp, Homo sapien
agcgtcaattcgaccgccaccgaga

SEQ ID NO: 152897 - DNA, 25 bp, Homo sapien
cgcgctagatggagtcagagctgtc

SEQ ID NO: 152898 - DNA, 25 bp, Homo sapien
agctgtatggcagcgctcctactca

SEQ ID NO: 152899 - DNA, 25 bp, Homo sapien
cctttcctagattgcagtgcctgtc

SEQ ID NO: 152900 - DNA, 25 bp, Homo sapien
tacggcgcaagcacagaggcctttc

SEQ ID NO: 152901 - DNA, 25 bp, Homo sapien
ccagtccgaaaggaggcggcactct

SEQ ID NO: 152902 - DNA, 25 bp, Homo sapien
gctcggtctggcctccaacttaaac

SEQ ID NO: 152903 - DNA, 25 bp, Homo sapien
ggccacaagccaatttccgcaaagg

SEQ ID NO: 152904 - DNA, 25 bp, Homo sapien
agctcacggcttttgtatccaagtc

SEQ ID NO: 152905 - DNA, 25 bp, Homo sapien
aattgcaccagacaggcagcgcatg

SEQ ID NO: 152906 - DNA, 25 bp, Homo sapien
tcttctcactttcggggattctcca

SEQ ID NO: 152907 - DNA, 25 bp, Homo sapien
cccgggcgcttcctggaaagatcca

SEQ ID NO: 152908 - DNA, 25 bp, Homo sapien
caccaaggtgtacggacgccaaaca

SEQ ID NO: 152909 - DNA, 25 bp, Homo sapien
gagcccggagaccagtaattgcacc

SEQ ID NO: 152910 - DNA, 25 bp, Homo sapien
cgaggtcgccgcgtataaatagtga

SEQ ID NO: 152911 - DNA, 25 bp, Homo sapien
cggcggaggtaagaaggattccatt

SEQ ID NO: 152912 - DNA, 25 bp, Homo sapien
tcgaagatcgaccaagcaggcctgc

SEQ ID NO: 152913 - DNA, 25 bp, Homo sapien
cacaacaggcttgagtcacggcgtt

SEQ ID NO: 152914 - DNA, 25 bp, Homo sapien
tcacggcgttgaggaactagccatg

SEQ ID NO: 152915 - DNA, 25 bp, Homo sapien
agcctcgccgcatctttggctcgaa

SEQ ID NO: 152916 - DNA, 25 bp, Homo sapien
gccctgcctggcacaacaggcttga

SEQ ID NO: 152917 - DNA, 25 bp, Homo sapien
gtgcggcactccactgtctagcctg

SEQ ID NO: 152918 - DNA, 25 bp, Homo sapien
acgagcactggcacccaggacagta

SEQ ID NO: 152919 - DNA, 25 bp, Homo sapien
atccgtcaggcagtcggagctagca

SEQ ID NO: 152920 - DNA, 25 bp, Homo sapien
cctgtgaggctcgttgtagacaaca

SEQ ID NO: 152921 - DNA, 25 bp, Homo sapien
gtccgctagccaggcgagtgtggca

SEQ ID NO: 152922 - DNA, 25 bp, Homo sapien
ggctcgttgtagacaacatggcggc

SEQ ID NO: 152923 - DNA, 25 bp, Homo sapien
tgaggctcgttgtagacaacatggc

SEQ ID NO: 152924 - DNA, 25 bp, Homo sapien
caccgtagccgccaagaggagctgg

SEQ ID NO: 152925 - DNA, 25 bp, Homo sapien
acgacggtagcctgtgaggctcgtt

SEQ ID NO: 152926 - DNA, 25 bp, Homo sapien
acggtagcctgtgaggctcgttgta

SEQ ID NO: 152927 - DNA, 25 bp, Homo sapien
agcctgtgaggctcgttgtagacaa

SEQ ID NO: 152928 - DNA, 25 bp, Homo sapien
tctccgtcgcggtgaaattatgccc

SEQ ID NO: 152929 - DNA, 25 bp, Homo sapien
attgggccgcaaagagaacgtcctc

SEQ ID NO: 152930 - DNA, 25 bp, Homo sapien
ccgtttatcttgttcaggtccctca

SEQ ID NO: 152931 - DNA, 25 bp, Homo sapien
tctgctcgaacttctggcgcttttc

SEQ ID NO: 152932 - DNA, 25 bp, Homo sapien
gaacgtccttctgctactgctatgg

SEQ ID NO: 152933 - DNA, 25 bp, Homo sapien
gagcgtgtccatcttcgcattactc

SEQ ID NO: 152934 - DNA, 25 bp, Homo sapien
ttgcaaatcgacttccggggcaccc

SEQ ID NO: 152935 - DNA, 25 bp, Homo sapien
cccgtttggtggcagtatgtattca

SEQ ID NO: 152936 - DNA, 25 bp, Homo sapien
agggaattcggctgtctcctttcta

SEQ ID NO: 152937 - DNA, 25 bp, Homo sapien
ccgccgcccgagtttattttgtgca

SEQ ID NO: 152938 - DNA, 25 bp, Homo sapien
ccatagcagtagcagaaggacgttc

SEQ ID NO: 152939 - DNA, 25 bp, Homo sapien
cggaccgtttccgagagtcatctcc

SEQ ID NO: 152940 - DNA, 25 bp, Homo sapien
tgcggcccaatttctgctctttaga

SEQ ID NO: 152941 - DNA, 25 bp, Homo sapien
ggaggacgttctctttgcggcccaa

SEQ ID NO: 152942 - DNA, 25 bp, Homo sapien
gggcataatttcaccgcgacggaga

SEQ ID NO: 152943 - DNA, 25 bp, Homo sapien
agctgcacgcatctgtgaatacata

SEQ ID NO: 152944 - DNA, 25 bp, Homo sapien
gtttgcgctcaaggatgccgccgca

SEQ ID NO: 152945 - DNA, 25 bp, Homo sapien
cgcccgtatcttggtgcgctccaaa

SEQ ID NO: 152946 - DNA, 25 bp, Homo sapien
cacttgctgaaaaaataaggttccg

SEQ ID NO: 152947 - DNA, 25 bp, Homo sapien
cctcgggaaaggcatagcaccgtcc

SEQ ID NO: 152948 - DNA, 25 bp, Homo sapien
agagcaacctcgtgccttagccgca

SEQ ID NO: 152949 - DNA, 25 bp, Homo sapien
gcgctccaaagctcacacttgctga

SEQ ID NO: 152950 - DNA, 25 bp, Homo sapien
cttagccgcagcagcgtttgcgctc

SEQ ID NO: 152951 - DNA, 25 bp, Homo sapien
ccgcagcgagccttttccgtaacaa

SEQ ID NO: 152952 - DNA, 25 bp, Homo sapien
cccacccgcggtaagggatcaagca

SEQ ID NO: 152953 - DNA, 25 bp, Homo sapien
tgacggacaaagcatctccttggtg

SEQ ID NO: 152954 - DNA, 25 bp, Homo sapien
acccacccgtgatgagggaccgagc

SEQ ID NO: 152955 - DNA, 25 bp, Homo sapien
gggaccaagcacttccgtactgcca

SEQ ID NO: 152956 - DNA, 25 bp, Homo sapien
gcctctgatggatcggacacctccg

SEQ ID NO: 152957 - DNA, 25 bp, Homo sapien
gagggcgcaagcaccttagtgcagc

SEQ ID NO: 152958 - DNA, 25 bp, Homo sapien
gcccacagcctatgagggaccaagc

SEQ ID NO: 152959 - DNA, 25 bp, Homo sapien
caccgccactgaggagttgagcacc

SEQ ID NO: 152960 - DNA, 25 bp, Homo sapien
acgccttgtcggcttctgtgattgc

SEQ ID NO: 152961 - DNA, 25 bp, Homo sapien
ggttgcgttttacctcatgggctca

SEQ ID NO: 152962 - DNA, 25 bp, Homo sapien
cgcctctaagtcgtcctgggatctc

SEQ ID NO: 152963 - DNA, 25 bp, Homo sapien
cgccattttgttgggccgaggctca

SEQ ID NO: 152964 - DNA, 25 bp, Homo sapien
cgcccggttacgatagaaatgcact

SEQ ID NO: 152965 - DNA, 25 bp, Homo sapien
gagcccgaccaagcgtcaccgttta

SEQ ID NO: 152966 - DNA, 25 bp, Homo sapien
cccacgcagtttctaggcccaaaga

SEQ ID NO: 152967 - DNA, 25 bp, Homo sapien
caccgtttaggggagattgcaagaa

SEQ ID NO: 152968 - DNA, 25 bp, Homo sapien
accgcgaccctctggcaagacttgg

SEQ ID NO: 152969 - DNA, 25 bp, Homo sapien
cctgacggccctgactagactgaaa

SEQ ID NO: 152970 - DNA, 25 bp, Homo sapien
atccgcggcttatccttcgcactta

SEQ ID NO: 152971 - DNA, 25 bp, Homo sapien
ttcgcacttaccaaggcatctctcg

SEQ ID NO: 152972 - DNA, 25 bp, Homo sapien
ggcatctctcggagcgttcttggga

SEQ ID NO: 152973 - DNA, 25 bp, Homo sapien
tcttgcccgactccatgttatccag

SEQ ID NO: 152974 - DNA, 25 bp, Homo sapien
gccactcgtcatccgcggagacaga

SEQ ID NO: 152975 - DNA, 25 bp, Homo sapien
actgaaacgagcgtgcgagccgacc

SEQ ID NO: 152976 - DNA, 25 bp, Homo sapien
tcccacgacttttcgcgggaggcga

SEQ ID NO: 152977 - DNA, 25 bp, Homo sapien
tagtcctgaatagccggcacgcgca

SEQ ID NO: 152978 - DNA, 25 bp, Homo sapien
gcggcgattagaacgggttccagtc

SEQ ID NO: 152979 - DNA, 25 bp, Homo sapien
ggctggtgcaactccaaaatggctg

SEQ ID NO: 152980 - DNA, 25 bp, Homo sapien
ctgtttctgctcctggaccgagggg

SEQ ID NO: 152981 - DNA, 25 bp, Homo sapien
taggtttgcaatcccatttcctgtt

SEQ ID NO: 152982 - DNA, 25 bp, Homo sapien
ggcacgcgcagctactaggtttgca

SEQ ID NO: 152983 - DNA, 25 bp, Homo sapien
tcctgcgctagtcctgaatagccgg

SEQ ID NO: 152984 - DNA, 25 bp, Homo sapien
gggtccatgcccaaccgcatcagga

SEQ ID NO: 152985 - DNA, 25 bp, Homo sapien
cagtcctcctgagtcgggtccatgc

SEQ ID NO: 152986 - DNA, 25 bp, Homo sapien
tgtgtggacacgatctgacagatcc

SEQ ID NO: 152987 - DNA, 25 bp, Homo sapien
tgtttcttgtagacggaaccgtcga

SEQ ID NO: 152988 - DNA, 25 bp, Homo sapien
aagcagacatagcagtcgggcacca

SEQ ID NO: 152989 - DNA, 25 bp, Homo sapien
cggtcttatgtagacgcttggcaaa

SEQ ID NO: 152990 - DNA, 25 bp, Homo sapien
accagccgccacacggtcttatgta

SEQ ID NO: 152991 - DNA, 25 bp, Homo sapien
cacctttgttctccttgatgcgctg

SEQ ID NO: 152992 - DNA, 25 bp, Homo sapien
cgcggattttcttagctgggtgaca

SEQ ID NO: 152993 - DNA, 25 bp, Homo sapien
ggatcactgaggctcaacttgagaa

SEQ ID NO: 152994 - DNA, 25 bp, Homo sapien
gctaacttcggccacaggatcactg

SEQ ID NO: 152995 - DNA, 25 bp, Homo sapien
tgtcccacgtcaaggcgctaacttc

SEQ ID NO: 152996 - DNA, 25 bp, Homo sapien
agacgtgattttggcgtcacaactg

SEQ ID NO: 152997 - DNA, 25 bp, Homo sapien
gctccactcgggcagtgggacctct

SEQ ID NO: 152998 - DNA, 25 bp, Homo sapien
tccggacggcgcacaaagaaggcta

SEQ ID NO: 152999 - DNA, 25 bp, Homo sapien
ttgagaagaatctcagcccggctcc

SEQ ID NO: 153000 - DNA, 25 bp, Homo sapien
gccgcggcatcccagcgccctccca

SEQ ID NO: 153001 - DNA, 25 bp, Homo sapien
cccgcctcccgcttggagagcgccg

SEQ ID NO: 153002 - DNA, 25 bp, Homo sapien
caggacttcggttccgcgagaccgg

SEQ ID NO: 153003 - DNA, 25 bp, Homo sapien
ggcaggacttcggttccgcgagacc

SEQ ID NO: 153004 - DNA, 25 bp, Homo sapien
tcccgcatcctaggaggcctgggag

SEQ ID NO: 153005 - DNA, 25 bp, Homo sapien
ctcccgcatcctaggaggcctggga

SEQ ID NO: 153006 - DNA, 25 bp, Homo sapien
agccgccttcttgtgggacttgggg

SEQ ID NO: 153007 - DNA, 25 bp, Homo sapien
tccacactgcgctccgtgtctggca

SEQ ID NO: 153008 - DNA, 25 bp, Homo sapien
ctgccgccatccttttcccgagggg

SEQ ID NO: 153009 - DNA, 25 bp, Homo sapien
cgatctgggtaggtgctgccgccat

SEQ ID NO: 153010 - DNA, 25 bp, Homo sapien
accggcttcgatctgggtaggtgct

SEQ ID NO: 153011 - DNA, 25 bp, Homo sapien
acccaccggcttcgatctgggtagg

SEQ ID NO: 153012 - DNA, 25 bp, Homo sapien
cgctgcctctattgtggtgaagccc

SEQ ID NO: 153013 - DNA, 25 bp, Homo sapien
cgcactcctcgtcctagtttcgctc

SEQ ID NO: 153014 - DNA, 25 bp, Homo sapien
tttcgctctctctcgaattcatcgc

SEQ ID NO: 153015 - DNA, 25 bp, Homo sapien
tctcgaattcatcgcatcacgtttc

SEQ ID NO: 153016 - DNA, 25 bp, Homo sapien
ctctgcggaggtttagcggaggccc

SEQ ID NO: 153017 - DNA, 25 bp, Homo sapien
acagctctgcggaggtttagcggag

SEQ ID NO: 153018 - DNA, 25 bp, Homo sapien
cccgacagctctgcggaggtttagc

SEQ ID NO: 153019 - DNA, 25 bp, Homo sapien
tcccgacagctctgcggaggtttag

SEQ ID NO: 153020 - DNA, 25 bp, Homo sapien
cgctcacctaccaggccggttaagc

SEQ ID NO: 153021 - DNA, 25 bp, Homo sapien
gtcgccgtctgggacttcgctcacc

SEQ ID NO: 153022 - DNA, 25 bp, Homo sapien
ccgtcgccgtctgggacttcgctca

SEQ ID NO: 153023 - DNA, 25 bp, Homo sapien
gctaacagttccacccgtcgccgtc

SEQ ID NO: 153024 - DNA, 25 bp, Homo sapien
gggagcccgaccagcattgacaaga

SEQ ID NO: 153025 - DNA, 25 bp, Homo sapien
agcagccgcatgaggtttattcgca

SEQ ID NO: 153026 - DNA, 25 bp, Homo sapien
ctggagacgcatttcctcaagtgtc

SEQ ID NO: 153027 - DNA, 25 bp, Homo sapien
aggagacgccaacctctgatgagtt

SEQ ID NO: 153028 - DNA, 25 bp, Homo sapien
tgggctcgcaccattgccaggatca

SEQ ID NO: 153029 - DNA, 25 bp, Homo sapien
aacgtgtactcgcagcctggcttca

SEQ ID NO: 153030 - DNA, 25 bp, Homo sapien
acctgcaactgggtgcgatcatcca

SEQ ID NO: 153031 - DNA, 25 bp, Homo sapien
caggagatctcctcgctggcagaca

SEQ ID NO: 153032 - DNA, 25 bp, Homo sapien
tccaggattcctgcgcgcagaaatc

SEQ ID NO: 153033 - DNA, 25 bp, Homo sapien
actggagatcacgacccggagacgc

SEQ ID NO: 153034 - DNA, 25 bp, Homo sapien
tccctcctggaagtgtggagcccgc

SEQ ID NO: 153035 - DNA, 25 bp, Homo sapien
cgcaggctaccgcagcatagatcga

SEQ ID NO: 153036 - DNA, 25 bp, Homo sapien
tctgagaaggattcggcggcaactc

SEQ ID NO: 153037 - DNA, 25 bp, Homo sapien
cacgcgattactttcactggagatc

SEQ ID NO: 153038 - DNA, 25 bp, Homo sapien
aagactttgccttcacacgcgatta

SEQ ID NO: 153039 - DNA, 25 bp, Homo sapien
cggccctcctagaggaaagactttg

SEQ ID NO: 153040 - DNA, 25 bp, Homo sapien
cttaactcccaaagccacagtattg

SEQ ID NO: 153041 - DNA, 25 bp, Homo sapien
ggctcggggcctgaaatctttgtat

SEQ ID NO: 153042 - DNA, 25 bp, Homo sapien
cggggcctgaaatctttgtatttct

SEQ ID NO: 153043 - DNA, 25 bp, Homo sapien
aacaagaattatctcttcagagacc

SEQ ID NO: 153044 - DNA, 25 bp, Homo sapien
ttctgtgatggtttaaatgtatccc

SEQ ID NO: 153045 - DNA, 25 bp, Homo sapien
tgtgttgacaacttaactcccaaag

SEQ ID NO: 153046 - DNA, 25 bp, Homo sapien
actcccaaagccacagtattgagag

SEQ ID NO: 153047 - DNA, 25 bp, Homo sapien
cccacccaaatcatgtgttgacaac

SEQ ID NO: 153048 - DNA, 25 bp, Homo sapien
tgtgctgcctctccaagagctgccg

SEQ ID NO: 153049 - DNA, 25 bp, Homo sapien
tgctctgtcaatatggcggcagcgg

SEQ ID NO: 153050 - DNA, 25 bp, Homo sapien
gccgcccggtgattcccatagagaa

SEQ ID NO: 153051 - DNA, 25 bp, Homo sapien
ggccgcgcatcctgtctattgaact

SEQ ID NO: 153052 - DNA, 25 bp, Homo sapien
tcctgaggagcgaatggtagcatct

SEQ ID NO: 153053 - DNA, 25 bp, Homo sapien
gaacacttccatttctcggtcccag

SEQ ID NO: 153054 - DNA, 25 bp, Homo sapien
ttagtcacaacaactctggcgtggc

SEQ ID NO: 153055 - DNA, 25 bp, Homo sapien
atgttcccagccagcaaactaggcg

SEQ ID NO: 153056 - DNA, 25 bp, Homo sapien
tcacagagcagatcagcgcgggtgt

SEQ ID NO: 153057 - DNA, 25 bp, Homo sapien
gctcatccacaaggagttcctcgaa

SEQ ID NO: 153058 - DNA, 25 bp, Homo sapien
gttgcggactatggccctaaagctc

SEQ ID NO: 153059 - DNA, 25 bp, Homo sapien
atctgccgaggcatacccttgctgc

SEQ ID NO: 153060 - DNA, 25 bp, Homo sapien
tcggtcaccatacgctacaggcatc

SEQ ID NO: 153061 - DNA, 25 bp, Homo sapien
cagtggcctctgatctcacagagca

SEQ ID NO: 153062 - DNA, 25 bp, Homo sapien
gcagcgcgtcagtcaacgtcacagg

SEQ ID NO: 153063 - DNA, 25 bp, Homo sapien
tacaggcatcctgcaggccatcgcg

SEQ ID NO: 153064 - DNA, 25 bp, Homo sapien
ctcggaaacccgaatgtgaggacct

SEQ ID NO: 153065 - DNA, 25 bp, Homo sapien
agctagagccgtcgttgagaccgtc

SEQ ID NO: 153066 - DNA, 25 bp, Homo sapien
tccaccgcgttcagtgtttcttgtc

SEQ ID NO: 153067 - DNA, 25 bp, Homo sapien
aggaccttaagggatccacagctgc

SEQ ID NO: 153068 - DNA, 25 bp, Homo sapien
cccagacgcagagtagattgtgatt

SEQ ID NO: 153069 - DNA, 25 bp, Homo sapien
tagcgtgacgtaatgcaacctcagc

SEQ ID NO: 153070 - DNA, 25 bp, Homo sapien
ctgaccgagctaatagtaacctttg

SEQ ID NO: 153071 - DNA, 25 bp, Homo sapien
cagccatccagagcgcggtcacagt

SEQ ID NO: 153072 - DNA, 25 bp, Homo sapien
ccatggaggccaaggtccgcccgag

SEQ ID NO: 153073 - DNA, 25 bp, Homo sapien
accgtcgcatctggaagacccagca

SEQ ID NO: 153074 - DNA, 25 bp, Homo sapien
ctacgcttcgaaattgggggctgtc

SEQ ID NO: 153075 - DNA, 25 bp, Homo sapien
tcgcccagaccgtcgcatctggaag

SEQ ID NO: 153076 - DNA, 25 bp, Homo sapien
gcttcgcaggcgttgaggcgagaac

SEQ ID NO: 153077 - DNA, 25 bp, Homo sapien
cagaggcaaaaaaatctacgcttcg

SEQ ID NO: 153078 - DNA, 25 bp, Homo sapien
cccagagtccgtcgtcgggcgacga

SEQ ID NO: 153079 - DNA, 25 bp, Homo sapien
aggtcatcgacggcttcgccatcgc

SEQ ID NO: 153080 - DNA, 25 bp, Homo sapien
tttctcccggaagctaggcgaagcc

SEQ ID NO: 153081 - DNA, 25 bp, Homo sapien
agtgatctctgcaacttccagcggc

SEQ ID NO: 153082 - DNA, 25 bp, Homo sapien
ccggaggacccacgatagagacaga

SEQ ID NO: 153083 - DNA, 25 bp, Homo sapien
gccggctgctgaagacttgcgaaca

SEQ ID NO: 153084 - DNA, 25 bp, Homo sapien
ttctcggactggatctctgttcttg

SEQ ID NO: 153085 - DNA, 25 bp, Homo sapien
tctgcgtgacatctgggagttctct

SEQ ID NO: 153086 - DNA, 25 bp, Homo sapien
tgggttcacagcataggccactttg

SEQ ID NO: 153087 - DNA, 25 bp, Homo sapien
tcaggagtcgcgctttgcgtttcca

SEQ ID NO: 153088 - DNA, 25 bp, Homo sapien
ccggtcttatcgcaccaagtgtctg

SEQ ID NO: 153089 - DNA, 25 bp, Homo sapien
tggtccctccgttggactgtcctgc

SEQ ID NO: 153090 - DNA, 25 bp, Homo sapien
tctgtgtcctatccgctgcctgcag

SEQ ID NO: 153091 - DNA, 25 bp, Homo sapien
cgagcctcaggctgctgaaatcacc

SEQ ID NO: 153092 - DNA, 25 bp, Homo sapien
cactgcgcgtttgccagtcagtctc

SEQ ID NO: 153093 - DNA, 25 bp, Homo sapien
agagctgacccactcactgcgcgtt

SEQ ID NO: 153094 - DNA, 25 bp, Homo sapien
cgaaaggctagccagcccgagactg

SEQ ID NO: 153095 - DNA, 25 bp, Homo sapien
tggtgtaccctttcgcagacgctga

SEQ ID NO: 153096 - DNA, 25 bp, Homo sapien
ctacagcagtcgcagtctccgtgga

SEQ ID NO: 153097 - DNA, 25 bp, Homo sapien
ggcccggacactggttcacttctct

SEQ ID NO: 153098 - DNA, 25 bp, Homo sapien
cctcgccattcaaaagggctggctc

SEQ ID NO: 153099 - DNA, 25 bp, Homo sapien
caagccaaacagagtgcgcagagtg

SEQ ID NO: 153100 - DNA, 25 bp, Homo sapien
cccgggctgcctgaatagcctcaga

SEQ ID NO: 153101 - DNA, 25 bp, Homo sapien
tcagaaacaacctcagcgactccgg

SEQ ID NO: 153102 - DNA, 25 bp, Homo sapien
tctccaggaggcgagcagtaacttc

SEQ ID NO: 153103 - DNA, 25 bp, Homo sapien
agcggcgcgttttcttcagcagcgg

SEQ ID NO: 153104 - DNA, 25 bp, Homo sapien
ccgagatctcttctcgttttagatc

SEQ ID NO: 153105 - DNA, 25 bp, Homo sapien
gcagtcagacctcccgttaatttcg

SEQ ID NO: 153106 - DNA, 25 bp, Homo sapien
gctcctcatttgctggtccacctta

SEQ ID NO: 153107 - DNA, 25 bp, Homo sapien
cgttaatttcgttcccagtgtgcct

SEQ ID NO: 153108 - DNA, 25 bp, Homo sapien
agccgaatggcgcagtatgagaccc

SEQ ID NO: 153109 - DNA, 25 bp, Homo sapien
cagtgtgcctttagttcgctcctca

SEQ ID NO: 153110 - DNA, 25 bp, Homo sapien
ctggtccaccttaattgacaaactg

SEQ ID NO: 153111 - DNA, 25 bp, Homo sapien
tgacaaactgtacgcccaacgaacg

SEQ ID NO: 153112 - DNA, 25 bp, Homo sapien
ccgggccgccaatgaagaggaaacg

SEQ ID NO: 153113 - DNA, 25 bp, Homo sapien
acccaaattggtgagtgctcccgca

SEQ ID NO: 153114 - DNA, 25 bp, Homo sapien
ccgaggtgctttctcagttgaggag

SEQ ID NO: 153115 - DNA, 25 bp, Homo sapien
tgaaatcggcagcttcccgggcaga

SEQ ID NO: 153116 - DNA, 25 bp, Homo sapien
cgaccgtggtaattgcaactgctca

SEQ ID NO: 153117 - DNA, 25 bp, Homo sapien
gccctcttaaagagataggcaccta

SEQ ID NO: 153118 - DNA, 25 bp, Homo sapien
ccgatgcgggcactttgaagaatca

SEQ ID NO: 153119 - DNA, 25 bp, Homo sapien
aatcacgtgtgttgaggccctctta

SEQ ID NO: 153120 - DNA, 25 bp, Homo sapien
gcacaggcacttgacggggacgcgg

SEQ ID NO: 153121 - DNA, 25 bp, Homo sapien
cacaggcacttgacggggacgcggg

SEQ ID NO: 153122 - DNA, 25 bp, Homo sapien
ggcacaggcacttgacggggacgcg

SEQ ID NO: 153123 - DNA, 25 bp, Homo sapien
gggcacaggcacttgacggggacgc

SEQ ID NO: 153124 - DNA, 25 bp, Homo sapien
tcgggcacaggcacttgacggggac

SEQ ID NO: 153125 - DNA, 25 bp, Homo sapien
ctcgggcacaggcacttgacgggga

SEQ ID NO: 153126 - DNA, 25 bp, Homo sapien
acaggcacttgacggggacgcgggt

SEQ ID NO: 153127 - DNA, 25 bp, Homo sapien
cgggcacaggcacttgacggggacg

SEQ ID NO: 153128 - DNA, 25 bp, Homo sapien
tgcacgccaaagcttcctgagtctg

SEQ ID NO: 153129 - DNA, 25 bp, Homo sapien
cgcgtcttgatctccaggccgaaca

SEQ ID NO: 153130 - DNA, 25 bp, Homo sapien
ctgagtctggatcgtaagcgctgtc

SEQ ID NO: 153131 - DNA, 25 bp, Homo sapien
cgcattgtcgttcaggtccttgatc

SEQ ID NO: 153132 - DNA, 25 bp, Homo sapien
gacctcgagcgagatgatgcacttg

SEQ ID NO: 153133 - DNA, 25 bp, Homo sapien
tggacaccacgcgaaaggctgaagc

SEQ ID NO: 153134 - DNA, 25 bp, Homo sapien
cgcgtctttggccacgttggcaatc

SEQ ID NO: 153135 - DNA, 25 bp, Homo sapien
aggctcttttccaccacgagttcgg

SEQ ID NO: 153136 - DNA, 25 bp, Homo sapien
tgtccgcttaggtcgccgacagctg

SEQ ID NO: 153137 - DNA, 25 bp, Homo sapien
ctgccagctccacttgggcggcggt

SEQ ID NO: 153138 - DNA, 25 bp, Homo sapien
catacatgtccgcttaggtcgccga

SEQ ID NO: 153139 - DNA, 25 bp, Homo sapien
cgggcacgccatacatgtccgctta

SEQ ID NO: 153140 - DNA, 25 bp, Homo sapien
ctctggggcgggcacgccatacatg

SEQ ID NO: 153141 - DNA, 25 bp, Homo sapien
agccagcagagctcaaagccgggca

SEQ ID NO: 153142 - DNA, 25 bp, Homo sapien
gccaagccagcagagctcaaagccg

SEQ ID NO: 153143 - DNA, 25 bp, Homo sapien
ctgcggcatgtgccagtactgggaa

SEQ ID NO: 153144 - DNA, 25 bp, Homo sapien
cgtgaactccggacgtggccctggc

SEQ ID NO: 153145 - DNA, 25 bp, Homo sapien
gcgcgtctctggtccagcatcgggt

SEQ ID NO: 153146 - DNA, 25 bp, Homo sapien
gccgtgttggtggagtctcatttcg

SEQ ID NO: 153147 - DNA, 25 bp, Homo sapien
tgtccgtgaactccggacgtggccc

SEQ ID NO: 153148 - DNA, 25 bp, Homo sapien
tcaggctgtccgtgaactccggacg

SEQ ID NO: 153149 - DNA, 25 bp, Homo sapien
tgctgtcaggctgtccgtgaactcc

SEQ ID NO: 153150 - DNA, 25 bp, Homo sapien
ctcatttcgggttgtttgccgacgg

SEQ ID NO: 153151 - DNA, 25 bp, Homo sapien
tggagtctcatttcgggttgtttgc

SEQ ID NO: 153152 - DNA, 25 bp, Homo sapien
gtcgtttcactgtttcacgttagga

SEQ ID NO: 153153 - DNA, 25 bp, Homo sapien
agagaatgacaacatggcaggcagc

SEQ ID NO: 153154 - DNA, 25 bp, Homo sapien
agcgtagggagcctgatccgctttc

SEQ ID NO: 153155 - DNA, 25 bp, Homo sapien
ttaggatgtgattcggcccagaaca

SEQ ID NO: 153156 - DNA, 25 bp, Homo sapien
caacagggagaaaaccgatgcttct

SEQ ID NO: 153157 - DNA, 25 bp, Homo sapien
accgatgcttctgcaatgagtatca

SEQ ID NO: 153158 - DNA, 25 bp, Homo sapien
ccagacaccgttggagaaatgggca

SEQ ID NO: 153159 - DNA, 25 bp, Homo sapien
ccctgaatatgtagccgaggccaaa

SEQ ID NO: 153160 - DNA, 25 bp, Homo sapien
cgctcttgaaacaagtaatgactgg

SEQ ID NO: 153161 - DNA, 25 bp, Homo sapien
actcgaacgctggtacgtctgggtc

SEQ ID NO: 153162 - DNA, 25 bp, Homo sapien
gtgtagattagcagaacgctcttga

SEQ ID NO: 153163 - DNA, 25 bp, Homo sapien
ctggtttagtctgcagtctccgaga

SEQ ID NO: 153164 - DNA, 25 bp, Homo sapien
gcagtctccgagacggggacgccat

SEQ ID NO: 153165 - DNA, 25 bp, Homo sapien
gggacgccatgactagcccgagacc

SEQ ID NO: 153166 - DNA, 25 bp, Homo sapien
accgcaccgggcgattggaacacag

SEQ ID NO: 153167 - DNA, 25 bp, Homo sapien
cttcgtctctcacccagaaaataaa

SEQ ID NO: 153168 - DNA, 25 bp, Homo sapien
ccgcgatgtcgtaggtccgaagaga

SEQ ID NO: 153169 - DNA, 25 bp, Homo sapien
aagctgcaactttccctggagcggg

SEQ ID NO: 153170 - DNA, 25 bp, Homo sapien
ggctccgggaagatcgcaacccagc

SEQ ID NO: 153171 - DNA, 25 bp, Homo sapien
tcgagaagtcccagtgccggtttca

SEQ ID NO: 153172 - DNA, 25 bp, Homo sapien
aggtgcctccagagatcgagaagtc

SEQ ID NO: 153173 - DNA, 25 bp, Homo sapien
ccgctggctgttgacctacctgtca

SEQ ID NO: 153174 - DNA, 25 bp, Homo sapien
ccacgaaaaggtgactggacgcctt

SEQ ID NO: 153175 - DNA, 25 bp, Homo sapien
ccaagcagacgggagtccaagcctg

SEQ ID NO: 153176 - DNA, 25 bp, Homo sapien
cagcggtggatcgttctctacgttc

SEQ ID NO: 153177 - DNA, 25 bp, Homo sapien
ctacgttctgtgttcggtgagagga

SEQ ID NO: 153178 - DNA, 25 bp, Homo sapien
gctccgtacggaagtgtgctttggc

SEQ ID NO: 153179 - DNA, 25 bp, Homo sapien
tctcatgaatcgctaccggagccgc

SEQ ID NO: 153180 - DNA, 25 bp, Homo sapien
tttgactgtgagagacccagcggtg

SEQ ID NO: 153181 - DNA, 25 bp, Homo sapien
actcaacagagctatggcgggtttg

SEQ ID NO: 153182 - DNA, 25 bp, Homo sapien
tggcgcaccggaagccgactcaaca

SEQ ID NO: 153183 - DNA, 25 bp, Homo sapien
cgcgcctgcggctaacagaatgtct

SEQ ID NO: 153184 - DNA, 25 bp, Homo sapien
tcgccaaactcttggacgccgtctg

SEQ ID NO: 153185 - DNA, 25 bp, Homo sapien
cgagaggtcggcagcttcaaaaact

SEQ ID NO: 153186 - DNA, 25 bp, Homo sapien
tggagtattgtcaccaccctgtctc

SEQ ID NO: 153187 - DNA, 25 bp, Homo sapien
gttctcaggatagctcctcggattc

SEQ ID NO: 153188 - DNA, 25 bp, Homo sapien
gacctttgccgagtccagggttctc

SEQ ID NO: 153189 - DNA, 25 bp, Homo sapien
tctcctcggagaaactttgctagtg

SEQ ID NO: 153190 - DNA, 25 bp, Homo sapien
cgctcgctctacaggatgaagaaaa

SEQ ID NO: 153191 - DNA, 25 bp, Homo sapien
accctgtctccgaatgcagtgttga

SEQ ID NO: 153192 - DNA, 25 bp, Homo sapien
tttctgtaaagcaagggttaaatca

SEQ ID NO: 153193 - DNA, 25 bp, Homo sapien
cccgcggacagtttggcatagtagg

SEQ ID NO: 153194 - DNA, 25 bp, Homo sapien
cctgaggcggcaaactaaaaggcca

SEQ ID NO: 153195 - DNA, 25 bp, Homo sapien
tgcggcggggaaacagtcacttcct

SEQ ID NO: 153196 - DNA, 25 bp, Homo sapien
agtcacttcctggtgcgcaaggcgc

SEQ ID NO: 153197 - DNA, 25 bp, Homo sapien
caacccttggcaagcgcggcgggac

SEQ ID NO: 153198 - DNA, 25 bp, Homo sapien
ggccgtacacgaccttgcgcagtca

SEQ ID NO: 153199 - DNA, 25 bp, Homo sapien
aatcctcttacaaacctgaggcggc

SEQ ID NO: 153200 - DNA, 25 bp, Homo sapien
gggtggagtcagcttctttgaattc

SEQ ID NO: 153201 - DNA, 25 bp, Homo sapien
ctttgaattccggaggcggcattcg

SEQ ID NO: 153202 - DNA, 25 bp, Homo sapien
atcaggcttcagctgagtgcgttgc

SEQ ID NO: 153203 - DNA, 25 bp, Homo sapien
gtacttttaagcaccgcgcgaaatg

SEQ ID NO: 153204 - DNA, 25 bp, Homo sapien
tgtcttaggtgaggaggtactttta

SEQ ID NO: 153205 - DNA, 25 bp, Homo sapien
agctgagtgcgttgctccgcccagc

SEQ ID NO: 153206 - DNA, 25 bp, Homo sapien
ttggttctacgccagcgtcgtcgcg

SEQ ID NO: 153207 - DNA, 25 bp, Homo sapien
cgctctccgtaattggttctacgcc

SEQ ID NO: 153208 - DNA, 25 bp, Homo sapien
cttggtcccggccttcatgcaggtg

SEQ ID NO: 153209 - DNA, 25 bp, Homo sapien
tctctggcacaaggcggccggttga

SEQ ID NO: 153210 - DNA, 25 bp, Homo sapien
tttatctctggcacaaggcggccgg

SEQ ID NO: 153211 - DNA, 25 bp, Homo sapien
ggcagcccgcttttatctctggcac

SEQ ID NO: 153212 - DNA, 25 bp, Homo sapien
gccggcagcccgcttttatctctgg

SEQ ID NO: 153213 - DNA, 25 bp, Homo sapien
gatgctccagatgacgccccaggcg

SEQ ID NO: 153214 - DNA, 25 bp, Homo sapien
gtagcgctcggccaacttggccttc

SEQ ID NO: 153215 - DNA, 25 bp, Homo sapien
gcacaaggcggccggttgaatttcc

SEQ ID NO: 153216 - DNA, 25 bp, Homo sapien
gagcacgacttcgaggcagtggccc

SEQ ID NO: 153217 - DNA, 25 bp, Homo sapien
gacctgcgtctctggtctgtgggtt

SEQ ID NO: 153218 - DNA, 25 bp, Homo sapien
caccgaaaaggctgggacctgcgtc

SEQ ID NO: 153219 - DNA, 25 bp, Homo sapien
ctggacagtaaaagcggcgcgcgcc

SEQ ID NO: 153220 - DNA, 25 bp, Homo sapien
gaggcccaacaggtcgcaacgggtc

SEQ ID NO: 153221 - DNA, 25 bp, Homo sapien
tgccggcgcctggacagtaaaagcg

SEQ ID NO: 153222 - DNA, 25 bp, Homo sapien
cggactggagcacgacttcgaggca

SEQ ID NO: 153223 - DNA, 25 bp, Homo sapien
tcccgcgcggaacgtagaggcgaac

SEQ ID NO: 153224 - DNA, 25 bp, Homo sapien
aggaggaatccatcccagggcgacc

SEQ ID NO: 153225 - DNA, 25 bp, Homo sapien
ccagggcgaccaagcttgcagagac

SEQ ID NO: 153226 - DNA, 25 bp, Homo sapien
cttgcagagacgaactccgcaccga

SEQ ID NO: 153227 - DNA, 25 bp, Homo sapien
gaccttcacgtgtctccgcgacgga

SEQ ID NO: 153228 - DNA, 25 bp, Homo sapien
tgcgcccagccttgcgccttgagat

SEQ ID NO: 153229 - DNA, 25 bp, Homo sapien
ggcttacagcccagagccgaggtgc

SEQ ID NO: 153230 - DNA, 25 bp, Homo sapien
gcgccttgagatcgcagggcttaca

SEQ ID NO: 153231 - DNA, 25 bp, Homo sapien
cggaaccacagctagctgcctctgg

SEQ ID NO: 153232 - DNA, 25 bp, Homo sapien
gcaccctgcacaagggcgtccagga

SEQ ID NO: 153233 - DNA, 25 bp, Homo sapien
acccgctcagcgatgtgagtaccca

SEQ ID NO: 153234 - DNA, 25 bp, Homo sapien
tccaggaagccgctggttagggtcc

SEQ ID NO: 153235 - DNA, 25 bp, Homo sapien
ccgcacaagggcgtccagtccgagt

SEQ ID NO: 153236 - DNA, 25 bp, Homo sapien
gacgacgacagcgtcctcgaagcca

SEQ ID NO: 153237 - DNA, 25 bp, Homo sapien
tgtcccagatgaaggtcaccgtgtc

SEQ ID NO: 153238 - DNA, 25 bp, Homo sapien
ggggtttgcctgagacagtgtctct

SEQ ID NO: 153239 - DNA, 25 bp, Homo sapien
agcaggcatgtagccctagccaggg

SEQ ID NO: 153240 - DNA, 25 bp, Homo sapien
ctatatacttccgtttgcctcgcgg

SEQ ID NO: 153241 - DNA, 25 bp, Homo sapien
gcgctgcgctgagccttacactcta

SEQ ID NO: 153242 - DNA, 25 bp, Homo sapien
tgattgctcctaccgactcccatga

SEQ ID NO: 153243 - DNA, 25 bp, Homo sapien
agtgcgatcgggaacctcctatata

SEQ ID NO: 153244 - DNA, 25 bp, Homo sapien
gggccgagtaacatccagcttaatc

SEQ ID NO: 153245 - DNA, 25 bp, Homo sapien
cgctcacgcaagcatggtaggactt

SEQ ID NO: 153246 - DNA, 25 bp, Homo sapien
ttaggcggagtccttccttaagctc

SEQ ID NO: 153247 - DNA, 25 bp, Homo sapien
gtgagtggaccaccctttaggcgga

SEQ ID NO: 153248 - DNA, 25 bp, Homo sapien
aagcgcgcagcccagatgtagttct

SEQ ID NO: 153249 - DNA, 25 bp, Homo sapien
acggtgaccggacagcataaatttc

SEQ ID NO: 153250 - DNA, 25 bp, Homo sapien
gggcggaccaatcaccgatgactta

SEQ ID NO: 153251 - DNA, 25 bp, Homo sapien
ttctctggcaactgggacggttatc

SEQ ID NO: 153252 - DNA, 25 bp, Homo sapien
cggcaccttagtgatcccgagttta

SEQ ID NO: 153253 - DNA, 25 bp, Homo sapien
atctcacatgacgtaggcgctcacg

SEQ ID NO: 153254 - DNA, 25 bp, Homo sapien
ggtcgtcgtctaccgtctcgctata

SEQ ID NO: 153255 - DNA, 25 bp, Homo sapien
tcgcttacgtgagcagaagtagttc

SEQ ID NO: 153256 - DNA, 25 bp, Homo sapien
ccgactccgagtgatctcgggccgg

SEQ ID NO: 153257 - DNA, 25 bp, Homo sapien
gaagacaatcgctttgccaaacacg

SEQ ID NO: 153258 - DNA, 25 bp, Homo sapien
gccaaacacggcagggcatctggaa

SEQ ID NO: 153259 - DNA, 25 bp, Homo sapien
gctcttttcggtcccattaggagga

SEQ ID NO: 153260 - DNA, 25 bp, Homo sapien
gcacaggcctagtcgtgcgacagga

SEQ ID NO: 153261 - DNA, 25 bp, Homo sapien
cagctgggtcctccttgcgtctggc

SEQ ID NO: 153262 - DNA, 25 bp, Homo sapien
gctccaagagggaagacaatcgctt

SEQ ID NO: 153263 - DNA, 25 bp, Homo sapien
ccagtacatttcctttcagggaaag

SEQ ID NO: 153264 - DNA, 25 bp, Homo sapien
tggggcaccgagcacagaccagaga

SEQ ID NO: 153265 - DNA, 25 bp, Homo sapien
cccggcagcggttacggggcttgag

SEQ ID NO: 153266 - DNA, 25 bp, Homo sapien
gccaggccggcagaagctcactgac

SEQ ID NO: 153267 - DNA, 25 bp, Homo sapien
agttcctggtgactggccgccggcc

SEQ ID NO: 153268 - DNA, 25 bp, Homo sapien
cagaccagagaacggggatgtctgt

SEQ ID NO: 153269 - DNA, 25 bp, Homo sapien
ggcaccgagcacagaccagagaacg

SEQ ID NO: 153270 - DNA, 25 bp, Homo sapien
gatgagtgacaacgcgtgcgcactg

SEQ ID NO: 153271 - DNA, 25 bp, Homo sapien
gcacagaccagagaacggggatgtc

SEQ ID NO: 153272 - DNA, 25 bp, Homo sapien
ctgtgtatacagactggcttgggga

SEQ ID NO: 153273 - DNA, 25 bp, Homo sapien
gctggtgcctgctactgtgtataca

SEQ ID NO: 153274 - DNA, 25 bp, Homo sapien
cagctataccatgggccgcactcgg

SEQ ID NO: 153275 - DNA, 25 bp, Homo sapien
ggttaagagatttgtcccagctata

SEQ ID NO: 153276 - DNA, 25 bp, Homo sapien
cctgttttgtgctcgggttaagaga

SEQ ID NO: 153277 - DNA, 25 bp, Homo sapien
gccagagcgagcctgttttgtgctc

SEQ ID NO: 153278 - DNA, 25 bp, Homo sapien
acgagaacgagaaaatctgggacga

SEQ ID NO: 153279 - DNA, 25 bp, Homo sapien
gacgtgtgcgcgcttctctgggcca

SEQ ID NO: 153280 - DNA, 25 bp, Homo sapien
aaaaagcgcgggatgtgaaagcacg

SEQ ID NO: 153281 - DNA, 25 bp, Homo sapien
ttggcctttactgcgccacggcagg

SEQ ID NO: 153282 - DNA, 25 bp, Homo sapien
cccaatctcggacgggctgaagaga

SEQ ID NO: 153283 - DNA, 25 bp, Homo sapien
cttcctgaggggaagactccgccgc

SEQ ID NO: 153284 - DNA, 25 bp, Homo sapien
gcgcggacaattgcacttgcgtctc

SEQ ID NO: 153285 - DNA, 25 bp, Homo sapien
gtctcgattccgttaagctccttta

SEQ ID NO: 153286 - DNA, 25 bp, Homo sapien
ttttaacgcttcagctcgagcctcg

SEQ ID NO: 153287 - DNA, 25 bp, Homo sapien
tccaccaatcggagagctttaagcc

SEQ ID NO: 153288 - DNA, 25 bp, Homo sapien
agcaccgcgtcacgggagctaggcc

SEQ ID NO: 153289 - DNA, 25 bp, Homo sapien
cccaatctaccggatcccttctccg

SEQ ID NO: 153290 - DNA, 25 bp, Homo sapien
tcctgcggctcgctgaagcccgctc

SEQ ID NO: 153291 - DNA, 25 bp, Homo sapien
ccaggttcgcttcggggtgctccct

SEQ ID NO: 153292 - DNA, 25 bp, Homo sapien
cgtgagcaccgcgtcacgggagcta

SEQ ID NO: 153293 - DNA, 25 bp, Homo sapien
cgtcacgggagctaggccaccacca

SEQ ID NO: 153294 - DNA, 25 bp, Homo sapien
agagggtgtgtgtaacaaaggagtg

SEQ ID NO: 153295 - DNA, 25 bp, Homo sapien
ctcacgtgagcaccgcgtcacggga

SEQ ID NO: 153296 - DNA, 25 bp, Homo sapien
cctcctccgcttgagtgtacagagc

SEQ ID NO: 153297 - DNA, 25 bp, Homo sapien
ctactgcggacaggtccctttaagg

SEQ ID NO: 153298 - DNA, 25 bp, Homo sapien
tccgacctgcagctactgcggacag

SEQ ID NO: 153299 - DNA, 25 bp, Homo sapien
acccagactcgctccggaccaggtt

SEQ ID NO: 153300 - DNA, 25 bp, Homo sapien
gaccaggttagcgttcccgcgcaga

SEQ ID NO: 153301 - DNA, 25 bp, Homo sapien
tggccaaaggtttccgggctcgcca

SEQ ID NO: 153302 - DNA, 25 bp, Homo sapien
cttgagtgtacagagcccgcgtcca

SEQ ID NO: 153303 - DNA, 25 bp, Homo sapien
tttctggcgcccagcctaacggcca

SEQ ID NO: 153304 - DNA, 25 bp, Homo sapien
tcgcggcgctaaacaaagcctgata

SEQ ID NO: 153305 - DNA, 25 bp, Homo sapien
tatcactccgcttccataagccgga

SEQ ID NO: 153306 - DNA, 25 bp, Homo sapien
gggagccctccgacagaaaagagtc

SEQ ID NO: 153307 - DNA, 25 bp, Homo sapien
ccactgccgttgtgggtaacgcgga

SEQ ID NO: 153308 - DNA, 25 bp, Homo sapien
cgcggacgtggaagaacctcgtctg

SEQ ID NO: 153309 - DNA, 25 bp, Homo sapien
cctcgtctgcggaggaaaaggtaga

SEQ ID NO: 153310 - DNA, 25 bp, Homo sapien
tgcgcattccaatacctgaagcggc

SEQ ID NO: 153311 - DNA, 25 bp, Homo sapien
atccggaattcgtccctgcgcattc

SEQ ID NO: 153312 - DNA, 25 bp, Homo sapien
ttcgacgtaccaagaagtcaaggta

SEQ ID NO: 153313 - DNA, 25 bp, Homo sapien
gtcaaggtaagtcgccgtggaagcc

SEQ ID NO: 153314 - DNA, 25 bp, Homo sapien
tcagccgtgtctggggctccagcat

SEQ ID NO: 153315 - DNA, 25 bp, Homo sapien
tgggctgcttccagccacgatgtcc

SEQ ID NO: 153316 - DNA, 25 bp, Homo sapien
atggacactgttggggacgcgtcct

SEQ ID NO: 153317 - DNA, 25 bp, Homo sapien
cgtcctggtggtcacaaagcccata

SEQ ID NO: 153318 - DNA, 25 bp, Homo sapien
aagcccataggagtggcctcacccg

SEQ ID NO: 153319 - DNA, 25 bp, Homo sapien
tctgggcggttcagttttcgacgta

SEQ ID NO: 153320 - DNA, 25 bp, Homo sapien
ggaatccaactgaagagcagccaga

SEQ ID NO: 153321 - DNA, 25 bp, Homo sapien
agaaatggccaaacgggagccgtgt

SEQ ID NO: 153322 - DNA, 25 bp, Homo sapien
ctgggaaagcggtgggaatccaact

SEQ ID NO: 153323 - DNA, 25 bp, Homo sapien
ttgccattcggatcgctgggaaagc

SEQ ID NO: 153324 - DNA, 25 bp, Homo sapien
gggactcgtctttgccattcggatc

SEQ ID NO: 153325 - DNA, 25 bp, Homo sapien
tctgggtcggaactatggtggttct

SEQ ID NO: 153326 - DNA, 25 bp, Homo sapien
gcccgccggtgccatatattatagc

SEQ ID NO: 153327 - DNA, 25 bp, Homo sapien
ccagctctgtgcctagcccgtggga

SEQ ID NO: 153328 - DNA, 25 bp, Homo sapien
aaatatggtagtggtcgccacgtta

SEQ ID NO: 153329 - DNA, 25 bp, Homo sapien
tctgtacccagtccgccggaggtga

SEQ ID NO: 153330 - DNA, 25 bp, Homo sapien
ggaaagcagtggctccaagtgagcc

SEQ ID NO: 153331 - DNA, 25 bp, Homo sapien
cgcgtctttcccgttcggatcgcgg

SEQ ID NO: 153332 - DNA, 25 bp, Homo sapien
cgcgtttgctactccgggtcccgat

SEQ ID NO: 153333 - DNA, 25 bp, Homo sapien
ttacagcagcgacagaaatatggta

SEQ ID NO: 153334 - DNA, 25 bp, Homo sapien
gcccgctggtcccatatattacagc

SEQ ID NO: 153335 - DNA, 25 bp, Homo sapien
tcccgttcggatcgcggggaaagca

SEQ ID NO: 153336 - DNA, 25 bp, Homo sapien
ctctgtgcccagcccacgagaggtg

SEQ ID NO: 153337 - DNA, 25 bp, Homo sapien
tgccattctgatagcggggaaagcg

SEQ ID NO: 153338 - DNA, 25 bp, Homo sapien
gccgaccctgacatcctggcaagga

SEQ ID NO: 153339 - DNA, 25 bp, Homo sapien
tgagaatcgaagtgaggagccgcca

SEQ ID NO: 153340 - DNA, 25 bp, Homo sapien
cgcccgtccctatattatagcaacg

SEQ ID NO: 153341 - DNA, 25 bp, Homo sapien
gtccctatattatagcaacgccaga

SEQ ID NO: 153342 - DNA, 25 bp, Homo sapien
gcgtctttgccattctgatagcggg

SEQ ID NO: 153343 - DNA, 25 bp, Homo sapien
gggacgcgtctttgccattctgata

SEQ ID NO: 153344 - DNA, 25 bp, Homo sapien
cctgacgtcatattagcgacggtga

SEQ ID NO: 153345 - DNA, 25 bp, Homo sapien
cgacggtgacgactttttattgaga

SEQ ID NO: 153346 - DNA, 25 bp, Homo sapien
tattgagaccaatttggcctgggga

SEQ ID NO: 153347 - DNA, 25 bp, Homo sapien
cttcaggcgtttggactcagtggag

SEQ ID NO: 153348 - DNA, 25 bp, Homo sapien
actcagtggaggttgtgagtgccca

SEQ ID NO: 153349 - DNA, 25 bp, Homo sapien
tggcctgaatctccgtggggtttag

SEQ ID NO: 153350 - DNA, 25 bp, Homo sapien
tcgttcccactttggggatcggcgc

SEQ ID NO: 153351 - DNA, 25 bp, Homo sapien
gcggttgccatagtaacctgacgtc

SEQ ID NO: 153352 - DNA, 25 bp, Homo sapien
accgctggtctttcgagggtatgga

SEQ ID NO: 153353 - DNA, 25 bp, Homo sapien
tctacgacattgcaaaccgctggtc

SEQ ID NO: 153354 - DNA, 25 bp, Homo sapien
tctgcgcacaaccttgctggtctgg

SEQ ID NO: 153355 - DNA, 25 bp, Homo sapien
tgaagctgaagctctgggatacgtc

SEQ ID NO: 153356 - DNA, 25 bp, Homo sapien
ggcagggaagattttgtaccatatt

SEQ ID NO: 153357 - DNA, 25 bp, Homo sapien
atattccgctcctactctcgtggtg

SEQ ID NO: 153358 - DNA, 25 bp, Homo sapien
tctcgtggtgcacaaggagtgatcc

SEQ ID NO: 153359 - DNA, 25 bp, Homo sapien
ggagtgatcctggtctacgacattg

SEQ ID NO: 153360 - DNA, 25 bp, Homo sapien
gccggcggccagttaactggtactc

SEQ ID NO: 153361 - DNA, 25 bp, Homo sapien
ggaacgctagctccttctccgccta

SEQ ID NO: 153362 - DNA, 25 bp, Homo sapien
ccgtggtgttcaccgttttcctgca

SEQ ID NO: 153363 - DNA, 25 bp, Homo sapien
gttcaccgttttcctgcaaggactc

SEQ ID NO: 153364 - DNA, 25 bp, Homo sapien
gcaaggactcgggaatggttttcca

SEQ ID NO: 153365 - DNA, 25 bp, Homo sapien
cgggaatggttttccatcgctcttg

SEQ ID NO: 153366 - DNA, 25 bp, Homo sapien
cggtgagcctctgctggcctagcca

SEQ ID NO: 153367 - DNA, 25 bp, Homo sapien
ccactatgttcccaagaatgttggg

SEQ ID NO: 153368 - DNA, 25 bp, Homo sapien
agccgtgcggagaagcaatcggtcc

SEQ ID NO: 153369 - DNA, 25 bp, Homo sapien
cgtgaccggccaacactgagtgttg

SEQ ID NO: 153370 - DNA, 25 bp, Homo sapien
agtgttgtctcgctctggcgtcaga

SEQ ID NO: 153371 - DNA, 25 bp, Homo sapien
cagagccgtcgtggctcgttccatt

SEQ ID NO: 153372 - DNA, 25 bp, Homo sapien
tcgttccattctcggcggtggtacc

SEQ ID NO: 153373 - DNA, 25 bp, Homo sapien
gaagcaatcggtccgcgatgcagcc

SEQ ID NO: 153374 - DNA, 25 bp, Homo sapien
tgcctacgccatcagcgcaagcttt

SEQ ID NO: 153375 - DNA, 25 bp, Homo sapien
cccgcgagccttccttgagcggaga

SEQ ID NO: 153376 - DNA, 25 bp, Homo sapien
ttttctgcatcaagaagggcggagc

SEQ ID NO: 153377 - DNA, 25 bp, Homo sapien
acgtgaggtgcgtcgccgcaacact

SEQ ID NO: 153378 - DNA, 25 bp, Homo sapien
gaacgctagagaggacccgccgcca

SEQ ID NO: 153379 - DNA, 25 bp, Homo sapien
gtgcttccgaaaggtcgtagcctca

SEQ ID NO: 153380 - DNA, 25 bp, Homo sapien
agcgacggcggttctgacgccacaa

SEQ ID NO: 153381 - DNA, 25 bp, Homo sapien
cgccacaacgaggtaagactcagtg

SEQ ID NO: 153382 - DNA, 25 bp, Homo sapien
taagactcagtgttggccgatcacg

SEQ ID NO: 153383 - DNA, 25 bp, Homo sapien
aacaggtaccactgccgagaaggga

SEQ ID NO: 153384 - DNA, 25 bp, Homo sapien
cggcggcgggtcttcgctagcgttc

SEQ ID NO: 153385 - DNA, 25 bp, Homo sapien
tgcaggaaaacagcgaacaccgcgg

SEQ ID NO: 153386 - DNA, 25 bp, Homo sapien
tcggcgacaggcgcagaacagcgca

SEQ ID NO: 153387 - DNA, 25 bp, Homo sapien
gggagatcctgctgcactggccgcc

SEQ ID NO: 153388 - DNA, 25 bp, Homo sapien
cccggccatgccagcagcggctgac

SEQ ID NO: 153389 - DNA, 25 bp, Homo sapien
agcggctgaccgacctcggcgacag

SEQ ID NO: 153390 - DNA, 25 bp, Homo sapien
aggtctgcgaggctaagtgtctccg

SEQ ID NO: 153391 - DNA, 25 bp, Homo sapien
ctcgactgcaggtctgcgaggctaa

SEQ ID NO: 153392 - DNA, 25 bp, Homo sapien
gaacgttaaacctgtgctgggcaca

SEQ ID NO: 153393 - DNA, 25 bp, Homo sapien
ctctccctcgggtgggagtgtagct

SEQ ID NO: 153394 - DNA, 25 bp, Homo sapien
tgctgactccggcatccctggctgg

SEQ ID NO: 153395 - DNA, 25 bp, Homo sapien
ttgggttcatgctccctccagaggc

SEQ ID NO: 153396 - DNA, 25 bp, Homo sapien
gtctggcatcatggtgttgggttca

SEQ ID NO: 153397 - DNA, 25 bp, Homo sapien
tggttgcattgctcctatctctgcc

SEQ ID NO: 153398 - DNA, 25 bp, Homo sapien
ggtacgtgtttcctgtgatttaata

SEQ ID NO: 153399 - DNA, 25 bp, Homo sapien
agtgtagctgtggtgtatctctgga

SEQ ID NO: 153400 - DNA, 25 bp, Homo sapien
ggctgcggcattcacgtgatctgca

SEQ ID NO: 153401 - DNA, 25 bp, Homo sapien
acgctgccagcggaacactggaatg

SEQ ID NO: 153402 - DNA, 25 bp, Homo sapien
caagtatccatgctcgctttccagg

SEQ ID NO: 153403 - DNA, 25 bp, Homo sapien
tccgtccattttggagccggagatg

SEQ ID NO: 153404 - DNA, 25 bp, Homo sapien
ggcacagagacccaaaattagtttg

SEQ ID NO: 153405 - DNA, 25 bp, Homo sapien
ttcctgggctcctaattcttggtcc

SEQ ID NO: 153406 - DNA, 25 bp, Homo sapien
tagagaaaaacgttgaccgcgaggc

SEQ ID NO: 153407 - DNA, 25 bp, Homo sapien
ctgccgttcccgtgcgtagagaaaa

SEQ ID NO: 153408 - DNA, 25 bp, Homo sapien
gaaacgtagacatattctggaaata

SEQ ID NO: 153409 - DNA, 25 bp, Homo sapien
gcaacagtgaaacgtagacatattc

SEQ ID NO: 153410 - DNA, 25 bp, Homo sapien
cccgcagtgcaacagtgaaacgtag

SEQ ID NO: 153411 - DNA, 25 bp, Homo sapien
ataccctgcgaggatgccgtgagat

SEQ ID NO: 153412 - DNA, 25 bp, Homo sapien
ccattttagtactggaaatggagta

SEQ ID NO: 153413 - DNA, 25 bp, Homo sapien
ccaggtaaagcacctggggtcagaa

SEQ ID NO: 153414 - DNA, 25 bp, Homo sapien
cgtgagatgcgccaggtaaagcacc

SEQ ID NO: 153415 - DNA, 25 bp, Homo sapien
gagagagataccctgcgaggatgcc

SEQ ID NO: 153416 - DNA, 25 bp, Homo sapien
atgcagttaagagagccggccagcc

SEQ ID NO: 153417 - DNA, 25 bp, Homo sapien
gatgggtgatacgatgctccttcta

SEQ ID NO: 153418 - DNA, 25 bp, Homo sapien
gctccttctaattgacacctctagg

SEQ ID NO: 153419 - DNA, 25 bp, Homo sapien
cctctaggtccagggcaagttaatg

SEQ ID NO: 153420 - DNA, 25 bp, Homo sapien
ttaatgatgagcttggaccgcgttg

SEQ ID NO: 153421 - DNA, 25 bp, Homo sapien
gaccgcgttgccaccggttcgaatg

SEQ ID NO: 153422 - DNA, 25 bp, Homo sapien
ggcctttgccagttttctctgcacg

SEQ ID NO: 153423 - DNA, 25 bp, Homo sapien
ccaccggttcgaatggcctttgcca

SEQ ID NO: 153424 - DNA, 25 bp, Homo sapien
agaggacgactaggagcacacggcc

SEQ ID NO: 153425 - DNA, 25 bp, Homo sapien
aaagcctgctgggaaaatggtgggc

SEQ ID NO: 153426 - DNA, 25 bp, Homo sapien
cgaggcctgtagcaaagcctgctgg

SEQ ID NO: 153427 - DNA, 25 bp, Homo sapien
ggcgaggcctgtagcaaagcctgct

SEQ ID NO: 153428 - DNA, 25 bp, Homo sapien
ccgaaaggcatggagtctgcaggcc

SEQ ID NO: 153429 - DNA, 25 bp, Homo sapien
gacgactaggagcacacggcccgga

SEQ ID NO: 153430 - DNA, 25 bp, Homo sapien
gacgccgaaaggcatggagtctgca

SEQ ID NO: 153431 - DNA, 25 bp, Homo sapien
cacctcgaggagaggacgactagga

SEQ ID NO: 153432 - DNA, 25 bp, Homo sapien
gcgcaaggcattaaggccagtgtgt

SEQ ID NO: 153433 - DNA, 25 bp, Homo sapien
cctgcggaaataggataggcggaaa

SEQ ID NO: 153434 - DNA, 25 bp, Homo sapien
aatgagctaaggttcccgcgagtgg

SEQ ID NO: 153435 - DNA, 25 bp, Homo sapien
aagcgcgaggtcaaatctggggcca

SEQ ID NO: 153436 - DNA, 25 bp, Homo sapien
cgaggtcaaatctggggccacgccc

SEQ ID NO: 153437 - DNA, 25 bp, Homo sapien
tctgctgtgtttgcaagtgagggtc

SEQ ID NO: 153438 - DNA, 25 bp, Homo sapien
caacgggcgcaaggcattaaggcca

SEQ ID NO: 153439 - DNA, 25 bp, Homo sapien
taggcggaaatgagctaaggttccc

SEQ ID NO: 153440 - DNA, 25 bp, Homo sapien
ctcgtgcccctttctcggcggtggg

SEQ ID NO: 153441 - DNA, 25 bp, Homo sapien
ccgggaatccggctccttagagtca

SEQ ID NO: 153442 - DNA, 25 bp, Homo sapien
caggtcagctctgcgtgccgggaat

SEQ ID NO: 153443 - DNA, 25 bp, Homo sapien
ctcctcgtcctcaatggggcagcaa

SEQ ID NO: 153444 - DNA, 25 bp, Homo sapien
ctcgtcctcaatggggcagcaagtg

SEQ ID NO: 153445 - DNA, 25 bp, Homo sapien
gacctcggtggcctgacagctgccg

SEQ ID NO: 153446 - DNA, 25 bp, Homo sapien
agagtcaccgtcactgctcctgctg

SEQ ID NO: 153447 - DNA, 25 bp, Homo sapien
ggctccttagagtcaccgtcactgc

SEQ ID NO: 153448 - DNA, 25 bp, Homo sapien
cttcgcagagaggtagccgagtcga

SEQ ID NO: 153449 - DNA, 25 bp, Homo sapien
cccacttcaatccaggcaaatcata

SEQ ID NO: 153450 - DNA, 25 bp, Homo sapien
aaatcgcgcgctctttctttacctg

SEQ ID NO: 153451 - DNA, 25 bp, Homo sapien
cccggcttagcgagtgcttcgcaga

SEQ ID NO: 153452 - DNA, 25 bp, Homo sapien
tctctgcccattgagacaaaagagc

SEQ ID NO: 153453 - DNA, 25 bp, Homo sapien
tactgctagcaagactcgggagctg

SEQ ID NO: 153454 - DNA, 25 bp, Homo sapien
tttgagaccggatgcctgaaacacg

SEQ ID NO: 153455 - DNA, 25 bp, Homo sapien
gcagcgtatgctcccgcgtcgacag

SEQ ID NO: 153456 - DNA, 25 bp, Homo sapien
gcgagtccgagcctttgtctttctg

SEQ ID NO: 153457 - DNA, 25 bp, Homo sapien
cctgctagaaggcttagcactgcag

SEQ ID NO: 153458 - DNA, 25 bp, Homo sapien
gcggcgcctgctagaaggcttagca

SEQ ID NO: 153459 - DNA, 25 bp, Homo sapien
ttaaagcggccagtccgcggtagct

SEQ ID NO: 153460 - DNA, 25 bp, Homo sapien
tcagaggcttcgaggatgaagagtt

SEQ ID NO: 153461 - DNA, 25 bp, Homo sapien
agcctttgtctttctggggcgccgc

SEQ ID NO: 153462 - DNA, 25 bp, Homo sapien
cgtggccgttagactgggcgtctaa

SEQ ID NO: 153463 - DNA, 25 bp, Homo sapien
ggccgttagactgggcgtctaacaa

SEQ ID NO: 153464 - DNA, 25 bp, Homo sapien
ttacacagatagatgcctcacgggg

SEQ ID NO: 153465 - DNA, 25 bp, Homo sapien
ggcatctcgtcaaccaatcacagtg

SEQ ID NO: 153466 - DNA, 25 bp, Homo sapien
aacctacctgcgttgaaggtgactg

SEQ ID NO: 153467 - DNA, 25 bp, Homo sapien
gggagcctctcagcaaacctacctg

SEQ ID NO: 153468 - DNA, 25 bp, Homo sapien
gccagcttcacgtctgattggatga

SEQ ID NO: 153469 - DNA, 25 bp, Homo sapien
cacttcggtacgcagcatggctcca

SEQ ID NO: 153470 - DNA, 25 bp, Homo sapien
gtcgtctcagaggaaggtccagcca

SEQ ID NO: 153471 - DNA, 25 bp, Homo sapien
gctgttcctcagaggtcgtctcaga

SEQ ID NO: 153472 - DNA, 25 bp, Homo sapien
caccgaggctggtcagctggcccat

SEQ ID NO: 153473 - DNA, 25 bp, Homo sapien
ggattctatgatccatgacatattg

SEQ ID NO: 153474 - DNA, 25 bp, Homo sapien
ggtcagctggcccattacaccaagc

SEQ ID NO: 153475 - DNA, 25 bp, Homo sapien
tggcccattacaccaagcgcgtgac

SEQ ID NO: 153476 - DNA, 25 bp, Homo sapien
agcgcgtgaccatcacctcccggga

SEQ ID NO: 153477 - DNA, 25 bp, Homo sapien
tcccgggacatccagatggccgtgc

SEQ ID NO: 153478 - DNA, 25 bp, Homo sapien
ggacatccagatggccgtgcgactg

SEQ ID NO: 153479 - DNA, 25 bp, Homo sapien
acgccaaccgccgtggggacagctt

SEQ ID NO: 153480 - DNA, 25 bp, Homo sapien
tgccagccacgcagcagcttggaga

SEQ ID NO: 153481 - DNA, 25 bp, Homo sapien
taagcagcctttgcaggaagccgtg

SEQ ID NO: 153482 - DNA, 25 bp, Homo sapien
gctgggcctcgatccgagttctagc

SEQ ID NO: 153483 - DNA, 25 bp, Homo sapien
cagcttggagaggacccgtccttaa

SEQ ID NO: 153484 - DNA, 25 bp, Homo sapien
ctcagtcccgaaactggagcccaag

SEQ ID NO: 153485 - DNA, 25 bp, Homo sapien
ctcatcgcgtttgagttcgcagttg

SEQ ID NO: 153486 - DNA, 25 bp, Homo sapien
tcgcagttggtgtcctggttttcca

SEQ ID NO: 153487 - DNA, 25 bp, Homo sapien
tgcggtcaggcgcacataagcagcc

SEQ ID NO: 153488 - DNA, 25 bp, Homo sapien
ggctgccttgggaaccgtgctgcct

SEQ ID NO: 153489 - DNA, 25 bp, Homo sapien
tctcagtcgccagagactgaaagca

SEQ ID NO: 153490 - DNA, 25 bp, Homo sapien
gagcacaagtaaagaaagaacgcgc

SEQ ID NO: 153491 - DNA, 25 bp, Homo sapien
cctcgctgggcggtcgtgcgcactc

SEQ ID NO: 153492 - DNA, 25 bp, Homo sapien
tgcgcactcgctaggtcgggcagcc

SEQ ID NO: 153493 - DNA, 25 bp, Homo sapien
gtggacgcgggagcacatgctgccc

SEQ ID NO: 153494 - DNA, 25 bp, Homo sapien
cagtggagcacaagtaaagaaagaa

SEQ ID NO: 153495 - DNA, 25 bp, Homo sapien
tcgcccggcccgtcacgctcttttg

SEQ ID NO: 153496 - DNA, 25 bp, Homo sapien
acttccgttcccgtttgcctgctag

SEQ ID NO: 153497 - DNA, 25 bp, Homo sapien
cttaagcgacgcacaacggagctcc

SEQ ID NO: 153498 - DNA, 25 bp, Homo sapien
accgtttcgcgactacgtcagttgg

SEQ ID NO: 153499 - DNA, 25 bp, Homo sapien
ggcctcagaaagcagcgacagtcgc

SEQ ID NO: 153500 - DNA, 25 bp, Homo sapien
agaagtgctacaaacctccgcctcg

SEQ ID NO: 153501 - DNA, 25 bp, Homo sapien
cgccctcagcccataagaagtgcta

SEQ ID NO: 153502 - DNA, 25 bp, Homo sapien
agcaggatgtgtctacgccctcagc

SEQ ID NO: 153503 - DNA, 25 bp, Homo sapien
gcgacagtcgcagtcaccggacctt

SEQ ID NO: 153504 - DNA, 25 bp, Homo sapien
caggtacgaactgcacctgagggca

SEQ ID NO: 153505 - DNA, 25 bp, Homo sapien
tccacaccaacaggtacgaactgca

SEQ ID NO: 153506 - DNA, 25 bp, Homo sapien
agcgacttcggctgccagctgtcct

SEQ ID NO: 153507 - DNA, 25 bp, Homo sapien
cgggctgcctggacatcagcgactt

SEQ ID NO: 153508 - DNA, 25 bp, Homo sapien
tcggccatcacttcctacgagaagt

SEQ ID NO: 153509 - DNA, 25 bp, Homo sapien
tgccagtgagctgcgacgggcacac

SEQ ID NO: 153510 - DNA, 25 bp, Homo sapien
gtggattttccacttctggtcgccc

SEQ ID NO: 153511 - DNA, 25 bp, Homo sapien
agactgctgcagtcgcaagcggcga

SEQ ID NO: 153512 - DNA, 25 bp, Homo sapien
tgacacggggtccacatctcattga

SEQ ID NO: 153513 - DNA, 25 bp, Homo sapien
ggtttcaatccgtctcaactgcagc

SEQ ID NO: 153514 - DNA, 25 bp, Homo sapien
ccacatctcattgaattgcgggatg

SEQ ID NO: 153515 - DNA, 25 bp, Homo sapien
ttgcgggatgacgtggaaattaatg

SEQ ID NO: 153516 - DNA, 25 bp, Homo sapien
tgacgtggaaattaatgtgacacac

SEQ ID NO: 153517 - DNA, 25 bp, Homo sapien
tgtgacacacgggagatgtggaaca

SEQ ID NO: 153518 - DNA, 25 bp, Homo sapien
cttcgaaggcaggatgaggatgatt

SEQ ID NO: 153519 - DNA, 25 bp, Homo sapien
aggatgattgatccgaatcggtttc

SEQ ID NO: 153520 - DNA, 25 bp, Homo sapien
caaagcaggatccagagcaggagca

SEQ ID NO: 153521 - DNA, 25 bp, Homo sapien
taactgttgatgacaggggcccatg

SEQ ID NO: 153522 - DNA, 25 bp, Homo sapien
gcccatgtgatgtgtacaggagcca

SEQ ID NO: 153523 - DNA, 25 bp, Homo sapien
gccagtgtgaggcacatgtgacctg

SEQ ID NO: 153524 - DNA, 25 bp, Homo sapien
cagcacaggtggtctaggtagttgt

SEQ ID NO: 153525 - DNA, 25 bp, Homo sapien
aggtagttgtggcaccagatgaaca

SEQ ID NO: 153526 - DNA, 25 bp, Homo sapien
ccagatgaacacacaaagcaggatc

SEQ ID NO: 153527 - DNA, 25 bp, Homo sapien
ctatctggcaggaaagaactttgga

SEQ ID NO: 153528 - DNA, 25 bp, Homo sapien
tgccaggctgcggtagccaatatca

SEQ ID NO: 153529 - DNA, 25 bp, Homo sapien
catcagcgaggtcacggtaagtttc

SEQ ID NO: 153530 - DNA, 25 bp, Homo sapien
ccctatatagcggtacggtgccttc

SEQ ID NO: 153531 - DNA, 25 bp, Homo sapien
ggacccgctatggaagagcaactgc

SEQ ID NO: 153532 - DNA, 25 bp, Homo sapien
ccgcgccacaacgtcgggatattga

SEQ ID NO: 153533 - DNA, 25 bp, Homo sapien
cgctgtcgataaagctgtgcacttc

SEQ ID NO: 153534 - DNA, 25 bp, Homo sapien
tccgtactcaggtttggaccgtgta

SEQ ID NO: 153535 - DNA, 25 bp, Homo sapien
gtgtacccgcgaagagactccatgc

SEQ ID NO: 153536 - DNA, 25 bp, Homo sapien
cgtgccacgtaccaaacgctcaatt

SEQ ID NO: 153537 - DNA, 25 bp, Homo sapien
ctgcgatctagaaacgctgctagtc

SEQ ID NO: 153538 - DNA, 25 bp, Homo sapien
cgggactcttcaacgctgcgatcta

SEQ ID NO: 153539 - DNA, 25 bp, Homo sapien
tctgggaagatacctggcgtggcaa

SEQ ID NO: 153540 - DNA, 25 bp, Homo sapien
aggtgtgttaatcagtgcggcgccc

SEQ ID NO: 153541 - DNA, 25 bp, Homo sapien
agcgctcagctgacccgttaaatga

SEQ ID NO: 153542 - DNA, 25 bp, Homo sapien
tctcgttcgctctctgtggctaatg

SEQ ID NO: 153543 - DNA, 25 bp, Homo sapien
gggccctgtatccatctctcgttcg

SEQ ID NO: 153544 - DNA, 25 bp, Homo sapien
ctgtactgtccgctgtttggggaga

SEQ ID NO: 153545 - DNA, 25 bp, Homo sapien
gccaatggaggctttatctttcctg

SEQ ID NO: 153546 - DNA, 25 bp, Homo sapien
tcaggtaatgtccactcgcagagct

SEQ ID NO: 153547 - DNA, 25 bp, Homo sapien
cgagcccaagcgttgcgtttccgcg

SEQ ID NO: 153548 - DNA, 25 bp, Homo sapien
ctggccgttttgcaagactcaggta

SEQ ID NO: 153549 - DNA, 25 bp, Homo sapien
acctgctggacgttttgctggccgt

SEQ ID NO: 153550 - DNA, 25 bp, Homo sapien
cgccctggacatggaactacgcatc

SEQ ID NO: 153551 - DNA, 25 bp, Homo sapien
ggtctccgcgcctggaaatttgcca

SEQ ID NO: 153552 - DNA, 25 bp, Homo sapien
cgaaatgctctcttttggcgggttc

SEQ ID NO: 153553 - DNA, 25 bp, Homo sapien
cctggcgacgtgacgctgcaccaat

SEQ ID NO: 153554 - DNA, 25 bp, Homo sapien
gcagacacagcgctctcgacacgga

SEQ ID NO: 153555 - DNA, 25 bp, Homo sapien
tcgacacggagcacccttctagctt

SEQ ID NO: 153556 - DNA, 25 bp, Homo sapien
agactctgcgcgcacccaattcagt

SEQ ID NO: 153557 - DNA, 25 bp, Homo sapien
tcaaaacgggctagaccaggacttc

SEQ ID NO: 153558 - DNA, 25 bp, Homo sapien
cgcaaaccgttatagtccttcagca

SEQ ID NO: 153559 - DNA, 25 bp, Homo sapien
ctagcttcttcgtctccaggactga

SEQ ID NO: 153560 - DNA, 25 bp, Homo sapien
caaagcgcgcggttttatttctctc

SEQ ID NO: 153561 - DNA, 25 bp, Homo sapien
gcagagtagcgatcgtcgccaaagc

SEQ ID NO: 153562 - DNA, 25 bp, Homo sapien
agtcttgcctgtcagcaggggcaga

SEQ ID NO: 153563 - DNA, 25 bp, Homo sapien
agtctttgcagcctcgctacggggc

SEQ ID NO: 153564 - DNA, 25 bp, Homo sapien
gcgcgcacgcgtaaagtctttgcag

SEQ ID NO: 153565 - DNA, 25 bp, Homo sapien
ctgcctagtaacagtgtctcgagtc

SEQ ID NO: 153566 - DNA, 25 bp, Homo sapien
taactcgcgcgtgtgactgcctagt

SEQ ID NO: 153567 - DNA, 25 bp, Homo sapien
ggtcggacgacctgctacgtaactc

SEQ ID NO: 153568 - DNA, 25 bp, Homo sapien
tggattagtcgggtctgcccgcgcc

SEQ ID NO: 153569 - DNA, 25 bp, Homo sapien
ctccagagagggaattgggactttg

SEQ ID NO: 153570 - DNA, 25 bp, Homo sapien
ccagaagagcgggacgcccgagatc

SEQ ID NO: 153571 - DNA, 25 bp, Homo sapien
cacctgccccgagttggagttcttt

SEQ ID NO: 153572 - DNA, 25 bp, Homo sapien
tcgggtcctcgcagacaaagcgcgc

SEQ ID NO: 153573 - DNA, 25 bp, Homo sapien
ctgtaccctgggcttgagtgatcct

SEQ ID NO: 153574 - DNA, 25 bp, Homo sapien
cgctgcggactccagagagggaatt

SEQ ID NO: 153575 - DNA, 25 bp, Homo sapien
ccctgggcttgagtgatcctctacc

SEQ ID NO: 153576 - DNA, 25 bp, Homo sapien
atcctgccagaaagctttatgtttg

SEQ ID NO: 153577 - DNA, 25 bp, Homo sapien
gcatctgcggcaacctgtgtgctga

SEQ ID NO: 153578 - DNA, 25 bp, Homo sapien
gggctgcaccttcgcagacaagatc

SEQ ID NO: 153579 - DNA, 25 bp, Homo sapien
cgaatttcacggtgcccacggtttg

SEQ ID NO: 153580 - DNA, 25 bp, Homo sapien
gcaagtctcttggttggccctcatc

SEQ ID NO: 153581 - DNA, 25 bp, Homo sapien
tggctgcggcttttccagattgctg

SEQ ID NO: 153582 - DNA, 25 bp, Homo sapien
gcctgtaacccgcacacgaatttca

SEQ ID NO: 153583 - DNA, 25 bp, Homo sapien
gtctggagccgtcatctttaacttc

SEQ ID NO: 153584 - DNA, 25 bp, Homo sapien
agctatcctaaagtgcccgaacgtc

SEQ ID NO: 153585 - DNA, 25 bp, Homo sapien
agaaatatggcgacctcctgacagc

SEQ ID NO: 153586 - DNA, 25 bp, Homo sapien
tcagggcccgaggtttttatgcatc

SEQ ID NO: 153587 - DNA, 25 bp, Homo sapien
gcgcgagagaaaaaccacactggtg

SEQ ID NO: 153588 - DNA, 25 bp, Homo sapien
gaacctagttcctggcgagagagcc

SEQ ID NO: 153589 - DNA, 25 bp, Homo sapien
tcctccgttttatgagcggaaccta

SEQ ID NO: 153590 - DNA, 25 bp, Homo sapien
tgcctctgggccgtacagaaatatg

SEQ ID NO: 153591 - DNA, 25 bp, Homo sapien
tagcagctccgcgatggcactgaag

SEQ ID NO: 153592 - DNA, 25 bp, Homo sapien
aagcgctacatggtttcggggccca

SEQ ID NO: 153593 - DNA, 25 bp, Homo sapien
tcggggcccaagcaagtagtcttta

SEQ ID NO: 153594 - DNA, 25 bp, Homo sapien
gacgttgcaaataaatgcgcccgcc

SEQ ID NO: 153595 - DNA, 25 bp, Homo sapien
gaggtacctacatctccggcgccgg

SEQ ID NO: 153596 - DNA, 25 bp, Homo sapien
gcgccgggaatttgtcagcctcaaa

SEQ ID NO: 153597 - DNA, 25 bp, Homo sapien
tcaaacccttttgcccagctgggtc

SEQ ID NO: 153598 - DNA, 25 bp, Homo sapien
gtggcagcccttcctgaacttcgct

SEQ ID NO: 153599 - DNA, 25 bp, Homo sapien
gtccgggtgaaacgacgaagccgca

SEQ ID NO: 153600 - DNA, 25 bp, Homo sapien
ggacctgctcgagccggaaagaatc

SEQ ID NO: 153601 - DNA, 25 bp, Homo sapien
cggaagccttgcctacagaggagaa

SEQ ID NO: 153602 - DNA, 25 bp, Homo sapien
cgtggaggactgtagcaaaaccttc

SEQ ID NO: 153603 - DNA, 25 bp, Homo sapien
ttcgagtcctcagatcgggaattca

SEQ ID NO: 153604 - DNA, 25 bp, Homo sapien
gcctgctgacgaacgggacaaacga

SEQ ID NO: 153605 - DNA, 25 bp, Homo sapien
gcctccgagactgctagacgccaga

SEQ ID NO: 153606 - DNA, 25 bp, Homo sapien
gcaggttcccgctgaagtgaagcta

SEQ ID NO: 153607 - DNA, 25 bp, Homo sapien
tcccggagtcgcgatgttccttaga

SEQ ID NO: 153608 - DNA, 25 bp, Homo sapien
gtaattgcagccagacagtaacctc

SEQ ID NO: 153609 - DNA, 25 bp, Homo sapien
ttcctcctcggggaacacatgggca

SEQ ID NO: 153610 - DNA, 25 bp, Homo sapien
agggtgagtaatttccgagcgtgca

SEQ ID NO: 153611 - DNA, 25 bp, Homo sapien
tccgagcgtgcaattataaagaacc

SEQ ID NO: 153612 - DNA, 25 bp, Homo sapien
ataaagaaccggagtgcagcagctc

SEQ ID NO: 153613 - DNA, 25 bp, Homo sapien
ttcccgcagtgtgcacgtaattgca

SEQ ID NO: 153614 - DNA, 25 bp, Homo sapien
cagtaacctcgctgtggcctgtgtc

SEQ ID NO: 153615 - DNA, 25 bp, Homo sapien
cccagccgttgcagggtgagtaatt

SEQ ID NO: 153616 - DNA, 25 bp, Homo sapien
tttgagtacgcggaagccagtcatc

SEQ ID NO: 153617 - DNA, 25 bp, Homo sapien
ctccgagggtgaagaaatcgacgtg

SEQ ID NO: 153618 - DNA, 25 bp, Homo sapien
cctcgggatactcgcccaaggagtt

SEQ ID NO: 153619 - DNA, 25 bp, Homo sapien
ctactggaaagcttgggacgcgaac

SEQ ID NO: 153620 - DNA, 25 bp, Homo sapien
acgagacggaatcccaggactactg

SEQ ID NO: 153621 - DNA, 25 bp, Homo sapien
gaccgcgactcgtaccatcactatt

SEQ ID NO: 153622 - DNA, 25 bp, Homo sapien
ctgcgtgagcaagcaagccaacatg

SEQ ID NO: 153623 - DNA, 25 bp, Homo sapien
aactagtctgctccaggtggcaagc

SEQ ID NO: 153624 - DNA, 25 bp, Homo sapien
ggccatgttcacaagcggacacgga

SEQ ID NO: 153625 - DNA, 25 bp, Homo sapien
ggttcccggggccatgttcacaagc

SEQ ID NO: 153626 - DNA, 25 bp, Homo sapien
ctgtctgaagcatgtgcgtggttcc

SEQ ID NO: 153627 - DNA, 25 bp, Homo sapien
ggggctgccagaaacagctgtctga

SEQ ID NO: 153628 - DNA, 25 bp, Homo sapien
cgttcattatggagcctttgtgtgc

SEQ ID NO: 153629 - DNA, 25 bp, Homo sapien
gagtgcagcgcgttcattatggagc

SEQ ID NO: 153630 - DNA, 25 bp, Homo sapien
gtaacggcccgttgcgtgcccactg

SEQ ID NO: 153631 - DNA, 25 bp, Homo sapien
ggaaatcgacgccagcactcgaggg

SEQ ID NO: 153632 - DNA, 25 bp, Homo sapien
ttaagattctggtcacagcaggggc

SEQ ID NO: 153633 - DNA, 25 bp, Homo sapien
tgagccagtcgcctccttctttaag

SEQ ID NO: 153634 - DNA, 25 bp, Homo sapien
ggcaggtttctaaggtgtcttccta

SEQ ID NO: 153635 - DNA, 25 bp, Homo sapien
agacaccgctgctgctaccttgcta

SEQ ID NO: 153636 - DNA, 25 bp, Homo sapien
cccgacggtaagtactgcgctctga

SEQ ID NO: 153637 - DNA, 25 bp, Homo sapien
gcgcgtcggaagcagacatccatct

SEQ ID NO: 153638 - DNA, 25 bp, Homo sapien
accttgctaccttcagcgctgggca

SEQ ID NO: 153639 - DNA, 25 bp, Homo sapien
cgccgtgtttacagctctctcgcta

SEQ ID NO: 153640 - DNA, 25 bp, Homo sapien
tggcggagtagcaacgcaaagcgct

SEQ ID NO: 153641 - DNA, 25 bp, Homo sapien
tattgagtctgtggccgacttcggt

SEQ ID NO: 153642 - DNA, 25 bp, Homo sapien
acttcggttccggtctctgcagcag

SEQ ID NO: 153643 - DNA, 25 bp, Homo sapien
ccctcttagctaatcgttgccagcg

SEQ ID NO: 153644 - DNA, 25 bp, Homo sapien
tagctaatcgttgccagcggggtgt

SEQ ID NO: 153645 - DNA, 25 bp, Homo sapien
tttgggtaatttagagccgcgcgcc

SEQ ID NO: 153646 - DNA, 25 bp, Homo sapien
cgcaaagcgcttggtattgagtctg

SEQ ID NO: 153647 - DNA, 25 bp, Homo sapien
ctccgccgctttgggtaatttagag

SEQ ID NO: 153648 - DNA, 25 bp, Homo sapien
ggcggcacacagctcgctcagagac

SEQ ID NO: 153649 - DNA, 25 bp, Homo sapien
ggacgcttcgatgacggatcccaga

SEQ ID NO: 153650 - DNA, 25 bp, Homo sapien
agcagctggttttcacggcgcagcg

SEQ ID NO: 153651 - DNA, 25 bp, Homo sapien
ggcctgctcgggcaatatgcaaaca

SEQ ID NO: 153652 - DNA, 25 bp, Homo sapien
caggcaaacctacccggctctgaag

SEQ ID NO: 153653 - DNA, 25 bp, Homo sapien
ggctggtaagcttccggccttctcc

SEQ ID NO: 153654 - DNA, 25 bp, Homo sapien
cggctctgaagctagctaggaattc

SEQ ID NO: 153655 - DNA, 25 bp, Homo sapien
taggaattccttctcggctggtaag

SEQ ID NO: 153656 - DNA, 25 bp, Homo sapien
tgaagcccattagccggggcgcctt

SEQ ID NO: 153657 - DNA, 25 bp, Homo sapien
aaaccgccctccattgaggaattca

SEQ ID NO: 153658 - DNA, 25 bp, Homo sapien
cgtgaataggatcgcagtgccaaaa

SEQ ID NO: 153659 - DNA, 25 bp, Homo sapien
ccaccgcgggaagcaagaaggagcc

SEQ ID NO: 153660 - DNA, 25 bp, Homo sapien
tgctgtccagcgatggatcccaccg

SEQ ID NO: 153661 - DNA, 25 bp, Homo sapien
ggaattcagcatagtgaagcccatt

SEQ ID NO: 153662 - DNA, 25 bp, Homo sapien
cggagcctcactttgaacccagttg

SEQ ID NO: 153663 - DNA, 25 bp, Homo sapien
tcgccgcccacgaagagtgtaaggc

SEQ ID NO: 153664 - DNA, 25 bp, Homo sapien
ggctgacacatacctacgactgtac

SEQ ID NO: 153665 - DNA, 25 bp, Homo sapien
gacacatacctacgactgtacactc

SEQ ID NO: 153666 - DNA, 25 bp, Homo sapien
ccggctgacacatacctacgactgt

SEQ ID NO: 153667 - DNA, 25 bp, Homo sapien
tccggctgacacatacctacgactg

SEQ ID NO: 153668 - DNA, 25 bp, Homo sapien
ctgacacatacctacgactgtacac

SEQ ID NO: 153669 - DNA, 25 bp, Homo sapien
gctgacacatacctacgactgtaca

SEQ ID NO: 153670 - DNA, 25 bp, Homo sapien
cggctgacacatacctacgactgta

SEQ ID NO: 153671 - DNA, 25 bp, Homo sapien
acacatacctacgactgtacactca

SEQ ID NO: 153672 - DNA, 25 bp, Homo sapien
tctagtctcacctcgaatgggtccc

SEQ ID NO: 153673 - DNA, 25 bp, Homo sapien
gacgcttcggttcaggctctttcag

SEQ ID NO: 153674 - DNA, 25 bp, Homo sapien
cagcactgggatatgacagcatgta

SEQ ID NO: 153675 - DNA, 25 bp, Homo sapien
cgcagtcccaagtttcccaagtgtg

SEQ ID NO: 153676 - DNA, 25 bp, Homo sapien
gagcggatccttcgggctcacttcc

SEQ ID NO: 153677 - DNA, 25 bp, Homo sapien
actgctccgggtgcgaatagaaaca

SEQ ID NO: 153678 - DNA, 25 bp, Homo sapien
actgggccatcttctcaggctcgga

SEQ ID NO: 153679 - DNA, 25 bp, Homo sapien
cgtgagggcaaatgtctctagtctc

SEQ ID NO: 153680 - DNA, 25 bp, Homo sapien
tcttaagtttagctcgggaggccca

SEQ ID NO: 153681 - DNA, 25 bp, Homo sapien
ggcacctgggaacgctatgggtaaa

SEQ ID NO: 153682 - DNA, 25 bp, Homo sapien
tcgtagccctcgcagggctagtctc

SEQ ID NO: 153683 - DNA, 25 bp, Homo sapien
ggctccggccgcttttcaggtgccg

SEQ ID NO: 153684 - DNA, 25 bp, Homo sapien
caacccgctgcggaggcagacgaga

SEQ ID NO: 153685 - DNA, 25 bp, Homo sapien
ccttttctgccagggagcgatcctc

SEQ ID NO: 153686 - DNA, 25 bp, Homo sapien
cctcctgggacggagtttgcactcc

SEQ ID NO: 153687 - DNA, 25 bp, Homo sapien
gctccggctctcagtcatgctgttg

SEQ ID NO: 153688 - DNA, 25 bp, Homo sapien
ctccagaagccagccattgggagga

SEQ ID NO: 153689 - DNA, 25 bp, Homo sapien
agcgtgaagactcaccgagaagccc

SEQ ID NO: 153690 - DNA, 25 bp, Homo sapien
cgagtggtgacatggagatgctttc

SEQ ID NO: 153691 - DNA, 25 bp, Homo sapien
tgcaagcgcttgcaagtgcgtgcaa

SEQ ID NO: 153692 - DNA, 25 bp, Homo sapien
tcctgcgctgtgagctcagcgcgct

SEQ ID NO: 153693 - DNA, 25 bp, Homo sapien
tgatttacacaggtgcggacgtggc

SEQ ID NO: 153694 - DNA, 25 bp, Homo sapien
gggacatgcgaagatgtgatttaca

SEQ ID NO: 153695 - DNA, 25 bp, Homo sapien
atgctttcgagcgtgaagactcacc

SEQ ID NO: 153696 - DNA, 25 bp, Homo sapien
cctagcgttgctttacctggtcagt

SEQ ID NO: 153697 - DNA, 25 bp, Homo sapien
gcttctctcagaaacggggcctccg

SEQ ID NO: 153698 - DNA, 25 bp, Homo sapien
ccagggatttatcggccagaatact

SEQ ID NO: 153699 - DNA, 25 bp, Homo sapien
ctgtaggccaggttgcagaccatta

SEQ ID NO: 153700 - DNA, 25 bp, Homo sapien
cagcaactacttgtcgcgcgagcaa

SEQ ID NO: 153701 - DNA, 25 bp, Homo sapien
gcctttgctgccctcacagacttgg

SEQ ID NO: 153702 - DNA, 25 bp, Homo sapien
gaccgtccgtccgtagtcaagttgc

SEQ ID NO: 153703 - DNA, 25 bp, Homo sapien
ccgggccaacgggaaaatatctgag

SEQ ID NO: 153704 - DNA, 25 bp, Homo sapien
cgagccaccggcaacgtcttgggct

SEQ ID NO: 153705 - DNA, 25 bp, Homo sapien
tcgtcgtcgttgtcagaatcttctc

SEQ ID NO: 153706 - DNA, 25 bp, Homo sapien
agcctggttatcacctctggcaagg

SEQ ID NO: 153707 - DNA, 25 bp, Homo sapien
tactgcttcggcatcagcagcatta

SEQ ID NO: 153708 - DNA, 25 bp, Homo sapien
cagcagcattagcaacaggttgaaa

SEQ ID NO: 153709 - DNA, 25 bp, Homo sapien
cagaggcggagtcaaatccagcagc

SEQ ID NO: 153710 - DNA, 25 bp, Homo sapien
gaggccgcagctacaacttggctga

SEQ ID NO: 153711 - DNA, 25 bp, Homo sapien
tgagggctaaagtcggctctgcagc

SEQ ID NO: 153712 - DNA, 25 bp, Homo sapien
tttccaccgtacgaggcagtgcgtc

SEQ ID NO: 153713 - DNA, 25 bp, Homo sapien
ctgggagggttgaatcgttctgtaa

SEQ ID NO: 153714 - DNA, 25 bp, Homo sapien
cgtcgtgttgcaacgtacggtgaca

SEQ ID NO: 153715 - DNA, 25 bp, Homo sapien
gcttctgataggtcctgggctgttt

SEQ ID NO: 153716 - DNA, 25 bp, Homo sapien
agtccaggtacgacagcttctgata

SEQ ID NO: 153717 - DNA, 25 bp, Homo sapien
ccagctggtactgaaagtccaggta

SEQ ID NO: 153718 - DNA, 25 bp, Homo sapien
cctttctgtggacgtccagctggta

SEQ ID NO: 153719 - DNA, 25 bp, Homo sapien
ggagctctcaccgacctttctgtgg

SEQ ID NO: 153720 - DNA, 25 bp, Homo sapien
gccacttcggtgttcagcctcacaa

SEQ ID NO: 153721 - DNA, 25 bp, Homo sapien
ctcggccaccatcgcgaagtattcg

SEQ ID NO: 153722 - DNA, 25 bp, Homo sapien
tttcgtagtattccagccgagctgg

SEQ ID NO: 153723 - DNA, 25 bp, Homo sapien
gcccatgcttctgtttccgcaggta

SEQ ID NO: 153724 - DNA, 25 bp, Homo sapien
gcaggtcctcctcttcggactcgga

SEQ ID NO: 153725 - DNA, 25 bp, Homo sapien
atctttatagaagggtggctccgcc

SEQ ID NO: 153726 - DNA, 25 bp, Homo sapien
gctgctgcacctcttagtcttcttg

SEQ ID NO: 153727 - DNA, 25 bp, Homo sapien
catctgctcgctggctcacggaaaa

SEQ ID NO: 153728 - DNA, 25 bp, Homo sapien
tatccagcgaaaccacagccaaggg

SEQ ID NO: 153729 - DNA, 25 bp, Homo sapien
tcagcggggaaagaagactctgttg

SEQ ID NO: 153730 - DNA, 25 bp, Homo sapien
ggccgccggtgaaataccactactc

SEQ ID NO: 153731 - DNA, 25 bp, Homo sapien
atgaacgagattcccactgtcccta

SEQ ID NO: 153732 - DNA, 25 bp, Homo sapien
cgtcatctaattagtgaggcgcatg

SEQ ID NO: 153733 - DNA, 25 bp, Homo sapien
aggtagccaaatgcctcgtcatcta

SEQ ID NO: 153734 - DNA, 25 bp, Homo sapien
atgcgatgtgatttctgcccagtgc

SEQ ID NO: 153735 - DNA, 25 bp, Homo sapien
tgactctagtctggcacggtgaaga

SEQ ID NO: 153736 - DNA, 25 bp, Homo sapien
tgtgcttttaacgacggaccgagct

SEQ ID NO: 153737 - DNA, 25 bp, Homo sapien
ggaccgagctacttccgggagagaa

SEQ ID NO: 153738 - DNA, 25 bp, Homo sapien
gcgggtttcgctctcttcataagta

SEQ ID NO: 153739 - DNA, 25 bp, Homo sapien
agtattgatcattccgcagccctgc

SEQ ID NO: 153740 - DNA, 25 bp, Homo sapien
actgctacaaggtcccagatggcca

SEQ ID NO: 153741 - DNA, 25 bp, Homo sapien
agatggccacgtctctggtgagtgc

SEQ ID NO: 153742 - DNA, 25 bp, Homo sapien
tgctcacgtggataggtgacgaatc

SEQ ID NO: 153743 - DNA, 25 bp, Homo sapien
tgacgaatcacgtcccggctctctg

SEQ ID NO: 153744 - DNA, 25 bp, Homo sapien
ctctcgctgcagttcatggctttcg

SEQ ID NO: 153745 - DNA, 25 bp, Homo sapien
gtgcagctcgagcaacaggcggctc

SEQ ID NO: 153746 - DNA, 25 bp, Homo sapien
cggcccacgaaagggtcaggcacga

SEQ ID NO: 153747 - DNA, 25 bp, Homo sapien
gtagagataggcgtcgtcgcccttg

SEQ ID NO: 153748 - DNA, 25 bp, Homo sapien
tccggccaagcaggcgtagaagatc

SEQ ID NO: 153749 - DNA, 25 bp, Homo sapien
gacggctcgtccttggcctcgacga

SEQ ID NO: 153750 - DNA, 25 bp, Homo sapien
tgtggttttagacccgctcagcgcc

SEQ ID NO: 153751 - DNA, 25 bp, Homo sapien
ctcagcagcggaaacagcggtagca

SEQ ID NO: 153752 - DNA, 25 bp, Homo sapien
gacccgacaggacggccctagagga

SEQ ID NO: 153753 - DNA, 25 bp, Homo sapien
tctccaggcggagcgcacaccgggt

SEQ ID NO: 153754 - DNA, 25 bp, Homo sapien
tagacggcgaactcccggagccacg

SEQ ID NO: 153755 - DNA, 25 bp, Homo sapien
tgctgccgccacagtagcagggacc

SEQ ID NO: 153756 - DNA, 25 bp, Homo sapien
gagcagtgagttgtcatcccgggta

SEQ ID NO: 153757 - DNA, 25 bp, Homo sapien
tatacggtgcgcactagggactctc

SEQ ID NO: 153758 - DNA, 25 bp, Homo sapien
tgtcagctggaattgacggtatacg

SEQ ID NO: 153759 - DNA, 25 bp, Homo sapien
tgtcatcccgggtagacggcgaact

SEQ ID NO: 153760 - DNA, 25 bp, Homo sapien
aacggctcgcctcaagttgttgctc

SEQ ID NO: 153761 - DNA, 25 bp, Homo sapien
atccagggatactcaccggaggggc

SEQ ID NO: 153762 - DNA, 25 bp, Homo sapien
tcgcaaaaaggaaccgcgtgcccgc

SEQ ID NO: 153763 - DNA, 25 bp, Homo sapien
tggcgatccgcttctgtcagtctcg

SEQ ID NO: 153764 - DNA, 25 bp, Homo sapien
ttcgggatgtccttgcgcctaacag

SEQ ID NO: 153765 - DNA, 25 bp, Homo sapien
cctaacagcagtgaggcgcagaatt

SEQ ID NO: 153766 - DNA, 25 bp, Homo sapien
ctggcactcggaaagctcgcaaaaa

SEQ ID NO: 153767 - DNA, 25 bp, Homo sapien
tccaggagctggaatgcccacccaa

SEQ ID NO: 153768 - DNA, 25 bp, Homo sapien
tgccgcagcactgccgggtctcctt

SEQ ID NO: 153769 - DNA, 25 bp, Homo sapien
tccctctgtggcgagtgcgtgagac

SEQ ID NO: 153770 - DNA, 25 bp, Homo sapien
taagagatccctctgtggcgagtgc

SEQ ID NO: 153771 - DNA, 25 bp, Homo sapien
cggttgcaggagtaagagatccctc

SEQ ID NO: 153772 - DNA, 25 bp, Homo sapien
ccacgcggttgcaggagtaagagat

SEQ ID NO: 153773 - DNA, 25 bp, Homo sapien
cccgtcggcggcgaagttgctagct

SEQ ID NO: 153774 - DNA, 25 bp, Homo sapien
ttttggctcccggttcgctgccgca

SEQ ID NO: 153775 - DNA, 25 bp, Homo sapien
caaggacggctctaaattggctgga

SEQ ID NO: 153776 - DNA, 25 bp, Homo sapien
catacaggtgacagtagagcacatc

SEQ ID NO: 153777 - DNA, 25 bp, Homo sapien
ggcacggtactcactagggctcgtt

SEQ ID NO: 153778 - DNA, 25 bp, Homo sapien
tcactagggctcgttggtgaatcgg

SEQ ID NO: 153779 - DNA, 25 bp, Homo sapien
gggctgctggtatccatacaggtga

SEQ ID NO: 153780 - DNA, 25 bp, Homo sapien
gtagagcacatcgaagcaaaagcag

SEQ ID NO: 153781 - DNA, 25 bp, Homo sapien
tccgacccataagtgaggcgagctg

SEQ ID NO: 153782 - DNA, 25 bp, Homo sapien
ggcggactcgcactttgcctcaact

SEQ ID NO: 153783 - DNA, 25 bp, Homo sapien
cgcagcgtttccgacccataagtga

SEQ ID NO: 153784 - DNA, 25 bp, Homo sapien
gaagtccgcaagcacgcagccgctg

SEQ ID NO: 153785 - DNA, 25 bp, Homo sapien
agccgctgcaagcacgcacactttc

SEQ ID NO: 153786 - DNA, 25 bp, Homo sapien
ctggcgggaagtccgcaagcacgca

SEQ ID NO: 153787 - DNA, 25 bp, Homo sapien
tgggaggaaaaacatcaccgccctc

SEQ ID NO: 153788 - DNA, 25 bp, Homo sapien
gccttctccgtctgccacgcgtgca

SEQ ID NO: 153789 - DNA, 25 bp, Homo sapien
gctcactaacctgggcactggcctt

SEQ ID NO: 153790 - DNA, 25 bp, Homo sapien
cgggcactgctcactaacctgggca

SEQ ID NO: 153791 - DNA, 25 bp, Homo sapien
ccaccccggcacaatggctttattt

SEQ ID NO: 153792 - DNA, 25 bp, Homo sapien
ggtaaatcccgcgactaactgcacc

SEQ ID NO: 153793 - DNA, 25 bp, Homo sapien
tggatccgtggcaggtaaatcccgc

SEQ ID NO: 153794 - DNA, 25 bp, Homo sapien
gtgacgtaatagcagagaagggcta

SEQ ID NO: 153795 - DNA, 25 bp, Homo sapien
gcgactaactgcacccgggctaccg

SEQ ID NO: 153796 - DNA, 25 bp, Homo sapien
tggcaggtaaatcccgcgactaact

SEQ ID NO: 153797 - DNA, 25 bp, Homo sapien
tgccagctaaccgtctgggatctcg

SEQ ID NO: 153798 - DNA, 25 bp, Homo sapien
ggcagctgtgccagctaaccgtctg

SEQ ID NO: 153799 - DNA, 25 bp, Homo sapien
cgctcggaggtagaggaaaggtctt

SEQ ID NO: 153800 - DNA, 25 bp, Homo sapien
gcgcagtgccgagagtccatgactc

SEQ ID NO: 153801 - DNA, 25 bp, Homo sapien
agtgccgagagtccatgactcggta

SEQ ID NO: 153802 - DNA, 25 bp, Homo sapien
tgccgagagtccatgactcggtagc

SEQ ID NO: 153803 - DNA, 25 bp, Homo sapien
cgagagtccatgactcggtagcact

SEQ ID NO: 153804 - DNA, 25 bp, Homo sapien
tcaggtcctggtattcccgatacag

SEQ ID NO: 153805 - DNA, 25 bp, Homo sapien
cctggtattcccgatacaggttgtg

SEQ ID NO: 153806 - DNA, 25 bp, Homo sapien
tggtattcccgatacaggttgtggg

SEQ ID NO: 153807 - DNA, 25 bp, Homo sapien
gagtccatgactcggtagcactggg

SEQ ID NO: 153808 - DNA, 25 bp, Homo sapien
cgcccgacagtctgcaagtgagtga

SEQ ID NO: 153809 - DNA, 25 bp, Homo sapien
cgagctgggtcgcttagattcatga

SEQ ID NO: 153810 - DNA, 25 bp, Homo sapien
cccggttctcgcagttgatcaagtg

SEQ ID NO: 153811 - DNA, 25 bp, Homo sapien
tgaccgtcgcgctcggaaagaaacc

SEQ ID NO: 153812 - DNA, 25 bp, Homo sapien
gtggcctcagttgcgtcatatccgg

SEQ ID NO: 153813 - DNA, 25 bp, Homo sapien
acccgcgccatgaagtgcgtgtttg

SEQ ID NO: 153814 - DNA, 25 bp, Homo sapien
tgcgtgtttgttaccgtagggacca

SEQ ID NO: 153815 - DNA, 25 bp, Homo sapien
gggaccaccagctttgacgacctca

SEQ ID NO: 153816 - DNA, 25 bp, Homo sapien
cgcgaaacagcagccgactgggaca

SEQ ID NO: 153817 - DNA, 25 bp, Homo sapien
ggactcctcttttgcggcgcgaaac

SEQ ID NO: 153818 - DNA, 25 bp, Homo sapien
atgtccaccggccaggatgcgtggt

SEQ ID NO: 153819 - DNA, 25 bp, Homo sapien
aatctgtgtcgtctggatgtccacc

SEQ ID NO: 153820 - DNA, 25 bp, Homo sapien
tttcggataaaatctgtgtcgtctg

SEQ ID NO: 153821 - DNA, 25 bp, Homo sapien
tgagccaagtggttttttcggataa

SEQ ID NO: 153822 - DNA, 25 bp, Homo sapien
tgtagacttaccctgagccaagtgg

SEQ ID NO: 153823 - DNA, 25 bp, Homo sapien
cggccgcctgtagacttaccctgag

SEQ ID NO: 153824 - DNA, 25 bp, Homo sapien
agaagacaaggtgacgactctctgc

SEQ ID NO: 153825 - DNA, 25 bp, Homo sapien
aggtcacagctctgcgagacaccct

SEQ ID NO: 153826 - DNA, 25 bp, Homo sapien
gaaaagcagcttccaccaaagcctg

SEQ ID NO: 153827 - DNA, 25 bp, Homo sapien
cacgactcggttgccgtagccgtga

SEQ ID NO: 153828 - DNA, 25 bp, Homo sapien
tcgccttcccactagaggggcacga

SEQ ID NO: 153829 - DNA, 25 bp, Homo sapien
ggcttttcttcttgcggtgagcggc

SEQ ID NO: 153830 - DNA, 25 bp, Homo sapien
gggtctaccagtttaggcagccaga

SEQ ID NO: 153831 - DNA, 25 bp, Homo sapien
actctctgctcgctcaagtggcttc

SEQ ID NO: 153832 - DNA, 25 bp, Homo sapien
ctcttgcctctagatgccagcctgg

SEQ ID NO: 153833 - DNA, 25 bp, Homo sapien
cacaggccatctgtgtgcggggaca

SEQ ID NO: 153834 - DNA, 25 bp, Homo sapien
ccggtaggtgtctcggccacaatct

SEQ ID NO: 153835 - DNA, 25 bp, Homo sapien
agtgccaggtgactatccgcctcgc

SEQ ID NO: 153836 - DNA, 25 bp, Homo sapien
tggtacttggtcacaggctcctctc

SEQ ID NO: 153837 - DNA, 25 bp, Homo sapien
tctcattcagccagccaatcatgta

SEQ ID NO: 153838 - DNA, 25 bp, Homo sapien
tattgccagcctcattcgggaattc

SEQ ID NO: 153839 - DNA, 25 bp, Homo sapien
acgtacagacgcgtgttcacactga

SEQ ID NO: 153840 - DNA, 25 bp, Homo sapien
tggcaagcacagacgccacgtccta

SEQ ID NO: 153841 - DNA, 25 bp, Homo sapien
ttgcgaggagactggcaagcacaga

SEQ ID NO: 153842 - DNA, 25 bp, Homo sapien
ccatgtcattgtcaccgctgcgggt

SEQ ID NO: 153843 - DNA, 25 bp, Homo sapien
tcccgcaacacggtcgccatttttg

SEQ ID NO: 153844 - DNA, 25 bp, Homo sapien
ggtcgccattctgttggtactaagg

SEQ ID NO: 153845 - DNA, 25 bp, Homo sapien
ttgtggttggtagaagcttaagtga

SEQ ID NO: 153846 - DNA, 25 bp, Homo sapien
cttaagtgagagcatcgcgagtagt

SEQ ID NO: 153847 - DNA, 25 bp, Homo sapien
gtagtgtggtcgcagccatgtcatt

SEQ ID NO: 153848 - DNA, 25 bp, Homo sapien
agcccagacgtgcttcagcaagccg

SEQ ID NO: 153849 - DNA, 25 bp, Homo sapien
aacgtgcctgcttgtttctacccga

SEQ ID NO: 153850 - DNA, 25 bp, Homo sapien
cgagcgccgctcaaaggctaacgtg

SEQ ID NO: 153851 - DNA, 25 bp, Homo sapien
gctccggctcagtcttacaggctct

SEQ ID NO: 153852 - DNA, 25 bp, Homo sapien
tacgcgccgcaaatgccaagaaagc

SEQ ID NO: 153853 - DNA, 25 bp, Homo sapien
aacctgaagaggcagtacgcgccgc

SEQ ID NO: 153854 - DNA, 25 bp, Homo sapien
ccgagccgcagcctagagaacctga

SEQ ID NO: 153855 - DNA, 25 bp, Homo sapien
agccgcgtggctagcaaactttctc

SEQ ID NO: 153856 - DNA, 25 bp, Homo sapien
cgatcttcccgatactgcctttgga

SEQ ID NO: 153857 - DNA, 25 bp, Homo sapien
cgcaaatcgcgaggagactgagtct

SEQ ID NO: 153858 - DNA, 25 bp, Homo sapien
tccacggaaggagcatagaagtctc

SEQ ID NO: 153859 - DNA, 25 bp, Homo sapien
gccgattgcatatgaactcttcttc

SEQ ID NO: 153860 - DNA, 25 bp, Homo sapien
tacatcgttgtcgtcggagtcgtcg

SEQ ID NO: 153861 - DNA, 25 bp, Homo sapien
gccttcgtccgtttagagtagtgta

SEQ ID NO: 153862 - DNA, 25 bp, Homo sapien
gcgattgcagccgagtccgtttctc

SEQ ID NO: 153863 - DNA, 25 bp, Homo sapien
tcttcctcccggacgctagtggtaa

SEQ ID NO: 153864 - DNA, 25 bp, Homo sapien
acgaggagtaccgaggccgctccct

SEQ ID NO: 153865 - DNA, 25 bp, Homo sapien
cagcaacagttacggccagagccac

SEQ ID NO: 153866 - DNA, 25 bp, Homo sapien
gccacgacagttccagccagagcaa

SEQ ID NO: 153867 - DNA, 25 bp, Homo sapien
tcgatgccaacagtggaggccgctc

SEQ ID NO: 153868 - DNA, 25 bp, Homo sapien
cagttccagcaacagttacggccag

SEQ ID NO: 153869 - DNA, 25 bp, Homo sapien
gatgccaacagtggaggccgctcgc

SEQ ID NO: 153870 - DNA, 25 bp, Homo sapien
aggccgctcgcctgatgcctacagt

SEQ ID NO: 153871 - DNA, 25 bp, Homo sapien
ctacgaggagtaccgaggccgctcc

SEQ ID NO: 153872 - DNA, 25 bp, Homo sapien
ccactatgaggagaaccgaggccac

SEQ ID NO: 153873 - DNA, 25 bp, Homo sapien
ttatgaggagtaccaaggccgctcg

SEQ ID NO: 153874 - DNA, 25 bp, Homo sapien
ttacagccggagtgaccgctacgga

SEQ ID NO: 153875 - DNA, 25 bp, Homo sapien
cgcagcagttccagtaacggttaca

SEQ ID NO: 153876 - DNA, 25 bp, Homo sapien
ggaccactcgcccaaagcctatagt

SEQ ID NO: 153877 - DNA, 25 bp, Homo sapien
ttgccagacgcctacagcagggacc

SEQ ID NO: 153878 - DNA, 25 bp, Homo sapien
cagcagttccagcaacagttacggc

SEQ ID NO: 153879 - DNA, 25 bp, Homo sapien
agttctggccagagcaactgctacg

SEQ ID NO: 153880 - DNA, 25 bp, Homo sapien
ctcacgttcaggagaacgggctgcc

SEQ ID NO: 153881 - DNA, 25 bp, Homo sapien
agacccgcagagtccaacaacgcag

SEQ ID NO: 153882 - DNA, 25 bp, Homo sapien
agagtccaacaacgcagccacgcag

SEQ ID NO: 153883 - DNA, 25 bp, Homo sapien
aggatgccggagctgcccgcctctt

SEQ ID NO: 153884 - DNA, 25 bp, Homo sapien
ccactgaggctcaggatgccggagc

SEQ ID NO: 153885 - DNA, 25 bp, Homo sapien
gtctcggagtttccgaccactgagg

SEQ ID NO: 153886 - DNA, 25 bp, Homo sapien
tcacctgcttgggtggtgtccgtca

SEQ ID NO: 153887 - DNA, 25 bp, Homo sapien
cgctgcccgggaagtctcggagttt

SEQ ID NO: 153888 - DNA, 25 bp, Homo sapien
caggcatacaaggccagggagctgt

SEQ ID NO: 153889 - DNA, 25 bp, Homo sapien
acccgcgaggcaggcatacaaggcc

SEQ ID NO: 153890 - DNA, 25 bp, Homo sapien
ccacgtgatgcactggtgcagctcc

SEQ ID NO: 153891 - DNA, 25 bp, Homo sapien
ggctgccacgtgatgcactggtgca

SEQ ID NO: 153892 - DNA, 25 bp, Homo sapien
ctctgcgcccactgcggcttgccgc

SEQ ID NO: 153893 - DNA, 25 bp, Homo sapien
cagctgtggggccgcgtacagccaa

SEQ ID NO: 153894 - DNA, 25 bp, Homo sapien
ccaaggccagtaggtacggtgctcg

SEQ ID NO: 153895 - DNA, 25 bp, Homo sapien
ggcacgggagcatgacagctggcct

SEQ ID NO: 153896 - DNA, 25 bp, Homo sapien
ggagcgcacaacttccctctgtcgt

SEQ ID NO: 153897 - DNA, 25 bp, Homo sapien
gccacagctgcaaagattccgaggt

SEQ ID NO: 153898 - DNA, 25 bp, Homo sapien
cggagaaatttcagttggagccctc

SEQ ID NO: 153899 - DNA, 25 bp, Homo sapien
gcatccgccgcagacacgttttctg

SEQ ID NO: 153900 - DNA, 25 bp, Homo sapien
gcatctcggttaagctcagcaggaa

SEQ ID NO: 153901 - DNA, 25 bp, Homo sapien
ctggagtcctagacgccagcccttg

SEQ ID NO: 153902 - DNA, 25 bp, Homo sapien
aaatcccggagccagcagcctgcta

SEQ ID NO: 153903 - DNA, 25 bp, Homo sapien
acctggctggcttaagccgaccctg

SEQ ID NO: 153904 - DNA, 25 bp, Homo sapien
tttaccgcggcgtataaggagtctg

SEQ ID NO: 153905 - DNA, 25 bp, Homo sapien
cggcgtataaggagtctgggcacac

SEQ ID NO: 153906 - DNA, 25 bp, Homo sapien
ttaccgcggcgtataaggagtctgg

SEQ ID NO: 153907 - DNA, 25 bp, Homo sapien
tataaggagtctgggcacacactag

SEQ ID NO: 153908 - DNA, 25 bp, Homo sapien
gtataaggagtctgggcacacacta

SEQ ID NO: 153909 - DNA, 25 bp, Homo sapien
gcgtataaggagtctgggcacacac

SEQ ID NO: 153910 - DNA, 25 bp, Homo sapien
ggcgtataaggagtctgggcacaca

SEQ ID NO: 153911 - DNA, 25 bp, Homo sapien
actctatattattcccctgtcttta

SEQ ID NO: 153912 - DNA, 25 bp, Homo sapien
cctacgtcacgcaggaagggagcca

SEQ ID NO: 153913 - DNA, 25 bp, Homo sapien
caattccggaatagcgggaccggca

SEQ ID NO: 153914 - DNA, 25 bp, Homo sapien
caggtgaacccacaattccggaata

SEQ ID NO: 153915 - DNA, 25 bp, Homo sapien
tttggcctcaaacttcaggtgaacc

SEQ ID NO: 153916 - DNA, 25 bp, Homo sapien
aggtcaaaggcgactggcgtcccac

SEQ ID NO: 153917 - DNA, 25 bp, Homo sapien
gcattctcacgggtcacggcaaggc

SEQ ID NO: 153918 - DNA, 25 bp, Homo sapien
gggacacattggcacttgggcattc

SEQ ID NO: 153919 - DNA, 25 bp, Homo sapien
tgcacgtacaacacacacagaggcg

SEQ ID NO: 153920 - DNA, 25 bp, Homo sapien
tctctttgcgtgacagtgcctcagc

SEQ ID NO: 153921 - DNA, 25 bp, Homo sapien
aggcaagtcccagttgaatgtcatc

SEQ ID NO: 153922 - DNA, 25 bp, Homo sapien
acgtggaaggtgaatgtctctttgc

SEQ ID NO: 153923 - DNA, 25 bp, Homo sapien
gcccttaaaggtgcgttgacgtgga

SEQ ID NO: 153924 - DNA, 25 bp, Homo sapien
ccgctctcgcccttaaaggtgcgtt

SEQ ID NO: 153925 - DNA, 25 bp, Homo sapien
gttgaatgtcatcccgttcctcttg

SEQ ID NO: 153926 - DNA, 25 bp, Homo sapien
ccaagccaaggtgaggcaagtccca

SEQ ID NO: 153927 - DNA, 25 bp, Homo sapien
ttcctcttgggcacggcggaccgct

SEQ ID NO: 153928 - DNA, 25 bp, Homo sapien
agtatgcgcccaagctggacagccc

SEQ ID NO: 153929 - DNA, 25 bp, Homo sapien
gaagccgccagcctcaggaagcaca

SEQ ID NO: 153930 - DNA, 25 bp, Homo sapien
tcaggaagcacaacgccgtcctgtc

SEQ ID NO: 153931 - DNA, 25 bp, Homo sapien
cttcccttccagtttgacaagtatg

SEQ ID NO: 153932 - DNA, 25 bp, Homo sapien
tttgacaagtatgcgcccaagctgg

SEQ ID NO: 153933 - DNA, 25 bp, Homo sapien
cctacttccgacattccagcgtgag

SEQ ID NO: 153934 - DNA, 25 bp, Homo sapien
gcgtgtcgctgtgcacgcaggtcct

SEQ ID NO: 153935 - DNA, 25 bp, Homo sapien
tccgacattccagcgtgagtgtgag

SEQ ID NO: 153936 - DNA, 25 bp, Homo sapien
ggcatcgcggccgtacccagacggt

SEQ ID NO: 153937 - DNA, 25 bp, Homo sapien
tttgaactcttggtcagctgggctt

SEQ ID NO: 153938 - DNA, 25 bp, Homo sapien
cccaaccgtcaattggaacccattg

SEQ ID NO: 153939 - DNA, 25 bp, Homo sapien
tttggttcacctgaaggttgaaggc

SEQ ID NO: 153940 - DNA, 25 bp, Homo sapien
cagcccttggcggttcttccaagtt

SEQ ID NO: 153941 - DNA, 25 bp, Homo sapien
cctttcctgcggtaagtaagctggc

SEQ ID NO: 153942 - DNA, 25 bp, Homo sapien
tgtttttggggttgccacttgcttc

SEQ ID NO: 153943 - DNA, 25 bp, Homo sapien
ggaacccattgcctttgaactcttg

SEQ ID NO: 153944 - DNA, 25 bp, Homo sapien
caacctcggggacatggacacaaca

SEQ ID NO: 153945 - DNA, 25 bp, Homo sapien
acagggtggcaagtctcaacaaggc

SEQ ID NO: 153946 - DNA, 25 bp, Homo sapien
ttgcgtccacctcgtcaagaaccgt

SEQ ID NO: 153947 - DNA, 25 bp, Homo sapien
cgggattgccaagccagttcctctt

SEQ ID NO: 153948 - DNA, 25 bp, Homo sapien
ccaatggccacggaactcagcactg

SEQ ID NO: 153949 - DNA, 25 bp, Homo sapien
gttcctcttgatggcagtattgctc

SEQ ID NO: 153950 - DNA, 25 bp, Homo sapien
gtattgctccagaaatgcccacctg

SEQ ID NO: 153951 - DNA, 25 bp, Homo sapien
cccttagccgatgcccagagagtct

SEQ ID NO: 153952 - DNA, 25 bp, Homo sapien
gaactggcttggcaatcccgcgcac

SEQ ID NO: 153953 - DNA, 25 bp, Homo sapien
tgccctgcgatcagaggcgcaccga

SEQ ID NO: 153954 - DNA, 25 bp, Homo sapien
gcacccgccttgttgagacttgcca

SEQ ID NO: 153955 - DNA, 25 bp, Homo sapien
cccagacggttcttgacgaggtgga

SEQ ID NO: 153956 - DNA, 25 bp, Homo sapien
gccgactgccagtgctgagttccgt

SEQ ID NO: 153957 - DNA, 25 bp, Homo sapien
acggatccgaggtctctggaggtcc

SEQ ID NO: 153958 - DNA, 25 bp, Homo sapien
accctgtcttgttgtgtccatgtcc

SEQ ID NO: 153959 - DNA, 25 bp, Homo sapien
ggtgggcatttctggagcaatactg

SEQ ID NO: 153960 - DNA, 25 bp, Homo sapien
tgccggtcccgctattccggaattg

SEQ ID NO: 153961 - DNA, 25 bp, Homo sapien
atgcccaagtgccaatgtgtcccgg

SEQ ID NO: 153962 - DNA, 25 bp, Homo sapien
tgacccgtgagaatgcccaagtgcc

SEQ ID NO: 153963 - DNA, 25 bp, Homo sapien
gccttgccgtgacccgtgagaatgc

SEQ ID NO: 153964 - DNA, 25 bp, Homo sapien
ccagtcgcctttgacctcttggtca

SEQ ID NO: 153965 - DNA, 25 bp, Homo sapien
ccggaattgtgggttcacctgaagt

SEQ ID NO: 153966 - DNA, 25 bp, Homo sapien
cctctgtgtgtgttgtacgtgcagc

SEQ ID NO: 153967 - DNA, 25 bp, Homo sapien
tcagtgggacgccagtcgcctttga

SEQ ID NO: 153968 - DNA, 25 bp, Homo sapien
atgcccaagtgccaatgtgtcccgg

SEQ ID NO: 153969 - DNA, 25 bp, Homo sapien
tgccggtcccgctattccggaattg

SEQ ID NO: 153970 - DNA, 25 bp, Homo sapien
ccggaattgtgggttcacctgaagt

SEQ ID NO: 153971 - DNA, 25 bp, Homo sapien
tcagtgggacgccagtcgcctttga

SEQ ID NO: 153972 - DNA, 25 bp, Homo sapien
ccagtcgcctttgacctcttggtca

SEQ ID NO: 153973 - DNA, 25 bp, Homo sapien
gccttgccgtgacccgtgagaatgc

SEQ ID NO: 153974 - DNA, 25 bp, Homo sapien
cctctgtgtgtgttgtacgtgcagc

SEQ ID NO: 153975 - DNA, 25 bp, Homo sapien
tgacccgtgagaatgcccaagtgcc

SEQ ID NO: 153976 - DNA, 25 bp, Homo sapien
tcggggactcccagataactgcctg

SEQ ID NO: 153977 - DNA, 25 bp, Homo sapien
gactacctctgatctgcgttctggg

SEQ ID NO: 153978 - DNA, 25 bp, Homo sapien
agcgggaaaggtccgactacctctg

SEQ ID NO: 153979 - DNA, 25 bp, Homo sapien
aaggagacctacctagctgaggctg

SEQ ID NO: 153980 - DNA, 25 bp, Homo sapien
gaaaggccgcctatggcacagaacc

SEQ ID NO: 153981 - DNA, 25 bp, Homo sapien
ctctgcaccagaaaggccgcctatg

SEQ ID NO: 153982 - DNA, 25 bp, Homo sapien
ctctggctgctcacatgatggagga

SEQ ID NO: 153983 - DNA, 25 bp, Homo sapien
gcagccaccattgcgcaagttcgag

SEQ ID NO: 153984 - DNA, 25 bp, Homo sapien
aatgaagctgtttccctgctcctct

SEQ ID NO: 153985 - DNA, 25 bp, Homo sapien
gccgctgcagttattttcaaaagtc

SEQ ID NO: 153986 - DNA, 25 bp, Homo sapien
cctaacccgaatgccgctgcagtta

SEQ ID NO: 153987 - DNA, 25 bp, Homo sapien
gcggagagcacggaccctaacccga

SEQ ID NO: 153988 - DNA, 25 bp, Homo sapien
ggcgggcaaaatgaagctgtttccc

SEQ ID NO: 153989 - DNA, 25 bp, Homo sapien
gacttcaggaccctgcctcaccttg

SEQ ID NO: 153990 - DNA, 25 bp, Homo sapien
tggtacagatcgcaactcctcgccg

SEQ ID NO: 153991 - DNA, 25 bp, Homo sapien
ccaggcttcccaggaataggagctg

SEQ ID NO: 153992 - DNA, 25 bp, Homo sapien
tccacaccaacgtttcccgagagta

SEQ ID NO: 153993 - DNA, 25 bp, Homo sapien
aaacgcgtctctttggaactgcaga

SEQ ID NO: 153994 - DNA, 25 bp, Homo sapien
cgcttgcgccgttttgataggcttc

SEQ ID NO: 153995 - DNA, 25 bp, Homo sapien
cgcgtcggtattttgcgggcaacta

SEQ ID NO: 153996 - DNA, 25 bp, Homo sapien
ttccgggcttggatagtaagacatc

SEQ ID NO: 153997 - DNA, 25 bp, Homo sapien
tcacccgcgggtgtgtcctataaat

SEQ ID NO: 153998 - DNA, 25 bp, Homo sapien
cttcttcccttactgcgaggagcca

SEQ ID NO: 153999 - DNA, 25 bp, Homo sapien
agcggtggcagcaacattccctgga

SEQ ID NO: 154000 - DNA, 25 bp, Homo sapien
tctgtccttcgacattggtgcgacc

SEQ ID NO: 154001 - DNA, 25 bp, Homo sapien
ccagtcgagccgctcacgctggaaa

SEQ ID NO: 154002 - DNA, 25 bp, Homo sapien
tcgagccgctcacgctggaaagcag

SEQ ID NO: 154003 - DNA, 25 bp, Homo sapien
agctctctgtccttcgacattggtg

SEQ ID NO: 154004 - DNA, 25 bp, Homo sapien
tccttcgacattggtgcgacccttc

SEQ ID NO: 154005 - DNA, 25 bp, Homo sapien
aaggcggctgctccacgttgttttc

SEQ ID NO: 154006 - DNA, 25 bp, Homo sapien
cggctgctccacgttgttttccagc

SEQ ID NO: 154007 - DNA, 25 bp, Homo sapien
gctggaaagcagctctctgtccttc

SEQ ID NO: 154008 - DNA, 25 bp, Homo sapien
gcgatgagcgtttggcacacacact

SEQ ID NO: 154009 - DNA, 25 bp, Homo sapien
caagggcacgacgagatcctgatcc

SEQ ID NO: 154010 - DNA, 25 bp, Homo sapien
gagctaaagagctgacctcgcgctg

SEQ ID NO: 154011 - DNA, 25 bp, Homo sapien
agtaagttttcgcaccggcagccgc

SEQ ID NO: 154012 - DNA, 25 bp, Homo sapien
tgtctttctccgctccagtaagttt

SEQ ID NO: 154013 - DNA, 25 bp, Homo sapien
gcgcaaattcaccaaacggctcagc

SEQ ID NO: 154014 - DNA, 25 bp, Homo sapien
tgccatggccgaagtgcgcaaattc

SEQ ID NO: 154015 - DNA, 25 bp, Homo sapien
agcgacttcctcctgcaactgggga

SEQ ID NO: 154016 - DNA, 25 bp, Homo sapien
cacgaccgaagtccaggcgagctga

SEQ ID NO: 154017 - DNA, 25 bp, Homo sapien
ttttgttcggtcagagaccggacgc

SEQ ID NO: 154018 - DNA, 25 bp, Homo sapien
ctctcgccggctcaggttacctgag

SEQ ID NO: 154019 - DNA, 25 bp, Homo sapien
cgcgcctacgggtgagtgcgaccct

SEQ ID NO: 154020 - DNA, 25 bp, Homo sapien
cagcgaagtaagagggctgcgactt

SEQ ID NO: 154021 - DNA, 25 bp, Homo sapien
tcagcgcccggaatgtcgcctgtga

SEQ ID NO: 154022 - DNA, 25 bp, Homo sapien
aacgcgccggggctctttgcccgag

SEQ ID NO: 154023 - DNA, 25 bp, Homo sapien
cgaaacatgcccacggcgtcagagg

SEQ ID NO: 154024 - DNA, 25 bp, Homo sapien
ccgcagacgcctctccgagcggagc

SEQ ID NO: 154025 - DNA, 25 bp, Homo sapien
tgcacaatgggctcctggcgcggac

SEQ ID NO: 154026 - DNA, 25 bp, Homo sapien
aacctcgggtcaaggagagccgctc

SEQ ID NO: 154027 - DNA, 25 bp, Homo sapien
agcgcgaggccgaacctcgggtcaa

SEQ ID NO: 154028 - DNA, 25 bp, Homo sapien
ccagggacctcctggagaagacgcg

SEQ ID NO: 154029 - DNA, 25 bp, Homo sapien
gtgctgaggggtcaccggccaccca

SEQ ID NO: 154030 - DNA, 25 bp, Homo sapien
tcaccggccacccagaaactggagg

SEQ ID NO: 154031 - DNA, 25 bp, Homo sapien
caacgggaacatcccggggctgcgc

SEQ ID NO: 154032 - DNA, 25 bp, Homo sapien
tgattggccgcactagcccgctcgt

SEQ ID NO: 154033 - DNA, 25 bp, Homo sapien
ttaggaacggcgctgcctcgtctct

SEQ ID NO: 154034 - DNA, 25 bp, Homo sapien
gcacttcgctgattggccgcactag

SEQ ID NO: 154035 - DNA, 25 bp, Homo sapien
ctcttttgtctcagctggcagagga

SEQ ID NO: 154036 - DNA, 25 bp, Homo sapien
gcagaggataaaagccgccgcggct

SEQ ID NO: 154037 - DNA, 25 bp, Homo sapien
ccgcggctgccttaggaacggcgct

SEQ ID NO: 154038 - DNA, 25 bp, Homo sapien
aggcggaatccacagctggcgacgc

SEQ ID NO: 154039 - DNA, 25 bp, Homo sapien
gcggccaaggaggcttcagttcttt

SEQ ID NO: 154040 - DNA, 25 bp, Homo sapien
gcagcggcgaaagcgactgaagtcc

SEQ ID NO: 154041 - DNA, 25 bp, Homo sapien
catcccgaaagggacggcggccacg

SEQ ID NO: 154042 - DNA, 25 bp, Homo sapien
gggcgccagaagcaatggtgcatcc

SEQ ID NO: 154043 - DNA, 25 bp, Homo sapien
atgagcttcccggtcaccaggaggc

SEQ ID NO: 154044 - DNA, 25 bp, Homo sapien
cgaaagcgactgaagtccgggagca

SEQ ID NO: 154045 - DNA, 25 bp, Homo sapien
gcctgcttgtttcgccatgcccggg

SEQ ID NO: 154046 - DNA, 25 bp, Homo sapien
aagcaatggtgcatcccgaaaggga

SEQ ID NO: 154047 - DNA, 25 bp, Homo sapien
agcagtcgcatgagcttcccggtca

SEQ ID NO: 154048 - DNA, 25 bp, Homo sapien
caggatgcccaaggcggcctgcgtt

SEQ ID NO: 154049 - DNA, 25 bp, Homo sapien
cctgcgttggttgtggaagggacat

SEQ ID NO: 154050 - DNA, 25 bp, Homo sapien
tggcagatgtgtccatgtggcgccc

SEQ ID NO: 154051 - DNA, 25 bp, Homo sapien
ccgtggcgctggcagatgtgtccat

SEQ ID NO: 154052 - DNA, 25 bp, Homo sapien
tccaggaaagcgtgcacggccgtgg

SEQ ID NO: 154053 - DNA, 25 bp, Homo sapien
tgattttggactggccatcgctgta

SEQ ID NO: 154054 - DNA, 25 bp, Homo sapien
ccaggatgattttggactggccatc

SEQ ID NO: 154055 - DNA, 25 bp, Homo sapien
ggccgcccaggatgattttggactg

SEQ ID NO: 154056 - DNA, 25 bp, Homo sapien
cattgtaaaccaggcgctgaggctc

SEQ ID NO: 154057 - DNA, 25 bp, Homo sapien
cgccttcaggaagtgtgtaggacac

SEQ ID NO: 154058 - DNA, 25 bp, Homo sapien
ctgaatagcgctctcagctcgcgtc

SEQ ID NO: 154059 - DNA, 25 bp, Homo sapien
cgggattcgcggactttctcctgaa

SEQ ID NO: 154060 - DNA, 25 bp, Homo sapien
gaggctattcggtctgccactgggc

SEQ ID NO: 154061 - DNA, 25 bp, Homo sapien
aggctcgtgcccagttgtacccttc

SEQ ID NO: 154062 - DNA, 25 bp, Homo sapien
cgcgagttcctcactgtccagcgag

SEQ ID NO: 154063 - DNA, 25 bp, Homo sapien
ggagcgacaaacctggaggctattc

SEQ ID NO: 154064 - DNA, 25 bp, Homo sapien
aggcggcactgctcaagtacaacga

SEQ ID NO: 154065 - DNA, 25 bp, Homo sapien
ccgtctcttcgtatctttgtcactg

SEQ ID NO: 154066 - DNA, 25 bp, Homo sapien
gccggaaatgtcatgggtttctatc

SEQ ID NO: 154067 - DNA, 25 bp, Homo sapien
gtgtggccacaccttttgtaaactg

SEQ ID NO: 154068 - DNA, 25 bp, Homo sapien
ttttgtaaactgtgcctggaacgtg

SEQ ID NO: 154069 - DNA, 25 bp, Homo sapien
tcggcaagttgtttccaggcccagc

SEQ ID NO: 154070 - DNA, 25 bp, Homo sapien
gtctgtgtctccttgcttctggttc

SEQ ID NO: 154071 - DNA, 25 bp, Homo sapien
gggtctctgagtttgttctgttttc

SEQ ID NO: 154072 - DNA, 25 bp, Homo sapien
atcctgatcaggatgcgtggcggcc

SEQ ID NO: 154073 - DNA, 25 bp, Homo sapien
cagtggcaacactgtggccggagtc

SEQ ID NO: 154074 - DNA, 25 bp, Homo sapien
agtcgcagggcccatgagaggcctc

SEQ ID NO: 154075 - DNA, 25 bp, Homo sapien
gaacgccgaggaagactcagagatc

SEQ ID NO: 154076 - DNA, 25 bp, Homo sapien
aggcggacaacttcgacttggtcgc

SEQ ID NO: 154077 - DNA, 25 bp, Homo sapien
ataagaggctttcgcatggagtttc

SEQ ID NO: 154078 - DNA, 25 bp, Homo sapien
catggagtttctggacatggtccac

SEQ ID NO: 154079 - DNA, 25 bp, Homo sapien
cactgcggcgcccagtggctcagaa

SEQ ID NO: 154080 - DNA, 25 bp, Homo sapien
cgtttttgcggcgagagcaccattt

SEQ ID NO: 154081 - DNA, 25 bp, Homo sapien
cccgcgtagagttgacctgtctctg

SEQ ID NO: 154082 - DNA, 25 bp, Homo sapien
ttgcaagttcgagcccagaggtgtc

SEQ ID NO: 154083 - DNA, 25 bp, Homo sapien
caccctccactctgtggtgtctagg

SEQ ID NO: 154084 - DNA, 25 bp, Homo sapien
gcccgccacttactctgaaatcttg

SEQ ID NO: 154085 - DNA, 25 bp, Homo sapien
tgaaagctagccatggtgctgctga

SEQ ID NO: 154086 - DNA, 25 bp, Homo sapien
gcatgcccttagaggctgccacgtg

SEQ ID NO: 154087 - DNA, 25 bp, Homo sapien
cacaggggaatgatgttgcaagttc

SEQ ID NO: 154088 - DNA, 25 bp, Homo sapien
cagcataggaagaaggccgcgtcca

SEQ ID NO: 154089 - DNA, 25 bp, Homo sapien
gcagcataggaagaaggccgcgtcc

SEQ ID NO: 154090 - DNA, 25 bp, Homo sapien
tggtgcagcgcccagatatcgggcg

SEQ ID NO: 154091 - DNA, 25 bp, Homo sapien
gcataggaagaaggccgcgtccaag

SEQ ID NO: 154092 - DNA, 25 bp, Homo sapien
gatatcgggcgtgcagtcgaggtgc

SEQ ID NO: 154093 - DNA, 25 bp, Homo sapien
gaagaaggccgcgtccaagaggcga

SEQ ID NO: 154094 - DNA, 25 bp, Homo sapien
gccgcgtccaagaggcgagttgcga

SEQ ID NO: 154095 - DNA, 25 bp, Homo sapien
aggcgagttgcgaggcgcgagaaag

SEQ ID NO: 154096 - DNA, 25 bp, Homo sapien
gcgtcgcgctcagctataggatggc

SEQ ID NO: 154097 - DNA, 25 bp, Homo sapien
catggccatcaacggcaaggtgttc

SEQ ID NO: 154098 - DNA, 25 bp, Homo sapien
ttcctgctctacaagatcgtgcgcg

SEQ ID NO: 154099 - DNA, 25 bp, Homo sapien
gcatgagattttcacgtcgccgctc

SEQ ID NO: 154100 - DNA, 25 bp, Homo sapien
ggcgccgacccaagcgatctggaga

SEQ ID NO: 154101 - DNA, 25 bp, Homo sapien
ctccagagatcatggctgccgagga

SEQ ID NO: 154102 - DNA, 25 bp, Homo sapien
gcggcccaacctttactccagagat

SEQ ID NO: 154103 - DNA, 25 bp, Homo sapien
tcgatgtgaccaaaggccgcaaatt

SEQ ID NO: 154104 - DNA, 25 bp, Homo sapien
aaaacgtgactctgctggggcaagc

SEQ ID NO: 154105 - DNA, 25 bp, Homo sapien
ggaaccgttcgtctctactccagga

SEQ ID NO: 154106 - DNA, 25 bp, Homo sapien
gagagggcaccttcagttcccatta

SEQ ID NO: 154107 - DNA, 25 bp, Homo sapien
cccattagcgggatgtcactgccaa

SEQ ID NO: 154108 - DNA, 25 bp, Homo sapien
tcactgccaacgtgcctcaggggaa

SEQ ID NO: 154109 - DNA, 25 bp, Homo sapien
ccgagggcatttaccgggagcttca

SEQ ID NO: 154110 - DNA, 25 bp, Homo sapien
gcgcgcagaagcgtcctcgctaaga

SEQ ID NO: 154111 - DNA, 25 bp, Homo sapien
ccagctgttgaatggctcgcgtcga

SEQ ID NO: 154112 - DNA, 25 bp, Homo sapien
tgtcacgcggcctcccgtcgtccca

SEQ ID NO: 154113 - DNA, 25 bp, Homo sapien
ccattgtgctccttcgttcttgggg

SEQ ID NO: 154114 - DNA, 25 bp, Homo sapien
ctggctctgccggatgccccattgt

SEQ ID NO: 154115 - DNA, 25 bp, Homo sapien
agtgaagcacagcaggtcccagctt

SEQ ID NO: 154116 - DNA, 25 bp, Homo sapien
cccggaagtgaagcacagcaggtcc

SEQ ID NO: 154117 - DNA, 25 bp, Homo sapien
tgtccggtgccatcgccccggaagt

SEQ ID NO: 154118 - DNA, 25 bp, Homo sapien
cctgcagcaccttgggatgctgggc

SEQ ID NO: 154119 - DNA, 25 bp, Homo sapien
gtccctcctgcagcaccttgggatg

SEQ ID NO: 154120 - DNA, 25 bp, Homo sapien
caggcccgagccacgcggtcttccg

SEQ ID NO: 154121 - DNA, 25 bp, Homo sapien
ttgtcgatcacctggggacccctcg

SEQ ID NO: 154122 - DNA, 25 bp, Homo sapien
gcctaccgcaagtaagagccgggcg

SEQ ID NO: 154123 - DNA, 25 bp, Homo sapien
agctcgccgcctaccgcaagtaaga

SEQ ID NO: 154124 - DNA, 25 bp, Homo sapien
aacgcggtggcgtgcctgcgcctct

SEQ ID NO: 154125 - DNA, 25 bp, Homo sapien
tcgccaccgtgctggcccaggttgg

SEQ ID NO: 154126 - DNA, 25 bp, Homo sapien
gacggccgactgacaggcggccaaa

SEQ ID NO: 154127 - DNA, 25 bp, Homo sapien
ctcgatggctacgtggaggcgggac

SEQ ID NO: 154128 - DNA, 25 bp, Homo sapien
taaatcggccatttgcttcgctccg

SEQ ID NO: 154129 - DNA, 25 bp, Homo sapien
gcagtctgcctcctctttcaacatg

SEQ ID NO: 154130 - DNA, 25 bp, Homo sapien
tcaacatgacagatgccgctgtgtc

SEQ ID NO: 154131 - DNA, 25 bp, Homo sapien
ctgctgcaggtacgtcctgggatcc

SEQ ID NO: 154132 - DNA, 25 bp, Homo sapien
gaggaacgccagttcttaccgaaga

SEQ ID NO: 154133 - DNA, 25 bp, Homo sapien
tcaaggtcgcggcaaggagataact

SEQ ID NO: 154134 - DNA, 25 bp, Homo sapien
ggaagcgcgtgtgccttttacgtcc

SEQ ID NO: 154135 - DNA, 25 bp, Homo sapien
gaggcgcctttagtgacctgaagta

SEQ ID NO: 154136 - DNA, 25 bp, Homo sapien
agagctgtgtcctccacgcagaccg

SEQ ID NO: 154137 - DNA, 25 bp, Homo sapien
gggaaactttgtaaagagcgctctc

SEQ ID NO: 154138 - DNA, 25 bp, Homo sapien
tcgccgaagtgcaaggctggattga

SEQ ID NO: 154139 - DNA, 25 bp, Homo sapien
cttttgcaggcctaatggcggttga

SEQ ID NO: 154140 - DNA, 25 bp, Homo sapien
cgagtagcagcagaaggaaatggcc

SEQ ID NO: 154141 - DNA, 25 bp, Homo sapien
tccgctaggactatgccgagtagca

SEQ ID NO: 154142 - DNA, 25 bp, Homo sapien
tcagcgcggtggctaaaacagtccg

SEQ ID NO: 154143 - DNA, 25 bp, Homo sapien
ctttaggcgccggttttgtaatctg

SEQ ID NO: 154144 - DNA, 25 bp, Homo sapien
cggagcctgtgcctcgattagctca

SEQ ID NO: 154145 - DNA, 25 bp, Homo sapien
atccatttgtagtggcttccgaccc

SEQ ID NO: 154146 - DNA, 25 bp, Homo sapien
gattagctcagttcccgctgccagg

SEQ ID NO: 154147 - DNA, 25 bp, Homo sapien
gctccgtccgagaacaacataatgg

SEQ ID NO: 154148 - DNA, 25 bp, Homo sapien
caggaggatcctccagccggagtca

SEQ ID NO: 154149 - DNA, 25 bp, Homo sapien
cctgtctgtcttcccgaaggttgca

SEQ ID NO: 154150 - DNA, 25 bp, Homo sapien
ctcccgtggggctttaatgacataa

SEQ ID NO: 154151 - DNA, 25 bp, Homo sapien
tctgagcccgggacatccatttgta

SEQ ID NO: 154152 - DNA, 25 bp, Homo sapien
gggcctttgacgcactacggtgaca

SEQ ID NO: 154153 - DNA, 25 bp, Homo sapien
cgctgaggggagaagatcaactctc

SEQ ID NO: 154154 - DNA, 25 bp, Homo sapien
actgcgcggagagcgataaaagacc

SEQ ID NO: 154155 - DNA, 25 bp, Homo sapien
tccagtgacgactacgggcctttga

SEQ ID NO: 154156 - DNA, 25 bp, Homo sapien
aggttctagcctacctacccgcgtg

SEQ ID NO: 154157 - DNA, 25 bp, Homo sapien
gcggctgttccctaacttccaaatc

SEQ ID NO: 154158 - DNA, 25 bp, Homo sapien
gaatctcgcgcgacgtacttttttc

SEQ ID NO: 154159 - DNA, 25 bp, Homo sapien
cagtcactttcgtggctatagcgcc

SEQ ID NO: 154160 - DNA, 25 bp, Homo sapien
aagtgttacacttcgggcgcgacca

SEQ ID NO: 154161 - DNA, 25 bp, Homo sapien
ggtacgtcccgacctctgctgaatt

SEQ ID NO: 154162 - DNA, 25 bp, Homo sapien
cgggagctactgcacaggaaacaga

SEQ ID NO: 154163 - DNA, 25 bp, Homo sapien
gagctatatcggtcgctgccatcgc

SEQ ID NO: 154164 - DNA, 25 bp, Homo sapien
tgcacttaccacctggcgagctata

SEQ ID NO: 154165 - DNA, 25 bp, Homo sapien
gcggctcttgggcaatgcaagttca

SEQ ID NO: 154166 - DNA, 25 bp, Homo sapien
ggctcctacggccattcattcggca

SEQ ID NO: 154167 - DNA, 25 bp, Homo sapien
atggccagaccagttccagttcttc

SEQ ID NO: 154168 - DNA, 25 bp, Homo sapien
cacctccgcgggtcctctctcgtgg

SEQ ID NO: 154169 - DNA, 25 bp, Homo sapien
gacaaggcggccaatagggcgcaga

SEQ ID NO: 154170 - DNA, 25 bp, Homo sapien
agaacttccgaaggcaggggtgcgc

SEQ ID NO: 154171 - DNA, 25 bp, Homo sapien
cagaggagagaacttccgaaggcag

SEQ ID NO: 154172 - DNA, 25 bp, Homo sapien
gatttctccttgaccctcattcagc

SEQ ID NO: 154173 - DNA, 25 bp, Homo sapien
ctgatttctccttgaccctcattca

SEQ ID NO: 154174 - DNA, 25 bp, Homo sapien
acggggagcggcctccagtcactct

SEQ ID NO: 154175 - DNA, 25 bp, Homo sapien
tgaccctcattcagcccgggacaag

SEQ ID NO: 154176 - DNA, 25 bp, Homo sapien
ttcccaggcacgctgatgcactctg

SEQ ID NO: 154177 - DNA, 25 bp, Homo sapien
tggtacacgatttcgccctacgccg

SEQ ID NO: 154178 - DNA, 25 bp, Homo sapien
tcaccggctactcggttctgcactg

SEQ ID NO: 154179 - DNA, 25 bp, Homo sapien
cctcgagagcggacactggtagcct

SEQ ID NO: 154180 - DNA, 25 bp, Homo sapien
ggcagcttcaagaccatggcccagc

SEQ ID NO: 154181 - DNA, 25 bp, Homo sapien
gaagggcagctaacgctggacactg

SEQ ID NO: 154182 - DNA, 25 bp, Homo sapien
tccgaacccaattgctcaagcagct

SEQ ID NO: 154183 - DNA, 25 bp, Homo sapien
cacgaggagctcattctggtacacg

SEQ ID NO: 154184 - DNA, 25 bp, Homo sapien
ttcccagagggttacgagtcatttc

SEQ ID NO: 154185 - DNA, 25 bp, Homo sapien
ctccaggttgctcgctggctcacta

SEQ ID NO: 154186 - DNA, 25 bp, Homo sapien
gttggaccacgtggacgcttatgta

SEQ ID NO: 154187 - DNA, 25 bp, Homo sapien
caggcggagagtaagtgccattttc

SEQ ID NO: 154188 - DNA, 25 bp, Homo sapien
gcggagtcaagaacacaccacgatg

SEQ ID NO: 154189 - DNA, 25 bp, Homo sapien
agcgcgctggtttctgccaaatgca

SEQ ID NO: 154190 - DNA, 25 bp, Homo sapien
gcagcccacagtcaggccacgattt

SEQ ID NO: 154191 - DNA, 25 bp, Homo sapien
aggggcaccctgcttcgtaagtgag

SEQ ID NO: 154192 - DNA, 25 bp, Homo sapien
ttctggaccgcaattcggggacgcc

SEQ ID NO: 154193 - DNA, 25 bp, Homo sapien
cagcttgtcccatcaggcgttggtc

SEQ ID NO: 154194 - DNA, 25 bp, Homo sapien
atacgtagaattgctggggatcctc

SEQ ID NO: 154195 - DNA, 25 bp, Homo sapien
cctcactggctttctccggagcgtg

SEQ ID NO: 154196 - DNA, 25 bp, Homo sapien
tctcacaaccttggtgcgcagaagg

SEQ ID NO: 154197 - DNA, 25 bp, Homo sapien
agggcctcagcattcacgctgcttc

SEQ ID NO: 154198 - DNA, 25 bp, Homo sapien
accttctgtccgttccggcaggcag

SEQ ID NO: 154199 - DNA, 25 bp, Homo sapien
ggcattggagtggaaatacgtagaa

SEQ ID NO: 154200 - DNA, 25 bp, Homo sapien
ggttactcgcttctccttaggcctg

SEQ ID NO: 154201 - DNA, 25 bp, Homo sapien
tccgccatcttgaagtgactctgtc

SEQ ID NO: 154202 - DNA, 25 bp, Homo sapien
ccttcgcgcgtcattagcaattccg

SEQ ID NO: 154203 - DNA, 25 bp, Homo sapien
ggcacaaacggctcccgggaagctc

SEQ ID NO: 154204 - DNA, 25 bp, Homo sapien
aatcccggcatacaaagcagctacc

SEQ ID NO: 154205 - DNA, 25 bp, Homo sapien
cttctccttgttgcgatcctgctta

SEQ ID NO: 154206 - DNA, 25 bp, Homo sapien
gggcaccttgctcagcgcttctttc

SEQ ID NO: 154207 - DNA, 25 bp, Homo sapien
ttccattgggtcctgccaagctctc

SEQ ID NO: 154208 - DNA, 25 bp, Homo sapien
gtcacgggtcttctgtatcattgga

SEQ ID NO: 154209 - DNA, 25 bp, Homo sapien
ggatttataaaccacgccgagactc

SEQ ID NO: 154210 - DNA, 25 bp, Homo sapien
agccgccttctgtttaccactgtca

SEQ ID NO: 154211 - DNA, 25 bp, Homo sapien
ttttccggtcgaaccacagtgcagc

SEQ ID NO: 154212 - DNA, 25 bp, Homo sapien
gccattttagagtcctgagctccga

SEQ ID NO: 154213 - DNA, 25 bp, Homo sapien
catgggcgtgtgcttgttgattcca

SEQ ID NO: 154214 - DNA, 25 bp, Homo sapien
ctccacgggctgatttccgaaaagg

SEQ ID NO: 154215 - DNA, 25 bp, Homo sapien
tcttgtgccctagcagattccgtcg

SEQ ID NO: 154216 - DNA, 25 bp, Homo sapien
gcgcgagtagctgccgtaatagact

SEQ ID NO: 154217 - DNA, 25 bp, Homo sapien
tcggactccaaaggcacgtaggctc

SEQ ID NO: 154218 - DNA, 25 bp, Homo sapien
taggccaaggcttgtcgctcccgta

SEQ ID NO: 154219 - DNA, 25 bp, Homo sapien
tctcgcgagcctaggaagatgtctg

SEQ ID NO: 154220 - DNA, 25 bp, Homo sapien
gggcttcggactcttcgacgaactg

SEQ ID NO: 154221 - DNA, 25 bp, Homo sapien
ccggacaccggagccatggctactg

SEQ ID NO: 154222 - DNA, 25 bp, Homo sapien
aagatgtctgttgccttggttcccg

SEQ ID NO: 154223 - DNA, 25 bp, Homo sapien
tcgtacaagagaaagtgcggccgtc

SEQ ID NO: 154224 - DNA, 25 bp, Homo sapien
gggctagattgtgtctcgctccgct

SEQ ID NO: 154225 - DNA, 25 bp, Homo sapien
tcaaggataaccagaagcgcggcgg

SEQ ID NO: 154226 - DNA, 25 bp, Homo sapien
ctgtagggactttggtgactgaagc

SEQ ID NO: 154227 - DNA, 25 bp, Homo sapien
actcagagcaggagccgaaggaccc

SEQ ID NO: 154228 - DNA, 25 bp, Homo sapien
tccacgagccggaactcagagcagg

SEQ ID NO: 154229 - DNA, 25 bp, Homo sapien
gagtggtcaacgaagctgcaaaatg

SEQ ID NO: 154230 - DNA, 25 bp, Homo sapien
tgcctcaatttcgactcctgccaga

SEQ ID NO: 154231 - DNA, 25 bp, Homo sapien
tgaccacgaacgcatccctgactta

SEQ ID NO: 154232 - DNA, 25 bp, Homo sapien
gcggcctgagaaaggtggcacagca

SEQ ID NO: 154233 - DNA, 25 bp, Homo sapien
agagttgaacaaatcaccggtccgg

SEQ ID NO: 154234 - DNA, 25 bp, Homo sapien
ttcctttcctagagttgaacaaatc

SEQ ID NO: 154235 - DNA, 25 bp, Homo sapien
tgctggcacgcgctcacggcaggaa

SEQ ID NO: 154236 - DNA, 25 bp, Homo sapien
gctcatggaacacgaagcccaggca

SEQ ID NO: 154237 - DNA, 25 bp, Homo sapien
ctagatctgggctgggacgcgatct

SEQ ID NO: 154238 - DNA, 25 bp, Homo sapien
cagccaggcactgaccgtcgccttc

SEQ ID NO: 154239 - DNA, 25 bp, Homo sapien
acggaaggtcctgctggcacgcgct

SEQ ID NO: 154240 - DNA, 25 bp, Homo sapien
ccggatctgggctggaacgccacct

SEQ ID NO: 154241 - DNA, 25 bp, Homo sapien
agtagcctcgggttcacgctcctct

SEQ ID NO: 154242 - DNA, 25 bp, Homo sapien
agagttcaccaaatcaccggttcgg

SEQ ID NO: 154243 - DNA, 25 bp, Homo sapien
ccgtcttctttctggagctcatcga

SEQ ID NO: 154244 - DNA, 25 bp, Homo sapien
cgtggtcgacgaagccgtgcgtctc

SEQ ID NO: 154245 - DNA, 25 bp, Homo sapien
tgctgctcaggacgcctccggtggc

SEQ ID NO: 154246 - DNA, 25 bp, Homo sapien
agcgagccttgctggcacgcgctct

SEQ ID NO: 154247 - DNA, 25 bp, Homo sapien
ccagacaggcactgaccgtcttctt

SEQ ID NO: 154248 - DNA, 25 bp, Homo sapien
ccttcccataggtggccaggaactc

SEQ ID NO: 154249 - DNA, 25 bp, Homo sapien
cgcgccaaccagagcaatgggctta

SEQ ID NO: 154250 - DNA, 25 bp, Homo sapien
gcaatgggcttaccgcaggaactca

SEQ ID NO: 154251 - DNA, 25 bp, Homo sapien
tggggaactgctcgcgttggaaaat

SEQ ID NO: 154252 - DNA, 25 bp, Homo sapien
ctcctgcagctgcaatggggtgaag

SEQ ID NO: 154253 - DNA, 25 bp, Homo sapien
gcgcgaatactgctgcccaggttcc

SEQ ID NO: 154254 - DNA, 25 bp, Homo sapien
ggttccttctcgctctggtcgctgt

SEQ ID NO: 154255 - DNA, 25 bp, Homo sapien
ggtcgctgtcctcaacgttgccatc

SEQ ID NO: 154256 - DNA, 25 bp, Homo sapien
cacaccgccctcagggttcatatta

SEQ ID NO: 154257 - DNA, 25 bp, Homo sapien
ctcaggcagtagaacacggtgtcgt

SEQ ID NO: 154258 - DNA, 25 bp, Homo sapien
ttacctggtatacactcaggcagta

SEQ ID NO: 154259 - DNA, 25 bp, Homo sapien
tacccatgaggcctggagctccttg

SEQ ID NO: 154260 - DNA, 25 bp, Homo sapien
atgccgttctcgtggttcacaccgc

SEQ ID NO: 154261 - DNA, 25 bp, Homo sapien
gatcatgccgccatcgcggttcatg

SEQ ID NO: 154262 - DNA, 25 bp, Homo sapien
ccgagttcgtggctgcatgttctcg

SEQ ID NO: 154263 - DNA, 25 bp, Homo sapien
ggccaacatggccttctgcgcttga

SEQ ID NO: 154264 - DNA, 25 bp, Homo sapien
cccaaggcggagaagaaaaagatgg

SEQ ID NO: 154265 - DNA, 25 bp, Homo sapien
acagcgaccagagcgagaaggaacc

SEQ ID NO: 154266 - DNA, 25 bp, Homo sapien
tgagttcctgcggtaagcccattgc

SEQ ID NO: 154267 - DNA, 25 bp, Homo sapien
ggcagcagtattcgcgcccacaggg

SEQ ID NO: 154268 - DNA, 25 bp, Homo sapien
cgagaaggaacctgggcagcagtat

SEQ ID NO: 154269 - DNA, 25 bp, Homo sapien
cagcgatggcaacgttgaggacagc

SEQ ID NO: 154270 - DNA, 25 bp, Homo sapien
agttcctggccacctatgggaagga

SEQ ID NO: 154271 - DNA, 25 bp, Homo sapien
aagcccattgctctggttggcgcgc

SEQ ID NO: 154272 - DNA, 25 bp, Homo sapien
caggacgaaattgtccaggaaggga

SEQ ID NO: 154273 - DNA, 25 bp, Homo sapien
gcagacaagctgtgcggcctcttct

SEQ ID NO: 154274 - DNA, 25 bp, Homo sapien
caagccggcgcagggtccatgctgt

SEQ ID NO: 154275 - DNA, 25 bp, Homo sapien
gcagggtccatgctgtactcccaac

SEQ ID NO: 154276 - DNA, 25 bp, Homo sapien
cacggcccgtgaggatgctcagcct

SEQ ID NO: 154277 - DNA, 25 bp, Homo sapien
ggatgctcagcctcatgcaaaggtc

SEQ ID NO: 154278 - DNA, 25 bp, Homo sapien
gcaaaggtctcaggacgaaattgtc

SEQ ID NO: 154279 - DNA, 25 bp, Homo sapien
gcctcatgcaaaggtctcaggacga

SEQ ID NO: 154280 - DNA, 25 bp, Homo sapien
acggcgcagtcagccgctcttgaga

SEQ ID NO: 154281 - DNA, 25 bp, Homo sapien
gctcttgagaatgcgaccacaactg

SEQ ID NO: 154282 - DNA, 25 bp, Homo sapien
gagccttggctgagcccattccatt

SEQ ID NO: 154283 - DNA, 25 bp, Homo sapien
tggggctcttggacaaactgcaaca

SEQ ID NO: 154284 - DNA, 25 bp, Homo sapien
aaccggacaccggagctactgcagc

SEQ ID NO: 154285 - DNA, 25 bp, Homo sapien
gcagtatccgttgcctttgctccaa

SEQ ID NO: 154286 - DNA, 25 bp, Homo sapien
aagagttccagtgagagttgcgccc

SEQ ID NO: 154287 - DNA, 25 bp, Homo sapien
ctgcagcctcgaaaacgggacattc

SEQ ID NO: 154288 - DNA, 25 bp, Homo sapien
ttccatccaattgcttgcgactgtc

SEQ ID NO: 154289 - DNA, 25 bp, Homo sapien
cctgcgtttgcattcgcctcacttg

SEQ ID NO: 154290 - DNA, 25 bp, Homo sapien
cgcgtcgacgtcgacccagactgga

SEQ ID NO: 154291 - DNA, 25 bp, Homo sapien
ggcgcctttggcttcagcgcttcgc

SEQ ID NO: 154292 - DNA, 25 bp, Homo sapien
gccgaacacacaagagcttcccagt

SEQ ID NO: 154293 - DNA, 25 bp, Homo sapien
ttgcgactgtcttacccgatctttc

SEQ ID NO: 154294 - DNA, 25 bp, Homo sapien
gcctcacttgaaccaggaagcggca

SEQ ID NO: 154295 - DNA, 25 bp, Homo sapien
gctcctccggctctttctttgtgtg

SEQ ID NO: 154296 - DNA, 25 bp, Homo sapien
tggcacgcagtcagcttcgtcatgc

SEQ ID NO: 154297 - DNA, 25 bp, Homo sapien
aggccgtggccacctggcacgcagt

SEQ ID NO: 154298 - DNA, 25 bp, Homo sapien
gcagtcagcttcgtcatgccgtgca

SEQ ID NO: 154299 - DNA, 25 bp, Homo sapien
gtgcatggcccgcatgaacctcagc

SEQ ID NO: 154300 - DNA, 25 bp, Homo sapien
tccgggctctggtagtacgcatcct

SEQ ID NO: 154301 - DNA, 25 bp, Homo sapien
gtagtacgcatcctggaacacagca

SEQ ID NO: 154302 - DNA, 25 bp, Homo sapien
acacagcaggtgcttaggggcacca

SEQ ID NO: 154303 - DNA, 25 bp, Homo sapien
ggacagattgaaggccgtggccacc

SEQ ID NO: 154304 - DNA, 25 bp, Homo sapien
ggcttttccacagtcgaatcgcata

SEQ ID NO: 154305 - DNA, 25 bp, Homo sapien
atcgcatatcttcggagtgggttca

SEQ ID NO: 154306 - DNA, 25 bp, Homo sapien
ctggccctcggtcaagggtttcaca

SEQ ID NO: 154307 - DNA, 25 bp, Homo sapien
tcacagtgatgtggaatggcttttc

SEQ ID NO: 154308 - DNA, 25 bp, Homo sapien
tgggttcagaccgacttgtgctgtc

SEQ ID NO: 154309 - DNA, 25 bp, Homo sapien
cacctggacacgtacatttgacgca

SEQ ID NO: 154310 - DNA, 25 bp, Homo sapien
cccatattggaagaacccgggagca

SEQ ID NO: 154311 - DNA, 25 bp, Homo sapien
cgacttctgtcgaaatgcccgtatt

SEQ ID NO: 154312 - DNA, 25 bp, Homo sapien
cagggactgatgcatggtgaaaact

SEQ ID NO: 154313 - DNA, 25 bp, Homo sapien
accgctgctgagtcagggactgatg

SEQ ID NO: 154314 - DNA, 25 bp, Homo sapien
ggccgctagacttacccatggaatc

SEQ ID NO: 154315 - DNA, 25 bp, Homo sapien
atactccgacgcaagcttggcgctc

SEQ ID NO: 154316 - DNA, 25 bp, Homo sapien
tcacagtccagaggccagggcactc

SEQ ID NO: 154317 - DNA, 25 bp, Homo sapien
catggtgaaaactgcccggttgccc

SEQ ID NO: 154318 - DNA, 25 bp, Homo sapien
gcactccggggcagagatactccga

SEQ ID NO: 154319 - DNA, 25 bp, Homo sapien
cgcagagcatcctactccgcggttg

SEQ ID NO: 154320 - DNA, 25 bp, Homo sapien
agtgactgggcagacacttttcata

SEQ ID NO: 154321 - DNA, 25 bp, Homo sapien
gcagcgcccttaccggaagtgactg

SEQ ID NO: 154322 - DNA, 25 bp, Homo sapien
agatggcgccatttccggtcacgcg

SEQ ID NO: 154323 - DNA, 25 bp, Homo sapien
agcacaagaggctaaagatggcgcc

SEQ ID NO: 154324 - DNA, 25 bp, Homo sapien
ccagggcttgttattgtcaatagca

SEQ ID NO: 154325 - DNA, 25 bp, Homo sapien
ctgcaggagcgactcagcgagtctg

SEQ ID NO: 154326 - DNA, 25 bp, Homo sapien
ggcgggccttcgagacaccttcgga

SEQ ID NO: 154327 - DNA, 25 bp, Homo sapien
gacacttttcatagcgcccagatcc

SEQ ID NO: 154328 - DNA, 25 bp, Homo sapien
tcaccttcctggcatggaaattgcg

SEQ ID NO: 154329 - DNA, 25 bp, Homo sapien
agacttgctataggcctgcgtgacc

SEQ ID NO: 154330 - DNA, 25 bp, Homo sapien
ccctgccgagttcagagacttgcta

SEQ ID NO: 154331 - DNA, 25 bp, Homo sapien
ggtgttctctcgttggtctcgctaa

SEQ ID NO: 154332 - DNA, 25 bp, Homo sapien
ctgttctagctgcaggcggtgttct

SEQ ID NO: 154333 - DNA, 25 bp, Homo sapien
ttacgctcctgaccaggctgttcta

SEQ ID NO: 154334 - DNA, 25 bp, Homo sapien
acgggtttcctctcacgttggcgca

SEQ ID NO: 154335 - DNA, 25 bp, Homo sapien
actcacccgcgtctagaacggcttg

SEQ ID NO: 154336 - DNA, 25 bp, Homo sapien
ctctaggtggccagccaaagacctg

SEQ ID NO: 154337 - DNA, 25 bp, Homo sapien
ttccctcaaggggacggcggagcaa

SEQ ID NO: 154338 - DNA, 25 bp, Homo sapien
aacgccatggtgcagatcctgtggg

SEQ ID NO: 154339 - DNA, 25 bp, Homo sapien
actatgcggcctacgaagtgctgga

SEQ ID NO: 154340 - DNA, 25 bp, Homo sapien
cccgagctgcgacaaggcattaaag

SEQ ID NO: 154341 - DNA, 25 bp, Homo sapien
agtgtacctcaacggcgagtttgtg

SEQ ID NO: 154342 - DNA, 25 bp, Homo sapien
gctggacgcactggtgaaggacaaa

SEQ ID NO: 154343 - DNA, 25 bp, Homo sapien
acaaagtggttgtcttccctcaagg

SEQ ID NO: 154344 - DNA, 25 bp, Homo sapien
acggcctcctctgaggtcggttcct

SEQ ID NO: 154345 - DNA, 25 bp, Homo sapien
tggaccaggtacaggaacacgaagc

SEQ ID NO: 154346 - DNA, 25 bp, Homo sapien
ttcgctatctggatgtggtcgttgt

SEQ ID NO: 154347 - DNA, 25 bp, Homo sapien
cggctgaggtgacggttcgctatct

SEQ ID NO: 154348 - DNA, 25 bp, Homo sapien
agggttgtcccagaggttgggcaca

SEQ ID NO: 154349 - DNA, 25 bp, Homo sapien
ggggtttctcatctgcggcctcctc

SEQ ID NO: 154350 - DNA, 25 bp, Homo sapien
tacaggaacacgaagccaatgcccg

SEQ ID NO: 154351 - DNA, 25 bp, Homo sapien
cctctgaggtcggttcctctgcggc

SEQ ID NO: 154352 - DNA, 25 bp, Homo sapien
tagcgacgggcgaccaccgccaagt

SEQ ID NO: 154353 - DNA, 25 bp, Homo sapien
gcacgaagtgaatgcccgacgccgg

SEQ ID NO: 154354 - DNA, 25 bp, Homo sapien
tgtccaggagcacgaagtgaatgcc

SEQ ID NO: 154355 - DNA, 25 bp, Homo sapien
gttctctatgaggatgtggtcgttg

SEQ ID NO: 154356 - DNA, 25 bp, Homo sapien
cggctgagttgacggttctctatga

SEQ ID NO: 154357 - DNA, 25 bp, Homo sapien
cctcctgtgcggtcggttcttctgt

SEQ ID NO: 154358 - DNA, 25 bp, Homo sapien
cgctagcccgttccttaccctctgg

SEQ ID NO: 154359 - DNA, 25 bp, Homo sapien
tgcctagaaccctgggacacacggg

SEQ ID NO: 154360 - DNA, 25 bp, Homo sapien
gtgtgcttccggtatctctgcggga

SEQ ID NO: 154361 - DNA, 25 bp, Homo sapien
tgcttccggtatctctgcgggagga

SEQ ID NO: 154362 - DNA, 25 bp, Homo sapien
tggctcacttccatggggacggccc

SEQ ID NO: 154363 - DNA, 25 bp, Homo sapien
ggtgagttgaggaagcttttccctg

SEQ ID NO: 154364 - DNA, 25 bp, Homo sapien
tgaggaagcttttccctggtgttgc

SEQ ID NO: 154365 - DNA, 25 bp, Homo sapien
cttttccctggtgttgctgggctca

SEQ ID NO: 154366 - DNA, 25 bp, Homo sapien
ttccctggtgttgctgggctcaccc

SEQ ID NO: 154367 - DNA, 25 bp, Homo sapien
gcgccatggctcacttccatgggga

SEQ ID NO: 154368 - DNA, 25 bp, Homo sapien
cactgaggtcttcgaaggtgtccgc

SEQ ID NO: 154369 - DNA, 25 bp, Homo sapien
tccacgtcactgaggtcttcgaagg

SEQ ID NO: 154370 - DNA, 25 bp, Homo sapien
ggtctcccgagtcctgtgacactca

SEQ ID NO: 154371 - DNA, 25 bp, Homo sapien
gtgtacggactccaccagcatgccg

SEQ ID NO: 154372 - DNA, 25 bp, Homo sapien
gagtcgtgcttgacactccgccgca

SEQ ID NO: 154373 - DNA, 25 bp, Homo sapien
ggcgggtagtagagcttcaccagct

SEQ ID NO: 154374 - DNA, 25 bp, Homo sapien
agagcttcaccagctgcttgcagaa

SEQ ID NO: 154375 - DNA, 25 bp, Homo sapien
cagaagtggttcagcgggaatccca

SEQ ID NO: 154376 - DNA, 25 bp, Homo sapien
ctccgattctgtgtgtgacgccgcc

SEQ ID NO: 154377 - DNA, 25 bp, Homo sapien
tgtgagcctccgattctgtgtgtga

SEQ ID NO: 154378 - DNA, 25 bp, Homo sapien
attctgtgtgtgacgccgcctgtgt

SEQ ID NO: 154379 - DNA, 25 bp, Homo sapien
gagcctccgattctgtgtgtgacgc

SEQ ID NO: 154380 - DNA, 25 bp, Homo sapien
cctgtgtgagcctccgattctgtgt

SEQ ID NO: 154381 - DNA, 25 bp, Homo sapien
agcctccgattctgtgtgtgacgcc

SEQ ID NO: 154382 - DNA, 25 bp, Homo sapien
cgattctgtgtgtgacgccgcctgt

SEQ ID NO: 154383 - DNA, 25 bp, Homo sapien
gcctccgattctgtgtgtgacgccg

SEQ ID NO: 154384 - DNA, 25 bp, Homo sapien
acctgttccgcgaccgtcacgcacc

SEQ ID NO: 154385 - DNA, 25 bp, Homo sapien
gaaggacctgaggacccaggaaagc

SEQ ID NO: 154386 - DNA, 25 bp, Homo sapien
gcggccaaccactcggccgcgttgc

SEQ ID NO: 154387 - DNA, 25 bp, Homo sapien
gggctccgcggccaaccactcggcc

SEQ ID NO: 154388 - DNA, 25 bp, Homo sapien
aaggacctgaggacccaggaaagcg

SEQ ID NO: 154389 - DNA, 25 bp, Homo sapien
tccgcctgccgcgatgtaccgctac

SEQ ID NO: 154390 - DNA, 25 bp, Homo sapien
gtgaaggacctgaggacccaggaaa

SEQ ID NO: 154391 - DNA, 25 bp, Homo sapien
gcctgccgcgatgtaccgctacctg

SEQ ID NO: 154392 - DNA, 25 bp, Homo sapien
tcaagatggtggagggcttcttcga

SEQ ID NO: 154393 - DNA, 25 bp, Homo sapien
cttcttcaagatggtggagggcttc

SEQ ID NO: 154394 - DNA, 25 bp, Homo sapien
ggcttcttcgatcgcggcgccagca

SEQ ID NO: 154395 - DNA, 25 bp, Homo sapien
atcctgcggatcatcaagccctgca

SEQ ID NO: 154396 - DNA, 25 bp, Homo sapien
caagccctgcaaccatgtgctgagt

SEQ ID NO: 154397 - DNA, 25 bp, Homo sapien
gctcctgggaggtcatcgaaggcta

SEQ ID NO: 154398 - DNA, 25 bp, Homo sapien
tgcgcggcatcctgcggatcatcaa

SEQ ID NO: 154399 - DNA, 25 bp, Homo sapien
tcatcgaaggctaccgggcccagca

SEQ ID NO: 154400 - DNA, 25 bp, Homo sapien
acgcagaccacgaattcatgaattg

SEQ ID NO: 154401 - DNA, 25 bp, Homo sapien
aattgccgctgtgtctgtctggagc

SEQ ID NO: 154402 - DNA, 25 bp, Homo sapien
gcaagcggcgaagtcacgcagacca

SEQ ID NO: 154403 - DNA, 25 bp, Homo sapien
tggagcccactttggatctcccaga

SEQ ID NO: 154404 - DNA, 25 bp, Homo sapien
tgtcccagggtgatgccgactgtct

SEQ ID NO: 154405 - DNA, 25 bp, Homo sapien
cgtgcagctcctggaagttgtccca

SEQ ID NO: 154406 - DNA, 25 bp, Homo sapien
gctcgctgctctggactttgccatg

SEQ ID NO: 154407 - DNA, 25 bp, Homo sapien
gtgaagagtcgaggcttttcggctc

SEQ ID NO: 154408 - DNA, 25 bp, Homo sapien
ctttgcgaggttactacacgggttg

SEQ ID NO: 154409 - DNA, 25 bp, Homo sapien
caggggcggaataagagttctacta

SEQ ID NO: 154410 - DNA, 25 bp, Homo sapien
tccaaactgcggagtccaacgggtg

SEQ ID NO: 154411 - DNA, 25 bp, Homo sapien
cgggagctgagagttcgtttttcga

SEQ ID NO: 154412 - DNA, 25 bp, Homo sapien
ctcactagtagcagaagcccggatg

SEQ ID NO: 154413 - DNA, 25 bp, Homo sapien
ccagttctttatccactctgcggga

SEQ ID NO: 154414 - DNA, 25 bp, Homo sapien
ctaccgcaggcagtagcgatttctg

SEQ ID NO: 154415 - DNA, 25 bp, Homo sapien
gttcgccctccttggacttcaggca

SEQ ID NO: 154416 - DNA, 25 bp, Homo sapien
gtggacgccagcttgtcacctccgt

SEQ ID NO: 154417 - DNA, 25 bp, Homo sapien
tgtggacgtattcccagagcagctc

SEQ ID NO: 154418 - DNA, 25 bp, Homo sapien
gctcctcggacagctccgagaactt

SEQ ID NO: 154419 - DNA, 25 bp, Homo sapien
tgatggtctgcaaggacacagccgt

SEQ ID NO: 154420 - DNA, 25 bp, Homo sapien
accctggtgtccagctgatggtctg

SEQ ID NO: 154421 - DNA, 25 bp, Homo sapien
cgtagaattccgagaccctggtgtc

SEQ ID NO: 154422 - DNA, 25 bp, Homo sapien
tcaccttcgtttcctcgtagaattc

SEQ ID NO: 154423 - DNA, 25 bp, Homo sapien
gctccgagaacttcaccttcgtttc

SEQ ID NO: 154424 - DNA, 25 bp, Homo sapien
gcaagggcctcattttttcttactg

SEQ ID NO: 154425 - DNA, 25 bp, Homo sapien
gcatttccagattggggctcgggcc

SEQ ID NO: 154426 - DNA, 25 bp, Homo sapien
gccgcagagcggagttggcatttcc

SEQ ID NO: 154427 - DNA, 25 bp, Homo sapien
gcgctaggtcagcttctcggttcca

SEQ ID NO: 154428 - DNA, 25 bp, Homo sapien
tttccttcacctaggctggggccaa

SEQ ID NO: 154429 - DNA, 25 bp, Homo sapien
ctgacgtggacacacttcgggtttc

SEQ ID NO: 154430 - DNA, 25 bp, Homo sapien
cggtgtctctttgaggccctgacgt

SEQ ID NO: 154431 - DNA, 25 bp, Homo sapien
gggtacagcttgtgtaggctttccc

SEQ ID NO: 154432 - DNA, 25 bp, Homo sapien
gcgcggccaaacgaatgagtaagtc

SEQ ID NO: 154433 - DNA, 25 bp, Homo sapien
ctaaagacagaagaaccgcggctcg

SEQ ID NO: 154434 - DNA, 25 bp, Homo sapien
accgctctagaaccgcgggagcttc

SEQ ID NO: 154435 - DNA, 25 bp, Homo sapien
gcgcgggcacggcaccttgtttacc

SEQ ID NO: 154436 - DNA, 25 bp, Homo sapien
agtcagtcggccacgattggtcggt

SEQ ID NO: 154437 - DNA, 25 bp, Homo sapien
ttgcagtggcaactctctgccgcta

SEQ ID NO: 154438 - DNA, 25 bp, Homo sapien
attcgcctccaagtcgccgaagagc

SEQ ID NO: 154439 - DNA, 25 bp, Homo sapien
ggtgatgcccgactgggctgccacc

SEQ ID NO: 154440 - DNA, 25 bp, Homo sapien
gcgcgccatcaagagggcctgtacc

SEQ ID NO: 154441 - DNA, 25 bp, Homo sapien
caatgaagtcctcatggacggcagc

SEQ ID NO: 154442 - DNA, 25 bp, Homo sapien
agcggcccagccttttacgtggcct

SEQ ID NO: 154443 - DNA, 25 bp, Homo sapien
atgccagcggcttccgccacaatga

SEQ ID NO: 154444 - DNA, 25 bp, Homo sapien
aggacagccttcaggccattgtggc

SEQ ID NO: 154445 - DNA, 25 bp, Homo sapien
agctgctgcaccacgttcggcggct

SEQ ID NO: 154446 - DNA, 25 bp, Homo sapien
acgaggtagaggacagccttcaggc

SEQ ID NO: 154447 - DNA, 25 bp, Homo sapien
cggcttccgccacaatgatgtgatc

SEQ ID NO: 154448 - DNA, 25 bp, Homo sapien
cccgcacattggagcgcatggttaa

SEQ ID NO: 154449 - DNA, 25 bp, Homo sapien
tctctggatgaaatgcggaaacaca

SEQ ID NO: 154450 - DNA, 25 bp, Homo sapien
caccgcctgggttgtaatgactatc

SEQ ID NO: 154451 - DNA, 25 bp, Homo sapien
tggttaaagtcaacaccgacggctc

SEQ ID NO: 154452 - DNA, 25 bp, Homo sapien
tctcggggaccaagtctctggatga

SEQ ID NO: 154453 - DNA, 25 bp, Homo sapien
gccgttgctgaatctcggggaccaa

SEQ ID NO: 154454 - DNA, 25 bp, Homo sapien
ctcgcagatatgctggccgttgctg

SEQ ID NO: 154455 - DNA, 25 bp, Homo sapien
gacaaaggtatagggaggacgcatc

SEQ ID NO: 154456 - DNA, 25 bp, Homo sapien
tccaagcgcaagtttcggcggcgtc

SEQ ID NO: 154457 - DNA, 25 bp, Homo sapien
gtcgcggtggtgcaaaaaatgtttc

SEQ ID NO: 154458 - DNA, 25 bp, Homo sapien
cggaggcaggaaccgaacctagcta

SEQ ID NO: 154459 - DNA, 25 bp, Homo sapien
ctcctgcgggaaacgactgtaaatc

SEQ ID NO: 154460 - DNA, 25 bp, Homo sapien
tgggagccaggagaaacgcacctac

SEQ ID NO: 154461 - DNA, 25 bp, Homo sapien
ttcgcctgtagtccttggggtagaa

SEQ ID NO: 154462 - DNA, 25 bp, Homo sapien
tagctactattgcaccagcggacga

SEQ ID NO: 154463 - DNA, 25 bp, Homo sapien
cacattactgttcgagctgccgctc

SEQ ID NO: 154464 - DNA, 25 bp, Homo sapien
caagagcctgcatgaaactggaaca

SEQ ID NO: 154465 - DNA, 25 bp, Homo sapien
acactgtgcgcgcttttgttcagaa

SEQ ID NO: 154466 - DNA, 25 bp, Homo sapien
tgactaaggtcacgaatccggcccg

SEQ ID NO: 154467 - DNA, 25 bp, Homo sapien
ccgctgggcaacaaaaatgactctg

SEQ ID NO: 154468 - DNA, 25 bp, Homo sapien
tcccaaggtctgtcggcgggaatca

SEQ ID NO: 154469 - DNA, 25 bp, Homo sapien
tcaaacctagtctcgtgcacggatc

SEQ ID NO: 154470 - DNA, 25 bp, Homo sapien
agcgcacgtaccattcttcggcaaa

SEQ ID NO: 154471 - DNA, 25 bp, Homo sapien
ctcaccgagaggaagagcatgtcta

SEQ ID NO: 154472 - DNA, 25 bp, Homo sapien
ctgggctccagcaaacacgcacttg

SEQ ID NO: 154473 - DNA, 25 bp, Homo sapien
taagggaagcttccgctggaaccag

SEQ ID NO: 154474 - DNA, 25 bp, Homo sapien
gcaacgcggtcctgcgtgaacatcc

SEQ ID NO: 154475 - DNA, 25 bp, Homo sapien
ggtcctgcgtgaacatcccagggcc

SEQ ID NO: 154476 - DNA, 25 bp, Homo sapien
gggctgtgaacaaacctcacctctg

SEQ ID NO: 154477 - DNA, 25 bp, Homo sapien
gctcagctcgcgagagggacgccca

SEQ ID NO: 154478 - DNA, 25 bp, Homo sapien
gaacaaacctcacctctgggtgcca

SEQ ID NO: 154479 - DNA, 25 bp, Homo sapien
gaagccaaagctgaggaaacgtgca

SEQ ID NO: 154480 - DNA, 25 bp, Homo sapien
aagctattgccgagttgggaacccg

SEQ ID NO: 154481 - DNA, 25 bp, Homo sapien
tgggaacccgctagaggttacaata

SEQ ID NO: 154482 - DNA, 25 bp, Homo sapien
tttcctccgcaagaacagggacagg

SEQ ID NO: 154483 - DNA, 25 bp, Homo sapien
tctttgggcgaaggacgtttactga

SEQ ID NO: 154484 - DNA, 25 bp, Homo sapien
cgtgggagataccaagtgccgagcc

SEQ ID NO: 154485 - DNA, 25 bp, Homo sapien
ggcgacgcccacagcagtcttcttt

SEQ ID NO: 154486 - DNA, 25 bp, Homo sapien
gaggcactctccagcggctaacatc

SEQ ID NO: 154487 - DNA, 25 bp, Homo sapien
ccagaaactcgcgtcagaagcctta

SEQ ID NO: 154488 - DNA, 25 bp, Homo sapien
aatgaagtcctcaggaacggcggca

SEQ ID NO: 154489 - DNA, 25 bp, Homo sapien
gccattgtggccgacccgcgggtgc

SEQ ID NO: 154490 - DNA, 25 bp, Homo sapien
accggcttcgggccattgtggccga

SEQ ID NO: 154491 - DNA, 25 bp, Homo sapien
tgaagtcctcaggaacggcggcagc

SEQ ID NO: 154492 - DNA, 25 bp, Homo sapien
cgggttccgccatgatgatgtgatc

SEQ ID NO: 154493 - DNA, 25 bp, Homo sapien
agcgggttccgccatgatgatgtga

SEQ ID NO: 154494 - DNA, 25 bp, Homo sapien
gaagtcctcaggaacggcggcagcc

SEQ ID NO: 154495 - DNA, 25 bp, Homo sapien
acaatgaagtcctcaggaacggcgg

SEQ ID NO: 154496 - DNA, 25 bp, Homo sapien
gtcagccgagagctcaggatctcta

SEQ ID NO: 154497 - DNA, 25 bp, Homo sapien
cctggccagagatgcgcggcctgac

SEQ ID NO: 154498 - DNA, 25 bp, Homo sapien
gcacgtccaccacaaacagcgtatt

SEQ ID NO: 154499 - DNA, 25 bp, Homo sapien
aaacagcgtattacacttggtgccg

SEQ ID NO: 154500 - DNA, 25 bp, Homo sapien
ggccgcttctgcttcttgggtagca

SEQ ID NO: 154501 - DNA, 25 bp, Homo sapien
aggatctctaagaccaagaagctgg

SEQ ID NO: 154502 - DNA, 25 bp, Homo sapien
agacttcagtctgaggctcggcggc

SEQ ID NO: 154503 - DNA, 25 bp, Homo sapien
gcccttcagatagtgcaccagcctg

SEQ ID NO: 154504 - DNA, 25 bp, Homo sapien
cgctatgccaggcaacagtgtcatc

SEQ ID NO: 154505 - DNA, 25 bp, Homo sapien
gtcatcgaacttgtccgggtccatc

SEQ ID NO: 154506 - DNA, 25 bp, Homo sapien
agccctgttggtcctgggccagcct

SEQ ID NO: 154507 - DNA, 25 bp, Homo sapien
ctcactgtcccgcaagaggggaatg

SEQ ID NO: 154508 - DNA, 25 bp, Homo sapien
cacgtccaccacgaaaagcgtgtta

SEQ ID NO: 154509 - DNA, 25 bp, Homo sapien
gaaccttcagatagtgcgccatcga

SEQ ID NO: 154510 - DNA, 25 bp, Homo sapien
gcgccatcgagcgatacgtcgccgg

SEQ ID NO: 154511 - DNA, 25 bp, Homo sapien
agccttcggattctgaggcgcggca

SEQ ID NO: 154512 - DNA, 25 bp, Homo sapien
catataacacaattcctcttgtggg

SEQ ID NO: 154513 - DNA, 25 bp, Homo sapien
aatttgaacagatatttgtatgccc

SEQ ID NO: 154514 - DNA, 25 bp, Homo sapien
tcacagcagcaataaatgaaagatg

SEQ ID NO: 154515 - DNA, 25 bp, Homo sapien
aagatggaaaccaactcatatgtcc

SEQ ID NO: 154516 - DNA, 25 bp, Homo sapien
agggtgagccgccagctaagtctca

SEQ ID NO: 154517 - DNA, 25 bp, Homo sapien
tatttgtatgcccattttcacagca

SEQ ID NO: 154518 - DNA, 25 bp, Homo sapien
cagagattcaacttgctggtctacc

SEQ ID NO: 154519 - DNA, 25 bp, Homo sapien
ccggaaaatacatagatttaccata

SEQ ID NO: 154520 - DNA, 25 bp, Homo sapien
tgaccacgtgaccatgctgtgaccc

SEQ ID NO: 154521 - DNA, 25 bp, Homo sapien
agaatgtcccgggtccttgtctcgg

SEQ ID NO: 154522 - DNA, 25 bp, Homo sapien
cctgtaagacaacaacgggtgacca

SEQ ID NO: 154523 - DNA, 25 bp, Homo sapien
gtttctcaaaaccaggggaggcagc

SEQ ID NO: 154524 - DNA, 25 bp, Homo sapien
tggacgatcgcgacacctgtgaaca

SEQ ID NO: 154525 - DNA, 25 bp, Homo sapien
ccgtgggagctacaaagcgagtttc

SEQ ID NO: 154526 - DNA, 25 bp, Homo sapien
agcgaggcgtccttaatcctggatc

SEQ ID NO: 154527 - DNA, 25 bp, Homo sapien
ccgcggttacctttgctggagcagt

SEQ ID NO: 154528 - DNA, 25 bp, Homo sapien
tgaccacgatagtggcggtcgcatc

SEQ ID NO: 154529 - DNA, 25 bp, Homo sapien
aaagctccgcgggtacctgtcggcg

SEQ ID NO: 154530 - DNA, 25 bp, Homo sapien
ctcagaggggccaggcacaggattt

SEQ ID NO: 154531 - DNA, 25 bp, Homo sapien
gcacaggatttgtccaccacacaca

SEQ ID NO: 154532 - DNA, 25 bp, Homo sapien
gggctgctcgtcctctatgaccacg

SEQ ID NO: 154533 - DNA, 25 bp, Homo sapien
gtggctgccactgcggcagtgtcct

SEQ ID NO: 154534 - DNA, 25 bp, Homo sapien
cagtgtcctgctccatgccgtggga

SEQ ID NO: 154535 - DNA, 25 bp, Homo sapien
tccctcctcctgagaggtggacggc

SEQ ID NO: 154536 - DNA, 25 bp, Homo sapien
tgcagttccgcagtttgaccgcagg

SEQ ID NO: 154537 - DNA, 25 bp, Homo sapien
gccgctctctcttgggtcagattct

SEQ ID NO: 154538 - DNA, 25 bp, Homo sapien
agtccgtcaggtctctcgctgcagt

SEQ ID NO: 154539 - DNA, 25 bp, Homo sapien
ggagacccttgactagcgcccgcat

SEQ ID NO: 154540 - DNA, 25 bp, Homo sapien
accgcgcttccgaaggagacccttg

SEQ ID NO: 154541 - DNA, 25 bp, Homo sapien
cgcttgccgtatccgccggagagaa

SEQ ID NO: 154542 - DNA, 25 bp, Homo sapien
agtccgctgtcctgctgagcccgga

SEQ ID NO: 154543 - DNA, 25 bp, Homo sapien
tgttcctcaaacgacacgcagccga

SEQ ID NO: 154544 - DNA, 25 bp, Homo sapien
agccttcagggaccagaagacgttc

SEQ ID NO: 154545 - DNA, 25 bp, Homo sapien
aagacgttcaacatgggagcccagc

SEQ ID NO: 154546 - DNA, 25 bp, Homo sapien
cactccaggggctgcattttgtagc

SEQ ID NO: 154547 - DNA, 25 bp, Homo sapien
agattcatgctgctccttgggccgc

SEQ ID NO: 154548 - DNA, 25 bp, Homo sapien
acacaccgcggtcaaggagagccag

SEQ ID NO: 154549 - DNA, 25 bp, Homo sapien
aaagaagcagtccttgtggccagcc

SEQ ID NO: 154550 - DNA, 25 bp, Homo sapien
ggtcagttccttccatcgatccacg

SEQ ID NO: 154551 - DNA, 25 bp, Homo sapien
cgcgagcccacttggtcatgtggtc

SEQ ID NO: 154552 - DNA, 25 bp, Homo sapien
cggccgtcttcccaggaagaagaca

SEQ ID NO: 154553 - DNA, 25 bp, Homo sapien
acagcggccgtcttcccaggaagaa

SEQ ID NO: 154554 - DNA, 25 bp, Homo sapien
gaagaagacatttcctggcggggta

SEQ ID NO: 154555 - DNA, 25 bp, Homo sapien
tcttcccaggaagaagacatttcct

SEQ ID NO: 154556 - DNA, 25 bp, Homo sapien
ccctggcaccgttgccctggccagg

SEQ ID NO: 154557 - DNA, 25 bp, Homo sapien
agtgcgcctacgcaccgggggcact

SEQ ID NO: 154558 - DNA, 25 bp, Homo sapien
cagacagcggccgtcttcccaggaa

SEQ ID NO: 154559 - DNA, 25 bp, Homo sapien
cagcgcggcagtgcgcctacgcacc

SEQ ID NO: 154560 - DNA, 25 bp, Homo sapien
cgcccgaaagcagagaagtacccag

SEQ ID NO: 154561 - DNA, 25 bp, Homo sapien
gggctgtgcacacgtcctattgaca

SEQ ID NO: 154562 - DNA, 25 bp, Homo sapien
cgagtgactcgtgagattgggcctc

SEQ ID NO: 154563 - DNA, 25 bp, Homo sapien
ttgggcctcccttgctgaaaacttc

SEQ ID NO: 154564 - DNA, 25 bp, Homo sapien
cgtggacattcagcggccctacctt

SEQ ID NO: 154565 - DNA, 25 bp, Homo sapien
tgcagcttctagacgagacgcccga

SEQ ID NO: 154566 - DNA, 25 bp, Homo sapien
tgttccctccttcggtcccaggaga

SEQ ID NO: 154567 - DNA, 25 bp, Homo sapien
tacctttttccgtcaggcgccagca

SEQ ID NO: 154568 - DNA, 25 bp, Homo sapien
cccgaactgccattggttttgccta

SEQ ID NO: 154569 - DNA, 25 bp, Homo sapien
tcgttacctgaaccacggagaccca

SEQ ID NO: 154570 - DNA, 25 bp, Homo sapien
aatcacgtcggcagccaaaggtggc

SEQ ID NO: 154571 - DNA, 25 bp, Homo sapien
aggctgtctcctcctgacaaggggc

SEQ ID NO: 154572 - DNA, 25 bp, Homo sapien
tcggggccctaaaccagctgtggca

SEQ ID NO: 154573 - DNA, 25 bp, Homo sapien
ggccaaatggaacgctcctcacgtc

SEQ ID NO: 154574 - DNA, 25 bp, Homo sapien
tccagtagttgctcgccctctattg

SEQ ID NO: 154575 - DNA, 25 bp, Homo sapien
ggttttgcctaacgccactcgacga

SEQ ID NO: 154576 - DNA, 25 bp, Homo sapien
acacccgcgcgccagagaaatacgg

SEQ ID NO: 154577 - DNA, 25 bp, Homo sapien
gcccgcacggaaattgctttccttc

SEQ ID NO: 154578 - DNA, 25 bp, Homo sapien
tcgcgagcgattgacggaaacagaa

SEQ ID NO: 154579 - DNA, 25 bp, Homo sapien
tcacgcctcgtacggaacggaagtg

SEQ ID NO: 154580 - DNA, 25 bp, Homo sapien
gggcgctgtagtctttccttctgga

SEQ ID NO: 154581 - DNA, 25 bp, Homo sapien
ctcaggcctcccagttttctgcagg

SEQ ID NO: 154582 - DNA, 25 bp, Homo sapien
tgacagccgtttcatctcaggcctc

SEQ ID NO: 154583 - DNA, 25 bp, Homo sapien
aacagaaattgctttgcggcccgca

SEQ ID NO: 154584 - DNA, 25 bp, Homo sapien
cccaccgtggtctttgggtcatctc

SEQ ID NO: 154585 - DNA, 25 bp, Homo sapien
tctaatccttgtaggtcccactttc

SEQ ID NO: 154586 - DNA, 25 bp, Homo sapien
gggcagttctcctcctgcatcggta

SEQ ID NO: 154587 - DNA, 25 bp, Homo sapien
cgtggtctttgggtcatctcgaaga

SEQ ID NO: 154588 - DNA, 25 bp, Homo sapien
agctgcgttaaatccctgccctcag

SEQ ID NO: 154589 - DNA, 25 bp, Homo sapien
cccttccctcgctgactgtccatcc

SEQ ID NO: 154590 - DNA, 25 bp, Homo sapien
ccttcgccttcgtggccagcgtggt

SEQ ID NO: 154591 - DNA, 25 bp, Homo sapien
tcgaagagctgcgttaaatccctgc

SEQ ID NO: 154592 - DNA, 25 bp, Homo sapien
cccaagccgtgagggatcctaagcc

SEQ ID NO: 154593 - DNA, 25 bp, Homo sapien
gggactgtcctgaaaatgcccaagc

SEQ ID NO: 154594 - DNA, 25 bp, Homo sapien
ggatgacttgatccggagcctcctc

SEQ ID NO: 154595 - DNA, 25 bp, Homo sapien
gccgcgaccttatctccgaggatga

SEQ ID NO: 154596 - DNA, 25 bp, Homo sapien
ctaagccgaccgtcagacccggaga

SEQ ID NO: 154597 - DNA, 25 bp, Homo sapien
cgaggtctagtgacacgtccctgcc

SEQ ID NO: 154598 - DNA, 25 bp, Homo sapien
ctacgcattgcagagcccttggata

SEQ ID NO: 154599 - DNA, 25 bp, Homo sapien
gagcccttggatagacctcgccgga

SEQ ID NO: 154600 - DNA, 25 bp, Homo sapien
aggcagctttttcggttcccaggct

SEQ ID NO: 154601 - DNA, 25 bp, Homo sapien
cgaataccaaggaatgcaccgggca

SEQ ID NO: 154602 - DNA, 25 bp, Homo sapien
agcctccgggtgcttcgaataccaa

SEQ ID NO: 154603 - DNA, 25 bp, Homo sapien
gttggtaacaggagacactcgcttg

SEQ ID NO: 154604 - DNA, 25 bp, Homo sapien
cagcacctttcggttggtaacagga

SEQ ID NO: 154605 - DNA, 25 bp, Homo sapien
ctcttcctgaggcagcacctttcgg

SEQ ID NO: 154606 - DNA, 25 bp, Homo sapien
ttcggctcacgtgaccgcttgctct

SEQ ID NO: 154607 - DNA, 25 bp, Homo sapien
ctccctcttgggctctttgtctgtc

SEQ ID NO: 154608 - DNA, 25 bp, Homo sapien
caggatttcctgcactcgacgcggc

SEQ ID NO: 154609 - DNA, 25 bp, Homo sapien
agacaggccctgaactccgtgctgc

SEQ ID NO: 154610 - DNA, 25 bp, Homo sapien
cgggagtcctaaaagacaggccctg

SEQ ID NO: 154611 - DNA, 25 bp, Homo sapien
tcagagcggccggaagaaacaggaa

SEQ ID NO: 154612 - DNA, 25 bp, Homo sapien
tccaggccctgagctatctcggagc

SEQ ID NO: 154613 - DNA, 25 bp, Homo sapien
tgcccatcccacatgcaaagcgtga

SEQ ID NO: 154614 - DNA, 25 bp, Homo sapien
tcgaacttcggcctccgacgaaggc

SEQ ID NO: 154615 - DNA, 25 bp, Homo sapien
tttaaaatgcagcaactcccggccc

SEQ ID NO: 154616 - DNA, 25 bp, Homo sapien
cgcaatgcctgttccgtaagctttt

SEQ ID NO: 154617 - DNA, 25 bp, Homo sapien
tcacgggcactacgggaaacgcaat

SEQ ID NO: 154618 - DNA, 25 bp, Homo sapien
cggacattagaaacgaggcaccctg

SEQ ID NO: 154619 - DNA, 25 bp, Homo sapien
accacgatcgtgtccgctccaatga

SEQ ID NO: 154620 - DNA, 25 bp, Homo sapien
ggcccgcaggtctttctgtaagaaa

SEQ ID NO: 154621 - DNA, 25 bp, Homo sapien
ccgtgggtctcacagagaagttttc

SEQ ID NO: 154622 - DNA, 25 bp, Homo sapien
cgaagccaggccgactttggaagtg

SEQ ID NO: 154623 - DNA, 25 bp, Homo sapien
ggtcaggcactcacggagcatctca

SEQ ID NO: 154624 - DNA, 25 bp, Homo sapien
gggcaattcatactagcaccggcaa

SEQ ID NO: 154625 - DNA, 25 bp, Homo sapien
tcgttcgccacgatccaagagagtc

SEQ ID NO: 154626 - DNA, 25 bp, Homo sapien
gggcaattatccgagtccctggaaa

SEQ ID NO: 154627 - DNA, 25 bp, Homo sapien
gggtgctcttcagggctgctttctt

SEQ ID NO: 154628 - DNA, 25 bp, Homo sapien
cttagccaggtgagactcgttcgcc

SEQ ID NO: 154629 - DNA, 25 bp, Homo sapien
ctccctggagctgggtatgtcttcg

SEQ ID NO: 154630 - DNA, 25 bp, Homo sapien
tggaggctatggtcttgttaactac

SEQ ID NO: 154631 - DNA, 25 bp, Homo sapien
aagagagtcttcttcccggctgggc

SEQ ID NO: 154632 - DNA, 25 bp, Homo sapien
caacatacactgaggctaaaacggg

SEQ ID NO: 154633 - DNA, 25 bp, Homo sapien
gaaccacgcactgaggtcgcccagg

SEQ ID NO: 154634 - DNA, 25 bp, Homo sapien
cttgagcgccagaaccacgcactga

SEQ ID NO: 154635 - DNA, 25 bp, Homo sapien
tcacacagagcaggagcgaaatctt

SEQ ID NO: 154636 - DNA, 25 bp, Homo sapien
gaaatctttcgctctccgacccgaa

SEQ ID NO: 154637 - DNA, 25 bp, Homo sapien
ctaaaacggggatgagagtcacaca

SEQ ID NO: 154638 - DNA, 25 bp, Homo sapien
gataaagaaacttgcttcccgcggc

SEQ ID NO: 154639 - DNA, 25 bp, Homo sapien
ttccgatcttgcgtggaacgagccc

SEQ ID NO: 154640 - DNA, 25 bp, Homo sapien
tctcccaggagtctagctttttgcc

SEQ ID NO: 154641 - DNA, 25 bp, Homo sapien
agagaaccctttggccgcggctcac

SEQ ID NO: 154642 - DNA, 25 bp, Homo sapien
tctggggtctcgagatttgcacact

SEQ ID NO: 154643 - DNA, 25 bp, Homo sapien
tgaatgcgtctgttctccgctgccc

SEQ ID NO: 154644 - DNA, 25 bp, Homo sapien
cttggagggaaagtagccaccagtc

SEQ ID NO: 154645 - DNA, 25 bp, Homo sapien
tctctatttctacacagggtcggcg

SEQ ID NO: 154646 - DNA, 25 bp, Homo sapien
tgtgagccacttccacgggtattca

SEQ ID NO: 154647 - DNA, 25 bp, Homo sapien
acctggatttccatgggagggatga

SEQ ID NO: 154648 - DNA, 25 bp, Homo sapien
tgcgggagattgttgtagggaaaga

SEQ ID NO: 154649 - DNA, 25 bp, Homo sapien
attgttgtagggaaagacgtggtcg

SEQ ID NO: 154650 - DNA, 25 bp, Homo sapien
ccggccgcacctcggctggggattt

SEQ ID NO: 154651 - DNA, 25 bp, Homo sapien
gccgcacctcggctggggatttcgc

SEQ ID NO: 154652 - DNA, 25 bp, Homo sapien
acctcggctggggatttcgcgttat

SEQ ID NO: 154653 - DNA, 25 bp, Homo sapien
cctcggctggggatttcgcgttatg

SEQ ID NO: 154654 - DNA, 25 bp, Homo sapien
tcgcgttatggaggtgcgggagatt

SEQ ID NO: 154655 - DNA, 25 bp, Homo sapien
aagggatagggaggtgaactggtcg

SEQ ID NO: 154656 - DNA, 25 bp, Homo sapien
acggtcaggtccctccgctagcaaa

SEQ ID NO: 154657 - DNA, 25 bp, Homo sapien
aagtgctcgggccttctggatcccg

SEQ ID NO: 154658 - DNA, 25 bp, Homo sapien
gaaccatccggggacagttgcaggc

SEQ ID NO: 154659 - DNA, 25 bp, Homo sapien
tttggtggcggccagaaccatccgg

SEQ ID NO: 154660 - DNA, 25 bp, Homo sapien
ggaaagttcgaagctccggagcagc

SEQ ID NO: 154661 - DNA, 25 bp, Homo sapien
tcgctctcccgcttcacggtagaag

SEQ ID NO: 154662 - DNA, 25 bp, Homo sapien
cctccgctagcaaacggctgtctgg

SEQ ID NO: 154663 - DNA, 25 bp, Homo sapien
ggccttctggatcccgcagcaggat

SEQ ID NO: 154664 - DNA, 25 bp, Homo sapien
cgacagcggacccaagatggcgacc

SEQ ID NO: 154665 - DNA, 25 bp, Homo sapien
agccgtgcagcctcatcgtttccag

SEQ ID NO: 154666 - DNA, 25 bp, Homo sapien
cgtttccaggtttcaatatggctcc

SEQ ID NO: 154667 - DNA, 25 bp, Homo sapien
cgcgtcaccgaaaaggttaatctca

SEQ ID NO: 154668 - DNA, 25 bp, Homo sapien
agaaactaacttgaactcgcgcgga

SEQ ID NO: 154669 - DNA, 25 bp, Homo sapien
aacagaagttgtcgcgctttgcatc

SEQ ID NO: 154670 - DNA, 25 bp, Homo sapien
agacgtcagcgtctaccggattccg

SEQ ID NO: 154671 - DNA, 25 bp, Homo sapien
ctcgcgcggaagtgacgcaacagaa

SEQ ID NO: 154672 - DNA, 25 bp, Homo sapien
ggcgcagacatgcaccgaaacgagc

SEQ ID NO: 154673 - DNA, 25 bp, Homo sapien
agttggagggagagatgcaaatacc

SEQ ID NO: 154674 - DNA, 25 bp, Homo sapien
gaaatgcagtagagacacacacgtc

SEQ ID NO: 154675 - DNA, 25 bp, Homo sapien
catctcggtggaaacagcgcccgtc

SEQ ID NO: 154676 - DNA, 25 bp, Homo sapien
caaggctcgaagaaccggcgccatc

SEQ ID NO: 154677 - DNA, 25 bp, Homo sapien
cttcgcgccgccaatggcaagttgg

SEQ ID NO: 154678 - DNA, 25 bp, Homo sapien
caaataccaggtgagacggcggcgc

SEQ ID NO: 154679 - DNA, 25 bp, Homo sapien
gcgccatcgacgtacctgaggccga

SEQ ID NO: 154680 - DNA, 25 bp, Homo sapien
gccgcggggctgatctccgtactct

SEQ ID NO: 154681 - DNA, 25 bp, Homo sapien
cttccaagcccggatcctggtgggg

SEQ ID NO: 154682 - DNA, 25 bp, Homo sapien
ggactttgcagaagcgcgcaggaac

SEQ ID NO: 154683 - DNA, 25 bp, Homo sapien
tcgagggactttgcagaagcgcgca

SEQ ID NO: 154684 - DNA, 25 bp, Homo sapien
ctttgctgaagttaggagccgcccg

SEQ ID NO: 154685 - DNA, 25 bp, Homo sapien
caggaggaggagatatcggctcctc

SEQ ID NO: 154686 - DNA, 25 bp, Homo sapien
accgcccgaaactgcaattcctttg

SEQ ID NO: 154687 - DNA, 25 bp, Homo sapien
tccttctctcgagttcggggacggc

SEQ ID NO: 154688 - DNA, 25 bp, Homo sapien
acatttcggcgaccgctattcggga

SEQ ID NO: 154689 - DNA, 25 bp, Homo sapien
cgctggctctaggtagccggttttc

SEQ ID NO: 154690 - DNA, 25 bp, Homo sapien
attggacagagaagccggcctgcta

SEQ ID NO: 154691 - DNA, 25 bp, Homo sapien
gggcaccagcttctgcttcaaagca

SEQ ID NO: 154692 - DNA, 25 bp, Homo sapien
gttgcctggaatgggtcagtcacct

SEQ ID NO: 154693 - DNA, 25 bp, Homo sapien
tgccgcattgcgattggtccgcacg

SEQ ID NO: 154694 - DNA, 25 bp, Homo sapien
aggatttgcgcatgcactagctggc

SEQ ID NO: 154695 - DNA, 25 bp, Homo sapien
tggccgcaagctcgcaaagacgctg

SEQ ID NO: 154696 - DNA, 25 bp, Homo sapien
ctcccgaggtgaaagaggtgcctcc

SEQ ID NO: 154697 - DNA, 25 bp, Homo sapien
ccagtgatgtcttaaggtgcagctc

SEQ ID NO: 154698 - DNA, 25 bp, Homo sapien
ccctggcttttgtgttggtgcctcc

SEQ ID NO: 154699 - DNA, 25 bp, Homo sapien
acgttctctttgtgtggagccctca

SEQ ID NO: 154700 - DNA, 25 bp, Homo sapien
agctcgactcgtcgctggaccagta

SEQ ID NO: 154701 - DNA, 25 bp, Homo sapien
ggaccagtacgtgcagattcgcatc

SEQ ID NO: 154702 - DNA, 25 bp, Homo sapien
ctcgagcgcacgaacgtggacgttc

SEQ ID NO: 154703 - DNA, 25 bp, Homo sapien
gagcatccctttatcccaaggcgcg

SEQ ID NO: 154704 - DNA, 25 bp, Homo sapien
cggagacttccagcgcggaaccggc

SEQ ID NO: 154705 - DNA, 25 bp, Homo sapien
gtatataactgcacgcgctgcctca

SEQ ID NO: 154706 - DNA, 25 bp, Homo sapien
agatggtggcccaccagctaccacg

SEQ ID NO: 154707 - DNA, 25 bp, Homo sapien
ccgtcgatccgcaccggcatagaga

SEQ ID NO: 154708 - DNA, 25 bp, Homo sapien
ccgcttaccgagagcagagcagatc

SEQ ID NO: 154709 - DNA, 25 bp, Homo sapien
ggagcgcgaaaaacctcaggcgaca

SEQ ID NO: 154710 - DNA, 25 bp, Homo sapien
ggcgacagcctcagcaacagcgact

SEQ ID NO: 154711 - DNA, 25 bp, Homo sapien
gcctcatgggtagacgccgactcca

SEQ ID NO: 154712 - DNA, 25 bp, Homo sapien
ttggtttcaatgcttccgggttggc

SEQ ID NO: 154713 - DNA, 25 bp, Homo sapien
ttccgcctcttatttcgcgcctttg

SEQ ID NO: 154714 - DNA, 25 bp, Homo sapien
tggggaagctaccaaattctcacgc

SEQ ID NO: 154715 - DNA, 25 bp, Homo sapien
gcgagcacgttaactggggaagcta

SEQ ID NO: 154716 - DNA, 25 bp, Homo sapien
cggtgacgaggcgacacctctttcc

SEQ ID NO: 154717 - DNA, 25 bp, Homo sapien
ttctagtccttctacgcgccaggtg

SEQ ID NO: 154718 - DNA, 25 bp, Homo sapien
cgttgccgcctttttcgtactgagc

SEQ ID NO: 154719 - DNA, 25 bp, Homo sapien
tcagcttcccagtcgtccgatgagc

SEQ ID NO: 154720 - DNA, 25 bp, Homo sapien
tagttttgctcttcctcagctccgg

SEQ ID NO: 154721 - DNA, 25 bp, Homo sapien
gaagtaaggcgtcagcttccttttg

SEQ ID NO: 154722 - DNA, 25 bp, Homo sapien
tcaccgaatcgactggccactggcg

SEQ ID NO: 154723 - DNA, 25 bp, Homo sapien
ctttcccgggcgctgattcctgagt

SEQ ID NO: 154724 - DNA, 25 bp, Homo sapien
attcctgagtgctgagcgcgaaccc

SEQ ID NO: 154725 - DNA, 25 bp, Homo sapien
agcgcgaacccgaggagatgaagta

SEQ ID NO: 154726 - DNA, 25 bp, Homo sapien
cccgaggagatgaagtaaggcgtca

SEQ ID NO: 154727 - DNA, 25 bp, Homo sapien
ctcttccggcgcgaggtcaccgaat

SEQ ID NO: 154728 - DNA, 25 bp, Homo sapien
ccggctaccgaagcgctagtcctta

SEQ ID NO: 154729 - DNA, 25 bp, Homo sapien
gccgcgccactctcttccgaaatgc

SEQ ID NO: 154730 - DNA, 25 bp, Homo sapien
cagttcctgggctcgtagtgccctc

SEQ ID NO: 154731 - DNA, 25 bp, Homo sapien
gctagtccttatacagccgcggaaa

SEQ ID NO: 154732 - DNA, 25 bp, Homo sapien
ctggcgcctagagctcaaaagccca

SEQ ID NO: 154733 - DNA, 25 bp, Homo sapien
ccgggctcaagagaactggcgccta

SEQ ID NO: 154734 - DNA, 25 bp, Homo sapien
aaaagagcaaagacagcgcgctccc

SEQ ID NO: 154735 - DNA, 25 bp, Homo sapien
tacagccgcggaaaatcgggccggc

SEQ ID NO: 154736 - DNA, 25 bp, Homo sapien
aacactcttagctgggtgcagggtg

SEQ ID NO: 154737 - DNA, 25 bp, Homo sapien
tgtccggtgaccgaaacactcttag

SEQ ID NO: 154738 - DNA, 25 bp, Homo sapien
caatcgcgctaatggctcggcggta

SEQ ID NO: 154739 - DNA, 25 bp, Homo sapien
caaaggttaactgcgagctgccggg

SEQ ID NO: 154740 - DNA, 25 bp, Homo sapien
catggcgtggatactggactgcctt

SEQ ID NO: 154741 - DNA, 25 bp, Homo sapien
tggactgccttttcgcctcggcctt

SEQ ID NO: 154742 - DNA, 25 bp, Homo sapien
tagctaattgttcctggctcaaggg

SEQ ID NO: 154743 - DNA, 25 bp, Homo sapien
aatcaccagctttgccgggaaccgc

SEQ ID NO: 154744 - DNA, 25 bp, Homo sapien
cgtggatccctctccagctcgaggg

SEQ ID NO: 154745 - DNA, 25 bp, Homo sapien
ggatcggccgtggatccctctccag

SEQ ID NO: 154746 - DNA, 25 bp, Homo sapien
atccctctccagctcgagggctgga

SEQ ID NO: 154747 - DNA, 25 bp, Homo sapien
ggcgggacttcccatgtctttctcc

SEQ ID NO: 154748 - DNA, 25 bp, Homo sapien
ggacttcccatgtctttctcctcga

SEQ ID NO: 154749 - DNA, 25 bp, Homo sapien
ttctcctcgagctcggaaaaagttc

SEQ ID NO: 154750 - DNA, 25 bp, Homo sapien
tcctcgagctcggaaaaagttccca

SEQ ID NO: 154751 - DNA, 25 bp, Homo sapien
aggccggcgggacttcccatgtctt

SEQ ID NO: 154752 - DNA, 25 bp, Homo sapien
ttaactttacaggttctgcgctgcc

SEQ ID NO: 154753 - DNA, 25 bp, Homo sapien
ggaccaagaggctcgccaagaggta

SEQ ID NO: 154754 - DNA, 25 bp, Homo sapien
cctgagagtgtggaacaagttgccc

SEQ ID NO: 154755 - DNA, 25 bp, Homo sapien
tgcccaggcttttgcgttcgatgtc

SEQ ID NO: 154756 - DNA, 25 bp, Homo sapien
cgcgccgcagggctttgtttaactt

SEQ ID NO: 154757 - DNA, 25 bp, Homo sapien
aaaggccatgctctgcagcgcagtg

SEQ ID NO: 154758 - DNA, 25 bp, Homo sapien
actgtcgagcaggtcacgcagcctt

SEQ ID NO: 154759 - DNA, 25 bp, Homo sapien
tcgatgtctcaaacgtaagagcgca

SEQ ID NO: 154760 - DNA, 25 bp, Homo sapien
ggttcgagtgcaccagggaatctca

SEQ ID NO: 154761 - DNA, 25 bp, Homo sapien
aatctcaggggtaagcgcgcggatt

SEQ ID NO: 154762 - DNA, 25 bp, Homo sapien
ggaggtgcgcctctagcactgccca

SEQ ID NO: 154763 - DNA, 25 bp, Homo sapien
gcaccgcgaacgcagcttgaattga

SEQ ID NO: 154764 - DNA, 25 bp, Homo sapien
agccactgatgccagattcggagtg

SEQ ID NO: 154765 - DNA, 25 bp, Homo sapien
gagcgcgcccgcagtaacttggcga

SEQ ID NO: 154766 - DNA, 25 bp, Homo sapien
ccctctcctgttgcgtgatctgggg

SEQ ID NO: 154767 - DNA, 25 bp, Homo sapien
tgtattgagcgactacgggtgcgta

SEQ ID NO: 154768 - DNA, 25 bp, Homo sapien
ccgttgatgatggtgtacatggcgc

SEQ ID NO: 154769 - DNA, 25 bp, Homo sapien
cgccggcgattcacacgattgaaca

SEQ ID NO: 154770 - DNA, 25 bp, Homo sapien
gccttggccctgcactcgacagggg

SEQ ID NO: 154771 - DNA, 25 bp, Homo sapien
gctcctggagctggcccttcacctg

SEQ ID NO: 154772 - DNA, 25 bp, Homo sapien
acctgctgctgcgtgagacctgtgc

SEQ ID NO: 154773 - DNA, 25 bp, Homo sapien
gcgaccaacttgctgggcccgttga

SEQ ID NO: 154774 - DNA, 25 bp, Homo sapien
cacgattgaacacaagccttggccc

SEQ ID NO: 154775 - DNA, 25 bp, Homo sapien
tgccggcttttcaggagctcctgga

SEQ ID NO: 154776 - DNA, 25 bp, Homo sapien
gccggggagccaagaaagacttcca

SEQ ID NO: 154777 - DNA, 25 bp, Homo sapien
actcacagcgctcggcgttcaggaa

SEQ ID NO: 154778 - DNA, 25 bp, Homo sapien
gactccgcggctatctgtaatccta

SEQ ID NO: 154779 - DNA, 25 bp, Homo sapien
cctcttcctaaagcggcgaggcgca

SEQ ID NO: 154780 - DNA, 25 bp, Homo sapien
agccaaacctcttcgctgcctggag

SEQ ID NO: 154781 - DNA, 25 bp, Homo sapien
agaggagcggcatcactcgagccca

SEQ ID NO: 154782 - DNA, 25 bp, Homo sapien
aagtttcagctcaagtcgtctccga

SEQ ID NO: 154783 - DNA, 25 bp, Homo sapien
cgccagaaaggtagactgagtccca

SEQ ID NO: 154784 - DNA, 25 bp, Homo sapien
cctctggaaacctgcgacgtcagtc

SEQ ID NO: 154785 - DNA, 25 bp, Homo sapien
ggctaataatctagcgaccgggaga

SEQ ID NO: 154786 - DNA, 25 bp, Homo sapien
agggtttccctgacacactggctga

SEQ ID NO: 154787 - DNA, 25 bp, Homo sapien
ggtgcggaacctgcgggctaataat

SEQ ID NO: 154788 - DNA, 25 bp, Homo sapien
gaggctctgtcacgccaaggccatg

SEQ ID NO: 154789 - DNA, 25 bp, Homo sapien
agaaggacgcacattacccggctga

SEQ ID NO: 154790 - DNA, 25 bp, Homo sapien
agggctccgttccagttaccgctgc

SEQ ID NO: 154791 - DNA, 25 bp, Homo sapien
agactggacgggatcacttccggtg

SEQ ID NO: 154792 - DNA, 25 bp, Homo sapien
agtgcgggcactttcttcctgtagg

SEQ ID NO: 154793 - DNA, 25 bp, Homo sapien
gggcgctgtttcgtcgcgaaatata

SEQ ID NO: 154794 - DNA, 25 bp, Homo sapien
aggctcttggttcagtccactcgga

SEQ ID NO: 154795 - DNA, 25 bp, Homo sapien
tgcaagactcctttcggttccaggg

SEQ ID NO: 154796 - DNA, 25 bp, Homo sapien
cccttcgtgctttttgcaagactcc

SEQ ID NO: 154797 - DNA, 25 bp, Homo sapien
aagtctacagacacgcgcacgctga

SEQ ID NO: 154798 - DNA, 25 bp, Homo sapien
ggccgctctggggtataaaatgtca

SEQ ID NO: 154799 - DNA, 25 bp, Homo sapien
ggttcgctcactcgtgcctggttct

SEQ ID NO: 154800 - DNA, 25 bp, Homo sapien
cggggctcatattaccctggggata

SEQ ID NO: 154801 - DNA, 25 bp, Homo sapien
gcccttgatgtcgaagtctaccttg

SEQ ID NO: 154802 - DNA, 25 bp, Homo sapien
gcggcacccaacttgctatcggaga

SEQ ID NO: 154803 - DNA, 25 bp, Homo sapien
tggtcatccggtatgcggcctccaa

SEQ ID NO: 154804 - DNA, 25 bp, Homo sapien
atcctctttggagcgcacacctctg

SEQ ID NO: 154805 - DNA, 25 bp, Homo sapien
tctcatcctccgagcggtacgggtc

SEQ ID NO: 154806 - DNA, 25 bp, Homo sapien
tgctccagctggatgttacgcacca

SEQ ID NO: 154807 - DNA, 25 bp, Homo sapien
ctagcagcagcttgttggatttctc

SEQ ID NO: 154808 - DNA, 25 bp, Homo sapien
agcggggcgtcctataaggagttca

SEQ ID NO: 154809 - DNA, 25 bp, Homo sapien
ccggtgacacgcactttgagggcca

SEQ ID NO: 154810 - DNA, 25 bp, Homo sapien
tttctccctctagtgtacctgcgtc

SEQ ID NO: 154811 - DNA, 25 bp, Homo sapien
tcccttcccgaagtgtcggtctctg

SEQ ID NO: 154812 - DNA, 25 bp, Homo sapien
gggtgtgcccacctaccgttgatct

SEQ ID NO: 154813 - DNA, 25 bp, Homo sapien
tggacacgtaaagacgtcgcacttc

SEQ ID NO: 154814 - DNA, 25 bp, Homo sapien
gtcgcacttccgagcaacttttcga

SEQ ID NO: 154815 - DNA, 25 bp, Homo sapien
acttttcgacttgagctcggcagcc

SEQ ID NO: 154816 - DNA, 25 bp, Homo sapien
tcatctgttgacagcggcagccctc

SEQ ID NO: 154817 - DNA, 25 bp, Homo sapien
ggacagtcaatcacgcagggccatt

SEQ ID NO: 154818 - DNA, 25 bp, Homo sapien
ggaggccacaaacgtctcacggtta

SEQ ID NO: 154819 - DNA, 25 bp, Homo sapien
gcctgagttgagaagagaccctgga

SEQ ID NO: 154820 - DNA, 25 bp, Homo sapien
cgcgcctcactggatgcctgagttg

SEQ ID NO: 154821 - DNA, 25 bp, Homo sapien
gttgagagccaccagccaagttttg

SEQ ID NO: 154822 - DNA, 25 bp, Homo sapien
ggcccgcctccatgacttgttgaga

SEQ ID NO: 154823 - DNA, 25 bp, Homo sapien
tgcgcatccgcattcacaacttggt

SEQ ID NO: 154824 - DNA, 25 bp, Homo sapien
tcaccaaggtcaaggggatcaccac

SEQ ID NO: 154825 - DNA, 25 bp, Homo sapien
tcaccacgtccgagcacaaagtgtg

SEQ ID NO: 154826 - DNA, 25 bp, Homo sapien
gtgcaccctaccctagtgggcggag

SEQ ID NO: 154827 - DNA, 25 bp, Homo sapien
ggcagcgtgttcagcatcatcacca

SEQ ID NO: 154828 - DNA, 25 bp, Homo sapien
cgcctccaccctagagcataagggt

SEQ ID NO: 154829 - DNA, 25 bp, Homo sapien
gcataagggtccacaacgccacctg

SEQ ID NO: 154830 - DNA, 25 bp, Homo sapien
ttcatcgtgcagaaaagctaccagg

SEQ ID NO: 154831 - DNA, 25 bp, Homo sapien
cgagagctccatcatcaccaaggtc

SEQ ID NO: 154832 - DNA, 25 bp, Homo sapien
gcaaaagtttcctcgcagctacctg

SEQ ID NO: 154833 - DNA, 25 bp, Homo sapien
gtgctgctacccagccgctgcaaaa

SEQ ID NO: 154834 - DNA, 25 bp, Homo sapien
ccctgaggagcaagagacgtgctgc

SEQ ID NO: 154835 - DNA, 25 bp, Homo sapien
ggccatcctgcttcgcagggagcta

SEQ ID NO: 154836 - DNA, 25 bp, Homo sapien
tcccgggaagtccaagctgagcagc

SEQ ID NO: 154837 - DNA, 25 bp, Homo sapien
cacccacttgagtccgggctgcagt

SEQ ID NO: 154838 - DNA, 25 bp, Homo sapien
acgggagtttctggcacccacttga

SEQ ID NO: 154839 - DNA, 25 bp, Homo sapien
agggcgctctggcataactactgca

SEQ ID NO: 154840 - DNA, 25 bp, Homo sapien
tccattcccgggttggtgggataga

SEQ ID NO: 154841 - DNA, 25 bp, Homo sapien
gagtccttaattaaaggcgcgcctg

SEQ ID NO: 154842 - DNA, 25 bp, Homo sapien
cggcccgcacaggaattaggaaacg

SEQ ID NO: 154843 - DNA, 25 bp, Homo sapien
ttggccctctgtccgtagctatatc

SEQ ID NO: 154844 - DNA, 25 bp, Homo sapien
cactaaatggatcaaggccgcgagc

SEQ ID NO: 154845 - DNA, 25 bp, Homo sapien
cggagttctccattcaaagcaccaa

SEQ ID NO: 154846 - DNA, 25 bp, Homo sapien
aagcatcatgggaaacggagttctc

SEQ ID NO: 154847 - DNA, 25 bp, Homo sapien
tgccaccacttgaggagcgctccgt

SEQ ID NO: 154848 - DNA, 25 bp, Homo sapien
gttcgggctctccagacggcatcca

SEQ ID NO: 154849 - DNA, 25 bp, Homo sapien
agtcctccggccaggctttgactgc

SEQ ID NO: 154850 - DNA, 25 bp, Homo sapien
gtcacctgcaatggggaccgaagca

SEQ ID NO: 154851 - DNA, 25 bp, Homo sapien
cccgccagcgactaggtcgggactg

SEQ ID NO: 154852 - DNA, 25 bp, Homo sapien
ccactgcaagttatttctgtcctta

SEQ ID NO: 154853 - DNA, 25 bp, Homo sapien
agacggcatccacgcttccaggtat

SEQ ID NO: 154854 - DNA, 25 bp, Homo sapien
ccaggctttgactgcgggacgccag

SEQ ID NO: 154855 - DNA, 25 bp, Homo sapien
tccaggtatgtctgcggacgggaaa

SEQ ID NO: 154856 - DNA, 25 bp, Homo sapien
agaatagaaggtccgcgcgcgaaca

SEQ ID NO: 154857 - DNA, 25 bp, Homo sapien
gcgagcccgtctctcctcgaatgaa

SEQ ID NO: 154858 - DNA, 25 bp, Homo sapien
cccgctctcaggcactgctggagaa

SEQ ID NO: 154859 - DNA, 25 bp, Homo sapien
ctggagaaccgagaccgacttcttt

SEQ ID NO: 154860 - DNA, 25 bp, Homo sapien
taaaggggactcttggtggtctcgc

SEQ ID NO: 154861 - DNA, 25 bp, Homo sapien
gtggtttctgcacatgcgctgtggc

SEQ ID NO: 154862 - DNA, 25 bp, Homo sapien
ggcctgccgccttcagtcgtacagg

SEQ ID NO: 154863 - DNA, 25 bp, Homo sapien
cgcgctcgggacgtatcaacgctct

SEQ ID NO: 154864 - DNA, 25 bp, Homo sapien
gccctcaggcgaacctctcggcttt

SEQ ID NO: 154865 - DNA, 25 bp, Homo sapien
ctccgttatggcgacccgcagccct

SEQ ID NO: 154866 - DNA, 25 bp, Homo sapien
cgggttcggctttacgtcacgcgag

SEQ ID NO: 154867 - DNA, 25 bp, Homo sapien
ttcggctttacgtcacgcgagggcg

SEQ ID NO: 154868 - DNA, 25 bp, Homo sapien
cggctgcgacgagccctcaggcgaa

SEQ ID NO: 154869 - DNA, 25 bp, Homo sapien
ctcggcacggaaagcgaccacctgg

SEQ ID NO: 154870 - DNA, 25 bp, Homo sapien
atggtgaggttctcggggcacctct

SEQ ID NO: 154871 - DNA, 25 bp, Homo sapien
aaatggcgttttggttgacatgtgc

SEQ ID NO: 154872 - DNA, 25 bp, Homo sapien
caaccggttccgtgtctcacctggg

SEQ ID NO: 154873 - DNA, 25 bp, Homo sapien
gcagaatggggatttctaggccgcc

SEQ ID NO: 154874 - DNA, 25 bp, Homo sapien
cgactcccagctctagacttcggaa

SEQ ID NO: 154875 - DNA, 25 bp, Homo sapien
gcaaaaggccgcttggattccggga

SEQ ID NO: 154876 - DNA, 25 bp, Homo sapien
tgttcgccgtttgagcctggagatt

SEQ ID NO: 154877 - DNA, 25 bp, Homo sapien
gggcgtcacaaggtggctctcccac

SEQ ID NO: 154878 - DNA, 25 bp, Homo sapien
tttcgatgcatctcgggagacccgg

SEQ ID NO: 154879 - DNA, 25 bp, Homo sapien
agctcaatttcgatgcatctcggga

SEQ ID NO: 154880 - DNA, 25 bp, Homo sapien
cggggcaaacgtttgatgcaatctt

SEQ ID NO: 154881 - DNA, 25 bp, Homo sapien
ggactacagccctgctgcgtggaca

SEQ ID NO: 154882 - DNA, 25 bp, Homo sapien
tgcagaactgttcccgctgctaggg

SEQ ID NO: 154883 - DNA, 25 bp, Homo sapien
gcaccgatcgctcactgcagaactg

SEQ ID NO: 154884 - DNA, 25 bp, Homo sapien
aggcccgaacggcagtcccagactt

SEQ ID NO: 154885 - DNA, 25 bp, Homo sapien
agacttacctgctgggtaggcccga

SEQ ID NO: 154886 - DNA, 25 bp, Homo sapien
atgcaatcttgggtctcgctgctcc

SEQ ID NO: 154887 - DNA, 25 bp, Homo sapien
accgcaggcgatggcctaagactta

SEQ ID NO: 154888 - DNA, 25 bp, Homo sapien
tgttagacgctattaaggaccatgc

SEQ ID NO: 154889 - DNA, 25 bp, Homo sapien
cgaagctttttgctcggtgcttaca

SEQ ID NO: 154890 - DNA, 25 bp, Homo sapien
ccatgcgtttgagtgcagatctgtc

SEQ ID NO: 154891 - DNA, 25 bp, Homo sapien
aggagcccttatcctggatgttaga

SEQ ID NO: 154892 - DNA, 25 bp, Homo sapien
ggaggtccttatccttgaagatgca

SEQ ID NO: 154893 - DNA, 25 bp, Homo sapien
tcacgatgtctgcagttttcaaatg

SEQ ID NO: 154894 - DNA, 25 bp, Homo sapien
gggcgcccagagtaaccaacaccga

SEQ ID NO: 154895 - DNA, 25 bp, Homo sapien
ccatagtcctttggtgggcataaca

SEQ ID NO: 154896 - DNA, 25 bp, Homo sapien
ctcgaaatccgcctccaaaggggag

SEQ ID NO: 154897 - DNA, 25 bp, Homo sapien
cggcggaactcatgctgctatcttt

SEQ ID NO: 154898 - DNA, 25 bp, Homo sapien
tctttccggctgaggaccacaagcg

SEQ ID NO: 154899 - DNA, 25 bp, Homo sapien
cgctagcaccgaggacctgacagtc

SEQ ID NO: 154900 - DNA, 25 bp, Homo sapien
cctcccgcctcgaggacaggttggg

SEQ ID NO: 154901 - DNA, 25 bp, Homo sapien
tcctctctcgggttctaatggtctg

SEQ ID NO: 154902 - DNA, 25 bp, Homo sapien
cacgcttcagaagcgggaacctccg

SEQ ID NO: 154903 - DNA, 25 bp, Homo sapien
ggccaagaccaaaatctacaacctg

SEQ ID NO: 154904 - DNA, 25 bp, Homo sapien
gggatcatagcctagcttggccttg

SEQ ID NO: 154905 - DNA, 25 bp, Homo sapien
cagccgggatgtggcttacgtgcct

SEQ ID NO: 154906 - DNA, 25 bp, Homo sapien
cgggtctagctccacgggatcatag

SEQ ID NO: 154907 - DNA, 25 bp, Homo sapien
cggcacaggacaaaacacgtgtgtc

SEQ ID NO: 154908 - DNA, 25 bp, Homo sapien
atctggatgcgtgcacacggcagca

SEQ ID NO: 154909 - DNA, 25 bp, Homo sapien
tgctccgtggccatccggcacatgt

SEQ ID NO: 154910 - DNA, 25 bp, Homo sapien
cggcacatgtcctccgggtctagct

SEQ ID NO: 154911 - DNA, 25 bp, Homo sapien
gctggcatacatgcgtgcacacggc

SEQ ID NO: 154912 - DNA, 25 bp, Homo sapien
aagacctgcaatggcgcaggcagct

SEQ ID NO: 154913 - DNA, 25 bp, Homo sapien
atacttggggttccttgcaggcgcg

SEQ ID NO: 154914 - DNA, 25 bp, Homo sapien
tggatacttggggttccttgcaggc

SEQ ID NO: 154915 - DNA, 25 bp, Homo sapien
gcgtggatacttggggttccttgca

SEQ ID NO: 154916 - DNA, 25 bp, Homo sapien
ggaggaaaggctggcgtggatactt

SEQ ID NO: 154917 - DNA, 25 bp, Homo sapien
caagacctgcaatggcgcaggcagc

SEQ ID NO: 154918 - DNA, 25 bp, Homo sapien
gccgcttggtgaagcaccgccccca

SEQ ID NO: 154919 - DNA, 25 bp, Homo sapien
ctggcgtggatacttggggttcctt

SEQ ID NO: 154920 - DNA, 25 bp, Homo sapien
cttccagttgctcgctggggcaacc

SEQ ID NO: 154921 - DNA, 25 bp, Homo sapien
ggcaacaccggcttcctcggaaagc

SEQ ID NO: 154922 - DNA, 25 bp, Homo sapien
cttcctcggaaagcagctgcgactg

SEQ ID NO: 154923 - DNA, 25 bp, Homo sapien
ggggctctcagccacgtaacttcca

SEQ ID NO: 154924 - DNA, 25 bp, Homo sapien
aaccctgccgatttccttccagttg

SEQ ID NO: 154925 - DNA, 25 bp, Homo sapien
accgccagtcacacacgggacagga

SEQ ID NO: 154926 - DNA, 25 bp, Homo sapien
gcgagctacacaccagctggccaga

SEQ ID NO: 154927 - DNA, 25 bp, Homo sapien
tccaccgaagagttgtcccgcgagc

SEQ ID NO: 154928 - DNA, 25 bp, Homo sapien
cagcgcagctcggatcagcagcagc

SEQ ID NO: 154929 - DNA, 25 bp, Homo sapien
acccgcggctcttacggcgccttct

SEQ ID NO: 154930 - DNA, 25 bp, Homo sapien
cactatgtgggaggcagcatcaggt

SEQ ID NO: 154931 - DNA, 25 bp, Homo sapien
tctgtcccacggtcggtgagtcagc

SEQ ID NO: 154932 - DNA, 25 bp, Homo sapien
atccctctgtcccacggtcggtgag

SEQ ID NO: 154933 - DNA, 25 bp, Homo sapien
agctcggatcagcagcagcccagga

SEQ ID NO: 154934 - DNA, 25 bp, Homo sapien
cgccagtgaccgctggggccagagc

SEQ ID NO: 154935 - DNA, 25 bp, Homo sapien
gtactttcccgcgtccatccctctg

SEQ ID NO: 154936 - DNA, 25 bp, Homo sapien
cactagtgaccatcgggctttgggg

SEQ ID NO: 154937 - DNA, 25 bp, Homo sapien
tgcgcactagtgaccatcgggcttt

SEQ ID NO: 154938 - DNA, 25 bp, Homo sapien
ctcacaccgcaaactgtcctgggat

SEQ ID NO: 154939 - DNA, 25 bp, Homo sapien
ccgttctgagcttgcgcactagtga

SEQ ID NO: 154940 - DNA, 25 bp, Homo sapien
ctcctgaagagagttaagccctccc

SEQ ID NO: 154941 - DNA, 25 bp, Homo sapien
cccgcctcctgaagagagttaagcc

SEQ ID NO: 154942 - DNA, 25 bp, Homo sapien
cgcgcctgccttgggaaatcttggc

SEQ ID NO: 154943 - DNA, 25 bp, Homo sapien
cgcctgccttgggaaatcttggccc

SEQ ID NO: 154944 - DNA, 25 bp, Homo sapien
gctggctccgctgagtttagctgag

SEQ ID NO: 154945 - DNA, 25 bp, Homo sapien
caccgaggcgtagcgggaagtgcat

SEQ ID NO: 154946 - DNA, 25 bp, Homo sapien
tttagctgagctgcgctgggcttcg

SEQ ID NO: 154947 - DNA, 25 bp, Homo sapien
ctccgctgagtttagctgagctgcg

SEQ ID NO: 154948 - DNA, 25 bp, Homo sapien
tcgaccttccatcgcgccgcgctgg

SEQ ID NO: 154949 - DNA, 25 bp, Homo sapien
cagctgcactcgaccttccatcgcg

SEQ ID NO: 154950 - DNA, 25 bp, Homo sapien
gcggacccttcccagagcaccggtc

SEQ ID NO: 154951 - DNA, 25 bp, Homo sapien
cgctgagtttagctgagctgcgctg

SEQ ID NO: 154952 - DNA, 25 bp, Homo sapien
ttctcgtccacgaacatgtaggagc

SEQ ID NO: 154953 - DNA, 25 bp, Homo sapien
gtctcccggcctagaagtcctcgtc

SEQ ID NO: 154954 - DNA, 25 bp, Homo sapien
gatgtaggggatcacccactgcagg

SEQ ID NO: 154955 - DNA, 25 bp, Homo sapien
gcgggtgatgaggaacgtcaccttc

SEQ ID NO: 154956 - DNA, 25 bp, Homo sapien
tgatgaggaacgtcaccttcagggc

SEQ ID NO: 154957 - DNA, 25 bp, Homo sapien
gaggaacgtcaccttcagggcgtcg

SEQ ID NO: 154958 - DNA, 25 bp, Homo sapien
ggagaacgtgttctcgtccacgaac

SEQ ID NO: 154959 - DNA, 25 bp, Homo sapien
gaacgtgttctcgtccacgaacatg

SEQ ID NO: 154960 - DNA, 25 bp, Homo sapien
tcccgctacctcaggaaactttagc

SEQ ID NO: 154961 - DNA, 25 bp, Homo sapien
tggacacgcatttccggcgacgcct

SEQ ID NO: 154962 - DNA, 25 bp, Homo sapien
acgcctcggtactgacctctgcaga

SEQ ID NO: 154963 - DNA, 25 bp, Homo sapien
gccggccttcgtggacacgcatttc

SEQ ID NO: 154964 - DNA, 25 bp, Homo sapien
ctgcgtactagggaccacccggctt

SEQ ID NO: 154965 - DNA, 25 bp, Homo sapien
ccacgacacgcctgcgtactaggga

SEQ ID NO: 154966 - DNA, 25 bp, Homo sapien
tttagcccagcctctccgatacaag

SEQ ID NO: 154967 - DNA, 25 bp, Homo sapien
agcccattgacgtccagcgaagcga

SEQ ID NO: 154968 - DNA, 25 bp, Homo sapien
gcgagctccgcccacaaagacttgt

SEQ ID NO: 154969 - DNA, 25 bp, Homo sapien
tcactagtgcgctggtgcgtcacag

SEQ ID NO: 154970 - DNA, 25 bp, Homo sapien
ctgtggagaccctagcggtggccac

SEQ ID NO: 154971 - DNA, 25 bp, Homo sapien
agaccctagcggtggccactggcac

SEQ ID NO: 154972 - DNA, 25 bp, Homo sapien
agagcccaggcgcttgcgcgagctc

SEQ ID NO: 154973 - DNA, 25 bp, Homo sapien
caaagacttgtggtcactagtgcgc

SEQ ID NO: 154974 - DNA, 25 bp, Homo sapien
cagcgcgctctagagtgcggcccag

SEQ ID NO: 154975 - DNA, 25 bp, Homo sapien
tggcacagcgaactcttcccagagc

SEQ ID NO: 154976 - DNA, 25 bp, Homo sapien
agccttgcttcaggggccactgcct

SEQ ID NO: 154977 - DNA, 25 bp, Homo sapien
gatcgacccgcaagagctcgagcct

SEQ ID NO: 154978 - DNA, 25 bp, Homo sapien
ccgcaagagctcgagcctcaggacg

SEQ ID NO: 154979 - DNA, 25 bp, Homo sapien
cctcgggttctccagactgagcctt

SEQ ID NO: 154980 - DNA, 25 bp, Homo sapien
gttctccagactgagccttgcttca

SEQ ID NO: 154981 - DNA, 25 bp, Homo sapien
gtccctcctccacgagcccgcacag

SEQ ID NO: 154982 - DNA, 25 bp, Homo sapien
ttttcgggcgcctcccaaggcagga

SEQ ID NO: 154983 - DNA, 25 bp, Homo sapien
gctccacatcacgtcactgcgggcc

SEQ ID NO: 154984 - DNA, 25 bp, Homo sapien
tcaggggatcgctaaaacgaatcta

SEQ ID NO: 154985 - DNA, 25 bp, Homo sapien
ccggtatttctcaggggatcgctaa

SEQ ID NO: 154986 - DNA, 25 bp, Homo sapien
ctccgctgctgcaccactaggggaa

SEQ ID NO: 154987 - DNA, 25 bp, Homo sapien
ccactaggggaagcgacgtcaggaa

SEQ ID NO: 154988 - DNA, 25 bp, Homo sapien
tgggtagcaaagctctccgctgctg

SEQ ID NO: 154989 - DNA, 25 bp, Homo sapien
gctgctctgggtagcaaagctctcc

SEQ ID NO: 154990 - DNA, 25 bp, Homo sapien
gttaccttcagtcagctctggcttc

SEQ ID NO: 154991 - DNA, 25 bp, Homo sapien
atcagcttctcggttaccttcagtc

SEQ ID NO: 154992 - DNA, 25 bp, Homo sapien
tcctagcacggaagtttggcgtcca

SEQ ID NO: 154993 - DNA, 25 bp, Homo sapien
agtcaggcttccagaccaccttggc

SEQ ID NO: 154994 - DNA, 25 bp, Homo sapien
gaaaccagttgtgcccgccggccaa

SEQ ID NO: 154995 - DNA, 25 bp, Homo sapien
ggcgtgctccggtttcaagttccag

SEQ ID NO: 154996 - DNA, 25 bp, Homo sapien
tccagccggtgagcccaactttgga

SEQ ID NO: 154997 - DNA, 25 bp, Homo sapien
cggcagagctgtctccagtagcttc

SEQ ID NO: 154998 - DNA, 25 bp, Homo sapien
ccggtccacacgcagaaagtcctag

SEQ ID NO: 154999 - DNA, 25 bp, Homo sapien
tggcgtccacagaccaatttgtcag

SEQ ID NO: 155000 - DNA, 25 bp, Homo sapien
tcaggggagaaatttggcgcgctcc

SEQ ID NO: 155001 - DNA, 25 bp, Homo sapien
tcctcagagacatggagccgttggc

SEQ ID NO: 155002 - DNA, 25 bp, Homo sapien
cacctctgcttcaggggagaaattt

SEQ ID NO: 155003 - DNA, 25 bp, Homo sapien
ccagactcgcgagagccggaaatgc

SEQ ID NO: 155004 - DNA, 25 bp, Homo sapien
ggaaatgccgccgtccatcaagagg

SEQ ID NO: 155005 - DNA, 25 bp, Homo sapien
acccgcgtccgcagtcagcgattgt

SEQ ID NO: 155006 - DNA, 25 bp, Homo sapien
agtcagcgattgtgaggcgccttgc

SEQ ID NO: 155007 - DNA, 25 bp, Homo sapien
ggagccgttggctaccacctctgct

SEQ ID NO: 155008 - DNA, 25 bp, Homo sapien
tcgcccaagagcgaacaggggccgc

SEQ ID NO: 155009 - DNA, 25 bp, Homo sapien
ccttcccgggagtccttctgggctg

SEQ ID NO: 155010 - DNA, 25 bp, Homo sapien
gccaccactccctgcgacccgaccg

SEQ ID NO: 155011 - DNA, 25 bp, Homo sapien
taactgggtgattccagctgtgccc

SEQ ID NO: 155012 - DNA, 25 bp, Homo sapien
ggggccgcgcccgagacactagcat

SEQ ID NO: 155013 - DNA, 25 bp, Homo sapien
gagatgtagtccgtagcgcagtccc

SEQ ID NO: 155014 - DNA, 25 bp, Homo sapien
tcggggcctcgtcgcccaagagcga

SEQ ID NO: 155015 - DNA, 25 bp, Homo sapien
gggccatgctaactgggtgattcca

SEQ ID NO: 155016 - DNA, 25 bp, Homo sapien
tccagaaactacctgggctcggccg

SEQ ID NO: 155017 - DNA, 25 bp, Homo sapien
cgcgcagaaacgcactgaatgggcc

SEQ ID NO: 155018 - DNA, 25 bp, Homo sapien
gtcccaccgccctgaggctcgcgct

SEQ ID NO: 155019 - DNA, 25 bp, Homo sapien
ggtcgcagcgctgacggcctctctg

SEQ ID NO: 155020 - DNA, 25 bp, Homo sapien
gtgcactagtgctcgggtcccaccg

SEQ ID NO: 155021 - DNA, 25 bp, Homo sapien
tgaatgggcccctgccatcgggctc

SEQ ID NO: 155022 - DNA, 25 bp, Homo sapien
ccagcggcggacctatgctggcctg

SEQ ID NO: 155023 - DNA, 25 bp, Homo sapien
gcgacccgctgggtgcactagtgct

SEQ ID NO: 155024 - DNA, 25 bp, Homo sapien
agcctggctcaggacaagttggatc

SEQ ID NO: 155025 - DNA, 25 bp, Homo sapien
cctggctcaggacaagttggatctg

SEQ ID NO: 155026 - DNA, 25 bp, Homo sapien
caggacaagttggatctgaaccgcc

SEQ ID NO: 155027 - DNA, 25 bp, Homo sapien
ggacaagttggatctgaaccgcctt

SEQ ID NO: 155028 - DNA, 25 bp, Homo sapien
agttggatctgaaccgccttgtcgc

SEQ ID NO: 155029 - DNA, 25 bp, Homo sapien
ccctgcgagtggcagaggaggtcca

SEQ ID NO: 155030 - DNA, 25 bp, Homo sapien
ggaagccaccgtggcgcgggaagag

SEQ ID NO: 155031 - DNA, 25 bp, Homo sapien
tgaaccgccttgtcgcccagctgga

SEQ ID NO: 155032 - DNA, 25 bp, Homo sapien
gtgcgcggcaccgaaaagcagcagc

SEQ ID NO: 155033 - DNA, 25 bp, Homo sapien
agcgagcgcatcagcctgaagttta

SEQ ID NO: 155034 - DNA, 25 bp, Homo sapien
tcagcctgaagtttaccaatgagga

SEQ ID NO: 155035 - DNA, 25 bp, Homo sapien
aggagctccggcgtcagatgaagat

SEQ ID NO: 155036 - DNA, 25 bp, Homo sapien
ctggacagtgagaataccagagtgg

SEQ ID NO: 155037 - DNA, 25 bp, Homo sapien
ccagcaccttagaatgcagccctgg

SEQ ID NO: 155038 - DNA, 25 bp, Homo sapien
ggctcctctagacctggacccagag

SEQ ID NO: 155039 - DNA, 25 bp, Homo sapien
cgtcagatgaagatgctggacagtg

SEQ ID NO: 155040 - DNA, 25 bp, Homo sapien
ccgcctaaggcggtcctgcgtcgcc

SEQ ID NO: 155041 - DNA, 25 bp, Homo sapien
ctgcatcaaggtaaaggggctacgg

SEQ ID NO: 155042 - DNA, 25 bp, Homo sapien
tactgcatcaaggtaaaggggctac

SEQ ID NO: 155043 - DNA, 25 bp, Homo sapien
cgtactgcatcaaggtaaaggggct

SEQ ID NO: 155044 - DNA, 25 bp, Homo sapien
cccgtactgcatcaaggtaaagggg

SEQ ID NO: 155045 - DNA, 25 bp, Homo sapien
agacaggtacatgctggtcacctac

SEQ ID NO: 155046 - DNA, 25 bp, Homo sapien
tggagacaggtacatgctggtcacc

SEQ ID NO: 155047 - DNA, 25 bp, Homo sapien
ccgtggagacaggtacatgctggtc

SEQ ID NO: 155048 - DNA, 25 bp, Homo sapien
tctgctccggaattggccaggttca

SEQ ID NO: 155049 - DNA, 25 bp, Homo sapien
ccgctctcagttaccttagctactg

SEQ ID NO: 155050 - DNA, 25 bp, Homo sapien
aaagtctttgcgtttctgctccgga

SEQ ID NO: 155051 - DNA, 25 bp, Homo sapien
cccagacccggagaaagtctttgcg

SEQ ID NO: 155052 - DNA, 25 bp, Homo sapien
tcggaaatctgtccgcgacgccagt

SEQ ID NO: 155053 - DNA, 25 bp, Homo sapien
agacaaccgcctttgcactcgttgg

SEQ ID NO: 155054 - DNA, 25 bp, Homo sapien
cagccgccggccttcaaagactaga

SEQ ID NO: 155055 - DNA, 25 bp, Homo sapien
ttccagcgaagcaacgacacggagg

SEQ ID NO: 155056 - DNA, 25 bp, Homo sapien
aacctgcgctatggaggcctctcta

SEQ ID NO: 155057 - DNA, 25 bp, Homo sapien
ccaacggagtcataaacgaagaggc

SEQ ID NO: 155058 - DNA, 25 bp, Homo sapien
caaagtgtctcagtggtggaaaagc

SEQ ID NO: 155059 - DNA, 25 bp, Homo sapien
cgagaacccacgaacctgcgctatg

SEQ ID NO: 155060 - DNA, 25 bp, Homo sapien
tccgatggtcccttagaagtgcgcc

SEQ ID NO: 155061 - DNA, 25 bp, Homo sapien
actgaagtcctgagcgcaaagtgtc

SEQ ID NO: 155062 - DNA, 25 bp, Homo sapien
cgcgccgcagaaagatgacgtcact

SEQ ID NO: 155063 - DNA, 25 bp, Homo sapien
ctgtttcttcttccaccggcgggtg

SEQ ID NO: 155064 - DNA, 25 bp, Homo sapien
cctggctatgatttatggcaagttc

SEQ ID NO: 155065 - DNA, 25 bp, Homo sapien
ggcaagttcctcaacccttgtcagc

SEQ ID NO: 155066 - DNA, 25 bp, Homo sapien
accggcctggctatgatttatggca

SEQ ID NO: 155067 - DNA, 25 bp, Homo sapien
tcctgcacgaaaccggcctggctat

SEQ ID NO: 155068 - DNA, 25 bp, Homo sapien
agaagcaagccgaggagagccaccg

SEQ ID NO: 155069 - DNA, 25 bp, Homo sapien
acgaggagatcgtgtccgagaagca

SEQ ID NO: 155070 - DNA, 25 bp, Homo sapien
ccctttggttgctcctcgcagtggg

SEQ ID NO: 155071 - DNA, 25 bp, Homo sapien
aggacagcgccaacctgctcatctt

SEQ ID NO: 155072 - DNA, 25 bp, Homo sapien
aggtgcagttcgactaggccttctg

SEQ ID NO: 155073 - DNA, 25 bp, Homo sapien
agtcaactttcctgcaggctgctgc

SEQ ID NO: 155074 - DNA, 25 bp, Homo sapien
gctgctgctgactcatggctgctca

SEQ ID NO: 155075 - DNA, 25 bp, Homo sapien
aggccttctggtccgccagcaaacg

SEQ ID NO: 155076 - DNA, 25 bp, Homo sapien
tccaaggcctgctcggaggtgcagt

SEQ ID NO: 155077 - DNA, 25 bp, Homo sapien
ctgaatactcagcacgaagcgggtc

SEQ ID NO: 155078 - DNA, 25 bp, Homo sapien
ttaatgggcaggtcagtcaactttc

SEQ ID NO: 155079 - DNA, 25 bp, Homo sapien
acacgagcggctctccggtggtctc

SEQ ID NO: 155080 - DNA, 25 bp, Homo sapien
cgcgccggccatagaaagactgtcc

SEQ ID NO: 155081 - DNA, 25 bp, Homo sapien
gatcgagatcgggaccaggtttaag

SEQ ID NO: 155082 - DNA, 25 bp, Homo sapien
aggtgttaccgttgggatcgagatc

SEQ ID NO: 155083 - DNA, 25 bp, Homo sapien
ctcgcgagcacaagtgacgggactg

SEQ ID NO: 155084 - DNA, 25 bp, Homo sapien
agctcccttaaaccaggatcccaag

SEQ ID NO: 155085 - DNA, 25 bp, Homo sapien
tgaacgcacttcaggccgcttgaac

SEQ ID NO: 155086 - DNA, 25 bp, Homo sapien
ggccgcttgaacagcacacgcagga

SEQ ID NO: 155087 - DNA, 25 bp, Homo sapien
cgtttaaacaaacctgcggcagctt

SEQ ID NO: 155088 - DNA, 25 bp, Homo sapien
agcccgctttctttccgcttgtgcg

SEQ ID NO: 155089 - DNA, 25 bp, Homo sapien
caggcctctaaggaccgctgcgcga

SEQ ID NO: 155090 - DNA, 25 bp, Homo sapien
tggggcttatttagctccctccggc

SEQ ID NO: 155091 - DNA, 25 bp, Homo sapien
tgcagtgattcgtgactcccgcagg

SEQ ID NO: 155092 - DNA, 25 bp, Homo sapien
tccctccggcttgctactaagggga

SEQ ID NO: 155093 - DNA, 25 bp, Homo sapien
cactgggattatggatggggcttat

SEQ ID NO: 155094 - DNA, 25 bp, Homo sapien
gaggcgagacgccaccctcacttgg

SEQ ID NO: 155095 - DNA, 25 bp, Homo sapien
cttttcagggagtgcgcaggttagc

SEQ ID NO: 155096 - DNA, 25 bp, Homo sapien
cacgaggcgactccagggaaaagtt

SEQ ID NO: 155097 - DNA, 25 bp, Homo sapien
cccgtcgaagcagagcccgtgagtt

SEQ ID NO: 155098 - DNA, 25 bp, Homo sapien
gataactcaaactttccgtgcctgg

SEQ ID NO: 155099 - DNA, 25 bp, Homo sapien
ggtggctctccgcatacattgcgca

SEQ ID NO: 155100 - DNA, 25 bp, Homo sapien
tcggacctgcgaaccgggcaggatt

SEQ ID NO: 155101 - DNA, 25 bp, Homo sapien
cgcggcgtcggctgacaatttcaac

SEQ ID NO: 155102 - DNA, 25 bp, Homo sapien
ccgtccgccatcatcggagtcggga

SEQ ID NO: 155103 - DNA, 25 bp, Homo sapien
cccgcagctctctcaaggatgggct

SEQ ID NO: 155104 - DNA, 25 bp, Homo sapien
cgcagctggaattcccgggacgcaa

SEQ ID NO: 155105 - DNA, 25 bp, Homo sapien
cttgtacacgtggtagtagctcttg

SEQ ID NO: 155106 - DNA, 25 bp, Homo sapien
ctcttgccgtagaacaggcggctca

SEQ ID NO: 155107 - DNA, 25 bp, Homo sapien
tgaagaggaacacggcccacatggc

SEQ ID NO: 155108 - DNA, 25 bp, Homo sapien
acgtcgaagcaggtgatgatgccca

SEQ ID NO: 155109 - DNA, 25 bp, Homo sapien
gcgctccacgctgatacaggtcatg

SEQ ID NO: 155110 - DNA, 25 bp, Homo sapien
catgtttgcgtaaaaggccacggtc

SEQ ID NO: 155111 - DNA, 25 bp, Homo sapien
gtccgtgacgctcaggttgatcatg

SEQ ID NO: 155112 - DNA, 25 bp, Homo sapien
caggacggccgggtcacggatccgc

SEQ ID NO: 155113 - DNA, 25 bp, Homo sapien
ggtctccatgcatcacgccggggag

SEQ ID NO: 155114 - DNA, 25 bp, Homo sapien
tcgggtctccatgcatcacgccggg

SEQ ID NO: 155115 - DNA, 25 bp, Homo sapien
ggcctccagcgaactgccgccaccg

SEQ ID NO: 155116 - DNA, 25 bp, Homo sapien
tggtcgggtctccatgcatcacgcc

SEQ ID NO: 155117 - DNA, 25 bp, Homo sapien
cggctggtcgggtctccatgcatca

SEQ ID NO: 155118 - DNA, 25 bp, Homo sapien
actccgggctcagcgtcgagcggct

SEQ ID NO: 155119 - DNA, 25 bp, Homo sapien
gcccgaggccactccgggctcagcg

SEQ ID NO: 155120 - DNA, 25 bp, Homo sapien
atggtgacacccagaccgatgccgg

SEQ ID NO: 155121 - DNA, 25 bp, Homo sapien
gcaccaacttggatgggaacgatga

SEQ ID NO: 155122 - DNA, 25 bp, Homo sapien
taggaaacatgagcggcaccaactt

SEQ ID NO: 155123 - DNA, 25 bp, Homo sapien
gctccagcgtcatttcggcctctta

SEQ ID NO: 155124 - DNA, 25 bp, Homo sapien
atttcctgacgttgccgagggagcc

SEQ ID NO: 155125 - DNA, 25 bp, Homo sapien
ggcgcgtcgttttctcgaagccaga

SEQ ID NO: 155126 - DNA, 25 bp, Homo sapien
ggttgacctccctttctctgctcag

SEQ ID NO: 155127 - DNA, 25 bp, Homo sapien
gtcggcgctttttgacgccatagtg

SEQ ID NO: 155128 - DNA, 25 bp, Homo sapien
ccaaggctgcgggaacagatcaacc

SEQ ID NO: 155129 - DNA, 25 bp, Homo sapien
gacccggacctggatcgcagaagta

SEQ ID NO: 155130 - DNA, 25 bp, Homo sapien
gttcttgttgccatagccgtgccgc

SEQ ID NO: 155131 - DNA, 25 bp, Homo sapien
tctaaagggaagtcagagtcttgtc

SEQ ID NO: 155132 - DNA, 25 bp, Homo sapien
cggcaccctggatctcagcgaactg

SEQ ID NO: 155133 - DNA, 25 bp, Homo sapien
ccaccagggcgaaactggagagctg

SEQ ID NO: 155134 - DNA, 25 bp, Homo sapien
ctcagcgaactgtgaggccctggca

SEQ ID NO: 155135 - DNA, 25 bp, Homo sapien
ctctccagcccagggattgtttttt

SEQ ID NO: 155136 - DNA, 25 bp, Homo sapien
tggcagccaaactttctcgagaagc

SEQ ID NO: 155137 - DNA, 25 bp, Homo sapien
ccagtcctaacacggggagagtgtc

SEQ ID NO: 155138 - DNA, 25 bp, Homo sapien
agcgccagcgccataccaatgcagg

SEQ ID NO: 155139 - DNA, 25 bp, Homo sapien
cgcagcccgcatggaagtccacatg

SEQ ID NO: 155140 - DNA, 25 bp, Homo sapien
ctccggggccgccaatgaatacgaa

SEQ ID NO: 155141 - DNA, 25 bp, Homo sapien
ctgggaacattcagagggcttcttc

SEQ ID NO: 155142 - DNA, 25 bp, Homo sapien
taggggcttcctagcagctcagcac

SEQ ID NO: 155143 - DNA, 25 bp, Homo sapien
tgcagcggaacctaattaaaactcg

SEQ ID NO: 155144 - DNA, 25 bp, Homo sapien
ttcctccacgggtgccgatttcatg

SEQ ID NO: 155145 - DNA, 25 bp, Homo sapien
tatcccgactaagtggccgtcctgg

SEQ ID NO: 155146 - DNA, 25 bp, Homo sapien
ccgaggctcttgtcatttccgctta

SEQ ID NO: 155147 - DNA, 25 bp, Homo sapien
tgcacggctttctaccttcccaggt

SEQ ID NO: 155148 - DNA, 25 bp, Homo sapien
agccggctcccgaaatgagtactcg

SEQ ID NO: 155149 - DNA, 25 bp, Homo sapien
tgggaaccaacctcgagcgccagtg

SEQ ID NO: 155150 - DNA, 25 bp, Homo sapien
accgggttgcgaaccatgttctatc

SEQ ID NO: 155151 - DNA, 25 bp, Homo sapien
ttatagtgccactagccggcctcgg

SEQ ID NO: 155152 - DNA, 25 bp, Homo sapien
cgcaggcagagttagtcacccgtca

SEQ ID NO: 155153 - DNA, 25 bp, Homo sapien
ctcagtgcctatgctggtgacaaaa

SEQ ID NO: 155154 - DNA, 25 bp, Homo sapien
accagcacggttgagcggatgatgc

SEQ ID NO: 155155 - DNA, 25 bp, Homo sapien
agcgccagcactatgttgccgacga

SEQ ID NO: 155156 - DNA, 25 bp, Homo sapien
ataaaacggttggtcacctgcagca

SEQ ID NO: 155157 - DNA, 25 bp, Homo sapien
tctcatctgtttctcctgctggcgc

SEQ ID NO: 155158 - DNA, 25 bp, Homo sapien
tttccggactctccagatctgtctg

SEQ ID NO: 155159 - DNA, 25 bp, Homo sapien
ggcagcttctatggctcctttccgg

SEQ ID NO: 155160 - DNA, 25 bp, Homo sapien
gcgcctggtagctcagcagccgtcg

SEQ ID NO: 155161 - DNA, 25 bp, Homo sapien
cgtctgtgcccgcacgtccggccag

SEQ ID NO: 155162 - DNA, 25 bp, Homo sapien
gcgcgccgcgctgcaagctctgaga

SEQ ID NO: 155163 - DNA, 25 bp, Homo sapien
ccgcgctgcaagctctgagaggcag

SEQ ID NO: 155164 - DNA, 25 bp, Homo sapien
ggtgccctcaccttgcggtgccgcc

SEQ ID NO: 155165 - DNA, 25 bp, Homo sapien
gcctgcgcccgtgacgcacgaggcc

SEQ ID NO: 155166 - DNA, 25 bp, Homo sapien
ctggtagctcagcagccgtcgggac

SEQ ID NO: 155167 - DNA, 25 bp, Homo sapien
cgggctgcttacctgttgctgctgc

SEQ ID NO: 155168 - DNA, 25 bp, Homo sapien
cagtattacgaagacggagcccgga

SEQ ID NO: 155169 - DNA, 25 bp, Homo sapien
ccattcgtctatgacgcgcgccata

SEQ ID NO: 155170 - DNA, 25 bp, Homo sapien
gctgggcgtggtctaaaataatttc

SEQ ID NO: 155171 - DNA, 25 bp, Homo sapien
gacccgcccgtgtctcattggaagc

SEQ ID NO: 155172 - DNA, 25 bp, Homo sapien
gcgcgccatagagaccaccgatatc

SEQ ID NO: 155173 - DNA, 25 bp, Homo sapien
gagatcttcatctgtcacgccaacg

SEQ ID NO: 155174 - DNA, 25 bp, Homo sapien
ttcccgcgagtcctagtcagttacg

SEQ ID NO: 155175 - DNA, 25 bp, Homo sapien
tgcaggcgtctgcaaagtcagcaca

SEQ ID NO: 155176 - DNA, 25 bp, Homo sapien
tgggcttgtagactcgctcttactc

SEQ ID NO: 155177 - DNA, 25 bp, Homo sapien
ctgccttcgctaccatttttgtttg

SEQ ID NO: 155178 - DNA, 25 bp, Homo sapien
acagcgcctgcgataggattcagca

SEQ ID NO: 155179 - DNA, 25 bp, Homo sapien
tcggttcttgactttgcggcacctg

SEQ ID NO: 155180 - DNA, 25 bp, Homo sapien
gacgcagatccgagaccgcttcttg

SEQ ID NO: 155181 - DNA, 25 bp, Homo sapien
ttcattcctgggtgtcctgaccatc

SEQ ID NO: 155182 - DNA, 25 bp, Homo sapien
ggggcagtctactcctcactaaacg

SEQ ID NO: 155183 - DNA, 25 bp, Homo sapien
gtttgtgaagatccctcggcacggc

SEQ ID NO: 155184 - DNA, 25 bp, Homo sapien
ggccagccacgtcggcgagttaaag

SEQ ID NO: 155185 - DNA, 25 bp, Homo sapien
tacggacaataaagccgccttcggc

SEQ ID NO: 155186 - DNA, 25 bp, Homo sapien
tgcggtagctagcactacgccactc

SEQ ID NO: 155187 - DNA, 25 bp, Homo sapien
agtgctcgacgatggcctctaaacc

SEQ ID NO: 155188 - DNA, 25 bp, Homo sapien
ggatcctgttccctcgcttcctgaa

SEQ ID NO: 155189 - DNA, 25 bp, Homo sapien
tcggttgagcgcaattcaggggcaa

SEQ ID NO: 155190 - DNA, 25 bp, Homo sapien
cgcgtcctccgagttgccaaagttg

SEQ ID NO: 155191 - DNA, 25 bp, Homo sapien
ccaaagttgcacagggcgctgcctc

SEQ ID NO: 155192 - DNA, 25 bp, Homo sapien
atggcccgccgtattcgttgttcgg

SEQ ID NO: 155193 - DNA, 25 bp, Homo sapien
ctctatcagaacgtgtccggcgctg

SEQ ID NO: 155194 - DNA, 25 bp, Homo sapien
gggccgccagaatgccaccttgttc

SEQ ID NO: 155195 - DNA, 25 bp, Homo sapien
cgctttccgtttcgacatttgcaac

SEQ ID NO: 155196 - DNA, 25 bp, Homo sapien
gggtctgaccgaggccaaattatct

SEQ ID NO: 155197 - DNA, 25 bp, Homo sapien
aatgcaaatggtcaacgctggggtc

SEQ ID NO: 155198 - DNA, 25 bp, Homo sapien
gaaacgcttaacacccaggcaaatg

SEQ ID NO: 155199 - DNA, 25 bp, Homo sapien
tcacccgaggatgtggcgaaacgct

SEQ ID NO: 155200 - DNA, 25 bp, Homo sapien
tccagcaaccttgcaaaggcggccg

SEQ ID NO: 155201 - DNA, 25 bp, Homo sapien
ccggctggcacgactgtctccgaat

SEQ ID NO: 155202 - DNA, 25 bp, Homo sapien
cagttccatctgtccagcaaccttg

SEQ ID NO: 155203 - DNA, 25 bp, Homo sapien
caaagtgcttgagaaggtgttcgtg

SEQ ID NO: 155204 - DNA, 25 bp, Homo sapien
ccgtggtcactcaaagtgcttgaga

SEQ ID NO: 155205 - DNA, 25 bp, Homo sapien
tgcaagccgtggtcactcaaagtgc

SEQ ID NO: 155206 - DNA, 25 bp, Homo sapien
cgcttaagtcgacggccgtgcctca

SEQ ID NO: 155207 - DNA, 25 bp, Homo sapien
gactgtctccgaatgcaaattctgc

SEQ ID NO: 155208 - DNA, 25 bp, Homo sapien
ggtccgagtgttacagcaaagtctc

SEQ ID NO: 155209 - DNA, 25 bp, Homo sapien
ctacggagccgctaagcaatatata

SEQ ID NO: 155210 - DNA, 25 bp, Homo sapien
ctacagccgtcgagttcacacttga

SEQ ID NO: 155211 - DNA, 25 bp, Homo sapien
gcccatatgcgcgtgagtgctcatc

SEQ ID NO: 155212 - DNA, 25 bp, Homo sapien
gaagggcacgtgctaggatctcaca

SEQ ID NO: 155213 - DNA, 25 bp, Homo sapien
ttggccctggaactctcagcaagga

SEQ ID NO: 155214 - DNA, 25 bp, Homo sapien
ccggcacagtcctggatttggtcta

SEQ ID NO: 155215 - DNA, 25 bp, Homo sapien
cgcggctgccggagaaatatgctaa

SEQ ID NO: 155216 - DNA, 25 bp, Homo sapien
cggcttgctttatggtgcgatgaca

SEQ ID NO: 155217 - DNA, 25 bp, Homo sapien
tcgggctccgatttccagctactta

SEQ ID NO: 155218 - DNA, 25 bp, Homo sapien
aaacagtccctctcgagcggtggca

SEQ ID NO: 155219 - DNA, 25 bp, Homo sapien
gcgcgttgcttttaactgtcgtata

SEQ ID NO: 155220 - DNA, 25 bp, Homo sapien
ctgcggagcgcggtataaaagcaca

SEQ ID NO: 155221 - DNA, 25 bp, Homo sapien
ctggacgtgctggtaaaaatgcatc

SEQ ID NO: 155222 - DNA, 25 bp, Homo sapien
taagtgaccgccacgtgagaaagtc

SEQ ID NO: 155223 - DNA, 25 bp, Homo sapien
ctgtcgtatacattgcgggttttcc

SEQ ID NO: 155224 - DNA, 25 bp, Homo sapien
actacggcacttcggagatctcctc

SEQ ID NO: 155225 - DNA, 25 bp, Homo sapien
gcccgggacaggattggcaaactcc

SEQ ID NO: 155226 - DNA, 25 bp, Homo sapien
tgttaaaccagatctagtccgagtc

SEQ ID NO: 155227 - DNA, 25 bp, Homo sapien
gggctgaatcccttcggggactcaa

SEQ ID NO: 155228 - DNA, 25 bp, Homo sapien
gcgcacgatctatcttcaggccaga

SEQ ID NO: 155229 - DNA, 25 bp, Homo sapien
caacgcgcgagtttctgttccgcca

SEQ ID NO: 155230 - DNA, 25 bp, Homo sapien
cctagctacttgctgtttcccgggc

SEQ ID NO: 155231 - DNA, 25 bp, Homo sapien
gcgcgcctgttagtttgttaaacca

SEQ ID NO: 155232 - DNA, 25 bp, Homo sapien
attacctctttattagcggtcggcg

SEQ ID NO: 155233 - DNA, 25 bp, Homo sapien
ccacacatttgtctgcgacttcgca

SEQ ID NO: 155234 - DNA, 25 bp, Homo sapien
ttggcttcggataaaacaatagggc

SEQ ID NO: 155235 - DNA, 25 bp, Homo sapien
tgggtggttcattcgctctttggct

SEQ ID NO: 155236 - DNA, 25 bp, Homo sapien
caatcggttgtttactgggaagctc

SEQ ID NO: 155237 - DNA, 25 bp, Homo sapien
gccgaggagtgcaatctgattccca

SEQ ID NO: 155238 - DNA, 25 bp, Homo sapien
tgtcttccacgttaaatccgatttg

SEQ ID NO: 155239 - DNA, 25 bp, Homo sapien
agtgacaccttgaacccattttggg

SEQ ID NO: 155240 - DNA, 25 bp, Homo sapien
cgcagccgtcgagtcggattttgca

SEQ ID NO: 155241 - DNA, 25 bp, Homo sapien
ccgtgccgggaacagactttgaagt

SEQ ID NO: 155242 - DNA, 25 bp, Homo sapien
cagccttttcgcagcgcctgggata

SEQ ID NO: 155243 - DNA, 25 bp, Homo sapien
cggggctcatcagcgaacgtcctct

SEQ ID NO: 155244 - DNA, 25 bp, Homo sapien
agcgctggccgcaaactttgtgttc

SEQ ID NO: 155245 - DNA, 25 bp, Homo sapien
cccaaacaatggtgagctccgaagg

SEQ ID NO: 155246 - DNA, 25 bp, Homo sapien
agcctctgcctaatccggacctggg

SEQ ID NO: 155247 - DNA, 25 bp, Homo sapien
ctagggtcaattctctcgcggtctc

SEQ ID NO: 155248 - DNA, 25 bp, Homo sapien
cggcacagtcgcagcacaggaattc

SEQ ID NO: 155249 - DNA, 25 bp, Homo sapien
cgacttcgccgctttggtctcctta

SEQ ID NO: 155250 - DNA, 25 bp, Homo sapien
tccgcactcgggcttcagccaagga

SEQ ID NO: 155251 - DNA, 25 bp, Homo sapien
ccgagtcttcgactagtccttgcaa

SEQ ID NO: 155252 - DNA, 25 bp, Homo sapien
cttgcaacttcttggcgtgataatc

SEQ ID NO: 155253 - DNA, 25 bp, Homo sapien
tccgacagggatcaaacaggtaatg

SEQ ID NO: 155254 - DNA, 25 bp, Homo sapien
taatggcctcgcatcttcgctgttg

SEQ ID NO: 155255 - DNA, 25 bp, Homo sapien
cttgcctcttctgacggatgagcga

SEQ ID NO: 155256 - DNA, 25 bp, Homo sapien
ccgcaaatgcgaattgtgcctaaga

SEQ ID NO: 155257 - DNA, 25 bp, Homo sapien
ggagccgacctgagtccacacagtg

SEQ ID NO: 155258 - DNA, 25 bp, Homo sapien
ccacacagtggtgagggccaggcac

SEQ ID NO: 155259 - DNA, 25 bp, Homo sapien
tgcacctggacacgagaatatggct

SEQ ID NO: 155260 - DNA, 25 bp, Homo sapien
gctcagaggcgatgaaggcaactcc

SEQ ID NO: 155261 - DNA, 25 bp, Homo sapien
tgcctaagaagtgcatgaagatgcc

SEQ ID NO: 155262 - DNA, 25 bp, Homo sapien
gcaactccgagcttttccgcaaatg

SEQ ID NO: 155263 - DNA, 25 bp, Homo sapien
atgaagatgccacggcgggtagatc

SEQ ID NO: 155264 - DNA, 25 bp, Homo sapien
ggctgcaccggagcgcgcagtatct

SEQ ID NO: 155265 - DNA, 25 bp, Homo sapien
accagcgctgctctgaccgccacca

SEQ ID NO: 155266 - DNA, 25 bp, Homo sapien
gaccgccaccatcttaacgctgctt

SEQ ID NO: 155267 - DNA, 25 bp, Homo sapien
tgcccgcggtctagactgcgaggcc

SEQ ID NO: 155268 - DNA, 25 bp, Homo sapien
ggactgcgaccacccgcaccgccag

SEQ ID NO: 155269 - DNA, 25 bp, Homo sapien
atcgaggacaagcaaacagaaaccc

SEQ ID NO: 155270 - DNA, 25 bp, Homo sapien
aaggcgctttgtcatgcccggagcc

SEQ ID NO: 155271 - DNA, 25 bp, Homo sapien
aacgtgcccgcggtctagactgcga

SEQ ID NO: 155272 - DNA, 25 bp, Homo sapien
ttgctcacctttgcacgcggcgtgt

SEQ ID NO: 155273 - DNA, 25 bp, Homo sapien
ggaggcccactcacgctgggcacta

SEQ ID NO: 155274 - DNA, 25 bp, Homo sapien
ctcacgctgggcactagtgacaagg

SEQ ID NO: 155275 - DNA, 25 bp, Homo sapien
cactagtgacaaggggacatcagcc

SEQ ID NO: 155276 - DNA, 25 bp, Homo sapien
caaggggacatcagcctttgttctc

SEQ ID NO: 155277 - DNA, 25 bp, Homo sapien
ggacatcagcctttgttctcctggg

SEQ ID NO: 155278 - DNA, 25 bp, Homo sapien
cttggcgaggctgcgctgccaaagc

SEQ ID NO: 155279 - DNA, 25 bp, Homo sapien
caccagggttgctcacctttgcacg

SEQ ID NO: 155280 - DNA, 25 bp, Homo sapien
tgtgagcctgttacaccgcagagtc

SEQ ID NO: 155281 - DNA, 25 bp, Homo sapien
caccgcggcgcattctatataaacg

SEQ ID NO: 155282 - DNA, 25 bp, Homo sapien
tcccagcttgcttgacaaggttcgc

SEQ ID NO: 155283 - DNA, 25 bp, Homo sapien
tcgctcagaagacggaagtcctcgc

SEQ ID NO: 155284 - DNA, 25 bp, Homo sapien
gcgggccgccaactcgatcaaaata

SEQ ID NO: 155285 - DNA, 25 bp, Homo sapien
gacgatggcccttacctgctctctt

SEQ ID NO: 155286 - DNA, 25 bp, Homo sapien
tccggtcctagagagccacgaatca

SEQ ID NO: 155287 - DNA, 25 bp, Homo sapien
gctcgccgcgctcaagaagtgaaga

SEQ ID NO: 155288 - DNA, 25 bp, Homo sapien
gctgcgttcgcctaccttcagtgcg

SEQ ID NO: 155289 - DNA, 25 bp, Homo sapien
ggctgcgttcgcctaccttcagtgc

SEQ ID NO: 155290 - DNA, 25 bp, Homo sapien
taccagtacaccagtgagtccaccc

SEQ ID NO: 155291 - DNA, 25 bp, Homo sapien
tgcgttcgcctaccttcagtgcgcc

SEQ ID NO: 155292 - DNA, 25 bp, Homo sapien
cacccgggtggtgcagaagctgccc

SEQ ID NO: 155293 - DNA, 25 bp, Homo sapien
cgggtggtgcagaagctgccctcac

SEQ ID NO: 155294 - DNA, 25 bp, Homo sapien
ctctaccagtacaccagtgagtcca

SEQ ID NO: 155295 - DNA, 25 bp, Homo sapien
tctaccagtacaccagtgagtccac

SEQ ID NO: 155296 - DNA, 25 bp, Homo sapien
gaacgcttcgctcctagggccgggc

SEQ ID NO: 155297 - DNA, 25 bp, Homo sapien
agcggttcctgggactgcaccgaag

SEQ ID NO: 155298 - DNA, 25 bp, Homo sapien
cacgcgcagtgcaaaaggtcgggct

SEQ ID NO: 155299 - DNA, 25 bp, Homo sapien
agccggcgaacgcttcgctcctagg

SEQ ID NO: 155300 - DNA, 25 bp, Homo sapien
gcgccggaagtggaaatgcgtcata

SEQ ID NO: 155301 - DNA, 25 bp, Homo sapien
caagaaggagaaacccggtgctgcc

SEQ ID NO: 155302 - DNA, 25 bp, Homo sapien
cagtgcaaaaggtcgggctcccgga

SEQ ID NO: 155303 - DNA, 25 bp, Homo sapien
gcgcctgaaactgtacgggggaatc

SEQ ID NO: 155304 - DNA, 25 bp, Homo sapien
ccagaggaacggagaacggatgacc

SEQ ID NO: 155305 - DNA, 25 bp, Homo sapien
acggatgacccagcgagttcgtggc

SEQ ID NO: 155306 - DNA, 25 bp, Homo sapien
ggggacttacctgccacgaagactg

SEQ ID NO: 155307 - DNA, 25 bp, Homo sapien
gcagaggtagttcttcccgtacttc

SEQ ID NO: 155308 - DNA, 25 bp, Homo sapien
agggccatggccatgtccacctgca

SEQ ID NO: 155309 - DNA, 25 bp, Homo sapien
cgcggagtccaggaacttgttaaga

SEQ ID NO: 155310 - DNA, 25 bp, Homo sapien
cccgcttagccaccggtggatgaaa

SEQ ID NO: 155311 - DNA, 25 bp, Homo sapien
tcgcctgggctatcggcatgaaagt

SEQ ID NO: 155312 - DNA, 25 bp, Homo sapien
ggactagttctgaaagcccaccctc

SEQ ID NO: 155313 - DNA, 25 bp, Homo sapien
acgattcaagctccggcggaacatc

SEQ ID NO: 155314 - DNA, 25 bp, Homo sapien
tcctcatctgcaccgacgagggttc

SEQ ID NO: 155315 - DNA, 25 bp, Homo sapien
agctcgcgcagcacccactgagaag

SEQ ID NO: 155316 - DNA, 25 bp, Homo sapien
acaaaacacactgcggcgtgggccg

SEQ ID NO: 155317 - DNA, 25 bp, Homo sapien
gggaaggcgccgtccacaaaacaca

SEQ ID NO: 155318 - DNA, 25 bp, Homo sapien
cggaacatcgcgtcgaaggctgccg

SEQ ID NO: 155319 - DNA, 25 bp, Homo sapien
tgtctctgtcgggagccacagcctc

SEQ ID NO: 155320 - DNA, 25 bp, Homo sapien
cccgctccgagttatcggtgctgca

SEQ ID NO: 155321 - DNA, 25 bp, Homo sapien
tccgagttatcggtgctgcagccgc

SEQ ID NO: 155322 - DNA, 25 bp, Homo sapien
agcatccacgccgttgcgggtggct

SEQ ID NO: 155323 - DNA, 25 bp, Homo sapien
catccacgccgttgcgggtggctga

SEQ ID NO: 155324 - DNA, 25 bp, Homo sapien
gcgactagcgctgtagcagttggcc

SEQ ID NO: 155325 - DNA, 25 bp, Homo sapien
gctgtagcagttggcctcagggccc

SEQ ID NO: 155326 - DNA, 25 bp, Homo sapien
gttatctccgcggccgcgaaggcag

SEQ ID NO: 155327 - DNA, 25 bp, Homo sapien
actagcgctgtagcagttggcctca

SEQ ID NO: 155328 - DNA, 25 bp, Homo sapien
ccaaacaaagcatgaaggcagagtg

SEQ ID NO: 155329 - DNA, 25 bp, Homo sapien
cgcggcgttttcaagtgctggctgc

SEQ ID NO: 155330 - DNA, 25 bp, Homo sapien
ctggctgcgaagcttgaaaaggacc

SEQ ID NO: 155331 - DNA, 25 bp, Homo sapien
agcttgaaaaggacccgccgctggg

SEQ ID NO: 155332 - DNA, 25 bp, Homo sapien
gcctctcggctcagactcaggccgg

SEQ ID NO: 155333 - DNA, 25 bp, Homo sapien
gccggcgcctagaaagttgtgatgc

SEQ ID NO: 155334 - DNA, 25 bp, Homo sapien
gtttgccaaacaaagcatgaaggca

SEQ ID NO: 155335 - DNA, 25 bp, Homo sapien
agcctcgcggcgttttcaagtgctg

SEQ ID NO: 155336 - DNA, 25 bp, Homo sapien
ctacggggttcttgagttcagtctc

SEQ ID NO: 155337 - DNA, 25 bp, Homo sapien
ctcagaggccaccaattagggtttc

SEQ ID NO: 155338 - DNA, 25 bp, Homo sapien
ccctctttggcctagtgacgtggta

SEQ ID NO: 155339 - DNA, 25 bp, Homo sapien
atgcgccctggccaatcattaccga

SEQ ID NO: 155340 - DNA, 25 bp, Homo sapien
cccgtgattgacaggttcgcagtga

SEQ ID NO: 155341 - DNA, 25 bp, Homo sapien
gcattcacagtctgcctgggctcta

SEQ ID NO: 155342 - DNA, 25 bp, Homo sapien
agcccgcaaagcttcccgttgtctg

SEQ ID NO: 155343 - DNA, 25 bp, Homo sapien
agttctctcgaacaggtcgcattca

SEQ ID NO: 155344 - DNA, 25 bp, Homo sapien
cgagctctgcacacgatgccgagtc

SEQ ID NO: 155345 - DNA, 25 bp, Homo sapien
ggcgactttgcttcccgtgaggaga

SEQ ID NO: 155346 - DNA, 25 bp, Homo sapien
cgggctttattccacagggcgactt

SEQ ID NO: 155347 - DNA, 25 bp, Homo sapien
cctgccgccgtctaagtgactgaca

SEQ ID NO: 155348 - DNA, 25 bp, Homo sapien
gatgcactccggttgcccgagctct

SEQ ID NO: 155349 - DNA, 25 bp, Homo sapien
tgtggtctctaaggtggatgcactc

SEQ ID NO: 155350 - DNA, 25 bp, Homo sapien
gtccaccttgccgaccggctgtgtg

SEQ ID NO: 155351 - DNA, 25 bp, Homo sapien
gagcatcccggacatgccaccgtga

SEQ ID NO: 155352 - DNA, 25 bp, Homo sapien
acacacgcccgggtggaagagacgc

SEQ ID NO: 155353 - DNA, 25 bp, Homo sapien
gccaagcctacagggcggcaagctc

SEQ ID NO: 155354 - DNA, 25 bp, Homo sapien
ctgtgagggccactgagatctggca

SEQ ID NO: 155355 - DNA, 25 bp, Homo sapien
gatctggcagctgagacttgaacct

SEQ ID NO: 155356 - DNA, 25 bp, Homo sapien
ggccaactgcggaaagcaagaaaga

SEQ ID NO: 155357 - DNA, 25 bp, Homo sapien
aaagaactgttagcagacgggcaca

SEQ ID NO: 155358 - DNA, 25 bp, Homo sapien
ggcccggagatgaacagcaaaagtc

SEQ ID NO: 155359 - DNA, 25 bp, Homo sapien
agcaaaagtcggagaataatggccc

SEQ ID NO: 155360 - DNA, 25 bp, Homo sapien
gcgcaaccttcgctaagggtcggga

SEQ ID NO: 155361 - DNA, 25 bp, Homo sapien
aacgcagtgggaaccaggaccgatc

SEQ ID NO: 155362 - DNA, 25 bp, Homo sapien
ggaccgatccttcaacctcttcagg

SEQ ID NO: 155363 - DNA, 25 bp, Homo sapien
tccaagtgcccttgggcggttcaca

SEQ ID NO: 155364 - DNA, 25 bp, Homo sapien
ggcggttcacagagctccggatctg

SEQ ID NO: 155365 - DNA, 25 bp, Homo sapien
ggaaacttcacccagcgtagcctct

SEQ ID NO: 155366 - DNA, 25 bp, Homo sapien
cttcgaaagagaccaagcggatttg

SEQ ID NO: 155367 - DNA, 25 bp, Homo sapien
gtgtcgcgacaggtaccacagcgca

SEQ ID NO: 155368 - DNA, 25 bp, Homo sapien
tgccaggtatggaggatgcctatcc

SEQ ID NO: 155369 - DNA, 25 bp, Homo sapien
ttctccgaaaagcatcgccgagtta

SEQ ID NO: 155370 - DNA, 25 bp, Homo sapien
ggccgctgtcatcccaattccattt

SEQ ID NO: 155371 - DNA, 25 bp, Homo sapien
ccagacggcgcgacaaaatgagatc

SEQ ID NO: 155372 - DNA, 25 bp, Homo sapien
ccaggaacagctaacgtgccgcttg

SEQ ID NO: 155373 - DNA, 25 bp, Homo sapien
gcgttgccgtctgagtggcctaaaa

SEQ ID NO: 155374 - DNA, 25 bp, Homo sapien
gcctcgcgagaagcgcaacatcttg

SEQ ID NO: 155375 - DNA, 25 bp, Homo sapien
ggccgtgatggctttttggcgtcta

SEQ ID NO: 155376 - DNA, 25 bp, Homo sapien
cacagaacggcactgcatcggagta

SEQ ID NO: 155377 - DNA, 25 bp, Homo sapien
actgcaaagacgagacgagtcctcc

SEQ ID NO: 155378 - DNA, 25 bp, Homo sapien
ttgcgtggctcggagcagccagacc

SEQ ID NO: 155379 - DNA, 25 bp, Homo sapien
ccgtattccgctttaaccaagcttg

SEQ ID NO: 155380 - DNA, 25 bp, Homo sapien
ccacaaattccctgagcggagcgtc

SEQ ID NO: 155381 - DNA, 25 bp, Homo sapien
ccgggtgacaacgtggcacagaacg

SEQ ID NO: 155382 - DNA, 25 bp, Homo sapien
catcggagtaggcacactgcaaaga

SEQ ID NO: 155383 - DNA, 25 bp, Homo sapien
gccgacgaatgctggagaggccatc

SEQ ID NO: 155384 - DNA, 25 bp, Homo sapien
gccgtctgcacgataaactcgggga

SEQ ID NO: 155385 - DNA, 25 bp, Homo sapien
cagaatcggttctcgttcacgagca

SEQ ID NO: 155386 - DNA, 25 bp, Homo sapien
tcacgagcatgtaagacgccgtctg

SEQ ID NO: 155387 - DNA, 25 bp, Homo sapien
ccaccggcttgtggtaggtctctcg

SEQ ID NO: 155388 - DNA, 25 bp, Homo sapien
gggagctctcgccattaaacgtttc

SEQ ID NO: 155389 - DNA, 25 bp, Homo sapien
cagcagccgcagctgttccatgagc

SEQ ID NO: 155390 - DNA, 25 bp, Homo sapien
tccatgagctggctgttctcgatgc

SEQ ID NO: 155391 - DNA, 25 bp, Homo sapien
tcatccaccattgcgaacggcctgg

SEQ ID NO: 155392 - DNA, 25 bp, Homo sapien
gccggagtttcagtggacctctcta

SEQ ID NO: 155393 - DNA, 25 bp, Homo sapien
ggatcctttccggtcctcagcggca

SEQ ID NO: 155394 - DNA, 25 bp, Homo sapien
agccacccgagacctgtacaacttg

SEQ ID NO: 155395 - DNA, 25 bp, Homo sapien
gtattcctagtcttgccgagcgcta

SEQ ID NO: 155396 - DNA, 25 bp, Homo sapien
tgcagagcttttagagttacccacc

SEQ ID NO: 155397 - DNA, 25 bp, Homo sapien
tccctggccagctacaaaaatcctg

SEQ ID NO: 155398 - DNA, 25 bp, Homo sapien
ggccgcctcgaagacgttggcacta

SEQ ID NO: 155399 - DNA, 25 bp, Homo sapien
gagtcactgacctgcttgccacggg

SEQ ID NO: 155400 - DNA, 25 bp, Homo sapien
ttctccgacatcctgaaggtgcgcg

SEQ ID NO: 155401 - DNA, 25 bp, Homo sapien
gactgggactccttcttccgcgacg

SEQ ID NO: 155402 - DNA, 25 bp, Homo sapien
ttccgcgacgccaaggacatgaacg

SEQ ID NO: 155403 - DNA, 25 bp, Homo sapien
cctgcaagtggttcgccctgaagga

SEQ ID NO: 155404 - DNA, 25 bp, Homo sapien
cgaggacgtcctggtcaaggtgttt

SEQ ID NO: 155405 - DNA, 25 bp, Homo sapien
gtaccgcgagtacatgggcttcatc

SEQ ID NO: 155406 - DNA, 25 bp, Homo sapien
ccctgcgcgggatgaaactcatgta

SEQ ID NO: 155407 - DNA, 25 bp, Homo sapien
cttcgaggcctatgtgcagtaccgc

SEQ ID NO: 155408 - DNA, 25 bp, Homo sapien
cagcgtcccgcattctcagtgtgga

SEQ ID NO: 155409 - DNA, 25 bp, Homo sapien
tccggtgaaacaggagcgactctca

SEQ ID NO: 155410 - DNA, 25 bp, Homo sapien
ctctgaaacatcatgcgctgctgga

SEQ ID NO: 155411 - DNA, 25 bp, Homo sapien
gggtttcgctctcccacgcctgtaa

SEQ ID NO: 155412 - DNA, 25 bp, Homo sapien
tcaagtcctctgtagcctgtgttcc

SEQ ID NO: 155413 - DNA, 25 bp, Homo sapien
gtcttcaccggccagcccaaggtta

SEQ ID NO: 155414 - DNA, 25 bp, Homo sapien
tgcttagcatcagcgccgacttcta

SEQ ID NO: 155415 - DNA, 25 bp, Homo sapien
tgcaggccaacttcaccatccggga

SEQ ID NO: 155416 - DNA, 25 bp, Homo sapien
ctgagccaggctctactcggttaga

SEQ ID NO: 155417 - DNA, 25 bp, Homo sapien
cagtgagccggctttcctcagtccg

SEQ ID NO: 155418 - DNA, 25 bp, Homo sapien
cgagctagaagcctccggtcggcct

SEQ ID NO: 155419 - DNA, 25 bp, Homo sapien
accgcaccaggcgtctagcaggtag

SEQ ID NO: 155420 - DNA, 25 bp, Homo sapien
gagacacctggtctcccggaagcgc

SEQ ID NO: 155421 - DNA, 25 bp, Homo sapien
agcgcccttcggaaatgggattcga

SEQ ID NO: 155422 - DNA, 25 bp, Homo sapien
tcgctcggtaagttctgagcactca

SEQ ID NO: 155423 - DNA, 25 bp, Homo sapien
cccaccgtgtcctgtggaaggcttg

SEQ ID NO: 155424 - DNA, 25 bp, Homo sapien
ccctagtcctgtcccggggagcctg

SEQ ID NO: 155425 - DNA, 25 bp, Homo sapien
tgacgtcaccctagtcctgtcccgg

SEQ ID NO: 155426 - DNA, 25 bp, Homo sapien
tcaccctagtcctgtcccggggagc

SEQ ID NO: 155427 - DNA, 25 bp, Homo sapien
cctagtcctgtcccggggagcctgc

SEQ ID NO: 155428 - DNA, 25 bp, Homo sapien
tagtcctgtcccggggagcctgcaa

SEQ ID NO: 155429 - DNA, 25 bp, Homo sapien
cgtgacgtcaccctagtcctgtccc

SEQ ID NO: 155430 - DNA, 25 bp, Homo sapien
gtgacgtcaccctagtcctgtcccg

SEQ ID NO: 155431 - DNA, 25 bp, Homo sapien
ctagtcctgtcccggggagcctgca

SEQ ID NO: 155432 - DNA, 25 bp, Homo sapien
caaactgctagacgcactgctgcca

SEQ ID NO: 155433 - DNA, 25 bp, Homo sapien
agcctgcaaagcctctcagattcaa

SEQ ID NO: 155434 - DNA, 25 bp, Homo sapien
agattcaaactgctagacgcactgc

SEQ ID NO: 155435 - DNA, 25 bp, Homo sapien
accgccaccgaattggaaacgcgcg

SEQ ID NO: 155436 - DNA, 25 bp, Homo sapien
ccgaattggaaacgcgcgcccaggc

SEQ ID NO: 155437 - DNA, 25 bp, Homo sapien
gcccaggctccgtcgtcgccttcgc

SEQ ID NO: 155438 - DNA, 25 bp, Homo sapien
ggctctccgacctccctacagaatc

SEQ ID NO: 155439 - DNA, 25 bp, Homo sapien
agcctctcagattcaaactgctaga

SEQ ID NO: 155440 - DNA, 25 bp, Homo sapien
cccgggaaatcaggtgcaagcatgt

SEQ ID NO: 155441 - DNA, 25 bp, Homo sapien
gcaagcatgtgtgttcccggggcgc

SEQ ID NO: 155442 - DNA, 25 bp, Homo sapien
tcaggtgcaagcatgtgtgttcccg

SEQ ID NO: 155443 - DNA, 25 bp, Homo sapien
atcaggtgcaagcatgtgtgttccc

SEQ ID NO: 155444 - DNA, 25 bp, Homo sapien
aatcaggtgcaagcatgtgtgttcc

SEQ ID NO: 155445 - DNA, 25 bp, Homo sapien
cgggaaatcaggtgcaagcatgtgt

SEQ ID NO: 155446 - DNA, 25 bp, Homo sapien
caggtgcaagcatgtgtgttcccgg

SEQ ID NO: 155447 - DNA, 25 bp, Homo sapien
ccgggaaatcaggtgcaagcatgtg

SEQ ID NO: 155448 - DNA, 25 bp, Homo sapien
ctcaagacgggcgagctgcccgaga

SEQ ID NO: 155449 - DNA, 25 bp, Homo sapien
actcggttactaatgacttggcggc

SEQ ID NO: 155450 - DNA, 25 bp, Homo sapien
gttactaatgacttggcggctggct

SEQ ID NO: 155451 - DNA, 25 bp, Homo sapien
ggacaactcggttactaatgacttg

SEQ ID NO: 155452 - DNA, 25 bp, Homo sapien
ggcaggatttagtaggacaactcgg

SEQ ID NO: 155453 - DNA, 25 bp, Homo sapien
tgcccgagatctcttcgagataccc

SEQ ID NO: 155454 - DNA, 25 bp, Homo sapien
cgagctgcccgagatctcttcgaga

SEQ ID NO: 155455 - DNA, 25 bp, Homo sapien
agctgcccgagatctcttcgagata

SEQ ID NO: 155456 - DNA, 25 bp, Homo sapien
ctctgcgtcctggtgtctgatatgc

SEQ ID NO: 155457 - DNA, 25 bp, Homo sapien
gcgctctgcatcctggtgtctgaaa

SEQ ID NO: 155458 - DNA, 25 bp, Homo sapien
gcgctctgcatcctggtgtctgata

SEQ ID NO: 155459 - DNA, 25 bp, Homo sapien
tctgcgtcctggtgtctgaaataca

SEQ ID NO: 155460 - DNA, 25 bp, Homo sapien
cgctctgcgtcctggtgtctgatat

SEQ ID NO: 155461 - DNA, 25 bp, Homo sapien
tctgcgtcctggtgtctgatatgca

SEQ ID NO: 155462 - DNA, 25 bp, Homo sapien
gcgcgtcctggtgtctgatatgcac

SEQ ID NO: 155463 - DNA, 25 bp, Homo sapien
tgcaccgtgtgaagctctctgcgtc

SEQ ID NO: 155464 - DNA, 25 bp, Homo sapien
ggaggcaagtcttcatgcggtcata

SEQ ID NO: 155465 - DNA, 25 bp, Homo sapien
gctgtgctgtagacgcagctttccc

SEQ ID NO: 155466 - DNA, 25 bp, Homo sapien
ctgaacagctccttcaggggctccg

SEQ ID NO: 155467 - DNA, 25 bp, Homo sapien
ctgctcacaggatacgatcagcttc

SEQ ID NO: 155468 - DNA, 25 bp, Homo sapien
ggcgttgaaacggtcgcgcactgac

SEQ ID NO: 155469 - DNA, 25 bp, Homo sapien
ctccctctcgatgctgtgctgtaga

SEQ ID NO: 155470 - DNA, 25 bp, Homo sapien
ctccaggggcatgttgtagacctcg

SEQ ID NO: 155471 - DNA, 25 bp, Homo sapien
tacgatcagcttctccctctcgatg

SEQ ID NO: 155472 - DNA, 25 bp, Homo sapien
gctccaatggcgctttctacaaggt

SEQ ID NO: 155473 - DNA, 25 bp, Homo sapien
gcgctcagctccgtttcggtttcac

SEQ ID NO: 155474 - DNA, 25 bp, Homo sapien
ttcggcctcagtcaggcgctcagct

SEQ ID NO: 155475 - DNA, 25 bp, Homo sapien
ttcagtgtttacacccgcagcgggc

SEQ ID NO: 155476 - DNA, 25 bp, Homo sapien
ggccctagcgcctatcgaaatgaga

SEQ ID NO: 155477 - DNA, 25 bp, Homo sapien
ctaagtgacggcgatggcttattcc

SEQ ID NO: 155478 - DNA, 25 bp, Homo sapien
tacaaggtacttggctctagggcag

SEQ ID NO: 155479 - DNA, 25 bp, Homo sapien
ctgagtgcacctctgcagaaatggg

SEQ ID NO: 155480 - DNA, 25 bp, Homo sapien
gggccactgccctattggcttctga

SEQ ID NO: 155481 - DNA, 25 bp, Homo sapien
cactgccctattggcttctgagtca

SEQ ID NO: 155482 - DNA, 25 bp, Homo sapien
ccacggactgccggaccgttgggct

SEQ ID NO: 155483 - DNA, 25 bp, Homo sapien
cgtcatcgtgaaggaatcagtttca

SEQ ID NO: 155484 - DNA, 25 bp, Homo sapien
atcagtttcaggtctcgcgagagtt

SEQ ID NO: 155485 - DNA, 25 bp, Homo sapien
tctcgcgagagttggcacatgccac

SEQ ID NO: 155486 - DNA, 25 bp, Homo sapien
gttggcacatgccacgcgagggcca

SEQ ID NO: 155487 - DNA, 25 bp, Homo sapien
cacgcgagggccactgccctattgg

SEQ ID NO: 155488 - DNA, 25 bp, Homo sapien
gatattccaaagaattatgcctctc

SEQ ID NO: 155489 - DNA, 25 bp, Homo sapien
attccaaagaattatgcctctcaaa

SEQ ID NO: 155490 - DNA, 25 bp, Homo sapien
agtaaatttcagagacgttcttcgc

SEQ ID NO: 155491 - DNA, 25 bp, Homo sapien
agctctgcttaaaagtaaatttcag

SEQ ID NO: 155492 - DNA, 25 bp, Homo sapien
taagctctgcttaaaagtaaatttc

SEQ ID NO: 155493 - DNA, 25 bp, Homo sapien
aaaagataagtttaagctctgctta

SEQ ID NO: 155494 - DNA, 25 bp, Homo sapien
ccaaagaattatgcctctcaaattt

SEQ ID NO: 155495 - DNA, 25 bp, Homo sapien
gcacaaataaaagataagtttaagc

SEQ ID NO: 155496 - DNA, 25 bp, Homo sapien
cacctcctgtatccctgccacggcc

SEQ ID NO: 155497 - DNA, 25 bp, Homo sapien
gggatgataacgtgcctgctccatg

SEQ ID NO: 155498 - DNA, 25 bp, Homo sapien
ccagatccggggatgataacgtgcc

SEQ ID NO: 155499 - DNA, 25 bp, Homo sapien
ccactagctgattttgacagtgggg

SEQ ID NO: 155500 - DNA, 25 bp, Homo sapien
gctcccactagctgattttgacagt

SEQ ID NO: 155501 - DNA, 25 bp, Homo sapien
tggccgctcccactagctgattttg

SEQ ID NO: 155502 - DNA, 25 bp, Homo sapien
gataacgtgcctgctccatgtcgcg

SEQ ID NO: 155503 - DNA, 25 bp, Homo sapien
gtccgggtcctcagctctgtggccg

SEQ ID NO: 155504 - DNA, 25 bp, Homo sapien
cgtcgctttgcgctccaagtctaaa

SEQ ID NO: 155505 - DNA, 25 bp, Homo sapien
cgactttttcagagactgggacttg

SEQ ID NO: 155506 - DNA, 25 bp, Homo sapien
tctcctttgatgagcgagtctcctg

SEQ ID NO: 155507 - DNA, 25 bp, Homo sapien
tctcctggcgaagtctgaggttttc

SEQ ID NO: 155508 - DNA, 25 bp, Homo sapien
tgcatttggctcacatcgaattcgg

SEQ ID NO: 155509 - DNA, 25 bp, Homo sapien
caccactcaggggaccttggttcga

SEQ ID NO: 155510 - DNA, 25 bp, Homo sapien
gcctggccgctatggatctattcga

SEQ ID NO: 155511 - DNA, 25 bp, Homo sapien
gagcttttctctcggagcggcttgc

SEQ ID NO: 155512 - DNA, 25 bp, Homo sapien
accgtgtggatcactgtctgggcgt

SEQ ID NO: 155513 - DNA, 25 bp, Homo sapien
ccggagaccgtgtggatcactgtct

SEQ ID NO: 155514 - DNA, 25 bp, Homo sapien
cagcacatgaaactgcctgaggacc

SEQ ID NO: 155515 - DNA, 25 bp, Homo sapien
gctcacagggcggttaaaccttcag

SEQ ID NO: 155516 - DNA, 25 bp, Homo sapien
tcccgcctaagggcgtgctgtgtgc

SEQ ID NO: 155517 - DNA, 25 bp, Homo sapien
ggatcactgtctgggcgtcggcacc

SEQ ID NO: 155518 - DNA, 25 bp, Homo sapien
ctcgtggggcggtgacagctcacag

SEQ ID NO: 155519 - DNA, 25 bp, Homo sapien
gggcggttaaaccttcagcacatga

SEQ ID NO: 155520 - DNA, 25 bp, Homo sapien
ggatcagagctgtaaggcacaaatc

SEQ ID NO: 155521 - DNA, 25 bp, Homo sapien
aggcacaaatccaagtgcgcgccgc

SEQ ID NO: 155522 - DNA, 25 bp, Homo sapien
ctgtgtggccggatcagagctgtaa

SEQ ID NO: 155523 - DNA, 25 bp, Homo sapien
tgtccctaaagccagggcggaaggc

SEQ ID NO: 155524 - DNA, 25 bp, Homo sapien
tccagcttgtccctaaagccagggc

SEQ ID NO: 155525 - DNA, 25 bp, Homo sapien
cctccagtggttctctgaggaacca

SEQ ID NO: 155526 - DNA, 25 bp, Homo sapien
tgccacagcggcctccagtggttct

SEQ ID NO: 155527 - DNA, 25 bp, Homo sapien
ccttcgtgcgttcttggtgccacag

SEQ ID NO: 155528 - DNA, 25 bp, Homo sapien
ttgcaagcttcgcagacccagcggc

SEQ ID NO: 155529 - DNA, 25 bp, Homo sapien
cgggccagttgccttgcaagcttcg

SEQ ID NO: 155530 - DNA, 25 bp, Homo sapien
tcatcctgcagcaataggcgtggcc

SEQ ID NO: 155531 - DNA, 25 bp, Homo sapien
gagtgcgtccgtgcgactcttccct

SEQ ID NO: 155532 - DNA, 25 bp, Homo sapien
gaacccatgaagactgcgcaacaca

SEQ ID NO: 155533 - DNA, 25 bp, Homo sapien
agacctcctcgtcgggaacccatga

SEQ ID NO: 155534 - DNA, 25 bp, Homo sapien
catttcggcttcgacgcggccgctt

SEQ ID NO: 155535 - DNA, 25 bp, Homo sapien
gacgcagacggagctcagaaccaga

SEQ ID NO: 155536 - DNA, 25 bp, Homo sapien
ctgttcattcctgtggcgaaaagcc

SEQ ID NO: 155537 - DNA, 25 bp, Homo sapien
cgtctgcgagtagaaagcccgtgta

SEQ ID NO: 155538 - DNA, 25 bp, Homo sapien
tgctcagccttcttgcggacggtac

SEQ ID NO: 155539 - DNA, 25 bp, Homo sapien
cccacgactcgcagggtccatggtt

SEQ ID NO: 155540 - DNA, 25 bp, Homo sapien
cggagttagcggcaacgaccttgca

SEQ ID NO: 155541 - DNA, 25 bp, Homo sapien
gaccttgcagcctggacactagcca

SEQ ID NO: 155542 - DNA, 25 bp, Homo sapien
acgtctccttgcttgggagcccatc

SEQ ID NO: 155543 - DNA, 25 bp, Homo sapien
cggggaagcagaggactgttcattc

SEQ ID NO: 155544 - DNA, 25 bp, Homo sapien
gggcacccacgtggcagagtggatc

SEQ ID NO: 155545 - DNA, 25 bp, Homo sapien
cccacgtggcagagtggatcacgca

SEQ ID NO: 155546 - DNA, 25 bp, Homo sapien
gcacccacgtggcagagtggatcac

SEQ ID NO: 155547 - DNA, 25 bp, Homo sapien
cacgtggcagagaggatcgctgcgg

SEQ ID NO: 155548 - DNA, 25 bp, Homo sapien
cagagaggatcgctgcggagtggca

SEQ ID NO: 155549 - DNA, 25 bp, Homo sapien
acgtggcagagaggatcgctgcgga

SEQ ID NO: 155550 - DNA, 25 bp, Homo sapien
cacccacgtggcagagtggatcgct

SEQ ID NO: 155551 - DNA, 25 bp, Homo sapien
cccacgtggcagagtggatcgctgc

SEQ ID NO: 155552 - DNA, 25 bp, Homo sapien
cccagagcgctcctcgctgggaggt

SEQ ID NO: 155553 - DNA, 25 bp, Homo sapien
ccttacagcgggttcatggcgccag

SEQ ID NO: 155554 - DNA, 25 bp, Homo sapien
acagcctgcgccttacagcgggttc

SEQ ID NO: 155555 - DNA, 25 bp, Homo sapien
aggttcatggcggagaacttcaccg

SEQ ID NO: 155556 - DNA, 25 bp, Homo sapien
cgccgaggccgactgttttgcctgg

SEQ ID NO: 155557 - DNA, 25 bp, Homo sapien
agcagaaaagaatggggttcccttg

SEQ ID NO: 155558 - DNA, 25 bp, Homo sapien
acaccaatgagggacagcaagcaga

SEQ ID NO: 155559 - DNA, 25 bp, Homo sapien
ccgagacgaagaagttgggacacca

SEQ ID NO: 155560 - DNA, 25 bp, Homo sapien
ctcacggcctctggaccctgagagt

SEQ ID NO: 155561 - DNA, 25 bp, Homo sapien
cagtgacagatgctagcggtccata

SEQ ID NO: 155562 - DNA, 25 bp, Homo sapien
agcaagggacaccaaagggcgcttc

SEQ ID NO: 155563 - DNA, 25 bp, Homo sapien
cagcccgcaagtaccgtctgcaaga

SEQ ID NO: 155564 - DNA, 25 bp, Homo sapien
catcaggggccctggtacctttcag

SEQ ID NO: 155565 - DNA, 25 bp, Homo sapien
ggtagctgccgcttactcccggaaa

SEQ ID NO: 155566 - DNA, 25 bp, Homo sapien
tttggcctcagagtacagtcctccg

SEQ ID NO: 155567 - DNA, 25 bp, Homo sapien
gcggtccataacttcggctttcatg

SEQ ID NO: 155568 - DNA, 25 bp, Homo sapien
ccgcgcctggggaattgtgttccct

SEQ ID NO: 155569 - DNA, 25 bp, Homo sapien
cgccgccaacaatccgctttataaa

SEQ ID NO: 155570 - DNA, 25 bp, Homo sapien
gtctccaagtggtttcgagccgctc

SEQ ID NO: 155571 - DNA, 25 bp, Homo sapien
ttcgaggaccctctgtgggaaccca

SEQ ID NO: 155572 - DNA, 25 bp, Homo sapien
tggacaccctaaatcctggcggccg

SEQ ID NO: 155573 - DNA, 25 bp, Homo sapien
gcgtctggctacacgcctcatttct

SEQ ID NO: 155574 - DNA, 25 bp, Homo sapien
acacacaagggctcaaactctccga

SEQ ID NO: 155575 - DNA, 25 bp, Homo sapien
ggatgagcgtgctactctggactgc

SEQ ID NO: 155576 - DNA, 25 bp, Homo sapien
cgctctttctccaggtaacttcgtg

SEQ ID NO: 155577 - DNA, 25 bp, Homo sapien
ccgcaggtgtccgtcttgggataac

SEQ ID NO: 155578 - DNA, 25 bp, Homo sapien
agctgccatcggctggagaagtcca

SEQ ID NO: 155579 - DNA, 25 bp, Homo sapien
ctccgctgagcgtgaccagatgtgt

SEQ ID NO: 155580 - DNA, 25 bp, Homo sapien
cacgaagggatcttgctgggttctc

SEQ ID NO: 155581 - DNA, 25 bp, Homo sapien
actgcgcctacgtagcccacgaagg

SEQ ID NO: 155582 - DNA, 25 bp, Homo sapien
ccacagcgggtctgtttggcagtca

SEQ ID NO: 155583 - DNA, 25 bp, Homo sapien
cttcgtgaaacgctaggaggcaatc

SEQ ID NO: 155584 - DNA, 25 bp, Homo sapien
ggtgcttcgagtcggtagaccctaa

SEQ ID NO: 155585 - DNA, 25 bp, Homo sapien
gtgccttcacatgccagctgcctga

SEQ ID NO: 155586 - DNA, 25 bp, Homo sapien
gcgcagctcgaaacgccggagacca

SEQ ID NO: 155587 - DNA, 25 bp, Homo sapien
gaccctaaagtttgctctgagcaca

SEQ ID NO: 155588 - DNA, 25 bp, Homo sapien
catcccggagtggaaaccctgagtt

SEQ ID NO: 155589 - DNA, 25 bp, Homo sapien
cagcatgaacttggccgcgagctga

SEQ ID NO: 155590 - DNA, 25 bp, Homo sapien
cgagcagattgaggccgccactgca

SEQ ID NO: 155591 - DNA, 25 bp, Homo sapien
cagcagtgagaaatgcctatcagta

SEQ ID NO: 155592 - DNA, 25 bp, Homo sapien
cgcctgctctggtgcgagtcttctc

SEQ ID NO: 155593 - DNA, 25 bp, Homo sapien
ctcggactcagaaaagccggcctgg

SEQ ID NO: 155594 - DNA, 25 bp, Homo sapien
ggtgcgagtcttctccgctttacga

SEQ ID NO: 155595 - DNA, 25 bp, Homo sapien
ggtcttgcaaatcgccgccgtccag

SEQ ID NO: 155596 - DNA, 25 bp, Homo sapien
tgtgcccggtcttgcaaatcgccgc

SEQ ID NO: 155597 - DNA, 25 bp, Homo sapien
ctacagagccgctgctgtgcccggt

SEQ ID NO: 155598 - DNA, 25 bp, Homo sapien
ccacacccgagggttggcagaggtc

SEQ ID NO: 155599 - DNA, 25 bp, Homo sapien
ctccgctttacgactcggactcaga

SEQ ID NO: 155600 - DNA, 25 bp, Homo sapien
tccatgcgtcggacccttcaaaatg

SEQ ID NO: 155601 - DNA, 25 bp, Homo sapien
ggtttcgtccaagcgccgtcgctgt

SEQ ID NO: 155602 - DNA, 25 bp, Homo sapien
tcagccactgcctggactttgcttc

SEQ ID NO: 155603 - DNA, 25 bp, Homo sapien
gccagtgtttctgtgtcatacacga

SEQ ID NO: 155604 - DNA, 25 bp, Homo sapien
cgagaggtttatctgcttttgcaac

SEQ ID NO: 155605 - DNA, 25 bp, Homo sapien
ttgcaacagttgagggaagatctta

SEQ ID NO: 155606 - DNA, 25 bp, Homo sapien
gttagttccctgatacgcagtcgga

SEQ ID NO: 155607 - DNA, 25 bp, Homo sapien
cgcagtcggaagtatgtacaggcac

SEQ ID NO: 155608 - DNA, 25 bp, Homo sapien
cggcctcagtggcagccaaagctca

SEQ ID NO: 155609 - DNA, 25 bp, Homo sapien
cctcggttgatccatggtgcgcagt

SEQ ID NO: 155610 - DNA, 25 bp, Homo sapien
ccgtgcctgcttgtcttctgagaaa

SEQ ID NO: 155611 - DNA, 25 bp, Homo sapien
ttctgagaaactgtgggagcctccc

SEQ ID NO: 155612 - DNA, 25 bp, Homo sapien
ggtgccttttcatcccggctcagcg

SEQ ID NO: 155613 - DNA, 25 bp, Homo sapien
agccaaagctcatgggatggggtcc

SEQ ID NO: 155614 - DNA, 25 bp, Homo sapien
gggtcccattgtccacctgacgcga

SEQ ID NO: 155615 - DNA, 25 bp, Homo sapien
ccacctgacgcgagatcggtcaacg

SEQ ID NO: 155616 - DNA, 25 bp, Homo sapien
cgggtgaccttgagaagggctcttc

SEQ ID NO: 155617 - DNA, 25 bp, Homo sapien
acgcgctgcagtcctttcccatgaa

SEQ ID NO: 155618 - DNA, 25 bp, Homo sapien
tgcttaatgaccgacaaacgcgctg

SEQ ID NO: 155619 - DNA, 25 bp, Homo sapien
gttcatatctgcagagtcgatctca

SEQ ID NO: 155620 - DNA, 25 bp, Homo sapien
tgcgctgaaagtgcaagttcatatc

SEQ ID NO: 155621 - DNA, 25 bp, Homo sapien
tcgtgactggctgcggtcaacaagc

SEQ ID NO: 155622 - DNA, 25 bp, Homo sapien
accctggccggagactgaagaaaag

SEQ ID NO: 155623 - DNA, 25 bp, Homo sapien
tgttccctgcaggagtgaaaccctg

SEQ ID NO: 155624 - DNA, 25 bp, Homo sapien
ggcgtcatctcagctccctgttgct

SEQ ID NO: 155625 - DNA, 25 bp, Homo sapien
ttccttctcactcagacgcatgatg

SEQ ID NO: 155626 - DNA, 25 bp, Homo sapien
tgacctaaccgcaggcgcctgtgtg

SEQ ID NO: 155627 - DNA, 25 bp, Homo sapien
tgtgacctcaccagtggcccagagc

SEQ ID NO: 155628 - DNA, 25 bp, Homo sapien
ctccgcagcgtgaacctgacaggtc

SEQ ID NO: 155629 - DNA, 25 bp, Homo sapien
caggcgcgactggtaactcccatga

SEQ ID NO: 155630 - DNA, 25 bp, Homo sapien
tggcagcccagtccttacctcatgg

SEQ ID NO: 155631 - DNA, 25 bp, Homo sapien
agaccatggggcctccaaacacctt

SEQ ID NO: 155632 - DNA, 25 bp, Homo sapien
cggcgggtcgttctgtttgaatgaa

SEQ ID NO: 155633 - DNA, 25 bp, Homo sapien
cggccgggaaggaagaagcaattca

SEQ ID NO: 155634 - DNA, 25 bp, Homo sapien
tgttttaaacggcagagcccgctgg

SEQ ID NO: 155635 - DNA, 25 bp, Homo sapien
cccagactagcgaacaatacaggta

SEQ ID NO: 155636 - DNA, 25 bp, Homo sapien
tgaatgaatgatcccagcagccgcg

SEQ ID NO: 155637 - DNA, 25 bp, Homo sapien
agcccttggcgatcccagttctgtt

SEQ ID NO: 155638 - DNA, 25 bp, Homo sapien
agaggtggtctaccatcggcccttc

SEQ ID NO: 155639 - DNA, 25 bp, Homo sapien
ggcgtccacgcctgcttaatatgca

SEQ ID NO: 155640 - DNA, 25 bp, Homo sapien
gcgctgcggtcttggaatttatttc

SEQ ID NO: 155641 - DNA, 25 bp, Homo sapien
tgtggtcagcctaagcactgcaggc

SEQ ID NO: 155642 - DNA, 25 bp, Homo sapien
acgccgacgcaggaaagcacgcaga

SEQ ID NO: 155643 - DNA, 25 bp, Homo sapien
tcagaatacaaatgcggcgggcggc

SEQ ID NO: 155644 - DNA, 25 bp, Homo sapien
cggcggctcgctcagaatacaaatg

SEQ ID NO: 155645 - DNA, 25 bp, Homo sapien
cggactttaataatgcacgcggcgg

SEQ ID NO: 155646 - DNA, 25 bp, Homo sapien
tctcctggctgcaatcggtttctcg

SEQ ID NO: 155647 - DNA, 25 bp, Homo sapien
agcacgcagagtccggactttaata

SEQ ID NO: 155648 - DNA, 25 bp, Homo sapien
cgccgcagaccggatgcgggaagtg

SEQ ID NO: 155649 - DNA, 25 bp, Homo sapien
agccacgtgacagggcccaaagccg

SEQ ID NO: 155650 - DNA, 25 bp, Homo sapien
aaggaagagatgaagccacgtgaca

SEQ ID NO: 155651 - DNA, 25 bp, Homo sapien
ggagctgcggggctagttctgagcc

SEQ ID NO: 155652 - DNA, 25 bp, Homo sapien
aaaggaaccgaaatagcccagactg

SEQ ID NO: 155653 - DNA, 25 bp, Homo sapien
agatgaagccacgtgacagggccca

SEQ ID NO: 155654 - DNA, 25 bp, Homo sapien
ggaaccgaaatagcccagactggcg

SEQ ID NO: 155655 - DNA, 25 bp, Homo sapien
ctagttctgagccgggaaaaggtga

SEQ ID NO: 155656 - DNA, 25 bp, Homo sapien
attcgcgccggattcagttcacaga

SEQ ID NO: 155657 - DNA, 25 bp, Homo sapien
gagcctctcgtcctgagtttccttg

SEQ ID NO: 155658 - DNA, 25 bp, Homo sapien
tccattcccgtgaccaaggttattg

SEQ ID NO: 155659 - DNA, 25 bp, Homo sapien
ttagtagccggcagaaatccattcc

SEQ ID NO: 155660 - DNA, 25 bp, Homo sapien
ccctactgtggcaagaagactagtc

SEQ ID NO: 155661 - DNA, 25 bp, Homo sapien
gcggggacccaagagaagagcttta

SEQ ID NO: 155662 - DNA, 25 bp, Homo sapien
tcgacaggagccgtaacttttagta

SEQ ID NO: 155663 - DNA, 25 bp, Homo sapien
cccgtgccgctcagtagagaatgcc

SEQ ID NO: 155664 - DNA, 25 bp, Homo sapien
gctgcgacctgctctgtgaaagtta

SEQ ID NO: 155665 - DNA, 25 bp, Homo sapien
gcctggaatttccaccgccagattc

SEQ ID NO: 155666 - DNA, 25 bp, Homo sapien
tgaaagttaagttcgcggcggccgc

SEQ ID NO: 155667 - DNA, 25 bp, Homo sapien
ggcccttaccagagcgcaacgcagt

SEQ ID NO: 155668 - DNA, 25 bp, Homo sapien
agcggagatcccaaggtccgtaagc

SEQ ID NO: 155669 - DNA, 25 bp, Homo sapien
tggagggatagaaggcagcaaaacc

SEQ ID NO: 155670 - DNA, 25 bp, Homo sapien
actgcagagcagctagtccggctta

SEQ ID NO: 155671 - DNA, 25 bp, Homo sapien
caaaggcgcccaaactccgagttca

SEQ ID NO: 155672 - DNA, 25 bp, Homo sapien
cctgggtaaggcctcggccatgact

SEQ ID NO: 155673 - DNA, 25 bp, Homo sapien
cccactcctatgtttttaattgaga

SEQ ID NO: 155674 - DNA, 25 bp, Homo sapien
ctggacatcatcaccaccttgttgg

SEQ ID NO: 155675 - DNA, 25 bp, Homo sapien
ccatgactgtgggtgggtttaactc

SEQ ID NO: 155676 - DNA, 25 bp, Homo sapien
ctcagctagcagctgcggcggtctt

SEQ ID NO: 155677 - DNA, 25 bp, Homo sapien
gtctctgtttcgtcggccctaaatg

SEQ ID NO: 155678 - DNA, 25 bp, Homo sapien
gacctagggatggtaatgtcaaaca

SEQ ID NO: 155679 - DNA, 25 bp, Homo sapien
gtagtcatgtaaaccctcccacaga

SEQ ID NO: 155680 - DNA, 25 bp, Homo sapien
gctacaccatggagcgcccggataa

SEQ ID NO: 155681 - DNA, 25 bp, Homo sapien
gttccctcgcggagcttactgagcg

SEQ ID NO: 155682 - DNA, 25 bp, Homo sapien
cgcgaaccgctacttccggtgcgaa

SEQ ID NO: 155683 - DNA, 25 bp, Homo sapien
agccaccgccggtaagtcatgtgag

SEQ ID NO: 155684 - DNA, 25 bp, Homo sapien
tcgtcggcggaatacgctcagttgc

SEQ ID NO: 155685 - DNA, 25 bp, Homo sapien
gcctcctgagttcaggtagccctga

SEQ ID NO: 155686 - DNA, 25 bp, Homo sapien
cgaggaccagtgttcacgcgagttc

SEQ ID NO: 155687 - DNA, 25 bp, Homo sapien
ggctcatatgctcgggtctccttgc

SEQ ID NO: 155688 - DNA, 25 bp, Homo sapien
ctttgaccaagggtcctctgtgtgc

SEQ ID NO: 155689 - DNA, 25 bp, Homo sapien
ggcacggttcggtatccagggccaa

SEQ ID NO: 155690 - DNA, 25 bp, Homo sapien
cgtgcgcaaacagggcggccgcctt

SEQ ID NO: 155691 - DNA, 25 bp, Homo sapien
acgactggaccagggctttgaccaa

SEQ ID NO: 155692 - DNA, 25 bp, Homo sapien
cacgccttgggtcacgactggacca

SEQ ID NO: 155693 - DNA, 25 bp, Homo sapien
tgctacgccgtatcttccgagggcc

SEQ ID NO: 155694 - DNA, 25 bp, Homo sapien
ggagctccctgctacgccgtatctt

SEQ ID NO: 155695 - DNA, 25 bp, Homo sapien
tgtcccagtcccgagggcacggttc

SEQ ID NO: 155696 - DNA, 25 bp, Homo sapien
ttggacaacatttccgcggagaccg

SEQ ID NO: 155697 - DNA, 25 bp, Homo sapien
tcgactggaggatcaataagatgcc

SEQ ID NO: 155698 - DNA, 25 bp, Homo sapien
agactccgaggagtgcttgtcacca

SEQ ID NO: 155699 - DNA, 25 bp, Homo sapien
gggatggagactcacctcgactgga

SEQ ID NO: 155700 - DNA, 25 bp, Homo sapien
atccgcgaactggagtcccgtcttc

SEQ ID NO: 155701 - DNA, 25 bp, Homo sapien
ttttgctgggctccaactttcactc

SEQ ID NO: 155702 - DNA, 25 bp, Homo sapien
ccgatggaaatctccgacgacgtga

SEQ ID NO: 155703 - DNA, 25 bp, Homo sapien
gcagtgcttctgagagcgggaatcc

SEQ ID NO: 155704 - DNA, 25 bp, Homo sapien
aggatgctaacgtcaagctgtccga

SEQ ID NO: 155705 - DNA, 25 bp, Homo sapien
atgctaacgtcaagctgtccgagct

SEQ ID NO: 155706 - DNA, 25 bp, Homo sapien
aagagagccagctagagtctgggat

SEQ ID NO: 155707 - DNA, 25 bp, Homo sapien
ttcatatgaagaccaccagcggttt

SEQ ID NO: 155708 - DNA, 25 bp, Homo sapien
atatgaagaccaccagcggttttgc

SEQ ID NO: 155709 - DNA, 25 bp, Homo sapien
tgaagaccaccagcggttttgcagg

SEQ ID NO: 155710 - DNA, 25 bp, Homo sapien
ccatcgcagatgccgagcagcttgg

SEQ ID NO: 155711 - DNA, 25 bp, Homo sapien
gccgttaaggatgctaacgtcaagc

SEQ ID NO: 155712 - DNA, 25 bp, Homo sapien
tcttcaactggtaagcgggcaccgc

SEQ ID NO: 155713 - DNA, 25 bp, Homo sapien
cgggctctcatctccggtatccggg

SEQ ID NO: 155714 - DNA, 25 bp, Homo sapien
ctcgctgctctctccttagaggcga

SEQ ID NO: 155715 - DNA, 25 bp, Homo sapien
gccgcagtgatcctgctgctcatca

SEQ ID NO: 155716 - DNA, 25 bp, Homo sapien
tgctcatcaggacctggctcgcgga

SEQ ID NO: 155717 - DNA, 25 bp, Homo sapien
cgagttctcctctgctgtgcccgaa

SEQ ID NO: 155718 - DNA, 25 bp, Homo sapien
tgtgcccgaagtcgtcctgaacctc

SEQ ID NO: 155719 - DNA, 25 bp, Homo sapien
ggcagacgacctctggcctcttgga

SEQ ID NO: 155720 - DNA, 25 bp, Homo sapien
ctccatttacagacgggaagcgacc

SEQ ID NO: 155721 - DNA, 25 bp, Homo sapien
tcgggaatgcgaacagtctcctctc

SEQ ID NO: 155722 - DNA, 25 bp, Homo sapien
ctcgggcaccacgagactccattta

SEQ ID NO: 155723 - DNA, 25 bp, Homo sapien
gacctggggctgaccttgataaaac

SEQ ID NO: 155724 - DNA, 25 bp, Homo sapien
agcggcaggtgccattgtcttccca

SEQ ID NO: 155725 - DNA, 25 bp, Homo sapien
ttgtcttcccaacagcggcgtgtgt

SEQ ID NO: 155726 - DNA, 25 bp, Homo sapien
tgtgtgacccaacacgagttcggga

SEQ ID NO: 155727 - DNA, 25 bp, Homo sapien
gttgcacgatctccgggcatcgcca

SEQ ID NO: 155728 - DNA, 25 bp, Homo sapien
tgccaggatgtgacgccactgactt

SEQ ID NO: 155729 - DNA, 25 bp, Homo sapien
tgacgccactgacttgcgcattgga

SEQ ID NO: 155730 - DNA, 25 bp, Homo sapien
cttgcgcattggaggtcagaagacc

SEQ ID NO: 155731 - DNA, 25 bp, Homo sapien
tcagaagaccgcgagattctcgccc

SEQ ID NO: 155732 - DNA, 25 bp, Homo sapien
ttctcgccctgagcaacgagcgacg

SEQ ID NO: 155733 - DNA, 25 bp, Homo sapien
acagagggcctcaaataatccagtg

SEQ ID NO: 155734 - DNA, 25 bp, Homo sapien
taatccagtgctgcctctgctgccg

SEQ ID NO: 155735 - DNA, 25 bp, Homo sapien
cccgcaggggaagacttccaggctg

SEQ ID NO: 155736 - DNA, 25 bp, Homo sapien
ccactctgggctcggatacccgcgc

SEQ ID NO: 155737 - DNA, 25 bp, Homo sapien
cccactctgggctcggatacccgcg

SEQ ID NO: 155738 - DNA, 25 bp, Homo sapien
acccactctgggctcggatacccgc

SEQ ID NO: 155739 - DNA, 25 bp, Homo sapien
gatacccactctgggctcggatacc

SEQ ID NO: 155740 - DNA, 25 bp, Homo sapien
ggatacccactctgggctcggatac

SEQ ID NO: 155741 - DNA, 25 bp, Homo sapien
cggatacccactctgggctcggata

SEQ ID NO: 155742 - DNA, 25 bp, Homo sapien
ctgggctcggatacccgcgctgggc

SEQ ID NO: 155743 - DNA, 25 bp, Homo sapien
gcactggattatttgaggccctctg

SEQ ID NO: 155744 - DNA, 25 bp, Homo sapien
agcagaggcagcactggattatttg

SEQ ID NO: 155745 - DNA, 25 bp, Homo sapien
gggcgagaatctcgcggtcttctga

SEQ ID NO: 155746 - DNA, 25 bp, Homo sapien
ctccaatgcgcaagtcagtggcgtc

SEQ ID NO: 155747 - DNA, 25 bp, Homo sapien
aggccctctgtctgaggtgaggccc

SEQ ID NO: 155748 - DNA, 25 bp, Homo sapien
tcagtggcgtcacatcctggcaacg

SEQ ID NO: 155749 - DNA, 25 bp, Homo sapien
gtcgctcgttgctcagggcgagaat

SEQ ID NO: 155750 - DNA, 25 bp, Homo sapien
ggtcttctgacctccaatgcgcaag

SEQ ID NO: 155751 - DNA, 25 bp, Homo sapien
aagctcggctgattctcggctcacg

SEQ ID NO: 155752 - DNA, 25 bp, Homo sapien
cgacagagcggcagcactcaccata

SEQ ID NO: 155753 - DNA, 25 bp, Homo sapien
ggcaaccgacgtgtacactgactcg

SEQ ID NO: 155754 - DNA, 25 bp, Homo sapien
ctccctattggtgcagggccgaaga

SEQ ID NO: 155755 - DNA, 25 bp, Homo sapien
cccgtctttattgggcaagatcacg

SEQ ID NO: 155756 - DNA, 25 bp, Homo sapien
cgccaattggctgagtcgtcgccga

SEQ ID NO: 155757 - DNA, 25 bp, Homo sapien
ccaatcctcttggtggaggaagctc

SEQ ID NO: 155758 - DNA, 25 bp, Homo sapien
ccttgccattggaggtcaccctgtg

SEQ ID NO: 155759 - DNA, 25 bp, Homo sapien
gtagttctcgactgaattaacccga

SEQ ID NO: 155760 - DNA, 25 bp, Homo sapien
cagcatctgtggaagtcgttggccc

SEQ ID NO: 155761 - DNA, 25 bp, Homo sapien
ccggggccagatcgcgcaactagga

SEQ ID NO: 155762 - DNA, 25 bp, Homo sapien
gaggaatttgcctggaagttttcca

SEQ ID NO: 155763 - DNA, 25 bp, Homo sapien
agttttccatcacggcagagccttc

SEQ ID NO: 155764 - DNA, 25 bp, Homo sapien
tagggctgtcgagtcgccattggat

SEQ ID NO: 155765 - DNA, 25 bp, Homo sapien
tgaattaacccgacagcatctgtgg

SEQ ID NO: 155766 - DNA, 25 bp, Homo sapien
cggaatgtgccaggcgcctctacct

SEQ ID NO: 155767 - DNA, 25 bp, Homo sapien
cgcgtaaggtctgaagccgcggcca

SEQ ID NO: 155768 - DNA, 25 bp, Homo sapien
ggattctcttgaggccatgcccgtg

SEQ ID NO: 155769 - DNA, 25 bp, Homo sapien
tccacaaagtgaaatggccgcccgg

SEQ ID NO: 155770 - DNA, 25 bp, Homo sapien
cgccgggaaaatgcgaccgtccaca

SEQ ID NO: 155771 - DNA, 25 bp, Homo sapien
gcgtaggccgccatttcttgaagcc

SEQ ID NO: 155772 - DNA, 25 bp, Homo sapien
cagaggtcgcccgaggatcacgaat

SEQ ID NO: 155773 - DNA, 25 bp, Homo sapien
gcccgtagtgagtacgcctgcgtag

SEQ ID NO: 155774 - DNA, 25 bp, Homo sapien
aactcggtcgcagtgcccgccggga

SEQ ID NO: 155775 - DNA, 25 bp, Homo sapien
agatcgaccgtggagaggctttttc

SEQ ID NO: 155776 - DNA, 25 bp, Homo sapien
aatggttgttttgggcgagatcgac

SEQ ID NO: 155777 - DNA, 25 bp, Homo sapien
tgagacgatcaacaaagaaaatggt

SEQ ID NO: 155778 - DNA, 25 bp, Homo sapien
ctgcctgcggtgctcgccgggaaat

SEQ ID NO: 155779 - DNA, 25 bp, Homo sapien
agccgcagactctgcctgcggtgct

SEQ ID NO: 155780 - DNA, 25 bp, Homo sapien
cgctgagatcgtgcgtgcacaggcc

SEQ ID NO: 155781 - DNA, 25 bp, Homo sapien
tcacaacgataagtgggcgggtgca

SEQ ID NO: 155782 - DNA, 25 bp, Homo sapien
gagaggctttttctgcagcagtccc

SEQ ID NO: 155783 - DNA, 25 bp, Homo sapien
cgcactggtgacataaaccctccta

SEQ ID NO: 155784 - DNA, 25 bp, Homo sapien
gaggtgcctccaagccggagttccc

SEQ ID NO: 155785 - DNA, 25 bp, Homo sapien
gaccaccacacgtctatggcggctg

SEQ ID NO: 155786 - DNA, 25 bp, Homo sapien
tccgtgctgactgcgccacgaggct

SEQ ID NO: 155787 - DNA, 25 bp, Homo sapien
aagaggttgtctggtgacgaccgcc

SEQ ID NO: 155788 - DNA, 25 bp, Homo sapien
catgagcggaactgcacacggcccg

SEQ ID NO: 155789 - DNA, 25 bp, Homo sapien
cccgctcacggttgcgcactggtga

SEQ ID NO: 155790 - DNA, 25 bp, Homo sapien
ctacttcctgcaaggtggttcctca

SEQ ID NO: 155791 - DNA, 25 bp, Homo sapien
ccgctggcacctccgtggcacgtgc

SEQ ID NO: 155792 - DNA, 25 bp, Homo sapien
caaaggcacggggactggccgccac

SEQ ID NO: 155793 - DNA, 25 bp, Homo sapien
ggactggccgccacagacctttggc

SEQ ID NO: 155794 - DNA, 25 bp, Homo sapien
agacctttggccaccgcagtgggga

SEQ ID NO: 155795 - DNA, 25 bp, Homo sapien
agggagagccacagtctgagcgaac

SEQ ID NO: 155796 - DNA, 25 bp, Homo sapien
acccgtccgcgccaatggccctgcg

SEQ ID NO: 155797 - DNA, 25 bp, Homo sapien
acagtctgagcgaacgtccgcgctg

SEQ ID NO: 155798 - DNA, 25 bp, Homo sapien
agagcccgacctcgtgacccgtccg

SEQ ID NO: 155799 - DNA, 25 bp, Homo sapien
gtcaacgctcgcaggggcctgctca

SEQ ID NO: 155800 - DNA, 25 bp, Homo sapien
tttacagtgctaggcaaagcgtttc

SEQ ID NO: 155801 - DNA, 25 bp, Homo sapien
cctgaggcctatgggacactttaca

SEQ ID NO: 155802 - DNA, 25 bp, Homo sapien
catcccggaggactgtgatgatgcc

SEQ ID NO: 155803 - DNA, 25 bp, Homo sapien
atggcggtgaccatgctgcaggact

SEQ ID NO: 155804 - DNA, 25 bp, Homo sapien
ttcgagaggaggataatgccaccgc

SEQ ID NO: 155805 - DNA, 25 bp, Homo sapien
tcgaccgggaagtcaactatgcttt

SEQ ID NO: 155806 - DNA, 25 bp, Homo sapien
tgatgccgaattccaagagtccctc

SEQ ID NO: 155807 - DNA, 25 bp, Homo sapien
gggactcttggaattcggcatcatc

SEQ ID NO: 155808 - DNA, 25 bp, Homo sapien
ttccctggggaccaaagcatagttg

SEQ ID NO: 155809 - DNA, 25 bp, Homo sapien
gccatgcccgcgattctggccagtg

SEQ ID NO: 155810 - DNA, 25 bp, Homo sapien
tcggcatcatcacagtcctccggga

SEQ ID NO: 155811 - DNA, 25 bp, Homo sapien
cactgtaaagtgtcccataggcctc

SEQ ID NO: 155812 - DNA, 25 bp, Homo sapien
tcgaaacgctttgcctagcactgta

SEQ ID NO: 155813 - DNA, 25 bp, Homo sapien
agcatagttgacttcccggtcgagc

SEQ ID NO: 155814 - DNA, 25 bp, Homo sapien
ggtggcattatcctcctctcgaaac

SEQ ID NO: 155815 - DNA, 25 bp, Homo sapien
tctccgagaacgaagcggcctccgg

SEQ ID NO: 155816 - DNA, 25 bp, Homo sapien
gcctccgggttcgtgtgctccgagc

SEQ ID NO: 155817 - DNA, 25 bp, Homo sapien
gcaggagtgaggaagcgcctctcac

SEQ ID NO: 155818 - DNA, 25 bp, Homo sapien
tgctccgagcccgagtactgtttgc

SEQ ID NO: 155819 - DNA, 25 bp, Homo sapien
aaggggccctgacgcgcagttgaaa

SEQ ID NO: 155820 - DNA, 25 bp, Homo sapien
cgagtactgtttgcggccgtcgtcc

SEQ ID NO: 155821 - DNA, 25 bp, Homo sapien
gccgtcgtcccgtcctggagcagga

SEQ ID NO: 155822 - DNA, 25 bp, Homo sapien
gcgctgtgcgtctccgagaacgaag

SEQ ID NO: 155823 - DNA, 25 bp, Homo sapien
gctggaatagctgtaggaacgtcaa

SEQ ID NO: 155824 - DNA, 25 bp, Homo sapien
caaggatatttacagagcggacagc

SEQ ID NO: 155825 - DNA, 25 bp, Homo sapien
gcggcagacacacatcgcaaggata

SEQ ID NO: 155826 - DNA, 25 bp, Homo sapien
taaacgtttctttcctggcggcaga

SEQ ID NO: 155827 - DNA, 25 bp, Homo sapien
tcgggacgacacttcggtttctatg

SEQ ID NO: 155828 - DNA, 25 bp, Homo sapien
gtcgtcatccagcagaacctcggga

SEQ ID NO: 155829 - DNA, 25 bp, Homo sapien
gctctccgtagcaagtcgtcatcca

SEQ ID NO: 155830 - DNA, 25 bp, Homo sapien
tgagtgagctccagatcgacgctga

SEQ ID NO: 155831 - DNA, 25 bp, Homo sapien
ccaccctgcgtggtgaaaagtcacg

SEQ ID NO: 155832 - DNA, 25 bp, Homo sapien
agcgccattgcttctactccaggga

SEQ ID NO: 155833 - DNA, 25 bp, Homo sapien
gccctgcgaggttacaagtcatggg

SEQ ID NO: 155834 - DNA, 25 bp, Homo sapien
caccctgcgtggtgaaaagtcacgg

SEQ ID NO: 155835 - DNA, 25 bp, Homo sapien
attgcagatgccctgcgccgtgaca

SEQ ID NO: 155836 - DNA, 25 bp, Homo sapien
tcacgggtgggcataggcattgccc

SEQ ID NO: 155837 - DNA, 25 bp, Homo sapien
gcagggccattgtccctactacatg

SEQ ID NO: 155838 - DNA, 25 bp, Homo sapien
acggttcacgagcacgcagggccat

SEQ ID NO: 155839 - DNA, 25 bp, Homo sapien
atagtcacgggtgggcataggcatt

SEQ ID NO: 155840 - DNA, 25 bp, Homo sapien
ccctgcggggaaacacgtcatctgc

SEQ ID NO: 155841 - DNA, 25 bp, Homo sapien
acgtcatctgcgtgcaaggccattg

SEQ ID NO: 155842 - DNA, 25 bp, Homo sapien
gggccattgcacctaacccaggtgc

SEQ ID NO: 155843 - DNA, 25 bp, Homo sapien
cctggcgcggttacaggtcaacgac

SEQ ID NO: 155844 - DNA, 25 bp, Homo sapien
aggtcaacgacaggcaccgccattg

SEQ ID NO: 155845 - DNA, 25 bp, Homo sapien
gtcagcggcacgcacggacattgcc

SEQ ID NO: 155846 - DNA, 25 bp, Homo sapien
agcagttacaggtcacggtcccgca

SEQ ID NO: 155847 - DNA, 25 bp, Homo sapien
ccaggaggccgctcacgatatccag

SEQ ID NO: 155848 - DNA, 25 bp, Homo sapien
agaagtctggatcttcctccaggag

SEQ ID NO: 155849 - DNA, 25 bp, Homo sapien
tccaggcgcaccacgaaggcaaaca

SEQ ID NO: 155850 - DNA, 25 bp, Homo sapien
ggtcaggaacttcatccgcgaggtc

SEQ ID NO: 155851 - DNA, 25 bp, Homo sapien
tccgcgaggtcatccatgtatcccg

SEQ ID NO: 155852 - DNA, 25 bp, Homo sapien
atgtatcccggctcctaaacacctg

SEQ ID NO: 155853 - DNA, 25 bp, Homo sapien
gggccaggccatccaagctgtccag

SEQ ID NO: 155854 - DNA, 25 bp, Homo sapien
tcaggcagtcctgcgcagagaagtc

SEQ ID NO: 155855 - DNA, 25 bp, Homo sapien
gaagatctcgcctcagtcacgcggc

SEQ ID NO: 155856 - DNA, 25 bp, Homo sapien
cactgcggaggcagcgatctggcac

SEQ ID NO: 155857 - DNA, 25 bp, Homo sapien
gacgctgcgaccacccgcggaaaaa

SEQ ID NO: 155858 - DNA, 25 bp, Homo sapien
ctctggaggccacctagaggccctg

SEQ ID NO: 155859 - DNA, 25 bp, Homo sapien
caggagggtggaagatctcgcctca

SEQ ID NO: 155860 - DNA, 25 bp, Homo sapien
ggaggcagcgatctggcacctgccc

SEQ ID NO: 155861 - DNA, 25 bp, Homo sapien
tgctcactttctccgactctgcgga

SEQ ID NO: 155862 - DNA, 25 bp, Homo sapien
aggccacctagaggccctggagcag

SEQ ID NO: 155863 - DNA, 25 bp, Homo sapien
ggctgatcagacttgcctgcccagt

SEQ ID NO: 155864 - DNA, 25 bp, Homo sapien
gcggggcctcgctccctcagaaccc

SEQ ID NO: 155865 - DNA, 25 bp, Homo sapien
gcgctcacggctccggaaacgcgcc

SEQ ID NO: 155866 - DNA, 25 bp, Homo sapien
caggaggacgtgtggacctgagtga

SEQ ID NO: 155867 - DNA, 25 bp, Homo sapien
atgacgagtacgaagaggcccgaag

SEQ ID NO: 155868 - DNA, 25 bp, Homo sapien
tgcgggccgcagaagagtgcacggt

SEQ ID NO: 155869 - DNA, 25 bp, Homo sapien
ggcagttggagagctgctcggcctt

SEQ ID NO: 155870 - DNA, 25 bp, Homo sapien
tcccggatgacgagtacgaagaggc

SEQ ID NO: 155871 - DNA, 25 bp, Homo sapien
cgctcggcactgcagaagcatcagc

SEQ ID NO: 155872 - DNA, 25 bp, Homo sapien
gcgggcggtcgttcaaagtcaacac

SEQ ID NO: 155873 - DNA, 25 bp, Homo sapien
ttcctggatcgccaggagcttctca

SEQ ID NO: 155874 - DNA, 25 bp, Homo sapien
gagctcggagctcaccaagcaccgg

SEQ ID NO: 155875 - DNA, 25 bp, Homo sapien
ccctatgagtgcgacaaatgcggca

SEQ ID NO: 155876 - DNA, 25 bp, Homo sapien
cacgagtagaaacgccctgtggtcc

SEQ ID NO: 155877 - DNA, 25 bp, Homo sapien
gcatccacagcggactgaaacccta

SEQ ID NO: 155878 - DNA, 25 bp, Homo sapien
tcggaaaagcctttcgcctgcaagg

SEQ ID NO: 155879 - DNA, 25 bp, Homo sapien
agccggctcctcacggcctgccaca

SEQ ID NO: 155880 - DNA, 25 bp, Homo sapien
acagccacgccgcacctaaaccggg

SEQ ID NO: 155881 - DNA, 25 bp, Homo sapien
ggcgggaagcccaccgtgacagcca

SEQ ID NO: 155882 - DNA, 25 bp, Homo sapien
cttccttggcgggaagcccaccgtg

SEQ ID NO: 155883 - DNA, 25 bp, Homo sapien
gggcgagtcaccctccctcttgcct

SEQ ID NO: 155884 - DNA, 25 bp, Homo sapien
tggagcccgccagcctgctctccca

SEQ ID NO: 155885 - DNA, 25 bp, Homo sapien
ctcctgggccgccatcctgagctcc

SEQ ID NO: 155886 - DNA, 25 bp, Homo sapien
ctctcgcgcctcagacccaggctgg

SEQ ID NO: 155887 - DNA, 25 bp, Homo sapien
cgccatccctctgcgccgcgcatgc

SEQ ID NO: 155888 - DNA, 25 bp, Homo sapien
cccagacagaaagcggaagtgcctc

SEQ ID NO: 155889 - DNA, 25 bp, Homo sapien
tcgtcggcgcaccagactgagactc

SEQ ID NO: 155890 - DNA, 25 bp, Homo sapien
ttcaggacgctcttcgcgagcggta

SEQ ID NO: 155891 - DNA, 25 bp, Homo sapien
ttcgcgagcggtacccagaggcgaa

SEQ ID NO: 155892 - DNA, 25 bp, Homo sapien
cccagaggcgaagtcgagacaagcc

SEQ ID NO: 155893 - DNA, 25 bp, Homo sapien
aagggaggccgactccctcggctgc

SEQ ID NO: 155894 - DNA, 25 bp, Homo sapien
cgcggtgcgctgaccacttcgaccc

SEQ ID NO: 155895 - DNA, 25 bp, Homo sapien
ccgagtgcggcaagctgtttcgccg

SEQ ID NO: 155896 - DNA, 25 bp, Homo sapien
cggagaagcggtacctgtgccagca

SEQ ID NO: 155897 - DNA, 25 bp, Homo sapien
tcaagcaccgcatcatccacagtgg

SEQ ID NO: 155898 - DNA, 25 bp, Homo sapien
ccacagtggcgagaagccttacgcg

SEQ ID NO: 155899 - DNA, 25 bp, Homo sapien
ggcgactgcggcaaactgttccgcc

SEQ ID NO: 155900 - DNA, 25 bp, Homo sapien
ccttcaagggcgtctcgcagctcat

SEQ ID NO: 155901 - DNA, 25 bp, Homo sapien
caacctattcaagcaccaggcagtg

SEQ ID NO: 155902 - DNA, 25 bp, Homo sapien
ccgagtgcagcaagaccttcacgcg

SEQ ID NO: 155903 - DNA, 25 bp, Homo sapien
aatcaaagccattgtgggccacaag

SEQ ID NO: 155904 - DNA, 25 bp, Homo sapien
tacatgggctcgatgtgggcccacc

SEQ ID NO: 155905 - DNA, 25 bp, Homo sapien
caaagagggacagctcggcaatctc

SEQ ID NO: 155906 - DNA, 25 bp, Homo sapien
atctcgctggccttggcagtgaagg

SEQ ID NO: 155907 - DNA, 25 bp, Homo sapien
ccgggcacatgcacagcgtgagctt

SEQ ID NO: 155908 - DNA, 25 bp, Homo sapien
agcttgtccaggacccggggcaata

SEQ ID NO: 155909 - DNA, 25 bp, Homo sapien
ggggcaatactagggcaccagactc

SEQ ID NO: 155910 - DNA, 25 bp, Homo sapien
caccagactcgtcgtgctccgggtt

SEQ ID NO: 155911 - DNA, 25 bp, Homo sapien
tccagcgaccacatgactaagcaaa

SEQ ID NO: 155912 - DNA, 25 bp, Homo sapien
ggaaggcactttcgttctcggcacc

SEQ ID NO: 155913 - DNA, 25 bp, Homo sapien
ctgttctcgggcaggtggacgctgt

SEQ ID NO: 155914 - DNA, 25 bp, Homo sapien
acaatgcgcattcctgtcttttctc

SEQ ID NO: 155915 - DNA, 25 bp, Homo sapien
gcccacaatgcgcattcctgtcttt

SEQ ID NO: 155916 - DNA, 25 bp, Homo sapien
ccacatgactaagcaaaggcagcgg

SEQ ID NO: 155917 - DNA, 25 bp, Homo sapien
gcgaccacatgactaagcaaaggca

SEQ ID NO: 155918 - DNA, 25 bp, Homo sapien
gaaggcactttcgttctcggcaccg

SEQ ID NO: 155919 - DNA, 25 bp, Homo sapien
tctgagtagtcgtcgccgccacggc

SEQ ID NO: 155920 - DNA, 25 bp, Homo sapien
tggcgccgcggacttccgcagcaag

SEQ ID NO: 155921 - DNA, 25 bp, Homo sapien
actggccggcaagaccgccaatcaa

SEQ ID NO: 155922 - DNA, 25 bp, Homo sapien
cccgccatgtttcgcgctccgagcc

SEQ ID NO: 155923 - DNA, 25 bp, Homo sapien
ctcgtcctctgagtagtcgtcgccg

SEQ ID NO: 155924 - DNA, 25 bp, Homo sapien
tttctgggccaacagcaccttcagc

SEQ ID NO: 155925 - DNA, 25 bp, Homo sapien
tcccattgggcgacatctccgcctg

SEQ ID NO: 155926 - DNA, 25 bp, Homo sapien
atgccctggcttcactggccggcaa

SEQ ID NO: 155927 - DNA, 25 bp, Homo sapien
cgggaatgaactcgaatttcacacg

SEQ ID NO: 155928 - DNA, 25 bp, Homo sapien
ctatgggcgggaatgaactcgaatt

SEQ ID NO: 155929 - DNA, 25 bp, Homo sapien
tccagcgaagccacgctatgggcgg

SEQ ID NO: 155930 - DNA, 25 bp, Homo sapien
ttcacacggagtccagcgaagccac

SEQ ID NO: 155931 - DNA, 25 bp, Homo sapien
gcggggccgctttcacacggagtcc

SEQ ID NO: 155932 - DNA, 25 bp, Homo sapien
gaacacgaacgtgcccgctcggagg

SEQ ID NO: 155933 - DNA, 25 bp, Homo sapien
cgctcgggtctagacggcttggcaa

SEQ ID NO: 155934 - DNA, 25 bp, Homo sapien
cgccaggacgggaacacgaacgtgc

SEQ ID NO: 155935 - DNA, 25 bp, Homo sapien
caggcctttccatccttggagcgga

SEQ ID NO: 155936 - DNA, 25 bp, Homo sapien
gagcggatcgttgcccgcctgacgc

SEQ ID NO: 155937 - DNA, 25 bp, Homo sapien
cggtcatgggcagtgcccacgagaa

SEQ ID NO: 155938 - DNA, 25 bp, Homo sapien
gcatccgtgtctgaggaacaaggcc

SEQ ID NO: 155939 - DNA, 25 bp, Homo sapien
acgcgcatccgtgtctgaggaacaa

SEQ ID NO: 155940 - DNA, 25 bp, Homo sapien
gcctgcgtgtccttgcggcactgcg

SEQ ID NO: 155941 - DNA, 25 bp, Homo sapien
cccatgcccgggtaagtggtgctct

SEQ ID NO: 155942 - DNA, 25 bp, Homo sapien
tccatccttggagcggatcgttgcc

SEQ ID NO: 155943 - DNA, 25 bp, Homo sapien
gcggccaccggaaaaggtgctaatg

SEQ ID NO: 155944 - DNA, 25 bp, Homo sapien
accggtccacgccatggggatacct

SEQ ID NO: 155945 - DNA, 25 bp, Homo sapien
cctctgctacggtgagcactccaga

SEQ ID NO: 155946 - DNA, 25 bp, Homo sapien
ggccgcggttacctgcctccatgat

SEQ ID NO: 155947 - DNA, 25 bp, Homo sapien
cactcggaagtgcaccctggcttcg

SEQ ID NO: 155948 - DNA, 25 bp, Homo sapien
ccagcgtggcttaggccaggtacaa

SEQ ID NO: 155949 - DNA, 25 bp, Homo sapien
taggccaggtacaaccggcagcgcc

SEQ ID NO: 155950 - DNA, 25 bp, Homo sapien
tctgaggtctgagaagacagcggcc

SEQ ID NO: 155951 - DNA, 25 bp, Homo sapien
ggtcccagaaataggctgccctttc

SEQ ID NO: 155952 - DNA, 25 bp, Homo sapien
atggtttccgctcagccaccaggca

SEQ ID NO: 155953 - DNA, 25 bp, Homo sapien
ctgccctttccagagggtgacggga

SEQ ID NO: 155954 - DNA, 25 bp, Homo sapien
gggcagagccgtctacaccaaaagc

SEQ ID NO: 155955 - DNA, 25 bp, Homo sapien
actagtgaagaactgggctcgggtc

SEQ ID NO: 155956 - DNA, 25 bp, Homo sapien
cgtgtctccagcatcgaaattcaca

SEQ ID NO: 155957 - DNA, 25 bp, Homo sapien
cttgacgctgagtccggcgaactaa

SEQ ID NO: 155958 - DNA, 25 bp, Homo sapien
tccctgcttcccgttgccatggttt

SEQ ID NO: 155959 - DNA, 25 bp, Homo sapien
actcattggcgccactggggaccgg

SEQ ID NO: 155960 - DNA, 25 bp, Homo sapien
cacactcgcgcgcatacaaaccacg

SEQ ID NO: 155961 - DNA, 25 bp, Homo sapien
gcacctcccgtgtctcctgccactt

SEQ ID NO: 155962 - DNA, 25 bp, Homo sapien
gacacccattcggtgctgctccgca

SEQ ID NO: 155963 - DNA, 25 bp, Homo sapien
gatttggagtttccctccgcagcgg

SEQ ID NO: 155964 - DNA, 25 bp, Homo sapien
gcgggatttggagtttccctccgca

SEQ ID NO: 155965 - DNA, 25 bp, Homo sapien
tcgggcaggactggcctagagaaca

SEQ ID NO: 155966 - DNA, 25 bp, Homo sapien
cctagagaacagaggcttgcaggtg

SEQ ID NO: 155967 - DNA, 25 bp, Homo sapien
agctgcccggcaagcacgtagtagg

SEQ ID NO: 155968 - DNA, 25 bp, Homo sapien
cccggcgctgaaatggaggcggccc

SEQ ID NO: 155969 - DNA, 25 bp, Homo sapien
gggaccaaaggggcgccagctgccc

SEQ ID NO: 155970 - DNA, 25 bp, Homo sapien
aagcacgtagtaggtgggttccatg

SEQ ID NO: 155971 - DNA, 25 bp, Homo sapien
cacgtagtaggtgggttccatgggg

SEQ ID NO: 155972 - DNA, 25 bp, Homo sapien
tccgcgcgcgctgtctgggtgcctg

SEQ ID NO: 155973 - DNA, 25 bp, Homo sapien
tgtctgggtgcctgcctgcgtgtgt

SEQ ID NO: 155974 - DNA, 25 bp, Homo sapien
gcgctgaaatggaggcggcccaggt

SEQ ID NO: 155975 - DNA, 25 bp, Homo sapien
aggttcccatttgtcctgttgctgg

SEQ ID NO: 155976 - DNA, 25 bp, Homo sapien
cggaggtggcaacaggttcccattt

SEQ ID NO: 155977 - DNA, 25 bp, Homo sapien
atttgtcctgttgctggcgctgcgg

SEQ ID NO: 155978 - DNA, 25 bp, Homo sapien
ccatttgtcctgttgctggcgctgc

SEQ ID NO: 155979 - DNA, 25 bp, Homo sapien
aggtggcaacaggttcccatttgtc

SEQ ID NO: 155980 - DNA, 25 bp, Homo sapien
gggttggctgcgctcagccctgcag

SEQ ID NO: 155981 - DNA, 25 bp, Homo sapien
agcgcgcggcctggctcagcccgcc

SEQ ID NO: 155982 - DNA, 25 bp, Homo sapien
tggcaacaggttcccatttgtcctg

SEQ ID NO: 155983 - DNA, 25 bp, Homo sapien
actcgctagcacctgagtggaccgg

SEQ ID NO: 155984 - DNA, 25 bp, Homo sapien
acagagactcgtgcaccgtcagggc

SEQ ID NO: 155985 - DNA, 25 bp, Homo sapien
ggaggcgagtccacagcagtcactc

SEQ ID NO: 155986 - DNA, 25 bp, Homo sapien
gcggcgtccacgaggacagagactc

SEQ ID NO: 155987 - DNA, 25 bp, Homo sapien
gaagaaggcccagatcacacaagtg

SEQ ID NO: 155988 - DNA, 25 bp, Homo sapien
tgccaggcagaacgcgccacctgtg

SEQ ID NO: 155989 - DNA, 25 bp, Homo sapien
cacctgtggacagcgtcactcgcta

SEQ ID NO: 155990 - DNA, 25 bp, Homo sapien
cccttctttggaagccctgctctga

SEQ ID NO: 155991 - DNA, 25 bp, Homo sapien
gagcgttcgcgagaagaccgagaca

SEQ ID NO: 155992 - DNA, 25 bp, Homo sapien
agttgtaactccacgtccgaaggca

SEQ ID NO: 155993 - DNA, 25 bp, Homo sapien
tccgaaggcagtttccaaggtggaa

SEQ ID NO: 155994 - DNA, 25 bp, Homo sapien
agtggccgtggccagaacgtccacg

SEQ ID NO: 155995 - DNA, 25 bp, Homo sapien
ctcgctccaggtctctttccttttg

SEQ ID NO: 155996 - DNA, 25 bp, Homo sapien
ggggccagaccacctctgagaggac

SEQ ID NO: 155997 - DNA, 25 bp, Homo sapien
agccagagtcggaagctcgaacttg

SEQ ID NO: 155998 - DNA, 25 bp, Homo sapien
agatctaggcctcgaacggcactcc

SEQ ID NO: 155999 - DNA, 25 bp, Homo sapien
agaggcccgataccttcttctaagg

SEQ ID NO: 156000 - DNA, 25 bp, Homo sapien
cccgggcacacgactagagtaccag

SEQ ID NO: 156001 - DNA, 25 bp, Homo sapien
cgggcacacgactagagtaccaggt

SEQ ID NO: 156002 - DNA, 25 bp, Homo sapien
acacgactagagtaccaggtggtgg

SEQ ID NO: 156003 - DNA, 25 bp, Homo sapien
caagaggcccgataccttcttctaa

SEQ ID NO: 156004 - DNA, 25 bp, Homo sapien
ggcccgataccttcttctaagggca

SEQ ID NO: 156005 - DNA, 25 bp, Homo sapien
gataccttcttctaagggcagggcc

SEQ ID NO: 156006 - DNA, 25 bp, Homo sapien
ctagagtaccaggtggtgggtcgct

SEQ ID NO: 156007 - DNA, 25 bp, Homo sapien
acaaagttgccacttaacgggcctg

SEQ ID NO: 156008 - DNA, 25 bp, Homo sapien
agttgccacttaacgggcctgccct

SEQ ID NO: 156009 - DNA, 25 bp, Homo sapien
ccctctggagacgtcctccggagaa

SEQ ID NO: 156010 - DNA, 25 bp, Homo sapien
cgcctaccgcgtagacccgcagggc

SEQ ID NO: 156011 - DNA, 25 bp, Homo sapien
tgcgccaggatcaccgcggcgccta

SEQ ID NO: 156012 - DNA, 25 bp, Homo sapien
ccgcgccgcagacaatggcgacatg

SEQ ID NO: 156013 - DNA, 25 bp, Homo sapien
tcctccggagaagggcccatcctca

SEQ ID NO: 156014 - DNA, 25 bp, Homo sapien
gcagacaatggcgacatggctgccc

SEQ ID NO: 156015 - DNA, 25 bp, Homo sapien
cgctttccagaaggctccatgctca

SEQ ID NO: 156016 - DNA, 25 bp, Homo sapien
acatccggccgctttccagaaggct

SEQ ID NO: 156017 - DNA, 25 bp, Homo sapien
ttgtaaggcaatcgccgggatccgg

SEQ ID NO: 156018 - DNA, 25 bp, Homo sapien
agggcctttgcaccaccggtggctg

SEQ ID NO: 156019 - DNA, 25 bp, Homo sapien
agggcaccttgtaaggcaatcgccg

SEQ ID NO: 156020 - DNA, 25 bp, Homo sapien
accaccggtggctgtctcccggaga

SEQ ID NO: 156021 - DNA, 25 bp, Homo sapien
cccgaaggcgaccagcgcctggatg

SEQ ID NO: 156022 - DNA, 25 bp, Homo sapien
tgtctcccggagagctcttcggcca

SEQ ID NO: 156023 - DNA, 25 bp, Homo sapien
cccagggtcagagcaacaatccttc

SEQ ID NO: 156024 - DNA, 25 bp, Homo sapien
ttgcctagacaacaggcccagggtc

SEQ ID NO: 156025 - DNA, 25 bp, Homo sapien
aggggccatcgcaaggtttccagtt

SEQ ID NO: 156026 - DNA, 25 bp, Homo sapien
taaagcgacagtctcaggggccatc

SEQ ID NO: 156027 - DNA, 25 bp, Homo sapien
aagttcctccacttgggctgcccga

SEQ ID NO: 156028 - DNA, 25 bp, Homo sapien
ctgacaggacaggagagccaagttc

SEQ ID NO: 156029 - DNA, 25 bp, Homo sapien
aggagtcactgtcgcttcagccagg

SEQ ID NO: 156030 - DNA, 25 bp, Homo sapien
agcccaggtgacatgccggtgctct

SEQ ID NO: 156031 - DNA, 25 bp, Homo sapien
gctcactgacaatgccaaccagctg

SEQ ID NO: 156032 - DNA, 25 bp, Homo sapien
gccctgtaatcgacagccctgactg

SEQ ID NO: 156033 - DNA, 25 bp, Homo sapien
tgggcgacttctccgactacaacaa

SEQ ID NO: 156034 - DNA, 25 bp, Homo sapien
caacaacagctacgtcggggccttt

SEQ ID NO: 156035 - DNA, 25 bp, Homo sapien
ccaggctgagtaccgctcctacgtg

SEQ ID NO: 156036 - DNA, 25 bp, Homo sapien
ggacaccaacctgtactcctacgtg

SEQ ID NO: 156037 - DNA, 25 bp, Homo sapien
aagccaccgtggagtacggcgtcac

SEQ ID NO: 156038 - DNA, 25 bp, Homo sapien
ggcacactctatgtcggcgcagtga

SEQ ID NO: 156039 - DNA, 25 bp, Homo sapien
ctgtgcaccacgcaggagggaaggt

SEQ ID NO: 156040 - DNA, 25 bp, Homo sapien
actgatccgtgtcaggggcaccggc

SEQ ID NO: 156041 - DNA, 25 bp, Homo sapien
cgactgccatcctggtacaggggtg

SEQ ID NO: 156042 - DNA, 25 bp, Homo sapien
gcaccggcctagacgtggtgcagcg

SEQ ID NO: 156043 - DNA, 25 bp, Homo sapien
ccagcttgtagcggcggagcccagt

SEQ ID NO: 156044 - DNA, 25 bp, Homo sapien
acccgactgccatcctggtacaggg

SEQ ID NO: 156045 - DNA, 25 bp, Homo sapien
atgcgggctgggctatgttgcccac

SEQ ID NO: 156046 - DNA, 25 bp, Homo sapien
gggctgggctatgttgcccaccgcc

SEQ ID NO: 156047 - DNA, 25 bp, Homo sapien
ccctggcgtctctcatgcccactgc

SEQ ID NO: 156048 - DNA, 25 bp, Homo sapien
tggccacaccggtgcctcagatgct

SEQ ID NO: 156049 - DNA, 25 bp, Homo sapien
cagcggccggccaaggctataaatt

SEQ ID NO: 156050 - DNA, 25 bp, Homo sapien
aggctataaattcgcaggccgcggc

SEQ ID NO: 156051 - DNA, 25 bp, Homo sapien
gtgcctcagatgctgcagggccttc

SEQ ID NO: 156052 - DNA, 25 bp, Homo sapien
agctgggaggctatttataaaggcg

SEQ ID NO: 156053 - DNA, 25 bp, Homo sapien
gggctccgaactagccctggccaca

SEQ ID NO: 156054 - DNA, 25 bp, Homo sapien
gctatttataaaggcgggtgagatc

SEQ ID NO: 156055 - DNA, 25 bp, Homo sapien
ttacgcgtcgctcttcctcgtttgc

SEQ ID NO: 156056 - DNA, 25 bp, Homo sapien
caatcggactccagactgcttcggg

SEQ ID NO: 156057 - DNA, 25 bp, Homo sapien
cgccatgacggaaagtgagagcctc

SEQ ID NO: 156058 - DNA, 25 bp, Homo sapien
tgctgccagagacgtcacaatgccg

SEQ ID NO: 156059 - DNA, 25 bp, Homo sapien
cgtgttcatgggagctcgttttctt

SEQ ID NO: 156060 - DNA, 25 bp, Homo sapien
gaccaaagcacctcgcgcacgttta

SEQ ID NO: 156061 - DNA, 25 bp, Homo sapien
cggcagccaggcttttccttgtctg

SEQ ID NO: 156062 - DNA, 25 bp, Homo sapien
cgcagataccgctctcgcgagagtt

SEQ ID NO: 156063 - DNA, 25 bp, Homo sapien
tatgttgcggcacttgaattccagg

SEQ ID NO: 156064 - DNA, 25 bp, Homo sapien
gccgttctccaggtggcacttgatc

SEQ ID NO: 156065 - DNA, 25 bp, Homo sapien
aggccttcatgcagcgctcacgcag

SEQ ID NO: 156066 - DNA, 25 bp, Homo sapien
gtagcgctcatactcctcatccgtg

SEQ ID NO: 156067 - DNA, 25 bp, Homo sapien
tttcagcagccgatctcgcacgggc

SEQ ID NO: 156068 - DNA, 25 bp, Homo sapien
gttcaagttggagttgccggccatg

SEQ ID NO: 156069 - DNA, 25 bp, Homo sapien
cttgtccgacttctcgggcagctcg

SEQ ID NO: 156070 - DNA, 25 bp, Homo sapien
atgtcggacagctcgtgcttcttgg

SEQ ID NO: 156071 - DNA, 25 bp, Homo sapien
ttacttccgggcctcttgctgcaac

SEQ ID NO: 156072 - DNA, 25 bp, Homo sapien
gggcacatgcagacttacttccggg

SEQ ID NO: 156073 - DNA, 25 bp, Homo sapien
cttatcgaactgcaacgactgtgga

SEQ ID NO: 156074 - DNA, 25 bp, Homo sapien
gtgaccgcgaccatctgctccttat

SEQ ID NO: 156075 - DNA, 25 bp, Homo sapien
gcctcattggcctctgtgaccgcga

SEQ ID NO: 156076 - DNA, 25 bp, Homo sapien
cttgctgcaactcttcgatttgttt

SEQ ID NO: 156077 - DNA, 25 bp, Homo sapien
accgtctggcattctggttcgcctc

SEQ ID NO: 156078 - DNA, 25 bp, Homo sapien
gatttgtttcttcagcgcctcattg

SEQ ID NO: 156079 - DNA, 25 bp, Homo sapien
gcatgggacgtggactcaccgacat

SEQ ID NO: 156080 - DNA, 25 bp, Homo sapien
cctgactcagccagatgcgtgccag

SEQ ID NO: 156081 - DNA, 25 bp, Homo sapien
actcagccagatgcgtgccaggagg

SEQ ID NO: 156082 - DNA, 25 bp, Homo sapien
tcatactccagctcatccaagcggt

SEQ ID NO: 156083 - DNA, 25 bp, Homo sapien
tactccagctcatccaagcggtctg

SEQ ID NO: 156084 - DNA, 25 bp, Homo sapien
gcgggccgccctccataaactccgc

SEQ ID NO: 156085 - DNA, 25 bp, Homo sapien
ctcaccgacatggacggaacacgta

SEQ ID NO: 156086 - DNA, 25 bp, Homo sapien
catggacggaacacgtaacctcacc

SEQ ID NO: 156087 - DNA, 25 bp, Homo sapien
ccaagtgcttgtcacacggcgcctg

SEQ ID NO: 156088 - DNA, 25 bp, Homo sapien
ccggagaggctaagaaaacagttgt

SEQ ID NO: 156089 - DNA, 25 bp, Homo sapien
tgatcaggaatctctgggaagccga

SEQ ID NO: 156090 - DNA, 25 bp, Homo sapien
gggcgcgacgccctcttgctgatca

SEQ ID NO: 156091 - DNA, 25 bp, Homo sapien
tgagctctgtttccaggctctgccc

SEQ ID NO: 156092 - DNA, 25 bp, Homo sapien
tggtggctgtattggcaggactcct

SEQ ID NO: 156093 - DNA, 25 bp, Homo sapien
gactcgcaatcccaagtgcttgtca

SEQ ID NO: 156094 - DNA, 25 bp, Homo sapien
agcccggagccgcagacaaagagcg

SEQ ID NO: 156095 - DNA, 25 bp, Homo sapien
tcgcttggagaaatcgcttgccgtt

SEQ ID NO: 156096 - DNA, 25 bp, Homo sapien
agtgcgacaccaatccttctccagg

SEQ ID NO: 156097 - DNA, 25 bp, Homo sapien
acgaggttggccttaaatgaagtgc

SEQ ID NO: 156098 - DNA, 25 bp, Homo sapien
cagccctggaatccaacacggattc

SEQ ID NO: 156099 - DNA, 25 bp, Homo sapien
cggtcgcattcctatcccgctaggg

SEQ ID NO: 156100 - DNA, 25 bp, Homo sapien
tgccgtttgatggaatgactcccga

SEQ ID NO: 156101 - DNA, 25 bp, Homo sapien
ctggcaatggccacacaaggtttcc

SEQ ID NO: 156102 - DNA, 25 bp, Homo sapien
tccaaacagcgggaacaagagacga

SEQ ID NO: 156103 - DNA, 25 bp, Homo sapien
tgaagagggccaccaggatcgcctt

SEQ ID NO: 156104 - DNA, 25 bp, Homo sapien
tagcgcattggacccacccgagagc

SEQ ID NO: 156105 - DNA, 25 bp, Homo sapien
tcgcggcagatgtaccagaggatca

SEQ ID NO: 156106 - DNA, 25 bp, Homo sapien
acccgatagcgcctggtgtgccata

SEQ ID NO: 156107 - DNA, 25 bp, Homo sapien
tggtcacagtccacatcgcggcaga

SEQ ID NO: 156108 - DNA, 25 bp, Homo sapien
gctccgtgaatcctcgggttcagtc

SEQ ID NO: 156109 - DNA, 25 bp, Homo sapien
gcgcctatgcgccttggacccaagg

SEQ ID NO: 156110 - DNA, 25 bp, Homo sapien
gtcaccggcgagatgagagactgca

SEQ ID NO: 156111 - DNA, 25 bp, Homo sapien
ggaacgggaagacgcctttcactga

SEQ ID NO: 156112 - DNA, 25 bp, Homo sapien
tacatcccatgttgctggccggcga

SEQ ID NO: 156113 - DNA, 25 bp, Homo sapien
gaccacgcacatattacatcccatg

SEQ ID NO: 156114 - DNA, 25 bp, Homo sapien
ctccggtttctggaccacgcacata

SEQ ID NO: 156115 - DNA, 25 bp, Homo sapien
cactttgtactgctcctccggtttc

SEQ ID NO: 156116 - DNA, 25 bp, Homo sapien
ggctggttcccacggagcgccaaca

SEQ ID NO: 156117 - DNA, 25 bp, Homo sapien
gggaactgcgctcgttgctatgcaa

SEQ ID NO: 156118 - DNA, 25 bp, Homo sapien
aggcccgccgggatctagattcggc

SEQ ID NO: 156119 - DNA, 25 bp, Homo sapien
ggatgctcccttagcctcggcctgg

SEQ ID NO: 156120 - DNA, 25 bp, Homo sapien
tccggcaaggaaggggatgctccct

SEQ ID NO: 156121 - DNA, 25 bp, Homo sapien
caagggagcccgctgtgaaagctcg

SEQ ID NO: 156122 - DNA, 25 bp, Homo sapien
tctccggccggagagtgtcctcagc

SEQ ID NO: 156123 - DNA, 25 bp, Homo sapien
ctgcgatgccgatgctgcggcagca

SEQ ID NO: 156124 - DNA, 25 bp, Homo sapien
cccgagcgcgtctgcgatgccgatg

SEQ ID NO: 156125 - DNA, 25 bp, Homo sapien
cacgcacggggacccgccaacttca

SEQ ID NO: 156126 - DNA, 25 bp, Homo sapien
acccgatctggcttcctttctcaga

SEQ ID NO: 156127 - DNA, 25 bp, Homo sapien
gagctccctcacgaccttgggttct

SEQ ID NO: 156128 - DNA, 25 bp, Homo sapien
gggacgcttggagctccctcacgac

SEQ ID NO: 156129 - DNA, 25 bp, Homo sapien
tggagctccctcacgaccttgggtt

SEQ ID NO: 156130 - DNA, 25 bp, Homo sapien
cacgaccttgggttctccgcaggaa

SEQ ID NO: 156131 - DNA, 25 bp, Homo sapien
tctcacctttgacttgcgtctcata

SEQ ID NO: 156132 - DNA, 25 bp, Homo sapien
tgacttgcgtctcatactcagcctg

SEQ ID NO: 156133 - DNA, 25 bp, Homo sapien
ttgcgtctcatactcagcctgcagc

SEQ ID NO: 156134 - DNA, 25 bp, Homo sapien
gcttggagctccctcacgaccttgg

SEQ ID NO: 156135 - DNA, 25 bp, Homo sapien
cgcctccggcccatacaaagggaag

SEQ ID NO: 156136 - DNA, 25 bp, Homo sapien
gcctgtgtggcgagttttcaacccg

SEQ ID NO: 156137 - DNA, 25 bp, Homo sapien
ggcgccagccaaagagaaccgagct

SEQ ID NO: 156138 - DNA, 25 bp, Homo sapien
gggaagcccacgtcttaagccaatc

SEQ ID NO: 156139 - DNA, 25 bp, Homo sapien
cttgcgaaccggaagacactgccgc

SEQ ID NO: 156140 - DNA, 25 bp, Homo sapien
atcagagcctgggaacgaacctcgc

SEQ ID NO: 156141 - DNA, 25 bp, Homo sapien
agtgccgccggaccaatcagagcct

SEQ ID NO: 156142 - DNA, 25 bp, Homo sapien
cctgctggtcacgtgcgaggcgcca

SEQ ID NO: 156143 - DNA, 25 bp, Homo sapien
gggcgctcaccctcgcattgcggat

SEQ ID NO: 156144 - DNA, 25 bp, Homo sapien
tgaccacgggtgagaagcctgctcc

SEQ ID NO: 156145 - DNA, 25 bp, Homo sapien
gcatctcctcgcacatggctaggca

SEQ ID NO: 156146 - DNA, 25 bp, Homo sapien
cattgcggatgttcataacggcggc

SEQ ID NO: 156147 - DNA, 25 bp, Homo sapien
gtggagcggactcagcctttattcc

SEQ ID NO: 156148 - DNA, 25 bp, Homo sapien
cacgcaaacaggagggaatcgcagc

SEQ ID NO: 156149 - DNA, 25 bp, Homo sapien
acggaggcccgacatcacgcaaaca

SEQ ID NO: 156150 - DNA, 25 bp, Homo sapien
ggcactgtgacgatctgactttgca

SEQ ID NO: 156151 - DNA, 25 bp, Homo sapien
gcgatgagaaccagtcccagaaata

SEQ ID NO: 156152 - DNA, 25 bp, Homo sapien
gactgcgtcacggtggtcacagccc

SEQ ID NO: 156153 - DNA, 25 bp, Homo sapien
ccatgcctggtacaagagcgacatc

SEQ ID NO: 156154 - DNA, 25 bp, Homo sapien
acagcccgcgtcagtgtggaggaca

SEQ ID NO: 156155 - DNA, 25 bp, Homo sapien
gaggctgcccttttatggtccggaa

SEQ ID NO: 156156 - DNA, 25 bp, Homo sapien
cggtgaagtgacacgcgatgagaac

SEQ ID NO: 156157 - DNA, 25 bp, Homo sapien
ccctgggctcttaccggcacagagg

SEQ ID NO: 156158 - DNA, 25 bp, Homo sapien
acatctggcgtctgagtgtggaact

SEQ ID NO: 156159 - DNA, 25 bp, Homo sapien
cccagctcctgtgtgcgaggcgagt

SEQ ID NO: 156160 - DNA, 25 bp, Homo sapien
aggatcaactgtgaacactgagggc

SEQ ID NO: 156161 - DNA, 25 bp, Homo sapien
cctcaggatcaactgtgaacactga

SEQ ID NO: 156162 - DNA, 25 bp, Homo sapien
tcctcaggatcaactgtgaacactg

SEQ ID NO: 156163 - DNA, 25 bp, Homo sapien
ccctcctcaggatcaactgtgaaca

SEQ ID NO: 156164 - DNA, 25 bp, Homo sapien
tgccctcctcaggatcaactgtgaa

SEQ ID NO: 156165 - DNA, 25 bp, Homo sapien
gatgccctcctcaggatcaactgtg

SEQ ID NO: 156166 - DNA, 25 bp, Homo sapien
cggatgccctcctcaggatcaactg

SEQ ID NO: 156167 - DNA, 25 bp, Homo sapien
tcagaggggccaactgcacaaaagc

SEQ ID NO: 156168 - DNA, 25 bp, Homo sapien
gctcagcctgactttgctgctcaga

SEQ ID NO: 156169 - DNA, 25 bp, Homo sapien
aggtccttaatgcttgggctgctca

SEQ ID NO: 156170 - DNA, 25 bp, Homo sapien
agtggccacactgatccggatcacg

SEQ ID NO: 156171 - DNA, 25 bp, Homo sapien
gaggctctcgcacacaggtgccatg

SEQ ID NO: 156172 - DNA, 25 bp, Homo sapien
ctcacatggtgggttggagcagact

SEQ ID NO: 156173 - DNA, 25 bp, Homo sapien
cgccgacgctcgacatggctgtagt

SEQ ID NO: 156174 - DNA, 25 bp, Homo sapien
cccggtggccatcacagtcatggtg

SEQ ID NO: 156175 - DNA, 25 bp, Homo sapien
aactcaaggcggtgtccgatcctca

SEQ ID NO: 156176 - DNA, 25 bp, Homo sapien
aactgcctttaaccagcactgggga

SEQ ID NO: 156177 - DNA, 25 bp, Homo sapien
tctctcgggttgataagggacgcac

SEQ ID NO: 156178 - DNA, 25 bp, Homo sapien
aaatgcccggatgagactgctaacc

SEQ ID NO: 156179 - DNA, 25 bp, Homo sapien
ccgcgggcgtcaatagcgactttca

SEQ ID NO: 156180 - DNA, 25 bp, Homo sapien
tgggctaaagctcgagtcgcgctca

SEQ ID NO: 156181 - DNA, 25 bp, Homo sapien
cgccatcttgtgtgaagaagtaaca

SEQ ID NO: 156182 - DNA, 25 bp, Homo sapien
cggtggaaccagctcgagctctcga

SEQ ID NO: 156183 - DNA, 25 bp, Homo sapien
tgcccatctttgcatggcccgtggc

SEQ ID NO: 156184 - DNA, 25 bp, Homo sapien
ccgctacctgaaggacgtgttcgca

SEQ ID NO: 156185 - DNA, 25 bp, Homo sapien
tgaacatggcctacacgctgctggg

SEQ ID NO: 156186 - DNA, 25 bp, Homo sapien
ggccatgccgttcaactcactcgtg

SEQ ID NO: 156187 - DNA, 25 bp, Homo sapien
acagtgtttccgtgcaagtgggcta

SEQ ID NO: 156188 - DNA, 25 bp, Homo sapien
tcacgggcattttcgacagtgtttc

SEQ ID NO: 156189 - DNA, 25 bp, Homo sapien
gccgccggttccagatgaatccaga

SEQ ID NO: 156190 - DNA, 25 bp, Homo sapien
tgttcctctctcttgagtgcgtctc

SEQ ID NO: 156191 - DNA, 25 bp, Homo sapien
ggccttccgaaagctcctgggcggc

SEQ ID NO: 156192 - DNA, 25 bp, Homo sapien
cctcgtacaagaagtgctgggcgcc

SEQ ID NO: 156193 - DNA, 25 bp, Homo sapien
gggtccgcggacactgactcacttc

SEQ ID NO: 156194 - DNA, 25 bp, Homo sapien
tcacaggctgtgatgatgtcccgcg

SEQ ID NO: 156195 - DNA, 25 bp, Homo sapien
aggatgtgcacgaggtcggccacac

SEQ ID NO: 156196 - DNA, 25 bp, Homo sapien
ccacacgggcgttgcggttgatcca

SEQ ID NO: 156197 - DNA, 25 bp, Homo sapien
tccatcactttgtagaagcggcaca

SEQ ID NO: 156198 - DNA, 25 bp, Homo sapien
cagggcggcacctcgtacaagaagt

SEQ ID NO: 156199 - DNA, 25 bp, Homo sapien
cggggggcactcacagtttcctgag

SEQ ID NO: 156200 - DNA, 25 bp, Homo sapien
gcctgctccgccgtctggtggccgc

SEQ ID NO: 156201 - DNA, 25 bp, Homo sapien
tctgctcgccttgggcgcgccgtgg

SEQ ID NO: 156202 - DNA, 25 bp, Homo sapien
cgcggacgatctctgctcgccttgg

SEQ ID NO: 156203 - DNA, 25 bp, Homo sapien
tgcactcgcggacgatctctgctcg

SEQ ID NO: 156204 - DNA, 25 bp, Homo sapien
ccttccgtgcgccagtggaggccgg

SEQ ID NO: 156205 - DNA, 25 bp, Homo sapien
cggcatcctggcgacgggcttgtgg

SEQ ID NO: 156206 - DNA, 25 bp, Homo sapien
gctgcactcgcggacgatctctgct

SEQ ID NO: 156207 - DNA, 25 bp, Homo sapien
gcactctcccgacgggaggcgaagt

SEQ ID NO: 156208 - DNA, 25 bp, Homo sapien
ctccagctgttgattggctgctttc

SEQ ID NO: 156209 - DNA, 25 bp, Homo sapien
tcctgtccatttcggccagggaaaa

SEQ ID NO: 156210 - DNA, 25 bp, Homo sapien
ccgtcaattggcgagatttcctgtc

SEQ ID NO: 156211 - DNA, 25 bp, Homo sapien
gtctcagcggcgatgccgtcaattg

SEQ ID NO: 156212 - DNA, 25 bp, Homo sapien
acagccctctctccgagaggaggga

SEQ ID NO: 156213 - DNA, 25 bp, Homo sapien
agcccgcccgtcattggctgtgatg

SEQ ID NO: 156214 - DNA, 25 bp, Homo sapien
tgttgattggctgctttcggccgtc

SEQ ID NO: 156215 - DNA, 25 bp, Homo sapien
cagtgagaaccagaatccacaaagg

SEQ ID NO: 156216 - DNA, 25 bp, Homo sapien
tccacaaaggccaaagtgcggaagg

SEQ ID NO: 156217 - DNA, 25 bp, Homo sapien
gtgcggaaggcactgagacaaagca

SEQ ID NO: 156218 - DNA, 25 bp, Homo sapien
gcaaagcgacccacagagcaagagg

SEQ ID NO: 156219 - DNA, 25 bp, Homo sapien
ccacagagcaagaggaccgagccgc

SEQ ID NO: 156220 - DNA, 25 bp, Homo sapien
gaaaaagcgttgcacagggcccgag

SEQ ID NO: 156221 - DNA, 25 bp, Homo sapien
gggcttcgcagaggcgttcagctca

SEQ ID NO: 156222 - DNA, 25 bp, Homo sapien
cgaagccgcagccttgctccggatt

SEQ ID NO: 156223 - DNA, 25 bp, Homo sapien
tcacataaacgcactgggcagctcg

SEQ ID NO: 156224 - DNA, 25 bp, Homo sapien
gggagctgcaccgacatcacataaa

SEQ ID NO: 156225 - DNA, 25 bp, Homo sapien
ccagatcccttgacttgcttgcgga

SEQ ID NO: 156226 - DNA, 25 bp, Homo sapien
gtgcacatgcaagtcacaaacattc

SEQ ID NO: 156227 - DNA, 25 bp, Homo sapien
agcccttttgagattgcaggagaga

SEQ ID NO: 156228 - DNA, 25 bp, Homo sapien
agctagtgccggaactttttgtgca

SEQ ID NO: 156229 - DNA, 25 bp, Homo sapien
cacgtgcggcaccacacagctagtg

SEQ ID NO: 156230 - DNA, 25 bp, Homo sapien
tcgcaggcgccattcgctcttcaga

SEQ ID NO: 156231 - DNA, 25 bp, Homo sapien
tagagaagctgggtcgttagattcg

SEQ ID NO: 156232 - DNA, 25 bp, Homo sapien
aggaagccgagcacgcagagttacc

SEQ ID NO: 156233 - DNA, 25 bp, Homo sapien
ttccgtacttgggtgaggaagccga

SEQ ID NO: 156234 - DNA, 25 bp, Homo sapien
ttcgggagagctggaatgatctgat

SEQ ID NO: 156235 - DNA, 25 bp, Homo sapien
agccgggagaggttctaccacttca

SEQ ID NO: 156236 - DNA, 25 bp, Homo sapien
tgggcactcgccttcacccttggag

SEQ ID NO: 156237 - DNA, 25 bp, Homo sapien
ggcatggctcctacccgtgggcact

SEQ ID NO: 156238 - DNA, 25 bp, Homo sapien
gatctgatgtgtcattccgtacttg

SEQ ID NO: 156239 - DNA, 25 bp, Homo sapien
cgtctggaggtgtctgtgcaccatt

SEQ ID NO: 156240 - DNA, 25 bp, Homo sapien
ggagactagggctgtccctccacgc

SEQ ID NO: 156241 - DNA, 25 bp, Homo sapien
ccactccactgtgctgcgaaagtgc

SEQ ID NO: 156242 - DNA, 25 bp, Homo sapien
cccttcctttgcagaccggtggtca

SEQ ID NO: 156243 - DNA, 25 bp, Homo sapien
ccttctcgggaatggaacgcttaga

SEQ ID NO: 156244 - DNA, 25 bp, Homo sapien
aggtccacacccaaaacacaaggcg

SEQ ID NO: 156245 - DNA, 25 bp, Homo sapien
gggaattccgtgcaatctgagcatg

SEQ ID NO: 156246 - DNA, 25 bp, Homo sapien
ctgagcatggtcattggcgaggaca

SEQ ID NO: 156247 - DNA, 25 bp, Homo sapien
cggcgccggcatttaccttggtatt

SEQ ID NO: 156248 - DNA, 25 bp, Homo sapien
ttggtattgccggacaaggcctgtc

SEQ ID NO: 156249 - DNA, 25 bp, Homo sapien
gcgttcctgctagctcttccggtta

SEQ ID NO: 156250 - DNA, 25 bp, Homo sapien
ccttcctagccggttgcatttcgtg

SEQ ID NO: 156251 - DNA, 25 bp, Homo sapien
gatcgtaagttactcttccctctga

SEQ ID NO: 156252 - DNA, 25 bp, Homo sapien
cgcttccagcttaagtgtcttgaga

SEQ ID NO: 156253 - DNA, 25 bp, Homo sapien
tcttgagattgtcgcggtgtctgca

SEQ ID NO: 156254 - DNA, 25 bp, Homo sapien
gaggctttgcttcgggtttgtctaa

SEQ ID NO: 156255 - DNA, 25 bp, Homo sapien
tgcccttcaaggtccgccatgtgct

SEQ ID NO: 156256 - DNA, 25 bp, Homo sapien
ccatcacctgccaaagacagaggct

SEQ ID NO: 156257 - DNA, 25 bp, Homo sapien
tcactgatgagctggtctttggagg

SEQ ID NO: 156258 - DNA, 25 bp, Homo sapien
cacctctctgtgcaggcgcgagagc

SEQ ID NO: 156259 - DNA, 25 bp, Homo sapien
ctgcgccgactggagatgcccttca

SEQ ID NO: 156260 - DNA, 25 bp, Homo sapien
agtgtgtttccatctcgtctcgctc

SEQ ID NO: 156261 - DNA, 25 bp, Homo sapien
cacggacagacctgcaagtgtgttt

SEQ ID NO: 156262 - DNA, 25 bp, Homo sapien
cagcctcttcctggtggctttcagc

SEQ ID NO: 156263 - DNA, 25 bp, Homo sapien
ctggacggggactgtgtcctccctc

SEQ ID NO: 156264 - DNA, 25 bp, Homo sapien
gaggagggccggctctccctgctat

SEQ ID NO: 156265 - DNA, 25 bp, Homo sapien
tcctagcgacctgttcggcagatgg

SEQ ID NO: 156266 - DNA, 25 bp, Homo sapien
agtgctctcctagcgacctgttcgg

SEQ ID NO: 156267 - DNA, 25 bp, Homo sapien
ctcagggagtgctctcctagcgacc

SEQ ID NO: 156268 - DNA, 25 bp, Homo sapien
ggcgccctcgctcagggagtgctct

SEQ ID NO: 156269 - DNA, 25 bp, Homo sapien
acctgttcggcagatgggcacagcc

SEQ ID NO: 156270 - DNA, 25 bp, Homo sapien
ccgatcccgcgggaagaacagcgag

SEQ ID NO: 156271 - DNA, 25 bp, Homo sapien
gggatctcgtcaccaccgtacttga

SEQ ID NO: 156272 - DNA, 25 bp, Homo sapien
gtcaccaccgtacttgatgaggatg

SEQ ID NO: 156273 - DNA, 25 bp, Homo sapien
atgaggatggtgtagcgacctgtca

SEQ ID NO: 156274 - DNA, 25 bp, Homo sapien
ctgtgacagtgcacttgctggcgtc

SEQ ID NO: 156275 - DNA, 25 bp, Homo sapien
agcagcgagcccttgcacacaggca

SEQ ID NO: 156276 - DNA, 25 bp, Homo sapien
agcgacctgtcacgtctggcacgta

SEQ ID NO: 156277 - DNA, 25 bp, Homo sapien
cgtctggcacgtaggccactgtata

SEQ ID NO: 156278 - DNA, 25 bp, Homo sapien
gggagaaggggatctcgtcaccacc

SEQ ID NO: 156279 - DNA, 25 bp, Homo sapien
ctttaattaaagtcgcaggcaccta

SEQ ID NO: 156280 - DNA, 25 bp, Homo sapien
ggggtggctctcttccctaagtcac

SEQ ID NO: 156281 - DNA, 25 bp, Homo sapien
tgagcacctccaacagcgcgataag

SEQ ID NO: 156282 - DNA, 25 bp, Homo sapien
ccgacacgttctcaagctgcatttg

SEQ ID NO: 156283 - DNA, 25 bp, Homo sapien
tgtgcttgcggtgcatcttcttctg

SEQ ID NO: 156284 - DNA, 25 bp, Homo sapien
tactcattttgaggcgcgagaagcc

SEQ ID NO: 156285 - DNA, 25 bp, Homo sapien
cccgagagtgggagctactcatttt

SEQ ID NO: 156286 - DNA, 25 bp, Homo sapien
tggacaccagtttgatgctctcgcg

SEQ ID NO: 156287 - DNA, 25 bp, Homo sapien
attggtaaaattgcccaggagcccg

SEQ ID NO: 156288 - DNA, 25 bp, Homo sapien
agccttaattggtaaaattgcccag

SEQ ID NO: 156289 - DNA, 25 bp, Homo sapien
gccgcccgccttcttgttggccgca

SEQ ID NO: 156290 - DNA, 25 bp, Homo sapien
cgcctcggggattctgtcggcgtcc

SEQ ID NO: 156291 - DNA, 25 bp, Homo sapien
agagcgaccggtgaccgatgaccgc

SEQ ID NO: 156292 - DNA, 25 bp, Homo sapien
tgctgttcctgagagcgaccggtga

SEQ ID NO: 156293 - DNA, 25 bp, Homo sapien
gcggagacctcacctgctgttcctg

SEQ ID NO: 156294 - DNA, 25 bp, Homo sapien
tcacgcatcccagctgaacctggcc

SEQ ID NO: 156295 - DNA, 25 bp, Homo sapien
ctgtgacgcgacaacgattcggctg

SEQ ID NO: 156296 - DNA, 25 bp, Homo sapien
ccgtgcttgtgacatatgggcttgc

SEQ ID NO: 156297 - DNA, 25 bp, Homo sapien
ccgtgacgcgacaacgattcggctg

SEQ ID NO: 156298 - DNA, 25 bp, Homo sapien
cgctagccaatcctcgcgttgatga

SEQ ID NO: 156299 - DNA, 25 bp, Homo sapien
acgccgctagccaatccatgcatta

SEQ ID NO: 156300 - DNA, 25 bp, Homo sapien
gctcccacagcgataccggtttgca

SEQ ID NO: 156301 - DNA, 25 bp, Homo sapien
ccaagcgacttagggaccagagcca

SEQ ID NO: 156302 - DNA, 25 bp, Homo sapien
tgccgctagccaatctgtgcgtttg

SEQ ID NO: 156303 - DNA, 25 bp, Homo sapien
cgttccagagagaaaagtcagcgtt

SEQ ID NO: 156304 - DNA, 25 bp, Homo sapien
ccgggcctaaatttggaatcgctag

SEQ ID NO: 156305 - DNA, 25 bp, Homo sapien
acagatctctctccctttgcatgag

SEQ ID NO: 156306 - DNA, 25 bp, Homo sapien
tctaggggaccttcttacagatctc

SEQ ID NO: 156307 - DNA, 25 bp, Homo sapien
ggtgcgtccgatttttcccaatcta

SEQ ID NO: 156308 - DNA, 25 bp, Homo sapien
caaactcttacatgtggggcggcct

SEQ ID NO: 156309 - DNA, 25 bp, Homo sapien
tcagcgtttgttgtcggagttgcaa

SEQ ID NO: 156310 - DNA, 25 bp, Homo sapien
aaaaatactctgtggatgcgggctc

SEQ ID NO: 156311 - DNA, 25 bp, Homo sapien
ggagggaggacacagtccccgtcca

SEQ ID NO: 156312 - DNA, 25 bp, Homo sapien
ggctgtgcccatctgccgaacaggt

SEQ ID NO: 156313 - DNA, 25 bp, Homo sapien
agagcactccctgagcgagggcgcc

SEQ ID NO: 156314 - DNA, 25 bp, Homo sapien
agagccggccctcctcgctgttctt

SEQ ID NO: 156315 - DNA, 25 bp, Homo sapien
aggtcgctaggagagcactccctga

SEQ ID NO: 156316 - DNA, 25 bp, Homo sapien
ctcgctgttcttcccgcgggatcgg

SEQ ID NO: 156317 - DNA, 25 bp, Homo sapien
ccgaacaggtcgctaggagagcact

SEQ ID NO: 156318 - DNA, 25 bp, Homo sapien
tgcccatctgccgaacaggtcgcta

SEQ ID NO: 156319 - DNA, 25 bp, Homo sapien
tctaagcgttccattcccgagaagg

SEQ ID NO: 156320 - DNA, 25 bp, Homo sapien
ccgcggaatggtgcacagacacctc

SEQ ID NO: 156321 - DNA, 25 bp, Homo sapien
ggcactttcgcagcacagtggagtg

SEQ ID NO: 156322 - DNA, 25 bp, Homo sapien
ggccctgatctcaggcgacgcctgt

SEQ ID NO: 156323 - DNA, 25 bp, Homo sapien
tgaccaccggtctgcaaaggaaggg

SEQ ID NO: 156324 - DNA, 25 bp, Homo sapien
tgtcctcgccaatgaccatgctcag

SEQ ID NO: 156325 - DNA, 25 bp, Homo sapien
ggtgcacacgcaacagtgccgcctt

SEQ ID NO: 156326 - DNA, 25 bp, Homo sapien
ccatgctcagattgcacggaattcc

SEQ ID NO: 156327 - DNA, 25 bp, Homo sapien
gagcgtccacccgtcttcgacagga

SEQ ID NO: 156328 - DNA, 25 bp, Homo sapien
cggtcacctctctgatctgcgcatg

SEQ ID NO: 156329 - DNA, 25 bp, Homo sapien
cgcgcgcagacagaccgcctatata

SEQ ID NO: 156330 - DNA, 25 bp, Homo sapien
aggagcgcctctttcccttcggtgt

SEQ ID NO: 156331 - DNA, 25 bp, Homo sapien
tgcctatggccgctgaaaacaattg

SEQ ID NO: 156332 - DNA, 25 bp, Homo sapien
tcaccgcattttcgggcgctagata

SEQ ID NO: 156333 - DNA, 25 bp, Homo sapien
cgctagatacgctcttggggccttt

SEQ ID NO: 156334 - DNA, 25 bp, Homo sapien
ggactctatggttcttacgcgcgca

SEQ ID NO: 156335 - DNA, 25 bp, Homo sapien
tcgctgccttttcatggagccctgg

SEQ ID NO: 156336 - DNA, 25 bp, Homo sapien
gcctctgcacgtgaagtggccgttc

SEQ ID NO: 156337 - DNA, 25 bp, Homo sapien
ctgcttctggaccagtgagtgggcc

SEQ ID NO: 156338 - DNA, 25 bp, Homo sapien
ccgccagagtacatgaaccacctga

SEQ ID NO: 156339 - DNA, 25 bp, Homo sapien
tacgagctcatcgagaagcgaggcc

SEQ ID NO: 156340 - DNA, 25 bp, Homo sapien
cgtgtccaatcaccagtcctgcatg

SEQ ID NO: 156341 - DNA, 25 bp, Homo sapien
atggacgaccctcatctctggggta

SEQ ID NO: 156342 - DNA, 25 bp, Homo sapien
ctgacctgcgaagggacctcggtcc

SEQ ID NO: 156343 - DNA, 25 bp, Homo sapien
cgggacctgcactcggagggctcca

SEQ ID NO: 156344 - DNA, 25 bp, Homo sapien
gggacctgcactcggagggctccac

SEQ ID NO: 156345 - DNA, 25 bp, Homo sapien
caccacacgggatctgcactcggag

SEQ ID NO: 156346 - DNA, 25 bp, Homo sapien
actcggagggctccacacggaccga

SEQ ID NO: 156347 - DNA, 25 bp, Homo sapien
accgcacgggacctgcactcggagg

SEQ ID NO: 156348 - DNA, 25 bp, Homo sapien
gaccgcacgggacctgcactcggag

SEQ ID NO: 156349 - DNA, 25 bp, Homo sapien
accacacgggatctgcactcggagg

SEQ ID NO: 156350 - DNA, 25 bp, Homo sapien
acccgcactcggagggctccacaca

SEQ ID NO: 156351 - DNA, 25 bp, Homo sapien
caacggtcacctgatctgcggctgt

SEQ ID NO: 156352 - DNA, 25 bp, Homo sapien
aatctgccggcgacagagctccagt

SEQ ID NO: 156353 - DNA, 25 bp, Homo sapien
tttcccactcggagcgtgagcgcct

SEQ ID NO: 156354 - DNA, 25 bp, Homo sapien
tggagacacgtacagccaaccagtg

SEQ ID NO: 156355 - DNA, 25 bp, Homo sapien
ccaaccagtgagaaggagtggccgc

SEQ ID NO: 156356 - DNA, 25 bp, Homo sapien
ttggtccaattacctgcggccctgc

SEQ ID NO: 156357 - DNA, 25 bp, Homo sapien
cgcgagtggcatgcacttggtccaa

SEQ ID NO: 156358 - DNA, 25 bp, Homo sapien
tgtccctcttgtctcgtcctagtcg

SEQ ID NO: 156359 - DNA, 25 bp, Homo sapien
gcgtcagctgactgttcggccgcca

SEQ ID NO: 156360 - DNA, 25 bp, Homo sapien
cgccgctgccatggctcaatacaag

SEQ ID NO: 156361 - DNA, 25 bp, Homo sapien
tggctcaatacaagggcgccgcgag

SEQ ID NO: 156362 - DNA, 25 bp, Homo sapien
agccagcgacagtctcatctgtgaa

SEQ ID NO: 156363 - DNA, 25 bp, Homo sapien
agccgagccagtgtttctgttggga

SEQ ID NO: 156364 - DNA, 25 bp, Homo sapien
tccagcagggcacacagaagcaagc

SEQ ID NO: 156365 - DNA, 25 bp, Homo sapien
ctggctcgctgacttccagcagggc

SEQ ID NO: 156366 - DNA, 25 bp, Homo sapien
ctgaggccactagctgatgaccggc

SEQ ID NO: 156367 - DNA, 25 bp, Homo sapien
ccctcccgctaagggctccgcgagt

SEQ ID NO: 156368 - DNA, 25 bp, Homo sapien
ccaaagaggaccctttgtcgcaggg

SEQ ID NO: 156369 - DNA, 25 bp, Homo sapien
taggtggccgtcatcgtcgccgtcc

SEQ ID NO: 156370 - DNA, 25 bp, Homo sapien
ggaggatcaacgctgtacttccctc

SEQ ID NO: 156371 - DNA, 25 bp, Homo sapien
gtcgccgtccgtgcggggccaaaca

SEQ ID NO: 156372 - DNA, 25 bp, Homo sapien
tggggacgccaacccaagaccaaca

SEQ ID NO: 156373 - DNA, 25 bp, Homo sapien
ccctcggaggatcaacgctgtactt

SEQ ID NO: 156374 - DNA, 25 bp, Homo sapien
cgggcaaaccggaccagcagcacgg

SEQ ID NO: 156375 - DNA, 25 bp, Homo sapien
cgtgccttcgtggtgacagacacca

SEQ ID NO: 156376 - DNA, 25 bp, Homo sapien
tggtgacagacaccacgcttaccca

SEQ ID NO: 156377 - DNA, 25 bp, Homo sapien
gcgcagtgaaccgagtctttaagct

SEQ ID NO: 156378 - DNA, 25 bp, Homo sapien
acctgactgagctgcgggcccatgt

SEQ ID NO: 156379 - DNA, 25 bp, Homo sapien
ccgtcgaggacaacgctcgctgcta

SEQ ID NO: 156380 - DNA, 25 bp, Homo sapien
cccgtggacaacatcaacaagctgc

SEQ ID NO: 156381 - DNA, 25 bp, Homo sapien
aacaagctgctgctcatagactatg

SEQ ID NO: 156382 - DNA, 25 bp, Homo sapien
tgctcatagactatgcggcccgccg

SEQ ID NO: 156383 - DNA, 25 bp, Homo sapien
ccacacggctttgctgaggagctga

SEQ ID NO: 156384 - DNA, 25 bp, Homo sapien
cacatgtgtgctgggagtccgccct

SEQ ID NO: 156385 - DNA, 25 bp, Homo sapien
tgtcagtgacgtcacctggggtgca

SEQ ID NO: 156386 - DNA, 25 bp, Homo sapien
ccagacctcagtgcgggcgtgagct

SEQ ID NO: 156387 - DNA, 25 bp, Homo sapien
gggtccggcccaacaatgtgtcagt

SEQ ID NO: 156388 - DNA, 25 bp, Homo sapien
aaggctcgctgttgcctggcactgt

SEQ ID NO: 156389 - DNA, 25 bp, Homo sapien
ctggcactgtgagctggacaggcct

SEQ ID NO: 156390 - DNA, 25 bp, Homo sapien
gcccaacaatgtgtcagtgacgtca

SEQ ID NO: 156391 - DNA, 25 bp, Homo sapien
tttgaccaagtgagtcccagccgtg

SEQ ID NO: 156392 - DNA, 25 bp, Homo sapien
ctacagctttgtggtgcgtggctgc

SEQ ID NO: 156393 - DNA, 25 bp, Homo sapien
cgcagtcggagcaggtctacagctt

SEQ ID NO: 156394 - DNA, 25 bp, Homo sapien
ggtgactgttcagccgacttccgca

SEQ ID NO: 156395 - DNA, 25 bp, Homo sapien
ctctgagccctaggatcgtgtgtga

SEQ ID NO: 156396 - DNA, 25 bp, Homo sapien
ttccggccgagtacatcagtgctga

SEQ ID NO: 156397 - DNA, 25 bp, Homo sapien
ttctctctcccgcaaggggcgtgtg

SEQ ID NO: 156398 - DNA, 25 bp, Homo sapien
tgcgttgcaactccattccggccga

SEQ ID NO: 156399 - DNA, 25 bp, Homo sapien
ggctgccggagtacggaggacagac

SEQ ID NO: 156400 - DNA, 25 bp, Homo sapien
aggtcagaggttgcccaagcgcgaa

SEQ ID NO: 156401 - DNA, 25 bp, Homo sapien
tcagaggttgcccaagcgcgaagga

SEQ ID NO: 156402 - DNA, 25 bp, Homo sapien
gctggggaatacaggccgtccaggc

SEQ ID NO: 156403 - DNA, 25 bp, Homo sapien
gcccagaactccaagcaggtgcgcg

SEQ ID NO: 156404 - DNA, 25 bp, Homo sapien
ctgggcgcatgggtgttaagacgca

SEQ ID NO: 156405 - DNA, 25 bp, Homo sapien
gccgaggcagccagagcgcggaaga

SEQ ID NO: 156406 - DNA, 25 bp, Homo sapien
ccagaactccaagcaggtgcgcggg

SEQ ID NO: 156407 - DNA, 25 bp, Homo sapien
tgctggacgtcaaaccgggctccca

SEQ ID NO: 156408 - DNA, 25 bp, Homo sapien
cgcaaggcgagcaccctgatgagtt

SEQ ID NO: 156409 - DNA, 25 bp, Homo sapien
ccctgatgagtttggcttcctgctg

SEQ ID NO: 156410 - DNA, 25 bp, Homo sapien
tcctgctggaccacgtgcaaacggc

SEQ ID NO: 156411 - DNA, 25 bp, Homo sapien
tactaccctgatcccagctttgagc

SEQ ID NO: 156412 - DNA, 25 bp, Homo sapien
ccctctggcgtgctggacgtcaaac

SEQ ID NO: 156413 - DNA, 25 bp, Homo sapien
aaccgggctcccacgtggtgctgaa

SEQ ID NO: 156414 - DNA, 25 bp, Homo sapien
atcccagctttgagccgctggggcc

SEQ ID NO: 156415 - DNA, 25 bp, Homo sapien
gcgcgttcgtgcttaccttcatcca

SEQ ID NO: 156416 - DNA, 25 bp, Homo sapien
gccgacctcatcgagaagaacctcg

SEQ ID NO: 156417 - DNA, 25 bp, Homo sapien
tatgccacggggctgctcaagcaac

SEQ ID NO: 156418 - DNA, 25 bp, Homo sapien
ctgcagagccggctcgactatgcca

SEQ ID NO: 156419 - DNA, 25 bp, Homo sapien
gacttacgccgtgcgcgtgctcttc

SEQ ID NO: 156420 - DNA, 25 bp, Homo sapien
ttaccttcatccacacgctggaggc

SEQ ID NO: 156421 - DNA, 25 bp, Homo sapien
cagacgccacccaacgtggagaagg

SEQ ID NO: 156422 - DNA, 25 bp, Homo sapien
agagcagcttctccatgcgcgaccg

SEQ ID NO: 156423 - DNA, 25 bp, Homo sapien
agaggctgcggtttcctccagaaac

SEQ ID NO: 156424 - DNA, 25 bp, Homo sapien
agacaccgtggtcgcctatcccaga

SEQ ID NO: 156425 - DNA, 25 bp, Homo sapien
agaaactctgccctttcgcgcgtaa

SEQ ID NO: 156426 - DNA, 25 bp, Homo sapien
cctgacggggcttttgaagacaccg

SEQ ID NO: 156427 - DNA, 25 bp, Homo sapien
tggcacaacgtccatgttgcgattc

SEQ ID NO: 156428 - DNA, 25 bp, Homo sapien
ttcgcgcgtaactcgattccagagc

SEQ ID NO: 156429 - DNA, 25 bp, Homo sapien
cccagctcggaaaggatacaatatg

SEQ ID NO: 156430 - DNA, 25 bp, Homo sapien
cagagcgctggtgcaaactgaccca

SEQ ID NO: 156431 - DNA, 25 bp, Homo sapien
cagggacgagatctccgcctgcgac

SEQ ID NO: 156432 - DNA, 25 bp, Homo sapien
ctctgcaaggctgtcatctgctgtc

SEQ ID NO: 156433 - DNA, 25 bp, Homo sapien
atctgctgtcgcaggtcgtgcactg

SEQ ID NO: 156434 - DNA, 25 bp, Homo sapien
ccggacactctgcagggacgagatc

SEQ ID NO: 156435 - DNA, 25 bp, Homo sapien
cacctgctgaagctggctctgcaag

SEQ ID NO: 156436 - DNA, 25 bp, Homo sapien
tgcgacgccttcagcttgctggtca

SEQ ID NO: 156437 - DNA, 25 bp, Homo sapien
gctgctggtaccactgccggacact

SEQ ID NO: 156438 - DNA, 25 bp, Homo sapien
cgtgcactgaaatggggcaagcaca

SEQ ID NO: 156439 - DNA, 25 bp, Homo sapien
ttcagcttctcggagaccagctgct

SEQ ID NO: 156440 - DNA, 25 bp, Homo sapien
gcactgggacgttcagcttctcgga

SEQ ID NO: 156441 - DNA, 25 bp, Homo sapien
tgcccttgaacagcagccgctgctg

SEQ ID NO: 156442 - DNA, 25 bp, Homo sapien
cctcccttggggtcatgtggcgctt

SEQ ID NO: 156443 - DNA, 25 bp, Homo sapien
accagctgcttcagcgtggacacca

SEQ ID NO: 156444 - DNA, 25 bp, Homo sapien
agcgccttcaccgtcagctgcatgg

SEQ ID NO: 156445 - DNA, 25 bp, Homo sapien
tcaccgtcagctgcatggcggtcgc

SEQ ID NO: 156446 - DNA, 25 bp, Homo sapien
atggcggtcgcgacggcgtccactc

SEQ ID NO: 156447 - DNA, 25 bp, Homo sapien
tgtgcggagttcctcctttcgttca

SEQ ID NO: 156448 - DNA, 25 bp, Homo sapien
ttgagtttgaccgacctggacgcca

SEQ ID NO: 156449 - DNA, 25 bp, Homo sapien
gttttggccacgttgccgctcaagg

SEQ ID NO: 156450 - DNA, 25 bp, Homo sapien
caatgggacagagggttagacgtta

SEQ ID NO: 156451 - DNA, 25 bp, Homo sapien
tacgctgcgacctctaaaggcaatg

SEQ ID NO: 156452 - DNA, 25 bp, Homo sapien
ccaggcattcccgattacgctgcga

SEQ ID NO: 156453 - DNA, 25 bp, Homo sapien
catctgaagctgttgtgatcgctgg

SEQ ID NO: 156454 - DNA, 25 bp, Homo sapien
cgctgcctggaccaatcgcttggca

SEQ ID NO: 156455 - DNA, 25 bp, Homo sapien
tgctagctggccgtgcttctccgcg

SEQ ID NO: 156456 - DNA, 25 bp, Homo sapien
tggccgtgcttctccgcgggataca

SEQ ID NO: 156457 - DNA, 25 bp, Homo sapien
ttctccgcgggatacagccttccat

SEQ ID NO: 156458 - DNA, 25 bp, Homo sapien
ggtcctggcactggccgtgctagct

SEQ ID NO: 156459 - DNA, 25 bp, Homo sapien
ctggcactggccgtgctagctggcc

SEQ ID NO: 156460 - DNA, 25 bp, Homo sapien
ggggtgtgagcctcagcctctgtcc

SEQ ID NO: 156461 - DNA, 25 bp, Homo sapien
cgttctggtcactgcctcggagccc

SEQ ID NO: 156462 - DNA, 25 bp, Homo sapien
cgtgcctcccttggtctggcctccc

SEQ ID NO: 156463 - DNA, 25 bp, Homo sapien
gtgcgttcaggctgaacccaccggc

SEQ ID NO: 156464 - DNA, 25 bp, Homo sapien
ccgggccggagatttctctggccgt

SEQ ID NO: 156465 - DNA, 25 bp, Homo sapien
gatcttgcccacaggagcctccggg

SEQ ID NO: 156466 - DNA, 25 bp, Homo sapien
ttggctcacgatcttgcccacagga

SEQ ID NO: 156467 - DNA, 25 bp, Homo sapien
tgctacgacctgtttgtccagccgc

SEQ ID NO: 156468 - DNA, 25 bp, Homo sapien
ggctcggtcagggaggttccctgtc

SEQ ID NO: 156469 - DNA, 25 bp, Homo sapien
tgcgccgtctggctccacgcaggcc

SEQ ID NO: 156470 - DNA, 25 bp, Homo sapien
cgatcggtgctacgacctgtttgtc

SEQ ID NO: 156471 - DNA, 25 bp, Homo sapien
tgaccacctactgcgctggcatggc

SEQ ID NO: 156472 - DNA, 25 bp, Homo sapien
acgggtcaagctcccgtcccttctg

SEQ ID NO: 156473 - DNA, 25 bp, Homo sapien
tgagaacacgggtcaagctcccgtc

SEQ ID NO: 156474 - DNA, 25 bp, Homo sapien
tgcccatgagaacacgggtcaagct

SEQ ID NO: 156475 - DNA, 25 bp, Homo sapien
tccctctgcccatgagaacacgggt

SEQ ID NO: 156476 - DNA, 25 bp, Homo sapien
attctccctgactgcctggctatct

SEQ ID NO: 156477 - DNA, 25 bp, Homo sapien
gcccttcggcctttctccagtcacc

SEQ ID NO: 156478 - DNA, 25 bp, Homo sapien
aggcagacgcggcccttcggccttt

SEQ ID NO: 156479 - DNA, 25 bp, Homo sapien
gcgaccgcgaaactgggactttctc

SEQ ID NO: 156480 - DNA, 25 bp, Homo sapien
cccaaagacagggttccatccgtgg

SEQ ID NO: 156481 - DNA, 25 bp, Homo sapien
tcacgtctgacggactctgctgaca

SEQ ID NO: 156482 - DNA, 25 bp, Homo sapien
tttacttccggatcccacagctatg

SEQ ID NO: 156483 - DNA, 25 bp, Homo sapien
tggccggcgtgcttatcattaccga

SEQ ID NO: 156484 - DNA, 25 bp, Homo sapien
tctgctgacaggtgtggtccttttc

SEQ ID NO: 156485 - DNA, 25 bp, Homo sapien
gccctattgggcagtctcttcttga

SEQ ID NO: 156486 - DNA, 25 bp, Homo sapien
gcagctccgcgtagtgctcccgaat

SEQ ID NO: 156487 - DNA, 25 bp, Homo sapien
gccttgctaacggtagaggcgacca

SEQ ID NO: 156488 - DNA, 25 bp, Homo sapien
gggcccattctgtcccttagccttg

SEQ ID NO: 156489 - DNA, 25 bp, Homo sapien
tgaggactccttcagattctgcctg

SEQ ID NO: 156490 - DNA, 25 bp, Homo sapien
tcgggtccatggttctttctgcctt

SEQ ID NO: 156491 - DNA, 25 bp, Homo sapien
cgcagggtctgtggttctacacttg

SEQ ID NO: 156492 - DNA, 25 bp, Homo sapien
atcagctcgcagtcacagggtgttc

SEQ ID NO: 156493 - DNA, 25 bp, Homo sapien
ctgcagttgtcctcgtgtctgttga

SEQ ID NO: 156494 - DNA, 25 bp, Homo sapien
cctgcattgaagcaaacacgtctta

SEQ ID NO: 156495 - DNA, 25 bp, Homo sapien
agcatgggcagacgcctcggccgta

SEQ ID NO: 156496 - DNA, 25 bp, Homo sapien
gggtctgtgatgggtcacgccctcc

SEQ ID NO: 156497 - DNA, 25 bp, Homo sapien
tccctggagaggtcaaagagcaaag

SEQ ID NO: 156498 - DNA, 25 bp, Homo sapien
ctatcacggcgtggtacaggggctc

SEQ ID NO: 156499 - DNA, 25 bp, Homo sapien
acccttgctatcacggcgtggtaca

SEQ ID NO: 156500 - DNA, 25 bp, Homo sapien
acctacccttgctatcacggcgtgg

SEQ ID NO: 156501 - DNA, 25 bp, Homo sapien
cgatgctccgacaccgcggcaccta

SEQ ID NO: 156502 - DNA, 25 bp, Homo sapien
atgggcagacgcctcggccgtagca

SEQ ID NO: 156503 - DNA, 25 bp, Homo sapien
ccctgcatgcgcagctggtccacct

SEQ ID NO: 156504 - DNA, 25 bp, Homo sapien
acggcaggggctatgcgcagggcgt

SEQ ID NO: 156505 - DNA, 25 bp, Homo sapien
cacggggaaagagcagactcaggga

SEQ ID NO: 156506 - DNA, 25 bp, Homo sapien
ctggcacggggaaagagcagactca

SEQ ID NO: 156507 - DNA, 25 bp, Homo sapien
agcgcctcgcgctcactctccagct

SEQ ID NO: 156508 - DNA, 25 bp, Homo sapien
tgactcacttctcctccgaggcggc

SEQ ID NO: 156509 - DNA, 25 bp, Homo sapien
ccgctgactcacttctcctccgagg

SEQ ID NO: 156510 - DNA, 25 bp, Homo sapien
ccctggcacggggaaagagcagact

SEQ ID NO: 156511 - DNA, 25 bp, Homo sapien
ccagccaaagaaaggggcacgcttt

SEQ ID NO: 156512 - DNA, 25 bp, Homo sapien
ccctggccgctcctgtacggagagt

SEQ ID NO: 156513 - DNA, 25 bp, Homo sapien
gctgcctagcacagcggcgaagctg

SEQ ID NO: 156514 - DNA, 25 bp, Homo sapien
gctcgacgtgcgatttcggtttccg

SEQ ID NO: 156515 - DNA, 25 bp, Homo sapien
tcacccagggtcacgagaaagcgct

SEQ ID NO: 156516 - DNA, 25 bp, Homo sapien
acgtagcgctgtagcttcctctcgg

SEQ ID NO: 156517 - DNA, 25 bp, Homo sapien
ggcacgctttcgagatgtctccctg

SEQ ID NO: 156518 - DNA, 25 bp, Homo sapien
gcgacttaacgagccagccggtgca

SEQ ID NO: 156519 - DNA, 25 bp, Homo sapien
ttcgcgcttcaggtgccagatcaaa

SEQ ID NO: 156520 - DNA, 25 bp, Homo sapien
tgcaggaccaactctttcaggaagc

SEQ ID NO: 156521 - DNA, 25 bp, Homo sapien
ggatcgagctcacctccgactgtga

SEQ ID NO: 156522 - DNA, 25 bp, Homo sapien
cgcgctactttcgttccggaacaga

SEQ ID NO: 156523 - DNA, 25 bp, Homo sapien
gcgggcaccggcatttacagagcca

SEQ ID NO: 156524 - DNA, 25 bp, Homo sapien
ctttcagctgcaaagggccaggcta

SEQ ID NO: 156525 - DNA, 25 bp, Homo sapien
tggccacctggaatgaagacaagtc

SEQ ID NO: 156526 - DNA, 25 bp, Homo sapien
atgaggccgccttcagaaagtgacc

SEQ ID NO: 156527 - DNA, 25 bp, Homo sapien
ctggccgagccagcaaatcgcattg

SEQ ID NO: 156528 - DNA, 25 bp, Homo sapien
aacccggaggtgaagcaactacagc

SEQ ID NO: 156529 - DNA, 25 bp, Homo sapien
agctccgagttgcaagaaagttcta

SEQ ID NO: 156530 - DNA, 25 bp, Homo sapien
gccgttacagctccatgcgactagg

SEQ ID NO: 156531 - DNA, 25 bp, Homo sapien
ccaaccaggctgcttgaggctcgaa

SEQ ID NO: 156532 - DNA, 25 bp, Homo sapien
tttaagctctgccatagccacgtgg

SEQ ID NO: 156533 - DNA, 25 bp, Homo sapien
cgagtggtcgcttatggaactttcc

SEQ ID NO: 156534 - DNA, 25 bp, Homo sapien
tcgccgtcgaaagacatctgccgtg

SEQ ID NO: 156535 - DNA, 25 bp, Homo sapien
ctcgccttgagggtcatctcgcaga

SEQ ID NO: 156536 - DNA, 25 bp, Homo sapien
gcagcaaatgctccaggtagaggtc

SEQ ID NO: 156537 - DNA, 25 bp, Homo sapien
ggctatcgcggtctccgacctatgg

SEQ ID NO: 156538 - DNA, 25 bp, Homo sapien
agtcccgagatgaatggccgagccc

SEQ ID NO: 156539 - DNA, 25 bp, Homo sapien
tggccgactacgcttctgcagcaaa

SEQ ID NO: 156540 - DNA, 25 bp, Homo sapien
atctcgcagaagctggaacactgga

SEQ ID NO: 156541 - DNA, 25 bp, Homo sapien
ctggaacgcaagacagggcagcgct

SEQ ID NO: 156542 - DNA, 25 bp, Homo sapien
gacctatggccaggacccgcaagga

SEQ ID NO: 156543 - DNA, 25 bp, Homo sapien
gccggtctacctcgctgcggttatt

SEQ ID NO: 156544 - DNA, 25 bp, Homo sapien
ttgagagccatcttgcctagctggg

SEQ ID NO: 156545 - DNA, 25 bp, Homo sapien
gatagcacactcaacgcccagcatg

SEQ ID NO: 156546 - DNA, 25 bp, Homo sapien
ctgggccaagccgagatagcacact

SEQ ID NO: 156547 - DNA, 25 bp, Homo sapien
cggttattgagtacctgacggccaa

SEQ ID NO: 156548 - DNA, 25 bp, Homo sapien
cgcggtaactgtcctcttgagagcc

SEQ ID NO: 156549 - DNA, 25 bp, Homo sapien
gccctggtcgctaggatacacagta

SEQ ID NO: 156550 - DNA, 25 bp, Homo sapien
cggagctttcgttttcagtgagcca

SEQ ID NO: 156551 - DNA, 25 bp, Homo sapien
ttcctggcccgctaccggctggtat

SEQ ID NO: 156552 - DNA, 25 bp, Homo sapien
accggctggtatcgaacaagctgaa

SEQ ID NO: 156553 - DNA, 25 bp, Homo sapien
agaagcggttcctgcggaagccgaa

SEQ ID NO: 156554 - DNA, 25 bp, Homo sapien
gagtgtctgccctacgcggcctggt

SEQ ID NO: 156555 - DNA, 25 bp, Homo sapien
tgcgtctgcacctcgagctgggcca

SEQ ID NO: 156556 - DNA, 25 bp, Homo sapien
ccttctcggacgtgctggtccgctg

SEQ ID NO: 156557 - DNA, 25 bp, Homo sapien
ggtcttcacgcgcatgcagcgcctg

SEQ ID NO: 156558 - DNA, 25 bp, Homo sapien
cctggcggtcttcacgcgcatgcag

SEQ ID NO: 156559 - DNA, 25 bp, Homo sapien
ggtctggcttctttgtccctttgga

SEQ ID NO: 156560 - DNA, 25 bp, Homo sapien
ccgttctcggaagcggtctggcttc

SEQ ID NO: 156561 - DNA, 25 bp, Homo sapien
ctacgtgtgtcctcgcgagacaagc

SEQ ID NO: 156562 - DNA, 25 bp, Homo sapien
ctaccgcgcagatcctctacgtgtg

SEQ ID NO: 156563 - DNA, 25 bp, Homo sapien
ctgagctctgtgatgtagccgcttg

SEQ ID NO: 156564 - DNA, 25 bp, Homo sapien
acgcgcatctcggtgcatctgttgg

SEQ ID NO: 156565 - DNA, 25 bp, Homo sapien
tcgcgtcaggaactcgcctccaggt

SEQ ID NO: 156566 - DNA, 25 bp, Homo sapien
ggacgttcatctcaaatgcctcgtg

SEQ ID NO: 156567 - DNA, 25 bp, Homo sapien
gtccagggagagttgtacgagattc

SEQ ID NO: 156568 - DNA, 25 bp, Homo sapien
ggggctgtgacttggaaataaaaca

SEQ ID NO: 156569 - DNA, 25 bp, Homo sapien
tgggactgactttcaaaagagcgtc

SEQ ID NO: 156570 - DNA, 25 bp, Homo sapien
cgttcgcggagatgtcgtcttaaag

SEQ ID NO: 156571 - DNA, 25 bp, Homo sapien
agatgtcgtcttaaagggctgtccc

SEQ ID NO: 156572 - DNA, 25 bp, Homo sapien
gctcacagagtacgtccgcctgcgg

SEQ ID NO: 156573 - DNA, 25 bp, Homo sapien
gccgaggtcactcgaaccgaagtta

SEQ ID NO: 156574 - DNA, 25 bp, Homo sapien
cagcacccggttggtcaggaccaag

SEQ ID NO: 156575 - DNA, 25 bp, Homo sapien
tgacccgcggtatcccagatctgga

SEQ ID NO: 156576 - DNA, 25 bp, Homo sapien
ctggctcgatctccaccaagcggga

SEQ ID NO: 156577 - DNA, 25 bp, Homo sapien
aacctgggcaaagcgaccctcggtg

SEQ ID NO: 156578 - DNA, 25 bp, Homo sapien
cgatgacaatgagccggaactggta

SEQ ID NO: 156579 - DNA, 25 bp, Homo sapien
ctgcgctcgcaaaggtgatgaaatg

SEQ ID NO: 156580 - DNA, 25 bp, Homo sapien
tgactcatcactgacaaccgggtta

SEQ ID NO: 156581 - DNA, 25 bp, Homo sapien
ggccgccgcactatctgtaagagga

SEQ ID NO: 156582 - DNA, 25 bp, Homo sapien
agcttgatgcgttttcctggctcga

SEQ ID NO: 156583 - DNA, 25 bp, Homo sapien
ccatgccggtgactgctctcgcgga

SEQ ID NO: 156584 - DNA, 25 bp, Homo sapien
aaatagtcaaatccgtggttcaggg

SEQ ID NO: 156585 - DNA, 25 bp, Homo sapien
gaagggcatgccgtagaaatagtca

SEQ ID NO: 156586 - DNA, 25 bp, Homo sapien
acagagaagaaaccgcaggtctggc

SEQ ID NO: 156587 - DNA, 25 bp, Homo sapien
accaagagatgaaaaacaggcagcc

SEQ ID NO: 156588 - DNA, 25 bp, Homo sapien
tcgcacaaacccgaaggaggagtac

SEQ ID NO: 156589 - DNA, 25 bp, Homo sapien
cccgaaggaggagtaccaagagatg

SEQ ID NO: 156590 - DNA, 25 bp, Homo sapien
tgcctgggtcacagtcgtttgtgag

SEQ ID NO: 156591 - DNA, 25 bp, Homo sapien
acggccctcacagtgccaggctccc

SEQ ID NO: 156592 - DNA, 25 bp, Homo sapien
ggcgcacggcactcacagtgccagg

SEQ ID NO: 156593 - DNA, 25 bp, Homo sapien
cggccctcacagtgccaggctccca

SEQ ID NO: 156594 - DNA, 25 bp, Homo sapien
gcacggccctcacagtgacaggctc

SEQ ID NO: 156595 - DNA, 25 bp, Homo sapien
ggcgcacggccctcacagtgacagg

SEQ ID NO: 156596 - DNA, 25 bp, Homo sapien
cgcacggccctcacagtgacaggct

SEQ ID NO: 156597 - DNA, 25 bp, Homo sapien
cggcgcacggcactcacagtgacag

SEQ ID NO: 156598 - DNA, 25 bp, Homo sapien
acggcgcacggcactcacagtgaca

SEQ ID NO: 156599 - DNA, 25 bp, Homo sapien
cgcagcggaccagcacgtccgagaa

SEQ ID NO: 156600 - DNA, 25 bp, Homo sapien
ataccagccggtagcgggccaggaa

SEQ ID NO: 156601 - DNA, 25 bp, Homo sapien
tcagcttgttcgataccagccggta

SEQ ID NO: 156602 - DNA, 25 bp, Homo sapien
caccaggccgcgtagggcagacact

SEQ ID NO: 156603 - DNA, 25 bp, Homo sapien
ggcccagctcgaggtgcagacgcac

SEQ ID NO: 156604 - DNA, 25 bp, Homo sapien
ctgcatgcgcgtgaagaccgccagg

SEQ ID NO: 156605 - DNA, 25 bp, Homo sapien
ccaggcgctgcatgcgcgtgaagac

SEQ ID NO: 156606 - DNA, 25 bp, Homo sapien
tcggcttccgcaggaaccgcttctt

SEQ ID NO: 156607 - DNA, 25 bp, Homo sapien
ttggccgtcaggtactcaataaccg

SEQ ID NO: 156608 - DNA, 25 bp, Homo sapien
ccagtactgtgtatcctagcgacca

SEQ ID NO: 156609 - DNA, 25 bp, Homo sapien
ctctcaagaggacagttaccgcgtc

SEQ ID NO: 156610 - DNA, 25 bp, Homo sapien
gcccagctaggcaagatggctctca

SEQ ID NO: 156611 - DNA, 25 bp, Homo sapien
gtgctatctcggcttggcccagcta

SEQ ID NO: 156612 - DNA, 25 bp, Homo sapien
tgaaaacgaaagctccgctcggacg

SEQ ID NO: 156613 - DNA, 25 bp, Homo sapien
gccgagaccaatgggcacgcacatc

SEQ ID NO: 156614 - DNA, 25 bp, Homo sapien
gctccacctggctcactgaaaacga

SEQ ID NO: 156615 - DNA, 25 bp, Homo sapien
cccactgcgacaggcctgaaagcga

SEQ ID NO: 156616 - DNA, 25 bp, Homo sapien
agatcgtgacgacaaccctgcggca

SEQ ID NO: 156617 - DNA, 25 bp, Homo sapien
tccgccagggttaaggtgagtacca

SEQ ID NO: 156618 - DNA, 25 bp, Homo sapien
tcgtgactgctaactccgcagagtg

SEQ ID NO: 156619 - DNA, 25 bp, Homo sapien
acccacctgtgctggaggtcgtgac

SEQ ID NO: 156620 - DNA, 25 bp, Homo sapien
gaggcagcctttcacccgccttttg

SEQ ID NO: 156621 - DNA, 25 bp, Homo sapien
tagggcgtcagtctcccattcggaa

SEQ ID NO: 156622 - DNA, 25 bp, Homo sapien
tgtcgcgcaactggcacagatcgtg

SEQ ID NO: 156623 - DNA, 25 bp, Homo sapien
cttcttagaaatcgggagggcgtca

SEQ ID NO: 156624 - DNA, 25 bp, Homo sapien
gaacacggccgtgctggaaggcatc

SEQ ID NO: 156625 - DNA, 25 bp, Homo sapien
cctttgaaggccgaatccgggcagc

SEQ ID NO: 156626 - DNA, 25 bp, Homo sapien
agaacgcgcctccagctacattttg

SEQ ID NO: 156627 - DNA, 25 bp, Homo sapien
cagctacattttggagactacaagg

SEQ ID NO: 156628 - DNA, 25 bp, Homo sapien
tggagactacaaggcgccggacaca

SEQ ID NO: 156629 - DNA, 25 bp, Homo sapien
ccaccctaggccttagtatgggccg

SEQ ID NO: 156630 - DNA, 25 bp, Homo sapien
aggccttagtatgggccgcgtcccg

SEQ ID NO: 156631 - DNA, 25 bp, Homo sapien
gtgccattgggaaggacccacacca

SEQ ID NO: 156632 - DNA, 25 bp, Homo sapien
aaggacccacaccaggctgggtgtc

SEQ ID NO: 156633 - DNA, 25 bp, Homo sapien
tccactctgcagatcggtgccattg

SEQ ID NO: 156634 - DNA, 25 bp, Homo sapien
tcagccttgtggtagaagcgctgca

SEQ ID NO: 156635 - DNA, 25 bp, Homo sapien
agcatgccgtcagccttgtggtaga

SEQ ID NO: 156636 - DNA, 25 bp, Homo sapien
accgctaatgtgtagcatgccgtca

SEQ ID NO: 156637 - DNA, 25 bp, Homo sapien
gtccaccgaggagagaccgctaatg

SEQ ID NO: 156638 - DNA, 25 bp, Homo sapien
catggccgtgatcttctcgctgatc

SEQ ID NO: 156639 - DNA, 25 bp, Homo sapien
gaacccgcgcttccgtcattgaggc

SEQ ID NO: 156640 - DNA, 25 bp, Homo sapien
ggcccgtcagtcagacacctcaatg

SEQ ID NO: 156641 - DNA, 25 bp, Homo sapien
ggacaccttgttgggacacaccgtg

SEQ ID NO: 156642 - DNA, 25 bp, Homo sapien
accgtgaattctctgccgggtcaga

SEQ ID NO: 156643 - DNA, 25 bp, Homo sapien
cccaggacggttatgaaatgagccc

SEQ ID NO: 156644 - DNA, 25 bp, Homo sapien
gccacgacttgcttggccggttgga

SEQ ID NO: 156645 - DNA, 25 bp, Homo sapien
cccgtgcgttgaatgtgcgcgtcac

SEQ ID NO: 156646 - DNA, 25 bp, Homo sapien
tgggacgtccttgctgtctctaagc

SEQ ID NO: 156647 - DNA, 25 bp, Homo sapien
atggccaggctgtccgccccggctg

SEQ ID NO: 156648 - DNA, 25 bp, Homo sapien
ccacgtgcaggcggatggccaggct

SEQ ID NO: 156649 - DNA, 25 bp, Homo sapien
cctgcgcgcggagcctaccaggttg

SEQ ID NO: 156650 - DNA, 25 bp, Homo sapien
tcctgcgcgcggagcctaccaggtt

SEQ ID NO: 156651 - DNA, 25 bp, Homo sapien
gcgttggctgctgcacgctgcacgt

SEQ ID NO: 156652 - DNA, 25 bp, Homo sapien
cgcgttggctgctgcacgctgcacg

SEQ ID NO: 156653 - DNA, 25 bp, Homo sapien
gcgcgttggctgctgcacgctgcac

SEQ ID NO: 156654 - DNA, 25 bp, Homo sapien
cgcgcgttggctgctgcacgctgca

SEQ ID NO: 156655 - DNA, 25 bp, Homo sapien
ttggcagtgcagtgaatgtgaatgc

SEQ ID NO: 156656 - DNA, 25 bp, Homo sapien
cccgaggcgctgcagtccagcttga

SEQ ID NO: 156657 - DNA, 25 bp, Homo sapien
ttgctggccacgcacttatagacgc

SEQ ID NO: 156658 - DNA, 25 bp, Homo sapien
cgcacttatagacgcctctgtctga

SEQ ID NO: 156659 - DNA, 25 bp, Homo sapien
ctctgtctgagaaggacgcctcctt

SEQ ID NO: 156660 - DNA, 25 bp, Homo sapien
acgcctccttgatggaaagggtccg

SEQ ID NO: 156661 - DNA, 25 bp, Homo sapien
tgcagtgaatgtgaatgctgagccc

SEQ ID NO: 156662 - DNA, 25 bp, Homo sapien
ctcttggacggcagcctccagagga

SEQ ID NO: 156663 - DNA, 25 bp, Homo sapien
gacctattcagtgcatcctccttca

SEQ ID NO: 156664 - DNA, 25 bp, Homo sapien
tgggcttcacttaggaattccgttg

SEQ ID NO: 156665 - DNA, 25 bp, Homo sapien
gcaagagcagagtgggcttcactta

SEQ ID NO: 156666 - DNA, 25 bp, Homo sapien
cttggaaagaggctcctcaagcgtc

SEQ ID NO: 156667 - DNA, 25 bp, Homo sapien
gtagccacagcctgagcaacttgga

SEQ ID NO: 156668 - DNA, 25 bp, Homo sapien
tctgcgtgatgactgtcccggtttt

SEQ ID NO: 156669 - DNA, 25 bp, Homo sapien
ctgcgggatgaattacgagctttcc

SEQ ID NO: 156670 - DNA, 25 bp, Homo sapien
ttgggtgtctcaaatcccttcaccc

SEQ ID NO: 156671 - DNA, 25 bp, Homo sapien
tcgtctagagagcaaatacacagta

SEQ ID NO: 156672 - DNA, 25 bp, Homo sapien
tcccttattcagtcgtctagagagc

SEQ ID NO: 156673 - DNA, 25 bp, Homo sapien
atcactggcacggaagcttttcctg

SEQ ID NO: 156674 - DNA, 25 bp, Homo sapien
tttctgaggcaacgaatcactggca

SEQ ID NO: 156675 - DNA, 25 bp, Homo sapien
ctcctgcgcgtcatgcagtttctga

SEQ ID NO: 156676 - DNA, 25 bp, Homo sapien
cgtcccagcggaagtctgactcctg

SEQ ID NO: 156677 - DNA, 25 bp, Homo sapien
cgtttcctattgacgtcccagcgga

SEQ ID NO: 156678 - DNA, 25 bp, Homo sapien
agcgtccgaaacactgctctcaggg

SEQ ID NO: 156679 - DNA, 25 bp, Homo sapien
tgctccataaagcagcgcgtgtccg

SEQ ID NO: 156680 - DNA, 25 bp, Homo sapien
tctgtacattccctgcctctgggca

SEQ ID NO: 156681 - DNA, 25 bp, Homo sapien
aatctgtacattccctgcctctggg

SEQ ID NO: 156682 - DNA, 25 bp, Homo sapien
gcgtgtccggatgcaagagcaccga

SEQ ID NO: 156683 - DNA, 25 bp, Homo sapien
ccctaagtggcacaggcgggccgat

SEQ ID NO: 156684 - DNA, 25 bp, Homo sapien
tacggagtccctaagtggcacaggc

SEQ ID NO: 156685 - DNA, 25 bp, Homo sapien
cttagccatacggagtccctaagtg

SEQ ID NO: 156686 - DNA, 25 bp, Homo sapien
tgtccggatgcaagagcaccgagaa

SEQ ID NO: 156687 - DNA, 25 bp, Homo sapien
gtcaaagtcctgcaggctgtacaca

SEQ ID NO: 156688 - DNA, 25 bp, Homo sapien
tgcaggctgtacacaggcggctccg

SEQ ID NO: 156689 - DNA, 25 bp, Homo sapien
caaagtcctgcaggctgtacacagg

SEQ ID NO: 156690 - DNA, 25 bp, Homo sapien
caccttgcgggagtcgctctccgcc

SEQ ID NO: 156691 - DNA, 25 bp, Homo sapien
gcgtgtcaaagtcctgcaggctgta

SEQ ID NO: 156692 - DNA, 25 bp, Homo sapien
ccagcgtgtcaaagtcctgcaggct

SEQ ID NO: 156693 - DNA, 25 bp, Homo sapien
ggtctcctccgccaccttgcgggag

SEQ ID NO: 156694 - DNA, 25 bp, Homo sapien
cctgcaggctgtacacaggcggctc

SEQ ID NO: 156695 - DNA, 25 bp, Homo sapien
ggagtgcgctccacccgggaagacc

SEQ ID NO: 156696 - DNA, 25 bp, Homo sapien
gactccgagccgaagtagcgggtca

SEQ ID NO: 156697 - DNA, 25 bp, Homo sapien
tgtcctactacaacgtcccggccac

SEQ ID NO: 156698 - DNA, 25 bp, Homo sapien
tctccgagaggagccgtcggcattt

SEQ ID NO: 156699 - DNA, 25 bp, Homo sapien
ccgtcggcatttcaggttaggcacc

SEQ ID NO: 156700 - DNA, 25 bp, Homo sapien
cggcatttcaggttaggcacccggc

SEQ ID NO: 156701 - DNA, 25 bp, Homo sapien
catttcaggttaggcacccggccgg

SEQ ID NO: 156702 - DNA, 25 bp, Homo sapien
agtagcgggtcagggccctccccag

SEQ ID NO: 156703 - DNA, 25 bp, Homo sapien
tgtcgtgtgcctgcagcgactcaca

SEQ ID NO: 156704 - DNA, 25 bp, Homo sapien
cacactcgtgatcgtgttccagctg

SEQ ID NO: 156705 - DNA, 25 bp, Homo sapien
ctgcttcatctgcagagacatgatc

SEQ ID NO: 156706 - DNA, 25 bp, Homo sapien
ctcttcgttctggatgtgagcgata

SEQ ID NO: 156707 - DNA, 25 bp, Homo sapien
agcgatatcatttgtggtgtttctc

SEQ ID NO: 156708 - DNA, 25 bp, Homo sapien
ggcgcctcttgtcctttttgtagta

SEQ ID NO: 156709 - DNA, 25 bp, Homo sapien
cagcgccgcaaaagctaagatgttg

SEQ ID NO: 156710 - DNA, 25 bp, Homo sapien
gcctgtgagtctcatggcgcctctt

SEQ ID NO: 156711 - DNA, 25 bp, Homo sapien
acgcccagcatgatgtcgtagttga

SEQ ID NO: 156712 - DNA, 25 bp, Homo sapien
agtcaaagtcgttgggcgtcacacc

SEQ ID NO: 156713 - DNA, 25 bp, Homo sapien
tcagggtagccgtaaaggttgtcca

SEQ ID NO: 156714 - DNA, 25 bp, Homo sapien
gatagtctcccgcaaagtgtctttc

SEQ ID NO: 156715 - DNA, 25 bp, Homo sapien
cggcccagtctgtgtacatgaactt

SEQ ID NO: 156716 - DNA, 25 bp, Homo sapien
agctgggcttcatttcgctttggca

SEQ ID NO: 156717 - DNA, 25 bp, Homo sapien
cgatcatggggatgccgaagacata

SEQ ID NO: 156718 - DNA, 25 bp, Homo sapien
aggaactcgccttgctccatcagga

SEQ ID NO: 156719 - DNA, 25 bp, Homo sapien
ggtagtctgtcctcgcagcttccaa

SEQ ID NO: 156720 - DNA, 25 bp, Homo sapien
tgtccaggagactgactgaaggatg

SEQ ID NO: 156721 - DNA, 25 bp, Homo sapien
gcgaccggcctcttggaaaaccaga

SEQ ID NO: 156722 - DNA, 25 bp, Homo sapien
tggcggatcttctccatcagttctg

SEQ ID NO: 156723 - DNA, 25 bp, Homo sapien
ttgcgttttccagggctgtagaggt

SEQ ID NO: 156724 - DNA, 25 bp, Homo sapien
gtgcgcctattggaaccgactcctc

SEQ ID NO: 156725 - DNA, 25 bp, Homo sapien
cagaccagggctccggtagtctgtc

SEQ ID NO: 156726 - DNA, 25 bp, Homo sapien
ctcgctccgagaaggggtgttctca

SEQ ID NO: 156727 - DNA, 25 bp, Homo sapien
tgcgtaaccgaaaagagagcgcgga

SEQ ID NO: 156728 - DNA, 25 bp, Homo sapien
ccggcgctgtatgtttacccgcatc

SEQ ID NO: 156729 - DNA, 25 bp, Homo sapien
agctgtagctgcagacccgggatgc

SEQ ID NO: 156730 - DNA, 25 bp, Homo sapien
tatgtttacccgcatcaattcctcc

SEQ ID NO: 156731 - DNA, 25 bp, Homo sapien
cacaagaccgcccttactggaggcg

SEQ ID NO: 156732 - DNA, 25 bp, Homo sapien
gcacgcatgcgtaaccgaaaagaga

SEQ ID NO: 156733 - DNA, 25 bp, Homo sapien
cgctcaaggtcgcacgcatgcgtaa

SEQ ID NO: 156734 - DNA, 25 bp, Homo sapien
tgcacactacccacccagaagaagt

SEQ ID NO: 156735 - DNA, 25 bp, Homo sapien
tgaacgagtccctttaaccagatgg

SEQ ID NO: 156736 - DNA, 25 bp, Homo sapien
ctccagcgcaggcaaggattcctcg

SEQ ID NO: 156737 - DNA, 25 bp, Homo sapien
tccgcgtaggctgagtcccagtcat

SEQ ID NO: 156738 - DNA, 25 bp, Homo sapien
ccagtcatcgatccggggtcaagcc

SEQ ID NO: 156739 - DNA, 25 bp, Homo sapien
gggacacttccgtgttgaacgagtc

SEQ ID NO: 156740 - DNA, 25 bp, Homo sapien
ctcccgcgcaggtatgtgacgtcat

SEQ ID NO: 156741 - DNA, 25 bp, Homo sapien
cgcctgctctatttaaacttctgga

SEQ ID NO: 156742 - DNA, 25 bp, Homo sapien
ttccacttctgcaaatggggacggg

SEQ ID NO: 156743 - DNA, 25 bp, Homo sapien
cgagtgatctgcaggctcaggcacc

SEQ ID NO: 156744 - DNA, 25 bp, Homo sapien
gttccgaattgaggcgcgcacagcc

SEQ ID NO: 156745 - DNA, 25 bp, Homo sapien
ttggcacaagtaccctggctggggc

SEQ ID NO: 156746 - DNA, 25 bp, Homo sapien
tctgagccctcagagagtgaaaacc

SEQ ID NO: 156747 - DNA, 25 bp, Homo sapien
gggcaagatgtctcgggcttctttt

SEQ ID NO: 156748 - DNA, 25 bp, Homo sapien
cgctctacgctagtccagggcaaga

SEQ ID NO: 156749 - DNA, 25 bp, Homo sapien
gccgagaactttgcgagcccaggct

SEQ ID NO: 156750 - DNA, 25 bp, Homo sapien
tgcactgctgaggaccaggcagacg

SEQ ID NO: 156751 - DNA, 25 bp, Homo sapien
cgtgtggcggagttctaattcaatc

SEQ ID NO: 156752 - DNA, 25 bp, Homo sapien
ttccactgcggtgctactgcaatca

SEQ ID NO: 156753 - DNA, 25 bp, Homo sapien
cagtgcgcccagacttgatcaggta

SEQ ID NO: 156754 - DNA, 25 bp, Homo sapien
agccggaagcactcaccgttttcga

SEQ ID NO: 156755 - DNA, 25 bp, Homo sapien
tcaggccgctggcagatttattatg

SEQ ID NO: 156756 - DNA, 25 bp, Homo sapien
cgtcgaatgggttctgcatcacttc

SEQ ID NO: 156757 - DNA, 25 bp, Homo sapien
gcagattttctcctcgccgcgagtc

SEQ ID NO: 156758 - DNA, 25 bp, Homo sapien
gcagcgtgtagcacccatgcagatc

SEQ ID NO: 156759 - DNA, 25 bp, Homo sapien
gctaggctgtgctctgcatgcggcc

SEQ ID NO: 156760 - DNA, 25 bp, Homo sapien
atgcggccctccgtcctcagggagg

SEQ ID NO: 156761 - DNA, 25 bp, Homo sapien
tccgtcctcagggaggcaagacccg

SEQ ID NO: 156762 - DNA, 25 bp, Homo sapien
aagacccggcttctctacacggctg

SEQ ID NO: 156763 - DNA, 25 bp, Homo sapien
tgcagccgccctcagaaggcgcagg

SEQ ID NO: 156764 - DNA, 25 bp, Homo sapien
tgcatgccaaaacggagcccacgtg

SEQ ID NO: 156765 - DNA, 25 bp, Homo sapien
gatctgcagggctaggctgtgctct

SEQ ID NO: 156766 - DNA, 25 bp, Homo sapien
caggagctagcgtgcatgccaaaac

SEQ ID NO: 156767 - DNA, 25 bp, Homo sapien
tccaaccgagacatgctgaagtacg

SEQ ID NO: 156768 - DNA, 25 bp, Homo sapien
aaacggcggctcaaggtgccttctc

SEQ ID NO: 156769 - DNA, 25 bp, Homo sapien
ccggacaggaagctcatctttggca

SEQ ID NO: 156770 - DNA, 25 bp, Homo sapien
cggtgaggctttatctgtgtcgaga

SEQ ID NO: 156771 - DNA, 25 bp, Homo sapien
tggtcgtgtccaccaaaacgccgga

SEQ ID NO: 156772 - DNA, 25 bp, Homo sapien
ccgcctggagcccaaattccatgta

SEQ ID NO: 156773 - DNA, 25 bp, Homo sapien
cagaagcgtctctcacggtggccct

SEQ ID NO: 156774 - DNA, 25 bp, Homo sapien
ccgtggtgcagacaatggtcgtgtc

SEQ ID NO: 156775 - DNA, 25 bp, Homo sapien
cactccacgcgatgaaggaggggac

SEQ ID NO: 156776 - DNA, 25 bp, Homo sapien
gcttcacggtcgtcctgcacatctt

SEQ ID NO: 156777 - DNA, 25 bp, Homo sapien
taaggcattagagacgtcctccttc

SEQ ID NO: 156778 - DNA, 25 bp, Homo sapien
cgtggcttctcagttgctctctcct

SEQ ID NO: 156779 - DNA, 25 bp, Homo sapien
tgctctctccttttgcagaaagaac

SEQ ID NO: 156780 - DNA, 25 bp, Homo sapien
tgcagaaagaactggaagccgcctg

SEQ ID NO: 156781 - DNA, 25 bp, Homo sapien
ggcattagagacgtcctccttcctc

SEQ ID NO: 156782 - DNA, 25 bp, Homo sapien
ggtgtttgaccgcttcacggtcgtc

SEQ ID NO: 156783 - DNA, 25 bp, Homo sapien
tgaaaagggacgtcgcccacctgta

SEQ ID NO: 156784 - DNA, 25 bp, Homo sapien
acagcgtccgcagagaccgagccac

SEQ ID NO: 156785 - DNA, 25 bp, Homo sapien
cgttcccacaccaggtcgaacttga

SEQ ID NO: 156786 - DNA, 25 bp, Homo sapien
acatcatggggtcaggtaactcggg

SEQ ID NO: 156787 - DNA, 25 bp, Homo sapien
ggctcgcgctacatcatggggtcag

SEQ ID NO: 156788 - DNA, 25 bp, Homo sapien
ccacctgtaccgaggagtcggctcg

SEQ ID NO: 156789 - DNA, 25 bp, Homo sapien
cggcgtcccagagggtcctcggaat

SEQ ID NO: 156790 - DNA, 25 bp, Homo sapien
cacaccaggtcgaacttgaaaaggg

SEQ ID NO: 156791 - DNA, 25 bp, Homo sapien
ctgtcgtctcagtggtgccgtacga

SEQ ID NO: 156792 - DNA, 25 bp, Homo sapien
aggcgagatcccgttccgccgagca

SEQ ID NO: 156793 - DNA, 25 bp, Homo sapien
cagagccctttctcatggaacagga

SEQ ID NO: 156794 - DNA, 25 bp, Homo sapien
ggagaatccttcatgcagctgcagc

SEQ ID NO: 156795 - DNA, 25 bp, Homo sapien
aaggccttggacaggcttcgcaaga

SEQ ID NO: 156796 - DNA, 25 bp, Homo sapien
gcttcgcaagaagaggcacctgctc

SEQ ID NO: 156797 - DNA, 25 bp, Homo sapien
gcctccgtagtgatctggcctttac

SEQ ID NO: 156798 - DNA, 25 bp, Homo sapien
tgatctccgtggtggggtacaccaa

SEQ ID NO: 156799 - DNA, 25 bp, Homo sapien
tcctggggctcagacttagtgtccc

SEQ ID NO: 156800 - DNA, 25 bp, Homo sapien
agctgtttgccacgctggacgtcac

SEQ ID NO: 156801 - DNA, 25 bp, Homo sapien
ctcccggcttatgtgcctgaacaca

SEQ ID NO: 156802 - DNA, 25 bp, Homo sapien
cgcatgaccgtcctgtacgtggaca

SEQ ID NO: 156803 - DNA, 25 bp, Homo sapien
gccctcctaggaaagaccacgctga

SEQ ID NO: 156804 - DNA, 25 bp, Homo sapien
gccgtgagcccgtgtagaaatagga

SEQ ID NO: 156805 - DNA, 25 bp, Homo sapien
acataagcgtgttcccgggtgcacc

SEQ ID NO: 156806 - DNA, 25 bp, Homo sapien
ctcggggccggaacaacaactgcct

SEQ ID NO: 156807 - DNA, 25 bp, Homo sapien
gcatctgttacgaccgcgccgaaga

SEQ ID NO: 156808 - DNA, 25 bp, Homo sapien
cgcttttcattaaggcggccactga

SEQ ID NO: 156809 - DNA, 25 bp, Homo sapien
cgcgatcatcaacgttgcggctatc

SEQ ID NO: 156810 - DNA, 25 bp, Homo sapien
gggctatttgcctcgacatcagtta

SEQ ID NO: 156811 - DNA, 25 bp, Homo sapien
cggtcgtgaagcaggcagcaaaata

SEQ ID NO: 156812 - DNA, 25 bp, Homo sapien
gatgccgccatcgaccatgttaata

SEQ ID NO: 156813 - DNA, 25 bp, Homo sapien
ggactatgagcttaacccttgttga

SEQ ID NO: 156814 - DNA, 25 bp, Homo sapien
ttcgtcaaacaacaggagccgcttt

SEQ ID NO: 156815 - DNA, 25 bp, Homo sapien
cgttccttaaatgggctggcggcaa

SEQ ID NO: 156816 - DNA, 25 bp, Homo sapien
gctgccggaactggatcgtttgatc

SEQ ID NO: 156817 - DNA, 25 bp, Homo sapien
ggctcggtgttccttaactcagaca

SEQ ID NO: 156818 - DNA, 25 bp, Homo sapien
agcgctgacctgattaacctgtatc

SEQ ID NO: 156819 - DNA, 25 bp, Homo sapien
tcgagcgtgcagcagcattccttta

SEQ ID NO: 156820 - DNA, 25 bp, Homo sapien
acggcctgattcgttacaacctgga

SEQ ID NO: 156821 - DNA, 25 bp, Homo sapien
tggtttcactaactacgcggctggt

SEQ ID NO: 156822 - DNA, 25 bp, Homo sapien
tcagggcctctatatcgacgaaatg

SEQ ID NO: 156823 - DNA, 25 bp, Homo sapien
cgacccgctgatcaaggttcgcatc

SEQ ID NO: 156824 - DNA, 25 bp, Homo sapien
ctttgtggcctaaatcgcttcgagc

SEQ ID NO: 156825 - DNA, 25 bp, Homo sapien
gcggccttttttattcctagcaaca

SEQ ID NO: 156826 - DNA, 25 bp, Homo sapien
ccgggagcatcctaaacggcatgtt

SEQ ID NO: 156827 - DNA, 25 bp, Homo sapien
gctggtgggtatcatcattgccgta

SEQ ID NO: 156828 - DNA, 25 bp, Homo sapien
gccgtaatgacgtatctgacaaatc

SEQ ID NO: 156829 - DNA, 25 bp, Homo sapien
tgggcacactggtaccgacattcgc

SEQ ID NO: 156830 - DNA, 25 bp, Homo sapien
ggagccgagatgaacccaacgttga

SEQ ID NO: 156831 - DNA, 25 bp, Homo sapien
ttttcacacataaccagccgctcgg

SEQ ID NO: 156832 - DNA, 25 bp, Homo sapien
cactccaagcaggtagcgcatcttc

SEQ ID NO: 156833 - DNA, 25 bp, Homo sapien
caatgggcatcctggctgtaaccgc

SEQ ID NO: 156834 - DNA, 25 bp, Homo sapien
tgccgctgacgatttgttaaacacc

SEQ ID NO: 156835 - DNA, 25 bp, Homo sapien
tcctggcgaactgacggcttccact

SEQ ID NO: 156836 - DNA, 25 bp, Homo sapien
ccacttctggcaagctgaccgtctg

SEQ ID NO: 156837 - DNA, 25 bp, Homo sapien
gcacactgcgtatggtcctggcgaa

SEQ ID NO: 156838 - DNA, 25 bp, Homo sapien
acgccgctcatgctggatgccactt

SEQ ID NO: 156839 - DNA, 25 bp, Homo sapien
gcttccgcccgcctcttcaacgcgc

SEQ ID NO: 156840 - DNA, 25 bp, Homo sapien
gcccgcctcttcaacgcgcacgctg

SEQ ID NO: 156841 - DNA, 25 bp, Homo sapien
gcggggcacgcccaggtctctggct

SEQ ID NO: 156842 - DNA, 25 bp, Homo sapien
tgagaggtcgtcctgggtgccaccc

SEQ ID NO: 156843 - DNA, 25 bp, Homo sapien
cctctgcgcctaagagggtcggggc

SEQ ID NO: 156844 - DNA, 25 bp, Homo sapien
tgcgcctctgcgcctaagagggtcg

SEQ ID NO: 156845 - DNA, 25 bp, Homo sapien
gcctggctctacaagcccgggccgc

SEQ ID NO: 156846 - DNA, 25 bp, Homo sapien
tcaacgcgcacgctgctaccgagct

SEQ ID NO: 156847 - DNA, 25 bp, Homo sapien
gccgtggtcactcacacaagggagc

SEQ ID NO: 156848 - DNA, 25 bp, Homo sapien
gagcgactaacttggcggccacgtc

SEQ ID NO: 156849 - DNA, 25 bp, Homo sapien
ccggttagcaaggagcgactaactt

SEQ ID NO: 156850 - DNA, 25 bp, Homo sapien
ctcaccggttagcaaggagcgacta

SEQ ID NO: 156851 - DNA, 25 bp, Homo sapien
gccgcggtcactcaccggttagcaa

SEQ ID NO: 156852 - DNA, 25 bp, Homo sapien
cggtcactcacacaagggagcagca

SEQ ID NO: 156853 - DNA, 25 bp, Homo sapien
ccgcggtcactcacacaagggagca

SEQ ID NO: 156854 - DNA, 25 bp, Homo sapien
tggtcactcacacaagggagcagca

SEQ ID NO: 156855 - DNA, 25 bp, Homo sapien
ccatgcgcgccatgcggcttgtgga

SEQ ID NO: 156856 - DNA, 25 bp, Homo sapien
ggggtgcgctctacttctccgagcg

SEQ ID NO: 156857 - DNA, 25 bp, Homo sapien
gtcgaagtcttgaaggcggttggca

SEQ ID NO: 156858 - DNA, 25 bp, Homo sapien
aagacgccaatgcgccttccggtgc

SEQ ID NO: 156859 - DNA, 25 bp, Homo sapien
agccgggcttccgcggatgcagcct

SEQ ID NO: 156860 - DNA, 25 bp, Homo sapien
ttgtcctacgacagcgtcccggccg

SEQ ID NO: 156861 - DNA, 25 bp, Homo sapien
ccgacaggagccgtcggcgttccag

SEQ ID NO: 156862 - DNA, 25 bp, Homo sapien
cccacaaagccacggaacacctgta

SEQ ID NO: 156863 - DNA, 25 bp, Homo sapien
ttcctgagggcaccgtaaaagacca

SEQ ID NO: 156864 - DNA, 25 bp, Homo sapien
ccacttcacactttgaggccggata

SEQ ID NO: 156865 - DNA, 25 bp, Homo sapien
ggccggataattacccagacctaca

SEQ ID NO: 156866 - DNA, 25 bp, Homo sapien
agacctacagaagatgcagcgctta

SEQ ID NO: 156867 - DNA, 25 bp, Homo sapien
cgcttacggttattgtgctccctga

SEQ ID NO: 156868 - DNA, 25 bp, Homo sapien
acgctgttacctccttcatcaagtg

SEQ ID NO: 156869 - DNA, 25 bp, Homo sapien
gcagccagctgtattcgcccaacga

SEQ ID NO: 156870 - DNA, 25 bp, Homo sapien
tgtgctccctgacgcgacaatgcgc

SEQ ID NO: 156871 - DNA, 25 bp, Homo sapien
gctgactggggcataaacactaatc

SEQ ID NO: 156872 - DNA, 25 bp, Homo sapien
cccgctgaacgttgcctgcgaaatc

SEQ ID NO: 156873 - DNA, 25 bp, Homo sapien
agtggtccaccagaacgatttagta

SEQ ID NO: 156874 - DNA, 25 bp, Homo sapien
tcgctcggtgattgtctgctgaaca

SEQ ID NO: 156875 - DNA, 25 bp, Homo sapien
acgtcaaaaccctgtggccggtatg

SEQ ID NO: 156876 - DNA, 25 bp, Homo sapien
ggaccgcgaatgactgacctgcaga

SEQ ID NO: 156877 - DNA, 25 bp, Homo sapien
cagcagctggttgataacggacaca

SEQ ID NO: 156878 - DNA, 25 bp, Homo sapien
ccgtcactgtgtcctcctcgaataa

SEQ ID NO: 156879 - DNA, 25 bp, Homo sapien
accgcgttctcgatcaggtctttga

SEQ ID NO: 156880 - DNA, 25 bp, Homo sapien
cctgcgtgaaatcggccagagtttc

SEQ ID NO: 156881 - DNA, 25 bp, Homo sapien
aaccgcctggctggtatcggcaatc

SEQ ID NO: 156882 - DNA, 25 bp, Homo sapien
cagcccgtcagcgttttcctgtata

SEQ ID NO: 156883 - DNA, 25 bp, Homo sapien
cgcggcactgttttcgccagattta

SEQ ID NO: 156884 - DNA, 25 bp, Homo sapien
catggggccatgctgataatctgca

SEQ ID NO: 156885 - DNA, 25 bp, Homo sapien
acgtgcccatgatccagtcggtcca

SEQ ID NO: 156886 - DNA, 25 bp, Homo sapien
cgtcggcatggtttttgatttcgtc

SEQ ID NO: 156887 - DNA, 25 bp, Homo sapien
tgtgtgcccttacggaactcccatt

SEQ ID NO: 156888 - DNA, 25 bp, Homo sapien
cagcggcgtatcgttgaggaaaata

SEQ ID NO: 156889 - DNA, 25 bp, Homo sapien
tgctcaaccggagtatgcgcgcttc

SEQ ID NO: 156890 - DNA, 25 bp, Homo sapien
ccagcctgagctgggttattagtta

SEQ ID NO: 156891 - DNA, 25 bp, Homo sapien
cgagtggcgtttgactggttacata

SEQ ID NO: 156892 - DNA, 25 bp, Homo sapien
gctctttctggtagcgccacatgtc

SEQ ID NO: 156893 - DNA, 25 bp, Homo sapien
ctcgagtacataccggcgctgacta

SEQ ID NO: 156894 - DNA, 25 bp, Homo sapien
tctgggtaacgaactgatctgctga

SEQ ID NO: 156895 - DNA, 25 bp, Homo sapien
taaaccatgggtgcggcggaagaaa

SEQ ID NO: 156896 - DNA, 25 bp, Homo sapien
cgcgctatcgatggtacgtagttca

SEQ ID NO: 156897 - DNA, 25 bp, Homo sapien
tacgtagttcatcaggcgccatgtc

SEQ ID NO: 156898 - DNA, 25 bp, Homo sapien
atcaggcgccatgtcccgctggagg

SEQ ID NO: 156899 - DNA, 25 bp, Homo sapien
gcggaagaaattttgaagttgccca

SEQ ID NO: 156900 - DNA, 25 bp, Homo sapien
gccgcgccgccggtgtaaaccatgg

SEQ ID NO: 156901 - DNA, 25 bp, Homo sapien
gactattggccgcggcccgccgtta

SEQ ID NO: 156902 - DNA, 25 bp, Homo sapien
ttaagcagcggactccaggcgcacc

SEQ ID NO: 156903 - DNA, 25 bp, Homo sapien
aagtcccgccaccatgattcaggta

SEQ ID NO: 156904 - DNA, 25 bp, Homo sapien
atgattcaggtacttcccctggctc

SEQ ID NO: 156905 - DNA, 25 bp, Homo sapien
cgccaccatgattcaggtacttccc

SEQ ID NO: 156906 - DNA, 25 bp, Homo sapien
gtcccgccaccatgattcaggtact

SEQ ID NO: 156907 - DNA, 25 bp, Homo sapien
aaagtcccgccaccatgattcaggt

SEQ ID NO: 156908 - DNA, 25 bp, Homo sapien
gaaagtcccgccaccatgattcagg

SEQ ID NO: 156909 - DNA, 25 bp, Homo sapien
ggaaagtcccgccaccatgattcag

SEQ ID NO: 156910 - DNA, 25 bp, Homo sapien
tcccgccaccatgattcaggtactt

SEQ ID NO: 156911 - DNA, 25 bp, Homo sapien
acctcaaagacctccgcctgggaga

SEQ ID NO: 156912 - DNA, 25 bp, Homo sapien
cgccgctttcccaggtgaggcacgt

SEQ ID NO: 156913 - DNA, 25 bp, Homo sapien
agaaaataaggtgggtccgctgtgc

SEQ ID NO: 156914 - DNA, 25 bp, Homo sapien
gtgacatctgagtgttaaacacatc

SEQ ID NO: 156915 - DNA, 25 bp, Homo sapien
tggaacctcaaagacctccgcctgg

SEQ ID NO: 156916 - DNA, 25 bp, Homo sapien
atgtgataacttttgggtcaggggc

SEQ ID NO: 156917 - DNA, 25 bp, Homo sapien
tggaacctcaaagaatgtgataact

SEQ ID NO: 156918 - DNA, 25 bp, Homo sapien
ggcaatgagaaaataaggtgggtcc

SEQ ID NO: 156919 - DNA, 25 bp, Homo sapien
atcaccctctgtaatggcagcgtca

SEQ ID NO: 156920 - DNA, 25 bp, Homo sapien
gtaatggcagcgtcagccaagagtg

SEQ ID NO: 156921 - DNA, 25 bp, Homo sapien
tctgtaatggcagcgtcagccaaga

SEQ ID NO: 156922 - DNA, 25 bp, Homo sapien
aatggcagcgtcagccaagagtgca

SEQ ID NO: 156923 - DNA, 25 bp, Homo sapien
accctctgtaatggcagcgtcagcc

SEQ ID NO: 156924 - DNA, 25 bp, Homo sapien
aacatcaccctctgtaatggcagcg

SEQ ID NO: 156925 - DNA, 25 bp, Homo sapien
ttctcaacatcaccctctgtaatgg

SEQ ID NO: 156926 - DNA, 25 bp, Homo sapien
cctctgtaatggcagcgtcagccaa

SEQ ID NO: 156927 - DNA, 25 bp, Homo sapien
aggatggcctccacaagccgcatgg

SEQ ID NO: 156928 - DNA, 25 bp, Homo sapien
cctccgaggctgcatccgcggaagc

SEQ ID NO: 156929 - DNA, 25 bp, Homo sapien
tccacaagccgcatggcgcgcatgg

SEQ ID NO: 156930 - DNA, 25 bp, Homo sapien
gcaccggaaggcgcattggcgtctt

SEQ ID NO: 156931 - DNA, 25 bp, Homo sapien
ctggaacgccgacggctcctgtcgg

SEQ ID NO: 156932 - DNA, 25 bp, Homo sapien
tcggagaagtagagcgcacccccca

SEQ ID NO: 156933 - DNA, 25 bp, Homo sapien
cggccgggacgctgtcgtaggacaa

SEQ ID NO: 156934 - DNA, 25 bp, Homo sapien
ctgccaaccgccttcaagacttcga

SEQ ID NO: 156935 - DNA, 25 bp, Homo sapien
ccactgacgtgtgctcccaggagac

SEQ ID NO: 156936 - DNA, 25 bp, Homo sapien
ccgggcacagccacaaagtgactca

SEQ ID NO: 156937 - DNA, 25 bp, Homo sapien
tgactcacgcgaaggctgaggcctg

SEQ ID NO: 156938 - DNA, 25 bp, Homo sapien
ttctgtactcaggacactgccggca

SEQ ID NO: 156939 - DNA, 25 bp, Homo sapien
cacacgacgtatggctggctgcaag

SEQ ID NO: 156940 - DNA, 25 bp, Homo sapien
cccagtgttagagagggaccagaac

SEQ ID NO: 156941 - DNA, 25 bp, Homo sapien
aagggcaaggacacgccactctgca

SEQ ID NO: 156942 - DNA, 25 bp, Homo sapien
ctcccgttaaaagcagagcgcggtg

SEQ ID NO: 156943 - DNA, 25 bp, Homo sapien
ttcaaatctttatttagggacgctg

SEQ ID NO: 156944 - DNA, 25 bp, Homo sapien
tgctgctaggccacaagggctgcac

SEQ ID NO: 156945 - DNA, 25 bp, Homo sapien
cccgagaaaacgtgctgaggagaga

SEQ ID NO: 156946 - DNA, 25 bp, Homo sapien
aatggctgaaaggatttctgaaccc

SEQ ID NO: 156947 - DNA, 25 bp, Homo sapien
ccttcaaattttgggacgtcaaatg

SEQ ID NO: 156948 - DNA, 25 bp, Homo sapien
gtgcccccttggttaaggcaagagc

SEQ ID NO: 156949 - DNA, 25 bp, Homo sapien
aatctttatttagggacgctgagaa

SEQ ID NO: 156950 - DNA, 25 bp, Homo sapien
acggggagctgctgctaggccacaa

SEQ ID NO: 156951 - DNA, 25 bp, Homo sapien
cgccatgaactctttctacaacagt

SEQ ID NO: 156952 - DNA, 25 bp, Homo sapien
tgcaggccactcaggatatccaaag

SEQ ID NO: 156953 - DNA, 25 bp, Homo sapien
aaaatgcgcctttcgggtactgtga

SEQ ID NO: 156954 - DNA, 25 bp, Homo sapien
tatccaaagcgatccacatctccgg

SEQ ID NO: 156955 - DNA, 25 bp, Homo sapien
ctcggcccagaggttgtcgaggaca

SEQ ID NO: 156956 - DNA, 25 bp, Homo sapien
gcgaactgcaggatctcttggtctc

SEQ ID NO: 156957 - DNA, 25 bp, Homo sapien
tttatacgctccaggggcactgtgc

SEQ ID NO: 156958 - DNA, 25 bp, Homo sapien
ctgataacaccaaggtcgcgggctc

SEQ ID NO: 156959 - DNA, 25 bp, Homo sapien
cctattgtgcgcttctcagggaggc

SEQ ID NO: 156960 - DNA, 25 bp, Homo sapien
atttggtatcgagacgctgccagcc

SEQ ID NO: 156961 - DNA, 25 bp, Homo sapien
tggctgcctccatcgcaaagtgggt

SEQ ID NO: 156962 - DNA, 25 bp, Homo sapien
agagccctgtgccttgcgctcagag

SEQ ID NO: 156963 - DNA, 25 bp, Homo sapien
ggatctttcgtaagggcgcctgcga

SEQ ID NO: 156964 - DNA, 25 bp, Homo sapien
cccggtagcgattggacaggatctt

SEQ ID NO: 156965 - DNA, 25 bp, Homo sapien
tcttgcttctcctcgggcatctctg

SEQ ID NO: 156966 - DNA, 25 bp, Homo sapien
attgacagcctctgcgatggccctg

SEQ ID NO: 156967 - DNA, 25 bp, Homo sapien
ggctgagtagacagaatacggtatt

SEQ ID NO: 156968 - DNA, 25 bp, Homo sapien
ttgtataactggagccttaataccc

SEQ ID NO: 156969 - DNA, 25 bp, Homo sapien
attccatccagcttgctgcaattgc

SEQ ID NO: 156970 - DNA, 25 bp, Homo sapien
gaacttattcgtcttgtataactgg

SEQ ID NO: 156971 - DNA, 25 bp, Homo sapien
tagacagcagatcagaacttattcg

SEQ ID NO: 156972 - DNA, 25 bp, Homo sapien
cgcagtggttgtagacagcagatca

SEQ ID NO: 156973 - DNA, 25 bp, Homo sapien
gtattattaactacaggcgcagtgg

SEQ ID NO: 156974 - DNA, 25 bp, Homo sapien
ctccaggtgacgctgtcataggaca

SEQ ID NO: 156975 - DNA, 25 bp, Homo sapien
gcctcgatccctccttctgagaaaa

SEQ ID NO: 156976 - DNA, 25 bp, Homo sapien
cgcgtgcgatcacaaaccgatgtcc

SEQ ID NO: 156977 - DNA, 25 bp, Homo sapien
actgctcgctttcccacctaaaaga

SEQ ID NO: 156978 - DNA, 25 bp, Homo sapien
ctcggcgacataactggacgtgcta

SEQ ID NO: 156979 - DNA, 25 bp, Homo sapien
ctcacagaggtagccaagcacaaca

SEQ ID NO: 156980 - DNA, 25 bp, Homo sapien
ggcgaacctcgagaatccttaaata

SEQ ID NO: 156981 - DNA, 25 bp, Homo sapien
gcgtgccgcaatccaacgttctttc

SEQ ID NO: 156982 - DNA, 25 bp, Homo sapien
catgaagccactcctagtcgcgggg

SEQ ID NO: 156983 - DNA, 25 bp, Homo sapien
atgagcagcgccaccaccatggtca

SEQ ID NO: 156984 - DNA, 25 bp, Homo sapien
cgctgacgctttccaagcacgcatg

SEQ ID NO: 156985 - DNA, 25 bp, Homo sapien
cgttttcattggtccgctaaagata

SEQ ID NO: 156986 - DNA, 25 bp, Homo sapien
cacgcccgctaaaagaaggttgatt

SEQ ID NO: 156987 - DNA, 25 bp, Homo sapien
tcacattacgtcacagcgcgctggc

SEQ ID NO: 156988 - DNA, 25 bp, Homo sapien
acgcatgcgcagttgtgaaatattg

SEQ ID NO: 156989 - DNA, 25 bp, Homo sapien
agtgaaactttgctccggctaggtc

SEQ ID NO: 156990 - DNA, 25 bp, Homo sapien
tgttcgctcctctcccttctataag

SEQ ID NO: 156991 - DNA, 25 bp, Homo sapien
cggctcgcacgctcgtttcagtcta

SEQ ID NO: 156992 - DNA, 25 bp, Homo sapien
ctggataacatggagtcgggcaaga

SEQ ID NO: 156993 - DNA, 25 bp, Homo sapien
caagatggcgcctcccaagaacgct

SEQ ID NO: 156994 - DNA, 25 bp, Homo sapien
gaacgctccgagagatgccttggta

SEQ ID NO: 156995 - DNA, 25 bp, Homo sapien
taagccgcggatcgcgaagccaggt

SEQ ID NO: 156996 - DNA, 25 bp, Homo sapien
cgtttcagtctagtcagggccgtca

SEQ ID NO: 156997 - DNA, 25 bp, Homo sapien
atctcgccgcttgggccaagtcttg

SEQ ID NO: 156998 - DNA, 25 bp, Homo sapien
ctggccagcggcttgctgaaactcc

SEQ ID NO: 156999 - DNA, 25 bp, Homo sapien
gaccctgggtctcgcacattcttca

SEQ ID NO: 157000 - DNA, 25 bp, Homo sapien
tgtgctctgtcgcaaacctctttgg

SEQ ID NO: 157001 - DNA, 25 bp, Homo sapien
tatgaggtaattctgcacgtttgcc

SEQ ID NO: 157002 - DNA, 25 bp, Homo sapien
gtcggctccctcgttgaccgaatca

SEQ ID NO: 157003 - DNA, 25 bp, Homo sapien
cgcggtgttccgcattctgcaagcc

SEQ ID NO: 157004 - DNA, 25 bp, Homo sapien
tcactagtaccctcgcagacggaca

SEQ ID NO: 157005 - DNA, 25 bp, Homo sapien
cggaagccgcacgtctcactagtac

SEQ ID NO: 157006 - DNA, 25 bp, Homo sapien
ttcttcacgtccgttcgcagcgtca

SEQ ID NO: 157007 - DNA, 25 bp, Homo sapien
aaagacccactcgaggctgcgtgtc

SEQ ID NO: 157008 - DNA, 25 bp, Homo sapien
gggatagtggactcgtaccctaaca

SEQ ID NO: 157009 - DNA, 25 bp, Homo sapien
ggagcctgcgtacgtggatttatcg

SEQ ID NO: 157010 - DNA, 25 bp, Homo sapien
gctggctctagaccacgcgttcctt

SEQ ID NO: 157011 - DNA, 25 bp, Homo sapien
cgcgttccttttcacgtgaccagtc

SEQ ID NO: 157012 - DNA, 25 bp, Homo sapien
gtgaccagtcgctctctttcccgtg

SEQ ID NO: 157013 - DNA, 25 bp, Homo sapien
gcagctactgtgacttctccgattg

SEQ ID NO: 157014 - DNA, 25 bp, Homo sapien
tggatttatcgctgccacggtctgc

SEQ ID NO: 157015 - DNA, 25 bp, Homo sapien
cgcgcgtaacttttgcctcagtatc

SEQ ID NO: 157016 - DNA, 25 bp, Homo sapien
gtcaagagacattgcggctccctca

SEQ ID NO: 157017 - DNA, 25 bp, Homo sapien
tcctaggagtagaagacggtccatc

SEQ ID NO: 157018 - DNA, 25 bp, Homo sapien
acggtccatcttagttgtcacgagg

SEQ ID NO: 157019 - DNA, 25 bp, Homo sapien
accctttcgggtacagttgcacaca

SEQ ID NO: 157020 - DNA, 25 bp, Homo sapien
tgcggggtcttcctgttctgaacgc

SEQ ID NO: 157021 - DNA, 25 bp, Homo sapien
gggccgctccatcgggattcacatc

SEQ ID NO: 157022 - DNA, 25 bp, Homo sapien
tcacttcttggaatccggcggcgtt

SEQ ID NO: 157023 - DNA, 25 bp, Homo sapien
cctgtgggattgagacctcgaagtc

SEQ ID NO: 157024 - DNA, 25 bp, Homo sapien
tgagcctcggcccaacaaaatggcg

SEQ ID NO: 157025 - DNA, 25 bp, Homo sapien
tgcttagccgaaagaggcatcgttt

SEQ ID NO: 157026 - DNA, 25 bp, Homo sapien
cagtgcatttctatcgtaaccgggc

SEQ ID NO: 157027 - DNA, 25 bp, Homo sapien
gtcgggctcctctgtttattctttg

SEQ ID NO: 157028 - DNA, 25 bp, Homo sapien
ggtatcccggtcatttttgctaatc

SEQ ID NO: 157029 - DNA, 25 bp, Homo sapien
atctttgggcctagaaactgcgtgg

SEQ ID NO: 157030 - DNA, 25 bp, Homo sapien
tatggggcgcttcttgcaatctccc

SEQ ID NO: 157031 - DNA, 25 bp, Homo sapien
tgaaggtcgcgaactgctgccaaaa

SEQ ID NO: 157032 - DNA, 25 bp, Homo sapien
ggcacgcccggacacagttacaaac

SEQ ID NO: 157033 - DNA, 25 bp, Homo sapien
gcgttctcttcgtcggtcacgttga

SEQ ID NO: 157034 - DNA, 25 bp, Homo sapien
tgccatggaacagtgcgacctctgc

SEQ ID NO: 157035 - DNA, 25 bp, Homo sapien
aagcgccgtcccagcttcttggaac

SEQ ID NO: 157036 - DNA, 25 bp, Homo sapien
tccggctcgaagatgtagtactcca

SEQ ID NO: 157037 - DNA, 25 bp, Homo sapien
gcagcgcagttcaaaaggtgccata

SEQ ID NO: 157038 - DNA, 25 bp, Homo sapien
ggaggacctgcaaaccaagaccgtg

SEQ ID NO: 157039 - DNA, 25 bp, Homo sapien
gcccgcgaccttggtgttatcagca

SEQ ID NO: 157040 - DNA, 25 bp, Homo sapien
aggctgtcctcgacaacctctgggc

SEQ ID NO: 157041 - DNA, 25 bp, Homo sapien
cctctgggccgagtccaagagatcc

SEQ ID NO: 157042 - DNA, 25 bp, Homo sapien
ccggagatgtggatcgctttggata

SEQ ID NO: 157043 - DNA, 25 bp, Homo sapien
ctttggatatcctgagtggcctgca

SEQ ID NO: 157044 - DNA, 25 bp, Homo sapien
caagagatcctgcagttcgctccta

SEQ ID NO: 157045 - DNA, 25 bp, Homo sapien
tcacagtacccgaaaggcgcatttt

SEQ ID NO: 157046 - DNA, 25 bp, Homo sapien
aagagatcccgcaagtcgctcctgc

SEQ ID NO: 157047 - DNA, 25 bp, Homo sapien
ttctgacctgtcctacggggatctc

SEQ ID NO: 157048 - DNA, 25 bp, Homo sapien
cggtgacgtgttctgacctgtccta

SEQ ID NO: 157049 - DNA, 25 bp, Homo sapien
catcaggatgcagtgacggtgacgt

SEQ ID NO: 157050 - DNA, 25 bp, Homo sapien
acgtgagattttcgtggcatcagga

SEQ ID NO: 157051 - DNA, 25 bp, Homo sapien
gtcgcttccgttatttcttcttctc

SEQ ID NO: 157052 - DNA, 25 bp, Homo sapien
acggggatctcctctatgaggttca

SEQ ID NO: 157053 - DNA, 25 bp, Homo sapien
tctatgaggttcagtaccggagccc

SEQ ID NO: 157054 - DNA, 25 bp, Homo sapien
ttcttctcagtgaaacccagttccc

SEQ ID NO: 157055 - DNA, 25 bp, Homo sapien
aggatttcacgcctgggcggctccg

SEQ ID NO: 157056 - DNA, 25 bp, Homo sapien
tccggccaaacggagatcccgggca

SEQ ID NO: 157057 - DNA, 25 bp, Homo sapien
aagcctctccaggatttcacgcctg

SEQ ID NO: 157058 - DNA, 25 bp, Homo sapien
agaaagccacgaaggcctctcccgg

SEQ ID NO: 157059 - DNA, 25 bp, Homo sapien
tccgcgtggagtgacaaagaaagcc

SEQ ID NO: 157060 - DNA, 25 bp, Homo sapien
ctcggattccgcgtggagtgacaaa

SEQ ID NO: 157061 - DNA, 25 bp, Homo sapien
tgggccacgtgtgacactcggattc

SEQ ID NO: 157062 - DNA, 25 bp, Homo sapien
acgaacttcacaggtgggccacgtg

SEQ ID NO: 157063 - DNA, 25 bp, Homo sapien
acgtgcctcacctgggaaagcggcg

SEQ ID NO: 157064 - DNA, 25 bp, Homo sapien
cggggactccaacctgggtcgctgg

SEQ ID NO: 157065 - DNA, 25 bp, Homo sapien
ccggagaagcctggccgccgcatcc

SEQ ID NO: 157066 - DNA, 25 bp, Homo sapien
agcggggactccaacctgggtcgct

SEQ ID NO: 157067 - DNA, 25 bp, Homo sapien
cggctgaagcggggactccaacctg

SEQ ID NO: 157068 - DNA, 25 bp, Homo sapien
gcggctgaagcggggactccaacct

SEQ ID NO: 157069 - DNA, 25 bp, Homo sapien
ggagaagcctggccgccgcatccgc

SEQ ID NO: 157070 - DNA, 25 bp, Homo sapien
acacctcggaaggcgacgctgcccg

SEQ ID NO: 157071 - DNA, 25 bp, Homo sapien
acccacttgcaccaggcggagaaca

SEQ ID NO: 157072 - DNA, 25 bp, Homo sapien
cagggactcaaagccaagagaaaga

SEQ ID NO: 157073 - DNA, 25 bp, Homo sapien
agaggcggacactcagacacgcata

SEQ ID NO: 157074 - DNA, 25 bp, Homo sapien
agccaagagaaagacgtgcagacca

SEQ ID NO: 157075 - DNA, 25 bp, Homo sapien
cgcatacaaaaagccacagggactc

SEQ ID NO: 157076 - DNA, 25 bp, Homo sapien
gaacagctcgaacctagacaccgtg

SEQ ID NO: 157077 - DNA, 25 bp, Homo sapien
tacgagaaggcgacacccacttgca

SEQ ID NO: 157078 - DNA, 25 bp, Homo sapien
gtgcagaccaacaaacccgcggaga

SEQ ID NO: 157079 - DNA, 25 bp, Homo sapien
accacgtgacaagggatgaccaatg

SEQ ID NO: 157080 - DNA, 25 bp, Homo sapien
actagcacgtgacgccggatgacca

SEQ ID NO: 157081 - DNA, 25 bp, Homo sapien
tgaccaatgaggagcacggcctgtg

SEQ ID NO: 157082 - DNA, 25 bp, Homo sapien
aggatcacgccctatgctgcggaga

SEQ ID NO: 157083 - DNA, 25 bp, Homo sapien
gacttggactccacccagcgcggaa

SEQ ID NO: 157084 - DNA, 25 bp, Homo sapien
tccggactctcgcaatcagacttgg

SEQ ID NO: 157085 - DNA, 25 bp, Homo sapien
tctccaggttccaggacagacgtgg

SEQ ID NO: 157086 - DNA, 25 bp, Homo sapien
gcgtgccaatcaccagcacctgatg

SEQ ID NO: 157087 - DNA, 25 bp, Homo sapien
tgggtctcctcagcgtcgccgtact

SEQ ID NO: 157088 - DNA, 25 bp, Homo sapien
ccggctgctactgcgttgccgctag

SEQ ID NO: 157089 - DNA, 25 bp, Homo sapien
cagcggcagcttccgccaactactg

SEQ ID NO: 157090 - DNA, 25 bp, Homo sapien
tcgctcttgaggtcatcgtatacca

SEQ ID NO: 157091 - DNA, 25 bp, Homo sapien
agggtaatcgaagtcatcgtcgtcc

SEQ ID NO: 157092 - DNA, 25 bp, Homo sapien
cagctcctccgggtaagggtaatcg

SEQ ID NO: 157093 - DNA, 25 bp, Homo sapien
tgctactgcgttgccgctagctgag

SEQ ID NO: 157094 - DNA, 25 bp, Homo sapien
gaggtcatcgtataccactttgtta

SEQ ID NO: 157095 - DNA, 25 bp, Homo sapien
aagtctgctaaactcgccgtcacga

SEQ ID NO: 157096 - DNA, 25 bp, Homo sapien
tgccggaacgtattacctgggagcc

SEQ ID NO: 157097 - DNA, 25 bp, Homo sapien
gaaacctgtccctgagcaacgcata

SEQ ID NO: 157098 - DNA, 25 bp, Homo sapien
ggggcctgtcactaagaaacctgtc

SEQ ID NO: 157099 - DNA, 25 bp, Homo sapien
cggggaattcgccaacgtgtctgaa

SEQ ID NO: 157100 - DNA, 25 bp, Homo sapien
caacatgctgtctcccggcaacgta

SEQ ID NO: 157101 - DNA, 25 bp, Homo sapien
cagagcgtcgtttgtcttcccaagc

SEQ ID NO: 157102 - DNA, 25 bp, Homo sapien
agccgcacgctgctaggcaacatgc

SEQ ID NO: 157103 - DNA, 25 bp, Homo sapien
agatcaattccacctcagcaccggc

SEQ ID NO: 157104 - DNA, 25 bp, Homo sapien
caccggcaggcgactttcctcccac

SEQ ID NO: 157105 - DNA, 25 bp, Homo sapien
ctcagcaccggcaggcgactttcct

SEQ ID NO: 157106 - DNA, 25 bp, Homo sapien
aattccacctcagcaccggcaggcg

SEQ ID NO: 157107 - DNA, 25 bp, Homo sapien
gggctctggcctctacagcagatca

SEQ ID NO: 157108 - DNA, 25 bp, Homo sapien
gctctggcctctacagcagatcaat

SEQ ID NO: 157109 - DNA, 25 bp, Homo sapien
tctggcctctacagcagatcaattc

SEQ ID NO: 157110 - DNA, 25 bp, Homo sapien
tgtgtgccggggctctggcctctac

SEQ ID NO: 157111 - DNA, 25 bp, Homo sapien
atgcgccgcgaacccgtcttaagca

SEQ ID NO: 157112 - DNA, 25 bp, Homo sapien
tccttcgaatttgggctgtgcgcaa

SEQ ID NO: 157113 - DNA, 25 bp, Homo sapien
cagggaaacgcgtccttcgaatttg

SEQ ID NO: 157114 - DNA, 25 bp, Homo sapien
gttcaatggctggtaatggcataca

SEQ ID NO: 157115 - DNA, 25 bp, Homo sapien
tttctggggtgagcctgctggaaac

SEQ ID NO: 157116 - DNA, 25 bp, Homo sapien
atctgcggagctggtgcccgccgtc

SEQ ID NO: 157117 - DNA, 25 bp, Homo sapien
atgaatgcgcatctgcggagctggt

SEQ ID NO: 157118 - DNA, 25 bp, Homo sapien
gcctgcagttggatgaatgcgcatc

SEQ ID NO: 157119 - DNA, 25 bp, Homo sapien
gctgcacgctcccttacccctcgga

SEQ ID NO: 157120 - DNA, 25 bp, Homo sapien
ctcgttcgcgctggggtcaccgcga

SEQ ID NO: 157121 - DNA, 25 bp, Homo sapien
accgcgagccggtccgcagcggggt

SEQ ID NO: 157122 - DNA, 25 bp, Homo sapien
tccgcagcggggtcaccgcgatccc

SEQ ID NO: 157123 - DNA, 25 bp, Homo sapien
ggcccgatcggggacgtgaacgcgc

SEQ ID NO: 157124 - DNA, 25 bp, Homo sapien
cgtgaacgcgcagaactacatttcc

SEQ ID NO: 157125 - DNA, 25 bp, Homo sapien
agccggcagccagctcgttcgcgct

SEQ ID NO: 157126 - DNA, 25 bp, Homo sapien
acgtgaacgcgcagaactacatttc

SEQ ID NO: 157127 - DNA, 25 bp, Homo sapien
ccgctggacccgcagatcccgcact

SEQ ID NO: 157128 - DNA, 25 bp, Homo sapien
gcactggccaaagggctccggtccc

SEQ ID NO: 157129 - DNA, 25 bp, Homo sapien
ccgcactggccaaagggctccggtc

SEQ ID NO: 157130 - DNA, 25 bp, Homo sapien
agatcccgcactggccaaagggctc

SEQ ID NO: 157131 - DNA, 25 bp, Homo sapien
ctacgtggacccaggtttcctgagg

SEQ ID NO: 157132 - DNA, 25 bp, Homo sapien
agacccgctccctgcaagacccacg

SEQ ID NO: 157133 - DNA, 25 bp, Homo sapien
tcccgcactggccaaagggctccgg

SEQ ID NO: 157134 - DNA, 25 bp, Homo sapien
tacgtggacccaggtttcctgagga

SEQ ID NO: 157135 - DNA, 25 bp, Homo sapien
agttcagagcggaagaggtttttca

SEQ ID NO: 157136 - DNA, 25 bp, Homo sapien
gcgtcgatgtgactctttggggaac

SEQ ID NO: 157137 - DNA, 25 bp, Homo sapien
cgagcagcagacgtttggggcatct

SEQ ID NO: 157138 - DNA, 25 bp, Homo sapien
gacgtttggggcatctttttgaaga

SEQ ID NO: 157139 - DNA, 25 bp, Homo sapien
gagcggaagaggtttttcagtgaat

SEQ ID NO: 157140 - DNA, 25 bp, Homo sapien
tgaagagcagaagcgagttcagagc

SEQ ID NO: 157141 - DNA, 25 bp, Homo sapien
cagctcggcgtcgatgtgactcttt

SEQ ID NO: 157142 - DNA, 25 bp, Homo sapien
tggggcatctttttgaagagcagaa

SEQ ID NO: 157143 - DNA, 25 bp, Homo sapien
ggcttagactcagtggaccggaatc

SEQ ID NO: 157144 - DNA, 25 bp, Homo sapien
agctaagcggctcggattatcctgg

SEQ ID NO: 157145 - DNA, 25 bp, Homo sapien
ggcctgtaacgagggagccttctcc

SEQ ID NO: 157146 - DNA, 25 bp, Homo sapien
cagctaaacacttccgtcggtccgg

SEQ ID NO: 157147 - DNA, 25 bp, Homo sapien
aaatccatccgtgcgactcctggta

SEQ ID NO: 157148 - DNA, 25 bp, Homo sapien
cccagaccgggaggttgtctagtca

SEQ ID NO: 157149 - DNA, 25 bp, Homo sapien
ctctcccgagtcagggccacggaaa

SEQ ID NO: 157150 - DNA, 25 bp, Homo sapien
gatgtagtttttccggcgccttcgc

SEQ ID NO: 157151 - DNA, 25 bp, Homo sapien
ttggcccttagcgcgcagtccctta

SEQ ID NO: 157152 - DNA, 25 bp, Homo sapien
ccatctgcgacagggttcctatggc

SEQ ID NO: 157153 - DNA, 25 bp, Homo sapien
gtgcccatctgcgacagggttccta

SEQ ID NO: 157154 - DNA, 25 bp, Homo sapien
atgcggccctgagggcccgctgacc

SEQ ID NO: 157155 - DNA, 25 bp, Homo sapien
gggtctcctggaaacccggcgcatg

SEQ ID NO: 157156 - DNA, 25 bp, Homo sapien
ctggactctgagctacccggcacaa

SEQ ID NO: 157157 - DNA, 25 bp, Homo sapien
ccattgattggccatgagggaagga

SEQ ID NO: 157158 - DNA, 25 bp, Homo sapien
ggaaacccggcgcatgcggccctga

SEQ ID NO: 157159 - DNA, 25 bp, Homo sapien
gcagagtgaagacggtgcaccctga

SEQ ID NO: 157160 - DNA, 25 bp, Homo sapien
gtgcaccctgaagacggtgtccttc

SEQ ID NO: 157161 - DNA, 25 bp, Homo sapien
gaagacggtgtccttctccggactc

SEQ ID NO: 157162 - DNA, 25 bp, Homo sapien
tgcagcccgacccatagcacaggaa

SEQ ID NO: 157163 - DNA, 25 bp, Homo sapien
gaaccctgcgctgccctttctgtag

SEQ ID NO: 157164 - DNA, 25 bp, Homo sapien
tgccctttctgtagcctgtgggtgg

SEQ ID NO: 157165 - DNA, 25 bp, Homo sapien
gccacctaacggactgcactcaaag

SEQ ID NO: 157166 - DNA, 25 bp, Homo sapien
actcaaagggcacctggagccgcgc

SEQ ID NO: 157167 - DNA, 25 bp, Homo sapien
gcacgcaggatatcgacggccaacc

SEQ ID NO: 157168 - DNA, 25 bp, Homo sapien
tctccggtgtgcctagggcatagga

SEQ ID NO: 157169 - DNA, 25 bp, Homo sapien
tagggcataggacgagaggcacttt

SEQ ID NO: 157170 - DNA, 25 bp, Homo sapien
ctcgacctgcgagagcgcttgccgg

SEQ ID NO: 157171 - DNA, 25 bp, Homo sapien
tctggcctctagaggcgacgacttc

SEQ ID NO: 157172 - DNA, 25 bp, Homo sapien
agaggcgacgacttccacccaagca

SEQ ID NO: 157173 - DNA, 25 bp, Homo sapien
cgggagcctctaggtctgcaaggca

SEQ ID NO: 157174 - DNA, 25 bp, Homo sapien
acgagaggcactttggaatgctccc

SEQ ID NO: 157175 - DNA, 25 bp, Homo sapien
ggctagaaccctggcatgtactctc

SEQ ID NO: 157176 - DNA, 25 bp, Homo sapien
ggaattcgtctgcactgtaggctag

SEQ ID NO: 157177 - DNA, 25 bp, Homo sapien
tatgtgggaggaaagtcacctgctt

SEQ ID NO: 157178 - DNA, 25 bp, Homo sapien
gaggaaagtcacctgcttgtgcaga

SEQ ID NO: 157179 - DNA, 25 bp, Homo sapien
ctgcactgtaggctagaaccctggc

SEQ ID NO: 157180 - DNA, 25 bp, Homo sapien
tggtacataaggaatattgcagatc

SEQ ID NO: 157181 - DNA, 25 bp, Homo sapien
ccaggtagatggtacataaggaata

SEQ ID NO: 157182 - DNA, 25 bp, Homo sapien
cctgcttgtgcagaggtggaattcg

SEQ ID NO: 157183 - DNA, 25 bp, Homo sapien
cggctgtgctgcagtcgcggatctt

SEQ ID NO: 157184 - DNA, 25 bp, Homo sapien
cgcccgggttgtagccaggctcctg

SEQ ID NO: 157185 - DNA, 25 bp, Homo sapien
aagcctgaagacacctgcgacctca

SEQ ID NO: 157186 - DNA, 25 bp, Homo sapien
tgggagtccaggaagcctgaagaca

SEQ ID NO: 157187 - DNA, 25 bp, Homo sapien
gaatagaatttcctgggagtccagg

SEQ ID NO: 157188 - DNA, 25 bp, Homo sapien
cggcgctagatgaatgaatagaatt

SEQ ID NO: 157189 - DNA, 25 bp, Homo sapien
tgcagcggcgctagatgaatgaata

SEQ ID NO: 157190 - DNA, 25 bp, Homo sapien
ttggacgattgcagcggcgctagat

SEQ ID NO: 157191 - DNA, 25 bp, Homo sapien
agatggagggttccacaggcctccg

SEQ ID NO: 157192 - DNA, 25 bp, Homo sapien
tgccgagggccatctggcgtcctag

SEQ ID NO: 157193 - DNA, 25 bp, Homo sapien
gcctggcattccgtccggcgcatga

SEQ ID NO: 157194 - DNA, 25 bp, Homo sapien
catctggcgtcctaggcgggctgcc

SEQ ID NO: 157195 - DNA, 25 bp, Homo sapien
gagggacctccctcgtgtctgtggt

SEQ ID NO: 157196 - DNA, 25 bp, Homo sapien
tgggatcccatggtcgcgttttcct

SEQ ID NO: 157197 - DNA, 25 bp, Homo sapien
ccatggtcgcgttttcctggtggcc

SEQ ID NO: 157198 - DNA, 25 bp, Homo sapien
tccctggtgtttcctgtctgtgacc

SEQ ID NO: 157199 - DNA, 25 bp, Homo sapien
cacctgctcccattggggccggcca

SEQ ID NO: 157200 - DNA, 25 bp, Homo sapien
catcacgacgagttgtgggtctctg

SEQ ID NO: 157201 - DNA, 25 bp, Homo sapien
cggccaggttcgcatcgctgccact

SEQ ID NO: 157202 - DNA, 25 bp, Homo sapien
cacacgtgcggggatgaaactgtgt

SEQ ID NO: 157203 - DNA, 25 bp, Homo sapien
tgggtctctgtgtcctctccgccgg

SEQ ID NO: 157204 - DNA, 25 bp, Homo sapien
tggttcttggcatcacgacgagttg

SEQ ID NO: 157205 - DNA, 25 bp, Homo sapien
cgctactgcgtccttccttcttggc

SEQ ID NO: 157206 - DNA, 25 bp, Homo sapien
cgcatctgccacaccgctccacctg

SEQ ID NO: 157207 - DNA, 25 bp, Homo sapien
gcggcgtcttttgtgagttcagtga

SEQ ID NO: 157208 - DNA, 25 bp, Homo sapien
tcgcgcatgcgcacatgcactcttg

SEQ ID NO: 157209 - DNA, 25 bp, Homo sapien
tttgtccttcgctgccacgtgagag

SEQ ID NO: 157210 - DNA, 25 bp, Homo sapien
caggtggcccgttcttcctctttgt

SEQ ID NO: 157211 - DNA, 25 bp, Homo sapien
ctcttggtaatgcttgcaggtggcc

SEQ ID NO: 157212 - DNA, 25 bp, Homo sapien
tgagcccgtttggagtcactccgtc

SEQ ID NO: 157213 - DNA, 25 bp, Homo sapien
gtctccaagcgacaggcacttccgg

SEQ ID NO: 157214 - DNA, 25 bp, Homo sapien
agttcagtgagtttattgcgggccc

SEQ ID NO: 157215 - DNA, 25 bp, Homo sapien
ctgagccgcgctgaaaagccgagct

SEQ ID NO: 157216 - DNA, 25 bp, Homo sapien
ttgacttgagcaccacggcacggtg

SEQ ID NO: 157217 - DNA, 25 bp, Homo sapien
gggaagcctagcagcgcctgaataa

SEQ ID NO: 157218 - DNA, 25 bp, Homo sapien
gcacccgggcctaggcgtaatgaag

SEQ ID NO: 157219 - DNA, 25 bp, Homo sapien
gaaacgctgtctgacccggagaagc

SEQ ID NO: 157220 - DNA, 25 bp, Homo sapien
aagagctgccagaggaaacgctgtc

SEQ ID NO: 157221 - DNA, 25 bp, Homo sapien
cctgcctgcacaagggctaggaaga

SEQ ID NO: 157222 - DNA, 25 bp, Homo sapien
tctttccggcaggaagactggcagg

SEQ ID NO: 157223 - DNA, 25 bp, Homo sapien
tgggaccaacccagcaccaaggtcg

SEQ ID NO: 157224 - DNA, 25 bp, Homo sapien
tcgacgcaacccaacgtactctgga

SEQ ID NO: 157225 - DNA, 25 bp, Homo sapien
agcgcggccactctaggttgtccgc

SEQ ID NO: 157226 - DNA, 25 bp, Homo sapien
gaagaaagcagactgcctcaccacc

SEQ ID NO: 157227 - DNA, 25 bp, Homo sapien
ttccctgcagggttcgcagaccgta

SEQ ID NO: 157228 - DNA, 25 bp, Homo sapien
tttctctgcggcagagacttgaccc

SEQ ID NO: 157229 - DNA, 25 bp, Homo sapien
gctgaggagtcctctggaacgcctg

SEQ ID NO: 157230 - DNA, 25 bp, Homo sapien
gccttccaggaaagcgcgtagttca

SEQ ID NO: 157231 - DNA, 25 bp, Homo sapien
tacctgtgaataagcgcatctcttc

SEQ ID NO: 157232 - DNA, 25 bp, Homo sapien
aagcgcatctcttcgttgttctacc

SEQ ID NO: 157233 - DNA, 25 bp, Homo sapien
tcttcgttgttctacctcaggtatc

SEQ ID NO: 157234 - DNA, 25 bp, Homo sapien
ctcaggtatccgagaatcaggcacc

SEQ ID NO: 157235 - DNA, 25 bp, Homo sapien
ctctgtggtgctgatcctgctttgg

SEQ ID NO: 157236 - DNA, 25 bp, Homo sapien
tcctgctttggggtcatccgcgagt

SEQ ID NO: 157237 - DNA, 25 bp, Homo sapien
tgccctcatccttgtgcctgctacg

SEQ ID NO: 157238 - DNA, 25 bp, Homo sapien
cgtcggtgctacctgtgaataagcg

SEQ ID NO: 157239 - DNA, 25 bp, Homo sapien
ccagcaacgcaacccgggcggacag

SEQ ID NO: 157240 - DNA, 25 bp, Homo sapien
gccagcaacgcaacccgggcggaca

SEQ ID NO: 157241 - DNA, 25 bp, Homo sapien
tggccagcaacgcaacccgggcgga

SEQ ID NO: 157242 - DNA, 25 bp, Homo sapien
ggcggacagcgtgtccatccgccta

SEQ ID NO: 157243 - DNA, 25 bp, Homo sapien
cggacagcgtgtccatccgcctaca

SEQ ID NO: 157244 - DNA, 25 bp, Homo sapien
gacagcgtgtccatccgcctacacg

SEQ ID NO: 157245 - DNA, 25 bp, Homo sapien
gtgtccatccgcctacacgtggcgg

SEQ ID NO: 157246 - DNA, 25 bp, Homo sapien
cgcgctgcgcgccaacgcgcgcatc

SEQ ID NO: 157247 - DNA, 25 bp, Homo sapien
ctcaagctggactgcagcgcctcgg

SEQ ID NO: 157248 - DNA, 25 bp, Homo sapien
tcctctggaggctgccgtccaagag

SEQ ID NO: 157249 - DNA, 25 bp, Homo sapien
ccggggctcagcattcacattcact

SEQ ID NO: 157250 - DNA, 25 bp, Homo sapien
gggctcagcattcacattcactgca

SEQ ID NO: 157251 - DNA, 25 bp, Homo sapien
agcattcacattcactgcactgcca

SEQ ID NO: 157252 - DNA, 25 bp, Homo sapien
gccaacgcgcgcatcacgggcacct

SEQ ID NO: 157253 - DNA, 25 bp, Homo sapien
gcatcctctggaggctgccgtccaa

SEQ ID NO: 157254 - DNA, 25 bp, Homo sapien
ctcgcgcccaaggacagcgggcgct

SEQ ID NO: 157255 - DNA, 25 bp, Homo sapien
agcgcttctaccacaaggctgacgg

SEQ ID NO: 157256 - DNA, 25 bp, Homo sapien
ggctgacggcatgctacacattagc

SEQ ID NO: 157257 - DNA, 25 bp, Homo sapien
tgggtccttcccaatggcaccgatc

SEQ ID NO: 157258 - DNA, 25 bp, Homo sapien
tcagcgagaagatcacggccatggc

SEQ ID NO: 157259 - DNA, 25 bp, Homo sapien
ttccacgacccgatcagcgagaaga

SEQ ID NO: 157260 - DNA, 25 bp, Homo sapien
tccagctggtatgcatggcacgcaa

SEQ ID NO: 157261 - DNA, 25 bp, Homo sapien
tgtcctggagcccatggagaaaccc

SEQ ID NO: 157262 - DNA, 25 bp, Homo sapien
cattagcggtctctcctcggtggac

SEQ ID NO: 157263 - DNA, 25 bp, Homo sapien
cgtctgtcctccatactgaggcagc

SEQ ID NO: 157264 - DNA, 25 bp, Homo sapien
gcaattcctcctcggcgctctaggt

SEQ ID NO: 157265 - DNA, 25 bp, Homo sapien
cgcctttgcttttgggcaacctctc

SEQ ID NO: 157266 - DNA, 25 bp, Homo sapien
tggagtactggtacatcctcttccc

SEQ ID NO: 157267 - DNA, 25 bp, Homo sapien
cgcacttgcttggagtactggtaca

SEQ ID NO: 157268 - DNA, 25 bp, Homo sapien
tcgcccagcgcacttgcttggagta

SEQ ID NO: 157269 - DNA, 25 bp, Homo sapien
tgattcttaatacccatgcgcccag

SEQ ID NO: 157270 - DNA, 25 bp, Homo sapien
tgcttttgggcaacctctctctgac

SEQ ID NO: 157271 - DNA, 25 bp, Homo sapien
ctgcacaatttgtcacgagcgcgtg

SEQ ID NO: 157272 - DNA, 25 bp, Homo sapien
gtactctactggacaagggcgcttt

SEQ ID NO: 157273 - DNA, 25 bp, Homo sapien
ccctgagatgtttagcacgagcgcc

SEQ ID NO: 157274 - DNA, 25 bp, Homo sapien
gcctcgtggactgtttggcacaaga

SEQ ID NO: 157275 - DNA, 25 bp, Homo sapien
ccgagcttccgtgcactgttaggca

SEQ ID NO: 157276 - DNA, 25 bp, Homo sapien
cgcgcaaccatgtgacctccgtgag

SEQ ID NO: 157277 - DNA, 25 bp, Homo sapien
tgcggtctctgagccacctaagcca

SEQ ID NO: 157278 - DNA, 25 bp, Homo sapien
gcacgcaagccatgtacagtccctg

SEQ ID NO: 157279 - DNA, 25 bp, Homo sapien
cacgttgtgcgtgctgtcgtatagc

SEQ ID NO: 157280 - DNA, 25 bp, Homo sapien
gtccagtgtaagagttccgctattc

SEQ ID NO: 157281 - DNA, 25 bp, Homo sapien
tacagtggactacccgatttttcgc

SEQ ID NO: 157282 - DNA, 25 bp, Homo sapien
cctttacttggcctgacggtttgtg

SEQ ID NO: 157283 - DNA, 25 bp, Homo sapien
tgagaccatgacaagaccacgtacg

SEQ ID NO: 157284 - DNA, 25 bp, Homo sapien
tctggtatagtactgggcctcacgc

SEQ ID NO: 157285 - DNA, 25 bp, Homo sapien
atgtgcgaccacgaacccgtttgtg

SEQ ID NO: 157286 - DNA, 25 bp, Homo sapien
ccgcgtaggctaaccagtgcgctta

SEQ ID NO: 157287 - DNA, 25 bp, Homo sapien
aagccatatgctctctcgcgcgggg

SEQ ID NO: 157288 - DNA, 25 bp, Homo sapien
cgccagtggtccaagcgcgatctct

SEQ ID NO: 157289 - DNA, 25 bp, Homo sapien
acggaaacgcatccttctgtggcca

SEQ ID NO: 157290 - DNA, 25 bp, Homo sapien
gaattgtagttgtcgcaggccctcg

SEQ ID NO: 157291 - DNA, 25 bp, Homo sapien
acgttcttcgtttctccgctagttg

SEQ ID NO: 157292 - DNA, 25 bp, Homo sapien
tttcgatgatgtgcgcttggcctca

SEQ ID NO: 157293 - DNA, 25 bp, Homo sapien
cgctcttttgcgcacggtcgctaga

SEQ ID NO: 157294 - DNA, 25 bp, Homo sapien
gccgcgagacactctggcagttata

SEQ ID NO: 157295 - DNA, 25 bp, Homo sapien
cgacagcgacagattggtgagtgcc

SEQ ID NO: 157296 - DNA, 25 bp, Homo sapien
gtgcgtacctgtccatgccaccaag

SEQ ID NO: 157297 - DNA, 25 bp, Homo sapien
cttcccggagagtatcgccagccaa

SEQ ID NO: 157298 - DNA, 25 bp, Homo sapien
tgtcaggctaacagactcctcttca

SEQ ID NO: 157299 - DNA, 25 bp, Homo sapien
catcaacgtgggcaagctgcgtcca

SEQ ID NO: 157300 - DNA, 25 bp, Homo sapien
cctcagcggctgcaaggaaaaaagc

SEQ ID NO: 157301 - DNA, 25 bp, Homo sapien
atcgctgcttgagactgtgacgcca

SEQ ID NO: 157302 - DNA, 25 bp, Homo sapien
atcgagtagttgaaaagacgccttc

SEQ ID NO: 157303 - DNA, 25 bp, Homo sapien
tacgtgagaagactagaaagcgggc

SEQ ID NO: 157304 - DNA, 25 bp, Homo sapien
ggcggttgtcgcaagctccagctgc

SEQ ID NO: 157305 - DNA, 25 bp, Homo sapien
attttcacagcccttcttgcagagg

SEQ ID NO: 157306 - DNA, 25 bp, Homo sapien
tgtgctagggatgccgaaatgccga

SEQ ID NO: 157307 - DNA, 25 bp, Homo sapien
caggactagcttccgggccgcgctt

SEQ ID NO: 157308 - DNA, 25 bp, Homo sapien
gcagcctccgcctacgtgagaagac
